United States Patent 7,901,882 (ANALYSIS OF METHYLATION USING NUCLEIC ACID ARRAYS) - sequence listing, part 15

SEQ ID NO: 546731 - DNA, 25 bp, Rattus norvegicus
tcccaggcgccggttcgttgccgca

SEQ ID NO: 546732 - DNA, 25 bp, Rattus norvegicus
gcggtgcatctgaatggtgaaaagc

SEQ ID NO: 546733 - DNA, 25 bp, Rattus norvegicus
cgactgagtggtagtaggccccgct

SEQ ID NO: 546734 - DNA, 25 bp, Rattus norvegicus
aagactgggcgactgagtggtagta

SEQ ID NO: 546735 - DNA, 25 bp, Rattus norvegicus
gagcctttgtctgccgcgcgcggcc

SEQ ID NO: 546736 - DNA, 25 bp, Rattus norvegicus
cggggacctgtcggagcctttgtct

SEQ ID NO: 546737 - DNA, 25 bp, Rattus norvegicus
tctgaatggtgaaaagcatgactga

SEQ ID NO: 546738 - DNA, 25 bp, Rattus norvegicus
accgagtacccagacactcagatgc

SEQ ID NO: 546739 - DNA, 25 bp, Rattus norvegicus
ccctttgcagcgttctcggtagtct

SEQ ID NO: 546740 - DNA, 25 bp, Rattus norvegicus
ctcggtagtctgactgagtggcgtt

SEQ ID NO: 546741 - DNA, 25 bp, Rattus norvegicus
agtggcgttgtactcggacatgacc

SEQ ID NO: 546742 - DNA, 25 bp, Rattus norvegicus
ggacatgacctccacaaactttcgg

SEQ ID NO: 546743 - DNA, 25 bp, Rattus norvegicus
aaactttcgggacagcgtggaatgc

SEQ ID NO: 546744 - DNA, 25 bp, Rattus norvegicus
taggtattgggctccaccgagtacc

SEQ ID NO: 546745 - DNA, 25 bp, Rattus norvegicus
attcggctgcacctgcgtcttccgg

SEQ ID NO: 546746 - DNA, 25 bp, Rattus norvegicus
gtccgccgacgagcggttcagacct

SEQ ID NO: 546747 - DNA, 25 bp, Rattus norvegicus
gttcagaccttcctcctgctcgatg

SEQ ID NO: 546748 - DNA, 25 bp, Rattus norvegicus
tgctcgatgctctgctcgatgcctg

SEQ ID NO: 546749 - DNA, 25 bp, Rattus norvegicus
ggccgctgaggaagcaataccctgc

SEQ ID NO: 546750 - DNA, 25 bp, Rattus norvegicus
ggaagcaataccctgcctccataca

SEQ ID NO: 546751 - DNA, 25 bp, Rattus norvegicus
tgcgtcttccggatcctcaggtccg

SEQ ID NO: 546752 - DNA, 25 bp, Rattus norvegicus
actcaccgtgcggagctcctgggtt

SEQ ID NO: 546753 - DNA, 25 bp, Rattus norvegicus
tgctgaagagctcgagtccgtgacc

SEQ ID NO: 546754 - DNA, 25 bp, Rattus norvegicus
atgcccggataggtcccgcccaggg

SEQ ID NO: 546755 - DNA, 25 bp, Rattus norvegicus
caggcggagaacaggtcacgatttt

SEQ ID NO: 546756 - DNA, 25 bp, Rattus norvegicus
caggtcacgattttgcatcccgcca

SEQ ID NO: 546757 - DNA, 25 bp, Rattus norvegicus
acgattttgcatcccgccaccgaaa

SEQ ID NO: 546758 - DNA, 25 bp, Rattus norvegicus
tcgagtccgtgaccagaagtagatc

SEQ ID NO: 546759 - DNA, 25 bp, Rattus norvegicus
cgcccgggtggcatgccggaaccaa

SEQ ID NO: 546760 - DNA, 25 bp, Rattus norvegicus
catgccggaaccaagtggagaatta

SEQ ID NO: 546761 - DNA, 25 bp, Rattus norvegicus
atcggactcaccgtgcggagctcct

SEQ ID NO: 546762 - DNA, 25 bp, Rattus norvegicus
ttcggtccttcatgctcgcgggagt

SEQ ID NO: 546763 - DNA, 25 bp, Rattus norvegicus
ggcgccggctgcaaccgagtaagcc

SEQ ID NO: 546764 - DNA, 25 bp, Rattus norvegicus
catcatccgtccatgcccggatagg

SEQ ID NO: 546765 - DNA, 25 bp, Rattus norvegicus
ccaagtggagaattacaaggcgcgg

SEQ ID NO: 546766 - DNA, 25 bp, Rattus norvegicus
aagattataggacagcggcagcggc

SEQ ID NO: 546767 - DNA, 25 bp, Rattus norvegicus
ccgtcggagagccactttaggtcac

SEQ ID NO: 546768 - DNA, 25 bp, Rattus norvegicus
ggtcctctgaaccaacgccttggcg

SEQ ID NO: 546769 - DNA, 25 bp, Rattus norvegicus
ttgaagttgcttttgctgccgaaga

SEQ ID NO: 546770 - DNA, 25 bp, Rattus norvegicus
ctgccgaagagtccatgcaaaagga

SEQ ID NO: 546771 - DNA, 25 bp, Rattus norvegicus
gagtgtcgcgtctccatctagaaga

SEQ ID NO: 546772 - DNA, 25 bp, Rattus norvegicus
tgacctcggatcagcgtttccttgg

SEQ ID NO: 546773 - DNA, 25 bp, Rattus norvegicus
tttccttggccactactgcggctgc

SEQ ID NO: 546774 - DNA, 25 bp, Rattus norvegicus
actgcggctgctactgaacgtgaca

SEQ ID NO: 546775 - DNA, 25 bp, Rattus norvegicus
tgaacgtgacaggaaccgccgaact

SEQ ID NO: 546776 - DNA, 25 bp, Rattus norvegicus
tgtctattccaacaagggctctgtc

SEQ ID NO: 546777 - DNA, 25 bp, Rattus norvegicus
ctttaggtcacgtggcctagcgtac

SEQ ID NO: 546778 - DNA, 25 bp, Rattus norvegicus
gggtgtccttgactgacctcggatc

SEQ ID NO: 546779 - DNA, 25 bp, Rattus norvegicus
gctctcaaaacgtgcttcctgcgca

SEQ ID NO: 546780 - DNA, 25 bp, Rattus norvegicus
atctctcgcttctgggcctcaggta

SEQ ID NO: 546781 - DNA, 25 bp, Rattus norvegicus
gctgccagtaggatagacaccacga

SEQ ID NO: 546782 - DNA, 25 bp, Rattus norvegicus
gtccttacggtcataggcggtgccg

SEQ ID NO: 546783 - DNA, 25 bp, Rattus norvegicus
gcctcaggtaccagcgggttataaa

SEQ ID NO: 546784 - DNA, 25 bp, Rattus norvegicus
gagcacagccgccaacaggaaaagc

SEQ ID NO: 546785 - DNA, 25 bp, Rattus norvegicus
actcccgccacgatggtgatcttgg

SEQ ID NO: 546786 - DNA, 25 bp, Rattus norvegicus
ggccgtctcatcttgtacgcagttg

SEQ ID NO: 546787 - DNA, 25 bp, Rattus norvegicus
tgatctgcgccgtgatgatgctgct

SEQ ID NO: 546788 - DNA, 25 bp, Rattus norvegicus
tgctgctgccgatgaatgccgaaac

SEQ ID NO: 546789 - DNA, 25 bp, Rattus norvegicus
tggacatggctgctggacttgaacc

SEQ ID NO: 546790 - DNA, 25 bp, Rattus norvegicus
ggccgctggacctgagaaccaactc

SEQ ID NO: 546791 - DNA, 25 bp, Rattus norvegicus
cttcaaaagttgacggaggtctgtc

SEQ ID NO: 546792 - DNA, 25 bp, Rattus norvegicus
cggcctctcagacgtagtccttacg

SEQ ID NO: 546793 - DNA, 25 bp, Rattus norvegicus
acaggccttcccaggtgatctgcgc

SEQ ID NO: 546794 - DNA, 25 bp, Rattus norvegicus
gtgcagctgcgacctaggtttcctc

SEQ ID NO: 546795 - DNA, 25 bp, Rattus norvegicus
aaagagctgcaggtcgttatgtccc

SEQ ID NO: 546796 - DNA, 25 bp, Rattus norvegicus
tggccatccagacgctgcgaggacc

SEQ ID NO: 546797 - DNA, 25 bp, Rattus norvegicus
ccgcagagcgcagctgttgcacaca

SEQ ID NO: 546798 - DNA, 25 bp, Rattus norvegicus
tgcgcagaaggcaatgtctgtccta

SEQ ID NO: 546799 - DNA, 25 bp, Rattus norvegicus
ggggacatgttctcaattccttagt

SEQ ID NO: 546800 - DNA, 25 bp, Rattus norvegicus
ccttagtcctctcggtgcaggtgca

SEQ ID NO: 546801 - DNA, 25 bp, Rattus norvegicus
tgcgcgctcagctctgcttttcaga

SEQ ID NO: 546802 - DNA, 25 bp, Rattus norvegicus
tttcagatcccgtgcctcgcttcag

SEQ ID NO: 546803 - DNA, 25 bp, Rattus norvegicus
agtggtcgcagatctcccagggaag

SEQ ID NO: 546804 - DNA, 25 bp, Rattus norvegicus
tcgcgacctgcaggggcgacaagaa

SEQ ID NO: 546805 - DNA, 25 bp, Rattus norvegicus
ttcgagctcaagatgcggaatgtcg

SEQ ID NO: 546806 - DNA, 25 bp, Rattus norvegicus
ggcatctgcccatgggtcttctgga

SEQ ID NO: 546807 - DNA, 25 bp, Rattus norvegicus
tcgttatgtccctgcccggtggcat

SEQ ID NO: 546808 - DNA, 25 bp, Rattus norvegicus
gcagatatgtccatatgcaccggga

SEQ ID NO: 546809 - DNA, 25 bp, Rattus norvegicus
accagcgcagggatgggaggcctct

SEQ ID NO: 546810 - DNA, 25 bp, Rattus norvegicus
cgcccgggcagatatgtccatatgc

SEQ ID NO: 546811 - DNA, 25 bp, Rattus norvegicus
atgtccatatgcaccgggactagtg

SEQ ID NO: 546812 - DNA, 25 bp, Rattus norvegicus
atatgcaccgggactagtgcgcctc

SEQ ID NO: 546813 - DNA, 25 bp, Rattus norvegicus
atgcaccgggactagtgcgcctctg

SEQ ID NO: 546814 - DNA, 25 bp, Rattus norvegicus
accgggactagtgcgcctctgagcc

SEQ ID NO: 546815 - DNA, 25 bp, Rattus norvegicus
tagtgcgcctctgagcccctggctg

SEQ ID NO: 546816 - DNA, 25 bp, Rattus norvegicus
aacttggggcgcgaagcaagcatgc

SEQ ID NO: 546817 - DNA, 25 bp, Rattus norvegicus
cttggggcgcgaagcaagcatgcat

SEQ ID NO: 546818 - DNA, 25 bp, Rattus norvegicus
gcatgcatgcttgcggggttcaatc

SEQ ID NO: 546819 - DNA, 25 bp, Rattus norvegicus
catgcttgcggggttcaatccaggc

SEQ ID NO: 546820 - DNA, 25 bp, Rattus norvegicus
cggggttcaatccaggcgggctccg

SEQ ID NO: 546821 - DNA, 25 bp, Rattus norvegicus
tgcgcccgggcagatatgtccatat

SEQ ID NO: 546822 - DNA, 25 bp, Rattus norvegicus
cccggcaggaatgcgtatttgaatt

SEQ ID NO: 546823 - DNA, 25 bp, Rattus norvegicus
ggggtctctgtctgctaattgcgaa

SEQ ID NO: 546824 - DNA, 25 bp, Rattus norvegicus
taattgcgaagctccgcccgttgca

SEQ ID NO: 546825 - DNA, 25 bp, Rattus norvegicus
ccctgaagccaagagaaggagcctc

SEQ ID NO: 546826 - DNA, 25 bp, Rattus norvegicus
cacgcgcggataggtaactcgagca

SEQ ID NO: 546827 - DNA, 25 bp, Rattus norvegicus
tgacaagaggtaagcgcgcgtcgtc

SEQ ID NO: 546828 - DNA, 25 bp, Rattus norvegicus
gtgtggatctggactagacctccta

SEQ ID NO: 546829 - DNA, 25 bp, Rattus norvegicus
taaagccgagatttgtcccaagttc

SEQ ID NO: 546830 - DNA, 25 bp, Rattus norvegicus
ccaagttcagggagctggcgagcaa

SEQ ID NO: 546831 - DNA, 25 bp, Rattus norvegicus
gcgagcaagctggtctttctgtgta

SEQ ID NO: 546832 - DNA, 25 bp, Rattus norvegicus
gcacccggtaatcatactcctttta

SEQ ID NO: 546833 - DNA, 25 bp, Rattus norvegicus
ccgacccggtccttctgacaagagg

SEQ ID NO: 546834 - DNA, 25 bp, Rattus norvegicus
tttcttaatacaggcagcacgcagc

SEQ ID NO: 546835 - DNA, 25 bp, Rattus norvegicus
ggtgccatttggtcactccggatgc

SEQ ID NO: 546836 - DNA, 25 bp, Rattus norvegicus
tcttcgagccttggggcctgaaacc

SEQ ID NO: 546837 - DNA, 25 bp, Rattus norvegicus
agctggagtgtatgtcggccaacga

SEQ ID NO: 546838 - DNA, 25 bp, Rattus norvegicus
ccgcctcctgcgaagctggagtgta

SEQ ID NO: 546839 - DNA, 25 bp, Rattus norvegicus
gtgtgcaattaaacccttccggagc

SEQ ID NO: 546840 - DNA, 25 bp, Rattus norvegicus
aacccttccggagcaaaggagccag

SEQ ID NO: 546841 - DNA, 25 bp, Rattus norvegicus
aacgaaggtgttcgcccaatggagc

SEQ ID NO: 546842 - DNA, 25 bp, Rattus norvegicus
ttcgcccaatggagcagatcactga

SEQ ID NO: 546843 - DNA, 25 bp, Rattus norvegicus
caatggagcagatcactgactactg

SEQ ID NO: 546844 - DNA, 25 bp, Rattus norvegicus
aggctcagggtcctcgagtctctag

SEQ ID NO: 546845 - DNA, 25 bp, Rattus norvegicus
tgtatgtcggccaacgaaggtgttc

SEQ ID NO: 546846 - DNA, 25 bp, Rattus norvegicus
ctagctgaggctagggatccaagta

SEQ ID NO: 546847 - DNA, 25 bp, Rattus norvegicus
aaacccaccgggaggcgagtgtgca

SEQ ID NO: 546848 - DNA, 25 bp, Rattus norvegicus
ggcgagtgtgcaattaaacccttcc

SEQ ID NO: 546849 - DNA, 25 bp, Rattus norvegicus
gtcctcgagtctctagctgaggcta

SEQ ID NO: 546850 - DNA, 25 bp, Rattus norvegicus
caccgatgcatgctccccactgatg

SEQ ID NO: 546851 - DNA, 25 bp, Rattus norvegicus
ctgatgcatgctccccactgatgca

SEQ ID NO: 546852 - DNA, 25 bp, Rattus norvegicus
cactgatgcatgctccccactgatg

SEQ ID NO: 546853 - DNA, 25 bp, Rattus norvegicus
tgcacgctcaccacccatgcatgct

SEQ ID NO: 546854 - DNA, 25 bp, Rattus norvegicus
cactgatgcatgtccccactgatgc

SEQ ID NO: 546855 - DNA, 25 bp, Rattus norvegicus
cccaccgatgcacgctcaccaccca

SEQ ID NO: 546856 - DNA, 25 bp, Rattus norvegicus
gatgcacgctctccaccgatgcatg

SEQ ID NO: 546857 - DNA, 25 bp, Rattus norvegicus
actgatgcatgtccccactgatgca

SEQ ID NO: 546858 - DNA, 25 bp, Rattus norvegicus
cccaccgatgcatgctccccaccga

SEQ ID NO: 546859 - DNA, 25 bp, Rattus norvegicus
cccactgatgcacgctccccaccga

SEQ ID NO: 546860 - DNA, 25 bp, Rattus norvegicus
ccactgatgcatgtccccactgatg

SEQ ID NO: 546861 - DNA, 25 bp, Rattus norvegicus
atgcacgctccccactgatgcatgt

SEQ ID NO: 546862 - DNA, 25 bp, Rattus norvegicus
actgatgcatgctccccactgatgc

SEQ ID NO: 546863 - DNA, 25 bp, Rattus norvegicus
gatgcatgtccccactgatgcacgc

SEQ ID NO: 546864 - DNA, 25 bp, Rattus norvegicus
ctttacccgagaacctggcgctgtg

SEQ ID NO: 546865 - DNA, 25 bp, Rattus norvegicus
aggaggacgaccagcgcctcttaga

SEQ ID NO: 546866 - DNA, 25 bp, Rattus norvegicus
cctcttagaccagcaggcagattta

SEQ ID NO: 546867 - DNA, 25 bp, Rattus norvegicus
cagatttagggcacaggctgcgctc

SEQ ID NO: 546868 - DNA, 25 bp, Rattus norvegicus
catcgcgggtacttgggaaaacaga

SEQ ID NO: 546869 - DNA, 25 bp, Rattus norvegicus
agccggccctacactagacaatgcg

SEQ ID NO: 546870 - DNA, 25 bp, Rattus norvegicus
ctgagtaggcgggataaagacaccc

SEQ ID NO: 546871 - DNA, 25 bp, Rattus norvegicus
ggctgcagtccctctttacccgaga

SEQ ID NO: 546872 - DNA, 25 bp, Rattus norvegicus
aagcctggtctccactgcacggcga

SEQ ID NO: 546873 - DNA, 25 bp, Rattus norvegicus
ttcctggagacgtggcactccgagc

SEQ ID NO: 546874 - DNA, 25 bp, Rattus norvegicus
ctctccagcactcatggggtggttg

SEQ ID NO: 546875 - DNA, 25 bp, Rattus norvegicus
gagatgtatctagaggctctccagc

SEQ ID NO: 546876 - DNA, 25 bp, Rattus norvegicus
gtagacccgatgcactgaagtaagg

SEQ ID NO: 546877 - DNA, 25 bp, Rattus norvegicus
cgcctgtggccaggctctttaaaaa

SEQ ID NO: 546878 - DNA, 25 bp, Rattus norvegicus
aagttttcaatatggcggcgggagc

SEQ ID NO: 546879 - DNA, 25 bp, Rattus norvegicus
acggctcggtggcaggtcctcgcct

SEQ ID NO: 546880 - DNA, 25 bp, Rattus norvegicus
tgcgctgcacgatccggcagcagtg

SEQ ID NO: 546881 - DNA, 25 bp, Rattus norvegicus
ggacgctgccacacagacttcgggc

SEQ ID NO: 546882 - DNA, 25 bp, Rattus norvegicus
tcgtgaggacaaccggctctggcag

SEQ ID NO: 546883 - DNA, 25 bp, Rattus norvegicus
tagccgagcagactgggatctgtaa

SEQ ID NO: 546884 - DNA, 25 bp, Rattus norvegicus
aagatccggcccatagccgagcaga

SEQ ID NO: 546885 - DNA, 25 bp, Rattus norvegicus
ttcgctttcatccacaagatccggc

SEQ ID NO: 546886 - DNA, 25 bp, Rattus norvegicus
ccagctgggaagagttcgcggaccc

SEQ ID NO: 546887 - DNA, 25 bp, Rattus norvegicus
cttcgagcccagctgggaagagttc

SEQ ID NO: 546888 - DNA, 25 bp, Rattus norvegicus
cgagtgtccggtcttcgagcccagc

SEQ ID NO: 546889 - DNA, 25 bp, Rattus norvegicus
gcttgctcgtcctggcggacgctgc

SEQ ID NO: 546890 - DNA, 25 bp, Rattus norvegicus
gacttcgggccggaccgctttgctc

SEQ ID NO: 546891 - DNA, 25 bp, Rattus norvegicus
gggccctgatggcttgctcgtcctg

SEQ ID NO: 546892 - DNA, 25 bp, Rattus norvegicus
gccgtctccagcctgcctcttttgc

SEQ ID NO: 546893 - DNA, 25 bp, Rattus norvegicus
cccgggtcaagcttcagggatctgc

SEQ ID NO: 546894 - DNA, 25 bp, Rattus norvegicus
ttcctggcatttccgtccctggacg

SEQ ID NO: 546895 - DNA, 25 bp, Rattus norvegicus
tctgttcctggcatttccgtccctg

SEQ ID NO: 546896 - DNA, 25 bp, Rattus norvegicus
cctctgcaggtttgcgcggcgagct

SEQ ID NO: 546897 - DNA, 25 bp, Rattus norvegicus
cgagaagcaggctcctctgcaggtt

SEQ ID NO: 546898 - DNA, 25 bp, Rattus norvegicus
tgcggagagttttcctagcctctgg

SEQ ID NO: 546899 - DNA, 25 bp, Rattus norvegicus
cgcaccgtcctttgcggagagtttt

SEQ ID NO: 546900 - DNA, 25 bp, Rattus norvegicus
atcctggcttctgagtccaggtgca

SEQ ID NO: 546901 - DNA, 25 bp, Rattus norvegicus
tccaaagtttctctatcctggcttc

SEQ ID NO: 546902 - DNA, 25 bp, Rattus norvegicus
tcgccttcgggtgagtcccgatgcc

SEQ ID NO: 546903 - DNA, 25 bp, Rattus norvegicus
tcggggaccgcggatctctgctgcc

SEQ ID NO: 546904 - DNA, 25 bp, Rattus norvegicus
gcccgtcgctgctttccgtcgggga

SEQ ID NO: 546905 - DNA, 25 bp, Rattus norvegicus
aagcttcagggatctgcggcaccgt

SEQ ID NO: 546906 - DNA, 25 bp, Rattus norvegicus
cgcccagcctgcaacttctgaaatg

SEQ ID NO: 546907 - DNA, 25 bp, Rattus norvegicus
cttctgaaatgaccgcatgcggcta

SEQ ID NO: 546908 - DNA, 25 bp, Rattus norvegicus
ctctgccctgtgattccaggcagca

SEQ ID NO: 546909 - DNA, 25 bp, Rattus norvegicus
gtgattccaggcagcacctcccggg

SEQ ID NO: 546910 - DNA, 25 bp, Rattus norvegicus
gggtgccaggacaggttcctgctcc

SEQ ID NO: 546911 - DNA, 25 bp, Rattus norvegicus
tcccggaaaagcttgcagtagcggg

SEQ ID NO: 546912 - DNA, 25 bp, Rattus norvegicus
cccaagatccgggatctggatcggg

SEQ ID NO: 546913 - DNA, 25 bp, Rattus norvegicus
cacaccgatcggctcccggaacatc

SEQ ID NO: 546914 - DNA, 25 bp, Rattus norvegicus
aggcggatgtgaggcgcatctcaat

SEQ ID NO: 546915 - DNA, 25 bp, Rattus norvegicus
atgtgaggcgcatctcaattggcgg

SEQ ID NO: 546916 - DNA, 25 bp, Rattus norvegicus
ggaagcggatcaggttgttactact

SEQ ID NO: 546917 - DNA, 25 bp, Rattus norvegicus
tgttactactgcagagcgcgcgagc

SEQ ID NO: 546918 - DNA, 25 bp, Rattus norvegicus
acttcggggcggcagactcccgctg

SEQ ID NO: 546919 - DNA, 25 bp, Rattus norvegicus
atctggatcggggatcgcctccgag

SEQ ID NO: 546920 - DNA, 25 bp, Rattus norvegicus
agactgttggtagccctgtgtggcc

SEQ ID NO: 546921 - DNA, 25 bp, Rattus norvegicus
agcaggcagccagaaagaccgcacc

SEQ ID NO: 546922 - DNA, 25 bp, Rattus norvegicus
agaaagaccgcaccatcctcgaagc

SEQ ID NO: 546923 - DNA, 25 bp, Rattus norvegicus
accatcctcgaagcggaccctgggg

SEQ ID NO: 546924 - DNA, 25 bp, Rattus norvegicus
cgggctcctgctctgtcagcgagcc

SEQ ID NO: 546925 - DNA, 25 bp, Rattus norvegicus
gactctgctcgcttccctcccaggt

SEQ ID NO: 546926 - DNA, 25 bp, Rattus norvegicus
ctcccaggtgttccagctccgccat

SEQ ID NO: 546927 - DNA, 25 bp, Rattus norvegicus
catggctcgagcttccgcagctgct

SEQ ID NO: 546928 - DNA, 25 bp, Rattus norvegicus
tttagcttcagcacgcaggcgctgc

SEQ ID NO: 546929 - DNA, 25 bp, Rattus norvegicus
ccaccagactgttggtagccctgtg

SEQ ID NO: 546930 - DNA, 25 bp, Rattus norvegicus
ggtagccctgtgtggccaccgtcgc

SEQ ID NO: 546931 - DNA, 25 bp, Rattus norvegicus
cctcggagggcttcagccagggaat

SEQ ID NO: 546932 - DNA, 25 bp, Rattus norvegicus
tagcaccgcccacacgctcctttag

SEQ ID NO: 546933 - DNA, 25 bp, Rattus norvegicus
gcagctgctgccaaaactaccacca

SEQ ID NO: 546934 - DNA, 25 bp, Rattus norvegicus
cactgcagacacacgagcggaaagc

SEQ ID NO: 546935 - DNA, 25 bp, Rattus norvegicus
cccgggttcagcctgggcactgcag

SEQ ID NO: 546936 - DNA, 25 bp, Rattus norvegicus
tcatttcaacggtctcccgggttca

SEQ ID NO: 546937 - DNA, 25 bp, Rattus norvegicus
acgtacccgaggtcacggtgagtct

SEQ ID NO: 546938 - DNA, 25 bp, Rattus norvegicus
tcggtgctgcctatccaggttctgt

SEQ ID NO: 546939 - DNA, 25 bp, Rattus norvegicus
ttgattaatcgccacaggcctgggg

SEQ ID NO: 546940 - DNA, 25 bp, Rattus norvegicus
tccaggttctgtgccttgattaatc

SEQ ID NO: 546941 - DNA, 25 bp, Rattus norvegicus
tgcggaccaatcacagtactctcta

SEQ ID NO: 546942 - DNA, 25 bp, Rattus norvegicus
ctctccgggtttgctgcggaccaat

SEQ ID NO: 546943 - DNA, 25 bp, Rattus norvegicus
ctgcttgagcgaactcacgctcgga

SEQ ID NO: 546944 - DNA, 25 bp, Rattus norvegicus
cgcgcgaatttgagccctgcttgag

SEQ ID NO: 546945 - DNA, 25 bp, Rattus norvegicus
cagcggaactgggaattccggaagc

SEQ ID NO: 546946 - DNA, 25 bp, Rattus norvegicus
caggcctggggcacaaaacaaaacg

SEQ ID NO: 546947 - DNA, 25 bp, Rattus norvegicus
ggggtggagtcatttcaacggtctc

SEQ ID NO: 546948 - DNA, 25 bp, Rattus norvegicus
aaggtcaaggcgtccactgaggcca

SEQ ID NO: 546949 - DNA, 25 bp, Rattus norvegicus
atactccgcgaactggccgaaggtc

SEQ ID NO: 546950 - DNA, 25 bp, Rattus norvegicus
aggaggccgcaggaaatgcccgtta

SEQ ID NO: 546951 - DNA, 25 bp, Rattus norvegicus
agcgggctccatactccgcgaactg

SEQ ID NO: 546952 - DNA, 25 bp, Rattus norvegicus
gaagcccgtagcctggcagcctagc

SEQ ID NO: 546953 - DNA, 25 bp, Rattus norvegicus
cccaggacggctaggaagcccgtag

SEQ ID NO: 546954 - DNA, 25 bp, Rattus norvegicus
caggtcacagagacgctgcactgca

SEQ ID NO: 546955 - DNA, 25 bp, Rattus norvegicus
gcagagcggggaggcaccatactcc

SEQ ID NO: 546956 - DNA, 25 bp, Rattus norvegicus
atcaccagggctacggcgaagccta

SEQ ID NO: 546957 - DNA, 25 bp, Rattus norvegicus
gcagagcgagttcatcatcaccagg

SEQ ID NO: 546958 - DNA, 25 bp, Rattus norvegicus
accggccaccacgaggaagcagagc

SEQ ID NO: 546959 - DNA, 25 bp, Rattus norvegicus
gcaggtcgcagtagagcttgatgta

SEQ ID NO: 546960 - DNA, 25 bp, Rattus norvegicus
accacaagcttgaccggagacaacg

SEQ ID NO: 546961 - DNA, 25 bp, Rattus norvegicus
gagcttgatgtaggcaccggccacc

SEQ ID NO: 546962 - DNA, 25 bp, Rattus norvegicus
acgcggtttagttctgttgctctca

SEQ ID NO: 546963 - DNA, 25 bp, Rattus norvegicus
tgctctcaggcgcacctggagacga

SEQ ID NO: 546964 - DNA, 25 bp, Rattus norvegicus
cttcacccggactcacctgcgtgca

SEQ ID NO: 546965 - DNA, 25 bp, Rattus norvegicus
cctgctgcgagaacccacgcggttt

SEQ ID NO: 546966 - DNA, 25 bp, Rattus norvegicus
gcgttttctggagctcggcgccctc

SEQ ID NO: 546967 - DNA, 25 bp, Rattus norvegicus
gaccttgtggcgttttctggagctc

SEQ ID NO: 546968 - DNA, 25 bp, Rattus norvegicus
tgcgagaacccacgcggtttagttc

SEQ ID NO: 546969 - DNA, 25 bp, Rattus norvegicus
cgtagatcttgggactcctttcccg

SEQ ID NO: 546970 - DNA, 25 bp, Rattus norvegicus
tgccgtagatcttgggactcctttc

SEQ ID NO: 546971 - DNA, 25 bp, Rattus norvegicus
gccacccatgccgtagatcttggga

SEQ ID NO: 546972 - DNA, 25 bp, Rattus norvegicus
aggagccacccatgccgtagatctt

SEQ ID NO: 546973 - DNA, 25 bp, Rattus norvegicus
tcaggcgcacctggagacgaggaca

SEQ ID NO: 546974 - DNA, 25 bp, Rattus norvegicus
tagttctgttgctctcaggcgcacc

SEQ ID NO: 546975 - DNA, 25 bp, Rattus norvegicus
gacgaggacagccaggagccaccca

SEQ ID NO: 546976 - DNA, 25 bp, Rattus norvegicus
catgatctcgaagggcctagggcca

SEQ ID NO: 546977 - DNA, 25 bp, Rattus norvegicus
gacctgtgcgccctggtgtctacgc

SEQ ID NO: 546978 - DNA, 25 bp, Rattus norvegicus
cggacccatccttgtgtgtcactga

SEQ ID NO: 546979 - DNA, 25 bp, Rattus norvegicus
gtgtgtcactgacccatcttcttca

SEQ ID NO: 546980 - DNA, 25 bp, Rattus norvegicus
atcttcttcagtgcccgtagcccgg

SEQ ID NO: 546981 - DNA, 25 bp, Rattus norvegicus
tagcccgggccttttggtgctgcta

SEQ ID NO: 546982 - DNA, 25 bp, Rattus norvegicus
agccaccgcacagcatgatctcgaa

SEQ ID NO: 546983 - DNA, 25 bp, Rattus norvegicus
aggcccggagtctgtgcctgagaac

SEQ ID NO: 546984 - DNA, 25 bp, Rattus norvegicus
ctgagaaccgggcagcgggaacaca

SEQ ID NO: 546985 - DNA, 25 bp, Rattus norvegicus
gcgggaacacagctcccgacgcggt

SEQ ID NO: 546986 - DNA, 25 bp, Rattus norvegicus
acgcggtccagagctaagaaactta

SEQ ID NO: 546987 - DNA, 25 bp, Rattus norvegicus
gctaagaaacttagcggcgccctaa

SEQ ID NO: 546988 - DNA, 25 bp, Rattus norvegicus
cttagcggcgccctaagagtcagga

SEQ ID NO: 546989 - DNA, 25 bp, Rattus norvegicus
ttttggtgctgctatcggatgacgc

SEQ ID NO: 546990 - DNA, 25 bp, Rattus norvegicus
gcaccggtggatagtcctggcaccc

SEQ ID NO: 546991 - DNA, 25 bp, Rattus norvegicus
aagtcctactcaggtgggcgccgcg

SEQ ID NO: 546992 - DNA, 25 bp, Rattus norvegicus
cgcgactgttcggttgggagcccac

SEQ ID NO: 546993 - DNA, 25 bp, Rattus norvegicus
aagaagtcctactcaggtgggcgcc

SEQ ID NO: 546994 - DNA, 25 bp, Rattus norvegicus
gcaccatgaagaagtcctactcagg

SEQ ID NO: 546995 - DNA, 25 bp, Rattus norvegicus
ggcggcaccatgaagaagtcctact

SEQ ID NO: 546996 - DNA, 25 bp, Rattus norvegicus
acactttcctgggagcggcggccac

SEQ ID NO: 546997 - DNA, 25 bp, Rattus norvegicus
accacactttcctgggagcggcggc

SEQ ID NO: 546998 - DNA, 25 bp, Rattus norvegicus
cgcggcctcgccaccacactttcct

SEQ ID NO: 546999 - DNA, 25 bp, Rattus norvegicus
cgacccggattagccacctgggagc

SEQ ID NO: 547000 - DNA, 25 bp, Rattus norvegicus
gggacctgcgcgagtcacctgaacg

SEQ ID NO: 547001 - DNA, 25 bp, Rattus norvegicus
cttactttcggcttcaggagggttg

SEQ ID NO: 547002 - DNA, 25 bp, Rattus norvegicus
cagtgacttactttcggcttcagga

SEQ ID NO: 547003 - DNA, 25 bp, Rattus norvegicus
cccgggaaagttgcagtgacttact

SEQ ID NO: 547004 - DNA, 25 bp, Rattus norvegicus
gcacaacgcaaagacacagcgccag

SEQ ID NO: 547005 - DNA, 25 bp, Rattus norvegicus
cccgcgcgcgccaatgcgcacagca

SEQ ID NO: 547006 - DNA, 25 bp, Rattus norvegicus
cacagcacaacgcaaagacacagcg

SEQ ID NO: 547007 - DNA, 25 bp, Rattus norvegicus
tgagcgcgcggctcacctcctggtt

SEQ ID NO: 547008 - DNA, 25 bp, Rattus norvegicus
gctcacctcctggttccgggcgggc

SEQ ID NO: 547009 - DNA, 25 bp, Rattus norvegicus
gtgagcgcgcggctcacctcctggt

SEQ ID NO: 547010 - DNA, 25 bp, Rattus norvegicus
acaacgcaaagacacagcgccagga

SEQ ID NO: 547011 - DNA, 25 bp, Rattus norvegicus
aacgcaaagacacagcgccaggagc

SEQ ID NO: 547012 - DNA, 25 bp, Rattus norvegicus
acagcgccaggagcaacggcgagct

SEQ ID NO: 547013 - DNA, 25 bp, Rattus norvegicus
aggagcaacggcgagctgtgcatct

SEQ ID NO: 547014 - DNA, 25 bp, Rattus norvegicus
gagcaacggcgagctgtgcatctcg

SEQ ID NO: 547015 - DNA, 25 bp, Rattus norvegicus
ctcggcggcaggctttggggcacct

SEQ ID NO: 547016 - DNA, 25 bp, Rattus norvegicus
gcgggcgcacggagctgtgagcgcg

SEQ ID NO: 547017 - DNA, 25 bp, Rattus norvegicus
gcgcgcgccaatgcgcacagcacaa

SEQ ID NO: 547018 - DNA, 25 bp, Rattus norvegicus
acgaggggaaccgagcttgcaatcc

SEQ ID NO: 547019 - DNA, 25 bp, Rattus norvegicus
agcttagggcctagtacggttcttg

SEQ ID NO: 547020 - DNA, 25 bp, Rattus norvegicus
gcggcactgagaggtctccaggcac

SEQ ID NO: 547021 - DNA, 25 bp, Rattus norvegicus
acgcgcagcccgagcgtgttgccag

SEQ ID NO: 547022 - DNA, 25 bp, Rattus norvegicus
ccgctccgcgcgtggattgtcacgg

SEQ ID NO: 547023 - DNA, 25 bp, Rattus norvegicus
aggcacagggaacccgccgcaggct

SEQ ID NO: 547024 - DNA, 25 bp, Rattus norvegicus
cttgcaatccggagctggcggcact

SEQ ID NO: 547025 - DNA, 25 bp, Rattus norvegicus
cctaggcagctggagtcgccgcctg

SEQ ID NO: 547026 - DNA, 25 bp, Rattus norvegicus
cttcgtcaacgtgatcgcggtatga

SEQ ID NO: 547027 - DNA, 25 bp, Rattus norvegicus
ggcaagaccaccttcgtcaacgtga

SEQ ID NO: 547028 - DNA, 25 bp, Rattus norvegicus
ttctggaaggaggaaatggagctca

SEQ ID NO: 547029 - DNA, 25 bp, Rattus norvegicus
ctggactggttcaaggccctgttct

SEQ ID NO: 547030 - DNA, 25 bp, Rattus norvegicus
cgaccatgatcgctttgttcaacaa

SEQ ID NO: 547031 - DNA, 25 bp, Rattus norvegicus
tggccacacccatcggcgagcggat

SEQ ID NO: 547032 - DNA, 25 bp, Rattus norvegicus
gatgcacgctctccaccgatgcatg

SEQ ID NO: 547033 - DNA, 25 bp, Rattus norvegicus
cccaccgatgcacgctcaccaccca

SEQ ID NO: 547034 - DNA, 25 bp, Rattus norvegicus
actgatgcatgctccccactgatgc

SEQ ID NO: 547035 - DNA, 25 bp, Rattus norvegicus
cactgatgcatgctccccactgatg

SEQ ID NO: 547036 - DNA, 25 bp, Rattus norvegicus
tgcacgctcaccacccatgcatgct

SEQ ID NO: 547037 - DNA, 25 bp, Rattus norvegicus
gcacgctcaccacccatgcatgctc

SEQ ID NO: 547038 - DNA, 25 bp, Rattus norvegicus
gatgcacgctcaccacccatgcatg

SEQ ID NO: 547039 - DNA, 25 bp, Rattus norvegicus
caccgatgcacgctcaccacccatg

SEQ ID NO: 547040 - DNA, 25 bp, Rattus norvegicus
ccactgatgcatgtccccactgatg

SEQ ID NO: 547041 - DNA, 25 bp, Rattus norvegicus
cccaccgatgcatgctccccactga

SEQ ID NO: 547042 - DNA, 25 bp, Rattus norvegicus
actgatgcatgtccccactgatgca

SEQ ID NO: 547043 - DNA, 25 bp, Rattus norvegicus
atgcacgctccccactgatgcatgt

SEQ ID NO: 547044 - DNA, 25 bp, Rattus norvegicus
caccgatgcatgctccccactgatg

SEQ ID NO: 547045 - DNA, 25 bp, Rattus norvegicus
cccactgatgcacgctccccaccga

SEQ ID NO: 547046 - DNA, 25 bp, Rattus norvegicus
tgtgcgaatcgagccgcagctccga

SEQ ID NO: 547047 - DNA, 25 bp, Rattus norvegicus
ttgctcacccgccaggaaggccggt

SEQ ID NO: 547048 - DNA, 25 bp, Rattus norvegicus
ctctccgacgcggtaggtgagctcc

SEQ ID NO: 547049 - DNA, 25 bp, Rattus norvegicus
gcacagcagggcttcggaaagacca

SEQ ID NO: 547050 - DNA, 25 bp, Rattus norvegicus
ttcggaaagaccacgcacagggcct

SEQ ID NO: 547051 - DNA, 25 bp, Rattus norvegicus
acagggcctggccatagtgcgagaa

SEQ ID NO: 547052 - DNA, 25 bp, Rattus norvegicus
tcacctccaggcaactgtgcgaatc

SEQ ID NO: 547053 - DNA, 25 bp, Rattus norvegicus
aactcggcccgcaggtccaggtgca

SEQ ID NO: 547054 - DNA, 25 bp, Rattus norvegicus
gcaggatctcgaaggcgcggaaact

SEQ ID NO: 547055 - DNA, 25 bp, Rattus norvegicus
aactggaggccgaggccacgtccac

SEQ ID NO: 547056 - DNA, 25 bp, Rattus norvegicus
acgtccacggcttgtgccgagtgaa

SEQ ID NO: 547057 - DNA, 25 bp, Rattus norvegicus
atggctcttagagcggttgctcacc

SEQ ID NO: 547058 - DNA, 25 bp, Rattus norvegicus
ttccagcgtcgccttgccgttcagt

SEQ ID NO: 547059 - DNA, 25 bp, Rattus norvegicus
tccgctgctctccatggctcttaga

SEQ ID NO: 547060 - DNA, 25 bp, Rattus norvegicus
ttcgaactccgaccacagcgggcgg

SEQ ID NO: 547061 - DNA, 25 bp, Rattus norvegicus
ggcagctcaccacggctctctcgcg

SEQ ID NO: 547062 - DNA, 25 bp, Rattus norvegicus
ctcgcgtactcctccatcttggctc

SEQ ID NO: 547063 - DNA, 25 bp, Rattus norvegicus
atcttggctccaacccgcgcgagag

SEQ ID NO: 547064 - DNA, 25 bp, Rattus norvegicus
caacccgcgcgagagtgtagggcac

SEQ ID NO: 547065 - DNA, 25 bp, Rattus norvegicus
tggacgaggattgggtcatcattcc

SEQ ID NO: 547066 - DNA, 25 bp, Rattus norvegicus
gctcattcgcgccacccacagctgc

SEQ ID NO: 547067 - DNA, 25 bp, Rattus norvegicus
cgcggacctccgcttgcacttcgaa

SEQ ID NO: 547068 - DNA, 25 bp, Rattus norvegicus
ttactggacgaggattgggtcatca

SEQ ID NO: 547069 - DNA, 25 bp, Rattus norvegicus
tccgcagccaatagcaatcgagctc

SEQ ID NO: 547070 - DNA, 25 bp, Rattus norvegicus
agccaatagcaatcgagctccgctc

SEQ ID NO: 547071 - DNA, 25 bp, Rattus norvegicus
tagggcacgctaggcggaaattgat

SEQ ID NO: 547072 - DNA, 25 bp, Rattus norvegicus
tctcggagccatgcggcgcggacct

SEQ ID NO: 547073 - DNA, 25 bp, Rattus norvegicus
tgatcccaggcggaggcgtgttact

SEQ ID NO: 547074 - DNA, 25 bp, Rattus norvegicus
tggtccgagccatcctcgtgacggt

SEQ ID NO: 547075 - DNA, 25 bp, Rattus norvegicus
cctgaagtcgcacgcgctgttagca

SEQ ID NO: 547076 - DNA, 25 bp, Rattus norvegicus
ataggtcgcagcctcccgagacagc

SEQ ID NO: 547077 - DNA, 25 bp, Rattus norvegicus
cggtgagggtatccaccaacgcctc

SEQ ID NO: 547078 - DNA, 25 bp, Rattus norvegicus
caaatccctgcggtcagcggactgt

SEQ ID NO: 547079 - DNA, 25 bp, Rattus norvegicus
accgaatgacggctcccgctgacgg

SEQ ID NO: 547080 - DNA, 25 bp, Rattus norvegicus
gaagccgcgcctgcgcatctaagta

SEQ ID NO: 547081 - DNA, 25 bp, Rattus norvegicus
agacagcgccttctgctgccggaac

SEQ ID NO: 547082 - DNA, 25 bp, Rattus norvegicus
ggccagcacgcttcggacgtatatg

SEQ ID NO: 547083 - DNA, 25 bp, Rattus norvegicus
tcggacgtatatgcacacagaattc

SEQ ID NO: 547084 - DNA, 25 bp, Rattus norvegicus
taacggtttgtagtcctgaagtcgc

SEQ ID NO: 547085 - DNA, 25 bp, Rattus norvegicus
gctgttagcaaacgcgcttggaata

SEQ ID NO: 547086 - DNA, 25 bp, Rattus norvegicus
tcttctaggactttcacggccgcca

SEQ ID NO: 547087 - DNA, 25 bp, Rattus norvegicus
gcacacagaattcccataacggttt

SEQ ID NO: 547088 - DNA, 25 bp, Rattus norvegicus
ttttttctgcacagccggcctagta

SEQ ID NO: 547089 - DNA, 25 bp, Rattus norvegicus
cccaaatcgtaagagccgcggacca

SEQ ID NO: 547090 - DNA, 25 bp, Rattus norvegicus
ggctccagctgtacttaaagcgaca

SEQ ID NO: 547091 - DNA, 25 bp, Rattus norvegicus
ttaaagcgacagagcccaatttctc

SEQ ID NO: 547092 - DNA, 25 bp, Rattus norvegicus
tctgtcgctgacttctgtcccgagc

SEQ ID NO: 547093 - DNA, 25 bp, Rattus norvegicus
gccagcgggctctttaacgcccaga

SEQ ID NO: 547094 - DNA, 25 bp, Rattus norvegicus
ggcctagtacttacggctccagctg

SEQ ID NO: 547095 - DNA, 25 bp, Rattus norvegicus
cccagagcaggtagacaaagagcta

SEQ ID NO: 547096 - DNA, 25 bp, Rattus norvegicus
gagctaccgcagtctttacgatttc

SEQ ID NO: 547097 - DNA, 25 bp, Rattus norvegicus
gcctcgcgccgcaagggtcgaaaga

SEQ ID NO: 547098 - DNA, 25 bp, Rattus norvegicus
cttgaatgccagcagcagtctgatg

SEQ ID NO: 547099 - DNA, 25 bp, Rattus norvegicus
ttacgatttcagtggcctctgcggc

SEQ ID NO: 547100 - DNA, 25 bp, Rattus norvegicus
tctgcggcctctgtagccggaaggt

SEQ ID NO: 547101 - DNA, 25 bp, Rattus norvegicus
cacctgggctgttcctgagttaacc

SEQ ID NO: 547102 - DNA, 25 bp, Rattus norvegicus
cgctgcactggccttggccatactg

SEQ ID NO: 547103 - DNA, 25 bp, Rattus norvegicus
ggcgcgcttgggcagcatgcctctc

SEQ ID NO: 547104 - DNA, 25 bp, Rattus norvegicus
aaacgagaggttggtgagcgacttc

SEQ ID NO: 547105 - DNA, 25 bp, Rattus norvegicus
cattctgcctgtgaggagcgcatgg

SEQ ID NO: 547106 - DNA, 25 bp, Rattus norvegicus
ctgctgcccagcattctgcctgtga

SEQ ID NO: 547107 - DNA, 25 bp, Rattus norvegicus
tgccggacttgaagaccttcagctc

SEQ ID NO: 547108 - DNA, 25 bp, Rattus norvegicus
cgcagctgcctttctgctggctccc

SEQ ID NO: 547109 - DNA, 25 bp, Rattus norvegicus
ggccttggccatactgccactgctg

SEQ ID NO: 547110 - DNA, 25 bp, Rattus norvegicus
gaagaccttcagctccgctgcactg

SEQ ID NO: 547111 - DNA, 25 bp, Rattus norvegicus
ccacgctgccggacttgaagacctt

SEQ ID NO: 547112 - DNA, 25 bp, Rattus norvegicus
gaacacgactgtccacgctgccgga

SEQ ID NO: 547113 - DNA, 25 bp, Rattus norvegicus
cttctgtttgcgcaggttggagaca

SEQ ID NO: 547114 - DNA, 25 bp, Rattus norvegicus
ttggtgagcgacttctgtttgcgca

SEQ ID NO: 547115 - DNA, 25 bp, Rattus norvegicus
cgggctgcacgctcttgacgctgct

SEQ ID NO: 547116 - DNA, 25 bp, Rattus norvegicus
gccgccgctgttcagagtcgcgcat

SEQ ID NO: 547117 - DNA, 25 bp, Rattus norvegicus
ggcgaagccactagcatcccggtta

SEQ ID NO: 547118 - DNA, 25 bp, Rattus norvegicus
gggctgactccagcccttccaagtg

SEQ ID NO: 547119 - DNA, 25 bp, Rattus norvegicus
ggccactcaccggagcgactctggt

SEQ ID NO: 547120 - DNA, 25 bp, Rattus norvegicus
atcgcccgagcagcgcagtgccgag

SEQ ID NO: 547121 - DNA, 25 bp, Rattus norvegicus
agtgccgagcgtcttctccttgcga

SEQ ID NO: 547122 - DNA, 25 bp, Rattus norvegicus
ctccttgcgaccagaaagtttcccg

SEQ ID NO: 547123 - DNA, 25 bp, Rattus norvegicus
cagcctctcactagggcggtcgcgg

SEQ ID NO: 547124 - DNA, 25 bp, Rattus norvegicus
cgggctccggctctactacgagaag

SEQ ID NO: 547125 - DNA, 25 bp, Rattus norvegicus
ggaggcggcatcctgaacaaagtgc

SEQ ID NO: 547126 - DNA, 25 bp, Rattus norvegicus
gcactgtgccagcttaacccgcaga

SEQ ID NO: 547127 - DNA, 25 bp, Rattus norvegicus
gggtcccttccagactttgtcattg

SEQ ID NO: 547128 - DNA, 25 bp, Rattus norvegicus
tcattggaaagctattcccgtaacc

SEQ ID NO: 547129 - DNA, 25 bp, Rattus norvegicus
cttccaagtgcagagctcagcgccg

SEQ ID NO: 547130 - DNA, 25 bp, Rattus norvegicus
ctcctagcagctgccaggtgagtgc

SEQ ID NO: 547131 - DNA, 25 bp, Rattus norvegicus
ccgcaactgcccgagcacctgggac

SEQ ID NO: 547132 - DNA, 25 bp, Rattus norvegicus
aaaacggcgcgcagtacggcgcagc

SEQ ID NO: 547133 - DNA, 25 bp, Rattus norvegicus
caccctgcgcctattggtttttccg

SEQ ID NO: 547134 - DNA, 25 bp, Rattus norvegicus
cgcaccctgcgcctattggtttttc

SEQ ID NO: 547135 - DNA, 25 bp, Rattus norvegicus
gggacgcaccctgcgcctattggtt

SEQ ID NO: 547136 - DNA, 25 bp, Rattus norvegicus
actgcccgagcacctgggacgcacc

SEQ ID NO: 547137 - DNA, 25 bp, Rattus norvegicus
cctagcagctgccaggtgagtgcgc

SEQ ID NO: 547138 - DNA, 25 bp, Rattus norvegicus
tacggcgcagccagccaccgcttcc

SEQ ID NO: 547139 - DNA, 25 bp, Rattus norvegicus
ctgtcgcccgtacgcctcctagcag

SEQ ID NO: 547140 - DNA, 25 bp, Rattus norvegicus
ttcccggagtgctgtcgcccgtacg

SEQ ID NO: 547141 - DNA, 25 bp, Rattus norvegicus
gcttcccggagtgctgtcgcccgta

SEQ ID NO: 547142 - DNA, 25 bp, Rattus norvegicus
aacggcgcgcagtacggcgcagcca

SEQ ID NO: 547143 - DNA, 25 bp, Rattus norvegicus
tgcgcgccccgagtagcccgcctcg

SEQ ID NO: 547144 - DNA, 25 bp, Rattus norvegicus
tgcagtccctgtagaagcagctctg

SEQ ID NO: 547145 - DNA, 25 bp, Rattus norvegicus
cctgtagaagcagctctggttccaa

SEQ ID NO: 547146 - DNA, 25 bp, Rattus norvegicus
cccattcattcagccgaccgtgggg

SEQ ID NO: 547147 - DNA, 25 bp, Rattus norvegicus
ctcacgaactttggctgcgtaaata

SEQ ID NO: 547148 - DNA, 25 bp, Rattus norvegicus
tggctgcgtaaataaaacctccggc

SEQ ID NO: 547149 - DNA, 25 bp, Rattus norvegicus
aacctccggcagcaagagcactgcg

SEQ ID NO: 547150 - DNA, 25 bp, Rattus norvegicus
gcaacagccagtgccgagtcgcgga

SEQ ID NO: 547151 - DNA, 25 bp, Rattus norvegicus
acaggcgggcgcaacagccagtgcc

SEQ ID NO: 547152 - DNA, 25 bp, Rattus norvegicus
cccagttttgacaggcgggcgcaac

SEQ ID NO: 547153 - DNA, 25 bp, Rattus norvegicus
aaggaggcgctcacgaactttggct

SEQ ID NO: 547154 - DNA, 25 bp, Rattus norvegicus
ggcccggcctccacatcctctacat

SEQ ID NO: 547155 - DNA, 25 bp, Rattus norvegicus
cctccaggcccagttttgacaggcg

SEQ ID NO: 547156 - DNA, 25 bp, Rattus norvegicus
cctgggactctgcagtccctgtaga

SEQ ID NO: 547157 - DNA, 25 bp, Rattus norvegicus
ccagcctaggtcgtgtgcctgggac

SEQ ID NO: 547158 - DNA, 25 bp, Rattus norvegicus
agcgggtagcatccgcacgcgcatc

SEQ ID NO: 547159 - DNA, 25 bp, Rattus norvegicus
gcccagcgcgcagactgagtgcagg

SEQ ID NO: 547160 - DNA, 25 bp, Rattus norvegicus
gggcgccacatctacttcacgctag

SEQ ID NO: 547161 - DNA, 25 bp, Rattus norvegicus
ctacttcacgctagtgaccgaaggc

SEQ ID NO: 547162 - DNA, 25 bp, Rattus norvegicus
tcccgcatcaaagccgtggagtgcg

SEQ ID NO: 547163 - DNA, 25 bp, Rattus norvegicus
gcttctcccgcatcaaagccgtgga

SEQ ID NO: 547164 - DNA, 25 bp, Rattus norvegicus
tcccgggtgccgctgtctgcaaggc

SEQ ID NO: 547165 - DNA, 25 bp, Rattus norvegicus
ggccggcccaaggagctcagcttct

SEQ ID NO: 547166 - DNA, 25 bp, Rattus norvegicus
tgcagctcttcgaggccaagggcac

SEQ ID NO: 547167 - DNA, 25 bp, Rattus norvegicus
accgagcgcgggctgcagctcttcg

SEQ ID NO: 547168 - DNA, 25 bp, Rattus norvegicus
cggaagcgttgcgtgctcaccgagc

SEQ ID NO: 547169 - DNA, 25 bp, Rattus norvegicus
cgaccgtgctaaaggagggcgtgct

SEQ ID NO: 547170 - DNA, 25 bp, Rattus norvegicus
agcctccagcgctgtgggaacctcg

SEQ ID NO: 547171 - DNA, 25 bp, Rattus norvegicus
gagctcagcttctcccgcatcaaag

SEQ ID NO: 547172 - DNA, 25 bp, Rattus norvegicus
tcggtgcgaccatcccgcagatcgg

SEQ ID NO: 547173 - DNA, 25 bp, Rattus norvegicus
catgtgaccctacctggcgcgggga

SEQ ID NO: 547174 - DNA, 25 bp, Rattus norvegicus
ccggcagagatctgcgcggctttgt

SEQ ID NO: 547175 - DNA, 25 bp, Rattus norvegicus
gcggctttgtctgggacgcccacac

SEQ ID NO: 547176 - DNA, 25 bp, Rattus norvegicus
gtctgggacgcccacacctcagagg

SEQ ID NO: 547177 - DNA, 25 bp, Rattus norvegicus
tcggcagcatgtcggtcagcagaaa

SEQ ID NO: 547178 - DNA, 25 bp, Rattus norvegicus
tgtcggtcagcagaaaggactggtc

SEQ ID NO: 547179 - DNA, 25 bp, Rattus norvegicus
agaaaggactggtccgcgctgtcta

SEQ ID NO: 547180 - DNA, 25 bp, Rattus norvegicus
ttctgggcaggaagtctcccgccct

SEQ ID NO: 547181 - DNA, 25 bp, Rattus norvegicus
cgagccaggctgagataagcggcca

SEQ ID NO: 547182 - DNA, 25 bp, Rattus norvegicus
taagcggccatgtgaccctacctgg

SEQ ID NO: 547183 - DNA, 25 bp, Rattus norvegicus
gcgccaagctggtccaactggttct

SEQ ID NO: 547184 - DNA, 25 bp, Rattus norvegicus
tggtccaactggttctgggcaggaa

SEQ ID NO: 547185 - DNA, 25 bp, Rattus norvegicus
cgctgtctaggtgagtgcagccacc

SEQ ID NO: 547186 - DNA, 25 bp, Rattus norvegicus
gctcagacgcgagctgtagggcact

SEQ ID NO: 547187 - DNA, 25 bp, Rattus norvegicus
tcaaggtggacgactgcgaagactt

SEQ ID NO: 547188 - DNA, 25 bp, Rattus norvegicus
gtttgaccgtcatcatcacctgctc

SEQ ID NO: 547189 - DNA, 25 bp, Rattus norvegicus
acgtgccggtcttcatcttctggtc

SEQ ID NO: 547190 - DNA, 25 bp, Rattus norvegicus
tcatcttctggtcagagggcaaagc

SEQ ID NO: 547191 - DNA, 25 bp, Rattus norvegicus
tgtcctggtcctggaagcattcgta

SEQ ID NO: 547192 - DNA, 25 bp, Rattus norvegicus
agcgcgtgttctcctctcagcggct

SEQ ID NO: 547193 - DNA, 25 bp, Rattus norvegicus
cgcatcgggagggaagcaccatccc

SEQ ID NO: 547194 - DNA, 25 bp, Rattus norvegicus
cgtccctcagtaggcactggccgga

SEQ ID NO: 547195 - DNA, 25 bp, Rattus norvegicus
cctttacctcggttggagtgactca

SEQ ID NO: 547196 - DNA, 25 bp, Rattus norvegicus
ttcctctcccggtgacggtgacgac

SEQ ID NO: 547197 - DNA, 25 bp, Rattus norvegicus
gccctccgtcagacaggatatacca

SEQ ID NO: 547198 - DNA, 25 bp, Rattus norvegicus
ctcagcggctccctatggccataga

SEQ ID NO: 547199 - DNA, 25 bp, Rattus norvegicus
gacttggacttctgccgtttgaccg

SEQ ID NO: 547200 - DNA, 25 bp, Rattus norvegicus
cggtagcgacgagagaagtcatccc

SEQ ID NO: 547201 - DNA, 25 bp, Rattus norvegicus
cagctgactggacatctctgcaaag

SEQ ID NO: 547202 - DNA, 25 bp, Rattus norvegicus
atctctgcaaagtcgcgacggtagc

SEQ ID NO: 547203 - DNA, 25 bp, Rattus norvegicus
ccggggaaagaagctgcaggtacca

SEQ ID NO: 547204 - DNA, 25 bp, Rattus norvegicus
cctggcagccgtgtctcggtgcaca

SEQ ID NO: 547205 - DNA, 25 bp, Rattus norvegicus
tccggttgctctcaggctggaagga

SEQ ID NO: 547206 - DNA, 25 bp, Rattus norvegicus
gggcgcggagtcttcatctccagta

SEQ ID NO: 547207 - DNA, 25 bp, Rattus norvegicus
cctctgtgacagcttataatggatg

SEQ ID NO: 547208 - DNA, 25 bp, Rattus norvegicus
gatgtacttcatcacgatctcccgg

SEQ ID NO: 547209 - DNA, 25 bp, Rattus norvegicus
acgatctcccggttatcataccctg

SEQ ID NO: 547210 - DNA, 25 bp, Rattus norvegicus
tatcataccctgttctcccggcttg

SEQ ID NO: 547211 - DNA, 25 bp, Rattus norvegicus
gcttgcgccatccttccggggaaag

SEQ ID NO: 547212 - DNA, 25 bp, Rattus norvegicus
gcaggtaccaatagcacttcgcgtc

SEQ ID NO: 547213 - DNA, 25 bp, Rattus norvegicus
ttcatctccagtatcccactcgtag

SEQ ID NO: 547214 - DNA, 25 bp, Rattus norvegicus
tgcagtactcttggcggtcagaacc

SEQ ID NO: 547215 - DNA, 25 bp, Rattus norvegicus
gtttgtcctgaacggcactaccagg

SEQ ID NO: 547216 - DNA, 25 bp, Rattus norvegicus
ttctcgtttgtcctgaacggcacta

SEQ ID NO: 547217 - DNA, 25 bp, Rattus norvegicus
ccgggcttctcgtttgtcctgaacg

SEQ ID NO: 547218 - DNA, 25 bp, Rattus norvegicus
gctgaagtagccaatagatgctgga

SEQ ID NO: 547219 - DNA, 25 bp, Rattus norvegicus
tactcttggcggtcagaacccgggc

SEQ ID NO: 547220 - DNA, 25 bp, Rattus norvegicus
cctgaacggcactaccagggcggtg

SEQ ID NO: 547221 - DNA, 25 bp, Rattus norvegicus
gtgtgcagtactcttggcggtcaga

SEQ ID NO: 547222 - DNA, 25 bp, Rattus norvegicus
accccaaatccttaggcagggtgtg

SEQ ID NO: 547223 - DNA, 25 bp, Rattus norvegicus
tcgagcggcggctgaagtagccaat

SEQ ID NO: 547224 - DNA, 25 bp, Rattus norvegicus
cggcggctgaagtagccaatagatg

SEQ ID NO: 547225 - DNA, 25 bp, Rattus norvegicus
tggagcctgctggtctttggcggct

SEQ ID NO: 547226 - DNA, 25 bp, Rattus norvegicus
ccaatagatgctggaggggtggagc

SEQ ID NO: 547227 - DNA, 25 bp, Rattus norvegicus
tcagaacccgggcttctcgtttgtc

SEQ ID NO: 547228 - DNA, 25 bp, Rattus norvegicus
ccagcctttgatttcgccagaagcc

SEQ ID NO: 547229 - DNA, 25 bp, Rattus norvegicus
gagtccagtgggtcctccttttcgc

SEQ ID NO: 547230 - DNA, 25 bp, Rattus norvegicus
tcggaggaacccagcctttgatttc

SEQ ID NO: 547231 - DNA, 25 bp, Rattus norvegicus
gttcgagcccgccttcatccagaaa

SEQ ID NO: 547232 - DNA, 25 bp, Rattus norvegicus
cgggacactccgagccgtcttacta

SEQ ID NO: 547233 - DNA, 25 bp, Rattus norvegicus
ccgagccgtcttactacgatgccta

SEQ ID NO: 547234 - DNA, 25 bp, Rattus norvegicus
gtcttactacgatgcctacactggg

SEQ ID NO: 547235 - DNA, 25 bp, Rattus norvegicus
ctacgatgcctacactggggtgttc

SEQ ID NO: 547236 - DNA, 25 bp, Rattus norvegicus
tgttatacccgggacactccgagcc

SEQ ID NO: 547237 - DNA, 25 bp, Rattus norvegicus
ttcatccagaaacgcaacgagcgcg

SEQ ID NO: 547238 - DNA, 25 bp, Rattus norvegicus
ggtgccctggctgaaaagaggctca

SEQ ID NO: 547239 - DNA, 25 bp, Rattus norvegicus
ccctggctgaaaagaggctcagcaa

SEQ ID NO: 547240 - DNA, 25 bp, Rattus norvegicus
cgccatccgctacatcaagtacttg

SEQ ID NO: 547241 - DNA, 25 bp, Rattus norvegicus
tacatcaagtacttgcaggagctgc

SEQ ID NO: 547242 - DNA, 25 bp, Rattus norvegicus
caccagccgctggtaacgtaggggt

SEQ ID NO: 547243 - DNA, 25 bp, Rattus norvegicus
gcccgcaggacagtcctttagtgag

SEQ ID NO: 547244 - DNA, 25 bp, Rattus norvegicus
tcccaggaggcagactcctaacacg

SEQ ID NO: 547245 - DNA, 25 bp, Rattus norvegicus
ggcagactcctaacacggaaagccc

SEQ ID NO: 547246 - DNA, 25 bp, Rattus norvegicus
ctgctccggagacgtgcacgctcat

SEQ ID NO: 547247 - DNA, 25 bp, Rattus norvegicus
gtgcacgctcatgccaccacttgag

SEQ ID NO: 547248 - DNA, 25 bp, Rattus norvegicus
acttgagctcctctgacacagctgc

SEQ ID NO: 547249 - DNA, 25 bp, Rattus norvegicus
ataggcggcacccacagctgcacga

SEQ ID NO: 547250 - DNA, 25 bp, Rattus norvegicus
tgcaccttcctcgtcataggcggca

SEQ ID NO: 547251 - DNA, 25 bp, Rattus norvegicus
acacagctgccttgctgagtgcccg

SEQ ID NO: 547252 - DNA, 25 bp, Rattus norvegicus
taggggtgcaccttcctcgtcatag

SEQ ID NO: 547253 - DNA, 25 bp, Rattus norvegicus
cacaatgcggctatgggagggcacc

SEQ ID NO: 547254 - DNA, 25 bp, Rattus norvegicus
ggccctcagccaccatcacatagcg

SEQ ID NO: 547255 - DNA, 25 bp, Rattus norvegicus
cctttagtgagggtgtgcgcacaat

SEQ ID NO: 547256 - DNA, 25 bp, Rattus norvegicus
gagcccgcgaaaccgtccattcatt

SEQ ID NO: 547257 - DNA, 25 bp, Rattus norvegicus
cagtgtgcaccctgcgggagcaaca

SEQ ID NO: 547258 - DNA, 25 bp, Rattus norvegicus
agcaacatcgcgagggacgacgctg

SEQ ID NO: 547259 - DNA, 25 bp, Rattus norvegicus
cctgctagaccggtttctgaagtct

SEQ ID NO: 547260 - DNA, 25 bp, Rattus norvegicus
acgaggctcgactagaggtcttagg

SEQ ID NO: 547261 - DNA, 25 bp, Rattus norvegicus
ggcagttttcattccgaagacccta

SEQ ID NO: 547262 - DNA, 25 bp, Rattus norvegicus
ccgaagaccctagcgtggaagaatg

SEQ ID NO: 547263 - DNA, 25 bp, Rattus norvegicus
aagaatgaaaggagacggcgcgccc

SEQ ID NO: 547264 - DNA, 25 bp, Rattus norvegicus
gcctatcccttctggcggccaggga

SEQ ID NO: 547265 - DNA, 25 bp, Rattus norvegicus
actgcggctcgatcgaatcttggtc

SEQ ID NO: 547266 - DNA, 25 bp, Rattus norvegicus
aatcttggtcgcctcgcctcctgag

SEQ ID NO: 547267 - DNA, 25 bp, Rattus norvegicus
agcgcctcctgctgcttgcgacgag

SEQ ID NO: 547268 - DNA, 25 bp, Rattus norvegicus
gcttcggaggcaaggcactcactcc

SEQ ID NO: 547269 - DNA, 25 bp, Rattus norvegicus
cctcacgttgtgttggaacggtgcc

SEQ ID NO: 547270 - DNA, 25 bp, Rattus norvegicus
accgagctgtcatctctggagagcg

SEQ ID NO: 547271 - DNA, 25 bp, Rattus norvegicus
caccacgaaggtgttgcccgtcagg

SEQ ID NO: 547272 - DNA, 25 bp, Rattus norvegicus
ctaccaagcggccaaagcagagttc

SEQ ID NO: 547273 - DNA, 25 bp, Rattus norvegicus
cgtcatcctgaggaggctaccaagc

SEQ ID NO: 547274 - DNA, 25 bp, Rattus norvegicus
tctctttgaagctccggtccacctg

SEQ ID NO: 547275 - DNA, 25 bp, Rattus norvegicus
agagttcgcctttgaggatcggccc

SEQ ID NO: 547276 - DNA, 25 bp, Rattus norvegicus
ttcgcacagctgtggacgaaagcta

SEQ ID NO: 547277 - DNA, 25 bp, Rattus norvegicus
ccggagtctcgccaggtagaaaaga

SEQ ID NO: 547278 - DNA, 25 bp, Rattus norvegicus
acgaagacgctctccacggtgaaga

SEQ ID NO: 547279 - DNA, 25 bp, Rattus norvegicus
tcggctgcaacctccggtagagcaa

SEQ ID NO: 547280 - DNA, 25 bp, Rattus norvegicus
ccgccagcgcgaagctgctgatttt

SEQ ID NO: 547281 - DNA, 25 bp, Rattus norvegicus
cagcaggagatagatgaccgggttc

SEQ ID NO: 547282 - DNA, 25 bp, Rattus norvegicus
ccgccaagtgcagtacgaaggtgtc

SEQ ID NO: 547283 - DNA, 25 bp, Rattus norvegicus
ctgattttgcacaggccatcgccga

SEQ ID NO: 547284 - DNA, 25 bp, Rattus norvegicus
accctgacttggtctgtggagcttc

SEQ ID NO: 547285 - DNA, 25 bp, Rattus norvegicus
ccgctcgtcccggtcctcgtgacgt

SEQ ID NO: 547286 - DNA, 25 bp, Rattus norvegicus
tgcgggttagatcacgccgctcgtc

SEQ ID NO: 547287 - DNA, 25 bp, Rattus norvegicus
tgtgctccataacctgcgtgctaga

SEQ ID NO: 547288 - DNA, 25 bp, Rattus norvegicus
gttcctgtgctccataacctgcgtg

SEQ ID NO: 547289 - DNA, 25 bp, Rattus norvegicus
tcgtgcctccggctcccgttcctgt

SEQ ID NO: 547290 - DNA, 25 bp, Rattus norvegicus
agcttcccggcttctcggccggagg

SEQ ID NO: 547291 - DNA, 25 bp, Rattus norvegicus
gaccctcaaaccctgacttggtctg

SEQ ID NO: 547292 - DNA, 25 bp, Rattus norvegicus
gcgtagccaggtggagctccgcctc

SEQ ID NO: 547293 - DNA, 25 bp, Rattus norvegicus
cacgtcaccgcgagggcgtagccag

SEQ ID NO: 547294 - DNA, 25 bp, Rattus norvegicus
cgcagcacgtcaccgcgagggcgta

SEQ ID NO: 547295 - DNA, 25 bp, Rattus norvegicus
ataacctgcgtgctagacggcggct

SEQ ID NO: 547296 - DNA, 25 bp, Rattus norvegicus
acttggtctgtggagcttcccggct

SEQ ID NO: 547297 - DNA, 25 bp, Rattus norvegicus
gtgcaccgcccaccgcagcacgtca

SEQ ID NO: 547298 - DNA, 25 bp, Rattus norvegicus
tatgctgttccctcccgtgggcgct

SEQ ID NO: 547299 - DNA, 25 bp, Rattus norvegicus
atacaggtgcgttgttaccagcggg

SEQ ID NO: 547300 - DNA, 25 bp, Rattus norvegicus
ccagcgggtggaccgctttcctctg

SEQ ID NO: 547301 - DNA, 25 bp, Rattus norvegicus
ctatgacccgggtggtggactctgc

SEQ ID NO: 547302 - DNA, 25 bp, Rattus norvegicus
tctgccttccgcgtggctagcatac

SEQ ID NO: 547303 - DNA, 25 bp, Rattus norvegicus
gcgtggctagcatacggttagtgta

SEQ ID NO: 547304 - DNA, 25 bp, Rattus norvegicus
tagtgtaggggaaaagtctgacctg

SEQ ID NO: 547305 - DNA, 25 bp, Rattus norvegicus
tctgacctgtgtatcttagagcctg

SEQ ID NO: 547306 - DNA, 25 bp, Rattus norvegicus
tatcttagagcctgcgctttggttc

SEQ ID NO: 547307 - DNA, 25 bp, Rattus norvegicus
tgcgctttggttctatgctgttccc

SEQ ID NO: 547308 - DNA, 25 bp, Rattus norvegicus
ttggttctatgctgttccctttcgt

SEQ ID NO: 547309 - DNA, 25 bp, Rattus norvegicus
cgctgttttggcctctagagcatgc

SEQ ID NO: 547310 - DNA, 25 bp, Rattus norvegicus
ctgcacacggcgctgttttggcctc

SEQ ID NO: 547311 - DNA, 25 bp, Rattus norvegicus
gcgcacggcgctgttttggcctcta

SEQ ID NO: 547312 - DNA, 25 bp, Rattus norvegicus
cgtcccatccggaagcctagagctg

SEQ ID NO: 547313 - DNA, 25 bp, Rattus norvegicus
tgagccctgagtactgagggtttga

SEQ ID NO: 547314 - DNA, 25 bp, Rattus norvegicus
ctctccgagctgaggttcgagctga

SEQ ID NO: 547315 - DNA, 25 bp, Rattus norvegicus
gaggttctgtggttgctcgtccaga

SEQ ID NO: 547316 - DNA, 25 bp, Rattus norvegicus
ctcgtccagagagccggtaggctga

SEQ ID NO: 547317 - DNA, 25 bp, Rattus norvegicus
gtgttcgcccagcatacccgggtgc

SEQ ID NO: 547318 - DNA, 25 bp, Rattus norvegicus
ggtcccggtacactgtcacagcctg

SEQ ID NO: 547319 - DNA, 25 bp, Rattus norvegicus
tcacagcctggcgtgactgccatag

SEQ ID NO: 547320 - DNA, 25 bp, Rattus norvegicus
ctgccatagtcgtctggagcctagg

SEQ ID NO: 547321 - DNA, 25 bp, Rattus norvegicus
atcgggaagcaaggcgcgcattcaa

SEQ ID NO: 547322 - DNA, 25 bp, Rattus norvegicus
ggcgcggcacttgacgctatactca

SEQ ID NO: 547323 - DNA, 25 bp, Rattus norvegicus
tatactcagcgaccaatcgggaagc

SEQ ID NO: 547324 - DNA, 25 bp, Rattus norvegicus
cattcaaattgctgcagccgcggga

SEQ ID NO: 547325 - DNA, 25 bp, Rattus norvegicus
tctcgcggtagaagctgcgcttccg

SEQ ID NO: 547326 - DNA, 25 bp, Rattus norvegicus
tgtcacagtccgctgtaacattgtc

SEQ ID NO: 547327 - DNA, 25 bp, Rattus norvegicus
cacagtccgctgtaacgttgtcaca

SEQ ID NO: 547328 - DNA, 25 bp, Rattus norvegicus
cacagtccgctgtaacattgtcaca

SEQ ID NO: 547329 - DNA, 25 bp, Rattus norvegicus
agtctgctgtaacgttgtcacagtc

SEQ ID NO: 547330 - DNA, 25 bp, Rattus norvegicus
gtcacagtccgctgtaacattgtca

SEQ ID NO: 547331 - DNA, 25 bp, Rattus norvegicus
cacagtctgctgtaacgttggtcca

SEQ ID NO: 547332 - DNA, 25 bp, Rattus norvegicus
tggtccagtccgctgtaacattgtc

SEQ ID NO: 547333 - DNA, 25 bp, Rattus norvegicus
tgtaacattgtcacagtccgctgta

SEQ ID NO: 547334 - DNA, 25 bp, Rattus norvegicus
ccgctgtaacgttgtcacagtctgc

SEQ ID NO: 547335 - DNA, 25 bp, Rattus norvegicus
agtctgctgtaacgttggtccagtc

SEQ ID NO: 547336 - DNA, 25 bp, Rattus norvegicus
agtccgctgtaacgttgtcacagtc

SEQ ID NO: 547337 - DNA, 25 bp, Rattus norvegicus
cacagtctgctgtaacgttgtcaca

SEQ ID NO: 547338 - DNA, 25 bp, Rattus norvegicus
gtcacagtccgctgtaacgttgtca

SEQ ID NO: 547339 - DNA, 25 bp, Rattus norvegicus
gtctgctgtaacgttggtccagtcc

SEQ ID NO: 547340 - DNA, 25 bp, Rattus norvegicus
caggcgcactgagctcgcagagctc

SEQ ID NO: 547341 - DNA, 25 bp, Rattus norvegicus
actgagctcgcagagctctcctctg

SEQ ID NO: 547342 - DNA, 25 bp, Rattus norvegicus
agctctcctctggtccggtcgagga

SEQ ID NO: 547343 - DNA, 25 bp, Rattus norvegicus
ccggtcgaggagttcccggcagaca

SEQ ID NO: 547344 - DNA, 25 bp, Rattus norvegicus
tctgccaggcggaaactgaggcgca

SEQ ID NO: 547345 - DNA, 25 bp, Rattus norvegicus
gccacgctgcaacacgctctcccgg

SEQ ID NO: 547346 - DNA, 25 bp, Rattus norvegicus
tgagttccacctcccgagcgacttt

SEQ ID NO: 547347 - DNA, 25 bp, Rattus norvegicus
tcagccactttctgctcctaggcag

SEQ ID NO: 547348 - DNA, 25 bp, Rattus norvegicus
tgctcctaggcagagccaccaatca

SEQ ID NO: 547349 - DNA, 25 bp, Rattus norvegicus
aatcacgtcccctcgctgcggaaga

SEQ ID NO: 547350 - DNA, 25 bp, Rattus norvegicus
tcgctgcggaagaccctccgctgtc

SEQ ID NO: 547351 - DNA, 25 bp, Rattus norvegicus
ctccgctgtccgtctcttaagtccc

SEQ ID NO: 547352 - DNA, 25 bp, Rattus norvegicus
cccttgattgacaggtctgccaggc

SEQ ID NO: 547353 - DNA, 25 bp, Rattus norvegicus
gacaggtctgccaggcggaaactga

SEQ ID NO: 547354 - DNA, 25 bp, Rattus norvegicus
ccggcggcgtcagccgcggccttcc

SEQ ID NO: 547355 - DNA, 25 bp, Rattus norvegicus
tttcaagaaggagccggcggcgtca

SEQ ID NO: 547356 - DNA, 25 bp, Rattus norvegicus
tgactttcaagaaggagccggcggc

SEQ ID NO: 547357 - DNA, 25 bp, Rattus norvegicus
acatgactttcaagaaggagccggc

SEQ ID NO: 547358 - DNA, 25 bp, Rattus norvegicus
cccggacatgactttcaagaaggag

SEQ ID NO: 547359 - DNA, 25 bp, Rattus norvegicus
gtgttatcctcctctacctccgcag

SEQ ID NO: 547360 - DNA, 25 bp, Rattus norvegicus
agtgcgtgttatcctcctctacctc

SEQ ID NO: 547361 - DNA, 25 bp, Rattus norvegicus
cgcagtgcgtgttatcctcctctac

SEQ ID NO: 547362 - DNA, 25 bp, Rattus norvegicus
ggtcaccagcttcacccggcctgcg

SEQ ID NO: 547363 - DNA, 25 bp, Rattus norvegicus
tggttatgttcaaccaccggctccc

SEQ ID NO: 547364 - DNA, 25 bp, Rattus norvegicus
agtatggttatgttcaaccaccggc

SEQ ID NO: 547365 - DNA, 25 bp, Rattus norvegicus
cccagagtatggttatgttcaacca

SEQ ID NO: 547366 - DNA, 25 bp, Rattus norvegicus
agagctgagatggagcccaccttcc

SEQ ID NO: 547367 - DNA, 25 bp, Rattus norvegicus
caggagagctgagatggagcccacc

SEQ ID NO: 547368 - DNA, 25 bp, Rattus norvegicus
ggatcggtatccaccagaccgcttc

SEQ ID NO: 547369 - DNA, 25 bp, Rattus norvegicus
cggagcgcctgatttcctgtacgta

SEQ ID NO: 547370 - DNA, 25 bp, Rattus norvegicus
acttcattctccgtcggagcgcctg

SEQ ID NO: 547371 - DNA, 25 bp, Rattus norvegicus
cagcccgttccgtggtgacggctgc

SEQ ID NO: 547372 - DNA, 25 bp, Rattus norvegicus
aaaggatgactgctacgaagttccc

SEQ ID NO: 547373 - DNA, 25 bp, Rattus norvegicus
gcttgctaaatgcaggcaaggacgc

SEQ ID NO: 547374 - DNA, 25 bp, Rattus norvegicus
ttctgattaaactccgaagggccaa

SEQ ID NO: 547375 - DNA, 25 bp, Rattus norvegicus
acacacgctggagcgcaggcatgga

SEQ ID NO: 547376 - DNA, 25 bp, Rattus norvegicus
agaccgcttcagacctccaggggag

SEQ ID NO: 547377 - DNA, 25 bp, Rattus norvegicus
agcgcaggcatggatcggtatccac

SEQ ID NO: 547378 - DNA, 25 bp, Rattus norvegicus
cctgtacgtacgtcaccgttcattc

SEQ ID NO: 547379 - DNA, 25 bp, Rattus norvegicus
tccgaagggccaatgcgttttccga

SEQ ID NO: 547380 - DNA, 25 bp, Rattus norvegicus
agacctccaggggagagacacgcca

SEQ ID NO: 547381 - DNA, 25 bp, Rattus norvegicus
ggggaccagaatcctcttctgatta

SEQ ID NO: 547382 - DNA, 25 bp, Rattus norvegicus
ttgatgagaaagcaccgtccgccta

SEQ ID NO: 547383 - DNA, 25 bp, Rattus norvegicus
agaagaccgctttcagctgcccagg

SEQ ID NO: 547384 - DNA, 25 bp, Rattus norvegicus
ggctaccacgcctgactaagaagac

SEQ ID NO: 547385 - DNA, 25 bp, Rattus norvegicus
tcaaagctgtccgtgagctgcgcgc

SEQ ID NO: 547386 - DNA, 25 bp, Rattus norvegicus
gccctgtccggttcagcagcttcaa

SEQ ID NO: 547387 - DNA, 25 bp, Rattus norvegicus
tccagcggaaagacaaggggtgatc

SEQ ID NO: 547388 - DNA, 25 bp, Rattus norvegicus
cacgggcagcacagattcaactcca

SEQ ID NO: 547389 - DNA, 25 bp, Rattus norvegicus
ctccactttgggcagcatgacaagg

SEQ ID NO: 547390 - DNA, 25 bp, Rattus norvegicus
gtcctgaggcttccgtctccacttt

SEQ ID NO: 547391 - DNA, 25 bp, Rattus norvegicus
taccttgcatgttttccggcatctg

SEQ ID NO: 547392 - DNA, 25 bp, Rattus norvegicus
tgtaaaagccaagagccggagcgcc

SEQ ID NO: 547393 - DNA, 25 bp, Rattus norvegicus
gggctgctctagtgcccatgctgca

SEQ ID NO: 547394 - DNA, 25 bp, Rattus norvegicus
cgtccgcctagttcaagtgccatta

SEQ ID NO: 547395 - DNA, 25 bp, Rattus norvegicus
cgaatcgcaaactgccggccgggct

SEQ ID NO: 547396 - DNA, 25 bp, Rattus norvegicus
tgcccttgacctgacctaagaagcg

SEQ ID NO: 547397 - DNA, 25 bp, Rattus norvegicus
acctgacctaagaagcgccgatccg

SEQ ID NO: 547398 - DNA, 25 bp, Rattus norvegicus
ggagaataaacctgcccttgacctg

SEQ ID NO: 547399 - DNA, 25 bp, Rattus norvegicus
cttgatgagcccgagaagcgcaggc

SEQ ID NO: 547400 - DNA, 25 bp, Rattus norvegicus
aagcgcaggcctggcatattttatc

SEQ ID NO: 547401 - DNA, 25 bp, Rattus norvegicus
ggcctggcatattttatccagcctc

SEQ ID NO: 547402 - DNA, 25 bp, Rattus norvegicus
ggagctgacgaggtctcgcactccc

SEQ ID NO: 547403 - DNA, 25 bp, Rattus norvegicus
cccacccgcgaggatgcaactgaaa

SEQ ID NO: 547404 - DNA, 25 bp, Rattus norvegicus
atgcaactgaaaagttttcctccgg

SEQ ID NO: 547405 - DNA, 25 bp, Rattus norvegicus
gtcttctcccttccggaggtggcga

SEQ ID NO: 547406 - DNA, 25 bp, Rattus norvegicus
ccttccggaggtggcgaacctctcg

SEQ ID NO: 547407 - DNA, 25 bp, Rattus norvegicus
gaacctctcggtggagcacgcacac

SEQ ID NO: 547408 - DNA, 25 bp, Rattus norvegicus
tggagcacgcacacggagaataaac

SEQ ID NO: 547409 - DNA, 25 bp, Rattus norvegicus
ggaggctcccgcagccttgatgagc

SEQ ID NO: 547410 - DNA, 25 bp, Rattus norvegicus
ctatgcctgtgagctggctcaggtg

SEQ ID NO: 547411 - DNA, 25 bp, Rattus norvegicus
gctcaggtgctcagcgatcagctcc

SEQ ID NO: 547412 - DNA, 25 bp, Rattus norvegicus
aggtgctcagcgatcagctccagtc

SEQ ID NO: 547413 - DNA, 25 bp, Rattus norvegicus
tcagcgatcagctccagtcccttgt

SEQ ID NO: 547414 - DNA, 25 bp, Rattus norvegicus
gtgatgcgcacacactgtccaatgt

SEQ ID NO: 547415 - DNA, 25 bp, Rattus norvegicus
tgcgcacacactgtccaatgttgag

SEQ ID NO: 547416 - DNA, 25 bp, Rattus norvegicus
cacacactgtccaatgttgagcgtg

SEQ ID NO: 547417 - DNA, 25 bp, Rattus norvegicus
cactgtccaatgttgagcgtgcgca

SEQ ID NO: 547418 - DNA, 25 bp, Rattus norvegicus
tgtccaatgttgagcgtgcgcagcc

SEQ ID NO: 547419 - DNA, 25 bp, Rattus norvegicus
ccaatgttgagcgtgcgcagcccgt

SEQ ID NO: 547420 - DNA, 25 bp, Rattus norvegicus
ttgagcgtgcgcagcccgtgcatct

SEQ ID NO: 547421 - DNA, 25 bp, Rattus norvegicus
agctggctcaggtgctcagcgatca

SEQ ID NO: 547422 - DNA, 25 bp, Rattus norvegicus
ccgcaccatgcggttgatgccatcg

SEQ ID NO: 547423 - DNA, 25 bp, Rattus norvegicus
gtgcatctgccgcaccatgcggttg

SEQ ID NO: 547424 - DNA, 25 bp, Rattus norvegicus
aacaggcacgagatgtgggtctcca

SEQ ID NO: 547425 - DNA, 25 bp, Rattus norvegicus
tccaggcccttgaggtactgggcta

SEQ ID NO: 547426 - DNA, 25 bp, Rattus norvegicus
ccaggcccttgaggtactgggctat

SEQ ID NO: 547427 - DNA, 25 bp, Rattus norvegicus
aggcccttgaggtactgggctatgc

SEQ ID NO: 547428 - DNA, 25 bp, Rattus norvegicus
ccaggctgctgtctgtgatctgctt

SEQ ID NO: 547429 - DNA, 25 bp, Rattus norvegicus
aggctgctgtctgtgatctgcttgc

SEQ ID NO: 547430 - DNA, 25 bp, Rattus norvegicus
cctccaggcccttgaggtactgggc

SEQ ID NO: 547431 - DNA, 25 bp, Rattus norvegicus
gctgctgtctgtgatctgcttgcag

SEQ ID NO: 547432 - DNA, 25 bp, Rattus norvegicus
caggcacgagatgtgggtctccatc

SEQ ID NO: 547433 - DNA, 25 bp, Rattus norvegicus
ggcacgagatgtgggtctccatctt

SEQ ID NO: 547434 - DNA, 25 bp, Rattus norvegicus
cacgagatgtgggtctccatcttcc

SEQ ID NO: 547435 - DNA, 25 bp, Rattus norvegicus
cgagatgtgggtctccatcttcctc

SEQ ID NO: 547436 - DNA, 25 bp, Rattus norvegicus
ggctgctgtctgtgatctgcttgca

SEQ ID NO: 547437 - DNA, 25 bp, Rattus norvegicus
cacctccaggcccttgaggtactgg

SEQ ID NO: 547438 - DNA, 25 bp, Rattus norvegicus
atcctcagaggcacgcgagtccgag

SEQ ID NO: 547439 - DNA, 25 bp, Rattus norvegicus
gcagcttaatcggttgagccaatcc

SEQ ID NO: 547440 - DNA, 25 bp, Rattus norvegicus
gggccgtgcatactcaccagggcgc

SEQ ID NO: 547441 - DNA, 25 bp, Rattus norvegicus
cggcctggcggatcctcagaggcac

SEQ ID NO: 547442 - DNA, 25 bp, Rattus norvegicus
ctccaccagttgtaggcggcctggc

SEQ ID NO: 547443 - DNA, 25 bp, Rattus norvegicus
tgcaccgcgctccaccagttgtagg

SEQ ID NO: 547444 - DNA, 25 bp, Rattus norvegicus
agttcctcctgtccgagcccggaga

SEQ ID NO: 547445 - DNA, 25 bp, Rattus norvegicus
ggcagctcgatccacgcgggctgca

SEQ ID NO: 547446 - DNA, 25 bp, Rattus norvegicus
tgaccaatgagctctgcccggaggc

SEQ ID NO: 547447 - DNA, 25 bp, Rattus norvegicus
gccaaggtgaccaatgagctctgcc

SEQ ID NO: 547448 - DNA, 25 bp, Rattus norvegicus
cgcgatcggtaaatagccaaggtga

SEQ ID NO: 547449 - DNA, 25 bp, Rattus norvegicus
cggttgagccaatccgcgatcggta

SEQ ID NO: 547450 - DNA, 25 bp, Rattus norvegicus
gcgggtcttcactggagttcctcct

SEQ ID NO: 547451 - DNA, 25 bp, Rattus norvegicus
tcaggagggtaaacatcccggcatc

SEQ ID NO: 547452 - DNA, 25 bp, Rattus norvegicus
tgctgccatcctgcggggaccggca

SEQ ID NO: 547453 - DNA, 25 bp, Rattus norvegicus
cccgcgagaaggtcaagtggctccg

SEQ ID NO: 547454 - DNA, 25 bp, Rattus norvegicus
agctccaccgcattccgctgacagg

SEQ ID NO: 547455 - DNA, 25 bp, Rattus norvegicus
ggaaacggagcagctccaccgcatt

SEQ ID NO: 547456 - DNA, 25 bp, Rattus norvegicus
gttgccttggaaacggagcagctcc

SEQ ID NO: 547457 - DNA, 25 bp, Rattus norvegicus
gggccctgcacagttgccttggaaa

SEQ ID NO: 547458 - DNA, 25 bp, Rattus norvegicus
tccgacttgctgagcttgggatgcc

SEQ ID NO: 547459 - DNA, 25 bp, Rattus norvegicus
cacgggagggccagtccttactcct

SEQ ID NO: 547460 - DNA, 25 bp, Rattus norvegicus
ggccgggatcttccgacttgctgag

SEQ ID NO: 547461 - DNA, 25 bp, Rattus norvegicus
agtccttactcctcccttgctgcca

SEQ ID NO: 547462 - DNA, 25 bp, Rattus norvegicus
accaagccacgggagggccagtcct

SEQ ID NO: 547463 - DNA, 25 bp, Rattus norvegicus
agtggccagtcatgtcctggggacc

SEQ ID NO: 547464 - DNA, 25 bp, Rattus norvegicus
gggatcttccgacttgctgagcttg

SEQ ID NO: 547465 - DNA, 25 bp, Rattus norvegicus
tcatgtcctggggaccaagccacgg

SEQ ID NO: 547466 - DNA, 25 bp, Rattus norvegicus
gcctagcaagcacgcctgcggggaa

SEQ ID NO: 547467 - DNA, 25 bp, Rattus norvegicus
cacgaattgttttcggctcggcacc

SEQ ID NO: 547468 - DNA, 25 bp, Rattus norvegicus
tccggagattccgtggaagagcatg

SEQ ID NO: 547469 - DNA, 25 bp, Rattus norvegicus
ccatgataccttggatgtggcctcc

SEQ ID NO: 547470 - DNA, 25 bp, Rattus norvegicus
cggtcttggatctgcgctccatttc

SEQ ID NO: 547471 - DNA, 25 bp, Rattus norvegicus
tgagctgagtgcctttggccagacg

SEQ ID NO: 547472 - DNA, 25 bp, Rattus norvegicus
gccggagatttgcagttttcccagc

SEQ ID NO: 547473 - DNA, 25 bp, Rattus norvegicus
gcgatcagctgctatacaaagactg

SEQ ID NO: 547474 - DNA, 25 bp, Rattus norvegicus
ctgcggggaaaacctagcgagcatc

SEQ ID NO: 547475 - DNA, 25 bp, Rattus norvegicus
tcctagacacctcgattcggaaagg

SEQ ID NO: 547476 - DNA, 25 bp, Rattus norvegicus
ctggggctctcagttcattcgagtg

SEQ ID NO: 547477 - DNA, 25 bp, Rattus norvegicus
ttcgagtgaagaagcaaaggcgacc

SEQ ID NO: 547478 - DNA, 25 bp, Rattus norvegicus
tagcgagcatccctaggcaaacgtc

SEQ ID NO: 547479 - DNA, 25 bp, Rattus norvegicus
ttccataaacacacgcctggggctc

SEQ ID NO: 547480 - DNA, 25 bp, Rattus norvegicus
tgagcagagctgctgtcggaagtct

SEQ ID NO: 547481 - DNA, 25 bp, Rattus norvegicus
aggaccttctgagcggacgcaccag

SEQ ID NO: 547482 - DNA, 25 bp, Rattus norvegicus
agtcttcggcccagggcggtgacct

SEQ ID NO: 547483 - DNA, 25 bp, Rattus norvegicus
agctgctgtcggaagtcttcggccc

SEQ ID NO: 547484 - DNA, 25 bp, Rattus norvegicus
cgccggtgttaactctcggttcact

SEQ ID NO: 547485 - DNA, 25 bp, Rattus norvegicus
cgatgtgcctctccgccggtgttaa

SEQ ID NO: 547486 - DNA, 25 bp, Rattus norvegicus
ccgcaggctccctcggaagcggaat

SEQ ID NO: 547487 - DNA, 25 bp, Rattus norvegicus
gtgcagctcggcgatgtgcctctcc

SEQ ID NO: 547488 - DNA, 25 bp, Rattus norvegicus
tctcggttcactggatgcctctgct

SEQ ID NO: 547489 - DNA, 25 bp, Rattus norvegicus
cgggtttctcgcaggaccttctgag

SEQ ID NO: 547490 - DNA, 25 bp, Rattus norvegicus
aagtgtgaccgggtttctcgcagga

SEQ ID NO: 547491 - DNA, 25 bp, Rattus norvegicus
cagggcggtgacctcccaagtgctt

SEQ ID NO: 547492 - DNA, 25 bp, Rattus norvegicus
gcttgtctcgacagcgcccggatac

SEQ ID NO: 547493 - DNA, 25 bp, Rattus norvegicus
ctcccaagtgcttgtctcgacagcg

SEQ ID NO: 547494 - DNA, 25 bp, Rattus norvegicus
cccatttgcaatgaatgagagtcgc

SEQ ID NO: 547495 - DNA, 25 bp, Rattus norvegicus
ggaagccggagcatccacttgagct

SEQ ID NO: 547496 - DNA, 25 bp, Rattus norvegicus
gaaagcggcgtttgtttatgccggc

SEQ ID NO: 547497 - DNA, 25 bp, Rattus norvegicus
gcctgagatgctttctgatcctttt

SEQ ID NO: 547498 - DNA, 25 bp, Rattus norvegicus
tgattttccacggtggcctgagatg

SEQ ID NO: 547499 - DNA, 25 bp, Rattus norvegicus
gctccctttaggatgattttccacg

SEQ ID NO: 547500 - DNA, 25 bp, Rattus norvegicus
acatgtgaccatggaccgcaggacc

SEQ ID NO: 547501 - DNA, 25 bp, Rattus norvegicus
aatgagagtcgcgatgtgggaaccc

SEQ ID NO: 547502 - DNA, 25 bp, Rattus norvegicus
cagaagccggttcccaggacagcag

SEQ ID NO: 547503 - DNA, 25 bp, Rattus norvegicus
ccatggaccgcaggaccaggtgagc

SEQ ID NO: 547504 - DNA, 25 bp, Rattus norvegicus
cgccgacttcctggttcgcggaagg

SEQ ID NO: 547505 - DNA, 25 bp, Rattus norvegicus
cgtatcagcgcgtcccggacggcgt

SEQ ID NO: 547506 - DNA, 25 bp, Rattus norvegicus
cccgcagcgacatgtgaccatggac

SEQ ID NO: 547507 - DNA, 25 bp, Rattus norvegicus
gttaggatcgtcgttgctcccttta

SEQ ID NO: 547508 - DNA, 25 bp, Rattus norvegicus
tgcgctggccttattgtcacggtca

SEQ ID NO: 547509 - DNA, 25 bp, Rattus norvegicus
gcgactgcgcgcgactgacgtgcct

SEQ ID NO: 547510 - DNA, 25 bp, Rattus norvegicus
gtctgcaaggtttgcagcctcggcg

SEQ ID NO: 547511 - DNA, 25 bp, Rattus norvegicus
cgggccaaccagtctgcaaggtttg

SEQ ID NO: 547512 - DNA, 25 bp, Rattus norvegicus
tgcagtccgggccaaccagtctgca

SEQ ID NO: 547513 - DNA, 25 bp, Rattus norvegicus
attgtcacggtcacagcacccaaac

SEQ ID NO: 547514 - DNA, 25 bp, Rattus norvegicus
gcatgctaatggagacttgcttttc

SEQ ID NO: 547515 - DNA, 25 bp, Rattus norvegicus
gctcgcccggggaaagcatgctaat

SEQ ID NO: 547516 - DNA, 25 bp, Rattus norvegicus
cggaaggtctgtctctctggagcca

SEQ ID NO: 547517 - DNA, 25 bp, Rattus norvegicus
cctagtggatttcggaaggtctgtc

SEQ ID NO: 547518 - DNA, 25 bp, Rattus norvegicus
aaggcttcgcttcctgcagtcgtcg

SEQ ID NO: 547519 - DNA, 25 bp, Rattus norvegicus
cgcgcatgcgctttggcggatgccc

SEQ ID NO: 547520 - DNA, 25 bp, Rattus norvegicus
agacttgcttttcgcggctgcgctg

SEQ ID NO: 547521 - DNA, 25 bp, Rattus norvegicus
gccgccctgcctagtggatttcgga

SEQ ID NO: 547522 - DNA, 25 bp, Rattus norvegicus
gccggtgctattgctcagccacttc

SEQ ID NO: 547523 - DNA, 25 bp, Rattus norvegicus
gccagggcttcagcgcgtcgccgaa

SEQ ID NO: 547524 - DNA, 25 bp, Rattus norvegicus
agcctctgcatgtggagctgtcgct

SEQ ID NO: 547525 - DNA, 25 bp, Rattus norvegicus
cgcacgcggagcctctgcatgtgga

SEQ ID NO: 547526 - DNA, 25 bp, Rattus norvegicus
tggtcctgcacaacccgcacgcgga

SEQ ID NO: 547527 - DNA, 25 bp, Rattus norvegicus
tacgcggtctctggtcctgcacaac

SEQ ID NO: 547528 - DNA, 25 bp, Rattus norvegicus
gtacgtcgcgtacgcggtctctggt

SEQ ID NO: 547529 - DNA, 25 bp, Rattus norvegicus
atgtccgcgtgggtacgtcgcgtac

SEQ ID NO: 547530 - DNA, 25 bp, Rattus norvegicus
cttcctctgtttcggggatgtccgc

SEQ ID NO: 547531 - DNA, 25 bp, Rattus norvegicus
tcagccacttctgcgccgttccctt

SEQ ID NO: 547532 - DNA, 25 bp, Rattus norvegicus
gaggacgcgtctccgccggtgctat

SEQ ID NO: 547533 - DNA, 25 bp, Rattus norvegicus
ccgaaccgctgcgagctgcaggtag

SEQ ID NO: 547534 - DNA, 25 bp, Rattus norvegicus
gtcgccgaaccgctgcgagctgcag

SEQ ID NO: 547535 - DNA, 25 bp, Rattus norvegicus
tcccttcctctgtttcggggatgtc

SEQ ID NO: 547536 - DNA, 25 bp, Rattus norvegicus
ttcggtggcccaagccggccaagca

SEQ ID NO: 547537 - DNA, 25 bp, Rattus norvegicus
ttcctgaggtcggacagggcaaggt

SEQ ID NO: 547538 - DNA, 25 bp, Rattus norvegicus
ggcggccagcagcaacatctctctg

SEQ ID NO: 547539 - DNA, 25 bp, Rattus norvegicus
cccgagcgtctactgggagatcaca

SEQ ID NO: 547540 - DNA, 25 bp, Rattus norvegicus
cccggcaagctcagcaacaggaggc

SEQ ID NO: 547541 - DNA, 25 bp, Rattus norvegicus
gcctccgccgtctgacttgctttcg

SEQ ID NO: 547542 - DNA, 25 bp, Rattus norvegicus
tgggagatcacatgcaccagcagcc

SEQ ID NO: 547543 - DNA, 25 bp, Rattus norvegicus
cccattctgcatctggctgcggctg

SEQ ID NO: 547544 - DNA, 25 bp, Rattus norvegicus
atctctctgcccgagcgtctactgg

SEQ ID NO: 547545 - DNA, 25 bp, Rattus norvegicus
tagaggagtagcacgaaggccacga

SEQ ID NO: 547546 - DNA, 25 bp, Rattus norvegicus
acaccatgtagaggagtagcacgaa

SEQ ID NO: 547547 - DNA, 25 bp, Rattus norvegicus
cggcgacaccatgtagaggagtagc

SEQ ID NO: 547548 - DNA, 25 bp, Rattus norvegicus
aggaggccactcaccactacgtgcg

SEQ ID NO: 547549 - DNA, 25 bp, Rattus norvegicus
atcacatgcaccagcagccgggagt

SEQ ID NO: 547550 - DNA, 25 bp, Rattus norvegicus
ctcttctggcgaaagagctgcggtc

SEQ ID NO: 547551 - DNA, 25 bp, Rattus norvegicus
gtgcctagccatcacgcggtgctca

SEQ ID NO: 547552 - DNA, 25 bp, Rattus norvegicus
atgccctagtgggaggctctggtcc

SEQ ID NO: 547553 - DNA, 25 bp, Rattus norvegicus
ctggtccttgcctttcaggaaagtg

SEQ ID NO: 547554 - DNA, 25 bp, Rattus norvegicus
cctttcaggaaagtgcctagccatc

SEQ ID NO: 547555 - DNA, 25 bp, Rattus norvegicus
aaagtgcctagccatcacgcggtgc

SEQ ID NO: 547556 - DNA, 25 bp, Rattus norvegicus
tcacacccaccacctgccctctttc

SEQ ID NO: 547557 - DNA, 25 bp, Rattus norvegicus
cctctttctaggcaccgcgcgaatt

SEQ ID NO: 547558 - DNA, 25 bp, Rattus norvegicus
taggcaccgcgcgaattttcttttc

SEQ ID NO: 547559 - DNA, 25 bp, Rattus norvegicus
ttctaggaaccagaggcggcgccga

SEQ ID NO: 547560 - DNA, 25 bp, Rattus norvegicus
gctgcgcccagtgcttgctcttctg

SEQ ID NO: 547561 - DNA, 25 bp, Rattus norvegicus
cggttccttggcagcgctggttcaa

SEQ ID NO: 547562 - DNA, 25 bp, Rattus norvegicus
tccttggcagcgctggttcaagtcg

SEQ ID NO: 547563 - DNA, 25 bp, Rattus norvegicus
ttgtcggtgaagtaacttttgcatc

SEQ ID NO: 547564 - DNA, 25 bp, Rattus norvegicus
ggtgatttactttccctgcgccagg

SEQ ID NO: 547565 - DNA, 25 bp, Rattus norvegicus
gcagcacgggcagaagccacccagg

SEQ ID NO: 547566 - DNA, 25 bp, Rattus norvegicus
ccgcgctatataaggcaaggccccg

SEQ ID NO: 547567 - DNA, 25 bp, Rattus norvegicus
gcggagaacgcctgactgacccacg

SEQ ID NO: 547568 - DNA, 25 bp, Rattus norvegicus
gactgacccacgctccgccagggcc

SEQ ID NO: 547569 - DNA, 25 bp, Rattus norvegicus
tttactttccctgcgccaggcttcg

SEQ ID NO: 547570 - DNA, 25 bp, Rattus norvegicus
gtccgcgtctacgacagcagcacgg

SEQ ID NO: 547571 - DNA, 25 bp, Rattus norvegicus
agcgcgcactgggtgatttactttc

SEQ ID NO: 547572 - DNA, 25 bp, Rattus norvegicus
actttcgatcccagagcgcgcactg

SEQ ID NO: 547573 - DNA, 25 bp, Rattus norvegicus
tgctgggcgcttccgcactttcgat

SEQ ID NO: 547574 - DNA, 25 bp, Rattus norvegicus
gagccttagcggaatcgcgcccggc

SEQ ID NO: 547575 - DNA, 25 bp, Rattus norvegicus
gggcacgccgccgactctgggaaac

SEQ ID NO: 547576 - DNA, 25 bp, Rattus norvegicus
tgctgagccttagcggaatcgcgcc

SEQ ID NO: 547577 - DNA, 25 bp, Rattus norvegicus
ctacgacagcagcacgggcagaagc

SEQ ID NO: 547578 - DNA, 25 bp, Rattus norvegicus
aggatgcgaatttggaggctcgtgg

SEQ ID NO: 547579 - DNA, 25 bp, Rattus norvegicus
cgggcaggtgagagcctcgctctac

SEQ ID NO: 547580 - DNA, 25 bp, Rattus norvegicus
tggccatgtcctggtaccgcgcggc

SEQ ID NO: 547581 - DNA, 25 bp, Rattus norvegicus
caggtgagagcctcgctctacggca

SEQ ID NO: 547582 - DNA, 25 bp, Rattus norvegicus
gagagcctcgctctacggcagagga

SEQ ID NO: 547583 - DNA, 25 bp, Rattus norvegicus
agcctcgctctacggcagaggatgc

SEQ ID NO: 547584 - DNA, 25 bp, Rattus norvegicus
ctcgctctacggcagaggatgcgaa

SEQ ID NO: 547585 - DNA, 25 bp, Rattus norvegicus
acagggtagccaggaagagcggcga

SEQ ID NO: 547586 - DNA, 25 bp, Rattus norvegicus
ctacggcagaggatgcgaatttgga

SEQ ID NO: 547587 - DNA, 25 bp, Rattus norvegicus
cgtggtcgcgctcgcgtgctccgtt

SEQ ID NO: 547588 - DNA, 25 bp, Rattus norvegicus
cttggccatgtcctggtaccgcgcg

SEQ ID NO: 547589 - DNA, 25 bp, Rattus norvegicus
cggacccttggccatgtcctggtac

SEQ ID NO: 547590 - DNA, 25 bp, Rattus norvegicus
gacccttggccatgtcctggtaccg

SEQ ID NO: 547591 - DNA, 25 bp, Rattus norvegicus
ctctacggcagaggatgcgaatttg

SEQ ID NO: 547592 - DNA, 25 bp, Rattus norvegicus
cgcgcttatcttgtcctttccactg

SEQ ID NO: 547593 - DNA, 25 bp, Rattus norvegicus
ccggacttgggactcggatacttga

SEQ ID NO: 547594 - DNA, 25 bp, Rattus norvegicus
tgcactgctgtattctccggacttg

SEQ ID NO: 547595 - DNA, 25 bp, Rattus norvegicus
tccgcagtgatcttgggagccacac

SEQ ID NO: 547596 - DNA, 25 bp, Rattus norvegicus
cccacgttgggacaggtggtcacct

SEQ ID NO: 547597 - DNA, 25 bp, Rattus norvegicus
tcattaaaggattcggtgagcacca

SEQ ID NO: 547598 - DNA, 25 bp, Rattus norvegicus
gccagacctcgaatgcccagaatcg

SEQ ID NO: 547599 - DNA, 25 bp, Rattus norvegicus
agtggtgtctcatggaaagcgaccc

SEQ ID NO: 547600 - DNA, 25 bp, Rattus norvegicus
tcctgacaggctgaagaggagtttc

SEQ ID NO: 547601 - DNA, 25 bp, Rattus norvegicus
cggcgcctagaaaccctgcgtagca

SEQ ID NO: 547602 - DNA, 25 bp, Rattus norvegicus
acctgtgcctggtaggcgatgctca

SEQ ID NO: 547603 - DNA, 25 bp, Rattus norvegicus
ctgggactgcacaaaagccggttcc

SEQ ID NO: 547604 - DNA, 25 bp, Rattus norvegicus
ccggggtcttcaccgagctcattaa

SEQ ID NO: 547605 - DNA, 25 bp, Rattus norvegicus
ggatacttgaattgactcgagcgtc

SEQ ID NO: 547606 - DNA, 25 bp, Rattus norvegicus
cgcggcccgtcgagatttttgatca

SEQ ID NO: 547607 - DNA, 25 bp, Rattus norvegicus
agatttttgatcagggcgcgtcgcg

SEQ ID NO: 547608 - DNA, 25 bp, Rattus norvegicus
tcagacccgggctgcatctgagccg

SEQ ID NO: 547609 - DNA, 25 bp, Rattus norvegicus
ttagagcaacaagatggccgcggtg

SEQ ID NO: 547610 - DNA, 25 bp, Rattus norvegicus
ggggttcttgtcagttagagcaaca

SEQ ID NO: 547611 - DNA, 25 bp, Rattus norvegicus
ttcgacttcctgttggaggcccacg

SEQ ID NO: 547612 - DNA, 25 bp, Rattus norvegicus
ccgccctccggtatgcagatacggt

SEQ ID NO: 547613 - DNA, 25 bp, Rattus norvegicus
tcagagcgctgattggccatcccgc

SEQ ID NO: 547614 - DNA, 25 bp, Rattus norvegicus
gcgtctgaagaacgcgcaacacgca

SEQ ID NO: 547615 - DNA, 25 bp, Rattus norvegicus
aaccaatgggatcgggagtactgtc

SEQ ID NO: 547616 - DNA, 25 bp, Rattus norvegicus
gtctcgggcactggacttggtacct

SEQ ID NO: 547617 - DNA, 25 bp, Rattus norvegicus
gcggagctcatgatcagagcgctga

SEQ ID NO: 547618 - DNA, 25 bp, Rattus norvegicus
cgcgtccgaggcgtctgaagaacgc

SEQ ID NO: 547619 - DNA, 25 bp, Rattus norvegicus
tatgcagatacggtgggagtcacgt

SEQ ID NO: 547620 - DNA, 25 bp, Rattus norvegicus
cagtcgtgctggacagccaggaaca

SEQ ID NO: 547621 - DNA, 25 bp, Rattus norvegicus
tggcactttgcattctcagacaccc

SEQ ID NO: 547622 - DNA, 25 bp, Rattus norvegicus
acttggaggcgtcggccacacctct

SEQ ID NO: 547623 - DNA, 25 bp, Rattus norvegicus
ccacacctctagagggcgcggattg

SEQ ID NO: 547624 - DNA, 25 bp, Rattus norvegicus
attggcccactgcagacggcacgag

SEQ ID NO: 547625 - DNA, 25 bp, Rattus norvegicus
gctgttgacgtaggcgccgcatcct

SEQ ID NO: 547626 - DNA, 25 bp, Rattus norvegicus
catcctcgtgcgcacacagggtggg

SEQ ID NO: 547627 - DNA, 25 bp, Rattus norvegicus
ccacagccgtgaagggtcctgaatt

SEQ ID NO: 547628 - DNA, 25 bp, Rattus norvegicus
tcttgagtgaagaccgtagtgtgtg

SEQ ID NO: 547629 - DNA, 25 bp, Rattus norvegicus
ttgtccatgggtacgcagtcgtgct

SEQ ID NO: 547630 - DNA, 25 bp, Rattus norvegicus
gtcctgaatttgtggctttttcttg

SEQ ID NO: 547631 - DNA, 25 bp, Rattus norvegicus
agagcgatcgctgttaggcagctca

SEQ ID NO: 547632 - DNA, 25 bp, Rattus norvegicus
cttctcctcgaccttggggccgttg

SEQ ID NO: 547633 - DNA, 25 bp, Rattus norvegicus
cctgcgctcttgtccatgggtacgc

SEQ ID NO: 547634 - DNA, 25 bp, Rattus norvegicus
tgagtactaattagcgccaccgcgc

SEQ ID NO: 547635 - DNA, 25 bp, Rattus norvegicus
gcctttgggtcttgaaactggtgaa

SEQ ID NO: 547636 - DNA, 25 bp, Rattus norvegicus
ggcagcgggtgagaaatacactaca

SEQ ID NO: 547637 - DNA, 25 bp, Rattus norvegicus
attcccagcgtgcatagcttccggc

SEQ ID NO: 547638 - DNA, 25 bp, Rattus norvegicus
ccttgctgcgtttaacgcgggacta

SEQ ID NO: 547639 - DNA, 25 bp, Rattus norvegicus
ttctcacagccataggaggggagcc

SEQ ID NO: 547640 - DNA, 25 bp, Rattus norvegicus
acggtaaggtcgtcttgctcctcgg

SEQ ID NO: 547641 - DNA, 25 bp, Rattus norvegicus
gtgccctctagtggctcggtttcta

SEQ ID NO: 547642 - DNA, 25 bp, Rattus norvegicus
gtagcccagagcctttcgggacgcc

SEQ ID NO: 547643 - DNA, 25 bp, Rattus norvegicus
ttctaccaaagagagtgaggcctgc

SEQ ID NO: 547644 - DNA, 25 bp, Rattus norvegicus
cagaggctactgtgaactcgcattc

SEQ ID NO: 547645 - DNA, 25 bp, Rattus norvegicus
tctagaagtggccagaggagtaccc

SEQ ID NO: 547646 - DNA, 25 bp, Rattus norvegicus
cgcagactgatgacgcgagccgtcc

SEQ ID NO: 547647 - DNA, 25 bp, Rattus norvegicus
gacgagggttgctgagtactaatta

SEQ ID NO: 547648 - DNA, 25 bp, Rattus norvegicus
gaacctcccaactttccactgctag

SEQ ID NO: 547649 - DNA, 25 bp, Rattus norvegicus
ccttttgtccggctgagtaggtcgt

SEQ ID NO: 547650 - DNA, 25 bp, Rattus norvegicus
gacctctccttctgattggccagcg

SEQ ID NO: 547651 - DNA, 25 bp, Rattus norvegicus
tctccttctgattggccagcggccg

SEQ ID NO: 547652 - DNA, 25 bp, Rattus norvegicus
gccagcgactgaacctcccaacttt

SEQ ID NO: 547653 - DNA, 25 bp, Rattus norvegicus
cgccgcgctccaggccagcgactga

SEQ ID NO: 547654 - DNA, 25 bp, Rattus norvegicus
acgctgcgagcctgcggtgccgcct

SEQ ID NO: 547655 - DNA, 25 bp, Rattus norvegicus
ccggcagagcgccgggtccatgccc

SEQ ID NO: 547656 - DNA, 25 bp, Rattus norvegicus
ctgcgagtagccgagtgccggcaga

SEQ ID NO: 547657 - DNA, 25 bp, Rattus norvegicus
gtgcagggagctgcgagtagccgag

SEQ ID NO: 547658 - DNA, 25 bp, Rattus norvegicus
tcgtgggctctaggcggccgcgtgc

SEQ ID NO: 547659 - DNA, 25 bp, Rattus norvegicus
ccggctgagtaggtcgtgggctcta

SEQ ID NO: 547660 - DNA, 25 bp, Rattus norvegicus
cttttgtccggctgagtaggtcgtg

SEQ ID NO: 547661 - DNA, 25 bp, Rattus norvegicus
acctctccttctgattggccagcgg

SEQ ID NO: 547662 - DNA, 25 bp, Rattus norvegicus
gttcctgcgagtacccagtggtctc

SEQ ID NO: 547663 - DNA, 25 bp, Rattus norvegicus
ctaggaaggatgacccgccggataa

SEQ ID NO: 547664 - DNA, 25 bp, Rattus norvegicus
ggtcctttgttccagctccacgttg

SEQ ID NO: 547665 - DNA, 25 bp, Rattus norvegicus
cacgttgcccgcttttcttgccaag

SEQ ID NO: 547666 - DNA, 25 bp, Rattus norvegicus
gccctcagagcgcatcggttccagg

SEQ ID NO: 547667 - DNA, 25 bp, Rattus norvegicus
ccctgacgtgtcagctctgagtgac

SEQ ID NO: 547668 - DNA, 25 bp, Rattus norvegicus
tcggggctctccgtgctaagactcc

SEQ ID NO: 547669 - DNA, 25 bp, Rattus norvegicus
gactgtgggcatcgtttcccgctgt

SEQ ID NO: 547670 - DNA, 25 bp, Rattus norvegicus
cgctgtcccaagaggaacgggcatc

SEQ ID NO: 547671 - DNA, 25 bp, Rattus norvegicus
gatgacccaggtacgcgctatacgc

SEQ ID NO: 547672 - DNA, 25 bp, Rattus norvegicus
cccgtcgaagctctggagatgaatt

SEQ ID NO: 547673 - DNA, 25 bp, Rattus norvegicus
ctgtgattcgcccaggcattcgagc

SEQ ID NO: 547674 - DNA, 25 bp, Rattus norvegicus
atgaatttcgccatctcttcagaga

SEQ ID NO: 547675 - DNA, 25 bp, Rattus norvegicus
ccttgcccagcggacagctaggaag

SEQ ID NO: 547676 - DNA, 25 bp, Rattus norvegicus
ggctcgcgtacagccttcccaattg

SEQ ID NO: 547677 - DNA, 25 bp, Rattus norvegicus
ggtcactgacgcttcgccgtttgtc

SEQ ID NO: 547678 - DNA, 25 bp, Rattus norvegicus
aggctggaatcgctgcctctggctt

SEQ ID NO: 547679 - DNA, 25 bp, Rattus norvegicus
cacgcttctgcgcagtctgtgttga

SEQ ID NO: 547680 - DNA, 25 bp, Rattus norvegicus
gcggccactgatgcagagacgtaca

SEQ ID NO: 547681 - DNA, 25 bp, Rattus norvegicus
ttgtagtcttatctcggttcggtgg

SEQ ID NO: 547682 - DNA, 25 bp, Rattus norvegicus
ctgtgtgtttcctccaaggaccgga

SEQ ID NO: 547683 - DNA, 25 bp, Rattus norvegicus
gccagtagtgaaaagccgtcgccca

SEQ ID NO: 547684 - DNA, 25 bp, Rattus norvegicus
acagcccgctgcacactgggaaatg

SEQ ID NO: 547685 - DNA, 25 bp, Rattus norvegicus
ggctttcagtttttcggctcgcagg

SEQ ID NO: 547686 - DNA, 25 bp, Rattus norvegicus
cagatacggctctggactcggctcc

SEQ ID NO: 547687 - DNA, 25 bp, Rattus norvegicus
gccctgtgtgcattaacgtctatta

SEQ ID NO: 547688 - DNA, 25 bp, Rattus norvegicus
gccgaacgctccaggcaattctaga

SEQ ID NO: 547689 - DNA, 25 bp, Rattus norvegicus
tgttgacttcgtaacgcctcgggga

SEQ ID NO: 547690 - DNA, 25 bp, Rattus norvegicus
gcaggcagcggctctccaggaatgt

SEQ ID NO: 547691 - DNA, 25 bp, Rattus norvegicus
cccgggtcaaaacgcgaagcagcca

SEQ ID NO: 547692 - DNA, 25 bp, Rattus norvegicus
agcaacagatactccggggcaggca

SEQ ID NO: 547693 - DNA, 25 bp, Rattus norvegicus
gtgcaggcccggactgtcaggccac

SEQ ID NO: 547694 - DNA, 25 bp, Rattus norvegicus
gtaagttcgcctacggctccggagc

SEQ ID NO: 547695 - DNA, 25 bp, Rattus norvegicus
tcacgggccgcgaacaatgagccct

SEQ ID NO: 547696 - DNA, 25 bp, Rattus norvegicus
ccggagcgagactcgaggatcaacc

SEQ ID NO: 547697 - DNA, 25 bp, Rattus norvegicus
ccggtgccgccgcacaatatggcga

SEQ ID NO: 547698 - DNA, 25 bp, Rattus norvegicus
cacaatatggcgagcctcggcttcc

SEQ ID NO: 547699 - DNA, 25 bp, Rattus norvegicus
tccgcaatggagctcgggaaataca

SEQ ID NO: 547700 - DNA, 25 bp, Rattus norvegicus
gggaaatacaacaggggccgctcaa

SEQ ID NO: 547701 - DNA, 25 bp, Rattus norvegicus
caggggccgctcaatattcatgaga

SEQ ID NO: 547702 - DNA, 25 bp, Rattus norvegicus
actcgaggatcaaccgccggtgccg

SEQ ID NO: 547703 - DNA, 25 bp, Rattus norvegicus
ctcgcggaggcagcaacagatactc

SEQ ID NO: 547704 - DNA, 25 bp, Rattus norvegicus
cagtcacccaggatgcgtttcgcca

SEQ ID NO: 547705 - DNA, 25 bp, Rattus norvegicus
ctcacaaaacttccgtaattccgag

SEQ ID NO: 547706 - DNA, 25 bp, Rattus norvegicus
atcaggaagtcacggtgcggaagtc

SEQ ID NO: 547707 - DNA, 25 bp, Rattus norvegicus
tcgcgaaatgagatcaggaagtcac

SEQ ID NO: 547708 - DNA, 25 bp, Rattus norvegicus
tgcgtttcgccacaaatgagctctc

SEQ ID NO: 547709 - DNA, 25 bp, Rattus norvegicus
gccacaaatgagctctcgcgaaatg

SEQ ID NO: 547710 - DNA, 25 bp, Rattus norvegicus
acgcgctaaccagtcacccaggatg

SEQ ID NO: 547711 - DNA, 25 bp, Rattus norvegicus
ccagctctagagcagtaaatctacc

SEQ ID NO: 547712 - DNA, 25 bp, Rattus norvegicus
cgtggacgccatggtggagatccaa

SEQ ID NO: 547713 - DNA, 25 bp, Rattus norvegicus
taaatctaccaggaactccagcagc

SEQ ID NO: 547714 - DNA, 25 bp, Rattus norvegicus
ccatggtggagatccaaagggtccc

SEQ ID NO: 547715 - DNA, 25 bp, Rattus norvegicus
ggtcacagccgcaacgctccggagg

SEQ ID NO: 547716 - DNA, 25 bp, Rattus norvegicus
cagcggcagtcccagctctagagca

SEQ ID NO: 547717 - DNA, 25 bp, Rattus norvegicus
tccggctctctagaggggcccagaa

SEQ ID NO: 547718 - DNA, 25 bp, Rattus norvegicus
tgtcacatccaccttcagctgcaag

SEQ ID NO: 547719 - DNA, 25 bp, Rattus norvegicus
acaccggttttctgagggagcactg

SEQ ID NO: 547720 - DNA, 25 bp, Rattus norvegicus
gaagttggccctttaattacagagc

SEQ ID NO: 547721 - DNA, 25 bp, Rattus norvegicus
aaaccggtgtcctgtttcaagcgcg

SEQ ID NO: 547722 - DNA, 25 bp, Rattus norvegicus
gcactggctagctggtgctactgtt

SEQ ID NO: 547723 - DNA, 25 bp, Rattus norvegicus
gcttgatcacctgcacaccggtttt

SEQ ID NO: 547724 - DNA, 25 bp, Rattus norvegicus
tagagccagggctagcttgatcacc

SEQ ID NO: 547725 - DNA, 25 bp, Rattus norvegicus
ggcaagtgcgcctatatccgaggta

SEQ ID NO: 547726 - DNA, 25 bp, Rattus norvegicus
tccagccaactggatgagggcaagt

SEQ ID NO: 547727 - DNA, 25 bp, Rattus norvegicus
gcagttggtgtcagtcctctgcctc

SEQ ID NO: 547728 - DNA, 25 bp, Rattus norvegicus
cagctgcaagcagcaggcgcagttg

SEQ ID NO: 547729 - DNA, 25 bp, Rattus norvegicus
tacagagccagttccctgtcacatc

SEQ ID NO: 547730 - DNA, 25 bp, Rattus norvegicus
cggcgacgcctctcaaggaagttgg

SEQ ID NO: 547731 - DNA, 25 bp, Rattus norvegicus
tggtgctactgttgggctcctagac

SEQ ID NO: 547732 - DNA, 25 bp, Rattus norvegicus
gggtttcctagcgaggctaccagca

SEQ ID NO: 547733 - DNA, 25 bp, Rattus norvegicus
ggacttttctgtggtgactctaaca

SEQ ID NO: 547734 - DNA, 25 bp, Rattus norvegicus
cccggcgcacagtggacttttctgt

SEQ ID NO: 547735 - DNA, 25 bp, Rattus norvegicus
gaaggcggtttcctagactacgaca

SEQ ID NO: 547736 - DNA, 25 bp, Rattus norvegicus
accagcagtggaggtgcctgtcatt

SEQ ID NO: 547737 - DNA, 25 bp, Rattus norvegicus
gactctaacagctggtgaggctgga

SEQ ID NO: 547738 - DNA, 25 bp, Rattus norvegicus
ttggccacgaccgtgtgcacggcag

SEQ ID NO: 547739 - DNA, 25 bp, Rattus norvegicus
ctctatctgatgttggccacgaccg

SEQ ID NO: 547740 - DNA, 25 bp, Rattus norvegicus
cgacggccgcgctctatctgatgtt

SEQ ID NO: 547741 - DNA, 25 bp, Rattus norvegicus
cccagcgagcgtcatggagcctggt

SEQ ID NO: 547742 - DNA, 25 bp, Rattus norvegicus
cccaccgtgcgggtgtagcagctgc

SEQ ID NO: 547743 - DNA, 25 bp, Rattus norvegicus
ttcggcaaacagtttggcgccggcg

SEQ ID NO: 547744 - DNA, 25 bp, Rattus norvegicus
gctcggtggcttcggcaaacagttt

SEQ ID NO: 547745 - DNA, 25 bp, Rattus norvegicus
tagactacgacaccggaaagctggg

SEQ ID NO: 547746 - DNA, 25 bp, Rattus norvegicus
ccggaggtggctcccgcttaccttg

SEQ ID NO: 547747 - DNA, 25 bp, Rattus norvegicus
tcccttggagcgagcagctccagca

SEQ ID NO: 547748 - DNA, 25 bp, Rattus norvegicus
ctccggtcccttggagcgagcagct

SEQ ID NO: 547749 - DNA, 25 bp, Rattus norvegicus
gaaagtcgtcagcagccctaaccgc

SEQ ID NO: 547750 - DNA, 25 bp, Rattus norvegicus
aggcctcgatgtgacgaaagtcgtc

SEQ ID NO: 547751 - DNA, 25 bp, Rattus norvegicus
aaccacccaggcctcgatgtgacga

SEQ ID NO: 547752 - DNA, 25 bp, Rattus norvegicus
ggctcccatcccttcggcagacacc

SEQ ID NO: 547753 - DNA, 25 bp, Rattus norvegicus
gtggctcccgcttaccttgggcgct

SEQ ID NO: 547754 - DNA, 25 bp, Rattus norvegicus
tcctccctacagtgtggccggggct

SEQ ID NO: 547755 - DNA, 25 bp, Rattus norvegicus
agctctccagtcactaagcgcggcg

SEQ ID NO: 547756 - DNA, 25 bp, Rattus norvegicus
agggaggggtgtctcacaccaacca

SEQ ID NO: 547757 - DNA, 25 bp, Rattus norvegicus
gcgcggctcgcaactaaagtgtgaa

SEQ ID NO: 547758 - DNA, 25 bp, Rattus norvegicus
ctaaagtgtgaaagaagcggtggcc

SEQ ID NO: 547759 - DNA, 25 bp, Rattus norvegicus
ccgccgcctggagtaaaagcagaaa

SEQ ID NO: 547760 - DNA, 25 bp, Rattus norvegicus
gtctcggtctttaaacacacacgcg

SEQ ID NO: 547761 - DNA, 25 bp, Rattus norvegicus
cgcgcgctctccttagcatacggtt

SEQ ID NO: 547762 - DNA, 25 bp, Rattus norvegicus
gcatacggtttctgagtcttgacta

SEQ ID NO: 547763 - DNA, 25 bp, Rattus norvegicus
ggagtctgatgttccgttatcctta

SEQ ID NO: 547764 - DNA, 25 bp, Rattus norvegicus
ctgccttgagataggaaggtgcctc

SEQ ID NO: 547765 - DNA, 25 bp, Rattus norvegicus
tggaatggctcttcgcctcggaagg

SEQ ID NO: 547766 - DNA, 25 bp, Rattus norvegicus
tgccaagctgggatccgcagtcttg

SEQ ID NO: 547767 - DNA, 25 bp, Rattus norvegicus
gttcagttcggtctcccgcgccaaa

SEQ ID NO: 547768 - DNA, 25 bp, Rattus norvegicus
gcggcaggcttcgtttccggaaata

SEQ ID NO: 547769 - DNA, 25 bp, Rattus norvegicus
ataacgtaggactgcggaccgactc

SEQ ID NO: 547770 - DNA, 25 bp, Rattus norvegicus
tgaccagctcctgcaaccatagaga

SEQ ID NO: 547771 - DNA, 25 bp, Rattus norvegicus
tttaggctcttaaccctgcgcgacc

SEQ ID NO: 547772 - DNA, 25 bp, Rattus norvegicus
gcgcatgcacagcaaagcgtcctgc

SEQ ID NO: 547773 - DNA, 25 bp, Rattus norvegicus
ttccttccgagccaagcagacgtca

SEQ ID NO: 547774 - DNA, 25 bp, Rattus norvegicus
aggcgtgagtcctccgcagagacgc

SEQ ID NO: 547775 - DNA, 25 bp, Rattus norvegicus
gcccgcgcagaaagccgtagtgcac

SEQ ID NO: 547776 - DNA, 25 bp, Rattus norvegicus
atgccgcccgcgcagaaagccgtag

SEQ ID NO: 547777 - DNA, 25 bp, Rattus norvegicus
gaatcgctgcgctcctccatgccgc

SEQ ID NO: 547778 - DNA, 25 bp, Rattus norvegicus
taggctcggaatcgctgcgctcctc

SEQ ID NO: 547779 - DNA, 25 bp, Rattus norvegicus
ctacagcccggggtaggctcggaat

SEQ ID NO: 547780 - DNA, 25 bp, Rattus norvegicus
cggcgccgccatcgcgaacgggacc

SEQ ID NO: 547781 - DNA, 25 bp, Rattus norvegicus
ggtgtgtgcccatccaggcgtcctc

SEQ ID NO: 547782 - DNA, 25 bp, Rattus norvegicus
accttagggtgtgtgcccatccagg

SEQ ID NO: 547783 - DNA, 25 bp, Rattus norvegicus
ggcgaccagtgccttgcactcgccc

SEQ ID NO: 547784 - DNA, 25 bp, Rattus norvegicus
tcgcacctcctgaccttagggtgtg

SEQ ID NO: 547785 - DNA, 25 bp, Rattus norvegicus
gaaagccgtagtgcaccgcgaaccc

SEQ ID NO: 547786 - DNA, 25 bp, Rattus norvegicus
cccgcccggccagaagccgagtcca

SEQ ID NO: 547787 - DNA, 25 bp, Rattus norvegicus
cctgaccttagggtgtgtgcccatc

SEQ ID NO: 547788 - DNA, 25 bp, Rattus norvegicus
aagtcggtgcccgtgcgcgttcccg

SEQ ID NO: 547789 - DNA, 25 bp, Rattus norvegicus
tgagggcagcctgctgcgcacactc

SEQ ID NO: 547790 - DNA, 25 bp, Rattus norvegicus
tcccgcgagctgcagaagtcggtgc

SEQ ID NO: 547791 - DNA, 25 bp, Rattus norvegicus
ggtccctggccaccgcggagcatga

SEQ ID NO: 547792 - DNA, 25 bp, Rattus norvegicus
tcccgctggccacggaacatggctg

SEQ ID NO: 547793 - DNA, 25 bp, Rattus norvegicus
tggccacggaacatggctgcgcgcc

SEQ ID NO: 547794 - DNA, 25 bp, Rattus norvegicus
gcctgcgcgctgttgctgctgtcct

SEQ ID NO: 547795 - DNA, 25 bp, Rattus norvegicus
cttcgctgccgagtccgagtcggat

SEQ ID NO: 547796 - DNA, 25 bp, Rattus norvegicus
cccactgtgttcgtggtcgtcctcg

SEQ ID NO: 547797 - DNA, 25 bp, Rattus norvegicus
tgttcgtggtcgtcctcgcccgcaa

SEQ ID NO: 547798 - DNA, 25 bp, Rattus norvegicus
tgcctcacttcctgggctgcctgga

SEQ ID NO: 547799 - DNA, 25 bp, Rattus norvegicus
gagcggctggactatcccaagagca

SEQ ID NO: 547800 - DNA, 25 bp, Rattus norvegicus
tcccaagagcaggatggccatctgg

SEQ ID NO: 547801 - DNA, 25 bp, Rattus norvegicus
cctgcagaaacccactgtgttcgtg

SEQ ID NO: 547802 - DNA, 25 bp, Rattus norvegicus
tcgttgctccagcttcggagtggtg

SEQ ID NO: 547803 - DNA, 25 bp, Rattus norvegicus
cccgcggatcaagggagcaagcaat

SEQ ID NO: 547804 - DNA, 25 bp, Rattus norvegicus
ttagacagtacaattcggcccgaga

SEQ ID NO: 547805 - DNA, 25 bp, Rattus norvegicus
caggctttcctgtttgtgcttgcga

SEQ ID NO: 547806 - DNA, 25 bp, Rattus norvegicus
gccgctccgtgatgtcaggctttcc

SEQ ID NO: 547807 - DNA, 25 bp, Rattus norvegicus
cgactcggccacaaaggagcgccgg

SEQ ID NO: 547808 - DNA, 25 bp, Rattus norvegicus
acacggacgctgcatggtgcgccct

SEQ ID NO: 547809 - DNA, 25 bp, Rattus norvegicus
tctcagttttctctccggcacacgg

SEQ ID NO: 547810 - DNA, 25 bp, Rattus norvegicus
gcttgccaaagtaatttcattctca

SEQ ID NO: 547811 - DNA, 25 bp, Rattus norvegicus
gcgttaccattttagcttgccaaag

SEQ ID NO: 547812 - DNA, 25 bp, Rattus norvegicus
tgcgagcgcactctccctttcggaa

SEQ ID NO: 547813 - DNA, 25 bp, Rattus norvegicus
caattcggcccgagaaagcgggaga

SEQ ID NO: 547814 - DNA, 25 bp, Rattus norvegicus
ggcggctccgatcagttagacagta

SEQ ID NO: 547815 - DNA, 25 bp, Rattus norvegicus
ggggagctcgcgttaccattttagc

SEQ ID NO: 547816 - DNA, 25 bp, Rattus norvegicus
ccagagttgcatcgcgatccgggat

SEQ ID NO: 547817 - DNA, 25 bp, Rattus norvegicus
tggactcatgcctacggcaatatcc

SEQ ID NO: 547818 - DNA, 25 bp, Rattus norvegicus
ggcaatatccttacgctcgcggcgg

SEQ ID NO: 547819 - DNA, 25 bp, Rattus norvegicus
cgcgatccgggatgtcgaagaacac

SEQ ID NO: 547820 - DNA, 25 bp, Rattus norvegicus
ctaggctcgctgaagaagaggcacc

SEQ ID NO: 547821 - DNA, 25 bp, Rattus norvegicus
aagtgagtcggacaaggctaggctc

SEQ ID NO: 547822 - DNA, 25 bp, Rattus norvegicus
gcaggcccagaagcgagcaagcagc

SEQ ID NO: 547823 - DNA, 25 bp, Rattus norvegicus
ttctatgggaacctcccgggtgtca

SEQ ID NO: 547824 - DNA, 25 bp, Rattus norvegicus
ggctggaccgcagaaaagcgtttct

SEQ ID NO: 547825 - DNA, 25 bp, Rattus norvegicus
actaggttctgcagccagtccatcc

SEQ ID NO: 547826 - DNA, 25 bp, Rattus norvegicus
ttctcccgctgactgcaggggacta

SEQ ID NO: 547827 - DNA, 25 bp, Rattus norvegicus
tcactagtttcgtgctgggcatcac

SEQ ID NO: 547828 - DNA, 25 bp, Rattus norvegicus
atggagggctccgatcactagtttc

SEQ ID NO: 547829 - DNA, 25 bp, Rattus norvegicus
aagaacacggtgtcgtcggcccgct

SEQ ID NO: 547830 - DNA, 25 bp, Rattus norvegicus
tcgagcccaaatcagccgggagtta

SEQ ID NO: 547831 - DNA, 25 bp, Rattus norvegicus
ggcttcctaatgatccgtccttctc

SEQ ID NO: 547832 - DNA, 25 bp, Rattus norvegicus
agcgcctggaggcttcctaatgatc

SEQ ID NO: 547833 - DNA, 25 bp, Rattus norvegicus
atcagcaagttgtgtggcgcctgcg

SEQ ID NO: 547834 - DNA, 25 bp, Rattus norvegicus
tctctcccttttgggatcagcaagt

SEQ ID NO: 547835 - DNA, 25 bp, Rattus norvegicus
gggtggtttccgctactctatatct

SEQ ID NO: 547836 - DNA, 25 bp, Rattus norvegicus
tcgcgagactttagcactgccggtc

SEQ ID NO: 547837 - DNA, 25 bp, Rattus norvegicus
aaggaagtccggttcgctctcgcga

SEQ ID NO: 547838 - DNA, 25 bp, Rattus norvegicus
acgaagcctccgtgggtctttcagg

SEQ ID NO: 547839 - DNA, 25 bp, Rattus norvegicus
agatactgcgcgctctgcaggctca

SEQ ID NO: 547840 - DNA, 25 bp, Rattus norvegicus
gcttcggcactcaccggagatactg

SEQ ID NO: 547841 - DNA, 25 bp, Rattus norvegicus
actgcctcgggagtccgctgtttct

SEQ ID NO: 547842 - DNA, 25 bp, Rattus norvegicus
ggggacagaaggacgctgcaactcc

SEQ ID NO: 547843 - DNA, 25 bp, Rattus norvegicus
gccgggagttacactcaaagccttc

SEQ ID NO: 547844 - DNA, 25 bp, Rattus norvegicus
ctgttcgacttttcctaggcggtcg

SEQ ID NO: 547845 - DNA, 25 bp, Rattus norvegicus
agactgttcgacttttcctaggcgg

SEQ ID NO: 547846 - DNA, 25 bp, Rattus norvegicus
cgagactgttcgacttttcctaggc

SEQ ID NO: 547847 - DNA, 25 bp, Rattus norvegicus
gggcgatactacaaagtcagggtgc

SEQ ID NO: 547848 - DNA, 25 bp, Rattus norvegicus
ctccagcagtcgagactgttcgact

SEQ ID NO: 547849 - DNA, 25 bp, Rattus norvegicus
cggctccagcagtcgagactgttcg

SEQ ID NO: 547850 - DNA, 25 bp, Rattus norvegicus
actggcaaggaacaggctagatgcg

SEQ ID NO: 547851 - DNA, 25 bp, Rattus norvegicus
ctaaaggaagagactggcaaggaac

SEQ ID NO: 547852 - DNA, 25 bp, Rattus norvegicus
tccctaaaggaagagactggcaagg

SEQ ID NO: 547853 - DNA, 25 bp, Rattus norvegicus
ggtccctaaaggaagagactggcaa

SEQ ID NO: 547854 - DNA, 25 bp, Rattus norvegicus
ggcttccccacaactgcttgaggcg

SEQ ID NO: 547855 - DNA, 25 bp, Rattus norvegicus
aggggcttccccacaactgcttgag

SEQ ID NO: 547856 - DNA, 25 bp, Rattus norvegicus
agactggcaaggaacaggctagatg

SEQ ID NO: 547857 - DNA, 25 bp, Rattus norvegicus
agcagtcgagactgttcgacttttc

SEQ ID NO: 547858 - DNA, 25 bp, Rattus norvegicus
ccgtctgcagacatatcgagacaca

SEQ ID NO: 547859 - DNA, 25 bp, Rattus norvegicus
gctctactctctcgtcaataccagg

SEQ ID NO: 547860 - DNA, 25 bp, Rattus norvegicus
gggacctattcccaatatgaccgag

SEQ ID NO: 547861 - DNA, 25 bp, Rattus norvegicus
tgaccgagaccacaaagacccacgt

SEQ ID NO: 547862 - DNA, 25 bp, Rattus norvegicus
agacccacgttatcctgctggcctg

SEQ ID NO: 547863 - DNA, 25 bp, Rattus norvegicus
tgcggcagcttcaatcccatcacta

SEQ ID NO: 547864 - DNA, 25 bp, Rattus norvegicus
cgctgatctggctggtgccaggtca

SEQ ID NO: 547865 - DNA, 25 bp, Rattus norvegicus
cgtctctagcttggggccagatcgc

SEQ ID NO: 547866 - DNA, 25 bp, Rattus norvegicus
ccgctagtgagagccgatgcaaact

SEQ ID NO: 547867 - DNA, 25 bp, Rattus norvegicus
tctagccggagtggcaagcgttaaa

SEQ ID NO: 547868 - DNA, 25 bp, Rattus norvegicus
gagcggctccttggagtccacagca

SEQ ID NO: 547869 - DNA, 25 bp, Rattus norvegicus
tcccatcactaaagggcacattcag

SEQ ID NO: 547870 - DNA, 25 bp, Rattus norvegicus
cattcagatgttcggtgagtcctcc

SEQ ID NO: 547871 - DNA, 25 bp, Rattus norvegicus
ccctggatccgtgcgagggacctat

SEQ ID NO: 547872 - DNA, 25 bp, Rattus norvegicus
cggagtttcctgtggcgttcccaag

SEQ ID NO: 547873 - DNA, 25 bp, Rattus norvegicus
tccagcaggtccagaagtctcagta

SEQ ID NO: 547874 - DNA, 25 bp, Rattus norvegicus
tcccaagttactgcgtgctgtgatg

SEQ ID NO: 547875 - DNA, 25 bp, Rattus norvegicus
tgctgtgatgagacctgcttctgcc

SEQ ID NO: 547876 - DNA, 25 bp, Rattus norvegicus
agcggctccctcttggtaatcttag

SEQ ID NO: 547877 - DNA, 25 bp, Rattus norvegicus
gaacccttcttgtttctccagcagg

SEQ ID NO: 547878 - DNA, 25 bp, Rattus norvegicus
cccttgccaagtgcgtattctttta

SEQ ID NO: 547879 - DNA, 25 bp, Rattus norvegicus
cgcccatagctggatcccgtggatc

SEQ ID NO: 547880 - DNA, 25 bp, Rattus norvegicus
gagcgggaccctagcattcaatgac

SEQ ID NO: 547881 - DNA, 25 bp, Rattus norvegicus
cccaagactattgtgcagaggatta

SEQ ID NO: 547882 - DNA, 25 bp, Rattus norvegicus
taggctccggacttggtacccaaga

SEQ ID NO: 547883 - DNA, 25 bp, Rattus norvegicus
cggggatctgcatcaccctctaacg

SEQ ID NO: 547884 - DNA, 25 bp, Rattus norvegicus
ctcagtagcttctcagacaaggtgc

SEQ ID NO: 547885 - DNA, 25 bp, Rattus norvegicus
tgcaaacgccatggtttcagatgtc

SEQ ID NO: 547886 - DNA, 25 bp, Rattus norvegicus
cagcagctgagccagagcgcaggca

SEQ ID NO: 547887 - DNA, 25 bp, Rattus norvegicus
cccgaggcagcagctgagccagagc

SEQ ID NO: 547888 - DNA, 25 bp, Rattus norvegicus
gctgtgccttccttttacctcgatc

SEQ ID NO: 547889 - DNA, 25 bp, Rattus norvegicus
gccttccttttacctcgatcaggtg

SEQ ID NO: 547890 - DNA, 25 bp, Rattus norvegicus
cctcgatcaggtgttttatcgactc

SEQ ID NO: 547891 - DNA, 25 bp, Rattus norvegicus
ttatcgactcttctacctgactcag

SEQ ID NO: 547892 - DNA, 25 bp, Rattus norvegicus
acctgactcagtcctgacaggaaga

SEQ ID NO: 547893 - DNA, 25 bp, Rattus norvegicus
cggggcgtgactcacctgtgaacaa

SEQ ID NO: 547894 - DNA, 25 bp, Rattus norvegicus
tgtgaacaaggaggacccaaccctc

SEQ ID NO: 547895 - DNA, 25 bp, Rattus norvegicus
aggaggacccaaccctccgaggcag

SEQ ID NO: 547896 - DNA, 25 bp, Rattus norvegicus
ctccgaggcagacaaacactcagcg

SEQ ID NO: 547897 - DNA, 25 bp, Rattus norvegicus
agacaaacactcagcgcacgccgag

SEQ ID NO: 547898 - DNA, 25 bp, Rattus norvegicus
cgccgagcagtaaacccgctcactg

SEQ ID NO: 547899 - DNA, 25 bp, Rattus norvegicus
actcagtcctgacaggaagagagtt

SEQ ID NO: 547900 - DNA, 25 bp, Rattus norvegicus
tctggcggtggagaaaacccaagac

SEQ ID NO: 547901 - DNA, 25 bp, Rattus norvegicus
ccagcatagtctggctttgccacca

SEQ ID NO: 547902 - DNA, 25 bp, Rattus norvegicus
ttgtagtcggtcaagaaggctgccc

SEQ ID NO: 547903 - DNA, 25 bp, Rattus norvegicus
cacaggtgacaggacttggtgactc

SEQ ID NO: 547904 - DNA, 25 bp, Rattus norvegicus
cggtcactccagtctgcacgcagta

SEQ ID NO: 547905 - DNA, 25 bp, Rattus norvegicus
cacgcagtactcctcgggtggagtc

SEQ ID NO: 547906 - DNA, 25 bp, Rattus norvegicus
gtcccacacgtgttggtagccacca

SEQ ID NO: 547907 - DNA, 25 bp, Rattus norvegicus
gtagccaccacggtcacattgaagg

SEQ ID NO: 547908 - DNA, 25 bp, Rattus norvegicus
cattgaaggcggcattaacaaactc

SEQ ID NO: 547909 - DNA, 25 bp, Rattus norvegicus
gcggcaggagcaaccactggctctc

SEQ ID NO: 547910 - DNA, 25 bp, Rattus norvegicus
gtccaagcgaagatcgcgctgcctc

SEQ ID NO: 547911 - DNA, 25 bp, Rattus norvegicus
gcttacccaggtgcagcgtgaggtt

SEQ ID NO: 547912 - DNA, 25 bp, Rattus norvegicus
acagggctgtcatcgcttacccagg

SEQ ID NO: 547913 - DNA, 25 bp, Rattus norvegicus
acaaactccggcatgcagcgctgcg

SEQ ID NO: 547914 - DNA, 25 bp, Rattus norvegicus
ctgtccgcaggatcccgcctcggcc

SEQ ID NO: 547915 - DNA, 25 bp, Rattus norvegicus
acatgctccctgctgtccgcaggat

SEQ ID NO: 547916 - DNA, 25 bp, Rattus norvegicus
ttgctaacatgctccctgctgtccg

SEQ ID NO: 547917 - DNA, 25 bp, Rattus norvegicus
gtgcttgctaacatgctccctgctg

SEQ ID NO: 547918 - DNA, 25 bp, Rattus norvegicus
ggcgtgcttgctaacatgctccctg

SEQ ID NO: 547919 - DNA, 25 bp, Rattus norvegicus
ttagggcgtgcttgctaacatgctc

SEQ ID NO: 547920 - DNA, 25 bp, Rattus norvegicus
gagagttagggcgtgcttgctaaca

SEQ ID NO: 547921 - DNA, 25 bp, Rattus norvegicus
ctggtgcacggcctcacagagggct

SEQ ID NO: 547922 - DNA, 25 bp, Rattus norvegicus
gagagctggtgcacggcctcacaga

SEQ ID NO: 547923 - DNA, 25 bp, Rattus norvegicus
tgcgcgtcgcgttctgctgcaggcc

SEQ ID NO: 547924 - DNA, 25 bp, Rattus norvegicus
gctgctgcgcgtcgcgttctgctgc

SEQ ID NO: 547925 - DNA, 25 bp, Rattus norvegicus
caaaatggcgctggctgctgcgcgt

SEQ ID NO: 547926 - DNA, 25 bp, Rattus norvegicus
tccaaaatggcgctggctgctgcgc

SEQ ID NO: 547927 - DNA, 25 bp, Rattus norvegicus
gatatccaaaatggcgctggctgct

SEQ ID NO: 547928 - DNA, 25 bp, Rattus norvegicus
agcgcggacatggagtcggatccca

SEQ ID NO: 547929 - DNA, 25 bp, Rattus norvegicus
ctacagggctcgaaggtgcgaagcc

SEQ ID NO: 547930 - DNA, 25 bp, Rattus norvegicus
acctgctcccatttcccgcctgcgc

SEQ ID NO: 547931 - DNA, 25 bp, Rattus norvegicus
atggagtcggatcccacgacctccg

SEQ ID NO: 547932 - DNA, 25 bp, Rattus norvegicus
cgcgatcgggagtgacagctcgcca

SEQ ID NO: 547933 - DNA, 25 bp, Rattus norvegicus
ctcgccagtggagcaggcgatccta

SEQ ID NO: 547934 - DNA, 25 bp, Rattus norvegicus
aggcgatcctagtctccctccggga

SEQ ID NO: 547935 - DNA, 25 bp, Rattus norvegicus
cccgcgcccagtgaagggcaaggct

SEQ ID NO: 547936 - DNA, 25 bp, Rattus norvegicus
cgccggtctctcaagccgagacagg

SEQ ID NO: 547937 - DNA, 25 bp, Rattus norvegicus
ctcaagccgagacaggtgacgagga

SEQ ID NO: 547938 - DNA, 25 bp, Rattus norvegicus
agaaggtggctctgtactgcgacca

SEQ ID NO: 547939 - DNA, 25 bp, Rattus norvegicus
gctctgtactgcgaccaggtgctac

SEQ ID NO: 547940 - DNA, 25 bp, Rattus norvegicus
tccgcgtccgccaagggcctcatgt

SEQ ID NO: 547941 - DNA, 25 bp, Rattus norvegicus
cgaccaggtgctacagggctcgaag

SEQ ID NO: 547942 - DNA, 25 bp, Rattus norvegicus
aagcagcggcgaaatggcttcgacc

SEQ ID NO: 547943 - DNA, 25 bp, Rattus norvegicus
cgcggtgtaattccgccatcactta

SEQ ID NO: 547944 - DNA, 25 bp, Rattus norvegicus
gcaggaggaactgcaacgacgcctc

SEQ ID NO: 547945 - DNA, 25 bp, Rattus norvegicus
acgacgcctcgtatcccaaagcaga

SEQ ID NO: 547946 - DNA, 25 bp, Rattus norvegicus
gccaccgctacaggcaactctgatt

SEQ ID NO: 547947 - DNA, 25 bp, Rattus norvegicus
tgtgaggaaaaccaccgcctagggc

SEQ ID NO: 547948 - DNA, 25 bp, Rattus norvegicus
ttaggtccgccacggtgcttcctta

SEQ ID NO: 547949 - DNA, 25 bp, Rattus norvegicus
gaggagacggagctacagccacttc

SEQ ID NO: 547950 - DNA, 25 bp, Rattus norvegicus
cttagacgagtttgcagcgccaacc

SEQ ID NO: 547951 - DNA, 25 bp, Rattus norvegicus
ctcacgcttgcgcagtaggccaact

SEQ ID NO: 547952 - DNA, 25 bp, Rattus norvegicus
ccgttatctaaagcagggcgatccc

SEQ ID NO: 547953 - DNA, 25 bp, Rattus norvegicus
ttccggatcagagaagcgaggaccc

SEQ ID NO: 547954 - DNA, 25 bp, Rattus norvegicus
cgtgcccgagagcacaaccttctta

SEQ ID NO: 547955 - DNA, 25 bp, Rattus norvegicus
agacttccgctgcatgactgaccga

SEQ ID NO: 547956 - DNA, 25 bp, Rattus norvegicus
ggtcagaacttgctacagcctcgct

SEQ ID NO: 547957 - DNA, 25 bp, Rattus norvegicus
tccctaacacctgcctggaaaggta

SEQ ID NO: 547958 - DNA, 25 bp, Rattus norvegicus
ccctctctcttattggtcggcgacg

SEQ ID NO: 547959 - DNA, 25 bp, Rattus norvegicus
tctctcttattggtcggcgacgctc

SEQ ID NO: 547960 - DNA, 25 bp, Rattus norvegicus
caggggataaaagacttagtagcca

SEQ ID NO: 547961 - DNA, 25 bp, Rattus norvegicus
gataaaagacttagtagccacgggc

SEQ ID NO: 547962 - DNA, 25 bp, Rattus norvegicus
cccatcagcgcaggtcagaacttgc

SEQ ID NO: 547963 - DNA, 25 bp, Rattus norvegicus
ttgctacagcctcgcttttctctct

SEQ ID NO: 547964 - DNA, 25 bp, Rattus norvegicus
acgtgctgccctgagcccgcaacca

SEQ ID NO: 547965 - DNA, 25 bp, Rattus norvegicus
gcccgcaaccatgtgccgcaccctg

SEQ ID NO: 547966 - DNA, 25 bp, Rattus norvegicus
ggaatccaccaacgctcagccttgg

SEQ ID NO: 547967 - DNA, 25 bp, Rattus norvegicus
caacgctcagccttgggaacgcggg

SEQ ID NO: 547968 - DNA, 25 bp, Rattus norvegicus
ggacgacaaagtccggaatccacca

SEQ ID NO: 547969 - DNA, 25 bp, Rattus norvegicus
tgcctggaaaggtaagagaattgtt

SEQ ID NO: 547970 - DNA, 25 bp, Rattus norvegicus
tctgtgacaaggcatacacctggtc

SEQ ID NO: 547971 - DNA, 25 bp, Rattus norvegicus
atcgcctccgaattggcgcagcaca

SEQ ID NO: 547972 - DNA, 25 bp, Rattus norvegicus
ggccataccgctgtcctttctgtga

SEQ ID NO: 547973 - DNA, 25 bp, Rattus norvegicus
tggtcgtctgatcaccgcaagcaca

SEQ ID NO: 547974 - DNA, 25 bp, Rattus norvegicus
cactggcgaaaaaccctatgggtgc

SEQ ID NO: 547975 - DNA, 25 bp, Rattus norvegicus
tgcgctcctcggatctgcgcaaaca

SEQ ID NO: 547976 - DNA, 25 bp, Rattus norvegicus
acatgcacagcaacgacaagccctt

SEQ ID NO: 547977 - DNA, 25 bp, Rattus norvegicus
gctcagtgcggcttgaccttcaaca

SEQ ID NO: 547978 - DNA, 25 bp, Rattus norvegicus
ggcaagtgcttcaccaaatcctcca

SEQ ID NO: 547979 - DNA, 25 bp, Rattus norvegicus
gaggcccttcaagtgcgccgactgc

SEQ ID NO: 547980 - DNA, 25 bp, Rattus norvegicus
cacaccggcgagaggccgtttcctt

SEQ ID NO: 547981 - DNA, 25 bp, Rattus norvegicus
agcagacccactctggggacaagga

SEQ ID NO: 547982 - DNA, 25 bp, Rattus norvegicus
caaggacttcctctgtgcggagtgc

SEQ ID NO: 547983 - DNA, 25 bp, Rattus norvegicus
agcaccggcgcctacacacaggtga

SEQ ID NO: 547984 - DNA, 25 bp, Rattus norvegicus
gaagttgtcgaagccggacaccgca

SEQ ID NO: 547985 - DNA, 25 bp, Rattus norvegicus
acgtggcggcgcctgccaacagccc

SEQ ID NO: 547986 - DNA, 25 bp, Rattus norvegicus
gcctgggctcagtccacgcatctcg

SEQ ID NO: 547987 - DNA, 25 bp, Rattus norvegicus
tcgggcagccttcggcctgggctca

SEQ ID NO: 547988 - DNA, 25 bp, Rattus norvegicus
cacagggcaggctcgggcagccttc

SEQ ID NO: 547989 - DNA, 25 bp, Rattus norvegicus
gctccctcctgtagccgggcacagg

SEQ ID NO: 547990 - DNA, 25 bp, Rattus norvegicus
tcctcctcaggcagagccaggacgt

SEQ ID NO: 547991 - DNA, 25 bp, Rattus norvegicus
tcgagcagggcacactgctgcggcc

SEQ ID NO: 547992 - DNA, 25 bp, Rattus norvegicus
tcggcctcgagcagggcacactgct

SEQ ID NO: 547993 - DNA, 25 bp, Rattus norvegicus
cctcgtcggaggcatcggcctcgag

SEQ ID NO: 547994 - DNA, 25 bp, Rattus norvegicus
tcgaagccggacaccgcagagcgcg

SEQ ID NO: 547995 - DNA, 25 bp, Rattus norvegicus
gcaccgggaagaagttgtcgaagcc

SEQ ID NO: 547996 - DNA, 25 bp, Rattus norvegicus
ctcctgcaccgggaagaagttgtcg

SEQ ID NO: 547997 - DNA, 25 bp, Rattus norvegicus
agcatgcccacctcgtcggaggcat

SEQ ID NO: 547998 - DNA, 25 bp, Rattus norvegicus
gcggctgcggctctaactccgaccg

SEQ ID NO: 547999 - DNA, 25 bp, Rattus norvegicus
cggagcgctccggtaaccctggcaa

SEQ ID NO: 548000 - DNA, 25 bp, Rattus norvegicus
cgtgcagctgggagctcccgcgaaa

SEQ ID NO: 548001 - DNA, 25 bp, Rattus norvegicus
cagctgggagctcccgcgaaaggct

SEQ ID NO: 548002 - DNA, 25 bp, Rattus norvegicus
gatcagcaggaacctcttgcccgcg

SEQ ID NO: 548003 - DNA, 25 bp, Rattus norvegicus
agcaggaacctcttgcccgcggggc

SEQ ID NO: 548004 - DNA, 25 bp, Rattus norvegicus
gggcgcattgttacgccctcggccg

SEQ ID NO: 548005 - DNA, 25 bp, Rattus norvegicus
gattgccgctgtcctgcaataccct

SEQ ID NO: 548006 - DNA, 25 bp, Rattus norvegicus
cggtaaccctggcaacggcggctgc

SEQ ID NO: 548007 - DNA, 25 bp, Rattus norvegicus
gttggaaataactgcgccgttccca

SEQ ID NO: 548008 - DNA, 25 bp, Rattus norvegicus
tgtcctgcaataccctcgcaccctg

SEQ ID NO: 548009 - DNA, 25 bp, Rattus norvegicus
ccgcgctccagaaggggcgcattgt

SEQ ID NO: 548010 - DNA, 25 bp, Rattus norvegicus
ttcccatggcgaccaggcagcgact

SEQ ID NO: 548011 - DNA, 25 bp, Rattus norvegicus
agcagattgccgctgtcctgcaata

SEQ ID NO: 548012 - DNA, 25 bp, Rattus norvegicus
ctcctcttccagacgacggggtgaa

SEQ ID NO: 548013 - DNA, 25 bp, Rattus norvegicus
gccgcagggcttttccgtaagagtc

SEQ ID NO: 548014 - DNA, 25 bp, Rattus norvegicus
gttcgcctctgtggttgtaccctca

SEQ ID NO: 548015 - DNA, 25 bp, Rattus norvegicus
ggtgaacgcctgcttgccttctaaa

SEQ ID NO: 548016 - DNA, 25 bp, Rattus norvegicus
tgtaccctcagcgtgtgaaagctcg

SEQ ID NO: 548017 - DNA, 25 bp, Rattus norvegicus
tgacgatacggtgagcctccagctt

SEQ ID NO: 548018 - DNA, 25 bp, Rattus norvegicus
cttgcccagggagatgctgacgata

SEQ ID NO: 548019 - DNA, 25 bp, Rattus norvegicus
acccgcgagttgtagatcttgccca

SEQ ID NO: 548020 - DNA, 25 bp, Rattus norvegicus
gcgcagcactaacgacaccaagagg

SEQ ID NO: 548021 - DNA, 25 bp, Rattus norvegicus
gggcaggggtcactcaagtagactt

SEQ ID NO: 548022 - DNA, 25 bp, Rattus norvegicus
gggacccgttctctgaggaccgctc

SEQ ID NO: 548023 - DNA, 25 bp, Rattus norvegicus
atgctgatgaggtttgccacgttcc

SEQ ID NO: 548024 - DNA, 25 bp, Rattus norvegicus
tcccgagaagctagacccgaagatg

SEQ ID NO: 548025 - DNA, 25 bp, Rattus norvegicus
ccttctaaagctgagagaggcgcga

SEQ ID NO: 548026 - DNA, 25 bp, Rattus norvegicus
ccgggcgccatgtccatggaggacc

SEQ ID NO: 548027 - DNA, 25 bp, Rattus norvegicus
ctctccggcgcagtgcctgggcgat

SEQ ID NO: 548028 - DNA, 25 bp, Rattus norvegicus
tggaggaccccttctttgtagtgaa

SEQ ID NO: 548029 - DNA, 25 bp, Rattus norvegicus
gtgggccgaggactcccgcctcagt

SEQ ID NO: 548030 - DNA, 25 bp, Rattus norvegicus
cagcaactgggcaggaaaagggaaa

SEQ ID NO: 548031 - DNA, 25 bp, Rattus norvegicus
tctcgggtctagtgacgcatcctag

SEQ ID NO: 548032 - DNA, 25 bp, Rattus norvegicus
aggcgctggccacggtagacctcag

SEQ ID NO: 548033 - DNA, 25 bp, Rattus norvegicus
ctgaccgagtgctggaccgacggct

SEQ ID NO: 548034 - DNA, 25 bp, Rattus norvegicus
acgcgtccatgattggtcgtggcga

SEQ ID NO: 548035 - DNA, 25 bp, Rattus norvegicus
tctagtgacgcatcctaggctccgc

SEQ ID NO: 548036 - DNA, 25 bp, Rattus norvegicus
tgaggctgccgtacgcgtccatgat

SEQ ID NO: 548037 - DNA, 25 bp, Rattus norvegicus
gagctagctcgggacggccactccg

SEQ ID NO: 548038 - DNA, 25 bp, Rattus norvegicus
atctgggtcacgtgagcttgagtgc

SEQ ID NO: 548039 - DNA, 25 bp, Rattus norvegicus
cattgtggagtcatggagctagctc

SEQ ID NO: 548040 - DNA, 25 bp, Rattus norvegicus
gagactcggcacctaggagagcagc

SEQ ID NO: 548041 - DNA, 25 bp, Rattus norvegicus
tcagcaacagctagctgggcacagc

SEQ ID NO: 548042 - DNA, 25 bp, Rattus norvegicus
tgctaggcgggcgtttggtacccta

SEQ ID NO: 548043 - DNA, 25 bp, Rattus norvegicus
tgtcgtcttttcctgccatcagtgg

SEQ ID NO: 548044 - DNA, 25 bp, Rattus norvegicus
gccatcagtgggctagtcagcaaca

SEQ ID NO: 548045 - DNA, 25 bp, Rattus norvegicus
ggttacggtcgctctcttcaaggca

SEQ ID NO: 548046 - DNA, 25 bp, Rattus norvegicus
tcaaggcagcgcctggagatcaccg

SEQ ID NO: 548047 - DNA, 25 bp, Rattus norvegicus
gcggtttgcctcctaccaacgaagc

SEQ ID NO: 548048 - DNA, 25 bp, Rattus norvegicus
agactcggccctgaggagactcggc

SEQ ID NO: 548049 - DNA, 25 bp, Rattus norvegicus
gtgctgagaaaaaccacacgcttta

SEQ ID NO: 548050 - DNA, 25 bp, Rattus norvegicus
tagggccgctgaggagaacaagcct

SEQ ID NO: 548051 - DNA, 25 bp, Rattus norvegicus
gagaacaagcctggcggctgcctgt

SEQ ID NO: 548052 - DNA, 25 bp, Rattus norvegicus
gcttgtcgagctcttgatgtccgta

SEQ ID NO: 548053 - DNA, 25 bp, Rattus norvegicus
gtctgggtctccatcgcggagactc

SEQ ID NO: 548054 - DNA, 25 bp, Rattus norvegicus
ccgtgaggatgtgtgtggtgatgcc

SEQ ID NO: 548055 - DNA, 25 bp, Rattus norvegicus
atgccgtgaggatgcgtgtggtgat

SEQ ID NO: 548056 - DNA, 25 bp, Rattus norvegicus
atgcgtgtggtgatgccgtgaggat

SEQ ID NO: 548057 - DNA, 25 bp, Rattus norvegicus
gtgtggtaatgctgtgaggaggatg

SEQ ID NO: 548058 - DNA, 25 bp, Rattus norvegicus
tgtggtaatgctgtgaggaggatgt

SEQ ID NO: 548059 - DNA, 25 bp, Rattus norvegicus
atgcgtgtggtgatgctgtgaggat

SEQ ID NO: 548060 - DNA, 25 bp, Rattus norvegicus
ctgtgaggatgcgtgtgatgccgtg

SEQ ID NO: 548061 - DNA, 25 bp, Rattus norvegicus
atgccgtgaggacgtgtgtggtgat

SEQ ID NO: 548062 - DNA, 25 bp, Rattus norvegicus
ccgtgaggatgtgtgtggtgatgct

SEQ ID NO: 548063 - DNA, 25 bp, Rattus norvegicus
tggtgatgctgtgaggatgtatgtg

SEQ ID NO: 548064 - DNA, 25 bp, Rattus norvegicus
gatgtatgtggtgatgctgtgagga

SEQ ID NO: 548065 - DNA, 25 bp, Rattus norvegicus
tgtgaggatgcgtgtgatgccgtga

SEQ ID NO: 548066 - DNA, 25 bp, Rattus norvegicus
atgtgtgtggtgatgctgtgaggat

SEQ ID NO: 548067 - DNA, 25 bp, Rattus norvegicus
gatgccgtgaggatgtgtgtggtga

SEQ ID NO: 548068 - DNA, 25 bp, Rattus norvegicus
gcgcttactggaaacacgctcccga

SEQ ID NO: 548069 - DNA, 25 bp, Rattus norvegicus
ggctcgctagcgcttactggaaaca

SEQ ID NO: 548070 - DNA, 25 bp, Rattus norvegicus
ggaacagctgcgctggctcgctagc

SEQ ID NO: 548071 - DNA, 25 bp, Rattus norvegicus
cgaactgtcgggaacagctgcgctg

SEQ ID NO: 548072 - DNA, 25 bp, Rattus norvegicus
gcacccggccgaactgtcgggaaca

SEQ ID NO: 548073 - DNA, 25 bp, Rattus norvegicus
ccgggcatctgtgtgcgcccgcacc

SEQ ID NO: 548074 - DNA, 25 bp, Rattus norvegicus
tgcattgatcgctggcgaagacgcg

SEQ ID NO: 548075 - DNA, 25 bp, Rattus norvegicus
tgcttgcattgatcgctggcgaaga

SEQ ID NO: 548076 - DNA, 25 bp, Rattus norvegicus
agtcggggatgcttgcattgatcgc

SEQ ID NO: 548077 - DNA, 25 bp, Rattus norvegicus
atgaggacccgagcaagcctgcccg

SEQ ID NO: 548078 - DNA, 25 bp, Rattus norvegicus
gtcttagaccatgaggacccgagca

SEQ ID NO: 548079 - DNA, 25 bp, Rattus norvegicus
cttgcagatcggtggtcttagacca

SEQ ID NO: 548080 - DNA, 25 bp, Rattus norvegicus
tggaaacacgctcccgagcgcgcag

SEQ ID NO: 548081 - DNA, 25 bp, Rattus norvegicus
acgtgatggtgtcttgcagatcggt

SEQ ID NO: 548082 - DNA, 25 bp, Rattus norvegicus
ggcgccgaccagatcccgagggact

SEQ ID NO: 548083 - DNA, 25 bp, Rattus norvegicus
ccgtacttactgagagcggtgcgcg

SEQ ID NO: 548084 - DNA, 25 bp, Rattus norvegicus
gcgcgggcttggttgccgcctccat

SEQ ID NO: 548085 - DNA, 25 bp, Rattus norvegicus
gcagcgcccgctacttcatagcttt

SEQ ID NO: 548086 - DNA, 25 bp, Rattus norvegicus
ccgctacttcatagctttgcttgaa

SEQ ID NO: 548087 - DNA, 25 bp, Rattus norvegicus
tgcttgaaggtgaaaggcccagccc

SEQ ID NO: 548088 - DNA, 25 bp, Rattus norvegicus
cctcacgggccgaccagagaagaga

SEQ ID NO: 548089 - DNA, 25 bp, Rattus norvegicus
aacgaaggccgcctagacggctgga

SEQ ID NO: 548090 - DNA, 25 bp, Rattus norvegicus
gactccacccggcttcggtggagcg

SEQ ID NO: 548091 - DNA, 25 bp, Rattus norvegicus
tacaccctgcatttggggcgcaccg

SEQ ID NO: 548092 - DNA, 25 bp, Rattus norvegicus
aaaggcggcgagcttcagccgactc

SEQ ID NO: 548093 - DNA, 25 bp, Rattus norvegicus
cggctcttcaccgtacttactgaga

SEQ ID NO: 548094 - DNA, 25 bp, Rattus norvegicus
ccttccagctctgtggcggcgggaa

SEQ ID NO: 548095 - DNA, 25 bp, Rattus norvegicus
cggctggaggatacaccctgcattt

SEQ ID NO: 548096 - DNA, 25 bp, Rattus norvegicus
ggcggcaacagcgactccgactcct

SEQ ID NO: 548097 - DNA, 25 bp, Rattus norvegicus
gccctctagacgtcatcgccatggt

SEQ ID NO: 548098 - DNA, 25 bp, Rattus norvegicus
tctagacgtcatcgccatggtaacc

SEQ ID NO: 548099 - DNA, 25 bp, Rattus norvegicus
tcgccgccgtctgcatatccgttac

SEQ ID NO: 548100 - DNA, 25 bp, Rattus norvegicus
ccgcgggtacctcatactggatgta

SEQ ID NO: 548101 - DNA, 25 bp, Rattus norvegicus
gggtacctcatactggatgtactgc

SEQ ID NO: 548102 - DNA, 25 bp, Rattus norvegicus
gatgtactgcttcctccactcggga

SEQ ID NO: 548103 - DNA, 25 bp, Rattus norvegicus
cggcgctgcgcgaagctgcgcttct

SEQ ID NO: 548104 - DNA, 25 bp, Rattus norvegicus
tcctccactcgggagtgatgtgcgc

SEQ ID NO: 548105 - DNA, 25 bp, Rattus norvegicus
cggagaggtgctcggcgaacttcat

SEQ ID NO: 548106 - DNA, 25 bp, Rattus norvegicus
aggtgctcggcgaacttcatcctgc

SEQ ID NO: 548107 - DNA, 25 bp, Rattus norvegicus
gccgaggtctcctcagagccgccct

SEQ ID NO: 548108 - DNA, 25 bp, Rattus norvegicus
cacccggctccagcagctacaggcg

SEQ ID NO: 548109 - DNA, 25 bp, Rattus norvegicus
tcggcgaacttcatcctgccgtgtc

SEQ ID NO: 548110 - DNA, 25 bp, Rattus norvegicus
ctgttaccgggtgcacccgtttctg

SEQ ID NO: 548111 - DNA, 25 bp, Rattus norvegicus
ccgccatggtgttccctgttaccgg

SEQ ID NO: 548112 - DNA, 25 bp, Rattus norvegicus
tgcacccgtttctgactcccgccat

SEQ ID NO: 548113 - DNA, 25 bp, Rattus norvegicus
tgttaccgggtgcacccgtttctga

SEQ ID NO: 548114 - DNA, 25 bp, Rattus norvegicus
tggtgttccctgttaccgggtgcac

SEQ ID NO: 548115 - DNA, 25 bp, Rattus norvegicus
ccgtttctgactcccgccatggtgt

SEQ ID NO: 548116 - DNA, 25 bp, Rattus norvegicus
catggtgttccctgttaccgggtgc

SEQ ID NO: 548117 - DNA, 25 bp, Rattus norvegicus
ccatggtgttccctgttaccgggtg

SEQ ID NO: 548118 - DNA, 25 bp, Rattus norvegicus
actcccgccatggtgttccctgtta

SEQ ID NO: 548119 - DNA, 25 bp, Rattus norvegicus
tgactcccgccatggtgttccctgt

SEQ ID NO: 548120 - DNA, 25 bp, Rattus norvegicus
cacccgtttctgactcccgccatgg

SEQ ID NO: 548121 - DNA, 25 bp, Rattus norvegicus
gactcccgccatggtgttccctgtt

SEQ ID NO: 548122 - DNA, 25 bp, Rattus norvegicus
cgccatggtgttccctgttaccggg

SEQ ID NO: 548123 - DNA, 25 bp, Rattus norvegicus
atggtgttccctgttaccgggtgca

SEQ ID NO: 548124 - DNA, 25 bp, Rattus norvegicus
cggagtggcagaatcacctgagacc

SEQ ID NO: 548125 - DNA, 25 bp, Rattus norvegicus
aacattgaggccgacccgcactgcg

SEQ ID NO: 548126 - DNA, 25 bp, Rattus norvegicus
atccacgactgccttctcgggagtg

SEQ ID NO: 548127 - DNA, 25 bp, Rattus norvegicus
aggtcccgtatccacgggcacgtgc

SEQ ID NO: 548128 - DNA, 25 bp, Rattus norvegicus
cctgagaccaccagacagctagctg

SEQ ID NO: 548129 - DNA, 25 bp, Rattus norvegicus
tgctcgagcttctcacccggactag

SEQ ID NO: 548130 - DNA, 25 bp, Rattus norvegicus
tctcacccggactagtggtccaggc

SEQ ID NO: 548131 - DNA, 25 bp, Rattus norvegicus
cgggaacccgcgtcacaccggagag

SEQ ID NO: 548132 - DNA, 25 bp, Rattus norvegicus
cacaccggagaggactgatcacagc

SEQ ID NO: 548133 - DNA, 25 bp, Rattus norvegicus
gaggactgatcacagcgagctagtg

SEQ ID NO: 548134 - DNA, 25 bp, Rattus norvegicus
gcgagctagtggacatggcaacacc

SEQ ID NO: 548135 - DNA, 25 bp, Rattus norvegicus
tggcaacaccatttctacccgcggg

SEQ ID NO: 548136 - DNA, 25 bp, Rattus norvegicus
cgactccggtgacttggaatccttc

SEQ ID NO: 548137 - DNA, 25 bp, Rattus norvegicus
cggagcaggcgaggtcccgtatcca

SEQ ID NO: 548138 - DNA, 25 bp, Rattus norvegicus
tggcctctgcctacatcggcaactg

SEQ ID NO: 548139 - DNA, 25 bp, Rattus norvegicus
tttttctcaaggctgcagggttcca

SEQ ID NO: 548140 - DNA, 25 bp, Rattus norvegicus
tcctcagtgagggaaccgagactcg

SEQ ID NO: 548141 - DNA, 25 bp, Rattus norvegicus
tcccgaaggcaaggaggcaagcagc

SEQ ID NO: 548142 - DNA, 25 bp, Rattus norvegicus
ggcgccactcttcgcttcggtcttt

SEQ ID NO: 548143 - DNA, 25 bp, Rattus norvegicus
cctggccgacgctcagaaacaagaa

SEQ ID NO: 548144 - DNA, 25 bp, Rattus norvegicus
gctcggccaccgcagttagatcaga

SEQ ID NO: 548145 - DNA, 25 bp, Rattus norvegicus
tgcccttgtcccactcaaacggtaa

SEQ ID NO: 548146 - DNA, 25 bp, Rattus norvegicus
agtgcgcgcaaagtcccgaaggaca

SEQ ID NO: 548147 - DNA, 25 bp, Rattus norvegicus
agagcacgcgccacttgcaagttcg

SEQ ID NO: 548148 - DNA, 25 bp, Rattus norvegicus
cccgcgaggcaaaaagaggtcacac

SEQ ID NO: 548149 - DNA, 25 bp, Rattus norvegicus
caccgagaggccttgattatttttc

SEQ ID NO: 548150 - DNA, 25 bp, Rattus norvegicus
cggtaatcacactgtccaggacgca

SEQ ID NO: 548151 - DNA, 25 bp, Rattus norvegicus
gcagggttccagacctctccaagtc

SEQ ID NO: 548152 - DNA, 25 bp, Rattus norvegicus
aagagcgctcacgacttccgagaga

SEQ ID NO: 548153 - DNA, 25 bp, Rattus norvegicus
tttctccttgatgccgaggaagccg

SEQ ID NO: 548154 - DNA, 25 bp, Rattus norvegicus
atcgccatttttcgccgcctttctc

SEQ ID NO: 548155 - DNA, 25 bp, Rattus norvegicus
tagaggtttcctcccacttgcccgc

SEQ ID NO: 548156 - DNA, 25 bp, Rattus norvegicus
ctgattttccactcgggaccggctc

SEQ ID NO: 548157 - DNA, 25 bp, Rattus norvegicus
gcggctcctgattttccactcggga

SEQ ID NO: 548158 - DNA, 25 bp, Rattus norvegicus
cagaaacgcggctcctgattttcca

SEQ ID NO: 548159 - DNA, 25 bp, Rattus norvegicus
ttcgggattcgcagaaacgcggctc

SEQ ID NO: 548160 - DNA, 25 bp, Rattus norvegicus
cgcagggttcgggattcgcagaaac

SEQ ID NO: 548161 - DNA, 25 bp, Rattus norvegicus
aaaccctgcttggagcgcagggttc

SEQ ID NO: 548162 - DNA, 25 bp, Rattus norvegicus
ggattgtaaaccctgcttggagcgc

SEQ ID NO: 548163 - DNA, 25 bp, Rattus norvegicus
agggcagcggtcaggattgtaaacc

SEQ ID NO: 548164 - DNA, 25 bp, Rattus norvegicus
agaagccctgacgtggaaaagaagt

SEQ ID NO: 548165 - DNA, 25 bp, Rattus norvegicus
cttccgagagaagccctgacgtgga

SEQ ID NO: 548166 - DNA, 25 bp, Rattus norvegicus
ttgcaccggcggtgctgcaagcttt

SEQ ID NO: 548167 - DNA, 25 bp, Rattus norvegicus
tcccgccaggttgggtaaagttgca

SEQ ID NO: 548168 - DNA, 25 bp, Rattus norvegicus
gtggcaaggggcttctgcccagccc

SEQ ID NO: 548169 - DNA, 25 bp, Rattus norvegicus
gctccaactgccgaaaccaagagtg

SEQ ID NO: 548170 - DNA, 25 bp, Rattus norvegicus
gggactcaaccaagtgctccaactg

SEQ ID NO: 548171 - DNA, 25 bp, Rattus norvegicus
gcagcagcgactggggactcaacca

SEQ ID NO: 548172 - DNA, 25 bp, Rattus norvegicus
tgtcggctgcgacacaggcagcagc

SEQ ID NO: 548173 - DNA, 25 bp, Rattus norvegicus
ggagcagtctgtcggctgcgacaca

SEQ ID NO: 548174 - DNA, 25 bp, Rattus norvegicus
tgagtgcactcgctcacccggagca

SEQ ID NO: 548175 - DNA, 25 bp, Rattus norvegicus
tagctggaatgtagtgagtgcactc

SEQ ID NO: 548176 - DNA, 25 bp, Rattus norvegicus
cgctgcattcctccgctagctggaa

SEQ ID NO: 548177 - DNA, 25 bp, Rattus norvegicus
gtccacaacttcgttccagagcttc

SEQ ID NO: 548178 - DNA, 25 bp, Rattus norvegicus
tgctgcaagctttggccattgccgc

SEQ ID NO: 548179 - DNA, 25 bp, Rattus norvegicus
ttccagagcttctcgccgctgcatt

SEQ ID NO: 548180 - DNA, 25 bp, Rattus norvegicus
ggctggattcggagatttgaaaata

SEQ ID NO: 548181 - DNA, 25 bp, Rattus norvegicus
tgacgtcgctttccgcagggaagcc

SEQ ID NO: 548182 - DNA, 25 bp, Rattus norvegicus
cgtgttctgtgactggatgattcca

SEQ ID NO: 548183 - DNA, 25 bp, Rattus norvegicus
tccaacccaccgagcgtgttctgtg

SEQ ID NO: 548184 - DNA, 25 bp, Rattus norvegicus
cggagttcagagcttctccaaccca

SEQ ID NO: 548185 - DNA, 25 bp, Rattus norvegicus
agcatcggtcctctaggatcaaaga

SEQ ID NO: 548186 - DNA, 25 bp, Rattus norvegicus
ccagtataaatactgcggcgggctg

SEQ ID NO: 548187 - DNA, 25 bp, Rattus norvegicus
attctttcacactgcaggagcggcc

SEQ ID NO: 548188 - DNA, 25 bp, Rattus norvegicus
ccgcggtcacccaggcattttgatt

SEQ ID NO: 548189 - DNA, 25 bp, Rattus norvegicus
ccagtcctcaggctgtttcaaatcc

SEQ ID NO: 548190 - DNA, 25 bp, Rattus norvegicus
tccgggaggactccacaagctggcc

SEQ ID NO: 548191 - DNA, 25 bp, Rattus norvegicus
taaaaccaaccaggccgctgaagtc

SEQ ID NO: 548192 - DNA, 25 bp, Rattus norvegicus
acagctcgtactcggccgggaacgc

SEQ ID NO: 548193 - DNA, 25 bp, Rattus norvegicus
tgaagtcacagaggaagccgagccc

SEQ ID NO: 548194 - DNA, 25 bp, Rattus norvegicus
gcgaaggcgatgcaatggccacacc

SEQ ID NO: 548195 - DNA, 25 bp, Rattus norvegicus
ctccgcccgcaaggaggagctacga

SEQ ID NO: 548196 - DNA, 25 bp, Rattus norvegicus
cctcaggcagcactcgaggtcgttg

SEQ ID NO: 548197 - DNA, 25 bp, Rattus norvegicus
ctcacctttcacgtcgttagcaagc

SEQ ID NO: 548198 - DNA, 25 bp, Rattus norvegicus
actgccagagtgagggtccagatac

SEQ ID NO: 548199 - DNA, 25 bp, Rattus norvegicus
ctcaagtttgtgactagtcggtacc

SEQ ID NO: 548200 - DNA, 25 bp, Rattus norvegicus
tgactgtccacctcgctcaagtttg

SEQ ID NO: 548201 - DNA, 25 bp, Rattus norvegicus
ctcctcatcctaggcggcttgactg

SEQ ID NO: 548202 - DNA, 25 bp, Rattus norvegicus
tggatcagaggacgagtagagcacc

SEQ ID NO: 548203 - DNA, 25 bp, Rattus norvegicus
gtgtccgcatccagcagcgtcagtg

SEQ ID NO: 548204 - DNA, 25 bp, Rattus norvegicus
tactggatcccagcacagccgggcg

SEQ ID NO: 548205 - DNA, 25 bp, Rattus norvegicus
tggccacaccaggaggcgaagaact

SEQ ID NO: 548206 - DNA, 25 bp, Rattus norvegicus
gttagcaagctccttccacgtcgga

SEQ ID NO: 548207 - DNA, 25 bp, Rattus norvegicus
gggtacgaatgccacaggggcctca

SEQ ID NO: 548208 - DNA, 25 bp, Rattus norvegicus
cttccaaattgagagggcgcccatt

SEQ ID NO: 548209 - DNA, 25 bp, Rattus norvegicus
cgtggtctctagtcgtacatgggca

SEQ ID NO: 548210 - DNA, 25 bp, Rattus norvegicus
ggtacgtattggtccacagctctgc

SEQ ID NO: 548211 - DNA, 25 bp, Rattus norvegicus
aagccacgcactctcccgagttgag

SEQ ID NO: 548212 - DNA, 25 bp, Rattus norvegicus
agctctgcccgaatacagctggttg

SEQ ID NO: 548213 - DNA, 25 bp, Rattus norvegicus
cagctggttgcctttgcatctgaca

SEQ ID NO: 548214 - DNA, 25 bp, Rattus norvegicus
ctttgcatctgacacgtggtctcta

SEQ ID NO: 548215 - DNA, 25 bp, Rattus norvegicus
gtcgtacatgggcactgctcactcc

SEQ ID NO: 548216 - DNA, 25 bp, Rattus norvegicus
ccagcgctctcttgaactccaattg

SEQ ID NO: 548217 - DNA, 25 bp, Rattus norvegicus
ttgaactccaattgcgcaagccacg

SEQ ID NO: 548218 - DNA, 25 bp, Rattus norvegicus
ccctgcatccaggtacgtattggtc

SEQ ID NO: 548219 - DNA, 25 bp, Rattus norvegicus
gagcaccacggtcccttccaaattg

SEQ ID NO: 548220 - DNA, 25 bp, Rattus norvegicus
attgctcccgagttgagcggacgcc

SEQ ID NO: 548221 - DNA, 25 bp, Rattus norvegicus
tctcccgagttgagcgagcaccacg

SEQ ID NO: 548222 - DNA, 25 bp, Rattus norvegicus
ggtgtgaacgcgttcccttcagctc

SEQ ID NO: 548223 - DNA, 25 bp, Rattus norvegicus
gggtcgcagctactctggcggccct

SEQ ID NO: 548224 - DNA, 25 bp, Rattus norvegicus
ggccctgcccagaatagctttcctt

SEQ ID NO: 548225 - DNA, 25 bp, Rattus norvegicus
atagctttccttccgggcagggttg

SEQ ID NO: 548226 - DNA, 25 bp, Rattus norvegicus
ccgcagtgccagctcccgaaatagg

SEQ ID NO: 548227 - DNA, 25 bp, Rattus norvegicus
cagctcccgaaatagggcccggcgg

SEQ ID NO: 548228 - DNA, 25 bp, Rattus norvegicus
aggggctgtcccagctcgcaggcac

SEQ ID NO: 548229 - DNA, 25 bp, Rattus norvegicus
tcgcaggcacactaagccgctgcga

SEQ ID NO: 548230 - DNA, 25 bp, Rattus norvegicus
accctggcacccgataggggcctgg

SEQ ID NO: 548231 - DNA, 25 bp, Rattus norvegicus
gaccacggagaaggggattgcaata

SEQ ID NO: 548232 - DNA, 25 bp, Rattus norvegicus
attgcaatagagacccgggatcggg

SEQ ID NO: 548233 - DNA, 25 bp, Rattus norvegicus
tgacctcacagcctgcgaggaagcc

SEQ ID NO: 548234 - DNA, 25 bp, Rattus norvegicus
tcacagcctgcgaggaagcccgtcg

SEQ ID NO: 548235 - DNA, 25 bp, Rattus norvegicus
ttgaggaattcgcagctggcggcct

SEQ ID NO: 548236 - DNA, 25 bp, Rattus norvegicus
cctgcgcgtgcttctttaacgcatc

SEQ ID NO: 548237 - DNA, 25 bp, Rattus norvegicus
cctgcgcatgcttcattaatgcatc

SEQ ID NO: 548238 - DNA, 25 bp, Rattus norvegicus
tgcgcatgcttcattaatgcatccc

SEQ ID NO: 548239 - DNA, 25 bp, Rattus norvegicus
ttaatgcatcccctctctgcgcatg

SEQ ID NO: 548240 - DNA, 25 bp, Rattus norvegicus
ctccctgtgcgtgcttcttttacag

SEQ ID NO: 548241 - DNA, 25 bp, Rattus norvegicus
ttcttttacagccttcgacagcttg

SEQ ID NO: 548242 - DNA, 25 bp, Rattus norvegicus
ttacagccttcgacagcttgacacg

SEQ ID NO: 548243 - DNA, 25 bp, Rattus norvegicus
ccctgtgcgtgcttcttttacagcc

SEQ ID NO: 548244 - DNA, 25 bp, Rattus norvegicus
tgtgcgtgcttcttttacagccttc

SEQ ID NO: 548245 - DNA, 25 bp, Rattus norvegicus
tgcgtgcttcttttacagccttcga

SEQ ID NO: 548246 - DNA, 25 bp, Rattus norvegicus
cgtgcttcttttacagccttcgaca

SEQ ID NO: 548247 - DNA, 25 bp, Rattus norvegicus
tgcttcttttacagccttcgacagc

SEQ ID NO: 548248 - DNA, 25 bp, Rattus norvegicus
tccctgcgcatgcttcattaatgca

SEQ ID NO: 548249 - DNA, 25 bp, Rattus norvegicus
cctccctgcgcatgcttcattaatg

SEQ ID NO: 548250 - DNA, 25 bp, Rattus norvegicus
agctcacctgagagtgtcgcctccg

SEQ ID NO: 548251 - DNA, 25 bp, Rattus norvegicus
gtcgccattacagctcaacaactga

SEQ ID NO: 548252 - DNA, 25 bp, Rattus norvegicus
aggcagttcagagtctccgcagctc

SEQ ID NO: 548253 - DNA, 25 bp, Rattus norvegicus
ccgaataaatcgtcactctaggcag

SEQ ID NO: 548254 - DNA, 25 bp, Rattus norvegicus
tgatgcttcagcaacagtccgaata

SEQ ID NO: 548255 - DNA, 25 bp, Rattus norvegicus
ctttctgcgagttgatgatgcttca

SEQ ID NO: 548256 - DNA, 25 bp, Rattus norvegicus
acttgacaaggatgaacccgggatc

SEQ ID NO: 548257 - DNA, 25 bp, Rattus norvegicus
cctttgacgctaattgggccttctg

SEQ ID NO: 548258 - DNA, 25 bp, Rattus norvegicus
aactcgggaggagccaaagtctatc

SEQ ID NO: 548259 - DNA, 25 bp, Rattus norvegicus
ctagagaacgcgaggaggccatctt

SEQ ID NO: 548260 - DNA, 25 bp, Rattus norvegicus
gtgagcgcgagacaagccgagtcta

SEQ ID NO: 548261 - DNA, 25 bp, Rattus norvegicus
cagccctgggttagggccatgttga

SEQ ID NO: 548262 - DNA, 25 bp, Rattus norvegicus
tcgcgagaactgtccggagacggtt

SEQ ID NO: 548263 - DNA, 25 bp, Rattus norvegicus
ggccaaacacgctgaggacttgaca

SEQ ID NO: 548264 - DNA, 25 bp, Rattus norvegicus
acggatgagtttcgtacgcaggcgc

SEQ ID NO: 548265 - DNA, 25 bp, Rattus norvegicus
agcaggcagccgagactgttacctc

SEQ ID NO: 548266 - DNA, 25 bp, Rattus norvegicus
tacctccgcggtcctcacttaagga

SEQ ID NO: 548267 - DNA, 25 bp, Rattus norvegicus
gactttccgcggttcgattccactg

SEQ ID NO: 548268 - DNA, 25 bp, Rattus norvegicus
tgctgctccagacgagtagacctcc

SEQ ID NO: 548269 - DNA, 25 bp, Rattus norvegicus
gtcttcatctcctcggcttcctggg

SEQ ID NO: 548270 - DNA, 25 bp, Rattus norvegicus
ctgcctccgttgtcgagaccgaaga

SEQ ID NO: 548271 - DNA, 25 bp, Rattus norvegicus
gaccgaagattgtaagcgctttctc

SEQ ID NO: 548272 - DNA, 25 bp, Rattus norvegicus
cccgccatagttgtttacgtagctg

SEQ ID NO: 548273 - DNA, 25 bp, Rattus norvegicus
tctggcggctcttctgaaaacctca

SEQ ID NO: 548274 - DNA, 25 bp, Rattus norvegicus
ggaatcatcaccactaccctagcgg

SEQ ID NO: 548275 - DNA, 25 bp, Rattus norvegicus
gcgtcactcccgtcgccattttgag

SEQ ID NO: 548276 - DNA, 25 bp, Rattus norvegicus
ggggctcgaagtcgccgtacacttc

SEQ ID NO: 548277 - DNA, 25 bp, Rattus norvegicus
agcccaaagggtcaaggaatcatca

SEQ ID NO: 548278 - DNA, 25 bp, Rattus norvegicus
gttaaggcggggtgctctgcacaag

SEQ ID NO: 548279 - DNA, 25 bp, Rattus norvegicus
ccgggcgcgcttacctaggtgttca

SEQ ID NO: 548280 - DNA, 25 bp, Rattus norvegicus
gacagcgctctggcgccaggctcat

SEQ ID NO: 548281 - DNA, 25 bp, Rattus norvegicus
tctctgcgttggaaaatgcctccta

SEQ ID NO: 548282 - DNA, 25 bp, Rattus norvegicus
cgaggccagagatctgtctgctgtt

SEQ ID NO: 548283 - DNA, 25 bp, Rattus norvegicus
tctgtctgctgttctgcgcgccgac

SEQ ID NO: 548284 - DNA, 25 bp, Rattus norvegicus
gccgacccactatctctgcgttgga

SEQ ID NO: 548285 - DNA, 25 bp, Rattus norvegicus
agcatttttgagagctcgggctgcg

SEQ ID NO: 548286 - DNA, 25 bp, Rattus norvegicus
tgccctggactctgcgcgccttcct

SEQ ID NO: 548287 - DNA, 25 bp, Rattus norvegicus
cgcttacctaggtgttcaggcgccc

SEQ ID NO: 548288 - DNA, 25 bp, Rattus norvegicus
gcgttggaaaatgcctcctaggtcc

SEQ ID NO: 548289 - DNA, 25 bp, Rattus norvegicus
cccactatctctgcgttggaaaatg

SEQ ID NO: 548290 - DNA, 25 bp, Rattus norvegicus
tccacacaccgaggccagagatctg

SEQ ID NO: 548291 - DNA, 25 bp, Rattus norvegicus
cttcccgcccagcatttttgagagc

SEQ ID NO: 548292 - DNA, 25 bp, Rattus norvegicus
gtgcaccacgttccacgcgcggagg

SEQ ID NO: 548293 - DNA, 25 bp, Rattus norvegicus
cggtcgcctcgctcggctcaggaag

SEQ ID NO: 548294 - DNA, 25 bp, Rattus norvegicus
gatcctgcggttccggctgagccag

SEQ ID NO: 548295 - DNA, 25 bp, Rattus norvegicus
aagcttgaacggatcgcaggccgcc

SEQ ID NO: 548296 - DNA, 25 bp, Rattus norvegicus
catgctcttcccgtgacctgagtcg

SEQ ID NO: 548297 - DNA, 25 bp, Rattus norvegicus
cccgtgacctgagtcggaaagtggt

SEQ ID NO: 548298 - DNA, 25 bp, Rattus norvegicus
ctgaggacggcgttagcgcatccct

SEQ ID NO: 548299 - DNA, 25 bp, Rattus norvegicus
ccaagtccggggcactcctggagag

SEQ ID NO: 548300 - DNA, 25 bp, Rattus norvegicus
tggcgcaggcaacctgcagcgccta

SEQ ID NO: 548301 - DNA, 25 bp, Rattus norvegicus
tacctccctccggatgcggtgggaa

SEQ ID NO: 548302 - DNA, 25 bp, Rattus norvegicus
ctccggatgcggtgggaaaacacag

SEQ ID NO: 548303 - DNA, 25 bp, Rattus norvegicus
tgggaaaacacagacgccgccggac

SEQ ID NO: 548304 - DNA, 25 bp, Rattus norvegicus
acggcgttagcgcatccctctgcgg

SEQ ID NO: 548305 - DNA, 25 bp, Rattus norvegicus
tgagccaggagaggtgccctccact

SEQ ID NO: 548306 - DNA, 25 bp, Rattus norvegicus
cgcggagctcttccagaaagaccca

SEQ ID NO: 548307 - DNA, 25 bp, Rattus norvegicus
cccgccgcgtagaatggacagcagg

SEQ ID NO: 548308 - DNA, 25 bp, Rattus norvegicus
agctcttccagaaagacccacggga

SEQ ID NO: 548309 - DNA, 25 bp, Rattus norvegicus
cagaaagacccacgggagaggtagc

SEQ ID NO: 548310 - DNA, 25 bp, Rattus norvegicus
acgggagaggtagcaggtcctcttc

SEQ ID NO: 548311 - DNA, 25 bp, Rattus norvegicus
agcaggtcctcttctagggatgaca

SEQ ID NO: 548312 - DNA, 25 bp, Rattus norvegicus
ggtcctcttctagggatgacaagaa

SEQ ID NO: 548313 - DNA, 25 bp, Rattus norvegicus
gatgacaagaagtcaaaggccggga

SEQ ID NO: 548314 - DNA, 25 bp, Rattus norvegicus
gaggagcaccgagctccagcagcca

SEQ ID NO: 548315 - DNA, 25 bp, Rattus norvegicus
gctccagcagccacggtagtgaatg

SEQ ID NO: 548316 - DNA, 25 bp, Rattus norvegicus
cagccacggtagtgaatgtggacga

SEQ ID NO: 548317 - DNA, 25 bp, Rattus norvegicus
tgaatgtggacgaggttcgaagccc

SEQ ID NO: 548318 - DNA, 25 bp, Rattus norvegicus
agggtacggaagtggtggccctgct

SEQ ID NO: 548319 - DNA, 25 bp, Rattus norvegicus
tgcccgccgcgtagaatggacagca

SEQ ID NO: 548320 - DNA, 25 bp, Rattus norvegicus
cgagcctctcgaagagactcccgga

SEQ ID NO: 548321 - DNA, 25 bp, Rattus norvegicus
tcggccggccatcccttttctggaa

SEQ ID NO: 548322 - DNA, 25 bp, Rattus norvegicus
cgtcgtcatagcaacgcaggaaccc

SEQ ID NO: 548323 - DNA, 25 bp, Rattus norvegicus
ccagcaactttgctggccgagctgc

SEQ ID NO: 548324 - DNA, 25 bp, Rattus norvegicus
gcctccggaggagctgtcagaagaa

SEQ ID NO: 548325 - DNA, 25 bp, Rattus norvegicus
aaacagtttctgcattctcaagatg

SEQ ID NO: 548326 - DNA, 25 bp, Rattus norvegicus
agatgcttccgtgtgactttagtca

SEQ ID NO: 548327 - DNA, 25 bp, Rattus norvegicus
tagtcacgggtagtagcaataagga

SEQ ID NO: 548328 - DNA, 25 bp, Rattus norvegicus
aagaatatttaatccggctgttgtc

SEQ ID NO: 548329 - DNA, 25 bp, Rattus norvegicus
ttgtctcggaatgggacagtctctc

SEQ ID NO: 548330 - DNA, 25 bp, Rattus norvegicus
ggacagtctctcgaagccgtgcttc

SEQ ID NO: 548331 - DNA, 25 bp, Rattus norvegicus
gcttccgggtgcagattgcgcaagc

SEQ ID NO: 548332 - DNA, 25 bp, Rattus norvegicus
ttctggaacgccctgcgtcgtcata

SEQ ID NO: 548333 - DNA, 25 bp, Rattus norvegicus
agcgcagacccgagcctctcgaaga

SEQ ID NO: 548334 - DNA, 25 bp, Rattus norvegicus
cccgagctcccggatgccattggtg

SEQ ID NO: 548335 - DNA, 25 bp, Rattus norvegicus
atgccattggtggtcctgcggcgcc

SEQ ID NO: 548336 - DNA, 25 bp, Rattus norvegicus
tacggaggaagataaagcgcaggcc

SEQ ID NO: 548337 - DNA, 25 bp, Rattus norvegicus
gcgttagggtgtcccttcgccagcc

SEQ ID NO: 548338 - DNA, 25 bp, Rattus norvegicus
gtcgctgcgttagggtgtcccttcg

SEQ ID NO: 548339 - DNA, 25 bp, Rattus norvegicus
cccgaggacagctgcagcggtctag

SEQ ID NO: 548340 - DNA, 25 bp, Rattus norvegicus
tacctgcgacccgaggacagctgca

SEQ ID NO: 548341 - DNA, 25 bp, Rattus norvegicus
cggaagctcgggcttacctgcgacc

SEQ ID NO: 548342 - DNA, 25 bp, Rattus norvegicus
gctcagggtggacctggtcaggaaa

SEQ ID NO: 548343 - DNA, 25 bp, Rattus norvegicus
gacagtccggcccaggctaggccag

SEQ ID NO: 548344 - DNA, 25 bp, Rattus norvegicus
ggctgcgggtaactttcccgctctc

SEQ ID NO: 548345 - DNA, 25 bp, Rattus norvegicus
tgcatcggatggctgcgggtaactt

SEQ ID NO: 548346 - DNA, 25 bp, Rattus norvegicus
cccaggctaggccagcagagccgga

SEQ ID NO: 548347 - DNA, 25 bp, Rattus norvegicus
gctctcccttctaaactcggcggga

SEQ ID NO: 548348 - DNA, 25 bp, Rattus norvegicus
cccggctaggctctccagcctggct

SEQ ID NO: 548349 - DNA, 25 bp, Rattus norvegicus
tccgcccaccgagtagcggaggtgc

SEQ ID NO: 548350 - DNA, 25 bp, Rattus norvegicus
ggagacgctctgtcccacgctcgcc

SEQ ID NO: 548351 - DNA, 25 bp, Rattus norvegicus
cacgctcgccctgtgctcggtggtt

SEQ ID NO: 548352 - DNA, 25 bp, Rattus norvegicus
gccctgtgctcggtggtttaaagat

SEQ ID NO: 548353 - DNA, 25 bp, Rattus norvegicus
ctgtgctcggtggtttaaagatggc

SEQ ID NO: 548354 - DNA, 25 bp, Rattus norvegicus
tctgtgagtcgctgggaggcagcac

SEQ ID NO: 548355 - DNA, 25 bp, Rattus norvegicus
caactccggcccagagggcctgggt

SEQ ID NO: 548356 - DNA, 25 bp, Rattus norvegicus
gcagacgccggcttcaacgtcttca

SEQ ID NO: 548357 - DNA, 25 bp, Rattus norvegicus
gtcttcacccagcacggtgagtgtg

SEQ ID NO: 548358 - DNA, 25 bp, Rattus norvegicus
ccagcacggtgagtgtgtcctaagc

SEQ ID NO: 548359 - DNA, 25 bp, Rattus norvegicus
acggtgagtgtgtcctaagccggct

SEQ ID NO: 548360 - DNA, 25 bp, Rattus norvegicus
aatcggctgccatctgggccagtca

SEQ ID NO: 548361 - DNA, 25 bp, Rattus norvegicus
ccagtcacgggaggcgaggcacacc

SEQ ID NO: 548362 - DNA, 25 bp, Rattus norvegicus
gactcagctgcccatcggactagaa

SEQ ID NO: 548363 - DNA, 25 bp, Rattus norvegicus
ttggtgtcccggactgcaggcatcc

SEQ ID NO: 548364 - DNA, 25 bp, Rattus norvegicus
ccgaactgaaactcaagttggtgtc

SEQ ID NO: 548365 - DNA, 25 bp, Rattus norvegicus
gaccagagacccatccgaactgaaa

SEQ ID NO: 548366 - DNA, 25 bp, Rattus norvegicus
catcggactagaagaaccgagtttc

SEQ ID NO: 548367 - DNA, 25 bp, Rattus norvegicus
agagtccgggaacccagaactcatc

SEQ ID NO: 548368 - DNA, 25 bp, Rattus norvegicus
aaaacatgactggagcgagcgcttc

SEQ ID NO: 548369 - DNA, 25 bp, Rattus norvegicus
tgatccggccacaaggtgcagctga

SEQ ID NO: 548370 - DNA, 25 bp, Rattus norvegicus
gtctcctgatcttcacagtgatccg

SEQ ID NO: 548371 - DNA, 25 bp, Rattus norvegicus
ggaccgctcttacccagaggcggca

SEQ ID NO: 548372 - DNA, 25 bp, Rattus norvegicus
gatgccgtgcttaagagtgagactg

SEQ ID NO: 548373 - DNA, 25 bp, Rattus norvegicus
aggcctctgaccgtacgcaggatgc

SEQ ID NO: 548374 - DNA, 25 bp, Rattus norvegicus
tgaagagcgcccagtaccgtttgga

SEQ ID NO: 548375 - DNA, 25 bp, Rattus norvegicus
accgagtttcgattcagaccagaga

SEQ ID NO: 548376 - DNA, 25 bp, Rattus norvegicus
aagtgactcttcctggcagagggcg

SEQ ID NO: 548377 - DNA, 25 bp, Rattus norvegicus
actgggctgagaataaacagcgctc

SEQ ID NO: 548378 - DNA, 25 bp, Rattus norvegicus
taaacagcgctctgcgcctgtaatc

SEQ ID NO: 548379 - DNA, 25 bp, Rattus norvegicus
tctgcgcctgtaatcccgttgccgt

SEQ ID NO: 548380 - DNA, 25 bp, Rattus norvegicus
tgtaatcccgttgccgtggcgacgg

SEQ ID NO: 548381 - DNA, 25 bp, Rattus norvegicus
aagggaccgccctccctgcgctcag

SEQ ID NO: 548382 - DNA, 25 bp, Rattus norvegicus
gcgctcagcgcggacattcttcgca

SEQ ID NO: 548383 - DNA, 25 bp, Rattus norvegicus
gcggacattcttcgcatagctgctc

SEQ ID NO: 548384 - DNA, 25 bp, Rattus norvegicus
cggtggccgggaagtgactcttcct

SEQ ID NO: 548385 - DNA, 25 bp, Rattus norvegicus
tgcagcacggggctctacccacctg

SEQ ID NO: 548386 - DNA, 25 bp, Rattus norvegicus
cggctcgaagcgcagagaccgaaac

SEQ ID NO: 548387 - DNA, 25 bp, Rattus norvegicus
agaccgaaacatgaggaggaccggc

SEQ ID NO: 548388 - DNA, 25 bp, Rattus norvegicus
gctgagtttcctggcactgggctga

SEQ ID NO: 548389 - DNA, 25 bp, Rattus norvegicus
ttcttcgcatagctgctcccgggct

SEQ ID NO: 548390 - DNA, 25 bp, Rattus norvegicus
tcgccgacagcctcggcccttcagg

SEQ ID NO: 548391 - DNA, 25 bp, Rattus norvegicus
agggacgaaggcaaggacgacactc

SEQ ID NO: 548392 - DNA, 25 bp, Rattus norvegicus
ccggccagcccagctcaggagggac

SEQ ID NO: 548393 - DNA, 25 bp, Rattus norvegicus
ggtcagcagtcagcaggcgtcccct

SEQ ID NO: 548394 - DNA, 25 bp, Rattus norvegicus
acgtccctgggtggaggtgcgccct

SEQ ID NO: 548395 - DNA, 25 bp, Rattus norvegicus
ttttctgcacgtccctgggtggagg

SEQ ID NO: 548396 - DNA, 25 bp, Rattus norvegicus
atttttctgcacgtccctgggtgga

SEQ ID NO: 548397 - DNA, 25 bp, Rattus norvegicus
caatttttctgcacgtccctgggtg

SEQ ID NO: 548398 - DNA, 25 bp, Rattus norvegicus
ttcaggcccaatttttctgcacgtc

SEQ ID NO: 548399 - DNA, 25 bp, Rattus norvegicus
tcccggttcacgctttccccgctgc

SEQ ID NO: 548400 - DNA, 25 bp, Rattus norvegicus
gcccttcaggcccaatttttctgca

SEQ ID NO: 548401 - DNA, 25 bp, Rattus norvegicus
ggacgaaggcaaggacgacactccc

SEQ ID NO: 548402 - DNA, 25 bp, Rattus norvegicus
ggcccaatttttctgcacgtccctg

SEQ ID NO: 548403 - DNA, 25 bp, Rattus norvegicus
tgcctcgccgacagcctcggccctt

SEQ ID NO: 548404 - DNA, 25 bp, Rattus norvegicus
ccagggccaagagcctctggggacc

SEQ ID NO: 548405 - DNA, 25 bp, Rattus norvegicus
gagggccgcatagggacccagcaaa

SEQ ID NO: 548406 - DNA, 25 bp, Rattus norvegicus
gccgggccatcacacccggaaatga

SEQ ID NO: 548407 - DNA, 25 bp, Rattus norvegicus
gctgttggtacggtcctagcggaac

SEQ ID NO: 548408 - DNA, 25 bp, Rattus norvegicus
gggctcgctcttaatcgccgggcca

SEQ ID NO: 548409 - DNA, 25 bp, Rattus norvegicus
ccgcaggcaccgtcggcggttttct

SEQ ID NO: 548410 - DNA, 25 bp, Rattus norvegicus
acccggaaatgaaaccgccagcgca

SEQ ID NO: 548411 - DNA, 25 bp, Rattus norvegicus
tagggactcagcgaaagcgctctcc

SEQ ID NO: 548412 - DNA, 25 bp, Rattus norvegicus
ggacccagcaaaagcgcactggctc

SEQ ID NO: 548413 - DNA, 25 bp, Rattus norvegicus
ggccgccgacaccagcttagcttga

SEQ ID NO: 548414 - DNA, 25 bp, Rattus norvegicus
ttagcttgacaggaggacgacgcca

SEQ ID NO: 548415 - DNA, 25 bp, Rattus norvegicus
cagcgagcaccggtcaccgcaagga

SEQ ID NO: 548416 - DNA, 25 bp, Rattus norvegicus
attcctgctgcgctgtgctccgcag

SEQ ID NO: 548417 - DNA, 25 bp, Rattus norvegicus
ctggacagtctcatctcaagttgtg

SEQ ID NO: 548418 - DNA, 25 bp, Rattus norvegicus
gccactgctccgctgactgggacga

SEQ ID NO: 548419 - DNA, 25 bp, Rattus norvegicus
ccggagcaatcgagagccgagagca

SEQ ID NO: 548420 - DNA, 25 bp, Rattus norvegicus
aggcccgcctactttcctaagactg

SEQ ID NO: 548421 - DNA, 25 bp, Rattus norvegicus
ttcctaagactgtccggctcggacc

SEQ ID NO: 548422 - DNA, 25 bp, Rattus norvegicus
ccgaagacagcaaaaatcgggcacc

SEQ ID NO: 548423 - DNA, 25 bp, Rattus norvegicus
atcccagggtgataggccggagcaa

SEQ ID NO: 548424 - DNA, 25 bp, Rattus norvegicus
tctgagaaacccacaagcccggcag

SEQ ID NO: 548425 - DNA, 25 bp, Rattus norvegicus
ttgctcctgcggaacgcgcagaccg

SEQ ID NO: 548426 - DNA, 25 bp, Rattus norvegicus
gccgtcgcctcaggggctcaaagcg

SEQ ID NO: 548427 - DNA, 25 bp, Rattus norvegicus
aaagctccatggtgtcccagaggga

SEQ ID NO: 548428 - DNA, 25 bp, Rattus norvegicus
atcgggcaccgaaatactcatcggg

SEQ ID NO: 548429 - DNA, 25 bp, Rattus norvegicus
accgcctctcggtgcgggatcttcg

SEQ ID NO: 548430 - DNA, 25 bp, Rattus norvegicus
cgcagcccacctgcaagcggagggt

SEQ ID NO: 548431 - DNA, 25 bp, Rattus norvegicus
gccgcgtgtgcaatccagtaaccga

SEQ ID NO: 548432 - DNA, 25 bp, Rattus norvegicus
cctgcctgtcgggttaagggttcag

SEQ ID NO: 548433 - DNA, 25 bp, Rattus norvegicus
tgcaagcccgactgttccccaagtt

SEQ ID NO: 548434 - DNA, 25 bp, Rattus norvegicus
ctgcaggtgcaagcccgactgttcc

SEQ ID NO: 548435 - DNA, 25 bp, Rattus norvegicus
tggctctgcaggtgcaagcccgact

SEQ ID NO: 548436 - DNA, 25 bp, Rattus norvegicus
tccctccggcgtggctctgcaggtg

SEQ ID NO: 548437 - DNA, 25 bp, Rattus norvegicus
atcctctggtcatggcggcgcggct

SEQ ID NO: 548438 - DNA, 25 bp, Rattus norvegicus
cgacatcctctggtcatggcggcgc

SEQ ID NO: 548439 - DNA, 25 bp, Rattus norvegicus
cttcgccgacatcctctggtcatgg

SEQ ID NO: 548440 - DNA, 25 bp, Rattus norvegicus
acccgctggccacgcccttcgccga

SEQ ID NO: 548441 - DNA, 25 bp, Rattus norvegicus
cctgggctcttcctgccacccgctg

SEQ ID NO: 548442 - DNA, 25 bp, Rattus norvegicus
gtcctcggacgcctttccgctctcc

SEQ ID NO: 548443 - DNA, 25 bp, Rattus norvegicus
agctggagcgtcctcggacgccttt

SEQ ID NO: 548444 - DNA, 25 bp, Rattus norvegicus
tgttccccaagttctccggcacagg

SEQ ID NO: 548445 - DNA, 25 bp, Rattus norvegicus
cctgtcgggttaagggttcagagct

SEQ ID NO: 548446 - DNA, 25 bp, Rattus norvegicus
ctgcctgaggacctgctggtgtcct

SEQ ID NO: 548447 - DNA, 25 bp, Rattus norvegicus
aggacctgctggtgtcctctgagcg

SEQ ID NO: 548448 - DNA, 25 bp, Rattus norvegicus
ggtgcatttcccaagtcctccggaa

SEQ ID NO: 548449 - DNA, 25 bp, Rattus norvegicus
tgtacgtggtcagaaacggttcctc

SEQ ID NO: 548450 - DNA, 25 bp, Rattus norvegicus
ccggaacccgccgagctcagaggag

SEQ ID NO: 548451 - DNA, 25 bp, Rattus norvegicus
acccgccgagctcagaggaggcgct

SEQ ID NO: 548452 - DNA, 25 bp, Rattus norvegicus
gcaggcaggcggattccatcctaga

SEQ ID NO: 548453 - DNA, 25 bp, Rattus norvegicus
cggattccatcctagagctgcagcc

SEQ ID NO: 548454 - DNA, 25 bp, Rattus norvegicus
gcggcaggtgcatttcccaagtcct

SEQ ID NO: 548455 - DNA, 25 bp, Rattus norvegicus
tcagaaacggttcctcgggcgtctg

SEQ ID NO: 548456 - DNA, 25 bp, Rattus norvegicus
ctgtgccttgtacgtggtcagaaac

SEQ ID NO: 548457 - DNA, 25 bp, Rattus norvegicus
atccgaaatctgtgccttgtacgtg

SEQ ID NO: 548458 - DNA, 25 bp, Rattus norvegicus
gccctgtcatccgaaatctgtgcct

SEQ ID NO: 548459 - DNA, 25 bp, Rattus norvegicus
ggctccttcggctgcctgaggacct

SEQ ID NO: 548460 - DNA, 25 bp, Rattus norvegicus
tctcttctctgtgcgcaatgacttc

SEQ ID NO: 548461 - DNA, 25 bp, Rattus norvegicus
gcgcgagaacgacctgagcatcatg

SEQ ID NO: 548462 - DNA, 25 bp, Rattus norvegicus
taccctacttcgtgctgggtgagtc

SEQ ID NO: 548463 - DNA, 25 bp, Rattus norvegicus
tcgtagtggacgacctagagaacac

SEQ ID NO: 548464 - DNA, 25 bp, Rattus norvegicus
tgagcatcatgcacagtccctcggc

SEQ ID NO: 548465 - DNA, 25 bp, Rattus norvegicus
agagaacacggagctaccctacttc

SEQ ID NO: 548466 - DNA, 25 bp, Rattus norvegicus
ccttcctgcgcgagaacgacctgag

SEQ ID NO: 548467 - DNA, 25 bp, Rattus norvegicus
aagagcatcaccgtgtcggcactgc

SEQ ID NO: 548468 - DNA, 25 bp, Rattus norvegicus
gctggagtgcaagctcaagagcatc

SEQ ID NO: 548469 - DNA, 25 bp, Rattus norvegicus
ctttagccgggctatgcgccctgtt

SEQ ID NO: 548470 - DNA, 25 bp, Rattus norvegicus
cgaacccaagcttctcttctctgtg

SEQ ID NO: 548471 - DNA, 25 bp, Rattus norvegicus
ccggcgacgtggatccatccaagga

SEQ ID NO: 548472 - DNA, 25 bp, Rattus norvegicus
ggctatgcgccctgttcgcctgctg

SEQ ID NO: 548473 - DNA, 25 bp, Rattus norvegicus
gccagggctcaagatggctttagcc

SEQ ID NO: 548474 - DNA, 25 bp, Rattus norvegicus
atggcttctctgatgtgatagtttc

SEQ ID NO: 548475 - DNA, 25 bp, Rattus norvegicus
tccgcaccgccgcaagtttagctgg

SEQ ID NO: 548476 - DNA, 25 bp, Rattus norvegicus
tttagctgggcaatccgccttggtc

SEQ ID NO: 548477 - DNA, 25 bp, Rattus norvegicus
ggtccagccggatcacacttaagca

SEQ ID NO: 548478 - DNA, 25 bp, Rattus norvegicus
agcagttgctttttgagcgttcccg

SEQ ID NO: 548479 - DNA, 25 bp, Rattus norvegicus
agcgttcccggttctctagaccaga

SEQ ID NO: 548480 - DNA, 25 bp, Rattus norvegicus
cctcttctactctttggctccatga

SEQ ID NO: 548481 - DNA, 25 bp, Rattus norvegicus
ggctccatgaaaacggccatccttc

SEQ ID NO: 548482 - DNA, 25 bp, Rattus norvegicus
ggccatccttctactacgtcaggaa

SEQ ID NO: 548483 - DNA, 25 bp, Rattus norvegicus
cggcttccacggcagtaatggcttc

SEQ ID NO: 548484 - DNA, 25 bp, Rattus norvegicus
cggcggtggaaagctcaactttatt

SEQ ID NO: 548485 - DNA, 25 bp, Rattus norvegicus
tcctcaggatgctcgggagctgagc

SEQ ID NO: 548486 - DNA, 25 bp, Rattus norvegicus
gagtcacgatgtcaggtagccgcca

SEQ ID NO: 548487 - DNA, 25 bp, Rattus norvegicus
acaagaccgtgggactctccgcaca

SEQ ID NO: 548488 - DNA, 25 bp, Rattus norvegicus
gttctgtaaaataccgcgatagcgc

SEQ ID NO: 548489 - DNA, 25 bp, Rattus norvegicus
tgccaaagcgcagaatacgggtgca

SEQ ID NO: 548490 - DNA, 25 bp, Rattus norvegicus
agaagaacgcgcagccgcactgttc

SEQ ID NO: 548491 - DNA, 25 bp, Rattus norvegicus
gcactgttccacctctgccaaagtg

SEQ ID NO: 548492 - DNA, 25 bp, Rattus norvegicus
tccacctctgccaaagtgggcggtc

SEQ ID NO: 548493 - DNA, 25 bp, Rattus norvegicus
ggatggtttgctcaagttctgtaaa

SEQ ID NO: 548494 - DNA, 25 bp, Rattus norvegicus
cgcgatagcgcaaatcccgtaccta

SEQ ID NO: 548495 - DNA, 25 bp, Rattus norvegicus
cctctccttctttataggctaaatc

SEQ ID NO: 548496 - DNA, 25 bp, Rattus norvegicus
cacgcaacctgtttcccacgttgta

SEQ ID NO: 548497 - DNA, 25 bp, Rattus norvegicus
ctgtttcccacgttgtaacgcggcg

SEQ ID NO: 548498 - DNA, 25 bp, Rattus norvegicus
gttggctggctaggcagacaacatg

SEQ ID NO: 548499 - DNA, 25 bp, Rattus norvegicus
aggcagacaacatggcggcgtcctt

SEQ ID NO: 548500 - DNA, 25 bp, Rattus norvegicus
cggcgtccttgctgggctcgctgct

SEQ ID NO: 548501 - DNA, 25 bp, Rattus norvegicus
tcgggatggatggtttgctcaagtt

SEQ ID NO: 548502 - DNA, 25 bp, Rattus norvegicus
gccgacatagcctggctgcgcagtc

SEQ ID NO: 548503 - DNA, 25 bp, Rattus norvegicus
cgcaatcgcggcctgatttagctcc

SEQ ID NO: 548504 - DNA, 25 bp, Rattus norvegicus
tgcgcagtcgcagctcgcaatcgcg

SEQ ID NO: 548505 - DNA, 25 bp, Rattus norvegicus
gctctggaaccttcgcgaggctcca

SEQ ID NO: 548506 - DNA, 25 bp, Rattus norvegicus
tgagacgtcattccgcgccgacata

SEQ ID NO: 548507 - DNA, 25 bp, Rattus norvegicus
tgtgctctagaagcgtcaaaccatc

SEQ ID NO: 548508 - DNA, 25 bp, Rattus norvegicus
ttctcgcgagcgaacgtgtgctcta

SEQ ID NO: 548509 - DNA, 25 bp, Rattus norvegicus
agcaacgttcaattctcgcgagcga

SEQ ID NO: 548510 - DNA, 25 bp, Rattus norvegicus
cagggaggtcgcttagcaacgttca

SEQ ID NO: 548511 - DNA, 25 bp, Rattus norvegicus
tccgcgccaaaaactgggatccaga

SEQ ID NO: 548512 - DNA, 25 bp, Rattus norvegicus
tcgcagcgtcggcagcgagctacac

SEQ ID NO: 548513 - DNA, 25 bp, Rattus norvegicus
ctgcagcggtgcactgaagtagaca

SEQ ID NO: 548514 - DNA, 25 bp, Rattus norvegicus
tcctccaaagcggaagccatgctgt

SEQ ID NO: 548515 - DNA, 25 bp, Rattus norvegicus
cgcacgagacggctctggaaccttc

SEQ ID NO: 548516 - DNA, 25 bp, Rattus norvegicus
taaaaccacaagcatcgccagcagg

SEQ ID NO: 548517 - DNA, 25 bp, Rattus norvegicus
cgccagcaggaacggagcaaagtgc

SEQ ID NO: 548518 - DNA, 25 bp, Rattus norvegicus
gggcccacgcggtcaactttgaagc

SEQ ID NO: 548519 - DNA, 25 bp, Rattus norvegicus
cgggatccaaccgacgctttcaagg

SEQ ID NO: 548520 - DNA, 25 bp, Rattus norvegicus
gcctatcccagacagtaaaaccaca

SEQ ID NO: 548521 - DNA, 25 bp, Rattus norvegicus
tgcccaaaaaacagcctatcccaga

SEQ ID NO: 548522 - DNA, 25 bp, Rattus norvegicus
ggggcattccttgcaggtagagatc

SEQ ID NO: 548523 - DNA, 25 bp, Rattus norvegicus
cggtcaactttgaagcggggcattc

SEQ ID NO: 548524 - DNA, 25 bp, Rattus norvegicus
agccacaagaagagcccggtgtcca

SEQ ID NO: 548525 - DNA, 25 bp, Rattus norvegicus
gcggccgtgccggaacaacaactct

SEQ ID NO: 548526 - DNA, 25 bp, Rattus norvegicus
aacaactctgtcagacgcccgagtc

SEQ ID NO: 548527 - DNA, 25 bp, Rattus norvegicus
ggcggaggcgccttctctgtccaag

SEQ ID NO: 548528 - DNA, 25 bp, Rattus norvegicus
agcgccgagtacaaacctgagcaga

SEQ ID NO: 548529 - DNA, 25 bp, Rattus norvegicus
cgccgcgacgagcaagccacaagaa

SEQ ID NO: 548530 - DNA, 25 bp, Rattus norvegicus
cactcccgtgcgtttccaccagggg

SEQ ID NO: 548531 - DNA, 25 bp, Rattus norvegicus
cgcctctattgccagcgtagacgtc

SEQ ID NO: 548532 - DNA, 25 bp, Rattus norvegicus
aggactcgcctctattgccagcgta

SEQ ID NO: 548533 - DNA, 25 bp, Rattus norvegicus
ttgccagcgtagacgtcttccaaga

SEQ ID NO: 548534 - DNA, 25 bp, Rattus norvegicus
agacgtcttccaagagctgagtcga

SEQ ID NO: 548535 - DNA, 25 bp, Rattus norvegicus
gagctgagtcgaagtgcctcggaca

SEQ ID NO: 548536 - DNA, 25 bp, Rattus norvegicus
ggggcccgcatccatcgacccactc

SEQ ID NO: 548537 - DNA, 25 bp, Rattus norvegicus
cgcaaccatcagtgtgtccaccggg

SEQ ID NO: 548538 - DNA, 25 bp, Rattus norvegicus
accatcagtgtgtccaccgggaggc

SEQ ID NO: 548539 - DNA, 25 bp, Rattus norvegicus
ggcgctgcagcccacctcgggctgt

SEQ ID NO: 548540 - DNA, 25 bp, Rattus norvegicus
gggctccaggactcgcctctattgc

SEQ ID NO: 548541 - DNA, 25 bp, Rattus norvegicus
ggtgcggagagcgaccgataaatta

SEQ ID NO: 548542 - DNA, 25 bp, Rattus norvegicus
cggagagcgaccgataaattagccc

SEQ ID NO: 548543 - DNA, 25 bp, Rattus norvegicus
ctgagtcgaagtgcctcggacaggc

SEQ ID NO: 548544 - DNA, 25 bp, Rattus norvegicus
cgggatcttcggttctcatccgctc

SEQ ID NO: 548545 - DNA, 25 bp, Rattus norvegicus
gctgtcgcggataagaaaggtgccc

SEQ ID NO: 548546 - DNA, 25 bp, Rattus norvegicus
ccggttacggcactccagtagaatc

SEQ ID NO: 548547 - DNA, 25 bp, Rattus norvegicus
accagctggtactcgctcttggagc

SEQ ID NO: 548548 - DNA, 25 bp, Rattus norvegicus
ctcttggagctgaaggtcttgaggc

SEQ ID NO: 548549 - DNA, 25 bp, Rattus norvegicus
cgggaaacttgctgtgggtgaccat

SEQ ID NO: 548550 - DNA, 25 bp, Rattus norvegicus
ctgcagaaagcaaagcgcgaggcgc

SEQ ID NO: 548551 - DNA, 25 bp, Rattus norvegicus
tgagtacccggaaccctccagcgtg

SEQ ID NO: 548552 - DNA, 25 bp, Rattus norvegicus
tttgacccgctgaagactgtgtctc

SEQ ID NO: 548553 - DNA, 25 bp, Rattus norvegicus
agctctccctaggaggacgcccaga

SEQ ID NO: 548554 - DNA, 25 bp, Rattus norvegicus
aactcgcgcgtggaagttggatctc

SEQ ID NO: 548555 - DNA, 25 bp, Rattus norvegicus
ccagtctgagtattacgggaacccg

SEQ ID NO: 548556 - DNA, 25 bp, Rattus norvegicus
tcccgaagcaaagtctccggccttg

SEQ ID NO: 548557 - DNA, 25 bp, Rattus norvegicus
ttgacgctcagtgtgaagaagtggc

SEQ ID NO: 548558 - DNA, 25 bp, Rattus norvegicus
gggaggccgaccaacaagatggccc

SEQ ID NO: 548559 - DNA, 25 bp, Rattus norvegicus
ctgagaggagctgctgctcggacca

SEQ ID NO: 548560 - DNA, 25 bp, Rattus norvegicus
attcagaatcgatggtggcagcggc

SEQ ID NO: 548561 - DNA, 25 bp, Rattus norvegicus
ctgctcggaccagcgcggtgagcaa

SEQ ID NO: 548562 - DNA, 25 bp, Rattus norvegicus
cggccgcggccgagaacaataggca

SEQ ID NO: 548563 - DNA, 25 bp, Rattus norvegicus
ccgagaacaataggcagcggctgcg

SEQ ID NO: 548564 - DNA, 25 bp, Rattus norvegicus
cttgtcagtggccagcgtcctttag

SEQ ID NO: 548565 - DNA, 25 bp, Rattus norvegicus
acaagatggcccctgctgcaggagc

SEQ ID NO: 548566 - DNA, 25 bp, Rattus norvegicus
agtggccagcgtcctttaggcctca

SEQ ID NO: 548567 - DNA, 25 bp, Rattus norvegicus
ggccagcgtcctttaggcctcaggc

SEQ ID NO: 548568 - DNA, 25 bp, Rattus norvegicus
cggcctgggacagattcagaatcga

SEQ ID NO: 548569 - DNA, 25 bp, Rattus norvegicus
ccggcggcctgggacagattcagaa

SEQ ID NO: 548570 - DNA, 25 bp, Rattus norvegicus
gggctgtcctcacccgccctgagct

SEQ ID NO: 548571 - DNA, 25 bp, Rattus norvegicus
acgaggacaacgagcgacgggcggc

SEQ ID NO: 548572 - DNA, 25 bp, Rattus norvegicus
catccgaaggctgtagagctgtgac

SEQ ID NO: 548573 - DNA, 25 bp, Rattus norvegicus
cagcgatgtgagctggacacccgcc

SEQ ID NO: 548574 - DNA, 25 bp, Rattus norvegicus
gagctgtgacacttttgacttgggg

SEQ ID NO: 548575 - DNA, 25 bp, Rattus norvegicus
ggagtctcaacatctccggagagtc

SEQ ID NO: 548576 - DNA, 25 bp, Rattus norvegicus
atcacgcggagactttggaaacatc

SEQ ID NO: 548577 - DNA, 25 bp, Rattus norvegicus
ctcacagtgatcacgcggagacttt

SEQ ID NO: 548578 - DNA, 25 bp, Rattus norvegicus
tgtcatcagctcttaactcacagtg

SEQ ID NO: 548579 - DNA, 25 bp, Rattus norvegicus
agcggatttgctgctcttgtcatca

SEQ ID NO: 548580 - DNA, 25 bp, Rattus norvegicus
gcgccgctggcatcagcggatttgc

SEQ ID NO: 548581 - DNA, 25 bp, Rattus norvegicus
tttcaccctcctggcagagagctgg

SEQ ID NO: 548582 - DNA, 25 bp, Rattus norvegicus
gaggaccgggcagctcttttcaccc

SEQ ID NO: 548583 - DNA, 25 bp, Rattus norvegicus
cgccggtcttagaggacggtgacca

SEQ ID NO: 548584 - DNA, 25 bp, Rattus norvegicus
gaggcagccactcgggcttggaaaa

SEQ ID NO: 548585 - DNA, 25 bp, Rattus norvegicus
gggacacccgttcgcccaatgagga

SEQ ID NO: 548586 - DNA, 25 bp, Rattus norvegicus
cacaaagatccaggtggtggcagcc

SEQ ID NO: 548587 - DNA, 25 bp, Rattus norvegicus
ggggatcctgctaccattgcctccg

SEQ ID NO: 548588 - DNA, 25 bp, Rattus norvegicus
ccactggggatcctgctaccattgc

SEQ ID NO: 548589 - DNA, 25 bp, Rattus norvegicus
taatggcacgccactggggatcctg

SEQ ID NO: 548590 - DNA, 25 bp, Rattus norvegicus
tgcccagtgggtaatggcacgccac

SEQ ID NO: 548591 - DNA, 25 bp, Rattus norvegicus
cgctagcaatcgtgcccagtgggta

SEQ ID NO: 548592 - DNA, 25 bp, Rattus norvegicus
gctgccgctagcaatcgtgcccagt

SEQ ID NO: 548593 - DNA, 25 bp, Rattus norvegicus
gggtcgcctgccttctgcgcaccat

SEQ ID NO: 548594 - DNA, 25 bp, Rattus norvegicus
accgacccgggcacaaagatccagg

SEQ ID NO: 548595 - DNA, 25 bp, Rattus norvegicus
gctgtgtagcttgcgagaaccttga

SEQ ID NO: 548596 - DNA, 25 bp, Rattus norvegicus
gcttgcgagaaccttgacagcggca

SEQ ID NO: 548597 - DNA, 25 bp, Rattus norvegicus
agcggcaaggcagactcctagttcg

SEQ ID NO: 548598 - DNA, 25 bp, Rattus norvegicus
attgcctccgccactccgctggcca

SEQ ID NO: 548599 - DNA, 25 bp, Rattus norvegicus
tgcgcaccatcgtgcaactcaccga

SEQ ID NO: 548600 - DNA, 25 bp, Rattus norvegicus
cgctccaggagctggctgcaaccaa

SEQ ID NO: 548601 - DNA, 25 bp, Rattus norvegicus
tcagccaccatatcggcctttcgga

SEQ ID NO: 548602 - DNA, 25 bp, Rattus norvegicus
ccaaggagcgtctggtatgggctaa

SEQ ID NO: 548603 - DNA, 25 bp, Rattus norvegicus
cctttcggagctgtgaggcgaagct

SEQ ID NO: 548604 - DNA, 25 bp, Rattus norvegicus
ggagaccttatatactcgactcagc

SEQ ID NO: 548605 - DNA, 25 bp, Rattus norvegicus
gtcttgacgtcacggagaccttata

SEQ ID NO: 548606 - DNA, 25 bp, Rattus norvegicus
gggcgtggccagctgaaaaatatga

SEQ ID NO: 548607 - DNA, 25 bp, Rattus norvegicus
ggcctgacgtgcctgaggcaactcc

SEQ ID NO: 548608 - DNA, 25 bp, Rattus norvegicus
acgtgccggaaggaaatcagtcacc

SEQ ID NO: 548609 - DNA, 25 bp, Rattus norvegicus
gagctcagtcgaggagcagcaccta

SEQ ID NO: 548610 - DNA, 25 bp, Rattus norvegicus
gctgcaaccaagacgcggccaagga

SEQ ID NO: 548611 - DNA, 25 bp, Rattus norvegicus
cccagagccaaaggagtggaaggtc

SEQ ID NO: 548612 - DNA, 25 bp, Rattus norvegicus
ccttcactcctcagggaggcagggg

SEQ ID NO: 548613 - DNA, 25 bp, Rattus norvegicus
gcaggtatgcgatatctgtccgtta

SEQ ID NO: 548614 - DNA, 25 bp, Rattus norvegicus
caagcctacttatggtctcaggaga

SEQ ID NO: 548615 - DNA, 25 bp, Rattus norvegicus
atttacgtgaaatcggcgggctacg

SEQ ID NO: 548616 - DNA, 25 bp, Rattus norvegicus
gcgacttcagttgctaatttacgtg

SEQ ID NO: 548617 - DNA, 25 bp, Rattus norvegicus
gcgcctttgcgaacggaggtttcaa

SEQ ID NO: 548618 - DNA, 25 bp, Rattus norvegicus
agcgaacctgtctctcccagggtga

SEQ ID NO: 548619 - DNA, 25 bp, Rattus norvegicus
gggatccttatgtctcttctgaacc

SEQ ID NO: 548620 - DNA, 25 bp, Rattus norvegicus
acctggcattgcttcggctctctct

SEQ ID NO: 548621 - DNA, 25 bp, Rattus norvegicus
agccaaaacctttcgtctcgacgtg

SEQ ID NO: 548622 - DNA, 25 bp, Rattus norvegicus
tctcgacgtggtcttggagccaaac

SEQ ID NO: 548623 - DNA, 25 bp, Rattus norvegicus
tgaatccggaatggacgacagtgtc

SEQ ID NO: 548624 - DNA, 25 bp, Rattus norvegicus
ccaagccttgccctcagttaaaatg

SEQ ID NO: 548625 - DNA, 25 bp, Rattus norvegicus
ctacgcggcgcaatagggaatttga

SEQ ID NO: 548626 - DNA, 25 bp, Rattus norvegicus
ttcggccaatcagagcgagggttcc

SEQ ID NO: 548627 - DNA, 25 bp, Rattus norvegicus
ccgcagggcaagtcgggaaatgatt

SEQ ID NO: 548628 - DNA, 25 bp, Rattus norvegicus
cggtgggctttgtgcatcctatccc

SEQ ID NO: 548629 - DNA, 25 bp, Rattus norvegicus
ccggctttgatcctcccgccgcagc

SEQ ID NO: 548630 - DNA, 25 bp, Rattus norvegicus
ccaaggtatcctcagctttcgtgtg

SEQ ID NO: 548631 - DNA, 25 bp, Rattus norvegicus
gctgcgcgaagtgcgccgtcgccat

SEQ ID NO: 548632 - DNA, 25 bp, Rattus norvegicus
ccgccgcagcaaaagggcaggccga

SEQ ID NO: 548633 - DNA, 25 bp, Rattus norvegicus
tgtgcatcctatcccggctttgatc

SEQ ID NO: 548634 - DNA, 25 bp, Rattus norvegicus
gtatcctcagctttcgtgtgtccgg

SEQ ID NO: 548635 - DNA, 25 bp, Rattus norvegicus
ggtgggcttcatccaaggtatcctc

SEQ ID NO: 548636 - DNA, 25 bp, Rattus norvegicus
ggctgctgtggtgggcttcatccaa

SEQ ID NO: 548637 - DNA, 25 bp, Rattus norvegicus
atcatctctacggtgctggcggcta

SEQ ID NO: 548638 - DNA, 25 bp, Rattus norvegicus
gacccgcatcatctctacggtgctg

SEQ ID NO: 548639 - DNA, 25 bp, Rattus norvegicus
cgcgggtgaatagacccgcatcatc

SEQ ID NO: 548640 - DNA, 25 bp, Rattus norvegicus
gaagtgcgccgtcgccatggtaacc

SEQ ID NO: 548641 - DNA, 25 bp, Rattus norvegicus
aggccgaaggtcgagggcgatctca

SEQ ID NO: 548642 - DNA, 25 bp, Rattus norvegicus
ccacgtgcaataggaaggaagcgta

SEQ ID NO: 548643 - DNA, 25 bp, Rattus norvegicus
ctcgcggctctgcaaagatgctcta

SEQ ID NO: 548644 - DNA, 25 bp, Rattus norvegicus
agaattgccggcactcgtacgtctc

SEQ ID NO: 548645 - DNA, 25 bp, Rattus norvegicus
gcgttccgggaagtgacctcaaaca

SEQ ID NO: 548646 - DNA, 25 bp, Rattus norvegicus
gccttccggatcgaccagggcataa

SEQ ID NO: 548647 - DNA, 25 bp, Rattus norvegicus
cagggcataaaccaagcactgtata

SEQ ID NO: 548648 - DNA, 25 bp, Rattus norvegicus
gcactgtatacaaagccaggttaaa

SEQ ID NO: 548649 - DNA, 25 bp, Rattus norvegicus
ggccgagcgcagcacagaaagaagc

SEQ ID NO: 548650 - DNA, 25 bp, Rattus norvegicus
gctgctgttcttcacgtggagttta

SEQ ID NO: 548651 - DNA, 25 bp, Rattus norvegicus
cgggctcctacggagacctagatca

SEQ ID NO: 548652 - DNA, 25 bp, Rattus norvegicus
gacctagatcagtgctggccgaatg

SEQ ID NO: 548653 - DNA, 25 bp, Rattus norvegicus
cgtggagtttacaggcaagcgagat

SEQ ID NO: 548654 - DNA, 25 bp, Rattus norvegicus
cgagattctggagctaaaggaggcc

SEQ ID NO: 548655 - DNA, 25 bp, Rattus norvegicus
gcggtggccacttacgaatctccta

SEQ ID NO: 548656 - DNA, 25 bp, Rattus norvegicus
agaatttctgatgatattcagctta

SEQ ID NO: 548657 - DNA, 25 bp, Rattus norvegicus
gtgtttccttccattgtcggcaccc

SEQ ID NO: 548658 - DNA, 25 bp, Rattus norvegicus
gctattaaaaaagaatttctgatga

SEQ ID NO: 548659 - DNA, 25 bp, Rattus norvegicus
cgtgtttccttccattgtcggcacc

SEQ ID NO: 548660 - DNA, 25 bp, Rattus norvegicus
ctgatgatattcagcttaatgtatg

SEQ ID NO: 548661 - DNA, 25 bp, Rattus norvegicus
tattcagcttaatgtatgaaactta

SEQ ID NO: 548662 - DNA, 25 bp, Rattus norvegicus
cttaatgtatgaaacttaaaatagg

SEQ ID NO: 548663 - DNA, 25 bp, Rattus norvegicus
cactaaagaacaaatgaaatacatt

SEQ ID NO: 548664 - DNA, 25 bp, Rattus norvegicus
taaaaatttctatcgctcacacttc

SEQ ID NO: 548665 - DNA, 25 bp, Rattus norvegicus
aatttctatcgctcacacttcgccg

SEQ ID NO: 548666 - DNA, 25 bp, Rattus norvegicus
tcgctcacacttcgccgctggctta

SEQ ID NO: 548667 - DNA, 25 bp, Rattus norvegicus
ccgtcctctgccgatcgcaatggaa

SEQ ID NO: 548668 - DNA, 25 bp, Rattus norvegicus
gtcctctgccgatcgcaatggaaga

SEQ ID NO: 548669 - DNA, 25 bp, Rattus norvegicus
agttttattcactaaagaacaaatg

SEQ ID NO: 548670 - DNA, 25 bp, Rattus norvegicus
cactctactgagttggatggaagga

SEQ ID NO: 548671 - DNA, 25 bp, Rattus norvegicus
cacccacttgctggcgctggaacag

SEQ ID NO: 548672 - DNA, 25 bp, Rattus norvegicus
caaaacgccacaaccgccgccctgc

SEQ ID NO: 548673 - DNA, 25 bp, Rattus norvegicus
gctgacaaagctccaaaacgccaca

SEQ ID NO: 548674 - DNA, 25 bp, Rattus norvegicus
accagtctcagcacgggccacgccc

SEQ ID NO: 548675 - DNA, 25 bp, Rattus norvegicus
ggctcgcactccaccagtctcagca

SEQ ID NO: 548676 - DNA, 25 bp, Rattus norvegicus
acccacgtccctctcggctcgcact

SEQ ID NO: 548677 - DNA, 25 bp, Rattus norvegicus
ttggatggaaggagacgcgtcaccc

SEQ ID NO: 548678 - DNA, 25 bp, Rattus norvegicus
ggcacctcacactctactgagttgg

SEQ ID NO: 548679 - DNA, 25 bp, Rattus norvegicus
tcgcctctcaacagccaatcgccgg

SEQ ID NO: 548680 - DNA, 25 bp, Rattus norvegicus
ccgcgtactcgcctctcaacagcca

SEQ ID NO: 548681 - DNA, 25 bp, Rattus norvegicus
caggaagtcctgtaaccctcggcct

SEQ ID NO: 548682 - DNA, 25 bp, Rattus norvegicus
ggaaggagacgcgtcacccacgtcc

SEQ ID NO: 548683 - DNA, 25 bp, Rattus norvegicus
gccctgcctgcgcaggtcccaccca

SEQ ID NO: 548684 - DNA, 25 bp, Rattus norvegicus
cctcgcggtgcggtgtctcaggagg

SEQ ID NO: 548685 - DNA, 25 bp, Rattus norvegicus
tctcaggagggacgctttggccgcc

SEQ ID NO: 548686 - DNA, 25 bp, Rattus norvegicus
ccgcccagtggtgcgaatccggaag

SEQ ID NO: 548687 - DNA, 25 bp, Rattus norvegicus
tgagtggttgtctaagacccttccc

SEQ ID NO: 548688 - DNA, 25 bp, Rattus norvegicus
tggttgtctaagacccttccctgct

SEQ ID NO: 548689 - DNA, 25 bp, Rattus norvegicus
caggtgggttccggcgtccttcgct

SEQ ID NO: 548690 - DNA, 25 bp, Rattus norvegicus
tgtagaagtagcagggctgctgctc

SEQ ID NO: 548691 - DNA, 25 bp, Rattus norvegicus
tcccggatgtagaagtagcagggct

SEQ ID NO: 548692 - DNA, 25 bp, Rattus norvegicus
ggaagtgctcctccacagtagtccc

SEQ ID NO: 548693 - DNA, 25 bp, Rattus norvegicus
tccggaagtgctcctccacagtagt

SEQ ID NO: 548694 - DNA, 25 bp, Rattus norvegicus
ctttggccgcccagtggtgcgaatc

SEQ ID NO: 548695 - DNA, 25 bp, Rattus norvegicus
gcgaatccggaagtgctcctccaca

SEQ ID NO: 548696 - DNA, 25 bp, Rattus norvegicus
ggtgcgaatccggaagtgctcctcc

SEQ ID NO: 548697 - DNA, 25 bp, Rattus norvegicus
gcttggtgagtggttgtctaagacc

SEQ ID NO: 548698 - DNA, 25 bp, Rattus norvegicus
tagtgaatcagccctgcggggaccg

SEQ ID NO: 548699 - DNA, 25 bp, Rattus norvegicus
cgtgtccgcgctcgcgctgtcaata

SEQ ID NO: 548700 - DNA, 25 bp, Rattus norvegicus
gctgtcaataaagttctcgcgcgcc

SEQ ID NO: 548701 - DNA, 25 bp, Rattus norvegicus
tgtcaataaagttctcgcgcgccgg

SEQ ID NO: 548702 - DNA, 25 bp, Rattus norvegicus
gcccggtgttctggaggcggctgct

SEQ ID NO: 548703 - DNA, 25 bp, Rattus norvegicus
tctccgaccgtctgggcaggagccg

SEQ ID NO: 548704 - DNA, 25 bp, Rattus norvegicus
ctgggctggggcttcgccgtctccc

SEQ ID NO: 548705 - DNA, 25 bp, Rattus norvegicus
ggcgtgcacggtgcaggagccaccc

SEQ ID NO: 548706 - DNA, 25 bp, Rattus norvegicus
agccaaagccgctgtgctgtggacc

SEQ ID NO: 548707 - DNA, 25 bp, Rattus norvegicus
caaagccgctgtgctgtggacctgg

SEQ ID NO: 548708 - DNA, 25 bp, Rattus norvegicus
tgagtgtggctgtcggtattagcgc

SEQ ID NO: 548709 - DNA, 25 bp, Rattus norvegicus
gctgtcggtattagcgcggtgagtt

SEQ ID NO: 548710 - DNA, 25 bp, Rattus norvegicus
tgagttggcggtagtgaatcagccc

SEQ ID NO: 548711 - DNA, 25 bp, Rattus norvegicus
ttggcggtagtgaatcagccctgcg

SEQ ID NO: 548712 - DNA, 25 bp, Rattus norvegicus
cgttccaacggcctgaagcacgggg

SEQ ID NO: 548713 - DNA, 25 bp, Rattus norvegicus
tggcagctccagcagacagctctgt

SEQ ID NO: 548714 - DNA, 25 bp, Rattus norvegicus
cacggcgatctgtggcagctccagc

SEQ ID NO: 548715 - DNA, 25 bp, Rattus norvegicus
tcccagagccgagaaagcgtcctgc

SEQ ID NO: 548716 - DNA, 25 bp, Rattus norvegicus
agcgtcctgcagacggttcaccaga

SEQ ID NO: 548717 - DNA, 25 bp, Rattus norvegicus
cggttcaccagagggatcagttctt

SEQ ID NO: 548718 - DNA, 25 bp, Rattus norvegicus
ggatcagttcttccatctcccggtt

SEQ ID NO: 548719 - DNA, 25 bp, Rattus norvegicus
cccatcttgcctgtgcggccaactg

SEQ ID NO: 548720 - DNA, 25 bp, Rattus norvegicus
cgggcctcgcagcacttgtccggtt

SEQ ID NO: 548721 - DNA, 25 bp, Rattus norvegicus
cacttgtccggtttgttgatgcgcg

SEQ ID NO: 548722 - DNA, 25 bp, Rattus norvegicus
atgcgcggggctcacaccgctgagt

SEQ ID NO: 548723 - DNA, 25 bp, Rattus norvegicus
gctgctaggctcctgacagctcaca

SEQ ID NO: 548724 - DNA, 25 bp, Rattus norvegicus
gggcctgagacggtcacgcccacag

SEQ ID NO: 548725 - DNA, 25 bp, Rattus norvegicus
agacagctctgtcccagagccgaga

SEQ ID NO: 548726 - DNA, 25 bp, Rattus norvegicus
gccagaggacaagacccggagcgtc

SEQ ID NO: 548727 - DNA, 25 bp, Rattus norvegicus
ccgtgggtagaggtgaatccttaca

SEQ ID NO: 548728 - DNA, 25 bp, Rattus norvegicus
ctgtgcttagaatgacccgtgggta

SEQ ID NO: 548729 - DNA, 25 bp, Rattus norvegicus
cttcctcaggggttcggagaaagcg

SEQ ID NO: 548730 - DNA, 25 bp, Rattus norvegicus
agctttgggatcgagttaccctcca

SEQ ID NO: 548731 - DNA, 25 bp, Rattus norvegicus
agccgaagaactggccgggaagctc

SEQ ID NO: 548732 - DNA, 25 bp, Rattus norvegicus
actgctgcccggagctcttcggaga

SEQ ID NO: 548733 - DNA, 25 bp, Rattus norvegicus
tcggagtaccgagcggttcgatctc

SEQ ID NO: 548734 - DNA, 25 bp, Rattus norvegicus
acaggttttgcgagtaagatttcca

SEQ ID NO: 548735 - DNA, 25 bp, Rattus norvegicus
ccggagcgtcgaaaggctcgatctc

SEQ ID NO: 548736 - DNA, 25 bp, Rattus norvegicus
atccttacacgtaacaggttttgcg

SEQ ID NO: 548737 - DNA, 25 bp, Rattus norvegicus
gtaagatttccaggcacgatttgcg

SEQ ID NO: 548738 - DNA, 25 bp, Rattus norvegicus
ctcgatctcggttgccagagcttgc

SEQ ID NO: 548739 - DNA, 25 bp, Rattus norvegicus
tcttcggagacctcaggtatcccgc

SEQ ID NO: 548740 - DNA, 25 bp, Rattus norvegicus
gcctagcgggaggaaagactactca

SEQ ID NO: 548741 - DNA, 25 bp, Rattus norvegicus
gtcttcccataaatgcggggctgga

SEQ ID NO: 548742 - DNA, 25 bp, Rattus norvegicus
agttgttcggcttgtccttagcgga

SEQ ID NO: 548743 - DNA, 25 bp, Rattus norvegicus
ctggttcccggtagagcctctacga

SEQ ID NO: 548744 - DNA, 25 bp, Rattus norvegicus
tctacgaccggcctgggctacacag

SEQ ID NO: 548745 - DNA, 25 bp, Rattus norvegicus
gcaaacgccagcatcaccacaggag

SEQ ID NO: 548746 - DNA, 25 bp, Rattus norvegicus
ctcggagctgctgccgtggaaaaac

SEQ ID NO: 548747 - DNA, 25 bp, Rattus norvegicus
tacccgccagggtgagaaccaagtc

SEQ ID NO: 548748 - DNA, 25 bp, Rattus norvegicus
caagtctgcgcgcttccagaggttc

SEQ ID NO: 548749 - DNA, 25 bp, Rattus norvegicus
aaggagtttccagagatcgtccgca

SEQ ID NO: 548750 - DNA, 25 bp, Rattus norvegicus
agcactttcgctacctcttgagagg

SEQ ID NO: 548751 - DNA, 25 bp, Rattus norvegicus
ccctacgtgctacgtcatgacgctg

SEQ ID NO: 548752 - DNA, 25 bp, Rattus norvegicus
tagaggctctctcggtcaccacagg

SEQ ID NO: 548753 - DNA, 25 bp, Rattus norvegicus
tgacgctgcgtacgtatagcaaatc

SEQ ID NO: 548754 - DNA, 25 bp, Rattus norvegicus
gccacagtacgacccacagacaagt

SEQ ID NO: 548755 - DNA, 25 bp, Rattus norvegicus
acaagtagcggtctctctctcaacg

SEQ ID NO: 548756 - DNA, 25 bp, Rattus norvegicus
gccctacaatcagtcagcaccggag

SEQ ID NO: 548757 - DNA, 25 bp, Rattus norvegicus
tcgctcacagacatggcgccggctg

SEQ ID NO: 548758 - DNA, 25 bp, Rattus norvegicus
tgcagctccacgaagatctcgctca

SEQ ID NO: 548759 - DNA, 25 bp, Rattus norvegicus
ggccggctgaaacgcagctccaatt

SEQ ID NO: 548760 - DNA, 25 bp, Rattus norvegicus
ggaccttagagacacgtgactcgta

SEQ ID NO: 548761 - DNA, 25 bp, Rattus norvegicus
aaacagctgagttggggaccttaga

SEQ ID NO: 548762 - DNA, 25 bp, Rattus norvegicus
ctccaattgaggaacaggggtccga

SEQ ID NO: 548763 - DNA, 25 bp, Rattus norvegicus
cttcagcatcacgtgggcataggcc

SEQ ID NO: 548764 - DNA, 25 bp, Rattus norvegicus
tcttcggaaacagcccttcagcatc

SEQ ID NO: 548765 - DNA, 25 bp, Rattus norvegicus
acaaagagtgggacctcgcctgctg

SEQ ID NO: 548766 - DNA, 25 bp, Rattus norvegicus
tgctgcccgcacataggcatcttcg

SEQ ID NO: 548767 - DNA, 25 bp, Rattus norvegicus
ctcgcagatcggcatgtaggaaaac

SEQ ID NO: 548768 - DNA, 25 bp, Rattus norvegicus
tcctccaggtctagcaggtgactga

SEQ ID NO: 548769 - DNA, 25 bp, Rattus norvegicus
ctgccactggtcagtcccggtgact

SEQ ID NO: 548770 - DNA, 25 bp, Rattus norvegicus
cttaagttcttaacgcctcatctcc

SEQ ID NO: 548771 - DNA, 25 bp, Rattus norvegicus
cgaaaccgaagcctggaacacgctc

SEQ ID NO: 548772 - DNA, 25 bp, Rattus norvegicus
cagtcactttttcccaggtctctta

SEQ ID NO: 548773 - DNA, 25 bp, Rattus norvegicus
gcctgcgggatttctggccgccgct

SEQ ID NO: 548774 - DNA, 25 bp, Rattus norvegicus
tagagtccctgcgtgggatcgcctg

SEQ ID NO: 548775 - DNA, 25 bp, Rattus norvegicus
gcaggtgactgacggagaagttctt

SEQ ID NO: 548776 - DNA, 25 bp, Rattus norvegicus
tcgaggttgccagggctatccaagc

SEQ ID NO: 548777 - DNA, 25 bp, Rattus norvegicus
ccagcggctaaagacagtggtgacc

SEQ ID NO: 548778 - DNA, 25 bp, Rattus norvegicus
acagtggtgaccgtagagtccctgc

SEQ ID NO: 548779 - DNA, 25 bp, Rattus norvegicus
ttcatcggtctttctgcgcttagcg

SEQ ID NO: 548780 - DNA, 25 bp, Rattus norvegicus
gcgcttagcgaccagtcactttttc

SEQ ID NO: 548781 - DNA, 25 bp, Rattus norvegicus
gaagttctttttcgcctgcagggtg

SEQ ID NO: 548782 - DNA, 25 bp, Rattus norvegicus
ctccagtgttttggggcccaggagc

SEQ ID NO: 548783 - DNA, 25 bp, Rattus norvegicus
agatacctcaaaaggtgacgaccgg

SEQ ID NO: 548784 - DNA, 25 bp, Rattus norvegicus
aggacgccagatacctcaaaaggtg

SEQ ID NO: 548785 - DNA, 25 bp, Rattus norvegicus
atgcgctttgcggagagtcgtgccc

SEQ ID NO: 548786 - DNA, 25 bp, Rattus norvegicus
ggctgctccagtgttttggggccca

SEQ ID NO: 548787 - DNA, 25 bp, Rattus norvegicus
agattgtagctgtcgcgtgagcgca

SEQ ID NO: 548788 - DNA, 25 bp, Rattus norvegicus
ggcggcctcaccgtggtaaccgctg

SEQ ID NO: 548789 - DNA, 25 bp, Rattus norvegicus
cgccttgcaggcctcgggactgtca

SEQ ID NO: 548790 - DNA, 25 bp, Rattus norvegicus
tcgggactgtcaccgcctctgcttt

SEQ ID NO: 548791 - DNA, 25 bp, Rattus norvegicus
cgcctctgctttgagggtaccttgg

SEQ ID NO: 548792 - DNA, 25 bp, Rattus norvegicus
tctgctttgagggtaccttggccgg

SEQ ID NO: 548793 - DNA, 25 bp, Rattus norvegicus
tgctgccgccgccatgcaaagcgag

SEQ ID NO: 548794 - DNA, 25 bp, Rattus norvegicus
ccatgcaaagcgaggacgccagata

SEQ ID NO: 548795 - DNA, 25 bp, Rattus norvegicus
ctttgcggagagtcgtgccctgacg

SEQ ID NO: 548796 - DNA, 25 bp, Rattus norvegicus
cagccaaagccgtctgccgggagca

SEQ ID NO: 548797 - DNA, 25 bp, Rattus norvegicus
gggcggaaatgaactcaaaagtagc

SEQ ID NO: 548798 - DNA, 25 bp, Rattus norvegicus
ccctgcagtcgagctggaaatacac

SEQ ID NO: 548799 - DNA, 25 bp, Rattus norvegicus
agctggaaatacacgcggaggtttc

SEQ ID NO: 548800 - DNA, 25 bp, Rattus norvegicus
gcggaggtttcccggcagccaaagc

SEQ ID NO: 548801 - DNA, 25 bp, Rattus norvegicus
ctggcgcacacacctcaacccggca

SEQ ID NO: 548802 - DNA, 25 bp, Rattus norvegicus
tcgcagcacctgtgcggccgctcta

SEQ ID NO: 548803 - DNA, 25 bp, Rattus norvegicus
cgctctagctcggttccgggttcgc

SEQ ID NO: 548804 - DNA, 25 bp, Rattus norvegicus
aggccggtctgttgacccgcttccg

SEQ ID NO: 548805 - DNA, 25 bp, Rattus norvegicus
actgaaggccggtctgttgacccgc

SEQ ID NO: 548806 - DNA, 25 bp, Rattus norvegicus
agcccggagcgacccattgaacgct

SEQ ID NO: 548807 - DNA, 25 bp, Rattus norvegicus
aatcgtggtctgagcgtcggagcca

SEQ ID NO: 548808 - DNA, 25 bp, Rattus norvegicus
cgcttccgggcccttgtagagctgc

SEQ ID NO: 548809 - DNA, 25 bp, Rattus norvegicus
ccattttggcttcgggcggaaatga

SEQ ID NO: 548810 - DNA, 25 bp, Rattus norvegicus
gggcagcaccgaaggcagctcccga

SEQ ID NO: 548811 - DNA, 25 bp, Rattus norvegicus
gctccctccagggtcacttagtata

SEQ ID NO: 548812 - DNA, 25 bp, Rattus norvegicus
cacttagtataagagggttcgagta

SEQ ID NO: 548813 - DNA, 25 bp, Rattus norvegicus
aagactcccgccacagcttagaacg

SEQ ID NO: 548814 - DNA, 25 bp, Rattus norvegicus
gaacgaattcgcaagactcccgcca

SEQ ID NO: 548815 - DNA, 25 bp, Rattus norvegicus
cccggagacgaacgaattcgcaaga

SEQ ID NO: 548816 - DNA, 25 bp, Rattus norvegicus
accgcaccgttctgcgacattctta

SEQ ID NO: 548817 - DNA, 25 bp, Rattus norvegicus
gacggcatatctcctccggccagct

SEQ ID NO: 548818 - DNA, 25 bp, Rattus norvegicus
ccctccaaggatatgaggagccggg

SEQ ID NO: 548819 - DNA, 25 bp, Rattus norvegicus
tcagcaccctccaaggatatgagga

SEQ ID NO: 548820 - DNA, 25 bp, Rattus norvegicus
tgaccgggaaaccaccagaaggctc

SEQ ID NO: 548821 - DNA, 25 bp, Rattus norvegicus
gcccgacaatgccaggcgcacctac

SEQ ID NO: 548822 - DNA, 25 bp, Rattus norvegicus
gagggttcgagtaccggccacagac

SEQ ID NO: 548823 - DNA, 25 bp, Rattus norvegicus
cagctgctgagttcctccagcatga

SEQ ID NO: 548824 - DNA, 25 bp, Rattus norvegicus
ttctttgcgttattggcacgttccg

SEQ ID NO: 548825 - DNA, 25 bp, Rattus norvegicus
cagatagctgatcggatttctgctc

SEQ ID NO: 548826 - DNA, 25 bp, Rattus norvegicus
tctgctcgcttggaaaagtggcctt

SEQ ID NO: 548827 - DNA, 25 bp, Rattus norvegicus
ctgatcggatttctgctcgcttgga

SEQ ID NO: 548828 - DNA, 25 bp, Rattus norvegicus
tcggatttctgctcgcttggaaaag

SEQ ID NO: 548829 - DNA, 25 bp, Rattus norvegicus
ctacgcagatagctgatcggatttc

SEQ ID NO: 548830 - DNA, 25 bp, Rattus norvegicus
ctgcgggctacgcagatagctgatc

SEQ ID NO: 548831 - DNA, 25 bp, Rattus norvegicus
tttgcggagggcctccggccgagcc

SEQ ID NO: 548832 - DNA, 25 bp, Rattus norvegicus
gacaagaacttgaccgagagacagg

SEQ ID NO: 548833 - DNA, 25 bp, Rattus norvegicus
ctggggccggacaagaacttgaccg

SEQ ID NO: 548834 - DNA, 25 bp, Rattus norvegicus
gttcctcactccctacctgctgggg

SEQ ID NO: 548835 - DNA, 25 bp, Rattus norvegicus
ggtcggagccgttcctcactcccta

SEQ ID NO: 548836 - DNA, 25 bp, Rattus norvegicus
gtggccttattctttgcgttattgg

SEQ ID NO: 548837 - DNA, 25 bp, Rattus norvegicus
aacttgaccgagagacaggtaggca

SEQ ID NO: 548838 - DNA, 25 bp, Rattus norvegicus
agtgagtagtgctcccgaagctctg

SEQ ID NO: 548839 - DNA, 25 bp, Rattus norvegicus
tccttcttctccgagttccagatga

SEQ ID NO: 548840 - DNA, 25 bp, Rattus norvegicus
gatgaatttcttccagctgccttcc

SEQ ID NO: 548841 - DNA, 25 bp, Rattus norvegicus
ctccttggcttttccgcgggccatg

SEQ ID NO: 548842 - DNA, 25 bp, Rattus norvegicus
cccggctctgtctccaaaggcgaga

SEQ ID NO: 548843 - DNA, 25 bp, Rattus norvegicus
tgctgcttcaagctgtagctgcacc

SEQ ID NO: 548844 - DNA, 25 bp, Rattus norvegicus
ctgcctgctatgacctctggcgaga

SEQ ID NO: 548845 - DNA, 25 bp, Rattus norvegicus
ctctggcgagatggaccagggacaa

SEQ ID NO: 548846 - DNA, 25 bp, Rattus norvegicus
cgcaggccagcagcaggagaaattg

SEQ ID NO: 548847 - DNA, 25 bp, Rattus norvegicus
gcggagcgcttacttacaccaacta

SEQ ID NO: 548848 - DNA, 25 bp, Rattus norvegicus
cggcacaaaggagccggctaggcta

SEQ ID NO: 548849 - DNA, 25 bp, Rattus norvegicus
acggatgcgcctcctagaaaaagcc

SEQ ID NO: 548850 - DNA, 25 bp, Rattus norvegicus
gaactgtccgcagtgtccgcgtaca

SEQ ID NO: 548851 - DNA, 25 bp, Rattus norvegicus
gcgcacgccctacctttactatata

SEQ ID NO: 548852 - DNA, 25 bp, Rattus norvegicus
ccaagaagatgagcttgtcccgctc

SEQ ID NO: 548853 - DNA, 25 bp, Rattus norvegicus
ctgaactcggaccttccaatatttc

SEQ ID NO: 548854 - DNA, 25 bp, Rattus norvegicus
gtcaggtttatcacgcgctgcctca

SEQ ID NO: 548855 - DNA, 25 bp, Rattus norvegicus
taggtgatctcgtccgtcaggttta

SEQ ID NO: 548856 - DNA, 25 bp, Rattus norvegicus
acatgtacacagagtaggtgatctc

SEQ ID NO: 548857 - DNA, 25 bp, Rattus norvegicus
ttgtcccgctcgaagagcccgcgtg

SEQ ID NO: 548858 - DNA, 25 bp, Rattus norvegicus
cgttacctggaaggtgacttgagcc

SEQ ID NO: 548859 - DNA, 25 bp, Rattus norvegicus
ggacaaaggcatcgtgcgttacctg

SEQ ID NO: 548860 - DNA, 25 bp, Rattus norvegicus
cacaggctgcagtctggggacaaag

SEQ ID NO: 548861 - DNA, 25 bp, Rattus norvegicus
tgtgtgttcaccagaccctgcgagg

SEQ ID NO: 548862 - DNA, 25 bp, Rattus norvegicus
caatgttgagctggtgtgtgttcac

SEQ ID NO: 548863 - DNA, 25 bp, Rattus norvegicus
caatatttcagcaggagcgtccgca

SEQ ID NO: 548864 - DNA, 25 bp, Rattus norvegicus
tgcagccaaccggactgaactcgga

SEQ ID NO: 548865 - DNA, 25 bp, Rattus norvegicus
gcccgcgtgccgtgtacatgtacac

SEQ ID NO: 548866 - DNA, 25 bp, Rattus norvegicus
cggaccgccgccttcggcgttcgct

SEQ ID NO: 548867 - DNA, 25 bp, Rattus norvegicus
gggagccacgccttccacaaagagc

SEQ ID NO: 548868 - DNA, 25 bp, Rattus norvegicus
cctgtggctgtgtcccagcagagct

SEQ ID NO: 548869 - DNA, 25 bp, Rattus norvegicus
tgtgtcccagcagagctcggcgccg

SEQ ID NO: 548870 - DNA, 25 bp, Rattus norvegicus
ggaggagagcaggacagctttccaa

SEQ ID NO: 548871 - DNA, 25 bp, Rattus norvegicus
gagcaggacagctttccaagaaatg

SEQ ID NO: 548872 - DNA, 25 bp, Rattus norvegicus
gctttccaagaaatgccaacttccc

SEQ ID NO: 548873 - DNA, 25 bp, Rattus norvegicus
gcactcacctcggacagaccgctgc

SEQ ID NO: 548874 - DNA, 25 bp, Rattus norvegicus
agaccgctgcggtcctcggtgtcct

SEQ ID NO: 548875 - DNA, 25 bp, Rattus norvegicus
ggtcctcggtgtcctggccgctcag

SEQ ID NO: 548876 - DNA, 25 bp, Rattus norvegicus
cagcaccttcttcagcttgtccatg

SEQ ID NO: 548877 - DNA, 25 bp, Rattus norvegicus
cttcagcttgtccatgtcaaggctc

SEQ ID NO: 548878 - DNA, 25 bp, Rattus norvegicus
ggcgttcgctctgccgaccactctt

SEQ ID NO: 548879 - DNA, 25 bp, Rattus norvegicus
tgtccatgtcaaggctcggaccgcc

SEQ ID NO: 548880 - DNA, 25 bp, Rattus norvegicus
gggaattcgtctttctggatccaga

SEQ ID NO: 548881 - DNA, 25 bp, Rattus norvegicus
cggtgccttacctactccttacaga

SEQ ID NO: 548882 - DNA, 25 bp, Rattus norvegicus
tccttacagacgtcgccgagcgatg

SEQ ID NO: 548883 - DNA, 25 bp, Rattus norvegicus
gcgatgtcatcacctcttgtgctta

SEQ ID NO: 548884 - DNA, 25 bp, Rattus norvegicus
tcgcggcgaagagggcatacccaaa

SEQ ID NO: 548885 - DNA, 25 bp, Rattus norvegicus
tcctgaattcttcgggtgacgtcac

SEQ ID NO: 548886 - DNA, 25 bp, Rattus norvegicus
cgagcaggggacaggactatttact

SEQ ID NO: 548887 - DNA, 25 bp, Rattus norvegicus
tgtcaatcaacggtcagtcagaggg

SEQ ID NO: 548888 - DNA, 25 bp, Rattus norvegicus
acttcatgatgtgggtcttggacgc

SEQ ID NO: 548889 - DNA, 25 bp, Rattus norvegicus
tccaaggcccgaaggagaagtcctg

SEQ ID NO: 548890 - DNA, 25 bp, Rattus norvegicus
gctgctctgaaagccgtggatcatc

SEQ ID NO: 548891 - DNA, 25 bp, Rattus norvegicus
ctactctgagcaagcgcctgcggca

SEQ ID NO: 548892 - DNA, 25 bp, Rattus norvegicus
ttacttccgggaccagccactagct

SEQ ID NO: 548893 - DNA, 25 bp, Rattus norvegicus
ctagctcaggatgactcacgtctta

SEQ ID NO: 548894 - DNA, 25 bp, Rattus norvegicus
gtttggggaagctggcgcttttgcg

SEQ ID NO: 548895 - DNA, 25 bp, Rattus norvegicus
accgcgccttggtttggggaagctg

SEQ ID NO: 548896 - DNA, 25 bp, Rattus norvegicus
ccggctgtaccgcgccttggtttgg

SEQ ID NO: 548897 - DNA, 25 bp, Rattus norvegicus
attcccggctgtaccgcgccttggt

SEQ ID NO: 548898 - DNA, 25 bp, Rattus norvegicus
gtccgagtctcattcccggctgtac

SEQ ID NO: 548899 - DNA, 25 bp, Rattus norvegicus
agtccgagtctcattcccggctgta

SEQ ID NO: 548900 - DNA, 25 bp, Rattus norvegicus
ttcggcgttccgcttctcccggcgc

SEQ ID NO: 548901 - DNA, 25 bp, Rattus norvegicus
ctgcgctgaaggcattgtgctgggc

SEQ ID NO: 548902 - DNA, 25 bp, Rattus norvegicus
cagctgcgctgaaggcattgtgctg

SEQ ID NO: 548903 - DNA, 25 bp, Rattus norvegicus
gcagctgcgctgaaggcattgtgct

SEQ ID NO: 548904 - DNA, 25 bp, Rattus norvegicus
atgcagctgcgctgaaggcattgtg

SEQ ID NO: 548905 - DNA, 25 bp, Rattus norvegicus
gatgcagctgcgctgaaggcattgt

SEQ ID NO: 548906 - DNA, 25 bp, Rattus norvegicus
cggcgcttcggtgagcaccgggctg

SEQ ID NO: 548907 - DNA, 25 bp, Rattus norvegicus
cagccgcggcgcttcggtgagcacc

SEQ ID NO: 548908 - DNA, 25 bp, Rattus norvegicus
gcaggatccaaaacagcctaggtta

SEQ ID NO: 548909 - DNA, 25 bp, Rattus norvegicus
ttttcctcacgtcccacaacaggtg

SEQ ID NO: 548910 - DNA, 25 bp, Rattus norvegicus
tccgctctgtgaggccagccaatta

SEQ ID NO: 548911 - DNA, 25 bp, Rattus norvegicus
aggtgagagtctgaccacgcctctt

SEQ ID NO: 548912 - DNA, 25 bp, Rattus norvegicus
gcctaggttacatagcgagacaccg

SEQ ID NO: 548913 - DNA, 25 bp, Rattus norvegicus
ccgggcgtgatgactcatgcttgta

SEQ ID NO: 548914 - DNA, 25 bp, Rattus norvegicus
cgctcacgcctctcgattcaaagga

SEQ ID NO: 548915 - DNA, 25 bp, Rattus norvegicus
agccgctgaaattgtctcgctcacg

SEQ ID NO: 548916 - DNA, 25 bp, Rattus norvegicus
gccctcaccctaggagagtagatta

SEQ ID NO: 548917 - DNA, 25 bp, Rattus norvegicus
acagaagccggcgtgcgtcacgatt

SEQ ID NO: 548918 - DNA, 25 bp, Rattus norvegicus
agaggatgtccaccggcaacagaag

SEQ ID NO: 548919 - DNA, 25 bp, Rattus norvegicus
cccggcctttctcgcgagaggatgt

SEQ ID NO: 548920 - DNA, 25 bp, Rattus norvegicus
gggacaggccgatcaacacccgagc

SEQ ID NO: 548921 - DNA, 25 bp, Rattus norvegicus
tacacccttcttagtcaaagtgagg

SEQ ID NO: 548922 - DNA, 25 bp, Rattus norvegicus
cttccgagtagtgaaaagaacgtca

SEQ ID NO: 548923 - DNA, 25 bp, Rattus norvegicus
tggccgagtattcaggccctgcgaa

SEQ ID NO: 548924 - DNA, 25 bp, Rattus norvegicus
ttgagaaggatctgacgcaaataca

SEQ ID NO: 548925 - DNA, 25 bp, Rattus norvegicus
ctctgcttccgcttccgagtagtga

SEQ ID NO: 548926 - DNA, 25 bp, Rattus norvegicus
ttgaacccgcgggaggactcgcagt

SEQ ID NO: 548927 - DNA, 25 bp, Rattus norvegicus
gaagccgactctggcgttgaacccg

SEQ ID NO: 548928 - DNA, 25 bp, Rattus norvegicus
tattcaggccctgcgaagccgactc

SEQ ID NO: 548929 - DNA, 25 bp, Rattus norvegicus
gcttctccagtatggccgagtattc

SEQ ID NO: 548930 - DNA, 25 bp, Rattus norvegicus
cttgttcgtgcttctccagtatggc

SEQ ID NO: 548931 - DNA, 25 bp, Rattus norvegicus
actcgcagtttgagaaggatctgac

SEQ ID NO: 548932 - DNA, 25 bp, Rattus norvegicus
acgtcacttccggaggttccgcgtg

SEQ ID NO: 548933 - DNA, 25 bp, Rattus norvegicus
tctgacgcaaatacaacggcgcgcg

SEQ ID NO: 548934 - DNA, 25 bp, Rattus norvegicus
acaacggcgcgcgaaaaaggtgagc

SEQ ID NO: 548935 - DNA, 25 bp, Rattus norvegicus
ttccgcgtggattaacttgttcgtg

SEQ ID NO: 548936 - DNA, 25 bp, Rattus norvegicus
ggggccgcaatcaatgtcacggctc

SEQ ID NO: 548937 - DNA, 25 bp, Rattus norvegicus
ctccacgccacagctccctgctccc

SEQ ID NO: 548938 - DNA, 25 bp, Rattus norvegicus
cgggcgcgaggacacctccacgcca

SEQ ID NO: 548939 - DNA, 25 bp, Rattus norvegicus
acacagctccggatcgcggctgcgg

SEQ ID NO: 548940 - DNA, 25 bp, Rattus norvegicus
tgagaccacacagctccggatcgcg

SEQ ID NO: 548941 - DNA, 25 bp, Rattus norvegicus
ggttggctcgcttgcctgagaccac

SEQ ID NO: 548942 - DNA, 25 bp, Rattus norvegicus
cagcggttggctcgcttgcctgaga

SEQ ID NO: 548943 - DNA, 25 bp, Rattus norvegicus
gacggcctctgccatcctgctcccg

SEQ ID NO: 548944 - DNA, 25 bp, Rattus norvegicus
aatgtcacggctccgacggcctctg

SEQ ID NO: 548945 - DNA, 25 bp, Rattus norvegicus
gcatcgcggctagcgccgaccacag

SEQ ID NO: 548946 - DNA, 25 bp, Rattus norvegicus
gcaatcaatgtcacggctccgacgg

SEQ ID NO: 548947 - DNA, 25 bp, Rattus norvegicus
gggccggggccgcaatcaatgtcac

SEQ ID NO: 548948 - DNA, 25 bp, Rattus norvegicus
cccagtggccaaccgccagccctca

SEQ ID NO: 548949 - DNA, 25 bp, Rattus norvegicus
tagcgccgaccacagccagcgccgg

SEQ ID NO: 548950 - DNA, 25 bp, Rattus norvegicus
ctgtgctcacccacgggcctggagg

SEQ ID NO: 548951 - DNA, 25 bp, Rattus norvegicus
gaaccgagctgtgctcacccacggg

SEQ ID NO: 548952 - DNA, 25 bp, Rattus norvegicus
cactgcggaaccgagctgtgctcac

SEQ ID NO: 548953 - DNA, 25 bp, Rattus norvegicus
cgcgggttcactgcggaaccgagct

SEQ ID NO: 548954 - DNA, 25 bp, Rattus norvegicus
ctgattgccagtgccgcgggttcac

SEQ ID NO: 548955 - DNA, 25 bp, Rattus norvegicus
cgctccggagcctgattgccagtgc

SEQ ID NO: 548956 - DNA, 25 bp, Rattus norvegicus
ccagaaggatcgctccggagcctga

SEQ ID NO: 548957 - DNA, 25 bp, Rattus norvegicus
gacggagctttcagtacctcccttc

SEQ ID NO: 548958 - DNA, 25 bp, Rattus norvegicus
gagagaacgcgcctttgcccagaag

SEQ ID NO: 548959 - DNA, 25 bp, Rattus norvegicus
cggaatccctttcagcccggccgag

SEQ ID NO: 548960 - DNA, 25 bp, Rattus norvegicus
gcagttctttcggttccgaggcacc

SEQ ID NO: 548961 - DNA, 25 bp, Rattus norvegicus
ccgcgagcagttctttcggttccga

SEQ ID NO: 548962 - DNA, 25 bp, Rattus norvegicus
ctttgcccagaaggatcgctccgga

SEQ ID NO: 548963 - DNA, 25 bp, Rattus norvegicus
gagctttcagtacctcccttcaggc

SEQ ID NO: 548964 - DNA, 25 bp, Rattus norvegicus
gggcggaaccctagcgtgcaatagt

SEQ ID NO: 548965 - DNA, 25 bp, Rattus norvegicus
ttcgtgactcacgtctcggactggg

SEQ ID NO: 548966 - DNA, 25 bp, Rattus norvegicus
cgtggacaggcgactgcctccactg

SEQ ID NO: 548967 - DNA, 25 bp, Rattus norvegicus
gtgcaatagttacggcggcagagtt

SEQ ID NO: 548968 - DNA, 25 bp, Rattus norvegicus
agtttggtcgcaaagcaggtgctct

SEQ ID NO: 548969 - DNA, 25 bp, Rattus norvegicus
tgctctgcagtcagcgccatggctg

SEQ ID NO: 548970 - DNA, 25 bp, Rattus norvegicus
cgctggccactatctccacgagaga

SEQ ID NO: 548971 - DNA, 25 bp, Rattus norvegicus
aggcccttcgcggacatcatctcaa

SEQ ID NO: 548972 - DNA, 25 bp, Rattus norvegicus
ctcaattagtgacggtcctccggga

SEQ ID NO: 548973 - DNA, 25 bp, Rattus norvegicus
ggcgagccctacatgtacctgagtc

SEQ ID NO: 548974 - DNA, 25 bp, Rattus norvegicus
ctgagtccgctgcaacaagcagtga

SEQ ID NO: 548975 - DNA, 25 bp, Rattus norvegicus
caagcagtgagcgacctgcaggtga

SEQ ID NO: 548976 - DNA, 25 bp, Rattus norvegicus
gctgtttcccaggacgggcagagca

SEQ ID NO: 548977 - DNA, 25 bp, Rattus norvegicus
cgctagtggcactactggtgtcgcc

SEQ ID NO: 548978 - DNA, 25 bp, Rattus norvegicus
tagttttgacgacatttggagtccc

SEQ ID NO: 548979 - DNA, 25 bp, Rattus norvegicus
ggcgcctctcggtaacggcacagca

SEQ ID NO: 548980 - DNA, 25 bp, Rattus norvegicus
ggtgtcgctcgacaggaaacctcga

SEQ ID NO: 548981 - DNA, 25 bp, Rattus norvegicus
agatcaccggcgataacctggcccg

SEQ ID NO: 548982 - DNA, 25 bp, Rattus norvegicus
tgagcggttcagatgggagatcacc

SEQ ID NO: 548983 - DNA, 25 bp, Rattus norvegicus
cccatgtcaggaagcatccttcagc

SEQ ID NO: 548984 - DNA, 25 bp, Rattus norvegicus
gactagccctttctctgattttcag

SEQ ID NO: 548985 - DNA, 25 bp, Rattus norvegicus
tccctgcccgtgtcgcgtggacagg

SEQ ID NO: 548986 - DNA, 25 bp, Rattus norvegicus
cagccttgaactgaggatccggccc

SEQ ID NO: 548987 - DNA, 25 bp, Rattus norvegicus
cagtttcggcccacacagccttgaa

SEQ ID NO: 548988 - DNA, 25 bp, Rattus norvegicus
cctgtgcgagaacagggagcccttc

SEQ ID NO: 548989 - DNA, 25 bp, Rattus norvegicus
gcttcaaaacgaaagctctccgttc

SEQ ID NO: 548990 - DNA, 25 bp, Rattus norvegicus
ccgttctgagagtgttagttttgac

SEQ ID NO: 548991 - DNA, 25 bp, Rattus norvegicus
ccgccgctctctcagagagggaaga

SEQ ID NO: 548992 - DNA, 25 bp, Rattus norvegicus
acgcttacagtgacggcacgcttac

SEQ ID NO: 548993 - DNA, 25 bp, Rattus norvegicus
cacgcttacagtgaccgcacgctta

SEQ ID NO: 548994 - DNA, 25 bp, Rattus norvegicus
tcacgcttacagtgacggcacgctt

SEQ ID NO: 548995 - DNA, 25 bp, Rattus norvegicus
cgcttacagtgacggcacgcttaca

SEQ ID NO: 548996 - DNA, 25 bp, Rattus norvegicus
cgcacgcttacagtgacggcacgct

SEQ ID NO: 548997 - DNA, 25 bp, Rattus norvegicus
tacagtgaccgcacgcttacagtga

SEQ ID NO: 548998 - DNA, 25 bp, Rattus norvegicus
gcacgcttacagtgacggcacgctt

SEQ ID NO: 548999 - DNA, 25 bp, Rattus norvegicus
ttacagtgacggcacgcttacagtg

SEQ ID NO: 549000 - DNA, 25 bp, Rattus norvegicus
ttacagtgaccgcacgcttacagtg

SEQ ID NO: 549001 - DNA, 25 bp, Rattus norvegicus
ggcacgcttacagtgacctcacgct

SEQ ID NO: 549002 - DNA, 25 bp, Rattus norvegicus
cgcttacaatgacggcacgcttaca

SEQ ID NO: 549003 - DNA, 25 bp, Rattus norvegicus
cacgcttacaatgacggcacgctta

SEQ ID NO: 549004 - DNA, 25 bp, Rattus norvegicus
tacagtgacggcacgcttacagtga

SEQ ID NO: 549005 - DNA, 25 bp, Rattus norvegicus
cacgcttacagtgacggcacgctta

SEQ ID NO: 549006 - DNA, 25 bp, Rattus norvegicus
cctgacgtgcgtctgggccacgcaa

SEQ ID NO: 549007 - DNA, 25 bp, Rattus norvegicus
tccagaatttctccatcagctcgtt

SEQ ID NO: 549008 - DNA, 25 bp, Rattus norvegicus
ggccacgcaagctgacgaccgagct

SEQ ID NO: 549009 - DNA, 25 bp, Rattus norvegicus
aggagccttcagttgatgtcagccc

SEQ ID NO: 549010 - DNA, 25 bp, Rattus norvegicus
cagcgtgcctcttacctttaagtta

SEQ ID NO: 549011 - DNA, 25 bp, Rattus norvegicus
attgacgtaagggatccagaatttc

SEQ ID NO: 549012 - DNA, 25 bp, Rattus norvegicus
agctcgttccggtacttcttggtga

SEQ ID NO: 549013 - DNA, 25 bp, Rattus norvegicus
ttcttggtgaagtagcccacgtagg

SEQ ID NO: 549014 - DNA, 25 bp, Rattus norvegicus
tgaagtagcccacgtaggaaacaaa

SEQ ID NO: 549015 - DNA, 25 bp, Rattus norvegicus
cagggtaacgccctggctccggaag

SEQ ID NO: 549016 - DNA, 25 bp, Rattus norvegicus
acgaccgagcttgcggaggagcctt

SEQ ID NO: 549017 - DNA, 25 bp, Rattus norvegicus
ggttcacattgcgtccgggtcctga

SEQ ID NO: 549018 - DNA, 25 bp, Rattus norvegicus
tggctccggaagttctccaccgact

SEQ ID NO: 549019 - DNA, 25 bp, Rattus norvegicus
gagtcctaaccactgcagcgtgcct

SEQ ID NO: 549020 - DNA, 25 bp, Rattus norvegicus
ctctggatgcgggcccgggaaacac

SEQ ID NO: 549021 - DNA, 25 bp, Rattus norvegicus
cacggcagcgcggacctctggatgc

SEQ ID NO: 549022 - DNA, 25 bp, Rattus norvegicus
aactgtcccgcgacccacggcagcg

SEQ ID NO: 549023 - DNA, 25 bp, Rattus norvegicus
ttcaacccaactgtcccgcgaccca

SEQ ID NO: 549024 - DNA, 25 bp, Rattus norvegicus
gatgtgcgcgaaggagccaccatac

SEQ ID NO: 549025 - DNA, 25 bp, Rattus norvegicus
acacggacgaccgaagccatttcca

SEQ ID NO: 549026 - DNA, 25 bp, Rattus norvegicus
gacgaccgaagccatttccacggaa

SEQ ID NO: 549027 - DNA, 25 bp, Rattus norvegicus
cagttctcgggtggcctctgagagc

SEQ ID NO: 549028 - DNA, 25 bp, Rattus norvegicus
tccagttctcgggtggcctctgaga

SEQ ID NO: 549029 - DNA, 25 bp, Rattus norvegicus
gagcgggctcacaacccgcaggcca

SEQ ID NO: 549030 - DNA, 25 bp, Rattus norvegicus
agcccagcctcctaagagtccgggg

SEQ ID NO: 549031 - DNA, 25 bp, Rattus norvegicus
gagggttcctcccacccagcccagc

SEQ ID NO: 549032 - DNA, 25 bp, Rattus norvegicus
cgaccgaagccatttccacggaagg

SEQ ID NO: 549033 - DNA, 25 bp, Rattus norvegicus
agagctccccgcctaggagcgagag

SEQ ID NO: 549034 - DNA, 25 bp, Rattus norvegicus
cacgcgcggacgtcccgctttaaat

SEQ ID NO: 549035 - DNA, 25 bp, Rattus norvegicus
agccggggttgagtatgaatatgaa

SEQ ID NO: 549036 - DNA, 25 bp, Rattus norvegicus
tgtaatgattacctgctgctgctgc

SEQ ID NO: 549037 - DNA, 25 bp, Rattus norvegicus
cctccgtccgccattttgaatattt

SEQ ID NO: 549038 - DNA, 25 bp, Rattus norvegicus
gccgcggctgaactctcatcttgac

SEQ ID NO: 549039 - DNA, 25 bp, Rattus norvegicus
ttcgccctttccaggagcgcagctt

SEQ ID NO: 549040 - DNA, 25 bp, Rattus norvegicus
cccaaagagtagtgtgtcaagtgct

SEQ ID NO: 549041 - DNA, 25 bp, Rattus norvegicus
gatagtcttctcgtcttccgtgtta

SEQ ID NO: 549042 - DNA, 25 bp, Rattus norvegicus
tccacggtggtattgtaaaagggca

SEQ ID NO: 549043 - DNA, 25 bp, Rattus norvegicus
gcgaggacgcgcatgagaaattagc

SEQ ID NO: 549044 - DNA, 25 bp, Rattus norvegicus
agaaattagcgagcgctccacggcc

SEQ ID NO: 549045 - DNA, 25 bp, Rattus norvegicus
ccggcgctccgcactttaaaaggct

SEQ ID NO: 549046 - DNA, 25 bp, Rattus norvegicus
ttaaaaggctttccgcgcagttgac

SEQ ID NO: 549047 - DNA, 25 bp, Rattus norvegicus
ctccgaggtaatttccggccctgtg

SEQ ID NO: 549048 - DNA, 25 bp, Rattus norvegicus
tctcctgtacgaagaaatagtaggc

SEQ ID NO: 549049 - DNA, 25 bp, Rattus norvegicus
tctatgggcgcccacaagccgggtt

SEQ ID NO: 549050 - DNA, 25 bp, Rattus norvegicus
cctcgccggcgcagttcgggaatct

SEQ ID NO: 549051 - DNA, 25 bp, Rattus norvegicus
gtaaccgagcttggagcctgcacgc

SEQ ID NO: 549052 - DNA, 25 bp, Rattus norvegicus
ccgcccttagtaaccgagcttggag

SEQ ID NO: 549053 - DNA, 25 bp, Rattus norvegicus
cgcagttcgggaatcttctcctgta

SEQ ID NO: 549054 - DNA, 25 bp, Rattus norvegicus
gaagaaatagtaggcattgcggctg

SEQ ID NO: 549055 - DNA, 25 bp, Rattus norvegicus
tcagccaggcgcttagccaatcagg

SEQ ID NO: 549056 - DNA, 25 bp, Rattus norvegicus
ttggagcctgcacgcgcttcagcca

SEQ ID NO: 549057 - DNA, 25 bp, Rattus norvegicus
ttggtccagcccttgggccgtgtcc

SEQ ID NO: 549058 - DNA, 25 bp, Rattus norvegicus
ctggaaggttctgtcggttggtcca

SEQ ID NO: 549059 - DNA, 25 bp, Rattus norvegicus
tccacgcctcggttctggaaggttc

SEQ ID NO: 549060 - DNA, 25 bp, Rattus norvegicus
tgaggtgtccgttccacgcctcggt

SEQ ID NO: 549061 - DNA, 25 bp, Rattus norvegicus
ctccagagacgcagcaagcagccgg

SEQ ID NO: 549062 - DNA, 25 bp, Rattus norvegicus
acggtgccttctaccaggacggctc

SEQ ID NO: 549063 - DNA, 25 bp, Rattus norvegicus
cgctccaaatccgagatgctgtcgc

SEQ ID NO: 549064 - DNA, 25 bp, Rattus norvegicus
gctggcggcctttgcagactcctat

SEQ ID NO: 549065 - DNA, 25 bp, Rattus norvegicus
tacgatcactcgtacctgagcagcg

SEQ ID NO: 549066 - DNA, 25 bp, Rattus norvegicus
cggaagaactttgccactggcgtgc

SEQ ID NO: 549067 - DNA, 25 bp, Rattus norvegicus
aggacggctcgctagacgagtacta

SEQ ID NO: 549068 - DNA, 25 bp, Rattus norvegicus
ccaccctacagcgaactggagctga

SEQ ID NO: 549069 - DNA, 25 bp, Rattus norvegicus
aagacgaggacgacgctgccgacga

SEQ ID NO: 549070 - DNA, 25 bp, Rattus norvegicus
agccacctacaaggctggggccagt

SEQ ID NO: 549071 - DNA, 25 bp, Rattus norvegicus
ctagacgagtactacggacgcgggc

SEQ ID NO: 549072 - DNA, 25 bp, Rattus norvegicus
cgtgccaacggcaacagccacgagg

SEQ ID NO: 549073 - DNA, 25 bp, Rattus norvegicus
cctggagacgccatccaagctgggc

SEQ ID NO: 549074 - DNA, 25 bp, Rattus norvegicus
ttgcagactcctatggccagcggtc

SEQ ID NO: 549075 - DNA, 25 bp, Rattus norvegicus
caggcgcggcctgagagcaacagcc

SEQ ID NO: 549076 - DNA, 25 bp, Rattus norvegicus
tcgagccttcagagtctggggcgca

SEQ ID NO: 549077 - DNA, 25 bp, Rattus norvegicus
agcagcactccagatgcccgggaaa

SEQ ID NO: 549078 - DNA, 25 bp, Rattus norvegicus
gggctgccttagtccctgtactctc

SEQ ID NO: 549079 - DNA, 25 bp, Rattus norvegicus
tgaaacagtaagagccgcggggacc

SEQ ID NO: 549080 - DNA, 25 bp, Rattus norvegicus
cgagctggaggctgccaagaagaac

SEQ ID NO: 549081 - DNA, 25 bp, Rattus norvegicus
caatggcgacctttgtgagcgagct

SEQ ID NO: 549082 - DNA, 25 bp, Rattus norvegicus
gttgatctttcggttgctggtgacc

SEQ ID NO: 549083 - DNA, 25 bp, Rattus norvegicus
gacgcctttcccagcgttctgtacg

SEQ ID NO: 549084 - DNA, 25 bp, Rattus norvegicus
cggggccgagaaccaaacacacgca

SEQ ID NO: 549085 - DNA, 25 bp, Rattus norvegicus
cctagctgctcgtaggacgcctttc

SEQ ID NO: 549086 - DNA, 25 bp, Rattus norvegicus
aggccttccgccgagttgatctttc

SEQ ID NO: 549087 - DNA, 25 bp, Rattus norvegicus
tgctttcccgactgtgagacgggcg

SEQ ID NO: 549088 - DNA, 25 bp, Rattus norvegicus
ctgggttgcatttaagaagcgcttt

SEQ ID NO: 549089 - DNA, 25 bp, Rattus norvegicus
gcccactaggtgaggcgagtcacgt

SEQ ID NO: 549090 - DNA, 25 bp, Rattus norvegicus
cggtaagggaacacagtgaggcctc

SEQ ID NO: 549091 - DNA, 25 bp, Rattus norvegicus
gtcgccattcgggtcaaaggcaatg

SEQ ID NO: 549092 - DNA, 25 bp, Rattus norvegicus
ggcgccttctctgggcgttaccata

SEQ ID NO: 549093 - DNA, 25 bp, Rattus norvegicus
aggaagccacctctctaggctgaga

SEQ ID NO: 549094 - DNA, 25 bp, Rattus norvegicus
tgtctctatggtttagcccggccgg

SEQ ID NO: 549095 - DNA, 25 bp, Rattus norvegicus
gccgaaacttcatgcaggcgccttc

SEQ ID NO: 549096 - DNA, 25 bp, Rattus norvegicus
ccggcgcagttggtttctcactttt

SEQ ID NO: 549097 - DNA, 25 bp, Rattus norvegicus
ccaagcgcttaacctcattggggtg

SEQ ID NO: 549098 - DNA, 25 bp, Rattus norvegicus
ccgccgccgcaagagtagtgaataa

SEQ ID NO: 549099 - DNA, 25 bp, Rattus norvegicus
cgaataatgttcagactggagtcca

SEQ ID NO: 549100 - DNA, 25 bp, Rattus norvegicus
actggagggccctgctccttttccg

SEQ ID NO: 549101 - DNA, 25 bp, Rattus norvegicus
gtgtccagtgctgtcagccgctctg

SEQ ID NO: 549102 - DNA, 25 bp, Rattus norvegicus
ctctaggctgagattagtgtctcta

SEQ ID NO: 549103 - DNA, 25 bp, Rattus norvegicus
cgttaccatagagaggaagccacct

SEQ ID NO: 549104 - DNA, 25 bp, Rattus norvegicus
attcaccgcgccatcggctccgccg

SEQ ID NO: 549105 - DNA, 25 bp, Rattus norvegicus
cttcgagccgagttagcccagtggc

SEQ ID NO: 549106 - DNA, 25 bp, Rattus norvegicus
gcgttcaaggcgtccagaaatgctc

SEQ ID NO: 549107 - DNA, 25 bp, Rattus norvegicus
acccaggcgttcaaggcgtccagaa

SEQ ID NO: 549108 - DNA, 25 bp, Rattus norvegicus
cggcgacactgccacgggcgatccc

SEQ ID NO: 549109 - DNA, 25 bp, Rattus norvegicus
ccgagttagcccagtggctggctgc

SEQ ID NO: 549110 - DNA, 25 bp, Rattus norvegicus
gctcgctccagccatcttgccctgc

SEQ ID NO: 549111 - DNA, 25 bp, Rattus norvegicus
acgtcggtgcttcgagccgagttag

SEQ ID NO: 549112 - DNA, 25 bp, Rattus norvegicus
gcgcttccggcgacgtcggtgcttc

SEQ ID NO: 549113 - DNA, 25 bp, Rattus norvegicus
tatcagcggctgacgtcagcaggcc

SEQ ID NO: 549114 - DNA, 25 bp, Rattus norvegicus
acgagggttgtgacccggcattcac

SEQ ID NO: 549115 - DNA, 25 bp, Rattus norvegicus
ggcgacagtccacgccgcccacctc

SEQ ID NO: 549116 - DNA, 25 bp, Rattus norvegicus
gcccaccgctaaggtcctccctcca

SEQ ID NO: 549117 - DNA, 25 bp, Rattus norvegicus
tggccgacgaggtgggctttaactc

SEQ ID NO: 549118 - DNA, 25 bp, Rattus norvegicus
gcgcgagaacatcgtggtgtacgat

SEQ ID NO: 549119 - DNA, 25 bp, Rattus norvegicus
tcgcccatcgtcctgcgctacaaga

SEQ ID NO: 549120 - DNA, 25 bp, Rattus norvegicus
ggtgtacgatgtgtgcgccaccatc

SEQ ID NO: 549121 - DNA, 25 bp, Rattus norvegicus
ttacttcaaagcctcggcccgtgtg

SEQ ID NO: 549122 - DNA, 25 bp, Rattus norvegicus
tgtgtgcgccaccatcgaccagtgc

SEQ ID NO: 549123 - DNA, 25 bp, Rattus norvegicus
aagcctcggcccgtgtggtcatgcc

SEQ ID NO: 549124 - DNA, 25 bp, Rattus norvegicus
atccggcgcgagaacatcgtggtgt

SEQ ID NO: 549125 - DNA, 25 bp, Rattus norvegicus
ggcatgtaagcgaccggccacgcca

SEQ ID NO: 549126 - DNA, 25 bp, Rattus norvegicus
acctgggcatgtaagcgaccggcca

SEQ ID NO: 549127 - DNA, 25 bp, Rattus norvegicus
cacctacagcgacctgggcatgtaa

SEQ ID NO: 549128 - DNA, 25 bp, Rattus norvegicus
gttcttcaacacctacagcgacctg

SEQ ID NO: 549129 - DNA, 25 bp, Rattus norvegicus
cagatggagttcttcaacacctaca

SEQ ID NO: 549130 - DNA, 25 bp, Rattus norvegicus
ccaggcttgcaaccagatggagttc

SEQ ID NO: 549131 - DNA, 25 bp, Rattus norvegicus
tgggctggatccaggcttgcaacca

SEQ ID NO: 549132 - DNA, 25 bp, Rattus norvegicus
aagcctggtccctacaaccgacttg

SEQ ID NO: 549133 - DNA, 25 bp, Rattus norvegicus
cgctcacgccgatcaggaagggctc

SEQ ID NO: 549134 - DNA, 25 bp, Rattus norvegicus
agcgcacacaggctccaagggaagc

SEQ ID NO: 549135 - DNA, 25 bp, Rattus norvegicus
tcgagcttcggctctccctgaaagc

SEQ ID NO: 549136 - DNA, 25 bp, Rattus norvegicus
tgctgtcatcccatccttgactgcg

SEQ ID NO: 549137 - DNA, 25 bp, Rattus norvegicus
tgaccataaaagacagcagtccctg

SEQ ID NO: 549138 - DNA, 25 bp, Rattus norvegicus
cctgcaggaaagacccgaggttagg

SEQ ID NO: 549139 - DNA, 25 bp, Rattus norvegicus
tttctcactgagactgatgccgttt

SEQ ID NO: 549140 - DNA, 25 bp, Rattus norvegicus
agagcacggagccagtacaactttc

SEQ ID NO: 549141 - DNA, 25 bp, Rattus norvegicus
ttccctgggatccaaggagcaagcg

SEQ ID NO: 549142 - DNA, 25 bp, Rattus norvegicus
tctcggaaagtcacactgggtagcc

SEQ ID NO: 549143 - DNA, 25 bp, Rattus norvegicus
cctcgctgccttgcagaagaaaata

SEQ ID NO: 549144 - DNA, 25 bp, Rattus norvegicus
gatgccgttttctcttctgaccata

SEQ ID NO: 549145 - DNA, 25 bp, Rattus norvegicus
tggcaggctgcaactgacacggccc

SEQ ID NO: 549146 - DNA, 25 bp, Rattus norvegicus
agcagttaacacaccgccgaggagg

SEQ ID NO: 549147 - DNA, 25 bp, Rattus norvegicus
ccatcctccgatgaaacgacatttc

SEQ ID NO: 549148 - DNA, 25 bp, Rattus norvegicus
tccaactctcgcgagactgggtctg

SEQ ID NO: 549149 - DNA, 25 bp, Rattus norvegicus
cgggttcctgcagtcttccgactca

SEQ ID NO: 549150 - DNA, 25 bp, Rattus norvegicus
ctcaagtggccacacggcgagaatg

SEQ ID NO: 549151 - DNA, 25 bp, Rattus norvegicus
tgctgtcaaagttgtagtgctcctc

SEQ ID NO: 549152 - DNA, 25 bp, Rattus norvegicus
cgtctctctggcttttgagtgcttc

SEQ ID NO: 549153 - DNA, 25 bp, Rattus norvegicus
cctcctccagcgtaataaaggctta

SEQ ID NO: 549154 - DNA, 25 bp, Rattus norvegicus
tcccgcatgacagggttctagtgtt

SEQ ID NO: 549155 - DNA, 25 bp, Rattus norvegicus
atgagcaccatgtttgcagacacgc

SEQ ID NO: 549156 - DNA, 25 bp, Rattus norvegicus
gcagacacgctgctcatcgttttta

SEQ ID NO: 549157 - DNA, 25 bp, Rattus norvegicus
atcgtttttatctccgtgtgcaccg

SEQ ID NO: 549158 - DNA, 25 bp, Rattus norvegicus
ctggcgttcggcacatgttagccta

SEQ ID NO: 549159 - DNA, 25 bp, Rattus norvegicus
agcgaccgaggactagctcaacttg

SEQ ID NO: 549160 - DNA, 25 bp, Rattus norvegicus
gagttaacacctgcccatctcggtg

SEQ ID NO: 549161 - DNA, 25 bp, Rattus norvegicus
gcaggcgactggtttcgaagactcc

SEQ ID NO: 549162 - DNA, 25 bp, Rattus norvegicus
ctcaggccggaatgacactcagctc

SEQ ID NO: 549163 - DNA, 25 bp, Rattus norvegicus
ttggccaacccggtgacaagcagca

SEQ ID NO: 549164 - DNA, 25 bp, Rattus norvegicus
ccgggtgactctcagttcacggcga

SEQ ID NO: 549165 - DNA, 25 bp, Rattus norvegicus
ttcacggcgaccctaaggaccaggc

SEQ ID NO: 549166 - DNA, 25 bp, Rattus norvegicus
tagctgtcatcgtcctccatggtgc

SEQ ID NO: 549167 - DNA, 25 bp, Rattus norvegicus
acagtccagctacgaaccgcggagc

SEQ ID NO: 549168 - DNA, 25 bp, Rattus norvegicus
aaaagcgcgcctgcgtgaacgccct

SEQ ID NO: 549169 - DNA, 25 bp, Rattus norvegicus
ggcctctttggtttgcgtttacgca

SEQ ID NO: 549170 - DNA, 25 bp, Rattus norvegicus
ttgcgtttacgcacgcgcggcctac

SEQ ID NO: 549171 - DNA, 25 bp, Rattus norvegicus
ggcctacctatgattccaccctaaa

SEQ ID NO: 549172 - DNA, 25 bp, Rattus norvegicus
tgcccgtgaccctacaggcctgggt

SEQ ID NO: 549173 - DNA, 25 bp, Rattus norvegicus
cgcggagaccctctaacctgtgtga

SEQ ID NO: 549174 - DNA, 25 bp, Rattus norvegicus
catgagcactggcaccttcgtcgtg

SEQ ID NO: 549175 - DNA, 25 bp, Rattus norvegicus
ctccgtaatggattgctgaacttgc

SEQ ID NO: 549176 - DNA, 25 bp, Rattus norvegicus
attgctgaacttgcgtggtcgcggc

SEQ ID NO: 549177 - DNA, 25 bp, Rattus norvegicus
aagcgttcgagccagccaccggtaa

SEQ ID NO: 549178 - DNA, 25 bp, Rattus norvegicus
cctccggcacggagaaagcgttcga

SEQ ID NO: 549179 - DNA, 25 bp, Rattus norvegicus
tcgtcgtgtcgcagccgctcaacta

SEQ ID NO: 549180 - DNA, 25 bp, Rattus norvegicus
tgcttggctttcctcccggacacta

SEQ ID NO: 549181 - DNA, 25 bp, Rattus norvegicus
agtcggacctgtgctgacctcgctc

SEQ ID NO: 549182 - DNA, 25 bp, Rattus norvegicus
ggccctgtgcactgagtctgttgcc

SEQ ID NO: 549183 - DNA, 25 bp, Rattus norvegicus
tctcagtgcagtcggacctgtgctg

SEQ ID NO: 549184 - DNA, 25 bp, Rattus norvegicus
cgccctgcgcccagaataaatgttt

SEQ ID NO: 549185 - DNA, 25 bp, Rattus norvegicus
gagttcttccgagttctccgtaatg

SEQ ID NO: 549186 - DNA, 25 bp, Rattus norvegicus
atgctccacactcgcgcagcgtggt

SEQ ID NO: 549187 - DNA, 25 bp, Rattus norvegicus
cgcagcgtggtttccatccctgggc

SEQ ID NO: 549188 - DNA, 25 bp, Rattus norvegicus
ttattgaacgtgctccgtgctgcga

SEQ ID NO: 549189 - DNA, 25 bp, Rattus norvegicus
agactccgcccaccacgtaccggtg

SEQ ID NO: 549190 - DNA, 25 bp, Rattus norvegicus
gggaccgatgggagactccgcccac

SEQ ID NO: 549191 - DNA, 25 bp, Rattus norvegicus
tggctgaaggattcgactctgtccc

SEQ ID NO: 549192 - DNA, 25 bp, Rattus norvegicus
tgtggctgaaggattcgactctgtc

SEQ ID NO: 549193 - DNA, 25 bp, Rattus norvegicus
ctaaatccaaggctgggtcgtccca

SEQ ID NO: 549194 - DNA, 25 bp, Rattus norvegicus
acgtgctccgtgctgcgatgcggct

SEQ ID NO: 549195 - DNA, 25 bp, Rattus norvegicus
cttgggaagattattgaacgtgctc

SEQ ID NO: 549196 - DNA, 25 bp, Rattus norvegicus
cgtctgggcagtcttgggaagatta

SEQ ID NO: 549197 - DNA, 25 bp, Rattus norvegicus
cacggaaagcgtctgggcagtcttg

SEQ ID NO: 549198 - DNA, 25 bp, Rattus norvegicus
ctgtggtttggcacggaaagcgtct

SEQ ID NO: 549199 - DNA, 25 bp, Rattus norvegicus
ctccctgtggtttggcacggaaagc

SEQ ID NO: 549200 - DNA, 25 bp, Rattus norvegicus
tccctccctgtggtttggcacggaa

SEQ ID NO: 549201 - DNA, 25 bp, Rattus norvegicus
cgccaggagagcctaaatccaaggc

SEQ ID NO: 549202 - DNA, 25 bp, Rattus norvegicus
gaaagcagggcggactttgcaccca

SEQ ID NO: 549203 - DNA, 25 bp, Rattus norvegicus
tgcagacgttcccagcactggccga

SEQ ID NO: 549204 - DNA, 25 bp, Rattus norvegicus
aaggcgactcctttgctcctgcaga

SEQ ID NO: 549205 - DNA, 25 bp, Rattus norvegicus
catccaagagtgagccgggctagtc

SEQ ID NO: 549206 - DNA, 25 bp, Rattus norvegicus
agcgagctcgcccatcaggtaagga

SEQ ID NO: 549207 - DNA, 25 bp, Rattus norvegicus
actccggcgcgtctaggagcagaac

SEQ ID NO: 549208 - DNA, 25 bp, Rattus norvegicus
caagaaagatctgcggcttgcggcc

SEQ ID NO: 549209 - DNA, 25 bp, Rattus norvegicus
cgatcttggaacagccgcctggctt

SEQ ID NO: 549210 - DNA, 25 bp, Rattus norvegicus
tccaggcagcagaccggagcatcag

SEQ ID NO: 549211 - DNA, 25 bp, Rattus norvegicus
ggacaaccgttccacgtggagagga

SEQ ID NO: 549212 - DNA, 25 bp, Rattus norvegicus
ttacggtgcagatccgagagcaacc

SEQ ID NO: 549213 - DNA, 25 bp, Rattus norvegicus
tgaggttagtcatcacttacggtgc

SEQ ID NO: 549214 - DNA, 25 bp, Rattus norvegicus
tccaggtgaggactgcttgaggtta

SEQ ID NO: 549215 - DNA, 25 bp, Rattus norvegicus
ttggcgggacgtcccaagaaagatc

SEQ ID NO: 549216 - DNA, 25 bp, Rattus norvegicus
gctcaccggcgacatctgttgcttt

SEQ ID NO: 549217 - DNA, 25 bp, Rattus norvegicus
cctctccgccttttgcaagatgcaa

SEQ ID NO: 549218 - DNA, 25 bp, Rattus norvegicus
actacgagaagtaagtgcctgcgtc

SEQ ID NO: 549219 - DNA, 25 bp, Rattus norvegicus
tggagaccacctgcttctaccggga

SEQ ID NO: 549220 - DNA, 25 bp, Rattus norvegicus
gcttctggcacgagcaatgcgtgca

SEQ ID NO: 549221 - DNA, 25 bp, Rattus norvegicus
ctgagactcaacgacagcttctggc

SEQ ID NO: 549222 - DNA, 25 bp, Rattus norvegicus
tcggataggtttctgctgagactca

SEQ ID NO: 549223 - DNA, 25 bp, Rattus norvegicus
cttttgtaggcagagcggtgagccc

SEQ ID NO: 549224 - DNA, 25 bp, Rattus norvegicus
aaggccagtaaatctcgcgcacccg

SEQ ID NO: 549225 - DNA, 25 bp, Rattus norvegicus
tctaccgggacaagaagctctactg

SEQ ID NO: 549226 - DNA, 25 bp, Rattus norvegicus
gagacacccgtaggaaaggccagta

SEQ ID NO: 549227 - DNA, 25 bp, Rattus norvegicus
ggtaccatccgtacgcacaacttgg

SEQ ID NO: 549228 - DNA, 25 bp, Rattus norvegicus
tcagcgggtcatctcggataggttt

SEQ ID NO: 549229 - DNA, 25 bp, Rattus norvegicus
gtgcagtgcgcctcttgcaaagagc

SEQ ID NO: 549230 - DNA, 25 bp, Rattus norvegicus
gccacggtaaatccgccggctctgg

SEQ ID NO: 549231 - DNA, 25 bp, Rattus norvegicus
acggtaaatccgccggctctggctg

SEQ ID NO: 549232 - DNA, 25 bp, Rattus norvegicus
tgccacggtaaatccgccggctctg

SEQ ID NO: 549233 - DNA, 25 bp, Rattus norvegicus
aatgccacggtaaatccgccggctc

SEQ ID NO: 549234 - DNA, 25 bp, Rattus norvegicus
agtaatgccacggtaaatccgccgg

SEQ ID NO: 549235 - DNA, 25 bp, Rattus norvegicus
cgcagacttaattaaaagtaatgcc

SEQ ID NO: 549236 - DNA, 25 bp, Rattus norvegicus
gcgccgcagacttaattaaaagtaa

SEQ ID NO: 549237 - DNA, 25 bp, Rattus norvegicus
cgccgcgccgcagacttaattaaaa

SEQ ID NO: 549238 - DNA, 25 bp, Rattus norvegicus
gcgccgcgccgcagacttaattaaa

SEQ ID NO: 549239 - DNA, 25 bp, Rattus norvegicus
ttcccaggtgacgtcaggcgggccc

SEQ ID NO: 549240 - DNA, 25 bp, Rattus norvegicus
ccttcccaggtgacgtcaggcgggc

SEQ ID NO: 549241 - DNA, 25 bp, Rattus norvegicus
ccgcgaggtcgtcggtccgcgcctc

SEQ ID NO: 549242 - DNA, 25 bp, Rattus norvegicus
gcgccttcccaggtgacgtcaggcg

SEQ ID NO: 549243 - DNA, 25 bp, Rattus norvegicus
gccgcgccgcagacttaattaaaag

SEQ ID NO: 549244 - DNA, 25 bp, Rattus norvegicus
caggaggctttacgccaccagacat

SEQ ID NO: 549245 - DNA, 25 bp, Rattus norvegicus
ttggccaccgagtcgtgacagcgct

SEQ ID NO: 549246 - DNA, 25 bp, Rattus norvegicus
tgagagagaaaagagtgacaccgcg

SEQ ID NO: 549247 - DNA, 25 bp, Rattus norvegicus
aaaagagtgacaccgcgtattgacc

SEQ ID NO: 549248 - DNA, 25 bp, Rattus norvegicus
agatgtggaggccagcacgcagccc

SEQ ID NO: 549249 - DNA, 25 bp, Rattus norvegicus
ccgcacggccatgccgctaattaat

SEQ ID NO: 549250 - DNA, 25 bp, Rattus norvegicus
gctaattaatcaccttggccaccga

SEQ ID NO: 549251 - DNA, 25 bp, Rattus norvegicus
ctggcccgcgtgtcacagccaatta

SEQ ID NO: 549252 - DNA, 25 bp, Rattus norvegicus
tgacagcgcttggtttgcacgatgc

SEQ ID NO: 549253 - DNA, 25 bp, Rattus norvegicus
cttggtttgcacgatgccaggagcc

SEQ ID NO: 549254 - DNA, 25 bp, Rattus norvegicus
caggagcctggcacctgcagagaga

SEQ ID NO: 549255 - DNA, 25 bp, Rattus norvegicus
cacagccaattaggctttggaggga

SEQ ID NO: 549256 - DNA, 25 bp, Rattus norvegicus
ccgcaggcaggaggctttacgccac

SEQ ID NO: 549257 - DNA, 25 bp, Rattus norvegicus
acctgcagagagacgcgcccgcagg

SEQ ID NO: 549258 - DNA, 25 bp, Rattus norvegicus
aaatttgcatatccgcctctctggg

SEQ ID NO: 549259 - DNA, 25 bp, Rattus norvegicus
gccagctcagcctttccagtcgtta

SEQ ID NO: 549260 - DNA, 25 bp, Rattus norvegicus
tttccgtgccgagcatcctttcctg

SEQ ID NO: 549261 - DNA, 25 bp, Rattus norvegicus
tctgcctaggcgagtttttcttcca

SEQ ID NO: 549262 - DNA, 25 bp, Rattus norvegicus
aggtcttgctgcttcagtggagttc

SEQ ID NO: 549263 - DNA, 25 bp, Rattus norvegicus
tttgcatacgccactctaggatggg

SEQ ID NO: 549264 - DNA, 25 bp, Rattus norvegicus
ccagagggaggctcagaattggctt

SEQ ID NO: 549265 - DNA, 25 bp, Rattus norvegicus
ccgcgcgccacaagactgaaaattt

SEQ ID NO: 549266 - DNA, 25 bp, Rattus norvegicus
tgcttggttttacccagaaggccgc

SEQ ID NO: 549267 - DNA, 25 bp, Rattus norvegicus
tcaaactcccgaggggcttcctgga

SEQ ID NO: 549268 - DNA, 25 bp, Rattus norvegicus
tttctacgactgctgcttcccatgc

SEQ ID NO: 549269 - DNA, 25 bp, Rattus norvegicus
cgcccggtgtacagtattttctacg

SEQ ID NO: 549270 - DNA, 25 bp, Rattus norvegicus
gcccggcaaccagagagctctaagt

SEQ ID NO: 549271 - DNA, 25 bp, Rattus norvegicus
tgctgcgacctggttaatttgcata

SEQ ID NO: 549272 - DNA, 25 bp, Rattus norvegicus
agcacacagaccgtgtggatccctc

SEQ ID NO: 549273 - DNA, 25 bp, Rattus norvegicus
taaaattaacacgaaagcacacaga

SEQ ID NO: 549274 - DNA, 25 bp, Rattus norvegicus
ctcgttcgtctacgcggtgacgctg

SEQ ID NO: 549275 - DNA, 25 bp, Rattus norvegicus
cacttaaacgcaagactgtaaaatt

SEQ ID NO: 549276 - DNA, 25 bp, Rattus norvegicus
gtggctccacttaaacgcaagactg

SEQ ID NO: 549277 - DNA, 25 bp, Rattus norvegicus
ctgcgtccttgaggaaaacgtggct

SEQ ID NO: 549278 - DNA, 25 bp, Rattus norvegicus
ccagtctccagttcttaaaggcgca

SEQ ID NO: 549279 - DNA, 25 bp, Rattus norvegicus
ccagttcttaaaggcgcagagagac

SEQ ID NO: 549280 - DNA, 25 bp, Rattus norvegicus
taaaggcgcagagagaccttagctc

SEQ ID NO: 549281 - DNA, 25 bp, Rattus norvegicus
agagaccttagctccggctcttgtc

SEQ ID NO: 549282 - DNA, 25 bp, Rattus norvegicus
agctccggctcttgtctgcttaggc

SEQ ID NO: 549283 - DNA, 25 bp, Rattus norvegicus
gctcttgtctgcttaggctgcgtcc

SEQ ID NO: 549284 - DNA, 25 bp, Rattus norvegicus
cacgacccagtctccagttcttaaa

SEQ ID NO: 549285 - DNA, 25 bp, Rattus norvegicus
gcttaggctgcgtccttgaggaaaa

SEQ ID NO: 549286 - DNA, 25 bp, Rattus norvegicus
ggccgttgtcacttttcaaaccagc

SEQ ID NO: 549287 - DNA, 25 bp, Rattus norvegicus
atccaccggccgttgtcacttttca

SEQ ID NO: 549288 - DNA, 25 bp, Rattus norvegicus
tgcagtcccagtagctcaccaaaga

SEQ ID NO: 549289 - DNA, 25 bp, Rattus norvegicus
gagcaaactcctaaaatccaccggc

SEQ ID NO: 549290 - DNA, 25 bp, Rattus norvegicus
ctcaccaaagagcagttacaaaccg

SEQ ID NO: 549291 - DNA, 25 bp, Rattus norvegicus
aaaccagccgcctttctatgcgagg

SEQ ID NO: 549292 - DNA, 25 bp, Rattus norvegicus
cgcagcagttaaagagaggagttcc

SEQ ID NO: 549293 - DNA, 25 bp, Rattus norvegicus
gactccgcctgtccaggaagcgcag

SEQ ID NO: 549294 - DNA, 25 bp, Rattus norvegicus
ttgcttctagtcgaaagcccgactc

SEQ ID NO: 549295 - DNA, 25 bp, Rattus norvegicus
ccattgtacagggagttgcttctag

SEQ ID NO: 549296 - DNA, 25 bp, Rattus norvegicus
tggaaagctcaaaagacctacggtg

SEQ ID NO: 549297 - DNA, 25 bp, Rattus norvegicus
tgcgacggatgcctggaaagctcaa

SEQ ID NO: 549298 - DNA, 25 bp, Rattus norvegicus
cacagcgcgcttcctttgcgacgga

SEQ ID NO: 549299 - DNA, 25 bp, Rattus norvegicus
tccaggtcagcggaaccattgtaca

SEQ ID NO: 549300 - DNA, 25 bp, Rattus norvegicus
ggtaatcaaaaccaccttccgcatc

SEQ ID NO: 549301 - DNA, 25 bp, Rattus norvegicus
cgcaactcggcgtcttctctccacg

SEQ ID NO: 549302 - DNA, 25 bp, Rattus norvegicus
tgggcccgccaatcgcaactcggcg

SEQ ID NO: 549303 - DNA, 25 bp, Rattus norvegicus
cccgaccaatcaaggctcaaccagg

SEQ ID NO: 549304 - DNA, 25 bp, Rattus norvegicus
gaaccacgatccctgaccacgcgca

SEQ ID NO: 549305 - DNA, 25 bp, Rattus norvegicus
ggtgagtcaccgacctacgcttctc

SEQ ID NO: 549306 - DNA, 25 bp, Rattus norvegicus
gcagctctcagccagaaccacgatc

SEQ ID NO: 549307 - DNA, 25 bp, Rattus norvegicus
cgtccacggttctcagcagctctca

SEQ ID NO: 549308 - DNA, 25 bp, Rattus norvegicus
cgcccacaccgggtgaggtgagata

SEQ ID NO: 549309 - DNA, 25 bp, Rattus norvegicus
tcattcacgccttgcagcggagttc

SEQ ID NO: 549310 - DNA, 25 bp, Rattus norvegicus
ggttccacgggagacctcacctgct

SEQ ID NO: 549311 - DNA, 25 bp, Rattus norvegicus
tccacgcccacaccgggtgaggtga

SEQ ID NO: 549312 - DNA, 25 bp, Rattus norvegicus
ctccagggttccacgggagacctca

SEQ ID NO: 549313 - DNA, 25 bp, Rattus norvegicus
ttcacgccttgcagcggagttccac

SEQ ID NO: 549314 - DNA, 25 bp, Rattus norvegicus
gcagacccgccagtctacgcgatga

SEQ ID NO: 549315 - DNA, 25 bp, Rattus norvegicus
cgatgtacgtgggtggcgtcacttc

SEQ ID NO: 549316 - DNA, 25 bp, Rattus norvegicus
gcctggcgtggttcccgcgatgtac

SEQ ID NO: 549317 - DNA, 25 bp, Rattus norvegicus
gacgcaagtgcgtagagctgaccca

SEQ ID NO: 549318 - DNA, 25 bp, Rattus norvegicus
ctcctgcgtgcctgacatcgtgtgt

SEQ ID NO: 549319 - DNA, 25 bp, Rattus norvegicus
ctctgctattcgtgacgcacacatc

SEQ ID NO: 549320 - DNA, 25 bp, Rattus norvegicus
ctaaggccgactcctctttcctgga

SEQ ID NO: 549321 - DNA, 25 bp, Rattus norvegicus
cggtcgctttaagaggcggagctaa

SEQ ID NO: 549322 - DNA, 25 bp, Rattus norvegicus
ccaagacgtttaaaggagcggcact

SEQ ID NO: 549323 - DNA, 25 bp, Rattus norvegicus
gagcctcacacacgtgtcaccaaga

SEQ ID NO: 549324 - DNA, 25 bp, Rattus norvegicus
tcgaaagttcctgcgttccgccgcg

SEQ ID NO: 549325 - DNA, 25 bp, Rattus norvegicus
tcagccttcgctggagttcccaaaa

SEQ ID NO: 549326 - DNA, 25 bp, Rattus norvegicus
acgcacctgtcagccttcgctggag

SEQ ID NO: 549327 - DNA, 25 bp, Rattus norvegicus
agagctgacccagctgcggcctggc

SEQ ID NO: 549328 - DNA, 25 bp, Rattus norvegicus
ggctggactaggctccggcttcttc

SEQ ID NO: 549329 - DNA, 25 bp, Rattus norvegicus
caggtgacggatttccgaacgccta

SEQ ID NO: 549330 - DNA, 25 bp, Rattus norvegicus
gccgagcaccgagtggcaacccgta

SEQ ID NO: 549331 - DNA, 25 bp, Rattus norvegicus
ccgcgcccgcctggaatatatacgg

SEQ ID NO: 549332 - DNA, 25 bp, Rattus norvegicus
tatatacggtcatccgaggggccgg

SEQ ID NO: 549333 - DNA, 25 bp, Rattus norvegicus
acgtcagcgaccgagagcggccaaa

SEQ ID NO: 549334 - DNA, 25 bp, Rattus norvegicus
gcggagcctctttacgtcgctcaga

SEQ ID NO: 549335 - DNA, 25 bp, Rattus norvegicus
gtcgctcagactcttgaccaatagg

SEQ ID NO: 549336 - DNA, 25 bp, Rattus norvegicus
gtgtcctgtcagtctgcggcaccgc

SEQ ID NO: 549337 - DNA, 25 bp, Rattus norvegicus
ctctcacgcacttgcggggccggag

SEQ ID NO: 549338 - DNA, 25 bp, Rattus norvegicus
agctggctacgctcgcagcctgcgg

SEQ ID NO: 549339 - DNA, 25 bp, Rattus norvegicus
ggcgccaccttaagtacctactgta

SEQ ID NO: 549340 - DNA, 25 bp, Rattus norvegicus
tctccgagcaggcagtgattcttca

SEQ ID NO: 549341 - DNA, 25 bp, Rattus norvegicus
caataggatgtttaggtgtcctgtc

SEQ ID NO: 549342 - DNA, 25 bp, Rattus norvegicus
tggttcccggaggcaggaactgctt

SEQ ID NO: 549343 - DNA, 25 bp, Rattus norvegicus
gcagcgcacccggtacaccgaggcc

SEQ ID NO: 549344 - DNA, 25 bp, Rattus norvegicus
gcccgcaccgactcccgggacctca

SEQ ID NO: 549345 - DNA, 25 bp, Rattus norvegicus
ctcttttcggaaaccatactccgca

SEQ ID NO: 549346 - DNA, 25 bp, Rattus norvegicus
acacgatgcgccaggcaggcccgcg

SEQ ID NO: 549347 - DNA, 25 bp, Rattus norvegicus
cgagccgacacgatgcgccaggcag

SEQ ID NO: 549348 - DNA, 25 bp, Rattus norvegicus
ggaaaccatactccgcagccgaggc

SEQ ID NO: 549349 - DNA, 25 bp, Rattus norvegicus
gagtgccgcagcagcgcacccggta

SEQ ID NO: 549350 - DNA, 25 bp, Rattus norvegicus
ggcaggaactgcttgagggcgccgg

SEQ ID NO: 549351 - DNA, 25 bp, Rattus norvegicus
tactccgcagccgaggcggcagccc

SEQ ID NO: 549352 - DNA, 25 bp, Rattus norvegicus
cggaaaccatactccgcagccgagg

SEQ ID NO: 549353 - DNA, 25 bp, Rattus norvegicus
ttcggaaaccatactccgcagccga

SEQ ID NO: 549354 - DNA, 25 bp, Rattus norvegicus
ttttcggaaaccatactccgcagcc

SEQ ID NO: 549355 - DNA, 25 bp, Rattus norvegicus
agccgacacgatgcgccaggcaggc

SEQ ID NO: 549356 - DNA, 25 bp, Rattus norvegicus
ctccaggcactgactttaacgtccc

SEQ ID NO: 549357 - DNA, 25 bp, Rattus norvegicus
gtacacggaacaccgaggccgagcc

SEQ ID NO: 549358 - DNA, 25 bp, Rattus norvegicus
acgccaggtaggctccaggcactga

SEQ ID NO: 549359 - DNA, 25 bp, Rattus norvegicus
gagccgacacgccacgccaggtagg

SEQ ID NO: 549360 - DNA, 25 bp, Rattus norvegicus
agaggacaagcgagccgacacgcca

SEQ ID NO: 549361 - DNA, 25 bp, Rattus norvegicus
gagccgctacccaagcggctctgta

SEQ ID NO: 549362 - DNA, 25 bp, Rattus norvegicus
agcgtacacggaacaccgaggccga

SEQ ID NO: 549363 - DNA, 25 bp, Rattus norvegicus
cacggggtgccgaagcagcgtacac

SEQ ID NO: 549364 - DNA, 25 bp, Rattus norvegicus
cccgtcgctccgcagggcgtggcct

SEQ ID NO: 549365 - DNA, 25 bp, Rattus norvegicus
tgttccgcgacccaggccacagccc

SEQ ID NO: 549366 - DNA, 25 bp, Rattus norvegicus
gccgaagcagcgtacacggaacacc

SEQ ID NO: 549367 - DNA, 25 bp, Rattus norvegicus
ggaaaccatgttccgcgacccaggc

SEQ ID NO: 549368 - DNA, 25 bp, Rattus norvegicus
tcctggaggaggcaggaactactta

SEQ ID NO: 549369 - DNA, 25 bp, Rattus norvegicus
gcaggaactacttaagggcgccagg

SEQ ID NO: 549370 - DNA, 25 bp, Rattus norvegicus
gtcgtgcccatcgtccacaaggttg

SEQ ID NO: 549371 - DNA, 25 bp, Rattus norvegicus
tgacccgcggcggacccgctgctcc

SEQ ID NO: 549372 - DNA, 25 bp, Rattus norvegicus
acttggttttgctgggcatggtgac

SEQ ID NO: 549373 - DNA, 25 bp, Rattus norvegicus
aggttgtacttggttttgctgggca

SEQ ID NO: 549374 - DNA, 25 bp, Rattus norvegicus
tccacaaggttgtacttggttttgc

SEQ ID NO: 549375 - DNA, 25 bp, Rattus norvegicus
cgtgcccatcgtccacaaggttgta

SEQ ID NO: 549376 - DNA, 25 bp, Rattus norvegicus
gcgacgagaaagagctggcgagacc

SEQ ID NO: 549377 - DNA, 25 bp, Rattus norvegicus
gtaagtcgtgcccatcgtccacaag

SEQ ID NO: 549378 - DNA, 25 bp, Rattus norvegicus
atccgtaagtcgtgcccatcgtcca

SEQ ID NO: 549379 - DNA, 25 bp, Rattus norvegicus
aagggatccgtaagtcgtgcccatc

SEQ ID NO: 549380 - DNA, 25 bp, Rattus norvegicus
gtgcaaagggatccgtaagtcgtgc

SEQ ID NO: 549381 - DNA, 25 bp, Rattus norvegicus
ggcgtcctcgttgtgcaaagggatc

SEQ ID NO: 549382 - DNA, 25 bp, Rattus norvegicus
ctggaaggcgtcctcgttgtgcaaa

SEQ ID NO: 549383 - DNA, 25 bp, Rattus norvegicus
cccatcgtccacaaggttgtacttg

SEQ ID NO: 549384 - DNA, 25 bp, Rattus norvegicus
tccgactcctctcgcgcgccagagc

SEQ ID NO: 549385 - DNA, 25 bp, Rattus norvegicus
aggcgcagtctgctcagccagtagc

SEQ ID NO: 549386 - DNA, 25 bp, Rattus norvegicus
ccaggcgcagtctgctcagccagta

SEQ ID NO: 549387 - DNA, 25 bp, Rattus norvegicus
gatccaggcgcagtctgctcagcca

SEQ ID NO: 549388 - DNA, 25 bp, Rattus norvegicus
gggatccaggcgcagtctgctcagc

SEQ ID NO: 549389 - DNA, 25 bp, Rattus norvegicus
gccgcaggaccgtggggatccaggc

SEQ ID NO: 549390 - DNA, 25 bp, Rattus norvegicus
gcagcgccaagccgggaccggggaa

SEQ ID NO: 549391 - DNA, 25 bp, Rattus norvegicus
gcaggtgaaagtccccgcagcgcca

SEQ ID NO: 549392 - DNA, 25 bp, Rattus norvegicus
ccgcgcgcgcccagcaggtgaaagt

SEQ ID NO: 549393 - DNA, 25 bp, Rattus norvegicus
gggcccgttccgactcctctcgcgc

SEQ ID NO: 549394 - DNA, 25 bp, Rattus norvegicus
gcgcagtctgctcagccagtagcag

SEQ ID NO: 549395 - DNA, 25 bp, Rattus norvegicus
cagccagtagcagcgaaacggcatc

SEQ ID NO: 549396 - DNA, 25 bp, Rattus norvegicus
gcgcgcgcccagcaggtgaaagtcc

SEQ ID NO: 549397 - DNA, 25 bp, Rattus norvegicus
ggcgcagtctgctcagccagtagca

SEQ ID NO: 549398 - DNA, 25 bp, Rattus norvegicus
gaagtccttctcaggtcagcatcta

SEQ ID NO: 549399 - DNA, 25 bp, Rattus norvegicus
agatacaaggccagcagcgcccttc

SEQ ID NO: 549400 - DNA, 25 bp, Rattus norvegicus
tacagtcagatacaaggccagcagc

SEQ ID NO: 549401 - DNA, 25 bp, Rattus norvegicus
tctcaggtcagcatctacagtcaga

SEQ ID NO: 549402 - DNA, 25 bp, Rattus norvegicus
cttgaaaacgcacacgaagtccttc

SEQ ID NO: 549403 - DNA, 25 bp, Rattus norvegicus
gctcgggcgtgaagaaaactcttga

SEQ ID NO: 549404 - DNA, 25 bp, Rattus norvegicus
tcgccctcagcaagccggcgctcta

SEQ ID NO: 549405 - DNA, 25 bp, Rattus norvegicus
cgtcttgagtccagtcccagtgtgt

SEQ ID NO: 549406 - DNA, 25 bp, Rattus norvegicus
ccggcacaatagaggctccgccttc

SEQ ID NO: 549407 - DNA, 25 bp, Rattus norvegicus
gggccagcaaccctccctcgtcttg

SEQ ID NO: 549408 - DNA, 25 bp, Rattus norvegicus
cctcgtcttgtgctctgtggccact

SEQ ID NO: 549409 - DNA, 25 bp, Rattus norvegicus
tggccactgtccgtcttgagtccag

SEQ ID NO: 549410 - DNA, 25 bp, Rattus norvegicus
gcgtagagcccgactctgtgcgctt

SEQ ID NO: 549411 - DNA, 25 bp, Rattus norvegicus
ccagtcccagtgtgtcccgggcttg

SEQ ID NO: 549412 - DNA, 25 bp, Rattus norvegicus
tgagtaatccgaaacggcagcggcc

SEQ ID NO: 549413 - DNA, 25 bp, Rattus norvegicus
acgcgcccgatctagctcgagtaca

SEQ ID NO: 549414 - DNA, 25 bp, Rattus norvegicus
agcccagcggttctgccagtctctt

SEQ ID NO: 549415 - DNA, 25 bp, Rattus norvegicus
agtctcttccacgattctgccagtc

SEQ ID NO: 549416 - DNA, 25 bp, Rattus norvegicus
cgtgacacggttcgtccacacctgt

SEQ ID NO: 549417 - DNA, 25 bp, Rattus norvegicus
gctcgagtacaatcgcagatccact

SEQ ID NO: 549418 - DNA, 25 bp, Rattus norvegicus
ccagtcttcacctggtccatgagga

SEQ ID NO: 549419 - DNA, 25 bp, Rattus norvegicus
tggtccatgaggaagaaccggacta

SEQ ID NO: 549420 - DNA, 25 bp, Rattus norvegicus
aaccggactaaaaggcgactccatg

SEQ ID NO: 549421 - DNA, 25 bp, Rattus norvegicus
cgcaactcggatcggtgagtaatcc

SEQ ID NO: 549422 - DNA, 25 bp, Rattus norvegicus
cagcggccggaggacaaaatatgct

SEQ ID NO: 549423 - DNA, 25 bp, Rattus norvegicus
atatgctgaacgctgacggacggtg

SEQ ID NO: 549424 - DNA, 25 bp, Rattus norvegicus
ccgagcggaggcaaactatctcatc

SEQ ID NO: 549425 - DNA, 25 bp, Rattus norvegicus
tctccctcgcaactcggatcggtga

SEQ ID NO: 549426 - DNA, 25 bp, Rattus norvegicus
ctttgcccacaggtggatagcggta

SEQ ID NO: 549427 - DNA, 25 bp, Rattus norvegicus
tctaagcggcaaccctaagggctcg

SEQ ID NO: 549428 - DNA, 25 bp, Rattus norvegicus
tgcgggatcctcagccatgctgttc

SEQ ID NO: 549429 - DNA, 25 bp, Rattus norvegicus
tgaccggttctcgtagacgttcctc

SEQ ID NO: 549430 - DNA, 25 bp, Rattus norvegicus
cggatcttctcttctgcggggattt

SEQ ID NO: 549431 - DNA, 25 bp, Rattus norvegicus
tgaacttggtatggtcctcaggccc

SEQ ID NO: 549432 - DNA, 25 bp, Rattus norvegicus
ttcgctagcgcgcttcaagggaaga

SEQ ID NO: 549433 - DNA, 25 bp, Rattus norvegicus
cactccagtcgcagaaataaactta

SEQ ID NO: 549434 - DNA, 25 bp, Rattus norvegicus
aggtctctctaacgctcgatgtgtc

SEQ ID NO: 549435 - DNA, 25 bp, Rattus norvegicus
ggtccaagcgctgactgaccagtgc

SEQ ID NO: 549436 - DNA, 25 bp, Rattus norvegicus
acctgcctacgatctgggtccaagc

SEQ ID NO: 549437 - DNA, 25 bp, Rattus norvegicus
ggtaagacgcggcaacacctgccta

SEQ ID NO: 549438 - DNA, 25 bp, Rattus norvegicus
actctggcagctacttgcggtaaga

SEQ ID NO: 549439 - DNA, 25 bp, Rattus norvegicus
gctgttctggcacacgcagcccgaa

SEQ ID NO: 549440 - DNA, 25 bp, Rattus norvegicus
gcgagcctggccgatgaaagccacg

SEQ ID NO: 549441 - DNA, 25 bp, Rattus norvegicus
tcggactaactccagccgctcggta

SEQ ID NO: 549442 - DNA, 25 bp, Rattus norvegicus
taaccagctccggtgtcggactaac

SEQ ID NO: 549443 - DNA, 25 bp, Rattus norvegicus
agtcaccggctagagtaaccagctc

SEQ ID NO: 549444 - DNA, 25 bp, Rattus norvegicus
gcgccaggaagccaagcagcctctg

SEQ ID NO: 549445 - DNA, 25 bp, Rattus norvegicus
gagctctgtacttccaacatggcgg

SEQ ID NO: 549446 - DNA, 25 bp, Rattus norvegicus
tcgcagccatggttagagctctgta

SEQ ID NO: 549447 - DNA, 25 bp, Rattus norvegicus
gtcggagcctgacgctcgcagccat

SEQ ID NO: 549448 - DNA, 25 bp, Rattus norvegicus
tcaggtagtccggtccagccactgc

SEQ ID NO: 549449 - DNA, 25 bp, Rattus norvegicus
gtgatgcccgcctccctcaggtagt

SEQ ID NO: 549450 - DNA, 25 bp, Rattus norvegicus
ggttccgagtccaccgtcagcacgg

SEQ ID NO: 549451 - DNA, 25 bp, Rattus norvegicus
gaggctctggagaccttcgaaacca

SEQ ID NO: 549452 - DNA, 25 bp, Rattus norvegicus
ccaagtgactgagcaggtcggtctc

SEQ ID NO: 549453 - DNA, 25 bp, Rattus norvegicus
tgaaagccacgcaccgatccaagtg

SEQ ID NO: 549454 - DNA, 25 bp, Rattus norvegicus
gaagcaacgccttaaactgtatatg

SEQ ID NO: 549455 - DNA, 25 bp, Rattus norvegicus
actgtatatggcgactggtttgctc

SEQ ID NO: 549456 - DNA, 25 bp, Rattus norvegicus
gactggtttgctcgcgaaggctttt

SEQ ID NO: 549457 - DNA, 25 bp, Rattus norvegicus
aaggcttttgagtggctgttgctta

SEQ ID NO: 549458 - DNA, 25 bp, Rattus norvegicus
cgcgacagtgaagcaacgccttaaa

SEQ ID NO: 549459 - DNA, 25 bp, Rattus norvegicus
acccagggtttagaacgcgacagtg

SEQ ID NO: 549460 - DNA, 25 bp, Rattus norvegicus
atctgaagtatctcgagtcgctggc

SEQ ID NO: 549461 - DNA, 25 bp, Rattus norvegicus
ccgtgtaaacgtcatctgaagtatc

SEQ ID NO: 549462 - DNA, 25 bp, Rattus norvegicus
caacgaccgtgtaaacgtcatctga

SEQ ID NO: 549463 - DNA, 25 bp, Rattus norvegicus
acctggcgctttgtcccaatcgttc

SEQ ID NO: 549464 - DNA, 25 bp, Rattus norvegicus
cgtcaagcagcggtttggaaacaac

SEQ ID NO: 549465 - DNA, 25 bp, Rattus norvegicus
tcccaatcgttcgtttgttcgctcg

SEQ ID NO: 549466 - DNA, 25 bp, Rattus norvegicus
cagcggtttggaaacaacgaccgtg

SEQ ID NO: 549467 - DNA, 25 bp, Rattus norvegicus
tgttgcttagctgccacctggcgct

SEQ ID NO: 549468 - DNA, 25 bp, Rattus norvegicus
gtggacgccagatccaggacagatc

SEQ ID NO: 549469 - DNA, 25 bp, Rattus norvegicus
cctgcgggctcagagttctcagcac

SEQ ID NO: 549470 - DNA, 25 bp, Rattus norvegicus
cttgtagaaggcgaactgcagcggc

SEQ ID NO: 549471 - DNA, 25 bp, Rattus norvegicus
cgcacaggccggctgtacttgtaga

SEQ ID NO: 549472 - DNA, 25 bp, Rattus norvegicus
gtggcagcctcacaccaataggatt

SEQ ID NO: 549473 - DNA, 25 bp, Rattus norvegicus
aggcaacaagcctggtcacccgtga

SEQ ID NO: 549474 - DNA, 25 bp, Rattus norvegicus
aaggcctttgagcagctgcatctcg

SEQ ID NO: 549475 - DNA, 25 bp, Rattus norvegicus
gatctcgacactggggtcttccgga

SEQ ID NO: 549476 - DNA, 25 bp, Rattus norvegicus
tgcagccctgtaaacgtgctgtttg

SEQ ID NO: 549477 - DNA, 25 bp, Rattus norvegicus
agcttcgcgcgacagatccgtggac

SEQ ID NO: 549478 - DNA, 25 bp, Rattus norvegicus
tccactttgggctgtagagcttcgc

SEQ ID NO: 549479 - DNA, 25 bp, Rattus norvegicus
ctcagcaccggcgtctggaacagct

SEQ ID NO: 549480 - DNA, 25 bp, Rattus norvegicus
tctcgcgaagcagaaggtccacttt

SEQ ID NO: 549481 - DNA, 25 bp, Rattus norvegicus
agggtactcgctatgctgaactgtc

SEQ ID NO: 549482 - DNA, 25 bp, Rattus norvegicus
aacgcacagcgcctgcaggcagctc

SEQ ID NO: 549483 - DNA, 25 bp, Rattus norvegicus
ctgttcactccctgacgttctcaaa

SEQ ID NO: 549484 - DNA, 25 bp, Rattus norvegicus
cgttaatagatcctctgcggcctga

SEQ ID NO: 549485 - DNA, 25 bp, Rattus norvegicus
ctccctgacgttctcaaatccagga

SEQ ID NO: 549486 - DNA, 25 bp, Rattus norvegicus
caaatccaggatccgcaaacgcaca

SEQ ID NO: 549487 - DNA, 25 bp, Rattus norvegicus
aggatccgcaaacgcacagcgcctg

SEQ ID NO: 549488 - DNA, 25 bp, Rattus norvegicus
atttcctccgctttcaccctgttca

SEQ ID NO: 549489 - DNA, 25 bp, Rattus norvegicus
gcaggcagctcccaaagtccaccgg

SEQ ID NO: 549490 - DNA, 25 bp, Rattus norvegicus
cagttcggtaagacgacttaggacg

SEQ ID NO: 549491 - DNA, 25 bp, Rattus norvegicus
tggggaagagaattggtcgttaata

SEQ ID NO: 549492 - DNA, 25 bp, Rattus norvegicus
ttggtcgttaatagatcctctgcgg

SEQ ID NO: 549493 - DNA, 25 bp, Rattus norvegicus
gcctgacacggaccctcggaaagga

SEQ ID NO: 549494 - DNA, 25 bp, Rattus norvegicus
tgcggcctgacacggaccctcggaa

SEQ ID NO: 549495 - DNA, 25 bp, Rattus norvegicus
atccaggatccgcaaacgcacagcg

SEQ ID NO: 549496 - DNA, 25 bp, Rattus norvegicus
gcaagggtctccacccggctttgca

SEQ ID NO: 549497 - DNA, 25 bp, Rattus norvegicus
gtcggtgaaggccatgtaactgtca

SEQ ID NO: 549498 - DNA, 25 bp, Rattus norvegicus
aacaccgcgtggagcgcgttcagga

SEQ ID NO: 549499 - DNA, 25 bp, Rattus norvegicus
cttccctaggggcagacgtggcttt

SEQ ID NO: 549500 - DNA, 25 bp, Rattus norvegicus
tgtaactgtcatggtgcatttgccc

SEQ ID NO: 549501 - DNA, 25 bp, Rattus norvegicus
cccggtcattggcaagggtctccac

SEQ ID NO: 549502 - DNA, 25 bp, Rattus norvegicus
gctgctcagccctgctgtcctggtt

SEQ ID NO: 549503 - DNA, 25 bp, Rattus norvegicus
ttttattcgatcgtgagggtcccgc

SEQ ID NO: 549504 - DNA, 25 bp, Rattus norvegicus
cccacgttgaaagaggattcggagc

SEQ ID NO: 549505 - DNA, 25 bp, Rattus norvegicus
tttggcttctcgctcccacgttgaa

SEQ ID NO: 549506 - DNA, 25 bp, Rattus norvegicus
tcgaggcggaaagccacttccctag

SEQ ID NO: 549507 - DNA, 25 bp, Rattus norvegicus
tatgaggacttggtgcccagatcga

SEQ ID NO: 549508 - DNA, 25 bp, Rattus norvegicus
ctttgcacgcccaggtatgaggact

SEQ ID NO: 549509 - DNA, 25 bp, Rattus norvegicus
ctgcgctgactctggcagaagattc

SEQ ID NO: 549510 - DNA, 25 bp, Rattus norvegicus
ggatgcccttagactctggtgcctc

SEQ ID NO: 549511 - DNA, 25 bp, Rattus norvegicus
gggacacctgctggcgaaggcttgc

SEQ ID NO: 549512 - DNA, 25 bp, Rattus norvegicus
cttagactctggtgcctcccggtgc

SEQ ID NO: 549513 - DNA, 25 bp, Rattus norvegicus
gatgcccttagactctggtgcctcc

SEQ ID NO: 549514 - DNA, 25 bp, Rattus norvegicus
tgcccttagactctggtgcctcccg

SEQ ID NO: 549515 - DNA, 25 bp, Rattus norvegicus
ccttagactctggtgcctcccggtg

SEQ ID NO: 549516 - DNA, 25 bp, Rattus norvegicus
ccctgttgggacacctgctggcgaa

SEQ ID NO: 549517 - DNA, 25 bp, Rattus norvegicus
ttgggacacctgctggcgaaggctt

SEQ ID NO: 549518 - DNA, 25 bp, Rattus norvegicus
cccggatgcccttagactctggtgc

SEQ ID NO: 549519 - DNA, 25 bp, Rattus norvegicus
tcccggatgcccttagactctggtg

SEQ ID NO: 549520 - DNA, 25 bp, Rattus norvegicus
cggatgcccttagactctggtgcct

SEQ ID NO: 549521 - DNA, 25 bp, Rattus norvegicus
ccggatgcccttagactctggtgcc

SEQ ID NO: 549522 - DNA, 25 bp, Rattus norvegicus
ttcccggatgcccttagactctggt

SEQ ID NO: 549523 - DNA, 25 bp, Rattus norvegicus
cctgttgggacacctgctggcgaag

SEQ ID NO: 549524 - DNA, 25 bp, Rattus norvegicus
gcgtacttggcacgcaggctatact

SEQ ID NO: 549525 - DNA, 25 bp, Rattus norvegicus
gcatctagtaatgccaggcgggtac

SEQ ID NO: 549526 - DNA, 25 bp, Rattus norvegicus
tggatgctgtggaaacgttgcactc

SEQ ID NO: 549527 - DNA, 25 bp, Rattus norvegicus
ggcagtgcacgctcaggagcatcta

SEQ ID NO: 549528 - DNA, 25 bp, Rattus norvegicus
ataggtaggcccgtcgctaccacgc

SEQ ID NO: 549529 - DNA, 25 bp, Rattus norvegicus
atagccatggccgtggttataggta

SEQ ID NO: 549530 - DNA, 25 bp, Rattus norvegicus
taggagtccgctgagctggcattgt

SEQ ID NO: 549531 - DNA, 25 bp, Rattus norvegicus
cgttgcactcgaggcagaacaaggg

SEQ ID NO: 549532 - DNA, 25 bp, Rattus norvegicus
gcagcggacctggattcatgttgtg

SEQ ID NO: 549533 - DNA, 25 bp, Rattus norvegicus
taaatgcaggccacgccgatcagtg

SEQ ID NO: 549534 - DNA, 25 bp, Rattus norvegicus
ctgccatctacgctggggtggctct

SEQ ID NO: 549535 - DNA, 25 bp, Rattus norvegicus
caggctatactgctgtgcgggtgtc

SEQ ID NO: 549536 - DNA, 25 bp, Rattus norvegicus
gtatgccaccaagaggcgaggcctc

SEQ ID NO: 549537 - DNA, 25 bp, Rattus norvegicus
aggagccgcacctacatagccatgg

SEQ ID NO: 549538 - DNA, 25 bp, Rattus norvegicus
ccatcactacatttagtggcaatcc

SEQ ID NO: 549539 - DNA, 25 bp, Rattus norvegicus
tttagtggcaatccctgactggtcc

SEQ ID NO: 549540 - DNA, 25 bp, Rattus norvegicus
atttagtggcaatccctgactggtc

SEQ ID NO: 549541 - DNA, 25 bp, Rattus norvegicus
catttagtggcaatccctgactggt

SEQ ID NO: 549542 - DNA, 25 bp, Rattus norvegicus
acatttagtggcaatccctgactgg

SEQ ID NO: 549543 - DNA, 25 bp, Rattus norvegicus
tacatttagtggcaatccctgactg

SEQ ID NO: 549544 - DNA, 25 bp, Rattus norvegicus
cactacatttagtggcaatccctga

SEQ ID NO: 549545 - DNA, 25 bp, Rattus norvegicus
attccaggacgcctgcgcaggagtg

SEQ ID NO: 549546 - DNA, 25 bp, Rattus norvegicus
catcactacatttagtggcaatccc

SEQ ID NO: 549547 - DNA, 25 bp, Rattus norvegicus
tagtggcaatccctgactggtccgg

SEQ ID NO: 549548 - DNA, 25 bp, Rattus norvegicus
actacatttagtggcaatccctgac

SEQ ID NO: 549549 - DNA, 25 bp, Rattus norvegicus
ttccaggacgcctgcgcaggagtgt

SEQ ID NO: 549550 - DNA, 25 bp, Rattus norvegicus
atcactacatttagtggcaatccct

SEQ ID NO: 549551 - DNA, 25 bp, Rattus norvegicus
tcactacatttagtggcaatccctg

SEQ ID NO: 549552 - DNA, 25 bp, Rattus norvegicus
cccttcaggtggcagaagtgggctg

SEQ ID NO: 549553 - DNA, 25 bp, Rattus norvegicus
aggatctgctggcactctcacaagg

SEQ ID NO: 549554 - DNA, 25 bp, Rattus norvegicus
ccaggatctgctggcactctcacaa

SEQ ID NO: 549555 - DNA, 25 bp, Rattus norvegicus
gtccggataagcattgtctgggctg

SEQ ID NO: 549556 - DNA, 25 bp, Rattus norvegicus
tccggtccggataagcattgtctgg

SEQ ID NO: 549557 - DNA, 25 bp, Rattus norvegicus
gcagaagtgggctggagtccggtcc

SEQ ID NO: 549558 - DNA, 25 bp, Rattus norvegicus
gatctgctggcactctcacaaggct

SEQ ID NO: 549559 - DNA, 25 bp, Rattus norvegicus
cttagactctggtgcctcccggtgc

SEQ ID NO: 549560 - DNA, 25 bp, Rattus norvegicus
gatgcccttagactctggtgcctcc

SEQ ID NO: 549561 - DNA, 25 bp, Rattus norvegicus
ccggatgcccttagactctggtgcc

SEQ ID NO: 549562 - DNA, 25 bp, Rattus norvegicus
ttcccggatgcccttagactctggt

SEQ ID NO: 549563 - DNA, 25 bp, Rattus norvegicus
ttgggacacctgctggcgaaggctt

SEQ ID NO: 549564 - DNA, 25 bp, Rattus norvegicus
ccctgttgggacacctgctggcgaa

SEQ ID NO: 549565 - DNA, 25 bp, Rattus norvegicus
agtccggtccggataagcattgtct

SEQ ID NO: 549566 - DNA, 25 bp, Rattus norvegicus
gaaagccgccgttggacaaggccgc

SEQ ID NO: 549567 - DNA, 25 bp, Rattus norvegicus
gtggagcttagctctttgagcctcc

SEQ ID NO: 549568 - DNA, 25 bp, Rattus norvegicus
ctgggagcccaagaaagccgccgtt

SEQ ID NO: 549569 - DNA, 25 bp, Rattus norvegicus
ttaccttcctcgctgaagggcgctg

SEQ ID NO: 549570 - DNA, 25 bp, Rattus norvegicus
ggcttctgtagcctcattaccttcc

SEQ ID NO: 549571 - DNA, 25 bp, Rattus norvegicus
tgtacaccgcagctcgggcaaagcc

SEQ ID NO: 549572 - DNA, 25 bp, Rattus norvegicus
gatccgggcgagactgtacaccgca

SEQ ID NO: 549573 - DNA, 25 bp, Rattus norvegicus
gtcgcaacgcgccacaggaagatgg

SEQ ID NO: 549574 - DNA, 25 bp, Rattus norvegicus
atggcggatttacgaccatgtcgtc

SEQ ID NO: 549575 - DNA, 25 bp, Rattus norvegicus
tgtcgtcataacaacgggccgcacc

SEQ ID NO: 549576 - DNA, 25 bp, Rattus norvegicus
cgcaccgagggctgcgtgtcctaca

SEQ ID NO: 549577 - DNA, 25 bp, Rattus norvegicus
caagaacgagtttgatggacaggta

SEQ ID NO: 549578 - DNA, 25 bp, Rattus norvegicus
tttgagcctccagcgcgggacttca

SEQ ID NO: 549579 - DNA, 25 bp, Rattus norvegicus
ttctgccgtatgagcggccgtcacc

SEQ ID NO: 549580 - DNA, 25 bp, Rattus norvegicus
actccgccaacaggcgcatgctagt

SEQ ID NO: 549581 - DNA, 25 bp, Rattus norvegicus
gactccgccaacaggcgcatgctag

SEQ ID NO: 549582 - DNA, 25 bp, Rattus norvegicus
agactccgccaacaggcgcatgcta

SEQ ID NO: 549583 - DNA, 25 bp, Rattus norvegicus
accgcacagactccgccaacaggcg

SEQ ID NO: 549584 - DNA, 25 bp, Rattus norvegicus
taccgcacagactccgccaacaggc

SEQ ID NO: 549585 - DNA, 25 bp, Rattus norvegicus
ccctaccgcacagactccgccaaca

SEQ ID NO: 549586 - DNA, 25 bp, Rattus norvegicus
ccatcactacattcagtggccatcg

SEQ ID NO: 549587 - DNA, 25 bp, Rattus norvegicus
gaccctaccgcacagactccgccaa

SEQ ID NO: 549588 - DNA, 25 bp, Rattus norvegicus
ggaccctaccgcacagactccgcca

SEQ ID NO: 549589 - DNA, 25 bp, Rattus norvegicus
tcactacattcagtggccatcgctg

SEQ ID NO: 549590 - DNA, 25 bp, Rattus norvegicus
atcactacattcagtggccatcgct

SEQ ID NO: 549591 - DNA, 25 bp, Rattus norvegicus
catcactacattcagtggccatcgc

SEQ ID NO: 549592 - DNA, 25 bp, Rattus norvegicus
cctaccgcacagactccgccaacag

SEQ ID NO: 549593 - DNA, 25 bp, Rattus norvegicus
ctaccgcacagactccgccaacagg

SEQ ID NO: 549594 - DNA, 25 bp, Rattus norvegicus
atgcccgcagcttgagcacccagag

SEQ ID NO: 549595 - DNA, 25 bp, Rattus norvegicus
ccgtccggtcaaggctgcttgttcc

SEQ ID NO: 549596 - DNA, 25 bp, Rattus norvegicus
ctcctgtctcttggttgctgcaatc

SEQ ID NO: 549597 - DNA, 25 bp, Rattus norvegicus
ccaacttcggtttcctggtgcgagg

SEQ ID NO: 549598 - DNA, 25 bp, Rattus norvegicus
ggtgctggcccagttggcagaaaaa

SEQ ID NO: 549599 - DNA, 25 bp, Rattus norvegicus
gagaggctttgtgggtcttgactcc

SEQ ID NO: 549600 - DNA, 25 bp, Rattus norvegicus
tcttgactccgtgtgggacttggtt

SEQ ID NO: 549601 - DNA, 25 bp, Rattus norvegicus
cgacagagactgtgtgcgcactccg

SEQ ID NO: 549602 - DNA, 25 bp, Rattus norvegicus
cggcccatcttcgacgcaggcaaga

SEQ ID NO: 549603 - DNA, 25 bp, Rattus norvegicus
tgaccagctcttgttctgcactgca

SEQ ID NO: 549604 - DNA, 25 bp, Rattus norvegicus
tgccgagtggctgcggttatcactt

SEQ ID NO: 549605 - DNA, 25 bp, Rattus norvegicus
tggcacacatctcacccagggagtc

SEQ ID NO: 549606 - DNA, 25 bp, Rattus norvegicus
cagagcacggttgagttcgtcggac

SEQ ID NO: 549607 - DNA, 25 bp, Rattus norvegicus
agaggcgttcagatctgcacccgaa

SEQ ID NO: 549608 - DNA, 25 bp, Rattus norvegicus
acacctaagacctggactcctcaaa

SEQ ID NO: 549609 - DNA, 25 bp, Rattus norvegicus
catgcctctgtgttgaggccgtcga

SEQ ID NO: 549610 - DNA, 25 bp, Rattus norvegicus
cttttcctccgcctctcaagggaga

SEQ ID NO: 549611 - DNA, 25 bp, Rattus norvegicus
tgtacacacaacagacacaaacagg

SEQ ID NO: 549612 - DNA, 25 bp, Rattus norvegicus
ggacgttctgacacagctctccggc

SEQ ID NO: 549613 - DNA, 25 bp, Rattus norvegicus
cagtcagtggattccagccgaggca

SEQ ID NO: 549614 - DNA, 25 bp, Rattus norvegicus
cacggtgcccatgcctctgtgttga

SEQ ID NO: 549615 - DNA, 25 bp, Rattus norvegicus
aggccgtcgaggcttctgctctaca

SEQ ID NO: 549616 - DNA, 25 bp, Rattus norvegicus
ggcttctgctctacagctggccttc

SEQ ID NO: 549617 - DNA, 25 bp, Rattus norvegicus
gtagtctggggactccgagttccaa

SEQ ID NO: 549618 - DNA, 25 bp, Rattus norvegicus
gagttccaacccaccacacctaaga

SEQ ID NO: 549619 - DNA, 25 bp, Rattus norvegicus
tggactcctcaaagggcccggtgcc

SEQ ID NO: 549620 - DNA, 25 bp, Rattus norvegicus
gacacaaacaggtaggagcgcgcca

SEQ ID NO: 549621 - DNA, 25 bp, Rattus norvegicus
tctcaagggagacacccacggtgcc

SEQ ID NO: 549622 - DNA, 25 bp, Rattus norvegicus
catctaagggagcttcggcgcaccc

SEQ ID NO: 549623 - DNA, 25 bp, Rattus norvegicus
atctcagccgaagctggccaggcta

SEQ ID NO: 549624 - DNA, 25 bp, Rattus norvegicus
agtgcttcgccaccaagagtaaggg

SEQ ID NO: 549625 - DNA, 25 bp, Rattus norvegicus
tcagtgtcacgatctcgattccggc

SEQ ID NO: 549626 - DNA, 25 bp, Rattus norvegicus
ccgctgctggaccagagcaataatc

SEQ ID NO: 549627 - DNA, 25 bp, Rattus norvegicus
cctccttaagtcttgccgctgctgg

SEQ ID NO: 549628 - DNA, 25 bp, Rattus norvegicus
gaagaagcactatccctcaagtgga

SEQ ID NO: 549629 - DNA, 25 bp, Rattus norvegicus
ccaaacagttcaggctccgagcggt

SEQ ID NO: 549630 - DNA, 25 bp, Rattus norvegicus
ggcctacccgagcaacccaagaaga

SEQ ID NO: 549631 - DNA, 25 bp, Rattus norvegicus
ctcctcctcgaagtctcattgatga

SEQ ID NO: 549632 - DNA, 25 bp, Rattus norvegicus
ctgcaatccatcagcgtctccggga

SEQ ID NO: 549633 - DNA, 25 bp, Rattus norvegicus
agccaatgcaactttaccgaggaga

SEQ ID NO: 549634 - DNA, 25 bp, Rattus norvegicus
agttgcaagtttccaagtggccggc

SEQ ID NO: 549635 - DNA, 25 bp, Rattus norvegicus
aaagtttgcctctagcacgcaggtg

SEQ ID NO: 549636 - DNA, 25 bp, Rattus norvegicus
tgtcctctttgtcaaggggcgaaga

SEQ ID NO: 549637 - DNA, 25 bp, Rattus norvegicus
ccgcgcaaactttctgtcctctttg

SEQ ID NO: 549638 - DNA, 25 bp, Rattus norvegicus
ctccgctgccttctatggctgtgtt

SEQ ID NO: 549639 - DNA, 25 bp, Rattus norvegicus
cttctatggctgtgtttgctgcggg

SEQ ID NO: 549640 - DNA, 25 bp, Rattus norvegicus
gccgagccgccgttttattgcgctc

SEQ ID NO: 549641 - DNA, 25 bp, Rattus norvegicus
ttattgcgctccgaggatcctctgc

SEQ ID NO: 549642 - DNA, 25 bp, Rattus norvegicus
tgctcctcctctcggtggctgacgg

SEQ ID NO: 549643 - DNA, 25 bp, Rattus norvegicus
cccggcttttgttgtgtgcccagcc

SEQ ID NO: 549644 - DNA, 25 bp, Rattus norvegicus
cagcctggcacaggctgcgggcttc

SEQ ID NO: 549645 - DNA, 25 bp, Rattus norvegicus
ccacgcgcgctgtgtacctgattgc

SEQ ID NO: 549646 - DNA, 25 bp, Rattus norvegicus
caaaacgcctgttgcgggtgcaccg

SEQ ID NO: 549647 - DNA, 25 bp, Rattus norvegicus
gggtggcacccacacacttctggtt

SEQ ID NO: 549648 - DNA, 25 bp, Rattus norvegicus
cgtctgcattgcaaaacgcctgttg

SEQ ID NO: 549649 - DNA, 25 bp, Rattus norvegicus
gaacccggctgcttacctacgtctg

SEQ ID NO: 549650 - DNA, 25 bp, Rattus norvegicus
tcaggcgtgagtcaccgtaaaaggg

SEQ ID NO: 549651 - DNA, 25 bp, Rattus norvegicus
ggacgcagcctgttcggccttgtcc

SEQ ID NO: 549652 - DNA, 25 bp, Rattus norvegicus
acagtgggaccggatgtgactctcg

SEQ ID NO: 549653 - DNA, 25 bp, Rattus norvegicus
ctcatttctggacagtgggaccgga

SEQ ID NO: 549654 - DNA, 25 bp, Rattus norvegicus
ctgagctcatttctggacagtggga

SEQ ID NO: 549655 - DNA, 25 bp, Rattus norvegicus
gttgcgcgctgagctcatttctgga

SEQ ID NO: 549656 - DNA, 25 bp, Rattus norvegicus
gggtaatcaggcgtgagtcaccgta

SEQ ID NO: 549657 - DNA, 25 bp, Rattus norvegicus
tccgggtaatcaggcgtgagtcacc

SEQ ID NO: 549658 - DNA, 25 bp, Rattus norvegicus
ctttccgggtaatcaggcgtgagtc

SEQ ID NO: 549659 - DNA, 25 bp, Rattus norvegicus
cccagtagagctttccgggtaatca

SEQ ID NO: 549660 - DNA, 25 bp, Rattus norvegicus
cacggtcccagtagagctttccggg

SEQ ID NO: 549661 - DNA, 25 bp, Rattus norvegicus
gtcccacggtcccagtagagctttc

SEQ ID NO: 549662 - DNA, 25 bp, Rattus norvegicus
atttctggacagtgggaccggatgt

SEQ ID NO: 549663 - DNA, 25 bp, Rattus norvegicus
cgcgctgagctcatttctggacagt

SEQ ID NO: 549664 - DNA, 25 bp, Rattus norvegicus
gcagacgccagtgctgtatgccatg

SEQ ID NO: 549665 - DNA, 25 bp, Rattus norvegicus
gcccaaggctgacgtgtgcaatccc

SEQ ID NO: 549666 - DNA, 25 bp, Rattus norvegicus
aacgctgggtagtccgggacagctg

SEQ ID NO: 549667 - DNA, 25 bp, Rattus norvegicus
ggacgggtggacatgatcaagccca

SEQ ID NO: 549668 - DNA, 25 bp, Rattus norvegicus
tggacatgatcaagcccaaggctga

SEQ ID NO: 549669 - DNA, 25 bp, Rattus norvegicus
caaggataagaaatagcggttagcg

SEQ ID NO: 549670 - DNA, 25 bp, Rattus norvegicus
tgtatgccatgctggaccacagccg

SEQ ID NO: 549671 - DNA, 25 bp, Rattus norvegicus
agccgaagcaccaaagctgccagtg

SEQ ID NO: 549672 - DNA, 25 bp, Rattus norvegicus
cgaagcaccaaagctgccagtgaga

SEQ ID NO: 549673 - DNA, 25 bp, Rattus norvegicus
gctgccagtgagaagaaatctaaag

SEQ ID NO: 549674 - DNA, 25 bp, Rattus norvegicus
ccagtgagaagaaatctaaagggct

SEQ ID NO: 549675 - DNA, 25 bp, Rattus norvegicus
gggagtctcgcaaggataagaaata

SEQ ID NO: 549676 - DNA, 25 bp, Rattus norvegicus
gtgctgtatgccatgctggaccaca

SEQ ID NO: 549677 - DNA, 25 bp, Rattus norvegicus
aagcccaaggctgacgtgtgcaatc

SEQ ID NO: 549678 - DNA, 25 bp, Rattus norvegicus
caggtgaggcaaaggggtcttggga

SEQ ID NO: 549679 - DNA, 25 bp, Rattus norvegicus
gacctggagcggcagccttctctcc

SEQ ID NO: 549680 - DNA, 25 bp, Rattus norvegicus
ggggtgtgctgagtggcaccactca

SEQ ID NO: 549681 - DNA, 25 bp, Rattus norvegicus
gtggcaccactcacctcgctcatcc

SEQ ID NO: 549682 - DNA, 25 bp, Rattus norvegicus
cgtggcaggcgcaggtgaggcaaag

SEQ ID NO: 549683 - DNA, 25 bp, Rattus norvegicus
cttgggagatgcgtgcgtggactac

SEQ ID NO: 549684 - DNA, 25 bp, Rattus norvegicus
cgtgcgtggactacggccgagagtt

SEQ ID NO: 549685 - DNA, 25 bp, Rattus norvegicus
ggactacggccgagagttgctgggc

SEQ ID NO: 549686 - DNA, 25 bp, Rattus norvegicus
ctccggggcagaggccctagcggtc

SEQ ID NO: 549687 - DNA, 25 bp, Rattus norvegicus
agagtgcacggcacgagctgctgct

SEQ ID NO: 549688 - DNA, 25 bp, Rattus norvegicus
ggccctagcggtcttggaggggaga

SEQ ID NO: 549689 - DNA, 25 bp, Rattus norvegicus
tgcacggcacgagctgctgcttcgt

SEQ ID NO: 549690 - DNA, 25 bp, Rattus norvegicus
gcacgagctgctgcttcgtgctgcc

SEQ ID NO: 549691 - DNA, 25 bp, Rattus norvegicus
tcatcccggcggcaggacggggcgt

SEQ ID NO: 549692 - DNA, 25 bp, Rattus norvegicus
aagatggcggcagcgatgcttgccc

SEQ ID NO: 549693 - DNA, 25 bp, Rattus norvegicus
gccaggctctgaccgaccacgccct

SEQ ID NO: 549694 - DNA, 25 bp, Rattus norvegicus
tcagattgagcacggacagggtctc

SEQ ID NO: 549695 - DNA, 25 bp, Rattus norvegicus
accacgcccttccaggtgagccggc

SEQ ID NO: 549696 - DNA, 25 bp, Rattus norvegicus
tttgaggagaatggggttctaatcc

SEQ ID NO: 549697 - DNA, 25 bp, Rattus norvegicus
cacattgcatggtaggggcaagcac

SEQ ID NO: 549698 - DNA, 25 bp, Rattus norvegicus
tgccttcacattgcatggtaggggc

SEQ ID NO: 549699 - DNA, 25 bp, Rattus norvegicus
gggccgattgccttcacattgcatg

SEQ ID NO: 549700 - DNA, 25 bp, Rattus norvegicus
agttctgcgtcaaggctaaaaaatc

SEQ ID NO: 549701 - DNA, 25 bp, Rattus norvegicus
gagaagaagttctgcgtcaaggcta

SEQ ID NO: 549702 - DNA, 25 bp, Rattus norvegicus
agagagtcctcggagaaaggtttag

SEQ ID NO: 549703 - DNA, 25 bp, Rattus norvegicus
accacggagagagagtcctcggaga

SEQ ID NO: 549704 - DNA, 25 bp, Rattus norvegicus
tgacgacgggaagcagaccaggtat

SEQ ID NO: 549705 - DNA, 25 bp, Rattus norvegicus
gcgtcaaggctaaaaaatcagattg

SEQ ID NO: 549706 - DNA, 25 bp, Rattus norvegicus
ggccaggctgcagctttagccgcag

SEQ ID NO: 549707 - DNA, 25 bp, Rattus norvegicus
cgcggtccgagaatgctgttcttcc

SEQ ID NO: 549708 - DNA, 25 bp, Rattus norvegicus
atgctgttcttccagcccagttctc

SEQ ID NO: 549709 - DNA, 25 bp, Rattus norvegicus
agcctctccctttgtggtgaacgtc

SEQ ID NO: 549710 - DNA, 25 bp, Rattus norvegicus
ctccctttgtggtgaacgtcctttg

SEQ ID NO: 549711 - DNA, 25 bp, Rattus norvegicus
acgtcctttggggtctggatccatc

SEQ ID NO: 549712 - DNA, 25 bp, Rattus norvegicus
ggggtctggatccatcctccctcgg

SEQ ID NO: 549713 - DNA, 25 bp, Rattus norvegicus
ttagccgcagctgttgcccagcttg

SEQ ID NO: 549714 - DNA, 25 bp, Rattus norvegicus
cgccatctttgttggtgccgcccgg

SEQ ID NO: 549715 - DNA, 25 bp, Rattus norvegicus
atctttgttggtgccgcccggccac

SEQ ID NO: 549716 - DNA, 25 bp, Rattus norvegicus
ggccaccggcttcacagtctcttag

SEQ ID NO: 549717 - DNA, 25 bp, Rattus norvegicus
aactcctcggcgcttgcgtgaaccc

SEQ ID NO: 549718 - DNA, 25 bp, Rattus norvegicus
gcgcgcccacactcgaaatcctccc

SEQ ID NO: 549719 - DNA, 25 bp, Rattus norvegicus
tcacagtctcttaggcgcctgcgcg

SEQ ID NO: 549720 - DNA, 25 bp, Rattus norvegicus
gccaattcccgagcacacctgatta

SEQ ID NO: 549721 - DNA, 25 bp, Rattus norvegicus
tgcggaagtggagttacttgtaact

SEQ ID NO: 549722 - DNA, 25 bp, Rattus norvegicus
tgctacgccgtcaaccacaggagta

SEQ ID NO: 549723 - DNA, 25 bp, Rattus norvegicus
cacaggagtaaaactgacccggata

SEQ ID NO: 549724 - DNA, 25 bp, Rattus norvegicus
tgacccggataagggactgatattc

SEQ ID NO: 549725 - DNA, 25 bp, Rattus norvegicus
ctgatattcctcctttagtcgctgc

SEQ ID NO: 549726 - DNA, 25 bp, Rattus norvegicus
tcctttagtcgctgcacccacaatt

SEQ ID NO: 549727 - DNA, 25 bp, Rattus norvegicus
caattcccgatctcggggtccggcg

SEQ ID NO: 549728 - DNA, 25 bp, Rattus norvegicus
ggtccggcgttagtcttcagcaccg

SEQ ID NO: 549729 - DNA, 25 bp, Rattus norvegicus
ttcagcaccgggatctcagacacga

SEQ ID NO: 549730 - DNA, 25 bp, Rattus norvegicus
gatctcagacacgacccgccgggtg

SEQ ID NO: 549731 - DNA, 25 bp, Rattus norvegicus
ttggaccagggctcaagaaaattgc

SEQ ID NO: 549732 - DNA, 25 bp, Rattus norvegicus
tacttgtaacttactcacggcgtcg

SEQ ID NO: 549733 - DNA, 25 bp, Rattus norvegicus
aagcggcttccacccggagccaatt

SEQ ID NO: 549734 - DNA, 25 bp, Rattus norvegicus
gttatggtctcgaagccgacactaa

SEQ ID NO: 549735 - DNA, 25 bp, Rattus norvegicus
gcagcgcggatggatccaacatggc

SEQ ID NO: 549736 - DNA, 25 bp, Rattus norvegicus
agcagcgcggatggatccaacatgg

SEQ ID NO: 549737 - DNA, 25 bp, Rattus norvegicus
gagcagcgcggatggatccaacatg

SEQ ID NO: 549738 - DNA, 25 bp, Rattus norvegicus
agagcagcgcggatggatccaacat

SEQ ID NO: 549739 - DNA, 25 bp, Rattus norvegicus
atgcggcgcggtgagacaggcccgg

SEQ ID NO: 549740 - DNA, 25 bp, Rattus norvegicus
gtggcggctggagcccggatgcggc

SEQ ID NO: 549741 - DNA, 25 bp, Rattus norvegicus
ctgtgcaggatgcagccacccccgc

SEQ ID NO: 549742 - DNA, 25 bp, Rattus norvegicus
cagcgcggatggatccaacatggcg

SEQ ID NO: 549743 - DNA, 25 bp, Rattus norvegicus
cgaagccgacactaaccgaccaggt

SEQ ID NO: 549744 - DNA, 25 bp, Rattus norvegicus
tcgaagccgacactaaccgaccagg

SEQ ID NO: 549745 - DNA, 25 bp, Rattus norvegicus
ggtctcgaagccgacactaaccgac

SEQ ID NO: 549746 - DNA, 25 bp, Rattus norvegicus
tatggtctcgaagccgacactaacc

SEQ ID NO: 549747 - DNA, 25 bp, Rattus norvegicus
aacatggcggcgccgaacctgagcc

SEQ ID NO: 549748 - DNA, 25 bp, Rattus norvegicus
gcaggccggaaagcttgcaggtggg

SEQ ID NO: 549749 - DNA, 25 bp, Rattus norvegicus
agcaagtgggcggtaaccactagag

SEQ ID NO: 549750 - DNA, 25 bp, Rattus norvegicus
aaccgcgagcgtagaaggcacctgg

SEQ ID NO: 549751 - DNA, 25 bp, Rattus norvegicus
ggaaccgcgagcgtagaaggcacct

SEQ ID NO: 549752 - DNA, 25 bp, Rattus norvegicus
tcggcggaacaggtgaggaaccgcg

SEQ ID NO: 549753 - DNA, 25 bp, Rattus norvegicus
acagcagcggtcgtgtgggcaagag

SEQ ID NO: 549754 - DNA, 25 bp, Rattus norvegicus
gaagatggcggacagcagcggtcgt

SEQ ID NO: 549755 - DNA, 25 bp, Rattus norvegicus
aaagcttgcaggtggggaagatggc

SEQ ID NO: 549756 - DNA, 25 bp, Rattus norvegicus
tgacgcagtgggagtgcgcaggccg

SEQ ID NO: 549757 - DNA, 25 bp, Rattus norvegicus
ccactagagcggatgtgacgcagtg

SEQ ID NO: 549758 - DNA, 25 bp, Rattus norvegicus
gtaaccactagagcggatgtgacgc

SEQ ID NO: 549759 - DNA, 25 bp, Rattus norvegicus
aaggcacctgggtcggtgtcgagtt

SEQ ID NO: 549760 - DNA, 25 bp, Rattus norvegicus
caagtgggcggtaaccactagagcg

SEQ ID NO: 549761 - DNA, 25 bp, Rattus norvegicus
gcggtaaccactagagcggatgtga

SEQ ID NO: 549762 - DNA, 25 bp, Rattus norvegicus
actccactcgaagtgtccagcgcag

SEQ ID NO: 549763 - DNA, 25 bp, Rattus norvegicus
gggcaaagtcgcagtaccaataagt

SEQ ID NO: 549764 - DNA, 25 bp, Rattus norvegicus
caataagttcgggtgctgtggtcca

SEQ ID NO: 549765 - DNA, 25 bp, Rattus norvegicus
ctgtggtccaactttaacgtgtaga

SEQ ID NO: 549766 - DNA, 25 bp, Rattus norvegicus
ccaccagtgccgcatcgtggtggct

SEQ ID NO: 549767 - DNA, 25 bp, Rattus norvegicus
gataagcgacgtgacccgtcccagc

SEQ ID NO: 549768 - DNA, 25 bp, Rattus norvegicus
tcgaagtgtccagcgcagccaccgt

SEQ ID NO: 549769 - DNA, 25 bp, Rattus norvegicus
agttggcaggcttcgcggtccatac

SEQ ID NO: 549770 - DNA, 25 bp, Rattus norvegicus
actctcggtctgagattcgggtgca

SEQ ID NO: 549771 - DNA, 25 bp, Rattus norvegicus
tgccagatacccgaaactctcggtc

SEQ ID NO: 549772 - DNA, 25 bp, Rattus norvegicus
gctgagtgcgggtaccaccctctct

SEQ ID NO: 549773 - DNA, 25 bp, Rattus norvegicus
tgctaccgtagcgtcgctgagtgcg

SEQ ID NO: 549774 - DNA, 25 bp, Rattus norvegicus
aacgtgtagatgctaccgtagcgtc

SEQ ID NO: 549775 - DNA, 25 bp, Rattus norvegicus
cagccaccgtggataagcgacgtga

SEQ ID NO: 549776 - DNA, 25 bp, Rattus norvegicus
gctagatttttctcaggcaaggcca

SEQ ID NO: 549777 - DNA, 25 bp, Rattus norvegicus
cctactactagttggtgggcctgga

SEQ ID NO: 549778 - DNA, 25 bp, Rattus norvegicus
gtgttcagctgcgagcctcaggcct

SEQ ID NO: 549779 - DNA, 25 bp, Rattus norvegicus
gccgtgcctggctctttatctcctg

SEQ ID NO: 549780 - DNA, 25 bp, Rattus norvegicus
atctcctgccctgctttgtgggcca

SEQ ID NO: 549781 - DNA, 25 bp, Rattus norvegicus
gacgttcccaacgatactgtttctc

SEQ ID NO: 549782 - DNA, 25 bp, Rattus norvegicus
tagatccaaagacggagaacgctgc

SEQ ID NO: 549783 - DNA, 25 bp, Rattus norvegicus
ctcgttctcaggcaaggtcccggcg

SEQ ID NO: 549784 - DNA, 25 bp, Rattus norvegicus
gactgcgcatgagcagctgtctatg

SEQ ID NO: 549785 - DNA, 25 bp, Rattus norvegicus
cctcaccaatatggccgcaggctgg

SEQ ID NO: 549786 - DNA, 25 bp, Rattus norvegicus
aagtgaacggaagtgcggcagctct

SEQ ID NO: 549787 - DNA, 25 bp, Rattus norvegicus
ggttctagaccgcatcaagtttgaa

SEQ ID NO: 549788 - DNA, 25 bp, Rattus norvegicus
tcacatctccaggtcggttctagac

SEQ ID NO: 549789 - DNA, 25 bp, Rattus norvegicus
actgtttctcttctgagcccgtatc

SEQ ID NO: 549790 - DNA, 25 bp, Rattus norvegicus
tgtcttccttcttacccttacctgc

SEQ ID NO: 549791 - DNA, 25 bp, Rattus norvegicus
cgcggggcggatgggaatcgtagtt

SEQ ID NO: 549792 - DNA, 25 bp, Rattus norvegicus
tctctgttcggcgcagcggccacgt

SEQ ID NO: 549793 - DNA, 25 bp, Rattus norvegicus
ctctgtgtcttccttcttaccctta

SEQ ID NO: 549794 - DNA, 25 bp, Rattus norvegicus
ttgctctgtgtcttccttcttaccc

SEQ ID NO: 549795 - DNA, 25 bp, Rattus norvegicus
cctttgctctgtgtcttccttctta

SEQ ID NO: 549796 - DNA, 25 bp, Rattus norvegicus
cagcctttgctctgtgtcttccttc

SEQ ID NO: 549797 - DNA, 25 bp, Rattus norvegicus
cctctgctctgcacccgcgtctctg

SEQ ID NO: 549798 - DNA, 25 bp, Rattus norvegicus
ggcagcctttgctctgtgtcttcct

SEQ ID NO: 549799 - DNA, 25 bp, Rattus norvegicus
ccggcagcctttgctctgtgtcttc

SEQ ID NO: 549800 - DNA, 25 bp, Rattus norvegicus
cgtcactcacccactgagagcctgg

SEQ ID NO: 549801 - DNA, 25 bp, Rattus norvegicus
tgccgcctacctgcgtagggccgga

SEQ ID NO: 549802 - DNA, 25 bp, Rattus norvegicus
cgcctacctgcgtagggccggacag

SEQ ID NO: 549803 - DNA, 25 bp, Rattus norvegicus
cacccgcgtctctgttcggcgcagc

SEQ ID NO: 549804 - DNA, 25 bp, Rattus norvegicus
aggctcgctcttgccgccatctgag

SEQ ID NO: 549805 - DNA, 25 bp, Rattus norvegicus
gcaagactggattcacgcgggccct

SEQ ID NO: 549806 - DNA, 25 bp, Rattus norvegicus
aagactggattcacgcgggccctcc

SEQ ID NO: 549807 - DNA, 25 bp, Rattus norvegicus
agactggattcacgcgggccctcct

SEQ ID NO: 549808 - DNA, 25 bp, Rattus norvegicus
ttcacgcgggccctcctcgcccgtg

SEQ ID NO: 549809 - DNA, 25 bp, Rattus norvegicus
tcctcgcccgtgcagctagtgcagg

SEQ ID NO: 549810 - DNA, 25 bp, Rattus norvegicus
tcgcccgtgcagctagtgcaggtgc

SEQ ID NO: 549811 - DNA, 25 bp, Rattus norvegicus
aaggctcgctcttgccgccatctga

SEQ ID NO: 549812 - DNA, 25 bp, Rattus norvegicus
gctcttgccgccatctgagagcacg

SEQ ID NO: 549813 - DNA, 25 bp, Rattus norvegicus
tcttgccgccatctgagagcacgct

SEQ ID NO: 549814 - DNA, 25 bp, Rattus norvegicus
cttgccgccatctgagagcacgctg

SEQ ID NO: 549815 - DNA, 25 bp, Rattus norvegicus
ttgccgccatctgagagcacgctgg

SEQ ID NO: 549816 - DNA, 25 bp, Rattus norvegicus
tgagagcacgctggcgacaaatgac

SEQ ID NO: 549817 - DNA, 25 bp, Rattus norvegicus
cccgtgcagctagtgcaggtgcccg

SEQ ID NO: 549818 - DNA, 25 bp, Rattus norvegicus
gaagagggcgattccctcgcgccga

SEQ ID NO: 549819 - DNA, 25 bp, Rattus norvegicus
actgttgtttctcttcacgtctatg

SEQ ID NO: 549820 - DNA, 25 bp, Rattus norvegicus
ttgaaactgtaatgggcaccgaggg

SEQ ID NO: 549821 - DNA, 25 bp, Rattus norvegicus
cgtcgcgtcgggattgaaactgtaa

SEQ ID NO: 549822 - DNA, 25 bp, Rattus norvegicus
aagctgttcccagcggagttgcggc

SEQ ID NO: 549823 - DNA, 25 bp, Rattus norvegicus
gcagtggatagcgaagctgttccca

SEQ ID NO: 549824 - DNA, 25 bp, Rattus norvegicus
tccagcccagcgcagtggatagcga

SEQ ID NO: 549825 - DNA, 25 bp, Rattus norvegicus
ggcttaacctggctgctagagtcca

SEQ ID NO: 549826 - DNA, 25 bp, Rattus norvegicus
ttcaccaatcggagcgccgggcagc

SEQ ID NO: 549827 - DNA, 25 bp, Rattus norvegicus
ttctcttcaccaatcggagcgccgg

SEQ ID NO: 549828 - DNA, 25 bp, Rattus norvegicus
tacggtgagtcactcctcggagctc

SEQ ID NO: 549829 - DNA, 25 bp, Rattus norvegicus
ggttgcacctgcgtacggtgagtca

SEQ ID NO: 549830 - DNA, 25 bp, Rattus norvegicus
cctgggtgagttcccagagttttgg

SEQ ID NO: 549831 - DNA, 25 bp, Rattus norvegicus
cacgtctatgatcctgggtgagttc

SEQ ID NO: 549832 - DNA, 25 bp, Rattus norvegicus
ccctcatgacagaagtaaaactcta

SEQ ID NO: 549833 - DNA, 25 bp, Rattus norvegicus
atgtgctacctttgtatttatttta

SEQ ID NO: 549834 - DNA, 25 bp, Rattus norvegicus
aaccgttccagtctacgttggctga

SEQ ID NO: 549835 - DNA, 25 bp, Rattus norvegicus
ctgtgatgtcctgtgccagcttgcc

SEQ ID NO: 549836 - DNA, 25 bp, Rattus norvegicus
gtaggctcagcactttgatgtgcta

SEQ ID NO: 549837 - DNA, 25 bp, Rattus norvegicus
cactttgatgtgctacctttgtatt

SEQ ID NO: 549838 - DNA, 25 bp, Rattus norvegicus
tattttaaacaattcaaccagcacc

SEQ ID NO: 549839 - DNA, 25 bp, Rattus norvegicus
gccttgacatacacagtgtaggctc

SEQ ID NO: 549840 - DNA, 25 bp, Rattus norvegicus
catgacagaagtaaaactctatttt

SEQ ID NO: 549841 - DNA, 25 bp, Rattus norvegicus
ccagtctacgttggctgagttcatg

SEQ ID NO: 549842 - DNA, 25 bp, Rattus norvegicus
tctacgttggctgagttcatgtcgt

SEQ ID NO: 549843 - DNA, 25 bp, Rattus norvegicus
gctgggagagtttggagagaaaccc

SEQ ID NO: 549844 - DNA, 25 bp, Rattus norvegicus
cctgtgtcagctgctgggagagttt

SEQ ID NO: 549845 - DNA, 25 bp, Rattus norvegicus
acacagtgtaggctcagcactttga

SEQ ID NO: 549846 - DNA, 25 bp, Rattus norvegicus
catgcagtgggaagggccttggccc

SEQ ID NO: 549847 - DNA, 25 bp, Rattus norvegicus
tagccctgtgcaagccaacatgacc

SEQ ID NO: 549848 - DNA, 25 bp, Rattus norvegicus
ccatagccctgtgcaagccaacatg

SEQ ID NO: 549849 - DNA, 25 bp, Rattus norvegicus
gagtctccggccctccctgccatag

SEQ ID NO: 549850 - DNA, 25 bp, Rattus norvegicus
gcacacagaggaggcgcgagtctcc

SEQ ID NO: 549851 - DNA, 25 bp, Rattus norvegicus
gcgatcaaatttgggtgctgcacac

SEQ ID NO: 549852 - DNA, 25 bp, Rattus norvegicus
cgctgcagcgatcaaatttgggtgc

SEQ ID NO: 549853 - DNA, 25 bp, Rattus norvegicus
acacgctgcagcgatcaaatttggg

SEQ ID NO: 549854 - DNA, 25 bp, Rattus norvegicus
tgggacacaacagcgggacacgctg

SEQ ID NO: 549855 - DNA, 25 bp, Rattus norvegicus
gcagtgggacacaacagcgggacac

SEQ ID NO: 549856 - DNA, 25 bp, Rattus norvegicus
ggatgcagcagtgggacacaacagc

SEQ ID NO: 549857 - DNA, 25 bp, Rattus norvegicus
cgcaaacaatgcggcgctgccagag

SEQ ID NO: 549858 - DNA, 25 bp, Rattus norvegicus
gtgaccagcccgcaaacaatgcggc

SEQ ID NO: 549859 - DNA, 25 bp, Rattus norvegicus
cagcggatgcagcagtgggacacaa

SEQ ID NO: 549860 - DNA, 25 bp, Rattus norvegicus
cggcaaactgaaccacgccctggta

SEQ ID NO: 549861 - DNA, 25 bp, Rattus norvegicus
catacctgaggtggccgacattata

SEQ ID NO: 549862 - DNA, 25 bp, Rattus norvegicus
ggaagtcccactttactgccgcgca

SEQ ID NO: 549863 - DNA, 25 bp, Rattus norvegicus
cgggtctcatctttgtcctacggaa

SEQ ID NO: 549864 - DNA, 25 bp, Rattus norvegicus
ccgacattatagaagcggctcgctc

SEQ ID NO: 549865 - DNA, 25 bp, Rattus norvegicus
tcgtaacacgaagactcggggcagt

SEQ ID NO: 549866 - DNA, 25 bp, Rattus norvegicus
tccaagatgcgcacgccgtagaaga

SEQ ID NO: 549867 - DNA, 25 bp, Rattus norvegicus
gtaaagcatccactagcgaaacggc

SEQ ID NO: 549868 - DNA, 25 bp, Rattus norvegicus
cggccagatagtgcacgaagagtaa

SEQ ID NO: 549869 - DNA, 25 bp, Rattus norvegicus
gctccagcagaactacggccagata

SEQ ID NO: 549870 - DNA, 25 bp, Rattus norvegicus
accttgagcgtgaactggggctgaa

SEQ ID NO: 549871 - DNA, 25 bp, Rattus norvegicus
atctgtggatcgcacgaccttgagc

SEQ ID NO: 549872 - DNA, 25 bp, Rattus norvegicus
aagcggctcgctccatctgtggatc

SEQ ID NO: 549873 - DNA, 25 bp, Rattus norvegicus
ggaagacaagcaccatgagcagagc

SEQ ID NO: 549874 - DNA, 25 bp, Rattus norvegicus
caagcaatcggggatcaggaatcag

SEQ ID NO: 549875 - DNA, 25 bp, Rattus norvegicus
tccgtcccagaccactcggctgttt

SEQ ID NO: 549876 - DNA, 25 bp, Rattus norvegicus
tcaggaatcagatctggagccggcg

SEQ ID NO: 549877 - DNA, 25 bp, Rattus norvegicus
cgctgctgcgtccattgtctgcggc

SEQ ID NO: 549878 - DNA, 25 bp, Rattus norvegicus
cccaggaccaagcaatcggggatca

SEQ ID NO: 549879 - DNA, 25 bp, Rattus norvegicus
tggcgggacccaggaccaagcaatc

SEQ ID NO: 549880 - DNA, 25 bp, Rattus norvegicus
agccctgcgcctagccatgccctgc

SEQ ID NO: 549881 - DNA, 25 bp, Rattus norvegicus
ctccagaaccggcagcgcgggcgat

SEQ ID NO: 549882 - DNA, 25 bp, Rattus norvegicus
tcgttccgaactccgcgctccagaa

SEQ ID NO: 549883 - DNA, 25 bp, Rattus norvegicus
gcagcgcaccgggtcgttccgaact

SEQ ID NO: 549884 - DNA, 25 bp, Rattus norvegicus
cctttgtatccgcagcgcaccgggt

SEQ ID NO: 549885 - DNA, 25 bp, Rattus norvegicus
gccgctgcgaaaagccgggtggact

SEQ ID NO: 549886 - DNA, 25 bp, Rattus norvegicus
tgcgtccattgtctgcggcccggct

SEQ ID NO: 549887 - DNA, 25 bp, Rattus norvegicus
tccgctccgcgcctttgtatccgca

SEQ ID NO: 549888 - DNA, 25 bp, Rattus norvegicus
gctaaagcccgactcggtctccgag

SEQ ID NO: 549889 - DNA, 25 bp, Rattus norvegicus
tggcgtgcgctgtgcggtacttggc

SEQ ID NO: 549890 - DNA, 25 bp, Rattus norvegicus
gcgccggcgcctgcgctcctcacgg

SEQ ID NO: 549891 - DNA, 25 bp, Rattus norvegicus
ctcacggctcaagtgctgcaggtct

SEQ ID NO: 549892 - DNA, 25 bp, Rattus norvegicus
aagcccgactcggtctccgagtgcg

SEQ ID NO: 549893 - DNA, 25 bp, Rattus norvegicus
ggcttccacgcggatgcgctcccgc

SEQ ID NO: 549894 - DNA, 25 bp, Rattus norvegicus
acagtcgctaaagcccgactcggtc

SEQ ID NO: 549895 - DNA, 25 bp, Rattus norvegicus
atccagcaccatccgggcccggccc

SEQ ID NO: 549896 - DNA, 25 bp, Rattus norvegicus
gatcgcccgatccagcaccatccgg

SEQ ID NO: 549897 - DNA, 25 bp, Rattus norvegicus
ggcccactcccggatcgcccgatcc

SEQ ID NO: 549898 - DNA, 25 bp, Rattus norvegicus
ctaagctccggacctggcccactcc

SEQ ID NO: 549899 - DNA, 25 bp, Rattus norvegicus
tccgagctctaagctccggacctgg

SEQ ID NO: 549900 - DNA, 25 bp, Rattus norvegicus
ctgcaggtctttgcggccggactct

SEQ ID NO: 549901 - DNA, 25 bp, Rattus norvegicus
gctcctcacggctcaagtgctgcag

SEQ ID NO: 549902 - DNA, 25 bp, Rattus norvegicus
ggtctctctaggcttccgctggcat

SEQ ID NO: 549903 - DNA, 25 bp, Rattus norvegicus
cgctggcatcgtctctgtggcccag

SEQ ID NO: 549904 - DNA, 25 bp, Rattus norvegicus
tgttccgcacggttcctcttaaaga

SEQ ID NO: 549905 - DNA, 25 bp, Rattus norvegicus
ctcttaaagatcagaggtccgggtg

SEQ ID NO: 549906 - DNA, 25 bp, Rattus norvegicus
tgacctcacctgctagtaccacgga

SEQ ID NO: 549907 - DNA, 25 bp, Rattus norvegicus
catcttgcctctccgctgggcggaa

SEQ ID NO: 549908 - DNA, 25 bp, Rattus norvegicus
ttccagtctcttagcggtctctcta

SEQ ID NO: 549909 - DNA, 25 bp, Rattus norvegicus
aaccggaagttcgtgtctgaggagc

SEQ ID NO: 549910 - DNA, 25 bp, Rattus norvegicus
ttgcacttgcgacgagctgttccgc

SEQ ID NO: 549911 - DNA, 25 bp, Rattus norvegicus
acgtggagcctttgggagtgcaacc

SEQ ID NO: 549912 - DNA, 25 bp, Rattus norvegicus
accagaagggcaacgcttgcacttg

SEQ ID NO: 549913 - DNA, 25 bp, Rattus norvegicus
ccaaattcgagaccaaaagcgcgcg

SEQ ID NO: 549914 - DNA, 25 bp, Rattus norvegicus
ggcctgaaggatgctaaccaaattc

SEQ ID NO: 549915 - DNA, 25 bp, Rattus norvegicus
cgggatccgctaatctgacctggga

SEQ ID NO: 549916 - DNA, 25 bp, Rattus norvegicus
gagcccagagctcgcgggaccgctc

SEQ ID NO: 549917 - DNA, 25 bp, Rattus norvegicus
ccaccaggagggttgggagcccaga

SEQ ID NO: 549918 - DNA, 25 bp, Rattus norvegicus
ctcgctgcttcggttggccttaggc

SEQ ID NO: 549919 - DNA, 25 bp, Rattus norvegicus
ggcctggaacagttggagcatccgc

SEQ ID NO: 549920 - DNA, 25 bp, Rattus norvegicus
cgtgcttgtaactgccccagccgga

SEQ ID NO: 549921 - DNA, 25 bp, Rattus norvegicus
tcgccagctcccgtgcttgtaactg

SEQ ID NO: 549922 - DNA, 25 bp, Rattus norvegicus
gaccgctctcgctcagtcgcctcca

SEQ ID NO: 549923 - DNA, 25 bp, Rattus norvegicus
gcctccagcacagcgtcgcaaaccc

SEQ ID NO: 549924 - DNA, 25 bp, Rattus norvegicus
cgccggaaagcgtgacggcgcaggc

SEQ ID NO: 549925 - DNA, 25 bp, Rattus norvegicus
ccgctggccagtgtaagatggcggc

SEQ ID NO: 549926 - DNA, 25 bp, Rattus norvegicus
agaaggatgaccctagatgggaagc

SEQ ID NO: 549927 - DNA, 25 bp, Rattus norvegicus
ccgctggcagaaggatgaccctaga

SEQ ID NO: 549928 - DNA, 25 bp, Rattus norvegicus
aacagttggagcatccgctggcaga

SEQ ID NO: 549929 - DNA, 25 bp, Rattus norvegicus
gctgcttcggttggccttaggctcc

SEQ ID NO: 549930 - DNA, 25 bp, Rattus norvegicus
actgctgttcagcacggaatgggcg

SEQ ID NO: 549931 - DNA, 25 bp, Rattus norvegicus
taagctgggcgtgagagtacccgaa

SEQ ID NO: 549932 - DNA, 25 bp, Rattus norvegicus
tgagttgagcctggacgcctgcaga

SEQ ID NO: 549933 - DNA, 25 bp, Rattus norvegicus
ctgcagaggcgagtccgaagctaaa

SEQ ID NO: 549934 - DNA, 25 bp, Rattus norvegicus
catcggactcccaaactgctgttca

SEQ ID NO: 549935 - DNA, 25 bp, Rattus norvegicus
aatgggcggatgaagccacgctgcc

SEQ ID NO: 549936 - DNA, 25 bp, Rattus norvegicus
tgcctgtagcacacccgtctctgga

SEQ ID NO: 549937 - DNA, 25 bp, Rattus norvegicus
gcacacccgtctctggaatcatcga

SEQ ID NO: 549938 - DNA, 25 bp, Rattus norvegicus
tggaatcatcgacagagacggaccc

SEQ ID NO: 549939 - DNA, 25 bp, Rattus norvegicus
cacagggcctgacaccgtggacctg

SEQ ID NO: 549940 - DNA, 25 bp, Rattus norvegicus
cgtggacctgtctgaattctcaagc

SEQ ID NO: 549941 - DNA, 25 bp, Rattus norvegicus
gggatcgtgaccctccaaacccaga

SEQ ID NO: 549942 - DNA, 25 bp, Rattus norvegicus
gcgggaagcaggctacatcctaatc

SEQ ID NO: 549943 - DNA, 25 bp, Rattus norvegicus
tgagagtacccgaaccagttgcccg

SEQ ID NO: 549944 - DNA, 25 bp, Rattus norvegicus
cagcgatagctaagcgatggaagga

SEQ ID NO: 549945 - DNA, 25 bp, Rattus norvegicus
cggggcttgcaagcttctatatata

SEQ ID NO: 549946 - DNA, 25 bp, Rattus norvegicus
ggcggggcttgcaagcttctatata

SEQ ID NO: 549947 - DNA, 25 bp, Rattus norvegicus
ctccgttacgcatgcgcatgggcgg

SEQ ID NO: 549948 - DNA, 25 bp, Rattus norvegicus
gggactccgttacgcatgcgcatgg

SEQ ID NO: 549949 - DNA, 25 bp, Rattus norvegicus
accgggactccgttacgcatgcgca

SEQ ID NO: 549950 - DNA, 25 bp, Rattus norvegicus
attggctacgttgcacggcgcgcga

SEQ ID NO: 549951 - DNA, 25 bp, Rattus norvegicus
tctatgattggctacgttgcacggc

SEQ ID NO: 549952 - DNA, 25 bp, Rattus norvegicus
tttcttcagcgatagctaagcgatg

SEQ ID NO: 549953 - DNA, 25 bp, Rattus norvegicus
gaaggaggcggcctggtagacgccc

SEQ ID NO: 549954 - DNA, 25 bp, Rattus norvegicus
atgattggctacgttgcacggcgcg

SEQ ID NO: 549955 - DNA, 25 bp, Rattus norvegicus
aagcttctatatataagaggcgccg

SEQ ID NO: 549956 - DNA, 25 bp, Rattus norvegicus
ccctacgcgttctatgattggctac

SEQ ID NO: 549957 - DNA, 25 bp, Rattus norvegicus
cgcgttctatgattggctacgttgc

SEQ ID NO: 549958 - DNA, 25 bp, Rattus norvegicus
cagtgacgagttcgacacctacatc

SEQ ID NO: 549959 - DNA, 25 bp, Rattus norvegicus
atcctgtatgcgcaggtgagcgacc

SEQ ID NO: 549960 - DNA, 25 bp, Rattus norvegicus
cgcaggtgagcgaccgcagcatcat

SEQ ID NO: 549961 - DNA, 25 bp, Rattus norvegicus
ggtgagcgaccgcagcatcatgcag

SEQ ID NO: 549962 - DNA, 25 bp, Rattus norvegicus
agtcagagcctgatgctggagctgc

SEQ ID NO: 549963 - DNA, 25 bp, Rattus norvegicus
gatgaggtatgggtgcgcctcttca

SEQ ID NO: 549964 - DNA, 25 bp, Rattus norvegicus
tgcgcctcttcaagggcgagcgtga

SEQ ID NO: 549965 - DNA, 25 bp, Rattus norvegicus
ggcgagcgtgagaacgccatcttca

SEQ ID NO: 549966 - DNA, 25 bp, Rattus norvegicus
agttcgacacctacatcaccttcag

SEQ ID NO: 549967 - DNA, 25 bp, Rattus norvegicus
gccatcttcagtgacgagttcgaca

SEQ ID NO: 549968 - DNA, 25 bp, Rattus norvegicus
agcggctacctggtcaagccggcct

SEQ ID NO: 549969 - DNA, 25 bp, Rattus norvegicus
aggaggtcgtgatcctgtatgcgca

SEQ ID NO: 549970 - DNA, 25 bp, Rattus norvegicus
accttcagcggctacctggtcaagc

SEQ ID NO: 549971 - DNA, 25 bp, Rattus norvegicus
gtgagaacgccatcttcagtgacga

SEQ ID NO: 549972 - DNA, 25 bp, Rattus norvegicus
accatcagggtcgaagtctagccta

SEQ ID NO: 549973 - DNA, 25 bp, Rattus norvegicus
tcgaagtctagcctaggcgacagcc

SEQ ID NO: 549974 - DNA, 25 bp, Rattus norvegicus
aagtctagcctaggcgacagcccgg

SEQ ID NO: 549975 - DNA, 25 bp, Rattus norvegicus
tctagcctaggcgacagcccggggc

SEQ ID NO: 549976 - DNA, 25 bp, Rattus norvegicus
gctttgcgcacccacgcttcactgc

SEQ ID NO: 549977 - DNA, 25 bp, Rattus norvegicus
tgctgctaatacttggtaagcgggg

SEQ ID NO: 549978 - DNA, 25 bp, Rattus norvegicus
acgcttcactgctccgctttttgtc

SEQ ID NO: 549979 - DNA, 25 bp, Rattus norvegicus
ccagaatcacctacgcagaatgggc

SEQ ID NO: 549980 - DNA, 25 bp, Rattus norvegicus
cacctacgcagaatgggcgtcccta

SEQ ID NO: 549981 - DNA, 25 bp, Rattus norvegicus
cctacgcagaatgggcgtccctagc

SEQ ID NO: 549982 - DNA, 25 bp, Rattus norvegicus
gtcaccatcagggtcgaagtctagc

SEQ ID NO: 549983 - DNA, 25 bp, Rattus norvegicus
cagggtcgaagtctagcctaggcga

SEQ ID NO: 549984 - DNA, 25 bp, Rattus norvegicus
ctgctaatacttggtaagcggggtg

SEQ ID NO: 549985 - DNA, 25 bp, Rattus norvegicus
cccacgccgctgagttcgctgctgc

SEQ ID NO: 549986 - DNA, 25 bp, Rattus norvegicus
tggttgtgcacatagccagagcggc

SEQ ID NO: 549987 - DNA, 25 bp, Rattus norvegicus
cagcggtcacgtgcgctagtctgga

SEQ ID NO: 549988 - DNA, 25 bp, Rattus norvegicus
tctgcctctgcagcagcggtcacgt

SEQ ID NO: 549989 - DNA, 25 bp, Rattus norvegicus
catgcccaaggcactttctcactgg

SEQ ID NO: 549990 - DNA, 25 bp, Rattus norvegicus
gcactttctcactggcgaaggattg

SEQ ID NO: 549991 - DNA, 25 bp, Rattus norvegicus
attggaggtgcagcttccgattggt

SEQ ID NO: 549992 - DNA, 25 bp, Rattus norvegicus
gctcacgactgctcaatgacaaatc

SEQ ID NO: 549993 - DNA, 25 bp, Rattus norvegicus
gcgagtctggttgtgcacatagcca

SEQ ID NO: 549994 - DNA, 25 bp, Rattus norvegicus
tgggacggctccctcaggtaaggat

SEQ ID NO: 549995 - DNA, 25 bp, Rattus norvegicus
tccctcaggtaaggatgctgtgccc

SEQ ID NO: 549996 - DNA, 25 bp, Rattus norvegicus
aagtgagtgcgctcctcgcacgatc

SEQ ID NO: 549997 - DNA, 25 bp, Rattus norvegicus
atcgcgggcctcctagttccacgtt

SEQ ID NO: 549998 - DNA, 25 bp, Rattus norvegicus
ctcctagttccacgtttggagggag

SEQ ID NO: 549999 - DNA, 25 bp, Rattus norvegicus
tgacaaatcgactggggacagctgg

SEQ ID NO: 550000 - DNA, 25 bp, Rattus norvegicus
cccacgcgaaacatgagacagaggc

SEQ ID NO: 550001 - DNA, 25 bp, Rattus norvegicus
acgatctcgaagtcgtccctctcga

SEQ ID NO: 550002 - DNA, 25 bp, Rattus norvegicus
cggcgtcgatctcatggctgatgac

SEQ ID NO: 550003 - DNA, 25 bp, Rattus norvegicus
gcgccactgcagatctaccagcgtg

SEQ ID NO: 550004 - DNA, 25 bp, Rattus norvegicus
gtggcttccaccatgccctcgagaa

SEQ ID NO: 550005 - DNA, 25 bp, Rattus norvegicus
ttgggctgcgagatcttgacgaaca

SEQ ID NO: 550006 - DNA, 25 bp, Rattus norvegicus
tgcggggtcttaataaaggtgtgcc

SEQ ID NO: 550007 - DNA, 25 bp, Rattus norvegicus
gtccttctccacgtagcgctggcga

SEQ ID NO: 550008 - DNA, 25 bp, Rattus norvegicus
ccgagttgatggatccggccaatgc

SEQ ID NO: 550009 - DNA, 25 bp, Rattus norvegicus
ccacgaagccgttgaggttgttgac

SEQ ID NO: 550010 - DNA, 25 bp, Rattus norvegicus
catagccgatggtggtttctgtctc

SEQ ID NO: 550011 - DNA, 25 bp, Rattus norvegicus
tcggtgatgacacggtgcccatagc

SEQ ID NO: 550012 - DNA, 25 bp, Rattus norvegicus
cccaggatggcttgcaacagcagca

SEQ ID NO: 550013 - DNA, 25 bp, Rattus norvegicus
gaaagcggcgttctcctgcgccatg

SEQ ID NO: 550014 - DNA, 25 bp, Rattus norvegicus
agctcggcttctatcgctacgcgta

SEQ ID NO: 550015 - DNA, 25 bp, Rattus norvegicus
tatctctccaatcctcaggctcggg

SEQ ID NO: 550016 - DNA, 25 bp, Rattus norvegicus
tgtcatcttgccagctcggcttcta

SEQ ID NO: 550017 - DNA, 25 bp, Rattus norvegicus
tatcgctacgcgtatcgtcccttca

SEQ ID NO: 550018 - DNA, 25 bp, Rattus norvegicus
gcgtatcgtcccttcatctctcttt

SEQ ID NO: 550019 - DNA, 25 bp, Rattus norvegicus
tcatctctctttctccgggactctg

SEQ ID NO: 550020 - DNA, 25 bp, Rattus norvegicus
tcgtctgggtttgcgcttctttgcc

SEQ ID NO: 550021 - DNA, 25 bp, Rattus norvegicus
ctgcacactcgttcgtctgggtttg

SEQ ID NO: 550022 - DNA, 25 bp, Rattus norvegicus
ttcggatgtttctgcacactcgttc

SEQ ID NO: 550023 - DNA, 25 bp, Rattus norvegicus
ccgggactctgtctggatctcagtc

SEQ ID NO: 550024 - DNA, 25 bp, Rattus norvegicus
ccttcattctgacagggccgcttcg

SEQ ID NO: 550025 - DNA, 25 bp, Rattus norvegicus
cctcgtcctggttccttcattctga

SEQ ID NO: 550026 - DNA, 25 bp, Rattus norvegicus
ctggatctcagtcttcggatgtttc

SEQ ID NO: 550027 - DNA, 25 bp, Rattus norvegicus
ggccgcttcgcttttcttctttctc

SEQ ID NO: 550028 - DNA, 25 bp, Rattus norvegicus
cctggtgcttacgaccctgtactta

SEQ ID NO: 550029 - DNA, 25 bp, Rattus norvegicus
tggcccgcactcagaccatgagcta

SEQ ID NO: 550030 - DNA, 25 bp, Rattus norvegicus
gaacgcggaagcactggtttctaca

SEQ ID NO: 550031 - DNA, 25 bp, Rattus norvegicus
cgacttctcagccactccgggattt

SEQ ID NO: 550032 - DNA, 25 bp, Rattus norvegicus
ccaatcccgaggaaggcagtagttc

SEQ ID NO: 550033 - DNA, 25 bp, Rattus norvegicus
tggagacaacttagagcccgcgcga

SEQ ID NO: 550034 - DNA, 25 bp, Rattus norvegicus
tgagttattactgtcggcgcaccgg

SEQ ID NO: 550035 - DNA, 25 bp, Rattus norvegicus
cactggggagaatggttcctgaacc

SEQ ID NO: 550036 - DNA, 25 bp, Rattus norvegicus
tgtctttcaggaccggactctgctc

SEQ ID NO: 550037 - DNA, 25 bp, Rattus norvegicus
tctgctcgtgaggtacaccgacata

SEQ ID NO: 550038 - DNA, 25 bp, Rattus norvegicus
tacctgagggcgacgtatcgctaca

SEQ ID NO: 550039 - DNA, 25 bp, Rattus norvegicus
actgcgtcttctggctgcttaaccc

SEQ ID NO: 550040 - DNA, 25 bp, Rattus norvegicus
ttcgcggtgcacatgaagatgtatc

SEQ ID NO: 550041 - DNA, 25 bp, Rattus norvegicus
gtctacctcagcgaactctttggca

SEQ ID NO: 550042 - DNA, 25 bp, Rattus norvegicus
ggggcgaccagagcccacgtgcgac

SEQ ID NO: 550043 - DNA, 25 bp, Rattus norvegicus
gcccgccttgttcggcctctgttgg

SEQ ID NO: 550044 - DNA, 25 bp, Rattus norvegicus
gcgtccttctctctctaaactacaa

SEQ ID NO: 550045 - DNA, 25 bp, Rattus norvegicus
ttggctccaattggccgccgcggga

SEQ ID NO: 550046 - DNA, 25 bp, Rattus norvegicus
tctgttggctccaattggccgccgc

SEQ ID NO: 550047 - DNA, 25 bp, Rattus norvegicus
gttcggcctctgttggctccaattg

SEQ ID NO: 550048 - DNA, 25 bp, Rattus norvegicus
actacaactcccaggcggctcgggg

SEQ ID NO: 550049 - DNA, 25 bp, Rattus norvegicus
gcccacgtgcgaccgcgtccttctc

SEQ ID NO: 550050 - DNA, 25 bp, Rattus norvegicus
tagttgtacagagctccacgagggg

SEQ ID NO: 550051 - DNA, 25 bp, Rattus norvegicus
cgcttagttgtacagagctccacga

SEQ ID NO: 550052 - DNA, 25 bp, Rattus norvegicus
tccctcgcttagttgtacagagctc

SEQ ID NO: 550053 - DNA, 25 bp, Rattus norvegicus
gccttccctcgcttagttgtacaga

SEQ ID NO: 550054 - DNA, 25 bp, Rattus norvegicus
ggaagcggcgatcagccttccctcg

SEQ ID NO: 550055 - DNA, 25 bp, Rattus norvegicus
tcggcctctgttggctccaattggc

SEQ ID NO: 550056 - DNA, 25 bp, Rattus norvegicus
tgaagatcacaagggtccgaactgg

SEQ ID NO: 550057 - DNA, 25 bp, Rattus norvegicus
gcgaacacttgagacttgctttagg

SEQ ID NO: 550058 - DNA, 25 bp, Rattus norvegicus
ctgtagaaagcaagaagcgaacact

SEQ ID NO: 550059 - DNA, 25 bp, Rattus norvegicus
ccggcttggacggtgagcagaactt

SEQ ID NO: 550060 - DNA, 25 bp, Rattus norvegicus
cattccacgcggctgcgcctttaaa

SEQ ID NO: 550061 - DNA, 25 bp, Rattus norvegicus
ccgtgctgtcaggtccggttcccag

SEQ ID NO: 550062 - DNA, 25 bp, Rattus norvegicus
tgcgctctcatctagccggcttgga

SEQ ID NO: 550063 - DNA, 25 bp, Rattus norvegicus
tccagaaaactccaagctcggccgg

SEQ ID NO: 550064 - DNA, 25 bp, Rattus norvegicus
gtctgaggcgggaccctccagaaaa

SEQ ID NO: 550065 - DNA, 25 bp, Rattus norvegicus
aggcaagctttacgggcgcacagac

SEQ ID NO: 550066 - DNA, 25 bp, Rattus norvegicus
cagcagttcgctccagcgtcgagtt

SEQ ID NO: 550067 - DNA, 25 bp, Rattus norvegicus
ccagcgtcgagttctccttaaagga

SEQ ID NO: 550068 - DNA, 25 bp, Rattus norvegicus
aggctgctgagtggccgcaagaact

SEQ ID NO: 550069 - DNA, 25 bp, Rattus norvegicus
cggttcccaggacatctttgcattg

SEQ ID NO: 550070 - DNA, 25 bp, Rattus norvegicus
agaggttgccaagagcccccagctc

SEQ ID NO: 550071 - DNA, 25 bp, Rattus norvegicus
ttcgggccagcagacttggctctca

SEQ ID NO: 550072 - DNA, 25 bp, Rattus norvegicus
acgcgcccgcctgttgttttccaga

SEQ ID NO: 550073 - DNA, 25 bp, Rattus norvegicus
gacttggctctcatcggccacctag

SEQ ID NO: 550074 - DNA, 25 bp, Rattus norvegicus
gcctcttagtgtgagcgcgcagcac

SEQ ID NO: 550075 - DNA, 25 bp, Rattus norvegicus
cccggtctacatcaaggtcaagagc

SEQ ID NO: 550076 - DNA, 25 bp, Rattus norvegicus
tgttttccagagtggacgccgaggc

SEQ ID NO: 550077 - DNA, 25 bp, Rattus norvegicus
ctggggtacccgacgcagaacgtca

SEQ ID NO: 550078 - DNA, 25 bp, Rattus norvegicus
tccctgcgccgcaagtacgcgcctc

SEQ ID NO: 550079 - DNA, 25 bp, Rattus norvegicus
tacatcaaggtcaagagcgcggagc

SEQ ID NO: 550080 - DNA, 25 bp, Rattus norvegicus
actgcgccgactgtgcccaggtcga

SEQ ID NO: 550081 - DNA, 25 bp, Rattus norvegicus
cccaggtcgagcagcgctcgtgcaa

SEQ ID NO: 550082 - DNA, 25 bp, Rattus norvegicus
gctcgtgcaaggacggcctcttagt

SEQ ID NO: 550083 - DNA, 25 bp, Rattus norvegicus
cccgcctgttgttttccagagtgga

SEQ ID NO: 550084 - DNA, 25 bp, Rattus norvegicus
ctagcggttcacgtagtctctcgga

SEQ ID NO: 550085 - DNA, 25 bp, Rattus norvegicus
ctcgcttgagctcacgaacgctctg

SEQ ID NO: 550086 - DNA, 25 bp, Rattus norvegicus
tgagctcacgaacgctctgacctct

SEQ ID NO: 550087 - DNA, 25 bp, Rattus norvegicus
gggcattggcctcgtccacgatctt

SEQ ID NO: 550088 - DNA, 25 bp, Rattus norvegicus
cctcgtccacgatcttcacaaattg

SEQ ID NO: 550089 - DNA, 25 bp, Rattus norvegicus
tcacaaattggtcgatctgttcggg

SEQ ID NO: 550090 - DNA, 25 bp, Rattus norvegicus
aggccgggacagctgtcactgtgag

SEQ ID NO: 550091 - DNA, 25 bp, Rattus norvegicus
cgctccgtcagggacaccaagtgtc

SEQ ID NO: 550092 - DNA, 25 bp, Rattus norvegicus
gacaccaagtgtcgcacgcccaggt

SEQ ID NO: 550093 - DNA, 25 bp, Rattus norvegicus
ccggagcgaggctggcctttcctac

SEQ ID NO: 550094 - DNA, 25 bp, Rattus norvegicus
tttcctacgccctgcgatcgggtca

SEQ ID NO: 550095 - DNA, 25 bp, Rattus norvegicus
agcacttgtcctagcggttcacgta

SEQ ID NO: 550096 - DNA, 25 bp, Rattus norvegicus
ggttcacgtagtctctcggacccgc

SEQ ID NO: 550097 - DNA, 25 bp, Rattus norvegicus
tgctcagcacttgtcctagcggttc

SEQ ID NO: 550098 - DNA, 25 bp, Rattus norvegicus
tcaccgtcctgggaaagattggccc

SEQ ID NO: 550099 - DNA, 25 bp, Rattus norvegicus
cccacggtcctcagagacagcgatg

SEQ ID NO: 550100 - DNA, 25 bp, Rattus norvegicus
tagggcgctcggagcaaaccattcg

SEQ ID NO: 550101 - DNA, 25 bp, Rattus norvegicus
tgcagtcgccgggattaaatagggc

SEQ ID NO: 550102 - DNA, 25 bp, Rattus norvegicus
ctcactcaccgtcctgggaaagatt

SEQ ID NO: 550103 - DNA, 25 bp, Rattus norvegicus
aaacaaagccaacaggctccctgcg

SEQ ID NO: 550104 - DNA, 25 bp, Rattus norvegicus
gccgtgtacacaggagggtgcacac

SEQ ID NO: 550105 - DNA, 25 bp, Rattus norvegicus
cacaagggtattccgagaggctggc

SEQ ID NO: 550106 - DNA, 25 bp, Rattus norvegicus
cagagacagacacaagggtattccg

SEQ ID NO: 550107 - DNA, 25 bp, Rattus norvegicus
agacagcgatgctcagagacagaca

SEQ ID NO: 550108 - DNA, 25 bp, Rattus norvegicus
gcagacatacacagtcggccgtgta

SEQ ID NO: 550109 - DNA, 25 bp, Rattus norvegicus
gaggctggcgacttgaaccctcgcc

SEQ ID NO: 550110 - DNA, 25 bp, Rattus norvegicus
tcgccgggattaaatagggcgctcg

SEQ ID NO: 550111 - DNA, 25 bp, Rattus norvegicus
cacaggagggtgcacacgccggcac

SEQ ID NO: 550112 - DNA, 25 bp, Rattus norvegicus
ctcgctgcgtccctcggtgtgtgcg

SEQ ID NO: 550113 - DNA, 25 bp, Rattus norvegicus
cgcgacgccgccaggaaggagcctg

SEQ ID NO: 550114 - DNA, 25 bp, Rattus norvegicus
tccgcgctgcagcacagccgtgctc

SEQ ID NO: 550115 - DNA, 25 bp, Rattus norvegicus
tttgaaaaagttgcgagcgaagccc

SEQ ID NO: 550116 - DNA, 25 bp, Rattus norvegicus
ctggctgcccgtctccgagtcctcc

SEQ ID NO: 550117 - DNA, 25 bp, Rattus norvegicus
agtcctccgcgtctcggcacgaagt

SEQ ID NO: 550118 - DNA, 25 bp, Rattus norvegicus
tctcggcacgaagttccccaaagta

SEQ ID NO: 550119 - DNA, 25 bp, Rattus norvegicus
ctcccgcgcctttgaaaaagttgcg

SEQ ID NO: 550120 - DNA, 25 bp, Rattus norvegicus
tcctctgccactcaggggcgcagtt

SEQ ID NO: 550121 - DNA, 25 bp, Rattus norvegicus
cgcttacctgttggaggtagaggaa

SEQ ID NO: 550122 - DNA, 25 bp, Rattus norvegicus
gcagccggagttcgccatggagcac

SEQ ID NO: 550123 - DNA, 25 bp, Rattus norvegicus
cggagttcgccatggagcacagcat

SEQ ID NO: 550124 - DNA, 25 bp, Rattus norvegicus
taaccgggtgtccagaacccctgca

SEQ ID NO: 550125 - DNA, 25 bp, Rattus norvegicus
ccatggagcacagcatggggcgtca

SEQ ID NO: 550126 - DNA, 25 bp, Rattus norvegicus
agagcctcggtgttttccaacctgc

SEQ ID NO: 550127 - DNA, 25 bp, Rattus norvegicus
agtgcgcgctgaactgagcatgttc

SEQ ID NO: 550128 - DNA, 25 bp, Rattus norvegicus
agagccaccgcgcattatgcaaagc

SEQ ID NO: 550129 - DNA, 25 bp, Rattus norvegicus
ccagctgcctgaattgtcccggaca

SEQ ID NO: 550130 - DNA, 25 bp, Rattus norvegicus
cccagggatgcggaaaccacaaaga

SEQ ID NO: 550131 - DNA, 25 bp, Rattus norvegicus
agcaagtcggattctagagcctcgg

SEQ ID NO: 550132 - DNA, 25 bp, Rattus norvegicus
gctggacagcgctcactctatagtc

SEQ ID NO: 550133 - DNA, 25 bp, Rattus norvegicus
tatcggataccgagtgtgctgaccc

SEQ ID NO: 550134 - DNA, 25 bp, Rattus norvegicus
gctgaccctttcgaggtgatccatc

SEQ ID NO: 550135 - DNA, 25 bp, Rattus norvegicus
cgatcgccgaggatttggaaactgc

SEQ ID NO: 550136 - DNA, 25 bp, Rattus norvegicus
accagttctggttcggacacggaca

SEQ ID NO: 550137 - DNA, 25 bp, Rattus norvegicus
cggacacggacatctacagctttca

SEQ ID NO: 550138 - DNA, 25 bp, Rattus norvegicus
aagcgcaggtgatgcctctcacgaa

SEQ ID NO: 550139 - DNA, 25 bp, Rattus norvegicus
tccaacctgcggatcagaaaaaatc

SEQ ID NO: 550140 - DNA, 25 bp, Rattus norvegicus
cggctgatggctttcagaatgtgtt

SEQ ID NO: 550141 - DNA, 25 bp, Rattus norvegicus
tgccacgtatctccgggtggcaggt

SEQ ID NO: 550142 - DNA, 25 bp, Rattus norvegicus
gcgcctgccacgtatctccgggtgg

SEQ ID NO: 550143 - DNA, 25 bp, Rattus norvegicus
aggtaagcgcgcctgccacgtatct

SEQ ID NO: 550144 - DNA, 25 bp, Rattus norvegicus
gaatgtgttcacaggtaagcgcgcc

SEQ ID NO: 550145 - DNA, 25 bp, Rattus norvegicus
cagcgacggctgatggctttcagaa

SEQ ID NO: 550146 - DNA, 25 bp, Rattus norvegicus
ggctttcagaatgtgttcacaggta

SEQ ID NO: 550147 - DNA, 25 bp, Rattus norvegicus
ccggcaaagaagcaccggttggaag

SEQ ID NO: 550148 - DNA, 25 bp, Rattus norvegicus
ctcgtgggcggcctcagtcgctcag

SEQ ID NO: 550149 - DNA, 25 bp, Rattus norvegicus
ggcctcagtcgctcagccgactgga

SEQ ID NO: 550150 - DNA, 25 bp, Rattus norvegicus
cgctcagccgactggaccgaggagc

SEQ ID NO: 550151 - DNA, 25 bp, Rattus norvegicus
accgaggagctaggcgcccgtacgc

SEQ ID NO: 550152 - DNA, 25 bp, Rattus norvegicus
ccgccaaggcacctggggctccagc

SEQ ID NO: 550153 - DNA, 25 bp, Rattus norvegicus
ctccagcgacggctgatggctttca

SEQ ID NO: 550154 - DNA, 25 bp, Rattus norvegicus
agaggccttcgacatcgccgccatg

SEQ ID NO: 550155 - DNA, 25 bp, Rattus norvegicus
ggtgcacccaaatccagacgttctc

SEQ ID NO: 550156 - DNA, 25 bp, Rattus norvegicus
tcgcccttgtggtgacagaagcccg

SEQ ID NO: 550157 - DNA, 25 bp, Rattus norvegicus
tcgcttccggaaactggcagaactc

SEQ ID NO: 550158 - DNA, 25 bp, Rattus norvegicus
agcagagctttgatttcctcacgga

SEQ ID NO: 550159 - DNA, 25 bp, Rattus norvegicus
gattccctgcagacctacatgtttg

SEQ ID NO: 550160 - DNA, 25 bp, Rattus norvegicus
tacgtgctggccaagctctacgagg

SEQ ID NO: 550161 - DNA, 25 bp, Rattus norvegicus
cgacgagaacatccacgagaacatt

SEQ ID NO: 550162 - DNA, 25 bp, Rattus norvegicus
gatcgagagcctctcccgctacgtg

SEQ ID NO: 550163 - DNA, 25 bp, Rattus norvegicus
cgagaacattgtgcgctatgacgac

SEQ ID NO: 550164 - DNA, 25 bp, Rattus norvegicus
caaacgctgcttctcgtccatgagg

SEQ ID NO: 550165 - DNA, 25 bp, Rattus norvegicus
tcagccacctcggactcagagcaga

SEQ ID NO: 550166 - DNA, 25 bp, Rattus norvegicus
tcagcagcacggtccacagctacgt

SEQ ID NO: 550167 - DNA, 25 bp, Rattus norvegicus
ctctacgaggccgacatggacctgt

SEQ ID NO: 550168 - DNA, 25 bp, Rattus norvegicus
tgatctcagagacgcgctcctggcc

SEQ ID NO: 550169 - DNA, 25 bp, Rattus norvegicus
gccaccgcagaaccgagccttaatg

SEQ ID NO: 550170 - DNA, 25 bp, Rattus norvegicus
gggaagccgcaaaggatctgtagtc

SEQ ID NO: 550171 - DNA, 25 bp, Rattus norvegicus
acctgtctctgcaaagctgatgatc

SEQ ID NO: 550172 - DNA, 25 bp, Rattus norvegicus
aaacgggagggatcacagccgcctc

SEQ ID NO: 550173 - DNA, 25 bp, Rattus norvegicus
acgacgtacaggtgtcctgcgagcc

SEQ ID NO: 550174 - DNA, 25 bp, Rattus norvegicus
atgtgtctcttcaccgcctccagga

SEQ ID NO: 550175 - DNA, 25 bp, Rattus norvegicus
tggacgcgcgacataggaaaggacc

SEQ ID NO: 550176 - DNA, 25 bp, Rattus norvegicus
atctgtagtctggacgcgcgacata

SEQ ID NO: 550177 - DNA, 25 bp, Rattus norvegicus
caggcggctcaagatgtgtctcttc

SEQ ID NO: 550178 - DNA, 25 bp, Rattus norvegicus
ctggggcccaattcccgtgagccag

SEQ ID NO: 550179 - DNA, 25 bp, Rattus norvegicus
gaagggcagggtactttccagttgc

SEQ ID NO: 550180 - DNA, 25 bp, Rattus norvegicus
agccttaatgccctcggggcgtgcg

SEQ ID NO: 550181 - DNA, 25 bp, Rattus norvegicus
ggaaaggaccgccaccatgagacgc

SEQ ID NO: 550182 - DNA, 25 bp, Rattus norvegicus
gccatagcaaaagcggttgaggatg

SEQ ID NO: 550183 - DNA, 25 bp, Rattus norvegicus
ggcaaccctcctcgctcaccgtctg

SEQ ID NO: 550184 - DNA, 25 bp, Rattus norvegicus
agtggctgcgtcttgcaccagtcac

SEQ ID NO: 550185 - DNA, 25 bp, Rattus norvegicus
tgcgtcttgcaccagtcactcttca

SEQ ID NO: 550186 - DNA, 25 bp, Rattus norvegicus
gacccgggcattcgagctccacgat

SEQ ID NO: 550187 - DNA, 25 bp, Rattus norvegicus
cctttttcacgtgtcgtgggatgta

SEQ ID NO: 550188 - DNA, 25 bp, Rattus norvegicus
ttcgagctccacgatgacagaggtg

SEQ ID NO: 550189 - DNA, 25 bp, Rattus norvegicus
acacgctggggcttgcagaaagcgc

SEQ ID NO: 550190 - DNA, 25 bp, Rattus norvegicus
gcactggccatagcaaaagcggttg

SEQ ID NO: 550191 - DNA, 25 bp, Rattus norvegicus
tgtagaaggagttgcactggccata

SEQ ID NO: 550192 - DNA, 25 bp, Rattus norvegicus
gtcactcttcaggtacttgcgctcg

SEQ ID NO: 550193 - DNA, 25 bp, Rattus norvegicus
gatggtgcggctgcggcaaccctcc

SEQ ID NO: 550194 - DNA, 25 bp, Rattus norvegicus
ccacgatgacagaggtgacacgctg

SEQ ID NO: 550195 - DNA, 25 bp, Rattus norvegicus
aaaggtggatcgagacccgggcatt

SEQ ID NO: 550196 - DNA, 25 bp, Rattus norvegicus
acagtcacgtgggacagggacgccc

SEQ ID NO: 550197 - DNA, 25 bp, Rattus norvegicus
ccgagcgcgccgctctttggggact

SEQ ID NO: 550198 - DNA, 25 bp, Rattus norvegicus
ccgctctttggggactgtggctccc

SEQ ID NO: 550199 - DNA, 25 bp, Rattus norvegicus
tttggggactgtggctcccgccgtc

SEQ ID NO: 550200 - DNA, 25 bp, Rattus norvegicus
ctctccggttacctcctcggccaag

SEQ ID NO: 550201 - DNA, 25 bp, Rattus norvegicus
agcagtgaggcagggcagcctcatc

SEQ ID NO: 550202 - DNA, 25 bp, Rattus norvegicus
aggcagggcagcctcatcacactcg

SEQ ID NO: 550203 - DNA, 25 bp, Rattus norvegicus
tcacactcgcgctgctcaggccacc

SEQ ID NO: 550204 - DNA, 25 bp, Rattus norvegicus
ccaccctcgcggtgcacaggcggcc

SEQ ID NO: 550205 - DNA, 25 bp, Rattus norvegicus
ctcgctcgttccctcctccgcttct

SEQ ID NO: 550206 - DNA, 25 bp, Rattus norvegicus
acgcccgacccgtgcgcgcgcgact

SEQ ID NO: 550207 - DNA, 25 bp, Rattus norvegicus
gacgcccgaaggtgccggctcggac

SEQ ID NO: 550208 - DNA, 25 bp, Rattus norvegicus
ccctccggagcacaggccctgtccc

SEQ ID NO: 550209 - DNA, 25 bp, Rattus norvegicus
ggactgggaccagtcgagcgcgcgc

SEQ ID NO: 550210 - DNA, 25 bp, Rattus norvegicus
gggagctccaacacaccgggctgga

SEQ ID NO: 550211 - DNA, 25 bp, Rattus norvegicus
cggggacacccaggacacactgaca

SEQ ID NO: 550212 - DNA, 25 bp, Rattus norvegicus
cccaggacacactgacatgaaggtc

SEQ ID NO: 550213 - DNA, 25 bp, Rattus norvegicus
actgacatgaaggtcaccgcgggga

SEQ ID NO: 550214 - DNA, 25 bp, Rattus norvegicus
gctcaccattcgcacgacgttcgga

SEQ ID NO: 550215 - DNA, 25 bp, Rattus norvegicus
ctgtacgtggatggaaagctgagcc

SEQ ID NO: 550216 - DNA, 25 bp, Rattus norvegicus
agggtggccgcttcccctgacaata

SEQ ID NO: 550217 - DNA, 25 bp, Rattus norvegicus
ccctgaacgtcagcgctcggccacg

SEQ ID NO: 550218 - DNA, 25 bp, Rattus norvegicus
cctgacaatacagcaccggcggagg

SEQ ID NO: 550219 - DNA, 25 bp, Rattus norvegicus
cgaggagacagaatgcgcggttcat

SEQ ID NO: 550220 - DNA, 25 bp, Rattus norvegicus
acagaatgcgcggttcatggtgctg

SEQ ID NO: 550221 - DNA, 25 bp, Rattus norvegicus
ttcatggtgctgctgtacgtggatg

SEQ ID NO: 550222 - DNA, 25 bp, Rattus norvegicus
atggaaagctgagcccaagacacgc

SEQ ID NO: 550223 - DNA, 25 bp, Rattus norvegicus
acgacgttcggagcacaccgtggga

SEQ ID NO: 550224 - DNA, 25 bp, Rattus norvegicus
tcaggccattgtgcctcggagcagc

SEQ ID NO: 550225 - DNA, 25 bp, Rattus norvegicus
caggctgcagctcaggccattgtgc

SEQ ID NO: 550226 - DNA, 25 bp, Rattus norvegicus
accgggtggagctcacgctcaggct

SEQ ID NO: 550227 - DNA, 25 bp, Rattus norvegicus
ccacgcagcgaaccgggtggagctc

SEQ ID NO: 550228 - DNA, 25 bp, Rattus norvegicus
agcagcgcgaggcaaccgagcagca

SEQ ID NO: 550229 - DNA, 25 bp, Rattus norvegicus
agcagcaccagcaggttgccgccga

SEQ ID NO: 550230 - DNA, 25 bp, Rattus norvegicus
cccagactgaggttgaccaggaaga

SEQ ID NO: 550231 - DNA, 25 bp, Rattus norvegicus
ggataccagcagatcgcccagactg

SEQ ID NO: 550232 - DNA, 25 bp, Rattus norvegicus
ctccgaacagggataccagcagatc

SEQ ID NO: 550233 - DNA, 25 bp, Rattus norvegicus
gcgaaggtgaaggtgactccgaaca

SEQ ID NO: 550234 - DNA, 25 bp, Rattus norvegicus
cacgacgcgaaggtgaaggtgactc

SEQ ID NO: 550235 - DNA, 25 bp, Rattus norvegicus
agccgttccgcaggcacgacgcgaa

SEQ ID NO: 550236 - DNA, 25 bp, Rattus norvegicus
tcaccaaagaggctgccgctaaacc

SEQ ID NO: 550237 - DNA, 25 bp, Rattus norvegicus
tcccgggcgactcaccaaagaggct

SEQ ID NO: 550238 - DNA, 25 bp, Rattus norvegicus
gaccttctggtgttgatgcgccaca

SEQ ID NO: 550239 - DNA, 25 bp, Rattus norvegicus
agcggacctttcgattctagcttca

SEQ ID NO: 550240 - DNA, 25 bp, Rattus norvegicus
cttcaccgagttcgagctggcattg

SEQ ID NO: 550241 - DNA, 25 bp, Rattus norvegicus
ccattggcggcagagttcctacctt

SEQ ID NO: 550242 - DNA, 25 bp, Rattus norvegicus
aggttcatgctctggacgcccaaga

SEQ ID NO: 550243 - DNA, 25 bp, Rattus norvegicus
cgcccaagaacgtcatgtccgctgg

SEQ ID NO: 550244 - DNA, 25 bp, Rattus norvegicus
tcccgcgcaaattgaaaggtccatg

SEQ ID NO: 550245 - DNA, 25 bp, Rattus norvegicus
cagcagctcgctggtgttctgaacc

SEQ ID NO: 550246 - DNA, 25 bp, Rattus norvegicus
tcgcaacttccttagcagccgggtc

SEQ ID NO: 550247 - DNA, 25 bp, Rattus norvegicus
ctccactggtatcgagcaacgagtt

SEQ ID NO: 550248 - DNA, 25 bp, Rattus norvegicus
tcatatgcaggtttgaggagccacg

SEQ ID NO: 550249 - DNA, 25 bp, Rattus norvegicus
gcgggccatgcctgtttattcggaa

SEQ ID NO: 550250 - DNA, 25 bp, Rattus norvegicus
tgctgctgttacctcgggtaccacc

SEQ ID NO: 550251 - DNA, 25 bp, Rattus norvegicus
ttcggaagacaagtgaagccgctgc

SEQ ID NO: 550252 - DNA, 25 bp, Rattus norvegicus
ctgttcccgagtggcagaagtcagg

SEQ ID NO: 550253 - DNA, 25 bp, Rattus norvegicus
ggcaagactcaggaggacgacgctc

SEQ ID NO: 550254 - DNA, 25 bp, Rattus norvegicus
ccaagaggcactggagcagggacaa

SEQ ID NO: 550255 - DNA, 25 bp, Rattus norvegicus
tgcagatcgccctcggaaagcacgg

SEQ ID NO: 550256 - DNA, 25 bp, Rattus norvegicus
gacgcgcaacccactcgggatggga

SEQ ID NO: 550257 - DNA, 25 bp, Rattus norvegicus
atcctgacatgaccaggcggctgcc

SEQ ID NO: 550258 - DNA, 25 bp, Rattus norvegicus
gtgctgccggatctccatcctgaca

SEQ ID NO: 550259 - DNA, 25 bp, Rattus norvegicus
ccttggggcggcttttcaatctcat

SEQ ID NO: 550260 - DNA, 25 bp, Rattus norvegicus
ctgctgtagaagttcgcgcccactc

SEQ ID NO: 550261 - DNA, 25 bp, Rattus norvegicus
agtcctgctgcttgacactgctgta

SEQ ID NO: 550262 - DNA, 25 bp, Rattus norvegicus
agcttatctttcctccggagccaga

SEQ ID NO: 550263 - DNA, 25 bp, Rattus norvegicus
gctcccgggagcgaatggtccttac

SEQ ID NO: 550264 - DNA, 25 bp, Rattus norvegicus
tggtccttacgtgttccagcttatc

SEQ ID NO: 550265 - DNA, 25 bp, Rattus norvegicus
ctcatctgctcgaaaccctcgtggg

SEQ ID NO: 550266 - DNA, 25 bp, Rattus norvegicus
tagtcgcctctggacaagcgtgcta

SEQ ID NO: 550267 - DNA, 25 bp, Rattus norvegicus
agccttctgtgaccctggagctgca

SEQ ID NO: 550268 - DNA, 25 bp, Rattus norvegicus
acttttgcgagccaggcatctgtgc

SEQ ID NO: 550269 - DNA, 25 bp, Rattus norvegicus
tcaactgcggtcagaacttttgcga

SEQ ID NO: 550270 - DNA, 25 bp, Rattus norvegicus
ccggaatctgcgctcatcaactgcg

SEQ ID NO: 550271 - DNA, 25 bp, Rattus norvegicus
tgctagcgtaaagtggtcccaggcc

SEQ ID NO: 550272 - DNA, 25 bp, Rattus norvegicus
ggtttcgctgcaaagcccagcccta

SEQ ID NO: 550273 - DNA, 25 bp, Rattus norvegicus
catgttccaagtttcggtttcgctg

SEQ ID NO: 550274 - DNA, 25 bp, Rattus norvegicus
agcgtccacttccttcatgttccaa

SEQ ID NO: 550275 - DNA, 25 bp, Rattus norvegicus
ttctctcaatggtgcctgcgtcccg

SEQ ID NO: 550276 - DNA, 25 bp, Rattus norvegicus
ccctgtggtcagattctctcaatgg

SEQ ID NO: 550277 - DNA, 25 bp, Rattus norvegicus
gaattccggtcaggctgtgcgccaa

SEQ ID NO: 550278 - DNA, 25 bp, Rattus norvegicus
gggcgctgatcttactcgggtcaag

SEQ ID NO: 550279 - DNA, 25 bp, Rattus norvegicus
cgacatccggagtgtttcgttgggt

SEQ ID NO: 550280 - DNA, 25 bp, Rattus norvegicus
tccggcaggctgagtgacagcacgt

SEQ ID NO: 550281 - DNA, 25 bp, Rattus norvegicus
gcagcgcgccaattccatacggagg

SEQ ID NO: 550282 - DNA, 25 bp, Rattus norvegicus
gtgggaccgcaaccaaccaggacta

SEQ ID NO: 550283 - DNA, 25 bp, Rattus norvegicus
cttgaacaatgaagagcggcttggc

SEQ ID NO: 550284 - DNA, 25 bp, Rattus norvegicus
ggcgtgtcctcaagacccgcttgaa

SEQ ID NO: 550285 - DNA, 25 bp, Rattus norvegicus
gctttgcagagggtctcacccactc

SEQ ID NO: 550286 - DNA, 25 bp, Rattus norvegicus
gcaggcgccagacccagacaatgaa

SEQ ID NO: 550287 - DNA, 25 bp, Rattus norvegicus
gttccgctgggcaataacgttattc

SEQ ID NO: 550288 - DNA, 25 bp, Rattus norvegicus
ccagagctgaggatgtgcagaatcc

SEQ ID NO: 550289 - DNA, 25 bp, Rattus norvegicus
cggcggcacaaagcgagagcgaaaa

SEQ ID NO: 550290 - DNA, 25 bp, Rattus norvegicus
ccctacaaaagggatgggcgccctg

SEQ ID NO: 550291 - DNA, 25 bp, Rattus norvegicus
caacgccatcagaaggctcgtcgtc

SEQ ID NO: 550292 - DNA, 25 bp, Rattus norvegicus
tgcagaatcccgagccttgcggacc

SEQ ID NO: 550293 - DNA, 25 bp, Rattus norvegicus
acacatagcgggaacagcagcgagc

SEQ ID NO: 550294 - DNA, 25 bp, Rattus norvegicus
acaccgactcgccaccggccgctcg

SEQ ID NO: 550295 - DNA, 25 bp, Rattus norvegicus
aacccagacgcgcagctcccggtac

SEQ ID NO: 550296 - DNA, 25 bp, Rattus norvegicus
tcccggtaccgctaggccaggaaca

SEQ ID NO: 550297 - DNA, 25 bp, Rattus norvegicus
gtcggtgtcacccacgcggggcatc

SEQ ID NO: 550298 - DNA, 25 bp, Rattus norvegicus
ccacggccccaaagcttcaggagga

SEQ ID NO: 550299 - DNA, 25 bp, Rattus norvegicus
cggccgcggtgacacccagacgccc

SEQ ID NO: 550300 - DNA, 25 bp, Rattus norvegicus
actcctgacgtcaggggctgcctct

SEQ ID NO: 550301 - DNA, 25 bp, Rattus norvegicus
ccgcggggcttgttgttgactttga

SEQ ID NO: 550302 - DNA, 25 bp, Rattus norvegicus
ttgttgactttgaggaaaactcctg

SEQ ID NO: 550303 - DNA, 25 bp, Rattus norvegicus
tttgaggaaaactcctgacgtcagg

SEQ ID NO: 550304 - DNA, 25 bp, Rattus norvegicus
cggccgctcgcgttacataacctcg

SEQ ID NO: 550305 - DNA, 25 bp, Rattus norvegicus
cggctccagctgagcagagccctaa

SEQ ID NO: 550306 - DNA, 25 bp, Rattus norvegicus
ccagctgagcagagccctaaggcgc

SEQ ID NO: 550307 - DNA, 25 bp, Rattus norvegicus
cgccgccgaagcttcttgccgccgc

SEQ ID NO: 550308 - DNA, 25 bp, Rattus norvegicus
ccgctgccaaaagggtgggagcatc

SEQ ID NO: 550309 - DNA, 25 bp, Rattus norvegicus
ggaagcagcaaaacccgcggcacgg

SEQ ID NO: 550310 - DNA, 25 bp, Rattus norvegicus
ggctcgcacggattagcctgctttc

SEQ ID NO: 550311 - DNA, 25 bp, Rattus norvegicus
gcctgctttcccatgaactacaaaa

SEQ ID NO: 550312 - DNA, 25 bp, Rattus norvegicus
atgctcgaatctggggcatttgcca

SEQ ID NO: 550313 - DNA, 25 bp, Rattus norvegicus
catttgccatcaaggggcaggctgc

SEQ ID NO: 550314 - DNA, 25 bp, Rattus norvegicus
caggctgcgcaggatgcaaggtaac

SEQ ID NO: 550315 - DNA, 25 bp, Rattus norvegicus
ggatgcaaggtaaccggagcttttc

SEQ ID NO: 550316 - DNA, 25 bp, Rattus norvegicus
ttttcccgggctgccgcagtctttg

SEQ ID NO: 550317 - DNA, 25 bp, Rattus norvegicus
gggtcactctaatccttcctgttta

SEQ ID NO: 550318 - DNA, 25 bp, Rattus norvegicus
tttatattgtgaacgcgtcggcagc

SEQ ID NO: 550319 - DNA, 25 bp, Rattus norvegicus
agcagggccgtggtaaatacgcatc

SEQ ID NO: 550320 - DNA, 25 bp, Rattus norvegicus
atacgcatcgcaatgcgggcattcc

SEQ ID NO: 550321 - DNA, 25 bp, Rattus norvegicus
gcgggcattcctaaacagctacgtc

SEQ ID NO: 550322 - DNA, 25 bp, Rattus norvegicus
gaaaatcactgggatcaggggaccc

SEQ ID NO: 550323 - DNA, 25 bp, Rattus norvegicus
cggggccagcgcaggaaaatcactg

SEQ ID NO: 550324 - DNA, 25 bp, Rattus norvegicus
gcctttgaagatttccgcggggcca

SEQ ID NO: 550325 - DNA, 25 bp, Rattus norvegicus
gctcattcctcttgtgcctttgaag

SEQ ID NO: 550326 - DNA, 25 bp, Rattus norvegicus
tgtaacctcgctcattcctcttgtg

SEQ ID NO: 550327 - DNA, 25 bp, Rattus norvegicus
gagcggctgataatgcgcccctgta

SEQ ID NO: 550328 - DNA, 25 bp, Rattus norvegicus
cacaaagaggggattatggtcctgc

SEQ ID NO: 550329 - DNA, 25 bp, Rattus norvegicus
tcgcagcgagcacaaagaggggatt

SEQ ID NO: 550330 - DNA, 25 bp, Rattus norvegicus
attacaagtggctctgcgctcgcag

SEQ ID NO: 550331 - DNA, 25 bp, Rattus norvegicus
aggaattacaagtggctctgcgctc

SEQ ID NO: 550332 - DNA, 25 bp, Rattus norvegicus
ggctggtctccacggccgacctgga

SEQ ID NO: 550333 - DNA, 25 bp, Rattus norvegicus
agacttaagagccaggctggtctcc

SEQ ID NO: 550334 - DNA, 25 bp, Rattus norvegicus
cccgtgcacgatggagagacttaag

SEQ ID NO: 550335 - DNA, 25 bp, Rattus norvegicus
ggccgcgggccttgctggaatccac

SEQ ID NO: 550336 - DNA, 25 bp, Rattus norvegicus
tgtcgcccttcacaaccaagacggg

SEQ ID NO: 550337 - DNA, 25 bp, Rattus norvegicus
tagagcctccatgggacgatctttc

SEQ ID NO: 550338 - DNA, 25 bp, Rattus norvegicus
gctgtctcttctgcctgctgcggca

SEQ ID NO: 550339 - DNA, 25 bp, Rattus norvegicus
tactaaggggccacgcaagcctttc

SEQ ID NO: 550340 - DNA, 25 bp, Rattus norvegicus
ccgacacgctccgagagtaggatcc

SEQ ID NO: 550341 - DNA, 25 bp, Rattus norvegicus
cccatggggcgacggataaatggca

SEQ ID NO: 550342 - DNA, 25 bp, Rattus norvegicus
gggatgccaggccacttttgctacc

SEQ ID NO: 550343 - DNA, 25 bp, Rattus norvegicus
gctctttccctgtctgccttggcga

SEQ ID NO: 550344 - DNA, 25 bp, Rattus norvegicus
cacaatctccgtatgtgcgcgcgcg

SEQ ID NO: 550345 - DNA, 25 bp, Rattus norvegicus
gtggcggccaaaagtctctctgtgt

SEQ ID NO: 550346 - DNA, 25 bp, Rattus norvegicus
tccgagcgcgtcacccggcaaagtt

SEQ ID NO: 550347 - DNA, 25 bp, Rattus norvegicus
cgatctttcgctatccagcctggga

SEQ ID NO: 550348 - DNA, 25 bp, Rattus norvegicus
tttcccaccacgtgagtgcttcgga

SEQ ID NO: 550349 - DNA, 25 bp, Rattus norvegicus
cccgaggagttcttcgctttgcctt

SEQ ID NO: 550350 - DNA, 25 bp, Rattus norvegicus
ttcaccaggccgctctggtgccaag

SEQ ID NO: 550351 - DNA, 25 bp, Rattus norvegicus
gtatgcccgggtgtctctggtatct

SEQ ID NO: 550352 - DNA, 25 bp, Rattus norvegicus
tgtctctggtatctggcacagcaca

SEQ ID NO: 550353 - DNA, 25 bp, Rattus norvegicus
ctggcacagcacagaacactcagga

SEQ ID NO: 550354 - DNA, 25 bp, Rattus norvegicus
cacagaacactcaggagggagctca

SEQ ID NO: 550355 - DNA, 25 bp, Rattus norvegicus
gagggagctcaacagagcctcgtta

SEQ ID NO: 550356 - DNA, 25 bp, Rattus norvegicus
acagagcctcgttaaacagtggaac

SEQ ID NO: 550357 - DNA, 25 bp, Rattus norvegicus
aaacagtggaacgagctgaggagtc

SEQ ID NO: 550358 - DNA, 25 bp, Rattus norvegicus
aacgagctgaggagtcgcccgtgcc

SEQ ID NO: 550359 - DNA, 25 bp, Rattus norvegicus
cacaagttcaccaggccgctctggt

SEQ ID NO: 550360 - DNA, 25 bp, Rattus norvegicus
tggtgccaagcttcctccggcatgc

SEQ ID NO: 550361 - DNA, 25 bp, Rattus norvegicus
ccggcatgccgcatcagaaggcatt

SEQ ID NO: 550362 - DNA, 25 bp, Rattus norvegicus
agaaggcattctgcagcgcgcaccc

SEQ ID NO: 550363 - DNA, 25 bp, Rattus norvegicus
ggagtcgcccgtgcccacaagttca

SEQ ID NO: 550364 - DNA, 25 bp, Rattus norvegicus
aagtcacccagaggggagccactgc

SEQ ID NO: 550365 - DNA, 25 bp, Rattus norvegicus
tgcttttcacggtacagacgggacg

SEQ ID NO: 550366 - DNA, 25 bp, Rattus norvegicus
ggatcctgaagagaaacgcagctgc

SEQ ID NO: 550367 - DNA, 25 bp, Rattus norvegicus
tgcaacttaactgaggacgccggga

SEQ ID NO: 550368 - DNA, 25 bp, Rattus norvegicus
acgccgggaaaaggcgcctctcaca

SEQ ID NO: 550369 - DNA, 25 bp, Rattus norvegicus
tcacagccgcctaggagtttgcagc

SEQ ID NO: 550370 - DNA, 25 bp, Rattus norvegicus
aagtatacttatggccgtcgcggtg

SEQ ID NO: 550371 - DNA, 25 bp, Rattus norvegicus
ttcgctcaatcgctgagcggccggc

SEQ ID NO: 550372 - DNA, 25 bp, Rattus norvegicus
tttctcacggccaagtcacccagag

SEQ ID NO: 550373 - DNA, 25 bp, Rattus norvegicus
tcctgaccgccactcctattggttg

SEQ ID NO: 550374 - DNA, 25 bp, Rattus norvegicus
ctcggggcaatgtctttgcttttca

SEQ ID NO: 550375 - DNA, 25 bp, Rattus norvegicus
tttgcagctcgcatgcacctggcga

SEQ ID NO: 550376 - DNA, 25 bp, Rattus norvegicus
gcgggctcctttcactttctcacgg

SEQ ID NO: 550377 - DNA, 25 bp, Rattus norvegicus
agagctcgctagtctccagcctgga

SEQ ID NO: 550378 - DNA, 25 bp, Rattus norvegicus
gtttccagtactcacacaacctgag

SEQ ID NO: 550379 - DNA, 25 bp, Rattus norvegicus
tgcgagcgcaggttcacgcagtccg

SEQ ID NO: 550380 - DNA, 25 bp, Rattus norvegicus
cacttccgcgagcaggatggcatcc

SEQ ID NO: 550381 - DNA, 25 bp, Rattus norvegicus
gatggcatccgcagcaagcctgccg

SEQ ID NO: 550382 - DNA, 25 bp, Rattus norvegicus
acgccgtggtgcacacccgtgagaa

SEQ ID NO: 550383 - DNA, 25 bp, Rattus norvegicus
cccagtgcggcaagagtttccagta

SEQ ID NO: 550384 - DNA, 25 bp, Rattus norvegicus
gaggactcactcaggggagaagccc

SEQ ID NO: 550385 - DNA, 25 bp, Rattus norvegicus
tcaagcgccacgagaggactcactc

SEQ ID NO: 550386 - DNA, 25 bp, Rattus norvegicus
tgtacaccctcaagcgccacgagag

SEQ ID NO: 550387 - DNA, 25 bp, Rattus norvegicus
agactttctcctgcatgtacaccct

SEQ ID NO: 550388 - DNA, 25 bp, Rattus norvegicus
ccacgtgctctctgtgtgggaagac

SEQ ID NO: 550389 - DNA, 25 bp, Rattus norvegicus
tgtcaatgtgcccacgtgctctctg

SEQ ID NO: 550390 - DNA, 25 bp, Rattus norvegicus
aagcctgccgccgatgtcaatgtgc

SEQ ID NO: 550391 - DNA, 25 bp, Rattus norvegicus
catgcctgcaagtggtgcgagcgca

SEQ ID NO: 550392 - DNA, 25 bp, Rattus norvegicus
acaccttggggtgtccagtcgttcg

SEQ ID NO: 550393 - DNA, 25 bp, Rattus norvegicus
cagtcgttcgttggcttagcgtctc

SEQ ID NO: 550394 - DNA, 25 bp, Rattus norvegicus
catttgcgggttatcctaaaagccg

SEQ ID NO: 550395 - DNA, 25 bp, Rattus norvegicus
cggcacatctggctgaaacatttgc

SEQ ID NO: 550396 - DNA, 25 bp, Rattus norvegicus
tctggctccaagagcggcacatctg

SEQ ID NO: 550397 - DNA, 25 bp, Rattus norvegicus
gcagttgttttaacttctggctcca

SEQ ID NO: 550398 - DNA, 25 bp, Rattus norvegicus
cgtctcatctcgagagcagttgttt

SEQ ID NO: 550399 - DNA, 25 bp, Rattus norvegicus
caatgaaagtggttagcgtgctcga

SEQ ID NO: 550400 - DNA, 25 bp, Rattus norvegicus
cgcgctgtaaggaaacaatgaaagt

SEQ ID NO: 550401 - DNA, 25 bp, Rattus norvegicus
tctcctagcaccacgcgctgtaagg

SEQ ID NO: 550402 - DNA, 25 bp, Rattus norvegicus
ggcaccaagatgacgcctctcctag

SEQ ID NO: 550403 - DNA, 25 bp, Rattus norvegicus
ccagcagtaaggcaccaagatgacg

SEQ ID NO: 550404 - DNA, 25 bp, Rattus norvegicus
tgctcgagtggagtgcgtctcatct

SEQ ID NO: 550405 - DNA, 25 bp, Rattus norvegicus
gtatttccggctgagctcgtccctc

SEQ ID NO: 550406 - DNA, 25 bp, Rattus norvegicus
aaaaggaccctagtccgctccagtg

SEQ ID NO: 550407 - DNA, 25 bp, Rattus norvegicus
gaacctcaacttaactgctgcggga

SEQ ID NO: 550408 - DNA, 25 bp, Rattus norvegicus
gactcggcaggagaacagaacctca

SEQ ID NO: 550409 - DNA, 25 bp, Rattus norvegicus
ctgctctcagagatcgacatggctc

SEQ ID NO: 550410 - DNA, 25 bp, Rattus norvegicus
gcagtcgccgttcggcaaggaagta

SEQ ID NO: 550411 - DNA, 25 bp, Rattus norvegicus
ctcacctggcaacggcacacgatgt

SEQ ID NO: 550412 - DNA, 25 bp, Rattus norvegicus
agagtcaccggaacgtcacccgaga

SEQ ID NO: 550413 - DNA, 25 bp, Rattus norvegicus
gtcgcgcatcttcctggttcttcca

SEQ ID NO: 550414 - DNA, 25 bp, Rattus norvegicus
tctaacccgagtccggagcaggcct

SEQ ID NO: 550415 - DNA, 25 bp, Rattus norvegicus
cccgcagcggattctaatagccaca

SEQ ID NO: 550416 - DNA, 25 bp, Rattus norvegicus
tcggatcctgtgagccctaaggctt

SEQ ID NO: 550417 - DNA, 25 bp, Rattus norvegicus
gccgacgttctgtgtgcctaagcct

SEQ ID NO: 550418 - DNA, 25 bp, Rattus norvegicus
cgaaatgcagctcaaacgtcgcgca

SEQ ID NO: 550419 - DNA, 25 bp, Rattus norvegicus
ggggaccctaaacagtggcatcgcc

SEQ ID NO: 550420 - DNA, 25 bp, Rattus norvegicus
gggatcacatccctggcgctttttt

SEQ ID NO: 550421 - DNA, 25 bp, Rattus norvegicus
ccctgtcgctctggaaagggtaatg

SEQ ID NO: 550422 - DNA, 25 bp, Rattus norvegicus
ggggaaacttaacctcggtgctgca

SEQ ID NO: 550423 - DNA, 25 bp, Rattus norvegicus
ctccggaagtgacgtcctcaaagcg

SEQ ID NO: 550424 - DNA, 25 bp, Rattus norvegicus
cagcgtccaaggctagcgtcttgga

SEQ ID NO: 550425 - DNA, 25 bp, Rattus norvegicus
ccatggctcacacggccacagaatg

SEQ ID NO: 550426 - DNA, 25 bp, Rattus norvegicus
taggcctgatccaggccgccagctg

SEQ ID NO: 550427 - DNA, 25 bp, Rattus norvegicus
ctgccggaagttgcagcctgccttt

SEQ ID NO: 550428 - DNA, 25 bp, Rattus norvegicus
tcctgttagagaacaagcccggctg

SEQ ID NO: 550429 - DNA, 25 bp, Rattus norvegicus
tctaattgtggcttgatgggcaaaa

SEQ ID NO: 550430 - DNA, 25 bp, Rattus norvegicus
ccatgggacctgaacccgtttgata

SEQ ID NO: 550431 - DNA, 25 bp, Rattus norvegicus
cccgtttgatattcatgtcctgtta

SEQ ID NO: 550432 - DNA, 25 bp, Rattus norvegicus
ggccaccagaggaaaccctgtcgct

SEQ ID NO: 550433 - DNA, 25 bp, Rattus norvegicus
gcgtcgaggccctaaccatggctca

SEQ ID NO: 550434 - DNA, 25 bp, Rattus norvegicus
tgctgcacgccaccgcgccgcggac

SEQ ID NO: 550435 - DNA, 25 bp, Rattus norvegicus
ccgcgcctccgccatgggctggccc

SEQ ID NO: 550436 - DNA, 25 bp, Rattus norvegicus
ttctctagcagctcgtgctgcacgc

SEQ ID NO: 550437 - DNA, 25 bp, Rattus norvegicus
accttctctagcagctcgtgctgca

SEQ ID NO: 550438 - DNA, 25 bp, Rattus norvegicus
ctgcaggcgcgccaccttctctagc

SEQ ID NO: 550439 - DNA, 25 bp, Rattus norvegicus
cgccgccagcaccagaagcccaagc

SEQ ID NO: 550440 - DNA, 25 bp, Rattus norvegicus
gaacttgcccttcctccggcgcgcc

SEQ ID NO: 550441 - DNA, 25 bp, Rattus norvegicus
aggcgagcctgggagtcccctagtc

SEQ ID NO: 550442 - DNA, 25 bp, Rattus norvegicus
tctgtagcagcctctgcaggccggg

SEQ ID NO: 550443 - DNA, 25 bp, Rattus norvegicus
cagcctctgtagcagcctctgcagg

SEQ ID NO: 550444 - DNA, 25 bp, Rattus norvegicus
agcgccgccgccaagtcgccagcct

SEQ ID NO: 550445 - DNA, 25 bp, Rattus norvegicus
tcgccgtaagtagcgccgccgccaa

SEQ ID NO: 550446 - DNA, 25 bp, Rattus norvegicus
agcgggatctcctccaggccctcgg

SEQ ID NO: 550447 - DNA, 25 bp, Rattus norvegicus
gggccgcgtgaacttgcccttcctc

SEQ ID NO: 550448 - DNA, 25 bp, Rattus norvegicus
aggaaggcacttgccgcctgacgca

SEQ ID NO: 550449 - DNA, 25 bp, Rattus norvegicus
tagcgactacttgcacccatggctg

SEQ ID NO: 550450 - DNA, 25 bp, Rattus norvegicus
cggtggagcttctctaggttgtctc

SEQ ID NO: 550451 - DNA, 25 bp, Rattus norvegicus
gcgaagtttctcgatgctccttgtc

SEQ ID NO: 550452 - DNA, 25 bp, Rattus norvegicus
gcacaacggttggaaatggcggtta

SEQ ID NO: 550453 - DNA, 25 bp, Rattus norvegicus
gccctctcggaggacaaagcagcgc

SEQ ID NO: 550454 - DNA, 25 bp, Rattus norvegicus
ccaaagccaggacaaaggacacgta

SEQ ID NO: 550455 - DNA, 25 bp, Rattus norvegicus
gcggcgagctatttttaacgttcta

SEQ ID NO: 550456 - DNA, 25 bp, Rattus norvegicus
ggcgactcggtttcctagacctatc

SEQ ID NO: 550457 - DNA, 25 bp, Rattus norvegicus
gggcccaagcgacacacacgttctg

SEQ ID NO: 550458 - DNA, 25 bp, Rattus norvegicus
cgcctgctgaactggctgaaacttg

SEQ ID NO: 550459 - DNA, 25 bp, Rattus norvegicus
gtctcctcttgtgttccattcctga

SEQ ID NO: 550460 - DNA, 25 bp, Rattus norvegicus
ccacgagccggagaaaaaggtaatg

SEQ ID NO: 550461 - DNA, 25 bp, Rattus norvegicus
taacgttctaaatctgagggccgga

SEQ ID NO: 550462 - DNA, 25 bp, Rattus norvegicus
agaggcgccgcttcttgagctcctc

SEQ ID NO: 550463 - DNA, 25 bp, Rattus norvegicus
caccgtcaccgcgaagagcgaggtg

SEQ ID NO: 550464 - DNA, 25 bp, Rattus norvegicus
acatacataatggaggcgccgccgg

SEQ ID NO: 550465 - DNA, 25 bp, Rattus norvegicus
cccggcgcccgacatacataatgga

SEQ ID NO: 550466 - DNA, 25 bp, Rattus norvegicus
ccgcctggtgtcgaacggcgccaat

SEQ ID NO: 550467 - DNA, 25 bp, Rattus norvegicus
ctgagtgctgctgcagaacggaccc

SEQ ID NO: 550468 - DNA, 25 bp, Rattus norvegicus
cgacaccttcagcttcttgacatta

SEQ ID NO: 550469 - DNA, 25 bp, Rattus norvegicus
ggtcgtcgccgttctcgtcttccga

SEQ ID NO: 550470 - DNA, 25 bp, Rattus norvegicus
ccttgaggcccttgtctgagaggcg

SEQ ID NO: 550471 - DNA, 25 bp, Rattus norvegicus
gatccatgagatcggccttgaggcc

SEQ ID NO: 550472 - DNA, 25 bp, Rattus norvegicus
cggcctggagtcgatccatgagatc

SEQ ID NO: 550473 - DNA, 25 bp, Rattus norvegicus
atctggtcgccgtccagagcggcaa

SEQ ID NO: 550474 - DNA, 25 bp, Rattus norvegicus
ctgctgctggagatagctgagtgct

SEQ ID NO: 550475 - DNA, 25 bp, Rattus norvegicus
cttgacattaacaggcgaagaactc

SEQ ID NO: 550476 - DNA, 25 bp, Rattus norvegicus
acaggcgggtgtgcgcattgcactt

SEQ ID NO: 550477 - DNA, 25 bp, Rattus norvegicus
tgatgcccgcttccgcgacagatgc

SEQ ID NO: 550478 - DNA, 25 bp, Rattus norvegicus
cagcccacttgacaactgcgcgggg

SEQ ID NO: 550479 - DNA, 25 bp, Rattus norvegicus
gggccaggcaccagcccacttgaca

SEQ ID NO: 550480 - DNA, 25 bp, Rattus norvegicus
cacttgacaactgcgcggggcccag

SEQ ID NO: 550481 - DNA, 25 bp, Rattus norvegicus
cacttcctgggaacggccagggtgg

SEQ ID NO: 550482 - DNA, 25 bp, Rattus norvegicus
tgtgcgcattgcacttcctgggaac

SEQ ID NO: 550483 - DNA, 25 bp, Rattus norvegicus
acaggccccggggaatcgtgagaca

SEQ ID NO: 550484 - DNA, 25 bp, Rattus norvegicus
cgtccacgccgcgtcacgtgagcgc

SEQ ID NO: 550485 - DNA, 25 bp, Rattus norvegicus
agcgcggtggccaagcacagccacc

SEQ ID NO: 550486 - DNA, 25 bp, Rattus norvegicus
gcacagccacctccgccctgcttgc

SEQ ID NO: 550487 - DNA, 25 bp, Rattus norvegicus
ccctgcttgccgcacgggagggact

SEQ ID NO: 550488 - DNA, 25 bp, Rattus norvegicus
agggactcgtgatgcccgcttccgc

SEQ ID NO: 550489 - DNA, 25 bp, Rattus norvegicus
cccgcttccgcgacagatgcttacg

SEQ ID NO: 550490 - DNA, 25 bp, Rattus norvegicus
gcgctggagcggtgcttaagaaaca

SEQ ID NO: 550491 - DNA, 25 bp, Rattus norvegicus
cggctcggggccttattaataaatg

SEQ ID NO: 550492 - DNA, 25 bp, Rattus norvegicus
cccacgaaatcactttaaaggcaga

SEQ ID NO: 550493 - DNA, 25 bp, Rattus norvegicus
cctcatggaggacagaagttggcgc

SEQ ID NO: 550494 - DNA, 25 bp, Rattus norvegicus
gcccgggaggctaataatggcgtcc

SEQ ID NO: 550495 - DNA, 25 bp, Rattus norvegicus
agcgcagccaggtctccatcttgag

SEQ ID NO: 550496 - DNA, 25 bp, Rattus norvegicus
caggcgacgggctccgcaccaagat

SEQ ID NO: 550497 - DNA, 25 bp, Rattus norvegicus
cagaagttggcgctagaacctggcg

SEQ ID NO: 550498 - DNA, 25 bp, Rattus norvegicus
tacgtccttgacagtcgcaaccagg

SEQ ID NO: 550499 - DNA, 25 bp, Rattus norvegicus
accgggttctgaggcgcacctgaca

SEQ ID NO: 550500 - DNA, 25 bp, Rattus norvegicus
ttccctgagtcgcagactggctctg

SEQ ID NO: 550501 - DNA, 25 bp, Rattus norvegicus
aataatggcgtccttgtccctggtc

SEQ ID NO: 550502 - DNA, 25 bp, Rattus norvegicus
agaacgccggcctcagttcttgggg

SEQ ID NO: 550503 - DNA, 25 bp, Rattus norvegicus
cgcagggtttgtgatgggatctccc

SEQ ID NO: 550504 - DNA, 25 bp, Rattus norvegicus
ccatctggctgtggaagctcctggt

SEQ ID NO: 550505 - DNA, 25 bp, Rattus norvegicus
tccagtggagctactgggcggtctt

SEQ ID NO: 550506 - DNA, 25 bp, Rattus norvegicus
cgtctggacggcatcatccagtgga

SEQ ID NO: 550507 - DNA, 25 bp, Rattus norvegicus
gttcctcatttatgcctgcttgctg

SEQ ID NO: 550508 - DNA, 25 bp, Rattus norvegicus
ggcagagcagccttcgccatgaacc

SEQ ID NO: 550509 - DNA, 25 bp, Rattus norvegicus
cggatgcccatctagaggcagagca

SEQ ID NO: 550510 - DNA, 25 bp, Rattus norvegicus
ccggaccacgtgattgcgcgcacgt

SEQ ID NO: 550511 - DNA, 25 bp, Rattus norvegicus
ccgagctgtgatctggagtctcctc

SEQ ID NO: 550512 - DNA, 25 bp, Rattus norvegicus
aagctcctggtcatcgtgggcgcct

SEQ ID NO: 550513 - DNA, 25 bp, Rattus norvegicus
tgggcaccaaccctagcctgagcta

SEQ ID NO: 550514 - DNA, 25 bp, Rattus norvegicus
tccaggaagcgtcctccggaggtct

SEQ ID NO: 550515 - DNA, 25 bp, Rattus norvegicus
gagtctcctccacacagcgggcgga

SEQ ID NO: 550516 - DNA, 25 bp, Rattus norvegicus
cggaggtctcggctagctcacagcc

SEQ ID NO: 550517 - DNA, 25 bp, Rattus norvegicus
gataccgcacgcatcgcggcgtcgg

SEQ ID NO: 550518 - DNA, 25 bp, Rattus norvegicus
ccacatgctgctttgaggctgataa

SEQ ID NO: 550519 - DNA, 25 bp, Rattus norvegicus
tcgctttggaggctacgaaatatcc

SEQ ID NO: 550520 - DNA, 25 bp, Rattus norvegicus
ttttgaccttctcgcctcgctttgg

SEQ ID NO: 550521 - DNA, 25 bp, Rattus norvegicus
ggaaacttccacagtgttctcaaca

SEQ ID NO: 550522 - DNA, 25 bp, Rattus norvegicus
tcgcgttgaaattggaagtaggaac

SEQ ID NO: 550523 - DNA, 25 bp, Rattus norvegicus
cggcagatatgatcgcgttgaaatt

SEQ ID NO: 550524 - DNA, 25 bp, Rattus norvegicus
ccctaaggtcttcggcagatatgat

SEQ ID NO: 550525 - DNA, 25 bp, Rattus norvegicus
cagaatacagatgcggctgcagccg

SEQ ID NO: 550526 - DNA, 25 bp, Rattus norvegicus
gcggcacctaggcagaatacagatg

SEQ ID NO: 550527 - DNA, 25 bp, Rattus norvegicus
gcgacgatattttctgcggcaccta

SEQ ID NO: 550528 - DNA, 25 bp, Rattus norvegicus
ctttgaggctgataagccgcgcgta

SEQ ID NO: 550529 - DNA, 25 bp, Rattus norvegicus
gtccatttcacctggccacatgctg

SEQ ID NO: 550530 - DNA, 25 bp, Rattus norvegicus
gggctttacgggctcgtccatttca

SEQ ID NO: 550531 - DNA, 25 bp, Rattus norvegicus
ccgcgcgtagctaatggcgacgata

SEQ ID NO: 550532 - DNA, 25 bp, Rattus norvegicus
ggtgctatcacttctggggtccatt

SEQ ID NO: 550533 - DNA, 25 bp, Rattus norvegicus
cctttgattacctgcggcaccgggt

SEQ ID NO: 550534 - DNA, 25 bp, Rattus norvegicus
cagtatttcgggacttgcaggcaga

SEQ ID NO: 550535 - DNA, 25 bp, Rattus norvegicus
agctcgcctggctaccggaatgtct

SEQ ID NO: 550536 - DNA, 25 bp, Rattus norvegicus
cgtccacgcggagataggttcccag

SEQ ID NO: 550537 - DNA, 25 bp, Rattus norvegicus
cggtctccaccaggggcaagaaata

SEQ ID NO: 550538 - DNA, 25 bp, Rattus norvegicus
tctggaagagccaccatgaattcgg

SEQ ID NO: 550539 - DNA, 25 bp, Rattus norvegicus
gtgggagcatttagaccctttcctc

SEQ ID NO: 550540 - DNA, 25 bp, Rattus norvegicus
cgccttctgggttggcagacctttt

SEQ ID NO: 550541 - DNA, 25 bp, Rattus norvegicus
cccgagtctggatccttatattttg

SEQ ID NO: 550542 - DNA, 25 bp, Rattus norvegicus
agcgatctggatgtgaccgcgaaga

SEQ ID NO: 550543 - DNA, 25 bp, Rattus norvegicus
gccctgcgcgcaactgtcaagagaa

SEQ ID NO: 550544 - DNA, 25 bp, Rattus norvegicus
acggcgcatattggctcggcgacac

SEQ ID NO: 550545 - DNA, 25 bp, Rattus norvegicus
cagaccttttggatgtagccttgtg

SEQ ID NO: 550546 - DNA, 25 bp, Rattus norvegicus
gtcaatgggcgcatctcggaactgc

SEQ ID NO: 550547 - DNA, 25 bp, Rattus norvegicus
cagtgggcacggtagtgataacagc

SEQ ID NO: 550548 - DNA, 25 bp, Rattus norvegicus
agtgataacagcagcgtcctgagcg

SEQ ID NO: 550549 - DNA, 25 bp, Rattus norvegicus
tctgggctggcttccaaactgcctt

SEQ ID NO: 550550 - DNA, 25 bp, Rattus norvegicus
cacggaggaaaagcccgcagccgcc

SEQ ID NO: 550551 - DNA, 25 bp, Rattus norvegicus
gggcgcatctcggaactgctccagg

SEQ ID NO: 550552 - DNA, 25 bp, Rattus norvegicus
tttaagagccgtcaatgggcgcatc

SEQ ID NO: 550553 - DNA, 25 bp, Rattus norvegicus
ggaaacacatgtcctggtccacgca

SEQ ID NO: 550554 - DNA, 25 bp, Rattus norvegicus
agccgcaccgctgcagcagtgggca

SEQ ID NO: 550555 - DNA, 25 bp, Rattus norvegicus
tcgctcagcaggaaccggggctctg

SEQ ID NO: 550556 - DNA, 25 bp, Rattus norvegicus
ctgccctcgccctacagcaagatca

SEQ ID NO: 550557 - DNA, 25 bp, Rattus norvegicus
ttccaaactgcctttaagagccgtc

SEQ ID NO: 550558 - DNA, 25 bp, Rattus norvegicus
ggtccacgcagtcgctcagcaggaa

SEQ ID NO: 550559 - DNA, 25 bp, Rattus norvegicus
gcccagcgggaaacacatgtcctgg

SEQ ID NO: 550560 - DNA, 25 bp, Rattus norvegicus
cggtcggcagtcgtgaacttttcca

SEQ ID NO: 550561 - DNA, 25 bp, Rattus norvegicus
ccctcggcttgagtctcgtgttttc

SEQ ID NO: 550562 - DNA, 25 bp, Rattus norvegicus
agcgatcgcaaacgacgccacgact

SEQ ID NO: 550563 - DNA, 25 bp, Rattus norvegicus
tgcgtcctgcgcttgcgtacaccag

SEQ ID NO: 550564 - DNA, 25 bp, Rattus norvegicus
agagccacgcgccagggctcaggct

SEQ ID NO: 550565 - DNA, 25 bp, Rattus norvegicus
tctcgtgttttctgactgcgcgcct

SEQ ID NO: 550566 - DNA, 25 bp, Rattus norvegicus
actcgagcggggtccctcggcttga

SEQ ID NO: 550567 - DNA, 25 bp, Rattus norvegicus
tccacacctcagactcgagcggggt

SEQ ID NO: 550568 - DNA, 25 bp, Rattus norvegicus
gaacctccatcctttctcagctcca

SEQ ID NO: 550569 - DNA, 25 bp, Rattus norvegicus
tcggcagtcgtgaacttttccacct

SEQ ID NO: 550570 - DNA, 25 bp, Rattus norvegicus
tgctcacagtgtaagccaaggggtc

SEQ ID NO: 550571 - DNA, 25 bp, Rattus norvegicus
ccaggaggcagcgatcgcaaacgac

SEQ ID NO: 550572 - DNA, 25 bp, Rattus norvegicus
cagggctcaggctccgtacctaccc

SEQ ID NO: 550573 - DNA, 25 bp, Rattus norvegicus
tgttttctgactgcgcgcctgcgtc

SEQ ID NO: 550574 - DNA, 25 bp, Rattus norvegicus
ctctccgtggcagcggtcgtatgtt

SEQ ID NO: 550575 - DNA, 25 bp, Rattus norvegicus
ggctccagcactccgtgcatgctgt

SEQ ID NO: 550576 - DNA, 25 bp, Rattus norvegicus
gtgccggaggagacacgcactttct

SEQ ID NO: 550577 - DNA, 25 bp, Rattus norvegicus
acacgcactttctgaggccagggcc

SEQ ID NO: 550578 - DNA, 25 bp, Rattus norvegicus
acgcgcctgcgcagcacagtcgaag

SEQ ID NO: 550579 - DNA, 25 bp, Rattus norvegicus
cagtcgaaggccgagacaggaagtc

SEQ ID NO: 550580 - DNA, 25 bp, Rattus norvegicus
actccgtgcatgctgtcagtgttcc

SEQ ID NO: 550581 - DNA, 25 bp, Rattus norvegicus
gggtccgcctctctgagatcagctc

SEQ ID NO: 550582 - DNA, 25 bp, Rattus norvegicus
tctgagatcagctcggcagaccgcg

SEQ ID NO: 550583 - DNA, 25 bp, Rattus norvegicus
ttgccttgacaaccagctctccgtg

SEQ ID NO: 550584 - DNA, 25 bp, Rattus norvegicus
gtcgtatgttcgagtcccagctgtg

SEQ ID NO: 550585 - DNA, 25 bp, Rattus norvegicus
tgctgctcctggtgtctgtctcaag

SEQ ID NO: 550586 - DNA, 25 bp, Rattus norvegicus
gtctcaagtgcgcttctgcctcaga

SEQ ID NO: 550587 - DNA, 25 bp, Rattus norvegicus
gcagaccgcgttgccttgacaacca

SEQ ID NO: 550588 - DNA, 25 bp, Rattus norvegicus
ctcggatgcccaggtgagactagca

SEQ ID NO: 550589 - DNA, 25 bp, Rattus norvegicus
tcgaaatcacaatcaggcaacggtt

SEQ ID NO: 550590 - DNA, 25 bp, Rattus norvegicus
cttctactccgcgtcggtgtctctg

SEQ ID NO: 550591 - DNA, 25 bp, Rattus norvegicus
aacagtgtagcctctgcgaagaaca

SEQ ID NO: 550592 - DNA, 25 bp, Rattus norvegicus
gcgaagaacacggagcaccacatca

SEQ ID NO: 550593 - DNA, 25 bp, Rattus norvegicus
tgcacatacttcacggcctcactag

SEQ ID NO: 550594 - DNA, 25 bp, Rattus norvegicus
tggcgcatgcgaacgacctagcctc

SEQ ID NO: 550595 - DNA, 25 bp, Rattus norvegicus
ctagcctcggtgctttcttcactcg

SEQ ID NO: 550596 - DNA, 25 bp, Rattus norvegicus
caggctcctgtgagtggactctccg

SEQ ID NO: 550597 - DNA, 25 bp, Rattus norvegicus
gtaggctctgatcgactcttgtgtg

SEQ ID NO: 550598 - DNA, 25 bp, Rattus norvegicus
ctagaggtgtctgattctccagtgc

SEQ ID NO: 550599 - DNA, 25 bp, Rattus norvegicus
tgtgtgtccacgaggacgactcctc

SEQ ID NO: 550600 - DNA, 25 bp, Rattus norvegicus
tctctagccgcgatctcactctatg

SEQ ID NO: 550601 - DNA, 25 bp, Rattus norvegicus
aggtcagagaagctacgccggttcc

SEQ ID NO: 550602 - DNA, 25 bp, Rattus norvegicus
ctagctgcgccgacagcggccaaga

SEQ ID NO: 550603 - DNA, 25 bp, Rattus norvegicus
ggtgttcggcgcctctggcttcacc

SEQ ID NO: 550604 - DNA, 25 bp, Rattus norvegicus
actgagaggatacgacgcctcgggc

SEQ ID NO: 550605 - DNA, 25 bp, Rattus norvegicus
gcttccaagctccagcgtgggcgac

SEQ ID NO: 550606 - DNA, 25 bp, Rattus norvegicus
tgctggagaaggctgcccagaagct

SEQ ID NO: 550607 - DNA, 25 bp, Rattus norvegicus
tgcgcctgcatcgagccctgcggga

SEQ ID NO: 550608 - DNA, 25 bp, Rattus norvegicus
gcttcaccggccagttcgtgacgga

SEQ ID NO: 550609 - DNA, 25 bp, Rattus norvegicus
ctgcccagaagctgggtaacgcggc

SEQ ID NO: 550610 - DNA, 25 bp, Rattus norvegicus
cagaggcctttccagctggtggtgt

SEQ ID NO: 550611 - DNA, 25 bp, Rattus norvegicus
ctcgcagtggactcgtcatggcgac

SEQ ID NO: 550612 - DNA, 25 bp, Rattus norvegicus
gctcctgtcagccagcgaggcggac

SEQ ID NO: 550613 - DNA, 25 bp, Rattus norvegicus
ctgccctggtcctccttcaggggaa

SEQ ID NO: 550614 - DNA, 25 bp, Rattus norvegicus
aagcgggaataaccggcctgccctg

SEQ ID NO: 550615 - DNA, 25 bp, Rattus norvegicus
cagatggcctcggagcagagctccc

SEQ ID NO: 550616 - DNA, 25 bp, Rattus norvegicus
agggtctctacgcttcctaggagta

SEQ ID NO: 550617 - DNA, 25 bp, Rattus norvegicus
tccggcctaatctggtggcggttcc

SEQ ID NO: 550618 - DNA, 25 bp, Rattus norvegicus
atttacttacagcagggtctctacg

SEQ ID NO: 550619 - DNA, 25 bp, Rattus norvegicus
aacctctccgccgagggaaggatcg

SEQ ID NO: 550620 - DNA, 25 bp, Rattus norvegicus
gaccgtcacagcatctcccgggaga

SEQ ID NO: 550621 - DNA, 25 bp, Rattus norvegicus
ttatgtaactaacgcccgagcgctg

SEQ ID NO: 550622 - DNA, 25 bp, Rattus norvegicus
tgccggcacctaccgccaaggttat

SEQ ID NO: 550623 - DNA, 25 bp, Rattus norvegicus
gagactccactctgcggccatgtgc

SEQ ID NO: 550624 - DNA, 25 bp, Rattus norvegicus
tctcgagttaggctcgtcccggatg

SEQ ID NO: 550625 - DNA, 25 bp, Rattus norvegicus
gaaaaacttggagcgcctgcagttg

SEQ ID NO: 550626 - DNA, 25 bp, Rattus norvegicus
cgactcgatttactgggctggcacc

SEQ ID NO: 550627 - DNA, 25 bp, Rattus norvegicus
gcttctcagagctacggtccggcct

SEQ ID NO: 550628 - DNA, 25 bp, Rattus norvegicus
cactacaccgtgacggctcggggtc

SEQ ID NO: 550629 - DNA, 25 bp, Rattus norvegicus
agctgcttccgtgcagaccgtcaca

SEQ ID NO: 550630 - DNA, 25 bp, Rattus norvegicus
cagacggcatctccgcagacgtgga

SEQ ID NO: 550631 - DNA, 25 bp, Rattus norvegicus
ccgtgtctcactgggccatcgcgtt

SEQ ID NO: 550632 - DNA, 25 bp, Rattus norvegicus
atcgcgttccacacccgagtcgtcc

SEQ ID NO: 550633 - DNA, 25 bp, Rattus norvegicus
agttcccagcccgtgtctcactggg

SEQ ID NO: 550634 - DNA, 25 bp, Rattus norvegicus
acagtggcgcagttcccagcccgtg

SEQ ID NO: 550635 - DNA, 25 bp, Rattus norvegicus
ctccgcagacgtggaggaaaaggcc

SEQ ID NO: 550636 - DNA, 25 bp, Rattus norvegicus
ggcatctccgcagacgtggaggaaa

SEQ ID NO: 550637 - DNA, 25 bp, Rattus norvegicus
gtgcgggacagacggcatctccgca

SEQ ID NO: 550638 - DNA, 25 bp, Rattus norvegicus
tgtcttaaagcggttggaagcctag

SEQ ID NO: 550639 - DNA, 25 bp, Rattus norvegicus
tcttgtcttaaagcggttggaagcc

SEQ ID NO: 550640 - DNA, 25 bp, Rattus norvegicus
tggctgtcttgtcttaaagcggttg

SEQ ID NO: 550641 - DNA, 25 bp, Rattus norvegicus
gggagtggctgtcttgtcttaaagc

SEQ ID NO: 550642 - DNA, 25 bp, Rattus norvegicus
tcgggagtggctgtcttgtcttaaa

SEQ ID NO: 550643 - DNA, 25 bp, Rattus norvegicus
ggacagacggcatctccgcagacgt

SEQ ID NO: 550644 - DNA, 25 bp, Rattus norvegicus
agaagatgacgcgtcctcgccgcag

SEQ ID NO: 550645 - DNA, 25 bp, Rattus norvegicus
aagcaggactcgctgcagagcccta

SEQ ID NO: 550646 - DNA, 25 bp, Rattus norvegicus
ctggaagcaggactcgctgcagagc

SEQ ID NO: 550647 - DNA, 25 bp, Rattus norvegicus
tccgctggaagcaggactcgctgca

SEQ ID NO: 550648 - DNA, 25 bp, Rattus norvegicus
cgccgcagtccgctggaagcaggac

SEQ ID NO: 550649 - DNA, 25 bp, Rattus norvegicus
gctgccctccctttgccgcggagga

SEQ ID NO: 550650 - DNA, 25 bp, Rattus norvegicus
aagatgacgcgtcctcgccgcagtc

SEQ ID NO: 550651 - DNA, 25 bp, Rattus norvegicus
gaagccaggaagaagatgacgcgtc

SEQ ID NO: 550652 - DNA, 25 bp, Rattus norvegicus
cgaggctcggcgtgctccgagccga

SEQ ID NO: 550653 - DNA, 25 bp, Rattus norvegicus
ccaggaagaagatgacgcgtcctcg

SEQ ID NO: 550654 - DNA, 25 bp, Rattus norvegicus
cgctgcagagccctaggaagaaaga

SEQ ID NO: 550655 - DNA, 25 bp, Rattus norvegicus
ctaggaagaaagagctcggagccga

SEQ ID NO: 550656 - DNA, 25 bp, Rattus norvegicus
ccgcggaggactcgcccaggagcta

SEQ ID NO: 550657 - DNA, 25 bp, Rattus norvegicus
gactcgctgcagagccctaggaaga

SEQ ID NO: 550658 - DNA, 25 bp, Rattus norvegicus
cctgagccagatccgggacgggaaa

SEQ ID NO: 550659 - DNA, 25 bp, Rattus norvegicus
ttggctgagccgctgttagctgccc

SEQ ID NO: 550660 - DNA, 25 bp, Rattus norvegicus
ttctgtttaccttctggcccgcgtg

SEQ ID NO: 550661 - DNA, 25 bp, Rattus norvegicus
aaggtaggctcctccgtcagcaaca

SEQ ID NO: 550662 - DNA, 25 bp, Rattus norvegicus
agccttaccgggctgcaggaaggta

SEQ ID NO: 550663 - DNA, 25 bp, Rattus norvegicus
ttctgagactagcagcgggccggca

SEQ ID NO: 550664 - DNA, 25 bp, Rattus norvegicus
cacttgaacgtgttagaatgaaccc

SEQ ID NO: 550665 - DNA, 25 bp, Rattus norvegicus
aggccgcactctgtcacttgaacgt

SEQ ID NO: 550666 - DNA, 25 bp, Rattus norvegicus
ggaaacttgcaacccaggccgcact

SEQ ID NO: 550667 - DNA, 25 bp, Rattus norvegicus
tccttggctgaaagggaaacttgca

SEQ ID NO: 550668 - DNA, 25 bp, Rattus norvegicus
tggccctgaggctccttggctgaaa

SEQ ID NO: 550669 - DNA, 25 bp, Rattus norvegicus
gaaagggctgcaccgtaacctggcc

SEQ ID NO: 550670 - DNA, 25 bp, Rattus norvegicus
tggacgacgcacaggcccgctaaga

SEQ ID NO: 550671 - DNA, 25 bp, Rattus norvegicus
cccagtgccacaggacgtagtggga

SEQ ID NO: 550672 - DNA, 25 bp, Rattus norvegicus
agatgtctgctcacgatcctggcga

SEQ ID NO: 550673 - DNA, 25 bp, Rattus norvegicus
tacctgtactgggtggtgaacaccg

SEQ ID NO: 550674 - DNA, 25 bp, Rattus norvegicus
cggggccaaactcttacctgtactg

SEQ ID NO: 550675 - DNA, 25 bp, Rattus norvegicus
ctccgtgagaagagccaactggaca

SEQ ID NO: 550676 - DNA, 25 bp, Rattus norvegicus
atggtccagtctccgctccgtgaga

SEQ ID NO: 550677 - DNA, 25 bp, Rattus norvegicus
atcccacggctacacagcggtcagg

SEQ ID NO: 550678 - DNA, 25 bp, Rattus norvegicus
gccagctagcttgtacgtcccgtca

SEQ ID NO: 550679 - DNA, 25 bp, Rattus norvegicus
aggattcccaagtttcactcgactg

SEQ ID NO: 550680 - DNA, 25 bp, Rattus norvegicus
gggaacgcacctgccttctaggatt

SEQ ID NO: 550681 - DNA, 25 bp, Rattus norvegicus
cgattatctcctacccaccggagga

SEQ ID NO: 550682 - DNA, 25 bp, Rattus norvegicus
gtaaccacagagacggacacgatta

SEQ ID NO: 550683 - DNA, 25 bp, Rattus norvegicus
tcttaacgcagaacccgggagacta

SEQ ID NO: 550684 - DNA, 25 bp, Rattus norvegicus
ggaggacccatcattacccggcgcg

SEQ ID NO: 550685 - DNA, 25 bp, Rattus norvegicus
agagttccttccacgaagcgcggga

SEQ ID NO: 550686 - DNA, 25 bp, Rattus norvegicus
tcagaggcccagagctgctccctaa

SEQ ID NO: 550687 - DNA, 25 bp, Rattus norvegicus
tttacgccgcggacggagcgcctct

SEQ ID NO: 550688 - DNA, 25 bp, Rattus norvegicus
gatcagcgacaggtcccgggccgca

SEQ ID NO: 550689 - DNA, 25 bp, Rattus norvegicus
tccgagctctccatgcggcccgcaa

SEQ ID NO: 550690 - DNA, 25 bp, Rattus norvegicus
aagggcctcgctgcatccgagctct

SEQ ID NO: 550691 - DNA, 25 bp, Rattus norvegicus
acgcgagggcactcagacgcggtca

SEQ ID NO: 550692 - DNA, 25 bp, Rattus norvegicus
cttgcgcacgaagggcctcgctgca

SEQ ID NO: 550693 - DNA, 25 bp, Rattus norvegicus
caggggccgcaacctgaagcccaga

SEQ ID NO: 550694 - DNA, 25 bp, Rattus norvegicus
cagacgcggtcagaggcccagagct

SEQ ID NO: 550695 - DNA, 25 bp, Rattus norvegicus
agctgctccctaagctccttcgaag

SEQ ID NO: 550696 - DNA, 25 bp, Rattus norvegicus
ggacggagcgcctctcccaggctag

SEQ ID NO: 550697 - DNA, 25 bp, Rattus norvegicus
agttctgggccggacgcactgccgc

SEQ ID NO: 550698 - DNA, 25 bp, Rattus norvegicus
ctgttccgtcccttgggcggtgcca

SEQ ID NO: 550699 - DNA, 25 bp, Rattus norvegicus
ccgagatcgacgcaggggccgcaac

SEQ ID NO: 550700 - DNA, 25 bp, Rattus norvegicus
gagattcgactttcccaccgtcttc

SEQ ID NO: 550701 - DNA, 25 bp, Rattus norvegicus
agcagcgcacgacctggcggtgtcc

SEQ ID NO: 550702 - DNA, 25 bp, Rattus norvegicus
cactattttcgtcttccaaaagttg

SEQ ID NO: 550703 - DNA, 25 bp, Rattus norvegicus
ctgggagtctgagcaattgcaggta

SEQ ID NO: 550704 - DNA, 25 bp, Rattus norvegicus
ctgagcaattgcaggtaagcgtggc

SEQ ID NO: 550705 - DNA, 25 bp, Rattus norvegicus
gcaggtaagcgtggcggctccttcc

SEQ ID NO: 550706 - DNA, 25 bp, Rattus norvegicus
tggcccttgtctctgaaccctcttt

SEQ ID NO: 550707 - DNA, 25 bp, Rattus norvegicus
cccatctgtgctggggttcctctgg

SEQ ID NO: 550708 - DNA, 25 bp, Rattus norvegicus
gctgctccggggcttagcatgcccg

SEQ ID NO: 550709 - DNA, 25 bp, Rattus norvegicus
gaagaggggagattcgactttccca

SEQ ID NO: 550710 - DNA, 25 bp, Rattus norvegicus
ctacgggatcgcctagtccctgcgc

SEQ ID NO: 550711 - DNA, 25 bp, Rattus norvegicus
ctgcgccggtacattcagcctcgtt

SEQ ID NO: 550712 - DNA, 25 bp, Rattus norvegicus
gccggtacattcagcctcgttgcac

SEQ ID NO: 550713 - DNA, 25 bp, Rattus norvegicus
ttccggggtccgagcacagcacaga

SEQ ID NO: 550714 - DNA, 25 bp, Rattus norvegicus
cccagaggaagctgaggattctgca

SEQ ID NO: 550715 - DNA, 25 bp, Rattus norvegicus
gctgtgtactgctatgccctcaata

SEQ ID NO: 550716 - DNA, 25 bp, Rattus norvegicus
cgaaatcgtttatggagcttggcgc

SEQ ID NO: 550717 - DNA, 25 bp, Rattus norvegicus
taggccatgctgctccatcggcgcg

SEQ ID NO: 550718 - DNA, 25 bp, Rattus norvegicus
tgttcgaggcgcaaatccaggcaca

SEQ ID NO: 550719 - DNA, 25 bp, Rattus norvegicus
gcggacccagtactatggctgtgta

SEQ ID NO: 550720 - DNA, 25 bp, Rattus norvegicus
ggcacagacctctgctattcaagcg

SEQ ID NO: 550721 - DNA, 25 bp, Rattus norvegicus
gccctcaatagcctggtgatcatga

SEQ ID NO: 550722 - DNA, 25 bp, Rattus norvegicus
gtgatcatgaacagcaccaacgagc

SEQ ID NO: 550723 - DNA, 25 bp, Rattus norvegicus
ccaacgagctgaagagtggcagccc

SEQ ID NO: 550724 - DNA, 25 bp, Rattus norvegicus
ttcagccctgggagaggcgcctcct

SEQ ID NO: 550725 - DNA, 25 bp, Rattus norvegicus
ccgacggaggctgaatagtagcagc

SEQ ID NO: 550726 - DNA, 25 bp, Rattus norvegicus
tctgcagcgcgaattgcaaaatgtg

SEQ ID NO: 550727 - DNA, 25 bp, Rattus norvegicus
ctccaggactaagccgggagccgcg

SEQ ID NO: 550728 - DNA, 25 bp, Rattus norvegicus
agctcggttctcttggttgcactga

SEQ ID NO: 550729 - DNA, 25 bp, Rattus norvegicus
tttttctggatagcggcactgcctg

SEQ ID NO: 550730 - DNA, 25 bp, Rattus norvegicus
ctgcggggagcttcttcccttaacg

SEQ ID NO: 550731 - DNA, 25 bp, Rattus norvegicus
tctgcggatcgaacccttcctgcta

SEQ ID NO: 550732 - DNA, 25 bp, Rattus norvegicus
taaggccttctcgaatctgcggatc

SEQ ID NO: 550733 - DNA, 25 bp, Rattus norvegicus
actatgcactcgtcagggctaaggc

SEQ ID NO: 550734 - DNA, 25 bp, Rattus norvegicus
ccaactcctggggattgtattgcca

SEQ ID NO: 550735 - DNA, 25 bp, Rattus norvegicus
tgaaagccacggagcagtctgagtc

SEQ ID NO: 550736 - DNA, 25 bp, Rattus norvegicus
tgattcacagacgtccatttggggc

SEQ ID NO: 550737 - DNA, 25 bp, Rattus norvegicus
ttcccaaattgtcaacgtccgtgtg

SEQ ID NO: 550738 - DNA, 25 bp, Rattus norvegicus
tcctaatctccaacggggctcggga

SEQ ID NO: 550739 - DNA, 25 bp, Rattus norvegicus
ggcacctgccggatgctcctaatct

SEQ ID NO: 550740 - DNA, 25 bp, Rattus norvegicus
gagcagctcgctgaggtccagaaaa

SEQ ID NO: 550741 - DNA, 25 bp, Rattus norvegicus
gctttaattgtgtgcggaccggccc

SEQ ID NO: 550742 - DNA, 25 bp, Rattus norvegicus
aggggcagcgtgacactttgtgaca

SEQ ID NO: 550743 - DNA, 25 bp, Rattus norvegicus
gcaggggtcccttcttctcgcgaac

SEQ ID NO: 550744 - DNA, 25 bp, Rattus norvegicus
ttcttctcgcgaacctgcacgacca

SEQ ID NO: 550745 - DNA, 25 bp, Rattus norvegicus
cagtctcagcgtctttgtgcaaagg

SEQ ID NO: 550746 - DNA, 25 bp, Rattus norvegicus
agcgtctttgtgcaaaggctccatg

SEQ ID NO: 550747 - DNA, 25 bp, Rattus norvegicus
tttgtgcaaaggctccatggctgga

SEQ ID NO: 550748 - DNA, 25 bp, Rattus norvegicus
aaggctccatggctggacgcgctct

SEQ ID NO: 550749 - DNA, 25 bp, Rattus norvegicus
tccatggctggacgcgctctccagg

SEQ ID NO: 550750 - DNA, 25 bp, Rattus norvegicus
cgcccagggcaccagggcagacgac

SEQ ID NO: 550751 - DNA, 25 bp, Rattus norvegicus
gacactttgtgacagcgctccctcg

SEQ ID NO: 550752 - DNA, 25 bp, Rattus norvegicus
atgcgcccttctcaggaggccagtg

SEQ ID NO: 550753 - DNA, 25 bp, Rattus norvegicus
gcgtgacactttgtgacagcgctcc

SEQ ID NO: 550754 - DNA, 25 bp, Rattus norvegicus
ggcacgcaggggtcccttcttctcg

SEQ ID NO: 550755 - DNA, 25 bp, Rattus norvegicus
gcgcaatgcgcccttctcaggaggc

SEQ ID NO: 550756 - DNA, 25 bp, Rattus norvegicus
cgcacgcttgcggagaaccgacacg

SEQ ID NO: 550757 - DNA, 25 bp, Rattus norvegicus
tgccgtcgaggtccctgagggccac

SEQ ID NO: 550758 - DNA, 25 bp, Rattus norvegicus
cgcatggccatcatggtgcaggtgc

SEQ ID NO: 550759 - DNA, 25 bp, Rattus norvegicus
gactcgctccgcatggccatcatgg

SEQ ID NO: 550760 - DNA, 25 bp, Rattus norvegicus
gcaagaaatgcagcgagagtatccc

SEQ ID NO: 550761 - DNA, 25 bp, Rattus norvegicus
gggcgcgcctcttgcaagaaatgca

SEQ ID NO: 550762 - DNA, 25 bp, Rattus norvegicus
ttaccgagtggagtacgctaagagc

SEQ ID NO: 550763 - DNA, 25 bp, Rattus norvegicus
accgacacgttagcggagcggaccg

SEQ ID NO: 550764 - DNA, 25 bp, Rattus norvegicus
atctatcctgaacggaggcggctcc

SEQ ID NO: 550765 - DNA, 25 bp, Rattus norvegicus
gcgccgccaggcatcagcaatctat

SEQ ID NO: 550766 - DNA, 25 bp, Rattus norvegicus
ggcaatgagaccagcgcgcacaggc

SEQ ID NO: 550767 - DNA, 25 bp, Rattus norvegicus
ctgtcccttcccagaggcaatgaga

SEQ ID NO: 550768 - DNA, 25 bp, Rattus norvegicus
ggtggcgcctgtcagactcctcggc

SEQ ID NO: 550769 - DNA, 25 bp, Rattus norvegicus
aggccacggagaggctttaccgagt

SEQ ID NO: 550770 - DNA, 25 bp, Rattus norvegicus
agtaagtagcgtctcagagcagtcc

SEQ ID NO: 550771 - DNA, 25 bp, Rattus norvegicus
atcgcccgcccggttatgtaactcg

SEQ ID NO: 550772 - DNA, 25 bp, Rattus norvegicus
gctgctctcccggagcgactgctgt

SEQ ID NO: 550773 - DNA, 25 bp, Rattus norvegicus
agtccagcctgtcctgacggagtcg

SEQ ID NO: 550774 - DNA, 25 bp, Rattus norvegicus
cgtcgccgcctttgttatggtgtct

SEQ ID NO: 550775 - DNA, 25 bp, Rattus norvegicus
cttcccgccggttgcttgtccggag

SEQ ID NO: 550776 - DNA, 25 bp, Rattus norvegicus
gagctcgaccagttgcctgacgaga

SEQ ID NO: 550777 - DNA, 25 bp, Rattus norvegicus
gcctttgaaaaagcggcgcggctcg

SEQ ID NO: 550778 - DNA, 25 bp, Rattus norvegicus
gcgggccgcgagctcctcattcgaa

SEQ ID NO: 550779 - DNA, 25 bp, Rattus norvegicus
agcgaccaggaacccaggtctcgtc

SEQ ID NO: 550780 - DNA, 25 bp, Rattus norvegicus
tccctccgtgcaaagcgaccaggaa

SEQ ID NO: 550781 - DNA, 25 bp, Rattus norvegicus
gttacttcgtgcagagctccctccg

SEQ ID NO: 550782 - DNA, 25 bp, Rattus norvegicus
tggggagccgagtacacgttacttc

SEQ ID NO: 550783 - DNA, 25 bp, Rattus norvegicus
ggtctttctactcaggcgctgccgc

SEQ ID NO: 550784 - DNA, 25 bp, Rattus norvegicus
aaggcctctcaagagcgcttggatc

SEQ ID NO: 550785 - DNA, 25 bp, Rattus norvegicus
tcgtcccaagtgtgggccagactta

SEQ ID NO: 550786 - DNA, 25 bp, Rattus norvegicus
ggaataatcgcttccgctgacccgg

SEQ ID NO: 550787 - DNA, 25 bp, Rattus norvegicus
cagacgccgcgggaataatcgcttc

SEQ ID NO: 550788 - DNA, 25 bp, Rattus norvegicus
cctgcagttatagcggccaggagcc

SEQ ID NO: 550789 - DNA, 25 bp, Rattus norvegicus
tgcggccatcactccgggacgtttc

SEQ ID NO: 550790 - DNA, 25 bp, Rattus norvegicus
gccctctgcgaactgaagctgctgg

SEQ ID NO: 550791 - DNA, 25 bp, Rattus norvegicus
tgtgggccagacttagacagaaccc

SEQ ID NO: 550792 - DNA, 25 bp, Rattus norvegicus
actgcagctgctcggagctgaacga

SEQ ID NO: 550793 - DNA, 25 bp, Rattus norvegicus
agacgagctccagcaactgcagctg

SEQ ID NO: 550794 - DNA, 25 bp, Rattus norvegicus
catggtctgtcggaagacgagctcc

SEQ ID NO: 550795 - DNA, 25 bp, Rattus norvegicus
cagacgctcccgcaagtggatgtcg

SEQ ID NO: 550796 - DNA, 25 bp, Rattus norvegicus
acctgcgactgcgactcacctggat

SEQ ID NO: 550797 - DNA, 25 bp, Rattus norvegicus
acctggatccttgactcgggtagca

SEQ ID NO: 550798 - DNA, 25 bp, Rattus norvegicus
ttccatgggctagagtgggacaaga

SEQ ID NO: 550799 - DNA, 25 bp, Rattus norvegicus
ttgctgaggcgttacacctggttta

SEQ ID NO: 550800 - DNA, 25 bp, Rattus norvegicus
cccgcgtcgcctgatattgctgagg

SEQ ID NO: 550801 - DNA, 25 bp, Rattus norvegicus
tagaaccctggtttagcagcccgcg

SEQ ID NO: 550802 - DNA, 25 bp, Rattus norvegicus
tcactaccggtctggcccttggtca

SEQ ID NO: 550803 - DNA, 25 bp, Rattus norvegicus
tggcacccggagtttgtcactaccg

SEQ ID NO: 550804 - DNA, 25 bp, Rattus norvegicus
gaacgccgttccgtccttggtggca

SEQ ID NO: 550805 - DNA, 25 bp, Rattus norvegicus
taagcaggtcactcgcctctgcggg

SEQ ID NO: 550806 - DNA, 25 bp, Rattus norvegicus
ctggcgctgcgcttctacaaaagta

SEQ ID NO: 550807 - DNA, 25 bp, Rattus norvegicus
agcaacttgaggtgtcgctcgacgg

SEQ ID NO: 550808 - DNA, 25 bp, Rattus norvegicus
cgcagctgaacgtagagcaacttga

SEQ ID NO: 550809 - DNA, 25 bp, Rattus norvegicus
cagcaggaagtcgatacgtggccgc

SEQ ID NO: 550810 - DNA, 25 bp, Rattus norvegicus
ctcttagaggggtgtgaggtcccta

SEQ ID NO: 550811 - DNA, 25 bp, Rattus norvegicus
cccagccgctttggcagcggaagtt

SEQ ID NO: 550812 - DNA, 25 bp, Rattus norvegicus
gcttcccaggaattaagtgtcaacg

SEQ ID NO: 550813 - DNA, 25 bp, Rattus norvegicus
cacaggacccaggtccgggtgctga

SEQ ID NO: 550814 - DNA, 25 bp, Rattus norvegicus
accagagggcgtacgagcgccgcca

SEQ ID NO: 550815 - DNA, 25 bp, Rattus norvegicus
ccaggctcgaaagacggccaccaga

SEQ ID NO: 550816 - DNA, 25 bp, Rattus norvegicus
cccgctctagtctggggactgttgc

SEQ ID NO: 550817 - DNA, 25 bp, Rattus norvegicus
agagtctgtagatctgggtcacctc

SEQ ID NO: 550818 - DNA, 25 bp, Rattus norvegicus
gagatcctcgcgtagagtctgtaga

SEQ ID NO: 550819 - DNA, 25 bp, Rattus norvegicus
tcaacgaaagtatgcttcctctgtg

SEQ ID NO: 550820 - DNA, 25 bp, Rattus norvegicus
tcacccatttggtggtccaagcgtg

SEQ ID NO: 550821 - DNA, 25 bp, Rattus norvegicus
gggtacgcggtctctgcccgcttct

SEQ ID NO: 550822 - DNA, 25 bp, Rattus norvegicus
atagccaccacttccgctgggtacg

SEQ ID NO: 550823 - DNA, 25 bp, Rattus norvegicus
tgggagggcctaacgctagcacaat

SEQ ID NO: 550824 - DNA, 25 bp, Rattus norvegicus
catccagaggcggatggccagcacg

SEQ ID NO: 550825 - DNA, 25 bp, Rattus norvegicus
ttcctctgtgcaaacgagatcctcg

SEQ ID NO: 550826 - DNA, 25 bp, Rattus norvegicus
cttgagcatcggagcaggtcctacc

SEQ ID NO: 550827 - DNA, 25 bp, Rattus norvegicus
tcccgcgtcccagctctagatttgg

SEQ ID NO: 550828 - DNA, 25 bp, Rattus norvegicus
ggtaaccgattcatggattcctctc

SEQ ID NO: 550829 - DNA, 25 bp, Rattus norvegicus
gcctagcggcctctggtaaccgatt

SEQ ID NO: 550830 - DNA, 25 bp, Rattus norvegicus
cactacaggaggatgcccgcttttt

SEQ ID NO: 550831 - DNA, 25 bp, Rattus norvegicus
ttctgcaggaaaacagctgcgcttc

SEQ ID NO: 550832 - DNA, 25 bp, Rattus norvegicus
tgccctgggcgaagggacctagaaa

SEQ ID NO: 550833 - DNA, 25 bp, Rattus norvegicus
aggctcgtagtctcccactacagga

SEQ ID NO: 550834 - DNA, 25 bp, Rattus norvegicus
gccttgcggcgggtaacaacacaac

SEQ ID NO: 550835 - DNA, 25 bp, Rattus norvegicus
ttttcgtcttcgcagtagatgaccc

SEQ ID NO: 550836 - DNA, 25 bp, Rattus norvegicus
tagatgacccatccttgtccgccgg

SEQ ID NO: 550837 - DNA, 25 bp, Rattus norvegicus
cgcggctcagaagaactggggttca

SEQ ID NO: 550838 - DNA, 25 bp, Rattus norvegicus
acactcgtctggaaaaggtctgccc

SEQ ID NO: 550839 - DNA, 25 bp, Rattus norvegicus
cttctaagagatcccgttgtgcaca

SEQ ID NO: 550840 - DNA, 25 bp, Rattus norvegicus
gtgcaaaggagaacctcggtcaccc

SEQ ID NO: 550841 - DNA, 25 bp, Rattus norvegicus
caggccaagcgagcgaagaacctcc

SEQ ID NO: 550842 - DNA, 25 bp, Rattus norvegicus
acctcgcggcgagatgagctaatcc

SEQ ID NO: 550843 - DNA, 25 bp, Rattus norvegicus
agtcaagtctctttcaagtcccgga

SEQ ID NO: 550844 - DNA, 25 bp, Rattus norvegicus
cgatttctgacaggtcccgggagtc

SEQ ID NO: 550845 - DNA, 25 bp, Rattus norvegicus
gtcgatctggtagtctggccacctg

SEQ ID NO: 550846 - DNA, 25 bp, Rattus norvegicus
tcaagaacaatgtcgcgtccgcgga

SEQ ID NO: 550847 - DNA, 25 bp, Rattus norvegicus
aggtgcgcgcccacgacctgcaaag

SEQ ID NO: 550848 - DNA, 25 bp, Rattus norvegicus
ggccgcagcatagcaaccgaacatg

SEQ ID NO: 550849 - DNA, 25 bp, Rattus norvegicus
cccaatttcggagcatgggcgcctg

SEQ ID NO: 550850 - DNA, 25 bp, Rattus norvegicus
gcctagagcactggcactcacaggt

SEQ ID NO: 550851 - DNA, 25 bp, Rattus norvegicus
cacaggtgcgagataggcggaattt

SEQ ID NO: 550852 - DNA, 25 bp, Rattus norvegicus
cccgggagtcttcaagaacaatgtc

SEQ ID NO: 550853 - DNA, 25 bp, Rattus norvegicus
agcgcctctcttaccttcgttgtca

SEQ ID NO: 550854 - DNA, 25 bp, Rattus norvegicus
cttctccttcggctggagctcagca

SEQ ID NO: 550855 - DNA, 25 bp, Rattus norvegicus
tgcgaacacaattgaaagatggctg

SEQ ID NO: 550856 - DNA, 25 bp, Rattus norvegicus
cgcggcgaaggctgcgaacacaatt

SEQ ID NO: 550857 - DNA, 25 bp, Rattus norvegicus
ccgcctctcgcggtgtgtacaaaca

SEQ ID NO: 550858 - DNA, 25 bp, Rattus norvegicus
atggtgaagctcaggcacaactgtg

SEQ ID NO: 550859 - DNA, 25 bp, Rattus norvegicus
catttctgcgccaaaaagtttgcgg

SEQ ID NO: 550860 - DNA, 25 bp, Rattus norvegicus
tttcaccgaagaaagagcccgcggc

SEQ ID NO: 550861 - DNA, 25 bp, Rattus norvegicus
gcagcaaaaagcgagttagcccggg

SEQ ID NO: 550862 - DNA, 25 bp, Rattus norvegicus
gcgccagccaatcacacacaatgga

SEQ ID NO: 550863 - DNA, 25 bp, Rattus norvegicus
ctgcatttcatatgcatcaagtttc

SEQ ID NO: 550864 - DNA, 25 bp, Rattus norvegicus
acacaatggagggaaggctcggccc

SEQ ID NO: 550865 - DNA, 25 bp, Rattus norvegicus
cggtgaccagagaagagacaagatg

SEQ ID NO: 550866 - DNA, 25 bp, Rattus norvegicus
cacaactgtggggaggcagcaaaaa

SEQ ID NO: 550867 - DNA, 25 bp, Rattus norvegicus
aagatggctgacaccgaggctttcc

SEQ ID NO: 550868 - DNA, 25 bp, Rattus norvegicus
tacacaaacccgactggagcgctgg

SEQ ID NO: 550869 - DNA, 25 bp, Rattus norvegicus
cgcagagcgcaaacaagcaaacata

SEQ ID NO: 550870 - DNA, 25 bp, Rattus norvegicus
agcaaacatagggacgagccgaacg

SEQ ID NO: 550871 - DNA, 25 bp, Rattus norvegicus
ccattcctcgggattgggaggcctc

SEQ ID NO: 550872 - DNA, 25 bp, Rattus norvegicus
acagtcctcccagtcccaaaaatag

SEQ ID NO: 550873 - DNA, 25 bp, Rattus norvegicus
tctaccgacactgcgaagaacaggt

SEQ ID NO: 550874 - DNA, 25 bp, Rattus norvegicus
gcggagctaaaggtagcttatcatc

SEQ ID NO: 550875 - DNA, 25 bp, Rattus norvegicus
cagagctcgccctttatagccagtc

SEQ ID NO: 550876 - DNA, 25 bp, Rattus norvegicus
tagctcgagcgctctgcggtcttat

SEQ ID NO: 550877 - DNA, 25 bp, Rattus norvegicus
gctcagtgcgcgatgtaatctaccg

SEQ ID NO: 550878 - DNA, 25 bp, Rattus norvegicus
ccaggtcacgtgattgtcttccgga

SEQ ID NO: 550879 - DNA, 25 bp, Rattus norvegicus
aaggccttcggtcatcaggatgcga

SEQ ID NO: 550880 - DNA, 25 bp, Rattus norvegicus
cgcggtctagaggttccgtcaccaa

SEQ ID NO: 550881 - DNA, 25 bp, Rattus norvegicus
aagcagtagccgagcccgctttctc

SEQ ID NO: 550882 - DNA, 25 bp, Rattus norvegicus
acgcagagagacgtgtggctgcttc

SEQ ID NO: 550883 - DNA, 25 bp, Rattus norvegicus
tcgtgcacaggcttgaccgatgtcc

SEQ ID NO: 550884 - DNA, 25 bp, Rattus norvegicus
gctgcttccgttgaggtctcgtccc

SEQ ID NO: 550885 - DNA, 25 bp, Rattus norvegicus
ggccgccataggacacatacgcaga

SEQ ID NO: 550886 - DNA, 25 bp, Rattus norvegicus
aagcctcatgaggaggccgccatag

SEQ ID NO: 550887 - DNA, 25 bp, Rattus norvegicus
gcgtcgccctgaagcctcatgagga

SEQ ID NO: 550888 - DNA, 25 bp, Rattus norvegicus
atccatgcaggttgttggcgtcgcc

SEQ ID NO: 550889 - DNA, 25 bp, Rattus norvegicus
cgggagtccacctcaaatccatgca

SEQ ID NO: 550890 - DNA, 25 bp, Rattus norvegicus
agcttcttcatcagcaggtagactc

SEQ ID NO: 550891 - DNA, 25 bp, Rattus norvegicus
cggaagttcagaacgccagcttctt

SEQ ID NO: 550892 - DNA, 25 bp, Rattus norvegicus
gcaaggctggtttcccggaagttca

SEQ ID NO: 550893 - DNA, 25 bp, Rattus norvegicus
ctcgagtgactaagcggcaaggctg

SEQ ID NO: 550894 - DNA, 25 bp, Rattus norvegicus
atgtccgtggctcgagtgactaagc

SEQ ID NO: 550895 - DNA, 25 bp, Rattus norvegicus
tcatcagcaggtagactcgggagtc

SEQ ID NO: 550896 - DNA, 25 bp, Rattus norvegicus
ttctggcagcagctgagccggccga

SEQ ID NO: 550897 - DNA, 25 bp, Rattus norvegicus
cggctggaaggtcttcgatgtgacc

SEQ ID NO: 550898 - DNA, 25 bp, Rattus norvegicus
tcttcgatgtgaccgaggccgtgaa

SEQ ID NO: 550899 - DNA, 25 bp, Rattus norvegicus
tcgatgtgaccgaggccgtgaactt

SEQ ID NO: 550900 - DNA, 25 bp, Rattus norvegicus
tgaccgaggccgtgaacttctggca

SEQ ID NO: 550901 - DNA, 25 bp, Rattus norvegicus
ccgaggccgtgaacttctggcagca

SEQ ID NO: 550902 - DNA, 25 bp, Rattus norvegicus
tgaacttctggcagcagctgagccg

SEQ ID NO: 550903 - DNA, 25 bp, Rattus norvegicus
ctgctgctccaggtgtcggtgcaga

SEQ ID NO: 550904 - DNA, 25 bp, Rattus norvegicus
tcggtgcagagggagcatctgggac

SEQ ID NO: 550905 - DNA, 25 bp, Rattus norvegicus
acctggagcgcacacaagttggtcc

SEQ ID NO: 550906 - DNA, 25 bp, Rattus norvegicus
agcgcacacaagttggtccggttcg

SEQ ID NO: 550907 - DNA, 25 bp, Rattus norvegicus
acacaagttggtccggttcgcggcg

SEQ ID NO: 550908 - DNA, 25 bp, Rattus norvegicus
cctgacgcgcgctgctgtgtctcag

SEQ ID NO: 550909 - DNA, 25 bp, Rattus norvegicus
gccgtgaacttctggcagcagctga

SEQ ID NO: 550910 - DNA, 25 bp, Rattus norvegicus
tttttccacgcgcagacactgagcc

SEQ ID NO: 550911 - DNA, 25 bp, Rattus norvegicus
ttccgattgggcctcacctagattc

SEQ ID NO: 550912 - DNA, 25 bp, Rattus norvegicus
ctagattctagcctcggattggttg

SEQ ID NO: 550913 - DNA, 25 bp, Rattus norvegicus
ggttgcttgggacacgtggccaacc

SEQ ID NO: 550914 - DNA, 25 bp, Rattus norvegicus
ccaaccggaggctgcgtatttggcg

SEQ ID NO: 550915 - DNA, 25 bp, Rattus norvegicus
ctgggattcttagggcctgtctaac

SEQ ID NO: 550916 - DNA, 25 bp, Rattus norvegicus
agggcctgtctaactgtccagtgca

SEQ ID NO: 550917 - DNA, 25 bp, Rattus norvegicus
actgtccagtgcatcccggtttgaa

SEQ ID NO: 550918 - DNA, 25 bp, Rattus norvegicus
cccggtttgaaagctgttgcgagca

SEQ ID NO: 550919 - DNA, 25 bp, Rattus norvegicus
ctgttgcgagcaattcggatccgtc

SEQ ID NO: 550920 - DNA, 25 bp, Rattus norvegicus
atcctgcagccatgagcgtgggttt

SEQ ID NO: 550921 - DNA, 25 bp, Rattus norvegicus
ggatccgtctttttccacgcgcaga

SEQ ID NO: 550922 - DNA, 25 bp, Rattus norvegicus
attcccagagtctccgggtcggcgc

SEQ ID NO: 550923 - DNA, 25 bp, Rattus norvegicus
gcgggctcaccgtctgacggcgctt

SEQ ID NO: 550924 - DNA, 25 bp, Rattus norvegicus
ccattgaatggctgcgcttccgcga

SEQ ID NO: 550925 - DNA, 25 bp, Rattus norvegicus
accgtaccgcccttatcgattctag

SEQ ID NO: 550926 - DNA, 25 bp, Rattus norvegicus
agggtctccctaaagcctgccagtc

SEQ ID NO: 550927 - DNA, 25 bp, Rattus norvegicus
tggaacagactccttcagggtctcc

SEQ ID NO: 550928 - DNA, 25 bp, Rattus norvegicus
acggaatggaacagactccttcagg

SEQ ID NO: 550929 - DNA, 25 bp, Rattus norvegicus
gtgggaacggaatggaacagactcc

SEQ ID NO: 550930 - DNA, 25 bp, Rattus norvegicus
cgtattaggagcgttagaaagtgca

SEQ ID NO: 550931 - DNA, 25 bp, Rattus norvegicus
ctctctcgtattaggagcgttagaa

SEQ ID NO: 550932 - DNA, 25 bp, Rattus norvegicus
aaagcctgccagtcctctcgcctga

SEQ ID NO: 550933 - DNA, 25 bp, Rattus norvegicus
attctaggtataagcgctcgctctc

SEQ ID NO: 550934 - DNA, 25 bp, Rattus norvegicus
atcgattctaggtataagcgctcgc

SEQ ID NO: 550935 - DNA, 25 bp, Rattus norvegicus
gcgcttccgcgaggatggctccaac

SEQ ID NO: 550936 - DNA, 25 bp, Rattus norvegicus
accgcccttatcgattctaggtata

SEQ ID NO: 550937 - DNA, 25 bp, Rattus norvegicus
tcgggtcaccattgaatggctgcgc

SEQ ID NO: 550938 - DNA, 25 bp, Rattus norvegicus
tagagagtgccaatcaaatcccgcg

SEQ ID NO: 550939 - DNA, 25 bp, Rattus norvegicus
ctgggacttcctgacagcctttggc

SEQ ID NO: 550940 - DNA, 25 bp, Rattus norvegicus
ggcaacgtcggagccctctcttctt

SEQ ID NO: 550941 - DNA, 25 bp, Rattus norvegicus
ttaccgggctagacccggcctgagc

SEQ ID NO: 550942 - DNA, 25 bp, Rattus norvegicus
gggacacgctctcccagccttgtgg

SEQ ID NO: 550943 - DNA, 25 bp, Rattus norvegicus
acagttctgcgcatgtgcaggaggc

SEQ ID NO: 550944 - DNA, 25 bp, Rattus norvegicus
aggcaacgcgtggaaacagttctgc

SEQ ID NO: 550945 - DNA, 25 bp, Rattus norvegicus
cggcgggagccaagagtccaaatta

SEQ ID NO: 550946 - DNA, 25 bp, Rattus norvegicus
ggcgcacagtcctcaacgttcagct

SEQ ID NO: 550947 - DNA, 25 bp, Rattus norvegicus
gaaccacagagaggctcactgcccg

SEQ ID NO: 550948 - DNA, 25 bp, Rattus norvegicus
ttccgcccgtagacctccgtgagga

SEQ ID NO: 550949 - DNA, 25 bp, Rattus norvegicus
gccaccgccgcaggtaaagtgggaa

SEQ ID NO: 550950 - DNA, 25 bp, Rattus norvegicus
cacgcgtggaccagagtcagagaac

SEQ ID NO: 550951 - DNA, 25 bp, Rattus norvegicus
gaggcgccggagtttcactttgtaa

SEQ ID NO: 550952 - DNA, 25 bp, Rattus norvegicus
tcgcaactctcacgctggggtgccg

SEQ ID NO: 550953 - DNA, 25 bp, Rattus norvegicus
gcgcaactcgactgctttgggagga

SEQ ID NO: 550954 - DNA, 25 bp, Rattus norvegicus
actcgactgctttgggaggaagatg

SEQ ID NO: 550955 - DNA, 25 bp, Rattus norvegicus
tattggatgcaggactgggaagcac

SEQ ID NO: 550956 - DNA, 25 bp, Rattus norvegicus
gactgggaagcacggcctactgcac

SEQ ID NO: 550957 - DNA, 25 bp, Rattus norvegicus
acggcctactgcacgcctggttcag

SEQ ID NO: 550958 - DNA, 25 bp, Rattus norvegicus
gcacgcctggttcaggcttgcagta

SEQ ID NO: 550959 - DNA, 25 bp, Rattus norvegicus
tactgtcagggtcacgctcgcgctc

SEQ ID NO: 550960 - DNA, 25 bp, Rattus norvegicus
agcttactgtcagggtcacgctcgc

SEQ ID NO: 550961 - DNA, 25 bp, Rattus norvegicus
cccggagcttactgtcagggtcacg

SEQ ID NO: 550962 - DNA, 25 bp, Rattus norvegicus
gccctcagccctcgcaactctcacg

SEQ ID NO: 550963 - DNA, 25 bp, Rattus norvegicus
ggcgcatttagctgcgggagttaca

SEQ ID NO: 550964 - DNA, 25 bp, Rattus norvegicus
tgcgggagttacacgcagccctcag

SEQ ID NO: 550965 - DNA, 25 bp, Rattus norvegicus
gaggcggcgcaactcgactgctttg

SEQ ID NO: 550966 - DNA, 25 bp, Rattus norvegicus
cactgcctggcgctggtgtctcact

SEQ ID NO: 550967 - DNA, 25 bp, Rattus norvegicus
ccgcaacttctgctcaacacgaaag

SEQ ID NO: 550968 - DNA, 25 bp, Rattus norvegicus
cctgtctacgaaaaccgcgggtctg

SEQ ID NO: 550969 - DNA, 25 bp, Rattus norvegicus
ctcagccacgcgaaaatggagttgc

SEQ ID NO: 550970 - DNA, 25 bp, Rattus norvegicus
tcaacacgaaagctccgcgagtagg

SEQ ID NO: 550971 - DNA, 25 bp, Rattus norvegicus
gcatcggaagttcctcccgcaactt

SEQ ID NO: 550972 - DNA, 25 bp, Rattus norvegicus
accggggaagactgcagcagcctcc

SEQ ID NO: 550973 - DNA, 25 bp, Rattus norvegicus
tggtgtctcactttaccggggaaga

SEQ ID NO: 550974 - DNA, 25 bp, Rattus norvegicus
ggtctgggcttcatgctcccactgc

SEQ ID NO: 550975 - DNA, 25 bp, Rattus norvegicus
cgttgcttcagtttcctgtctacga

SEQ ID NO: 550976 - DNA, 25 bp, Rattus norvegicus
cgcacctgaatgactcgttgcttca

SEQ ID NO: 550977 - DNA, 25 bp, Rattus norvegicus
tgtcctcagatacacacgcacctga

SEQ ID NO: 550978 - DNA, 25 bp, Rattus norvegicus
atggagttgcagtgtcctcagatac

SEQ ID NO: 550979 - DNA, 25 bp, Rattus norvegicus
cgcgctgctaaggaattcgggaaga

SEQ ID NO: 550980 - DNA, 25 bp, Rattus norvegicus
ctgtctacttcgtatccttggttga

SEQ ID NO: 550981 - DNA, 25 bp, Rattus norvegicus
tggtgttcctcttctcgctcctcga

SEQ ID NO: 550982 - DNA, 25 bp, Rattus norvegicus
atggaggcggtggtgttcctcttct

SEQ ID NO: 550983 - DNA, 25 bp, Rattus norvegicus
gcccggagctggtttgacgggcgga

SEQ ID NO: 550984 - DNA, 25 bp, Rattus norvegicus
cctcgactgttgttcgctcatcttc

SEQ ID NO: 550985 - DNA, 25 bp, Rattus norvegicus
tcttctcgctcctcgactgttgttc

SEQ ID NO: 550986 - DNA, 25 bp, Rattus norvegicus
tgttgttcgctcatcttcctctctg

SEQ ID NO: 550987 - DNA, 25 bp, Rattus norvegicus
ttgttcgctcatcttcctctctgtc

SEQ ID NO: 550988 - DNA, 25 bp, Rattus norvegicus
catcttcctctctgtctacttcgta

SEQ ID NO: 550989 - DNA, 25 bp, Rattus norvegicus
cctctctgtctacttcgtatccttg

SEQ ID NO: 550990 - DNA, 25 bp, Rattus norvegicus
ttctcgctcctcgactgttgttcgc

SEQ ID NO: 550991 - DNA, 25 bp, Rattus norvegicus
cgtatccttggttgaagcgggccga

SEQ ID NO: 550992 - DNA, 25 bp, Rattus norvegicus
ttcgtatccttggttgaagcgggcc

SEQ ID NO: 550993 - DNA, 25 bp, Rattus norvegicus
cttcccagggctaccgccgggaatg

SEQ ID NO: 550994 - DNA, 25 bp, Rattus norvegicus
tgttgctattgttgccagcggcgga

SEQ ID NO: 550995 - DNA, 25 bp, Rattus norvegicus
cctggccctcaccagttgttggacg

SEQ ID NO: 550996 - DNA, 25 bp, Rattus norvegicus
gacatcaggccgattcgttttcttc

SEQ ID NO: 550997 - DNA, 25 bp, Rattus norvegicus
ggctgctctcaagacatcaggccga

SEQ ID NO: 550998 - DNA, 25 bp, Rattus norvegicus
gacaatccagctccggaggtgcgtg

SEQ ID NO: 550999 - DNA, 25 bp, Rattus norvegicus
aggccattgaggtgctgtcctatga

SEQ ID NO: 551000 - DNA, 25 bp, Rattus norvegicus
ttgttggacgggcacttacttgagc

SEQ ID NO: 551001 - DNA, 25 bp, Rattus norvegicus
gtcctatgagcctaatgacatcctc

SEQ ID NO: 551002 - DNA, 25 bp, Rattus norvegicus
tgacatcctcatcggactgcgagag

SEQ ID NO: 551003 - DNA, 25 bp, Rattus norvegicus
cgagagccgcttcttcttcttgagg

SEQ ID NO: 551004 - DNA, 25 bp, Rattus norvegicus
cccgttattgacactcaggctgttg

SEQ ID NO: 551005 - DNA, 25 bp, Rattus norvegicus
acactcaggctgttgctattgttgc

SEQ ID NO: 551006 - DNA, 25 bp, Rattus norvegicus
ttctgcgccgacaggcaggcgagct

SEQ ID NO: 551007 - DNA, 25 bp, Rattus norvegicus
ttacttgagccctaggccattgagg

SEQ ID NO: 551008 - DNA, 25 bp, Rattus norvegicus
aagcctgtggagtggccacgacaaa

SEQ ID NO: 551009 - DNA, 25 bp, Rattus norvegicus
acgacaaaggcctcggcgtcctggg

SEQ ID NO: 551010 - DNA, 25 bp, Rattus norvegicus
acgcgtcccgggttagaactgcgcg

SEQ ID NO: 551011 - DNA, 25 bp, Rattus norvegicus
agccgtccctgaaacctggagctcg

SEQ ID NO: 551012 - DNA, 25 bp, Rattus norvegicus
tcctagccgtccctgaaacctggag

SEQ ID NO: 551013 - DNA, 25 bp, Rattus norvegicus
ccgggttagaactgcgcggtgcaca

SEQ ID NO: 551014 - DNA, 25 bp, Rattus norvegicus
tggccacgacaaaggcctcggcgtc

SEQ ID NO: 551015 - DNA, 25 bp, Rattus norvegicus
gccgagatggcaatttcatctcttt

SEQ ID NO: 551016 - DNA, 25 bp, Rattus norvegicus
gcgcgggccgagatggcaatttcat

SEQ ID NO: 551017 - DNA, 25 bp, Rattus norvegicus
tgcaaaagtaaaaccgaaggagcgc

SEQ ID NO: 551018 - DNA, 25 bp, Rattus norvegicus
ccggagccttcgattgcaaaagtaa

SEQ ID NO: 551019 - DNA, 25 bp, Rattus norvegicus
gggcccagctttccgctgtgagcca

SEQ ID NO: 551020 - DNA, 25 bp, Rattus norvegicus
ccagccggagccttcgattgcaaaa

SEQ ID NO: 551021 - DNA, 25 bp, Rattus norvegicus
aagccctcaacccttctgggacgcg

SEQ ID NO: 551022 - DNA, 25 bp, Rattus norvegicus
ggaaatgcctatactgccctcctcg

SEQ ID NO: 551023 - DNA, 25 bp, Rattus norvegicus
ctccgctccctggtgtgttgattct

SEQ ID NO: 551024 - DNA, 25 bp, Rattus norvegicus
gctccctggtgtgttgattcttccc

SEQ ID NO: 551025 - DNA, 25 bp, Rattus norvegicus
cccagctgctgcctaatggagtccg

SEQ ID NO: 551026 - DNA, 25 bp, Rattus norvegicus
tgagatgcgacccagcacgacctgg

SEQ ID NO: 551027 - DNA, 25 bp, Rattus norvegicus
ctgtcacccggcacgtgtgtgtccg

SEQ ID NO: 551028 - DNA, 25 bp, Rattus norvegicus
gctcacttccggcagcaggtatgga

SEQ ID NO: 551029 - DNA, 25 bp, Rattus norvegicus
tccggcagcaggtatggaacctata

SEQ ID NO: 551030 - DNA, 25 bp, Rattus norvegicus
agtaagttcgcagccaccctccgag

SEQ ID NO: 551031 - DNA, 25 bp, Rattus norvegicus
tggcccgcagtaagttcgcagccac

SEQ ID NO: 551032 - DNA, 25 bp, Rattus norvegicus
gtagagatcgtgtccacgctgtgta

SEQ ID NO: 551033 - DNA, 25 bp, Rattus norvegicus
gtccacgctgtgtacccggagtgac

SEQ ID NO: 551034 - DNA, 25 bp, Rattus norvegicus
ccggagtgacccagaaaggagcgac

SEQ ID NO: 551035 - DNA, 25 bp, Rattus norvegicus
gctggcgtcacaggaaatgcctata

SEQ ID NO: 551036 - DNA, 25 bp, Rattus norvegicus
gtgtatcaggactcgttcccgggca

SEQ ID NO: 551037 - DNA, 25 bp, Rattus norvegicus
tcaggactcgttcccgggcaggaga

SEQ ID NO: 551038 - DNA, 25 bp, Rattus norvegicus
gagagagccacgaagccgaaggcca

SEQ ID NO: 551039 - DNA, 25 bp, Rattus norvegicus
gccggtcctggctcaggttgcagcc

SEQ ID NO: 551040 - DNA, 25 bp, Rattus norvegicus
tcagccgagccagcgcaatcagaga

SEQ ID NO: 551041 - DNA, 25 bp, Rattus norvegicus
agcgcaatcagagaacccgcactgc

SEQ ID NO: 551042 - DNA, 25 bp, Rattus norvegicus
agagaacccgcactgcgagcgggac

SEQ ID NO: 551043 - DNA, 25 bp, Rattus norvegicus
tgcctgccctgggatccactgaggc

SEQ ID NO: 551044 - DNA, 25 bp, Rattus norvegicus
ccctgggatccactgaggcgttgga

SEQ ID NO: 551045 - DNA, 25 bp, Rattus norvegicus
cgcctctgacagtccggcttgcagt

SEQ ID NO: 551046 - DNA, 25 bp, Rattus norvegicus
gtccggcttgcagtcctccagacga

SEQ ID NO: 551047 - DNA, 25 bp, Rattus norvegicus
tccgacttcccgctcagagttcgag

SEQ ID NO: 551048 - DNA, 25 bp, Rattus norvegicus
ccgctcagagttcgagataaagatc

SEQ ID NO: 551049 - DNA, 25 bp, Rattus norvegicus
cccgtgtcgcgcgtgtatcaggact

SEQ ID NO: 551050 - DNA, 25 bp, Rattus norvegicus
cggcaagtttcctacaagaggaggg

SEQ ID NO: 551051 - DNA, 25 bp, Rattus norvegicus
gtcgtgtcatcgccagagccttcca

SEQ ID NO: 551052 - DNA, 25 bp, Rattus norvegicus
catagctgcattgggagaccctacc

SEQ ID NO: 551053 - DNA, 25 bp, Rattus norvegicus
caccttcccactcgctcggggcgca

SEQ ID NO: 551054 - DNA, 25 bp, Rattus norvegicus
ttcctacaagaggagggcgcgcacc

SEQ ID NO: 551055 - DNA, 25 bp, Rattus norvegicus
gcgcaccgcgtctcctcctcggtcc

SEQ ID NO: 551056 - DNA, 25 bp, Rattus norvegicus
gcgagcagcacttggccggaaatct

SEQ ID NO: 551057 - DNA, 25 bp, Rattus norvegicus
cacttggccggaaatctgcgccgca

SEQ ID NO: 551058 - DNA, 25 bp, Rattus norvegicus
gagctggccatctaggctggagccc

SEQ ID NO: 551059 - DNA, 25 bp, Rattus norvegicus
tggccatctaggctggagcccacgc

SEQ ID NO: 551060 - DNA, 25 bp, Rattus norvegicus
ggggacggatgcatctcagtacgca

SEQ ID NO: 551061 - DNA, 25 bp, Rattus norvegicus
tctcagtacgcatagctgcattggg

SEQ ID NO: 551062 - DNA, 25 bp, Rattus norvegicus
cgcatagctgcattgggagacccta

SEQ ID NO: 551063 - DNA, 25 bp, Rattus norvegicus
tggccggaaatctgcgccgcagccg

SEQ ID NO: 551064 - DNA, 25 bp, Rattus norvegicus
gcgctccgtccatgtgtaaccacag

SEQ ID NO: 551065 - DNA, 25 bp, Rattus norvegicus
ttcatcgtgcgacgctaggcgaagg

SEQ ID NO: 551066 - DNA, 25 bp, Rattus norvegicus
gacgacctttcatcgtgcgacgcta

SEQ ID NO: 551067 - DNA, 25 bp, Rattus norvegicus
atctgtgaggaaggcgacgaccttt

SEQ ID NO: 551068 - DNA, 25 bp, Rattus norvegicus
gcctgggccagcaatctgtgaggaa

SEQ ID NO: 551069 - DNA, 25 bp, Rattus norvegicus
cccaggcaccgagctgggctttggc

SEQ ID NO: 551070 - DNA, 25 bp, Rattus norvegicus
ccttttgaatcatcgccggcgctgg

SEQ ID NO: 551071 - DNA, 25 bp, Rattus norvegicus
tggtccctcgaccttttgaatcatc

SEQ ID NO: 551072 - DNA, 25 bp, Rattus norvegicus
cagtgcgcagcgagtggccctcgaa

SEQ ID NO: 551073 - DNA, 25 bp, Rattus norvegicus
aggggccagaggcagttaactcttc

SEQ ID NO: 551074 - DNA, 25 bp, Rattus norvegicus
atgtcaccgcgcagaagcactcacg

SEQ ID NO: 551075 - DNA, 25 bp, Rattus norvegicus
gggacctgtgccgacgctcacctgg

SEQ ID NO: 551076 - DNA, 25 bp, Rattus norvegicus
ccctagcgaggattcccattggtcc

SEQ ID NO: 551077 - DNA, 25 bp, Rattus norvegicus
aagcactcacgaggccgggacaggt

SEQ ID NO: 551078 - DNA, 25 bp, Rattus norvegicus
tggaacgcctgacttccgctatgga

SEQ ID NO: 551079 - DNA, 25 bp, Rattus norvegicus
ctgagaagctctacttggcggaccc

SEQ ID NO: 551080 - DNA, 25 bp, Rattus norvegicus
gactggggtcttctctaaccttggc

SEQ ID NO: 551081 - DNA, 25 bp, Rattus norvegicus
taaccttggcgcgacctgtgcacat

SEQ ID NO: 551082 - DNA, 25 bp, Rattus norvegicus
ctgtgcacatccaggaagctgaatc

SEQ ID NO: 551083 - DNA, 25 bp, Rattus norvegicus
cttccatctgacacggagacccatg

SEQ ID NO: 551084 - DNA, 25 bp, Rattus norvegicus
gccagcaaccacaggcagagccttt

SEQ ID NO: 551085 - DNA, 25 bp, Rattus norvegicus
ttccagacctgggaggagttcagcc

SEQ ID NO: 551086 - DNA, 25 bp, Rattus norvegicus
aagccgcgatgcctcagttccagac

SEQ ID NO: 551087 - DNA, 25 bp, Rattus norvegicus
tgtcagtgcgacagcgcgtttcttg

SEQ ID NO: 551088 - DNA, 25 bp, Rattus norvegicus
gcctccatctttgggccgccagagt

SEQ ID NO: 551089 - DNA, 25 bp, Rattus norvegicus
aacagcatgcctcctgcccattgga

SEQ ID NO: 551090 - DNA, 25 bp, Rattus norvegicus
ccgctatggatttggttggtttacg

SEQ ID NO: 551091 - DNA, 25 bp, Rattus norvegicus
gagacccatggaagctccgccagca

SEQ ID NO: 551092 - DNA, 25 bp, Rattus norvegicus
ggagcctcatgaggtcacgcctctc

SEQ ID NO: 551093 - DNA, 25 bp, Rattus norvegicus
cgccaagaaccttgcgggctcaaga

SEQ ID NO: 551094 - DNA, 25 bp, Rattus norvegicus
gccaagcaggcgtctggactcaagc

SEQ ID NO: 551095 - DNA, 25 bp, Rattus norvegicus
gccggtccctcagatcactggaata

SEQ ID NO: 551096 - DNA, 25 bp, Rattus norvegicus
tggctacctctccacgagttcggaa

SEQ ID NO: 551097 - DNA, 25 bp, Rattus norvegicus
actggaccacgtgatggaggctccc

SEQ ID NO: 551098 - DNA, 25 bp, Rattus norvegicus
ggcaccctcaactgtcgagccagga

SEQ ID NO: 551099 - DNA, 25 bp, Rattus norvegicus
ccagcgccagaccatcgaagggtca

SEQ ID NO: 551100 - DNA, 25 bp, Rattus norvegicus
gggcgctggtcttcacctaagatct

SEQ ID NO: 551101 - DNA, 25 bp, Rattus norvegicus
ggctggtccgtgtagacccattcga

SEQ ID NO: 551102 - DNA, 25 bp, Rattus norvegicus
ttcgaactcctctcgggacacgcgg

SEQ ID NO: 551103 - DNA, 25 bp, Rattus norvegicus
aaccggctgtgattaagtggcaacg

SEQ ID NO: 551104 - DNA, 25 bp, Rattus norvegicus
ggcagctagttatccggctcgtgtc

SEQ ID NO: 551105 - DNA, 25 bp, Rattus norvegicus
ccgatcagggaagtctagggtcacc

SEQ ID NO: 551106 - DNA, 25 bp, Rattus norvegicus
caactccgttacttctcgcagacgg

SEQ ID NO: 551107 - DNA, 25 bp, Rattus norvegicus
cagcgccaccagtgtgttgttttga

SEQ ID NO: 551108 - DNA, 25 bp, Rattus norvegicus
ctacgatgggcagcgccaccagtgt

SEQ ID NO: 551109 - DNA, 25 bp, Rattus norvegicus
ctgaggatgttctcgatggctacga

SEQ ID NO: 551110 - DNA, 25 bp, Rattus norvegicus
tcgtcgtaggacataaagctgagga

SEQ ID NO: 551111 - DNA, 25 bp, Rattus norvegicus
agctggctaatttcgtcgtaggaca

SEQ ID NO: 551112 - DNA, 25 bp, Rattus norvegicus
cctcaccaggcggagctggctaatt

SEQ ID NO: 551113 - DNA, 25 bp, Rattus norvegicus
tgccagtgcagcagcaccgggccga

SEQ ID NO: 551114 - DNA, 25 bp, Rattus norvegicus
cagtcaggatgccagtgcagcagca

SEQ ID NO: 551115 - DNA, 25 bp, Rattus norvegicus
agaccctcaaggcacggagcctcgg

SEQ ID NO: 551116 - DNA, 25 bp, Rattus norvegicus
ttacttctcgcagacgggcgcgtcc

SEQ ID NO: 551117 - DNA, 25 bp, Rattus norvegicus
ggcggaggggcaccaagcccaactc

SEQ ID NO: 551118 - DNA, 25 bp, Rattus norvegicus
gtccgcctacttgggagtgaactca

SEQ ID NO: 551119 - DNA, 25 bp, Rattus norvegicus
tggggaccaggagaccctcaaggca

SEQ ID NO: 551120 - DNA, 25 bp, Rattus norvegicus
tgaggggactcactcgccgctgcct

SEQ ID NO: 551121 - DNA, 25 bp, Rattus norvegicus
gtccaaaatgatgccggtaagcggg

SEQ ID NO: 551122 - DNA, 25 bp, Rattus norvegicus
cgactgccaacgaggtgagggacac

SEQ ID NO: 551123 - DNA, 25 bp, Rattus norvegicus
tgcggttcgggtccaaaatgatgcc

SEQ ID NO: 551124 - DNA, 25 bp, Rattus norvegicus
gcttccatgcggttcgggtccaaaa

SEQ ID NO: 551125 - DNA, 25 bp, Rattus norvegicus
cgcgacctcgttctcgctccgcttc

SEQ ID NO: 551126 - DNA, 25 bp, Rattus norvegicus
ccaacgaggtgagggacacagccct

SEQ ID NO: 551127 - DNA, 25 bp, Rattus norvegicus
cctctggatcggctgaggggactca

SEQ ID NO: 551128 - DNA, 25 bp, Rattus norvegicus
agacaaagccgcgtcccggggacag

SEQ ID NO: 551129 - DNA, 25 bp, Rattus norvegicus
ggagcaaaggttcccgcctcctctg

SEQ ID NO: 551130 - DNA, 25 bp, Rattus norvegicus
tctggagcagctccgcggcctgtgc

SEQ ID NO: 551131 - DNA, 25 bp, Rattus norvegicus
attgttctcctgaggcaccgccttc

SEQ ID NO: 551132 - DNA, 25 bp, Rattus norvegicus
tttacgattattgttctcctgaggc

SEQ ID NO: 551133 - DNA, 25 bp, Rattus norvegicus
cgggccacttctgctccgccaggcc

SEQ ID NO: 551134 - DNA, 25 bp, Rattus norvegicus
atgaactgctgtgcagaggccgtgc

SEQ ID NO: 551135 - DNA, 25 bp, Rattus norvegicus
acacgatacgggagagaggtgccga

SEQ ID NO: 551136 - DNA, 25 bp, Rattus norvegicus
acaagacacgatacgggagagaggt

SEQ ID NO: 551137 - DNA, 25 bp, Rattus norvegicus
tgttaacaagacacgatacgggaga

SEQ ID NO: 551138 - DNA, 25 bp, Rattus norvegicus
ctttgttaacaagacacgatacggg

SEQ ID NO: 551139 - DNA, 25 bp, Rattus norvegicus
tactgacctttgttaacaagacacg

SEQ ID NO: 551140 - DNA, 25 bp, Rattus norvegicus
ggccgtgcagtttactgacctttgt

SEQ ID NO: 551141 - DNA, 25 bp, Rattus norvegicus
tttcatgtgtgataaacgaagcttg

SEQ ID NO: 551142 - DNA, 25 bp, Rattus norvegicus
actgctgtgcagaggccgtgcagtt

SEQ ID NO: 551143 - DNA, 25 bp, Rattus norvegicus
agcttggtatgaactgctgtgcaga

SEQ ID NO: 551144 - DNA, 25 bp, Rattus norvegicus
cgaagcttggtatgaactgctgtgc

SEQ ID NO: 551145 - DNA, 25 bp, Rattus norvegicus
aaacgaagcttggtatgaactgctg

SEQ ID NO: 551146 - DNA, 25 bp, Rattus norvegicus
tgtgtgataaacgaagcttggtatg

SEQ ID NO: 551147 - DNA, 25 bp, Rattus norvegicus
gcagaggccgtgcagtttactgacc

SEQ ID NO: 551148 - DNA, 25 bp, Rattus norvegicus
ctgaagccgagggatgggtgctgag

SEQ ID NO: 551149 - DNA, 25 bp, Rattus norvegicus
ttgagggatgggtgctgaggccgag

SEQ ID NO: 551150 - DNA, 25 bp, Rattus norvegicus
gtaccgagggatgggtgtcgaggga

SEQ ID NO: 551151 - DNA, 25 bp, Rattus norvegicus
tcgagggatgggtgctgaggccgaa

SEQ ID NO: 551152 - DNA, 25 bp, Rattus norvegicus
gccgagggatgggtgctgaagccga

SEQ ID NO: 551153 - DNA, 25 bp, Rattus norvegicus
gccgagggatgggtgctgaggccga

SEQ ID NO: 551154 - DNA, 25 bp, Rattus norvegicus
aggccgaaggatgggtgctgaggcc

SEQ ID NO: 551155 - DNA, 25 bp, Rattus norvegicus
gtgttgagggatgggtgctgaggcc

SEQ ID NO: 551156 - DNA, 25 bp, Rattus norvegicus
cgggtaccgagggatgggtgtcgag

SEQ ID NO: 551157 - DNA, 25 bp, Rattus norvegicus
gggatgggtgctgaggccgaaggat

SEQ ID NO: 551158 - DNA, 25 bp, Rattus norvegicus
ctgaggccgagggatgggtgctgag

SEQ ID NO: 551159 - DNA, 25 bp, Rattus norvegicus
gccgaaggatgggtgctgaggccga

SEQ ID NO: 551160 - DNA, 25 bp, Rattus norvegicus
ccgagggatgggtgctgaagccgag

SEQ ID NO: 551161 - DNA, 25 bp, Rattus norvegicus
ctgaggccgagggatgggtgccgag

SEQ ID NO: 551162 - DNA, 25 bp, Rattus norvegicus
tctgtaaacgcaaggacaataggcg

SEQ ID NO: 551163 - DNA, 25 bp, Rattus norvegicus
ccggacagccaccaactagcagggg

SEQ ID NO: 551164 - DNA, 25 bp, Rattus norvegicus
agccaccaactagcaggggcccgta

SEQ ID NO: 551165 - DNA, 25 bp, Rattus norvegicus
cctcctcggctccagtgacggagta

SEQ ID NO: 551166 - DNA, 25 bp, Rattus norvegicus
ctccagtgacggagtacgcatgtcc

SEQ ID NO: 551167 - DNA, 25 bp, Rattus norvegicus
acggagtacgcatgtcctttcacca

SEQ ID NO: 551168 - DNA, 25 bp, Rattus norvegicus
cgcatgtcctttcaccaacttctgg

SEQ ID NO: 551169 - DNA, 25 bp, Rattus norvegicus
caacttctggtacgtaacggcctca

SEQ ID NO: 551170 - DNA, 25 bp, Rattus norvegicus
gtacgtaacggcctcagaatccgca

SEQ ID NO: 551171 - DNA, 25 bp, Rattus norvegicus
acggcctcagaatccgcagcgctgg

SEQ ID NO: 551172 - DNA, 25 bp, Rattus norvegicus
gaatccgcagcgctggtgatctgta

SEQ ID NO: 551173 - DNA, 25 bp, Rattus norvegicus
ctggtgatctgtaaacgcaaggaca

SEQ ID NO: 551174 - DNA, 25 bp, Rattus norvegicus
aataggcggcggctgctctagcccg

SEQ ID NO: 551175 - DNA, 25 bp, Rattus norvegicus
ccgccgctgtgaccagcagagggca

SEQ ID NO: 551176 - DNA, 25 bp, Rattus norvegicus
tccgcctgaaccgaactgcgcctgc

SEQ ID NO: 551177 - DNA, 25 bp, Rattus norvegicus
ctctccaaataagctcacctgagct

SEQ ID NO: 551178 - DNA, 25 bp, Rattus norvegicus
tgagactcctgcaattgcgagcccg

SEQ ID NO: 551179 - DNA, 25 bp, Rattus norvegicus
cgcctccgccatcttcagggaccgg

SEQ ID NO: 551180 - DNA, 25 bp, Rattus norvegicus
gaaagccaccgacatcctcgaggcg

SEQ ID NO: 551181 - DNA, 25 bp, Rattus norvegicus
gagcttccggttgccgctgagcgca

SEQ ID NO: 551182 - DNA, 25 bp, Rattus norvegicus
tccgctctacggagtcggggcaaaa

SEQ ID NO: 551183 - DNA, 25 bp, Rattus norvegicus
atgagaggctgcgaaatcagctgtt

SEQ ID NO: 551184 - DNA, 25 bp, Rattus norvegicus
atcagctgttgttggtggcctcggt

SEQ ID NO: 551185 - DNA, 25 bp, Rattus norvegicus
ggcctcggtagtcaagggttctgac

SEQ ID NO: 551186 - DNA, 25 bp, Rattus norvegicus
tagtcaagggttctgacgggtgccc

SEQ ID NO: 551187 - DNA, 25 bp, Rattus norvegicus
gttctgacgggtgccctgactctgt

SEQ ID NO: 551188 - DNA, 25 bp, Rattus norvegicus
agcctgagactcctgcaattgcgag

SEQ ID NO: 551189 - DNA, 25 bp, Rattus norvegicus
agctcacctgagctctgccgggaga

SEQ ID NO: 551190 - DNA, 25 bp, Rattus norvegicus
cagcccgactgtctgctcgtgggca

SEQ ID NO: 551191 - DNA, 25 bp, Rattus norvegicus
cccgctagagaacggccgtttcatt

SEQ ID NO: 551192 - DNA, 25 bp, Rattus norvegicus
ctcgtgggcaccaacatggacaacc

SEQ ID NO: 551193 - DNA, 25 bp, Rattus norvegicus
tgaagcttaccaaggccgtgcggta

SEQ ID NO: 551194 - DNA, 25 bp, Rattus norvegicus
tgggcttcgacccacacttcagcta

SEQ ID NO: 551195 - DNA, 25 bp, Rattus norvegicus
atggcccaagcgactggctagccgt

SEQ ID NO: 551196 - DNA, 25 bp, Rattus norvegicus
aggtcttcggcacggcctactgcag

SEQ ID NO: 551197 - DNA, 25 bp, Rattus norvegicus
ctcgtacggcctacgcggagaagct

SEQ ID NO: 551198 - DNA, 25 bp, Rattus norvegicus
acagcagcaagactcgtacggccta

SEQ ID NO: 551199 - DNA, 25 bp, Rattus norvegicus
agcgactgggcttcatcaccaacaa

SEQ ID NO: 551200 - DNA, 25 bp, Rattus norvegicus
tggacacgctgctgttcgactgcga

SEQ ID NO: 551201 - DNA, 25 bp, Rattus norvegicus
agccaattgctggtgtagctggacc

SEQ ID NO: 551202 - DNA, 25 bp, Rattus norvegicus
gcgtatgctttacccttgccggttg

SEQ ID NO: 551203 - DNA, 25 bp, Rattus norvegicus
atggacaaccggctcccgctagaga

SEQ ID NO: 551204 - DNA, 25 bp, Rattus norvegicus
aaggaaggatcctggaagagcgccc

SEQ ID NO: 551205 - DNA, 25 bp, Rattus norvegicus
gccaatgctgccaccttcggacaga

SEQ ID NO: 551206 - DNA, 25 bp, Rattus norvegicus
tgcacagcgacagcccgaccgtgga

SEQ ID NO: 551207 - DNA, 25 bp, Rattus norvegicus
agcgatcgggatggcgcacagcaca

SEQ ID NO: 551208 - DNA, 25 bp, Rattus norvegicus
atgcccgccatggtagcgatcggga

SEQ ID NO: 551209 - DNA, 25 bp, Rattus norvegicus
cagtttcatcgcgatgcccgccatg

SEQ ID NO: 551210 - DNA, 25 bp, Rattus norvegicus
cctcgcggtctttggccagtttcat

SEQ ID NO: 551211 - DNA, 25 bp, Rattus norvegicus
tcctggttgaggtacttgatggctc

SEQ ID NO: 551212 - DNA, 25 bp, Rattus norvegicus
accttcggacagatcccgggatggc

SEQ ID NO: 551213 - DNA, 25 bp, Rattus norvegicus
ccaactccttgaagcccagggacga

SEQ ID NO: 551214 - DNA, 25 bp, Rattus norvegicus
taccgtgggccgcttccattcgatg

SEQ ID NO: 551215 - DNA, 25 bp, Rattus norvegicus
cgcagtgtctcgtagtcctggttga

SEQ ID NO: 551216 - DNA, 25 bp, Rattus norvegicus
tccaggcactcgttccgcagtgtct

SEQ ID NO: 551217 - DNA, 25 bp, Rattus norvegicus
acttgatggctctctcgtgagaccc

SEQ ID NO: 551218 - DNA, 25 bp, Rattus norvegicus
ggtctgcgagccacatgtgtcaggc

SEQ ID NO: 551219 - DNA, 25 bp, Rattus norvegicus
ctgctgccaagttctgctggacttg

SEQ ID NO: 551220 - DNA, 25 bp, Rattus norvegicus
aagttctgctggacttggtcggtgc

SEQ ID NO: 551221 - DNA, 25 bp, Rattus norvegicus
ctgctggacttggtcggtgcctccc

SEQ ID NO: 551222 - DNA, 25 bp, Rattus norvegicus
gggcacctcggtctcgatctcagct

SEQ ID NO: 551223 - DNA, 25 bp, Rattus norvegicus
atcccgcaggcttcttccaggcgga

SEQ ID NO: 551224 - DNA, 25 bp, Rattus norvegicus
caggcttcttccaggcggaggttcc

SEQ ID NO: 551225 - DNA, 25 bp, Rattus norvegicus
tgcttcctggctcggtccgagggtc

SEQ ID NO: 551226 - DNA, 25 bp, Rattus norvegicus
tcgggtgcacccagggcacctcggt

SEQ ID NO: 551227 - DNA, 25 bp, Rattus norvegicus
cgggcgaacacttcgggtgcaccca

SEQ ID NO: 551228 - DNA, 25 bp, Rattus norvegicus
aggcaatatacccacgccgacggga

SEQ ID NO: 551229 - DNA, 25 bp, Rattus norvegicus
ttctcgtggcgaggcaatataccca

SEQ ID NO: 551230 - DNA, 25 bp, Rattus norvegicus
acatgtgtcaggctgtggctttctc

SEQ ID NO: 551231 - DNA, 25 bp, Rattus norvegicus
gtggctttctcgtggcgaggcaata

SEQ ID NO: 551232 - DNA, 25 bp, Rattus norvegicus
gcctggcgactcgagcccgacaggt

SEQ ID NO: 551233 - DNA, 25 bp, Rattus norvegicus
cgctcccgagctcaggtagcgggcg

SEQ ID NO: 551234 - DNA, 25 bp, Rattus norvegicus
gcgcctgggcctcgtcccttcctcc

SEQ ID NO: 551235 - DNA, 25 bp, Rattus norvegicus
ttaccctcactaccggcgctggctg

SEQ ID NO: 551236 - DNA, 25 bp, Rattus norvegicus
actcgagcccgacaggtgcaggcgc

SEQ ID NO: 551237 - DNA, 25 bp, Rattus norvegicus
agcctctgatggcacgcacggggca

SEQ ID NO: 551238 - DNA, 25 bp, Rattus norvegicus
tatgcgtacgcgcgtgtgtgaatgc

SEQ ID NO: 551239 - DNA, 25 bp, Rattus norvegicus
cgtgcatatgcgtacgcgcgtgtgt

SEQ ID NO: 551240 - DNA, 25 bp, Rattus norvegicus
tatgtgtgcgtgcatatgcgtacgc

SEQ ID NO: 551241 - DNA, 25 bp, Rattus norvegicus
tgcctgggtatgtgtgcgtgcatat

SEQ ID NO: 551242 - DNA, 25 bp, Rattus norvegicus
accgcggtgcagacctgcggtgtgt

SEQ ID NO: 551243 - DNA, 25 bp, Rattus norvegicus
tccagaggccactggtgaaggaccg

SEQ ID NO: 551244 - DNA, 25 bp, Rattus norvegicus
cacgcacggggcaagggctccagag

SEQ ID NO: 551245 - DNA, 25 bp, Rattus norvegicus
gtgcaggcgcgccggcttcccattg

SEQ ID NO: 551246 - DNA, 25 bp, Rattus norvegicus
ggagcgtctgcagagagcctgctct

SEQ ID NO: 551247 - DNA, 25 bp, Rattus norvegicus
ccagcaccctcgctgtgaaggttgt

SEQ ID NO: 551248 - DNA, 25 bp, Rattus norvegicus
cctcgctgtgaaggttgtgtgactc

SEQ ID NO: 551249 - DNA, 25 bp, Rattus norvegicus
gctgtgaaggttgtgtgactcaata

SEQ ID NO: 551250 - DNA, 25 bp, Rattus norvegicus
ggttgtgtgactcaatagcgcagtc

SEQ ID NO: 551251 - DNA, 25 bp, Rattus norvegicus
actcaatagcgcagtcacgtgtctg

SEQ ID NO: 551252 - DNA, 25 bp, Rattus norvegicus
gcgcagtcacgtgtctgagcgtatc

SEQ ID NO: 551253 - DNA, 25 bp, Rattus norvegicus
tcacgtgtctgagcgtatccagagc

SEQ ID NO: 551254 - DNA, 25 bp, Rattus norvegicus
atccagagcctgctgcgggcttgcc

SEQ ID NO: 551255 - DNA, 25 bp, Rattus norvegicus
cgtctgcagagagcctgctctttgt

SEQ ID NO: 551256 - DNA, 25 bp, Rattus norvegicus
ccggtccgtttctgcctgcagtggc

SEQ ID NO: 551257 - DNA, 25 bp, Rattus norvegicus
tgcagtggccaacaccgcgctgtct

SEQ ID NO: 551258 - DNA, 25 bp, Rattus norvegicus
acaccgcgctgtctggcacctgcga

SEQ ID NO: 551259 - DNA, 25 bp, Rattus norvegicus
tctgagcgtatccagagcctgctgc

SEQ ID NO: 551260 - DNA, 25 bp, Rattus norvegicus
ccgaagcacctgattgccgtgatgt

SEQ ID NO: 551261 - DNA, 25 bp, Rattus norvegicus
ccgtgatgttactgacgtagttagc

SEQ ID NO: 551262 - DNA, 25 bp, Rattus norvegicus
tggtgaagctggtgacaaacatgga

SEQ ID NO: 551263 - DNA, 25 bp, Rattus norvegicus
gctgcatgctgcaaggtgacgctta

SEQ ID NO: 551264 - DNA, 25 bp, Rattus norvegicus
aaggtgacgcttaccgcctcagacg

SEQ ID NO: 551265 - DNA, 25 bp, Rattus norvegicus
ctcagacgtttctgcacggggcttg

SEQ ID NO: 551266 - DNA, 25 bp, Rattus norvegicus
ccgatcccgaccaggatgatgagtg

SEQ ID NO: 551267 - DNA, 25 bp, Rattus norvegicus
tgtagttccagacgtcgcacaggac

SEQ ID NO: 551268 - DNA, 25 bp, Rattus norvegicus
cggtaaaggaagtaggagacgatca

SEQ ID NO: 551269 - DNA, 25 bp, Rattus norvegicus
tcagggagctgatgatggcaaacat

SEQ ID NO: 551270 - DNA, 25 bp, Rattus norvegicus
acatggtcatgagcgtgatgaacac

SEQ ID NO: 551271 - DNA, 25 bp, Rattus norvegicus
aacacggacttggtgtagacacaca

SEQ ID NO: 551272 - DNA, 25 bp, Rattus norvegicus
gcttgtcggacttggtgtagttcca

SEQ ID NO: 551273 - DNA, 25 bp, Rattus norvegicus
tcatgaatgggaagaactcgaagtt

SEQ ID NO: 551274 - DNA, 25 bp, Rattus norvegicus
cggcgctgagaggacatattctaca

SEQ ID NO: 551275 - DNA, 25 bp, Rattus norvegicus
cggcgctgagtggacatattctaca

SEQ ID NO: 551276 - DNA, 25 bp, Rattus norvegicus
tacggcgctgagaggacatattcta

SEQ ID NO: 551277 - DNA, 25 bp, Rattus norvegicus
cggcgctgagcggacatattctaca

SEQ ID NO: 551278 - DNA, 25 bp, Rattus norvegicus
cggcactgagcggacatattctaca

SEQ ID NO: 551279 - DNA, 25 bp, Rattus norvegicus
ggcgctgagcggacatattctacac

SEQ ID NO: 551280 - DNA, 25 bp, Rattus norvegicus
cggcgctgagtgaacatattctaca

SEQ ID NO: 551281 - DNA, 25 bp, Rattus norvegicus
acggcgctgagaggacatattctac

SEQ ID NO: 551282 - DNA, 25 bp, Rattus norvegicus
ggcactgagcggacatattctacac

SEQ ID NO: 551283 - DNA, 25 bp, Rattus norvegicus
gcactgagcggacatattctacacg

SEQ ID NO: 551284 - DNA, 25 bp, Rattus norvegicus
actacggcgctgagaggacatattc

SEQ ID NO: 551285 - DNA, 25 bp, Rattus norvegicus
ctacggcgctgagaggacatattct

SEQ ID NO: 551286 - DNA, 25 bp, Rattus norvegicus
ggcgctgagtggacatattctacat

SEQ ID NO: 551287 - DNA, 25 bp, Rattus norvegicus
ctacggcgctgagtgaacatattct

SEQ ID NO: 551288 - DNA, 25 bp, Rattus norvegicus
aagaagcatccacaccgaccgcagg

SEQ ID NO: 551289 - DNA, 25 bp, Rattus norvegicus
agctcgcggatcctggcccggagcc

SEQ ID NO: 551290 - DNA, 25 bp, Rattus norvegicus
ctgctccagccggagctcgcggatc

SEQ ID NO: 551291 - DNA, 25 bp, Rattus norvegicus
catccctacgagcttcgggacacgg

SEQ ID NO: 551292 - DNA, 25 bp, Rattus norvegicus
gcgtcccggacactgaggctccgaa

SEQ ID NO: 551293 - DNA, 25 bp, Rattus norvegicus
gcagcgcgaagaagcatccacaccg

SEQ ID NO: 551294 - DNA, 25 bp, Rattus norvegicus
gggacgcagcgcgaagaagcatcca

SEQ ID NO: 551295 - DNA, 25 bp, Rattus norvegicus
cagccgtcctcacccaggggtcccg

SEQ ID NO: 551296 - DNA, 25 bp, Rattus norvegicus
cggcctcctcagtccctcgcagcca

SEQ ID NO: 551297 - DNA, 25 bp, Rattus norvegicus
tggaggatgtcacctcggcctcctc

SEQ ID NO: 551298 - DNA, 25 bp, Rattus norvegicus
cccgtggaggatgtcacctcggcct

SEQ ID NO: 551299 - DNA, 25 bp, Rattus norvegicus
acgagcttcgggacacggacacacc

SEQ ID NO: 551300 - DNA, 25 bp, Rattus norvegicus
ccctacgagcttcgggacacggaca

SEQ ID NO: 551301 - DNA, 25 bp, Rattus norvegicus
gtcccggacactgaggctccgaact

SEQ ID NO: 551302 - DNA, 25 bp, Rattus norvegicus
gccgacttcgactcttggggccagc

SEQ ID NO: 551303 - DNA, 25 bp, Rattus norvegicus
tagcagcaaccaaagccgacgccgg

SEQ ID NO: 551304 - DNA, 25 bp, Rattus norvegicus
gagtcggccgatctagacgctaaca

SEQ ID NO: 551305 - DNA, 25 bp, Rattus norvegicus
ttccactgactaccatccaagggtg

SEQ ID NO: 551306 - DNA, 25 bp, Rattus norvegicus
aggggatgaccttccactgaagttc

SEQ ID NO: 551307 - DNA, 25 bp, Rattus norvegicus
ggagatctcaaactcacacgctttc

SEQ ID NO: 551308 - DNA, 25 bp, Rattus norvegicus
ttctgacaagcttaccggagacctc

SEQ ID NO: 551309 - DNA, 25 bp, Rattus norvegicus
cgtaaggcccactcttcctgctgaa

SEQ ID NO: 551310 - DNA, 25 bp, Rattus norvegicus
ggagcccagtagcaccgagataact

SEQ ID NO: 551311 - DNA, 25 bp, Rattus norvegicus
tgcccttacttctcgagcttctgtc

SEQ ID NO: 551312 - DNA, 25 bp, Rattus norvegicus
ttaatgccggatgccactgtagcga

SEQ ID NO: 551313 - DNA, 25 bp, Rattus norvegicus
ccgccttggagctgcaaagtttggc

SEQ ID NO: 551314 - DNA, 25 bp, Rattus norvegicus
cagtcttaggagaggcgccgacttc

SEQ ID NO: 551315 - DNA, 25 bp, Rattus norvegicus
gcggttcctcctggtcctgttaatg

SEQ ID NO: 551316 - DNA, 25 bp, Rattus norvegicus
tacagccatggagggaccctgtttc

SEQ ID NO: 551317 - DNA, 25 bp, Rattus norvegicus
accctgtttcgagtcgtctctggcc

SEQ ID NO: 551318 - DNA, 25 bp, Rattus norvegicus
cgcagctacagccatggagggaccc

SEQ ID NO: 551319 - DNA, 25 bp, Rattus norvegicus
ggaacagaagcaccgcgcgcagccg

SEQ ID NO: 551320 - DNA, 25 bp, Rattus norvegicus
ctcctgagaacagactggggacggc

SEQ ID NO: 551321 - DNA, 25 bp, Rattus norvegicus
ttcggagtcgggctcctgagaacag

SEQ ID NO: 551322 - DNA, 25 bp, Rattus norvegicus
ccgtgtagttctctggggtgcagct

SEQ ID NO: 551323 - DNA, 25 bp, Rattus norvegicus
gtcctcctccgtgtagttctctggg

SEQ ID NO: 551324 - DNA, 25 bp, Rattus norvegicus
ttgcgggttccaaaacaacacggca

SEQ ID NO: 551325 - DNA, 25 bp, Rattus norvegicus
tccagcgcttgctgttccagcctgg

SEQ ID NO: 551326 - DNA, 25 bp, Rattus norvegicus
aaccgccgctcattctggctgtaca

SEQ ID NO: 551327 - DNA, 25 bp, Rattus norvegicus
gacggatgtattgcgggttccaaaa

SEQ ID NO: 551328 - DNA, 25 bp, Rattus norvegicus
cgtctctggcctcgggaaagttgga

SEQ ID NO: 551329 - DNA, 25 bp, Rattus norvegicus
agagccaggcgtcctcctccgtgta

SEQ ID NO: 551330 - DNA, 25 bp, Rattus norvegicus
caccagtgacgttgataagaggtca

SEQ ID NO: 551331 - DNA, 25 bp, Rattus norvegicus
gtcgcatctgcgacgtcagggctcc

SEQ ID NO: 551332 - DNA, 25 bp, Rattus norvegicus
gggctccactccgatcctcatttat

SEQ ID NO: 551333 - DNA, 25 bp, Rattus norvegicus
cctcatttatcacgcggagagaaga

SEQ ID NO: 551334 - DNA, 25 bp, Rattus norvegicus
aagacgcctttgcagacacaggttc

SEQ ID NO: 551335 - DNA, 25 bp, Rattus norvegicus
cacaggttcgagctgtacgtctttc

SEQ ID NO: 551336 - DNA, 25 bp, Rattus norvegicus
gcggcaccagcaccagtgacgttga

SEQ ID NO: 551337 - DNA, 25 bp, Rattus norvegicus
ctgaaacactggctggacgcaggcg

SEQ ID NO: 551338 - DNA, 25 bp, Rattus norvegicus
cggctctgtcgctgtgctaaagata

SEQ ID NO: 551339 - DNA, 25 bp, Rattus norvegicus
gtcgctgtgctaaagataatctcta

SEQ ID NO: 551340 - DNA, 25 bp, Rattus norvegicus
ggctttgtgcagagaacacggagaa

SEQ ID NO: 551341 - DNA, 25 bp, Rattus norvegicus
agaaataaaggggacggcacagaga

SEQ ID NO: 551342 - DNA, 25 bp, Rattus norvegicus
ctcggcgactgaaacactggctgga

SEQ ID NO: 551343 - DNA, 25 bp, Rattus norvegicus
tacgtctttcgcttggtgctcggct

SEQ ID NO: 551344 - DNA, 25 bp, Rattus norvegicus
cagagccgggtcactgaacaggaca

SEQ ID NO: 551345 - DNA, 25 bp, Rattus norvegicus
cggggccgccatgggcaacctgttc

SEQ ID NO: 551346 - DNA, 25 bp, Rattus norvegicus
ggcgttcgcacagcctaggaagtcc

SEQ ID NO: 551347 - DNA, 25 bp, Rattus norvegicus
cacagcctaggaagtccagcggtgc

SEQ ID NO: 551348 - DNA, 25 bp, Rattus norvegicus
gaagtccagcggtgcgctgcgcaaa

SEQ ID NO: 551349 - DNA, 25 bp, Rattus norvegicus
gctgcgcaaaggacgaagctgcttc

SEQ ID NO: 551350 - DNA, 25 bp, Rattus norvegicus
acgaagctgcttcgcgttctgaggc

SEQ ID NO: 551351 - DNA, 25 bp, Rattus norvegicus
cgtgggccgcgcttccggtgctatc

SEQ ID NO: 551352 - DNA, 25 bp, Rattus norvegicus
ttccggtgctatcgcctgtccagct

SEQ ID NO: 551353 - DNA, 25 bp, Rattus norvegicus
gctatcgcctgtccagctgcaggca

SEQ ID NO: 551354 - DNA, 25 bp, Rattus norvegicus
ccggaaagaccgggattgtgtctag

SEQ ID NO: 551355 - DNA, 25 bp, Rattus norvegicus
ctgttcggtcgcaagaagcagagcc

SEQ ID NO: 551356 - DNA, 25 bp, Rattus norvegicus
tcgcaagaagcagagccgggtcact

SEQ ID NO: 551357 - DNA, 25 bp, Rattus norvegicus
atgggcaacctgttcggtcgcaaga

SEQ ID NO: 551358 - DNA, 25 bp, Rattus norvegicus
cgcgtgatagtccagtagcgatcca

SEQ ID NO: 551359 - DNA, 25 bp, Rattus norvegicus
ccgtctgcggccgaatcgaaacttg

SEQ ID NO: 551360 - DNA, 25 bp, Rattus norvegicus
gcggctttgtatatcttccagtaga

SEQ ID NO: 551361 - DNA, 25 bp, Rattus norvegicus
tccagtagacgaagagcaccacggc

SEQ ID NO: 551362 - DNA, 25 bp, Rattus norvegicus
ccagaggcacgtagaaagctccgca

SEQ ID NO: 551363 - DNA, 25 bp, Rattus norvegicus
gctgcagccgagcatcgtaggcttc

SEQ ID NO: 551364 - DNA, 25 bp, Rattus norvegicus
atcataagtgctgaagcgcggcgcc

SEQ ID NO: 551365 - DNA, 25 bp, Rattus norvegicus
ctgtgcagcacaacacgtcgaagga

SEQ ID NO: 551366 - DNA, 25 bp, Rattus norvegicus
cgtcgaaggagatccacacgtggca

SEQ ID NO: 551367 - DNA, 25 bp, Rattus norvegicus
tcgctcaccaggctcagtggcatca

SEQ ID NO: 551368 - DNA, 25 bp, Rattus norvegicus
gcggtcgaggctaccaagttatgtg

SEQ ID NO: 551369 - DNA, 25 bp, Rattus norvegicus
acgcgcaggatagtcaccagaacta

SEQ ID NO: 551370 - DNA, 25 bp, Rattus norvegicus
gtggcagcgatcagcaacaccagta

SEQ ID NO: 551371 - DNA, 25 bp, Rattus norvegicus
cagtgcccaggtgatcgcgatcata

SEQ ID NO: 551372 - DNA, 25 bp, Rattus norvegicus
ccagccgggacttctgagggcgcca

SEQ ID NO: 551373 - DNA, 25 bp, Rattus norvegicus
cagtaggcggctgaccagagactaa

SEQ ID NO: 551374 - DNA, 25 bp, Rattus norvegicus
tccaaggcgaaggagcagccgcccg

SEQ ID NO: 551375 - DNA, 25 bp, Rattus norvegicus
ggtttcttgacagcggccgggtcca

SEQ ID NO: 551376 - DNA, 25 bp, Rattus norvegicus
aaagagggtttcttgacagcggccg

SEQ ID NO: 551377 - DNA, 25 bp, Rattus norvegicus
gtccgcgatgcagaaagagggtttc

SEQ ID NO: 551378 - DNA, 25 bp, Rattus norvegicus
gcggctgaccagagactaaagttgg

SEQ ID NO: 551379 - DNA, 25 bp, Rattus norvegicus
cgtgcaggatgtccgcgatgcagaa

SEQ ID NO: 551380 - DNA, 25 bp, Rattus norvegicus
tgcacggagcccaagtgtgcggtga

SEQ ID NO: 551381 - DNA, 25 bp, Rattus norvegicus
atctggcggcagcttggaaggaagc

SEQ ID NO: 551382 - DNA, 25 bp, Rattus norvegicus
aatccagccgggacttctgagggcg

SEQ ID NO: 551383 - DNA, 25 bp, Rattus norvegicus
ctgagggaatccagccgggacttct

SEQ ID NO: 551384 - DNA, 25 bp, Rattus norvegicus
cggagacagccgctgagggaatcca

SEQ ID NO: 551385 - DNA, 25 bp, Rattus norvegicus
agactaaagttggaagcgtagaagg

SEQ ID NO: 551386 - DNA, 25 bp, Rattus norvegicus
tgtcttcgtgaccaatgggactccg

SEQ ID NO: 551387 - DNA, 25 bp, Rattus norvegicus
accttgatccgtgcgctcattggct

SEQ ID NO: 551388 - DNA, 25 bp, Rattus norvegicus
tggctgtcttcgtgaccaatgggac

SEQ ID NO: 551389 - DNA, 25 bp, Rattus norvegicus
tcagacccggggtaggaccttgatc

SEQ ID NO: 551390 - DNA, 25 bp, Rattus norvegicus
ttcgtgaccaatgggactccggagt

SEQ ID NO: 551391 - DNA, 25 bp, Rattus norvegicus
acgccctggccacgccaaagtgttt

SEQ ID NO: 551392 - DNA, 25 bp, Rattus norvegicus
cctggccacgccaaagtgttttctg

SEQ ID NO: 551393 - DNA, 25 bp, Rattus norvegicus
gccaaagtgttttctgcggccgcgt

SEQ ID NO: 551394 - DNA, 25 bp, Rattus norvegicus
ggctgagcagagtcctgagagtatc

SEQ ID NO: 551395 - DNA, 25 bp, Rattus norvegicus
tcctgagagtatctgggagccgctt

SEQ ID NO: 551396 - DNA, 25 bp, Rattus norvegicus
gccgaaagtcgactcctagggcctc

SEQ ID NO: 551397 - DNA, 25 bp, Rattus norvegicus
aaagtcgactcctagggcctctggc

SEQ ID NO: 551398 - DNA, 25 bp, Rattus norvegicus
gccacccgcagagcctcggagtccg

SEQ ID NO: 551399 - DNA, 25 bp, Rattus norvegicus
tgcgctcattggctgtcttcgtgac

SEQ ID NO: 551400 - DNA, 25 bp, Rattus norvegicus
gttgtgccaccgttcccacttgctg

SEQ ID NO: 551401 - DNA, 25 bp, Rattus norvegicus
acccacacagcctaggtcagcgtgg

SEQ ID NO: 551402 - DNA, 25 bp, Rattus norvegicus
cagcctaggtcagcgtggtgatgct

SEQ ID NO: 551403 - DNA, 25 bp, Rattus norvegicus
atgctcggcgttcgcatacctgtcg

SEQ ID NO: 551404 - DNA, 25 bp, Rattus norvegicus
atggcagtgcactccgcctcggtca

SEQ ID NO: 551405 - DNA, 25 bp, Rattus norvegicus
atcgggtagatccagagttgtgcca

SEQ ID NO: 551406 - DNA, 25 bp, Rattus norvegicus
tagatccagagttgtgccaccgttc

SEQ ID NO: 551407 - DNA, 25 bp, Rattus norvegicus
cagcgcggcgacacagacccaggtg

SEQ ID NO: 551408 - DNA, 25 bp, Rattus norvegicus
gcgacacagacccaggtggaccctg

SEQ ID NO: 551409 - DNA, 25 bp, Rattus norvegicus
acacccgggtcgcagagaagccgag

SEQ ID NO: 551410 - DNA, 25 bp, Rattus norvegicus
cagcgcccaggtgcgggcactcatg

SEQ ID NO: 551411 - DNA, 25 bp, Rattus norvegicus
gctgatacacctcgggcgccaactg

SEQ ID NO: 551412 - DNA, 25 bp, Rattus norvegicus
tggaccaagagctactgtggccggc

SEQ ID NO: 551413 - DNA, 25 bp, Rattus norvegicus
gcgccaactggaccaagagctactg

SEQ ID NO: 551414 - DNA, 25 bp, Rattus norvegicus
cgctgcactcgtttacccttttgct

SEQ ID NO: 551415 - DNA, 25 bp, Rattus norvegicus
tctgcaggtacagacaagacgactg

SEQ ID NO: 551416 - DNA, 25 bp, Rattus norvegicus
ggaacgctcggcttcaacctctgca

SEQ ID NO: 551417 - DNA, 25 bp, Rattus norvegicus
cggagatcgcgccaactcagtggaa

SEQ ID NO: 551418 - DNA, 25 bp, Rattus norvegicus
gcgagaagccgcactcaaatgaagc

SEQ ID NO: 551419 - DNA, 25 bp, Rattus norvegicus
ttccttcctttgctcggctcgcaaa

SEQ ID NO: 551420 - DNA, 25 bp, Rattus norvegicus
cgcaaagtttgcactcaccgagggg

SEQ ID NO: 551421 - DNA, 25 bp, Rattus norvegicus
ggtacggaactcctctctcgacttc

SEQ ID NO: 551422 - DNA, 25 bp, Rattus norvegicus
cacgcgtggggtagtcactttcatt

SEQ ID NO: 551423 - DNA, 25 bp, Rattus norvegicus
agcgcctgtcaaacttctgctgaag

SEQ ID NO: 551424 - DNA, 25 bp, Rattus norvegicus
gtagatccaaaccttcgacaccgtg

SEQ ID NO: 551425 - DNA, 25 bp, Rattus norvegicus
ccatgtcggtgcactcagtctcgca

SEQ ID NO: 551426 - DNA, 25 bp, Rattus norvegicus
ggacccacacttccaagccgggata

SEQ ID NO: 551427 - DNA, 25 bp, Rattus norvegicus
ttgcttctaaaagcgcactcagttg

SEQ ID NO: 551428 - DNA, 25 bp, Rattus norvegicus
tccggcaaccgtaggtcgcagcaca

SEQ ID NO: 551429 - DNA, 25 bp, Rattus norvegicus
cgggctaggaggcaacctttgctct

SEQ ID NO: 551430 - DNA, 25 bp, Rattus norvegicus
tagccagaccggacataaagctttc

SEQ ID NO: 551431 - DNA, 25 bp, Rattus norvegicus
gcgactcccggttctgtctgaatca

SEQ ID NO: 551432 - DNA, 25 bp, Rattus norvegicus
ccaccgtcatgatgccgcggagctg

SEQ ID NO: 551433 - DNA, 25 bp, Rattus norvegicus
tgcccgcctaagtctagtgaccgta

SEQ ID NO: 551434 - DNA, 25 bp, Rattus norvegicus
atagcatctgtctcctcgtcaccgg

SEQ ID NO: 551435 - DNA, 25 bp, Rattus norvegicus
tgccgtacttcttcagttttcgccg

SEQ ID NO: 551436 - DNA, 25 bp, Rattus norvegicus
caagctgctcgccttgcttcggagc

SEQ ID NO: 551437 - DNA, 25 bp, Rattus norvegicus
acgcgggcgtctaggattcaatcac

SEQ ID NO: 551438 - DNA, 25 bp, Rattus norvegicus
tcacctaacgttctcctgtggcggg

SEQ ID NO: 551439 - DNA, 25 bp, Rattus norvegicus
acggtcccggactacagcttcgcaa

SEQ ID NO: 551440 - DNA, 25 bp, Rattus norvegicus
tgggcccaaggttccaagtcaacta

SEQ ID NO: 551441 - DNA, 25 bp, Rattus norvegicus
acctcttcttgggtttgtcgcctgg

SEQ ID NO: 551442 - DNA, 25 bp, Rattus norvegicus
ccgcgctggaggctcggggtgtaga

SEQ ID NO: 551443 - DNA, 25 bp, Rattus norvegicus
gctcgcccaggtggccgcgctggag

SEQ ID NO: 551444 - DNA, 25 bp, Rattus norvegicus
gaggggcactcacgttctccgtgtc

SEQ ID NO: 551445 - DNA, 25 bp, Rattus norvegicus
aggggcactcacgttctccgtgtcc

SEQ ID NO: 551446 - DNA, 25 bp, Rattus norvegicus
tcacgttctccgtgtcccgctcgtt

SEQ ID NO: 551447 - DNA, 25 bp, Rattus norvegicus
tgtcccgctcgttcaccgtgggcaa

SEQ ID NO: 551448 - DNA, 25 bp, Rattus norvegicus
gtcccgctcgttcaccgtgggcaat

SEQ ID NO: 551449 - DNA, 25 bp, Rattus norvegicus
tcccgctcgttcaccgtgggcaatg

SEQ ID NO: 551450 - DNA, 25 bp, Rattus norvegicus
cgctcgttcaccgtgggcaatgcgt

SEQ ID NO: 551451 - DNA, 25 bp, Rattus norvegicus
gctcgttcaccgtgggcaatgcgtc

SEQ ID NO: 551452 - DNA, 25 bp, Rattus norvegicus
ctcgttcaccgtgggcaatgcgtcc

SEQ ID NO: 551453 - DNA, 25 bp, Rattus norvegicus
cgttcaccgtgggcaatgcgtccgc

SEQ ID NO: 551454 - DNA, 25 bp, Rattus norvegicus
gtcaggccgggctcgcccaggtggc

SEQ ID NO: 551455 - DNA, 25 bp, Rattus norvegicus
aggctcggggtgtagaggggcactc

SEQ ID NO: 551456 - DNA, 25 bp, Rattus norvegicus
atctgccgcttttcgggctgctttg

SEQ ID NO: 551457 - DNA, 25 bp, Rattus norvegicus
tgtccgggatataaatgtagggacc

SEQ ID NO: 551458 - DNA, 25 bp, Rattus norvegicus
accctccgcacaaggcccgcggctg

SEQ ID NO: 551459 - DNA, 25 bp, Rattus norvegicus
cccaaagcatggtggaggaccgggc

SEQ ID NO: 551460 - DNA, 25 bp, Rattus norvegicus
gctgctgtccgggatataaatgtag

SEQ ID NO: 551461 - DNA, 25 bp, Rattus norvegicus
ggctacggagcgtaccacgagcctc

SEQ ID NO: 551462 - DNA, 25 bp, Rattus norvegicus
agtgtcgcggtatctgccgcttttc

SEQ ID NO: 551463 - DNA, 25 bp, Rattus norvegicus
ttcatcgggaagttggtctgcggca

SEQ ID NO: 551464 - DNA, 25 bp, Rattus norvegicus
tccatgtcggactgctggtggccca

SEQ ID NO: 551465 - DNA, 25 bp, Rattus norvegicus
ggatctccagctccatgtcggactg

SEQ ID NO: 551466 - DNA, 25 bp, Rattus norvegicus
cggcagcagcacagtgtcgcggtat

SEQ ID NO: 551467 - DNA, 25 bp, Rattus norvegicus
gcccagcagcttcatcgggaagttg

SEQ ID NO: 551468 - DNA, 25 bp, Rattus norvegicus
cgtccggtacctgctggatctccag

SEQ ID NO: 551469 - DNA, 25 bp, Rattus norvegicus
tgctggtggcccagcagcttcatcg

SEQ ID NO: 551470 - DNA, 25 bp, Rattus norvegicus
tgcacattgaactggtggacctgga

SEQ ID NO: 551471 - DNA, 25 bp, Rattus norvegicus
gctttgacggcaggcggcgttaacc

SEQ ID NO: 551472 - DNA, 25 bp, Rattus norvegicus
aggcggcgttaacctgcgcaaaacg

SEQ ID NO: 551473 - DNA, 25 bp, Rattus norvegicus
tgcgcaaaacgctcagaaatgggtt

SEQ ID NO: 551474 - DNA, 25 bp, Rattus norvegicus
gaaatgggttttccgactgctagga

SEQ ID NO: 551475 - DNA, 25 bp, Rattus norvegicus
tgcgccgacctctcgcacgcgcagc

SEQ ID NO: 551476 - DNA, 25 bp, Rattus norvegicus
cctggaggcagcctgttctgtgaca

SEQ ID NO: 551477 - DNA, 25 bp, Rattus norvegicus
tctgtgacagcgagccaccaggccg

SEQ ID NO: 551478 - DNA, 25 bp, Rattus norvegicus
gccaccaggccggacatcgcttagg

SEQ ID NO: 551479 - DNA, 25 bp, Rattus norvegicus
ccggacatcgcttaggggacgccag

SEQ ID NO: 551480 - DNA, 25 bp, Rattus norvegicus
caggctgactgtaagtttctctggc

SEQ ID NO: 551481 - DNA, 25 bp, Rattus norvegicus
gactgtaagtttctctggcggccgc

SEQ ID NO: 551482 - DNA, 25 bp, Rattus norvegicus
gtaagtttctctggcggccgcgcag

SEQ ID NO: 551483 - DNA, 25 bp, Rattus norvegicus
ggttttccgactgctaggagcgcgc

SEQ ID NO: 551484 - DNA, 25 bp, Rattus norvegicus
tgtgccttacggtgaacgccggaaa

SEQ ID NO: 551485 - DNA, 25 bp, Rattus norvegicus
gggagacgcgagacttctttcaatg

SEQ ID NO: 551486 - DNA, 25 bp, Rattus norvegicus
ttccctcacttaacgacgagtctta

SEQ ID NO: 551487 - DNA, 25 bp, Rattus norvegicus
gttccttttctacagcggagtagca

SEQ ID NO: 551488 - DNA, 25 bp, Rattus norvegicus
ggagtagcacctcacttgcgaccta

SEQ ID NO: 551489 - DNA, 25 bp, Rattus norvegicus
tgcgacctaacctgatgcaactgga

SEQ ID NO: 551490 - DNA, 25 bp, Rattus norvegicus
cggcgcaccgtgattacgatcaata

SEQ ID NO: 551491 - DNA, 25 bp, Rattus norvegicus
agcgttttccagacgtcagtgtccg

SEQ ID NO: 551492 - DNA, 25 bp, Rattus norvegicus
gcatgccttgacctctgcattcgtg

SEQ ID NO: 551493 - DNA, 25 bp, Rattus norvegicus
gtgcctcggcggacgcatatttatg

SEQ ID NO: 551494 - DNA, 25 bp, Rattus norvegicus
ttgcagcgtgcgcaatgacactagc

SEQ ID NO: 551495 - DNA, 25 bp, Rattus norvegicus
taggttccacggcagtcatgctgag

SEQ ID NO: 551496 - DNA, 25 bp, Rattus norvegicus
cgcgcgtacacgttgcatctcctag

SEQ ID NO: 551497 - DNA, 25 bp, Rattus norvegicus
cctgacgagtagactgcagctcctg

SEQ ID NO: 551498 - DNA, 25 bp, Rattus norvegicus
gacctactagttggccacgcttgtg

SEQ ID NO: 551499 - DNA, 25 bp, Rattus norvegicus
tttattgactggactcccaagttgc

SEQ ID NO: 551500 - DNA, 25 bp, Rattus norvegicus
accctttattgactggactcccaag

SEQ ID NO: 551501 - DNA, 25 bp, Rattus norvegicus
gcttaaccctttattgactggactc

SEQ ID NO: 551502 - DNA, 25 bp, Rattus norvegicus
gtgcgcttaaccctttattgactgg

SEQ ID NO: 551503 - DNA, 25 bp, Rattus norvegicus
tgtgtgcgcttaaccctttattgac

SEQ ID NO: 551504 - DNA, 25 bp, Rattus norvegicus
cgcttgtgtgcgcttaaccctttat

SEQ ID NO: 551505 - DNA, 25 bp, Rattus norvegicus
cggacctactagttggccacgcttg

SEQ ID NO: 551506 - DNA, 25 bp, Rattus norvegicus
tactagttggccacgcttgtgtgcg

SEQ ID NO: 551507 - DNA, 25 bp, Rattus norvegicus
ctcccaagttgcgattggagtttgc

SEQ ID NO: 551508 - DNA, 25 bp, Rattus norvegicus
attggagtttgctgacaggacggac

SEQ ID NO: 551509 - DNA, 25 bp, Rattus norvegicus
tgcgattggagtttgctgacaggac

SEQ ID NO: 551510 - DNA, 25 bp, Rattus norvegicus
tggccacgcttgtgtgcgcttaacc

SEQ ID NO: 551511 - DNA, 25 bp, Rattus norvegicus
tttgctgacaggacggacgaaaggc

SEQ ID NO: 551512 - DNA, 25 bp, Rattus norvegicus
tgcaccggctcacggaaaatgtcta

SEQ ID NO: 551513 - DNA, 25 bp, Rattus norvegicus
ggccttcggcggctataaaagcggc

SEQ ID NO: 551514 - DNA, 25 bp, Rattus norvegicus
ccgcctccgaaatctaccaatagga

SEQ ID NO: 551515 - DNA, 25 bp, Rattus norvegicus
cctcaggcagctctagggcctcaga

SEQ ID NO: 551516 - DNA, 25 bp, Rattus norvegicus
tgagggacccttgagggccttcaac

SEQ ID NO: 551517 - DNA, 25 bp, Rattus norvegicus
tcgcgcactcctgagggacccttga

SEQ ID NO: 551518 - DNA, 25 bp, Rattus norvegicus
ttgctgcagttgtcgcctttctcac

SEQ ID NO: 551519 - DNA, 25 bp, Rattus norvegicus
gggacccaggaccatgtcgctttca

SEQ ID NO: 551520 - DNA, 25 bp, Rattus norvegicus
ctttcacgctcggaggagatgcacc

SEQ ID NO: 551521 - DNA, 25 bp, Rattus norvegicus
tccgagtcgtccctaggtcttcagg

SEQ ID NO: 551522 - DNA, 25 bp, Rattus norvegicus
gtcttcaggcccgagcagggcaccg

SEQ ID NO: 551523 - DNA, 25 bp, Rattus norvegicus
ggccgatcttcggttggtcacaggt

SEQ ID NO: 551524 - DNA, 25 bp, Rattus norvegicus
gcgcgccttttcctgttgctgcagt

SEQ ID NO: 551525 - DNA, 25 bp, Rattus norvegicus
tcacctgcaatagcgcgggagccac

SEQ ID NO: 551526 - DNA, 25 bp, Rattus norvegicus
cagcgccacctacggctatgtgcgg

SEQ ID NO: 551527 - DNA, 25 bp, Rattus norvegicus
tcgacgacccggagctggtactcat

SEQ ID NO: 551528 - DNA, 25 bp, Rattus norvegicus
gctgctctcggactcgttcaacatg

SEQ ID NO: 551529 - DNA, 25 bp, Rattus norvegicus
gggctgtaaagatgggccgttattc

SEQ ID NO: 551530 - DNA, 25 bp, Rattus norvegicus
cctcggccggaagaaagcagcagga

SEQ ID NO: 551531 - DNA, 25 bp, Rattus norvegicus
gtggggctgctcatcttccaggact

SEQ ID NO: 551532 - DNA, 25 bp, Rattus norvegicus
taccatcttcgtggaggccgtgttg

SEQ ID NO: 551533 - DNA, 25 bp, Rattus norvegicus
cgcgctctgctttaccatcttcgtg

SEQ ID NO: 551534 - DNA, 25 bp, Rattus norvegicus
gggcgcgctcagcaacgcagtcttc

SEQ ID NO: 551535 - DNA, 25 bp, Rattus norvegicus
gtctgatctgatctcgctgtgcgtg

SEQ ID NO: 551536 - DNA, 25 bp, Rattus norvegicus
ttcttcgtggccgaactggtgtcgg

SEQ ID NO: 551537 - DNA, 25 bp, Rattus norvegicus
aagacctgtcggctgctgttcatgc

SEQ ID NO: 551538 - DNA, 25 bp, Rattus norvegicus
cgttattcgggcaagacctgtcggc

SEQ ID NO: 551539 - DNA, 25 bp, Rattus norvegicus
cggctcagactcagcagtgactctc

SEQ ID NO: 551540 - DNA, 25 bp, Rattus norvegicus
tctgggttcccgaagtcgttcgaca

SEQ ID NO: 551541 - DNA, 25 bp, Rattus norvegicus
ttggagaccgaatttcctgcagcgc

SEQ ID NO: 551542 - DNA, 25 bp, Rattus norvegicus
tgcgcaggagtttcatctgtaactg

SEQ ID NO: 551543 - DNA, 25 bp, Rattus norvegicus
ggggttcagcacagctcaccttgca

SEQ ID NO: 551544 - DNA, 25 bp, Rattus norvegicus
tgcagcttcaggttccgttgccgca

SEQ ID NO: 551545 - DNA, 25 bp, Rattus norvegicus
cagcttggcgttccgcttttcgatc

SEQ ID NO: 551546 - DNA, 25 bp, Rattus norvegicus
gcttttcgatcttcttgcgcaggag

SEQ ID NO: 551547 - DNA, 25 bp, Rattus norvegicus
taactgcgacatgttgccgggttgc

SEQ ID NO: 551548 - DNA, 25 bp, Rattus norvegicus
ccgtctgcaccgagcgacagatgca

SEQ ID NO: 551549 - DNA, 25 bp, Rattus norvegicus
cacgtgcgcagttccgagtcggaag

SEQ ID NO: 551550 - DNA, 25 bp, Rattus norvegicus
tcggaagtgttgtatcgctggactc

SEQ ID NO: 551551 - DNA, 25 bp, Rattus norvegicus
atgctttgggcggaaacggtttctg

SEQ ID NO: 551552 - DNA, 25 bp, Rattus norvegicus
gagagctgggtttcctttggagacc

SEQ ID NO: 551553 - DNA, 25 bp, Rattus norvegicus
gcgcaccgccgagtttctgggttcc

SEQ ID NO: 551554 - DNA, 25 bp, Rattus norvegicus
atctgaggaactccgggccaacctt

SEQ ID NO: 551555 - DNA, 25 bp, Rattus norvegicus
gtagtactcctcgtcgcttcgctcg

SEQ ID NO: 551556 - DNA, 25 bp, Rattus norvegicus
tggatctgaggaactccgggccaac

SEQ ID NO: 551557 - DNA, 25 bp, Rattus norvegicus
ggctgctgtggatctgaggaactcc

SEQ ID NO: 551558 - DNA, 25 bp, Rattus norvegicus
aacctccttggcgtagtactcctcg

SEQ ID NO: 551559 - DNA, 25 bp, Rattus norvegicus
ggacggcatgtcgattttataaacc

SEQ ID NO: 551560 - DNA, 25 bp, Rattus norvegicus
gaagtgggacggcatgtcgatttta

SEQ ID NO: 551561 - DNA, 25 bp, Rattus norvegicus
aggacagaacggaaacgaagcgatc

SEQ ID NO: 551562 - DNA, 25 bp, Rattus norvegicus
cagaacggaaacgaagcgatcggga

SEQ ID NO: 551563 - DNA, 25 bp, Rattus norvegicus
cgaagcgatcgggacctggggactt

SEQ ID NO: 551564 - DNA, 25 bp, Rattus norvegicus
aagggcgaacgcctaaaggctgctg

SEQ ID NO: 551565 - DNA, 25 bp, Rattus norvegicus
ttggcgtagtactcctcgtcgcttc

SEQ ID NO: 551566 - DNA, 25 bp, Rattus norvegicus
cgcctaaaggctgctgtggatctga

SEQ ID NO: 551567 - DNA, 25 bp, Rattus norvegicus
atgtcgattttataaacctccttgg

SEQ ID NO: 551568 - DNA, 25 bp, Rattus norvegicus
gtgcggagtggctgatctgaactcc

SEQ ID NO: 551569 - DNA, 25 bp, Rattus norvegicus
ctgtggcctacacccggctgggtcg

SEQ ID NO: 551570 - DNA, 25 bp, Rattus norvegicus
ggccctgccttccacacgtgtgtgg

SEQ ID NO: 551571 - DNA, 25 bp, Rattus norvegicus
gctgatctgaactccgatcctccgg

SEQ ID NO: 551572 - DNA, 25 bp, Rattus norvegicus
tgcgccgggctctaactgagatgtt

SEQ ID NO: 551573 - DNA, 25 bp, Rattus norvegicus
ctgagatgttcaaagaccgagcggc

SEQ ID NO: 551574 - DNA, 25 bp, Rattus norvegicus
ttcaaagaccgagcggctgggccct

SEQ ID NO: 551575 - DNA, 25 bp, Rattus norvegicus
tccacacgtgtgtggatgagtgtgc

SEQ ID NO: 551576 - DNA, 25 bp, Rattus norvegicus
ccggagcggctcactctcggagact

SEQ ID NO: 551577 - DNA, 25 bp, Rattus norvegicus
actctcggagactcggtggggcact

SEQ ID NO: 551578 - DNA, 25 bp, Rattus norvegicus
cgggagatccgccaaggcctgagca

SEQ ID NO: 551579 - DNA, 25 bp, Rattus norvegicus
ctcctgcgggccgtgctgtggccta

SEQ ID NO: 551580 - DNA, 25 bp, Rattus norvegicus
ggctgggtcgctccacgttgcagcc

SEQ ID NO: 551581 - DNA, 25 bp, Rattus norvegicus
aaggcctgagcaggcagccacgacc

SEQ ID NO: 551582 - DNA, 25 bp, Rattus norvegicus
ttgtccggcctgaaattccgctgtg

SEQ ID NO: 551583 - DNA, 25 bp, Rattus norvegicus
gattctccagcggagtcggttctcg

SEQ ID NO: 551584 - DNA, 25 bp, Rattus norvegicus
tcgccggaagtgcaaaatgataatt

SEQ ID NO: 551585 - DNA, 25 bp, Rattus norvegicus
attcagtcgggtcgcaacaaacgga

SEQ ID NO: 551586 - DNA, 25 bp, Rattus norvegicus
tctagttccggagttacagagttcc

SEQ ID NO: 551587 - DNA, 25 bp, Rattus norvegicus
cgcagccattttggttcgccggaag

SEQ ID NO: 551588 - DNA, 25 bp, Rattus norvegicus
ctccggtgtagatggagagagactc

SEQ ID NO: 551589 - DNA, 25 bp, Rattus norvegicus
gagagagactcgacccacccggatt

SEQ ID NO: 551590 - DNA, 25 bp, Rattus norvegicus
cgccggaagagtctttgagctcatc

SEQ ID NO: 551591 - DNA, 25 bp, Rattus norvegicus
agcttcgacactgcagccttggcta

SEQ ID NO: 551592 - DNA, 25 bp, Rattus norvegicus
ttcttcggggaacgcttcagctttc

SEQ ID NO: 551593 - DNA, 25 bp, Rattus norvegicus
cttcagctttcctccggggttcaca

SEQ ID NO: 551594 - DNA, 25 bp, Rattus norvegicus
cacacgtgagtcctgaacggccgca

SEQ ID NO: 551595 - DNA, 25 bp, Rattus norvegicus
cagagttccggaacaccgttgtccg

SEQ ID NO: 551596 - DNA, 25 bp, Rattus norvegicus
aaagcacgggtaatcgcggagaaga

SEQ ID NO: 551597 - DNA, 25 bp, Rattus norvegicus
gcgagatcttgagagcttctaaagc

SEQ ID NO: 551598 - DNA, 25 bp, Rattus norvegicus
cttgagagcttctaaagcacgggta

SEQ ID NO: 551599 - DNA, 25 bp, Rattus norvegicus
gagcttctaaagcacgggtaatcgc

SEQ ID NO: 551600 - DNA, 25 bp, Rattus norvegicus
tctaaagcacgggtaatcgcggaga

SEQ ID NO: 551601 - DNA, 25 bp, Rattus norvegicus
cgagatcttgagagcttctaaagca

SEQ ID NO: 551602 - DNA, 25 bp, Rattus norvegicus
ggagggtgaagttcaagcgaaaaca

SEQ ID NO: 551603 - DNA, 25 bp, Rattus norvegicus
gggtgaagttcaagcgaaaacagga

SEQ ID NO: 551604 - DNA, 25 bp, Rattus norvegicus
ttcaagcgaaaacaggacagcggtc

SEQ ID NO: 551605 - DNA, 25 bp, Rattus norvegicus
agcgaaaacaggacagcggtcgatc

SEQ ID NO: 551606 - DNA, 25 bp, Rattus norvegicus
acaggacagcggtcgatcagtgttc

SEQ ID NO: 551607 - DNA, 25 bp, Rattus norvegicus
aggacagcggtcgatcagtgttctg

SEQ ID NO: 551608 - DNA, 25 bp, Rattus norvegicus
gcttctaaagcacgggtaatcgcgg

SEQ ID NO: 551609 - DNA, 25 bp, Rattus norvegicus
gagagcttctaaagcacgggtaatc

SEQ ID NO: 551610 - DNA, 25 bp, Rattus norvegicus
ctcgcgagattagaaatcggcgcac

SEQ ID NO: 551611 - DNA, 25 bp, Rattus norvegicus
cgggtctgaccaggaagtctcgcga

SEQ ID NO: 551612 - DNA, 25 bp, Rattus norvegicus
ccatagcgttagctggagagaggcc

SEQ ID NO: 551613 - DNA, 25 bp, Rattus norvegicus
atggcgctccgggtctgaccaggaa

SEQ ID NO: 551614 - DNA, 25 bp, Rattus norvegicus
tcgatcagtgttctggactccgggc

SEQ ID NO: 551615 - DNA, 25 bp, Rattus norvegicus
ctggactccgggctgccgtgcacat

SEQ ID NO: 551616 - DNA, 25 bp, Rattus norvegicus
gccgtgcacatccaactccattatg

SEQ ID NO: 551617 - DNA, 25 bp, Rattus norvegicus
ccattatgaactcaatcgatcgctg

SEQ ID NO: 551618 - DNA, 25 bp, Rattus norvegicus
aactcaatcgatcgctgttccacca

SEQ ID NO: 551619 - DNA, 25 bp, Rattus norvegicus
gttccaccaccgctgtaagtctgag

SEQ ID NO: 551620 - DNA, 25 bp, Rattus norvegicus
accaccgctgtaagtctgagagggc

SEQ ID NO: 551621 - DNA, 25 bp, Rattus norvegicus
ctgtgaccgcatcgcgggcgatggc

SEQ ID NO: 551622 - DNA, 25 bp, Rattus norvegicus
cgagattagaaatcggcgcacagga

SEQ ID NO: 551623 - DNA, 25 bp, Rattus norvegicus
ggcagaagccatagcgttagctgga

SEQ ID NO: 551624 - DNA, 25 bp, Rattus norvegicus
aggtagaagtggctttggcaaattt

SEQ ID NO: 551625 - DNA, 25 bp, Rattus norvegicus
acagggaggctacgaaagcgtccta

SEQ ID NO: 551626 - DNA, 25 bp, Rattus norvegicus
ggctacgaaagcgtcctacgacaaa

SEQ ID NO: 551627 - DNA, 25 bp, Rattus norvegicus
cctacgacaaagacagctcacggtg

SEQ ID NO: 551628 - DNA, 25 bp, Rattus norvegicus
caaagacagctcacggtggagtaaa

SEQ ID NO: 551629 - DNA, 25 bp, Rattus norvegicus
cggtggagtaaagacaaggatgcct

SEQ ID NO: 551630 - DNA, 25 bp, Rattus norvegicus
gacaaggatgcctacagcagctttg

SEQ ID NO: 551631 - DNA, 25 bp, Rattus norvegicus
acagcagctttggttcccgcagtga

SEQ ID NO: 551632 - DNA, 25 bp, Rattus norvegicus
ttggttcccgcagtgacacgagagc

SEQ ID NO: 551633 - DNA, 25 bp, Rattus norvegicus
cccgcagtgacacgagagccaagtc

SEQ ID NO: 551634 - DNA, 25 bp, Rattus norvegicus
cacgagagccaagtcgagtttcttc

SEQ ID NO: 551635 - DNA, 25 bp, Rattus norvegicus
tcgagtttcttcagcgaccgcggaa

SEQ ID NO: 551636 - DNA, 25 bp, Rattus norvegicus
tccagaggaaggtttgatgaccgcg

SEQ ID NO: 551637 - DNA, 25 bp, Rattus norvegicus
tcagcgaccgcggaagtggctccag

SEQ ID NO: 551638 - DNA, 25 bp, Rattus norvegicus
tgcaaaaccggccatatcgtactag

SEQ ID NO: 551639 - DNA, 25 bp, Rattus norvegicus
cgatttccttcaggccgtgttcccg

SEQ ID NO: 551640 - DNA, 25 bp, Rattus norvegicus
taccgatttccttcaggccgtgttc

SEQ ID NO: 551641 - DNA, 25 bp, Rattus norvegicus
aattgctctcaaaatgctgaagtgc

SEQ ID NO: 551642 - DNA, 25 bp, Rattus norvegicus
atggtcgcttccagcttccggtttc

SEQ ID NO: 551643 - DNA, 25 bp, Rattus norvegicus
aaaccggccatatcgtactagattc

SEQ ID NO: 551644 - DNA, 25 bp, Rattus norvegicus
gcgctcccgggtgtcgttgatgttt

SEQ ID NO: 551645 - DNA, 25 bp, Rattus norvegicus
gcctccagccggcttccggaaattg

SEQ ID NO: 551646 - DNA, 25 bp, Rattus norvegicus
attccgtggccgaagagattacaga

SEQ ID NO: 551647 - DNA, 25 bp, Rattus norvegicus
tggccgaagagattacagaaatccc

SEQ ID NO: 551648 - DNA, 25 bp, Rattus norvegicus
cccagttccggaagtttctgagtgg

SEQ ID NO: 551649 - DNA, 25 bp, Rattus norvegicus
ttctgagtggcagagacctcaggcc

SEQ ID NO: 551650 - DNA, 25 bp, Rattus norvegicus
tcgtactagattccgtggccgaaga

SEQ ID NO: 551651 - DNA, 25 bp, Rattus norvegicus
cggcttccggaaattgctctcaaaa

SEQ ID NO: 551652 - DNA, 25 bp, Rattus norvegicus
ggcaagatagctcgaccgggagata

SEQ ID NO: 551653 - DNA, 25 bp, Rattus norvegicus
agccgaaaggctagcgcttctccct

SEQ ID NO: 551654 - DNA, 25 bp, Rattus norvegicus
gcgcttctccctctccgctccatcc

SEQ ID NO: 551655 - DNA, 25 bp, Rattus norvegicus
cagggcagcagcgtggcccaccctc

SEQ ID NO: 551656 - DNA, 25 bp, Rattus norvegicus
tctagctcttcacgctcctcgtctc

SEQ ID NO: 551657 - DNA, 25 bp, Rattus norvegicus
ctggagcgagaaggagatgaattgg

SEQ ID NO: 551658 - DNA, 25 bp, Rattus norvegicus
tgatggcaagatagctcgaccggga

SEQ ID NO: 551659 - DNA, 25 bp, Rattus norvegicus
gacgaaaatcatccgagacgcgcga

SEQ ID NO: 551660 - DNA, 25 bp, Rattus norvegicus
aagatagctcgaccgggagataatc

SEQ ID NO: 551661 - DNA, 25 bp, Rattus norvegicus
ttcggagcctggagccgaaaggcta

SEQ ID NO: 551662 - DNA, 25 bp, Rattus norvegicus
cctggagccgaaaggctagcgcttc

SEQ ID NO: 551663 - DNA, 25 bp, Rattus norvegicus
aattggggtgatggcaagatagctc

SEQ ID NO: 551664 - DNA, 25 bp, Rattus norvegicus
cctcttcggagcctggagccgaaag

SEQ ID NO: 551665 - DNA, 25 bp, Rattus norvegicus
gaagcaccagacgaaaatcatccga

SEQ ID NO: 551666 - DNA, 25 bp, Rattus norvegicus
tcgcaaccgacaccgagaacgtttg

SEQ ID NO: 551667 - DNA, 25 bp, Rattus norvegicus
ggggctccttcaatatctttatgtg

SEQ ID NO: 551668 - DNA, 25 bp, Rattus norvegicus
caatatctttatgtgcccgggcagg

SEQ ID NO: 551669 - DNA, 25 bp, Rattus norvegicus
caggggcatacgcttggtcgtaatt

SEQ ID NO: 551670 - DNA, 25 bp, Rattus norvegicus
acgcaccggcctgtgtggactcgtg

SEQ ID NO: 551671 - DNA, 25 bp, Rattus norvegicus
gcggcaagggctgctgcctaatacc

SEQ ID NO: 551672 - DNA, 25 bp, Rattus norvegicus
tttccgttgggtccaagccaggctg

SEQ ID NO: 551673 - DNA, 25 bp, Rattus norvegicus
gccaggctggactcttgggcaaata

SEQ ID NO: 551674 - DNA, 25 bp, Rattus norvegicus
cttgggcaaatacgcgtagggatca

SEQ ID NO: 551675 - DNA, 25 bp, Rattus norvegicus
tagggatcatgagacgacaattggc

SEQ ID NO: 551676 - DNA, 25 bp, Rattus norvegicus
acgacaattggcaggacgggccgct

SEQ ID NO: 551677 - DNA, 25 bp, Rattus norvegicus
gagtgactctcacccacggagtacg

SEQ ID NO: 551678 - DNA, 25 bp, Rattus norvegicus
tagcattgggcgcacaagtctggca

SEQ ID NO: 551679 - DNA, 25 bp, Rattus norvegicus
agggcagtaaaggagagtgactctc

SEQ ID NO: 551680 - DNA, 25 bp, Rattus norvegicus
cgaggcccgagacggctggcactat

SEQ ID NO: 551681 - DNA, 25 bp, Rattus norvegicus
acacacccgttgtctcggcagctga

SEQ ID NO: 551682 - DNA, 25 bp, Rattus norvegicus
ctcggcagctgagaacaagacactg

SEQ ID NO: 551683 - DNA, 25 bp, Rattus norvegicus
atggcagccggcctagaacgtaacg

SEQ ID NO: 551684 - DNA, 25 bp, Rattus norvegicus
gctgagaacaagacactgccacggt

SEQ ID NO: 551685 - DNA, 25 bp, Rattus norvegicus
gacactgccacggtcaagctccatg

SEQ ID NO: 551686 - DNA, 25 bp, Rattus norvegicus
gtcaagctccatggcagccggccta

SEQ ID NO: 551687 - DNA, 25 bp, Rattus norvegicus
catgcgggtcaaggccattttctcc

SEQ ID NO: 551688 - DNA, 25 bp, Rattus norvegicus
cggccggcgacaatagcactctgct

SEQ ID NO: 551689 - DNA, 25 bp, Rattus norvegicus
atagcactctgctgagcttcaagga

SEQ ID NO: 551690 - DNA, 25 bp, Rattus norvegicus
ctgagcttcaaggagggcgacctca

SEQ ID NO: 551691 - DNA, 25 bp, Rattus norvegicus
tcatcacgctgctagtgcccgaggc

SEQ ID NO: 551692 - DNA, 25 bp, Rattus norvegicus
cctagaacgtaacggccgcatgcgg

SEQ ID NO: 551693 - DNA, 25 bp, Rattus norvegicus
gggcgacctcatcacgctgctagtg

SEQ ID NO: 551694 - DNA, 25 bp, Rattus norvegicus
cgttcctcgctttagcctgctgtca

SEQ ID NO: 551695 - DNA, 25 bp, Rattus norvegicus
gccgtctaaaagtttgctatttata

SEQ ID NO: 551696 - DNA, 25 bp, Rattus norvegicus
ctctgcacgcgggaccttgtgagtt

SEQ ID NO: 551697 - DNA, 25 bp, Rattus norvegicus
tgtcacacgcacagccttctcattt

SEQ ID NO: 551698 - DNA, 25 bp, Rattus norvegicus
tggcgtccggtgacttgtttgtgtt

SEQ ID NO: 551699 - DNA, 25 bp, Rattus norvegicus
aaccctgcgccggattcctggtgcg

SEQ ID NO: 551700 - DNA, 25 bp, Rattus norvegicus
ttatagtgtacacccggcagcccga

SEQ ID NO: 551701 - DNA, 25 bp, Rattus norvegicus
cgtccagctgaggacattgccctga

SEQ ID NO: 551702 - DNA, 25 bp, Rattus norvegicus
attgccctgagtagctttggcctcg

SEQ ID NO: 551703 - DNA, 25 bp, Rattus norvegicus
atagcctgctggtgtggagccaccc

SEQ ID NO: 551704 - DNA, 25 bp, Rattus norvegicus
tgaccaggcggacatcctcggggac

SEQ ID NO: 551705 - DNA, 25 bp, Rattus norvegicus
gctgtcaatttgaagccgagtttgc

SEQ ID NO: 551706 - DNA, 25 bp, Rattus norvegicus
gccgctggccgccatgagattaccg

SEQ ID NO: 551707 - DNA, 25 bp, Rattus norvegicus
ccgagtttgcttctggactgagaga

SEQ ID NO: 551708 - DNA, 25 bp, Rattus norvegicus
cgtgcagacgccaccctgccctgca

SEQ ID NO: 551709 - DNA, 25 bp, Rattus norvegicus
tcggcggccagagcgcactcggaac

SEQ ID NO: 551710 - DNA, 25 bp, Rattus norvegicus
tgtcactcctgcagcagcggtcgtc

SEQ ID NO: 551711 - DNA, 25 bp, Rattus norvegicus
cacctttatcacctgggcttgcaca

SEQ ID NO: 551712 - DNA, 25 bp, Rattus norvegicus
tgggcttgcacatgtcactcctgca

SEQ ID NO: 551713 - DNA, 25 bp, Rattus norvegicus
ccggatgcagcacctttatcacctg

SEQ ID NO: 551714 - DNA, 25 bp, Rattus norvegicus
tcacgcttacggagtgggagtagac

SEQ ID NO: 551715 - DNA, 25 bp, Rattus norvegicus
aacgccgagcctctcgcagcgtccc

SEQ ID NO: 551716 - DNA, 25 bp, Rattus norvegicus
gctcgagcctgctctcccgctgagt

SEQ ID NO: 551717 - DNA, 25 bp, Rattus norvegicus
cagcccggcctctcctcagggccca

SEQ ID NO: 551718 - DNA, 25 bp, Rattus norvegicus
tcagggcccactcgcctccatggcg

SEQ ID NO: 551719 - DNA, 25 bp, Rattus norvegicus
gcggccgccacaaccgtctggagga

SEQ ID NO: 551720 - DNA, 25 bp, Rattus norvegicus
cacaaccgtctggaggacgggtcgc

SEQ ID NO: 551721 - DNA, 25 bp, Rattus norvegicus
cgctggcgcttcacgcttacggagt

SEQ ID NO: 551722 - DNA, 25 bp, Rattus norvegicus
ggagccaggctttcattctaccgca

SEQ ID NO: 551723 - DNA, 25 bp, Rattus norvegicus
ggctctggataaaacccggagaagc

SEQ ID NO: 551724 - DNA, 25 bp, Rattus norvegicus
ccagacgcgaccaagtggtaagtta

SEQ ID NO: 551725 - DNA, 25 bp, Rattus norvegicus
taaagcgcgcgggagacaacccgta

SEQ ID NO: 551726 - DNA, 25 bp, Rattus norvegicus
ccgaaaatgcagacaccagacgcga

SEQ ID NO: 551727 - DNA, 25 bp, Rattus norvegicus
tcgactacagcagatcctcggactc

SEQ ID NO: 551728 - DNA, 25 bp, Rattus norvegicus
gcaggatccctcttttcgactacag

SEQ ID NO: 551729 - DNA, 25 bp, Rattus norvegicus
ccgtcgctctcggaattggcggaag

SEQ ID NO: 551730 - DNA, 25 bp, Rattus norvegicus
ggcaagcgatcgcatgtcacagacg

SEQ ID NO: 551731 - DNA, 25 bp, Rattus norvegicus
ggcacttcacactcggggaccgtca

SEQ ID NO: 551732 - DNA, 25 bp, Rattus norvegicus
atctcccgagcaaccgtaaagcgcg

SEQ ID NO: 551733 - DNA, 25 bp, Rattus norvegicus
agcagaagcaatagtagcagcagca

SEQ ID NO: 551734 - DNA, 25 bp, Rattus norvegicus
gtcggagctcacacttcctcgcggg

SEQ ID NO: 551735 - DNA, 25 bp, Rattus norvegicus
ggggaccgtcacttggcaagcgatc

SEQ ID NO: 551736 - DNA, 25 bp, Rattus norvegicus
tctccgcatgtctttgtgcggcgcc

SEQ ID NO: 551737 - DNA, 25 bp, Rattus norvegicus
tgcctcccgctttggagcagctctc

SEQ ID NO: 551738 - DNA, 25 bp, Rattus norvegicus
cgctccgagctgcacgggcaggcat

SEQ ID NO: 551739 - DNA, 25 bp, Rattus norvegicus
ggagcgtgagaagaaatgaaatcgc

SEQ ID NO: 551740 - DNA, 25 bp, Rattus norvegicus
agaagaaatgaaatcgcgggaagga

SEQ ID NO: 551741 - DNA, 25 bp, Rattus norvegicus
ccgaggccaagttgggctccgacga

SEQ ID NO: 551742 - DNA, 25 bp, Rattus norvegicus
ccaagttgggctccgacgacgacgc

SEQ ID NO: 551743 - DNA, 25 bp, Rattus norvegicus
tcgcgcgttgggtcaccccgactgt

SEQ ID NO: 551744 - DNA, 25 bp, Rattus norvegicus
gggcgatcactgcagccagttcggc

SEQ ID NO: 551745 - DNA, 25 bp, Rattus norvegicus
gagctgcacgggcaggcattttccc

SEQ ID NO: 551746 - DNA, 25 bp, Rattus norvegicus
aacacccgggtgtctttgtgccacg

SEQ ID NO: 551747 - DNA, 25 bp, Rattus norvegicus
cgcctggccagaagctccactctcc

SEQ ID NO: 551748 - DNA, 25 bp, Rattus norvegicus
tcactgcagccagttcggccgaaca

SEQ ID NO: 551749 - DNA, 25 bp, Rattus norvegicus
ctcccagccctatgcgcgtccgcgt

SEQ ID NO: 551750 - DNA, 25 bp, Rattus norvegicus
ttcaccgccgagctcctcacaaagc

SEQ ID NO: 551751 - DNA, 25 bp, Rattus norvegicus
aaggctgtcgaccaatccgcgccag

SEQ ID NO: 551752 - DNA, 25 bp, Rattus norvegicus
ctcttcctgtcgttcacttccggtc

SEQ ID NO: 551753 - DNA, 25 bp, Rattus norvegicus
gccgctaagcgagaatgaagctaca

SEQ ID NO: 551754 - DNA, 25 bp, Rattus norvegicus
aaaccatgagggactccgatggggc

SEQ ID NO: 551755 - DNA, 25 bp, Rattus norvegicus
gacccaaagccgctaagcgagaatg

SEQ ID NO: 551756 - DNA, 25 bp, Rattus norvegicus
ggaacccggctcagggatccgagaa

SEQ ID NO: 551757 - DNA, 25 bp, Rattus norvegicus
tgccgcccagcacgagcgattcaaa

SEQ ID NO: 551758 - DNA, 25 bp, Rattus norvegicus
gagcgattcaaactgcccgcggcca

SEQ ID NO: 551759 - DNA, 25 bp, Rattus norvegicus
tgctaaaggctgtcgaccaatccgc

SEQ ID NO: 551760 - DNA, 25 bp, Rattus norvegicus
ctattggccattgctaaaggctgtc

SEQ ID NO: 551761 - DNA, 25 bp, Rattus norvegicus
agctagtctccacgcctattggcca

SEQ ID NO: 551762 - DNA, 25 bp, Rattus norvegicus
tgaagctacaagaaaccatgaggga

SEQ ID NO: 551763 - DNA, 25 bp, Rattus norvegicus
gctgctcacctgagcgcctctcgga

SEQ ID NO: 551764 - DNA, 25 bp, Rattus norvegicus
gtcaacgtgcggcacccgggtcact

SEQ ID NO: 551765 - DNA, 25 bp, Rattus norvegicus
ccgaggctcaagttctgcacaactt

SEQ ID NO: 551766 - DNA, 25 bp, Rattus norvegicus
acagcctggcattcctcggattcca

SEQ ID NO: 551767 - DNA, 25 bp, Rattus norvegicus
taagctagccagtcgggagcagata

SEQ ID NO: 551768 - DNA, 25 bp, Rattus norvegicus
ggctcctcttttcagcgctgggcgc

SEQ ID NO: 551769 - DNA, 25 bp, Rattus norvegicus
ggcgctcgctcctccaggattgagc

SEQ ID NO: 551770 - DNA, 25 bp, Rattus norvegicus
agccgactcgtccatagggcaggtc

SEQ ID NO: 551771 - DNA, 25 bp, Rattus norvegicus
gtcctcgtggagcatctggtgccaa

SEQ ID NO: 551772 - DNA, 25 bp, Rattus norvegicus
gtgctcaggttcttggccctttctc

SEQ ID NO: 551773 - DNA, 25 bp, Rattus norvegicus
cttctagaagccagtggtggggacc

SEQ ID NO: 551774 - DNA, 25 bp, Rattus norvegicus
ctagactcgctgatggtcaacgtgc

SEQ ID NO: 551775 - DNA, 25 bp, Rattus norvegicus
actcccgggccatgtaagcaggtaa

SEQ ID NO: 551776 - DNA, 25 bp, Rattus norvegicus
gatactccagcagagccaacttggg

SEQ ID NO: 551777 - DNA, 25 bp, Rattus norvegicus
cctcggattccagtgctgtgacgtc

SEQ ID NO: 551778 - DNA, 25 bp, Rattus norvegicus
cggtctctgcggaatctcaacatca

SEQ ID NO: 551779 - DNA, 25 bp, Rattus norvegicus
agatgcgggagaggcacccctacac

SEQ ID NO: 551780 - DNA, 25 bp, Rattus norvegicus
ccgaggaactggtgtacagccagcc

SEQ ID NO: 551781 - DNA, 25 bp, Rattus norvegicus
agcccgaggaactggtgtacagcca

SEQ ID NO: 551782 - DNA, 25 bp, Rattus norvegicus
tacaaccagcccgaggaactggtgt

SEQ ID NO: 551783 - DNA, 25 bp, Rattus norvegicus
catcaacacccacgcctacaaccag

SEQ ID NO: 551784 - DNA, 25 bp, Rattus norvegicus
tctgcggaatctcaacatcatcaac

SEQ ID NO: 551785 - DNA, 25 bp, Rattus norvegicus
agccagagccggtctctgcggaatc

SEQ ID NO: 551786 - DNA, 25 bp, Rattus norvegicus
ctgcacgcggacagccagagccggt

SEQ ID NO: 551787 - DNA, 25 bp, Rattus norvegicus
cgagacagtcatgcggcagatgaag

SEQ ID NO: 551788 - DNA, 25 bp, Rattus norvegicus
ctacgagacagtcatgcggcagatg

SEQ ID NO: 551789 - DNA, 25 bp, Rattus norvegicus
ccagactacgagacagtcatgcggc

SEQ ID NO: 551790 - DNA, 25 bp, Rattus norvegicus
atcatcgtgccgtcctacaggccga

SEQ ID NO: 551791 - DNA, 25 bp, Rattus norvegicus
agagccggtctctgcggaatctcaa

SEQ ID NO: 551792 - DNA, 25 bp, Rattus norvegicus
cgaagcagcactcgcagtggtggcc

SEQ ID NO: 551793 - DNA, 25 bp, Rattus norvegicus
ccataccgtccctcctcaaggataa

SEQ ID NO: 551794 - DNA, 25 bp, Rattus norvegicus
ccggctgatcgggttgtcacttctt

SEQ ID NO: 551795 - DNA, 25 bp, Rattus norvegicus
ctgatcgggttgtcacttcttgggg

SEQ ID NO: 551796 - DNA, 25 bp, Rattus norvegicus
gggagccgcccatctcagcacagcc

SEQ ID NO: 551797 - DNA, 25 bp, Rattus norvegicus
aggcctccggaccacagggagtcta

SEQ ID NO: 551798 - DNA, 25 bp, Rattus norvegicus
cggaccacagggagtctaaactaga

SEQ ID NO: 551799 - DNA, 25 bp, Rattus norvegicus
agtacctggcgaagcagcactcgca

SEQ ID NO: 551800 - DNA, 25 bp, Rattus norvegicus
cccgctcgcccacggtgagcacgca

SEQ ID NO: 551801 - DNA, 25 bp, Rattus norvegicus
caggagaagaggaggtcgcccacgt

SEQ ID NO: 551802 - DNA, 25 bp, Rattus norvegicus
gctgcagaagcgctccaggccgccg

SEQ ID NO: 551803 - DNA, 25 bp, Rattus norvegicus
ggccttcaaggaactcggcgctcct

SEQ ID NO: 551804 - DNA, 25 bp, Rattus norvegicus
agtccgcccgcacacgccaggctgc

SEQ ID NO: 551805 - DNA, 25 bp, Rattus norvegicus
gtctaaactagagcggacacgcgtg

SEQ ID NO: 551806 - DNA, 25 bp, Rattus norvegicus
ctgggagcttcttctcgcctatggg

SEQ ID NO: 551807 - DNA, 25 bp, Rattus norvegicus
taggaactggggcaacagagtagcc

SEQ ID NO: 551808 - DNA, 25 bp, Rattus norvegicus
aactcgtctctccacggttgcagaa

SEQ ID NO: 551809 - DNA, 25 bp, Rattus norvegicus
gtgaaaggtatgcaaacaccaagca

SEQ ID NO: 551810 - DNA, 25 bp, Rattus norvegicus
taaaaaggagaagtgaaaggtatgc

SEQ ID NO: 551811 - DNA, 25 bp, Rattus norvegicus
gaacacacagaggaaagtcaccagg

SEQ ID NO: 551812 - DNA, 25 bp, Rattus norvegicus
aagctcccagctctgaacacacaga

SEQ ID NO: 551813 - DNA, 25 bp, Rattus norvegicus
ttgcagaaccgggtgcaagctccca

SEQ ID NO: 551814 - DNA, 25 bp, Rattus norvegicus
ctccacggttgcagaaccgggtgca

SEQ ID NO: 551815 - DNA, 25 bp, Rattus norvegicus
cttctcgcctatgggcggccaagca

SEQ ID NO: 551816 - DNA, 25 bp, Rattus norvegicus
acccaagcgtgccagcaatggctgg

SEQ ID NO: 551817 - DNA, 25 bp, Rattus norvegicus
cagtcctaggaactggggcaacaga

SEQ ID NO: 551818 - DNA, 25 bp, Rattus norvegicus
actctcacctctccactctgctggg

SEQ ID NO: 551819 - DNA, 25 bp, Rattus norvegicus
agcaatggctgggagcttcttctcg

SEQ ID NO: 551820 - DNA, 25 bp, Rattus norvegicus
agcgctctctcagctgagggctccg

SEQ ID NO: 551821 - DNA, 25 bp, Rattus norvegicus
gctgcagtggcggtcgctttcccag

SEQ ID NO: 551822 - DNA, 25 bp, Rattus norvegicus
ttcccagcgctctctcagctgaggg

SEQ ID NO: 551823 - DNA, 25 bp, Rattus norvegicus
gggctccgctccacaacaagattta

SEQ ID NO: 551824 - DNA, 25 bp, Rattus norvegicus
gagggctccgctccacaacaagatt

SEQ ID NO: 551825 - DNA, 25 bp, Rattus norvegicus
ccgctccacaacaagatttacttta

SEQ ID NO: 551826 - DNA, 25 bp, Rattus norvegicus
ctttaagacacagctgaaggaaaca

SEQ ID NO: 551827 - DNA, 25 bp, Rattus norvegicus
ctgaaggaaacaggaagactgcacg

SEQ ID NO: 551828 - DNA, 25 bp, Rattus norvegicus
acaggaagactgcacgtcacagtcc

SEQ ID NO: 551829 - DNA, 25 bp, Rattus norvegicus
agactgcacgtcacagtcccactga

SEQ ID NO: 551830 - DNA, 25 bp, Rattus norvegicus
tgcacgtcacagtcccactgacgta

SEQ ID NO: 551831 - DNA, 25 bp, Rattus norvegicus
tcacagtcccactgacgtacccggc

SEQ ID NO: 551832 - DNA, 25 bp, Rattus norvegicus
gtggcggtcgctttcccagcgctct

SEQ ID NO: 551833 - DNA, 25 bp, Rattus norvegicus
atttactttaagacacagctgaagg

SEQ ID NO: 551834 - DNA, 25 bp, Rattus norvegicus
atgaagcagcagtgagttcagatgc

SEQ ID NO: 551835 - DNA, 25 bp, Rattus norvegicus
gtattcgaagttgaggccgtggctc

SEQ ID NO: 551836 - DNA, 25 bp, Rattus norvegicus
tgaggccgtggctcgtctcagtgac

SEQ ID NO: 551837 - DNA, 25 bp, Rattus norvegicus
tctcagtgactgtcagcacgtcgtc

SEQ ID NO: 551838 - DNA, 25 bp, Rattus norvegicus
agcacgtcgtcgctgtccacgtgga

SEQ ID NO: 551839 - DNA, 25 bp, Rattus norvegicus
cgtcgctgtccacgtggaagccgtc

SEQ ID NO: 551840 - DNA, 25 bp, Rattus norvegicus
ggaagccgtcactggtgaactgctc

SEQ ID NO: 551841 - DNA, 25 bp, Rattus norvegicus
ccagcagcgggaaagatgaagcagc

SEQ ID NO: 551842 - DNA, 25 bp, Rattus norvegicus
gcgccctgcggaacctgggctgaaa

SEQ ID NO: 551843 - DNA, 25 bp, Rattus norvegicus
agtgagttcagatgcggcagctgcc

SEQ ID NO: 551844 - DNA, 25 bp, Rattus norvegicus
agctgtcgggtgcacacagctcctg

SEQ ID NO: 551845 - DNA, 25 bp, Rattus norvegicus
ctggtgaactgctccagcagcggga

SEQ ID NO: 551846 - DNA, 25 bp, Rattus norvegicus
ccagcctcccacttgtattcgaagt

SEQ ID NO: 551847 - DNA, 25 bp, Rattus norvegicus
cctgcggaacctgggctgaaagcag

SEQ ID NO: 551848 - DNA, 25 bp, Rattus norvegicus
gagtctctcgccaagctcagctaca

SEQ ID NO: 551849 - DNA, 25 bp, Rattus norvegicus
tggttgcgtttagcattcggactca

SEQ ID NO: 551850 - DNA, 25 bp, Rattus norvegicus
ttcggactcacgttttgcacatgtc

SEQ ID NO: 551851 - DNA, 25 bp, Rattus norvegicus
ttgcacatgtcacgattgggatctg

SEQ ID NO: 551852 - DNA, 25 bp, Rattus norvegicus
ggaaaagtttcctgagcgccctcaa

SEQ ID NO: 551853 - DNA, 25 bp, Rattus norvegicus
tgagcgccctcaaataagtccttta

SEQ ID NO: 551854 - DNA, 25 bp, Rattus norvegicus
atctgtctcgcagaggggcaaagta

SEQ ID NO: 551855 - DNA, 25 bp, Rattus norvegicus
taaccgcgggagagacaagcaaact

SEQ ID NO: 551856 - DNA, 25 bp, Rattus norvegicus
tacagcagttcgcagcccgcactag

SEQ ID NO: 551857 - DNA, 25 bp, Rattus norvegicus
gcgacccagggctctgaaagctgta

SEQ ID NO: 551858 - DNA, 25 bp, Rattus norvegicus
ctgaaagctgtagccgagccctgtc

SEQ ID NO: 551859 - DNA, 25 bp, Rattus norvegicus
ccctgggttccaagccgcactagag

SEQ ID NO: 551860 - DNA, 25 bp, Rattus norvegicus
cgcactagagcaaggcgtgagaccc

SEQ ID NO: 551861 - DNA, 25 bp, Rattus norvegicus
cctgagtcaaagctggggtaaccgc

SEQ ID NO: 551862 - DNA, 25 bp, Rattus norvegicus
ttcggagtacactgggccgaacagg

SEQ ID NO: 551863 - DNA, 25 bp, Rattus norvegicus
cagggcagccacctgctcccaggcc

SEQ ID NO: 551864 - DNA, 25 bp, Rattus norvegicus
gcgagcatcccacgcagccgggaga

SEQ ID NO: 551865 - DNA, 25 bp, Rattus norvegicus
ggagacgcgggccatggccaggccc

SEQ ID NO: 551866 - DNA, 25 bp, Rattus norvegicus
tccggttcggagtacactgggccga

SEQ ID NO: 551867 - DNA, 25 bp, Rattus norvegicus
gtttggcgtcgcagcatccaggccc

SEQ ID NO: 551868 - DNA, 25 bp, Rattus norvegicus
atccaggcccgggagatgctgaccg

SEQ ID NO: 551869 - DNA, 25 bp, Rattus norvegicus
agatgctgaccgataggtgctgtgc

SEQ ID NO: 551870 - DNA, 25 bp, Rattus norvegicus
accgataggtgctgtgcggtatttg

SEQ ID NO: 551871 - DNA, 25 bp, Rattus norvegicus
ctgtgcggtatttgccgccgagcgt

SEQ ID NO: 551872 - DNA, 25 bp, Rattus norvegicus
ttggctgccacaagcgaccgctcag

SEQ ID NO: 551873 - DNA, 25 bp, Rattus norvegicus
tgccacaagcgaccgctcagctctg

SEQ ID NO: 551874 - DNA, 25 bp, Rattus norvegicus
gctctgttcgctccggttcggagta

SEQ ID NO: 551875 - DNA, 25 bp, Rattus norvegicus
ttcgctccggttcggagtacactgg

SEQ ID NO: 551876 - DNA, 25 bp, Rattus norvegicus
ataagcaccgggctaagtcgctgcg

SEQ ID NO: 551877 - DNA, 25 bp, Rattus norvegicus
ggcaaccgttataagcaccgggcta

SEQ ID NO: 551878 - DNA, 25 bp, Rattus norvegicus
cggctgtaacctcggcaaccgttat

SEQ ID NO: 551879 - DNA, 25 bp, Rattus norvegicus
tggcgccgctttggattctctcccg

SEQ ID NO: 551880 - DNA, 25 bp, Rattus norvegicus
gtcatcccggtcaacgttcgggata

SEQ ID NO: 551881 - DNA, 25 bp, Rattus norvegicus
ttggatctgcttccggatcaccaca

SEQ ID NO: 551882 - DNA, 25 bp, Rattus norvegicus
actgccgcttggatctgcttccgga

SEQ ID NO: 551883 - DNA, 25 bp, Rattus norvegicus
cacagagcacgagagccgcgacgag

SEQ ID NO: 551884 - DNA, 25 bp, Rattus norvegicus
tccacgcagcacagagcacgagagc

SEQ ID NO: 551885 - DNA, 25 bp, Rattus norvegicus
gcggcagactccacgcagcacagag

SEQ ID NO: 551886 - DNA, 25 bp, Rattus norvegicus
aagcgggccaggtccgcactgtgac

SEQ ID NO: 551887 - DNA, 25 bp, Rattus norvegicus
ggtaaccttatagatcgtgtagccc

SEQ ID NO: 551888 - DNA, 25 bp, Rattus norvegicus
cacccgtgcggtaaccttatagatc

SEQ ID NO: 551889 - DNA, 25 bp, Rattus norvegicus
atccagacactcacccgtgcggtaa

SEQ ID NO: 551890 - DNA, 25 bp, Rattus norvegicus
tgagcgggagcttttggtgccaccc

SEQ ID NO: 551891 - DNA, 25 bp, Rattus norvegicus
aggcccgagcactgcaggctagatc

SEQ ID NO: 551892 - DNA, 25 bp, Rattus norvegicus
gcactgcaggctagatcggctggcc

SEQ ID NO: 551893 - DNA, 25 bp, Rattus norvegicus
tcaggtgtgacctagaggcccgagc

SEQ ID NO: 551894 - DNA, 25 bp, Rattus norvegicus
accgagcgcggaagcaggacctgaa

SEQ ID NO: 551895 - DNA, 25 bp, Rattus norvegicus
gtataccggcgagcaccttgaccga

SEQ ID NO: 551896 - DNA, 25 bp, Rattus norvegicus
ggggaagcagggacgcaccctccac

SEQ ID NO: 551897 - DNA, 25 bp, Rattus norvegicus
cccagagacccaagcactgaaggga

SEQ ID NO: 551898 - DNA, 25 bp, Rattus norvegicus
cgccggacactgagcgggagctttt

SEQ ID NO: 551899 - DNA, 25 bp, Rattus norvegicus
cgctctgctagacgagcgcccaggg

SEQ ID NO: 551900 - DNA, 25 bp, Rattus norvegicus
ggcagcatcccgagggtccacgctg

SEQ ID NO: 551901 - DNA, 25 bp, Rattus norvegicus
aaaccgaaactcactgacctctcag

SEQ ID NO: 551902 - DNA, 25 bp, Rattus norvegicus
ctgggagcatacagaacggaaaaac

SEQ ID NO: 551903 - DNA, 25 bp, Rattus norvegicus
gccggcacgtcctgtctgtctgtcg

SEQ ID NO: 551904 - DNA, 25 bp, Rattus norvegicus
cgagtgagcagtaggctagtacttc

SEQ ID NO: 551905 - DNA, 25 bp, Rattus norvegicus
cgatcgctcccacttccggttccgg

SEQ ID NO: 551906 - DNA, 25 bp, Rattus norvegicus
ggatagagatgtgagctagctgacc

SEQ ID NO: 551907 - DNA, 25 bp, Rattus norvegicus
gaccgaaccagggaggctcccggca

SEQ ID NO: 551908 - DNA, 25 bp, Rattus norvegicus
cgcgcgctgtaatgtgcgaccgccg

SEQ ID NO: 551909 - DNA, 25 bp, Rattus norvegicus
ctgcctttccgcgggtagccaagat

SEQ ID NO: 551910 - DNA, 25 bp, Rattus norvegicus
tagtacttccgcaagcccagcaggc

SEQ ID NO: 551911 - DNA, 25 bp, Rattus norvegicus
gcagtaggctagtacttccgcaagc

SEQ ID NO: 551912 - DNA, 25 bp, Rattus norvegicus
atgtgagctagctgaccatgcactg

SEQ ID NO: 551913 - DNA, 25 bp, Rattus norvegicus
tccgttccgtgctgctaagaggccg

SEQ ID NO: 551914 - DNA, 25 bp, Rattus norvegicus
gctgccgtccgttccgtgctgctaa

SEQ ID NO: 551915 - DNA, 25 bp, Rattus norvegicus
tgccacagtccaccacacaggccgg

SEQ ID NO: 551916 - DNA, 25 bp, Rattus norvegicus
acccgtcgccagtctggccggctca

SEQ ID NO: 551917 - DNA, 25 bp, Rattus norvegicus
gctgtaatgtgcgaccgccgggcct

SEQ ID NO: 551918 - DNA, 25 bp, Rattus norvegicus
tcggtgcgcctcgagcgcttggaaa

SEQ ID NO: 551919 - DNA, 25 bp, Rattus norvegicus
ctactggaccggacgacgctgcggt

SEQ ID NO: 551920 - DNA, 25 bp, Rattus norvegicus
ctgcggtagaaaagccctgaggctc

SEQ ID NO: 551921 - DNA, 25 bp, Rattus norvegicus
caggtgccacgtcgcccggaagaaa

SEQ ID NO: 551922 - DNA, 25 bp, Rattus norvegicus
catcgccggtaacccgcgcttggga

SEQ ID NO: 551923 - DNA, 25 bp, Rattus norvegicus
agtgaagccacttcgtccgaacttc

SEQ ID NO: 551924 - DNA, 25 bp, Rattus norvegicus
cggtgctgccacgtgacttccacga

SEQ ID NO: 551925 - DNA, 25 bp, Rattus norvegicus
agcgcctggcctttagcggaaagca

SEQ ID NO: 551926 - DNA, 25 bp, Rattus norvegicus
aaagcagcgacttgggtgggatcct

SEQ ID NO: 551927 - DNA, 25 bp, Rattus norvegicus
gaggccagagctccaggtgagtccc

SEQ ID NO: 551928 - DNA, 25 bp, Rattus norvegicus
gacttccacgaagcgcctggccttt

SEQ ID NO: 551929 - DNA, 25 bp, Rattus norvegicus
cgcttggaaaggctgcagccgctcc

SEQ ID NO: 551930 - DNA, 25 bp, Rattus norvegicus
cgcctgggaaccagccgcaggtagt

SEQ ID NO: 551931 - DNA, 25 bp, Rattus norvegicus
gcctttagcggaaagcagcgacttg

SEQ ID NO: 551932 - DNA, 25 bp, Rattus norvegicus
cttctgccctgtccgcctcaagttg

SEQ ID NO: 551933 - DNA, 25 bp, Rattus norvegicus
gcgatctcccagcttctgccctgtc

SEQ ID NO: 551934 - DNA, 25 bp, Rattus norvegicus
gggccaagcgatctcccagcttctg

SEQ ID NO: 551935 - DNA, 25 bp, Rattus norvegicus
cccgagcgtcgagaagcctgcctgg

SEQ ID NO: 551936 - DNA, 25 bp, Rattus norvegicus
ggggccaagcgatctcccagcttct

SEQ ID NO: 551937 - DNA, 25 bp, Rattus norvegicus
tcaagttgccggctccaggagctga

SEQ ID NO: 551938 - DNA, 25 bp, Rattus norvegicus
gtccgtggaacaggcgtggacctca

SEQ ID NO: 551939 - DNA, 25 bp, Rattus norvegicus
cgagaagcctgcctggaccagggct

SEQ ID NO: 551940 - DNA, 25 bp, Rattus norvegicus
cgtggaacaggcgtggacctcaccc

SEQ ID NO: 551941 - DNA, 25 bp, Rattus norvegicus
gaacaggcgtggacctcacccggga

SEQ ID NO: 551942 - DNA, 25 bp, Rattus norvegicus
caggcgtggacctcacccgggagtc

SEQ ID NO: 551943 - DNA, 25 bp, Rattus norvegicus
ttgagctgcggctgaggtctgcgct

SEQ ID NO: 551944 - DNA, 25 bp, Rattus norvegicus
agcctgcctggaccagggcttgagc

SEQ ID NO: 551945 - DNA, 25 bp, Rattus norvegicus
cgtcgagaagcctgcctggaccagg

SEQ ID NO: 551946 - DNA, 25 bp, Rattus norvegicus
ccagtccgggaaagaggacgctttg

SEQ ID NO: 551947 - DNA, 25 bp, Rattus norvegicus
ttctccgcgaaagcaagagcttaga

SEQ ID NO: 551948 - DNA, 25 bp, Rattus norvegicus
accggtcgctgtcagctcatttttg

SEQ ID NO: 551949 - DNA, 25 bp, Rattus norvegicus
ccgccaggaacccaaggtgtcagtg

SEQ ID NO: 551950 - DNA, 25 bp, Rattus norvegicus
ttaacgtagacattcggcggcttcg

SEQ ID NO: 551951 - DNA, 25 bp, Rattus norvegicus
ccgctcacagctgtgggttaacgta

SEQ ID NO: 551952 - DNA, 25 bp, Rattus norvegicus
tatcccgcgtgaaggaggtacccaa

SEQ ID NO: 551953 - DNA, 25 bp, Rattus norvegicus
tcccaggctgacgtaatgctattaa

SEQ ID NO: 551954 - DNA, 25 bp, Rattus norvegicus
gctgcgtgttccaggcatgagccaa

SEQ ID NO: 551955 - DNA, 25 bp, Rattus norvegicus
tctatctccatatcaggccgggagc

SEQ ID NO: 551956 - DNA, 25 bp, Rattus norvegicus
ctggacgtcgggaaatacttagaga

SEQ ID NO: 551957 - DNA, 25 bp, Rattus norvegicus
tgagccaatggtgcccaagccagcg

SEQ ID NO: 551958 - DNA, 25 bp, Rattus norvegicus
gcgggcacgacctttctctaaaatg

SEQ ID NO: 551959 - DNA, 25 bp, Rattus norvegicus
accgccagatgtgcgtattcgccgc

SEQ ID NO: 551960 - DNA, 25 bp, Rattus norvegicus
tgatgactcacgcagtcgggcctcc

SEQ ID NO: 551961 - DNA, 25 bp, Rattus norvegicus
cggctcctttaagacagcgaaactc

SEQ ID NO: 551962 - DNA, 25 bp, Rattus norvegicus
agcgaaactcgaactttctatcccg

SEQ ID NO: 551963 - DNA, 25 bp, Rattus norvegicus
ggcagcgcgcttacgtcacagcgtt

SEQ ID NO: 551964 - DNA, 25 bp, Rattus norvegicus
tcacgtaaggtgcacccgtggggtc

SEQ ID NO: 551965 - DNA, 25 bp, Rattus norvegicus
gcagctcggccggtctaattttagc

SEQ ID NO: 551966 - DNA, 25 bp, Rattus norvegicus
attttagctctgaggtgtcagggtc

SEQ ID NO: 551967 - DNA, 25 bp, Rattus norvegicus
gatcctcttggtgagcgggttctta

SEQ ID NO: 551968 - DNA, 25 bp, Rattus norvegicus
cgggttcttaaggtcacgtgaaatg

SEQ ID NO: 551969 - DNA, 25 bp, Rattus norvegicus
tcacgtgaaatgacagcacagggtc

SEQ ID NO: 551970 - DNA, 25 bp, Rattus norvegicus
cacaacttggacacgggtctcctca

SEQ ID NO: 551971 - DNA, 25 bp, Rattus norvegicus
tcaggactgggttgccaggttcagc

SEQ ID NO: 551972 - DNA, 25 bp, Rattus norvegicus
gtcaccgggtcacgtaaggtgcacc

SEQ ID NO: 551973 - DNA, 25 bp, Rattus norvegicus
tacgtcacagcgttctccgcgaagg

SEQ ID NO: 551974 - DNA, 25 bp, Rattus norvegicus
cctcctttctctctaaggctaagtc

SEQ ID NO: 551975 - DNA, 25 bp, Rattus norvegicus
agccttatcaatgtcttctctctcc

SEQ ID NO: 551976 - DNA, 25 bp, Rattus norvegicus
aggatccagccttatcaatgtcttc

SEQ ID NO: 551977 - DNA, 25 bp, Rattus norvegicus
ccatgtaagacaggatccagcctta

SEQ ID NO: 551978 - DNA, 25 bp, Rattus norvegicus
gaggggccatgtaagacaggatcca

SEQ ID NO: 551979 - DNA, 25 bp, Rattus norvegicus
taaaatcagacccacagcaacaagg

SEQ ID NO: 551980 - DNA, 25 bp, Rattus norvegicus
aggtcacactcacactaaaatcaga

SEQ ID NO: 551981 - DNA, 25 bp, Rattus norvegicus
ttgcacaaaccgtcagccatgtggc

SEQ ID NO: 551982 - DNA, 25 bp, Rattus norvegicus
ggcaggtcactttgcacaaaccgtc

SEQ ID NO: 551983 - DNA, 25 bp, Rattus norvegicus
cgtagcctttgatgttcttgaactg

SEQ ID NO: 551984 - DNA, 25 bp, Rattus norvegicus
gcgctcaggcaggtcactttgcaca

SEQ ID NO: 551985 - DNA, 25 bp, Rattus norvegicus
tcctactacgtagcctttgatgttc

SEQ ID NO: 551986 - DNA, 25 bp, Rattus norvegicus
ctaaggctaagtcctactacgtagc

SEQ ID NO: 551987 - DNA, 25 bp, Rattus norvegicus
tcttgaactggcagcgatcctcctg

SEQ ID NO: 551988 - DNA, 25 bp, Rattus norvegicus
tccgcaggtgcggagtgcacggccc

SEQ ID NO: 551989 - DNA, 25 bp, Rattus norvegicus
tggtgcagtccgaaaacacgcggga

SEQ ID NO: 551990 - DNA, 25 bp, Rattus norvegicus
tgggccggcgttccggcatcatcgc

SEQ ID NO: 551991 - DNA, 25 bp, Rattus norvegicus
agtccgaaaacacgcgggagcgcgc

SEQ ID NO: 551992 - DNA, 25 bp, Rattus norvegicus
actcacccgggtcgaagtgggagct

SEQ ID NO: 551993 - DNA, 25 bp, Rattus norvegicus
tctggctggtgcagtccgaaaacac

SEQ ID NO: 551994 - DNA, 25 bp, Rattus norvegicus
ggcggcgacagactaggcgcctccg

SEQ ID NO: 551995 - DNA, 25 bp, Rattus norvegicus
caccagtaggggcggcgacagacta

SEQ ID NO: 551996 - DNA, 25 bp, Rattus norvegicus
cttaagctcagaacgccggcggcct

SEQ ID NO: 551997 - DNA, 25 bp, Rattus norvegicus
gctgcgcttaagctcagaacgccgg

SEQ ID NO: 551998 - DNA, 25 bp, Rattus norvegicus
cgggcgctgcgcttaagctcagaac

SEQ ID NO: 551999 - DNA, 25 bp, Rattus norvegicus
aaggacgacgacatggccagggcca

SEQ ID NO: 552000 - DNA, 25 bp, Rattus norvegicus
ctgaaggcaaagctggggttgaaga

SEQ ID NO: 552001 - DNA, 25 bp, Rattus norvegicus
gcatcatcgcccagcggcctccgca

SEQ ID NO: 552002 - DNA, 25 bp, Rattus norvegicus
atctacgcatgcgttgagcgccgcc

SEQ ID NO: 552003 - DNA, 25 bp, Rattus norvegicus
aacagctcgtctcgatggccgtctc

SEQ ID NO: 552004 - DNA, 25 bp, Rattus norvegicus
agaccttgtctaaccggagcagccc

SEQ ID NO: 552005 - DNA, 25 bp, Rattus norvegicus
gtgcagccgtcccataccgttagac

SEQ ID NO: 552006 - DNA, 25 bp, Rattus norvegicus
ctactgtccaggtttgcttgaggcc

SEQ ID NO: 552007 - DNA, 25 bp, Rattus norvegicus
tagccgtcagccactactgtccagg

SEQ ID NO: 552008 - DNA, 25 bp, Rattus norvegicus
gcggcactgcatccttagccgtcag

SEQ ID NO: 552009 - DNA, 25 bp, Rattus norvegicus
cgcaggtggatgattggcactccgt

SEQ ID NO: 552010 - DNA, 25 bp, Rattus norvegicus
catcctaccaggaggtgcggacagg

SEQ ID NO: 552011 - DNA, 25 bp, Rattus norvegicus
tcacttagtagagcgggtagacctc

SEQ ID NO: 552012 - DNA, 25 bp, Rattus norvegicus
ggccagtgccatgatccgacaagac

SEQ ID NO: 552013 - DNA, 25 bp, Rattus norvegicus
acgcctggtcttaggcggtagacta

SEQ ID NO: 552014 - DNA, 25 bp, Rattus norvegicus
cggtagactagagcgggtctcactt

SEQ ID NO: 552015 - DNA, 25 bp, Rattus norvegicus
gcggcggcagcagaatctacgcatg

SEQ ID NO: 552016 - DNA, 25 bp, Rattus norvegicus
gtggcctcccggatgtctatcaaga

SEQ ID NO: 552017 - DNA, 25 bp, Rattus norvegicus
tcacaactgtaaaggagagctctca

SEQ ID NO: 552018 - DNA, 25 bp, Rattus norvegicus
ggggtgccttgtgcgtcacaactgt

SEQ ID NO: 552019 - DNA, 25 bp, Rattus norvegicus
gcgggccacaaccaatcgcaagtga

SEQ ID NO: 552020 - DNA, 25 bp, Rattus norvegicus
agctctcgttctcctgtcagcgctg

SEQ ID NO: 552021 - DNA, 25 bp, Rattus norvegicus
cccgatctttggagagtcgccctcg

SEQ ID NO: 552022 - DNA, 25 bp, Rattus norvegicus
tctatcaagagtccatagctgggtg

SEQ ID NO: 552023 - DNA, 25 bp, Rattus norvegicus
cgaccaatcgcagagctaagcggca

SEQ ID NO: 552024 - DNA, 25 bp, Rattus norvegicus
aaagcatgccagttccctcgaccaa

SEQ ID NO: 552025 - DNA, 25 bp, Rattus norvegicus
tttgactgacaacttccgcggggtc

SEQ ID NO: 552026 - DNA, 25 bp, Rattus norvegicus
ctgctacaacttgagagggtggctg

SEQ ID NO: 552027 - DNA, 25 bp, Rattus norvegicus
cacgcccggggtagcaactgctaca

SEQ ID NO: 552028 - DNA, 25 bp, Rattus norvegicus
cttccgtgtactctggcgctacgct

SEQ ID NO: 552029 - DNA, 25 bp, Rattus norvegicus
gctatgtgacagacgcgggccacaa

SEQ ID NO: 552030 - DNA, 25 bp, Rattus norvegicus
gaccgttactcaccgttcctcagga

SEQ ID NO: 552031 - DNA, 25 bp, Rattus norvegicus
gctggacgctaactccgctcttatg

SEQ ID NO: 552032 - DNA, 25 bp, Rattus norvegicus
caagtctttcctggccgatgccggc

SEQ ID NO: 552033 - DNA, 25 bp, Rattus norvegicus
ggcgtcaaactcaaccaagtctttc

SEQ ID NO: 552034 - DNA, 25 bp, Rattus norvegicus
cggtaactataaggatcatggcgtc

SEQ ID NO: 552035 - DNA, 25 bp, Rattus norvegicus
tgcaatctttgtgactaggcgagtc

SEQ ID NO: 552036 - DNA, 25 bp, Rattus norvegicus
tgcgtacactgcctgacagctcacg

SEQ ID NO: 552037 - DNA, 25 bp, Rattus norvegicus
tgattggctctcgtcgcagcgttct

SEQ ID NO: 552038 - DNA, 25 bp, Rattus norvegicus
actgacgtcatgctctctgattggc

SEQ ID NO: 552039 - DNA, 25 bp, Rattus norvegicus
ggagcaccgagttgaagagcatttc

SEQ ID NO: 552040 - DNA, 25 bp, Rattus norvegicus
tcggttacggtgaagagtgtccttc

SEQ ID NO: 552041 - DNA, 25 bp, Rattus norvegicus
cgcgcgatattgacgtaagcagcca

SEQ ID NO: 552042 - DNA, 25 bp, Rattus norvegicus
tccgctcttatggaactggacaaag

SEQ ID NO: 552043 - DNA, 25 bp, Rattus norvegicus
cagcgcgacacggttttgcctccaa

SEQ ID NO: 552044 - DNA, 25 bp, Rattus norvegicus
gcttgcgcccactgaggtgagcccg

SEQ ID NO: 552045 - DNA, 25 bp, Rattus norvegicus
tcacctgaggaaaccgctgcccgag

SEQ ID NO: 552046 - DNA, 25 bp, Rattus norvegicus
atacctggctgaggggagccctccg

SEQ ID NO: 552047 - DNA, 25 bp, Rattus norvegicus
ctgaggagacctggctgaggatacc

SEQ ID NO: 552048 - DNA, 25 bp, Rattus norvegicus
ccctcagaagcgaagcgaagcaagc

SEQ ID NO: 552049 - DNA, 25 bp, Rattus norvegicus
cccgctgttgcggacgagcccttgg

SEQ ID NO: 552050 - DNA, 25 bp, Rattus norvegicus
ttcaggacccgcgtggcgggacctc

SEQ ID NO: 552051 - DNA, 25 bp, Rattus norvegicus
cgggacggtctagcgttggctaaat

SEQ ID NO: 552052 - DNA, 25 bp, Rattus norvegicus
gttggctaaatatattccgccgtgg

SEQ ID NO: 552053 - DNA, 25 bp, Rattus norvegicus
cggaacggctctcttgaccttgtgc

SEQ ID NO: 552054 - DNA, 25 bp, Rattus norvegicus
gaggaaaccgctgcccgagccttct

SEQ ID NO: 552055 - DNA, 25 bp, Rattus norvegicus
gctctcttgaccttgtgcggctcct

SEQ ID NO: 552056 - DNA, 25 bp, Rattus norvegicus
ccctggagatcgcagggcgaacgct

SEQ ID NO: 552057 - DNA, 25 bp, Rattus norvegicus
acctggctgaggatacctggctgag

SEQ ID NO: 552058 - DNA, 25 bp, Rattus norvegicus
gactttcgctgccagcgccgtcggt

SEQ ID NO: 552059 - DNA, 25 bp, Rattus norvegicus
actccatcgaggggcaggaaggcca

SEQ ID NO: 552060 - DNA, 25 bp, Rattus norvegicus
cacgactccatcgaggggcaggaag

SEQ ID NO: 552061 - DNA, 25 bp, Rattus norvegicus
cgccacgactccatcgaggggcagg

SEQ ID NO: 552062 - DNA, 25 bp, Rattus norvegicus
gtgccgccacgactccatcgagggg

SEQ ID NO: 552063 - DNA, 25 bp, Rattus norvegicus
atggtgccgccacgactccatcgag

SEQ ID NO: 552064 - DNA, 25 bp, Rattus norvegicus
gattgggtctgctgtgcggcaggat

SEQ ID NO: 552065 - DNA, 25 bp, Rattus norvegicus
tagcgcggtgactgagattgggtct

SEQ ID NO: 552066 - DNA, 25 bp, Rattus norvegicus
cggccctaagccgaggggtagcgcg

SEQ ID NO: 552067 - DNA, 25 bp, Rattus norvegicus
tggcctgcctgacagccgcggccct

SEQ ID NO: 552068 - DNA, 25 bp, Rattus norvegicus
ggtggcctgggtcactcccctcagt

SEQ ID NO: 552069 - DNA, 25 bp, Rattus norvegicus
aggactttcgctgccagcgccgtcg

SEQ ID NO: 552070 - DNA, 25 bp, Rattus norvegicus
gggcctccaggactttcgctgccag

SEQ ID NO: 552071 - DNA, 25 bp, Rattus norvegicus
actcccctcagtggggccgagtgct

SEQ ID NO: 552072 - DNA, 25 bp, Rattus norvegicus
gccgagagccgagctcacgtgctct

SEQ ID NO: 552073 - DNA, 25 bp, Rattus norvegicus
tgcaccttcactgtggaccaatagg

SEQ ID NO: 552074 - DNA, 25 bp, Rattus norvegicus
gcagcccttccatggcgggcttagg

SEQ ID NO: 552075 - DNA, 25 bp, Rattus norvegicus
acaagcgtcgcctacgctgggaagg

SEQ ID NO: 552076 - DNA, 25 bp, Rattus norvegicus
ggcggccacctgaactcttcgtgga

SEQ ID NO: 552077 - DNA, 25 bp, Rattus norvegicus
aggatcggattgtagcctccaggga

SEQ ID NO: 552078 - DNA, 25 bp, Rattus norvegicus
caatcagagctgagatgcaccttca

SEQ ID NO: 552079 - DNA, 25 bp, Rattus norvegicus
agcagtgttgtgttttctcagccaa

SEQ ID NO: 552080 - DNA, 25 bp, Rattus norvegicus
cattttcccaagatgcctagcagtg

SEQ ID NO: 552081 - DNA, 25 bp, Rattus norvegicus
cggttgcctagcgacacgcattttc

SEQ ID NO: 552082 - DNA, 25 bp, Rattus norvegicus
gagcagctcactaacgcagacacca

SEQ ID NO: 552083 - DNA, 25 bp, Rattus norvegicus
cgcgcgaactccgtagagcagctca

SEQ ID NO: 552084 - DNA, 25 bp, Rattus norvegicus
cctcagcggaggaatggaattaccg

SEQ ID NO: 552085 - DNA, 25 bp, Rattus norvegicus
gttaccacagcgacctcagcggagg

SEQ ID NO: 552086 - DNA, 25 bp, Rattus norvegicus
ctgctggaagccgtcgagcgcttca

SEQ ID NO: 552087 - DNA, 25 bp, Rattus norvegicus
tgtcacgctcgggtccgtgtgaaaa

SEQ ID NO: 552088 - DNA, 25 bp, Rattus norvegicus
gctgctgctgaccttcatgttcatg

SEQ ID NO: 552089 - DNA, 25 bp, Rattus norvegicus
gactccttccacatgctgtcggacg

SEQ ID NO: 552090 - DNA, 25 bp, Rattus norvegicus
tcacgccacgcagaagaacacattc

SEQ ID NO: 552091 - DNA, 25 bp, Rattus norvegicus
gcgcgctggtgaacgccatcttcct

SEQ ID NO: 552092 - DNA, 25 bp, Rattus norvegicus
gctgtgcttcgccatcctgctggaa

SEQ ID NO: 552093 - DNA, 25 bp, Rattus norvegicus
gagcgcttcatcgagccgcatgaga

SEQ ID NO: 552094 - DNA, 25 bp, Rattus norvegicus
cgcatgagatgcagcagccgctcgt

SEQ ID NO: 552095 - DNA, 25 bp, Rattus norvegicus
ctgctagtcaacgtgctggggctct

SEQ ID NO: 552096 - DNA, 25 bp, Rattus norvegicus
ggaccaggaggagaccaacacgcta

SEQ ID NO: 552097 - DNA, 25 bp, Rattus norvegicus
caacacgctagtggctaacaccagc

SEQ ID NO: 552098 - DNA, 25 bp, Rattus norvegicus
ccagcaattccaacgggctgaaggc

SEQ ID NO: 552099 - DNA, 25 bp, Rattus norvegicus
ccatcttcctcacggggctgtgctt

SEQ ID NO: 552100 - DNA, 25 bp, Rattus norvegicus
agtcgtggaggcctttgccaccgca

SEQ ID NO: 552101 - DNA, 25 bp, Rattus norvegicus
aagcggaaacgctactgcatttctc

SEQ ID NO: 552102 - DNA, 25 bp, Rattus norvegicus
tgcatttctcccacgtcagcggcga

SEQ ID NO: 552103 - DNA, 25 bp, Rattus norvegicus
attggccggcgctctgtacatttac

SEQ ID NO: 552104 - DNA, 25 bp, Rattus norvegicus
ctgtctccacgcatgggaagtcgtg

SEQ ID NO: 552105 - DNA, 25 bp, Rattus norvegicus
agcgccagcttcacgcgagccttct

SEQ ID NO: 552106 - DNA, 25 bp, Rattus norvegicus
tctgtctcgcgctggtgaaatcacc

SEQ ID NO: 552107 - DNA, 25 bp, Rattus norvegicus
gtgaaatcacctgaatcgcagcgtg

SEQ ID NO: 552108 - DNA, 25 bp, Rattus norvegicus
aatcgcagcgtgcagagctgagtgc

SEQ ID NO: 552109 - DNA, 25 bp, Rattus norvegicus
cgcagggaagaaggcgtccctgcac

SEQ ID NO: 552110 - DNA, 25 bp, Rattus norvegicus
aacgccttggcctgagatgttgctc

SEQ ID NO: 552111 - DNA, 25 bp, Rattus norvegicus
gcctgagatgttgctcccggctgcc

SEQ ID NO: 552112 - DNA, 25 bp, Rattus norvegicus
acacgggaagcggaaacgctactgc

SEQ ID NO: 552113 - DNA, 25 bp, Rattus norvegicus
acgacctgctgcgacaccctagcca

SEQ ID NO: 552114 - DNA, 25 bp, Rattus norvegicus
aggaccgtgtttgcaaagaaggcca

SEQ ID NO: 552115 - DNA, 25 bp, Rattus norvegicus
cccgcagagaacaggcgatgtaagt

SEQ ID NO: 552116 - DNA, 25 bp, Rattus norvegicus
accctgcgccctatgtggatggggc

SEQ ID NO: 552117 - DNA, 25 bp, Rattus norvegicus
tgcctgcacaatgggcgcccagagc

SEQ ID NO: 552118 - DNA, 25 bp, Rattus norvegicus
gggcgagctctgatgctttccagtc

SEQ ID NO: 552119 - DNA, 25 bp, Rattus norvegicus
caggcgatgtaagttaaaaggaccg

SEQ ID NO: 552120 - DNA, 25 bp, Rattus norvegicus
agctggtgccagctgcctgcacaat

SEQ ID NO: 552121 - DNA, 25 bp, Rattus norvegicus
gcaaagaaggccaacctggacgcta

SEQ ID NO: 552122 - DNA, 25 bp, Rattus norvegicus
acctggacgctaggatgctgagccg

SEQ ID NO: 552123 - DNA, 25 bp, Rattus norvegicus
tgaggcaggggcatccgcatctcag

SEQ ID NO: 552124 - DNA, 25 bp, Rattus norvegicus
tgcacacgcgtcagggacatacgtc

SEQ ID NO: 552125 - DNA, 25 bp, Rattus norvegicus
gacatacgtctgcactccctgtctg

SEQ ID NO: 552126 - DNA, 25 bp, Rattus norvegicus
cggctctttgttatgttaattccct

SEQ ID NO: 552127 - DNA, 25 bp, Rattus norvegicus
acgcggacgagatcgcgcctccgag

SEQ ID NO: 552128 - DNA, 25 bp, Rattus norvegicus
ccgtgggtgacaataaagcgctgtc

SEQ ID NO: 552129 - DNA, 25 bp, Rattus norvegicus
aggccctctctagttcctggcggga

SEQ ID NO: 552130 - DNA, 25 bp, Rattus norvegicus
cccacggcgatcttccgggactggg

SEQ ID NO: 552131 - DNA, 25 bp, Rattus norvegicus
ctgtcctgtaagtcccggcgtggga

SEQ ID NO: 552132 - DNA, 25 bp, Rattus norvegicus
attgggccgttaggctgtcctgtaa

SEQ ID NO: 552133 - DNA, 25 bp, Rattus norvegicus
atcttcgggtaggtcattgggccgt

SEQ ID NO: 552134 - DNA, 25 bp, Rattus norvegicus
ggacgccctctctgatcttcgggta

SEQ ID NO: 552135 - DNA, 25 bp, Rattus norvegicus
agggattggctctccggacgccctc

SEQ ID NO: 552136 - DNA, 25 bp, Rattus norvegicus
ctgggaacaggccgtcctcgctgca

SEQ ID NO: 552137 - DNA, 25 bp, Rattus norvegicus
aataaagcgctgtccgcaggggcga

SEQ ID NO: 552138 - DNA, 25 bp, Rattus norvegicus
ggcctccgccgtgggtgacaataaa

SEQ ID NO: 552139 - DNA, 25 bp, Rattus norvegicus
tctctagttcctggcgggaccgcgc

SEQ ID NO: 552140 - DNA, 25 bp, Rattus norvegicus
ccctctctgatcttcgggtaggtca

SEQ ID NO: 552141 - DNA, 25 bp, Rattus norvegicus
cgcgcgccgctcagggattggctct

SEQ ID NO: 552142 - DNA, 25 bp, Rattus norvegicus
aggcggaccctcattgctacccggg

SEQ ID NO: 552143 - DNA, 25 bp, Rattus norvegicus
cttggtgccccgctcctgatgtggg

SEQ ID NO: 552144 - DNA, 25 bp, Rattus norvegicus
cgccgctgcccacgcgcctcccggg

SEQ ID NO: 552145 - DNA, 25 bp, Rattus norvegicus
ctcgctgtgtccagctgtgccctgg

SEQ ID NO: 552146 - DNA, 25 bp, Rattus norvegicus
cattgctacccggggacaccggact

SEQ ID NO: 552147 - DNA, 25 bp, Rattus norvegicus
ggaccctcattgctacccggggaca

SEQ ID NO: 552148 - DNA, 25 bp, Rattus norvegicus
cgccgctagagctagggtggacctt

SEQ ID NO: 552149 - DNA, 25 bp, Rattus norvegicus
agcagtggcgccttgttccgcggat

SEQ ID NO: 552150 - DNA, 25 bp, Rattus norvegicus
agctccagcagtggcgccttgttcc

SEQ ID NO: 552151 - DNA, 25 bp, Rattus norvegicus
tcagctccagcagtggcgccttgtt

SEQ ID NO: 552152 - DNA, 25 bp, Rattus norvegicus
gggacacaaggtgtcagctccagca

SEQ ID NO: 552153 - DNA, 25 bp, Rattus norvegicus
cgctcgggaaagttgcggggccgag

SEQ ID NO: 552154 - DNA, 25 bp, Rattus norvegicus
agtggcgccttgttccgcggatccc

SEQ ID NO: 552155 - DNA, 25 bp, Rattus norvegicus
aggtgagccgaggacagcgccgccc

SEQ ID NO: 552156 - DNA, 25 bp, Rattus norvegicus
atggaccgcaccaaccacacaggga

SEQ ID NO: 552157 - DNA, 25 bp, Rattus norvegicus
tacctcagcgcccatagcgcgtagg

SEQ ID NO: 552158 - DNA, 25 bp, Rattus norvegicus
cagcttggcccacaacctagactta

SEQ ID NO: 552159 - DNA, 25 bp, Rattus norvegicus
cgatcgccatgatgcgctcgccatg

SEQ ID NO: 552160 - DNA, 25 bp, Rattus norvegicus
cttggcttccacttaccttcgatcg

SEQ ID NO: 552161 - DNA, 25 bp, Rattus norvegicus
gtcttctccgcgcatcacttggctt

SEQ ID NO: 552162 - DNA, 25 bp, Rattus norvegicus
agcgcgtaggccagaactctcaaga

SEQ ID NO: 552163 - DNA, 25 bp, Rattus norvegicus
ggcgtctaagtacctcagctcctta

SEQ ID NO: 552164 - DNA, 25 bp, Rattus norvegicus
cagagactcagcgacttggcgtcta

SEQ ID NO: 552165 - DNA, 25 bp, Rattus norvegicus
ttagtacctgagtctcctctgtgcc

SEQ ID NO: 552166 - DNA, 25 bp, Rattus norvegicus
caccgtgctgctcaatacctcagag

SEQ ID NO: 552167 - DNA, 25 bp, Rattus norvegicus
agcgtggatatcatcggcccaggga

SEQ ID NO: 552168 - DNA, 25 bp, Rattus norvegicus
ccgtcaacggaagggaataatagcg

SEQ ID NO: 552169 - DNA, 25 bp, Rattus norvegicus
agctccttagtacctgagcatctca

SEQ ID NO: 552170 - DNA, 25 bp, Rattus norvegicus
aaagctgctttacgccctgcgagga

SEQ ID NO: 552171 - DNA, 25 bp, Rattus norvegicus
ccctgcgaggacgacaggcgttaca

SEQ ID NO: 552172 - DNA, 25 bp, Rattus norvegicus
gcactcggatgacaggcagcacgct

SEQ ID NO: 552173 - DNA, 25 bp, Rattus norvegicus
agcacgctccgctgtctcagcaggt

SEQ ID NO: 552174 - DNA, 25 bp, Rattus norvegicus
cccgacctgtcgtagaaggggtgct

SEQ ID NO: 552175 - DNA, 25 bp, Rattus norvegicus
ccgaagtcgcggaggtgcttcttct

SEQ ID NO: 552176 - DNA, 25 bp, Rattus norvegicus
cttcttggtcattgtgctgagcagc

SEQ ID NO: 552177 - DNA, 25 bp, Rattus norvegicus
acgactccggcgtttgcccatagcg

SEQ ID NO: 552178 - DNA, 25 bp, Rattus norvegicus
gcccatagcggaaacgtcaagcttc

SEQ ID NO: 552179 - DNA, 25 bp, Rattus norvegicus
gtcaagcttcccaccacaacataaa

SEQ ID NO: 552180 - DNA, 25 bp, Rattus norvegicus
tttccagtgggaagttgtcgcacgt

SEQ ID NO: 552181 - DNA, 25 bp, Rattus norvegicus
cgggagccgtaaagcaaagctgctt

SEQ ID NO: 552182 - DNA, 25 bp, Rattus norvegicus
agctcctcgagtgcacggatgtgcc

SEQ ID NO: 552183 - DNA, 25 bp, Rattus norvegicus
gcgttacaccctccgggttgcgata

SEQ ID NO: 552184 - DNA, 25 bp, Rattus norvegicus
tccctcacttggtggcaggggcgta

SEQ ID NO: 552185 - DNA, 25 bp, Rattus norvegicus
gacgccctcctatttcgaggtgacc

SEQ ID NO: 552186 - DNA, 25 bp, Rattus norvegicus
agggacgacgccctcctatttcgag

SEQ ID NO: 552187 - DNA, 25 bp, Rattus norvegicus
ctccttgcaagtcctcaggatcatc

SEQ ID NO: 552188 - DNA, 25 bp, Rattus norvegicus
ggaccgctccctcacttggtggcag

SEQ ID NO: 552189 - DNA, 25 bp, Rattus norvegicus
tgcacctgttcctgagcaccgactg

SEQ ID NO: 552190 - DNA, 25 bp, Rattus norvegicus
ctcggcccaggaacgcagagtatca

SEQ ID NO: 552191 - DNA, 25 bp, Rattus norvegicus
gcagagtatcagatttctcgcaatg

SEQ ID NO: 552192 - DNA, 25 bp, Rattus norvegicus
ctaggctcagagcaccgggcaccga

SEQ ID NO: 552193 - DNA, 25 bp, Rattus norvegicus
ccagccgtgcctagccgtcgggaga

SEQ ID NO: 552194 - DNA, 25 bp, Rattus norvegicus
tcctgtgctgcggtggcgagaactc

SEQ ID NO: 552195 - DNA, 25 bp, Rattus norvegicus
tggcgagaactcctgtgcacctgtt

SEQ ID NO: 552196 - DNA, 25 bp, Rattus norvegicus
tgttcctgagcaccgactgaggcca

SEQ ID NO: 552197 - DNA, 25 bp, Rattus norvegicus
caggatcatcgaacacccgcagggt

SEQ ID NO: 552198 - DNA, 25 bp, Rattus norvegicus
aatgacgtcatgaaagggcggagta

SEQ ID NO: 552199 - DNA, 25 bp, Rattus norvegicus
gaacctgcggcggaagtgcaagcct

SEQ ID NO: 552200 - DNA, 25 bp, Rattus norvegicus
aggtcccggatgcttctctcctctt

SEQ ID NO: 552201 - DNA, 25 bp, Rattus norvegicus
gcccgcagctgctctaccggaaggg

SEQ ID NO: 552202 - DNA, 25 bp, Rattus norvegicus
cggatccaagatggctttacctccc

SEQ ID NO: 552203 - DNA, 25 bp, Rattus norvegicus
tcagtccgcggctttgccaaaggtt

SEQ ID NO: 552204 - DNA, 25 bp, Rattus norvegicus
ttgccaaaggttccggcttgaggtc

SEQ ID NO: 552205 - DNA, 25 bp, Rattus norvegicus
ttgaggtcgagctcctaatgacgtc

SEQ ID NO: 552206 - DNA, 25 bp, Rattus norvegicus
gtcagactgttttttcctgggcttc

SEQ ID NO: 552207 - DNA, 25 bp, Rattus norvegicus
cctgggcttctcacatcctgggttt

SEQ ID NO: 552208 - DNA, 25 bp, Rattus norvegicus
catcctgggtttttcactgtactta

SEQ ID NO: 552209 - DNA, 25 bp, Rattus norvegicus
ctgtacttactgtgaatggtgcgtg

SEQ ID NO: 552210 - DNA, 25 bp, Rattus norvegicus
agagtactggtttcttggccgctgg

SEQ ID NO: 552211 - DNA, 25 bp, Rattus norvegicus
taagtcagtgtgcatgcgcgtcaga

SEQ ID NO: 552212 - DNA, 25 bp, Rattus norvegicus
aagtcgtgccggagaaacctgaaga

SEQ ID NO: 552213 - DNA, 25 bp, Rattus norvegicus
ggttaacacggcctctatgataatg

SEQ ID NO: 552214 - DNA, 25 bp, Rattus norvegicus
gctgccgggatccttcagctgaaga

SEQ ID NO: 552215 - DNA, 25 bp, Rattus norvegicus
tcagctgaagacgagcgatcagatc

SEQ ID NO: 552216 - DNA, 25 bp, Rattus norvegicus
tgatgtcagagcagcccggaaagtc

SEQ ID NO: 552217 - DNA, 25 bp, Rattus norvegicus
aacctgaagacacccggctttgagc

SEQ ID NO: 552218 - DNA, 25 bp, Rattus norvegicus
tacgcgaagacccaatccggggcta

SEQ ID NO: 552219 - DNA, 25 bp, Rattus norvegicus
cgggccgaggattttaatgaccctg

SEQ ID NO: 552220 - DNA, 25 bp, Rattus norvegicus
ttccatgtggaccaggctgttcctg

SEQ ID NO: 552221 - DNA, 25 bp, Rattus norvegicus
gctgccctgggcaatcgccagacga

SEQ ID NO: 552222 - DNA, 25 bp, Rattus norvegicus
gcgtgatccgccactgtccaggctt

SEQ ID NO: 552223 - DNA, 25 bp, Rattus norvegicus
tccgggccatagattccggcggctc

SEQ ID NO: 552224 - DNA, 25 bp, Rattus norvegicus
ctccgtggtgcgcttgtaacgcgca

SEQ ID NO: 552225 - DNA, 25 bp, Rattus norvegicus
atcagatctggtggacccgtgagcc

SEQ ID NO: 552226 - DNA, 25 bp, Rattus norvegicus
tcagagacaacgaccgcagcggagg

SEQ ID NO: 552227 - DNA, 25 bp, Rattus norvegicus
tccatcttcttacctggaagccaga

SEQ ID NO: 552228 - DNA, 25 bp, Rattus norvegicus
acggctgccaccgagaggagccgca

SEQ ID NO: 552229 - DNA, 25 bp, Rattus norvegicus
agcgggcaagagcatcagagacaac

SEQ ID NO: 552230 - DNA, 25 bp, Rattus norvegicus
tgctgcgatgccgagaacccacatc

SEQ ID NO: 552231 - DNA, 25 bp, Rattus norvegicus
tccgcaaaaagttgctgcgatgccg

SEQ ID NO: 552232 - DNA, 25 bp, Rattus norvegicus
cctggaagccagaacaatccgcaaa

SEQ ID NO: 552233 - DNA, 25 bp, Rattus norvegicus
cagtctagcgccttgggtctcagtt

SEQ ID NO: 552234 - DNA, 25 bp, Rattus norvegicus
ggcagctggcctctccatcttctta

SEQ ID NO: 552235 - DNA, 25 bp, Rattus norvegicus
ccagcgcagcgaggaccacagctgg

SEQ ID NO: 552236 - DNA, 25 bp, Rattus norvegicus
cagcagcaaactcccgctgggtagc

SEQ ID NO: 552237 - DNA, 25 bp, Rattus norvegicus
tgggtctcagtttccagcagcaaac

SEQ ID NO: 552238 - DNA, 25 bp, Rattus norvegicus
gacttggagagcgtcccagtctagc

SEQ ID NO: 552239 - DNA, 25 bp, Rattus norvegicus
gcagccaggagtcgcgccaatctgc

SEQ ID NO: 552240 - DNA, 25 bp, Rattus norvegicus
aggaacggcgcagtacattcgagac

SEQ ID NO: 552241 - DNA, 25 bp, Rattus norvegicus
tggctaagtcctctgccgcagttcg

SEQ ID NO: 552242 - DNA, 25 bp, Rattus norvegicus
gaccgcgtttccagcaggcgcaacg

SEQ ID NO: 552243 - DNA, 25 bp, Rattus norvegicus
agcagagtccgcagtgttgcgcctc

SEQ ID NO: 552244 - DNA, 25 bp, Rattus norvegicus
ccgtgactcggcttcccagtaggcg

SEQ ID NO: 552245 - DNA, 25 bp, Rattus norvegicus
ccgcgagaaaataattggctaagtc

SEQ ID NO: 552246 - DNA, 25 bp, Rattus norvegicus
cattcgagacgaaggagcttgctcc

SEQ ID NO: 552247 - DNA, 25 bp, Rattus norvegicus
ccttctagctcttaagaggcgcgga

SEQ ID NO: 552248 - DNA, 25 bp, Rattus norvegicus
tgcagctagaggacataccaccggg

SEQ ID NO: 552249 - DNA, 25 bp, Rattus norvegicus
taccaccgggcaggttttctgcgga

SEQ ID NO: 552250 - DNA, 25 bp, Rattus norvegicus
ggcaggttttctgcggactcccacc

SEQ ID NO: 552251 - DNA, 25 bp, Rattus norvegicus
ccctaccattaataacgtgggtgtg

SEQ ID NO: 552252 - DNA, 25 bp, Rattus norvegicus
acttggatggagctctgaactggcc

SEQ ID NO: 552253 - DNA, 25 bp, Rattus norvegicus
tgacctcggcttgccgagttcggcc

SEQ ID NO: 552254 - DNA, 25 bp, Rattus norvegicus
ccacccagagtacgggaaatggcgc

SEQ ID NO: 552255 - DNA, 25 bp, Rattus norvegicus
cccaaagtagatggcgacaagaaca

SEQ ID NO: 552256 - DNA, 25 bp, Rattus norvegicus
ccgcagctcacccaaagtagatggc

SEQ ID NO: 552257 - DNA, 25 bp, Rattus norvegicus
cccagaccagcattggagtcaacgc

SEQ ID NO: 552258 - DNA, 25 bp, Rattus norvegicus
cgacaagaacagcagcaggacggcc

SEQ ID NO: 552259 - DNA, 25 bp, Rattus norvegicus
caccctgggaaaggctcgctgcgct

SEQ ID NO: 552260 - DNA, 25 bp, Rattus norvegicus
gctgcacgctcaccctgggaaaggc

SEQ ID NO: 552261 - DNA, 25 bp, Rattus norvegicus
aaatggcgctgggttccggaatgaa

SEQ ID NO: 552262 - DNA, 25 bp, Rattus norvegicus
gatttgagttgagcgcgctgcacgc

SEQ ID NO: 552263 - DNA, 25 bp, Rattus norvegicus
ccagtctcacggcaaagcggtggag

SEQ ID NO: 552264 - DNA, 25 bp, Rattus norvegicus
ggtctcaagcccagtctcacggcaa

SEQ ID NO: 552265 - DNA, 25 bp, Rattus norvegicus
cgcggcagaaggctacaaggcgccc

SEQ ID NO: 552266 - DNA, 25 bp, Rattus norvegicus
agcaggacggccagatgcactcctc

SEQ ID NO: 552267 - DNA, 25 bp, Rattus norvegicus
agatgcactcctccgcggcagaagg

SEQ ID NO: 552268 - DNA, 25 bp, Rattus norvegicus
agctcaccaagaactcccggagcga

SEQ ID NO: 552269 - DNA, 25 bp, Rattus norvegicus
ctcccggagcgatgagagcgaagaa

SEQ ID NO: 552270 - DNA, 25 bp, Rattus norvegicus
gcgaagaaaacccagagcgaaccca

SEQ ID NO: 552271 - DNA, 25 bp, Rattus norvegicus
gcgaacccaaggctcccatgccgtc

SEQ ID NO: 552272 - DNA, 25 bp, Rattus norvegicus
cggcccaaccgcagctgcgagggaa

SEQ ID NO: 552273 - DNA, 25 bp, Rattus norvegicus
ccaaccgcagctgcgagggaaggaa

SEQ ID NO: 552274 - DNA, 25 bp, Rattus norvegicus
tgtggggagccgacccttaaatagc

SEQ ID NO: 552275 - DNA, 25 bp, Rattus norvegicus
gggagccgacccttaaatagcatcg

SEQ ID NO: 552276 - DNA, 25 bp, Rattus norvegicus
cttaaatagcatcggctcgggcgcc

SEQ ID NO: 552277 - DNA, 25 bp, Rattus norvegicus
aatagcatcggctcgggcgccgctg

SEQ ID NO: 552278 - DNA, 25 bp, Rattus norvegicus
gggctgaagattcgtggagcacatc

SEQ ID NO: 552279 - DNA, 25 bp, Rattus norvegicus
tcgtggagcacatctgcaggtgacc

SEQ ID NO: 552280 - DNA, 25 bp, Rattus norvegicus
agcacatctgcaggtgaccaggggc

SEQ ID NO: 552281 - DNA, 25 bp, Rattus norvegicus
cggagcgatgagagcgaagaaaacc

SEQ ID NO: 552282 - DNA, 25 bp, Rattus norvegicus
gagtgtcagcacacccggcgagttt

SEQ ID NO: 552283 - DNA, 25 bp, Rattus norvegicus
tagtactgtccggtcttcccacagg

SEQ ID NO: 552284 - DNA, 25 bp, Rattus norvegicus
tggcgactctggtcagaccctagta

SEQ ID NO: 552285 - DNA, 25 bp, Rattus norvegicus
ctcatgtctgtcaacggagcggtgt

SEQ ID NO: 552286 - DNA, 25 bp, Rattus norvegicus
agggcctgaaagaaccgctcatgtc

SEQ ID NO: 552287 - DNA, 25 bp, Rattus norvegicus
attctacaccggaagaggcagggcc

SEQ ID NO: 552288 - DNA, 25 bp, Rattus norvegicus
agggaccggatgttcacacattcta

SEQ ID NO: 552289 - DNA, 25 bp, Rattus norvegicus
cccaggtagagtcggacaagaacta

SEQ ID NO: 552290 - DNA, 25 bp, Rattus norvegicus
ggcgggcacaaaggcggaaacatct

SEQ ID NO: 552291 - DNA, 25 bp, Rattus norvegicus
caatcgttctcaggaggcgggcaca

SEQ ID NO: 552292 - DNA, 25 bp, Rattus norvegicus
atcctccaatcgtcgcgtttctctg

SEQ ID NO: 552293 - DNA, 25 bp, Rattus norvegicus
tggtccaggtaacctcccagtctgc

SEQ ID NO: 552294 - DNA, 25 bp, Rattus norvegicus
cggcgagtttcactcaccctatgta

SEQ ID NO: 552295 - DNA, 25 bp, Rattus norvegicus
ccctatgtagaaagctcaagcggtc

SEQ ID NO: 552296 - DNA, 25 bp, Rattus norvegicus
gcacctaggcttttgttgtgtcgca

SEQ ID NO: 552297 - DNA, 25 bp, Rattus norvegicus
cctaggcttttgttgtgtcgcacgc

SEQ ID NO: 552298 - DNA, 25 bp, Rattus norvegicus
ggcttttgttgtgtcgcacgcctcc

SEQ ID NO: 552299 - DNA, 25 bp, Rattus norvegicus
ttgttgtgtcgcacgcctcctgtcc

SEQ ID NO: 552300 - DNA, 25 bp, Rattus norvegicus
tgcctccggtgtcccagtgcaatct

SEQ ID NO: 552301 - DNA, 25 bp, Rattus norvegicus
tccggtgtcccagtgcaatctgggc

SEQ ID NO: 552302 - DNA, 25 bp, Rattus norvegicus
atctgggccacaggacctttctctc

SEQ ID NO: 552303 - DNA, 25 bp, Rattus norvegicus
cagcagtgccacttccctgggaatc

SEQ ID NO: 552304 - DNA, 25 bp, Rattus norvegicus
ttccctgggaatctcgcgctaaaga

SEQ ID NO: 552305 - DNA, 25 bp, Rattus norvegicus
ggaatctcgcgctaaagaaatgccc

SEQ ID NO: 552306 - DNA, 25 bp, Rattus norvegicus
cccaagtccgtggtatggcaggcgc

SEQ ID NO: 552307 - DNA, 25 bp, Rattus norvegicus
agcaggcgcgcactcctatgggtcc

SEQ ID NO: 552308 - DNA, 25 bp, Rattus norvegicus
tgcaatctgggccacaggacctttc

SEQ ID NO: 552309 - DNA, 25 bp, Rattus norvegicus
gcctggggacagcagtgccacttcc

SEQ ID NO: 552310 - DNA, 25 bp, Rattus norvegicus
gagacagtccttatccgggccaacg

SEQ ID NO: 552311 - DNA, 25 bp, Rattus norvegicus
agatctcctaaccattcggtcctga

SEQ ID NO: 552312 - DNA, 25 bp, Rattus norvegicus
agttttcagaccgtccctgccgagg

SEQ ID NO: 552313 - DNA, 25 bp, Rattus norvegicus
tgctgcagggtcgaacgatcgattc

SEQ ID NO: 552314 - DNA, 25 bp, Rattus norvegicus
gcccggaatccctttgccttagaga

SEQ ID NO: 552315 - DNA, 25 bp, Rattus norvegicus
ccgagaagcagaggcgttccgaatt

SEQ ID NO: 552316 - DNA, 25 bp, Rattus norvegicus
ttccgaattggctgagcgctctgcc

SEQ ID NO: 552317 - DNA, 25 bp, Rattus norvegicus
ctttgccttagagatccgcgcgagc

SEQ ID NO: 552318 - DNA, 25 bp, Rattus norvegicus
gcctcgccagggctggtagttttca

SEQ ID NO: 552319 - DNA, 25 bp, Rattus norvegicus
cagcccaggtagctgtgcctcagtc

SEQ ID NO: 552320 - DNA, 25 bp, Rattus norvegicus
ccagttcccaggagcacggttgcag

SEQ ID NO: 552321 - DNA, 25 bp, Rattus norvegicus
cccgactgctactgatggtgcttct

SEQ ID NO: 552322 - DNA, 25 bp, Rattus norvegicus
ggtgcttctgctgctcctctactag

SEQ ID NO: 552323 - DNA, 25 bp, Rattus norvegicus
ctgatcgtttggacccaggaggaac

SEQ ID NO: 552324 - DNA, 25 bp, Rattus norvegicus
cagaaggtccaaagcccgcggaagc

SEQ ID NO: 552325 - DNA, 25 bp, Rattus norvegicus
agtcttcggaacctatggccgcgcg

SEQ ID NO: 552326 - DNA, 25 bp, Rattus norvegicus
tcacttctcggattggtgcccagga

SEQ ID NO: 552327 - DNA, 25 bp, Rattus norvegicus
ggcaccgggatcgatgcacccaggc

SEQ ID NO: 552328 - DNA, 25 bp, Rattus norvegicus
caggtccgccgctagctcagcgtgt

SEQ ID NO: 552329 - DNA, 25 bp, Rattus norvegicus
agaaagagcttcacccggaccgcgg

SEQ ID NO: 552330 - DNA, 25 bp, Rattus norvegicus
gtccggctgcatagaggagctcaga

SEQ ID NO: 552331 - DNA, 25 bp, Rattus norvegicus
gaaaggtggaactgtcgcctccgct

SEQ ID NO: 552332 - DNA, 25 bp, Rattus norvegicus
gtcctcaaacccgtcgctgaactgg

SEQ ID NO: 552333 - DNA, 25 bp, Rattus norvegicus
caggagagagggcaccgcagctcat

SEQ ID NO: 552334 - DNA, 25 bp, Rattus norvegicus
accctcatggatcccgaaaggtgga

SEQ ID NO: 552335 - DNA, 25 bp, Rattus norvegicus
caccaagctccgcatataggggaca

SEQ ID NO: 552336 - DNA, 25 bp, Rattus norvegicus
accacgatggagacacgggtccgaa

SEQ ID NO: 552337 - DNA, 25 bp, Rattus norvegicus
ccctaattgctctgcagtcttcgga

SEQ ID NO: 552338 - DNA, 25 bp, Rattus norvegicus
tgcgtcacctgtgtgatgccgccca

SEQ ID NO: 552339 - DNA, 25 bp, Rattus norvegicus
cactgagtgaccatgggcgggacct

SEQ ID NO: 552340 - DNA, 25 bp, Rattus norvegicus
cgccatcttgcagagcggagcgtca

SEQ ID NO: 552341 - DNA, 25 bp, Rattus norvegicus
aagcgtgggcgtctccctcagaacc

SEQ ID NO: 552342 - DNA, 25 bp, Rattus norvegicus
ctcagaacctgcgtcacctgtgtga

SEQ ID NO: 552343 - DNA, 25 bp, Rattus norvegicus
ggggtaccaaactcacctcactgtc

SEQ ID NO: 552344 - DNA, 25 bp, Rattus norvegicus
gccgcccagggttagacaagtccaa

SEQ ID NO: 552345 - DNA, 25 bp, Rattus norvegicus
ttagacaagtccaaacgcgctactc

SEQ ID NO: 552346 - DNA, 25 bp, Rattus norvegicus
ggctgtggtgaagtctgtgatctca

SEQ ID NO: 552347 - DNA, 25 bp, Rattus norvegicus
tgatctcaaacacttcggactcggg

SEQ ID NO: 552348 - DNA, 25 bp, Rattus norvegicus
agcacagacagtaagccgcgggcca

SEQ ID NO: 552349 - DNA, 25 bp, Rattus norvegicus
taagccgcgggccactgacgtcggc

SEQ ID NO: 552350 - DNA, 25 bp, Rattus norvegicus
acgtcggcggcagaaccctgtgaca

SEQ ID NO: 552351 - DNA, 25 bp, Rattus norvegicus
tgtgacagccgtacccggggtacca

SEQ ID NO: 552352 - DNA, 25 bp, Rattus norvegicus
acggcgccatgttaccgggacacta

SEQ ID NO: 552353 - DNA, 25 bp, Rattus norvegicus
aatgctccgcgcctgttgtcattgg

SEQ ID NO: 552354 - DNA, 25 bp, Rattus norvegicus
ctctccgtagagtgggccacgcctt

SEQ ID NO: 552355 - DNA, 25 bp, Rattus norvegicus
cgtgttctccagctgttctcgagta

SEQ ID NO: 552356 - DNA, 25 bp, Rattus norvegicus
gctggcgatgcgacagctcttcatc

SEQ ID NO: 552357 - DNA, 25 bp, Rattus norvegicus
cagggccgcaactaggaaaaggata

SEQ ID NO: 552358 - DNA, 25 bp, Rattus norvegicus
ggactccgcgccaatgcattgaggc

SEQ ID NO: 552359 - DNA, 25 bp, Rattus norvegicus
ggccctagctttttgtgtttctctg

SEQ ID NO: 552360 - DNA, 25 bp, Rattus norvegicus
gcgcttcccgacacaggttacacaa

SEQ ID NO: 552361 - DNA, 25 bp, Rattus norvegicus
tctcgccagggaagcactgctattc

SEQ ID NO: 552362 - DNA, 25 bp, Rattus norvegicus
ttggcttcgctcatcccggattcct

SEQ ID NO: 552363 - DNA, 25 bp, Rattus norvegicus
ttccgtgaaacatctgggacctttc

SEQ ID NO: 552364 - DNA, 25 bp, Rattus norvegicus
ttctctgccgagatcaaaagaccgc

SEQ ID NO: 552365 - DNA, 25 bp, Rattus norvegicus
ccggctcgcactggtcttttgcttt

SEQ ID NO: 552366 - DNA, 25 bp, Rattus norvegicus
tgggttttcaaacgatgattggatc

SEQ ID NO: 552367 - DNA, 25 bp, Rattus norvegicus
gtaacgcgggtaagagatgccatcc

SEQ ID NO: 552368 - DNA, 25 bp, Rattus norvegicus
tggatcatccgtatgtcactcagtg

SEQ ID NO: 552369 - DNA, 25 bp, Rattus norvegicus
tcactcagtgttgatctagcgtatg

SEQ ID NO: 552370 - DNA, 25 bp, Rattus norvegicus
tagcgtatgaggtaggctgcttttc

SEQ ID NO: 552371 - DNA, 25 bp, Rattus norvegicus
gcttttcgtcaacgcgacggagagg

SEQ ID NO: 552372 - DNA, 25 bp, Rattus norvegicus
ttcccttccgtgagactcttccttg

SEQ ID NO: 552373 - DNA, 25 bp, Rattus norvegicus
atgcccggggctgatagacccgctc

SEQ ID NO: 552374 - DNA, 25 bp, Rattus norvegicus
cgggttctgagacgagccctcccgt

SEQ ID NO: 552375 - DNA, 25 bp, Rattus norvegicus
ctccttctcctcagtaacgcgggta

SEQ ID NO: 552376 - DNA, 25 bp, Rattus norvegicus
ctgctcttgcgagccctggagatcc

SEQ ID NO: 552377 - DNA, 25 bp, Rattus norvegicus
cggaggggaaaagcagccatagtca

SEQ ID NO: 552378 - DNA, 25 bp, Rattus norvegicus
tcccgctgcccgcagtgataatggg

SEQ ID NO: 552379 - DNA, 25 bp, Rattus norvegicus
gctggtgatggggttaattcccttc

SEQ ID NO: 552380 - DNA, 25 bp, Rattus norvegicus
gtctcctatcccgaccagtatggtt

SEQ ID NO: 552381 - DNA, 25 bp, Rattus norvegicus
tgggctccgacagcataagaccctg

SEQ ID NO: 552382 - DNA, 25 bp, Rattus norvegicus
cgtcaacgtgccgtagcggttagtc

SEQ ID NO: 552383 - DNA, 25 bp, Rattus norvegicus
agcggttagtcatccttcctgatac

SEQ ID NO: 552384 - DNA, 25 bp, Rattus norvegicus
tgatacttccacttcctggagtcgg

SEQ ID NO: 552385 - DNA, 25 bp, Rattus norvegicus
cacacggacttacctaggagacaag

SEQ ID NO: 552386 - DNA, 25 bp, Rattus norvegicus
acgaggagtgttgtcacgtgacaca

SEQ ID NO: 552387 - DNA, 25 bp, Rattus norvegicus
cgtgctattcttgccttgcgcgctc

SEQ ID NO: 552388 - DNA, 25 bp, Rattus norvegicus
ggccatcgcgtctgctaagaggagc

SEQ ID NO: 552389 - DNA, 25 bp, Rattus norvegicus
gcgtgacctctctgcatctgtgtga

SEQ ID NO: 552390 - DNA, 25 bp, Rattus norvegicus
tcttgattctgttagcgtcgaggga

SEQ ID NO: 552391 - DNA, 25 bp, Rattus norvegicus
ggttttatagggctccaggcttgct

SEQ ID NO: 552392 - DNA, 25 bp, Rattus norvegicus
tgagaagctcgtccaggccctatcc

SEQ ID NO: 552393 - DNA, 25 bp, Rattus norvegicus
ccaagcacagaatccggcgaggaga

SEQ ID NO: 552394 - DNA, 25 bp, Rattus norvegicus
ggtagcggcgtaaatcctttcctca

SEQ ID NO: 552395 - DNA, 25 bp, Rattus norvegicus
cacggctgcgcgattacttctccaa

SEQ ID NO: 552396 - DNA, 25 bp, Rattus norvegicus
tggagctgcacaccgagctgttgga

SEQ ID NO: 552397 - DNA, 25 bp, Rattus norvegicus
gtacttgctgactgccctggagctg

SEQ ID NO: 552398 - DNA, 25 bp, Rattus norvegicus
agacgcctgcagagtcggctaccga

SEQ ID NO: 552399 - DNA, 25 bp, Rattus norvegicus
ccagtctggcctagtccctaggtga

SEQ ID NO: 552400 - DNA, 25 bp, Rattus norvegicus
tcgcgagactagagaccaggaagac

SEQ ID NO: 552401 - DNA, 25 bp, Rattus norvegicus
tccaatcctggcaacttcgagaggc

SEQ ID NO: 552402 - DNA, 25 bp, Rattus norvegicus
aaggtgggaccaagccagttctcgc

SEQ ID NO: 552403 - DNA, 25 bp, Rattus norvegicus
actcctgacagaataagatggcggc

SEQ ID NO: 552404 - DNA, 25 bp, Rattus norvegicus
tgcctgtcgggccaagtagaaaagc

SEQ ID NO: 552405 - DNA, 25 bp, Rattus norvegicus
gacccgacgggaattcaggctgagt

SEQ ID NO: 552406 - DNA, 25 bp, Rattus norvegicus
ctgcctagttggtcagtggttctca

SEQ ID NO: 552407 - DNA, 25 bp, Rattus norvegicus
ccgctcagctgttgcgcgatcagta

SEQ ID NO: 552408 - DNA, 25 bp, Rattus norvegicus
ggaggccactcactcttccaggaag

SEQ ID NO: 552409 - DNA, 25 bp, Rattus norvegicus
ttccaggaagtctaggaacagcttc

SEQ ID NO: 552410 - DNA, 25 bp, Rattus norvegicus
aacagcttctgacatttctcggcca

SEQ ID NO: 552411 - DNA, 25 bp, Rattus norvegicus
gaggtccatggcagcgctaaaagta

SEQ ID NO: 552412 - DNA, 25 bp, Rattus norvegicus
agtacgcactgctgaagaaagacca

SEQ ID NO: 552413 - DNA, 25 bp, Rattus norvegicus
tgaagaaagaccaccgccgagaagc

SEQ ID NO: 552414 - DNA, 25 bp, Rattus norvegicus
cgcagcagcggaaggcctagccgca

SEQ ID NO: 552415 - DNA, 25 bp, Rattus norvegicus
cccagccaataatggagcgggagct

SEQ ID NO: 552416 - DNA, 25 bp, Rattus norvegicus
ggagctgagctacttcgcgccaagt

SEQ ID NO: 552417 - DNA, 25 bp, Rattus norvegicus
tcgcgccaagtctgtccaatcaatg

SEQ ID NO: 552418 - DNA, 25 bp, Rattus norvegicus
taatttcgcgccaaaagcagacgcc

SEQ ID NO: 552419 - DNA, 25 bp, Rattus norvegicus
gcttttgcccatgcgcaatgtagtc

SEQ ID NO: 552420 - DNA, 25 bp, Rattus norvegicus
agcagacgccaagaagcttttgccc

SEQ ID NO: 552421 - DNA, 25 bp, Rattus norvegicus
atcaatggcggttccgtccagagcc

SEQ ID NO: 552422 - DNA, 25 bp, Rattus norvegicus
gacggcgcgaccctagataacccta

SEQ ID NO: 552423 - DNA, 25 bp, Rattus norvegicus
actctgccaggaagtgacggtatta

SEQ ID NO: 552424 - DNA, 25 bp, Rattus norvegicus
aggaccggcatgattccgtgcaatc

SEQ ID NO: 552425 - DNA, 25 bp, Rattus norvegicus
ttccgccttcggagtgtactctgcc

SEQ ID NO: 552426 - DNA, 25 bp, Rattus norvegicus
ggcgtcgcaaaatcagcctccggac

SEQ ID NO: 552427 - DNA, 25 bp, Rattus norvegicus
cccactatgctgtttacgacgttcg

SEQ ID NO: 552428 - DNA, 25 bp, Rattus norvegicus
cccgactcacctgtttgaagcagaa

SEQ ID NO: 552429 - DNA, 25 bp, Rattus norvegicus
ttcccatcagcggagcacttcaaac

SEQ ID NO: 552430 - DNA, 25 bp, Rattus norvegicus
gaggactttgctcgggtctcttccc

SEQ ID NO: 552431 - DNA, 25 bp, Rattus norvegicus
tgcacgactcgcttcgaggactttg

SEQ ID NO: 552432 - DNA, 25 bp, Rattus norvegicus
gcggaacgcgcagatccagatcatg

SEQ ID NO: 552433 - DNA, 25 bp, Rattus norvegicus
ctctgtgctcttccgtacggtgtta

SEQ ID NO: 552434 - DNA, 25 bp, Rattus norvegicus
tccgtcggagtcaaacacaggacta

SEQ ID NO: 552435 - DNA, 25 bp, Rattus norvegicus
tcacagccatggtttcaggttcccg

SEQ ID NO: 552436 - DNA, 25 bp, Rattus norvegicus
cgcaggcttccgtaggacaggctaa

SEQ ID NO: 552437 - DNA, 25 bp, Rattus norvegicus
agcgcgtttcttctaggccacggtt

SEQ ID NO: 552438 - DNA, 25 bp, Rattus norvegicus
ggaacctcggctagaaatatcgcga

SEQ ID NO: 552439 - DNA, 25 bp, Rattus norvegicus
gctggccctcccagtccttgtttta

SEQ ID NO: 552440 - DNA, 25 bp, Rattus norvegicus
aatatcgcgagagctgcagtcgagc

SEQ ID NO: 552441 - DNA, 25 bp, Rattus norvegicus
gcgctgggcatcaggacactggatt

SEQ ID NO: 552442 - DNA, 25 bp, Rattus norvegicus
ttctcctgacccttacggctggcgt

SEQ ID NO: 552443 - DNA, 25 bp, Rattus norvegicus
caaagtgccgacaggagctcccgaa

SEQ ID NO: 552444 - DNA, 25 bp, Rattus norvegicus
tcacgccgtggcctgcgcaaagtgc

SEQ ID NO: 552445 - DNA, 25 bp, Rattus norvegicus
atccttgggagtattggcttgcggc

SEQ ID NO: 552446 - DNA, 25 bp, Rattus norvegicus
acacatggccctgagatccttggga

SEQ ID NO: 552447 - DNA, 25 bp, Rattus norvegicus
agtagcagtcccaagtagttcgggc

SEQ ID NO: 552448 - DNA, 25 bp, Rattus norvegicus
ggccacggttccaagagtagcagtc

SEQ ID NO: 552449 - DNA, 25 bp, Rattus norvegicus
agactccgcgtggaacctcggctag

SEQ ID NO: 552450 - DNA, 25 bp, Rattus norvegicus
acccaggatgttgtgcctacgcgtg

SEQ ID NO: 552451 - DNA, 25 bp, Rattus norvegicus
cgggtcagactccagcaaagcgctc

SEQ ID NO: 552452 - DNA, 25 bp, Rattus norvegicus
cggctccagcgtgagcgcctttgaa

SEQ ID NO: 552453 - DNA, 25 bp, Rattus norvegicus
cactggggctcagtcaaactgtctc

SEQ ID NO: 552454 - DNA, 25 bp, Rattus norvegicus
ttgcacctgttcatccctgcggcga

SEQ ID NO: 552455 - DNA, 25 bp, Rattus norvegicus
ggaccctttctcatgaacgatctta

SEQ ID NO: 552456 - DNA, 25 bp, Rattus norvegicus
ggctcgtatgccactgcggagaaga

SEQ ID NO: 552457 - DNA, 25 bp, Rattus norvegicus
aaagcgctgctactccatcccaaag

SEQ ID NO: 552458 - DNA, 25 bp, Rattus norvegicus
ccacggctgccgcagtttgtgatcc

SEQ ID NO: 552459 - DNA, 25 bp, Rattus norvegicus
cctaggctagcgatgctgcaggcta

SEQ ID NO: 552460 - DNA, 25 bp, Rattus norvegicus
ggctagctcagttttcccgccgaca

SEQ ID NO: 552461 - DNA, 25 bp, Rattus norvegicus
cgggcactcctcagtctacagcatg

SEQ ID NO: 552462 - DNA, 25 bp, Rattus norvegicus
ttcggttcgaagctaacccaggatg

SEQ ID NO: 552463 - DNA, 25 bp, Rattus norvegicus
acagctccaagacgcttcggttcga

SEQ ID NO: 552464 - DNA, 25 bp, Rattus norvegicus
gactaaatggagcagcctgggactg

SEQ ID NO: 552465 - DNA, 25 bp, Rattus norvegicus
tgggaagtcttagcgaagagctagt

SEQ ID NO: 552466 - DNA, 25 bp, Rattus norvegicus
atccatgcgcagtcagtgggcgctc

SEQ ID NO: 552467 - DNA, 25 bp, Rattus norvegicus
gacatcttcccagacccgcgccaga

SEQ ID NO: 552468 - DNA, 25 bp, Rattus norvegicus
ttgcagtgggcgcccagacatcttc

SEQ ID NO: 552469 - DNA, 25 bp, Rattus norvegicus
cgtggatggctaggaagtctcagac

SEQ ID NO: 552470 - DNA, 25 bp, Rattus norvegicus
cgcagaacactaagatgggaagtct

SEQ ID NO: 552471 - DNA, 25 bp, Rattus norvegicus
tcgtgtctcccacgcagaacactaa

SEQ ID NO: 552472 - DNA, 25 bp, Rattus norvegicus
tgagcccaaagctttcgcttcacgc

SEQ ID NO: 552473 - DNA, 25 bp, Rattus norvegicus
gagcctagcctgagcccaaagcttt

SEQ ID NO: 552474 - DNA, 25 bp, Rattus norvegicus
cagcctgggactgcgagcctagcct

SEQ ID NO: 552475 - DNA, 25 bp, Rattus norvegicus
ccacgagctccaagagactaaatgg

SEQ ID NO: 552476 - DNA, 25 bp, Rattus norvegicus
gcgctccacgagctccaagagacta

SEQ ID NO: 552477 - DNA, 25 bp, Rattus norvegicus
tggctaggaagtctcagacaggctg

SEQ ID NO: 552478 - DNA, 25 bp, Rattus norvegicus
cagcccggttgccagacgctggaat

SEQ ID NO: 552479 - DNA, 25 bp, Rattus norvegicus
ccagctggtagggactgatgccgcg

SEQ ID NO: 552480 - DNA, 25 bp, Rattus norvegicus
ttctcccagccagtcgcgggaactt

SEQ ID NO: 552481 - DNA, 25 bp, Rattus norvegicus
agccaggcgccttccctgctccctt

SEQ ID NO: 552482 - DNA, 25 bp, Rattus norvegicus
acagactttcctagccaggcgcctt

SEQ ID NO: 552483 - DNA, 25 bp, Rattus norvegicus
gggcgcctcccgcacagactttcct

SEQ ID NO: 552484 - DNA, 25 bp, Rattus norvegicus
tggccaaatggagagatagctgccc

SEQ ID NO: 552485 - DNA, 25 bp, Rattus norvegicus
cccttggttggccaaatggagagat

SEQ ID NO: 552486 - DNA, 25 bp, Rattus norvegicus
tgagtgcggccgcactgtgccccag

SEQ ID NO: 552487 - DNA, 25 bp, Rattus norvegicus
tcggcggctcccagaagctgcagct

SEQ ID NO: 552488 - DNA, 25 bp, Rattus norvegicus
atcttcaccggggaagctcggggct

SEQ ID NO: 552489 - DNA, 25 bp, Rattus norvegicus
gtctcccgacacacaccaccatctt

SEQ ID NO: 552490 - DNA, 25 bp, Rattus norvegicus
ccagacgctggaatgggtggtctcc

SEQ ID NO: 552491 - DNA, 25 bp, Rattus norvegicus
tggaatgggtggtctcccgacacac

SEQ ID NO: 552492 - DNA, 25 bp, Rattus norvegicus
tcaccgcttacagtcggggacagca

SEQ ID NO: 552493 - DNA, 25 bp, Rattus norvegicus
gtgaggcgcgagataagacacccta

SEQ ID NO: 552494 - DNA, 25 bp, Rattus norvegicus
gtcgttcagaatctactcaatatcc

SEQ ID NO: 552495 - DNA, 25 bp, Rattus norvegicus
gttccctccttgaagagcgcgggcc

SEQ ID NO: 552496 - DNA, 25 bp, Rattus norvegicus
ctggagctgttttgagccagggtta

SEQ ID NO: 552497 - DNA, 25 bp, Rattus norvegicus
aacaatgcctgctgagcatgcgccc

SEQ ID NO: 552498 - DNA, 25 bp, Rattus norvegicus
cccgttacggggaacaatgcctgct

SEQ ID NO: 552499 - DNA, 25 bp, Rattus norvegicus
caggcaaccggcacctggcagcgga

SEQ ID NO: 552500 - DNA, 25 bp, Rattus norvegicus
cagggttggagattcgcactcgacc

SEQ ID NO: 552501 - DNA, 25 bp, Rattus norvegicus
gcctccaccttaagaatagaacagc

SEQ ID NO: 552502 - DNA, 25 bp, Rattus norvegicus
agcaggtgttcagccatctagcctc

SEQ ID NO: 552503 - DNA, 25 bp, Rattus norvegicus
actggactctcacccgcagcaggtg

SEQ ID NO: 552504 - DNA, 25 bp, Rattus norvegicus
tatccacgccgacactgcagtgagg

SEQ ID NO: 552505 - DNA, 25 bp, Rattus norvegicus
ccagggttaattgaatggctgcgga

SEQ ID NO: 552506 - DNA, 25 bp, Rattus norvegicus
cagactgaagaagtccgggctccgg

SEQ ID NO: 552507 - DNA, 25 bp, Rattus norvegicus
gaagcaccgtcgctctgcaccttaa

SEQ ID NO: 552508 - DNA, 25 bp, Rattus norvegicus
ggctcagcgtccctgaagggctgca

SEQ ID NO: 552509 - DNA, 25 bp, Rattus norvegicus
tccctgaagggctgcacgcccagga

SEQ ID NO: 552510 - DNA, 25 bp, Rattus norvegicus
ctgcacgcccaggagtgtcacggga

SEQ ID NO: 552511 - DNA, 25 bp, Rattus norvegicus
gtgtcacgggagctacccttcccta

SEQ ID NO: 552512 - DNA, 25 bp, Rattus norvegicus
cttccctaaagcacgaagcaccgtc

SEQ ID NO: 552513 - DNA, 25 bp, Rattus norvegicus
cccacgtacagactgctcaattatc

SEQ ID NO: 552514 - DNA, 25 bp, Rattus norvegicus
ctgctcaattatcgctcaccctatg

SEQ ID NO: 552515 - DNA, 25 bp, Rattus norvegicus
tcaccctatgacctgtcctattcgt

SEQ ID NO: 552516 - DNA, 25 bp, Rattus norvegicus
gtcctattcgtcctccctgctgtag

SEQ ID NO: 552517 - DNA, 25 bp, Rattus norvegicus
gtcctccctgctgtagacccggtgt

SEQ ID NO: 552518 - DNA, 25 bp, Rattus norvegicus
agcgagcaggcagactgaagaagtc

SEQ ID NO: 552519 - DNA, 25 bp, Rattus norvegicus
ctgtagacccggtgtcgccaccgga

SEQ ID NO: 552520 - DNA, 25 bp, Rattus norvegicus
agtgtatttggaagggccgaagcca

SEQ ID NO: 552521 - DNA, 25 bp, Rattus norvegicus
tggatctcagcgaccgggacatcac

SEQ ID NO: 552522 - DNA, 25 bp, Rattus norvegicus
gtcggctacccaccagagtgcctgg

SEQ ID NO: 552523 - DNA, 25 bp, Rattus norvegicus
tcctggcagtcagcgaatcctcgtc

SEQ ID NO: 552524 - DNA, 25 bp, Rattus norvegicus
tatcaccggcatcgctcctggcagt

SEQ ID NO: 552525 - DNA, 25 bp, Rattus norvegicus
ctgcagggccaaatcgccgctatca

SEQ ID NO: 552526 - DNA, 25 bp, Rattus norvegicus
cggacccgcttacgggaactgcagg

SEQ ID NO: 552527 - DNA, 25 bp, Rattus norvegicus
gcacccacgttttgcagggtctttc

SEQ ID NO: 552528 - DNA, 25 bp, Rattus norvegicus
gctgcaaggccaagggtggcaccca

SEQ ID NO: 552529 - DNA, 25 bp, Rattus norvegicus
cagcggctacttctcgcgatgtttg

SEQ ID NO: 552530 - DNA, 25 bp, Rattus norvegicus
cacggctgcccttatcactttaaga

SEQ ID NO: 552531 - DNA, 25 bp, Rattus norvegicus
gctcgggagaactggccaacctcca

SEQ ID NO: 552532 - DNA, 25 bp, Rattus norvegicus
ggggacctgcccatccagtcaggta

SEQ ID NO: 552533 - DNA, 25 bp, Rattus norvegicus
gccgacactatgtggcggctccgct

SEQ ID NO: 552534 - DNA, 25 bp, Rattus norvegicus
agcgcacacaccagcgaggcgtgga

SEQ ID NO: 552535 - DNA, 25 bp, Rattus norvegicus
agccctgccactggtaagctccgcc

SEQ ID NO: 552536 - DNA, 25 bp, Rattus norvegicus
ggccttcccgccagatccctacaca

SEQ ID NO: 552537 - DNA, 25 bp, Rattus norvegicus
agatccctacacagcgccgggatgc

SEQ ID NO: 552538 - DNA, 25 bp, Rattus norvegicus
aggccgcgctcgcagaacaacgtct

SEQ ID NO: 552539 - DNA, 25 bp, Rattus norvegicus
cgcagaacaacgtctacagcgcctg

SEQ ID NO: 552540 - DNA, 25 bp, Rattus norvegicus
gcgcgcacgggaacccgacaacgtg

SEQ ID NO: 552541 - DNA, 25 bp, Rattus norvegicus
acccgacaacgtgggtgagcgcaca

SEQ ID NO: 552542 - DNA, 25 bp, Rattus norvegicus
acaacgtgggtgagcgcacacacca

SEQ ID NO: 552543 - DNA, 25 bp, Rattus norvegicus
aaggctggggccctcaccgctttct

SEQ ID NO: 552544 - DNA, 25 bp, Rattus norvegicus
tcttctgtcccataggttcagcgga

SEQ ID NO: 552545 - DNA, 25 bp, Rattus norvegicus
gtcccataggttcagcggaggctct

SEQ ID NO: 552546 - DNA, 25 bp, Rattus norvegicus
tcaccgctttcttctgtcccatagg

SEQ ID NO: 552547 - DNA, 25 bp, Rattus norvegicus
gcggaggctctgctcctcaacgccc

SEQ ID NO: 552548 - DNA, 25 bp, Rattus norvegicus
atgccgaagccatctccaccgggtg

SEQ ID NO: 552549 - DNA, 25 bp, Rattus norvegicus
tgcaggtaaggacccgcaccgctgt

SEQ ID NO: 552550 - DNA, 25 bp, Rattus norvegicus
ctcccattgcaggtaaggacccgca

SEQ ID NO: 552551 - DNA, 25 bp, Rattus norvegicus
ctgctcctcccattgcaggtaagga

SEQ ID NO: 552552 - DNA, 25 bp, Rattus norvegicus
cgtgctgctcctcccattgcaggta

SEQ ID NO: 552553 - DNA, 25 bp, Rattus norvegicus
ggcgccgccagtttcccgcgcctct

SEQ ID NO: 552554 - DNA, 25 bp, Rattus norvegicus
tcgtggaatgccgaagccatctcca

SEQ ID NO: 552555 - DNA, 25 bp, Rattus norvegicus
gcactcgtggaatgccgaagccatc

SEQ ID NO: 552556 - DNA, 25 bp, Rattus norvegicus
cgggtctgaagcactcgtggaatgc

SEQ ID NO: 552557 - DNA, 25 bp, Rattus norvegicus
gatcccgcgcgggtctgaagcactc

SEQ ID NO: 552558 - DNA, 25 bp, Rattus norvegicus
cacccgagagctcagagcctgggga

SEQ ID NO: 552559 - DNA, 25 bp, Rattus norvegicus
gctgcacccgagagctcagagcctg

SEQ ID NO: 552560 - DNA, 25 bp, Rattus norvegicus
cgcaggtgctgcacccgagagctca

SEQ ID NO: 552561 - DNA, 25 bp, Rattus norvegicus
ctctgctggcgctctgcgtgctgct

SEQ ID NO: 552562 - DNA, 25 bp, Rattus norvegicus
ggcggttccagacaatcgcgggaca

SEQ ID NO: 552563 - DNA, 25 bp, Rattus norvegicus
ggcgaatttttgctgggttctcttg

SEQ ID NO: 552564 - DNA, 25 bp, Rattus norvegicus
gatccgcagcaccttcccgttgatg

SEQ ID NO: 552565 - DNA, 25 bp, Rattus norvegicus
taaagggccttttgtgcccgcagaa

SEQ ID NO: 552566 - DNA, 25 bp, Rattus norvegicus
gaccgaccaaccagctcaatgagta

SEQ ID NO: 552567 - DNA, 25 bp, Rattus norvegicus
gagcgaacttctccaaaccgaccga

SEQ ID NO: 552568 - DNA, 25 bp, Rattus norvegicus
gccggagagagcgaagtcacattcc

SEQ ID NO: 552569 - DNA, 25 bp, Rattus norvegicus
cgacttgacgtggaactgagggaac

SEQ ID NO: 552570 - DNA, 25 bp, Rattus norvegicus
tttcggatctgcaggcccgacttga

SEQ ID NO: 552571 - DNA, 25 bp, Rattus norvegicus
tcggtgatggcgttctttcggatct

SEQ ID NO: 552572 - DNA, 25 bp, Rattus norvegicus
ctggtgaccttgtagtcgtcggtga

SEQ ID NO: 552573 - DNA, 25 bp, Rattus norvegicus
cgttgatgcccaggccaagcacttg

SEQ ID NO: 552574 - DNA, 25 bp, Rattus norvegicus
ggttctcttgtcgaagatccgcagc

SEQ ID NO: 552575 - DNA, 25 bp, Rattus norvegicus
gtcacattccggctcccaaataagg

SEQ ID NO: 552576 - DNA, 25 bp, Rattus norvegicus
agcaaaccagacctagctctagacg

SEQ ID NO: 552577 - DNA, 25 bp, Rattus norvegicus
aagacccttgtccttgtcggccgcg

SEQ ID NO: 552578 - DNA, 25 bp, Rattus norvegicus
aatcagaagtgacggcagagtggac

SEQ ID NO: 552579 - DNA, 25 bp, Rattus norvegicus
cctagcccgaccttaatcagaagtg

SEQ ID NO: 552580 - DNA, 25 bp, Rattus norvegicus
gcgctgtcaggagaacctagcccga

SEQ ID NO: 552581 - DNA, 25 bp, Rattus norvegicus
cactctgaaatgaggggcgctgtca

SEQ ID NO: 552582 - DNA, 25 bp, Rattus norvegicus
gtctccaacaatgcactctgaaatg

SEQ ID NO: 552583 - DNA, 25 bp, Rattus norvegicus
ggggctaaatcagtctccaacaatg

SEQ ID NO: 552584 - DNA, 25 bp, Rattus norvegicus
gctctagacgtctcagcagggagtc

SEQ ID NO: 552585 - DNA, 25 bp, Rattus norvegicus
tccaccgagagtccagcaaaccaga

SEQ ID NO: 552586 - DNA, 25 bp, Rattus norvegicus
caggctgtctctgactccaccgaga

SEQ ID NO: 552587 - DNA, 25 bp, Rattus norvegicus
agagctccttgcgtcgccgaccagt

SEQ ID NO: 552588 - DNA, 25 bp, Rattus norvegicus
ccaggtcggctggagcccaaagacc

SEQ ID NO: 552589 - DNA, 25 bp, Rattus norvegicus
cataagcggacctcactcgggctgc

SEQ ID NO: 552590 - DNA, 25 bp, Rattus norvegicus
tttgtgatcgtagacccgggctacc

SEQ ID NO: 552591 - DNA, 25 bp, Rattus norvegicus
ttgccgcttcttggcattcgggccc

SEQ ID NO: 552592 - DNA, 25 bp, Rattus norvegicus
tgggaccaccaataactccttgccg

SEQ ID NO: 552593 - DNA, 25 bp, Rattus norvegicus
tctcgaggcacgtggatataggccc

SEQ ID NO: 552594 - DNA, 25 bp, Rattus norvegicus
aagccagatggtctcgaggcacgtg

SEQ ID NO: 552595 - DNA, 25 bp, Rattus norvegicus
tcatagcggtaagccagatggtctc

SEQ ID NO: 552596 - DNA, 25 bp, Rattus norvegicus
ctgtcggagtttgtgatcgtagacc

SEQ ID NO: 552597 - DNA, 25 bp, Rattus norvegicus
tcagggccacgtactgtcggagttt

SEQ ID NO: 552598 - DNA, 25 bp, Rattus norvegicus
tgcgcaccattttcagggccacgta

SEQ ID NO: 552599 - DNA, 25 bp, Rattus norvegicus
gcgcttctcgttgcgcaccattttc

SEQ ID NO: 552600 - DNA, 25 bp, Rattus norvegicus
cctggcggtgaaagcgcttctcgtt

SEQ ID NO: 552601 - DNA, 25 bp, Rattus norvegicus
atctcctcggctgcctggcggtgaa

SEQ ID NO: 552602 - DNA, 25 bp, Rattus norvegicus
tttcagcacctcatagcggtaagcc

SEQ ID NO: 552603 - DNA, 25 bp, Rattus norvegicus
ccttgccaataattttcagcacctc

SEQ ID NO: 552604 - DNA, 25 bp, Rattus norvegicus
cctcagcatggctgcctccagggtt

SEQ ID NO: 552605 - DNA, 25 bp, Rattus norvegicus
gccgctcgagcagacatgttcgcta

SEQ ID NO: 552606 - DNA, 25 bp, Rattus norvegicus
tcttcttgtctttcctgggccgctc

SEQ ID NO: 552607 - DNA, 25 bp, Rattus norvegicus
ggagctgccacaccctcgttttgtt

SEQ ID NO: 552608 - DNA, 25 bp, Rattus norvegicus
ctatttggcgccgagtcctcagcat

SEQ ID NO: 552609 - DNA, 25 bp, Rattus norvegicus
ttcctagccggctgctatttggcgc

SEQ ID NO: 552610 - DNA, 25 bp, Rattus norvegicus
tcaggtctagggctgtaaagctacg

SEQ ID NO: 552611 - DNA, 25 bp, Rattus norvegicus
ctaggaccggccagcatcaggtcta

SEQ ID NO: 552612 - DNA, 25 bp, Rattus norvegicus
cgtgcgtcagttccgggactaggac

SEQ ID NO: 552613 - DNA, 25 bp, Rattus norvegicus
tgctggctcgtagctacacctggta

SEQ ID NO: 552614 - DNA, 25 bp, Rattus norvegicus
attactacagacgtgctggctcgta

SEQ ID NO: 552615 - DNA, 25 bp, Rattus norvegicus
cagacatgttcgctaaggcctttcg

SEQ ID NO: 552616 - DNA, 25 bp, Rattus norvegicus
gctgtaaagctacgtgccggggttc

SEQ ID NO: 552617 - DNA, 25 bp, Rattus norvegicus
ctggcgtctgtgctcttcttgtctt

SEQ ID NO: 552618 - DNA, 25 bp, Rattus norvegicus
ggctccggccgagcgcgcttttaaa

SEQ ID NO: 552619 - DNA, 25 bp, Rattus norvegicus
gctccagagcctggccaacagaagg

SEQ ID NO: 552620 - DNA, 25 bp, Rattus norvegicus
gagcgagcccgctgctgtcagcaag

SEQ ID NO: 552621 - DNA, 25 bp, Rattus norvegicus
ctggttagctcccaggacgccctaa

SEQ ID NO: 552622 - DNA, 25 bp, Rattus norvegicus
gaaggtctgagcatccgcgaggctc

SEQ ID NO: 552623 - DNA, 25 bp, Rattus norvegicus
agccgcatgggtttagaggcgactc

SEQ ID NO: 552624 - DNA, 25 bp, Rattus norvegicus
caatggccggggacgccatggccaa

SEQ ID NO: 552625 - DNA, 25 bp, Rattus norvegicus
cggtgccacccaggctctgcagata

SEQ ID NO: 552626 - DNA, 25 bp, Rattus norvegicus
agtctctgctgcagaccgggccgga

SEQ ID NO: 552627 - DNA, 25 bp, Rattus norvegicus
ctcgaagatgctcctcacgtcgcgg

SEQ ID NO: 552628 - DNA, 25 bp, Rattus norvegicus
gatcctgcggttgctcgaagatgct

SEQ ID NO: 552629 - DNA, 25 bp, Rattus norvegicus
tcctctctcggctaagacgcgggga

SEQ ID NO: 552630 - DNA, 25 bp, Rattus norvegicus
ggagcgccaattccgcgaaacggtg

SEQ ID NO: 552631 - DNA, 25 bp, Rattus norvegicus
ccggaagggcaacacgcgtgactgc

SEQ ID NO: 552632 - DNA, 25 bp, Rattus norvegicus
acggggcctccagccaataataata

SEQ ID NO: 552633 - DNA, 25 bp, Rattus norvegicus
agcccatctgacatcggcaccgtta

SEQ ID NO: 552634 - DNA, 25 bp, Rattus norvegicus
cggcctctgagctcacgtcaggaaa

SEQ ID NO: 552635 - DNA, 25 bp, Rattus norvegicus
gcagatgctggccaataagcttaga

SEQ ID NO: 552636 - DNA, 25 bp, Rattus norvegicus
ctcggggtgtgtcttccaagttcac

SEQ ID NO: 552637 - DNA, 25 bp, Rattus norvegicus
ctggcctggacagtaagcacatcta

SEQ ID NO: 552638 - DNA, 25 bp, Rattus norvegicus
ctcgcaagagaagacaggaccaatc

SEQ ID NO: 552639 - DNA, 25 bp, Rattus norvegicus
ccggcctgtgaaagcctaaagtaga

SEQ ID NO: 552640 - DNA, 25 bp, Rattus norvegicus
gaggccgagctaatcttaaccaatc

SEQ ID NO: 552641 - DNA, 25 bp, Rattus norvegicus
acgaaacttagaggtgtggcgaaca

SEQ ID NO: 552642 - DNA, 25 bp, Rattus norvegicus
gccttctatcgactgacggggcctc

SEQ ID NO: 552643 - DNA, 25 bp, Rattus norvegicus
cccagtcccggtttgttcagtcaga

SEQ ID NO: 552644 - DNA, 25 bp, Rattus norvegicus
tcctgagaagtattatgggctgcac

SEQ ID NO: 552645 - DNA, 25 bp, Rattus norvegicus
tagctgcctaggctcagtcccagag

SEQ ID NO: 552646 - DNA, 25 bp, Rattus norvegicus
atgctcatccgccatgatgctcatc

SEQ ID NO: 552647 - DNA, 25 bp, Rattus norvegicus
tgatgctcatccgccatgatgctca

SEQ ID NO: 552648 - DNA, 25 bp, Rattus norvegicus
tcatccgccatgatgctcatccgcc

SEQ ID NO: 552649 - DNA, 25 bp, Rattus norvegicus
tccgccatgatgctcatccgccatg

SEQ ID NO: 552650 - DNA, 25 bp, Rattus norvegicus
gctcatccgccatgatgctcatccg

SEQ ID NO: 552651 - DNA, 25 bp, Rattus norvegicus
ctcatccgccatgatgctcatccgc

SEQ ID NO: 552652 - DNA, 25 bp, Rattus norvegicus
ccgccatgatgctcatccgccatga

SEQ ID NO: 552653 - DNA, 25 bp, Rattus norvegicus
atgatgctcatccgccatgatgctc

SEQ ID NO: 552654 - DNA, 25 bp, Rattus norvegicus
catgatgctcatccgccatgatgct

SEQ ID NO: 552655 - DNA, 25 bp, Rattus norvegicus
gccatgatgctcatccgccatgatg

SEQ ID NO: 552656 - DNA, 25 bp, Rattus norvegicus
gatgctcatccgccatgatgctcat

SEQ ID NO: 552657 - DNA, 25 bp, Rattus norvegicus
ccatgatgctcatccgccatgatgc

SEQ ID NO: 552658 - DNA, 25 bp, Rattus norvegicus
tgctcatccgccatgatgctcatcc

SEQ ID NO: 552659 - DNA, 25 bp, Rattus norvegicus
cgccatgatgctcatccgccatgat

SEQ ID NO: 552660 - DNA, 25 bp, Rattus norvegicus
tctgagttcccgtcactctagtgcg

SEQ ID NO: 552661 - DNA, 25 bp, Rattus norvegicus
cgatcgccagctggccggctcaaag

SEQ ID NO: 552662 - DNA, 25 bp, Rattus norvegicus
tttcgggtcttctggaaggcccaga

SEQ ID NO: 552663 - DNA, 25 bp, Rattus norvegicus
gcccagaggctcactagagatagtc

SEQ ID NO: 552664 - DNA, 25 bp, Rattus norvegicus
tagtcaagattcaggggtacatgcg

SEQ ID NO: 552665 - DNA, 25 bp, Rattus norvegicus
cagaacgctcgcctggagagggcac

SEQ ID NO: 552666 - DNA, 25 bp, Rattus norvegicus
acacgcgatgtctgctgaggcctgt

SEQ ID NO: 552667 - DNA, 25 bp, Rattus norvegicus
cgcaggaaggcagaagcgaaatgta

SEQ ID NO: 552668 - DNA, 25 bp, Rattus norvegicus
ctctgattggctgatgcagttgtcc

SEQ ID NO: 552669 - DNA, 25 bp, Rattus norvegicus
gcagttgtccatcctgaatctattt

SEQ ID NO: 552670 - DNA, 25 bp, Rattus norvegicus
acagccgaacactcttgtccaagtc

SEQ ID NO: 552671 - DNA, 25 bp, Rattus norvegicus
ctcttgtccaagtcggcgggcaaga

SEQ ID NO: 552672 - DNA, 25 bp, Rattus norvegicus
gacgagcaagctcgacacctcaggc

SEQ ID NO: 552673 - DNA, 25 bp, Rattus norvegicus
ggtacatgcgtagcagaacgctcgc

SEQ ID NO: 552674 - DNA, 25 bp, Rattus norvegicus
tgcccatccggtcgcgaccagaaag

SEQ ID NO: 552675 - DNA, 25 bp, Rattus norvegicus
agcgctgtgctgtagcgcccgctgt

SEQ ID NO: 552676 - DNA, 25 bp, Rattus norvegicus
gcgtccgcgctgagtgcgcttcctt

SEQ ID NO: 552677 - DNA, 25 bp, Rattus norvegicus
agatttaaaagctgcccgctggcgc

SEQ ID NO: 552678 - DNA, 25 bp, Rattus norvegicus
ccactgagtaacctggagatttaaa

SEQ ID NO: 552679 - DNA, 25 bp, Rattus norvegicus
gcgaccagaaaggagactgcttctc

SEQ ID NO: 552680 - DNA, 25 bp, Rattus norvegicus
aatgacagggcagtctaggagcctc

SEQ ID NO: 552681 - DNA, 25 bp, Rattus norvegicus
cggtgcacagccctaggtaatgaca

SEQ ID NO: 552682 - DNA, 25 bp, Rattus norvegicus
ctaaacgttttggtggcgagcggca

SEQ ID NO: 552683 - DNA, 25 bp, Rattus norvegicus
gccggcaatggtcgcagactggctt

SEQ ID NO: 552684 - DNA, 25 bp, Rattus norvegicus
gtccagaagggcacgcgccggcaat

SEQ ID NO: 552685 - DNA, 25 bp, Rattus norvegicus
cgtggcgttctgtactccgcgggat

SEQ ID NO: 552686 - DNA, 25 bp, Rattus norvegicus
ctgtgcctggacagcgggatgtcca

SEQ ID NO: 552687 - DNA, 25 bp, Rattus norvegicus
agtgcgcttccttcgggagcgctgt

SEQ ID NO: 552688 - DNA, 25 bp, Rattus norvegicus
tcttagcctggttctacgcgggcca

SEQ ID NO: 552689 - DNA, 25 bp, Rattus norvegicus
gttttaacttgtcttagtggcagga

SEQ ID NO: 552690 - DNA, 25 bp, Rattus norvegicus
gccgtagtgaagaacgtcgagcgca

SEQ ID NO: 552691 - DNA, 25 bp, Rattus norvegicus
gaaggtggcagcagtttttgttgtc

SEQ ID NO: 552692 - DNA, 25 bp, Rattus norvegicus
cttcccgcaccacggtgggttgtgc

SEQ ID NO: 552693 - DNA, 25 bp, Rattus norvegicus
cctattggctcgctctccttgggag

SEQ ID NO: 552694 - DNA, 25 bp, Rattus norvegicus
aggattcctgtgtcctgcctggtga

SEQ ID NO: 552695 - DNA, 25 bp, Rattus norvegicus
cgtttaaggtcgagaaggattcctg

SEQ ID NO: 552696 - DNA, 25 bp, Rattus norvegicus
gtgacagagtctagcaccgcgttta

SEQ ID NO: 552697 - DNA, 25 bp, Rattus norvegicus
tgaattcctagcgtgaggagcagtc

SEQ ID NO: 552698 - DNA, 25 bp, Rattus norvegicus
tgccgcgccgtctttgaattcctag

SEQ ID NO: 552699 - DNA, 25 bp, Rattus norvegicus
ttaactagccacatcgccgtccggg

SEQ ID NO: 552700 - DNA, 25 bp, Rattus norvegicus
acggcgagtggcagcttaactagcc

SEQ ID NO: 552701 - DNA, 25 bp, Rattus norvegicus
gcagctccgcggagctcaggtgctc

SEQ ID NO: 552702 - DNA, 25 bp, Rattus norvegicus
ccacctcgcttcacgttccctgggg

SEQ ID NO: 552703 - DNA, 25 bp, Rattus norvegicus
ctgaagaagacgctccagtaggtga

SEQ ID NO: 552704 - DNA, 25 bp, Rattus norvegicus
ggccgaagctgaagaagacgctcca

SEQ ID NO: 552705 - DNA, 25 bp, Rattus norvegicus
tgcacaggccgaagctgaagaagac

SEQ ID NO: 552706 - DNA, 25 bp, Rattus norvegicus
acccgaccgtcgcagcccatggctc

SEQ ID NO: 552707 - DNA, 25 bp, Rattus norvegicus
tcacagcgagccctgggccgagtgc

SEQ ID NO: 552708 - DNA, 25 bp, Rattus norvegicus
cggagcagccctgacacccgaccgt

SEQ ID NO: 552709 - DNA, 25 bp, Rattus norvegicus
gactggaacccatccaggagcgcga

SEQ ID NO: 552710 - DNA, 25 bp, Rattus norvegicus
atccaggagcgcgacccgccagcta

SEQ ID NO: 552711 - DNA, 25 bp, Rattus norvegicus
gccagctagtgccagaggctccgcg

SEQ ID NO: 552712 - DNA, 25 bp, Rattus norvegicus
gcgcgccctactccaagcagccttt

SEQ ID NO: 552713 - DNA, 25 bp, Rattus norvegicus
ccaggaaggcgatgcacaggccgaa

SEQ ID NO: 552714 - DNA, 25 bp, Rattus norvegicus
ctccaagcagcctttccgcctggcg

SEQ ID NO: 552715 - DNA, 25 bp, Rattus norvegicus
agctcacagcgagccctgggccgag

SEQ ID NO: 552716 - DNA, 25 bp, Rattus norvegicus
gggcaacgttcttgacggccgtgcc

SEQ ID NO: 552717 - DNA, 25 bp, Rattus norvegicus
aggctaaggccaacggcctctcgga

SEQ ID NO: 552718 - DNA, 25 bp, Rattus norvegicus
agagggaaccgctcaggccgtcacc

SEQ ID NO: 552719 - DNA, 25 bp, Rattus norvegicus
aggacgcgcttgtcgacttgctcct

SEQ ID NO: 552720 - DNA, 25 bp, Rattus norvegicus
gtcgctggccgacttccgagagcct

SEQ ID NO: 552721 - DNA, 25 bp, Rattus norvegicus
cactacctgcgcgactcagaggcta

SEQ ID NO: 552722 - DNA, 25 bp, Rattus norvegicus
tggcgcgcaaggactaccactacct

SEQ ID NO: 552723 - DNA, 25 bp, Rattus norvegicus
gcaacccgctggagctgcgctttct

SEQ ID NO: 552724 - DNA, 25 bp, Rattus norvegicus
ggctgctggacctgtgcaacccgct

SEQ ID NO: 552725 - DNA, 25 bp, Rattus norvegicus
ctcgagccgcctgttgctagcgggc

SEQ ID NO: 552726 - DNA, 25 bp, Rattus norvegicus
gatgaagctgccaccgaagtccacg

SEQ ID NO: 552727 - DNA, 25 bp, Rattus norvegicus
gcaccgccttagctgaggatgctga

SEQ ID NO: 552728 - DNA, 25 bp, Rattus norvegicus
tcatcgtttacctagcgctgctggg

SEQ ID NO: 552729 - DNA, 25 bp, Rattus norvegicus
acttccgagagcctgcggtgcgctc

SEQ ID NO: 552730 - DNA, 25 bp, Rattus norvegicus
tggaagcgggactacccaccaagcg

SEQ ID NO: 552731 - DNA, 25 bp, Rattus norvegicus
agagattcattccactcgcagcttc

SEQ ID NO: 552732 - DNA, 25 bp, Rattus norvegicus
ttctccaccggcgtcggaagcttta

SEQ ID NO: 552733 - DNA, 25 bp, Rattus norvegicus
cgaaatacagagttttggtggaagc

SEQ ID NO: 552734 - DNA, 25 bp, Rattus norvegicus
gacagacgcgcgcagcgaattcgcc

SEQ ID NO: 552735 - DNA, 25 bp, Rattus norvegicus
cgcccgggactctggccacaattaa

SEQ ID NO: 552736 - DNA, 25 bp, Rattus norvegicus
tctggccacaattaaggatcgcttt

SEQ ID NO: 552737 - DNA, 25 bp, Rattus norvegicus
taaggatcgctttgtcctagaaaga

SEQ ID NO: 552738 - DNA, 25 bp, Rattus norvegicus
gggaccttctctccatcgtgggatc

SEQ ID NO: 552739 - DNA, 25 bp, Rattus norvegicus
gatccgtgctctacccgactcggaa

SEQ ID NO: 552740 - DNA, 25 bp, Rattus norvegicus
ctacccgactcggaaagtcacattc

SEQ ID NO: 552741 - DNA, 25 bp, Rattus norvegicus
ttcctcacccaaactacgacggaga

SEQ ID NO: 552742 - DNA, 25 bp, Rattus norvegicus
cgacggagatagacacttggtgtgc

SEQ ID NO: 552743 - DNA, 25 bp, Rattus norvegicus
cgtcggaagctttatggcttgttga

SEQ ID NO: 552744 - DNA, 25 bp, Rattus norvegicus
tttgctcagcttgcccggcgcgctg

SEQ ID NO: 552745 - DNA, 25 bp, Rattus norvegicus
cccaaaacacaagcgcgcctgccga

SEQ ID NO: 552746 - DNA, 25 bp, Rattus norvegicus
ggccaaagggagtcccggatccaga

SEQ ID NO: 552747 - DNA, 25 bp, Rattus norvegicus
ggcacgcgttctgtctcagcacctg

SEQ ID NO: 552748 - DNA, 25 bp, Rattus norvegicus
gttctgtctcagcacctggaacttg

SEQ ID NO: 552749 - DNA, 25 bp, Rattus norvegicus
cacctggaacttgggagtggctttc

SEQ ID NO: 552750 - DNA, 25 bp, Rattus norvegicus
gtggctttccgagggcatccttcac

SEQ ID NO: 552751 - DNA, 25 bp, Rattus norvegicus
gcccattgcctacggcagctcggaa

SEQ ID NO: 552752 - DNA, 25 bp, Rattus norvegicus
tgcctacggcagctcggaaatttta

SEQ ID NO: 552753 - DNA, 25 bp, Rattus norvegicus
gcagctcggaaattttacccaaatc

SEQ ID NO: 552754 - DNA, 25 bp, Rattus norvegicus
ttacccaaatctccagcgcaaaggc

SEQ ID NO: 552755 - DNA, 25 bp, Rattus norvegicus
gcttacctttgctcagcttgcccgg

SEQ ID NO: 552756 - DNA, 25 bp, Rattus norvegicus
cggactctgtgcgtgtcccggtcgt

SEQ ID NO: 552757 - DNA, 25 bp, Rattus norvegicus
agggccgctcggcttacctttgctc

SEQ ID NO: 552758 - DNA, 25 bp, Rattus norvegicus
cagatggaaacccaacccaggccgg

SEQ ID NO: 552759 - DNA, 25 bp, Rattus norvegicus
gcagataatttattctctaatcccg

SEQ ID NO: 552760 - DNA, 25 bp, Rattus norvegicus
gcgcacacacacatttcctgacaat

SEQ ID NO: 552761 - DNA, 25 bp, Rattus norvegicus
attagcgagcacaccttggccgcgc

SEQ ID NO: 552762 - DNA, 25 bp, Rattus norvegicus
cggcccaatgagaaaacagcagata

SEQ ID NO: 552763 - DNA, 25 bp, Rattus norvegicus
tcaaccgcggcccaatgagaaaaca

SEQ ID NO: 552764 - DNA, 25 bp, Rattus norvegicus
ggccgcaaaagagaagcggaagaaa

SEQ ID NO: 552765 - DNA, 25 bp, Rattus norvegicus
gaagaaaagtaaggcagcgctggcc

SEQ ID NO: 552766 - DNA, 25 bp, Rattus norvegicus
cccttcctttgttacagcctgagtg

SEQ ID NO: 552767 - DNA, 25 bp, Rattus norvegicus
ctttgttacagcctgagtgtgagcg

SEQ ID NO: 552768 - DNA, 25 bp, Rattus norvegicus
tctttctcgcccgtgcagaactcgg

SEQ ID NO: 552769 - DNA, 25 bp, Rattus norvegicus
ctcccgagacgcagctagtggctgc

SEQ ID NO: 552770 - DNA, 25 bp, Rattus norvegicus
tggctgctttcagatggaaacccaa

SEQ ID NO: 552771 - DNA, 25 bp, Rattus norvegicus
tcctgacaattagcgagcacacctt

SEQ ID NO: 552772 - DNA, 25 bp, Rattus norvegicus
gctgcccggccggtgctgaaagcct

SEQ ID NO: 552773 - DNA, 25 bp, Rattus norvegicus
gtctggaccttgtcgggacgctttg

SEQ ID NO: 552774 - DNA, 25 bp, Rattus norvegicus
ctgccctagattcgcccggttcttt

SEQ ID NO: 552775 - DNA, 25 bp, Rattus norvegicus
caaagttgacctagggcgagctacc

SEQ ID NO: 552776 - DNA, 25 bp, Rattus norvegicus
cggggcgcatcctacaaagttgacc

SEQ ID NO: 552777 - DNA, 25 bp, Rattus norvegicus
tgctgaaagcctcgcgccgctgtgg

SEQ ID NO: 552778 - DNA, 25 bp, Rattus norvegicus
tgcttctggggaccgctcgcctgcg

SEQ ID NO: 552779 - DNA, 25 bp, Rattus norvegicus
acagcctccgtctcgggagcgcgtg

SEQ ID NO: 552780 - DNA, 25 bp, Rattus norvegicus
tgtagacgcggtaggccttgccctc

SEQ ID NO: 552781 - DNA, 25 bp, Rattus norvegicus
tgtctccgaccctgtagacgcggta

SEQ ID NO: 552782 - DNA, 25 bp, Rattus norvegicus
tctctggctgtctccgaccctgtag

SEQ ID NO: 552783 - DNA, 25 bp, Rattus norvegicus
cgctgacacccaagggaccgggaga

SEQ ID NO: 552784 - DNA, 25 bp, Rattus norvegicus
tccacgctggcaggatctgcctgtc

SEQ ID NO: 552785 - DNA, 25 bp, Rattus norvegicus
aggatctgcctgtcatctgggcacc

SEQ ID NO: 552786 - DNA, 25 bp, Rattus norvegicus
ggagaccctgggcaagggcacctac

SEQ ID NO: 552787 - DNA, 25 bp, Rattus norvegicus
cctctgatgaagaagcaggcggtga

SEQ ID NO: 552788 - DNA, 25 bp, Rattus norvegicus
catagcgcgtcccttgtggtgtcct

SEQ ID NO: 552789 - DNA, 25 bp, Rattus norvegicus
aaagcacgagagagctcgggacgcc

SEQ ID NO: 552790 - DNA, 25 bp, Rattus norvegicus
cacaacctgaggcaccgctacgagt

SEQ ID NO: 552791 - DNA, 25 bp, Rattus norvegicus
cggtgaagcggcaccatcacaaaca

SEQ ID NO: 552792 - DNA, 25 bp, Rattus norvegicus
aagtcgcccaaacctctgatgaaga

SEQ ID NO: 552793 - DNA, 25 bp, Rattus norvegicus
ggaccggctcatcaagtcgcccaaa

SEQ ID NO: 552794 - DNA, 25 bp, Rattus norvegicus
accatggagtcggtggccttacacc

SEQ ID NO: 552795 - DNA, 25 bp, Rattus norvegicus
ctgtgacctctgagcctgcggctct

SEQ ID NO: 552796 - DNA, 25 bp, Rattus norvegicus
tagcaattcggaacgcggggctttc

SEQ ID NO: 552797 - DNA, 25 bp, Rattus norvegicus
cctccaaacgttttatagcaattcg

SEQ ID NO: 552798 - DNA, 25 bp, Rattus norvegicus
tcgccggcaagctggctaatgggac

SEQ ID NO: 552799 - DNA, 25 bp, Rattus norvegicus
ccgctacgagttcctggagaccctg

SEQ ID NO: 552800 - DNA, 25 bp, Rattus norvegicus
atgttggcgcctacatccttcagcc

SEQ ID NO: 552801 - DNA, 25 bp, Rattus norvegicus
gatgttgtccgcactgccgaacttg

SEQ ID NO: 552802 - DNA, 25 bp, Rattus norvegicus
agggcccattctgctcgatctcctt

SEQ ID NO: 552803 - DNA, 25 bp, Rattus norvegicus
gtagcacatccttgggctgcctcga

SEQ ID NO: 552804 - DNA, 25 bp, Rattus norvegicus
tcagcccttgctgcatatcacgtag

SEQ ID NO: 552805 - DNA, 25 bp, Rattus norvegicus
ttgggctgcctcgagggcccattct

SEQ ID NO: 552806 - DNA, 25 bp, Rattus norvegicus
ggcacgcatgttggcgcctacatcc

SEQ ID NO: 552807 - DNA, 25 bp, Rattus norvegicus
gaagccactgatgccggcacgcatg

SEQ ID NO: 552808 - DNA, 25 bp, Rattus norvegicus
aggccagagagactgcccttgacgc

SEQ ID NO: 552809 - DNA, 25 bp, Rattus norvegicus
cttgcgagaggccagagagactgcc

SEQ ID NO: 552810 - DNA, 25 bp, Rattus norvegicus
aactcccggggcttggacaccactg

SEQ ID NO: 552811 - DNA, 25 bp, Rattus norvegicus
tgttgcgaatgaggctggcgaactc

SEQ ID NO: 552812 - DNA, 25 bp, Rattus norvegicus
gcactgccgaacttgttgcgaatga

SEQ ID NO: 552813 - DNA, 25 bp, Rattus norvegicus
gcatatcacgtagcacatccttggg

SEQ ID NO: 552814 - DNA, 25 bp, Rattus norvegicus
gcattgctgccgtcagccaggagca

SEQ ID NO: 552815 - DNA, 25 bp, Rattus norvegicus
cagcataggagacgcggtgcatctc

SEQ ID NO: 552816 - DNA, 25 bp, Rattus norvegicus
tgcagggacacagcataggagacgc

SEQ ID NO: 552817 - DNA, 25 bp, Rattus norvegicus
gcaggtcgtgcagggacacagcata

SEQ ID NO: 552818 - DNA, 25 bp, Rattus norvegicus
cccggttgaaagcagtaggtcgcgc

SEQ ID NO: 552819 - DNA, 25 bp, Rattus norvegicus
ctgtaacacccggttgaaagcagta

SEQ ID NO: 552820 - DNA, 25 bp, Rattus norvegicus
ggatttgctgtaacacccggttgaa

SEQ ID NO: 552821 - DNA, 25 bp, Rattus norvegicus
ggcctggaacggatttgctgtaaca

SEQ ID NO: 552822 - DNA, 25 bp, Rattus norvegicus
ccccgcttgatggagggcctggaac

SEQ ID NO: 552823 - DNA, 25 bp, Rattus norvegicus
gctcccgccactgctgtgcaggctg

SEQ ID NO: 552824 - DNA, 25 bp, Rattus norvegicus
tccagggagctgctcttggcacggc

SEQ ID NO: 552825 - DNA, 25 bp, Rattus norvegicus
cggctccagggagctgctcttggca

SEQ ID NO: 552826 - DNA, 25 bp, Rattus norvegicus
gggccttacgaagcaggtgagggct

SEQ ID NO: 552827 - DNA, 25 bp, Rattus norvegicus
cgtcagccaggagcaaggcggtatc

SEQ ID NO: 552828 - DNA, 25 bp, Rattus norvegicus
cagcggagttagcactcgaggcctc

SEQ ID NO: 552829 - DNA, 25 bp, Rattus norvegicus
gacggtctgcgctcacctttaaatc

SEQ ID NO: 552830 - DNA, 25 bp, Rattus norvegicus
ggacaccgctgtaggcttggttgca

SEQ ID NO: 552831 - DNA, 25 bp, Rattus norvegicus
ccgcagcgccagcatctgaagttgg

SEQ ID NO: 552832 - DNA, 25 bp, Rattus norvegicus
aaggcaagcggcgtcttccatccca

SEQ ID NO: 552833 - DNA, 25 bp, Rattus norvegicus
tgttgctgcagctcatccgatttgc

SEQ ID NO: 552834 - DNA, 25 bp, Rattus norvegicus
ccgatttgcacctcttcatggtgta

SEQ ID NO: 552835 - DNA, 25 bp, Rattus norvegicus
gggaatctgtccttctagcgtgcta

SEQ ID NO: 552836 - DNA, 25 bp, Rattus norvegicus
tagcgtgctatcttggggagagacc

SEQ ID NO: 552837 - DNA, 25 bp, Rattus norvegicus
ttgcactcaaaagacctagggttta

SEQ ID NO: 552838 - DNA, 25 bp, Rattus norvegicus
ggcagatcacgagttcttgaattta

SEQ ID NO: 552839 - DNA, 25 bp, Rattus norvegicus
agccttgggatagttcattccgacc

SEQ ID NO: 552840 - DNA, 25 bp, Rattus norvegicus
cagcggtccttaggcagtcactggc

SEQ ID NO: 552841 - DNA, 25 bp, Rattus norvegicus
acctttaaatcaggaggcttgcttc

SEQ ID NO: 552842 - DNA, 25 bp, Rattus norvegicus
gttcttccgcgacatcaagtgctcc

SEQ ID NO: 552843 - DNA, 25 bp, Rattus norvegicus
caaggcgagtgtaagcacagagatc

SEQ ID NO: 552844 - DNA, 25 bp, Rattus norvegicus
gtgagacccagaagttcttccgcga

SEQ ID NO: 552845 - DNA, 25 bp, Rattus norvegicus
gccagccgcaaagacagcgggctga

SEQ ID NO: 552846 - DNA, 25 bp, Rattus norvegicus
cgtgtacagaacaaaaatacatttt

SEQ ID NO: 552847 - DNA, 25 bp, Rattus norvegicus
ctccgcgggttctgtcttcccttag

SEQ ID NO: 552848 - DNA, 25 bp, Rattus norvegicus
agcacagagatcagtcggggacacc

SEQ ID NO: 552849 - DNA, 25 bp, Rattus norvegicus
gttggggcattccacccagcccaga

SEQ ID NO: 552850 - DNA, 25 bp, Rattus norvegicus
acggtgcctcggtgagttcttccct

SEQ ID NO: 552851 - DNA, 25 bp, Rattus norvegicus
tgagttcttccctcgctccgcaggg

SEQ ID NO: 552852 - DNA, 25 bp, Rattus norvegicus
cggagccgggagctctagcttctct

SEQ ID NO: 552853 - DNA, 25 bp, Rattus norvegicus
ctctagcttctctgccgcggcagtg

SEQ ID NO: 552854 - DNA, 25 bp, Rattus norvegicus
gggaggcggattccgccttctctga

SEQ ID NO: 552855 - DNA, 25 bp, Rattus norvegicus
cttcccttaggaattcgtgtacaga

SEQ ID NO: 552856 - DNA, 25 bp, Rattus norvegicus
tctccgttctggtactcccgtgaca

SEQ ID NO: 552857 - DNA, 25 bp, Rattus norvegicus
ccgaagccgtctccgttctggtact

SEQ ID NO: 552858 - DNA, 25 bp, Rattus norvegicus
aaggacagcaggtagccgaagccgt

SEQ ID NO: 552859 - DNA, 25 bp, Rattus norvegicus
cttgcctgcggaaggacagcaggta

SEQ ID NO: 552860 - DNA, 25 bp, Rattus norvegicus
cccgggcagtctgccagctggagct

SEQ ID NO: 552861 - DNA, 25 bp, Rattus norvegicus
aagtactgcgcatcagcgccaggca

SEQ ID NO: 552862 - DNA, 25 bp, Rattus norvegicus
ggatgctgtcattgccgtagacgaa

SEQ ID NO: 552863 - DNA, 25 bp, Rattus norvegicus
tgtagggctggatgctgtcattgcc

SEQ ID NO: 552864 - DNA, 25 bp, Rattus norvegicus
cttgacctcaaagggtgtgtagggc

SEQ ID NO: 552865 - DNA, 25 bp, Rattus norvegicus
actcccgtgacacgggctgagggca

SEQ ID NO: 552866 - DNA, 25 bp, Rattus norvegicus
cccggcgattgtagcttcggatctt

SEQ ID NO: 552867 - DNA, 25 bp, Rattus norvegicus
aggcacccgggcagtctgccagctg

SEQ ID NO: 552868 - DNA, 25 bp, Rattus norvegicus
tagcttcggatcttgacctcaaagg

SEQ ID NO: 552869 - DNA, 25 bp, Rattus norvegicus
gccgtagacgaagtactgcgcatca

SEQ ID NO: 552870 - DNA, 25 bp, Rattus norvegicus
agtcccagatgtctgctcccggcgc

SEQ ID NO: 552871 - DNA, 25 bp, Rattus norvegicus
ggcgccgccacttcgcccgcgtccc

SEQ ID NO: 552872 - DNA, 25 bp, Rattus norvegicus
tccgcgaccgggttctgctacccta

SEQ ID NO: 552873 - DNA, 25 bp, Rattus norvegicus
tctgctaccctaccgggtgcccgcg

SEQ ID NO: 552874 - DNA, 25 bp, Rattus norvegicus
cctgcagcagctctcgccgccagcc

SEQ ID NO: 552875 - DNA, 25 bp, Rattus norvegicus
ggtgcccgcgctcaccttacctcca

SEQ ID NO: 552876 - DNA, 25 bp, Rattus norvegicus
ggatgctcaggtgccacagtccgcc

SEQ ID NO: 552877 - DNA, 25 bp, Rattus norvegicus
cgccagccgccgcattagggcagag

SEQ ID NO: 552878 - DNA, 25 bp, Rattus norvegicus
gccgccgcattagggcagagactag

SEQ ID NO: 552879 - DNA, 25 bp, Rattus norvegicus
gggcagagactagcccgtgcgcgcc

SEQ ID NO: 552880 - DNA, 25 bp, Rattus norvegicus
cctccctgcgtacgagttgccggga

SEQ ID NO: 552881 - DNA, 25 bp, Rattus norvegicus
agttgccgggaccaggacccagaag

SEQ ID NO: 552882 - DNA, 25 bp, Rattus norvegicus
gacccagaagcacggaaggatgctc

SEQ ID NO: 552883 - DNA, 25 bp, Rattus norvegicus
gaaggatgctcaggtgccacagtcc

SEQ ID NO: 552884 - DNA, 25 bp, Rattus norvegicus
actctcctagccacccagcggtcgg

SEQ ID NO: 552885 - DNA, 25 bp, Rattus norvegicus
caggctttcagacgccgcctcgcca

SEQ ID NO: 552886 - DNA, 25 bp, Rattus norvegicus
cagtcacacgcagagggcaatcacc

SEQ ID NO: 552887 - DNA, 25 bp, Rattus norvegicus
agagggcaatcacccgggcgccgtc

SEQ ID NO: 552888 - DNA, 25 bp, Rattus norvegicus
gagttatcgatagtaactccgggcg

SEQ ID NO: 552889 - DNA, 25 bp, Rattus norvegicus
cgggccgagcgtagagttatcgata

SEQ ID NO: 552890 - DNA, 25 bp, Rattus norvegicus
ccagcaggaggcagtcacacgcaga

SEQ ID NO: 552891 - DNA, 25 bp, Rattus norvegicus
gctctgcactctgccttagtccagg

SEQ ID NO: 552892 - DNA, 25 bp, Rattus norvegicus
taccggcgtgattacccggaccgca

SEQ ID NO: 552893 - DNA, 25 bp, Rattus norvegicus
ggctctgtcctaccggcgtgattac

SEQ ID NO: 552894 - DNA, 25 bp, Rattus norvegicus
tagctgaccggcactgggatcggat

SEQ ID NO: 552895 - DNA, 25 bp, Rattus norvegicus
gctgctgagcatgcgtagctgaccg

SEQ ID NO: 552896 - DNA, 25 bp, Rattus norvegicus
gccgtctgccgcaagggtaggcaac

SEQ ID NO: 552897 - DNA, 25 bp, Rattus norvegicus
ctgccttagtccaggacggcgaggc

SEQ ID NO: 552898 - DNA, 25 bp, Rattus norvegicus
tctcgccagctctcgtctatggcga

SEQ ID NO: 552899 - DNA, 25 bp, Rattus norvegicus
gcagctccggggagctcaggctgac

SEQ ID NO: 552900 - DNA, 25 bp, Rattus norvegicus
atattcatgagtgaggtcgggccgc

SEQ ID NO: 552901 - DNA, 25 bp, Rattus norvegicus
ccttcccgcgcttcattaatattca

SEQ ID NO: 552902 - DNA, 25 bp, Rattus norvegicus
cgccttcccgcgcttcattaatatt

SEQ ID NO: 552903 - DNA, 25 bp, Rattus norvegicus
tgcatattcatgagcaactccgccc

SEQ ID NO: 552904 - DNA, 25 bp, Rattus norvegicus
gtcgtcatgctaacgatgcatattc

SEQ ID NO: 552905 - DNA, 25 bp, Rattus norvegicus
cccagaaatgtcgtcatgctaacga

SEQ ID NO: 552906 - DNA, 25 bp, Rattus norvegicus
gcgtcacgtttgtttaccctgaggc

SEQ ID NO: 552907 - DNA, 25 bp, Rattus norvegicus
gcacgcgtcacgtttgtttaccctg

SEQ ID NO: 552908 - DNA, 25 bp, Rattus norvegicus
caaacctcctgggaaacagttctgc

SEQ ID NO: 552909 - DNA, 25 bp, Rattus norvegicus
tggcgaggacaaacctcctgggaaa

SEQ ID NO: 552910 - DNA, 25 bp, Rattus norvegicus
ccagctctcgtctatggcgaggaca

SEQ ID NO: 552911 - DNA, 25 bp, Rattus norvegicus
ctcgtctatggcgaggacaaacctc

SEQ ID NO: 552912 - DNA, 25 bp, Rattus norvegicus
cggccagggctttgatgacccagtg

SEQ ID NO: 552913 - DNA, 25 bp, Rattus norvegicus
tctgctgacgccctcgcaggctggg

SEQ ID NO: 552914 - DNA, 25 bp, Rattus norvegicus
atgcctgcaggagagctggtgattt

SEQ ID NO: 552915 - DNA, 25 bp, Rattus norvegicus
tggggacacagtcattctgctgacg

SEQ ID NO: 552916 - DNA, 25 bp, Rattus norvegicus
tcgccgagatgcctgcaggagagct

SEQ ID NO: 552917 - DNA, 25 bp, Rattus norvegicus
tcgcaggctgggctttgcgaccact

SEQ ID NO: 552918 - DNA, 25 bp, Rattus norvegicus
gggctttgcgaccactcccaagaca

SEQ ID NO: 552919 - DNA, 25 bp, Rattus norvegicus
cactcccaagacaagtgcaggttgg

SEQ ID NO: 552920 - DNA, 25 bp, Rattus norvegicus
cggcgagtggcagacatacatatag

SEQ ID NO: 552921 - DNA, 25 bp, Rattus norvegicus
atacatataggacagcgcccgcgcg

SEQ ID NO: 552922 - DNA, 25 bp, Rattus norvegicus
tccgaggacgctggcgtggcctcaa

SEQ ID NO: 552923 - DNA, 25 bp, Rattus norvegicus
tggcctcaagggtcgcggcgatccc

SEQ ID NO: 552924 - DNA, 25 bp, Rattus norvegicus
cgcaggattggggacacagtcattc

SEQ ID NO: 552925 - DNA, 25 bp, Rattus norvegicus
agcccgctgtggagcagcgatccca

SEQ ID NO: 552926 - DNA, 25 bp, Rattus norvegicus
ctcccgcgaccaggcgattcggtgt

SEQ ID NO: 552927 - DNA, 25 bp, Rattus norvegicus
atggcagggccgaaagcccaaccgg

SEQ ID NO: 552928 - DNA, 25 bp, Rattus norvegicus
cagcgtccgggccaacaatggcagg

SEQ ID NO: 552929 - DNA, 25 bp, Rattus norvegicus
tgcagagcgccctcttagtcggggc

SEQ ID NO: 552930 - DNA, 25 bp, Rattus norvegicus
tagacacccagccacgacagtcagg

SEQ ID NO: 552931 - DNA, 25 bp, Rattus norvegicus
agggagcaggcgacactgaacatca

SEQ ID NO: 552932 - DNA, 25 bp, Rattus norvegicus
cacgcccgttgcttgcccgtgtggt

SEQ ID NO: 552933 - DNA, 25 bp, Rattus norvegicus
acgctttcagcagacagcaccgggc

SEQ ID NO: 552934 - DNA, 25 bp, Rattus norvegicus
acgacaatctgctagcgggaagtga

SEQ ID NO: 552935 - DNA, 25 bp, Rattus norvegicus
tcgcgctattgtctcacccggggct

SEQ ID NO: 552936 - DNA, 25 bp, Rattus norvegicus
ctcctcggagcacggcaggttgctc

SEQ ID NO: 552937 - DNA, 25 bp, Rattus norvegicus
acagtcagggtgtcgcggcagaacc

SEQ ID NO: 552938 - DNA, 25 bp, Rattus norvegicus
actgcgagctcgtgcacgctttcag

SEQ ID NO: 552939 - DNA, 25 bp, Rattus norvegicus
gtcggcggagcactagacacccagc

SEQ ID NO: 552940 - DNA, 25 bp, Rattus norvegicus
tcggtcgttcgtttcgtcttgcagc

SEQ ID NO: 552941 - DNA, 25 bp, Rattus norvegicus
ttctctatggtggagcggtctcaca

SEQ ID NO: 552942 - DNA, 25 bp, Rattus norvegicus
tctcctaggagaccagaacgaactg

SEQ ID NO: 552943 - DNA, 25 bp, Rattus norvegicus
atgcgcatatcctaggtccggctga

SEQ ID NO: 552944 - DNA, 25 bp, Rattus norvegicus
cctgctctgccctgagtaaggaagc

SEQ ID NO: 552945 - DNA, 25 bp, Rattus norvegicus
aacgtctgtgtatttcgcgcctccg

SEQ ID NO: 552946 - DNA, 25 bp, Rattus norvegicus
ctgcggccattttgagcttcgcttc

SEQ ID NO: 552947 - DNA, 25 bp, Rattus norvegicus
gttcgcacgcctgcacttccgagtt

SEQ ID NO: 552948 - DNA, 25 bp, Rattus norvegicus
tagggcgcctccattctcgccgaga

SEQ ID NO: 552949 - DNA, 25 bp, Rattus norvegicus
acggtacatcgctcgctacggaagc

SEQ ID NO: 552950 - DNA, 25 bp, Rattus norvegicus
ccactccgtgtctgggcaaggctaa

SEQ ID NO: 552951 - DNA, 25 bp, Rattus norvegicus
ctaagactgtgtaggcctcggatcc

SEQ ID NO: 552952 - DNA, 25 bp, Rattus norvegicus
cgtgcccgagaagttgccaaggaaa

SEQ ID NO: 552953 - DNA, 25 bp, Rattus norvegicus
tggggttcagcaaaagacgttaggc

SEQ ID NO: 552954 - DNA, 25 bp, Rattus norvegicus
ccgatggacctacggagtggaccgc

SEQ ID NO: 552955 - DNA, 25 bp, Rattus norvegicus
tcccaccaaccgaagtggtgttatc

SEQ ID NO: 552956 - DNA, 25 bp, Rattus norvegicus
caaccgaagtggtgttatcacttcc

SEQ ID NO: 552957 - DNA, 25 bp, Rattus norvegicus
gtgcgtgactcgaggctcgccctcg

SEQ ID NO: 552958 - DNA, 25 bp, Rattus norvegicus
ctccagggcccgcagttcaagagca

SEQ ID NO: 552959 - DNA, 25 bp, Rattus norvegicus
ttcaagagcaggctcggagcgacga

SEQ ID NO: 552960 - DNA, 25 bp, Rattus norvegicus
gcggcggcaggagcctcttaattac

SEQ ID NO: 552961 - DNA, 25 bp, Rattus norvegicus
ggagcctcttaattactcaccacgc

SEQ ID NO: 552962 - DNA, 25 bp, Rattus norvegicus
accacgctaattgcccggcactgaa

SEQ ID NO: 552963 - DNA, 25 bp, Rattus norvegicus
tgcccggcactgaacttcaggagcc

SEQ ID NO: 552964 - DNA, 25 bp, Rattus norvegicus
ccgcctctaggaggcgcagaaagtg

SEQ ID NO: 552965 - DNA, 25 bp, Rattus norvegicus
ggacaccgagatggccgatgagatc

SEQ ID NO: 552966 - DNA, 25 bp, Rattus norvegicus
atgagatcgactggctggacctgcc

SEQ ID NO: 552967 - DNA, 25 bp, Rattus norvegicus
acctgccaggccgatggacctacgg

SEQ ID NO: 552968 - DNA, 25 bp, Rattus norvegicus
gatggcaccgtttggatccccagcc

SEQ ID NO: 552969 - DNA, 25 bp, Rattus norvegicus
acggcaggatggcaccgtttggatc

SEQ ID NO: 552970 - DNA, 25 bp, Rattus norvegicus
cgacagccggtctactatgatgagc

SEQ ID NO: 552971 - DNA, 25 bp, Rattus norvegicus
ccggtctactatgatgagctggatg

SEQ ID NO: 552972 - DNA, 25 bp, Rattus norvegicus
ctactatgatgagctggatgctgcc

SEQ ID NO: 552973 - DNA, 25 bp, Rattus norvegicus
ctatgatgagctggatgctgcctct

SEQ ID NO: 552974 - DNA, 25 bp, Rattus norvegicus
ggcaggatggcaccgtttggatccc

SEQ ID NO: 552975 - DNA, 25 bp, Rattus norvegicus
cccgtgcgctcacccagtgcccgtt

SEQ ID NO: 552976 - DNA, 25 bp, Rattus norvegicus
tcccgacagccggtctactatgatg

SEQ ID NO: 552977 - DNA, 25 bp, Rattus norvegicus
ccagccagggctcctatagtcgtgc

SEQ ID NO: 552978 - DNA, 25 bp, Rattus norvegicus
agtgcccgtttcgatcggctgccac

SEQ ID NO: 552979 - DNA, 25 bp, Rattus norvegicus
gctcctatagtcgtgcccgcatcta

SEQ ID NO: 552980 - DNA, 25 bp, Rattus norvegicus
tcctatagtcgtgcccgcatctact

SEQ ID NO: 552981 - DNA, 25 bp, Rattus norvegicus
cagggctcctatagtcgtgcccgca

SEQ ID NO: 552982 - DNA, 25 bp, Rattus norvegicus
ttgcgtcattaaggcggggcatcac

SEQ ID NO: 552983 - DNA, 25 bp, Rattus norvegicus
gaggctccgccctttgcgtcattaa

SEQ ID NO: 552984 - DNA, 25 bp, Rattus norvegicus
agagctccaggtagccttggaccca

SEQ ID NO: 552985 - DNA, 25 bp, Rattus norvegicus
tactgcggcccatgatgtcactgtc

SEQ ID NO: 552986 - DNA, 25 bp, Rattus norvegicus
cggagatcggaacaggcagctcgct

SEQ ID NO: 552987 - DNA, 25 bp, Rattus norvegicus
gtgctcgcccttttacctgcggagg

SEQ ID NO: 552988 - DNA, 25 bp, Rattus norvegicus
gtgcttcgccatcgcagtggaccag

SEQ ID NO: 552989 - DNA, 25 bp, Rattus norvegicus
aggcagctcgctcatgagtcatgga

SEQ ID NO: 552990 - DNA, 25 bp, Rattus norvegicus
ttccaagtgcgggttccaggattgt

SEQ ID NO: 552991 - DNA, 25 bp, Rattus norvegicus
gcccgacagtgcatccttccaagtg

SEQ ID NO: 552992 - DNA, 25 bp, Rattus norvegicus
gccgcactggaagcccgaacaagtt

SEQ ID NO: 552993 - DNA, 25 bp, Rattus norvegicus
tcgcagtggaccaggacgacatcct

SEQ ID NO: 552994 - DNA, 25 bp, Rattus norvegicus
ttgcccgcagtgctcatggagcatg

SEQ ID NO: 552995 - DNA, 25 bp, Rattus norvegicus
tgctctgcgccttatccgggagctg

SEQ ID NO: 552996 - DNA, 25 bp, Rattus norvegicus
tcctttcttctttcaggccagaaca

SEQ ID NO: 552997 - DNA, 25 bp, Rattus norvegicus
ggccagaacactgaaaccttaccta

SEQ ID NO: 552998 - DNA, 25 bp, Rattus norvegicus
gttccttccatttgtcacacctgga

SEQ ID NO: 552999 - DNA, 25 bp, Rattus norvegicus
cactgaaaccttacctaggacctgt

SEQ ID NO: 553000 - DNA, 25 bp, Rattus norvegicus
agcaatggccgctggcctctgaagg

SEQ ID NO: 553001 - DNA, 25 bp, Rattus norvegicus
gatattggggctgcctgctctccct

SEQ ID NO: 553002 - DNA, 25 bp, Rattus norvegicus
tccctgcggtgtcccgggcctatgg

SEQ ID NO: 553003 - DNA, 25 bp, Rattus norvegicus
cccatgtcagctgttccttccattt

SEQ ID NO: 553004 - DNA, 25 bp, Rattus norvegicus
tgtcagctgttccttccatttgtca

SEQ ID NO: 553005 - DNA, 25 bp, Rattus norvegicus
aggagcaacgtagagggagaaacta

SEQ ID NO: 553006 - DNA, 25 bp, Rattus norvegicus
tagagggagaaactaatgctcctcc

SEQ ID NO: 553007 - DNA, 25 bp, Rattus norvegicus
tggcggggactccagacccaaacac

SEQ ID NO: 553008 - DNA, 25 bp, Rattus norvegicus
acggacagtttaccgggcttgctgc

SEQ ID NO: 553009 - DNA, 25 bp, Rattus norvegicus
cctctgaagggccaccgggatattg

SEQ ID NO: 553010 - DNA, 25 bp, Rattus norvegicus
ctgccctccaaagggacgcgagatc

SEQ ID NO: 553011 - DNA, 25 bp, Rattus norvegicus
tccgacactccaccgtgggacgtag

SEQ ID NO: 553012 - DNA, 25 bp, Rattus norvegicus
cagccctgtgctcaatttatttcta

SEQ ID NO: 553013 - DNA, 25 bp, Rattus norvegicus
tgggaaaacaatggcgaaccgctgg

SEQ ID NO: 553014 - DNA, 25 bp, Rattus norvegicus
tgagtgtgtgtttacgtaccgaacg

SEQ ID NO: 553015 - DNA, 25 bp, Rattus norvegicus
accctagagctcctggggaatctga

SEQ ID NO: 553016 - DNA, 25 bp, Rattus norvegicus
tgctccggctcctgttcagtgcgtc

SEQ ID NO: 553017 - DNA, 25 bp, Rattus norvegicus
agtacttaaactgggcgcgatggtc

SEQ ID NO: 553018 - DNA, 25 bp, Rattus norvegicus
cagcaacggctgaaaaacgggaggc

SEQ ID NO: 553019 - DNA, 25 bp, Rattus norvegicus
tgcccaagatggaaagtcgcgcgga

SEQ ID NO: 553020 - DNA, 25 bp, Rattus norvegicus
aacagagccagcgtgtcccttggaa

SEQ ID NO: 553021 - DNA, 25 bp, Rattus norvegicus
cgcgcgtgtcaaacttcgcgaggtt

SEQ ID NO: 553022 - DNA, 25 bp, Rattus norvegicus
gcacttactaatcggtcgggcgctg

SEQ ID NO: 553023 - DNA, 25 bp, Rattus norvegicus
gctcgcacgcggatacctaagctgg

SEQ ID NO: 553024 - DNA, 25 bp, Rattus norvegicus
ccagtggctaggaaacgcctctcta

SEQ ID NO: 553025 - DNA, 25 bp, Rattus norvegicus
agcggcccgtaccaggttgccctgt

SEQ ID NO: 553026 - DNA, 25 bp, Rattus norvegicus
caaagcccagagttcacgccgcgga

SEQ ID NO: 553027 - DNA, 25 bp, Rattus norvegicus
atgggctgcaccatcaccttctgca

SEQ ID NO: 553028 - DNA, 25 bp, Rattus norvegicus
gcggtacgccatggtggaagtcaca

SEQ ID NO: 553029 - DNA, 25 bp, Rattus norvegicus
ccacacgaataggaagaccgcctca

SEQ ID NO: 553030 - DNA, 25 bp, Rattus norvegicus
aaccgaggtctgtcctacagcgcca

SEQ ID NO: 553031 - DNA, 25 bp, Rattus norvegicus
agtccaccgctctttgaaaccgagg

SEQ ID NO: 553032 - DNA, 25 bp, Rattus norvegicus
tctctatgcttatagcctccgccgg

SEQ ID NO: 553033 - DNA, 25 bp, Rattus norvegicus
cggagccgctttttctctatgctta

SEQ ID NO: 553034 - DNA, 25 bp, Rattus norvegicus
tctctagccacggagccgctttttc

SEQ ID NO: 553035 - DNA, 25 bp, Rattus norvegicus
cctcagcaagcgacttccggaagca

SEQ ID NO: 553036 - DNA, 25 bp, Rattus norvegicus
cttccggaagcaagacctggaaacg

SEQ ID NO: 553037 - DNA, 25 bp, Rattus norvegicus
cctggaaacggaagtgcctgtagtc

SEQ ID NO: 553038 - DNA, 25 bp, Rattus norvegicus
tgggaagctcatcccgattcacctc

SEQ ID NO: 553039 - DNA, 25 bp, Rattus norvegicus
tccttctcagtggagctgcagcgct

SEQ ID NO: 553040 - DNA, 25 bp, Rattus norvegicus
ttcgcgcgctagattcctgacgttc

SEQ ID NO: 553041 - DNA, 25 bp, Rattus norvegicus
gacgttcacgttgcagggaccaatg

SEQ ID NO: 553042 - DNA, 25 bp, Rattus norvegicus
cccagctcgttgtgtaggtagaaaa

SEQ ID NO: 553043 - DNA, 25 bp, Rattus norvegicus
ccactgtcggagctcagtgcattca

SEQ ID NO: 553044 - DNA, 25 bp, Rattus norvegicus
gcgagctagcccagtccagaagacg

SEQ ID NO: 553045 - DNA, 25 bp, Rattus norvegicus
tgtgtgtagatgttgcccagctcgt

SEQ ID NO: 553046 - DNA, 25 bp, Rattus norvegicus
cttattgaactgcaggtgtggcggc

SEQ ID NO: 553047 - DNA, 25 bp, Rattus norvegicus
cggtagccggtcaatacgaacttat

SEQ ID NO: 553048 - DNA, 25 bp, Rattus norvegicus
gccgcgagtgcaagaagcatgaatc

SEQ ID NO: 553049 - DNA, 25 bp, Rattus norvegicus
gcggctcacctaccgtgtgtgtaga

SEQ ID NO: 553050 - DNA, 25 bp, Rattus norvegicus
gtgcattcagctccaccgtggcaaa

SEQ ID NO: 553051 - DNA, 25 bp, Rattus norvegicus
ctgctcctggatttccttctcagtg

SEQ ID NO: 553052 - DNA, 25 bp, Rattus norvegicus
gggcagccggtgcaaaccaatggca

SEQ ID NO: 553053 - DNA, 25 bp, Rattus norvegicus
attccaggacacagcgcaggggcta

SEQ ID NO: 553054 - DNA, 25 bp, Rattus norvegicus
gcgaaaaggggacgaactctgagcc

SEQ ID NO: 553055 - DNA, 25 bp, Rattus norvegicus
gccttagaataaagcgacgcgcatt

SEQ ID NO: 553056 - DNA, 25 bp, Rattus norvegicus
catttccacggggactggctccaag

SEQ ID NO: 553057 - DNA, 25 bp, Rattus norvegicus
agcccagtagggattccaggacaca

SEQ ID NO: 553058 - DNA, 25 bp, Rattus norvegicus
gggacacgtttgctgcgaaaatctc

SEQ ID NO: 553059 - DNA, 25 bp, Rattus norvegicus
gaaaatctcctacacaccagctggg

SEQ ID NO: 553060 - DNA, 25 bp, Rattus norvegicus
accagctgggtttttattcattctc

SEQ ID NO: 553061 - DNA, 25 bp, Rattus norvegicus
agaagctactccctacccgattagt

SEQ ID NO: 553062 - DNA, 25 bp, Rattus norvegicus
gactccgccgaactaattctccagg

SEQ ID NO: 553063 - DNA, 25 bp, Rattus norvegicus
gtttccgtagtccttaggatcagca

SEQ ID NO: 553064 - DNA, 25 bp, Rattus norvegicus
tgcagccgcagtccaagaaggagcc

SEQ ID NO: 553065 - DNA, 25 bp, Rattus norvegicus
gattcgttttctagcgctgaggccc

SEQ ID NO: 553066 - DNA, 25 bp, Rattus norvegicus
cagcgtcaaagatggcgcccggcta

SEQ ID NO: 553067 - DNA, 25 bp, Rattus norvegicus
gatgacaatgtctccgactcccgcg

SEQ ID NO: 553068 - DNA, 25 bp, Rattus norvegicus
cgtgctgccacgtctatctcttttc

SEQ ID NO: 553069 - DNA, 25 bp, Rattus norvegicus
ctcttttcttagctgcggtcgcccg

SEQ ID NO: 553070 - DNA, 25 bp, Rattus norvegicus
cccaagactgccagcgtcaaagatg

SEQ ID NO: 553071 - DNA, 25 bp, Rattus norvegicus
cccggctacaggctcggctttaagg

SEQ ID NO: 553072 - DNA, 25 bp, Rattus norvegicus
tcggctttaaggctgggccagtaaa

SEQ ID NO: 553073 - DNA, 25 bp, Rattus norvegicus
tgggccagtaaaagtgccagcacga

SEQ ID NO: 553074 - DNA, 25 bp, Rattus norvegicus
gacgcaaagcgcaggcattctggga

SEQ ID NO: 553075 - DNA, 25 bp, Rattus norvegicus
ctgggaggtgtagtttcctctatga

SEQ ID NO: 553076 - DNA, 25 bp, Rattus norvegicus
cctctatgaggcgagccttaagatg

SEQ ID NO: 553077 - DNA, 25 bp, Rattus norvegicus
ccttaagatggcttcttgggtcata

SEQ ID NO: 553078 - DNA, 25 bp, Rattus norvegicus
tcatagggtcacgtgtcacggaggc

SEQ ID NO: 553079 - DNA, 25 bp, Rattus norvegicus
gtcctcacagcagccgaacaagcag

SEQ ID NO: 553080 - DNA, 25 bp, Rattus norvegicus
ctgtgcacccggagtctggacagga

SEQ ID NO: 553081 - DNA, 25 bp, Rattus norvegicus
agctcggaagagacgtggagccacc

SEQ ID NO: 553082 - DNA, 25 bp, Rattus norvegicus
ggaactagaagctgacccggccacg

SEQ ID NO: 553083 - DNA, 25 bp, Rattus norvegicus
cctcctcttcgtccgaggaactaga

SEQ ID NO: 553084 - DNA, 25 bp, Rattus norvegicus
ccagcgccgagagcgtgtcagaccg

SEQ ID NO: 553085 - DNA, 25 bp, Rattus norvegicus
gacgcgctgtgcacctcgggtcaac

SEQ ID NO: 553086 - DNA, 25 bp, Rattus norvegicus
agacgctgctccagaagcaccggca

SEQ ID NO: 553087 - DNA, 25 bp, Rattus norvegicus
gtgctctgcacgctggacaccacag

SEQ ID NO: 553088 - DNA, 25 bp, Rattus norvegicus
gtgcacgtctttgaccgccacatgg

SEQ ID NO: 553089 - DNA, 25 bp, Rattus norvegicus
ctccagcggggctgtgtgcacgtct

SEQ ID NO: 553090 - DNA, 25 bp, Rattus norvegicus
agctgcttcagctgcagccgtcgga

SEQ ID NO: 553091 - DNA, 25 bp, Rattus norvegicus
agtctggacaggaagacgctgctcc

SEQ ID NO: 553092 - DNA, 25 bp, Rattus norvegicus
gctgaagaggaatctgtcggccgcc

SEQ ID NO: 553093 - DNA, 25 bp, Rattus norvegicus
tccgacaccgagagcttcagcctga

SEQ ID NO: 553094 - DNA, 25 bp, Rattus norvegicus
ctgagtagaggaagcgcgctacacc

SEQ ID NO: 553095 - DNA, 25 bp, Rattus norvegicus
tggagcgccctactgaaaaccttga

SEQ ID NO: 553096 - DNA, 25 bp, Rattus norvegicus
acaacgtgtgctcaccggtcagtgc

SEQ ID NO: 553097 - DNA, 25 bp, Rattus norvegicus
atcgctcactgacgtcattattggg

SEQ ID NO: 553098 - DNA, 25 bp, Rattus norvegicus
ttgagtctctgctcgctcacgcagc

SEQ ID NO: 553099 - DNA, 25 bp, Rattus norvegicus
gagggacagaggaccatcaacggcc

SEQ ID NO: 553100 - DNA, 25 bp, Rattus norvegicus
tcaacggcctcggagattaattaga

SEQ ID NO: 553101 - DNA, 25 bp, Rattus norvegicus
cccgtcccagaaacagtgaggaaag

SEQ ID NO: 553102 - DNA, 25 bp, Rattus norvegicus
cacccattggccgaagctggcggat

SEQ ID NO: 553103 - DNA, 25 bp, Rattus norvegicus
tctccgggagcatgtcggttctctt

SEQ ID NO: 553104 - DNA, 25 bp, Rattus norvegicus
cttcccgtggctcataccggtggtt

SEQ ID NO: 553105 - DNA, 25 bp, Rattus norvegicus
taattagagcaagacacccgagccc

SEQ ID NO: 553106 - DNA, 25 bp, Rattus norvegicus
ctgtattagcaggacgatgatggtc

SEQ ID NO: 553107 - DNA, 25 bp, Rattus norvegicus
attattgggaaccagcaccggactc

SEQ ID NO: 553108 - DNA, 25 bp, Rattus norvegicus
agcgggtctgcacccaaataagggc

SEQ ID NO: 553109 - DNA, 25 bp, Rattus norvegicus
agcgtcccttctcaagacgtggctg

SEQ ID NO: 553110 - DNA, 25 bp, Rattus norvegicus
ttgcgtgacgcgcggcgccacgtca

SEQ ID NO: 553111 - DNA, 25 bp, Rattus norvegicus
gggtctgcacccaaataagggcagc

SEQ ID NO: 553112 - DNA, 25 bp, Rattus norvegicus
tctgcacccaaataagggcagcgct

SEQ ID NO: 553113 - DNA, 25 bp, Rattus norvegicus
gcagcgggtctgcacccaaataagg

SEQ ID NO: 553114 - DNA, 25 bp, Rattus norvegicus
taagggcagcgcttccccgaggatt

SEQ ID NO: 553115 - DNA, 25 bp, Rattus norvegicus
ccgcagcgggtctgcacccaaataa

SEQ ID NO: 553116 - DNA, 25 bp, Rattus norvegicus
cttccccgaggattgcgtgacgcgc

SEQ ID NO: 553117 - DNA, 25 bp, Rattus norvegicus
ggcggccagggctacgcagcttccc

SEQ ID NO: 553118 - DNA, 25 bp, Rattus norvegicus
caagacgtggctggctgcgcgccct

SEQ ID NO: 553119 - DNA, 25 bp, Rattus norvegicus
cttctcaagacgtggctggctgcgc

SEQ ID NO: 553120 - DNA, 25 bp, Rattus norvegicus
tcccttctcaagacgtggctggctg

SEQ ID NO: 553121 - DNA, 25 bp, Rattus norvegicus
cagagaccgcggtgacgcggccgga

SEQ ID NO: 553122 - DNA, 25 bp, Rattus norvegicus
acatggtgtggcagaggctcagccc

SEQ ID NO: 553123 - DNA, 25 bp, Rattus norvegicus
gcctttcaagcaatcacatggtgtg

SEQ ID NO: 553124 - DNA, 25 bp, Rattus norvegicus
agggactaagcccaggacctgccgg

SEQ ID NO: 553125 - DNA, 25 bp, Rattus norvegicus
cctgtttcatacctgggactggatg

SEQ ID NO: 553126 - DNA, 25 bp, Rattus norvegicus
caggcgtgattctgagggactaagc

SEQ ID NO: 553127 - DNA, 25 bp, Rattus norvegicus
gctcagccccggacgcgtttaaaga

SEQ ID NO: 553128 - DNA, 25 bp, Rattus norvegicus
caatcacatggtgtggcagaggctc

SEQ ID NO: 553129 - DNA, 25 bp, Rattus norvegicus
tgtgcccacccacctgggacgccgc

SEQ ID NO: 553130 - DNA, 25 bp, Rattus norvegicus
gcatcggctcatcgttctccaggct

SEQ ID NO: 553131 - DNA, 25 bp, Rattus norvegicus
gcccggcctttcaagcaatcacatg

SEQ ID NO: 553132 - DNA, 25 bp, Rattus norvegicus
tgcgcgcacgcctaccctgtgccca

SEQ ID NO: 553133 - DNA, 25 bp, Rattus norvegicus
ctgccgggtccacgggctcccattc

SEQ ID NO: 553134 - DNA, 25 bp, Rattus norvegicus
gactaagcccaggacctgccgggtc

SEQ ID NO: 553135 - DNA, 25 bp, Rattus norvegicus
cgcgtttaaagaggtagtgcccctg

SEQ ID NO: 553136 - DNA, 25 bp, Rattus norvegicus
gtttcctccaggagggtgctcgacg

SEQ ID NO: 553137 - DNA, 25 bp, Rattus norvegicus
tgcccaacatgccaccgctatggtg

SEQ ID NO: 553138 - DNA, 25 bp, Rattus norvegicus
cagggtggacacacggaagcccgca

SEQ ID NO: 553139 - DNA, 25 bp, Rattus norvegicus
gggtctccgctgaggtgcccaacat

SEQ ID NO: 553140 - DNA, 25 bp, Rattus norvegicus
tgccaccgctatggtgatcccgagg

SEQ ID NO: 553141 - DNA, 25 bp, Rattus norvegicus
aggccgaaagcgtttcctccaggag

SEQ ID NO: 553142 - DNA, 25 bp, Rattus norvegicus
catgcggccaagcacgaagcgaagc

SEQ ID NO: 553143 - DNA, 25 bp, Rattus norvegicus
tgcagcggacccagggtggacacac

SEQ ID NO: 553144 - DNA, 25 bp, Rattus norvegicus
ggcactcaccttccggcatgatctt

SEQ ID NO: 553145 - DNA, 25 bp, Rattus norvegicus
ggaggaacccatttccagcctggca

SEQ ID NO: 553146 - DNA, 25 bp, Rattus norvegicus
accgcagcgttagtgcagctcagcc

SEQ ID NO: 553147 - DNA, 25 bp, Rattus norvegicus
agaacacacagagcgcgggttagtg

SEQ ID NO: 553148 - DNA, 25 bp, Rattus norvegicus
gaccgtggagggctccagtctctgc

SEQ ID NO: 553149 - DNA, 25 bp, Rattus norvegicus
tggtgatcccgaggccgaaagcgtt

SEQ ID NO: 553150 - DNA, 25 bp, Rattus norvegicus
ccagccctggttcacacgtgacaag

SEQ ID NO: 553151 - DNA, 25 bp, Rattus norvegicus
ccgcaaaggtagctgcagcctccac

SEQ ID NO: 553152 - DNA, 25 bp, Rattus norvegicus
gcagtgcgaagcgtcctagaggcaa

SEQ ID NO: 553153 - DNA, 25 bp, Rattus norvegicus
gtgcgaagcgtcctagaggcaagcc

SEQ ID NO: 553154 - DNA, 25 bp, Rattus norvegicus
gaagcgtcctagaggcaagcccgca

SEQ ID NO: 553155 - DNA, 25 bp, Rattus norvegicus
gcgtcctagaggcaagcccgcaaag

SEQ ID NO: 553156 - DNA, 25 bp, Rattus norvegicus
tcctagaggcaagcccgcaaaggta

SEQ ID NO: 553157 - DNA, 25 bp, Rattus norvegicus
aggcaagcccgcaaaggtagctgca

SEQ ID NO: 553158 - DNA, 25 bp, Rattus norvegicus
caagcccgcaaaggtagctgcagcc

SEQ ID NO: 553159 - DNA, 25 bp, Rattus norvegicus
cctcggcagtgcgaagcgtcctaga

SEQ ID NO: 553160 - DNA, 25 bp, Rattus norvegicus
agcccgcaaaggtagctgcagcctc

SEQ ID NO: 553161 - DNA, 25 bp, Rattus norvegicus
cgacctcggcagtgcgaagcgtcct

SEQ ID NO: 553162 - DNA, 25 bp, Rattus norvegicus
caccgcccagtaccgtggcccgaag

SEQ ID NO: 553163 - DNA, 25 bp, Rattus norvegicus
ccctggttcacacgtgacaagggcg

SEQ ID NO: 553164 - DNA, 25 bp, Rattus norvegicus
gcaaagtctccgcagccgagtctcg

SEQ ID NO: 553165 - DNA, 25 bp, Rattus norvegicus
gagtctcgccaagctggaccctgct

SEQ ID NO: 553166 - DNA, 25 bp, Rattus norvegicus
ctgaaacagagcaaagagccaaggc

SEQ ID NO: 553167 - DNA, 25 bp, Rattus norvegicus
aggctgcggctatcgcgaggactca

SEQ ID NO: 553168 - DNA, 25 bp, Rattus norvegicus
gactcaggcgaggactctgggtccc

SEQ ID NO: 553169 - DNA, 25 bp, Rattus norvegicus
ggcatagtccgccacagtcactgaa

SEQ ID NO: 553170 - DNA, 25 bp, Rattus norvegicus
tgtagcggaggccaagttcctaaag

SEQ ID NO: 553171 - DNA, 25 bp, Rattus norvegicus
ttggccacggctttcttgacccgtc

SEQ ID NO: 553172 - DNA, 25 bp, Rattus norvegicus
ttcctaaagggtagcgggctgcaca

SEQ ID NO: 553173 - DNA, 25 bp, Rattus norvegicus
acagggtgtgtgttatcgccttctc

SEQ ID NO: 553174 - DNA, 25 bp, Rattus norvegicus
cttctcgtaggcgtttggtgtgtca

SEQ ID NO: 553175 - DNA, 25 bp, Rattus norvegicus
tggtgtgtcagacccagccctccaa

SEQ ID NO: 553176 - DNA, 25 bp, Rattus norvegicus
agccaaggcctcctcagactcgggg

SEQ ID NO: 553177 - DNA, 25 bp, Rattus norvegicus
accgccggatccgagttggcatagt

SEQ ID NO: 553178 - DNA, 25 bp, Rattus norvegicus
aggtcaaacgtgacggctctccctc

SEQ ID NO: 553179 - DNA, 25 bp, Rattus norvegicus
cagaggcagccagccaggccgtaag

SEQ ID NO: 553180 - DNA, 25 bp, Rattus norvegicus
agcgcgcccggatgattggcacgct

SEQ ID NO: 553181 - DNA, 25 bp, Rattus norvegicus
gcgacccccagagttgagcttgcga

SEQ ID NO: 553182 - DNA, 25 bp, Rattus norvegicus
ccgcgatccgcaggtcaaacgtgac

SEQ ID NO: 553183 - DNA, 25 bp, Rattus norvegicus
ccggatgattggcacgctcaggaat

SEQ ID NO: 553184 - DNA, 25 bp, Rattus norvegicus
cgagtactgtctcggcagctgtgcg

SEQ ID NO: 553185 - DNA, 25 bp, Rattus norvegicus
acgctcaggaatgcctagatcggag

SEQ ID NO: 553186 - DNA, 25 bp, Rattus norvegicus
ctctccctcctggatagggtcggcg

SEQ ID NO: 553187 - DNA, 25 bp, Rattus norvegicus
agcttgcgagttgggtacgggaaca

SEQ ID NO: 553188 - DNA, 25 bp, Rattus norvegicus
ccagccaggccgtaagtgtcccggg

SEQ ID NO: 553189 - DNA, 25 bp, Rattus norvegicus
ccggcagtccgcgagtactgtctcg

SEQ ID NO: 553190 - DNA, 25 bp, Rattus norvegicus
cctccagagccgcgggatgtagcgc

SEQ ID NO: 553191 - DNA, 25 bp, Rattus norvegicus
tggcacgctcaggaatgcctagatc

SEQ ID NO: 553192 - DNA, 25 bp, Rattus norvegicus
cggagcctagagtttaccacggaga

SEQ ID NO: 553193 - DNA, 25 bp, Rattus norvegicus
ggcgcggccctgacacgcgcccttt

SEQ ID NO: 553194 - DNA, 25 bp, Rattus norvegicus
cgcctagctcggagcctagagttta

SEQ ID NO: 553195 - DNA, 25 bp, Rattus norvegicus
tagagtttaccacggagactgctcc

SEQ ID NO: 553196 - DNA, 25 bp, Rattus norvegicus
tcccttctgccctcagccggggacg

SEQ ID NO: 553197 - DNA, 25 bp, Rattus norvegicus
agctcggagcctagagtttaccacg

SEQ ID NO: 553198 - DNA, 25 bp, Rattus norvegicus
ccacccacagagtgacgtcatcacg

SEQ ID NO: 553199 - DNA, 25 bp, Rattus norvegicus
taccacggagactgctccgcggcgg

SEQ ID NO: 553200 - DNA, 25 bp, Rattus norvegicus
tgacacgcgccctttcccttctgcc

SEQ ID NO: 553201 - DNA, 25 bp, Rattus norvegicus
gcggtcgcctagctcggagcctaga

SEQ ID NO: 553202 - DNA, 25 bp, Rattus norvegicus
ggctctgcctcctaacgtgacgtaa

SEQ ID NO: 553203 - DNA, 25 bp, Rattus norvegicus
ctaacgtgacgtaacccaggagaga

SEQ ID NO: 553204 - DNA, 25 bp, Rattus norvegicus
gtgacgtaacccaggagagacccgc

SEQ ID NO: 553205 - DNA, 25 bp, Rattus norvegicus
gcctagagtttaccacggagactgc

SEQ ID NO: 553206 - DNA, 25 bp, Rattus norvegicus
gtttcatttccctgcgcaacgccga

SEQ ID NO: 553207 - DNA, 25 bp, Rattus norvegicus
gcttccagcagtctttcccgggcta

SEQ ID NO: 553208 - DNA, 25 bp, Rattus norvegicus
gcccgagagcagtcatcaaaccaag

SEQ ID NO: 553209 - DNA, 25 bp, Rattus norvegicus
cggaagcctcttttctgcattttgc

SEQ ID NO: 553210 - DNA, 25 bp, Rattus norvegicus
gcattttgcattcacctcgttaaga

SEQ ID NO: 553211 - DNA, 25 bp, Rattus norvegicus
gctttctgcagggaccgaacgactg

SEQ ID NO: 553212 - DNA, 25 bp, Rattus norvegicus
tgcaggggatgcatgcgctttaaca

SEQ ID NO: 553213 - DNA, 25 bp, Rattus norvegicus
agtgcctctggtatcctgctaacgc

SEQ ID NO: 553214 - DNA, 25 bp, Rattus norvegicus
gcgagtccgggctctttagcttcaa

SEQ ID NO: 553215 - DNA, 25 bp, Rattus norvegicus
cggaaagtacttcccgtcgccgctg

SEQ ID NO: 553216 - DNA, 25 bp, Rattus norvegicus
ccgcgcatttccagcccggaaagta

SEQ ID NO: 553217 - DNA, 25 bp, Rattus norvegicus
tgccgatggcttcgcacacaggtca

SEQ ID NO: 553218 - DNA, 25 bp, Rattus norvegicus
tggtagcgctgacccaatctctgga

SEQ ID NO: 553219 - DNA, 25 bp, Rattus norvegicus
tttagcttcaagaccagagaccctg

SEQ ID NO: 553220 - DNA, 25 bp, Rattus norvegicus
gcgctgatcggatctccaggagatg

SEQ ID NO: 553221 - DNA, 25 bp, Rattus norvegicus
cggccgaagccggatccctagcaag

SEQ ID NO: 553222 - DNA, 25 bp, Rattus norvegicus
tcgtctatctagtccggagagctgc

SEQ ID NO: 553223 - DNA, 25 bp, Rattus norvegicus
ccgcagtcaggctcgtctatctagt

SEQ ID NO: 553224 - DNA, 25 bp, Rattus norvegicus
acgaggactcaatcgcgggctgacc

SEQ ID NO: 553225 - DNA, 25 bp, Rattus norvegicus
gcgggattcaaacgcgtactggata

SEQ ID NO: 553226 - DNA, 25 bp, Rattus norvegicus
ggaactcgaatttcaagcactcaga

SEQ ID NO: 553227 - DNA, 25 bp, Rattus norvegicus
agcactcagaaaatccgcggcttgc

SEQ ID NO: 553228 - DNA, 25 bp, Rattus norvegicus
cgcggcttgcaagggatgcttacac

SEQ ID NO: 553229 - DNA, 25 bp, Rattus norvegicus
tgcttacaccaaccgagaacagggg

SEQ ID NO: 553230 - DNA, 25 bp, Rattus norvegicus
aataacggggctcacctcaggcgaa

SEQ ID NO: 553231 - DNA, 25 bp, Rattus norvegicus
cgtactggatagaggagcgctgatc

SEQ ID NO: 553232 - DNA, 25 bp, Rattus norvegicus
cacgccgttgtcctcgtaggatcca

SEQ ID NO: 553233 - DNA, 25 bp, Rattus norvegicus
ggaagctcctctgtgtgcgtacgaa

SEQ ID NO: 553234 - DNA, 25 bp, Rattus norvegicus
cccgttcctatctgggctgatgggg

SEQ ID NO: 553235 - DNA, 25 bp, Rattus norvegicus
gagtctccggactcggcgaactgct

SEQ ID NO: 553236 - DNA, 25 bp, Rattus norvegicus
ttcgggttctttagaggtgctcttg

SEQ ID NO: 553237 - DNA, 25 bp, Rattus norvegicus
cccggcgtttagatgcgaaatttga

SEQ ID NO: 553238 - DNA, 25 bp, Rattus norvegicus
gctctcgggcaggacggaacacaaa

SEQ ID NO: 553239 - DNA, 25 bp, Rattus norvegicus
cacccgcgagggaaactcggcagga

SEQ ID NO: 553240 - DNA, 25 bp, Rattus norvegicus
tgcccttcctggctccgtttggagc

SEQ ID NO: 553241 - DNA, 25 bp, Rattus norvegicus
tccaccggaggacaaaggcgtctca

SEQ ID NO: 553242 - DNA, 25 bp, Rattus norvegicus
cccttgtttgcgtagaaagtctagc

SEQ ID NO: 553243 - DNA, 25 bp, Rattus norvegicus
tctagcaggcttgtgagaaaggcac

SEQ ID NO: 553244 - DNA, 25 bp, Rattus norvegicus
cctactttgaaatgtcttactgggg

SEQ ID NO: 553245 - DNA, 25 bp, Rattus norvegicus
gagaccgtcgcgaagccttgtatcg

SEQ ID NO: 553246 - DNA, 25 bp, Rattus norvegicus
ctccagtttggccagaagcacagcg

SEQ ID NO: 553247 - DNA, 25 bp, Rattus norvegicus
aggtgctcttgtcggctactctccg

SEQ ID NO: 553248 - DNA, 25 bp, Rattus norvegicus
tcgccggcaggtaataaagtgcttg

SEQ ID NO: 553249 - DNA, 25 bp, Rattus norvegicus
aggcgcctgcgcaatttagtccaga

SEQ ID NO: 553250 - DNA, 25 bp, Rattus norvegicus
tccggcaataagcaaaggcgcctgc

SEQ ID NO: 553251 - DNA, 25 bp, Rattus norvegicus
atttagtccagacgcctgcgcagtg

SEQ ID NO: 553252 - DNA, 25 bp, Rattus norvegicus
cgccagcgtagttccggacgagcca

SEQ ID NO: 553253 - DNA, 25 bp, Rattus norvegicus
ctctcaggtttctggagaccgcgcc

SEQ ID NO: 553254 - DNA, 25 bp, Rattus norvegicus
ctgacactttggtccggcaataagc

SEQ ID NO: 553255 - DNA, 25 bp, Rattus norvegicus
aacgagctagtgtcagccgaaggcc

SEQ ID NO: 553256 - DNA, 25 bp, Rattus norvegicus
tgctcttttctctcgccggcaggta

SEQ ID NO: 553257 - DNA, 25 bp, Rattus norvegicus
gcttggtgctgcttaagagtcgcgc

SEQ ID NO: 553258 - DNA, 25 bp, Rattus norvegicus
tccttcagagggtgcacctgtccta

SEQ ID NO: 553259 - DNA, 25 bp, Rattus norvegicus
agtcgcgctgcccagagcaaccgag

SEQ ID NO: 553260 - DNA, 25 bp, Rattus norvegicus
tctctctcgcggagtcgtccttcag

SEQ ID NO: 553261 - DNA, 25 bp, Rattus norvegicus
tggaaccctgcgagctgcagaacga

SEQ ID NO: 553262 - DNA, 25 bp, Rattus norvegicus
cgtcacctagcgagcgcggtaatta

SEQ ID NO: 553263 - DNA, 25 bp, Rattus norvegicus
gcgacatggtatgcggccacccaat

SEQ ID NO: 553264 - DNA, 25 bp, Rattus norvegicus
tatgcggccacccaatagcagactg

SEQ ID NO: 553265 - DNA, 25 bp, Rattus norvegicus
ggccacccaatagcagactgaagga

SEQ ID NO: 553266 - DNA, 25 bp, Rattus norvegicus
tacagacccggtccagcgccacgct

SEQ ID NO: 553267 - DNA, 25 bp, Rattus norvegicus
cgagctacgctgaaaggagggtttc

SEQ ID NO: 553268 - DNA, 25 bp, Rattus norvegicus
tagcgagcgcggtaattatgttgtc

SEQ ID NO: 553269 - DNA, 25 bp, Rattus norvegicus
cttgcctaatgagagtccttctggt

SEQ ID NO: 553270 - DNA, 25 bp, Rattus norvegicus
caatagcagactgaaggacggccgg

SEQ ID NO: 553271 - DNA, 25 bp, Rattus norvegicus
accgcttgcctaatgagagtccttc

SEQ ID NO: 553272 - DNA, 25 bp, Rattus norvegicus
ggctgtcaccgcttgcctaatgaga

SEQ ID NO: 553273 - DNA, 25 bp, Rattus norvegicus
tccgggctgtcaccgcttgcctaat

SEQ ID NO: 553274 - DNA, 25 bp, Rattus norvegicus
aattatgttgtctgcgggtgcgagc

SEQ ID NO: 553275 - DNA, 25 bp, Rattus norvegicus
agtccttctggtggcaccgcgcgtc

SEQ ID NO: 553276 - DNA, 25 bp, Rattus norvegicus
ctaaagctaaccgagagatgacgca

SEQ ID NO: 553277 - DNA, 25 bp, Rattus norvegicus
ccctaaagctaaccgagagatgacg

SEQ ID NO: 553278 - DNA, 25 bp, Rattus norvegicus
agctaaccgagagatgacgcagata

SEQ ID NO: 553279 - DNA, 25 bp, Rattus norvegicus
gctaaccgagagatgacgcagataa

SEQ ID NO: 553280 - DNA, 25 bp, Rattus norvegicus
ggctttactggggacgacaccctca

SEQ ID NO: 553281 - DNA, 25 bp, Rattus norvegicus
ctttactggggacgacaccctcagg

SEQ ID NO: 553282 - DNA, 25 bp, Rattus norvegicus
gatctggcaccgcacctacaacgag

SEQ ID NO: 553283 - DNA, 25 bp, Rattus norvegicus
gaagatctggcaccgcacctacaac

SEQ ID NO: 553284 - DNA, 25 bp, Rattus norvegicus
ctcctccgccgatcacaatggaaga

SEQ ID NO: 553285 - DNA, 25 bp, Rattus norvegicus
agaagatctggcaccgcacctacaa

SEQ ID NO: 553286 - DNA, 25 bp, Rattus norvegicus
ccggcttacactgcgctcctttctg

SEQ ID NO: 553287 - DNA, 25 bp, Rattus norvegicus
gcttacactgcgctcctttctgctc

SEQ ID NO: 553288 - DNA, 25 bp, Rattus norvegicus
tgctcctccgccgatcacaatggaa

SEQ ID NO: 553289 - DNA, 25 bp, Rattus norvegicus
tggcaccgcacctacaacgagctgc

SEQ ID NO: 553290 - DNA, 25 bp, Rattus norvegicus
ccagacaatgcttatccggaccgga

SEQ ID NO: 553291 - DNA, 25 bp, Rattus norvegicus
gcccagacaatgcttatccggaccg

SEQ ID NO: 553292 - DNA, 25 bp, Rattus norvegicus
ccttgtgagagtgccagcagatcct

SEQ ID NO: 553293 - DNA, 25 bp, Rattus norvegicus
accagagtctaagggcatccgggaa

SEQ ID NO: 553294 - DNA, 25 bp, Rattus norvegicus
cagcccagacaatgcttatccggac

SEQ ID NO: 553295 - DNA, 25 bp, Rattus norvegicus
agccttgtgagagtgccagcagatc

SEQ ID NO: 553296 - DNA, 25 bp, Rattus norvegicus
agacaatgcttatccggaccggact

SEQ ID NO: 553297 - DNA, 25 bp, Rattus norvegicus
ggaccggactccagcccacttctgc

SEQ ID NO: 553298 - DNA, 25 bp, Rattus norvegicus
cagcccacttctgccacctgaaggg

SEQ ID NO: 553299 - DNA, 25 bp, Rattus norvegicus
gcaccgggaggcaccagagtctaag

SEQ ID NO: 553300 - DNA, 25 bp, Rattus norvegicus
ggaggcaccagagtctaagggcatc

SEQ ID NO: 553301 - DNA, 25 bp, Rattus norvegicus
aggcaccagagtctaagggcatccg

SEQ ID NO: 553302 - DNA, 25 bp, Rattus norvegicus
gcaccagagtctaagggcatccggg

SEQ ID NO: 553303 - DNA, 25 bp, Rattus norvegicus
ttgtgagagtgccagcagatcctgg

SEQ ID NO: 553304 - DNA, 25 bp, Rattus norvegicus
tcctactcactcgaccttctcccac

SEQ ID NO: 553305 - DNA, 25 bp, Rattus norvegicus
tgtgctggattgaaactcggggccc

SEQ ID NO: 553306 - DNA, 25 bp, Rattus norvegicus
ggcttcggtgtgctggattgaaact

SEQ ID NO: 553307 - DNA, 25 bp, Rattus norvegicus
gcttcggtgtgctggattgaaactc

SEQ ID NO: 553308 - DNA, 25 bp, Rattus norvegicus
cttcggtgtgctggattgaaactcg

SEQ ID NO: 553309 - DNA, 25 bp, Rattus norvegicus
gctggattgaaactcggggccccca

SEQ ID NO: 553310 - DNA, 25 bp, Rattus norvegicus
tggattgaaactcggggcccccaga

SEQ ID NO: 553311 - DNA, 25 bp, Rattus norvegicus
caggtcctatctcctactcactcga

SEQ ID NO: 553312 - DNA, 25 bp, Rattus norvegicus
cccagaggtttgctgtggacagaag

SEQ ID NO: 553313 - DNA, 25 bp, Rattus norvegicus
tcaggtcctatctcctactcactcg

SEQ ID NO: 553314 - DNA, 25 bp, Rattus norvegicus
cagaggtttgctgtggacagaaggc

SEQ ID NO: 553315 - DNA, 25 bp, Rattus norvegicus
ggtttgctgtggacagaaggcgctg

SEQ ID NO: 553316 - DNA, 25 bp, Rattus norvegicus
gtgctcaggtcctatctcctactca

SEQ ID NO: 553317 - DNA, 25 bp, Rattus norvegicus
gctcaggtcctatctcctactcact

SEQ ID NO: 553318 - DNA, 25 bp, Rattus norvegicus
aggacgacgacagccacaaacacac

SEQ ID NO: 553319 - DNA, 25 bp, Rattus norvegicus
gggaagaaccacaggcgtccgtctc

SEQ ID NO: 553320 - DNA, 25 bp, Rattus norvegicus
cagggaagaaccacaggcgtccgtc

SEQ ID NO: 553321 - DNA, 25 bp, Rattus norvegicus
cgccagggaagaaccacaggcgtcc

SEQ ID NO: 553322 - DNA, 25 bp, Rattus norvegicus
accacgccagggaagaaccacaggc

SEQ ID NO: 553323 - DNA, 25 bp, Rattus norvegicus
taccacgccagggaagaaccacagg

SEQ ID NO: 553324 - DNA, 25 bp, Rattus norvegicus
tctaccacgccagggaagaaccaca

SEQ ID NO: 553325 - DNA, 25 bp, Rattus norvegicus
cgtctaccacgccagggaagaacca

SEQ ID NO: 553326 - DNA, 25 bp, Rattus norvegicus
ggaagaaccacaggcgtccgtctcc

SEQ ID NO: 553327 - DNA, 25 bp, Rattus norvegicus
acgacgacagccacaaacacacgca

SEQ ID NO: 553328 - DNA, 25 bp, Rattus norvegicus
gaggacgacgacagccacaaacaca

SEQ ID NO: 553329 - DNA, 25 bp, Rattus norvegicus
acgaggacgacgacagccacaaaca

SEQ ID NO: 553330 - DNA, 25 bp, Rattus norvegicus
taacgaggacgacgacagccacaaa

SEQ ID NO: 553331 - DNA, 25 bp, Rattus norvegicus
gcccgtctaccacgccagggaagaa

SEQ ID NO: 553332 - DNA, 25 bp, Rattus norvegicus
agtttcaatccagcacaccgaagcc

SEQ ID NO: 553333 - DNA, 25 bp, Rattus norvegicus
tttcaatccagcacaccgaagccct

SEQ ID NO: 553334 - DNA, 25 bp, Rattus norvegicus
gtttcaatccagcacaccgaagccc

SEQ ID NO: 553335 - DNA, 25 bp, Rattus norvegicus
gtgggagaaggtcgagtgagtagga

SEQ ID NO: 553336 - DNA, 25 bp, Rattus norvegicus
gagtttcaatccagcacaccgaagc

SEQ ID NO: 553337 - DNA, 25 bp, Rattus norvegicus
cgagtttcaatccagcacaccgaag

SEQ ID NO: 553338 - DNA, 25 bp, Rattus norvegicus
gggccccgagtttcaatccagcaca

SEQ ID NO: 553339 - DNA, 25 bp, Rattus norvegicus
actacaacaagctctcctcgctcgc

SEQ ID NO: 553340 - DNA, 25 bp, Rattus norvegicus
ctgtccacagcaaacctctgggggc

SEQ ID NO: 553341 - DNA, 25 bp, Rattus norvegicus
tctgtccacagcaaacctctggggg

SEQ ID NO: 553342 - DNA, 25 bp, Rattus norvegicus
ttctgtccacagcaaacctctgggg

SEQ ID NO: 553343 - DNA, 25 bp, Rattus norvegicus
cttctgtccacagcaaacctctggg

SEQ ID NO: 553344 - DNA, 25 bp, Rattus norvegicus
tgagtaggagataggacctgagcac

SEQ ID NO: 553345 - DNA, 25 bp, Rattus norvegicus
tgtccacagcaaacctctgggggcc

SEQ ID NO: 553346 - DNA, 25 bp, Rattus norvegicus
cggctatcaactcctggaaacagac

SEQ ID NO: 553347 - DNA, 25 bp, Rattus norvegicus
gctcacggctatcaactcctggaaa

SEQ ID NO: 553348 - DNA, 25 bp, Rattus norvegicus
tcacggctatcaactcctggaaaca

SEQ ID NO: 553349 - DNA, 25 bp, Rattus norvegicus
ccaacgccgcacagccggacccaca

SEQ ID NO: 553350 - DNA, 25 bp, Rattus norvegicus
gaccttggcaaaagttgggcacgct

SEQ ID NO: 553351 - DNA, 25 bp, Rattus norvegicus
aggaccttggcaaaagttgggcacg

SEQ ID NO: 553352 - DNA, 25 bp, Rattus norvegicus
catgctcacggctatcaactcctgg

SEQ ID NO: 553353 - DNA, 25 bp, Rattus norvegicus
aaaggtctggcgctttccgatcttc

SEQ ID NO: 553354 - DNA, 25 bp, Rattus norvegicus
ggtgcccactacctgaaaaggtctg

SEQ ID NO: 553355 - DNA, 25 bp, Rattus norvegicus
cggtgcccactacctgaaaaggtct

SEQ ID NO: 553356 - DNA, 25 bp, Rattus norvegicus
ccctggcctctgccgcttccacagc

SEQ ID NO: 553357 - DNA, 25 bp, Rattus norvegicus
aaggccttaggaggctggcgttctc

SEQ ID NO: 553358 - DNA, 25 bp, Rattus norvegicus
gacacacaccctctcggccaccagg

SEQ ID NO: 553359 - DNA, 25 bp, Rattus norvegicus
aggtctggcgctttccgatcttccc

SEQ ID NO: 553360 - DNA, 25 bp, Rattus norvegicus
tctgcactgtataaagtcgttggtc

SEQ ID NO: 553361 - DNA, 25 bp, Rattus norvegicus
aaaggctctttatctgcactgtata

SEQ ID NO: 553362 - DNA, 25 bp, Rattus norvegicus
taaagtcgttggtcacgctgcgctg

SEQ ID NO: 553363 - DNA, 25 bp, Rattus norvegicus
ggctgccgcgcgatgttattatcca

SEQ ID NO: 553364 - DNA, 25 bp, Rattus norvegicus
tgttattatccattacccgcccggc

SEQ ID NO: 553365 - DNA, 25 bp, Rattus norvegicus
ggcgcagtcgttggcacactcccgg

SEQ ID NO: 553366 - DNA, 25 bp, Rattus norvegicus
cgggtataattgtccttctcggcta

SEQ ID NO: 553367 - DNA, 25 bp, Rattus norvegicus
gctacaaattgcctctcccggcagg

SEQ ID NO: 553368 - DNA, 25 bp, Rattus norvegicus
cccggcaggcccatttgcataaatc

SEQ ID NO: 553369 - DNA, 25 bp, Rattus norvegicus
ggcccatttgcataaatcctccgac

SEQ ID NO: 553370 - DNA, 25 bp, Rattus norvegicus
tccgacctcctccaaacaggattgg

SEQ ID NO: 553371 - DNA, 25 bp, Rattus norvegicus
acctcctccaaacaggattggcgcg

SEQ ID NO: 553372 - DNA, 25 bp, Rattus norvegicus
gtccttctcggctacaaattgcctc

SEQ ID NO: 553373 - DNA, 25 bp, Rattus norvegicus
gcggcgttgcgtaaaaggctcttta

SEQ ID NO: 553374 - DNA, 25 bp, Rattus norvegicus
tactcctgaaggtttctcgaccgga

SEQ ID NO: 553375 - DNA, 25 bp, Rattus norvegicus
atcaagatgcccaggccgccttaga

SEQ ID NO: 553376 - DNA, 25 bp, Rattus norvegicus
gcgggtgttcctgaaacagtacttg

SEQ ID NO: 553377 - DNA, 25 bp, Rattus norvegicus
cgccttagtttaaacctggaagatg

SEQ ID NO: 553378 - DNA, 25 bp, Rattus norvegicus
ggtctcagcaatcccgccttagttt

SEQ ID NO: 553379 - DNA, 25 bp, Rattus norvegicus
gttccagggagggaagcatccttcc

SEQ ID NO: 553380 - DNA, 25 bp, Rattus norvegicus
gagtgcgctgcaccttaaagagggc

SEQ ID NO: 553381 - DNA, 25 bp, Rattus norvegicus
ccaaacccatagctactcctgaagg

SEQ ID NO: 553382 - DNA, 25 bp, Rattus norvegicus
agatggcagtgacagtccactaacc

SEQ ID NO: 553383 - DNA, 25 bp, Rattus norvegicus
acatacgctgtcaaagtccggggca

SEQ ID NO: 553384 - DNA, 25 bp, Rattus norvegicus
acttgcgggaaatgacgcgtccctc

SEQ ID NO: 553385 - DNA, 25 bp, Rattus norvegicus
tccggatagactaggtacggcctga

SEQ ID NO: 553386 - DNA, 25 bp, Rattus norvegicus
ccctagaggacttccgagtgcgctg

SEQ ID NO: 553387 - DNA, 25 bp, Rattus norvegicus
gctgcagtcgatcaggtttccggtc

SEQ ID NO: 553388 - DNA, 25 bp, Rattus norvegicus
atgtcccagagaaaccgcaaggtgc

SEQ ID NO: 553389 - DNA, 25 bp, Rattus norvegicus
agactcgagtagattccaaatgtcc

SEQ ID NO: 553390 - DNA, 25 bp, Rattus norvegicus
accgcaaggtgcagtaatgtccgac

SEQ ID NO: 553391 - DNA, 25 bp, Rattus norvegicus
gcagtaatgtccgaccctgtggatc

SEQ ID NO: 553392 - DNA, 25 bp, Rattus norvegicus
gcagcaagactcgagtagattccaa

SEQ ID NO: 553393 - DNA, 25 bp, Rattus norvegicus
accctgtggatccaaggcttctgca

SEQ ID NO: 553394 - DNA, 25 bp, Rattus norvegicus
aaggcttctgcattctggctccaca

SEQ ID NO: 553395 - DNA, 25 bp, Rattus norvegicus
tgcctgtagtagttgttccagaaca

SEQ ID NO: 553396 - DNA, 25 bp, Rattus norvegicus
ccagccctctcttgaatgtatagtt

SEQ ID NO: 553397 - DNA, 25 bp, Rattus norvegicus
taatacatctcataaaccagccctc

SEQ ID NO: 553398 - DNA, 25 bp, Rattus norvegicus
tctgtttggatctattacacatttg

SEQ ID NO: 553399 - DNA, 25 bp, Rattus norvegicus
tgatctcttgaaaattctgtttgga

SEQ ID NO: 553400 - DNA, 25 bp, Rattus norvegicus
gcgccctgccattcacttttgatct

SEQ ID NO: 553401 - DNA, 25 bp, Rattus norvegicus
tgcagcgggcaacaagggcctccga

SEQ ID NO: 553402 - DNA, 25 bp, Rattus norvegicus
agcaggaactcctcgccgcgtgctt

SEQ ID NO: 553403 - DNA, 25 bp, Rattus norvegicus
tgcagggagacgaaagcaggaactc

SEQ ID NO: 553404 - DNA, 25 bp, Rattus norvegicus
catagccaccgaaaccctgcaggga

SEQ ID NO: 553405 - DNA, 25 bp, Rattus norvegicus
cgagggtctgtgcaactccatagcc

SEQ ID NO: 553406 - DNA, 25 bp, Rattus norvegicus
tcctgcatcctgaaaggtccgcgca

SEQ ID NO: 553407 - DNA, 25 bp, Rattus norvegicus
gggcacgtgttctgcgattcctgca

SEQ ID NO: 553408 - DNA, 25 bp, Rattus norvegicus
tcgtccttcagcctgaccagctgtg

SEQ ID NO: 553409 - DNA, 25 bp, Rattus norvegicus
agccgccgcacaggaagtcgtcctt

SEQ ID NO: 553410 - DNA, 25 bp, Rattus norvegicus
gtaatcgctgtttccagccgccgca

SEQ ID NO: 553411 - DNA, 25 bp, Rattus norvegicus
atggccagctgggtgttctgtaatc

SEQ ID NO: 553412 - DNA, 25 bp, Rattus norvegicus
aatcccacgtgggtcctccgtcatg

SEQ ID NO: 553413 - DNA, 25 bp, Rattus norvegicus
ggtctgtatctctctgtgccctcgc

SEQ ID NO: 553414 - DNA, 25 bp, Rattus norvegicus
ctgcctttctaagctgtgcctggta

SEQ ID NO: 553415 - DNA, 25 bp, Rattus norvegicus
gccttgtgcgcatgcgctggaatga

SEQ ID NO: 553416 - DNA, 25 bp, Rattus norvegicus
ccagcctcttgggaacgcactgcta

SEQ ID NO: 553417 - DNA, 25 bp, Rattus norvegicus
ccgctctgatcctcggcatggcata

SEQ ID NO: 553418 - DNA, 25 bp, Rattus norvegicus
cagggcttgtggttcttcacacgtc

SEQ ID NO: 553419 - DNA, 25 bp, Rattus norvegicus
ttcacacgtcgatgcggaagtaacg

SEQ ID NO: 553420 - DNA, 25 bp, Rattus norvegicus
gaagtaacgaggctctgcgtctcca

SEQ ID NO: 553421 - DNA, 25 bp, Rattus norvegicus
cttgcactaacagcccagagacttc

SEQ ID NO: 553422 - DNA, 25 bp, Rattus norvegicus
ttcgcacgggaaagcggtaaccagc

SEQ ID NO: 553423 - DNA, 25 bp, Rattus norvegicus
tttcctggcttcaggaggcgtcttg

SEQ ID NO: 553424 - DNA, 25 bp, Rattus norvegicus
cggaggtcacggacaaaatggtgcc

SEQ ID NO: 553425 - DNA, 25 bp, Rattus norvegicus
gttcaggtctctccgctcatcaagg

SEQ ID NO: 553426 - DNA, 25 bp, Rattus norvegicus
ttagcattgcccaccctcgagactg

SEQ ID NO: 553427 - DNA, 25 bp, Rattus norvegicus
caccggtgttccttctgctctaacg

SEQ ID NO: 553428 - DNA, 25 bp, Rattus norvegicus
tttgttctgcagttcggccggtact

SEQ ID NO: 553429 - DNA, 25 bp, Rattus norvegicus
actgctatcctccagtcgctagggg

SEQ ID NO: 553430 - DNA, 25 bp, Rattus norvegicus
cacataccctctagtttgctccata

SEQ ID NO: 553431 - DNA, 25 bp, Rattus norvegicus
ccgtgtacagctccgggatcttcag

SEQ ID NO: 553432 - DNA, 25 bp, Rattus norvegicus
tcggctcttcctcatttggaaacga

SEQ ID NO: 553433 - DNA, 25 bp, Rattus norvegicus
tcttcctcatttggaaacgacaccc

SEQ ID NO: 553434 - DNA, 25 bp, Rattus norvegicus
tcccttgagggcacataccctctag

SEQ ID NO: 553435 - DNA, 25 bp, Rattus norvegicus
tgagggcacataccctctagtttgc

SEQ ID NO: 553436 - DNA, 25 bp, Rattus norvegicus
ctagtttgctccatagccatttgtc

SEQ ID NO: 553437 - DNA, 25 bp, Rattus norvegicus
gtttgctccatagccatttgtcgtg

SEQ ID NO: 553438 - DNA, 25 bp, Rattus norvegicus
gctccatagccatttgtcgtgcacg

SEQ ID NO: 553439 - DNA, 25 bp, Rattus norvegicus
ccatagccatttgtcgtgcacggct

SEQ ID NO: 553440 - DNA, 25 bp, Rattus norvegicus
tctcctttagcctgccgaggttggc

SEQ ID NO: 553441 - DNA, 25 bp, Rattus norvegicus
cagagggcgagcagtgggttagaac

SEQ ID NO: 553442 - DNA, 25 bp, Rattus norvegicus
cctccgtgtacagctccgggatctt

SEQ ID NO: 553443 - DNA, 25 bp, Rattus norvegicus
taccctctagtttgctccatagcca

SEQ ID NO: 553444 - DNA, 25 bp, Rattus norvegicus
ctagaagctctccaaccgggtaaag

SEQ ID NO: 553445 - DNA, 25 bp, Rattus norvegicus
cgaagcaccaggctctgcgtcggcg

SEQ ID NO: 553446 - DNA, 25 bp, Rattus norvegicus
gggccgaagcaccaggctctgcgtc

SEQ ID NO: 553447 - DNA, 25 bp, Rattus norvegicus
ccggcggcgggccagagctgaagcg

SEQ ID NO: 553448 - DNA, 25 bp, Rattus norvegicus
tgacgtcagagcaggctgcgacgcc

SEQ ID NO: 553449 - DNA, 25 bp, Rattus norvegicus
gtcctgctggttaaggcagaaggaa

SEQ ID NO: 553450 - DNA, 25 bp, Rattus norvegicus
agcaccaggctctgcgtcggcggct

SEQ ID NO: 553451 - DNA, 25 bp, Rattus norvegicus
caggcaaaggagaactagaagctct

SEQ ID NO: 553452 - DNA, 25 bp, Rattus norvegicus
tggcaggcaaaggagaactagaagc

SEQ ID NO: 553453 - DNA, 25 bp, Rattus norvegicus
gactggcaggcaaaggagaactaga

SEQ ID NO: 553454 - DNA, 25 bp, Rattus norvegicus
cagagattgactggcaggcaaagga

SEQ ID NO: 553455 - DNA, 25 bp, Rattus norvegicus
agccagagattgactggcaggcaaa

SEQ ID NO: 553456 - DNA, 25 bp, Rattus norvegicus
gaactagaagctctccaaccgggta

SEQ ID NO: 553457 - DNA, 25 bp, Rattus norvegicus
tcctgctggttaaggcagaaggaag

SEQ ID NO: 553458 - DNA, 25 bp, Rattus norvegicus
ctgctttgtgagtctctgcggccca

SEQ ID NO: 553459 - DNA, 25 bp, Rattus norvegicus
tttcgacacatcctgcttcgtgcgc

SEQ ID NO: 553460 - DNA, 25 bp, Rattus norvegicus
gacgctgatgttctccttggagtcc

SEQ ID NO: 553461 - DNA, 25 bp, Rattus norvegicus
tcggtcagcgcgacgctgatgttct

SEQ ID NO: 553462 - DNA, 25 bp, Rattus norvegicus
ttgccatcggtcagcgcgacgctga

SEQ ID NO: 553463 - DNA, 25 bp, Rattus norvegicus
ggccctgtctttgccatcggtcagc

SEQ ID NO: 553464 - DNA, 25 bp, Rattus norvegicus
tcccgttgcttttcgacacatcctg

SEQ ID NO: 553465 - DNA, 25 bp, Rattus norvegicus
aggacgctggccctgtctttgccat

SEQ ID NO: 553466 - DNA, 25 bp, Rattus norvegicus
gtgtgccgtgatgccgcttcccgtt

SEQ ID NO: 553467 - DNA, 25 bp, Rattus norvegicus
ctctgcggcccaccctcttgtgcct

SEQ ID NO: 553468 - DNA, 25 bp, Rattus norvegicus
cattgctgctttgtgagtctctgcg

SEQ ID NO: 553469 - DNA, 25 bp, Rattus norvegicus
ttgttaagaactcattgctgctttg

SEQ ID NO: 553470 - DNA, 25 bp, Rattus norvegicus
gtccgaaattgttaagaactcattg

SEQ ID NO: 553471 - DNA, 25 bp, Rattus norvegicus
ttctccttggagtccgaaattgtta

SEQ ID NO: 553472 - DNA, 25 bp, Rattus norvegicus
ttcccacggggcgacttgcaaagcc

SEQ ID NO: 553473 - DNA, 25 bp, Rattus norvegicus
tactctcccgagagaatcggttttc

SEQ ID NO: 553474 - DNA, 25 bp, Rattus norvegicus
tgtttgctctcggaagcgttctgcg

SEQ ID NO: 553475 - DNA, 25 bp, Rattus norvegicus
aaagcccaggtgtcctcgcactgta

SEQ ID NO: 553476 - DNA, 25 bp, Rattus norvegicus
tgtatgtcgctctggggtccttaaa

SEQ ID NO: 553477 - DNA, 25 bp, Rattus norvegicus
acagcgcgaagctcgcaggttccca

SEQ ID NO: 553478 - DNA, 25 bp, Rattus norvegicus
tttccaggcaccctggagcgtgggc

SEQ ID NO: 553479 - DNA, 25 bp, Rattus norvegicus
tgcccgcttcgagtctcagccagtt

SEQ ID NO: 553480 - DNA, 25 bp, Rattus norvegicus
cactgtcggaagctgcccgcttcga

SEQ ID NO: 553481 - DNA, 25 bp, Rattus norvegicus
gccagcagcttgacccactgtcgga

SEQ ID NO: 553482 - DNA, 25 bp, Rattus norvegicus
gggtccttaaatgcggccagcagct

SEQ ID NO: 553483 - DNA, 25 bp, Rattus norvegicus
gcgccggtgccaaccgcttgcagag

SEQ ID NO: 553484 - DNA, 25 bp, Rattus norvegicus
cgcactgtaccggatgtttgctctc

SEQ ID NO: 553485 - DNA, 25 bp, Rattus norvegicus
gtctcagccagttttccatactctc

SEQ ID NO: 553486 - DNA, 25 bp, Rattus norvegicus
gccataattgtagatgcaccgagga

SEQ ID NO: 553487 - DNA, 25 bp, Rattus norvegicus
ggagcccagccttcagcatccaaga

SEQ ID NO: 553488 - DNA, 25 bp, Rattus norvegicus
ggaggcaaagcttaaaccgccgcta

SEQ ID NO: 553489 - DNA, 25 bp, Rattus norvegicus
accgccgctaagtctaagcaggaaa

SEQ ID NO: 553490 - DNA, 25 bp, Rattus norvegicus
ttgcctcgggttagaccagttcctc

SEQ ID NO: 553491 - DNA, 25 bp, Rattus norvegicus
gcgacactctcgcaggaggagccca

SEQ ID NO: 553492 - DNA, 25 bp, Rattus norvegicus
cttccagagctccacgcgaaaggtg

SEQ ID NO: 553493 - DNA, 25 bp, Rattus norvegicus
taccttcgcaatgaggcaatactgc

SEQ ID NO: 553494 - DNA, 25 bp, Rattus norvegicus
agaaaagacgcctccgaactcaatg

SEQ ID NO: 553495 - DNA, 25 bp, Rattus norvegicus
ctcctcagatgaggggcctggaaac

SEQ ID NO: 553496 - DNA, 25 bp, Rattus norvegicus
cgcaggttccttctcgacagctttt

SEQ ID NO: 553497 - DNA, 25 bp, Rattus norvegicus
agccacgctttgaagacacccatcg

SEQ ID NO: 553498 - DNA, 25 bp, Rattus norvegicus
tgcaaattccgccagcgctagggcc

SEQ ID NO: 553499 - DNA, 25 bp, Rattus norvegicus
ggcctggaaacgcacaagataagtc

SEQ ID NO: 553500 - DNA, 25 bp, Rattus norvegicus
cggagcctgggaacgccacaagcag

SEQ ID NO: 553501 - DNA, 25 bp, Rattus norvegicus
cccgaaggcgaggttaagatcaaga

SEQ ID NO: 553502 - DNA, 25 bp, Rattus norvegicus
cgaggttaagatcaagagacggacg

SEQ ID NO: 553503 - DNA, 25 bp, Rattus norvegicus
tcaagagacggacggtgaagaccaa

SEQ ID NO: 553504 - DNA, 25 bp, Rattus norvegicus
aggtgcaccgggcaagaagaaagcc

SEQ ID NO: 553505 - DNA, 25 bp, Rattus norvegicus
caagaagaaagccaagggcaaggca

SEQ ID NO: 553506 - DNA, 25 bp, Rattus norvegicus
gaacgccacaagcagggattccctt

SEQ ID NO: 553507 - DNA, 25 bp, Rattus norvegicus
gccacaagcagggattcccttttta

SEQ ID NO: 553508 - DNA, 25 bp, Rattus norvegicus
acccggacctttgcctgccgagagg

SEQ ID NO: 553509 - DNA, 25 bp, Rattus norvegicus
ctgccgagaggagggcagcaaactt

SEQ ID NO: 553510 - DNA, 25 bp, Rattus norvegicus
cagcaaacttgccagtgagcgcctc

SEQ ID NO: 553511 - DNA, 25 bp, Rattus norvegicus
ctcaagagagccacgcgcaagagcg

SEQ ID NO: 553512 - DNA, 25 bp, Rattus norvegicus
agtgagcgcctcaagagagccacgc

SEQ ID NO: 553513 - DNA, 25 bp, Rattus norvegicus
acttgccagtgagcgcctcaagaga

SEQ ID NO: 553514 - DNA, 25 bp, Rattus norvegicus
cgcggcaacaagagaatcggcccta

SEQ ID NO: 553515 - DNA, 25 bp, Rattus norvegicus
actttccctgtaagagcaccgcttg

SEQ ID NO: 553516 - DNA, 25 bp, Rattus norvegicus
tacctctaccgaggtaccttgcggc

SEQ ID NO: 553517 - DNA, 25 bp, Rattus norvegicus
gactgttccggattgtgctgacgaa

SEQ ID NO: 553518 - DNA, 25 bp, Rattus norvegicus
tgtgctgacgaaattggtcccgggt

SEQ ID NO: 553519 - DNA, 25 bp, Rattus norvegicus
ggtcccgggtttcaactgcaccgca

SEQ ID NO: 553520 - DNA, 25 bp, Rattus norvegicus
accgcttgtcttacctctaccgagg

SEQ ID NO: 553521 - DNA, 25 bp, Rattus norvegicus
ctgcaccgcaacatgaaaaaggttc

SEQ ID NO: 553522 - DNA, 25 bp, Rattus norvegicus
aggttcctctcggaaactggcaaag

SEQ ID NO: 553523 - DNA, 25 bp, Rattus norvegicus
tctggcgtgtacaccgcggcaacaa

SEQ ID NO: 553524 - DNA, 25 bp, Rattus norvegicus
aagcagggcgggacgacttagcttc

SEQ ID NO: 553525 - DNA, 25 bp, Rattus norvegicus
gccgccatgttgactgttccggatt

SEQ ID NO: 553526 - DNA, 25 bp, Rattus norvegicus
gacttagcttctgtgccctcgtggc

SEQ ID NO: 553527 - DNA, 25 bp, Rattus norvegicus
ggttcacctaggactgcccttcgtg

SEQ ID NO: 553528 - DNA, 25 bp, Rattus norvegicus
gaaatggctgctggtgctcgttctt

SEQ ID NO: 553529 - DNA, 25 bp, Rattus norvegicus
gtgaattagagcgaaggcaccgaaa

SEQ ID NO: 553530 - DNA, 25 bp, Rattus norvegicus
ggcaccgaaagctcgcgtctctctt

SEQ ID NO: 553531 - DNA, 25 bp, Rattus norvegicus
tccgtgctccggagtcggacctgga

SEQ ID NO: 553532 - DNA, 25 bp, Rattus norvegicus
tagagtgtttccgtgctccggagtc

SEQ ID NO: 553533 - DNA, 25 bp, Rattus norvegicus
ctggtgctcgttcttggcccgcgga

SEQ ID NO: 553534 - DNA, 25 bp, Rattus norvegicus
tgtgtttgtgtgtttcccctgccgc

SEQ ID NO: 553535 - DNA, 25 bp, Rattus norvegicus
accctggcgcgctgaatgcaggtga

SEQ ID NO: 553536 - DNA, 25 bp, Rattus norvegicus
gcctgcatgtctttactgccctcag

SEQ ID NO: 553537 - DNA, 25 bp, Rattus norvegicus
gggctgcctgcatgtctttactgcc

SEQ ID NO: 553538 - DNA, 25 bp, Rattus norvegicus
tgatccgtctgctctgcgctccctt

SEQ ID NO: 553539 - DNA, 25 bp, Rattus norvegicus
tcagcgccagaaggccaaggccaag

SEQ ID NO: 553540 - DNA, 25 bp, Rattus norvegicus
agcggcggcagcctcagcgccagaa

SEQ ID NO: 553541 - DNA, 25 bp, Rattus norvegicus
atgaggtagagtgtttccgtgctcc

SEQ ID NO: 553542 - DNA, 25 bp, Rattus norvegicus
ttgaagccaccgaagcgggttctgg

SEQ ID NO: 553543 - DNA, 25 bp, Rattus norvegicus
gtctcgagactgaacaaagaactgg

SEQ ID NO: 553544 - DNA, 25 bp, Rattus norvegicus
ggaccggaagattgaagccaccgaa

SEQ ID NO: 553545 - DNA, 25 bp, Rattus norvegicus
ccgcgccgagcaggaacctaatact

SEQ ID NO: 553546 - DNA, 25 bp, Rattus norvegicus
gtgtggcctcacaacatcccggagc

SEQ ID NO: 553547 - DNA, 25 bp, Rattus norvegicus
tagcagactgcaatccaaacccgga

SEQ ID NO: 553548 - DNA, 25 bp, Rattus norvegicus
gggactctaccgtcctagcagactg

SEQ ID NO: 553549 - DNA, 25 bp, Rattus norvegicus
ccctacgcttctgcagcttaaagga

SEQ ID NO: 553550 - DNA, 25 bp, Rattus norvegicus
ttcggttcagtaacggtgctgagtc

SEQ ID NO: 553551 - DNA, 25 bp, Rattus norvegicus
agcaggaacctaatacttcggttca

SEQ ID NO: 553552 - DNA, 25 bp, Rattus norvegicus
caaagaactggaaggaggaggcttc

SEQ ID NO: 553553 - DNA, 25 bp, Rattus norvegicus
gacaaggggagtccagtctgcccgc

SEQ ID NO: 553554 - DNA, 25 bp, Rattus norvegicus
ccgcaagtggagacagagcggccca

SEQ ID NO: 553555 - DNA, 25 bp, Rattus norvegicus
cctgtcagtccctcggatgcgactg

SEQ ID NO: 553556 - DNA, 25 bp, Rattus norvegicus
tttccagaggcgcatgcgcagcaca

SEQ ID NO: 553557 - DNA, 25 bp, Rattus norvegicus
gtcaccactgtgaggcctacagctc

SEQ ID NO: 553558 - DNA, 25 bp, Rattus norvegicus
ttagttcgctgagtgacccttcggc

SEQ ID NO: 553559 - DNA, 25 bp, Rattus norvegicus
ccggcccagggtcatcatggaatta

SEQ ID NO: 553560 - DNA, 25 bp, Rattus norvegicus
agcgcctctgtctcgctttttctta

SEQ ID NO: 553561 - DNA, 25 bp, Rattus norvegicus
ggaggccagcgcttttcttgctcgc

SEQ ID NO: 553562 - DNA, 25 bp, Rattus norvegicus
acgttgtttacagacgcgcgcggct

SEQ ID NO: 553563 - DNA, 25 bp, Rattus norvegicus
ttgcgggaaggagaacactgacgtt

SEQ ID NO: 553564 - DNA, 25 bp, Rattus norvegicus
cgtccacaggacaccgaagattgcg

SEQ ID NO: 553565 - DNA, 25 bp, Rattus norvegicus
tcaaactctcttacgcgtccacagg

SEQ ID NO: 553566 - DNA, 25 bp, Rattus norvegicus
gatcttctcccaaaactcgtctttg

SEQ ID NO: 553567 - DNA, 25 bp, Rattus norvegicus
aaggagtccgcgcacctttccttct

SEQ ID NO: 553568 - DNA, 25 bp, Rattus norvegicus
accaagcctcttacgtcaccgagag

SEQ ID NO: 553569 - DNA, 25 bp, Rattus norvegicus
tccgcgcatccgaggaaaaggagtc

SEQ ID NO: 553570 - DNA, 25 bp, Rattus norvegicus
tacagccctgtgacacagcgcttca

SEQ ID NO: 553571 - DNA, 25 bp, Rattus norvegicus
ctccactgtcaccagctaagcgttg

SEQ ID NO: 553572 - DNA, 25 bp, Rattus norvegicus
tcagtcagcgccttcctccactgtc

SEQ ID NO: 553573 - DNA, 25 bp, Rattus norvegicus
gcgaggaaaccctcctcagtcagcg

SEQ ID NO: 553574 - DNA, 25 bp, Rattus norvegicus
gagaaccgcgaggaaaccctcctca

SEQ ID NO: 553575 - DNA, 25 bp, Rattus norvegicus
tgtgacacagcgcttcagctcccaa

SEQ ID NO: 553576 - DNA, 25 bp, Rattus norvegicus
gcttctacagccctgtgacacagcg

SEQ ID NO: 553577 - DNA, 25 bp, Rattus norvegicus
tttgacccgcttctacagccctgtg

SEQ ID NO: 553578 - DNA, 25 bp, Rattus norvegicus
atgcaccggggggtaagccaccacg

SEQ ID NO: 553579 - DNA, 25 bp, Rattus norvegicus
tccggaatttcacaatgcaccgggg

SEQ ID NO: 553580 - DNA, 25 bp, Rattus norvegicus
agggtgtccggaatttcacaatgca

SEQ ID NO: 553581 - DNA, 25 bp, Rattus norvegicus
cgcctgagggtgtccggaatttcac

SEQ ID NO: 553582 - DNA, 25 bp, Rattus norvegicus
tgtcaccagctaagcgttgtgcgcc

SEQ ID NO: 553583 - DNA, 25 bp, Rattus norvegicus
agcgcttcagctcccaattctcatg

SEQ ID NO: 553584 - DNA, 25 bp, Rattus norvegicus
tccggagccctctcctggagaaacg

SEQ ID NO: 553585 - DNA, 25 bp, Rattus norvegicus
gtcggcctcaagtgcttctcactgg

SEQ ID NO: 553586 - DNA, 25 bp, Rattus norvegicus
cccgtccgtggaactgccagggtat

SEQ ID NO: 553587 - DNA, 25 bp, Rattus norvegicus
ggaccggtgaacagccaaaacctgc

SEQ ID NO: 553588 - DNA, 25 bp, Rattus norvegicus
ggtcttcatgctcggggttctcagc

SEQ ID NO: 553589 - DNA, 25 bp, Rattus norvegicus
tgggcgtcttccacgcgtttgacga

SEQ ID NO: 553590 - DNA, 25 bp, Rattus norvegicus
acacagtgtccctggtggaacgcaa

SEQ ID NO: 553591 - DNA, 25 bp, Rattus norvegicus
tggaacgcaagtactcccactattg

SEQ ID NO: 553592 - DNA, 25 bp, Rattus norvegicus
tgccgccagttgaaggactaccagc

SEQ ID NO: 553593 - DNA, 25 bp, Rattus norvegicus
ggcctggtgctctccactgtattca

SEQ ID NO: 553594 - DNA, 25 bp, Rattus norvegicus
aactacaagtcgtcgcaggctcggc

SEQ ID NO: 553595 - DNA, 25 bp, Rattus norvegicus
caagccgatctttggcgcgaccgcg

SEQ ID NO: 553596 - DNA, 25 bp, Rattus norvegicus
tgtgtcctacatcaacgtgggcgtc

SEQ ID NO: 553597 - DNA, 25 bp, Rattus norvegicus
aaacctgctgctcctaggcgtcctg

SEQ ID NO: 553598 - DNA, 25 bp, Rattus norvegicus
ctggtgagctgataggttgataatc

SEQ ID NO: 553599 - DNA, 25 bp, Rattus norvegicus
cgcccgctttattccagcaacatgg

SEQ ID NO: 553600 - DNA, 25 bp, Rattus norvegicus
gggtgcagagagagacctgacccca

SEQ ID NO: 553601 - DNA, 25 bp, Rattus norvegicus
aacgcggcgggtgaaccatgatcct

SEQ ID NO: 553602 - DNA, 25 bp, Rattus norvegicus
tttattccagcaacatggcctcccg

SEQ ID NO: 553603 - DNA, 25 bp, Rattus norvegicus
gaaccatgatcctggtgagctgata

SEQ ID NO: 553604 - DNA, 25 bp, Rattus norvegicus
tgataggttgataatctgtgaagtc

SEQ ID NO: 553605 - DNA, 25 bp, Rattus norvegicus
ctgtgaagtcagacactttccctcc

SEQ ID NO: 553606 - DNA, 25 bp, Rattus norvegicus
cccactaaagtgtcctgtgcccaga

SEQ ID NO: 553607 - DNA, 25 bp, Rattus norvegicus
aaagtgtcctgtgcccagacgctgc

SEQ ID NO: 553608 - DNA, 25 bp, Rattus norvegicus
gcctcccgcctggactcaaccatta

SEQ ID NO: 553609 - DNA, 25 bp, Rattus norvegicus
tggagtccgcgtaaaagcctaggcg

SEQ ID NO: 553610 - DNA, 25 bp, Rattus norvegicus
taaaagcctaggcgcggaggtccca

SEQ ID NO: 553611 - DNA, 25 bp, Rattus norvegicus
tgcccagacgctgcccgactctccc

SEQ ID NO: 553612 - DNA, 25 bp, Rattus norvegicus
tgagccacttcaagagcttcctgcg

SEQ ID NO: 553613 - DNA, 25 bp, Rattus norvegicus
cacgtgccttcaggccagctgcagg

SEQ ID NO: 553614 - DNA, 25 bp, Rattus norvegicus
actgggaccagaggctgctcaagcc

SEQ ID NO: 553615 - DNA, 25 bp, Rattus norvegicus
ctcaaaaggaggtacagggacctgc

SEQ ID NO: 553616 - DNA, 25 bp, Rattus norvegicus
ccaagtacgtggtgctcaaaaggag

SEQ ID NO: 553617 - DNA, 25 bp, Rattus norvegicus
cttcaagggcttcgtgaactcggtg

SEQ ID NO: 553618 - DNA, 25 bp, Rattus norvegicus
agcgtcgcgagctcttcaagggctt

SEQ ID NO: 553619 - DNA, 25 bp, Rattus norvegicus
aagatctcggagaccctgcagccgc

SEQ ID NO: 553620 - DNA, 25 bp, Rattus norvegicus
ctcgctgcgacaggccagcgtcgtt

SEQ ID NO: 553621 - DNA, 25 bp, Rattus norvegicus
cgtgcgtaacgcagagctgctgagc

SEQ ID NO: 553622 - DNA, 25 bp, Rattus norvegicus
agccaggaggcactgctggactttc

SEQ ID NO: 553623 - DNA, 25 bp, Rattus norvegicus
ggaacagccgctgccggaagatctc

SEQ ID NO: 553624 - DNA, 25 bp, Rattus norvegicus
agtctgtaacgcctgtctgggctcc

SEQ ID NO: 553625 - DNA, 25 bp, Rattus norvegicus
agaacgctcgcctgagtctgtaacg

SEQ ID NO: 553626 - DNA, 25 bp, Rattus norvegicus
ccttgatgctgttcctgtaggcgcg

SEQ ID NO: 553627 - DNA, 25 bp, Rattus norvegicus
cacgggactgggcatccttgatgct

SEQ ID NO: 553628 - DNA, 25 bp, Rattus norvegicus
ccaggtcccggcgacgaaatgatgt

SEQ ID NO: 553629 - DNA, 25 bp, Rattus norvegicus
gaacgcttcttctgctcggctgtga

SEQ ID NO: 553630 - DNA, 25 bp, Rattus norvegicus
tccggctccgagtaggaacgcttct

SEQ ID NO: 553631 - DNA, 25 bp, Rattus norvegicus
ggacgcagtgcacggactcagcctc

SEQ ID NO: 553632 - DNA, 25 bp, Rattus norvegicus
gctctccgagaagcgcagctgcgct

SEQ ID NO: 553633 - DNA, 25 bp, Rattus norvegicus
aactgcttcagttcagggccagaca

SEQ ID NO: 553634 - DNA, 25 bp, Rattus norvegicus
agggcgctctgctggaactgcttca

SEQ ID NO: 553635 - DNA, 25 bp, Rattus norvegicus
tccgcctcactgaagagctgaaagg

SEQ ID NO: 553636 - DNA, 25 bp, Rattus norvegicus
ccgctggcaaaggagctgctgcgat

SEQ ID NO: 553637 - DNA, 25 bp, Rattus norvegicus
gtgctccttgcagggcagcacctcg

SEQ ID NO: 553638 - DNA, 25 bp, Rattus norvegicus
accgcctgaaagtagacgctctgtg

SEQ ID NO: 553639 - DNA, 25 bp, Rattus norvegicus
gctcccgtagcgaactcaggctgca

SEQ ID NO: 553640 - DNA, 25 bp, Rattus norvegicus
tcctgagcgagtggaatttaccatg

SEQ ID NO: 553641 - DNA, 25 bp, Rattus norvegicus
tgccctcggaattttcgatcctgtc

SEQ ID NO: 553642 - DNA, 25 bp, Rattus norvegicus
agcggtgctcttgttgccctcggaa

SEQ ID NO: 553643 - DNA, 25 bp, Rattus norvegicus
tttaccatgacaatagcgtccgccc

SEQ ID NO: 553644 - DNA, 25 bp, Rattus norvegicus
cgacagagccgcaaagaaatacctc

SEQ ID NO: 553645 - DNA, 25 bp, Rattus norvegicus
tctgggaagaaagcgacagagccgc

SEQ ID NO: 553646 - DNA, 25 bp, Rattus norvegicus
cacacgcgccaaagccttgtctgtg

SEQ ID NO: 553647 - DNA, 25 bp, Rattus norvegicus
gcagactgctttcggctcgcacacg

SEQ ID NO: 553648 - DNA, 25 bp, Rattus norvegicus
ccagggttcccgcagactgctttcg

SEQ ID NO: 553649 - DNA, 25 bp, Rattus norvegicus
aattcggggctctcgcagaagtccc

SEQ ID NO: 553650 - DNA, 25 bp, Rattus norvegicus
ctacaccctctggaattcggggctc

SEQ ID NO: 553651 - DNA, 25 bp, Rattus norvegicus
ccgcaggctaggagaaacgcagtcc

SEQ ID NO: 553652 - DNA, 25 bp, Rattus norvegicus
gtcctgcaagctacccgcaggctag

SEQ ID NO: 553653 - DNA, 25 bp, Rattus norvegicus
cgccctccgcagaagctgcatttaa

SEQ ID NO: 553654 - DNA, 25 bp, Rattus norvegicus
acccgaagccctgcgctctaagggt

SEQ ID NO: 553655 - DNA, 25 bp, Rattus norvegicus
gctagccaccggtgttccctcccga

SEQ ID NO: 553656 - DNA, 25 bp, Rattus norvegicus
ccctcccgattcctcacccgcctat

SEQ ID NO: 553657 - DNA, 25 bp, Rattus norvegicus
gcctatccatgtcgtcgtcgtcctc

SEQ ID NO: 553658 - DNA, 25 bp, Rattus norvegicus
gtcctccggctcgtccacgtcctct

SEQ ID NO: 553659 - DNA, 25 bp, Rattus norvegicus
acgtcctcttcctcaggctccgtgt

SEQ ID NO: 553660 - DNA, 25 bp, Rattus norvegicus
cctcaggctccgtgtccacttccag

SEQ ID NO: 553661 - DNA, 25 bp, Rattus norvegicus
ccagcctctgttcctcagacaatga

SEQ ID NO: 553662 - DNA, 25 bp, Rattus norvegicus
cctcagacaatgaggactcatctta

SEQ ID NO: 553663 - DNA, 25 bp, Rattus norvegicus
gaggactcatcttacagctcagatg

SEQ ID NO: 553664 - DNA, 25 bp, Rattus norvegicus
ctcagatgacgaggaccccaccttg

SEQ ID NO: 553665 - DNA, 25 bp, Rattus norvegicus
accttgctgctgcagacctgtctca

SEQ ID NO: 553666 - DNA, 25 bp, Rattus norvegicus
gcagacctgtctcacccgtcccgta

SEQ ID NO: 553667 - DNA, 25 bp, Rattus norvegicus
tgcgctctaagggtagcagccccca

SEQ ID NO: 553668 - DNA, 25 bp, Rattus norvegicus
tgtgcactgcgccaagcgcggccag

SEQ ID NO: 553669 - DNA, 25 bp, Rattus norvegicus
cgcctggctactccaggacaggaca

SEQ ID NO: 553670 - DNA, 25 bp, Rattus norvegicus
tcggggaagctggtccaccagaacc

SEQ ID NO: 553671 - DNA, 25 bp, Rattus norvegicus
gggaacgtgaaaacaactggctcga

SEQ ID NO: 553672 - DNA, 25 bp, Rattus norvegicus
atcccatgccagaagagcccggttg

SEQ ID NO: 553673 - DNA, 25 bp, Rattus norvegicus
cgagaggaggaagagtacctgcttt

SEQ ID NO: 553674 - DNA, 25 bp, Rattus norvegicus
agtacctgctttggagaccagctcc

SEQ ID NO: 553675 - DNA, 25 bp, Rattus norvegicus
gaccagctcccgatcggaaggttca

SEQ ID NO: 553676 - DNA, 25 bp, Rattus norvegicus
aaggttcagggctcaggccgccact

SEQ ID NO: 553677 - DNA, 25 bp, Rattus norvegicus
agccacaggatgagcgctccggcca

SEQ ID NO: 553678 - DNA, 25 bp, Rattus norvegicus
cgaccagcagggctgaccagacggc

SEQ ID NO: 553679 - DNA, 25 bp, Rattus norvegicus
taagagtcccggtgcacggctcaac

SEQ ID NO: 553680 - DNA, 25 bp, Rattus norvegicus
actctcatcggtgctcctggtctca

SEQ ID NO: 553681 - DNA, 25 bp, Rattus norvegicus
aggtgcgtctttcagcggctccgca

SEQ ID NO: 553682 - DNA, 25 bp, Rattus norvegicus
gggagcactacgctcagcctcggga

SEQ ID NO: 553683 - DNA, 25 bp, Rattus norvegicus
cagcctggggagcactgcgctcagc

SEQ ID NO: 553684 - DNA, 25 bp, Rattus norvegicus
ctcgggagcactacgctcagcctgg

SEQ ID NO: 553685 - DNA, 25 bp, Rattus norvegicus
ctacgctcagcctggggagcactgc

SEQ ID NO: 553686 - DNA, 25 bp, Rattus norvegicus
tcagcctggggagcactgcgctcag

SEQ ID NO: 553687 - DNA, 25 bp, Rattus norvegicus
ctcagcctggggagcactgcgctca

SEQ ID NO: 553688 - DNA, 25 bp, Rattus norvegicus
gagcactacgctcagcctggggagc

SEQ ID NO: 553689 - DNA, 25 bp, Rattus norvegicus
tcagcctcgggagcactacgctcag

SEQ ID NO: 553690 - DNA, 25 bp, Rattus norvegicus
agcactacgctcagcctggggagca

SEQ ID NO: 553691 - DNA, 25 bp, Rattus norvegicus
actacgctcagcctggggagcactg

SEQ ID NO: 553692 - DNA, 25 bp, Rattus norvegicus
gctcagcctggggagcactgcgctc

SEQ ID NO: 553693 - DNA, 25 bp, Rattus norvegicus
ggagcactacgctcagcctcgggag

SEQ ID NO: 553694 - DNA, 25 bp, Rattus norvegicus
ctcagcctcgggagcactacgctca

SEQ ID NO: 553695 - DNA, 25 bp, Rattus norvegicus
actgcgctcagcctggggagcactg

SEQ ID NO: 553696 - DNA, 25 bp, Rattus norvegicus
cgctgcatgaccactgccgggactt

SEQ ID NO: 553697 - DNA, 25 bp, Rattus norvegicus
gacgcggagaaaggcaactagcagc

SEQ ID NO: 553698 - DNA, 25 bp, Rattus norvegicus
ctgccgggacttgggttgcaagttc

SEQ ID NO: 553699 - DNA, 25 bp, Rattus norvegicus
cgccatggcactgcccgctgcatga

SEQ ID NO: 553700 - DNA, 25 bp, Rattus norvegicus
ttaggctggagtcgctgcccacgct

SEQ ID NO: 553701 - DNA, 25 bp, Rattus norvegicus
cagagttttaggctggagtcgctgc

SEQ ID NO: 553702 - DNA, 25 bp, Rattus norvegicus
catcagtttcggagccagagtttta

SEQ ID NO: 553703 - DNA, 25 bp, Rattus norvegicus
cggcgctccctcatcagtttcggag

SEQ ID NO: 553704 - DNA, 25 bp, Rattus norvegicus
agcgctgcgcgagcactgcgcttac

SEQ ID NO: 553705 - DNA, 25 bp, Rattus norvegicus
caggttccctgctagcagctgcgag

SEQ ID NO: 553706 - DNA, 25 bp, Rattus norvegicus
aggatccaggttccctgctagcagc

SEQ ID NO: 553707 - DNA, 25 bp, Rattus norvegicus
ctagcagcgaggtctatctctgccc

SEQ ID NO: 553708 - DNA, 25 bp, Rattus norvegicus
aaggcaactagcagcgaggtctatc

SEQ ID NO: 553709 - DNA, 25 bp, Rattus norvegicus
agttccggcgctccctcatcagttt

SEQ ID NO: 553710 - DNA, 25 bp, Rattus norvegicus
gaaccgctcacagtatggcccgatg

SEQ ID NO: 553711 - DNA, 25 bp, Rattus norvegicus
tatggcccgatgctgcttctacacg

SEQ ID NO: 553712 - DNA, 25 bp, Rattus norvegicus
ctggcccgtgaaccgctcacagtat

SEQ ID NO: 553713 - DNA, 25 bp, Rattus norvegicus
ctgcagggcacatgactggaggcct

SEQ ID NO: 553714 - DNA, 25 bp, Rattus norvegicus
tgcagcagcccgagaaaacgaaagc

SEQ ID NO: 553715 - DNA, 25 bp, Rattus norvegicus
aaacgaaagccaggcgatcccagca

SEQ ID NO: 553716 - DNA, 25 bp, Rattus norvegicus
cgatcgcgcgggctctgtgctccga

SEQ ID NO: 553717 - DNA, 25 bp, Rattus norvegicus
gtgctcgcctggtgcctactccagg

SEQ ID NO: 553718 - DNA, 25 bp, Rattus norvegicus
gccctggagctttgggcgactgcta

SEQ ID NO: 553719 - DNA, 25 bp, Rattus norvegicus
ctttgggcgactgctacgcggcctt

SEQ ID NO: 553720 - DNA, 25 bp, Rattus norvegicus
cggccttggccgaggctcttccttg

SEQ ID NO: 553721 - DNA, 25 bp, Rattus norvegicus
aggctcttccttgctcgccgttctg

SEQ ID NO: 553722 - DNA, 25 bp, Rattus norvegicus
ttgctcgccgttctgtcgcgggcct

SEQ ID NO: 553723 - DNA, 25 bp, Rattus norvegicus
gtgaccgctccacctgcagggagag

SEQ ID NO: 553724 - DNA, 25 bp, Rattus norvegicus
ctggggatcacatggcacgcttatc

SEQ ID NO: 553725 - DNA, 25 bp, Rattus norvegicus
ctgcccagacgggtaaggctgcccg

SEQ ID NO: 553726 - DNA, 25 bp, Rattus norvegicus
cctcctccgcttaggccaggaagga

SEQ ID NO: 553727 - DNA, 25 bp, Rattus norvegicus
tttcccagccggaggaaagagcgga

SEQ ID NO: 553728 - DNA, 25 bp, Rattus norvegicus
gccggggaccacttaagtgctgctc

SEQ ID NO: 553729 - DNA, 25 bp, Rattus norvegicus
gctgctcccgcgacatggcattcaa

SEQ ID NO: 553730 - DNA, 25 bp, Rattus norvegicus
tggcattcaattttggggctccttc

SEQ ID NO: 553731 - DNA, 25 bp, Rattus norvegicus
tcaattttggggctccttcgggcac

SEQ ID NO: 553732 - DNA, 25 bp, Rattus norvegicus
gtgagtcagccctggtcctaccttc

SEQ ID NO: 553733 - DNA, 25 bp, Rattus norvegicus
cctcgatccgatcggtccggctggg

SEQ ID NO: 553734 - DNA, 25 bp, Rattus norvegicus
gggcactcccgacaccttggggaca

SEQ ID NO: 553735 - DNA, 25 bp, Rattus norvegicus
cgacaccttggggacatttggaaag

SEQ ID NO: 553736 - DNA, 25 bp, Rattus norvegicus
acatggcacgcttatcccgcgtggc

SEQ ID NO: 553737 - DNA, 25 bp, Rattus norvegicus
ttgcttcccgccattggggtgttcg

SEQ ID NO: 553738 - DNA, 25 bp, Rattus norvegicus
acccgccggcctatgtcgaggaggt

SEQ ID NO: 553739 - DNA, 25 bp, Rattus norvegicus
gtgtcccacgtgctgtttccgggta

SEQ ID NO: 553740 - DNA, 25 bp, Rattus norvegicus
taccctaggaaacacgagtctaagc

SEQ ID NO: 553741 - DNA, 25 bp, Rattus norvegicus
tgacagaggcctacgttttccaaga

SEQ ID NO: 553742 - DNA, 25 bp, Rattus norvegicus
acgttttccaagaactgctcgccag

SEQ ID NO: 553743 - DNA, 25 bp, Rattus norvegicus
tcgccagggagcctatctacagcca

SEQ ID NO: 553744 - DNA, 25 bp, Rattus norvegicus
acagccaccatgtccgggaggaaca

SEQ ID NO: 553745 - DNA, 25 bp, Rattus norvegicus
gaggaacaacaacaagctgcccagc

SEQ ID NO: 553746 - DNA, 25 bp, Rattus norvegicus
cactctaaaacctgttgcctccggg

SEQ ID NO: 553747 - DNA, 25 bp, Rattus norvegicus
cagaacctgatcaagcgggacccgc

SEQ ID NO: 553748 - DNA, 25 bp, Rattus norvegicus
tcaccgggatgctcccgtgagcttc

SEQ ID NO: 553749 - DNA, 25 bp, Rattus norvegicus
ctaaggacttgtttcccaccacttg

SEQ ID NO: 553750 - DNA, 25 bp, Rattus norvegicus
accacttgtaaatatgcttccctgc

SEQ ID NO: 553751 - DNA, 25 bp, Rattus norvegicus
aacctgccgcagttacagaacctga

SEQ ID NO: 553752 - DNA, 25 bp, Rattus norvegicus
cgctacgcagctggcagcgaaggcc

SEQ ID NO: 553753 - DNA, 25 bp, Rattus norvegicus
gctccctgatgacgtttcccgcgga

SEQ ID NO: 553754 - DNA, 25 bp, Rattus norvegicus
ctgtcaagatctagcttccggcgcg

SEQ ID NO: 553755 - DNA, 25 bp, Rattus norvegicus
cccgtccgctcaggattccaaattt

SEQ ID NO: 553756 - DNA, 25 bp, Rattus norvegicus
ggtcatcctcgacggagtcctggcc

SEQ ID NO: 553757 - DNA, 25 bp, Rattus norvegicus
agagcgtagccggtcgctccctgat

SEQ ID NO: 553758 - DNA, 25 bp, Rattus norvegicus
gcgcccgcgcatgggaaatacgtca

SEQ ID NO: 553759 - DNA, 25 bp, Rattus norvegicus
gcgggaccgcaggatattaagtgta

SEQ ID NO: 553760 - DNA, 25 bp, Rattus norvegicus
aatcacctcaatcgctacgcagctg

SEQ ID NO: 553761 - DNA, 25 bp, Rattus norvegicus
tctggcagaggaacgcacaggagct

SEQ ID NO: 553762 - DNA, 25 bp, Rattus norvegicus
accatgctccggtctggcagaggaa

SEQ ID NO: 553763 - DNA, 25 bp, Rattus norvegicus
gggtctctgcaccatgctccggtct

SEQ ID NO: 553764 - DNA, 25 bp, Rattus norvegicus
ctatacctgctacgggttcgggcgc

SEQ ID NO: 553765 - DNA, 25 bp, Rattus norvegicus
tggtccattcaggagcctggctttc

SEQ ID NO: 553766 - DNA, 25 bp, Rattus norvegicus
gctggctgccgatgctgcagcacta

SEQ ID NO: 553767 - DNA, 25 bp, Rattus norvegicus
ctgttctgtgcagcgcccaacggat

SEQ ID NO: 553768 - DNA, 25 bp, Rattus norvegicus
cgcccaacggatggctgacacagca

SEQ ID NO: 553769 - DNA, 25 bp, Rattus norvegicus
gtccggtgaacttgcagtcaagctc

SEQ ID NO: 553770 - DNA, 25 bp, Rattus norvegicus
tctccaacactacaaaagctcattg

SEQ ID NO: 553771 - DNA, 25 bp, Rattus norvegicus
gcagcactacgacccagacttcgtg

SEQ ID NO: 553772 - DNA, 25 bp, Rattus norvegicus
caaaagctcattggtcaggtagtga

SEQ ID NO: 553773 - DNA, 25 bp, Rattus norvegicus
ttcaacgtcagtctggacgcggccc

SEQ ID NO: 553774 - DNA, 25 bp, Rattus norvegicus
cgcctctcttcaacgtcagtctgga

SEQ ID NO: 553775 - DNA, 25 bp, Rattus norvegicus
tgctgtcgctgtcggatccctggct

SEQ ID NO: 553776 - DNA, 25 bp, Rattus norvegicus
cacacctggcgctggctctgttgct

SEQ ID NO: 553777 - DNA, 25 bp, Rattus norvegicus
aggtagtgacctcagcagcccgagc

SEQ ID NO: 553778 - DNA, 25 bp, Rattus norvegicus
acttgcagtcaagctccgctctttc

SEQ ID NO: 553779 - DNA, 25 bp, Rattus norvegicus
agcgcgggacaagtccggtgaactt

SEQ ID NO: 553780 - DNA, 25 bp, Rattus norvegicus
ttagactacgcgcttgggctggtag

SEQ ID NO: 553781 - DNA, 25 bp, Rattus norvegicus
cttctgtgtgctggggtccggcact

SEQ ID NO: 553782 - DNA, 25 bp, Rattus norvegicus
ccctgaagccctcctgtcactacgg

SEQ ID NO: 553783 - DNA, 25 bp, Rattus norvegicus
gcgtggatgccctgttctctcccag

SEQ ID NO: 553784 - DNA, 25 bp, Rattus norvegicus
tgcgctcaccgtctcagcttctgtg

SEQ ID NO: 553785 - DNA, 25 bp, Rattus norvegicus
caccgtctcagcttctgtgtgctgg

SEQ ID NO: 553786 - DNA, 25 bp, Rattus norvegicus
ctcagattagactacgcgcttgggc

SEQ ID NO: 553787 - DNA, 25 bp, Rattus norvegicus
gaaattcatctcgtcgctcagccgc

SEQ ID NO: 553788 - DNA, 25 bp, Rattus norvegicus
gccaccgcagcctcctactcagcag

SEQ ID NO: 553789 - DNA, 25 bp, Rattus norvegicus
tgagcccggaaacagccaccgccgc

SEQ ID NO: 553790 - DNA, 25 bp, Rattus norvegicus
cagcaggcctgccaccacaggggca

SEQ ID NO: 553791 - DNA, 25 bp, Rattus norvegicus
tgcccagtcggctccggaggctcag

SEQ ID NO: 553792 - DNA, 25 bp, Rattus norvegicus
ctccggaggctcagattagactacg

SEQ ID NO: 553793 - DNA, 25 bp, Rattus norvegicus
cccgcggaggaaattcatctcgtcg

SEQ ID NO: 553794 - DNA, 25 bp, Rattus norvegicus
cgcagatgcgaaagtagcggcctcc

SEQ ID NO: 553795 - DNA, 25 bp, Rattus norvegicus
ctggctttccggacacccgagtgag

SEQ ID NO: 553796 - DNA, 25 bp, Rattus norvegicus
ttctgtgcccggaaactgaatccgg

SEQ ID NO: 553797 - DNA, 25 bp, Rattus norvegicus
tctccgctcgtttgcggccctagtt

SEQ ID NO: 553798 - DNA, 25 bp, Rattus norvegicus
cgcagcttccagagtgcgccgacgg

SEQ ID NO: 553799 - DNA, 25 bp, Rattus norvegicus
agccgggcctttccttgcaaggtga

SEQ ID NO: 553800 - DNA, 25 bp, Rattus norvegicus
ctgcctacgccagcaggagtgcgtg

SEQ ID NO: 553801 - DNA, 25 bp, Rattus norvegicus
aaacattgttctcgccggctgccta

SEQ ID NO: 553802 - DNA, 25 bp, Rattus norvegicus
ttggtgcggcagaaacattgttctc

SEQ ID NO: 553803 - DNA, 25 bp, Rattus norvegicus
attccgaagcctcgggttgattcga

SEQ ID NO: 553804 - DNA, 25 bp, Rattus norvegicus
agctcgctgctctctggattccgaa

SEQ ID NO: 553805 - DNA, 25 bp, Rattus norvegicus
gttctcggagctcgttgcagctcta

SEQ ID NO: 553806 - DNA, 25 bp, Rattus norvegicus
caaactgatgcctgattggctggcg

SEQ ID NO: 553807 - DNA, 25 bp, Rattus norvegicus
ctgggtccagctctccaaactgatg

SEQ ID NO: 553808 - DNA, 25 bp, Rattus norvegicus
ccgcttgttcgcacacgcgaactaa

SEQ ID NO: 553809 - DNA, 25 bp, Rattus norvegicus
agggcctctgctgttcaggctacgc

SEQ ID NO: 553810 - DNA, 25 bp, Rattus norvegicus
agccctcttagggtctgaccttgga

SEQ ID NO: 553811 - DNA, 25 bp, Rattus norvegicus
gtctgaccttggacgagctctttta

SEQ ID NO: 553812 - DNA, 25 bp, Rattus norvegicus
gcctgcaacgcagccctcttagggt

SEQ ID NO: 553813 - DNA, 25 bp, Rattus norvegicus
gggctctcagtcttggcttgtgatt

SEQ ID NO: 553814 - DNA, 25 bp, Rattus norvegicus
gctacgaggtccactggcgaccgca

SEQ ID NO: 553815 - DNA, 25 bp, Rattus norvegicus
cccagggctgaacgggtcgccgtca

SEQ ID NO: 553816 - DNA, 25 bp, Rattus norvegicus
tggggcgcccttttgttctttgcgc

SEQ ID NO: 553817 - DNA, 25 bp, Rattus norvegicus
cgcccttctctagcaaggaacatca

SEQ ID NO: 553818 - DNA, 25 bp, Rattus norvegicus
gcttgtgattggtcgatgtgtaacc

SEQ ID NO: 553819 - DNA, 25 bp, Rattus norvegicus
tgtgtaaccaattagagggcctctg

SEQ ID NO: 553820 - DNA, 25 bp, Rattus norvegicus
caggctacgccgattggccaagaga

SEQ ID NO: 553821 - DNA, 25 bp, Rattus norvegicus
cgagctcttttattctccgttcccg

SEQ ID NO: 553822 - DNA, 25 bp, Rattus norvegicus
tcgtgacggaagagggccccctcca

SEQ ID NO: 553823 - DNA, 25 bp, Rattus norvegicus
cgcagggatatcaggcgcaatgatc

SEQ ID NO: 553824 - DNA, 25 bp, Rattus norvegicus
gatatcaggcgcaatgatcggggtc

SEQ ID NO: 553825 - DNA, 25 bp, Rattus norvegicus
caatgatcggggtcctggtggtcca

SEQ ID NO: 553826 - DNA, 25 bp, Rattus norvegicus
tccacgaggcggcatgacacagaaa

SEQ ID NO: 553827 - DNA, 25 bp, Rattus norvegicus
gatgaccgcagggatatcaggcgca

SEQ ID NO: 553828 - DNA, 25 bp, Rattus norvegicus
aatgatgcgtgatcgtgacggaaga

SEQ ID NO: 553829 - DNA, 25 bp, Rattus norvegicus
aaggccgcttcacaggacagcgtcg

SEQ ID NO: 553830 - DNA, 25 bp, Rattus norvegicus
atggaaggccgcttcacaggacagc

SEQ ID NO: 553831 - DNA, 25 bp, Rattus norvegicus
accgggcaaatggaaggccgcttca

SEQ ID NO: 553832 - DNA, 25 bp, Rattus norvegicus
ttctggaagaggaaccgggcaaatg

SEQ ID NO: 553833 - DNA, 25 bp, Rattus norvegicus
gcggcatgacacagaaacttggttc

SEQ ID NO: 553834 - DNA, 25 bp, Rattus norvegicus
cgaggcggcatgacacagaaacttg

SEQ ID NO: 553835 - DNA, 25 bp, Rattus norvegicus
tcctggtggtccacgtggaattgtg

SEQ ID NO: 553836 - DNA, 25 bp, Rattus norvegicus
tctctctggagactgcctatggctg

SEQ ID NO: 553837 - DNA, 25 bp, Rattus norvegicus
cagctgatcgaacctgtgggctcca

SEQ ID NO: 553838 - DNA, 25 bp, Rattus norvegicus
cggagccaatcataacgcctgacga

SEQ ID NO: 553839 - DNA, 25 bp, Rattus norvegicus
caggcctcagccaaccaggatcagg

SEQ ID NO: 553840 - DNA, 25 bp, Rattus norvegicus
aacgccttcgcccagggctacttga

SEQ ID NO: 553841 - DNA, 25 bp, Rattus norvegicus
gctacttgacgaggtgctgcttccc

SEQ ID NO: 553842 - DNA, 25 bp, Rattus norvegicus
tttgacaggcggtgttctctttccc

SEQ ID NO: 553843 - DNA, 25 bp, Rattus norvegicus
ttctctgcagctcttggccgtgaca

SEQ ID NO: 553844 - DNA, 25 bp, Rattus norvegicus
cgacggacaggtctctacaaactta

SEQ ID NO: 553845 - DNA, 25 bp, Rattus norvegicus
agacgcattctgactcgggcccttc

SEQ ID NO: 553846 - DNA, 25 bp, Rattus norvegicus
cggcagtcctcggaagtgtgagctt

SEQ ID NO: 553847 - DNA, 25 bp, Rattus norvegicus
cttggctcttctcgtgaccacgcga

SEQ ID NO: 553848 - DNA, 25 bp, Rattus norvegicus
gggaaatctcacagtctcctcagtc

SEQ ID NO: 553849 - DNA, 25 bp, Rattus norvegicus
tgctagtgtccgtgcctgtcacaga

SEQ ID NO: 553850 - DNA, 25 bp, Rattus norvegicus
acgtcgacgacggaataagcgtctc

SEQ ID NO: 553851 - DNA, 25 bp, Rattus norvegicus
tagaaccgaccaaccgcgggctcta

SEQ ID NO: 553852 - DNA, 25 bp, Rattus norvegicus
ccgcaatctgggctggcagcaatgg

SEQ ID NO: 553853 - DNA, 25 bp, Rattus norvegicus
ggaagaagagccaacctaagagtta

SEQ ID NO: 553854 - DNA, 25 bp, Rattus norvegicus
ttagcagcgacgacagcgactaacg

SEQ ID NO: 553855 - DNA, 25 bp, Rattus norvegicus
taagcgtctcacttggctttcgccc

SEQ ID NO: 553856 - DNA, 25 bp, Rattus norvegicus
aggaaccggacatccggctgctcca

SEQ ID NO: 553857 - DNA, 25 bp, Rattus norvegicus
ccggctgctccagatcacgtgatca

SEQ ID NO: 553858 - DNA, 25 bp, Rattus norvegicus
gtgatcatccgccatattgactgta

SEQ ID NO: 553859 - DNA, 25 bp, Rattus norvegicus
attgactgtagtggcctctgctccg

SEQ ID NO: 553860 - DNA, 25 bp, Rattus norvegicus
cagaccggctctgcttctttaaggc

SEQ ID NO: 553861 - DNA, 25 bp, Rattus norvegicus
tctttaaggcgtggcttccaagctg

SEQ ID NO: 553862 - DNA, 25 bp, Rattus norvegicus
taagagttattaccgttagcagcga

SEQ ID NO: 553863 - DNA, 25 bp, Rattus norvegicus
accaaccgcgggctctaggagctgc

SEQ ID NO: 553864 - DNA, 25 bp, Rattus norvegicus
acctggtgcggcttctcagcactta

SEQ ID NO: 553865 - DNA, 25 bp, Rattus norvegicus
ttgcgcgtcaccgttacacgccgga

SEQ ID NO: 553866 - DNA, 25 bp, Rattus norvegicus
gccgagacccatcgatgacagaatc

SEQ ID NO: 553867 - DNA, 25 bp, Rattus norvegicus
tttgttgtccggctaccagtcacct

SEQ ID NO: 553868 - DNA, 25 bp, Rattus norvegicus
tgtcgagctgctggataatatctgg

SEQ ID NO: 553869 - DNA, 25 bp, Rattus norvegicus
acttagaatttcgacctggtgacgc

SEQ ID NO: 553870 - DNA, 25 bp, Rattus norvegicus
attcttagccttttagccctggagc

SEQ ID NO: 553871 - DNA, 25 bp, Rattus norvegicus
ggtccactaaaacgcagcaggaatc

SEQ ID NO: 553872 - DNA, 25 bp, Rattus norvegicus
acccaggacccgcattgagtacata

SEQ ID NO: 553873 - DNA, 25 bp, Rattus norvegicus
cagactaccaatgccggtgcggatg

SEQ ID NO: 553874 - DNA, 25 bp, Rattus norvegicus
ttaactacatggatggcagactacc

SEQ ID NO: 553875 - DNA, 25 bp, Rattus norvegicus
gctgtcaccgcgatgtttctaaccg

SEQ ID NO: 553876 - DNA, 25 bp, Rattus norvegicus
cgcagatcgatctgggtccactaaa

SEQ ID NO: 553877 - DNA, 25 bp, Rattus norvegicus
ccctggagctctaagggagaacaaa

SEQ ID NO: 553878 - DNA, 25 bp, Rattus norvegicus
gacagcactgagagcgccagcgaaa

SEQ ID NO: 553879 - DNA, 25 bp, Rattus norvegicus
tgagcactttatagacccgcgggaa

SEQ ID NO: 553880 - DNA, 25 bp, Rattus norvegicus
gcactttatagacccgcgggaacca

SEQ ID NO: 553881 - DNA, 25 bp, Rattus norvegicus
gccagcgaaagcgacggagttctca

SEQ ID NO: 553882 - DNA, 25 bp, Rattus norvegicus
ggtgcggtgagcactttatagaccc

SEQ ID NO: 553883 - DNA, 25 bp, Rattus norvegicus
ggagttctcattggttccgcggccc

SEQ ID NO: 553884 - DNA, 25 bp, Rattus norvegicus
ctctgcggcaacacgacagcggctc

SEQ ID NO: 553885 - DNA, 25 bp, Rattus norvegicus
ccggaacagcggaaccgcgaagcaa

SEQ ID NO: 553886 - DNA, 25 bp, Rattus norvegicus
agtcaggaaggagcagagcgaactt

SEQ ID NO: 553887 - DNA, 25 bp, Rattus norvegicus
cagcgcctagggctcggctcaaaat

SEQ ID NO: 553888 - DNA, 25 bp, Rattus norvegicus
cctagggctcggctcaaaatgacag

SEQ ID NO: 553889 - DNA, 25 bp, Rattus norvegicus
ctcaaaatgacagggcagcggccgc

SEQ ID NO: 553890 - DNA, 25 bp, Rattus norvegicus
gggctcggctcaaaatgacagggca

SEQ ID NO: 553891 - DNA, 25 bp, Rattus norvegicus
gcgaaagcgacggagttctcattgg

SEQ ID NO: 553892 - DNA, 25 bp, Rattus norvegicus
gtcagctctgcgacacgtccggggc

SEQ ID NO: 553893 - DNA, 25 bp, Rattus norvegicus
ctcgcgcaggccctcggcccaggcg

SEQ ID NO: 553894 - DNA, 25 bp, Rattus norvegicus
caccgttccgcgtgctccgcgtgct

SEQ ID NO: 553895 - DNA, 25 bp, Rattus norvegicus
cgcagctcctaccttcggctgctgc

SEQ ID NO: 553896 - DNA, 25 bp, Rattus norvegicus
tcctaccttcggctgctgctcccga

SEQ ID NO: 553897 - DNA, 25 bp, Rattus norvegicus
acgcgcgctccgctacgcccggggc

SEQ ID NO: 553898 - DNA, 25 bp, Rattus norvegicus
gccctcagcagggttccggggcgcg

SEQ ID NO: 553899 - DNA, 25 bp, Rattus norvegicus
tacgcccggggctcgcgcaggccct

SEQ ID NO: 553900 - DNA, 25 bp, Rattus norvegicus
cagcgacaagccacgggcccgcgtc

SEQ ID NO: 553901 - DNA, 25 bp, Rattus norvegicus
cgtcgccatgcctcgccgtccgcct

SEQ ID NO: 553902 - DNA, 25 bp, Rattus norvegicus
ggtcctgcggtcagctctgcgacac

SEQ ID NO: 553903 - DNA, 25 bp, Rattus norvegicus
tgcggtcagctctgcgacacgtccg

SEQ ID NO: 553904 - DNA, 25 bp, Rattus norvegicus
acacgtccggggccctcagcagggt

SEQ ID NO: 553905 - DNA, 25 bp, Rattus norvegicus
tggcgggcgactcggctgcgacccg

SEQ ID NO: 553906 - DNA, 25 bp, Rattus norvegicus
aagacaagccatccaggcactcgct

SEQ ID NO: 553907 - DNA, 25 bp, Rattus norvegicus
gctgatggcgtcactcgcgcttccg

SEQ ID NO: 553908 - DNA, 25 bp, Rattus norvegicus
ccaggcactcgctcgttcgcttgct

SEQ ID NO: 553909 - DNA, 25 bp, Rattus norvegicus
cttagtatcgcgagacgaggtgaga

SEQ ID NO: 553910 - DNA, 25 bp, Rattus norvegicus
ggcccgctgctctccatcccactgc

SEQ ID NO: 553911 - DNA, 25 bp, Rattus norvegicus
cacctcccggatctggaggccaggc

SEQ ID NO: 553912 - DNA, 25 bp, Rattus norvegicus
tccgcctgcggctgcgttctaatca

SEQ ID NO: 553913 - DNA, 25 bp, Rattus norvegicus
tttggagaagcaggcagagatcctc

SEQ ID NO: 553914 - DNA, 25 bp, Rattus norvegicus
agcaggcagagatcctcgcgcggcc

SEQ ID NO: 553915 - DNA, 25 bp, Rattus norvegicus
cctggagtctgcactttggagaagc

SEQ ID NO: 553916 - DNA, 25 bp, Rattus norvegicus
cccgcccttagtatcgcgagacgag

SEQ ID NO: 553917 - DNA, 25 bp, Rattus norvegicus
ggaagccattctaggcgcacttccc

SEQ ID NO: 553918 - DNA, 25 bp, Rattus norvegicus
ccagggaagccattctaggcgcact

SEQ ID NO: 553919 - DNA, 25 bp, Rattus norvegicus
gctcagactcggtttccccagggaa

SEQ ID NO: 553920 - DNA, 25 bp, Rattus norvegicus
tttgccgcaagctgatcccgacacg

SEQ ID NO: 553921 - DNA, 25 bp, Rattus norvegicus
accaagtggacagggccgaaaacag

SEQ ID NO: 553922 - DNA, 25 bp, Rattus norvegicus
cgcacgctggctgcctgggaaccaa

SEQ ID NO: 553923 - DNA, 25 bp, Rattus norvegicus
cgaagccgcagctgaacgcacgctg

SEQ ID NO: 553924 - DNA, 25 bp, Rattus norvegicus
tcacaacatgtctgccgaagccgca

SEQ ID NO: 553925 - DNA, 25 bp, Rattus norvegicus
actagcagcggttgcagccgcctcg

SEQ ID NO: 553926 - DNA, 25 bp, Rattus norvegicus
accacagcagggtcggctctacaga

SEQ ID NO: 553927 - DNA, 25 bp, Rattus norvegicus
gcgcacgcaagaccgaggagtaccc

SEQ ID NO: 553928 - DNA, 25 bp, Rattus norvegicus
tcgcctcaaacggactggcgctgtc

SEQ ID NO: 553929 - DNA, 25 bp, Rattus norvegicus
acgctttgcgccaccggaagtctca

SEQ ID NO: 553930 - DNA, 25 bp, Rattus norvegicus
cggcgctaacggtggtctttctacg

SEQ ID NO: 553931 - DNA, 25 bp, Rattus norvegicus
tcctcgacggatttccgagtgctcg

SEQ ID NO: 553932 - DNA, 25 bp, Rattus norvegicus
gcgtttcctcaatcaggccctaggg

SEQ ID NO: 553933 - DNA, 25 bp, Rattus norvegicus
ggcgctgtcgcctaaccgaacctaa

SEQ ID NO: 553934 - DNA, 25 bp, Rattus norvegicus
tcctgatggccaaggtctaggtgtc

SEQ ID NO: 553935 - DNA, 25 bp, Rattus norvegicus
ggttgctccggtcgctgcgcacctt

SEQ ID NO: 553936 - DNA, 25 bp, Rattus norvegicus
ccatgctatgcggatcgtgtgccgg

SEQ ID NO: 553937 - DNA, 25 bp, Rattus norvegicus
tctagccatgctatgcggatcgtgt

SEQ ID NO: 553938 - DNA, 25 bp, Rattus norvegicus
cgcccgtcgtgtctagccatgctat

SEQ ID NO: 553939 - DNA, 25 bp, Rattus norvegicus
aaggtctaggtgtcttcctcgctga

SEQ ID NO: 553940 - DNA, 25 bp, Rattus norvegicus
tgcgctcagcctcctgatggccaag

SEQ ID NO: 553941 - DNA, 25 bp, Rattus norvegicus
gggcctcagactggcgcatgcgctc

SEQ ID NO: 553942 - DNA, 25 bp, Rattus norvegicus
atcgctttggctgagtaggtaaggc

SEQ ID NO: 553943 - DNA, 25 bp, Rattus norvegicus
cgacgctggacttcatcgctttggc

SEQ ID NO: 553944 - DNA, 25 bp, Rattus norvegicus
acgtcatctctagcgcgacgctgga

SEQ ID NO: 553945 - DNA, 25 bp, Rattus norvegicus
gaaaggcggggcctacgtcatctct

SEQ ID NO: 553946 - DNA, 25 bp, Rattus norvegicus
aagctgctttgtgccgcgtgggaaa

SEQ ID NO: 553947 - DNA, 25 bp, Rattus norvegicus
aggtgtcttcctcgctgacctgccg

SEQ ID NO: 553948 - DNA, 25 bp, Rattus norvegicus
ggtccaggcggcgctttcgtagccc

SEQ ID NO: 553949 - DNA, 25 bp, Rattus norvegicus
cacggtgctccgagagcctcgcaaa

SEQ ID NO: 553950 - DNA, 25 bp, Rattus norvegicus
atctcggtgcttagcctcggcggcc

SEQ ID NO: 553951 - DNA, 25 bp, Rattus norvegicus
gagccatctcggtgcttagcctcgg

SEQ ID NO: 553952 - DNA, 25 bp, Rattus norvegicus
gggacccgagccatctcggtgctta

SEQ ID NO: 553953 - DNA, 25 bp, Rattus norvegicus
tcctgggacccgagccatctcggtg

SEQ ID NO: 553954 - DNA, 25 bp, Rattus norvegicus
aggatccagggctcgcgctgcctct

SEQ ID NO: 553955 - DNA, 25 bp, Rattus norvegicus
tcggtcgccttattagcgcccggcg

SEQ ID NO: 553956 - DNA, 25 bp, Rattus norvegicus
agtgcgagtcctgaccctgcgccgg

SEQ ID NO: 553957 - DNA, 25 bp, Rattus norvegicus
tgctccgagagcctcgcaaaagcag

SEQ ID NO: 553958 - DNA, 25 bp, Rattus norvegicus
ccgggacagtgcgagtcctgaccct

SEQ ID NO: 553959 - DNA, 25 bp, Rattus norvegicus
gggtgactcggtcgccttattagcg

SEQ ID NO: 553960 - DNA, 25 bp, Rattus norvegicus
cccatcacggagaccaaggggatgc

SEQ ID NO: 553961 - DNA, 25 bp, Rattus norvegicus
ctcgtcccatcacggagaccaaggg

SEQ ID NO: 553962 - DNA, 25 bp, Rattus norvegicus
ctaaactatagccagcagccgcgcg

SEQ ID NO: 553963 - DNA, 25 bp, Rattus norvegicus
acagactgttggatcctgcggtccc

SEQ ID NO: 553964 - DNA, 25 bp, Rattus norvegicus
ggaactgggctgaccacccgcgtcg

SEQ ID NO: 553965 - DNA, 25 bp, Rattus norvegicus
agaccggctcgcattccagaatttc

SEQ ID NO: 553966 - DNA, 25 bp, Rattus norvegicus
agaatttcccatcccttgtccgcag

SEQ ID NO: 553967 - DNA, 25 bp, Rattus norvegicus
ttgtccgcagcacctcgccgagaga

SEQ ID NO: 553968 - DNA, 25 bp, Rattus norvegicus
gaacggcagcccgagccaatcaatg

SEQ ID NO: 553969 - DNA, 25 bp, Rattus norvegicus
gagatgcacacacagctaaactata

SEQ ID NO: 553970 - DNA, 25 bp, Rattus norvegicus
cctattggttgagagaacggcagcc

SEQ ID NO: 553971 - DNA, 25 bp, Rattus norvegicus
tccgagcgcttacttggaatgcggt

SEQ ID NO: 553972 - DNA, 25 bp, Rattus norvegicus
tgcacagcatccgagcgcttacttg

SEQ ID NO: 553973 - DNA, 25 bp, Rattus norvegicus
ttcgagacttaagctgaacagactg

SEQ ID NO: 553974 - DNA, 25 bp, Rattus norvegicus
gcccgagccaatcaatgcacagcat

SEQ ID NO: 553975 - DNA, 25 bp, Rattus norvegicus
ctcgccgagagacgcagagatgcac

SEQ ID NO: 553976 - DNA, 25 bp, Rattus norvegicus
ccaggtgtgagactggagccagatc

SEQ ID NO: 553977 - DNA, 25 bp, Rattus norvegicus
cgctctggcgagaagttagggtcgc

SEQ ID NO: 553978 - DNA, 25 bp, Rattus norvegicus
ccacttttcgcgagggcgctccggg

SEQ ID NO: 553979 - DNA, 25 bp, Rattus norvegicus
atcctagcgggccaccaggctgtac

SEQ ID NO: 553980 - DNA, 25 bp, Rattus norvegicus
gatctcatcctagcgggccaccagg

SEQ ID NO: 553981 - DNA, 25 bp, Rattus norvegicus
agatctcatcctagcgggccaccag

SEQ ID NO: 553982 - DNA, 25 bp, Rattus norvegicus
agccagatctcatcctagcgggcca

SEQ ID NO: 553983 - DNA, 25 bp, Rattus norvegicus
ggagccagatctcatcctagcgggc

SEQ ID NO: 553984 - DNA, 25 bp, Rattus norvegicus
tggagccagatctcatcctagcggg

SEQ ID NO: 553985 - DNA, 25 bp, Rattus norvegicus
gactggagccagatctcatcctagc

SEQ ID NO: 553986 - DNA, 25 bp, Rattus norvegicus
gagactggagccagatctcatccta

SEQ ID NO: 553987 - DNA, 25 bp, Rattus norvegicus
tgtgagactggagccagatctcatc

SEQ ID NO: 553988 - DNA, 25 bp, Rattus norvegicus
aggtgtgagactggagccagatctc

SEQ ID NO: 553989 - DNA, 25 bp, Rattus norvegicus
ctccgggcgctctggcgagaagtta

SEQ ID NO: 553990 - DNA, 25 bp, Rattus norvegicus
gctcatcacacttggggattcctta

SEQ ID NO: 553991 - DNA, 25 bp, Rattus norvegicus
tcactgcaccggagtttggacagcc

SEQ ID NO: 553992 - DNA, 25 bp, Rattus norvegicus
tgcaccggagtttggacagccctcc

SEQ ID NO: 553993 - DNA, 25 bp, Rattus norvegicus
ggagagcccgagctcatcacacttg

SEQ ID NO: 553994 - DNA, 25 bp, Rattus norvegicus
ccgagctcatcacacttggggattc

SEQ ID NO: 553995 - DNA, 25 bp, Rattus norvegicus
actgcaccggagtttggacagccct

SEQ ID NO: 553996 - DNA, 25 bp, Rattus norvegicus
tcacacttggggattccttagcccg

SEQ ID NO: 553997 - DNA, 25 bp, Rattus norvegicus
acacttggggattccttagcccgcg

SEQ ID NO: 553998 - DNA, 25 bp, Rattus norvegicus
tggggattccttagcccgcggcgac

SEQ ID NO: 553999 - DNA, 25 bp, Rattus norvegicus
tagcccgcggcgaccagaaacggtc

SEQ ID NO: 554000 - DNA, 25 bp, Rattus norvegicus
cgcggcgaccagaaacggtccaggt

SEQ ID NO: 554001 - DNA, 25 bp, Rattus norvegicus
gggtctcactgcaccggagtttgga

SEQ ID NO: 554002 - DNA, 25 bp, Rattus norvegicus
cctggggtctcactgcaccggagtt

SEQ ID NO: 554003 - DNA, 25 bp, Rattus norvegicus
agcccgagctcatcacacttgggga

SEQ ID NO: 554004 - DNA, 25 bp, Rattus norvegicus
gtcatctgaacgctgagacggaata

SEQ ID NO: 554005 - DNA, 25 bp, Rattus norvegicus
cgctgagacggaataaaaagtactt

SEQ ID NO: 554006 - DNA, 25 bp, Rattus norvegicus
aaagtactttttccgcagcaacagc

SEQ ID NO: 554007 - DNA, 25 bp, Rattus norvegicus
tttccgcagcaacagcggcggtgtc

SEQ ID NO: 554008 - DNA, 25 bp, Rattus norvegicus
aacagcggcggtgtccacacttcgc

SEQ ID NO: 554009 - DNA, 25 bp, Rattus norvegicus
aggcttggagacgtggccgaccctc

SEQ ID NO: 554010 - DNA, 25 bp, Rattus norvegicus
gaaccacccaaagtcgtcatctgaa

SEQ ID NO: 554011 - DNA, 25 bp, Rattus norvegicus
gggcttccgtcgctcctccagtttg

SEQ ID NO: 554012 - DNA, 25 bp, Rattus norvegicus
gctcctccagtttggcgaccgaatg

SEQ ID NO: 554013 - DNA, 25 bp, Rattus norvegicus
tcacctcctgggatcgggcttccgt

SEQ ID NO: 554014 - DNA, 25 bp, Rattus norvegicus
atttaaagcggcgagtggcctcggc

SEQ ID NO: 554015 - DNA, 25 bp, Rattus norvegicus
cgatccatatttaaagcggcgagtg

SEQ ID NO: 554016 - DNA, 25 bp, Rattus norvegicus
cgcgagcccgcgatccatatttaaa

SEQ ID NO: 554017 - DNA, 25 bp, Rattus norvegicus
tttggcgaccgaatgtgaggctgca

SEQ ID NO: 554018 - DNA, 25 bp, Rattus norvegicus
ttcccaacaaaggatgcagtggtcc

SEQ ID NO: 554019 - DNA, 25 bp, Rattus norvegicus
accgatgttcccttcgatggagatc

SEQ ID NO: 554020 - DNA, 25 bp, Rattus norvegicus
ggttcgtttacctacgctacatctc

SEQ ID NO: 554021 - DNA, 25 bp, Rattus norvegicus
cagtggtccagagcgcgcctcacaa

SEQ ID NO: 554022 - DNA, 25 bp, Rattus norvegicus
cgcaccggggacaccttaccgatgt

SEQ ID NO: 554023 - DNA, 25 bp, Rattus norvegicus
agatcttcttgatgcgggtgccctc

SEQ ID NO: 554024 - DNA, 25 bp, Rattus norvegicus
cagaacctcttaggtggggtggcca

SEQ ID NO: 554025 - DNA, 25 bp, Rattus norvegicus
tagctcggggttgcagcgtcaatct

SEQ ID NO: 554026 - DNA, 25 bp, Rattus norvegicus
cagcgtcaatctcgcgccggcggga

SEQ ID NO: 554027 - DNA, 25 bp, Rattus norvegicus
cgggacccgcactttgactttggcg

SEQ ID NO: 554028 - DNA, 25 bp, Rattus norvegicus
tgcacagtgcgcaactccaccggga

SEQ ID NO: 554029 - DNA, 25 bp, Rattus norvegicus
aacccggagagccaggcgactgacc

SEQ ID NO: 554030 - DNA, 25 bp, Rattus norvegicus
ggcgactgaccctgcgcgacgagct

SEQ ID NO: 554031 - DNA, 25 bp, Rattus norvegicus
gggaggaatcgccaagcaccagccc

SEQ ID NO: 554032 - DNA, 25 bp, Rattus norvegicus
gctccacagtgttcggagcctagcg

SEQ ID NO: 554033 - DNA, 25 bp, Rattus norvegicus
gctagctcggcggactggaaaccga

SEQ ID NO: 554034 - DNA, 25 bp, Rattus norvegicus
aagacctggattcggctagctcggc

SEQ ID NO: 554035 - DNA, 25 bp, Rattus norvegicus
caaagccggcgcgaccgggctactt

SEQ ID NO: 554036 - DNA, 25 bp, Rattus norvegicus
cgcgaccgggctacttacaacaaga

SEQ ID NO: 554037 - DNA, 25 bp, Rattus norvegicus
tacaacaagaagctcatgtcggccg

SEQ ID NO: 554038 - DNA, 25 bp, Rattus norvegicus
cgggcctgaatcagaggaaaagcaa

SEQ ID NO: 554039 - DNA, 25 bp, Rattus norvegicus
gacttcttcggcttcgctacttcca

SEQ ID NO: 554040 - DNA, 25 bp, Rattus norvegicus
cgccacaggtttgcccaagcacgtg

SEQ ID NO: 554041 - DNA, 25 bp, Rattus norvegicus
aatggaagacctggattcggctagc

SEQ ID NO: 554042 - DNA, 25 bp, Rattus norvegicus
cggagctgctccacagtgttcggag

SEQ ID NO: 554043 - DNA, 25 bp, Rattus norvegicus
ttgcccaagcacgtggcccggggtc

SEQ ID NO: 554044 - DNA, 25 bp, Rattus norvegicus
tcgggatcaccttcgggtcacctcg

SEQ ID NO: 554045 - DNA, 25 bp, Rattus norvegicus
ttcgctacttccagcggccagcgga

SEQ ID NO: 554046 - DNA, 25 bp, Rattus norvegicus
gtcctcgggcgtccacctgactgaa

SEQ ID NO: 554047 - DNA, 25 bp, Rattus norvegicus
cctgactgaaggtcacctctgcaag

SEQ ID NO: 554048 - DNA, 25 bp, Rattus norvegicus
ccttgttttgttccctccgagtctg

SEQ ID NO: 554049 - DNA, 25 bp, Rattus norvegicus
atgtagaggccttgtttcccgccgg

SEQ ID NO: 554050 - DNA, 25 bp, Rattus norvegicus
ccctagccttatgcccgctggaagt

SEQ ID NO: 554051 - DNA, 25 bp, Rattus norvegicus
ccgctggaagtgaagctgagagacc

SEQ ID NO: 554052 - DNA, 25 bp, Rattus norvegicus
gggtgaatgtagaggccttgtttcc

SEQ ID NO: 554053 - DNA, 25 bp, Rattus norvegicus
cgggcgtccacctgactgaaggtca

SEQ ID NO: 554054 - DNA, 25 bp, Rattus norvegicus
ggcaccggaacaagggacgctctcc

SEQ ID NO: 554055 - DNA, 25 bp, Rattus norvegicus
cgtcctcctattgggcaccggaaca

SEQ ID NO: 554056 - DNA, 25 bp, Rattus norvegicus
cttctgtcggcgagcgcctcgcgtg

SEQ ID NO: 554057 - DNA, 25 bp, Rattus norvegicus
ttactgccaggtacgtggctccgcg

SEQ ID NO: 554058 - DNA, 25 bp, Rattus norvegicus
tgcccttctactcggccgccggcac

SEQ ID NO: 554059 - DNA, 25 bp, Rattus norvegicus
ttatgcccgctggaagtgaagctga

SEQ ID NO: 554060 - DNA, 25 bp, Rattus norvegicus
cgtgcggctcggaaacccagcgaga

SEQ ID NO: 554061 - DNA, 25 bp, Rattus norvegicus
gcgacctaggagtggacgccgccaa

SEQ ID NO: 554062 - DNA, 25 bp, Rattus norvegicus
ctgtgcccaacactcacggtgcttg

SEQ ID NO: 554063 - DNA, 25 bp, Rattus norvegicus
cgctcgggtagctcagtagcaggaa

SEQ ID NO: 554064 - DNA, 25 bp, Rattus norvegicus
gtgtcctggccgcaactttcagcag

SEQ ID NO: 554065 - DNA, 25 bp, Rattus norvegicus
cacggtgcttgcctccgccaccgct

SEQ ID NO: 554066 - DNA, 25 bp, Rattus norvegicus
gggactctgccatctcgctggtggc

SEQ ID NO: 554067 - DNA, 25 bp, Rattus norvegicus
gccatctcgctggtggcttcgcggt

SEQ ID NO: 554068 - DNA, 25 bp, Rattus norvegicus
gcttcgcggtgcagccgcctctcca

SEQ ID NO: 554069 - DNA, 25 bp, Rattus norvegicus
ttccgctggcctctggcgcgcagat

SEQ ID NO: 554070 - DNA, 25 bp, Rattus norvegicus
ctctggcgcgcagattcctctcgat

SEQ ID NO: 554071 - DNA, 25 bp, Rattus norvegicus
gcgcagattcctctcgatcccgggg

SEQ ID NO: 554072 - DNA, 25 bp, Rattus norvegicus
ctccatctcccgggtacagcaggaa

SEQ ID NO: 554073 - DNA, 25 bp, Rattus norvegicus
cagcgaagccggctcctccatctcc

SEQ ID NO: 554074 - DNA, 25 bp, Rattus norvegicus
aatcgtcctcattttcgtccgtggc

SEQ ID NO: 554075 - DNA, 25 bp, Rattus norvegicus
tagacagtttcccagctctcggtta

SEQ ID NO: 554076 - DNA, 25 bp, Rattus norvegicus
gcccagtgagctacgctagacagtt

SEQ ID NO: 554077 - DNA, 25 bp, Rattus norvegicus
tgggcctctacgtctccatgcgtca

SEQ ID NO: 554078 - DNA, 25 bp, Rattus norvegicus
gccgagccttttgtggcgacttccg

SEQ ID NO: 554079 - DNA, 25 bp, Rattus norvegicus
cctttctaaaagcagtcgattccgg

SEQ ID NO: 554080 - DNA, 25 bp, Rattus norvegicus
cgtagtcccgctgtgcctttctaaa

SEQ ID NO: 554081 - DNA, 25 bp, Rattus norvegicus
ggtgaataccggatcccagagtctg

SEQ ID NO: 554082 - DNA, 25 bp, Rattus norvegicus
acgctccacgccacacaagttggtg

SEQ ID NO: 554083 - DNA, 25 bp, Rattus norvegicus
gcaaccggaggttttcagcaccacc

SEQ ID NO: 554084 - DNA, 25 bp, Rattus norvegicus
tgtccgcgcagaaacgattccagca

SEQ ID NO: 554085 - DNA, 25 bp, Rattus norvegicus
cgcgatttccgccacttctgatgtc

SEQ ID NO: 554086 - DNA, 25 bp, Rattus norvegicus
gccgtgatcgcttcaccatggctca

SEQ ID NO: 554087 - DNA, 25 bp, Rattus norvegicus
tcgccatgttgtccaggctagtctc

SEQ ID NO: 554088 - DNA, 25 bp, Rattus norvegicus
gctccgggagtgaagagaactccga

SEQ ID NO: 554089 - DNA, 25 bp, Rattus norvegicus
gaggcgtggtttcagtacatcgaac

SEQ ID NO: 554090 - DNA, 25 bp, Rattus norvegicus
tcgcggaacgtcacagtgcggagca

SEQ ID NO: 554091 - DNA, 25 bp, Rattus norvegicus
gctccgtgtctctcgcggaacgtca

SEQ ID NO: 554092 - DNA, 25 bp, Rattus norvegicus
ttgcgctgtttacgctccgtgtctc

SEQ ID NO: 554093 - DNA, 25 bp, Rattus norvegicus
ctcccgaaatgccttgcgctgttta

SEQ ID NO: 554094 - DNA, 25 bp, Rattus norvegicus
gcctgacctcggacagcgcgggctt

SEQ ID NO: 554095 - DNA, 25 bp, Rattus norvegicus
agcctgcttcctgcgcgaaacaatc

SEQ ID NO: 554096 - DNA, 25 bp, Rattus norvegicus
taaaatggagcctgcttcctgcgcg

SEQ ID NO: 554097 - DNA, 25 bp, Rattus norvegicus
ctttctgttggggattcggccacac

SEQ ID NO: 554098 - DNA, 25 bp, Rattus norvegicus
aggcgcacgagtccgtccgtcagtc

SEQ ID NO: 554099 - DNA, 25 bp, Rattus norvegicus
aactccgagccgaagcaaagccctg

SEQ ID NO: 554100 - DNA, 25 bp, Rattus norvegicus
agcgcgggcttcaatctttctgttg

SEQ ID NO: 554101 - DNA, 25 bp, Rattus norvegicus
aaagccctggccgagatgttaggcg

SEQ ID NO: 554102 - DNA, 25 bp, Rattus norvegicus
cgctgctctaagttccctcggatcg

SEQ ID NO: 554103 - DNA, 25 bp, Rattus norvegicus
cacgaagtggaagcctcggactctc

SEQ ID NO: 554104 - DNA, 25 bp, Rattus norvegicus
gacactgcttccactttccgtggga

SEQ ID NO: 554105 - DNA, 25 bp, Rattus norvegicus
gccgaaaccgacaagtcctctgtga

SEQ ID NO: 554106 - DNA, 25 bp, Rattus norvegicus
ctctgtgaaggaaggatgcgaaacc

SEQ ID NO: 554107 - DNA, 25 bp, Rattus norvegicus
cgttatcgccgccaacgttgattgg

SEQ ID NO: 554108 - DNA, 25 bp, Rattus norvegicus
gccgaggtcacatcggactacattt

SEQ ID NO: 554109 - DNA, 25 bp, Rattus norvegicus
agcgaacctctgaggcgccgagttc

SEQ ID NO: 554110 - DNA, 25 bp, Rattus norvegicus
cgaccgcgaccgaggtgaatctgag

SEQ ID NO: 554111 - DNA, 25 bp, Rattus norvegicus
agcttggaaaacttgccgaccgcga

SEQ ID NO: 554112 - DNA, 25 bp, Rattus norvegicus
tgacatggtcgcctcgcaacagctt

SEQ ID NO: 554113 - DNA, 25 bp, Rattus norvegicus
gaaggagtgcttctaccagcccatg

SEQ ID NO: 554114 - DNA, 25 bp, Rattus norvegicus
cctcggatcgggatttcacagcgga

SEQ ID NO: 554115 - DNA, 25 bp, Rattus norvegicus
aaacgacgctgatcgcagggcatgc

SEQ ID NO: 554116 - DNA, 25 bp, Rattus norvegicus
aacgcggacgaaggctccgttcttg

SEQ ID NO: 554117 - DNA, 25 bp, Rattus norvegicus
ctcagccgaggagactcgctcttcg

SEQ ID NO: 554118 - DNA, 25 bp, Rattus norvegicus
aaggctccgttcttgagttccggcg

SEQ ID NO: 554119 - DNA, 25 bp, Rattus norvegicus
agactcgctcttcgcggttgccggt

SEQ ID NO: 554120 - DNA, 25 bp, Rattus norvegicus
ttgctgcagtctctcggaaggcgat

SEQ ID NO: 554121 - DNA, 25 bp, Rattus norvegicus
tcctgctcctcctggggagcctgcg

SEQ ID NO: 554122 - DNA, 25 bp, Rattus norvegicus
ctgtgaagaagcgtcctgctcctcc

SEQ ID NO: 554123 - DNA, 25 bp, Rattus norvegicus
tttcctgtgaagaagcgtcctgctc

SEQ ID NO: 554124 - DNA, 25 bp, Rattus norvegicus
cagctcggaaccacagggagcaagg

SEQ ID NO: 554125 - DNA, 25 bp, Rattus norvegicus
gtctgagccgttggctgtgctttcc

SEQ ID NO: 554126 - DNA, 25 bp, Rattus norvegicus
ggcgagcaagcgagcaagcgagaga

SEQ ID NO: 554127 - DNA, 25 bp, Rattus norvegicus
ttccctgcctccctgacttgctgca

SEQ ID NO: 554128 - DNA, 25 bp, Rattus norvegicus
aggccacggggcagctcggaaccac

SEQ ID NO: 554129 - DNA, 25 bp, Rattus norvegicus
cgttggctgtgctttcctgtgaaga

SEQ ID NO: 554130 - DNA, 25 bp, Rattus norvegicus
agtgtgagaccgatcgcggcctccc

SEQ ID NO: 554131 - DNA, 25 bp, Rattus norvegicus
cgaagtgtgagaccgatcgcggcct

SEQ ID NO: 554132 - DNA, 25 bp, Rattus norvegicus
gaaagaagtgagcgggccgcttacc

SEQ ID NO: 554133 - DNA, 25 bp, Rattus norvegicus
cccgccgctatttaagcgggagcgg

SEQ ID NO: 554134 - DNA, 25 bp, Rattus norvegicus
cgagctaccccggagaagagtactt

SEQ ID NO: 554135 - DNA, 25 bp, Rattus norvegicus
gcgatctatgcaaggaagccaccga

SEQ ID NO: 554136 - DNA, 25 bp, Rattus norvegicus
cagggcaaagagaagaacagggtat

SEQ ID NO: 554137 - DNA, 25 bp, Rattus norvegicus
gcaaggaagccaccgaatcagcgta

SEQ ID NO: 554138 - DNA, 25 bp, Rattus norvegicus
agccaccgaatcagcgtagtcctca

SEQ ID NO: 554139 - DNA, 25 bp, Rattus norvegicus
aatcagcgtagtcctcacccagccc

SEQ ID NO: 554140 - DNA, 25 bp, Rattus norvegicus
ggagtcctccgctagcgccgagcta

SEQ ID NO: 554141 - DNA, 25 bp, Rattus norvegicus
gaacagggtatacagggagtccact

SEQ ID NO: 554142 - DNA, 25 bp, Rattus norvegicus
tcttccattgcgatctatgcaagga

SEQ ID NO: 554143 - DNA, 25 bp, Rattus norvegicus
cccaaaaaggagtcctccgctagcg

SEQ ID NO: 554144 - DNA, 25 bp, Rattus norvegicus
aaccatggcctcgttccatctggta

SEQ ID NO: 554145 - DNA, 25 bp, Rattus norvegicus
cttttcccgctggccagagtcgggt

SEQ ID NO: 554146 - DNA, 25 bp, Rattus norvegicus
ctgcgtccggcttgtgagaggtgcg

SEQ ID NO: 554147 - DNA, 25 bp, Rattus norvegicus
tctcgtgctcgagcgatcgggacgc

SEQ ID NO: 554148 - DNA, 25 bp, Rattus norvegicus
tcgtctcgtgctcgagcgatcggga

SEQ ID NO: 554149 - DNA, 25 bp, Rattus norvegicus
tcggtcgtctcgtgctcgagcgatc

SEQ ID NO: 554150 - DNA, 25 bp, Rattus norvegicus
agtgagtcggtcgtctcgtgctcga

SEQ ID NO: 554151 - DNA, 25 bp, Rattus norvegicus
atgagtgagtcggtcgtctcgtgct

SEQ ID NO: 554152 - DNA, 25 bp, Rattus norvegicus
tcgggcctgcgcgatgagtgagtcg

SEQ ID NO: 554153 - DNA, 25 bp, Rattus norvegicus
ctcgttccatctggtaagtgcgggt

SEQ ID NO: 554154 - DNA, 25 bp, Rattus norvegicus
atggcctcgttccatctggtaagtg

SEQ ID NO: 554155 - DNA, 25 bp, Rattus norvegicus
cggaaccatggcctcgttccatctg

SEQ ID NO: 554156 - DNA, 25 bp, Rattus norvegicus
gggccggaaccatggcctcgttcca

SEQ ID NO: 554157 - DNA, 25 bp, Rattus norvegicus
ggcctcgttccatctggtaagtgcg

SEQ ID NO: 554158 - DNA, 25 bp, Rattus norvegicus
aggcgtcgtcgagaggattctttac

SEQ ID NO: 554159 - DNA, 25 bp, Rattus norvegicus
tctcggaaaccgctaggcaacactc

SEQ ID NO: 554160 - DNA, 25 bp, Rattus norvegicus
gcctccgcgttgagcagcgggaact

SEQ ID NO: 554161 - DNA, 25 bp, Rattus norvegicus
ccagacacagcaggagcgagcaagc

SEQ ID NO: 554162 - DNA, 25 bp, Rattus norvegicus
gggagacgctggagctccagacaca

SEQ ID NO: 554163 - DNA, 25 bp, Rattus norvegicus
acagtagcttgtcactggcgaggcc

SEQ ID NO: 554164 - DNA, 25 bp, Rattus norvegicus
agcaagtcacacttacagtagcttg

SEQ ID NO: 554165 - DNA, 25 bp, Rattus norvegicus
cttcgtttaagcaagtcacacttac

SEQ ID NO: 554166 - DNA, 25 bp, Rattus norvegicus
gtgggtgtgcgacttcgtttaagca

SEQ ID NO: 554167 - DNA, 25 bp, Rattus norvegicus
accacggcagcctgcagattacttc

SEQ ID NO: 554168 - DNA, 25 bp, Rattus norvegicus
gagaggattctttaccctaattatc

SEQ ID NO: 554169 - DNA, 25 bp, Rattus norvegicus
tgcagattacttccctccgtgggtg

SEQ ID NO: 554170 - DNA, 25 bp, Rattus norvegicus
gacgtgcctttctcggaaaccgcta

SEQ ID NO: 554171 - DNA, 25 bp, Rattus norvegicus
attatcccgggaggaagacgtgcct

SEQ ID NO: 554172 - DNA, 25 bp, Rattus norvegicus
ctgcctctctggcaggctgctattc

SEQ ID NO: 554173 - DNA, 25 bp, Rattus norvegicus
tccaccaagcctgaaccttagactg

SEQ ID NO: 554174 - DNA, 25 bp, Rattus norvegicus
accacgcgggacctaagaggcagaa

SEQ ID NO: 554175 - DNA, 25 bp, Rattus norvegicus
ggcaggctgctattccgcacctcta

SEQ ID NO: 554176 - DNA, 25 bp, Rattus norvegicus
gctattccgcacctctaaaggggcc

SEQ ID NO: 554177 - DNA, 25 bp, Rattus norvegicus
tggagcttgtgtctaccgggtcgca

SEQ ID NO: 554178 - DNA, 25 bp, Rattus norvegicus
tctaccgggtcgcagcgctccaaga

SEQ ID NO: 554179 - DNA, 25 bp, Rattus norvegicus
agcgctccaagagccgctgccgaga

SEQ ID NO: 554180 - DNA, 25 bp, Rattus norvegicus
gctgccgagactaaaacccgctctt

SEQ ID NO: 554181 - DNA, 25 bp, Rattus norvegicus
acccgctcttcagctccaattaatg

SEQ ID NO: 554182 - DNA, 25 bp, Rattus norvegicus
ctccaattaatgtttgtccgctttt

SEQ ID NO: 554183 - DNA, 25 bp, Rattus norvegicus
ttgtccgcttttgctggcgtatccg

SEQ ID NO: 554184 - DNA, 25 bp, Rattus norvegicus
tgaaccttagactgaaccacgcggg

SEQ ID NO: 554185 - DNA, 25 bp, Rattus norvegicus
cttagactgaaccacgcgggaccta

SEQ ID NO: 554186 - DNA, 25 bp, Rattus norvegicus
aggcactgaaactgatcggcaggtc

SEQ ID NO: 554187 - DNA, 25 bp, Rattus norvegicus
cctctggacctatcagatggggttc

SEQ ID NO: 554188 - DNA, 25 bp, Rattus norvegicus
tcagatggggttcaccaggcgtccc

SEQ ID NO: 554189 - DNA, 25 bp, Rattus norvegicus
gaccagaggcactgaaactgatcgg

SEQ ID NO: 554190 - DNA, 25 bp, Rattus norvegicus
atcagatggggttcaccaggcgtcc

SEQ ID NO: 554191 - DNA, 25 bp, Rattus norvegicus
cgacttcgtgtcgaccagaggcact

SEQ ID NO: 554192 - DNA, 25 bp, Rattus norvegicus
tgcctaacaaaccggtcgtcaagga

SEQ ID NO: 554193 - DNA, 25 bp, Rattus norvegicus
cttgcctaacaaaccggtcgtcaag

SEQ ID NO: 554194 - DNA, 25 bp, Rattus norvegicus
cagaccttgcctaacaaaccggtcg

SEQ ID NO: 554195 - DNA, 25 bp, Rattus norvegicus
acttcgtgtcgaccagaggcactga

SEQ ID NO: 554196 - DNA, 25 bp, Rattus norvegicus
ccagaggcactgaaactgatcggca

SEQ ID NO: 554197 - DNA, 25 bp, Rattus norvegicus
tcgaccagaggcactgaaactgatc

SEQ ID NO: 554198 - DNA, 25 bp, Rattus norvegicus
gtgtcgaccagaggcactgaaactg

SEQ ID NO: 554199 - DNA, 25 bp, Rattus norvegicus
tcgtgtcgaccagaggcactgaaac

SEQ ID NO: 554200 - DNA, 25 bp, Rattus norvegicus
gtcacccagcttgcgcgactgacag

SEQ ID NO: 554201 - DNA, 25 bp, Rattus norvegicus
cgcgactgacagaacgcgggttctc

SEQ ID NO: 554202 - DNA, 25 bp, Rattus norvegicus
gcgggttctcctctcctctacatct

SEQ ID NO: 554203 - DNA, 25 bp, Rattus norvegicus
tccagcctagctgaggaaaggcgcc

SEQ ID NO: 554204 - DNA, 25 bp, Rattus norvegicus
cacgatcagatgagtgtgcgcatga

SEQ ID NO: 554205 - DNA, 25 bp, Rattus norvegicus
tctacatctccctgtgtcaccgggt

SEQ ID NO: 554206 - DNA, 25 bp, Rattus norvegicus
tccagtgttgctccagcctagctga

SEQ ID NO: 554207 - DNA, 25 bp, Rattus norvegicus
cgggtcgcccagtagctgatagaac

SEQ ID NO: 554208 - DNA, 25 bp, Rattus norvegicus
gcccagtagctgatagaacctcgaa

SEQ ID NO: 554209 - DNA, 25 bp, Rattus norvegicus
gatagaacctcgaacccatgccaaa

SEQ ID NO: 554210 - DNA, 25 bp, Rattus norvegicus
cccgcatcacgatcagatgagtgtg

SEQ ID NO: 554211 - DNA, 25 bp, Rattus norvegicus
gttcccacgtccagtgttgctccag

SEQ ID NO: 554212 - DNA, 25 bp, Rattus norvegicus
cccgaccaaaggacagcattggggt

SEQ ID NO: 554213 - DNA, 25 bp, Rattus norvegicus
ggattcgtccctgtcacccagcttg

SEQ ID NO: 554214 - DNA, 25 bp, Rattus norvegicus
gcatacgggagcttcatcgcccagc

SEQ ID NO: 554215 - DNA, 25 bp, Rattus norvegicus
gctccggcagtagagggtccgctct

SEQ ID NO: 554216 - DNA, 25 bp, Rattus norvegicus
ccgcgcaaactccttgccgggtgta

SEQ ID NO: 554217 - DNA, 25 bp, Rattus norvegicus
agcttcggtggtcgcggatcagctc

SEQ ID NO: 554218 - DNA, 25 bp, Rattus norvegicus
tagccgctccgcagaatcttggaga

SEQ ID NO: 554219 - DNA, 25 bp, Rattus norvegicus
tagcttcgggcatacgggagcttca

SEQ ID NO: 554220 - DNA, 25 bp, Rattus norvegicus
gaagaggaccgaggccaaggaaata

SEQ ID NO: 554221 - DNA, 25 bp, Rattus norvegicus
gcagcgcgcagtccgcgagatgcca

SEQ ID NO: 554222 - DNA, 25 bp, Rattus norvegicus
tgcatctccgctcctgggaactgga

SEQ ID NO: 554223 - DNA, 25 bp, Rattus norvegicus
gatcgcgcccgcagacaggcagcgt

SEQ ID NO: 554224 - DNA, 25 bp, Rattus norvegicus
cagcgtgcgcacagcggccaaggca

SEQ ID NO: 554225 - DNA, 25 bp, Rattus norvegicus
gggcggctagcaaaacccggatctg

SEQ ID NO: 554226 - DNA, 25 bp, Rattus norvegicus
caaaacccggatctggagtccgcga

SEQ ID NO: 554227 - DNA, 25 bp, Rattus norvegicus
ccgtgccgggtagcttcgggcatac

SEQ ID NO: 554228 - DNA, 25 bp, Rattus norvegicus
cgagcatccctggagacccgcggga

SEQ ID NO: 554229 - DNA, 25 bp, Rattus norvegicus
gtgcggcagcgacggcgtcacctac

SEQ ID NO: 554230 - DNA, 25 bp, Rattus norvegicus
gcagcggctttaagggttggcctcc

SEQ ID NO: 554231 - DNA, 25 bp, Rattus norvegicus
gggctgctcacttgcgcgctcgcgt

SEQ ID NO: 554232 - DNA, 25 bp, Rattus norvegicus
tgcagccggattgctgctcctgctc

SEQ ID NO: 554233 - DNA, 25 bp, Rattus norvegicus
gtgcaagagccgctacccggtgtgc

SEQ ID NO: 554234 - DNA, 25 bp, Rattus norvegicus
agagccgcggagagaaggccatcac

SEQ ID NO: 554235 - DNA, 25 bp, Rattus norvegicus
gagaaggccatcacccaggtcagca

SEQ ID NO: 554236 - DNA, 25 bp, Rattus norvegicus
ggtcagcaaaggcacctgcgagcaa

SEQ ID NO: 554237 - DNA, 25 bp, Rattus norvegicus
gcaaggtgggaaccagcgccttccc

SEQ ID NO: 554238 - DNA, 25 bp, Rattus norvegicus
ctcgccggggcagcgaagatgccca

SEQ ID NO: 554239 - DNA, 25 bp, Rattus norvegicus
ttgatggcggcccagtgtcccgagc

SEQ ID NO: 554240 - DNA, 25 bp, Rattus norvegicus
tgtcccgagccaggggaaacgcctc

SEQ ID NO: 554241 - DNA, 25 bp, Rattus norvegicus
acctgcgagcaaggtgggaaccagc

SEQ ID NO: 554242 - DNA, 25 bp, Rattus norvegicus
cgcgagaaatctaggcttggtcacg

SEQ ID NO: 554243 - DNA, 25 bp, Rattus norvegicus
tggcgttgaagatagacagcttctc

SEQ ID NO: 554244 - DNA, 25 bp, Rattus norvegicus
tgtgggctaagcactgaggaccttc

SEQ ID NO: 554245 - DNA, 25 bp, Rattus norvegicus
tgctcacccagcctttgcacgtttg

SEQ ID NO: 554246 - DNA, 25 bp, Rattus norvegicus
tgcacgtttgactgaattctcgggt

SEQ ID NO: 554247 - DNA, 25 bp, Rattus norvegicus
ttctcgggtctcagagctttcatcg

SEQ ID NO: 554248 - DNA, 25 bp, Rattus norvegicus
acagttccttcgttgtctggtcctg

SEQ ID NO: 554249 - DNA, 25 bp, Rattus norvegicus
cctgggagtttctcggacgctaaca

SEQ ID NO: 554250 - DNA, 25 bp, Rattus norvegicus
catctgccagcgtggatcatccctg

SEQ ID NO: 554251 - DNA, 25 bp, Rattus norvegicus
ccgacacggaggaacgctttctgtt

SEQ ID NO: 554252 - DNA, 25 bp, Rattus norvegicus
ccctgaggaacagctgcgggaattg

SEQ ID NO: 554253 - DNA, 25 bp, Rattus norvegicus
agccgcgatcagtacctggagcttg

SEQ ID NO: 554254 - DNA, 25 bp, Rattus norvegicus
tggtcacgccgttggacagttcctt

SEQ ID NO: 554255 - DNA, 25 bp, Rattus norvegicus
aacgctgctggctactggtgcacca

SEQ ID NO: 554256 - DNA, 25 bp, Rattus norvegicus
taccggcgtccgatcgggcctgtac

SEQ ID NO: 554257 - DNA, 25 bp, Rattus norvegicus
gggctctgacctcgcgcgctgccca

SEQ ID NO: 554258 - DNA, 25 bp, Rattus norvegicus
tgccaccagcgtcggcctcggcggc

SEQ ID NO: 554259 - DNA, 25 bp, Rattus norvegicus
tgcccaccaccctagaggcgccttt

SEQ ID NO: 554260 - DNA, 25 bp, Rattus norvegicus
agttacctcgctaccggcgtccgat

SEQ ID NO: 554261 - DNA, 25 bp, Rattus norvegicus
ctccgccaccaacccgcgggcggtg

SEQ ID NO: 554262 - DNA, 25 bp, Rattus norvegicus
ctttgcaaacttgggccctcttgct

SEQ ID NO: 554263 - DNA, 25 bp, Rattus norvegicus
ctctttgcaaacttgggccctcttg

SEQ ID NO: 554264 - DNA, 25 bp, Rattus norvegicus
aagcagctctttgcaaacttgggcc

SEQ ID NO: 554265 - DNA, 25 bp, Rattus norvegicus
aaataccaaacacaaagcagctctt

SEQ ID NO: 554266 - DNA, 25 bp, Rattus norvegicus
gaaataggcattcggccattttctc

SEQ ID NO: 554267 - DNA, 25 bp, Rattus norvegicus
gcggcattcctaactgaaataggca

SEQ ID NO: 554268 - DNA, 25 bp, Rattus norvegicus
ggcggcggcattcctaactgaaata

SEQ ID NO: 554269 - DNA, 25 bp, Rattus norvegicus
tccgatcgggcctgtaccggggctc

SEQ ID NO: 554270 - DNA, 25 bp, Rattus norvegicus
tacacaatagtgagcgctgcccttc

SEQ ID NO: 554271 - DNA, 25 bp, Rattus norvegicus
agcgcggaggaacaccgtgccctac

SEQ ID NO: 554272 - DNA, 25 bp, Rattus norvegicus
acacgcactgaattccttggggacg

SEQ ID NO: 554273 - DNA, 25 bp, Rattus norvegicus
tatgcgttctcacaccggcctcaaa

SEQ ID NO: 554274 - DNA, 25 bp, Rattus norvegicus
tcgctacagcccttcgccattttgg

SEQ ID NO: 554275 - DNA, 25 bp, Rattus norvegicus
ttcccgcggactaccggtgcattct

SEQ ID NO: 554276 - DNA, 25 bp, Rattus norvegicus
ggccgaatggcagctctccagagcc

SEQ ID NO: 554277 - DNA, 25 bp, Rattus norvegicus
ccagcgctgaacaaagagggactct

SEQ ID NO: 554278 - DNA, 25 bp, Rattus norvegicus
actctttaatgtcgcggtgggacta

SEQ ID NO: 554279 - DNA, 25 bp, Rattus norvegicus
tgctgccggtgcatacacaatagtg

SEQ ID NO: 554280 - DNA, 25 bp, Rattus norvegicus
agcgctgcccttccagacgcagagg

SEQ ID NO: 554281 - DNA, 25 bp, Rattus norvegicus
cagaggctcgctggactgtttttcg

SEQ ID NO: 554282 - DNA, 25 bp, Rattus norvegicus
actgtttttcgtgtccaacctatcg

SEQ ID NO: 554283 - DNA, 25 bp, Rattus norvegicus
gactaagtccttctgctgccggtgc

SEQ ID NO: 554284 - DNA, 25 bp, Rattus norvegicus
tggcttgcgtgagctcggccctgcc

SEQ ID NO: 554285 - DNA, 25 bp, Rattus norvegicus
tcacatcccaatcacgtgggagggg

SEQ ID NO: 554286 - DNA, 25 bp, Rattus norvegicus
gccatcacatcccaatcacgtggga

SEQ ID NO: 554287 - DNA, 25 bp, Rattus norvegicus
ggaagcggccatcacatcccaatca

SEQ ID NO: 554288 - DNA, 25 bp, Rattus norvegicus
cgggaagcggccatcacatcccaat

SEQ ID NO: 554289 - DNA, 25 bp, Rattus norvegicus
cccatacaggctcggtgtggagctg

SEQ ID NO: 554290 - DNA, 25 bp, Rattus norvegicus
ttcccatacaggctcggtgtggagc

SEQ ID NO: 554291 - DNA, 25 bp, Rattus norvegicus
gcttcccatacaggctcggtgtgga

SEQ ID NO: 554292 - DNA, 25 bp, Rattus norvegicus
gagcttcccatacaggctcggtgtg

SEQ ID NO: 554293 - DNA, 25 bp, Rattus norvegicus
ccaggagcttcccatacaggctcgg

SEQ ID NO: 554294 - DNA, 25 bp, Rattus norvegicus
ccctctgtgaattctgcgccccgca

SEQ ID NO: 554295 - DNA, 25 bp, Rattus norvegicus
cccgatctggggtgagtcccgtggc

SEQ ID NO: 554296 - DNA, 25 bp, Rattus norvegicus
ggggtcaccagttctgccactccag

SEQ ID NO: 554297 - DNA, 25 bp, Rattus norvegicus
aggttgcgccccgaaactgccaagc

SEQ ID NO: 554298 - DNA, 25 bp, Rattus norvegicus
tacagacgctcacggaccatgtcgg

SEQ ID NO: 554299 - DNA, 25 bp, Rattus norvegicus
gagtccagccctgcgtgtgtcctca

SEQ ID NO: 554300 - DNA, 25 bp, Rattus norvegicus
gtgtgtcctcagtccttagggcagc

SEQ ID NO: 554301 - DNA, 25 bp, Rattus norvegicus
cttagggcagctccggacctccgga

SEQ ID NO: 554302 - DNA, 25 bp, Rattus norvegicus
tccggaggcagctcttgaggagctt

SEQ ID NO: 554303 - DNA, 25 bp, Rattus norvegicus
tccatccttagccaggttggggaca

SEQ ID NO: 554304 - DNA, 25 bp, Rattus norvegicus
cccacggaggaccaggtggagatcc

SEQ ID NO: 554305 - DNA, 25 bp, Rattus norvegicus
gagatcctggagtacaacttcaaca

SEQ ID NO: 554306 - DNA, 25 bp, Rattus norvegicus
acttcaacaaggtcaacaagcaccc

SEQ ID NO: 554307 - DNA, 25 bp, Rattus norvegicus
gctgtgcctcatcgcagccgaggcg

SEQ ID NO: 554308 - DNA, 25 bp, Rattus norvegicus
acgcaggtgagaacccaagcctata

SEQ ID NO: 554309 - DNA, 25 bp, Rattus norvegicus
aagcctatagcatcctccgggactg

SEQ ID NO: 554310 - DNA, 25 bp, Rattus norvegicus
tcttgaggagcttcctccactgtcc

SEQ ID NO: 554311 - DNA, 25 bp, Rattus norvegicus
ctcacggaccatgtcggcgcagact

SEQ ID NO: 554312 - DNA, 25 bp, Rattus norvegicus
acagtggcctcggaagcgagagtcc

SEQ ID NO: 554313 - DNA, 25 bp, Rattus norvegicus
cgtagttcggcgacgacgtaacaga

SEQ ID NO: 554314 - DNA, 25 bp, Rattus norvegicus
tccggttctctgcggtcaagacccg

SEQ ID NO: 554315 - DNA, 25 bp, Rattus norvegicus
acccggttctctgcgtagttcggcg

SEQ ID NO: 554316 - DNA, 25 bp, Rattus norvegicus
tcggaagcgagagtcccggtcccag

SEQ ID NO: 554317 - DNA, 25 bp, Rattus norvegicus
ctctgcgtagttcggcgacgacgta

SEQ ID NO: 554318 - DNA, 25 bp, Rattus norvegicus
gttcggcgacgacgtaacagagcta

SEQ ID NO: 554319 - DNA, 25 bp, Rattus norvegicus
tcggcgacgacgtaacagagctagc

SEQ ID NO: 554320 - DNA, 25 bp, Rattus norvegicus
cgacgacgtaacagagctagcgggc

SEQ ID NO: 554321 - DNA, 25 bp, Rattus norvegicus
acgtaacagagctagcgggcctgga

SEQ ID NO: 554322 - DNA, 25 bp, Rattus norvegicus
gctagcgggcctggatgcccacagt

SEQ ID NO: 554323 - DNA, 25 bp, Rattus norvegicus
ccacagtggcctcggaagcgagagt

SEQ ID NO: 554324 - DNA, 25 bp, Rattus norvegicus
gcctcggaagcgagagtcccggtcc

SEQ ID NO: 554325 - DNA, 25 bp, Rattus norvegicus
ggttctctgcgtagttcggcgacga

SEQ ID NO: 554326 - DNA, 25 bp, Rattus norvegicus
tccggcagcggagaagatatcaaga

SEQ ID NO: 554327 - DNA, 25 bp, Rattus norvegicus
gttctgcccataacggttcacctca

SEQ ID NO: 554328 - DNA, 25 bp, Rattus norvegicus
ccggacgccatggtctctttaagtc

SEQ ID NO: 554329 - DNA, 25 bp, Rattus norvegicus
ctgagggaagtaagtacacgtggcc

SEQ ID NO: 554330 - DNA, 25 bp, Rattus norvegicus
agtaagtacacgtggccctaagcga

SEQ ID NO: 554331 - DNA, 25 bp, Rattus norvegicus
gtggccctaagcgaccgagctccgg

SEQ ID NO: 554332 - DNA, 25 bp, Rattus norvegicus
agccgaacgaaggacgcagcgatcc

SEQ ID NO: 554333 - DNA, 25 bp, Rattus norvegicus
gacagtccggctgtcccgacactta

SEQ ID NO: 554334 - DNA, 25 bp, Rattus norvegicus
gctgtcccgacacttacttttgttg

SEQ ID NO: 554335 - DNA, 25 bp, Rattus norvegicus
cacttacttttgttgacggtcttga

SEQ ID NO: 554336 - DNA, 25 bp, Rattus norvegicus
atttggaagcggttccggacgccat

SEQ ID NO: 554337 - DNA, 25 bp, Rattus norvegicus
cgtgaagtcgctgttctgcccataa

SEQ ID NO: 554338 - DNA, 25 bp, Rattus norvegicus
tttgttgacggtcttgagggcacgc

SEQ ID NO: 554339 - DNA, 25 bp, Rattus norvegicus
aggcggcttcctcctgacagtccgg

SEQ ID NO: 554340 - DNA, 25 bp, Rattus norvegicus
gccgaccacgcactttgccagaagg

SEQ ID NO: 554341 - DNA, 25 bp, Rattus norvegicus
cggagtctcccacgtgcagggaaaa

SEQ ID NO: 554342 - DNA, 25 bp, Rattus norvegicus
agcaggtccctccacgtgctttcgg

SEQ ID NO: 554343 - DNA, 25 bp, Rattus norvegicus
tcgagcctgtgaggcgctctatagc

SEQ ID NO: 554344 - DNA, 25 bp, Rattus norvegicus
cgccgccgcagtagcgagatactag

SEQ ID NO: 554345 - DNA, 25 bp, Rattus norvegicus
atcctgacctctgccgcggagaatt

SEQ ID NO: 554346 - DNA, 25 bp, Rattus norvegicus
tctgagggaccaacgcgattaacta

SEQ ID NO: 554347 - DNA, 25 bp, Rattus norvegicus
gacacgcacggctcagactttctga

SEQ ID NO: 554348 - DNA, 25 bp, Rattus norvegicus
tttctgggttggatcggaccaagtc

SEQ ID NO: 554349 - DNA, 25 bp, Rattus norvegicus
tgtcgccattatcctaggtgaacta

SEQ ID NO: 554350 - DNA, 25 bp, Rattus norvegicus
agttactcaccttcagctgtcgcca

SEQ ID NO: 554351 - DNA, 25 bp, Rattus norvegicus
aagggctaagatccaaacgcgtctg

SEQ ID NO: 554352 - DNA, 25 bp, Rattus norvegicus
ccaagcgcttggaccacgtgttctg

SEQ ID NO: 554353 - DNA, 25 bp, Rattus norvegicus
aacgcgtctgcgtcaagcctgctag

SEQ ID NO: 554354 - DNA, 25 bp, Rattus norvegicus
tccgctactgggctggaaagtgcag

SEQ ID NO: 554355 - DNA, 25 bp, Rattus norvegicus
ttggtccgctttacggctgctgagc

SEQ ID NO: 554356 - DNA, 25 bp, Rattus norvegicus
gccgcgcactgtcgtgaaaaggtgg

SEQ ID NO: 554357 - DNA, 25 bp, Rattus norvegicus
accggctgctccatcccgggtccgg

SEQ ID NO: 554358 - DNA, 25 bp, Rattus norvegicus
actctgggagccaccggctgctcca

SEQ ID NO: 554359 - DNA, 25 bp, Rattus norvegicus
ctggaaagtgcaggccgcgcactgt

SEQ ID NO: 554360 - DNA, 25 bp, Rattus norvegicus
agcgtccgctactgggctggaaagt

SEQ ID NO: 554361 - DNA, 25 bp, Rattus norvegicus
tccgctttacggctgctgagcgtcc

SEQ ID NO: 554362 - DNA, 25 bp, Rattus norvegicus
agatgacgcgttggtccgctttacg

SEQ ID NO: 554363 - DNA, 25 bp, Rattus norvegicus
gcagatgacgcgttggtccgcttta

SEQ ID NO: 554364 - DNA, 25 bp, Rattus norvegicus
cccgacgctggcgtgacgttcgggc

SEQ ID NO: 554365 - DNA, 25 bp, Rattus norvegicus
tctgcaggatgacgcggcattctgg

SEQ ID NO: 554366 - DNA, 25 bp, Rattus norvegicus
gctctgcaggatgacgcggcattct

SEQ ID NO: 554367 - DNA, 25 bp, Rattus norvegicus
ttacggctgctgagcgtccgctact

SEQ ID NO: 554368 - DNA, 25 bp, Rattus norvegicus
ctgggcgcttttcttctgatagacc

SEQ ID NO: 554369 - DNA, 25 bp, Rattus norvegicus
ctttggggaagagaatctgcctact

SEQ ID NO: 554370 - DNA, 25 bp, Rattus norvegicus
tcaccgtccgtgctctgtttgaagg

SEQ ID NO: 554371 - DNA, 25 bp, Rattus norvegicus
tgcgccgctgtctgagaatttctgc

SEQ ID NO: 554372 - DNA, 25 bp, Rattus norvegicus
ttctggatcgaatggaagcccactc

SEQ ID NO: 554373 - DNA, 25 bp, Rattus norvegicus
acttgcacgccgagtccttgatctg

SEQ ID NO: 554374 - DNA, 25 bp, Rattus norvegicus
ccttgatctggctcaggttgaccgc

SEQ ID NO: 554375 - DNA, 25 bp, Rattus norvegicus
cgctccagtgaccagaatggccgtg

SEQ ID NO: 554376 - DNA, 25 bp, Rattus norvegicus
gagctcctccacctttcgatcgatg

SEQ ID NO: 554377 - DNA, 25 bp, Rattus norvegicus
atcgatgtctgcagcggtagcttcc

SEQ ID NO: 554378 - DNA, 25 bp, Rattus norvegicus
cgtgccttccttctgtctctcttga

SEQ ID NO: 554379 - DNA, 25 bp, Rattus norvegicus
gagaggcttctttcccttccacgtc

SEQ ID NO: 554380 - DNA, 25 bp, Rattus norvegicus
tcttgcgtacgttccctcgggaatc

SEQ ID NO: 554381 - DNA, 25 bp, Rattus norvegicus
tcccggaggatacctggaacgtgta

SEQ ID NO: 554382 - DNA, 25 bp, Rattus norvegicus
tgcctctcggccttttcctgctcac

SEQ ID NO: 554383 - DNA, 25 bp, Rattus norvegicus
ttgcctttcggcctcctcgcgctgc

SEQ ID NO: 554384 - DNA, 25 bp, Rattus norvegicus
ttttcctgctcacgcctgcgctctt

SEQ ID NO: 554385 - DNA, 25 bp, Rattus norvegicus
agaccagactgaggcccttcctctg

SEQ ID NO: 554386 - DNA, 25 bp, Rattus norvegicus
agactgaggcccttcctctggaggt

SEQ ID NO: 554387 - DNA, 25 bp, Rattus norvegicus
aggcccttcctctggaggtgccttc

SEQ ID NO: 554388 - DNA, 25 bp, Rattus norvegicus
ttcctctggaggtgccttccctgcc

SEQ ID NO: 554389 - DNA, 25 bp, Rattus norvegicus
ttccctgcctgtagcaacaggccta

SEQ ID NO: 554390 - DNA, 25 bp, Rattus norvegicus
caggcctacctcttcagcctcctct

SEQ ID NO: 554391 - DNA, 25 bp, Rattus norvegicus
tgcctgtagcaacaggcctacctct

SEQ ID NO: 554392 - DNA, 25 bp, Rattus norvegicus
gtagcaacaggcctacctcttcagc

SEQ ID NO: 554393 - DNA, 25 bp, Rattus norvegicus
ttacttcctcctcttgtttctcggc

SEQ ID NO: 554394 - DNA, 25 bp, Rattus norvegicus
tctcctcttgattttcggcctcgcg

SEQ ID NO: 554395 - DNA, 25 bp, Rattus norvegicus
tcagtttctcctcttgattttcggc

SEQ ID NO: 554396 - DNA, 25 bp, Rattus norvegicus
tccaccgctgcaggaatggccagag

SEQ ID NO: 554397 - DNA, 25 bp, Rattus norvegicus
gcctctgccatcaaactggtagctc

SEQ ID NO: 554398 - DNA, 25 bp, Rattus norvegicus
ctggtagctcatcagaactggggca

SEQ ID NO: 554399 - DNA, 25 bp, Rattus norvegicus
aacaagagtttgtgcgcatcggctc

SEQ ID NO: 554400 - DNA, 25 bp, Rattus norvegicus
gcatcggctcggcaaaggttaaaca

SEQ ID NO: 554401 - DNA, 25 bp, Rattus norvegicus
tcccagctcctgactggagaggtcc

SEQ ID NO: 554402 - DNA, 25 bp, Rattus norvegicus
cgggtcccatgatctcagcaagttc

SEQ ID NO: 554403 - DNA, 25 bp, Rattus norvegicus
gctgcctattgtctgttccctcgaa

SEQ ID NO: 554404 - DNA, 25 bp, Rattus norvegicus
cctcgaacagtgaggggagctcacc

SEQ ID NO: 554405 - DNA, 25 bp, Rattus norvegicus
gagcgccaccctggagagaacgatg

SEQ ID NO: 554406 - DNA, 25 bp, Rattus norvegicus
ccgagctcggtcgatgcatctcaga

SEQ ID NO: 554407 - DNA, 25 bp, Rattus norvegicus
ccgactgactcgaagccaggagtta

SEQ ID NO: 554408 - DNA, 25 bp, Rattus norvegicus
ggacttaccagtgcggtctccaccg

SEQ ID NO: 554409 - DNA, 25 bp, Rattus norvegicus
gggaaacctttgttcgcctctgcca

SEQ ID NO: 554410 - DNA, 25 bp, Rattus norvegicus
aacctctgcggtgcccgaggacctt

SEQ ID NO: 554411 - DNA, 25 bp, Rattus norvegicus
aggcgcatcgccctcgggacccacc

SEQ ID NO: 554412 - DNA, 25 bp, Rattus norvegicus
ccctggcgggaagcccgaacctctg

SEQ ID NO: 554413 - DNA, 25 bp, Rattus norvegicus
ccggaaacgtaacggctggccgatg

SEQ ID NO: 554414 - DNA, 25 bp, Rattus norvegicus
accggagctacccacagtggcggcg

SEQ ID NO: 554415 - DNA, 25 bp, Rattus norvegicus
taacggaccggagctacccacagtg

SEQ ID NO: 554416 - DNA, 25 bp, Rattus norvegicus
tcgcggcccacaaggagggagcgcc

SEQ ID NO: 554417 - DNA, 25 bp, Rattus norvegicus
cagtttgaaaatggcgcggagagac

SEQ ID NO: 554418 - DNA, 25 bp, Rattus norvegicus
cggacacgaacgcagtttgaaaatg

SEQ ID NO: 554419 - DNA, 25 bp, Rattus norvegicus
tggctcggacacgaacgcagtttga

SEQ ID NO: 554420 - DNA, 25 bp, Rattus norvegicus
tgcggccaatggctcggacacgaac

SEQ ID NO: 554421 - DNA, 25 bp, Rattus norvegicus
ggacccaccgtcctcgctgtctcct

SEQ ID NO: 554422 - DNA, 25 bp, Rattus norvegicus
ccgggcgcgcctcaccgttgctgcc

SEQ ID NO: 554423 - DNA, 25 bp, Rattus norvegicus
tctgcggtgcccgaggaccttgacg

SEQ ID NO: 554424 - DNA, 25 bp, Rattus norvegicus
cggagacaatggaagggaacagatt

SEQ ID NO: 554425 - DNA, 25 bp, Rattus norvegicus
gaaacgcttttcattgagctgggaa

SEQ ID NO: 554426 - DNA, 25 bp, Rattus norvegicus
cagattgaccaatggacttggagga

SEQ ID NO: 554427 - DNA, 25 bp, Rattus norvegicus
ccggccgaggttggtgctccaagac

SEQ ID NO: 554428 - DNA, 25 bp, Rattus norvegicus
ttggtgctccaagacggactctaca

SEQ ID NO: 554429 - DNA, 25 bp, Rattus norvegicus
acggactctacaagggcgccggcag

SEQ ID NO: 554430 - DNA, 25 bp, Rattus norvegicus
cagcaagagcagctatgaaacgctt

SEQ ID NO: 554431 - DNA, 25 bp, Rattus norvegicus
ctgggaaaagaagcggccagaagcc

SEQ ID NO: 554432 - DNA, 25 bp, Rattus norvegicus
agaagccgccacttcccgtatccgg

SEQ ID NO: 554433 - DNA, 25 bp, Rattus norvegicus
tatccggtcacgtgccgctctgtac

SEQ ID NO: 554434 - DNA, 25 bp, Rattus norvegicus
tgccgctctgtaccggaagttgatc

SEQ ID NO: 554435 - DNA, 25 bp, Rattus norvegicus
taccggaagttgatcttgtggagcc

SEQ ID NO: 554436 - DNA, 25 bp, Rattus norvegicus
cttgtggagccggaaacggagacaa

SEQ ID NO: 554437 - DNA, 25 bp, Rattus norvegicus
acttggaggaggtcgaacgttgcct

SEQ ID NO: 554438 - DNA, 25 bp, Rattus norvegicus
tgcagaaggcgctgcgagccagcac

SEQ ID NO: 554439 - DNA, 25 bp, Rattus norvegicus
acgcctttgtctgcgtgtgtgcaga

SEQ ID NO: 554440 - DNA, 25 bp, Rattus norvegicus
agccagcacggaacggccttgtatg

SEQ ID NO: 554441 - DNA, 25 bp, Rattus norvegicus
ggcgcgcggccatatttggcgattt

SEQ ID NO: 554442 - DNA, 25 bp, Rattus norvegicus
tatttggcgatttggacccgcgctc

SEQ ID NO: 554443 - DNA, 25 bp, Rattus norvegicus
cgcgctcctcgccttatttagtcaa

SEQ ID NO: 554444 - DNA, 25 bp, Rattus norvegicus
tttagtcaagcaggctacccattgg

SEQ ID NO: 554445 - DNA, 25 bp, Rattus norvegicus
aagcaggctacccattggcccgcgg

SEQ ID NO: 554446 - DNA, 25 bp, Rattus norvegicus
cgcggagaccctcggctgtgcgctt

SEQ ID NO: 554447 - DNA, 25 bp, Rattus norvegicus
accctcggctgtgcgcttgggctca

SEQ ID NO: 554448 - DNA, 25 bp, Rattus norvegicus
agaggcgcagccctcccaggagacg

SEQ ID NO: 554449 - DNA, 25 bp, Rattus norvegicus
ggcctcctaacgctgtgcacgggaa

SEQ ID NO: 554450 - DNA, 25 bp, Rattus norvegicus
ggctttctctaaggacgcctttgtc

SEQ ID NO: 554451 - DNA, 25 bp, Rattus norvegicus
ttgtatggccgggttccctctgacg

SEQ ID NO: 554452 - DNA, 25 bp, Rattus norvegicus
attacctccaggtaggccggccgcg

SEQ ID NO: 554453 - DNA, 25 bp, Rattus norvegicus
gctcgcacaggtcctgactcgaaat

SEQ ID NO: 554454 - DNA, 25 bp, Rattus norvegicus
cacaggtcctgactcgaaatggaga

SEQ ID NO: 554455 - DNA, 25 bp, Rattus norvegicus
tgactcgaaatggagaccggagcgc

SEQ ID NO: 554456 - DNA, 25 bp, Rattus norvegicus
cgcgtgcagccgcaagcctgtaaca

SEQ ID NO: 554457 - DNA, 25 bp, Rattus norvegicus
gccgcaagcctgtaacagcgaagtg

SEQ ID NO: 554458 - DNA, 25 bp, Rattus norvegicus
cctgtaacagcgaagtgggcgctcc

SEQ ID NO: 554459 - DNA, 25 bp, Rattus norvegicus
cgaagtgggcgctccacggagccca

SEQ ID NO: 554460 - DNA, 25 bp, Rattus norvegicus
ccacggagcccacgctgtgcgcacc

SEQ ID NO: 554461 - DNA, 25 bp, Rattus norvegicus
ccctttaagcacggaggcgcaggcg

SEQ ID NO: 554462 - DNA, 25 bp, Rattus norvegicus
ggcctggctgaggaaaccccattac

SEQ ID NO: 554463 - DNA, 25 bp, Rattus norvegicus
cgccacgcgggactccgcgctcggt

SEQ ID NO: 554464 - DNA, 25 bp, Rattus norvegicus
cgcgctcggtcctccctctgtgcgc

SEQ ID NO: 554465 - DNA, 25 bp, Rattus norvegicus
cgcgccttgacaaccgccacggctg

SEQ ID NO: 554466 - DNA, 25 bp, Rattus norvegicus
gggacgctgagggacagctttaaca

SEQ ID NO: 554467 - DNA, 25 bp, Rattus norvegicus
ggacagctttaacacccgcacaaca

SEQ ID NO: 554468 - DNA, 25 bp, Rattus norvegicus
cccgcacaacacagggtacctggtt

SEQ ID NO: 554469 - DNA, 25 bp, Rattus norvegicus
cagggtacctggttcccagtccaga

SEQ ID NO: 554470 - DNA, 25 bp, Rattus norvegicus
ccagtccagagctgcttggagggca

SEQ ID NO: 554471 - DNA, 25 bp, Rattus norvegicus
cagagatgtcgcgagcagctaatcg

SEQ ID NO: 554472 - DNA, 25 bp, Rattus norvegicus
gcgagcagctaatcgccgcccaggg

SEQ ID NO: 554473 - DNA, 25 bp, Rattus norvegicus
agggctctccgcaggacaattggcc

SEQ ID NO: 554474 - DNA, 25 bp, Rattus norvegicus
gaatgcgtggttccctgagtcagac

SEQ ID NO: 554475 - DNA, 25 bp, Rattus norvegicus
cgtgtgcgccggatttaaaagttgg

SEQ ID NO: 554476 - DNA, 25 bp, Rattus norvegicus
gcgtggagactacgccagcctagcc

SEQ ID NO: 554477 - DNA, 25 bp, Rattus norvegicus
gtcactttggtgtctgagctcagca

SEQ ID NO: 554478 - DNA, 25 bp, Rattus norvegicus
cctgagtcagacacccggccaggga

SEQ ID NO: 554479 - DNA, 25 bp, Rattus norvegicus
cgaggtcacgcgtggagactacgcc

SEQ ID NO: 554480 - DNA, 25 bp, Rattus norvegicus
tgggcggcgcatgcgtgctcccgga

SEQ ID NO: 554481 - DNA, 25 bp, Rattus norvegicus
caatcacggactgggctggcggcta

SEQ ID NO: 554482 - DNA, 25 bp, Rattus norvegicus
ggcggctaccggctggagagaggaa

SEQ ID NO: 554483 - DNA, 25 bp, Rattus norvegicus
ctggagagaggaaatcccggacggc

SEQ ID NO: 554484 - DNA, 25 bp, Rattus norvegicus
aaatcccggacggcgagagcgcgaa

SEQ ID NO: 554485 - DNA, 25 bp, Rattus norvegicus
agagcgcgaaggaaatctggccgcc

SEQ ID NO: 554486 - DNA, 25 bp, Rattus norvegicus
gcctcggccggacgcgcggcggaag

SEQ ID NO: 554487 - DNA, 25 bp, Rattus norvegicus
cgccgggagggagcgcaatcacgga

SEQ ID NO: 554488 - DNA, 25 bp, Rattus norvegicus
gcgtgctcccggagccggtggagga

SEQ ID NO: 554489 - DNA, 25 bp, Rattus norvegicus
cgcggccggtgtccggcgacgcgta

SEQ ID NO: 554490 - DNA, 25 bp, Rattus norvegicus
gcgacgcgtagagcgcgaagctcca

SEQ ID NO: 554491 - DNA, 25 bp, Rattus norvegicus
aagctccagggagtcgcgctcagcg

SEQ ID NO: 554492 - DNA, 25 bp, Rattus norvegicus
tgcgccaagtgtcgcggggccgccg

SEQ ID NO: 554493 - DNA, 25 bp, Rattus norvegicus
agcgcgaaggaaatctggccgccgc

SEQ ID NO: 554494 - DNA, 25 bp, Rattus norvegicus
cattggtccgacgtcagcccggcgt

SEQ ID NO: 554495 - DNA, 25 bp, Rattus norvegicus
ccgcgcctgggaaggcagtctgtca

SEQ ID NO: 554496 - DNA, 25 bp, Rattus norvegicus
tgggaaggcagtctgtcaccctcct

SEQ ID NO: 554497 - DNA, 25 bp, Rattus norvegicus
ctcctcccagcgaggctagcagggg

SEQ ID NO: 554498 - DNA, 25 bp, Rattus norvegicus
tcgaggccctgtactgccgcgggct

SEQ ID NO: 554499 - DNA, 25 bp, Rattus norvegicus
ctcctggttccggtggctcaggtct

SEQ ID NO: 554500 - DNA, 25 bp, Rattus norvegicus
tggctcaggtcttcctcggggccag

SEQ ID NO: 554501 - DNA, 25 bp, Rattus norvegicus
gggcccagagcaacggaagcagcaa

SEQ ID NO: 554502 - DNA, 25 bp, Rattus norvegicus
caagagcacgagcagccgtcgcgtc

SEQ ID NO: 554503 - DNA, 25 bp, Rattus norvegicus
ctccaactgcctcggcggcccaact

SEQ ID NO: 554504 - DNA, 25 bp, Rattus norvegicus
ccttggcaagacagcctcccattgg

SEQ ID NO: 554505 - DNA, 25 bp, Rattus norvegicus
tggcaagacagcctcccattggtcc

SEQ ID NO: 554506 - DNA, 25 bp, Rattus norvegicus
cgtcgtgacgtttccggcaggttga

SEQ ID NO: 554507 - DNA, 25 bp, Rattus norvegicus
cgtcagcccggcgtcgtgacgtttc

SEQ ID NO: 554508 - DNA, 25 bp, Rattus norvegicus
agagcgcgcagctcggtagcagcct

SEQ ID NO: 554509 - DNA, 25 bp, Rattus norvegicus
ctggcgggcgccagctgcagcagca

SEQ ID NO: 554510 - DNA, 25 bp, Rattus norvegicus
cctcttggggacgtcgaaggccctg

SEQ ID NO: 554511 - DNA, 25 bp, Rattus norvegicus
cccgcccaaccagccatggccgggg

SEQ ID NO: 554512 - DNA, 25 bp, Rattus norvegicus
cagcgcacgcagcgggttcaggacc

SEQ ID NO: 554513 - DNA, 25 bp, Rattus norvegicus
gccagcaacagccacagcgcacgca

SEQ ID NO: 554514 - DNA, 25 bp, Rattus norvegicus
tcccgtagcggatgaggtcctggaa

SEQ ID NO: 554515 - DNA, 25 bp, Rattus norvegicus
atgaggtcctggaagagcgcgcagc

SEQ ID NO: 554516 - DNA, 25 bp, Rattus norvegicus
ggtcttcccgtagcggatgaggtcc

SEQ ID NO: 554517 - DNA, 25 bp, Rattus norvegicus
cttggtcttcccgtagcggatgagg

SEQ ID NO: 554518 - DNA, 25 bp, Rattus norvegicus
actgcttggtcttcccgtagcggat

SEQ ID NO: 554519 - DNA, 25 bp, Rattus norvegicus
cgccgcgagccggactgcttggtct

SEQ ID NO: 554520 - DNA, 25 bp, Rattus norvegicus
aaggccctgcagacggcggggcgcc

SEQ ID NO: 554521 - DNA, 25 bp, Rattus norvegicus
tcttggggacgtcgaaggccctgca

SEQ ID NO: 554522 - DNA, 25 bp, Rattus norvegicus
tctggctaggccgaaatcgcaaatc

SEQ ID NO: 554523 - DNA, 25 bp, Rattus norvegicus
atcccacgcagactcgggagacgga

SEQ ID NO: 554524 - DNA, 25 bp, Rattus norvegicus
agtcaaaaccggacaccacagcatc

SEQ ID NO: 554525 - DNA, 25 bp, Rattus norvegicus
cattttgagtcaaaaccggacacca

SEQ ID NO: 554526 - DNA, 25 bp, Rattus norvegicus
ggtgatcatagaaaaaccattttga

SEQ ID NO: 554527 - DNA, 25 bp, Rattus norvegicus
tggggtgaggtgatcatagaaaaac

SEQ ID NO: 554528 - DNA, 25 bp, Rattus norvegicus
aaacgcgtgagattgctaggtagga

SEQ ID NO: 554529 - DNA, 25 bp, Rattus norvegicus
gaacatttcgctaaaacgcgtgaga

SEQ ID NO: 554530 - DNA, 25 bp, Rattus norvegicus
gtgacgtcccgtgaacatttcgcta

SEQ ID NO: 554531 - DNA, 25 bp, Rattus norvegicus
ggcactcacatttccttttaccacg

SEQ ID NO: 554532 - DNA, 25 bp, Rattus norvegicus
atcattcctgatgtctctggctagg

SEQ ID NO: 554533 - DNA, 25 bp, Rattus norvegicus
atcgcaaatctttgtgatccgcccg

SEQ ID NO: 554534 - DNA, 25 bp, Rattus norvegicus
gacggaggacggcactcacatttcc

SEQ ID NO: 554535 - DNA, 25 bp, Rattus norvegicus
taccacgtaattcgaatcattcctg

SEQ ID NO: 554536 - DNA, 25 bp, Rattus norvegicus
cagagcacagcgacacagaaaacgg

SEQ ID NO: 554537 - DNA, 25 bp, Rattus norvegicus
agggtagcgaacactccagagcaca

SEQ ID NO: 554538 - DNA, 25 bp, Rattus norvegicus
gtaaggacagggtagcgaacactcc

SEQ ID NO: 554539 - DNA, 25 bp, Rattus norvegicus
tacctctaacgaacacgtaaataga

SEQ ID NO: 554540 - DNA, 25 bp, Rattus norvegicus
cgtaaatagagctcctgaggccgct

SEQ ID NO: 554541 - DNA, 25 bp, Rattus norvegicus
ctgccgctgacgcacgtgtatttgc

SEQ ID NO: 554542 - DNA, 25 bp, Rattus norvegicus
cctcggctttttctcgaatccattc

SEQ ID NO: 554543 - DNA, 25 bp, Rattus norvegicus
ctcgaatccattcgctctgcttatt

SEQ ID NO: 554544 - DNA, 25 bp, Rattus norvegicus
tcgctctgcttattctcaatcctta

SEQ ID NO: 554545 - DNA, 25 bp, Rattus norvegicus
ctcaatccttacatcgaggatctcg

SEQ ID NO: 554546 - DNA, 25 bp, Rattus norvegicus
cgaggatctcgaaagtccatttgac

SEQ ID NO: 554547 - DNA, 25 bp, Rattus norvegicus
tccatttgacaaaggcggggtcagt

SEQ ID NO: 554548 - DNA, 25 bp, Rattus norvegicus
cagtgcacgtcagcctgatggtgtc

SEQ ID NO: 554549 - DNA, 25 bp, Rattus norvegicus
tgtatttgcccgtgtgagtggcctc

SEQ ID NO: 554550 - DNA, 25 bp, Rattus norvegicus
aggctctccaagtttgcccagcgtg

SEQ ID NO: 554551 - DNA, 25 bp, Rattus norvegicus
cgtggcagcacctcactaggaaaga

SEQ ID NO: 554552 - DNA, 25 bp, Rattus norvegicus
aagtctgcaacctagcggctgctcg

SEQ ID NO: 554553 - DNA, 25 bp, Rattus norvegicus
atagccgccacctacaggctcgtgg

SEQ ID NO: 554554 - DNA, 25 bp, Rattus norvegicus
ctgtgcacaaagagcgcccgagctg

SEQ ID NO: 554555 - DNA, 25 bp, Rattus norvegicus
gtcacccacgcgcaacttttaacaa

SEQ ID NO: 554556 - DNA, 25 bp, Rattus norvegicus
gccgcgcttagtcggcacaaaagca

SEQ ID NO: 554557 - DNA, 25 bp, Rattus norvegicus
cgccaccttcgctgtagctgtaaca

SEQ ID NO: 554558 - DNA, 25 bp, Rattus norvegicus
tgggaaaagccaaaagctaccactc

SEQ ID NO: 554559 - DNA, 25 bp, Rattus norvegicus
cacggagcaggaccaacaggacgca

SEQ ID NO: 554560 - DNA, 25 bp, Rattus norvegicus
agactctgagctcctctctctgcta

SEQ ID NO: 554561 - DNA, 25 bp, Rattus norvegicus
acagctctcgcccaagtgcacggag

SEQ ID NO: 554562 - DNA, 25 bp, Rattus norvegicus
gctctcggactggaatatgctgatt

SEQ ID NO: 554563 - DNA, 25 bp, Rattus norvegicus
agcaagcccgagattcgtctccacg

SEQ ID NO: 554564 - DNA, 25 bp, Rattus norvegicus
cctacaagatctctctggatccgga

SEQ ID NO: 554565 - DNA, 25 bp, Rattus norvegicus
cagacccggaccctcagcccaccct

SEQ ID NO: 554566 - DNA, 25 bp, Rattus norvegicus
tctccacttcagacccggaccctca

SEQ ID NO: 554567 - DNA, 25 bp, Rattus norvegicus
caccttctgctaaattaagatgccc

SEQ ID NO: 554568 - DNA, 25 bp, Rattus norvegicus
acccaccttctgctaaattaagatg

SEQ ID NO: 554569 - DNA, 25 bp, Rattus norvegicus
tccacccaccttctgctaaattaag

SEQ ID NO: 554570 - DNA, 25 bp, Rattus norvegicus
gatctctctggatccggaatcccgc

SEQ ID NO: 554571 - DNA, 25 bp, Rattus norvegicus
acaagatctctctggatccggaatc

SEQ ID NO: 554572 - DNA, 25 bp, Rattus norvegicus
cctggaggcctggagcgcacaagcg

SEQ ID NO: 554573 - DNA, 25 bp, Rattus norvegicus
agcgcacaagcgggcgactgtccca

SEQ ID NO: 554574 - DNA, 25 bp, Rattus norvegicus
ggcgactgtcccaccctacaagatc

SEQ ID NO: 554575 - DNA, 25 bp, Rattus norvegicus
acaaaccgcaacaagccgaaggagc

SEQ ID NO: 554576 - DNA, 25 bp, Rattus norvegicus
ccgcaacaagccgaaggagcttgcg

SEQ ID NO: 554577 - DNA, 25 bp, Rattus norvegicus
acaagccgaaggagcttgcgccggc

SEQ ID NO: 554578 - DNA, 25 bp, Rattus norvegicus
tgcattgttttcaactgcgacctga

SEQ ID NO: 554579 - DNA, 25 bp, Rattus norvegicus
gctgcgaggagacacggatctactc

SEQ ID NO: 554580 - DNA, 25 bp, Rattus norvegicus
aggcgaacaacagcgcctcctgcag

SEQ ID NO: 554581 - DNA, 25 bp, Rattus norvegicus
ggttacaggcgaacaacagcgcctc

SEQ ID NO: 554582 - DNA, 25 bp, Rattus norvegicus
ttgttttcaactgcgacctgagagg

SEQ ID NO: 554583 - DNA, 25 bp, Rattus norvegicus
tttagggttacaggcgaacaacagc

SEQ ID NO: 554584 - DNA, 25 bp, Rattus norvegicus
cagcgtttgcattgttttcaactgc

SEQ ID NO: 554585 - DNA, 25 bp, Rattus norvegicus
atcctccctgctcagggctgccgca

SEQ ID NO: 554586 - DNA, 25 bp, Rattus norvegicus
actcggtgatcaagcccaagcccaa

SEQ ID NO: 554587 - DNA, 25 bp, Rattus norvegicus
cggatctactcggtgatcaagccca

SEQ ID NO: 554588 - DNA, 25 bp, Rattus norvegicus
ggagacacggatctactcggtgatc

SEQ ID NO: 554589 - DNA, 25 bp, Rattus norvegicus
gcgccaagaagatcgccactgctgc

SEQ ID NO: 554590 - DNA, 25 bp, Rattus norvegicus
agatcgccactgctgcgaggagaca

SEQ ID NO: 554591 - DNA, 25 bp, Rattus norvegicus
tcaactgcgacctgagaggagactg

SEQ ID NO: 554592 - DNA, 25 bp, Rattus norvegicus
caaagcctgcgagcttcgcgagttc

SEQ ID NO: 554593 - DNA, 25 bp, Rattus norvegicus
cgagttcgagccgagatgttcgcca

SEQ ID NO: 554594 - DNA, 25 bp, Rattus norvegicus
ggccagccggttgcgccctataaca

SEQ ID NO: 554595 - DNA, 25 bp, Rattus norvegicus
ccacgcagttcctcatggatgacca

SEQ ID NO: 554596 - DNA, 25 bp, Rattus norvegicus
gatgaccatgatcaggaggagcctg

SEQ ID NO: 554597 - DNA, 25 bp, Rattus norvegicus
ggagcctgatctcaaaaccggcctt

SEQ ID NO: 554598 - DNA, 25 bp, Rattus norvegicus
ccgacgacaccagcgatgaggattt

SEQ ID NO: 554599 - DNA, 25 bp, Rattus norvegicus
ctgcagcgggacttttccgagactt

SEQ ID NO: 554600 - DNA, 25 bp, Rattus norvegicus
tccgagacttacgagcggtaccacg

SEQ ID NO: 554601 - DNA, 25 bp, Rattus norvegicus
cacgccgagagcctgcagaacatga

SEQ ID NO: 554602 - DNA, 25 bp, Rattus norvegicus
gcaagcaggagctcatcaaagagta

SEQ ID NO: 554603 - DNA, 25 bp, Rattus norvegicus
ctctcccgcaaggaggacgaaaata

SEQ ID NO: 554604 - DNA, 25 bp, Rattus norvegicus
gccagctgctgaccgaaaacgaact

SEQ ID NO: 554605 - DNA, 25 bp, Rattus norvegicus
ggagcgagcgcctccttccaagttc

SEQ ID NO: 554606 - DNA, 25 bp, Rattus norvegicus
agcgccgccggacagtccacccagc

SEQ ID NO: 554607 - DNA, 25 bp, Rattus norvegicus
cgctatccgtccctccgcgtcggag

SEQ ID NO: 554608 - DNA, 25 bp, Rattus norvegicus
gagcccgaacccacggagggcgctg

SEQ ID NO: 554609 - DNA, 25 bp, Rattus norvegicus
tggaaaggatgcgatcgcagacgcc

SEQ ID NO: 554610 - DNA, 25 bp, Rattus norvegicus
gatgcgatcgcagacgccgagccgc

SEQ ID NO: 554611 - DNA, 25 bp, Rattus norvegicus
cgctgcgtctgagccgccgagagca

SEQ ID NO: 554612 - DNA, 25 bp, Rattus norvegicus
cccacaccgccagggtgcagggcga

SEQ ID NO: 554613 - DNA, 25 bp, Rattus norvegicus
gaggaagggatgctgtgggtctccc

SEQ ID NO: 554614 - DNA, 25 bp, Rattus norvegicus
ggccaggagcgctcagacccttggt

SEQ ID NO: 554615 - DNA, 25 bp, Rattus norvegicus
cttctcgccccagctctggaggagg

SEQ ID NO: 554616 - DNA, 25 bp, Rattus norvegicus
cacggtccctgaggccgctggcgat

SEQ ID NO: 554617 - DNA, 25 bp, Rattus norvegicus
ggcacctgcggcacccacggtccct

SEQ ID NO: 554618 - DNA, 25 bp, Rattus norvegicus
gaggccgctggcgatcacatcttcc

SEQ ID NO: 554619 - DNA, 25 bp, Rattus norvegicus
agcgctcagacccttggtccgcgta

SEQ ID NO: 554620 - DNA, 25 bp, Rattus norvegicus
gcactgaggattccgccagcggctt

SEQ ID NO: 554621 - DNA, 25 bp, Rattus norvegicus
cagtaattacgagggctcgactggc

SEQ ID NO: 554622 - DNA, 25 bp, Rattus norvegicus
acgaacccagcgcactgaggattcc

SEQ ID NO: 554623 - DNA, 25 bp, Rattus norvegicus
gtgagaggcgcacgaacccagcgca

SEQ ID NO: 554624 - DNA, 25 bp, Rattus norvegicus
tagcctcgccgtccagtaattacga

SEQ ID NO: 554625 - DNA, 25 bp, Rattus norvegicus
ccgtccagtaattacgagggctcga

SEQ ID NO: 554626 - DNA, 25 bp, Rattus norvegicus
gtagtcctgccaaaccgcgggcgac

SEQ ID NO: 554627 - DNA, 25 bp, Rattus norvegicus
gcggcttctagcacccaaataattc

SEQ ID NO: 554628 - DNA, 25 bp, Rattus norvegicus
tagcacccaaataattcgctcccaa

SEQ ID NO: 554629 - DNA, 25 bp, Rattus norvegicus
gccagcggcttctagcacccaaata

SEQ ID NO: 554630 - DNA, 25 bp, Rattus norvegicus
actactctcttggtgccgcagctgc

SEQ ID NO: 554631 - DNA, 25 bp, Rattus norvegicus
ccagatgtttccagtagcctcgccg

SEQ ID NO: 554632 - DNA, 25 bp, Rattus norvegicus
ccactgccgcgctcaagtctggccc

SEQ ID NO: 554633 - DNA, 25 bp, Rattus norvegicus
gctcactactctcttggtgccgcag

SEQ ID NO: 554634 - DNA, 25 bp, Rattus norvegicus
tgcgcagtatgtagcacctccagga

SEQ ID NO: 554635 - DNA, 25 bp, Rattus norvegicus
ggacatttttaaacgcgcacgcgta

SEQ ID NO: 554636 - DNA, 25 bp, Rattus norvegicus
caggcttgttgctaggacattttta

SEQ ID NO: 554637 - DNA, 25 bp, Rattus norvegicus
ttgtcatctcaacacgcaagcaaga

SEQ ID NO: 554638 - DNA, 25 bp, Rattus norvegicus
ccggtcggaggacgaatgtcagatt

SEQ ID NO: 554639 - DNA, 25 bp, Rattus norvegicus
acctccaggacgcaagcgacgtggg

SEQ ID NO: 554640 - DNA, 25 bp, Rattus norvegicus
aaagaccggagtcgcgtacgcatgc

SEQ ID NO: 554641 - DNA, 25 bp, Rattus norvegicus
cagacctgcagagtcggccgcgcta

SEQ ID NO: 554642 - DNA, 25 bp, Rattus norvegicus
cctgcggaacagagacccgcaactg

SEQ ID NO: 554643 - DNA, 25 bp, Rattus norvegicus
ggtctgagacccagatgcccactca

SEQ ID NO: 554644 - DNA, 25 bp, Rattus norvegicus
gcagagcagggaatcgaacgccatc

SEQ ID NO: 554645 - DNA, 25 bp, Rattus norvegicus
ccggcagccattaggccacgctgga

SEQ ID NO: 554646 - DNA, 25 bp, Rattus norvegicus
accgactcctgacgatcccggagga

SEQ ID NO: 554647 - DNA, 25 bp, Rattus norvegicus
aggcatcagggtgcgcagcctatcg

SEQ ID NO: 554648 - DNA, 25 bp, Rattus norvegicus
tttgagccacgaaaccgagacaccc

SEQ ID NO: 554649 - DNA, 25 bp, Rattus norvegicus
caaacctgggcgaagcggcacttcc

SEQ ID NO: 554650 - DNA, 25 bp, Rattus norvegicus
cttcgacttgcgctctattttttga

SEQ ID NO: 554651 - DNA, 25 bp, Rattus norvegicus
ggccttcgacttgcgctctattttt

SEQ ID NO: 554652 - DNA, 25 bp, Rattus norvegicus
gaagcggcacttcccagagcgagtg

SEQ ID NO: 554653 - DNA, 25 bp, Rattus norvegicus
ctctattttttgaatgctcttgggg

SEQ ID NO: 554654 - DNA, 25 bp, Rattus norvegicus
gcgctctattttttgaatgctcttg

SEQ ID NO: 554655 - DNA, 25 bp, Rattus norvegicus
tccaggaaccaaacctgggcgaagc

SEQ ID NO: 554656 - DNA, 25 bp, Rattus norvegicus
gctgacactccaggaaccaaacctg

SEQ ID NO: 554657 - DNA, 25 bp, Rattus norvegicus
ggggcgctgacactccaggaaccaa

SEQ ID NO: 554658 - DNA, 25 bp, Rattus norvegicus
acccagcgaagagtcagtagggacg

SEQ ID NO: 554659 - DNA, 25 bp, Rattus norvegicus
acgaaaccgagacacccagcgaaga

SEQ ID NO: 554660 - DNA, 25 bp, Rattus norvegicus
ggatgtttgagccacgaaaccgaga

SEQ ID NO: 554661 - DNA, 25 bp, Rattus norvegicus
ccgagacacccagcgaagagtcagt

SEQ ID NO: 554662 - DNA, 25 bp, Rattus norvegicus
acctggttcctgctcaggcagggga

SEQ ID NO: 554663 - DNA, 25 bp, Rattus norvegicus
cagctctccgggagttgtcgacgtc

SEQ ID NO: 554664 - DNA, 25 bp, Rattus norvegicus
ctttccacgtgggccgaggcgctgt

SEQ ID NO: 554665 - DNA, 25 bp, Rattus norvegicus
tctccaggcaaaggggctttccacg

SEQ ID NO: 554666 - DNA, 25 bp, Rattus norvegicus
cagaagactggtctccaggcaaagg

SEQ ID NO: 554667 - DNA, 25 bp, Rattus norvegicus
gttgtcgacgtcattcagaagactg

SEQ ID NO: 554668 - DNA, 25 bp, Rattus norvegicus
cccggtgctccggtgacacctggtt

SEQ ID NO: 554669 - DNA, 25 bp, Rattus norvegicus
cgggagttgtcgacgtcattcagaa

SEQ ID NO: 554670 - DNA, 25 bp, Rattus norvegicus
ccggtgacacctggttcctgctcag

SEQ ID NO: 554671 - DNA, 25 bp, Rattus norvegicus
ccgctcagctctccgggagttgtcg

SEQ ID NO: 554672 - DNA, 25 bp, Rattus norvegicus
tcccggacttgggatttgccgagcc

SEQ ID NO: 554673 - DNA, 25 bp, Rattus norvegicus
ccatcccggacttgggatttgccga

SEQ ID NO: 554674 - DNA, 25 bp, Rattus norvegicus
gcaccgacaggcgtcctgcccatcc

SEQ ID NO: 554675 - DNA, 25 bp, Rattus norvegicus
accgtgacgtctcggtggagtggct

SEQ ID NO: 554676 - DNA, 25 bp, Rattus norvegicus
gaggagccctttcgccggccttcaa

SEQ ID NO: 554677 - DNA, 25 bp, Rattus norvegicus
cttcaaagcccacccggtctcctgt

SEQ ID NO: 554678 - DNA, 25 bp, Rattus norvegicus
ctgtatctttgctttcagaccgtcg

SEQ ID NO: 554679 - DNA, 25 bp, Rattus norvegicus
tccctccagcgccacggaccgagga

SEQ ID NO: 554680 - DNA, 25 bp, Rattus norvegicus
aaagcctccgcctcaaatgcggtcg

SEQ ID NO: 554681 - DNA, 25 bp, Rattus norvegicus
gcctcaaatgcggtcgcagcacctg

SEQ ID NO: 554682 - DNA, 25 bp, Rattus norvegicus
tgcggtcgcagcacctgtatctttg

SEQ ID NO: 554683 - DNA, 25 bp, Rattus norvegicus
ccttggcagaaacaaaacaacgacg

SEQ ID NO: 554684 - DNA, 25 bp, Rattus norvegicus
gggattccgaaagcctccgcctcaa

SEQ ID NO: 554685 - DNA, 25 bp, Rattus norvegicus
gacctagcgggattccgaaagcctc

SEQ ID NO: 554686 - DNA, 25 bp, Rattus norvegicus
cacccattgccaggcgagggaccta

SEQ ID NO: 554687 - DNA, 25 bp, Rattus norvegicus
aggatccagacggtggaaactgccc

SEQ ID NO: 554688 - DNA, 25 bp, Rattus norvegicus
tgtcgaaccaaggatccagacggtg

SEQ ID NO: 554689 - DNA, 25 bp, Rattus norvegicus
gggtaactgtcgaaccaaggatcca

SEQ ID NO: 554690 - DNA, 25 bp, Rattus norvegicus
gattgttcctcgaagcgcctttccc

SEQ ID NO: 554691 - DNA, 25 bp, Rattus norvegicus
acaggttcaggtacgtcgcgatctc

SEQ ID NO: 554692 - DNA, 25 bp, Rattus norvegicus
gattttcacctgcttctctgacagg

SEQ ID NO: 554693 - DNA, 25 bp, Rattus norvegicus
cctgcttctctgacaggttcaggta

SEQ ID NO: 554694 - DNA, 25 bp, Rattus norvegicus
cttgcagcttgcgtgattgttcctc

SEQ ID NO: 554695 - DNA, 25 bp, Rattus norvegicus
tggctacccacgcacttgcagcttg

SEQ ID NO: 554696 - DNA, 25 bp, Rattus norvegicus
cgcgcatagtgagcctggctaccca

SEQ ID NO: 554697 - DNA, 25 bp, Rattus norvegicus
ctcgtcctctgagcgcgcatagtga

SEQ ID NO: 554698 - DNA, 25 bp, Rattus norvegicus
tcttcgttagccgaggctggggaca

SEQ ID NO: 554699 - DNA, 25 bp, Rattus norvegicus
atctccttgtcttcgttagccgagg

SEQ ID NO: 554700 - DNA, 25 bp, Rattus norvegicus
tcgcgatctcgattctccggagtcg

SEQ ID NO: 554701 - DNA, 25 bp, Rattus norvegicus
caggtacgtcgcgatctcgattctc

SEQ ID NO: 554702 - DNA, 25 bp, Rattus norvegicus
ggagaaggagcctccgcccttacaa

SEQ ID NO: 554703 - DNA, 25 bp, Rattus norvegicus
ctggggacaaggagtcctcgtcctc

SEQ ID NO: 554704 - DNA, 25 bp, Rattus norvegicus
tggctcacccgtgggcaaaactgcg

SEQ ID NO: 554705 - DNA, 25 bp, Rattus norvegicus
tctttccgtgatctgagctctgtcc

SEQ ID NO: 554706 - DNA, 25 bp, Rattus norvegicus
ccacgtagaaggagcgcgacatttc

SEQ ID NO: 554707 - DNA, 25 bp, Rattus norvegicus
gtccttgatgatgagtgagtccacg

SEQ ID NO: 554708 - DNA, 25 bp, Rattus norvegicus
agaaatccggacctgggtgcgattc

SEQ ID NO: 554709 - DNA, 25 bp, Rattus norvegicus
acggcatgcccagcgggatgaagaa

SEQ ID NO: 554710 - DNA, 25 bp, Rattus norvegicus
cggacactgacatcaccaacgggga

SEQ ID NO: 554711 - DNA, 25 bp, Rattus norvegicus
aagcgccgcttttgcgggacggaca

SEQ ID NO: 554712 - DNA, 25 bp, Rattus norvegicus
ctacccatggtgaggcagtggaatc

SEQ ID NO: 554713 - DNA, 25 bp, Rattus norvegicus
aggtgacgcaaagcgggcacacgca

SEQ ID NO: 554714 - DNA, 25 bp, Rattus norvegicus
ctcttaagcaaaggtagggcgcccg

SEQ ID NO: 554715 - DNA, 25 bp, Rattus norvegicus
tgctgaggtgtactgggattcgaac

SEQ ID NO: 554716 - DNA, 25 bp, Rattus norvegicus
ggcacacgcaaaaagcgccgctttt

SEQ ID NO: 554717 - DNA, 25 bp, Rattus norvegicus
aatctccgcgggtcggacacgttgt

SEQ ID NO: 554718 - DNA, 25 bp, Rattus norvegicus
ggagtgagtgcttcacaccttgaga

SEQ ID NO: 554719 - DNA, 25 bp, Rattus norvegicus
ttttcctagtcacgctcccgggata

SEQ ID NO: 554720 - DNA, 25 bp, Rattus norvegicus
ccaaacaaggtaccatcgatcccaa

SEQ ID NO: 554721 - DNA, 25 bp, Rattus norvegicus
acaccgtagtcccagcggctgagta

SEQ ID NO: 554722 - DNA, 25 bp, Rattus norvegicus
tcccgggataaaacaagtgaattca

SEQ ID NO: 554723 - DNA, 25 bp, Rattus norvegicus
aagtgaattcattcggtggcaccga

SEQ ID NO: 554724 - DNA, 25 bp, Rattus norvegicus
cttgtgctagttggcaagcgcgtga

SEQ ID NO: 554725 - DNA, 25 bp, Rattus norvegicus
cagacactgtgagcgccgcagggtt

SEQ ID NO: 554726 - DNA, 25 bp, Rattus norvegicus
cgatgcaattcgaggcagacactgt

SEQ ID NO: 554727 - DNA, 25 bp, Rattus norvegicus
acggatgtgcttcacgatgcaattc

SEQ ID NO: 554728 - DNA, 25 bp, Rattus norvegicus
tgcacgtttccgcactgtggaattc

SEQ ID NO: 554729 - DNA, 25 bp, Rattus norvegicus
tcggtgtgaaggtgaaacatagtgt

SEQ ID NO: 554730 - DNA, 25 bp, Rattus norvegicus
gatcccaaacctacctgagcgtctg

SEQ ID NO: 554731 - DNA, 25 bp, Rattus norvegicus
tgagcgtctggcctgcaccgcagac

SEQ ID NO: 554732 - DNA, 25 bp, Rattus norvegicus
cggctccggtcacgtcaccgtgtaa

SEQ ID NO: 554733 - DNA, 25 bp, Rattus norvegicus
acagacgccgccttccgggtcggtg

SEQ ID NO: 554734 - DNA, 25 bp, Rattus norvegicus
cggtctctggtgactggcgccgcac

SEQ ID NO: 554735 - DNA, 25 bp, Rattus norvegicus
tcacgtcaccgtgtaaggccctgcg

SEQ ID NO: 554736 - DNA, 25 bp, Rattus norvegicus
aacagctgctcaagtactcgcccga

SEQ ID NO: 554737 - DNA, 25 bp, Rattus norvegicus
tcgatgaaatctacgaggaggagga

SEQ ID NO: 554738 - DNA, 25 bp, Rattus norvegicus
cgggatggcggatttcgatgaaatc

SEQ ID NO: 554739 - DNA, 25 bp, Rattus norvegicus
agagccgatactgccgagctccagc

SEQ ID NO: 554740 - DNA, 25 bp, Rattus norvegicus
gtcttctcaatagccagagccgata

SEQ ID NO: 554741 - DNA, 25 bp, Rattus norvegicus
cggccgggaccaggtcttctcaata

SEQ ID NO: 554742 - DNA, 25 bp, Rattus norvegicus
gttgttcctgcccacggtaatggcg

SEQ ID NO: 554743 - DNA, 25 bp, Rattus norvegicus
aagtctcgcgatgcggtagccggct

SEQ ID NO: 554744 - DNA, 25 bp, Rattus norvegicus
gcgctcccgggaagtctcgcgatgc

SEQ ID NO: 554745 - DNA, 25 bp, Rattus norvegicus
taaggccctgcgagagctaggacga

SEQ ID NO: 554746 - DNA, 25 bp, Rattus norvegicus
tacagaggcaatgcatcgtgggatg

SEQ ID NO: 554747 - DNA, 25 bp, Rattus norvegicus
ccgcattcgggactcatcaagaacc

SEQ ID NO: 554748 - DNA, 25 bp, Rattus norvegicus
gcgacggtctccctacattcttgag

SEQ ID NO: 554749 - DNA, 25 bp, Rattus norvegicus
tgaccctctgccctgggcctggtgt

SEQ ID NO: 554750 - DNA, 25 bp, Rattus norvegicus
acattcttgagtggggctgacgacc

SEQ ID NO: 554751 - DNA, 25 bp, Rattus norvegicus
tgggcgtctacagaggcaatgcatc

SEQ ID NO: 554752 - DNA, 25 bp, Rattus norvegicus
gggcctccgcattcgggactcatca

SEQ ID NO: 554753 - DNA, 25 bp, Rattus norvegicus
cagctgcctttcatctgtttcggta

SEQ ID NO: 554754 - DNA, 25 bp, Rattus norvegicus
ctggtgttctgcgtgggcgtctaca

SEQ ID NO: 554755 - DNA, 25 bp, Rattus norvegicus
cagaacatccggtcctaagtgggcc

SEQ ID NO: 554756 - DNA, 25 bp, Rattus norvegicus
tggggctgacgacccgtctgtgacc

SEQ ID NO: 554757 - DNA, 25 bp, Rattus norvegicus
atccggtcctaagtgggcctccgca

SEQ ID NO: 554758 - DNA, 25 bp, Rattus norvegicus
gcagtgtcgctgtgcagctgccttt

SEQ ID NO: 554759 - DNA, 25 bp, Rattus norvegicus
tgtttcggtaacagaacatccggtc

SEQ ID NO: 554760 - DNA, 25 bp, Rattus norvegicus
actgtcgcttcttggtcttgccgca

SEQ ID NO: 554761 - DNA, 25 bp, Rattus norvegicus
tacctgtcggcagaagaagatgggc

SEQ ID NO: 554762 - DNA, 25 bp, Rattus norvegicus
gcgtggcctgtgagatggatcaccc

SEQ ID NO: 554763 - DNA, 25 bp, Rattus norvegicus
acccgggccgtgactgtcgcttctt

SEQ ID NO: 554764 - DNA, 25 bp, Rattus norvegicus
tcttgccgcagcctgacgggcgctg

SEQ ID NO: 554765 - DNA, 25 bp, Rattus norvegicus
ctgggtgctgcagtcagagccacac

SEQ ID NO: 554766 - DNA, 25 bp, Rattus norvegicus
gtcagagccacacggccgcttcttt

SEQ ID NO: 554767 - DNA, 25 bp, Rattus norvegicus
ccgcttctttggtggcgttgaggac

SEQ ID NO: 554768 - DNA, 25 bp, Rattus norvegicus
cgttgaggaccgactgtcctgcttt

SEQ ID NO: 554769 - DNA, 25 bp, Rattus norvegicus
tgtcctgctttgctacggccatctc

SEQ ID NO: 554770 - DNA, 25 bp, Rattus norvegicus
tgtggaccgtacacctggccatcca

SEQ ID NO: 554771 - DNA, 25 bp, Rattus norvegicus
ggcgctacgtgcacctgtgccttca

SEQ ID NO: 554772 - DNA, 25 bp, Rattus norvegicus
gtgcacctgtgccttcaggaggacg

SEQ ID NO: 554773 - DNA, 25 bp, Rattus norvegicus
ctgtgagatggatcacccgggccgt

SEQ ID NO: 554774 - DNA, 25 bp, Rattus norvegicus
attcagcaactggtccgcctgcgca

SEQ ID NO: 554775 - DNA, 25 bp, Rattus norvegicus
gaacccgctggtaagcgaacgaaga

SEQ ID NO: 554776 - DNA, 25 bp, Rattus norvegicus
gcctcgccgtctcagggcgcgagaa

SEQ ID NO: 554777 - DNA, 25 bp, Rattus norvegicus
ctcgaacaagttaaaggcgacgatc

SEQ ID NO: 554778 - DNA, 25 bp, Rattus norvegicus
gcgaacgaagagagcgcgagactca

SEQ ID NO: 554779 - DNA, 25 bp, Rattus norvegicus
aggaagttccgtaccgccatacagc

SEQ ID NO: 554780 - DNA, 25 bp, Rattus norvegicus
cccgggagacagacaggaagttccg

SEQ ID NO: 554781 - DNA, 25 bp, Rattus norvegicus
ctgccagggctagtacgagaggcct

SEQ ID NO: 554782 - DNA, 25 bp, Rattus norvegicus
tcggcctaacgcaggcctgccaggg

SEQ ID NO: 554783 - DNA, 25 bp, Rattus norvegicus
aggcggcgaccgtgaatattcagca

SEQ ID NO: 554784 - DNA, 25 bp, Rattus norvegicus
gcatgcgcagcagtatccaagcggc

SEQ ID NO: 554785 - DNA, 25 bp, Rattus norvegicus
cggcgtctctaggtggattcgcttc

SEQ ID NO: 554786 - DNA, 25 bp, Rattus norvegicus
gcgcgagactcaaatccagggtcga

SEQ ID NO: 554787 - DNA, 25 bp, Rattus norvegicus
tcaaatccagggtcgacctcggcgg

SEQ ID NO: 554788 - DNA, 25 bp, Rattus norvegicus
aagtactcagtatccggaagccctg

SEQ ID NO: 554789 - DNA, 25 bp, Rattus norvegicus
gactgtcaaagtctcaaagtactca

SEQ ID NO: 554790 - DNA, 25 bp, Rattus norvegicus
cacgtgtactgtgttgactgtcaaa

SEQ ID NO: 554791 - DNA, 25 bp, Rattus norvegicus
taccgaatcatgagtgccgtgggcg

SEQ ID NO: 554792 - DNA, 25 bp, Rattus norvegicus
gagaccggcccacgtgtactgtgtt

SEQ ID NO: 554793 - DNA, 25 bp, Rattus norvegicus
gagactcctggccagactgcgccta

SEQ ID NO: 554794 - DNA, 25 bp, Rattus norvegicus
gcgcgcaggcatacgccaagcattg

SEQ ID NO: 554795 - DNA, 25 bp, Rattus norvegicus
atcagcgccctggacgtcatcaacg

SEQ ID NO: 554796 - DNA, 25 bp, Rattus norvegicus
actgcgcctaccgaatcatgagtgc

SEQ ID NO: 554797 - DNA, 25 bp, Rattus norvegicus
cagtatccggaagccctgcgttctg

SEQ ID NO: 554798 - DNA, 25 bp, Rattus norvegicus
gccctgcgttctgaccgaggttcct

SEQ ID NO: 554799 - DNA, 25 bp, Rattus norvegicus
gccaagcattggagaccggcccacg

SEQ ID NO: 554800 - DNA, 25 bp, Rattus norvegicus
ggacgtcatcaacgcgcgcaggcat

SEQ ID NO: 554801 - DNA, 25 bp, Rattus norvegicus
gcgcatccgccggtgagactcctgg

SEQ ID NO: 554802 - DNA, 25 bp, Rattus norvegicus
agctgcagcagagagtcctggcttc

SEQ ID NO: 554803 - DNA, 25 bp, Rattus norvegicus
tcctggcttcggttaagagacgttg

SEQ ID NO: 554804 - DNA, 25 bp, Rattus norvegicus
cctggcttcggttaagagacgttgc

SEQ ID NO: 554805 - DNA, 25 bp, Rattus norvegicus
ggcttcggttaagagacgttgcctc

SEQ ID NO: 554806 - DNA, 25 bp, Rattus norvegicus
cttcggttaagagacgttgcctctt

SEQ ID NO: 554807 - DNA, 25 bp, Rattus norvegicus
gttaagagacgttgcctcttttcga

SEQ ID NO: 554808 - DNA, 25 bp, Rattus norvegicus
aagagacgttgcctcttttcgagtc

SEQ ID NO: 554809 - DNA, 25 bp, Rattus norvegicus
gagacgttgcctcttttcgagtctt

SEQ ID NO: 554810 - DNA, 25 bp, Rattus norvegicus
gacgttgcctcttttcgagtcttgg

SEQ ID NO: 554811 - DNA, 25 bp, Rattus norvegicus
cgttgcctcttttcgagtcttggct

SEQ ID NO: 554812 - DNA, 25 bp, Rattus norvegicus
caaggtcgtcgggaatcgatcttgt

SEQ ID NO: 554813 - DNA, 25 bp, Rattus norvegicus
tcgggaatcgatcttgtgaagcccg

SEQ ID NO: 554814 - DNA, 25 bp, Rattus norvegicus
cgtcgggaatcgatcttgtgaagcc

SEQ ID NO: 554815 - DNA, 25 bp, Rattus norvegicus
aggtcgtcgggaatcgatcttgtga

SEQ ID NO: 554816 - DNA, 25 bp, Rattus norvegicus
ggcaacgtgctggacccatccggct

SEQ ID NO: 554817 - DNA, 25 bp, Rattus norvegicus
actctgcgatggtacacatgttctg

SEQ ID NO: 554818 - DNA, 25 bp, Rattus norvegicus
agtgaccctcttccgctgaagcagg

SEQ ID NO: 554819 - DNA, 25 bp, Rattus norvegicus
accacggcgatcttgacgagccggc

SEQ ID NO: 554820 - DNA, 25 bp, Rattus norvegicus
ttctggatgagacgcatcgccgctc

SEQ ID NO: 554821 - DNA, 25 bp, Rattus norvegicus
agacggctcgcgttgcaaagagaga

SEQ ID NO: 554822 - DNA, 25 bp, Rattus norvegicus
tgcaaagagagaagggcacccggtc

SEQ ID NO: 554823 - DNA, 25 bp, Rattus norvegicus
cgcgggcagagactggaaagaaccc

SEQ ID NO: 554824 - DNA, 25 bp, Rattus norvegicus
atccacggaaaacagggcggctggc

SEQ ID NO: 554825 - DNA, 25 bp, Rattus norvegicus
atctgtccgtgtctgctgggtctca

SEQ ID NO: 554826 - DNA, 25 bp, Rattus norvegicus
ggaatctgtccttgccttcgtggga

SEQ ID NO: 554827 - DNA, 25 bp, Rattus norvegicus
ttcgtgggagacttgtcctgtctgc

SEQ ID NO: 554828 - DNA, 25 bp, Rattus norvegicus
aagggctcagcagttccaattcgcg

SEQ ID NO: 554829 - DNA, 25 bp, Rattus norvegicus
ttcctcgcttggactcaccggtctt

SEQ ID NO: 554830 - DNA, 25 bp, Rattus norvegicus
gctacttcccaatgaccaagcggtc

SEQ ID NO: 554831 - DNA, 25 bp, Rattus norvegicus
agcctatggggtcattcctagtcaa

SEQ ID NO: 554832 - DNA, 25 bp, Rattus norvegicus
cacgcctcttaatccctgtcaagtg

SEQ ID NO: 554833 - DNA, 25 bp, Rattus norvegicus
tgtcaagtggtgctacttcccaatg

SEQ ID NO: 554834 - DNA, 25 bp, Rattus norvegicus
gtcaagtggtgctacttcccaatga

SEQ ID NO: 554835 - DNA, 25 bp, Rattus norvegicus
caagtggtgctacttcccaatgacc

SEQ ID NO: 554836 - DNA, 25 bp, Rattus norvegicus
gtggtgctacttcccaatgaccaag

SEQ ID NO: 554837 - DNA, 25 bp, Rattus norvegicus
gtgctacttcccaatgaccaagcgg

SEQ ID NO: 554838 - DNA, 25 bp, Rattus norvegicus
ctacttcccaatgaccaagcggtca

SEQ ID NO: 554839 - DNA, 25 bp, Rattus norvegicus
acgcctcttaatccctgtcaagtgg

SEQ ID NO: 554840 - DNA, 25 bp, Rattus norvegicus
cccaatgaccaagcggtcaaatata

SEQ ID NO: 554841 - DNA, 25 bp, Rattus norvegicus
gagcctatggggtcattcctagtca

SEQ ID NO: 554842 - DNA, 25 bp, Rattus norvegicus
ggtgctacttcccaatgaccaagcg

SEQ ID NO: 554843 - DNA, 25 bp, Rattus norvegicus
ttcccaatgaccaagcggtcaaata

SEQ ID NO: 554844 - DNA, 25 bp, Rattus norvegicus
acctgcgcttctatccgaggcagca

SEQ ID NO: 554845 - DNA, 25 bp, Rattus norvegicus
tgccctgggccttccttcgatcaat

SEQ ID NO: 554846 - DNA, 25 bp, Rattus norvegicus
gctgcgctgatacaaccaccagaga

SEQ ID NO: 554847 - DNA, 25 bp, Rattus norvegicus
tgccggcacgtacctgcgcttctat

SEQ ID NO: 554848 - DNA, 25 bp, Rattus norvegicus
cagcacagcttgggcagtggagatc

SEQ ID NO: 554849 - DNA, 25 bp, Rattus norvegicus
gagggctttgtctctcgcgcagccc

SEQ ID NO: 554850 - DNA, 25 bp, Rattus norvegicus
aggggacacggggacatcctgacac

SEQ ID NO: 554851 - DNA, 25 bp, Rattus norvegicus
cggggacatcctgacaccctgcaga

SEQ ID NO: 554852 - DNA, 25 bp, Rattus norvegicus
ctgacaccctgcagagtggacactc

SEQ ID NO: 554853 - DNA, 25 bp, Rattus norvegicus
agagtggacactcaccgcaacgccg

SEQ ID NO: 554854 - DNA, 25 bp, Rattus norvegicus
cgccgggaacagaaaggccaagccg

SEQ ID NO: 554855 - DNA, 25 bp, Rattus norvegicus
cagaaaggccaagccggtgcgcgct

SEQ ID NO: 554856 - DNA, 25 bp, Rattus norvegicus
gtgcgcgctgcgctgatacaaccac

SEQ ID NO: 554857 - DNA, 25 bp, Rattus norvegicus
ttccttcgatcaatgccggcacgta

SEQ ID NO: 554858 - DNA, 25 bp, Rattus norvegicus
gcgagccaggcaaagaaagggaacc

SEQ ID NO: 554859 - DNA, 25 bp, Rattus norvegicus
agaacagctttcagccgggttgggc

SEQ ID NO: 554860 - DNA, 25 bp, Rattus norvegicus
gtgcgcgatcgctgcaacctttaga

SEQ ID NO: 554861 - DNA, 25 bp, Rattus norvegicus
gatcgctgcaacctttagactaatg

SEQ ID NO: 554862 - DNA, 25 bp, Rattus norvegicus
tagactaatgactgtccgaaacatc

SEQ ID NO: 554863 - DNA, 25 bp, Rattus norvegicus
tgtccgaaacatcgcctccatctgt

SEQ ID NO: 554864 - DNA, 25 bp, Rattus norvegicus
ggaccctgaagggatcccagggatc

SEQ ID NO: 554865 - DNA, 25 bp, Rattus norvegicus
cgcccgcagcgagccaggcaaagaa

SEQ ID NO: 554866 - DNA, 25 bp, Rattus norvegicus
cgcggtcagaagttcccggctctga

SEQ ID NO: 554867 - DNA, 25 bp, Rattus norvegicus
atgcagctggcacggagcggtaccc

SEQ ID NO: 554868 - DNA, 25 bp, Rattus norvegicus
ctccatctgtaatatggtgagtggc

SEQ ID NO: 554869 - DNA, 25 bp, Rattus norvegicus
gcgccaccatggacagtcccgtttt

SEQ ID NO: 554870 - DNA, 25 bp, Rattus norvegicus
gactgacctagcgatgcagctggca

SEQ ID NO: 554871 - DNA, 25 bp, Rattus norvegicus
gttcgttggggactgacctagcgat

SEQ ID NO: 554872 - DNA, 25 bp, Rattus norvegicus
cgacttcgggagatctagtagtaga

SEQ ID NO: 554873 - DNA, 25 bp, Rattus norvegicus
cgattattaaacaaaccttgacgtg

SEQ ID NO: 554874 - DNA, 25 bp, Rattus norvegicus
acaaaccttgacgtggcggccggct

SEQ ID NO: 554875 - DNA, 25 bp, Rattus norvegicus
ccagggcgaaggcatcgaagccatc

SEQ ID NO: 554876 - DNA, 25 bp, Rattus norvegicus
acgcagctggagtgtccatcctcgc

SEQ ID NO: 554877 - DNA, 25 bp, Rattus norvegicus
cgcgcttccgacttcgggagatcta

SEQ ID NO: 554878 - DNA, 25 bp, Rattus norvegicus
gacgacggggtgatgtagtttacaa

SEQ ID NO: 554879 - DNA, 25 bp, Rattus norvegicus
ggtgatgtagtttacaaagatgtta

SEQ ID NO: 554880 - DNA, 25 bp, Rattus norvegicus
ctcgcgcctagccttgggaccttgg

SEQ ID NO: 554881 - DNA, 25 bp, Rattus norvegicus
ttatattctacacaggctcagaacg

SEQ ID NO: 554882 - DNA, 25 bp, Rattus norvegicus
tctacacaggctcagaacgcagctg

SEQ ID NO: 554883 - DNA, 25 bp, Rattus norvegicus
tcagaacgcagctggagtgtccatc

SEQ ID NO: 554884 - DNA, 25 bp, Rattus norvegicus
cctgcccggcgattttctggctccc

SEQ ID NO: 554885 - DNA, 25 bp, Rattus norvegicus
ggacccgcggctagcgtccgagcaa

SEQ ID NO: 554886 - DNA, 25 bp, Rattus norvegicus
ggagcctgcgcctggacgtgcctct

SEQ ID NO: 554887 - DNA, 25 bp, Rattus norvegicus
cctctgcgggagtgatacgggtcat

SEQ ID NO: 554888 - DNA, 25 bp, Rattus norvegicus
cagactcttgcccactctggatttc

SEQ ID NO: 554889 - DNA, 25 bp, Rattus norvegicus
agctgtccctctgcgggagtgatac

SEQ ID NO: 554890 - DNA, 25 bp, Rattus norvegicus
cgcagtcaagatgctggcgaaggcc

SEQ ID NO: 554891 - DNA, 25 bp, Rattus norvegicus
gggagctgtccgcagtcaagatgct

SEQ ID NO: 554892 - DNA, 25 bp, Rattus norvegicus
cgaccgagcaggtctgtgagcctgc

SEQ ID NO: 554893 - DNA, 25 bp, Rattus norvegicus
ggatctgagcctacacagactcttg

SEQ ID NO: 554894 - DNA, 25 bp, Rattus norvegicus
agtgaccggcctccagggatctgag

SEQ ID NO: 554895 - DNA, 25 bp, Rattus norvegicus
actcacggtggcgagtgaccggcct

SEQ ID NO: 554896 - DNA, 25 bp, Rattus norvegicus
acccgcgagtgactcacggtggcga

SEQ ID NO: 554897 - DNA, 25 bp, Rattus norvegicus
tgccacgcccatgcaacccgcgagt

SEQ ID NO: 554898 - DNA, 25 bp, Rattus norvegicus
gcccactctggatttctttcggagg

SEQ ID NO: 554899 - DNA, 25 bp, Rattus norvegicus
cgtggccatcccagggtgtgagccc

SEQ ID NO: 554900 - DNA, 25 bp, Rattus norvegicus
gtcctgtaatcccagcccgcgttga

SEQ ID NO: 554901 - DNA, 25 bp, Rattus norvegicus
tcccagaattccatgagcctgcctt

SEQ ID NO: 554902 - DNA, 25 bp, Rattus norvegicus
cgagttagtcaagcaaggaggttcc

SEQ ID NO: 554903 - DNA, 25 bp, Rattus norvegicus
gttccaggagccagaccctaaagga

SEQ ID NO: 554904 - DNA, 25 bp, Rattus norvegicus
cacgcgcgttgctatgcctccaaag

SEQ ID NO: 554905 - DNA, 25 bp, Rattus norvegicus
aagcggccctccatacaggttaaca

SEQ ID NO: 554906 - DNA, 25 bp, Rattus norvegicus
ttagggaactgcgtcacacactgcc

SEQ ID NO: 554907 - DNA, 25 bp, Rattus norvegicus
aacgcattgggtctccgcggcataa

SEQ ID NO: 554908 - DNA, 25 bp, Rattus norvegicus
caggtccggtcagcaagcagacagc

SEQ ID NO: 554909 - DNA, 25 bp, Rattus norvegicus
ctcccggttgctcgctaaaagtggc

SEQ ID NO: 554910 - DNA, 25 bp, Rattus norvegicus
ccgcggcataaagcacgagttagtc

SEQ ID NO: 554911 - DNA, 25 bp, Rattus norvegicus
cccgggcagctgagactacaagtcc

SEQ ID NO: 554912 - DNA, 25 bp, Rattus norvegicus
tctgggactcgtttccacagttacc

SEQ ID NO: 554913 - DNA, 25 bp, Rattus norvegicus
gggaccctgacacctcttacgctaa

SEQ ID NO: 554914 - DNA, 25 bp, Rattus norvegicus
tgcctccgaccatggcgtgttgtca

SEQ ID NO: 554915 - DNA, 25 bp, Rattus norvegicus
cgacagatagtgcacgcgcgaggaa

SEQ ID NO: 554916 - DNA, 25 bp, Rattus norvegicus
gcgggcagcagaagtccgacagata

SEQ ID NO: 554917 - DNA, 25 bp, Rattus norvegicus
ctccgcatcatgtcgcagcacatgg

SEQ ID NO: 554918 - DNA, 25 bp, Rattus norvegicus
cccggtggacagaaagacctccgca

SEQ ID NO: 554919 - DNA, 25 bp, Rattus norvegicus
acatagacgaactcgcgcccggtgg

SEQ ID NO: 554920 - DNA, 25 bp, Rattus norvegicus
gccctcctggtcatacacatagacg

SEQ ID NO: 554921 - DNA, 25 bp, Rattus norvegicus
gccacacctggtcgggaaactggta

SEQ ID NO: 554922 - DNA, 25 bp, Rattus norvegicus
tccgggcacacaggacgtagagtgc

SEQ ID NO: 554923 - DNA, 25 bp, Rattus norvegicus
caggcagtagatgccagtccgggca

SEQ ID NO: 554924 - DNA, 25 bp, Rattus norvegicus
ccagtgagtccaacgacaggcagta

SEQ ID NO: 554925 - DNA, 25 bp, Rattus norvegicus
gacccgacttgtgcactggccggac

SEQ ID NO: 554926 - DNA, 25 bp, Rattus norvegicus
tcagtggccgtcagaaggactacta

SEQ ID NO: 554927 - DNA, 25 bp, Rattus norvegicus
aggactactactggggcaaaccgcg

SEQ ID NO: 554928 - DNA, 25 bp, Rattus norvegicus
cctggtagaggccactattcggagc

SEQ ID NO: 554929 - DNA, 25 bp, Rattus norvegicus
tggacccaacggctgtcagtcattc

SEQ ID NO: 554930 - DNA, 25 bp, Rattus norvegicus
tcattcaagggtccgaaagcgcgtg

SEQ ID NO: 554931 - DNA, 25 bp, Rattus norvegicus
gggacttggtctatcttgaccctga

SEQ ID NO: 554932 - DNA, 25 bp, Rattus norvegicus
cggtcgcgccagttctcatcaatcg

SEQ ID NO: 554933 - DNA, 25 bp, Rattus norvegicus
ccctagactgcaacgtgattggccc

SEQ ID NO: 554934 - DNA, 25 bp, Rattus norvegicus
tcggactccaggaggggaacagctc

SEQ ID NO: 554935 - DNA, 25 bp, Rattus norvegicus
gctggctctgtgctactcactgaca

SEQ ID NO: 554936 - DNA, 25 bp, Rattus norvegicus
gacagctgcagcatccgagtgcatt

SEQ ID NO: 554937 - DNA, 25 bp, Rattus norvegicus
cgagtgcattttcgggcagctcaca

SEQ ID NO: 554938 - DNA, 25 bp, Rattus norvegicus
gctctcaacagaggaccggcggctc

SEQ ID NO: 554939 - DNA, 25 bp, Rattus norvegicus
catcccgcctttctcattggctaga

SEQ ID NO: 554940 - DNA, 25 bp, Rattus norvegicus
ttggctagaccaccaccgagggacc

SEQ ID NO: 554941 - DNA, 25 bp, Rattus norvegicus
cggctctcatttgaccgaaggagtg

SEQ ID NO: 554942 - DNA, 25 bp, Rattus norvegicus
ggcgctccagagctgcactgcggct

SEQ ID NO: 554943 - DNA, 25 bp, Rattus norvegicus
tcaatactcgtgtgtcggccacgcc

SEQ ID NO: 554944 - DNA, 25 bp, Rattus norvegicus
tgccgctgggcagtctctcaatact

SEQ ID NO: 554945 - DNA, 25 bp, Rattus norvegicus
tgttagacagctctggggcactgcc

SEQ ID NO: 554946 - DNA, 25 bp, Rattus norvegicus
accatcgacaggaaatgatgttaga

SEQ ID NO: 554947 - DNA, 25 bp, Rattus norvegicus
agacccggaagcagtaccatcgaca

SEQ ID NO: 554948 - DNA, 25 bp, Rattus norvegicus
agcgccagcagaccgagacccggaa

SEQ ID NO: 554949 - DNA, 25 bp, Rattus norvegicus
gtcacctagacacaagcgccagcag

SEQ ID NO: 554950 - DNA, 25 bp, Rattus norvegicus
gggctcgccaagatgtcacctagac

SEQ ID NO: 554951 - DNA, 25 bp, Rattus norvegicus
gagggcagcttcaaagggctcgcca

SEQ ID NO: 554952 - DNA, 25 bp, Rattus norvegicus
cccaaagacaggcacggaggacaac

SEQ ID NO: 554953 - DNA, 25 bp, Rattus norvegicus
tacctcacgaaggaggcggcaacgc

SEQ ID NO: 554954 - DNA, 25 bp, Rattus norvegicus
tgggagactggcagaaagctgaaac

SEQ ID NO: 554955 - DNA, 25 bp, Rattus norvegicus
gaccggacacctccaggcaggaaaa

SEQ ID NO: 554956 - DNA, 25 bp, Rattus norvegicus
aggggacgcgccattgtcaaagaga

SEQ ID NO: 554957 - DNA, 25 bp, Rattus norvegicus
ccacccactgcttgcggtgctggga

SEQ ID NO: 554958 - DNA, 25 bp, Rattus norvegicus
ttgctcatccgacccggctgagggt

SEQ ID NO: 554959 - DNA, 25 bp, Rattus norvegicus
ggcgctgctgcagcgttgctcatcc

SEQ ID NO: 554960 - DNA, 25 bp, Rattus norvegicus
gctccgttcgcacgccgcgggatta

SEQ ID NO: 554961 - DNA, 25 bp, Rattus norvegicus
aaagcccgtcggagctgcggcagac

SEQ ID NO: 554962 - DNA, 25 bp, Rattus norvegicus
tactgagccggggtcaaccgaaagc

SEQ ID NO: 554963 - DNA, 25 bp, Rattus norvegicus
tacccatcttgctgcgagccgcgag

SEQ ID NO: 554964 - DNA, 25 bp, Rattus norvegicus
atttcactttctcttccagcgccgg

SEQ ID NO: 554965 - DNA, 25 bp, Rattus norvegicus
ccattgtcaaagagaacggagcctg

SEQ ID NO: 554966 - DNA, 25 bp, Rattus norvegicus
atcggtcccgatcggattattcctt

SEQ ID NO: 554967 - DNA, 25 bp, Rattus norvegicus
tctgggagagacagaaatccggtta

SEQ ID NO: 554968 - DNA, 25 bp, Rattus norvegicus
ctgtttggggaaaggcgcttcattt

SEQ ID NO: 554969 - DNA, 25 bp, Rattus norvegicus
gctcctaacggacgccggcgcggta

SEQ ID NO: 554970 - DNA, 25 bp, Rattus norvegicus
ccattcgcctaacggggctagcctg

SEQ ID NO: 554971 - DNA, 25 bp, Rattus norvegicus
ctcgaggccggtcttcgaggacacc

SEQ ID NO: 554972 - DNA, 25 bp, Rattus norvegicus
tagcctgagattaaccgcgggtttc

SEQ ID NO: 554973 - DNA, 25 bp, Rattus norvegicus
gagcgccgggtctccattcgcctaa

SEQ ID NO: 554974 - DNA, 25 bp, Rattus norvegicus
aagttggcgtctccatacggcctgc

SEQ ID NO: 554975 - DNA, 25 bp, Rattus norvegicus
ccctgctcggaaagttggcgtctcc

SEQ ID NO: 554976 - DNA, 25 bp, Rattus norvegicus
aagttcatgttgacggcggagtcca

SEQ ID NO: 554977 - DNA, 25 bp, Rattus norvegicus
ctgcgccctgggctttcctgaagcg

SEQ ID NO: 554978 - DNA, 25 bp, Rattus norvegicus
cattatgccgtagaggccgccggcc

SEQ ID NO: 554979 - DNA, 25 bp, Rattus norvegicus
taacctgctcgaacccattatgccg

SEQ ID NO: 554980 - DNA, 25 bp, Rattus norvegicus
aatcccttcggcttctacttcggct

SEQ ID NO: 554981 - DNA, 25 bp, Rattus norvegicus
ctgggaagtcagcagtttgcagcgc

SEQ ID NO: 554982 - DNA, 25 bp, Rattus norvegicus
cagcactgcgcggagttctcccgag

SEQ ID NO: 554983 - DNA, 25 bp, Rattus norvegicus
aggcgtgtcttgtgttgccctgact

SEQ ID NO: 554984 - DNA, 25 bp, Rattus norvegicus
ctcgccgggaacatgggtgcgtccc

SEQ ID NO: 554985 - DNA, 25 bp, Rattus norvegicus
aggccatgagctgcgctcgctgata

SEQ ID NO: 554986 - DNA, 25 bp, Rattus norvegicus
ggggactgctttcatcactgccacc

SEQ ID NO: 554987 - DNA, 25 bp, Rattus norvegicus
ccaccgaaggtcacgggcgagtaca

SEQ ID NO: 554988 - DNA, 25 bp, Rattus norvegicus
gtgcggcgcccgagcgaacactgca

SEQ ID NO: 554989 - DNA, 25 bp, Rattus norvegicus
cgagcgaacactgcaccgaggcatc

SEQ ID NO: 554990 - DNA, 25 bp, Rattus norvegicus
aacactgcaccgaggcatcgcggcg

SEQ ID NO: 554991 - DNA, 25 bp, Rattus norvegicus
ccgcgttaaataggcggccgcgcac

SEQ ID NO: 554992 - DNA, 25 bp, Rattus norvegicus
cattcgcgacagcaaggccatgagc

SEQ ID NO: 554993 - DNA, 25 bp, Rattus norvegicus
gcgctcgctgatagctgtcaaagta

SEQ ID NO: 554994 - DNA, 25 bp, Rattus norvegicus
gctgtcaaagtactccgcggccatg

SEQ ID NO: 554995 - DNA, 25 bp, Rattus norvegicus
ccgcggccatgagctgtctgtagcc

SEQ ID NO: 554996 - DNA, 25 bp, Rattus norvegicus
cctccgcgccgcgttaaataggcgg

SEQ ID NO: 554997 - DNA, 25 bp, Rattus norvegicus
gccggggacccattcgcgacagcaa

SEQ ID NO: 554998 - DNA, 25 bp, Rattus norvegicus
tcggcttcaacctgtctgtccggtc

SEQ ID NO: 554999 - DNA, 25 bp, Rattus norvegicus
aggggctatcctcggcttcaacctg

SEQ ID NO: 555000 - DNA, 25 bp, Rattus norvegicus
caagtcgggactgaagccgatgctc

SEQ ID NO: 555001 - DNA, 25 bp, Rattus norvegicus
acgaacacgttcagcccgtggttga

SEQ ID NO: 555002 - DNA, 25 bp, Rattus norvegicus
aaggcggcgcccacgaacacgttca

SEQ ID NO: 555003 - DNA, 25 bp, Rattus norvegicus
gcccagcatggtgatgcacaaggcg

SEQ ID NO: 555004 - DNA, 25 bp, Rattus norvegicus
tggttcacgtccacggtacagccca

SEQ ID NO: 555005 - DNA, 25 bp, Rattus norvegicus
tgcgctccgaagtggttcacgtcca

SEQ ID NO: 555006 - DNA, 25 bp, Rattus norvegicus
aagccgaactggcagagagcagcca

SEQ ID NO: 555007 - DNA, 25 bp, Rattus norvegicus
cgagcagcggcaagaagccgaactg

SEQ ID NO: 555008 - DNA, 25 bp, Rattus norvegicus
atccagcttgaaggcgagggccagc

SEQ ID NO: 555009 - DNA, 25 bp, Rattus norvegicus
gcggccacctcatccagcttgaagg

SEQ ID NO: 555010 - DNA, 25 bp, Rattus norvegicus
acggtacagcccaggcccagcatgg

SEQ ID NO: 555011 - DNA, 25 bp, Rattus norvegicus
ccgtgtgcatgctgcccggcagctg

SEQ ID NO: 555012 - DNA, 25 bp, Rattus norvegicus
agatcctcactgctggtccgtcgcg

SEQ ID NO: 555013 - DNA, 25 bp, Rattus norvegicus
aggaggcctgcactctgcacggctc

SEQ ID NO: 555014 - DNA, 25 bp, Rattus norvegicus
ctgagcggctcctcagctgctcgtt

SEQ ID NO: 555015 - DNA, 25 bp, Rattus norvegicus
ctggtccgcgttcacattggagtta

SEQ ID NO: 555016 - DNA, 25 bp, Rattus norvegicus
gagttaacgtcctccatgccggccg

SEQ ID NO: 555017 - DNA, 25 bp, Rattus norvegicus
agagaggcgttaccgccaccgctca

SEQ ID NO: 555018 - DNA, 25 bp, Rattus norvegicus
tcacgctagccgaggcgccggcata

SEQ ID NO: 555019 - DNA, 25 bp, Rattus norvegicus
aggcggcgccaatatccggcctcgg

SEQ ID NO: 555020 - DNA, 25 bp, Rattus norvegicus
gctgcccgtgggctgaaagaactaa

SEQ ID NO: 555021 - DNA, 25 bp, Rattus norvegicus
tgaaagaactaagcgcccggctcgc

SEQ ID NO: 555022 - DNA, 25 bp, Rattus norvegicus
tgtgagccagggtgaaatcgagaac

SEQ ID NO: 555023 - DNA, 25 bp, Rattus norvegicus
cgggatccagatccagctcaggctc

SEQ ID NO: 555024 - DNA, 25 bp, Rattus norvegicus
agcggttctacctcgtccagcaagc

SEQ ID NO: 555025 - DNA, 25 bp, Rattus norvegicus
tgacaagcgctccagctcgtcgggc

SEQ ID NO: 555026 - DNA, 25 bp, Rattus norvegicus
acaggtgtcactgctaccggctctc

SEQ ID NO: 555027 - DNA, 25 bp, Rattus norvegicus
atcatcatccggtttgcccgcgggg

SEQ ID NO: 555028 - DNA, 25 bp, Rattus norvegicus
tggaggtcggttccctgttcccaca

SEQ ID NO: 555029 - DNA, 25 bp, Rattus norvegicus
agggctctcagccacccacaggtgt

SEQ ID NO: 555030 - DNA, 25 bp, Rattus norvegicus
cgctcggtcaaggtaagaacccagg

SEQ ID NO: 555031 - DNA, 25 bp, Rattus norvegicus
agcatttctctggacggttctctta

SEQ ID NO: 555032 - DNA, 25 bp, Rattus norvegicus
ctcttaggatgggaagtccggactt

SEQ ID NO: 555033 - DNA, 25 bp, Rattus norvegicus
ccacgccgcgtctgtgtggataaca

SEQ ID NO: 555034 - DNA, 25 bp, Rattus norvegicus
aacaggcgctctctggaacttcggc

SEQ ID NO: 555035 - DNA, 25 bp, Rattus norvegicus
gagctcgggcaccagtctttgactt

SEQ ID NO: 555036 - DNA, 25 bp, Rattus norvegicus
tggtcagcgcttgccaaactccagg

SEQ ID NO: 555037 - DNA, 25 bp, Rattus norvegicus
gtctcctgtcctgtgtcagcacgcg

SEQ ID NO: 555038 - DNA, 25 bp, Rattus norvegicus
ttttatcaccgcaaggcacatcatc

SEQ ID NO: 555039 - DNA, 25 bp, Rattus norvegicus
ccgagccggagacgaaagagcattt

SEQ ID NO: 555040 - DNA, 25 bp, Rattus norvegicus
acgcattctacggtccgcgggcaga

SEQ ID NO: 555041 - DNA, 25 bp, Rattus norvegicus
tttccaaaggtcgagagcaaccgca

SEQ ID NO: 555042 - DNA, 25 bp, Rattus norvegicus
agacgtagctttcggtgcggtccac

SEQ ID NO: 555043 - DNA, 25 bp, Rattus norvegicus
tgcgggtcacaagcagcgctctgct

SEQ ID NO: 555044 - DNA, 25 bp, Rattus norvegicus
gcccaccaatgaaggtgtctacgtt

SEQ ID NO: 555045 - DNA, 25 bp, Rattus norvegicus
gctccagagcactctgggaaatata

SEQ ID NO: 555046 - DNA, 25 bp, Rattus norvegicus
gcgcatgcgcgctgagaatttctta

SEQ ID NO: 555047 - DNA, 25 bp, Rattus norvegicus
cgccgtcggtaaggagacgtagctt

SEQ ID NO: 555048 - DNA, 25 bp, Rattus norvegicus
tgcggtccacttcagcagttggttc

SEQ ID NO: 555049 - DNA, 25 bp, Rattus norvegicus
tcacggtcagtcagcgtttcggtgc

SEQ ID NO: 555050 - DNA, 25 bp, Rattus norvegicus
accgcacttctcctgagggtgacga

SEQ ID NO: 555051 - DNA, 25 bp, Rattus norvegicus
ttctctgcagggatggacgcttcct

SEQ ID NO: 555052 - DNA, 25 bp, Rattus norvegicus
aaatggagtccctcttagcggcgca

SEQ ID NO: 555053 - DNA, 25 bp, Rattus norvegicus
tgtctacgtttcacgagctccagag

SEQ ID NO: 555054 - DNA, 25 bp, Rattus norvegicus
tgctccggaggagcacagtcgccga

SEQ ID NO: 555055 - DNA, 25 bp, Rattus norvegicus
cagtcatgggcagggtttctttcaa

SEQ ID NO: 555056 - DNA, 25 bp, Rattus norvegicus
gccctccatgcactgaacgggtttg

SEQ ID NO: 555057 - DNA, 25 bp, Rattus norvegicus
agactgcaggtggaaccgtcggact

SEQ ID NO: 555058 - DNA, 25 bp, Rattus norvegicus
tgctcttgtcctgggcgatgctacc

SEQ ID NO: 555059 - DNA, 25 bp, Rattus norvegicus
tctttcaacgttcgggtcagctctg

SEQ ID NO: 555060 - DNA, 25 bp, Rattus norvegicus
ctccactcccgtggcttggagtcgg

SEQ ID NO: 555061 - DNA, 25 bp, Rattus norvegicus
acttctcagtggctcgctcagtgcc

SEQ ID NO: 555062 - DNA, 25 bp, Rattus norvegicus
ccgtaggtcagtcagtgagcacaga

SEQ ID NO: 555063 - DNA, 25 bp, Rattus norvegicus
acctcctgcctgtccgtaggtcagt

SEQ ID NO: 555064 - DNA, 25 bp, Rattus norvegicus
agtcctggtgacttcagagtcaatc

SEQ ID NO: 555065 - DNA, 25 bp, Rattus norvegicus
gagggtaagatccaccctcctcgct

SEQ ID NO: 555066 - DNA, 25 bp, Rattus norvegicus
acacaggtcgcgtggcctgagtcct

SEQ ID NO: 555067 - DNA, 25 bp, Rattus norvegicus
gcgatgctacctgtcctgcagagtc

SEQ ID NO: 555068 - DNA, 25 bp, Rattus norvegicus
accttgggtgcaggtacctgtcgtc

SEQ ID NO: 555069 - DNA, 25 bp, Rattus norvegicus
tcagaagccaaccaagtcgccctgg

SEQ ID NO: 555070 - DNA, 25 bp, Rattus norvegicus
ccggatagagcgtcgcttccgctca

SEQ ID NO: 555071 - DNA, 25 bp, Rattus norvegicus
gcttccgctcagagccgcgtgtgac

SEQ ID NO: 555072 - DNA, 25 bp, Rattus norvegicus
tgaccttcccgcttgcggagctatg

SEQ ID NO: 555073 - DNA, 25 bp, Rattus norvegicus
agaattccgtagatatgcggtcgcc

SEQ ID NO: 555074 - DNA, 25 bp, Rattus norvegicus
tcgcgccgcctagtgcgtaatatca

SEQ ID NO: 555075 - DNA, 25 bp, Rattus norvegicus
cgccgctgagacctatcgcagtgga

SEQ ID NO: 555076 - DNA, 25 bp, Rattus norvegicus
cagtggacggtagcatagcccgagc

SEQ ID NO: 555077 - DNA, 25 bp, Rattus norvegicus
ccagtactatttccgggcccagact

SEQ ID NO: 555078 - DNA, 25 bp, Rattus norvegicus
ggagaaagctccgacccagtactat

SEQ ID NO: 555079 - DNA, 25 bp, Rattus norvegicus
cccttgcgagacaaaggcatgccgc

SEQ ID NO: 555080 - DNA, 25 bp, Rattus norvegicus
tgcggtcgcctactcattacccttg

SEQ ID NO: 555081 - DNA, 25 bp, Rattus norvegicus
agcgctccgccttgtcaggtatagc

SEQ ID NO: 555082 - DNA, 25 bp, Rattus norvegicus
gctggttaccgccaggatccctgtt

SEQ ID NO: 555083 - DNA, 25 bp, Rattus norvegicus
actgaaacttctcggaacttcgcgc

SEQ ID NO: 555084 - DNA, 25 bp, Rattus norvegicus
gtagcaatcgcttcccactgaaact

SEQ ID NO: 555085 - DNA, 25 bp, Rattus norvegicus
tcccaggaaagtaatcgtagcaatc

SEQ ID NO: 555086 - DNA, 25 bp, Rattus norvegicus
tggagacttagtttccagattccca

SEQ ID NO: 555087 - DNA, 25 bp, Rattus norvegicus
gaccgaggtggagacttagtttcca

SEQ ID NO: 555088 - DNA, 25 bp, Rattus norvegicus
tgcgcagcttcccagttttggggac

SEQ ID NO: 555089 - DNA, 25 bp, Rattus norvegicus
atagtgggcgcgctttgcgcagctt

SEQ ID NO: 555090 - DNA, 25 bp, Rattus norvegicus
cgggacttctgtgccggagctctag

SEQ ID NO: 555091 - DNA, 25 bp, Rattus norvegicus
ctgctagaactcagtgcgggacttc

SEQ ID NO: 555092 - DNA, 25 bp, Rattus norvegicus
tgctgtcctaccaggttctgctaga

SEQ ID NO: 555093 - DNA, 25 bp, Rattus norvegicus
aaggcgtcctgaggtgctgtcctac

SEQ ID NO: 555094 - DNA, 25 bp, Rattus norvegicus
gccaggatccctgttgcgcaaagcg

SEQ ID NO: 555095 - DNA, 25 bp, Rattus norvegicus
cgcaaagcgggaaccggaccagcca

SEQ ID NO: 555096 - DNA, 25 bp, Rattus norvegicus
acgcgcacaaggactttgagcctga

SEQ ID NO: 555097 - DNA, 25 bp, Rattus norvegicus
gtgcggggtcttcttgattctagaa

SEQ ID NO: 555098 - DNA, 25 bp, Rattus norvegicus
tagaaagcctgagatctgctgcgtc

SEQ ID NO: 555099 - DNA, 25 bp, Rattus norvegicus
tcacgtgggagaaccgtagcttacg

SEQ ID NO: 555100 - DNA, 25 bp, Rattus norvegicus
ggacgattattcctgggaccctgga

SEQ ID NO: 555101 - DNA, 25 bp, Rattus norvegicus
ccgccctctgagaagtcacgtggga

SEQ ID NO: 555102 - DNA, 25 bp, Rattus norvegicus
tttacgcgggcctgggaatggccca

SEQ ID NO: 555103 - DNA, 25 bp, Rattus norvegicus
ggactttgagcctgactgctggccc

SEQ ID NO: 555104 - DNA, 25 bp, Rattus norvegicus
ccctggagacagaatggcggctaaa

SEQ ID NO: 555105 - DNA, 25 bp, Rattus norvegicus
atcttagcttctcggggatggagcc

SEQ ID NO: 555106 - DNA, 25 bp, Rattus norvegicus
cacgtgacaggtatcttagcttctc

SEQ ID NO: 555107 - DNA, 25 bp, Rattus norvegicus
aggtccaggcctatcacgtgacagg

SEQ ID NO: 555108 - DNA, 25 bp, Rattus norvegicus
ggctgcagaagcttcctccggagca

SEQ ID NO: 555109 - DNA, 25 bp, Rattus norvegicus
cgtagcttacgcctaaggtccaggc

SEQ ID NO: 555110 - DNA, 25 bp, Rattus norvegicus
aaatagtgcggagtacgtctccttc

SEQ ID NO: 555111 - DNA, 25 bp, Rattus norvegicus
tttcgcagctgcgtaagctcggcca

SEQ ID NO: 555112 - DNA, 25 bp, Rattus norvegicus
ggggacaggttcatttcgcagctgc

SEQ ID NO: 555113 - DNA, 25 bp, Rattus norvegicus
tatgctggcgacatcgatccgcatc

SEQ ID NO: 555114 - DNA, 25 bp, Rattus norvegicus
cgacactcagggagacccggctaaa

SEQ ID NO: 555115 - DNA, 25 bp, Rattus norvegicus
caccatattcacttccgagaccatg

SEQ ID NO: 555116 - DNA, 25 bp, Rattus norvegicus
ctgaacatcccgacactcagggaga

SEQ ID NO: 555117 - DNA, 25 bp, Rattus norvegicus
gaggtgaccaccaatgaaaagcaga

SEQ ID NO: 555118 - DNA, 25 bp, Rattus norvegicus
tggggaaaccgacagtgtgtgtact

SEQ ID NO: 555119 - DNA, 25 bp, Rattus norvegicus
gtgtcgaaaatacaaactgtgggga

SEQ ID NO: 555120 - DNA, 25 bp, Rattus norvegicus
gcagtagccctgtgtgtcgaaaata

SEQ ID NO: 555121 - DNA, 25 bp, Rattus norvegicus
gtctccttcggaacactgcagtagc

SEQ ID NO: 555122 - DNA, 25 bp, Rattus norvegicus
cgagaccatgtctatgctggcgaca

SEQ ID NO: 555123 - DNA, 25 bp, Rattus norvegicus
cccggctaaagtaaggctcagactc

SEQ ID NO: 555124 - DNA, 25 bp, Rattus norvegicus
tccggctcgcactgggcgcgagcgg

SEQ ID NO: 555125 - DNA, 25 bp, Rattus norvegicus
cgcccaccgcggctaggctggagga

SEQ ID NO: 555126 - DNA, 25 bp, Rattus norvegicus
cccgcctcccttggcggcgtgcaca

SEQ ID NO: 555127 - DNA, 25 bp, Rattus norvegicus
cttgacaaggtacggagctgagcgc

SEQ ID NO: 555128 - DNA, 25 bp, Rattus norvegicus
caggcttgacaaggtacggagctga

SEQ ID NO: 555129 - DNA, 25 bp, Rattus norvegicus
tttcaggcttgacaaggtacggagc

SEQ ID NO: 555130 - DNA, 25 bp, Rattus norvegicus
agcgctttcaggcttgacaaggtac

SEQ ID NO: 555131 - DNA, 25 bp, Rattus norvegicus
agcagcgctttcaggcttgacaagg

SEQ ID NO: 555132 - DNA, 25 bp, Rattus norvegicus
gcgagcagcgctttcaggcttgaca

SEQ ID NO: 555133 - DNA, 25 bp, Rattus norvegicus
agctcccaagttcaccggcgagcag

SEQ ID NO: 555134 - DNA, 25 bp, Rattus norvegicus
acacacacgcccaccgcggctaggc

SEQ ID NO: 555135 - DNA, 25 bp, Rattus norvegicus
gcgtggcaggagctcccaagttcac

SEQ ID NO: 555136 - DNA, 25 bp, Rattus norvegicus
gctttcaggcttgacaaggtacgga

SEQ ID NO: 555137 - DNA, 25 bp, Rattus norvegicus
caggagctcccaagttcaccggcga

SEQ ID NO: 555138 - DNA, 25 bp, Rattus norvegicus
gaggggcccgcagataatcgcctgc

SEQ ID NO: 555139 - DNA, 25 bp, Rattus norvegicus
tgcccgagggacacacaacaccgag

SEQ ID NO: 555140 - DNA, 25 bp, Rattus norvegicus
cgcctgcgccattagcggacaaatt

SEQ ID NO: 555141 - DNA, 25 bp, Rattus norvegicus
ggctttgtcaactctcccggagcga

SEQ ID NO: 555142 - DNA, 25 bp, Rattus norvegicus
attcctggcgcttgtaactcgggcc

SEQ ID NO: 555143 - DNA, 25 bp, Rattus norvegicus
tctccaaacaccgtctggattcctg

SEQ ID NO: 555144 - DNA, 25 bp, Rattus norvegicus
ggctcgaagcttaaccctcgcagtg

SEQ ID NO: 555145 - DNA, 25 bp, Rattus norvegicus
tccgcgcggataaacggcgggacta

SEQ ID NO: 555146 - DNA, 25 bp, Rattus norvegicus
tctcgccgttcggacctctagtagg

SEQ ID NO: 555147 - DNA, 25 bp, Rattus norvegicus
tggactggacgccactcagggctca

SEQ ID NO: 555148 - DNA, 25 bp, Rattus norvegicus
gcgcgtagacgctgagcgtatcaaa

SEQ ID NO: 555149 - DNA, 25 bp, Rattus norvegicus
gcgtatcaaaggcagacaaagggtt

SEQ ID NO: 555150 - DNA, 25 bp, Rattus norvegicus
acaacttccggccaatctgagagcc

SEQ ID NO: 555151 - DNA, 25 bp, Rattus norvegicus
gtccggctcacctcgatagagatca

SEQ ID NO: 555152 - DNA, 25 bp, Rattus norvegicus
tggacactatctgccttcacatcgg

SEQ ID NO: 555153 - DNA, 25 bp, Rattus norvegicus
tatctgccttcacatcggttggcgc

SEQ ID NO: 555154 - DNA, 25 bp, Rattus norvegicus
ttcacatcggttggcgcatcaccct

SEQ ID NO: 555155 - DNA, 25 bp, Rattus norvegicus
atcggttggcgcatcaccctgtcgc

SEQ ID NO: 555156 - DNA, 25 bp, Rattus norvegicus
accctgtcgccgctctttttgtgct

SEQ ID NO: 555157 - DNA, 25 bp, Rattus norvegicus
ggccagccaccgtggacactatctg

SEQ ID NO: 555158 - DNA, 25 bp, Rattus norvegicus
gctgccgcagtagctgtctcttctt

SEQ ID NO: 555159 - DNA, 25 bp, Rattus norvegicus
gagcctctgcccagggctcgtggca

SEQ ID NO: 555160 - DNA, 25 bp, Rattus norvegicus
ccgctctttttgtgctgccgcagta

SEQ ID NO: 555161 - DNA, 25 bp, Rattus norvegicus
agaccgacgcagctcgggcagctcg

SEQ ID NO: 555162 - DNA, 25 bp, Rattus norvegicus
caggcagcctggctgtagcggtacc

SEQ ID NO: 555163 - DNA, 25 bp, Rattus norvegicus
agaccttagcgtctgcggatccctc

SEQ ID NO: 555164 - DNA, 25 bp, Rattus norvegicus
tcttcttccgagaccttagcgtctg

SEQ ID NO: 555165 - DNA, 25 bp, Rattus norvegicus
tagcggtaccgcagaccgacgcagc

SEQ ID NO: 555166 - DNA, 25 bp, Rattus norvegicus
aggagatcggcctctgttgggccac

SEQ ID NO: 555167 - DNA, 25 bp, Rattus norvegicus
tcctgctgttccgtcgttggatgag

SEQ ID NO: 555168 - DNA, 25 bp, Rattus norvegicus
tcccgagtcctttcctgtgtttgtg

SEQ ID NO: 555169 - DNA, 25 bp, Rattus norvegicus
tgtttgtgtttgcatccgggttctc

SEQ ID NO: 555170 - DNA, 25 bp, Rattus norvegicus
catccgggttctcaggcttcctcaa

SEQ ID NO: 555171 - DNA, 25 bp, Rattus norvegicus
ttcctcaatcctcaccggctggagt

SEQ ID NO: 555172 - DNA, 25 bp, Rattus norvegicus
ctgggtgtgttaggtcctgctgttc

SEQ ID NO: 555173 - DNA, 25 bp, Rattus norvegicus
ggacacagctccgaatcggggcatt

SEQ ID NO: 555174 - DNA, 25 bp, Rattus norvegicus
cattgacgcggctcgttgtcgcaga

SEQ ID NO: 555175 - DNA, 25 bp, Rattus norvegicus
ttgtcgcagattcccggggcccgac

SEQ ID NO: 555176 - DNA, 25 bp, Rattus norvegicus
agcttgggcgctcctgcctagtgcc

SEQ ID NO: 555177 - DNA, 25 bp, Rattus norvegicus
caccggaggtttccagcgcctgaca

SEQ ID NO: 555178 - DNA, 25 bp, Rattus norvegicus
accaacttggcaatgcgcatgcgca

SEQ ID NO: 555179 - DNA, 25 bp, Rattus norvegicus
cccgacgcgaagtctagcttgggcg

SEQ ID NO: 555180 - DNA, 25 bp, Rattus norvegicus
aaccaggcctgtcgcaaaccaaacg

SEQ ID NO: 555181 - DNA, 25 bp, Rattus norvegicus
tcggtttaggcgaatcccgtcactc

SEQ ID NO: 555182 - DNA, 25 bp, Rattus norvegicus
gctcgcccacggtgcacgtgcggaa

SEQ ID NO: 555183 - DNA, 25 bp, Rattus norvegicus
tgcggaagccctgcaccttcctggg

SEQ ID NO: 555184 - DNA, 25 bp, Rattus norvegicus
tgagcctgtcaccttgagctcggcc

SEQ ID NO: 555185 - DNA, 25 bp, Rattus norvegicus
gctcggccgcgctgaagagcctgca

SEQ ID NO: 555186 - DNA, 25 bp, Rattus norvegicus
gaccgccagggagaccacatagtaa

SEQ ID NO: 555187 - DNA, 25 bp, Rattus norvegicus
cggtcgctccgcttatgacgtcagc

SEQ ID NO: 555188 - DNA, 25 bp, Rattus norvegicus
tgacgtcagcgcgtctacgccaagg

SEQ ID NO: 555189 - DNA, 25 bp, Rattus norvegicus
tctacgccaaggtcgaaaggttagc

SEQ ID NO: 555190 - DNA, 25 bp, Rattus norvegicus
gaatcgcgggatagcactgcctccg

SEQ ID NO: 555191 - DNA, 25 bp, Rattus norvegicus
ttgtcttgtagtgagctccttggga

SEQ ID NO: 555192 - DNA, 25 bp, Rattus norvegicus
aaccaaacgcgctgccagtcggtcg

SEQ ID NO: 555193 - DNA, 25 bp, Rattus norvegicus
ctgcctccgcagtgcttgtcttgta

SEQ ID NO: 555194 - DNA, 25 bp, Rattus norvegicus
cccggaggtagtagaactgaatgtt

SEQ ID NO: 555195 - DNA, 25 bp, Rattus norvegicus
tcgcggagctccattcctgagagtc

SEQ ID NO: 555196 - DNA, 25 bp, Rattus norvegicus
cggggaccatggctttgaaggacac

SEQ ID NO: 555197 - DNA, 25 bp, Rattus norvegicus
ggacaagcgctctgggttcctcaca

SEQ ID NO: 555198 - DNA, 25 bp, Rattus norvegicus
tcctcccgatcagcgagatggtgtc

SEQ ID NO: 555199 - DNA, 25 bp, Rattus norvegicus
gccaggtttatgtgaccaagcattc

SEQ ID NO: 555200 - DNA, 25 bp, Rattus norvegicus
caagcattcgacgttgctcagcgtc

SEQ ID NO: 555201 - DNA, 25 bp, Rattus norvegicus
gcttcttcatcgaccgcgacggctt

SEQ ID NO: 555202 - DNA, 25 bp, Rattus norvegicus
gtctcttgtacacttgcagtcggtc

SEQ ID NO: 555203 - DNA, 25 bp, Rattus norvegicus
ctgtcgcccaaggtcaccaagcaga

SEQ ID NO: 555204 - DNA, 25 bp, Rattus norvegicus
agagcgacctggaggacaacctttc

SEQ ID NO: 555205 - DNA, 25 bp, Rattus norvegicus
acgtgctggattacctgcgcgacaa

SEQ ID NO: 555206 - DNA, 25 bp, Rattus norvegicus
actgacctggtcaagctgctgtcgc

SEQ ID NO: 555207 - DNA, 25 bp, Rattus norvegicus
gcttcctctttaggtacgtgctgga

SEQ ID NO: 555208 - DNA, 25 bp, Rattus norvegicus
gagaaagctagaatcgatgtccctc

SEQ ID NO: 555209 - DNA, 25 bp, Rattus norvegicus
agacctaggcggctctgcggacgca

SEQ ID NO: 555210 - DNA, 25 bp, Rattus norvegicus
tctccccgcggatggtacggtccaa

SEQ ID NO: 555211 - DNA, 25 bp, Rattus norvegicus
agatccgctctcgtgcggaaggtga

SEQ ID NO: 555212 - DNA, 25 bp, Rattus norvegicus
aagctagaatcgatgtccctctccc

SEQ ID NO: 555213 - DNA, 25 bp, Rattus norvegicus
tctgccactgcggggagacctaggc

SEQ ID NO: 555214 - DNA, 25 bp, Rattus norvegicus
gcggacgcagctccttcgccgcctt

SEQ ID NO: 555215 - DNA, 25 bp, Rattus norvegicus
gcagctgagctctctgcgcggtgca

SEQ ID NO: 555216 - DNA, 25 bp, Rattus norvegicus
cccgagacctacctgcaggggctgt

SEQ ID NO: 555217 - DNA, 25 bp, Rattus norvegicus
caggggctgtcgagatgcccaccat

SEQ ID NO: 555218 - DNA, 25 bp, Rattus norvegicus
cgagatgcccaccatgcggaggaca

SEQ ID NO: 555219 - DNA, 25 bp, Rattus norvegicus
ccaccatgcggaggacagtgtcgga

SEQ ID NO: 555220 - DNA, 25 bp, Rattus norvegicus
aggacagtgtcggagatccgctctc

SEQ ID NO: 555221 - DNA, 25 bp, Rattus norvegicus
cccactccaggaggccagcgagtga

SEQ ID NO: 555222 - DNA, 25 bp, Rattus norvegicus
cgcttgactgcgcaccaggtaatta

SEQ ID NO: 555223 - DNA, 25 bp, Rattus norvegicus
ggccatggctgaggcacgcacgtct

SEQ ID NO: 555224 - DNA, 25 bp, Rattus norvegicus
acgcacgtctcgctggtactttgga

SEQ ID NO: 555225 - DNA, 25 bp, Rattus norvegicus
tggtactttggagggctggcttcct

SEQ ID NO: 555226 - DNA, 25 bp, Rattus norvegicus
cttacttcccggtagacagcggtgg

SEQ ID NO: 555227 - DNA, 25 bp, Rattus norvegicus
caccaggtaattaccgccggtgacg

SEQ ID NO: 555228 - DNA, 25 bp, Rattus norvegicus
gggcgctcggtagcactttgaaccg

SEQ ID NO: 555229 - DNA, 25 bp, Rattus norvegicus
tataaggcgcctacttcggccgccg

SEQ ID NO: 555230 - DNA, 25 bp, Rattus norvegicus
gcaccctctagacctgctcaaggtg

SEQ ID NO: 555231 - DNA, 25 bp, Rattus norvegicus
cctgctcaaggtgaggctgagtttc

SEQ ID NO: 555232 - DNA, 25 bp, Rattus norvegicus
gctgagtttcaaggccgagcgcgcc

SEQ ID NO: 555233 - DNA, 25 bp, Rattus norvegicus
agccctaggcgctggggaccatcct

SEQ ID NO: 555234 - DNA, 25 bp, Rattus norvegicus
accatcctgggcctggcgcctataa

SEQ ID NO: 555235 - DNA, 25 bp, Rattus norvegicus
tgagggcgccactacgcttacttcc

SEQ ID NO: 555236 - DNA, 25 bp, Rattus norvegicus
cccttagcggggctcatcgcgctag

SEQ ID NO: 555237 - DNA, 25 bp, Rattus norvegicus
ttcatttaaaaaccagcgcggaggc

SEQ ID NO: 555238 - DNA, 25 bp, Rattus norvegicus
gcgcttgagctccacgagtttcatt

SEQ ID NO: 555239 - DNA, 25 bp, Rattus norvegicus
ctgtcacatagccagggaaaacctg

SEQ ID NO: 555240 - DNA, 25 bp, Rattus norvegicus
gtcgccgtgcgagctaatcacagcc

SEQ ID NO: 555241 - DNA, 25 bp, Rattus norvegicus
agacagcggagtctcggccaagtgc

SEQ ID NO: 555242 - DNA, 25 bp, Rattus norvegicus
ctgactgtcacgcaggccggagaca

SEQ ID NO: 555243 - DNA, 25 bp, Rattus norvegicus
cacaagcagacagagcgccagcagc

SEQ ID NO: 555244 - DNA, 25 bp, Rattus norvegicus
agttcagcttggctctccacgtgca

SEQ ID NO: 555245 - DNA, 25 bp, Rattus norvegicus
caccacggaggctgccacagaagca

SEQ ID NO: 555246 - DNA, 25 bp, Rattus norvegicus
ctccactggccggaggacagcatgg

SEQ ID NO: 555247 - DNA, 25 bp, Rattus norvegicus
gtcaagaacgcgctctcctgggtta

SEQ ID NO: 555248 - DNA, 25 bp, Rattus norvegicus
cggccagttgacctcccggtcaaga

SEQ ID NO: 555249 - DNA, 25 bp, Rattus norvegicus
ggggaccagcggctaattccgctcc

SEQ ID NO: 555250 - DNA, 25 bp, Rattus norvegicus
ggccacggcgcagacacacgccttc

SEQ ID NO: 555251 - DNA, 25 bp, Rattus norvegicus
ctccctccaggcattggcgaggcgg

SEQ ID NO: 555252 - DNA, 25 bp, Rattus norvegicus
tgtcaatcagcgctgggcggcagcc

SEQ ID NO: 555253 - DNA, 25 bp, Rattus norvegicus
ccttcgtgcactccgagagttggga

SEQ ID NO: 555254 - DNA, 25 bp, Rattus norvegicus
tgcactccgagagttgggaggtcac

SEQ ID NO: 555255 - DNA, 25 bp, Rattus norvegicus
ttccaaagctcggaccctgccggca

SEQ ID NO: 555256 - DNA, 25 bp, Rattus norvegicus
cgcctcacgtccacagcggagagag

SEQ ID NO: 555257 - DNA, 25 bp, Rattus norvegicus
tccacagcggagagagccgggaccc

SEQ ID NO: 555258 - DNA, 25 bp, Rattus norvegicus
ccacgaccctgtccgaggcgccgat

SEQ ID NO: 555259 - DNA, 25 bp, Rattus norvegicus
cccatcatcattagcagatattacc

SEQ ID NO: 555260 - DNA, 25 bp, Rattus norvegicus
tagcagatattaccctaaacacttg

SEQ ID NO: 555261 - DNA, 25 bp, Rattus norvegicus
gatattaccctaaacacttgctcct

SEQ ID NO: 555262 - DNA, 25 bp, Rattus norvegicus
acacttgctccttacctcctttctc

SEQ ID NO: 555263 - DNA, 25 bp, Rattus norvegicus
ctttctccctccaggcattggcgag

SEQ ID NO: 555264 - DNA, 25 bp, Rattus norvegicus
agcgacggcgccagcctagagctca

SEQ ID NO: 555265 - DNA, 25 bp, Rattus norvegicus
ttctggaagattcccggagccgcgg

SEQ ID NO: 555266 - DNA, 25 bp, Rattus norvegicus
ccactccgaggagacgcccatttta

SEQ ID NO: 555267 - DNA, 25 bp, Rattus norvegicus
gcctagagctcagtgcaggtacaga

SEQ ID NO: 555268 - DNA, 25 bp, Rattus norvegicus
cgcgcgccttaacaggtggctgcgt

SEQ ID NO: 555269 - DNA, 25 bp, Rattus norvegicus
actccgaggagacgcccattttatt

SEQ ID NO: 555270 - DNA, 25 bp, Rattus norvegicus
tcgggtagtagtaacttctggaaga

SEQ ID NO: 555271 - DNA, 25 bp, Rattus norvegicus
ctgcgctcgggtagtagtaacttct

SEQ ID NO: 555272 - DNA, 25 bp, Rattus norvegicus
gcaactttgcggagctcccgcggtg

SEQ ID NO: 555273 - DNA, 25 bp, Rattus norvegicus
tccgggccgcaactttgcggagctc

SEQ ID NO: 555274 - DNA, 25 bp, Rattus norvegicus
caggtacagactccgggccgcaact

SEQ ID NO: 555275 - DNA, 25 bp, Rattus norvegicus
agctcagtgcaggtacagactccgg

SEQ ID NO: 555276 - DNA, 25 bp, Rattus norvegicus
gccagcctagagctcagtgcaggta

SEQ ID NO: 555277 - DNA, 25 bp, Rattus norvegicus
cgggtccaggccactccgaggagac

SEQ ID NO: 555278 - DNA, 25 bp, Rattus norvegicus
ctcagcttattagaggcccgcgtaa

SEQ ID NO: 555279 - DNA, 25 bp, Rattus norvegicus
ccaagttggtggaatccgccatttc

SEQ ID NO: 555280 - DNA, 25 bp, Rattus norvegicus
cccggaaacatcctggcggggcaga

SEQ ID NO: 555281 - DNA, 25 bp, Rattus norvegicus
gcacctgtgaggaccttgcgagacc

SEQ ID NO: 555282 - DNA, 25 bp, Rattus norvegicus
cgatgcgccttaagaccttcccggg

SEQ ID NO: 555283 - DNA, 25 bp, Rattus norvegicus
cgccatttcccacggcctgtttggg

SEQ ID NO: 555284 - DNA, 25 bp, Rattus norvegicus
cggaagtgacgaaatatgccagctg

SEQ ID NO: 555285 - DNA, 25 bp, Rattus norvegicus
ggtgtttatggccagcacggatctg

SEQ ID NO: 555286 - DNA, 25 bp, Rattus norvegicus
gcggcgaactcaagggaccctccaa

SEQ ID NO: 555287 - DNA, 25 bp, Rattus norvegicus
cacggatctgtaccgagtgattgac

SEQ ID NO: 555288 - DNA, 25 bp, Rattus norvegicus
tttggaagtccgtgtcccatccagg

SEQ ID NO: 555289 - DNA, 25 bp, Rattus norvegicus
ctgccgtgccaactgactccataga

SEQ ID NO: 555290 - DNA, 25 bp, Rattus norvegicus
cgtggtcgccttgctgatcactcaa

SEQ ID NO: 555291 - DNA, 25 bp, Rattus norvegicus
tcccatccagggagacagtcttccg

SEQ ID NO: 555292 - DNA, 25 bp, Rattus norvegicus
ctgggtccagaccaaagctgccttt

SEQ ID NO: 555293 - DNA, 25 bp, Rattus norvegicus
gcccgggacactgcgacagcaaaga

SEQ ID NO: 555294 - DNA, 25 bp, Rattus norvegicus
aggaaaacgtcagtgccaggcgaca

SEQ ID NO: 555295 - DNA, 25 bp, Rattus norvegicus
aggcgacaatcctccgacctgtttc

SEQ ID NO: 555296 - DNA, 25 bp, Rattus norvegicus
gacctgtttcccgagccggctggaa

SEQ ID NO: 555297 - DNA, 25 bp, Rattus norvegicus
ccgtgcagcacacggccgcagaagt

SEQ ID NO: 555298 - DNA, 25 bp, Rattus norvegicus
gataatacctgtcccgctgggtcca

SEQ ID NO: 555299 - DNA, 25 bp, Rattus norvegicus
ctagaaagacccaagcgaaggcgga

SEQ ID NO: 555300 - DNA, 25 bp, Rattus norvegicus
gcggagcttcggagtaaggccttaa

SEQ ID NO: 555301 - DNA, 25 bp, Rattus norvegicus
cttaaagggccgatcgacgccgccg

SEQ ID NO: 555302 - DNA, 25 bp, Rattus norvegicus
ttgcaaaaccggaagtgatcctttc

SEQ ID NO: 555303 - DNA, 25 bp, Rattus norvegicus
tgatcctttcgtttccgcgtgagtc

SEQ ID NO: 555304 - DNA, 25 bp, Rattus norvegicus
tcgtatccgccatggaagacacacg

SEQ ID NO: 555305 - DNA, 25 bp, Rattus norvegicus
tacggcggccggataatacctgtcc

SEQ ID NO: 555306 - DNA, 25 bp, Rattus norvegicus
cgattactaaggagacgcggcctct

SEQ ID NO: 555307 - DNA, 25 bp, Rattus norvegicus
ccgacccgcgcgattactaaggaga

SEQ ID NO: 555308 - DNA, 25 bp, Rattus norvegicus
gacggacaaaagtgctggaaccttc

SEQ ID NO: 555309 - DNA, 25 bp, Rattus norvegicus
gacgccctggcgaaagcacagcatc

SEQ ID NO: 555310 - DNA, 25 bp, Rattus norvegicus
cgtttgaaaacggatccatcagcgg

SEQ ID NO: 555311 - DNA, 25 bp, Rattus norvegicus
cagggtgtgtccgttctggaaaatt

SEQ ID NO: 555312 - DNA, 25 bp, Rattus norvegicus
tgggttgaccacaggaatgatcgcc

SEQ ID NO: 555313 - DNA, 25 bp, Rattus norvegicus
cctcgcccgctcttagggatgattt

SEQ ID NO: 555314 - DNA, 25 bp, Rattus norvegicus
aggggtctttctgaaggaacttgtg

SEQ ID NO: 555315 - DNA, 25 bp, Rattus norvegicus
cggccctattcagctgacgagtcaa

SEQ ID NO: 555316 - DNA, 25 bp, Rattus norvegicus
tcaaagacgctaaatggggacatca

SEQ ID NO: 555317 - DNA, 25 bp, Rattus norvegicus
cccaactaggaatacggatccaatc

SEQ ID NO: 555318 - DNA, 25 bp, Rattus norvegicus
ggggatccgctctacctagtctgca

SEQ ID NO: 555319 - DNA, 25 bp, Rattus norvegicus
catcagcgggtactcggcgtttaaa

SEQ ID NO: 555320 - DNA, 25 bp, Rattus norvegicus
gggctcaggtttcgacccgagatta

SEQ ID NO: 555321 - DNA, 25 bp, Rattus norvegicus
cttccctaggacaagatttttggtg

SEQ ID NO: 555322 - DNA, 25 bp, Rattus norvegicus
tggtgagcagatcggaaaatacttc

SEQ ID NO: 555323 - DNA, 25 bp, Rattus norvegicus
gcaagcgcgcagttcacaccaactt

SEQ ID NO: 555324 - DNA, 25 bp, Rattus norvegicus
ggcaccgcgtgctttgccagcaagc

SEQ ID NO: 555325 - DNA, 25 bp, Rattus norvegicus
tttcatcttgctggcccgggaaacc

SEQ ID NO: 555326 - DNA, 25 bp, Rattus norvegicus
ggcggatccgtttcagcctaggcct

SEQ ID NO: 555327 - DNA, 25 bp, Rattus norvegicus
tccggcagtctgaaccgcacgaagc

SEQ ID NO: 555328 - DNA, 25 bp, Rattus norvegicus
ctctccgtgcgtgctttaagaactg

SEQ ID NO: 555329 - DNA, 25 bp, Rattus norvegicus
ctgcagcacgaggttggcttcccac

SEQ ID NO: 555330 - DNA, 25 bp, Rattus norvegicus
ggaccaggcagtcgtgctttcccac

SEQ ID NO: 555331 - DNA, 25 bp, Rattus norvegicus
gacgttcagcctccattgcctggga

SEQ ID NO: 555332 - DNA, 25 bp, Rattus norvegicus
gctttcccacgggtctcattcctgg

SEQ ID NO: 555333 - DNA, 25 bp, Rattus norvegicus
cgttggcgctccacaaacttgggca

SEQ ID NO: 555334 - DNA, 25 bp, Rattus norvegicus
agcctttgcccccagcttcgggaag

SEQ ID NO: 555335 - DNA, 25 bp, Rattus norvegicus
aaaggcaaatagtgcgtgcgagtga

SEQ ID NO: 555336 - DNA, 25 bp, Rattus norvegicus
ccgggttgcatttattggagtcttc

SEQ ID NO: 555337 - DNA, 25 bp, Rattus norvegicus
tgcatttattggagtcttcccaggg

SEQ ID NO: 555338 - DNA, 25 bp, Rattus norvegicus
ttattggagtcttcccaggggtgag

SEQ ID NO: 555339 - DNA, 25 bp, Rattus norvegicus
tgagagtcccaaatctccttaagtc

SEQ ID NO: 555340 - DNA, 25 bp, Rattus norvegicus
tctcgccacagacccgggccagcct

SEQ ID NO: 555341 - DNA, 25 bp, Rattus norvegicus
aatctccttaagtctcagcgcctgc

SEQ ID NO: 555342 - DNA, 25 bp, Rattus norvegicus
ccaggccttctctgaaggcgtcata

SEQ ID NO: 555343 - DNA, 25 bp, Rattus norvegicus
ggccgccgccagtctcgccacagac

SEQ ID NO: 555344 - DNA, 25 bp, Rattus norvegicus
ttctctgaaggcgtcataccctcca

SEQ ID NO: 555345 - DNA, 25 bp, Rattus norvegicus
gaaggcgtcataccctccagccttt

SEQ ID NO: 555346 - DNA, 25 bp, Rattus norvegicus
gcgtgcgagtgagagtcccaaatct

SEQ ID NO: 555347 - DNA, 25 bp, Rattus norvegicus
gcgccgggttgcatttattggagtc

SEQ ID NO: 555348 - DNA, 25 bp, Rattus norvegicus
cgactcctcaggacgtttcaaagtc

SEQ ID NO: 555349 - DNA, 25 bp, Rattus norvegicus
accgctgtcttttgcttccgcggga

SEQ ID NO: 555350 - DNA, 25 bp, Rattus norvegicus
ctgtcttttgcttccgcgggatccg

SEQ ID NO: 555351 - DNA, 25 bp, Rattus norvegicus
tgcttctctgcctgggtctggcgct

SEQ ID NO: 555352 - DNA, 25 bp, Rattus norvegicus
ctgcctgggtctggcgctggattaa

SEQ ID NO: 555353 - DNA, 25 bp, Rattus norvegicus
gcgctggattaatggtggcgccgca

SEQ ID NO: 555354 - DNA, 25 bp, Rattus norvegicus
cccggaacagggaggctttcagagt

SEQ ID NO: 555355 - DNA, 25 bp, Rattus norvegicus
tcagagttctttgcgactcctcagg

SEQ ID NO: 555356 - DNA, 25 bp, Rattus norvegicus
ttcaaagtcccaaactgcgggtgga

SEQ ID NO: 555357 - DNA, 25 bp, Rattus norvegicus
aggggtgatcgtatagatcagcttc

SEQ ID NO: 555358 - DNA, 25 bp, Rattus norvegicus
gtatagatcagcttctcccacccag

SEQ ID NO: 555359 - DNA, 25 bp, Rattus norvegicus
ctgcacgctgcgagcgcctttctga

SEQ ID NO: 555360 - DNA, 25 bp, Rattus norvegicus
ctgcgagcgcctttctgagacctgc

SEQ ID NO: 555361 - DNA, 25 bp, Rattus norvegicus
cagggaggctttcagagttctttgc

SEQ ID NO: 555362 - DNA, 25 bp, Rattus norvegicus
agcatgctaatgagcagcgcgcagg

SEQ ID NO: 555363 - DNA, 25 bp, Rattus norvegicus
tgagccggttgaaccgagccagagc

SEQ ID NO: 555364 - DNA, 25 bp, Rattus norvegicus
ttgaaccgagccagagcaagggcga

SEQ ID NO: 555365 - DNA, 25 bp, Rattus norvegicus
ccgagccagagcaagggcgaggctc

SEQ ID NO: 555366 - DNA, 25 bp, Rattus norvegicus
cgaggctcatggagctcgcaaccca

SEQ ID NO: 555367 - DNA, 25 bp, Rattus norvegicus
aggctcatggagctcgcaacccagg

SEQ ID NO: 555368 - DNA, 25 bp, Rattus norvegicus
gctcatggagctcgcaacccaggcg

SEQ ID NO: 555369 - DNA, 25 bp, Rattus norvegicus
catggagctcgcaacccaggcgggt

SEQ ID NO: 555370 - DNA, 25 bp, Rattus norvegicus
cccgaggggcgcttgcgaggctgca

SEQ ID NO: 555371 - DNA, 25 bp, Rattus norvegicus
ctcggggagcatgctaatgagcagc

SEQ ID NO: 555372 - DNA, 25 bp, Rattus norvegicus
gcacgcggtgccactcaggcccgcg

SEQ ID NO: 555373 - DNA, 25 bp, Rattus norvegicus
gccggttgaaccgagccagagcaag

SEQ ID NO: 555374 - DNA, 25 bp, Rattus norvegicus
ggtatgagccggttgaaccgagcca

SEQ ID NO: 555375 - DNA, 25 bp, Rattus norvegicus
cgctcggggagcatgctaatgagca

SEQ ID NO: 555376 - DNA, 25 bp, Rattus norvegicus
ctcggaattacaccgagaggttctg

SEQ ID NO: 555377 - DNA, 25 bp, Rattus norvegicus
agcccagtcctagacccagcaagtg

SEQ ID NO: 555378 - DNA, 25 bp, Rattus norvegicus
cacagtgagcactagggtcgggccc

SEQ ID NO: 555379 - DNA, 25 bp, Rattus norvegicus
acccagcaagtgagcacagtgagca

SEQ ID NO: 555380 - DNA, 25 bp, Rattus norvegicus
gcccagatcccagtgcgctcgagga

SEQ ID NO: 555381 - DNA, 25 bp, Rattus norvegicus
gctcgctgcaggtcggctgcactaa

SEQ ID NO: 555382 - DNA, 25 bp, Rattus norvegicus
agctacaaggcaagctcggcacaca

SEQ ID NO: 555383 - DNA, 25 bp, Rattus norvegicus
gtgcccgggatatagagctacaagg

SEQ ID NO: 555384 - DNA, 25 bp, Rattus norvegicus
cagggcctgctcctgtgtgccagaa

SEQ ID NO: 555385 - DNA, 25 bp, Rattus norvegicus
gtacacttggtgagggttctcggaa

SEQ ID NO: 555386 - DNA, 25 bp, Rattus norvegicus
gatcctcggggttatggtacacttg

SEQ ID NO: 555387 - DNA, 25 bp, Rattus norvegicus
ccagggtgcgcaagattggatcctc

SEQ ID NO: 555388 - DNA, 25 bp, Rattus norvegicus
ggaatcacccgtggaggctctctga

SEQ ID NO: 555389 - DNA, 25 bp, Rattus norvegicus
tcggcacacaagagaggtactcgga

SEQ ID NO: 555390 - DNA, 25 bp, Rattus norvegicus
tggagccagactatccggagggaca

SEQ ID NO: 555391 - DNA, 25 bp, Rattus norvegicus
aagccctgggctggcgccctacggt

SEQ ID NO: 555392 - DNA, 25 bp, Rattus norvegicus
gcgacttggagccagactatccgga

SEQ ID NO: 555393 - DNA, 25 bp, Rattus norvegicus
agaggcgacttggagccagactatc

SEQ ID NO: 555394 - DNA, 25 bp, Rattus norvegicus
tggcgcgaccaagtagaggcgactt

SEQ ID NO: 555395 - DNA, 25 bp, Rattus norvegicus
cctcaagacggctggcgcgaccaag

SEQ ID NO: 555396 - DNA, 25 bp, Rattus norvegicus
tcggctgaacaaggctggcaccctc

SEQ ID NO: 555397 - DNA, 25 bp, Rattus norvegicus
agactatccggagggacaagccctg

SEQ ID NO: 555398 - DNA, 25 bp, Rattus norvegicus
ccgttcggtcggctgaacaaggctg

SEQ ID NO: 555399 - DNA, 25 bp, Rattus norvegicus
gtttgctcatccaaccgtgaggttc

SEQ ID NO: 555400 - DNA, 25 bp, Rattus norvegicus
tcaaggaggcgcacagcactcgggt

SEQ ID NO: 555401 - DNA, 25 bp, Rattus norvegicus
ttcgagctaggagaggtcttcaagg

SEQ ID NO: 555402 - DNA, 25 bp, Rattus norvegicus
caaccgtgaggttcgagctaggaga

SEQ ID NO: 555403 - DNA, 25 bp, Rattus norvegicus
acaaggctggcaccctcaagacggc

SEQ ID NO: 555404 - DNA, 25 bp, Rattus norvegicus
agggtcttcgctgagacacactacc

SEQ ID NO: 555405 - DNA, 25 bp, Rattus norvegicus
gctcaaagagttggagagggtcttc

SEQ ID NO: 555406 - DNA, 25 bp, Rattus norvegicus
agcgcgcagctcaaagagttggaga

SEQ ID NO: 555407 - DNA, 25 bp, Rattus norvegicus
ctcaccgaggcgagagtccaggtac

SEQ ID NO: 555408 - DNA, 25 bp, Rattus norvegicus
ttcacaagcgcgcagctcaaagagt

SEQ ID NO: 555409 - DNA, 25 bp, Rattus norvegicus
ggagctagcgctgaagatcgacctc

SEQ ID NO: 555410 - DNA, 25 bp, Rattus norvegicus
caacgagaaacgcaagcagcggcgc

SEQ ID NO: 555411 - DNA, 25 bp, Rattus norvegicus
tggagagggtcttcgctgagacaca

SEQ ID NO: 555412 - DNA, 25 bp, Rattus norvegicus
cacggtggcctcaacgagaaacgca

SEQ ID NO: 555413 - DNA, 25 bp, Rattus norvegicus
gaccacggtggcctcaacgagaaac

SEQ ID NO: 555414 - DNA, 25 bp, Rattus norvegicus
tagcgctgaagatcgacctcaccga

SEQ ID NO: 555415 - DNA, 25 bp, Rattus norvegicus
ctgaagatcgacctcaccgaggcga

SEQ ID NO: 555416 - DNA, 25 bp, Rattus norvegicus
tacgggagactgagtgcggcccgca

SEQ ID NO: 555417 - DNA, 25 bp, Rattus norvegicus
ggcctcaacgagaaacgcaagcagc

SEQ ID NO: 555418 - DNA, 25 bp, Rattus norvegicus
cagcgtcttatcttcgctccaaaga

SEQ ID NO: 555419 - DNA, 25 bp, Rattus norvegicus
tggaggtcccttcgccagcgtctta

SEQ ID NO: 555420 - DNA, 25 bp, Rattus norvegicus
gctccaaagacccaacggtgccaaa

SEQ ID NO: 555421 - DNA, 25 bp, Rattus norvegicus
ccatcccggattcgcttggaggtcc

SEQ ID NO: 555422 - DNA, 25 bp, Rattus norvegicus
cgccttagtgaagagcagtatgttc

SEQ ID NO: 555423 - DNA, 25 bp, Rattus norvegicus
cagtatgttctgatctgcgatccga

SEQ ID NO: 555424 - DNA, 25 bp, Rattus norvegicus
agtgggtagacccaaggctagtatc

SEQ ID NO: 555425 - DNA, 25 bp, Rattus norvegicus
cccaaggctagtatcgctgctgtca

SEQ ID NO: 555426 - DNA, 25 bp, Rattus norvegicus
tcgctgctgtcagtggctttttcca

SEQ ID NO: 555427 - DNA, 25 bp, Rattus norvegicus
agtggctttttccatcgaaggccta

SEQ ID NO: 555428 - DNA, 25 bp, Rattus norvegicus
cgaaggcctaaaatgatcgcgattc

SEQ ID NO: 555429 - DNA, 25 bp, Rattus norvegicus
cgcgattcgaaaaaacgagaaaatg

SEQ ID NO: 555430 - DNA, 25 bp, Rattus norvegicus
aacggtgccaaagccgccttagtga

SEQ ID NO: 555431 - DNA, 25 bp, Rattus norvegicus
gttctgatctgcgatccgaggcggc

SEQ ID NO: 555432 - DNA, 25 bp, Rattus norvegicus
aacaaaaagcaagcgggatgagagc

SEQ ID NO: 555433 - DNA, 25 bp, Rattus norvegicus
tgcctcctcctcacaccgcatgtca

SEQ ID NO: 555434 - DNA, 25 bp, Rattus norvegicus
tgctgtgcggcagcaccgctgcctc

SEQ ID NO: 555435 - DNA, 25 bp, Rattus norvegicus
cgctaccgggctgagagccgcctct

SEQ ID NO: 555436 - DNA, 25 bp, Rattus norvegicus
tcctttcgccgccactgcacaccgc

SEQ ID NO: 555437 - DNA, 25 bp, Rattus norvegicus
tactcgtgctcctgatgcggagaga

SEQ ID NO: 555438 - DNA, 25 bp, Rattus norvegicus
ctcctgatgcggagagagcaaaaac

SEQ ID NO: 555439 - DNA, 25 bp, Rattus norvegicus
tcgtgctcctgatgcggagagagca

SEQ ID NO: 555440 - DNA, 25 bp, Rattus norvegicus
tcacaccgcatgtcaaacatactcg

SEQ ID NO: 555441 - DNA, 25 bp, Rattus norvegicus
ccgcatgtcaaacatactcgtgctc

SEQ ID NO: 555442 - DNA, 25 bp, Rattus norvegicus
catgtcaaacatactcgtgctcctg

SEQ ID NO: 555443 - DNA, 25 bp, Rattus norvegicus
gtcaaacatactcgtgctcctgatg

SEQ ID NO: 555444 - DNA, 25 bp, Rattus norvegicus
aacatactcgtgctcctgatgcgga

SEQ ID NO: 555445 - DNA, 25 bp, Rattus norvegicus
cgccactgcacaccgccgcctgggg

SEQ ID NO: 555446 - DNA, 25 bp, Rattus norvegicus
cgatccacttctgtgcctcggcgaa

SEQ ID NO: 555447 - DNA, 25 bp, Rattus norvegicus
atgcggctcccgcaagagctctgga

SEQ ID NO: 555448 - DNA, 25 bp, Rattus norvegicus
actgcgcttccagtggcagcacttg

SEQ ID NO: 555449 - DNA, 25 bp, Rattus norvegicus
ccgagccgagattgcgagctccgca

SEQ ID NO: 555450 - DNA, 25 bp, Rattus norvegicus
ttttgcagcgctaagtctcgcactg

SEQ ID NO: 555451 - DNA, 25 bp, Rattus norvegicus
ggaatcgcagtcttcctccgaaggc

SEQ ID NO: 555452 - DNA, 25 bp, Rattus norvegicus
ttgaaggacttccagaccgagagcg

SEQ ID NO: 555453 - DNA, 25 bp, Rattus norvegicus
caagccatctgcgaagcccggcgag

SEQ ID NO: 555454 - DNA, 25 bp, Rattus norvegicus
aagcccggcgagtactgaagcgctc

SEQ ID NO: 555455 - DNA, 25 bp, Rattus norvegicus
cgggatgagcacagcgtcctccgca

SEQ ID NO: 555456 - DNA, 25 bp, Rattus norvegicus
caccgagcgcaggtccctgaggaca

SEQ ID NO: 555457 - DNA, 25 bp, Rattus norvegicus
aaataacctgctaggagctccgggc

SEQ ID NO: 555458 - DNA, 25 bp, Rattus norvegicus
tcccggctcacgcaaggaccatggg

SEQ ID NO: 555459 - DNA, 25 bp, Rattus norvegicus
gctagaccgcagtgtaccctgttca

SEQ ID NO: 555460 - DNA, 25 bp, Rattus norvegicus
ccggacaaatgatgggcacctgcta

SEQ ID NO: 555461 - DNA, 25 bp, Rattus norvegicus
gtcgccacgccctcgagatgtgttc

SEQ ID NO: 555462 - DNA, 25 bp, Rattus norvegicus
agcttggccaacacctgcagggaaa

SEQ ID NO: 555463 - DNA, 25 bp, Rattus norvegicus
acaggggcagccagccggaaaaagc

SEQ ID NO: 555464 - DNA, 25 bp, Rattus norvegicus
cggggtcagcacgagcattcagcgt

SEQ ID NO: 555465 - DNA, 25 bp, Rattus norvegicus
gtcgcgcagtgacacagcacaaagc

SEQ ID NO: 555466 - DNA, 25 bp, Rattus norvegicus
agcacaaagctcagcccacacgtgg

SEQ ID NO: 555467 - DNA, 25 bp, Rattus norvegicus
gactagagtccgctgaccgtcgcca

SEQ ID NO: 555468 - DNA, 25 bp, Rattus norvegicus
caagattgatctttctcagtcaccc

SEQ ID NO: 555469 - DNA, 25 bp, Rattus norvegicus
ataactcagggcagaggcgacaccc

SEQ ID NO: 555470 - DNA, 25 bp, Rattus norvegicus
ctccagcgatgctcccgtgggagag

SEQ ID NO: 555471 - DNA, 25 bp, Rattus norvegicus
cccgagtctgggaggagcctccgca

SEQ ID NO: 555472 - DNA, 25 bp, Rattus norvegicus
ccggctaggcgtctccagcgatgct

SEQ ID NO: 555473 - DNA, 25 bp, Rattus norvegicus
tcgcgcgaagccctcggactagagt

SEQ ID NO: 555474 - DNA, 25 bp, Rattus norvegicus
ttcctgcgtatctaaggagaccgcc

SEQ ID NO: 555475 - DNA, 25 bp, Rattus norvegicus
tttcggcggtgatcctggagaccct

SEQ ID NO: 555476 - DNA, 25 bp, Rattus norvegicus
ggctttccggaagggtgattgcatc

SEQ ID NO: 555477 - DNA, 25 bp, Rattus norvegicus
ttccggaagggtgattgcatcaggt

SEQ ID NO: 555478 - DNA, 25 bp, Rattus norvegicus
attgcatcaggtgtggagcagggcg

SEQ ID NO: 555479 - DNA, 25 bp, Rattus norvegicus
agaatcgggtgatagggtaggctct

SEQ ID NO: 555480 - DNA, 25 bp, Rattus norvegicus
cgtatctaaggagaccgcctggagg

SEQ ID NO: 555481 - DNA, 25 bp, Rattus norvegicus
cagcacgggttttcctgcgtatcta

SEQ ID NO: 555482 - DNA, 25 bp, Rattus norvegicus
caggcgacccggctgggaggccgaa

SEQ ID NO: 555483 - DNA, 25 bp, Rattus norvegicus
actccagcacgggttttcctgcgta

SEQ ID NO: 555484 - DNA, 25 bp, Rattus norvegicus
cacgggttttcctgcgtatctaagg

SEQ ID NO: 555485 - DNA, 25 bp, Rattus norvegicus
agcggactccagcacgggttttcct

SEQ ID NO: 555486 - DNA, 25 bp, Rattus norvegicus
cacagcggactccagcacgggtttt

SEQ ID NO: 555487 - DNA, 25 bp, Rattus norvegicus
tgcgtatctaaggagaccgcctgga

SEQ ID NO: 555488 - DNA, 25 bp, Rattus norvegicus
gaagtcgctgtgtcgctctctggac

SEQ ID NO: 555489 - DNA, 25 bp, Rattus norvegicus
gttttctaaccagctagggcgcctg

SEQ ID NO: 555490 - DNA, 25 bp, Rattus norvegicus
ctagggcgcctgacagtagcgatta

SEQ ID NO: 555491 - DNA, 25 bp, Rattus norvegicus
cctgtgcctcctcagcgtcggagaa

SEQ ID NO: 555492 - DNA, 25 bp, Rattus norvegicus
gcctttcaagccctacgcgtggagc

SEQ ID NO: 555493 - DNA, 25 bp, Rattus norvegicus
ggctgtaccaagatcgcggccacga

SEQ ID NO: 555494 - DNA, 25 bp, Rattus norvegicus
gcggcggctcctacaaatgcatcaa

SEQ ID NO: 555495 - DNA, 25 bp, Rattus norvegicus
tcaagtgcagcaaggtgaggctccc

SEQ ID NO: 555496 - DNA, 25 bp, Rattus norvegicus
acgagaccctttgcgtgcgagatgt

SEQ ID NO: 555497 - DNA, 25 bp, Rattus norvegicus
tggagcaacacaaggccgtacactc

SEQ ID NO: 555498 - DNA, 25 bp, Rattus norvegicus
ccgtacactcgcaggtaagcttggc

SEQ ID NO: 555499 - DNA, 25 bp, Rattus norvegicus
cgctgcactggggatatttcagttc

SEQ ID NO: 555500 - DNA, 25 bp, Rattus norvegicus
gtgttttccacaccgcatgggctgg

SEQ ID NO: 555501 - DNA, 25 bp, Rattus norvegicus
tagcgattatgcactgcgggctccg

SEQ ID NO: 555502 - DNA, 25 bp, Rattus norvegicus
tcgccggagccagtgctgctctaag

SEQ ID NO: 555503 - DNA, 25 bp, Rattus norvegicus
cgccgccaaagcctggagaagtgga

SEQ ID NO: 555504 - DNA, 25 bp, Rattus norvegicus
tttctggcggtcaccgccggtcgct

SEQ ID NO: 555505 - DNA, 25 bp, Rattus norvegicus
ctgctcggtttctggcggtcaccgc

SEQ ID NO: 555506 - DNA, 25 bp, Rattus norvegicus
gctgcttgtgccctcgcggctgctg

SEQ ID NO: 555507 - DNA, 25 bp, Rattus norvegicus
cggcgagcctggctgcttgtgccct

SEQ ID NO: 555508 - DNA, 25 bp, Rattus norvegicus
cagcccgggaatctgaggaatgacc

SEQ ID NO: 555509 - DNA, 25 bp, Rattus norvegicus
ttcagagccgatcgatcgccgcgca

SEQ ID NO: 555510 - DNA, 25 bp, Rattus norvegicus
ggacccgggttcagagccgatcgat

SEQ ID NO: 555511 - DNA, 25 bp, Rattus norvegicus
tgctgcagcccgcagctgatccggg

SEQ ID NO: 555512 - DNA, 25 bp, Rattus norvegicus
cagtgctgctctaagtaggaagctc

SEQ ID NO: 555513 - DNA, 25 bp, Rattus norvegicus
ctaagtaggaagctcgcgtgctgca

SEQ ID NO: 555514 - DNA, 25 bp, Rattus norvegicus
agaagtggaatctcgccgccgctgc

SEQ ID NO: 555515 - DNA, 25 bp, Rattus norvegicus
cagcgggctgcgaaacctaggaccc

SEQ ID NO: 555516 - DNA, 25 bp, Rattus norvegicus
ctcggctctcgggatccctcaaaga

SEQ ID NO: 555517 - DNA, 25 bp, Rattus norvegicus
aacctctgtacttggggcgctggag

SEQ ID NO: 555518 - DNA, 25 bp, Rattus norvegicus
gcggaggccgtttaattcaagtaca

SEQ ID NO: 555519 - DNA, 25 bp, Rattus norvegicus
ggtccctgagggaaacgctgcctcc

SEQ ID NO: 555520 - DNA, 25 bp, Rattus norvegicus
cagggtgcccggatctccatggcaa

SEQ ID NO: 555521 - DNA, 25 bp, Rattus norvegicus
tccctcaaagaaggctctgggtccc

SEQ ID NO: 555522 - DNA, 25 bp, Rattus norvegicus
ctgaggggacgcttctcgcgaccac

SEQ ID NO: 555523 - DNA, 25 bp, Rattus norvegicus
gctcttgcagccaacctagcgggta

SEQ ID NO: 555524 - DNA, 25 bp, Rattus norvegicus
gtacagcagcaggaagccaggagct

SEQ ID NO: 555525 - DNA, 25 bp, Rattus norvegicus
ctgaagacgcggcaacctctgtact

SEQ ID NO: 555526 - DNA, 25 bp, Rattus norvegicus
tggctaccgaaatttcctctaagtc

SEQ ID NO: 555527 - DNA, 25 bp, Rattus norvegicus
tctaagtcttctagaggcgtgagcg

SEQ ID NO: 555528 - DNA, 25 bp, Rattus norvegicus
gcgaatccgcccttctctaaggttg

SEQ ID NO: 555529 - DNA, 25 bp, Rattus norvegicus
ctgggtccgtactcgaccctggcta

SEQ ID NO: 555530 - DNA, 25 bp, Rattus norvegicus
tcagcttacgggctgaccgcgggca

SEQ ID NO: 555531 - DNA, 25 bp, Rattus norvegicus
ctgaccgcgggcaggccctggactt

SEQ ID NO: 555532 - DNA, 25 bp, Rattus norvegicus
aggccctggacttgcgcagagacac

SEQ ID NO: 555533 - DNA, 25 bp, Rattus norvegicus
cctggacttgcgcagagacactgca

SEQ ID NO: 555534 - DNA, 25 bp, Rattus norvegicus
cttgcgcagagacactgcatcagga

SEQ ID NO: 555535 - DNA, 25 bp, Rattus norvegicus
gcagagacactgcatcaggacaact

SEQ ID NO: 555536 - DNA, 25 bp, Rattus norvegicus
agcccagaagcagggagcgccctca

SEQ ID NO: 555537 - DNA, 25 bp, Rattus norvegicus
accggcaagggcaccggagcgattt

SEQ ID NO: 555538 - DNA, 25 bp, Rattus norvegicus
agacactgcatcaggacaactggga

SEQ ID NO: 555539 - DNA, 25 bp, Rattus norvegicus
ggctggcctgcgcagcccagaagca

SEQ ID NO: 555540 - DNA, 25 bp, Rattus norvegicus
ccagaagcagggagcgccctcaagg

SEQ ID NO: 555541 - DNA, 25 bp, Rattus norvegicus
agcccgttcagcttacgggctgacc

SEQ ID NO: 555542 - DNA, 25 bp, Rattus norvegicus
catcaggacaactgggatgtgggca

SEQ ID NO: 555543 - DNA, 25 bp, Rattus norvegicus
ctgggatgtgggcagagcaggtaac

SEQ ID NO: 555544 - DNA, 25 bp, Rattus norvegicus
gagccatgctcagcctcaggtaagg

SEQ ID NO: 555545 - DNA, 25 bp, Rattus norvegicus
cccgtgacgtgcctgcctgtgttct

SEQ ID NO: 555546 - DNA, 25 bp, Rattus norvegicus
tgacgtgcctgcctgtgttctccga

SEQ ID NO: 555547 - DNA, 25 bp, Rattus norvegicus
tgcctgcctgtgttctccgagccat

SEQ ID NO: 555548 - DNA, 25 bp, Rattus norvegicus
tgtgttctccgagccatgctcagcc

SEQ ID NO: 555549 - DNA, 25 bp, Rattus norvegicus
cctgtgttctccgagccatgctcag

SEQ ID NO: 555550 - DNA, 25 bp, Rattus norvegicus
gccatgctcagcctcaggtaaggac

SEQ ID NO: 555551 - DNA, 25 bp, Rattus norvegicus
tcaggtaaggacagtccagaaggtc

SEQ ID NO: 555552 - DNA, 25 bp, Rattus norvegicus
cagtccagaaggtcccggtttcctg

SEQ ID NO: 555553 - DNA, 25 bp, Rattus norvegicus
cagaaggtcccggtttcctgcaggc

SEQ ID NO: 555554 - DNA, 25 bp, Rattus norvegicus
cccggcaaaggtcagagctcggccc

SEQ ID NO: 555555 - DNA, 25 bp, Rattus norvegicus
gccctgctgtgaaggccccggcaaa

SEQ ID NO: 555556 - DNA, 25 bp, Rattus norvegicus
ctgcctgtgttctccgagccatgct

SEQ ID NO: 555557 - DNA, 25 bp, Rattus norvegicus
tccgagccatgctcagcctcaggta

SEQ ID NO: 555558 - DNA, 25 bp, Rattus norvegicus
gagcgatctgttgctttaagccgca

SEQ ID NO: 555559 - DNA, 25 bp, Rattus norvegicus
cgcagcccgctcgtactacccagcc

SEQ ID NO: 555560 - DNA, 25 bp, Rattus norvegicus
actacccagcctagccggtcgccga

SEQ ID NO: 555561 - DNA, 25 bp, Rattus norvegicus
ctccgggacccggagaagctaggct

SEQ ID NO: 555562 - DNA, 25 bp, Rattus norvegicus
ctccgctggtcgctcaggttaagaa

SEQ ID NO: 555563 - DNA, 25 bp, Rattus norvegicus
cgctcaggttaagaaattgtgacaa

SEQ ID NO: 555564 - DNA, 25 bp, Rattus norvegicus
gacaaactggaattcccagagcctg

SEQ ID NO: 555565 - DNA, 25 bp, Rattus norvegicus
tctgttgctttaagccgcacggtgg

SEQ ID NO: 555566 - DNA, 25 bp, Rattus norvegicus
ttaagccgcacggtgggaagtagct

SEQ ID NO: 555567 - DNA, 25 bp, Rattus norvegicus
tgggaagtagcttggagactcttta

SEQ ID NO: 555568 - DNA, 25 bp, Rattus norvegicus
gtagcttggagactctttaatttgg

SEQ ID NO: 555569 - DNA, 25 bp, Rattus norvegicus
ttctatttaaaagagggcggccagc

SEQ ID NO: 555570 - DNA, 25 bp, Rattus norvegicus
agttaaagcctagagcgatctgttg

SEQ ID NO: 555571 - DNA, 25 bp, Rattus norvegicus
cccagagcctgggagagttaaagcc

SEQ ID NO: 555572 - DNA, 25 bp, Rattus norvegicus
actgatggagcgcaccggttacaac

SEQ ID NO: 555573 - DNA, 25 bp, Rattus norvegicus
agatccgtgactacgccttcgtgca

SEQ ID NO: 555574 - DNA, 25 bp, Rattus norvegicus
tttggccagttcaacccaggctgtg

SEQ ID NO: 555575 - DNA, 25 bp, Rattus norvegicus
gatcctctacgtgcgcaacctcatg

SEQ ID NO: 555576 - DNA, 25 bp, Rattus norvegicus
tgatgcagaccgtgaagatcctcta

SEQ ID NO: 555577 - DNA, 25 bp, Rattus norvegicus
cgtatccagctgtggggccaccaga

SEQ ID NO: 555578 - DNA, 25 bp, Rattus norvegicus
cgaggcttcgcctttgtggaatatg

SEQ ID NO: 555579 - DNA, 25 bp, Rattus norvegicus
caacgtgattgtgtatgccagtgca

SEQ ID NO: 555580 - DNA, 25 bp, Rattus norvegicus
gacaactgccgcctcttcatcggtg

SEQ ID NO: 555581 - DNA, 25 bp, Rattus norvegicus
gctgtccgtgagctcaacaactatg

SEQ ID NO: 555582 - DNA, 25 bp, Rattus norvegicus
cgcggctatgccttcgtgatgtact

SEQ ID NO: 555583 - DNA, 25 bp, Rattus norvegicus
atttcgatggcaagaaccgcggcta

SEQ ID NO: 555584 - DNA, 25 bp, Rattus norvegicus
tcgtgcacttcactagccgcgagga

SEQ ID NO: 555585 - DNA, 25 bp, Rattus norvegicus
cgagctgcgcctcatgatggatttc

SEQ ID NO: 555586 - DNA, 25 bp, Rattus norvegicus
acaagagaatgagcagcccacgttc

SEQ ID NO: 555587 - DNA, 25 bp, Rattus norvegicus
tcagaacacaagagaatgagcagcc

SEQ ID NO: 555588 - DNA, 25 bp, Rattus norvegicus
agcccacgttctgccgagttgtaaa

SEQ ID NO: 555589 - DNA, 25 bp, Rattus norvegicus
gtaaaactttgcctcggcttctaga

SEQ ID NO: 555590 - DNA, 25 bp, Rattus norvegicus
ctcggcttctagagctgtttgcagg

SEQ ID NO: 555591 - DNA, 25 bp, Rattus norvegicus
aaccagcagtttctccgaggtatta

SEQ ID NO: 555592 - DNA, 25 bp, Rattus norvegicus
tccgaggtattaaccatttctcaac

SEQ ID NO: 555593 - DNA, 25 bp, Rattus norvegicus
atttctcaaccagtccggtcacgtc

SEQ ID NO: 555594 - DNA, 25 bp, Rattus norvegicus
accagacaagccttcaagagtcccg

SEQ ID NO: 555595 - DNA, 25 bp, Rattus norvegicus
caagccttcaagagtcccggactcg

SEQ ID NO: 555596 - DNA, 25 bp, Rattus norvegicus
gcggggaacaggagcatcacaagcc

SEQ ID NO: 555597 - DNA, 25 bp, Rattus norvegicus
acaggagcatcacaagccggcgcct

SEQ ID NO: 555598 - DNA, 25 bp, Rattus norvegicus
gacctcgggcgactctcagaacaca

SEQ ID NO: 555599 - DNA, 25 bp, Rattus norvegicus
ttctgccgagttgtaaaactttgcc

SEQ ID NO: 555600 - DNA, 25 bp, Rattus norvegicus
cattgtgaaaagagggctaggaaac

SEQ ID NO: 555601 - DNA, 25 bp, Rattus norvegicus
ttcccgctgaactttgattttctga

SEQ ID NO: 555602 - DNA, 25 bp, Rattus norvegicus
ggacaagatcaccaccgacgaaatg

SEQ ID NO: 555603 - DNA, 25 bp, Rattus norvegicus
ccctccgggagtaaaagagatcacg

SEQ ID NO: 555604 - DNA, 25 bp, Rattus norvegicus
gaagatcgcttaccctccgggagta

SEQ ID NO: 555605 - DNA, 25 bp, Rattus norvegicus
ccaggatggacttcacgcagccgaa

SEQ ID NO: 555606 - DNA, 25 bp, Rattus norvegicus
gccggtagaggactgtgaaagaaaa

SEQ ID NO: 555607 - DNA, 25 bp, Rattus norvegicus
attttctgaccgatagaggccggta

SEQ ID NO: 555608 - DNA, 25 bp, Rattus norvegicus
aaactccgggagctgctcggcgcct

SEQ ID NO: 555609 - DNA, 25 bp, Rattus norvegicus
accaaacttccgacctaggtgctcg

SEQ ID NO: 555610 - DNA, 25 bp, Rattus norvegicus
ctcgagtctcctttcccggaggtga

SEQ ID NO: 555611 - DNA, 25 bp, Rattus norvegicus
agctgaaccctctaggcctcgagtc

SEQ ID NO: 555612 - DNA, 25 bp, Rattus norvegicus
gtacctagttttgcggcctaagctg

SEQ ID NO: 555613 - DNA, 25 bp, Rattus norvegicus
agggccctttccagattagagattt

SEQ ID NO: 555614 - DNA, 25 bp, Rattus norvegicus
agtgtagaatcacctccgcgcccgg

SEQ ID NO: 555615 - DNA, 25 bp, Rattus norvegicus
tcacgtgcccgggacgagtgcttcg

SEQ ID NO: 555616 - DNA, 25 bp, Rattus norvegicus
tctctctagagctcacgtgcccggg

SEQ ID NO: 555617 - DNA, 25 bp, Rattus norvegicus
ttacggtgaggcctccagtccctag

SEQ ID NO: 555618 - DNA, 25 bp, Rattus norvegicus
tccctcagtgattcagacccgagca

SEQ ID NO: 555619 - DNA, 25 bp, Rattus norvegicus
agtccctagccacggacccgaggtg

SEQ ID NO: 555620 - DNA, 25 bp, Rattus norvegicus
cccgagcacacgaacgctgccactg

SEQ ID NO: 555621 - DNA, 25 bp, Rattus norvegicus
cgcagctgattcgtacccgcctcct

SEQ ID NO: 555622 - DNA, 25 bp, Rattus norvegicus
ggccatgtctctgcccgcagctgat

SEQ ID NO: 555623 - DNA, 25 bp, Rattus norvegicus
ctgcaccgcgatgttggccatgtct

SEQ ID NO: 555624 - DNA, 25 bp, Rattus norvegicus
cttgattcgctgcaccgcgatgttg

SEQ ID NO: 555625 - DNA, 25 bp, Rattus norvegicus
ttgaactcccgcttgattcgctgca

SEQ ID NO: 555626 - DNA, 25 bp, Rattus norvegicus
gggtgtccggtagctcattcctgac

SEQ ID NO: 555627 - DNA, 25 bp, Rattus norvegicus
ccataggcagaaaggcggccgcagc

SEQ ID NO: 555628 - DNA, 25 bp, Rattus norvegicus
caggcacccgcagcccgggtggttt

SEQ ID NO: 555629 - DNA, 25 bp, Rattus norvegicus
agatccgggtctcgtggctaagagt

SEQ ID NO: 555630 - DNA, 25 bp, Rattus norvegicus
agcttcagcggcgtccggaacgctc

SEQ ID NO: 555631 - DNA, 25 bp, Rattus norvegicus
cacacacgtcagcactgaggctgcg

SEQ ID NO: 555632 - DNA, 25 bp, Rattus norvegicus
cgcgcatgctcactaggtagggtca

SEQ ID NO: 555633 - DNA, 25 bp, Rattus norvegicus
gctccgggcgctacaatctgttgcg

SEQ ID NO: 555634 - DNA, 25 bp, Rattus norvegicus
ctccggagccggcagatccgggtct

SEQ ID NO: 555635 - DNA, 25 bp, Rattus norvegicus
tcgtggctaagagtgacgtggtcta

SEQ ID NO: 555636 - DNA, 25 bp, Rattus norvegicus
gtggtctatcgaatccaaacagagg

SEQ ID NO: 555637 - DNA, 25 bp, Rattus norvegicus
cggcagtctgcaactgggctggcca

SEQ ID NO: 555638 - DNA, 25 bp, Rattus norvegicus
gtggtttcacttttagggccacata

SEQ ID NO: 555639 - DNA, 25 bp, Rattus norvegicus
acttttagggccacataggcggcgc

SEQ ID NO: 555640 - DNA, 25 bp, Rattus norvegicus
cctggtgggttcgatgaagtcaccc

SEQ ID NO: 555641 - DNA, 25 bp, Rattus norvegicus
cctcttcgcgttgccacttctgtgg

SEQ ID NO: 555642 - DNA, 25 bp, Rattus norvegicus
tgtgtgcagcacgttgccagacttc

SEQ ID NO: 555643 - DNA, 25 bp, Rattus norvegicus
cgacgcatctggctccggctaaata

SEQ ID NO: 555644 - DNA, 25 bp, Rattus norvegicus
ccggctaaatattttcagtcgctca

SEQ ID NO: 555645 - DNA, 25 bp, Rattus norvegicus
tttcagtcgctcagatcccaaggta

SEQ ID NO: 555646 - DNA, 25 bp, Rattus norvegicus
cgctcagatcccaaggtaaatattt

SEQ ID NO: 555647 - DNA, 25 bp, Rattus norvegicus
ccaaggtaaatatttgcagggtcga

SEQ ID NO: 555648 - DNA, 25 bp, Rattus norvegicus
aatatttgcagggtcgatggctgca

SEQ ID NO: 555649 - DNA, 25 bp, Rattus norvegicus
cagctttcactcaaggcccgcacag

SEQ ID NO: 555650 - DNA, 25 bp, Rattus norvegicus
gccacgcccacttccacacgccacg

SEQ ID NO: 555651 - DNA, 25 bp, Rattus norvegicus
tggctccggctaaatattttcagtc

SEQ ID NO: 555652 - DNA, 25 bp, Rattus norvegicus
ttcctgtgtgcagcacgttgccaga

SEQ ID NO: 555653 - DNA, 25 bp, Rattus norvegicus
cgttgccagacttcagctcttgcga

SEQ ID NO: 555654 - DNA, 25 bp, Rattus norvegicus
cagctcttgcgaggctggtttcgag

SEQ ID NO: 555655 - DNA, 25 bp, Rattus norvegicus
cgggcaccacctcgcttcctgtgtg

SEQ ID NO: 555656 - DNA, 25 bp, Rattus norvegicus
cgctgtccgagagaacgtgatctgc

SEQ ID NO: 555657 - DNA, 25 bp, Rattus norvegicus
tccagaaggaaatagaggcctgccc

SEQ ID NO: 555658 - DNA, 25 bp, Rattus norvegicus
ggagatcagacgaaccgggctttta

SEQ ID NO: 555659 - DNA, 25 bp, Rattus norvegicus
cccgtgagttggctccagctgattc

SEQ ID NO: 555660 - DNA, 25 bp, Rattus norvegicus
ctggttgcaagggaatgaagcctcc

SEQ ID NO: 555661 - DNA, 25 bp, Rattus norvegicus
ccgggcttttaattcgcaactcgtg

SEQ ID NO: 555662 - DNA, 25 bp, Rattus norvegicus
cgtggtcatacatttgggcccgccc

SEQ ID NO: 555663 - DNA, 25 bp, Rattus norvegicus
ggtatcacgtcgtgcgcttgcagga

SEQ ID NO: 555664 - DNA, 25 bp, Rattus norvegicus
ttcccgctcttggagaggctcccta

SEQ ID NO: 555665 - DNA, 25 bp, Rattus norvegicus
tgggtaagcaccaatccttgcgggc

SEQ ID NO: 555666 - DNA, 25 bp, Rattus norvegicus
tcctggccttggaagtgggtaagca

SEQ ID NO: 555667 - DNA, 25 bp, Rattus norvegicus
cagctgattcgccttgtctccacaa

SEQ ID NO: 555668 - DNA, 25 bp, Rattus norvegicus
gaagcatttaaatacggccgcgggc

SEQ ID NO: 555669 - DNA, 25 bp, Rattus norvegicus
cgcaactcgtgtatcttcaagccaa

SEQ ID NO: 555670 - DNA, 25 bp, Rattus norvegicus
cccggcatctctgaaaaagaagacc

SEQ ID NO: 555671 - DNA, 25 bp, Rattus norvegicus
tctgaaaaagaagaccggcggacgc

SEQ ID NO: 555672 - DNA, 25 bp, Rattus norvegicus
ctgaaaaagaagaccggcggacgcg

SEQ ID NO: 555673 - DNA, 25 bp, Rattus norvegicus
ctctgaaaaagaagaccggcggacg

SEQ ID NO: 555674 - DNA, 25 bp, Rattus norvegicus
tctctgaaaaagaagaccggcggac

SEQ ID NO: 555675 - DNA, 25 bp, Rattus norvegicus
atctctgaaaaagaagaccggcgga

SEQ ID NO: 555676 - DNA, 25 bp, Rattus norvegicus
ccggcatctctgaaaaagaagaccg

SEQ ID NO: 555677 - DNA, 25 bp, Rattus norvegicus
agaagggaggggctgcccggcatct

SEQ ID NO: 555678 - DNA, 25 bp, Rattus norvegicus
atcgccggcgaacggagcgcagcga

SEQ ID NO: 555679 - DNA, 25 bp, Rattus norvegicus
ccacgtgatcgccggcgaacggagc

SEQ ID NO: 555680 - DNA, 25 bp, Rattus norvegicus
aaacggcgcgggccacgtgatcgcc

SEQ ID NO: 555681 - DNA, 25 bp, Rattus norvegicus
cgcaaacggcgcgggccacgtgatc

SEQ ID NO: 555682 - DNA, 25 bp, Rattus norvegicus
gccgcttctagtgggccggccggaa

SEQ ID NO: 555683 - DNA, 25 bp, Rattus norvegicus
catctctgaaaaagaagaccggcgg

SEQ ID NO: 555684 - DNA, 25 bp, Rattus norvegicus
cctagctggcgatttccgtttggag

SEQ ID NO: 555685 - DNA, 25 bp, Rattus norvegicus
ggaatctaaacccatcctctcttgg

SEQ ID NO: 555686 - DNA, 25 bp, Rattus norvegicus
cggtgatcgagtagttttgccttaa

SEQ ID NO: 555687 - DNA, 25 bp, Rattus norvegicus
gcgcgactcgactagctcggtgatc

SEQ ID NO: 555688 - DNA, 25 bp, Rattus norvegicus
gccttaaaccgtcgctcggtcgtga

SEQ ID NO: 555689 - DNA, 25 bp, Rattus norvegicus
agggcctgcgttcctttggaatcta

SEQ ID NO: 555690 - DNA, 25 bp, Rattus norvegicus
ctgcacgacatacgccctttggatt

SEQ ID NO: 555691 - DNA, 25 bp, Rattus norvegicus
gctagaagttgcgttcgggctttca

SEQ ID NO: 555692 - DNA, 25 bp, Rattus norvegicus
cggacttcctaacacttctctggtg

SEQ ID NO: 555693 - DNA, 25 bp, Rattus norvegicus
gccggcttgcttgtcttcctagctg

SEQ ID NO: 555694 - DNA, 25 bp, Rattus norvegicus
gccagcgccctgacggattacaaga

SEQ ID NO: 555695 - DNA, 25 bp, Rattus norvegicus
ccgtcgctttacttatgacgcaata

SEQ ID NO: 555696 - DNA, 25 bp, Rattus norvegicus
acgcaatacgcgatcgtcgaacctg

SEQ ID NO: 555697 - DNA, 25 bp, Rattus norvegicus
ggacccactcgtgtcttgccggctt

SEQ ID NO: 555698 - DNA, 25 bp, Rattus norvegicus
accatgcagagtgctccgaggggcc

SEQ ID NO: 555699 - DNA, 25 bp, Rattus norvegicus
agcgcgcctccgacgtcatcaccgc

SEQ ID NO: 555700 - DNA, 25 bp, Rattus norvegicus
caccagggacgcagcgtgcagggat

SEQ ID NO: 555701 - DNA, 25 bp, Rattus norvegicus
cgtctgctacttcgcgggagaagtt

SEQ ID NO: 555702 - DNA, 25 bp, Rattus norvegicus
atgtggctgctacgcggcactttca

SEQ ID NO: 555703 - DNA, 25 bp, Rattus norvegicus
cgcctgagcgtctgctacttcgcgg

SEQ ID NO: 555704 - DNA, 25 bp, Rattus norvegicus
actacagagactttgcaggcggggt

SEQ ID NO: 555705 - DNA, 25 bp, Rattus norvegicus
ctacttcgcgggagaagttgttggc

SEQ ID NO: 555706 - DNA, 25 bp, Rattus norvegicus
agttgttggcgccaatgtattccga

SEQ ID NO: 555707 - DNA, 25 bp, Rattus norvegicus
cgccaatgtattccgagcggcgata

SEQ ID NO: 555708 - DNA, 25 bp, Rattus norvegicus
ccacctgctcctgttcggtcgtggg

SEQ ID NO: 555709 - DNA, 25 bp, Rattus norvegicus
ttccgagcggcgataacggataccc

SEQ ID NO: 555710 - DNA, 25 bp, Rattus norvegicus
aggcggtgcaactacagagactttg

SEQ ID NO: 555711 - DNA, 25 bp, Rattus norvegicus
agccacccgggaggcggtgcaacta

SEQ ID NO: 555712 - DNA, 25 bp, Rattus norvegicus
tatttaccttcatttcaaggctcca

SEQ ID NO: 555713 - DNA, 25 bp, Rattus norvegicus
gcgctccgagagctgaagaaataca

SEQ ID NO: 555714 - DNA, 25 bp, Rattus norvegicus
aagaaatacagaggtggtccgcgtc

SEQ ID NO: 555715 - DNA, 25 bp, Rattus norvegicus
atacagaggtggtccgcgtcttctc

SEQ ID NO: 555716 - DNA, 25 bp, Rattus norvegicus
gcgtcttctcatcccgcgggcattt

SEQ ID NO: 555717 - DNA, 25 bp, Rattus norvegicus
tcatcccgcgggcatttgtaagtta

SEQ ID NO: 555718 - DNA, 25 bp, Rattus norvegicus
agcggcaaccccgatcttggaagtg

SEQ ID NO: 555719 - DNA, 25 bp, Rattus norvegicus
taccgcgttctcgtcacccaggaga

SEQ ID NO: 555720 - DNA, 25 bp, Rattus norvegicus
ctcgtcacccaggagaccgtgcaaa

SEQ ID NO: 555721 - DNA, 25 bp, Rattus norvegicus
cccaggagaccgtgcaaacagcaac

SEQ ID NO: 555722 - DNA, 25 bp, Rattus norvegicus
cgtgcaaacagcaaccaatcagcga

SEQ ID NO: 555723 - DNA, 25 bp, Rattus norvegicus
accaatcagcgaacgtggggcgtgg

SEQ ID NO: 555724 - DNA, 25 bp, Rattus norvegicus
ggcatttgtaagttatttaccttca

SEQ ID NO: 555725 - DNA, 25 bp, Rattus norvegicus
atcccgcgggcatttgtaagttatt

SEQ ID NO: 555726 - DNA, 25 bp, Rattus norvegicus
ccgcgtggagaactttgagcaactc

SEQ ID NO: 555727 - DNA, 25 bp, Rattus norvegicus
gcagggcccaaaagaccgagaattc

SEQ ID NO: 555728 - DNA, 25 bp, Rattus norvegicus
tcggacacacggttagtcccggcgc

SEQ ID NO: 555729 - DNA, 25 bp, Rattus norvegicus
caggagtcaaacttgtcccgcagcc

SEQ ID NO: 555730 - DNA, 25 bp, Rattus norvegicus
cgccaggccaggagtcaaacttgtc

SEQ ID NO: 555731 - DNA, 25 bp, Rattus norvegicus
tccgtcaggcgacgccaggccagga

SEQ ID NO: 555732 - DNA, 25 bp, Rattus norvegicus
cgccgaggaggaagtcgcacttacc

SEQ ID NO: 555733 - DNA, 25 bp, Rattus norvegicus
tgtgtagggagctggccttagctca

SEQ ID NO: 555734 - DNA, 25 bp, Rattus norvegicus
tcacccaggccagctcgtcctcgga

SEQ ID NO: 555735 - DNA, 25 bp, Rattus norvegicus
actttgagcaactccaggccggcgg

SEQ ID NO: 555736 - DNA, 25 bp, Rattus norvegicus
catcagcgccgcgtggagaactttg

SEQ ID NO: 555737 - DNA, 25 bp, Rattus norvegicus
tggccttagctcaccgcgccgagga

SEQ ID NO: 555738 - DNA, 25 bp, Rattus norvegicus
agtcccggttgcagctcgagagtcc

SEQ ID NO: 555739 - DNA, 25 bp, Rattus norvegicus
tcgcacttaccgaggagggtcagga

SEQ ID NO: 555740 - DNA, 25 bp, Rattus norvegicus
cctgccttcctacggggaagccttg

SEQ ID NO: 555741 - DNA, 25 bp, Rattus norvegicus
caagcaagttcctttctacggacca

SEQ ID NO: 555742 - DNA, 25 bp, Rattus norvegicus
ccttcctacggggaagccttgcacg

SEQ ID NO: 555743 - DNA, 25 bp, Rattus norvegicus
tccgcgcacccagctcggtggtccc

SEQ ID NO: 555744 - DNA, 25 bp, Rattus norvegicus
tgacctgctgcgaactccgcgcacc

SEQ ID NO: 555745 - DNA, 25 bp, Rattus norvegicus
actgcgccctgacctgctgcgaact

SEQ ID NO: 555746 - DNA, 25 bp, Rattus norvegicus
cccgggctcttaccgcttggctggc

SEQ ID NO: 555747 - DNA, 25 bp, Rattus norvegicus
ttctacggaccattctcctccggtg

SEQ ID NO: 555748 - DNA, 25 bp, Rattus norvegicus
ggtgacttctcaggaccccgcagaa

SEQ ID NO: 555749 - DNA, 25 bp, Rattus norvegicus
ttctcctccggtgacttctcaggac

SEQ ID NO: 555750 - DNA, 25 bp, Rattus norvegicus
cattctcctccggtgacttctcagg

SEQ ID NO: 555751 - DNA, 25 bp, Rattus norvegicus
gcaagttcctttctacggaccattc

SEQ ID NO: 555752 - DNA, 25 bp, Rattus norvegicus
acggaccattctcctccggtgactt

SEQ ID NO: 555753 - DNA, 25 bp, Rattus norvegicus
ccccgcagaagtcagggatggctgt

SEQ ID NO: 555754 - DNA, 25 bp, Rattus norvegicus
cagcctgacagacactcattattcc

SEQ ID NO: 555755 - DNA, 25 bp, Rattus norvegicus
ctggaggctgggctccaagtttgct

SEQ ID NO: 555756 - DNA, 25 bp, Rattus norvegicus
ctccaagtttgctgggccgcagctg

SEQ ID NO: 555757 - DNA, 25 bp, Rattus norvegicus
acctggctctctccaacgcggtcgc

SEQ ID NO: 555758 - DNA, 25 bp, Rattus norvegicus
ggggccagcctgacagacactcatt

SEQ ID NO: 555759 - DNA, 25 bp, Rattus norvegicus
gggcgtcacacgctccagacccata

SEQ ID NO: 555760 - DNA, 25 bp, Rattus norvegicus
cacacagcccgggttcgcaggcgag

SEQ ID NO: 555761 - DNA, 25 bp, Rattus norvegicus
acccgctcccgcgagaagggtctgt

SEQ ID NO: 555762 - DNA, 25 bp, Rattus norvegicus
ccgcgagaagggtctgtcccatccg

SEQ ID NO: 555763 - DNA, 25 bp, Rattus norvegicus
ggcgcgatcgctgctccgtgcacag

SEQ ID NO: 555764 - DNA, 25 bp, Rattus norvegicus
tccgtgcacagggtcgcgctgctgc

SEQ ID NO: 555765 - DNA, 25 bp, Rattus norvegicus
ctgcctgtgcgctggctggcgctct

SEQ ID NO: 555766 - DNA, 25 bp, Rattus norvegicus
cccatagcgccgcttccaaaacaca

SEQ ID NO: 555767 - DNA, 25 bp, Rattus norvegicus
tcggcgagtcactggcaaacacgca

SEQ ID NO: 555768 - DNA, 25 bp, Rattus norvegicus
cgatgtcgttatcgaaggagctaaa

SEQ ID NO: 555769 - DNA, 25 bp, Rattus norvegicus
gctcacatggttgaacttctcgata

SEQ ID NO: 555770 - DNA, 25 bp, Rattus norvegicus
ctgcggccacagctcacatggttga

SEQ ID NO: 555771 - DNA, 25 bp, Rattus norvegicus
atcccagtctattctgcggccacag

SEQ ID NO: 555772 - DNA, 25 bp, Rattus norvegicus
ggcgcatcccagtctattctgcggc

SEQ ID NO: 555773 - DNA, 25 bp, Rattus norvegicus
cgcagtccaggctgtgagaaggatt

SEQ ID NO: 555774 - DNA, 25 bp, Rattus norvegicus
gttgaacttctcgatacactcgtcg

SEQ ID NO: 555775 - DNA, 25 bp, Rattus norvegicus
gcatcctggaactccttcctgaagg

SEQ ID NO: 555776 - DNA, 25 bp, Rattus norvegicus
actgcggaggctagcatcctggaac

SEQ ID NO: 555777 - DNA, 25 bp, Rattus norvegicus
tcgaaggagctaaaggtgctactgc

SEQ ID NO: 555778 - DNA, 25 bp, Rattus norvegicus
gccgattaggtgattttcgatgtcg

SEQ ID NO: 555779 - DNA, 25 bp, Rattus norvegicus
caggctgtgagaaggatttgcgcat

SEQ ID NO: 555780 - DNA, 25 bp, Rattus norvegicus
gctaaaggtgctactgcggaggcta

SEQ ID NO: 555781 - DNA, 25 bp, Rattus norvegicus
actccttcctgaaggccagcgagcg

SEQ ID NO: 555782 - DNA, 25 bp, Rattus norvegicus
atgaatgaaaagtagctcggcgctc

SEQ ID NO: 555783 - DNA, 25 bp, Rattus norvegicus
ccctggtgattgaggagtgatatga

SEQ ID NO: 555784 - DNA, 25 bp, Rattus norvegicus
accgggtgttcaatccctggtgatt

SEQ ID NO: 555785 - DNA, 25 bp, Rattus norvegicus
accggacctgctcacgcgggaagtt

SEQ ID NO: 555786 - DNA, 25 bp, Rattus norvegicus
cccagcagaccggcgagaaagggaa

SEQ ID NO: 555787 - DNA, 25 bp, Rattus norvegicus
atcgtcccgagacggcggtcagcct

SEQ ID NO: 555788 - DNA, 25 bp, Rattus norvegicus
cccagctgaacaatggtgacatcgc

SEQ ID NO: 555789 - DNA, 25 bp, Rattus norvegicus
cttggccacccagctgaacaatggt

SEQ ID NO: 555790 - DNA, 25 bp, Rattus norvegicus
tgggcccgcggtagttctagcccgc

SEQ ID NO: 555791 - DNA, 25 bp, Rattus norvegicus
ctcggtccggcagttggaggtccct

SEQ ID NO: 555792 - DNA, 25 bp, Rattus norvegicus
gctcgctcgaatggcctggcgtccg

SEQ ID NO: 555793 - DNA, 25 bp, Rattus norvegicus
tgaaaagtagctcggcgctcgctcg

SEQ ID NO: 555794 - DNA, 25 bp, Rattus norvegicus
aacaatggtgacatcgcaggcccgg

SEQ ID NO: 555795 - DNA, 25 bp, Rattus norvegicus
agtgatatgacgctcccggtctccg

SEQ ID NO: 555796 - DNA, 25 bp, Rattus norvegicus
aggctcttgttcgtaccggtagcga

SEQ ID NO: 555797 - DNA, 25 bp, Rattus norvegicus
gaggttctacctcctttcacatcgc

SEQ ID NO: 555798 - DNA, 25 bp, Rattus norvegicus
gacagctcagcagccgcgaggttct

SEQ ID NO: 555799 - DNA, 25 bp, Rattus norvegicus
atgggaaatgccgtcagaagctagg

SEQ ID NO: 555800 - DNA, 25 bp, Rattus norvegicus
tccgccatgggaaatgccgtcagaa

SEQ ID NO: 555801 - DNA, 25 bp, Rattus norvegicus
agcagagtccgccatgggaaatgcc

SEQ ID NO: 555802 - DNA, 25 bp, Rattus norvegicus
ccagagagtaaggaacagcagagtc

SEQ ID NO: 555803 - DNA, 25 bp, Rattus norvegicus
ttcacatcgccctgaaccaagctgg

SEQ ID NO: 555804 - DNA, 25 bp, Rattus norvegicus
tgttcgtaccggtagcgactcggtg

SEQ ID NO: 555805 - DNA, 25 bp, Rattus norvegicus
tcccaacctgggaagaggctcttgt

SEQ ID NO: 555806 - DNA, 25 bp, Rattus norvegicus
accaaggtctcagggtcccaacctg

SEQ ID NO: 555807 - DNA, 25 bp, Rattus norvegicus
tgcgtagtactcagaccaaggtctc

SEQ ID NO: 555808 - DNA, 25 bp, Rattus norvegicus
gcgcgtgcgtagtactcagaccaag

SEQ ID NO: 555809 - DNA, 25 bp, Rattus norvegicus
cacttgggcccagagagtaaggaac

SEQ ID NO: 555810 - DNA, 25 bp, Rattus norvegicus
agtaatctgtggacaaggggccctc

SEQ ID NO: 555811 - DNA, 25 bp, Rattus norvegicus
actgcgtcagctgtcaccggttagc

SEQ ID NO: 555812 - DNA, 25 bp, Rattus norvegicus
cccagggttcaggagtctgtgcttt

SEQ ID NO: 555813 - DNA, 25 bp, Rattus norvegicus
ccagcgcgattctccgtcgaacgtg

SEQ ID NO: 555814 - DNA, 25 bp, Rattus norvegicus
ctggacttctgactggcgacttttc

SEQ ID NO: 555815 - DNA, 25 bp, Rattus norvegicus
ggcgaactttctctttctggacttc

SEQ ID NO: 555816 - DNA, 25 bp, Rattus norvegicus
cagttcttgcctcggattggccaca

SEQ ID NO: 555817 - DNA, 25 bp, Rattus norvegicus
agacccggaggcctttcagttcttg

SEQ ID NO: 555818 - DNA, 25 bp, Rattus norvegicus
tcggtccagacctcgcctttataaa

SEQ ID NO: 555819 - DNA, 25 bp, Rattus norvegicus
ctccaccagcaggtagttgtgcgcc

SEQ ID NO: 555820 - DNA, 25 bp, Rattus norvegicus
ccgagggcggcccttagtaatctgt

SEQ ID NO: 555821 - DNA, 25 bp, Rattus norvegicus
ttcacacgtccggaatggcagatgc

SEQ ID NO: 555822 - DNA, 25 bp, Rattus norvegicus
cagcgcctctgcgaagttgctcttc

SEQ ID NO: 555823 - DNA, 25 bp, Rattus norvegicus
ttgcattctgactggaccgcgtttc

SEQ ID NO: 555824 - DNA, 25 bp, Rattus norvegicus
gaaggtgcaacgatcgccgctccat

SEQ ID NO: 555825 - DNA, 25 bp, Rattus norvegicus
ggggaccgctccacagtatctgctt

SEQ ID NO: 555826 - DNA, 25 bp, Rattus norvegicus
ccacgcgactctggctaagggactc

SEQ ID NO: 555827 - DNA, 25 bp, Rattus norvegicus
agaatattccctgcgtgctcacaag

SEQ ID NO: 555828 - DNA, 25 bp, Rattus norvegicus
tgctcacaagtgattacggccctcg

SEQ ID NO: 555829 - DNA, 25 bp, Rattus norvegicus
cgcggcgggatgtgtagtcacacac

SEQ ID NO: 555830 - DNA, 25 bp, Rattus norvegicus
cacacaccgggttcttgaccgctta

SEQ ID NO: 555831 - DNA, 25 bp, Rattus norvegicus
cgcttatttatagcaggtagccctg

SEQ ID NO: 555832 - DNA, 25 bp, Rattus norvegicus
caggaatcctgcttctctgcacgca

SEQ ID NO: 555833 - DNA, 25 bp, Rattus norvegicus
gaccggaagatcactgcgcagcaca

SEQ ID NO: 555834 - DNA, 25 bp, Rattus norvegicus
atccttcttgcactggggtcgaatg

SEQ ID NO: 555835 - DNA, 25 bp, Rattus norvegicus
ggctgaagtgccctccgcagattag

SEQ ID NO: 555836 - DNA, 25 bp, Rattus norvegicus
agtatctgcttctcttgcgggttga

SEQ ID NO: 555837 - DNA, 25 bp, Rattus norvegicus
cccgggagccaagaacaggactaga

SEQ ID NO: 555838 - DNA, 25 bp, Rattus norvegicus
tctacccggtctagcagccgggcga

SEQ ID NO: 555839 - DNA, 25 bp, Rattus norvegicus
ggcgagccacacagctgtctcagtc

SEQ ID NO: 555840 - DNA, 25 bp, Rattus norvegicus
cacaacccagcggaggaggcccggt

SEQ ID NO: 555841 - DNA, 25 bp, Rattus norvegicus
gtttatgccgatcaggctctgtgtg

SEQ ID NO: 555842 - DNA, 25 bp, Rattus norvegicus
agagccggagatcggcccttacccg

SEQ ID NO: 555843 - DNA, 25 bp, Rattus norvegicus
tcagtcccgccacagtttatgccga

SEQ ID NO: 555844 - DNA, 25 bp, Rattus norvegicus
ggtcccagcgtagccactgcgcggt

SEQ ID NO: 555845 - DNA, 25 bp, Rattus norvegicus
actgcgcggtctcctggtccagtcg

SEQ ID NO: 555846 - DNA, 25 bp, Rattus norvegicus
gtccagtcgcgcgtccattcccaag

SEQ ID NO: 555847 - DNA, 25 bp, Rattus norvegicus
attcccaagccgctggcctcgggag

SEQ ID NO: 555848 - DNA, 25 bp, Rattus norvegicus
tctgtgttggtgtcgctgccgccat

SEQ ID NO: 555849 - DNA, 25 bp, Rattus norvegicus
tgtccgagccacaacccagcggagg

SEQ ID NO: 555850 - DNA, 25 bp, Rattus norvegicus
aggaggcccggtcacccttctggag

SEQ ID NO: 555851 - DNA, 25 bp, Rattus norvegicus
ccagggaacccaagagccggagatc

SEQ ID NO: 555852 - DNA, 25 bp, Rattus norvegicus
cacggaattcaacctaggcgcggga

SEQ ID NO: 555853 - DNA, 25 bp, Rattus norvegicus
cacccgggccaaggcgcaggtaaag

SEQ ID NO: 555854 - DNA, 25 bp, Rattus norvegicus
acttcgggagaagtcacggaattca

SEQ ID NO: 555855 - DNA, 25 bp, Rattus norvegicus
acgcgaggcaaaccggtggtttgat

SEQ ID NO: 555856 - DNA, 25 bp, Rattus norvegicus
cccgcctcaggtaagtagcgtccgg

SEQ ID NO: 555857 - DNA, 25 bp, Rattus norvegicus
ccgcgaagccatgggcgccgcgatt

SEQ ID NO: 555858 - DNA, 25 bp, Rattus norvegicus
ctcaagcatagatcaccggacgtcc

SEQ ID NO: 555859 - DNA, 25 bp, Rattus norvegicus
tgtctggctcgctaaccattcactc

SEQ ID NO: 555860 - DNA, 25 bp, Rattus norvegicus
tcaagcaactatgctgtctggctcg

SEQ ID NO: 555861 - DNA, 25 bp, Rattus norvegicus
ccctgtgggctcgatcaagcaacta

SEQ ID NO: 555862 - DNA, 25 bp, Rattus norvegicus
taccgagcaggcgacaagccctgtg

SEQ ID NO: 555863 - DNA, 25 bp, Rattus norvegicus
agcggcgtctgtgcagtttgtctag

SEQ ID NO: 555864 - DNA, 25 bp, Rattus norvegicus
agagtggcgacaaggaacaggtttc

SEQ ID NO: 555865 - DNA, 25 bp, Rattus norvegicus
cagtttgtctagctaccgagcaggc

SEQ ID NO: 555866 - DNA, 25 bp, Rattus norvegicus
accctgcccagagatgtggcgactg

SEQ ID NO: 555867 - DNA, 25 bp, Rattus norvegicus
acaccgaaccagcaagcacagcaga

SEQ ID NO: 555868 - DNA, 25 bp, Rattus norvegicus
aactcagtaggcatcccgacccgga

SEQ ID NO: 555869 - DNA, 25 bp, Rattus norvegicus
tccggccgattgagcgcaaaagctc

SEQ ID NO: 555870 - DNA, 25 bp, Rattus norvegicus
ctcaaaacccttgggtcggcgtctg

SEQ ID NO: 555871 - DNA, 25 bp, Rattus norvegicus
tcggcgtctgatgcgcgcctaagcc

SEQ ID NO: 555872 - DNA, 25 bp, Rattus norvegicus
ccgcctcctctgttgggcgggctaa

SEQ ID NO: 555873 - DNA, 25 bp, Rattus norvegicus
ttccgtacgcagacccaactcagta

SEQ ID NO: 555874 - DNA, 25 bp, Rattus norvegicus
cttcgacgtcccgagcccaggtaga

SEQ ID NO: 555875 - DNA, 25 bp, Rattus norvegicus
ggcgggctaaccctgcccagagatg

SEQ ID NO: 555876 - DNA, 25 bp, Rattus norvegicus
tcagagcctgatccggtagcagagc

SEQ ID NO: 555877 - DNA, 25 bp, Rattus norvegicus
ggacacccagatgttcagagcctga

SEQ ID NO: 555878 - DNA, 25 bp, Rattus norvegicus
aggcactcgagcagtgctgcgcgcc

SEQ ID NO: 555879 - DNA, 25 bp, Rattus norvegicus
gcgccgttcttagaagtgacgggaa

SEQ ID NO: 555880 - DNA, 25 bp, Rattus norvegicus
cttggtttcctaggaggacacgctc

SEQ ID NO: 555881 - DNA, 25 bp, Rattus norvegicus
gacttaccttcagggttggcgctga

SEQ ID NO: 555882 - DNA, 25 bp, Rattus norvegicus
cagaccgactaacagggccaaagga

SEQ ID NO: 555883 - DNA, 25 bp, Rattus norvegicus
ccgtctctgctcttcgggtccttga

SEQ ID NO: 555884 - DNA, 25 bp, Rattus norvegicus
ctctgggcattgacaaaggagtatc

SEQ ID NO: 555885 - DNA, 25 bp, Rattus norvegicus
cacgcctaagggctggagcatcaga

SEQ ID NO: 555886 - DNA, 25 bp, Rattus norvegicus
cccaggctgctctctcagtgaagga

SEQ ID NO: 555887 - DNA, 25 bp, Rattus norvegicus
tcgtcgggactctcagaaatgaagc

SEQ ID NO: 555888 - DNA, 25 bp, Rattus norvegicus
ggcgaccagagcaggtcaaagttta

SEQ ID NO: 555889 - DNA, 25 bp, Rattus norvegicus
ctctgcttctggagcccgtagccat

SEQ ID NO: 555890 - DNA, 25 bp, Rattus norvegicus
gagtactgccttagctcccgccaga

SEQ ID NO: 555891 - DNA, 25 bp, Rattus norvegicus
ttgtcgcctcctacacctctgagta

SEQ ID NO: 555892 - DNA, 25 bp, Rattus norvegicus
ggttctatttgtctctcgtgtcgtg

SEQ ID NO: 555893 - DNA, 25 bp, Rattus norvegicus
cgggcgtctgcaagcctttgccaag

SEQ ID NO: 555894 - DNA, 25 bp, Rattus norvegicus
ttcctcaactgcaggatggcgtccc

SEQ ID NO: 555895 - DNA, 25 bp, Rattus norvegicus
aaactcaggagcgttgctcacgtgc

SEQ ID NO: 555896 - DNA, 25 bp, Rattus norvegicus
tcaggagcgttgctcacgtgcttgc

SEQ ID NO: 555897 - DNA, 25 bp, Rattus norvegicus
gcgttgctcacgtgcttgcggagca

SEQ ID NO: 555898 - DNA, 25 bp, Rattus norvegicus
cgacaggtcctcatacagaccaaac

SEQ ID NO: 555899 - DNA, 25 bp, Rattus norvegicus
tacagaccaaacataagcgccagcg

SEQ ID NO: 555900 - DNA, 25 bp, Rattus norvegicus
aaacataagcgccagcgtggtcgtc

SEQ ID NO: 555901 - DNA, 25 bp, Rattus norvegicus
ccagcgtggtcgtcttctgcatcag

SEQ ID NO: 555902 - DNA, 25 bp, Rattus norvegicus
cgtggtcgtcttctgcatcagtggg

SEQ ID NO: 555903 - DNA, 25 bp, Rattus norvegicus
agttgcggaacccatccttcctcaa

SEQ ID NO: 555904 - DNA, 25 bp, Rattus norvegicus
cggcgcagcagccacagaagtaatg

SEQ ID NO: 555905 - DNA, 25 bp, Rattus norvegicus
gcagccacagaagtaatgctttatt

SEQ ID NO: 555906 - DNA, 25 bp, Rattus norvegicus
gtggcaaactcaggagcgttgctca

SEQ ID NO: 555907 - DNA, 25 bp, Rattus norvegicus
gtacaagttgcggaacccatccttc

SEQ ID NO: 555908 - DNA, 25 bp, Rattus norvegicus
ggcagcaatgcttcggaacccggac

SEQ ID NO: 555909 - DNA, 25 bp, Rattus norvegicus
agctcggatccctctagtgggcgtc

SEQ ID NO: 555910 - DNA, 25 bp, Rattus norvegicus
agattgtgcagctcggatccctcta

SEQ ID NO: 555911 - DNA, 25 bp, Rattus norvegicus
tgctctagattgtgcagctcggatc

SEQ ID NO: 555912 - DNA, 25 bp, Rattus norvegicus
ccgggtgcttgggctgctctagatt

SEQ ID NO: 555913 - DNA, 25 bp, Rattus norvegicus
agaacgtcacgcctcggggcgcgcc

SEQ ID NO: 555914 - DNA, 25 bp, Rattus norvegicus
cgaggcgaatctccggagtggtctg

SEQ ID NO: 555915 - DNA, 25 bp, Rattus norvegicus
ccgcgcgagagcgaggcgaatctcc

SEQ ID NO: 555916 - DNA, 25 bp, Rattus norvegicus
actgatctgcccaggctgggcggcc

SEQ ID NO: 555917 - DNA, 25 bp, Rattus norvegicus
agccggcactgatctgcccaggctg

SEQ ID NO: 555918 - DNA, 25 bp, Rattus norvegicus
ggatgagccggcactgatctgccca

SEQ ID NO: 555919 - DNA, 25 bp, Rattus norvegicus
cccatggggatgagccggcactgat

SEQ ID NO: 555920 - DNA, 25 bp, Rattus norvegicus
cgctgagcacctgggagtcccagcc

SEQ ID NO: 555921 - DNA, 25 bp, Rattus norvegicus
tgctcgcccgctcgtctgccggctg

SEQ ID NO: 555922 - DNA, 25 bp, Rattus norvegicus
gcagaaaccgccctgggcctcccca

SEQ ID NO: 555923 - DNA, 25 bp, Rattus norvegicus
caggagctctgcagcatgtgcttcc

SEQ ID NO: 555924 - DNA, 25 bp, Rattus norvegicus
gcggcgttgagggtcagctcggccg

SEQ ID NO: 555925 - DNA, 25 bp, Rattus norvegicus
gagctctgcagcatgtgcttccccg

SEQ ID NO: 555926 - DNA, 25 bp, Rattus norvegicus
ggagctctgcagcatgtgcttcccc

SEQ ID NO: 555927 - DNA, 25 bp, Rattus norvegicus
aggagctctgcagcatgtgcttccc

SEQ ID NO: 555928 - DNA, 25 bp, Rattus norvegicus
ccagtgttgcgcctcaccaggttgc

SEQ ID NO: 555929 - DNA, 25 bp, Rattus norvegicus
gttgcgcctcaccaggttgcctgca

SEQ ID NO: 555930 - DNA, 25 bp, Rattus norvegicus
gcttcccagtgttgcgcctcaccag

SEQ ID NO: 555931 - DNA, 25 bp, Rattus norvegicus
caccacgcgcttcccagtgttgcgc

SEQ ID NO: 555932 - DNA, 25 bp, Rattus norvegicus
gcctcaccaggttgcctgcaccttg

SEQ ID NO: 555933 - DNA, 25 bp, Rattus norvegicus
tgcgcctcaccaggttgcctgcacc

SEQ ID NO: 555934 - DNA, 25 bp, Rattus norvegicus
tgttgcgcctcaccaggttgcctgc

SEQ ID NO: 555935 - DNA, 25 bp, Rattus norvegicus
gtgttgcgcctcaccaggttgcctg

SEQ ID NO: 555936 - DNA, 25 bp, Rattus norvegicus
agtgttgcgcctcaccaggttgcct

SEQ ID NO: 555937 - DNA, 25 bp, Rattus norvegicus
cagtgttgcgcctcaccaggttgcc

SEQ ID NO: 555938 - DNA, 25 bp, Rattus norvegicus
ttcccagtgttgcgcctcaccaggt

SEQ ID NO: 555939 - DNA, 25 bp, Rattus norvegicus
cgcttcccagtgttgcgcctcacca

SEQ ID NO: 555940 - DNA, 25 bp, Rattus norvegicus
acgcgcttcccagtgttgcgcctca

SEQ ID NO: 555941 - DNA, 25 bp, Rattus norvegicus
cgcctcaccaggttgcctgcacctt

SEQ ID NO: 555942 - DNA, 25 bp, Rattus norvegicus
caaaggcgactccaggctggggatt

SEQ ID NO: 555943 - DNA, 25 bp, Rattus norvegicus
aaaggcgactccaggctggggattt

SEQ ID NO: 555944 - DNA, 25 bp, Rattus norvegicus
aaggcgactccaggctggggattta

SEQ ID NO: 555945 - DNA, 25 bp, Rattus norvegicus
ccatgcagtttcctgggaagaagca

SEQ ID NO: 555946 - DNA, 25 bp, Rattus norvegicus
catgcagtttcctgggaagaagcag

SEQ ID NO: 555947 - DNA, 25 bp, Rattus norvegicus
atgcagtttcctgggaagaagcaga

SEQ ID NO: 555948 - DNA, 25 bp, Rattus norvegicus
ccaaaggcgactccaggctggggat

SEQ ID NO: 555949 - DNA, 25 bp, Rattus norvegicus
agcggtccgataccgagaggctgca

SEQ ID NO: 555950 - DNA, 25 bp, Rattus norvegicus
ttctcttccagagcaggatcgcgcg

SEQ ID NO: 555951 - DNA, 25 bp, Rattus norvegicus
gtgtctgtgagacgagagtcttctc

SEQ ID NO: 555952 - DNA, 25 bp, Rattus norvegicus
ctgtagaatgtctagtacgagtgtc

SEQ ID NO: 555953 - DNA, 25 bp, Rattus norvegicus
ggagacctcgcgcttctgtagaatg

SEQ ID NO: 555954 - DNA, 25 bp, Rattus norvegicus
gtcgccattttgctgcgggcctcgt

SEQ ID NO: 555955 - DNA, 25 bp, Rattus norvegicus
tcccgcaccaaatgacgaacgtcgt

SEQ ID NO: 555956 - DNA, 25 bp, Rattus norvegicus
tgtcgggcaaagaaacacataaagc

SEQ ID NO: 555957 - DNA, 25 bp, Rattus norvegicus
gtccctctgagaggtgtcgggcaaa

SEQ ID NO: 555958 - DNA, 25 bp, Rattus norvegicus
ctgtaatgcctgcaggcgacgcgca

SEQ ID NO: 555959 - DNA, 25 bp, Rattus norvegicus
tgtctttcagaaacccactgtaatg

SEQ ID NO: 555960 - DNA, 25 bp, Rattus norvegicus
caacccggacgggaagcgcctagat

SEQ ID NO: 555961 - DNA, 25 bp, Rattus norvegicus
gtcacttccggggtcacaagacttc

SEQ ID NO: 555962 - DNA, 25 bp, Rattus norvegicus
tagatgccgttcagttccgcagatc

SEQ ID NO: 555963 - DNA, 25 bp, Rattus norvegicus
cgcgggttatattcggcgctggcag

SEQ ID NO: 555964 - DNA, 25 bp, Rattus norvegicus
gcgcgggttatattcggcgctggca

SEQ ID NO: 555965 - DNA, 25 bp, Rattus norvegicus
cgcgcgggttatattcggcgctggc

SEQ ID NO: 555966 - DNA, 25 bp, Rattus norvegicus
gggcgcgcgggttatattcggcgct

SEQ ID NO: 555967 - DNA, 25 bp, Rattus norvegicus
ggcgcgcgggttatattcggcgctg

SEQ ID NO: 555968 - DNA, 25 bp, Rattus norvegicus
ttgggcatcatctcggccacgggag

SEQ ID NO: 555969 - DNA, 25 bp, Rattus norvegicus
ggcgttgggcatcatctcggccacg

SEQ ID NO: 555970 - DNA, 25 bp, Rattus norvegicus
gcgttgggcatcatctcggccacgg

SEQ ID NO: 555971 - DNA, 25 bp, Rattus norvegicus
cgttgggcatcatctcggccacggg

SEQ ID NO: 555972 - DNA, 25 bp, Rattus norvegicus
gttgggcatcatctcggccacggga

SEQ ID NO: 555973 - DNA, 25 bp, Rattus norvegicus
tagggaatccctccgcgcataagcc

SEQ ID NO: 555974 - DNA, 25 bp, Rattus norvegicus
tcgccttcctctaggctagggaatc

SEQ ID NO: 555975 - DNA, 25 bp, Rattus norvegicus
ggtgctctcactgcgcagcgagtcc

SEQ ID NO: 555976 - DNA, 25 bp, Rattus norvegicus
cccgctctcaaaggcgaggcggcta

SEQ ID NO: 555977 - DNA, 25 bp, Rattus norvegicus
gatcacgggaaatacgcggtaatta

SEQ ID NO: 555978 - DNA, 25 bp, Rattus norvegicus
cctttcctctgctgagatcacggga

SEQ ID NO: 555979 - DNA, 25 bp, Rattus norvegicus
agccgtcttactggcctttcctctg

SEQ ID NO: 555980 - DNA, 25 bp, Rattus norvegicus
tacagcaaaggggaagccgtcttac

SEQ ID NO: 555981 - DNA, 25 bp, Rattus norvegicus
ctcgtcccggtggaggtacagcaaa

SEQ ID NO: 555982 - DNA, 25 bp, Rattus norvegicus
agagctcggcctcaggatctcgtcc

SEQ ID NO: 555983 - DNA, 25 bp, Rattus norvegicus
agccagtgtctccaactggcgtcgc

SEQ ID NO: 555984 - DNA, 25 bp, Rattus norvegicus
catgcggccagagttgcaacctcgg

SEQ ID NO: 555985 - DNA, 25 bp, Rattus norvegicus
tagcactactgagggcatgcggcca

SEQ ID NO: 555986 - DNA, 25 bp, Rattus norvegicus
ggccgccagctgactagcactactg

SEQ ID NO: 555987 - DNA, 25 bp, Rattus norvegicus
cgtcagcacgctgtagcgtcacttc

SEQ ID NO: 555988 - DNA, 25 bp, Rattus norvegicus
cggattcgggcctcgtatcgagccc

SEQ ID NO: 555989 - DNA, 25 bp, Rattus norvegicus
tgtccattttgtcggccatggcggg

SEQ ID NO: 555990 - DNA, 25 bp, Rattus norvegicus
gtcgtccaaagacatgtccattttg

SEQ ID NO: 555991 - DNA, 25 bp, Rattus norvegicus
ctggctccggttcagcttaatgatg

SEQ ID NO: 555992 - DNA, 25 bp, Rattus norvegicus
ctcactctgctgtatggtgccggtc

SEQ ID NO: 555993 - DNA, 25 bp, Rattus norvegicus
tgctgccacttgtcgggaagttgtt

SEQ ID NO: 555994 - DNA, 25 bp, Rattus norvegicus
ggccgccaaacttttctcacagcag

SEQ ID NO: 555995 - DNA, 25 bp, Rattus norvegicus
accgtaaggtcagagactcctgatc

SEQ ID NO: 555996 - DNA, 25 bp, Rattus norvegicus
tccgaagagcgcttacgtacagttc

SEQ ID NO: 555997 - DNA, 25 bp, Rattus norvegicus
tacgtacagttctctgaggcggctg

SEQ ID NO: 555998 - DNA, 25 bp, Rattus norvegicus
gctggaccaggacgggacaaagcct

SEQ ID NO: 555999 - DNA, 25 bp, Rattus norvegicus
ccagacgcggcacggtcgtttttat

SEQ ID NO: 556000 - DNA, 25 bp, Rattus norvegicus
tctgaggcgcctactgattggtctc

SEQ ID NO: 556001 - DNA, 25 bp, Rattus norvegicus
ggcgcccagcgagcactctcaggcg

SEQ ID NO: 556002 - DNA, 25 bp, Rattus norvegicus
gagtgagcagagctgctcccgcctc

SEQ ID NO: 556003 - DNA, 25 bp, Rattus norvegicus
cccgcctcctacctgagcacgtcgc

SEQ ID NO: 556004 - DNA, 25 bp, Rattus norvegicus
tgagctgctccgacaccaccgcctt

SEQ ID NO: 556005 - DNA, 25 bp, Rattus norvegicus
gcctgctccacagtgggccatatca

SEQ ID NO: 556006 - DNA, 25 bp, Rattus norvegicus
tctcaggcgcctgcctcagaaccag

SEQ ID NO: 556007 - DNA, 25 bp, Rattus norvegicus
ataaaaagtccacagccacgtgacc

SEQ ID NO: 556008 - DNA, 25 bp, Rattus norvegicus
gtgggccatatcaggctcaagagcc

SEQ ID NO: 556009 - DNA, 25 bp, Rattus norvegicus
atcaggctcaagagcccgggtgcca

SEQ ID NO: 556010 - DNA, 25 bp, Rattus norvegicus
agttcccgtcccacctagtttgcag

SEQ ID NO: 556011 - DNA, 25 bp, Rattus norvegicus
cacctagtttgcagccggtccctaa

SEQ ID NO: 556012 - DNA, 25 bp, Rattus norvegicus
tccacagtgggccatatcaggctca

SEQ ID NO: 556013 - DNA, 25 bp, Rattus norvegicus
ggtgcctaggaataaaaagtccaca

SEQ ID NO: 556014 - DNA, 25 bp, Rattus norvegicus
tttgcagccggtccctaaattcagc

SEQ ID NO: 556015 - DNA, 25 bp, Rattus norvegicus
tactgaagctgtcaagctcccgcct

SEQ ID NO: 556016 - DNA, 25 bp, Rattus norvegicus
ccgccttcctgacagaggctccgcc

SEQ ID NO: 556017 - DNA, 25 bp, Rattus norvegicus
agctgtcaagctcccgccttcctga

SEQ ID NO: 556018 - DNA, 25 bp, Rattus norvegicus
actgaagctgtcaagctcccgcctt

SEQ ID NO: 556019 - DNA, 25 bp, Rattus norvegicus
tgtcgctcatgactccgggttgctg

SEQ ID NO: 556020 - DNA, 25 bp, Rattus norvegicus
ccgctgtcgctcatgactccgggtt

SEQ ID NO: 556021 - DNA, 25 bp, Rattus norvegicus
cgactcgctccgcaccacctccgca

SEQ ID NO: 556022 - DNA, 25 bp, Rattus norvegicus
ttactgaagctgtcaagctcccgcc

SEQ ID NO: 556023 - DNA, 25 bp, Rattus norvegicus
ctgtcgctcatgactccgggttgct

SEQ ID NO: 556024 - DNA, 25 bp, Rattus norvegicus
cgctgtcgctcatgactccgggttg

SEQ ID NO: 556025 - DNA, 25 bp, Rattus norvegicus
tcgctcatgactccgggttgctgtc

SEQ ID NO: 556026 - DNA, 25 bp, Rattus norvegicus
cgctcatgactccgggttgctgtca

SEQ ID NO: 556027 - DNA, 25 bp, Rattus norvegicus
ctttactgaagctgtcaagctcccg

SEQ ID NO: 556028 - DNA, 25 bp, Rattus norvegicus
tttactgaagctgtcaagctcccgc

SEQ ID NO: 556029 - DNA, 25 bp, Rattus norvegicus
tgggtactccggctgctctagattg

SEQ ID NO: 556030 - DNA, 25 bp, Rattus norvegicus
gactcagccgcgcagcaatgctgcg

SEQ ID NO: 556031 - DNA, 25 bp, Rattus norvegicus
tgtgccgctcgggttgcgcttccct

SEQ ID NO: 556032 - DNA, 25 bp, Rattus norvegicus
agaacgtcgcacttcggggtgggct

SEQ ID NO: 556033 - DNA, 25 bp, Rattus norvegicus
ttgcgcttccctcgagtgggcgtcg

SEQ ID NO: 556034 - DNA, 25 bp, Rattus norvegicus
tgctctagattgtgccgctcgggtt

SEQ ID NO: 556035 - DNA, 25 bp, Rattus norvegicus
gcaggctgactcagccgcgcagcaa

SEQ ID NO: 556036 - DNA, 25 bp, Rattus norvegicus
cccactgggcagacccgctccaggt

SEQ ID NO: 556037 - DNA, 25 bp, Rattus norvegicus
tccgcagtaagcagaaggaaacggg

SEQ ID NO: 556038 - DNA, 25 bp, Rattus norvegicus
ctcagagcgcacagtatccgcagta

SEQ ID NO: 556039 - DNA, 25 bp, Rattus norvegicus
agccctgctcagagcgcacagtatc

SEQ ID NO: 556040 - DNA, 25 bp, Rattus norvegicus
ggcgttccgcctcattggccaccag

SEQ ID NO: 556041 - DNA, 25 bp, Rattus norvegicus
agccggcgctgagctgcccaggttc

SEQ ID NO: 556042 - DNA, 25 bp, Rattus norvegicus
gcacagtatccgcagtaagcagaag

SEQ ID NO: 556043 - DNA, 25 bp, Rattus norvegicus
gcagccgggaagcactcaacatatc

SEQ ID NO: 556044 - DNA, 25 bp, Rattus norvegicus
tcgccggtgaggttgtcaatcttca

SEQ ID NO: 556045 - DNA, 25 bp, Rattus norvegicus
ggactggagcaaacctgcagccttc

SEQ ID NO: 556046 - DNA, 25 bp, Rattus norvegicus
aaccggtcacgatgcccaggtccga

SEQ ID NO: 556047 - DNA, 25 bp, Rattus norvegicus
tcatgcaatgggtgctaatcgcccg

SEQ ID NO: 556048 - DNA, 25 bp, Rattus norvegicus
ggccaccgtttactcgcagtactca

SEQ ID NO: 556049 - DNA, 25 bp, Rattus norvegicus
cgcagtactcacagttcacgggaca

SEQ ID NO: 556050 - DNA, 25 bp, Rattus norvegicus
tgacagccctgctagtccttactgc

SEQ ID NO: 556051 - DNA, 25 bp, Rattus norvegicus
ctcgagttaagtccaattcacgttc

SEQ ID NO: 556052 - DNA, 25 bp, Rattus norvegicus
ctagacccaggctctgtttaggctc

SEQ ID NO: 556053 - DNA, 25 bp, Rattus norvegicus
tccggaggtccaaacaaacgtgagc

SEQ ID NO: 556054 - DNA, 25 bp, Rattus norvegicus
tctgactcctctaaagcagccggga

SEQ ID NO: 556055 - DNA, 25 bp, Rattus norvegicus
aaaattccacggcaggtcgcttcgg

SEQ ID NO: 556056 - DNA, 25 bp, Rattus norvegicus
ggggcgagcaacaagccagtctcaa

SEQ ID NO: 556057 - DNA, 25 bp, Rattus norvegicus
agccgaaggagacgcagccgctccg

SEQ ID NO: 556058 - DNA, 25 bp, Rattus norvegicus
cggaagcagactcccgccgggtgct

SEQ ID NO: 556059 - DNA, 25 bp, Rattus norvegicus
caggtcgcatccgtccgccacgccg

SEQ ID NO: 556060 - DNA, 25 bp, Rattus norvegicus
ccgccgggcactcgctcgccgccag

SEQ ID NO: 556061 - DNA, 25 bp, Rattus norvegicus
cattgctgcccagcgccgtcgggaa

SEQ ID NO: 556062 - DNA, 25 bp, Rattus norvegicus
gagcagcattgctgcccagcgccgt

SEQ ID NO: 556063 - DNA, 25 bp, Rattus norvegicus
acagcccgaagagcagcattgctgc

SEQ ID NO: 556064 - DNA, 25 bp, Rattus norvegicus
caccaacagcccgaagagcagcatt

SEQ ID NO: 556065 - DNA, 25 bp, Rattus norvegicus
cagccgcagccgaaggagacgcagc

SEQ ID NO: 556066 - DNA, 25 bp, Rattus norvegicus
cctcacctgtcagcagcgcctggcg

SEQ ID NO: 556067 - DNA, 25 bp, Rattus norvegicus
gagtcccgccaagcctgctcgtcgc

SEQ ID NO: 556068 - DNA, 25 bp, Rattus norvegicus
tccgaagtgcgacgaccggcgccaa

SEQ ID NO: 556069 - DNA, 25 bp, Rattus norvegicus
actaggaaggcgtccgaagtgcgac

SEQ ID NO: 556070 - DNA, 25 bp, Rattus norvegicus
tgccggggcaccaggtcgcatccgt

SEQ ID NO: 556071 - DNA, 25 bp, Rattus norvegicus
aggcggagctttaggagccaaagaa

SEQ ID NO: 556072 - DNA, 25 bp, Rattus norvegicus
gacctggataaagccagtcgacgtc

SEQ ID NO: 556073 - DNA, 25 bp, Rattus norvegicus
caggcggagctttaggagccaaaga

SEQ ID NO: 556074 - DNA, 25 bp, Rattus norvegicus
ggaaggcctgtgtctcgcccacgca

SEQ ID NO: 556075 - DNA, 25 bp, Rattus norvegicus
gtgtctcgcccacgcagtgatccga

SEQ ID NO: 556076 - DNA, 25 bp, Rattus norvegicus
tctcgcccacgcagtgatccgatga

SEQ ID NO: 556077 - DNA, 25 bp, Rattus norvegicus
tcgcccacgcagtgatccgatgatg

SEQ ID NO: 556078 - DNA, 25 bp, Rattus norvegicus
cgcccacgcagtgatccgatgatgg

SEQ ID NO: 556079 - DNA, 25 bp, Rattus norvegicus
ccacgcagtgatccgatgatgggca

SEQ ID NO: 556080 - DNA, 25 bp, Rattus norvegicus
acgcagtgatccgatgatgggcagc

SEQ ID NO: 556081 - DNA, 25 bp, Rattus norvegicus
cagtgatccgatgatgggcagcctg

SEQ ID NO: 556082 - DNA, 25 bp, Rattus norvegicus
cctggggacctggataaagccagtc

SEQ ID NO: 556083 - DNA, 25 bp, Rattus norvegicus
tggggacctggataaagccagtcga

SEQ ID NO: 556084 - DNA, 25 bp, Rattus norvegicus
cccaggcggagctttaggagccaaa

SEQ ID NO: 556085 - DNA, 25 bp, Rattus norvegicus
ccacaggtgcgcgactctggctggc

SEQ ID NO: 556086 - DNA, 25 bp, Rattus norvegicus
acatcaccgcgtgggcggacgcagt

SEQ ID NO: 556087 - DNA, 25 bp, Rattus norvegicus
tgacatcaccgcgtgggcggacgca

SEQ ID NO: 556088 - DNA, 25 bp, Rattus norvegicus
cccgggcgatgacatcaccgcgtgg

SEQ ID NO: 556089 - DNA, 25 bp, Rattus norvegicus
acccgggcgatgacatcaccgcgtg

SEQ ID NO: 556090 - DNA, 25 bp, Rattus norvegicus
gcgctcccgagttccgtgggcggac

SEQ ID NO: 556091 - DNA, 25 bp, Rattus norvegicus
cagagcgctcccgagttccgtgggc

SEQ ID NO: 556092 - DNA, 25 bp, Rattus norvegicus
gcacagagcgctcccgagttccgtg

SEQ ID NO: 556093 - DNA, 25 bp, Rattus norvegicus
tggcacagagcgctcccgagttccg

SEQ ID NO: 556094 - DNA, 25 bp, Rattus norvegicus
caggtgcgcgactctggctggcaca

SEQ ID NO: 556095 - DNA, 25 bp, Rattus norvegicus
acggactctggcggccgccacaggt

SEQ ID NO: 556096 - DNA, 25 bp, Rattus norvegicus
aacgcgcatgcccacggactctggc

SEQ ID NO: 556097 - DNA, 25 bp, Rattus norvegicus
cgcagcaacgcgcatgcccacggac

SEQ ID NO: 556098 - DNA, 25 bp, Rattus norvegicus
tggctggcacagagcgctcccgagt

SEQ ID NO: 556099 - DNA, 25 bp, Rattus norvegicus
cacatgcgttccgagggcggaaaga

SEQ ID NO: 556100 - DNA, 25 bp, Rattus norvegicus
tacggccgccggcaaggaaagaatg

SEQ ID NO: 556101 - DNA, 25 bp, Rattus norvegicus
cgccggcaaggaaagaatgcgctgc

SEQ ID NO: 556102 - DNA, 25 bp, Rattus norvegicus
aaagaatgcgctgcagggtcccact

SEQ ID NO: 556103 - DNA, 25 bp, Rattus norvegicus
atgcgctgcagggtcccactcctgg

SEQ ID NO: 556104 - DNA, 25 bp, Rattus norvegicus
cgctgacacttctcccggacctttt

SEQ ID NO: 556105 - DNA, 25 bp, Rattus norvegicus
cttttttacgctaggactcctccag

SEQ ID NO: 556106 - DNA, 25 bp, Rattus norvegicus
ttacgctaggactcctccagcgggc

SEQ ID NO: 556107 - DNA, 25 bp, Rattus norvegicus
aggactcctccagcgggcgttgcct

SEQ ID NO: 556108 - DNA, 25 bp, Rattus norvegicus
ttgcctggcaactgctgggccgtgt

SEQ ID NO: 556109 - DNA, 25 bp, Rattus norvegicus
aactgctgggccgtgtgtccgtccc

SEQ ID NO: 556110 - DNA, 25 bp, Rattus norvegicus
ccgcatctgaaagacctcgcacatg

SEQ ID NO: 556111 - DNA, 25 bp, Rattus norvegicus
ggccgtgtgtccgtccctctctggt

SEQ ID NO: 556112 - DNA, 25 bp, Rattus norvegicus
aaagacctcgcacatgcgttccgag

SEQ ID NO: 556113 - DNA, 25 bp, Rattus norvegicus
tctcttggaaagcaaagggccggga

SEQ ID NO: 556114 - DNA, 25 bp, Rattus norvegicus
ctcatctaggcctgtgaaacgctca

SEQ ID NO: 556115 - DNA, 25 bp, Rattus norvegicus
cccacttgaggaggtgtctcatcta

SEQ ID NO: 556116 - DNA, 25 bp, Rattus norvegicus
cgagcgggaagccacttggaataca

SEQ ID NO: 556117 - DNA, 25 bp, Rattus norvegicus
tccggcacctgatacggagattaga

SEQ ID NO: 556118 - DNA, 25 bp, Rattus norvegicus
atctcaccacgtgtgcgggtagtgc

SEQ ID NO: 556119 - DNA, 25 bp, Rattus norvegicus
aggccacgcggcagtcatgcctatc

SEQ ID NO: 556120 - DNA, 25 bp, Rattus norvegicus
gctcccaaagcttttcgcctgcaga

SEQ ID NO: 556121 - DNA, 25 bp, Rattus norvegicus
tcgggatgacctcgtctcccatcgg

SEQ ID NO: 556122 - DNA, 25 bp, Rattus norvegicus
gctcgctcccaagtgcctaggcttg

SEQ ID NO: 556123 - DNA, 25 bp, Rattus norvegicus
atcctgcaagctggctgttgccttg

SEQ ID NO: 556124 - DNA, 25 bp, Rattus norvegicus
tgcttctaggcggtcacctacacgc

SEQ ID NO: 556125 - DNA, 25 bp, Rattus norvegicus
cacctccggaggagctgcttctagg

SEQ ID NO: 556126 - DNA, 25 bp, Rattus norvegicus
tccggttttcctcagtctccacgta

SEQ ID NO: 556127 - DNA, 25 bp, Rattus norvegicus
cgtgcccacagcttgaatcgctatg

SEQ ID NO: 556128 - DNA, 25 bp, Rattus norvegicus
ttgaatcgctatgcagcgtccgaca

SEQ ID NO: 556129 - DNA, 25 bp, Rattus norvegicus
atgcagcgtccgacagcgagcccga

SEQ ID NO: 556130 - DNA, 25 bp, Rattus norvegicus
ctgctggtgcctgctgccgctggac

SEQ ID NO: 556131 - DNA, 25 bp, Rattus norvegicus
agccattcagtgagggctcctgctg

SEQ ID NO: 556132 - DNA, 25 bp, Rattus norvegicus
tgctggcactgacaagaacgttaac

SEQ ID NO: 556133 - DNA, 25 bp, Rattus norvegicus
ctgacaagaacgttaaccgcagcca

SEQ ID NO: 556134 - DNA, 25 bp, Rattus norvegicus
aaccgcagccagtcctttgctgtgc

SEQ ID NO: 556135 - DNA, 25 bp, Rattus norvegicus
agtcctttgctgtgcggccacgtaa

SEQ ID NO: 556136 - DNA, 25 bp, Rattus norvegicus
tcagccatggctagcgccaacctag

SEQ ID NO: 556137 - DNA, 25 bp, Rattus norvegicus
cgccaacctagctgatgagccgtct

SEQ ID NO: 556138 - DNA, 25 bp, Rattus norvegicus
ctgatgagccgtctccagatgttga

SEQ ID NO: 556139 - DNA, 25 bp, Rattus norvegicus
ccagatgttgagacagaggatggcc

SEQ ID NO: 556140 - DNA, 25 bp, Rattus norvegicus
ggcccaagaaacgtgcccacagctt

SEQ ID NO: 556141 - DNA, 25 bp, Rattus norvegicus
cctcgcctcaggctgactgcgtgga

SEQ ID NO: 556142 - DNA, 25 bp, Rattus norvegicus
agaggtcactcacggtattcttcca

SEQ ID NO: 556143 - DNA, 25 bp, Rattus norvegicus
acggtattcttccagccgcagaagg

SEQ ID NO: 556144 - DNA, 25 bp, Rattus norvegicus
cttccagccgcagaaggggccggaa

SEQ ID NO: 556145 - DNA, 25 bp, Rattus norvegicus
tagaaggcggctccgaccatagaga

SEQ ID NO: 556146 - DNA, 25 bp, Rattus norvegicus
accatagagatgaagcctccgaata

SEQ ID NO: 556147 - DNA, 25 bp, Rattus norvegicus
cctccgaatatgagcgcggtgcgca

SEQ ID NO: 556148 - DNA, 25 bp, Rattus norvegicus
ctcaaggtcgcgacccggctcggaa

SEQ ID NO: 556149 - DNA, 25 bp, Rattus norvegicus
gagcaactctcgcttccgggatttg

SEQ ID NO: 556150 - DNA, 25 bp, Rattus norvegicus
atggggcggagactcaaaccgagcc

SEQ ID NO: 556151 - DNA, 25 bp, Rattus norvegicus
ggtggcccgtgcagtcacaaatttg

SEQ ID NO: 556152 - DNA, 25 bp, Rattus norvegicus
atttggctacactcctttctcgagc

SEQ ID NO: 556153 - DNA, 25 bp, Rattus norvegicus
cttttgacctcttactcgcctcggg

SEQ ID NO: 556154 - DNA, 25 bp, Rattus norvegicus
ctgggctgaaagactcctcgcagtg

SEQ ID NO: 556155 - DNA, 25 bp, Rattus norvegicus
ctctcgatagagtccattccgcttc

SEQ ID NO: 556156 - DNA, 25 bp, Rattus norvegicus
ggacttgccggctactctcgataga

SEQ ID NO: 556157 - DNA, 25 bp, Rattus norvegicus
tggaccggacttgccggctactctc

SEQ ID NO: 556158 - DNA, 25 bp, Rattus norvegicus
cccttgggatgagtacccggtgcgt

SEQ ID NO: 556159 - DNA, 25 bp, Rattus norvegicus
gcgctcccagcccttgggatgagta

SEQ ID NO: 556160 - DNA, 25 bp, Rattus norvegicus
gacctcgccgcgactttgtctcttt

SEQ ID NO: 556161 - DNA, 25 bp, Rattus norvegicus
ccaaccgcaggaggtagggacctcg

SEQ ID NO: 556162 - DNA, 25 bp, Rattus norvegicus
tagggtccttccttctgcgcgggcc

SEQ ID NO: 556163 - DNA, 25 bp, Rattus norvegicus
gtgagcgccggaccttattagggtc

SEQ ID NO: 556164 - DNA, 25 bp, Rattus norvegicus
ctttctctgctacctggtgagcgcc

SEQ ID NO: 556165 - DNA, 25 bp, Rattus norvegicus
gatccgggcggcctcgccatgcagt

SEQ ID NO: 556166 - DNA, 25 bp, Rattus norvegicus
caggtgacctgttccggccgggatc

SEQ ID NO: 556167 - DNA, 25 bp, Rattus norvegicus
ggtccctgcaccaggtgacctgttc

SEQ ID NO: 556168 - DNA, 25 bp, Rattus norvegicus
gatagagtccattccgcttcctcgc

SEQ ID NO: 556169 - DNA, 25 bp, Rattus norvegicus
acaaaagtttgagcaggtggacgga

SEQ ID NO: 556170 - DNA, 25 bp, Rattus norvegicus
acaccagggaccagtagagcagggc

SEQ ID NO: 556171 - DNA, 25 bp, Rattus norvegicus
cgcagtagccgtacaccagggacca

SEQ ID NO: 556172 - DNA, 25 bp, Rattus norvegicus
ctaccgatgctccacaaaagtttga

SEQ ID NO: 556173 - DNA, 25 bp, Rattus norvegicus
gccctaccgatgctccacaaaagtt

SEQ ID NO: 556174 - DNA, 25 bp, Rattus norvegicus
tgatgcgcacgtagcagtgggtccc

SEQ ID NO: 556175 - DNA, 25 bp, Rattus norvegicus
gcccgcagctatcaggggacgaata

SEQ ID NO: 556176 - DNA, 25 bp, Rattus norvegicus
cggccttcaccttgatgcgcacgta

SEQ ID NO: 556177 - DNA, 25 bp, Rattus norvegicus
gcgacggccttcaccttgatgcgca

SEQ ID NO: 556178 - DNA, 25 bp, Rattus norvegicus
ataatcagcccggagccctaggcac

SEQ ID NO: 556179 - DNA, 25 bp, Rattus norvegicus
gacgaataatcagcccggagcccta

SEQ ID NO: 556180 - DNA, 25 bp, Rattus norvegicus
agctatcaggggacgaataatcagc

SEQ ID NO: 556181 - DNA, 25 bp, Rattus norvegicus
caccttgatgcgcacgtagcagtgg

SEQ ID NO: 556182 - DNA, 25 bp, Rattus norvegicus
tagccgtacaccagggaccagtaga

SEQ ID NO: 556183 - DNA, 25 bp, Rattus norvegicus
gctgagcgcccggtatatatacagc

SEQ ID NO: 556184 - DNA, 25 bp, Rattus norvegicus
ccggtatatatacagcgaaggtgtt

SEQ ID NO: 556185 - DNA, 25 bp, Rattus norvegicus
atacagcgaaggtgttgcgcaaaga

SEQ ID NO: 556186 - DNA, 25 bp, Rattus norvegicus
cctacctgtgggcttagtgagccca

SEQ ID NO: 556187 - DNA, 25 bp, Rattus norvegicus
gccggcggcagtcgctgtcatcacg

SEQ ID NO: 556188 - DNA, 25 bp, Rattus norvegicus
tagtgagcccatcgccacctcgaga

SEQ ID NO: 556189 - DNA, 25 bp, Rattus norvegicus
catcgccacctcgagagctgcgggg

SEQ ID NO: 556190 - DNA, 25 bp, Rattus norvegicus
agaccaggcccgcagtaggaacggc

SEQ ID NO: 556191 - DNA, 25 bp, Rattus norvegicus
ccttcgcaggtaagggacagcagga

SEQ ID NO: 556192 - DNA, 25 bp, Rattus norvegicus
taggaacggccgaacggcctgcgcc

SEQ ID NO: 556193 - DNA, 25 bp, Rattus norvegicus
aacctcagaccaggcccgcagtagg

SEQ ID NO: 556194 - DNA, 25 bp, Rattus norvegicus
tagcggcggcggtgtactcaccagc

SEQ ID NO: 556195 - DNA, 25 bp, Rattus norvegicus
cggcactgcctacctgtgggcttag

SEQ ID NO: 556196 - DNA, 25 bp, Rattus norvegicus
accagcgctcccttcgcaggtaagg

SEQ ID NO: 556197 - DNA, 25 bp, Rattus norvegicus
gcaacgacgctctcgtgaaggccgt

SEQ ID NO: 556198 - DNA, 25 bp, Rattus norvegicus
ggcctactcctagccagctgccttc

SEQ ID NO: 556199 - DNA, 25 bp, Rattus norvegicus
cgcagcatgggtgcggccctgcaac

SEQ ID NO: 556200 - DNA, 25 bp, Rattus norvegicus
ccgacgctaggttgtcctcgcgaga

SEQ ID NO: 556201 - DNA, 25 bp, Rattus norvegicus
ctccgcgctcagaggaagcttccgg

SEQ ID NO: 556202 - DNA, 25 bp, Rattus norvegicus
ctaggttgtcctcgcgagaggaagt

SEQ ID NO: 556203 - DNA, 25 bp, Rattus norvegicus
gtacctgccagactctcaaactcgg

SEQ ID NO: 556204 - DNA, 25 bp, Rattus norvegicus
tgccagcagcggtacctgccagact

SEQ ID NO: 556205 - DNA, 25 bp, Rattus norvegicus
gcgcaaagccctgccagcagcggta

SEQ ID NO: 556206 - DNA, 25 bp, Rattus norvegicus
cggccacaaagctttggcgcaaagc

SEQ ID NO: 556207 - DNA, 25 bp, Rattus norvegicus
ggagcacccggccacaaagctttgg

SEQ ID NO: 556208 - DNA, 25 bp, Rattus norvegicus
tgaaggccgtcggagcacccggcca

SEQ ID NO: 556209 - DNA, 25 bp, Rattus norvegicus
ggccctgcaacgacgctctcgtgaa

SEQ ID NO: 556210 - DNA, 25 bp, Rattus norvegicus
ctcagaggaagcttccggcgccgac

SEQ ID NO: 556211 - DNA, 25 bp, Rattus norvegicus
cgaggtcccgaaagcctctgtctca

SEQ ID NO: 556212 - DNA, 25 bp, Rattus norvegicus
ggaggaatcacgccgccgccagaca

SEQ ID NO: 556213 - DNA, 25 bp, Rattus norvegicus
acgggtcctggaggaatcacgccgc

SEQ ID NO: 556214 - DNA, 25 bp, Rattus norvegicus
cgcggcacaccggacccacagcgcc

SEQ ID NO: 556215 - DNA, 25 bp, Rattus norvegicus
aagaaagagcgcctccgcggcacac

SEQ ID NO: 556216 - DNA, 25 bp, Rattus norvegicus
ctctgtctcaaccaaggaggcaaag

SEQ ID NO: 556217 - DNA, 25 bp, Rattus norvegicus
cgaaagcctctgtctcaaccaagga

SEQ ID NO: 556218 - DNA, 25 bp, Rattus norvegicus
actcaagacagtccatgggcgccgc

SEQ ID NO: 556219 - DNA, 25 bp, Rattus norvegicus
tcaccctccagggactcaagacagt

SEQ ID NO: 556220 - DNA, 25 bp, Rattus norvegicus
cgccgacccaccgtgtgggcactgc

SEQ ID NO: 556221 - DNA, 25 bp, Rattus norvegicus
agccgacaaagctgggcgcacacgc

SEQ ID NO: 556222 - DNA, 25 bp, Rattus norvegicus
gcatccagcccaagcctcgccattg

SEQ ID NO: 556223 - DNA, 25 bp, Rattus norvegicus
tcgccattggcgagagccgacaaag

SEQ ID NO: 556224 - DNA, 25 bp, Rattus norvegicus
ccattggcgagagccgacaaagctg

SEQ ID NO: 556225 - DNA, 25 bp, Rattus norvegicus
agcgacacgaggcagcagcggctcc

SEQ ID NO: 556226 - DNA, 25 bp, Rattus norvegicus
actggggcccgagcatcacgccgaa

SEQ ID NO: 556227 - DNA, 25 bp, Rattus norvegicus
tcgggcattcagagccgccgggctc

SEQ ID NO: 556228 - DNA, 25 bp, Rattus norvegicus
aggcctccgccatgatgtcccgggg

SEQ ID NO: 556229 - DNA, 25 bp, Rattus norvegicus
cgcacctgagactgcgttgcgggtc

SEQ ID NO: 556230 - DNA, 25 bp, Rattus norvegicus
gagatcgaccggtcctcggacacca

SEQ ID NO: 556231 - DNA, 25 bp, Rattus norvegicus
acaagctcgcggagatcgaccggtc

SEQ ID NO: 556232 - DNA, 25 bp, Rattus norvegicus
ggtccagctcggtggacaagctcgc

SEQ ID NO: 556233 - DNA, 25 bp, Rattus norvegicus
actgcgttgcgggtccggtccagct

SEQ ID NO: 556234 - DNA, 25 bp, Rattus norvegicus
gagcatcacgccgaaccgcggcgga

SEQ ID NO: 556235 - DNA, 25 bp, Rattus norvegicus
tccgccatgatgtcccggggcggct

SEQ ID NO: 556236 - DNA, 25 bp, Rattus norvegicus
gcgcgtacaccggtcgcacctgaga

SEQ ID NO: 556237 - DNA, 25 bp, Rattus norvegicus
accggtcgcacctgagactgcgttg

SEQ ID NO: 556238 - DNA, 25 bp, Rattus norvegicus
ggcccaagcgacacgaggcagcagc

SEQ ID NO: 556239 - DNA, 25 bp, Rattus norvegicus
gctgtaccaaggagtccatcatctg

SEQ ID NO: 556240 - DNA, 25 bp, Rattus norvegicus
ttgcagctgtaccaaggagtccatc

SEQ ID NO: 556241 - DNA, 25 bp, Rattus norvegicus
tcatcccgccgagcgcgcaggtgag

SEQ ID NO: 556242 - DNA, 25 bp, Rattus norvegicus
taggatcgtgcctggcgacatcagc

SEQ ID NO: 556243 - DNA, 25 bp, Rattus norvegicus
ctgagcgccgcgtgcctcatcccgc

SEQ ID NO: 556244 - DNA, 25 bp, Rattus norvegicus
cgccacttgcagctgtaccaaggag

SEQ ID NO: 556245 - DNA, 25 bp, Rattus norvegicus
taccaaggagtccatcatctgcgtg

SEQ ID NO: 556246 - DNA, 25 bp, Rattus norvegicus
tccatcatctgcgtgggctcctctt

SEQ ID NO: 556247 - DNA, 25 bp, Rattus norvegicus
catcatctgcgtgggctcctcttgg

SEQ ID NO: 556248 - DNA, 25 bp, Rattus norvegicus
tgcctaggatcgtgcctggcgacat

SEQ ID NO: 556249 - DNA, 25 bp, Rattus norvegicus
gcgacatcagctccctgtgagtggg

SEQ ID NO: 556250 - DNA, 25 bp, Rattus norvegicus
tggcgacatcagctccctgtgagtg

SEQ ID NO: 556251 - DNA, 25 bp, Rattus norvegicus
gtgcctggcgacatcagctccctgt

SEQ ID NO: 556252 - DNA, 25 bp, Rattus norvegicus
aggagtccatcatctgcgtgggctc

SEQ ID NO: 556253 - DNA, 25 bp, Rattus norvegicus
ctccgggtcggcctctggagcggct

SEQ ID NO: 556254 - DNA, 25 bp, Rattus norvegicus
atcccgcactttcaggcctgcgggg

SEQ ID NO: 556255 - DNA, 25 bp, Rattus norvegicus
aggtgcacggtccatcccgcacttt

SEQ ID NO: 556256 - DNA, 25 bp, Rattus norvegicus
agcggctgcagcgggttcccaagcc

SEQ ID NO: 556257 - DNA, 25 bp, Rattus norvegicus
gcgatcggaccgagagcgactggca

SEQ ID NO: 556258 - DNA, 25 bp, Rattus norvegicus
gacatggacggcgatcggaccgaga

SEQ ID NO: 556259 - DNA, 25 bp, Rattus norvegicus
cgcgcaagccggaggggacatggac

SEQ ID NO: 556260 - DNA, 25 bp, Rattus norvegicus
gtgcagcctgttcgcgcaagccgga

SEQ ID NO: 556261 - DNA, 25 bp, Rattus norvegicus
gtccgtgcagcctgttcgcgcaagc

SEQ ID NO: 556262 - DNA, 25 bp, Rattus norvegicus
aggcgtccgtgcagcctgttcgcgc

SEQ ID NO: 556263 - DNA, 25 bp, Rattus norvegicus
gcggcgacaagagccggaggaggag

SEQ ID NO: 556264 - DNA, 25 bp, Rattus norvegicus
aggtgccgggccctctctgggctgc

SEQ ID NO: 556265 - DNA, 25 bp, Rattus norvegicus
cccgagtcactgtagggcagtggtt

SEQ ID NO: 556266 - DNA, 25 bp, Rattus norvegicus
tggccgcagcaggacctgcaggtgc

SEQ ID NO: 556267 - DNA, 25 bp, Rattus norvegicus
ttcgatgcttccaaaggcggccatc

SEQ ID NO: 556268 - DNA, 25 bp, Rattus norvegicus
tggaggcatctatgcgcgcagcagc

SEQ ID NO: 556269 - DNA, 25 bp, Rattus norvegicus
ccctgggtgatgcttaagtggtctt

SEQ ID NO: 556270 - DNA, 25 bp, Rattus norvegicus
aagtggtcttgcactcgctctcccg

SEQ ID NO: 556271 - DNA, 25 bp, Rattus norvegicus
cttcttgcgctcctttgtctggctc

SEQ ID NO: 556272 - DNA, 25 bp, Rattus norvegicus
cgagttgctggtgcctaccacgcag

SEQ ID NO: 556273 - DNA, 25 bp, Rattus norvegicus
ctggtgcctaccacgcagcaggcga

SEQ ID NO: 556274 - DNA, 25 bp, Rattus norvegicus
agccggcgacctgcgttgccgttct

SEQ ID NO: 556275 - DNA, 25 bp, Rattus norvegicus
cggtggactcgcagccctggctcag

SEQ ID NO: 556276 - DNA, 25 bp, Rattus norvegicus
tgccgttctgcacgctggcctggtt

SEQ ID NO: 556277 - DNA, 25 bp, Rattus norvegicus
ggccaggcccattcgatgcttccaa

SEQ ID NO: 556278 - DNA, 25 bp, Rattus norvegicus
cgcgcaccacgaagttgccgaagtc

SEQ ID NO: 556279 - DNA, 25 bp, Rattus norvegicus
tgcggcacacccagcgggttgtagt

SEQ ID NO: 556280 - DNA, 25 bp, Rattus norvegicus
tggcctggttgccacctttacccag

SEQ ID NO: 556281 - DNA, 25 bp, Rattus norvegicus
ttgtcgctgcacaaggctgaatgcc

SEQ ID NO: 556282 - DNA, 25 bp, Rattus norvegicus
tgtcgagtttccacaggttcccatc

SEQ ID NO: 556283 - DNA, 25 bp, Rattus norvegicus
tgggaaccgtacctctgcgcaactt

SEQ ID NO: 556284 - DNA, 25 bp, Rattus norvegicus
caacttggagatgcgcccaagcgta

SEQ ID NO: 556285 - DNA, 25 bp, Rattus norvegicus
agcgtaagaagccttgtgagtgcaa

SEQ ID NO: 556286 - DNA, 25 bp, Rattus norvegicus
acccaggccctgtgtgtcaaagatg

SEQ ID NO: 556287 - DNA, 25 bp, Rattus norvegicus
ggcaactcaacagccgagggacttt

SEQ ID NO: 556288 - DNA, 25 bp, Rattus norvegicus
cggacgtcttcttgtcgctgcacaa

SEQ ID NO: 556289 - DNA, 25 bp, Rattus norvegicus
gctgaatgccaaagcgcctgaaccc

SEQ ID NO: 556290 - DNA, 25 bp, Rattus norvegicus
tgacgccagccctcgcgtggtacaa

SEQ ID NO: 556291 - DNA, 25 bp, Rattus norvegicus
ggcgggatcccaccactactcggtg

SEQ ID NO: 556292 - DNA, 25 bp, Rattus norvegicus
tttccagtgtaaggcggacgtcttc

SEQ ID NO: 556293 - DNA, 25 bp, Rattus norvegicus
ctccatggtccggtgtaggacgctg

SEQ ID NO: 556294 - DNA, 25 bp, Rattus norvegicus
ttccgagtctccagcactccgggtg

SEQ ID NO: 556295 - DNA, 25 bp, Rattus norvegicus
gtccttcgcaatcgctcagagcggc

SEQ ID NO: 556296 - DNA, 25 bp, Rattus norvegicus
tcagagcggctcacagctaggagga

SEQ ID NO: 556297 - DNA, 25 bp, Rattus norvegicus
ggggcgcagagccattcagccaatg

SEQ ID NO: 556298 - DNA, 25 bp, Rattus norvegicus
tcagccaatggcacatcgggcggga

SEQ ID NO: 556299 - DNA, 25 bp, Rattus norvegicus
tgccctcgtcgtggccgccatttta

SEQ ID NO: 556300 - DNA, 25 bp, Rattus norvegicus
cgccattttagctcctggttcgggc

SEQ ID NO: 556301 - DNA, 25 bp, Rattus norvegicus
tccctgcgagttgagcagcgggcct

SEQ ID NO: 556302 - DNA, 25 bp, Rattus norvegicus
gcctcttctgtgtggatccggctgc

SEQ ID NO: 556303 - DNA, 25 bp, Rattus norvegicus
atccggctgctggagtctctcttct

SEQ ID NO: 556304 - DNA, 25 bp, Rattus norvegicus
cttcctaagcgtccgctctgggagt

SEQ ID NO: 556305 - DNA, 25 bp, Rattus norvegicus
tctgggagtgcgaagatgtccaaga

SEQ ID NO: 556306 - DNA, 25 bp, Rattus norvegicus
tccaagaggcatcggttggacctgg

SEQ ID NO: 556307 - DNA, 25 bp, Rattus norvegicus
gcaggcccggcagccgagtctttgt

SEQ ID NO: 556308 - DNA, 25 bp, Rattus norvegicus
gagtctttgtctgccatcggccggc

SEQ ID NO: 556309 - DNA, 25 bp, Rattus norvegicus
agagaggaggctctactcctcccga

SEQ ID NO: 556310 - DNA, 25 bp, Rattus norvegicus
ctgcaatctcaagtagatgcgtccc

SEQ ID NO: 556311 - DNA, 25 bp, Rattus norvegicus
ctttccctaaaatggctgcaatctc

SEQ ID NO: 556312 - DNA, 25 bp, Rattus norvegicus
cggagccacctctttccctaaaatg

SEQ ID NO: 556313 - DNA, 25 bp, Rattus norvegicus
ccgaggctgcctagctgtgagaccc

SEQ ID NO: 556314 - DNA, 25 bp, Rattus norvegicus
caaaagcagggaactcgagcgcaac

SEQ ID NO: 556315 - DNA, 25 bp, Rattus norvegicus
ccggacaactccaggcaaaagcagg

SEQ ID NO: 556316 - DNA, 25 bp, Rattus norvegicus
cagcccagagggtacccgagaaaga

SEQ ID NO: 556317 - DNA, 25 bp, Rattus norvegicus
gctcatttggctatagacacctatc

SEQ ID NO: 556318 - DNA, 25 bp, Rattus norvegicus
tcgcgtccctccagtgctcatttgg

SEQ ID NO: 556319 - DNA, 25 bp, Rattus norvegicus
catacatagcgccagctccagaggc

SEQ ID NO: 556320 - DNA, 25 bp, Rattus norvegicus
gccaaccggcgacagaggtgttccc

SEQ ID NO: 556321 - DNA, 25 bp, Rattus norvegicus
actgtctgggtcagcgccaaccggc

SEQ ID NO: 556322 - DNA, 25 bp, Rattus norvegicus
tcacttggcaccaggcgggtagaca

SEQ ID NO: 556323 - DNA, 25 bp, Rattus norvegicus
tggggcttggcaaactccagtctcc

SEQ ID NO: 556324 - DNA, 25 bp, Rattus norvegicus
gtctcccaggcacaaatagctaaag

SEQ ID NO: 556325 - DNA, 25 bp, Rattus norvegicus
tagtggccaggtgacgacttcgcct

SEQ ID NO: 556326 - DNA, 25 bp, Rattus norvegicus
aggccgccggagtgaataattcaga

SEQ ID NO: 556327 - DNA, 25 bp, Rattus norvegicus
accgctcgggagatccaaaaggctc

SEQ ID NO: 556328 - DNA, 25 bp, Rattus norvegicus
gctataagatcctgccagccggccg

SEQ ID NO: 556329 - DNA, 25 bp, Rattus norvegicus
cgcgctcctgtgagctcgcgtaaag

SEQ ID NO: 556330 - DNA, 25 bp, Rattus norvegicus
ccagctcgcctttgaggaccgaggc

SEQ ID NO: 556331 - DNA, 25 bp, Rattus norvegicus
tagtatttgccgaaagccacggacc

SEQ ID NO: 556332 - DNA, 25 bp, Rattus norvegicus
tgtggctgtcgatgagtcagaaacc

SEQ ID NO: 556333 - DNA, 25 bp, Rattus norvegicus
cgaagccctaaagccaaagaacaga

SEQ ID NO: 556334 - DNA, 25 bp, Rattus norvegicus
tcaatcgcccaggagcggggctata

SEQ ID NO: 556335 - DNA, 25 bp, Rattus norvegicus
ctgtccgcggcagctagtatttgcc

SEQ ID NO: 556336 - DNA, 25 bp, Rattus norvegicus
cggctgcgatctgaaacttgcggga

SEQ ID NO: 556337 - DNA, 25 bp, Rattus norvegicus
tcgctccgctagctgtgaactggga

SEQ ID NO: 556338 - DNA, 25 bp, Rattus norvegicus
cgaggctttaggtgttcgtgcaaac

SEQ ID NO: 556339 - DNA, 25 bp, Rattus norvegicus
ttcccgtacccgacaggagtgcaga

SEQ ID NO: 556340 - DNA, 25 bp, Rattus norvegicus
gttgggctgattgggacatttgtcc

SEQ ID NO: 556341 - DNA, 25 bp, Rattus norvegicus
gaatccgcttgcagagttgggctga

SEQ ID NO: 556342 - DNA, 25 bp, Rattus norvegicus
tccaggccactttcgctgcgcgatt

SEQ ID NO: 556343 - DNA, 25 bp, Rattus norvegicus
ctcatggatgttgctagaggaatcc

SEQ ID NO: 556344 - DNA, 25 bp, Rattus norvegicus
tgtgaacttggttgggacaaacttg

SEQ ID NO: 556345 - DNA, 25 bp, Rattus norvegicus
ctcccgctgatggtagaggctccct

SEQ ID NO: 556346 - DNA, 25 bp, Rattus norvegicus
gcgctggaccctgatggatagcaga

SEQ ID NO: 556347 - DNA, 25 bp, Rattus norvegicus
gctcccggcaggaggtgaaagtccc

SEQ ID NO: 556348 - DNA, 25 bp, Rattus norvegicus
tcctccctggcagtgagagacagtg

SEQ ID NO: 556349 - DNA, 25 bp, Rattus norvegicus
gactcgcttcggctagtaactcctc

SEQ ID NO: 556350 - DNA, 25 bp, Rattus norvegicus
tcggggagtcagtcctgaaaacgca

SEQ ID NO: 556351 - DNA, 25 bp, Rattus norvegicus
gcatgtcgttgcgaagcaggaccga

SEQ ID NO: 556352 - DNA, 25 bp, Rattus norvegicus
ttttgctccactctggccgccgagt

SEQ ID NO: 556353 - DNA, 25 bp, Rattus norvegicus
gccgcggacaaaggagcatgtcgtt

SEQ ID NO: 556354 - DNA, 25 bp, Rattus norvegicus
gaagcaggaccgatcctcgggccgc

SEQ ID NO: 556355 - DNA, 25 bp, Rattus norvegicus
gacacgctgcccaaccgcacggtca

SEQ ID NO: 556356 - DNA, 25 bp, Rattus norvegicus
gcacggtcaccctgtgagtaaccca

SEQ ID NO: 556357 - DNA, 25 bp, Rattus norvegicus
tgagtaacccaagacgcctcgctgc

SEQ ID NO: 556358 - DNA, 25 bp, Rattus norvegicus
ctcgctcccgggtgcaccgaatggg

SEQ ID NO: 556359 - DNA, 25 bp, Rattus norvegicus
tctccggggtatacacgcttctttg

SEQ ID NO: 556360 - DNA, 25 bp, Rattus norvegicus
atacacgcttctttgtgtgcgcgcg

SEQ ID NO: 556361 - DNA, 25 bp, Rattus norvegicus
aagccctgcggcttcgtgtgggacc

SEQ ID NO: 556362 - DNA, 25 bp, Rattus norvegicus
tctgctcctcctctgctagtttgca

SEQ ID NO: 556363 - DNA, 25 bp, Rattus norvegicus
cctctgctagtttgcaaagaaaagt

SEQ ID NO: 556364 - DNA, 25 bp, Rattus norvegicus
ggcgcgtcccatcccatccctgctt

SEQ ID NO: 556365 - DNA, 25 bp, Rattus norvegicus
gccgccatcataaaaaccgaagtaa

SEQ ID NO: 556366 - DNA, 25 bp, Rattus norvegicus
agcagtgaaggacattcgaggagtc

SEQ ID NO: 556367 - DNA, 25 bp, Rattus norvegicus
gccaggcagcagtgaaggacattcg

SEQ ID NO: 556368 - DNA, 25 bp, Rattus norvegicus
ggctcacctaagagccggccaggca

SEQ ID NO: 556369 - DNA, 25 bp, Rattus norvegicus
gcagcgggcagagcggctcacctaa

SEQ ID NO: 556370 - DNA, 25 bp, Rattus norvegicus
cctgcgagagtatgcctatgatgtc

SEQ ID NO: 556371 - DNA, 25 bp, Rattus norvegicus
gcagactcacggtcctgcgagagta

SEQ ID NO: 556372 - DNA, 25 bp, Rattus norvegicus
cgaagtaaaggacaccgggccagca

SEQ ID NO: 556373 - DNA, 25 bp, Rattus norvegicus
gagcaaacatgcatccaagccgcca

SEQ ID NO: 556374 - DNA, 25 bp, Rattus norvegicus
gacgtgcagtttcgagcaaacatgc

SEQ ID NO: 556375 - DNA, 25 bp, Rattus norvegicus
ggctcctttagacgtgcagtttcga

SEQ ID NO: 556376 - DNA, 25 bp, Rattus norvegicus
aatgcatgtggctcctttagacgtg

SEQ ID NO: 556377 - DNA, 25 bp, Rattus norvegicus
cgatattaaaatgcatgtggctcct

SEQ ID NO: 556378 - DNA, 25 bp, Rattus norvegicus
gaacactcgatggataacgatatta

SEQ ID NO: 556379 - DNA, 25 bp, Rattus norvegicus
aacgtgagaagggtggaaagcatct

SEQ ID NO: 556380 - DNA, 25 bp, Rattus norvegicus
gcgcctcgctctgtctggcggtaca

SEQ ID NO: 556381 - DNA, 25 bp, Rattus norvegicus
tctggcggtacagcgctccgggctt

SEQ ID NO: 556382 - DNA, 25 bp, Rattus norvegicus
cgtagctctgctacccagcgtggca

SEQ ID NO: 556383 - DNA, 25 bp, Rattus norvegicus
cagcgccttggtcgcccaggacaga

SEQ ID NO: 556384 - DNA, 25 bp, Rattus norvegicus
ccctgggtcagtggactctaagagt

SEQ ID NO: 556385 - DNA, 25 bp, Rattus norvegicus
ggactctaagagtgtcgctccagca

SEQ ID NO: 556386 - DNA, 25 bp, Rattus norvegicus
taagagtgtcgctccagcatctatc

SEQ ID NO: 556387 - DNA, 25 bp, Rattus norvegicus
atccctaaagatgaacgtgagaagg

SEQ ID NO: 556388 - DNA, 25 bp, Rattus norvegicus
aaagcatctcggctcagctggagga

SEQ ID NO: 556389 - DNA, 25 bp, Rattus norvegicus
agctccacaggcggtaggatgcgac

SEQ ID NO: 556390 - DNA, 25 bp, Rattus norvegicus
ggcaccgtccttccctggctgtgat

SEQ ID NO: 556391 - DNA, 25 bp, Rattus norvegicus
tccttccctggctgtgatccggtgc

SEQ ID NO: 556392 - DNA, 25 bp, Rattus norvegicus
gctccagcatctatcatccctaaag

SEQ ID NO: 556393 - DNA, 25 bp, Rattus norvegicus
gtcactcggactctctgcaccaaag

SEQ ID NO: 556394 - DNA, 25 bp, Rattus norvegicus
agtgacgtcacacgcgcgccgctag

SEQ ID NO: 556395 - DNA, 25 bp, Rattus norvegicus
atccggcgccgtgcagtgacgtcac

SEQ ID NO: 556396 - DNA, 25 bp, Rattus norvegicus
tagcatagacatccggcgccgtgca

SEQ ID NO: 556397 - DNA, 25 bp, Rattus norvegicus
gccaagttcaagtagcatagacatc

SEQ ID NO: 556398 - DNA, 25 bp, Rattus norvegicus
cctccggcagcggtgattccagaag

SEQ ID NO: 556399 - DNA, 25 bp, Rattus norvegicus
gcgtccgctcctaccgcctctccag

SEQ ID NO: 556400 - DNA, 25 bp, Rattus norvegicus
cgacatgggagagccctcacgccga

SEQ ID NO: 556401 - DNA, 25 bp, Rattus norvegicus
agcagccgacatgggagagccctca

SEQ ID NO: 556402 - DNA, 25 bp, Rattus norvegicus
gctctagccacgagcagccgacatg

SEQ ID NO: 556403 - DNA, 25 bp, Rattus norvegicus
tagcaacaagctcctccggctctag

SEQ ID NO: 556404 - DNA, 25 bp, Rattus norvegicus
gctccaggaccttagcaacaagctc

SEQ ID NO: 556405 - DNA, 25 bp, Rattus norvegicus
ggagctcccgtgctccaggacctta

SEQ ID NO: 556406 - DNA, 25 bp, Rattus norvegicus
gcggtgattccagaagccaagttca

SEQ ID NO: 556407 - DNA, 25 bp, Rattus norvegicus
ccgggtctgcgtttatttcttcatt

SEQ ID NO: 556408 - DNA, 25 bp, Rattus norvegicus
tttcttcattaaagactcgcgcaga

SEQ ID NO: 556409 - DNA, 25 bp, Rattus norvegicus
atcgcccacactacactagcccaag

SEQ ID NO: 556410 - DNA, 25 bp, Rattus norvegicus
actagcccaagccatccgcgcctgc

SEQ ID NO: 556411 - DNA, 25 bp, Rattus norvegicus
cggcccatgcgcaaccgggagagcc

SEQ ID NO: 556412 - DNA, 25 bp, Rattus norvegicus
cgtgtcgtagggctcggcttcacaa

SEQ ID NO: 556413 - DNA, 25 bp, Rattus norvegicus
cgtagggctcggcttcacaaagaga

SEQ ID NO: 556414 - DNA, 25 bp, Rattus norvegicus
ggctcggcttcacaaagagagtagc

SEQ ID NO: 556415 - DNA, 25 bp, Rattus norvegicus
ttcacaaagagagtagcctccgcgc

SEQ ID NO: 556416 - DNA, 25 bp, Rattus norvegicus
agagagtagcctccgcgcttcgctt

SEQ ID NO: 556417 - DNA, 25 bp, Rattus norvegicus
cgcttcgcttccctaactcgggaag

SEQ ID NO: 556418 - DNA, 25 bp, Rattus norvegicus
tcgcttccctaactcgggaagtgcc

SEQ ID NO: 556419 - DNA, 25 bp, Rattus norvegicus
ccaccaggagcatgggggccgtcat

SEQ ID NO: 556420 - DNA, 25 bp, Rattus norvegicus
tcattaaagactcgcgcagacaggg

SEQ ID NO: 556421 - DNA, 25 bp, Rattus norvegicus
caccgggtattcaggcagccttggg

SEQ ID NO: 556422 - DNA, 25 bp, Rattus norvegicus
gggctcagctcacggggtctctcca

SEQ ID NO: 556423 - DNA, 25 bp, Rattus norvegicus
ggcgcaccgggtattcaggcagcct

SEQ ID NO: 556424 - DNA, 25 bp, Rattus norvegicus
tgcacttcactggaggatatcttgg

SEQ ID NO: 556425 - DNA, 25 bp, Rattus norvegicus
aggatatcttggcaatcccgcctcc

SEQ ID NO: 556426 - DNA, 25 bp, Rattus norvegicus
aagccgtcttctctgcttcgcgaca

SEQ ID NO: 556427 - DNA, 25 bp, Rattus norvegicus
tcactggaggatatcttggcaatcc

SEQ ID NO: 556428 - DNA, 25 bp, Rattus norvegicus
gtctctccactcctgcggcacagca

SEQ ID NO: 556429 - DNA, 25 bp, Rattus norvegicus
gtcttctctgcttcgcgacagccaa

SEQ ID NO: 556430 - DNA, 25 bp, Rattus norvegicus
ctctgcttcgcgacagccaaggatg

SEQ ID NO: 556431 - DNA, 25 bp, Rattus norvegicus
cttcgcgacagccaaggatggtttg

SEQ ID NO: 556432 - DNA, 25 bp, Rattus norvegicus
agccaaggatggtttgcacacacac

SEQ ID NO: 556433 - DNA, 25 bp, Rattus norvegicus
cacacatgcacttcactggaggata

SEQ ID NO: 556434 - DNA, 25 bp, Rattus norvegicus
cgacagccaaggatggtttgcacac

SEQ ID NO: 556435 - DNA, 25 bp, Rattus norvegicus
agaagactcgggatccgccaaccgc

SEQ ID NO: 556436 - DNA, 25 bp, Rattus norvegicus
gcatttccggtttttgggaagtgca

SEQ ID NO: 556437 - DNA, 25 bp, Rattus norvegicus
tttgggaagtgcaccgtccgatgca

SEQ ID NO: 556438 - DNA, 25 bp, Rattus norvegicus
gatgcacccgcgtctgcacgctaca

SEQ ID NO: 556439 - DNA, 25 bp, Rattus norvegicus
cctaagtgaccggaggccaggttgc

SEQ ID NO: 556440 - DNA, 25 bp, Rattus norvegicus
tgcggcctcagaagactcgggatcc

SEQ ID NO: 556441 - DNA, 25 bp, Rattus norvegicus
aagacagccgcatttccggtttttg

SEQ ID NO: 556442 - DNA, 25 bp, Rattus norvegicus
gcccgttccggatcatggcaccaga

SEQ ID NO: 556443 - DNA, 25 bp, Rattus norvegicus
gttccggatcatggcaccagaggcc

SEQ ID NO: 556444 - DNA, 25 bp, Rattus norvegicus
ggcagctcccgcgacacacagcacc

SEQ ID NO: 556445 - DNA, 25 bp, Rattus norvegicus
cttgcgcgtgctcacgcgggtctca

SEQ ID NO: 556446 - DNA, 25 bp, Rattus norvegicus
ccgctaggcgcagccaattgcgtgc

SEQ ID NO: 556447 - DNA, 25 bp, Rattus norvegicus
agccaattgcgtgcaccacccgggg

SEQ ID NO: 556448 - DNA, 25 bp, Rattus norvegicus
caggttgcctcgtgcggcctcagaa

SEQ ID NO: 556449 - DNA, 25 bp, Rattus norvegicus
cccaggcaagtgtctaaacaatagg

SEQ ID NO: 556450 - DNA, 25 bp, Rattus norvegicus
acagtctaggcagcgctcggcttcc

SEQ ID NO: 556451 - DNA, 25 bp, Rattus norvegicus
actcggcgaccacagtctaggcagc

SEQ ID NO: 556452 - DNA, 25 bp, Rattus norvegicus
ttgcacctgactcggcgaccacagt

SEQ ID NO: 556453 - DNA, 25 bp, Rattus norvegicus
ccggacgttgcacctgactcggcga

SEQ ID NO: 556454 - DNA, 25 bp, Rattus norvegicus
cagacgttgagaagccgcttggccc

SEQ ID NO: 556455 - DNA, 25 bp, Rattus norvegicus
tccagccgcagacgttgagaagccg

SEQ ID NO: 556456 - DNA, 25 bp, Rattus norvegicus
gtctaaacaataggacggactccgc

SEQ ID NO: 556457 - DNA, 25 bp, Rattus norvegicus
ccgcagtcgcggctcccgggaagaa

SEQ ID NO: 556458 - DNA, 25 bp, Rattus norvegicus
aactggagttgtccgctctggctgc

SEQ ID NO: 556459 - DNA, 25 bp, Rattus norvegicus
ggaggctttccgcagtcgcggctcc

SEQ ID NO: 556460 - DNA, 25 bp, Rattus norvegicus
ataggacggactccgcagcccaagt

SEQ ID NO: 556461 - DNA, 25 bp, Rattus norvegicus
ggttgttgttgtaactggagttgtc

SEQ ID NO: 556462 - DNA, 25 bp, Rattus norvegicus
ggagtccagccgcagacgttgagaa

SEQ ID NO: 556463 - DNA, 25 bp, Rattus norvegicus
gcctgcgccgctcgtatgtaaatga

SEQ ID NO: 556464 - DNA, 25 bp, Rattus norvegicus
tcgtatgtaaatgagggcgcgtgac

SEQ ID NO: 556465 - DNA, 25 bp, Rattus norvegicus
caagggaatagagagaatggccgct

SEQ ID NO: 556466 - DNA, 25 bp, Rattus norvegicus
gcgggaactcgactcttggcgccac

SEQ ID NO: 556467 - DNA, 25 bp, Rattus norvegicus
ggagctccggttcgggtcagttcaa

SEQ ID NO: 556468 - DNA, 25 bp, Rattus norvegicus
cagaaggaaggtagtgacacgtgtc

SEQ ID NO: 556469 - DNA, 25 bp, Rattus norvegicus
ctcaacgcgagtggactacaaagcc

SEQ ID NO: 556470 - DNA, 25 bp, Rattus norvegicus
agactgcacagcgtcgctctcttca

SEQ ID NO: 556471 - DNA, 25 bp, Rattus norvegicus
tgaagtctgtggacttccagagccc

SEQ ID NO: 556472 - DNA, 25 bp, Rattus norvegicus
aagagaggcgttgctagtccgctcc

SEQ ID NO: 556473 - DNA, 25 bp, Rattus norvegicus
agtccgctccttcagcacgcgggtt

SEQ ID NO: 556474 - DNA, 25 bp, Rattus norvegicus
gtatggcttgcctgagtaaactccg

SEQ ID NO: 556475 - DNA, 25 bp, Rattus norvegicus
aggttgcttccttctcttcgcgctc

SEQ ID NO: 556476 - DNA, 25 bp, Rattus norvegicus
caccgcctcatgcactgtgtaggta

SEQ ID NO: 556477 - DNA, 25 bp, Rattus norvegicus
ccggtcgcgcaaaggcaaaaagttg

SEQ ID NO: 556478 - DNA, 25 bp, Rattus norvegicus
ctgtagctcccggtccgcaaaggac

SEQ ID NO: 556479 - DNA, 25 bp, Rattus norvegicus
cttagtttctacagactggccagcg

SEQ ID NO: 556480 - DNA, 25 bp, Rattus norvegicus
gcagacgccaggagttccgatcact

SEQ ID NO: 556481 - DNA, 25 bp, Rattus norvegicus
tgtagttaccgccagagttttcaaa

SEQ ID NO: 556482 - DNA, 25 bp, Rattus norvegicus
caactctcgcgggaggacgaatctc

SEQ ID NO: 556483 - DNA, 25 bp, Rattus norvegicus
gctgcgccagctgaaaagcctcctt

SEQ ID NO: 556484 - DNA, 25 bp, Rattus norvegicus
gcaaaaagttgagctcgggagccga

SEQ ID NO: 556485 - DNA, 25 bp, Rattus norvegicus
aagccgcttcttctgcgctgccatg

SEQ ID NO: 556486 - DNA, 25 bp, Rattus norvegicus
aacacctcgggcaaacctcagagca

SEQ ID NO: 556487 - DNA, 25 bp, Rattus norvegicus
gttccgatcactgtctaagaccaga

SEQ ID NO: 556488 - DNA, 25 bp, Rattus norvegicus
aactgcctgagagtggctgtagctc

SEQ ID NO: 556489 - DNA, 25 bp, Rattus norvegicus
ccatggcgccggatgagaactgcct

SEQ ID NO: 556490 - DNA, 25 bp, Rattus norvegicus
gcgcgactaccagcttcgcctggtt

SEQ ID NO: 556491 - DNA, 25 bp, Rattus norvegicus
ggcatcagccctcaacagcaaaatt

SEQ ID NO: 556492 - DNA, 25 bp, Rattus norvegicus
aatcgctcagctcaccaaggtaagg

SEQ ID NO: 556493 - DNA, 25 bp, Rattus norvegicus
gctggagaatggactgcgatcctga

SEQ ID NO: 556494 - DNA, 25 bp, Rattus norvegicus
cagggctgcttaaagcgatggcatc

SEQ ID NO: 556495 - DNA, 25 bp, Rattus norvegicus
tcagagcatttcagtgcagggctgc

SEQ ID NO: 556496 - DNA, 25 bp, Rattus norvegicus
cagtgagaacgggagtcagagcatt

SEQ ID NO: 556497 - DNA, 25 bp, Rattus norvegicus
cgcacgtgcacacagccagcagtga

SEQ ID NO: 556498 - DNA, 25 bp, Rattus norvegicus
ggactgcagtgccacctctctggag

SEQ ID NO: 556499 - DNA, 25 bp, Rattus norvegicus
agacacctccggaaagagagccacg

SEQ ID NO: 556500 - DNA, 25 bp, Rattus norvegicus
ccgcgaacgagcacgagcagaggaa

SEQ ID NO: 556501 - DNA, 25 bp, Rattus norvegicus
cgtgagccagctagcccgcgaacga

SEQ ID NO: 556502 - DNA, 25 bp, Rattus norvegicus
taaacctcacgtgcaaggcgccagc

SEQ ID NO: 556503 - DNA, 25 bp, Rattus norvegicus
ctctcggaagcatccgcagatggta

SEQ ID NO: 556504 - DNA, 25 bp, Rattus norvegicus
cgatcctgagatgcacgtgaaaatg

SEQ ID NO: 556505 - DNA, 25 bp, Rattus norvegicus
ctgtcagaaactcacggttcacgga

SEQ ID NO: 556506 - DNA, 25 bp, Rattus norvegicus
tctgcccgacttgagccaaccgagg

SEQ ID NO: 556507 - DNA, 25 bp, Rattus norvegicus
cgccaaacgcgcaggcgcgattctt

SEQ ID NO: 556508 - DNA, 25 bp, Rattus norvegicus
ttcccgcgctgctttgaattgctca

SEQ ID NO: 556509 - DNA, 25 bp, Rattus norvegicus
tctaagtcgcgatcaggaactcgtc

SEQ ID NO: 556510 - DNA, 25 bp, Rattus norvegicus
gtccacggctgtgggacaaactgtc

SEQ ID NO: 556511 - DNA, 25 bp, Rattus norvegicus
gatgctcgtagggagacaccatcta

SEQ ID NO: 556512 - DNA, 25 bp, Rattus norvegicus
agcacagtgcgcaggcccaactctt

SEQ ID NO: 556513 - DNA, 25 bp, Rattus norvegicus
cgccagcgccaacgggaagcacagt

SEQ ID NO: 556514 - DNA, 25 bp, Rattus norvegicus
gggagaccgtagcagtagctcagta

SEQ ID NO: 556515 - DNA, 25 bp, Rattus norvegicus
tgctaagctagggagcccagggtta

SEQ ID NO: 556516 - DNA, 25 bp, Rattus norvegicus
gctcagtagtcctctgctaagctag

SEQ ID NO: 556517 - DNA, 25 bp, Rattus norvegicus
tgaattgctcatgcgcactccgaag

SEQ ID NO: 556518 - DNA, 25 bp, Rattus norvegicus
gaaagcgtcggagagagctcgccct

SEQ ID NO: 556519 - DNA, 25 bp, Rattus norvegicus
ctcggcttacctcgaatgatgattc

SEQ ID NO: 556520 - DNA, 25 bp, Rattus norvegicus
tgattccaactcgtccaccaaagtg

SEQ ID NO: 556521 - DNA, 25 bp, Rattus norvegicus
ctgcttgtagaagcgacgcctggcc

SEQ ID NO: 556522 - DNA, 25 bp, Rattus norvegicus
ggcttcaaggccacggtctccagaa

SEQ ID NO: 556523 - DNA, 25 bp, Rattus norvegicus
agggacgccgccatgtctgtaatgg

SEQ ID NO: 556524 - DNA, 25 bp, Rattus norvegicus
tgacaggcggttggtttgtacccta

SEQ ID NO: 556525 - DNA, 25 bp, Rattus norvegicus
ttgtaccctaacgatcagagttacc

SEQ ID NO: 556526 - DNA, 25 bp, Rattus norvegicus
caccaaagtgctgttagatggtctc

SEQ ID NO: 556527 - DNA, 25 bp, Rattus norvegicus
tcagagttaccagaatccgtgtttc

SEQ ID NO: 556528 - DNA, 25 bp, Rattus norvegicus
cttccgcacgagtgagggctcacaa

SEQ ID NO: 556529 - DNA, 25 bp, Rattus norvegicus
aggaattaacctgcgagccttccgc

SEQ ID NO: 556530 - DNA, 25 bp, Rattus norvegicus
cacatcaactaagcgccgggaccga

SEQ ID NO: 556531 - DNA, 25 bp, Rattus norvegicus
ctaggcgacttccattcttcggtcc

SEQ ID NO: 556532 - DNA, 25 bp, Rattus norvegicus
tctccagaaatgtcgcgcggttgca

SEQ ID NO: 556533 - DNA, 25 bp, Rattus norvegicus
gagcgtttctgctcagccttcagaa

SEQ ID NO: 556534 - DNA, 25 bp, Rattus norvegicus
aagtacatcttctcggctcggccca

SEQ ID NO: 556535 - DNA, 25 bp, Rattus norvegicus
accttcgtcatgtctgcggtggaca

SEQ ID NO: 556536 - DNA, 25 bp, Rattus norvegicus
agtcatcctgctgccagcggcctgg

SEQ ID NO: 556537 - DNA, 25 bp, Rattus norvegicus
tagatgcgttacgtcccacacgtcg

SEQ ID NO: 556538 - DNA, 25 bp, Rattus norvegicus
tcagctcatttttgcaactagatgc

SEQ ID NO: 556539 - DNA, 25 bp, Rattus norvegicus
ccaccgaacttttctgttcagctca

SEQ ID NO: 556540 - DNA, 25 bp, Rattus norvegicus
aaggactcgccctcaacaaacagcg

SEQ ID NO: 556541 - DNA, 25 bp, Rattus norvegicus
ttcagaacccagcactgtccagtta

SEQ ID NO: 556542 - DNA, 25 bp, Rattus norvegicus
taaagactggttccgtggagtgagc

SEQ ID NO: 556543 - DNA, 25 bp, Rattus norvegicus
tctgcgaggactaaaagaattgacg

SEQ ID NO: 556544 - DNA, 25 bp, Rattus norvegicus
gccgtcctttctagggtttctgcga

SEQ ID NO: 556545 - DNA, 25 bp, Rattus norvegicus
gccctccagagagcacgtggcgcat

SEQ ID NO: 556546 - DNA, 25 bp, Rattus norvegicus
tccagttaggaagaaaggactcgcc

SEQ ID NO: 556547 - DNA, 25 bp, Rattus norvegicus
tgtcggccatgtgcacccatgacta

SEQ ID NO: 556548 - DNA, 25 bp, Rattus norvegicus
ggcgctggggaaaagctctcattgc

SEQ ID NO: 556549 - DNA, 25 bp, Rattus norvegicus
ccctaggtggggttcaagacactgt

SEQ ID NO: 556550 - DNA, 25 bp, Rattus norvegicus
cgtgctgcacgcctactgggtaaaa

SEQ ID NO: 556551 - DNA, 25 bp, Rattus norvegicus
ggcacagtttagagcacgcgcctaa

SEQ ID NO: 556552 - DNA, 25 bp, Rattus norvegicus
acgcgcctaagttgctacactttta

SEQ ID NO: 556553 - DNA, 25 bp, Rattus norvegicus
tacacttttattggctccagagcgg

SEQ ID NO: 556554 - DNA, 25 bp, Rattus norvegicus
tcagccgcttagcttgcacaagttc

SEQ ID NO: 556555 - DNA, 25 bp, Rattus norvegicus
ggggtcacgcacttcagctttcgcg

SEQ ID NO: 556556 - DNA, 25 bp, Rattus norvegicus
cgcgcttctattggccgaatcagga

SEQ ID NO: 556557 - DNA, 25 bp, Rattus norvegicus
cgtagctctgtgatggctccgactc

SEQ ID NO: 556558 - DNA, 25 bp, Rattus norvegicus
tgttctgggcaaccttcctgagttc

SEQ ID NO: 556559 - DNA, 25 bp, Rattus norvegicus
aactgggtaatattgcgagacggcc

SEQ ID NO: 556560 - DNA, 25 bp, Rattus norvegicus
tcctcactgggtatcggcgagcaag

SEQ ID NO: 556561 - DNA, 25 bp, Rattus norvegicus
cccgcggttaccagtgagggagtat

SEQ ID NO: 556562 - DNA, 25 bp, Rattus norvegicus
caggagagatgcagccaaggcagca

SEQ ID NO: 556563 - DNA, 25 bp, Rattus norvegicus
gtgatagcgaggacgccagcgtctt

SEQ ID NO: 556564 - DNA, 25 bp, Rattus norvegicus
gcgacacggcgacggcagaaagaaa

SEQ ID NO: 556565 - DNA, 25 bp, Rattus norvegicus
gccgtacggaaagccacgctgagcc

SEQ ID NO: 556566 - DNA, 25 bp, Rattus norvegicus
caccgcacgggcacaagaggctcag

SEQ ID NO: 556567 - DNA, 25 bp, Rattus norvegicus
ctgtccacggacagggaatgtgaca

SEQ ID NO: 556568 - DNA, 25 bp, Rattus norvegicus
cccgagctaggctttggacactgtc

SEQ ID NO: 556569 - DNA, 25 bp, Rattus norvegicus
atcacactgccggtcgggccgagtc

SEQ ID NO: 556570 - DNA, 25 bp, Rattus norvegicus
ttcccgaaaggcagcccaaaatgtc

SEQ ID NO: 556571 - DNA, 25 bp, Rattus norvegicus
gcggtcacatatccctattcccgaa

SEQ ID NO: 556572 - DNA, 25 bp, Rattus norvegicus
caagcagtgactaggtgacagaaac

SEQ ID NO: 556573 - DNA, 25 bp, Rattus norvegicus
gtgacagaaacaggccaccttggct

SEQ ID NO: 556574 - DNA, 25 bp, Rattus norvegicus
ggtcacagtcccacggcaagcagtg

SEQ ID NO: 556575 - DNA, 25 bp, Rattus norvegicus
tcagggtcacacatcaccgagactt

SEQ ID NO: 556576 - DNA, 25 bp, Rattus norvegicus
cctcgcagtcggttcttttgtgttc

SEQ ID NO: 556577 - DNA, 25 bp, Rattus norvegicus
tcaacccgcgctcaaaggggactcg

SEQ ID NO: 556578 - DNA, 25 bp, Rattus norvegicus
tgggtcggaggttccaatcctcaac

SEQ ID NO: 556579 - DNA, 25 bp, Rattus norvegicus
ccagagctttgtggctgctcgaaga

SEQ ID NO: 556580 - DNA, 25 bp, Rattus norvegicus
accgagactttcctggagatggaga

SEQ ID NO: 556581 - DNA, 25 bp, Rattus norvegicus
tggctccaatcagccctcagggtca

SEQ ID NO: 556582 - DNA, 25 bp, Rattus norvegicus
tctgctacctatgtgcagcacacgg

SEQ ID NO: 556583 - DNA, 25 bp, Rattus norvegicus
ctcttatgcggtaaggaaagctccg

SEQ ID NO: 556584 - DNA, 25 bp, Rattus norvegicus
gtgagactttcaggccaccgactcg

SEQ ID NO: 556585 - DNA, 25 bp, Rattus norvegicus
gggactctcggtcaccagccactat

SEQ ID NO: 556586 - DNA, 25 bp, Rattus norvegicus
gtccgggtttggagaactcttatgc

SEQ ID NO: 556587 - DNA, 25 bp, Rattus norvegicus
ggcgctcagggcataccttgataga

SEQ ID NO: 556588 - DNA, 25 bp, Rattus norvegicus
tcgggtgctccttccatcccgtgga

SEQ ID NO: 556589 - DNA, 25 bp, Rattus norvegicus
gcagctacaaagacgcatgcgcgcg

SEQ ID NO: 556590 - DNA, 25 bp, Rattus norvegicus
gcctcatccggcagctacaaagacg

SEQ ID NO: 556591 - DNA, 25 bp, Rattus norvegicus
tgccatcgctccctggactgcgctt

SEQ ID NO: 556592 - DNA, 25 bp, Rattus norvegicus
ggctcagaccgccaccggctgccat

SEQ ID NO: 556593 - DNA, 25 bp, Rattus norvegicus
tttgcgctccgagcggctcagaccg

SEQ ID NO: 556594 - DNA, 25 bp, Rattus norvegicus
ttacctgacggaggcgctcccgctg

SEQ ID NO: 556595 - DNA, 25 bp, Rattus norvegicus
cgggcatggcagtggcttacctgac

SEQ ID NO: 556596 - DNA, 25 bp, Rattus norvegicus
acctacggacgagcagtaggtgagc

SEQ ID NO: 556597 - DNA, 25 bp, Rattus norvegicus
gcgtgacacctacggacgagcagta

SEQ ID NO: 556598 - DNA, 25 bp, Rattus norvegicus
ccttcctcaggatgcgtgacaccta

SEQ ID NO: 556599 - DNA, 25 bp, Rattus norvegicus
tgcagccgccttcctcaggatgcgt

SEQ ID NO: 556600 - DNA, 25 bp, Rattus norvegicus
cactctcagctagaagccggccctc

SEQ ID NO: 556601 - DNA, 25 bp, Rattus norvegicus
gaagctcggtcaccagatcctcact

SEQ ID NO: 556602 - DNA, 25 bp, Rattus norvegicus
cgaccctgaagctcggtcaccagat

SEQ ID NO: 556603 - DNA, 25 bp, Rattus norvegicus
ccgcttctgcggttactagcagcca

SEQ ID NO: 556604 - DNA, 25 bp, Rattus norvegicus
cccgatgaagtggacgtcttcaccg

SEQ ID NO: 556605 - DNA, 25 bp, Rattus norvegicus
ccgcaggccgcttctgcggttacta

SEQ ID NO: 556606 - DNA, 25 bp, Rattus norvegicus
acgggcgctcgcgcgactgacctgt

SEQ ID NO: 556607 - DNA, 25 bp, Rattus norvegicus
ctactgcgacaaggtaaaggagcgc

SEQ ID NO: 556608 - DNA, 25 bp, Rattus norvegicus
tggggcgctactgcgacaaggtaaa

SEQ ID NO: 556609 - DNA, 25 bp, Rattus norvegicus
ttactagcagccagggcaccgctcg

SEQ ID NO: 556610 - DNA, 25 bp, Rattus norvegicus
aggcagtggcgatggcgcccttccc

SEQ ID NO: 556611 - DNA, 25 bp, Rattus norvegicus
ccgcgtcacggacccgctgagccac

SEQ ID NO: 556612 - DNA, 25 bp, Rattus norvegicus
gttgcaacaccgcatggcggcggcc

SEQ ID NO: 556613 - DNA, 25 bp, Rattus norvegicus
cacgtgggttgcaacaccgcatggc

SEQ ID NO: 556614 - DNA, 25 bp, Rattus norvegicus
ccggtcacgtgggttgcaacaccgc

SEQ ID NO: 556615 - DNA, 25 bp, Rattus norvegicus
cccacactggcggatgaagcagctg

SEQ ID NO: 556616 - DNA, 25 bp, Rattus norvegicus
gatgaagtggacgtcttcaccgccc

SEQ ID NO: 556617 - DNA, 25 bp, Rattus norvegicus
ctgttgaggtaaattcatggcgggc

SEQ ID NO: 556618 - DNA, 25 bp, Rattus norvegicus
tgacagttcctcccggcctgtgaca

SEQ ID NO: 556619 - DNA, 25 bp, Rattus norvegicus
aggtgccgccgcttcggcttcccta

SEQ ID NO: 556620 - DNA, 25 bp, Rattus norvegicus
tccctagcccagtgcagaacaaact

SEQ ID NO: 556621 - DNA, 25 bp, Rattus norvegicus
gcagaacaaactccagaagggaaca

SEQ ID NO: 556622 - DNA, 25 bp, Rattus norvegicus
tacctggtggtggttgtacgagttc

SEQ ID NO: 556623 - DNA, 25 bp, Rattus norvegicus
tggttgtacgagttcctctgctgca

SEQ ID NO: 556624 - DNA, 25 bp, Rattus norvegicus
acgagttcctctgctgcaggaaggc

SEQ ID NO: 556625 - DNA, 25 bp, Rattus norvegicus
gctgacgggtgacctccggctctgc

SEQ ID NO: 556626 - DNA, 25 bp, Rattus norvegicus
gcagcccggggtagaagccgttctc

SEQ ID NO: 556627 - DNA, 25 bp, Rattus norvegicus
ccgggttcatggacgacggcagccc

SEQ ID NO: 556628 - DNA, 25 bp, Rattus norvegicus
tagaagccgttctccgagtccgggc

SEQ ID NO: 556629 - DNA, 25 bp, Rattus norvegicus
ggcggctgctgttgaggtaaattca

SEQ ID NO: 556630 - DNA, 25 bp, Rattus norvegicus
gacagccgcgcgcagcctgacagtt

SEQ ID NO: 556631 - DNA, 25 bp, Rattus norvegicus
ctcggagaagccggtgacaggcaac

SEQ ID NO: 556632 - DNA, 25 bp, Rattus norvegicus
ggctgctgtgtcagcccgagcagca

SEQ ID NO: 556633 - DNA, 25 bp, Rattus norvegicus
tgcacggcctgctgatgcgccacga

SEQ ID NO: 556634 - DNA, 25 bp, Rattus norvegicus
ttgcggacggttcctgggcaaccgc

SEQ ID NO: 556635 - DNA, 25 bp, Rattus norvegicus
cgaacccgaagtcccgcatttatca

SEQ ID NO: 556636 - DNA, 25 bp, Rattus norvegicus
ccgcatttatcaggtcggcggccgc

SEQ ID NO: 556637 - DNA, 25 bp, Rattus norvegicus
gtcaatgggaaagggacactgtgac

SEQ ID NO: 556638 - DNA, 25 bp, Rattus norvegicus
acactgtgactgagccggggcaccg

SEQ ID NO: 556639 - DNA, 25 bp, Rattus norvegicus
ccggaacgtgcgtcagcagccacct

SEQ ID NO: 556640 - DNA, 25 bp, Rattus norvegicus
ccctcattagcatgcgttgtggacc

SEQ ID NO: 556641 - DNA, 25 bp, Rattus norvegicus
cattagcatgcgttgtggaccctgc

SEQ ID NO: 556642 - DNA, 25 bp, Rattus norvegicus
atgcgttgtggaccctgcgagccag

SEQ ID NO: 556643 - DNA, 25 bp, Rattus norvegicus
gcgcgtccttcggtccaggaccttg

SEQ ID NO: 556644 - DNA, 25 bp, Rattus norvegicus
ccaggaccttgtacggagccgaatt

SEQ ID NO: 556645 - DNA, 25 bp, Rattus norvegicus
ggcccggcttcctggactgcaggaa

SEQ ID NO: 556646 - DNA, 25 bp, Rattus norvegicus
cgagcaaaccgggacgactagtctg

SEQ ID NO: 556647 - DNA, 25 bp, Rattus norvegicus
agctcctggggtgggacactaccca

SEQ ID NO: 556648 - DNA, 25 bp, Rattus norvegicus
gactagtctgactctacgttttccc

SEQ ID NO: 556649 - DNA, 25 bp, Rattus norvegicus
tgcaggaactgtggtcccatcagcc

SEQ ID NO: 556650 - DNA, 25 bp, Rattus norvegicus
cgaatcgtgacgatgcactggccga

SEQ ID NO: 556651 - DNA, 25 bp, Rattus norvegicus
cggcacctccgggaaggtcagtcct

SEQ ID NO: 556652 - DNA, 25 bp, Rattus norvegicus
ccaggaccggcaactgaaaatcgtc

SEQ ID NO: 556653 - DNA, 25 bp, Rattus norvegicus
tgtcagactctgaggaggagagcca

SEQ ID NO: 556654 - DNA, 25 bp, Rattus norvegicus
cagcatcctcggacaccatgtcaga

SEQ ID NO: 556655 - DNA, 25 bp, Rattus norvegicus
ccctgggttccttcagggctgagga

SEQ ID NO: 556656 - DNA, 25 bp, Rattus norvegicus
gcggggcatcttttcagtgacgtac

SEQ ID NO: 556657 - DNA, 25 bp, Rattus norvegicus
ccattacaccgtgatggttggcgca

SEQ ID NO: 556658 - DNA, 25 bp, Rattus norvegicus
catcagcctgttgggcccacacggg

SEQ ID NO: 556659 - DNA, 25 bp, Rattus norvegicus
tgagtgcctgtgtcccttcacggct

SEQ ID NO: 556660 - DNA, 25 bp, Rattus norvegicus
accgcaggctctctctcggtgagtg

SEQ ID NO: 556661 - DNA, 25 bp, Rattus norvegicus
tgcaaggtcctcagcgcgctgcagc

SEQ ID NO: 556662 - DNA, 25 bp, Rattus norvegicus
aaaacgcctgtctgcaaggtcctca

SEQ ID NO: 556663 - DNA, 25 bp, Rattus norvegicus
cctgggaatttgctccaaggggcgc

SEQ ID NO: 556664 - DNA, 25 bp, Rattus norvegicus
gaaccggcaccaaaacgcctgtctg

SEQ ID NO: 556665 - DNA, 25 bp, Rattus norvegicus
tgggcgctcgagatcctcttctgcc

SEQ ID NO: 556666 - DNA, 25 bp, Rattus norvegicus
agctaacacggcagcagtgggcgct

SEQ ID NO: 556667 - DNA, 25 bp, Rattus norvegicus
actcgggccagcaccggagctaaca

SEQ ID NO: 556668 - DNA, 25 bp, Rattus norvegicus
cttagcttgcttgctggaagtcggc

SEQ ID NO: 556669 - DNA, 25 bp, Rattus norvegicus
aaaatccgaggagccaaggtactgc

SEQ ID NO: 556670 - DNA, 25 bp, Rattus norvegicus
ttcgggacccagaagcgcagaaatc

SEQ ID NO: 556671 - DNA, 25 bp, Rattus norvegicus
actgcgtgagccgaggcggctcctt

SEQ ID NO: 556672 - DNA, 25 bp, Rattus norvegicus
cgcagaaatccggtgcttagcttgc

SEQ ID NO: 556673 - DNA, 25 bp, Rattus norvegicus
tcgccagactatgcgggatgccaag

SEQ ID NO: 556674 - DNA, 25 bp, Rattus norvegicus
tcccgcagagggcagcagtacccgt

SEQ ID NO: 556675 - DNA, 25 bp, Rattus norvegicus
cagcagtacccgtgcatgcgtgcat

SEQ ID NO: 556676 - DNA, 25 bp, Rattus norvegicus
agggcggagaacacggtctacaatc

SEQ ID NO: 556677 - DNA, 25 bp, Rattus norvegicus
gagaacacggtctacaatcgccaga

SEQ ID NO: 556678 - DNA, 25 bp, Rattus norvegicus
cacggtctacaatcgccagactatg

SEQ ID NO: 556679 - DNA, 25 bp, Rattus norvegicus
tacaatcgccagactatgcgggatg

SEQ ID NO: 556680 - DNA, 25 bp, Rattus norvegicus
agagggcagcagtacccgtgcatgc

SEQ ID NO: 556681 - DNA, 25 bp, Rattus norvegicus
aacgttcccgcagagggcagcagta

SEQ ID NO: 556682 - DNA, 25 bp, Rattus norvegicus
gtctacaatcgccagactatgcggg

SEQ ID NO: 556683 - DNA, 25 bp, Rattus norvegicus
gcaacagcgactggtgagtgcctgg

SEQ ID NO: 556684 - DNA, 25 bp, Rattus norvegicus
cttagagggtgaggcaacagcgact

SEQ ID NO: 556685 - DNA, 25 bp, Rattus norvegicus
atgcgtgcatgcttgggagggccag

SEQ ID NO: 556686 - DNA, 25 bp, Rattus norvegicus
ctggcggagaggtggaacgttcccg

SEQ ID NO: 556687 - DNA, 25 bp, Rattus norvegicus
tcacctcagggcgtgcatgccgtgc

SEQ ID NO: 556688 - DNA, 25 bp, Rattus norvegicus
tcgactcagcgacccgggccaggtg

SEQ ID NO: 556689 - DNA, 25 bp, Rattus norvegicus
gctcctttgggtgcgtggtcccgca

SEQ ID NO: 556690 - DNA, 25 bp, Rattus norvegicus
agtcagttatgcgtgaacgtctgcg

SEQ ID NO: 556691 - DNA, 25 bp, Rattus norvegicus
aaggtttctgtctagtcagttatgc

SEQ ID NO: 556692 - DNA, 25 bp, Rattus norvegicus
tcccgcagggtcttcacggaggaaa

SEQ ID NO: 556693 - DNA, 25 bp, Rattus norvegicus
atgccgtgcggcctgttctccaggc

SEQ ID NO: 556694 - DNA, 25 bp, Rattus norvegicus
cggcctgtccgaccctcacctcagg

SEQ ID NO: 556695 - DNA, 25 bp, Rattus norvegicus
attcctgtcaggttgcttggcctga

SEQ ID NO: 556696 - DNA, 25 bp, Rattus norvegicus
ggctccacgcattcctgtcaggttg

SEQ ID NO: 556697 - DNA, 25 bp, Rattus norvegicus
ggcgagcggctccacgcattcctgt

SEQ ID NO: 556698 - DNA, 25 bp, Rattus norvegicus
tcttcacggaggaaaggtttctgtc

SEQ ID NO: 556699 - DNA, 25 bp, Rattus norvegicus
gggaatcggcgctcgactcagcgac

SEQ ID NO: 556700 - DNA, 25 bp, Rattus norvegicus
ttccctcgcgctcctttgggtgcgt

SEQ ID NO: 556701 - DNA, 25 bp, Rattus norvegicus
cggctttggctttcagtgtttggaa

SEQ ID NO: 556702 - DNA, 25 bp, Rattus norvegicus
cctctgtgttagacggatcgggtca

SEQ ID NO: 556703 - DNA, 25 bp, Rattus norvegicus
tccgtccactgggatctgggaccgt

SEQ ID NO: 556704 - DNA, 25 bp, Rattus norvegicus
cggtctagatgcctgtccgtccact

SEQ ID NO: 556705 - DNA, 25 bp, Rattus norvegicus
ccgcgactcatcgtgccgggcggtt

SEQ ID NO: 556706 - DNA, 25 bp, Rattus norvegicus
gttgagccggctttttaaatgatgc

SEQ ID NO: 556707 - DNA, 25 bp, Rattus norvegicus
accacgctggcattgtctttggagc

SEQ ID NO: 556708 - DNA, 25 bp, Rattus norvegicus
tttaaagcctctcggcctccgaggc

SEQ ID NO: 556709 - DNA, 25 bp, Rattus norvegicus
ggacgcgacggtgcagctctcgcac

SEQ ID NO: 556710 - DNA, 25 bp, Rattus norvegicus
tcgcccgggaaagcgtgcatccctg

SEQ ID NO: 556711 - DNA, 25 bp, Rattus norvegicus
tgcgagcgcgccaacaataaacttg

SEQ ID NO: 556712 - DNA, 25 bp, Rattus norvegicus
caataaacttgaggaccacgctggc

SEQ ID NO: 556713 - DNA, 25 bp, Rattus norvegicus
gcctttgtgcagtgccggctcagcc

SEQ ID NO: 556714 - DNA, 25 bp, Rattus norvegicus
tcgtcaggaggccatttttaaagcc

SEQ ID NO: 556715 - DNA, 25 bp, Rattus norvegicus
ggcgataatttcctctacaccaatg

SEQ ID NO: 556716 - DNA, 25 bp, Rattus norvegicus
ccctcatgcaccgtgcggggtttgt

SEQ ID NO: 556717 - DNA, 25 bp, Rattus norvegicus
ttttcaccggtcgtgtcgcgtcact

SEQ ID NO: 556718 - DNA, 25 bp, Rattus norvegicus
ccgagctgagcgcttgactatatat

SEQ ID NO: 556719 - DNA, 25 bp, Rattus norvegicus
ctcggccactgctaggttctactcg

SEQ ID NO: 556720 - DNA, 25 bp, Rattus norvegicus
gctgactgcctgcaactccctgggt

SEQ ID NO: 556721 - DNA, 25 bp, Rattus norvegicus
tcctcagagaaggtgttcgccagcc

SEQ ID NO: 556722 - DNA, 25 bp, Rattus norvegicus
cgaggatgccgtacgagatcagtga

SEQ ID NO: 556723 - DNA, 25 bp, Rattus norvegicus
cggggtttgtgtctcctcagagaag

SEQ ID NO: 556724 - DNA, 25 bp, Rattus norvegicus
gtgtctctaagatcctcggcggaga

SEQ ID NO: 556725 - DNA, 25 bp, Rattus norvegicus
tcgacgtgagtactctctgcccggc

SEQ ID NO: 556726 - DNA, 25 bp, Rattus norvegicus
accaatggcaagtgcgtcatcctga

SEQ ID NO: 556727 - DNA, 25 bp, Rattus norvegicus
ttgccctgcgagctaccttcagagc

SEQ ID NO: 556728 - DNA, 25 bp, Rattus norvegicus
gtcatcctgaggaacatcgacgtga

SEQ ID NO: 556729 - DNA, 25 bp, Rattus norvegicus
agccagttgcctctgtaatcccagc

SEQ ID NO: 556730 - DNA, 25 bp, Rattus norvegicus
caaggtccagacgattaggagagtc

SEQ ID NO: 556731 - DNA, 25 bp, Rattus norvegicus
agcacgttcccgagcaaggtccaga

SEQ ID NO: 556732 - DNA, 25 bp, Rattus norvegicus
taatcccagccttgccggttgagcc

SEQ ID NO: 556733 - DNA, 25 bp, Rattus norvegicus
cagcatgtcgcgctgagtagctcgg

SEQ ID NO: 556734 - DNA, 25 bp, Rattus norvegicus
ggctctctgcttgcggtcccaactt

SEQ ID NO: 556735 - DNA, 25 bp, Rattus norvegicus
accgtgcaccgcttaggatcctgta

SEQ ID NO: 556736 - DNA, 25 bp, Rattus norvegicus
ggatcctgtaatggtaacactcttg

SEQ ID NO: 556737 - DNA, 25 bp, Rattus norvegicus
tggtaacactcttgcgcacctctgg

SEQ ID NO: 556738 - DNA, 25 bp, Rattus norvegicus
ggaccagaaacgaccgatgcccgcg

SEQ ID NO: 556739 - DNA, 25 bp, Rattus norvegicus
gatggcagcacacactagcacgttc

SEQ ID NO: 556740 - DNA, 25 bp, Rattus norvegicus
tctgagatcctgtgtcggcagcaca

SEQ ID NO: 556741 - DNA, 25 bp, Rattus norvegicus
gttccgagtcggagaaacgcagagc

SEQ ID NO: 556742 - DNA, 25 bp, Rattus norvegicus
gggcgtccacctgagccagttgcct

SEQ ID NO: 556743 - DNA, 25 bp, Rattus norvegicus
gccgctcctcagacgtcacatgatg

SEQ ID NO: 556744 - DNA, 25 bp, Rattus norvegicus
tctggccacatgttcgggcagtgtg

SEQ ID NO: 556745 - DNA, 25 bp, Rattus norvegicus
ccctggcaatgtctcgcgggagtag

SEQ ID NO: 556746 - DNA, 25 bp, Rattus norvegicus
cgcggctggcctaagcttaaaggga

SEQ ID NO: 556747 - DNA, 25 bp, Rattus norvegicus
cgtcacatgatgtttggtcacgtgg

SEQ ID NO: 556748 - DNA, 25 bp, Rattus norvegicus
gcaccggcgaacagccctcttttga

SEQ ID NO: 556749 - DNA, 25 bp, Rattus norvegicus
ccgacggacacctgatgagtcagca

SEQ ID NO: 556750 - DNA, 25 bp, Rattus norvegicus
tgatgactcagcacgtctccgctgg

SEQ ID NO: 556751 - DNA, 25 bp, Rattus norvegicus
agcaggagcaccgagtgacctcatg

SEQ ID NO: 556752 - DNA, 25 bp, Rattus norvegicus
tctcccgactagacgggccgatagc

SEQ ID NO: 556753 - DNA, 25 bp, Rattus norvegicus
ggatctagccctgtctcccgactag

SEQ ID NO: 556754 - DNA, 25 bp, Rattus norvegicus
acttaaacacgacccaggatcctgg

SEQ ID NO: 556755 - DNA, 25 bp, Rattus norvegicus
ctcacaggtccgtcaaacttaaaca

SEQ ID NO: 556756 - DNA, 25 bp, Rattus norvegicus
ttccattcatgaagcggcgacgcgg

SEQ ID NO: 556757 - DNA, 25 bp, Rattus norvegicus
atgtagctgcgacccacgtaccaca

SEQ ID NO: 556758 - DNA, 25 bp, Rattus norvegicus
cccgcacgttgctcttggctcctgt

SEQ ID NO: 556759 - DNA, 25 bp, Rattus norvegicus
cctgatgatgctgcgggagaagata

SEQ ID NO: 556760 - DNA, 25 bp, Rattus norvegicus
cactcggggagcctgatgatgctgc

SEQ ID NO: 556761 - DNA, 25 bp, Rattus norvegicus
ggctgctcagagtctccgccagctt

SEQ ID NO: 556762 - DNA, 25 bp, Rattus norvegicus
gtccatactggctgctcagagtctc

SEQ ID NO: 556763 - DNA, 25 bp, Rattus norvegicus
cacgaacacgttcagtccatactgg

SEQ ID NO: 556764 - DNA, 25 bp, Rattus norvegicus
ctcttgcccacacccgtcgcgtgca

SEQ ID NO: 556765 - DNA, 25 bp, Rattus norvegicus
atacgcacaacaggtcgctcttgcc

SEQ ID NO: 556766 - DNA, 25 bp, Rattus norvegicus
ggttaatacgcacaacaggtcgctc

SEQ ID NO: 556767 - DNA, 25 bp, Rattus norvegicus
cagcagcatgagtgcggttaatacg

SEQ ID NO: 556768 - DNA, 25 bp, Rattus norvegicus
cgtaccacagcatccagagcagctg

SEQ ID NO: 556769 - DNA, 25 bp, Rattus norvegicus
ggcgctgcatgtagctgcgacccac

SEQ ID NO: 556770 - DNA, 25 bp, Rattus norvegicus
agctgcagcagcatgagtgcggtta

SEQ ID NO: 556771 - DNA, 25 bp, Rattus norvegicus
ctccagctcagaactccagattttg

SEQ ID NO: 556772 - DNA, 25 bp, Rattus norvegicus
aggcccactgacagcgcggtgtgat

SEQ ID NO: 556773 - DNA, 25 bp, Rattus norvegicus
gagtcctgcagttgacaccagtttg

SEQ ID NO: 556774 - DNA, 25 bp, Rattus norvegicus
caatcccggctagcacgagtcaatg

SEQ ID NO: 556775 - DNA, 25 bp, Rattus norvegicus
gtcctcaaggaaggcggccatgccg

SEQ ID NO: 556776 - DNA, 25 bp, Rattus norvegicus
gattttgcccgcgagcgagtcctca

SEQ ID NO: 556777 - DNA, 25 bp, Rattus norvegicus
aaggcgtcctgggacactcgactcg

SEQ ID NO: 556778 - DNA, 25 bp, Rattus norvegicus
tagcacgagtcaatgcgcatgcgca

SEQ ID NO: 556779 - DNA, 25 bp, Rattus norvegicus
accgggatgcaacgtctccagctca

SEQ ID NO: 556780 - DNA, 25 bp, Rattus norvegicus
cgcatgcgcatagaggccaagcctc

SEQ ID NO: 556781 - DNA, 25 bp, Rattus norvegicus
gccaagcctcaaacggaagtgacgg

SEQ ID NO: 556782 - DNA, 25 bp, Rattus norvegicus
cctggcggagcacaaagctaagatc

SEQ ID NO: 556783 - DNA, 25 bp, Rattus norvegicus
agtcacccttgctgctgcggtctgc

SEQ ID NO: 556784 - DNA, 25 bp, Rattus norvegicus
caccagtttgacgagaacgagtgtc

SEQ ID NO: 556785 - DNA, 25 bp, Rattus norvegicus
cttgccttgtgctggcggtttctcc

SEQ ID NO: 556786 - DNA, 25 bp, Rattus norvegicus
ctaaagacgtgtccagagggaatcc

SEQ ID NO: 556787 - DNA, 25 bp, Rattus norvegicus
gttaaaaacgtcagtggcatcgggc

SEQ ID NO: 556788 - DNA, 25 bp, Rattus norvegicus
tttctccctgcagggtgtgagtctg

SEQ ID NO: 556789 - DNA, 25 bp, Rattus norvegicus
ctcgaccttaaccaggacaacattc

SEQ ID NO: 556790 - DNA, 25 bp, Rattus norvegicus
ctgtgccacacgtttctgaagtcgg

SEQ ID NO: 556791 - DNA, 25 bp, Rattus norvegicus
cagaacgttctgaatctgtgccaca

SEQ ID NO: 556792 - DNA, 25 bp, Rattus norvegicus
tcgggcagatcctggacttcatgta

SEQ ID NO: 556793 - DNA, 25 bp, Rattus norvegicus
cgtgctccaccagcagatttcggtc

SEQ ID NO: 556794 - DNA, 25 bp, Rattus norvegicus
acagcgcagtgtttgcaagtgcaga

SEQ ID NO: 556795 - DNA, 25 bp, Rattus norvegicus
acattcaggtgatgctggacacagc

SEQ ID NO: 556796 - DNA, 25 bp, Rattus norvegicus
ggcaccgctgccaggcttgccttgt

SEQ ID NO: 556797 - DNA, 25 bp, Rattus norvegicus
acttcatgtacacgtcgcgcctcga

SEQ ID NO: 556798 - DNA, 25 bp, Rattus norvegicus
tgcaggactgccctatggaaggccc

SEQ ID NO: 556799 - DNA, 25 bp, Rattus norvegicus
tgtcagtcaatacacagcctgagac

SEQ ID NO: 556800 - DNA, 25 bp, Rattus norvegicus
gcccagatctgctggagccaggcgt

SEQ ID NO: 556801 - DNA, 25 bp, Rattus norvegicus
tctaactgcgattgccgtgtccctg

SEQ ID NO: 556802 - DNA, 25 bp, Rattus norvegicus
ccgggtattcccttagtcaggcatc

SEQ ID NO: 556803 - DNA, 25 bp, Rattus norvegicus
cttagtcaggcatcgggagtctcag

SEQ ID NO: 556804 - DNA, 25 bp, Rattus norvegicus
gagtctcaggttctccttcctccgg

SEQ ID NO: 556805 - DNA, 25 bp, Rattus norvegicus
gtgctcctttgtgcgaccgatccgc

SEQ ID NO: 556806 - DNA, 25 bp, Rattus norvegicus
cggagcgcgcttgaagcccagatct

SEQ ID NO: 556807 - DNA, 25 bp, Rattus norvegicus
agagcatctctgaagcaagggccgc

SEQ ID NO: 556808 - DNA, 25 bp, Rattus norvegicus
ggatgggagtctagaaatgtcagtc

SEQ ID NO: 556809 - DNA, 25 bp, Rattus norvegicus
agcctgagactctgatctaactgcg

SEQ ID NO: 556810 - DNA, 25 bp, Rattus norvegicus
tgccacctctctggggagatcaggc

SEQ ID NO: 556811 - DNA, 25 bp, Rattus norvegicus
ctgggctaaggctcgcactgatccc

SEQ ID NO: 556812 - DNA, 25 bp, Rattus norvegicus
gggaggcacagaacccaatcgctga

SEQ ID NO: 556813 - DNA, 25 bp, Rattus norvegicus
agggaatctccgttccagacagcta

SEQ ID NO: 556814 - DNA, 25 bp, Rattus norvegicus
agcaaccagcttaccacttcacggg

SEQ ID NO: 556815 - DNA, 25 bp, Rattus norvegicus
agtcgttcccatagcaaccagctta

SEQ ID NO: 556816 - DNA, 25 bp, Rattus norvegicus
gctggagaagtctcccttgggccga

SEQ ID NO: 556817 - DNA, 25 bp, Rattus norvegicus
ggaacagctcgtctcggctgccatc

SEQ ID NO: 556818 - DNA, 25 bp, Rattus norvegicus
ttattccgcgtcttcactgtcttga

SEQ ID NO: 556819 - DNA, 25 bp, Rattus norvegicus
actgtcttgacgctagccctgaaga

SEQ ID NO: 556820 - DNA, 25 bp, Rattus norvegicus
agtgtgatgtccaccgccatagcga

SEQ ID NO: 556821 - DNA, 25 bp, Rattus norvegicus
ctgagggacgttccgatttcgcttc

SEQ ID NO: 556822 - DNA, 25 bp, Rattus norvegicus
tccgatttcgcttccgcctgggaac

SEQ ID NO: 556823 - DNA, 25 bp, Rattus norvegicus
aaggttccgctctcagcccgtgtac

SEQ ID NO: 556824 - DNA, 25 bp, Rattus norvegicus
cagcccgtgtactgcgtcgagtaga

SEQ ID NO: 556825 - DNA, 25 bp, Rattus norvegicus
tcgagtagagaaaggttccggcctc

SEQ ID NO: 556826 - DNA, 25 bp, Rattus norvegicus
tagccctgaagagcagtgtgatgtc

SEQ ID NO: 556827 - DNA, 25 bp, Rattus norvegicus
gctgagacgttcaagcgctgaatta

SEQ ID NO: 556828 - DNA, 25 bp, Rattus norvegicus
ggcctcggcacatctgcgttttatc

SEQ ID NO: 556829 - DNA, 25 bp, Rattus norvegicus
accgcaaatttcagaggcctcggca

SEQ ID NO: 556830 - DNA, 25 bp, Rattus norvegicus
cgaaccacttagcaaaccgcaaatt

SEQ ID NO: 556831 - DNA, 25 bp, Rattus norvegicus
ggcaagcatcgctcgaaccacttag

SEQ ID NO: 556832 - DNA, 25 bp, Rattus norvegicus
ggccgcaggcaagcatcgctcgaac

SEQ ID NO: 556833 - DNA, 25 bp, Rattus norvegicus
gcgttttatcagctttttccggata

SEQ ID NO: 556834 - DNA, 25 bp, Rattus norvegicus
tcggccgacagctgagacgttcaag

SEQ ID NO: 556835 - DNA, 25 bp, Rattus norvegicus
agtaatgaaagcagcctgccgccag

SEQ ID NO: 556836 - DNA, 25 bp, Rattus norvegicus
gctgaattacagagaaagggccgga

SEQ ID NO: 556837 - DNA, 25 bp, Rattus norvegicus
agggccggagataaagccaagcaca

SEQ ID NO: 556838 - DNA, 25 bp, Rattus norvegicus
aattgtctgcagatcggccgacagc

SEQ ID NO: 556839 - DNA, 25 bp, Rattus norvegicus
gccaagcacatgtatcccatcaaag

SEQ ID NO: 556840 - DNA, 25 bp, Rattus norvegicus
tgtatcccatcaaagtaatgaaagc

SEQ ID NO: 556841 - DNA, 25 bp, Rattus norvegicus
agagttttatctgccgcgggccagc

SEQ ID NO: 556842 - DNA, 25 bp, Rattus norvegicus
ccctgcccttgccaggcgtgaatta

SEQ ID NO: 556843 - DNA, 25 bp, Rattus norvegicus
aatgcgtgcctttccttcttcagga

SEQ ID NO: 556844 - DNA, 25 bp, Rattus norvegicus
cagcctgggttgtcagctcgcttaa

SEQ ID NO: 556845 - DNA, 25 bp, Rattus norvegicus
gcaattagcgatgcagcccttctta

SEQ ID NO: 556846 - DNA, 25 bp, Rattus norvegicus
gctcgcttaacccactggccaggaa

SEQ ID NO: 556847 - DNA, 25 bp, Rattus norvegicus
aggttgcctgctctcatcgattcca

SEQ ID NO: 556848 - DNA, 25 bp, Rattus norvegicus
cgcactccgtgagttccgctggaga

SEQ ID NO: 556849 - DNA, 25 bp, Rattus norvegicus
ggtcctgcgctctagaagccatcga

SEQ ID NO: 556850 - DNA, 25 bp, Rattus norvegicus
cgctggatcactacagacccaaatg

SEQ ID NO: 556851 - DNA, 25 bp, Rattus norvegicus
aggctaggcctctttgctctgactg

SEQ ID NO: 556852 - DNA, 25 bp, Rattus norvegicus
aattacggtcggttttctctgcagc

SEQ ID NO: 556853 - DNA, 25 bp, Rattus norvegicus
gccgctggcgcctaaaaacaacatc

SEQ ID NO: 556854 - DNA, 25 bp, Rattus norvegicus
gcagagcgcctgtctcagagtttta

SEQ ID NO: 556855 - DNA, 25 bp, Rattus norvegicus
ggtcgccattgtaacgctccgagta

SEQ ID NO: 556856 - DNA, 25 bp, Rattus norvegicus
ccggtttgacgcacacggcaccaaa

SEQ ID NO: 556857 - DNA, 25 bp, Rattus norvegicus
ccgttggagccgagtagcgtacaga

SEQ ID NO: 556858 - DNA, 25 bp, Rattus norvegicus
attggcacgggagctccggctgccc

SEQ ID NO: 556859 - DNA, 25 bp, Rattus norvegicus
agcagcggtgcgctgtttctgccgc

SEQ ID NO: 556860 - DNA, 25 bp, Rattus norvegicus
cacggcaccaaactgtgagtttcgg

SEQ ID NO: 556861 - DNA, 25 bp, Rattus norvegicus
ctgcatttcggacgtccgggctgag

SEQ ID NO: 556862 - DNA, 25 bp, Rattus norvegicus
gggagctacgccctaggctggctcc

SEQ ID NO: 556863 - DNA, 25 bp, Rattus norvegicus
cgcgttttgccgcacaggctaagat

SEQ ID NO: 556864 - DNA, 25 bp, Rattus norvegicus
ctgctgcagaagaagcccgggtcgc

SEQ ID NO: 556865 - DNA, 25 bp, Rattus norvegicus
ggggttttgtttagtcacatgtagc

SEQ ID NO: 556866 - DNA, 25 bp, Rattus norvegicus
tttagtcacatgtagcggagcagcc

SEQ ID NO: 556867 - DNA, 25 bp, Rattus norvegicus
cattgtaacgctccgagtaacgggg

SEQ ID NO: 556868 - DNA, 25 bp, Rattus norvegicus
ggagccttgcggtcgccattgtaac

SEQ ID NO: 556869 - DNA, 25 bp, Rattus norvegicus
gtttcctggagattagagcccggcg

SEQ ID NO: 556870 - DNA, 25 bp, Rattus norvegicus
ggacatttcaccgaagcgagtattc

SEQ ID NO: 556871 - DNA, 25 bp, Rattus norvegicus
tcaccgaagcgagtattcccgaacc

SEQ ID NO: 556872 - DNA, 25 bp, Rattus norvegicus
cttactatttttccaggccctgtgg

SEQ ID NO: 556873 - DNA, 25 bp, Rattus norvegicus
ggtgaggctccgatctctctggcct

SEQ ID NO: 556874 - DNA, 25 bp, Rattus norvegicus
gccgtctgggtaataaagtaattca

SEQ ID NO: 556875 - DNA, 25 bp, Rattus norvegicus
ttcattttccttaatctggtcgccc

SEQ ID NO: 556876 - DNA, 25 bp, Rattus norvegicus
ccctaatctacagctttttattgcg

SEQ ID NO: 556877 - DNA, 25 bp, Rattus norvegicus
acagctttttattgcgcccagttaa

SEQ ID NO: 556878 - DNA, 25 bp, Rattus norvegicus
cagttaaaaggccagggaattcgct

SEQ ID NO: 556879 - DNA, 25 bp, Rattus norvegicus
ggaattcgctatccctccgtgctcg

SEQ ID NO: 556880 - DNA, 25 bp, Rattus norvegicus
atccctccgtgctcggataattacc

SEQ ID NO: 556881 - DNA, 25 bp, Rattus norvegicus
cccttgtgtttcctggagattagag

SEQ ID NO: 556882 - DNA, 25 bp, Rattus norvegicus
agcccggcggtcatcaatgctcagt

SEQ ID NO: 556883 - DNA, 25 bp, Rattus norvegicus
gccctcatggccgatcacaggaagc

SEQ ID NO: 556884 - DNA, 25 bp, Rattus norvegicus
cttccagggaagctgcaggagactc

SEQ ID NO: 556885 - DNA, 25 bp, Rattus norvegicus
atccctgggagctcacagaagccgg

SEQ ID NO: 556886 - DNA, 25 bp, Rattus norvegicus
cgaaacccatgatccagggctggcc

SEQ ID NO: 556887 - DNA, 25 bp, Rattus norvegicus
cccggctgctgctatgacttctttg

SEQ ID NO: 556888 - DNA, 25 bp, Rattus norvegicus
tatgacttctttgccactcggtgtc

SEQ ID NO: 556889 - DNA, 25 bp, Rattus norvegicus
ctgcaaccgccatgggcacagatga

SEQ ID NO: 556890 - DNA, 25 bp, Rattus norvegicus
cggcctctcggccatttctctgttg

SEQ ID NO: 556891 - DNA, 25 bp, Rattus norvegicus
ggggactcctcaagctgccagaaga

SEQ ID NO: 556892 - DNA, 25 bp, Rattus norvegicus
cagaagatgctctggtgaaggccga

SEQ ID NO: 556893 - DNA, 25 bp, Rattus norvegicus
agcccggagaagctagatcggaccc

SEQ ID NO: 556894 - DNA, 25 bp, Rattus norvegicus
tagccagccctggatggagagcgaa

SEQ ID NO: 556895 - DNA, 25 bp, Rattus norvegicus
acctgcaactgggtacctggaggcc

SEQ ID NO: 556896 - DNA, 25 bp, Rattus norvegicus
actcggtgtcaaagtggaggactcc

SEQ ID NO: 556897 - DNA, 25 bp, Rattus norvegicus
tgcgccataaagctgtccatgttgc

SEQ ID NO: 556898 - DNA, 25 bp, Rattus norvegicus
gaagtccagcgggaagctctccacc

SEQ ID NO: 556899 - DNA, 25 bp, Rattus norvegicus
tggcaatgtcactccggcctgtggc

SEQ ID NO: 556900 - DNA, 25 bp, Rattus norvegicus
ccacctgcggagagcagacggcagt

SEQ ID NO: 556901 - DNA, 25 bp, Rattus norvegicus
gggcgcgcaagacactgctgctcct

SEQ ID NO: 556902 - DNA, 25 bp, Rattus norvegicus
caatgcagactctgggtgcgctggc

SEQ ID NO: 556903 - DNA, 25 bp, Rattus norvegicus
tgcccgcgcgttagaagtgccgccg

SEQ ID NO: 556904 - DNA, 25 bp, Rattus norvegicus
gggctgcgctcactcttttcttggc

SEQ ID NO: 556905 - DNA, 25 bp, Rattus norvegicus
cttttcttggcggaggcttagcctt

SEQ ID NO: 556906 - DNA, 25 bp, Rattus norvegicus
ttcccaaaccacaagcctgacggag

SEQ ID NO: 556907 - DNA, 25 bp, Rattus norvegicus
gattgcgcagctgctctgcccgacg

SEQ ID NO: 556908 - DNA, 25 bp, Rattus norvegicus
atgttgccctccactgccgtgaagt

SEQ ID NO: 556909 - DNA, 25 bp, Rattus norvegicus
ccagtgcattcgtgggagactcgca

SEQ ID NO: 556910 - DNA, 25 bp, Rattus norvegicus
ttcacctggaacagttggggccttc

SEQ ID NO: 556911 - DNA, 25 bp, Rattus norvegicus
tcaccgctttgctagttcccgaatg

SEQ ID NO: 556912 - DNA, 25 bp, Rattus norvegicus
aggagctctctaatcaccgctttgc

SEQ ID NO: 556913 - DNA, 25 bp, Rattus norvegicus
ccgctttgctagttcccgaatgttt

SEQ ID NO: 556914 - DNA, 25 bp, Rattus norvegicus
ccgaatgttttggacaaggctttcg

SEQ ID NO: 556915 - DNA, 25 bp, Rattus norvegicus
caaggctttcgaagcggacccagca

SEQ ID NO: 556916 - DNA, 25 bp, Rattus norvegicus
cggacccagcagtcagcgacatgtt

SEQ ID NO: 556917 - DNA, 25 bp, Rattus norvegicus
gttgttccagaatagtcctaagttc

SEQ ID NO: 556918 - DNA, 25 bp, Rattus norvegicus
gaatagtcctaagttcttgcggccc

SEQ ID NO: 556919 - DNA, 25 bp, Rattus norvegicus
tcttgcggcccttaggcttcctttc

SEQ ID NO: 556920 - DNA, 25 bp, Rattus norvegicus
cagcgaacccgctcgaagatatttc

SEQ ID NO: 556921 - DNA, 25 bp, Rattus norvegicus
tcgaagatatttcaggagcacggga

SEQ ID NO: 556922 - DNA, 25 bp, Rattus norvegicus
gtcagcgacatgttgttccagaata

SEQ ID NO: 556923 - DNA, 25 bp, Rattus norvegicus
caacgagacggccaaaggagctctc

SEQ ID NO: 556924 - DNA, 25 bp, Rattus norvegicus
caggagcacgggaaattcccaagtt

SEQ ID NO: 556925 - DNA, 25 bp, Rattus norvegicus
ccaggacgcccttcaccacggctca

SEQ ID NO: 556926 - DNA, 25 bp, Rattus norvegicus
caatgttgccgcctgcggccttcgg

SEQ ID NO: 556927 - DNA, 25 bp, Rattus norvegicus
gccgcgaagccaatgttgccgcctg

SEQ ID NO: 556928 - DNA, 25 bp, Rattus norvegicus
agaagttgaagatggccgcgaagcc

SEQ ID NO: 556929 - DNA, 25 bp, Rattus norvegicus
tccagaaccgccgtgccaaggccaa

SEQ ID NO: 556930 - DNA, 25 bp, Rattus norvegicus
tcagccttaccgagacccaggtgaa

SEQ ID NO: 556931 - DNA, 25 bp, Rattus norvegicus
gtacctgtctattgccgagcgcgcc

SEQ ID NO: 556932 - DNA, 25 bp, Rattus norvegicus
ccacggctcagctactggctctgga

SEQ ID NO: 556933 - DNA, 25 bp, Rattus norvegicus
tacgcaagcacaagaccaaccgcaa

SEQ ID NO: 556934 - DNA, 25 bp, Rattus norvegicus
tcctttcctcttggtggccctgcag

SEQ ID NO: 556935 - DNA, 25 bp, Rattus norvegicus
agttctccagctcgctcagccttac

SEQ ID NO: 556936 - DNA, 25 bp, Rattus norvegicus
cgcaagttccgccagaagcagtacc

SEQ ID NO: 556937 - DNA, 25 bp, Rattus norvegicus
ttccgccagaagcagtacctgtcta

SEQ ID NO: 556938 - DNA, 25 bp, Rattus norvegicus
gcgcctcactctacagtgcctctgg

SEQ ID NO: 556939 - DNA, 25 bp, Rattus norvegicus
ggggatcccttcagctatgttcgac

SEQ ID NO: 556940 - DNA, 25 bp, Rattus norvegicus
gctatgttcgacagctccggatccc

SEQ ID NO: 556941 - DNA, 25 bp, Rattus norvegicus
cgcaagcttgcattcggattcgggg

SEQ ID NO: 556942 - DNA, 25 bp, Rattus norvegicus
gcctcaccgcaagcttgcattcgga

SEQ ID NO: 556943 - DNA, 25 bp, Rattus norvegicus
taaatgttcactgtcctccgcctca

SEQ ID NO: 556944 - DNA, 25 bp, Rattus norvegicus
acttcccacagctaaatgttcactg

SEQ ID NO: 556945 - DNA, 25 bp, Rattus norvegicus
cccttgatgctaggcgccactgaga

SEQ ID NO: 556946 - DNA, 25 bp, Rattus norvegicus
ctacccttgatgctaggcgccactg

SEQ ID NO: 556947 - DNA, 25 bp, Rattus norvegicus
agccgctcactcctctacaacagtc

SEQ ID NO: 556948 - DNA, 25 bp, Rattus norvegicus
ggcggcctttcaactcttccgctgg

SEQ ID NO: 556949 - DNA, 25 bp, Rattus norvegicus
agagcccgaccggttcaggcctgcg

SEQ ID NO: 556950 - DNA, 25 bp, Rattus norvegicus
ctaggagagcccgaccggttcaggc

SEQ ID NO: 556951 - DNA, 25 bp, Rattus norvegicus
ctcagcctccacttcgaaacgccaa

SEQ ID NO: 556952 - DNA, 25 bp, Rattus norvegicus
ggcagcggcggcctttcaactcttc

SEQ ID NO: 556953 - DNA, 25 bp, Rattus norvegicus
cgcatgctcagtgcacggtagggct

SEQ ID NO: 556954 - DNA, 25 bp, Rattus norvegicus
gtgctactgggtgccttactcggcc

SEQ ID NO: 556955 - DNA, 25 bp, Rattus norvegicus
gggtgccttactcggcctgggcctc

SEQ ID NO: 556956 - DNA, 25 bp, Rattus norvegicus
caggtgggtcccaatgcggccggga

SEQ ID NO: 556957 - DNA, 25 bp, Rattus norvegicus
aggcggcgcctacgctgctggtccc

SEQ ID NO: 556958 - DNA, 25 bp, Rattus norvegicus
cctgcaggagagatgcgcgactgca

SEQ ID NO: 556959 - DNA, 25 bp, Rattus norvegicus
catgacctgcaggagagatgcgcga

SEQ ID NO: 556960 - DNA, 25 bp, Rattus norvegicus
ggtcacccgcccgagccctcatgac

SEQ ID NO: 556961 - DNA, 25 bp, Rattus norvegicus
cagcgggaaagggtaccgaggcgag

SEQ ID NO: 556962 - DNA, 25 bp, Rattus norvegicus
ttggagcggcgggtccaagctcctc

SEQ ID NO: 556963 - DNA, 25 bp, Rattus norvegicus
ccggaaaggctgaaagtttggagcg

SEQ ID NO: 556964 - DNA, 25 bp, Rattus norvegicus
ctcagtgcacggtagggctagcccg

SEQ ID NO: 556965 - DNA, 25 bp, Rattus norvegicus
cccgcagtgctactgggtgccttac

SEQ ID NO: 556966 - DNA, 25 bp, Rattus norvegicus
atgctcagtgcacggtagggctagc

SEQ ID NO: 556967 - DNA, 25 bp, Rattus norvegicus
cttcacgcccgcagagagagggact

SEQ ID NO: 556968 - DNA, 25 bp, Rattus norvegicus
ctcccggcacatcctgcggagggag

SEQ ID NO: 556969 - DNA, 25 bp, Rattus norvegicus
cgcagagagagggactggatactcc

SEQ ID NO: 556970 - DNA, 25 bp, Rattus norvegicus
agccacaaagcactgcggcagggtg

SEQ ID NO: 556971 - DNA, 25 bp, Rattus norvegicus
cttacggtgatgtgcgggatgctct

SEQ ID NO: 556972 - DNA, 25 bp, Rattus norvegicus
ggccgctggaactaacgtctgcctg

SEQ ID NO: 556973 - DNA, 25 bp, Rattus norvegicus
cgctactcgtgggagctgcgacaaa

SEQ ID NO: 556974 - DNA, 25 bp, Rattus norvegicus
gaaagaaaggacagaaactcggctc

SEQ ID NO: 556975 - DNA, 25 bp, Rattus norvegicus
aaggacagaaactcggctcccaccg

SEQ ID NO: 556976 - DNA, 25 bp, Rattus norvegicus
tggcggcagcagaaccggattcgcc

SEQ ID NO: 556977 - DNA, 25 bp, Rattus norvegicus
tttcggctcgaaccaggaagcgctt

SEQ ID NO: 556978 - DNA, 25 bp, Rattus norvegicus
aaccaggaagcgcttcccttccgat

SEQ ID NO: 556979 - DNA, 25 bp, Rattus norvegicus
ttttgttcagctccgcatcctccgg

SEQ ID NO: 556980 - DNA, 25 bp, Rattus norvegicus
cgggtctggaccctgatggcgacca

SEQ ID NO: 556981 - DNA, 25 bp, Rattus norvegicus
caggacatcggatgcgcaacgccgg

SEQ ID NO: 556982 - DNA, 25 bp, Rattus norvegicus
actgccagctacaaaggaccacgga

SEQ ID NO: 556983 - DNA, 25 bp, Rattus norvegicus
tacggtgaccaaggccagcgccact

SEQ ID NO: 556984 - DNA, 25 bp, Rattus norvegicus
ccaagcgcgactgcggtcgggcaaa

SEQ ID NO: 556985 - DNA, 25 bp, Rattus norvegicus
ggcggtcagctctcgctaccgctgg

SEQ ID NO: 556986 - DNA, 25 bp, Rattus norvegicus
aggtcgtcctccgtgttccatgctc

SEQ ID NO: 556987 - DNA, 25 bp, Rattus norvegicus
gatggtcttgttctcgtaggctccc

SEQ ID NO: 556988 - DNA, 25 bp, Rattus norvegicus
ggctcgctcacatcgctggccgtgt

SEQ ID NO: 556989 - DNA, 25 bp, Rattus norvegicus
gtctgtcatcgcgatcgcctggcga

SEQ ID NO: 556990 - DNA, 25 bp, Rattus norvegicus
cgcgtgtacacacggtgaagcttca

SEQ ID NO: 556991 - DNA, 25 bp, Rattus norvegicus
cctagggtacctggccattgtcccg

SEQ ID NO: 556992 - DNA, 25 bp, Rattus norvegicus
gaacatgccgccgtacttctggcgc

SEQ ID NO: 556993 - DNA, 25 bp, Rattus norvegicus
cgcctggcgagctgacagcagagcc

SEQ ID NO: 556994 - DNA, 25 bp, Rattus norvegicus
gcccacgctgtaggcgtcgaagtcg

SEQ ID NO: 556995 - DNA, 25 bp, Rattus norvegicus
cggccagaaactgcgatccagagct

SEQ ID NO: 556996 - DNA, 25 bp, Rattus norvegicus
tgcctcccgcacctaggagttgcgg

SEQ ID NO: 556997 - DNA, 25 bp, Rattus norvegicus
tgccgtctgatcgaactctctgcct

SEQ ID NO: 556998 - DNA, 25 bp, Rattus norvegicus
gcagccaccgttgccgtctgatcga

SEQ ID NO: 556999 - DNA, 25 bp, Rattus norvegicus
tgcacctgcacacgcagaacgcgtt

SEQ ID NO: 557000 - DNA, 25 bp, Rattus norvegicus
tctgccgcatgcagctgagccagca

SEQ ID NO: 557001 - DNA, 25 bp, Rattus norvegicus
gtaccgggcgacgagtctgccgcat

SEQ ID NO: 557002 - DNA, 25 bp, Rattus norvegicus
atccagagctcctggtaccgggcga

SEQ ID NO: 557003 - DNA, 25 bp, Rattus norvegicus
ttttggtgggcgagctcctctacct

SEQ ID NO: 557004 - DNA, 25 bp, Rattus norvegicus
tcctctacctgactgtgcaggccta

SEQ ID NO: 557005 - DNA, 25 bp, Rattus norvegicus
caggcctatctctgacaacgtcagc

SEQ ID NO: 557006 - DNA, 25 bp, Rattus norvegicus
agcccatacacgcagcagcgcagtt

SEQ ID NO: 557007 - DNA, 25 bp, Rattus norvegicus
gcgctcagctctatgacctccgtgt

SEQ ID NO: 557008 - DNA, 25 bp, Rattus norvegicus
tgtcacccagggaaccggccagaaa

SEQ ID NO: 557009 - DNA, 25 bp, Rattus norvegicus
agcgcctgcagttccttcgtcttct

SEQ ID NO: 557010 - DNA, 25 bp, Rattus norvegicus
gcagtcttgactttgtccgcggcgc

SEQ ID NO: 557011 - DNA, 25 bp, Rattus norvegicus
gcttggccttgagttctgagatgta

SEQ ID NO: 557012 - DNA, 25 bp, Rattus norvegicus
tcgtcttctcttcgtgcagcttggc

SEQ ID NO: 557013 - DNA, 25 bp, Rattus norvegicus
agcacattcagcgtggcctgcagtc

SEQ ID NO: 557014 - DNA, 25 bp, Rattus norvegicus
taccagtctgcggatgtcacgttca

SEQ ID NO: 557015 - DNA, 25 bp, Rattus norvegicus
gtcacgttcacactcccgcttgatg

SEQ ID NO: 557016 - DNA, 25 bp, Rattus norvegicus
gcgtcggccagcaatgcagtcttga

SEQ ID NO: 557017 - DNA, 25 bp, Rattus norvegicus
gcacctcatcctggtgcgcctggta

SEQ ID NO: 557018 - DNA, 25 bp, Rattus norvegicus
tctggcgctcgccatcaaaggtcct

SEQ ID NO: 557019 - DNA, 25 bp, Rattus norvegicus
gcatgcagttgctgagtgcctcttc

SEQ ID NO: 557020 - DNA, 25 bp, Rattus norvegicus
tgcctcttctgcctgtttgcgcgca

SEQ ID NO: 557021 - DNA, 25 bp, Rattus norvegicus
gcgcgcagccttcagttccagaatc

SEQ ID NO: 557022 - DNA, 25 bp, Rattus norvegicus
gccttccttgatcttggcggtccgc

SEQ ID NO: 557023 - DNA, 25 bp, Rattus norvegicus
ggaggcactgctggctgctccgcta

SEQ ID NO: 557024 - DNA, 25 bp, Rattus norvegicus
catctccggaagagggccgattaca

SEQ ID NO: 557025 - DNA, 25 bp, Rattus norvegicus
tcgcttcgcgttcatctccggaaga

SEQ ID NO: 557026 - DNA, 25 bp, Rattus norvegicus
caggtcccggggaggagccatccac

SEQ ID NO: 557027 - DNA, 25 bp, Rattus norvegicus
ggccggacagtagaggcctcccttc

SEQ ID NO: 557028 - DNA, 25 bp, Rattus norvegicus
agcttgaacagctaggggcaggtcc

SEQ ID NO: 557029 - DNA, 25 bp, Rattus norvegicus
gggtcagcccgactggaaccacggc

SEQ ID NO: 557030 - DNA, 25 bp, Rattus norvegicus
ccatcccggggtatgaggtccttgc

SEQ ID NO: 557031 - DNA, 25 bp, Rattus norvegicus
ctatggactgcggagcagacggacc

SEQ ID NO: 557032 - DNA, 25 bp, Rattus norvegicus
gacggacccaaaggccgatctgctg

SEQ ID NO: 557033 - DNA, 25 bp, Rattus norvegicus
gagcaaagttgctgtcctctgcgtc

SEQ ID NO: 557034 - DNA, 25 bp, Rattus norvegicus
gcccaggggatgctccttctgctcg

SEQ ID NO: 557035 - DNA, 25 bp, Rattus norvegicus
atgctccttctgctcggttggcgcg

SEQ ID NO: 557036 - DNA, 25 bp, Rattus norvegicus
catccacggggcgtggccgttatgt

SEQ ID NO: 557037 - DNA, 25 bp, Rattus norvegicus
tcaggacaggaaccggccggccaac

SEQ ID NO: 557038 - DNA, 25 bp, Rattus norvegicus
acagggtggataccagcctttcttc

SEQ ID NO: 557039 - DNA, 25 bp, Rattus norvegicus
aacctggaccgtagccgaggaggct

SEQ ID NO: 557040 - DNA, 25 bp, Rattus norvegicus
acactctgggctccacctaggcaga

SEQ ID NO: 557041 - DNA, 25 bp, Rattus norvegicus
cctaggcagagaccctcaggacagg

SEQ ID NO: 557042 - DNA, 25 bp, Rattus norvegicus
cctggacgtaatgacaagacgactg

SEQ ID NO: 557043 - DNA, 25 bp, Rattus norvegicus
gagccaccggccagtgttccggagc

SEQ ID NO: 557044 - DNA, 25 bp, Rattus norvegicus
gagcgccgccaccacagaaaagatt

SEQ ID NO: 557045 - DNA, 25 bp, Rattus norvegicus
caagggtagcggtgtcctcgtcgca

SEQ ID NO: 557046 - DNA, 25 bp, Rattus norvegicus
ggcccgcggagaacccgtgcacgat

SEQ ID NO: 557047 - DNA, 25 bp, Rattus norvegicus
tcgtccctccgattggtgttttctc

SEQ ID NO: 557048 - DNA, 25 bp, Rattus norvegicus
ggtgttttctctcgccagtcatggg

SEQ ID NO: 557049 - DNA, 25 bp, Rattus norvegicus
cactcctcactcctggacgtaatga

SEQ ID NO: 557050 - DNA, 25 bp, Rattus norvegicus
aatgaactgttatgagaggcgcaga

SEQ ID NO: 557051 - DNA, 25 bp, Rattus norvegicus
cgccacacggtgaaggtgacgccga

SEQ ID NO: 557052 - DNA, 25 bp, Rattus norvegicus
gcgccgtcgggacgccagtgtctca

SEQ ID NO: 557053 - DNA, 25 bp, Rattus norvegicus
ccagtgtctcagcaacgcagagcca

SEQ ID NO: 557054 - DNA, 25 bp, Rattus norvegicus
cagccttctgggtctccgggaagag

SEQ ID NO: 557055 - DNA, 25 bp, Rattus norvegicus
tcagcaacgcagagccaaggcgccg

SEQ ID NO: 557056 - DNA, 25 bp, Rattus norvegicus
ataaagttgtttgaggcgagccggc

SEQ ID NO: 557057 - DNA, 25 bp, Rattus norvegicus
gtgacgccgagcaccgtgctgctgc

SEQ ID NO: 557058 - DNA, 25 bp, Rattus norvegicus
cctgaggcagccaatgagcgacttt

SEQ ID NO: 557059 - DNA, 25 bp, Rattus norvegicus
aatgagcgactttcgcgcggctgcc

SEQ ID NO: 557060 - DNA, 25 bp, Rattus norvegicus
catcctctggcgctaatgttcgggc

SEQ ID NO: 557061 - DNA, 25 bp, Rattus norvegicus
cactaacagggtcgcgccacgcgag

SEQ ID NO: 557062 - DNA, 25 bp, Rattus norvegicus
agacccagaatcttcggtgcttgtc

SEQ ID NO: 557063 - DNA, 25 bp, Rattus norvegicus
gtgcttgtccgaatccagccttctg

SEQ ID NO: 557064 - DNA, 25 bp, Rattus norvegicus
cgtccgggctgttgcggataaagtt

SEQ ID NO: 557065 - DNA, 25 bp, Rattus norvegicus
actgagccagttgtgtccaagccga

SEQ ID NO: 557066 - DNA, 25 bp, Rattus norvegicus
gtctgaagtctgaagatggggcctc

SEQ ID NO: 557067 - DNA, 25 bp, Rattus norvegicus
ctccctctgagtcgcttcaggaatg

SEQ ID NO: 557068 - DNA, 25 bp, Rattus norvegicus
tgttattaggcaggctcacgggctt

SEQ ID NO: 557069 - DNA, 25 bp, Rattus norvegicus
gcgcaccttgattcgcgagagcaca

SEQ ID NO: 557070 - DNA, 25 bp, Rattus norvegicus
caggcatgtcgaccactcagaggga

SEQ ID NO: 557071 - DNA, 25 bp, Rattus norvegicus
ccgaggtgtctactgtcccaactga

SEQ ID NO: 557072 - DNA, 25 bp, Rattus norvegicus
ccggaattaggacgcctggcacgaa

SEQ ID NO: 557073 - DNA, 25 bp, Rattus norvegicus
tgctagaagttggaagccaggactc

SEQ ID NO: 557074 - DNA, 25 bp, Rattus norvegicus
cgcgacgttagtcagcattgtaata

SEQ ID NO: 557075 - DNA, 25 bp, Rattus norvegicus
cagcactgcggctggtgagtttttc

SEQ ID NO: 557076 - DNA, 25 bp, Rattus norvegicus
ggccgctgcaatctccgcggttttg

SEQ ID NO: 557077 - DNA, 25 bp, Rattus norvegicus
agtttttcagggtcgttgtgccatg

SEQ ID NO: 557078 - DNA, 25 bp, Rattus norvegicus
cgagttttgctcctgggtccaacca

SEQ ID NO: 557079 - DNA, 25 bp, Rattus norvegicus
acatgctcccgttcttcctgggtga

SEQ ID NO: 557080 - DNA, 25 bp, Rattus norvegicus
cccatcctgtagctctggtaacacg

SEQ ID NO: 557081 - DNA, 25 bp, Rattus norvegicus
ctggtaacacgtccacggctgagga

SEQ ID NO: 557082 - DNA, 25 bp, Rattus norvegicus
gtccgagtgaccgagatcgacaaca

SEQ ID NO: 557083 - DNA, 25 bp, Rattus norvegicus
cgcggccacgaagaagacgccatca

SEQ ID NO: 557084 - DNA, 25 bp, Rattus norvegicus
ggccgcttcaagtatgtccgagtga

SEQ ID NO: 557085 - DNA, 25 bp, Rattus norvegicus
agggacatcgtcctgcgagccacca

SEQ ID NO: 557086 - DNA, 25 bp, Rattus norvegicus
ttcaaggacgtgctgctgaacctgc

SEQ ID NO: 557087 - DNA, 25 bp, Rattus norvegicus
gaacctgcgtcagggcagcctcata

SEQ ID NO: 557088 - DNA, 25 bp, Rattus norvegicus
tagagttcagcaccatcctcgaggg

SEQ ID NO: 557089 - DNA, 25 bp, Rattus norvegicus
caagtggcccgtcttcgagctcaag

SEQ ID NO: 557090 - DNA, 25 bp, Rattus norvegicus
gccatcagctgcctcaattgcatga

SEQ ID NO: 557091 - DNA, 25 bp, Rattus norvegicus
cccggaggcacgtaaagatcgaaca

SEQ ID NO: 557092 - DNA, 25 bp, Rattus norvegicus
gtttgaccgctacaagtttgagatc

SEQ ID NO: 557093 - DNA, 25 bp, Rattus norvegicus
aaatttctgcgagctttggcccggc

SEQ ID NO: 557094 - DNA, 25 bp, Rattus norvegicus
gcagccttgggctttgtaaatgata

SEQ ID NO: 557095 - DNA, 25 bp, Rattus norvegicus
gtaaatgatagtcagggcccgatcc

SEQ ID NO: 557096 - DNA, 25 bp, Rattus norvegicus
ggggtctcagacaacacgtacgtta

SEQ ID NO: 557097 - DNA, 25 bp, Rattus norvegicus
ccctctccagggagtgggcaatcta

SEQ ID NO: 557098 - DNA, 25 bp, Rattus norvegicus
ccctagaggatctggcaatgaaatt

SEQ ID NO: 557099 - DNA, 25 bp, Rattus norvegicus
ttctcagtaacactacccgggaata

SEQ ID NO: 557100 - DNA, 25 bp, Rattus norvegicus
cgcagagcctctttggggtaacatg

SEQ ID NO: 557101 - DNA, 25 bp, Rattus norvegicus
ggctgacgcacagggccaacttagg

SEQ ID NO: 557102 - DNA, 25 bp, Rattus norvegicus
ctggggactccggaagttactgtca

SEQ ID NO: 557103 - DNA, 25 bp, Rattus norvegicus
tggcactccctcactgcagcagatt

SEQ ID NO: 557104 - DNA, 25 bp, Rattus norvegicus
aagaggctcctacactgcccgggga

SEQ ID NO: 557105 - DNA, 25 bp, Rattus norvegicus
ccaaaccttcggagggcattcggtg

SEQ ID NO: 557106 - DNA, 25 bp, Rattus norvegicus
ggagatttccacaccagatttgctg

SEQ ID NO: 557107 - DNA, 25 bp, Rattus norvegicus
tgcacggtacactccagccgacagg

SEQ ID NO: 557108 - DNA, 25 bp, Rattus norvegicus
gagagctgcacggtacactccagcc

SEQ ID NO: 557109 - DNA, 25 bp, Rattus norvegicus
tacactccagccgacaggggcgcgg

SEQ ID NO: 557110 - DNA, 25 bp, Rattus norvegicus
acaggggcgcggtaccatgtcaagc

SEQ ID NO: 557111 - DNA, 25 bp, Rattus norvegicus
ggtaccatgtcaagctcgtgcccta

SEQ ID NO: 557112 - DNA, 25 bp, Rattus norvegicus
atgtcaagctcgtgccctacccatg

SEQ ID NO: 557113 - DNA, 25 bp, Rattus norvegicus
tcgtgccctacccatgggctggctg

SEQ ID NO: 557114 - DNA, 25 bp, Rattus norvegicus
ggacccggaagtggactgctccacc

SEQ ID NO: 557115 - DNA, 25 bp, Rattus norvegicus
gaagtggactgctccacccgggacc

SEQ ID NO: 557116 - DNA, 25 bp, Rattus norvegicus
agcgtcccaccggaccaacaatggg

SEQ ID NO: 557117 - DNA, 25 bp, Rattus norvegicus
accggaccaacaatggggctgctgc

SEQ ID NO: 557118 - DNA, 25 bp, Rattus norvegicus
tgccgctgctcggccagctattgct

SEQ ID NO: 557119 - DNA, 25 bp, Rattus norvegicus
agctattgctgctgtggccgctggc

SEQ ID NO: 557120 - DNA, 25 bp, Rattus norvegicus
catgggctggctgcgttcgcgcact

SEQ ID NO: 557121 - DNA, 25 bp, Rattus norvegicus
aggcctctgaggagagcgctctcaa

SEQ ID NO: 557122 - DNA, 25 bp, Rattus norvegicus
ctccgtggcttctccgaggcagaaa

SEQ ID NO: 557123 - DNA, 25 bp, Rattus norvegicus
gaagttttgaagactcggcccgagc

SEQ ID NO: 557124 - DNA, 25 bp, Rattus norvegicus
cgagctcggtcactgagtgtcgtgc

SEQ ID NO: 557125 - DNA, 25 bp, Rattus norvegicus
tgtcgtgcagacaagcaaagcagcg

SEQ ID NO: 557126 - DNA, 25 bp, Rattus norvegicus
gaggaggacttcgagcagtttctgc

SEQ ID NO: 557127 - DNA, 25 bp, Rattus norvegicus
tttctgctgcccgtcatccacgaga

SEQ ID NO: 557128 - DNA, 25 bp, Rattus norvegicus
catccacgagatgcgcgaggacatc

SEQ ID NO: 557129 - DNA, 25 bp, Rattus norvegicus
gggactccattttgttcgccgctcg

SEQ ID NO: 557130 - DNA, 25 bp, Rattus norvegicus
aagagcgagtcttcgtgagccgtcc

SEQ ID NO: 557131 - DNA, 25 bp, Rattus norvegicus
tcaagacgcaggtagaggcctctga

SEQ ID NO: 557132 - DNA, 25 bp, Rattus norvegicus
agagcgctctcaaccacctgcaggg

SEQ ID NO: 557133 - DNA, 25 bp, Rattus norvegicus
ctctggttgacggttgggactccat

SEQ ID NO: 557134 - DNA, 25 bp, Rattus norvegicus
gctgatccagatcaagacgcaggta

SEQ ID NO: 557135 - DNA, 25 bp, Rattus norvegicus
gatgaggcgcatctacggcagaatc

SEQ ID NO: 557136 - DNA, 25 bp, Rattus norvegicus
tacgagccgccagtcctgtttcgga

SEQ ID NO: 557137 - DNA, 25 bp, Rattus norvegicus
agcgttcccgctctctttaagtcgg

SEQ ID NO: 557138 - DNA, 25 bp, Rattus norvegicus
ttcggaggctgctgcataccatcag

SEQ ID NO: 557139 - DNA, 25 bp, Rattus norvegicus
gtcaccaaggccgaagccgaactgg

SEQ ID NO: 557140 - DNA, 25 bp, Rattus norvegicus
actagaggccttcgtgaggatgatc

SEQ ID NO: 557141 - DNA, 25 bp, Rattus norvegicus
tgtgcctcggatccacgctaaagcc

SEQ ID NO: 557142 - DNA, 25 bp, Rattus norvegicus
tgctggacatgattcgcggagactc

SEQ ID NO: 557143 - DNA, 25 bp, Rattus norvegicus
cctgctcgccaaggtggacgagttc

SEQ ID NO: 557144 - DNA, 25 bp, Rattus norvegicus
ggccacgtatcgcagagccacagca

SEQ ID NO: 557145 - DNA, 25 bp, Rattus norvegicus
tcggaaccctgtctcgagaggtctc

SEQ ID NO: 557146 - DNA, 25 bp, Rattus norvegicus
ccgcggaaggtaacgcgatcgctta

SEQ ID NO: 557147 - DNA, 25 bp, Rattus norvegicus
tcggacagaggatcacttccctggc

SEQ ID NO: 557148 - DNA, 25 bp, Rattus norvegicus
ggccagaatggaggagcaagtcacc

SEQ ID NO: 557149 - DNA, 25 bp, Rattus norvegicus
tgacaggccctggaatcgccggcct

SEQ ID NO: 557150 - DNA, 25 bp, Rattus norvegicus
gcgtccaccgcttggccagggctga

SEQ ID NO: 557151 - DNA, 25 bp, Rattus norvegicus
ggcagaagtgacaggccctggaatc

SEQ ID NO: 557152 - DNA, 25 bp, Rattus norvegicus
gccctcagctttgtccttcggcggt

SEQ ID NO: 557153 - DNA, 25 bp, Rattus norvegicus
aggagaggcgcccacccggtagcct

SEQ ID NO: 557154 - DNA, 25 bp, Rattus norvegicus
ctgcagccctcggagcgcaaggaga

SEQ ID NO: 557155 - DNA, 25 bp, Rattus norvegicus
gccgctttacgtaaggcgcaggcca

SEQ ID NO: 557156 - DNA, 25 bp, Rattus norvegicus
cgcgctgatgtaatcccggcgcctg

SEQ ID NO: 557157 - DNA, 25 bp, Rattus norvegicus
ccttgcggtgtcaggatcttcagca

SEQ ID NO: 557158 - DNA, 25 bp, Rattus norvegicus
catgttggaagggttcggcaaagcc

SEQ ID NO: 557159 - DNA, 25 bp, Rattus norvegicus
gtgaagcttcaaagtctcagatccc

SEQ ID NO: 557160 - DNA, 25 bp, Rattus norvegicus
tctcaggacctggtgaagcttcaaa

SEQ ID NO: 557161 - DNA, 25 bp, Rattus norvegicus
gcgccctctctcaggacctggtgaa

SEQ ID NO: 557162 - DNA, 25 bp, Rattus norvegicus
ccgttgccaggtaacgcagcggagc

SEQ ID NO: 557163 - DNA, 25 bp, Rattus norvegicus
ggcgtctgcagtgtctagcctccta

SEQ ID NO: 557164 - DNA, 25 bp, Rattus norvegicus
caacgctcctgtcccttggcgtgtg

SEQ ID NO: 557165 - DNA, 25 bp, Rattus norvegicus
cggtgtggacactgtgactctctca

SEQ ID NO: 557166 - DNA, 25 bp, Rattus norvegicus
gagatttcttcgcagctccgcttgg

SEQ ID NO: 557167 - DNA, 25 bp, Rattus norvegicus
ctccgcttggccttgaggacagaaa

SEQ ID NO: 557168 - DNA, 25 bp, Rattus norvegicus
aacccagggcgaatacttggcaggc

SEQ ID NO: 557169 - DNA, 25 bp, Rattus norvegicus
atacttggcaggctggaggaccagc

SEQ ID NO: 557170 - DNA, 25 bp, Rattus norvegicus
ctgcagggtcaagctgacaggttgc

SEQ ID NO: 557171 - DNA, 25 bp, Rattus norvegicus
aatgtcaggctccaagctctacgga

SEQ ID NO: 557172 - DNA, 25 bp, Rattus norvegicus
gccgctgacaggcacctgctgtggc

SEQ ID NO: 557173 - DNA, 25 bp, Rattus norvegicus
tctagcctcctagcccagcaagttg

SEQ ID NO: 557174 - DNA, 25 bp, Rattus norvegicus
agggttgacgctgaccgctgccacc

SEQ ID NO: 557175 - DNA, 25 bp, Rattus norvegicus
gactgccctcggtcagagcttgtct

SEQ ID NO: 557176 - DNA, 25 bp, Rattus norvegicus
aggaccagcgccagtaaatgtcagg

SEQ ID NO: 557177 - DNA, 25 bp, Rattus norvegicus
actcactgggcatggagcctccggc

SEQ ID NO: 557178 - DNA, 25 bp, Rattus norvegicus
acgcgcctctgaggcctggcgttca

SEQ ID NO: 557179 - DNA, 25 bp, Rattus norvegicus
gcccagcttggccttcactagagtc

SEQ ID NO: 557180 - DNA, 25 bp, Rattus norvegicus
tggcctccactcactgggcatggag

SEQ ID NO: 557181 - DNA, 25 bp, Rattus norvegicus
acgctggagtgaggctggcctccac

SEQ ID NO: 557182 - DNA, 25 bp, Rattus norvegicus
ctggcgttcatggtgagtcttatgc

SEQ ID NO: 557183 - DNA, 25 bp, Rattus norvegicus
atccgtggtccagacgctggagtga

SEQ ID NO: 557184 - DNA, 25 bp, Rattus norvegicus
agctgcgtgtagatccgtggtccag

SEQ ID NO: 557185 - DNA, 25 bp, Rattus norvegicus
acccgcccagtgtggagctgcgtgt

SEQ ID NO: 557186 - DNA, 25 bp, Rattus norvegicus
attgagtgtcctgccgtcccggcca

SEQ ID NO: 557187 - DNA, 25 bp, Rattus norvegicus
ctgcatctgtgagcgattgagtgtc

SEQ ID NO: 557188 - DNA, 25 bp, Rattus norvegicus
agtcttatgcgggtctgccgcccag

SEQ ID NO: 557189 - DNA, 25 bp, Rattus norvegicus
ttcactagagtctcggcctgccctt

SEQ ID NO: 557190 - DNA, 25 bp, Rattus norvegicus
ccttcaaggcctgcttggtcctgtg

SEQ ID NO: 557191 - DNA, 25 bp, Rattus norvegicus
gggcctggcattggccgcagtctct

SEQ ID NO: 557192 - DNA, 25 bp, Rattus norvegicus
gcagcccggggctacttggcctgca

SEQ ID NO: 557193 - DNA, 25 bp, Rattus norvegicus
tcgcggctcagacttggccgccgca

SEQ ID NO: 557194 - DNA, 25 bp, Rattus norvegicus
ggatcctccctcttcgcggctcaga

SEQ ID NO: 557195 - DNA, 25 bp, Rattus norvegicus
cctcgtgggtgctccaaagggccga

SEQ ID NO: 557196 - DNA, 25 bp, Rattus norvegicus
ccgggcgcctcgtgggtgctccaaa

SEQ ID NO: 557197 - DNA, 25 bp, Rattus norvegicus
ctccgcagcgcttggtgggatgcta

SEQ ID NO: 557198 - DNA, 25 bp, Rattus norvegicus
cctttgcctccgcagcgcttggtgg

SEQ ID NO: 557199 - DNA, 25 bp, Rattus norvegicus
tggaccggatccacccggcccgcca

SEQ ID NO: 557200 - DNA, 25 bp, Rattus norvegicus
gcagcagggtgtccgctcctcgtgt

SEQ ID NO: 557201 - DNA, 25 bp, Rattus norvegicus
cagtctctggggcacgtgacccgtg

SEQ ID NO: 557202 - DNA, 25 bp, Rattus norvegicus
tcgtgcccggcgagccgcatggcca

SEQ ID NO: 557203 - DNA, 25 bp, Rattus norvegicus
ggctacttggcctgcagcggctacc

SEQ ID NO: 557204 - DNA, 25 bp, Rattus norvegicus
gcacgtgacccgtggaccggatcca

SEQ ID NO: 557205 - DNA, 25 bp, Rattus norvegicus
ttcagctgcctaaaggagccgccgc

SEQ ID NO: 557206 - DNA, 25 bp, Rattus norvegicus
gagtgtccactacggccctgcgcag

SEQ ID NO: 557207 - DNA, 25 bp, Rattus norvegicus
tttctctgtcccagtatccgccgtt

SEQ ID NO: 557208 - DNA, 25 bp, Rattus norvegicus
tggctacttgatggattgcgcagtc

SEQ ID NO: 557209 - DNA, 25 bp, Rattus norvegicus
acagcggccgttggtgtctggccac

SEQ ID NO: 557210 - DNA, 25 bp, Rattus norvegicus
gactcggatcttccgggcctaaatc

SEQ ID NO: 557211 - DNA, 25 bp, Rattus norvegicus
tcagcgcctcaatacggggcggatg

SEQ ID NO: 557212 - DNA, 25 bp, Rattus norvegicus
cgctttcaccatcgctttctggtcg

SEQ ID NO: 557213 - DNA, 25 bp, Rattus norvegicus
gaccctcagctccatggcagcggtg

SEQ ID NO: 557214 - DNA, 25 bp, Rattus norvegicus
atcttgcggcccagtcggtacctgt

SEQ ID NO: 557215 - DNA, 25 bp, Rattus norvegicus
ccgaaggagccgctgccgatcttgc

SEQ ID NO: 557216 - DNA, 25 bp, Rattus norvegicus
cgagatagatgtctccgaaggagcc

SEQ ID NO: 557217 - DNA, 25 bp, Rattus norvegicus
cgctgggcctcaccgagatagatgt

SEQ ID NO: 557218 - DNA, 25 bp, Rattus norvegicus
tcgcaaccaggcctgtttctctgtc

SEQ ID NO: 557219 - DNA, 25 bp, Rattus norvegicus
agtactgcgtgtactgcttggccga

SEQ ID NO: 557220 - DNA, 25 bp, Rattus norvegicus
cccgcgattggtcatttgcttttcc

SEQ ID NO: 557221 - DNA, 25 bp, Rattus norvegicus
ccatcgagcagttcggcttcggcaa

SEQ ID NO: 557222 - DNA, 25 bp, Rattus norvegicus
ggctgcctgatcaggccttcctcgg

SEQ ID NO: 557223 - DNA, 25 bp, Rattus norvegicus
tcacactctggggtcctgaggcaga

SEQ ID NO: 557224 - DNA, 25 bp, Rattus norvegicus
ccgctgatgcctgctgttaggtttc

SEQ ID NO: 557225 - DNA, 25 bp, Rattus norvegicus
gagcagctgctactggacgccatcg

SEQ ID NO: 557226 - DNA, 25 bp, Rattus norvegicus
cctcccggtaatattaggccaatga

SEQ ID NO: 557227 - DNA, 25 bp, Rattus norvegicus
ggccaatgaagatctgcgaacaggt

SEQ ID NO: 557228 - DNA, 25 bp, Rattus norvegicus
aggcgctaattggacgctggcttgc

SEQ ID NO: 557229 - DNA, 25 bp, Rattus norvegicus
ttgcggcttctccagtccatgaggc

SEQ ID NO: 557230 - DNA, 25 bp, Rattus norvegicus
agagcaaaagctctgctgtccgcga

SEQ ID NO: 557231 - DNA, 25 bp, Rattus norvegicus
ccgctgcacagagtgccaggacatc

SEQ ID NO: 557232 - DNA, 25 bp, Rattus norvegicus
tggctgtccatattcgacccgctgg

SEQ ID NO: 557233 - DNA, 25 bp, Rattus norvegicus
gagagtaccgtgtgtcgcctgacaa

SEQ ID NO: 557234 - DNA, 25 bp, Rattus norvegicus
cgtctgccgcaagcacgctatgtca

SEQ ID NO: 557235 - DNA, 25 bp, Rattus norvegicus
cgagtcatgacagagtaccggttcc

SEQ ID NO: 557236 - DNA, 25 bp, Rattus norvegicus
ctaggctccggctacattctgccaa

SEQ ID NO: 557237 - DNA, 25 bp, Rattus norvegicus
gccagttgactggtgttcgctctag

SEQ ID NO: 557238 - DNA, 25 bp, Rattus norvegicus
gaccgtggaacgcatgccagttgac

SEQ ID NO: 557239 - DNA, 25 bp, Rattus norvegicus
cgcgcccggagatagccaatgaaga

SEQ ID NO: 557240 - DNA, 25 bp, Rattus norvegicus
tttagctaatccgtgatcgccgttg

SEQ ID NO: 557241 - DNA, 25 bp, Rattus norvegicus
cccacctactgctgttgtttagcta

SEQ ID NO: 557242 - DNA, 25 bp, Rattus norvegicus
ggagcagtgctctcttacctgaacg

SEQ ID NO: 557243 - DNA, 25 bp, Rattus norvegicus
gctgctaatgtcctcgccagagctc

SEQ ID NO: 557244 - DNA, 25 bp, Rattus norvegicus
cctgacaagcaaatggcggagcctt

SEQ ID NO: 557245 - DNA, 25 bp, Rattus norvegicus
tccgactgtgaggatgagacttcag

SEQ ID NO: 557246 - DNA, 25 bp, Rattus norvegicus
tcgccgttgttctgatggacagata

SEQ ID NO: 557247 - DNA, 25 bp, Rattus norvegicus
atcggagctcccaggttctgctgcc

SEQ ID NO: 557248 - DNA, 25 bp, Rattus norvegicus
ggtcactcctgctgggcattcttgg

SEQ ID NO: 557249 - DNA, 25 bp, Rattus norvegicus
cacctcgggatacccagggagacta

SEQ ID NO: 557250 - DNA, 25 bp, Rattus norvegicus
cagcagcgtaagtgacctccgcacg

SEQ ID NO: 557251 - DNA, 25 bp, Rattus norvegicus
ctggacaggagagaacagcagcgta

SEQ ID NO: 557252 - DNA, 25 bp, Rattus norvegicus
cgcgacgcacaaccaggcgatggta

SEQ ID NO: 557253 - DNA, 25 bp, Rattus norvegicus
cacgtcgttcgtgctcaagggagac

SEQ ID NO: 557254 - DNA, 25 bp, Rattus norvegicus
ggtctcgctcatcagcacgtcgttc

SEQ ID NO: 557255 - DNA, 25 bp, Rattus norvegicus
gttctgcttcgggtcccagcactga

SEQ ID NO: 557256 - DNA, 25 bp, Rattus norvegicus
acacgagaatcggagcctggcgtcc

SEQ ID NO: 557257 - DNA, 25 bp, Rattus norvegicus
ccaggatccgcagacacgagaatcg

SEQ ID NO: 557258 - DNA, 25 bp, Rattus norvegicus
gtcccagtgtgcaggtcaccaggct

SEQ ID NO: 557259 - DNA, 25 bp, Rattus norvegicus
acggagtccagcaatcgccaggatc

SEQ ID NO: 557260 - DNA, 25 bp, Rattus norvegicus
ttctctgcgctcttgctcaagcttc

SEQ ID NO: 557261 - DNA, 25 bp, Rattus norvegicus
ctgtcctgtaagtccaagtatgcgg

SEQ ID NO: 557262 - DNA, 25 bp, Rattus norvegicus
cgcagctcagcgatctcagtctgga

SEQ ID NO: 557263 - DNA, 25 bp, Rattus norvegicus
agcgtccgctgcctcaacaatggag

SEQ ID NO: 557264 - DNA, 25 bp, Rattus norvegicus
cacctcaggattcagtggctcgtga

SEQ ID NO: 557265 - DNA, 25 bp, Rattus norvegicus
gtccagggacatcgtgggacacctg

SEQ ID NO: 557266 - DNA, 25 bp, Rattus norvegicus
cagagacgctgccttgtcaggagtc

SEQ ID NO: 557267 - DNA, 25 bp, Rattus norvegicus
ggagatcttcgagcagttcctggaa

SEQ ID NO: 557268 - DNA, 25 bp, Rattus norvegicus
agagaccctgccctgtccagagacg

SEQ ID NO: 557269 - DNA, 25 bp, Rattus norvegicus
cgtccagccctgtatagagaccctg

SEQ ID NO: 557270 - DNA, 25 bp, Rattus norvegicus
cccagttctgtctggggaccctgca

SEQ ID NO: 557271 - DNA, 25 bp, Rattus norvegicus
ggacccgccctctagccaatggtga

SEQ ID NO: 557272 - DNA, 25 bp, Rattus norvegicus
aagtatgcggtctgcccttgtccga

SEQ ID NO: 557273 - DNA, 25 bp, Rattus norvegicus
ccttgtccgatgttgggagatcttc

SEQ ID NO: 557274 - DNA, 25 bp, Rattus norvegicus
ggagaccctgcccagccttgtctgg

SEQ ID NO: 557275 - DNA, 25 bp, Rattus norvegicus
agaaattggctacgcactgcaggta

SEQ ID NO: 557276 - DNA, 25 bp, Rattus norvegicus
ggtatacctagtcctcgagacccta

SEQ ID NO: 557277 - DNA, 25 bp, Rattus norvegicus
accctaccggggttgcagctatgag

SEQ ID NO: 557278 - DNA, 25 bp, Rattus norvegicus
gttgcagctatgagcctacggatca

SEQ ID NO: 557279 - DNA, 25 bp, Rattus norvegicus
tacggatcaccggtcgcagctctca

SEQ ID NO: 557280 - DNA, 25 bp, Rattus norvegicus
tcatgtcagcggcagctcccagtag

SEQ ID NO: 557281 - DNA, 25 bp, Rattus norvegicus
ccgcagttggacgtgtggactacaa

SEQ ID NO: 557282 - DNA, 25 bp, Rattus norvegicus
ccgctgggctcaggaattagctaga

SEQ ID NO: 557283 - DNA, 25 bp, Rattus norvegicus
tgtgtgttccgctcaggcgcagact

SEQ ID NO: 557284 - DNA, 25 bp, Rattus norvegicus
agactggtggtagcgcaggtaccct

SEQ ID NO: 557285 - DNA, 25 bp, Rattus norvegicus
aagggattccggcttacgcagctcc

SEQ ID NO: 557286 - DNA, 25 bp, Rattus norvegicus
cccggctcagagatagaggctgccg

SEQ ID NO: 557287 - DNA, 25 bp, Rattus norvegicus
gcctttcggggctgcacaccctgga

SEQ ID NO: 557288 - DNA, 25 bp, Rattus norvegicus
ctggcacgatcctcagcacgcttga

SEQ ID NO: 557289 - DNA, 25 bp, Rattus norvegicus
cgctgccgttggacccacacggtgt

SEQ ID NO: 557290 - DNA, 25 bp, Rattus norvegicus
gcggactgccttggcctttaagcgc

SEQ ID NO: 557291 - DNA, 25 bp, Rattus norvegicus
ccgccagccgtcgtgcgttgcagat

SEQ ID NO: 557292 - DNA, 25 bp, Rattus norvegicus
tgtgtggcacagacgggcacacata

SEQ ID NO: 557293 - DNA, 25 bp, Rattus norvegicus
cgttgcagatctccgggactccagt

SEQ ID NO: 557294 - DNA, 25 bp, Rattus norvegicus
tggactcgccatgcggggacagtct

SEQ ID NO: 557295 - DNA, 25 bp, Rattus norvegicus
cctctgcaactgctgcttggtgtgc

SEQ ID NO: 557296 - DNA, 25 bp, Rattus norvegicus
ggggctatgtgccagacctctgcaa

SEQ ID NO: 557297 - DNA, 25 bp, Rattus norvegicus
tggccacgctagctgtgtcggtcct

SEQ ID NO: 557298 - DNA, 25 bp, Rattus norvegicus
ccgagccagagtgcgcctgagccgt

SEQ ID NO: 557299 - DNA, 25 bp, Rattus norvegicus
gcccgttttgcgctccgagccagag

SEQ ID NO: 557300 - DNA, 25 bp, Rattus norvegicus
cgctcaactgaaagaggctcgggtc

SEQ ID NO: 557301 - DNA, 25 bp, Rattus norvegicus
taagcgcccgctgacgctcaactga

SEQ ID NO: 557302 - DNA, 25 bp, Rattus norvegicus
acacatatgccgacgtgtgcgcgct

SEQ ID NO: 557303 - DNA, 25 bp, Rattus norvegicus
cggatccagcttgcggtcggtccgt

SEQ ID NO: 557304 - DNA, 25 bp, Rattus norvegicus
ggtaagtcctcaccgcccggatcca

SEQ ID NO: 557305 - DNA, 25 bp, Rattus norvegicus
gcctgaagccttgcgtcatcatgct

SEQ ID NO: 557306 - DNA, 25 bp, Rattus norvegicus
gtcggtccgtggtcctagtactggc

SEQ ID NO: 557307 - DNA, 25 bp, Rattus norvegicus
cgcgtcgtcgccagggaaacgcaga

SEQ ID NO: 557308 - DNA, 25 bp, Rattus norvegicus
gtcggtccggcaaacactgttgatc

SEQ ID NO: 557309 - DNA, 25 bp, Rattus norvegicus
cggcaaacactgttgatcaggaatg

SEQ ID NO: 557310 - DNA, 25 bp, Rattus norvegicus
tgttgatcaggaatgtccagacctc

SEQ ID NO: 557311 - DNA, 25 bp, Rattus norvegicus
tgtccagacctctgagggtggagca

SEQ ID NO: 557312 - DNA, 25 bp, Rattus norvegicus
atcccggaacgtgacgtcatccctc

SEQ ID NO: 557313 - DNA, 25 bp, Rattus norvegicus
gtcatccctcccttgactcgggttg

SEQ ID NO: 557314 - DNA, 25 bp, Rattus norvegicus
cctcccttgactcgggttgctgctg

SEQ ID NO: 557315 - DNA, 25 bp, Rattus norvegicus
ctgcctgaagccttgcgtcatcatg

SEQ ID NO: 557316 - DNA, 25 bp, Rattus norvegicus
tagtactggcgtcggtccggcaaac

SEQ ID NO: 557317 - DNA, 25 bp, Rattus norvegicus
tgagccaatgctcttccgggtcgcg

SEQ ID NO: 557318 - DNA, 25 bp, Rattus norvegicus
gtcgcgtcatcccaatgcgccgaga

SEQ ID NO: 557319 - DNA, 25 bp, Rattus norvegicus
agctccgtagagtgccgctagacga

SEQ ID NO: 557320 - DNA, 25 bp, Rattus norvegicus
cctgattctctgctacccggaggtt

SEQ ID NO: 557321 - DNA, 25 bp, Rattus norvegicus
ggtcttccggctctaattcccatga

SEQ ID NO: 557322 - DNA, 25 bp, Rattus norvegicus
gcccgcatagaagcccgtgggagaa

SEQ ID NO: 557323 - DNA, 25 bp, Rattus norvegicus
tgggagaactttgcggcccagtgcc

SEQ ID NO: 557324 - DNA, 25 bp, Rattus norvegicus
gctgacctggacttgctatggaacc

SEQ ID NO: 557325 - DNA, 25 bp, Rattus norvegicus
tggaaccgagtctcccaaagcctcg

SEQ ID NO: 557326 - DNA, 25 bp, Rattus norvegicus
ccggaaatactgaccttctatggcc

SEQ ID NO: 557327 - DNA, 25 bp, Rattus norvegicus
ccctcgttgggttctcctcctgaag

SEQ ID NO: 557328 - DNA, 25 bp, Rattus norvegicus
aggagctcgacctggttctcagaac

SEQ ID NO: 557329 - DNA, 25 bp, Rattus norvegicus
tctcagaaccgtcatcccgaaagcg

SEQ ID NO: 557330 - DNA, 25 bp, Rattus norvegicus
gtgccgctagacgaccctgattctc

SEQ ID NO: 557331 - DNA, 25 bp, Rattus norvegicus
ctgctggctgcgctagctgctttgg

SEQ ID NO: 557332 - DNA, 25 bp, Rattus norvegicus
gctgacgattgtaacccgactccta

SEQ ID NO: 557333 - DNA, 25 bp, Rattus norvegicus
tgacgattgtaacccgactcctacg

SEQ ID NO: 557334 - DNA, 25 bp, Rattus norvegicus
gcctcccagccgctgggcccagcag

SEQ ID NO: 557335 - DNA, 25 bp, Rattus norvegicus
gtgccacatcactgcgccctcccgc

SEQ ID NO: 557336 - DNA, 25 bp, Rattus norvegicus
cgcgcatccgcgcatctgtgcccac

SEQ ID NO: 557337 - DNA, 25 bp, Rattus norvegicus
atgcctacaacgccgctgctgctgg

SEQ ID NO: 557338 - DNA, 25 bp, Rattus norvegicus
gctggctgcgctagctgctttggcc

SEQ ID NO: 557339 - DNA, 25 bp, Rattus norvegicus
gcgctggccgttgctgcgtactcca

SEQ ID NO: 557340 - DNA, 25 bp, Rattus norvegicus
ctggccgttgctgcgtactccagct

SEQ ID NO: 557341 - DNA, 25 bp, Rattus norvegicus
gttgctgcgtactccagctgctcgc

SEQ ID NO: 557342 - DNA, 25 bp, Rattus norvegicus
tgcgtactccagctgctcgcctgga

SEQ ID NO: 557343 - DNA, 25 bp, Rattus norvegicus
ccagctgctcgcctggacctgaccc

SEQ ID NO: 557344 - DNA, 25 bp, Rattus norvegicus
atctgtgcccaccatgcctacaacg

SEQ ID NO: 557345 - DNA, 25 bp, Rattus norvegicus
gctcgccctggccaaaggccagaag

SEQ ID NO: 557346 - DNA, 25 bp, Rattus norvegicus
atgtgctgtaaggcgcgggatcaat

SEQ ID NO: 557347 - DNA, 25 bp, Rattus norvegicus
accattaggctaatgtgatgtgctg

SEQ ID NO: 557348 - DNA, 25 bp, Rattus norvegicus
agttgaatcatcagagaaaccatta

SEQ ID NO: 557349 - DNA, 25 bp, Rattus norvegicus
ctgcagatcccagaggcgaggtcct

SEQ ID NO: 557350 - DNA, 25 bp, Rattus norvegicus
ctagtctaaggtgagcgccaggttc

SEQ ID NO: 557351 - DNA, 25 bp, Rattus norvegicus
ggcccggaagctctagtctaaggtg

SEQ ID NO: 557352 - DNA, 25 bp, Rattus norvegicus
tctgactccggaaggcccggaagct

SEQ ID NO: 557353 - DNA, 25 bp, Rattus norvegicus
actggaaggttcgagggtctgactc

SEQ ID NO: 557354 - DNA, 25 bp, Rattus norvegicus
tctctggtttgaactggaaggttcg

SEQ ID NO: 557355 - DNA, 25 bp, Rattus norvegicus
aggctcatctctggtttgaactgga

SEQ ID NO: 557356 - DNA, 25 bp, Rattus norvegicus
cccagcggtcactgtgcttcggagc

SEQ ID NO: 557357 - DNA, 25 bp, Rattus norvegicus
tgcaggaccgattggctgccggcct

SEQ ID NO: 557358 - DNA, 25 bp, Rattus norvegicus
tgcttcggagctgccaggctcatct

SEQ ID NO: 557359 - DNA, 25 bp, Rattus norvegicus
acaggacgcgttgcatctcttaagc

SEQ ID NO: 557360 - DNA, 25 bp, Rattus norvegicus
gggacgttcctgcaacacagctttc

SEQ ID NO: 557361 - DNA, 25 bp, Rattus norvegicus
atctggcgcccatctctgctgaaga

SEQ ID NO: 557362 - DNA, 25 bp, Rattus norvegicus
cacagctttctgcacgcattagcca

SEQ ID NO: 557363 - DNA, 25 bp, Rattus norvegicus
gcattagccaacctgtgcgcggtga

SEQ ID NO: 557364 - DNA, 25 bp, Rattus norvegicus
ctgggtttcgagcatctgagtgaca

SEQ ID NO: 557365 - DNA, 25 bp, Rattus norvegicus
tgagcgcacgttcacgagctgcaca

SEQ ID NO: 557366 - DNA, 25 bp, Rattus norvegicus
agtgggctcagaaccttgctccgaa

SEQ ID NO: 557367 - DNA, 25 bp, Rattus norvegicus
aaacccagcttgcacctctcagagg

SEQ ID NO: 557368 - DNA, 25 bp, Rattus norvegicus
gccaagtcgcctgtgagcggagttt

SEQ ID NO: 557369 - DNA, 25 bp, Rattus norvegicus
ttccgcgaactggtgactcgaaggc

SEQ ID NO: 557370 - DNA, 25 bp, Rattus norvegicus
tggcgtggccggttattaataccca

SEQ ID NO: 557371 - DNA, 25 bp, Rattus norvegicus
tattaatacccagaccggcgcattc

SEQ ID NO: 557372 - DNA, 25 bp, Rattus norvegicus
gcagtgactggcattgaaaactttc

SEQ ID NO: 557373 - DNA, 25 bp, Rattus norvegicus
gataacaatatgatgcctccttatg

SEQ ID NO: 557374 - DNA, 25 bp, Rattus norvegicus
ctgcggcgaattgataacaatatga

SEQ ID NO: 557375 - DNA, 25 bp, Rattus norvegicus
gcgaaggcaggcacattgatctatt

SEQ ID NO: 557376 - DNA, 25 bp, Rattus norvegicus
gcctccttatgtggccgaggaaata

SEQ ID NO: 557377 - DNA, 25 bp, Rattus norvegicus
ccgaggaaatatgtacgcgcgcaaa

SEQ ID NO: 557378 - DNA, 25 bp, Rattus norvegicus
gtacgcgcgcaaacgcgcagaaata

SEQ ID NO: 557379 - DNA, 25 bp, Rattus norvegicus
ggcaggcacattgatctattgcaga

SEQ ID NO: 557380 - DNA, 25 bp, Rattus norvegicus
tacacacgcggacttgagcgctgtg

SEQ ID NO: 557381 - DNA, 25 bp, Rattus norvegicus
acttgagcgctgtgcgccacagaga

SEQ ID NO: 557382 - DNA, 25 bp, Rattus norvegicus
gcgcagaaatatataaggacacacc

SEQ ID NO: 557383 - DNA, 25 bp, Rattus norvegicus
tataaggacacacccgcacaggtac

SEQ ID NO: 557384 - DNA, 25 bp, Rattus norvegicus
caggtacaatacacacgcggacttg

SEQ ID NO: 557385 - DNA, 25 bp, Rattus norvegicus
ttgatctattgcagagcgctgcggc

SEQ ID NO: 557386 - DNA, 25 bp, Rattus norvegicus
ccacagagagggagcgatgccgccc

SEQ ID NO: 557387 - DNA, 25 bp, Rattus norvegicus
gtgtgcagaccgcagcagactgcaa

SEQ ID NO: 557388 - DNA, 25 bp, Rattus norvegicus
gagcgtttcgggcctggactccgcc

SEQ ID NO: 557389 - DNA, 25 bp, Rattus norvegicus
tccgccagcacccttgttcatgtag

SEQ ID NO: 557390 - DNA, 25 bp, Rattus norvegicus
tcatgtagccccctgttcctgatac

SEQ ID NO: 557391 - DNA, 25 bp, Rattus norvegicus
ctgccttcagcacggaacgggacct

SEQ ID NO: 557392 - DNA, 25 bp, Rattus norvegicus
cagcagactgcaagacgccaggtga

SEQ ID NO: 557393 - DNA, 25 bp, Rattus norvegicus
cgggacctttactaagcgatgctgg

SEQ ID NO: 557394 - DNA, 25 bp, Rattus norvegicus
tgcaagacgccaggtgagcggccta

SEQ ID NO: 557395 - DNA, 25 bp, Rattus norvegicus
gaacgggacctttactaagcgatgc

SEQ ID NO: 557396 - DNA, 25 bp, Rattus norvegicus
cctttactaagcgatgctgggcacc

SEQ ID NO: 557397 - DNA, 25 bp, Rattus norvegicus
tactaagcgatgctgggcacctagc

SEQ ID NO: 557398 - DNA, 25 bp, Rattus norvegicus
ctaagcgatgctgggcacctagccc

SEQ ID NO: 557399 - DNA, 25 bp, Rattus norvegicus
ctagcccccgtagggacacagaggg

SEQ ID NO: 557400 - DNA, 25 bp, Rattus norvegicus
gatggtgtgcagaccgcagcagact

SEQ ID NO: 557401 - DNA, 25 bp, Rattus norvegicus
gcgccggaaacagaagacctagatc

SEQ ID NO: 557402 - DNA, 25 bp, Rattus norvegicus
cgcaaggtcgcgacctttaagccct

SEQ ID NO: 557403 - DNA, 25 bp, Rattus norvegicus
ctgcgtcgcaaggtcgcgaccttta

SEQ ID NO: 557404 - DNA, 25 bp, Rattus norvegicus
acactgcgtcgcaaggtcgcgacct

SEQ ID NO: 557405 - DNA, 25 bp, Rattus norvegicus
aacagaagacctagatcccagaccc

SEQ ID NO: 557406 - DNA, 25 bp, Rattus norvegicus
ctttaagcccttttgcctcctcact

SEQ ID NO: 557407 - DNA, 25 bp, Rattus norvegicus
ctacttgcgccggaaacagaagacc

SEQ ID NO: 557408 - DNA, 25 bp, Rattus norvegicus
cacagatctacttgcgccggaaaca

SEQ ID NO: 557409 - DNA, 25 bp, Rattus norvegicus
gccacagatctacttgcgccggaaa

SEQ ID NO: 557410 - DNA, 25 bp, Rattus norvegicus
gcactctgcgccacagatctacttg

SEQ ID NO: 557411 - DNA, 25 bp, Rattus norvegicus
tcactggcgcccgtatcccgagtga

SEQ ID NO: 557412 - DNA, 25 bp, Rattus norvegicus
cgcccttcgcgtgtgtctcctgtgg

SEQ ID NO: 557413 - DNA, 25 bp, Rattus norvegicus
gcccgtatcccgagtgaggagtccg

SEQ ID NO: 557414 - DNA, 25 bp, Rattus norvegicus
ttcgcgtgtgtctcctgtggggccc

SEQ ID NO: 557415 - DNA, 25 bp, Rattus norvegicus
tcctgggagagccacgagagaacca

SEQ ID NO: 557416 - DNA, 25 bp, Rattus norvegicus
ttgtagaggagtcacctcctgaacg

SEQ ID NO: 557417 - DNA, 25 bp, Rattus norvegicus
tccacagccggatgagtcgaagtgc

SEQ ID NO: 557418 - DNA, 25 bp, Rattus norvegicus
aagtgcgttgagtccgggattcgta

SEQ ID NO: 557419 - DNA, 25 bp, Rattus norvegicus
gccggctcaatcctgggttgctcag

SEQ ID NO: 557420 - DNA, 25 bp, Rattus norvegicus
aaacccgagctcctgttgtagagga

SEQ ID NO: 557421 - DNA, 25 bp, Rattus norvegicus
ggtgttttagcccttctccatccgc

SEQ ID NO: 557422 - DNA, 25 bp, Rattus norvegicus
cctgaacggcaggacgcgtgcaaag

SEQ ID NO: 557423 - DNA, 25 bp, Rattus norvegicus
cgcgtgcaaaggatcgcagccactg

SEQ ID NO: 557424 - DNA, 25 bp, Rattus norvegicus
agagtcgagcggagaataacgtcgc

SEQ ID NO: 557425 - DNA, 25 bp, Rattus norvegicus
aataacgtcgccgtgtcctgggaga

SEQ ID NO: 557426 - DNA, 25 bp, Rattus norvegicus
cccttagaggtggtgccggctcaat

SEQ ID NO: 557427 - DNA, 25 bp, Rattus norvegicus
tgctcggtctgcttaggtgttttag

SEQ ID NO: 557428 - DNA, 25 bp, Rattus norvegicus
tagccggaggtgcaagtaagaaacc

SEQ ID NO: 557429 - DNA, 25 bp, Rattus norvegicus
gtacactctggagcagctgcccacg

SEQ ID NO: 557430 - DNA, 25 bp, Rattus norvegicus
gcagctgctcagcactcggtgccgg

SEQ ID NO: 557431 - DNA, 25 bp, Rattus norvegicus
tgccggccaccgctttctattggaa

SEQ ID NO: 557432 - DNA, 25 bp, Rattus norvegicus
cgctttctattggaacgggtcttca

SEQ ID NO: 557433 - DNA, 25 bp, Rattus norvegicus
acgggtcttcagtcctgcagctagc

SEQ ID NO: 557434 - DNA, 25 bp, Rattus norvegicus
tacactcggtacactgggtacactc

SEQ ID NO: 557435 - DNA, 25 bp, Rattus norvegicus
ggactctcgtggtagagcaccggca

SEQ ID NO: 557436 - DNA, 25 bp, Rattus norvegicus
ctgcgtctccgtgagttgcagcgag

SEQ ID NO: 557437 - DNA, 25 bp, Rattus norvegicus
cgcgctgctcaggtagcgtttcaga

SEQ ID NO: 557438 - DNA, 25 bp, Rattus norvegicus
gcgtttcagatcgaaagtggactcg

SEQ ID NO: 557439 - DNA, 25 bp, Rattus norvegicus
aagaccgtgcgcgtcttcttcctgc

SEQ ID NO: 557440 - DNA, 25 bp, Rattus norvegicus
tatcctcgccggtctccggagagtc

SEQ ID NO: 557441 - DNA, 25 bp, Rattus norvegicus
cgtccggtacactcagtacactcgg

SEQ ID NO: 557442 - DNA, 25 bp, Rattus norvegicus
aagcgcgcccgagaaaccgagcagc

SEQ ID NO: 557443 - DNA, 25 bp, Rattus norvegicus
gctgccagcaggttctctatgagga

SEQ ID NO: 557444 - DNA, 25 bp, Rattus norvegicus
agaagccattgcaggagacgccgcc

SEQ ID NO: 557445 - DNA, 25 bp, Rattus norvegicus
tcgcatccgaggagagccttactca

SEQ ID NO: 557446 - DNA, 25 bp, Rattus norvegicus
ccaggctagccaatcgcatccgagg

SEQ ID NO: 557447 - DNA, 25 bp, Rattus norvegicus
accattggttacagggtcgctgaga

SEQ ID NO: 557448 - DNA, 25 bp, Rattus norvegicus
gctgggaggtcgaccattggttaca

SEQ ID NO: 557449 - DNA, 25 bp, Rattus norvegicus
tgcagcccggagagaagccattgca

SEQ ID NO: 557450 - DNA, 25 bp, Rattus norvegicus
ctttctcggagcgactcaggtcacc

SEQ ID NO: 557451 - DNA, 25 bp, Rattus norvegicus
tgtcagcttctgtgctgttctaggc

SEQ ID NO: 557452 - DNA, 25 bp, Rattus norvegicus
tgtgaagagcggtcgcctagcgcac

SEQ ID NO: 557453 - DNA, 25 bp, Rattus norvegicus
agcgtgtcggaacccacggaacgcg

SEQ ID NO: 557454 - DNA, 25 bp, Rattus norvegicus
tcggtcagctcatccggcatcgcgg

SEQ ID NO: 557455 - DNA, 25 bp, Rattus norvegicus
tgctccggatcctcgtcctcagggt

SEQ ID NO: 557456 - DNA, 25 bp, Rattus norvegicus
cagtcccgctgggattgtgaagagc

SEQ ID NO: 557457 - DNA, 25 bp, Rattus norvegicus
tgaggaaacccaccacggctgccag

SEQ ID NO: 557458 - DNA, 25 bp, Rattus norvegicus
ttggccagcgaaaagggcatgacca

SEQ ID NO: 557459 - DNA, 25 bp, Rattus norvegicus
ccaagctgatgcatgcaagcggctc

SEQ ID NO: 557460 - DNA, 25 bp, Rattus norvegicus
gtaccagtaggccatgagctcattg

SEQ ID NO: 557461 - DNA, 25 bp, Rattus norvegicus
gagcacgtccagtgccaggtacaca

SEQ ID NO: 557462 - DNA, 25 bp, Rattus norvegicus
tagcggtccaggctaatggcacaca

SEQ ID NO: 557463 - DNA, 25 bp, Rattus norvegicus
taccgcttgcgtcaccgaccagtag

SEQ ID NO: 557464 - DNA, 25 bp, Rattus norvegicus
ggcatgaccagtgtggccaccagga

SEQ ID NO: 557465 - DNA, 25 bp, Rattus norvegicus
caccaggatgtcagctgaggccaga

SEQ ID NO: 557466 - DNA, 25 bp, Rattus norvegicus
cgcagcgctcggcttgtcaacacag

SEQ ID NO: 557467 - DNA, 25 bp, Rattus norvegicus
gagcacgttgcccaccacggtgaaa

SEQ ID NO: 557468 - DNA, 25 bp, Rattus norvegicus
ccagcccacggagatgtagtgtcca

SEQ ID NO: 557469 - DNA, 25 bp, Rattus norvegicus
gcgtgcgcttcaggttgtactctac

SEQ ID NO: 557470 - DNA, 25 bp, Rattus norvegicus
cacagcgatcaccacgagcacgttg

SEQ ID NO: 557471 - DNA, 25 bp, Rattus norvegicus
ccaaagtgaaaatgccttgggatca

SEQ ID NO: 557472 - DNA, 25 bp, Rattus norvegicus
taatggcaaaaaccatctcccaccg

SEQ ID NO: 557473 - DNA, 25 bp, Rattus norvegicus
agaccgaaaaatgggccgtcatatg

SEQ ID NO: 557474 - DNA, 25 bp, Rattus norvegicus
gcaaggcggagccagagaccgaaaa

SEQ ID NO: 557475 - DNA, 25 bp, Rattus norvegicus
cttgggatcattgctctctgccgga

SEQ ID NO: 557476 - DNA, 25 bp, Rattus norvegicus
ggaagtgtctgggatgtgtcccaaa

SEQ ID NO: 557477 - DNA, 25 bp, Rattus norvegicus
tttcccagcttcgtctccttagagg

SEQ ID NO: 557478 - DNA, 25 bp, Rattus norvegicus
agtagctccagttctgccgcaggtc

SEQ ID NO: 557479 - DNA, 25 bp, Rattus norvegicus
accgcgcttcttgcgtgattttaag

SEQ ID NO: 557480 - DNA, 25 bp, Rattus norvegicus
gctgctcccgtctttaatggcaaaa

SEQ ID NO: 557481 - DNA, 25 bp, Rattus norvegicus
gctgagatagctgctcccgtcttta

SEQ ID NO: 557482 - DNA, 25 bp, Rattus norvegicus
gtgtcccaaagacggagctgagata

SEQ ID NO: 557483 - DNA, 25 bp, Rattus norvegicus
tgcgcagatgagacggagtagctcc

SEQ ID NO: 557484 - DNA, 25 bp, Rattus norvegicus
gcccgactggtgagctctaaaggtt

SEQ ID NO: 557485 - DNA, 25 bp, Rattus norvegicus
acctactcttccactgcggagacag

SEQ ID NO: 557486 - DNA, 25 bp, Rattus norvegicus
gacaggacagcgtgagaagccgccc

SEQ ID NO: 557487 - DNA, 25 bp, Rattus norvegicus
gctgcctcggtcatcttctgtcatg

SEQ ID NO: 557488 - DNA, 25 bp, Rattus norvegicus
accggcgatggcttgcgcagcacca

SEQ ID NO: 557489 - DNA, 25 bp, Rattus norvegicus
gcccagggtcactttcaaaatagct

SEQ ID NO: 557490 - DNA, 25 bp, Rattus norvegicus
tgcgactctccgattaccgccgggg

SEQ ID NO: 557491 - DNA, 25 bp, Rattus norvegicus
tcatcttctgtcatggttcccgccg

SEQ ID NO: 557492 - DNA, 25 bp, Rattus norvegicus
gtcccgatggctcgtcgagaccggc

SEQ ID NO: 557493 - DNA, 25 bp, Rattus norvegicus
ttgcaggaccgtcagggtcccgatg

SEQ ID NO: 557494 - DNA, 25 bp, Rattus norvegicus
tcagccacgcgttgcaggaccgtca

SEQ ID NO: 557495 - DNA, 25 bp, Rattus norvegicus
ctatttcgggcgagctggcacctca

SEQ ID NO: 557496 - DNA, 25 bp, Rattus norvegicus
agcggctgcgactctccgattaccg

SEQ ID NO: 557497 - DNA, 25 bp, Rattus norvegicus
cactttcaaaatagctccgggaggg

SEQ ID NO: 557498 - DNA, 25 bp, Rattus norvegicus
tggcacctcagccacgcgttgcagg

SEQ ID NO: 557499 - DNA, 25 bp, Rattus norvegicus
tcccggagtcccgcgcgaacaaaga

SEQ ID NO: 557500 - DNA, 25 bp, Rattus norvegicus
ggcttctgagccgggtcagaccccg

SEQ ID NO: 557501 - DNA, 25 bp, Rattus norvegicus
ctgagccgggtcagaccccgcccga

SEQ ID NO: 557502 - DNA, 25 bp, Rattus norvegicus
gctacggcccgtggaacccgcacat

SEQ ID NO: 557503 - DNA, 25 bp, Rattus norvegicus
acggcccgtggaacccgcacatccg

SEQ ID NO: 557504 - DNA, 25 bp, Rattus norvegicus
ccgtggaacccgcacatccggcctg

SEQ ID NO: 557505 - DNA, 25 bp, Rattus norvegicus
tggaacccgcacatccggcctgcgc

SEQ ID NO: 557506 - DNA, 25 bp, Rattus norvegicus
gaacccgcacatccggcctgcgcgg

SEQ ID NO: 557507 - DNA, 25 bp, Rattus norvegicus
tgcgcgggaccccagccgcagcccg

SEQ ID NO: 557508 - DNA, 25 bp, Rattus norvegicus
agcccgcgcgggcaagttcccggag

SEQ ID NO: 557509 - DNA, 25 bp, Rattus norvegicus
gcaagttcccggagtcccgcgcgaa

SEQ ID NO: 557510 - DNA, 25 bp, Rattus norvegicus
cccacggccgcaggaggacaaggcc

SEQ ID NO: 557511 - DNA, 25 bp, Rattus norvegicus
ccggagtcccgcgcgaacaaagaag

SEQ ID NO: 557512 - DNA, 25 bp, Rattus norvegicus
ggcaagttcccggagtcccgcgcga

SEQ ID NO: 557513 - DNA, 25 bp, Rattus norvegicus
tatagaagaaagacccgcgaggagg

SEQ ID NO: 557514 - DNA, 25 bp, Rattus norvegicus
gggcgcgcgctatagaagaaagacc

SEQ ID NO: 557515 - DNA, 25 bp, Rattus norvegicus
gcgcgcgctatagaagaaagacccg

SEQ ID NO: 557516 - DNA, 25 bp, Rattus norvegicus
cgcgcgctatagaagaaagacccgc

SEQ ID NO: 557517 - DNA, 25 bp, Rattus norvegicus
gctatagaagaaagacccgcgagga

SEQ ID NO: 557518 - DNA, 25 bp, Rattus norvegicus
cctaagagcggagctccgactcctg

SEQ ID NO: 557519 - DNA, 25 bp, Rattus norvegicus
tcacctaccgggccgccgcttgctc

SEQ ID NO: 557520 - DNA, 25 bp, Rattus norvegicus
agcgggtcaggccgttgtgcacttc

SEQ ID NO: 557521 - DNA, 25 bp, Rattus norvegicus
ggcgcccgccgaaagcatcaacggt

SEQ ID NO: 557522 - DNA, 25 bp, Rattus norvegicus
cgaaagcatcaacggtcaccgccgt

SEQ ID NO: 557523 - DNA, 25 bp, Rattus norvegicus
aaagcatcaacggtcaccgccgtcg

SEQ ID NO: 557524 - DNA, 25 bp, Rattus norvegicus
cgggacccagtcattgtagggcggg

SEQ ID NO: 557525 - DNA, 25 bp, Rattus norvegicus
taagagcggagctccgactcctggg

SEQ ID NO: 557526 - DNA, 25 bp, Rattus norvegicus
cgcgctatagaagaaagacccgcga

SEQ ID NO: 557527 - DNA, 25 bp, Rattus norvegicus
gcctactggacagcggctcggagac

SEQ ID NO: 557528 - DNA, 25 bp, Rattus norvegicus
cggagtccgcctactggacagcggc

SEQ ID NO: 557529 - DNA, 25 bp, Rattus norvegicus
ggctcctagaaagcggagtccgcct

SEQ ID NO: 557530 - DNA, 25 bp, Rattus norvegicus
ttggactcgtagcacagaagtgctc

SEQ ID NO: 557531 - DNA, 25 bp, Rattus norvegicus
acaggccgggttggactcgtagcac

SEQ ID NO: 557532 - DNA, 25 bp, Rattus norvegicus
cacagaagtgctcacgaagtaggga

SEQ ID NO: 557533 - DNA, 25 bp, Rattus norvegicus
aagtagggacttgcctgagactgaa

SEQ ID NO: 557534 - DNA, 25 bp, Rattus norvegicus
gcctgagactgaagacctaacggaa

SEQ ID NO: 557535 - DNA, 25 bp, Rattus norvegicus
gactgaagacctaacggaaagctca

SEQ ID NO: 557536 - DNA, 25 bp, Rattus norvegicus
cggaaagctcaacaatcagggcgta

SEQ ID NO: 557537 - DNA, 25 bp, Rattus norvegicus
gctcaacaatcagggcgtagggcta

SEQ ID NO: 557538 - DNA, 25 bp, Rattus norvegicus
caatcagggcgtagggctagacaga

SEQ ID NO: 557539 - DNA, 25 bp, Rattus norvegicus
gccgggctcctagaaagcggagtcc

SEQ ID NO: 557540 - DNA, 25 bp, Rattus norvegicus
cgggttggactcgtagcacagaagt

SEQ ID NO: 557541 - DNA, 25 bp, Rattus norvegicus
gagcggcagcagaagttcgaaaatc

SEQ ID NO: 557542 - DNA, 25 bp, Rattus norvegicus
agccaggcacgacaggggctccgca

SEQ ID NO: 557543 - DNA, 25 bp, Rattus norvegicus
tcacgcgagtcttggtgagtgtgtc

SEQ ID NO: 557544 - DNA, 25 bp, Rattus norvegicus
atctccgaggctggagacgcttggc

SEQ ID NO: 557545 - DNA, 25 bp, Rattus norvegicus
ccagggaaaactggatctccgaggc

SEQ ID NO: 557546 - DNA, 25 bp, Rattus norvegicus
ctggctcccgaagcctagtccgcga

SEQ ID NO: 557547 - DNA, 25 bp, Rattus norvegicus
cagaagttcgaaaatcgccgagggg

SEQ ID NO: 557548 - DNA, 25 bp, Rattus norvegicus
cggagaactgcggtttgtgcgcacc

SEQ ID NO: 557549 - DNA, 25 bp, Rattus norvegicus
ctaactgcctagctcagggcggaga

SEQ ID NO: 557550 - DNA, 25 bp, Rattus norvegicus
gctcgggcctagagacccctaactg

SEQ ID NO: 557551 - DNA, 25 bp, Rattus norvegicus
cgcgcattggttggacagtcttcca

SEQ ID NO: 557552 - DNA, 25 bp, Rattus norvegicus
ttaggtgtccaaggcgcgcgcgcat

SEQ ID NO: 557553 - DNA, 25 bp, Rattus norvegicus
tcatcgccgccttaggtgtccaagg

SEQ ID NO: 557554 - DNA, 25 bp, Rattus norvegicus
cctgcacgccgctgagctgagagca

SEQ ID NO: 557555 - DNA, 25 bp, Rattus norvegicus
acgttctccggtagcagtgctgcgt

SEQ ID NO: 557556 - DNA, 25 bp, Rattus norvegicus
gcgctttgagaatcctgtactgaga

SEQ ID NO: 557557 - DNA, 25 bp, Rattus norvegicus
tgagtcaagcccacagcctccggtt

SEQ ID NO: 557558 - DNA, 25 bp, Rattus norvegicus
cgacccagccctcggaatggtcatg

SEQ ID NO: 557559 - DNA, 25 bp, Rattus norvegicus
tggtcatgcccacacaccagtcagg

SEQ ID NO: 557560 - DNA, 25 bp, Rattus norvegicus
aaggatcccgctacctgttcgcgtg

SEQ ID NO: 557561 - DNA, 25 bp, Rattus norvegicus
gccggcgttctgctgcactatttcc

SEQ ID NO: 557562 - DNA, 25 bp, Rattus norvegicus
cactatttccttcgggaactctggg

SEQ ID NO: 557563 - DNA, 25 bp, Rattus norvegicus
aactctgggtggtcctctccgctga

SEQ ID NO: 557564 - DNA, 25 bp, Rattus norvegicus
caggcgggacacgagaaccaccaaa

SEQ ID NO: 557565 - DNA, 25 bp, Rattus norvegicus
caaactcggggcaatagctgcgacc

SEQ ID NO: 557566 - DNA, 25 bp, Rattus norvegicus
gcacctgcggagttgtacgttctcc

SEQ ID NO: 557567 - DNA, 25 bp, Rattus norvegicus
atgacctgtctcctatggccgtcgc

SEQ ID NO: 557568 - DNA, 25 bp, Rattus norvegicus
tgggctggaccaggatgacctgtct

SEQ ID NO: 557569 - DNA, 25 bp, Rattus norvegicus
ggaggtaccgcgaccctctggacag

SEQ ID NO: 557570 - DNA, 25 bp, Rattus norvegicus
tcgcaaactgggaaccgtgaaggca

SEQ ID NO: 557571 - DNA, 25 bp, Rattus norvegicus
gccatgcccagcacgcaggccaggg

SEQ ID NO: 557572 - DNA, 25 bp, Rattus norvegicus
taccgcgaccctctggacaggggac

SEQ ID NO: 557573 - DNA, 25 bp, Rattus norvegicus
actcacggtcggtgcagcggctcct

SEQ ID NO: 557574 - DNA, 25 bp, Rattus norvegicus
cctggcctcagggaggtaccgcgac

SEQ ID NO: 557575 - DNA, 25 bp, Rattus norvegicus
ggaaggccaaagacccctcaaggca

SEQ ID NO: 557576 - DNA, 25 bp, Rattus norvegicus
gcctgaccaggctgtctcctctggg

SEQ ID NO: 557577 - DNA, 25 bp, Rattus norvegicus
gcgagtccctcgctggcctgaccag

SEQ ID NO: 557578 - DNA, 25 bp, Rattus norvegicus
ctggagccgtgacgctcctcagcga

SEQ ID NO: 557579 - DNA, 25 bp, Rattus norvegicus
tgaaggcactggagccgtgacgctc

SEQ ID NO: 557580 - DNA, 25 bp, Rattus norvegicus
ctaacttcgcaaactgggaaccgtg

SEQ ID NO: 557581 - DNA, 25 bp, Rattus norvegicus
aactgggaaccgtgaaggcactgga

SEQ ID NO: 557582 - DNA, 25 bp, Rattus norvegicus
accctctggacaggggaccgcgttg

SEQ ID NO: 557583 - DNA, 25 bp, Rattus norvegicus
tgtcagcggccatccctggacatct

SEQ ID NO: 557584 - DNA, 25 bp, Rattus norvegicus
tggggtcagagaaccgccgctccct

SEQ ID NO: 557585 - DNA, 25 bp, Rattus norvegicus
agctgtgaaggagcagaaagagatc

SEQ ID NO: 557586 - DNA, 25 bp, Rattus norvegicus
cctggacatctgaccgaagctgtga

SEQ ID NO: 557587 - DNA, 25 bp, Rattus norvegicus
cacgaagattcctgctggggtcaga

SEQ ID NO: 557588 - DNA, 25 bp, Rattus norvegicus
acgctgccctgtagttgctgggaca

SEQ ID NO: 557589 - DNA, 25 bp, Rattus norvegicus
gcccagaatgaatctcactgacgcc

SEQ ID NO: 557590 - DNA, 25 bp, Rattus norvegicus
tctcactgacgcctgaatctgcttc

SEQ ID NO: 557591 - DNA, 25 bp, Rattus norvegicus
cgcctgaatctgcttcgcgtgctca

SEQ ID NO: 557592 - DNA, 25 bp, Rattus norvegicus
ccggcctacaagtctctcctgagtc

SEQ ID NO: 557593 - DNA, 25 bp, Rattus norvegicus
ggtggcctaatgctctacgctcaga

SEQ ID NO: 557594 - DNA, 25 bp, Rattus norvegicus
tacgctcagagtgtcagcggccatc

SEQ ID NO: 557595 - DNA, 25 bp, Rattus norvegicus
cagagagctgatttggggcagtccc

SEQ ID NO: 557596 - DNA, 25 bp, Rattus norvegicus
tgtagttgctgggacacgaagattc

SEQ ID NO: 557597 - DNA, 25 bp, Rattus norvegicus
gccgaagaaagctcctctgagtgaa

SEQ ID NO: 557598 - DNA, 25 bp, Rattus norvegicus
aaaaagccaagcaagaggatcggtg

SEQ ID NO: 557599 - DNA, 25 bp, Rattus norvegicus
tgagccgagagtgagcgcggcaacg

SEQ ID NO: 557600 - DNA, 25 bp, Rattus norvegicus
gtgggcgaggcaggctgccagatga

SEQ ID NO: 557601 - DNA, 25 bp, Rattus norvegicus
ccaagcaagaggatcggtgggcgag

SEQ ID NO: 557602 - DNA, 25 bp, Rattus norvegicus
agtgaaaaagccaagcaagaggatc

SEQ ID NO: 557603 - DNA, 25 bp, Rattus norvegicus
gaaagctcctctgagtgaaaaagcc

SEQ ID NO: 557604 - DNA, 25 bp, Rattus norvegicus
ttcccggccgaagaaagctcctctg

SEQ ID NO: 557605 - DNA, 25 bp, Rattus norvegicus
cgaagaaagctcctctgagtgaaaa

SEQ ID NO: 557606 - DNA, 25 bp, Rattus norvegicus
ggccgaagaaagctcctctgagtga

SEQ ID NO: 557607 - DNA, 25 bp, Rattus norvegicus
cggccgaagaaagctcctctgagtg

SEQ ID NO: 557608 - DNA, 25 bp, Rattus norvegicus
ccggccgaagaaagctcctctgagt

SEQ ID NO: 557609 - DNA, 25 bp, Rattus norvegicus
tcccggccgaagaaagctcctctga

SEQ ID NO: 557610 - DNA, 25 bp, Rattus norvegicus
agaaagctcctctgagtgaaaaagc

SEQ ID NO: 557611 - DNA, 25 bp, Rattus norvegicus
cagcaaggtaatgaatggggctcta

SEQ ID NO: 557612 - DNA, 25 bp, Rattus norvegicus
gcgtcgtcctctttctcaacgtttg

SEQ ID NO: 557613 - DNA, 25 bp, Rattus norvegicus
attgacaagcggatgcgtcgtcctc

SEQ ID NO: 557614 - DNA, 25 bp, Rattus norvegicus
cgccagacctgcagaattgacaagc

SEQ ID NO: 557615 - DNA, 25 bp, Rattus norvegicus
gaggccacgccagacctgcagaatt

SEQ ID NO: 557616 - DNA, 25 bp, Rattus norvegicus
cggcgagtgcgtcccgtgacgtcat

SEQ ID NO: 557617 - DNA, 25 bp, Rattus norvegicus
ggaaccaaagctcccagccatcttg

SEQ ID NO: 557618 - DNA, 25 bp, Rattus norvegicus
tagaccgaagcggaaccaaagctcc

SEQ ID NO: 557619 - DNA, 25 bp, Rattus norvegicus
cgcagcgccacttagcagcaaggta

SEQ ID NO: 557620 - DNA, 25 bp, Rattus norvegicus
tgaatggggctctacgaggtagacc

SEQ ID NO: 557621 - DNA, 25 bp, Rattus norvegicus
gtgccctgcctctgctagtttatta

SEQ ID NO: 557622 - DNA, 25 bp, Rattus norvegicus
gctagtttattaagactctccgccc

SEQ ID NO: 557623 - DNA, 25 bp, Rattus norvegicus
tctacgaggtagaccgaagcggaac

SEQ ID NO: 557624 - DNA, 25 bp, Rattus norvegicus
ttctcaacgtttggtcgtgggcgtg

SEQ ID NO: 557625 - DNA, 25 bp, Rattus norvegicus
gcctgcgccgtcgatgccgcggttt

SEQ ID NO: 557626 - DNA, 25 bp, Rattus norvegicus
actcccaccaagagcgccgtcgtcg

SEQ ID NO: 557627 - DNA, 25 bp, Rattus norvegicus
ggcgtcgccaccactcccaccaaga

SEQ ID NO: 557628 - DNA, 25 bp, Rattus norvegicus
tcctccgcctcctctggcgtcgcca

SEQ ID NO: 557629 - DNA, 25 bp, Rattus norvegicus
ttcgggatgcttgaccgcctctgtc

SEQ ID NO: 557630 - DNA, 25 bp, Rattus norvegicus
tgagctacagggcttcgggatgctt

SEQ ID NO: 557631 - DNA, 25 bp, Rattus norvegicus
cttgtcctttgagctacagggcttc

SEQ ID NO: 557632 - DNA, 25 bp, Rattus norvegicus
cgggcatcccttgtcctttgagcta

SEQ ID NO: 557633 - DNA, 25 bp, Rattus norvegicus
cactggtgcaccctccgggcatccc

SEQ ID NO: 557634 - DNA, 25 bp, Rattus norvegicus
aggagatcctaacgccactggtgca

SEQ ID NO: 557635 - DNA, 25 bp, Rattus norvegicus
ctgccggggaggagatcctaacgcc

SEQ ID NO: 557636 - DNA, 25 bp, Rattus norvegicus
tttctgggtccaggcaattgaggca

SEQ ID NO: 557637 - DNA, 25 bp, Rattus norvegicus
cgtcgaacttttctgggtccaggca

SEQ ID NO: 557638 - DNA, 25 bp, Rattus norvegicus
atgccgcggtttccggcgtcgaact

SEQ ID NO: 557639 - DNA, 25 bp, Rattus norvegicus
tccttggcaggaagacacgccacga

SEQ ID NO: 557640 - DNA, 25 bp, Rattus norvegicus
agacacgccacgatgtgggcctgcc

SEQ ID NO: 557641 - DNA, 25 bp, Rattus norvegicus
gaagacacgccacgatgtgggcctg

SEQ ID NO: 557642 - DNA, 25 bp, Rattus norvegicus
agatccttggcaggaagacacgcca

SEQ ID NO: 557643 - DNA, 25 bp, Rattus norvegicus
ccagatccttggcaggaagacacgc

SEQ ID NO: 557644 - DNA, 25 bp, Rattus norvegicus
gttccagatccttggcaggaagaca

SEQ ID NO: 557645 - DNA, 25 bp, Rattus norvegicus
cccaaatccatttgaagtgaaagtc

SEQ ID NO: 557646 - DNA, 25 bp, Rattus norvegicus
ccatttgaagtgaaagtcaaccggc

SEQ ID NO: 557647 - DNA, 25 bp, Rattus norvegicus
agtgaaagtcaaccggcagaagttc

SEQ ID NO: 557648 - DNA, 25 bp, Rattus norvegicus
agtcaaccggcagaagttccagatc

SEQ ID NO: 557649 - DNA, 25 bp, Rattus norvegicus
aaccggcagaagttccagatccttg

SEQ ID NO: 557650 - DNA, 25 bp, Rattus norvegicus
cggcagaagttccagatccttggca

SEQ ID NO: 557651 - DNA, 25 bp, Rattus norvegicus
cagaagttccagatccttggcagga

SEQ ID NO: 557652 - DNA, 25 bp, Rattus norvegicus
tggcaggaagacacgccacgatgtg

SEQ ID NO: 557653 - DNA, 25 bp, Rattus norvegicus
gcctgtatttctcgcgaagtacggg

SEQ ID NO: 557654 - DNA, 25 bp, Rattus norvegicus
aggcaggtccacaaagcgccggcag

SEQ ID NO: 557655 - DNA, 25 bp, Rattus norvegicus
cgaggaggcaggtccacaaagcgcc

SEQ ID NO: 557656 - DNA, 25 bp, Rattus norvegicus
tagcagagtgaatgtcatggggaaa

SEQ ID NO: 557657 - DNA, 25 bp, Rattus norvegicus
ccaaagtgtagcagagtgaatgtca

SEQ ID NO: 557658 - DNA, 25 bp, Rattus norvegicus
tccaagcccagtcttccaaagtgta

SEQ ID NO: 557659 - DNA, 25 bp, Rattus norvegicus
gtaagcccagtcttccaagcccagt

SEQ ID NO: 557660 - DNA, 25 bp, Rattus norvegicus
agctccttggtctgtaagcccagtc

SEQ ID NO: 557661 - DNA, 25 bp, Rattus norvegicus
tgcacgagtttcttgagctccttgg

SEQ ID NO: 557662 - DNA, 25 bp, Rattus norvegicus
ctgcatcttgtgcacgagtttcttg

SEQ ID NO: 557663 - DNA, 25 bp, Rattus norvegicus
ggcgtggctttgcatctgcatcttg

SEQ ID NO: 557664 - DNA, 25 bp, Rattus norvegicus
cactcaacgcgagacgaagctgggc

SEQ ID NO: 557665 - DNA, 25 bp, Rattus norvegicus
ttctcgcgaagtacgggaagctgac

SEQ ID NO: 557666 - DNA, 25 bp, Rattus norvegicus
tacgggaagctgacgcactcaacgc

SEQ ID NO: 557667 - DNA, 25 bp, Rattus norvegicus
acttgggactgcttccgttctgccc

SEQ ID NO: 557668 - DNA, 25 bp, Rattus norvegicus
agcggcgagcaagtgcccgaatcgc

SEQ ID NO: 557669 - DNA, 25 bp, Rattus norvegicus
caccggacgagagagactgcagcaa

SEQ ID NO: 557670 - DNA, 25 bp, Rattus norvegicus
actgcagcaagggtttcacgtgatc

SEQ ID NO: 557671 - DNA, 25 bp, Rattus norvegicus
caagggtttcacgtgatcgtgtgta

SEQ ID NO: 557672 - DNA, 25 bp, Rattus norvegicus
cgtgatcgtgtgtaatgttcgtcca

SEQ ID NO: 557673 - DNA, 25 bp, Rattus norvegicus
ttagtcttcgacttgggactgcttc

SEQ ID NO: 557674 - DNA, 25 bp, Rattus norvegicus
aaaactgtgtctgagcggcgagcaa

SEQ ID NO: 557675 - DNA, 25 bp, Rattus norvegicus
ccggccagagttcagccatcttgtc

SEQ ID NO: 557676 - DNA, 25 bp, Rattus norvegicus
gccatcttgtcttctctcgctgctg

SEQ ID NO: 557677 - DNA, 25 bp, Rattus norvegicus
tgtcttctctcgctgctgcttctga

SEQ ID NO: 557678 - DNA, 25 bp, Rattus norvegicus
cgctgctgcttctgaaaactgtgtc

SEQ ID NO: 557679 - DNA, 25 bp, Rattus norvegicus
cttctgaaaactgtgtctgagcggc

SEQ ID NO: 557680 - DNA, 25 bp, Rattus norvegicus
atgttcgtccacaccttagtcttcg

SEQ ID NO: 557681 - DNA, 25 bp, Rattus norvegicus
agaaccgagcggccacttccacaga

SEQ ID NO: 557682 - DNA, 25 bp, Rattus norvegicus
ggccatcctgggaagcgacgatgca

SEQ ID NO: 557683 - DNA, 25 bp, Rattus norvegicus
aagcgacgatgcagtgtcctcgccc

SEQ ID NO: 557684 - DNA, 25 bp, Rattus norvegicus
cccgcactccgaggcaagcacctag

SEQ ID NO: 557685 - DNA, 25 bp, Rattus norvegicus
cgcgccctcctcagtgcagtggaag

SEQ ID NO: 557686 - DNA, 25 bp, Rattus norvegicus
gccctcctcagtgcagtggaagcgc

SEQ ID NO: 557687 - DNA, 25 bp, Rattus norvegicus
ttccacagagaacccggcgtccgtc

SEQ ID NO: 557688 - DNA, 25 bp, Rattus norvegicus
acgggccagctcagaaccgagcggc

SEQ ID NO: 557689 - DNA, 25 bp, Rattus norvegicus
ctcacctccgcggagaatcgggaaa

SEQ ID NO: 557690 - DNA, 25 bp, Rattus norvegicus
ccgcctgcagcagccctcgtcctct

SEQ ID NO: 557691 - DNA, 25 bp, Rattus norvegicus
agcgctgcggcccaacaatacgcaa

SEQ ID NO: 557692 - DNA, 25 bp, Rattus norvegicus
cggagaatcgggaaaagcgcacagc

SEQ ID NO: 557693 - DNA, 25 bp, Rattus norvegicus
aaagcgcacagcttcccgggtccga

SEQ ID NO: 557694 - DNA, 25 bp, Rattus norvegicus
gtccgtccgggccatcctgggaagc

SEQ ID NO: 557695 - DNA, 25 bp, Rattus norvegicus
cctgtgaacagcgacattgtccaga

SEQ ID NO: 557696 - DNA, 25 bp, Rattus norvegicus
agagcccgccatagctcgtagagcc

SEQ ID NO: 557697 - DNA, 25 bp, Rattus norvegicus
gtctaccctgtgaacagcgacattg

SEQ ID NO: 557698 - DNA, 25 bp, Rattus norvegicus
ggccagtgcccgtctaccctgtgaa

SEQ ID NO: 557699 - DNA, 25 bp, Rattus norvegicus
atagctcgtagagccccaggccgga

SEQ ID NO: 557700 - DNA, 25 bp, Rattus norvegicus
ccagagcccgccatagctcgtagag

SEQ ID NO: 557701 - DNA, 25 bp, Rattus norvegicus
cctggagcccgtctcccgccagccc

SEQ ID NO: 557702 - DNA, 25 bp, Rattus norvegicus
gcagcctcatccctggagcccgtct

SEQ ID NO: 557703 - DNA, 25 bp, Rattus norvegicus
ccgggcccaccagacgcagcctcat

SEQ ID NO: 557704 - DNA, 25 bp, Rattus norvegicus
aacagcgacattgtccagagccggg

SEQ ID NO: 557705 - DNA, 25 bp, Rattus norvegicus
accctgtgaacagcgacattgtcca

SEQ ID NO: 557706 - DNA, 25 bp, Rattus norvegicus
tgcccgtctaccctgtgaacagcga

SEQ ID NO: 557707 - DNA, 25 bp, Rattus norvegicus
agtgcccgtctaccctgtgaacagc

SEQ ID NO: 557708 - DNA, 25 bp, Rattus norvegicus
taggggccaggtgaggaagcggacc

SEQ ID NO: 557709 - DNA, 25 bp, Rattus norvegicus
tttgcagccagctgggcgggcagca

SEQ ID NO: 557710 - DNA, 25 bp, Rattus norvegicus
gcagcaggcactccggtgcaggctc

SEQ ID NO: 557711 - DNA, 25 bp, Rattus norvegicus
atgcagtgccttacccgccggttcc

SEQ ID NO: 557712 - DNA, 25 bp, Rattus norvegicus
ggatccctcctctgttgcttcgctt

SEQ ID NO: 557713 - DNA, 25 bp, Rattus norvegicus
atccctcctctgttgcttcgctttg

SEQ ID NO: 557714 - DNA, 25 bp, Rattus norvegicus
gcttcgctttgcagccagctgggcg

SEQ ID NO: 557715 - DNA, 25 bp, Rattus norvegicus
ctccggtgcaggctccgcctccaat

SEQ ID NO: 557716 - DNA, 25 bp, Rattus norvegicus
cttcgctttgcagccagctgggcgg

SEQ ID NO: 557717 - DNA, 25 bp, Rattus norvegicus
tgtgccgcgcatgtccacgaccggt

SEQ ID NO: 557718 - DNA, 25 bp, Rattus norvegicus
gcaggctccgcctccaatctggccc

SEQ ID NO: 557719 - DNA, 25 bp, Rattus norvegicus
gaccggtcccaaaacccatgcagtg

SEQ ID NO: 557720 - DNA, 25 bp, Rattus norvegicus
gcgcatgtccacgaccggtcccaaa

SEQ ID NO: 557721 - DNA, 25 bp, Rattus norvegicus
ggtcccaaaacccatgcagtgcctt

SEQ ID NO: 557722 - DNA, 25 bp, Rattus norvegicus
gtcccaaaacccatgcagtgcctta

SEQ ID NO: 557723 - DNA, 25 bp, Rattus norvegicus
acttctggatcaggtggagcgcttc

SEQ ID NO: 557724 - DNA, 25 bp, Rattus norvegicus
gaaggctggttatcgctcccgcagc

SEQ ID NO: 557725 - DNA, 25 bp, Rattus norvegicus
cgctcccgcagcctagagaagttgg

SEQ ID NO: 557726 - DNA, 25 bp, Rattus norvegicus
gagaagttggagacgcccaagtccc

SEQ ID NO: 557727 - DNA, 25 bp, Rattus norvegicus
acggaaggcccacagctatgtcgtc

SEQ ID NO: 557728 - DNA, 25 bp, Rattus norvegicus
cacagctatgtcgtctggggacgca

SEQ ID NO: 557729 - DNA, 25 bp, Rattus norvegicus
acgcaaggtctggtagacaggacga

SEQ ID NO: 557730 - DNA, 25 bp, Rattus norvegicus
tcagcgctctgtggcctgtaccacg

SEQ ID NO: 557731 - DNA, 25 bp, Rattus norvegicus
tgtaccacgaggcaggccagcaact

SEQ ID NO: 557732 - DNA, 25 bp, Rattus norvegicus
ggccagcaactacagctcctgaagg

SEQ ID NO: 557733 - DNA, 25 bp, Rattus norvegicus
ctcctgaaggatcagctggctgcgc

SEQ ID NO: 557734 - DNA, 25 bp, Rattus norvegicus
aagggcacacggcaccatcacttgt

SEQ ID NO: 557735 - DNA, 25 bp, Rattus norvegicus
gtgcctcggagtcccaactgcggca

SEQ ID NO: 557736 - DNA, 25 bp, Rattus norvegicus
catcacttgtggacgcacttctgga

SEQ ID NO: 557737 - DNA, 25 bp, Rattus norvegicus
tttgctcaatctgccttgcgcccga

SEQ ID NO: 557738 - DNA, 25 bp, Rattus norvegicus
agaacagtctctcgaacttccggac

SEQ ID NO: 557739 - DNA, 25 bp, Rattus norvegicus
tttcgcggacttccgggataagagc

SEQ ID NO: 557740 - DNA, 25 bp, Rattus norvegicus
tccggacttctgtttcgcggacttc

SEQ ID NO: 557741 - DNA, 25 bp, Rattus norvegicus
tcctcctgaggagtgcacacgctcg

SEQ ID NO: 557742 - DNA, 25 bp, Rattus norvegicus
gcacacgctcggtttgctcaatctg

SEQ ID NO: 557743 - DNA, 25 bp, Rattus norvegicus
cctgcacaggacacaacggatcgga

SEQ ID NO: 557744 - DNA, 25 bp, Rattus norvegicus
caacggatcggaaccagaaaagctg

SEQ ID NO: 557745 - DNA, 25 bp, Rattus norvegicus
ccagaaaagctgcaggacacgcacg

SEQ ID NO: 557746 - DNA, 25 bp, Rattus norvegicus
aggacacgcacgtttgccagaaccg

SEQ ID NO: 557747 - DNA, 25 bp, Rattus norvegicus
ttgccagaaccgaggaacgtgtacg

SEQ ID NO: 557748 - DNA, 25 bp, Rattus norvegicus
ggaacgtgtacgacaattagtgcga

SEQ ID NO: 557749 - DNA, 25 bp, Rattus norvegicus
acaattagtgcgagagaacagtctc

SEQ ID NO: 557750 - DNA, 25 bp, Rattus norvegicus
cccgatccagatccgcaagcggtga

SEQ ID NO: 557751 - DNA, 25 bp, Rattus norvegicus
ccctgctcgtagtgggcttctctaa

SEQ ID NO: 557752 - DNA, 25 bp, Rattus norvegicus
tagggccacgcgcacttagccgtgc

SEQ ID NO: 557753 - DNA, 25 bp, Rattus norvegicus
gttagagtccaatatggcggacaca

SEQ ID NO: 557754 - DNA, 25 bp, Rattus norvegicus
gtgccgccgctgaccagagttagag

SEQ ID NO: 557755 - DNA, 25 bp, Rattus norvegicus
ggccggcatctgacggctggtaatt

SEQ ID NO: 557756 - DNA, 25 bp, Rattus norvegicus
tgtgaccttggcctataccggggcc

SEQ ID NO: 557757 - DNA, 25 bp, Rattus norvegicus
cctttcacctgtcgctgtgtgacct

SEQ ID NO: 557758 - DNA, 25 bp, Rattus norvegicus
ggcttctctaactttgacccagtcc

SEQ ID NO: 557759 - DNA, 25 bp, Rattus norvegicus
acggctggtaattcgctgcatcgcc

SEQ ID NO: 557760 - DNA, 25 bp, Rattus norvegicus
tcccgtctaagaccgaggctcttgc

SEQ ID NO: 557761 - DNA, 25 bp, Rattus norvegicus
tcgcagttccaactctggcggtctc

SEQ ID NO: 557762 - DNA, 25 bp, Rattus norvegicus
ggtccaaaagggtctcgcagttcca

SEQ ID NO: 557763 - DNA, 25 bp, Rattus norvegicus
cgcggccctatggactctgtagtcc

SEQ ID NO: 557764 - DNA, 25 bp, Rattus norvegicus
ttgacccagtccaggttcgagcgtg

SEQ ID NO: 557765 - DNA, 25 bp, Rattus norvegicus
cctgcgaagcttacccttacttgga

SEQ ID NO: 557766 - DNA, 25 bp, Rattus norvegicus
cctcggctctctcgcagcttagata

SEQ ID NO: 557767 - DNA, 25 bp, Rattus norvegicus
cattcagttccaaggcccgcaagcg

SEQ ID NO: 557768 - DNA, 25 bp, Rattus norvegicus
ctgcgtcgtcagcaaggaacaaaaa

SEQ ID NO: 557769 - DNA, 25 bp, Rattus norvegicus
ctagctcaggttttcgccgatccgc

SEQ ID NO: 557770 - DNA, 25 bp, Rattus norvegicus
caaaaaaggttctccggccaggctg

SEQ ID NO: 557771 - DNA, 25 bp, Rattus norvegicus
gagatttccctacttccgatgagtg

SEQ ID NO: 557772 - DNA, 25 bp, Rattus norvegicus
ttggtgttatcagccaaacgccttg

SEQ ID NO: 557773 - DNA, 25 bp, Rattus norvegicus
cgctcgagcaaggacgcacctaatc

SEQ ID NO: 557774 - DNA, 25 bp, Rattus norvegicus
actctcgtgctctaccggtttagga

SEQ ID NO: 557775 - DNA, 25 bp, Rattus norvegicus
tgaaatgcaccttcttccggccacg

SEQ ID NO: 557776 - DNA, 25 bp, Rattus norvegicus
gctcctcccacgagaacttggcgga

SEQ ID NO: 557777 - DNA, 25 bp, Rattus norvegicus
tgcggcgctccatgttccgacaatc

SEQ ID NO: 557778 - DNA, 25 bp, Rattus norvegicus
ggagcttccacttcccgcgagagta

SEQ ID NO: 557779 - DNA, 25 bp, Rattus norvegicus
ttgaatcgaaagtgcccaccaattg

SEQ ID NO: 557780 - DNA, 25 bp, Rattus norvegicus
cgtgtttccgctctgctcaagcgtg

SEQ ID NO: 557781 - DNA, 25 bp, Rattus norvegicus
tacgatcgatagtttcccttgtttg

SEQ ID NO: 557782 - DNA, 25 bp, Rattus norvegicus
tctggtcctgggtgtcaaacacttc

SEQ ID NO: 557783 - DNA, 25 bp, Rattus norvegicus
cagtgtcaaggttttttagtgtcta

SEQ ID NO: 557784 - DNA, 25 bp, Rattus norvegicus
tgctcaagcgtgcttgggaaccgtg

SEQ ID NO: 557785 - DNA, 25 bp, Rattus norvegicus
gagccgcgggatctttttgcccttc

SEQ ID NO: 557786 - DNA, 25 bp, Rattus norvegicus
ccaacacttagcacgggcacatcta

SEQ ID NO: 557787 - DNA, 25 bp, Rattus norvegicus
tccctggcccggcactggttacagt

SEQ ID NO: 557788 - DNA, 25 bp, Rattus norvegicus
tggttacagtgggtaccatttggac

SEQ ID NO: 557789 - DNA, 25 bp, Rattus norvegicus
gcacaccgaggttcgggttctcaaa

SEQ ID NO: 557790 - DNA, 25 bp, Rattus norvegicus
ctcgctggcacgcagcggccaatgg

SEQ ID NO: 557791 - DNA, 25 bp, Rattus norvegicus
gcggagcgcaccctccttcttgtgg

SEQ ID NO: 557792 - DNA, 25 bp, Rattus norvegicus
acatctaaggttggggtactgcgtc

SEQ ID NO: 557793 - DNA, 25 bp, Rattus norvegicus
gaaaggttgcttccctctcagctca

SEQ ID NO: 557794 - DNA, 25 bp, Rattus norvegicus
cgatttgcttcttgcctttccctca

SEQ ID NO: 557795 - DNA, 25 bp, Rattus norvegicus
tgatccatctccacccagtgctgta

SEQ ID NO: 557796 - DNA, 25 bp, Rattus norvegicus
gctgtaacatctcctgcgcctgcga

SEQ ID NO: 557797 - DNA, 25 bp, Rattus norvegicus
atggaggaggcactgcgtcttgcac

SEQ ID NO: 557798 - DNA, 25 bp, Rattus norvegicus
actgcgtcttgcacccaggcgctta

SEQ ID NO: 557799 - DNA, 25 bp, Rattus norvegicus
acccaggcgcttaggcatcagcttt

SEQ ID NO: 557800 - DNA, 25 bp, Rattus norvegicus
cagctcacccgcagttgtgggcgtt

SEQ ID NO: 557801 - DNA, 25 bp, Rattus norvegicus
cttctcagacccgaaaggttgcttc

SEQ ID NO: 557802 - DNA, 25 bp, Rattus norvegicus
gtcctaggcggtgacacgacctgct

SEQ ID NO: 557803 - DNA, 25 bp, Rattus norvegicus
gcaggggcgatttgcttcttgcctt

SEQ ID NO: 557804 - DNA, 25 bp, Rattus norvegicus
aggcatcagctttcccacgcaacag

SEQ ID NO: 557805 - DNA, 25 bp, Rattus norvegicus
gtgacacgacctgctgcggtgctgc

SEQ ID NO: 557806 - DNA, 25 bp, Rattus norvegicus
ctcaggaggcttctaggtgatgatg

SEQ ID NO: 557807 - DNA, 25 bp, Rattus norvegicus
ggcatgcattgaccgctcttttcca

SEQ ID NO: 557808 - DNA, 25 bp, Rattus norvegicus
ggtagccgcctgcacccttttggat

SEQ ID NO: 557809 - DNA, 25 bp, Rattus norvegicus
ttggatctccgaccagtcctctgtc

SEQ ID NO: 557810 - DNA, 25 bp, Rattus norvegicus
ggttcagtttgcatccctatcctcg

SEQ ID NO: 557811 - DNA, 25 bp, Rattus norvegicus
ttcgcacttgtgaaccgaccttctc

SEQ ID NO: 557812 - DNA, 25 bp, Rattus norvegicus
tctggcctagaatagtgggtctccc

SEQ ID NO: 557813 - DNA, 25 bp, Rattus norvegicus
ctcgtctgggtactagatgggcacc

SEQ ID NO: 557814 - DNA, 25 bp, Rattus norvegicus
ttccaataccagacagggctctttc

SEQ ID NO: 557815 - DNA, 25 bp, Rattus norvegicus
ctgtccctgcattccgcgacttgga

SEQ ID NO: 557816 - DNA, 25 bp, Rattus norvegicus
cctcgtttccctggccctgtatgaa

SEQ ID NO: 557817 - DNA, 25 bp, Rattus norvegicus
gcaggtccctcctcgattagacaga

SEQ ID NO: 557818 - DNA, 25 bp, Rattus norvegicus
taaacccaaggtgagcggctccagc

SEQ ID NO: 557819 - DNA, 25 bp, Rattus norvegicus
tcaggatccgcttgctcaggcaggt

SEQ ID NO: 557820 - DNA, 25 bp, Rattus norvegicus
tggcctgtttcttctcgtctgggta

SEQ ID NO: 557821 - DNA, 25 bp, Rattus norvegicus
gggacccaatttacatagaccgatc

SEQ ID NO: 557822 - DNA, 25 bp, Rattus norvegicus
gtcaagcttcgcatctgtcaacatt

SEQ ID NO: 557823 - DNA, 25 bp, Rattus norvegicus
acacccattggctgtgtcgactgct

SEQ ID NO: 557824 - DNA, 25 bp, Rattus norvegicus
taggaaagagcgcacacacccattg

SEQ ID NO: 557825 - DNA, 25 bp, Rattus norvegicus
gcccaatcggtgtgcaatgcctact

SEQ ID NO: 557826 - DNA, 25 bp, Rattus norvegicus
ttaacatgcacgatggccgccagtc

SEQ ID NO: 557827 - DNA, 25 bp, Rattus norvegicus
ctgggccaccacgtgctgttgctaa

SEQ ID NO: 557828 - DNA, 25 bp, Rattus norvegicus
cgtgctgttgctaagcttgggcttc

SEQ ID NO: 557829 - DNA, 25 bp, Rattus norvegicus
taaattgttactactggagccagcc

SEQ ID NO: 557830 - DNA, 25 bp, Rattus norvegicus
ttcggccagtccctattggccaagg

SEQ ID NO: 557831 - DNA, 25 bp, Rattus norvegicus
gctgctctacttatgtgtcaatttg

SEQ ID NO: 557832 - DNA, 25 bp, Rattus norvegicus
aggatggagctgaactctctgctgc

SEQ ID NO: 557833 - DNA, 25 bp, Rattus norvegicus
tgcccttcgacggtgacttcgccag

SEQ ID NO: 557834 - DNA, 25 bp, Rattus norvegicus
tggagccagcctatcccagtcaagc

SEQ ID NO: 557835 - DNA, 25 bp, Rattus norvegicus
tacggatggtgtaatctgcgcgtgc

SEQ ID NO: 557836 - DNA, 25 bp, Rattus norvegicus
tcaggtactcccgtgaggcattgcg

SEQ ID NO: 557837 - DNA, 25 bp, Rattus norvegicus
ctagaggcatcgatagaggtcgctg

SEQ ID NO: 557838 - DNA, 25 bp, Rattus norvegicus
cgctagaggcatcgatagaggtcgc

SEQ ID NO: 557839 - DNA, 25 bp, Rattus norvegicus
cgccgctagaggcatcgatagaggt

SEQ ID NO: 557840 - DNA, 25 bp, Rattus norvegicus
ggccgccgctagaggcatcgataga

SEQ ID NO: 557841 - DNA, 25 bp, Rattus norvegicus
caggtactcccgtgaggcattgcgg

SEQ ID NO: 557842 - DNA, 25 bp, Rattus norvegicus
tgcgcgtgcgcgctcaggtactccc

SEQ ID NO: 557843 - DNA, 25 bp, Rattus norvegicus
cactacggatggtgtaatctgcgcg

SEQ ID NO: 557844 - DNA, 25 bp, Rattus norvegicus
gcagacactacggatggtgtaatct

SEQ ID NO: 557845 - DNA, 25 bp, Rattus norvegicus
ctgcgcagacactacggatggtgta

SEQ ID NO: 557846 - DNA, 25 bp, Rattus norvegicus
ctcccggacacctcgccgcctgcgc

SEQ ID NO: 557847 - DNA, 25 bp, Rattus norvegicus
aggcatcgatagaggtcgctgggcc

SEQ ID NO: 557848 - DNA, 25 bp, Rattus norvegicus
ctcggtctcccggacacctcgccgc

SEQ ID NO: 557849 - DNA, 25 bp, Rattus norvegicus
atgcgctccaagatgccgtcgtaga

SEQ ID NO: 557850 - DNA, 25 bp, Rattus norvegicus
gtagccacgatcttcgtctcgcaga

SEQ ID NO: 557851 - DNA, 25 bp, Rattus norvegicus
tcgtctcgcagaccatgtcgggagg

SEQ ID NO: 557852 - DNA, 25 bp, Rattus norvegicus
tcgggaggcccacaatgcatgcacc

SEQ ID NO: 557853 - DNA, 25 bp, Rattus norvegicus
cgccgcattttggagaagtatttat

SEQ ID NO: 557854 - DNA, 25 bp, Rattus norvegicus
aagtatttataatgcagcggcgccg

SEQ ID NO: 557855 - DNA, 25 bp, Rattus norvegicus
tagcgtccactgcattggctgccga

SEQ ID NO: 557856 - DNA, 25 bp, Rattus norvegicus
ctgccgagggtcaccatgtgatctc

SEQ ID NO: 557857 - DNA, 25 bp, Rattus norvegicus
agagcatgcgaggaaatggtcttca

SEQ ID NO: 557858 - DNA, 25 bp, Rattus norvegicus
gttcctgcagcaatgcgtcctcttc

SEQ ID NO: 557859 - DNA, 25 bp, Rattus norvegicus
gcggccgctgtcagtagtcacggaa

SEQ ID NO: 557860 - DNA, 25 bp, Rattus norvegicus
agtcacggaagtgtctccatctccc

SEQ ID NO: 557861 - DNA, 25 bp, Rattus norvegicus
ctgcgcggaactcgcggatgcacac

SEQ ID NO: 557862 - DNA, 25 bp, Rattus norvegicus
agtgcctcatggtcctccgtagcca

SEQ ID NO: 557863 - DNA, 25 bp, Rattus norvegicus
agggcgcgctgcatgaattcaaatg

SEQ ID NO: 557864 - DNA, 25 bp, Rattus norvegicus
agctcaggtgcgcttagcccagtcc

SEQ ID NO: 557865 - DNA, 25 bp, Rattus norvegicus
cgccctgcagcaagtagcggtcagc

SEQ ID NO: 557866 - DNA, 25 bp, Rattus norvegicus
ctagcagcgccaggctcagcagcag

SEQ ID NO: 557867 - DNA, 25 bp, Rattus norvegicus
aggcacctactttgcgcggggacag

SEQ ID NO: 557868 - DNA, 25 bp, Rattus norvegicus
gtaggaaacaaagacgcctcccgca

SEQ ID NO: 557869 - DNA, 25 bp, Rattus norvegicus
ttcccacctaagaagtgaccgcgta

SEQ ID NO: 557870 - DNA, 25 bp, Rattus norvegicus
aatcagcgtcacgtgagggtggaca

SEQ ID NO: 557871 - DNA, 25 bp, Rattus norvegicus
gacagtccacgcacggacggcctga

SEQ ID NO: 557872 - DNA, 25 bp, Rattus norvegicus
cccgacgtcgtcgtcatggaaacgc

SEQ ID NO: 557873 - DNA, 25 bp, Rattus norvegicus
ttgccttgcttctgtgcgatgctcc

SEQ ID NO: 557874 - DNA, 25 bp, Rattus norvegicus
tcatcactctggctgcgcgctcagt

SEQ ID NO: 557875 - DNA, 25 bp, Rattus norvegicus
agtcctcggccagcacctgttcagg

SEQ ID NO: 557876 - DNA, 25 bp, Rattus norvegicus
gcggtccacagaaccgcgaacagca

SEQ ID NO: 557877 - DNA, 25 bp, Rattus norvegicus
tcatcggctgtgaagctcaagctgc

SEQ ID NO: 557878 - DNA, 25 bp, Rattus norvegicus
caccgctgcggtcatcgataacatc

SEQ ID NO: 557879 - DNA, 25 bp, Rattus norvegicus
tgcacaacaaactgggcgccacgga

SEQ ID NO: 557880 - DNA, 25 bp, Rattus norvegicus
acacgggcctgtggctgcacaacaa

SEQ ID NO: 557881 - DNA, 25 bp, Rattus norvegicus
caagatggcttccatgcgggagagc

SEQ ID NO: 557882 - DNA, 25 bp, Rattus norvegicus
acacgtaggcgtccgcgtaagatgc

SEQ ID NO: 557883 - DNA, 25 bp, Rattus norvegicus
tgtatttgtctgtcactcgaggccc

SEQ ID NO: 557884 - DNA, 25 bp, Rattus norvegicus
ggcggggccatttgcaattgtattt

SEQ ID NO: 557885 - DNA, 25 bp, Rattus norvegicus
gcctcggctcgtagcctccagaagg

SEQ ID NO: 557886 - DNA, 25 bp, Rattus norvegicus
ccacagtccttttcgcggagactca

SEQ ID NO: 557887 - DNA, 25 bp, Rattus norvegicus
cgccatcatgcgttacggaaaccca

SEQ ID NO: 557888 - DNA, 25 bp, Rattus norvegicus
acaacacaatgtcgggctacgtcat

SEQ ID NO: 557889 - DNA, 25 bp, Rattus norvegicus
gggcacacggatgcgacacaacaca

SEQ ID NO: 557890 - DNA, 25 bp, Rattus norvegicus
tcactctgggcgatgcatctctagg

SEQ ID NO: 557891 - DNA, 25 bp, Rattus norvegicus
agcgcctaagccagccaaggctttg

SEQ ID NO: 557892 - DNA, 25 bp, Rattus norvegicus
cttcgcccggggacagtgctcggca

SEQ ID NO: 557893 - DNA, 25 bp, Rattus norvegicus
ttcagattgtgcttcgcccggggac

SEQ ID NO: 557894 - DNA, 25 bp, Rattus norvegicus
ccggacccccagtagcttcagattg

SEQ ID NO: 557895 - DNA, 25 bp, Rattus norvegicus
gctgccgcttcagtggtctccggac

SEQ ID NO: 557896 - DNA, 25 bp, Rattus norvegicus
ggggcacctgcgctgcaagtaccca

SEQ ID NO: 557897 - DNA, 25 bp, Rattus norvegicus
agctcaccgccctcgcagagcgcca

SEQ ID NO: 557898 - DNA, 25 bp, Rattus norvegicus
agcagccctcatcaagccagctagc

SEQ ID NO: 557899 - DNA, 25 bp, Rattus norvegicus
acagtgctcggcagaagctggaaga

SEQ ID NO: 557900 - DNA, 25 bp, Rattus norvegicus
cagccaaggctttggcgggactgca

SEQ ID NO: 557901 - DNA, 25 bp, Rattus norvegicus
tccctgcagaggtaaagcgtgctca

SEQ ID NO: 557902 - DNA, 25 bp, Rattus norvegicus
gcacgccaccgcctgtgtcacccaa

SEQ ID NO: 557903 - DNA, 25 bp, Rattus norvegicus
ggtaaagcgtgctcacggcacgcca

SEQ ID NO: 557904 - DNA, 25 bp, Rattus norvegicus
tttggcgggactgcagtccagcagc

SEQ ID NO: 557905 - DNA, 25 bp, Rattus norvegicus
ttgtagtcggcagaggaaagcctcc

SEQ ID NO: 557906 - DNA, 25 bp, Rattus norvegicus
cctccgaacgtctgtgccgggacat

SEQ ID NO: 557907 - DNA, 25 bp, Rattus norvegicus
ggagccaacctctgcggtcaaccgt

SEQ ID NO: 557908 - DNA, 25 bp, Rattus norvegicus
tgcggtcaaccgtccgcacgatctg

SEQ ID NO: 557909 - DNA, 25 bp, Rattus norvegicus
agggcgaaaatcagccgaggaagct

SEQ ID NO: 557910 - DNA, 25 bp, Rattus norvegicus
agccgaggaagctgaggctgccata

SEQ ID NO: 557911 - DNA, 25 bp, Rattus norvegicus
tgaggctgccataggacgccgccgc

SEQ ID NO: 557912 - DNA, 25 bp, Rattus norvegicus
cgcatggcgtccatcttgctcagga

SEQ ID NO: 557913 - DNA, 25 bp, Rattus norvegicus
ccatcttgctcaggagctgccgcgg

SEQ ID NO: 557914 - DNA, 25 bp, Rattus norvegicus
taagcgggagctgcgcacccgacct

SEQ ID NO: 557915 - DNA, 25 bp, Rattus norvegicus
cacccgacctgttgtgggcgaccag

SEQ ID NO: 557916 - DNA, 25 bp, Rattus norvegicus
cagcgcggcagtgacaagcaccggc

SEQ ID NO: 557917 - DNA, 25 bp, Rattus norvegicus
cagtgacaagcaccggcggctctgt

SEQ ID NO: 557918 - DNA, 25 bp, Rattus norvegicus
aaagcctcccggatgcacgctggga

SEQ ID NO: 557919 - DNA, 25 bp, Rattus norvegicus
accgtggctccttttcgtatccttg

SEQ ID NO: 557920 - DNA, 25 bp, Rattus norvegicus
aacagcttgggtccgtccttacctg

SEQ ID NO: 557921 - DNA, 25 bp, Rattus norvegicus
ccaagggctgttcgctgatgccaaa

SEQ ID NO: 557922 - DNA, 25 bp, Rattus norvegicus
ccctgtggtgctactcaacccaatg

SEQ ID NO: 557923 - DNA, 25 bp, Rattus norvegicus
ataaactgccgcgtccgagctgaca

SEQ ID NO: 557924 - DNA, 25 bp, Rattus norvegicus
tggcggaaccaataaccaggcactt

SEQ ID NO: 557925 - DNA, 25 bp, Rattus norvegicus
tgcgagacactgagagctgagcttt

SEQ ID NO: 557926 - DNA, 25 bp, Rattus norvegicus
gagctttggctgagatactactatc

SEQ ID NO: 557927 - DNA, 25 bp, Rattus norvegicus
cggctctgaagctgtcaccttgtca

SEQ ID NO: 557928 - DNA, 25 bp, Rattus norvegicus
ccctcaggcagcgtacgggataaga

SEQ ID NO: 557929 - DNA, 25 bp, Rattus norvegicus
ccagaggactatctaggcggtgcca

SEQ ID NO: 557930 - DNA, 25 bp, Rattus norvegicus
gggcactcagtgtcccatcggactt

SEQ ID NO: 557931 - DNA, 25 bp, Rattus norvegicus
accaactcgctgctctggaccggga

SEQ ID NO: 557932 - DNA, 25 bp, Rattus norvegicus
tccgcaatgtcgagccttcctttag

SEQ ID NO: 557933 - DNA, 25 bp, Rattus norvegicus
tccggagcgtgaccccagctttcag

SEQ ID NO: 557934 - DNA, 25 bp, Rattus norvegicus
cccagcgaccgggagcgcaaagagt

SEQ ID NO: 557935 - DNA, 25 bp, Rattus norvegicus
tttgcataatctccgggccgggctg

SEQ ID NO: 557936 - DNA, 25 bp, Rattus norvegicus
agccgccggggatttgcataatctc

SEQ ID NO: 557937 - DNA, 25 bp, Rattus norvegicus
ggcgccgctcaaaggccgctaatgt

SEQ ID NO: 557938 - DNA, 25 bp, Rattus norvegicus
gctcaaaggccgctaatgttcgcta

SEQ ID NO: 557939 - DNA, 25 bp, Rattus norvegicus
aggccgctaatgttcgctaatcccg

SEQ ID NO: 557940 - DNA, 25 bp, Rattus norvegicus
atgttcgctaatcccggcctttcag

SEQ ID NO: 557941 - DNA, 25 bp, Rattus norvegicus
gcccgagctgttggcccaacaacag

SEQ ID NO: 557942 - DNA, 25 bp, Rattus norvegicus
tggcccaacaacaggcggctgaaag

SEQ ID NO: 557943 - DNA, 25 bp, Rattus norvegicus
gggactgggactgggccatccctcc

SEQ ID NO: 557944 - DNA, 25 bp, Rattus norvegicus
cgaccgggagcgcaaagagtcccag

SEQ ID NO: 557945 - DNA, 25 bp, Rattus norvegicus
cagcgcctcgttagggatttaatta

SEQ ID NO: 557946 - DNA, 25 bp, Rattus norvegicus
agaagcggtgcgcacacgaggcctt

SEQ ID NO: 557947 - DNA, 25 bp, Rattus norvegicus
tgcagctgttcagccgcctgcggct

SEQ ID NO: 557948 - DNA, 25 bp, Rattus norvegicus
gagcactggccagcgaagccagcag

SEQ ID NO: 557949 - DNA, 25 bp, Rattus norvegicus
ctggccagcgaagccagcaggagct

SEQ ID NO: 557950 - DNA, 25 bp, Rattus norvegicus
ggccttgcagctgttcagccgcctg

SEQ ID NO: 557951 - DNA, 25 bp, Rattus norvegicus
tgagttgtgcttggatctgcgaagc

SEQ ID NO: 557952 - DNA, 25 bp, Rattus norvegicus
cccgcactgccggacagcctgcgag

SEQ ID NO: 557953 - DNA, 25 bp, Rattus norvegicus
ctgtgggccgagcaattaggaatcc

SEQ ID NO: 557954 - DNA, 25 bp, Rattus norvegicus
gggacgccgagtgccccgctaacaa

SEQ ID NO: 557955 - DNA, 25 bp, Rattus norvegicus
gtcgccgctttgatccttgccttct

SEQ ID NO: 557956 - DNA, 25 bp, Rattus norvegicus
tcacctagtctctcgccctaatgag

SEQ ID NO: 557957 - DNA, 25 bp, Rattus norvegicus
agtctctcgccctaatgagttgtgc

SEQ ID NO: 557958 - DNA, 25 bp, Rattus norvegicus
cgccctaatgagttgtgcttggatc

SEQ ID NO: 557959 - DNA, 25 bp, Rattus norvegicus
tggatctgcgaagcgggaacacgac

SEQ ID NO: 557960 - DNA, 25 bp, Rattus norvegicus
actaggccggccttgcagctgttca

SEQ ID NO: 557961 - DNA, 25 bp, Rattus norvegicus
ggcttggcttttctcagctgttaaa

SEQ ID NO: 557962 - DNA, 25 bp, Rattus norvegicus
accgagagttgacgttctgcagcca

SEQ ID NO: 557963 - DNA, 25 bp, Rattus norvegicus
gcgctgcagaagaggcctctgtata

SEQ ID NO: 557964 - DNA, 25 bp, Rattus norvegicus
ccacgggacagacaatctcagagtc

SEQ ID NO: 557965 - DNA, 25 bp, Rattus norvegicus
cgtgttcacgcccaacgagttctac

SEQ ID NO: 557966 - DNA, 25 bp, Rattus norvegicus
tgcagtgtctcctccgaactgtttg

SEQ ID NO: 557967 - DNA, 25 bp, Rattus norvegicus
tccgcacaggattccgagaattacc

SEQ ID NO: 557968 - DNA, 25 bp, Rattus norvegicus
gtctcccaggatgcccttcgggtta

SEQ ID NO: 557969 - DNA, 25 bp, Rattus norvegicus
tttcctagaatgctttgcgggtgtc

SEQ ID NO: 557970 - DNA, 25 bp, Rattus norvegicus
cgggtgtcttgacaggagtctctca

SEQ ID NO: 557971 - DNA, 25 bp, Rattus norvegicus
ctcacggctagcctgactaggactc

SEQ ID NO: 557972 - DNA, 25 bp, Rattus norvegicus
tggctgcggcaacctaccaactgtc

SEQ ID NO: 557973 - DNA, 25 bp, Rattus norvegicus
gtgaccttcacgttggcctacctgg

SEQ ID NO: 557974 - DNA, 25 bp, Rattus norvegicus
attgtcgtctagcatctcgggccca

SEQ ID NO: 557975 - DNA, 25 bp, Rattus norvegicus
ctgcagaccatcgacctgaaaggtg

SEQ ID NO: 557976 - DNA, 25 bp, Rattus norvegicus
ccgccatggcctgcagacctagaag

SEQ ID NO: 557977 - DNA, 25 bp, Rattus norvegicus
gcggtcatgcggttttcaagtcttc

SEQ ID NO: 557978 - DNA, 25 bp, Rattus norvegicus
aagtcttcggtttctagtctctctg

SEQ ID NO: 557979 - DNA, 25 bp, Rattus norvegicus
tctctctgtgaggtagggttccttg

SEQ ID NO: 557980 - DNA, 25 bp, Rattus norvegicus
ggctaggcaggctcagacctcttct

SEQ ID NO: 557981 - DNA, 25 bp, Rattus norvegicus
ggttccttgaaccatcggtgctttg

SEQ ID NO: 557982 - DNA, 25 bp, Rattus norvegicus
tctcctgcgcgatggagtctcggac

SEQ ID NO: 557983 - DNA, 25 bp, Rattus norvegicus
gaaggcgagctccagactgcagacc

SEQ ID NO: 557984 - DNA, 25 bp, Rattus norvegicus
ctgctggtgagctctccttcaaacc

SEQ ID NO: 557985 - DNA, 25 bp, Rattus norvegicus
cagttctgaggcttaggtcggaacc

SEQ ID NO: 557986 - DNA, 25 bp, Rattus norvegicus
ccggacagtatctgggtgttccacc

SEQ ID NO: 557987 - DNA, 25 bp, Rattus norvegicus
agacctcttctgtgctgtcgctggg

SEQ ID NO: 557988 - DNA, 25 bp, Rattus norvegicus
aagagaccggaagcctgaggactcc

SEQ ID NO: 557989 - DNA, 25 bp, Rattus norvegicus
gacattgctctgtgccgtcgttcgc

SEQ ID NO: 557990 - DNA, 25 bp, Rattus norvegicus
taggttaacgtcacacccggcgcgc

SEQ ID NO: 557991 - DNA, 25 bp, Rattus norvegicus
gttcgcctgcccatcgctaagagct

SEQ ID NO: 557992 - DNA, 25 bp, Rattus norvegicus
ggaacgccgtgtccttgcgctgtaa

SEQ ID NO: 557993 - DNA, 25 bp, Rattus norvegicus
cttgcgctgtaagcccggaatctcc

SEQ ID NO: 557994 - DNA, 25 bp, Rattus norvegicus
cggaatctccgtacgtcggccggcg

SEQ ID NO: 557995 - DNA, 25 bp, Rattus norvegicus
ccgcacgtcgagagccgggtgcatc

SEQ ID NO: 557996 - DNA, 25 bp, Rattus norvegicus
gtgcatcgccacagcgcgcggaaca

SEQ ID NO: 557997 - DNA, 25 bp, Rattus norvegicus
acagcgcgcggaacaccctctaggt

SEQ ID NO: 557998 - DNA, 25 bp, Rattus norvegicus
ggccggcacctcagcaccttaaggt

SEQ ID NO: 557999 - DNA, 25 bp, Rattus norvegicus
cagcactgtccttgtgtcccgtgtc

SEQ ID NO: 558000 - DNA, 25 bp, Rattus norvegicus
ctccgggacccagcatctcaaagaa

SEQ ID NO: 558001 - DNA, 25 bp, Rattus norvegicus
acgcccacaacaagccgggcagtga

SEQ ID NO: 558002 - DNA, 25 bp, Rattus norvegicus
acccgtcgcgcggacattgctctgt

SEQ ID NO: 558003 - DNA, 25 bp, Rattus norvegicus
gcgccgcggcagattagtcaagcgc

SEQ ID NO: 558004 - DNA, 25 bp, Rattus norvegicus
gctttcgtaatgagcacatattacc

SEQ ID NO: 558005 - DNA, 25 bp, Rattus norvegicus
gccagatctgttttgctttcgtaat

SEQ ID NO: 558006 - DNA, 25 bp, Rattus norvegicus
cctgcgtttattcatgccagatctg

SEQ ID NO: 558007 - DNA, 25 bp, Rattus norvegicus
gactgagcacttcatcctgcgttta

SEQ ID NO: 558008 - DNA, 25 bp, Rattus norvegicus
ctgtcacgttgcgactgagcacttc

SEQ ID NO: 558009 - DNA, 25 bp, Rattus norvegicus
cgccactgatcatgctgtcacgttg

SEQ ID NO: 558010 - DNA, 25 bp, Rattus norvegicus
tctgcgattactgccgccactgatc

SEQ ID NO: 558011 - DNA, 25 bp, Rattus norvegicus
agccctcgattctctgcgattactg

SEQ ID NO: 558012 - DNA, 25 bp, Rattus norvegicus
ggttatggaataatttagccctcga

SEQ ID NO: 558013 - DNA, 25 bp, Rattus norvegicus
cctcaaatcacggttatggaataat

SEQ ID NO: 558014 - DNA, 25 bp, Rattus norvegicus
acacgtcatggtgccgcaggcagct

SEQ ID NO: 558015 - DNA, 25 bp, Rattus norvegicus
ttttatcaggacacgtcatggtgcc

SEQ ID NO: 558016 - DNA, 25 bp, Rattus norvegicus
tgggaaggatgttttatcaggacac

SEQ ID NO: 558017 - DNA, 25 bp, Rattus norvegicus
tgtacagcagttcgcgcatgcgctc

SEQ ID NO: 558018 - DNA, 25 bp, Rattus norvegicus
ctcggtcacagcctgggtcgtaaca

SEQ ID NO: 558019 - DNA, 25 bp, Rattus norvegicus
cggatttgccaacccgaggcccatg

SEQ ID NO: 558020 - DNA, 25 bp, Rattus norvegicus
atgcggaatccgcaggctcctcact

SEQ ID NO: 558021 - DNA, 25 bp, Rattus norvegicus
ttacccagcggcaggcccttgttga

SEQ ID NO: 558022 - DNA, 25 bp, Rattus norvegicus
ctgggtatccacgagaaggattctc

SEQ ID NO: 558023 - DNA, 25 bp, Rattus norvegicus
acagcctgggtcgtaacaccacaga

SEQ ID NO: 558024 - DNA, 25 bp, Rattus norvegicus
ttgtcacctgcgcaagtcgcgagcg

SEQ ID NO: 558025 - DNA, 25 bp, Rattus norvegicus
cggaaaatagggacgcgcacacgca

SEQ ID NO: 558026 - DNA, 25 bp, Rattus norvegicus
gcacgcgcacgcctgtacagcagtt

SEQ ID NO: 558027 - DNA, 25 bp, Rattus norvegicus
cccttgttgagcaagtgcgagctgc

SEQ ID NO: 558028 - DNA, 25 bp, Rattus norvegicus
tgcgagctgcccattgaaaggcgcg

SEQ ID NO: 558029 - DNA, 25 bp, Rattus norvegicus
gctctcgtacacaaagccagcgctg

SEQ ID NO: 558030 - DNA, 25 bp, Rattus norvegicus
cctaggtccggcctgggtatccacg

SEQ ID NO: 558031 - DNA, 25 bp, Rattus norvegicus
ctagctgttggtggaactgtcaggc

SEQ ID NO: 558032 - DNA, 25 bp, Rattus norvegicus
cccgccagggaaagtgatctgtgca

SEQ ID NO: 558033 - DNA, 25 bp, Rattus norvegicus
cgccagggaaagtgatctgtgcaca

SEQ ID NO: 558034 - DNA, 25 bp, Rattus norvegicus
ccagggaaagtgatctgtgcacagg

SEQ ID NO: 558035 - DNA, 25 bp, Rattus norvegicus
aaagtgatctgtgcacagggtcaca

SEQ ID NO: 558036 - DNA, 25 bp, Rattus norvegicus
gtgatctgtgcacagggtcacatac

SEQ ID NO: 558037 - DNA, 25 bp, Rattus norvegicus
ataccctccgggcacgcagagtaag

SEQ ID NO: 558038 - DNA, 25 bp, Rattus norvegicus
tccgggcacgcagagtaagagccta

SEQ ID NO: 558039 - DNA, 25 bp, Rattus norvegicus
agcctagctgttggtggaactgtca

SEQ ID NO: 558040 - DNA, 25 bp, Rattus norvegicus
cagagtaagagcctagctgttggtg

SEQ ID NO: 558041 - DNA, 25 bp, Rattus norvegicus
cacgcagagtaagagcctagctgtt

SEQ ID NO: 558042 - DNA, 25 bp, Rattus norvegicus
tcaggcgagcgtagcgagtgatacc

SEQ ID NO: 558043 - DNA, 25 bp, Rattus norvegicus
cgggcacgcagagtaagagcctagc

SEQ ID NO: 558044 - DNA, 25 bp, Rattus norvegicus
accctccgggcacgcagagtaagag

SEQ ID NO: 558045 - DNA, 25 bp, Rattus norvegicus
ccagtaaagcaacgcagcctgctgc

SEQ ID NO: 558046 - DNA, 25 bp, Rattus norvegicus
ctacgcaaagccagtaaagcaacgc

SEQ ID NO: 558047 - DNA, 25 bp, Rattus norvegicus
cgcaaagccagtaaagcaacgcagc

SEQ ID NO: 558048 - DNA, 25 bp, Rattus norvegicus
gcaaagccagtaaagcaacgcagcc

SEQ ID NO: 558049 - DNA, 25 bp, Rattus norvegicus
cttcagactacgcaaagccagtaaa

SEQ ID NO: 558050 - DNA, 25 bp, Rattus norvegicus
gccagtaaagcaacgcagcctgctg

SEQ ID NO: 558051 - DNA, 25 bp, Rattus norvegicus
gtaaagcaacgcagcctgctgcgca

SEQ ID NO: 558052 - DNA, 25 bp, Rattus norvegicus
agcaacgcagcctgctgcgcatgtg

SEQ ID NO: 558053 - DNA, 25 bp, Rattus norvegicus
caacgcagcctgctgcgcatgtgca

SEQ ID NO: 558054 - DNA, 25 bp, Rattus norvegicus
acgcagcctgctgcgcatgtgcact

SEQ ID NO: 558055 - DNA, 25 bp, Rattus norvegicus
cagcctgctgcgcatgtgcacttgt

SEQ ID NO: 558056 - DNA, 25 bp, Rattus norvegicus
cagactacgcaaagccagtaaagca

SEQ ID NO: 558057 - DNA, 25 bp, Rattus norvegicus
tcagactacgcaaagccagtaaagc

SEQ ID NO: 558058 - DNA, 25 bp, Rattus norvegicus
aaagccagtaaagcaacgcagcctg

SEQ ID NO: 558059 - DNA, 25 bp, Rattus norvegicus
gcggcctctgagcaaggtgctctga

SEQ ID NO: 558060 - DNA, 25 bp, Rattus norvegicus
gctccgccttccatgaggtgcagta

SEQ ID NO: 558061 - DNA, 25 bp, Rattus norvegicus
cttgtgccgcagcagtctacgtgag

SEQ ID NO: 558062 - DNA, 25 bp, Rattus norvegicus
gccgcagcagtctacgtgaggcttc

SEQ ID NO: 558063 - DNA, 25 bp, Rattus norvegicus
gcagtctacgtgaggcttcgctgga

SEQ ID NO: 558064 - DNA, 25 bp, Rattus norvegicus
tacgtgaggcttcgctggatggtca

SEQ ID NO: 558065 - DNA, 25 bp, Rattus norvegicus
gagcctagcttacgacactaacttg

SEQ ID NO: 558066 - DNA, 25 bp, Rattus norvegicus
cttccatgaggtgcagtagagccta

SEQ ID NO: 558067 - DNA, 25 bp, Rattus norvegicus
ccaggccgcggcctctgagcaaggt

SEQ ID NO: 558068 - DNA, 25 bp, Rattus norvegicus
aacttgattgagctggccaggccgc

SEQ ID NO: 558069 - DNA, 25 bp, Rattus norvegicus
cgacactaacttgattgagctggcc

SEQ ID NO: 558070 - DNA, 25 bp, Rattus norvegicus
catgaggtgcagtagagcctagctt

SEQ ID NO: 558071 - DNA, 25 bp, Rattus norvegicus
agcaaggtgctctgaagtcgctgcg

SEQ ID NO: 558072 - DNA, 25 bp, Rattus norvegicus
gaagtcgctgcggttcggcctcctc

SEQ ID NO: 558073 - DNA, 25 bp, Rattus norvegicus
gccacggcgtgcaccacctgaaatt

SEQ ID NO: 558074 - DNA, 25 bp, Rattus norvegicus
ctcgatcactgctgtgcgtcctgca

SEQ ID NO: 558075 - DNA, 25 bp, Rattus norvegicus
aagacgcatgccacttctacatgca

SEQ ID NO: 558076 - DNA, 25 bp, Rattus norvegicus
cacctgaaattgatcgccgcctctt

SEQ ID NO: 558077 - DNA, 25 bp, Rattus norvegicus
gggatgaagacgcatgccacttcta

SEQ ID NO: 558078 - DNA, 25 bp, Rattus norvegicus
agttactcgccatgggccgagagcg

SEQ ID NO: 558079 - DNA, 25 bp, Rattus norvegicus
gtctcagttactcgccatgggccga

SEQ ID NO: 558080 - DNA, 25 bp, Rattus norvegicus
ttctacatgcaccactcgatcactg

SEQ ID NO: 558081 - DNA, 25 bp, Rattus norvegicus
catgcaccactcgatcactgctgtg

SEQ ID NO: 558082 - DNA, 25 bp, Rattus norvegicus
gtgcgtcctgcagctacatccaatg

SEQ ID NO: 558083 - DNA, 25 bp, Rattus norvegicus
tgcagctacatccaatgccacggcg

SEQ ID NO: 558084 - DNA, 25 bp, Rattus norvegicus
ggcgtgcaccacctgaaattgatcg

SEQ ID NO: 558085 - DNA, 25 bp, Rattus norvegicus
ttgatcgccgcctcttctaggcctt

SEQ ID NO: 558086 - DNA, 25 bp, Rattus norvegicus
gtggtctcagttactcgccatgggc

SEQ ID NO: 558087 - DNA, 25 bp, Rattus norvegicus
cgctctctagagctgtcggcgattg

SEQ ID NO: 558088 - DNA, 25 bp, Rattus norvegicus
tcggtgtactgtgacctagatggca

SEQ ID NO: 558089 - DNA, 25 bp, Rattus norvegicus
acccgaccctcaaggtgcgttctag

SEQ ID NO: 558090 - DNA, 25 bp, Rattus norvegicus
ccagctgtccatgaccctgaaggtg

SEQ ID NO: 558091 - DNA, 25 bp, Rattus norvegicus
ctcgtgaaagatgattggccctgga

SEQ ID NO: 558092 - DNA, 25 bp, Rattus norvegicus
cgggcatgcctctggtgctaattag

SEQ ID NO: 558093 - DNA, 25 bp, Rattus norvegicus
ctacgccggcggacaattcaatgag

SEQ ID NO: 558094 - DNA, 25 bp, Rattus norvegicus
ttaaatctgcatctgcggcctacgc

SEQ ID NO: 558095 - DNA, 25 bp, Rattus norvegicus
gcgtcaggatctcggctctattaaa

SEQ ID NO: 558096 - DNA, 25 bp, Rattus norvegicus
caactctcggaatgtacatggcgtc

SEQ ID NO: 558097 - DNA, 25 bp, Rattus norvegicus
ggtgcgattccaacgtgagccgttc

SEQ ID NO: 558098 - DNA, 25 bp, Rattus norvegicus
ggcccgatgtcacgattggtgcaga

SEQ ID NO: 558099 - DNA, 25 bp, Rattus norvegicus
ctagggtcgccaccgtatcttcgga

SEQ ID NO: 558100 - DNA, 25 bp, Rattus norvegicus
ggcagggcctgtaaccactaggaga

SEQ ID NO: 558101 - DNA, 25 bp, Rattus norvegicus
ctaatctgaaaggaccagagcgggc

SEQ ID NO: 558102 - DNA, 25 bp, Rattus norvegicus
tgtcaccggaacagcggaacgctgg

SEQ ID NO: 558103 - DNA, 25 bp, Rattus norvegicus
acagagcgctgcctacaccggaagg

SEQ ID NO: 558104 - DNA, 25 bp, Rattus norvegicus
gcctcctttttctcgcgcttagttc

SEQ ID NO: 558105 - DNA, 25 bp, Rattus norvegicus
agacaagaggctgcatccggtggtc

SEQ ID NO: 558106 - DNA, 25 bp, Rattus norvegicus
tggccggtcagattctcggcccgca

SEQ ID NO: 558107 - DNA, 25 bp, Rattus norvegicus
tcttctggagtttgtgcccgccgct

SEQ ID NO: 558108 - DNA, 25 bp, Rattus norvegicus
tccctggggcctgtaacagagcgct

SEQ ID NO: 558109 - DNA, 25 bp, Rattus norvegicus
gagactggtggtggcctaatctgaa

SEQ ID NO: 558110 - DNA, 25 bp, Rattus norvegicus
ccacccgggcaaatgcgggagactg

SEQ ID NO: 558111 - DNA, 25 bp, Rattus norvegicus
ctcgcgcttagttcttcttgaactg

SEQ ID NO: 558112 - DNA, 25 bp, Rattus norvegicus
gcggaacgctggtactgtctcctga

SEQ ID NO: 558113 - DNA, 25 bp, Rattus norvegicus
tccggtggtccgtgtcaccggaaca

SEQ ID NO: 558114 - DNA, 25 bp, Rattus norvegicus
tactgtctcctgaagcggagggtca

SEQ ID NO: 558115 - DNA, 25 bp, Rattus norvegicus
ccttggctggatcaaattagggacg

SEQ ID NO: 558116 - DNA, 25 bp, Rattus norvegicus
aattaccgcgggcaatgatccttcg

SEQ ID NO: 558117 - DNA, 25 bp, Rattus norvegicus
gaggagacagcccagcttttaaata

SEQ ID NO: 558118 - DNA, 25 bp, Rattus norvegicus
cccggattgctatttttcgcgtctg

SEQ ID NO: 558119 - DNA, 25 bp, Rattus norvegicus
cgagagcccgctctgcacaaggacg

SEQ ID NO: 558120 - DNA, 25 bp, Rattus norvegicus
aatctggtcaggttctctgtccctc

SEQ ID NO: 558121 - DNA, 25 bp, Rattus norvegicus
cggccgcgagtgacgctcattagaa

SEQ ID NO: 558122 - DNA, 25 bp, Rattus norvegicus
caggtggcctacataaagatcgata

SEQ ID NO: 558123 - DNA, 25 bp, Rattus norvegicus
gtgcaccgtctcttccacagtctgg

SEQ ID NO: 558124 - DNA, 25 bp, Rattus norvegicus
tggatatttacaggacggcctccgc

SEQ ID NO: 558125 - DNA, 25 bp, Rattus norvegicus
gccgatgctttgcttccgagtttcc

SEQ ID NO: 558126 - DNA, 25 bp, Rattus norvegicus
agctgacccgactctgaaggaccca

SEQ ID NO: 558127 - DNA, 25 bp, Rattus norvegicus
ttttcgcgtctggagcaatctggtc

SEQ ID NO: 558128 - DNA, 25 bp, Rattus norvegicus
gtgctccagcggatgtgcactcctc

SEQ ID NO: 558129 - DNA, 25 bp, Rattus norvegicus
tcgccttaggtcctctggccacgag

SEQ ID NO: 558130 - DNA, 25 bp, Rattus norvegicus
gtagcgagtggccttaaacttgttc

SEQ ID NO: 558131 - DNA, 25 bp, Rattus norvegicus
aaacttgttctccagcgccacgagc

SEQ ID NO: 558132 - DNA, 25 bp, Rattus norvegicus
gtacgtctgcgagcccagcacgaag

SEQ ID NO: 558133 - DNA, 25 bp, Rattus norvegicus
ccacgaggccttatggtgcagtccc

SEQ ID NO: 558134 - DNA, 25 bp, Rattus norvegicus
ccttagaaaagagatggccgcgctc

SEQ ID NO: 558135 - DNA, 25 bp, Rattus norvegicus
cggctatatacaggaccaacgactg

SEQ ID NO: 558136 - DNA, 25 bp, Rattus norvegicus
ctcttctgtaggaaccggctatata

SEQ ID NO: 558137 - DNA, 25 bp, Rattus norvegicus
cctgcgcacactcgtttataaattt

SEQ ID NO: 558138 - DNA, 25 bp, Rattus norvegicus
tgcaaagtgcttggagcaggccacg

SEQ ID NO: 558139 - DNA, 25 bp, Rattus norvegicus
cgcgtggcttcctgtggtttattaa

SEQ ID NO: 558140 - DNA, 25 bp, Rattus norvegicus
ggtgtcagcgccaggattttgtttc

SEQ ID NO: 558141 - DNA, 25 bp, Rattus norvegicus
agagccttcggaaaaacctcgcgtg

SEQ ID NO: 558142 - DNA, 25 bp, Rattus norvegicus
gatcctggcaccgaggttcagaggt

SEQ ID NO: 558143 - DNA, 25 bp, Rattus norvegicus
tgggtaagtcaccaagccagccgcc

SEQ ID NO: 558144 - DNA, 25 bp, Rattus norvegicus
tccctgagcattccggtcggtgaga

SEQ ID NO: 558145 - DNA, 25 bp, Rattus norvegicus
tttggcccagcagaatctttccaga

SEQ ID NO: 558146 - DNA, 25 bp, Rattus norvegicus
aatgacccaggtcgcttgaagactg

SEQ ID NO: 558147 - DNA, 25 bp, Rattus norvegicus
caggtcttagcagggcaactcttcc

SEQ ID NO: 558148 - DNA, 25 bp, Rattus norvegicus
ggcgaccgtagccagtcatccaagc

SEQ ID NO: 558149 - DNA, 25 bp, Rattus norvegicus
tctaggaacggaggaaggtcaatgc

SEQ ID NO: 558150 - DNA, 25 bp, Rattus norvegicus
atcaggagctggtcgaatgcaattc

SEQ ID NO: 558151 - DNA, 25 bp, Rattus norvegicus
catgcgccgtaatgggatatcgacc

SEQ ID NO: 558152 - DNA, 25 bp, Rattus norvegicus
ttccagagataaccagcgttttgtc

SEQ ID NO: 558153 - DNA, 25 bp, Rattus norvegicus
tggcgccgacatactggagcataaa

SEQ ID NO: 558154 - DNA, 25 bp, Rattus norvegicus
caccagagactgactaggcgaatcc

SEQ ID NO: 558155 - DNA, 25 bp, Rattus norvegicus
tctttccagaaacgtgcagcagtga

SEQ ID NO: 558156 - DNA, 25 bp, Rattus norvegicus
ttctccaaatgtgcagcgctcgctc

SEQ ID NO: 558157 - DNA, 25 bp, Rattus norvegicus
agccaaggacaagctctgcggagga

SEQ ID NO: 558158 - DNA, 25 bp, Rattus norvegicus
gtggaacctgctcccgaggcttttc

SEQ ID NO: 558159 - DNA, 25 bp, Rattus norvegicus
gaggcttttctgcttctgtcgcgcg

SEQ ID NO: 558160 - DNA, 25 bp, Rattus norvegicus
tggtctccgccgctgcaagccaagg

SEQ ID NO: 558161 - DNA, 25 bp, Rattus norvegicus
cccgtgtgctcatgactcttcgcga

SEQ ID NO: 558162 - DNA, 25 bp, Rattus norvegicus
gactcttcgcgaccgtctgatcagc

SEQ ID NO: 558163 - DNA, 25 bp, Rattus norvegicus
tctgatcagcgacagagggtttccc

SEQ ID NO: 558164 - DNA, 25 bp, Rattus norvegicus
tcgcaaacgtgaggctgaaccggcc

SEQ ID NO: 558165 - DNA, 25 bp, Rattus norvegicus
tgaaccggccttggccctggatgct

SEQ ID NO: 558166 - DNA, 25 bp, Rattus norvegicus
cggctcgaggtctccggtggaacct

SEQ ID NO: 558167 - DNA, 25 bp, Rattus norvegicus
gcgcagaacgcaccaggctctggcg

SEQ ID NO: 558168 - DNA, 25 bp, Rattus norvegicus
gtccctgtgcttgcttggcctcggg

SEQ ID NO: 558169 - DNA, 25 bp, Rattus norvegicus
aaggaaaacagagtcgcaaacgtga

SEQ ID NO: 558170 - DNA, 25 bp, Rattus norvegicus
ttctgcttctgtcgcgcgtggtctc

SEQ ID NO: 558171 - DNA, 25 bp, Rattus norvegicus
agcgtgccaaagtcctgggcgccgc

SEQ ID NO: 558172 - DNA, 25 bp, Rattus norvegicus
tggacctggctttgcgcctgcgtcc

SEQ ID NO: 558173 - DNA, 25 bp, Rattus norvegicus
tcggaccatgcagggagcgtgccaa

SEQ ID NO: 558174 - DNA, 25 bp, Rattus norvegicus
agccaggaatgcacggatcggacca

SEQ ID NO: 558175 - DNA, 25 bp, Rattus norvegicus
gtccaaatgcctgaagtgcagccag

SEQ ID NO: 558176 - DNA, 25 bp, Rattus norvegicus
tgtcctgaggtcagagtccaaatgc

SEQ ID NO: 558177 - DNA, 25 bp, Rattus norvegicus
gcgcggaactgcagtgacccgtgtt

SEQ ID NO: 558178 - DNA, 25 bp, Rattus norvegicus
agctgtgtctgcacaggtgaagaca

SEQ ID NO: 558179 - DNA, 25 bp, Rattus norvegicus
acgtcactagggagggctgcgccac

SEQ ID NO: 558180 - DNA, 25 bp, Rattus norvegicus
tgttcctgtacggagacgtcactag

SEQ ID NO: 558181 - DNA, 25 bp, Rattus norvegicus
ttgtccgagacctgggtgttcctgt

SEQ ID NO: 558182 - DNA, 25 bp, Rattus norvegicus
tttcagggtggttgtccgagacctg

SEQ ID NO: 558183 - DNA, 25 bp, Rattus norvegicus
tgtctgcgatgtagcgggtgtttca

SEQ ID NO: 558184 - DNA, 25 bp, Rattus norvegicus
aggtgaagacacacggccgcttcgc

SEQ ID NO: 558185 - DNA, 25 bp, Rattus norvegicus
cagctcctaggtgtgcagtgctcta

SEQ ID NO: 558186 - DNA, 25 bp, Rattus norvegicus
cgatgactgatatgtcagccgcatt

SEQ ID NO: 558187 - DNA, 25 bp, Rattus norvegicus
cagccgcattgcgaatgcgctcata

SEQ ID NO: 558188 - DNA, 25 bp, Rattus norvegicus
gctcataggactggatgggtgcatc

SEQ ID NO: 558189 - DNA, 25 bp, Rattus norvegicus
gaccgcctggcacaaaagtcctctg

SEQ ID NO: 558190 - DNA, 25 bp, Rattus norvegicus
taacagcggggctcaaggtgctact

SEQ ID NO: 558191 - DNA, 25 bp, Rattus norvegicus
tcaaggtgctactgtccatggcggt

SEQ ID NO: 558192 - DNA, 25 bp, Rattus norvegicus
ggggccactcactccttatactgct

SEQ ID NO: 558193 - DNA, 25 bp, Rattus norvegicus
ccggcaggtaaagtctgttcggtga

SEQ ID NO: 558194 - DNA, 25 bp, Rattus norvegicus
tgcaccgcaccgtcgggaagcagct

SEQ ID NO: 558195 - DNA, 25 bp, Rattus norvegicus
cagtgggcacctcgcacagttgcca

SEQ ID NO: 558196 - DNA, 25 bp, Rattus norvegicus
agtgctctaagtcagcaaagctgca

SEQ ID NO: 558197 - DNA, 25 bp, Rattus norvegicus
ccacgaagtagatgacgatgactga

SEQ ID NO: 558198 - DNA, 25 bp, Rattus norvegicus
ctgcttttgagttaatgatcagccc

SEQ ID NO: 558199 - DNA, 25 bp, Rattus norvegicus
ctataaatagcagcgactagggccg

SEQ ID NO: 558200 - DNA, 25 bp, Rattus norvegicus
gatggtggttccactggcaggcgtt

SEQ ID NO: 558201 - DNA, 25 bp, Rattus norvegicus
attttaccgccgcagcgttgaaggg

SEQ ID NO: 558202 - DNA, 25 bp, Rattus norvegicus
aagagtgctgcattttaccgccgca

SEQ ID NO: 558203 - DNA, 25 bp, Rattus norvegicus
ggcgccttaagagtgctgcatttta

SEQ ID NO: 558204 - DNA, 25 bp, Rattus norvegicus
aatagcagcgactagggccgcgctg

SEQ ID NO: 558205 - DNA, 25 bp, Rattus norvegicus
ggtgacgtcatctactataaatagc

SEQ ID NO: 558206 - DNA, 25 bp, Rattus norvegicus
ttttttaaggtgacgtcatctacta

SEQ ID NO: 558207 - DNA, 25 bp, Rattus norvegicus
gggaggacacgaccacgcctgcgca

SEQ ID NO: 558208 - DNA, 25 bp, Rattus norvegicus
ttctcgctagctggctgcacgcgct

SEQ ID NO: 558209 - DNA, 25 bp, Rattus norvegicus
caccgccttcatggcggaggccatg

SEQ ID NO: 558210 - DNA, 25 bp, Rattus norvegicus
cgcgcccaaaaggtggcggtgcgta

SEQ ID NO: 558211 - DNA, 25 bp, Rattus norvegicus
cccggccaggcctcaggaaatggag

SEQ ID NO: 558212 - DNA, 25 bp, Rattus norvegicus
tgcgcaggcgccttaagagtgctgc

SEQ ID NO: 558213 - DNA, 25 bp, Rattus norvegicus
gcaccgccgaacagcgctcacctga

SEQ ID NO: 558214 - DNA, 25 bp, Rattus norvegicus
ttcccgccaccgtccatggtgcttc

SEQ ID NO: 558215 - DNA, 25 bp, Rattus norvegicus
tcttcaaactcaattcccgttggcg

SEQ ID NO: 558216 - DNA, 25 bp, Rattus norvegicus
ggcgtcgagtctatcttcaaactca

SEQ ID NO: 558217 - DNA, 25 bp, Rattus norvegicus
gcgtggcgtcgagtctatcttcaaa

SEQ ID NO: 558218 - DNA, 25 bp, Rattus norvegicus
gccacttcctcctccggagctgggg

SEQ ID NO: 558219 - DNA, 25 bp, Rattus norvegicus
gcctccgcctcgtctcggtgaccgc

SEQ ID NO: 558220 - DNA, 25 bp, Rattus norvegicus
agacagacagcaccgccgaacagcg

SEQ ID NO: 558221 - DNA, 25 bp, Rattus norvegicus
gagccagacagacagcaccgccgaa

SEQ ID NO: 558222 - DNA, 25 bp, Rattus norvegicus
taggagccagacagacagcaccgcc

SEQ ID NO: 558223 - DNA, 25 bp, Rattus norvegicus
agctctaggagccagacagacagca

SEQ ID NO: 558224 - DNA, 25 bp, Rattus norvegicus
gcttccgcaccagagctctaggagc

SEQ ID NO: 558225 - DNA, 25 bp, Rattus norvegicus
gcagcttccgcaccagagctctagg

SEQ ID NO: 558226 - DNA, 25 bp, Rattus norvegicus
tcgtctcggtgaccgcgccacttcc

SEQ ID NO: 558227 - DNA, 25 bp, Rattus norvegicus
ctccagaagatctggtagagttggc

SEQ ID NO: 558228 - DNA, 25 bp, Rattus norvegicus
tccgccggatggtgctgactaaagg

SEQ ID NO: 558229 - DNA, 25 bp, Rattus norvegicus
ctagcagagggtggaggtaccagct

SEQ ID NO: 558230 - DNA, 25 bp, Rattus norvegicus
cagggagccgaagggcaccgaaaca

SEQ ID NO: 558231 - DNA, 25 bp, Rattus norvegicus
aagaggcctgggcagccccacgacg

SEQ ID NO: 558232 - DNA, 25 bp, Rattus norvegicus
ggcctcggctccagaagatctggta

SEQ ID NO: 558233 - DNA, 25 bp, Rattus norvegicus
ctcgggcctcggctccagaagatct

SEQ ID NO: 558234 - DNA, 25 bp, Rattus norvegicus
agagcactgtaggagcggtggaggc

SEQ ID NO: 558235 - DNA, 25 bp, Rattus norvegicus
gtccgtccgcatggctggctttggc

SEQ ID NO: 558236 - DNA, 25 bp, Rattus norvegicus
atcaaggtccgtccgcatggctggc

SEQ ID NO: 558237 - DNA, 25 bp, Rattus norvegicus
cgggatcaaggtccgtccgcatggc

SEQ ID NO: 558238 - DNA, 25 bp, Rattus norvegicus
gaagagccgccctccggattgcgcg

SEQ ID NO: 558239 - DNA, 25 bp, Rattus norvegicus
ggtaccagctgggaagagccgccct

SEQ ID NO: 558240 - DNA, 25 bp, Rattus norvegicus
tcctccgccggatggtgctgactaa

SEQ ID NO: 558241 - DNA, 25 bp, Rattus norvegicus
gccgggtgcaccttgatctgtatta

SEQ ID NO: 558242 - DNA, 25 bp, Rattus norvegicus
acagccatcacctgtctgcggaaga

SEQ ID NO: 558243 - DNA, 25 bp, Rattus norvegicus
ccttgatctgtattatgtcggtctc

SEQ ID NO: 558244 - DNA, 25 bp, Rattus norvegicus
ctgctgtccactgcgggcgaacgca

SEQ ID NO: 558245 - DNA, 25 bp, Rattus norvegicus
cggcgagctggctgctgtccactgc

SEQ ID NO: 558246 - DNA, 25 bp, Rattus norvegicus
catcacctgtctgcggaagactggg

SEQ ID NO: 558247 - DNA, 25 bp, Rattus norvegicus
gccatcacctgtctgcggaagactg

SEQ ID NO: 558248 - DNA, 25 bp, Rattus norvegicus
ggtgcaccttgatctgtattatgtc

SEQ ID NO: 558249 - DNA, 25 bp, Rattus norvegicus
tgtattatgtcggtctctgacagcc

SEQ ID NO: 558250 - DNA, 25 bp, Rattus norvegicus
tgcaccttgatctgtattatgtcgg

SEQ ID NO: 558251 - DNA, 25 bp, Rattus norvegicus
cgggtgcaccttgatctgtattatg

SEQ ID NO: 558252 - DNA, 25 bp, Rattus norvegicus
tgcgggcgaacgcaccgccgggact

SEQ ID NO: 558253 - DNA, 25 bp, Rattus norvegicus
gtctctgacagccatcacctgtctg

SEQ ID NO: 558254 - DNA, 25 bp, Rattus norvegicus
tgatctgtattatgtcggtctctga

SEQ ID NO: 558255 - DNA, 25 bp, Rattus norvegicus
cacacgaaaggtgggtgcgtcgtcc

SEQ ID NO: 558256 - DNA, 25 bp, Rattus norvegicus
tgaagacaacaaagggtcgccgatc

SEQ ID NO: 558257 - DNA, 25 bp, Rattus norvegicus
aaagggtcgccgatctccagcgggc

SEQ ID NO: 558258 - DNA, 25 bp, Rattus norvegicus
cggcggtgttccagtcttccttact

SEQ ID NO: 558259 - DNA, 25 bp, Rattus norvegicus
gttccagtcttccttactccgttca

SEQ ID NO: 558260 - DNA, 25 bp, Rattus norvegicus
gttcagcagaggctcgtcggcctcc

SEQ ID NO: 558261 - DNA, 25 bp, Rattus norvegicus
ccgctagtcccactccagatgaagt

SEQ ID NO: 558262 - DNA, 25 bp, Rattus norvegicus
tcccactccagatgaagtgtgagca

SEQ ID NO: 558263 - DNA, 25 bp, Rattus norvegicus
tgagcactgcacacgaaaggtgggt

SEQ ID NO: 558264 - DNA, 25 bp, Rattus norvegicus
ggcgaaagccaaggccgcgaatcga

SEQ ID NO: 558265 - DNA, 25 bp, Rattus norvegicus
agtcttccttactccgttcagcaga

SEQ ID NO: 558266 - DNA, 25 bp, Rattus norvegicus
tccttactccgttcagcagaggctc

SEQ ID NO: 558267 - DNA, 25 bp, Rattus norvegicus
tactccgttcagcagaggctcgtcg

SEQ ID NO: 558268 - DNA, 25 bp, Rattus norvegicus
ccagatgaagtgtgagcactgcaca

SEQ ID NO: 558269 - DNA, 25 bp, Rattus norvegicus
agagcaggtgctaccagccaccgcg

SEQ ID NO: 558270 - DNA, 25 bp, Rattus norvegicus
agccaccgcgtggactgtgaaatga

SEQ ID NO: 558271 - DNA, 25 bp, Rattus norvegicus
aaatgagtccgggtgtggcctaaag

SEQ ID NO: 558272 - DNA, 25 bp, Rattus norvegicus
tgactggaaggacacggcgctacct

SEQ ID NO: 558273 - DNA, 25 bp, Rattus norvegicus
ttgccgcgtgtaggtctgactggaa

SEQ ID NO: 558274 - DNA, 25 bp, Rattus norvegicus
aaggagcggtgtatcccatcgaccc

SEQ ID NO: 558275 - DNA, 25 bp, Rattus norvegicus
cgcagccggaaagcagtacgcagaa

SEQ ID NO: 558276 - DNA, 25 bp, Rattus norvegicus
agtacgcagaagcttccggcccagc

SEQ ID NO: 558277 - DNA, 25 bp, Rattus norvegicus
caggttcctgattggtccggtgaca

SEQ ID NO: 558278 - DNA, 25 bp, Rattus norvegicus
ggtcagcacaggtcaagccaggttc

SEQ ID NO: 558279 - DNA, 25 bp, Rattus norvegicus
ctggggagagaagccatttctcgtc

SEQ ID NO: 558280 - DNA, 25 bp, Rattus norvegicus
atttctcgtcgtccgcttgccgcgt

SEQ ID NO: 558281 - DNA, 25 bp, Rattus norvegicus
ctttccctcggctcaagagcaggtg

SEQ ID NO: 558282 - DNA, 25 bp, Rattus norvegicus
ggtctcgccggttctctccaattcg

SEQ ID NO: 558283 - DNA, 25 bp, Rattus norvegicus
agcgcgctgccttccgggaaacaga

SEQ ID NO: 558284 - DNA, 25 bp, Rattus norvegicus
tctcctcattgcgtggtggcgcacg

SEQ ID NO: 558285 - DNA, 25 bp, Rattus norvegicus
cagtctggggtttcgcgccctgcgt

SEQ ID NO: 558286 - DNA, 25 bp, Rattus norvegicus
cggcccgcgccggaagctgatctgt

SEQ ID NO: 558287 - DNA, 25 bp, Rattus norvegicus
tgtcgcgtttagagcgcgctgcctt

SEQ ID NO: 558288 - DNA, 25 bp, Rattus norvegicus
ctgccttccgggaaacagaggctcc

SEQ ID NO: 558289 - DNA, 25 bp, Rattus norvegicus
cagaggctccgcttcctacggtttt

SEQ ID NO: 558290 - DNA, 25 bp, Rattus norvegicus
tcttggccggaagtatcggcgcttc

SEQ ID NO: 558291 - DNA, 25 bp, Rattus norvegicus
tcttggaagcgtgtctccagttaca

SEQ ID NO: 558292 - DNA, 25 bp, Rattus norvegicus
cgtgtctccagttacaactcctgca

SEQ ID NO: 558293 - DNA, 25 bp, Rattus norvegicus
actcctgcacccgaccggtgtgaga

SEQ ID NO: 558294 - DNA, 25 bp, Rattus norvegicus
accggtgtgagaccgaaaagtgtct

SEQ ID NO: 558295 - DNA, 25 bp, Rattus norvegicus
gaaaagtgtctctcctcattgcgtg

SEQ ID NO: 558296 - DNA, 25 bp, Rattus norvegicus
cggaagctgatctgtcgcgtttaga

SEQ ID NO: 558297 - DNA, 25 bp, Rattus norvegicus
ttcttccggaggagcctccagtctg

SEQ ID NO: 558298 - DNA, 25 bp, Rattus norvegicus
gagtttctcagaggcggcccgcact

SEQ ID NO: 558299 - DNA, 25 bp, Rattus norvegicus
acagcccaggtcctgcgcatagcga

SEQ ID NO: 558300 - DNA, 25 bp, Rattus norvegicus
cgtgagtacagtccctgcccttctt

SEQ ID NO: 558301 - DNA, 25 bp, Rattus norvegicus
ccgacctgtggacttggtccctgct

SEQ ID NO: 558302 - DNA, 25 bp, Rattus norvegicus
ccctcatgacgcgtgggaacgcggc

SEQ ID NO: 558303 - DNA, 25 bp, Rattus norvegicus
ccttgagttgcccatagcggctgcc

SEQ ID NO: 558304 - DNA, 25 bp, Rattus norvegicus
tgtgaattcaggtgccggctcccac

SEQ ID NO: 558305 - DNA, 25 bp, Rattus norvegicus
gtcatgatcacgttcccgtagccgc

SEQ ID NO: 558306 - DNA, 25 bp, Rattus norvegicus
cgccgtgctcgtctggctattgtac

SEQ ID NO: 558307 - DNA, 25 bp, Rattus norvegicus
gctattgtacctttgccttccggcc

SEQ ID NO: 558308 - DNA, 25 bp, Rattus norvegicus
ccacggagaacccagcgcggcggat

SEQ ID NO: 558309 - DNA, 25 bp, Rattus norvegicus
ccagcgcggcttttccggcaggcat

SEQ ID NO: 558310 - DNA, 25 bp, Rattus norvegicus
cccatagcggctgcctgtgaattca

SEQ ID NO: 558311 - DNA, 25 bp, Rattus norvegicus
tcccactcatggtggcaggggctca

SEQ ID NO: 558312 - DNA, 25 bp, Rattus norvegicus
ctccttatcaggagagacgcccggg

SEQ ID NO: 558313 - DNA, 25 bp, Rattus norvegicus
gcccaaaaaagtgcgcgcagatact

SEQ ID NO: 558314 - DNA, 25 bp, Rattus norvegicus
cgagccataaaagacctagacccgg

SEQ ID NO: 558315 - DNA, 25 bp, Rattus norvegicus
tccgtgcaaagcgtgcgagccataa

SEQ ID NO: 558316 - DNA, 25 bp, Rattus norvegicus
ttccgccagccagagcggtgtcata

SEQ ID NO: 558317 - DNA, 25 bp, Rattus norvegicus
cgcaacactattccgcgagaagtcc

SEQ ID NO: 558318 - DNA, 25 bp, Rattus norvegicus
agcgcgggacttgctaattctcgca

SEQ ID NO: 558319 - DNA, 25 bp, Rattus norvegicus
actgtgccctttacctcggcttcga

SEQ ID NO: 558320 - DNA, 25 bp, Rattus norvegicus
cgaaccggccttcacactagctaga

SEQ ID NO: 558321 - DNA, 25 bp, Rattus norvegicus
tcggcttcgatctccgcgatcttcg

SEQ ID NO: 558322 - DNA, 25 bp, Rattus norvegicus
acctcggattcctggcttgtggaga

SEQ ID NO: 558323 - DNA, 25 bp, Rattus norvegicus
tagctagacctccttcacgcgtcag

SEQ ID NO: 558324 - DNA, 25 bp, Rattus norvegicus
cctgacgacgcggatggaaacaccg

SEQ ID NO: 558325 - DNA, 25 bp, Rattus norvegicus
tcggacctgccggtacgcaaggcag

SEQ ID NO: 558326 - DNA, 25 bp, Rattus norvegicus
gcttttgccggaggggcgcacctct

SEQ ID NO: 558327 - DNA, 25 bp, Rattus norvegicus
ctcggcgcttggatcgtattggtcg

SEQ ID NO: 558328 - DNA, 25 bp, Rattus norvegicus
tgggaaagggcccaccctgctgcag

SEQ ID NO: 558329 - DNA, 25 bp, Rattus norvegicus
gctgccatctttcctccgttccgaa

SEQ ID NO: 558330 - DNA, 25 bp, Rattus norvegicus
acgccgagctcactgctttcttctt

SEQ ID NO: 558331 - DNA, 25 bp, Rattus norvegicus
ccaggctagggagcccgatgcgcac

SEQ ID NO: 558332 - DNA, 25 bp, Rattus norvegicus
aagtttgcagcgctaggcggcccag

SEQ ID NO: 558333 - DNA, 25 bp, Rattus norvegicus
aagtggaaagtttgcagcgctaggc

SEQ ID NO: 558334 - DNA, 25 bp, Rattus norvegicus
gcgctcggcacaaagaaagtggaaa

SEQ ID NO: 558335 - DNA, 25 bp, Rattus norvegicus
gctgcagaaagaggggtgtataaat

SEQ ID NO: 558336 - DNA, 25 bp, Rattus norvegicus
gctttcttctttctgcaagctgggg

SEQ ID NO: 558337 - DNA, 25 bp, Rattus norvegicus
cagggtgctgatgcccgtcggacct

SEQ ID NO: 558338 - DNA, 25 bp, Rattus norvegicus
cgccactcgtgcctggcttgggaaa

SEQ ID NO: 558339 - DNA, 25 bp, Rattus norvegicus
atcttgtaataacttgcaagtgagc

SEQ ID NO: 558340 - DNA, 25 bp, Rattus norvegicus
tcaaatcccgttcgcaaaggggaca

SEQ ID NO: 558341 - DNA, 25 bp, Rattus norvegicus
cgcttggttcaaatcccgttcgcaa

SEQ ID NO: 558342 - DNA, 25 bp, Rattus norvegicus
tgcccgcgttcgcttggttcaaatc

SEQ ID NO: 558343 - DNA, 25 bp, Rattus norvegicus
tgcaagtgagcatctgcaatctagg

SEQ ID NO: 558344 - DNA, 25 bp, Rattus norvegicus
gctacaaacatcgaacattcggttt

SEQ ID NO: 558345 - DNA, 25 bp, Rattus norvegicus
ctcctaaaatgcattatcttgtaat

SEQ ID NO: 558346 - DNA, 25 bp, Rattus norvegicus
agggcttatctactcctaaaatgca

SEQ ID NO: 558347 - DNA, 25 bp, Rattus norvegicus
tgcttaaagggcttatctactccta

SEQ ID NO: 558348 - DNA, 25 bp, Rattus norvegicus
ccgcgttctgcttaaagggcttatc

SEQ ID NO: 558349 - DNA, 25 bp, Rattus norvegicus
tccgtgcgccgcgttctgcttaaag

SEQ ID NO: 558350 - DNA, 25 bp, Rattus norvegicus
gtttcgtctgctaccagcctccgtg

SEQ ID NO: 558351 - DNA, 25 bp, Rattus norvegicus
gaacattcggtttcgtctgctacca

SEQ ID NO: 558352 - DNA, 25 bp, Rattus norvegicus
catctgcaatctaggaaggtatccc

SEQ ID NO: 558353 - DNA, 25 bp, Rattus norvegicus
aggcagttcgctcgttccgcaaagc

SEQ ID NO: 558354 - DNA, 25 bp, Rattus norvegicus
cacttgtaaacaacggtgggaggca

SEQ ID NO: 558355 - DNA, 25 bp, Rattus norvegicus
tgagctcatcctctgcgagcacttg

SEQ ID NO: 558356 - DNA, 25 bp, Rattus norvegicus
ccgcagcattcggagtgagctcatc

SEQ ID NO: 558357 - DNA, 25 bp, Rattus norvegicus
ggccgcggagcccaaagcccattgg

SEQ ID NO: 558358 - DNA, 25 bp, Rattus norvegicus
gtcagagctatctccaggccgcgga

SEQ ID NO: 558359 - DNA, 25 bp, Rattus norvegicus
gcggtccgattggtcagagctatct

SEQ ID NO: 558360 - DNA, 25 bp, Rattus norvegicus
agcgagactggcgtccctgaaaagc

SEQ ID NO: 558361 - DNA, 25 bp, Rattus norvegicus
gtctccgctgcctcaactggttggc

SEQ ID NO: 558362 - DNA, 25 bp, Rattus norvegicus
ccctgcgaggacttgcgttgcccag

SEQ ID NO: 558363 - DNA, 25 bp, Rattus norvegicus
ggccctggtgctacatcagcagcga

SEQ ID NO: 558364 - DNA, 25 bp, Rattus norvegicus
cgtccctgaaaagcggccctgcgag

SEQ ID NO: 558365 - DNA, 25 bp, Rattus norvegicus
acgttagtcccgtgcgccgagcagc

SEQ ID NO: 558366 - DNA, 25 bp, Rattus norvegicus
gctcgcccagcccagtgagtgaacg

SEQ ID NO: 558367 - DNA, 25 bp, Rattus norvegicus
ctgcagcgggaaggatgcaccgcct

SEQ ID NO: 558368 - DNA, 25 bp, Rattus norvegicus
tgagtggcgacttctagaggcgttc

SEQ ID NO: 558369 - DNA, 25 bp, Rattus norvegicus
gggaggaccaaaccgcacctggcac

SEQ ID NO: 558370 - DNA, 25 bp, Rattus norvegicus
ttagagaggaggtcgtctctgcctc

SEQ ID NO: 558371 - DNA, 25 bp, Rattus norvegicus
ccgcgcccgcttgcggtttagagag

SEQ ID NO: 558372 - DNA, 25 bp, Rattus norvegicus
acacaggaaggaccacccggcagca

SEQ ID NO: 558373 - DNA, 25 bp, Rattus norvegicus
tccagggcgcggacaacacaggaag

SEQ ID NO: 558374 - DNA, 25 bp, Rattus norvegicus
cagccagccagaaactcgcggtcgg

SEQ ID NO: 558375 - DNA, 25 bp, Rattus norvegicus
tgaggatccctgacccaagagaaac

SEQ ID NO: 558376 - DNA, 25 bp, Rattus norvegicus
caccctgccaggatctcgctgagga

SEQ ID NO: 558377 - DNA, 25 bp, Rattus norvegicus
ggggaccacagtgttcgatcatccc

SEQ ID NO: 558378 - DNA, 25 bp, Rattus norvegicus
gacgacgcgctcctacttccagagt

SEQ ID NO: 558379 - DNA, 25 bp, Rattus norvegicus
caaggagccctcagtcttgggacga

SEQ ID NO: 558380 - DNA, 25 bp, Rattus norvegicus
tgcagattcggggacccacctcgcg

SEQ ID NO: 558381 - DNA, 25 bp, Rattus norvegicus
tcccacagtggacaagccagtctta

SEQ ID NO: 558382 - DNA, 25 bp, Rattus norvegicus
ccggaaaaggctggtgtggcagcac

SEQ ID NO: 558383 - DNA, 25 bp, Rattus norvegicus
ttagagcaacttccggttacagccg

SEQ ID NO: 558384 - DNA, 25 bp, Rattus norvegicus
ggagccacctctattagagcaactt

SEQ ID NO: 558385 - DNA, 25 bp, Rattus norvegicus
tgacaaggagccacctctattagag

SEQ ID NO: 558386 - DNA, 25 bp, Rattus norvegicus
ccggatcttgatcacctgacaagga

SEQ ID NO: 558387 - DNA, 25 bp, Rattus norvegicus
tcctacccggatcttgatcacctga

SEQ ID NO: 558388 - DNA, 25 bp, Rattus norvegicus
tcaggaagattgaacctccgaaccc

SEQ ID NO: 558389 - DNA, 25 bp, Rattus norvegicus
tcacgtacctgtccccgtagagcga

SEQ ID NO: 558390 - DNA, 25 bp, Rattus norvegicus
gccagtcttagagacgcgtcagtca

SEQ ID NO: 558391 - DNA, 25 bp, Rattus norvegicus
tgtggcagcactgcgttccggccca

SEQ ID NO: 558392 - DNA, 25 bp, Rattus norvegicus
gccagcgacgccaccagtccgttcc

SEQ ID NO: 558393 - DNA, 25 bp, Rattus norvegicus
acgcgtcagtcaggaagattgaacc

SEQ ID NO: 558394 - DNA, 25 bp, Rattus norvegicus
gccgtcctagctcgtcacgtacctg

SEQ ID NO: 558395 - DNA, 25 bp, Rattus norvegicus
tgctgctgcttctcgcagcccttgt

SEQ ID NO: 558396 - DNA, 25 bp, Rattus norvegicus
tggtttatggctgggcggagccttt

SEQ ID NO: 558397 - DNA, 25 bp, Rattus norvegicus
acctccatcaccacctaccgaccgg

SEQ ID NO: 558398 - DNA, 25 bp, Rattus norvegicus
gctgcttctcgcagcccttgtggct

SEQ ID NO: 558399 - DNA, 25 bp, Rattus norvegicus
gatgaacatcctactgtcgccgccg

SEQ ID NO: 558400 - DNA, 25 bp, Rattus norvegicus
ggcacagatgaacatcctactgtcg

SEQ ID NO: 558401 - DNA, 25 bp, Rattus norvegicus
ctgccaggcacagatgaacatccta

SEQ ID NO: 558402 - DNA, 25 bp, Rattus norvegicus
ctcctgccaggcacagatgaacatc

SEQ ID NO: 558403 - DNA, 25 bp, Rattus norvegicus
cgtctcctgccaggcacagatgaac

SEQ ID NO: 558404 - DNA, 25 bp, Rattus norvegicus
gtgcagcctgcggaacgtctcctgc

SEQ ID NO: 558405 - DNA, 25 bp, Rattus norvegicus
tttgggtgcagcctgcggaacgtct

SEQ ID NO: 558406 - DNA, 25 bp, Rattus norvegicus
tagacgtggcgcagcggccgagttt

SEQ ID NO: 558407 - DNA, 25 bp, Rattus norvegicus
cagcttgcgggctagacgtggcgca

SEQ ID NO: 558408 - DNA, 25 bp, Rattus norvegicus
tgtggctccagccacctccatcacc

SEQ ID NO: 558409 - DNA, 25 bp, Rattus norvegicus
gcggcgacttctacctgcgctgtct

SEQ ID NO: 558410 - DNA, 25 bp, Rattus norvegicus
tcaatgcggcaggttcccgagcagc

SEQ ID NO: 558411 - DNA, 25 bp, Rattus norvegicus
atgattctacgcagcctagggcgga

SEQ ID NO: 558412 - DNA, 25 bp, Rattus norvegicus
gaatgtcagagtggctagcggctcc

SEQ ID NO: 558413 - DNA, 25 bp, Rattus norvegicus
tcggcggcgcagctttccattggcc

SEQ ID NO: 558414 - DNA, 25 bp, Rattus norvegicus
cagctttccattggccggcctcggt

SEQ ID NO: 558415 - DNA, 25 bp, Rattus norvegicus
attggccggcgtgcccgtccgtcgt

SEQ ID NO: 558416 - DNA, 25 bp, Rattus norvegicus
tcgagtacctcatgaagaagcgttc

SEQ ID NO: 558417 - DNA, 25 bp, Rattus norvegicus
tgggccactcgagcttcatctcgcg

SEQ ID NO: 558418 - DNA, 25 bp, Rattus norvegicus
gctgtgacacatcggtcaatgcggc

SEQ ID NO: 558419 - DNA, 25 bp, Rattus norvegicus
tacctgcgctgtctcggcaagaacg

SEQ ID NO: 558420 - DNA, 25 bp, Rattus norvegicus
tctcggcaagaacggcgtgttcgtg

SEQ ID NO: 558421 - DNA, 25 bp, Rattus norvegicus
gtagatgtgagcatgggccactcga

SEQ ID NO: 558422 - DNA, 25 bp, Rattus norvegicus
cgagcagcgtgcatgattctacgca

SEQ ID NO: 558423 - DNA, 25 bp, Rattus norvegicus
tctaccgtaagtcggcgcccgaagc

SEQ ID NO: 558424 - DNA, 25 bp, Rattus norvegicus
aaactctcttgctgagggccgacgc

SEQ ID NO: 558425 - DNA, 25 bp, Rattus norvegicus
acaggagctcggcttctaccgtaag

SEQ ID NO: 558426 - DNA, 25 bp, Rattus norvegicus
gcttctaccgtaagtcggcgcccga

SEQ ID NO: 558427 - DNA, 25 bp, Rattus norvegicus
ccgggagcataaactctcttgctga

SEQ ID NO: 558428 - DNA, 25 bp, Rattus norvegicus
gcatcccgggagcataaactctctt

SEQ ID NO: 558429 - DNA, 25 bp, Rattus norvegicus
agaatgaagcgctcagcatcccggg

SEQ ID NO: 558430 - DNA, 25 bp, Rattus norvegicus
ccgagtacctgtgggcgcccgctaa

SEQ ID NO: 558431 - DNA, 25 bp, Rattus norvegicus
aggacgcttcggaccgcgccgactt

SEQ ID NO: 558432 - DNA, 25 bp, Rattus norvegicus
ccggagacagaatgaagcgctcagc

SEQ ID NO: 558433 - DNA, 25 bp, Rattus norvegicus
ctgagccacgttggagctgggaccc

SEQ ID NO: 558434 - DNA, 25 bp, Rattus norvegicus
acttgtagccctgagccacgttgga

SEQ ID NO: 558435 - DNA, 25 bp, Rattus norvegicus
gaccgcgccgacttgtagccctgag

SEQ ID NO: 558436 - DNA, 25 bp, Rattus norvegicus
gagctcggcttctaccgtaagtcgg

SEQ ID NO: 558437 - DNA, 25 bp, Rattus norvegicus
cgcaggcgcagctcatggcgccgca

SEQ ID NO: 558438 - DNA, 25 bp, Rattus norvegicus
cagcgattgcacgtaggtgaagacg

SEQ ID NO: 558439 - DNA, 25 bp, Rattus norvegicus
tacagcgattgcacgtaggtgaaga

SEQ ID NO: 558440 - DNA, 25 bp, Rattus norvegicus
ttgtacagcgattgcacgtaggtga

SEQ ID NO: 558441 - DNA, 25 bp, Rattus norvegicus
ggtggttgtacagcgattgcacgta

SEQ ID NO: 558442 - DNA, 25 bp, Rattus norvegicus
ctcatggcgccgcaggtggttgtac

SEQ ID NO: 558443 - DNA, 25 bp, Rattus norvegicus
gtgtttcgacagacggggcagcagt

SEQ ID NO: 558444 - DNA, 25 bp, Rattus norvegicus
tggctagacattcttgccgcgcagg

SEQ ID NO: 558445 - DNA, 25 bp, Rattus norvegicus
agtggctagacattcttgccgcgca

SEQ ID NO: 558446 - DNA, 25 bp, Rattus norvegicus
agcagtggctagacattcttgccgc

SEQ ID NO: 558447 - DNA, 25 bp, Rattus norvegicus
tgtgagcagtggctagacattcttg

SEQ ID NO: 558448 - DNA, 25 bp, Rattus norvegicus
cggtgtgagcagtggctagacattc

SEQ ID NO: 558449 - DNA, 25 bp, Rattus norvegicus
ctagacattcttgccgcgcaggcgc

SEQ ID NO: 558450 - DNA, 25 bp, Rattus norvegicus
cgcaggtggttgtacagcgattgca

SEQ ID NO: 558451 - DNA, 25 bp, Rattus norvegicus
cccgtcctcaggaatgtgcgggagc

SEQ ID NO: 558452 - DNA, 25 bp, Rattus norvegicus
gctgggcacagcttcccatataagg

SEQ ID NO: 558453 - DNA, 25 bp, Rattus norvegicus
caccgggcgatgaagctcggggctg

SEQ ID NO: 558454 - DNA, 25 bp, Rattus norvegicus
actgcggctcccctagtcagctggg

SEQ ID NO: 558455 - DNA, 25 bp, Rattus norvegicus
tcagctgggcacagcttcccatata

SEQ ID NO: 558456 - DNA, 25 bp, Rattus norvegicus
cggggccggaagcaactgcggctcc

SEQ ID NO: 558457 - DNA, 25 bp, Rattus norvegicus
ggcacagcttcccatataaggccgg

SEQ ID NO: 558458 - DNA, 25 bp, Rattus norvegicus
acagcttcccatataaggccgggcc

SEQ ID NO: 558459 - DNA, 25 bp, Rattus norvegicus
cgttcctgccacgaagccggagggt

SEQ ID NO: 558460 - DNA, 25 bp, Rattus norvegicus
ccggagggtgggaccctcacagctc

SEQ ID NO: 558461 - DNA, 25 bp, Rattus norvegicus
tgggaccctcacagctctgggcaca

SEQ ID NO: 558462 - DNA, 25 bp, Rattus norvegicus
cctcacagctctgggcacagcaatg

SEQ ID NO: 558463 - DNA, 25 bp, Rattus norvegicus
cacagcaatggcgcgcaccgggcga

SEQ ID NO: 558464 - DNA, 25 bp, Rattus norvegicus
agtcagctgggcacagcttcccata

SEQ ID NO: 558465 - DNA, 25 bp, Rattus norvegicus
ccgccaatcagaaggtggagtctca

SEQ ID NO: 558466 - DNA, 25 bp, Rattus norvegicus
cgcccgagttctgcgtacgagaaga

SEQ ID NO: 558467 - DNA, 25 bp, Rattus norvegicus
tcgtcggatcgcaaaggcataggcc

SEQ ID NO: 558468 - DNA, 25 bp, Rattus norvegicus
atggctcctccgctctgcgatgcag

SEQ ID NO: 558469 - DNA, 25 bp, Rattus norvegicus
cggctaaacaagatccggtcacgtg

SEQ ID NO: 558470 - DNA, 25 bp, Rattus norvegicus
gtggatcaacgttgcccgccaatca

SEQ ID NO: 558471 - DNA, 25 bp, Rattus norvegicus
cttacggagacaaagcggtgcctga

SEQ ID NO: 558472 - DNA, 25 bp, Rattus norvegicus
ggactctgagacgttctaaacgctg

SEQ ID NO: 558473 - DNA, 25 bp, Rattus norvegicus
aacgctgaatctcgtgacgctcgtc

SEQ ID NO: 558474 - DNA, 25 bp, Rattus norvegicus
ctgtcatcgtcttttctggcgcggc

SEQ ID NO: 558475 - DNA, 25 bp, Rattus norvegicus
gcagcgacagcacatggttccaaga

SEQ ID NO: 558476 - DNA, 25 bp, Rattus norvegicus
caggcaacgcccgatccgatctggt

SEQ ID NO: 558477 - DNA, 25 bp, Rattus norvegicus
cccggcgacaagacaagatggctcc

SEQ ID NO: 558478 - DNA, 25 bp, Rattus norvegicus
gctgcggtggttgagttccaattcc

SEQ ID NO: 558479 - DNA, 25 bp, Rattus norvegicus
cgctgcttctcggtgttggcctcgt

SEQ ID NO: 558480 - DNA, 25 bp, Rattus norvegicus
ccacagccggccgtgcacgactcca

SEQ ID NO: 558481 - DNA, 25 bp, Rattus norvegicus
gtcgccggttcaggcgctgcttctc

SEQ ID NO: 558482 - DNA, 25 bp, Rattus norvegicus
gctatgctctgtgctcaccttcctc

SEQ ID NO: 558483 - DNA, 25 bp, Rattus norvegicus
tcggtgttggcctcgtcccagcggc

SEQ ID NO: 558484 - DNA, 25 bp, Rattus norvegicus
tccatcagccgctggtccggccgca

SEQ ID NO: 558485 - DNA, 25 bp, Rattus norvegicus
tcctcctgctcgttgagggtcaggg

SEQ ID NO: 558486 - DNA, 25 bp, Rattus norvegicus
tcctgctcgttgagggtcagggcca

SEQ ID NO: 558487 - DNA, 25 bp, Rattus norvegicus
gtcagggccagctccgagaaatagt

SEQ ID NO: 558488 - DNA, 25 bp, Rattus norvegicus
ggccagctccgagaaatagtacatg

SEQ ID NO: 558489 - DNA, 25 bp, Rattus norvegicus
cagctccgagaaatagtacatgttc

SEQ ID NO: 558490 - DNA, 25 bp, Rattus norvegicus
cgagaaatagtacatgttctccgcg

SEQ ID NO: 558491 - DNA, 25 bp, Rattus norvegicus
tccgcgttctccctgtggcggtgag

SEQ ID NO: 558492 - DNA, 25 bp, Rattus norvegicus
gtgcacgactccagccgccgtcgcc

SEQ ID NO: 558493 - DNA, 25 bp, Rattus norvegicus
cgcacagctaggaggaccgcggaac

SEQ ID NO: 558494 - DNA, 25 bp, Rattus norvegicus
tcgcgaaaatccgagcgaaggtgcc

SEQ ID NO: 558495 - DNA, 25 bp, Rattus norvegicus
ggccacgtcatgtctgctcgcgaaa

SEQ ID NO: 558496 - DNA, 25 bp, Rattus norvegicus
aaggccactgcgcagcgtacaccgg

SEQ ID NO: 558497 - DNA, 25 bp, Rattus norvegicus
ccgtcggcgccgtgagagccaagct

SEQ ID NO: 558498 - DNA, 25 bp, Rattus norvegicus
gtccagcgtcgcgtcgcacggagca

SEQ ID NO: 558499 - DNA, 25 bp, Rattus norvegicus
tcgcgtggaccggtcctgcagcaaa

SEQ ID NO: 558500 - DNA, 25 bp, Rattus norvegicus
tgggcgctacatggcgcccgagtca

SEQ ID NO: 558501 - DNA, 25 bp, Rattus norvegicus
aggaacgcacggaggccgtctccca

SEQ ID NO: 558502 - DNA, 25 bp, Rattus norvegicus
gccagagctacagaaggaacgcacg

SEQ ID NO: 558503 - DNA, 25 bp, Rattus norvegicus
ttaaatttattcaggcagccagagc

SEQ ID NO: 558504 - DNA, 25 bp, Rattus norvegicus
tgacatcagaggctcgcgtggaccg

SEQ ID NO: 558505 - DNA, 25 bp, Rattus norvegicus
cggtcctgcagcaaagcccggcgtg

SEQ ID NO: 558506 - DNA, 25 bp, Rattus norvegicus
cccacgccatgagcaagtgacatca

SEQ ID NO: 558507 - DNA, 25 bp, Rattus norvegicus
caagcttttaggcagcggtcgcagt

SEQ ID NO: 558508 - DNA, 25 bp, Rattus norvegicus
caggtacggtgtctcagccagcgcc

SEQ ID NO: 558509 - DNA, 25 bp, Rattus norvegicus
caggggcgaggccaagaacgctgca

SEQ ID NO: 558510 - DNA, 25 bp, Rattus norvegicus
acgctgcaaaaaatatcagcatagc

SEQ ID NO: 558511 - DNA, 25 bp, Rattus norvegicus
aatatcagcatagcagaggcggggc

SEQ ID NO: 558512 - DNA, 25 bp, Rattus norvegicus
caccaggtacggtgtctcagccagc

SEQ ID NO: 558513 - DNA, 25 bp, Rattus norvegicus
ccaaaacagcaagcttttaggcagc

SEQ ID NO: 558514 - DNA, 25 bp, Rattus norvegicus
cgtccacgcgcaccaggtacggtgt

SEQ ID NO: 558515 - DNA, 25 bp, Rattus norvegicus
aggcagcggtcgcagtgttccgcct

SEQ ID NO: 558516 - DNA, 25 bp, Rattus norvegicus
cacgtgaccattcgccaggcctgga

SEQ ID NO: 558517 - DNA, 25 bp, Rattus norvegicus
tcgccaggcctggacaaaacggaac

SEQ ID NO: 558518 - DNA, 25 bp, Rattus norvegicus
tggacaaaacggaacccagtcacgc

SEQ ID NO: 558519 - DNA, 25 bp, Rattus norvegicus
acgcgccgcctcttcctggcgagtt

SEQ ID NO: 558520 - DNA, 25 bp, Rattus norvegicus
gcatggctgggatatccaggcgccc

SEQ ID NO: 558521 - DNA, 25 bp, Rattus norvegicus
cccgcaatcgcacgccggagaccgc

SEQ ID NO: 558522 - DNA, 25 bp, Rattus norvegicus
ggcagccatccagcccgcaatcgca

SEQ ID NO: 558523 - DNA, 25 bp, Rattus norvegicus
aggggcagcggctcgcacacgcaca

SEQ ID NO: 558524 - DNA, 25 bp, Rattus norvegicus
cacttcctgtttcaaagagagcgag

SEQ ID NO: 558525 - DNA, 25 bp, Rattus norvegicus
gatcaagagagtccccgcgagcaaa

SEQ ID NO: 558526 - DNA, 25 bp, Rattus norvegicus
acctggaccaggtggccaccctgct

SEQ ID NO: 558527 - DNA, 25 bp, Rattus norvegicus
cctcagggcgctctcgaggactcgg

SEQ ID NO: 558528 - DNA, 25 bp, Rattus norvegicus
tgcgacgccagacttcactcctcca

SEQ ID NO: 558529 - DNA, 25 bp, Rattus norvegicus
cacgttgcagtcagcagtgcacttc

SEQ ID NO: 558530 - DNA, 25 bp, Rattus norvegicus
gcagtcagcagtgcacttcctgttt

SEQ ID NO: 558531 - DNA, 25 bp, Rattus norvegicus
ggaaccgctgcgacgccagacttca

SEQ ID NO: 558532 - DNA, 25 bp, Rattus norvegicus
agcagtgcacttcctgtttcaaaga

SEQ ID NO: 558533 - DNA, 25 bp, Rattus norvegicus
gagaccgcggctacccggctcgctt

SEQ ID NO: 558534 - DNA, 25 bp, Rattus norvegicus
agccggcagcacgttgcagtcagca

SEQ ID NO: 558535 - DNA, 25 bp, Rattus norvegicus
atctgggccggatcactaccgagga

SEQ ID NO: 558536 - DNA, 25 bp, Rattus norvegicus
ggaccgcggggactcagtcagcctc

SEQ ID NO: 558537 - DNA, 25 bp, Rattus norvegicus
cgctctcagcgcgtctcggtgctgt

SEQ ID NO: 558538 - DNA, 25 bp, Rattus norvegicus
cgggctctaggcacccggctggaca

SEQ ID NO: 558539 - DNA, 25 bp, Rattus norvegicus
cacccggctggacaaaggctagctc

SEQ ID NO: 558540 - DNA, 25 bp, Rattus norvegicus
acaaaggctagctcccttggaagga

SEQ ID NO: 558541 - DNA, 25 bp, Rattus norvegicus
ctcccttggaaggacgcgcgaagga

SEQ ID NO: 558542 - DNA, 25 bp, Rattus norvegicus
cgcgaaggaggcgaaagcacagctc

SEQ ID NO: 558543 - DNA, 25 bp, Rattus norvegicus
cagctcagcctcttaaagcgcatcg

SEQ ID NO: 558544 - DNA, 25 bp, Rattus norvegicus
cctcttaaagcgcatcggtgtgatc

SEQ ID NO: 558545 - DNA, 25 bp, Rattus norvegicus
aagcgcatcggtgtgatcgggaacc

SEQ ID NO: 558546 - DNA, 25 bp, Rattus norvegicus
gatcgggaacccgacctggcaccta

SEQ ID NO: 558547 - DNA, 25 bp, Rattus norvegicus
acctagggcgctatctgggccggat

SEQ ID NO: 558548 - DNA, 25 bp, Rattus norvegicus
cgacctggcacctagggcgctatct

SEQ ID NO: 558549 - DNA, 25 bp, Rattus norvegicus
ggcagagcaatggtccttccggttg

SEQ ID NO: 558550 - DNA, 25 bp, Rattus norvegicus
agcggtggtctcattcgaaacgtcc

SEQ ID NO: 558551 - DNA, 25 bp, Rattus norvegicus
ctgtccattgttccgcgaggagaaa

SEQ ID NO: 558552 - DNA, 25 bp, Rattus norvegicus
tctgttttagagacggtcgcccgcg

SEQ ID NO: 558553 - DNA, 25 bp, Rattus norvegicus
tccggaatcatgaagggccctctct

SEQ ID NO: 558554 - DNA, 25 bp, Rattus norvegicus
tcctgtaggcccagagctgtccatt

SEQ ID NO: 558555 - DNA, 25 bp, Rattus norvegicus
cgttctttatgactctcggctgggc

SEQ ID NO: 558556 - DNA, 25 bp, Rattus norvegicus
cgtgacagtgttttggcgttcttta

SEQ ID NO: 558557 - DNA, 25 bp, Rattus norvegicus
tatctacacgggagcctaaggcgga

SEQ ID NO: 558558 - DNA, 25 bp, Rattus norvegicus
cgcggacacggagcgactatctaca

SEQ ID NO: 558559 - DNA, 25 bp, Rattus norvegicus
taccatgatggaaggacgcggacac

SEQ ID NO: 558560 - DNA, 25 bp, Rattus norvegicus
agggctctggcggactagaatcaga

SEQ ID NO: 558561 - DNA, 25 bp, Rattus norvegicus
gtaatccgagcccaagtcccatttg

SEQ ID NO: 558562 - DNA, 25 bp, Rattus norvegicus
tcgttgctactgagatccggaatca

SEQ ID NO: 558563 - DNA, 25 bp, Rattus norvegicus
caggcacgtccaaccctgggtagta

SEQ ID NO: 558564 - DNA, 25 bp, Rattus norvegicus
cgtaactagcaagcgccgagcgcca

SEQ ID NO: 558565 - DNA, 25 bp, Rattus norvegicus
gagaccctgacgctcggcagtaagc

SEQ ID NO: 558566 - DNA, 25 bp, Rattus norvegicus
tggatgcgcgtgagcgtaactagca

SEQ ID NO: 558567 - DNA, 25 bp, Rattus norvegicus
cagacgatctatccggtcgcgcggc

SEQ ID NO: 558568 - DNA, 25 bp, Rattus norvegicus
gcataccgctcaaaaccagacgatc

SEQ ID NO: 558569 - DNA, 25 bp, Rattus norvegicus
tgaagccggcgtacagcagcccgtt

SEQ ID NO: 558570 - DNA, 25 bp, Rattus norvegicus
gggtctcaccatggtcctggttgaa

SEQ ID NO: 558571 - DNA, 25 bp, Rattus norvegicus
agtctgagatctctgggcgtgaccg

SEQ ID NO: 558572 - DNA, 25 bp, Rattus norvegicus
tttcctgaaagagccgccagagtga

SEQ ID NO: 558573 - DNA, 25 bp, Rattus norvegicus
atgcccgggctagaaaggaaggtct

SEQ ID NO: 558574 - DNA, 25 bp, Rattus norvegicus
gtaaaaaagtgacactgcccgccga

SEQ ID NO: 558575 - DNA, 25 bp, Rattus norvegicus
gcaacgtaagcgctagagaccctga

SEQ ID NO: 558576 - DNA, 25 bp, Rattus norvegicus
gtgaccgagtctccggttagggctc

SEQ ID NO: 558577 - DNA, 25 bp, Rattus norvegicus
cagcctttgcgcctgggcttgcgca

SEQ ID NO: 558578 - DNA, 25 bp, Rattus norvegicus
cggagctcacgcgatggttttacac

SEQ ID NO: 558579 - DNA, 25 bp, Rattus norvegicus
tggttttacacagaatccgcttgcc

SEQ ID NO: 558580 - DNA, 25 bp, Rattus norvegicus
actgtcaggatgaggacactgatcc

SEQ ID NO: 558581 - DNA, 25 bp, Rattus norvegicus
atgtttggtgctcaggccgtgacca

SEQ ID NO: 558582 - DNA, 25 bp, Rattus norvegicus
ccaggcagggtcgataatgttccga

SEQ ID NO: 558583 - DNA, 25 bp, Rattus norvegicus
cgcctcttactgtgcggggaataga

SEQ ID NO: 558584 - DNA, 25 bp, Rattus norvegicus
gctccacccggaaagttcggctcag

SEQ ID NO: 558585 - DNA, 25 bp, Rattus norvegicus
cgcttgcctttttccatcttcggtc

SEQ ID NO: 558586 - DNA, 25 bp, Rattus norvegicus
agctgcggcagagtcttttagtgga

SEQ ID NO: 558587 - DNA, 25 bp, Rattus norvegicus
agcgagggctgtaccagtcaccaac

SEQ ID NO: 558588 - DNA, 25 bp, Rattus norvegicus
gtcaccaacgggaatcgggattgtc

SEQ ID NO: 558589 - DNA, 25 bp, Rattus norvegicus
gcagacgcagaaccgcgagctcgga

SEQ ID NO: 558590 - DNA, 25 bp, Rattus norvegicus
tgatcccgacctcctgcatgtttgg

SEQ ID NO: 558591 - DNA, 25 bp, Rattus norvegicus
ggggcatggaccaggcctgccagcg

SEQ ID NO: 558592 - DNA, 25 bp, Rattus norvegicus
ccgccgcccagtgagcgccacggcg

SEQ ID NO: 558593 - DNA, 25 bp, Rattus norvegicus
cccattggccctggcgtcaggggcc

SEQ ID NO: 558594 - DNA, 25 bp, Rattus norvegicus
tattgagaacgggtgcggcagccgc

SEQ ID NO: 558595 - DNA, 25 bp, Rattus norvegicus
acctggccgagagtattgagaacgg

SEQ ID NO: 558596 - DNA, 25 bp, Rattus norvegicus
cacctggccgagagtattgagaacg

SEQ ID NO: 558597 - DNA, 25 bp, Rattus norvegicus
cctcacctggccgagagtattgaga

SEQ ID NO: 558598 - DNA, 25 bp, Rattus norvegicus
ctggcctcacctggccgagagtatt

SEQ ID NO: 558599 - DNA, 25 bp, Rattus norvegicus
tgctggcctcacctggccgagagta

SEQ ID NO: 558600 - DNA, 25 bp, Rattus norvegicus
gagctgaatacagcttctgtgcctc

SEQ ID NO: 558601 - DNA, 25 bp, Rattus norvegicus
gtggcgcccattggccctggcgtca

SEQ ID NO: 558602 - DNA, 25 bp, Rattus norvegicus
ctgaatacagcttctgtgcctcttg

SEQ ID NO: 558603 - DNA, 25 bp, Rattus norvegicus
cccagggagctgaatacagcttctg

SEQ ID NO: 558604 - DNA, 25 bp, Rattus norvegicus
tctgtgcctcttgggcaggcgcgca

SEQ ID NO: 558605 - DNA, 25 bp, Rattus norvegicus
cacgtcttgaaccaccgaatggggc

SEQ ID NO: 558606 - DNA, 25 bp, Rattus norvegicus
ggaagaaccatccaacacgtcttga

SEQ ID NO: 558607 - DNA, 25 bp, Rattus norvegicus
gagcgtccgagtgccatgaacaaag

SEQ ID NO: 558608 - DNA, 25 bp, Rattus norvegicus
ccatgaacaaagatggcggacgata

SEQ ID NO: 558609 - DNA, 25 bp, Rattus norvegicus
tggcggacgatactcaccggctgaa

SEQ ID NO: 558610 - DNA, 25 bp, Rattus norvegicus
caccggctgaaccaatcgaaagata

SEQ ID NO: 558611 - DNA, 25 bp, Rattus norvegicus
aacagactgcgtctgtctctgtgcg

SEQ ID NO: 558612 - DNA, 25 bp, Rattus norvegicus
aggagaggaacagaccgcctctgtc

SEQ ID NO: 558613 - DNA, 25 bp, Rattus norvegicus
atgtgccggttcctgtgtttgtccg

SEQ ID NO: 558614 - DNA, 25 bp, Rattus norvegicus
cgccggtcagcacggaagaaccatc

SEQ ID NO: 558615 - DNA, 25 bp, Rattus norvegicus
cgcctctgtctatgtgccggttcct

SEQ ID NO: 558616 - DNA, 25 bp, Rattus norvegicus
agataacttgttaggacttcggaga

SEQ ID NO: 558617 - DNA, 25 bp, Rattus norvegicus
tcgcgagaggagaaaaacagactgc

SEQ ID NO: 558618 - DNA, 25 bp, Rattus norvegicus
gacttcggagaaagttgtcgcgaga

SEQ ID NO: 558619 - DNA, 25 bp, Rattus norvegicus
taaagtcccagtctttggccgaggc

SEQ ID NO: 558620 - DNA, 25 bp, Rattus norvegicus
accctgaacgagaagcagtccgctg

SEQ ID NO: 558621 - DNA, 25 bp, Rattus norvegicus
ccgaggtcctcaccctgaacgagaa

SEQ ID NO: 558622 - DNA, 25 bp, Rattus norvegicus
tccgaggctgctcgtgatggagacc

SEQ ID NO: 558623 - DNA, 25 bp, Rattus norvegicus
gggaccgtacctcgcagccgctttg

SEQ ID NO: 558624 - DNA, 25 bp, Rattus norvegicus
atggagaccgcgatgaccaaacttc

SEQ ID NO: 558625 - DNA, 25 bp, Rattus norvegicus
cggcagccgctggagtaaagtccca

SEQ ID NO: 558626 - DNA, 25 bp, Rattus norvegicus
cagtccgctgggcactagccaagcg

SEQ ID NO: 558627 - DNA, 25 bp, Rattus norvegicus
cagaaccggctcaccttggccagtg

SEQ ID NO: 558628 - DNA, 25 bp, Rattus norvegicus
agtgcctcctcctgtttggggctca

SEQ ID NO: 558629 - DNA, 25 bp, Rattus norvegicus
ttggggctcaggtcaccgactctcc

SEQ ID NO: 558630 - DNA, 25 bp, Rattus norvegicus
cgctcatcgtggctcagcctcgggg

SEQ ID NO: 558631 - DNA, 25 bp, Rattus norvegicus
ggcagctgatgaagctccgactctt

SEQ ID NO: 558632 - DNA, 25 bp, Rattus norvegicus
tccgactcttttgcagccgcggcag

SEQ ID NO: 558633 - DNA, 25 bp, Rattus norvegicus
agcctcagctctgtgtctggcaagc

SEQ ID NO: 558634 - DNA, 25 bp, Rattus norvegicus
tggcaagctcacagaacttcctccg

SEQ ID NO: 558635 - DNA, 25 bp, Rattus norvegicus
cggcttttctctgggtcgtcgccat

SEQ ID NO: 558636 - DNA, 25 bp, Rattus norvegicus
aaactctaaagcagggcgcccagga

SEQ ID NO: 558637 - DNA, 25 bp, Rattus norvegicus
tcgtcgccatcttgccattgagttg

SEQ ID NO: 558638 - DNA, 25 bp, Rattus norvegicus
ccagggatccctcgaaactctaaag

SEQ ID NO: 558639 - DNA, 25 bp, Rattus norvegicus
tgagcttaaccttgtcgccgtaccg

SEQ ID NO: 558640 - DNA, 25 bp, Rattus norvegicus
taccggttgtccacaccgaggcgga

SEQ ID NO: 558641 - DNA, 25 bp, Rattus norvegicus
cagccctgagcgtcgcagtcatgca

SEQ ID NO: 558642 - DNA, 25 bp, Rattus norvegicus
tcactgagcccaaacaggtaccgtg

SEQ ID NO: 558643 - DNA, 25 bp, Rattus norvegicus
tcctccgcctgcagtcctgttgtag

SEQ ID NO: 558644 - DNA, 25 bp, Rattus norvegicus
tgttgtaggcctcgttcctccactc

SEQ ID NO: 558645 - DNA, 25 bp, Rattus norvegicus
ggagacttcgtgtggtgagcttaac

SEQ ID NO: 558646 - DNA, 25 bp, Rattus norvegicus
caacggcgtaccgtgccatcgtgca

SEQ ID NO: 558647 - DNA, 25 bp, Rattus norvegicus
aaaagcagcagagagaatgggccgc

SEQ ID NO: 558648 - DNA, 25 bp, Rattus norvegicus
tcacgtcggtccacttggcgccagg

SEQ ID NO: 558649 - DNA, 25 bp, Rattus norvegicus
gtgggagctccctgggtatccgccc

SEQ ID NO: 558650 - DNA, 25 bp, Rattus norvegicus
cgcggccgatatggcgaaaagcagc

SEQ ID NO: 558651 - DNA, 25 bp, Rattus norvegicus
ttcctacctacggacagaaaggcca

SEQ ID NO: 558652 - DNA, 25 bp, Rattus norvegicus
gccgccactgccgatgagctaagct

SEQ ID NO: 558653 - DNA, 25 bp, Rattus norvegicus
cgatgagctaagctccctgggctcc

SEQ ID NO: 558654 - DNA, 25 bp, Rattus norvegicus
gctccgactcggaggccaacggctt

SEQ ID NO: 558655 - DNA, 25 bp, Rattus norvegicus
agtttggcttcatcgtgggttcgca

SEQ ID NO: 558656 - DNA, 25 bp, Rattus norvegicus
tgggcctgacccaccaacgtgtcgt

SEQ ID NO: 558657 - DNA, 25 bp, Rattus norvegicus
aacgtgtcgtctccactatcctatc

SEQ ID NO: 558658 - DNA, 25 bp, Rattus norvegicus
agcggtcgtctacttcctacctacg

SEQ ID NO: 558659 - DNA, 25 bp, Rattus norvegicus
cgagcgccgcatcgacaagtttggc

SEQ ID NO: 558660 - DNA, 25 bp, Rattus norvegicus
ccagctttgtggcagccaatgggtg

SEQ ID NO: 558661 - DNA, 25 bp, Rattus norvegicus
cgagcctggaggatagacatgagac

SEQ ID NO: 558662 - DNA, 25 bp, Rattus norvegicus
gtgcgcacccgggttcacgagcgca

SEQ ID NO: 558663 - DNA, 25 bp, Rattus norvegicus
tgcgagtactgagcctcgcgcgtcc

SEQ ID NO: 558664 - DNA, 25 bp, Rattus norvegicus
atcgcctcctgcctaggtctagctg

SEQ ID NO: 558665 - DNA, 25 bp, Rattus norvegicus
ggtgcttctttaagcctggcgcctc

SEQ ID NO: 558666 - DNA, 25 bp, Rattus norvegicus
gccgccgaagagtggatccctggct

SEQ ID NO: 558667 - DNA, 25 bp, Rattus norvegicus
ccacttctcagtggctgtgggcgtg

SEQ ID NO: 558668 - DNA, 25 bp, Rattus norvegicus
ttttggcgaagttcgaaggcagccc

SEQ ID NO: 558669 - DNA, 25 bp, Rattus norvegicus
gggcaggccttgatcctcaggctga

SEQ ID NO: 558670 - DNA, 25 bp, Rattus norvegicus
acatgagaccgggagctcctagcac

SEQ ID NO: 558671 - DNA, 25 bp, Rattus norvegicus
ggaggactagactcgccgcgaagca

SEQ ID NO: 558672 - DNA, 25 bp, Rattus norvegicus
catcctagagcaccgggtgcgagta

SEQ ID NO: 558673 - DNA, 25 bp, Rattus norvegicus
gcgggatctgcgatggaacttcaca

SEQ ID NO: 558674 - DNA, 25 bp, Rattus norvegicus
taggcgggtcctggaagccacagat

SEQ ID NO: 558675 - DNA, 25 bp, Rattus norvegicus
atggtccggtcaccgcgcacccagc

SEQ ID NO: 558676 - DNA, 25 bp, Rattus norvegicus
cccgccgcgccactcggacacttgg

SEQ ID NO: 558677 - DNA, 25 bp, Rattus norvegicus
agcttgcaaactccggccaggaccg

SEQ ID NO: 558678 - DNA, 25 bp, Rattus norvegicus
agcagcttgcaaactccggccagga

SEQ ID NO: 558679 - DNA, 25 bp, Rattus norvegicus
gcaggcggctgagcagcttgcaaac

SEQ ID NO: 558680 - DNA, 25 bp, Rattus norvegicus
tcttttccaactgcgtcccgggctg

SEQ ID NO: 558681 - DNA, 25 bp, Rattus norvegicus
tttccgctttctcttttccaactgc

SEQ ID NO: 558682 - DNA, 25 bp, Rattus norvegicus
acttctccgctgtcgcctagattca

SEQ ID NO: 558683 - DNA, 25 bp, Rattus norvegicus
ctcccgcgctgctcttacttctccg

SEQ ID NO: 558684 - DNA, 25 bp, Rattus norvegicus
acccagccggcgcagtctcgctcca

SEQ ID NO: 558685 - DNA, 25 bp, Rattus norvegicus
gcgagcgccgcacatggtccggtca

SEQ ID NO: 558686 - DNA, 25 bp, Rattus norvegicus
gggcgccgattacgagtccccgctg

SEQ ID NO: 558687 - DNA, 25 bp, Rattus norvegicus
ctgggcgagcactcgcgggacaccc

SEQ ID NO: 558688 - DNA, 25 bp, Rattus norvegicus
gcagtctcgctccaccgccttctct

SEQ ID NO: 558689 - DNA, 25 bp, Rattus norvegicus
cggagtcgccgcgataggcaatctc

SEQ ID NO: 558690 - DNA, 25 bp, Rattus norvegicus
agggaagcgtttctgcagaagttca

SEQ ID NO: 558691 - DNA, 25 bp, Rattus norvegicus
cgtttctgcagaagttcaagggctc

SEQ ID NO: 558692 - DNA, 25 bp, Rattus norvegicus
cccaacccggagatggcccgcggcg

SEQ ID NO: 558693 - DNA, 25 bp, Rattus norvegicus
ttctgcagaagttcaagggctcctc

SEQ ID NO: 558694 - DNA, 25 bp, Rattus norvegicus
agtcgccgcgataggcaatctccgc

SEQ ID NO: 558695 - DNA, 25 bp, Rattus norvegicus
gatagggaagcgtttctgcagaagt

SEQ ID NO: 558696 - DNA, 25 bp, Rattus norvegicus
aagactcggagtcgccgcgataggc

SEQ ID NO: 558697 - DNA, 25 bp, Rattus norvegicus
ggccagacaccaaacacccacctcc

SEQ ID NO: 558698 - DNA, 25 bp, Rattus norvegicus
ggccaaccaggccagacaccaaaca

SEQ ID NO: 558699 - DNA, 25 bp, Rattus norvegicus
ccggctcccggccaaccaggccaga

SEQ ID NO: 558700 - DNA, 25 bp, Rattus norvegicus
agttcaagggctcctctcgccggct

SEQ ID NO: 558701 - DNA, 25 bp, Rattus norvegicus
tgcagaagttcaagggctcctctcg

SEQ ID NO: 558702 - DNA, 25 bp, Rattus norvegicus
tgcgatcgcgcgcacggaggccgag

SEQ ID NO: 558703 - DNA, 25 bp, Rattus norvegicus
ccaggttccggatggccgccgagct

SEQ ID NO: 558704 - DNA, 25 bp, Rattus norvegicus
tagcccgcggtttccaacagcacga

SEQ ID NO: 558705 - DNA, 25 bp, Rattus norvegicus
gacctccggccactcgccactaagg

SEQ ID NO: 558706 - DNA, 25 bp, Rattus norvegicus
gccactaaggactcccaaagtctcg

SEQ ID NO: 558707 - DNA, 25 bp, Rattus norvegicus
caaagtctcggccagggcctcaggc

SEQ ID NO: 558708 - DNA, 25 bp, Rattus norvegicus
aggccacacgctcacctcccggagg

SEQ ID NO: 558709 - DNA, 25 bp, Rattus norvegicus
tgctagcccgcggtttccaacagca

SEQ ID NO: 558710 - DNA, 25 bp, Rattus norvegicus
cccgagaccgatcggagctgagagc

SEQ ID NO: 558711 - DNA, 25 bp, Rattus norvegicus
gggcctcagtgctccattccgagag

SEQ ID NO: 558712 - DNA, 25 bp, Rattus norvegicus
cagtgctccattccgagagcttgcc

SEQ ID NO: 558713 - DNA, 25 bp, Rattus norvegicus
ctggagcgtctccaccggctgctcc

SEQ ID NO: 558714 - DNA, 25 bp, Rattus norvegicus
aaccacaacaacatggcggcagcgg

SEQ ID NO: 558715 - DNA, 25 bp, Rattus norvegicus
agcgcgctcccgagaccgatcggag

SEQ ID NO: 558716 - DNA, 25 bp, Rattus norvegicus
cgagcggtagctcccaacactcggg

SEQ ID NO: 558717 - DNA, 25 bp, Rattus norvegicus
aagctggccaggatctctcccttgc

SEQ ID NO: 558718 - DNA, 25 bp, Rattus norvegicus
gctcattggttagcaagctcgccca

SEQ ID NO: 558719 - DNA, 25 bp, Rattus norvegicus
tctcagttgctgaggtgtatacaca

SEQ ID NO: 558720 - DNA, 25 bp, Rattus norvegicus
tcgccattggcgaatctcagttgct

SEQ ID NO: 558721 - DNA, 25 bp, Rattus norvegicus
aaggagctcatcatgccggcccagc

SEQ ID NO: 558722 - DNA, 25 bp, Rattus norvegicus
tcgcccaccaacaggaacttaagta

SEQ ID NO: 558723 - DNA, 25 bp, Rattus norvegicus
agctcgcccatctatttcttaacgc

SEQ ID NO: 558724 - DNA, 25 bp, Rattus norvegicus
tgctccgtcctgcaagctggccagg

SEQ ID NO: 558725 - DNA, 25 bp, Rattus norvegicus
tggccgtaaggagattcggctgctc

SEQ ID NO: 558726 - DNA, 25 bp, Rattus norvegicus
agcgctgcaactccgggtgctatag

SEQ ID NO: 558727 - DNA, 25 bp, Rattus norvegicus
agccgctctggagactaaacccacg

SEQ ID NO: 558728 - DNA, 25 bp, Rattus norvegicus
agcatgcgggacctagctctaccca

SEQ ID NO: 558729 - DNA, 25 bp, Rattus norvegicus
ctaaacccacgctggaaaggccgct

SEQ ID NO: 558730 - DNA, 25 bp, Rattus norvegicus
gggctgcccaaggagctcatcatgc

SEQ ID NO: 558731 - DNA, 25 bp, Rattus norvegicus
ctgtcgcggtgaattgcggctgaac

SEQ ID NO: 558732 - DNA, 25 bp, Rattus norvegicus
acccttcagtccacgggcttcgcgg

SEQ ID NO: 558733 - DNA, 25 bp, Rattus norvegicus
ggcgcctcggcacccttcagtccac

SEQ ID NO: 558734 - DNA, 25 bp, Rattus norvegicus
ccaggacagtgcttcgggcgcctcg

SEQ ID NO: 558735 - DNA, 25 bp, Rattus norvegicus
aagccaggacagtgcttcgggcgcc

SEQ ID NO: 558736 - DNA, 25 bp, Rattus norvegicus
ccgggagaagccaggacagtgcttc

SEQ ID NO: 558737 - DNA, 25 bp, Rattus norvegicus
aacatcacgggtgtggagccgggga

SEQ ID NO: 558738 - DNA, 25 bp, Rattus norvegicus
attgcggctgaacatcacgggtgtg

SEQ ID NO: 558739 - DNA, 25 bp, Rattus norvegicus
aagtgctggatctgtggaagctgtc

SEQ ID NO: 558740 - DNA, 25 bp, Rattus norvegicus
tcgcggtgaattgcggctgaacatc

SEQ ID NO: 558741 - DNA, 25 bp, Rattus norvegicus
atctgtggaagctgtcgcggtgaat

SEQ ID NO: 558742 - DNA, 25 bp, Rattus norvegicus
cgcctacggaatcgcagtttgaccc

SEQ ID NO: 558743 - DNA, 25 bp, Rattus norvegicus
gaatcgcagtttgaccccggaagtg

SEQ ID NO: 558744 - DNA, 25 bp, Rattus norvegicus
gaattgcggctgaacatcacgggtg

SEQ ID NO: 558745 - DNA, 25 bp, Rattus norvegicus
gtagcgaccaacttctcactccaaa

SEQ ID NO: 558746 - DNA, 25 bp, Rattus norvegicus
tgcgcctgcgtagcgaccaacttct

SEQ ID NO: 558747 - DNA, 25 bp, Rattus norvegicus
ttgatgtaatcgtagaccgcgtctg

SEQ ID NO: 558748 - DNA, 25 bp, Rattus norvegicus
gcgtctgcaccctgatcgaaggcgc

SEQ ID NO: 558749 - DNA, 25 bp, Rattus norvegicus
caccctgatcgaaggcgcgctcgaa

SEQ ID NO: 558750 - DNA, 25 bp, Rattus norvegicus
cgcgctcgaagaacagggcgctcac

SEQ ID NO: 558751 - DNA, 25 bp, Rattus norvegicus
gcgaaggtagaagtcctgcggaaca

SEQ ID NO: 558752 - DNA, 25 bp, Rattus norvegicus
cctgcggaacagcaaggagtacaaa

SEQ ID NO: 558753 - DNA, 25 bp, Rattus norvegicus
caaggagtacaaacgcgaagtgacc

SEQ ID NO: 558754 - DNA, 25 bp, Rattus norvegicus
caaacgcgaagtgaccgtcggcgac

SEQ ID NO: 558755 - DNA, 25 bp, Rattus norvegicus
gaccgtcggcgacgccatgttgcct

SEQ ID NO: 558756 - DNA, 25 bp, Rattus norvegicus
catgttgcctcgctgacgaactggc

SEQ ID NO: 558757 - DNA, 25 bp, Rattus norvegicus
tgacgaactggcgtcactgcgcctg

SEQ ID NO: 558758 - DNA, 25 bp, Rattus norvegicus
ttctcactccaaaagtttcaacgcg

SEQ ID NO: 558759 - DNA, 25 bp, Rattus norvegicus
gatctgctggttggaacaggctgca

SEQ ID NO: 558760 - DNA, 25 bp, Rattus norvegicus
ccttccagaagacggtgtcaaagtc

SEQ ID NO: 558761 - DNA, 25 bp, Rattus norvegicus
cagccagggcgtaccttccagaaga

SEQ ID NO: 558762 - DNA, 25 bp, Rattus norvegicus
cggagtcccattcagccagggcgta

SEQ ID NO: 558763 - DNA, 25 bp, Rattus norvegicus
gtaagcgcacgttcccaaagacagg

SEQ ID NO: 558764 - DNA, 25 bp, Rattus norvegicus
ctgcatgtcacacttgggtggcgaa

SEQ ID NO: 558765 - DNA, 25 bp, Rattus norvegicus
gtccaccgtcagcttctgcatgtca

SEQ ID NO: 558766 - DNA, 25 bp, Rattus norvegicus
agaagtcgtttcagctcgtccaccg

SEQ ID NO: 558767 - DNA, 25 bp, Rattus norvegicus
acaggtgctcacagaaggtgtcata

SEQ ID NO: 558768 - DNA, 25 bp, Rattus norvegicus
tcctccgtcatgatgatgttctcta

SEQ ID NO: 558769 - DNA, 25 bp, Rattus norvegicus
gatagaatcagatccgcacttcggc

SEQ ID NO: 558770 - DNA, 25 bp, Rattus norvegicus
acactgatgatgaaggcgatggcga

SEQ ID NO: 558771 - DNA, 25 bp, Rattus norvegicus
gccgcgatgagcatgacactgatga

SEQ ID NO: 558772 - DNA, 25 bp, Rattus norvegicus
gcacttcggcacaaggactcgactt

SEQ ID NO: 558773 - DNA, 25 bp, Rattus norvegicus
cgctgctccgacagcaggttgggca

SEQ ID NO: 558774 - DNA, 25 bp, Rattus norvegicus
tcttcagggatatccaccgggcgct

SEQ ID NO: 558775 - DNA, 25 bp, Rattus norvegicus
ctctagctcgtcttcagggatatcc

SEQ ID NO: 558776 - DNA, 25 bp, Rattus norvegicus
ccgcaaactttgaggccggggctca

SEQ ID NO: 558777 - DNA, 25 bp, Rattus norvegicus
caagagcggggcagtcgccctctct

SEQ ID NO: 558778 - DNA, 25 bp, Rattus norvegicus
ccgtcaccgggtggaacggcatctt

SEQ ID NO: 558779 - DNA, 25 bp, Rattus norvegicus
ctcgtccgcttgctggtgtcggtct

SEQ ID NO: 558780 - DNA, 25 bp, Rattus norvegicus
gctcatctgagtcgcgcagcagggt

SEQ ID NO: 558781 - DNA, 25 bp, Rattus norvegicus
ggcgcagccgctcatctgagtcgcg

SEQ ID NO: 558782 - DNA, 25 bp, Rattus norvegicus
cgagcggaatgtcaataggagcgca

SEQ ID NO: 558783 - DNA, 25 bp, Rattus norvegicus
ctcaacgcgacacgagcggaatgtc

SEQ ID NO: 558784 - DNA, 25 bp, Rattus norvegicus
attggattctcaacgcgacacgagc

SEQ ID NO: 558785 - DNA, 25 bp, Rattus norvegicus
cactgccggagcagattggattctc

SEQ ID NO: 558786 - DNA, 25 bp, Rattus norvegicus
aacggcatcttggaggctccgcgcc

SEQ ID NO: 558787 - DNA, 25 bp, Rattus norvegicus
cgaccggttacctcgcagttgaact

SEQ ID NO: 558788 - DNA, 25 bp, Rattus norvegicus
tcggcatccatggtgacgatccgca

SEQ ID NO: 558789 - DNA, 25 bp, Rattus norvegicus
caccgtgaatgtcttgggctgcttc

SEQ ID NO: 558790 - DNA, 25 bp, Rattus norvegicus
ttcctcttgagtgagctgaagctca

SEQ ID NO: 558791 - DNA, 25 bp, Rattus norvegicus
agtagctgcacaggcctcagggcca

SEQ ID NO: 558792 - DNA, 25 bp, Rattus norvegicus
cggggacgcctcttagacagaaatc

SEQ ID NO: 558793 - DNA, 25 bp, Rattus norvegicus
ggactcctagaacgctacacactga

SEQ ID NO: 558794 - DNA, 25 bp, Rattus norvegicus
ttgcactaaaccagggccgccggtc

SEQ ID NO: 558795 - DNA, 25 bp, Rattus norvegicus
acgccgcggccagacaagcagaact

SEQ ID NO: 558796 - DNA, 25 bp, Rattus norvegicus
actcctactctagcaagactggttg

SEQ ID NO: 558797 - DNA, 25 bp, Rattus norvegicus
agaaatcctagacggcagtggcgcc

SEQ ID NO: 558798 - DNA, 25 bp, Rattus norvegicus
caccgcacgaggtactgtcgaggta

SEQ ID NO: 558799 - DNA, 25 bp, Rattus norvegicus
agaggcggtcactccgaacgctttt

SEQ ID NO: 558800 - DNA, 25 bp, Rattus norvegicus
tgtgattggctggaacgcccaagga

SEQ ID NO: 558801 - DNA, 25 bp, Rattus norvegicus
acactatgcgtgttcccggtctggc

SEQ ID NO: 558802 - DNA, 25 bp, Rattus norvegicus
ggtttgagatgcagacgacactatg

SEQ ID NO: 558803 - DNA, 25 bp, Rattus norvegicus
acggggtttgagatgcagacgacac

SEQ ID NO: 558804 - DNA, 25 bp, Rattus norvegicus
ccgactggggttgcaggtcctcgcc

SEQ ID NO: 558805 - DNA, 25 bp, Rattus norvegicus
atcgttctggtgagtgaggctgcag

SEQ ID NO: 558806 - DNA, 25 bp, Rattus norvegicus
tgcctggctggaaggcgtgaggatc

SEQ ID NO: 558807 - DNA, 25 bp, Rattus norvegicus
ctatggtcgcgaaccggaagtggat

SEQ ID NO: 558808 - DNA, 25 bp, Rattus norvegicus
cgcttctctatggtcgcgaaccgga

SEQ ID NO: 558809 - DNA, 25 bp, Rattus norvegicus
tgagatgcagacgacactatgcgtg

SEQ ID NO: 558810 - DNA, 25 bp, Rattus norvegicus
tctgtggctcttgccttccgcttct

SEQ ID NO: 558811 - DNA, 25 bp, Rattus norvegicus
cacttccggtctgtggctcttgcct

SEQ ID NO: 558812 - DNA, 25 bp, Rattus norvegicus
tgttcccggtctggcgtcctcactt

SEQ ID NO: 558813 - DNA, 25 bp, Rattus norvegicus
gccttccgcttctctatggtcgcga

SEQ ID NO: 558814 - DNA, 25 bp, Rattus norvegicus
tgcagacgacactatgcgtgttccc

SEQ ID NO: 558815 - DNA, 25 bp, Rattus norvegicus
cttatcgatgtagcccgcgaagcgg

SEQ ID NO: 558816 - DNA, 25 bp, Rattus norvegicus
gccctgaatctgaccgagcagctcg

SEQ ID NO: 558817 - DNA, 25 bp, Rattus norvegicus
acgtcacgtcgcacttgagggcgtc

SEQ ID NO: 558818 - DNA, 25 bp, Rattus norvegicus
aggtagccgcactcttcctgcagcg

SEQ ID NO: 558819 - DNA, 25 bp, Rattus norvegicus
caagctgcctcaccttatcgatgta

SEQ ID NO: 558820 - DNA, 25 bp, Rattus norvegicus
acgcagccctctgggccattgctta

SEQ ID NO: 558821 - DNA, 25 bp, Rattus norvegicus
cattgcttagggtgtctagcgagtc

SEQ ID NO: 558822 - DNA, 25 bp, Rattus norvegicus
aggcggacacggagctcaccgacgt

SEQ ID NO: 558823 - DNA, 25 bp, Rattus norvegicus
cccacgaatggaagccgctggagga

SEQ ID NO: 558824 - DNA, 25 bp, Rattus norvegicus
ctcagcgcgtagtgcaggctgcctc

SEQ ID NO: 558825 - DNA, 25 bp, Rattus norvegicus
gccgccgaagctcatcatggccgga

SEQ ID NO: 558826 - DNA, 25 bp, Rattus norvegicus
ctgggacgccggctcttttatatcc

SEQ ID NO: 558827 - DNA, 25 bp, Rattus norvegicus
gctcttttatatccgcggtggcccg

SEQ ID NO: 558828 - DNA, 25 bp, Rattus norvegicus
tgcgcgatgtcctccagcaagtgct

SEQ ID NO: 558829 - DNA, 25 bp, Rattus norvegicus
caccaggagccgtttggatttgtgg

SEQ ID NO: 558830 - DNA, 25 bp, Rattus norvegicus
tggcggcccggcgtcaaccggtcat

SEQ ID NO: 558831 - DNA, 25 bp, Rattus norvegicus
tcattcattcacggcggcttggcgg

SEQ ID NO: 558832 - DNA, 25 bp, Rattus norvegicus
aaagggctgcgtgttcattcattca

SEQ ID NO: 558833 - DNA, 25 bp, Rattus norvegicus
acgctacgctggagaggtacgagct

SEQ ID NO: 558834 - DNA, 25 bp, Rattus norvegicus
cccagcgagataggtggaaaactga

SEQ ID NO: 558835 - DNA, 25 bp, Rattus norvegicus
tgaggaaaaaggaaacccagcgaga

SEQ ID NO: 558836 - DNA, 25 bp, Rattus norvegicus
gcggcaccaggagccgtttggattt

SEQ ID NO: 558837 - DNA, 25 bp, Rattus norvegicus
aggctgcggacattttgctgctgaa

SEQ ID NO: 558838 - DNA, 25 bp, Rattus norvegicus
cttccgctcggcaggtgacagcggt

SEQ ID NO: 558839 - DNA, 25 bp, Rattus norvegicus
ggctgctcacttccgctcggcaggt

SEQ ID NO: 558840 - DNA, 25 bp, Rattus norvegicus
ggtgtgcgtccaccggaagttccgc

SEQ ID NO: 558841 - DNA, 25 bp, Rattus norvegicus
ggctccgcccaacaggtctccagcc

SEQ ID NO: 558842 - DNA, 25 bp, Rattus norvegicus
cggcgtcaaccggtcatctcaggtc

SEQ ID NO: 558843 - DNA, 25 bp, Rattus norvegicus
tgacttcgctggacccgactcgagt

SEQ ID NO: 558844 - DNA, 25 bp, Rattus norvegicus
tgcgtgtccacgtgtcctgacctag

SEQ ID NO: 558845 - DNA, 25 bp, Rattus norvegicus
cccagaagtcttgaggtagccgttc

SEQ ID NO: 558846 - DNA, 25 bp, Rattus norvegicus
gggcgggcagttacctcatcgccgc

SEQ ID NO: 558847 - DNA, 25 bp, Rattus norvegicus
gagtgcgctctcctcgcggagctgc

SEQ ID NO: 558848 - DNA, 25 bp, Rattus norvegicus
ggcctcttgtgactcaggtgctgta

SEQ ID NO: 558849 - DNA, 25 bp, Rattus norvegicus
gcgcagtacgggctcatgaagctcc

SEQ ID NO: 558850 - DNA, 25 bp, Rattus norvegicus
ggagtgggcaagaccgccatcatcc

SEQ ID NO: 558851 - DNA, 25 bp, Rattus norvegicus
gccatcatccgccagttcctgtttg

SEQ ID NO: 558852 - DNA, 25 bp, Rattus norvegicus
ctgtttggtgactatcccgagcgcc

SEQ ID NO: 558853 - DNA, 25 bp, Rattus norvegicus
cggcgccgtctacgatctgagtatc

SEQ ID NO: 558854 - DNA, 25 bp, Rattus norvegicus
tctgagtatccgtgatggtgacttc

SEQ ID NO: 558855 - DNA, 25 bp, Rattus norvegicus
cccgactcgagtcccagaagtcttg

SEQ ID NO: 558856 - DNA, 25 bp, Rattus norvegicus
tgtgtacacttggtgcccacgtgcg

SEQ ID NO: 558857 - DNA, 25 bp, Rattus norvegicus
agaatggctgccaaacgtcgccgga

SEQ ID NO: 558858 - DNA, 25 bp, Rattus norvegicus
gtaacatggactccgggcccgtgca

SEQ ID NO: 558859 - DNA, 25 bp, Rattus norvegicus
tgggaccaaccgcagcctgcgagcg

SEQ ID NO: 558860 - DNA, 25 bp, Rattus norvegicus
gcggagaagaatggctgccaaacgt

SEQ ID NO: 558861 - DNA, 25 bp, Rattus norvegicus
ttgaagctcagcaggtgcaccgggc

SEQ ID NO: 558862 - DNA, 25 bp, Rattus norvegicus
tgcttgaagctcagcaggtgcaccg

SEQ ID NO: 558863 - DNA, 25 bp, Rattus norvegicus
tgctggactgactgcttgaagctca

SEQ ID NO: 558864 - DNA, 25 bp, Rattus norvegicus
cgggatgctggactgactgcttgaa

SEQ ID NO: 558865 - DNA, 25 bp, Rattus norvegicus
cgcctgcctaggggtctgtccggct

SEQ ID NO: 558866 - DNA, 25 bp, Rattus norvegicus
tgattgcctgcgctgtgcccgcgcg

SEQ ID NO: 558867 - DNA, 25 bp, Rattus norvegicus
ccatgtgattgcctgcgctgtgccc

SEQ ID NO: 558868 - DNA, 25 bp, Rattus norvegicus
gcctccatgtgattgcctgcgctgt

SEQ ID NO: 558869 - DNA, 25 bp, Rattus norvegicus
ccgggcctccatgtgattgcctgcg

SEQ ID NO: 558870 - DNA, 25 bp, Rattus norvegicus
aatggctgccaaacgtcgccggagg

SEQ ID NO: 558871 - DNA, 25 bp, Rattus norvegicus
tacggagcctgctactggcacgatg

SEQ ID NO: 558872 - DNA, 25 bp, Rattus norvegicus
cgcgagctgttttgttggcttgagc

SEQ ID NO: 558873 - DNA, 25 bp, Rattus norvegicus
cttcgcgcgagctgttttgttggct

SEQ ID NO: 558874 - DNA, 25 bp, Rattus norvegicus
agctgttttgttggcttgagcggcc

SEQ ID NO: 558875 - DNA, 25 bp, Rattus norvegicus
ttgttggcttgagcggcccgtagtt

SEQ ID NO: 558876 - DNA, 25 bp, Rattus norvegicus
ggctggccgctctcgcgctgtatct

SEQ ID NO: 558877 - DNA, 25 bp, Rattus norvegicus
agggttcttacggagcctgctactg

SEQ ID NO: 558878 - DNA, 25 bp, Rattus norvegicus
cctgctactggcacgatggtactga

SEQ ID NO: 558879 - DNA, 25 bp, Rattus norvegicus
ctggcacgatggtactgagcaacga

SEQ ID NO: 558880 - DNA, 25 bp, Rattus norvegicus
actgagcaacgagccggctgcgagc

SEQ ID NO: 558881 - DNA, 25 bp, Rattus norvegicus
gatgatgcgcttgtccgcgcctcca

SEQ ID NO: 558882 - DNA, 25 bp, Rattus norvegicus
ctccaccctggaagcgttcggcgag

SEQ ID NO: 558883 - DNA, 25 bp, Rattus norvegicus
caccctggaagcgttcggcgagagt

SEQ ID NO: 558884 - DNA, 25 bp, Rattus norvegicus
atggtactgagcaacgagccggctg

SEQ ID NO: 558885 - DNA, 25 bp, Rattus norvegicus
gtgctgcgtctcttccgagagcttc

SEQ ID NO: 558886 - DNA, 25 bp, Rattus norvegicus
ttggtgcgcacacgtcctgcacatc

SEQ ID NO: 558887 - DNA, 25 bp, Rattus norvegicus
cccatcctggtggtgggcaacaagc

SEQ ID NO: 558888 - DNA, 25 bp, Rattus norvegicus
gcaacaagcgggaccgtcagcggct

SEQ ID NO: 558889 - DNA, 25 bp, Rattus norvegicus
gaccgtcagcggctgcgcttcggac

SEQ ID NO: 558890 - DNA, 25 bp, Rattus norvegicus
tgcgcttcggacctcgtcgtgcact

SEQ ID NO: 558891 - DNA, 25 bp, Rattus norvegicus
tcgtcgtgcactggccactctagtt

SEQ ID NO: 558892 - DNA, 25 bp, Rattus norvegicus
ccactctagttcgaaggggctggcg

SEQ ID NO: 558893 - DNA, 25 bp, Rattus norvegicus
cgctgtggctacctcgagtgctcag

SEQ ID NO: 558894 - DNA, 25 bp, Rattus norvegicus
cgagtgctcagccaaatacaattgg

SEQ ID NO: 558895 - DNA, 25 bp, Rattus norvegicus
atacaattggcacgtgctgcgtctc

SEQ ID NO: 558896 - DNA, 25 bp, Rattus norvegicus
ctcttccgagagcttctacgttgtg

SEQ ID NO: 558897 - DNA, 25 bp, Rattus norvegicus
cttctacgttgtgctttggtgcgca

SEQ ID NO: 558898 - DNA, 25 bp, Rattus norvegicus
acatcccgctctgcgtctgcagggg

SEQ ID NO: 558899 - DNA, 25 bp, Rattus norvegicus
tcagccggtggttaggccgctccct

SEQ ID NO: 558900 - DNA, 25 bp, Rattus norvegicus
acaagtgagcgtccaggctgagacc

SEQ ID NO: 558901 - DNA, 25 bp, Rattus norvegicus
ggacttccaggcacaagtgagcgtc

SEQ ID NO: 558902 - DNA, 25 bp, Rattus norvegicus
cgagagagacgtgtatcaccggcgc

SEQ ID NO: 558903 - DNA, 25 bp, Rattus norvegicus
gagccagtggctgaatcgtcgctgc

SEQ ID NO: 558904 - DNA, 25 bp, Rattus norvegicus
cagccggtctcgagactggctgcga

SEQ ID NO: 558905 - DNA, 25 bp, Rattus norvegicus
ctggaggccgacagctgagcgcctc

SEQ ID NO: 558906 - DNA, 25 bp, Rattus norvegicus
taccgcctgttcctcgcggttctgg

SEQ ID NO: 558907 - DNA, 25 bp, Rattus norvegicus
ctgcgcaccaccagtaccgcctgtt

SEQ ID NO: 558908 - DNA, 25 bp, Rattus norvegicus
acccacgagtgctggccgtctcggt

SEQ ID NO: 558909 - DNA, 25 bp, Rattus norvegicus
tctgcggggtactccttccagaacc

SEQ ID NO: 558910 - DNA, 25 bp, Rattus norvegicus
tgggttggaccagccaccgcccgga

SEQ ID NO: 558911 - DNA, 25 bp, Rattus norvegicus
gcgtccaggctgagaccgcgacttc

SEQ ID NO: 558912 - DNA, 25 bp, Rattus norvegicus
ctgaatcgtcgctgcgggcacccat

SEQ ID NO: 558913 - DNA, 25 bp, Rattus norvegicus
cccggcccacctccgggcactctgg

SEQ ID NO: 558914 - DNA, 25 bp, Rattus norvegicus
ccgtgcctttctcgggccttaggct

SEQ ID NO: 558915 - DNA, 25 bp, Rattus norvegicus
ctatcccgcgacctttaactcggcg

SEQ ID NO: 558916 - DNA, 25 bp, Rattus norvegicus
ggcgaagacgcccttctatccctat

SEQ ID NO: 558917 - DNA, 25 bp, Rattus norvegicus
tccagagagggtgcgtgcccagtca

SEQ ID NO: 558918 - DNA, 25 bp, Rattus norvegicus
ttctcgggccttaggctccgaggcg

SEQ ID NO: 558919 - DNA, 25 bp, Rattus norvegicus
gcccgtgcctgtaaggccgggactc

SEQ ID NO: 558920 - DNA, 25 bp, Rattus norvegicus
ccctggaattcggatccggccagga

SEQ ID NO: 558921 - DNA, 25 bp, Rattus norvegicus
agctcgctgcttccaggcgtccgct

SEQ ID NO: 558922 - DNA, 25 bp, Rattus norvegicus
ccgccgcacacaggcgccgcccgag

SEQ ID NO: 558923 - DNA, 25 bp, Rattus norvegicus
gcgtgcccagtcaaggtcacacagc

SEQ ID NO: 558924 - DNA, 25 bp, Rattus norvegicus
gacccagcgagcctccgcagtgctc

SEQ ID NO: 558925 - DNA, 25 bp, Rattus norvegicus
cgggactccgaaccgacccagcgag

SEQ ID NO: 558926 - DNA, 25 bp, Rattus norvegicus
aggcgggcgaagacgcccttctatc

SEQ ID NO: 558927 - DNA, 25 bp, Rattus norvegicus
cgaagagaaacgagccggcgatatc

SEQ ID NO: 558928 - DNA, 25 bp, Rattus norvegicus
gcgatatccggctctttgctcccga

SEQ ID NO: 558929 - DNA, 25 bp, Rattus norvegicus
atcctctccaaagagccggacgtga

SEQ ID NO: 558930 - DNA, 25 bp, Rattus norvegicus
cgcgtggtctaaaaaaggcacctca

SEQ ID NO: 558931 - DNA, 25 bp, Rattus norvegicus
cgcaacctcggacgctaccataggg

SEQ ID NO: 558932 - DNA, 25 bp, Rattus norvegicus
tggctctagggaccgtctctgaaga

SEQ ID NO: 558933 - DNA, 25 bp, Rattus norvegicus
ccggcctggcacaactgctgactaa

SEQ ID NO: 558934 - DNA, 25 bp, Rattus norvegicus
ctgactaatcggcaggcgggatcac

SEQ ID NO: 558935 - DNA, 25 bp, Rattus norvegicus
ccgagggatcctctgcacgaggctt

SEQ ID NO: 558936 - DNA, 25 bp, Rattus norvegicus
gctagtgagcgagtgttcccaacaa

SEQ ID NO: 558937 - DNA, 25 bp, Rattus norvegicus
cacttacccgtggacgccattttct

SEQ ID NO: 558938 - DNA, 25 bp, Rattus norvegicus
ggttccagaaccagtccgcctagtg

SEQ ID NO: 558939 - DNA, 25 bp, Rattus norvegicus
cctttgggcctcagagaccgtaggc

SEQ ID NO: 558940 - DNA, 25 bp, Rattus norvegicus
tctctgaagagtctgccctggaggg

SEQ ID NO: 558941 - DNA, 25 bp, Rattus norvegicus
acatctcgggcgaaccgctctgtgg

SEQ ID NO: 558942 - DNA, 25 bp, Rattus norvegicus
ggcctgggaagcaggacgcccggac

SEQ ID NO: 558943 - DNA, 25 bp, Rattus norvegicus
actcggcctgggaagcaggacgccc

SEQ ID NO: 558944 - DNA, 25 bp, Rattus norvegicus
aaccgctctgtggactcggcctggg

SEQ ID NO: 558945 - DNA, 25 bp, Rattus norvegicus
gaaccgctctgtggactcggcctgg

SEQ ID NO: 558946 - DNA, 25 bp, Rattus norvegicus
cgaaccgctctgtggactcggcctg

SEQ ID NO: 558947 - DNA, 25 bp, Rattus norvegicus
gcgaaccgctctgtggactcggcct

SEQ ID NO: 558948 - DNA, 25 bp, Rattus norvegicus
ggcgaaccgctctgtggactcggcc

SEQ ID NO: 558949 - DNA, 25 bp, Rattus norvegicus
tcgggcgaaccgctctgtggactcg

SEQ ID NO: 558950 - DNA, 25 bp, Rattus norvegicus
atctcgggcgaaccgctctgtggac

SEQ ID NO: 558951 - DNA, 25 bp, Rattus norvegicus
catctcgggcgaaccgctctgtgga

SEQ ID NO: 558952 - DNA, 25 bp, Rattus norvegicus
gagggcaacatctcgggcgaaccgc

SEQ ID NO: 558953 - DNA, 25 bp, Rattus norvegicus
agggcaacatctcgggcgaaccgct

SEQ ID NO: 558954 - DNA, 25 bp, Rattus norvegicus
aacatctcgggcgaaccgctctgtg

SEQ ID NO: 558955 - DNA, 25 bp, Rattus norvegicus
cgggcgactttagccgtcacgcact

SEQ ID NO: 558956 - DNA, 25 bp, Rattus norvegicus
gagcatcgggttctccgtggtccac

SEQ ID NO: 558957 - DNA, 25 bp, Rattus norvegicus
ccggactcggagtagtctacactct

SEQ ID NO: 558958 - DNA, 25 bp, Rattus norvegicus
tctacactctgtacgggcgacttta

SEQ ID NO: 558959 - DNA, 25 bp, Rattus norvegicus
ttctccgtggtccacgcgcgagaga

SEQ ID NO: 558960 - DNA, 25 bp, Rattus norvegicus
ccatctctctcctaagtagtgagta

SEQ ID NO: 558961 - DNA, 25 bp, Rattus norvegicus
ggacagaagcccgagcatcgggttc

SEQ ID NO: 558962 - DNA, 25 bp, Rattus norvegicus
gtccacgccgcgtgccgggacagaa

SEQ ID NO: 558963 - DNA, 25 bp, Rattus norvegicus
attcctggtaaagcgggacaggcag

SEQ ID NO: 558964 - DNA, 25 bp, Rattus norvegicus
ggcagattcctggtaaagcgggaca

SEQ ID NO: 558965 - DNA, 25 bp, Rattus norvegicus
gcacgcggggcagattcctggtaaa

SEQ ID NO: 558966 - DNA, 25 bp, Rattus norvegicus
cgggaaagttcgaagccggcacgcg

SEQ ID NO: 558967 - DNA, 25 bp, Rattus norvegicus
tagtgagtagagtccgggaaagttc

SEQ ID NO: 558968 - DNA, 25 bp, Rattus norvegicus
tctcctaagtagtgagtagagtccg

SEQ ID NO: 558969 - DNA, 25 bp, Rattus norvegicus
tgagataacgcatggaaaccacgca

SEQ ID NO: 558970 - DNA, 25 bp, Rattus norvegicus
taacgcatggaaaccacgcacgcac

SEQ ID NO: 558971 - DNA, 25 bp, Rattus norvegicus
acgcatggaaaccacgcacgcaccg

SEQ ID NO: 558972 - DNA, 25 bp, Rattus norvegicus
ggtacaaagtgagataacgcatgga

SEQ ID NO: 558973 - DNA, 25 bp, Rattus norvegicus
gtggtacaaagtgagataacgcatg

SEQ ID NO: 558974 - DNA, 25 bp, Rattus norvegicus
gataacgcatggaaaccacgcacgc

SEQ ID NO: 558975 - DNA, 25 bp, Rattus norvegicus
agtgagataacgcatggaaaccacg

SEQ ID NO: 558976 - DNA, 25 bp, Rattus norvegicus
aagcggtggtacaaagtgagataac

SEQ ID NO: 558977 - DNA, 25 bp, Rattus norvegicus
caaagtgagataacgcatggaaacc

SEQ ID NO: 558978 - DNA, 25 bp, Rattus norvegicus
ctgctccacaaagcggtggtacaaa

SEQ ID NO: 558979 - DNA, 25 bp, Rattus norvegicus
ctccacaaagcggtggtacaaagtg

SEQ ID NO: 558980 - DNA, 25 bp, Rattus norvegicus
caaagcggtggtacaaagtgagata

SEQ ID NO: 558981 - DNA, 25 bp, Rattus norvegicus
cggtggtacaaagtgagataacgca

SEQ ID NO: 558982 - DNA, 25 bp, Rattus norvegicus
cacaaagcggtggtacaaagtgaga

SEQ ID NO: 558983 - DNA, 25 bp, Rattus norvegicus
ctgtttcaccctcacctaggtcgtg

SEQ ID NO: 558984 - DNA, 25 bp, Rattus norvegicus
gactcgtgagatctatataaatttg

SEQ ID NO: 558985 - DNA, 25 bp, Rattus norvegicus
cccacttggtgactcgtgagatcta

SEQ ID NO: 558986 - DNA, 25 bp, Rattus norvegicus
ggagtccgcctgacccagttcgtac

SEQ ID NO: 558987 - DNA, 25 bp, Rattus norvegicus
aaagcgtgttttggagtccgcctga

SEQ ID NO: 558988 - DNA, 25 bp, Rattus norvegicus
tagcggttagccaaagcgtgttttg

SEQ ID NO: 558989 - DNA, 25 bp, Rattus norvegicus
ctttctaggctagcggtagcggtta

SEQ ID NO: 558990 - DNA, 25 bp, Rattus norvegicus
gagcaaacctcctctttctaggcta

SEQ ID NO: 558991 - DNA, 25 bp, Rattus norvegicus
tgcggtagtaacgagagcaaacctc

SEQ ID NO: 558992 - DNA, 25 bp, Rattus norvegicus
tgccaagcgataggtcgacaccatc

SEQ ID NO: 558993 - DNA, 25 bp, Rattus norvegicus
acctaggtcgtgacccacgcgcggg

SEQ ID NO: 558994 - DNA, 25 bp, Rattus norvegicus
gggcgcccagtgacctctgtttcac

SEQ ID NO: 558995 - DNA, 25 bp, Rattus norvegicus
ggggctcccttctgccaagcgatag

SEQ ID NO: 558996 - DNA, 25 bp, Rattus norvegicus
cgggctccaccactgcggtagtaac

SEQ ID NO: 558997 - DNA, 25 bp, Rattus norvegicus
aaaacgtcccgccaactcaagagtg

SEQ ID NO: 558998 - DNA, 25 bp, Rattus norvegicus
ggtcgctccgaaaacagagcaaaca

SEQ ID NO: 558999 - DNA, 25 bp, Rattus norvegicus
caaacatggatggaaagcaaagcct

SEQ ID NO: 559000 - DNA, 25 bp, Rattus norvegicus
atggaaagcaaagcctgcgaccttt

SEQ ID NO: 559001 - DNA, 25 bp, Rattus norvegicus
gcaaagcctgcgacctttaagaagc

SEQ ID NO: 559002 - DNA, 25 bp, Rattus norvegicus
gcctgcgacctttaagaagccgctc

SEQ ID NO: 559003 - DNA, 25 bp, Rattus norvegicus
gcgacctttaagaagccgctccatc

SEQ ID NO: 559004 - DNA, 25 bp, Rattus norvegicus
taagaagccgctccatccttcaact

SEQ ID NO: 559005 - DNA, 25 bp, Rattus norvegicus
ctctcgcctttgcaaagttggcatt

SEQ ID NO: 559006 - DNA, 25 bp, Rattus norvegicus
cggcaacttggtcgctccgaaaaca

SEQ ID NO: 559007 - DNA, 25 bp, Rattus norvegicus
tcccgggactttcacctgagggaga

SEQ ID NO: 559008 - DNA, 25 bp, Rattus norvegicus
cgcctttgcaaagttggcattcaac

SEQ ID NO: 559009 - DNA, 25 bp, Rattus norvegicus
ttggcattcaacaggtagttcccgg

SEQ ID NO: 559010 - DNA, 25 bp, Rattus norvegicus
cattcaacaggtagttcccgggact

SEQ ID NO: 559011 - DNA, 25 bp, Rattus norvegicus
gctaacacctccatggaccgcgaaa

SEQ ID NO: 559012 - DNA, 25 bp, Rattus norvegicus
cttccttgcaaggatgcttcatccg

SEQ ID NO: 559013 - DNA, 25 bp, Rattus norvegicus
tcggtgctcgctaacacctccatgg

SEQ ID NO: 559014 - DNA, 25 bp, Rattus norvegicus
gcagtcagaggcggtttgcaacccg

SEQ ID NO: 559015 - DNA, 25 bp, Rattus norvegicus
cccggcagtcagaggcggtttgcaa

SEQ ID NO: 559016 - DNA, 25 bp, Rattus norvegicus
atggaccgcgaaaggccccggcagt

SEQ ID NO: 559017 - DNA, 25 bp, Rattus norvegicus
aacacctccatggaccgcgaaaggc

SEQ ID NO: 559018 - DNA, 25 bp, Rattus norvegicus
ggtgctcgctaacacctccatggac

SEQ ID NO: 559019 - DNA, 25 bp, Rattus norvegicus
ggcactattggccacccgcactcgg

SEQ ID NO: 559020 - DNA, 25 bp, Rattus norvegicus
cagctccggcactattggccacccg

SEQ ID NO: 559021 - DNA, 25 bp, Rattus norvegicus
aggatgcttcatccgcagctccggc

SEQ ID NO: 559022 - DNA, 25 bp, Rattus norvegicus
tgcaaggatgcttcatccgcagctc

SEQ ID NO: 559023 - DNA, 25 bp, Rattus norvegicus
attggccacccgcactcggtgctcg

SEQ ID NO: 559024 - DNA, 25 bp, Rattus norvegicus
tccttgcaaggatgcttcatccgca

SEQ ID NO: 559025 - DNA, 25 bp, Rattus norvegicus
cgggagagttaaggtcctcaacctg

SEQ ID NO: 559026 - DNA, 25 bp, Rattus norvegicus
aacctgctttggtgcgggagttaga

SEQ ID NO: 559027 - DNA, 25 bp, Rattus norvegicus
acaccctctcgtctgtgctccgccc

SEQ ID NO: 559028 - DNA, 25 bp, Rattus norvegicus
cccgcccaatctactgagtcccgcc

SEQ ID NO: 559029 - DNA, 25 bp, Rattus norvegicus
ccattggagcgtcaaaggccttgtc

SEQ ID NO: 559030 - DNA, 25 bp, Rattus norvegicus
gttagagccagccattggagcgtca

SEQ ID NO: 559031 - DNA, 25 bp, Rattus norvegicus
gcaacctgctttggtgcgggagtta

SEQ ID NO: 559032 - DNA, 25 bp, Rattus norvegicus
gcccgctcggtgcaacctgctttgg

SEQ ID NO: 559033 - DNA, 25 bp, Rattus norvegicus
gtcctcaacctgttcgcccgctcgg

SEQ ID NO: 559034 - DNA, 25 bp, Rattus norvegicus
gagttaaggtcctcaacctgttcgc

SEQ ID NO: 559035 - DNA, 25 bp, Rattus norvegicus
gacatttctccctgcagtttctgga

SEQ ID NO: 559036 - DNA, 25 bp, Rattus norvegicus
tcgtctttttggtcacgccccttgc

SEQ ID NO: 559037 - DNA, 25 bp, Rattus norvegicus
cgcccaggtcgtctttttggtcacg

SEQ ID NO: 559038 - DNA, 25 bp, Rattus norvegicus
tggagcgtcaaaggccttgtccttc

SEQ ID NO: 559039 - DNA, 25 bp, Rattus norvegicus
taaggcccagctcgcacggcgaaca

SEQ ID NO: 559040 - DNA, 25 bp, Rattus norvegicus
tggcgccggacattataacgtggtc

SEQ ID NO: 559041 - DNA, 25 bp, Rattus norvegicus
gctatggtaacgatctgtgagactc

SEQ ID NO: 559042 - DNA, 25 bp, Rattus norvegicus
gactcggtttggaaatctggcctga

SEQ ID NO: 559043 - DNA, 25 bp, Rattus norvegicus
gcattccgggtaaaagtctcagctg

SEQ ID NO: 559044 - DNA, 25 bp, Rattus norvegicus
ctggaccctggacttcagcaaccgg

SEQ ID NO: 559045 - DNA, 25 bp, Rattus norvegicus
gggcctgcaggaccaataaacgatg

SEQ ID NO: 559046 - DNA, 25 bp, Rattus norvegicus
taaacgatgaatacagccgcgcgtc

SEQ ID NO: 559047 - DNA, 25 bp, Rattus norvegicus
tcacgcagcacaggccaatcgcaga

SEQ ID NO: 559048 - DNA, 25 bp, Rattus norvegicus
gcagacggccacgaccctagaaagg

SEQ ID NO: 559049 - DNA, 25 bp, Rattus norvegicus
agattcgcctcgaaagcgggactga

SEQ ID NO: 559050 - DNA, 25 bp, Rattus norvegicus
caggaacgcccgacacaggtacaga

SEQ ID NO: 559051 - DNA, 25 bp, Rattus norvegicus
gcgtagacgtttcctggctatggtg

SEQ ID NO: 559052 - DNA, 25 bp, Rattus norvegicus
tcctcacggtgggttagattcgcct

SEQ ID NO: 559053 - DNA, 25 bp, Rattus norvegicus
ggcagcgtccgcgaccctagtcgtt

SEQ ID NO: 559054 - DNA, 25 bp, Rattus norvegicus
gccggccctacgacctgggactcac

SEQ ID NO: 559055 - DNA, 25 bp, Rattus norvegicus
gctgttctaccgtccgggctgctcg

SEQ ID NO: 559056 - DNA, 25 bp, Rattus norvegicus
gcgactgcaggaagtccgcgctgcc

SEQ ID NO: 559057 - DNA, 25 bp, Rattus norvegicus
tttgttgtgtatagagggccgctgt

SEQ ID NO: 559058 - DNA, 25 bp, Rattus norvegicus
atggcttcgcagacgaggcagcgtc

SEQ ID NO: 559059 - DNA, 25 bp, Rattus norvegicus
cgaccctagtcgttcctgttcccag

SEQ ID NO: 559060 - DNA, 25 bp, Rattus norvegicus
tcccagtcttagcagtggccgccac

SEQ ID NO: 559061 - DNA, 25 bp, Rattus norvegicus
cgccaccgccgctacccacgagagc

SEQ ID NO: 559062 - DNA, 25 bp, Rattus norvegicus
cgccttctagaaccctccactccgg

SEQ ID NO: 559063 - DNA, 25 bp, Rattus norvegicus
gtccgcccagagacacgtcgggatt

SEQ ID NO: 559064 - DNA, 25 bp, Rattus norvegicus
cccagagacacgtcgggatttgttg

SEQ ID NO: 559065 - DNA, 25 bp, Rattus norvegicus
cacgtcgggatttgttgtgtataga

SEQ ID NO: 559066 - DNA, 25 bp, Rattus norvegicus
aggaagtccgcgctgccgctcagag

SEQ ID NO: 559067 - DNA, 25 bp, Rattus norvegicus
gctgcttcacgctttgagcttccta

SEQ ID NO: 559068 - DNA, 25 bp, Rattus norvegicus
tgagcttcctaaactacgacttccg

SEQ ID NO: 559069 - DNA, 25 bp, Rattus norvegicus
cccgggcactgtgcacgtcggaact

SEQ ID NO: 559070 - DNA, 25 bp, Rattus norvegicus
tacaggatacaggagccggaagtcc

SEQ ID NO: 559071 - DNA, 25 bp, Rattus norvegicus
aactctaggggctgcttcacgcttt

SEQ ID NO: 559072 - DNA, 25 bp, Rattus norvegicus
ttcaggaactctaggggctgcttca

SEQ ID NO: 559073 - DNA, 25 bp, Rattus norvegicus
tgtagttcaccgacttcaggaactc

SEQ ID NO: 559074 - DNA, 25 bp, Rattus norvegicus
gaacttgtagttcaccgacttcagg

SEQ ID NO: 559075 - DNA, 25 bp, Rattus norvegicus
cgctcgcgacggtcccataaccagc

SEQ ID NO: 559076 - DNA, 25 bp, Rattus norvegicus
cggaagacggagtcccaggtccagt

SEQ ID NO: 559077 - DNA, 25 bp, Rattus norvegicus
agtcccaggtccagtgcgcggcgca

SEQ ID NO: 559078 - DNA, 25 bp, Rattus norvegicus
gcactccgcggaagacggagtccca

SEQ ID NO: 559079 - DNA, 25 bp, Rattus norvegicus
cactgtgcacgtcggaacttgtagt

SEQ ID NO: 559080 - DNA, 25 bp, Rattus norvegicus
agcggctacaccctccggcatcatc

SEQ ID NO: 559081 - DNA, 25 bp, Rattus norvegicus
cgagggtgtccgcaaaacaggatgc

SEQ ID NO: 559082 - DNA, 25 bp, Rattus norvegicus
atcaagcctctacgcggctggatgg

SEQ ID NO: 559083 - DNA, 25 bp, Rattus norvegicus
gttccgcaccgggaaatcaagcctc

SEQ ID NO: 559084 - DNA, 25 bp, Rattus norvegicus
cggagaccaccaggcgtctagggct

SEQ ID NO: 559085 - DNA, 25 bp, Rattus norvegicus
cgggaacttcctcctctgcggagac

SEQ ID NO: 559086 - DNA, 25 bp, Rattus norvegicus
ctctgagccgggacgcagctaacgc

SEQ ID NO: 559087 - DNA, 25 bp, Rattus norvegicus
cgaacctagtggcagggtgctgact

SEQ ID NO: 559088 - DNA, 25 bp, Rattus norvegicus
gcgcgcccagagaaccgaacctagt

SEQ ID NO: 559089 - DNA, 25 bp, Rattus norvegicus
cgaccacattgtgcctgtcccagag

SEQ ID NO: 559090 - DNA, 25 bp, Rattus norvegicus
cacatgccgggcaggcgaccacatt

SEQ ID NO: 559091 - DNA, 25 bp, Rattus norvegicus
agtacccagaacctgcggcggccag

SEQ ID NO: 559092 - DNA, 25 bp, Rattus norvegicus
ggcgaccgcgttttctcctagtgcg

SEQ ID NO: 559093 - DNA, 25 bp, Rattus norvegicus
cgctgctcatggcttgtcgcgacca

SEQ ID NO: 559094 - DNA, 25 bp, Rattus norvegicus
tgtcgcgaccagagtgctacggcca

SEQ ID NO: 559095 - DNA, 25 bp, Rattus norvegicus
acacggagggcggcgcatgctcaca

SEQ ID NO: 559096 - DNA, 25 bp, Rattus norvegicus
cacggagggcggcgcatgctcacac

SEQ ID NO: 559097 - DNA, 25 bp, Rattus norvegicus
aggcgcatgctcacacggagggcgg

SEQ ID NO: 559098 - DNA, 25 bp, Rattus norvegicus
ctcacacggacggaggcgcatgctc

SEQ ID NO: 559099 - DNA, 25 bp, Rattus norvegicus
acggaagcgcatgctcacacggagg

SEQ ID NO: 559100 - DNA, 25 bp, Rattus norvegicus
cacacggacggaagcgcatgctcac

SEQ ID NO: 559101 - DNA, 25 bp, Rattus norvegicus
atggtcacacggacggaagcgcatg

SEQ ID NO: 559102 - DNA, 25 bp, Rattus norvegicus
ggacggaagcgcatgctcacacgga

SEQ ID NO: 559103 - DNA, 25 bp, Rattus norvegicus
acacggacggaagcgcatgctcaca

SEQ ID NO: 559104 - DNA, 25 bp, Rattus norvegicus
ggcgcatgctcacacggagggcggc

SEQ ID NO: 559105 - DNA, 25 bp, Rattus norvegicus
acggaggcgcatgctcacacggagg

SEQ ID NO: 559106 - DNA, 25 bp, Rattus norvegicus
cacacggacggaggcgcatgctcac

SEQ ID NO: 559107 - DNA, 25 bp, Rattus norvegicus
tgctcacacggacggaggcgcatgc

SEQ ID NO: 559108 - DNA, 25 bp, Rattus norvegicus
cgcatggtcacacggacggaagcgc

SEQ ID NO: 559109 - DNA, 25 bp, Rattus norvegicus
cagccctttcggtgtgcgatgtagt

SEQ ID NO: 559110 - DNA, 25 bp, Rattus norvegicus
tcacctgtgtgctgcgacagccagc

SEQ ID NO: 559111 - DNA, 25 bp, Rattus norvegicus
cggttctaggaacgaaggtgcagtc

SEQ ID NO: 559112 - DNA, 25 bp, Rattus norvegicus
gcctcctcgtagctcaccggcttgt

SEQ ID NO: 559113 - DNA, 25 bp, Rattus norvegicus
gccgcagagccggaactaacgggaa

SEQ ID NO: 559114 - DNA, 25 bp, Rattus norvegicus
tgctgcgacagccagccctttcggt

SEQ ID NO: 559115 - DNA, 25 bp, Rattus norvegicus
tctaggaacgaaggtgcagtcacgg

SEQ ID NO: 559116 - DNA, 25 bp, Rattus norvegicus
cgtcagtacgcagccgcaggaagga

SEQ ID NO: 559117 - DNA, 25 bp, Rattus norvegicus
gcaacgcgggatgcgtcagtacgca

SEQ ID NO: 559118 - DNA, 25 bp, Rattus norvegicus
gccatcttgggccagcgcaacgcgg

SEQ ID NO: 559119 - DNA, 25 bp, Rattus norvegicus
actcaccttggcgcagaccgcggag

SEQ ID NO: 559120 - DNA, 25 bp, Rattus norvegicus
ggacggacgcagacgacgccatctt

SEQ ID NO: 559121 - DNA, 25 bp, Rattus norvegicus
gaggcgccgcagagccggaactaac

SEQ ID NO: 559122 - DNA, 25 bp, Rattus norvegicus
tctggccgcccggttctaggaacga

SEQ ID NO: 559123 - DNA, 25 bp, Rattus norvegicus
gtccaaacgccagaaacacacgtca

SEQ ID NO: 559124 - DNA, 25 bp, Rattus norvegicus
gaaacacacgtcaggcctgctaagc

SEQ ID NO: 559125 - DNA, 25 bp, Rattus norvegicus
tcaggcctgctaagccgctctgcgg

SEQ ID NO: 559126 - DNA, 25 bp, Rattus norvegicus
tgcggcctcagccaagccctaggac

SEQ ID NO: 559127 - DNA, 25 bp, Rattus norvegicus
ccctcccgcagcttccctgttgccc

SEQ ID NO: 559128 - DNA, 25 bp, Rattus norvegicus
tgaccggctgctgtcctggctggtc

SEQ ID NO: 559129 - DNA, 25 bp, Rattus norvegicus
ggactaacaactgcagccactagcc

SEQ ID NO: 559130 - DNA, 25 bp, Rattus norvegicus
ggcacctggccggacagagtcagcc

SEQ ID NO: 559131 - DNA, 25 bp, Rattus norvegicus
gcgccgggtcatgaacacgcacatc

SEQ ID NO: 559132 - DNA, 25 bp, Rattus norvegicus
gggtcatgaacacgcacatctcggc

SEQ ID NO: 559133 - DNA, 25 bp, Rattus norvegicus
ccaggcccgggaggactaacaactg

SEQ ID NO: 559134 - DNA, 25 bp, Rattus norvegicus
ggaggactaacaactgcagccacta

SEQ ID NO: 559135 - DNA, 25 bp, Rattus norvegicus
gcaagcaagtccaaacgccagaaac

SEQ ID NO: 559136 - DNA, 25 bp, Rattus norvegicus
cctggcccggctacgaccgcccaag

SEQ ID NO: 559137 - DNA, 25 bp, Rattus norvegicus
ggctgccacagcgaatagaaacccg

SEQ ID NO: 559138 - DNA, 25 bp, Rattus norvegicus
aacccgcggctgagacgcgttgaca

SEQ ID NO: 559139 - DNA, 25 bp, Rattus norvegicus
gcgttgacacctgccctgcgcaagg

SEQ ID NO: 559140 - DNA, 25 bp, Rattus norvegicus
cagaaccgccgcttgcgcagattta

SEQ ID NO: 559141 - DNA, 25 bp, Rattus norvegicus
tccagaaagtatggacggtggaaac

SEQ ID NO: 559142 - DNA, 25 bp, Rattus norvegicus
agggcgaagtcacgcgaccatgtca

SEQ ID NO: 559143 - DNA, 25 bp, Rattus norvegicus
tgtgcgacagggttctcagacccgg

SEQ ID NO: 559144 - DNA, 25 bp, Rattus norvegicus
gaccatgtcacgtgcgcgcgcagct

SEQ ID NO: 559145 - DNA, 25 bp, Rattus norvegicus
tttaggaggtgggagcctacgccta

SEQ ID NO: 559146 - DNA, 25 bp, Rattus norvegicus
agcatggttgtgaaacggatccaga

SEQ ID NO: 559147 - DNA, 25 bp, Rattus norvegicus
tagactgccgctcccggggtgcaga

SEQ ID NO: 559148 - DNA, 25 bp, Rattus norvegicus
acccggggactgctgcgcgcacaag

SEQ ID NO: 559149 - DNA, 25 bp, Rattus norvegicus
taactgaccgtgtgcgacagggttc

SEQ ID NO: 559150 - DNA, 25 bp, Rattus norvegicus
gtgcaccgcggcacgcacgcgtaga

SEQ ID NO: 559151 - DNA, 25 bp, Rattus norvegicus
catcattgctgagaccgtggggcgt

SEQ ID NO: 559152 - DNA, 25 bp, Rattus norvegicus
gtgcgggtggtcaccgagaaatccc

SEQ ID NO: 559153 - DNA, 25 bp, Rattus norvegicus
tttaattcactaactgccaacccgc

SEQ ID NO: 559154 - DNA, 25 bp, Rattus norvegicus
ccttctgggcatggcttctgcacgt

SEQ ID NO: 559155 - DNA, 25 bp, Rattus norvegicus
gcagagtagctaacagtctccctac

SEQ ID NO: 559156 - DNA, 25 bp, Rattus norvegicus
ctggccctcgcggattttaattcac

SEQ ID NO: 559157 - DNA, 25 bp, Rattus norvegicus
tgcgtacttcggaccaggacctata

SEQ ID NO: 559158 - DNA, 25 bp, Rattus norvegicus
gccttaattttacccgcagagtagc

SEQ ID NO: 559159 - DNA, 25 bp, Rattus norvegicus
actggtaagcagcaaagcagggcca

SEQ ID NO: 559160 - DNA, 25 bp, Rattus norvegicus
ttctgcacgtcagaggcgaagcttc

SEQ ID NO: 559161 - DNA, 25 bp, Rattus norvegicus
gtccgtcactggaggccggcagaaa

SEQ ID NO: 559162 - DNA, 25 bp, Rattus norvegicus
gaaagctgaggctgcatcattgctg

SEQ ID NO: 559163 - DNA, 25 bp, Rattus norvegicus
cgtgacatggcggtgaacctgagcc

SEQ ID NO: 559164 - DNA, 25 bp, Rattus norvegicus
ggacctataggcaggcctggccctc

SEQ ID NO: 559165 - DNA, 25 bp, Rattus norvegicus
gtagatggctacacccgggaagcgc

SEQ ID NO: 559166 - DNA, 25 bp, Rattus norvegicus
tgacgggcataaatacaccagcacc

SEQ ID NO: 559167 - DNA, 25 bp, Rattus norvegicus
tcgccctgggccacagttaagtcca

SEQ ID NO: 559168 - DNA, 25 bp, Rattus norvegicus
tgcttgctgtcgcagcagctgcgcg

SEQ ID NO: 559169 - DNA, 25 bp, Rattus norvegicus
aacccaaagccgcaggtgctgcttg

SEQ ID NO: 559170 - DNA, 25 bp, Rattus norvegicus
cgggagccgcacacctgtaaacatc

SEQ ID NO: 559171 - DNA, 25 bp, Rattus norvegicus
ttaagtccatgcactggggtgacgg

SEQ ID NO: 559172 - DNA, 25 bp, Rattus norvegicus
accgactcaggaagcacgggaggcc

SEQ ID NO: 559173 - DNA, 25 bp, Rattus norvegicus
ggaagcatctggacaccgactcagg

SEQ ID NO: 559174 - DNA, 25 bp, Rattus norvegicus
taaagcgctgtgtggggaccctgct

SEQ ID NO: 559175 - DNA, 25 bp, Rattus norvegicus
cccattcgcggctccgcaaggtaga

SEQ ID NO: 559176 - DNA, 25 bp, Rattus norvegicus
gaagcctttggaccgcgccaggcga

SEQ ID NO: 559177 - DNA, 25 bp, Rattus norvegicus
aacatctaggatgcggaagcctttg

SEQ ID NO: 559178 - DNA, 25 bp, Rattus norvegicus
gccgccgtcgcttcggaagcatctg

SEQ ID NO: 559179 - DNA, 25 bp, Rattus norvegicus
attagtcggggctccgtgctgctcc

SEQ ID NO: 559180 - DNA, 25 bp, Rattus norvegicus
agcgtgcccgcaaatccaaggcagg

SEQ ID NO: 559181 - DNA, 25 bp, Rattus norvegicus
ggacgacgtggaagcccagccactt

SEQ ID NO: 559182 - DNA, 25 bp, Rattus norvegicus
tcctttcggagtttgagacccagtc

SEQ ID NO: 559183 - DNA, 25 bp, Rattus norvegicus
caggagttcctcgaaggcttccttt

SEQ ID NO: 559184 - DNA, 25 bp, Rattus norvegicus
acggacgacgagatccaggagttcc

SEQ ID NO: 559185 - DNA, 25 bp, Rattus norvegicus
gccatggctgcggtacgcaccgcat

SEQ ID NO: 559186 - DNA, 25 bp, Rattus norvegicus
ctggataccctcgacgtccacgttg

SEQ ID NO: 559187 - DNA, 25 bp, Rattus norvegicus
gggctcgccagaacctctctcggaa

SEQ ID NO: 559188 - DNA, 25 bp, Rattus norvegicus
gagcgcccatttgccgccggagctg

SEQ ID NO: 559189 - DNA, 25 bp, Rattus norvegicus
ccacgcggggtaggagcgcccattt

SEQ ID NO: 559190 - DNA, 25 bp, Rattus norvegicus
cggtccgcgtgagagctagccacgc

SEQ ID NO: 559191 - DNA, 25 bp, Rattus norvegicus
tcgcaagcactccagagggcggtcc

SEQ ID NO: 559192 - DNA, 25 bp, Rattus norvegicus
ctgacgttgctattagtcggggctc

SEQ ID NO: 559193 - DNA, 25 bp, Rattus norvegicus
ccaagatttgcaacgtggactacga

SEQ ID NO: 559194 - DNA, 25 bp, Rattus norvegicus
ctgaacccgggtgagtaccgtgtga

SEQ ID NO: 559195 - DNA, 25 bp, Rattus norvegicus
cgggtgagtaccgtgtgacagctca

SEQ ID NO: 559196 - DNA, 25 bp, Rattus norvegicus
tgtgacagctcacgcagagggctac

SEQ ID NO: 559197 - DNA, 25 bp, Rattus norvegicus
agctcacgcagagggctacacctcg

SEQ ID NO: 559198 - DNA, 25 bp, Rattus norvegicus
gctacacctcgagtgccaagatttg

SEQ ID NO: 559199 - DNA, 25 bp, Rattus norvegicus
tggactacgatatcggggccaccca

SEQ ID NO: 559200 - DNA, 25 bp, Rattus norvegicus
tcggggccacccagtgcaacttcat

SEQ ID NO: 559201 - DNA, 25 bp, Rattus norvegicus
agtgcaacttcatcctggcgcgctc

SEQ ID NO: 559202 - DNA, 25 bp, Rattus norvegicus
caactggaagcgcattcgggagatc

SEQ ID NO: 559203 - DNA, 25 bp, Rattus norvegicus
cgcattcgggagatcttggctatga

SEQ ID NO: 559204 - DNA, 25 bp, Rattus norvegicus
ggaaccgtcccattctccgagttga

SEQ ID NO: 559205 - DNA, 25 bp, Rattus norvegicus
ccggctacggtaccggctcaggatg

SEQ ID NO: 559206 - DNA, 25 bp, Rattus norvegicus
tcttggctatgaacgggaaccgtcc

SEQ ID NO: 559207 - DNA, 25 bp, Rattus norvegicus
tagcactgagtttcccatgcgcatg

SEQ ID NO: 559208 - DNA, 25 bp, Rattus norvegicus
atcccgccaatctccgcgcgcccgt

SEQ ID NO: 559209 - DNA, 25 bp, Rattus norvegicus
gcacgttggtggcagcggcccacat

SEQ ID NO: 559210 - DNA, 25 bp, Rattus norvegicus
agccggacgctatgggcgacctgtc

SEQ ID NO: 559211 - DNA, 25 bp, Rattus norvegicus
cctcgggcccacgttgcagttcgaa

SEQ ID NO: 559212 - DNA, 25 bp, Rattus norvegicus
ttgcggctgggcctcaccgtgtgaa

SEQ ID NO: 559213 - DNA, 25 bp, Rattus norvegicus
cagcctggcccaacacccatattga

SEQ ID NO: 559214 - DNA, 25 bp, Rattus norvegicus
ccgcccattggtgcattcggccaat

SEQ ID NO: 559215 - DNA, 25 bp, Rattus norvegicus
gtgcattcggccaatggcgtcccgc

SEQ ID NO: 559216 - DNA, 25 bp, Rattus norvegicus
gcccgtcgctgcacgcctcatccag

SEQ ID NO: 559217 - DNA, 25 bp, Rattus norvegicus
cggacaacccttacctagcactgag

SEQ ID NO: 559218 - DNA, 25 bp, Rattus norvegicus
ctctgcgcctggctgatcccactct

SEQ ID NO: 559219 - DNA, 25 bp, Rattus norvegicus
tttcccatgcgcatgcggcgtttgc

SEQ ID NO: 559220 - DNA, 25 bp, Rattus norvegicus
ctcaccgtgtgaacccgtgggtagt

SEQ ID NO: 559221 - DNA, 25 bp, Rattus norvegicus
aggcttccgtactcggacgtcacgc

SEQ ID NO: 559222 - DNA, 25 bp, Rattus norvegicus
ggacgtcacgctggccggtcctaac

SEQ ID NO: 559223 - DNA, 25 bp, Rattus norvegicus
ttccaggcttccgtactcggacgtc

SEQ ID NO: 559224 - DNA, 25 bp, Rattus norvegicus
cgcgtccatagctgaggcgtttggt

SEQ ID NO: 559225 - DNA, 25 bp, Rattus norvegicus
accttctccagggacgcgtccatag

SEQ ID NO: 559226 - DNA, 25 bp, Rattus norvegicus
cggagacctgggaccacagcgccgt

SEQ ID NO: 559227 - DNA, 25 bp, Rattus norvegicus
ccggtagcggagacctgggaccaca

SEQ ID NO: 559228 - DNA, 25 bp, Rattus norvegicus
aggacgccctccaccagcgagattc

SEQ ID NO: 559229 - DNA, 25 bp, Rattus norvegicus
aagccaaggccggttccgacagcac

SEQ ID NO: 559230 - DNA, 25 bp, Rattus norvegicus
accctacaggaccagcgcgggttca

SEQ ID NO: 559231 - DNA, 25 bp, Rattus norvegicus
ctatagctcctgtcaccctacagga

SEQ ID NO: 559232 - DNA, 25 bp, Rattus norvegicus
gggtccacacctatagctcctgtca

SEQ ID NO: 559233 - DNA, 25 bp, Rattus norvegicus
gcgcttctggggtccacacctatag

SEQ ID NO: 559234 - DNA, 25 bp, Rattus norvegicus
gcgagattccttagtcccacgggga

SEQ ID NO: 559235 - DNA, 25 bp, Rattus norvegicus
ttgctccagcggctggctcattagc

SEQ ID NO: 559236 - DNA, 25 bp, Rattus norvegicus
cggctggctcattagcccagcggga

SEQ ID NO: 559237 - DNA, 25 bp, Rattus norvegicus
cttcgaggggcgcatttgctccagc

SEQ ID NO: 559238 - DNA, 25 bp, Rattus norvegicus
gaagccagcttcgaggggcgcattt

SEQ ID NO: 559239 - DNA, 25 bp, Rattus norvegicus
gcttctgcactagagttggcggaga

SEQ ID NO: 559240 - DNA, 25 bp, Rattus norvegicus
tctctggaaacaggctgacgaaggg

SEQ ID NO: 559241 - DNA, 25 bp, Rattus norvegicus
tacatctctggaaacaggctgacga

SEQ ID NO: 559242 - DNA, 25 bp, Rattus norvegicus
agctcttaatagtacatctctggaa

SEQ ID NO: 559243 - DNA, 25 bp, Rattus norvegicus
ggtttacttgtacaagctcttaata

SEQ ID NO: 559244 - DNA, 25 bp, Rattus norvegicus
gcaaacggtttacttgtacaagctc

SEQ ID NO: 559245 - DNA, 25 bp, Rattus norvegicus
gcttcgctcagcaaacggtttactt

SEQ ID NO: 559246 - DNA, 25 bp, Rattus norvegicus
ggcgcagccagcttcgctcagcaaa

SEQ ID NO: 559247 - DNA, 25 bp, Rattus norvegicus
tgcttcgtcccaccaggcgcagcca

SEQ ID NO: 559248 - DNA, 25 bp, Rattus norvegicus
gtcggctcgttgcttcgtcccacca

SEQ ID NO: 559249 - DNA, 25 bp, Rattus norvegicus
tgcctggctcaccttgaaagcaacg

SEQ ID NO: 559250 - DNA, 25 bp, Rattus norvegicus
agctccaaggtgctgctctagccag

SEQ ID NO: 559251 - DNA, 25 bp, Rattus norvegicus
aggtactgccatgccagctccaagg

SEQ ID NO: 559252 - DNA, 25 bp, Rattus norvegicus
gcacgtagggtctggcgacaattaa

SEQ ID NO: 559253 - DNA, 25 bp, Rattus norvegicus
tgaaagcaacgtcgtagaagtctcc

SEQ ID NO: 559254 - DNA, 25 bp, Rattus norvegicus
agaagtctccagtgccaccaagtga

SEQ ID NO: 559255 - DNA, 25 bp, Rattus norvegicus
cagcgtagaggcagccggcacactc

SEQ ID NO: 559256 - DNA, 25 bp, Rattus norvegicus
ttcttcctggacatggttctcagtg

SEQ ID NO: 559257 - DNA, 25 bp, Rattus norvegicus
ggttctcagtgtgctcctgctgcta

SEQ ID NO: 559258 - DNA, 25 bp, Rattus norvegicus
acctgctgcattcccatggcgggga

SEQ ID NO: 559259 - DNA, 25 bp, Rattus norvegicus
gctctgaggcggagccatgcaaata

SEQ ID NO: 559260 - DNA, 25 bp, Rattus norvegicus
agcggcggtctaggatccaacacca

SEQ ID NO: 559261 - DNA, 25 bp, Rattus norvegicus
tctagccagccagttcagcgccgag

SEQ ID NO: 559262 - DNA, 25 bp, Rattus norvegicus
accgctgccaatggccgctctgagg

SEQ ID NO: 559263 - DNA, 25 bp, Rattus norvegicus
gctgacctcgggtgcagcttgtaca

SEQ ID NO: 559264 - DNA, 25 bp, Rattus norvegicus
atgttgtggatctgctttcggtccc

SEQ ID NO: 559265 - DNA, 25 bp, Rattus norvegicus
gcaagcgaaggtggaagctgacctc

SEQ ID NO: 559266 - DNA, 25 bp, Rattus norvegicus
tgcagcttgtacacggagccatcca

SEQ ID NO: 559267 - DNA, 25 bp, Rattus norvegicus
ggagccatccacgcccacagtgatg

SEQ ID NO: 559268 - DNA, 25 bp, Rattus norvegicus
tgatgcgcatcacgtcctcactgcg

SEQ ID NO: 559269 - DNA, 25 bp, Rattus norvegicus
gctttcgcgcatgcgatttatgacc

SEQ ID NO: 559270 - DNA, 25 bp, Rattus norvegicus
cccagctagtcctgcggagcacata

SEQ ID NO: 559271 - DNA, 25 bp, Rattus norvegicus
ggcgcgagtggacacgctttcacag

SEQ ID NO: 559272 - DNA, 25 bp, Rattus norvegicus
gctttcacaggcacggcgcacaatg

SEQ ID NO: 559273 - DNA, 25 bp, Rattus norvegicus
cggcgcacaatgtcgcagtcggtga

SEQ ID NO: 559274 - DNA, 25 bp, Rattus norvegicus
gcacaatgtcgcagtcggtgacaga

SEQ ID NO: 559275 - DNA, 25 bp, Rattus norvegicus
cccagagtgcttaggatgttgtgga

SEQ ID NO: 559276 - DNA, 25 bp, Rattus norvegicus
tagtcctgcggagcacatatgggcg

SEQ ID NO: 559277 - DNA, 25 bp, Rattus norvegicus
caagctgcaccggttgcgcaagcgg

SEQ ID NO: 559278 - DNA, 25 bp, Rattus norvegicus
ctcaaccacgggaacagcgaaggca

SEQ ID NO: 559279 - DNA, 25 bp, Rattus norvegicus
aacagcgaaggcaccgacccgggtg

SEQ ID NO: 559280 - DNA, 25 bp, Rattus norvegicus
catccacgtataggtgcgggcagcg

SEQ ID NO: 559281 - DNA, 25 bp, Rattus norvegicus
ccgcttagccaggtgcactgtgcca

SEQ ID NO: 559282 - DNA, 25 bp, Rattus norvegicus
gtgaggcgccaccaggtaaccgcac

SEQ ID NO: 559283 - DNA, 25 bp, Rattus norvegicus
cgcccaggagccgatccattgtgac

SEQ ID NO: 559284 - DNA, 25 bp, Rattus norvegicus
cgatccattgtgacgcgggacgcga

SEQ ID NO: 559285 - DNA, 25 bp, Rattus norvegicus
gcggggcgaacacactgactaattg

SEQ ID NO: 559286 - DNA, 25 bp, Rattus norvegicus
gggcgcgctactccagcagaggacc

SEQ ID NO: 559287 - DNA, 25 bp, Rattus norvegicus
agcacgcgggctgcgcaagctgcac

SEQ ID NO: 559288 - DNA, 25 bp, Rattus norvegicus
ggggctgcattccagaaacccagga

SEQ ID NO: 559289 - DNA, 25 bp, Rattus norvegicus
ggacacacaggtgcgcgctcaacca

SEQ ID NO: 559290 - DNA, 25 bp, Rattus norvegicus
cacactgactaattgcgcgcgcgga

SEQ ID NO: 559291 - DNA, 25 bp, Rattus norvegicus
gactcagcctgacgcgggtgcgtcc

SEQ ID NO: 559292 - DNA, 25 bp, Rattus norvegicus
gcggtgcttctcaaagccgcgtacg

SEQ ID NO: 559293 - DNA, 25 bp, Rattus norvegicus
cagcccggaagagagcgtgtgccaa

SEQ ID NO: 559294 - DNA, 25 bp, Rattus norvegicus
gtgtgccaaggcactgccacgcagg

SEQ ID NO: 559295 - DNA, 25 bp, Rattus norvegicus
gagaccgagccttctggcgccgact

SEQ ID NO: 559296 - DNA, 25 bp, Rattus norvegicus
ttccgtcctccagtgcgcgtctgaa

SEQ ID NO: 559297 - DNA, 25 bp, Rattus norvegicus
gcgtctgaagcacccagcgactgga

SEQ ID NO: 559298 - DNA, 25 bp, Rattus norvegicus
agcacccagcgactggaaccggaag

SEQ ID NO: 559299 - DNA, 25 bp, Rattus norvegicus
cctaagctaggaggaagaagccggc

SEQ ID NO: 559300 - DNA, 25 bp, Rattus norvegicus
tgcggcgccatgaagctgtacagcc

SEQ ID NO: 559301 - DNA, 25 bp, Rattus norvegicus
agctgtacagccttagtgtctttta

SEQ ID NO: 559302 - DNA, 25 bp, Rattus norvegicus
tagtgtcttttacaaaggcgaacca

SEQ ID NO: 559303 - DNA, 25 bp, Rattus norvegicus
aggcgaaccaaaagcggtgcttctc

SEQ ID NO: 559304 - DNA, 25 bp, Rattus norvegicus
cactgccacgcaggcggagaccgag

SEQ ID NO: 559305 - DNA, 25 bp, Rattus norvegicus
gacagcgtgcccacaccggagacga

SEQ ID NO: 559306 - DNA, 25 bp, Rattus norvegicus
ctcgtatagctggtactcgtccgtg

SEQ ID NO: 559307 - DNA, 25 bp, Rattus norvegicus
cgccaggagcgcgacgcacacctac

SEQ ID NO: 559308 - DNA, 25 bp, Rattus norvegicus
gcacgcgagatctgctcgctctgtc

SEQ ID NO: 559309 - DNA, 25 bp, Rattus norvegicus
cgagcgcacgcgagatctgctcgct

SEQ ID NO: 559310 - DNA, 25 bp, Rattus norvegicus
tccgtgaaacgggtgcaggtcaccg

SEQ ID NO: 559311 - DNA, 25 bp, Rattus norvegicus
agctggtactcgtccgtgaaacggg

SEQ ID NO: 559312 - DNA, 25 bp, Rattus norvegicus
cttgccaatatcctcgtatagctgg

SEQ ID NO: 559313 - DNA, 25 bp, Rattus norvegicus
gcgccgaggctcttacttgccaata

SEQ ID NO: 559314 - DNA, 25 bp, Rattus norvegicus
ccggcagggccataagcgctgcagt

SEQ ID NO: 559315 - DNA, 25 bp, Rattus norvegicus
cccgccgccaaatgcgtcacgtctg

SEQ ID NO: 559316 - DNA, 25 bp, Rattus norvegicus
tcgggcactctaggcctggcagcct

SEQ ID NO: 559317 - DNA, 25 bp, Rattus norvegicus
taggaccgacccttcgggcactcta

SEQ ID NO: 559318 - DNA, 25 bp, Rattus norvegicus
gccaagctatggcacccggcagggc

SEQ ID NO: 559319 - DNA, 25 bp, Rattus norvegicus
cgcggctcccttcgcacacatgtcg

SEQ ID NO: 559320 - DNA, 25 bp, Rattus norvegicus
ctctctcgcaccctacactcgcctg

SEQ ID NO: 559321 - DNA, 25 bp, Rattus norvegicus
cgccttctacctgcactagcgctcg

SEQ ID NO: 559322 - DNA, 25 bp, Rattus norvegicus
ctgcactagcgctcgcgcctgcacg

SEQ ID NO: 559323 - DNA, 25 bp, Rattus norvegicus
actgcacccgcaccgcggctccctt

SEQ ID NO: 559324 - DNA, 25 bp, Rattus norvegicus
ttcgcacacatgtcgcgcccgcgcc

SEQ ID NO: 559325 - DNA, 25 bp, Rattus norvegicus
cccgcgccggcacccgcactgcgcc

SEQ ID NO: 559326 - DNA, 25 bp, Rattus norvegicus
actgcgcccgcaccatgcaatccca

SEQ ID NO: 559327 - DNA, 25 bp, Rattus norvegicus
agcacatgggctgcaccacacggtg

SEQ ID NO: 559328 - DNA, 25 bp, Rattus norvegicus
acacggtgcccacgcactgcgtctg

SEQ ID NO: 559329 - DNA, 25 bp, Rattus norvegicus
acgcactgcgtctgaccctctaagc

SEQ ID NO: 559330 - DNA, 25 bp, Rattus norvegicus
ctgaccctctaagcccgcgccctgt

SEQ ID NO: 559331 - DNA, 25 bp, Rattus norvegicus
cgcctgcacccgcacacacaccgca

SEQ ID NO: 559332 - DNA, 25 bp, Rattus norvegicus
cgcctgcacgcgcactgcacccgca

SEQ ID NO: 559333 - DNA, 25 bp, Rattus norvegicus
tccacgctgacagtgcgcacgcgta

SEQ ID NO: 559334 - DNA, 25 bp, Rattus norvegicus
agcccaagtcggtgacagcctaaga

SEQ ID NO: 559335 - DNA, 25 bp, Rattus norvegicus
tcaactctggaggatacgtcacttc

SEQ ID NO: 559336 - DNA, 25 bp, Rattus norvegicus
atagcataagctgcggtcttcccgg

SEQ ID NO: 559337 - DNA, 25 bp, Rattus norvegicus
caacttgtgcttctggctgtgcgca

SEQ ID NO: 559338 - DNA, 25 bp, Rattus norvegicus
ccagcgccagaggtatggctttttc

SEQ ID NO: 559339 - DNA, 25 bp, Rattus norvegicus
gcgtaggtcgtgaccagcccaagtc

SEQ ID NO: 559340 - DNA, 25 bp, Rattus norvegicus
cctaagaaggaagaggatgcgactc

SEQ ID NO: 559341 - DNA, 25 bp, Rattus norvegicus
gaggacagcagcacgccaggtccca

SEQ ID NO: 559342 - DNA, 25 bp, Rattus norvegicus
gttcaaaacccagcgcttcttggtc

SEQ ID NO: 559343 - DNA, 25 bp, Rattus norvegicus
tcttggtcctccatggcgtgacttc

SEQ ID NO: 559344 - DNA, 25 bp, Rattus norvegicus
gggcgggacaagtcaataaccaatc

SEQ ID NO: 559345 - DNA, 25 bp, Rattus norvegicus
gtccgacgtttccaccaacttgtgc

SEQ ID NO: 559346 - DNA, 25 bp, Rattus norvegicus
ctttttcctggattagcgtaggtcg

SEQ ID NO: 559347 - DNA, 25 bp, Rattus norvegicus
aagcagcgcttctcagtctcgccga

SEQ ID NO: 559348 - DNA, 25 bp, Rattus norvegicus
tcgggtatttcctcgatgaagcagc

SEQ ID NO: 559349 - DNA, 25 bp, Rattus norvegicus
gtctcgtcgggtatttcctcgatga

SEQ ID NO: 559350 - DNA, 25 bp, Rattus norvegicus
tatttcctcgatgaagcagcgcttc

SEQ ID NO: 559351 - DNA, 25 bp, Rattus norvegicus
gacacctgccatcgcgcctcaacct

SEQ ID NO: 559352 - DNA, 25 bp, Rattus norvegicus
cttggcaacggaaagcgcgcctgcg

SEQ ID NO: 559353 - DNA, 25 bp, Rattus norvegicus
caccggcttggcaacggaaagcgcg

SEQ ID NO: 559354 - DNA, 25 bp, Rattus norvegicus
gaccatggtctcgtcgggtatttcc

SEQ ID NO: 559355 - DNA, 25 bp, Rattus norvegicus
actgctcagcgtttgcgcaccggct

SEQ ID NO: 559356 - DNA, 25 bp, Rattus norvegicus
cgcttctcagtctcgccgatgtgga

SEQ ID NO: 559357 - DNA, 25 bp, Rattus norvegicus
gaaatagagaccacgggcacccgca

SEQ ID NO: 559358 - DNA, 25 bp, Rattus norvegicus
ttgcgcaccggcttggcaacggaaa

SEQ ID NO: 559359 - DNA, 25 bp, Rattus norvegicus
cagtctcgccgatgtggaaatagag

SEQ ID NO: 559360 - DNA, 25 bp, Rattus norvegicus
gtaagcaccagcagcacaaatcgca

SEQ ID NO: 559361 - DNA, 25 bp, Rattus norvegicus
cccaattctgtgacgtcatgttacg

SEQ ID NO: 559362 - DNA, 25 bp, Rattus norvegicus
agggtgaggccaattcgtccttgca

SEQ ID NO: 559363 - DNA, 25 bp, Rattus norvegicus
agctgaacaggagacaggtaacctt

SEQ ID NO: 559364 - DNA, 25 bp, Rattus norvegicus
agccggagcgactgaaacccaattc

SEQ ID NO: 559365 - DNA, 25 bp, Rattus norvegicus
acaggtaaccttgtgcggcagacgg

SEQ ID NO: 559366 - DNA, 25 bp, Rattus norvegicus
atgttacgcccacaagcctgtccag

SEQ ID NO: 559367 - DNA, 25 bp, Rattus norvegicus
ggtgacactggtttccctagaaaca

SEQ ID NO: 559368 - DNA, 25 bp, Rattus norvegicus
tgtcggccaaggtgacactggtttc

SEQ ID NO: 559369 - DNA, 25 bp, Rattus norvegicus
tatgaggtaaaccaggctgtcggcc

SEQ ID NO: 559370 - DNA, 25 bp, Rattus norvegicus
ccacctgccggtatgaggtaaacca

SEQ ID NO: 559371 - DNA, 25 bp, Rattus norvegicus
cgctattggctctggtgacggagcc

SEQ ID NO: 559372 - DNA, 25 bp, Rattus norvegicus
gacatgcatcgtagccaatggagtg

SEQ ID NO: 559373 - DNA, 25 bp, Rattus norvegicus
ggacgaggcctgatggacatgcatc

SEQ ID NO: 559374 - DNA, 25 bp, Rattus norvegicus
aattcgtccttgcagcccgagtgcc

SEQ ID NO: 559375 - DNA, 25 bp, Rattus norvegicus
atgcatatgcatgagcagcgcggcg

SEQ ID NO: 559376 - DNA, 25 bp, Rattus norvegicus
cgggcgcactgaacttcctgcacgg

SEQ ID NO: 559377 - DNA, 25 bp, Rattus norvegicus
cctggccatgcaggcccgcactcgc

SEQ ID NO: 559378 - DNA, 25 bp, Rattus norvegicus
acggcagccagtcgccgcccgggcc

SEQ ID NO: 559379 - DNA, 25 bp, Rattus norvegicus
gaacttcctgcacggcagccagtcg

SEQ ID NO: 559380 - DNA, 25 bp, Rattus norvegicus
tgaacttcctgcacggcagccagtc

SEQ ID NO: 559381 - DNA, 25 bp, Rattus norvegicus
ggcgcactgaacttcctgcacggca

SEQ ID NO: 559382 - DNA, 25 bp, Rattus norvegicus
ggccgggcgcactgaacttcctgca

SEQ ID NO: 559383 - DNA, 25 bp, Rattus norvegicus
cggcgcggcgtcatgcatatgcatg

SEQ ID NO: 559384 - DNA, 25 bp, Rattus norvegicus
agcctccggagcaccgctcggggct

SEQ ID NO: 559385 - DNA, 25 bp, Rattus norvegicus
ccctgcccgagcctccggagcaccg

SEQ ID NO: 559386 - DNA, 25 bp, Rattus norvegicus
gcaggccgggcgcactgaacttcct

SEQ ID NO: 559387 - DNA, 25 bp, Rattus norvegicus
tccccggtggacagcagcaggaagc

SEQ ID NO: 559388 - DNA, 25 bp, Rattus norvegicus
gcggtcgcaaaggtgcggaggggac

SEQ ID NO: 559389 - DNA, 25 bp, Rattus norvegicus
gctaaagaacacacaaggggctgga

SEQ ID NO: 559390 - DNA, 25 bp, Rattus norvegicus
ccgccctgttaagctaaagaacaca

SEQ ID NO: 559391 - DNA, 25 bp, Rattus norvegicus
ccatttcctgacgaggggccatttt

SEQ ID NO: 559392 - DNA, 25 bp, Rattus norvegicus
acatcacggctgatggcgagccctt

SEQ ID NO: 559393 - DNA, 25 bp, Rattus norvegicus
cgcttgctgcagacatggtcaaccc

SEQ ID NO: 559394 - DNA, 25 bp, Rattus norvegicus
ctcttttcgccgcttgctgcagaca

SEQ ID NO: 559395 - DNA, 25 bp, Rattus norvegicus
ttgcagacgccgctgtctcttttcg

SEQ ID NO: 559396 - DNA, 25 bp, Rattus norvegicus
aggctcgtgccgctttgcagacgcc

SEQ ID NO: 559397 - DNA, 25 bp, Rattus norvegicus
ttgtgattgatccaggtccaggcgc

SEQ ID NO: 559398 - DNA, 25 bp, Rattus norvegicus
ccgtctgggaagcagttgtgattga

SEQ ID NO: 559399 - DNA, 25 bp, Rattus norvegicus
tcgcaccgtcactccgtctgggaag

SEQ ID NO: 559400 - DNA, 25 bp, Rattus norvegicus
cggacagcgaagcaaccatccctta

SEQ ID NO: 559401 - DNA, 25 bp, Rattus norvegicus
ggactcttcccacacggacagcgaa

SEQ ID NO: 559402 - DNA, 25 bp, Rattus norvegicus
tctggtgccctgtaatggtgtgtct

SEQ ID NO: 559403 - DNA, 25 bp, Rattus norvegicus
acgccactgcgctgtgagtagctgt

SEQ ID NO: 559404 - DNA, 25 bp, Rattus norvegicus
ttctcgcttattgggcggagcctct

SEQ ID NO: 559405 - DNA, 25 bp, Rattus norvegicus
tgccgcgtcaattgctcgggtcgct

SEQ ID NO: 559406 - DNA, 25 bp, Rattus norvegicus
aacgctgagcagctgtcgcaccgca

SEQ ID NO: 559407 - DNA, 25 bp, Rattus norvegicus
cccacggccaacttggaagcgcagg

SEQ ID NO: 559408 - DNA, 25 bp, Rattus norvegicus
aggactgaggtagatagagcccttc

SEQ ID NO: 559409 - DNA, 25 bp, Rattus norvegicus
ccgcccattgcaggatctgcagtga

SEQ ID NO: 559410 - DNA, 25 bp, Rattus norvegicus
atagagcccttctggagcattgccg

SEQ ID NO: 559411 - DNA, 25 bp, Rattus norvegicus
cgcccaccaaagttctcgcttattg

SEQ ID NO: 559412 - DNA, 25 bp, Rattus norvegicus
gcctggtctgcagcaacccaactga

SEQ ID NO: 559413 - DNA, 25 bp, Rattus norvegicus
tgctcaacgagtcggggctcgaaac

SEQ ID NO: 559414 - DNA, 25 bp, Rattus norvegicus
gcctaagcgggcagttgctcaacga

SEQ ID NO: 559415 - DNA, 25 bp, Rattus norvegicus
cggagcctgtgaaggccttctcttc

SEQ ID NO: 559416 - DNA, 25 bp, Rattus norvegicus
cggcctggctagagcatcatgactg

SEQ ID NO: 559417 - DNA, 25 bp, Rattus norvegicus
cgggccaattgtacgcctccttcta

SEQ ID NO: 559418 - DNA, 25 bp, Rattus norvegicus
acagggaactcgcacagcagcagcc

SEQ ID NO: 559419 - DNA, 25 bp, Rattus norvegicus
cggagccgaagacagggaactcgca

SEQ ID NO: 559420 - DNA, 25 bp, Rattus norvegicus
ctggtggctaggatcagaactcctc

SEQ ID NO: 559421 - DNA, 25 bp, Rattus norvegicus
cgatcctcagtaggggcattacgta

SEQ ID NO: 559422 - DNA, 25 bp, Rattus norvegicus
agaactcctccgatcctcagtaggg

SEQ ID NO: 559423 - DNA, 25 bp, Rattus norvegicus
cacgttgttcgtttgaacctcggcg

SEQ ID NO: 559424 - DNA, 25 bp, Rattus norvegicus
cggagtccggaacagcgggcactcc

SEQ ID NO: 559425 - DNA, 25 bp, Rattus norvegicus
tgtacgcctccttctagccataact

SEQ ID NO: 559426 - DNA, 25 bp, Rattus norvegicus
tgccacctccctaacggctgtttgt

SEQ ID NO: 559427 - DNA, 25 bp, Rattus norvegicus
actcccggctcctcaagtggaggcg

SEQ ID NO: 559428 - DNA, 25 bp, Rattus norvegicus
gaccgccgcagctagagccggacaa

SEQ ID NO: 559429 - DNA, 25 bp, Rattus norvegicus
atagccgcccacgttgttcgtttga

SEQ ID NO: 559430 - DNA, 25 bp, Rattus norvegicus
tagagccggacaatgcccggggccc

SEQ ID NO: 559431 - DNA, 25 bp, Rattus norvegicus
aactcgctcttaagcgcgcggcgcg

SEQ ID NO: 559432 - DNA, 25 bp, Rattus norvegicus
gtcgcggaactcgatgaggccctgc

SEQ ID NO: 559433 - DNA, 25 bp, Rattus norvegicus
gtccaggtagtacttgcggttctcg

SEQ ID NO: 559434 - DNA, 25 bp, Rattus norvegicus
taccgtctgacggatgcgcaggaag

SEQ ID NO: 559435 - DNA, 25 bp, Rattus norvegicus
cgccgcggtttaccgtctgacggat

SEQ ID NO: 559436 - DNA, 25 bp, Rattus norvegicus
agcgcgatggtctggccgctctgca

SEQ ID NO: 559437 - DNA, 25 bp, Rattus norvegicus
aagaagcgcttggagtccaccgtga

SEQ ID NO: 559438 - DNA, 25 bp, Rattus norvegicus
ccatcgagagcgtgaggcggctctt

SEQ ID NO: 559439 - DNA, 25 bp, Rattus norvegicus
gccgacgtcgaagaagaagcgcttg

SEQ ID NO: 559440 - DNA, 25 bp, Rattus norvegicus
ccgtacttgttgcagccgacgtcga

SEQ ID NO: 559441 - DNA, 25 bp, Rattus norvegicus
aggatggcttcacctcgctcactcg

SEQ ID NO: 559442 - DNA, 25 bp, Rattus norvegicus
cattgcggtaggatggcttcacctc

SEQ ID NO: 559443 - DNA, 25 bp, Rattus norvegicus
agtccaccgtgatggaggtgccctc

SEQ ID NO: 559444 - DNA, 25 bp, Rattus norvegicus
cggccaccgccatcgagagcgtgag

SEQ ID NO: 559445 - DNA, 25 bp, Rattus norvegicus
ctacgtgtgtcagcacagcccggca

SEQ ID NO: 559446 - DNA, 25 bp, Rattus norvegicus
aaaccacctactgctggccaggcgg

SEQ ID NO: 559447 - DNA, 25 bp, Rattus norvegicus
ttttgtgtgccctgtgaagctcacg

SEQ ID NO: 559448 - DNA, 25 bp, Rattus norvegicus
tcacgggagccaccaaacgtcgggc

SEQ ID NO: 559449 - DNA, 25 bp, Rattus norvegicus
tgaggaagcgcctcgtgacaccaga

SEQ ID NO: 559450 - DNA, 25 bp, Rattus norvegicus
gtgacaccagagctcattaatagcc

SEQ ID NO: 559451 - DNA, 25 bp, Rattus norvegicus
tcggttgacgtcactgccgagggac

SEQ ID NO: 559452 - DNA, 25 bp, Rattus norvegicus
cttcgagaatgctccggaaagactc

SEQ ID NO: 559453 - DNA, 25 bp, Rattus norvegicus
aagctcgcggtccagaaaccaccta

SEQ ID NO: 559454 - DNA, 25 bp, Rattus norvegicus
cctcaccgcagctcgggaagggttt

SEQ ID NO: 559455 - DNA, 25 bp, Rattus norvegicus
tgacccaactcgacagggacaccaa

SEQ ID NO: 559456 - DNA, 25 bp, Rattus norvegicus
cagggacaccaacgatacacggcca

SEQ ID NO: 559457 - DNA, 25 bp, Rattus norvegicus
cacggccaacttcacagaacagtgg

SEQ ID NO: 559458 - DNA, 25 bp, Rattus norvegicus
taatagcctgttcgcttcgagaatg

SEQ ID NO: 559459 - DNA, 25 bp, Rattus norvegicus
tggactcgaagtagccctgcaccgc

SEQ ID NO: 559460 - DNA, 25 bp, Rattus norvegicus
gccaaccatggctgccatctgaatg

SEQ ID NO: 559461 - DNA, 25 bp, Rattus norvegicus
tgatgacgacggatgcagaaaaggt

SEQ ID NO: 559462 - DNA, 25 bp, Rattus norvegicus
tgagggccgcagcacatgcgacaaa

SEQ ID NO: 559463 - DNA, 25 bp, Rattus norvegicus
catgcgacaaaggagccgccaacca

SEQ ID NO: 559464 - DNA, 25 bp, Rattus norvegicus
gctgccatctgaatgcgcacacgtg

SEQ ID NO: 559465 - DNA, 25 bp, Rattus norvegicus
taaagttatggccacagcagcgagc

SEQ ID NO: 559466 - DNA, 25 bp, Rattus norvegicus
cggcgcgcgcatgtaacgacatcac

SEQ ID NO: 559467 - DNA, 25 bp, Rattus norvegicus
cctgaagccgcgtgcgcgggctcaa

SEQ ID NO: 559468 - DNA, 25 bp, Rattus norvegicus
ctcaaggatggtgacgtcagcagtc

SEQ ID NO: 559469 - DNA, 25 bp, Rattus norvegicus
tggttgaccgcaggcggacctcagc

SEQ ID NO: 559470 - DNA, 25 bp, Rattus norvegicus
gggaaaacgtccctgcttcaccgca

SEQ ID NO: 559471 - DNA, 25 bp, Rattus norvegicus
ccaattcctacctggactcgaagta

SEQ ID NO: 559472 - DNA, 25 bp, Rattus norvegicus
gcgcacacgtgtccgtaaagttatg

SEQ ID NO: 559473 - DNA, 25 bp, Rattus norvegicus
tttgccctgtaaggaagcgccctcc

SEQ ID NO: 559474 - DNA, 25 bp, Rattus norvegicus
tgggaaatcggcctccctaaagatg

SEQ ID NO: 559475 - DNA, 25 bp, Rattus norvegicus
ctccctaaagatggcggcagaattg

SEQ ID NO: 559476 - DNA, 25 bp, Rattus norvegicus
aaaagttggatccactcccgcgcgg

SEQ ID NO: 559477 - DNA, 25 bp, Rattus norvegicus
aaccgggatctcctcaggggcattc

SEQ ID NO: 559478 - DNA, 25 bp, Rattus norvegicus
ccagcggttttctctgggcggaagt

SEQ ID NO: 559479 - DNA, 25 bp, Rattus norvegicus
ccagagcgagcatgtagcggccgct

SEQ ID NO: 559480 - DNA, 25 bp, Rattus norvegicus
ggaacttggaccactgggctgtgcc

SEQ ID NO: 559481 - DNA, 25 bp, Rattus norvegicus
cggcgaggcttttactgcccacttg

SEQ ID NO: 559482 - DNA, 25 bp, Rattus norvegicus
cacttggctttgtttttggatgtcc

SEQ ID NO: 559483 - DNA, 25 bp, Rattus norvegicus
tggatgtccagtaaaagcaaagatg

SEQ ID NO: 559484 - DNA, 25 bp, Rattus norvegicus
gatggacttagcttctcggcgggtt

SEQ ID NO: 559485 - DNA, 25 bp, Rattus norvegicus
cgtcgactgtcgctcgtatttaata

SEQ ID NO: 559486 - DNA, 25 bp, Rattus norvegicus
ggcagacgtactccataggccctga

SEQ ID NO: 559487 - DNA, 25 bp, Rattus norvegicus
gcccgcctatcaagccgagtgagcg

SEQ ID NO: 559488 - DNA, 25 bp, Rattus norvegicus
tctgtccgtcaatgcgctcggagta

SEQ ID NO: 559489 - DNA, 25 bp, Rattus norvegicus
gggcggcgtaaatgacgtcagcact

SEQ ID NO: 559490 - DNA, 25 bp, Rattus norvegicus
ggacgtgtgcctgccgatacccctg

SEQ ID NO: 559491 - DNA, 25 bp, Rattus norvegicus
tccgtcaatgcgctcggagtagcca

SEQ ID NO: 559492 - DNA, 25 bp, Rattus norvegicus
tcaatgcgctcggagtagccagcac

SEQ ID NO: 559493 - DNA, 25 bp, Rattus norvegicus
gcgctcggagtagccagcacggcca

SEQ ID NO: 559494 - DNA, 25 bp, Rattus norvegicus
ggcgtaaatgacgtcagcactgccc

SEQ ID NO: 559495 - DNA, 25 bp, Rattus norvegicus
cgcggtctcacctgtgcgggatcca

SEQ ID NO: 559496 - DNA, 25 bp, Rattus norvegicus
ggtctcacctgtgcgggatccagac

SEQ ID NO: 559497 - DNA, 25 bp, Rattus norvegicus
ctgtgcgggatccagaccctcctgc

SEQ ID NO: 559498 - DNA, 25 bp, Rattus norvegicus
tatcaagccgagtgagcgtgcgcca

SEQ ID NO: 559499 - DNA, 25 bp, Rattus norvegicus
tgagcgtgcgccagctcgccgagca

SEQ ID NO: 559500 - DNA, 25 bp, Rattus norvegicus
gagggcgctcgttccctacgttcac

SEQ ID NO: 559501 - DNA, 25 bp, Rattus norvegicus
tacctacgcttagaaacccagtctc

SEQ ID NO: 559502 - DNA, 25 bp, Rattus norvegicus
gccaagagtcactgcaggtagcgta

SEQ ID NO: 559503 - DNA, 25 bp, Rattus norvegicus
gccgccggaagctaggtagtcaagt

SEQ ID NO: 559504 - DNA, 25 bp, Rattus norvegicus
gtctctccatgacgccagacgggtg

SEQ ID NO: 559505 - DNA, 25 bp, Rattus norvegicus
aggtagtcaagtgctctcggacgga

SEQ ID NO: 559506 - DNA, 25 bp, Rattus norvegicus
ttcccgtctcggatacctacgctta

SEQ ID NO: 559507 - DNA, 25 bp, Rattus norvegicus
ttactaactgttgcccttcctagcc

SEQ ID NO: 559508 - DNA, 25 bp, Rattus norvegicus
cccttgggtcgcagtgtcaaaagcc

SEQ ID NO: 559509 - DNA, 25 bp, Rattus norvegicus
gaaacgaatttgcaaccggccagcg

SEQ ID NO: 559510 - DNA, 25 bp, Rattus norvegicus
cgcgtgcacaatcgcaggccggaaa

SEQ ID NO: 559511 - DNA, 25 bp, Rattus norvegicus
taggcctcgtccaacgcgggccgag

SEQ ID NO: 559512 - DNA, 25 bp, Rattus norvegicus
aggtagcgtagcttcctcggctagg

SEQ ID NO: 559513 - DNA, 25 bp, Rattus norvegicus
actggcaggggacgccaagagtcac

SEQ ID NO: 559514 - DNA, 25 bp, Rattus norvegicus
cgggtgcagcgatcaccctcactga

SEQ ID NO: 559515 - DNA, 25 bp, Rattus norvegicus
cgaagagctgcggtggtctattatc

SEQ ID NO: 559516 - DNA, 25 bp, Rattus norvegicus
gttcttttcatagcgcacatggatg

SEQ ID NO: 559517 - DNA, 25 bp, Rattus norvegicus
catagcgcacatggatgtggggacc

SEQ ID NO: 559518 - DNA, 25 bp, Rattus norvegicus
tgtggggaccgcgatttacatacag

SEQ ID NO: 559519 - DNA, 25 bp, Rattus norvegicus
cccgccctcggtgaactaatgcgga

SEQ ID NO: 559520 - DNA, 25 bp, Rattus norvegicus
ctaatgcggaacgaagagctgcggt

SEQ ID NO: 559521 - DNA, 25 bp, Rattus norvegicus
ggtctattatccacagcggcgaacg

SEQ ID NO: 559522 - DNA, 25 bp, Rattus norvegicus
cagcggcgaacggtcataaattatg

SEQ ID NO: 559523 - DNA, 25 bp, Rattus norvegicus
tcataaattatgaaggcactcgagc

SEQ ID NO: 559524 - DNA, 25 bp, Rattus norvegicus
aggcactcgagctctgcaggcgcaa

SEQ ID NO: 559525 - DNA, 25 bp, Rattus norvegicus
tgcaggcgcaatttgtcttgacata

SEQ ID NO: 559526 - DNA, 25 bp, Rattus norvegicus
cagggagatgcaatcagacggccgc

SEQ ID NO: 559527 - DNA, 25 bp, Rattus norvegicus
gcggggatcaagttcttttcatagc

SEQ ID NO: 559528 - DNA, 25 bp, Rattus norvegicus
ttgtcttgacataacagggagatgc

SEQ ID NO: 559529 - DNA, 25 bp, Rattus norvegicus
tctggaggacggtaagtggcaccac

SEQ ID NO: 559530 - DNA, 25 bp, Rattus norvegicus
gccaagcgcccacgtctctggagga

SEQ ID NO: 559531 - DNA, 25 bp, Rattus norvegicus
cttactggtcacagccgccttggtc

SEQ ID NO: 559532 - DNA, 25 bp, Rattus norvegicus
ggctgcctcgcacttactggtcaca

SEQ ID NO: 559533 - DNA, 25 bp, Rattus norvegicus
tgcgcagcctactggccatcggctt

SEQ ID NO: 559534 - DNA, 25 bp, Rattus norvegicus
gtcaccttcgtgtcctatgccttgc

SEQ ID NO: 559535 - DNA, 25 bp, Rattus norvegicus
tgttccgcggctacacgttgcggct

SEQ ID NO: 559536 - DNA, 25 bp, Rattus norvegicus
agcaggcggccacgctgaaagcgct

SEQ ID NO: 559537 - DNA, 25 bp, Rattus norvegicus
aaagcgctggcggtgcttagcctgc

SEQ ID NO: 559538 - DNA, 25 bp, Rattus norvegicus
gccaaggggtcgcacccagtgcact

SEQ ID NO: 559539 - DNA, 25 bp, Rattus norvegicus
agtgcactgcatccttttcctggcg

SEQ ID NO: 559540 - DNA, 25 bp, Rattus norvegicus
gctgttcgtggtcaccaatgtccga

SEQ ID NO: 559541 - DNA, 25 bp, Rattus norvegicus
ccaatgtccgatccctgcaggtgtc

SEQ ID NO: 559542 - DNA, 25 bp, Rattus norvegicus
tggcaactccttttggtcaccttcg

SEQ ID NO: 559543 - DNA, 25 bp, Rattus norvegicus
gcacccgccacgagcagcttgtccg

SEQ ID NO: 559544 - DNA, 25 bp, Rattus norvegicus
tgtgtactagaacctgccgcacccg

SEQ ID NO: 559545 - DNA, 25 bp, Rattus norvegicus
agcctgtgtactagaacctgccgca

SEQ ID NO: 559546 - DNA, 25 bp, Rattus norvegicus
gccagggagcctgtgtactagaacc

SEQ ID NO: 559547 - DNA, 25 bp, Rattus norvegicus
tcacccgtggccagggagcctgtgt

SEQ ID NO: 559548 - DNA, 25 bp, Rattus norvegicus
aggggagcctcgacctctgcatgcc

SEQ ID NO: 559549 - DNA, 25 bp, Rattus norvegicus
gccaggggagcctcgacctctgcat

SEQ ID NO: 559550 - DNA, 25 bp, Rattus norvegicus
actcagctgccgtgcgctgccaggg

SEQ ID NO: 559551 - DNA, 25 bp, Rattus norvegicus
tgcgctcagggactcagctgccgtg

SEQ ID NO: 559552 - DNA, 25 bp, Rattus norvegicus
tgtggccactgcgcgctgcgctcag

SEQ ID NO: 559553 - DNA, 25 bp, Rattus norvegicus
cttgccactgggtgctgcctgtggt

SEQ ID NO: 559554 - DNA, 25 bp, Rattus norvegicus
gacatgtgccttgccactgggtgct

SEQ ID NO: 559555 - DNA, 25 bp, Rattus norvegicus
tggctgctgcccgacatgtgccttg

SEQ ID NO: 559556 - DNA, 25 bp, Rattus norvegicus
cccgagatttctcggcctgcgggct

SEQ ID NO: 559557 - DNA, 25 bp, Rattus norvegicus
ctgcgccgcgggatggagataatcc

SEQ ID NO: 559558 - DNA, 25 bp, Rattus norvegicus
cagcacggtctgtttcgtggcggtc

SEQ ID NO: 559559 - DNA, 25 bp, Rattus norvegicus
gagataatccggagcagtgcgtgtc

SEQ ID NO: 559560 - DNA, 25 bp, Rattus norvegicus
gctgcttttgctacggaactctgcg

SEQ ID NO: 559561 - DNA, 25 bp, Rattus norvegicus
ccgccgctgcttttgctacggaact

SEQ ID NO: 559562 - DNA, 25 bp, Rattus norvegicus
tgtttcgtggcggtctcggacaccc

SEQ ID NO: 559563 - DNA, 25 bp, Rattus norvegicus
tgctacggaactctgcgcgtggacc

SEQ ID NO: 559564 - DNA, 25 bp, Rattus norvegicus
ggaagtgtccagcacggtctgtttc

SEQ ID NO: 559565 - DNA, 25 bp, Rattus norvegicus
tttccggaagtgtccagcacggtct

SEQ ID NO: 559566 - DNA, 25 bp, Rattus norvegicus
gtgtcacagcctagacgcaggcgca

SEQ ID NO: 559567 - DNA, 25 bp, Rattus norvegicus
cctgacgtgtcacagcctagacgca

SEQ ID NO: 559568 - DNA, 25 bp, Rattus norvegicus
aggcccagacctcgtgtgcttggcg

SEQ ID NO: 559569 - DNA, 25 bp, Rattus norvegicus
gagcagtgcgtgtccgccgcacagc

SEQ ID NO: 559570 - DNA, 25 bp, Rattus norvegicus
tgctaggcccagacctcgtgtgctt

SEQ ID NO: 559571 - DNA, 25 bp, Rattus norvegicus
acagcttaccaggagacggctggga

SEQ ID NO: 559572 - DNA, 25 bp, Rattus norvegicus
ccgatatatagaagccgggttggcg

SEQ ID NO: 559573 - DNA, 25 bp, Rattus norvegicus
ggcgcgcaggccgatatatagaagc

SEQ ID NO: 559574 - DNA, 25 bp, Rattus norvegicus
ctctaagctcgcatctgggcagttc

SEQ ID NO: 559575 - DNA, 25 bp, Rattus norvegicus
aagcaggtcctcagcgtccagtcac

SEQ ID NO: 559576 - DNA, 25 bp, Rattus norvegicus
gcgcgcaagtcaggcagcagccgca

SEQ ID NO: 559577 - DNA, 25 bp, Rattus norvegicus
tcgcgcagcgcgcaagtcaggcagc

SEQ ID NO: 559578 - DNA, 25 bp, Rattus norvegicus
gtgtagacgccgcacgcgtcgcctt

SEQ ID NO: 559579 - DNA, 25 bp, Rattus norvegicus
gtgccacagcgctccgtgtagacgc

SEQ ID NO: 559580 - DNA, 25 bp, Rattus norvegicus
cgccttcaggggatactgctcggcc

SEQ ID NO: 559581 - DNA, 25 bp, Rattus norvegicus
gcggccattcagcagcgccttcagg

SEQ ID NO: 559582 - DNA, 25 bp, Rattus norvegicus
cgcacgtgacaaggacagcttacca

SEQ ID NO: 559583 - DNA, 25 bp, Rattus norvegicus
cgctgcgcgtgtcttcactgggcac

SEQ ID NO: 559584 - DNA, 25 bp, Rattus norvegicus
gttggcgcagaacccgcggccattc

SEQ ID NO: 559585 - DNA, 25 bp, Rattus norvegicus
ggactctgcaaaagctcctgccgtc

SEQ ID NO: 559586 - DNA, 25 bp, Rattus norvegicus
cccgggacgtccacgtgcgtgacaa

SEQ ID NO: 559587 - DNA, 25 bp, Rattus norvegicus
cgtgcgtgacaacccgagggtgccc

SEQ ID NO: 559588 - DNA, 25 bp, Rattus norvegicus
atctgccgtactcacctggcgtgga

SEQ ID NO: 559589 - DNA, 25 bp, Rattus norvegicus
gcgtctcagccggactctgcaaaag

SEQ ID NO: 559590 - DNA, 25 bp, Rattus norvegicus
tcctgccgtcagaagtcagacgccg

SEQ ID NO: 559591 - DNA, 25 bp, Rattus norvegicus
ccagcaaggacaagtacatgacctc

SEQ ID NO: 559592 - DNA, 25 bp, Rattus norvegicus
gagaagtgggcaaagaaacgccttc

SEQ ID NO: 559593 - DNA, 25 bp, Rattus norvegicus
ccctgccgccatctgactggaatta

SEQ ID NO: 559594 - DNA, 25 bp, Rattus norvegicus
actggaattaccgacgcttggctcg

SEQ ID NO: 559595 - DNA, 25 bp, Rattus norvegicus
ggggttcggcattactaggatttca

SEQ ID NO: 559596 - DNA, 25 bp, Rattus norvegicus
ctaggatttcaaacctctaggcgcg

SEQ ID NO: 559597 - DNA, 25 bp, Rattus norvegicus
acaagtacatgacctcgtgcgccca

SEQ ID NO: 559598 - DNA, 25 bp, Rattus norvegicus
tcagacgccgggaacaaaagccagg

SEQ ID NO: 559599 - DNA, 25 bp, Rattus norvegicus
ccctccgaatgatggggaaaagcgc

SEQ ID NO: 559600 - DNA, 25 bp, Rattus norvegicus
gggaaagaggcacacaagtcacttg

SEQ ID NO: 559601 - DNA, 25 bp, Rattus norvegicus
acacaagtcacttgcctggaaaagg

SEQ ID NO: 559602 - DNA, 25 bp, Rattus norvegicus
cgggagtaaagtcctgagaagtctc

SEQ ID NO: 559603 - DNA, 25 bp, Rattus norvegicus
gtcctgagaagtctcattgcagccc

SEQ ID NO: 559604 - DNA, 25 bp, Rattus norvegicus
acagtctcagggagcaaagtcctca

SEQ ID NO: 559605 - DNA, 25 bp, Rattus norvegicus
gctgtcctcagtcctgggtcccgaa

SEQ ID NO: 559606 - DNA, 25 bp, Rattus norvegicus
cctcaactgtctctgcgctcagatt

SEQ ID NO: 559607 - DNA, 25 bp, Rattus norvegicus
cgctcagatttggtgtttgctggtc

SEQ ID NO: 559608 - DNA, 25 bp, Rattus norvegicus
gctggtctgggtcccagctccaaga

SEQ ID NO: 559609 - DNA, 25 bp, Rattus norvegicus
ctcccaaactctggaacctgagcgg

SEQ ID NO: 559610 - DNA, 25 bp, Rattus norvegicus
ccgaagcgaagctgggctccgagtt

SEQ ID NO: 559611 - DNA, 25 bp, Rattus norvegicus
ctcgaggcggctcgggcaatcgcca

SEQ ID NO: 559612 - DNA, 25 bp, Rattus norvegicus
tacctgagcgaacccgcagcgcagt

SEQ ID NO: 559613 - DNA, 25 bp, Rattus norvegicus
gactggccaccgagtcccacttgtg

SEQ ID NO: 559614 - DNA, 25 bp, Rattus norvegicus
gtgaagctgcgtcatccgattccca

SEQ ID NO: 559615 - DNA, 25 bp, Rattus norvegicus
tctgctccctgtggatctcactatc

SEQ ID NO: 559616 - DNA, 25 bp, Rattus norvegicus
ctagaccgtgacctgactgtgaagc

SEQ ID NO: 559617 - DNA, 25 bp, Rattus norvegicus
gtcccacttgtgtgcctagaccgtg

SEQ ID NO: 559618 - DNA, 25 bp, Rattus norvegicus
tctccgcgtctcagggacaaacacg

SEQ ID NO: 559619 - DNA, 25 bp, Rattus norvegicus
agcttctggggtgcgactggccacc

SEQ ID NO: 559620 - DNA, 25 bp, Rattus norvegicus
caggccctctgcagactgggaggaa

SEQ ID NO: 559621 - DNA, 25 bp, Rattus norvegicus
cttccaggccctctgcagactggga

SEQ ID NO: 559622 - DNA, 25 bp, Rattus norvegicus
tgcgcgttggtacttccgtttccac

SEQ ID NO: 559623 - DNA, 25 bp, Rattus norvegicus
ttacgcatgcgcgttggtacttccg

SEQ ID NO: 559624 - DNA, 25 bp, Rattus norvegicus
cacgtgtggattgttacgcatgcgc

SEQ ID NO: 559625 - DNA, 25 bp, Rattus norvegicus
tctcagggacaaacacgtgtggatt

SEQ ID NO: 559626 - DNA, 25 bp, Rattus norvegicus
acctgactgtgaagctgcgtcatcc

SEQ ID NO: 559627 - DNA, 25 bp, Rattus norvegicus
acggacgcgcgcacagtggttccgc

SEQ ID NO: 559628 - DNA, 25 bp, Rattus norvegicus
cgaagccctgccagctcacgtgtaa

SEQ ID NO: 559629 - DNA, 25 bp, Rattus norvegicus
tgccagctcacgtgtaaagtgattc

SEQ ID NO: 559630 - DNA, 25 bp, Rattus norvegicus
cgtgtaaagtgattcagacaagcca

SEQ ID NO: 559631 - DNA, 25 bp, Rattus norvegicus
ttcagacaagccagatccacgatct

SEQ ID NO: 559632 - DNA, 25 bp, Rattus norvegicus
gatccacgatcttggcacgaaactt

SEQ ID NO: 559633 - DNA, 25 bp, Rattus norvegicus
cgatcttggcacgaaacttcatggc

SEQ ID NO: 559634 - DNA, 25 bp, Rattus norvegicus
gcacgaaacttcatggcggatacca

SEQ ID NO: 559635 - DNA, 25 bp, Rattus norvegicus
gcggcgtcagtccaaggcgtaccaa

SEQ ID NO: 559636 - DNA, 25 bp, Rattus norvegicus
gagaggtccgcccactgcctgccct

SEQ ID NO: 559637 - DNA, 25 bp, Rattus norvegicus
tgcctgccctggattaagttaggcg

SEQ ID NO: 559638 - DNA, 25 bp, Rattus norvegicus
tggattaagttaggcgcgctcgctc

SEQ ID NO: 559639 - DNA, 25 bp, Rattus norvegicus
aagttaggcgcgctcgctcgtccac

SEQ ID NO: 559640 - DNA, 25 bp, Rattus norvegicus
aacttcatggcggataccaggccga

SEQ ID NO: 559641 - DNA, 25 bp, Rattus norvegicus
gttgatagacgtctgcaccctgctc

SEQ ID NO: 559642 - DNA, 25 bp, Rattus norvegicus
tgtgtttccgcgtctctctgagagt

SEQ ID NO: 559643 - DNA, 25 bp, Rattus norvegicus
gtggagccagttctcttgctacgaa

SEQ ID NO: 559644 - DNA, 25 bp, Rattus norvegicus
ctacaggggctgtaaatcccagatc

SEQ ID NO: 559645 - DNA, 25 bp, Rattus norvegicus
ccagatctggagaaccgggagctca

SEQ ID NO: 559646 - DNA, 25 bp, Rattus norvegicus
gagctcacagtgacctcagtgcctg

SEQ ID NO: 559647 - DNA, 25 bp, Rattus norvegicus
gcggcccgtgatgacttatagtaca

SEQ ID NO: 559648 - DNA, 25 bp, Rattus norvegicus
atagtcctgctgtctacgctgcgtg

SEQ ID NO: 559649 - DNA, 25 bp, Rattus norvegicus
cgtgcacgtgcccttgctgtttacc

SEQ ID NO: 559650 - DNA, 25 bp, Rattus norvegicus
atactcactgaatgcgctctggctg

SEQ ID NO: 559651 - DNA, 25 bp, Rattus norvegicus
ctctggctgtatattctggcgcatg

SEQ ID NO: 559652 - DNA, 25 bp, Rattus norvegicus
ctcctgggtgttcagcgtggacacc

SEQ ID NO: 559653 - DNA, 25 bp, Rattus norvegicus
tagcagcacctttctcttccggacg

SEQ ID NO: 559654 - DNA, 25 bp, Rattus norvegicus
gcggctcccagagaaccagggctta

SEQ ID NO: 559655 - DNA, 25 bp, Rattus norvegicus
ggcgccaggccctagctgctatcag

SEQ ID NO: 559656 - DNA, 25 bp, Rattus norvegicus
tgagtggtctgctttgagggctcct

SEQ ID NO: 559657 - DNA, 25 bp, Rattus norvegicus
ctctgctagttgtgcgccggtgacc

SEQ ID NO: 559658 - DNA, 25 bp, Rattus norvegicus
tttgagggctcctctctggttcttc

SEQ ID NO: 559659 - DNA, 25 bp, Rattus norvegicus
ctggttcttcctgcctataggtggg

SEQ ID NO: 559660 - DNA, 25 bp, Rattus norvegicus
ctgcctataggtggggactgaagct

SEQ ID NO: 559661 - DNA, 25 bp, Rattus norvegicus
actgaagctcgggtccactgcggtg

SEQ ID NO: 559662 - DNA, 25 bp, Rattus norvegicus
cactgcggtgatcgctacaaagacc

SEQ ID NO: 559663 - DNA, 25 bp, Rattus norvegicus
cggagcgtaaaacagtaggagcatc

SEQ ID NO: 559664 - DNA, 25 bp, Rattus norvegicus
atcccgctccggatgctctgctagt

SEQ ID NO: 559665 - DNA, 25 bp, Rattus norvegicus
tctctcagcagatgaaggtgcaggc

SEQ ID NO: 559666 - DNA, 25 bp, Rattus norvegicus
gccggtgacctctctcagcagatga

SEQ ID NO: 559667 - DNA, 25 bp, Rattus norvegicus
tgctatcagctgagcccttcggccg

SEQ ID NO: 559668 - DNA, 25 bp, Rattus norvegicus
tttaaaaggtctggcgcgcagcttc

SEQ ID NO: 559669 - DNA, 25 bp, Rattus norvegicus
cgcccgcaacaaggcggagagcacg

SEQ ID NO: 559670 - DNA, 25 bp, Rattus norvegicus
gccacttccgctcgggtgatctgcg

SEQ ID NO: 559671 - DNA, 25 bp, Rattus norvegicus
gaccgacggacacgccgccacttcc

SEQ ID NO: 559672 - DNA, 25 bp, Rattus norvegicus
aaggtcgttacctggcgcgcgccca

SEQ ID NO: 559673 - DNA, 25 bp, Rattus norvegicus
cctcggcgcagaaggtcgttacctg

SEQ ID NO: 559674 - DNA, 25 bp, Rattus norvegicus
gcctccatccacacgccgccgacgg

SEQ ID NO: 559675 - DNA, 25 bp, Rattus norvegicus
cggggccaaggcctccatccacacg

SEQ ID NO: 559676 - DNA, 25 bp, Rattus norvegicus
acagcgccgagagcacggagcccga

SEQ ID NO: 559677 - DNA, 25 bp, Rattus norvegicus
ccatgcggcgccgagcctcacctgc

SEQ ID NO: 559678 - DNA, 25 bp, Rattus norvegicus
ttctcgtgaggagccgcggcagcca

SEQ ID NO: 559679 - DNA, 25 bp, Rattus norvegicus
cgcaattctcgtgaggagccgcggc

SEQ ID NO: 559680 - DNA, 25 bp, Rattus norvegicus
gggaccaacgcaattctcgtgagga

SEQ ID NO: 559681 - DNA, 25 bp, Rattus norvegicus
tgacacgggaccaacgcaattctcg

SEQ ID NO: 559682 - DNA, 25 bp, Rattus norvegicus
agtcacgtgacacgggaccaacgca

SEQ ID NO: 559683 - DNA, 25 bp, Rattus norvegicus
gcaaactttgtatgcgcggcccggc

SEQ ID NO: 559684 - DNA, 25 bp, Rattus norvegicus
tgagccggaccagcccgcgggcaaa

SEQ ID NO: 559685 - DNA, 25 bp, Rattus norvegicus
atcccgggacgctagaccgcggcag

SEQ ID NO: 559686 - DNA, 25 bp, Rattus norvegicus
cgagtgagcctgtgtcacgaccgcc

SEQ ID NO: 559687 - DNA, 25 bp, Rattus norvegicus
cccgtgcggctgcaaactttgtatg

SEQ ID NO: 559688 - DNA, 25 bp, Rattus norvegicus
acgggacggtgtctccctgtgcccg

SEQ ID NO: 559689 - DNA, 25 bp, Rattus norvegicus
cagcccaaagtttgctcggtgcggg

SEQ ID NO: 559690 - DNA, 25 bp, Rattus norvegicus
aaatggggaacaatgcgagtgagca

SEQ ID NO: 559691 - DNA, 25 bp, Rattus norvegicus
actctaacaagtgcctgtgcggccg

SEQ ID NO: 559692 - DNA, 25 bp, Rattus norvegicus
ggcggatcgcgtgcgccagcccaaa

SEQ ID NO: 559693 - DNA, 25 bp, Rattus norvegicus
tgaggaagtcattgtgaaagaaagc

SEQ ID NO: 559694 - DNA, 25 bp, Rattus norvegicus
aagctgggaattgctccgcggccaa

SEQ ID NO: 559695 - DNA, 25 bp, Rattus norvegicus
cggccaacttagcagggcactctaa

SEQ ID NO: 559696 - DNA, 25 bp, Rattus norvegicus
tgcgagtgagcaacttgaggaagtc

SEQ ID NO: 559697 - DNA, 25 bp, Rattus norvegicus
tcagcacgagtggtgagcagctgaa

SEQ ID NO: 559698 - DNA, 25 bp, Rattus norvegicus
cttccgtgtggtcagcacgagtggt

SEQ ID NO: 559699 - DNA, 25 bp, Rattus norvegicus
gacgccttccgtgtggtcagcacga

SEQ ID NO: 559700 - DNA, 25 bp, Rattus norvegicus
agaactcgcaggacgccttccgtgt

SEQ ID NO: 559701 - DNA, 25 bp, Rattus norvegicus
cctcagagaactcgcaggacgcctt

SEQ ID NO: 559702 - DNA, 25 bp, Rattus norvegicus
tgagggcagcctcagagaactcgca

SEQ ID NO: 559703 - DNA, 25 bp, Rattus norvegicus
agcgcagcggtctcatctacctaac

SEQ ID NO: 559704 - DNA, 25 bp, Rattus norvegicus
aaccaaccacatcactccgcatgcg

SEQ ID NO: 559705 - DNA, 25 bp, Rattus norvegicus
gcagcggtctcatctacctaaccaa

SEQ ID NO: 559706 - DNA, 25 bp, Rattus norvegicus
cagctgaaggtgtacaagtgcgaac

SEQ ID NO: 559707 - DNA, 25 bp, Rattus norvegicus
ctctcaaggaggagcagcgcgccta

SEQ ID NO: 559708 - DNA, 25 bp, Rattus norvegicus
cgcgcaacgggctggctctcaagga

SEQ ID NO: 559709 - DNA, 25 bp, Rattus norvegicus
tccgcatgcgcgcaacgggctggct

SEQ ID NO: 559710 - DNA, 25 bp, Rattus norvegicus
gtgtacaagtgcgaacactgccgcg

SEQ ID NO: 559711 - DNA, 25 bp, Rattus norvegicus
gaggtgtagtttccagcccaggcat

SEQ ID NO: 559712 - DNA, 25 bp, Rattus norvegicus
ggcttggataagagaggccaactcc

SEQ ID NO: 559713 - DNA, 25 bp, Rattus norvegicus
cgcaccttctgacctaaactctagg

SEQ ID NO: 559714 - DNA, 25 bp, Rattus norvegicus
ggaactttagctccaggcttgcgtc

SEQ ID NO: 559715 - DNA, 25 bp, Rattus norvegicus
agcccaggcatgaactcggggttgc

SEQ ID NO: 559716 - DNA, 25 bp, Rattus norvegicus
cacgttgagcaagtgatggacccgc

SEQ ID NO: 559717 - DNA, 25 bp, Rattus norvegicus
ttgtagttccgcgtgcacgttgagc

SEQ ID NO: 559718 - DNA, 25 bp, Rattus norvegicus
cggatagtgactcgcagtcggagcc

SEQ ID NO: 559719 - DNA, 25 bp, Rattus norvegicus
actatctgagttgagctctctggga

SEQ ID NO: 559720 - DNA, 25 bp, Rattus norvegicus
ggcgaggctttgcagactatctgag

SEQ ID NO: 559721 - DNA, 25 bp, Rattus norvegicus
ctgccggaagcgcaacctgtacttc

SEQ ID NO: 559722 - DNA, 25 bp, Rattus norvegicus
tcctgcacccaggaaagggcgcaca

SEQ ID NO: 559723 - DNA, 25 bp, Rattus norvegicus
cccagaagtcagagcctccaggact

SEQ ID NO: 559724 - DNA, 25 bp, Rattus norvegicus
gccgcctacaaacgcttgagtctca

SEQ ID NO: 559725 - DNA, 25 bp, Rattus norvegicus
taagcaatccctaggcgtccggttc

SEQ ID NO: 559726 - DNA, 25 bp, Rattus norvegicus
ctcaaaatgcgtacgtttaggtggc

SEQ ID NO: 559727 - DNA, 25 bp, Rattus norvegicus
ttcccaacactcctagcgggaggta

SEQ ID NO: 559728 - DNA, 25 bp, Rattus norvegicus
taagctgcggctgaccgaccgtcac

SEQ ID NO: 559729 - DNA, 25 bp, Rattus norvegicus
tcggacaacccgagtctaagaactg

SEQ ID NO: 559730 - DNA, 25 bp, Rattus norvegicus
cccgccggcctagcggagaaaagca

SEQ ID NO: 559731 - DNA, 25 bp, Rattus norvegicus
gggacagcagccaccgaaaagcgcg

SEQ ID NO: 559732 - DNA, 25 bp, Rattus norvegicus
gaaaagcgcgcccttccaagtgcgc

SEQ ID NO: 559733 - DNA, 25 bp, Rattus norvegicus
ttgcgcacgcgcgtatgagagtaag

SEQ ID NO: 559734 - DNA, 25 bp, Rattus norvegicus
cgcgctgtggcgatagttttaccta

SEQ ID NO: 559735 - DNA, 25 bp, Rattus norvegicus
cgtccggttcacttcaggcataatc

SEQ ID NO: 559736 - DNA, 25 bp, Rattus norvegicus
aggcataatctgtcctttctgccga

SEQ ID NO: 559737 - DNA, 25 bp, Rattus norvegicus
ctgccgaattaggtgctgtgaaata

SEQ ID NO: 559738 - DNA, 25 bp, Rattus norvegicus
cgcgctctgagggagatgcatcccg

SEQ ID NO: 559739 - DNA, 25 bp, Rattus norvegicus
cggacagctcctgaacccgtcagta

SEQ ID NO: 559740 - DNA, 25 bp, Rattus norvegicus
gagctgctcaccacttggacctttg

SEQ ID NO: 559741 - DNA, 25 bp, Rattus norvegicus
acgcgctgacatacgtgttacatgc

SEQ ID NO: 559742 - DNA, 25 bp, Rattus norvegicus
tgacaggcggcaacatgcgatgaca

SEQ ID NO: 559743 - DNA, 25 bp, Rattus norvegicus
tgacacgcagtaacacgggccgaca

SEQ ID NO: 559744 - DNA, 25 bp, Rattus norvegicus
tgcagattttgggaggcaaaccctt

SEQ ID NO: 559745 - DNA, 25 bp, Rattus norvegicus
ctttccaaacgaccaccgtgacttg

SEQ ID NO: 559746 - DNA, 25 bp, Rattus norvegicus
tagcacagacttcgccacacggggt

SEQ ID NO: 559747 - DNA, 25 bp, Rattus norvegicus
tgttacatgcgccaacacaggccga

SEQ ID NO: 559748 - DNA, 25 bp, Rattus norvegicus
agctaagggcctacggctccgaaga

SEQ ID NO: 559749 - DNA, 25 bp, Rattus norvegicus
tggcacgcgccaacaaaccggcatg

SEQ ID NO: 559750 - DNA, 25 bp, Rattus norvegicus
aacacgagtcggcatgcgccacaca

SEQ ID NO: 559751 - DNA, 25 bp, Rattus norvegicus
ccgacacggcgaactaggtcctaag

SEQ ID NO: 559752 - DNA, 25 bp, Rattus norvegicus
cgtgacttgagcacgtctcctctta

SEQ ID NO: 559753 - DNA, 25 bp, Rattus norvegicus
tgtgcccaagccactctttgctgcg

SEQ ID NO: 559754 - DNA, 25 bp, Rattus norvegicus
cccagagagttaaaggcatcatcgc

SEQ ID NO: 559755 - DNA, 25 bp, Rattus norvegicus
agtggcagcatgcatgcagtatcgc

SEQ ID NO: 559756 - DNA, 25 bp, Rattus norvegicus
agctgccaggtagcggaagcagcca

SEQ ID NO: 559757 - DNA, 25 bp, Rattus norvegicus
cagtatcgcgccctgggctctgaga

SEQ ID NO: 559758 - DNA, 25 bp, Rattus norvegicus
ggcagccctggtctgcgcctgaagc

SEQ ID NO: 559759 - DNA, 25 bp, Rattus norvegicus
agcacgcaagccgagcgactgacgt

SEQ ID NO: 559760 - DNA, 25 bp, Rattus norvegicus
cattagaggcaaagttgggcgccgc

SEQ ID NO: 559761 - DNA, 25 bp, Rattus norvegicus
cagccgccggaggagacacttcacg

SEQ ID NO: 559762 - DNA, 25 bp, Rattus norvegicus
ggcatcatcgcagccattagaggca

SEQ ID NO: 559763 - DNA, 25 bp, Rattus norvegicus
acacttcacggcgtggcagccctgg

SEQ ID NO: 559764 - DNA, 25 bp, Rattus norvegicus
ccactctttgctgcgagtggcagca

SEQ ID NO: 559765 - DNA, 25 bp, Rattus norvegicus
tcccggcgcccagagagttaaaggc

SEQ ID NO: 559766 - DNA, 25 bp, Rattus norvegicus
tgaagcctccggatcgcagccagct

SEQ ID NO: 559767 - DNA, 25 bp, Rattus norvegicus
gctatcctggcctcggaactgagtg

SEQ ID NO: 559768 - DNA, 25 bp, Rattus norvegicus
ggtgccacggagaccttagagattc

SEQ ID NO: 559769 - DNA, 25 bp, Rattus norvegicus
cttagagattcttggggagagccga

SEQ ID NO: 559770 - DNA, 25 bp, Rattus norvegicus
gacagggaaattcagggattgatcc

SEQ ID NO: 559771 - DNA, 25 bp, Rattus norvegicus
ctgcttgagatctggcgtggagaca

SEQ ID NO: 559772 - DNA, 25 bp, Rattus norvegicus
gttgctcttccgtttcttaaattgc

SEQ ID NO: 559773 - DNA, 25 bp, Rattus norvegicus
ggcctccgttatgctcggtgagcac

SEQ ID NO: 559774 - DNA, 25 bp, Rattus norvegicus
tcggtgagcacggtaaccgcgacga

SEQ ID NO: 559775 - DNA, 25 bp, Rattus norvegicus
ttgctttgtctgaagcgttccaaga

SEQ ID NO: 559776 - DNA, 25 bp, Rattus norvegicus
aaggcggggatctcttctagctgtt

SEQ ID NO: 559777 - DNA, 25 bp, Rattus norvegicus
taaccgcgacgaccgtgggaatgct

SEQ ID NO: 559778 - DNA, 25 bp, Rattus norvegicus
ggaactctccaaggcgtcgctaaga

SEQ ID NO: 559779 - DNA, 25 bp, Rattus norvegicus
tcgctaagacagagggtgccacgga

SEQ ID NO: 559780 - DNA, 25 bp, Rattus norvegicus
agcgagggagtccagcggctatcct

SEQ ID NO: 559781 - DNA, 25 bp, Rattus norvegicus
tgcggctgcacacggctggagttca

SEQ ID NO: 559782 - DNA, 25 bp, Rattus norvegicus
aaagcccgggttgtcgcggctccat

SEQ ID NO: 559783 - DNA, 25 bp, Rattus norvegicus
catgcctgcctggagcaggacgaca

SEQ ID NO: 559784 - DNA, 25 bp, Rattus norvegicus
gatgcgctccatctcaatctccagg

SEQ ID NO: 559785 - DNA, 25 bp, Rattus norvegicus
cctcggagaacaggggttcgagcct

SEQ ID NO: 559786 - DNA, 25 bp, Rattus norvegicus
gaggtggaaccgcagactgccgccc

SEQ ID NO: 559787 - DNA, 25 bp, Rattus norvegicus
gcgggtcccgatcttacctcgcagt

SEQ ID NO: 559788 - DNA, 25 bp, Rattus norvegicus
ccgccgagctcacggccgaagagga

SEQ ID NO: 559789 - DNA, 25 bp, Rattus norvegicus
agcacgcacctgatgctgcgggtcc

SEQ ID NO: 559790 - DNA, 25 bp, Rattus norvegicus
ctggagttcaccatagcgctcactg

SEQ ID NO: 559791 - DNA, 25 bp, Rattus norvegicus
ggttcgagcctgcaagcaagcagtt

SEQ ID NO: 559792 - DNA, 25 bp, Rattus norvegicus
gtcgtcatcctcttcggcctcaaag

SEQ ID NO: 559793 - DNA, 25 bp, Rattus norvegicus
ccgcaggagccatgttcttttcttc

SEQ ID NO: 559794 - DNA, 25 bp, Rattus norvegicus
agcaagcagttgttaagcacgcacc

SEQ ID NO: 559795 - DNA, 25 bp, Rattus norvegicus
tggaccttagaccagctctccctta

SEQ ID NO: 559796 - DNA, 25 bp, Rattus norvegicus
tctactgtagagctggcggactgtt

SEQ ID NO: 559797 - DNA, 25 bp, Rattus norvegicus
agctggcggactgttctccaccttc

SEQ ID NO: 559798 - DNA, 25 bp, Rattus norvegicus
gctgacctaagcgactcggctctct

SEQ ID NO: 559799 - DNA, 25 bp, Rattus norvegicus
gcttccggaagagaggctgacctaa

SEQ ID NO: 559800 - DNA, 25 bp, Rattus norvegicus
gtgtgtttctctgggcttccggaag

SEQ ID NO: 559801 - DNA, 25 bp, Rattus norvegicus
ctcttcgcgcagaggcgtcattgcg

SEQ ID NO: 559802 - DNA, 25 bp, Rattus norvegicus
cctttcaattggctcttcgcgcaga

SEQ ID NO: 559803 - DNA, 25 bp, Rattus norvegicus
aagccggttagtcagagcccgccca

SEQ ID NO: 559804 - DNA, 25 bp, Rattus norvegicus
gagaattgagcccaacggaaccgga

SEQ ID NO: 559805 - DNA, 25 bp, Rattus norvegicus
cacgtagcctaggagagaattgagc

SEQ ID NO: 559806 - DNA, 25 bp, Rattus norvegicus
tttgagagggcagagacacgtagcc

SEQ ID NO: 559807 - DNA, 25 bp, Rattus norvegicus
cttacttacgggatggcggtttgag

SEQ ID NO: 559808 - DNA, 25 bp, Rattus norvegicus
aagcgactcggctctctactgtaga

SEQ ID NO: 559809 - DNA, 25 bp, Rattus norvegicus
acgaccgtgggactcagtctgactc

SEQ ID NO: 559810 - DNA, 25 bp, Rattus norvegicus
tggagtaagaaccaacgcgcctctg

SEQ ID NO: 559811 - DNA, 25 bp, Rattus norvegicus
atccgcaagtgggaccggcatgtcc

SEQ ID NO: 559812 - DNA, 25 bp, Rattus norvegicus
cacgtgcgcccagtactgtcaggga

SEQ ID NO: 559813 - DNA, 25 bp, Rattus norvegicus
ctcagtaggcgtttggagtagaaac

SEQ ID NO: 559814 - DNA, 25 bp, Rattus norvegicus
agttgcctcacttttctgcgctcag

SEQ ID NO: 559815 - DNA, 25 bp, Rattus norvegicus
gctctcggctgctgccaacttagtt

SEQ ID NO: 559816 - DNA, 25 bp, Rattus norvegicus
gaccttaggaggaactggacattta

SEQ ID NO: 559817 - DNA, 25 bp, Rattus norvegicus
tgcgagaaccaagctactgctgctg

SEQ ID NO: 559818 - DNA, 25 bp, Rattus norvegicus
cgaccctcagggactgcgagaacca

SEQ ID NO: 559819 - DNA, 25 bp, Rattus norvegicus
gagagccagagccaacgactgccga

SEQ ID NO: 559820 - DNA, 25 bp, Rattus norvegicus
tgactcggattaatcccggagagcc

SEQ ID NO: 559821 - DNA, 25 bp, Rattus norvegicus
ggacctcagagacgcgcggtttcct

SEQ ID NO: 559822 - DNA, 25 bp, Rattus norvegicus
ggaggctaccgccaccaagacaggc

SEQ ID NO: 559823 - DNA, 25 bp, Rattus norvegicus
tgtacagaggcgaccgctcctagct

SEQ ID NO: 559824 - DNA, 25 bp, Rattus norvegicus
tgtggcctgcatccatcggctctct

SEQ ID NO: 559825 - DNA, 25 bp, Rattus norvegicus
gctcctagctgtggcctgcatccat

SEQ ID NO: 559826 - DNA, 25 bp, Rattus norvegicus
aaatctggggtgtacagaggcgacc

SEQ ID NO: 559827 - DNA, 25 bp, Rattus norvegicus
ctgctgcctccgtgctgtctctggt

SEQ ID NO: 559828 - DNA, 25 bp, Rattus norvegicus
cgcctgctgcttctcaaaatctggg

SEQ ID NO: 559829 - DNA, 25 bp, Rattus norvegicus
ctctggtgcccgctccttgtctgag

SEQ ID NO: 559830 - DNA, 25 bp, Rattus norvegicus
tctcttcctccctgcttgtccctgc

SEQ ID NO: 559831 - DNA, 25 bp, Rattus norvegicus
ccgctccttgtctgagtgtggtgga

SEQ ID NO: 559832 - DNA, 25 bp, Rattus norvegicus
ctctgccagctatgggggatctacc

SEQ ID NO: 559833 - DNA, 25 bp, Rattus norvegicus
gatctaccggggatcgtgcgccttt

SEQ ID NO: 559834 - DNA, 25 bp, Rattus norvegicus
gatcgtgcgcctttccatcgcgctg

SEQ ID NO: 559835 - DNA, 25 bp, Rattus norvegicus
ctgtccacgactccggtcacggttg

SEQ ID NO: 559836 - DNA, 25 bp, Rattus norvegicus
gctgcttctcaaaatctggggtgta

SEQ ID NO: 559837 - DNA, 25 bp, Rattus norvegicus
gctcccgggcctctgaaagctgcaa

SEQ ID NO: 559838 - DNA, 25 bp, Rattus norvegicus
gagcgtgaggctgcaaccctctcct

SEQ ID NO: 559839 - DNA, 25 bp, Rattus norvegicus
aatccggttggagaacgtctgcacg

SEQ ID NO: 559840 - DNA, 25 bp, Rattus norvegicus
cccggcgcacggtacgcaaaaagcg

SEQ ID NO: 559841 - DNA, 25 bp, Rattus norvegicus
tcacatgacaggaagcgcggctccc

SEQ ID NO: 559842 - DNA, 25 bp, Rattus norvegicus
ggccttccttcggtcacatgacagg

SEQ ID NO: 559843 - DNA, 25 bp, Rattus norvegicus
cgggtttcaagtcctcggacacttg

SEQ ID NO: 559844 - DNA, 25 bp, Rattus norvegicus
ccgcctagcaagatggtgagacctc

SEQ ID NO: 559845 - DNA, 25 bp, Rattus norvegicus
ttgcaaacgccggacggctcggtgt

SEQ ID NO: 559846 - DNA, 25 bp, Rattus norvegicus
atgggcctctgcacggcctgagact

SEQ ID NO: 559847 - DNA, 25 bp, Rattus norvegicus
ttcttaagtccgtgggcctccacgc

SEQ ID NO: 559848 - DNA, 25 bp, Rattus norvegicus
tagctcggcctttgccgaacccttg

SEQ ID NO: 559849 - DNA, 25 bp, Rattus norvegicus
gcgtcctcctgggtagaaaattcca

SEQ ID NO: 559850 - DNA, 25 bp, Rattus norvegicus
gccctgtttcgtgccttgaggttgc

SEQ ID NO: 559851 - DNA, 25 bp, Rattus norvegicus
ccctctgtgcgtgacgggagtaaag

SEQ ID NO: 559852 - DNA, 25 bp, Rattus norvegicus
gctgccctagaatatgcctgtttgc

SEQ ID NO: 559853 - DNA, 25 bp, Rattus norvegicus
gccagcctccaccaatcaatttgaa

SEQ ID NO: 559854 - DNA, 25 bp, Rattus norvegicus
actggaacacgtgcgaggttgtgcc

SEQ ID NO: 559855 - DNA, 25 bp, Rattus norvegicus
ccggataagtgcaaccactggaaca

SEQ ID NO: 559856 - DNA, 25 bp, Rattus norvegicus
cggccatgttcaacccggataagtg

SEQ ID NO: 559857 - DNA, 25 bp, Rattus norvegicus
gaatagaccctttcgtctgcctggg

SEQ ID NO: 559858 - DNA, 25 bp, Rattus norvegicus
ccgtcccggtgttttgcgtctccat

SEQ ID NO: 559859 - DNA, 25 bp, Rattus norvegicus
gattgctcagcctgtcgcttcttcg

SEQ ID NO: 559860 - DNA, 25 bp, Rattus norvegicus
tgtcccgccgctgacgattgctcag

SEQ ID NO: 559861 - DNA, 25 bp, Rattus norvegicus
gtgtccatgcgtccagcgtctccat

SEQ ID NO: 559862 - DNA, 25 bp, Rattus norvegicus
accaggagctgatctcccgagagcg

SEQ ID NO: 559863 - DNA, 25 bp, Rattus norvegicus
ttgctaatgtctccgtgccgtctcg

SEQ ID NO: 559864 - DNA, 25 bp, Rattus norvegicus
tgcgtctccatctcggccatgttca

SEQ ID NO: 559865 - DNA, 25 bp, Rattus norvegicus
tcgccctctacgttgacgccgttga

SEQ ID NO: 559866 - DNA, 25 bp, Rattus norvegicus
tcacaccacccgcaggctggagcgc

SEQ ID NO: 559867 - DNA, 25 bp, Rattus norvegicus
cgcgactggccacggctcacaccac

SEQ ID NO: 559868 - DNA, 25 bp, Rattus norvegicus
accaggcgacacaagcggggccgca

SEQ ID NO: 559869 - DNA, 25 bp, Rattus norvegicus
ggcctttctcgccatgcaggtggaa

SEQ ID NO: 559870 - DNA, 25 bp, Rattus norvegicus
cggcggcctttctcgccatgcaggt

SEQ ID NO: 559871 - DNA, 25 bp, Rattus norvegicus
acgcgccggatgaactggccacggc

SEQ ID NO: 559872 - DNA, 25 bp, Rattus norvegicus
ttgacgccgttgacctcaaccaggc

SEQ ID NO: 559873 - DNA, 25 bp, Rattus norvegicus
ggtgatgcgtctcgccctctacgtt

SEQ ID NO: 559874 - DNA, 25 bp, Rattus norvegicus
gcagggacccacctggtgatgcgtc

SEQ ID NO: 559875 - DNA, 25 bp, Rattus norvegicus
gcatcttggccagcgcagtagggat

SEQ ID NO: 559876 - DNA, 25 bp, Rattus norvegicus
cgaaggcatcttggccagcgcagta

SEQ ID NO: 559877 - DNA, 25 bp, Rattus norvegicus
ggtcccacgatagggcacgccgaag

SEQ ID NO: 559878 - DNA, 25 bp, Rattus norvegicus
agcctggctccacgcgccggatgaa

SEQ ID NO: 559879 - DNA, 25 bp, Rattus norvegicus
gcgtagtcaccagagcctgtcaatg

SEQ ID NO: 559880 - DNA, 25 bp, Rattus norvegicus
acgtccatactgtggccgactggga

SEQ ID NO: 559881 - DNA, 25 bp, Rattus norvegicus
cccgggatcacgtccatactgtggc

SEQ ID NO: 559882 - DNA, 25 bp, Rattus norvegicus
gtcctgctcctgtcacagtctcttt

SEQ ID NO: 559883 - DNA, 25 bp, Rattus norvegicus
tgaggtattgtgctgaaccgagttc

SEQ ID NO: 559884 - DNA, 25 bp, Rattus norvegicus
caggcgtccacggtattgaggtatt

SEQ ID NO: 559885 - DNA, 25 bp, Rattus norvegicus
cgcgacctcttttccggagacaggc

SEQ ID NO: 559886 - DNA, 25 bp, Rattus norvegicus
tggcgtcatcattgcgcgacctctt

SEQ ID NO: 559887 - DNA, 25 bp, Rattus norvegicus
aaaaaaccgtgtcatggcgtcatca

SEQ ID NO: 559888 - DNA, 25 bp, Rattus norvegicus
caagaccgggaacgacgcatgcgcg

SEQ ID NO: 559889 - DNA, 25 bp, Rattus norvegicus
agtacgcacgcgcaagaccgggaac

SEQ ID NO: 559890 - DNA, 25 bp, Rattus norvegicus
gggcttctcgctgcaagcgtagtca

SEQ ID NO: 559891 - DNA, 25 bp, Rattus norvegicus
gtggcttttagctccgggatgattg

SEQ ID NO: 559892 - DNA, 25 bp, Rattus norvegicus
gccacggaacgcgatcgcacgagta

SEQ ID NO: 559893 - DNA, 25 bp, Rattus norvegicus
tcattcccgtggcaccgtccttcag

SEQ ID NO: 559894 - DNA, 25 bp, Rattus norvegicus
accgatcaccgccatctttgcaagt

SEQ ID NO: 559895 - DNA, 25 bp, Rattus norvegicus
cgggacaaccgctccgctaagaggc

SEQ ID NO: 559896 - DNA, 25 bp, Rattus norvegicus
atcttgctacggaggagcgggacaa

SEQ ID NO: 559897 - DNA, 25 bp, Rattus norvegicus
attcacatcttgctacggaggagcg

SEQ ID NO: 559898 - DNA, 25 bp, Rattus norvegicus
gtccttcagccgcattcacatcttg

SEQ ID NO: 559899 - DNA, 25 bp, Rattus norvegicus
ttccttcgccgactcattcccgtgg

SEQ ID NO: 559900 - DNA, 25 bp, Rattus norvegicus
agggctgtccgcatgcttccttcgc

SEQ ID NO: 559901 - DNA, 25 bp, Rattus norvegicus
tccgcacagggctgtccgcatgctt

SEQ ID NO: 559902 - DNA, 25 bp, Rattus norvegicus
agcagttctcggcacccgccctgcg

SEQ ID NO: 559903 - DNA, 25 bp, Rattus norvegicus
ttccgctgccgagcagcagttctcg

SEQ ID NO: 559904 - DNA, 25 bp, Rattus norvegicus
cacagttccgctgccgagcagcagt

SEQ ID NO: 559905 - DNA, 25 bp, Rattus norvegicus
ccgccgttgcgaccgcagcgcagac

SEQ ID NO: 559906 - DNA, 25 bp, Rattus norvegicus
agccgcattcacatcttgctacgga

SEQ ID NO: 559907 - DNA, 25 bp, Rattus norvegicus
aggcgacggcgctcacctttcaggc

SEQ ID NO: 559908 - DNA, 25 bp, Rattus norvegicus
ctagaataaatcctgcaggcctccc

SEQ ID NO: 559909 - DNA, 25 bp, Rattus norvegicus
aagcaagacggatcttccaggaggg

SEQ ID NO: 559910 - DNA, 25 bp, Rattus norvegicus
gcggtggaaagcaagacggatcttc

SEQ ID NO: 559911 - DNA, 25 bp, Rattus norvegicus
catgtcatgcttataatgcggtgga

SEQ ID NO: 559912 - DNA, 25 bp, Rattus norvegicus
ggcgtttatttatttgcatgtcatg

SEQ ID NO: 559913 - DNA, 25 bp, Rattus norvegicus
ccacgcaaagccggcggcgtttatt

SEQ ID NO: 559914 - DNA, 25 bp, Rattus norvegicus
cctccttcgtctagaataaatcctg

SEQ ID NO: 559915 - DNA, 25 bp, Rattus norvegicus
tccgtgtatgttcctccttcgtcta

SEQ ID NO: 559916 - DNA, 25 bp, Rattus norvegicus
cctgcggaaattcatattccgtgta

SEQ ID NO: 559917 - DNA, 25 bp, Rattus norvegicus
tccgaagctcctgcggaaattcata

SEQ ID NO: 559918 - DNA, 25 bp, Rattus norvegicus
ggaatcactccgaagctcctgcgga

SEQ ID NO: 559919 - DNA, 25 bp, Rattus norvegicus
ggcggaaagcaaccgagaaggaatc

SEQ ID NO: 559920 - DNA, 25 bp, Rattus norvegicus
cgagaaggaatcactccgaagctcc

SEQ ID NO: 559921 - DNA, 25 bp, Rattus norvegicus
cgctcgcacttgaactccctgggaa

SEQ ID NO: 559922 - DNA, 25 bp, Rattus norvegicus
cacagtgcgccacgcgtggacgcga

SEQ ID NO: 559923 - DNA, 25 bp, Rattus norvegicus
ccctccgccctaggggcaaggagct

SEQ ID NO: 559924 - DNA, 25 bp, Rattus norvegicus
ttagaggcaaatgggcagttaccgc

SEQ ID NO: 559925 - DNA, 25 bp, Rattus norvegicus
ggaggctccaaaagtgactcgcacc

SEQ ID NO: 559926 - DNA, 25 bp, Rattus norvegicus
agtcagttctctcggaggctccaaa

SEQ ID NO: 559927 - DNA, 25 bp, Rattus norvegicus
tgtcaaagcacagtcagttctctcg

SEQ ID NO: 559928 - DNA, 25 bp, Rattus norvegicus
agccgccggcgctttgtcaaagcac

SEQ ID NO: 559929 - DNA, 25 bp, Rattus norvegicus
gcaaggagctgagccaccgagccgc

SEQ ID NO: 559930 - DNA, 25 bp, Rattus norvegicus
acttgaactccctgggaagccctgc

SEQ ID NO: 559931 - DNA, 25 bp, Rattus norvegicus
gctggctgcgctcgcacttgaactc

SEQ ID NO: 559932 - DNA, 25 bp, Rattus norvegicus
gcggcgcttcctcggcatcgcgaag

SEQ ID NO: 559933 - DNA, 25 bp, Rattus norvegicus
tgggaaatcaaactcgccacgcggc

SEQ ID NO: 559934 - DNA, 25 bp, Rattus norvegicus
gcctggacagtcctgggaaatcaaa

SEQ ID NO: 559935 - DNA, 25 bp, Rattus norvegicus
ctactcaaatccagaaaagtgggtg

SEQ ID NO: 559936 - DNA, 25 bp, Rattus norvegicus
ttgtggagatctccgcgctggacgc

SEQ ID NO: 559937 - DNA, 25 bp, Rattus norvegicus
caaatccagaaaagtgggtgaggtc

SEQ ID NO: 559938 - DNA, 25 bp, Rattus norvegicus
ggggcctctaggtgaaatcaccacc

SEQ ID NO: 559939 - DNA, 25 bp, Rattus norvegicus
tacgctcaacaacatcttcgagggg

SEQ ID NO: 559940 - DNA, 25 bp, Rattus norvegicus
ggtttgaaaccctaggatacgctca

SEQ ID NO: 559941 - DNA, 25 bp, Rattus norvegicus
ggtgaccgttatcagtggccctcga

SEQ ID NO: 559942 - DNA, 25 bp, Rattus norvegicus
tcagtggccctcgatctccctaaag

SEQ ID NO: 559943 - DNA, 25 bp, Rattus norvegicus
tggccctcgatctccctaaagggaa

SEQ ID NO: 559944 - DNA, 25 bp, Rattus norvegicus
tgccgcctttccaggtctctaagag

SEQ ID NO: 559945 - DNA, 25 bp, Rattus norvegicus
ggtctttgccgcctttccaggtctc

SEQ ID NO: 559946 - DNA, 25 bp, Rattus norvegicus
ggtgaaatcaccacctactcaaatc

SEQ ID NO: 559947 - DNA, 25 bp, Rattus norvegicus
taggatacgctcaacaacatcttcg

SEQ ID NO: 559948 - DNA, 25 bp, Rattus norvegicus
ccaggtctctaagaggtgaccgtta

SEQ ID NO: 559949 - DNA, 25 bp, Rattus norvegicus
tctgaggtgtccgacctcgccggga

SEQ ID NO: 559950 - DNA, 25 bp, Rattus norvegicus
gcaggtccacccgagatctgggagc

SEQ ID NO: 559951 - DNA, 25 bp, Rattus norvegicus
cgcagcccatcctagaaacggggta

SEQ ID NO: 559952 - DNA, 25 bp, Rattus norvegicus
cctgaggaccggacagttacggacg

SEQ ID NO: 559953 - DNA, 25 bp, Rattus norvegicus
agagcgacacggtggctaccgcctt

SEQ ID NO: 559954 - DNA, 25 bp, Rattus norvegicus
caccagcaaccagcgggcactagga

SEQ ID NO: 559955 - DNA, 25 bp, Rattus norvegicus
gcgcgacagcgctttacggcgacgc

SEQ ID NO: 559956 - DNA, 25 bp, Rattus norvegicus
ggcgacgccgcaaaccaacctgtgt

SEQ ID NO: 559957 - DNA, 25 bp, Rattus norvegicus
acgcggagaccgagaacactgaggc

SEQ ID NO: 559958 - DNA, 25 bp, Rattus norvegicus
tgtgatgtgacggacgctgcgacca

SEQ ID NO: 559959 - DNA, 25 bp, Rattus norvegicus
gctgcgaccacgtgtttccaggaga

SEQ ID NO: 559960 - DNA, 25 bp, Rattus norvegicus
gcgaagtttgagaagacgtagaatg

SEQ ID NO: 559961 - DNA, 25 bp, Rattus norvegicus
acgcgagggccaccgagagcgacac

SEQ ID NO: 559962 - DNA, 25 bp, Rattus norvegicus
ccgagatctgggagccgcagcccat

SEQ ID NO: 559963 - DNA, 25 bp, Rattus norvegicus
cttgcagtcgccgtgcgtgtgtaaa

SEQ ID NO: 559964 - DNA, 25 bp, Rattus norvegicus
cagtcgccgtgcgtgtgtaaagtgt

SEQ ID NO: 559965 - DNA, 25 bp, Rattus norvegicus
tgtgtaaagtgtgtgttgcacaggc

SEQ ID NO: 559966 - DNA, 25 bp, Rattus norvegicus
gaggtggattccgaccagaatgcta

SEQ ID NO: 559967 - DNA, 25 bp, Rattus norvegicus
ccgaccagaatgctagaacccggaa

SEQ ID NO: 559968 - DNA, 25 bp, Rattus norvegicus
agtagtggtggccataacaggtcgc

SEQ ID NO: 559969 - DNA, 25 bp, Rattus norvegicus
tggccataacaggtcgcgtcttaca

SEQ ID NO: 559970 - DNA, 25 bp, Rattus norvegicus
taacaggtcgcgtcttacacaatgc

SEQ ID NO: 559971 - DNA, 25 bp, Rattus norvegicus
tcgcgtcttacacaatgcattgggc

SEQ ID NO: 559972 - DNA, 25 bp, Rattus norvegicus
gcattgggctgcagcaagtaggctc

SEQ ID NO: 559973 - DNA, 25 bp, Rattus norvegicus
gctgcagcaagtaggctcctcggca

SEQ ID NO: 559974 - DNA, 25 bp, Rattus norvegicus
ggcagaaaggcgctccatgaattcg

SEQ ID NO: 559975 - DNA, 25 bp, Rattus norvegicus
gaaaggcgctccatgaattcgcacg

SEQ ID NO: 559976 - DNA, 25 bp, Rattus norvegicus
gatgctgcccgcttgcagtcgccgt

SEQ ID NO: 559977 - DNA, 25 bp, Rattus norvegicus
caaacaccgagctatttatgaccgc

SEQ ID NO: 559978 - DNA, 25 bp, Rattus norvegicus
ctgcctttgtctgggcgacgccgag

SEQ ID NO: 559979 - DNA, 25 bp, Rattus norvegicus
ctgcggccggcgctgcctttgtctg

SEQ ID NO: 559980 - DNA, 25 bp, Rattus norvegicus
gcagtccgcaaggttagccgtgcgc

SEQ ID NO: 559981 - DNA, 25 bp, Rattus norvegicus
tcgcgcagtccgcaaggttagccgt

SEQ ID NO: 559982 - DNA, 25 bp, Rattus norvegicus
cgaggctctttctcggtcgcgcagt

SEQ ID NO: 559983 - DNA, 25 bp, Rattus norvegicus
gcccgcacctagctgccagacctcg

SEQ ID NO: 559984 - DNA, 25 bp, Rattus norvegicus
cggagagcgaaactcagcgcccgca

SEQ ID NO: 559985 - DNA, 25 bp, Rattus norvegicus
cgagctatttatgaccgccggagag

SEQ ID NO: 559986 - DNA, 25 bp, Rattus norvegicus
cccagcgcttgtttacaaacaccga

SEQ ID NO: 559987 - DNA, 25 bp, Rattus norvegicus
aacaatgagccgagcgccgggaatg

SEQ ID NO: 559988 - DNA, 25 bp, Rattus norvegicus
ccctcagccctagccgcggcgcgaa

SEQ ID NO: 559989 - DNA, 25 bp, Rattus norvegicus
cgcctcctcaccctggtagccctca

SEQ ID NO: 559990 - DNA, 25 bp, Rattus norvegicus
tgaccgccggagagcgaaactcagc

SEQ ID NO: 559991 - DNA, 25 bp, Rattus norvegicus
gccaaaaggctctctcccccaaagc

SEQ ID NO: 559992 - DNA, 25 bp, Rattus norvegicus
aataatcgatcagcagggagcttcg

SEQ ID NO: 559993 - DNA, 25 bp, Rattus norvegicus
aatcgatcagcagggagcttcgatc

SEQ ID NO: 559994 - DNA, 25 bp, Rattus norvegicus
tcgatcagcagggagcttcgatctg

SEQ ID NO: 559995 - DNA, 25 bp, Rattus norvegicus
cagggagcttcgatctgctgggaat

SEQ ID NO: 559996 - DNA, 25 bp, Rattus norvegicus
gcttcgatctgctgggaatgcaaac

SEQ ID NO: 559997 - DNA, 25 bp, Rattus norvegicus
ggaatgcaaactgccattccggatt

SEQ ID NO: 559998 - DNA, 25 bp, Rattus norvegicus
tgcaaactgccattccggattcccg

SEQ ID NO: 559999 - DNA, 25 bp, Rattus norvegicus
tcaaataatcgatcagcagggagct

SEQ ID NO: 560000 - DNA, 25 bp, Rattus norvegicus
gattcccgccctgaaggtggccaaa

SEQ ID NO: 560001 - DNA, 25 bp, Rattus norvegicus
gatcagcagggagcttcgatctgct

SEQ ID NO: 560002 - DNA, 25 bp, Rattus norvegicus
ggattcccgccctgaaggtggccaa

SEQ ID NO: 560003 - DNA, 25 bp, Rattus norvegicus
ggagcttcgatctgctgggaatgca

SEQ ID NO: 560004 - DNA, 25 bp, Rattus norvegicus
ttatcaaataatcgatcagcaggga

SEQ ID NO: 560005 - DNA, 25 bp, Rattus norvegicus
ccgaagttagggcttcaggtgctta

SEQ ID NO: 560006 - DNA, 25 bp, Rattus norvegicus
atcccgcctagaggcaccgagtggc

SEQ ID NO: 560007 - DNA, 25 bp, Rattus norvegicus
ctatagcttccactgctcaggctga

SEQ ID NO: 560008 - DNA, 25 bp, Rattus norvegicus
gtgtcgtagtgtgcctttcttcccg

SEQ ID NO: 560009 - DNA, 25 bp, Rattus norvegicus
gctcggcctggggtctaattccaga

SEQ ID NO: 560010 - DNA, 25 bp, Rattus norvegicus
taattccagaagcttctcgcctttg

SEQ ID NO: 560011 - DNA, 25 bp, Rattus norvegicus
cgcctttgttcatggacagtttttc

SEQ ID NO: 560012 - DNA, 25 bp, Rattus norvegicus
cagtttttccttcgaggcgtcattc

SEQ ID NO: 560013 - DNA, 25 bp, Rattus norvegicus
cggccagtaggtcatgtaggtcatg

SEQ ID NO: 560014 - DNA, 25 bp, Rattus norvegicus
atgtaggtcatgtgctcggcgatca

SEQ ID NO: 560015 - DNA, 25 bp, Rattus norvegicus
ggtgagcgacgctagctatagcttc

SEQ ID NO: 560016 - DNA, 25 bp, Rattus norvegicus
ggtgccttgtacaccctcggaggga

SEQ ID NO: 560017 - DNA, 25 bp, Rattus norvegicus
agacccgcgtgtgtcctcgtctcag

SEQ ID NO: 560018 - DNA, 25 bp, Rattus norvegicus
tctcagcttccagccgctgcgagtg

SEQ ID NO: 560019 - DNA, 25 bp, Rattus norvegicus
catggctgggcacgaagcgtctcac

SEQ ID NO: 560020 - DNA, 25 bp, Rattus norvegicus
tgctcctgcttaggtcaagcacggg

SEQ ID NO: 560021 - DNA, 25 bp, Rattus norvegicus
cgcgcagctatgtgcgccctgaagc

SEQ ID NO: 560022 - DNA, 25 bp, Rattus norvegicus
tgatttgctgcaggaaccatggctg

SEQ ID NO: 560023 - DNA, 25 bp, Rattus norvegicus
cttgagacggtcgtcgagcctgaca

SEQ ID NO: 560024 - DNA, 25 bp, Rattus norvegicus
gagctacaagctgtgctcctgctta

SEQ ID NO: 560025 - DNA, 25 bp, Rattus norvegicus
acgagacctgactggagctacaagc

SEQ ID NO: 560026 - DNA, 25 bp, Rattus norvegicus
ttgaccagacaacgagacctgactg

SEQ ID NO: 560027 - DNA, 25 bp, Rattus norvegicus
cagagtgattttattgaccagacaa

SEQ ID NO: 560028 - DNA, 25 bp, Rattus norvegicus
gggcgcaggaatcagagtgatttta

SEQ ID NO: 560029 - DNA, 25 bp, Rattus norvegicus
cacaacggaggaaaagggtcacacg

SEQ ID NO: 560030 - DNA, 25 bp, Rattus norvegicus
ctagacgctaagtacacaacggagg

SEQ ID NO: 560031 - DNA, 25 bp, Rattus norvegicus
gcgccctgaagctagacgctaagta

SEQ ID NO: 560032 - DNA, 25 bp, Rattus norvegicus
tgacaggatcggcaaagatgatttg

SEQ ID NO: 560033 - DNA, 25 bp, Rattus norvegicus
ttcataatacttgcacccgcgtgga

SEQ ID NO: 560034 - DNA, 25 bp, Rattus norvegicus
cggggttggcgtttcattcataata

SEQ ID NO: 560035 - DNA, 25 bp, Rattus norvegicus
gcggaggcttttcgtctgtttaata

SEQ ID NO: 560036 - DNA, 25 bp, Rattus norvegicus
aatcccggctatgcaaccgaaaggg

SEQ ID NO: 560037 - DNA, 25 bp, Rattus norvegicus
aaatgatcctggagtgtgccgcctg

SEQ ID NO: 560038 - DNA, 25 bp, Rattus norvegicus
cgccgcccttggctaattataccgg

SEQ ID NO: 560039 - DNA, 25 bp, Rattus norvegicus
tataccggagattgtgcaatgggcc

SEQ ID NO: 560040 - DNA, 25 bp, Rattus norvegicus
actacgtctgcactgtccagggctc

SEQ ID NO: 560041 - DNA, 25 bp, Rattus norvegicus
ctgctcgcccgagcgtagtgatgca

SEQ ID NO: 560042 - DNA, 25 bp, Rattus norvegicus
aggaactgataaacccgcgcgagtg

SEQ ID NO: 560043 - DNA, 25 bp, Rattus norvegicus
ctcgagcgccggtcattgagaaata

SEQ ID NO: 560044 - DNA, 25 bp, Rattus norvegicus
tgccgagccgcctgctcgaaaagta

SEQ ID NO: 560045 - DNA, 25 bp, Rattus norvegicus
aaagtaggacctgctccgctgctga

SEQ ID NO: 560046 - DNA, 25 bp, Rattus norvegicus
tcctacctgaagtggcgacctcagc

SEQ ID NO: 560047 - DNA, 25 bp, Rattus norvegicus
gccaagggcgcgcaaatgacctccg

SEQ ID NO: 560048 - DNA, 25 bp, Rattus norvegicus
ggacaggcgtctaggtgaacaagaa

SEQ ID NO: 560049 - DNA, 25 bp, Rattus norvegicus
acacccggacgagtaagttcgctgc

SEQ ID NO: 560050 - DNA, 25 bp, Rattus norvegicus
ggggaagcgcgctcctgacttgtat

SEQ ID NO: 560051 - DNA, 25 bp, Rattus norvegicus
tcattcataaaaacacggaggagtt

SEQ ID NO: 560052 - DNA, 25 bp, Rattus norvegicus
gctctcatttgcataccacattttc

SEQ ID NO: 560053 - DNA, 25 bp, Rattus norvegicus
cgttttcttgaatcgctctcatttg

SEQ ID NO: 560054 - DNA, 25 bp, Rattus norvegicus
tccgccatttcgttttcttgaatcg

SEQ ID NO: 560055 - DNA, 25 bp, Rattus norvegicus
agtgactttgtgactcctggcaccg

SEQ ID NO: 560056 - DNA, 25 bp, Rattus norvegicus
cgagagcggaagctctgacgccctc

SEQ ID NO: 560057 - DNA, 25 bp, Rattus norvegicus
cctccaccaccaaatcaggagatgt

SEQ ID NO: 560058 - DNA, 25 bp, Rattus norvegicus
cctggggtctgcaagtccaggtcgc

SEQ ID NO: 560059 - DNA, 25 bp, Rattus norvegicus
tgcagtcgctggctaagctgtcgag

SEQ ID NO: 560060 - DNA, 25 bp, Rattus norvegicus
tcgatgggtctgtgtgcatagtgac

SEQ ID NO: 560061 - DNA, 25 bp, Rattus norvegicus
cgtttgctgcgtggctgttattaga

SEQ ID NO: 560062 - DNA, 25 bp, Rattus norvegicus
ggctgttattagagacaactctgtc

SEQ ID NO: 560063 - DNA, 25 bp, Rattus norvegicus
tgtcgtcccagcttttcacgttctg

SEQ ID NO: 560064 - DNA, 25 bp, Rattus norvegicus
acacttccagtgtggcgtttgctgc

SEQ ID NO: 560065 - DNA, 25 bp, Rattus norvegicus
gttctggtcttgacaccctcgctca

SEQ ID NO: 560066 - DNA, 25 bp, Rattus norvegicus
tcgctcacacttgcagtgacgcggc

SEQ ID NO: 560067 - DNA, 25 bp, Rattus norvegicus
ggctcttggagaagttgcccgtcga

SEQ ID NO: 560068 - DNA, 25 bp, Rattus norvegicus
ttgcccgtcgagcacacttccagtg

SEQ ID NO: 560069 - DNA, 25 bp, Rattus norvegicus
gagctcggagacgatgacgttttta

SEQ ID NO: 560070 - DNA, 25 bp, Rattus norvegicus
gacgtttttacagtgagtatccttc

SEQ ID NO: 560071 - DNA, 25 bp, Rattus norvegicus
acagtgagtatccttcgccctttgg

SEQ ID NO: 560072 - DNA, 25 bp, Rattus norvegicus
tcgccctttggttctcgttaggtga

SEQ ID NO: 560073 - DNA, 25 bp, Rattus norvegicus
ttctcgttaggtgatggctcttgga

SEQ ID NO: 560074 - DNA, 25 bp, Rattus norvegicus
gatccataacgaagctgagctcgga

SEQ ID NO: 560075 - DNA, 25 bp, Rattus norvegicus
ccctacgttgattcttcggactttg

SEQ ID NO: 560076 - DNA, 25 bp, Rattus norvegicus
tcggtctcttgcgaaaacgcgctga

SEQ ID NO: 560077 - DNA, 25 bp, Rattus norvegicus
gcagggacatgttcaaccacgaaga

SEQ ID NO: 560078 - DNA, 25 bp, Rattus norvegicus
actcggactggaggctcctagctta

SEQ ID NO: 560079 - DNA, 25 bp, Rattus norvegicus
ccagggatctttctttgcggctgtc

SEQ ID NO: 560080 - DNA, 25 bp, Rattus norvegicus
ccctgggctgtaacactgtctggtt

SEQ ID NO: 560081 - DNA, 25 bp, Rattus norvegicus
tgaacagcgtttgccgcggtcgtac

SEQ ID NO: 560082 - DNA, 25 bp, Rattus norvegicus
ttacgaagattaccggcacgcgcca

SEQ ID NO: 560083 - DNA, 25 bp, Rattus norvegicus
ccgcggcaaatacttggacagcacc

SEQ ID NO: 560084 - DNA, 25 bp, Rattus norvegicus
tggacagcaccgaagacgcagactc

SEQ ID NO: 560085 - DNA, 25 bp, Rattus norvegicus
cttcggcgaggatcccaaaggcaat

SEQ ID NO: 560086 - DNA, 25 bp, Rattus norvegicus
ccgacgccgtgagaacgtgcattcg

SEQ ID NO: 560087 - DNA, 25 bp, Rattus norvegicus
cactgacccttgttcgtgcgacaca

SEQ ID NO: 560088 - DNA, 25 bp, Rattus norvegicus
gggccgaccatcctatgtacgcggt

SEQ ID NO: 560089 - DNA, 25 bp, Rattus norvegicus
ctgacccaggtgtctcgggacctag

SEQ ID NO: 560090 - DNA, 25 bp, Rattus norvegicus
ggggcagcctcgaagcccagagcta

SEQ ID NO: 560091 - DNA, 25 bp, Rattus norvegicus
tttctctgcggaacccgtttcctgc

SEQ ID NO: 560092 - DNA, 25 bp, Rattus norvegicus
ctcgcattcggcatcttcagctaca

SEQ ID NO: 560093 - DNA, 25 bp, Rattus norvegicus
agaggaaggccgctaggtcttgtat

SEQ ID NO: 560094 - DNA, 25 bp, Rattus norvegicus
gtcttgtatggacggacacaggcga

SEQ ID NO: 560095 - DNA, 25 bp, Rattus norvegicus
aggctcggaaatggagacctcctcg

SEQ ID NO: 560096 - DNA, 25 bp, Rattus norvegicus
aatggagacctcctcgccacctaga

SEQ ID NO: 560097 - DNA, 25 bp, Rattus norvegicus
tagacctacatctcgggacgcgggc

SEQ ID NO: 560098 - DNA, 25 bp, Rattus norvegicus
ttcctgccctggctgtccatggttc

SEQ ID NO: 560099 - DNA, 25 bp, Rattus norvegicus
ctccaagagggaggtacagagaaaa

SEQ ID NO: 560100 - DNA, 25 bp, Rattus norvegicus
cagcacttcctcttttctctgcgga

SEQ ID NO: 560101 - DNA, 25 bp, Rattus norvegicus
ccaatgagagttgcccggtatgggc

SEQ ID NO: 560102 - DNA, 25 bp, Rattus norvegicus
ctggcagccgagaagaccaatgaga

SEQ ID NO: 560103 - DNA, 25 bp, Rattus norvegicus
gcgcggagtgctcacgactctcttt

SEQ ID NO: 560104 - DNA, 25 bp, Rattus norvegicus
ggtcgacgtttgctctaccggaaca

SEQ ID NO: 560105 - DNA, 25 bp, Rattus norvegicus
ctctaccggaacagcttagctcatt

SEQ ID NO: 560106 - DNA, 25 bp, Rattus norvegicus
ggcagctgcagtgacatgtccagca

SEQ ID NO: 560107 - DNA, 25 bp, Rattus norvegicus
tgtccagcatgaatcccgaatagtg

SEQ ID NO: 560108 - DNA, 25 bp, Rattus norvegicus
tgaatcccgaatagtgagtgcagga

SEQ ID NO: 560109 - DNA, 25 bp, Rattus norvegicus
cactcggaaggtcgaccaggcgaac

SEQ ID NO: 560110 - DNA, 25 bp, Rattus norvegicus
cccattgtctgatggccgagggccg

SEQ ID NO: 560111 - DNA, 25 bp, Rattus norvegicus
ctcgaccttagccaatccgctaggg

SEQ ID NO: 560112 - DNA, 25 bp, Rattus norvegicus
acaagctcgcaagggcgcatgcgta

SEQ ID NO: 560113 - DNA, 25 bp, Rattus norvegicus
cagttcctggttcgccggcggccat

SEQ ID NO: 560114 - DNA, 25 bp, Rattus norvegicus
cggccattttgggtggaagcgatca

SEQ ID NO: 560115 - DNA, 25 bp, Rattus norvegicus
ggctgctgattgtgttctaagggtc

SEQ ID NO: 560116 - DNA, 25 bp, Rattus norvegicus
agtccgagcgaagtcctagccagca

SEQ ID NO: 560117 - DNA, 25 bp, Rattus norvegicus
gcagaatccgtacccagccgggcgg

SEQ ID NO: 560118 - DNA, 25 bp, Rattus norvegicus
cagaggtaaccgctgcgtcgtccgg

SEQ ID NO: 560119 - DNA, 25 bp, Rattus norvegicus
cgggcacgagcaagcgggcgggcaa

SEQ ID NO: 560120 - DNA, 25 bp, Rattus norvegicus
agaatccgtacccagccgggcggcg

SEQ ID NO: 560121 - DNA, 25 bp, Rattus norvegicus
caagtgagcgcgtccgccgagtgtc

SEQ ID NO: 560122 - DNA, 25 bp, Rattus norvegicus
cggacagaggtaaccgctgcgtcgt

SEQ ID NO: 560123 - DNA, 25 bp, Rattus norvegicus
ggtaaccgctgcgtcgtccggcgca

SEQ ID NO: 560124 - DNA, 25 bp, Rattus norvegicus
gactcagcctggagcggccacccgc

SEQ ID NO: 560125 - DNA, 25 bp, Rattus norvegicus
ccacccgcgttcgcgtcggtgagga

SEQ ID NO: 560126 - DNA, 25 bp, Rattus norvegicus
ccgcgagcggcgacgcaggtgctcg

SEQ ID NO: 560127 - DNA, 25 bp, Rattus norvegicus
ggggctcccgcagaatccgtaccca

SEQ ID NO: 560128 - DNA, 25 bp, Rattus norvegicus
gcagcccgcgcgtgcctcgctgccc

SEQ ID NO: 560129 - DNA, 25 bp, Rattus norvegicus
cccgcagttttcaggcgcgctccgc

SEQ ID NO: 560130 - DNA, 25 bp, Rattus norvegicus
ccgcggacagaggtaaccgctgcgt

SEQ ID NO: 560131 - DNA, 25 bp, Rattus norvegicus
ccactgtgggttcaggcttgtgttt

SEQ ID NO: 560132 - DNA, 25 bp, Rattus norvegicus
atccgcagcccgcttctgcatgaga

SEQ ID NO: 560133 - DNA, 25 bp, Rattus norvegicus
ggagctcctttctccgctgcttcga

SEQ ID NO: 560134 - DNA, 25 bp, Rattus norvegicus
atgcgttcactgtgccaggggaagc

SEQ ID NO: 560135 - DNA, 25 bp, Rattus norvegicus
gagtcgctgtgacccgctgattccc

SEQ ID NO: 560136 - DNA, 25 bp, Rattus norvegicus
acgaccaaggtcgacgcgcgcacag

SEQ ID NO: 560137 - DNA, 25 bp, Rattus norvegicus
cgcgcacagctgcatggctgccaga

SEQ ID NO: 560138 - DNA, 25 bp, Rattus norvegicus
atgcccggtctcgagtctcggcgca

SEQ ID NO: 560139 - DNA, 25 bp, Rattus norvegicus
ccgcacgtcccaagcggctgggata

SEQ ID NO: 560140 - DNA, 25 bp, Rattus norvegicus
aggacgcccgaagaagcagccaatc

SEQ ID NO: 560141 - DNA, 25 bp, Rattus norvegicus
ttgctttcctcctcggatgcgttca

SEQ ID NO: 560142 - DNA, 25 bp, Rattus norvegicus
accctcggttcggatgcttcactaa

SEQ ID NO: 560143 - DNA, 25 bp, Rattus norvegicus
ggcctatgggaagccggagctcctt

SEQ ID NO: 560144 - DNA, 25 bp, Rattus norvegicus
aagcagccaatccagaccctcggtt

SEQ ID NO: 560145 - DNA, 25 bp, Rattus norvegicus
caagactgagtagaccgtgccgcgc

SEQ ID NO: 560146 - DNA, 25 bp, Rattus norvegicus
ccaccagcggtaggatgatcatgcg

SEQ ID NO: 560147 - DNA, 25 bp, Rattus norvegicus
agccttccttcagagccgctgctgg

SEQ ID NO: 560148 - DNA, 25 bp, Rattus norvegicus
tggtgaggccgaagtaagcaacagc

SEQ ID NO: 560149 - DNA, 25 bp, Rattus norvegicus
ccgagctctgctagtccctacagga

SEQ ID NO: 560150 - DNA, 25 bp, Rattus norvegicus
ccaatgaatggatcaggcggagaca

SEQ ID NO: 560151 - DNA, 25 bp, Rattus norvegicus
cgccgctctaagcagcagcacgtga

SEQ ID NO: 560152 - DNA, 25 bp, Rattus norvegicus
ggtatccgttggtctcctccatgtc

SEQ ID NO: 560153 - DNA, 25 bp, Rattus norvegicus
cgcgttgcgccgaaaaaagctagca

SEQ ID NO: 560154 - DNA, 25 bp, Rattus norvegicus
gcgcagcatacggagcagcatctcg

SEQ ID NO: 560155 - DNA, 25 bp, Rattus norvegicus
ggccaatcctgtctcctggcagctt

SEQ ID NO: 560156 - DNA, 25 bp, Rattus norvegicus
cagcacgtgaggaacttggactcgg

SEQ ID NO: 560157 - DNA, 25 bp, Rattus norvegicus
ccgcctccgagattatgaccaatta

SEQ ID NO: 560158 - DNA, 25 bp, Rattus norvegicus
gcagcttcccgtcctagctaacgga

SEQ ID NO: 560159 - DNA, 25 bp, Rattus norvegicus
gccctagaccgagttggaccaacga

SEQ ID NO: 560160 - DNA, 25 bp, Rattus norvegicus
cctgttcgcatctatctaatagaga

SEQ ID NO: 560161 - DNA, 25 bp, Rattus norvegicus
ccggggaaatagctggccaggcata

SEQ ID NO: 560162 - DNA, 25 bp, Rattus norvegicus
ctgggatgaggttaacttcagcgca

SEQ ID NO: 560163 - DNA, 25 bp, Rattus norvegicus
gacgagcagggtttatgcaccaacg

SEQ ID NO: 560164 - DNA, 25 bp, Rattus norvegicus
cccggctgaggtgccctagaccgag

SEQ ID NO: 560165 - DNA, 25 bp, Rattus norvegicus
gaccaacgattatagggaggacatt

SEQ ID NO: 560166 - DNA, 25 bp, Rattus norvegicus
cagcatgtttcttatcctgttcgca

SEQ ID NO: 560167 - DNA, 25 bp, Rattus norvegicus
taatagagaatttagccgaggctgg

SEQ ID NO: 560168 - DNA, 25 bp, Rattus norvegicus
tgcaccaacgcagagcggtttcgta

SEQ ID NO: 560169 - DNA, 25 bp, Rattus norvegicus
tgtgttctttaaatacggcgcctgc

SEQ ID NO: 560170 - DNA, 25 bp, Rattus norvegicus
gccaggcatattgcatgtgtgttta

SEQ ID NO: 560171 - DNA, 25 bp, Rattus norvegicus
ttaacttcagcgcaggtgggacgag

SEQ ID NO: 560172 - DNA, 25 bp, Rattus norvegicus
aaatacggcgcctgcatctcggggc

SEQ ID NO: 560173 - DNA, 25 bp, Rattus norvegicus
gaggcacgacccactgtgtgatagc

SEQ ID NO: 560174 - DNA, 25 bp, Rattus norvegicus
tgcgactacagcttctcaatggccc

SEQ ID NO: 560175 - DNA, 25 bp, Rattus norvegicus
tcagttggtgcgactacagcttctc

SEQ ID NO: 560176 - DNA, 25 bp, Rattus norvegicus
agagactagtcagttggtgcgacta

SEQ ID NO: 560177 - DNA, 25 bp, Rattus norvegicus
ctccggaggatggaagagactagtc

SEQ ID NO: 560178 - DNA, 25 bp, Rattus norvegicus
gacgccagcgcgctcaagtccatgg

SEQ ID NO: 560179 - DNA, 25 bp, Rattus norvegicus
cgccacgtgcttgtaccaggcgctg

SEQ ID NO: 560180 - DNA, 25 bp, Rattus norvegicus
atgagcagcccggaggcacgaccca

SEQ ID NO: 560181 - DNA, 25 bp, Rattus norvegicus
tgccggtgaactcctgcttcgtacc

SEQ ID NO: 560182 - DNA, 25 bp, Rattus norvegicus
atgcacgggaagtcctgccggtgaa

SEQ ID NO: 560183 - DNA, 25 bp, Rattus norvegicus
agactccgggttgcatgcacgggaa

SEQ ID NO: 560184 - DNA, 25 bp, Rattus norvegicus
gactgctcaggttggccggctccct

SEQ ID NO: 560185 - DNA, 25 bp, Rattus norvegicus
tgatagcgagggctcgccacgtgct

SEQ ID NO: 560186 - DNA, 25 bp, Rattus norvegicus
acccactgtgtgatagcgagggctc

SEQ ID NO: 560187 - DNA, 25 bp, Rattus norvegicus
ttctagcgacaaccattgcagcccg

SEQ ID NO: 560188 - DNA, 25 bp, Rattus norvegicus
ctgcctgtgcttcgcttgtgactct

SEQ ID NO: 560189 - DNA, 25 bp, Rattus norvegicus
tccttctctgcctcgctgagtggga

SEQ ID NO: 560190 - DNA, 25 bp, Rattus norvegicus
actctgatgaggctctgtctgcggg

SEQ ID NO: 560191 - DNA, 25 bp, Rattus norvegicus
gggttattgttcttccttctctgcc

SEQ ID NO: 560192 - DNA, 25 bp, Rattus norvegicus
tcagactctggctctgaagcccgcg

SEQ ID NO: 560193 - DNA, 25 bp, Rattus norvegicus
gcagctcacgcccagccagcccacg

SEQ ID NO: 560194 - DNA, 25 bp, Rattus norvegicus
ttcgcttgtgactctgatgaggctc

SEQ ID NO: 560195 - DNA, 25 bp, Rattus norvegicus
ctgcagttggcaccccttctagcga

SEQ ID NO: 560196 - DNA, 25 bp, Rattus norvegicus
cagatcttttgggttattgttcttc

SEQ ID NO: 560197 - DNA, 25 bp, Rattus norvegicus
gtcctttgcggctccagatcttttg

SEQ ID NO: 560198 - DNA, 25 bp, Rattus norvegicus
gttcgcgtcctttgcggctccagat

SEQ ID NO: 560199 - DNA, 25 bp, Rattus norvegicus
ggacccagacgttcgcgtcctttgc

SEQ ID NO: 560200 - DNA, 25 bp, Rattus norvegicus
gcgagccagggacccagacgttcgc

SEQ ID NO: 560201 - DNA, 25 bp, Rattus norvegicus
ctgccctaggactctttaaagtctg

SEQ ID NO: 560202 - DNA, 25 bp, Rattus norvegicus
gccgggctctcacacggttacttgt

SEQ ID NO: 560203 - DNA, 25 bp, Rattus norvegicus
ttacttgtgtgactgacacgggccg

SEQ ID NO: 560204 - DNA, 25 bp, Rattus norvegicus
ttctcattggccacaggccgacgtc

SEQ ID NO: 560205 - DNA, 25 bp, Rattus norvegicus
ggattggcggaaagctcacttctag

SEQ ID NO: 560206 - DNA, 25 bp, Rattus norvegicus
tcacttctagaacgaggagggcaga

SEQ ID NO: 560207 - DNA, 25 bp, Rattus norvegicus
gcgcgacagtgtccttagaagactc

SEQ ID NO: 560208 - DNA, 25 bp, Rattus norvegicus
ttagaagactcattgggccaggggc

SEQ ID NO: 560209 - DNA, 25 bp, Rattus norvegicus
aggggcgaagccagccacctagcga

SEQ ID NO: 560210 - DNA, 25 bp, Rattus norvegicus
cgccattggtctacgatcacgcctg

SEQ ID NO: 560211 - DNA, 25 bp, Rattus norvegicus
ctatccatggctggctggctgtact

SEQ ID NO: 560212 - DNA, 25 bp, Rattus norvegicus
attaaatgtcttgagcgagccgagc

SEQ ID NO: 560213 - DNA, 25 bp, Rattus norvegicus
agcggcacgccctgccattgggcat

SEQ ID NO: 560214 - DNA, 25 bp, Rattus norvegicus
tctgtgagtcactgcacaacctatc

SEQ ID NO: 560215 - DNA, 25 bp, Rattus norvegicus
cctgtcatatttgtggtcgtgctcc

SEQ ID NO: 560216 - DNA, 25 bp, Rattus norvegicus
ccaaatagttcggatgcctgtcata

SEQ ID NO: 560217 - DNA, 25 bp, Rattus norvegicus
gtcgtgctcctctgcggacagtacc

SEQ ID NO: 560218 - DNA, 25 bp, Rattus norvegicus
ttagtagtgttagtagtagccgtcc

SEQ ID NO: 560219 - DNA, 25 bp, Rattus norvegicus
tcctttagtctacagggccgactgc

SEQ ID NO: 560220 - DNA, 25 bp, Rattus norvegicus
cgactgctgaagctcggtgtctgct

SEQ ID NO: 560221 - DNA, 25 bp, Rattus norvegicus
ttcaccctgcgggaatctgcattta

SEQ ID NO: 560222 - DNA, 25 bp, Rattus norvegicus
atctgcatttatggcacctgggcgg

SEQ ID NO: 560223 - DNA, 25 bp, Rattus norvegicus
ttgtataatgttcccgacgcgcagg

SEQ ID NO: 560224 - DNA, 25 bp, Rattus norvegicus
cagaggacgccggagtcatagctcc

SEQ ID NO: 560225 - DNA, 25 bp, Rattus norvegicus
ctccgatgcgttagctccgggcgga

SEQ ID NO: 560226 - DNA, 25 bp, Rattus norvegicus
acctgcctgtggtgagttcccggtc

SEQ ID NO: 560227 - DNA, 25 bp, Rattus norvegicus
gccaaccggcccaagtggccaaata

SEQ ID NO: 560228 - DNA, 25 bp, Rattus norvegicus
cgctctgtcatctgcctgtttttca

SEQ ID NO: 560229 - DNA, 25 bp, Rattus norvegicus
ggaccggttactcggacgctgagct

SEQ ID NO: 560230 - DNA, 25 bp, Rattus norvegicus
gagcgccgtaccactctgcttcagg

SEQ ID NO: 560231 - DNA, 25 bp, Rattus norvegicus
ctctccgcaagggacacagctctgg

SEQ ID NO: 560232 - DNA, 25 bp, Rattus norvegicus
ccgcgaggcagacagtgtttacacc

SEQ ID NO: 560233 - DNA, 25 bp, Rattus norvegicus
acagaattcttacttctgcgcaggc

SEQ ID NO: 560234 - DNA, 25 bp, Rattus norvegicus
ttcagagaccctcctaggcggcaca

SEQ ID NO: 560235 - DNA, 25 bp, Rattus norvegicus
ctgcccgttggagcattcagagacc

SEQ ID NO: 560236 - DNA, 25 bp, Rattus norvegicus
tccgtactcactgaagtgtgggcta

SEQ ID NO: 560237 - DNA, 25 bp, Rattus norvegicus
catggacgcccacccggagtttcag

SEQ ID NO: 560238 - DNA, 25 bp, Rattus norvegicus
tcccatcatgcagcggggaaccgct

SEQ ID NO: 560239 - DNA, 25 bp, Rattus norvegicus
accgctgctgtcgatacgtcacttc

SEQ ID NO: 560240 - DNA, 25 bp, Rattus norvegicus
tcgccattttgggtgcgggcaagtt

SEQ ID NO: 560241 - DNA, 25 bp, Rattus norvegicus
tcgtgtgcaacgacgttcgccattt

SEQ ID NO: 560242 - DNA, 25 bp, Rattus norvegicus
tggctctcctctgctgagaccggga

SEQ ID NO: 560243 - DNA, 25 bp, Rattus norvegicus
ggtgcagcgacagcgctccgtttct

SEQ ID NO: 560244 - DNA, 25 bp, Rattus norvegicus
atttaaaggcggcagggctcgactc

SEQ ID NO: 560245 - DNA, 25 bp, Rattus norvegicus
caccggggaagcaaagcccgtgtag

SEQ ID NO: 560246 - DNA, 25 bp, Rattus norvegicus
ttccacccggtctaagcctctgatg

SEQ ID NO: 560247 - DNA, 25 bp, Rattus norvegicus
gacagcgctccgtttctcccgggag

SEQ ID NO: 560248 - DNA, 25 bp, Rattus norvegicus
cggcaccgcgggtcggtagacctct

SEQ ID NO: 560249 - DNA, 25 bp, Rattus norvegicus
ctgccctacggccattggaccatgg

SEQ ID NO: 560250 - DNA, 25 bp, Rattus norvegicus
ctacggccattggaccatggctgga

SEQ ID NO: 560251 - DNA, 25 bp, Rattus norvegicus
cccaggctcttgagatcggatcaaa

SEQ ID NO: 560252 - DNA, 25 bp, Rattus norvegicus
tccaagcacaaacgctcccggagtc

SEQ ID NO: 560253 - DNA, 25 bp, Rattus norvegicus
tcaaattcaaggtcgcggcccaccg

SEQ ID NO: 560254 - DNA, 25 bp, Rattus norvegicus
tcggatcaaattcaaggtcgcggcc

SEQ ID NO: 560255 - DNA, 25 bp, Rattus norvegicus
cacccggtctaagcctctgatgatc

SEQ ID NO: 560256 - DNA, 25 bp, Rattus norvegicus
ggcggctgacaggtaccgcgcttcc

SEQ ID NO: 560257 - DNA, 25 bp, Rattus norvegicus
tgcaggctccgccggtacctacgtt

SEQ ID NO: 560258 - DNA, 25 bp, Rattus norvegicus
ttgtgaggagctgcccggaacgccc

SEQ ID NO: 560259 - DNA, 25 bp, Rattus norvegicus
gaagcgcctttgtgaggagctgccc

SEQ ID NO: 560260 - DNA, 25 bp, Rattus norvegicus
tttgcggcgccgcatcccgcgaggt

SEQ ID NO: 560261 - DNA, 25 bp, Rattus norvegicus
ctccgagcctatgccggtggcgacg

SEQ ID NO: 560262 - DNA, 25 bp, Rattus norvegicus
ggaacttcctccgagcctatgccgg

SEQ ID NO: 560263 - DNA, 25 bp, Rattus norvegicus
tacctacgttcaaccggtgcttgcg

SEQ ID NO: 560264 - DNA, 25 bp, Rattus norvegicus
gctccgcgttccactcggcctcgcg

SEQ ID NO: 560265 - DNA, 25 bp, Rattus norvegicus
cgagcctctctctcgtccgcgctca

SEQ ID NO: 560266 - DNA, 25 bp, Rattus norvegicus
agctcactacaaagcgggcccgagc

SEQ ID NO: 560267 - DNA, 25 bp, Rattus norvegicus
gcagcccggggagctcactacaaag

SEQ ID NO: 560268 - DNA, 25 bp, Rattus norvegicus
gccactggatttgcctgcagcccgg

SEQ ID NO: 560269 - DNA, 25 bp, Rattus norvegicus
ccgtgaggcgccactggatttgcct

SEQ ID NO: 560270 - DNA, 25 bp, Rattus norvegicus
tacgttcaaccggtgcttgcgccgc

SEQ ID NO: 560271 - DNA, 25 bp, Rattus norvegicus
gagcgcagttccgagaggacttctg

SEQ ID NO: 560272 - DNA, 25 bp, Rattus norvegicus
tctgcctttaccagggcgacagggg

SEQ ID NO: 560273 - DNA, 25 bp, Rattus norvegicus
aaggcggaaggcaacgctcggcttc

SEQ ID NO: 560274 - DNA, 25 bp, Rattus norvegicus
cggaaggcaacgctcggcttctctg

SEQ ID NO: 560275 - DNA, 25 bp, Rattus norvegicus
ggcaacgctcggcttctctggacaa

SEQ ID NO: 560276 - DNA, 25 bp, Rattus norvegicus
cttctgcctttaccagggcgacagg

SEQ ID NO: 560277 - DNA, 25 bp, Rattus norvegicus
ctggagcgcagttccgagaggactt

SEQ ID NO: 560278 - DNA, 25 bp, Rattus norvegicus
agttccgagaggacttctgccttta

SEQ ID NO: 560279 - DNA, 25 bp, Rattus norvegicus
ttccgagaggacttctgcctttacc

SEQ ID NO: 560280 - DNA, 25 bp, Rattus norvegicus
cgagaggacttctgcctttaccagg

SEQ ID NO: 560281 - DNA, 25 bp, Rattus norvegicus
aggacttctgcctttaccagggcga

SEQ ID NO: 560282 - DNA, 25 bp, Rattus norvegicus
cgctccggtccgcttgccgggaaag

SEQ ID NO: 560283 - DNA, 25 bp, Rattus norvegicus
cgaagggtccgctccggtccgcttg

SEQ ID NO: 560284 - DNA, 25 bp, Rattus norvegicus
gcttctctggacaacctgggcgggg

SEQ ID NO: 560285 - DNA, 25 bp, Rattus norvegicus
gccggcagccctgtgctgggcatct

SEQ ID NO: 560286 - DNA, 25 bp, Rattus norvegicus
ggctccgtagcacccggccacagct

SEQ ID NO: 560287 - DNA, 25 bp, Rattus norvegicus
ctggcagagctatcggctccgtagc

SEQ ID NO: 560288 - DNA, 25 bp, Rattus norvegicus
ctcgggttgtgagatggcgacggca

SEQ ID NO: 560289 - DNA, 25 bp, Rattus norvegicus
tggctttagcgtgcacctggagttg

SEQ ID NO: 560290 - DNA, 25 bp, Rattus norvegicus
cccacgtgagcctgcgcgttaggta

SEQ ID NO: 560291 - DNA, 25 bp, Rattus norvegicus
gacctggctttagcgtgcacctgga

SEQ ID NO: 560292 - DNA, 25 bp, Rattus norvegicus
tacaccgcggacctggctttagcgt

SEQ ID NO: 560293 - DNA, 25 bp, Rattus norvegicus
cgttacaccgcggacctggctttag

SEQ ID NO: 560294 - DNA, 25 bp, Rattus norvegicus
agcctaaggccctcgttacaccgcg

SEQ ID NO: 560295 - DNA, 25 bp, Rattus norvegicus
agcctgcgcgttaggtagcgcagtc

SEQ ID NO: 560296 - DNA, 25 bp, Rattus norvegicus
cgggcagtggttccccacgtctcgg

SEQ ID NO: 560297 - DNA, 25 bp, Rattus norvegicus
gagctatcggctccgtagcacccgg

SEQ ID NO: 560298 - DNA, 25 bp, Rattus norvegicus
agcggactggcagagctatcggctc

SEQ ID NO: 560299 - DNA, 25 bp, Rattus norvegicus
tgtgttgatttggacaggtcggctc

SEQ ID NO: 560300 - DNA, 25 bp, Rattus norvegicus
acaggtcggctcgaagctcatctcc

SEQ ID NO: 560301 - DNA, 25 bp, Rattus norvegicus
gcagccatctcagcgtgtgtgttga

SEQ ID NO: 560302 - DNA, 25 bp, Rattus norvegicus
tgttgtccggcgtgcagccatctca

SEQ ID NO: 560303 - DNA, 25 bp, Rattus norvegicus
gagcgtcgtcctcggcagtgttgtc

SEQ ID NO: 560304 - DNA, 25 bp, Rattus norvegicus
caagctggcgctggcttgtgtcatc

SEQ ID NO: 560305 - DNA, 25 bp, Rattus norvegicus
ccctacttcagagccatgtttcttt

SEQ ID NO: 560306 - DNA, 25 bp, Rattus norvegicus
cagagccatgtttctttctgaaatg

SEQ ID NO: 560307 - DNA, 25 bp, Rattus norvegicus
tttctgaaatgtctgaggctaagca

SEQ ID NO: 560308 - DNA, 25 bp, Rattus norvegicus
aagctcatctcctgccacaagctgg

SEQ ID NO: 560309 - DNA, 25 bp, Rattus norvegicus
attcgggactttgacggcgatgccg

SEQ ID NO: 560310 - DNA, 25 bp, Rattus norvegicus
gctaagcaggcgctgatcgagattc

SEQ ID NO: 560311 - DNA, 25 bp, Rattus norvegicus
cgctgatcgagattcgggactttga

SEQ ID NO: 560312 - DNA, 25 bp, Rattus norvegicus
aggacttggtgaagttcgtctactc

SEQ ID NO: 560313 - DNA, 25 bp, Rattus norvegicus
caaactttccgggtctcagccaggc

SEQ ID NO: 560314 - DNA, 25 bp, Rattus norvegicus
ggctctcccagaatcagggccggca

SEQ ID NO: 560315 - DNA, 25 bp, Rattus norvegicus
ctcccctggagaatagtaacccgca

SEQ ID NO: 560316 - DNA, 25 bp, Rattus norvegicus
ctcttggagccttctagaataaaaa

SEQ ID NO: 560317 - DNA, 25 bp, Rattus norvegicus
ttccgggtctcagccaggcccgtag

SEQ ID NO: 560318 - DNA, 25 bp, Rattus norvegicus
gatcccaaactttccgggtctcagc

SEQ ID NO: 560319 - DNA, 25 bp, Rattus norvegicus
agacgcagatcccaaactttccggg

SEQ ID NO: 560320 - DNA, 25 bp, Rattus norvegicus
ttgtagacgcagatcccaaactttc

SEQ ID NO: 560321 - DNA, 25 bp, Rattus norvegicus
cagtccttgtagacgcagatcccaa

SEQ ID NO: 560322 - DNA, 25 bp, Rattus norvegicus
tccacagtccttgtagacgcagatc

SEQ ID NO: 560323 - DNA, 25 bp, Rattus norvegicus
cagctacttccacagtccttgtaga

SEQ ID NO: 560324 - DNA, 25 bp, Rattus norvegicus
ggaccagctacttccacagtccttg

SEQ ID NO: 560325 - DNA, 25 bp, Rattus norvegicus
tctggaatcccggaccagctacttc

SEQ ID NO: 560326 - DNA, 25 bp, Rattus norvegicus
ccctcttggagccttctagaataaa

SEQ ID NO: 560327 - DNA, 25 bp, Rattus norvegicus
aacagcagctctgtaccacaccaga

SEQ ID NO: 560328 - DNA, 25 bp, Rattus norvegicus
gcttcctttggcgtctctagagcta

SEQ ID NO: 560329 - DNA, 25 bp, Rattus norvegicus
ccgcatttatatgaccgggaaggtt

SEQ ID NO: 560330 - DNA, 25 bp, Rattus norvegicus
acgtcgggatcgaacagcagctctg

SEQ ID NO: 560331 - DNA, 25 bp, Rattus norvegicus
ggcggaagtcgtagcgcgcacttcc

SEQ ID NO: 560332 - DNA, 25 bp, Rattus norvegicus
tcgctgcgatcacccggtgtgctac

SEQ ID NO: 560333 - DNA, 25 bp, Rattus norvegicus
gtgtgctaccggtgctctaccaaga

SEQ ID NO: 560334 - DNA, 25 bp, Rattus norvegicus
cgagcagcgctactgcgccgtatgc

SEQ ID NO: 560335 - DNA, 25 bp, Rattus norvegicus
ccgtatgccgcgaggagctacgcca

SEQ ID NO: 560336 - DNA, 25 bp, Rattus norvegicus
tggactcctgatggctttgcctgct

SEQ ID NO: 560337 - DNA, 25 bp, Rattus norvegicus
ctttgcctgctcagtgtccggctgc

SEQ ID NO: 560338 - DNA, 25 bp, Rattus norvegicus
cggtcgaggcgccatgcgatcaccg

SEQ ID NO: 560339 - DNA, 25 bp, Rattus norvegicus
ctctaccaagatgcgggtgctgtgc

SEQ ID NO: 560340 - DNA, 25 bp, Rattus norvegicus
tttgcactggagtcacggggtagaa

SEQ ID NO: 560341 - DNA, 25 bp, Rattus norvegicus
aggcggacctagagcagcttcaccg

SEQ ID NO: 560342 - DNA, 25 bp, Rattus norvegicus
tttcatcaatggagaggcggaccta

SEQ ID NO: 560343 - DNA, 25 bp, Rattus norvegicus
cctggaatcaggtctcgaaggctgc

SEQ ID NO: 560344 - DNA, 25 bp, Rattus norvegicus
tcggtctttgcctgctgtctgcagc

SEQ ID NO: 560345 - DNA, 25 bp, Rattus norvegicus
cacggtgccaagcatgtcggtcttt

SEQ ID NO: 560346 - DNA, 25 bp, Rattus norvegicus
gctcagaagcgaacgcgggaatccc

SEQ ID NO: 560347 - DNA, 25 bp, Rattus norvegicus
cgaagtttgctcagggcttggccaa

SEQ ID NO: 560348 - DNA, 25 bp, Rattus norvegicus
agcgaaggggcagcgcaaccttttc

SEQ ID NO: 560349 - DNA, 25 bp, Rattus norvegicus
cgccagtcaggagccgaagtttgct

SEQ ID NO: 560350 - DNA, 25 bp, Rattus norvegicus
ccacggctcagaacgacaggcacag

SEQ ID NO: 560351 - DNA, 25 bp, Rattus norvegicus
gcaaatacctggagcccggcgccag

SEQ ID NO: 560352 - DNA, 25 bp, Rattus norvegicus
gctccggtcacacgcaaatacctgg

SEQ ID NO: 560353 - DNA, 25 bp, Rattus norvegicus
agcccataaatagccgggactcgga

SEQ ID NO: 560354 - DNA, 25 bp, Rattus norvegicus
tgcgaattccgcacccgggcagaca

SEQ ID NO: 560355 - DNA, 25 bp, Rattus norvegicus
gcgcctcgcggactgcaaagtagtc

SEQ ID NO: 560356 - DNA, 25 bp, Rattus norvegicus
tcgtatcctgaatccgtagtcggca

SEQ ID NO: 560357 - DNA, 25 bp, Rattus norvegicus
gcggcacggttgttcgtatcctgaa

SEQ ID NO: 560358 - DNA, 25 bp, Rattus norvegicus
tttctttttatctaggggccagagc

SEQ ID NO: 560359 - DNA, 25 bp, Rattus norvegicus
aaccgagacagagtggagctgcgtc

SEQ ID NO: 560360 - DNA, 25 bp, Rattus norvegicus
aggctcacctgaacgctctcggaac

SEQ ID NO: 560361 - DNA, 25 bp, Rattus norvegicus
tcaccgttgctaggcgacagggaag

SEQ ID NO: 560362 - DNA, 25 bp, Rattus norvegicus
ggaaccggcagcttcaccgttgcta

SEQ ID NO: 560363 - DNA, 25 bp, Rattus norvegicus
aggaattgacgcttgcggaggaacc

SEQ ID NO: 560364 - DNA, 25 bp, Rattus norvegicus
aaaacgcactctctcagaggcggga

SEQ ID NO: 560365 - DNA, 25 bp, Rattus norvegicus
ggaggcaaagagaccttccgttgca

SEQ ID NO: 560366 - DNA, 25 bp, Rattus norvegicus
tgcctgacgtcgctcaccaattggc

SEQ ID NO: 560367 - DNA, 25 bp, Rattus norvegicus
tgattggagcacgactgcgagcaga

SEQ ID NO: 560368 - DNA, 25 bp, Rattus norvegicus
ctgagcctctgtgattggagcacga

SEQ ID NO: 560369 - DNA, 25 bp, Rattus norvegicus
ggtgacccaaggacgctttccaatg

SEQ ID NO: 560370 - DNA, 25 bp, Rattus norvegicus
ccagcggacggacaccggctgcgct

SEQ ID NO: 560371 - DNA, 25 bp, Rattus norvegicus
cccaaactccacacgggtggccgcg

SEQ ID NO: 560372 - DNA, 25 bp, Rattus norvegicus
ctgcgctcgggacgcctggagattt

SEQ ID NO: 560373 - DNA, 25 bp, Rattus norvegicus
gcctggagatttcgttgcgctccca

SEQ ID NO: 560374 - DNA, 25 bp, Rattus norvegicus
tgcgctcccaggacgtgttggcgct

SEQ ID NO: 560375 - DNA, 25 bp, Rattus norvegicus
ctcccaggacgtgttggcgctgttc

SEQ ID NO: 560376 - DNA, 25 bp, Rattus norvegicus
tggcgctgttcggtgccccagagtt

SEQ ID NO: 560377 - DNA, 25 bp, Rattus norvegicus
tccagagcccgctaacttctagctg

SEQ ID NO: 560378 - DNA, 25 bp, Rattus norvegicus
taacttctagctgcgggctccagcc

SEQ ID NO: 560379 - DNA, 25 bp, Rattus norvegicus
acgcgctttcggcttcgagagaggg

SEQ ID NO: 560380 - DNA, 25 bp, Rattus norvegicus
cggcttcgagagaggggtgacccaa

SEQ ID NO: 560381 - DNA, 25 bp, Rattus norvegicus
tgccccagagttcgggctccagagc

SEQ ID NO: 560382 - DNA, 25 bp, Rattus norvegicus
cgctaacttctagctgcgggctcca

SEQ ID NO: 560383 - DNA, 25 bp, Rattus norvegicus
gagctgacctctccattcctggctg

SEQ ID NO: 560384 - DNA, 25 bp, Rattus norvegicus
ccgatcagtctcacggactagaagc

SEQ ID NO: 560385 - DNA, 25 bp, Rattus norvegicus
cgcgggcaagttttcgttgtctcct

SEQ ID NO: 560386 - DNA, 25 bp, Rattus norvegicus
actcgcactcacacaggagctgtcg

SEQ ID NO: 560387 - DNA, 25 bp, Rattus norvegicus
cacaggagctgtcgggtagaacagt

SEQ ID NO: 560388 - DNA, 25 bp, Rattus norvegicus
gaacagtctggacagttctgagccc

SEQ ID NO: 560389 - DNA, 25 bp, Rattus norvegicus
cagcggacggtgttaatacccagtc

SEQ ID NO: 560390 - DNA, 25 bp, Rattus norvegicus
agtccctccagtttagtctcccaag

SEQ ID NO: 560391 - DNA, 25 bp, Rattus norvegicus
tagtctcccaagtccgtcccagagg

SEQ ID NO: 560392 - DNA, 25 bp, Rattus norvegicus
ccgagctgggaagggtagcacctac

SEQ ID NO: 560393 - DNA, 25 bp, Rattus norvegicus
tagcacctacgagcccttcggtgtc

SEQ ID NO: 560394 - DNA, 25 bp, Rattus norvegicus
agacgcacggggagctgacctctcc

SEQ ID NO: 560395 - DNA, 25 bp, Rattus norvegicus
attcctggctgcaggccggccgtct

SEQ ID NO: 560396 - DNA, 25 bp, Rattus norvegicus
ctcctccgaggaagtgaaactcgca

SEQ ID NO: 560397 - DNA, 25 bp, Rattus norvegicus
cgcaccggagacgacttcttcttga

SEQ ID NO: 560398 - DNA, 25 bp, Rattus norvegicus
cactgatacggatgccggcgctgag

SEQ ID NO: 560399 - DNA, 25 bp, Rattus norvegicus
gcgttgctcggagcgcctaatggct

SEQ ID NO: 560400 - DNA, 25 bp, Rattus norvegicus
cctaatggctctggcactgatacgg

SEQ ID NO: 560401 - DNA, 25 bp, Rattus norvegicus
cgacttcttcttgaccggccggctt

SEQ ID NO: 560402 - DNA, 25 bp, Rattus norvegicus
agctctcgcgcaccggagacgactt

SEQ ID NO: 560403 - DNA, 25 bp, Rattus norvegicus
tgaactggccgctgctctcggaacc

SEQ ID NO: 560404 - DNA, 25 bp, Rattus norvegicus
acgaagacgcagagctagatacggc

SEQ ID NO: 560405 - DNA, 25 bp, Rattus norvegicus
tggacgctgagctagacgaagacgc

SEQ ID NO: 560406 - DNA, 25 bp, Rattus norvegicus
aggcactggacgctgagctagacga

SEQ ID NO: 560407 - DNA, 25 bp, Rattus norvegicus
atggacgaagcagtaggcgtgctca

SEQ ID NO: 560408 - DNA, 25 bp, Rattus norvegicus
cgggctccagatggacgaagcagta

SEQ ID NO: 560409 - DNA, 25 bp, Rattus norvegicus
ctgcatgcatgaggcgttgctcgga

SEQ ID NO: 560410 - DNA, 25 bp, Rattus norvegicus
ggcttttcgttccattcccgctctg

SEQ ID NO: 560411 - DNA, 25 bp, Rattus norvegicus
actgagtgacaggaagccgggcaat

SEQ ID NO: 560412 - DNA, 25 bp, Rattus norvegicus
ccaacctgcaaaacggaggcgcaca

SEQ ID NO: 560413 - DNA, 25 bp, Rattus norvegicus
ttcccagtagctctgtgcgtgtccc

SEQ ID NO: 560414 - DNA, 25 bp, Rattus norvegicus
tccctccgggtttcactttattgca

SEQ ID NO: 560415 - DNA, 25 bp, Rattus norvegicus
tgtttgcaaagtcccacatgctttt

SEQ ID NO: 560416 - DNA, 25 bp, Rattus norvegicus
tggcagctgcactctcggtgcaacc

SEQ ID NO: 560417 - DNA, 25 bp, Rattus norvegicus
tggagaaatcctgcatagtcacttg

SEQ ID NO: 560418 - DNA, 25 bp, Rattus norvegicus
tcaagcaatttaccttgtcggagtg

SEQ ID NO: 560419 - DNA, 25 bp, Rattus norvegicus
ctggataaccggttcctgctcgcgc

SEQ ID NO: 560420 - DNA, 25 bp, Rattus norvegicus
gcctgatgaagattgatcacctttc

SEQ ID NO: 560421 - DNA, 25 bp, Rattus norvegicus
ctaactccggagctcgggtggcaaa

SEQ ID NO: 560422 - DNA, 25 bp, Rattus norvegicus
tggcaaattccgctcagaaggagtc

SEQ ID NO: 560423 - DNA, 25 bp, Rattus norvegicus
agtggcgtcaagctgctggataacc

SEQ ID NO: 560424 - DNA, 25 bp, Rattus norvegicus
gtggcttgtcttgctcggttgttta

SEQ ID NO: 560425 - DNA, 25 bp, Rattus norvegicus
ggggctgcgactgccgctcatcaaa

SEQ ID NO: 560426 - DNA, 25 bp, Rattus norvegicus
taaaatacggtaacagaatatgacg

SEQ ID NO: 560427 - DNA, 25 bp, Rattus norvegicus
gacacttttctttggagtccgaata

SEQ ID NO: 560428 - DNA, 25 bp, Rattus norvegicus
gcgacacttttctttggagtccgaa

SEQ ID NO: 560429 - DNA, 25 bp, Rattus norvegicus
cgcgacacttttctttggagtccga

SEQ ID NO: 560430 - DNA, 25 bp, Rattus norvegicus
ccacgcgacacttttctttggagtc

SEQ ID NO: 560431 - DNA, 25 bp, Rattus norvegicus
aaaaggggctgcgactgccgctcat

SEQ ID NO: 560432 - DNA, 25 bp, Rattus norvegicus
cccgctgagtgaaaaggggctgcga

SEQ ID NO: 560433 - DNA, 25 bp, Rattus norvegicus
cgcggtccgctgcagtcgctgaccg

SEQ ID NO: 560434 - DNA, 25 bp, Rattus norvegicus
tagagcggagcacggggacgcccag

SEQ ID NO: 560435 - DNA, 25 bp, Rattus norvegicus
cagccgctgggagcaaggtagagcg

SEQ ID NO: 560436 - DNA, 25 bp, Rattus norvegicus
gtgagttcggcagccgctgggagca

SEQ ID NO: 560437 - DNA, 25 bp, Rattus norvegicus
tgcgactgccgctcatcaaagtgct

SEQ ID NO: 560438 - DNA, 25 bp, Rattus norvegicus
ctgcgactgccgctcatcaaagtgc

SEQ ID NO: 560439 - DNA, 25 bp, Rattus norvegicus
aactctgctagtctggcctcttcgg

SEQ ID NO: 560440 - DNA, 25 bp, Rattus norvegicus
gcataggaatgtgcccgcgaggtcc

SEQ ID NO: 560441 - DNA, 25 bp, Rattus norvegicus
gcggctgtacgcataggaatgtgcc

SEQ ID NO: 560442 - DNA, 25 bp, Rattus norvegicus
ttcgaacctcgccagggtcaggctt

SEQ ID NO: 560443 - DNA, 25 bp, Rattus norvegicus
cagtcttcgaacctcgccagggtca

SEQ ID NO: 560444 - DNA, 25 bp, Rattus norvegicus
tagtctggcctcttcggggctggtt

SEQ ID NO: 560445 - DNA, 25 bp, Rattus norvegicus
atccctgtcctggtcttcgggctgt

SEQ ID NO: 560446 - DNA, 25 bp, Rattus norvegicus
ctgaaggcatccctgtcctggtctt

SEQ ID NO: 560447 - DNA, 25 bp, Rattus norvegicus
tcctggggagtgcactgaaggcatc

SEQ ID NO: 560448 - DNA, 25 bp, Rattus norvegicus
cacgaaaacgctgaggtcctgggga

SEQ ID NO: 560449 - DNA, 25 bp, Rattus norvegicus
gcgcactagtttggcgggcacgaaa

SEQ ID NO: 560450 - DNA, 25 bp, Rattus norvegicus
gggccatcctgagtttaaagaaaga

SEQ ID NO: 560451 - DNA, 25 bp, Rattus norvegicus
cacgtctggctaggaaactctgcta

SEQ ID NO: 560452 - DNA, 25 bp, Rattus norvegicus
ggctggttcgttggcagtcttcgaa

SEQ ID NO: 560453 - DNA, 25 bp, Rattus norvegicus
tgcggcccaactccacggtccaggt

SEQ ID NO: 560454 - DNA, 25 bp, Rattus norvegicus
gcactgtgctgagctgccgcaacgc

SEQ ID NO: 560455 - DNA, 25 bp, Rattus norvegicus
acgcgactcccaggctgcggcccaa

SEQ ID NO: 560456 - DNA, 25 bp, Rattus norvegicus
ctgtgctgagctgccgcaacgcgac

SEQ ID NO: 560457 - DNA, 25 bp, Rattus norvegicus
ttctaggtctctgtccgatagcggg

SEQ ID NO: 560458 - DNA, 25 bp, Rattus norvegicus
ctaggtctctgtccgatagcgggca

SEQ ID NO: 560459 - DNA, 25 bp, Rattus norvegicus
tctctgtccgatagcgggcaggatt

SEQ ID NO: 560460 - DNA, 25 bp, Rattus norvegicus
tccgatagcgggcaggattcttgct

SEQ ID NO: 560461 - DNA, 25 bp, Rattus norvegicus
atagcgggcaggattcttgcttgcc

SEQ ID NO: 560462 - DNA, 25 bp, Rattus norvegicus
gcaggattcttgcttgccctaagga

SEQ ID NO: 560463 - DNA, 25 bp, Rattus norvegicus
aggattcttgcttgccctaaggagc

SEQ ID NO: 560464 - DNA, 25 bp, Rattus norvegicus
ttcttgcttgccctaaggagcccga

SEQ ID NO: 560465 - DNA, 25 bp, Rattus norvegicus
ttgcttgccctaaggagcccgactc

SEQ ID NO: 560466 - DNA, 25 bp, Rattus norvegicus
tgctccaccgccgctgaggggcgtt

SEQ ID NO: 560467 - DNA, 25 bp, Rattus norvegicus
cgtcgaagcgtacagtgggaaagca

SEQ ID NO: 560468 - DNA, 25 bp, Rattus norvegicus
aaagccgacatcctgccatcttgca

SEQ ID NO: 560469 - DNA, 25 bp, Rattus norvegicus
ccatcttgcattgtgctctgaggtg

SEQ ID NO: 560470 - DNA, 25 bp, Rattus norvegicus
acgatacctcgggagcctgtgtttc

SEQ ID NO: 560471 - DNA, 25 bp, Rattus norvegicus
gctcgttctcctcactgtcgctgga

SEQ ID NO: 560472 - DNA, 25 bp, Rattus norvegicus
cgctctcagagtcggaggaactgtc

SEQ ID NO: 560473 - DNA, 25 bp, Rattus norvegicus
aggaactgtctgactcgctgctctc

SEQ ID NO: 560474 - DNA, 25 bp, Rattus norvegicus
gctctctgactctgcactactggaa

SEQ ID NO: 560475 - DNA, 25 bp, Rattus norvegicus
actactggaatgtgctgaggccacg

SEQ ID NO: 560476 - DNA, 25 bp, Rattus norvegicus
gctcgggaatcgtctgcggagcact

SEQ ID NO: 560477 - DNA, 25 bp, Rattus norvegicus
ggtacggtcaagaggatcacacaca

SEQ ID NO: 560478 - DNA, 25 bp, Rattus norvegicus
gcctatccatatctgctcctagaca

SEQ ID NO: 560479 - DNA, 25 bp, Rattus norvegicus
cctagacagtaagcgcgcaccaatg

SEQ ID NO: 560480 - DNA, 25 bp, Rattus norvegicus
tgtctccactgccaagcgcttacgg

SEQ ID NO: 560481 - DNA, 25 bp, Rattus norvegicus
cctgagaagcccagatccagtagca

SEQ ID NO: 560482 - DNA, 25 bp, Rattus norvegicus
ggctcccgcgtttccattgaagacg

SEQ ID NO: 560483 - DNA, 25 bp, Rattus norvegicus
gtccgagttcacgtagccctcattg

SEQ ID NO: 560484 - DNA, 25 bp, Rattus norvegicus
ctggaccgctgtccgagttcacgta

SEQ ID NO: 560485 - DNA, 25 bp, Rattus norvegicus
agcgcagttctggaccgctgtccga

SEQ ID NO: 560486 - DNA, 25 bp, Rattus norvegicus
ttccattgaagacgcagcgcagttc

SEQ ID NO: 560487 - DNA, 25 bp, Rattus norvegicus
gccgaagcggcaggctcccgcgttt

SEQ ID NO: 560488 - DNA, 25 bp, Rattus norvegicus
tagacctagtacgacgccgaagcgg

SEQ ID NO: 560489 - DNA, 25 bp, Rattus norvegicus
gaaggccacgcaggcgatgaaagcc

SEQ ID NO: 560490 - DNA, 25 bp, Rattus norvegicus
gctgaaagcgcacgtccagcagcag

SEQ ID NO: 560491 - DNA, 25 bp, Rattus norvegicus
gctgctgatctgctgaaagcgcacg

SEQ ID NO: 560492 - DNA, 25 bp, Rattus norvegicus
tccagtagcactgcacgacggcggt

SEQ ID NO: 560493 - DNA, 25 bp, Rattus norvegicus
agccctcattgacaatcggcccgaa

SEQ ID NO: 560494 - DNA, 25 bp, Rattus norvegicus
agcactgcacgacggcggtctcgga

SEQ ID NO: 560495 - DNA, 25 bp, Rattus norvegicus
ctccctcagattcggccaatggtgg

SEQ ID NO: 560496 - DNA, 25 bp, Rattus norvegicus
tctaacggcaaggtttgggtgacag

SEQ ID NO: 560497 - DNA, 25 bp, Rattus norvegicus
ggctggtatctaacggcaaggtttg

SEQ ID NO: 560498 - DNA, 25 bp, Rattus norvegicus
ggacagaggctggtatctaacggca

SEQ ID NO: 560499 - DNA, 25 bp, Rattus norvegicus
ttcggggacagaggctggtatctaa

SEQ ID NO: 560500 - DNA, 25 bp, Rattus norvegicus
ctctaaggaggggacagcgggatta

SEQ ID NO: 560501 - DNA, 25 bp, Rattus norvegicus
cgaccgaagagctgctctaaggagg

SEQ ID NO: 560502 - DNA, 25 bp, Rattus norvegicus
gcggcgaccgaagagctgctctaag

SEQ ID NO: 560503 - DNA, 25 bp, Rattus norvegicus
gcaacgcctgtctgtgcggaggcag

SEQ ID NO: 560504 - DNA, 25 bp, Rattus norvegicus
cggctcccgcaaaggagcgccgcgc

SEQ ID NO: 560505 - DNA, 25 bp, Rattus norvegicus
ggggctccctcagattcggccaatg

SEQ ID NO: 560506 - DNA, 25 bp, Rattus norvegicus
aaggaggcggggctccctcagattc

SEQ ID NO: 560507 - DNA, 25 bp, Rattus norvegicus
accgcggctggcaacgcctgtctgt

SEQ ID NO: 560508 - DNA, 25 bp, Rattus norvegicus
tgttccacgcggctccagcggggat

SEQ ID NO: 560509 - DNA, 25 bp, Rattus norvegicus
accatgttcggcgactccagccgta

SEQ ID NO: 560510 - DNA, 25 bp, Rattus norvegicus
taccgggccagagtccagtgaggcc

SEQ ID NO: 560511 - DNA, 25 bp, Rattus norvegicus
agtgcatagcaggaacgccttctcc

SEQ ID NO: 560512 - DNA, 25 bp, Rattus norvegicus
ccgctacgtgaaagcagtccgctcg

SEQ ID NO: 560513 - DNA, 25 bp, Rattus norvegicus
gtagccacagctactgcacccggtg

SEQ ID NO: 560514 - DNA, 25 bp, Rattus norvegicus
cgggagaccacgagcttcagtagcc

SEQ ID NO: 560515 - DNA, 25 bp, Rattus norvegicus
actgtcctgggttaggagaccgcga

SEQ ID NO: 560516 - DNA, 25 bp, Rattus norvegicus
cctctccgcggagaaggctctggag

SEQ ID NO: 560517 - DNA, 25 bp, Rattus norvegicus
tgagcaacctcagcctcaccatgtt

SEQ ID NO: 560518 - DNA, 25 bp, Rattus norvegicus
gaccctgttcgtcagcgcttgagca

SEQ ID NO: 560519 - DNA, 25 bp, Rattus norvegicus
gccagacatggagctgccggaccct

SEQ ID NO: 560520 - DNA, 25 bp, Rattus norvegicus
agctggcccactagcgggaacgtga

SEQ ID NO: 560521 - DNA, 25 bp, Rattus norvegicus
agccctgttgccaagggaaccgcca

SEQ ID NO: 560522 - DNA, 25 bp, Rattus norvegicus
cacggcttcagccagggtactgtcc

SEQ ID NO: 560523 - DNA, 25 bp, Rattus norvegicus
agcctatggtggtcaagaggaaaca

SEQ ID NO: 560524 - DNA, 25 bp, Rattus norvegicus
caataaggtcatttaaaaggtgttg

SEQ ID NO: 560525 - DNA, 25 bp, Rattus norvegicus
cctatggtggtcaagaggaaacaga

SEQ ID NO: 560526 - DNA, 25 bp, Rattus norvegicus
aaagccagaagcctatggtggtcaa

SEQ ID NO: 560527 - DNA, 25 bp, Rattus norvegicus
tcaaagccagaagcctatggtggtc

SEQ ID NO: 560528 - DNA, 25 bp, Rattus norvegicus
agccatccacatggccagtgccatc

SEQ ID NO: 560529 - DNA, 25 bp, Rattus norvegicus
tggcagccatccacatggccagtgc

SEQ ID NO: 560530 - DNA, 25 bp, Rattus norvegicus
tctgcgtatggcagccatccacatg

SEQ ID NO: 560531 - DNA, 25 bp, Rattus norvegicus
ctgatctgcgtatggcagccatcca

SEQ ID NO: 560532 - DNA, 25 bp, Rattus norvegicus
aaggagaggagttgctgccatgtcc

SEQ ID NO: 560533 - DNA, 25 bp, Rattus norvegicus
ccgcaaggagaggagttgctgccat

SEQ ID NO: 560534 - DNA, 25 bp, Rattus norvegicus
tccagccgccgcaaggagaggagtt

SEQ ID NO: 560535 - DNA, 25 bp, Rattus norvegicus
tagtatctttctctccgtctccagc

SEQ ID NO: 560536 - DNA, 25 bp, Rattus norvegicus
cgtatggcagccatccacatggcca

SEQ ID NO: 560537 - DNA, 25 bp, Rattus norvegicus
ccagggaaatgatgtgcggagacca

SEQ ID NO: 560538 - DNA, 25 bp, Rattus norvegicus
cccgatggagcggatgcgcagacac

SEQ ID NO: 560539 - DNA, 25 bp, Rattus norvegicus
gcgcagacaccgtaggagccacaga

SEQ ID NO: 560540 - DNA, 25 bp, Rattus norvegicus
ttgtctagggacacctccagctcgg

SEQ ID NO: 560541 - DNA, 25 bp, Rattus norvegicus
tcagctccagcacttgttgccgcgg

SEQ ID NO: 560542 - DNA, 25 bp, Rattus norvegicus
ccctcattgcgccaagaaaaccaaa

SEQ ID NO: 560543 - DNA, 25 bp, Rattus norvegicus
gcgtgtggctaagcctatacggctc

SEQ ID NO: 560544 - DNA, 25 bp, Rattus norvegicus
cagggactagtccaaactcttcagc

SEQ ID NO: 560545 - DNA, 25 bp, Rattus norvegicus
gcgtggcgctcagtgagaatttttc

SEQ ID NO: 560546 - DNA, 25 bp, Rattus norvegicus
aaccaaagttacactggggcgcgcg

SEQ ID NO: 560547 - DNA, 25 bp, Rattus norvegicus
gggcgcgcggtctccaaagactacc

SEQ ID NO: 560548 - DNA, 25 bp, Rattus norvegicus
agaagagaccgagtcccaaaccttg

SEQ ID NO: 560549 - DNA, 25 bp, Rattus norvegicus
cccaaaccttgctgagatccaggga

SEQ ID NO: 560550 - DNA, 25 bp, Rattus norvegicus
gagaatttttctgccagcgccggcg

SEQ ID NO: 560551 - DNA, 25 bp, Rattus norvegicus
cgagcggacgccacactgtgtgtaa

SEQ ID NO: 560552 - DNA, 25 bp, Rattus norvegicus
aggacgagcggacgccacactgtgt

SEQ ID NO: 560553 - DNA, 25 bp, Rattus norvegicus
tgaggacgagcggacgccacactgt

SEQ ID NO: 560554 - DNA, 25 bp, Rattus norvegicus
gtgtgtaactaagcacctgtgagga

SEQ ID NO: 560555 - DNA, 25 bp, Rattus norvegicus
actgtgtgtaactaagcacctgtga

SEQ ID NO: 560556 - DNA, 25 bp, Rattus norvegicus
cacactgtgtgtaactaagcacctg

SEQ ID NO: 560557 - DNA, 25 bp, Rattus norvegicus
cggacgccacactgtgtgtaactaa

SEQ ID NO: 560558 - DNA, 25 bp, Rattus norvegicus
taactaagcacctgtgaggacgagc

SEQ ID NO: 560559 - DNA, 25 bp, Rattus norvegicus
ctaagcacctgtgaggacgagcgga

SEQ ID NO: 560560 - DNA, 25 bp, Rattus norvegicus
ctgtgtgtaactaagcacctgtgag

SEQ ID NO: 560561 - DNA, 25 bp, Rattus norvegicus
cgccacactgtgtgtaactaagcac

SEQ ID NO: 560562 - DNA, 25 bp, Rattus norvegicus
actaagcacctgtgaggacgagcgg

SEQ ID NO: 560563 - DNA, 25 bp, Rattus norvegicus
gccacactgtgtgtaactaagcacc

SEQ ID NO: 560564 - DNA, 25 bp, Rattus norvegicus
gcggacgccacactgtgtgtaacta

SEQ ID NO: 560565 - DNA, 25 bp, Rattus norvegicus
cctcggaagtgaaggaacgacccag

SEQ ID NO: 560566 - DNA, 25 bp, Rattus norvegicus
ggcacagaagccctcggaagtgaag

SEQ ID NO: 560567 - DNA, 25 bp, Rattus norvegicus
aacgacccaggctgagctttgtgcg

SEQ ID NO: 560568 - DNA, 25 bp, Rattus norvegicus
gtgaaggaacgacccaggctgagct

SEQ ID NO: 560569 - DNA, 25 bp, Rattus norvegicus
acaccgcgctgtgtgactgagcggt

SEQ ID NO: 560570 - DNA, 25 bp, Rattus norvegicus
cagacaccgcgctgtgtgactgagc

SEQ ID NO: 560571 - DNA, 25 bp, Rattus norvegicus
aggctgagctttgtgcgcctgagca

SEQ ID NO: 560572 - DNA, 25 bp, Rattus norvegicus
cgcctgagcatcgcgaggaagagca

SEQ ID NO: 560573 - DNA, 25 bp, Rattus norvegicus
cggaagccgcactgtgtgcgcctga

SEQ ID NO: 560574 - DNA, 25 bp, Rattus norvegicus
tgagcggacgccacactgtgtgtaa

SEQ ID NO: 560575 - DNA, 25 bp, Rattus norvegicus
tgaggatgagcggacgccacactgt

SEQ ID NO: 560576 - DNA, 25 bp, Rattus norvegicus
catcgtgaggacgagcggacgccac

SEQ ID NO: 560577 - DNA, 25 bp, Rattus norvegicus
ttgtgcgcctgagcatcgtgaggac

SEQ ID NO: 560578 - DNA, 25 bp, Rattus norvegicus
cgaggaagagcagacaccgcgctgt

SEQ ID NO: 560579 - DNA, 25 bp, Rattus norvegicus
gggcaactgcgcaggtcagccttac

SEQ ID NO: 560580 - DNA, 25 bp, Rattus norvegicus
tactgcggataaccgggcaactgcg

SEQ ID NO: 560581 - DNA, 25 bp, Rattus norvegicus
gcaggccggccttacatattgtgga

SEQ ID NO: 560582 - DNA, 25 bp, Rattus norvegicus
caactgcgcaggtcagccttacata

SEQ ID NO: 560583 - DNA, 25 bp, Rattus norvegicus
gcgcaggctggccttacatattgtg

SEQ ID NO: 560584 - DNA, 25 bp, Rattus norvegicus
gcaggctggccttacatattgtgga

SEQ ID NO: 560585 - DNA, 25 bp, Rattus norvegicus
gcaggccagccttacatattgtgga

SEQ ID NO: 560586 - DNA, 25 bp, Rattus norvegicus
caggcaggctgtactgcggataacc

SEQ ID NO: 560587 - DNA, 25 bp, Rattus norvegicus
aactgcgcaggtcagccttacgtgc

SEQ ID NO: 560588 - DNA, 25 bp, Rattus norvegicus
gcgcaggccggccttacatattgtg

SEQ ID NO: 560589 - DNA, 25 bp, Rattus norvegicus
ggccggccttacatattgtggataa

SEQ ID NO: 560590 - DNA, 25 bp, Rattus norvegicus
cgcaggccagccttacatattgtgg

SEQ ID NO: 560591 - DNA, 25 bp, Rattus norvegicus
cgcaggccggccttacatattgtgg

SEQ ID NO: 560592 - DNA, 25 bp, Rattus norvegicus
ggtcagccttacgtactgcggataa

SEQ ID NO: 560593 - DNA, 25 bp, Rattus norvegicus
tggcacctgtcacgcctttaaaacc

SEQ ID NO: 560594 - DNA, 25 bp, Rattus norvegicus
ctcactgtgaccttagccttgggtg

SEQ ID NO: 560595 - DNA, 25 bp, Rattus norvegicus
ggcccagatccgcttcagcaacatt

SEQ ID NO: 560596 - DNA, 25 bp, Rattus norvegicus
cgccatgccggagaacgtagcttcc

SEQ ID NO: 560597 - DNA, 25 bp, Rattus norvegicus
aatccgtgtccatcggtcctcctga

SEQ ID NO: 560598 - DNA, 25 bp, Rattus norvegicus
gggcgcagctttctactgagtactc

SEQ ID NO: 560599 - DNA, 25 bp, Rattus norvegicus
cgttactccacagcaggccggaatc

SEQ ID NO: 560600 - DNA, 25 bp, Rattus norvegicus
tgacgtcatatctgcgccggcacca

SEQ ID NO: 560601 - DNA, 25 bp, Rattus norvegicus
tgttccttcagaggtggtctcgtcc

SEQ ID NO: 560602 - DNA, 25 bp, Rattus norvegicus
gagtggctccggtctacatagaatg

SEQ ID NO: 560603 - DNA, 25 bp, Rattus norvegicus
ggctgtcacggcttcgtcaacatga

SEQ ID NO: 560604 - DNA, 25 bp, Rattus norvegicus
actccggaacaaagccagggctgtc

SEQ ID NO: 560605 - DNA, 25 bp, Rattus norvegicus
cgtcgctttctggaaggttcgtgga

SEQ ID NO: 560606 - DNA, 25 bp, Rattus norvegicus
catttccgcggccaaaggtatcacc

SEQ ID NO: 560607 - DNA, 25 bp, Rattus norvegicus
ttgcctgcgttacggtccttcgcca

SEQ ID NO: 560608 - DNA, 25 bp, Rattus norvegicus
actcggggctcgcatttgtgacagt

SEQ ID NO: 560609 - DNA, 25 bp, Rattus norvegicus
tgagaaaggacgttgcctgcgttac

SEQ ID NO: 560610 - DNA, 25 bp, Rattus norvegicus
tgtccgggtcctcaccagcagggac

SEQ ID NO: 560611 - DNA, 25 bp, Rattus norvegicus
gtggcttcgccgcactaggctatca

SEQ ID NO: 560612 - DNA, 25 bp, Rattus norvegicus
ccgcactaggctatcagactggctg

SEQ ID NO: 560613 - DNA, 25 bp, Rattus norvegicus
tatcagactggctgctgccaacctc

SEQ ID NO: 560614 - DNA, 25 bp, Rattus norvegicus
cgcaaatcccatcacaggagcaagg

SEQ ID NO: 560615 - DNA, 25 bp, Rattus norvegicus
gggcctcccagtacgaacgcgaaga

SEQ ID NO: 560616 - DNA, 25 bp, Rattus norvegicus
cttatagttcttggtagcagcggcg

SEQ ID NO: 560617 - DNA, 25 bp, Rattus norvegicus
ctcaccagcagggacgggtggaaat

SEQ ID NO: 560618 - DNA, 25 bp, Rattus norvegicus
cagaagaaaaggatgtggcagatac

SEQ ID NO: 560619 - DNA, 25 bp, Rattus norvegicus
tcacaggagcaagggcctcccagta

SEQ ID NO: 560620 - DNA, 25 bp, Rattus norvegicus
ttgtgacagtgagaaaggacgttgc

SEQ ID NO: 560621 - DNA, 25 bp, Rattus norvegicus
cgccagcgaattcgtgtcagtcaca

SEQ ID NO: 560622 - DNA, 25 bp, Rattus norvegicus
cttcccgaagcctgccatggtgctg

SEQ ID NO: 560623 - DNA, 25 bp, Rattus norvegicus
agaaagctaagcgtccctccctcgg

SEQ ID NO: 560624 - DNA, 25 bp, Rattus norvegicus
tcctggaggaccacgaacgcgccag

SEQ ID NO: 560625 - DNA, 25 bp, Rattus norvegicus
acgctgttctgcgtgctggctccac

SEQ ID NO: 560626 - DNA, 25 bp, Rattus norvegicus
cagagccgctctaggcacgcagtgt

SEQ ID NO: 560627 - DNA, 25 bp, Rattus norvegicus
tgcgcacgcgcacagtccataactg

SEQ ID NO: 560628 - DNA, 25 bp, Rattus norvegicus
gtcacagccctagacgctcagtgga

SEQ ID NO: 560629 - DNA, 25 bp, Rattus norvegicus
acgcctctctctccgcagattaata

SEQ ID NO: 560630 - DNA, 25 bp, Rattus norvegicus
tctcacactacgtcacgaaaaaggc

SEQ ID NO: 560631 - DNA, 25 bp, Rattus norvegicus
acgctcagtggaggttcaggtcacc

SEQ ID NO: 560632 - DNA, 25 bp, Rattus norvegicus
gcctcgtcgtgagaataatgcgtta

SEQ ID NO: 560633 - DNA, 25 bp, Rattus norvegicus
gcacgcagtgttgtccggtctcgtt

SEQ ID NO: 560634 - DNA, 25 bp, Rattus norvegicus
aatagttcttcccttcgcctcgtcg

SEQ ID NO: 560635 - DNA, 25 bp, Rattus norvegicus
cgtcaccaaaggagcccagccaatg

SEQ ID NO: 560636 - DNA, 25 bp, Rattus norvegicus
gcgagccgaaaaggccgggcttaca

SEQ ID NO: 560637 - DNA, 25 bp, Rattus norvegicus
tgcacttgactgacagctgactcca

SEQ ID NO: 560638 - DNA, 25 bp, Rattus norvegicus
ttctccgctctcctctttgctgggt

SEQ ID NO: 560639 - DNA, 25 bp, Rattus norvegicus
actctgcgggcaaatcactgctgga

SEQ ID NO: 560640 - DNA, 25 bp, Rattus norvegicus
ccaataggaggtaggctgatgacac

SEQ ID NO: 560641 - DNA, 25 bp, Rattus norvegicus
ggcgccatgggctgaaaactcaacc

SEQ ID NO: 560642 - DNA, 25 bp, Rattus norvegicus
agccaccagtcgctgaggagcacgc

SEQ ID NO: 560643 - DNA, 25 bp, Rattus norvegicus
agcagtcgtgcaaccatcccgaggg

SEQ ID NO: 560644 - DNA, 25 bp, Rattus norvegicus
gcagccgtacctgttccagcctttg

SEQ ID NO: 560645 - DNA, 25 bp, Rattus norvegicus
agcagcgggagcttcagcatcagca

SEQ ID NO: 560646 - DNA, 25 bp, Rattus norvegicus
tggaatctcccagtctgaaccggtt

SEQ ID NO: 560647 - DNA, 25 bp, Rattus norvegicus
accggttccgagtttgaggcactag

SEQ ID NO: 560648 - DNA, 25 bp, Rattus norvegicus
tccagcctttgctgcagcagtcgtg

SEQ ID NO: 560649 - DNA, 25 bp, Rattus norvegicus
caccggcctgccctgccggagacct

SEQ ID NO: 560650 - DNA, 25 bp, Rattus norvegicus
acccgcaacagggtctggggccgct

SEQ ID NO: 560651 - DNA, 25 bp, Rattus norvegicus
ctgcgcaaagctcacgggatcaaag

SEQ ID NO: 560652 - DNA, 25 bp, Rattus norvegicus
gctcacgggatcaaaggcagctccc

SEQ ID NO: 560653 - DNA, 25 bp, Rattus norvegicus
ggatcaaaggcagctcccgcacggc

SEQ ID NO: 560654 - DNA, 25 bp, Rattus norvegicus
aaaggatgctccttccattgcggga

SEQ ID NO: 560655 - DNA, 25 bp, Rattus norvegicus
tgctccttccattgcgggacctgtg

SEQ ID NO: 560656 - DNA, 25 bp, Rattus norvegicus
ttccattgcgggacctgtgccttct

SEQ ID NO: 560657 - DNA, 25 bp, Rattus norvegicus
tgtgccttctgtccgtttgtcccac

SEQ ID NO: 560658 - DNA, 25 bp, Rattus norvegicus
ctgccggagacctcccagggctgat

SEQ ID NO: 560659 - DNA, 25 bp, Rattus norvegicus
gacctcccagggctgatgctgaggc

SEQ ID NO: 560660 - DNA, 25 bp, Rattus norvegicus
tgctgaggctgctgatgctgtggat

SEQ ID NO: 560661 - DNA, 25 bp, Rattus norvegicus
atgctgtggatgctgctgcctctgc

SEQ ID NO: 560662 - DNA, 25 bp, Rattus norvegicus
gggacctgtgccttctgtccgtttg

SEQ ID NO: 560663 - DNA, 25 bp, Rattus norvegicus
agggcgagagcttcctctccgagtc

SEQ ID NO: 560664 - DNA, 25 bp, Rattus norvegicus
cggctcttcggtcacactttctgga

SEQ ID NO: 560665 - DNA, 25 bp, Rattus norvegicus
atcgggcgctccgtagattttggca

SEQ ID NO: 560666 - DNA, 25 bp, Rattus norvegicus
attttggcatggagacttggcaccg

SEQ ID NO: 560667 - DNA, 25 bp, Rattus norvegicus
tccatcctgggctgtgccatctttg

SEQ ID NO: 560668 - DNA, 25 bp, Rattus norvegicus
ccgaagcggagcgatagtagattgt

SEQ ID NO: 560669 - DNA, 25 bp, Rattus norvegicus
gctcatcgcctttcgcggtctgaaa

SEQ ID NO: 560670 - DNA, 25 bp, Rattus norvegicus
cgttgctgacagaaagtgatccggg

SEQ ID NO: 560671 - DNA, 25 bp, Rattus norvegicus
cccggtcgtgacacgaggggtatct

SEQ ID NO: 560672 - DNA, 25 bp, Rattus norvegicus
gacttgctgcttaggaactccttca

SEQ ID NO: 560673 - DNA, 25 bp, Rattus norvegicus
cttcatagtcacctagcatggtctg

SEQ ID NO: 560674 - DNA, 25 bp, Rattus norvegicus
agcatggtctgtatgcgactcgaca

SEQ ID NO: 560675 - DNA, 25 bp, Rattus norvegicus
agactcgaggactgcgggaaccgaa

SEQ ID NO: 560676 - DNA, 25 bp, Rattus norvegicus
atctttggactttggctgacgttgc

SEQ ID NO: 560677 - DNA, 25 bp, Rattus norvegicus
gaagcgcttctgtcgctcggtgatg

SEQ ID NO: 560678 - DNA, 25 bp, Rattus norvegicus
tggtagtgagtctgagcccctgcgc

SEQ ID NO: 560679 - DNA, 25 bp, Rattus norvegicus
agtgcttgctgggtcatcggcgtgt

SEQ ID NO: 560680 - DNA, 25 bp, Rattus norvegicus
ttctgtcgctcggtgatggaggcgg

SEQ ID NO: 560681 - DNA, 25 bp, Rattus norvegicus
aagcgcttctgtcgctcggtgatgg

SEQ ID NO: 560682 - DNA, 25 bp, Rattus norvegicus
ctgcgattgaatggaagcgcttctg

SEQ ID NO: 560683 - DNA, 25 bp, Rattus norvegicus
gcagagcctgcgattgaatggaagc

SEQ ID NO: 560684 - DNA, 25 bp, Rattus norvegicus
cctcggcagagcctgcgattgaatg

SEQ ID NO: 560685 - DNA, 25 bp, Rattus norvegicus
aaggcgaggagcgtggtagtgagtc

SEQ ID NO: 560686 - DNA, 25 bp, Rattus norvegicus
gcctgcgattgaatggaagcgcttc

SEQ ID NO: 560687 - DNA, 25 bp, Rattus norvegicus
tcggcagagcctgcgattgaatgga

SEQ ID NO: 560688 - DNA, 25 bp, Rattus norvegicus
gcgattgaatggaagcgcttctgtc

SEQ ID NO: 560689 - DNA, 25 bp, Rattus norvegicus
tgaatggaagcgcttctgtcgctcg

SEQ ID NO: 560690 - DNA, 25 bp, Rattus norvegicus
atggaagcgcttctgtcgctcggtg

SEQ ID NO: 560691 - DNA, 25 bp, Rattus norvegicus
atcagtcagtgcgatcctaagcggg

SEQ ID NO: 560692 - DNA, 25 bp, Rattus norvegicus
cggccgaacgatgtgcgagaactgc

SEQ ID NO: 560693 - DNA, 25 bp, Rattus norvegicus
gaatgacggcaaagtccaccgcttc

SEQ ID NO: 560694 - DNA, 25 bp, Rattus norvegicus
tgtgcgagaactgcgcagacctggt

SEQ ID NO: 560695 - DNA, 25 bp, Rattus norvegicus
agcgctccattaaaatggcggcggc

SEQ ID NO: 560696 - DNA, 25 bp, Rattus norvegicus
gcagcccgagcgctccattaaaatg

SEQ ID NO: 560697 - DNA, 25 bp, Rattus norvegicus
cggctccttcgcctgggcggaaaga

SEQ ID NO: 560698 - DNA, 25 bp, Rattus norvegicus
cgcagacctggtggaggtgttaaat

SEQ ID NO: 560699 - DNA, 25 bp, Rattus norvegicus
ttccggccgctgacagagatccggg

SEQ ID NO: 560700 - DNA, 25 bp, Rattus norvegicus
gaggtgttaaatgaaagtaagtagc

SEQ ID NO: 560701 - DNA, 25 bp, Rattus norvegicus
ggtggtgaagtgactctgctgcttc

SEQ ID NO: 560702 - DNA, 25 bp, Rattus norvegicus
caccttcaaagtacccgaatgacgg

SEQ ID NO: 560703 - DNA, 25 bp, Rattus norvegicus
gcggctgtctccaccttcaaagtac

SEQ ID NO: 560704 - DNA, 25 bp, Rattus norvegicus
gggatccgctgacccgcggctgtct

SEQ ID NO: 560705 - DNA, 25 bp, Rattus norvegicus
ttctgattccctgggcccgctgcgg

SEQ ID NO: 560706 - DNA, 25 bp, Rattus norvegicus
gggccgcccttcctcttctgattcc

SEQ ID NO: 560707 - DNA, 25 bp, Rattus norvegicus
acgaagctgaacgtggggcctgggc

SEQ ID NO: 560708 - DNA, 25 bp, Rattus norvegicus
gctgccatcgttggcaaacaagttc

SEQ ID NO: 560709 - DNA, 25 bp, Rattus norvegicus
gttcacaccgctggacaccggactt

SEQ ID NO: 560710 - DNA, 25 bp, Rattus norvegicus
ccggttgatcaggtcgctgcgggcc

SEQ ID NO: 560711 - DNA, 25 bp, Rattus norvegicus
atcttccgcttgaacagctccagga

SEQ ID NO: 560712 - DNA, 25 bp, Rattus norvegicus
ttggcaaacaagttcacaccgctgg

SEQ ID NO: 560713 - DNA, 25 bp, Rattus norvegicus
gcaaacaagttcacaccgctggaca

SEQ ID NO: 560714 - DNA, 25 bp, Rattus norvegicus
acaccgctggacaccggacttgagc

SEQ ID NO: 560715 - DNA, 25 bp, Rattus norvegicus
tcgtcatccccactctcgggtgatg

SEQ ID NO: 560716 - DNA, 25 bp, Rattus norvegicus
cactctcgggtgatgttcccggccc

SEQ ID NO: 560717 - DNA, 25 bp, Rattus norvegicus
cccgactcagcccatcggctcctgc

SEQ ID NO: 560718 - DNA, 25 bp, Rattus norvegicus
gccatcgttggcaaacaagttcaca

SEQ ID NO: 560719 - DNA, 25 bp, Rattus norvegicus
ggacacagcgccgtcggcacacgca

SEQ ID NO: 560720 - DNA, 25 bp, Rattus norvegicus
gcagaaggtccctcgcggggctcgg

SEQ ID NO: 560721 - DNA, 25 bp, Rattus norvegicus
tgaggcagaaggtccctcgcggggc

SEQ ID NO: 560722 - DNA, 25 bp, Rattus norvegicus
gaggcacagctgtcggcggagtgag

SEQ ID NO: 560723 - DNA, 25 bp, Rattus norvegicus
accgaggcacagctgtcggcggagt

SEQ ID NO: 560724 - DNA, 25 bp, Rattus norvegicus
aggggcgaccgaggcacagctgtcg

SEQ ID NO: 560725 - DNA, 25 bp, Rattus norvegicus
ctcaaggccgaggagggccgggtga

SEQ ID NO: 560726 - DNA, 25 bp, Rattus norvegicus
tacgcagctcaaggccgaggagggc

SEQ ID NO: 560727 - DNA, 25 bp, Rattus norvegicus
actacgcagctcaaggccgaggagg

SEQ ID NO: 560728 - DNA, 25 bp, Rattus norvegicus
cactacgcagctcaaggccgaggag

SEQ ID NO: 560729 - DNA, 25 bp, Rattus norvegicus
gcactacgcagctcaaggccgagga

SEQ ID NO: 560730 - DNA, 25 bp, Rattus norvegicus
cgcactacgcagctcaaggccgagg

SEQ ID NO: 560731 - DNA, 25 bp, Rattus norvegicus
gcgcactacgcagctcaaggccgag

SEQ ID NO: 560732 - DNA, 25 bp, Rattus norvegicus
cagcgccgtcggcacacgcacgcgc

SEQ ID NO: 560733 - DNA, 25 bp, Rattus norvegicus
cagaaggtctgtgagccgcacgccc

SEQ ID NO: 560734 - DNA, 25 bp, Rattus norvegicus
ccgggcccaccgcaccaatgccagt

SEQ ID NO: 560735 - DNA, 25 bp, Rattus norvegicus
gcaccaatgccagttgttcacgttg

SEQ ID NO: 560736 - DNA, 25 bp, Rattus norvegicus
aatgccagttgttcacgttggtccc

SEQ ID NO: 560737 - DNA, 25 bp, Rattus norvegicus
cagttgttcacgttggtcccgtcct

SEQ ID NO: 560738 - DNA, 25 bp, Rattus norvegicus
cgctgacgacgagggccctggcagc

SEQ ID NO: 560739 - DNA, 25 bp, Rattus norvegicus
tttccggccagaaggtctgtgagcc

SEQ ID NO: 560740 - DNA, 25 bp, Rattus norvegicus
taggaaccgtctcccgccacgggca

SEQ ID NO: 560741 - DNA, 25 bp, Rattus norvegicus
ggcagttaggaaccgtctcccgcca

SEQ ID NO: 560742 - DNA, 25 bp, Rattus norvegicus
gaccagggcagttaggaaccgtctc

SEQ ID NO: 560743 - DNA, 25 bp, Rattus norvegicus
gagcagcctgaagccggaggaccag

SEQ ID NO: 560744 - DNA, 25 bp, Rattus norvegicus
ggcccaactttccggagcagcctga

SEQ ID NO: 560745 - DNA, 25 bp, Rattus norvegicus
gggctcggcccaactttccggagca

SEQ ID NO: 560746 - DNA, 25 bp, Rattus norvegicus
gctcctccacgatccagcgcgggtc

SEQ ID NO: 560747 - DNA, 25 bp, Rattus norvegicus
tgctgctggttcctgtcgaccggcg

SEQ ID NO: 560748 - DNA, 25 bp, Rattus norvegicus
tcccggcggcgtcttctgctaggct

SEQ ID NO: 560749 - DNA, 25 bp, Rattus norvegicus
cgccctatgcggcacctcccggcgg

SEQ ID NO: 560750 - DNA, 25 bp, Rattus norvegicus
ggcggcgtcttctgctaggctcctc

SEQ ID NO: 560751 - DNA, 25 bp, Rattus norvegicus
agtccttaagactccgccctggctc

SEQ ID NO: 560752 - DNA, 25 bp, Rattus norvegicus
ttgtatcccctgagccgcctggttc

SEQ ID NO: 560753 - DNA, 25 bp, Rattus norvegicus
ggcttctggcctagggcttcgactt

SEQ ID NO: 560754 - DNA, 25 bp, Rattus norvegicus
gcctagggcttcgacttctggccta

SEQ ID NO: 560755 - DNA, 25 bp, Rattus norvegicus
gggcttcgacttctggcctagactt

SEQ ID NO: 560756 - DNA, 25 bp, Rattus norvegicus
gcttcgacttctggcctagacttcg

SEQ ID NO: 560757 - DNA, 25 bp, Rattus norvegicus
gacttctggcctagacttcgcccag

SEQ ID NO: 560758 - DNA, 25 bp, Rattus norvegicus
tctggcctagacttcgcccagggct

SEQ ID NO: 560759 - DNA, 25 bp, Rattus norvegicus
agacttcgcccagggctcctacgag

SEQ ID NO: 560760 - DNA, 25 bp, Rattus norvegicus
tggctccatcctccgctttgtatcc

SEQ ID NO: 560761 - DNA, 25 bp, Rattus norvegicus
cagccgtcctgcagtagcgccgagg

SEQ ID NO: 560762 - DNA, 25 bp, Rattus norvegicus
ggcctcacgagccacggccgcaccc

SEQ ID NO: 560763 - DNA, 25 bp, Rattus norvegicus
ccacttccagctcccgggtggctgc

SEQ ID NO: 560764 - DNA, 25 bp, Rattus norvegicus
tctctcacctccacagggccgcggc

SEQ ID NO: 560765 - DNA, 25 bp, Rattus norvegicus
gccaattgcaagctagcgccgcagc

SEQ ID NO: 560766 - DNA, 25 bp, Rattus norvegicus
cagaacggcgcgacccggcgcacac

SEQ ID NO: 560767 - DNA, 25 bp, Rattus norvegicus
gctagccagccgtcctgcagtagcg

SEQ ID NO: 560768 - DNA, 25 bp, Rattus norvegicus
agcctctcatcgtctctctcacctc

SEQ ID NO: 560769 - DNA, 25 bp, Rattus norvegicus
gtagcccggccaattgcaagctagc

SEQ ID NO: 560770 - DNA, 25 bp, Rattus norvegicus
aattgcaagctagcgccgcagcgca

SEQ ID NO: 560771 - DNA, 25 bp, Rattus norvegicus
cgcagcgcagcatccaatgagtgac

SEQ ID NO: 560772 - DNA, 25 bp, Rattus norvegicus
gcatccaatgagtgacgagctcctg

SEQ ID NO: 560773 - DNA, 25 bp, Rattus norvegicus
caatgagtgacgagctcctgtgggc

SEQ ID NO: 560774 - DNA, 25 bp, Rattus norvegicus
tcaccgcaccggtgtcacctgcagc

SEQ ID NO: 560775 - DNA, 25 bp, Rattus norvegicus
aagctcgatgccttgaagcgggtca

SEQ ID NO: 560776 - DNA, 25 bp, Rattus norvegicus
tctagcgccggcttccgtggggcca

SEQ ID NO: 560777 - DNA, 25 bp, Rattus norvegicus
tgaagcgggtcaggctgtcccgccc

SEQ ID NO: 560778 - DNA, 25 bp, Rattus norvegicus
ccctagtcccgcaaataaggacagg

SEQ ID NO: 560779 - DNA, 25 bp, Rattus norvegicus
ataaggacaggaagcgccgcttttc

SEQ ID NO: 560780 - DNA, 25 bp, Rattus norvegicus
ggaagcgccgcttttctctctagcg

SEQ ID NO: 560781 - DNA, 25 bp, Rattus norvegicus
aaaggcgcggccgtacagaccggca

SEQ ID NO: 560782 - DNA, 25 bp, Rattus norvegicus
agacgccggacttggagacccgctc

SEQ ID NO: 560783 - DNA, 25 bp, Rattus norvegicus
cacactcactggaaagtggggccgg

SEQ ID NO: 560784 - DNA, 25 bp, Rattus norvegicus
ctgggaggccatgtctcgcctgctc

SEQ ID NO: 560785 - DNA, 25 bp, Rattus norvegicus
tccggctcaggacagcgactgcgac

SEQ ID NO: 560786 - DNA, 25 bp, Rattus norvegicus
cgcctgacgtcaggccaaggcgtgt

SEQ ID NO: 560787 - DNA, 25 bp, Rattus norvegicus
gcagcagacccaagctcgatgcctt

SEQ ID NO: 560788 - DNA, 25 bp, Rattus norvegicus
tacagaccggcagacgccggacttg

SEQ ID NO: 560789 - DNA, 25 bp, Rattus norvegicus
ggcacagatttgcatacggggaccc

SEQ ID NO: 560790 - DNA, 25 bp, Rattus norvegicus
cggtactcactcgaggccatggctc

SEQ ID NO: 560791 - DNA, 25 bp, Rattus norvegicus
aagccagccagccagtcagtgagtg

SEQ ID NO: 560792 - DNA, 25 bp, Rattus norvegicus
agctagcccgtcagtcagccaacta

SEQ ID NO: 560793 - DNA, 25 bp, Rattus norvegicus
tgggtttgcggctcacaccttccca

SEQ ID NO: 560794 - DNA, 25 bp, Rattus norvegicus
cgaatcttcgcgctccggtcactag

SEQ ID NO: 560795 - DNA, 25 bp, Rattus norvegicus
ccggtcactagtgtcctggagtcgc

SEQ ID NO: 560796 - DNA, 25 bp, Rattus norvegicus
ggggatttcccgctgcctacgtcac

SEQ ID NO: 560797 - DNA, 25 bp, Rattus norvegicus
cgcgttcggctgtaaggcacagatt

SEQ ID NO: 560798 - DNA, 25 bp, Rattus norvegicus
cgcagccttattttccctctatatc

SEQ ID NO: 560799 - DNA, 25 bp, Rattus norvegicus
acattacgtctttacctagcagagg

SEQ ID NO: 560800 - DNA, 25 bp, Rattus norvegicus
tagcagaggttttcagctgcgctgc

SEQ ID NO: 560801 - DNA, 25 bp, Rattus norvegicus
tcctgtataaatgaacacgacgtcc

SEQ ID NO: 560802 - DNA, 25 bp, Rattus norvegicus
ccctattccttatttcgcacatgca

SEQ ID NO: 560803 - DNA, 25 bp, Rattus norvegicus
caatatggcgctgcttcccaggctg

SEQ ID NO: 560804 - DNA, 25 bp, Rattus norvegicus
gccagtgtctttcgctttggggtcc

SEQ ID NO: 560805 - DNA, 25 bp, Rattus norvegicus
tttatgacaatacagcgcggccgcc

SEQ ID NO: 560806 - DNA, 25 bp, Rattus norvegicus
agccgaggcattcaaccgagtagtg

SEQ ID NO: 560807 - DNA, 25 bp, Rattus norvegicus
ctttcgctcgcttatagctcgcttg

SEQ ID NO: 560808 - DNA, 25 bp, Rattus norvegicus
gacatctctttcatcgcttcctgcg

SEQ ID NO: 560809 - DNA, 25 bp, Rattus norvegicus
tggggtcctgttcttgccctctctt

SEQ ID NO: 560810 - DNA, 25 bp, Rattus norvegicus
gcgtctctctccagccagtgtcttt

SEQ ID NO: 560811 - DNA, 25 bp, Rattus norvegicus
gcaaaccacgggctccgctaggtca

SEQ ID NO: 560812 - DNA, 25 bp, Rattus norvegicus
cgctaggtcagtccctctccgaaag

SEQ ID NO: 560813 - DNA, 25 bp, Rattus norvegicus
acctgaaagacagcgggtccggccg

SEQ ID NO: 560814 - DNA, 25 bp, Rattus norvegicus
gagtgaccgaccgtttttctcttca

SEQ ID NO: 560815 - DNA, 25 bp, Rattus norvegicus
ccaatgcagacacgagcagaccggc

SEQ ID NO: 560816 - DNA, 25 bp, Rattus norvegicus
gggatggtatttgcgccaatgcaga

SEQ ID NO: 560817 - DNA, 25 bp, Rattus norvegicus
acctgctctgcagagtgtgtgcaag

SEQ ID NO: 560818 - DNA, 25 bp, Rattus norvegicus
cgcacctgctctgcagagtgtgtgc

SEQ ID NO: 560819 - DNA, 25 bp, Rattus norvegicus
cctgctctgcagagtgtgtgcaagg

SEQ ID NO: 560820 - DNA, 25 bp, Rattus norvegicus
ctgctctgcagagtgtgtgcaagga

SEQ ID NO: 560821 - DNA, 25 bp, Rattus norvegicus
tctgcagagtgtgtgcaaggagcgc

SEQ ID NO: 560822 - DNA, 25 bp, Rattus norvegicus
tgtgtgcaaggagcgcgccagctga

SEQ ID NO: 560823 - DNA, 25 bp, Rattus norvegicus
agcgcgccagctgagagctggagag

SEQ ID NO: 560824 - DNA, 25 bp, Rattus norvegicus
cattgaggcgcgcagcttggcagaa

SEQ ID NO: 560825 - DNA, 25 bp, Rattus norvegicus
cttggcagaagaaggtgaggcccgt

SEQ ID NO: 560826 - DNA, 25 bp, Rattus norvegicus
tgaggcccgtgtgcgcacgcgcagg

SEQ ID NO: 560827 - DNA, 25 bp, Rattus norvegicus
cgggcaggagctcaaccgcaggtcc

SEQ ID NO: 560828 - DNA, 25 bp, Rattus norvegicus
ggcaggagctcaaccgcaggtcccg

SEQ ID NO: 560829 - DNA, 25 bp, Rattus norvegicus
tgagagctggagaggccattgaggc

SEQ ID NO: 560830 - DNA, 25 bp, Rattus norvegicus
cacctgctctgcagagtgtgtgcaa

SEQ ID NO: 560831 - DNA, 25 bp, Rattus norvegicus
tccatagtggggtttaggcttcctc

SEQ ID NO: 560832 - DNA, 25 bp, Rattus norvegicus
tcctccagaagaagtgaagtgtgtc

SEQ ID NO: 560833 - DNA, 25 bp, Rattus norvegicus
ttctcggcgccttggcaacgcacga

SEQ ID NO: 560834 - DNA, 25 bp, Rattus norvegicus
gcggcaaaatttggggtctttctgc

SEQ ID NO: 560835 - DNA, 25 bp, Rattus norvegicus
tggctcagacccttgcggcaaaatt

SEQ ID NO: 560836 - DNA, 25 bp, Rattus norvegicus
tctgagatgagatccgagatgctac

SEQ ID NO: 560837 - DNA, 25 bp, Rattus norvegicus
gctgtgctgagatcttggtctgaga

SEQ ID NO: 560838 - DNA, 25 bp, Rattus norvegicus
gtactcttgcgcctggttgtccgcc

SEQ ID NO: 560839 - DNA, 25 bp, Rattus norvegicus
ccgccatattgctggcgtacgagca

SEQ ID NO: 560840 - DNA, 25 bp, Rattus norvegicus
gtcagtcaccaggtcgtcggtcatc

SEQ ID NO: 560841 - DNA, 25 bp, Rattus norvegicus
gcaggggcgttgtcttttctatgcc

SEQ ID NO: 560842 - DNA, 25 bp, Rattus norvegicus
atctgcaccttctgctgggtccgca

SEQ ID NO: 560843 - DNA, 25 bp, Rattus norvegicus
gggtccgcatccacgacttgaagtc

SEQ ID NO: 560844 - DNA, 25 bp, Rattus norvegicus
acttgaagtccacgcaggcccggca

SEQ ID NO: 560845 - DNA, 25 bp, Rattus norvegicus
gataccaacatccttgtggtcccgc

SEQ ID NO: 560846 - DNA, 25 bp, Rattus norvegicus
gccacacgatggagcccgcttcatg

SEQ ID NO: 560847 - DNA, 25 bp, Rattus norvegicus
tctggccacacgatggagcccgctt

SEQ ID NO: 560848 - DNA, 25 bp, Rattus norvegicus
cgcttcatgcagacccggaccatgg

SEQ ID NO: 560849 - DNA, 25 bp, Rattus norvegicus
atgcagacccggaccatggcagcgg

SEQ ID NO: 560850 - DNA, 25 bp, Rattus norvegicus
gacaaaggcgggtgcccggcatcca

SEQ ID NO: 560851 - DNA, 25 bp, Rattus norvegicus
tgtggtcgccctgacgcgctgagct

SEQ ID NO: 560852 - DNA, 25 bp, Rattus norvegicus
ccctgacgcgctgagctgggtagct

SEQ ID NO: 560853 - DNA, 25 bp, Rattus norvegicus
cggactctggccacacgatggagcc

SEQ ID NO: 560854 - DNA, 25 bp, Rattus norvegicus
agtaccggactctggccacacgatg

SEQ ID NO: 560855 - DNA, 25 bp, Rattus norvegicus
actgcagtaccggactctggccaca

SEQ ID NO: 560856 - DNA, 25 bp, Rattus norvegicus
gtgccactggcactgcagtaccgga

SEQ ID NO: 560857 - DNA, 25 bp, Rattus norvegicus
gcgatgataccaacatccttgtggt

SEQ ID NO: 560858 - DNA, 25 bp, Rattus norvegicus
actggcactgcagtaccggactctg

SEQ ID NO: 560859 - DNA, 25 bp, Rattus norvegicus
cctgcgcaagcctcacctggagtgg

SEQ ID NO: 560860 - DNA, 25 bp, Rattus norvegicus
cagggcacgccaatgaaaatccagg

SEQ ID NO: 560861 - DNA, 25 bp, Rattus norvegicus
tgaaaatccaggctccggcagaccc

SEQ ID NO: 560862 - DNA, 25 bp, Rattus norvegicus
cggcagacccgagaaaccaacttca

SEQ ID NO: 560863 - DNA, 25 bp, Rattus norvegicus
ataacagttcttcgggtcagaaacg

SEQ ID NO: 560864 - DNA, 25 bp, Rattus norvegicus
gtcagaaacgggatctttaacctca

SEQ ID NO: 560865 - DNA, 25 bp, Rattus norvegicus
tgcacccggtgcagacactgttttc

SEQ ID NO: 560866 - DNA, 25 bp, Rattus norvegicus
tgttttctgcccgacactccgggga

SEQ ID NO: 560867 - DNA, 25 bp, Rattus norvegicus
atagcagcgatccagcggcttcctg

SEQ ID NO: 560868 - DNA, 25 bp, Rattus norvegicus
caccagctctgggttcagcatcggc

SEQ ID NO: 560869 - DNA, 25 bp, Rattus norvegicus
acgccaaatggccaactaggagagc

SEQ ID NO: 560870 - DNA, 25 bp, Rattus norvegicus
gcctccttttaagggcagcgcgctt

SEQ ID NO: 560871 - DNA, 25 bp, Rattus norvegicus
agtgggagcactcgatcacggccct

SEQ ID NO: 560872 - DNA, 25 bp, Rattus norvegicus
cactccggggatgagatagcagcga

SEQ ID NO: 560873 - DNA, 25 bp, Rattus norvegicus
caaagtttctcgagcgctgccacga

SEQ ID NO: 560874 - DNA, 25 bp, Rattus norvegicus
caaacttgggctggatttctctctc

SEQ ID NO: 560875 - DNA, 25 bp, Rattus norvegicus
tgaaagtatcccacgccagagcgaa

SEQ ID NO: 560876 - DNA, 25 bp, Rattus norvegicus
cctagctttcactgggcaaagtttc

SEQ ID NO: 560877 - DNA, 25 bp, Rattus norvegicus
agcccgcagcagagctcttaacttg

SEQ ID NO: 560878 - DNA, 25 bp, Rattus norvegicus
ccgactgtttgtagggtcgctcaga

SEQ ID NO: 560879 - DNA, 25 bp, Rattus norvegicus
attcagggcttcagtggcattcagc

SEQ ID NO: 560880 - DNA, 25 bp, Rattus norvegicus
gacctttctgttcctgcaatcctcg

SEQ ID NO: 560881 - DNA, 25 bp, Rattus norvegicus
gggactgaaacacacccggaatctg

SEQ ID NO: 560882 - DNA, 25 bp, Rattus norvegicus
ccgagtgctcccatctggggactga

SEQ ID NO: 560883 - DNA, 25 bp, Rattus norvegicus
gtccttcgctcagtgctttcgcagt

SEQ ID NO: 560884 - DNA, 25 bp, Rattus norvegicus
cgcagctcctgctagccagttttct

SEQ ID NO: 560885 - DNA, 25 bp, Rattus norvegicus
cgccagagcgaagcccgctttttga

SEQ ID NO: 560886 - DNA, 25 bp, Rattus norvegicus
tggacgctcagctctcaacttcggg

SEQ ID NO: 560887 - DNA, 25 bp, Rattus norvegicus
cctgcagaaattccagtctttaata

SEQ ID NO: 560888 - DNA, 25 bp, Rattus norvegicus
cctagtctggagtcgagatcgccca

SEQ ID NO: 560889 - DNA, 25 bp, Rattus norvegicus
gctgccgtcttttgttccggccgga

SEQ ID NO: 560890 - DNA, 25 bp, Rattus norvegicus
cctcctgggtgagccctgaaggaga

SEQ ID NO: 560891 - DNA, 25 bp, Rattus norvegicus
gcaacgcaagagaatgtacaatttc

SEQ ID NO: 560892 - DNA, 25 bp, Rattus norvegicus
gaagccaaacattctgccagtcgta

SEQ ID NO: 560893 - DNA, 25 bp, Rattus norvegicus
cacctctttcctggattcgttcgca

SEQ ID NO: 560894 - DNA, 25 bp, Rattus norvegicus
cgaggaactccctcctcttactatt

SEQ ID NO: 560895 - DNA, 25 bp, Rattus norvegicus
ttgggaaaaatctcgtgtctgaatg

SEQ ID NO: 560896 - DNA, 25 bp, Rattus norvegicus
tctgaatgtttacaagcaccgcgtg

SEQ ID NO: 560897 - DNA, 25 bp, Rattus norvegicus
cgggagcctcctgccaacaaacaga

SEQ ID NO: 560898 - DNA, 25 bp, Rattus norvegicus
aaacagacagaggaccgagcgcgcc

SEQ ID NO: 560899 - DNA, 25 bp, Rattus norvegicus
gctggcgcttcccagtcagccgagt

SEQ ID NO: 560900 - DNA, 25 bp, Rattus norvegicus
gccagtcgtatttttcacctctttc

SEQ ID NO: 560901 - DNA, 25 bp, Rattus norvegicus
aatgaatttcaggacccgcgctcgg

SEQ ID NO: 560902 - DNA, 25 bp, Rattus norvegicus
cgggcgaaacacatttgcacagatc

SEQ ID NO: 560903 - DNA, 25 bp, Rattus norvegicus
cggggaagccaagactcgatcaggt

SEQ ID NO: 560904 - DNA, 25 bp, Rattus norvegicus
tgcccttggcttctaggttcacttt

SEQ ID NO: 560905 - DNA, 25 bp, Rattus norvegicus
tgcagggatcacgtctttcattttc

SEQ ID NO: 560906 - DNA, 25 bp, Rattus norvegicus
cgtcctcagctacgtggactgaatg

SEQ ID NO: 560907 - DNA, 25 bp, Rattus norvegicus
catttggtcgctaggaggcagaaca

SEQ ID NO: 560908 - DNA, 25 bp, Rattus norvegicus
tccacgaacttgaacctgtaccaga

SEQ ID NO: 560909 - DNA, 25 bp, Rattus norvegicus
gttctctcgagtttaggggcacggc

SEQ ID NO: 560910 - DNA, 25 bp, Rattus norvegicus
ttaataatgaataaccgcggtcgcc

SEQ ID NO: 560911 - DNA, 25 bp, Rattus norvegicus
caggcttaccggacggcttggcaac

SEQ ID NO: 560912 - DNA, 25 bp, Rattus norvegicus
cgggctagcagcgtcattaataatg

SEQ ID NO: 560913 - DNA, 25 bp, Rattus norvegicus
gcaacgaacggttaggctgaattcc

SEQ ID NO: 560914 - DNA, 25 bp, Rattus norvegicus
ctggaagcccgaaatcacaacaata

SEQ ID NO: 560915 - DNA, 25 bp, Rattus norvegicus
tggctatgcagcctccaggcagctc

SEQ ID NO: 560916 - DNA, 25 bp, Rattus norvegicus
actgttaatggtcgtggctgctccc

SEQ ID NO: 560917 - DNA, 25 bp, Rattus norvegicus
gggtctgtccaaaaagctcctgctg

SEQ ID NO: 560918 - DNA, 25 bp, Rattus norvegicus
gaccgcatagacgatggcactgtta

SEQ ID NO: 560919 - DNA, 25 bp, Rattus norvegicus
cgagaagcataagcgcagccacctg

SEQ ID NO: 560920 - DNA, 25 bp, Rattus norvegicus
ccaccaggtcctgggcgagaagcat

SEQ ID NO: 560921 - DNA, 25 bp, Rattus norvegicus
agctccatgcagcacttcagcgagg

SEQ ID NO: 560922 - DNA, 25 bp, Rattus norvegicus
aggcagctcaaagatcccttcctta

SEQ ID NO: 560923 - DNA, 25 bp, Rattus norvegicus
tgcgatgcctaacacggagaacgtg

SEQ ID NO: 560924 - DNA, 25 bp, Rattus norvegicus
cggagactccagacaatcgcctttt

SEQ ID NO: 560925 - DNA, 25 bp, Rattus norvegicus
atcgccttttgcctcctcgtcagag

SEQ ID NO: 560926 - DNA, 25 bp, Rattus norvegicus
cctcgtcagagcactcctcggagaa

SEQ ID NO: 560927 - DNA, 25 bp, Rattus norvegicus
cccagctcaaaagagggcagacgca

SEQ ID NO: 560928 - DNA, 25 bp, Rattus norvegicus
atagggacacttgcgacgaagactc

SEQ ID NO: 560929 - DNA, 25 bp, Rattus norvegicus
cgggcaaaagcctgtcactcgtagc

SEQ ID NO: 560930 - DNA, 25 bp, Rattus norvegicus
ctgctgcttcctcagaatcgggaga

SEQ ID NO: 560931 - DNA, 25 bp, Rattus norvegicus
gagaaaactgtgtatgagggcttca

SEQ ID NO: 560932 - DNA, 25 bp, Rattus norvegicus
agggcttcatttcggctcaggtacc

SEQ ID NO: 560933 - DNA, 25 bp, Rattus norvegicus
cgttctctcgggcaaaagcctgtca

SEQ ID NO: 560934 - DNA, 25 bp, Rattus norvegicus
gttgcgccatttcccgctgctgctt

SEQ ID NO: 560935 - DNA, 25 bp, Rattus norvegicus
cctgtcactcgtagcgcaggttggc

SEQ ID NO: 560936 - DNA, 25 bp, Rattus norvegicus
cggagattggaaagcagcgccgata

SEQ ID NO: 560937 - DNA, 25 bp, Rattus norvegicus
agcgccgatattctgcgcatgcgcg

SEQ ID NO: 560938 - DNA, 25 bp, Rattus norvegicus
atgtgcggcggccattcctgcgcgc

SEQ ID NO: 560939 - DNA, 25 bp, Rattus norvegicus
attcctgcgcgccatggcggacacg

SEQ ID NO: 560940 - DNA, 25 bp, Rattus norvegicus
ctcaggtaccctgcggggtcgttct

SEQ ID NO: 560941 - DNA, 25 bp, Rattus norvegicus
tggcggacacggaagcaaacctgtt

SEQ ID NO: 560942 - DNA, 25 bp, Rattus norvegicus
cggaagcaaacctgttgcgccattt

SEQ ID NO: 560943 - DNA, 25 bp, Rattus norvegicus
aagttagtcaaagcccactgggatg

SEQ ID NO: 560944 - DNA, 25 bp, Rattus norvegicus
tgaatgtcagtcacatttcacagtg

SEQ ID NO: 560945 - DNA, 25 bp, Rattus norvegicus
tattccaagttttagtagtgatttc

SEQ ID NO: 560946 - DNA, 25 bp, Rattus norvegicus
atgcaccggaatggcgtgtgtccgc

SEQ ID NO: 560947 - DNA, 25 bp, Rattus norvegicus
ggcgtgtgtccgctgacatgatccc

SEQ ID NO: 560948 - DNA, 25 bp, Rattus norvegicus
gctgagcagcagtcgacagagtttc

SEQ ID NO: 560949 - DNA, 25 bp, Rattus norvegicus
caacgtcttctttggtgaatgtccc

SEQ ID NO: 560950 - DNA, 25 bp, Rattus norvegicus
catgggctcagaaagtttccctttt

SEQ ID NO: 560951 - DNA, 25 bp, Rattus norvegicus
tggtacataattcgcttatacacta

SEQ ID NO: 560952 - DNA, 25 bp, Rattus norvegicus
agccagctgccatgacatatgaatg

SEQ ID NO: 560953 - DNA, 25 bp, Rattus norvegicus
actgtagtaaggtaagccagctgcc

SEQ ID NO: 560954 - DNA, 25 bp, Rattus norvegicus
tggtgaatgtccctactgtagtaag

SEQ ID NO: 560955 - DNA, 25 bp, Rattus norvegicus
tataatagtaactggacatgggctc

SEQ ID NO: 560956 - DNA, 25 bp, Rattus norvegicus
cagtcgacagagtttcaacgtcttc

SEQ ID NO: 560957 - DNA, 25 bp, Rattus norvegicus
atggcagtcgcggactctgcagaag

SEQ ID NO: 560958 - DNA, 25 bp, Rattus norvegicus
ctgcagaagcgcctgccggtttccg

SEQ ID NO: 560959 - DNA, 25 bp, Rattus norvegicus
atctgaacggagaactgggccacgg

SEQ ID NO: 560960 - DNA, 25 bp, Rattus norvegicus
gaactggaggaggatgtgattcacc

SEQ ID NO: 560961 - DNA, 25 bp, Rattus norvegicus
cctcaacccggcagtatgtcgggcg

SEQ ID NO: 560962 - DNA, 25 bp, Rattus norvegicus
tatgtcgggcgaccacgtgaaagtt

SEQ ID NO: 560963 - DNA, 25 bp, Rattus norvegicus
cacgtgaaagttgttggctaaagtc

SEQ ID NO: 560964 - DNA, 25 bp, Rattus norvegicus
tgttggctaaagtcggcgagtctcc

SEQ ID NO: 560965 - DNA, 25 bp, Rattus norvegicus
cggcgagtctccctagaacaacttc

SEQ ID NO: 560966 - DNA, 25 bp, Rattus norvegicus
gaacaacttctgagcgggacagata

SEQ ID NO: 560967 - DNA, 25 bp, Rattus norvegicus
cgggctgaggactggacctgcaccc

SEQ ID NO: 560968 - DNA, 25 bp, Rattus norvegicus
ttcagacgatccctcccggggcgga

SEQ ID NO: 560969 - DNA, 25 bp, Rattus norvegicus
ggaagactgacctgccgtctgagtc

SEQ ID NO: 560970 - DNA, 25 bp, Rattus norvegicus
tgacgctcgcccagttcagacgatc

SEQ ID NO: 560971 - DNA, 25 bp, Rattus norvegicus
gcgcttcgagagtcagcggcacctc

SEQ ID NO: 560972 - DNA, 25 bp, Rattus norvegicus
gcggacgacattgcccgacaggacc

SEQ ID NO: 560973 - DNA, 25 bp, Rattus norvegicus
ccatccaagtgtgcgtacctgccga

SEQ ID NO: 560974 - DNA, 25 bp, Rattus norvegicus
atcgcgctcaccttttcagcttcgg

SEQ ID NO: 560975 - DNA, 25 bp, Rattus norvegicus
ggatcagatcctccttgctccactg

SEQ ID NO: 560976 - DNA, 25 bp, Rattus norvegicus
cccaactccgagcaagtccatgatg

SEQ ID NO: 560977 - DNA, 25 bp, Rattus norvegicus
gccttcgacatggtatccgcgcagc

SEQ ID NO: 560978 - DNA, 25 bp, Rattus norvegicus
aacgcctcctgcaagggccaaatgc

SEQ ID NO: 560979 - DNA, 25 bp, Rattus norvegicus
acacccagagggttctgcctcaatc

SEQ ID NO: 560980 - DNA, 25 bp, Rattus norvegicus
ctcctttgctcagatcgagacagcc

SEQ ID NO: 560981 - DNA, 25 bp, Rattus norvegicus
agaggctgtcctttcctgaacgatc

SEQ ID NO: 560982 - DNA, 25 bp, Rattus norvegicus
tcctgcggctgatcctaaactgttc

SEQ ID NO: 560983 - DNA, 25 bp, Rattus norvegicus
ggaagccttgggttttcagagccca

SEQ ID NO: 560984 - DNA, 25 bp, Rattus norvegicus
gcagttcttcgtccgtcactttaga

SEQ ID NO: 560985 - DNA, 25 bp, Rattus norvegicus
agcgtttccctccaagctcagcagc

SEQ ID NO: 560986 - DNA, 25 bp, Rattus norvegicus
tgaagcggcacaatcccgccgcagt

SEQ ID NO: 560987 - DNA, 25 bp, Rattus norvegicus
ggccatgtcccagggcagcgtttcc

SEQ ID NO: 560988 - DNA, 25 bp, Rattus norvegicus
gctttgaagcggcacaatcccgccg

SEQ ID NO: 560989 - DNA, 25 bp, Rattus norvegicus
ctttctccctcgtgaaacagccagg

SEQ ID NO: 560990 - DNA, 25 bp, Rattus norvegicus
tcgtgaaacagccagggtgctactc

SEQ ID NO: 560991 - DNA, 25 bp, Rattus norvegicus
gccagggtgctactctgtactccaa

SEQ ID NO: 560992 - DNA, 25 bp, Rattus norvegicus
ctctgtactccaagacacgctgtga

SEQ ID NO: 560993 - DNA, 25 bp, Rattus norvegicus
ccaagacacgctgtgatgatgtcgc

SEQ ID NO: 560994 - DNA, 25 bp, Rattus norvegicus
ctgtgatgatgtcgcgagtcgcaac

SEQ ID NO: 560995 - DNA, 25 bp, Rattus norvegicus
gtcgcgagtcgcaactactttgacg

SEQ ID NO: 560996 - DNA, 25 bp, Rattus norvegicus
cgcaactactttgacgtcatcagca

SEQ ID NO: 560997 - DNA, 25 bp, Rattus norvegicus
tttgacgtcatcagcatgcgcgccg

SEQ ID NO: 560998 - DNA, 25 bp, Rattus norvegicus
gcagtctcggccatgtcccagggca

SEQ ID NO: 560999 - DNA, 25 bp, Rattus norvegicus
cgtctacgtaggaagcctgctagga

SEQ ID NO: 561000 - DNA, 25 bp, Rattus norvegicus
gcctgctaggattgctttcccggca

SEQ ID NO: 561001 - DNA, 25 bp, Rattus norvegicus
cactcagctatttgcaggtgcgagc

SEQ ID NO: 561002 - DNA, 25 bp, Rattus norvegicus
taggaagcctgctaggattgctttc

SEQ ID NO: 561003 - DNA, 25 bp, Rattus norvegicus
gcggcatcgtgcactcagctatttg

SEQ ID NO: 561004 - DNA, 25 bp, Rattus norvegicus
cggccaaggcggcatcgtgcactca

SEQ ID NO: 561005 - DNA, 25 bp, Rattus norvegicus
ctaggattgctttcccggcagtttt

SEQ ID NO: 561006 - DNA, 25 bp, Rattus norvegicus
tgtctccgaccgctgagctgcggtc

SEQ ID NO: 561007 - DNA, 25 bp, Rattus norvegicus
ttgtgcctgtgtctccgaccgctga

SEQ ID NO: 561008 - DNA, 25 bp, Rattus norvegicus
caggccgtgctgcttgtgcctgtgt

SEQ ID NO: 561009 - DNA, 25 bp, Rattus norvegicus
ggctggccaatgaggcaccgcccgg

SEQ ID NO: 561010 - DNA, 25 bp, Rattus norvegicus
gctccgcccacctgcgggctggcca

SEQ ID NO: 561011 - DNA, 25 bp, Rattus norvegicus
tgctttcccggcagttttcaggttc

SEQ ID NO: 561012 - DNA, 25 bp, Rattus norvegicus
agctatttgcaggtgcgagcgctgt

SEQ ID NO: 561013 - DNA, 25 bp, Rattus norvegicus
gctcaccgtggccatggaacacttt

SEQ ID NO: 561014 - DNA, 25 bp, Rattus norvegicus
cttctcgcggctaaacctttggagc

SEQ ID NO: 561015 - DNA, 25 bp, Rattus norvegicus
cgccactaccgggtctcaagagtga

SEQ ID NO: 561016 - DNA, 25 bp, Rattus norvegicus
ctatgcattggactaatcggccgcc

SEQ ID NO: 561017 - DNA, 25 bp, Rattus norvegicus
cgtgtttggccgtaggtactatgca

SEQ ID NO: 561018 - DNA, 25 bp, Rattus norvegicus
tctgactctccggaagcgtgtttgg

SEQ ID NO: 561019 - DNA, 25 bp, Rattus norvegicus
gggccagtagccactatgtcggata

SEQ ID NO: 561020 - DNA, 25 bp, Rattus norvegicus
ccagcctggctctggtcagttgaca

SEQ ID NO: 561021 - DNA, 25 bp, Rattus norvegicus
cagcccgtgcgaacctgctggaaga

SEQ ID NO: 561022 - DNA, 25 bp, Rattus norvegicus
ctcgcagattctataacggatttta

SEQ ID NO: 561023 - DNA, 25 bp, Rattus norvegicus
ttaagatcgcccactgctcaccgtg

SEQ ID NO: 561024 - DNA, 25 bp, Rattus norvegicus
ctgtcaacgcgtttgtggaacatta

SEQ ID NO: 561025 - DNA, 25 bp, Rattus norvegicus
ctttggcgggaaataagaactgtca

SEQ ID NO: 561026 - DNA, 25 bp, Rattus norvegicus
ggggctcgacttcacataagactca

SEQ ID NO: 561027 - DNA, 25 bp, Rattus norvegicus
tcccaccaggaaagtagcaaggccg

SEQ ID NO: 561028 - DNA, 25 bp, Rattus norvegicus
ttcggctctaaagctgcgggaatcc

SEQ ID NO: 561029 - DNA, 25 bp, Rattus norvegicus
agtccttgctgggacgacctcgtca

SEQ ID NO: 561030 - DNA, 25 bp, Rattus norvegicus
ccctggtttctggaagctacctgca

SEQ ID NO: 561031 - DNA, 25 bp, Rattus norvegicus
cagactccgacaacgggacattttc

SEQ ID NO: 561032 - DNA, 25 bp, Rattus norvegicus
ctgggactcgtgtgttacgcaactc

SEQ ID NO: 561033 - DNA, 25 bp, Rattus norvegicus
aagaacctggctgtactcctggaga

SEQ ID NO: 561034 - DNA, 25 bp, Rattus norvegicus
ggtaccaccaatctcctgccagagg

SEQ ID NO: 561035 - DNA, 25 bp, Rattus norvegicus
gttcccagaagtgcctccaactttg

SEQ ID NO: 561036 - DNA, 25 bp, Rattus norvegicus
gccaatccttgttcttaagacgctg

SEQ ID NO: 561037 - DNA, 25 bp, Rattus norvegicus
gtgccgagaaactggccaatccttg

SEQ ID NO: 561038 - DNA, 25 bp, Rattus norvegicus
tctgcgcccattcgctccaaaggtt

SEQ ID NO: 561039 - DNA, 25 bp, Rattus norvegicus
acctcccttgacctgttgagatgca

SEQ ID NO: 561040 - DNA, 25 bp, Rattus norvegicus
ttttcccgcaggacgcgaggctcaa

SEQ ID NO: 561041 - DNA, 25 bp, Rattus norvegicus
gctgaaagcagaagtgcaggtattg

SEQ ID NO: 561042 - DNA, 25 bp, Rattus norvegicus
tagacactacaaaccagttaacgta

SEQ ID NO: 561043 - DNA, 25 bp, Rattus norvegicus
cagttaacgtaaaatggtcgctatg

SEQ ID NO: 561044 - DNA, 25 bp, Rattus norvegicus
tggtcgctatgacaacatacctagc

SEQ ID NO: 561045 - DNA, 25 bp, Rattus norvegicus
atacctagcggtccggaagtgaggc

SEQ ID NO: 561046 - DNA, 25 bp, Rattus norvegicus
cctgtcttaaaatggcgtgccgagg

SEQ ID NO: 561047 - DNA, 25 bp, Rattus norvegicus
gaagtgaggcccgagtcctgagctc

SEQ ID NO: 561048 - DNA, 25 bp, Rattus norvegicus
ggaacgtttcctattggctggaaga

SEQ ID NO: 561049 - DNA, 25 bp, Rattus norvegicus
ggagaccgcgttcgcgctcccgtgt

SEQ ID NO: 561050 - DNA, 25 bp, Rattus norvegicus
tccgctcattggtctggagttgcta

SEQ ID NO: 561051 - DNA, 25 bp, Rattus norvegicus
caggtattggctaccgcgcctggag

SEQ ID NO: 561052 - DNA, 25 bp, Rattus norvegicus
cagtctggcctttcggccgcaggaa

SEQ ID NO: 561053 - DNA, 25 bp, Rattus norvegicus
cgcgcgcggcctgtcttaaaatggc

SEQ ID NO: 561054 - DNA, 25 bp, Rattus norvegicus
ggtgcaaacgatagccctccgctca

SEQ ID NO: 561055 - DNA, 25 bp, Rattus norvegicus
acgctccgccagaatctgggcggcg

SEQ ID NO: 561056 - DNA, 25 bp, Rattus norvegicus
ggcgcgctcatgcagcggttttctt

SEQ ID NO: 561057 - DNA, 25 bp, Rattus norvegicus
ctcatgcagcggttttcttctccca

SEQ ID NO: 561058 - DNA, 25 bp, Rattus norvegicus
cggcactgcggttccgaggccgtta

SEQ ID NO: 561059 - DNA, 25 bp, Rattus norvegicus
acggtcagggacacgcctcggagct

SEQ ID NO: 561060 - DNA, 25 bp, Rattus norvegicus
ttttgcagccagacggtcagggaca

SEQ ID NO: 561061 - DNA, 25 bp, Rattus norvegicus
cccacgctgagcttgagtccttggc

SEQ ID NO: 561062 - DNA, 25 bp, Rattus norvegicus
acgctgagcttgagtccttggcggc

SEQ ID NO: 561063 - DNA, 25 bp, Rattus norvegicus
accttgacgggctttttgtctcgtg

SEQ ID NO: 561064 - DNA, 25 bp, Rattus norvegicus
cctcctcaccgggtgcagactgcca

SEQ ID NO: 561065 - DNA, 25 bp, Rattus norvegicus
tcagcgcgggattcgggctcgtttt

SEQ ID NO: 561066 - DNA, 25 bp, Rattus norvegicus
cgccgcaactgcagagcccgcgcgt

SEQ ID NO: 561067 - DNA, 25 bp, Rattus norvegicus
cggggcttttgcagccagacggtca

SEQ ID NO: 561068 - DNA, 25 bp, Rattus norvegicus
gcctagagcctctcgcccaggtcca

SEQ ID NO: 561069 - DNA, 25 bp, Rattus norvegicus
ctaaagagcttgctggaagtgccgt

SEQ ID NO: 561070 - DNA, 25 bp, Rattus norvegicus
cttgctggaagtgccgtggcttccg

SEQ ID NO: 561071 - DNA, 25 bp, Rattus norvegicus
tcccgggtctctgctgcagcggaag

SEQ ID NO: 561072 - DNA, 25 bp, Rattus norvegicus
agtgcctgcttgctccgccctgtca

SEQ ID NO: 561073 - DNA, 25 bp, Rattus norvegicus
tctgctgcagcggaagctgcccttg

SEQ ID NO: 561074 - DNA, 25 bp, Rattus norvegicus
gcggaagctgcccttgaccttcttg

SEQ ID NO: 561075 - DNA, 25 bp, Rattus norvegicus
gaccttcttggggtcgcagcctcac

SEQ ID NO: 561076 - DNA, 25 bp, Rattus norvegicus
ggtcgcagcctcacctccggatgtt

SEQ ID NO: 561077 - DNA, 25 bp, Rattus norvegicus
atgttccacgacctccgtgcgaatg

SEQ ID NO: 561078 - DNA, 25 bp, Rattus norvegicus
cacgacctccgtgcgaatggcgagg

SEQ ID NO: 561079 - DNA, 25 bp, Rattus norvegicus
cctgccattttctctgctacgtcgg

SEQ ID NO: 561080 - DNA, 25 bp, Rattus norvegicus
tctctgctacgtcggcaggctaaag

SEQ ID NO: 561081 - DNA, 25 bp, Rattus norvegicus
tacgtcggcaggctaaagagcttgc

SEQ ID NO: 561082 - DNA, 25 bp, Rattus norvegicus
agggcgccaagcctctgctctaatg

SEQ ID NO: 561083 - DNA, 25 bp, Rattus norvegicus
tcgcgagtgccagtgtcacttgccg

SEQ ID NO: 561084 - DNA, 25 bp, Rattus norvegicus
ctgagtgacccacagttctcctggg

SEQ ID NO: 561085 - DNA, 25 bp, Rattus norvegicus
tacgctaagatggtcgcgagtgcca

SEQ ID NO: 561086 - DNA, 25 bp, Rattus norvegicus
gtggggtttctacgctaagatggtc

SEQ ID NO: 561087 - DNA, 25 bp, Rattus norvegicus
aactgagtgagtggggtttctacgc

SEQ ID NO: 561088 - DNA, 25 bp, Rattus norvegicus
ctgggtccggaaggcgacctcgcct

SEQ ID NO: 561089 - DNA, 25 bp, Rattus norvegicus
tgcgcttcccagaggcccgtgtggc

SEQ ID NO: 561090 - DNA, 25 bp, Rattus norvegicus
cggaaggaacggactgagtgaccca

SEQ ID NO: 561091 - DNA, 25 bp, Rattus norvegicus
gagcacccgggtgcgcttcccagag

SEQ ID NO: 561092 - DNA, 25 bp, Rattus norvegicus
aagcaccacggggaccttgcggaag

SEQ ID NO: 561093 - DNA, 25 bp, Rattus norvegicus
cagacaacccggaattcagtgggaa

SEQ ID NO: 561094 - DNA, 25 bp, Rattus norvegicus
tatcagccacagacaacccggaatt

SEQ ID NO: 561095 - DNA, 25 bp, Rattus norvegicus
ttcagtgcccacgagcacccgggtg

SEQ ID NO: 561096 - DNA, 25 bp, Rattus norvegicus
aggcgacctcgcctgggaactgagt

SEQ ID NO: 561097 - DNA, 25 bp, Rattus norvegicus
cactcaccaacgatggcggatcgga

SEQ ID NO: 561098 - DNA, 25 bp, Rattus norvegicus
tgcatttcgccactccggacagagc

SEQ ID NO: 561099 - DNA, 25 bp, Rattus norvegicus
ctcaggctcagaaacgcgttctcta

SEQ ID NO: 561100 - DNA, 25 bp, Rattus norvegicus
gcctgattagctcgggcgctcgatt

SEQ ID NO: 561101 - DNA, 25 bp, Rattus norvegicus
agccaagcgtggctgaccgagtctc

SEQ ID NO: 561102 - DNA, 25 bp, Rattus norvegicus
ggagcgaagcgtctccctccatata

SEQ ID NO: 561103 - DNA, 25 bp, Rattus norvegicus
agcgaccggtagagccactagccag

SEQ ID NO: 561104 - DNA, 25 bp, Rattus norvegicus
ggattagacccgaccacaccagtga

SEQ ID NO: 561105 - DNA, 25 bp, Rattus norvegicus
gcggctgctccacctgcattcgaaa

SEQ ID NO: 561106 - DNA, 25 bp, Rattus norvegicus
aaaatctgcatcgtggcggctgctc

SEQ ID NO: 561107 - DNA, 25 bp, Rattus norvegicus
ggtcttccctgtaagggtcttcaca

SEQ ID NO: 561108 - DNA, 25 bp, Rattus norvegicus
cgtacctcgagcgtgatggtcttcc

SEQ ID NO: 561109 - DNA, 25 bp, Rattus norvegicus
gcgttctctattacacagggcctca

SEQ ID NO: 561110 - DNA, 25 bp, Rattus norvegicus
ggctgtctaacgcagtgcctgatta

SEQ ID NO: 561111 - DNA, 25 bp, Rattus norvegicus
cctccgtcttttgtgtcttggcctg

SEQ ID NO: 561112 - DNA, 25 bp, Rattus norvegicus
cgacccgccagccatggaagacata

SEQ ID NO: 561113 - DNA, 25 bp, Rattus norvegicus
aagctcccagaggacgacgagcctc

SEQ ID NO: 561114 - DNA, 25 bp, Rattus norvegicus
agaggcagccatcctgggaacgcag

SEQ ID NO: 561115 - DNA, 25 bp, Rattus norvegicus
tggacttcagcagcgactcggtgcc

SEQ ID NO: 561116 - DNA, 25 bp, Rattus norvegicus
gcccgccttcaagtaccagttcgtg

SEQ ID NO: 561117 - DNA, 25 bp, Rattus norvegicus
ggaagacatagaccagtcgtcgctg

SEQ ID NO: 561118 - DNA, 25 bp, Rattus norvegicus
acaaccgcccgcgactctgaggaga

SEQ ID NO: 561119 - DNA, 25 bp, Rattus norvegicus
gtcgcctctgcaggttcttcggctc

SEQ ID NO: 561120 - DNA, 25 bp, Rattus norvegicus
cagtctcattgttccgggagccgtc

SEQ ID NO: 561121 - DNA, 25 bp, Rattus norvegicus
gcacatctcgatcgcgaaggcagga

SEQ ID NO: 561122 - DNA, 25 bp, Rattus norvegicus
tggcctctctccattgctcgtctgg

SEQ ID NO: 561123 - DNA, 25 bp, Rattus norvegicus
tcttgggaccctagagctttgtcta

SEQ ID NO: 561124 - DNA, 25 bp, Rattus norvegicus
ccgggaaggtgagtcacgccaaact

SEQ ID NO: 561125 - DNA, 25 bp, Rattus norvegicus
atttccgcggcgacgcacagacaca

SEQ ID NO: 561126 - DNA, 25 bp, Rattus norvegicus
gggtacagcgccaggcgccgatttc

SEQ ID NO: 561127 - DNA, 25 bp, Rattus norvegicus
acctgcaagggctcagggtacagcg

SEQ ID NO: 561128 - DNA, 25 bp, Rattus norvegicus
ctcgagctgcgacggacctgcaagg

SEQ ID NO: 561129 - DNA, 25 bp, Rattus norvegicus
tgtcctcttcaaggctcgagctgcg

SEQ ID NO: 561130 - DNA, 25 bp, Rattus norvegicus
cgggcgccggttctgtcctcttcaa

SEQ ID NO: 561131 - DNA, 25 bp, Rattus norvegicus
gccatgataagccaacaccgcgcga

SEQ ID NO: 561132 - DNA, 25 bp, Rattus norvegicus
ggagctgtccgatccgccatgataa

SEQ ID NO: 561133 - DNA, 25 bp, Rattus norvegicus
ctcactgcacctgcgggcttcggga

SEQ ID NO: 561134 - DNA, 25 bp, Rattus norvegicus
cccgcctttaaaatcaaagatctgc

SEQ ID NO: 561135 - DNA, 25 bp, Rattus norvegicus
gatctgcatttccagacacggatta

SEQ ID NO: 561136 - DNA, 25 bp, Rattus norvegicus
gacacggattaccagttcgccaagt

SEQ ID NO: 561137 - DNA, 25 bp, Rattus norvegicus
taccagttcgccaagtttgaggagc

SEQ ID NO: 561138 - DNA, 25 bp, Rattus norvegicus
caccatcatctgctactgcgggaga

SEQ ID NO: 561139 - DNA, 25 bp, Rattus norvegicus
ttcttcgggaaaacacgtgagtctg

SEQ ID NO: 561140 - DNA, 25 bp, Rattus norvegicus
accctgtcattctcgcgggagagtc

SEQ ID NO: 561141 - DNA, 25 bp, Rattus norvegicus
agagtcagcggcaacgtccagatcc

SEQ ID NO: 561142 - DNA, 25 bp, Rattus norvegicus
gatccggtggaattaactcattttg

SEQ ID NO: 561143 - DNA, 25 bp, Rattus norvegicus
gcggcgacaacgttcagatccagtg

SEQ ID NO: 561144 - DNA, 25 bp, Rattus norvegicus
caggccaaagccgaggatgattttc

SEQ ID NO: 561145 - DNA, 25 bp, Rattus norvegicus
agcgccggcgcgagtatttatatac

SEQ ID NO: 561146 - DNA, 25 bp, Rattus norvegicus
tttatatacgcgcttccggctggtg

SEQ ID NO: 561147 - DNA, 25 bp, Rattus norvegicus
gcagttgccctgtatagacgttcga

SEQ ID NO: 561148 - DNA, 25 bp, Rattus norvegicus
ttggctcgctataaaaggtcccttc

SEQ ID NO: 561149 - DNA, 25 bp, Rattus norvegicus
acatccggacggacacagctttggc

SEQ ID NO: 561150 - DNA, 25 bp, Rattus norvegicus
ccctggggttctactgatttgcttt

SEQ ID NO: 561151 - DNA, 25 bp, Rattus norvegicus
cacgtgagtctgtgttactgggctc

SEQ ID NO: 561152 - DNA, 25 bp, Rattus norvegicus
tcttgtcactagcaaatggcggatg

SEQ ID NO: 561153 - DNA, 25 bp, Rattus norvegicus
ctcacccaggatggcgttggcgttc

SEQ ID NO: 561154 - DNA, 25 bp, Rattus norvegicus
gggagcctgcgtttctcctaccgga

SEQ ID NO: 561155 - DNA, 25 bp, Rattus norvegicus
tggtactagtgccaagggagcctgc

SEQ ID NO: 561156 - DNA, 25 bp, Rattus norvegicus
catcacagggccgtggtactagtgc

SEQ ID NO: 561157 - DNA, 25 bp, Rattus norvegicus
gtcccagggttctatgcatcacagg

SEQ ID NO: 561158 - DNA, 25 bp, Rattus norvegicus
agcgccctgggtgtactacaagtcc

SEQ ID NO: 561159 - DNA, 25 bp, Rattus norvegicus
taacctaactgctgcggcgagcgcc

SEQ ID NO: 561160 - DNA, 25 bp, Rattus norvegicus
gtcgtaggcctctgtaacctaactg

SEQ ID NO: 561161 - DNA, 25 bp, Rattus norvegicus
acgcatcttgggagtcgtaggcctc

SEQ ID NO: 561162 - DNA, 25 bp, Rattus norvegicus
cgcctgttccgtacgcatcttggga

SEQ ID NO: 561163 - DNA, 25 bp, Rattus norvegicus
agatgcccgcgagggctgaagcctc

SEQ ID NO: 561164 - DNA, 25 bp, Rattus norvegicus
ctctaggaaacgcagatgcccgcga

SEQ ID NO: 561165 - DNA, 25 bp, Rattus norvegicus
cggttactaggcgaaattgcggctc

SEQ ID NO: 561166 - DNA, 25 bp, Rattus norvegicus
gccagccagcgaaatcctctgcttg

SEQ ID NO: 561167 - DNA, 25 bp, Rattus norvegicus
tccggagagcgtgcacgcgctcgct

SEQ ID NO: 561168 - DNA, 25 bp, Rattus norvegicus
ttcgggtcttcaacaggttcctgcg

SEQ ID NO: 561169 - DNA, 25 bp, Rattus norvegicus
ccagagctccggagagcgtgcacgc

SEQ ID NO: 561170 - DNA, 25 bp, Rattus norvegicus
tgcctggctgcagagctgcgcccag

SEQ ID NO: 561171 - DNA, 25 bp, Rattus norvegicus
ccggaatcagtgcagctgtcgcctt

SEQ ID NO: 561172 - DNA, 25 bp, Rattus norvegicus
cagtgcagctgtcgcctttcaggct

SEQ ID NO: 561173 - DNA, 25 bp, Rattus norvegicus
aggatgccaactcacccggggctgc

SEQ ID NO: 561174 - DNA, 25 bp, Rattus norvegicus
ggctccgcagtgaggacgcttgccc

SEQ ID NO: 561175 - DNA, 25 bp, Rattus norvegicus
acgccctgggtgctgtcagtttggt

SEQ ID NO: 561176 - DNA, 25 bp, Rattus norvegicus
gggccttgtccaggctctgcgtgta

SEQ ID NO: 561177 - DNA, 25 bp, Rattus norvegicus
tccaggctctgcgtgtagcggcgtt

SEQ ID NO: 561178 - DNA, 25 bp, Rattus norvegicus
ttttttgcgcatgacgccgctgctg

SEQ ID NO: 561179 - DNA, 25 bp, Rattus norvegicus
ggctcaagaagcaccgccagggatg

SEQ ID NO: 561180 - DNA, 25 bp, Rattus norvegicus
agcctcctgccgttcgggtcttcaa

SEQ ID NO: 561181 - DNA, 25 bp, Rattus norvegicus
ccttttcgagtgatggtaatccgga

SEQ ID NO: 561182 - DNA, 25 bp, Rattus norvegicus
ccgcgcagtggctgcctgtgcccag

SEQ ID NO: 561183 - DNA, 25 bp, Rattus norvegicus
ctgcctgtgcccaggtgcacggctt

SEQ ID NO: 561184 - DNA, 25 bp, Rattus norvegicus
ctgtgcccaggtgcacggcttggtc

SEQ ID NO: 561185 - DNA, 25 bp, Rattus norvegicus
gtcggctcggctctgacccgcctct

SEQ ID NO: 561186 - DNA, 25 bp, Rattus norvegicus
tgggccctgcactccttttcgagtg

SEQ ID NO: 561187 - DNA, 25 bp, Rattus norvegicus
agtgatggtaatccggagacttttc

SEQ ID NO: 561188 - DNA, 25 bp, Rattus norvegicus
ctccttttcgagtgatggtaatccg

SEQ ID NO: 561189 - DNA, 25 bp, Rattus norvegicus
tcgagtgatggtaatccggagactt

SEQ ID NO: 561190 - DNA, 25 bp, Rattus norvegicus
tgtgtttgcagttggcgcccgcgca

SEQ ID NO: 561191 - DNA, 25 bp, Rattus norvegicus
tctgggccctgcactccttttcgag

SEQ ID NO: 561192 - DNA, 25 bp, Rattus norvegicus
tggtaatccggagacttttctgtta

SEQ ID NO: 561193 - DNA, 25 bp, Rattus norvegicus
ctgcactccttttcgagtgatggta

SEQ ID NO: 561194 - DNA, 25 bp, Rattus norvegicus
gccctgcactccttttcgagtgatg

SEQ ID NO: 561195 - DNA, 25 bp, Rattus norvegicus
gctcaccgcagctcccgattaaatt

SEQ ID NO: 561196 - DNA, 25 bp, Rattus norvegicus
ctgctctctgagcaggatcgcagcg

SEQ ID NO: 561197 - DNA, 25 bp, Rattus norvegicus
cgattaaattacaaaccggcagcgg

SEQ ID NO: 561198 - DNA, 25 bp, Rattus norvegicus
tgacatcactgagcagctcaccgca

SEQ ID NO: 561199 - DNA, 25 bp, Rattus norvegicus
atcaggtgacatcactgagcagctc

SEQ ID NO: 561200 - DNA, 25 bp, Rattus norvegicus
gctgttatgctaatcaggtgacatc

SEQ ID NO: 561201 - DNA, 25 bp, Rattus norvegicus
gcgtttcctctacaatgctgttatg

SEQ ID NO: 561202 - DNA, 25 bp, Rattus norvegicus
ggcctgcgtttcctctacaatgctg

SEQ ID NO: 561203 - DNA, 25 bp, Rattus norvegicus
tgttcggcctgcgtttcctctacaa

SEQ ID NO: 561204 - DNA, 25 bp, Rattus norvegicus
atctgcaaggttggcctgcgtgcgc

SEQ ID NO: 561205 - DNA, 25 bp, Rattus norvegicus
gtggaccgctcaaccgaactccgta

SEQ ID NO: 561206 - DNA, 25 bp, Rattus norvegicus
gacttttctgttaggtggaccgctc

SEQ ID NO: 561207 - DNA, 25 bp, Rattus norvegicus
cgaactccgtaattccagcagcttt

SEQ ID NO: 561208 - DNA, 25 bp, Rattus norvegicus
tgtgcgctgctctctgagcaggatc

SEQ ID NO: 561209 - DNA, 25 bp, Rattus norvegicus
ggtttgcgccctgcgcgtgcataaa

SEQ ID NO: 561210 - DNA, 25 bp, Rattus norvegicus
tcacagccataagggcgcgcaacta

SEQ ID NO: 561211 - DNA, 25 bp, Rattus norvegicus
ttccacgccggtgcggccgagttgt

SEQ ID NO: 561212 - DNA, 25 bp, Rattus norvegicus
actgcgagcagaaaagggccgtgcc

SEQ ID NO: 561213 - DNA, 25 bp, Rattus norvegicus
ctgacctgcggggtacagaggctcc

SEQ ID NO: 561214 - DNA, 25 bp, Rattus norvegicus
gccatgtgcacctagggcgcgctgc

SEQ ID NO: 561215 - DNA, 25 bp, Rattus norvegicus
cgagtgcgcggccatgtgcacctag

SEQ ID NO: 561216 - DNA, 25 bp, Rattus norvegicus
ccctgcgcgtgcataaagcccttta

SEQ ID NO: 561217 - DNA, 25 bp, Rattus norvegicus
tagagcaaagtgactcccatggagc

SEQ ID NO: 561218 - DNA, 25 bp, Rattus norvegicus
gcgactgtcacccactagagcaaag

SEQ ID NO: 561219 - DNA, 25 bp, Rattus norvegicus
taagggcgcgcaactatgagacctg

SEQ ID NO: 561220 - DNA, 25 bp, Rattus norvegicus
aagggccgtgccctaccgtggccag

SEQ ID NO: 561221 - DNA, 25 bp, Rattus norvegicus
agccctttattgaggcgacaggtga

SEQ ID NO: 561222 - DNA, 25 bp, Rattus norvegicus
cccagcgggttctgtctggaactgc

SEQ ID NO: 561223 - DNA, 25 bp, Rattus norvegicus
aggacatccagcatttcagggccgc

SEQ ID NO: 561224 - DNA, 25 bp, Rattus norvegicus
cgactggcttaaggtccagcccttt

SEQ ID NO: 561225 - DNA, 25 bp, Rattus norvegicus
tgcagaggacatccagcatttcagg

SEQ ID NO: 561226 - DNA, 25 bp, Rattus norvegicus
cataatggaattgcagaggacatcc

SEQ ID NO: 561227 - DNA, 25 bp, Rattus norvegicus
ccttaggtcgggcataatggaattg

SEQ ID NO: 561228 - DNA, 25 bp, Rattus norvegicus
tttcagggccgctgtcgccggccta

SEQ ID NO: 561229 - DNA, 25 bp, Rattus norvegicus
gcctgggccttaggtcgggcataat

SEQ ID NO: 561230 - DNA, 25 bp, Rattus norvegicus
tggaacgggatttttacggcgcagc

SEQ ID NO: 561231 - DNA, 25 bp, Rattus norvegicus
gggagtggagccacggaagctgctt

SEQ ID NO: 561232 - DNA, 25 bp, Rattus norvegicus
gtccagccctttcgcctgggcggga

SEQ ID NO: 561233 - DNA, 25 bp, Rattus norvegicus
taaggtccagccctttcgcctgggc

SEQ ID NO: 561234 - DNA, 25 bp, Rattus norvegicus
accgaccggaatgcgactggcttaa

SEQ ID NO: 561235 - DNA, 25 bp, Rattus norvegicus
ccggaatgcgactggcttaaggtcc

SEQ ID NO: 561236 - DNA, 25 bp, Rattus norvegicus
tccagcatttcagggccgctgtcgc

SEQ ID NO: 561237 - DNA, 25 bp, Rattus norvegicus
gtaccttgcactgtcccgaacactt

SEQ ID NO: 561238 - DNA, 25 bp, Rattus norvegicus
tccgtagtgaggacggccggacacc

SEQ ID NO: 561239 - DNA, 25 bp, Rattus norvegicus
cgcagtccgcagtccgtagtgagga

SEQ ID NO: 561240 - DNA, 25 bp, Rattus norvegicus
cgccgggtcacgcaagaccacagga

SEQ ID NO: 561241 - DNA, 25 bp, Rattus norvegicus
ctctgggaccgacgcctggcaggac

SEQ ID NO: 561242 - DNA, 25 bp, Rattus norvegicus
cagacgccaggcgaaggaggctcat

SEQ ID NO: 561243 - DNA, 25 bp, Rattus norvegicus
ccgaacacttcgtagtccacagact

SEQ ID NO: 561244 - DNA, 25 bp, Rattus norvegicus
ggttcaggccgtaccttgcactgtc

SEQ ID NO: 561245 - DNA, 25 bp, Rattus norvegicus
ggatggcgcaagctacctcctctct

SEQ ID NO: 561246 - DNA, 25 bp, Rattus norvegicus
atggctgcccagaagtcgctgcctc

SEQ ID NO: 561247 - DNA, 25 bp, Rattus norvegicus
ccctaagatggatggcgcaagctac

SEQ ID NO: 561248 - DNA, 25 bp, Rattus norvegicus
gtcgctgcctcagcggaaagaccca

SEQ ID NO: 561249 - DNA, 25 bp, Rattus norvegicus
agtccacagacttaagcggctccgc

SEQ ID NO: 561250 - DNA, 25 bp, Rattus norvegicus
ggctgctgtgtcatggctgcccaga

SEQ ID NO: 561251 - DNA, 25 bp, Rattus norvegicus
gtctttggggaagcgaatcctgtcc

SEQ ID NO: 561252 - DNA, 25 bp, Rattus norvegicus
ctcgcgtggaaaccacagccgctga

SEQ ID NO: 561253 - DNA, 25 bp, Rattus norvegicus
aaactcagctgtcggggagaaagcc

SEQ ID NO: 561254 - DNA, 25 bp, Rattus norvegicus
ctgcagcgtcaccagacgagccgga

SEQ ID NO: 561255 - DNA, 25 bp, Rattus norvegicus
tcgtcccgcagaaagagatcgtgta

SEQ ID NO: 561256 - DNA, 25 bp, Rattus norvegicus
tcgtgtacaacaagcttctgcccta

SEQ ID NO: 561257 - DNA, 25 bp, Rattus norvegicus
ttgcagctggcgcagatcaagagca

SEQ ID NO: 561258 - DNA, 25 bp, Rattus norvegicus
gcctcttctggacgcggaaactctc

SEQ ID NO: 561259 - DNA, 25 bp, Rattus norvegicus
tctccacgtaagtgggctgaagctg

SEQ ID NO: 561260 - DNA, 25 bp, Rattus norvegicus
tgccgctgctcaactttgtcctgtc

SEQ ID NO: 561261 - DNA, 25 bp, Rattus norvegicus
gcgctcagtctcctggttggtttct

SEQ ID NO: 561262 - DNA, 25 bp, Rattus norvegicus
gggtcctgctgttcgcctctcagga

SEQ ID NO: 561263 - DNA, 25 bp, Rattus norvegicus
gacgagtggcttccattggttctcc

SEQ ID NO: 561264 - DNA, 25 bp, Rattus norvegicus
ctcaggatcagcgttccggtccttt

SEQ ID NO: 561265 - DNA, 25 bp, Rattus norvegicus
gcgatgacggtgatgactctagccc

SEQ ID NO: 561266 - DNA, 25 bp, Rattus norvegicus
atgacggtgatgactctagcccggc

SEQ ID NO: 561267 - DNA, 25 bp, Rattus norvegicus
cggtgatgactctagcccggcagca

SEQ ID NO: 561268 - DNA, 25 bp, Rattus norvegicus
gtgatgactctagcccggcagcatc

SEQ ID NO: 561269 - DNA, 25 bp, Rattus norvegicus
gctgcgccccgggttctgtgactgc

SEQ ID NO: 561270 - DNA, 25 bp, Rattus norvegicus
actctagcccggcagcatccaggcc

SEQ ID NO: 561271 - DNA, 25 bp, Rattus norvegicus
gcggccacggtcagagggaggggct

SEQ ID NO: 561272 - DNA, 25 bp, Rattus norvegicus
cagcatccaggccaccgggcgcaga

SEQ ID NO: 561273 - DNA, 25 bp, Rattus norvegicus
gagcatccaggccaccgggcgcaga

SEQ ID NO: 561274 - DNA, 25 bp, Rattus norvegicus
cgcagatagggtcgctgctgcgaca

SEQ ID NO: 561275 - DNA, 25 bp, Rattus norvegicus
cagatagggtcgctgctgcgacatg

SEQ ID NO: 561276 - DNA, 25 bp, Rattus norvegicus
tcgctgctgcgacatggaggaggaa

SEQ ID NO: 561277 - DNA, 25 bp, Rattus norvegicus
ggttctgtgactgcgccgccggccc

SEQ ID NO: 561278 - DNA, 25 bp, Rattus norvegicus
gctcgcctaggctcccgggatgcgt

SEQ ID NO: 561279 - DNA, 25 bp, Rattus norvegicus
gtctccttccggacggctgggcaaa

SEQ ID NO: 561280 - DNA, 25 bp, Rattus norvegicus
cgttggtgcaggagactcaaccgcc

SEQ ID NO: 561281 - DNA, 25 bp, Rattus norvegicus
cttacaaggacttcgggccaccgct

SEQ ID NO: 561282 - DNA, 25 bp, Rattus norvegicus
gcaggcagcacatcaacatccgagg

SEQ ID NO: 561283 - DNA, 25 bp, Rattus norvegicus
tgcaccgcattgctgccgtagcgtc

SEQ ID NO: 561284 - DNA, 25 bp, Rattus norvegicus
gactcaaacgcggaggcccgagaca

SEQ ID NO: 561285 - DNA, 25 bp, Rattus norvegicus
gcccgagacagacgccggttgaacc

SEQ ID NO: 561286 - DNA, 25 bp, Rattus norvegicus
ttgaaccggtctggagacagcactt

SEQ ID NO: 561287 - DNA, 25 bp, Rattus norvegicus
gcgaggagttcagccacaagggtct

SEQ ID NO: 561288 - DNA, 25 bp, Rattus norvegicus
ggccggctctcaaaaagcgagtgga

SEQ ID NO: 561289 - DNA, 25 bp, Rattus norvegicus
gcctccaggagaccgtacagaacca

SEQ ID NO: 561290 - DNA, 25 bp, Rattus norvegicus
gtacagaaccagcaacagcggccct

SEQ ID NO: 561291 - DNA, 25 bp, Rattus norvegicus
cgggactacaaagcgacgttggtgc

SEQ ID NO: 561292 - DNA, 25 bp, Rattus norvegicus
agcgtcctagcggttggactcaaac

SEQ ID NO: 561293 - DNA, 25 bp, Rattus norvegicus
ggattcctccacagtgtcaagtaga

SEQ ID NO: 561294 - DNA, 25 bp, Rattus norvegicus
tcagcgctctgaagagacgtttgcg

SEQ ID NO: 561295 - DNA, 25 bp, Rattus norvegicus
tcgcgtgcggaagaggacagttctt

SEQ ID NO: 561296 - DNA, 25 bp, Rattus norvegicus
ccacgtagcgtcaaacctgaacctg

SEQ ID NO: 561297 - DNA, 25 bp, Rattus norvegicus
ggcggcgaagctttcggattcctcc

SEQ ID NO: 561298 - DNA, 25 bp, Rattus norvegicus
cacagcactgtgtctatgggcgatg

SEQ ID NO: 561299 - DNA, 25 bp, Rattus norvegicus
cgatggggccaatgttgctagacct

SEQ ID NO: 561300 - DNA, 25 bp, Rattus norvegicus
acctggctcggcgaacgctgacaga

SEQ ID NO: 561301 - DNA, 25 bp, Rattus norvegicus
ggttcctgccacactcctgttcttt

SEQ ID NO: 561302 - DNA, 25 bp, Rattus norvegicus
ctctgtaagtagatgagaacgcatc

SEQ ID NO: 561303 - DNA, 25 bp, Rattus norvegicus
cgcatctggagttgagtcgttttgt

SEQ ID NO: 561304 - DNA, 25 bp, Rattus norvegicus
gtgttcgctcgtttcaatgtctgta

SEQ ID NO: 561305 - DNA, 25 bp, Rattus norvegicus
caatgtctgtaagatcgcgtgcgga

SEQ ID NO: 561306 - DNA, 25 bp, Rattus norvegicus
ctgaacctgtttccggcatccacgg

SEQ ID NO: 561307 - DNA, 25 bp, Rattus norvegicus
aggggccgcgatacccttctccatg

SEQ ID NO: 561308 - DNA, 25 bp, Rattus norvegicus
ctgctcaagcagcagaggacagcgg

SEQ ID NO: 561309 - DNA, 25 bp, Rattus norvegicus
ggttggacttcttatcagactcctc

SEQ ID NO: 561310 - DNA, 25 bp, Rattus norvegicus
ggacttcttatcagactcctccttg

SEQ ID NO: 561311 - DNA, 25 bp, Rattus norvegicus
tatcagactcctccttgctaggggc

SEQ ID NO: 561312 - DNA, 25 bp, Rattus norvegicus
tagctaccggaggtccggcccacga

SEQ ID NO: 561313 - DNA, 25 bp, Rattus norvegicus
tccggcccacgatgcagtgccgggt

SEQ ID NO: 561314 - DNA, 25 bp, Rattus norvegicus
atgctgcacttctccagcgcctgag

SEQ ID NO: 561315 - DNA, 25 bp, Rattus norvegicus
gacatgtctgcgtttgtgatcacca

SEQ ID NO: 561316 - DNA, 25 bp, Rattus norvegicus
gtctgcgtttgtgatcaccaccttc

SEQ ID NO: 561317 - DNA, 25 bp, Rattus norvegicus
gcgtttgtgatcaccaccttccagt

SEQ ID NO: 561318 - DNA, 25 bp, Rattus norvegicus
ttgtgatcaccaccttccagtcgca

SEQ ID NO: 561319 - DNA, 25 bp, Rattus norvegicus
aggacagcgggtcgctactgaaacc

SEQ ID NO: 561320 - DNA, 25 bp, Rattus norvegicus
actcctccttgctaggggccgcgat

SEQ ID NO: 561321 - DNA, 25 bp, Rattus norvegicus
ctgaccgaacttggcgatttttctt

SEQ ID NO: 561322 - DNA, 25 bp, Rattus norvegicus
aactcctctccgtggcacgtgactg

SEQ ID NO: 561323 - DNA, 25 bp, Rattus norvegicus
tccgtggcacgtgactgtgatgtca

SEQ ID NO: 561324 - DNA, 25 bp, Rattus norvegicus
gactgtgatgtcaggcagcaaatgg

SEQ ID NO: 561325 - DNA, 25 bp, Rattus norvegicus
cagcaaatggggaaacacgggcatc

SEQ ID NO: 561326 - DNA, 25 bp, Rattus norvegicus
aacacgggcatcctgggtaactcta

SEQ ID NO: 561327 - DNA, 25 bp, Rattus norvegicus
atcctgggtaactctagaatccgcc

SEQ ID NO: 561328 - DNA, 25 bp, Rattus norvegicus
tagaatccgccctataactagtcgg

SEQ ID NO: 561329 - DNA, 25 bp, Rattus norvegicus
aactagtcggacagttttgggcgca

SEQ ID NO: 561330 - DNA, 25 bp, Rattus norvegicus
cgcagctcgcagcagatttaccgca

SEQ ID NO: 561331 - DNA, 25 bp, Rattus norvegicus
tcgcagcagatttaccgcatcggtg

SEQ ID NO: 561332 - DNA, 25 bp, Rattus norvegicus
ttaccgcatcggtgtgggtcatgtt

SEQ ID NO: 561333 - DNA, 25 bp, Rattus norvegicus
catcggtgtgggtcatgtttgtaac

SEQ ID NO: 561334 - DNA, 25 bp, Rattus norvegicus
gccaaagtcgcactgaccgaacttg

SEQ ID NO: 561335 - DNA, 25 bp, Rattus norvegicus
tctgcgaatgttttcccacgttttc

SEQ ID NO: 561336 - DNA, 25 bp, Rattus norvegicus
tttacctcttcgctgttctgtctgc

SEQ ID NO: 561337 - DNA, 25 bp, Rattus norvegicus
catcgccgcatcgaacgctactaaa

SEQ ID NO: 561338 - DNA, 25 bp, Rattus norvegicus
ggctgctttcatggtccacctcatc

SEQ ID NO: 561339 - DNA, 25 bp, Rattus norvegicus
tattcggtctgctgtcgcggagaca

SEQ ID NO: 561340 - DNA, 25 bp, Rattus norvegicus
agacattgggcgagctctctggtgt

SEQ ID NO: 561341 - DNA, 25 bp, Rattus norvegicus
gctctctggtgtatgtgtaacctga

SEQ ID NO: 561342 - DNA, 25 bp, Rattus norvegicus
ctgagggaaagcacgaggacgtctc

SEQ ID NO: 561343 - DNA, 25 bp, Rattus norvegicus
aggacgtctcttcagtgggtgtaga

SEQ ID NO: 561344 - DNA, 25 bp, Rattus norvegicus
cgtgcgcggctttaggaaacaatcc

SEQ ID NO: 561345 - DNA, 25 bp, Rattus norvegicus
caatcctgtttgtcttaagttcgtt

SEQ ID NO: 561346 - DNA, 25 bp, Rattus norvegicus
gttcgtttccagtcgcacagctctc

SEQ ID NO: 561347 - DNA, 25 bp, Rattus norvegicus
cacagctctcaaagtgcgtgggcgg

SEQ ID NO: 561348 - DNA, 25 bp, Rattus norvegicus
ccacgttttcgttattcggtctgct

SEQ ID NO: 561349 - DNA, 25 bp, Rattus norvegicus
cgctccagaccggaacctctttaag

SEQ ID NO: 561350 - DNA, 25 bp, Rattus norvegicus
gtcgagcttgcttccggctctagtt

SEQ ID NO: 561351 - DNA, 25 bp, Rattus norvegicus
gtgcccacgaaacggagaagcgctg

SEQ ID NO: 561352 - DNA, 25 bp, Rattus norvegicus
ggggctctacagcttttgtgctttc

SEQ ID NO: 561353 - DNA, 25 bp, Rattus norvegicus
gctttctaaagcagccaagctctcg

SEQ ID NO: 561354 - DNA, 25 bp, Rattus norvegicus
agcagccaagctctcgccgaacgga

SEQ ID NO: 561355 - DNA, 25 bp, Rattus norvegicus
gccgaacggagctaaatgcagcatt

SEQ ID NO: 561356 - DNA, 25 bp, Rattus norvegicus
cttccttccggcagcttctagtcga

SEQ ID NO: 561357 - DNA, 25 bp, Rattus norvegicus
agcttctagtcgagcctgctttttc

SEQ ID NO: 561358 - DNA, 25 bp, Rattus norvegicus
agcctgctttttctcggttgtgcca

SEQ ID NO: 561359 - DNA, 25 bp, Rattus norvegicus
ggttgtgccagctttacgtcatctc

SEQ ID NO: 561360 - DNA, 25 bp, Rattus norvegicus
cctctttaaggcacaggcgtcgagc

SEQ ID NO: 561361 - DNA, 25 bp, Rattus norvegicus
cggcactgccttatttcgctccaga

SEQ ID NO: 561362 - DNA, 25 bp, Rattus norvegicus
ctctagttctgaagtcgagcacgcg

SEQ ID NO: 561363 - DNA, 25 bp, Rattus norvegicus
gcctcctaggagcttggcgtctgta

SEQ ID NO: 561364 - DNA, 25 bp, Rattus norvegicus
cagcggaagcaaccggacgaggtta

SEQ ID NO: 561365 - DNA, 25 bp, Rattus norvegicus
gctgccggctctgcagaaacacgtg

SEQ ID NO: 561366 - DNA, 25 bp, Rattus norvegicus
gaaacacgtgcccttccgcttgctg

SEQ ID NO: 561367 - DNA, 25 bp, Rattus norvegicus
gacgcaactcgctctctgacttacg

SEQ ID NO: 561368 - DNA, 25 bp, Rattus norvegicus
ggtcaccgctttaggcctaggtagc

SEQ ID NO: 561369 - DNA, 25 bp, Rattus norvegicus
cgccatgtcgctgctgcagtctgca

SEQ ID NO: 561370 - DNA, 25 bp, Rattus norvegicus
ccggaaaagtcacggctgggatgta

SEQ ID NO: 561371 - DNA, 25 bp, Rattus norvegicus
ctgagaccgagagagtcacgactga

SEQ ID NO: 561372 - DNA, 25 bp, Rattus norvegicus
cacgactgaggtgtgggtcagatca

SEQ ID NO: 561373 - DNA, 25 bp, Rattus norvegicus
cctaggtagcaaagaggatcgtgtc

SEQ ID NO: 561374 - DNA, 25 bp, Rattus norvegicus
gggagtcatctttctgggcatagtc

SEQ ID NO: 561375 - DNA, 25 bp, Rattus norvegicus
tcatcgctacgaagggacaccgccg

SEQ ID NO: 561376 - DNA, 25 bp, Rattus norvegicus
accagagtgacttcgtggggcagac

SEQ ID NO: 561377 - DNA, 25 bp, Rattus norvegicus
cggtgcggtttcctgtcgttcagga

SEQ ID NO: 561378 - DNA, 25 bp, Rattus norvegicus
ttcaggatgggttccggtgccattt

SEQ ID NO: 561379 - DNA, 25 bp, Rattus norvegicus
cgttcaggatgggttccggtgccat

SEQ ID NO: 561380 - DNA, 25 bp, Rattus norvegicus
cggtgccgtttcctgtcgttcagga

SEQ ID NO: 561381 - DNA, 25 bp, Rattus norvegicus
ttccggtgccgtttcctgttgttca

SEQ ID NO: 561382 - DNA, 25 bp, Rattus norvegicus
cggtgccgtttcctgttgttcagga

SEQ ID NO: 561383 - DNA, 25 bp, Rattus norvegicus
cggtgccatttcctgtcgttcagga

SEQ ID NO: 561384 - DNA, 25 bp, Rattus norvegicus
ggtgccgtttcctgtccttcaggat

SEQ ID NO: 561385 - DNA, 25 bp, Rattus norvegicus
ttcctgtcgttcaggatgagttccg

SEQ ID NO: 561386 - DNA, 25 bp, Rattus norvegicus
ttcctgtcgttcaggatgggttccg

SEQ ID NO: 561387 - DNA, 25 bp, Rattus norvegicus
tttcggtgccgtttcctgtcgttca

SEQ ID NO: 561388 - DNA, 25 bp, Rattus norvegicus
gtgccgtttcctgtcgttcaggatg

SEQ ID NO: 561389 - DNA, 25 bp, Rattus norvegicus
cggtgccgtttcctgtccttcagga

SEQ ID NO: 561390 - DNA, 25 bp, Rattus norvegicus
tttcctgtcgttcaggatgggttcc

SEQ ID NO: 561391 - DNA, 25 bp, Rattus norvegicus
ctgttgtcgctgctgctcgtggcac

SEQ ID NO: 561392 - DNA, 25 bp, Rattus norvegicus
ctgctcgtggcacggctgcttcggc

SEQ ID NO: 561393 - DNA, 25 bp, Rattus norvegicus
cacgctcctgcggtcgcttttgttc

SEQ ID NO: 561394 - DNA, 25 bp, Rattus norvegicus
gcggtcgcttttgttctcatagtcc

SEQ ID NO: 561395 - DNA, 25 bp, Rattus norvegicus
cccaggatgagaaaggtcatcctga

SEQ ID NO: 561396 - DNA, 25 bp, Rattus norvegicus
aggtcatcctgaggcgggccgtcta

SEQ ID NO: 561397 - DNA, 25 bp, Rattus norvegicus
aagttcccgccgtagaagtcttgct

SEQ ID NO: 561398 - DNA, 25 bp, Rattus norvegicus
gtagaagtcttgctccgggcacgta

SEQ ID NO: 561399 - DNA, 25 bp, Rattus norvegicus
cttgctccgggcacgtagtggtaga

SEQ ID NO: 561400 - DNA, 25 bp, Rattus norvegicus
agttctcggggagggagatttcaca

SEQ ID NO: 561401 - DNA, 25 bp, Rattus norvegicus
gaggtggaccacgtggcactgtcca

SEQ ID NO: 561402 - DNA, 25 bp, Rattus norvegicus
tggcactgtccacgctgtgcttgtc

SEQ ID NO: 561403 - DNA, 25 bp, Rattus norvegicus
actgtccacgctgtgcttgtcgtcg

SEQ ID NO: 561404 - DNA, 25 bp, Rattus norvegicus
acgaacgtctcgctgttgtcgctgc

SEQ ID NO: 561405 - DNA, 25 bp, Rattus norvegicus
ttattattccgagtgtaacttgccg

SEQ ID NO: 561406 - DNA, 25 bp, Rattus norvegicus
cttcgccacgcgctcgagcaggaag

SEQ ID NO: 561407 - DNA, 25 bp, Rattus norvegicus
ttgtgagcccggaggccttcgccac

SEQ ID NO: 561408 - DNA, 25 bp, Rattus norvegicus
taattatcttgtgagcccggaggcc

SEQ ID NO: 561409 - DNA, 25 bp, Rattus norvegicus
cgttcatcctggtaatctaattatc

SEQ ID NO: 561410 - DNA, 25 bp, Rattus norvegicus
atccttccttgcgttcatcctggta

SEQ ID NO: 561411 - DNA, 25 bp, Rattus norvegicus
cctgcaaagcactaatccttccttg

SEQ ID NO: 561412 - DNA, 25 bp, Rattus norvegicus
acgccgtgtttatctgccctgcaaa

SEQ ID NO: 561413 - DNA, 25 bp, Rattus norvegicus
aacaaccgcacttgcagttcctgtg

SEQ ID NO: 561414 - DNA, 25 bp, Rattus norvegicus
ggggctcaacgcacaaacaaccgca

SEQ ID NO: 561415 - DNA, 25 bp, Rattus norvegicus
cgaccttgttcaggcaggggctcaa

SEQ ID NO: 561416 - DNA, 25 bp, Rattus norvegicus
caggcgtctacagcgcgaccttgtt

SEQ ID NO: 561417 - DNA, 25 bp, Rattus norvegicus
cccaggcagagctgatcaggcgtct

SEQ ID NO: 561418 - DNA, 25 bp, Rattus norvegicus
tgtaacttgccgaagccctacggtc

SEQ ID NO: 561419 - DNA, 25 bp, Rattus norvegicus
cctaaagatgagttcgggccggcag

SEQ ID NO: 561420 - DNA, 25 bp, Rattus norvegicus
cagagccacagctgcgtggaaagtt

SEQ ID NO: 561421 - DNA, 25 bp, Rattus norvegicus
accctgccagggatgcgggacctac

SEQ ID NO: 561422 - DNA, 25 bp, Rattus norvegicus
atgcgggacctacaagagatggctg

SEQ ID NO: 561423 - DNA, 25 bp, Rattus norvegicus
acctacaagagatggctggcggctg

SEQ ID NO: 561424 - DNA, 25 bp, Rattus norvegicus
cctgcgtgctgctctcagaggaagc

SEQ ID NO: 561425 - DNA, 25 bp, Rattus norvegicus
attcgccgggcctgcgtgctgctct

SEQ ID NO: 561426 - DNA, 25 bp, Rattus norvegicus
ggctgcgccgatgtccaggctccta

SEQ ID NO: 561427 - DNA, 25 bp, Rattus norvegicus
tgccctttactttccagggtgagcg

SEQ ID NO: 561428 - DNA, 25 bp, Rattus norvegicus
cggcagggtgccctttactttccag

SEQ ID NO: 561429 - DNA, 25 bp, Rattus norvegicus
tccaggctcctaggactggcctaaa

SEQ ID NO: 561430 - DNA, 25 bp, Rattus norvegicus
gtcaagtcacctaccctgccaggga

SEQ ID NO: 561431 - DNA, 25 bp, Rattus norvegicus
ctaggactggcctaaagatgagttc

SEQ ID NO: 561432 - DNA, 25 bp, Rattus norvegicus
tgctgctctcagaggaagcccggga

SEQ ID NO: 561433 - DNA, 25 bp, Rattus norvegicus
ggagacggccaccagccctcacttt

SEQ ID NO: 561434 - DNA, 25 bp, Rattus norvegicus
cgcagcggtgctttctcagcagggt

SEQ ID NO: 561435 - DNA, 25 bp, Rattus norvegicus
ggtggatcccgagccgtccgtcagc

SEQ ID NO: 561436 - DNA, 25 bp, Rattus norvegicus
agcggtgctttctcagcagggtccc

SEQ ID NO: 561437 - DNA, 25 bp, Rattus norvegicus
cggagagggtgagcgccgcgccagc

SEQ ID NO: 561438 - DNA, 25 bp, Rattus norvegicus
cccgaggcgaggatagaagggcacg

SEQ ID NO: 561439 - DNA, 25 bp, Rattus norvegicus
ccaccagccctcactttccgggatg

SEQ ID NO: 561440 - DNA, 25 bp, Rattus norvegicus
ggagcagcggcgagggaaggaagta

SEQ ID NO: 561441 - DNA, 25 bp, Rattus norvegicus
tgcagtttctgcggccggcctggta

SEQ ID NO: 561442 - DNA, 25 bp, Rattus norvegicus
tgatggagaggagcagcccgtgcac

SEQ ID NO: 561443 - DNA, 25 bp, Rattus norvegicus
ctcctgccgagggtgcgggcaagca

SEQ ID NO: 561444 - DNA, 25 bp, Rattus norvegicus
agccgtccgtcagccggcgcgggag

SEQ ID NO: 561445 - DNA, 25 bp, Rattus norvegicus
cagcagctgcgggagacggccacca

SEQ ID NO: 561446 - DNA, 25 bp, Rattus norvegicus
ccgcgcggctgcagtttctgcggcc

SEQ ID NO: 561447 - DNA, 25 bp, Rattus norvegicus
tcaccttttctacgagggccaagtg

SEQ ID NO: 561448 - DNA, 25 bp, Rattus norvegicus
cttcggtcagatccctaagcaggta

SEQ ID NO: 561449 - DNA, 25 bp, Rattus norvegicus
ggcttcattaacaacttcggtcaga

SEQ ID NO: 561450 - DNA, 25 bp, Rattus norvegicus
atccctaagcaggtacggctgctcc

SEQ ID NO: 561451 - DNA, 25 bp, Rattus norvegicus
gagacggccaccatcggcttcatta

SEQ ID NO: 561452 - DNA, 25 bp, Rattus norvegicus
gacccgctaaaggagacggccacca

SEQ ID NO: 561453 - DNA, 25 bp, Rattus norvegicus
gggccaagtggatatctacaacata

SEQ ID NO: 561454 - DNA, 25 bp, Rattus norvegicus
catcttcggctataagcagcagggc

SEQ ID NO: 561455 - DNA, 25 bp, Rattus norvegicus
tggatcgacctcatcttcggctata

SEQ ID NO: 561456 - DNA, 25 bp, Rattus norvegicus
cacctgcacgagtggatcgacctca

SEQ ID NO: 561457 - DNA, 25 bp, Rattus norvegicus
gcgactacgtgagtgcccacctgca

SEQ ID NO: 561458 - DNA, 25 bp, Rattus norvegicus
ggctgcttcggaatcacaggctctg

SEQ ID NO: 561459 - DNA, 25 bp, Rattus norvegicus
tcacaggctctggagtgcgactacg

SEQ ID NO: 561460 - DNA, 25 bp, Rattus norvegicus
tggaggctgtgaacgtcttccatca

SEQ ID NO: 561461 - DNA, 25 bp, Rattus norvegicus
cactcgttctgtgtctgggtcggct

SEQ ID NO: 561462 - DNA, 25 bp, Rattus norvegicus
aggtcgtaggccttcgtcaagtagg

SEQ ID NO: 561463 - DNA, 25 bp, Rattus norvegicus
gggctccgggtacacatccttgtcc

SEQ ID NO: 561464 - DNA, 25 bp, Rattus norvegicus
atccttgtcccaagagtccggcatg

SEQ ID NO: 561465 - DNA, 25 bp, Rattus norvegicus
agagtccggcatggtttaagcgaac

SEQ ID NO: 561466 - DNA, 25 bp, Rattus norvegicus
ctgcggaccttccactcgttctgtg

SEQ ID NO: 561467 - DNA, 25 bp, Rattus norvegicus
tgtctgggtcggctcggcctgctaa

SEQ ID NO: 561468 - DNA, 25 bp, Rattus norvegicus
tacgcctgcgcagaaagacggcagc

SEQ ID NO: 561469 - DNA, 25 bp, Rattus norvegicus
cagccgcgaggtaccatgggattgt

SEQ ID NO: 561470 - DNA, 25 bp, Rattus norvegicus
agggtcacgggccagtccacgacga

SEQ ID NO: 561471 - DNA, 25 bp, Rattus norvegicus
attgtggttcgcctctctggcaccc

SEQ ID NO: 561472 - DNA, 25 bp, Rattus norvegicus
tccacgacgaggtcgtaggccttcg

SEQ ID NO: 561473 - DNA, 25 bp, Rattus norvegicus
accatgggattgtggttcgcctctc

SEQ ID NO: 561474 - DNA, 25 bp, Rattus norvegicus
cttcgtcaagtaggtgatggggtta

SEQ ID NO: 561475 - DNA, 25 bp, Rattus norvegicus
catcaacgagcgagcgctcgaggcc

SEQ ID NO: 561476 - DNA, 25 bp, Rattus norvegicus
tgctctcggtttcgtggtcgccgcc

SEQ ID NO: 561477 - DNA, 25 bp, Rattus norvegicus
cccagaacggcatcaacgagcgagc

SEQ ID NO: 561478 - DNA, 25 bp, Rattus norvegicus
gcccttccgaggaaaggcgagagtg

SEQ ID NO: 561479 - DNA, 25 bp, Rattus norvegicus
agctccagcatgtcccgctctcgcg

SEQ ID NO: 561480 - DNA, 25 bp, Rattus norvegicus
cactttgtcgctggtgctctcggtt

SEQ ID NO: 561481 - DNA, 25 bp, Rattus norvegicus
cgcactcactcactttgtcgctggt

SEQ ID NO: 561482 - DNA, 25 bp, Rattus norvegicus
gggaagacacgcaggacccccgcga

SEQ ID NO: 561483 - DNA, 25 bp, Rattus norvegicus
tgcagtctggttccggagcgactac

SEQ ID NO: 561484 - DNA, 25 bp, Rattus norvegicus
agaagctagagtgcagtctggttcc

SEQ ID NO: 561485 - DNA, 25 bp, Rattus norvegicus
ctgcggggacgggttccatcctgac

SEQ ID NO: 561486 - DNA, 25 bp, Rattus norvegicus
ggcagccactagacggccagagcgc

SEQ ID NO: 561487 - DNA, 25 bp, Rattus norvegicus
agtggtggcagccactagacggcca

SEQ ID NO: 561488 - DNA, 25 bp, Rattus norvegicus
gaacggcatcaacgagcgagcgctc

SEQ ID NO: 561489 - DNA, 25 bp, Rattus norvegicus
agggactcagcccagcttaacacgc

SEQ ID NO: 561490 - DNA, 25 bp, Rattus norvegicus
ccctggtgatgacgtcaacgtccag

SEQ ID NO: 561491 - DNA, 25 bp, Rattus norvegicus
ggtgtgggaccagccaagggctgga

SEQ ID NO: 561492 - DNA, 25 bp, Rattus norvegicus
gcccggaagttctcctcggcgcagg

SEQ ID NO: 561493 - DNA, 25 bp, Rattus norvegicus
cggaagttctcctcggcgcagggat

SEQ ID NO: 561494 - DNA, 25 bp, Rattus norvegicus
tctcctcggcgcagggatgtcagga

SEQ ID NO: 561495 - DNA, 25 bp, Rattus norvegicus
cagggatgtcaggaggagttcaacc

SEQ ID NO: 561496 - DNA, 25 bp, Rattus norvegicus
gcccagcttaacacgccgtagcgtg

SEQ ID NO: 561497 - DNA, 25 bp, Rattus norvegicus
ttaacacgccgtagcgtggcggagc

SEQ ID NO: 561498 - DNA, 25 bp, Rattus norvegicus
cccaagcagaaacttgctgggcagg

SEQ ID NO: 561499 - DNA, 25 bp, Rattus norvegicus
gcagaaacttgctgggcaggacaga

SEQ ID NO: 561500 - DNA, 25 bp, Rattus norvegicus
tgggcaggacagacccgttggctcc

SEQ ID NO: 561501 - DNA, 25 bp, Rattus norvegicus
gagttcaaccgactcctccaaggga

SEQ ID NO: 561502 - DNA, 25 bp, Rattus norvegicus
atgtcaggaggagttcaaccgactc

SEQ ID NO: 561503 - DNA, 25 bp, Rattus norvegicus
gacattttctgctgcgcagctcgca

SEQ ID NO: 561504 - DNA, 25 bp, Rattus norvegicus
actcccggagtcgagaaagcgccaa

SEQ ID NO: 561505 - DNA, 25 bp, Rattus norvegicus
ctcccgcggggcatttggacatttt

SEQ ID NO: 561506 - DNA, 25 bp, Rattus norvegicus
gatcgaatcccggactcccggagtc

SEQ ID NO: 561507 - DNA, 25 bp, Rattus norvegicus
aagcagagctctctgagtcgggagc

SEQ ID NO: 561508 - DNA, 25 bp, Rattus norvegicus
ttgttgcaaactctctgggccagcc

SEQ ID NO: 561509 - DNA, 25 bp, Rattus norvegicus
ctcttacatcaaagcgatcgctccg

SEQ ID NO: 561510 - DNA, 25 bp, Rattus norvegicus
atctccgcgagagccgtttgcgctc

SEQ ID NO: 561511 - DNA, 25 bp, Rattus norvegicus
gcacggcatcaacgacatcctgagc

SEQ ID NO: 561512 - DNA, 25 bp, Rattus norvegicus
agtcacacttcgcttgcgcgcgagc

SEQ ID NO: 561513 - DNA, 25 bp, Rattus norvegicus
gcagagcgcgttcctgctcagcagc

SEQ ID NO: 561514 - DNA, 25 bp, Rattus norvegicus
cacagcatggccgagatgaagaccc

SEQ ID NO: 561515 - DNA, 25 bp, Rattus norvegicus
ctttgggcgcacacaacccgggcgg

SEQ ID NO: 561516 - DNA, 25 bp, Rattus norvegicus
tccgagcgagaacagaggcgcgcac

SEQ ID NO: 561517 - DNA, 25 bp, Rattus norvegicus
gtgttactatcgctatggcaacggc

SEQ ID NO: 561518 - DNA, 25 bp, Rattus norvegicus
ttgctttgcgttccctgagcaccgg

SEQ ID NO: 561519 - DNA, 25 bp, Rattus norvegicus
caggctcggtcctttgctttgcgtt

SEQ ID NO: 561520 - DNA, 25 bp, Rattus norvegicus
gcccgccaagtgcactgctcaaaaa

SEQ ID NO: 561521 - DNA, 25 bp, Rattus norvegicus
tgctcgcccggcctttactattttc

SEQ ID NO: 561522 - DNA, 25 bp, Rattus norvegicus
acaaatccagcggaggcagcctcct

SEQ ID NO: 561523 - DNA, 25 bp, Rattus norvegicus
gacgagaaaatcactcagctgctga

SEQ ID NO: 561524 - DNA, 25 bp, Rattus norvegicus
ctggacccgaactctgacgacgaga

SEQ ID NO: 561525 - DNA, 25 bp, Rattus norvegicus
ggacgacgacgattacaacaagccc

SEQ ID NO: 561526 - DNA, 25 bp, Rattus norvegicus
aggactcggagactgagcggctcaa

SEQ ID NO: 561527 - DNA, 25 bp, Rattus norvegicus
tggccacggccaagaagaagcagga

SEQ ID NO: 561528 - DNA, 25 bp, Rattus norvegicus
aaagaagcacgcagccgagatggcc

SEQ ID NO: 561529 - DNA, 25 bp, Rattus norvegicus
tcctcttggctctcaggtctggttc

SEQ ID NO: 561530 - DNA, 25 bp, Rattus norvegicus
aggcctttagactgactttgacgcc

SEQ ID NO: 561531 - DNA, 25 bp, Rattus norvegicus
gcgcgtgtctgccttaggtacattg

SEQ ID NO: 561532 - DNA, 25 bp, Rattus norvegicus
ttgaatacgtgtgtgacatggtgac

SEQ ID NO: 561533 - DNA, 25 bp, Rattus norvegicus
ctgccttaggtacattgaatacgtg

SEQ ID NO: 561534 - DNA, 25 bp, Rattus norvegicus
accttaggtacattgaatacgtgtg

SEQ ID NO: 561535 - DNA, 25 bp, Rattus norvegicus
caggcgcgtgtctaccttaggtaca

SEQ ID NO: 561536 - DNA, 25 bp, Rattus norvegicus
gccttaggtacattgaatacgtgtg

SEQ ID NO: 561537 - DNA, 25 bp, Rattus norvegicus
acaggcgcgtgtctgccttaggtac

SEQ ID NO: 561538 - DNA, 25 bp, Rattus norvegicus
cgcgtgtctgccttaggtacattga

SEQ ID NO: 561539 - DNA, 25 bp, Rattus norvegicus
ttgaatacgtgtgtgacatggtggc

SEQ ID NO: 561540 - DNA, 25 bp, Rattus norvegicus
cgtgtctgccttaggtacattgaat

SEQ ID NO: 561541 - DNA, 25 bp, Rattus norvegicus
gtctgccttaggtacattgaatacg

SEQ ID NO: 561542 - DNA, 25 bp, Rattus norvegicus
tgacaggcgcgtgtctgccttaggt

SEQ ID NO: 561543 - DNA, 25 bp, Rattus norvegicus
atacgtgtgtgacatggtgacaggc

SEQ ID NO: 561544 - DNA, 25 bp, Rattus norvegicus
tgaatacgtgtgtgacatggtgaca

SEQ ID NO: 561545 - DNA, 25 bp, Rattus norvegicus
gctgtttcctctaaacctagggcta

SEQ ID NO: 561546 - DNA, 25 bp, Rattus norvegicus
tggctctccagtctcgttttccgca

SEQ ID NO: 561547 - DNA, 25 bp, Rattus norvegicus
agcctcaccctttcttctggattca

SEQ ID NO: 561548 - DNA, 25 bp, Rattus norvegicus
ccagctgtcgcgaacataagttaca

SEQ ID NO: 561549 - DNA, 25 bp, Rattus norvegicus
cgcagctcccaccaggtttgttcta

SEQ ID NO: 561550 - DNA, 25 bp, Rattus norvegicus
cgtacgcgacacagtcacaggagtg

SEQ ID NO: 561551 - DNA, 25 bp, Rattus norvegicus
cgcgcctggttctatgctgagcagt

SEQ ID NO: 561552 - DNA, 25 bp, Rattus norvegicus
tcctcgaggagtttctagccttttc

SEQ ID NO: 561553 - DNA, 25 bp, Rattus norvegicus
ctctgagctgctgcgacacaagaca

SEQ ID NO: 561554 - DNA, 25 bp, Rattus norvegicus
tttccgcaagcgaggtgaccatttg

SEQ ID NO: 561555 - DNA, 25 bp, Rattus norvegicus
tttcgcacccacgacacggtcagtg

SEQ ID NO: 561556 - DNA, 25 bp, Rattus norvegicus
cgcgcacgctcatttcggatttgga

SEQ ID NO: 561557 - DNA, 25 bp, Rattus norvegicus
ggaaacccacgagctcagtccgaga

SEQ ID NO: 561558 - DNA, 25 bp, Rattus norvegicus
tcctggagcttctcaaggtcgcgca

SEQ ID NO: 561559 - DNA, 25 bp, Rattus norvegicus
cttgtccttggacacaagccgcaca

SEQ ID NO: 561560 - DNA, 25 bp, Rattus norvegicus
ttccctcgttctcttggcgctgatg

SEQ ID NO: 561561 - DNA, 25 bp, Rattus norvegicus
gacatgacttcgtggccttcgtggc

SEQ ID NO: 561562 - DNA, 25 bp, Rattus norvegicus
tgtccttggacacaagccgcacagc

SEQ ID NO: 561563 - DNA, 25 bp, Rattus norvegicus
gtccttggacacaagccgcacagct

SEQ ID NO: 561564 - DNA, 25 bp, Rattus norvegicus
ggacacaagccgcacagctcccgga

SEQ ID NO: 561565 - DNA, 25 bp, Rattus norvegicus
cacaagccgcacagctcccggatca

SEQ ID NO: 561566 - DNA, 25 bp, Rattus norvegicus
tgctgacatgacttcgtggccttcg

SEQ ID NO: 561567 - DNA, 25 bp, Rattus norvegicus
agcccgttgctcagctcttccctcg

SEQ ID NO: 561568 - DNA, 25 bp, Rattus norvegicus
gctgacatgacttcgtggccttcgt

SEQ ID NO: 561569 - DNA, 25 bp, Rattus norvegicus
ctgacatgacttcgtggccttcgtg

SEQ ID NO: 561570 - DNA, 25 bp, Rattus norvegicus
tgacatgacttcgtggccttcgtgg

SEQ ID NO: 561571 - DNA, 25 bp, Rattus norvegicus
ttgctgacatgacttcgtggccttc

SEQ ID NO: 561572 - DNA, 25 bp, Rattus norvegicus
tcttccctcgttctcttggcgctga

SEQ ID NO: 561573 - DNA, 25 bp, Rattus norvegicus
gccgcactgcctcggctgcaaggtt

SEQ ID NO: 561574 - DNA, 25 bp, Rattus norvegicus
ctcggctgcaggttagccgcactgc

SEQ ID NO: 561575 - DNA, 25 bp, Rattus norvegicus
tagccgcactgcctcggctgcaagg

SEQ ID NO: 561576 - DNA, 25 bp, Rattus norvegicus
gcactgcctcggctgcaaggttagc

SEQ ID NO: 561577 - DNA, 25 bp, Rattus norvegicus
tcggctgcaaggctagccgcactgc

SEQ ID NO: 561578 - DNA, 25 bp, Rattus norvegicus
aggttagccgcactgcctcggctgc

SEQ ID NO: 561579 - DNA, 25 bp, Rattus norvegicus
cactgcctcggctgcaaggttagcc

SEQ ID NO: 561580 - DNA, 25 bp, Rattus norvegicus
ctgcctcggctgcaagattagcctc

SEQ ID NO: 561581 - DNA, 25 bp, Rattus norvegicus
tcggctgcaaggttagccgcactgc

SEQ ID NO: 561582 - DNA, 25 bp, Rattus norvegicus
actgcctcggctgcaaggctagccg

SEQ ID NO: 561583 - DNA, 25 bp, Rattus norvegicus
gcactgcctcggctgcaagattagc

SEQ ID NO: 561584 - DNA, 25 bp, Rattus norvegicus
ctgcctcggctgcaggttagccgca

SEQ ID NO: 561585 - DNA, 25 bp, Rattus norvegicus
actgcctcggctgcaggttagccgc

SEQ ID NO: 561586 - DNA, 25 bp, Rattus norvegicus
aaggttagccgcactgcctcggctg

SEQ ID NO: 561587 - DNA, 25 bp, Rattus norvegicus
tctcagaactactgcgatctctttg

SEQ ID NO: 561588 - DNA, 25 bp, Rattus norvegicus
gctctcttcagctctgcggagcgaa

SEQ ID NO: 561589 - DNA, 25 bp, Rattus norvegicus
cacagcgtccaatccggagttgggc

SEQ ID NO: 561590 - DNA, 25 bp, Rattus norvegicus
gccgcagctcggaaaacacagcgtc

SEQ ID NO: 561591 - DNA, 25 bp, Rattus norvegicus
cagacctgagtgtctcgggcgagaa

SEQ ID NO: 561592 - DNA, 25 bp, Rattus norvegicus
taggggacaccctagtgcagtcaga

SEQ ID NO: 561593 - DNA, 25 bp, Rattus norvegicus
ttcctccgggtagcgattgcgacaa

SEQ ID NO: 561594 - DNA, 25 bp, Rattus norvegicus
gatatgcgggtagccagtagctttc

SEQ ID NO: 561595 - DNA, 25 bp, Rattus norvegicus
cgcactcccggcaaaggttctttcg

SEQ ID NO: 561596 - DNA, 25 bp, Rattus norvegicus
ggttctttcggtagcagactttcca

SEQ ID NO: 561597 - DNA, 25 bp, Rattus norvegicus
gagtggacctctgacgtctccaaga

SEQ ID NO: 561598 - DNA, 25 bp, Rattus norvegicus
agaccttgtttgtgagcgtgcaaca

SEQ ID NO: 561599 - DNA, 25 bp, Rattus norvegicus
cgtgcaacacgacctcctgggaggg

SEQ ID NO: 561600 - DNA, 25 bp, Rattus norvegicus
ttcgggaagaggaaactacagagcc

SEQ ID NO: 561601 - DNA, 25 bp, Rattus norvegicus
ccagccctttgcgagggatcccggt

SEQ ID NO: 561602 - DNA, 25 bp, Rattus norvegicus
ttccagcatctcaacactgactcag

SEQ ID NO: 561603 - DNA, 25 bp, Rattus norvegicus
tgccgttcctacctgcagcgcgcgc

SEQ ID NO: 561604 - DNA, 25 bp, Rattus norvegicus
tttgcgagggatcccggtgccgttc

SEQ ID NO: 561605 - DNA, 25 bp, Rattus norvegicus
tgttgtctggcttcgtgcttggcgc

SEQ ID NO: 561606 - DNA, 25 bp, Rattus norvegicus
gaggaaagtcgggtagctttcctgc

SEQ ID NO: 561607 - DNA, 25 bp, Rattus norvegicus
ctgactcagatacggtgagccgggc

SEQ ID NO: 561608 - DNA, 25 bp, Rattus norvegicus
catccgggtcctttttatctgctcg

SEQ ID NO: 561609 - DNA, 25 bp, Rattus norvegicus
ggtcctttttatctgctcgcgcttg

SEQ ID NO: 561610 - DNA, 25 bp, Rattus norvegicus
ctttttatctgctcgcgcttggacg

SEQ ID NO: 561611 - DNA, 25 bp, Rattus norvegicus
tcattctccagcctcccgtcgggcg

SEQ ID NO: 561612 - DNA, 25 bp, Rattus norvegicus
cgcgcttggacgtgaaggaaagttc

SEQ ID NO: 561613 - DNA, 25 bp, Rattus norvegicus
tctcaacactgactcagatacggtg

SEQ ID NO: 561614 - DNA, 25 bp, Rattus norvegicus
actacccagccctttgcgagggatc

SEQ ID NO: 561615 - DNA, 25 bp, Rattus norvegicus
ccggctctcggcttgcgaggctgca

SEQ ID NO: 561616 - DNA, 25 bp, Rattus norvegicus
gacgtccgtgcacttggctctgaac

SEQ ID NO: 561617 - DNA, 25 bp, Rattus norvegicus
ttgctggagttcctgcgcttgcacc

SEQ ID NO: 561618 - DNA, 25 bp, Rattus norvegicus
cccaggcgctcatcgtgggcgtgaa

SEQ ID NO: 561619 - DNA, 25 bp, Rattus norvegicus
tgctaagcgcctactgcctctttgc

SEQ ID NO: 561620 - DNA, 25 bp, Rattus norvegicus
gctctgttgctaagcgcctactgcc

SEQ ID NO: 561621 - DNA, 25 bp, Rattus norvegicus
ctggcgctcacagctctgttgctaa

SEQ ID NO: 561622 - DNA, 25 bp, Rattus norvegicus
ctctgctggcgctcacagctctgtt

SEQ ID NO: 561623 - DNA, 25 bp, Rattus norvegicus
gccaggggactgcactgcgtgctcc

SEQ ID NO: 561624 - DNA, 25 bp, Rattus norvegicus
cccatggcaggtagcagtgtcctgg

SEQ ID NO: 561625 - DNA, 25 bp, Rattus norvegicus
ctgagcgtgcgacgtgctatagccg

SEQ ID NO: 561626 - DNA, 25 bp, Rattus norvegicus
aggtgctatgatcgcggcctcgcct

SEQ ID NO: 561627 - DNA, 25 bp, Rattus norvegicus
tgcagagctcaacccagaagccggg

SEQ ID NO: 561628 - DNA, 25 bp, Rattus norvegicus
ttcttcgacaggtgctatgatcgcg

SEQ ID NO: 561629 - DNA, 25 bp, Rattus norvegicus
ccggacattttacccgcgtgagttg

SEQ ID NO: 561630 - DNA, 25 bp, Rattus norvegicus
tcatcacaggggctgcggtgacaac

SEQ ID NO: 561631 - DNA, 25 bp, Rattus norvegicus
cgcccaggtacagccctgctgagtg

SEQ ID NO: 561632 - DNA, 25 bp, Rattus norvegicus
ggtgtctctccgcaaaagaaaccgc

SEQ ID NO: 561633 - DNA, 25 bp, Rattus norvegicus
tccctatacagctgcgcagagcaag

SEQ ID NO: 561634 - DNA, 25 bp, Rattus norvegicus
gccgttgtcatggaggaaagttctc

SEQ ID NO: 561635 - DNA, 25 bp, Rattus norvegicus
cgacaggtcccttccgatattcttc

SEQ ID NO: 561636 - DNA, 25 bp, Rattus norvegicus
gctgatgctccgtcacttgcttacg

SEQ ID NO: 561637 - DNA, 25 bp, Rattus norvegicus
acacacgggctgtgctgcagagaga

SEQ ID NO: 561638 - DNA, 25 bp, Rattus norvegicus
aatgctccgtacctttgtgttcccg

SEQ ID NO: 561639 - DNA, 25 bp, Rattus norvegicus
gccagtcgcggttgtcaagttcttc

SEQ ID NO: 561640 - DNA, 25 bp, Rattus norvegicus
tgcgaaggtagccaggatttcaatg

SEQ ID NO: 561641 - DNA, 25 bp, Rattus norvegicus
gcccgcgatgcttacgcaaaggttc

SEQ ID NO: 561642 - DNA, 25 bp, Rattus norvegicus
ggctgcaatgccatgccggacattt

SEQ ID NO: 561643 - DNA, 25 bp, Rattus norvegicus
ccacgctcggagaccggagaccgga

SEQ ID NO: 561644 - DNA, 25 bp, Rattus norvegicus
tcggtcaggaccttagccagggaga

SEQ ID NO: 561645 - DNA, 25 bp, Rattus norvegicus
cctagggactcggtcaggaccttag

SEQ ID NO: 561646 - DNA, 25 bp, Rattus norvegicus
gcgtgatgcacccatcgggtcagtc

SEQ ID NO: 561647 - DNA, 25 bp, Rattus norvegicus
actgagagcccgctgccggcgtgat

SEQ ID NO: 561648 - DNA, 25 bp, Rattus norvegicus
ctgtccgccgcagccgtagtgaact

SEQ ID NO: 561649 - DNA, 25 bp, Rattus norvegicus
ctgcgtgcccgggtcccataactga

SEQ ID NO: 561650 - DNA, 25 bp, Rattus norvegicus
ctgggtgacgtcaccaatcggcgtc

SEQ ID NO: 561651 - DNA, 25 bp, Rattus norvegicus
cgggcatatccgtggctgcgtgccc

SEQ ID NO: 561652 - DNA, 25 bp, Rattus norvegicus
cctggacaagcccatcggtgagtgg

SEQ ID NO: 561653 - DNA, 25 bp, Rattus norvegicus
acctgcggctcatgcgcctggacaa

SEQ ID NO: 561654 - DNA, 25 bp, Rattus norvegicus
gccagggagaaacacgcagatttcc

SEQ ID NO: 561655 - DNA, 25 bp, Rattus norvegicus
gcctagcgtcatgctgcgcttggga

SEQ ID NO: 561656 - DNA, 25 bp, Rattus norvegicus
ggtcccataactgagagcccgctgc

SEQ ID NO: 561657 - DNA, 25 bp, Rattus norvegicus
aaggaacccgcagagggcgttatca

SEQ ID NO: 561658 - DNA, 25 bp, Rattus norvegicus
ctgagtcaggcctaactcgagcctc

SEQ ID NO: 561659 - DNA, 25 bp, Rattus norvegicus
atttaccgccacagccgacttcagg

SEQ ID NO: 561660 - DNA, 25 bp, Rattus norvegicus
aggacttaagaagctggcagtcacc

SEQ ID NO: 561661 - DNA, 25 bp, Rattus norvegicus
gcagagggcgttatcaaggacttaa

SEQ ID NO: 561662 - DNA, 25 bp, Rattus norvegicus
gggctcgccgaacagacactaagga

SEQ ID NO: 561663 - DNA, 25 bp, Rattus norvegicus
cagaagccaaaggaacccgcagagg

SEQ ID NO: 561664 - DNA, 25 bp, Rattus norvegicus
ttaccacgcttccagaagccaaagg

SEQ ID NO: 561665 - DNA, 25 bp, Rattus norvegicus
gtcatctttcttaccacgcttccag

SEQ ID NO: 561666 - DNA, 25 bp, Rattus norvegicus
ggggagccgtcatctttcttaccac

SEQ ID NO: 561667 - DNA, 25 bp, Rattus norvegicus
caccgcctggggagccgtcatcttt

SEQ ID NO: 561668 - DNA, 25 bp, Rattus norvegicus
agacactaaggaaggcgcccaccgc

SEQ ID NO: 561669 - DNA, 25 bp, Rattus norvegicus
ggcggcagcaaacagaagtcaaact

SEQ ID NO: 561670 - DNA, 25 bp, Rattus norvegicus
aagtcaaactcggtgcgttgggctc

SEQ ID NO: 561671 - DNA, 25 bp, Rattus norvegicus
cgagaggcacgaacccacttggtgt

SEQ ID NO: 561672 - DNA, 25 bp, Rattus norvegicus
cccgaaagagatttagcatttgaga

SEQ ID NO: 561673 - DNA, 25 bp, Rattus norvegicus
gctggaaaccgcacctaccatggtc

SEQ ID NO: 561674 - DNA, 25 bp, Rattus norvegicus
cttgcgcaatgacgcgactcgggtt

SEQ ID NO: 561675 - DNA, 25 bp, Rattus norvegicus
ctgggcgcgtgattttgaacaaacc

SEQ ID NO: 561676 - DNA, 25 bp, Rattus norvegicus
cgggcttctgggaacctgttttgct

SEQ ID NO: 561677 - DNA, 25 bp, Rattus norvegicus
taccatggtctagtcacaaagcgag

SEQ ID NO: 561678 - DNA, 25 bp, Rattus norvegicus
tgtcatttcgtaccagcgcctcctt

SEQ ID NO: 561679 - DNA, 25 bp, Rattus norvegicus
ttgtatggactcctctggctgtgtg

SEQ ID NO: 561680 - DNA, 25 bp, Rattus norvegicus
ctgtgtgtccgtttccctcgcgaag

SEQ ID NO: 561681 - DNA, 25 bp, Rattus norvegicus
tgggactcagcctggccaagcaacg

SEQ ID NO: 561682 - DNA, 25 bp, Rattus norvegicus
cgaagcccaccagccaaatgtcata

SEQ ID NO: 561683 - DNA, 25 bp, Rattus norvegicus
agtcacgtggaacccgacagcgctc

SEQ ID NO: 561684 - DNA, 25 bp, Rattus norvegicus
acctgttttgctgctgtgtcatttc

SEQ ID NO: 561685 - DNA, 25 bp, Rattus norvegicus
tagcgctccatttcgggcaaactgg

SEQ ID NO: 561686 - DNA, 25 bp, Rattus norvegicus
ttggaatccgcaggtatctcgactc

SEQ ID NO: 561687 - DNA, 25 bp, Rattus norvegicus
tatctcgactccctgtggcgttcct

SEQ ID NO: 561688 - DNA, 25 bp, Rattus norvegicus
gttcctcggggctcacaggagccgt

SEQ ID NO: 561689 - DNA, 25 bp, Rattus norvegicus
tcacaggagccgtgtgtctggtcct

SEQ ID NO: 561690 - DNA, 25 bp, Rattus norvegicus
ccgtgtgtctggtcctgggatgata

SEQ ID NO: 561691 - DNA, 25 bp, Rattus norvegicus
agcactgccgggctcgaaattgccc

SEQ ID NO: 561692 - DNA, 25 bp, Rattus norvegicus
acgacccgccggtgagcgctggaac

SEQ ID NO: 561693 - DNA, 25 bp, Rattus norvegicus
tgacgaggtgaaaatggcggatctt

SEQ ID NO: 561694 - DNA, 25 bp, Rattus norvegicus
aaatggcggatctttcgaaatacaa

SEQ ID NO: 561695 - DNA, 25 bp, Rattus norvegicus
ccgaatactgtatagcgctccattt

SEQ ID NO: 561696 - DNA, 25 bp, Rattus norvegicus
gacagagctacggtgcacaggcaaa

SEQ ID NO: 561697 - DNA, 25 bp, Rattus norvegicus
tgcacaggcaaaacaagcactgccg

SEQ ID NO: 561698 - DNA, 25 bp, Rattus norvegicus
ccctgacataccagaggcggtggcc

SEQ ID NO: 561699 - DNA, 25 bp, Rattus norvegicus
cagacccaaggttgatcagcccgga

SEQ ID NO: 561700 - DNA, 25 bp, Rattus norvegicus
cgcagcagcacagagcgccacatgg

SEQ ID NO: 561701 - DNA, 25 bp, Rattus norvegicus
gctgctgttgatcgttcaccttgga

SEQ ID NO: 561702 - DNA, 25 bp, Rattus norvegicus
gtaactagcgccctagcagccagtc

SEQ ID NO: 561703 - DNA, 25 bp, Rattus norvegicus
ccgctttctagccatgggtctccta

SEQ ID NO: 561704 - DNA, 25 bp, Rattus norvegicus
tcaccttggaaggtaactagcgccc

SEQ ID NO: 561705 - DNA, 25 bp, Rattus norvegicus
cctactcttggttccttgcctttca

SEQ ID NO: 561706 - DNA, 25 bp, Rattus norvegicus
cgctgtccgtctcaaggtgctgaag

SEQ ID NO: 561707 - DNA, 25 bp, Rattus norvegicus
cggccacgaaagaacaggatgcctt

SEQ ID NO: 561708 - DNA, 25 bp, Rattus norvegicus
cgcgagccaggccagaatctgggaa

SEQ ID NO: 561709 - DNA, 25 bp, Rattus norvegicus
atgccttggtctttgcggaatctcc

SEQ ID NO: 561710 - DNA, 25 bp, Rattus norvegicus
gctgaagcggcccttgattcccttt

SEQ ID NO: 561711 - DNA, 25 bp, Rattus norvegicus
cctcgcccagcaaagcaaagggtgc

SEQ ID NO: 561712 - DNA, 25 bp, Rattus norvegicus
ttgattccctttcccatcggcattt

SEQ ID NO: 561713 - DNA, 25 bp, Rattus norvegicus
aactttcgtctaccctgcccagtga

SEQ ID NO: 561714 - DNA, 25 bp, Rattus norvegicus
ctagccaatcgcaggccagctgtgt

SEQ ID NO: 561715 - DNA, 25 bp, Rattus norvegicus
ctgtgtcgcagcagccaataggaga

SEQ ID NO: 561716 - DNA, 25 bp, Rattus norvegicus
gcaggttccctcttgccattctgtc

SEQ ID NO: 561717 - DNA, 25 bp, Rattus norvegicus
ggacgcgctgaactccttccgacta

SEQ ID NO: 561718 - DNA, 25 bp, Rattus norvegicus
agtgaagttccctctcccgggctca

SEQ ID NO: 561719 - DNA, 25 bp, Rattus norvegicus
ctgacgtctgtctggtcttggcgac

SEQ ID NO: 561720 - DNA, 25 bp, Rattus norvegicus
agtaacgtcactcaagccggaaggc

SEQ ID NO: 561721 - DNA, 25 bp, Rattus norvegicus
ctgagcgccaaacaggtccggttgc

SEQ ID NO: 561722 - DNA, 25 bp, Rattus norvegicus
ttgcagtcccgcagtagagagcctc

SEQ ID NO: 561723 - DNA, 25 bp, Rattus norvegicus
cggcgctccctaaggctgtaccttg

SEQ ID NO: 561724 - DNA, 25 bp, Rattus norvegicus
ccttttgttagagttcggctgtgcc

SEQ ID NO: 561725 - DNA, 25 bp, Rattus norvegicus
tactggttcgcaatccggcgccatc

SEQ ID NO: 561726 - DNA, 25 bp, Rattus norvegicus
tgtgccttcggtccttacctactgg

SEQ ID NO: 561727 - DNA, 25 bp, Rattus norvegicus
tccactgccaagaggacgcatcctt

SEQ ID NO: 561728 - DNA, 25 bp, Rattus norvegicus
ccggctaacgcaggacaggtcactg

SEQ ID NO: 561729 - DNA, 25 bp, Rattus norvegicus
gagagtccgacgttcgccggctaac

SEQ ID NO: 561730 - DNA, 25 bp, Rattus norvegicus
cccgattagtcttccggagccgctg

SEQ ID NO: 561731 - DNA, 25 bp, Rattus norvegicus
gcagtctttacctccggcccgatta

SEQ ID NO: 561732 - DNA, 25 bp, Rattus norvegicus
tgtgtccgccgtttgtttcctgccc

SEQ ID NO: 561733 - DNA, 25 bp, Rattus norvegicus
gacgcatccttacgttaggcgcctc

SEQ ID NO: 561734 - DNA, 25 bp, Rattus norvegicus
gcagccgggtgatcgcgcccgtcat

SEQ ID NO: 561735 - DNA, 25 bp, Rattus norvegicus
caccgctcttctttcctgacggaga

SEQ ID NO: 561736 - DNA, 25 bp, Rattus norvegicus
acaggagtgctacgtggcgtcctcc

SEQ ID NO: 561737 - DNA, 25 bp, Rattus norvegicus
agctgctgaagcctcacaggagtgc

SEQ ID NO: 561738 - DNA, 25 bp, Rattus norvegicus
tcgcccagtccagtgtcggcttcgt

SEQ ID NO: 561739 - DNA, 25 bp, Rattus norvegicus
cacaaagcgcggcagtctttacctc

SEQ ID NO: 561740 - DNA, 25 bp, Rattus norvegicus
gacaacgcctggagtcgcagcagcc

SEQ ID NO: 561741 - DNA, 25 bp, Rattus norvegicus
tgacaggtgtcccaccgccgcgggt

SEQ ID NO: 561742 - DNA, 25 bp, Rattus norvegicus
aggcaaacgcgtccaccttggctta

SEQ ID NO: 561743 - DNA, 25 bp, Rattus norvegicus
accttggcttaggaaggaggcgatt

SEQ ID NO: 561744 - DNA, 25 bp, Rattus norvegicus
ccggggcgctaacttgcggtgccct

SEQ ID NO: 561745 - DNA, 25 bp, Rattus norvegicus
cgcgtccaccttggcttaggaagga

SEQ ID NO: 561746 - DNA, 25 bp, Rattus norvegicus
gaggcgattggaccgtccgcccgca

SEQ ID NO: 561747 - DNA, 25 bp, Rattus norvegicus
cccaccgcgattgccaccgccgccg

SEQ ID NO: 561748 - DNA, 25 bp, Rattus norvegicus
cccgcctccgcagtgtctcctgagt

SEQ ID NO: 561749 - DNA, 25 bp, Rattus norvegicus
taggagcggtgaagccgagtccgcc

SEQ ID NO: 561750 - DNA, 25 bp, Rattus norvegicus
gctaacttgcggtgccctgcacgca

SEQ ID NO: 561751 - DNA, 25 bp, Rattus norvegicus
acttgcggtgccctgcacgcagtcg

SEQ ID NO: 561752 - DNA, 25 bp, Rattus norvegicus
ccctgctgggcgctcgttcctggga

SEQ ID NO: 561753 - DNA, 25 bp, Rattus norvegicus
ggcgctcgttcctgggaagaatcca

SEQ ID NO: 561754 - DNA, 25 bp, Rattus norvegicus
aagaatccaggatttcgaggagggg

SEQ ID NO: 561755 - DNA, 25 bp, Rattus norvegicus
aagaagcgaatacccgagcccggag

SEQ ID NO: 561756 - DNA, 25 bp, Rattus norvegicus
tgcccttcggtcctgctgcactgat

SEQ ID NO: 561757 - DNA, 25 bp, Rattus norvegicus
caagaggaactgtggccctgcgaca

SEQ ID NO: 561758 - DNA, 25 bp, Rattus norvegicus
ctggacgccgaacgcaaacgattct

SEQ ID NO: 561759 - DNA, 25 bp, Rattus norvegicus
aagggactgagtcgaactggacgcc

SEQ ID NO: 561760 - DNA, 25 bp, Rattus norvegicus
ctaggtgcacgccaccctttgctgg

SEQ ID NO: 561761 - DNA, 25 bp, Rattus norvegicus
tccagccggcgcgaggacaaaacac

SEQ ID NO: 561762 - DNA, 25 bp, Rattus norvegicus
gacccgcttttctgctccgctgatt

SEQ ID NO: 561763 - DNA, 25 bp, Rattus norvegicus
atccgtcaaagtaggcctcgcgtgg

SEQ ID NO: 561764 - DNA, 25 bp, Rattus norvegicus
ccgcgtgcgctttggcacatcttca

SEQ ID NO: 561765 - DNA, 25 bp, Rattus norvegicus
gctgcactgattttcccgttatctc

SEQ ID NO: 561766 - DNA, 25 bp, Rattus norvegicus
cattggccgccggaaagccgcgaac

SEQ ID NO: 561767 - DNA, 25 bp, Rattus norvegicus
gccgcgaacgccatccgtcaaagta

SEQ ID NO: 561768 - DNA, 25 bp, Rattus norvegicus
gcacatcttcagtcatccgagcagg

SEQ ID NO: 561769 - DNA, 25 bp, Rattus norvegicus
ctagctggcccggaagtatccggtg

SEQ ID NO: 561770 - DNA, 25 bp, Rattus norvegicus
acgtcccgaaggttcacagccgagc

SEQ ID NO: 561771 - DNA, 25 bp, Rattus norvegicus
ggcctcttgctaacggtcgccgact

SEQ ID NO: 561772 - DNA, 25 bp, Rattus norvegicus
tcgccgactccaggtggttcgccag

SEQ ID NO: 561773 - DNA, 25 bp, Rattus norvegicus
cagccctgctgtgggaagtcgtaga

SEQ ID NO: 561774 - DNA, 25 bp, Rattus norvegicus
aagtcgtagagcgtgacctgcgtca

SEQ ID NO: 561775 - DNA, 25 bp, Rattus norvegicus
tggaacccggtggatcacctagctg

SEQ ID NO: 561776 - DNA, 25 bp, Rattus norvegicus
aagtatccggtgagctgcgactctg

SEQ ID NO: 561777 - DNA, 25 bp, Rattus norvegicus
agctgcgactctgactgcctgctgt

SEQ ID NO: 561778 - DNA, 25 bp, Rattus norvegicus
gcatccattcgacggcgcgggacca

SEQ ID NO: 561779 - DNA, 25 bp, Rattus norvegicus
cagttcttagggcttgtgcctgagc

SEQ ID NO: 561780 - DNA, 25 bp, Rattus norvegicus
gtgcctgagctgagaggaaacccgc

SEQ ID NO: 561781 - DNA, 25 bp, Rattus norvegicus
actgcctgctgtggcatccattcga

SEQ ID NO: 561782 - DNA, 25 bp, Rattus norvegicus
gtgacctgcgtcagttggaacccgg

SEQ ID NO: 561783 - DNA, 25 bp, Rattus norvegicus
ggagcgaagatcgacgccagtaaga

SEQ ID NO: 561784 - DNA, 25 bp, Rattus norvegicus
gccgccgctgctacttattcttttt

SEQ ID NO: 561785 - DNA, 25 bp, Rattus norvegicus
tcggccattttaggtggtccgcggc

SEQ ID NO: 561786 - DNA, 25 bp, Rattus norvegicus
cttttttagtgcagccggggagagt

SEQ ID NO: 561787 - DNA, 25 bp, Rattus norvegicus
cccaccgatttagccgccaggattt

SEQ ID NO: 561788 - DNA, 25 bp, Rattus norvegicus
aggccctagtgcagtcgcctgctcg

SEQ ID NO: 561789 - DNA, 25 bp, Rattus norvegicus
gcagtagcactatgtcggaggagca

SEQ ID NO: 561790 - DNA, 25 bp, Rattus norvegicus
tttgctgctagtttcggttcgcggc

SEQ ID NO: 561791 - DNA, 25 bp, Rattus norvegicus
cggcggggattactttgctgctagt

SEQ ID NO: 561792 - DNA, 25 bp, Rattus norvegicus
cgccttgtcttgtgtgcctcgcgag

SEQ ID NO: 561793 - DNA, 25 bp, Rattus norvegicus
gcaggagcctttgcagccacgcgcg

SEQ ID NO: 561794 - DNA, 25 bp, Rattus norvegicus
cgccaggattttttcccgcctgtcg

SEQ ID NO: 561795 - DNA, 25 bp, Rattus norvegicus
gtttccacctttagccgtcaccatg

SEQ ID NO: 561796 - DNA, 25 bp, Rattus norvegicus
catgggtctcctcccaccgatttag

SEQ ID NO: 561797 - DNA, 25 bp, Rattus norvegicus
gggctacccagcactacactgttca

SEQ ID NO: 561798 - DNA, 25 bp, Rattus norvegicus
caggaacggcttgtagaaaggcgcc

SEQ ID NO: 561799 - DNA, 25 bp, Rattus norvegicus
gttcacctgaaccttcgccatcatt

SEQ ID NO: 561800 - DNA, 25 bp, Rattus norvegicus
cccgcatgcggtgcgtcagccggaa

SEQ ID NO: 561801 - DNA, 25 bp, Rattus norvegicus
gtcagccggaaacgcaaacgccttc

SEQ ID NO: 561802 - DNA, 25 bp, Rattus norvegicus
cggaaacgcaaacgccttcctgcag

SEQ ID NO: 561803 - DNA, 25 bp, Rattus norvegicus
agtcttcagccaggtcctcgatgca

SEQ ID NO: 561804 - DNA, 25 bp, Rattus norvegicus
gattgtattcctcactttcagcaga

SEQ ID NO: 561805 - DNA, 25 bp, Rattus norvegicus
tcactttcagcagagcccacggaga

SEQ ID NO: 561806 - DNA, 25 bp, Rattus norvegicus
cagagcccacggagataattttcca

SEQ ID NO: 561807 - DNA, 25 bp, Rattus norvegicus
tttccactccaagtcttcagccagg

SEQ ID NO: 561808 - DNA, 25 bp, Rattus norvegicus
cagactctaaacttgattgtattcc

SEQ ID NO: 561809 - DNA, 25 bp, Rattus norvegicus
cgccatcattcgaagaaaacaaaca

SEQ ID NO: 561810 - DNA, 25 bp, Rattus norvegicus
ggtgatctcaaacaggaacggcttg

SEQ ID NO: 561811 - DNA, 25 bp, Rattus norvegicus
ctcgaccattagcaacgcagctgta

SEQ ID NO: 561812 - DNA, 25 bp, Rattus norvegicus
cgcagctgtaggtgatcgtcatagc

SEQ ID NO: 561813 - DNA, 25 bp, Rattus norvegicus
aggtgatcgtcatagccggcagacc

SEQ ID NO: 561814 - DNA, 25 bp, Rattus norvegicus
gccacctgtgggtcccgcagagctt

SEQ ID NO: 561815 - DNA, 25 bp, Rattus norvegicus
gagagaagctgaccgcctcctaacc

SEQ ID NO: 561816 - DNA, 25 bp, Rattus norvegicus
catagccggcagaccagtgagagaa

SEQ ID NO: 561817 - DNA, 25 bp, Rattus norvegicus
gccaggaccgctcgaccattagcaa

SEQ ID NO: 561818 - DNA, 25 bp, Rattus norvegicus
gggcgccagcctcgaggaaccgaac

SEQ ID NO: 561819 - DNA, 25 bp, Rattus norvegicus
agtgagagaagctgaccgcctccta

SEQ ID NO: 561820 - DNA, 25 bp, Rattus norvegicus
ccagacgcccgcgtgcagttccagc

SEQ ID NO: 561821 - DNA, 25 bp, Rattus norvegicus
taggagccgccggtcaaggctagct

SEQ ID NO: 561822 - DNA, 25 bp, Rattus norvegicus
cgcgacccgcaggtacctgatagga

SEQ ID NO: 561823 - DNA, 25 bp, Rattus norvegicus
gtcaaggctagctccgccaggaccg

SEQ ID NO: 561824 - DNA, 25 bp, Rattus norvegicus
gtacctgataggagccgccggtcaa

SEQ ID NO: 561825 - DNA, 25 bp, Rattus norvegicus
agctgcggatctctgatggtgtata

SEQ ID NO: 561826 - DNA, 25 bp, Rattus norvegicus
cgctgagcatctcacgtgggagaga

SEQ ID NO: 561827 - DNA, 25 bp, Rattus norvegicus
cgcagttgtaagatcgctgagcatc

SEQ ID NO: 561828 - DNA, 25 bp, Rattus norvegicus
ccgaggctaagagcgcgcgtcaacc

SEQ ID NO: 561829 - DNA, 25 bp, Rattus norvegicus
tgccgcggtccttccgaggctaaga

SEQ ID NO: 561830 - DNA, 25 bp, Rattus norvegicus
caccttatgacgcagttgtaagatc

SEQ ID NO: 561831 - DNA, 25 bp, Rattus norvegicus
ccatcctggaactgtggctgccgcg

SEQ ID NO: 561832 - DNA, 25 bp, Rattus norvegicus
ccaggtctttcgatctcaaactacg

SEQ ID NO: 561833 - DNA, 25 bp, Rattus norvegicus
ctgtgagcacccaaggggtttctta

SEQ ID NO: 561834 - DNA, 25 bp, Rattus norvegicus
taacatcggcgcacagctgtgagca

SEQ ID NO: 561835 - DNA, 25 bp, Rattus norvegicus
gccatatcagaagcgctaacatcgg

SEQ ID NO: 561836 - DNA, 25 bp, Rattus norvegicus
atatgcccacatggcggaaatacgg

SEQ ID NO: 561837 - DNA, 25 bp, Rattus norvegicus
gtggacagtgatacccaggtctttc

SEQ ID NO: 561838 - DNA, 25 bp, Rattus norvegicus
ctctgatggtgtatatgcccacatg

SEQ ID NO: 561839 - DNA, 25 bp, Rattus norvegicus
cggcgtctgcatctctgcctatggg

SEQ ID NO: 561840 - DNA, 25 bp, Rattus norvegicus
tggtcgcaagctgtcagcgcagccc

SEQ ID NO: 561841 - DNA, 25 bp, Rattus norvegicus
tgcatctctgcctatgggcgggcct

SEQ ID NO: 561842 - DNA, 25 bp, Rattus norvegicus
tcgtgcgctgttggccctcctgaca

SEQ ID NO: 561843 - DNA, 25 bp, Rattus norvegicus
tactacggcgttagtgacattcagc

SEQ ID NO: 561844 - DNA, 25 bp, Rattus norvegicus
acattcagctggtgaggcgagcgca

SEQ ID NO: 561845 - DNA, 25 bp, Rattus norvegicus
gctacctgctcctctcacccgggca

SEQ ID NO: 561846 - DNA, 25 bp, Rattus norvegicus
ggtccaggagcttcggtccgccctg

SEQ ID NO: 561847 - DNA, 25 bp, Rattus norvegicus
cccagctctggcaagggtcgaggac

SEQ ID NO: 561848 - DNA, 25 bp, Rattus norvegicus
tctgcctccctgctcgtatatggca

SEQ ID NO: 561849 - DNA, 25 bp, Rattus norvegicus
ccctgctcgtatatggcaaagtttc

SEQ ID NO: 561850 - DNA, 25 bp, Rattus norvegicus
gtatatggcaaagtttctcgcggcg

SEQ ID NO: 561851 - DNA, 25 bp, Rattus norvegicus
tcccgccttggtcgcaagctgtcag

SEQ ID NO: 561852 - DNA, 25 bp, Rattus norvegicus
ctggctgtcgctgcgtcgctgctct

SEQ ID NO: 561853 - DNA, 25 bp, Rattus norvegicus
tgtccatgatggcacggatctgatc

SEQ ID NO: 561854 - DNA, 25 bp, Rattus norvegicus
gccgtggtccacgtgagcaatgact

SEQ ID NO: 561855 - DNA, 25 bp, Rattus norvegicus
tggcacggatctgatctactgtgaa

SEQ ID NO: 561856 - DNA, 25 bp, Rattus norvegicus
aagttcaccagggtggcggatggcg

SEQ ID NO: 561857 - DNA, 25 bp, Rattus norvegicus
tgaacagggcagtgtgccgatgatg

SEQ ID NO: 561858 - DNA, 25 bp, Rattus norvegicus
tgccgatgatggcggcgccaatgat

SEQ ID NO: 561859 - DNA, 25 bp, Rattus norvegicus
agggaatcgttcagcgtggacttgc

SEQ ID NO: 561860 - DNA, 25 bp, Rattus norvegicus
gttcagcgtggacttgccgtggtcc

SEQ ID NO: 561861 - DNA, 25 bp, Rattus norvegicus
gacttgatcgtgaggcagcgctcct

SEQ ID NO: 561862 - DNA, 25 bp, Rattus norvegicus
catgatggcacggatctgatctact

SEQ ID NO: 561863 - DNA, 25 bp, Rattus norvegicus
ttgcatacaagggaatcgttcagcg

SEQ ID NO: 561864 - DNA, 25 bp, Rattus norvegicus
tgcgggccttgcatacaagggaatc

SEQ ID NO: 561865 - DNA, 25 bp, Rattus norvegicus
tgatcgtgaggcagcgctcctgctc

SEQ ID NO: 561866 - DNA, 25 bp, Rattus norvegicus
aatcgttcagcgtggacttgccgtg

SEQ ID NO: 561867 - DNA, 25 bp, Rattus norvegicus
atggaccgactggaagcctgcaaca

SEQ ID NO: 561868 - DNA, 25 bp, Rattus norvegicus
ggaagcctgcaacagcccgggaaca

SEQ ID NO: 561869 - DNA, 25 bp, Rattus norvegicus
cccagcgccaattgttttcgtcacg

SEQ ID NO: 561870 - DNA, 25 bp, Rattus norvegicus
ccaacgcgatggtacaagggtgctg

SEQ ID NO: 561871 - DNA, 25 bp, Rattus norvegicus
tgagctgctccaacgcgatggtaca

SEQ ID NO: 561872 - DNA, 25 bp, Rattus norvegicus
gtggttagcctcctgagctgctcca

SEQ ID NO: 561873 - DNA, 25 bp, Rattus norvegicus
gcaacagcccgggaacatctgggac

SEQ ID NO: 561874 - DNA, 25 bp, Rattus norvegicus
ggggcggagactaaccagatcattc

SEQ ID NO: 561875 - DNA, 25 bp, Rattus norvegicus
ggagactaaccagatcattccgccc

SEQ ID NO: 561876 - DNA, 25 bp, Rattus norvegicus
cagcgctttgcagtgtaatgcaagt

SEQ ID NO: 561877 - DNA, 25 bp, Rattus norvegicus
cagacactgggatggcccggactat

SEQ ID NO: 561878 - DNA, 25 bp, Rattus norvegicus
ggcccggactatggaccgactggaa

SEQ ID NO: 561879 - DNA, 25 bp, Rattus norvegicus
gtctttctgctggtggttagcctcc

SEQ ID NO: 561880 - DNA, 25 bp, Rattus norvegicus
atgcgcgccgctgggtctttctgct

SEQ ID NO: 561881 - DNA, 25 bp, Rattus norvegicus
agcaagccagcctctgcagcgtggg

SEQ ID NO: 561882 - DNA, 25 bp, Rattus norvegicus
agctgcgctgtgattggccagcgta

SEQ ID NO: 561883 - DNA, 25 bp, Rattus norvegicus
caccgaggaggaaacgcgcgccgac

SEQ ID NO: 561884 - DNA, 25 bp, Rattus norvegicus
cctgcggcaagaggcgggcattccc

SEQ ID NO: 561885 - DNA, 25 bp, Rattus norvegicus
ctcgggcaggagtttcagtataaac

SEQ ID NO: 561886 - DNA, 25 bp, Rattus norvegicus
ggcgttcgacccttcctggtcctga

SEQ ID NO: 561887 - DNA, 25 bp, Rattus norvegicus
cttcctggtcctgagctcgccttgg

SEQ ID NO: 561888 - DNA, 25 bp, Rattus norvegicus
ggcgcctcggtacggcatccagtag

SEQ ID NO: 561889 - DNA, 25 bp, Rattus norvegicus
tacggcatccagtaggtggaggctc

SEQ ID NO: 561890 - DNA, 25 bp, Rattus norvegicus
cgagcgcaggcgaagccagagacct

SEQ ID NO: 561891 - DNA, 25 bp, Rattus norvegicus
gaagccagagacctaggagtccctg

SEQ ID NO: 561892 - DNA, 25 bp, Rattus norvegicus
agacctaggagtccctgcgcctgct

SEQ ID NO: 561893 - DNA, 25 bp, Rattus norvegicus
tgccgcgctcccaacaggtgcggag

SEQ ID NO: 561894 - DNA, 25 bp, Rattus norvegicus
ggccgcagcgtcacgggagtcccaa

SEQ ID NO: 561895 - DNA, 25 bp, Rattus norvegicus
gctagcatccacgatgttatcgccc

SEQ ID NO: 561896 - DNA, 25 bp, Rattus norvegicus
cagccggtctctcatgctgcttgca

SEQ ID NO: 561897 - DNA, 25 bp, Rattus norvegicus
cgtgcgttgcgcgttgtgcacctct

SEQ ID NO: 561898 - DNA, 25 bp, Rattus norvegicus
ctgcgcacttggaaagttacccggc

SEQ ID NO: 561899 - DNA, 25 bp, Rattus norvegicus
gacgagctgcgcacttggaaagtta

SEQ ID NO: 561900 - DNA, 25 bp, Rattus norvegicus
ggcagcacccacgtcgccgcagctc

SEQ ID NO: 561901 - DNA, 25 bp, Rattus norvegicus
ctccggagtacaggttcgcgccggc

SEQ ID NO: 561902 - DNA, 25 bp, Rattus norvegicus
taaagtgcagactgtcgccgtcgcc

SEQ ID NO: 561903 - DNA, 25 bp, Rattus norvegicus
ttcggggtataaagtgcagactgtc

SEQ ID NO: 561904 - DNA, 25 bp, Rattus norvegicus
tgcctcactccggaggttcggggta

SEQ ID NO: 561905 - DNA, 25 bp, Rattus norvegicus
tacttaagttgcctcactccggagg

SEQ ID NO: 561906 - DNA, 25 bp, Rattus norvegicus
gatgttatcgccctacttaagttgc

SEQ ID NO: 561907 - DNA, 25 bp, Rattus norvegicus
ctcatgctgcttgcatggggacatg

SEQ ID NO: 561908 - DNA, 25 bp, Rattus norvegicus
atgtggacgcgcgtttcttcctctc

SEQ ID NO: 561909 - DNA, 25 bp, Rattus norvegicus
cagacgagttgtcaagcgcgggttc

SEQ ID NO: 561910 - DNA, 25 bp, Rattus norvegicus
tgacaccttgtcgtgaggcctcagg

SEQ ID NO: 561911 - DNA, 25 bp, Rattus norvegicus
tgcggctctgaagctacgaaccgtg

SEQ ID NO: 561912 - DNA, 25 bp, Rattus norvegicus
acgaaccgtgttaccgccatgcagg

SEQ ID NO: 561913 - DNA, 25 bp, Rattus norvegicus
tgctgccgctgtacctgtcatagag

SEQ ID NO: 561914 - DNA, 25 bp, Rattus norvegicus
tgtcatagagccacagcatatgctc

SEQ ID NO: 561915 - DNA, 25 bp, Rattus norvegicus
ttccgcgccacctgagactcgggaa

SEQ ID NO: 561916 - DNA, 25 bp, Rattus norvegicus
caccacctgtcatgcggtcgcttga

SEQ ID NO: 561917 - DNA, 25 bp, Rattus norvegicus
gtcgcttgactcagtcccgcggagt

SEQ ID NO: 561918 - DNA, 25 bp, Rattus norvegicus
tcccgggaggtgcaaatttggtctc

SEQ ID NO: 561919 - DNA, 25 bp, Rattus norvegicus
aatttggtctctgtccctgtgccag

SEQ ID NO: 561920 - DNA, 25 bp, Rattus norvegicus
caggaaaggtccctaccgtgtactg

SEQ ID NO: 561921 - DNA, 25 bp, Rattus norvegicus
cgtccgggacactctggagaaggaa

SEQ ID NO: 561922 - DNA, 25 bp, Rattus norvegicus
tagtcaagtcccgttgtcgtgccgc

SEQ ID NO: 561923 - DNA, 25 bp, Rattus norvegicus
tcagcacggtgctgcgcatctcctt

SEQ ID NO: 561924 - DNA, 25 bp, Rattus norvegicus
cgccagtgttgatgcccacgacgct

SEQ ID NO: 561925 - DNA, 25 bp, Rattus norvegicus
ggttgcagtcgccaacgccagtgtt

SEQ ID NO: 561926 - DNA, 25 bp, Rattus norvegicus
ttgggagcagtacgaggaagacact

SEQ ID NO: 561927 - DNA, 25 bp, Rattus norvegicus
cgttttagtaaagaccaggagctga

SEQ ID NO: 561928 - DNA, 25 bp, Rattus norvegicus
ctctatgggcggacactactggatt

SEQ ID NO: 561929 - DNA, 25 bp, Rattus norvegicus
ttccggcagtaagcgggcattagca

SEQ ID NO: 561930 - DNA, 25 bp, Rattus norvegicus
cttcaggaaaagcacaggctcgctc

SEQ ID NO: 561931 - DNA, 25 bp, Rattus norvegicus
ccatggtctaaccttgggtcacgtg

SEQ ID NO: 561932 - DNA, 25 bp, Rattus norvegicus
acaggcactggttggctgtgagctc

SEQ ID NO: 561933 - DNA, 25 bp, Rattus norvegicus
ccttggaataggcatctggcgctgg

SEQ ID NO: 561934 - DNA, 25 bp, Rattus norvegicus
ggtcacgtgacaaccgactcctctg

SEQ ID NO: 561935 - DNA, 25 bp, Rattus norvegicus
cattagcaccggtgagccctccgga

SEQ ID NO: 561936 - DNA, 25 bp, Rattus norvegicus
gcatctccttgacgtggtctgcgta

SEQ ID NO: 561937 - DNA, 25 bp, Rattus norvegicus
ccaggaagtcttcgtaggtgttgaa

SEQ ID NO: 561938 - DNA, 25 bp, Rattus norvegicus
aagcttctcgaagccagagacctgc

SEQ ID NO: 561939 - DNA, 25 bp, Rattus norvegicus
aagccagagacctgcggtgcgcgcc

SEQ ID NO: 561940 - DNA, 25 bp, Rattus norvegicus
gacccgcgcttacctccaggtagta

SEQ ID NO: 561941 - DNA, 25 bp, Rattus norvegicus
ctccaggtagtacaggtcgaccgta

SEQ ID NO: 561942 - DNA, 25 bp, Rattus norvegicus
tgatctgcgagtccaggaagtcttc

SEQ ID NO: 561943 - DNA, 25 bp, Rattus norvegicus
cttcgtaggtgttgaactgcgtgac

SEQ ID NO: 561944 - DNA, 25 bp, Rattus norvegicus
actgcgtgacgatgttgtccaaggc

SEQ ID NO: 561945 - DNA, 25 bp, Rattus norvegicus
acgatgttgtccaaggccgtcattc

SEQ ID NO: 561946 - DNA, 25 bp, Rattus norvegicus
tgtccaaggccgtcattccatcgtc

SEQ ID NO: 561947 - DNA, 25 bp, Rattus norvegicus
aggccgtcattccatcgtcctgatc

SEQ ID NO: 561948 - DNA, 25 bp, Rattus norvegicus
atcgtcctgatccatcgcggctaca

SEQ ID NO: 561949 - DNA, 25 bp, Rattus norvegicus
ggctacaccgacgcgtccctagtaa

SEQ ID NO: 561950 - DNA, 25 bp, Rattus norvegicus
acaggtcgaccgtagtgatctgcga

SEQ ID NO: 561951 - DNA, 25 bp, Rattus norvegicus
tccctcgccgcactgggtggacata

SEQ ID NO: 561952 - DNA, 25 bp, Rattus norvegicus
cgctggcaccgggatatttataacg

SEQ ID NO: 561953 - DNA, 25 bp, Rattus norvegicus
gctctccacgcaaggggcacggacg

SEQ ID NO: 561954 - DNA, 25 bp, Rattus norvegicus
tggaccttggctgcgaccacgcacg

SEQ ID NO: 561955 - DNA, 25 bp, Rattus norvegicus
aggtgtcttgccctcagaagctgcc

SEQ ID NO: 561956 - DNA, 25 bp, Rattus norvegicus
aaggacaggctcattcttccggccg

SEQ ID NO: 561957 - DNA, 25 bp, Rattus norvegicus
agtgatctcactgctccgtgcacgc

SEQ ID NO: 561958 - DNA, 25 bp, Rattus norvegicus
cccgaagggctccactggaaactgc

SEQ ID NO: 561959 - DNA, 25 bp, Rattus norvegicus
acccgagctgatctcggcgctggca

SEQ ID NO: 561960 - DNA, 25 bp, Rattus norvegicus
aagtgcatcttgcagggctggctcc

SEQ ID NO: 561961 - DNA, 25 bp, Rattus norvegicus
cgcttccttggctgcccggagaagc

SEQ ID NO: 561962 - DNA, 25 bp, Rattus norvegicus
ggaaactgctgtgctccgagccgct

SEQ ID NO: 561963 - DNA, 25 bp, Rattus norvegicus
cccttcgggagtgagacgcttctcc

SEQ ID NO: 561964 - DNA, 25 bp, Rattus norvegicus
acccgccgctttgtgtactcactgg

SEQ ID NO: 561965 - DNA, 25 bp, Rattus norvegicus
agctcctccttggaggtcgccagcg

SEQ ID NO: 561966 - DNA, 25 bp, Rattus norvegicus
acactaggtcggaggtcatgcggaa

SEQ ID NO: 561967 - DNA, 25 bp, Rattus norvegicus
aggcgttgcacttggcgcaccagtt

SEQ ID NO: 561968 - DNA, 25 bp, Rattus norvegicus
cgcaccagttctgcgcgggcagaca

SEQ ID NO: 561969 - DNA, 25 bp, Rattus norvegicus
gcagccgaactcttgggccagaagg

SEQ ID NO: 561970 - DNA, 25 bp, Rattus norvegicus
tgcagcttcacagccagcggatcag

SEQ ID NO: 561971 - DNA, 25 bp, Rattus norvegicus
cctggtagagtctggtgggacccac

SEQ ID NO: 561972 - DNA, 25 bp, Rattus norvegicus
agaaggcgctcttacgctcgtccga

SEQ ID NO: 561973 - DNA, 25 bp, Rattus norvegicus
ggccgttctcctccaggccgaagta

SEQ ID NO: 561974 - DNA, 25 bp, Rattus norvegicus
tccacgaaggcgctgcgctttgcct

SEQ ID NO: 561975 - DNA, 25 bp, Rattus norvegicus
accctgccacgggagtggacgagcc

SEQ ID NO: 561976 - DNA, 25 bp, Rattus norvegicus
ggccagcagtttctcggcagtcccg

SEQ ID NO: 561977 - DNA, 25 bp, Rattus norvegicus
gcccagctgcgacaccgaggtgaat

SEQ ID NO: 561978 - DNA, 25 bp, Rattus norvegicus
cgtctcccgggtgacagggttccag

SEQ ID NO: 561979 - DNA, 25 bp, Rattus norvegicus
tacgacgcaaaccagccacaataag

SEQ ID NO: 561980 - DNA, 25 bp, Rattus norvegicus
gggctaatagcggtccgtgctgcca

SEQ ID NO: 561981 - DNA, 25 bp, Rattus norvegicus
tccactcccggctggcattgtctgg

SEQ ID NO: 561982 - DNA, 25 bp, Rattus norvegicus
tgccaccgtggccactacgacgcaa

SEQ ID NO: 561983 - DNA, 25 bp, Rattus norvegicus
tcccggctggcattgtctggtagcc

SEQ ID NO: 561984 - DNA, 25 bp, Rattus norvegicus
ccacaataagcgataggcaggaccc

SEQ ID NO: 561985 - DNA, 25 bp, Rattus norvegicus
ccgggctttaatatctagtctttca

SEQ ID NO: 561986 - DNA, 25 bp, Rattus norvegicus
tagtctttcacagtcctacgcccat

SEQ ID NO: 561987 - DNA, 25 bp, Rattus norvegicus
gggaaacccagagccagctgggctc

SEQ ID NO: 561988 - DNA, 25 bp, Rattus norvegicus
agccagctgggctcgctgaaaagcg

SEQ ID NO: 561989 - DNA, 25 bp, Rattus norvegicus
gctcgctgaaaagcgggcgctactg

SEQ ID NO: 561990 - DNA, 25 bp, Rattus norvegicus
gaaaagcgggcgctactgccgaagc

SEQ ID NO: 561991 - DNA, 25 bp, Rattus norvegicus
agcgggcgctactgccgaagctctc

SEQ ID NO: 561992 - DNA, 25 bp, Rattus norvegicus
taatagcggtccgtgctgccaccgt

SEQ ID NO: 561993 - DNA, 25 bp, Rattus norvegicus
gtggtcatttccactctcggacgga

SEQ ID NO: 561994 - DNA, 25 bp, Rattus norvegicus
cttccagagcgggtactagcgtctg

SEQ ID NO: 561995 - DNA, 25 bp, Rattus norvegicus
gcagcctctgttggctgtcccacgg

SEQ ID NO: 561996 - DNA, 25 bp, Rattus norvegicus
ctgcttcctacctgcggaatgcggg

SEQ ID NO: 561997 - DNA, 25 bp, Rattus norvegicus
tccgggcgagccgacctctgaagtc

SEQ ID NO: 561998 - DNA, 25 bp, Rattus norvegicus
tgaagtcccgcgctccgacacgggt

SEQ ID NO: 561999 - DNA, 25 bp, Rattus norvegicus
ccgacacgggttcctgggcccagat

SEQ ID NO: 562000 - DNA, 25 bp, Rattus norvegicus
ggcccagatcccagccgaggctttg

SEQ ID NO: 562001 - DNA, 25 bp, Rattus norvegicus
gctttgcgatccgtactgggctctt

SEQ ID NO: 562002 - DNA, 25 bp, Rattus norvegicus
taccgcaagcagagcgcaaggaacc

SEQ ID NO: 562003 - DNA, 25 bp, Rattus norvegicus
ggcgcccagacagcgagcttccaga

SEQ ID NO: 562004 - DNA, 25 bp, Rattus norvegicus
ccttgtggcctcagagttagtagcg

SEQ ID NO: 562005 - DNA, 25 bp, Rattus norvegicus
ctgcgggacccttaggccaagggca

SEQ ID NO: 562006 - DNA, 25 bp, Rattus norvegicus
aggaaccgccatctggagtctgacg

SEQ ID NO: 562007 - DNA, 25 bp, Rattus norvegicus
gcggccgattgtcagcggaggaagt

SEQ ID NO: 562008 - DNA, 25 bp, Rattus norvegicus
aggttgtcccgacatctgctggtgg

SEQ ID NO: 562009 - DNA, 25 bp, Rattus norvegicus
agctagcaggttgtcccgacatctg

SEQ ID NO: 562010 - DNA, 25 bp, Rattus norvegicus
gcgagctagcaggttgtcccgacat

SEQ ID NO: 562011 - DNA, 25 bp, Rattus norvegicus
tttcgcggccaggtgcgagctagca

SEQ ID NO: 562012 - DNA, 25 bp, Rattus norvegicus
cgcatagtatcaaagcggcggtcgg

SEQ ID NO: 562013 - DNA, 25 bp, Rattus norvegicus
gggctggcgcgcatagtatcaaagc

SEQ ID NO: 562014 - DNA, 25 bp, Rattus norvegicus
agggctcccggactgagctctgcgc

SEQ ID NO: 562015 - DNA, 25 bp, Rattus norvegicus
cctttggagccgaaactgtgctggg

SEQ ID NO: 562016 - DNA, 25 bp, Rattus norvegicus
tcacggtgcctttggagccgaaact

SEQ ID NO: 562017 - DNA, 25 bp, Rattus norvegicus
gagcccttcacggtgcctttggagc

SEQ ID NO: 562018 - DNA, 25 bp, Rattus norvegicus
gcggcgagcccttcacggtgccttt

SEQ ID NO: 562019 - DNA, 25 bp, Rattus norvegicus
caggaccgttttggtctcacgcgcg

SEQ ID NO: 562020 - DNA, 25 bp, Rattus norvegicus
agagcggcaggaccgttttggtctc

SEQ ID NO: 562021 - DNA, 25 bp, Rattus norvegicus
cggcctggcctgctgaagtccattg

SEQ ID NO: 562022 - DNA, 25 bp, Rattus norvegicus
acctcgctggccgtgaagcgctcgc

SEQ ID NO: 562023 - DNA, 25 bp, Rattus norvegicus
cccacggacacatcacctcgctggc

SEQ ID NO: 562024 - DNA, 25 bp, Rattus norvegicus
cttccgcccataggccttcccgcca

SEQ ID NO: 562025 - DNA, 25 bp, Rattus norvegicus
gccttcccgccacccgtcagtctcc

SEQ ID NO: 562026 - DNA, 25 bp, Rattus norvegicus
tccgcaatgcccgacccgaggacct

SEQ ID NO: 562027 - DNA, 25 bp, Rattus norvegicus
ctggcctgctgaagtccattgccga

SEQ ID NO: 562028 - DNA, 25 bp, Rattus norvegicus
cctgctgaagtccattgccgaggca

SEQ ID NO: 562029 - DNA, 25 bp, Rattus norvegicus
gctgaagtccattgccgaggcaacg

SEQ ID NO: 562030 - DNA, 25 bp, Rattus norvegicus
cattgccgaggcaacgacgcggtgt

SEQ ID NO: 562031 - DNA, 25 bp, Rattus norvegicus
ctgccagccaggatgaacatccgca

SEQ ID NO: 562032 - DNA, 25 bp, Rattus norvegicus
cggtgtgggcccttcggccctgcca

SEQ ID NO: 562033 - DNA, 25 bp, Rattus norvegicus
aagtccattgccgaggcaacgacgc

SEQ ID NO: 562034 - DNA, 25 bp, Rattus norvegicus
tgaagcgctcgcaccggcgcctcgg

SEQ ID NO: 562035 - DNA, 25 bp, Rattus norvegicus
ggccgctaccgtgagcagagcctcg

SEQ ID NO: 562036 - DNA, 25 bp, Rattus norvegicus
atccagacccggtgaaccgctgtga

SEQ ID NO: 562037 - DNA, 25 bp, Rattus norvegicus
tgtcagctacaatccagacccggtg

SEQ ID NO: 562038 - DNA, 25 bp, Rattus norvegicus
tccagatggcagtgtgtcagctaca

SEQ ID NO: 562039 - DNA, 25 bp, Rattus norvegicus
cttgggcctgcgttatccagatggc

SEQ ID NO: 562040 - DNA, 25 bp, Rattus norvegicus
ggcagcagatggcacgcagattaga

SEQ ID NO: 562041 - DNA, 25 bp, Rattus norvegicus
attagactctgaccgctggctttcg

SEQ ID NO: 562042 - DNA, 25 bp, Rattus norvegicus
ctttcgctgtggcaacccgggctct

SEQ ID NO: 562043 - DNA, 25 bp, Rattus norvegicus
agggttctgtggtgagcttatctta

SEQ ID NO: 562044 - DNA, 25 bp, Rattus norvegicus
agggcggacaaccacacggccgcta

SEQ ID NO: 562045 - DNA, 25 bp, Rattus norvegicus
cgtccgcatacttagcttgggcctg

SEQ ID NO: 562046 - DNA, 25 bp, Rattus norvegicus
aggtctgtacgcgtccgcatactta

SEQ ID NO: 562047 - DNA, 25 bp, Rattus norvegicus
actctcaggaggagaccgcaggtct

SEQ ID NO: 562048 - DNA, 25 bp, Rattus norvegicus
ggacgccctgccttgactctcagga

SEQ ID NO: 562049 - DNA, 25 bp, Rattus norvegicus
gagacccgcgccatgagaagcatga

SEQ ID NO: 562050 - DNA, 25 bp, Rattus norvegicus
catgagaagcatgaggcccagaggc

SEQ ID NO: 562051 - DNA, 25 bp, Rattus norvegicus
ttatatattccgacccgaagccagg

SEQ ID NO: 562052 - DNA, 25 bp, Rattus norvegicus
tgcgcatggattcacttatatattc

SEQ ID NO: 562053 - DNA, 25 bp, Rattus norvegicus
aggggtgcgcatggattcacttata

SEQ ID NO: 562054 - DNA, 25 bp, Rattus norvegicus
tcggctttgacaccggggtgtcgca

SEQ ID NO: 562055 - DNA, 25 bp, Rattus norvegicus
attgatcggctttgacaccggggtg

SEQ ID NO: 562056 - DNA, 25 bp, Rattus norvegicus
cacagcccattgatcggctttgaca

SEQ ID NO: 562057 - DNA, 25 bp, Rattus norvegicus
cgcaggaaggtgatcacagcccatt

SEQ ID NO: 562058 - DNA, 25 bp, Rattus norvegicus
tatgtcgcaggaaggtgatcacagc

SEQ ID NO: 562059 - DNA, 25 bp, Rattus norvegicus
cgtttcaaagggtatgtatgtcgca

SEQ ID NO: 562060 - DNA, 25 bp, Rattus norvegicus
ggacgtgcgtttcaaagggtatgta

SEQ ID NO: 562061 - DNA, 25 bp, Rattus norvegicus
cgacccgaagccagggccgagctga

SEQ ID NO: 562062 - DNA, 25 bp, Rattus norvegicus
agctgaggacggagacccgcgccat

SEQ ID NO: 562063 - DNA, 25 bp, Rattus norvegicus
tgacccaaggcactccggcggggac

SEQ ID NO: 562064 - DNA, 25 bp, Rattus norvegicus
gtgagtccctcgttcctgtccatca

SEQ ID NO: 562065 - DNA, 25 bp, Rattus norvegicus
gtccatcaccatcgacgccagcctg

SEQ ID NO: 562066 - DNA, 25 bp, Rattus norvegicus
aagcgtgagtccctcgttcctgtcc

SEQ ID NO: 562067 - DNA, 25 bp, Rattus norvegicus
ttccaaagcgtgagtccctcgttcc

SEQ ID NO: 562068 - DNA, 25 bp, Rattus norvegicus
ggctattccaaagcgtgagtccctc

SEQ ID NO: 562069 - DNA, 25 bp, Rattus norvegicus
agaggctattccaaagcgtgagtcc

SEQ ID NO: 562070 - DNA, 25 bp, Rattus norvegicus
tacaccaagaggctattccaaagcg

SEQ ID NO: 562071 - DNA, 25 bp, Rattus norvegicus
gtggacttggagttttacaccaaga

SEQ ID NO: 562072 - DNA, 25 bp, Rattus norvegicus
cgccgaccaaggacgtggtggactt

SEQ ID NO: 562073 - DNA, 25 bp, Rattus norvegicus
gggcggctccgtgccctgacccaag

SEQ ID NO: 562074 - DNA, 25 bp, Rattus norvegicus
tccagccaggtaggatgctgcggcc

SEQ ID NO: 562075 - DNA, 25 bp, Rattus norvegicus
ccggaggcaaagcaggaccgggtgc

SEQ ID NO: 562076 - DNA, 25 bp, Rattus norvegicus
gtggtggacttggagttttacacca

SEQ ID NO: 562077 - DNA, 25 bp, Rattus norvegicus
aatgcgatcgctagcttgcggccgc

SEQ ID NO: 562078 - DNA, 25 bp, Rattus norvegicus
ctggatctgagcaggaacgcactcc

SEQ ID NO: 562079 - DNA, 25 bp, Rattus norvegicus
agcaggaacgcactccgaagcgtca

SEQ ID NO: 562080 - DNA, 25 bp, Rattus norvegicus
ccgaagcgtcaaagctaacgtcttt

SEQ ID NO: 562081 - DNA, 25 bp, Rattus norvegicus
gtctttgtacatttgcccaggctgc

SEQ ID NO: 562082 - DNA, 25 bp, Rattus norvegicus
aggctgcagaagctgtacctggacc

SEQ ID NO: 562083 - DNA, 25 bp, Rattus norvegicus
gctgtacctggaccggaacctcatt

SEQ ID NO: 562084 - DNA, 25 bp, Rattus norvegicus
accggaacctcattacagccgtggc

SEQ ID NO: 562085 - DNA, 25 bp, Rattus norvegicus
ccctcgtgcctttctgggcatgaag

SEQ ID NO: 562086 - DNA, 25 bp, Rattus norvegicus
tttctgggcatgaaggccctgcgtt

SEQ ID NO: 562087 - DNA, 25 bp, Rattus norvegicus
ttggctggacctgtcgcacaaccgc

SEQ ID NO: 562088 - DNA, 25 bp, Rattus norvegicus
acaaccgcgtggctggcctcatgga

SEQ ID NO: 562089 - DNA, 25 bp, Rattus norvegicus
gcctcatggaggacaccttcccagg

SEQ ID NO: 562090 - DNA, 25 bp, Rattus norvegicus
ctgcgcctggcacacaatgcgatcg

SEQ ID NO: 562091 - DNA, 25 bp, Rattus norvegicus
ctacgtggtgcatacaacacgggga

SEQ ID NO: 562092 - DNA, 25 bp, Rattus norvegicus
gctaaacagggagttgcaaggtgct

SEQ ID NO: 562093 - DNA, 25 bp, Rattus norvegicus
cccactacgtggtgcatacaacacg

SEQ ID NO: 562094 - DNA, 25 bp, Rattus norvegicus
ccactacgtggtgcatacaacacgg

SEQ ID NO: 562095 - DNA, 25 bp, Rattus norvegicus
cactacgtggtgcatacaacacggg

SEQ ID NO: 562096 - DNA, 25 bp, Rattus norvegicus
actacgtggtgcatacaacacgggg

SEQ ID NO: 562097 - DNA, 25 bp, Rattus norvegicus
tggtgcatacaacacggggagggct

SEQ ID NO: 562098 - DNA, 25 bp, Rattus norvegicus
tgcatacaacacggggagggctaaa

SEQ ID NO: 562099 - DNA, 25 bp, Rattus norvegicus
gcatacaacacggggagggctaaac

SEQ ID NO: 562100 - DNA, 25 bp, Rattus norvegicus
catacaacacggggagggctaaaca

SEQ ID NO: 562101 - DNA, 25 bp, Rattus norvegicus
atacaacacggggagggctaaacag

SEQ ID NO: 562102 - DNA, 25 bp, Rattus norvegicus
gtgcatacaacacggggagggctaa

SEQ ID NO: 562103 - DNA, 25 bp, Rattus norvegicus
ttggagaagactcagcctcacctgc

SEQ ID NO: 562104 - DNA, 25 bp, Rattus norvegicus
acaccttctgtcttagcctaccggg

SEQ ID NO: 562105 - DNA, 25 bp, Rattus norvegicus
cagcgcgatgacaccttctgtctta

SEQ ID NO: 562106 - DNA, 25 bp, Rattus norvegicus
ccgctctactcttacagcgcgatga

SEQ ID NO: 562107 - DNA, 25 bp, Rattus norvegicus
gaactaggctcttggcgcggccacc

SEQ ID NO: 562108 - DNA, 25 bp, Rattus norvegicus
cttctctctgcagcttaacaagggg

SEQ ID NO: 562109 - DNA, 25 bp, Rattus norvegicus
cattctctacctgaacggcgtcgtc

SEQ ID NO: 562110 - DNA, 25 bp, Rattus norvegicus
ctcctggccaaggagcaggatcact

SEQ ID NO: 562111 - DNA, 25 bp, Rattus norvegicus
tccagctactcctggccaaggagca

SEQ ID NO: 562112 - DNA, 25 bp, Rattus norvegicus
gtcagcagagcttggcccaggccat

SEQ ID NO: 562113 - DNA, 25 bp, Rattus norvegicus
ctgtcccgcgcccagcgacttttcc

SEQ ID NO: 562114 - DNA, 25 bp, Rattus norvegicus
tgctcgcccagtgtcagcagagctt

SEQ ID NO: 562115 - DNA, 25 bp, Rattus norvegicus
tacctgaacggcgtcgtcgggccgc

SEQ ID NO: 562116 - DNA, 25 bp, Rattus norvegicus
cttggcccaggccatgaccgaggtg

SEQ ID NO: 562117 - DNA, 25 bp, Rattus norvegicus
gcggcgcttggctgtatatatctcc

SEQ ID NO: 562118 - DNA, 25 bp, Rattus norvegicus
tggctgtatatatctccgcacaccc

SEQ ID NO: 562119 - DNA, 25 bp, Rattus norvegicus
gcgcctgctccagttgctgcagctg

SEQ ID NO: 562120 - DNA, 25 bp, Rattus norvegicus
gcagtagcagcaacatggctgttga

SEQ ID NO: 562121 - DNA, 25 bp, Rattus norvegicus
gtcttctcatcacccgagagagctg

SEQ ID NO: 562122 - DNA, 25 bp, Rattus norvegicus
ctgcagctgccactgttggcggctg

SEQ ID NO: 562123 - DNA, 25 bp, Rattus norvegicus
tccggcagggcatccgctagctggc

SEQ ID NO: 562124 - DNA, 25 bp, Rattus norvegicus
gaaggcactcgggatcgcgctttcg

SEQ ID NO: 562125 - DNA, 25 bp, Rattus norvegicus
gacagccgcagccaatttaccgcgg

SEQ ID NO: 562126 - DNA, 25 bp, Rattus norvegicus
caacatggctgttgatgggtgttcg

SEQ ID NO: 562127 - DNA, 25 bp, Rattus norvegicus
gagggcgcggattctccgatcttaa

SEQ ID NO: 562128 - DNA, 25 bp, Rattus norvegicus
tctccgatcttaacgagctgtcttc

SEQ ID NO: 562129 - DNA, 25 bp, Rattus norvegicus
cgagctgtcttctcatcacccgaga

SEQ ID NO: 562130 - DNA, 25 bp, Rattus norvegicus
gcagggcagacagccgcagccaatt

SEQ ID NO: 562131 - DNA, 25 bp, Rattus norvegicus
gcgtaggcggagctcagcgcctcaa

SEQ ID NO: 562132 - DNA, 25 bp, Rattus norvegicus
tccagattccattccagagcggcct

SEQ ID NO: 562133 - DNA, 25 bp, Rattus norvegicus
ccgggacccagctcggagccggtgt

SEQ ID NO: 562134 - DNA, 25 bp, Rattus norvegicus
gtctatggcgccgtcggagtccggg

SEQ ID NO: 562135 - DNA, 25 bp, Rattus norvegicus
cctcaagaggcagacgcgaaggccg

SEQ ID NO: 562136 - DNA, 25 bp, Rattus norvegicus
ctacgcgcgggcatcgctccggccc

SEQ ID NO: 562137 - DNA, 25 bp, Rattus norvegicus
gtgccgccagtagcggccagccgaa

SEQ ID NO: 562138 - DNA, 25 bp, Rattus norvegicus
agcggccagccgaaccggaactact

SEQ ID NO: 562139 - DNA, 25 bp, Rattus norvegicus
aaaacacggggaggatgagagcgca

SEQ ID NO: 562140 - DNA, 25 bp, Rattus norvegicus
tctcatcagcctcggcgcccgctca

SEQ ID NO: 562141 - DNA, 25 bp, Rattus norvegicus
ggagctcagcgcctcaagaggcaga

SEQ ID NO: 562142 - DNA, 25 bp, Rattus norvegicus
gatttcctccagattccattccaga

SEQ ID NO: 562143 - DNA, 25 bp, Rattus norvegicus
acggggcagctcaaccccctgattt

SEQ ID NO: 562144 - DNA, 25 bp, Rattus norvegicus
tcctccagattccattccagagcgg

SEQ ID NO: 562145 - DNA, 25 bp, Rattus norvegicus
ggacctcagccaacacttccggaag

SEQ ID NO: 562146 - DNA, 25 bp, Rattus norvegicus
tgaaacttcccgctgccagccgctg

SEQ ID NO: 562147 - DNA, 25 bp, Rattus norvegicus
agggacctcagccaacacttccgga

SEQ ID NO: 562148 - DNA, 25 bp, Rattus norvegicus
ttggagggacctcagccaacacttc

SEQ ID NO: 562149 - DNA, 25 bp, Rattus norvegicus
ccgctgattggagggacctcagcca

SEQ ID NO: 562150 - DNA, 25 bp, Rattus norvegicus
acgaagcttgcgataggttggttcc

SEQ ID NO: 562151 - DNA, 25 bp, Rattus norvegicus
taggttggttccgtgcgacatttaa

SEQ ID NO: 562152 - DNA, 25 bp, Rattus norvegicus
tccgccgaactgaaacttcccgctg

SEQ ID NO: 562153 - DNA, 25 bp, Rattus norvegicus
ccctcgaacgaagcttgcgataggt

SEQ ID NO: 562154 - DNA, 25 bp, Rattus norvegicus
ttggttccgtgcgacatttaaattg

SEQ ID NO: 562155 - DNA, 25 bp, Rattus norvegicus
cgacatttaaattgtttggaaggca

SEQ ID NO: 562156 - DNA, 25 bp, Rattus norvegicus
ccgtgcgacatttaaattgtttgga

SEQ ID NO: 562157 - DNA, 25 bp, Rattus norvegicus
agcttgcgataggttggttccgtgc

SEQ ID NO: 562158 - DNA, 25 bp, Rattus norvegicus
cgataggttggttccgtgcgacatt

SEQ ID NO: 562159 - DNA, 25 bp, Rattus norvegicus
tagaccgtgatgtcaccgcaggccc

SEQ ID NO: 562160 - DNA, 25 bp, Rattus norvegicus
cggcgcgtgatgtcacgccggttta

SEQ ID NO: 562161 - DNA, 25 bp, Rattus norvegicus
cacgccggtttagccaaacaaatgg

SEQ ID NO: 562162 - DNA, 25 bp, Rattus norvegicus
tcctggtccgtctcagtctcgggga

SEQ ID NO: 562163 - DNA, 25 bp, Rattus norvegicus
tccgtctcagtctcggggagcgagt

SEQ ID NO: 562164 - DNA, 25 bp, Rattus norvegicus
tcctcgctcaggtgagcggcgcgtc

SEQ ID NO: 562165 - DNA, 25 bp, Rattus norvegicus
cggtgaggtcacagtaccgaggctc

SEQ ID NO: 562166 - DNA, 25 bp, Rattus norvegicus
gtgatgtcagggctctaccgagata

SEQ ID NO: 562167 - DNA, 25 bp, Rattus norvegicus
ctctaccgagatagaccgtgatgtc

SEQ ID NO: 562168 - DNA, 25 bp, Rattus norvegicus
ggaagttcggtccttgcagatttga

SEQ ID NO: 562169 - DNA, 25 bp, Rattus norvegicus
ggtccttgcagatttgaaccgaaat

SEQ ID NO: 562170 - DNA, 25 bp, Rattus norvegicus
atttgaaccgaaatcgtgggatctc

SEQ ID NO: 562171 - DNA, 25 bp, Rattus norvegicus
gatgtcacgccggtttagccaaaca

SEQ ID NO: 562172 - DNA, 25 bp, Rattus norvegicus
ccgaaatcgtgggatctcagcttcg

SEQ ID NO: 562173 - DNA, 25 bp, Rattus norvegicus
accaggtccggtgctagagcccgcg

SEQ ID NO: 562174 - DNA, 25 bp, Rattus norvegicus
gcccgcggcccaaagccaggagcct

SEQ ID NO: 562175 - DNA, 25 bp, Rattus norvegicus
aaccgccggcgagtggtgttgcaca

SEQ ID NO: 562176 - DNA, 25 bp, Rattus norvegicus
accgagtccaccaggtccggtgcta

SEQ ID NO: 562177 - DNA, 25 bp, Rattus norvegicus
tggtgttgcacagaggacaccgctc

SEQ ID NO: 562178 - DNA, 25 bp, Rattus norvegicus
tgcacagaggacaccgctcaacagc

SEQ ID NO: 562179 - DNA, 25 bp, Rattus norvegicus
acagccacgtaaaggccctcggcgt

SEQ ID NO: 562180 - DNA, 25 bp, Rattus norvegicus
ctctggacgcacttagcgcaagtca

SEQ ID NO: 562181 - DNA, 25 bp, Rattus norvegicus
gaaatcaccgctctggacgcactta

SEQ ID NO: 562182 - DNA, 25 bp, Rattus norvegicus
gtcgaaatagacgaaatcaccgctc

SEQ ID NO: 562183 - DNA, 25 bp, Rattus norvegicus
cgcggccgtcgaaatagacgaaatc

SEQ ID NO: 562184 - DNA, 25 bp, Rattus norvegicus
tcaacagccacgtaaaggccctcgg

SEQ ID NO: 562185 - DNA, 25 bp, Rattus norvegicus
cttagcgcaagtcaaccgccggcga

SEQ ID NO: 562186 - DNA, 25 bp, Rattus norvegicus
ccggtcgcggccgtcgaaatagacg

SEQ ID NO: 562187 - DNA, 25 bp, Rattus norvegicus
actgcatcacggtagagagattcgc

SEQ ID NO: 562188 - DNA, 25 bp, Rattus norvegicus
gccttcggctgccgggccaatgcag

SEQ ID NO: 562189 - DNA, 25 bp, Rattus norvegicus
gtggccacgtccagggacatctccg

SEQ ID NO: 562190 - DNA, 25 bp, Rattus norvegicus
ggattgtttgcgtcgcgaccggaac

SEQ ID NO: 562191 - DNA, 25 bp, Rattus norvegicus
tgtttgcgtcgcgaccggaacggaa

SEQ ID NO: 562192 - DNA, 25 bp, Rattus norvegicus
cgcgttgaccttgcgggcggtcaaa

SEQ ID NO: 562193 - DNA, 25 bp, Rattus norvegicus
gccacggactgcatcacggtagaga

SEQ ID NO: 562194 - DNA, 25 bp, Rattus norvegicus
cacggtagagagattcgcgagcctc

SEQ ID NO: 562195 - DNA, 25 bp, Rattus norvegicus
agagagattcgcgagcctcaggcga

SEQ ID NO: 562196 - DNA, 25 bp, Rattus norvegicus
agcctcaggcgagggacgcaacctc

SEQ ID NO: 562197 - DNA, 25 bp, Rattus norvegicus
aggcgagggacgcaacctccagctc

SEQ ID NO: 562198 - DNA, 25 bp, Rattus norvegicus
caacctccagctccgcggagaccga

SEQ ID NO: 562199 - DNA, 25 bp, Rattus norvegicus
aagctgtcggacagcccgccttcgg

SEQ ID NO: 562200 - DNA, 25 bp, Rattus norvegicus
agccaggggccacggactgcatcac

SEQ ID NO: 562201 - DNA, 25 bp, Rattus norvegicus
cgctgcttagtgtcttcgggtcctt

SEQ ID NO: 562202 - DNA, 25 bp, Rattus norvegicus
ctcccaccaccaggttgtagagtta

SEQ ID NO: 562203 - DNA, 25 bp, Rattus norvegicus
ggaattctgcgaagttctccctctc

SEQ ID NO: 562204 - DNA, 25 bp, Rattus norvegicus
gttctccctctctcccaggggtgtg

SEQ ID NO: 562205 - DNA, 25 bp, Rattus norvegicus
gtgtgtccgccttgttgcccaacaa

SEQ ID NO: 562206 - DNA, 25 bp, Rattus norvegicus
caacaatggaatttgggacgtcccg

SEQ ID NO: 562207 - DNA, 25 bp, Rattus norvegicus
acgtcccggatctagccgcgttcgg

SEQ ID NO: 562208 - DNA, 25 bp, Rattus norvegicus
gaggagcagcgtccctttctttgtc

SEQ ID NO: 562209 - DNA, 25 bp, Rattus norvegicus
gaacctatttttagcccggctcgca

SEQ ID NO: 562210 - DNA, 25 bp, Rattus norvegicus
cgctgcatctcggtttaggttaaaa

SEQ ID NO: 562211 - DNA, 25 bp, Rattus norvegicus
gaattcggccttcgagaccggagca

SEQ ID NO: 562212 - DNA, 25 bp, Rattus norvegicus
cggtgcgacggcacctgagctactg

SEQ ID NO: 562213 - DNA, 25 bp, Rattus norvegicus
ctgcgccgacctgtccctttaaggg

SEQ ID NO: 562214 - DNA, 25 bp, Rattus norvegicus
ctcgtagcacgctgacccggaggta

SEQ ID NO: 562215 - DNA, 25 bp, Rattus norvegicus
ggacagaccacaccaagccgatgca

SEQ ID NO: 562216 - DNA, 25 bp, Rattus norvegicus
acccacataagcagggcagccgctg

SEQ ID NO: 562217 - DNA, 25 bp, Rattus norvegicus
cgctgtcaggcagtccgagggcaac

SEQ ID NO: 562218 - DNA, 25 bp, Rattus norvegicus
cgagggcaacggtccatgtggccat

SEQ ID NO: 562219 - DNA, 25 bp, Rattus norvegicus
ccatgtggccatgcagcgacggtca

SEQ ID NO: 562220 - DNA, 25 bp, Rattus norvegicus
gcgacggtcagtcggtcacagtccc

SEQ ID NO: 562221 - DNA, 25 bp, Rattus norvegicus
agtcggtcacagtccctgctggtgc

SEQ ID NO: 562222 - DNA, 25 bp, Rattus norvegicus
tgctggtgcccgctgcgaaaccgtt

SEQ ID NO: 562223 - DNA, 25 bp, Rattus norvegicus
gaaaccgttgtgaccgcagcagcag

SEQ ID NO: 562224 - DNA, 25 bp, Rattus norvegicus
tcgtggctcgcttccggacagacca

SEQ ID NO: 562225 - DNA, 25 bp, Rattus norvegicus
caaaatccacatagcacggtgctgg

SEQ ID NO: 562226 - DNA, 25 bp, Rattus norvegicus
gcaagaagcagtcagaacccacata

SEQ ID NO: 562227 - DNA, 25 bp, Rattus norvegicus
gtgaggcagcagtggtcaaaatcca

SEQ ID NO: 562228 - DNA, 25 bp, Rattus norvegicus
gggtttcggcaccaatgttgtggta

SEQ ID NO: 562229 - DNA, 25 bp, Rattus norvegicus
gggttaagcattgttccagtctgtg

SEQ ID NO: 562230 - DNA, 25 bp, Rattus norvegicus
tgtccatacctcttgggtctccgta

SEQ ID NO: 562231 - DNA, 25 bp, Rattus norvegicus
ctcgcattcctagtccggtcccgct

SEQ ID NO: 562232 - DNA, 25 bp, Rattus norvegicus
gacgctcgcagccacgacggagcag

SEQ ID NO: 562233 - DNA, 25 bp, Rattus norvegicus
ggccgagcacggctccatgttttca

SEQ ID NO: 562234 - DNA, 25 bp, Rattus norvegicus
tccatgttttcacccggccaggagg

SEQ ID NO: 562235 - DNA, 25 bp, Rattus norvegicus
cccaacaaggagccggtgaaatacg

SEQ ID NO: 562236 - DNA, 25 bp, Rattus norvegicus
cccgtggccgctggggacttctcgt

SEQ ID NO: 562237 - DNA, 25 bp, Rattus norvegicus
ctgaggaccgcgaacgcggagccct

SEQ ID NO: 562238 - DNA, 25 bp, Rattus norvegicus
attgttccagtctgtgacccgggcg

SEQ ID NO: 562239 - DNA, 25 bp, Rattus norvegicus
cctccgcttctttggcgccgggagt

SEQ ID NO: 562240 - DNA, 25 bp, Rattus norvegicus
tgagatcggccaagggcctggacct

SEQ ID NO: 562241 - DNA, 25 bp, Rattus norvegicus
cgggtgtccatacctcttgggtctc

SEQ ID NO: 562242 - DNA, 25 bp, Rattus norvegicus
ttctcgttcctgaggaccgcgaacg

SEQ ID NO: 562243 - DNA, 25 bp, Rattus norvegicus
cgtacctgagctgcggtcacgtgca

SEQ ID NO: 562244 - DNA, 25 bp, Rattus norvegicus
ccacgctcctctggagaaccgccga

SEQ ID NO: 562245 - DNA, 25 bp, Rattus norvegicus
gccgacggcctcttccacgcaccga

SEQ ID NO: 562246 - DNA, 25 bp, Rattus norvegicus
cacgcaccgactcagaagcacattg

SEQ ID NO: 562247 - DNA, 25 bp, Rattus norvegicus
agaagcacattgaagccctccggca

SEQ ID NO: 562248 - DNA, 25 bp, Rattus norvegicus
cattgaagccctccggcaggagatc

SEQ ID NO: 562249 - DNA, 25 bp, Rattus norvegicus
tccggcaggagatcaacgcagcccg

SEQ ID NO: 562250 - DNA, 25 bp, Rattus norvegicus
cccagtgtcccgtgggcctcaacac

SEQ ID NO: 562251 - DNA, 25 bp, Rattus norvegicus
cgtgggcctcaacaccctggccttc

SEQ ID NO: 562252 - DNA, 25 bp, Rattus norvegicus
cagcatcaaccggaaggaagtggta

SEQ ID NO: 562253 - DNA, 25 bp, Rattus norvegicus
gcagccctgggcgtacctgagctgc

SEQ ID NO: 562254 - DNA, 25 bp, Rattus norvegicus
tcacgtgcacggctaccacagctgg

SEQ ID NO: 562255 - DNA, 25 bp, Rattus norvegicus
gctaccacagctggggccatcggag

SEQ ID NO: 562256 - DNA, 25 bp, Rattus norvegicus
tcaaccggaaggaagtggtagaaga

SEQ ID NO: 562257 - DNA, 25 bp, Rattus norvegicus
ctgcgtaaggcggttgctttagata

SEQ ID NO: 562258 - DNA, 25 bp, Rattus norvegicus
caacctcgaagctcctgaggggcga

SEQ ID NO: 562259 - DNA, 25 bp, Rattus norvegicus
ggaatcgagaatgccgcgggactca

SEQ ID NO: 562260 - DNA, 25 bp, Rattus norvegicus
atgccgcgggactcacttacccggg

SEQ ID NO: 562261 - DNA, 25 bp, Rattus norvegicus
agcccacggagggatgcagcaagtc

SEQ ID NO: 562262 - DNA, 25 bp, Rattus norvegicus
tgcagcaagtccatacccgaagtgg

SEQ ID NO: 562263 - DNA, 25 bp, Rattus norvegicus
tccatacccgaagtggtcagactca

SEQ ID NO: 562264 - DNA, 25 bp, Rattus norvegicus
cccattgactgcgtaaggcggttgc

SEQ ID NO: 562265 - DNA, 25 bp, Rattus norvegicus
ggcggttgctttagataagacatca

SEQ ID NO: 562266 - DNA, 25 bp, Rattus norvegicus
gtggtcagactcagcccattgactg

SEQ ID NO: 562267 - DNA, 25 bp, Rattus norvegicus
ggaggcgcaaagtcggcccaaattg

SEQ ID NO: 562268 - DNA, 25 bp, Rattus norvegicus
gacccagccggacggtctcgattcg

SEQ ID NO: 562269 - DNA, 25 bp, Rattus norvegicus
taaggttgtttggaggcgcaaagtc

SEQ ID NO: 562270 - DNA, 25 bp, Rattus norvegicus
gataagacatcatgctaaggttgtt

SEQ ID NO: 562271 - DNA, 25 bp, Rattus norvegicus
ctccaggcgcaagcgactgggtccg

SEQ ID NO: 562272 - DNA, 25 bp, Rattus norvegicus
tcaataataattacctcgtccgaga

SEQ ID NO: 562273 - DNA, 25 bp, Rattus norvegicus
cctcgtccgagaattaattataata

SEQ ID NO: 562274 - DNA, 25 bp, Rattus norvegicus
cagccttatatctaacggtcaattc

SEQ ID NO: 562275 - DNA, 25 bp, Rattus norvegicus
gtcaattcatgcaatctgtcgcttc

SEQ ID NO: 562276 - DNA, 25 bp, Rattus norvegicus
agaagcccatctaccagttgctgtg

SEQ ID NO: 562277 - DNA, 25 bp, Rattus norvegicus
gttgctgtgtcctcgctcaataata

SEQ ID NO: 562278 - DNA, 25 bp, Rattus norvegicus
aaacttcgcggactggcgacttggc

SEQ ID NO: 562279 - DNA, 25 bp, Rattus norvegicus
ctcgtcctggctgattaattttctg

SEQ ID NO: 562280 - DNA, 25 bp, Rattus norvegicus
ccggcctgcacagccttatatctaa

SEQ ID NO: 562281 - DNA, 25 bp, Rattus norvegicus
tgctcagctctgcttctcgtcctgg

SEQ ID NO: 562282 - DNA, 25 bp, Rattus norvegicus
aattacaggccgtcgtgctcagctc

SEQ ID NO: 562283 - DNA, 25 bp, Rattus norvegicus
gggcacacgtcccttaattacaggc

SEQ ID NO: 562284 - DNA, 25 bp, Rattus norvegicus
cgagataatccgaggggcacacgtc

SEQ ID NO: 562285 - DNA, 25 bp, Rattus norvegicus
ttcggaagcgctcaccttattatcg

SEQ ID NO: 562286 - DNA, 25 bp, Rattus norvegicus
agcgggcgccttccattagttcctt

SEQ ID NO: 562287 - DNA, 25 bp, Rattus norvegicus
tgcagaagtgctcaacgggccacga

SEQ ID NO: 562288 - DNA, 25 bp, Rattus norvegicus
ttcggctcccgctgcaaactgagga

SEQ ID NO: 562289 - DNA, 25 bp, Rattus norvegicus
cggaagtaaccagacgccagcgctg

SEQ ID NO: 562290 - DNA, 25 bp, Rattus norvegicus
gacctcagtgtgcagttcccgggtt

SEQ ID NO: 562291 - DNA, 25 bp, Rattus norvegicus
aaacctgtccaactagcggcctcgg

SEQ ID NO: 562292 - DNA, 25 bp, Rattus norvegicus
ggcagagtcgcctttaaaacctgtc

SEQ ID NO: 562293 - DNA, 25 bp, Rattus norvegicus
cctgaaccacactaggcagagtcgc

SEQ ID NO: 562294 - DNA, 25 bp, Rattus norvegicus
cagaacaactgaggacacgaagtcc

SEQ ID NO: 562295 - DNA, 25 bp, Rattus norvegicus
ctgaggagtctaagggcaacccgct

SEQ ID NO: 562296 - DNA, 25 bp, Rattus norvegicus
cctccgtatgaggttggccttgacc

SEQ ID NO: 562297 - DNA, 25 bp, Rattus norvegicus
cccaagcctgaaaaggcagtgcaga

SEQ ID NO: 562298 - DNA, 25 bp, Rattus norvegicus
ggccttgacccacgacacttcattg

SEQ ID NO: 562299 - DNA, 25 bp, Rattus norvegicus
ggactactaccgagacatggccatc

SEQ ID NO: 562300 - DNA, 25 bp, Rattus norvegicus
ctgccttgggtctttgcttgtaatg

SEQ ID NO: 562301 - DNA, 25 bp, Rattus norvegicus
taatgggcgattacagggtccagcg

SEQ ID NO: 562302 - DNA, 25 bp, Rattus norvegicus
tccagcgtggaaagccgtgcatcgc

SEQ ID NO: 562303 - DNA, 25 bp, Rattus norvegicus
agggccacagcgctggaccgctacg

SEQ ID NO: 562304 - DNA, 25 bp, Rattus norvegicus
gaccacagtaagagaccctttccta

SEQ ID NO: 562305 - DNA, 25 bp, Rattus norvegicus
catggccatcgagtaccacggcgtc

SEQ ID NO: 562306 - DNA, 25 bp, Rattus norvegicus
ctcacggccgctggaatgtggacac

SEQ ID NO: 562307 - DNA, 25 bp, Rattus norvegicus
ttcacgcacgtgctgaatgccgctc

SEQ ID NO: 562308 - DNA, 25 bp, Rattus norvegicus
acgggctgcagaaggccggcttcac

SEQ ID NO: 562309 - DNA, 25 bp, Rattus norvegicus
ccttcgacctcagcatctttttcta

SEQ ID NO: 562310 - DNA, 25 bp, Rattus norvegicus
gcctctggaagtgcgctcgctgcct

SEQ ID NO: 562311 - DNA, 25 bp, Rattus norvegicus
tctttttctactcggctgccgcctt

SEQ ID NO: 562312 - DNA, 25 bp, Rattus norvegicus
tcggcgctccaagacgaccacagta

SEQ ID NO: 562313 - DNA, 25 bp, Rattus norvegicus
tctgagcgttgccttcgtggatgaa

SEQ ID NO: 562314 - DNA, 25 bp, Rattus norvegicus
taccgagatcgtgttgggcaagaac

SEQ ID NO: 562315 - DNA, 25 bp, Rattus norvegicus
cagcgctgacgggacggaaacactc

SEQ ID NO: 562316 - DNA, 25 bp, Rattus norvegicus
cagagccacctgaaacactttgaga

SEQ ID NO: 562317 - DNA, 25 bp, Rattus norvegicus
ggctgccttctgagtgaagaaatta

SEQ ID NO: 562318 - DNA, 25 bp, Rattus norvegicus
attttccagcctgtctggcgcggcg

SEQ ID NO: 562319 - DNA, 25 bp, Rattus norvegicus
ggggaaatcttgtcctaccgagatc

SEQ ID NO: 562320 - DNA, 25 bp, Rattus norvegicus
aagccactgaaaactcgcacccgga

SEQ ID NO: 562321 - DNA, 25 bp, Rattus norvegicus
atgctaaggcacagcgaccggctct

SEQ ID NO: 562322 - DNA, 25 bp, Rattus norvegicus
ggcacgtcctgttttcgggatgcta

SEQ ID NO: 562323 - DNA, 25 bp, Rattus norvegicus
tcgcgacctgtcctagactttggca

SEQ ID NO: 562324 - DNA, 25 bp, Rattus norvegicus
cgtgtctacttgtgagctcgcggtt

SEQ ID NO: 562325 - DNA, 25 bp, Rattus norvegicus
acacccggccgaagcagcaagtttt

SEQ ID NO: 562326 - DNA, 25 bp, Rattus norvegicus
agtttaaccaagtaggctgggctgc

SEQ ID NO: 562327 - DNA, 25 bp, Rattus norvegicus
gcctgtgatgctgtggcttctgtga

SEQ ID NO: 562328 - DNA, 25 bp, Rattus norvegicus
atcccggagcctcccaccactcgcc

SEQ ID NO: 562329 - DNA, 25 bp, Rattus norvegicus
gcctcccaccactcgcctgctcgca

SEQ ID NO: 562330 - DNA, 25 bp, Rattus norvegicus
cactcgcctgctcgcacctgtcacc

SEQ ID NO: 562331 - DNA, 25 bp, Rattus norvegicus
cccatgctgaccgaggctctgtcag

SEQ ID NO: 562332 - DNA, 25 bp, Rattus norvegicus
ccatgctgaccgaggctctgtcagg

SEQ ID NO: 562333 - DNA, 25 bp, Rattus norvegicus
gcctccagtgcgctctttggctagc

SEQ ID NO: 562334 - DNA, 25 bp, Rattus norvegicus
ctccagtgcgctctttggctagccg

SEQ ID NO: 562335 - DNA, 25 bp, Rattus norvegicus
cagtgcgctctttggctagccgggt

SEQ ID NO: 562336 - DNA, 25 bp, Rattus norvegicus
ctggcgcctgtgatgctgtggcttc

SEQ ID NO: 562337 - DNA, 25 bp, Rattus norvegicus
cctgtgatgctgtggcttctgtgac

SEQ ID NO: 562338 - DNA, 25 bp, Rattus norvegicus
tgatgctgtggcttctgtgacgttc

SEQ ID NO: 562339 - DNA, 25 bp, Rattus norvegicus
atgctgtggcttctgtgacgttccg

SEQ ID NO: 562340 - DNA, 25 bp, Rattus norvegicus
cgctctttggctagccgggtggagg

SEQ ID NO: 562341 - DNA, 25 bp, Rattus norvegicus
tgtacccagcgcctccatcaggatg

SEQ ID NO: 562342 - DNA, 25 bp, Rattus norvegicus
tcacgcgtgtgaggcctgactacac

SEQ ID NO: 562343 - DNA, 25 bp, Rattus norvegicus
gtcggagcctgcatcttccagcaca

SEQ ID NO: 562344 - DNA, 25 bp, Rattus norvegicus
ccagtaggcgataatgcggttattc

SEQ ID NO: 562345 - DNA, 25 bp, Rattus norvegicus
ggttattccaccatctccagtgagg

SEQ ID NO: 562346 - DNA, 25 bp, Rattus norvegicus
ccaggacctgatctgcccgtaaagc

SEQ ID NO: 562347 - DNA, 25 bp, Rattus norvegicus
gctctcctactgaactccgggctgg

SEQ ID NO: 562348 - DNA, 25 bp, Rattus norvegicus
cgacttctctagcaggggcaccttc

SEQ ID NO: 562349 - DNA, 25 bp, Rattus norvegicus
cttcggcgtctgagtcggaaatctc

SEQ ID NO: 562350 - DNA, 25 bp, Rattus norvegicus
acgtacccggatgcttttgttcagg

SEQ ID NO: 562351 - DNA, 25 bp, Rattus norvegicus
tttgttcaggacactggccgcttcc

SEQ ID NO: 562352 - DNA, 25 bp, Rattus norvegicus
gagactcgcagctctacgccctaga

SEQ ID NO: 562353 - DNA, 25 bp, Rattus norvegicus
gtcgtctggttacccgcaagtcctg

SEQ ID NO: 562354 - DNA, 25 bp, Rattus norvegicus
tgctgcggctcaatgcggcattcac

SEQ ID NO: 562355 - DNA, 25 bp, Rattus norvegicus
ggctcctaagcctgtcgaaacgtcg

SEQ ID NO: 562356 - DNA, 25 bp, Rattus norvegicus
tttgaaagcgaatgacgcgccttga

SEQ ID NO: 562357 - DNA, 25 bp, Rattus norvegicus
ccgcggaggcgctcatttgaaagcg

SEQ ID NO: 562358 - DNA, 25 bp, Rattus norvegicus
ccatgaagcggagccgcagacgcct

SEQ ID NO: 562359 - DNA, 25 bp, Rattus norvegicus
cagcgcaagagagcggccatgaagc

SEQ ID NO: 562360 - DNA, 25 bp, Rattus norvegicus
cgggtcctcacacagcgaagacagc

SEQ ID NO: 562361 - DNA, 25 bp, Rattus norvegicus
gcttcacatgctgcgcctcagaggc

SEQ ID NO: 562362 - DNA, 25 bp, Rattus norvegicus
cgtcctgtcgccagaacgtctggtc

SEQ ID NO: 562363 - DNA, 25 bp, Rattus norvegicus
ccagtgcggctcctaagcctgtcga

SEQ ID NO: 562364 - DNA, 25 bp, Rattus norvegicus
tcgaaacgtcggcacggagaagccc

SEQ ID NO: 562365 - DNA, 25 bp, Rattus norvegicus
aatgacgcgccttgagcctcgcggg

SEQ ID NO: 562366 - DNA, 25 bp, Rattus norvegicus
cacctcgaagagctcggccgtcgtg

SEQ ID NO: 562367 - DNA, 25 bp, Rattus norvegicus
cccgcagcactgtcgtgaggatctg

SEQ ID NO: 562368 - DNA, 25 bp, Rattus norvegicus
atctgcacggcaagatccggctcgc

SEQ ID NO: 562369 - DNA, 25 bp, Rattus norvegicus
caggcagggaagtgtcgtaaagctt

SEQ ID NO: 562370 - DNA, 25 bp, Rattus norvegicus
caaggcgcgttcttgccttcgctgc

SEQ ID NO: 562371 - DNA, 25 bp, Rattus norvegicus
agctcaacggattgattggcccaga

SEQ ID NO: 562372 - DNA, 25 bp, Rattus norvegicus
ttggcccagaactgagacacctccg

SEQ ID NO: 562373 - DNA, 25 bp, Rattus norvegicus
gggaccctcaagagtaaggttctga

SEQ ID NO: 562374 - DNA, 25 bp, Rattus norvegicus
caagagtaaggttctgagtgcagcg

SEQ ID NO: 562375 - DNA, 25 bp, Rattus norvegicus
cccaaagtgactgccacaaaaggag

SEQ ID NO: 562376 - DNA, 25 bp, Rattus norvegicus
gccacaaaaggagccgagggacacc

SEQ ID NO: 562377 - DNA, 25 bp, Rattus norvegicus
gaggtaccgcctgggcctagcagcc

SEQ ID NO: 562378 - DNA, 25 bp, Rattus norvegicus
tcgcttctaggatggcggaggtacc

SEQ ID NO: 562379 - DNA, 25 bp, Rattus norvegicus
tcctctctcggctgtgtcgcttcta

SEQ ID NO: 562380 - DNA, 25 bp, Rattus norvegicus
tgagggacggtttctgcctttgttc

SEQ ID NO: 562381 - DNA, 25 bp, Rattus norvegicus
gtgtcgtaaagcttggcccaggaaa

SEQ ID NO: 562382 - DNA, 25 bp, Rattus norvegicus
cgctcgcttgctgcagcgaggacga

SEQ ID NO: 562383 - DNA, 25 bp, Rattus norvegicus
gcgccagtgccagccatccctgcca

SEQ ID NO: 562384 - DNA, 25 bp, Rattus norvegicus
cgggtttgtcctcacctggagcatt

SEQ ID NO: 562385 - DNA, 25 bp, Rattus norvegicus
agcgcgaaggaaagtggcagcgcca

SEQ ID NO: 562386 - DNA, 25 bp, Rattus norvegicus
tcagcacagctgagcgcgaaggaaa

SEQ ID NO: 562387 - DNA, 25 bp, Rattus norvegicus
cacctggagcattcagcacagctga

SEQ ID NO: 562388 - DNA, 25 bp, Rattus norvegicus
gtcctcacctggagcattcagcaca

SEQ ID NO: 562389 - DNA, 25 bp, Rattus norvegicus
ggtttgtcctcacctggagcattca

SEQ ID NO: 562390 - DNA, 25 bp, Rattus norvegicus
tgcagaagccgggtttgtcctcacc

SEQ ID NO: 562391 - DNA, 25 bp, Rattus norvegicus
ccaggtttgcagaagccgggtttgt

SEQ ID NO: 562392 - DNA, 25 bp, Rattus norvegicus
cctctcgccaggtttgcagaagccg

SEQ ID NO: 562393 - DNA, 25 bp, Rattus norvegicus
cctgcctctcgccaggtttgcagaa

SEQ ID NO: 562394 - DNA, 25 bp, Rattus norvegicus
atccctgccacgactcacgtagagg

SEQ ID NO: 562395 - DNA, 25 bp, Rattus norvegicus
gtgcagggagctccaccctagggct

SEQ ID NO: 562396 - DNA, 25 bp, Rattus norvegicus
cactcagagcgagcccgtgcagccc

SEQ ID NO: 562397 - DNA, 25 bp, Rattus norvegicus
tgatgacgtcgtccttcaagcgcta

SEQ ID NO: 562398 - DNA, 25 bp, Rattus norvegicus
ctgaattgggttatgaggcccgcga

SEQ ID NO: 562399 - DNA, 25 bp, Rattus norvegicus
catcccggcaaagggtgatgacgtc

SEQ ID NO: 562400 - DNA, 25 bp, Rattus norvegicus
aatttgcatgcgctctagcccaggc

SEQ ID NO: 562401 - DNA, 25 bp, Rattus norvegicus
aaagcacagcgtgtaatttgcatgc

SEQ ID NO: 562402 - DNA, 25 bp, Rattus norvegicus
gtgacttcccacaaagcacagcgtg

SEQ ID NO: 562403 - DNA, 25 bp, Rattus norvegicus
tgaatttaacacttacggtgacttc

SEQ ID NO: 562404 - DNA, 25 bp, Rattus norvegicus
gccgccataataagactccaaaaga

SEQ ID NO: 562405 - DNA, 25 bp, Rattus norvegicus
agtgtgaagacctgccgccataata

SEQ ID NO: 562406 - DNA, 25 bp, Rattus norvegicus
cccgcccactaggagtgtgaagacc

SEQ ID NO: 562407 - DNA, 25 bp, Rattus norvegicus
gccgagagagtgacgagcactcagc

SEQ ID NO: 562408 - DNA, 25 bp, Rattus norvegicus
attgaactcgaattgctggccgtga

SEQ ID NO: 562409 - DNA, 25 bp, Rattus norvegicus
tccttcaagcgctatggcgccgcgg

SEQ ID NO: 562410 - DNA, 25 bp, Rattus norvegicus
ggtgcctcacctcagccattgaact

SEQ ID NO: 562411 - DNA, 25 bp, Rattus norvegicus
ggcaccgcgatgaacgacccagaac

SEQ ID NO: 562412 - DNA, 25 bp, Rattus norvegicus
aggactagctgtaaccggcaccgcg

SEQ ID NO: 562413 - DNA, 25 bp, Rattus norvegicus
atcttgttggcgctgccttcgaacc

SEQ ID NO: 562414 - DNA, 25 bp, Rattus norvegicus
ttcaggcgccagaagttatgtcacg

SEQ ID NO: 562415 - DNA, 25 bp, Rattus norvegicus
gcggagccctcgaatcacgtgacaa

SEQ ID NO: 562416 - DNA, 25 bp, Rattus norvegicus
tcaccgcgctctagaaccacgtggg

SEQ ID NO: 562417 - DNA, 25 bp, Rattus norvegicus
ttatgtcacgagtggcaggcgaacc

SEQ ID NO: 562418 - DNA, 25 bp, Rattus norvegicus
agggctttcgttacagcgatgccga

SEQ ID NO: 562419 - DNA, 25 bp, Rattus norvegicus
gtaaacactgcttcggtgctccaga

SEQ ID NO: 562420 - DNA, 25 bp, Rattus norvegicus
gcgaccttgtttgccgaagggccta

SEQ ID NO: 562421 - DNA, 25 bp, Rattus norvegicus
cattctttgtgcagtgaggggctcc

SEQ ID NO: 562422 - DNA, 25 bp, Rattus norvegicus
gcccacgtgggaacagacagactcc

SEQ ID NO: 562423 - DNA, 25 bp, Rattus norvegicus
tgctccagacgcctaagggctttcg

SEQ ID NO: 562424 - DNA, 25 bp, Rattus norvegicus
caccgtttcttatctgcaggcagcg

SEQ ID NO: 562425 - DNA, 25 bp, Rattus norvegicus
tctcgcggcaggcttagacagtgat

SEQ ID NO: 562426 - DNA, 25 bp, Rattus norvegicus
catgtttaccggctccgtacggagg

SEQ ID NO: 562427 - DNA, 25 bp, Rattus norvegicus
cccgtagctgctgagtccgtaaaca

SEQ ID NO: 562428 - DNA, 25 bp, Rattus norvegicus
cctaggcctaggtgcatttcagacc

SEQ ID NO: 562429 - DNA, 25 bp, Rattus norvegicus
gtcacatgaccttcccgtagctgct

SEQ ID NO: 562430 - DNA, 25 bp, Rattus norvegicus
aggatacctcgctccgtgacaggtg

SEQ ID NO: 562431 - DNA, 25 bp, Rattus norvegicus
agtgattgcggaccaaggatacctc

SEQ ID NO: 562432 - DNA, 25 bp, Rattus norvegicus
taaccacggatgctccacggaggtg

SEQ ID NO: 562433 - DNA, 25 bp, Rattus norvegicus
cactgtcatttgtggacctgaaaca

SEQ ID NO: 562434 - DNA, 25 bp, Rattus norvegicus
gcgggtcacgtcaccgtcacatgac

SEQ ID NO: 562435 - DNA, 25 bp, Rattus norvegicus
tccgtaaacactgcacgtgactaga

SEQ ID NO: 562436 - DNA, 25 bp, Rattus norvegicus
tgactagaagttgtgcgagccattg

SEQ ID NO: 562437 - DNA, 25 bp, Rattus norvegicus
gcgagccattggaagtgcggccatc

SEQ ID NO: 562438 - DNA, 25 bp, Rattus norvegicus
accctctgaggaagctctcgcggca

SEQ ID NO: 562439 - DNA, 25 bp, Rattus norvegicus
gctgtcgctgagaactgcgaactta

SEQ ID NO: 562440 - DNA, 25 bp, Rattus norvegicus
cgtggagcggaaagggcaggatttc

SEQ ID NO: 562441 - DNA, 25 bp, Rattus norvegicus
aagggcaggatttcggcgcagccgt

SEQ ID NO: 562442 - DNA, 25 bp, Rattus norvegicus
agaactgcgaacttagcagcctggg

SEQ ID NO: 562443 - DNA, 25 bp, Rattus norvegicus
gcgcagccgtcggtgacaccatgga

SEQ ID NO: 562444 - DNA, 25 bp, Rattus norvegicus
cagccgtcggtgacaccatggagaa

SEQ ID NO: 562445 - DNA, 25 bp, Rattus norvegicus
tcggtgacaccatggagaacgagta

SEQ ID NO: 562446 - DNA, 25 bp, Rattus norvegicus
tgacaccatggagaacgagtaagtg

SEQ ID NO: 562447 - DNA, 25 bp, Rattus norvegicus
gactctggctgtgtcgccgtggagc

SEQ ID NO: 562448 - DNA, 25 bp, Rattus norvegicus
acgggctgtcgctgagaactgcgaa

SEQ ID NO: 562449 - DNA, 25 bp, Rattus norvegicus
gtcgctgagaactgcgaacttagca

SEQ ID NO: 562450 - DNA, 25 bp, Rattus norvegicus
gggatgcagagaggcctggcacaga

SEQ ID NO: 562451 - DNA, 25 bp, Rattus norvegicus
ggcccagagaaggagcgagtctgct

SEQ ID NO: 562452 - DNA, 25 bp, Rattus norvegicus
caccatggagaacgagtaagtgcgg

SEQ ID NO: 562453 - DNA, 25 bp, Rattus norvegicus
tctggaacgcagataggtggagggc

SEQ ID NO: 562454 - DNA, 25 bp, Rattus norvegicus
aaggtaatgggatttcggcactgga

SEQ ID NO: 562455 - DNA, 25 bp, Rattus norvegicus
cggccttggttgaagcgaagccgct

SEQ ID NO: 562456 - DNA, 25 bp, Rattus norvegicus
gactccggccttggttgaagcgaag

SEQ ID NO: 562457 - DNA, 25 bp, Rattus norvegicus
tgcttacaaagccacccgaccgcct

SEQ ID NO: 562458 - DNA, 25 bp, Rattus norvegicus
ctgctggaaagacaagctcccactc

SEQ ID NO: 562459 - DNA, 25 bp, Rattus norvegicus
tgaggaaaacgcaggttctggaacg

SEQ ID NO: 562460 - DNA, 25 bp, Rattus norvegicus
ggatttcggcactggagcgcctcct

SEQ ID NO: 562461 - DNA, 25 bp, Rattus norvegicus
gctcgccataaggtaatgggatttc

SEQ ID NO: 562462 - DNA, 25 bp, Rattus norvegicus
gctcgtgctcgccataaggtaatgg

SEQ ID NO: 562463 - DNA, 25 bp, Rattus norvegicus
cccaaggctcgtgctcgccataagg

SEQ ID NO: 562464 - DNA, 25 bp, Rattus norvegicus
agccgctggaggcagaagcaaggct

SEQ ID NO: 562465 - DNA, 25 bp, Rattus norvegicus
caaggctgaggaaaacgcaggttct

SEQ ID NO: 562466 - DNA, 25 bp, Rattus norvegicus
agcgcctcctgctggaaagacaagc

SEQ ID NO: 562467 - DNA, 25 bp, Rattus norvegicus
actcgcccgtgtctgcaagcacgtg

SEQ ID NO: 562468 - DNA, 25 bp, Rattus norvegicus
gcgggcacgcgaagttaaaattcga

SEQ ID NO: 562469 - DNA, 25 bp, Rattus norvegicus
gccaatcgcttggtgccctttgttg

SEQ ID NO: 562470 - DNA, 25 bp, Rattus norvegicus
ccctagcccgcagctaaagtttgtg

SEQ ID NO: 562471 - DNA, 25 bp, Rattus norvegicus
ggttgtacacaacgccaatcaggag

SEQ ID NO: 562472 - DNA, 25 bp, Rattus norvegicus
ggcgcttggccttattggttgtaca

SEQ ID NO: 562473 - DNA, 25 bp, Rattus norvegicus
tctacctctagaaatggattggatc

SEQ ID NO: 562474 - DNA, 25 bp, Rattus norvegicus
ggcacctattggtccagcccttttc

SEQ ID NO: 562475 - DNA, 25 bp, Rattus norvegicus
tgccagtaccaatcaacagaccgcg

SEQ ID NO: 562476 - DNA, 25 bp, Rattus norvegicus
ggggcaagttcctgccggtcatctc

SEQ ID NO: 562477 - DNA, 25 bp, Rattus norvegicus
agccaaccgttggactaccggtctg

SEQ ID NO: 562478 - DNA, 25 bp, Rattus norvegicus
ccgttccattggacgagaccacgta

SEQ ID NO: 562479 - DNA, 25 bp, Rattus norvegicus
gcggaacgatctcgctgcagcctct

SEQ ID NO: 562480 - DNA, 25 bp, Rattus norvegicus
attcgaggttctcagtcgcctgctc

SEQ ID NO: 562481 - DNA, 25 bp, Rattus norvegicus
ttggacgcaggagaaggttgacctc

SEQ ID NO: 562482 - DNA, 25 bp, Rattus norvegicus
ggttgacctccctgcaagagctagg

SEQ ID NO: 562483 - DNA, 25 bp, Rattus norvegicus
taccgggaggctaagtccgcacaca

SEQ ID NO: 562484 - DNA, 25 bp, Rattus norvegicus
acttcactgtctcgcgcaggaaata

SEQ ID NO: 562485 - DNA, 25 bp, Rattus norvegicus
gtaccgcagttgacgtgagaccttg

SEQ ID NO: 562486 - DNA, 25 bp, Rattus norvegicus
gaggccgtggttatgactttctgta

SEQ ID NO: 562487 - DNA, 25 bp, Rattus norvegicus
ggaatggcctttctctcagaagagc

SEQ ID NO: 562488 - DNA, 25 bp, Rattus norvegicus
gggatctcaggctaaccacgctacc

SEQ ID NO: 562489 - DNA, 25 bp, Rattus norvegicus
tttcctagctgtggcggcatcaatc

SEQ ID NO: 562490 - DNA, 25 bp, Rattus norvegicus
catgccatcccgcagagtgggtttg

SEQ ID NO: 562491 - DNA, 25 bp, Rattus norvegicus
cgggcgtcctcagagctctgacttc

SEQ ID NO: 562492 - DNA, 25 bp, Rattus norvegicus
cgtctgtagcttctcgctcaaggca

SEQ ID NO: 562493 - DNA, 25 bp, Rattus norvegicus
ctctgcgctctaacaaagtctccga

SEQ ID NO: 562494 - DNA, 25 bp, Rattus norvegicus
gcgcaccgcgctaagattggacgca

SEQ ID NO: 562495 - DNA, 25 bp, Rattus norvegicus
ctgacgctaaaggaaacagggctgc

SEQ ID NO: 562496 - DNA, 25 bp, Rattus norvegicus
cccgagtcgagcgtcctgacgctaa

SEQ ID NO: 562497 - DNA, 25 bp, Rattus norvegicus
ttgtcctcgcgtaggagctccagct

SEQ ID NO: 562498 - DNA, 25 bp, Rattus norvegicus
ccgacatcaccgagccggagcagta

SEQ ID NO: 562499 - DNA, 25 bp, Rattus norvegicus
tcgtgctcctggttctcgctcagca

SEQ ID NO: 562500 - DNA, 25 bp, Rattus norvegicus
agcacgttcaccaccagcggcatga

SEQ ID NO: 562501 - DNA, 25 bp, Rattus norvegicus
gagtcaaggttctccagcacgttca

SEQ ID NO: 562502 - DNA, 25 bp, Rattus norvegicus
tcgctcagcaccgagtcaaggttct

SEQ ID NO: 562503 - DNA, 25 bp, Rattus norvegicus
ctcaggcagccaccaccttaggatg

SEQ ID NO: 562504 - DNA, 25 bp, Rattus norvegicus
agcagtgaatgaggcgctcgaactc

SEQ ID NO: 562505 - DNA, 25 bp, Rattus norvegicus
tgaccacctcctcatcatagcagtg

SEQ ID NO: 562506 - DNA, 25 bp, Rattus norvegicus
tctggatctccatcatcgcggctac

SEQ ID NO: 562507 - DNA, 25 bp, Rattus norvegicus
gccttctcgcgctcgtattgcgtga

SEQ ID NO: 562508 - DNA, 25 bp, Rattus norvegicus
ccggagcagtagtcatcttggtaca

SEQ ID NO: 562509 - DNA, 25 bp, Rattus norvegicus
ctatcgcaatgccaggaaacccgtt

SEQ ID NO: 562510 - DNA, 25 bp, Rattus norvegicus
ggtctgacttttgttattggtattg

SEQ ID NO: 562511 - DNA, 25 bp, Rattus norvegicus
gttattggtattgtccggtttcata

SEQ ID NO: 562512 - DNA, 25 bp, Rattus norvegicus
cataaagggaaactagccaaggctc

SEQ ID NO: 562513 - DNA, 25 bp, Rattus norvegicus
tagccaaggctcagaattctacagc

SEQ ID NO: 562514 - DNA, 25 bp, Rattus norvegicus
ctcagaattctacagcaccaagcga

SEQ ID NO: 562515 - DNA, 25 bp, Rattus norvegicus
gcaccaagcgaaaacaaagaaagtc

SEQ ID NO: 562516 - DNA, 25 bp, Rattus norvegicus
caacactttgcttttcacctgccta

SEQ ID NO: 562517 - DNA, 25 bp, Rattus norvegicus
taccctacgctcagcttcactcttg

SEQ ID NO: 562518 - DNA, 25 bp, Rattus norvegicus
cgtttcactaaatacgtcccatcta

SEQ ID NO: 562519 - DNA, 25 bp, Rattus norvegicus
tcactaaatacgtcccatctaccgg

SEQ ID NO: 562520 - DNA, 25 bp, Rattus norvegicus
tcccacaaaggactctagcactgtt

SEQ ID NO: 562521 - DNA, 25 bp, Rattus norvegicus
tagcactgttccactatcgcaatgc

SEQ ID NO: 562522 - DNA, 25 bp, Rattus norvegicus
ggactctagcactgttccactatcg

SEQ ID NO: 562523 - DNA, 25 bp, Rattus norvegicus
tcacaggcacgtggacttccgtttc

SEQ ID NO: 562524 - DNA, 25 bp, Rattus norvegicus
ccaggtagacaacaggtccgatttc

SEQ ID NO: 562525 - DNA, 25 bp, Rattus norvegicus
cccggtgtgtcccaggtagacaaca

SEQ ID NO: 562526 - DNA, 25 bp, Rattus norvegicus
tctgcaggcattcgctgcccttgtg

SEQ ID NO: 562527 - DNA, 25 bp, Rattus norvegicus
ctgtttctttcgctgtctgcaggca

SEQ ID NO: 562528 - DNA, 25 bp, Rattus norvegicus
atgcctcggacagcaagcacctgca

SEQ ID NO: 562529 - DNA, 25 bp, Rattus norvegicus
acatctctcggaggagcagcgacct

SEQ ID NO: 562530 - DNA, 25 bp, Rattus norvegicus
actgggtttccagagacatctctcg

SEQ ID NO: 562531 - DNA, 25 bp, Rattus norvegicus
ccagtcccgagtaagtgcatcttcc

SEQ ID NO: 562532 - DNA, 25 bp, Rattus norvegicus
ttctgcagatcgtgccgcagccttc

SEQ ID NO: 562533 - DNA, 25 bp, Rattus norvegicus
cgtttccggtgtgtcctgcagccat

SEQ ID NO: 562534 - DNA, 25 bp, Rattus norvegicus
tcttagcagcttgggctgagggtca

SEQ ID NO: 562535 - DNA, 25 bp, Rattus norvegicus
ttccacggaagatgctcttagcagc

SEQ ID NO: 562536 - DNA, 25 bp, Rattus norvegicus
caccgccagggcatcgagatttctg

SEQ ID NO: 562537 - DNA, 25 bp, Rattus norvegicus
gtgcattgtcacctctgttgtccag

SEQ ID NO: 562538 - DNA, 25 bp, Rattus norvegicus
acgctgtggtcacagcccgtcggca

SEQ ID NO: 562539 - DNA, 25 bp, Rattus norvegicus
gggcacatgcagcacgctgtggtca

SEQ ID NO: 562540 - DNA, 25 bp, Rattus norvegicus
cctctgttgtccagatgggcacatg

SEQ ID NO: 562541 - DNA, 25 bp, Rattus norvegicus
aacggcctcgccatgtgcattgtca

SEQ ID NO: 562542 - DNA, 25 bp, Rattus norvegicus
cctgttcttaaacggcctcgccatg

SEQ ID NO: 562543 - DNA, 25 bp, Rattus norvegicus
cccgaatcacgcagcctgttcttaa

SEQ ID NO: 562544 - DNA, 25 bp, Rattus norvegicus
gcaggtagaggagatacggccatct

SEQ ID NO: 562545 - DNA, 25 bp, Rattus norvegicus
acggccatctgagtgagtgtagcaa

SEQ ID NO: 562546 - DNA, 25 bp, Rattus norvegicus
gagtgtagcaagagcccgcagccca

SEQ ID NO: 562547 - DNA, 25 bp, Rattus norvegicus
acagcccgtcggcacggcaggtaga

SEQ ID NO: 562548 - DNA, 25 bp, Rattus norvegicus
ctctcacgccgcagggatttatatc

SEQ ID NO: 562549 - DNA, 25 bp, Rattus norvegicus
agggatttatatcgctgtgcccgcg

SEQ ID NO: 562550 - DNA, 25 bp, Rattus norvegicus
tccagatgggcacatgcagcacgct

SEQ ID NO: 562551 - DNA, 25 bp, Rattus norvegicus
ccacagctcagaccgggtttcgggg

SEQ ID NO: 562552 - DNA, 25 bp, Rattus norvegicus
tcgagggcgcaggaattccgaacaa

SEQ ID NO: 562553 - DNA, 25 bp, Rattus norvegicus
gtgctggtacctcctcagccgagtc

SEQ ID NO: 562554 - DNA, 25 bp, Rattus norvegicus
aagcagagagctaggtcaaggaaga

SEQ ID NO: 562555 - DNA, 25 bp, Rattus norvegicus
tacgcccgcccggaagcagagagct

SEQ ID NO: 562556 - DNA, 25 bp, Rattus norvegicus
aaggtgcccacgtcccacgatttca

SEQ ID NO: 562557 - DNA, 25 bp, Rattus norvegicus
gccaccttcacttgcctttgactta

SEQ ID NO: 562558 - DNA, 25 bp, Rattus norvegicus
caggaattccgaacaattggggtgc

SEQ ID NO: 562559 - DNA, 25 bp, Rattus norvegicus
aggctcatttttggctctcttccta

SEQ ID NO: 562560 - DNA, 25 bp, Rattus norvegicus
cctactgtgacctggctctgccagg

SEQ ID NO: 562561 - DNA, 25 bp, Rattus norvegicus
cacagaggtgatgcttgtaggctcc

SEQ ID NO: 562562 - DNA, 25 bp, Rattus norvegicus
cttaggtccgccctagttcaggctc

SEQ ID NO: 562563 - DNA, 25 bp, Rattus norvegicus
ttgcctttgacttaggtccgcccta

SEQ ID NO: 562564 - DNA, 25 bp, Rattus norvegicus
cccagattgagtggcagcgacggat

SEQ ID NO: 562565 - DNA, 25 bp, Rattus norvegicus
aagagtgggacacctcccgacgccg

SEQ ID NO: 562566 - DNA, 25 bp, Rattus norvegicus
ctccagtggtcttacgagcccggta

SEQ ID NO: 562567 - DNA, 25 bp, Rattus norvegicus
ttacgagcccggtactgtgcagagt

SEQ ID NO: 562568 - DNA, 25 bp, Rattus norvegicus
aggcctcagcatctatggggcttcc

SEQ ID NO: 562569 - DNA, 25 bp, Rattus norvegicus
tcacaggcagcgtcacttccaacag

SEQ ID NO: 562570 - DNA, 25 bp, Rattus norvegicus
gtcacttccaacagctcgacgaatt

SEQ ID NO: 562571 - DNA, 25 bp, Rattus norvegicus
cgacgaattcaccttctggaccttc

SEQ ID NO: 562572 - DNA, 25 bp, Rattus norvegicus
ctggaccttctgcaggatcattgtg

SEQ ID NO: 562573 - DNA, 25 bp, Rattus norvegicus
tacctcctcagggagtggagagcta

SEQ ID NO: 562574 - DNA, 25 bp, Rattus norvegicus
cagagcgaagaagacgcgggaaacc

SEQ ID NO: 562575 - DNA, 25 bp, Rattus norvegicus
tcctgcagctagacccggcgagact

SEQ ID NO: 562576 - DNA, 25 bp, Rattus norvegicus
tgtgcccgcctagagctgctcggcg

SEQ ID NO: 562577 - DNA, 25 bp, Rattus norvegicus
agccatggtgagtcccgcgaatcac

SEQ ID NO: 562578 - DNA, 25 bp, Rattus norvegicus
cgcagcgcgagctgtcctgcagcta

SEQ ID NO: 562579 - DNA, 25 bp, Rattus norvegicus
ccgcaatgtgggcactggaaggctt

SEQ ID NO: 562580 - DNA, 25 bp, Rattus norvegicus
ccgaggtgcgaaacttgcctttgca

SEQ ID NO: 562581 - DNA, 25 bp, Rattus norvegicus
ctttgcagaaaggacaacggaaggc

SEQ ID NO: 562582 - DNA, 25 bp, Rattus norvegicus
ctgagcttctggctctcccgagtcg

SEQ ID NO: 562583 - DNA, 25 bp, Rattus norvegicus
tcccgagtcgggcttcacgaagcag

SEQ ID NO: 562584 - DNA, 25 bp, Rattus norvegicus
gaagcagggcgcgttcctccaactc

SEQ ID NO: 562585 - DNA, 25 bp, Rattus norvegicus
ccgctgacacctggtccgttggagt

SEQ ID NO: 562586 - DNA, 25 bp, Rattus norvegicus
cagcaacagccgtgcagcaggactg

SEQ ID NO: 562587 - DNA, 25 bp, Rattus norvegicus
ggctctcaggtgcaatgccaggata

SEQ ID NO: 562588 - DNA, 25 bp, Rattus norvegicus
tcggaagcgctttccgcacacagga

SEQ ID NO: 562589 - DNA, 25 bp, Rattus norvegicus
ccgcacacaggacaggggaagcgcc

SEQ ID NO: 562590 - DNA, 25 bp, Rattus norvegicus
ggaagcgccgttcgcctgcacgagt

SEQ ID NO: 562591 - DNA, 25 bp, Rattus norvegicus
tccgttggagtagcgctgaagatcc

SEQ ID NO: 562592 - DNA, 25 bp, Rattus norvegicus
tgaagatccagctcgccgtcgaagg

SEQ ID NO: 562593 - DNA, 25 bp, Rattus norvegicus
catctgctgagtgacgccaggcgct

SEQ ID NO: 562594 - DNA, 25 bp, Rattus norvegicus
ttcccgcctctagtgagcacgctgg

SEQ ID NO: 562595 - DNA, 25 bp, Rattus norvegicus
ttgcctgcagcttcgggtactggca

SEQ ID NO: 562596 - DNA, 25 bp, Rattus norvegicus
tgagcacgctggtggacccagcccg

SEQ ID NO: 562597 - DNA, 25 bp, Rattus norvegicus
gcagcttcgggtactggcaaaggct

SEQ ID NO: 562598 - DNA, 25 bp, Rattus norvegicus
cgctgtgcatctgctgagtgacgcc

SEQ ID NO: 562599 - DNA, 25 bp, Rattus norvegicus
ggagcagggcctagccgagtttccc

SEQ ID NO: 562600 - DNA, 25 bp, Rattus norvegicus
tttgatccctgcagcggtaatggtc

SEQ ID NO: 562601 - DNA, 25 bp, Rattus norvegicus
cctcgcgcgagtgcccaggttcaga

SEQ ID NO: 562602 - DNA, 25 bp, Rattus norvegicus
cgagtgcccaggttcagagtcctga

SEQ ID NO: 562603 - DNA, 25 bp, Rattus norvegicus
cagagtcctgagacttggagcgcgc

SEQ ID NO: 562604 - DNA, 25 bp, Rattus norvegicus
acctaagactttcccgcctctagtg

SEQ ID NO: 562605 - DNA, 25 bp, Rattus norvegicus
cacccttcccaaggcgggagcagga

SEQ ID NO: 562606 - DNA, 25 bp, Rattus norvegicus
gggtctctagccctcttgcctgcag

SEQ ID NO: 562607 - DNA, 25 bp, Rattus norvegicus
ttggctgtgacttttctcgctcccg

SEQ ID NO: 562608 - DNA, 25 bp, Rattus norvegicus
aggtccggccagatcaccgcatttc

SEQ ID NO: 562609 - DNA, 25 bp, Rattus norvegicus
ttccgtccaatcatcacacgaggtg

SEQ ID NO: 562610 - DNA, 25 bp, Rattus norvegicus
cgtgtcgtcctatcagtgcttccta

SEQ ID NO: 562611 - DNA, 25 bp, Rattus norvegicus
gcgcacagcttctcatccgggtatc

SEQ ID NO: 562612 - DNA, 25 bp, Rattus norvegicus
ttttcgcctttgtatcgcgcacagc

SEQ ID NO: 562613 - DNA, 25 bp, Rattus norvegicus
acggatggttattggtcactgtacc

SEQ ID NO: 562614 - DNA, 25 bp, Rattus norvegicus
gggagaatttccacatgcgtaacaa

SEQ ID NO: 562615 - DNA, 25 bp, Rattus norvegicus
tcgctctccgtctcttcacaaaatg

SEQ ID NO: 562616 - DNA, 25 bp, Rattus norvegicus
agagcctgcctctcctactgcgggt

SEQ ID NO: 562617 - DNA, 25 bp, Rattus norvegicus
gaggcctgttgcctcccgccttaga

SEQ ID NO: 562618 - DNA, 25 bp, Rattus norvegicus
attttcgtacgcaccgtggcctaga

SEQ ID NO: 562619 - DNA, 25 bp, Rattus norvegicus
accagcgcgcaaagagggtattttc

SEQ ID NO: 562620 - DNA, 25 bp, Rattus norvegicus
ctcgctcccgctcctaattagatag

SEQ ID NO: 562621 - DNA, 25 bp, Rattus norvegicus
ccgggtccctatagcgtcgaagatt

SEQ ID NO: 562622 - DNA, 25 bp, Rattus norvegicus
attcttatgagagcccgcaggtttc

SEQ ID NO: 562623 - DNA, 25 bp, Rattus norvegicus
gggtctattacccacgcagggccta

SEQ ID NO: 562624 - DNA, 25 bp, Rattus norvegicus
gcgcgggagcagcatttctcaactc

SEQ ID NO: 562625 - DNA, 25 bp, Rattus norvegicus
caaacggtaattctggcgggacctg

SEQ ID NO: 562626 - DNA, 25 bp, Rattus norvegicus
acagtctcttaactcgccggtagta

SEQ ID NO: 562627 - DNA, 25 bp, Rattus norvegicus
ccggtagtacgcgtctttgtccaga

SEQ ID NO: 562628 - DNA, 25 bp, Rattus norvegicus
ttgtccagagtcacagccatagccc

SEQ ID NO: 562629 - DNA, 25 bp, Rattus norvegicus
cacttttcgagctcggggcgctcta

SEQ ID NO: 562630 - DNA, 25 bp, Rattus norvegicus
ccgcactctctgtgacccggaagta

SEQ ID NO: 562631 - DNA, 25 bp, Rattus norvegicus
acccagctcgctctgtagggtagta

SEQ ID NO: 562632 - DNA, 25 bp, Rattus norvegicus
aaccaggtctgaggcgtcctatcaa

SEQ ID NO: 562633 - DNA, 25 bp, Rattus norvegicus
tgatgccgacatgggaaaccaggtc

SEQ ID NO: 562634 - DNA, 25 bp, Rattus norvegicus
cgagaatcacgcgaggtcccagctc

SEQ ID NO: 562635 - DNA, 25 bp, Rattus norvegicus
cgccctccggactctggagaaaacg

SEQ ID NO: 562636 - DNA, 25 bp, Rattus norvegicus
agcgccctccggactctggagaaaa

SEQ ID NO: 562637 - DNA, 25 bp, Rattus norvegicus
cccacatgccttgcagcgccctccg

SEQ ID NO: 562638 - DNA, 25 bp, Rattus norvegicus
tactcgaaagctgcccacatgcctt

SEQ ID NO: 562639 - DNA, 25 bp, Rattus norvegicus
aggctactcgaaagctgcccacatg

SEQ ID NO: 562640 - DNA, 25 bp, Rattus norvegicus
tcgtctccaaccagcgctgtaaaga

SEQ ID NO: 562641 - DNA, 25 bp, Rattus norvegicus
tccaaccagcgctgtaaagaaagct

SEQ ID NO: 562642 - DNA, 25 bp, Rattus norvegicus
gtaaagaaagctgatggcgaagttc

SEQ ID NO: 562643 - DNA, 25 bp, Rattus norvegicus
gatggcgaagttcggttttccaggc

SEQ ID NO: 562644 - DNA, 25 bp, Rattus norvegicus
ccggagttcctgaggcccatacgag

SEQ ID NO: 562645 - DNA, 25 bp, Rattus norvegicus
tcctgaggcccatacgagggaggcc

SEQ ID NO: 562646 - DNA, 25 bp, Rattus norvegicus
tcctctggccgcctaggcaaggcta

SEQ ID NO: 562647 - DNA, 25 bp, Rattus norvegicus
gccgcctaggcaaggctactcgaaa

SEQ ID NO: 562648 - DNA, 25 bp, Rattus norvegicus
ctaggcaaggctactcgaaagctgc

SEQ ID NO: 562649 - DNA, 25 bp, Rattus norvegicus
gcaagcgcttcaggagagccacgtg

SEQ ID NO: 562650 - DNA, 25 bp, Rattus norvegicus
caaacagctcggcagcgccgggcta

SEQ ID NO: 562651 - DNA, 25 bp, Rattus norvegicus
tgcgaatccacagttcctcggccga

SEQ ID NO: 562652 - DNA, 25 bp, Rattus norvegicus
ggctagcgtctctcctgagcaagcg

SEQ ID NO: 562653 - DNA, 25 bp, Rattus norvegicus
ggagagccacgtgtcctaatcccgc

SEQ ID NO: 562654 - DNA, 25 bp, Rattus norvegicus
gagcgcgctcagtaccctcagggga

SEQ ID NO: 562655 - DNA, 25 bp, Rattus norvegicus
agcccgacttgctagcttggccgtc

SEQ ID NO: 562656 - DNA, 25 bp, Rattus norvegicus
ctgacccgcccaagccagttggata

SEQ ID NO: 562657 - DNA, 25 bp, Rattus norvegicus
gcgccaatcaagaacctgcagccta

SEQ ID NO: 562658 - DNA, 25 bp, Rattus norvegicus
gaacctgcagcctatcgtggagtca

SEQ ID NO: 562659 - DNA, 25 bp, Rattus norvegicus
gccggcatcgcgcttacagctgact

SEQ ID NO: 562660 - DNA, 25 bp, Rattus norvegicus
gtcgcctctcatggctccagacgtg

SEQ ID NO: 562661 - DNA, 25 bp, Rattus norvegicus
ggctccagacgtggccattggttca

SEQ ID NO: 562662 - DNA, 25 bp, Rattus norvegicus
gccagttggataactcccgcgccaa

SEQ ID NO: 562663 - DNA, 25 bp, Rattus norvegicus
ctgattggaaataggaaccggcggc

SEQ ID NO: 562664 - DNA, 25 bp, Rattus norvegicus
ccgcagatatgcctgattggaaata

SEQ ID NO: 562665 - DNA, 25 bp, Rattus norvegicus
gggtacgtaggcaaccgcagatatg

SEQ ID NO: 562666 - DNA, 25 bp, Rattus norvegicus
gggcgccatccaggaagtctcagaa

SEQ ID NO: 562667 - DNA, 25 bp, Rattus norvegicus
gcttgctagtcctccatgctcctgg

SEQ ID NO: 562668 - DNA, 25 bp, Rattus norvegicus
aacaaggcgccttccggcggagcac

SEQ ID NO: 562669 - DNA, 25 bp, Rattus norvegicus
caccgtccgggagaacaaggcgcct

SEQ ID NO: 562670 - DNA, 25 bp, Rattus norvegicus
gcaagagttgcaacccaccgtccgg

SEQ ID NO: 562671 - DNA, 25 bp, Rattus norvegicus
ttacctgagccagtcctgcagcttc

SEQ ID NO: 562672 - DNA, 25 bp, Rattus norvegicus
cgcccagtatccgacgaggcttggt

SEQ ID NO: 562673 - DNA, 25 bp, Rattus norvegicus
tcactcagaactgcacccgcatggg

SEQ ID NO: 562674 - DNA, 25 bp, Rattus norvegicus
tctcacaaagagagtggttcagccc

SEQ ID NO: 562675 - DNA, 25 bp, Rattus norvegicus
tgacaagctccgaaactccacgctg

SEQ ID NO: 562676 - DNA, 25 bp, Rattus norvegicus
tcgcccagcggtgcaatgacaagct

SEQ ID NO: 562677 - DNA, 25 bp, Rattus norvegicus
caccctttcctgtcaggggccgagg

SEQ ID NO: 562678 - DNA, 25 bp, Rattus norvegicus
gccgctcaatctacggatctcctta

SEQ ID NO: 562679 - DNA, 25 bp, Rattus norvegicus
gggttacctgtgtctccgatgatga

SEQ ID NO: 562680 - DNA, 25 bp, Rattus norvegicus
ccgaggtgagcaaaagctgctgatg

SEQ ID NO: 562681 - DNA, 25 bp, Rattus norvegicus
ttacctgacgatcactgggccctcg

SEQ ID NO: 562682 - DNA, 25 bp, Rattus norvegicus
tcccggaggaaatgacaattacctg

SEQ ID NO: 562683 - DNA, 25 bp, Rattus norvegicus
gaggaagtgacgctctcggaactta

SEQ ID NO: 562684 - DNA, 25 bp, Rattus norvegicus
gagcgacgctactccttgaggaagt

SEQ ID NO: 562685 - DNA, 25 bp, Rattus norvegicus
tgcgtcccttgactcggtccaatca

SEQ ID NO: 562686 - DNA, 25 bp, Rattus norvegicus
ctagctcaagctgcgtctctattgc

SEQ ID NO: 562687 - DNA, 25 bp, Rattus norvegicus
cgaatccaggacaccgcctctaggg

SEQ ID NO: 562688 - DNA, 25 bp, Rattus norvegicus
taagcgtaagtcatggtcccgaggt

SEQ ID NO: 562689 - DNA, 25 bp, Rattus norvegicus
atcttcgccggatcccgaatccagg

SEQ ID NO: 562690 - DNA, 25 bp, Rattus norvegicus
gtgtccgaggcttcgagcacctcta

SEQ ID NO: 562691 - DNA, 25 bp, Rattus norvegicus
ggacgtaatcctcaccgcagttctg

SEQ ID NO: 562692 - DNA, 25 bp, Rattus norvegicus
cccagcctagaacgaagatacatct

SEQ ID NO: 562693 - DNA, 25 bp, Rattus norvegicus
atctaattctcacgcggacgcccga

SEQ ID NO: 562694 - DNA, 25 bp, Rattus norvegicus
gcccgaaaggccagccggataaaga

SEQ ID NO: 562695 - DNA, 25 bp, Rattus norvegicus
gagccaagatgaaaagccacttccg

SEQ ID NO: 562696 - DNA, 25 bp, Rattus norvegicus
ggcgaaccagcggacgtaatcctca

SEQ ID NO: 562697 - DNA, 25 bp, Rattus norvegicus
gttcctagcgcggactagcacatcc

SEQ ID NO: 562698 - DNA, 25 bp, Rattus norvegicus
ccgcagttctgtctcgtgcttccgg

SEQ ID NO: 562699 - DNA, 25 bp, Rattus norvegicus
ctcgcgaagcgagtccagttgtttc

SEQ ID NO: 562700 - DNA, 25 bp, Rattus norvegicus
aagccacttccggttggcgaaccag

SEQ ID NO: 562701 - DNA, 25 bp, Rattus norvegicus
cctggatagagctccacgtgtccga

SEQ ID NO: 562702 - DNA, 25 bp, Rattus norvegicus
cagttgtttcttatgggcctggata

SEQ ID NO: 562703 - DNA, 25 bp, Rattus norvegicus
gccgctgcagtctctcgcgaagcga

SEQ ID NO: 562704 - DNA, 25 bp, Rattus norvegicus
cgtgtccgacatcctagttcctagc

SEQ ID NO: 562705 - DNA, 25 bp, Rattus norvegicus
gttaggacacaatgggtatccggtc

SEQ ID NO: 562706 - DNA, 25 bp, Rattus norvegicus
caagcctggccctaccgcacctccg

SEQ ID NO: 562707 - DNA, 25 bp, Rattus norvegicus
gccctaccgcacctccgcgctccgc

SEQ ID NO: 562708 - DNA, 25 bp, Rattus norvegicus
tcgagagccgttcccggtttcctgc

SEQ ID NO: 562709 - DNA, 25 bp, Rattus norvegicus
agccgttcccggtttcctgcgccat

SEQ ID NO: 562710 - DNA, 25 bp, Rattus norvegicus
tcccggtttcctgcgccatggccgt

SEQ ID NO: 562711 - DNA, 25 bp, Rattus norvegicus
cgccatggccgtgggaagtggaagg

SEQ ID NO: 562712 - DNA, 25 bp, Rattus norvegicus
tgggttaggacacaatgggtatccg

SEQ ID NO: 562713 - DNA, 25 bp, Rattus norvegicus
ttaggacacaatgggtatccggtct

SEQ ID NO: 562714 - DNA, 25 bp, Rattus norvegicus
aggacacaatgggtatccggtctgg

SEQ ID NO: 562715 - DNA, 25 bp, Rattus norvegicus
acacaatgggtatccggtctgggga

SEQ ID NO: 562716 - DNA, 25 bp, Rattus norvegicus
gcgctgcggcagtctctgcacccag

SEQ ID NO: 562717 - DNA, 25 bp, Rattus norvegicus
tctctgcacccagcggcccagactg

SEQ ID NO: 562718 - DNA, 25 bp, Rattus norvegicus
gatgggttaggacacaatgggtatc

SEQ ID NO: 562719 - DNA, 25 bp, Rattus norvegicus
gaacttcggataccggacgaacaca

SEQ ID NO: 562720 - DNA, 25 bp, Rattus norvegicus
cgccgacatgacgaacccgggaact

SEQ ID NO: 562721 - DNA, 25 bp, Rattus norvegicus
cgaacacagggtatgtggctcgcgc

SEQ ID NO: 562722 - DNA, 25 bp, Rattus norvegicus
aaccttggcgcctcacaattaatgc

SEQ ID NO: 562723 - DNA, 25 bp, Rattus norvegicus
ttaatgcgcagacgcagactacatc

SEQ ID NO: 562724 - DNA, 25 bp, Rattus norvegicus
cccagactgaaaactacagccggaa

SEQ ID NO: 562725 - DNA, 25 bp, Rattus norvegicus
cggaaataaattaatgcgcctgcgc

SEQ ID NO: 562726 - DNA, 25 bp, Rattus norvegicus
ggagatgacggacaccacagacgcc

SEQ ID NO: 562727 - DNA, 25 bp, Rattus norvegicus
cctctctgaagacgtgtactacatt

SEQ ID NO: 562728 - DNA, 25 bp, Rattus norvegicus
actacattcttatttccgtcctgcg

SEQ ID NO: 562729 - DNA, 25 bp, Rattus norvegicus
gtcctgcgtttgttgacgcccactg

SEQ ID NO: 562730 - DNA, 25 bp, Rattus norvegicus
acgcccactgttgctctggcgacga

SEQ ID NO: 562731 - DNA, 25 bp, Rattus norvegicus
tgctctggcgacgagatttgtgacg

SEQ ID NO: 562732 - DNA, 25 bp, Rattus norvegicus
gcatggcctatctcctctctgaaga

SEQ ID NO: 562733 - DNA, 25 bp, Rattus norvegicus
tcaccgtgcgttgaagaatatctcc

SEQ ID NO: 562734 - DNA, 25 bp, Rattus norvegicus
atatctccgaactggacgctttgga

SEQ ID NO: 562735 - DNA, 25 bp, Rattus norvegicus
ggctttgctttccacagcgatttga

SEQ ID NO: 562736 - DNA, 25 bp, Rattus norvegicus
cgctgggaagcggttttcttatcac

SEQ ID NO: 562737 - DNA, 25 bp, Rattus norvegicus
tgatggcctctttatctcccgttaa

SEQ ID NO: 562738 - DNA, 25 bp, Rattus norvegicus
ctgggaagcagtcaatgatggcctc

SEQ ID NO: 562739 - DNA, 25 bp, Rattus norvegicus
gcccttgcagtcagaatcagaaatg

SEQ ID NO: 562740 - DNA, 25 bp, Rattus norvegicus
gatgatttagagtcgcctgcccttg

SEQ ID NO: 562741 - DNA, 25 bp, Rattus norvegicus
ctttgttgtcaagctgcgacggtgc

SEQ ID NO: 562742 - DNA, 25 bp, Rattus norvegicus
tgctgctgacaagctcgcctggagc

SEQ ID NO: 562743 - DNA, 25 bp, Rattus norvegicus
cgatttgaaatgagcgtcccgggca

SEQ ID NO: 562744 - DNA, 25 bp, Rattus norvegicus
gcggactgtcggatgttacgatatt

SEQ ID NO: 562745 - DNA, 25 bp, Rattus norvegicus
acatcttgtcttgaatacgtagccg

SEQ ID NO: 562746 - DNA, 25 bp, Rattus norvegicus
tttggagggcgatgacaaacacatc

SEQ ID NO: 562747 - DNA, 25 bp, Rattus norvegicus
gggtccctgaaaccgctggcaacca

SEQ ID NO: 562748 - DNA, 25 bp, Rattus norvegicus
gccttgcccttgtcacttgagctga

SEQ ID NO: 562749 - DNA, 25 bp, Rattus norvegicus
acgagcagatgctgacccggccact

SEQ ID NO: 562750 - DNA, 25 bp, Rattus norvegicus
actgggacctgcgtgtcatgacctc

SEQ ID NO: 562751 - DNA, 25 bp, Rattus norvegicus
tagctgtctgggaactgctttcgac

SEQ ID NO: 562752 - DNA, 25 bp, Rattus norvegicus
tgctttcgaccctgagccgtgacct

SEQ ID NO: 562753 - DNA, 25 bp, Rattus norvegicus
ttccgtaacaggatgcgggagacca

SEQ ID NO: 562754 - DNA, 25 bp, Rattus norvegicus
tcccggcaagatggcgatgggttca

SEQ ID NO: 562755 - DNA, 25 bp, Rattus norvegicus
gcacgctccagtgcatgccttcggg

SEQ ID NO: 562756 - DNA, 25 bp, Rattus norvegicus
ttcactcggtcagttccacagcgtc

SEQ ID NO: 562757 - DNA, 25 bp, Rattus norvegicus
tcgctggcagcttctgcgactccta

SEQ ID NO: 562758 - DNA, 25 bp, Rattus norvegicus
gcatgcgcgagagtaagttctcttc

SEQ ID NO: 562759 - DNA, 25 bp, Rattus norvegicus
ttcggtaaggttccgtccatggtgc

SEQ ID NO: 562760 - DNA, 25 bp, Rattus norvegicus
gcctgaagtcagtgcgagcagagtt

SEQ ID NO: 562761 - DNA, 25 bp, Rattus norvegicus
ggacccgcgattgaaaaccacattc

SEQ ID NO: 562762 - DNA, 25 bp, Rattus norvegicus
tgtccggaggttgcacagtagtgca

SEQ ID NO: 562763 - DNA, 25 bp, Rattus norvegicus
agccagtggcgactccagtgagtgc

SEQ ID NO: 562764 - DNA, 25 bp, Rattus norvegicus
ggggcaacagacctctaactcgcta

SEQ ID NO: 562765 - DNA, 25 bp, Rattus norvegicus
ctggctatccagtgagtgattgtga

SEQ ID NO: 562766 - DNA, 25 bp, Rattus norvegicus
gccttagggacctggctatccagtg

SEQ ID NO: 562767 - DNA, 25 bp, Rattus norvegicus
tcaagatgtcggcttccggttttcc

SEQ ID NO: 562768 - DNA, 25 bp, Rattus norvegicus
ttccgtacgatgacccaagatggtg

SEQ ID NO: 562769 - DNA, 25 bp, Rattus norvegicus
ggcagcgaactctcacttccgtacg

SEQ ID NO: 562770 - DNA, 25 bp, Rattus norvegicus
tgttcagaacatacagccggcagcg

SEQ ID NO: 562771 - DNA, 25 bp, Rattus norvegicus
gcgggacagttcctcctgttcagaa

SEQ ID NO: 562772 - DNA, 25 bp, Rattus norvegicus
cacctcggaggttgtaagatgcacg

SEQ ID NO: 562773 - DNA, 25 bp, Rattus norvegicus
tactcttccagtaggtgtccggagg

SEQ ID NO: 562774 - DNA, 25 bp, Rattus norvegicus
cacttccggtttctttgctccagca

SEQ ID NO: 562775 - DNA, 25 bp, Rattus norvegicus
agtcgatccaacttttgcccgcttc

SEQ ID NO: 562776 - DNA, 25 bp, Rattus norvegicus
cggctgggcccaaagcagcaacttc

SEQ ID NO: 562777 - DNA, 25 bp, Rattus norvegicus
gatcgtagcccaccgcggtcctgaa

SEQ ID NO: 562778 - DNA, 25 bp, Rattus norvegicus
tcctcaactcttccgtgatcgtagc

SEQ ID NO: 562779 - DNA, 25 bp, Rattus norvegicus
gaagtaagtgagctcctccggccct

SEQ ID NO: 562780 - DNA, 25 bp, Rattus norvegicus
ctgaaagaactctgcagtggggccc

SEQ ID NO: 562781 - DNA, 25 bp, Rattus norvegicus
tttcccaagctctgcgcgcgatgtg

SEQ ID NO: 562782 - DNA, 25 bp, Rattus norvegicus
caccaggcgggagcctcagaaactc

SEQ ID NO: 562783 - DNA, 25 bp, Rattus norvegicus
ggtgtcacacgcgagttgttccttc

SEQ ID NO: 562784 - DNA, 25 bp, Rattus norvegicus
tgttccttcagtttggcagcgctca

SEQ ID NO: 562785 - DNA, 25 bp, Rattus norvegicus
ctgcacgggcgcatctgtaccaagt

SEQ ID NO: 562786 - DNA, 25 bp, Rattus norvegicus
ttctgcattgatcgcccagagacta

SEQ ID NO: 562787 - DNA, 25 bp, Rattus norvegicus
atcgctggacgagtaaattgagggc

SEQ ID NO: 562788 - DNA, 25 bp, Rattus norvegicus
agtgtcccaactgactttggcgttc

SEQ ID NO: 562789 - DNA, 25 bp, Rattus norvegicus
tcctgccaggtagtcgagcggcgcc

SEQ ID NO: 562790 - DNA, 25 bp, Rattus norvegicus
gtcccactcacaaccagggaaggcg

SEQ ID NO: 562791 - DNA, 25 bp, Rattus norvegicus
ggctccgggacggacagtccacaaa

SEQ ID NO: 562792 - DNA, 25 bp, Rattus norvegicus
tttcggcgaggtcacgcacctcctt

SEQ ID NO: 562793 - DNA, 25 bp, Rattus norvegicus
tcacaaccagggaaggcgacctttc

SEQ ID NO: 562794 - DNA, 25 bp, Rattus norvegicus
tgtggggctgtcctacactgcccgt

SEQ ID NO: 562795 - DNA, 25 bp, Rattus norvegicus
ttcgacccaggatgctatcggccct

SEQ ID NO: 562796 - DNA, 25 bp, Rattus norvegicus
tctgaagttggcaagaggcgtcacc

SEQ ID NO: 562797 - DNA, 25 bp, Rattus norvegicus
gcggagcttcctgccaggtagtcga

SEQ ID NO: 562798 - DNA, 25 bp, Rattus norvegicus
taaggagcgatcaactctgaagttg

SEQ ID NO: 562799 - DNA, 25 bp, Rattus norvegicus
ggcaccggtaaggagcgatcaactc

SEQ ID NO: 562800 - DNA, 25 bp, Rattus norvegicus
tccacaaagtttggtccgcggagga

SEQ ID NO: 562801 - DNA, 25 bp, Rattus norvegicus
gacggacagtccacaaagtttggtc

SEQ ID NO: 562802 - DNA, 25 bp, Rattus norvegicus
aaggcgacctttcggcgaggtcacg

SEQ ID NO: 562803 - DNA, 25 bp, Rattus norvegicus
tcactgtcatcctgcggcgagagag

SEQ ID NO: 562804 - DNA, 25 bp, Rattus norvegicus
aagacgcgcgcgatcgtgccgcgca

SEQ ID NO: 562805 - DNA, 25 bp, Rattus norvegicus
cctctggtgccaagacgcgcgcgat

SEQ ID NO: 562806 - DNA, 25 bp, Rattus norvegicus
tgagctttgggtctcactgtcccgc

SEQ ID NO: 562807 - DNA, 25 bp, Rattus norvegicus
ggcctctgagctttgggtctcactg

SEQ ID NO: 562808 - DNA, 25 bp, Rattus norvegicus
gcagcatgacctggcctctgagctt

SEQ ID NO: 562809 - DNA, 25 bp, Rattus norvegicus
aggtagaccaacacggcccggagct

SEQ ID NO: 562810 - DNA, 25 bp, Rattus norvegicus
gatcgtgccgcgcacctgcctattg

SEQ ID NO: 562811 - DNA, 25 bp, Rattus norvegicus
cgtccctctttgtgctgctgctgtc

SEQ ID NO: 562812 - DNA, 25 bp, Rattus norvegicus
aacatggcggccgttgtttgttcca

SEQ ID NO: 562813 - DNA, 25 bp, Rattus norvegicus
caacttcactgtcatcctgcggcga

SEQ ID NO: 562814 - DNA, 25 bp, Rattus norvegicus
ctgcggaaggcacggcagcatgacc

SEQ ID NO: 562815 - DNA, 25 bp, Rattus norvegicus
ggccgttgtttgttccagcgccgcc

SEQ ID NO: 562816 - DNA, 25 bp, Rattus norvegicus
ggcacagtgctgagcccgaccggac

SEQ ID NO: 562817 - DNA, 25 bp, Rattus norvegicus
cggacagcagctaaggcggtcagca

SEQ ID NO: 562818 - DNA, 25 bp, Rattus norvegicus
gtcagcagctaaggcggccagcagc

SEQ ID NO: 562819 - DNA, 25 bp, Rattus norvegicus
gcagctaaggccgacagcagctaag

SEQ ID NO: 562820 - DNA, 25 bp, Rattus norvegicus
gacagcagctaaggcggtcagcagc

SEQ ID NO: 562821 - DNA, 25 bp, Rattus norvegicus
cggccagcagctaaggcggacagca

SEQ ID NO: 562822 - DNA, 25 bp, Rattus norvegicus
gtcagcagctaaggcggtcagcagc

SEQ ID NO: 562823 - DNA, 25 bp, Rattus norvegicus
cggtcagcagctaaggcggccagca

SEQ ID NO: 562824 - DNA, 25 bp, Rattus norvegicus
cggccagcagctaaggcggccagca

SEQ ID NO: 562825 - DNA, 25 bp, Rattus norvegicus
cggtcagcagctaaggcggacagca

SEQ ID NO: 562826 - DNA, 25 bp, Rattus norvegicus
gtcagcagctaaggcggacagcagc

SEQ ID NO: 562827 - DNA, 25 bp, Rattus norvegicus
gacagcagctaaggccgacagcagc

SEQ ID NO: 562828 - DNA, 25 bp, Rattus norvegicus
ccgacagcagctaaggccgacagca

SEQ ID NO: 562829 - DNA, 25 bp, Rattus norvegicus
ccgacagcagctaaggcggccagca

SEQ ID NO: 562830 - DNA, 25 bp, Rattus norvegicus
cggtcagcagctaaggcggtcagca

SEQ ID NO: 562831 - DNA, 25 bp, Rattus norvegicus
gagtgggactgctcctacgccctgc

SEQ ID NO: 562832 - DNA, 25 bp, Rattus norvegicus
accgctgcaactaccagacgttctg

SEQ ID NO: 562833 - DNA, 25 bp, Rattus norvegicus
gcaactaccagacgttctgcgctga

SEQ ID NO: 562834 - DNA, 25 bp, Rattus norvegicus
accagacgttctgcgctgacggagc

SEQ ID NO: 562835 - DNA, 25 bp, Rattus norvegicus
acgagaggcgctgtcggcattgcca

SEQ ID NO: 562836 - DNA, 25 bp, Rattus norvegicus
gctgtcggcattgccagcctggcaa

SEQ ID NO: 562837 - DNA, 25 bp, Rattus norvegicus
ttgccagcctggcaacttccggtgc

SEQ ID NO: 562838 - DNA, 25 bp, Rattus norvegicus
aaagtgatcacagcagcggtcatcg

SEQ ID NO: 562839 - DNA, 25 bp, Rattus norvegicus
atgagaagtgtgtgtatgagacgtg

SEQ ID NO: 562840 - DNA, 25 bp, Rattus norvegicus
gcagccggactgcactgacggcagt

SEQ ID NO: 562841 - DNA, 25 bp, Rattus norvegicus
cggactgcactgacggcagtgacga

SEQ ID NO: 562842 - DNA, 25 bp, Rattus norvegicus
ccacggcctgctacctgcctgccga

SEQ ID NO: 562843 - DNA, 25 bp, Rattus norvegicus
gcagtgacgagtgggactgctccta

SEQ ID NO: 562844 - DNA, 25 bp, Rattus norvegicus
gcaacttccggtgccgggatgagaa

SEQ ID NO: 562845 - DNA, 25 bp, Rattus norvegicus
gccgcgcaacgccaagttcttcaag

SEQ ID NO: 562846 - DNA, 25 bp, Rattus norvegicus
cactcgtgagctcttcgagggcgct

SEQ ID NO: 562847 - DNA, 25 bp, Rattus norvegicus
agcggccggaacctagcagcccgga

SEQ ID NO: 562848 - DNA, 25 bp, Rattus norvegicus
tctctgtgctctgagccacggtcgc

SEQ ID NO: 562849 - DNA, 25 bp, Rattus norvegicus
accacaacactcgtgagctcttcga

SEQ ID NO: 562850 - DNA, 25 bp, Rattus norvegicus
gtcgtgtcacgacctctctgtgctc

SEQ ID NO: 562851 - DNA, 25 bp, Rattus norvegicus
agttcttcaagcaacgctccaggtc

SEQ ID NO: 562852 - DNA, 25 bp, Rattus norvegicus
taagcgcttcctcgccaacctggtg

SEQ ID NO: 562853 - DNA, 25 bp, Rattus norvegicus
cctcaccaagaaagctaagcgcttc

SEQ ID NO: 562854 - DNA, 25 bp, Rattus norvegicus
ggacgctgagctgcaagcacataga

SEQ ID NO: 562855 - DNA, 25 bp, Rattus norvegicus
cgcgagagcctcaccaagaaagcta

SEQ ID NO: 562856 - DNA, 25 bp, Rattus norvegicus
gcacatagagacatcagccgctctc

SEQ ID NO: 562857 - DNA, 25 bp, Rattus norvegicus
ccacggtcgccatggtcactgcagt

SEQ ID NO: 562858 - DNA, 25 bp, Rattus norvegicus
agcaacgctccaggtcgtgtcacga

SEQ ID NO: 562859 - DNA, 25 bp, Rattus norvegicus
tcacaaagcggagaacagtcccggg

SEQ ID NO: 562860 - DNA, 25 bp, Rattus norvegicus
ctggacacgcggctgccaccagcac

SEQ ID NO: 562861 - DNA, 25 bp, Rattus norvegicus
gcacctccgactgccatcgccgcca

SEQ ID NO: 562862 - DNA, 25 bp, Rattus norvegicus
gccatcttttccctcgcgcagccca

SEQ ID NO: 562863 - DNA, 25 bp, Rattus norvegicus
gcccacgccgggattccttgctatt

SEQ ID NO: 562864 - DNA, 25 bp, Rattus norvegicus
cgccgggattccttgctattagagg

SEQ ID NO: 562865 - DNA, 25 bp, Rattus norvegicus
tccttgctattagaggccaatcaca

SEQ ID NO: 562866 - DNA, 25 bp, Rattus norvegicus
aacaaccagagcgtctttacagccc

SEQ ID NO: 562867 - DNA, 25 bp, Rattus norvegicus
ggccaatcacaaagcggagaacagt

SEQ ID NO: 562868 - DNA, 25 bp, Rattus norvegicus
ggaggcgggacaagtcgccttaaca

SEQ ID NO: 562869 - DNA, 25 bp, Rattus norvegicus
gggacaagtcgccttaacaaccaga

SEQ ID NO: 562870 - DNA, 25 bp, Rattus norvegicus
tttacagccccaaagcggaggtgga

SEQ ID NO: 562871 - DNA, 25 bp, Rattus norvegicus
tggagggaccaagtcgctgctccca

SEQ ID NO: 562872 - DNA, 25 bp, Rattus norvegicus
cgcagaccgcacagtgacatgggcg

SEQ ID NO: 562873 - DNA, 25 bp, Rattus norvegicus
tctgacgcaggcgtgcttgagccct

SEQ ID NO: 562874 - DNA, 25 bp, Rattus norvegicus
accggtcttaaatcagccgggcgcg

SEQ ID NO: 562875 - DNA, 25 bp, Rattus norvegicus
gaggtgacccttccaaggccggaga

SEQ ID NO: 562876 - DNA, 25 bp, Rattus norvegicus
tgcacgctgcactggacgcagattg

SEQ ID NO: 562877 - DNA, 25 bp, Rattus norvegicus
cgcagattgatcgtgccgactgttt

SEQ ID NO: 562878 - DNA, 25 bp, Rattus norvegicus
ccgactgttttcacaagaggtgacc

SEQ ID NO: 562879 - DNA, 25 bp, Rattus norvegicus
ccaaggccggagatgatcaagatgc

SEQ ID NO: 562880 - DNA, 25 bp, Rattus norvegicus
tcaagatgcagaacgcgctctccgg

SEQ ID NO: 562881 - DNA, 25 bp, Rattus norvegicus
gtcctaccgtctgagccgccaagaa

SEQ ID NO: 562882 - DNA, 25 bp, Rattus norvegicus
ccaagaagtcctaagggcgagcgcg

SEQ ID NO: 562883 - DNA, 25 bp, Rattus norvegicus
gccagcgtagacacaaccggtctta

SEQ ID NO: 562884 - DNA, 25 bp, Rattus norvegicus
ttctgcgaccacaggacgtgacctc

SEQ ID NO: 562885 - DNA, 25 bp, Rattus norvegicus
gcaactgcctcggaggccgctcgga

SEQ ID NO: 562886 - DNA, 25 bp, Rattus norvegicus
gctccgggtcatcgagcgctaacct

SEQ ID NO: 562887 - DNA, 25 bp, Rattus norvegicus
cgtagcccatgctgatgccgctggt

SEQ ID NO: 562888 - DNA, 25 bp, Rattus norvegicus
agtaatcttctctggcctctggctc

SEQ ID NO: 562889 - DNA, 25 bp, Rattus norvegicus
ggaggcctctggaacgaaggaacca

SEQ ID NO: 562890 - DNA, 25 bp, Rattus norvegicus
gctcctcggtgtcctgatttcctag

SEQ ID NO: 562891 - DNA, 25 bp, Rattus norvegicus
tccctggccggttccaaagcttcat

SEQ ID NO: 562892 - DNA, 25 bp, Rattus norvegicus
cgcttcaaaggagccgcgtgcgttc

SEQ ID NO: 562893 - DNA, 25 bp, Rattus norvegicus
gaaaggacccttcgaagcgctgcgc

SEQ ID NO: 562894 - DNA, 25 bp, Rattus norvegicus
catcgctggccgagctactggcgaa

SEQ ID NO: 562895 - DNA, 25 bp, Rattus norvegicus
gtagccaccgtcaaacgcagcagtg

SEQ ID NO: 562896 - DNA, 25 bp, Rattus norvegicus
gcagtgctgttagctcgtcctggta

SEQ ID NO: 562897 - DNA, 25 bp, Rattus norvegicus
taagagtgacggctctcctggcagc

SEQ ID NO: 562898 - DNA, 25 bp, Rattus norvegicus
acccaccggccgatgagcgcatagt

SEQ ID NO: 562899 - DNA, 25 bp, Rattus norvegicus
gttgcgtcccacgtctctccaaagg

SEQ ID NO: 562900 - DNA, 25 bp, Rattus norvegicus
gagccgtggtctccaaccgaaaatc

SEQ ID NO: 562901 - DNA, 25 bp, Rattus norvegicus
cgagctgtctgagtaccttgaaggc

SEQ ID NO: 562902 - DNA, 25 bp, Rattus norvegicus
gacgtcacagcttcacgcccagtta

SEQ ID NO: 562903 - DNA, 25 bp, Rattus norvegicus
tgcctccgagaacaccgccaaagaa

SEQ ID NO: 562904 - DNA, 25 bp, Rattus norvegicus
gccagcgccatgtttagcaagggca

SEQ ID NO: 562905 - DNA, 25 bp, Rattus norvegicus
tccgagtccaaaaaacccgtgctga

SEQ ID NO: 562906 - DNA, 25 bp, Rattus norvegicus
agcagatctgcacgacctccgagtc

SEQ ID NO: 562907 - DNA, 25 bp, Rattus norvegicus
cggacccaagtccagcagatctgca

SEQ ID NO: 562908 - DNA, 25 bp, Rattus norvegicus
gcatttcgattcgtggctcctccgg

SEQ ID NO: 562909 - DNA, 25 bp, Rattus norvegicus
gggtggtggttccatgaagcatttc

SEQ ID NO: 562910 - DNA, 25 bp, Rattus norvegicus
agcgcccgactgttttcagctagga

SEQ ID NO: 562911 - DNA, 25 bp, Rattus norvegicus
gaggcgccatttttactccgggcaa

SEQ ID NO: 562912 - DNA, 25 bp, Rattus norvegicus
tcctagagagtggttggaacgttca

SEQ ID NO: 562913 - DNA, 25 bp, Rattus norvegicus
ctttggtgtcgaagcagtacggcta

SEQ ID NO: 562914 - DNA, 25 bp, Rattus norvegicus
cgactcgctgagatgccggagaatt

SEQ ID NO: 562915 - DNA, 25 bp, Rattus norvegicus
ccatacacctgcacggagtcgtacg

SEQ ID NO: 562916 - DNA, 25 bp, Rattus norvegicus
tacacctgcacggagtcgtacgggg

SEQ ID NO: 562917 - DNA, 25 bp, Rattus norvegicus
gaacgctggggtcctcgtccgcctc

SEQ ID NO: 562918 - DNA, 25 bp, Rattus norvegicus
agcaactgcgccacatcagcggggc

SEQ ID NO: 562919 - DNA, 25 bp, Rattus norvegicus
gctgctggaggagcggctccgtccg

SEQ ID NO: 562920 - DNA, 25 bp, Rattus norvegicus
gtccgcggcagcacatcgcggcgta

SEQ ID NO: 562921 - DNA, 25 bp, Rattus norvegicus
agccatacacctgcacggagtcgta

SEQ ID NO: 562922 - DNA, 25 bp, Rattus norvegicus
tcatagccatacacctgcacggagt

SEQ ID NO: 562923 - DNA, 25 bp, Rattus norvegicus
ccatacagctctgccagagtgcgga

SEQ ID NO: 562924 - DNA, 25 bp, Rattus norvegicus
gcccagggagctgagcgagccgcag

SEQ ID NO: 562925 - DNA, 25 bp, Rattus norvegicus
gccagcctcgctgcccgagcccagg

SEQ ID NO: 562926 - DNA, 25 bp, Rattus norvegicus
cccagtcgtccagtggctcggcggg

SEQ ID NO: 562927 - DNA, 25 bp, Rattus norvegicus
aagagtgggccccagtcgtccagtg

SEQ ID NO: 562928 - DNA, 25 bp, Rattus norvegicus
cagctctgccagagtgcggaagagt

SEQ ID NO: 562929 - DNA, 25 bp, Rattus norvegicus
cggctcgcgcgggagaggagagccc

SEQ ID NO: 562930 - DNA, 25 bp, Rattus norvegicus
ccgggcgcatacagatgcagggccc

SEQ ID NO: 562931 - DNA, 25 bp, Rattus norvegicus
cccgggcgagaacaagggagcgaga

SEQ ID NO: 562932 - DNA, 25 bp, Rattus norvegicus
ctccgctgcaggtctgagcggcccg

SEQ ID NO: 562933 - DNA, 25 bp, Rattus norvegicus
aagcagatccaagccggcgccgcgg

SEQ ID NO: 562934 - DNA, 25 bp, Rattus norvegicus
ccgcctgcctccgtcgctggctccc

SEQ ID NO: 562935 - DNA, 25 bp, Rattus norvegicus
agggacccgggaccacgagcagcgc

SEQ ID NO: 562936 - DNA, 25 bp, Rattus norvegicus
gggcaggcgcccttacctggctcta

SEQ ID NO: 562937 - DNA, 25 bp, Rattus norvegicus
gcgaggattcccgacccgggcaggc

SEQ ID NO: 562938 - DNA, 25 bp, Rattus norvegicus
agcgcaccgcaagctgcggggtccc

SEQ ID NO: 562939 - DNA, 25 bp, Rattus norvegicus
agccagagcgcaccgcaagctgcgg

SEQ ID NO: 562940 - DNA, 25 bp, Rattus norvegicus
ggggtgcagccccaagcagatccaa

SEQ ID NO: 562941 - DNA, 25 bp, Rattus norvegicus
gcccttacctggctctaccgaggga

SEQ ID NO: 562942 - DNA, 25 bp, Rattus norvegicus
ccgcggctccgctgcaggtctgagc

SEQ ID NO: 562943 - DNA, 25 bp, Rattus norvegicus
gcgggaaccggcgttatctctattc

SEQ ID NO: 562944 - DNA, 25 bp, Rattus norvegicus
gccgaggctttgaatcgaatctatt

SEQ ID NO: 562945 - DNA, 25 bp, Rattus norvegicus
ggctatctccggacttgagggctga

SEQ ID NO: 562946 - DNA, 25 bp, Rattus norvegicus
agagtagcgcgcaccctcccatttt

SEQ ID NO: 562947 - DNA, 25 bp, Rattus norvegicus
ttcggaagccctcgaatctggcata

SEQ ID NO: 562948 - DNA, 25 bp, Rattus norvegicus
gccgcttgaccagggcactcttctg

SEQ ID NO: 562949 - DNA, 25 bp, Rattus norvegicus
tcggtcacccgcagagcctgaagag

SEQ ID NO: 562950 - DNA, 25 bp, Rattus norvegicus
agcctgaagaggcttcccgtccaga

SEQ ID NO: 562951 - DNA, 25 bp, Rattus norvegicus
ctccgccatcttgcgtgaggtactc

SEQ ID NO: 562952 - DNA, 25 bp, Rattus norvegicus
cggcttcgggcatcttcggtaattt

SEQ ID NO: 562953 - DNA, 25 bp, Rattus norvegicus
ggtcgtttccgtctccacatcggta

SEQ ID NO: 562954 - DNA, 25 bp, Rattus norvegicus
cacatcggtaccaatcggctttttc

SEQ ID NO: 562955 - DNA, 25 bp, Rattus norvegicus
cggctttttccatctgcctagcggc

SEQ ID NO: 562956 - DNA, 25 bp, Rattus norvegicus
cggctcctcccattttactttcagg

SEQ ID NO: 562957 - DNA, 25 bp, Rattus norvegicus
ggggtccctgcaaccgtatagcttc

SEQ ID NO: 562958 - DNA, 25 bp, Rattus norvegicus
ttggaacagaggtggctgcaaacgc

SEQ ID NO: 562959 - DNA, 25 bp, Rattus norvegicus
agaggcgccatactctggcgttcgc

SEQ ID NO: 562960 - DNA, 25 bp, Rattus norvegicus
ctcgtactccaacagaggcgccata

SEQ ID NO: 562961 - DNA, 25 bp, Rattus norvegicus
tgtcgagcagttccagcacctgctg

SEQ ID NO: 562962 - DNA, 25 bp, Rattus norvegicus
accagcccgtcgctgtcgagcagtt

SEQ ID NO: 562963 - DNA, 25 bp, Rattus norvegicus
gcgtgttgagcaccagcaccaggca

SEQ ID NO: 562964 - DNA, 25 bp, Rattus norvegicus
acctcctcggcaggctgcgtgttga

SEQ ID NO: 562965 - DNA, 25 bp, Rattus norvegicus
cgtatagcttcacgttcctgccgca

SEQ ID NO: 562966 - DNA, 25 bp, Rattus norvegicus
agccaagttcaagaggacagcctgc

SEQ ID NO: 562967 - DNA, 25 bp, Rattus norvegicus
acagcctgccgattgtagccgaaga

SEQ ID NO: 562968 - DNA, 25 bp, Rattus norvegicus
cagagggcggatctagttgaactca

SEQ ID NO: 562969 - DNA, 25 bp, Rattus norvegicus
cagccgagaggtaccaaaagcgtta

SEQ ID NO: 562970 - DNA, 25 bp, Rattus norvegicus
gctgcaaacgccaactctgagagta

SEQ ID NO: 562971 - DNA, 25 bp, Rattus norvegicus
tggaattctccggaaagcgtttatc

SEQ ID NO: 562972 - DNA, 25 bp, Rattus norvegicus
gctgcggcgtttatttgcggaccga

SEQ ID NO: 562973 - DNA, 25 bp, Rattus norvegicus
cgctcgcgaatgtgcttccctttcg

SEQ ID NO: 562974 - DNA, 25 bp, Rattus norvegicus
acgccgcagatcgttccatctgtga

SEQ ID NO: 562975 - DNA, 25 bp, Rattus norvegicus
atcaggtttccacctgctgcggtcg

SEQ ID NO: 562976 - DNA, 25 bp, Rattus norvegicus
agcggtgctcaggtactttcttctc

SEQ ID NO: 562977 - DNA, 25 bp, Rattus norvegicus
tgcagccctcctaacgaaacagatc

SEQ ID NO: 562978 - DNA, 25 bp, Rattus norvegicus
agcgtttatcttcagaagcccagga

SEQ ID NO: 562979 - DNA, 25 bp, Rattus norvegicus
ctgctaacaaacaagggccgtgctt

SEQ ID NO: 562980 - DNA, 25 bp, Rattus norvegicus
acgagagtcacacgtgtcactgcta

SEQ ID NO: 562981 - DNA, 25 bp, Rattus norvegicus
gcgctcctaggctctaaaagtgaca

SEQ ID NO: 562982 - DNA, 25 bp, Rattus norvegicus
tttcagaaacggagagcgagcgctc

SEQ ID NO: 562983 - DNA, 25 bp, Rattus norvegicus
gtctctttctaaacgctcgtgcgta

SEQ ID NO: 562984 - DNA, 25 bp, Rattus norvegicus
cggcggcttgctctggtcagaattt

SEQ ID NO: 562985 - DNA, 25 bp, Rattus norvegicus
ctttcctttaccactcaggcgcatg

SEQ ID NO: 562986 - DNA, 25 bp, Rattus norvegicus
catgctcgttctgtgtgaccctccg

SEQ ID NO: 562987 - DNA, 25 bp, Rattus norvegicus
gcatgctcgttctgtgtgaccctcc

SEQ ID NO: 562988 - DNA, 25 bp, Rattus norvegicus
gcgcatgctcgttctgtgtgaccct

SEQ ID NO: 562989 - DNA, 25 bp, Rattus norvegicus
cgcatgctcgttctgtgtgaccctc

SEQ ID NO: 562990 - DNA, 25 bp, Rattus norvegicus
cactcaggcgcatgctcgttctgtg

SEQ ID NO: 562991 - DNA, 25 bp, Rattus norvegicus
actcaggcgcatgctcgttctgtgt

SEQ ID NO: 562992 - DNA, 25 bp, Rattus norvegicus
ctttaccactcaggcgcatgctcgt

SEQ ID NO: 562993 - DNA, 25 bp, Rattus norvegicus
tttcctttaccactcaggcgcatgc

SEQ ID NO: 562994 - DNA, 25 bp, Rattus norvegicus
accactcaggcgcatgctcgttctg

SEQ ID NO: 562995 - DNA, 25 bp, Rattus norvegicus
ccactcaggcgcatgctcgttctgt

SEQ ID NO: 562996 - DNA, 25 bp, Rattus norvegicus
acgcatgctcgttcctccaactctt

SEQ ID NO: 562997 - DNA, 25 bp, Rattus norvegicus
ttcctttaccactcaggcgcatgct

SEQ ID NO: 562998 - DNA, 25 bp, Rattus norvegicus
tcctttaccactcaggcgcatgctc

SEQ ID NO: 562999 - DNA, 25 bp, Rattus norvegicus
cattggctgcacgggtcccggccga

SEQ ID NO: 563000 - DNA, 25 bp, Rattus norvegicus
aggggctgcggcacgcccgactcct

SEQ ID NO: 563001 - DNA, 25 bp, Rattus norvegicus
tagggtatccaagagggagaggggc

SEQ ID NO: 563002 - DNA, 25 bp, Rattus norvegicus
attggctgcggggaatcggtcagtg

SEQ ID NO: 563003 - DNA, 25 bp, Rattus norvegicus
gcggcacgcccgactcctggcaccc

SEQ ID NO: 563004 - DNA, 25 bp, Rattus norvegicus
cagccacgcgaagccctggaccgcc

SEQ ID NO: 563005 - DNA, 25 bp, Rattus norvegicus
tccgcccctactagtgcggcttggg

SEQ ID NO: 563006 - DNA, 25 bp, Rattus norvegicus
cgggcatcggcacaacgcactgggc

SEQ ID NO: 563007 - DNA, 25 bp, Rattus norvegicus
gcatcggcacaacgcactgggccgg

SEQ ID NO: 563008 - DNA, 25 bp, Rattus norvegicus
ggcacaacgcactgggccggccatt

SEQ ID NO: 563009 - DNA, 25 bp, Rattus norvegicus
gcacaacgcactgggccggccattg

SEQ ID NO: 563010 - DNA, 25 bp, Rattus norvegicus
cactgggccggccattggctgcacg

SEQ ID NO: 563011 - DNA, 25 bp, Rattus norvegicus
tcccggccgaggtccgcgattggct

SEQ ID NO: 563012 - DNA, 25 bp, Rattus norvegicus
gcggggaatcggtcagtgtaggcgc

SEQ ID NO: 563013 - DNA, 25 bp, Rattus norvegicus
actctcttgcgagtgtcagggctgc

SEQ ID NO: 563014 - DNA, 25 bp, Rattus norvegicus
ccgcgtctgcgcgttccaggcagat

SEQ ID NO: 563015 - DNA, 25 bp, Rattus norvegicus
ttccaggcagatgcgctgcgcctgc

SEQ ID NO: 563016 - DNA, 25 bp, Rattus norvegicus
aagccgggctctagggctggctcca

SEQ ID NO: 563017 - DNA, 25 bp, Rattus norvegicus
gcgattcgcgcgtcctaaggagaga

SEQ ID NO: 563018 - DNA, 25 bp, Rattus norvegicus
ctcacgcgcttctcgtaggccaggt

SEQ ID NO: 563019 - DNA, 25 bp, Rattus norvegicus
cgcgtcggcgaaacgcactctcttg

SEQ ID NO: 563020 - DNA, 25 bp, Rattus norvegicus
ccggcctgcttggtttccttgacca

SEQ ID NO: 563021 - DNA, 25 bp, Rattus norvegicus
gcgcgctcggtcaatgctgctataa

SEQ ID NO: 563022 - DNA, 25 bp, Rattus norvegicus
tgctgctataaagctcaggttgcgg

SEQ ID NO: 563023 - DNA, 25 bp, Rattus norvegicus
ccgccggctctatgtccgatcataa

SEQ ID NO: 563024 - DNA, 25 bp, Rattus norvegicus
ccgatcataaggtgcagggctgctc

SEQ ID NO: 563025 - DNA, 25 bp, Rattus norvegicus
ggctgtggactctccttgccgtcac

SEQ ID NO: 563026 - DNA, 25 bp, Rattus norvegicus
agggcgtccctctgcagttgcacct

SEQ ID NO: 563027 - DNA, 25 bp, Rattus norvegicus
gcctaggatggctctagagaaggta

SEQ ID NO: 563028 - DNA, 25 bp, Rattus norvegicus
agagccgggactggttgagaccgac

SEQ ID NO: 563029 - DNA, 25 bp, Rattus norvegicus
catcatgggcgcctaggatggctct

SEQ ID NO: 563030 - DNA, 25 bp, Rattus norvegicus
ggctctagagaaggtaaattaattg

SEQ ID NO: 563031 - DNA, 25 bp, Rattus norvegicus
ttttctatttcaatcacgaccctcg

SEQ ID NO: 563032 - DNA, 25 bp, Rattus norvegicus
tttcaatcacgaccctcgcacgagg

SEQ ID NO: 563033 - DNA, 25 bp, Rattus norvegicus
accctcgcacgaggcgagggaaatg

SEQ ID NO: 563034 - DNA, 25 bp, Rattus norvegicus
tcagttctccaatcgccgagcggcg

SEQ ID NO: 563035 - DNA, 25 bp, Rattus norvegicus
cgacgtggccagctcagttctccaa

SEQ ID NO: 563036 - DNA, 25 bp, Rattus norvegicus
aatgaatcctcgacgtggccagctc

SEQ ID NO: 563037 - DNA, 25 bp, Rattus norvegicus
ctgactaatgaatcctcgacgtggc

SEQ ID NO: 563038 - DNA, 25 bp, Rattus norvegicus
ggctgactgactaatgaatcctcga

SEQ ID NO: 563039 - DNA, 25 bp, Rattus norvegicus
taacgggcaggctgactgactaatg

SEQ ID NO: 563040 - DNA, 25 bp, Rattus norvegicus
tctgatggggcatcatgggcgccta

SEQ ID NO: 563041 - DNA, 25 bp, Rattus norvegicus
aggccatgcccagcgccacgaagag

SEQ ID NO: 563042 - DNA, 25 bp, Rattus norvegicus
ccgcgccgagagaatgagctgttgt

SEQ ID NO: 563043 - DNA, 25 bp, Rattus norvegicus
tgtctggcccagctatgtgcaaagg

SEQ ID NO: 563044 - DNA, 25 bp, Rattus norvegicus
ctccacggtgctgtcgattttgttg

SEQ ID NO: 563045 - DNA, 25 bp, Rattus norvegicus
cggggcacagacacttactccattg

SEQ ID NO: 563046 - DNA, 25 bp, Rattus norvegicus
ccacctgggcgagtagagcctcgaa

SEQ ID NO: 563047 - DNA, 25 bp, Rattus norvegicus
ccacgaagagcacgggcaggcagca

SEQ ID NO: 563048 - DNA, 25 bp, Rattus norvegicus
gggctgctcccagcccgaagcgttg

SEQ ID NO: 563049 - DNA, 25 bp, Rattus norvegicus
ttgaaatccggtggggcgaagccac

SEQ ID NO: 563050 - DNA, 25 bp, Rattus norvegicus
tgtagtcccagtccttcaggcagtg

SEQ ID NO: 563051 - DNA, 25 bp, Rattus norvegicus
agcacgggcagtccgttgtagtccc

SEQ ID NO: 563052 - DNA, 25 bp, Rattus norvegicus
cctcacctggccgatggcattggtg

SEQ ID NO: 563053 - DNA, 25 bp, Rattus norvegicus
cagcacaggccgagctgcagctgct

SEQ ID NO: 563054 - DNA, 25 bp, Rattus norvegicus
gtccgtactggtgacgactctgctg

SEQ ID NO: 563055 - DNA, 25 bp, Rattus norvegicus
aagggcagttctatgggcttgccta

SEQ ID NO: 563056 - DNA, 25 bp, Rattus norvegicus
ctcagtccaggggattaagagaagg

SEQ ID NO: 563057 - DNA, 25 bp, Rattus norvegicus
ctccaggtgtattggggaacgaaga

SEQ ID NO: 563058 - DNA, 25 bp, Rattus norvegicus
cggcgctcggcgagtcccaaagctt

SEQ ID NO: 563059 - DNA, 25 bp, Rattus norvegicus
cgaggcacctctgggtctcagcgct

SEQ ID NO: 563060 - DNA, 25 bp, Rattus norvegicus
actgctcagcacagccaggtcttgg

SEQ ID NO: 563061 - DNA, 25 bp, Rattus norvegicus
gccggagccaaaggcctaagagcgc

SEQ ID NO: 563062 - DNA, 25 bp, Rattus norvegicus
agtgtcgccaaactcgctcaagtca

SEQ ID NO: 563063 - DNA, 25 bp, Rattus norvegicus
aggagcgacaactgaaccgagtgtc

SEQ ID NO: 563064 - DNA, 25 bp, Rattus norvegicus
acgagcgactctaggggccaaccct

SEQ ID NO: 563065 - DNA, 25 bp, Rattus norvegicus
tggttaagctggacgagcgactcta

SEQ ID NO: 563066 - DNA, 25 bp, Rattus norvegicus
agaagccgcctgagtggttaagctg

SEQ ID NO: 563067 - DNA, 25 bp, Rattus norvegicus
ctcaagtcagcgcaaaggccggagc

SEQ ID NO: 563068 - DNA, 25 bp, Rattus norvegicus
acgatccttcccgaggcggtgttga

SEQ ID NO: 563069 - DNA, 25 bp, Rattus norvegicus
acttgctgtctctgcctcggttcgg

SEQ ID NO: 563070 - DNA, 25 bp, Rattus norvegicus
cgggcatgcgtagatgttgcagcac

SEQ ID NO: 563071 - DNA, 25 bp, Rattus norvegicus
agcagctgcagacgcctctgggcct

SEQ ID NO: 563072 - DNA, 25 bp, Rattus norvegicus
ggccgctctgtagcagctgcagacg

SEQ ID NO: 563073 - DNA, 25 bp, Rattus norvegicus
ttcttcggctgctgggccgctctgt

SEQ ID NO: 563074 - DNA, 25 bp, Rattus norvegicus
agctgagagtccttcttcggctgct

SEQ ID NO: 563075 - DNA, 25 bp, Rattus norvegicus
tactctggagagctgagagtccttc

SEQ ID NO: 563076 - DNA, 25 bp, Rattus norvegicus
cggctgaagctcagaatactctgga

SEQ ID NO: 563077 - DNA, 25 bp, Rattus norvegicus
gttactttgcggttatccccttgca

SEQ ID NO: 563078 - DNA, 25 bp, Rattus norvegicus
ttcctacttgctgtctctgcctcgg

SEQ ID NO: 563079 - DNA, 25 bp, Rattus norvegicus
tagatgttgcagcacagctaggcgg

SEQ ID NO: 563080 - DNA, 25 bp, Rattus norvegicus
ccgcccacggctgaagctcagaata

SEQ ID NO: 563081 - DNA, 25 bp, Rattus norvegicus
caggagtctgaagccgcccacggct

SEQ ID NO: 563082 - DNA, 25 bp, Rattus norvegicus
cctcttcctcaccaggagtctgaag

SEQ ID NO: 563083 - DNA, 25 bp, Rattus norvegicus
ccagctgagatcctatgcgggctgc

SEQ ID NO: 563084 - DNA, 25 bp, Rattus norvegicus
ctcggcgcggtacgtctaggctctc

SEQ ID NO: 563085 - DNA, 25 bp, Rattus norvegicus
aggctgacagctcagagccctctca

SEQ ID NO: 563086 - DNA, 25 bp, Rattus norvegicus
gcgcgctagcccatccatccatcag

SEQ ID NO: 563087 - DNA, 25 bp, Rattus norvegicus
atccatcagcccttccgcccgggtt

SEQ ID NO: 563088 - DNA, 25 bp, Rattus norvegicus
cgcggtacgtctaggctctcgctgc

SEQ ID NO: 563089 - DNA, 25 bp, Rattus norvegicus
cagccagctgagatcctatgcgggc

SEQ ID NO: 563090 - DNA, 25 bp, Rattus norvegicus
ggcgcggtacgtctaggctctcgct

SEQ ID NO: 563091 - DNA, 25 bp, Rattus norvegicus
agctgagatcctatgcgggctgcag

SEQ ID NO: 563092 - DNA, 25 bp, Rattus norvegicus
gcagccagctgagatcctatgcggg

SEQ ID NO: 563093 - DNA, 25 bp, Rattus norvegicus
tctaggctctcgctgccctctgtcc

SEQ ID NO: 563094 - DNA, 25 bp, Rattus norvegicus
ctgagatcctatgcgggctgcaggc

SEQ ID NO: 563095 - DNA, 25 bp, Rattus norvegicus
tgacagctcagagccctctcactca

SEQ ID NO: 563096 - DNA, 25 bp, Rattus norvegicus
ggtacgtctaggctctcgctgccct

SEQ ID NO: 563097 - DNA, 25 bp, Rattus norvegicus
cccacgaatctcttcgattaggtcc

SEQ ID NO: 563098 - DNA, 25 bp, Rattus norvegicus
ggattgcgttccaccgccgacctaa

SEQ ID NO: 563099 - DNA, 25 bp, Rattus norvegicus
gatctctaaaggattgcgttccacc

SEQ ID NO: 563100 - DNA, 25 bp, Rattus norvegicus
tgccctgagccaagatctctaaagg

SEQ ID NO: 563101 - DNA, 25 bp, Rattus norvegicus
aggaggcccgaatttgggcgcactc

SEQ ID NO: 563102 - DNA, 25 bp, Rattus norvegicus
cggttggacagaattgccctgagcc

SEQ ID NO: 563103 - DNA, 25 bp, Rattus norvegicus
ttctggatcacctcccgttcctggg

SEQ ID NO: 563104 - DNA, 25 bp, Rattus norvegicus
ctcttcgattaggtcctgaagtttc

SEQ ID NO: 563105 - DNA, 25 bp, Rattus norvegicus
ctgaagtttcaacgaaggcaccatc

SEQ ID NO: 563106 - DNA, 25 bp, Rattus norvegicus
acgaaggcaccatcctggggacaga

SEQ ID NO: 563107 - DNA, 25 bp, Rattus norvegicus
accatcctggggacagagcccggga

SEQ ID NO: 563108 - DNA, 25 bp, Rattus norvegicus
ttaacacgttctagccggttggaca

SEQ ID NO: 563109 - DNA, 25 bp, Rattus norvegicus
atttgggcgcactccttctggatca

SEQ ID NO: 563110 - DNA, 25 bp, Rattus norvegicus
tctagccggttggacagaattgccc

SEQ ID NO: 563111 - DNA, 25 bp, Rattus norvegicus
ccagggaaccctagctgctgcaagg

SEQ ID NO: 563112 - DNA, 25 bp, Rattus norvegicus
gctaaagtacgcacggtcgcccagg

SEQ ID NO: 563113 - DNA, 25 bp, Rattus norvegicus
cgttggctaacgctggctaaagtac

SEQ ID NO: 563114 - DNA, 25 bp, Rattus norvegicus
agaaggtctccgtctctggttatcc

SEQ ID NO: 563115 - DNA, 25 bp, Rattus norvegicus
acggagtattccagttcgcagaagg

SEQ ID NO: 563116 - DNA, 25 bp, Rattus norvegicus
cgtagcacagcccactaacagtttt

SEQ ID NO: 563117 - DNA, 25 bp, Rattus norvegicus
ggtggggactatgcactctgaaatc

SEQ ID NO: 563118 - DNA, 25 bp, Rattus norvegicus
cgacagccaatagggtcagcgttct

SEQ ID NO: 563119 - DNA, 25 bp, Rattus norvegicus
gcgtctcttccgattggcgaaccga

SEQ ID NO: 563120 - DNA, 25 bp, Rattus norvegicus
ccattggtcagtaggcgttacgtgc

SEQ ID NO: 563121 - DNA, 25 bp, Rattus norvegicus
aaggcgagcacgtccagcttttctg

SEQ ID NO: 563122 - DNA, 25 bp, Rattus norvegicus
cgcgctctctaaacagttccggcta

SEQ ID NO: 563123 - DNA, 25 bp, Rattus norvegicus
ttcgcaactcctctctgtggaccgg

SEQ ID NO: 563124 - DNA, 25 bp, Rattus norvegicus
cagacgcggtcaccgagcactgttc

SEQ ID NO: 563125 - DNA, 25 bp, Rattus norvegicus
agccatggcgttttccggcttgcca

SEQ ID NO: 563126 - DNA, 25 bp, Rattus norvegicus
tgtgatgcacaagctgacaggtggt

SEQ ID NO: 563127 - DNA, 25 bp, Rattus norvegicus
ggattttggcaatgtcagcggactg

SEQ ID NO: 563128 - DNA, 25 bp, Rattus norvegicus
ccgggaaggaacaggccaagcttcg

SEQ ID NO: 563129 - DNA, 25 bp, Rattus norvegicus
ccaaagcccttggaagctcaggtga

SEQ ID NO: 563130 - DNA, 25 bp, Rattus norvegicus
gccttggtaagtgcctgtcgatgta

SEQ ID NO: 563131 - DNA, 25 bp, Rattus norvegicus
gactgcaggctacaagctgacttga

SEQ ID NO: 563132 - DNA, 25 bp, Rattus norvegicus
gacggacgggaatactggaaacaga

SEQ ID NO: 563133 - DNA, 25 bp, Rattus norvegicus
gctggcgcaccgcacgcatatggct

SEQ ID NO: 563134 - DNA, 25 bp, Rattus norvegicus
caggtggctcagagactgtgatgca

SEQ ID NO: 563135 - DNA, 25 bp, Rattus norvegicus
ccttcatctcctggtaggggtaggg

SEQ ID NO: 563136 - DNA, 25 bp, Rattus norvegicus
cggaagaatccacctgctgctgggg

SEQ ID NO: 563137 - DNA, 25 bp, Rattus norvegicus
agcagcagtgaacggcggaagaatc

SEQ ID NO: 563138 - DNA, 25 bp, Rattus norvegicus
agtcagaacattacggcggctccca

SEQ ID NO: 563139 - DNA, 25 bp, Rattus norvegicus
ggactgctgttaagaggctggactc

SEQ ID NO: 563140 - DNA, 25 bp, Rattus norvegicus
cgccagaacccactcgcgaataagg

SEQ ID NO: 563141 - DNA, 25 bp, Rattus norvegicus
acccagcttccggatctgaactatg

SEQ ID NO: 563142 - DNA, 25 bp, Rattus norvegicus
agggagcgctctcaaccgcggctct

SEQ ID NO: 563143 - DNA, 25 bp, Rattus norvegicus
ctcgcgaataaggtggccctggtca

SEQ ID NO: 563144 - DNA, 25 bp, Rattus norvegicus
agttccgggctgactcgccagaacc

SEQ ID NO: 563145 - DNA, 25 bp, Rattus norvegicus
aggatggccagttccgggctgactc

SEQ ID NO: 563146 - DNA, 25 bp, Rattus norvegicus
ctgttaagaggctggactcgagcgt

SEQ ID NO: 563147 - DNA, 25 bp, Rattus norvegicus
tccggatctgaactatgcagaaagc

SEQ ID NO: 563148 - DNA, 25 bp, Rattus norvegicus
tagcagagttcaacccagcttccgg

SEQ ID NO: 563149 - DNA, 25 bp, Rattus norvegicus
agaccagcctcctgtcctttgaacg

SEQ ID NO: 563150 - DNA, 25 bp, Rattus norvegicus
gcaggacgctcgcagctagaccagc

SEQ ID NO: 563151 - DNA, 25 bp, Rattus norvegicus
tcctggaagcgtagcaggctgtcca

SEQ ID NO: 563152 - DNA, 25 bp, Rattus norvegicus
aaggtggccctggtcacagcctcca

SEQ ID NO: 563153 - DNA, 25 bp, Rattus norvegicus
ctggcaaccgggttcgcagtcacat

SEQ ID NO: 563154 - DNA, 25 bp, Rattus norvegicus
ggtcatagctgaggcggccgccctc

SEQ ID NO: 563155 - DNA, 25 bp, Rattus norvegicus
tggacgtcatgacttcacctaccgg

SEQ ID NO: 563156 - DNA, 25 bp, Rattus norvegicus
cgatgtccgatgctcagcgtctgtc

SEQ ID NO: 563157 - DNA, 25 bp, Rattus norvegicus
cgtctgtctgggtagcagtaggtac

SEQ ID NO: 563158 - DNA, 25 bp, Rattus norvegicus
cagtaggtaccacagcaactgctcc

SEQ ID NO: 563159 - DNA, 25 bp, Rattus norvegicus
cagctctggcactcagcgacggaga

SEQ ID NO: 563160 - DNA, 25 bp, Rattus norvegicus
cagcgacggagagcgcgtcctcaca

SEQ ID NO: 563161 - DNA, 25 bp, Rattus norvegicus
cacgcgggctagctgaccagcaaga

SEQ ID NO: 563162 - DNA, 25 bp, Rattus norvegicus
cggtggccatcttgagtcctggtaa

SEQ ID NO: 563163 - DNA, 25 bp, Rattus norvegicus
agtcacatgggcacgctctacctcg

SEQ ID NO: 563164 - DNA, 25 bp, Rattus norvegicus
agtgcccgcctcaaaaatggccgcg

SEQ ID NO: 563165 - DNA, 25 bp, Rattus norvegicus
ccctctgcttacctggtggacgtca

SEQ ID NO: 563166 - DNA, 25 bp, Rattus norvegicus
gcaacaaggttgagtgcccgcctca

SEQ ID NO: 563167 - DNA, 25 bp, Rattus norvegicus
cagcaaggacgagctggacggttcc

SEQ ID NO: 563168 - DNA, 25 bp, Rattus norvegicus
cccgactagcgagcagaaaagaacc

SEQ ID NO: 563169 - DNA, 25 bp, Rattus norvegicus
cgagactagcatgtgcggcgcctct

SEQ ID NO: 563170 - DNA, 25 bp, Rattus norvegicus
tgctccattggccaactcttcggga

SEQ ID NO: 563171 - DNA, 25 bp, Rattus norvegicus
gctcggcaagctcagcgcgcatgct

SEQ ID NO: 563172 - DNA, 25 bp, Rattus norvegicus
tctgggcttctcacgaggtagcccg

SEQ ID NO: 563173 - DNA, 25 bp, Rattus norvegicus
ccctgagatagctcggacaccaggc

SEQ ID NO: 563174 - DNA, 25 bp, Rattus norvegicus
gcacggcagtagaaacgctgcaccc

SEQ ID NO: 563175 - DNA, 25 bp, Rattus norvegicus
ccgaagcacgtaaacaaagaaattg

SEQ ID NO: 563176 - DNA, 25 bp, Rattus norvegicus
ttcagagttgcctccagggtcagca

SEQ ID NO: 563177 - DNA, 25 bp, Rattus norvegicus
gcagcatcgcccttgattcagagtt

SEQ ID NO: 563178 - DNA, 25 bp, Rattus norvegicus
cggacaggtcctttagcagcatcgc

SEQ ID NO: 563179 - DNA, 25 bp, Rattus norvegicus
ccggcacattcggacaggtccttta

SEQ ID NO: 563180 - DNA, 25 bp, Rattus norvegicus
aaattgaagaattcggctccgggtg

SEQ ID NO: 563181 - DNA, 25 bp, Rattus norvegicus
cgacatcgagaccagcgcggcgtct

SEQ ID NO: 563182 - DNA, 25 bp, Rattus norvegicus
gaccaggttgatgcgggtgtcaccc

SEQ ID NO: 563183 - DNA, 25 bp, Rattus norvegicus
gttcaactcgcgcaccgacatcgag

SEQ ID NO: 563184 - DNA, 25 bp, Rattus norvegicus
tctgaaaatctctcgggcaactgca

SEQ ID NO: 563185 - DNA, 25 bp, Rattus norvegicus
cggacccagggccaccggaagtcag

SEQ ID NO: 563186 - DNA, 25 bp, Rattus norvegicus
aagtcagccggtcacagcgggcctt

SEQ ID NO: 563187 - DNA, 25 bp, Rattus norvegicus
tcacagcgggccttgtagaggtcgc

SEQ ID NO: 563188 - DNA, 25 bp, Rattus norvegicus
tagaggtcgcgctctcgagccaggc

SEQ ID NO: 563189 - DNA, 25 bp, Rattus norvegicus
atgcgggtgtcacccggcgagacac

SEQ ID NO: 563190 - DNA, 25 bp, Rattus norvegicus
tgcagccgcttggagcgacaggcct

SEQ ID NO: 563191 - DNA, 25 bp, Rattus norvegicus
cagagaaacagtgcagggaccaggt

SEQ ID NO: 563192 - DNA, 25 bp, Rattus norvegicus
ggccaccggaagtcagccggtcaca

SEQ ID NO: 563193 - DNA, 25 bp, Rattus norvegicus
cgtagggcatccagctgtgcggcta

SEQ ID NO: 563194 - DNA, 25 bp, Rattus norvegicus
cagcgcggcgtctgaaaatctctcg

SEQ ID NO: 563195 - DNA, 25 bp, Rattus norvegicus
tcgagagaaccagctaggttccgcc

SEQ ID NO: 563196 - DNA, 25 bp, Rattus norvegicus
ctgaactcaggcctccaatggcttg

SEQ ID NO: 563197 - DNA, 25 bp, Rattus norvegicus
cagcctcggagtgggcggatcccaa

SEQ ID NO: 563198 - DNA, 25 bp, Rattus norvegicus
actggttcctgtggccatcccgcag

SEQ ID NO: 563199 - DNA, 25 bp, Rattus norvegicus
ccaatggcttgagggtgtgatgacc

SEQ ID NO: 563200 - DNA, 25 bp, Rattus norvegicus
ccggcctacagatggtcgagagaac

SEQ ID NO: 563201 - DNA, 25 bp, Rattus norvegicus
tctggctttgccacgcttcttcctt

SEQ ID NO: 563202 - DNA, 25 bp, Rattus norvegicus
gcccactccgcgctccatcttcggg

SEQ ID NO: 563203 - DNA, 25 bp, Rattus norvegicus
tgggcggatcccaagctgaactcag

SEQ ID NO: 563204 - DNA, 25 bp, Rattus norvegicus
tgagtgacccatagcacggggccca

SEQ ID NO: 563205 - DNA, 25 bp, Rattus norvegicus
cccggcctgcggtgagtgacccata

SEQ ID NO: 563206 - DNA, 25 bp, Rattus norvegicus
gtgccatggctgctatgtacctccc

SEQ ID NO: 563207 - DNA, 25 bp, Rattus norvegicus
cagcgccagtccaggtgccatggct

SEQ ID NO: 563208 - DNA, 25 bp, Rattus norvegicus
gcccgggctagtgagccggcctaca

SEQ ID NO: 563209 - DNA, 25 bp, Rattus norvegicus
tgcgcactacgcaaccggaaagact

SEQ ID NO: 563210 - DNA, 25 bp, Rattus norvegicus
agtgacgtcatcaggcctggcagtc

SEQ ID NO: 563211 - DNA, 25 bp, Rattus norvegicus
catcgaggagcgtcgagtgacgtca

SEQ ID NO: 563212 - DNA, 25 bp, Rattus norvegicus
tcaccggtctcagctgtccaatcag

SEQ ID NO: 563213 - DNA, 25 bp, Rattus norvegicus
atgcaggccgcagccaattccagtc

SEQ ID NO: 563214 - DNA, 25 bp, Rattus norvegicus
tccgctatctctaatgcaggccgca

SEQ ID NO: 563215 - DNA, 25 bp, Rattus norvegicus
agactttacgtctagctccgctatc

SEQ ID NO: 563216 - DNA, 25 bp, Rattus norvegicus
aagggaccacctcgcagactttacg

SEQ ID NO: 563217 - DNA, 25 bp, Rattus norvegicus
ccaccagtgaggactgctttcgaca

SEQ ID NO: 563218 - DNA, 25 bp, Rattus norvegicus
tcgtctaacaagaccgccgcgggta

SEQ ID NO: 563219 - DNA, 25 bp, Rattus norvegicus
ccgcgacatttagggagcgtctgca

SEQ ID NO: 563220 - DNA, 25 bp, Rattus norvegicus
ggaaaggcctgggttccaccagtga

SEQ ID NO: 563221 - DNA, 25 bp, Rattus norvegicus
ctcgcgacttaggagctgttagccg

SEQ ID NO: 563222 - DNA, 25 bp, Rattus norvegicus
actcgaggccaagcgaccttaaggg

SEQ ID NO: 563223 - DNA, 25 bp, Rattus norvegicus
cggtgcaggtttcgagctgtgcttt

SEQ ID NO: 563224 - DNA, 25 bp, Rattus norvegicus
tcgagctgtgctttcgctttccctt

SEQ ID NO: 563225 - DNA, 25 bp, Rattus norvegicus
gtttcgagctgtgctttcgctttcc

SEQ ID NO: 563226 - DNA, 25 bp, Rattus norvegicus
tgcaggtttcgagctgtgctttcgc

SEQ ID NO: 563227 - DNA, 25 bp, Rattus norvegicus
cggaaacgctactcgggctgctgga

SEQ ID NO: 563228 - DNA, 25 bp, Rattus norvegicus
ctttagagaggcgtggctcagaacg

SEQ ID NO: 563229 - DNA, 25 bp, Rattus norvegicus
ctctggccatggctacactgagggt

SEQ ID NO: 563230 - DNA, 25 bp, Rattus norvegicus
caggtttcgagctgtgctttcgctt

SEQ ID NO: 563231 - DNA, 25 bp, Rattus norvegicus
gagctgtgctttcgctttcccttcc

SEQ ID NO: 563232 - DNA, 25 bp, Rattus norvegicus
ttcgagtggggacgagaggctttag

SEQ ID NO: 563233 - DNA, 25 bp, Rattus norvegicus
tctggccatggctacactgagggtc

SEQ ID NO: 563234 - DNA, 25 bp, Rattus norvegicus
aagcccaagccaaggtgagcgttgc

SEQ ID NO: 563235 - DNA, 25 bp, Rattus norvegicus
agcccaagccaaggtgagcgttgcg

SEQ ID NO: 563236 - DNA, 25 bp, Rattus norvegicus
caaggtgagcgttgcgggttcgagt

SEQ ID NO: 563237 - DNA, 25 bp, Rattus norvegicus
ggtgcacaccgcgatcaacgggctg

SEQ ID NO: 563238 - DNA, 25 bp, Rattus norvegicus
cccgttgacagcagcgtgtgggtac

SEQ ID NO: 563239 - DNA, 25 bp, Rattus norvegicus
gggagccagcaacaacccgttgaca

SEQ ID NO: 563240 - DNA, 25 bp, Rattus norvegicus
agacattctccggaccgcgtcgcgg

SEQ ID NO: 563241 - DNA, 25 bp, Rattus norvegicus
gtcggtgaggcagagacattctccg

SEQ ID NO: 563242 - DNA, 25 bp, Rattus norvegicus
catgacggacaaggccagatggctg

SEQ ID NO: 563243 - DNA, 25 bp, Rattus norvegicus
gcgcgacctccagcatgacggacaa

SEQ ID NO: 563244 - DNA, 25 bp, Rattus norvegicus
taggctcgggcggagatctccacct

SEQ ID NO: 563245 - DNA, 25 bp, Rattus norvegicus
gcaacctggttgagcgcgacctcca

SEQ ID NO: 563246 - DNA, 25 bp, Rattus norvegicus
ttgtccatgccgcaacctggttgag

SEQ ID NO: 563247 - DNA, 25 bp, Rattus norvegicus
cgcatgcatttaggctgagggtcct

SEQ ID NO: 563248 - DNA, 25 bp, Rattus norvegicus
taccgagaggcgtgcagacacatct

SEQ ID NO: 563249 - DNA, 25 bp, Rattus norvegicus
tgcagacacatcttcccgtaggctc

SEQ ID NO: 563250 - DNA, 25 bp, Rattus norvegicus
gatcaacgggctgcgcatgcattta

SEQ ID NO: 563251 - DNA, 25 bp, Rattus norvegicus
ctcggaggaaaaaggttctgtcgca

SEQ ID NO: 563252 - DNA, 25 bp, Rattus norvegicus
gaaagcgaagaagagagactgactc

SEQ ID NO: 563253 - DNA, 25 bp, Rattus norvegicus
ttctgtcgcattatgggaggagccg

SEQ ID NO: 563254 - DNA, 25 bp, Rattus norvegicus
cggtttccttattggcggcgacctg

SEQ ID NO: 563255 - DNA, 25 bp, Rattus norvegicus
acctggccgctcttcctgatcatag

SEQ ID NO: 563256 - DNA, 25 bp, Rattus norvegicus
tcttcctgatcatagcttttccgtc

SEQ ID NO: 563257 - DNA, 25 bp, Rattus norvegicus
tagcttttccgtcactctgaacccg

SEQ ID NO: 563258 - DNA, 25 bp, Rattus norvegicus
cagcgaagctgagcctgtctccggt

SEQ ID NO: 563259 - DNA, 25 bp, Rattus norvegicus
tccgctgcaacgctcatggggaggt

SEQ ID NO: 563260 - DNA, 25 bp, Rattus norvegicus
tgtctccggtctcaggatgccagga

SEQ ID NO: 563261 - DNA, 25 bp, Rattus norvegicus
agacgaggagcgagccttcctagcg

SEQ ID NO: 563262 - DNA, 25 bp, Rattus norvegicus
aggtgggattctgcgcaggtatttc

SEQ ID NO: 563263 - DNA, 25 bp, Rattus norvegicus
tggagcagctcacgccgcttctggc

SEQ ID NO: 563264 - DNA, 25 bp, Rattus norvegicus
ttttcctccaaagtggtccacagtc

SEQ ID NO: 563265 - DNA, 25 bp, Rattus norvegicus
aaccgcgagtgtattgggcagagcc

SEQ ID NO: 563266 - DNA, 25 bp, Rattus norvegicus
agtgtattgggcagagccctcgatc

SEQ ID NO: 563267 - DNA, 25 bp, Rattus norvegicus
ctagggctaaagaaccgcgagtgta

SEQ ID NO: 563268 - DNA, 25 bp, Rattus norvegicus
cttcatcagacggaagctagggcta

SEQ ID NO: 563269 - DNA, 25 bp, Rattus norvegicus
cagcagccgagccatcttcatcaga

SEQ ID NO: 563270 - DNA, 25 bp, Rattus norvegicus
cagaaatgtgtccagcagccgagcc

SEQ ID NO: 563271 - DNA, 25 bp, Rattus norvegicus
ctgccggcgtgcagaaatgtgtcca

SEQ ID NO: 563272 - DNA, 25 bp, Rattus norvegicus
cgactttgctgagcagcgtctcctg

SEQ ID NO: 563273 - DNA, 25 bp, Rattus norvegicus
ggccgacactgctcctccatgagag

SEQ ID NO: 563274 - DNA, 25 bp, Rattus norvegicus
ctggagacggttgcccaggagatcc

SEQ ID NO: 563275 - DNA, 25 bp, Rattus norvegicus
ttgcccaggagatccggtaagccca

SEQ ID NO: 563276 - DNA, 25 bp, Rattus norvegicus
gagatccggtaagcccacgactttg

SEQ ID NO: 563277 - DNA, 25 bp, Rattus norvegicus
taagcccacgactttgctgagcagc

SEQ ID NO: 563278 - DNA, 25 bp, Rattus norvegicus
agcggccactctgccggcgtgcaga

SEQ ID NO: 563279 - DNA, 25 bp, Rattus norvegicus
aaggaaggctcctcttctgagcgtg

SEQ ID NO: 563280 - DNA, 25 bp, Rattus norvegicus
cgataccagttgtcgtccgggcgag

SEQ ID NO: 563281 - DNA, 25 bp, Rattus norvegicus
ctgcgcttgccaacccgtttctata

SEQ ID NO: 563282 - DNA, 25 bp, Rattus norvegicus
cgccacgaattccacgaagttcgct

SEQ ID NO: 563283 - DNA, 25 bp, Rattus norvegicus
cgaagagctctggttcgcccgcgat

SEQ ID NO: 563284 - DNA, 25 bp, Rattus norvegicus
gtttctatagcaacgcccggcgggc

SEQ ID NO: 563285 - DNA, 25 bp, Rattus norvegicus
gtagctgcccttgggcttctgcccg

SEQ ID NO: 563286 - DNA, 25 bp, Rattus norvegicus
agacacgtcagtcttaccacttccg

SEQ ID NO: 563287 - DNA, 25 bp, Rattus norvegicus
ggctcgttcaaatgctcctcgaaga

SEQ ID NO: 563288 - DNA, 25 bp, Rattus norvegicus
tccgcactcggctcgttcaaatgct

SEQ ID NO: 563289 - DNA, 25 bp, Rattus norvegicus
tgaggacctgacgacggacctcctc

SEQ ID NO: 563290 - DNA, 25 bp, Rattus norvegicus
ctgccctccgtaggttggagagaga

SEQ ID NO: 563291 - DNA, 25 bp, Rattus norvegicus
ccaaagaggcgccagtggcctcaca

SEQ ID NO: 563292 - DNA, 25 bp, Rattus norvegicus
ccgagccaccgaacgataccagttg

SEQ ID NO: 563293 - DNA, 25 bp, Rattus norvegicus
agtcgcgtcatgatccacccacaga

SEQ ID NO: 563294 - DNA, 25 bp, Rattus norvegicus
gctctgcggggagaatacctgcagc

SEQ ID NO: 563295 - DNA, 25 bp, Rattus norvegicus
caagagcgccttcggaggctctgcg

SEQ ID NO: 563296 - DNA, 25 bp, Rattus norvegicus
ctcagacagcgcaagagcgccttcg

SEQ ID NO: 563297 - DNA, 25 bp, Rattus norvegicus
ggtgactagagcgtcgtctccgcat

SEQ ID NO: 563298 - DNA, 25 bp, Rattus norvegicus
gctccggtgactagagcgtcgtctc

SEQ ID NO: 563299 - DNA, 25 bp, Rattus norvegicus
aaccggcgaagctccggtgactaga

SEQ ID NO: 563300 - DNA, 25 bp, Rattus norvegicus
gcgccacagagaaccggcgaagctc

SEQ ID NO: 563301 - DNA, 25 bp, Rattus norvegicus
cccaactctatggtggccaagtagg

SEQ ID NO: 563302 - DNA, 25 bp, Rattus norvegicus
tggcgctgaacgaaccccaactcta

SEQ ID NO: 563303 - DNA, 25 bp, Rattus norvegicus
tgatccacccacagactcaaacttg

SEQ ID NO: 563304 - DNA, 25 bp, Rattus norvegicus
tttggcagtcgcgtcatgatccacc

SEQ ID NO: 563305 - DNA, 25 bp, Rattus norvegicus
gcaagctttggcagtcgcgtcatga

SEQ ID NO: 563306 - DNA, 25 bp, Rattus norvegicus
agactcaaacttggcgctgaacgaa

SEQ ID NO: 563307 - DNA, 25 bp, Rattus norvegicus
gctcgcactcaacggcagacttagt

SEQ ID NO: 563308 - DNA, 25 bp, Rattus norvegicus
gactctgttacccagaaggccttgc

SEQ ID NO: 563309 - DNA, 25 bp, Rattus norvegicus
ccacggcgaggaacacttctgcttc

SEQ ID NO: 563310 - DNA, 25 bp, Rattus norvegicus
ttcccgaaacgctcaggagtgccct

SEQ ID NO: 563311 - DNA, 25 bp, Rattus norvegicus
gtgccctcggattttgtgtcagttg

SEQ ID NO: 563312 - DNA, 25 bp, Rattus norvegicus
ttgcatcctaggagttgtagtcctc

SEQ ID NO: 563313 - DNA, 25 bp, Rattus norvegicus
ttcccatcacgtctggaggcaggtc

SEQ ID NO: 563314 - DNA, 25 bp, Rattus norvegicus
gctggaacagaacaaactacttttc

SEQ ID NO: 563315 - DNA, 25 bp, Rattus norvegicus
acgtgtccagcgaactggtgttagc

SEQ ID NO: 563316 - DNA, 25 bp, Rattus norvegicus
tttaggaagagccagacgacacctg

SEQ ID NO: 563317 - DNA, 25 bp, Rattus norvegicus
agcgccctaagctagaattccttgg

SEQ ID NO: 563318 - DNA, 25 bp, Rattus norvegicus
tcgggtttgcaattagcggaatttg

SEQ ID NO: 563319 - DNA, 25 bp, Rattus norvegicus
cggaatttgttcgagtcgccctcaa

SEQ ID NO: 563320 - DNA, 25 bp, Rattus norvegicus
acttagtgtgtggactctgttaccc

SEQ ID NO: 563321 - DNA, 25 bp, Rattus norvegicus
cgaatcactgactcgcccaggtgtc

SEQ ID NO: 563322 - DNA, 25 bp, Rattus norvegicus
tggcgcttccaccttgagcttcttg

SEQ ID NO: 563323 - DNA, 25 bp, Rattus norvegicus
ccttggctcgctgcaagtgccttct

SEQ ID NO: 563324 - DNA, 25 bp, Rattus norvegicus
cgagtatgcacctgagcagagtcca

SEQ ID NO: 563325 - DNA, 25 bp, Rattus norvegicus
tcaggcagtgtgttgggcactccaa

SEQ ID NO: 563326 - DNA, 25 bp, Rattus norvegicus
tcttcgcactctcaccgcggtttgg

SEQ ID NO: 563327 - DNA, 25 bp, Rattus norvegicus
tgctgcttcagcttcggttcagaga

SEQ ID NO: 563328 - DNA, 25 bp, Rattus norvegicus
tccgggttggagacatctcaaaagc

SEQ ID NO: 563329 - DNA, 25 bp, Rattus norvegicus
caaaagccggggaacagactgcata

SEQ ID NO: 563330 - DNA, 25 bp, Rattus norvegicus
cgttgtttctttctagtcccgctga

SEQ ID NO: 563331 - DNA, 25 bp, Rattus norvegicus
tgtggaagattcagagcctcaacct

SEQ ID NO: 563332 - DNA, 25 bp, Rattus norvegicus
ttcctccagaccctgagtaatgtgg

SEQ ID NO: 563333 - DNA, 25 bp, Rattus norvegicus
ctgcgctcagggagtgccaatctcc

SEQ ID NO: 563334 - DNA, 25 bp, Rattus norvegicus
gcccaatccgtgactctggtctgtc

SEQ ID NO: 563335 - DNA, 25 bp, Rattus norvegicus
tgtccagacggcaaagcttaaaatg

SEQ ID NO: 563336 - DNA, 25 bp, Rattus norvegicus
tttccctcagcgcagacttcctaga

SEQ ID NO: 563337 - DNA, 25 bp, Rattus norvegicus
ctctacttggcgacggcggacaact

SEQ ID NO: 563338 - DNA, 25 bp, Rattus norvegicus
gagcttcggttctctcgtctgcacc

SEQ ID NO: 563339 - DNA, 25 bp, Rattus norvegicus
gctttagccagtttcggggagccac

SEQ ID NO: 563340 - DNA, 25 bp, Rattus norvegicus
cggaatcctagagtctcctcccaga

SEQ ID NO: 563341 - DNA, 25 bp, Rattus norvegicus
ccactctcgggaagtgctctacttg

SEQ ID NO: 563342 - DNA, 25 bp, Rattus norvegicus
ctgagtgtgtcaacctgtccagacg

SEQ ID NO: 563343 - DNA, 25 bp, Rattus norvegicus
ggcagcagcaaaccgcagagacgcg

SEQ ID NO: 563344 - DNA, 25 bp, Rattus norvegicus
ttaaaatgccgccactgcgcggagc

SEQ ID NO: 563345 - DNA, 25 bp, Rattus norvegicus
cccagaactgtgaaagtgacatgtg

SEQ ID NO: 563346 - DNA, 25 bp, Rattus norvegicus
tgacatgtggcctcgcgtcactctt

SEQ ID NO: 563347 - DNA, 25 bp, Rattus norvegicus
tcctcccagaccgtgactgagtgtg

SEQ ID NO: 563348 - DNA, 25 bp, Rattus norvegicus
cttcctagacgctcccgtaggcgga

SEQ ID NO: 563349 - DNA, 25 bp, Rattus norvegicus
cgggcgaacccacctactcagggag

SEQ ID NO: 563350 - DNA, 25 bp, Rattus norvegicus
tgtcgttaagtttctgttagcgccc

SEQ ID NO: 563351 - DNA, 25 bp, Rattus norvegicus
aactgcgtgtgtgtcgttaagtttc

SEQ ID NO: 563352 - DNA, 25 bp, Rattus norvegicus
cagctagagcggctccgtgccgtgt

SEQ ID NO: 563353 - DNA, 25 bp, Rattus norvegicus
tcccagtcagctagagcggctccgt

SEQ ID NO: 563354 - DNA, 25 bp, Rattus norvegicus
gccaccgagtcccagtcagctagag

SEQ ID NO: 563355 - DNA, 25 bp, Rattus norvegicus
gtgccaggacgtgcaactccggccg

SEQ ID NO: 563356 - DNA, 25 bp, Rattus norvegicus
cccacctactcagggaggaggtgcc

SEQ ID NO: 563357 - DNA, 25 bp, Rattus norvegicus
ggagagagcagtgcccgctcgctcc

SEQ ID NO: 563358 - DNA, 25 bp, Rattus norvegicus
tcggttcccacagatctttccaaag

SEQ ID NO: 563359 - DNA, 25 bp, Rattus norvegicus
ggtcaggaggaagcgctcaccacaa

SEQ ID NO: 563360 - DNA, 25 bp, Rattus norvegicus
cagcaggcccaggctaaggatcccg

SEQ ID NO: 563361 - DNA, 25 bp, Rattus norvegicus
ttcccggaagctgccagcaggccca

SEQ ID NO: 563362 - DNA, 25 bp, Rattus norvegicus
aggaggtgccaggacgtgcaactcc

SEQ ID NO: 563363 - DNA, 25 bp, Rattus norvegicus
gtcgcaaactcatgacgtctccgtg

SEQ ID NO: 563364 - DNA, 25 bp, Rattus norvegicus
cgctgtcagcgctgaaagtggctcc

SEQ ID NO: 563365 - DNA, 25 bp, Rattus norvegicus
cggatatttccgacgggcgctgtca

SEQ ID NO: 563366 - DNA, 25 bp, Rattus norvegicus
cccggaggcgctcggatatttccga

SEQ ID NO: 563367 - DNA, 25 bp, Rattus norvegicus
aaagcgcggcgccagttctcaggtg

SEQ ID NO: 563368 - DNA, 25 bp, Rattus norvegicus
ttgggaccgcgttccgctcacaaag

SEQ ID NO: 563369 - DNA, 25 bp, Rattus norvegicus
ccaaagcacgcatggggttgggacc

SEQ ID NO: 563370 - DNA, 25 bp, Rattus norvegicus
acttctggtcccaaagcacgcatgg

SEQ ID NO: 563371 - DNA, 25 bp, Rattus norvegicus
aagcgtgaacttctggtcccaaagc

SEQ ID NO: 563372 - DNA, 25 bp, Rattus norvegicus
gctgcaaccgggaagcgtgaacttc

SEQ ID NO: 563373 - DNA, 25 bp, Rattus norvegicus
gtcagcgctgaaagtggctccggac

SEQ ID NO: 563374 - DNA, 25 bp, Rattus norvegicus
ctcatgacgtctccgtgcgtcagga

SEQ ID NO: 563375 - DNA, 25 bp, Rattus norvegicus
gagtgcttgcctggatggaagtccg

SEQ ID NO: 563376 - DNA, 25 bp, Rattus norvegicus
acgtctccgtgcgtcaggagcgcgc

SEQ ID NO: 563377 - DNA, 25 bp, Rattus norvegicus
gggactgccaggcaatggcttcgta

SEQ ID NO: 563378 - DNA, 25 bp, Rattus norvegicus
cacacttgtgctgcatctggcgcta

SEQ ID NO: 563379 - DNA, 25 bp, Rattus norvegicus
gcagtgtactacgtgtgcgcgctca

SEQ ID NO: 563380 - DNA, 25 bp, Rattus norvegicus
gcgtgtgtcaattgtgccacccatc

SEQ ID NO: 563381 - DNA, 25 bp, Rattus norvegicus
gctcatctgagcctggagaccctga

SEQ ID NO: 563382 - DNA, 25 bp, Rattus norvegicus
tgactgccttcgtcctgccttttgg

SEQ ID NO: 563383 - DNA, 25 bp, Rattus norvegicus
catcgtactggcctttggcttgctc

SEQ ID NO: 563384 - DNA, 25 bp, Rattus norvegicus
tcaatctcctacaggcggtggccgc

SEQ ID NO: 563385 - DNA, 25 bp, Rattus norvegicus
cgctggaactacagccttggctttc

SEQ ID NO: 563386 - DNA, 25 bp, Rattus norvegicus
tttagttccagcgtcaacccggtgc

SEQ ID NO: 563387 - DNA, 25 bp, Rattus norvegicus
aacccggtgctctacgtctttactg

SEQ ID NO: 563388 - DNA, 25 bp, Rattus norvegicus
tctttactgcgggtgatttgctgcc

SEQ ID NO: 563389 - DNA, 25 bp, Rattus norvegicus
ctcgactcttcgaaggctctgggga

SEQ ID NO: 563390 - DNA, 25 bp, Rattus norvegicus
gcggccactagcagccacacttgtg

SEQ ID NO: 563391 - DNA, 25 bp, Rattus norvegicus
tctgctctttgaagccatcacgggc

SEQ ID NO: 563392 - DNA, 25 bp, Rattus norvegicus
tctgcgactcgaggtatcccagcga

SEQ ID NO: 563393 - DNA, 25 bp, Rattus norvegicus
cccagcgacgggcataaagtctttc

SEQ ID NO: 563394 - DNA, 25 bp, Rattus norvegicus
ttcgtagtcaagctgctcgagggca

SEQ ID NO: 563395 - DNA, 25 bp, Rattus norvegicus
tggccttcctgagcagcagcgtgaa

SEQ ID NO: 563396 - DNA, 25 bp, Rattus norvegicus
cgctacgtgctgatcgcgctggcct

SEQ ID NO: 563397 - DNA, 25 bp, Rattus norvegicus
gcagcgtctgaagctggcccgctac

SEQ ID NO: 563398 - DNA, 25 bp, Rattus norvegicus
ctgggacaagaacagccctgctggg

SEQ ID NO: 563399 - DNA, 25 bp, Rattus norvegicus
tgaacctggtggaagctggccgcac

SEQ ID NO: 563400 - DNA, 25 bp, Rattus norvegicus
ctggctgccttatcacctggtgaac

SEQ ID NO: 563401 - DNA, 25 bp, Rattus norvegicus
ggtggtgctcattatcctggccttc

SEQ ID NO: 563402 - DNA, 25 bp, Rattus norvegicus
ctactctgacatcgggcgcaggctg

SEQ ID NO: 563403 - DNA, 25 bp, Rattus norvegicus
gtggtggccagctactctgacatcg

SEQ ID NO: 563404 - DNA, 25 bp, Rattus norvegicus
gcactggctccgaggtgtccagcac

SEQ ID NO: 563405 - DNA, 25 bp, Rattus norvegicus
cctgagagaaggttctcgtccagta

SEQ ID NO: 563406 - DNA, 25 bp, Rattus norvegicus
ggggcccacctccaggtcagcgcat

SEQ ID NO: 563407 - DNA, 25 bp, Rattus norvegicus
tgacgcaccattgagcctgagagaa

SEQ ID NO: 563408 - DNA, 25 bp, Rattus norvegicus
cgcctttgcccacaaatcctaggtt

SEQ ID NO: 563409 - DNA, 25 bp, Rattus norvegicus
gcgattccatgactgcgcgtggaca

SEQ ID NO: 563410 - DNA, 25 bp, Rattus norvegicus
aggtcagcgcatcctctgtctccca

SEQ ID NO: 563411 - DNA, 25 bp, Rattus norvegicus
actgcgcgtggacagcgtgtccagc

SEQ ID NO: 563412 - DNA, 25 bp, Rattus norvegicus
ccattgagcctgagagaaggttctc

SEQ ID NO: 563413 - DNA, 25 bp, Rattus norvegicus
gatcgatgacgcaccattgagcctg

SEQ ID NO: 563414 - DNA, 25 bp, Rattus norvegicus
ccacgagagagatcgatgacgcacc

SEQ ID NO: 563415 - DNA, 25 bp, Rattus norvegicus
tcttcagagcccacgagagagatcg

SEQ ID NO: 563416 - DNA, 25 bp, Rattus norvegicus
ccagttcttcagagcccacgagaga

SEQ ID NO: 563417 - DNA, 25 bp, Rattus norvegicus
atcctaggttctccagttcttcaga

SEQ ID NO: 563418 - DNA, 25 bp, Rattus norvegicus
gtctcccaagctctgcgattccatg

SEQ ID NO: 563419 - DNA, 25 bp, Rattus norvegicus
ccagattcagtgtcagcggaaggca

SEQ ID NO: 563420 - DNA, 25 bp, Rattus norvegicus
gctggtgactgcagcatctgcgcct

SEQ ID NO: 563421 - DNA, 25 bp, Rattus norvegicus
agggactaaccagcggcgcgccgac

SEQ ID NO: 563422 - DNA, 25 bp, Rattus norvegicus
ttatggctagggactaaccagcggc

SEQ ID NO: 563423 - DNA, 25 bp, Rattus norvegicus
cctacttatggctagggactaacca

SEQ ID NO: 563424 - DNA, 25 bp, Rattus norvegicus
cgacgcgctggtgactgcagcatct

SEQ ID NO: 563425 - DNA, 25 bp, Rattus norvegicus
aggaccacgcgccagattcagtgtc

SEQ ID NO: 563426 - DNA, 25 bp, Rattus norvegicus
gtcagcggaaggcagccttgagtcc

SEQ ID NO: 563427 - DNA, 25 bp, Rattus norvegicus
gccttgagtccaagtcgcagacctc

SEQ ID NO: 563428 - DNA, 25 bp, Rattus norvegicus
agtcgcagacctcacgcgaaactta

SEQ ID NO: 563429 - DNA, 25 bp, Rattus norvegicus
cacgcgaaacttacaggaatattta

SEQ ID NO: 563430 - DNA, 25 bp, Rattus norvegicus
ggaatatttagaatttctggggcca

SEQ ID NO: 563431 - DNA, 25 bp, Rattus norvegicus
tttctggggccaatacctacttatg

SEQ ID NO: 563432 - DNA, 25 bp, Rattus norvegicus
gattcgccacagcaccaggaccacg

SEQ ID NO: 563433 - DNA, 25 bp, Rattus norvegicus
tggctcccgagtgtttgtaaacgtc

SEQ ID NO: 563434 - DNA, 25 bp, Rattus norvegicus
gcttgtagccggagctgcgccgcac

SEQ ID NO: 563435 - DNA, 25 bp, Rattus norvegicus
cgcctggctcccgagtgtttgtaaa

SEQ ID NO: 563436 - DNA, 25 bp, Rattus norvegicus
tcattagagtaatgggcgcggtccc

SEQ ID NO: 563437 - DNA, 25 bp, Rattus norvegicus
gcagagcctgtttctcattagagta

SEQ ID NO: 563438 - DNA, 25 bp, Rattus norvegicus
agctgcgccgcacgtcattggggtc

SEQ ID NO: 563439 - DNA, 25 bp, Rattus norvegicus
ggcttggcctcggaacattcttctc

SEQ ID NO: 563440 - DNA, 25 bp, Rattus norvegicus
tcaaaccaggccctctcccggcttg

SEQ ID NO: 563441 - DNA, 25 bp, Rattus norvegicus
atgtaacctgagaagaaccgaaggg

SEQ ID NO: 563442 - DNA, 25 bp, Rattus norvegicus
gaagccggacgggaatgtaacctga

SEQ ID NO: 563443 - DNA, 25 bp, Rattus norvegicus
cctcctgctccgaggtgaagccgga

SEQ ID NO: 563444 - DNA, 25 bp, Rattus norvegicus
agtgtttgtaaacgtctgacccgag

SEQ ID NO: 563445 - DNA, 25 bp, Rattus norvegicus
tcggaacattcttctctcccgacgg

SEQ ID NO: 563446 - DNA, 25 bp, Rattus norvegicus
ccctaaccgtgagttcctcctgctc

SEQ ID NO: 563447 - DNA, 25 bp, Rattus norvegicus
cggctaggccgactgtctctgggat

SEQ ID NO: 563448 - DNA, 25 bp, Rattus norvegicus
cctgtctggccgcaatgagaggcag

SEQ ID NO: 563449 - DNA, 25 bp, Rattus norvegicus
ttctgtatacgcgatgcctggggct

SEQ ID NO: 563450 - DNA, 25 bp, Rattus norvegicus
tggccctagagtttaaggctttaga

SEQ ID NO: 563451 - DNA, 25 bp, Rattus norvegicus
tttaaggctttagaacctatgcctg

SEQ ID NO: 563452 - DNA, 25 bp, Rattus norvegicus
aggctttagaacctatgcctggttc

SEQ ID NO: 563453 - DNA, 25 bp, Rattus norvegicus
cctatgcctggttctgtatacgcga

SEQ ID NO: 563454 - DNA, 25 bp, Rattus norvegicus
atgcctggttctgtatacgcgatgc

SEQ ID NO: 563455 - DNA, 25 bp, Rattus norvegicus
caatgagaggcagatggcggggaag

SEQ ID NO: 563456 - DNA, 25 bp, Rattus norvegicus
tggttctgtatacgcgatgcctggg

SEQ ID NO: 563457 - DNA, 25 bp, Rattus norvegicus
tgtctggccgcaatgagaggcagat

SEQ ID NO: 563458 - DNA, 25 bp, Rattus norvegicus
gcggcggccgccgcttgcacgaaat

SEQ ID NO: 563459 - DNA, 25 bp, Rattus norvegicus
gccgcttgcacgaaatccgcgctgc

SEQ ID NO: 563460 - DNA, 25 bp, Rattus norvegicus
cctggttctgtatacgcgatgcctg

SEQ ID NO: 563461 - DNA, 25 bp, Rattus norvegicus
cccggaggatccgtggagcctatat

SEQ ID NO: 563462 - DNA, 25 bp, Rattus norvegicus
cccgggcttctcctaggccatggac

SEQ ID NO: 563463 - DNA, 25 bp, Rattus norvegicus
gcggcgctattccagttccggaacc

SEQ ID NO: 563464 - DNA, 25 bp, Rattus norvegicus
caagcggcgctattccagttccgga

SEQ ID NO: 563465 - DNA, 25 bp, Rattus norvegicus
ttctccctgcggcaagcggcgctat

SEQ ID NO: 563466 - DNA, 25 bp, Rattus norvegicus
gctcctgggcccatcccagcctccc

SEQ ID NO: 563467 - DNA, 25 bp, Rattus norvegicus
tggctacttctcagcgctcctgggc

SEQ ID NO: 563468 - DNA, 25 bp, Rattus norvegicus
aggatagctggctacttctcagcgc

SEQ ID NO: 563469 - DNA, 25 bp, Rattus norvegicus
ccagaggatagctggctacttctca

SEQ ID NO: 563470 - DNA, 25 bp, Rattus norvegicus
ccgagcgccagaggatagctggcta

SEQ ID NO: 563471 - DNA, 25 bp, Rattus norvegicus
atggtccaagctccggaggccgagc

SEQ ID NO: 563472 - DNA, 25 bp, Rattus norvegicus
ctatatggtccaagctccggaggcc

SEQ ID NO: 563473 - DNA, 25 bp, Rattus norvegicus
tccgtggagcctatatggtccaagc

SEQ ID NO: 563474 - DNA, 25 bp, Rattus norvegicus
ctcctaggccatggaccccggagga

SEQ ID NO: 563475 - DNA, 25 bp, Rattus norvegicus
agtgactccaaacccactacgcggt

SEQ ID NO: 563476 - DNA, 25 bp, Rattus norvegicus
cgcttcccggcgcttgggagctgaa

SEQ ID NO: 563477 - DNA, 25 bp, Rattus norvegicus
aactctcggctttggcggtaggcgc

SEQ ID NO: 563478 - DNA, 25 bp, Rattus norvegicus
agagggcgaaactctcggctttggc

SEQ ID NO: 563479 - DNA, 25 bp, Rattus norvegicus
gccctcctaggttcgggctcccatc

SEQ ID NO: 563480 - DNA, 25 bp, Rattus norvegicus
acgcggtgttgacgagagaagtcta

SEQ ID NO: 563481 - DNA, 25 bp, Rattus norvegicus
ctccaaacccactacgcggtgttga

SEQ ID NO: 563482 - DNA, 25 bp, Rattus norvegicus
ggggaggagtcgagctgactccgcc

SEQ ID NO: 563483 - DNA, 25 bp, Rattus norvegicus
ttgccctgagcccaggccagtgcag

SEQ ID NO: 563484 - DNA, 25 bp, Rattus norvegicus
gtcgctcggctgcaggacagcaggc

SEQ ID NO: 563485 - DNA, 25 bp, Rattus norvegicus
gtgagtgttggtgacccggtaggcc

SEQ ID NO: 563486 - DNA, 25 bp, Rattus norvegicus
gcacctagaagagagggcgaaactc

SEQ ID NO: 563487 - DNA, 25 bp, Rattus norvegicus
cccactacgcggtgttgacgagaga

SEQ ID NO: 563488 - DNA, 25 bp, Rattus norvegicus
cgaaactctcggctttggcggtagg

SEQ ID NO: 563489 - DNA, 25 bp, Rattus norvegicus
tgcgactgtactggactggccacgc

SEQ ID NO: 563490 - DNA, 25 bp, Rattus norvegicus
tgttccgtcacctcccagtaattta

SEQ ID NO: 563491 - DNA, 25 bp, Rattus norvegicus
gtcaccgaacgcagtcaaaacactg

SEQ ID NO: 563492 - DNA, 25 bp, Rattus norvegicus
atcacctcagtagggcgggacatcc

SEQ ID NO: 563493 - DNA, 25 bp, Rattus norvegicus
gggcgctccttataagggcatagtg

SEQ ID NO: 563494 - DNA, 25 bp, Rattus norvegicus
ggcttctattagtcttccttcgaga

SEQ ID NO: 563495 - DNA, 25 bp, Rattus norvegicus
cagagcccgactgcggcttctatta

SEQ ID NO: 563496 - DNA, 25 bp, Rattus norvegicus
agagtccgggcttccctcagcgtaa

SEQ ID NO: 563497 - DNA, 25 bp, Rattus norvegicus
cggcgaaccgcaggcaacagaaaac

SEQ ID NO: 563498 - DNA, 25 bp, Rattus norvegicus
tcgatcgtgcgcgtgtgaaacaccg

SEQ ID NO: 563499 - DNA, 25 bp, Rattus norvegicus
ccaggtgagagatctgctgcgccac

SEQ ID NO: 563500 - DNA, 25 bp, Rattus norvegicus
cctcgtgcataatcaccaggtgaga

SEQ ID NO: 563501 - DNA, 25 bp, Rattus norvegicus
gtcaggaatggctttgccgtccacc

SEQ ID NO: 563502 - DNA, 25 bp, Rattus norvegicus
cgggacatcctcacctcaggctgtg

SEQ ID NO: 563503 - DNA, 25 bp, Rattus norvegicus
cacgcctgcgcgagatttaaatacc

SEQ ID NO: 563504 - DNA, 25 bp, Rattus norvegicus
catagtgacggggagctagcacgcc

SEQ ID NO: 563505 - DNA, 25 bp, Rattus norvegicus
cgcgaatttcagtaggtgcaccctc

SEQ ID NO: 563506 - DNA, 25 bp, Rattus norvegicus
aggagttgtagtaatagcgaaggac

SEQ ID NO: 563507 - DNA, 25 bp, Rattus norvegicus
gcgaaggactataagtttctctggg

SEQ ID NO: 563508 - DNA, 25 bp, Rattus norvegicus
tacgcgtctcacctcacgcgaattt

SEQ ID NO: 563509 - DNA, 25 bp, Rattus norvegicus
gaaaccagcacaactctagaccgca

SEQ ID NO: 563510 - DNA, 25 bp, Rattus norvegicus
tctagaccgcaaagcgctgggcgct

SEQ ID NO: 563511 - DNA, 25 bp, Rattus norvegicus
aagcgctgggcgcttgtccagtatc

SEQ ID NO: 563512 - DNA, 25 bp, Rattus norvegicus
cttgtccagtatcggggcggccgca

SEQ ID NO: 563513 - DNA, 25 bp, Rattus norvegicus
cggccgcaccgtggaattcgtattc

SEQ ID NO: 563514 - DNA, 25 bp, Rattus norvegicus
gagatttaaataccggacgcgacta

SEQ ID NO: 563515 - DNA, 25 bp, Rattus norvegicus
gagtgcaggaaggatccgctcttaa

SEQ ID NO: 563516 - DNA, 25 bp, Rattus norvegicus
ggatccgctcttaaagaaaccagca

SEQ ID NO: 563517 - DNA, 25 bp, Rattus norvegicus
tgcttgggtggaagcgtttcccacc

SEQ ID NO: 563518 - DNA, 25 bp, Rattus norvegicus
tcccacttccaatagctgttttctt

SEQ ID NO: 563519 - DNA, 25 bp, Rattus norvegicus
gttcccacttccaatagctgttttc

SEQ ID NO: 563520 - DNA, 25 bp, Rattus norvegicus
tgggttcccacttccaatagctgtt

SEQ ID NO: 563521 - DNA, 25 bp, Rattus norvegicus
ctgggttcccacttccaatagctgt

SEQ ID NO: 563522 - DNA, 25 bp, Rattus norvegicus
actgggttcccacttccaatagctg

SEQ ID NO: 563523 - DNA, 25 bp, Rattus norvegicus
gtactgggttcccacttccaatagc

SEQ ID NO: 563524 - DNA, 25 bp, Rattus norvegicus
tgtaagtacgcttaggtagatgggt

SEQ ID NO: 563525 - DNA, 25 bp, Rattus norvegicus
tgtgcttgggtggaagcgtttccca

SEQ ID NO: 563526 - DNA, 25 bp, Rattus norvegicus
tttcctgccctgtatttaagtgtgc

SEQ ID NO: 563527 - DNA, 25 bp, Rattus norvegicus
gtttcctgccctgtatttaagtgtg

SEQ ID NO: 563528 - DNA, 25 bp, Rattus norvegicus
acgcttaggtagatgggtttcctgc

SEQ ID NO: 563529 - DNA, 25 bp, Rattus norvegicus
tacgcttaggtagatgggtttcctg

SEQ ID NO: 563530 - DNA, 25 bp, Rattus norvegicus
tactgggttcccacttccaatagct

SEQ ID NO: 563531 - DNA, 25 bp, Rattus norvegicus
cgcgtgccactgttgttgcgcaacc

SEQ ID NO: 563532 - DNA, 25 bp, Rattus norvegicus
tagtcgccagatccgccctaaagca

SEQ ID NO: 563533 - DNA, 25 bp, Rattus norvegicus
ccagccaggtatcaagaggagtccc

SEQ ID NO: 563534 - DNA, 25 bp, Rattus norvegicus
gcgcactcgggtttcctatcccagg

SEQ ID NO: 563535 - DNA, 25 bp, Rattus norvegicus
cgtccctggtgcagtgaactgtgtc

SEQ ID NO: 563536 - DNA, 25 bp, Rattus norvegicus
ttgcttctgcaacgccaacatcttc

SEQ ID NO: 563537 - DNA, 25 bp, Rattus norvegicus
cggcagccgccaccaaaagttcaga

SEQ ID NO: 563538 - DNA, 25 bp, Rattus norvegicus
cgcgctaaagcaacgcgcatcttca

SEQ ID NO: 563539 - DNA, 25 bp, Rattus norvegicus
caacaggccagcatccggtgtctta

SEQ ID NO: 563540 - DNA, 25 bp, Rattus norvegicus
acatcgtttgccagcgggttggacc

SEQ ID NO: 563541 - DNA, 25 bp, Rattus norvegicus
gggttggaccaccagccacagtatg

SEQ ID NO: 563542 - DNA, 25 bp, Rattus norvegicus
gtgagaaccttagacgaccatcgga

SEQ ID NO: 563543 - DNA, 25 bp, Rattus norvegicus
ttgcgcaaccggcagaacctagtcg

SEQ ID NO: 563544 - DNA, 25 bp, Rattus norvegicus
cgggtgcgttatatctccacgtcta

SEQ ID NO: 563545 - DNA, 25 bp, Rattus norvegicus
gttcagaccgcttcgaccagtgata

SEQ ID NO: 563546 - DNA, 25 bp, Rattus norvegicus
gcgcctggggcacatgcaaactaca

SEQ ID NO: 563547 - DNA, 25 bp, Rattus norvegicus
cctccaatgactcctgggaaatgta

SEQ ID NO: 563548 - DNA, 25 bp, Rattus norvegicus
taaagtcacctttgagcaggcccgg

SEQ ID NO: 563549 - DNA, 25 bp, Rattus norvegicus
ttccacgaagacacagcggttcaga

SEQ ID NO: 563550 - DNA, 25 bp, Rattus norvegicus
caccagttaccgttccacgaagaca

SEQ ID NO: 563551 - DNA, 25 bp, Rattus norvegicus
ccataaacgttgctaggggttgcgc

SEQ ID NO: 563552 - DNA, 25 bp, Rattus norvegicus
ggacgggcttctcagctcctttcgc

SEQ ID NO: 563553 - DNA, 25 bp, Rattus norvegicus
cctctcaggaaacaggcggcggacg

SEQ ID NO: 563554 - DNA, 25 bp, Rattus norvegicus
gctcggaagaacaaagcgggcttaa

SEQ ID NO: 563555 - DNA, 25 bp, Rattus norvegicus
atctctcgggtgctcggaagaacaa

SEQ ID NO: 563556 - DNA, 25 bp, Rattus norvegicus
cccttgagaagcgatctctcgggtg

SEQ ID NO: 563557 - DNA, 25 bp, Rattus norvegicus
cggagcacgtctcccgggacagaaa

SEQ ID NO: 563558 - DNA, 25 bp, Rattus norvegicus
gcaggcccggcatttacgaaagagc

SEQ ID NO: 563559 - DNA, 25 bp, Rattus norvegicus
ctccgaggaaaggatcatccgaccc

SEQ ID NO: 563560 - DNA, 25 bp, Rattus norvegicus
tggagaggtcaactttgtctgcgcg

SEQ ID NO: 563561 - DNA, 25 bp, Rattus norvegicus
tgcgctggagaggtcaactttgtct

SEQ ID NO: 563562 - DNA, 25 bp, Rattus norvegicus
atgaccttcgctgaaactttgctca

SEQ ID NO: 563563 - DNA, 25 bp, Rattus norvegicus
ggccatgaccttcgctgaaactttg

SEQ ID NO: 563564 - DNA, 25 bp, Rattus norvegicus
gtcccgggtggccatgaccttcgct

SEQ ID NO: 563565 - DNA, 25 bp, Rattus norvegicus
aggctgtctgacagcccgaggaccc

SEQ ID NO: 563566 - DNA, 25 bp, Rattus norvegicus
cccaggaggctgtctgacagcccga

SEQ ID NO: 563567 - DNA, 25 bp, Rattus norvegicus
tcatccgaccccaggaagggccagg

SEQ ID NO: 563568 - DNA, 25 bp, Rattus norvegicus
gggctccgaggaaaggatcatccga

SEQ ID NO: 563569 - DNA, 25 bp, Rattus norvegicus
aagcacagaggctggaacgctggct

SEQ ID NO: 563570 - DNA, 25 bp, Rattus norvegicus
ccggaagcacagaggctggaacgct

SEQ ID NO: 563571 - DNA, 25 bp, Rattus norvegicus
ctctcccggaagcacagaggctgga

SEQ ID NO: 563572 - DNA, 25 bp, Rattus norvegicus
atctccaagcaggtgcgtgggtgcc

SEQ ID NO: 563573 - DNA, 25 bp, Rattus norvegicus
gctgttcttgtggagtttggtcctc

SEQ ID NO: 563574 - DNA, 25 bp, Rattus norvegicus
ctgacgaggagacgccgctgctgaa

SEQ ID NO: 563575 - DNA, 25 bp, Rattus norvegicus
ggcaacctgacgaggagacgccgct

SEQ ID NO: 563576 - DNA, 25 bp, Rattus norvegicus
tgcttcgaaggacggggcaacctga

SEQ ID NO: 563577 - DNA, 25 bp, Rattus norvegicus
ccgctgcttcgaaggacggggcaac

SEQ ID NO: 563578 - DNA, 25 bp, Rattus norvegicus
ttggtccggccgagatcgcgatgac

SEQ ID NO: 563579 - DNA, 25 bp, Rattus norvegicus
gaaagtgtcttggtccggccgagat

SEQ ID NO: 563580 - DNA, 25 bp, Rattus norvegicus
tctaagaaagtgtcttggtccggcc

SEQ ID NO: 563581 - DNA, 25 bp, Rattus norvegicus
ggccatggccaacgtttctaagaaa

SEQ ID NO: 563582 - DNA, 25 bp, Rattus norvegicus
cgtcctgggtcacgtgggcaccgat

SEQ ID NO: 563583 - DNA, 25 bp, Rattus norvegicus
tggagtttggtcctcagtgggccat

SEQ ID NO: 563584 - DNA, 25 bp, Rattus norvegicus
cgtgggcaccgatggtagatcatgt

SEQ ID NO: 563585 - DNA, 25 bp, Rattus norvegicus
gcgcttacggacctcaccggcctcc

SEQ ID NO: 563586 - DNA, 25 bp, Rattus norvegicus
ctcagtgggccatggccaacgtttc

SEQ ID NO: 563587 - DNA, 25 bp, Rattus norvegicus
gcagtgcacacacgtcatcgttgac

SEQ ID NO: 563588 - DNA, 25 bp, Rattus norvegicus
aagaattacgatcccatgtcgccgg

SEQ ID NO: 563589 - DNA, 25 bp, Rattus norvegicus
agttccagtgaactcgtcctgccga

SEQ ID NO: 563590 - DNA, 25 bp, Rattus norvegicus
catcgttgacagtgctgacgtcctg

SEQ ID NO: 563591 - DNA, 25 bp, Rattus norvegicus
ctgacgtcctgagccggtgtcatct

SEQ ID NO: 563592 - DNA, 25 bp, Rattus norvegicus
gccggtgtcatctgaactccatcca

SEQ ID NO: 563593 - DNA, 25 bp, Rattus norvegicus
tccagaagaacgatgtccagatagc

SEQ ID NO: 563594 - DNA, 25 bp, Rattus norvegicus
tgtccagatagcaaacccagccttc

SEQ ID NO: 563595 - DNA, 25 bp, Rattus norvegicus
aacccagccttcatcgaggactcgg

SEQ ID NO: 563596 - DNA, 25 bp, Rattus norvegicus
atcgaggactcggtcagacagcgca

SEQ ID NO: 563597 - DNA, 25 bp, Rattus norvegicus
ctcctggatgtgaagaattacgatc

SEQ ID NO: 563598 - DNA, 25 bp, Rattus norvegicus
ggcagcgcctccagctgaaaagatc

SEQ ID NO: 563599 - DNA, 25 bp, Rattus norvegicus
ccagctgaaaagatcagttccagtg

SEQ ID NO: 563600 - DNA, 25 bp, Rattus norvegicus
gtcagacagcgcagactcctggatg

SEQ ID NO: 563601 - DNA, 25 bp, Rattus norvegicus
gctggcttctcccactgtcgagtca

SEQ ID NO: 563602 - DNA, 25 bp, Rattus norvegicus
aggcagcgttcttcctcagaaagcc

SEQ ID NO: 563603 - DNA, 25 bp, Rattus norvegicus
cagcctagaaggatggtgccggtcc

SEQ ID NO: 563604 - DNA, 25 bp, Rattus norvegicus
cctttgcaggattggccactctgtg

SEQ ID NO: 563605 - DNA, 25 bp, Rattus norvegicus
atccgagactcgacgcccacaattg

SEQ ID NO: 563606 - DNA, 25 bp, Rattus norvegicus
gaaggacgcagccaccaagggaacg

SEQ ID NO: 563607 - DNA, 25 bp, Rattus norvegicus
cgagtcacgccgcagaagcggatta

SEQ ID NO: 563608 - DNA, 25 bp, Rattus norvegicus
gcggtttttcgcgttggtttgcaca

SEQ ID NO: 563609 - DNA, 25 bp, Rattus norvegicus
cggcggctactgaggaaaacatgag

SEQ ID NO: 563610 - DNA, 25 bp, Rattus norvegicus
tggccgcgctagttatgtcagttcc

SEQ ID NO: 563611 - DNA, 25 bp, Rattus norvegicus
tgtcagttccggacaacattggccg

SEQ ID NO: 563612 - DNA, 25 bp, Rattus norvegicus
caacattggccgatctcccgaggtg

SEQ ID NO: 563613 - DNA, 25 bp, Rattus norvegicus
acgcggaacagcctggaacagccta

SEQ ID NO: 563614 - DNA, 25 bp, Rattus norvegicus
ggccactctgtgtgtcaatccgaga

SEQ ID NO: 563615 - DNA, 25 bp, Rattus norvegicus
cccgcggtggccgaatgctcaaaat

SEQ ID NO: 563616 - DNA, 25 bp, Rattus norvegicus
gtgtacccacgtctccacatatagc

SEQ ID NO: 563617 - DNA, 25 bp, Rattus norvegicus
gcccagcacctagcaaggaccgatg

SEQ ID NO: 563618 - DNA, 25 bp, Rattus norvegicus
ctcggtcgcggttgatgaaaacctc

SEQ ID NO: 563619 - DNA, 25 bp, Rattus norvegicus
atgaaaacctcgctgggctcgccgt

SEQ ID NO: 563620 - DNA, 25 bp, Rattus norvegicus
cgcttgaagtcctcctccgtgatgt

SEQ ID NO: 563621 - DNA, 25 bp, Rattus norvegicus
cgccgggcttgaggaaactcttgat

SEQ ID NO: 563622 - DNA, 25 bp, Rattus norvegicus
ctcttgatgtcaatggtgaagccca

SEQ ID NO: 563623 - DNA, 25 bp, Rattus norvegicus
tgaagcccatctcctcgtccgggtg

SEQ ID NO: 563624 - DNA, 25 bp, Rattus norvegicus
aaggcgagccggatttttctcaata

SEQ ID NO: 563625 - DNA, 25 bp, Rattus norvegicus
atacgtacttgcttcaggtttcctc

SEQ ID NO: 563626 - DNA, 25 bp, Rattus norvegicus
gcccgtacccgcgaactgtttgcta

SEQ ID NO: 563627 - DNA, 25 bp, Rattus norvegicus
tggataccgcctagacgtctgtgta

SEQ ID NO: 563628 - DNA, 25 bp, Rattus norvegicus
ctcaaaatggcgctgcttcaaactg

SEQ ID NO: 563629 - DNA, 25 bp, Rattus norvegicus
aaaacgctgcgggacctaagctgcc

SEQ ID NO: 563630 - DNA, 25 bp, Rattus norvegicus
cgccagaccgaagggccaaagggct

SEQ ID NO: 563631 - DNA, 25 bp, Rattus norvegicus
ctttacctctcaggccgcaagcgaa

SEQ ID NO: 563632 - DNA, 25 bp, Rattus norvegicus
aggccgcaagcgaagccgcccagga

SEQ ID NO: 563633 - DNA, 25 bp, Rattus norvegicus
ttgcgccgcacaaacaactacgctc

SEQ ID NO: 563634 - DNA, 25 bp, Rattus norvegicus
cgtccagtaccgtcttcagcgctgg

SEQ ID NO: 563635 - DNA, 25 bp, Rattus norvegicus
gtaccgtcttcagcgctggtgagga

SEQ ID NO: 563636 - DNA, 25 bp, Rattus norvegicus
cttctttcaggacccttctccgtga

SEQ ID NO: 563637 - DNA, 25 bp, Rattus norvegicus
caggacccttctccgtgaggtagtc

SEQ ID NO: 563638 - DNA, 25 bp, Rattus norvegicus
tagtcactgcggctgtccgtaagcc

SEQ ID NO: 563639 - DNA, 25 bp, Rattus norvegicus
ttctccgtgaggtagtcactgcggc

SEQ ID NO: 563640 - DNA, 25 bp, Rattus norvegicus
ttaaaagctgcgacaggcgagagcg

SEQ ID NO: 563641 - DNA, 25 bp, Rattus norvegicus
cggctgtccgtaagccgtgggccac

SEQ ID NO: 563642 - DNA, 25 bp, Rattus norvegicus
caggcgagagcgaaagagaaaacgc

SEQ ID NO: 563643 - DNA, 25 bp, Rattus norvegicus
ctctgccagaggagagacgaggcct

SEQ ID NO: 563644 - DNA, 25 bp, Rattus norvegicus
tgcaactctgccagaggagagacga

SEQ ID NO: 563645 - DNA, 25 bp, Rattus norvegicus
ccctgcaactctgccagaggagaga

SEQ ID NO: 563646 - DNA, 25 bp, Rattus norvegicus
caacctagactgtctgaactcgacc

SEQ ID NO: 563647 - DNA, 25 bp, Rattus norvegicus
aactctgccagaggagagacgaggc

SEQ ID NO: 563648 - DNA, 25 bp, Rattus norvegicus
ccctgcaacctagactgtctgaact

SEQ ID NO: 563649 - DNA, 25 bp, Rattus norvegicus
tgccagaggagagacgaggcctcta

SEQ ID NO: 563650 - DNA, 25 bp, Rattus norvegicus
ccagaggagagacgaggcctctatg

SEQ ID NO: 563651 - DNA, 25 bp, Rattus norvegicus
gaggagagacgaggcctctatgtcc

SEQ ID NO: 563652 - DNA, 25 bp, Rattus norvegicus
agagacgaggcctctatgtcccggc

SEQ ID NO: 563653 - DNA, 25 bp, Rattus norvegicus
gacgaggcctctatgtcccggcatc

SEQ ID NO: 563654 - DNA, 25 bp, Rattus norvegicus
ccgctaacggcgtgcgcgcctagat

SEQ ID NO: 563655 - DNA, 25 bp, Rattus norvegicus
cgctaacggcgtgcgcgcctagatt

SEQ ID NO: 563656 - DNA, 25 bp, Rattus norvegicus
tgcaacctagactgtctgaactcga

SEQ ID NO: 563657 - DNA, 25 bp, Rattus norvegicus
ggacgccaggcctcggcctccagac

SEQ ID NO: 563658 - DNA, 25 bp, Rattus norvegicus
gtgcaggcgcttccaccttgcctgg

SEQ ID NO: 563659 - DNA, 25 bp, Rattus norvegicus
ggaagggtgtccctcctccgccatg

SEQ ID NO: 563660 - DNA, 25 bp, Rattus norvegicus
cgggaggagatgtcggcctccattt

SEQ ID NO: 563661 - DNA, 25 bp, Rattus norvegicus
ggcctccattttgtgggatctgttg

SEQ ID NO: 563662 - DNA, 25 bp, Rattus norvegicus
gtacgcctcgcgcttcggcctttgg

SEQ ID NO: 563663 - DNA, 25 bp, Rattus norvegicus
ggagaacttgggacccatcagaacc

SEQ ID NO: 563664 - DNA, 25 bp, Rattus norvegicus
agatgtcggcctccattttgtggga

SEQ ID NO: 563665 - DNA, 25 bp, Rattus norvegicus
ccatcagaaccgaaaccgtggggat

SEQ ID NO: 563666 - DNA, 25 bp, Rattus norvegicus
cgaaaccgtggggatgagaaacttg

SEQ ID NO: 563667 - DNA, 25 bp, Rattus norvegicus
gatcgcgctctaccgtaggccttgc

SEQ ID NO: 563668 - DNA, 25 bp, Rattus norvegicus
tgccaccgggcgcattcgaagcgga

SEQ ID NO: 563669 - DNA, 25 bp, Rattus norvegicus
ctgttgggagaacttgggacccatc

SEQ ID NO: 563670 - DNA, 25 bp, Rattus norvegicus
ccattttgtgggatctgttgggaga

SEQ ID NO: 563671 - DNA, 25 bp, Rattus norvegicus
tggggagatgtttagtgccgggccc

SEQ ID NO: 563672 - DNA, 25 bp, Rattus norvegicus
attgcagcccatttggcgggtcacg

SEQ ID NO: 563673 - DNA, 25 bp, Rattus norvegicus
gagattgcagcccatttggcgggtc

SEQ ID NO: 563674 - DNA, 25 bp, Rattus norvegicus
gatatttccagagcccgagattgca

SEQ ID NO: 563675 - DNA, 25 bp, Rattus norvegicus
tagatatttccagagcccgagattg

SEQ ID NO: 563676 - DNA, 25 bp, Rattus norvegicus
ccttagatatttccagagcccgaga

SEQ ID NO: 563677 - DNA, 25 bp, Rattus norvegicus
ggtgcagagcctggccactgcagcc

SEQ ID NO: 563678 - DNA, 25 bp, Rattus norvegicus
ctccgcactgagctggccgcggccg

SEQ ID NO: 563679 - DNA, 25 bp, Rattus norvegicus
ccctgcagtggtcccaggagccgtg

SEQ ID NO: 563680 - DNA, 25 bp, Rattus norvegicus
cagcctcgctgctgggcagtgctgc

SEQ ID NO: 563681 - DNA, 25 bp, Rattus norvegicus
aggatcccagcctcgctgctgggca

SEQ ID NO: 563682 - DNA, 25 bp, Rattus norvegicus
ccctccctcgatcccggctgcccac

SEQ ID NO: 563683 - DNA, 25 bp, Rattus norvegicus
ccacacagctcaggagcccactccg

SEQ ID NO: 563684 - DNA, 25 bp, Rattus norvegicus
tcaggagcccactccgcgtcggctc

SEQ ID NO: 563685 - DNA, 25 bp, Rattus norvegicus
gtccgccgcaggcactgccgggctc

SEQ ID NO: 563686 - DNA, 25 bp, Rattus norvegicus
gactgacggacagcctcagtgacta

SEQ ID NO: 563687 - DNA, 25 bp, Rattus norvegicus
ccacgactgacggacagcctcagtg

SEQ ID NO: 563688 - DNA, 25 bp, Rattus norvegicus
gtggcccacgactgacggacagcct

SEQ ID NO: 563689 - DNA, 25 bp, Rattus norvegicus
ggctgcgtctctccaccggcagagt

SEQ ID NO: 563690 - DNA, 25 bp, Rattus norvegicus
ctcagtgactaccacacggaggaga

SEQ ID NO: 563691 - DNA, 25 bp, Rattus norvegicus
actaccacacggaggagagtcctga

SEQ ID NO: 563692 - DNA, 25 bp, Rattus norvegicus
gaggctgcgtctctccaccggcaga

SEQ ID NO: 563693 - DNA, 25 bp, Rattus norvegicus
tctctccaccggcagagtcgcaggg

SEQ ID NO: 563694 - DNA, 25 bp, Rattus norvegicus
ctcaccatcgctaaagccgggactg

SEQ ID NO: 563695 - DNA, 25 bp, Rattus norvegicus
caccatcgctaaagccgggactgga

SEQ ID NO: 563696 - DNA, 25 bp, Rattus norvegicus
cgctaaagccgggactggaccgagc

SEQ ID NO: 563697 - DNA, 25 bp, Rattus norvegicus
accgagcggagttgtgcgtgtcgcc

SEQ ID NO: 563698 - DNA, 25 bp, Rattus norvegicus
agcgtcgggagcctcccacggagcc

SEQ ID NO: 563699 - DNA, 25 bp, Rattus norvegicus
cgcccagaagcgaatgtgcgagatg

SEQ ID NO: 563700 - DNA, 25 bp, Rattus norvegicus
atgtgcagcacgtggcccagataga

SEQ ID NO: 563701 - DNA, 25 bp, Rattus norvegicus
ggcgtggacacgaagatgatttgca

SEQ ID NO: 563702 - DNA, 25 bp, Rattus norvegicus
agcggctgcagctggaagccatata

SEQ ID NO: 563703 - DNA, 25 bp, Rattus norvegicus
tcttctcctccatgcgcacgatgtg

SEQ ID NO: 563704 - DNA, 25 bp, Rattus norvegicus
cgaagatgatttgcagcgcccagaa

SEQ ID NO: 563705 - DNA, 25 bp, Rattus norvegicus
gggctccctgtacgcattggttccc

SEQ ID NO: 563706 - DNA, 25 bp, Rattus norvegicus
ccgtgctgagggttgtctctcctca

SEQ ID NO: 563707 - DNA, 25 bp, Rattus norvegicus
attggttcccgaccacggccgtgct

SEQ ID NO: 563708 - DNA, 25 bp, Rattus norvegicus
cccacttcgaagagcgtcttgaaga

SEQ ID NO: 563709 - DNA, 25 bp, Rattus norvegicus
gttgaagacgtaggtccgcagcagc

SEQ ID NO: 563710 - DNA, 25 bp, Rattus norvegicus
gcgatgcgcaccttgccacggtcat

SEQ ID NO: 563711 - DNA, 25 bp, Rattus norvegicus
ccttgccacggtcatcgcgcagtgg

SEQ ID NO: 563712 - DNA, 25 bp, Rattus norvegicus
atatagaaagtactggcccgcgatg

SEQ ID NO: 563713 - DNA, 25 bp, Rattus norvegicus
cccgcgggcaacaagctataaatag

SEQ ID NO: 563714 - DNA, 25 bp, Rattus norvegicus
cggggctcaaggcacaacctactgc

SEQ ID NO: 563715 - DNA, 25 bp, Rattus norvegicus
aacctactgccatggcagcctgggc

SEQ ID NO: 563716 - DNA, 25 bp, Rattus norvegicus
cctggggatgcagacttgttcctcg

SEQ ID NO: 563717 - DNA, 25 bp, Rattus norvegicus
cctgctctgtaaaggaggctccctc

SEQ ID NO: 563718 - DNA, 25 bp, Rattus norvegicus
gagccatggccggaattccgtccct

SEQ ID NO: 563719 - DNA, 25 bp, Rattus norvegicus
tgcttccaggcggacacaaattagc

SEQ ID NO: 563720 - DNA, 25 bp, Rattus norvegicus
ggacacaaattagccgacagctcca

SEQ ID NO: 563721 - DNA, 25 bp, Rattus norvegicus
tcctgcatggctggagtgatcagcc

SEQ ID NO: 563722 - DNA, 25 bp, Rattus norvegicus
tccagtctggggaagctaacacctg

SEQ ID NO: 563723 - DNA, 25 bp, Rattus norvegicus
gccgcggtacgcaccgcacttggtg

SEQ ID NO: 563724 - DNA, 25 bp, Rattus norvegicus
aggaggctccctcttcactcgtgcg

SEQ ID NO: 563725 - DNA, 25 bp, Rattus norvegicus
aagctataaatagcggccaccagcc

SEQ ID NO: 563726 - DNA, 25 bp, Rattus norvegicus
agacttgttcctcgggcgagccatg

SEQ ID NO: 563727 - DNA, 25 bp, Rattus norvegicus
cggaagcctcctgcttaacaaatga

SEQ ID NO: 563728 - DNA, 25 bp, Rattus norvegicus
aaaggtcagtgtcttcccacggaag

SEQ ID NO: 563729 - DNA, 25 bp, Rattus norvegicus
accgagttttcctgctaagctttcg

SEQ ID NO: 563730 - DNA, 25 bp, Rattus norvegicus
tttcaatggcagcagacaacgcagc

SEQ ID NO: 563731 - DNA, 25 bp, Rattus norvegicus
gccaggaggcctcgggaaaattcta

SEQ ID NO: 563732 - DNA, 25 bp, Rattus norvegicus
caaaggaacactggcgacacgtctc

SEQ ID NO: 563733 - DNA, 25 bp, Rattus norvegicus
acacgtctcagtcgcgcgcggaaca

SEQ ID NO: 563734 - DNA, 25 bp, Rattus norvegicus
tccagccgcagaaacgcgttcacga

SEQ ID NO: 563735 - DNA, 25 bp, Rattus norvegicus
gcgttcacgactcgggtccctatgc

SEQ ID NO: 563736 - DNA, 25 bp, Rattus norvegicus
gggcgggctacaccaatgtgactcg

SEQ ID NO: 563737 - DNA, 25 bp, Rattus norvegicus
ctgcgatcttggacacctgttggcc

SEQ ID NO: 563738 - DNA, 25 bp, Rattus norvegicus
tggccgtggcgccttttaactgaac

SEQ ID NO: 563739 - DNA, 25 bp, Rattus norvegicus
ccctggagcgattgagaaagttgca

SEQ ID NO: 563740 - DNA, 25 bp, Rattus norvegicus
cccagtgcttcaggtggtaaaggtc

SEQ ID NO: 563741 - DNA, 25 bp, Rattus norvegicus
gcgcgcaagaggaaatgcatcactt

SEQ ID NO: 563742 - DNA, 25 bp, Rattus norvegicus
tgcatcacttccagttgcgccgctg

SEQ ID NO: 563743 - DNA, 25 bp, Rattus norvegicus
cgccgctggacccacgttttgtagt

SEQ ID NO: 563744 - DNA, 25 bp, Rattus norvegicus
gctggacccacgttttgtagtcgta

SEQ ID NO: 563745 - DNA, 25 bp, Rattus norvegicus
tcggcttccggttttgtgcgacgga

SEQ ID NO: 563746 - DNA, 25 bp, Rattus norvegicus
ctctgcggctcgtgggctggacttc

SEQ ID NO: 563747 - DNA, 25 bp, Rattus norvegicus
gaacagtgtcctgtgctcacgggcg

SEQ ID NO: 563748 - DNA, 25 bp, Rattus norvegicus
gcgggacgcttactgctgtctctct

SEQ ID NO: 563749 - DNA, 25 bp, Rattus norvegicus
tgctgtctctcttccagagcggtca

SEQ ID NO: 563750 - DNA, 25 bp, Rattus norvegicus
tcttccagagcggtcagggctctgc

SEQ ID NO: 563751 - DNA, 25 bp, Rattus norvegicus
tggacttcccgaagcttgcatccgc

SEQ ID NO: 563752 - DNA, 25 bp, Rattus norvegicus
aatttgaggtgaagttcggcttccg

SEQ ID NO: 563753 - DNA, 25 bp, Rattus norvegicus
agtcgaggtcgctatgaacagtgtc

SEQ ID NO: 563754 - DNA, 25 bp, Rattus norvegicus
gaagtgacgaaagccctgagcgccg

SEQ ID NO: 563755 - DNA, 25 bp, Rattus norvegicus
tctgccgtttgatgtcctccaggtc

SEQ ID NO: 563756 - DNA, 25 bp, Rattus norvegicus
cagcgtgttgcagacgaagtcctcc

SEQ ID NO: 563757 - DNA, 25 bp, Rattus norvegicus
cttccctatgctggtcgagtgcttg

SEQ ID NO: 563758 - DNA, 25 bp, Rattus norvegicus
gaccgtgatccataccttccctatg

SEQ ID NO: 563759 - DNA, 25 bp, Rattus norvegicus
gcggccaccacgaggatcatgactc

SEQ ID NO: 563760 - DNA, 25 bp, Rattus norvegicus
tggggtggacacaaagatcagctgc

SEQ ID NO: 563761 - DNA, 25 bp, Rattus norvegicus
taggccacgtgcatggccaccagca

SEQ ID NO: 563762 - DNA, 25 bp, Rattus norvegicus
ttcatgtctgtagtaggccacgtgc

SEQ ID NO: 563763 - DNA, 25 bp, Rattus norvegicus
gcggataaactttcgggcagtttca

SEQ ID NO: 563764 - DNA, 25 bp, Rattus norvegicus
tggtgtacgtccaccacagcgagcc

SEQ ID NO: 563765 - DNA, 25 bp, Rattus norvegicus
tcgatgcgcaccttctgccgtttga

SEQ ID NO: 563766 - DNA, 25 bp, Rattus norvegicus
ttcgaagatgatgcggaagaagatg

SEQ ID NO: 563767 - DNA, 25 bp, Rattus norvegicus
agaagatgctgctggtgtacgtcca

SEQ ID NO: 563768 - DNA, 25 bp, Rattus norvegicus
tcggaagatgaagatgaccgtgatc

SEQ ID NO: 563769 - DNA, 25 bp, Rattus norvegicus
accaccaggcaacctggaacagtcg

SEQ ID NO: 563770 - DNA, 25 bp, Rattus norvegicus
gcacttacccgctcggtgggagccg

SEQ ID NO: 563771 - DNA, 25 bp, Rattus norvegicus
ctcggtttccacctgcggcttcttt

SEQ ID NO: 563772 - DNA, 25 bp, Rattus norvegicus
aatcgggaacagaatcggggacagt

SEQ ID NO: 563773 - DNA, 25 bp, Rattus norvegicus
ctgagcgtcggttggatcagaagcc

SEQ ID NO: 563774 - DNA, 25 bp, Rattus norvegicus
agagctcctgccctgagcgtcggtt

SEQ ID NO: 563775 - DNA, 25 bp, Rattus norvegicus
ctccaagcttgcagcggcactcaga

SEQ ID NO: 563776 - DNA, 25 bp, Rattus norvegicus
aggaaaagctcccactcgcacttac

SEQ ID NO: 563777 - DNA, 25 bp, Rattus norvegicus
tgctcgggcttctcggaggaaaagc

SEQ ID NO: 563778 - DNA, 25 bp, Rattus norvegicus
cagcgaaccacaaatccggtgagga

SEQ ID NO: 563779 - DNA, 25 bp, Rattus norvegicus
cactgtcaaagctctgcctagaacc

SEQ ID NO: 563780 - DNA, 25 bp, Rattus norvegicus
aggcagataagaatgcgggcagccc

SEQ ID NO: 563781 - DNA, 25 bp, Rattus norvegicus
gacaacgcgggtgacagccaccctg

SEQ ID NO: 563782 - DNA, 25 bp, Rattus norvegicus
ggggacagaccacttccttcacctg

SEQ ID NO: 563783 - DNA, 25 bp, Rattus norvegicus
ggagacctttacctgcctatgatca

SEQ ID NO: 563784 - DNA, 25 bp, Rattus norvegicus
agcacggcgccacggagacctttac

SEQ ID NO: 563785 - DNA, 25 bp, Rattus norvegicus
agccattgcagcacggcgccacgga

SEQ ID NO: 563786 - DNA, 25 bp, Rattus norvegicus
cgccaggattgccactgggaacgtg

SEQ ID NO: 563787 - DNA, 25 bp, Rattus norvegicus
tgccagggcgccagccattgcagca

SEQ ID NO: 563788 - DNA, 25 bp, Rattus norvegicus
tcactcgttccggacgctgccaggg

SEQ ID NO: 563789 - DNA, 25 bp, Rattus norvegicus
ggaaggtcactcgttccggacgctg

SEQ ID NO: 563790 - DNA, 25 bp, Rattus norvegicus
ggtacaacctgatgcccacccgagg

SEQ ID NO: 563791 - DNA, 25 bp, Rattus norvegicus
gcgcctggagaagcgaggtacaacc

SEQ ID NO: 563792 - DNA, 25 bp, Rattus norvegicus
cagatccgggcctggccgtacagct

SEQ ID NO: 563793 - DNA, 25 bp, Rattus norvegicus
ctggccgtacagctgcgctagcgga

SEQ ID NO: 563794 - DNA, 25 bp, Rattus norvegicus
acgccatggcagatccgggcctggc

SEQ ID NO: 563795 - DNA, 25 bp, Rattus norvegicus
ccattggctgacaacctccggggag

SEQ ID NO: 563796 - DNA, 25 bp, Rattus norvegicus
cgtgctcaagcctcgtgatgtagcc

SEQ ID NO: 563797 - DNA, 25 bp, Rattus norvegicus
acgtagcgtctcctagaccaccata

SEQ ID NO: 563798 - DNA, 25 bp, Rattus norvegicus
tggctccgggacacatttcattcgc

SEQ ID NO: 563799 - DNA, 25 bp, Rattus norvegicus
cattcgcttagccatcacgctctgg

SEQ ID NO: 563800 - DNA, 25 bp, Rattus norvegicus
cgtcctctctgtagatggctgcttc

SEQ ID NO: 563801 - DNA, 25 bp, Rattus norvegicus
tggctgcttcgggtttcactcgatc

SEQ ID NO: 563802 - DNA, 25 bp, Rattus norvegicus
cgggtttcactcgatcttgatttcc

SEQ ID NO: 563803 - DNA, 25 bp, Rattus norvegicus
gtgatgactcctagcacgtagcgtc

SEQ ID NO: 563804 - DNA, 25 bp, Rattus norvegicus
gaccaccataaatatcgagccaatc

SEQ ID NO: 563805 - DNA, 25 bp, Rattus norvegicus
ggcttccttggagccgcacctggca

SEQ ID NO: 563806 - DNA, 25 bp, Rattus norvegicus
cctggcaacggctgggcgtccagct

SEQ ID NO: 563807 - DNA, 25 bp, Rattus norvegicus
cagctctggcctgctgagcctcagg

SEQ ID NO: 563808 - DNA, 25 bp, Rattus norvegicus
ccctctacctgcctggtgcgtgagt

SEQ ID NO: 563809 - DNA, 25 bp, Rattus norvegicus
gagccaatctctggactcactcagc

SEQ ID NO: 563810 - DNA, 25 bp, Rattus norvegicus
cttgatttccttctgtgatgactcc

SEQ ID NO: 563811 - DNA, 25 bp, Rattus norvegicus
cccacctcctaacaagtctggaaag

SEQ ID NO: 563812 - DNA, 25 bp, Rattus norvegicus
cgtgtgcggcgcctttatttacttc

SEQ ID NO: 563813 - DNA, 25 bp, Rattus norvegicus
gcgcctttatttacttcgcagaaga

SEQ ID NO: 563814 - DNA, 25 bp, Rattus norvegicus
ttacttcgcagaagagcctccagcc

SEQ ID NO: 563815 - DNA, 25 bp, Rattus norvegicus
aacctgcgcagcgtgtcgccctggg

SEQ ID NO: 563816 - DNA, 25 bp, Rattus norvegicus
ccagtccacttctgtaggggcgaca

SEQ ID NO: 563817 - DNA, 25 bp, Rattus norvegicus
tgtaggggcgacacccagcccgcag

SEQ ID NO: 563818 - DNA, 25 bp, Rattus norvegicus
ttcctgttggcactggcgccgggcc

SEQ ID NO: 563819 - DNA, 25 bp, Rattus norvegicus
aggtctggatgctcctcgtcggctt

SEQ ID NO: 563820 - DNA, 25 bp, Rattus norvegicus
tctggaaagcaacagggcgacgcga

SEQ ID NO: 563821 - DNA, 25 bp, Rattus norvegicus
agaggcgtctcacgggcattcgcag

SEQ ID NO: 563822 - DNA, 25 bp, Rattus norvegicus
tcccgcgacgatgagcgcggtctgt

SEQ ID NO: 563823 - DNA, 25 bp, Rattus norvegicus
gtctgtcccgcaggtctggatgctc

SEQ ID NO: 563824 - DNA, 25 bp, Rattus norvegicus
tcctcgtcggcttcctgttggcact

SEQ ID NO: 563825 - DNA, 25 bp, Rattus norvegicus
agccggacaagtccgcggacagtgc

SEQ ID NO: 563826 - DNA, 25 bp, Rattus norvegicus
ggcgctgatgagactgcccgccacg

SEQ ID NO: 563827 - DNA, 25 bp, Rattus norvegicus
cggacagtgccaactccagcatgga

SEQ ID NO: 563828 - DNA, 25 bp, Rattus norvegicus
acctgtgtgcccgagccggacaagt

SEQ ID NO: 563829 - DNA, 25 bp, Rattus norvegicus
atcccggtgggctgcacctgtgtgc

SEQ ID NO: 563830 - DNA, 25 bp, Rattus norvegicus
gaacactacatcaccatcccggtgg

SEQ ID NO: 563831 - DNA, 25 bp, Rattus norvegicus
actgcctgtgccgaggctgtctgac

SEQ ID NO: 563832 - DNA, 25 bp, Rattus norvegicus
acccgtcttctctccggcggtggtg

SEQ ID NO: 563833 - DNA, 25 bp, Rattus norvegicus
tgaggaggacttccgctttcgcagc

SEQ ID NO: 563834 - DNA, 25 bp, Rattus norvegicus
gctctacggtgaggaggacttccgc

SEQ ID NO: 563835 - DNA, 25 bp, Rattus norvegicus
ccgaggctgtctgaccgggctctac

SEQ ID NO: 563836 - DNA, 25 bp, Rattus norvegicus
ttccgagatacctgcccgaagccta

SEQ ID NO: 563837 - DNA, 25 bp, Rattus norvegicus
gccgctcggtgtacgccgaacacta

SEQ ID NO: 563838 - DNA, 25 bp, Rattus norvegicus
ctccagcatggacaagatgctgctg

SEQ ID NO: 563839 - DNA, 25 bp, Rattus norvegicus
tgtctttcgggcatgttgttgcagg

SEQ ID NO: 563840 - DNA, 25 bp, Rattus norvegicus
actggctgcgtccaggctcatcaca

SEQ ID NO: 563841 - DNA, 25 bp, Rattus norvegicus
ccctttccctgtgccctcggattgg

SEQ ID NO: 563842 - DNA, 25 bp, Rattus norvegicus
gagttgaccccagccggtgcgctct

SEQ ID NO: 563843 - DNA, 25 bp, Rattus norvegicus
tacttctctacttattgtagggtta

SEQ ID NO: 563844 - DNA, 25 bp, Rattus norvegicus
cttattgtagggttattggtggcta

SEQ ID NO: 563845 - DNA, 25 bp, Rattus norvegicus
ggtacatgtgtctttcgggcatgtt

SEQ ID NO: 563846 - DNA, 25 bp, Rattus norvegicus
agctgaaagaccctgggtgcgtgct

SEQ ID NO: 563847 - DNA, 25 bp, Rattus norvegicus
accctgggtgcgtgctgggcatcac

SEQ ID NO: 563848 - DNA, 25 bp, Rattus norvegicus
gctgggcatcactcactggctgcgt

SEQ ID NO: 563849 - DNA, 25 bp, Rattus norvegicus
atcactcactggctgcgtccaggct

SEQ ID NO: 563850 - DNA, 25 bp, Rattus norvegicus
caggctcatcacagcgggctggctg

SEQ ID NO: 563851 - DNA, 25 bp, Rattus norvegicus
tctttcgggcatgttgttgcagggt

SEQ ID NO: 563852 - DNA, 25 bp, Rattus norvegicus
gggcatcactcactggctgcgtcca

SEQ ID NO: 563853 - DNA, 25 bp, Rattus norvegicus
agggctgttggcttatcccagatcc

SEQ ID NO: 563854 - DNA, 25 bp, Rattus norvegicus
tgccaccgaaaccacccgcagggtc

SEQ ID NO: 563855 - DNA, 25 bp, Rattus norvegicus
acttcccgcgagtcttgccaccgaa

SEQ ID NO: 563856 - DNA, 25 bp, Rattus norvegicus
tcagccggtgcctaactggatgaca

SEQ ID NO: 563857 - DNA, 25 bp, Rattus norvegicus
agttgcctcattccggtcactccgc

SEQ ID NO: 563858 - DNA, 25 bp, Rattus norvegicus
tgggctcccggtttctttggcgagc

SEQ ID NO: 563859 - DNA, 25 bp, Rattus norvegicus
cgggtgagccatccttgagaacagc

SEQ ID NO: 563860 - DNA, 25 bp, Rattus norvegicus
cttatcccagatccgggtcgcgtag

SEQ ID NO: 563861 - DNA, 25 bp, Rattus norvegicus
cactgcagagggctgttggcttatc

SEQ ID NO: 563862 - DNA, 25 bp, Rattus norvegicus
tctgcagactgtgccacccggcgtg

SEQ ID NO: 563863 - DNA, 25 bp, Rattus norvegicus
tgagaacagcctccggtccacggtc

SEQ ID NO: 563864 - DNA, 25 bp, Rattus norvegicus
tcacacggggttctttcagccggtg

SEQ ID NO: 563865 - DNA, 25 bp, Rattus norvegicus
actccaccgggtgagccatccttga

SEQ ID NO: 563866 - DNA, 25 bp, Rattus norvegicus
actggatgacaactctcggccgcac

SEQ ID NO: 563867 - DNA, 25 bp, Rattus norvegicus
tgtcctgccgtgctcttttcgctag

SEQ ID NO: 563868 - DNA, 25 bp, Rattus norvegicus
aatcagcgtttcgtgcctcctgctc

SEQ ID NO: 563869 - DNA, 25 bp, Rattus norvegicus
cgcctacggccagaatcagcgtttc

SEQ ID NO: 563870 - DNA, 25 bp, Rattus norvegicus
gctctcctaaaggtgcgcctacggc

SEQ ID NO: 563871 - DNA, 25 bp, Rattus norvegicus
tcttagccttggaagcgctctccta

SEQ ID NO: 563872 - DNA, 25 bp, Rattus norvegicus
ttttcgctagcgtaggctgtccatc

SEQ ID NO: 563873 - DNA, 25 bp, Rattus norvegicus
cgcgcagccctgtagctgccggtta

SEQ ID NO: 563874 - DNA, 25 bp, Rattus norvegicus
acgcgccatgcgctgcattatggga

SEQ ID NO: 563875 - DNA, 25 bp, Rattus norvegicus
ccgccatcatggtctctcttcaatg

SEQ ID NO: 563876 - DNA, 25 bp, Rattus norvegicus
ttctccagctgagcgatcacttctg

SEQ ID NO: 563877 - DNA, 25 bp, Rattus norvegicus
aactttggccgcgttctccagctga

SEQ ID NO: 563878 - DNA, 25 bp, Rattus norvegicus
cggcgtcctcaccatcagaactttg

SEQ ID NO: 563879 - DNA, 25 bp, Rattus norvegicus
ggagtcccactgatcccgcggttct

SEQ ID NO: 563880 - DNA, 25 bp, Rattus norvegicus
gtccatcgtggagcaggatttctta

SEQ ID NO: 563881 - DNA, 25 bp, Rattus norvegicus
ctgtactgctcagacttactgggca

SEQ ID NO: 563882 - DNA, 25 bp, Rattus norvegicus
gggtgggcctgcactgccctccttg

SEQ ID NO: 563883 - DNA, 25 bp, Rattus norvegicus
accagcgctgtactgctcagactta

SEQ ID NO: 563884 - DNA, 25 bp, Rattus norvegicus
ccgaagtccatatccagcgggggtg

SEQ ID NO: 563885 - DNA, 25 bp, Rattus norvegicus
cagcagcaagtgctttgggtaagga

SEQ ID NO: 563886 - DNA, 25 bp, Rattus norvegicus
ctcagacttactgggcagcagcaag

SEQ ID NO: 563887 - DNA, 25 bp, Rattus norvegicus
agcgctgtactgctcagacttactg

SEQ ID NO: 563888 - DNA, 25 bp, Rattus norvegicus
acggctgtctgaggctcgggccgca

SEQ ID NO: 563889 - DNA, 25 bp, Rattus norvegicus
gcgcagactctgctccacaccggtg

SEQ ID NO: 563890 - DNA, 25 bp, Rattus norvegicus
tgctccacaccggtgcacaggcggt

SEQ ID NO: 563891 - DNA, 25 bp, Rattus norvegicus
acaccggtgcacaggcggtccagac

SEQ ID NO: 563892 - DNA, 25 bp, Rattus norvegicus
tgcacaggcggtccagaccagcgct

SEQ ID NO: 563893 - DNA, 25 bp, Rattus norvegicus
aggcggtccagaccagcgctgtact

SEQ ID NO: 563894 - DNA, 25 bp, Rattus norvegicus
ccagaccagcgctgtactgctcaga

SEQ ID NO: 563895 - DNA, 25 bp, Rattus norvegicus
ctctacgcatgcgtgggcattccca

SEQ ID NO: 563896 - DNA, 25 bp, Rattus norvegicus
cggctgaacttgatggcacggacgt

SEQ ID NO: 563897 - DNA, 25 bp, Rattus norvegicus
cagcttcggctttggttaccttgga

SEQ ID NO: 563898 - DNA, 25 bp, Rattus norvegicus
cgctctccacttggggcaaatcttt

SEQ ID NO: 563899 - DNA, 25 bp, Rattus norvegicus
tgttggttgaatcacgcatgcgctc

SEQ ID NO: 563900 - DNA, 25 bp, Rattus norvegicus
actgtttccggccagggcatctaga

SEQ ID NO: 563901 - DNA, 25 bp, Rattus norvegicus
gccgtccactgctcagcagcgattg

SEQ ID NO: 563902 - DNA, 25 bp, Rattus norvegicus
gatcccacccattcctacaggttag

SEQ ID NO: 563903 - DNA, 25 bp, Rattus norvegicus
cgttctcctcaaacaagcgagtgtg

SEQ ID NO: 563904 - DNA, 25 bp, Rattus norvegicus
atccctcgtggacagccaggttgca

SEQ ID NO: 563905 - DNA, 25 bp, Rattus norvegicus
gcgagcgtgttagaccgcagacacc

SEQ ID NO: 563906 - DNA, 25 bp, Rattus norvegicus
cgttccgggcaagcgtgtgacccat

SEQ ID NO: 563907 - DNA, 25 bp, Rattus norvegicus
ggaaacagacagtacccgcgcgcgt

SEQ ID NO: 563908 - DNA, 25 bp, Rattus norvegicus
agacatcttgtttcggccggcttgc

SEQ ID NO: 563909 - DNA, 25 bp, Rattus norvegicus
gcctgcgtttgtagctcagggccgc

SEQ ID NO: 563910 - DNA, 25 bp, Rattus norvegicus
acgcctgtaacttgctgccgtggtg

SEQ ID NO: 563911 - DNA, 25 bp, Rattus norvegicus
ggccggcagatgctgtgtgtcaccc

SEQ ID NO: 563912 - DNA, 25 bp, Rattus norvegicus
gcgcgctgcattgttttgactgaaa

SEQ ID NO: 563913 - DNA, 25 bp, Rattus norvegicus
tttgactgaaaatgccgtcggtttc

SEQ ID NO: 563914 - DNA, 25 bp, Rattus norvegicus
aatgccgtcggtttcgaaagctgcg

SEQ ID NO: 563915 - DNA, 25 bp, Rattus norvegicus
agaccgagaaaccaacccactacag

SEQ ID NO: 563916 - DNA, 25 bp, Rattus norvegicus
caacccactacaggtcagtgcctgg

SEQ ID NO: 563917 - DNA, 25 bp, Rattus norvegicus
acggccatccggactcgggcagtcg

SEQ ID NO: 563918 - DNA, 25 bp, Rattus norvegicus
cacgcgccagactggagtctgggaa

SEQ ID NO: 563919 - DNA, 25 bp, Rattus norvegicus
tgtcccgcttcacgcctgtaacttg

SEQ ID NO: 563920 - DNA, 25 bp, Rattus norvegicus
gggctggacttgctcctggtctcag

SEQ ID NO: 563921 - DNA, 25 bp, Rattus norvegicus
cagcccttgtgggtcacgccgtcag

SEQ ID NO: 563922 - DNA, 25 bp, Rattus norvegicus
gggaaacagcgcctgcgtttgtagc

SEQ ID NO: 563923 - DNA, 25 bp, Rattus norvegicus
cccaagcgggacattcgctacattg

SEQ ID NO: 563924 - DNA, 25 bp, Rattus norvegicus
acgccgccgcgcgagcacaacaaag

SEQ ID NO: 563925 - DNA, 25 bp, Rattus norvegicus
caagagaggcgttacgcaactgccc

SEQ ID NO: 563926 - DNA, 25 bp, Rattus norvegicus
agtaggctcaagagaggcgttacgc

SEQ ID NO: 563927 - DNA, 25 bp, Rattus norvegicus
ttccgaagcgcagacccaagcggga

SEQ ID NO: 563928 - DNA, 25 bp, Rattus norvegicus
tcccgctcacgctcccaggcatacg

SEQ ID NO: 563929 - DNA, 25 bp, Rattus norvegicus
cgggacattcgctacattgttggca

SEQ ID NO: 563930 - DNA, 25 bp, Rattus norvegicus
cattgttggcattccacgggcgtca

SEQ ID NO: 563931 - DNA, 25 bp, Rattus norvegicus
gttggcattccacgggcgtcacgtg

SEQ ID NO: 563932 - DNA, 25 bp, Rattus norvegicus
ccaacgctgggctcgcgtcggaagt

SEQ ID NO: 563933 - DNA, 25 bp, Rattus norvegicus
tcacgccgcggttccgaagcgcaga

SEQ ID NO: 563934 - DNA, 25 bp, Rattus norvegicus
caggcatacgttctcacccggaggc

SEQ ID NO: 563935 - DNA, 25 bp, Rattus norvegicus
agcacgccgctggtggccaaaaatc

SEQ ID NO: 563936 - DNA, 25 bp, Rattus norvegicus
tggtggccaaaaatctcccgggtga

SEQ ID NO: 563937 - DNA, 25 bp, Rattus norvegicus
gtccgctataaaatctcgctccttt

SEQ ID NO: 563938 - DNA, 25 bp, Rattus norvegicus
tagaccattgcgcatgcgtccgtcc

SEQ ID NO: 563939 - DNA, 25 bp, Rattus norvegicus
cgcgcgtgtggccacacacataaga

SEQ ID NO: 563940 - DNA, 25 bp, Rattus norvegicus
acacataagaaagtgcgcttgcgcc

SEQ ID NO: 563941 - DNA, 25 bp, Rattus norvegicus
agaaagtgcgcttgcgccgagcgac

SEQ ID NO: 563942 - DNA, 25 bp, Rattus norvegicus
gccactcgtccgctataaaatctcg

SEQ ID NO: 563943 - DNA, 25 bp, Rattus norvegicus
tcgctcctttcctcgcgagagacga

SEQ ID NO: 563944 - DNA, 25 bp, Rattus norvegicus
cgcgagagacgactagctcatgctc

SEQ ID NO: 563945 - DNA, 25 bp, Rattus norvegicus
caaatggcgcgccagaggctgactc

SEQ ID NO: 563946 - DNA, 25 bp, Rattus norvegicus
cgggctgcgccctcagggactgaca

SEQ ID NO: 563947 - DNA, 25 bp, Rattus norvegicus
cagggactgacagggcggccttact

SEQ ID NO: 563948 - DNA, 25 bp, Rattus norvegicus
cagggcggccttactcgccgtgtaa

SEQ ID NO: 563949 - DNA, 25 bp, Rattus norvegicus
gcctgtagaccattgcgcatgcgtc

SEQ ID NO: 563950 - DNA, 25 bp, Rattus norvegicus
ttcctcgcgagagacgactagctca

SEQ ID NO: 563951 - DNA, 25 bp, Rattus norvegicus
ccggagaacttgtcagcgttgtttt

SEQ ID NO: 563952 - DNA, 25 bp, Rattus norvegicus
cgagaaccactactggctgagcatg

SEQ ID NO: 563953 - DNA, 25 bp, Rattus norvegicus
cgcggactgtgtctttccaagcgaa

SEQ ID NO: 563954 - DNA, 25 bp, Rattus norvegicus
cggctttcgtgtcctttcctcagga

SEQ ID NO: 563955 - DNA, 25 bp, Rattus norvegicus
gtagtcggctcctggtcactcactt

SEQ ID NO: 563956 - DNA, 25 bp, Rattus norvegicus
tctttcccagtagtgtagtcggctc

SEQ ID NO: 563957 - DNA, 25 bp, Rattus norvegicus
aacctctccgtggtcagttcgtacg

SEQ ID NO: 563958 - DNA, 25 bp, Rattus norvegicus
tgggtcagtgtacgcggaactctaa

SEQ ID NO: 563959 - DNA, 25 bp, Rattus norvegicus
aagtctcgcaccaggaacgctgcta

SEQ ID NO: 563960 - DNA, 25 bp, Rattus norvegicus
gcaggcgcagacttttctcgcgaga

SEQ ID NO: 563961 - DNA, 25 bp, Rattus norvegicus
ctcgaacgcgccacacatttgaatc

SEQ ID NO: 563962 - DNA, 25 bp, Rattus norvegicus
cggtggccagactccgcagtttaca

SEQ ID NO: 563963 - DNA, 25 bp, Rattus norvegicus
gcgttgttttcctcacagatcgaca

SEQ ID NO: 563964 - DNA, 25 bp, Rattus norvegicus
tgagcatgccctacatgacagcgga

SEQ ID NO: 563965 - DNA, 25 bp, Rattus norvegicus
agctccaccacgtacgcgtagtagg

SEQ ID NO: 563966 - DNA, 25 bp, Rattus norvegicus
agcccactacgcgttggcagcagcg

SEQ ID NO: 563967 - DNA, 25 bp, Rattus norvegicus
ccgcgggataagaacgcagcgccct

SEQ ID NO: 563968 - DNA, 25 bp, Rattus norvegicus
ccgctccgcgggataagaacgcagc

SEQ ID NO: 563969 - DNA, 25 bp, Rattus norvegicus
cctaggacgtggagcccaccggctg

SEQ ID NO: 563970 - DNA, 25 bp, Rattus norvegicus
tccagcagcccacggttctgcaggg

SEQ ID NO: 563971 - DNA, 25 bp, Rattus norvegicus
cagccacccggaagctcggaacgtg

SEQ ID NO: 563972 - DNA, 25 bp, Rattus norvegicus
cagacgaccacaaaggtgatgaaga

SEQ ID NO: 563973 - DNA, 25 bp, Rattus norvegicus
ttgcctagtccagcagcccacggtt

SEQ ID NO: 563974 - DNA, 25 bp, Rattus norvegicus
gttcttctgctgattgcctagtcca

SEQ ID NO: 563975 - DNA, 25 bp, Rattus norvegicus
agggcgccatgttcttctgctgatt

SEQ ID NO: 563976 - DNA, 25 bp, Rattus norvegicus
cagcgccagagtgtccagggcgcca

SEQ ID NO: 563977 - DNA, 25 bp, Rattus norvegicus
tgatgaagagcaccggaacccagcc

SEQ ID NO: 563978 - DNA, 25 bp, Rattus norvegicus
cgcgtagtaggaccagacgaccaca

SEQ ID NO: 563979 - DNA, 25 bp, Rattus norvegicus
atctttgcggaagcgcccgaacgcc

SEQ ID NO: 563980 - DNA, 25 bp, Rattus norvegicus
atgttctgcgcgtgtgttgctaggt

SEQ ID NO: 563981 - DNA, 25 bp, Rattus norvegicus
gttctcgcgagagctcatcaacctc

SEQ ID NO: 563982 - DNA, 25 bp, Rattus norvegicus
gcctccacctttggtggccggagga

SEQ ID NO: 563983 - DNA, 25 bp, Rattus norvegicus
gccatctttgcggaagcgcccgaac

SEQ ID NO: 563984 - DNA, 25 bp, Rattus norvegicus
aggccgccagccgagcgcttcttcc

SEQ ID NO: 563985 - DNA, 25 bp, Rattus norvegicus
agggccgcgactcggcacagctcgt

SEQ ID NO: 563986 - DNA, 25 bp, Rattus norvegicus
tgatgccatgctgctcctgcgcctg

SEQ ID NO: 563987 - DNA, 25 bp, Rattus norvegicus
gctttcacgcgtccgtgatgccatg

SEQ ID NO: 563988 - DNA, 25 bp, Rattus norvegicus
cggctgctttcacgcgtccgtgatg

SEQ ID NO: 563989 - DNA, 25 bp, Rattus norvegicus
cggggctgagccgtacctgcaccaa

SEQ ID NO: 563990 - DNA, 25 bp, Rattus norvegicus
acgcccacacgcgtcgccagagaga

SEQ ID NO: 563991 - DNA, 25 bp, Rattus norvegicus
tgctaggtgtggctgctttctcgac

SEQ ID NO: 563992 - DNA, 25 bp, Rattus norvegicus
tagagttgagttctcgcgagagctc

SEQ ID NO: 563993 - DNA, 25 bp, Rattus norvegicus
acgtttctttgtccctgcatggggc

SEQ ID NO: 563994 - DNA, 25 bp, Rattus norvegicus
cagcaagcagcgctagtgcccaggc

SEQ ID NO: 563995 - DNA, 25 bp, Rattus norvegicus
cgagcgagccctgagcagcaagcag

SEQ ID NO: 563996 - DNA, 25 bp, Rattus norvegicus
gggaccagagctccggcttccaagt

SEQ ID NO: 563997 - DNA, 25 bp, Rattus norvegicus
gcaaaagccctgacccgggaccaga

SEQ ID NO: 563998 - DNA, 25 bp, Rattus norvegicus
ctcgaaggccgctggccgcgagcaa

SEQ ID NO: 563999 - DNA, 25 bp, Rattus norvegicus
tcgggagctgcgctcaagtcttagc

SEQ ID NO: 564000 - DNA, 25 bp, Rattus norvegicus
cgggcagtacgtttctttgtccctg

SEQ ID NO: 564001 - DNA, 25 bp, Rattus norvegicus
gcaactttcaccatcttgacccgag

SEQ ID NO: 564002 - DNA, 25 bp, Rattus norvegicus
cttgacccgagagtctaagacaatg

SEQ ID NO: 564003 - DNA, 25 bp, Rattus norvegicus
taagacaatgtgaacaaagaggagc

SEQ ID NO: 564004 - DNA, 25 bp, Rattus norvegicus
ctgtgttggggacgccttgctcaga

SEQ ID NO: 564005 - DNA, 25 bp, Rattus norvegicus
gctggccgcgagcaaaagccctgac

SEQ ID NO: 564006 - DNA, 25 bp, Rattus norvegicus
tgcgctcaagtcttagcaactttca

SEQ ID NO: 564007 - DNA, 25 bp, Rattus norvegicus
cggcgacacctgttcgcggcagccc

SEQ ID NO: 564008 - DNA, 25 bp, Rattus norvegicus
agcctctgtagcgttctggatacta

SEQ ID NO: 564009 - DNA, 25 bp, Rattus norvegicus
caatgccgccgcctgcgccactctg

SEQ ID NO: 564010 - DNA, 25 bp, Rattus norvegicus
gcgtctccggcgtctctaaagccgg

SEQ ID NO: 564011 - DNA, 25 bp, Rattus norvegicus
ggccgaacgtctccagggctgctgc

SEQ ID NO: 564012 - DNA, 25 bp, Rattus norvegicus
tctcaggcggccgaacgtctccagg

SEQ ID NO: 564013 - DNA, 25 bp, Rattus norvegicus
cgagctagatctcaggcggccgaac

SEQ ID NO: 564014 - DNA, 25 bp, Rattus norvegicus
tgtgcctttagcgagctagatctca

SEQ ID NO: 564015 - DNA, 25 bp, Rattus norvegicus
gaccctgtgcctttagcgagctaga

SEQ ID NO: 564016 - DNA, 25 bp, Rattus norvegicus
cctctgaccctgtgcctttagcgag

SEQ ID NO: 564017 - DNA, 25 bp, Rattus norvegicus
ttctggatactagctttggacgccg

SEQ ID NO: 564018 - DNA, 25 bp, Rattus norvegicus
ctggacctccgcagagcctctgtag

SEQ ID NO: 564019 - DNA, 25 bp, Rattus norvegicus
gctcgcctcattgcaagccgctgga

SEQ ID NO: 564020 - DNA, 25 bp, Rattus norvegicus
attgcaagccgctggacctccgcag

SEQ ID NO: 564021 - DNA, 25 bp, Rattus norvegicus
atccggatctagtcttgcgggagca

SEQ ID NO: 564022 - DNA, 25 bp, Rattus norvegicus
tgccactcaccctcgttcggatgga

SEQ ID NO: 564023 - DNA, 25 bp, Rattus norvegicus
ctattgttaaccactagcctaggga

SEQ ID NO: 564024 - DNA, 25 bp, Rattus norvegicus
tggaactgagcttcgcggtctcatg

SEQ ID NO: 564025 - DNA, 25 bp, Rattus norvegicus
tgcgaccagccaaatccacctttat

SEQ ID NO: 564026 - DNA, 25 bp, Rattus norvegicus
ttattgtgtgaattaccgggtccca

SEQ ID NO: 564027 - DNA, 25 bp, Rattus norvegicus
ggcccaggtcaagtgatagccctca

SEQ ID NO: 564028 - DNA, 25 bp, Rattus norvegicus
ccttaagataggacgtttgccacgc

SEQ ID NO: 564029 - DNA, 25 bp, Rattus norvegicus
ttgccacgcgcacttgatacatctg

SEQ ID NO: 564030 - DNA, 25 bp, Rattus norvegicus
tattgagtctctgtgctaggctgca

SEQ ID NO: 564031 - DNA, 25 bp, Rattus norvegicus
tcagcggacaaggactgcaggtacc

SEQ ID NO: 564032 - DNA, 25 bp, Rattus norvegicus
gacatctctactctcgggttccgca

SEQ ID NO: 564033 - DNA, 25 bp, Rattus norvegicus
ttaagtctttcatccggttgcagtg

SEQ ID NO: 564034 - DNA, 25 bp, Rattus norvegicus
ccttctttccgaagcgcgcagcggg

SEQ ID NO: 564035 - DNA, 25 bp, Rattus norvegicus
tgaacgaacagagtgaatcctcctc

SEQ ID NO: 564036 - DNA, 25 bp, Rattus norvegicus
tgtaggggacacgtgtgtacattgc

SEQ ID NO: 564037 - DNA, 25 bp, Rattus norvegicus
gtttgcgccatcctcgccagttctg

SEQ ID NO: 564038 - DNA, 25 bp, Rattus norvegicus
cgccagttctggcaaaggctctcgg

SEQ ID NO: 564039 - DNA, 25 bp, Rattus norvegicus
tctcggcctcagaaatgaacgaaca

SEQ ID NO: 564040 - DNA, 25 bp, Rattus norvegicus
agtgaatcctcctcaaagcggtcgg

SEQ ID NO: 564041 - DNA, 25 bp, Rattus norvegicus
tcaaagcggtcggaatcctcaaacg

SEQ ID NO: 564042 - DNA, 25 bp, Rattus norvegicus
tcctcaaacgagaagcgctcgccgt

SEQ ID NO: 564043 - DNA, 25 bp, Rattus norvegicus
tccgcgaacatcagctccatggggc

SEQ ID NO: 564044 - DNA, 25 bp, Rattus norvegicus
cgggcctcacccaacagcgaggtgt

SEQ ID NO: 564045 - DNA, 25 bp, Rattus norvegicus
attgtggccagtctgcgagactcga

SEQ ID NO: 564046 - DNA, 25 bp, Rattus norvegicus
atcagctgatccgaacttccggccg

SEQ ID NO: 564047 - DNA, 25 bp, Rattus norvegicus
gtgtacattgcctgccgttttctcg

SEQ ID NO: 564048 - DNA, 25 bp, Rattus norvegicus
tggcaaaggctctcggcctcagaaa

SEQ ID NO: 564049 - DNA, 25 bp, Rattus norvegicus
cggcctacaacaaaaccggagcagg

SEQ ID NO: 564050 - DNA, 25 bp, Rattus norvegicus
aggaacaccaagcacgcaggttagc

SEQ ID NO: 564051 - DNA, 25 bp, Rattus norvegicus
ccggtcccactggagaggaacacca

SEQ ID NO: 564052 - DNA, 25 bp, Rattus norvegicus
ctctgaggaaactcgctgccggtcc

SEQ ID NO: 564053 - DNA, 25 bp, Rattus norvegicus
gcgagctgagtaaatggcgttgccc

SEQ ID NO: 564054 - DNA, 25 bp, Rattus norvegicus
gcgttctgtcctgcgggaacttcac

SEQ ID NO: 564055 - DNA, 25 bp, Rattus norvegicus
aggaaggccaagctccgctaccatc

SEQ ID NO: 564056 - DNA, 25 bp, Rattus norvegicus
agggagacacgtgcgctgacaaaca

SEQ ID NO: 564057 - DNA, 25 bp, Rattus norvegicus
aggccttcctcagaccgtgcaggga

SEQ ID NO: 564058 - DNA, 25 bp, Rattus norvegicus
gcttaacgcaggtgtccaggccttc

SEQ ID NO: 564059 - DNA, 25 bp, Rattus norvegicus
gccttgtctcggtcggcttaacgca

SEQ ID NO: 564060 - DNA, 25 bp, Rattus norvegicus
acagctctggggcagatagtcagcg

SEQ ID NO: 564061 - DNA, 25 bp, Rattus norvegicus
atagtcagcgttcaggagccttgtc

SEQ ID NO: 564062 - DNA, 25 bp, Rattus norvegicus
tccgtttacccgcatagcacaagca

SEQ ID NO: 564063 - DNA, 25 bp, Rattus norvegicus
atttcctaaatcagcgtcggcgcag

SEQ ID NO: 564064 - DNA, 25 bp, Rattus norvegicus
tttgcagcataagtgcagccagcac

SEQ ID NO: 564065 - DNA, 25 bp, Rattus norvegicus
ttccaagtacgatgaggccaccggc

SEQ ID NO: 564066 - DNA, 25 bp, Rattus norvegicus
ctgttccaagtacgatgaggccacc

SEQ ID NO: 564067 - DNA, 25 bp, Rattus norvegicus
cagcccggacgtttactgttccaag

SEQ ID NO: 564068 - DNA, 25 bp, Rattus norvegicus
atggcaccttcaactacagcccgga

SEQ ID NO: 564069 - DNA, 25 bp, Rattus norvegicus
acgcgatggcaccttcaactacagc

SEQ ID NO: 564070 - DNA, 25 bp, Rattus norvegicus
caagtacgatgaggccaccggcctg

SEQ ID NO: 564071 - DNA, 25 bp, Rattus norvegicus
cattggcatttcctaaatcagcgtc

SEQ ID NO: 564072 - DNA, 25 bp, Rattus norvegicus
agcacaggccgttcacctgtttcca

SEQ ID NO: 564073 - DNA, 25 bp, Rattus norvegicus
taagtgcagccagcacaggccgttc

SEQ ID NO: 564074 - DNA, 25 bp, Rattus norvegicus
cctgtgtcccgacggtgacgagtaa

SEQ ID NO: 564075 - DNA, 25 bp, Rattus norvegicus
gcagaccgctccgacgacgcgatgg

SEQ ID NO: 564076 - DNA, 25 bp, Rattus norvegicus
cgacgacgcgatggcaccttcaact

SEQ ID NO: 564077 - DNA, 25 bp, Rattus norvegicus
ccacttgagcgtgaagtcttgaggc

SEQ ID NO: 564078 - DNA, 25 bp, Rattus norvegicus
ccaatagggctctcctcagtctaga

SEQ ID NO: 564079 - DNA, 25 bp, Rattus norvegicus
cgctgaccgcttcgaccaatagggc

SEQ ID NO: 564080 - DNA, 25 bp, Rattus norvegicus
gattatctcggtccctctcgcgctg

SEQ ID NO: 564081 - DNA, 25 bp, Rattus norvegicus
cctgattggtcagcgattatctcgg

SEQ ID NO: 564082 - DNA, 25 bp, Rattus norvegicus
gaaagcgctgcctcctgattggtca

SEQ ID NO: 564083 - DNA, 25 bp, Rattus norvegicus
gggctcctggctgaaagcgctgcct

SEQ ID NO: 564084 - DNA, 25 bp, Rattus norvegicus
aacgcctgggagctccgcgctgttt

SEQ ID NO: 564085 - DNA, 25 bp, Rattus norvegicus
gctcagacgcctattggctgcagcc

SEQ ID NO: 564086 - DNA, 25 bp, Rattus norvegicus
ctgcgccagctcagacgcctattgg

SEQ ID NO: 564087 - DNA, 25 bp, Rattus norvegicus
gtgaagtcttgaggcgccctcacct

SEQ ID NO: 564088 - DNA, 25 bp, Rattus norvegicus
agcagccacgaaagagagcgccgca

SEQ ID NO: 564089 - DNA, 25 bp, Rattus norvegicus
ggaaccagcagccacgaaagagagc

SEQ ID NO: 564090 - DNA, 25 bp, Rattus norvegicus
cgggaaacaccagtccacagcattc

SEQ ID NO: 564091 - DNA, 25 bp, Rattus norvegicus
ttgcgcagcaagatgacgtcttagc

SEQ ID NO: 564092 - DNA, 25 bp, Rattus norvegicus
cttccggcgcctgtgtgacgtcaga

SEQ ID NO: 564093 - DNA, 25 bp, Rattus norvegicus
gtctgcgtgccgactgacctctcgg

SEQ ID NO: 564094 - DNA, 25 bp, Rattus norvegicus
tgcatcggatccgtttctttcatcc

SEQ ID NO: 564095 - DNA, 25 bp, Rattus norvegicus
ggacaactcgcccagtcaggcatga

SEQ ID NO: 564096 - DNA, 25 bp, Rattus norvegicus
gtcatgctgcccgtctgcgtgccga

SEQ ID NO: 564097 - DNA, 25 bp, Rattus norvegicus
cctgtgtgacgtcagagtccagcgc

SEQ ID NO: 564098 - DNA, 25 bp, Rattus norvegicus
gcccagtcaggcatgataggataca

SEQ ID NO: 564099 - DNA, 25 bp, Rattus norvegicus
ggcatgataggatacactcagctca

SEQ ID NO: 564100 - DNA, 25 bp, Rattus norvegicus
agctcaccttcagccgcctctgcgg

SEQ ID NO: 564101 - DNA, 25 bp, Rattus norvegicus
ggcctgtcaacaaccgctcgttttg

SEQ ID NO: 564102 - DNA, 25 bp, Rattus norvegicus
caaccgctcgttttgcgcagcaaga

SEQ ID NO: 564103 - DNA, 25 bp, Rattus norvegicus
gtcttagcatgtccctcgcttccgg

SEQ ID NO: 564104 - DNA, 25 bp, Rattus norvegicus
agatgacgtcttagcatgtccctcg

SEQ ID NO: 564105 - DNA, 25 bp, Rattus norvegicus
tactcctgtgaaggccgaacctagc

SEQ ID NO: 564106 - DNA, 25 bp, Rattus norvegicus
tgctgcacttgctgccgggagcact

SEQ ID NO: 564107 - DNA, 25 bp, Rattus norvegicus
tgcggacactcgcagcgtccgaagc

SEQ ID NO: 564108 - DNA, 25 bp, Rattus norvegicus
tgactagaggcggaaagcatccagc

SEQ ID NO: 564109 - DNA, 25 bp, Rattus norvegicus
tccggaccctgatgcagaaacgctc

SEQ ID NO: 564110 - DNA, 25 bp, Rattus norvegicus
atgtttcttctgctatactcctgtg

SEQ ID NO: 564111 - DNA, 25 bp, Rattus norvegicus
gagctgactcgcagccctgctaggc

SEQ ID NO: 564112 - DNA, 25 bp, Rattus norvegicus
ccgggtcactcacaaggagggatga

SEQ ID NO: 564113 - DNA, 25 bp, Rattus norvegicus
ggatgacttagaccctggctctgca

SEQ ID NO: 564114 - DNA, 25 bp, Rattus norvegicus
ccctgggatcgctgagccataactt

SEQ ID NO: 564115 - DNA, 25 bp, Rattus norvegicus
gggagatccgtgtcctctagagaca

SEQ ID NO: 564116 - DNA, 25 bp, Rattus norvegicus
agcccgagggactgaaacttccgtg

SEQ ID NO: 564117 - DNA, 25 bp, Rattus norvegicus
agacatcaccagtgcccagagcagt

SEQ ID NO: 564118 - DNA, 25 bp, Rattus norvegicus
aagggcggattgcaaaccaggcttc

SEQ ID NO: 564119 - DNA, 25 bp, Rattus norvegicus
atcatcctcgggtccctcgtagcag

SEQ ID NO: 564120 - DNA, 25 bp, Rattus norvegicus
gccgtttctcatcgttggctccgtg

SEQ ID NO: 564121 - DNA, 25 bp, Rattus norvegicus
ggctccgtgttcgttgccttcatca

SEQ ID NO: 564122 - DNA, 25 bp, Rattus norvegicus
tcgttgccttcatcatcctcgggtc

SEQ ID NO: 564123 - DNA, 25 bp, Rattus norvegicus
gccagcacgtcacggggctcatctt

SEQ ID NO: 564124 - DNA, 25 bp, Rattus norvegicus
agtccagcacggctgccagttccag

SEQ ID NO: 564125 - DNA, 25 bp, Rattus norvegicus
tccctcgtagcagcgtgctgttgcc

SEQ ID NO: 564126 - DNA, 25 bp, Rattus norvegicus
ggggctcatcttctcgccagtccag

SEQ ID NO: 564127 - DNA, 25 bp, Rattus norvegicus
ttccagctccagtgcgaactccggg

SEQ ID NO: 564128 - DNA, 25 bp, Rattus norvegicus
gattcccagtgccagcacgtcacgg

SEQ ID NO: 564129 - DNA, 25 bp, Rattus norvegicus
gagaccattcccatgattcccagtg

SEQ ID NO: 564130 - DNA, 25 bp, Rattus norvegicus
gggcaaccgcctgatggagaccatt

SEQ ID NO: 564131 - DNA, 25 bp, Rattus norvegicus
atgtctacggccaaagcaggatccc

SEQ ID NO: 564132 - DNA, 25 bp, Rattus norvegicus
gtgctgttgccgatgtctacggcca

SEQ ID NO: 564133 - DNA, 25 bp, Rattus norvegicus
gtgcctctagctggtctccaacaga

SEQ ID NO: 564134 - DNA, 25 bp, Rattus norvegicus
ggacatctcatcctctgccttcttg

SEQ ID NO: 564135 - DNA, 25 bp, Rattus norvegicus
ccatcacaacctgaattcgtgaaga

SEQ ID NO: 564136 - DNA, 25 bp, Rattus norvegicus
accacgccctagaccttgtggaggc

SEQ ID NO: 564137 - DNA, 25 bp, Rattus norvegicus
tgccttcttgtagcccgcagaagaa

SEQ ID NO: 564138 - DNA, 25 bp, Rattus norvegicus
cagaagaacgaacgggtcctgcaga

SEQ ID NO: 564139 - DNA, 25 bp, Rattus norvegicus
cgaggcgcagggaaaacaaaacaca

SEQ ID NO: 564140 - DNA, 25 bp, Rattus norvegicus
ccagctgcgaaggatgctctagtga

SEQ ID NO: 564141 - DNA, 25 bp, Rattus norvegicus
actggggccgcctatgtacctaggc

SEQ ID NO: 564142 - DNA, 25 bp, Rattus norvegicus
ccctggagactagaccgtagccaca

SEQ ID NO: 564143 - DNA, 25 bp, Rattus norvegicus
tgtatttaccagagacctcaccacg

SEQ ID NO: 564144 - DNA, 25 bp, Rattus norvegicus
ccaggcttctctagctctgtattta

SEQ ID NO: 564145 - DNA, 25 bp, Rattus norvegicus
ttcgtgaagaaggttcccaggcttc

SEQ ID NO: 564146 - DNA, 25 bp, Rattus norvegicus
tctccaacagacgtggcccgggaca

SEQ ID NO: 564147 - DNA, 25 bp, Rattus norvegicus
actttgggccgcaccggtgccaggt

SEQ ID NO: 564148 - DNA, 25 bp, Rattus norvegicus
ccaggttgtctgaccaggggtcagc

SEQ ID NO: 564149 - DNA, 25 bp, Rattus norvegicus
cagggcgtggcgtccggaattccca

SEQ ID NO: 564150 - DNA, 25 bp, Rattus norvegicus
caccggtgccaggttgtctgaccag

SEQ ID NO: 564151 - DNA, 25 bp, Rattus norvegicus
cgggtcgccctagccagtgcccgca

SEQ ID NO: 564152 - DNA, 25 bp, Rattus norvegicus
gccaggaccgcagcgccagggccat

SEQ ID NO: 564153 - DNA, 25 bp, Rattus norvegicus
gcgccgttcagcatcgcgcgaggct

SEQ ID NO: 564154 - DNA, 25 bp, Rattus norvegicus
ttaaaagcctggtccaggcccgcgc

SEQ ID NO: 564155 - DNA, 25 bp, Rattus norvegicus
gacatcttaaaagcctggtccaggc

SEQ ID NO: 564156 - DNA, 25 bp, Rattus norvegicus
tccgcggtaacgacatcttaaaagc

SEQ ID NO: 564157 - DNA, 25 bp, Rattus norvegicus
cacggacgcgccgatcctcgccctc

SEQ ID NO: 564158 - DNA, 25 bp, Rattus norvegicus
aagggcggagcagtgtctcccagcc

SEQ ID NO: 564159 - DNA, 25 bp, Rattus norvegicus
gtggcgtccggaattcccaggcacc

SEQ ID NO: 564160 - DNA, 25 bp, Rattus norvegicus
gccctccgcggtaacgacatcttaa

SEQ ID NO: 564161 - DNA, 25 bp, Rattus norvegicus
gggaccacacgcgaacgcatgcgca

SEQ ID NO: 564162 - DNA, 25 bp, Rattus norvegicus
gcccttggcgcgaagccgtcagcaa

SEQ ID NO: 564163 - DNA, 25 bp, Rattus norvegicus
gagaggcctaggacgcttctgtccc

SEQ ID NO: 564164 - DNA, 25 bp, Rattus norvegicus
ggatgtgccacattgctgtcgccca

SEQ ID NO: 564165 - DNA, 25 bp, Rattus norvegicus
accgcccgcgcggaaagcactagaa

SEQ ID NO: 564166 - DNA, 25 bp, Rattus norvegicus
ccgaaggagaatccgctgcctgtgc

SEQ ID NO: 564167 - DNA, 25 bp, Rattus norvegicus
cattcacagccctgcggggatcgta

SEQ ID NO: 564168 - DNA, 25 bp, Rattus norvegicus
tagcaaaggctagtcagcacggtta

SEQ ID NO: 564169 - DNA, 25 bp, Rattus norvegicus
cgggagagcaccacagtagcaaagg

SEQ ID NO: 564170 - DNA, 25 bp, Rattus norvegicus
tacatgccgatcctcgcgggagagc

SEQ ID NO: 564171 - DNA, 25 bp, Rattus norvegicus
ctgaagccaggcctctacatgccga

SEQ ID NO: 564172 - DNA, 25 bp, Rattus norvegicus
ggatcgtaaggaagccaggcagtct

SEQ ID NO: 564173 - DNA, 25 bp, Rattus norvegicus
agcacggttacctggacgcgccgaa

SEQ ID NO: 564174 - DNA, 25 bp, Rattus norvegicus
ttctgtcccttcacttccgaggagg

SEQ ID NO: 564175 - DNA, 25 bp, Rattus norvegicus
ggagcacatccggacaaccaaggta

SEQ ID NO: 564176 - DNA, 25 bp, Rattus norvegicus
atggtgttctcctgaggctagctgc

SEQ ID NO: 564177 - DNA, 25 bp, Rattus norvegicus
ttcctctcccaatggtgttctcctg

SEQ ID NO: 564178 - DNA, 25 bp, Rattus norvegicus
agtgttctcagacgacgcctgcgca

SEQ ID NO: 564179 - DNA, 25 bp, Rattus norvegicus
tctaggcgacagtgttctcagacga

SEQ ID NO: 564180 - DNA, 25 bp, Rattus norvegicus
ccctctgtggctgggatttgcggaa

SEQ ID NO: 564181 - DNA, 25 bp, Rattus norvegicus
gtgcgatccagctagcgcacgctct

SEQ ID NO: 564182 - DNA, 25 bp, Rattus norvegicus
caaccaaggtagtcggcgggagatc

SEQ ID NO: 564183 - DNA, 25 bp, Rattus norvegicus
tttgcggaagtgtttctaggcgaca

SEQ ID NO: 564184 - DNA, 25 bp, Rattus norvegicus
gcacgctctcgatgggcgacgctct

SEQ ID NO: 564185 - DNA, 25 bp, Rattus norvegicus
tcggtaaacggtggccgcccagcga

SEQ ID NO: 564186 - DNA, 25 bp, Rattus norvegicus
gcgagctttgcgcttttgaacaaga

SEQ ID NO: 564187 - DNA, 25 bp, Rattus norvegicus
agatcctcgcaactgccggggttca

SEQ ID NO: 564188 - DNA, 25 bp, Rattus norvegicus
cgacgctctgcctgctgtcaggatc

SEQ ID NO: 564189 - DNA, 25 bp, Rattus norvegicus
ccctggcgatcaaagctcccgggga

SEQ ID NO: 564190 - DNA, 25 bp, Rattus norvegicus
tgaaagggatcttcagcagcatgcg

SEQ ID NO: 564191 - DNA, 25 bp, Rattus norvegicus
gcgagcaaggctggcggcaaacaaa

SEQ ID NO: 564192 - DNA, 25 bp, Rattus norvegicus
atcggagaccggcaagggagaccat

SEQ ID NO: 564193 - DNA, 25 bp, Rattus norvegicus
cctgctgaaaaagaacgggcgatcg

SEQ ID NO: 564194 - DNA, 25 bp, Rattus norvegicus
cggtggccaagtcccacagcttctt

SEQ ID NO: 564195 - DNA, 25 bp, Rattus norvegicus
tacggctgacgacagcggctgatcc

SEQ ID NO: 564196 - DNA, 25 bp, Rattus norvegicus
cggctgatcccactcggtttccatg

SEQ ID NO: 564197 - DNA, 25 bp, Rattus norvegicus
tcgctgcagacatggactcgcattg

SEQ ID NO: 564198 - DNA, 25 bp, Rattus norvegicus
ccgtcggggaagatcaataaggctg

SEQ ID NO: 564199 - DNA, 25 bp, Rattus norvegicus
aaggctgcgttcaagttattcaaga

SEQ ID NO: 564200 - DNA, 25 bp, Rattus norvegicus
accatgcccagcatttttggggtca

SEQ ID NO: 564201 - DNA, 25 bp, Rattus norvegicus
tgagaagcaggacccacgacggact

SEQ ID NO: 564202 - DNA, 25 bp, Rattus norvegicus
cccacgacggactagccgaggtgct

SEQ ID NO: 564203 - DNA, 25 bp, Rattus norvegicus
caaattaggatgtgcgcgcccttta

SEQ ID NO: 564204 - DNA, 25 bp, Rattus norvegicus
gggccaacagccgacaccaaattag

SEQ ID NO: 564205 - DNA, 25 bp, Rattus norvegicus
tagtcccacagtgacgctcgatcgg

SEQ ID NO: 564206 - DNA, 25 bp, Rattus norvegicus
ccgggtcttagtcccacagtgacgc

SEQ ID NO: 564207 - DNA, 25 bp, Rattus norvegicus
gtgcgcgctctttccgggtcttagt

SEQ ID NO: 564208 - DNA, 25 bp, Rattus norvegicus
tgcggcctacgaccagctgtgcgcg

SEQ ID NO: 564209 - DNA, 25 bp, Rattus norvegicus
tcttgacctctacgcgctgggcgtg

SEQ ID NO: 564210 - DNA, 25 bp, Rattus norvegicus
taagctccgcggcaccgtgcgtgac

SEQ ID NO: 564211 - DNA, 25 bp, Rattus norvegicus
ttttgcacaacgttcccagtaagct

SEQ ID NO: 564212 - DNA, 25 bp, Rattus norvegicus
gggcgtcgccattttgcacaacgtt

SEQ ID NO: 564213 - DNA, 25 bp, Rattus norvegicus
ggccgcgtaaactgggcgtcgccat

SEQ ID NO: 564214 - DNA, 25 bp, Rattus norvegicus
aagaggcttgttgggtttcaggata

SEQ ID NO: 564215 - DNA, 25 bp, Rattus norvegicus
cgcgattagctaagataagaggctt

SEQ ID NO: 564216 - DNA, 25 bp, Rattus norvegicus
cgtcggttcccaacgcgattagcta

SEQ ID NO: 564217 - DNA, 25 bp, Rattus norvegicus
cctctttgtgagtcaggctttcagc

SEQ ID NO: 564218 - DNA, 25 bp, Rattus norvegicus
aggctttcagccgaaacctgtctgc

SEQ ID NO: 564219 - DNA, 25 bp, Rattus norvegicus
acctgtctgctcttgcacaccttgg

SEQ ID NO: 564220 - DNA, 25 bp, Rattus norvegicus
tcttgcacaccttggcaggcagggg

SEQ ID NO: 564221 - DNA, 25 bp, Rattus norvegicus
gagcgcgaaccaggcaggtttgaat

SEQ ID NO: 564222 - DNA, 25 bp, Rattus norvegicus
aggtttgaatcctcagtgacagaca

SEQ ID NO: 564223 - DNA, 25 bp, Rattus norvegicus
aatcctcagtgacagacagccggcc

SEQ ID NO: 564224 - DNA, 25 bp, Rattus norvegicus
ctgcggaggatatgagtcagcattg

SEQ ID NO: 564225 - DNA, 25 bp, Rattus norvegicus
tctcggcgctttggaacgagcatgc

SEQ ID NO: 564226 - DNA, 25 bp, Rattus norvegicus
gctgcggcagatcccggtctcgcgt

SEQ ID NO: 564227 - DNA, 25 bp, Rattus norvegicus
tcgcgtcagcccagcaccaagttgt

SEQ ID NO: 564228 - DNA, 25 bp, Rattus norvegicus
gcaccaagttgtgggtcgtcatttc

SEQ ID NO: 564229 - DNA, 25 bp, Rattus norvegicus
ggtcgtcatttctcggcgctttgga

SEQ ID NO: 564230 - DNA, 25 bp, Rattus norvegicus
gtcagcattgacagtggctgcggca

SEQ ID NO: 564231 - DNA, 25 bp, Rattus norvegicus
tttgaatgcttccttcctcggaggg

SEQ ID NO: 564232 - DNA, 25 bp, Rattus norvegicus
ctcgagtgggtatagctgaggaact

SEQ ID NO: 564233 - DNA, 25 bp, Rattus norvegicus
aactgagcgccaaggacggcctctg

SEQ ID NO: 564234 - DNA, 25 bp, Rattus norvegicus
gtgtcttgctgccagctcctgcttg

SEQ ID NO: 564235 - DNA, 25 bp, Rattus norvegicus
tgctgttctagctggtgcctttccc

SEQ ID NO: 564236 - DNA, 25 bp, Rattus norvegicus
acgctggctttggagcttcggaagt

SEQ ID NO: 564237 - DNA, 25 bp, Rattus norvegicus
tgcgccaggacgacggacaaaggtt

SEQ ID NO: 564238 - DNA, 25 bp, Rattus norvegicus
ctctgtgacccgagggtgtcttgct

SEQ ID NO: 564239 - DNA, 25 bp, Rattus norvegicus
agggattaccctgaaactctatcta

SEQ ID NO: 564240 - DNA, 25 bp, Rattus norvegicus
agcgctgctctttctgtggaggcca

SEQ ID NO: 564241 - DNA, 25 bp, Rattus norvegicus
cctaccaggggtgagcgtagtctaa

SEQ ID NO: 564242 - DNA, 25 bp, Rattus norvegicus
tgctcacctgttgcgccaccgtgag

SEQ ID NO: 564243 - DNA, 25 bp, Rattus norvegicus
ggacctcttggatacgctggctttg

SEQ ID NO: 564244 - DNA, 25 bp, Rattus norvegicus
gctttaactgcacggttggggcttg

SEQ ID NO: 564245 - DNA, 25 bp, Rattus norvegicus
cagtcagtgccagagcctgcggtgt

SEQ ID NO: 564246 - DNA, 25 bp, Rattus norvegicus
agcatcgacagcttgagcgtcctga

SEQ ID NO: 564247 - DNA, 25 bp, Rattus norvegicus
ccgcgcagaagcaagagcatcgaca

SEQ ID NO: 564248 - DNA, 25 bp, Rattus norvegicus
tcgacagcttgagcgtcctgaagag

SEQ ID NO: 564249 - DNA, 25 bp, Rattus norvegicus
gtgtgagatccaagtgcgcgaccct

SEQ ID NO: 564250 - DNA, 25 bp, Rattus norvegicus
tgagatccaagtgcgcgaccctgag

SEQ ID NO: 564251 - DNA, 25 bp, Rattus norvegicus
agagcctgcggtgtgtgagatccaa

SEQ ID NO: 564252 - DNA, 25 bp, Rattus norvegicus
tctgccgcgcagaagcaagagcatc

SEQ ID NO: 564253 - DNA, 25 bp, Rattus norvegicus
ggcctatggcctgggccgcatcagc

SEQ ID NO: 564254 - DNA, 25 bp, Rattus norvegicus
gcagcatccgcagggcctatggcct

SEQ ID NO: 564255 - DNA, 25 bp, Rattus norvegicus
gagctccttcaagcgcaagtctgcg

SEQ ID NO: 564256 - DNA, 25 bp, Rattus norvegicus
gcatcgttcgcgcagcatccgcagg

SEQ ID NO: 564257 - DNA, 25 bp, Rattus norvegicus
gtcctgaagagctccttcaagcgca

SEQ ID NO: 564258 - DNA, 25 bp, Rattus norvegicus
aagcgcaagtctgcgtccaacctca

SEQ ID NO: 564259 - DNA, 25 bp, Rattus norvegicus
ggcgacgctcttgctaacgagagtc

SEQ ID NO: 564260 - DNA, 25 bp, Rattus norvegicus
agggcgctacggaacttgagctgct

SEQ ID NO: 564261 - DNA, 25 bp, Rattus norvegicus
taacgagagtcagcgtgcaccagtc

SEQ ID NO: 564262 - DNA, 25 bp, Rattus norvegicus
agcgtgcaccagtcgggtctgcaac

SEQ ID NO: 564263 - DNA, 25 bp, Rattus norvegicus
ggtctgcaacgcgagtgcccagcgc

SEQ ID NO: 564264 - DNA, 25 bp, Rattus norvegicus
gtgcccagcgcaagctgctaccttg

SEQ ID NO: 564265 - DNA, 25 bp, Rattus norvegicus
tgctaccttggaaacgcagggcgcg

SEQ ID NO: 564266 - DNA, 25 bp, Rattus norvegicus
acgcggtatgcctaccggctgtgcg

SEQ ID NO: 564267 - DNA, 25 bp, Rattus norvegicus
agctgcgcccggagcgttagcacta

SEQ ID NO: 564268 - DNA, 25 bp, Rattus norvegicus
cggagcgttagcactagctggtccc

SEQ ID NO: 564269 - DNA, 25 bp, Rattus norvegicus
gtgggcgctgcctttaacgtcaagc

SEQ ID NO: 564270 - DNA, 25 bp, Rattus norvegicus
cccagggccacctgtgggacctgtt

SEQ ID NO: 564271 - DNA, 25 bp, Rattus norvegicus
cgtctcgctgaaaggggactgcacc

SEQ ID NO: 564272 - DNA, 25 bp, Rattus norvegicus
gactgcaccgggataaggccgtccc

SEQ ID NO: 564273 - DNA, 25 bp, Rattus norvegicus
tccgctgcagttgcgcagtgggaca

SEQ ID NO: 564274 - DNA, 25 bp, Rattus norvegicus
gattcgcacacccacgcacaagtga

SEQ ID NO: 564275 - DNA, 25 bp, Rattus norvegicus
cgcacaagtgacttaaaaacgtctc

SEQ ID NO: 564276 - DNA, 25 bp, Rattus norvegicus
aacgtctccttcacacagattagag

SEQ ID NO: 564277 - DNA, 25 bp, Rattus norvegicus
cagattagagcctaagtctggtcgc

SEQ ID NO: 564278 - DNA, 25 bp, Rattus norvegicus
agtctggtcgctcatgcttttgccc

SEQ ID NO: 564279 - DNA, 25 bp, Rattus norvegicus
cccaagcgacttggcggtctgggac

SEQ ID NO: 564280 - DNA, 25 bp, Rattus norvegicus
gggactgtcactcagcccgcttcta

SEQ ID NO: 564281 - DNA, 25 bp, Rattus norvegicus
cgcttctagcacgtgcgcttcggca

SEQ ID NO: 564282 - DNA, 25 bp, Rattus norvegicus
ttccgaatgcccacccagggacagg

SEQ ID NO: 564283 - DNA, 25 bp, Rattus norvegicus
atgagcgccagctggggttccgaat

SEQ ID NO: 564284 - DNA, 25 bp, Rattus norvegicus
cggtgcccgactgcagtttgagact

SEQ ID NO: 564285 - DNA, 25 bp, Rattus norvegicus
gggctaggcgtgattcgcacaccca

SEQ ID NO: 564286 - DNA, 25 bp, Rattus norvegicus
actaggctctgtagcccggcaaccg

SEQ ID NO: 564287 - DNA, 25 bp, Rattus norvegicus
tgacgatggccacagtgagactctg

SEQ ID NO: 564288 - DNA, 25 bp, Rattus norvegicus
gaacagctgtatcgggtgttgcgcc

SEQ ID NO: 564289 - DNA, 25 bp, Rattus norvegicus
cgtctggtctaggaacagctgtatc

SEQ ID NO: 564290 - DNA, 25 bp, Rattus norvegicus
tcggactgcgtctggtctaggaaca

SEQ ID NO: 564291 - DNA, 25 bp, Rattus norvegicus
cacagtgagactctgagggtccttc

SEQ ID NO: 564292 - DNA, 25 bp, Rattus norvegicus
cgaccaggttgacgatggccacagt

SEQ ID NO: 564293 - DNA, 25 bp, Rattus norvegicus
cacacaaagggcaggcgaccaggtt

SEQ ID NO: 564294 - DNA, 25 bp, Rattus norvegicus
tggtacaaaaggcacacaaagggca

SEQ ID NO: 564295 - DNA, 25 bp, Rattus norvegicus
ctcgttgttggtacaaaaggcacac

SEQ ID NO: 564296 - DNA, 25 bp, Rattus norvegicus
cacgctgggactcgttgttggtaca

SEQ ID NO: 564297 - DNA, 25 bp, Rattus norvegicus
cgctgaatgcagtggcggtcacgct

SEQ ID NO: 564298 - DNA, 25 bp, Rattus norvegicus
tcctgcgctgaatgcagtggcggtc

SEQ ID NO: 564299 - DNA, 25 bp, Rattus norvegicus
gcactctgccggtcctgcgctgaat

SEQ ID NO: 564300 - DNA, 25 bp, Rattus norvegicus
agactctgagggtccttcggactgc

SEQ ID NO: 564301 - DNA, 25 bp, Rattus norvegicus
ggaacaggcctctgccatgaggatc

SEQ ID NO: 564302 - DNA, 25 bp, Rattus norvegicus
aggcagggcttgagtctccttagaa

SEQ ID NO: 564303 - DNA, 25 bp, Rattus norvegicus
tgccctcttagatgggcgcagtcgc

SEQ ID NO: 564304 - DNA, 25 bp, Rattus norvegicus
tcttcgctgagaccggcttcccggt

SEQ ID NO: 564305 - DNA, 25 bp, Rattus norvegicus
gaccgtccctttgcctgtcgcaggt

SEQ ID NO: 564306 - DNA, 25 bp, Rattus norvegicus
gcctgctggcggcaggaaattcacc

SEQ ID NO: 564307 - DNA, 25 bp, Rattus norvegicus
atggccctttacagccctgagcgcg

SEQ ID NO: 564308 - DNA, 25 bp, Rattus norvegicus
gcgacgcctggatggccctttacag

SEQ ID NO: 564309 - DNA, 25 bp, Rattus norvegicus
acagtagcagcttttagggcgcgtc

SEQ ID NO: 564310 - DNA, 25 bp, Rattus norvegicus
ctgaggctcctccaagaacagtagc

SEQ ID NO: 564311 - DNA, 25 bp, Rattus norvegicus
ggaccgtcctttggcatccaggaga

SEQ ID NO: 564312 - DNA, 25 bp, Rattus norvegicus
gaaattcaccggctcctgtctgtca

SEQ ID NO: 564313 - DNA, 25 bp, Rattus norvegicus
gtctccttagaacagccgcagtctg

SEQ ID NO: 564314 - DNA, 25 bp, Rattus norvegicus
cgggacctcaaggagcgcatcttcg

SEQ ID NO: 564315 - DNA, 25 bp, Rattus norvegicus
caggcggcgacgctgcgacacttac

SEQ ID NO: 564316 - DNA, 25 bp, Rattus norvegicus
acaccggatcgagccgggagctagc

SEQ ID NO: 564317 - DNA, 25 bp, Rattus norvegicus
agctagcgtgctatccgctcgtggg

SEQ ID NO: 564318 - DNA, 25 bp, Rattus norvegicus
cagcgcccaacgctcgcccatggtt

SEQ ID NO: 564319 - DNA, 25 bp, Rattus norvegicus
gagcacaacagcaacgaggaccctg

SEQ ID NO: 564320 - DNA, 25 bp, Rattus norvegicus
ccgccagtagcgctgagcacaacag

SEQ ID NO: 564321 - DNA, 25 bp, Rattus norvegicus
ggcccagacgcaggcctagcgtgca

SEQ ID NO: 564322 - DNA, 25 bp, Rattus norvegicus
gtagcagagccaggcgagcacccaa

SEQ ID NO: 564323 - DNA, 25 bp, Rattus norvegicus
gcaccagtgagtcgtagcagagcca

SEQ ID NO: 564324 - DNA, 25 bp, Rattus norvegicus
ctgcgacacttaccagcacgaagtg

SEQ ID NO: 564325 - DNA, 25 bp, Rattus norvegicus
ccactcctcttcactcgggcggagc

SEQ ID NO: 564326 - DNA, 25 bp, Rattus norvegicus
cctactgggcgccagagacatcagg

SEQ ID NO: 564327 - DNA, 25 bp, Rattus norvegicus
tggttccacagcacaccggatcgag

SEQ ID NO: 564328 - DNA, 25 bp, Rattus norvegicus
ccagcacgaagtgcaccagtgagtc

SEQ ID NO: 564329 - DNA, 25 bp, Rattus norvegicus
tgcgcgcgctttcggctaggcgctc

SEQ ID NO: 564330 - DNA, 25 bp, Rattus norvegicus
gctttctacagcttcgaaaattaga

SEQ ID NO: 564331 - DNA, 25 bp, Rattus norvegicus
gggcaactctggagatggcaccttg

SEQ ID NO: 564332 - DNA, 25 bp, Rattus norvegicus
ggacccaggctccatgtgcggcagc

SEQ ID NO: 564333 - DNA, 25 bp, Rattus norvegicus
tacaattcccagattgccaggcgcg

SEQ ID NO: 564334 - DNA, 25 bp, Rattus norvegicus
gggcggagggcgcaaactacaattc

SEQ ID NO: 564335 - DNA, 25 bp, Rattus norvegicus
gagcccgacctagcagcttttaccg

SEQ ID NO: 564336 - DNA, 25 bp, Rattus norvegicus
tgtgctagaaatggagcccgaccta

SEQ ID NO: 564337 - DNA, 25 bp, Rattus norvegicus
ccacagcagctagtcatgtgctaga

SEQ ID NO: 564338 - DNA, 25 bp, Rattus norvegicus
ctccaagccggggttctcggccatg

SEQ ID NO: 564339 - DNA, 25 bp, Rattus norvegicus
ctcttaatgcggtggttctccaagc

SEQ ID NO: 564340 - DNA, 25 bp, Rattus norvegicus
gcggcccttgttcttgaagctctta

SEQ ID NO: 564341 - DNA, 25 bp, Rattus norvegicus
caggtgccgcgctagccgctcagag

SEQ ID NO: 564342 - DNA, 25 bp, Rattus norvegicus
gcaccttgcagcctatccggagaga

SEQ ID NO: 564343 - DNA, 25 bp, Rattus norvegicus
gtgtccaactgtacggcgggcatct

SEQ ID NO: 564344 - DNA, 25 bp, Rattus norvegicus
gtggctaatgccctgactgacttgg

SEQ ID NO: 564345 - DNA, 25 bp, Rattus norvegicus
tttctggaagtaggcgtggctaatg

SEQ ID NO: 564346 - DNA, 25 bp, Rattus norvegicus
ccctcggcctgactgactggaagag

SEQ ID NO: 564347 - DNA, 25 bp, Rattus norvegicus
ggaccagcggccagctcgactaaaa

SEQ ID NO: 564348 - DNA, 25 bp, Rattus norvegicus
ctcggcgaagaagcgaggaccgccc

SEQ ID NO: 564349 - DNA, 25 bp, Rattus norvegicus
cggcgggcatctccttgagaggaat

SEQ ID NO: 564350 - DNA, 25 bp, Rattus norvegicus
tacccatgtgctgcgtgtccaactg

SEQ ID NO: 564351 - DNA, 25 bp, Rattus norvegicus
agtcgggaggcccttacccatgtgc

SEQ ID NO: 564352 - DNA, 25 bp, Rattus norvegicus
ggagagccctccgacgcaggcacag

SEQ ID NO: 564353 - DNA, 25 bp, Rattus norvegicus
gggaacacctgactcctcactggga

SEQ ID NO: 564354 - DNA, 25 bp, Rattus norvegicus
gctttcctcacctgggaacacctga

SEQ ID NO: 564355 - DNA, 25 bp, Rattus norvegicus
tgacactcgacaccggggcactgat

SEQ ID NO: 564356 - DNA, 25 bp, Rattus norvegicus
gaatgtggccagttccgccgtccct

SEQ ID NO: 564357 - DNA, 25 bp, Rattus norvegicus
cccaggagcacttcccaggggttgg

SEQ ID NO: 564358 - DNA, 25 bp, Rattus norvegicus
gagtaagcgtgccaaaagcacatgc

SEQ ID NO: 564359 - DNA, 25 bp, Rattus norvegicus
ctccagttttacagtcaaaccgtgg

SEQ ID NO: 564360 - DNA, 25 bp, Rattus norvegicus
acagcgttctccagttttacagtca

SEQ ID NO: 564361 - DNA, 25 bp, Rattus norvegicus
ttctcttttctctacagcgttctcc

SEQ ID NO: 564362 - DNA, 25 bp, Rattus norvegicus
tgtgtgtaacactctttctcttttc

SEQ ID NO: 564363 - DNA, 25 bp, Rattus norvegicus
caggagagggccaagaatgcagatt

SEQ ID NO: 564364 - DNA, 25 bp, Rattus norvegicus
ctccgctgtggaggcgctctagcca

SEQ ID NO: 564365 - DNA, 25 bp, Rattus norvegicus
cgtggtcgccgtgtccatttcgcac

SEQ ID NO: 564366 - DNA, 25 bp, Rattus norvegicus
ttctccagagaaagagtaagcgtgc

SEQ ID NO: 564367 - DNA, 25 bp, Rattus norvegicus
cacttcccaggggttgggcgacctg

SEQ ID NO: 564368 - DNA, 25 bp, Rattus norvegicus
tgttgttcctgaaaaaatgcaaaga

SEQ ID NO: 564369 - DNA, 25 bp, Rattus norvegicus
ctgagattcaggcaaagtgatatga

SEQ ID NO: 564370 - DNA, 25 bp, Rattus norvegicus
atatgaagggttgggctatgttttg

SEQ ID NO: 564371 - DNA, 25 bp, Rattus norvegicus
gggccactcgtctcctcggccatga

SEQ ID NO: 564372 - DNA, 25 bp, Rattus norvegicus
acagctctttaggtgcgtgcctggg

SEQ ID NO: 564373 - DNA, 25 bp, Rattus norvegicus
actcagctcgctctcccagtccctg

SEQ ID NO: 564374 - DNA, 25 bp, Rattus norvegicus
tcttacagctctttaggtgcgtgcc

SEQ ID NO: 564375 - DNA, 25 bp, Rattus norvegicus
gcctcatcttacagctctttaggtg

SEQ ID NO: 564376 - DNA, 25 bp, Rattus norvegicus
cagcctcatcttacagctctttagg

SEQ ID NO: 564377 - DNA, 25 bp, Rattus norvegicus
gggctctacagcctcatcttacagc

SEQ ID NO: 564378 - DNA, 25 bp, Rattus norvegicus
cgctgggctctacagcctcatctta

SEQ ID NO: 564379 - DNA, 25 bp, Rattus norvegicus
agccggctacgctgggctctacagc

SEQ ID NO: 564380 - DNA, 25 bp, Rattus norvegicus
tcggagccggctacgctgggctcta

SEQ ID NO: 564381 - DNA, 25 bp, Rattus norvegicus
cccgctcgccatccttgcactcgtc

SEQ ID NO: 564382 - DNA, 25 bp, Rattus norvegicus
tctcccagtccctgtcggggccact

SEQ ID NO: 564383 - DNA, 25 bp, Rattus norvegicus
ttgcactcgtcctcatccctgtcca

SEQ ID NO: 564384 - DNA, 25 bp, Rattus norvegicus
ggctacgctgggctctacagcctca

SEQ ID NO: 564385 - DNA, 25 bp, Rattus norvegicus
caggcacttgccataggaatccacc

SEQ ID NO: 564386 - DNA, 25 bp, Rattus norvegicus
tggacccactcggacagcactaaac

SEQ ID NO: 564387 - DNA, 25 bp, Rattus norvegicus
acactggtaggtccacggtctctgc

SEQ ID NO: 564388 - DNA, 25 bp, Rattus norvegicus
gccgtaaaaaagcaatgcgcgcgtc

SEQ ID NO: 564389 - DNA, 25 bp, Rattus norvegicus
ccgcgcggaagtctgtgccgtaaaa

SEQ ID NO: 564390 - DNA, 25 bp, Rattus norvegicus
gcagccactgcaacggcagcggata

SEQ ID NO: 564391 - DNA, 25 bp, Rattus norvegicus
tgcaaatagagcagcggcgcgtacc

SEQ ID NO: 564392 - DNA, 25 bp, Rattus norvegicus
tagcgcatgagctcgcgtacgtagc

SEQ ID NO: 564393 - DNA, 25 bp, Rattus norvegicus
gccgtagctgtgtcctgtaaccgca

SEQ ID NO: 564394 - DNA, 25 bp, Rattus norvegicus
atccacctaagcgagtcagagcacg

SEQ ID NO: 564395 - DNA, 25 bp, Rattus norvegicus
agccgaccaggtcctacgccatagg

SEQ ID NO: 564396 - DNA, 25 bp, Rattus norvegicus
tgctgctggccgaacagacactgag

SEQ ID NO: 564397 - DNA, 25 bp, Rattus norvegicus
cacccaccgggatgtagcgcatgag

SEQ ID NO: 564398 - DNA, 25 bp, Rattus norvegicus
ctatgcgctccgagtcacctgggaa

SEQ ID NO: 564399 - DNA, 25 bp, Rattus norvegicus
gtcgcgctactctcggacaggttat

SEQ ID NO: 564400 - DNA, 25 bp, Rattus norvegicus
cgcgttacccttgtacggcagtgga

SEQ ID NO: 564401 - DNA, 25 bp, Rattus norvegicus
ggtggtcagctttcggacacaactc

SEQ ID NO: 564402 - DNA, 25 bp, Rattus norvegicus
actgaactccgagccaccgtgtgtg

SEQ ID NO: 564403 - DNA, 25 bp, Rattus norvegicus
caccgtgtgtgccttagagccttgt

SEQ ID NO: 564404 - DNA, 25 bp, Rattus norvegicus
tttaaaactgcacaacgggtgtcgc

SEQ ID NO: 564405 - DNA, 25 bp, Rattus norvegicus
gccagcgcttcgcagatctgtcaga

SEQ ID NO: 564406 - DNA, 25 bp, Rattus norvegicus
ctctcccgctagattgatgagatca

SEQ ID NO: 564407 - DNA, 25 bp, Rattus norvegicus
accctgttgcgcatgcggaaacttc

SEQ ID NO: 564408 - DNA, 25 bp, Rattus norvegicus
ccaccgactgtcctttggtctaagt

SEQ ID NO: 564409 - DNA, 25 bp, Rattus norvegicus
tacttgaggctcttaccgatggcgc

SEQ ID NO: 564410 - DNA, 25 bp, Rattus norvegicus
cgagacccactttgctacttgaggc

SEQ ID NO: 564411 - DNA, 25 bp, Rattus norvegicus
ctccaggggagcttctgccagtaaa

SEQ ID NO: 564412 - DNA, 25 bp, Rattus norvegicus
tgaggctcctcattcaaattcgtta

SEQ ID NO: 564413 - DNA, 25 bp, Rattus norvegicus
ccgagcttcgtctcccgtagggagc

SEQ ID NO: 564414 - DNA, 25 bp, Rattus norvegicus
gccgtcgctgctcctcgttctattt

SEQ ID NO: 564415 - DNA, 25 bp, Rattus norvegicus
caccgtggactaggcggactctgca

SEQ ID NO: 564416 - DNA, 25 bp, Rattus norvegicus
ctgcaggtctgcgttcaaaggggat

SEQ ID NO: 564417 - DNA, 25 bp, Rattus norvegicus
ttcaaaggggatcgagacacgcacg

SEQ ID NO: 564418 - DNA, 25 bp, Rattus norvegicus
tctctccgtgcactccggggttaca

SEQ ID NO: 564419 - DNA, 25 bp, Rattus norvegicus
agccacgcgcagatcgcttcctgga

SEQ ID NO: 564420 - DNA, 25 bp, Rattus norvegicus
ccttctaaaagtggagcctggtgga

SEQ ID NO: 564421 - DNA, 25 bp, Rattus norvegicus
acctgtcagagacggtggaagaccc

SEQ ID NO: 564422 - DNA, 25 bp, Rattus norvegicus
tgcagtttcagcaaagctccgagga

SEQ ID NO: 564423 - DNA, 25 bp, Rattus norvegicus
agctccgaggaagttggtccttttg

SEQ ID NO: 564424 - DNA, 25 bp, Rattus norvegicus
gcacacgacctaagtacacagcgcg

SEQ ID NO: 564425 - DNA, 25 bp, Rattus norvegicus
ggtgtgcatgacctgggtacccaca

SEQ ID NO: 564426 - DNA, 25 bp, Rattus norvegicus
acgccttgctcagagtggcgccgaa

SEQ ID NO: 564427 - DNA, 25 bp, Rattus norvegicus
gcccagcccaggaaaccttgaagcg

SEQ ID NO: 564428 - DNA, 25 bp, Rattus norvegicus
caccgaggtcgccaagtagccttca

SEQ ID NO: 564429 - DNA, 25 bp, Rattus norvegicus
tgcactgactcgctacgagggaaga

SEQ ID NO: 564430 - DNA, 25 bp, Rattus norvegicus
agcagcgagctctcctcggtctcag

SEQ ID NO: 564431 - DNA, 25 bp, Rattus norvegicus
agctgctgctgacttcaaccgaagg

SEQ ID NO: 564432 - DNA, 25 bp, Rattus norvegicus
gtttaaggttgtagatcagacgtcc

SEQ ID NO: 564433 - DNA, 25 bp, Rattus norvegicus
tgagactgcctctgcggttagcacc

SEQ ID NO: 564434 - DNA, 25 bp, Rattus norvegicus
acacagttatgtccggggagtgccg

SEQ ID NO: 564435 - DNA, 25 bp, Rattus norvegicus
accaccgggttctttcgcaatccag

SEQ ID NO: 564436 - DNA, 25 bp, Rattus norvegicus
agcactagtgtacccaagactttgc

SEQ ID NO: 564437 - DNA, 25 bp, Rattus norvegicus
ttgagttaaccctccagcagcgagc

SEQ ID NO: 564438 - DNA, 25 bp, Rattus norvegicus
ctgcgaggcgaagaaaactcccttg

SEQ ID NO: 564439 - DNA, 25 bp, Rattus norvegicus
gcgacctctggtcgcggagcttttg

SEQ ID NO: 564440 - DNA, 25 bp, Rattus norvegicus
taaaaacctaggacaccgcgctcgc

SEQ ID NO: 564441 - DNA, 25 bp, Rattus norvegicus
ttgggtactccgcagccattgcagg

SEQ ID NO: 564442 - DNA, 25 bp, Rattus norvegicus
aagccgcaggtatagtgagcggctt

SEQ ID NO: 564443 - DNA, 25 bp, Rattus norvegicus
cagaaggagaaacccacgcgggctc

SEQ ID NO: 564444 - DNA, 25 bp, Rattus norvegicus
cgcagccattgcagggttaatttcc

SEQ ID NO: 564445 - DNA, 25 bp, Rattus norvegicus
acgcagcggcgaagccgcaggtata

SEQ ID NO: 564446 - DNA, 25 bp, Rattus norvegicus
tgtgtccttacctctctgtttggcc

SEQ ID NO: 564447 - DNA, 25 bp, Rattus norvegicus
cccgcagcagcacggattgtcttcg

SEQ ID NO: 564448 - DNA, 25 bp, Rattus norvegicus
tctgccgggactgattgtgtcctta

SEQ ID NO: 564449 - DNA, 25 bp, Rattus norvegicus
aacccggtcgcgtctgccgggactg

SEQ ID NO: 564450 - DNA, 25 bp, Rattus norvegicus
tctgagtacgtgagggttcaacccg

SEQ ID NO: 564451 - DNA, 25 bp, Rattus norvegicus
agctttcccatctgagtacgtgagg

SEQ ID NO: 564452 - DNA, 25 bp, Rattus norvegicus
gtcttcgtagagctttcccatctga

SEQ ID NO: 564453 - DNA, 25 bp, Rattus norvegicus
cacggattgtcttcgtagagctttc

SEQ ID NO: 564454 - DNA, 25 bp, Rattus norvegicus
aagaagcggcagaaggagaaaccca

SEQ ID NO: 564455 - DNA, 25 bp, Rattus norvegicus
acgcgagccaaagcgctgcgcatcg

SEQ ID NO: 564456 - DNA, 25 bp, Rattus norvegicus
ccaccatttggtggctgatggaagc

SEQ ID NO: 564457 - DNA, 25 bp, Rattus norvegicus
cagggtctgcagagccaccatttgg

SEQ ID NO: 564458 - DNA, 25 bp, Rattus norvegicus
ctcctgctgtagtagctgcagggtc

SEQ ID NO: 564459 - DNA, 25 bp, Rattus norvegicus
cccactcctgctgtagtagctgcag

SEQ ID NO: 564460 - DNA, 25 bp, Rattus norvegicus
cgcatctggcctgagcgacgagcct

SEQ ID NO: 564461 - DNA, 25 bp, Rattus norvegicus
atcgccatccgcgccaaggtacagg

SEQ ID NO: 564462 - DNA, 25 bp, Rattus norvegicus
gtcgagtccaccacgcgagccaaag

SEQ ID NO: 564463 - DNA, 25 bp, Rattus norvegicus
tccgaggtcgagtccaccacgcgag

SEQ ID NO: 564464 - DNA, 25 bp, Rattus norvegicus
tggagcgcaggcaaaagagcctagc

SEQ ID NO: 564465 - DNA, 25 bp, Rattus norvegicus
aggcaaaagagcctagcagctttcg

SEQ ID NO: 564466 - DNA, 25 bp, Rattus norvegicus
gctgatggaagccactaagggcgca

SEQ ID NO: 564467 - DNA, 25 bp, Rattus norvegicus
agcctagcagctttcggcgttcggg

SEQ ID NO: 564468 - DNA, 25 bp, Rattus norvegicus
ccgggtccgcatctggcctgagcga

SEQ ID NO: 564469 - DNA, 25 bp, Rattus norvegicus
cgaagggagagtttgcgctgattcc

SEQ ID NO: 564470 - DNA, 25 bp, Rattus norvegicus
tcggcagactgagagtgagaaagcc

SEQ ID NO: 564471 - DNA, 25 bp, Rattus norvegicus
cgtgtcacaacacgcgggaaactcc

SEQ ID NO: 564472 - DNA, 25 bp, Rattus norvegicus
tgcatcctggtcacgtgtcacaaca

SEQ ID NO: 564473 - DNA, 25 bp, Rattus norvegicus
ctttgcaatgcatcctggtcacgtg

SEQ ID NO: 564474 - DNA, 25 bp, Rattus norvegicus
tcggcgacccgcactttgcaatgca

SEQ ID NO: 564475 - DNA, 25 bp, Rattus norvegicus
acttccaggtaaatgcggtcggcgc

SEQ ID NO: 564476 - DNA, 25 bp, Rattus norvegicus
gacttggctgctaggcagctagtgt

SEQ ID NO: 564477 - DNA, 25 bp, Rattus norvegicus
acttccggcggcgtgcgacatggcc

SEQ ID NO: 564478 - DNA, 25 bp, Rattus norvegicus
gctggtggtccggactgaacagccc

SEQ ID NO: 564479 - DNA, 25 bp, Rattus norvegicus
cagatttcaaagaggaagccgagcg

SEQ ID NO: 564480 - DNA, 25 bp, Rattus norvegicus
gggcccgcgcagatttcaaagagga

SEQ ID NO: 564481 - DNA, 25 bp, Rattus norvegicus
gagaaagccgcggagctcctcaacc

SEQ ID NO: 564482 - DNA, 25 bp, Rattus norvegicus
cagctagtgttcctacttccaggta

SEQ ID NO: 564483 - DNA, 25 bp, Rattus norvegicus
tcggatcctcgcctagtggcgcccg

SEQ ID NO: 564484 - DNA, 25 bp, Rattus norvegicus
actgcgtggactctggagccgagac

SEQ ID NO: 564485 - DNA, 25 bp, Rattus norvegicus
gagccgagaccggagggtgagccaa

SEQ ID NO: 564486 - DNA, 25 bp, Rattus norvegicus
acgggagctcagttcttgcggtccc

SEQ ID NO: 564487 - DNA, 25 bp, Rattus norvegicus
agctcagttcttgcggtcccgagcc

SEQ ID NO: 564488 - DNA, 25 bp, Rattus norvegicus
agttcttgcggtcccgagcccgagc

SEQ ID NO: 564489 - DNA, 25 bp, Rattus norvegicus
ccatgaacccgaaggcggccggtga

SEQ ID NO: 564490 - DNA, 25 bp, Rattus norvegicus
acgcgcgccatgaacccgaaggcgg

SEQ ID NO: 564491 - DNA, 25 bp, Rattus norvegicus
gagcgcagaggccacgcgcgccatg

SEQ ID NO: 564492 - DNA, 25 bp, Rattus norvegicus
gcgttcgggactgggtcgttgccaa

SEQ ID NO: 564493 - DNA, 25 bp, Rattus norvegicus
cgcgcatcccgtgcacacgctcgga

SEQ ID NO: 564494 - DNA, 25 bp, Rattus norvegicus
ggctcgtgcacacgcgcgcatcccg

SEQ ID NO: 564495 - DNA, 25 bp, Rattus norvegicus
ccgcactcacgctcgggctcgtgca

SEQ ID NO: 564496 - DNA, 25 bp, Rattus norvegicus
tgccaaggccgggtacgaggctgtc

SEQ ID NO: 564497 - DNA, 25 bp, Rattus norvegicus
cctctgccctattggctggtcctta

SEQ ID NO: 564498 - DNA, 25 bp, Rattus norvegicus
gcccagatggctgcgctggttcata

SEQ ID NO: 564499 - DNA, 25 bp, Rattus norvegicus
gcatattcaaacagctcaggggcgg

SEQ ID NO: 564500 - DNA, 25 bp, Rattus norvegicus
ggtccttacagcctcattagcatat

SEQ ID NO: 564501 - DNA, 25 bp, Rattus norvegicus
gcagacgtgtctatcaggaacagta

SEQ ID NO: 564502 - DNA, 25 bp, Rattus norvegicus
agtcatgtgatccagagaccctctg

SEQ ID NO: 564503 - DNA, 25 bp, Rattus norvegicus
gtggagcccgcagtaaacctgttgc

SEQ ID NO: 564504 - DNA, 25 bp, Rattus norvegicus
ccctgacacgtactcgagtcatgtg

SEQ ID NO: 564505 - DNA, 25 bp, Rattus norvegicus
tcacactccggttttaactcgggca

SEQ ID NO: 564506 - DNA, 25 bp, Rattus norvegicus
ctctcgctactgaagcgcttttctc

SEQ ID NO: 564507 - DNA, 25 bp, Rattus norvegicus
acatggagccagacccagcagagcc

SEQ ID NO: 564508 - DNA, 25 bp, Rattus norvegicus
ctcggtcagtcggtaccttcatgaa

SEQ ID NO: 564509 - DNA, 25 bp, Rattus norvegicus
tgaaggtctctaccgcgcctttggc

SEQ ID NO: 564510 - DNA, 25 bp, Rattus norvegicus
agaagtttgagagactccctccgca

SEQ ID NO: 564511 - DNA, 25 bp, Rattus norvegicus
ctgagttgacgcacgcgcattggct

SEQ ID NO: 564512 - DNA, 25 bp, Rattus norvegicus
ctcggaggacaggtactgactgctt

SEQ ID NO: 564513 - DNA, 25 bp, Rattus norvegicus
accgcatctgcggattcgcttccaa

SEQ ID NO: 564514 - DNA, 25 bp, Rattus norvegicus
tgtgcctaaggaagagggtgtcatc

SEQ ID NO: 564515 - DNA, 25 bp, Rattus norvegicus
tgagcattctcttcagccaagtccc

SEQ ID NO: 564516 - DNA, 25 bp, Rattus norvegicus
tcctgagcgcaagcctgagcattct

SEQ ID NO: 564517 - DNA, 25 bp, Rattus norvegicus
ctgctagtgcccatcctccggaagt

SEQ ID NO: 564518 - DNA, 25 bp, Rattus norvegicus
gtttagcgtctgtccttcctgcagg

SEQ ID NO: 564519 - DNA, 25 bp, Rattus norvegicus
cgcatgcacactctggtctcaacta

SEQ ID NO: 564520 - DNA, 25 bp, Rattus norvegicus
cttagaggtgagtcatctgcgcgca

SEQ ID NO: 564521 - DNA, 25 bp, Rattus norvegicus
cgccctctccggtgtattattgtta

SEQ ID NO: 564522 - DNA, 25 bp, Rattus norvegicus
ccgcttaactatggtcgacagtaca

SEQ ID NO: 564523 - DNA, 25 bp, Rattus norvegicus
ggtgcagacgagagccgcttaacta

SEQ ID NO: 564524 - DNA, 25 bp, Rattus norvegicus
gggcaagcgcgttcacagattttca

SEQ ID NO: 564525 - DNA, 25 bp, Rattus norvegicus
cccacggagctgaggatttcacata

SEQ ID NO: 564526 - DNA, 25 bp, Rattus norvegicus
cgtgagcgacagcaggaactgactt

SEQ ID NO: 564527 - DNA, 25 bp, Rattus norvegicus
tcaaaaccggaagctgtgcgagcgc

SEQ ID NO: 564528 - DNA, 25 bp, Rattus norvegicus
ggcgcacatgctttggaacgaccca

SEQ ID NO: 564529 - DNA, 25 bp, Rattus norvegicus
catcttcccggcatgtgtcggcgca

SEQ ID NO: 564530 - DNA, 25 bp, Rattus norvegicus
caacatcaggaagccagtcagccgc

SEQ ID NO: 564531 - DNA, 25 bp, Rattus norvegicus
cgcgatgggctcacccgaaagtgtt

SEQ ID NO: 564532 - DNA, 25 bp, Rattus norvegicus
ggttatgcgcgtgaagccactgacc

SEQ ID NO: 564533 - DNA, 25 bp, Rattus norvegicus
gaaagtgttgggctcctccaccacc

SEQ ID NO: 564534 - DNA, 25 bp, Rattus norvegicus
gcgctgccttgtgccttggctatgt

SEQ ID NO: 564535 - DNA, 25 bp, Rattus norvegicus
gtgcagactgaagaggccgagaacc

SEQ ID NO: 564536 - DNA, 25 bp, Rattus norvegicus
ttatgggccgcaagaaggttgctcg

SEQ ID NO: 564537 - DNA, 25 bp, Rattus norvegicus
tctctccttgtagcatcggtgcaga

SEQ ID NO: 564538 - DNA, 25 bp, Rattus norvegicus
gctctctggatgctttcgctgagga

SEQ ID NO: 564539 - DNA, 25 bp, Rattus norvegicus
agtggctcggttcggctcagcgact

SEQ ID NO: 564540 - DNA, 25 bp, Rattus norvegicus
agactgcgagtctccggggtgctca

SEQ ID NO: 564541 - DNA, 25 bp, Rattus norvegicus
tccagtggccatggcgcacttcaag

SEQ ID NO: 564542 - DNA, 25 bp, Rattus norvegicus
gtgacccgcagtggtcggcttctct

SEQ ID NO: 564543 - DNA, 25 bp, Rattus norvegicus
ctagtccggcagagctccgggcctt

SEQ ID NO: 564544 - DNA, 25 bp, Rattus norvegicus
tccggcacactagtccggcagagct

SEQ ID NO: 564545 - DNA, 25 bp, Rattus norvegicus
agaagacctaggctccggcacacta

SEQ ID NO: 564546 - DNA, 25 bp, Rattus norvegicus
tattggatcgcggtcctctggaaga

SEQ ID NO: 564547 - DNA, 25 bp, Rattus norvegicus
ctatgttcagtattggatcgcggtc

SEQ ID NO: 564548 - DNA, 25 bp, Rattus norvegicus
ctccgaggccgtagatgctatgttc

SEQ ID NO: 564549 - DNA, 25 bp, Rattus norvegicus
cggctgaagccaccttggctgggtt

SEQ ID NO: 564550 - DNA, 25 bp, Rattus norvegicus
ttcggctcagcgactgcgggcccag

SEQ ID NO: 564551 - DNA, 25 bp, Rattus norvegicus
agctgcgccgtacttaggggtgcac

SEQ ID NO: 564552 - DNA, 25 bp, Rattus norvegicus
tggctccgcggctgaagccaccttg

SEQ ID NO: 564553 - DNA, 25 bp, Rattus norvegicus
tcgttcctaacgtcaaggctcccaa

SEQ ID NO: 564554 - DNA, 25 bp, Rattus norvegicus
atcgccggtcacagatgtcggaggt

SEQ ID NO: 564555 - DNA, 25 bp, Rattus norvegicus
gaggtgagggtctctttctaggccc

SEQ ID NO: 564556 - DNA, 25 bp, Rattus norvegicus
tttcctctaaaaccggacagcgatc

SEQ ID NO: 564557 - DNA, 25 bp, Rattus norvegicus
ccggacagcgatcaggccagaaata

SEQ ID NO: 564558 - DNA, 25 bp, Rattus norvegicus
gatccaggttcgacttcgttcctaa

SEQ ID NO: 564559 - DNA, 25 bp, Rattus norvegicus
aggctcccaagctcgacttccggtt

SEQ ID NO: 564560 - DNA, 25 bp, Rattus norvegicus
caagctcgacttccggttccgaggg

SEQ ID NO: 564561 - DNA, 25 bp, Rattus norvegicus
cttctgccacgtcggccttaggcat

SEQ ID NO: 564562 - DNA, 25 bp, Rattus norvegicus
ccttaggcatgcttccgggaacccg

SEQ ID NO: 564563 - DNA, 25 bp, Rattus norvegicus
gacctaagaccgatcgccggtcaca

SEQ ID NO: 564564 - DNA, 25 bp, Rattus norvegicus
aacccggatgttgcgcatgcgtatg

SEQ ID NO: 564565 - DNA, 25 bp, Rattus norvegicus
gttgcgcatgcgtatgtgttttatc

SEQ ID NO: 564566 - DNA, 25 bp, Rattus norvegicus
ggctccagatccaggttcgacttcg

SEQ ID NO: 564567 - DNA, 25 bp, Rattus norvegicus
ggatcccgctttccgtggagaccag

SEQ ID NO: 564568 - DNA, 25 bp, Rattus norvegicus
aactccatccttgtggctgcggggc

SEQ ID NO: 564569 - DNA, 25 bp, Rattus norvegicus
aagagacctcccgtgcatgcagtgg

SEQ ID NO: 564570 - DNA, 25 bp, Rattus norvegicus
cccggtccatcttgggtatgaaatt

SEQ ID NO: 564571 - DNA, 25 bp, Rattus norvegicus
agctgctcgcaccagaaaaccgtta

SEQ ID NO: 564572 - DNA, 25 bp, Rattus norvegicus
tgggtatgaaattccgccggcctcc

SEQ ID NO: 564573 - DNA, 25 bp, Rattus norvegicus
tcgcagcaggttgtagaactcctcc

SEQ ID NO: 564574 - DNA, 25 bp, Rattus norvegicus
ggcgcgatgaccacaccctagaatt

SEQ ID NO: 564575 - DNA, 25 bp, Rattus norvegicus
cgcatcagtggacgctttggaattc

SEQ ID NO: 564576 - DNA, 25 bp, Rattus norvegicus
aattcgggtacaggcttggtctaca

SEQ ID NO: 564577 - DNA, 25 bp, Rattus norvegicus
gtctacacgtgcctggagctccaag

SEQ ID NO: 564578 - DNA, 25 bp, Rattus norvegicus
gttcacctcttgatacgcctaaggg

SEQ ID NO: 564579 - DNA, 25 bp, Rattus norvegicus
ccgggtggcctagacacttcacgaa

SEQ ID NO: 564580 - DNA, 25 bp, Rattus norvegicus
ggactggaaatgtcaccggcttgta

SEQ ID NO: 564581 - DNA, 25 bp, Rattus norvegicus
agctgccacccgaggtggctccaga

SEQ ID NO: 564582 - DNA, 25 bp, Rattus norvegicus
ctcaccgagattggggtgtctcgca

SEQ ID NO: 564583 - DNA, 25 bp, Rattus norvegicus
aggatgcgcccacatcggccatgta

SEQ ID NO: 564584 - DNA, 25 bp, Rattus norvegicus
gtgtaagcggctccctcagctccag

SEQ ID NO: 564585 - DNA, 25 bp, Rattus norvegicus
gtggctccagaagcagcaccactgc

SEQ ID NO: 564586 - DNA, 25 bp, Rattus norvegicus
ccctgcaggtaggacaggcccagca

SEQ ID NO: 564587 - DNA, 25 bp, Rattus norvegicus
cagcacagaggacggcacccgcgga

SEQ ID NO: 564588 - DNA, 25 bp, Rattus norvegicus
ttggcggccatagccaggctttggt

SEQ ID NO: 564589 - DNA, 25 bp, Rattus norvegicus
aagctctgagcttcggtgtgctccc

SEQ ID NO: 564590 - DNA, 25 bp, Rattus norvegicus
tttgcaagtcaaggagcccacgcgg

SEQ ID NO: 564591 - DNA, 25 bp, Rattus norvegicus
cggcagaccaaagcgacaagaattg

SEQ ID NO: 564592 - DNA, 25 bp, Rattus norvegicus
caggtgtgcagaactgtcgcgaaaa

SEQ ID NO: 564593 - DNA, 25 bp, Rattus norvegicus
cgcactgtgcatgaaggcgccaggt

SEQ ID NO: 564594 - DNA, 25 bp, Rattus norvegicus
tactgctgtaggctgcagcttcccg

SEQ ID NO: 564595 - DNA, 25 bp, Rattus norvegicus
agctgcagcaacagcggagcctcgg

SEQ ID NO: 564596 - DNA, 25 bp, Rattus norvegicus
gctgctctgccaaggatcgtgttta

SEQ ID NO: 564597 - DNA, 25 bp, Rattus norvegicus
tgcggtttgctgctctgccaaggat

SEQ ID NO: 564598 - DNA, 25 bp, Rattus norvegicus
cagcccgacgtccttgcggtttgct

SEQ ID NO: 564599 - DNA, 25 bp, Rattus norvegicus
aaagtgctcagtaccagcgctccgc

SEQ ID NO: 564600 - DNA, 25 bp, Rattus norvegicus
atctctcggggaatgaaagtgctca

SEQ ID NO: 564601 - DNA, 25 bp, Rattus norvegicus
ccagcaggcaaagtccatgcgcgcg

SEQ ID NO: 564602 - DNA, 25 bp, Rattus norvegicus
cgttgcgatcgcctgctctgactgg

SEQ ID NO: 564603 - DNA, 25 bp, Rattus norvegicus
cgcgatctccgtgagtccgcggagc

SEQ ID NO: 564604 - DNA, 25 bp, Rattus norvegicus
ggagcctcgggcgaccactctgcag

SEQ ID NO: 564605 - DNA, 25 bp, Rattus norvegicus
ctgccaaggatcgtgtttattctcg

SEQ ID NO: 564606 - DNA, 25 bp, Rattus norvegicus
ggcaaagtccatgcgcgcggatctc

SEQ ID NO: 564607 - DNA, 25 bp, Rattus norvegicus
cttgtcccttgctcccggagcggtt

SEQ ID NO: 564608 - DNA, 25 bp, Rattus norvegicus
cctgctctgactggcctaagggagt

SEQ ID NO: 564609 - DNA, 25 bp, Rattus norvegicus
gcggcctgtcaggtcttattgatga

SEQ ID NO: 564610 - DNA, 25 bp, Rattus norvegicus
ggctcttaccgctccgcagcgccgc

SEQ ID NO: 564611 - DNA, 25 bp, Rattus norvegicus
cttcccagcccggtgcaccctggcc

SEQ ID NO: 564612 - DNA, 25 bp, Rattus norvegicus
cgctctccggcctcgcttccttccc

SEQ ID NO: 564613 - DNA, 25 bp, Rattus norvegicus
gcagactcgccggcgctcgaggtca

SEQ ID NO: 564614 - DNA, 25 bp, Rattus norvegicus
tgatgaggtgcgcactgaccgccgc

SEQ ID NO: 564615 - DNA, 25 bp, Rattus norvegicus
cttattgatgaggtgcgcactgacc

SEQ ID NO: 564616 - DNA, 25 bp, Rattus norvegicus
caggtcttattgatgaggtgcgcac

SEQ ID NO: 564617 - DNA, 25 bp, Rattus norvegicus
agccggcggcctgtcaggtcttatt

SEQ ID NO: 564618 - DNA, 25 bp, Rattus norvegicus
ccgcccggcgtgatggatggccacg

SEQ ID NO: 564619 - DNA, 25 bp, Rattus norvegicus
agcctccgggaagctatggctctcg

SEQ ID NO: 564620 - DNA, 25 bp, Rattus norvegicus
gcatcgcgagcctccgggaagctat

SEQ ID NO: 564621 - DNA, 25 bp, Rattus norvegicus
acccagcggtgcgagcatcgcgagc

SEQ ID NO: 564622 - DNA, 25 bp, Rattus norvegicus
gcaccctggcctggctcttaccgct

SEQ ID NO: 564623 - DNA, 25 bp, Rattus norvegicus
ggcttcacatttcctacccagagct

SEQ ID NO: 564624 - DNA, 25 bp, Rattus norvegicus
tgcgaaaggggcttgctttgccact

SEQ ID NO: 564625 - DNA, 25 bp, Rattus norvegicus
aaagagacttgagccaccgcggttc

SEQ ID NO: 564626 - DNA, 25 bp, Rattus norvegicus
ccaccgcggttcagactggttgaaa

SEQ ID NO: 564627 - DNA, 25 bp, Rattus norvegicus
ggttcagactggttgaaacacgttc

SEQ ID NO: 564628 - DNA, 25 bp, Rattus norvegicus
tggttgaaacacgttcggagtaatc

SEQ ID NO: 564629 - DNA, 25 bp, Rattus norvegicus
tttgccactctgctccatctggccg

SEQ ID NO: 564630 - DNA, 25 bp, Rattus norvegicus
gagtaatccggcttcacatttccta

SEQ ID NO: 564631 - DNA, 25 bp, Rattus norvegicus
gacttcagccacgactcatccattc

SEQ ID NO: 564632 - DNA, 25 bp, Rattus norvegicus
cctacccagagctaagtggcgagca

SEQ ID NO: 564633 - DNA, 25 bp, Rattus norvegicus
agcaggttcggcaaagtgacagcga

SEQ ID NO: 564634 - DNA, 25 bp, Rattus norvegicus
acgttcggagtaatccggcttcaca

SEQ ID NO: 564635 - DNA, 25 bp, Rattus norvegicus
cccagccttgcgaaaggggcttgct

SEQ ID NO: 564636 - DNA, 25 bp, Rattus norvegicus
agtgacagcgaaccccattggcagg

SEQ ID NO: 564637 - DNA, 25 bp, Rattus norvegicus
gcccaggcctgacgccgctagattt

SEQ ID NO: 564638 - DNA, 25 bp, Rattus norvegicus
ctaccctccgcccaggcctgacgcc

SEQ ID NO: 564639 - DNA, 25 bp, Rattus norvegicus
gcctgacgccgctagatttgttgat

SEQ ID NO: 564640 - DNA, 25 bp, Rattus norvegicus
taccctccgcccaggcctgacgccg

SEQ ID NO: 564641 - DNA, 25 bp, Rattus norvegicus
cctgacgccgctagatttgttgatc

SEQ ID NO: 564642 - DNA, 25 bp, Rattus norvegicus
tagatttgttgatcttagatcagcc

SEQ ID NO: 564643 - DNA, 25 bp, Rattus norvegicus
agatttgttgatcttagatcagccc

SEQ ID NO: 564644 - DNA, 25 bp, Rattus norvegicus
tttgttgatcttagatcagcccccg

SEQ ID NO: 564645 - DNA, 25 bp, Rattus norvegicus
tgttgatcttagatcagcccccggc

SEQ ID NO: 564646 - DNA, 25 bp, Rattus norvegicus
gttgatcttagatcagcccccggcc

SEQ ID NO: 564647 - DNA, 25 bp, Rattus norvegicus
ttgatcttagatcagcccccggcct

SEQ ID NO: 564648 - DNA, 25 bp, Rattus norvegicus
cccggcctttatcacccgagatccg

SEQ ID NO: 564649 - DNA, 25 bp, Rattus norvegicus
ggcctgacgccgctagatttgttga

SEQ ID NO: 564650 - DNA, 25 bp, Rattus norvegicus
gatcttagatcagcccccggccttt

SEQ ID NO: 564651 - DNA, 25 bp, Rattus norvegicus
cggcgcccatctctgaactttccta

SEQ ID NO: 564652 - DNA, 25 bp, Rattus norvegicus
acgccgtcagctccttttcttttgg

SEQ ID NO: 564653 - DNA, 25 bp, Rattus norvegicus
gctgcaccggatccggagctcgacg

SEQ ID NO: 564654 - DNA, 25 bp, Rattus norvegicus
gatccggagctcgacgccgtcagct

SEQ ID NO: 564655 - DNA, 25 bp, Rattus norvegicus
cggatccggagctcgacgccgtcag

SEQ ID NO: 564656 - DNA, 25 bp, Rattus norvegicus
gacgccgtcagctccttttcttttg

SEQ ID NO: 564657 - DNA, 25 bp, Rattus norvegicus
gagctcgacgccgtcagctcctttt

SEQ ID NO: 564658 - DNA, 25 bp, Rattus norvegicus
gccgtcagctccttttcttttggcg

SEQ ID NO: 564659 - DNA, 25 bp, Rattus norvegicus
cgtcagctccttttcttttggcggg

SEQ ID NO: 564660 - DNA, 25 bp, Rattus norvegicus
tcagctccttttcttttggcgggcg

SEQ ID NO: 564661 - DNA, 25 bp, Rattus norvegicus
cagctccttttcttttggcgggcgg

SEQ ID NO: 564662 - DNA, 25 bp, Rattus norvegicus
gggcggattggagcgtggttctccc

SEQ ID NO: 564663 - DNA, 25 bp, Rattus norvegicus
gagctgcaccggatccggagctcga

SEQ ID NO: 564664 - DNA, 25 bp, Rattus norvegicus
tcgacgccgtcagctccttttcttt

SEQ ID NO: 564665 - DNA, 25 bp, Rattus norvegicus
acccgggcgcacttggaccagagat

SEQ ID NO: 564666 - DNA, 25 bp, Rattus norvegicus
gccctgacgcaacgcaaaagaacgt

SEQ ID NO: 564667 - DNA, 25 bp, Rattus norvegicus
gaccggagctcaagaaggtgggttc

SEQ ID NO: 564668 - DNA, 25 bp, Rattus norvegicus
cgacgcgaccggagctcaagaaggt

SEQ ID NO: 564669 - DNA, 25 bp, Rattus norvegicus
tccgacgacgcgaccggagctcaag

SEQ ID NO: 564670 - DNA, 25 bp, Rattus norvegicus
aacggtgcggggaattctcagcgat

SEQ ID NO: 564671 - DNA, 25 bp, Rattus norvegicus
cgcaacgcaaaagaacgtcccttca

SEQ ID NO: 564672 - DNA, 25 bp, Rattus norvegicus
accgccctgacgcaacgcaaaagaa

SEQ ID NO: 564673 - DNA, 25 bp, Rattus norvegicus
tagctctgcggtcgccaggcaaccg

SEQ ID NO: 564674 - DNA, 25 bp, Rattus norvegicus
aatagctctgcggtcgccaggcaac

SEQ ID NO: 564675 - DNA, 25 bp, Rattus norvegicus
cggcggaatagctctgcggtcgcca

SEQ ID NO: 564676 - DNA, 25 bp, Rattus norvegicus
ccgacctgccgcggcttgaatggga

SEQ ID NO: 564677 - DNA, 25 bp, Rattus norvegicus
cgcacttggaccagagatgccggga

SEQ ID NO: 564678 - DNA, 25 bp, Rattus norvegicus
accagagatgccgggaggccgacct

SEQ ID NO: 564679 - DNA, 25 bp, Rattus norvegicus
tcctacactgacctgcagacgcgga

SEQ ID NO: 564680 - DNA, 25 bp, Rattus norvegicus
cggaagactggatgctgagaatgcc

SEQ ID NO: 564681 - DNA, 25 bp, Rattus norvegicus
ctgggctacgtagaagcccttttct

SEQ ID NO: 564682 - DNA, 25 bp, Rattus norvegicus
gcagcacgtgcagagtcaagagttt

SEQ ID NO: 564683 - DNA, 25 bp, Rattus norvegicus
actgacctgcagacgcggaagactg

SEQ ID NO: 564684 - DNA, 25 bp, Rattus norvegicus
agacacggaccatctcctacactga

SEQ ID NO: 564685 - DNA, 25 bp, Rattus norvegicus
cacagacgcggcaggagacacggac

SEQ ID NO: 564686 - DNA, 25 bp, Rattus norvegicus
aagaggtccaattcccgggcacaga

SEQ ID NO: 564687 - DNA, 25 bp, Rattus norvegicus
gcgcgccctgaaagaggtccaattc

SEQ ID NO: 564688 - DNA, 25 bp, Rattus norvegicus
gctggtcgtccagcgcgccctgaaa

SEQ ID NO: 564689 - DNA, 25 bp, Rattus norvegicus
caaacaacaaacttcgctggtcgtc

SEQ ID NO: 564690 - DNA, 25 bp, Rattus norvegicus
agtggcgccctgaagtctctcccga

SEQ ID NO: 564691 - DNA, 25 bp, Rattus norvegicus
ctggcggcccaaaaagcagtggcgc

SEQ ID NO: 564692 - DNA, 25 bp, Rattus norvegicus
tgagaatgccacagccggagccgga

SEQ ID NO: 564693 - DNA, 25 bp, Rattus norvegicus
taccaaaagcgttagcgcgcggaaa

SEQ ID NO: 564694 - DNA, 25 bp, Rattus norvegicus
tagcgcgcggaaaggcgtctgggtt

SEQ ID NO: 564695 - DNA, 25 bp, Rattus norvegicus
agccgcaggaaatggtagaggagcc

SEQ ID NO: 564696 - DNA, 25 bp, Rattus norvegicus
cgtctgggttcggaccgcaacctgg

SEQ ID NO: 564697 - DNA, 25 bp, Rattus norvegicus
gtagtacgaatgtgcccgagtcaga

SEQ ID NO: 564698 - DNA, 25 bp, Rattus norvegicus
ccaaaagcgttagcgcgcggaaagg

SEQ ID NO: 564699 - DNA, 25 bp, Rattus norvegicus
tagtacgaatgtgcccgagtcagag

SEQ ID NO: 564700 - DNA, 25 bp, Rattus norvegicus
agtgtagtacgaatgtgcccgagtc

SEQ ID NO: 564701 - DNA, 25 bp, Rattus norvegicus
acaagtgtagtacgaatgtgcccga

SEQ ID NO: 564702 - DNA, 25 bp, Rattus norvegicus
cgggaacaagtgtagtacgaatgtg

SEQ ID NO: 564703 - DNA, 25 bp, Rattus norvegicus
aggcgggaacaagtgtagtacgaat

SEQ ID NO: 564704 - DNA, 25 bp, Rattus norvegicus
ccgaagaagagtcgaggcgggaaca

SEQ ID NO: 564705 - DNA, 25 bp, Rattus norvegicus
aatggtagaggagccggtcggcgcc

SEQ ID NO: 564706 - DNA, 25 bp, Rattus norvegicus
ttcggaccgcaacctggtggcgtcg

SEQ ID NO: 564707 - DNA, 25 bp, Rattus norvegicus
ctgcactcggcgcagagaaggcttc

SEQ ID NO: 564708 - DNA, 25 bp, Rattus norvegicus
ccggcagtaactccgtgcagaatta

SEQ ID NO: 564709 - DNA, 25 bp, Rattus norvegicus
ttaatccgcagacctagcgcctcgg

SEQ ID NO: 564710 - DNA, 25 bp, Rattus norvegicus
gagtctcttcggcaccactggcctg

SEQ ID NO: 564711 - DNA, 25 bp, Rattus norvegicus
agacgcagggcggttaatccgcaga

SEQ ID NO: 564712 - DNA, 25 bp, Rattus norvegicus
ttcacgccaggccttgcactttctg

SEQ ID NO: 564713 - DNA, 25 bp, Rattus norvegicus
tcggggtagcatccgagctcgagca

SEQ ID NO: 564714 - DNA, 25 bp, Rattus norvegicus
agctcgagcagctagggacttctgg

SEQ ID NO: 564715 - DNA, 25 bp, Rattus norvegicus
agggaggcctactcccgcagacgca

SEQ ID NO: 564716 - DNA, 25 bp, Rattus norvegicus
ggggtcttaatcagctccgcaaact

SEQ ID NO: 564717 - DNA, 25 bp, Rattus norvegicus
cttctggcggaagtagctactggac

SEQ ID NO: 564718 - DNA, 25 bp, Rattus norvegicus
aggcactcaagactcggaagactta

SEQ ID NO: 564719 - DNA, 25 bp, Rattus norvegicus
aaactccatgtctctagcggaggga

SEQ ID NO: 564720 - DNA, 25 bp, Rattus norvegicus
cgttaaggcctgagggcaccgccct

SEQ ID NO: 564721 - DNA, 25 bp, Rattus norvegicus
tctgaaacgccgaggggtcaacctg

SEQ ID NO: 564722 - DNA, 25 bp, Rattus norvegicus
ggcggccatcttggccggtagggta

SEQ ID NO: 564723 - DNA, 25 bp, Rattus norvegicus
ctgaggcacaggagggcggccatct

SEQ ID NO: 564724 - DNA, 25 bp, Rattus norvegicus
tcaacctgatgggtttcggggtcaa

SEQ ID NO: 564725 - DNA, 25 bp, Rattus norvegicus
aaacgccgaggggtcaacctgatgg

SEQ ID NO: 564726 - DNA, 25 bp, Rattus norvegicus
ctgaaacgccgaggggtcaacctga

SEQ ID NO: 564727 - DNA, 25 bp, Rattus norvegicus
ccagcgggattctgaaacgccgagg

SEQ ID NO: 564728 - DNA, 25 bp, Rattus norvegicus
gcccagcgggattctgaaacgccga

SEQ ID NO: 564729 - DNA, 25 bp, Rattus norvegicus
cagcccagcgggattctgaaacgcc

SEQ ID NO: 564730 - DNA, 25 bp, Rattus norvegicus
tcagcccagcgggattctgaaacgc

SEQ ID NO: 564731 - DNA, 25 bp, Rattus norvegicus
catcttggccggtagggtagggcca

SEQ ID NO: 564732 - DNA, 25 bp, Rattus norvegicus
tctcactcagcccagcgggattctg

SEQ ID NO: 564733 - DNA, 25 bp, Rattus norvegicus
gaagtgacgccgaccgcccggaagc

SEQ ID NO: 564734 - DNA, 25 bp, Rattus norvegicus
tcactcagcccagcgggattctgaa

SEQ ID NO: 564735 - DNA, 25 bp, Rattus norvegicus
cccgagctgctatcgctggtacaga

SEQ ID NO: 564736 - DNA, 25 bp, Rattus norvegicus
agctgctatcgctggtacagaacct

SEQ ID NO: 564737 - DNA, 25 bp, Rattus norvegicus
cgcaaacagatgttccggcctggaa

SEQ ID NO: 564738 - DNA, 25 bp, Rattus norvegicus
gaagagacgaagaactcgcccaacc

SEQ ID NO: 564739 - DNA, 25 bp, Rattus norvegicus
cctggaaaggaagagacgaagaact

SEQ ID NO: 564740 - DNA, 25 bp, Rattus norvegicus
tgttccggcctggaaaggaagagac

SEQ ID NO: 564741 - DNA, 25 bp, Rattus norvegicus
ggaacccgcaaacagatgttccggc

SEQ ID NO: 564742 - DNA, 25 bp, Rattus norvegicus
gcaccggcatcctgcaggaggctcg

SEQ ID NO: 564743 - DNA, 25 bp, Rattus norvegicus
tctgtgccggctgcccgcaccggca

SEQ ID NO: 564744 - DNA, 25 bp, Rattus norvegicus
gagcagcgcatctctgtgccggctg

SEQ ID NO: 564745 - DNA, 25 bp, Rattus norvegicus
cagcgctcgggagcagcgcatctct

SEQ ID NO: 564746 - DNA, 25 bp, Rattus norvegicus
ctggatgaaaaacctcgggcgggcg

SEQ ID NO: 564747 - DNA, 25 bp, Rattus norvegicus
aatctggtccggaggaggacgcttt

SEQ ID NO: 564748 - DNA, 25 bp, Rattus norvegicus
tccggaggaggacgctttaagcctc

SEQ ID NO: 564749 - DNA, 25 bp, Rattus norvegicus
atcgtgctagcgctgctggtgttct

SEQ ID NO: 564750 - DNA, 25 bp, Rattus norvegicus
cgtggcttgactgcctgtggatcgt

SEQ ID NO: 564751 - DNA, 25 bp, Rattus norvegicus
tcttcgtgctggtgccgtcgctgct

SEQ ID NO: 564752 - DNA, 25 bp, Rattus norvegicus
gctgaccctgttcttcgtgctggtg

SEQ ID NO: 564753 - DNA, 25 bp, Rattus norvegicus
actacggctgcttcgggctgaccct

SEQ ID NO: 564754 - DNA, 25 bp, Rattus norvegicus
tggccctcgactactaccgcaaggg

SEQ ID NO: 564755 - DNA, 25 bp, Rattus norvegicus
tgctagcgctgctggtgttcttcgg

SEQ ID NO: 564756 - DNA, 25 bp, Rattus norvegicus
cttgactgcctgtggatcgtgctag

SEQ ID NO: 564757 - DNA, 25 bp, Rattus norvegicus
accctgttcttcgtgctggtgccgt

SEQ ID NO: 564758 - DNA, 25 bp, Rattus norvegicus
ttccgctggttcgtgcaggactaca

SEQ ID NO: 564759 - DNA, 25 bp, Rattus norvegicus
ctggttcgtgcaggactacacgggc

SEQ ID NO: 564760 - DNA, 25 bp, Rattus norvegicus
tgtggctggccctcgactactaccg

SEQ ID NO: 564761 - DNA, 25 bp, Rattus norvegicus
tgcagagcctgagcttccgctggtt

SEQ ID NO: 564762 - DNA, 25 bp, Rattus norvegicus
tgctggtgcagagcctgagcttccg

SEQ ID NO: 564763 - DNA, 25 bp, Rattus norvegicus
cgacaatgtcgatgctagcggagcg

SEQ ID NO: 564764 - DNA, 25 bp, Rattus norvegicus
cttggtgacgtcagtagtatgcgcc

SEQ ID NO: 564765 - DNA, 25 bp, Rattus norvegicus
aactaaaagcttgggccgtgcgcgc

SEQ ID NO: 564766 - DNA, 25 bp, Rattus norvegicus
cgcagactcgcttcttggaactaaa

SEQ ID NO: 564767 - DNA, 25 bp, Rattus norvegicus
agatcatctatgtcccgcagactcg

SEQ ID NO: 564768 - DNA, 25 bp, Rattus norvegicus
cccgcgagggacagatcatctatgt

SEQ ID NO: 564769 - DNA, 25 bp, Rattus norvegicus
tgagtgtccgccaagctggacgacc

SEQ ID NO: 564770 - DNA, 25 bp, Rattus norvegicus
gcgtggcgttccgacattcaggaca

SEQ ID NO: 564771 - DNA, 25 bp, Rattus norvegicus
ttcaggctcctcataaccgctgggc

SEQ ID NO: 564772 - DNA, 25 bp, Rattus norvegicus
agtgaaactcttggacccggcgtgc

SEQ ID NO: 564773 - DNA, 25 bp, Rattus norvegicus
tctcagactgttgtcccttgcgctg

SEQ ID NO: 564774 - DNA, 25 bp, Rattus norvegicus
ctcggctttacgtagtccgtggcga

SEQ ID NO: 564775 - DNA, 25 bp, Rattus norvegicus
agcgctcgacagacttgcgacaatg

SEQ ID NO: 564776 - DNA, 25 bp, Rattus norvegicus
tgagccggcttcttccctaactgca

SEQ ID NO: 564777 - DNA, 25 bp, Rattus norvegicus
gctgataaataagggcccggcccga

SEQ ID NO: 564778 - DNA, 25 bp, Rattus norvegicus
cacagtgaaaccgtaggaccagcgc

SEQ ID NO: 564779 - DNA, 25 bp, Rattus norvegicus
cggcccaacagctgaacagggactg

SEQ ID NO: 564780 - DNA, 25 bp, Rattus norvegicus
ggactggacctgactcctgcgccaa

SEQ ID NO: 564781 - DNA, 25 bp, Rattus norvegicus
tcctgcgccaagcagtggtgactgc

SEQ ID NO: 564782 - DNA, 25 bp, Rattus norvegicus
agagtcattggcagacccggtggcc

SEQ ID NO: 564783 - DNA, 25 bp, Rattus norvegicus
caacgcggagcttagcaagatgctg

SEQ ID NO: 564784 - DNA, 25 bp, Rattus norvegicus
ggggcccaagcaagccacagtgaaa

SEQ ID NO: 564785 - DNA, 25 bp, Rattus norvegicus
cccttctcggagtcgcggagagata

SEQ ID NO: 564786 - DNA, 25 bp, Rattus norvegicus
tggccttgcagcacctgcatccgag

SEQ ID NO: 564787 - DNA, 25 bp, Rattus norvegicus
cctggaaactggaactcgagctcaa

SEQ ID NO: 564788 - DNA, 25 bp, Rattus norvegicus
tcgagctcaaggactcagacgggcg

SEQ ID NO: 564789 - DNA, 25 bp, Rattus norvegicus
gacacgaagcgggtcctggaaactg

SEQ ID NO: 564790 - DNA, 25 bp, Rattus norvegicus
gaggcgaagccaagtgacccgcgtt

SEQ ID NO: 564791 - DNA, 25 bp, Rattus norvegicus
gttcccagagtacgtgaagcggcgc

SEQ ID NO: 564792 - DNA, 25 bp, Rattus norvegicus
tcagcagccatgctgtcgtacctgc

SEQ ID NO: 564793 - DNA, 25 bp, Rattus norvegicus
agcggcgcgggccaaaatttatgct

SEQ ID NO: 564794 - DNA, 25 bp, Rattus norvegicus
ctgtctctgagggacaaagttccca

SEQ ID NO: 564795 - DNA, 25 bp, Rattus norvegicus
agcatggacagcgtgtccgtctcgc

SEQ ID NO: 564796 - DNA, 25 bp, Rattus norvegicus
gtcgcccatcatccgtaccgggatg

SEQ ID NO: 564797 - DNA, 25 bp, Rattus norvegicus
gaccttcgaagatgagtcgcccatc

SEQ ID NO: 564798 - DNA, 25 bp, Rattus norvegicus
ccgcgctgatgaccttcgaagatga

SEQ ID NO: 564799 - DNA, 25 bp, Rattus norvegicus
tggcaaagcttcctccgcgctgatg

SEQ ID NO: 564800 - DNA, 25 bp, Rattus norvegicus
tcgtacctgctacggggatcgactc

SEQ ID NO: 564801 - DNA, 25 bp, Rattus norvegicus
actgtgcgcaggctccacgcgcatg

SEQ ID NO: 564802 - DNA, 25 bp, Rattus norvegicus
cccacacattttccgggagggcact

SEQ ID NO: 564803 - DNA, 25 bp, Rattus norvegicus
ccaaaatttatgctggctgggcgcc

SEQ ID NO: 564804 - DNA, 25 bp, Rattus norvegicus
gatcgactctgtgcgtcctggcaaa

SEQ ID NO: 564805 - DNA, 25 bp, Rattus norvegicus
tggctggacgtgtagacgcactttt

SEQ ID NO: 564806 - DNA, 25 bp, Rattus norvegicus
ctccacgtccgcaggacgggtggct

SEQ ID NO: 564807 - DNA, 25 bp, Rattus norvegicus
gcgcgctctccgcagtgacagcaac

SEQ ID NO: 564808 - DNA, 25 bp, Rattus norvegicus
ccagcactgtcctgcccagacgcca

SEQ ID NO: 564809 - DNA, 25 bp, Rattus norvegicus
ccaccttccgccattcgtcttccca

SEQ ID NO: 564810 - DNA, 25 bp, Rattus norvegicus
acaagagactatggttctccatccc

SEQ ID NO: 564811 - DNA, 25 bp, Rattus norvegicus
ggggacgacaagagactatggttct

SEQ ID NO: 564812 - DNA, 25 bp, Rattus norvegicus
cttcactttcaccttgactgcgggg

SEQ ID NO: 564813 - DNA, 25 bp, Rattus norvegicus
cacgcaactagaggcgcgagcacgc

SEQ ID NO: 564814 - DNA, 25 bp, Rattus norvegicus
agcgcgcgcacgcaactagaggcgc

SEQ ID NO: 564815 - DNA, 25 bp, Rattus norvegicus
gtgcctctgtaatctcggacgtcca

SEQ ID NO: 564816 - DNA, 25 bp, Rattus norvegicus
gcacttttgtgcctctgtaatctcg

SEQ ID NO: 564817 - DNA, 25 bp, Rattus norvegicus
gaagtggctctccacgtccgcagga

SEQ ID NO: 564818 - DNA, 25 bp, Rattus norvegicus
acgtgtagacgcacttttgtgcctc

SEQ ID NO: 564819 - DNA, 25 bp, Rattus norvegicus
cggcagcacgatgggcgactccaaa

SEQ ID NO: 564820 - DNA, 25 bp, Rattus norvegicus
agctgtcaccgagctcggcaggcct

SEQ ID NO: 564821 - DNA, 25 bp, Rattus norvegicus
tccagagagcgacgcgcctattttc

SEQ ID NO: 564822 - DNA, 25 bp, Rattus norvegicus
tacaagttccagagagcgacgcgcc

SEQ ID NO: 564823 - DNA, 25 bp, Rattus norvegicus
tggtaaacggaggtgcagtaagaac

SEQ ID NO: 564824 - DNA, 25 bp, Rattus norvegicus
acgcagctcttagggcggacagccc

SEQ ID NO: 564825 - DNA, 25 bp, Rattus norvegicus
ggcgacagatgactacaagttccag

SEQ ID NO: 564826 - DNA, 25 bp, Rattus norvegicus
gcctcctgtacacgcagctcttagg

SEQ ID NO: 564827 - DNA, 25 bp, Rattus norvegicus
gacagccctacttttcgattttcca

SEQ ID NO: 564828 - DNA, 25 bp, Rattus norvegicus
cggccggccttgtgagaacttcaaa

SEQ ID NO: 564829 - DNA, 25 bp, Rattus norvegicus
cgactccaaagtgaaagtggcggta

SEQ ID NO: 564830 - DNA, 25 bp, Rattus norvegicus
accgacgaggtgagaacttgtcccg

SEQ ID NO: 564831 - DNA, 25 bp, Rattus norvegicus
ggccaatgaaccgacgaggtgagaa

SEQ ID NO: 564832 - DNA, 25 bp, Rattus norvegicus
caggtgcctgtagtggtagagcctt

SEQ ID NO: 564833 - DNA, 25 bp, Rattus norvegicus
gccgaacctgcgtttactaccgaga

SEQ ID NO: 564834 - DNA, 25 bp, Rattus norvegicus
gaacttgccgaagctgggccggaaa

SEQ ID NO: 564835 - DNA, 25 bp, Rattus norvegicus
tgcctgagtgaaagtccgcttccca

SEQ ID NO: 564836 - DNA, 25 bp, Rattus norvegicus
agccaccgctgttgcctgagtgaaa

SEQ ID NO: 564837 - DNA, 25 bp, Rattus norvegicus
ttccagtcagggacgagccaccgct

SEQ ID NO: 564838 - DNA, 25 bp, Rattus norvegicus
cctaccggcttccagtcagggacga

SEQ ID NO: 564839 - DNA, 25 bp, Rattus norvegicus
gcaagctcaaggctgcccggtcctt

SEQ ID NO: 564840 - DNA, 25 bp, Rattus norvegicus
ctcaggcttgcatgctgctcggact

SEQ ID NO: 564841 - DNA, 25 bp, Rattus norvegicus
gcaccgatctgttcgtaactttccg

SEQ ID NO: 564842 - DNA, 25 bp, Rattus norvegicus
acagaaatgttaccgtgggccgcta

SEQ ID NO: 564843 - DNA, 25 bp, Rattus norvegicus
aggttgcgcttccacagaaatgtta

SEQ ID NO: 564844 - DNA, 25 bp, Rattus norvegicus
cacgaggagctaaaggttgcgcttc

SEQ ID NO: 564845 - DNA, 25 bp, Rattus norvegicus
atgctgctcggactcctaccggctt

SEQ ID NO: 564846 - DNA, 25 bp, Rattus norvegicus
tttactaccgagaggaaagcaccga

SEQ ID NO: 564847 - DNA, 25 bp, Rattus norvegicus
cgtctgtcagtctgtggtaaaaagc

SEQ ID NO: 564848 - DNA, 25 bp, Rattus norvegicus
tcgcggtctcactagctggggacac

SEQ ID NO: 564849 - DNA, 25 bp, Rattus norvegicus
cagcactcaccgtggacagggcttc

SEQ ID NO: 564850 - DNA, 25 bp, Rattus norvegicus
catcgggtaggagttacagcactca

SEQ ID NO: 564851 - DNA, 25 bp, Rattus norvegicus
cccgacggcagtctgacggcatcgg

SEQ ID NO: 564852 - DNA, 25 bp, Rattus norvegicus
tctgtggtaaaaagcaggttaagcc

SEQ ID NO: 564853 - DNA, 25 bp, Rattus norvegicus
ccactgggagcgtagtgcaaaaacc

SEQ ID NO: 564854 - DNA, 25 bp, Rattus norvegicus
attcccgtgctccactgggagcgta

SEQ ID NO: 564855 - DNA, 25 bp, Rattus norvegicus
tgacgccagtaattcccgtgctcca

SEQ ID NO: 564856 - DNA, 25 bp, Rattus norvegicus
ccgtggcctctgacgccagtaattc

SEQ ID NO: 564857 - DNA, 25 bp, Rattus norvegicus
aggacctcagtttcccgtggcctct

SEQ ID NO: 564858 - DNA, 25 bp, Rattus norvegicus
ctggggacaccgaggcacagcgacc

SEQ ID NO: 564859 - DNA, 25 bp, Rattus norvegicus
cgccctctactgtgctcggagctta

SEQ ID NO: 564860 - DNA, 25 bp, Rattus norvegicus
actgtgctcggagcttaggacgccc

SEQ ID NO: 564861 - DNA, 25 bp, Rattus norvegicus
tcgctacagcaccaggaaccgaggt

SEQ ID NO: 564862 - DNA, 25 bp, Rattus norvegicus
cgcccaaacgttcaggcggcaccgg

SEQ ID NO: 564863 - DNA, 25 bp, Rattus norvegicus
gccctcaagggacgagcttccacag

SEQ ID NO: 564864 - DNA, 25 bp, Rattus norvegicus
caggaaccgaggtcggccaacgccg

SEQ ID NO: 564865 - DNA, 25 bp, Rattus norvegicus
ggcggacctccacggtcgcagaaca

SEQ ID NO: 564866 - DNA, 25 bp, Rattus norvegicus
gacctccacggtcgcagaacacttg

SEQ ID NO: 564867 - DNA, 25 bp, Rattus norvegicus
cccgcccacgacagatagaccacgc

SEQ ID NO: 564868 - DNA, 25 bp, Rattus norvegicus
agtcaagtcccacctcgaaaactcg

SEQ ID NO: 564869 - DNA, 25 bp, Rattus norvegicus
gaaaactcgcccaagccctcaatag

SEQ ID NO: 564870 - DNA, 25 bp, Rattus norvegicus
acggtcgcagaacacttggcccggc

SEQ ID NO: 564871 - DNA, 25 bp, Rattus norvegicus
tctccaggacttcccgccctcaagg

SEQ ID NO: 564872 - DNA, 25 bp, Rattus norvegicus
gcaccgggttgtggatgcaccgccc

SEQ ID NO: 564873 - DNA, 25 bp, Rattus norvegicus
agttcttgctgcacaggcgaactcg

SEQ ID NO: 564874 - DNA, 25 bp, Rattus norvegicus
cccaacgttttgagttcttgctgca

SEQ ID NO: 564875 - DNA, 25 bp, Rattus norvegicus
tggggctcaggcagaaaatttttta

SEQ ID NO: 564876 - DNA, 25 bp, Rattus norvegicus
cagcggtatccatgccgccacgaaa

SEQ ID NO: 564877 - DNA, 25 bp, Rattus norvegicus
cgccacgaaacccagcccagctaga

SEQ ID NO: 564878 - DNA, 25 bp, Rattus norvegicus
tcccgcccttagtgcgagtcacgtg

SEQ ID NO: 564879 - DNA, 25 bp, Rattus norvegicus
ctccggcggcttgtttactcctggc

SEQ ID NO: 564880 - DNA, 25 bp, Rattus norvegicus
cgtttacggcgcgtttacacagcca

SEQ ID NO: 564881 - DNA, 25 bp, Rattus norvegicus
cgcgtttacacagccagaatgcata

SEQ ID NO: 564882 - DNA, 25 bp, Rattus norvegicus
cagccagaatgcatacgtttaagga

SEQ ID NO: 564883 - DNA, 25 bp, Rattus norvegicus
tcggttctggggctcaggcagaaaa

SEQ ID NO: 564884 - DNA, 25 bp, Rattus norvegicus
agcgcgctacgcctgcagaaacagc

SEQ ID NO: 564885 - DNA, 25 bp, Rattus norvegicus
cgcctgcagaaacagcagcggtatc

SEQ ID NO: 564886 - DNA, 25 bp, Rattus norvegicus
tagtgagccgccctgactgcgcagg

SEQ ID NO: 564887 - DNA, 25 bp, Rattus norvegicus
aagcttccgccgagcgaaggctata

SEQ ID NO: 564888 - DNA, 25 bp, Rattus norvegicus
atgcatacgtttaaggaccgaaagg

SEQ ID NO: 564889 - DNA, 25 bp, Rattus norvegicus
acctcttttcgcctcatcatcgtta

SEQ ID NO: 564890 - DNA, 25 bp, Rattus norvegicus
gcctcgcgttacgactacaaacgaa

SEQ ID NO: 564891 - DNA, 25 bp, Rattus norvegicus
tgcgctatacgtagttcggttccgg

SEQ ID NO: 564892 - DNA, 25 bp, Rattus norvegicus
ggggtagcaagatgcgctatacgta

SEQ ID NO: 564893 - DNA, 25 bp, Rattus norvegicus
tcgcgttacgactacaaacgaataa

SEQ ID NO: 564894 - DNA, 25 bp, Rattus norvegicus
tttggctggctttgcagttcggttg

SEQ ID NO: 564895 - DNA, 25 bp, Rattus norvegicus
aactttggctggctttgcagttcgg

SEQ ID NO: 564896 - DNA, 25 bp, Rattus norvegicus
aaaacggcagccagaaactttggct

SEQ ID NO: 564897 - DNA, 25 bp, Rattus norvegicus
cgcctcatcatcgttacccgggttg

SEQ ID NO: 564898 - DNA, 25 bp, Rattus norvegicus
gtccctggcgcctagagcttctggc

SEQ ID NO: 564899 - DNA, 25 bp, Rattus norvegicus
tgtggccctcgccaagctcctgtcc

SEQ ID NO: 564900 - DNA, 25 bp, Rattus norvegicus
acactcttggtccaaagcgaaatgg

SEQ ID NO: 564901 - DNA, 25 bp, Rattus norvegicus
tcttggtccaaagcgaaatggaaag

SEQ ID NO: 564902 - DNA, 25 bp, Rattus norvegicus
ttcaagcgcttccaacctcttttcg

SEQ ID NO: 564903 - DNA, 25 bp, Rattus norvegicus
gtagctatagcagccgcggcggtta

SEQ ID NO: 564904 - DNA, 25 bp, Rattus norvegicus
acgattatcgcgagacatcctcggc

SEQ ID NO: 564905 - DNA, 25 bp, Rattus norvegicus
tttccagcaggtctctcttccacgg

SEQ ID NO: 564906 - DNA, 25 bp, Rattus norvegicus
gcaggtctctcttccacggttctcg

SEQ ID NO: 564907 - DNA, 25 bp, Rattus norvegicus
ctcgccgtcgccgagggaagtatcg

SEQ ID NO: 564908 - DNA, 25 bp, Rattus norvegicus
cgagagttggttgccttggctccct

SEQ ID NO: 564909 - DNA, 25 bp, Rattus norvegicus
cttggctccctgtagctatagcagc

SEQ ID NO: 564910 - DNA, 25 bp, Rattus norvegicus
tgttaggagggactccctttctgtg

SEQ ID NO: 564911 - DNA, 25 bp, Rattus norvegicus
actgaccaccggctagccggtattc

SEQ ID NO: 564912 - DNA, 25 bp, Rattus norvegicus
gccgccatcttacacacgattatcg

SEQ ID NO: 564913 - DNA, 25 bp, Rattus norvegicus
actccctttctgtgcgcagcgggac

SEQ ID NO: 564914 - DNA, 25 bp, Rattus norvegicus
ccggctagccggtattcttgaactc

SEQ ID NO: 564915 - DNA, 25 bp, Rattus norvegicus
tcttgaactcggtcagagcagttgg

SEQ ID NO: 564916 - DNA, 25 bp, Rattus norvegicus
agagcagttggtcctcgcccgcgtt

SEQ ID NO: 564917 - DNA, 25 bp, Rattus norvegicus
tctccagatccagagagcgcggtgc

SEQ ID NO: 564918 - DNA, 25 bp, Rattus norvegicus
ccagatccagagagcgcggtgctgc

SEQ ID NO: 564919 - DNA, 25 bp, Rattus norvegicus
cctctcacgcgtcgccttgtttatg

SEQ ID NO: 564920 - DNA, 25 bp, Rattus norvegicus
ctcacgcgtcgccttgtttatgtcg

SEQ ID NO: 564921 - DNA, 25 bp, Rattus norvegicus
cgtcgccttgtttatgtcgcgggtc

SEQ ID NO: 564922 - DNA, 25 bp, Rattus norvegicus
gccttgtttatgtcgcgggtcctac

SEQ ID NO: 564923 - DNA, 25 bp, Rattus norvegicus
gtcgcgggtcctacggccggatctc

SEQ ID NO: 564924 - DNA, 25 bp, Rattus norvegicus
ggatctccctcccaactttgagcgg

SEQ ID NO: 564925 - DNA, 25 bp, Rattus norvegicus
cctcccaactttgagcggtggccgg

SEQ ID NO: 564926 - DNA, 25 bp, Rattus norvegicus
ctcgcggggccacactgacctgtta

SEQ ID NO: 564927 - DNA, 25 bp, Rattus norvegicus
cactgacctgttaacctgctccttt

SEQ ID NO: 564928 - DNA, 25 bp, Rattus norvegicus
tgacctgttaacctgctccttttcc

SEQ ID NO: 564929 - DNA, 25 bp, Rattus norvegicus
tgctccttttccggctgggccgtca

SEQ ID NO: 564930 - DNA, 25 bp, Rattus norvegicus
tctccctcccaactttgagcggtgg

SEQ ID NO: 564931 - DNA, 25 bp, Rattus norvegicus
tttggccccagtgccgctccgtagt

SEQ ID NO: 564932 - DNA, 25 bp, Rattus norvegicus
cttctggcgggacctttgaaagcgt

SEQ ID NO: 564933 - DNA, 25 bp, Rattus norvegicus
actgcgcgaaggcttgagttttggc

SEQ ID NO: 564934 - DNA, 25 bp, Rattus norvegicus
ggacctttgaaagcgtgagtcttaa

SEQ ID NO: 564935 - DNA, 25 bp, Rattus norvegicus
cgtgagtcttaaacgcagcggcggt

SEQ ID NO: 564936 - DNA, 25 bp, Rattus norvegicus
gtcttaaacgcagcggcggttactg

SEQ ID NO: 564937 - DNA, 25 bp, Rattus norvegicus
agggagctgttcctgcactttcgga

SEQ ID NO: 564938 - DNA, 25 bp, Rattus norvegicus
tgttcctgcactttcggaagcaaga

SEQ ID NO: 564939 - DNA, 25 bp, Rattus norvegicus
tcggaagcaagacagctttgagttc

SEQ ID NO: 564940 - DNA, 25 bp, Rattus norvegicus
gcaagacagctttgagttctaactc

SEQ ID NO: 564941 - DNA, 25 bp, Rattus norvegicus
gacagctttgagttctaactccagt

SEQ ID NO: 564942 - DNA, 25 bp, Rattus norvegicus
ccagcggcctttaaaaacgcgcgcg

SEQ ID NO: 564943 - DNA, 25 bp, Rattus norvegicus
aaacgccgcggcggttacagagttg

SEQ ID NO: 564944 - DNA, 25 bp, Rattus norvegicus
ctccgtagtcttctggcgggacctt

SEQ ID NO: 564945 - DNA, 25 bp, Rattus norvegicus
cttcgttcctcagtctccctttgga

SEQ ID NO: 564946 - DNA, 25 bp, Rattus norvegicus
acgctactgcgttctgattcgtcgc

SEQ ID NO: 564947 - DNA, 25 bp, Rattus norvegicus
attcgtcgctgctcagcgcttccta

SEQ ID NO: 564948 - DNA, 25 bp, Rattus norvegicus
gcgcttcctagagcctgcgccgtga

SEQ ID NO: 564949 - DNA, 25 bp, Rattus norvegicus
ctgcgccgtgattggcttctagcca

SEQ ID NO: 564950 - DNA, 25 bp, Rattus norvegicus
atgacgctaccttcgttcctcagtc

SEQ ID NO: 564951 - DNA, 25 bp, Rattus norvegicus
cgttcaaattcacgcgcgctacttg

SEQ ID NO: 564952 - DNA, 25 bp, Rattus norvegicus
gcgccctgccagtgcgttcaaattc

SEQ ID NO: 564953 - DNA, 25 bp, Rattus norvegicus
caaatctgctcacaggagcccggcg

SEQ ID NO: 564954 - DNA, 25 bp, Rattus norvegicus
gcacctcagcaagcgaacaaatctg

SEQ ID NO: 564955 - DNA, 25 bp, Rattus norvegicus
ctacggaaagatacctcagcacctc

SEQ ID NO: 564956 - DNA, 25 bp, Rattus norvegicus
ccactcctgcgagggacctacggaa

SEQ ID NO: 564957 - DNA, 25 bp, Rattus norvegicus
tcacgcgcgctacttgagatcaacg

SEQ ID NO: 564958 - DNA, 25 bp, Rattus norvegicus
agcagacagcgtgcgcccacattca

SEQ ID NO: 564959 - DNA, 25 bp, Rattus norvegicus
ccggcccagatcaacttccttgata

SEQ ID NO: 564960 - DNA, 25 bp, Rattus norvegicus
ccgcggtgctcgagtagccttggat

SEQ ID NO: 564961 - DNA, 25 bp, Rattus norvegicus
ggatagcgtggttaccgttgtggtg

SEQ ID NO: 564962 - DNA, 25 bp, Rattus norvegicus
attttcaaaactgccgctgccggga

SEQ ID NO: 564963 - DNA, 25 bp, Rattus norvegicus
ccagatcaacttccttgatattttc

SEQ ID NO: 564964 - DNA, 25 bp, Rattus norvegicus
tccctcgtcgtcgtcaccgcttggg

SEQ ID NO: 564965 - DNA, 25 bp, Rattus norvegicus
tcgcgcgcatccctctctccgcctc

SEQ ID NO: 564966 - DNA, 25 bp, Rattus norvegicus
cgcagtcctggcctcgcgcgcatcc

SEQ ID NO: 564967 - DNA, 25 bp, Rattus norvegicus
ggacgccacgctgcccgccggagcc

SEQ ID NO: 564968 - DNA, 25 bp, Rattus norvegicus
tgcttagacagcgtagcaggaggaa

SEQ ID NO: 564969 - DNA, 25 bp, Rattus norvegicus
atgcggctctgtgcccctgcttaga

SEQ ID NO: 564970 - DNA, 25 bp, Rattus norvegicus
atttgcgtggggacacatgcggctc

SEQ ID NO: 564971 - DNA, 25 bp, Rattus norvegicus
cggcccgcgtgtctgggatttgcgt

SEQ ID NO: 564972 - DNA, 25 bp, Rattus norvegicus
atattttcaaaactgccgctgccgg

SEQ ID NO: 564973 - DNA, 25 bp, Rattus norvegicus
agcatcgtgtgcaacccatcaagga

SEQ ID NO: 564974 - DNA, 25 bp, Rattus norvegicus
ggccttcgcgctccttcaaagagga

SEQ ID NO: 564975 - DNA, 25 bp, Rattus norvegicus
cggttttcagacattcgggcttggc

SEQ ID NO: 564976 - DNA, 25 bp, Rattus norvegicus
atccaggcccgtctgaacaatgctg

SEQ ID NO: 564977 - DNA, 25 bp, Rattus norvegicus
agctgttgtgctgtgcctgtcaagc

SEQ ID NO: 564978 - DNA, 25 bp, Rattus norvegicus
ctcacgctcttctgcgtggaggaca

SEQ ID NO: 564979 - DNA, 25 bp, Rattus norvegicus
cacacgctcaacaacctggtggaga

SEQ ID NO: 564980 - DNA, 25 bp, Rattus norvegicus
agtgactctgcgctgtggccacaac

SEQ ID NO: 564981 - DNA, 25 bp, Rattus norvegicus
acattcgtgattggctggaggcacc

SEQ ID NO: 564982 - DNA, 25 bp, Rattus norvegicus
tccgagccctcaaaaaacattcgtg

SEQ ID NO: 564983 - DNA, 25 bp, Rattus norvegicus
tccgcgctggatctaaatggattgc

SEQ ID NO: 564984 - DNA, 25 bp, Rattus norvegicus
cacttcggtgggacgacagatcctt

SEQ ID NO: 564985 - DNA, 25 bp, Rattus norvegicus
caatgctggagtggtacggttttca

SEQ ID NO: 564986 - DNA, 25 bp, Rattus norvegicus
aacgccctcaggctaggcatgaagg

SEQ ID NO: 564987 - DNA, 25 bp, Rattus norvegicus
ccttgcacgtgacacgtttgagtcc

SEQ ID NO: 564988 - DNA, 25 bp, Rattus norvegicus
gtgacacgtttgagtccgtgatccc

SEQ ID NO: 564989 - DNA, 25 bp, Rattus norvegicus
acgtgacacgtttgaggccatgatc

SEQ ID NO: 564990 - DNA, 25 bp, Rattus norvegicus
acccttgcacgtgacacgtttgagg

SEQ ID NO: 564991 - DNA, 25 bp, Rattus norvegicus
cgtgacacgtttgagtccgtgatcc

SEQ ID NO: 564992 - DNA, 25 bp, Rattus norvegicus
gcacgtgacacgtttgagtccgtga

SEQ ID NO: 564993 - DNA, 25 bp, Rattus norvegicus
acgtgacacgtttgagtccgtgatc

SEQ ID NO: 564994 - DNA, 25 bp, Rattus norvegicus
gaacccttgcacgtgacacgtttga

SEQ ID NO: 564995 - DNA, 25 bp, Rattus norvegicus
agaacccttgcacgtgacacgtttg

SEQ ID NO: 564996 - DNA, 25 bp, Rattus norvegicus
cacgtgacacgtttgagtccgtgat

SEQ ID NO: 564997 - DNA, 25 bp, Rattus norvegicus
cccttgcacgtgacacgtttgaggc

SEQ ID NO: 564998 - DNA, 25 bp, Rattus norvegicus
cgtgacacgtttgaggccatgatcc

SEQ ID NO: 564999 - DNA, 25 bp, Rattus norvegicus
ccagaacccttgcacgtgacacgtt

SEQ ID NO: 565000 - DNA, 25 bp, Rattus norvegicus
cagaacccttgcacgtgacacgttt

SEQ ID NO: 565001 - DNA, 25 bp, Rattus norvegicus
ctcagagggcaccttaccaggcaca

SEQ ID NO: 565002 - DNA, 25 bp, Rattus norvegicus
acctaggctcaagggagcgtctgca

SEQ ID NO: 565003 - DNA, 25 bp, Rattus norvegicus
tggaagctccctaacctacgaatta

SEQ ID NO: 565004 - DNA, 25 bp, Rattus norvegicus
agcgtctgcaaactcctcatcggga

SEQ ID NO: 565005 - DNA, 25 bp, Rattus norvegicus
gcctacgccgtctatttaaacatga

SEQ ID NO: 565006 - DNA, 25 bp, Rattus norvegicus
tgagcttcgctcagcccttactcgg

SEQ ID NO: 565007 - DNA, 25 bp, Rattus norvegicus
tgaacggccgcactcttaaagggga

SEQ ID NO: 565008 - DNA, 25 bp, Rattus norvegicus
agcgcgtccactcgaggacacatca

SEQ ID NO: 565009 - DNA, 25 bp, Rattus norvegicus
cattttctgtaattggctagccctg

SEQ ID NO: 565010 - DNA, 25 bp, Rattus norvegicus
atacggggcgttgagacattttctg

SEQ ID NO: 565011 - DNA, 25 bp, Rattus norvegicus
tgaggcctaaacatcctgggaatcg

SEQ ID NO: 565012 - DNA, 25 bp, Rattus norvegicus
gagtcccgggagcaaagatcactga

SEQ ID NO: 565013 - DNA, 25 bp, Rattus norvegicus
gctctggaggtatccttgggctcaa

SEQ ID NO: 565014 - DNA, 25 bp, Rattus norvegicus
tttccaagggtcattcggatgctca

SEQ ID NO: 565015 - DNA, 25 bp, Rattus norvegicus
agaccgctttgtatgcgccaccacg

SEQ ID NO: 565016 - DNA, 25 bp, Rattus norvegicus
ggccctgaaagaggactgcacctcg

SEQ ID NO: 565017 - DNA, 25 bp, Rattus norvegicus
ttacctccgtgagcttgctcgctgc

SEQ ID NO: 565018 - DNA, 25 bp, Rattus norvegicus
agcgccattacctccgtgagcttgc

SEQ ID NO: 565019 - DNA, 25 bp, Rattus norvegicus
gcgccaatcgcagccagcgccatta

SEQ ID NO: 565020 - DNA, 25 bp, Rattus norvegicus
tctggaaccggccaggccatctgcg

SEQ ID NO: 565021 - DNA, 25 bp, Rattus norvegicus
tcattgtctggaaccggccaggcca

SEQ ID NO: 565022 - DNA, 25 bp, Rattus norvegicus
cgacgatcattgtctggaaccggcc

SEQ ID NO: 565023 - DNA, 25 bp, Rattus norvegicus
cctcggccacgacgatcattgtctg

SEQ ID NO: 565024 - DNA, 25 bp, Rattus norvegicus
agaggactgcacctcggccacgacg

SEQ ID NO: 565025 - DNA, 25 bp, Rattus norvegicus
tccgtgagcttgctcgctgctgtcc

SEQ ID NO: 565026 - DNA, 25 bp, Rattus norvegicus
gtgtttgtcccggatagaggccctg

SEQ ID NO: 565027 - DNA, 25 bp, Rattus norvegicus
gtgaattcctcgcagaggtgtttgt

SEQ ID NO: 565028 - DNA, 25 bp, Rattus norvegicus
gaacatcgtgaattcctcgcagagg

SEQ ID NO: 565029 - DNA, 25 bp, Rattus norvegicus
tgactgcgcagagccaatggcctcg

SEQ ID NO: 565030 - DNA, 25 bp, Rattus norvegicus
cgctcactgattggtccgaatcgtg

SEQ ID NO: 565031 - DNA, 25 bp, Rattus norvegicus
cgcccaggcagcaactgctgcagtg

SEQ ID NO: 565032 - DNA, 25 bp, Rattus norvegicus
cagatgcttcatctgcaatgcaggg

SEQ ID NO: 565033 - DNA, 25 bp, Rattus norvegicus
atctgcaatgcagggcacaatggag

SEQ ID NO: 565034 - DNA, 25 bp, Rattus norvegicus
cgcaagcccgcgactaaggggcttc

SEQ ID NO: 565035 - DNA, 25 bp, Rattus norvegicus
cacaatggaggggtgatcatcccgg

SEQ ID NO: 565036 - DNA, 25 bp, Rattus norvegicus
aaagccatccgcttcgcgagagacg

SEQ ID NO: 565037 - DNA, 25 bp, Rattus norvegicus
ctggaggaacaaggacagcatccgg

SEQ ID NO: 565038 - DNA, 25 bp, Rattus norvegicus
caatggcctcgctagcggcgagcgc

SEQ ID NO: 565039 - DNA, 25 bp, Rattus norvegicus
cgcgagagacgctcactgattggtc

SEQ ID NO: 565040 - DNA, 25 bp, Rattus norvegicus
tccgaatcgtgggatatgcaaataa

SEQ ID NO: 565041 - DNA, 25 bp, Rattus norvegicus
acagcatccgggaaggtcttgggct

SEQ ID NO: 565042 - DNA, 25 bp, Rattus norvegicus
cagcaactgctgcagtgcgcgcagg

SEQ ID NO: 565043 - DNA, 25 bp, Rattus norvegicus
cggggcagaacatgccgcagaattt

SEQ ID NO: 565044 - DNA, 25 bp, Rattus norvegicus
tgcctaccgcaaggtgcacagaaag

SEQ ID NO: 565045 - DNA, 25 bp, Rattus norvegicus
gtgtgcactagcctcttgctgctgc

SEQ ID NO: 565046 - DNA, 25 bp, Rattus norvegicus
attgctttctctcggccatggctgg

SEQ ID NO: 565047 - DNA, 25 bp, Rattus norvegicus
ccaacctgatcgtagatgttctgca

SEQ ID NO: 565048 - DNA, 25 bp, Rattus norvegicus
aggcagggacctcttcgtcctctgc

SEQ ID NO: 565049 - DNA, 25 bp, Rattus norvegicus
ccacctccgagcaaagttggatctg

SEQ ID NO: 565050 - DNA, 25 bp, Rattus norvegicus
ccgaggatccttccacggggcagaa

SEQ ID NO: 565051 - DNA, 25 bp, Rattus norvegicus
ggcccactgaaagcgagtcgaaatc

SEQ ID NO: 565052 - DNA, 25 bp, Rattus norvegicus
ccttccggcccgattcaacagatgg

SEQ ID NO: 565053 - DNA, 25 bp, Rattus norvegicus
ttctgcagagcttccttgcccgagg

SEQ ID NO: 565054 - DNA, 25 bp, Rattus norvegicus
cacctcccaggcacaagaagatgag

SEQ ID NO: 565055 - DNA, 25 bp, Rattus norvegicus
tcctccgcgacaagccagggtgcag

SEQ ID NO: 565056 - DNA, 25 bp, Rattus norvegicus
tgctgccttcccagattgctttctc

SEQ ID NO: 565057 - DNA, 25 bp, Rattus norvegicus
aacctcgacccaaaccaatgagctg

SEQ ID NO: 565058 - DNA, 25 bp, Rattus norvegicus
ttcctgcgagtcagtcgcaatagcc

SEQ ID NO: 565059 - DNA, 25 bp, Rattus norvegicus
tgactcgggcgccaggaacgaattc

SEQ ID NO: 565060 - DNA, 25 bp, Rattus norvegicus
ctcctccggacttgcgggtgcggaa

SEQ ID NO: 565061 - DNA, 25 bp, Rattus norvegicus
tgaggcggggcattcgccagctcct

SEQ ID NO: 565062 - DNA, 25 bp, Rattus norvegicus
cacaggcagccggactatagggtct

SEQ ID NO: 565063 - DNA, 25 bp, Rattus norvegicus
tcccgggccacgtgatgacaacaca

SEQ ID NO: 565064 - DNA, 25 bp, Rattus norvegicus
gtgacgtcagaaccttcccgggcca

SEQ ID NO: 565065 - DNA, 25 bp, Rattus norvegicus
gggcagcaacacaacaagtcgagtc

SEQ ID NO: 565066 - DNA, 25 bp, Rattus norvegicus
acagtatccggctctcgggcagcaa

SEQ ID NO: 565067 - DNA, 25 bp, Rattus norvegicus
cggcggctcgactaagtgagacatg

SEQ ID NO: 565068 - DNA, 25 bp, Rattus norvegicus
agggcgtcgctgtcactcacatgcc

SEQ ID NO: 565069 - DNA, 25 bp, Rattus norvegicus
ctaaacctctgtgcccagagcgcag

SEQ ID NO: 565070 - DNA, 25 bp, Rattus norvegicus
cacggccgcaggacgacagtatccg

SEQ ID NO: 565071 - DNA, 25 bp, Rattus norvegicus
ttcttgccgtgaactgcggcgcgct

SEQ ID NO: 565072 - DNA, 25 bp, Rattus norvegicus
tgactggctgcctcccttggggagt

SEQ ID NO: 565073 - DNA, 25 bp, Rattus norvegicus
gcgagtgactggctgcctcccttgg

SEQ ID NO: 565074 - DNA, 25 bp, Rattus norvegicus
caggtgagaggtacccgaagccctg

SEQ ID NO: 565075 - DNA, 25 bp, Rattus norvegicus
ccaggcgttggctgctcggccgtct

SEQ ID NO: 565076 - DNA, 25 bp, Rattus norvegicus
gttctgtgcggggtgtcgctaacgc

SEQ ID NO: 565077 - DNA, 25 bp, Rattus norvegicus
ggtcgctttcttgccgtgaactgcg

SEQ ID NO: 565078 - DNA, 25 bp, Rattus norvegicus
ggtggtcgctttcttgccgtgaact

SEQ ID NO: 565079 - DNA, 25 bp, Rattus norvegicus
ccttcgcccgcatctggtgtggcgg

SEQ ID NO: 565080 - DNA, 25 bp, Rattus norvegicus
agaaacccagacacaatcccttcgc

SEQ ID NO: 565081 - DNA, 25 bp, Rattus norvegicus
caggtgccagtacacggacatccag

SEQ ID NO: 565082 - DNA, 25 bp, Rattus norvegicus
tttcaggtgccagtacacggacatc

SEQ ID NO: 565083 - DNA, 25 bp, Rattus norvegicus
attttttcaggtgccagtacacgga

SEQ ID NO: 565084 - DNA, 25 bp, Rattus norvegicus
tcacaggtgagaggtacccgaagcc

SEQ ID NO: 565085 - DNA, 25 bp, Rattus norvegicus
cttctcccgcggtgaagacggcagc

SEQ ID NO: 565086 - DNA, 25 bp, Rattus norvegicus
agaggaagcggcaccctgtcagccg

SEQ ID NO: 565087 - DNA, 25 bp, Rattus norvegicus
tgtcagccgcccaagggccgtttct

SEQ ID NO: 565088 - DNA, 25 bp, Rattus norvegicus
tacctgccatgtcgcgctgcaaatg

SEQ ID NO: 565089 - DNA, 25 bp, Rattus norvegicus
tgtcgcgctgcaaatggtgaccctg

SEQ ID NO: 565090 - DNA, 25 bp, Rattus norvegicus
aaatggtgaccctgccgggctcgtc

SEQ ID NO: 565091 - DNA, 25 bp, Rattus norvegicus
tcggcaggatggtggcgttcactca

SEQ ID NO: 565092 - DNA, 25 bp, Rattus norvegicus
tggcgttcactcaggggcgtcctgt

SEQ ID NO: 565093 - DNA, 25 bp, Rattus norvegicus
cgtgctccttctcccgcggtgaaga

SEQ ID NO: 565094 - DNA, 25 bp, Rattus norvegicus
ggcaggcgactccactttcaaaatg

SEQ ID NO: 565095 - DNA, 25 bp, Rattus norvegicus
ctggctgcccggtgacgtcactcga

SEQ ID NO: 565096 - DNA, 25 bp, Rattus norvegicus
ttgctctgtgttggtcacgcctcct

SEQ ID NO: 565097 - DNA, 25 bp, Rattus norvegicus
ggccgtttcttctttacctgccatg

SEQ ID NO: 565098 - DNA, 25 bp, Rattus norvegicus
aggggcgtcctgtctcgtgctcctt

SEQ ID NO: 565099 - DNA, 25 bp, Rattus norvegicus
tacagcttagggcacaaggccgacg

SEQ ID NO: 565100 - DNA, 25 bp, Rattus norvegicus
cctctgggagccacgattgcttgcc

SEQ ID NO: 565101 - DNA, 25 bp, Rattus norvegicus
gagccacgattgcttgccgcagcca

SEQ ID NO: 565102 - DNA, 25 bp, Rattus norvegicus
cgcagccacaagctcggcttctgtg

SEQ ID NO: 565103 - DNA, 25 bp, Rattus norvegicus
acaagctcggcttctgtggcgcggt

SEQ ID NO: 565104 - DNA, 25 bp, Rattus norvegicus
gcgcggtggtcagtttttctgccac

SEQ ID NO: 565105 - DNA, 25 bp, Rattus norvegicus
cctccttaagaccttcacaaacata

SEQ ID NO: 565106 - DNA, 25 bp, Rattus norvegicus
acaaacataatcaacgccaaggcgg

SEQ ID NO: 565107 - DNA, 25 bp, Rattus norvegicus
aatcaacgccaaggcggttggcaga

SEQ ID NO: 565108 - DNA, 25 bp, Rattus norvegicus
gcagaaaggcgctcggcgcgcacaa

SEQ ID NO: 565109 - DNA, 25 bp, Rattus norvegicus
cgcacaagcgctacagcttagggca

SEQ ID NO: 565110 - DNA, 25 bp, Rattus norvegicus
agcgctacagcttagggcacaaggc

SEQ ID NO: 565111 - DNA, 25 bp, Rattus norvegicus
acgggagcaaccctctgggagccac

SEQ ID NO: 565112 - DNA, 25 bp, Rattus norvegicus
cgaaggagacgggagcaaccctctg

SEQ ID NO: 565113 - DNA, 25 bp, Rattus norvegicus
atgcaaatgaggctccttatcgggc

SEQ ID NO: 565114 - DNA, 25 bp, Rattus norvegicus
aacactcggggctctggccgggact

SEQ ID NO: 565115 - DNA, 25 bp, Rattus norvegicus
actcccggcttgtggcttgcaatag

SEQ ID NO: 565116 - DNA, 25 bp, Rattus norvegicus
ttgtggcttgcaatagcctttcacc

SEQ ID NO: 565117 - DNA, 25 bp, Rattus norvegicus
atagcctttcacctcccggacttcg

SEQ ID NO: 565118 - DNA, 25 bp, Rattus norvegicus
cgggcaccgcaaagcttggcgaacg

SEQ ID NO: 565119 - DNA, 25 bp, Rattus norvegicus
caccgcaaagcttggcgaacgctgc

SEQ ID NO: 565120 - DNA, 25 bp, Rattus norvegicus
ggcttgcccagagccggccaatccc

SEQ ID NO: 565121 - DNA, 25 bp, Rattus norvegicus
gcaggctaaacactcggggctctgg

SEQ ID NO: 565122 - DNA, 25 bp, Rattus norvegicus
caatcccgggcgtccatgcaaatga

SEQ ID NO: 565123 - DNA, 25 bp, Rattus norvegicus
gaggctccttatcgggcctcggctc

SEQ ID NO: 565124 - DNA, 25 bp, Rattus norvegicus
ggctctgcggcttgctcaaccaccg

SEQ ID NO: 565125 - DNA, 25 bp, Rattus norvegicus
agtaaccattcatggggcccgcgcg

SEQ ID NO: 565126 - DNA, 25 bp, Rattus norvegicus
gcccgggttgtagtaaccattcatg

SEQ ID NO: 565127 - DNA, 25 bp, Rattus norvegicus
tctcggattgctttggagaacacca

SEQ ID NO: 565128 - DNA, 25 bp, Rattus norvegicus
cagatctgaagctaccgaggataaa

SEQ ID NO: 565129 - DNA, 25 bp, Rattus norvegicus
ctgaagctaccgaggataaaaacgc

SEQ ID NO: 565130 - DNA, 25 bp, Rattus norvegicus
cgaggataaaaacgcaaagtttgca

SEQ ID NO: 565131 - DNA, 25 bp, Rattus norvegicus
caaagtttgcattgtgcgtggagga

SEQ ID NO: 565132 - DNA, 25 bp, Rattus norvegicus
tggaggaaagggctggctatttctt

SEQ ID NO: 565133 - DNA, 25 bp, Rattus norvegicus
gaggaaagggctggctatttctttc

SEQ ID NO: 565134 - DNA, 25 bp, Rattus norvegicus
cctctgccgcttttctcggattgct

SEQ ID NO: 565135 - DNA, 25 bp, Rattus norvegicus
cgcttttctcggattgctttggaga

SEQ ID NO: 565136 - DNA, 25 bp, Rattus norvegicus
ggattgctttggagaacaccatttg

SEQ ID NO: 565137 - DNA, 25 bp, Rattus norvegicus
cccgaggcgacagatctgaagctac

SEQ ID NO: 565138 - DNA, 25 bp, Rattus norvegicus
cgacctagagtggaagccccgaggc

SEQ ID NO: 565139 - DNA, 25 bp, Rattus norvegicus
gcgacagatctgaagctaccgagga

SEQ ID NO: 565140 - DNA, 25 bp, Rattus norvegicus
ctgccgcttttctcggattgctttg

SEQ ID NO: 565141 - DNA, 25 bp, Rattus norvegicus
gcatctttcctgatggcttggagac

SEQ ID NO: 565142 - DNA, 25 bp, Rattus norvegicus
cggcgagaggatccggagaggcctg

SEQ ID NO: 565143 - DNA, 25 bp, Rattus norvegicus
ctttcctgatggcttggagacttgg

SEQ ID NO: 565144 - DNA, 25 bp, Rattus norvegicus
cggtgcgcgaagatccgagctggcg

SEQ ID NO: 565145 - DNA, 25 bp, Rattus norvegicus
atcagagccggctttccggtcacta

SEQ ID NO: 565146 - DNA, 25 bp, Rattus norvegicus
tcagagccggctttccggtcactag

SEQ ID NO: 565147 - DNA, 25 bp, Rattus norvegicus
agagccggctttccggtcactaggt

SEQ ID NO: 565148 - DNA, 25 bp, Rattus norvegicus
actaggttccccacgctgcctgaga

SEQ ID NO: 565149 - DNA, 25 bp, Rattus norvegicus
acgctgcctgagagcgcctctcctc

SEQ ID NO: 565150 - DNA, 25 bp, Rattus norvegicus
cagcatctttcctgatggcttggag

SEQ ID NO: 565151 - DNA, 25 bp, Rattus norvegicus
agcatctttcctgatggcttggaga

SEQ ID NO: 565152 - DNA, 25 bp, Rattus norvegicus
atctttcctgatggcttggagactt

SEQ ID NO: 565153 - DNA, 25 bp, Rattus norvegicus
agcccagcggccagatggtggcggc

SEQ ID NO: 565154 - DNA, 25 bp, Rattus norvegicus
tctagcggagcggtgcgcgaagatc

SEQ ID NO: 565155 - DNA, 25 bp, Rattus norvegicus
gatgcgcagaaagaactcgctgggc

SEQ ID NO: 565156 - DNA, 25 bp, Rattus norvegicus
tgtcctcggcctcgtcatcggtgct

SEQ ID NO: 565157 - DNA, 25 bp, Rattus norvegicus
cctctccagagagcagggactcgcg

SEQ ID NO: 565158 - DNA, 25 bp, Rattus norvegicus
aatgactcggcacgccgcagtggcg

SEQ ID NO: 565159 - DNA, 25 bp, Rattus norvegicus
tggtccaatgactcggcacgccgca

SEQ ID NO: 565160 - DNA, 25 bp, Rattus norvegicus
ctgcggtggtccaatgactcggcac

SEQ ID NO: 565161 - DNA, 25 bp, Rattus norvegicus
gtccagcgtgctgcggtggtccaat

SEQ ID NO: 565162 - DNA, 25 bp, Rattus norvegicus
gaaagaactcgctgggcagggccac

SEQ ID NO: 565163 - DNA, 25 bp, Rattus norvegicus
agggccaccatctgcccgttgcagt

SEQ ID NO: 565164 - DNA, 25 bp, Rattus norvegicus
ctccagagagcagggactcgcgctc

SEQ ID NO: 565165 - DNA, 25 bp, Rattus norvegicus
tctgcccgttgcagtcatggaactt

SEQ ID NO: 565166 - DNA, 25 bp, Rattus norvegicus
cccacactggctgcggcgtttgagg

SEQ ID NO: 565167 - DNA, 25 bp, Rattus norvegicus
gttcccgtgcttggtctgctgtcct

SEQ ID NO: 565168 - DNA, 25 bp, Rattus norvegicus
cagtcatggaacttggtcggcagga

SEQ ID NO: 565169 - DNA, 25 bp, Rattus norvegicus
ccgccggatagtttactctattagc

SEQ ID NO: 565170 - DNA, 25 bp, Rattus norvegicus
attggcgcaggtcagtgtcaatctg

SEQ ID NO: 565171 - DNA, 25 bp, Rattus norvegicus
aaccgaacgctgattggcttaatgc

SEQ ID NO: 565172 - DNA, 25 bp, Rattus norvegicus
ttcaccgccgtctagtattactctg

SEQ ID NO: 565173 - DNA, 25 bp, Rattus norvegicus
gcagatactcctttccgtcaaccag

SEQ ID NO: 565174 - DNA, 25 bp, Rattus norvegicus
agagcggccctttgccagtagcttc

SEQ ID NO: 565175 - DNA, 25 bp, Rattus norvegicus
ctaaagcccagcgaggagttgactg

SEQ ID NO: 565176 - DNA, 25 bp, Rattus norvegicus
tgaccaatcgtgacagaaccgccgg

SEQ ID NO: 565177 - DNA, 25 bp, Rattus norvegicus
ttggctgctggaaacttcgaaaatg

SEQ ID NO: 565178 - DNA, 25 bp, Rattus norvegicus
gttccgcggagcaatacttcagttg

SEQ ID NO: 565179 - DNA, 25 bp, Rattus norvegicus
tccggaagaatcacagacagccatg

SEQ ID NO: 565180 - DNA, 25 bp, Rattus norvegicus
cagaccttactctcgtgctctcgga

SEQ ID NO: 565181 - DNA, 25 bp, Rattus norvegicus
agggcttcctgcaggtcgctgcaca

SEQ ID NO: 565182 - DNA, 25 bp, Rattus norvegicus
acgtgcgcctgctcagtaacgctta

SEQ ID NO: 565183 - DNA, 25 bp, Rattus norvegicus
tctgcctcttggtagggatccaacg

SEQ ID NO: 565184 - DNA, 25 bp, Rattus norvegicus
cacagtgcgcgccactagagttggg

SEQ ID NO: 565185 - DNA, 25 bp, Rattus norvegicus
agcacttttacatcagagcgggttg

SEQ ID NO: 565186 - DNA, 25 bp, Rattus norvegicus
tgaaatctcggggttgcagcaccgg

SEQ ID NO: 565187 - DNA, 25 bp, Rattus norvegicus
caaagtggactcagtggcgctcaga

SEQ ID NO: 565188 - DNA, 25 bp, Rattus norvegicus
agcggctacagccactcgtgctcgg

SEQ ID NO: 565189 - DNA, 25 bp, Rattus norvegicus
caaaacttgggcgactttggcgcgc

SEQ ID NO: 565190 - DNA, 25 bp, Rattus norvegicus
tgagagttactggtcgcctccggac

SEQ ID NO: 565191 - DNA, 25 bp, Rattus norvegicus
gcctccggacctcaataaatatttg

SEQ ID NO: 565192 - DNA, 25 bp, Rattus norvegicus
ctcgctgaccacctacggcagtggg

SEQ ID NO: 565193 - DNA, 25 bp, Rattus norvegicus
ccgagcttcaaggtccgcagggaac

SEQ ID NO: 565194 - DNA, 25 bp, Rattus norvegicus
atccaacgggccatggcgacgactt

SEQ ID NO: 565195 - DNA, 25 bp, Rattus norvegicus
aatgaatgagccgtgtgctcccgcc

SEQ ID NO: 565196 - DNA, 25 bp, Rattus norvegicus
gactcctccgccatgttcgggcaaa

SEQ ID NO: 565197 - DNA, 25 bp, Rattus norvegicus
caggctcagatccagtatgctcaga

SEQ ID NO: 565198 - DNA, 25 bp, Rattus norvegicus
tcccggcgtataaatagaggtggca

SEQ ID NO: 565199 - DNA, 25 bp, Rattus norvegicus
ctcagtacgagaagctggccgccaa

SEQ ID NO: 565200 - DNA, 25 bp, Rattus norvegicus
ctctcaaggacatccgcgctcagta

SEQ ID NO: 565201 - DNA, 25 bp, Rattus norvegicus
atctccgtggagatggacgtgtcct

SEQ ID NO: 565202 - DNA, 25 bp, Rattus norvegicus
ccgccaccatgagttcgttcagcta

SEQ ID NO: 565203 - DNA, 25 bp, Rattus norvegicus
cgttcagctacgagccgtacttttc

SEQ ID NO: 565204 - DNA, 25 bp, Rattus norvegicus
tttcgacctcctacaagcggcgcta

SEQ ID NO: 565205 - DNA, 25 bp, Rattus norvegicus
ccagcttcatcgagcgcgtgcacga

SEQ ID NO: 565206 - DNA, 25 bp, Rattus norvegicus
tgcgccagaagcactcagagccttc

SEQ ID NO: 565207 - DNA, 25 bp, Rattus norvegicus
ccgcgccctgtatgagcaggagatc

SEQ ID NO: 565208 - DNA, 25 bp, Rattus norvegicus
tggccgccaagaatatgcagaatgc

SEQ ID NO: 565209 - DNA, 25 bp, Rattus norvegicus
tgcgcaacctgcaggctcgctacga

SEQ ID NO: 565210 - DNA, 25 bp, Rattus norvegicus
cagcctgatggacgagatagccttc

SEQ ID NO: 565211 - DNA, 25 bp, Rattus norvegicus
ggatgtcttcctccaagtgatcaga

SEQ ID NO: 565212 - DNA, 25 bp, Rattus norvegicus
tcaatgctcttggactgcagctggc

SEQ ID NO: 565213 - DNA, 25 bp, Rattus norvegicus
cgtagcggcatttgaaccactcttc

SEQ ID NO: 565214 - DNA, 25 bp, Rattus norvegicus
gcgagtccagcgtgtagctcatctt

SEQ ID NO: 565215 - DNA, 25 bp, Rattus norvegicus
actcggcgatctcttctttagcgga

SEQ ID NO: 565216 - DNA, 25 bp, Rattus norvegicus
ggggaaccgctcacacgactgaagc

SEQ ID NO: 565217 - DNA, 25 bp, Rattus norvegicus
ctctttctcgttggagcgggacagc

SEQ ID NO: 565218 - DNA, 25 bp, Rattus norvegicus
agcggatctctttcagcgccgtgga

SEQ ID NO: 565219 - DNA, 25 bp, Rattus norvegicus
tcggatctcctggtcgtaagcgtca

SEQ ID NO: 565220 - DNA, 25 bp, Rattus norvegicus
actcctctatgtctttgcgcagcgc

SEQ ID NO: 565221 - DNA, 25 bp, Rattus norvegicus
tgcagcgactgcaccttcttgtcca

SEQ ID NO: 565222 - DNA, 25 bp, Rattus norvegicus
cctcttcgtgattgctccgcaggaa

SEQ ID NO: 565223 - DNA, 25 bp, Rattus norvegicus
gtcttcaggtagtctttgcgctcta

SEQ ID NO: 565224 - DNA, 25 bp, Rattus norvegicus
gcactttctcgatgtagccggcgaa

SEQ ID NO: 565225 - DNA, 25 bp, Rattus norvegicus
gcctagatcccgacagacacgcatt

SEQ ID NO: 565226 - DNA, 25 bp, Rattus norvegicus
tggcagtgcccgtacttgtactgga

SEQ ID NO: 565227 - DNA, 25 bp, Rattus norvegicus
ggcactccctacagcgctagctatg

SEQ ID NO: 565228 - DNA, 25 bp, Rattus norvegicus
ctgatctcgaaatgaactgtccgga

SEQ ID NO: 565229 - DNA, 25 bp, Rattus norvegicus
cagcgatacctgtctgcgccggagc

SEQ ID NO: 565230 - DNA, 25 bp, Rattus norvegicus
caaaaccggcgctacaagtgcaaga

SEQ ID NO: 565231 - DNA, 25 bp, Rattus norvegicus
gtgctattttcgcaggcccaggtgc

SEQ ID NO: 565232 - DNA, 25 bp, Rattus norvegicus
tactggacgtcaagccctgcctaga

SEQ ID NO: 565233 - DNA, 25 bp, Rattus norvegicus
tgcttcagcagctacacaggcactc

SEQ ID NO: 565234 - DNA, 25 bp, Rattus norvegicus
accgctggctagctctggcttcagc

SEQ ID NO: 565235 - DNA, 25 bp, Rattus norvegicus
cggcctagtgaaaaacctgggctca

SEQ ID NO: 565236 - DNA, 25 bp, Rattus norvegicus
gtgcctgatgcctgatgcctgatcc

SEQ ID NO: 565237 - DNA, 25 bp, Rattus norvegicus
gcactgccggtcgtactgatctcga

SEQ ID NO: 565238 - DNA, 25 bp, Rattus norvegicus
acttggccagtgtgctgcagctcac

SEQ ID NO: 565239 - DNA, 25 bp, Rattus norvegicus
ccagtctggccttccagcggtagtc

SEQ ID NO: 565240 - DNA, 25 bp, Rattus norvegicus
gctagttcccagtctccagtctggc

SEQ ID NO: 565241 - DNA, 25 bp, Rattus norvegicus
ggccagtcagctagttcccagtctc

SEQ ID NO: 565242 - DNA, 25 bp, Rattus norvegicus
tcttccgccggccagtcagctagtt

SEQ ID NO: 565243 - DNA, 25 bp, Rattus norvegicus
ctggttcaggtgaggaccgacaccc

SEQ ID NO: 565244 - DNA, 25 bp, Rattus norvegicus
gtgtgacgctgctttctggttcagg

SEQ ID NO: 565245 - DNA, 25 bp, Rattus norvegicus
ctccctggctccatattgcaggaaa

SEQ ID NO: 565246 - DNA, 25 bp, Rattus norvegicus
gccttccagcggtagtcgtggaacc

SEQ ID NO: 565247 - DNA, 25 bp, Rattus norvegicus
ttcaactcggagagagagacacgcg

SEQ ID NO: 565248 - DNA, 25 bp, Rattus norvegicus
ccatattgcaggaaagcgggctagg

SEQ ID NO: 565249 - DNA, 25 bp, Rattus norvegicus
gcaccacctggagtagattcaactc

SEQ ID NO: 565250 - DNA, 25 bp, Rattus norvegicus
ggacccaagcttccgtcttcccgca

SEQ ID NO: 565251 - DNA, 25 bp, Rattus norvegicus
agagacacgcgttaaaaccagcaga

SEQ ID NO: 565252 - DNA, 25 bp, Rattus norvegicus
taaaaccagcagagccacctgaggg

SEQ ID NO: 565253 - DNA, 25 bp, Rattus norvegicus
ggcagcgccacccacgcagtccaag

SEQ ID NO: 565254 - DNA, 25 bp, Rattus norvegicus
tcatccaggacatcctgcgggacca

SEQ ID NO: 565255 - DNA, 25 bp, Rattus norvegicus
ggctcacgtccttcctcatccagga

SEQ ID NO: 565256 - DNA, 25 bp, Rattus norvegicus
gagcccaccgcagccaatcggggcg

SEQ ID NO: 565257 - DNA, 25 bp, Rattus norvegicus
caatcggggcgcagccgtgttcccg

SEQ ID NO: 565258 - DNA, 25 bp, Rattus norvegicus
agccgtgttcccgcggccaatgggc

SEQ ID NO: 565259 - DNA, 25 bp, Rattus norvegicus
cgcggcgctcagcatggctataagt

SEQ ID NO: 565260 - DNA, 25 bp, Rattus norvegicus
catggctataagtgcgcgcgaccta

SEQ ID NO: 565261 - DNA, 25 bp, Rattus norvegicus
gtgcgcgcgacctagcgatagcaaa

SEQ ID NO: 565262 - DNA, 25 bp, Rattus norvegicus
gcgacctagcgatagcaaaagcggc

SEQ ID NO: 565263 - DNA, 25 bp, Rattus norvegicus
ccacgcagtccaagcggctcacgtc

SEQ ID NO: 565264 - DNA, 25 bp, Rattus norvegicus
ctagcgatagcaaaagcggcgcgca

SEQ ID NO: 565265 - DNA, 25 bp, Rattus norvegicus
tggtcgcagtccctgggcagcgcca

SEQ ID NO: 565266 - DNA, 25 bp, Rattus norvegicus
gatgcttagggtagcggagccccaa

SEQ ID NO: 565267 - DNA, 25 bp, Rattus norvegicus
agccgagcagccagaagcaccaata

SEQ ID NO: 565268 - DNA, 25 bp, Rattus norvegicus
ccaccgggtacatgatggagtgctc

SEQ ID NO: 565269 - DNA, 25 bp, Rattus norvegicus
atggagtgctccagaatcccggcca

SEQ ID NO: 565270 - DNA, 25 bp, Rattus norvegicus
tcaccttcacggagtccaccgggta

SEQ ID NO: 565271 - DNA, 25 bp, Rattus norvegicus
ctgcacgcacccaatccgggagaga

SEQ ID NO: 565272 - DNA, 25 bp, Rattus norvegicus
gagcgacacggtacgctttcccgga

SEQ ID NO: 565273 - DNA, 25 bp, Rattus norvegicus
ggcgtcagaagtgcaagactccctg

SEQ ID NO: 565274 - DNA, 25 bp, Rattus norvegicus
gcgcactgagagctcgccacttgtc

SEQ ID NO: 565275 - DNA, 25 bp, Rattus norvegicus
tcccgctgtcatgtgggtggacacc

SEQ ID NO: 565276 - DNA, 25 bp, Rattus norvegicus
aggttctcatagtcctccgacccgg

SEQ ID NO: 565277 - DNA, 25 bp, Rattus norvegicus
gtcggacagctcagagccacagtca

SEQ ID NO: 565278 - DNA, 25 bp, Rattus norvegicus
agggcacccacctctctgtgtgacg

SEQ ID NO: 565279 - DNA, 25 bp, Rattus norvegicus
tgcacatttccaagcaaccggacgg

SEQ ID NO: 565280 - DNA, 25 bp, Rattus norvegicus
cactggtcggtaggttctcatagtc

SEQ ID NO: 565281 - DNA, 25 bp, Rattus norvegicus
ctgcgctttggggaagtttcctgtt

SEQ ID NO: 565282 - DNA, 25 bp, Rattus norvegicus
cgtgactcccgaaggagccgaacct

SEQ ID NO: 565283 - DNA, 25 bp, Rattus norvegicus
cgcgcgcagcgtgactcccgaagga

SEQ ID NO: 565284 - DNA, 25 bp, Rattus norvegicus
atcacgtatttgctttgctctgcgc

SEQ ID NO: 565285 - DNA, 25 bp, Rattus norvegicus
cgacgcatgtagcatcacgtatttg

SEQ ID NO: 565286 - DNA, 25 bp, Rattus norvegicus
tcccgaaatctgacgacgacgcatg

SEQ ID NO: 565287 - DNA, 25 bp, Rattus norvegicus
gggctggatggcctctgcctgcctc

SEQ ID NO: 565288 - DNA, 25 bp, Rattus norvegicus
aaggactattgatcccggggctgga

SEQ ID NO: 565289 - DNA, 25 bp, Rattus norvegicus
gctgagggagaaggactattgatcc

SEQ ID NO: 565290 - DNA, 25 bp, Rattus norvegicus
agcgggaggccacggccctgtccaa

SEQ ID NO: 565291 - DNA, 25 bp, Rattus norvegicus
atgcggtgcgctattggccgcccgc

SEQ ID NO: 565292 - DNA, 25 bp, Rattus norvegicus
cctccgcaaagctggtggccgggat

SEQ ID NO: 565293 - DNA, 25 bp, Rattus norvegicus
aggagccgaacctccgcaaagctgg

SEQ ID NO: 565294 - DNA, 25 bp, Rattus norvegicus
ttgctttgctctgcgctttggggaa

SEQ ID NO: 565295 - DNA, 25 bp, Rattus norvegicus
cacagtctggaacggcgcggtctcc

SEQ ID NO: 565296 - DNA, 25 bp, Rattus norvegicus
agcttgccgcaactgtagcgcgcgc

SEQ ID NO: 565297 - DNA, 25 bp, Rattus norvegicus
gcccgccttaatcttagtaaatcat

SEQ ID NO: 565298 - DNA, 25 bp, Rattus norvegicus
atggaaggcgcagaatcctctagtg

SEQ ID NO: 565299 - DNA, 25 bp, Rattus norvegicus
ggcgcagaatcctctagtggaaagg

SEQ ID NO: 565300 - DNA, 25 bp, Rattus norvegicus
ctctagtggaaaggagtgcacagtc

SEQ ID NO: 565301 - DNA, 25 bp, Rattus norvegicus
ctagtggaaaggagtgcacagtctg

SEQ ID NO: 565302 - DNA, 25 bp, Rattus norvegicus
taggataaaccgaggaagttcaaca

SEQ ID NO: 565303 - DNA, 25 bp, Rattus norvegicus
gaggccgggctaaactagaggccgc

SEQ ID NO: 565304 - DNA, 25 bp, Rattus norvegicus
ttgccgcgagtttctctttaaaagc

SEQ ID NO: 565305 - DNA, 25 bp, Rattus norvegicus
ttaaaagcgggaggcgaaagcttgc

SEQ ID NO: 565306 - DNA, 25 bp, Rattus norvegicus
tagtaaatcataccctgagcgaact

SEQ ID NO: 565307 - DNA, 25 bp, Rattus norvegicus
gaggcgaaagcttgccgcaactgta

SEQ ID NO: 565308 - DNA, 25 bp, Rattus norvegicus
ccaatcctaggataaaccgaggaag

SEQ ID NO: 565309 - DNA, 25 bp, Rattus norvegicus
ctgtcgttggacagatagcgggccc

SEQ ID NO: 565310 - DNA, 25 bp, Rattus norvegicus
agacgcaggctacggcgtttaacct

SEQ ID NO: 565311 - DNA, 25 bp, Rattus norvegicus
aaccttccggaagatgtggcctaca

SEQ ID NO: 565312 - DNA, 25 bp, Rattus norvegicus
tgtggcctacatacttgaggagctc

SEQ ID NO: 565313 - DNA, 25 bp, Rattus norvegicus
ttgaggagctcctcgtagcagctgc

SEQ ID NO: 565314 - DNA, 25 bp, Rattus norvegicus
agctcctcgtagcagctgccgggct

SEQ ID NO: 565315 - DNA, 25 bp, Rattus norvegicus
ctgccgggctctgagaagctggcca

SEQ ID NO: 565316 - DNA, 25 bp, Rattus norvegicus
ccagagtgctgtcgttggacagata

SEQ ID NO: 565317 - DNA, 25 bp, Rattus norvegicus
gctctgagaagctggccagagtgct

SEQ ID NO: 565318 - DNA, 25 bp, Rattus norvegicus
gggatccaccttcttacgccagcgg

SEQ ID NO: 565319 - DNA, 25 bp, Rattus norvegicus
cagggccttggccatgcacggtact

SEQ ID NO: 565320 - DNA, 25 bp, Rattus norvegicus
ggtactgctgggatccaccttctta

SEQ ID NO: 565321 - DNA, 25 bp, Rattus norvegicus
atgcacggtactgctgggatccacc

SEQ ID NO: 565322 - DNA, 25 bp, Rattus norvegicus
ccagcgggcataaagacgcaggcta

SEQ ID NO: 565323 - DNA, 25 bp, Rattus norvegicus
ttcttcccagcggaatcagcgccat

SEQ ID NO: 565324 - DNA, 25 bp, Rattus norvegicus
gtggagccgagtgcgctcacgtcca

SEQ ID NO: 565325 - DNA, 25 bp, Rattus norvegicus
cgctcacgtccagggccaggctgga

SEQ ID NO: 565326 - DNA, 25 bp, Rattus norvegicus
atctctccgcgtgctaccttagctt

SEQ ID NO: 565327 - DNA, 25 bp, Rattus norvegicus
ccgcgtgctaccttagcttttcagt

SEQ ID NO: 565328 - DNA, 25 bp, Rattus norvegicus
cttagcttttcagttcttaggcgca

SEQ ID NO: 565329 - DNA, 25 bp, Rattus norvegicus
ttttcagttcttaggcgcagcccgc

SEQ ID NO: 565330 - DNA, 25 bp, Rattus norvegicus
ttcttaggcgcagcccgctgaaacc

SEQ ID NO: 565331 - DNA, 25 bp, Rattus norvegicus
cgtccttcccatccgcgatcccagg

SEQ ID NO: 565332 - DNA, 25 bp, Rattus norvegicus
tataacgcacgtgccgcagaggggc

SEQ ID NO: 565333 - DNA, 25 bp, Rattus norvegicus
ggcagcccagaaagttgccgccgcg

SEQ ID NO: 565334 - DNA, 25 bp, Rattus norvegicus
ccagcggaatcagcgccatcgtgcg

SEQ ID NO: 565335 - DNA, 25 bp, Rattus norvegicus
gccgggaggatataacgcacgtgcc

SEQ ID NO: 565336 - DNA, 25 bp, Rattus norvegicus
gcggaaacccgtgacaccctcaaca

SEQ ID NO: 565337 - DNA, 25 bp, Rattus norvegicus
gttcacctcgcgactcctcttaaaa

SEQ ID NO: 565338 - DNA, 25 bp, Rattus norvegicus
gaagagggcgttcttgcccgaacga

SEQ ID NO: 565339 - DNA, 25 bp, Rattus norvegicus
tggctcagcaccaacggagcccaga

SEQ ID NO: 565340 - DNA, 25 bp, Rattus norvegicus
accttctttccgtggcctttgtgcg

SEQ ID NO: 565341 - DNA, 25 bp, Rattus norvegicus
caacggaacactgcctttgcgctgg

SEQ ID NO: 565342 - DNA, 25 bp, Rattus norvegicus
cattcatttggccaggaccgggaga

SEQ ID NO: 565343 - DNA, 25 bp, Rattus norvegicus
aggcgtagcgctgcattcatttggc

SEQ ID NO: 565344 - DNA, 25 bp, Rattus norvegicus
aagtctcgcaagtcttcagggcgca

SEQ ID NO: 565345 - DNA, 25 bp, Rattus norvegicus
ctgccgccagtgtgataaaagtctc

SEQ ID NO: 565346 - DNA, 25 bp, Rattus norvegicus
cgccaaggaaccgaacacaagcctg

SEQ ID NO: 565347 - DNA, 25 bp, Rattus norvegicus
acagaaaagacatgcgctcctcatc

SEQ ID NO: 565348 - DNA, 25 bp, Rattus norvegicus
gcccatcttgctgtcccagtcggtg

SEQ ID NO: 565349 - DNA, 25 bp, Rattus norvegicus
tgcaagtcccgcagtcgcaagcgca

SEQ ID NO: 565350 - DNA, 25 bp, Rattus norvegicus
ctttgtgcgacatgaagggttttgc

SEQ ID NO: 565351 - DNA, 25 bp, Rattus norvegicus
cagcctcagcggtctggatagatca

SEQ ID NO: 565352 - DNA, 25 bp, Rattus norvegicus
gcagctggcccagcaaagcgcgcta

SEQ ID NO: 565353 - DNA, 25 bp, Rattus norvegicus
accaaggagagaccgcgctaaagtg

SEQ ID NO: 565354 - DNA, 25 bp, Rattus norvegicus
accgtactctaggtgagtggaccca

SEQ ID NO: 565355 - DNA, 25 bp, Rattus norvegicus
ctaaagtgccctgctagccgagcgc

SEQ ID NO: 565356 - DNA, 25 bp, Rattus norvegicus
ttcccggacagcagacctcggacta

SEQ ID NO: 565357 - DNA, 25 bp, Rattus norvegicus
gcgcgacatgagcacggtgacccaa

SEQ ID NO: 565358 - DNA, 25 bp, Rattus norvegicus
acgaggcgccgctttgatagcaaaa

SEQ ID NO: 565359 - DNA, 25 bp, Rattus norvegicus
tctggcggtgtggacaaacttcgct

SEQ ID NO: 565360 - DNA, 25 bp, Rattus norvegicus
aaacttcgctgtgggccaggtacga

SEQ ID NO: 565361 - DNA, 25 bp, Rattus norvegicus
acactcaagactgggaggatatgac

SEQ ID NO: 565362 - DNA, 25 bp, Rattus norvegicus
ggaccctcaggtcagagaaattaga

SEQ ID NO: 565363 - DNA, 25 bp, Rattus norvegicus
aagcgcgctagggtaccaaacctgg

SEQ ID NO: 565364 - DNA, 25 bp, Rattus norvegicus
caagcttttctgctactggtgagta

SEQ ID NO: 565365 - DNA, 25 bp, Rattus norvegicus
aacagttgctgtgacaggcaccgcc

SEQ ID NO: 565366 - DNA, 25 bp, Rattus norvegicus
gctcacgacctccttttttcattca

SEQ ID NO: 565367 - DNA, 25 bp, Rattus norvegicus
gcacagccttaagacgcccagcgcc

SEQ ID NO: 565368 - DNA, 25 bp, Rattus norvegicus
gcggcgcgctagagagccaagcgcc

SEQ ID NO: 565369 - DNA, 25 bp, Rattus norvegicus
tcatggaggctcgaagagccaggct

SEQ ID NO: 565370 - DNA, 25 bp, Rattus norvegicus
gcccaatgtcatggaggctcgaaga

SEQ ID NO: 565371 - DNA, 25 bp, Rattus norvegicus
ccgggcgcccaatgtcatggaggct

SEQ ID NO: 565372 - DNA, 25 bp, Rattus norvegicus
tccggatcagcatctccgcgcgccc

SEQ ID NO: 565373 - DNA, 25 bp, Rattus norvegicus
gcagccactgcctcttccggatcag

SEQ ID NO: 565374 - DNA, 25 bp, Rattus norvegicus
tggggcgctgcactgcagccactgc

SEQ ID NO: 565375 - DNA, 25 bp, Rattus norvegicus
aaattgcacccaggaacagttgctg

SEQ ID NO: 565376 - DNA, 25 bp, Rattus norvegicus
ccaggaacagttgctgtgacaggca

SEQ ID NO: 565377 - DNA, 25 bp, Rattus norvegicus
gcaccgcccacagcggcgctcggtt

SEQ ID NO: 565378 - DNA, 25 bp, Rattus norvegicus
acacccggcggccacgcccgagaca

SEQ ID NO: 565379 - DNA, 25 bp, Rattus norvegicus
ttttccactggatgccaaaatatgc

SEQ ID NO: 565380 - DNA, 25 bp, Rattus norvegicus
taagcttggacatgccgcttggtcc

SEQ ID NO: 565381 - DNA, 25 bp, Rattus norvegicus
agggccgagaacctcgcggcaagtc

SEQ ID NO: 565382 - DNA, 25 bp, Rattus norvegicus
tcgcggcaagtccaggcaaaaggca

SEQ ID NO: 565383 - DNA, 25 bp, Rattus norvegicus
ggcaaaaggcaggaacccaccgaga

SEQ ID NO: 565384 - DNA, 25 bp, Rattus norvegicus
caatgcagaggagcgcccaaagctt

SEQ ID NO: 565385 - DNA, 25 bp, Rattus norvegicus
cgcccaaagcttgcgggtatcccgg

SEQ ID NO: 565386 - DNA, 25 bp, Rattus norvegicus
gccagagctcgaggttaatttttca

SEQ ID NO: 565387 - DNA, 25 bp, Rattus norvegicus
cgcctccctaggtgacgctacagtt

SEQ ID NO: 565388 - DNA, 25 bp, Rattus norvegicus
gctacagtttgtgcggttcctttaa

SEQ ID NO: 565389 - DNA, 25 bp, Rattus norvegicus
ccgttcttcccttttccactggatg

SEQ ID NO: 565390 - DNA, 25 bp, Rattus norvegicus
ggggaccggaatctgcagccaaata

SEQ ID NO: 565391 - DNA, 25 bp, Rattus norvegicus
caaaatatgcaaatccggggaccgg

SEQ ID NO: 565392 - DNA, 25 bp, Rattus norvegicus
cacgggcactgcagttaagcttgga

SEQ ID NO: 565393 - DNA, 25 bp, Rattus norvegicus
ggatgcgggattcaccgcgcccacg

SEQ ID NO: 565394 - DNA, 25 bp, Rattus norvegicus
acgccgccactgaggagggaatcct

SEQ ID NO: 565395 - DNA, 25 bp, Rattus norvegicus
gccgccactgaggagggaatcctcc

SEQ ID NO: 565396 - DNA, 25 bp, Rattus norvegicus
tgaggagggaatcctcccccgccaa

SEQ ID NO: 565397 - DNA, 25 bp, Rattus norvegicus
caacccggtgtgatttggggtcgcg

SEQ ID NO: 565398 - DNA, 25 bp, Rattus norvegicus
ccctcgctctcagccaggctgcgcg

SEQ ID NO: 565399 - DNA, 25 bp, Rattus norvegicus
cccttgagggatgcaagttccccca

SEQ ID NO: 565400 - DNA, 25 bp, Rattus norvegicus
aaccctgactctccagcgggggatg

SEQ ID NO: 565401 - DNA, 25 bp, Rattus norvegicus
atttggggtcgcgcctccgtgctcc

SEQ ID NO: 565402 - DNA, 25 bp, Rattus norvegicus
tcccactccccttgagggatgcaag

SEQ ID NO: 565403 - DNA, 25 bp, Rattus norvegicus
cccacgccgccactgaggagggaat

SEQ ID NO: 565404 - DNA, 25 bp, Rattus norvegicus
gcatggacctcccacggcgtgaggc

SEQ ID NO: 565405 - DNA, 25 bp, Rattus norvegicus
cctctcttcctccttgtcaacactc

SEQ ID NO: 565406 - DNA, 25 bp, Rattus norvegicus
ttcctccttgtcaacactcccactc

SEQ ID NO: 565407 - DNA, 25 bp, Rattus norvegicus
agtgtcgcaggagagacgtacttgc

SEQ ID NO: 565408 - DNA, 25 bp, Rattus norvegicus
ggggcgctctttcagtctttaggct

SEQ ID NO: 565409 - DNA, 25 bp, Rattus norvegicus
aggaccgagaatgtccgcaccacca

SEQ ID NO: 565410 - DNA, 25 bp, Rattus norvegicus
cgcaccaccacaggaacttaagcta

SEQ ID NO: 565411 - DNA, 25 bp, Rattus norvegicus
ttccgcagcagtcaacgaacagtca

SEQ ID NO: 565412 - DNA, 25 bp, Rattus norvegicus
gaacagtcaccggtgccttgccgta

SEQ ID NO: 565413 - DNA, 25 bp, Rattus norvegicus
acgcccgtacgcattggaggagaaa

SEQ ID NO: 565414 - DNA, 25 bp, Rattus norvegicus
tgcttccgcagagggctttccggct

SEQ ID NO: 565415 - DNA, 25 bp, Rattus norvegicus
ctttccggctctggtgtgatgccga

SEQ ID NO: 565416 - DNA, 25 bp, Rattus norvegicus
tgatgccgacgttgcggcgagtacc

SEQ ID NO: 565417 - DNA, 25 bp, Rattus norvegicus
gcgccatggtccacctcagtgagtg

SEQ ID NO: 565418 - DNA, 25 bp, Rattus norvegicus
gaaagcgactcaccggagcgccatg

SEQ ID NO: 565419 - DNA, 25 bp, Rattus norvegicus
tttcagtctttaggctccgtggagc

SEQ ID NO: 565420 - DNA, 25 bp, Rattus norvegicus
gacgtacttgcagggtaaccagcac

SEQ ID NO: 565421 - DNA, 25 bp, Rattus norvegicus
gtgctttgctttcggcttcgtccct

SEQ ID NO: 565422 - DNA, 25 bp, Rattus norvegicus
ccttctttctaatcttctaattgac

SEQ ID NO: 565423 - DNA, 25 bp, Rattus norvegicus
cttcctgctttctaatgttccattg

SEQ ID NO: 565424 - DNA, 25 bp, Rattus norvegicus
tgttccattgtgaggagcttccatt

SEQ ID NO: 565425 - DNA, 25 bp, Rattus norvegicus
ggcccgcttcctgctttctaatgtt

SEQ ID NO: 565426 - DNA, 25 bp, Rattus norvegicus
gcatcgcgtgctttgctttcggctt

SEQ ID NO: 565427 - DNA, 25 bp, Rattus norvegicus
gaggagcttccattgtgacgtcgcg

SEQ ID NO: 565428 - DNA, 25 bp, Rattus norvegicus
tcctctcgctttccttctttctaat

SEQ ID NO: 565429 - DNA, 25 bp, Rattus norvegicus
cgctttccttctttctaatcttcta

SEQ ID NO: 565430 - DNA, 25 bp, Rattus norvegicus
tcggctgggctttgtctgtccatat

SEQ ID NO: 565431 - DNA, 25 bp, Rattus norvegicus
tgggcagctacgtcacggagctttc

SEQ ID NO: 565432 - DNA, 25 bp, Rattus norvegicus
gcagctacgtcacggagctttcccg

SEQ ID NO: 565433 - DNA, 25 bp, Rattus norvegicus
tttcataaagaacggcgagcggtgc

SEQ ID NO: 565434 - DNA, 25 bp, Rattus norvegicus
tgtgaggagcttccattgtgacgtc

SEQ ID NO: 565435 - DNA, 25 bp, Rattus norvegicus
tacgcagacgaccacggctagcatg

SEQ ID NO: 565436 - DNA, 25 bp, Rattus norvegicus
atgggctccattccagaacacaagc

SEQ ID NO: 565437 - DNA, 25 bp, Rattus norvegicus
tcaaagacaagcagatccacccggg

SEQ ID NO: 565438 - DNA, 25 bp, Rattus norvegicus
caactgcggcgacctctactcggag

SEQ ID NO: 565439 - DNA, 25 bp, Rattus norvegicus
cccacctcgggaagaacaacaatgc

SEQ ID NO: 565440 - DNA, 25 bp, Rattus norvegicus
tagcctcatgagtgccggcatcttg

SEQ ID NO: 565441 - DNA, 25 bp, Rattus norvegicus
cctctggagaccatcaaggccttca

SEQ ID NO: 565442 - DNA, 25 bp, Rattus norvegicus
ctggtgccaggacaacatcattagc

SEQ ID NO: 565443 - DNA, 25 bp, Rattus norvegicus
ctttcgactctccttccaactggtg

SEQ ID NO: 565444 - DNA, 25 bp, Rattus norvegicus
cccgatccgtagtattttgctgtat

SEQ ID NO: 565445 - DNA, 25 bp, Rattus norvegicus
ctccgcagagaatgtgatggacatc

SEQ ID NO: 565446 - DNA, 25 bp, Rattus norvegicus
ggtctgaccaacgagaagcccaatc

SEQ ID NO: 565447 - DNA, 25 bp, Rattus norvegicus
cggaactctcttattcgggctcttt

SEQ ID NO: 565448 - DNA, 25 bp, Rattus norvegicus
gccggccttggacagcaatcttttc

SEQ ID NO: 565449 - DNA, 25 bp, Rattus norvegicus
tggccgaatccggaagtgatcttcg

SEQ ID NO: 565450 - DNA, 25 bp, Rattus norvegicus
cagtcggcgtgagtttaggaccatg

SEQ ID NO: 565451 - DNA, 25 bp, Rattus norvegicus
tttaggaccatgagctggtgagtga

SEQ ID NO: 565452 - DNA, 25 bp, Rattus norvegicus
gcggcctgacagtcccgcttctaag

SEQ ID NO: 565453 - DNA, 25 bp, Rattus norvegicus
cgcttctaagcggttccgggagcct

SEQ ID NO: 565454 - DNA, 25 bp, Rattus norvegicus
gaggctccgtctctcggccaggctt

SEQ ID NO: 565455 - DNA, 25 bp, Rattus norvegicus
ccggaagtgatcttcgagaatctac

SEQ ID NO: 565456 - DNA, 25 bp, Rattus norvegicus
tcacttcctggagactggccgaatc

SEQ ID NO: 565457 - DNA, 25 bp, Rattus norvegicus
ggcgtgtcctacatcacttcctgga

SEQ ID NO: 565458 - DNA, 25 bp, Rattus norvegicus
tcttccgggcaaaagagggcgtgtc

SEQ ID NO: 565459 - DNA, 25 bp, Rattus norvegicus
gtcgcgcaaaggaaactccacctca

SEQ ID NO: 565460 - DNA, 25 bp, Rattus norvegicus
gcgcaaccgggtcgcgcaaaggaaa

SEQ ID NO: 565461 - DNA, 25 bp, Rattus norvegicus
gaatctacttttctacagaggaccc

SEQ ID NO: 565462 - DNA, 25 bp, Rattus norvegicus
tcggccaggcttccgaggatccctt

SEQ ID NO: 565463 - DNA, 25 bp, Rattus norvegicus
taggacgttgaatcttaacatgaac

SEQ ID NO: 565464 - DNA, 25 bp, Rattus norvegicus
atgcggcgctgtcctcagctgtgcc

SEQ ID NO: 565465 - DNA, 25 bp, Rattus norvegicus
ccagacgaaggaatttaggacgttg

SEQ ID NO: 565466 - DNA, 25 bp, Rattus norvegicus
ttggaaaccagatccagacgaagga

SEQ ID NO: 565467 - DNA, 25 bp, Rattus norvegicus
gctccatgaatgcttggaaaccaga

SEQ ID NO: 565468 - DNA, 25 bp, Rattus norvegicus
tctgggcgttgctccatgaatgctt

SEQ ID NO: 565469 - DNA, 25 bp, Rattus norvegicus
tgcagctagtctccttctgggcgtt

SEQ ID NO: 565470 - DNA, 25 bp, Rattus norvegicus
gccgccacctttgcttgcagctagt

SEQ ID NO: 565471 - DNA, 25 bp, Rattus norvegicus
taggaacgcccgctcacaggatggg

SEQ ID NO: 565472 - DNA, 25 bp, Rattus norvegicus
tgccattctttcctgtggtcccttt

SEQ ID NO: 565473 - DNA, 25 bp, Rattus norvegicus
gtggtcccttttggaagctgctaaa

SEQ ID NO: 565474 - DNA, 25 bp, Rattus norvegicus
gctgctaaagagctcttggttcttc

SEQ ID NO: 565475 - DNA, 25 bp, Rattus norvegicus
ttgctgagtcatgcggcgctgtcct

SEQ ID NO: 565476 - DNA, 25 bp, Rattus norvegicus
cttaacatgaaccatctgaggggca

SEQ ID NO: 565477 - DNA, 25 bp, Rattus norvegicus
agctcaagttcaaagggtcccaggc

SEQ ID NO: 565478 - DNA, 25 bp, Rattus norvegicus
ctccttattagagacaaatgcgccc

SEQ ID NO: 565479 - DNA, 25 bp, Rattus norvegicus
gccgggatgtctttgtctctcctta

SEQ ID NO: 565480 - DNA, 25 bp, Rattus norvegicus
aggggcacccggacttcgtccgctg

SEQ ID NO: 565481 - DNA, 25 bp, Rattus norvegicus
cagagcccggagctgggccagtacc

SEQ ID NO: 565482 - DNA, 25 bp, Rattus norvegicus
gtccctgggctctcgggagccaaca

SEQ ID NO: 565483 - DNA, 25 bp, Rattus norvegicus
acatcccttggtcggtgcttctctc

SEQ ID NO: 565484 - DNA, 25 bp, Rattus norvegicus
cggcgctgtcactggggacccagtc

SEQ ID NO: 565485 - DNA, 25 bp, Rattus norvegicus
cccaggcgcgcagtaagcgcgcgta

SEQ ID NO: 565486 - DNA, 25 bp, Rattus norvegicus
cccagacgtaagctatcccaagaca

SEQ ID NO: 565487 - DNA, 25 bp, Rattus norvegicus
ccgcgctcagcgcaggaaacttcgg

SEQ ID NO: 565488 - DNA, 25 bp, Rattus norvegicus
tcccgatgcggaaaaccgctaaatg

SEQ ID NO: 565489 - DNA, 25 bp, Rattus norvegicus
ccagcagcggcaacggtgtcccgat

SEQ ID NO: 565490 - DNA, 25 bp, Rattus norvegicus
ggcaccagctctcgcggaagctctg

SEQ ID NO: 565491 - DNA, 25 bp, Rattus norvegicus
ggaccacggcgcgaggtttctcctc

SEQ ID NO: 565492 - DNA, 25 bp, Rattus norvegicus
cggaagaccgccaggcgtcttttca

SEQ ID NO: 565493 - DNA, 25 bp, Rattus norvegicus
gccaggcgtcttttcagacccgctg

SEQ ID NO: 565494 - DNA, 25 bp, Rattus norvegicus
gtgcgccttcccagatccgataatg

SEQ ID NO: 565495 - DNA, 25 bp, Rattus norvegicus
cttcccagatccgataatgccttcg

SEQ ID NO: 565496 - DNA, 25 bp, Rattus norvegicus
ccagggagacggagcttgcagtcct

SEQ ID NO: 565497 - DNA, 25 bp, Rattus norvegicus
ataatgccttcggaagctgagctcg

SEQ ID NO: 565498 - DNA, 25 bp, Rattus norvegicus
aactgtggaacggaagtgcgccttc

SEQ ID NO: 565499 - DNA, 25 bp, Rattus norvegicus
catcccgctccaactgtggaacgga

SEQ ID NO: 565500 - DNA, 25 bp, Rattus norvegicus
tcccggatatggtacctccctcttc

SEQ ID NO: 565501 - DNA, 25 bp, Rattus norvegicus
gaccactggtcggaagctgccactc

SEQ ID NO: 565502 - DNA, 25 bp, Rattus norvegicus
gcctctccggaagagcgaccactgg

SEQ ID NO: 565503 - DNA, 25 bp, Rattus norvegicus
ctggcgcatcttcgctgttcggacc

SEQ ID NO: 565504 - DNA, 25 bp, Rattus norvegicus
ggctctttccgcgactggcgcatct

SEQ ID NO: 565505 - DNA, 25 bp, Rattus norvegicus
catggcgtgtttcagacgcggaaac

SEQ ID NO: 565506 - DNA, 25 bp, Rattus norvegicus
ctcaacccgccggtccctgcccagc

SEQ ID NO: 565507 - DNA, 25 bp, Rattus norvegicus
agttgcgctcaagcagctcaacccg

SEQ ID NO: 565508 - DNA, 25 bp, Rattus norvegicus
tccctagttgcgctcaagcagctca

SEQ ID NO: 565509 - DNA, 25 bp, Rattus norvegicus
tccaagtccctagttgcgctcaagc

SEQ ID NO: 565510 - DNA, 25 bp, Rattus norvegicus
gggcgtcctccaagtccctagttgc

SEQ ID NO: 565511 - DNA, 25 bp, Rattus norvegicus
gcaccggagtgatcccgggcgtcct

SEQ ID NO: 565512 - DNA, 25 bp, Rattus norvegicus
ttcagacgcggaaaccactgcaaca

SEQ ID NO: 565513 - DNA, 25 bp, Rattus norvegicus
acggctcagcatggcgtgtttcaga

SEQ ID NO: 565514 - DNA, 25 bp, Rattus norvegicus
caaagacgcggcgacggctcagcat

SEQ ID NO: 565515 - DNA, 25 bp, Rattus norvegicus
ttgctccaccgcaaagacgcggcga

SEQ ID NO: 565516 - DNA, 25 bp, Rattus norvegicus
gccaagttgctccaccgcaaagacg

SEQ ID NO: 565517 - DNA, 25 bp, Rattus norvegicus
atgggtaggaggcaacgcgactcac

SEQ ID NO: 565518 - DNA, 25 bp, Rattus norvegicus
ccactgcaacagcaccggagtgatc

SEQ ID NO: 565519 - DNA, 25 bp, Rattus norvegicus
aggtgtccacatcctccggactgtc

SEQ ID NO: 565520 - DNA, 25 bp, Rattus norvegicus
agccgtctgtccgactctagggaga

SEQ ID NO: 565521 - DNA, 25 bp, Rattus norvegicus
ctgactcgcgccttgcggggaagct

SEQ ID NO: 565522 - DNA, 25 bp, Rattus norvegicus
gaccctacgggaagaagcctcgaga

SEQ ID NO: 565523 - DNA, 25 bp, Rattus norvegicus
gagacccttccgaggtgtccacatc

SEQ ID NO: 565524 - DNA, 25 bp, Rattus norvegicus
cggagtacagggagtcggttcaaat

SEQ ID NO: 565525 - DNA, 25 bp, Rattus norvegicus
gtcggttcaaatgacagaccctccc

SEQ ID NO: 565526 - DNA, 25 bp, Rattus norvegicus
cccacggtgcgcagaatacggagga

SEQ ID NO: 565527 - DNA, 25 bp, Rattus norvegicus
aatacggaggagtctgcgtcccacc

SEQ ID NO: 565528 - DNA, 25 bp, Rattus norvegicus
gaaagtaaccctcgatgccgcggtc

SEQ ID NO: 565529 - DNA, 25 bp, Rattus norvegicus
ccagacctctgacaggcaaccggtg

SEQ ID NO: 565530 - DNA, 25 bp, Rattus norvegicus
caaccggtggcttgatggagtccgc

SEQ ID NO: 565531 - DNA, 25 bp, Rattus norvegicus
taaggacgaggagccaccgccgttc

SEQ ID NO: 565532 - DNA, 25 bp, Rattus norvegicus
agcctcgagactgagacccttccga

SEQ ID NO: 565533 - DNA, 25 bp, Rattus norvegicus
gtcgggccttgggttccaccatcca

SEQ ID NO: 565534 - DNA, 25 bp, Rattus norvegicus
cctgagagttctgcgtagggacacc

SEQ ID NO: 565535 - DNA, 25 bp, Rattus norvegicus
agtgcggccacctcctccggaaaag

SEQ ID NO: 565536 - DNA, 25 bp, Rattus norvegicus
tagggacaccggacgcgatcagagc

SEQ ID NO: 565537 - DNA, 25 bp, Rattus norvegicus
ctcctccggaaaagttcgcggctcg

SEQ ID NO: 565538 - DNA, 25 bp, Rattus norvegicus
cgccgccagccactaccactagagt

SEQ ID NO: 565539 - DNA, 25 bp, Rattus norvegicus
agtcctcctcggtttaggacaggtg

SEQ ID NO: 565540 - DNA, 25 bp, Rattus norvegicus
tcctcggtttaggacaggtggcctc

SEQ ID NO: 565541 - DNA, 25 bp, Rattus norvegicus
gatgcggccaggcacttttccgatt

SEQ ID NO: 565542 - DNA, 25 bp, Rattus norvegicus
ccaggcacttttccgattttcaggc

SEQ ID NO: 565543 - DNA, 25 bp, Rattus norvegicus
cccggggaacagaccctctgctccg

SEQ ID NO: 565544 - DNA, 25 bp, Rattus norvegicus
gcgtctctatcacttaccgggcgga

SEQ ID NO: 565545 - DNA, 25 bp, Rattus norvegicus
ctctatcacttaccgggcggagggc

SEQ ID NO: 565546 - DNA, 25 bp, Rattus norvegicus
cggacgcgatcagagcctgggaccc

SEQ ID NO: 565547 - DNA, 25 bp, Rattus norvegicus
gctgctctgcaagagccaggacaca

SEQ ID NO: 565548 - DNA, 25 bp, Rattus norvegicus
ggtgaagtggagatgcctgctactc

SEQ ID NO: 565549 - DNA, 25 bp, Rattus norvegicus
gagcccgctggtttcccagatgcct

SEQ ID NO: 565550 - DNA, 25 bp, Rattus norvegicus
cccactggcaaagctggagtcagaa

SEQ ID NO: 565551 - DNA, 25 bp, Rattus norvegicus
ggctggacgcccaacaaagaagagg

SEQ ID NO: 565552 - DNA, 25 bp, Rattus norvegicus
agagtttccagcgacacttccaggg

SEQ ID NO: 565553 - DNA, 25 bp, Rattus norvegicus
cgcagcccacgaccttgggaaggca

SEQ ID NO: 565554 - DNA, 25 bp, Rattus norvegicus
ggcaggagtgattaacagaacggtc

SEQ ID NO: 565555 - DNA, 25 bp, Rattus norvegicus
cagaacggtcccagagtgccaaagc

SEQ ID NO: 565556 - DNA, 25 bp, Rattus norvegicus
agccggaattagatacgcagcccac

SEQ ID NO: 565557 - DNA, 25 bp, Rattus norvegicus
tgaccaggcgttgtaaacactcgtg

SEQ ID NO: 565558 - DNA, 25 bp, Rattus norvegicus
gagagttcgtgcctgtctaaacgca

SEQ ID NO: 565559 - DNA, 25 bp, Rattus norvegicus
ggcagacaggctgggaccaagataa

SEQ ID NO: 565560 - DNA, 25 bp, Rattus norvegicus
caagataaatcacggtggcccagga

SEQ ID NO: 565561 - DNA, 25 bp, Rattus norvegicus
gttgcttctcaaaccaaccgctgga

SEQ ID NO: 565562 - DNA, 25 bp, Rattus norvegicus
ctcagctaggacgaccgcgtcgaaa

SEQ ID NO: 565563 - DNA, 25 bp, Rattus norvegicus
cgtcgaaaactacgctgaccgcggc

SEQ ID NO: 565564 - DNA, 25 bp, Rattus norvegicus
tgaccgcggctaagggagacaacaa

SEQ ID NO: 565565 - DNA, 25 bp, Rattus norvegicus
agacaacaagggagaccgcggctgc

SEQ ID NO: 565566 - DNA, 25 bp, Rattus norvegicus
tgttctcagctctagttactgctgc

SEQ ID NO: 565567 - DNA, 25 bp, Rattus norvegicus
tctagttactgctgcccaccgtcgg

SEQ ID NO: 565568 - DNA, 25 bp, Rattus norvegicus
cctgacctgttgcttctcaaaccaa

SEQ ID NO: 565569 - DNA, 25 bp, Rattus norvegicus
cccagaatacgaggcggtcctcgga

SEQ ID NO: 565570 - DNA, 25 bp, Rattus norvegicus
caaccgctggaaccgcggaagcagc

SEQ ID NO: 565571 - DNA, 25 bp, Rattus norvegicus
gggcggagcggtcgctctacccact

SEQ ID NO: 565572 - DNA, 25 bp, Rattus norvegicus
tctaggtacccgtccagcagtcact

SEQ ID NO: 565573 - DNA, 25 bp, Rattus norvegicus
ccagcagtcactggggacgccgaga

SEQ ID NO: 565574 - DNA, 25 bp, Rattus norvegicus
cctcgcgtcgggcaaatgctccgaa

SEQ ID NO: 565575 - DNA, 25 bp, Rattus norvegicus
ggcctcctgaaagaagactccaggt

SEQ ID NO: 565576 - DNA, 25 bp, Rattus norvegicus
cctggtcctccagcgttgtgcatct

SEQ ID NO: 565577 - DNA, 25 bp, Rattus norvegicus
tctgatatgcccatcgactccgctt

SEQ ID NO: 565578 - DNA, 25 bp, Rattus norvegicus
acacagctactgagtgggtgcgccc

SEQ ID NO: 565579 - DNA, 25 bp, Rattus norvegicus
gatcaggtgctaccgggactggact

SEQ ID NO: 565580 - DNA, 25 bp, Rattus norvegicus
actcagggagtacgcggcctcctga

SEQ ID NO: 565581 - DNA, 25 bp, Rattus norvegicus
gtcctggggctctagaaagctcatc

SEQ ID NO: 565582 - DNA, 25 bp, Rattus norvegicus
atctcagtctttccgctcagctatc

SEQ ID NO: 565583 - DNA, 25 bp, Rattus norvegicus
tgcatctcgggctcgcatcctagct

SEQ ID NO: 565584 - DNA, 25 bp, Rattus norvegicus
atgggacagcgctatgacctccttc

SEQ ID NO: 565585 - DNA, 25 bp, Rattus norvegicus
cgccaccgtggcaaggcgatcaggt

SEQ ID NO: 565586 - DNA, 25 bp, Rattus norvegicus
cgttcagttaccctggccaacctgg

SEQ ID NO: 565587 - DNA, 25 bp, Rattus norvegicus
ggcagtcagctagcaccgttcagtt

SEQ ID NO: 565588 - DNA, 25 bp, Rattus norvegicus
cgccactacagagcatctgatatgc

SEQ ID NO: 565589 - DNA, 25 bp, Rattus norvegicus
acttaaacctgcgtcccagcttctg

SEQ ID NO: 565590 - DNA, 25 bp, Rattus norvegicus
agcaactggctggtctctgtccctc

SEQ ID NO: 565591 - DNA, 25 bp, Rattus norvegicus
cggaagtgctgctgggcccgcccat

SEQ ID NO: 565592 - DNA, 25 bp, Rattus norvegicus
gggcccgcccatcactgggtttcaa

SEQ ID NO: 565593 - DNA, 25 bp, Rattus norvegicus
atcactgggtttcaaccctccggcg

SEQ ID NO: 565594 - DNA, 25 bp, Rattus norvegicus
tccggcgctcaattcagctccggga

SEQ ID NO: 565595 - DNA, 25 bp, Rattus norvegicus
agctccgggagcgacttaaacctgc

SEQ ID NO: 565596 - DNA, 25 bp, Rattus norvegicus
tgcgtcccagcttctgatccagaga

SEQ ID NO: 565597 - DNA, 25 bp, Rattus norvegicus
cccagcttctgatccagagagagga

SEQ ID NO: 565598 - DNA, 25 bp, Rattus norvegicus
tctgatccagagagaggatcctggc

SEQ ID NO: 565599 - DNA, 25 bp, Rattus norvegicus
agagaggatcctggctcggagcaac

SEQ ID NO: 565600 - DNA, 25 bp, Rattus norvegicus
gatcctggctcggagcaactggctg

SEQ ID NO: 565601 - DNA, 25 bp, Rattus norvegicus
catcctttctcggttatccgcgggc

SEQ ID NO: 565602 - DNA, 25 bp, Rattus norvegicus
cggagcccgcgtcagccctcagccc

SEQ ID NO: 565603 - DNA, 25 bp, Rattus norvegicus
tcctgtgacgcaggcgcccagagct

SEQ ID NO: 565604 - DNA, 25 bp, Rattus norvegicus
ggaccagaaagaggacgccacccgc

SEQ ID NO: 565605 - DNA, 25 bp, Rattus norvegicus
gcttccaggtttgtgggaccgcgat

SEQ ID NO: 565606 - DNA, 25 bp, Rattus norvegicus
ggctaccacaaggtgtccctgcaag

SEQ ID NO: 565607 - DNA, 25 bp, Rattus norvegicus
acggcgaagtccgacgcggctacca

SEQ ID NO: 565608 - DNA, 25 bp, Rattus norvegicus
cgcgaggcttccgacggcgaagtcc

SEQ ID NO: 565609 - DNA, 25 bp, Rattus norvegicus
cgacctctaccaggtgctgggcgtg

SEQ ID NO: 565610 - DNA, 25 bp, Rattus norvegicus
aggtgtttggcaccgccgacctcta

SEQ ID NO: 565611 - DNA, 25 bp, Rattus norvegicus
cccgacagagtaaaggaggaccaga

SEQ ID NO: 565612 - DNA, 25 bp, Rattus norvegicus
cccagagctatttgggcgggaaaag

SEQ ID NO: 565613 - DNA, 25 bp, Rattus norvegicus
taaactgccgtaacgcgcggctggc

SEQ ID NO: 565614 - DNA, 25 bp, Rattus norvegicus
tttgcgctgccgtaaactgccgtaa

SEQ ID NO: 565615 - DNA, 25 bp, Rattus norvegicus
aattttacttcacgggcgagagcga

SEQ ID NO: 565616 - DNA, 25 bp, Rattus norvegicus
ggggtttgcggagcagcctcttccc

SEQ ID NO: 565617 - DNA, 25 bp, Rattus norvegicus
cacctctagctttggactcgtcaca

SEQ ID NO: 565618 - DNA, 25 bp, Rattus norvegicus
gggcgtgatcggaccatagtattta

SEQ ID NO: 565619 - DNA, 25 bp, Rattus norvegicus
ggctgccatcttaccctagggcgga

SEQ ID NO: 565620 - DNA, 25 bp, Rattus norvegicus
ccggtctcacggcaaggcggaagtc

SEQ ID NO: 565621 - DNA, 25 bp, Rattus norvegicus
gagtttcacgacctcacctctaacg

SEQ ID NO: 565622 - DNA, 25 bp, Rattus norvegicus
tagtatttatcagacggtgcctcgc

SEQ ID NO: 565623 - DNA, 25 bp, Rattus norvegicus
ggactgcatgacgtacctgcgttga

SEQ ID NO: 565624 - DNA, 25 bp, Rattus norvegicus
tcccagtcccacgtggcgaggtttc

SEQ ID NO: 565625 - DNA, 25 bp, Rattus norvegicus
ggcaacaaagtgactccaagggctg

SEQ ID NO: 565626 - DNA, 25 bp, Rattus norvegicus
ccgacatggttcctagaggaaagta

SEQ ID NO: 565627 - DNA, 25 bp, Rattus norvegicus
cgcggcgtttccttccgacatggtt

SEQ ID NO: 565628 - DNA, 25 bp, Rattus norvegicus
caccgccaagggtgaggtcccgaga

SEQ ID NO: 565629 - DNA, 25 bp, Rattus norvegicus
cgttgaggctctacgccgagtttca

SEQ ID NO: 565630 - DNA, 25 bp, Rattus norvegicus
cggtaccttcttgacaccgccaagg

SEQ ID NO: 565631 - DNA, 25 bp, Rattus norvegicus
gagcacattggggatcgccgacatt

SEQ ID NO: 565632 - DNA, 25 bp, Rattus norvegicus
cctgcggaagttaattgactgcatc

SEQ ID NO: 565633 - DNA, 25 bp, Rattus norvegicus
cacctgtttgggcacacctaggaca

SEQ ID NO: 565634 - DNA, 25 bp, Rattus norvegicus
cattgtcagagtctccgcgtggcta

SEQ ID NO: 565635 - DNA, 25 bp, Rattus norvegicus
gtggctacacctgaccaggcctcaa

SEQ ID NO: 565636 - DNA, 25 bp, Rattus norvegicus
cacgcctgagacgtggggtaagttc

SEQ ID NO: 565637 - DNA, 25 bp, Rattus norvegicus
gggtaagttcactcaggacgtcctg

SEQ ID NO: 565638 - DNA, 25 bp, Rattus norvegicus
aacggctagcctcggttaacctgcg

SEQ ID NO: 565639 - DNA, 25 bp, Rattus norvegicus
agggcacgcaaccaccactagaggc

SEQ ID NO: 565640 - DNA, 25 bp, Rattus norvegicus
gtgcgacgcagtaaacctggctttc

SEQ ID NO: 565641 - DNA, 25 bp, Rattus norvegicus
tggctttctcaaaccgctgcgaaga

SEQ ID NO: 565642 - DNA, 25 bp, Rattus norvegicus
acgccaaaagctgcagtaccacctg

SEQ ID NO: 565643 - DNA, 25 bp, Rattus norvegicus
aaagcgtttctgctcgcggccagca

SEQ ID NO: 565644 - DNA, 25 bp, Rattus norvegicus
atcctgagggatactgccgaggacc

SEQ ID NO: 565645 - DNA, 25 bp, Rattus norvegicus
tgtcaggtcggttccttcctcttag

SEQ ID NO: 565646 - DNA, 25 bp, Rattus norvegicus
ccttgcaggggtctttgtagttgag

SEQ ID NO: 565647 - DNA, 25 bp, Rattus norvegicus
gacacgctgtcaggtcggttccttc

SEQ ID NO: 565648 - DNA, 25 bp, Rattus norvegicus
agggcgggttttcgcccagctcagc

SEQ ID NO: 565649 - DNA, 25 bp, Rattus norvegicus
cccttttagggaaatgagctcgctg

SEQ ID NO: 565650 - DNA, 25 bp, Rattus norvegicus
cctcttagaccctggatcagcgatc

SEQ ID NO: 565651 - DNA, 25 bp, Rattus norvegicus
ctctcggtcgctccctttcttttct

SEQ ID NO: 565652 - DNA, 25 bp, Rattus norvegicus
tagtcggccaagtccagcggccggc

SEQ ID NO: 565653 - DNA, 25 bp, Rattus norvegicus
tcgtaggtgtagtcggccaagtcca

SEQ ID NO: 565654 - DNA, 25 bp, Rattus norvegicus
cctcgcccaggtcgtaggtgtagtc

SEQ ID NO: 565655 - DNA, 25 bp, Rattus norvegicus
gcccgcagcctcgatcccagcctgc

SEQ ID NO: 565656 - DNA, 25 bp, Rattus norvegicus
agtcgggagtcgctcacccgccttg

SEQ ID NO: 565657 - DNA, 25 bp, Rattus norvegicus
cacccgccttgcaggggtctttgta

SEQ ID NO: 565658 - DNA, 25 bp, Rattus norvegicus
gaggataagagtagcaccgcccgcc

SEQ ID NO: 565659 - DNA, 25 bp, Rattus norvegicus
ccagcgcccgaggtcaggaggaata

SEQ ID NO: 565660 - DNA, 25 bp, Rattus norvegicus
ctacgagccaggcggggccctatgt

SEQ ID NO: 565661 - DNA, 25 bp, Rattus norvegicus
agaccctgcaggaggcatggcccgg

SEQ ID NO: 565662 - DNA, 25 bp, Rattus norvegicus
ggccagagcagcttgcagctgcagc

SEQ ID NO: 565663 - DNA, 25 bp, Rattus norvegicus
cagcccggaggtggacgctctcgag

SEQ ID NO: 565664 - DNA, 25 bp, Rattus norvegicus
gaggaataggtggcgcctagaaacc

SEQ ID NO: 565665 - DNA, 25 bp, Rattus norvegicus
caccagccctggcagccagtagttg

SEQ ID NO: 565666 - DNA, 25 bp, Rattus norvegicus
gctgaaaggactgcagccagcgccc

SEQ ID NO: 565667 - DNA, 25 bp, Rattus norvegicus
ctccggagctgaaaggactgcagcc

SEQ ID NO: 565668 - DNA, 25 bp, Rattus norvegicus
agcgctccggagctgaaaggactgc

SEQ ID NO: 565669 - DNA, 25 bp, Rattus norvegicus
agttgcggtcccagttccgcgcagc

SEQ ID NO: 565670 - DNA, 25 bp, Rattus norvegicus
agtagttgcggtcccagttccgcgc

SEQ ID NO: 565671 - DNA, 25 bp, Rattus norvegicus
gcagccagtagttgcggtcccagtt

SEQ ID NO: 565672 - DNA, 25 bp, Rattus norvegicus
cctagaaaccgggtggcaccagagc

SEQ ID NO: 565673 - DNA, 25 bp, Rattus norvegicus
cacagcgaagccctagacgggttga

SEQ ID NO: 565674 - DNA, 25 bp, Rattus norvegicus
gtgcgcggagcatcgccgctttaag

SEQ ID NO: 565675 - DNA, 25 bp, Rattus norvegicus
tctgcgaggccctctgtccactggt

SEQ ID NO: 565676 - DNA, 25 bp, Rattus norvegicus
ctctgtccactggttccgggttctc

SEQ ID NO: 565677 - DNA, 25 bp, Rattus norvegicus
cacctccgaagtgcgcggagcatcg

SEQ ID NO: 565678 - DNA, 25 bp, Rattus norvegicus
ggttgacgaacggttctccgcggca

SEQ ID NO: 565679 - DNA, 25 bp, Rattus norvegicus
agagaccggccttttgtctccctga

SEQ ID NO: 565680 - DNA, 25 bp, Rattus norvegicus
ccctctgaaggcttcattgcgcttg

SEQ ID NO: 565681 - DNA, 25 bp, Rattus norvegicus
gaaggcttcattgcgcttgcgtctg

SEQ ID NO: 565682 - DNA, 25 bp, Rattus norvegicus
ctggttccgtgcaactttcaagtga

SEQ ID NO: 565683 - DNA, 25 bp, Rattus norvegicus
ttcaagtgagttacaaactccgccc

SEQ ID NO: 565684 - DNA, 25 bp, Rattus norvegicus
gcaggacctggttccgtgcaacttt

SEQ ID NO: 565685 - DNA, 25 bp, Rattus norvegicus
gcttgcgtctggagcttgagctctg

SEQ ID NO: 565686 - DNA, 25 bp, Rattus norvegicus
atcgccgctttaagagaccggcctt

SEQ ID NO: 565687 - DNA, 25 bp, Rattus norvegicus
ccactctcagttgcgcgtctggcga

SEQ ID NO: 565688 - DNA, 25 bp, Rattus norvegicus
agttcccgggcttggcacctatagt

SEQ ID NO: 565689 - DNA, 25 bp, Rattus norvegicus
acagcctcggcccagaagctggtgc

SEQ ID NO: 565690 - DNA, 25 bp, Rattus norvegicus
gagtctcggcgtcccatggcgcaac

SEQ ID NO: 565691 - DNA, 25 bp, Rattus norvegicus
tcactgacccgtgagaacccgactg

SEQ ID NO: 565692 - DNA, 25 bp, Rattus norvegicus
cccaaagcgcagcacggagtctcgg

SEQ ID NO: 565693 - DNA, 25 bp, Rattus norvegicus
cccatggggagcgagtgcccagcac

SEQ ID NO: 565694 - DNA, 25 bp, Rattus norvegicus
ggtgcctcgctcctggctcacagga

SEQ ID NO: 565695 - DNA, 25 bp, Rattus norvegicus
attagccgcgctacgcggtgctgcg

SEQ ID NO: 565696 - DNA, 25 bp, Rattus norvegicus
tgtgccgcatcctgcaaatcccgga

SEQ ID NO: 565697 - DNA, 25 bp, Rattus norvegicus
cggctgggaagctggcacactgccc

SEQ ID NO: 565698 - DNA, 25 bp, Rattus norvegicus
ctcctgtttccctcagggtgctgga

SEQ ID NO: 565699 - DNA, 25 bp, Rattus norvegicus
gccgccgaatcacgggctcctgttt

SEQ ID NO: 565700 - DNA, 25 bp, Rattus norvegicus
atggcgatcagaggtcctgctgcgc

SEQ ID NO: 565701 - DNA, 25 bp, Rattus norvegicus
gtaaccgctgcgagatggccaatcc

SEQ ID NO: 565702 - DNA, 25 bp, Rattus norvegicus
caagtgacgccatcgaccctggtca

SEQ ID NO: 565703 - DNA, 25 bp, Rattus norvegicus
accctggtcacggtggtgttcatca

SEQ ID NO: 565704 - DNA, 25 bp, Rattus norvegicus
cgtgctgggtgaattagctaattgc

SEQ ID NO: 565705 - DNA, 25 bp, Rattus norvegicus
gtgatgcgcagcctatcagagacca

SEQ ID NO: 565706 - DNA, 25 bp, Rattus norvegicus
agaccagatgtctcccggaggttcc

SEQ ID NO: 565707 - DNA, 25 bp, Rattus norvegicus
gttccgcgttagacttggccctcaa

SEQ ID NO: 565708 - DNA, 25 bp, Rattus norvegicus
cgtgcgactgcggaagaatgtctgc

SEQ ID NO: 565709 - DNA, 25 bp, Rattus norvegicus
cgtgttcctcaacgagcaggtgagc

SEQ ID NO: 565710 - DNA, 25 bp, Rattus norvegicus
gtgccgcctgccctgatcgaaacag

SEQ ID NO: 565711 - DNA, 25 bp, Rattus norvegicus
agaatgtctgctacgtggtgctggc

SEQ ID NO: 565712 - DNA, 25 bp, Rattus norvegicus
gcaggatgacatcaccgtcggaacc

SEQ ID NO: 565713 - DNA, 25 bp, Rattus norvegicus
gagcctcggcttccgtaatgtcatc

SEQ ID NO: 565714 - DNA, 25 bp, Rattus norvegicus
gagcgtccgacgactagccagcctt

SEQ ID NO: 565715 - DNA, 25 bp, Rattus norvegicus
gagctagcctaagcgctcctggcgg

SEQ ID NO: 565716 - DNA, 25 bp, Rattus norvegicus
ccgagccggctcagcatgatggcga

SEQ ID NO: 565717 - DNA, 25 bp, Rattus norvegicus
agagaaccctggagctagcctaagc

SEQ ID NO: 565718 - DNA, 25 bp, Rattus norvegicus
agccagtcggtcaggagagaaccct

SEQ ID NO: 565719 - DNA, 25 bp, Rattus norvegicus
caaggtcgccggagccagtcggtca

SEQ ID NO: 565720 - DNA, 25 bp, Rattus norvegicus
tcaggatcaagggagtgcgcctcag

SEQ ID NO: 565721 - DNA, 25 bp, Rattus norvegicus
tccggactcaggatcaagggagtgc

SEQ ID NO: 565722 - DNA, 25 bp, Rattus norvegicus
ctcaggatcaagagatccggactca

SEQ ID NO: 565723 - DNA, 25 bp, Rattus norvegicus
gggatcccgactcaggatcaagaga

SEQ ID NO: 565724 - DNA, 25 bp, Rattus norvegicus
aggccggatcaagggatcccgactc

SEQ ID NO: 565725 - DNA, 25 bp, Rattus norvegicus
cacaacaggaagcagtgcggaggcc

SEQ ID NO: 565726 - DNA, 25 bp, Rattus norvegicus
ggcacaggaagcacaacaggaagca

SEQ ID NO: 565727 - DNA, 25 bp, Rattus norvegicus
aacgttacaagaagccgtgcggagc

SEQ ID NO: 565728 - DNA, 25 bp, Rattus norvegicus
ggctcagcatgatggcgacccggcc

SEQ ID NO: 565729 - DNA, 25 bp, Rattus norvegicus
gctcaccttctgcagacgttccatg

SEQ ID NO: 565730 - DNA, 25 bp, Rattus norvegicus
ccttctgcagacgttccatgcggca

SEQ ID NO: 565731 - DNA, 25 bp, Rattus norvegicus
actccggagctgacctgggagagca

SEQ ID NO: 565732 - DNA, 25 bp, Rattus norvegicus
ttccatgcggcagccactggccggc

SEQ ID NO: 565733 - DNA, 25 bp, Rattus norvegicus
tggcccggggtgcaacccgctcacc

SEQ ID NO: 565734 - DNA, 25 bp, Rattus norvegicus
cgctccctcggaagccggtgcgcac

SEQ ID NO: 565735 - DNA, 25 bp, Rattus norvegicus
gcgcacgtggagaggacagacgtca

SEQ ID NO: 565736 - DNA, 25 bp, Rattus norvegicus
gctcctgcagcgagggcttcacaac

SEQ ID NO: 565737 - DNA, 25 bp, Rattus norvegicus
tgcagcgagggcttcacaacgctct

SEQ ID NO: 565738 - DNA, 25 bp, Rattus norvegicus
cgagggcttcacaacgctctgtggt

SEQ ID NO: 565739 - DNA, 25 bp, Rattus norvegicus
acaacgctctgtggtgtcctcatcc

SEQ ID NO: 565740 - DNA, 25 bp, Rattus norvegicus
tggtgtcctcatcccttgggcctct

SEQ ID NO: 565741 - DNA, 25 bp, Rattus norvegicus
atcccttgggcctctctgcgctgtt

SEQ ID NO: 565742 - DNA, 25 bp, Rattus norvegicus
ttgggcctctctgcgctgttgaccg

SEQ ID NO: 565743 - DNA, 25 bp, Rattus norvegicus
ctcatgccgggcgttctggaaggct

SEQ ID NO: 565744 - DNA, 25 bp, Rattus norvegicus
cacgaattcgaactgcttctgcctt

SEQ ID NO: 565745 - DNA, 25 bp, Rattus norvegicus
ctgcctttcagcgtggttggggaaa

SEQ ID NO: 565746 - DNA, 25 bp, Rattus norvegicus
aagtgggcctctcgctggttctggc

SEQ ID NO: 565747 - DNA, 25 bp, Rattus norvegicus
cctgccgggtgaaagccatgaacca

SEQ ID NO: 565748 - DNA, 25 bp, Rattus norvegicus
ggcggagcccacgaattcgaactgc

SEQ ID NO: 565749 - DNA, 25 bp, Rattus norvegicus
tgaaccagccctcatgccgggcgtt

SEQ ID NO: 565750 - DNA, 25 bp, Rattus norvegicus
tgcttctgcctttcagcgtggttgg

SEQ ID NO: 565751 - DNA, 25 bp, Rattus norvegicus
ctggaaggctgtgtagttgttctcc

SEQ ID NO: 565752 - DNA, 25 bp, Rattus norvegicus
ttctccagtacgatctcggtgaata

SEQ ID NO: 565753 - DNA, 25 bp, Rattus norvegicus
atctcggtgaatacgcagtctttgc

SEQ ID NO: 565754 - DNA, 25 bp, Rattus norvegicus
atacgcagtctttgctcttcccgct

SEQ ID NO: 565755 - DNA, 25 bp, Rattus norvegicus
ggtgaaagccatgaaccagccctca

SEQ ID NO: 565756 - DNA, 25 bp, Rattus norvegicus
aggcgcttgatgaagtgggcctctc

SEQ ID NO: 565757 - DNA, 25 bp, Rattus norvegicus
ccttactgcgcgtgcgtggaacaag

SEQ ID NO: 565758 - DNA, 25 bp, Rattus norvegicus
agccgctgcgcttggtgtcagctgt

SEQ ID NO: 565759 - DNA, 25 bp, Rattus norvegicus
ggaaatcacccagcgcatgagtcct

SEQ ID NO: 565760 - DNA, 25 bp, Rattus norvegicus
gcatgagtccttactgcgcgtgcgt

SEQ ID NO: 565761 - DNA, 25 bp, Rattus norvegicus
atttcagccgctgcgcttggtgtca

SEQ ID NO: 565762 - DNA, 25 bp, Rattus norvegicus
ggcagcccagatgcaacctaggcat

SEQ ID NO: 565763 - DNA, 25 bp, Rattus norvegicus
gccgctccttctgacgcaaggaacg

SEQ ID NO: 565764 - DNA, 25 bp, Rattus norvegicus
cgcaaggaacgcacgggatcacttc

SEQ ID NO: 565765 - DNA, 25 bp, Rattus norvegicus
gaacgcacgggatcacttccggggc

SEQ ID NO: 565766 - DNA, 25 bp, Rattus norvegicus
ttccggggccgtgcagaacataggc

SEQ ID NO: 565767 - DNA, 25 bp, Rattus norvegicus
ccgtgcagaacataggcttagattt

SEQ ID NO: 565768 - DNA, 25 bp, Rattus norvegicus
agatgcaacctaggcatccgccgct

SEQ ID NO: 565769 - DNA, 25 bp, Rattus norvegicus
taggcttagatttcagccgctgcgc

SEQ ID NO: 565770 - DNA, 25 bp, Rattus norvegicus
tcacccagcgcatgagtccttactg

SEQ ID NO: 565771 - DNA, 25 bp, Rattus norvegicus
ggtgtgggttctgagtttcacccta

SEQ ID NO: 565772 - DNA, 25 bp, Rattus norvegicus
gcacacgtgtctcccggtgtgggtt

SEQ ID NO: 565773 - DNA, 25 bp, Rattus norvegicus
ctgagcgctgcttaaagagcggtgc

SEQ ID NO: 565774 - DNA, 25 bp, Rattus norvegicus
gagctggactccacccacttagggt

SEQ ID NO: 565775 - DNA, 25 bp, Rattus norvegicus
tgtaatgacttcaggcgctgtgggc

SEQ ID NO: 565776 - DNA, 25 bp, Rattus norvegicus
cccggtgcttggtgtaatgacttca

SEQ ID NO: 565777 - DNA, 25 bp, Rattus norvegicus
gtggaagtctgatccggccacgacg

SEQ ID NO: 565778 - DNA, 25 bp, Rattus norvegicus
tctaatacgcaaccggagtcccgca

SEQ ID NO: 565779 - DNA, 25 bp, Rattus norvegicus
ttttggtgtacgctcaccctggcct

SEQ ID NO: 565780 - DNA, 25 bp, Rattus norvegicus
caccctggcctgtgtgaacgtgatc

SEQ ID NO: 565781 - DNA, 25 bp, Rattus norvegicus
tgaacgtgatcctcgcagttccctg

SEQ ID NO: 565782 - DNA, 25 bp, Rattus norvegicus
tgcgctcagggagccaacttggtca

SEQ ID NO: 565783 - DNA, 25 bp, Rattus norvegicus
ttggtcaagcaactgtcccgggagc

SEQ ID NO: 565784 - DNA, 25 bp, Rattus norvegicus
cctacccttcaggatcgagagattg

SEQ ID NO: 565785 - DNA, 25 bp, Rattus norvegicus
gctcactcgattgctgtacgaagtc

SEQ ID NO: 565786 - DNA, 25 bp, Rattus norvegicus
gcggacccatatgcgttcgccactg

SEQ ID NO: 565787 - DNA, 25 bp, Rattus norvegicus
agctcccgtgtgcaggtcgagaaag

SEQ ID NO: 565788 - DNA, 25 bp, Rattus norvegicus
ctcgggctcaaagagcagtgtgctc

SEQ ID NO: 565789 - DNA, 25 bp, Rattus norvegicus
tacttcgcagttaggcagcgcactc

SEQ ID NO: 565790 - DNA, 25 bp, Rattus norvegicus
agaagcgacagacctgtgcaggaca

SEQ ID NO: 565791 - DNA, 25 bp, Rattus norvegicus
cccaggcctgaactgctctcagaga

SEQ ID NO: 565792 - DNA, 25 bp, Rattus norvegicus
caggtgagcccagcagatgcccaga

SEQ ID NO: 565793 - DNA, 25 bp, Rattus norvegicus
gaggcctccgagtctccgagacaga

SEQ ID NO: 565794 - DNA, 25 bp, Rattus norvegicus
ctgactcaggcacaccgggaggcct

SEQ ID NO: 565795 - DNA, 25 bp, Rattus norvegicus
cgcataagcagagggagtcgtctga

SEQ ID NO: 565796 - DNA, 25 bp, Rattus norvegicus
ccacggagagaccaggggcgcataa

SEQ ID NO: 565797 - DNA, 25 bp, Rattus norvegicus
tgcagacctcctggcctgcctgatg

SEQ ID NO: 565798 - DNA, 25 bp, Rattus norvegicus
gacagaggcaaagggatgcagctcc

SEQ ID NO: 565799 - DNA, 25 bp, Rattus norvegicus
cgcgtggaagtggaccatgctttct

SEQ ID NO: 565800 - DNA, 25 bp, Rattus norvegicus
ccagcaccgcgtggaagtggaccat

SEQ ID NO: 565801 - DNA, 25 bp, Rattus norvegicus
aaaggggccgcgctcgaactcgcgc

SEQ ID NO: 565802 - DNA, 25 bp, Rattus norvegicus
tacgcaggccctggccggtcggctt

SEQ ID NO: 565803 - DNA, 25 bp, Rattus norvegicus
ctcgtggcgtagtgccgctcggcta

SEQ ID NO: 565804 - DNA, 25 bp, Rattus norvegicus
ctcggcgctctacgctcgtggcgta

SEQ ID NO: 565805 - DNA, 25 bp, Rattus norvegicus
ttgctccattcatgctcctctcagg

SEQ ID NO: 565806 - DNA, 25 bp, Rattus norvegicus
gatccgccattttgctccattcatg

SEQ ID NO: 565807 - DNA, 25 bp, Rattus norvegicus
cacctgcacatgatccgccattttg

SEQ ID NO: 565808 - DNA, 25 bp, Rattus norvegicus
cttccagcgcctcgtgtgaggcatg

SEQ ID NO: 565809 - DNA, 25 bp, Rattus norvegicus
gacagtcagcgaggggtcctctccc

SEQ ID NO: 565810 - DNA, 25 bp, Rattus norvegicus
ctcttaggacagtcagcgaggggtc

SEQ ID NO: 565811 - DNA, 25 bp, Rattus norvegicus
gctctttttgttaatcacggagggc

SEQ ID NO: 565812 - DNA, 25 bp, Rattus norvegicus
cgcgtggtgaggctctttttgttaa

SEQ ID NO: 565813 - DNA, 25 bp, Rattus norvegicus
cccaggactcgggatcttcaaccgg

SEQ ID NO: 565814 - DNA, 25 bp, Rattus norvegicus
actcgggatcttcaaccggcggccg

SEQ ID NO: 565815 - DNA, 25 bp, Rattus norvegicus
ccgcattggatttgggggtcgttat

SEQ ID NO: 565816 - DNA, 25 bp, Rattus norvegicus
ggtcgttattgctcggctgttatta

SEQ ID NO: 565817 - DNA, 25 bp, Rattus norvegicus
ccagcagtgagaatcccaggactcg

SEQ ID NO: 565818 - DNA, 25 bp, Rattus norvegicus
cgtgtgtttgatttcagtggcaagg

SEQ ID NO: 565819 - DNA, 25 bp, Rattus norvegicus
tagctacgtgtgtttgatttcagtg

SEQ ID NO: 565820 - DNA, 25 bp, Rattus norvegicus
aggcagccagacacatagctacgtg

SEQ ID NO: 565821 - DNA, 25 bp, Rattus norvegicus
gaccaggctgttggcttagaaggca

SEQ ID NO: 565822 - DNA, 25 bp, Rattus norvegicus
aagggctgggctgacctcaggacca

SEQ ID NO: 565823 - DNA, 25 bp, Rattus norvegicus
tattgctcggctgttattattatcg

SEQ ID NO: 565824 - DNA, 25 bp, Rattus norvegicus
ggcttagaaggcagccagacacata

SEQ ID NO: 565825 - DNA, 25 bp, Rattus norvegicus
ccaaccagcagtgagaatcccagga

SEQ ID NO: 565826 - DNA, 25 bp, Rattus norvegicus
ctcaggaccaggctgttggcttaga

SEQ ID NO: 565827 - DNA, 25 bp, Rattus norvegicus
gccgccctttccagagtcgtgtcaa

SEQ ID NO: 565828 - DNA, 25 bp, Rattus norvegicus
gacgtcgaaatcactcgctcctttt

SEQ ID NO: 565829 - DNA, 25 bp, Rattus norvegicus
ttttccttcacctagcgcacgccgc

SEQ ID NO: 565830 - DNA, 25 bp, Rattus norvegicus
ttccagagtcgtgtcaaaagttccc

SEQ ID NO: 565831 - DNA, 25 bp, Rattus norvegicus
gcagcagcgctagcgatctgacgtc

SEQ ID NO: 565832 - DNA, 25 bp, Rattus norvegicus
tcgccacccacctaacaggtggttg

SEQ ID NO: 565833 - DNA, 25 bp, Rattus norvegicus
cctaacaggtggttgacttacctgg

SEQ ID NO: 565834 - DNA, 25 bp, Rattus norvegicus
cgcagacccgaagggcgtgttttcg

SEQ ID NO: 565835 - DNA, 25 bp, Rattus norvegicus
tttcgaggatttaaccctcaggtga

SEQ ID NO: 565836 - DNA, 25 bp, Rattus norvegicus
atttaaccctcaggtgagcgggcag

SEQ ID NO: 565837 - DNA, 25 bp, Rattus norvegicus
tctcttctgcgaggctccggctcgt

SEQ ID NO: 565838 - DNA, 25 bp, Rattus norvegicus
cctcactaggttggaggtgggccca

SEQ ID NO: 565839 - DNA, 25 bp, Rattus norvegicus
cgctagcgatctgacgtcgaaatca

SEQ ID NO: 565840 - DNA, 25 bp, Rattus norvegicus
gcgaggaccgcagcctcccttcctc

SEQ ID NO: 565841 - DNA, 25 bp, Rattus norvegicus
aggcaacggctgtagggttcccgct

SEQ ID NO: 565842 - DNA, 25 bp, Rattus norvegicus
gcctggagccgctcgctgactcaat

SEQ ID NO: 565843 - DNA, 25 bp, Rattus norvegicus
gtctttccgctctttcccgcctgga

SEQ ID NO: 565844 - DNA, 25 bp, Rattus norvegicus
tagcggcgccgtttccaggtctttc

SEQ ID NO: 565845 - DNA, 25 bp, Rattus norvegicus
cttccaagcacaaggcgcgggctag

SEQ ID NO: 565846 - DNA, 25 bp, Rattus norvegicus
gtccctgctgtggttctgggttcac

SEQ ID NO: 565847 - DNA, 25 bp, Rattus norvegicus
ggctgtagggttcccgcttccagct

SEQ ID NO: 565848 - DNA, 25 bp, Rattus norvegicus
tccgtttttgcgtcgccccgaggca

SEQ ID NO: 565849 - DNA, 25 bp, Rattus norvegicus
tgcgcatgcgcgcaggccaagcctg

SEQ ID NO: 565850 - DNA, 25 bp, Rattus norvegicus
tctgggttcacgtcccttcctgggc

SEQ ID NO: 565851 - DNA, 25 bp, Rattus norvegicus
ctgtggttctgggttcacgtccctt

SEQ ID NO: 565852 - DNA, 25 bp, Rattus norvegicus
tcagcgccaacccacccgagccagg

SEQ ID NO: 565853 - DNA, 25 bp, Rattus norvegicus
cgctcgctgactcaatggccgcata

SEQ ID NO: 565854 - DNA, 25 bp, Rattus norvegicus
ccggtgtctccatcccttccaagca

SEQ ID NO: 565855 - DNA, 25 bp, Rattus norvegicus
cgcgagcccaggaccgtgtcaccgc

SEQ ID NO: 565856 - DNA, 25 bp, Rattus norvegicus
tgaggaaaaccggacgcgcccggca

SEQ ID NO: 565857 - DNA, 25 bp, Rattus norvegicus
cggcctctgggagaacgctggacag

SEQ ID NO: 565858 - DNA, 25 bp, Rattus norvegicus
ccgggcttgtctccgcccgcgtcgt

SEQ ID NO: 565859 - DNA, 25 bp, Rattus norvegicus
aacgtcatttctgcccgcggcgtca

SEQ ID NO: 565860 - DNA, 25 bp, Rattus norvegicus
gaaaacgtcatttctgcccgcggcg

SEQ ID NO: 565861 - DNA, 25 bp, Rattus norvegicus
caaccgcgggaaaacgtcatttctg

SEQ ID NO: 565862 - DNA, 25 bp, Rattus norvegicus
tcttcggggtcactgtcctgcgcgg

SEQ ID NO: 565863 - DNA, 25 bp, Rattus norvegicus
cagctcttcggggtcactgtcctgc

SEQ ID NO: 565864 - DNA, 25 bp, Rattus norvegicus
atcaggggcagctcttcggggtcac

SEQ ID NO: 565865 - DNA, 25 bp, Rattus norvegicus
ctcacctgatcaggggcagctcttc

SEQ ID NO: 565866 - DNA, 25 bp, Rattus norvegicus
gcgccgctcctatcgcttgcccggc

SEQ ID NO: 565867 - DNA, 25 bp, Rattus norvegicus
gacacctgtcaagccgcagtccaga

SEQ ID NO: 565868 - DNA, 25 bp, Rattus norvegicus
gcgctcctcacctgatcaggggcag

SEQ ID NO: 565869 - DNA, 25 bp, Rattus norvegicus
gggagctcgtacacctgtgcaactg

SEQ ID NO: 565870 - DNA, 25 bp, Rattus norvegicus
gctgctcttgggctcgtccttcttg

SEQ ID NO: 565871 - DNA, 25 bp, Rattus norvegicus
aggttcccaggcgaccgagccaagt

SEQ ID NO: 565872 - DNA, 25 bp, Rattus norvegicus
agccaagtgcaaagccgcgggagct

SEQ ID NO: 565873 - DNA, 25 bp, Rattus norvegicus
acacaccacggtacccaggagcgga

SEQ ID NO: 565874 - DNA, 25 bp, Rattus norvegicus
acgacccgagccaggaccttgcaat

SEQ ID NO: 565875 - DNA, 25 bp, Rattus norvegicus
cagcgccgagttgaacgtcaccttc

SEQ ID NO: 565876 - DNA, 25 bp, Rattus norvegicus
gtcaccttcaccatggtgcggcctg

SEQ ID NO: 565877 - DNA, 25 bp, Rattus norvegicus
gtgcagcctcgtcggccgagctcag

SEQ ID NO: 565878 - DNA, 25 bp, Rattus norvegicus
tcggccgagctcagggcacgactct

SEQ ID NO: 565879 - DNA, 25 bp, Rattus norvegicus
agcgaactgcgcgacagcagcagcg

SEQ ID NO: 565880 - DNA, 25 bp, Rattus norvegicus
cagcagcagcggctcagtgcagcgc

SEQ ID NO: 565881 - DNA, 25 bp, Rattus norvegicus
tgcagcgcggtttccggcctcgcag

SEQ ID NO: 565882 - DNA, 25 bp, Rattus norvegicus
tggcctccttttgggccagcgccga

SEQ ID NO: 565883 - DNA, 25 bp, Rattus norvegicus
aatgacaggccttggcagtacgcga

SEQ ID NO: 565884 - DNA, 25 bp, Rattus norvegicus
atggacgtggggtcaactgccttcc

SEQ ID NO: 565885 - DNA, 25 bp, Rattus norvegicus
ggagtctccggccaacgtgatggac

SEQ ID NO: 565886 - DNA, 25 bp, Rattus norvegicus
tcttgtcgaggtaaccgcggcctgg

SEQ ID NO: 565887 - DNA, 25 bp, Rattus norvegicus
atctggaggtcttgtcgaggtaacc

SEQ ID NO: 565888 - DNA, 25 bp, Rattus norvegicus
ccaacgtgatggacgtggggtcaac

SEQ ID NO: 565889 - DNA, 25 bp, Rattus norvegicus
cagtacgcgagagcggcttctgtct

SEQ ID NO: 565890 - DNA, 25 bp, Rattus norvegicus
ggcgtttcaggaatgacaggccttg

SEQ ID NO: 565891 - DNA, 25 bp, Rattus norvegicus
cttcttcaagtggtgagaaggaaaa

SEQ ID NO: 565892 - DNA, 25 bp, Rattus norvegicus
gacgatggcggcttcttcaagtggt

SEQ ID NO: 565893 - DNA, 25 bp, Rattus norvegicus
tcgcactgcgcatgcgacggctggt

SEQ ID NO: 565894 - DNA, 25 bp, Rattus norvegicus
ctgcggctagctcgcactgcgcatg

SEQ ID NO: 565895 - DNA, 25 bp, Rattus norvegicus
ataggcggcgctctagcgggaccac

SEQ ID NO: 565896 - DNA, 25 bp, Rattus norvegicus
agagcggcttctgtctgcgctggaa

SEQ ID NO: 565897 - DNA, 25 bp, Rattus norvegicus
cacggaactcaattgcgcactgacg

SEQ ID NO: 565898 - DNA, 25 bp, Rattus norvegicus
tgacccgggaagtgacgttaatctc

SEQ ID NO: 565899 - DNA, 25 bp, Rattus norvegicus
ccatagcgtttgactgacccgggaa

SEQ ID NO: 565900 - DNA, 25 bp, Rattus norvegicus
gctccgcgttagtggccatagcgtt

SEQ ID NO: 565901 - DNA, 25 bp, Rattus norvegicus
cgaggtcgtcctgctcacccaaatt

SEQ ID NO: 565902 - DNA, 25 bp, Rattus norvegicus
caacgaggatgctcgcagctcaaca

SEQ ID NO: 565903 - DNA, 25 bp, Rattus norvegicus
ccagaaggacgcaacgaggatgctc

SEQ ID NO: 565904 - DNA, 25 bp, Rattus norvegicus
ccaggaagctggaaactgccggctc

SEQ ID NO: 565905 - DNA, 25 bp, Rattus norvegicus
gatcccagaggacaccggggccaca

SEQ ID NO: 565906 - DNA, 25 bp, Rattus norvegicus
tgacgcgcttcacacggaccgatta

SEQ ID NO: 565907 - DNA, 25 bp, Rattus norvegicus
tcacacggaccgattatgtagtgcg

SEQ ID NO: 565908 - DNA, 25 bp, Rattus norvegicus
tgtagtgcggtctagtgacattccc

SEQ ID NO: 565909 - DNA, 25 bp, Rattus norvegicus
gtgacattcccgagacttccgcttc

SEQ ID NO: 565910 - DNA, 25 bp, Rattus norvegicus
tcctgctcacccaaattccaagtgg

SEQ ID NO: 565911 - DNA, 25 bp, Rattus norvegicus
gggttccttgcgatgctcagaggca

SEQ ID NO: 565912 - DNA, 25 bp, Rattus norvegicus
cccgaggattgtccttgtcacggcc

SEQ ID NO: 565913 - DNA, 25 bp, Rattus norvegicus
tgaacctctggagcagctggctctg

SEQ ID NO: 565914 - DNA, 25 bp, Rattus norvegicus
gtcggactcagaaatggcggcgtcc

SEQ ID NO: 565915 - DNA, 25 bp, Rattus norvegicus
cggcgtccatgttcttcggccggca

SEQ ID NO: 565916 - DNA, 25 bp, Rattus norvegicus
ggagccaccggtcgcagactacagt

SEQ ID NO: 565917 - DNA, 25 bp, Rattus norvegicus
agactacagtgcgagccacggccca

SEQ ID NO: 565918 - DNA, 25 bp, Rattus norvegicus
cagccctgttcgctttaggttcggg

SEQ ID NO: 565919 - DNA, 25 bp, Rattus norvegicus
atgctcagaggcaatggccagggct

SEQ ID NO: 565920 - DNA, 25 bp, Rattus norvegicus
agctggcgctcaggcatctcggctc

SEQ ID NO: 565921 - DNA, 25 bp, Rattus norvegicus
cgtcttggctgtcggcctcgcttgc

SEQ ID NO: 565922 - DNA, 25 bp, Rattus norvegicus
tcgcttgccggagtccgccggaacg

SEQ ID NO: 565923 - DNA, 25 bp, Rattus norvegicus
acggcccaggtaagtcagccctgtt

SEQ ID NO: 565924 - DNA, 25 bp, Rattus norvegicus
tcacggcccgggtgaacctctggag

SEQ ID NO: 565925 - DNA, 25 bp, Rattus norvegicus
gtctgaatcctccacgtgtgacatg

SEQ ID NO: 565926 - DNA, 25 bp, Rattus norvegicus
gtccttccgggtatgacctgttgcg

SEQ ID NO: 565927 - DNA, 25 bp, Rattus norvegicus
gtgaccctggtaactcgcgcaccta

SEQ ID NO: 565928 - DNA, 25 bp, Rattus norvegicus
cgcaatgacaagagccacccaggtg

SEQ ID NO: 565929 - DNA, 25 bp, Rattus norvegicus
tggggctcgaaaccgctattgcaac

SEQ ID NO: 565930 - DNA, 25 bp, Rattus norvegicus
atccgcaaggttcctgagcccaaca

SEQ ID NO: 565931 - DNA, 25 bp, Rattus norvegicus
atctctgcagcgtggcttgactttc

SEQ ID NO: 565932 - DNA, 25 bp, Rattus norvegicus
actgcccagtgcgtgcatctctgca

SEQ ID NO: 565933 - DNA, 25 bp, Rattus norvegicus
ccgcagcctgattcctcaactgagg

SEQ ID NO: 565934 - DNA, 25 bp, Rattus norvegicus
tgccgctgcagctcagtctcagttc

SEQ ID NO: 565935 - DNA, 25 bp, Rattus norvegicus
acgcagggcccaatctttgtcctca

SEQ ID NO: 565936 - DNA, 25 bp, Rattus norvegicus
gggcctcactcatgtccagcatcgg

SEQ ID NO: 565937 - DNA, 25 bp, Rattus norvegicus
agcacctgcgacacggcatcacgga

SEQ ID NO: 565938 - DNA, 25 bp, Rattus norvegicus
ctctgtggacggacactctggaatc

SEQ ID NO: 565939 - DNA, 25 bp, Rattus norvegicus
tcaaagacagccacgggctggctga

SEQ ID NO: 565940 - DNA, 25 bp, Rattus norvegicus
cgtgcaggtctcaggaacgaaggct

SEQ ID NO: 565941 - DNA, 25 bp, Rattus norvegicus
gacccggctcaagctacgcgcaggc

SEQ ID NO: 565942 - DNA, 25 bp, Rattus norvegicus
gcgacctcaaagacagccacgggct

SEQ ID NO: 565943 - DNA, 25 bp, Rattus norvegicus
gccagcggcggcgacctcaaagaca

SEQ ID NO: 565944 - DNA, 25 bp, Rattus norvegicus
tctcaggaacgaaggctgagccagc

SEQ ID NO: 565945 - DNA, 25 bp, Rattus norvegicus
cgcaggcgcaacagagagccacctg

SEQ ID NO: 565946 - DNA, 25 bp, Rattus norvegicus
aacagagagccacctgcgcaagcgc

SEQ ID NO: 565947 - DNA, 25 bp, Rattus norvegicus
gcgcgccatggaacaacggttagcc

SEQ ID NO: 565948 - DNA, 25 bp, Rattus norvegicus
catggaacaacggttagccgagttc

SEQ ID NO: 565949 - DNA, 25 bp, Rattus norvegicus
gcaaacgagccggtttggtagccca

SEQ ID NO: 565950 - DNA, 25 bp, Rattus norvegicus
gccggtttggtagcccagccttcca

SEQ ID NO: 565951 - DNA, 25 bp, Rattus norvegicus
gccttccacgtcgagccagagcgtg

SEQ ID NO: 565952 - DNA, 25 bp, Rattus norvegicus
agccagagcgtgcaggtctcaggaa

SEQ ID NO: 565953 - DNA, 25 bp, Rattus norvegicus
gtgacgatctctgcaccgttttcgc

SEQ ID NO: 565954 - DNA, 25 bp, Rattus norvegicus
agctcaggctctaggcggaagctcc

SEQ ID NO: 565955 - DNA, 25 bp, Rattus norvegicus
tcttttctggagagttcggaacctc

SEQ ID NO: 565956 - DNA, 25 bp, Rattus norvegicus
acctcaccaaggtaagacggcgtgg

SEQ ID NO: 565957 - DNA, 25 bp, Rattus norvegicus
tgggtggtgagttccagtaattctc

SEQ ID NO: 565958 - DNA, 25 bp, Rattus norvegicus
aattctctacctggtctggggcggc

SEQ ID NO: 565959 - DNA, 25 bp, Rattus norvegicus
tgcgcggacgtctagagttaagatg

SEQ ID NO: 565960 - DNA, 25 bp, Rattus norvegicus
tccaccggacctgctaatcgcttta

SEQ ID NO: 565961 - DNA, 25 bp, Rattus norvegicus
atcgctttaatttcggggagctgga

SEQ ID NO: 565962 - DNA, 25 bp, Rattus norvegicus
gaaacaatgtgtgacctgaggcacc

SEQ ID NO: 565963 - DNA, 25 bp, Rattus norvegicus
tgaggcaccaggctttctgggaagc

SEQ ID NO: 565964 - DNA, 25 bp, Rattus norvegicus
acaggaacgcgcgaaaaggctctcg

SEQ ID NO: 565965 - DNA, 25 bp, Rattus norvegicus
gctgcgagcgatgccactaggaccc

SEQ ID NO: 565966 - DNA, 25 bp, Rattus norvegicus
tacgcgccggtacagcatttcgctg

SEQ ID NO: 565967 - DNA, 25 bp, Rattus norvegicus
agaattggctgcctcctctagcgcg

SEQ ID NO: 565968 - DNA, 25 bp, Rattus norvegicus
ggcgagccaatcgagcaacacactc

SEQ ID NO: 565969 - DNA, 25 bp, Rattus norvegicus
cacaggcgcagaaccaaggctggca

SEQ ID NO: 565970 - DNA, 25 bp, Rattus norvegicus
gccgcgacactacgaggagaggaca

SEQ ID NO: 565971 - DNA, 25 bp, Rattus norvegicus
ccgggacgcaaaatgtttccatgta

SEQ ID NO: 565972 - DNA, 25 bp, Rattus norvegicus
tttccatgtagaggtccaggatctg

SEQ ID NO: 565973 - DNA, 25 bp, Rattus norvegicus
ggcagcacagctcgcttgatcacca

SEQ ID NO: 565974 - DNA, 25 bp, Rattus norvegicus
agaaccctcttctggcgagccaatc

SEQ ID NO: 565975 - DNA, 25 bp, Rattus norvegicus
tcacctgcctgaaccgtgtccgaga

SEQ ID NO: 565976 - DNA, 25 bp, Rattus norvegicus
ggctgcagtcctgggaaattccttc

SEQ ID NO: 565977 - DNA, 25 bp, Rattus norvegicus
cttcagcttcctggcgctcaggttc

SEQ ID NO: 565978 - DNA, 25 bp, Rattus norvegicus
gcgcgctccaaaccacggttcaagg

SEQ ID NO: 565979 - DNA, 25 bp, Rattus norvegicus
ttgatcaccaacgtttccagcgggg

SEQ ID NO: 565980 - DNA, 25 bp, Rattus norvegicus
ccaggatctggttcgtgttcccgac

SEQ ID NO: 565981 - DNA, 25 bp, Rattus norvegicus
gagacgtaggtaagccgcggtccac

SEQ ID NO: 565982 - DNA, 25 bp, Rattus norvegicus
gagcttttcagatcacgagtgttgc

SEQ ID NO: 565983 - DNA, 25 bp, Rattus norvegicus
cgcggtccacgcgagattctctgac

SEQ ID NO: 565984 - DNA, 25 bp, Rattus norvegicus
tgtcctcaaggttccgcgacgcagt

SEQ ID NO: 565985 - DNA, 25 bp, Rattus norvegicus
cgggcagctttcctggagcttttca

SEQ ID NO: 565986 - DNA, 25 bp, Rattus norvegicus
agcaaagataactggcgtcccggca

SEQ ID NO: 565987 - DNA, 25 bp, Rattus norvegicus
ccatccgaatagtggggaagccgca

SEQ ID NO: 565988 - DNA, 25 bp, Rattus norvegicus
tagcgcgtctccgtgtttccgtgtt

SEQ ID NO: 565989 - DNA, 25 bp, Rattus norvegicus
tctaaggcgcccactcggtagcgcg

SEQ ID NO: 565990 - DNA, 25 bp, Rattus norvegicus
cgagattctctgacttcagctctga

SEQ ID NO: 565991 - DNA, 25 bp, Rattus norvegicus
tcagctctgacccatccgaatagtg

SEQ ID NO: 565992 - DNA, 25 bp, Rattus norvegicus
ccggtcctagctgcatgtcctcaag

SEQ ID NO: 565993 - DNA, 25 bp, Rattus norvegicus
tgtttccgtgtttccgcgggcagct

SEQ ID NO: 565994 - DNA, 25 bp, Rattus norvegicus
cggggagctcatttgtgccaagttt

SEQ ID NO: 565995 - DNA, 25 bp, Rattus norvegicus
acgtctcatctggtgtccggagctc

SEQ ID NO: 565996 - DNA, 25 bp, Rattus norvegicus
ctgacgcctaatctggcggccggaa

SEQ ID NO: 565997 - DNA, 25 bp, Rattus norvegicus
gggcttactcgctgacgcctaatct

SEQ ID NO: 565998 - DNA, 25 bp, Rattus norvegicus
aagctgcctggcttgcgaaggagta

SEQ ID NO: 565999 - DNA, 25 bp, Rattus norvegicus
cttgcgaaggagtagggcaaactcg

SEQ ID NO: 566000 - DNA, 25 bp, Rattus norvegicus
ggcaaactcgtgacttccgtcggct

SEQ ID NO: 566001 - DNA, 25 bp, Rattus norvegicus
tccgtcggcttttagatgcttccta

SEQ ID NO: 566002 - DNA, 25 bp, Rattus norvegicus
tgcttcctatgtagaggcccgatgg

SEQ ID NO: 566003 - DNA, 25 bp, Rattus norvegicus
agttgcgggtttagcgcgttgctct

SEQ ID NO: 566004 - DNA, 25 bp, Rattus norvegicus
gcggcctctgtacgtctcatctggt

SEQ ID NO: 566005 - DNA, 25 bp, Rattus norvegicus
agctccctggagcttggcgaagatc

SEQ ID NO: 566006 - DNA, 25 bp, Rattus norvegicus
agatctgggcggctccgctgctctc

SEQ ID NO: 566007 - DNA, 25 bp, Rattus norvegicus
agtcgcgcgtgcacgtcttctccgt

SEQ ID NO: 566008 - DNA, 25 bp, Rattus norvegicus
cgttgctctgcagcggcctctgtac

SEQ ID NO: 566009 - DNA, 25 bp, Rattus norvegicus
cggcgagtcggtgagttcactgtga

SEQ ID NO: 566010 - DNA, 25 bp, Rattus norvegicus
cggcatgtcggtgagttcgccgtga

SEQ ID NO: 566011 - DNA, 25 bp, Rattus norvegicus
agttcactgtgacggggctaagatg

SEQ ID NO: 566012 - DNA, 25 bp, Rattus norvegicus
gcggcatgtcggtgagttcgccgtg

SEQ ID NO: 566013 - DNA, 25 bp, Rattus norvegicus
atggcggcgagtcggtgagttcact

SEQ ID NO: 566014 - DNA, 25 bp, Rattus norvegicus
tgagttcactgtgacggggctaaga

SEQ ID NO: 566015 - DNA, 25 bp, Rattus norvegicus
atggcggcatgtcggtgagttcacc

SEQ ID NO: 566016 - DNA, 25 bp, Rattus norvegicus
cggcgagtcggtgagttcaccgtga

SEQ ID NO: 566017 - DNA, 25 bp, Rattus norvegicus
ggcatgtcggtgagttcgccgtgag

SEQ ID NO: 566018 - DNA, 25 bp, Rattus norvegicus
atggcggcgagtcggtgagttcacc

SEQ ID NO: 566019 - DNA, 25 bp, Rattus norvegicus
cggcgtgtcggtgagttcaccgtga

SEQ ID NO: 566020 - DNA, 25 bp, Rattus norvegicus
gagttcactgtgacggggctaagat

SEQ ID NO: 566021 - DNA, 25 bp, Rattus norvegicus
cggcatgtcggtgagttcaccgtga

SEQ ID NO: 566022 - DNA, 25 bp, Rattus norvegicus
ggcgagtcggtgagttcactgtgac

SEQ ID NO: 566023 - DNA, 25 bp, Rattus norvegicus
ttagctccagcaccgagtccgtctg

SEQ ID NO: 566024 - DNA, 25 bp, Rattus norvegicus
cgtggctttcgaccgaggataaaca

SEQ ID NO: 566025 - DNA, 25 bp, Rattus norvegicus
cccggaaacgcttccacagcgtggg

SEQ ID NO: 566026 - DNA, 25 bp, Rattus norvegicus
ccgacaggcagagccggggaacttc

SEQ ID NO: 566027 - DNA, 25 bp, Rattus norvegicus
tcagcaacgcagaaccggagcccga

SEQ ID NO: 566028 - DNA, 25 bp, Rattus norvegicus
agagacagcttctcgcgggcgtccc

SEQ ID NO: 566029 - DNA, 25 bp, Rattus norvegicus
gcctgtctgtcagcggcgctatcga

SEQ ID NO: 566030 - DNA, 25 bp, Rattus norvegicus
ggcaggttctccactgccgccttta

SEQ ID NO: 566031 - DNA, 25 bp, Rattus norvegicus
acaggaagccgggagcaacccacgc

SEQ ID NO: 566032 - DNA, 25 bp, Rattus norvegicus
ctgacagcaggacacacgtaggccc

SEQ ID NO: 566033 - DNA, 25 bp, Rattus norvegicus
cgcgagcaatgcgaggctgacagca

SEQ ID NO: 566034 - DNA, 25 bp, Rattus norvegicus
tggacgtccacgcaccctggcaggg

SEQ ID NO: 566035 - DNA, 25 bp, Rattus norvegicus
ccgaggccagaacagacgtggcttt

SEQ ID NO: 566036 - DNA, 25 bp, Rattus norvegicus
agtcgggtctccgatcccagagaga

SEQ ID NO: 566037 - DNA, 25 bp, Rattus norvegicus
tccgagccagtgcagccgcctggga

SEQ ID NO: 566038 - DNA, 25 bp, Rattus norvegicus
actgtctctgcccacggatgggagg

SEQ ID NO: 566039 - DNA, 25 bp, Rattus norvegicus
ttgccgatccgacccaggaagagcg

SEQ ID NO: 566040 - DNA, 25 bp, Rattus norvegicus
ggcctttgccgatccgacccaggaa

SEQ ID NO: 566041 - DNA, 25 bp, Rattus norvegicus
tcattggtcactgccgacaccggct

SEQ ID NO: 566042 - DNA, 25 bp, Rattus norvegicus
gcccacagcacattctcattggtca

SEQ ID NO: 566043 - DNA, 25 bp, Rattus norvegicus
ctctggctgggtccatgaggcagca

SEQ ID NO: 566044 - DNA, 25 bp, Rattus norvegicus
gcagcggttctctggctgggtccat

SEQ ID NO: 566045 - DNA, 25 bp, Rattus norvegicus
tggggcacttcagcccagagcaaac

SEQ ID NO: 566046 - DNA, 25 bp, Rattus norvegicus
ttcaatccttgagcctcccggacgg

SEQ ID NO: 566047 - DNA, 25 bp, Rattus norvegicus
gaggaagtgccgcagcaaaaggttc

SEQ ID NO: 566048 - DNA, 25 bp, Rattus norvegicus
agctcgcgggtgctgaagccgcact

SEQ ID NO: 566049 - DNA, 25 bp, Rattus norvegicus
cgggaactcaccctgcggcggagct

SEQ ID NO: 566050 - DNA, 25 bp, Rattus norvegicus
gccgcagcaaaaggttcaatccttg

SEQ ID NO: 566051 - DNA, 25 bp, Rattus norvegicus
ttcccttacagatgacgagctgttc

SEQ ID NO: 566052 - DNA, 25 bp, Rattus norvegicus
cggaggagacgctctttccggcctt

SEQ ID NO: 566053 - DNA, 25 bp, Rattus norvegicus
gcctggaaataggtccgcgaactca

SEQ ID NO: 566054 - DNA, 25 bp, Rattus norvegicus
cgctggagctcgtgcaatccttcca

SEQ ID NO: 566055 - DNA, 25 bp, Rattus norvegicus
acggacggctctctgttcccttaca

SEQ ID NO: 566056 - DNA, 25 bp, Rattus norvegicus
ctctatatgaggttgggaagcgccc

SEQ ID NO: 566057 - DNA, 25 bp, Rattus norvegicus
cgtcaccgcttacgacagttccggg

SEQ ID NO: 566058 - DNA, 25 bp, Rattus norvegicus
tgtactgccatgacgtggccacgcc

SEQ ID NO: 566059 - DNA, 25 bp, Rattus norvegicus
gctcagctgcgtacccgacaacagt

SEQ ID NO: 566060 - DNA, 25 bp, Rattus norvegicus
acccgggtagcgactctagcctcag

SEQ ID NO: 566061 - DNA, 25 bp, Rattus norvegicus
tcaggtcttccgtccatctcaagtc

SEQ ID NO: 566062 - DNA, 25 bp, Rattus norvegicus
actccgtattgtgtcccaggtctcg

SEQ ID NO: 566063 - DNA, 25 bp, Rattus norvegicus
gcgcacccagggaaactccgtattg

SEQ ID NO: 566064 - DNA, 25 bp, Rattus norvegicus
cgtagatgagcgtgccctctatatg

SEQ ID NO: 566065 - DNA, 25 bp, Rattus norvegicus
ccgcgctccgccataagtttgtcgt

SEQ ID NO: 566066 - DNA, 25 bp, Rattus norvegicus
tgggacaagtagaccgcgaaaagcc

SEQ ID NO: 566067 - DNA, 25 bp, Rattus norvegicus
tgcgcacggtacgtccggacagcgt

SEQ ID NO: 566068 - DNA, 25 bp, Rattus norvegicus
ggaacacgccgctgaatgaagaagt

SEQ ID NO: 566069 - DNA, 25 bp, Rattus norvegicus
acgtcagagagcgatagacagtcca

SEQ ID NO: 566070 - DNA, 25 bp, Rattus norvegicus
gcgacccgggactgaacgtcagaga

SEQ ID NO: 566071 - DNA, 25 bp, Rattus norvegicus
aacagcgacccgcttctcagaacag

SEQ ID NO: 566072 - DNA, 25 bp, Rattus norvegicus
ccataagtttgtcgtgtgaggcggc

SEQ ID NO: 566073 - DNA, 25 bp, Rattus norvegicus
tttggcgcccgtcagatcgagttcc

SEQ ID NO: 566074 - DNA, 25 bp, Rattus norvegicus
acacgccggtgttctgtttggcgcc

SEQ ID NO: 566075 - DNA, 25 bp, Rattus norvegicus
cagacccagaactttcggaagcgcc

SEQ ID NO: 566076 - DNA, 25 bp, Rattus norvegicus
ctcagaacagcggtggcccgggaaa

SEQ ID NO: 566077 - DNA, 25 bp, Rattus norvegicus
acttaagacgagaggaacacgccgc

SEQ ID NO: 566078 - DNA, 25 bp, Rattus norvegicus
tgcgcgcacaagcagcgacccggga

SEQ ID NO: 566079 - DNA, 25 bp, Rattus norvegicus
catttactgtgagtgtccggtggga

SEQ ID NO: 566080 - DNA, 25 bp, Rattus norvegicus
ctgcaaggggatacgcgtgtcatcc

SEQ ID NO: 566081 - DNA, 25 bp, Rattus norvegicus
cgtttgcggcctttcagacatgtgg

SEQ ID NO: 566082 - DNA, 25 bp, Rattus norvegicus
catgcgcccagacagcctagtaatg

SEQ ID NO: 566083 - DNA, 25 bp, Rattus norvegicus
gcagagcacagtccagcgtcgccat

SEQ ID NO: 566084 - DNA, 25 bp, Rattus norvegicus
ttcacctagcgctctgcaaatactg

SEQ ID NO: 566085 - DNA, 25 bp, Rattus norvegicus
agcgtcgccatcagctctgactaga

SEQ ID NO: 566086 - DNA, 25 bp, Rattus norvegicus
ctctgactagagatcccgcggactc

SEQ ID NO: 566087 - DNA, 25 bp, Rattus norvegicus
ctacacacgggcaccttctggctga

SEQ ID NO: 566088 - DNA, 25 bp, Rattus norvegicus
tctggctgaccagagtcgtgctcct

SEQ ID NO: 566089 - DNA, 25 bp, Rattus norvegicus
tgcgggccctcgctttcatttactg

SEQ ID NO: 566090 - DNA, 25 bp, Rattus norvegicus
cggcatcctgtgacttggtcccaac

SEQ ID NO: 566091 - DNA, 25 bp, Rattus norvegicus
tactgaagccaaccaccgagacttt

SEQ ID NO: 566092 - DNA, 25 bp, Rattus norvegicus
ccgagactttcaccgctaggcaaga

SEQ ID NO: 566093 - DNA, 25 bp, Rattus norvegicus
cgtctgatgacgtaagcccgcgatt

SEQ ID NO: 566094 - DNA, 25 bp, Rattus norvegicus
tcgatgctcagattcttcccgcggc

SEQ ID NO: 566095 - DNA, 25 bp, Rattus norvegicus
ccgcctcaggacaactgggtgtact

SEQ ID NO: 566096 - DNA, 25 bp, Rattus norvegicus
ggcttgctgtttgctctaggtggca

SEQ ID NO: 566097 - DNA, 25 bp, Rattus norvegicus
gctcctggtcctcaactgttgcgcg

SEQ ID NO: 566098 - DNA, 25 bp, Rattus norvegicus
cccgcgattggctcgttgacagatg

SEQ ID NO: 566099 - DNA, 25 bp, Rattus norvegicus
tcgctgcaacgcacagtcgctcaaa

SEQ ID NO: 566100 - DNA, 25 bp, Rattus norvegicus
aaacttttccggcttcgtctgatga

SEQ ID NO: 566101 - DNA, 25 bp, Rattus norvegicus
actaggatttacagccagggccgga

SEQ ID NO: 566102 - DNA, 25 bp, Rattus norvegicus
acacagcctgctggaccgtagacta

SEQ ID NO: 566103 - DNA, 25 bp, Rattus norvegicus
caagcccacttgcacacgcagttta

SEQ ID NO: 566104 - DNA, 25 bp, Rattus norvegicus
aactgttgcgcgctccttgaagcca

SEQ ID NO: 566105 - DNA, 25 bp, Rattus norvegicus
atcaggtccctagccattcgctgca

SEQ ID NO: 566106 - DNA, 25 bp, Rattus norvegicus
cggaagtgacgtctaatgttagttc

SEQ ID NO: 566107 - DNA, 25 bp, Rattus norvegicus
cagcggggaccatgttccgacgcaa

SEQ ID NO: 566108 - DNA, 25 bp, Rattus norvegicus
gcgattggctccgtctgccgtccgt

SEQ ID NO: 566109 - DNA, 25 bp, Rattus norvegicus
agtagcggtgattggcgagttctta

SEQ ID NO: 566110 - DNA, 25 bp, Rattus norvegicus
tgattggcgagttcttacgggctga

SEQ ID NO: 566111 - DNA, 25 bp, Rattus norvegicus
ctgagggcgtttctaagccgcgatt

SEQ ID NO: 566112 - DNA, 25 bp, Rattus norvegicus
taagccgcgattggctccgtctgcc

SEQ ID NO: 566113 - DNA, 25 bp, Rattus norvegicus
tcacctcgcttctcctgtcccggcg

SEQ ID NO: 566114 - DNA, 25 bp, Rattus norvegicus
gacgcaagctcacggccctggatta

SEQ ID NO: 566115 - DNA, 25 bp, Rattus norvegicus
gaccatgttccgacgcaagctcacg

SEQ ID NO: 566116 - DNA, 25 bp, Rattus norvegicus
agctcacggccctggattaccacaa

SEQ ID NO: 566117 - DNA, 25 bp, Rattus norvegicus
cccacaggcttcaactgcaaaggtg

SEQ ID NO: 566118 - DNA, 25 bp, Rattus norvegicus
cgcctcctcagcagtagcggtgatt

SEQ ID NO: 566119 - DNA, 25 bp, Rattus norvegicus
tgaaccaggacccaaacacggcggc

SEQ ID NO: 566120 - DNA, 25 bp, Rattus norvegicus
tttctaagccgcgattggctccgtc

SEQ ID NO: 566121 - DNA, 25 bp, Rattus norvegicus
gcggctccgacccactgagaaatgc

SEQ ID NO: 566122 - DNA, 25 bp, Rattus norvegicus
tcctagccaagtatctttatcgttg

SEQ ID NO: 566123 - DNA, 25 bp, Rattus norvegicus
tctttatcgttgtagggagatcaca

SEQ ID NO: 566124 - DNA, 25 bp, Rattus norvegicus
tagggagatcacagccaacgttttc

SEQ ID NO: 566125 - DNA, 25 bp, Rattus norvegicus
gccaacgttttctatttcggatctg

SEQ ID NO: 566126 - DNA, 25 bp, Rattus norvegicus
atttcggatctgttctgcgcctgcc

SEQ ID NO: 566127 - DNA, 25 bp, Rattus norvegicus
tgtcactcggaagccgtagaggacc

SEQ ID NO: 566128 - DNA, 25 bp, Rattus norvegicus
caggcaggacatttaaggggatcca

SEQ ID NO: 566129 - DNA, 25 bp, Rattus norvegicus
aggggatccaacgtcaacagaaaga

SEQ ID NO: 566130 - DNA, 25 bp, Rattus norvegicus
ctgagtctctatgcgcggctccgac

SEQ ID NO: 566131 - DNA, 25 bp, Rattus norvegicus
ccaccgggttcacggcgtctcaaag

SEQ ID NO: 566132 - DNA, 25 bp, Rattus norvegicus
ctcaaagaggattggtgactgggca

SEQ ID NO: 566133 - DNA, 25 bp, Rattus norvegicus
tggtgacaacggcagtccagccttc

SEQ ID NO: 566134 - DNA, 25 bp, Rattus norvegicus
acagaaagaactgagtggctgagtc

SEQ ID NO: 566135 - DNA, 25 bp, Rattus norvegicus
ctagcttctccacgcgacccggatt

SEQ ID NO: 566136 - DNA, 25 bp, Rattus norvegicus
cgtgatgctgttgctgaggagaaaa

SEQ ID NO: 566137 - DNA, 25 bp, Rattus norvegicus
gcgaaggaccgcgtggcagccacca

SEQ ID NO: 566138 - DNA, 25 bp, Rattus norvegicus
gacagcagcggacacgcctaacctg

SEQ ID NO: 566139 - DNA, 25 bp, Rattus norvegicus
ggagaaaagccttattacccattca

SEQ ID NO: 566140 - DNA, 25 bp, Rattus norvegicus
tgggagctgcaactcgtgatgctgt

SEQ ID NO: 566141 - DNA, 25 bp, Rattus norvegicus
gcctgactcatgtcgtggcagcagc

SEQ ID NO: 566142 - DNA, 25 bp, Rattus norvegicus
gcgccgaggaagaaagcctgactca

SEQ ID NO: 566143 - DNA, 25 bp, Rattus norvegicus
cgccacgcgccgaggaagaaagcct

SEQ ID NO: 566144 - DNA, 25 bp, Rattus norvegicus
aacccaggtactgcttggagaagga

SEQ ID NO: 566145 - DNA, 25 bp, Rattus norvegicus
gaaggcacccgactccatcggggca

SEQ ID NO: 566146 - DNA, 25 bp, Rattus norvegicus
cacaaaaggtaccactgctgtgggg

SEQ ID NO: 566147 - DNA, 25 bp, Rattus norvegicus
ccgctctgcacaaaaggtaccactg

SEQ ID NO: 566148 - DNA, 25 bp, Rattus norvegicus
ccttattacccattcagcaggccgg

SEQ ID NO: 566149 - DNA, 25 bp, Rattus norvegicus
tgctaggaagatggcgcacccggca

SEQ ID NO: 566150 - DNA, 25 bp, Rattus norvegicus
tgctctcagtgcagcaggtaccggc

SEQ ID NO: 566151 - DNA, 25 bp, Rattus norvegicus
gcctctgctctcagtgcagcaggta

SEQ ID NO: 566152 - DNA, 25 bp, Rattus norvegicus
tggtggcagcgcctctgctctcagt

SEQ ID NO: 566153 - DNA, 25 bp, Rattus norvegicus
gcacccggcaatgttccctcgaagg

SEQ ID NO: 566154 - DNA, 25 bp, Rattus norvegicus
tgcagacattagtgctaggaagatg

SEQ ID NO: 566155 - DNA, 25 bp, Rattus norvegicus
gccgctgctgcagacattagtgcta

SEQ ID NO: 566156 - DNA, 25 bp, Rattus norvegicus
ccgccagagtccaccgccgcggcgg

SEQ ID NO: 566157 - DNA, 25 bp, Rattus norvegicus
agcacaatgcaccagccgccagagt

SEQ ID NO: 566158 - DNA, 25 bp, Rattus norvegicus
aaggaaattgcactcgcctcctccg

SEQ ID NO: 566159 - DNA, 25 bp, Rattus norvegicus
tacggtgcagaaggaaattgcactc

SEQ ID NO: 566160 - DNA, 25 bp, Rattus norvegicus
ctccatacaaagattacggtgcaga

SEQ ID NO: 566161 - DNA, 25 bp, Rattus norvegicus
ctccggcttctccatacaaagatta

SEQ ID NO: 566162 - DNA, 25 bp, Rattus norvegicus
aatgttccctcgaaggggcagcggt

SEQ ID NO: 566163 - DNA, 25 bp, Rattus norvegicus
agccgagtcggattgagctgctgca

SEQ ID NO: 566164 - DNA, 25 bp, Rattus norvegicus
tccagccagcactgccgttttcacg

SEQ ID NO: 566165 - DNA, 25 bp, Rattus norvegicus
cagacgccaggccactccagccagc

SEQ ID NO: 566166 - DNA, 25 bp, Rattus norvegicus
accgtgtgctttcagggaccctgac

SEQ ID NO: 566167 - DNA, 25 bp, Rattus norvegicus
ctcctctagaggagtggagccggca

SEQ ID NO: 566168 - DNA, 25 bp, Rattus norvegicus
cccgcctatatgtggcgctggggcc

SEQ ID NO: 566169 - DNA, 25 bp, Rattus norvegicus
agcctcggaggagttggcgcccaac

SEQ ID NO: 566170 - DNA, 25 bp, Rattus norvegicus
taagcgtgcgggcaccgtgtgcttt

SEQ ID NO: 566171 - DNA, 25 bp, Rattus norvegicus
acggggtctgactcccttagatgta

SEQ ID NO: 566172 - DNA, 25 bp, Rattus norvegicus
ccgctttggagacggggtctgactc

SEQ ID NO: 566173 - DNA, 25 bp, Rattus norvegicus
cctgacgcaagcctcggaggagttg

SEQ ID NO: 566174 - DNA, 25 bp, Rattus norvegicus
ccttagatgtaagcgtgcgggcacc

SEQ ID NO: 566175 - DNA, 25 bp, Rattus norvegicus
tgtgctttcagggaccctgacgcaa

SEQ ID NO: 566176 - DNA, 25 bp, Rattus norvegicus
tctgactcccttagatgtaagcgtg

SEQ ID NO: 566177 - DNA, 25 bp, Rattus norvegicus
cgcgcggacggaagtaatctctcat

SEQ ID NO: 566178 - DNA, 25 bp, Rattus norvegicus
ccacctgcaaggatggccgggatga

SEQ ID NO: 566179 - DNA, 25 bp, Rattus norvegicus
tctcgactcccacctgcaaggatgg

SEQ ID NO: 566180 - DNA, 25 bp, Rattus norvegicus
gcgcttggagatgctctcgactccc

SEQ ID NO: 566181 - DNA, 25 bp, Rattus norvegicus
ccaccatggcttgggcgcttggaga

SEQ ID NO: 566182 - DNA, 25 bp, Rattus norvegicus
gctgtttggccaccatggcttgggc

SEQ ID NO: 566183 - DNA, 25 bp, Rattus norvegicus
acggaagtaatctctcatctcagga

SEQ ID NO: 566184 - DNA, 25 bp, Rattus norvegicus
gttagccatccggatccgctgtttg

SEQ ID NO: 566185 - DNA, 25 bp, Rattus norvegicus
gctacctaccctacgcggccaccga

SEQ ID NO: 566186 - DNA, 25 bp, Rattus norvegicus
tccggatccgctgtttggccaccat

SEQ ID NO: 566187 - DNA, 25 bp, Rattus norvegicus
cgacttcctcgccatccttccggtc

SEQ ID NO: 566188 - DNA, 25 bp, Rattus norvegicus
tgtccgggtcctgagatcgaacgct

SEQ ID NO: 566189 - DNA, 25 bp, Rattus norvegicus
cctgagatcgaacgctgcggggcat

SEQ ID NO: 566190 - DNA, 25 bp, Rattus norvegicus
taatctctcatctcaggaaaccctc

SEQ ID NO: 566191 - DNA, 25 bp, Rattus norvegicus
aggctgcagtctagcccggtctggc

SEQ ID NO: 566192 - DNA, 25 bp, Rattus norvegicus
gaaactttcctctctgcccgatctg

SEQ ID NO: 566193 - DNA, 25 bp, Rattus norvegicus
tctggcgcgggccagaaactttcct

SEQ ID NO: 566194 - DNA, 25 bp, Rattus norvegicus
cttggcgttctccactctggcgcgg

SEQ ID NO: 566195 - DNA, 25 bp, Rattus norvegicus
gtcctcctcctgtcttgcatagcat

SEQ ID NO: 566196 - DNA, 25 bp, Rattus norvegicus
gttgttcccgtctttccacactgtc

SEQ ID NO: 566197 - DNA, 25 bp, Rattus norvegicus
cgttctttttatcgctggccggcca

SEQ ID NO: 566198 - DNA, 25 bp, Rattus norvegicus
gcgccctggacagagtccggcagaa

SEQ ID NO: 566199 - DNA, 25 bp, Rattus norvegicus
ccgatctgcgcgaggtactattgtt

SEQ ID NO: 566200 - DNA, 25 bp, Rattus norvegicus
acacaggcttctagccgccacgggg

SEQ ID NO: 566201 - DNA, 25 bp, Rattus norvegicus
gggcgctgctactcacacaggcttc

SEQ ID NO: 566202 - DNA, 25 bp, Rattus norvegicus
gcgacgaattttgcctcggtcccta

SEQ ID NO: 566203 - DNA, 25 bp, Rattus norvegicus
agacaggcggcccatccttcctagg

SEQ ID NO: 566204 - DNA, 25 bp, Rattus norvegicus
cccacacagatgttctccgttcttt

SEQ ID NO: 566205 - DNA, 25 bp, Rattus norvegicus
ctcgtcggcactgatcgtacagatg

SEQ ID NO: 566206 - DNA, 25 bp, Rattus norvegicus
tacagatgtgttcccttacccgtcg

SEQ ID NO: 566207 - DNA, 25 bp, Rattus norvegicus
cccgtcggcactgatcgtacagatg

SEQ ID NO: 566208 - DNA, 25 bp, Rattus norvegicus
agatgtgttcccttacccgtcggca

SEQ ID NO: 566209 - DNA, 25 bp, Rattus norvegicus
agatgtgttcccttactcgtcggca

SEQ ID NO: 566210 - DNA, 25 bp, Rattus norvegicus
gtacagatgtgttcccttacccgtc

SEQ ID NO: 566211 - DNA, 25 bp, Rattus norvegicus
cttacccgtcggcactgatcgtaca

SEQ ID NO: 566212 - DNA, 25 bp, Rattus norvegicus
cagatgtgttcccttacccgtcggc

SEQ ID NO: 566213 - DNA, 25 bp, Rattus norvegicus
cgtcggcactgatcgtacagatgtg

SEQ ID NO: 566214 - DNA, 25 bp, Rattus norvegicus
gttcccttactcgtcggcactgatc

SEQ ID NO: 566215 - DNA, 25 bp, Rattus norvegicus
gtgttcccttactcgtcggcactga

SEQ ID NO: 566216 - DNA, 25 bp, Rattus norvegicus
cagatgtgttcccttactcgtcggc

SEQ ID NO: 566217 - DNA, 25 bp, Rattus norvegicus
ctgatcgtacagatgtgttccctta

SEQ ID NO: 566218 - DNA, 25 bp, Rattus norvegicus
ttcccttactcgtcggcactgatcg

SEQ ID NO: 566219 - DNA, 25 bp, Rattus norvegicus
tcagtcattctttccgccagctgtg

SEQ ID NO: 566220 - DNA, 25 bp, Rattus norvegicus
ttctttccgccagctgtgcacgcga

SEQ ID NO: 566221 - DNA, 25 bp, Rattus norvegicus
cgccagctgtgcacgcgacctagga

SEQ ID NO: 566222 - DNA, 25 bp, Rattus norvegicus
tgtgcacgcgacctaggaggagccc

SEQ ID NO: 566223 - DNA, 25 bp, Rattus norvegicus
gagcccggaccgcacagtgtaggtc

SEQ ID NO: 566224 - DNA, 25 bp, Rattus norvegicus
cgcacagtgtaggtccgtccgtcac

SEQ ID NO: 566225 - DNA, 25 bp, Rattus norvegicus
taggtccgtccgtcacggcgcggtc

SEQ ID NO: 566226 - DNA, 25 bp, Rattus norvegicus
cggtcctgccctccgactcaccgcg

SEQ ID NO: 566227 - DNA, 25 bp, Rattus norvegicus
tgagctgcagcctcggggaacgaac

SEQ ID NO: 566228 - DNA, 25 bp, Rattus norvegicus
ccagagtcgcccgaagcggtccgcc

SEQ ID NO: 566229 - DNA, 25 bp, Rattus norvegicus
cgccgctcagcagttccgggtcaga

SEQ ID NO: 566230 - DNA, 25 bp, Rattus norvegicus
cgctcagcagttccgggtcagagcc

SEQ ID NO: 566231 - DNA, 25 bp, Rattus norvegicus
agggaagaagcgtccctcctccctg

SEQ ID NO: 566232 - DNA, 25 bp, Rattus norvegicus
ggcacgggcgccctcagtcattctt

SEQ ID NO: 566233 - DNA, 25 bp, Rattus norvegicus
catggattcctccgcatggattcct

SEQ ID NO: 566234 - DNA, 25 bp, Rattus norvegicus
gcatggattcctccgcatggactcc

SEQ ID NO: 566235 - DNA, 25 bp, Rattus norvegicus
tggattcctccgcatggactcctcc

SEQ ID NO: 566236 - DNA, 25 bp, Rattus norvegicus
tggactcctccgcatggactcctcc

SEQ ID NO: 566237 - DNA, 25 bp, Rattus norvegicus
atggactcctccgcatggactcctc

SEQ ID NO: 566238 - DNA, 25 bp, Rattus norvegicus
ggactcctccgcatggactcctccg

SEQ ID NO: 566239 - DNA, 25 bp, Rattus norvegicus
gcatggactcctccgcatggattcc

SEQ ID NO: 566240 - DNA, 25 bp, Rattus norvegicus
tggattcctccgcatggattcctcc

SEQ ID NO: 566241 - DNA, 25 bp, Rattus norvegicus
atggattcctccgcatggactcctc

SEQ ID NO: 566242 - DNA, 25 bp, Rattus norvegicus
catggactcctccgcatggactcct

SEQ ID NO: 566243 - DNA, 25 bp, Rattus norvegicus
gcatggactcctccgcatggactcc

SEQ ID NO: 566244 - DNA, 25 bp, Rattus norvegicus
atggattcctccgcatggattcctc

SEQ ID NO: 566245 - DNA, 25 bp, Rattus norvegicus
gcatggattcctccgcatggattcc

SEQ ID NO: 566246 - DNA, 25 bp, Rattus norvegicus
atggactcctccgcatggattcctc

SEQ ID NO: 566247 - DNA, 25 bp, Rattus norvegicus
tagcagttcagggactccgaggacg

SEQ ID NO: 566248 - DNA, 25 bp, Rattus norvegicus
gcagactcaccgctgtgtggtcgat

SEQ ID NO: 566249 - DNA, 25 bp, Rattus norvegicus
actcaccgctgtgtggtcgatgtcg

SEQ ID NO: 566250 - DNA, 25 bp, Rattus norvegicus
gtattcggcgtagcgcagcccctct

SEQ ID NO: 566251 - DNA, 25 bp, Rattus norvegicus
gccgccaccggtagccatagcagtt

SEQ ID NO: 566252 - DNA, 25 bp, Rattus norvegicus
aacttcgcattcagggcagacgtcc

SEQ ID NO: 566253 - DNA, 25 bp, Rattus norvegicus
agccatagcagttcagggactccga

SEQ ID NO: 566254 - DNA, 25 bp, Rattus norvegicus
tccgaggacgcgctgagttgactac

SEQ ID NO: 566255 - DNA, 25 bp, Rattus norvegicus
gctgagttgactacgaggcgtccgc

SEQ ID NO: 566256 - DNA, 25 bp, Rattus norvegicus
tccgcggggacaaactagtgcggac

SEQ ID NO: 566257 - DNA, 25 bp, Rattus norvegicus
tgcggacgggttaacttcgcattca

SEQ ID NO: 566258 - DNA, 25 bp, Rattus norvegicus
agcctctgggcttaagcgaggcgcc

SEQ ID NO: 566259 - DNA, 25 bp, Rattus norvegicus
acgggttaacttcgcattcagggca

SEQ ID NO: 566260 - DNA, 25 bp, Rattus norvegicus
accggtagccatagcagttcaggga

SEQ ID NO: 566261 - DNA, 25 bp, Rattus norvegicus
gcgcaggtacttgccgtagtctcgg

SEQ ID NO: 566262 - DNA, 25 bp, Rattus norvegicus
ctgaaggcgcgggatgcagcggacc

SEQ ID NO: 566263 - DNA, 25 bp, Rattus norvegicus
cagcggaccctcgtgtgggacgcca

SEQ ID NO: 566264 - DNA, 25 bp, Rattus norvegicus
accctcgtgtgggacgccagggcaa

SEQ ID NO: 566265 - DNA, 25 bp, Rattus norvegicus
gggacgccagggcaactgcccatct

SEQ ID NO: 566266 - DNA, 25 bp, Rattus norvegicus
cgccgccgagcagactcccggccag

SEQ ID NO: 566267 - DNA, 25 bp, Rattus norvegicus
gctccgcgatcgctctctcccttcc

SEQ ID NO: 566268 - DNA, 25 bp, Rattus norvegicus
agccgcgcaggtacttgccgtagtc

SEQ ID NO: 566269 - DNA, 25 bp, Rattus norvegicus
gcgctggagccggtgctgaaggcgc

SEQ ID NO: 566270 - DNA, 25 bp, Rattus norvegicus
ggtacttgccgtagtctcggctggc

SEQ ID NO: 566271 - DNA, 25 bp, Rattus norvegicus
ccaggaacatgaagcgggaggcggc

SEQ ID NO: 566272 - DNA, 25 bp, Rattus norvegicus
caggtacttgccgtagtctcggctg

SEQ ID NO: 566273 - DNA, 25 bp, Rattus norvegicus
agggcaactgcccatctcctccgag

SEQ ID NO: 566274 - DNA, 25 bp, Rattus norvegicus
gagttcgggcgccctgctccgcgat

SEQ ID NO: 566275 - DNA, 25 bp, Rattus norvegicus
cttcctgcctaggatggcaaagtag

SEQ ID NO: 566276 - DNA, 25 bp, Rattus norvegicus
actcggacctctggtccgcatgcgg

SEQ ID NO: 566277 - DNA, 25 bp, Rattus norvegicus
cacactgcccgccagactccactcg

SEQ ID NO: 566278 - DNA, 25 bp, Rattus norvegicus
catcgtcaccctccggcagcagtcg

SEQ ID NO: 566279 - DNA, 25 bp, Rattus norvegicus
ttcatcgtcaccctccggcagcagt

SEQ ID NO: 566280 - DNA, 25 bp, Rattus norvegicus
gagctttcatcgtcaccctccggca

SEQ ID NO: 566281 - DNA, 25 bp, Rattus norvegicus
gctgagctttcatcgtcaccctccg

SEQ ID NO: 566282 - DNA, 25 bp, Rattus norvegicus
cctgcctaggatggcaaagtagagg

SEQ ID NO: 566283 - DNA, 25 bp, Rattus norvegicus
ttcctgcctaggatggcaaagtaga

SEQ ID NO: 566284 - DNA, 25 bp, Rattus norvegicus
tcttcctgcctaggatggcaaagta

SEQ ID NO: 566285 - DNA, 25 bp, Rattus norvegicus
catcttcctgcctaggatggcaaag

SEQ ID NO: 566286 - DNA, 25 bp, Rattus norvegicus
ctaaaacgcagaccccaccagcctc

SEQ ID NO: 566287 - DNA, 25 bp, Rattus norvegicus
tcctgcctaggatggcaaagtagag

SEQ ID NO: 566288 - DNA, 25 bp, Rattus norvegicus
tcatcttcctgcctaggatggcaaa

SEQ ID NO: 566289 - DNA, 25 bp, Rattus norvegicus
gaggcaccctctccattggccgggt

SEQ ID NO: 566290 - DNA, 25 bp, Rattus norvegicus
cagcggtatctgaggttagggcaac

SEQ ID NO: 566291 - DNA, 25 bp, Rattus norvegicus
agcctctcagttcccgggcatgtca

SEQ ID NO: 566292 - DNA, 25 bp, Rattus norvegicus
ggaaaaaatcttcccacgtgctctg

SEQ ID NO: 566293 - DNA, 25 bp, Rattus norvegicus
ttcccacgtgctctggagggcaaag

SEQ ID NO: 566294 - DNA, 25 bp, Rattus norvegicus
tgacagcgatgcaaacagcggtatc

SEQ ID NO: 566295 - DNA, 25 bp, Rattus norvegicus
cgtcacgtgacgtggaggcaccctc

SEQ ID NO: 566296 - DNA, 25 bp, Rattus norvegicus
tgctgcggaggacaaagtgcactgt

SEQ ID NO: 566297 - DNA, 25 bp, Rattus norvegicus
gtgggagctttaaacccgaagctga

SEQ ID NO: 566298 - DNA, 25 bp, Rattus norvegicus
agctgacctacgaactctccgctga

SEQ ID NO: 566299 - DNA, 25 bp, Rattus norvegicus
gaactctccgctgacgtcttgcgcg

SEQ ID NO: 566300 - DNA, 25 bp, Rattus norvegicus
cttcctggtgcgttgccttgggaac

SEQ ID NO: 566301 - DNA, 25 bp, Rattus norvegicus
caaagctgcgggtcgcccgtcacgt

SEQ ID NO: 566302 - DNA, 25 bp, Rattus norvegicus
gccgagcccgcgcaaaaggaacaag

SEQ ID NO: 566303 - DNA, 25 bp, Rattus norvegicus
gggatctcccggagcgttccctcta

SEQ ID NO: 566304 - DNA, 25 bp, Rattus norvegicus
cggatacaagtgcacgggatctccc

SEQ ID NO: 566305 - DNA, 25 bp, Rattus norvegicus
ctgtggtcagttgctgggctctgcc

SEQ ID NO: 566306 - DNA, 25 bp, Rattus norvegicus
agcctcaccttggtccggatctgtc

SEQ ID NO: 566307 - DNA, 25 bp, Rattus norvegicus
ccggatctgtccagaggtggacact

SEQ ID NO: 566308 - DNA, 25 bp, Rattus norvegicus
ggtggacactttacggatcagcttc

SEQ ID NO: 566309 - DNA, 25 bp, Rattus norvegicus
acggatcagcttctggggtccctcc

SEQ ID NO: 566310 - DNA, 25 bp, Rattus norvegicus
gcttcactgtcggacgaatcctctc

SEQ ID NO: 566311 - DNA, 25 bp, Rattus norvegicus
ggacgaatcctctccgggtcctgca

SEQ ID NO: 566312 - DNA, 25 bp, Rattus norvegicus
ggccatcctctctgattcctgcagg

SEQ ID NO: 566313 - DNA, 25 bp, Rattus norvegicus
cctctctgattcctgcagggacaca

SEQ ID NO: 566314 - DNA, 25 bp, Rattus norvegicus
ttgctgggctctgcccgagcgtccg

SEQ ID NO: 566315 - DNA, 25 bp, Rattus norvegicus
ctgctccgcttcactgtcggacgaa

SEQ ID NO: 566316 - DNA, 25 bp, Rattus norvegicus
cccttctccggatacaagtgcacgg

SEQ ID NO: 566317 - DNA, 25 bp, Rattus norvegicus
cgccgcaccacactcgggaatgaag

SEQ ID NO: 566318 - DNA, 25 bp, Rattus norvegicus
caggccttataaggcgcggaaccga

SEQ ID NO: 566319 - DNA, 25 bp, Rattus norvegicus
ctgggcgcacgtgctgcggctccat

SEQ ID NO: 566320 - DNA, 25 bp, Rattus norvegicus
gcgcggtattttttggctcctccca

SEQ ID NO: 566321 - DNA, 25 bp, Rattus norvegicus
cggaccgcttcctgaacggaacctg

SEQ ID NO: 566322 - DNA, 25 bp, Rattus norvegicus
aagcagctggggacctcatcccgga

SEQ ID NO: 566323 - DNA, 25 bp, Rattus norvegicus
tgccgaccggacaaaggctctccgg

SEQ ID NO: 566324 - DNA, 25 bp, Rattus norvegicus
ggaagagctcctgccgaccggacaa

SEQ ID NO: 566325 - DNA, 25 bp, Rattus norvegicus
ggtcctcgaaagaccgtcgccagag

SEQ ID NO: 566326 - DNA, 25 bp, Rattus norvegicus
tgaagcgcggaaacggtcctcgaaa

SEQ ID NO: 566327 - DNA, 25 bp, Rattus norvegicus
tgcaaagttgggaaaaggatgaagc

SEQ ID NO: 566328 - DNA, 25 bp, Rattus norvegicus
cactcgggaatgaagtgcaaagttg

SEQ ID NO: 566329 - DNA, 25 bp, Rattus norvegicus
caggcggcagacctcgggaacctgc

SEQ ID NO: 566330 - DNA, 25 bp, Rattus norvegicus
taaggcgcggaaccgaaagcggcca

SEQ ID NO: 566331 - DNA, 25 bp, Rattus norvegicus
cccggtggccgatcttaccggctgg

SEQ ID NO: 566332 - DNA, 25 bp, Rattus norvegicus
gtgaccacgcctggggcggtgcgct

SEQ ID NO: 566333 - DNA, 25 bp, Rattus norvegicus
gtggccgatcttaccggctggcgct

SEQ ID NO: 566334 - DNA, 25 bp, Rattus norvegicus
tggccgatcttaccggctggcgctg

SEQ ID NO: 566335 - DNA, 25 bp, Rattus norvegicus
gggcccacacggccgagcccagcgc

SEQ ID NO: 566336 - DNA, 25 bp, Rattus norvegicus
gcctcccagccgcttcctgtcccgc

SEQ ID NO: 566337 - DNA, 25 bp, Rattus norvegicus
agccgcttcctgtcccgcttgccga

SEQ ID NO: 566338 - DNA, 25 bp, Rattus norvegicus
tcccgcttgccgaccggctcctgcc

SEQ ID NO: 566339 - DNA, 25 bp, Rattus norvegicus
ccctggaggtcccactccgtgcctc

SEQ ID NO: 566340 - DNA, 25 bp, Rattus norvegicus
tccgtgcctcctgcactatgcagtc

SEQ ID NO: 566341 - DNA, 25 bp, Rattus norvegicus
ctgcactatgcagtcccgcctcctc

SEQ ID NO: 566342 - DNA, 25 bp, Rattus norvegicus
tgcggctgcttctgcggcaggtgct

SEQ ID NO: 566343 - DNA, 25 bp, Rattus norvegicus
ctgcttctgcggcaggtgctgcggg

SEQ ID NO: 566344 - DNA, 25 bp, Rattus norvegicus
gcgtccctggggtgaccacgcctgg

SEQ ID NO: 566345 - DNA, 25 bp, Rattus norvegicus
aagcctacaagtcatgcgggagccc

SEQ ID NO: 566346 - DNA, 25 bp, Rattus norvegicus
acgctttcgtgactcctagggatgg

SEQ ID NO: 566347 - DNA, 25 bp, Rattus norvegicus
aacgctcaggcagacgctttcgtga

SEQ ID NO: 566348 - DNA, 25 bp, Rattus norvegicus
gacttggcagccacgaatgacgtca

SEQ ID NO: 566349 - DNA, 25 bp, Rattus norvegicus
ccgcctgcggtagccatgatgaaaa

SEQ ID NO: 566350 - DNA, 25 bp, Rattus norvegicus
ggaaacagagcttaacgtgacacgc

SEQ ID NO: 566351 - DNA, 25 bp, Rattus norvegicus
cgtgacacgctttaacaatacgaga

SEQ ID NO: 566352 - DNA, 25 bp, Rattus norvegicus
ccttacagcggcctttgaaacaata

SEQ ID NO: 566353 - DNA, 25 bp, Rattus norvegicus
gccgcatgctgagcgatcgctgatt

SEQ ID NO: 566354 - DNA, 25 bp, Rattus norvegicus
tctccacggatagtcgagcgaactg

SEQ ID NO: 566355 - DNA, 25 bp, Rattus norvegicus
agctcagttggggtttctttagaag

SEQ ID NO: 566356 - DNA, 25 bp, Rattus norvegicus
gaactgatgcgccatacccggctcg

SEQ ID NO: 566357 - DNA, 25 bp, Rattus norvegicus
caacgggttccagtaccttacagcg

SEQ ID NO: 566358 - DNA, 25 bp, Rattus norvegicus
aatgacgtcacgcacaacttggccg

SEQ ID NO: 566359 - DNA, 25 bp, Rattus norvegicus
tatcttggcgctcgtagtccacctg

SEQ ID NO: 566360 - DNA, 25 bp, Rattus norvegicus
agcctaaagtgctcgtgcccgtaga

SEQ ID NO: 566361 - DNA, 25 bp, Rattus norvegicus
tcaccaccaggtagctgccagcata

SEQ ID NO: 566362 - DNA, 25 bp, Rattus norvegicus
ctgagacgtaagtggacacggcttc

SEQ ID NO: 566363 - DNA, 25 bp, Rattus norvegicus
cggccaccagcgtcaggttgtactc

SEQ ID NO: 566364 - DNA, 25 bp, Rattus norvegicus
ctcggatgcgcacgatgaccttgca

SEQ ID NO: 566365 - DNA, 25 bp, Rattus norvegicus
ggagcgttgtcattctcgtcaccca

SEQ ID NO: 566366 - DNA, 25 bp, Rattus norvegicus
tgttttcgcggactgacacctcgta

SEQ ID NO: 566367 - DNA, 25 bp, Rattus norvegicus
ctaccagccggtaggtgacctgacc

SEQ ID NO: 566368 - DNA, 25 bp, Rattus norvegicus
gggcgccaaaggtgaacacaacgtc

SEQ ID NO: 566369 - DNA, 25 bp, Rattus norvegicus
gcacgtccagctcataggtatcttg

SEQ ID NO: 566370 - DNA, 25 bp, Rattus norvegicus
tgttccagacccagccgacgaggct

SEQ ID NO: 566371 - DNA, 25 bp, Rattus norvegicus
gccgggctatggtcattggcatcta

SEQ ID NO: 566372 - DNA, 25 bp, Rattus norvegicus
agcgttgtcgttgacgtctcggatg

SEQ ID NO: 566373 - DNA, 25 bp, Rattus norvegicus
cacagctccacaatggccgcgtttt

SEQ ID NO: 566374 - DNA, 25 bp, Rattus norvegicus
cgcctggttaccatgccaaaaggtc

SEQ ID NO: 566375 - DNA, 25 bp, Rattus norvegicus
gttttagcaacttcgcccgcaactg

SEQ ID NO: 566376 - DNA, 25 bp, Rattus norvegicus
aaaagctgccctgatcgcctggtta

SEQ ID NO: 566377 - DNA, 25 bp, Rattus norvegicus
aaggacgatttaaagcggtcactgc

SEQ ID NO: 566378 - DNA, 25 bp, Rattus norvegicus
gccgcccgcgttcgctagataatgg

SEQ ID NO: 566379 - DNA, 25 bp, Rattus norvegicus
tgtgaatcggtgctcaccggcctgg

SEQ ID NO: 566380 - DNA, 25 bp, Rattus norvegicus
aggactggtgtgagcactgtgaatc

SEQ ID NO: 566381 - DNA, 25 bp, Rattus norvegicus
cggtcactgcaactcccggtggaaa

SEQ ID NO: 566382 - DNA, 25 bp, Rattus norvegicus
gccgcgttttctcgagatgcaaatg

SEQ ID NO: 566383 - DNA, 25 bp, Rattus norvegicus
gggtttctgtcaccgcgcctaatgc

SEQ ID NO: 566384 - DNA, 25 bp, Rattus norvegicus
ctcccggtggaaaagaaatgcctag

SEQ ID NO: 566385 - DNA, 25 bp, Rattus norvegicus
tattgtgaagctcgcgtgcagacct

SEQ ID NO: 566386 - DNA, 25 bp, Rattus norvegicus
gcctaatgccggtattgtgaagctc

SEQ ID NO: 566387 - DNA, 25 bp, Rattus norvegicus
tgggacctctggcaccctctcggga

SEQ ID NO: 566388 - DNA, 25 bp, Rattus norvegicus
accctctcgggagaaaggtgcgcct

SEQ ID NO: 566389 - DNA, 25 bp, Rattus norvegicus
tctggcaccctctcgggagaaaggt

SEQ ID NO: 566390 - DNA, 25 bp, Rattus norvegicus
gtgcgcagaagctgcggttgcaatc

SEQ ID NO: 566391 - DNA, 25 bp, Rattus norvegicus
taagcaaaggctcagaggtggctcc

SEQ ID NO: 566392 - DNA, 25 bp, Rattus norvegicus
tcaccctaagcaaaggctcagaggt

SEQ ID NO: 566393 - DNA, 25 bp, Rattus norvegicus
tcgggagaaaggtgcgcctcaccct

SEQ ID NO: 566394 - DNA, 25 bp, Rattus norvegicus
acctctggcaccctctcgggagaaa

SEQ ID NO: 566395 - DNA, 25 bp, Rattus norvegicus
ttctcggcaggtggaaagaaccgcg

SEQ ID NO: 566396 - DNA, 25 bp, Rattus norvegicus
gctctggtttctcggcaggtggaaa

SEQ ID NO: 566397 - DNA, 25 bp, Rattus norvegicus
aacagctctggtttctcggcaggtg

SEQ ID NO: 566398 - DNA, 25 bp, Rattus norvegicus
cgccgccaggctcggaagaacagct

SEQ ID NO: 566399 - DNA, 25 bp, Rattus norvegicus
aaaggtgcgcctcaccctaagcaaa

SEQ ID NO: 566400 - DNA, 25 bp, Rattus norvegicus
ggctcggaagaacagctctggtttc

SEQ ID NO: 566401 - DNA, 25 bp, Rattus norvegicus
ctacgcgataaagggaggcggcacc

SEQ ID NO: 566402 - DNA, 25 bp, Rattus norvegicus
aagccctctgtgtcggcctttttca

SEQ ID NO: 566403 - DNA, 25 bp, Rattus norvegicus
cggcccaagaggatttccaagccct

SEQ ID NO: 566404 - DNA, 25 bp, Rattus norvegicus
cctcggatatgctccagctggagta

SEQ ID NO: 566405 - DNA, 25 bp, Rattus norvegicus
aagtctttctacgacgcgcgtctgc

SEQ ID NO: 566406 - DNA, 25 bp, Rattus norvegicus
tcctggcacagctcaagtctttcta

SEQ ID NO: 566407 - DNA, 25 bp, Rattus norvegicus
cgcgtctgctgtgcgatgtgaccat

SEQ ID NO: 566408 - DNA, 25 bp, Rattus norvegicus
agtacgtgcgtgaagcctgtgcttc

SEQ ID NO: 566409 - DNA, 25 bp, Rattus norvegicus
aggccaatgtgcagcgcctgtacgc

SEQ ID NO: 566410 - DNA, 25 bp, Rattus norvegicus
tggactactgctacactggccgcgt

SEQ ID NO: 566411 - DNA, 25 bp, Rattus norvegicus
ccttcgaggtcttggtggactactg

SEQ ID NO: 566412 - DNA, 25 bp, Rattus norvegicus
tacttcaagagcatgttcacagggg

SEQ ID NO: 566413 - DNA, 25 bp, Rattus norvegicus
cttctcgtgcaaccgcaacgtgctg

SEQ ID NO: 566414 - DNA, 25 bp, Rattus norvegicus
aattaaaggacacggcccattctgc

SEQ ID NO: 566415 - DNA, 25 bp, Rattus norvegicus
acttttccaggcactcgggaggtga

SEQ ID NO: 566416 - DNA, 25 bp, Rattus norvegicus
ctatgcgggaggagtttcgctttcc

SEQ ID NO: 566417 - DNA, 25 bp, Rattus norvegicus
gcgttcggttgagtttgtgagcaaa

SEQ ID NO: 566418 - DNA, 25 bp, Rattus norvegicus
ctggttaacttcagcgtctgcgttc

SEQ ID NO: 566419 - DNA, 25 bp, Rattus norvegicus
ttgctttctagtggctctggttaac

SEQ ID NO: 566420 - DNA, 25 bp, Rattus norvegicus
ctcgactttggacgaactggttttg

SEQ ID NO: 566421 - DNA, 25 bp, Rattus norvegicus
tgctcgtagtagcacttcccatatg

SEQ ID NO: 566422 - DNA, 25 bp, Rattus norvegicus
tgatgattaactcgggcctcgcctt

SEQ ID NO: 566423 - DNA, 25 bp, Rattus norvegicus
gcggtagcatcgctgacgctagtca

SEQ ID NO: 566424 - DNA, 25 bp, Rattus norvegicus
gggcttcgcctcagaactttccagg

SEQ ID NO: 566425 - DNA, 25 bp, Rattus norvegicus
agcccggacctgacggctgagaaag

SEQ ID NO: 566426 - DNA, 25 bp, Rattus norvegicus
cacccagaagggacgaaagcgcgac

SEQ ID NO: 566427 - DNA, 25 bp, Rattus norvegicus
cccggtatgggaacagtatagcttt

SEQ ID NO: 566428 - DNA, 25 bp, Rattus norvegicus
cacttcccatatggtctagcggtta

SEQ ID NO: 566429 - DNA, 25 bp, Rattus norvegicus
cggactcagctagtcaatgactcta

SEQ ID NO: 566430 - DNA, 25 bp, Rattus norvegicus
tagagtcagtcagcaagagacgctg

SEQ ID NO: 566431 - DNA, 25 bp, Rattus norvegicus
cgtgaggtgaatagagtcagtcagc

SEQ ID NO: 566432 - DNA, 25 bp, Rattus norvegicus
atcaatgtttaagcggcggcgtgag

SEQ ID NO: 566433 - DNA, 25 bp, Rattus norvegicus
tcagtatcaatgtttaagcggcggc

SEQ ID NO: 566434 - DNA, 25 bp, Rattus norvegicus
gcagagaatcagtatcaatgtttaa

SEQ ID NO: 566435 - DNA, 25 bp, Rattus norvegicus
acgccgattggctggcagagaatca

SEQ ID NO: 566436 - DNA, 25 bp, Rattus norvegicus
tgcgggcctagatgctctccggtcg

SEQ ID NO: 566437 - DNA, 25 bp, Rattus norvegicus
cctaccgtttctccgcctcccattg

SEQ ID NO: 566438 - DNA, 25 bp, Rattus norvegicus
tccggtcggactcagctagtcaatg

SEQ ID NO: 566439 - DNA, 25 bp, Rattus norvegicus
ctagtcaatgactctaaagctccgg

SEQ ID NO: 566440 - DNA, 25 bp, Rattus norvegicus
agacgctggggagagaatccggact

SEQ ID NO: 566441 - DNA, 25 bp, Rattus norvegicus
gatgctctccggtcggactcagcta

SEQ ID NO: 566442 - DNA, 25 bp, Rattus norvegicus
tgactctaaagctccggagctgctg

SEQ ID NO: 566443 - DNA, 25 bp, Rattus norvegicus
gtctgcccaatgcaccgggggccca

SEQ ID NO: 566444 - DNA, 25 bp, Rattus norvegicus
gcttggcaggaacccgctctgcaaa

SEQ ID NO: 566445 - DNA, 25 bp, Rattus norvegicus
gacggctctgtgcttggcaggaacc

SEQ ID NO: 566446 - DNA, 25 bp, Rattus norvegicus
agtacccgtacttgcggtagctggc

SEQ ID NO: 566447 - DNA, 25 bp, Rattus norvegicus
tgaggcgggcgggctagtacccgta

SEQ ID NO: 566448 - DNA, 25 bp, Rattus norvegicus
tgacggctctgtgcttggcaggaac

SEQ ID NO: 566449 - DNA, 25 bp, Rattus norvegicus
cttggcaggaacccgctctgcaaac

SEQ ID NO: 566450 - DNA, 25 bp, Rattus norvegicus
ggagggcgccctggaccgccacgtc

SEQ ID NO: 566451 - DNA, 25 bp, Rattus norvegicus
ctgacggctctgtgcttggcaggaa

SEQ ID NO: 566452 - DNA, 25 bp, Rattus norvegicus
cctgacggctctgtgcttggcagga

SEQ ID NO: 566453 - DNA, 25 bp, Rattus norvegicus
ccctgacggctctgtgcttggcagg

SEQ ID NO: 566454 - DNA, 25 bp, Rattus norvegicus
gggatccactcccttggcgggctcc

SEQ ID NO: 566455 - DNA, 25 bp, Rattus norvegicus
agcgcccgggatccactcccttggc

SEQ ID NO: 566456 - DNA, 25 bp, Rattus norvegicus
tgtctccccgggtggcttcgctttg

SEQ ID NO: 566457 - DNA, 25 bp, Rattus norvegicus
catggcctctttgcactggacgtca

SEQ ID NO: 566458 - DNA, 25 bp, Rattus norvegicus
ctccgctacggtgcagatcaatgtg

SEQ ID NO: 566459 - DNA, 25 bp, Rattus norvegicus
gtccagtcttcgaggctccatcgta

SEQ ID NO: 566460 - DNA, 25 bp, Rattus norvegicus
catcgtacttggtggaactgcccga

SEQ ID NO: 566461 - DNA, 25 bp, Rattus norvegicus
gtcattgatctgaacgccaccgatg

SEQ ID NO: 566462 - DNA, 25 bp, Rattus norvegicus
ccaccgatgctgatgaaggacccaa

SEQ ID NO: 566463 - DNA, 25 bp, Rattus norvegicus
cctgatccgcgttaagggcaacctg

SEQ ID NO: 566464 - DNA, 25 bp, Rattus norvegicus
tccagcccattgcaaggtcacagtc

SEQ ID NO: 566465 - DNA, 25 bp, Rattus norvegicus
taacgcgccgtccattggtttcgtc

SEQ ID NO: 566466 - DNA, 25 bp, Rattus norvegicus
tggcacagtcatcgccctagttcgg

SEQ ID NO: 566467 - DNA, 25 bp, Rattus norvegicus
gtccgctggaccgtgagacacaaga

SEQ ID NO: 566468 - DNA, 25 bp, Rattus norvegicus
ccttcgctgtcaagattctggatga

SEQ ID NO: 566469 - DNA, 25 bp, Rattus norvegicus
caaaggactgtacgtgctccaagta

SEQ ID NO: 566470 - DNA, 25 bp, Rattus norvegicus
cgacggcaccaagttcccagagcta

SEQ ID NO: 566471 - DNA, 25 bp, Rattus norvegicus
agactattcggagtactcgaaaacg

SEQ ID NO: 566472 - DNA, 25 bp, Rattus norvegicus
tcaaataggctgccgaactcgacct

SEQ ID NO: 566473 - DNA, 25 bp, Rattus norvegicus
ctcaaataggctgccgaactcgacc

SEQ ID NO: 566474 - DNA, 25 bp, Rattus norvegicus
actcaaataggctgccgaactcgac

SEQ ID NO: 566475 - DNA, 25 bp, Rattus norvegicus
tactcaaataggctgccgaactcga

SEQ ID NO: 566476 - DNA, 25 bp, Rattus norvegicus
caagattttaaacacggtcgtcagt

SEQ ID NO: 566477 - DNA, 25 bp, Rattus norvegicus
tcaagattttaaacacggtcgtcag

SEQ ID NO: 566478 - DNA, 25 bp, Rattus norvegicus
ttcaagattttaaacacggtcgtca

SEQ ID NO: 566479 - DNA, 25 bp, Rattus norvegicus
cacagtcgtcggttcaagattttaa

SEQ ID NO: 566480 - DNA, 25 bp, Rattus norvegicus
acacagtcgtcggttcaagatttta

SEQ ID NO: 566481 - DNA, 25 bp, Rattus norvegicus
cttctcgccctctaggcagtacaga

SEQ ID NO: 566482 - DNA, 25 bp, Rattus norvegicus
atgctcggcagactcaccttccggg

SEQ ID NO: 566483 - DNA, 25 bp, Rattus norvegicus
tcgcgacctgatctggggctatgct

SEQ ID NO: 566484 - DNA, 25 bp, Rattus norvegicus
atcgcccggcttcacagacagcaga

SEQ ID NO: 566485 - DNA, 25 bp, Rattus norvegicus
cacttaccaacttggggcgcttctc

SEQ ID NO: 566486 - DNA, 25 bp, Rattus norvegicus
gccgattaacagctctgaccttccg

SEQ ID NO: 566487 - DNA, 25 bp, Rattus norvegicus
agggaatcgaatcccgccctgtcgc

SEQ ID NO: 566488 - DNA, 25 bp, Rattus norvegicus
aatcccgcgccgtgcgactagtgac

SEQ ID NO: 566489 - DNA, 25 bp, Rattus norvegicus
tgattggcccttctgcctgtccatc

SEQ ID NO: 566490 - DNA, 25 bp, Rattus norvegicus
agcagagcattcgtcccagaaggga

SEQ ID NO: 566491 - DNA, 25 bp, Rattus norvegicus
gccctgtcgctgtgatctaagccga

SEQ ID NO: 566492 - DNA, 25 bp, Rattus norvegicus
ccttttccgggaatgccaacgcctg

SEQ ID NO: 566493 - DNA, 25 bp, Rattus norvegicus
attaaccgctgcacacggctgggcc

SEQ ID NO: 566494 - DNA, 25 bp, Rattus norvegicus
gctgggccaatacatccgaaatctc

SEQ ID NO: 566495 - DNA, 25 bp, Rattus norvegicus
ggctcgagttgcagtcttttgagtc

SEQ ID NO: 566496 - DNA, 25 bp, Rattus norvegicus
agggtgcctagctcacccatctgtc

SEQ ID NO: 566497 - DNA, 25 bp, Rattus norvegicus
cctaagtacaggattagggtgccta

SEQ ID NO: 566498 - DNA, 25 bp, Rattus norvegicus
agaaaaagcagttgtcacctccacc

SEQ ID NO: 566499 - DNA, 25 bp, Rattus norvegicus
atgcccagtggcacagtcgaacaga

SEQ ID NO: 566500 - DNA, 25 bp, Rattus norvegicus
tttttctgggtctccagcaggaggc

SEQ ID NO: 566501 - DNA, 25 bp, Rattus norvegicus
ggctcccgtgtgtgcaacttagaaa

SEQ ID NO: 566502 - DNA, 25 bp, Rattus norvegicus
taaacgtggccgtggtagcatcatc

SEQ ID NO: 566503 - DNA, 25 bp, Rattus norvegicus
cccatctgtcggctgggactcagag

SEQ ID NO: 566504 - DNA, 25 bp, Rattus norvegicus
atgggctgggctacaccgccctaaa

SEQ ID NO: 566505 - DNA, 25 bp, Rattus norvegicus
gccctgaccagaacaatcagctctg

SEQ ID NO: 566506 - DNA, 25 bp, Rattus norvegicus
ttttgagtctcagccgaccactagg

SEQ ID NO: 566507 - DNA, 25 bp, Rattus norvegicus
agcagctaaccatggccgaggtgtc

SEQ ID NO: 566508 - DNA, 25 bp, Rattus norvegicus
cggaagcgcccgtcgcactgagcat

SEQ ID NO: 566509 - DNA, 25 bp, Rattus norvegicus
cggaacaaggcgctgactgtctcta

SEQ ID NO: 566510 - DNA, 25 bp, Rattus norvegicus
cggggacctagattctcgccaccgg

SEQ ID NO: 566511 - DNA, 25 bp, Rattus norvegicus
ggtgcgattgcacccgagcgaaacc

SEQ ID NO: 566512 - DNA, 25 bp, Rattus norvegicus
tcctaccgagcttgccgcggcggag

SEQ ID NO: 566513 - DNA, 25 bp, Rattus norvegicus
ccagcatcttgcagtgcgggaggct

SEQ ID NO: 566514 - DNA, 25 bp, Rattus norvegicus
agctatcgagctcctaccgagcttg

SEQ ID NO: 566515 - DNA, 25 bp, Rattus norvegicus
ggctcgggagctatcgagctcctac

SEQ ID NO: 566516 - DNA, 25 bp, Rattus norvegicus
agagctgttttcaggacgcgcactg

SEQ ID NO: 566517 - DNA, 25 bp, Rattus norvegicus
ctagattctcgccaccgggtggtga

SEQ ID NO: 566518 - DNA, 25 bp, Rattus norvegicus
tcccgggagagctgttttcaggacg

SEQ ID NO: 566519 - DNA, 25 bp, Rattus norvegicus
aacgatcccggtcccgggagagctg

SEQ ID NO: 566520 - DNA, 25 bp, Rattus norvegicus
gccgcgaaaacctggagaaacgatc

SEQ ID NO: 566521 - DNA, 25 bp, Rattus norvegicus
tcggcagccgcgaaaacctggagaa

SEQ ID NO: 566522 - DNA, 25 bp, Rattus norvegicus
cgggccctgattggccagcatcttg

SEQ ID NO: 566523 - DNA, 25 bp, Rattus norvegicus
tgtgcttcacatcgaaatcttttcg

SEQ ID NO: 566524 - DNA, 25 bp, Rattus norvegicus
cgcccagagccggacatgcttaatg

SEQ ID NO: 566525 - DNA, 25 bp, Rattus norvegicus
agagccttatggctcagtccgggtc

SEQ ID NO: 566526 - DNA, 25 bp, Rattus norvegicus
catgcttaatgcacggaggaccaag

SEQ ID NO: 566527 - DNA, 25 bp, Rattus norvegicus
gaggaccaagggactgcagctcaca

SEQ ID NO: 566528 - DNA, 25 bp, Rattus norvegicus
tgcagctcacacaccagtagcctgg

SEQ ID NO: 566529 - DNA, 25 bp, Rattus norvegicus
acaccagtagcctggcgagcggact

SEQ ID NO: 566530 - DNA, 25 bp, Rattus norvegicus
caatggcttctggagacgagaaaga

SEQ ID NO: 566531 - DNA, 25 bp, Rattus norvegicus
cccgtgtatacggagtgccaaaggt

SEQ ID NO: 566532 - DNA, 25 bp, Rattus norvegicus
tatacggagtgccaaaggtggtcaa

SEQ ID NO: 566533 - DNA, 25 bp, Rattus norvegicus
aggcgactacaccagcacctagagc

SEQ ID NO: 566534 - DNA, 25 bp, Rattus norvegicus
cctagagcgcgctgcagagccttat

SEQ ID NO: 566535 - DNA, 25 bp, Rattus norvegicus
ggagtcgcaggatgtgcttcacatc

SEQ ID NO: 566536 - DNA, 25 bp, Rattus norvegicus
tcgaaatcttttcgcccagagccgg

SEQ ID NO: 566537 - DNA, 25 bp, Rattus norvegicus
cggccgacagatcgagtccagcggc

SEQ ID NO: 566538 - DNA, 25 bp, Rattus norvegicus
tccagcggcgcaggagccatcgctg

SEQ ID NO: 566539 - DNA, 25 bp, Rattus norvegicus
cccaggtgctcccatttgtggagga

SEQ ID NO: 566540 - DNA, 25 bp, Rattus norvegicus
cgatcctccgcccacgtgcctgtcg

SEQ ID NO: 566541 - DNA, 25 bp, Rattus norvegicus
tggaggacccgcaagcgatcctccg

SEQ ID NO: 566542 - DNA, 25 bp, Rattus norvegicus
catttgtggaggacccgcaagcgat

SEQ ID NO: 566543 - DNA, 25 bp, Rattus norvegicus
tcccatttgtggaggacccgcaagc

SEQ ID NO: 566544 - DNA, 25 bp, Rattus norvegicus
tgctcccatttgtggaggacccgca

SEQ ID NO: 566545 - DNA, 25 bp, Rattus norvegicus
cagcccaggtgctcccatttgtgga

SEQ ID NO: 566546 - DNA, 25 bp, Rattus norvegicus
cggcagcagcgcaggtagggccagt

SEQ ID NO: 566547 - DNA, 25 bp, Rattus norvegicus
cgcaggagccatcgctgcgcgacgg

SEQ ID NO: 566548 - DNA, 25 bp, Rattus norvegicus
acagatcgagtccagcggcgcagga

SEQ ID NO: 566549 - DNA, 25 bp, Rattus norvegicus
ccgacagatcgagtccagcggcgca

SEQ ID NO: 566550 - DNA, 25 bp, Rattus norvegicus
ccgcagtgcccgtgtgcgccgccgt

SEQ ID NO: 566551 - DNA, 25 bp, Rattus norvegicus
cacaccgcacatcaaatcaacagaa

SEQ ID NO: 566552 - DNA, 25 bp, Rattus norvegicus
aaatgcccaatgacgtccgcaactc

SEQ ID NO: 566553 - DNA, 25 bp, Rattus norvegicus
cagaaatgcccaatgacgtccgcaa

SEQ ID NO: 566554 - DNA, 25 bp, Rattus norvegicus
aatcaacagaaatgcccaatgacgt

SEQ ID NO: 566555 - DNA, 25 bp, Rattus norvegicus
acaccgcacatcaaatcaacagaaa

SEQ ID NO: 566556 - DNA, 25 bp, Rattus norvegicus
acagaaatgcccaatgacgtccgca

SEQ ID NO: 566557 - DNA, 25 bp, Rattus norvegicus
accgcacatcaaatcaacagaaatg

SEQ ID NO: 566558 - DNA, 25 bp, Rattus norvegicus
aaatcaacagaaatgcccaatgacg

SEQ ID NO: 566559 - DNA, 25 bp, Rattus norvegicus
agaaatgcccaatgacgtccgcaac

SEQ ID NO: 566560 - DNA, 25 bp, Rattus norvegicus
atcaacagaaatgcccaatgacgtc

SEQ ID NO: 566561 - DNA, 25 bp, Rattus norvegicus
atcaaatcaacagaaatgcccaatg

SEQ ID NO: 566562 - DNA, 25 bp, Rattus norvegicus
cccacaccgcacatcaaatcaacag

SEQ ID NO: 566563 - DNA, 25 bp, Rattus norvegicus
gaaatgcccaatgacgtccgcaact

SEQ ID NO: 566564 - DNA, 25 bp, Rattus norvegicus
aacagaaatgcccaatgacgtccgc

SEQ ID NO: 566565 - DNA, 25 bp, Rattus norvegicus
gaccggaagatgtcctcatacacta

SEQ ID NO: 566566 - DNA, 25 bp, Rattus norvegicus
gcgccgctaccgctagccatggaga

SEQ ID NO: 566567 - DNA, 25 bp, Rattus norvegicus
ctctggtttcctggctgcagacgtg

SEQ ID NO: 566568 - DNA, 25 bp, Rattus norvegicus
cgaggagttagcgttcgaattcacc

SEQ ID NO: 566569 - DNA, 25 bp, Rattus norvegicus
cccgggacttcagtcgcaggcttct

SEQ ID NO: 566570 - DNA, 25 bp, Rattus norvegicus
aggcctggactcctgtctcgagttg

SEQ ID NO: 566571 - DNA, 25 bp, Rattus norvegicus
atggtctccctcaccgcgttcaggt

SEQ ID NO: 566572 - DNA, 25 bp, Rattus norvegicus
cgcctgaccgcgttgatttgaattt

SEQ ID NO: 566573 - DNA, 25 bp, Rattus norvegicus
tgaatttggagcctcgttcccttgc

SEQ ID NO: 566574 - DNA, 25 bp, Rattus norvegicus
ttcccttgcgcggaacgtagagcga

SEQ ID NO: 566575 - DNA, 25 bp, Rattus norvegicus
ctccttactgaaacgccagagactg

SEQ ID NO: 566576 - DNA, 25 bp, Rattus norvegicus
tacccacgaatgtcggtacgtcctc

SEQ ID NO: 566577 - DNA, 25 bp, Rattus norvegicus
cgcaggacaccgctaaggtcgatga

SEQ ID NO: 566578 - DNA, 25 bp, Rattus norvegicus
gcggggtgctagaacttccacgtta

SEQ ID NO: 566579 - DNA, 25 bp, Rattus norvegicus
acagtgacgcgcgtaagttccctga

SEQ ID NO: 566580 - DNA, 25 bp, Rattus norvegicus
tcccgcgagttgttagtttcacgtc

SEQ ID NO: 566581 - DNA, 25 bp, Rattus norvegicus
tggttgtcttggtgaccgctcctaa

SEQ ID NO: 566582 - DNA, 25 bp, Rattus norvegicus
cgcgccctaggttcttcggatttct

SEQ ID NO: 566583 - DNA, 25 bp, Rattus norvegicus
ccgcttccgactgacttccgggaga

SEQ ID NO: 566584 - DNA, 25 bp, Rattus norvegicus
cggggctttactctggactgcagct

SEQ ID NO: 566585 - DNA, 25 bp, Rattus norvegicus
tgcttgtcatttccgcccacaggtg

SEQ ID NO: 566586 - DNA, 25 bp, Rattus norvegicus
agcggaggcgcttccattcgcattt

SEQ ID NO: 566587 - DNA, 25 bp, Rattus norvegicus
agcatctcgtctcgcggcgtggaac

SEQ ID NO: 566588 - DNA, 25 bp, Rattus norvegicus
cccgcgcgggtcttctttaagaatg

SEQ ID NO: 566589 - DNA, 25 bp, Rattus norvegicus
gcaggtagtgctcgcgcacgatctt

SEQ ID NO: 566590 - DNA, 25 bp, Rattus norvegicus
cgcagccgatgtcatcccgcaggta

SEQ ID NO: 566591 - DNA, 25 bp, Rattus norvegicus
agcagcacattggtgtccggcagga

SEQ ID NO: 566592 - DNA, 25 bp, Rattus norvegicus
agttccctgatggtcgtgacgattg

SEQ ID NO: 566593 - DNA, 25 bp, Rattus norvegicus
taagccgagagtggccggcctccct

SEQ ID NO: 566594 - DNA, 25 bp, Rattus norvegicus
tctgtcagagaagttgtgtacaaac

SEQ ID NO: 566595 - DNA, 25 bp, Rattus norvegicus
acctcgtggggcttcttttctattg

SEQ ID NO: 566596 - DNA, 25 bp, Rattus norvegicus
tggggcttcttttctattggctagc

SEQ ID NO: 566597 - DNA, 25 bp, Rattus norvegicus
ttctattggctagccgctggccttg

SEQ ID NO: 566598 - DNA, 25 bp, Rattus norvegicus
ccttggggcattgccattggccaca

SEQ ID NO: 566599 - DNA, 25 bp, Rattus norvegicus
ggcattgccattggccacaacgctg

SEQ ID NO: 566600 - DNA, 25 bp, Rattus norvegicus
ggccacaacgctgccagtcgcatga

SEQ ID NO: 566601 - DNA, 25 bp, Rattus norvegicus
tgccagtcgcatgagctggccctgc

SEQ ID NO: 566602 - DNA, 25 bp, Rattus norvegicus
gttgtgtacaaactgcgccgcagcc

SEQ ID NO: 566603 - DNA, 25 bp, Rattus norvegicus
cctccctggagttgggtgaaataga

SEQ ID NO: 566604 - DNA, 25 bp, Rattus norvegicus
cccgatctgtccagagaaggctaaa

SEQ ID NO: 566605 - DNA, 25 bp, Rattus norvegicus
agaaggctaaagagccgcgcgctca

SEQ ID NO: 566606 - DNA, 25 bp, Rattus norvegicus
ccctgcctccctggagttgggtgaa

SEQ ID NO: 566607 - DNA, 25 bp, Rattus norvegicus
catcggaagttctgtttcagtgtcc

SEQ ID NO: 566608 - DNA, 25 bp, Rattus norvegicus
cctcctttgctttgccctttgcagg

SEQ ID NO: 566609 - DNA, 25 bp, Rattus norvegicus
tttcagtgtccagcgtgagtacagc

SEQ ID NO: 566610 - DNA, 25 bp, Rattus norvegicus
tccgcccgttcttctctgtgcagga

SEQ ID NO: 566611 - DNA, 25 bp, Rattus norvegicus
cctcgacgcagcctacgtgaagggg

SEQ ID NO: 566612 - DNA, 25 bp, Rattus norvegicus
ggctcagagcccaattgtccgattc

SEQ ID NO: 566613 - DNA, 25 bp, Rattus norvegicus
cctaacgccgcgtccgtcagtcgct

SEQ ID NO: 566614 - DNA, 25 bp, Rattus norvegicus
tttgcaggcggcctcgacgcagcct

SEQ ID NO: 566615 - DNA, 25 bp, Rattus norvegicus
ggaggccgcagcgtcccatgctcag

SEQ ID NO: 566616 - DNA, 25 bp, Rattus norvegicus
cctcaggcttgcttccctctctctc

SEQ ID NO: 566617 - DNA, 25 bp, Rattus norvegicus
tctctgtgcaggagcagtgacggac

SEQ ID NO: 566618 - DNA, 25 bp, Rattus norvegicus
atttcacccgacctcctttgctttg

SEQ ID NO: 566619 - DNA, 25 bp, Rattus norvegicus
agtcccgaccgctcctccatttcac

SEQ ID NO: 566620 - DNA, 25 bp, Rattus norvegicus
acgctctgagcgtcctctgtgacct

SEQ ID NO: 566621 - DNA, 25 bp, Rattus norvegicus
gctgcttgggcaacaatggggtccc

SEQ ID NO: 566622 - DNA, 25 bp, Rattus norvegicus
gcaaagattcaccttggcgggatga

SEQ ID NO: 566623 - DNA, 25 bp, Rattus norvegicus
gtgcgggcagagagactctactaga

SEQ ID NO: 566624 - DNA, 25 bp, Rattus norvegicus
cattgtttgggttcgagtgagtcgc

SEQ ID NO: 566625 - DNA, 25 bp, Rattus norvegicus
tgagtcgcacgttgcaggagaagct

SEQ ID NO: 566626 - DNA, 25 bp, Rattus norvegicus
tgcctcgctcgggaacgcgggcaca

SEQ ID NO: 566627 - DNA, 25 bp, Rattus norvegicus
aacagggacagatcggtgctcggtc

SEQ ID NO: 566628 - DNA, 25 bp, Rattus norvegicus
gagccgggtgctggacgccatccct

SEQ ID NO: 566629 - DNA, 25 bp, Rattus norvegicus
cctgcgcgcacggagcagtggattc

SEQ ID NO: 566630 - DNA, 25 bp, Rattus norvegicus
aggaagctctgctgttccctccgcg

SEQ ID NO: 566631 - DNA, 25 bp, Rattus norvegicus
ttccctccgcggctgagaggactcg

SEQ ID NO: 566632 - DNA, 25 bp, Rattus norvegicus
agaggactcggggtcaagcctcccg

SEQ ID NO: 566633 - DNA, 25 bp, Rattus norvegicus
ctcaaccgcggctaagttggaaagg

SEQ ID NO: 566634 - DNA, 25 bp, Rattus norvegicus
ggcgcctgaccaagctggttattta

SEQ ID NO: 566635 - DNA, 25 bp, Rattus norvegicus
taaagtccgtgcttcagcggccctg

SEQ ID NO: 566636 - DNA, 25 bp, Rattus norvegicus
acaaaaacaaacgtggcctcgcgcg

SEQ ID NO: 566637 - DNA, 25 bp, Rattus norvegicus
cggcccgctcagtctcggagaacta

SEQ ID NO: 566638 - DNA, 25 bp, Rattus norvegicus
tagactagcgggagacacaggctca

SEQ ID NO: 566639 - DNA, 25 bp, Rattus norvegicus
ctcggtgccaccagcctttaaagtc

SEQ ID NO: 566640 - DNA, 25 bp, Rattus norvegicus
gcggaggaaactgctaactgtcgtc

SEQ ID NO: 566641 - DNA, 25 bp, Rattus norvegicus
atcctgaatgcagctaggcgactcc

SEQ ID NO: 566642 - DNA, 25 bp, Rattus norvegicus
tgcgggaaaggctcatcctgaatgc

SEQ ID NO: 566643 - DNA, 25 bp, Rattus norvegicus
taccatagccggaagcgcttgtcgc

SEQ ID NO: 566644 - DNA, 25 bp, Rattus norvegicus
gcgtggtcctgcgatccaagcaaga

SEQ ID NO: 566645 - DNA, 25 bp, Rattus norvegicus
tctcggccatgagccacgggagcat

SEQ ID NO: 566646 - DNA, 25 bp, Rattus norvegicus
agccttgtgctcgaagatgaacacc

SEQ ID NO: 566647 - DNA, 25 bp, Rattus norvegicus
tgaagcgcgagatgtgctgagcctt

SEQ ID NO: 566648 - DNA, 25 bp, Rattus norvegicus
tgaccggctgtcacctggaaggtcg

SEQ ID NO: 566649 - DNA, 25 bp, Rattus norvegicus
acacgatttagagaaacgccgtctg

SEQ ID NO: 566650 - DNA, 25 bp, Rattus norvegicus
gtactgagatccctccatggccaga

SEQ ID NO: 566651 - DNA, 25 bp, Rattus norvegicus
ttcgggtgcaagacagaagcgcagc

SEQ ID NO: 566652 - DNA, 25 bp, Rattus norvegicus
ctagcccttcgggtgcaagacagaa

SEQ ID NO: 566653 - DNA, 25 bp, Rattus norvegicus
tccctgtactgagatccctccatgg

SEQ ID NO: 566654 - DNA, 25 bp, Rattus norvegicus
agcaccggctccctgtactgagatc

SEQ ID NO: 566655 - DNA, 25 bp, Rattus norvegicus
gtacttacctccgacttggcgtcca

SEQ ID NO: 566656 - DNA, 25 bp, Rattus norvegicus
gcaacggaagcagagacacgattta

SEQ ID NO: 566657 - DNA, 25 bp, Rattus norvegicus
gccggtgacctgcaacggaagcaga

SEQ ID NO: 566658 - DNA, 25 bp, Rattus norvegicus
tggaaatcgcaagcaccggccagca

SEQ ID NO: 566659 - DNA, 25 bp, Rattus norvegicus
tcacctggccggtgacctgcaacgg

SEQ ID NO: 566660 - DNA, 25 bp, Rattus norvegicus
ctccatggccagagtggaaatcgca

SEQ ID NO: 566661 - DNA, 25 bp, Rattus norvegicus
aaacgccgtctgagcgccagagtcc

SEQ ID NO: 566662 - DNA, 25 bp, Rattus norvegicus
cacttctcctcctagcccgtactta

SEQ ID NO: 566663 - DNA, 25 bp, Rattus norvegicus
gtttggttgcctctcatctggttcc

SEQ ID NO: 566664 - DNA, 25 bp, Rattus norvegicus
gattccctgttgattccggctcgtt

SEQ ID NO: 566665 - DNA, 25 bp, Rattus norvegicus
ccggctcgtttgttttctcatgaga

SEQ ID NO: 566666 - DNA, 25 bp, Rattus norvegicus
ttctcatgagataggacatggcttc

SEQ ID NO: 566667 - DNA, 25 bp, Rattus norvegicus
gacatggcttcggtttatcatctta

SEQ ID NO: 566668 - DNA, 25 bp, Rattus norvegicus
taataactctatggctgcgtctccg

SEQ ID NO: 566669 - DNA, 25 bp, Rattus norvegicus
ctccgtagggaacgattaagcatcc

SEQ ID NO: 566670 - DNA, 25 bp, Rattus norvegicus
gccgtggaacctcactcgttggttc

SEQ ID NO: 566671 - DNA, 25 bp, Rattus norvegicus
atgcgcgcgtctctaaactcctcta

SEQ ID NO: 566672 - DNA, 25 bp, Rattus norvegicus
tcaccaaccaggtgagtgcggtgtc

SEQ ID NO: 566673 - DNA, 25 bp, Rattus norvegicus
ctcttcgttcgtctccttgccgttg

SEQ ID NO: 566674 - DNA, 25 bp, Rattus norvegicus
cgcatgcgtagaactcgggtgctcc

SEQ ID NO: 566675 - DNA, 25 bp, Rattus norvegicus
tcgggtgctccctctcaggaaggga

SEQ ID NO: 566676 - DNA, 25 bp, Rattus norvegicus
actgtctcgtttcaggtcaccaacc

SEQ ID NO: 566677 - DNA, 25 bp, Rattus norvegicus
tcgagaaagcaactcccgcaagttc

SEQ ID NO: 566678 - DNA, 25 bp, Rattus norvegicus
tcctgctccagtcctgctggatttg

SEQ ID NO: 566679 - DNA, 25 bp, Rattus norvegicus
acagcgcttgcgacttttgaagttc

SEQ ID NO: 566680 - DNA, 25 bp, Rattus norvegicus
tcaccgaacccgttgtagcgagagg

SEQ ID NO: 566681 - DNA, 25 bp, Rattus norvegicus
ggttcctgaacttaaactgcacatc

SEQ ID NO: 566682 - DNA, 25 bp, Rattus norvegicus
ctgaggccgattgctccgttgcatt

SEQ ID NO: 566683 - DNA, 25 bp, Rattus norvegicus
caattgtgtgcagctattcctggta

SEQ ID NO: 566684 - DNA, 25 bp, Rattus norvegicus
ttcttggcccggaaaggtgcaattg

SEQ ID NO: 566685 - DNA, 25 bp, Rattus norvegicus
ccgacccacctgtgatcggggagga

SEQ ID NO: 566686 - DNA, 25 bp, Rattus norvegicus
tgaagccgcaggtcttcccaaccga

SEQ ID NO: 566687 - DNA, 25 bp, Rattus norvegicus
tttgagcggatttcaggagtttcga

SEQ ID NO: 566688 - DNA, 25 bp, Rattus norvegicus
ttcctggtatgtcaggccgcaggca

SEQ ID NO: 566689 - DNA, 25 bp, Rattus norvegicus
ccgcccagactttcagaccagagag

SEQ ID NO: 566690 - DNA, 25 bp, Rattus norvegicus
ccctctcttgccctagtcatggaag

SEQ ID NO: 566691 - DNA, 25 bp, Rattus norvegicus
cacaccatacagatcttcctcgtag

SEQ ID NO: 566692 - DNA, 25 bp, Rattus norvegicus
gagcctccagtaccgccaatcaaca

SEQ ID NO: 566693 - DNA, 25 bp, Rattus norvegicus
agctccgccagcacttcgagttcgg

SEQ ID NO: 566694 - DNA, 25 bp, Rattus norvegicus
cagcacttcgagttcggccgcgaac

SEQ ID NO: 566695 - DNA, 25 bp, Rattus norvegicus
cggccgcgaactgattttggaagtc

SEQ ID NO: 566696 - DNA, 25 bp, Rattus norvegicus
cgcgaactgattttggaagtcatcc

SEQ ID NO: 566697 - DNA, 25 bp, Rattus norvegicus
gaagtcatcctccacaccatacaga

SEQ ID NO: 566698 - DNA, 25 bp, Rattus norvegicus
tcttcctcgtagtcttccatggtcc

SEQ ID NO: 566699 - DNA, 25 bp, Rattus norvegicus
gtgcaggcagaccacagcttctaca

SEQ ID NO: 566700 - DNA, 25 bp, Rattus norvegicus
cagaccacagcttctacagctaagc

SEQ ID NO: 566701 - DNA, 25 bp, Rattus norvegicus
acagctaagcttccctcagaacttc

SEQ ID NO: 566702 - DNA, 25 bp, Rattus norvegicus
gcgccactgccatcgcgcgccaccc

SEQ ID NO: 566703 - DNA, 25 bp, Rattus norvegicus
agatcttcctcgtagtcttccatgg

SEQ ID NO: 566704 - DNA, 25 bp, Rattus norvegicus
tccctcagaacttcccgcgccactg

SEQ ID NO: 566705 - DNA, 25 bp, Rattus norvegicus
ccggtccagaaagaagcggcctttg

SEQ ID NO: 566706 - DNA, 25 bp, Rattus norvegicus
gctacggctagccagatccagcgtg

SEQ ID NO: 566707 - DNA, 25 bp, Rattus norvegicus
tccggcagctcgaagtactcggcct

SEQ ID NO: 566708 - DNA, 25 bp, Rattus norvegicus
agtcgggcagcacgagctgcaagtc

SEQ ID NO: 566709 - DNA, 25 bp, Rattus norvegicus
tgcaagtcccgcaggtaatccagga

SEQ ID NO: 566710 - DNA, 25 bp, Rattus norvegicus
gaagaggaagccatcccggtccaga

SEQ ID NO: 566711 - DNA, 25 bp, Rattus norvegicus
catacgccagagcagcgagtcgggc

SEQ ID NO: 566712 - DNA, 25 bp, Rattus norvegicus
tcgggcacggacaccacggtacagc

SEQ ID NO: 566713 - DNA, 25 bp, Rattus norvegicus
tacagcgccgggtcacatacacctg

SEQ ID NO: 566714 - DNA, 25 bp, Rattus norvegicus
acgttcagctccacgatgtccggga

SEQ ID NO: 566715 - DNA, 25 bp, Rattus norvegicus
gtaatcctcgggtgctgtccgccag

SEQ ID NO: 566716 - DNA, 25 bp, Rattus norvegicus
ggctgctgctgcgtgaacatacgcc

SEQ ID NO: 566717 - DNA, 25 bp, Rattus norvegicus
cgcttaagtagagccgcccgctcgg

SEQ ID NO: 566718 - DNA, 25 bp, Rattus norvegicus
tccaaagactgggacggcgtgagca

SEQ ID NO: 566719 - DNA, 25 bp, Rattus norvegicus
acacagggcacactgcgggcgacac

SEQ ID NO: 566720 - DNA, 25 bp, Rattus norvegicus
tcatacgcccaagccggtgctcgtg

SEQ ID NO: 566721 - DNA, 25 bp, Rattus norvegicus
agcgcggatccgttgtcccagcgcg

SEQ ID NO: 566722 - DNA, 25 bp, Rattus norvegicus
ctggagagcgcggatccgttgtccc

SEQ ID NO: 566723 - DNA, 25 bp, Rattus norvegicus
ctggcccgtaccctacaagtgagtg

SEQ ID NO: 566724 - DNA, 25 bp, Rattus norvegicus
aacgctggcccgtaccctacaagtg

SEQ ID NO: 566725 - DNA, 25 bp, Rattus norvegicus
ccggaggtcatacgcccaagccggt

SEQ ID NO: 566726 - DNA, 25 bp, Rattus norvegicus
taggacagtggaggcgtcacgctcc

SEQ ID NO: 566727 - DNA, 25 bp, Rattus norvegicus
gctcctcctgggctaggacagtgga

SEQ ID NO: 566728 - DNA, 25 bp, Rattus norvegicus
cgcagtggagcagaggcgctcctcc

SEQ ID NO: 566729 - DNA, 25 bp, Rattus norvegicus
gaggacagcgctttttcgcctcccg

SEQ ID NO: 566730 - DNA, 25 bp, Rattus norvegicus
cgccagtctccagctccttccggga

SEQ ID NO: 566731 - DNA, 25 bp, Rattus norvegicus
cacactgcgggcgacactgcgagcg

SEQ ID NO: 566732 - DNA, 25 bp, Rattus norvegicus
tccgggaggacagcgctttttcgcc

SEQ ID NO: 566733 - DNA, 25 bp, Rattus norvegicus
tgttgacaagtactgaggtccaggc

SEQ ID NO: 566734 - DNA, 25 bp, Rattus norvegicus
ccggacgtaaacatcagctgacagc

SEQ ID NO: 566735 - DNA, 25 bp, Rattus norvegicus
cgaccagagcggctgcacttaagtt

SEQ ID NO: 566736 - DNA, 25 bp, Rattus norvegicus
cttaagttcgccaagttttccactg

SEQ ID NO: 566737 - DNA, 25 bp, Rattus norvegicus
gaggagtgtctgcaaaacccgaccc

SEQ ID NO: 566738 - DNA, 25 bp, Rattus norvegicus
gagcgccaggcctttcccagggtta

SEQ ID NO: 566739 - DNA, 25 bp, Rattus norvegicus
ttggagttaactaggagcgccaggc

SEQ ID NO: 566740 - DNA, 25 bp, Rattus norvegicus
gcgcgccacgccttgttgacaagta

SEQ ID NO: 566741 - DNA, 25 bp, Rattus norvegicus
ctgtccctggagaagtttgtttagg

SEQ ID NO: 566742 - DNA, 25 bp, Rattus norvegicus
tccagtctcggggactgtccctgga

SEQ ID NO: 566743 - DNA, 25 bp, Rattus norvegicus
cgagcctcggcccagttacagaatc

SEQ ID NO: 566744 - DNA, 25 bp, Rattus norvegicus
agcggccaacagcagccaacagcag

SEQ ID NO: 566745 - DNA, 25 bp, Rattus norvegicus
cgcggccaaaggtgctgtctgcaca

SEQ ID NO: 566746 - DNA, 25 bp, Rattus norvegicus
ccgggcggaaagcttcctttctctg

SEQ ID NO: 566747 - DNA, 25 bp, Rattus norvegicus
agcggtgccaaagcgacgtgaaatc

SEQ ID NO: 566748 - DNA, 25 bp, Rattus norvegicus
atgcacacgcggcaaggaaggacgc

SEQ ID NO: 566749 - DNA, 25 bp, Rattus norvegicus
acgcccgggagactcacctggaggc

SEQ ID NO: 566750 - DNA, 25 bp, Rattus norvegicus
aggccgggtacccagtgctgctgcc

SEQ ID NO: 566751 - DNA, 25 bp, Rattus norvegicus
ctgagcgcagtggtgtaaatcctcc

SEQ ID NO: 566752 - DNA, 25 bp, Rattus norvegicus
aatcctccggtagcgatccgccaag

SEQ ID NO: 566753 - DNA, 25 bp, Rattus norvegicus
accgaaccgtcaggaaccggcatga

SEQ ID NO: 566754 - DNA, 25 bp, Rattus norvegicus
tcaggaaccggcatgaacagcgccc

SEQ ID NO: 566755 - DNA, 25 bp, Rattus norvegicus
tcggccaacgacgacggctgtagcg

SEQ ID NO: 566756 - DNA, 25 bp, Rattus norvegicus
gggacactacaaagacagcgacctt

SEQ ID NO: 566757 - DNA, 25 bp, Rattus norvegicus
cgctgttggggccactcatctaacc

SEQ ID NO: 566758 - DNA, 25 bp, Rattus norvegicus
accgccggagttgcccgcaatggga

SEQ ID NO: 566759 - DNA, 25 bp, Rattus norvegicus
tgctcagtcataggacctggctctc

SEQ ID NO: 566760 - DNA, 25 bp, Rattus norvegicus
gcctcctccgagttgtgggtatcca

SEQ ID NO: 566761 - DNA, 25 bp, Rattus norvegicus
ctagagcaagagcacagggcagagc

SEQ ID NO: 566762 - DNA, 25 bp, Rattus norvegicus
gaggacgacgactacacctggtatg

SEQ ID NO: 566763 - DNA, 25 bp, Rattus norvegicus
tcaggccaggtccaatcaggcacct

SEQ ID NO: 566764 - DNA, 25 bp, Rattus norvegicus
ccaatcaggcacctggggttaggtg

SEQ ID NO: 566765 - DNA, 25 bp, Rattus norvegicus
tcgacgcagccatcatcggaggctc

SEQ ID NO: 566766 - DNA, 25 bp, Rattus norvegicus
ccgcctggagcgaggacgacgacta

SEQ ID NO: 566767 - DNA, 25 bp, Rattus norvegicus
tcctccaacgctgctggacgaggtg

SEQ ID NO: 566768 - DNA, 25 bp, Rattus norvegicus
tggcagcccggaaccatggaccgcg

SEQ ID NO: 566769 - DNA, 25 bp, Rattus norvegicus
ttcgtctactccaagccggcggcgg

SEQ ID NO: 566770 - DNA, 25 bp, Rattus norvegicus
gcggagcaggtgaaatgcgcctccc

SEQ ID NO: 566771 - DNA, 25 bp, Rattus norvegicus
ggcagagctgctcggctgccgcttc

SEQ ID NO: 566772 - DNA, 25 bp, Rattus norvegicus
gctaaaacccggagccgctagagca

SEQ ID NO: 566773 - DNA, 25 bp, Rattus norvegicus
ctgatgctggtagactgcgcgagct

SEQ ID NO: 566774 - DNA, 25 bp, Rattus norvegicus
acacctggtatggacgagctccgcc

SEQ ID NO: 566775 - DNA, 25 bp, Rattus norvegicus
ctgggcgagcaaagctgaacaggct

SEQ ID NO: 566776 - DNA, 25 bp, Rattus norvegicus
cacgccgagcagagccgtggcatgc

SEQ ID NO: 566777 - DNA, 25 bp, Rattus norvegicus
agcctccgctcgcacgcagagttgg

SEQ ID NO: 566778 - DNA, 25 bp, Rattus norvegicus
acgcagagttggcacgccgagcaga

SEQ ID NO: 566779 - DNA, 25 bp, Rattus norvegicus
ctgcctacgattccctgcggctgga

SEQ ID NO: 566780 - DNA, 25 bp, Rattus norvegicus
gctgaacaggcttctgcctacgatt

SEQ ID NO: 566781 - DNA, 25 bp, Rattus norvegicus
tccctgcggctggagcgtgtgctct

SEQ ID NO: 566782 - DNA, 25 bp, Rattus norvegicus
ttgacgcttgacaagcagaggcgcg

SEQ ID NO: 566783 - DNA, 25 bp, Rattus norvegicus
tccagcttgacgcttgacaagcaga

SEQ ID NO: 566784 - DNA, 25 bp, Rattus norvegicus
tgtgaatgtttccagcttgacgctt

SEQ ID NO: 566785 - DNA, 25 bp, Rattus norvegicus
gctaaggtcagtgtgaatgtttcca

SEQ ID NO: 566786 - DNA, 25 bp, Rattus norvegicus
cgtggcatgctaaggtcagtgtgaa

SEQ ID NO: 566787 - DNA, 25 bp, Rattus norvegicus
gcagagccgtggcatgctaaggtca

SEQ ID NO: 566788 - DNA, 25 bp, Rattus norvegicus
ggcttctgcctacgattccctgcgg

SEQ ID NO: 566789 - DNA, 25 bp, Rattus norvegicus
attcatcgtgtggtacgtggcgtcc

SEQ ID NO: 566790 - DNA, 25 bp, Rattus norvegicus
gctgcaggcgacacaaaccaaacca

SEQ ID NO: 566791 - DNA, 25 bp, Rattus norvegicus
cacaagccggaaagcacgggcaaaa

SEQ ID NO: 566792 - DNA, 25 bp, Rattus norvegicus
ttgccctgggacaccgcgatgtcca

SEQ ID NO: 566793 - DNA, 25 bp, Rattus norvegicus
acgagatgtggtccagcaggtcacc

SEQ ID NO: 566794 - DNA, 25 bp, Rattus norvegicus
ggacacgggaacacattccgggaga

SEQ ID NO: 566795 - DNA, 25 bp, Rattus norvegicus
gaaatggagatgtcactcgaagcta

SEQ ID NO: 566796 - DNA, 25 bp, Rattus norvegicus
ctcgaagctaaggacccgtgccaca

SEQ ID NO: 566797 - DNA, 25 bp, Rattus norvegicus
gcgagcgagcacacagatcgccttg

SEQ ID NO: 566798 - DNA, 25 bp, Rattus norvegicus
acaggcgctggacagaggcacaaga

SEQ ID NO: 566799 - DNA, 25 bp, Rattus norvegicus
gcgaagaggttgctctgcagctgca

SEQ ID NO: 566800 - DNA, 25 bp, Rattus norvegicus
ccttgtgcaggcgtgaaattaacag

SEQ ID NO: 566801 - DNA, 25 bp, Rattus norvegicus
ggcaaaacacaaagcgaccatgata

SEQ ID NO: 566802 - DNA, 25 bp, Rattus norvegicus
cggcttgaaagggtggctcttgccc

SEQ ID NO: 566803 - DNA, 25 bp, Rattus norvegicus
ctcagggaaggagcgtcccgtccct

SEQ ID NO: 566804 - DNA, 25 bp, Rattus norvegicus
agaggttccactgctccgtctgtgc

SEQ ID NO: 566805 - DNA, 25 bp, Rattus norvegicus
cgctgggtccgggacacaaactcgc

SEQ ID NO: 566806 - DNA, 25 bp, Rattus norvegicus
caaacttgtccacaggtacgccagc

SEQ ID NO: 566807 - DNA, 25 bp, Rattus norvegicus
acctcacgggacacgaatcaagttc

SEQ ID NO: 566808 - DNA, 25 bp, Rattus norvegicus
aatcaagttctgtcaccttcctgtg

SEQ ID NO: 566809 - DNA, 25 bp, Rattus norvegicus
ccttcctgtgtcagacagcctttgg

SEQ ID NO: 566810 - DNA, 25 bp, Rattus norvegicus
tgaggaccagcagtcccgcccaagg

SEQ ID NO: 566811 - DNA, 25 bp, Rattus norvegicus
ccgcccaagggacatttcgtggatg

SEQ ID NO: 566812 - DNA, 25 bp, Rattus norvegicus
acatttcgtggatgcagaagggcgc

SEQ ID NO: 566813 - DNA, 25 bp, Rattus norvegicus
cggtgaagaaaatcgcgaggcagcc

SEQ ID NO: 566814 - DNA, 25 bp, Rattus norvegicus
cgaggcagccaagccagtccgagct

SEQ ID NO: 566815 - DNA, 25 bp, Rattus norvegicus
ccctgtcatttagggaacgaccaga

SEQ ID NO: 566816 - DNA, 25 bp, Rattus norvegicus
cacaaactcgcccttccggtgagga

SEQ ID NO: 566817 - DNA, 25 bp, Rattus norvegicus
ggaagtcccgccgacagcagctctt

SEQ ID NO: 566818 - DNA, 25 bp, Rattus norvegicus
accgctcttcgcaggccggctgaag

SEQ ID NO: 566819 - DNA, 25 bp, Rattus norvegicus
ccagaggagcccaccgatcccggtc

SEQ ID NO: 566820 - DNA, 25 bp, Rattus norvegicus
gctcccgcgggcaattggtcctcaa

SEQ ID NO: 566821 - DNA, 25 bp, Rattus norvegicus
gcagctcttcgccacgctgggaatg

SEQ ID NO: 566822 - DNA, 25 bp, Rattus norvegicus
cagagtgagggacaatgtaacgttc

SEQ ID NO: 566823 - DNA, 25 bp, Rattus norvegicus
tgtaacgttctgcacggtctgagcc

SEQ ID NO: 566824 - DNA, 25 bp, Rattus norvegicus
acggtctgagccatggcagcgttca

SEQ ID NO: 566825 - DNA, 25 bp, Rattus norvegicus
ggcgcccacacactgaccgctcttc

SEQ ID NO: 566826 - DNA, 25 bp, Rattus norvegicus
tcagaatcccgccaacacggaagtc

SEQ ID NO: 566827 - DNA, 25 bp, Rattus norvegicus
gagctcgcaggtcagccttccctgg

SEQ ID NO: 566828 - DNA, 25 bp, Rattus norvegicus
tcttcgccacgctgggaatgcgcga

SEQ ID NO: 566829 - DNA, 25 bp, Rattus norvegicus
agcgttcagaatcccgccaacacgg

SEQ ID NO: 566830 - DNA, 25 bp, Rattus norvegicus
cccaagcaaatgtggcacgtgatgg

SEQ ID NO: 566831 - DNA, 25 bp, Rattus norvegicus
gctgccgataaatctcgcgagaatt

SEQ ID NO: 566832 - DNA, 25 bp, Rattus norvegicus
ctccaccgcaggcattctgagtaaa

SEQ ID NO: 566833 - DNA, 25 bp, Rattus norvegicus
ctgagtaaaactgcaccgatccgtg

SEQ ID NO: 566834 - DNA, 25 bp, Rattus norvegicus
acaagcgccgtcctatttcataagg

SEQ ID NO: 566835 - DNA, 25 bp, Rattus norvegicus
tgatcggccttcgtagtgaataacc

SEQ ID NO: 566836 - DNA, 25 bp, Rattus norvegicus
tgaggccttagtccctttgatcggc

SEQ ID NO: 566837 - DNA, 25 bp, Rattus norvegicus
gcatgccgggaagagacgcaaattc

SEQ ID NO: 566838 - DNA, 25 bp, Rattus norvegicus
taaggacggaatggccgctgactcc

SEQ ID NO: 566839 - DNA, 25 bp, Rattus norvegicus
ctcagctttgggattaggtgcttgc

SEQ ID NO: 566840 - DNA, 25 bp, Rattus norvegicus
gacccggacttttctctcagctttg

SEQ ID NO: 566841 - DNA, 25 bp, Rattus norvegicus
tcttcccgaaggagagccgaacgcg

SEQ ID NO: 566842 - DNA, 25 bp, Rattus norvegicus
tcatcttagaaaccatccaccgcgg

SEQ ID NO: 566843 - DNA, 25 bp, Rattus norvegicus
agcgcctcgaagttttcaatgatca

SEQ ID NO: 566844 - DNA, 25 bp, Rattus norvegicus
agaccgtagcgtttttgtatatgca

SEQ ID NO: 566845 - DNA, 25 bp, Rattus norvegicus
ggctgtcatggcgtcgcccttcagt

SEQ ID NO: 566846 - DNA, 25 bp, Rattus norvegicus
ggatgacttcatcgggccgtctcag

SEQ ID NO: 566847 - DNA, 25 bp, Rattus norvegicus
cttcagtggggcactacagctgacc

SEQ ID NO: 566848 - DNA, 25 bp, Rattus norvegicus
tgggaaactgaacgctgtggaactt

SEQ ID NO: 566849 - DNA, 25 bp, Rattus norvegicus
tgtggaacttgcacctttgagtccg

SEQ ID NO: 566850 - DNA, 25 bp, Rattus norvegicus
tttgagtccgctggtccaagcgctg

SEQ ID NO: 566851 - DNA, 25 bp, Rattus norvegicus
ccaagcgctgaaggcggccagcaga

SEQ ID NO: 566852 - DNA, 25 bp, Rattus norvegicus
agagggcgcacactcttttcaaagc

SEQ ID NO: 566853 - DNA, 25 bp, Rattus norvegicus
ctcttttcaaagcttgttcacggaa

SEQ ID NO: 566854 - DNA, 25 bp, Rattus norvegicus
ttcacggaaagaaatgagcatgcgc

SEQ ID NO: 566855 - DNA, 25 bp, Rattus norvegicus
cagctgaccgacctggatgacttca

SEQ ID NO: 566856 - DNA, 25 bp, Rattus norvegicus
ctgcgtgccgtttgagtgtcatttt

SEQ ID NO: 566857 - DNA, 25 bp, Rattus norvegicus
aatttgcgttttccggcagagtggc

SEQ ID NO: 566858 - DNA, 25 bp, Rattus norvegicus
acgctcagcggcagtgaggctgtca

SEQ ID NO: 566859 - DNA, 25 bp, Rattus norvegicus
gcacgtacctgtcagggaggcgatc

SEQ ID NO: 566860 - DNA, 25 bp, Rattus norvegicus
tccgacgccgatcggcgagcgaagc

SEQ ID NO: 566861 - DNA, 25 bp, Rattus norvegicus
gacttgcctgacttttccatctcct

SEQ ID NO: 566862 - DNA, 25 bp, Rattus norvegicus
cgacaggaagtgaagtggccccgcc

SEQ ID NO: 566863 - DNA, 25 bp, Rattus norvegicus
aggcgggcaggatggatcaccacca

SEQ ID NO: 566864 - DNA, 25 bp, Rattus norvegicus
cacccgtgagccgtgagtggtgtcc

SEQ ID NO: 566865 - DNA, 25 bp, Rattus norvegicus
tcttttccgcctcggttgccaccgc

SEQ ID NO: 566866 - DNA, 25 bp, Rattus norvegicus
tcccgaccggctgacaacctagagg

SEQ ID NO: 566867 - DNA, 25 bp, Rattus norvegicus
cccgggacttgcctgacttttccat

SEQ ID NO: 566868 - DNA, 25 bp, Rattus norvegicus
ccacctagggacaccttcggagcgg

SEQ ID NO: 566869 - DNA, 25 bp, Rattus norvegicus
gacaccttcggagcggggcctccga

SEQ ID NO: 566870 - DNA, 25 bp, Rattus norvegicus
ccgagcatgctcagtagcgcgcgcg

SEQ ID NO: 566871 - DNA, 25 bp, Rattus norvegicus
ctgactcagacacccgtgagccgtg

SEQ ID NO: 566872 - DNA, 25 bp, Rattus norvegicus
accggctgacaacctagagggctcc

SEQ ID NO: 566873 - DNA, 25 bp, Rattus norvegicus
tgtctactggattaacccgattata

SEQ ID NO: 566874 - DNA, 25 bp, Rattus norvegicus
cgagcacggccttacaaagaaccta

SEQ ID NO: 566875 - DNA, 25 bp, Rattus norvegicus
cggcagcagtaaatggcgtcatgtg

SEQ ID NO: 566876 - DNA, 25 bp, Rattus norvegicus
agagcagttgttgtcccagaggata

SEQ ID NO: 566877 - DNA, 25 bp, Rattus norvegicus
ggggctacattcactcgcactccag

SEQ ID NO: 566878 - DNA, 25 bp, Rattus norvegicus
cgcaggaggcattcaaaagggcaac

SEQ ID NO: 566879 - DNA, 25 bp, Rattus norvegicus
ccgccgcgaggtcagtttatctagt

SEQ ID NO: 566880 - DNA, 25 bp, Rattus norvegicus
gacgttgcaaactaacccggccgca

SEQ ID NO: 566881 - DNA, 25 bp, Rattus norvegicus
ccgagctgcagctttttggattcga

SEQ ID NO: 566882 - DNA, 25 bp, Rattus norvegicus
ctccgagccttgtacgggaggaacg

SEQ ID NO: 566883 - DNA, 25 bp, Rattus norvegicus
ttcgggtttcaagtcccttctgctc

SEQ ID NO: 566884 - DNA, 25 bp, Rattus norvegicus
cttctgctctgactgggattggctt

SEQ ID NO: 566885 - DNA, 25 bp, Rattus norvegicus
acagccttagcgtggaaagccgagc

SEQ ID NO: 566886 - DNA, 25 bp, Rattus norvegicus
aggatatatcgcatccggtcccagc

SEQ ID NO: 566887 - DNA, 25 bp, Rattus norvegicus
gcgttgacgtcatttccaggtgctt

SEQ ID NO: 566888 - DNA, 25 bp, Rattus norvegicus
ggccagcgaggccttagtccttacg

SEQ ID NO: 566889 - DNA, 25 bp, Rattus norvegicus
caaggaggcctttggccttagcgtc

SEQ ID NO: 566890 - DNA, 25 bp, Rattus norvegicus
cagtgaggcctaccgcttttgcgcc

SEQ ID NO: 566891 - DNA, 25 bp, Rattus norvegicus
ggctttaggccctagcgtccctcag

SEQ ID NO: 566892 - DNA, 25 bp, Rattus norvegicus
aggccttagcccttagcgcctggcg

SEQ ID NO: 566893 - DNA, 25 bp, Rattus norvegicus
ctcagcagggcaacgaggccttagc

SEQ ID NO: 566894 - DNA, 25 bp, Rattus norvegicus
aaaacctcgcgtgtctcagcagggc

SEQ ID NO: 566895 - DNA, 25 bp, Rattus norvegicus
tggcagctggtccacaaaacctcgc

SEQ ID NO: 566896 - DNA, 25 bp, Rattus norvegicus
tccttgagcggaccgaggaaagccg

SEQ ID NO: 566897 - DNA, 25 bp, Rattus norvegicus
ctgccgtgagttggtttccttgagc

SEQ ID NO: 566898 - DNA, 25 bp, Rattus norvegicus
gctttatattgaggagcagccgggc

SEQ ID NO: 566899 - DNA, 25 bp, Rattus norvegicus
aagaacttgttttcgagcgcgttga

SEQ ID NO: 566900 - DNA, 25 bp, Rattus norvegicus
gctctgtgtgagctttgaggctcca

SEQ ID NO: 566901 - DNA, 25 bp, Rattus norvegicus
tcaaatactaattaggggccgcgac

SEQ ID NO: 566902 - DNA, 25 bp, Rattus norvegicus
caggcgtagagcaacgctgctccta

SEQ ID NO: 566903 - DNA, 25 bp, Rattus norvegicus
acccgctacccagcagatgtgactg

SEQ ID NO: 566904 - DNA, 25 bp, Rattus norvegicus
tcctatgagagaagacgtgactttt

SEQ ID NO: 566905 - DNA, 25 bp, Rattus norvegicus
gggcgatgaacgcacaccctcgagc

SEQ ID NO: 566906 - DNA, 25 bp, Rattus norvegicus
gactgccttcttagatcctatgaga

SEQ ID NO: 566907 - DNA, 25 bp, Rattus norvegicus
gctgccaggacatgctacaggcgta

SEQ ID NO: 566908 - DNA, 25 bp, Rattus norvegicus
ccctcaaaggatgtcggagataaag

SEQ ID NO: 566909 - DNA, 25 bp, Rattus norvegicus
ttgcaaataatgaggatcgtgcgcc

SEQ ID NO: 566910 - DNA, 25 bp, Rattus norvegicus
catctggggagggatagcaaaaatc

SEQ ID NO: 566911 - DNA, 25 bp, Rattus norvegicus
tttagagcgtcccaagctgccagga

SEQ ID NO: 566912 - DNA, 25 bp, Rattus norvegicus
accatgtacagtgtgcgctgcaaga

SEQ ID NO: 566913 - DNA, 25 bp, Rattus norvegicus
tcgcccaggctgaccagcacgttga

SEQ ID NO: 566914 - DNA, 25 bp, Rattus norvegicus
ggatgcgggagcctttcaaatacta

SEQ ID NO: 566915 - DNA, 25 bp, Rattus norvegicus
acttcgcgccctgcggcgaggtcta

SEQ ID NO: 566916 - DNA, 25 bp, Rattus norvegicus
gccgccgattgttcccggcttaggc

SEQ ID NO: 566917 - DNA, 25 bp, Rattus norvegicus
aatggccctcgggaggcttcgcacg

SEQ ID NO: 566918 - DNA, 25 bp, Rattus norvegicus
aagtactttgttttttatgctaatg

SEQ ID NO: 566919 - DNA, 25 bp, Rattus norvegicus
cctgcccggcgcacacaatggccct

SEQ ID NO: 566920 - DNA, 25 bp, Rattus norvegicus
tccgtatttacgttgaggcgggagc

SEQ ID NO: 566921 - DNA, 25 bp, Rattus norvegicus
gccgcccttcattcacccacatggt

SEQ ID NO: 566922 - DNA, 25 bp, Rattus norvegicus
cagggaaacctgttgtgcgctaagc

SEQ ID NO: 566923 - DNA, 25 bp, Rattus norvegicus
ggtttgttccttcgcgccacttcgc

SEQ ID NO: 566924 - DNA, 25 bp, Rattus norvegicus
cgccctgcggcgaggtctatttgtg

SEQ ID NO: 566925 - DNA, 25 bp, Rattus norvegicus
gaaacctgttgtgcgctaagcggag

SEQ ID NO: 566926 - DNA, 25 bp, Rattus norvegicus
tcgcccggccgccaagaacgagccg

SEQ ID NO: 566927 - DNA, 25 bp, Rattus norvegicus
atggtccttcgaggtgccgccgccg

SEQ ID NO: 566928 - DNA, 25 bp, Rattus norvegicus
tggggcttgtccgtatttacgttga

SEQ ID NO: 566929 - DNA, 25 bp, Rattus norvegicus
ccgcaggcaggcacagcctaggtta

SEQ ID NO: 566930 - DNA, 25 bp, Rattus norvegicus
agctcttctaggtgaagccgcggtc

SEQ ID NO: 566931 - DNA, 25 bp, Rattus norvegicus
cccgggatgctaagaaagagaagtc

SEQ ID NO: 566932 - DNA, 25 bp, Rattus norvegicus
gtccggcatctcagcctcagggctt

SEQ ID NO: 566933 - DNA, 25 bp, Rattus norvegicus
ttcaggggagaaagcgaagctcttc

SEQ ID NO: 566934 - DNA, 25 bp, Rattus norvegicus
agccgcggtctgttcgcggtcttcc

SEQ ID NO: 566935 - DNA, 25 bp, Rattus norvegicus
gcttcgaaccctcgccagatttggc

SEQ ID NO: 566936 - DNA, 25 bp, Rattus norvegicus
tttggctaggcatcatcttccagcg

SEQ ID NO: 566937 - DNA, 25 bp, Rattus norvegicus
cctggctcttcttggatctacccga

SEQ ID NO: 566938 - DNA, 25 bp, Rattus norvegicus
ctctgttcgacaggatctgtacttg

SEQ ID NO: 566939 - DNA, 25 bp, Rattus norvegicus
tggatgctcgctgtttcttcgcttc

SEQ ID NO: 566940 - DNA, 25 bp, Rattus norvegicus
tttcttcgcttcttcccggcttgtg

SEQ ID NO: 566941 - DNA, 25 bp, Rattus norvegicus
tgtgttcggcttacgcagcgccaac

SEQ ID NO: 566942 - DNA, 25 bp, Rattus norvegicus
ctagccggactcttgctctgttcga

SEQ ID NO: 566943 - DNA, 25 bp, Rattus norvegicus
gccacttccgcgctctcagctccgt

SEQ ID NO: 566944 - DNA, 25 bp, Rattus norvegicus
ctctcagctccgtgtggccggagtc

SEQ ID NO: 566945 - DNA, 25 bp, Rattus norvegicus
gccgcactcttcgtcttcctgcagc

SEQ ID NO: 566946 - DNA, 25 bp, Rattus norvegicus
cagcagcagctgacactgatgccgc

SEQ ID NO: 566947 - DNA, 25 bp, Rattus norvegicus
gcagccccaggtgcagctcggagta

SEQ ID NO: 566948 - DNA, 25 bp, Rattus norvegicus
tcagctccgtgtggccggagtccgt

SEQ ID NO: 566949 - DNA, 25 bp, Rattus norvegicus
cagctcggagtagaggtgcgagccc

SEQ ID NO: 566950 - DNA, 25 bp, Rattus norvegicus
gcagctgacactgatgccgccactt

SEQ ID NO: 566951 - DNA, 25 bp, Rattus norvegicus
gcgcgactcaccttggggagccaac

SEQ ID NO: 566952 - DNA, 25 bp, Rattus norvegicus
ggtcagcgctgaccgggagaagacg

SEQ ID NO: 566953 - DNA, 25 bp, Rattus norvegicus
acaccgcctagtcgcgaggcggtca

SEQ ID NO: 566954 - DNA, 25 bp, Rattus norvegicus
ccaggaggcgcaccgctacaccgcc

SEQ ID NO: 566955 - DNA, 25 bp, Rattus norvegicus
catcaggggccacccgggcacttgg

SEQ ID NO: 566956 - DNA, 25 bp, Rattus norvegicus
cgtcccggcccaggcatcaggggcc

SEQ ID NO: 566957 - DNA, 25 bp, Rattus norvegicus
actttctgcgggtgcctcccaggaa

SEQ ID NO: 566958 - DNA, 25 bp, Rattus norvegicus
tcgctggggcaaacttgggagaact

SEQ ID NO: 566959 - DNA, 25 bp, Rattus norvegicus
cctggcctctagagcaggggaagat

SEQ ID NO: 566960 - DNA, 25 bp, Rattus norvegicus
tgctacctccgtggctggcctagag

SEQ ID NO: 566961 - DNA, 25 bp, Rattus norvegicus
accggctaccatggggacacattgc

SEQ ID NO: 566962 - DNA, 25 bp, Rattus norvegicus
tgttgctcagttggtgctcactttc

SEQ ID NO: 566963 - DNA, 25 bp, Rattus norvegicus
ttacggtgccaagggattcagcctg

SEQ ID NO: 566964 - DNA, 25 bp, Rattus norvegicus
ggctgtgattcttcctctctccggg

SEQ ID NO: 566965 - DNA, 25 bp, Rattus norvegicus
ttgcaccatgccttcttggatccgg

SEQ ID NO: 566966 - DNA, 25 bp, Rattus norvegicus
cctccatctggcttataaaagtttg

SEQ ID NO: 566967 - DNA, 25 bp, Rattus norvegicus
ggacacattgctcgggtccctagga

SEQ ID NO: 566968 - DNA, 25 bp, Rattus norvegicus
tggttggcttgccatcctccatctg

SEQ ID NO: 566969 - DNA, 25 bp, Rattus norvegicus
ccgaggtggacttgcatgttgcacc

SEQ ID NO: 566970 - DNA, 25 bp, Rattus norvegicus
tcgctcagcgccaccgtcttagtgg

SEQ ID NO: 566971 - DNA, 25 bp, Rattus norvegicus
ggtgtctgtctgcacctcggtgcac

SEQ ID NO: 566972 - DNA, 25 bp, Rattus norvegicus
ggtcatcctgatttcgaaggacgta

SEQ ID NO: 566973 - DNA, 25 bp, Rattus norvegicus
ccgctccagggcctggtgtctgtct

SEQ ID NO: 566974 - DNA, 25 bp, Rattus norvegicus
tgcactggccgcgaccgtctagaaa

SEQ ID NO: 566975 - DNA, 25 bp, Rattus norvegicus
cgaccgtctagaaagccgcatatgt

SEQ ID NO: 566976 - DNA, 25 bp, Rattus norvegicus
cgcatatgttgtttgcctcggggcc

SEQ ID NO: 566977 - DNA, 25 bp, Rattus norvegicus
gcagcattctttgttcagcacgcca

SEQ ID NO: 566978 - DNA, 25 bp, Rattus norvegicus
gttcagcacgccatccaaggtcatg

SEQ ID NO: 566979 - DNA, 25 bp, Rattus norvegicus
caaggtcatgcagacgcggggaaac

SEQ ID NO: 566980 - DNA, 25 bp, Rattus norvegicus
acgcggggaaactgagcccgagctc

SEQ ID NO: 566981 - DNA, 25 bp, Rattus norvegicus
tgagcccgagctccgagcagaattc

SEQ ID NO: 566982 - DNA, 25 bp, Rattus norvegicus
cgagctccgagcagaattccgcagc

SEQ ID NO: 566983 - DNA, 25 bp, Rattus norvegicus
cccatgccttcttaattgggaggcc

SEQ ID NO: 566984 - DNA, 25 bp, Rattus norvegicus
tcgcacgaggcccatgccttcttaa

SEQ ID NO: 566985 - DNA, 25 bp, Rattus norvegicus
aaggcggcctggaagcattgcgcac

SEQ ID NO: 566986 - DNA, 25 bp, Rattus norvegicus
ttctcacgccggagactcccgacgg

SEQ ID NO: 566987 - DNA, 25 bp, Rattus norvegicus
caagataggaccctcctttctcacg

SEQ ID NO: 566988 - DNA, 25 bp, Rattus norvegicus
tgttccacaacaagataggaccctc

SEQ ID NO: 566989 - DNA, 25 bp, Rattus norvegicus
ccggcctgttccacaacaagatagg

SEQ ID NO: 566990 - DNA, 25 bp, Rattus norvegicus
ggaagacccggcctgttccacaaca

SEQ ID NO: 566991 - DNA, 25 bp, Rattus norvegicus
ggaagtgccagtgcctgttgcctgc

SEQ ID NO: 566992 - DNA, 25 bp, Rattus norvegicus
gatcttctcgcctccagggaagacc

SEQ ID NO: 566993 - DNA, 25 bp, Rattus norvegicus
acgcgatcttctcgcctccagggaa

SEQ ID NO: 566994 - DNA, 25 bp, Rattus norvegicus
aggacatttgtacgcgatcttctcg

SEQ ID NO: 566995 - DNA, 25 bp, Rattus norvegicus
agccgaaggacatttgtacgcgatc

SEQ ID NO: 566996 - DNA, 25 bp, Rattus norvegicus
gcattaaaaattgggagccgaagga

SEQ ID NO: 566997 - DNA, 25 bp, Rattus norvegicus
gcgcaggaggatcggcattaaaaat

SEQ ID NO: 566998 - DNA, 25 bp, Rattus norvegicus
cgacgacacccggaagtgccagtgc

SEQ ID NO: 566999 - DNA, 25 bp, Rattus norvegicus
acgtgccaccagtgctcggtgctgc

SEQ ID NO: 567000 - DNA, 25 bp, Rattus norvegicus
gacctacctgttttgggctcttcgc

SEQ ID NO: 567001 - DNA, 25 bp, Rattus norvegicus
tccgggatagcctcgtagacattct

SEQ ID NO: 567002 - DNA, 25 bp, Rattus norvegicus
agacattctccgagtcgctacgcgc

SEQ ID NO: 567003 - DNA, 25 bp, Rattus norvegicus
agcccgccacgctggaggccttgaa

SEQ ID NO: 567004 - DNA, 25 bp, Rattus norvegicus
ggctcggcagaagacccatcggcac

SEQ ID NO: 567005 - DNA, 25 bp, Rattus norvegicus
ctcacgaagcggtagtcgtaggcca

SEQ ID NO: 567006 - DNA, 25 bp, Rattus norvegicus
ccggcagctcgcgtacgtactgagc

SEQ ID NO: 567007 - DNA, 25 bp, Rattus norvegicus
acgctcattgggttggatggcgata

SEQ ID NO: 567008 - DNA, 25 bp, Rattus norvegicus
ccgtctttgccggtgtactcgaagg

SEQ ID NO: 567009 - DNA, 25 bp, Rattus norvegicus
aaggggtgctccaccagcacgtaca

SEQ ID NO: 567010 - DNA, 25 bp, Rattus norvegicus
tccgggctcaaagacaagggttcga

SEQ ID NO: 567011 - DNA, 25 bp, Rattus norvegicus
gcgcagcagtcggtaacgctcattg

SEQ ID NO: 567012 - DNA, 25 bp, Rattus norvegicus
gcagccgggaagagcatcgagttcc

SEQ ID NO: 567013 - DNA, 25 bp, Rattus norvegicus
gacacgcagttcaaggtcgtacttc

SEQ ID NO: 567014 - DNA, 25 bp, Rattus norvegicus
tccatgattgagagacacgcagttc

SEQ ID NO: 567015 - DNA, 25 bp, Rattus norvegicus
agcagcagcgcccacacagtataga

SEQ ID NO: 567016 - DNA, 25 bp, Rattus norvegicus
ctcggagcctacactagcagcagca

SEQ ID NO: 567017 - DNA, 25 bp, Rattus norvegicus
ccctccttgggttccgagtgatggt

SEQ ID NO: 567018 - DNA, 25 bp, Rattus norvegicus
tacttcccaaggctccgggctggta

SEQ ID NO: 567019 - DNA, 25 bp, Rattus norvegicus
gtatagacggccaatcccgagcctg

SEQ ID NO: 567020 - DNA, 25 bp, Rattus norvegicus
acccaggcggtagatgagaattacg

SEQ ID NO: 567021 - DNA, 25 bp, Rattus norvegicus
gggtcgtcttgatccatgattgaga

SEQ ID NO: 567022 - DNA, 25 bp, Rattus norvegicus
agaattacggagtttgcctcgagtg

SEQ ID NO: 567023 - DNA, 25 bp, Rattus norvegicus
gtgggtctacggtccgagacataca

SEQ ID NO: 567024 - DNA, 25 bp, Rattus norvegicus
ctcagtcaacgcttcggctgggtcg

SEQ ID NO: 567025 - DNA, 25 bp, Rattus norvegicus
tgctgccgcttgcaataactctagc

SEQ ID NO: 567026 - DNA, 25 bp, Rattus norvegicus
cgccgcaatagcaaaagcctaggta

SEQ ID NO: 567027 - DNA, 25 bp, Rattus norvegicus
aagtcgcagagacttccgggttctc

SEQ ID NO: 567028 - DNA, 25 bp, Rattus norvegicus
tctgaagacccgagggaagcacctt

SEQ ID NO: 567029 - DNA, 25 bp, Rattus norvegicus
cttcgcaaagctgccgggaggacca

SEQ ID NO: 567030 - DNA, 25 bp, Rattus norvegicus
gcagccgacatcttcagctccgtgg

SEQ ID NO: 567031 - DNA, 25 bp, Rattus norvegicus
gacatcttcagctccgtggcgccag

SEQ ID NO: 567032 - DNA, 25 bp, Rattus norvegicus
gccgtaaagcgcgtctgaagacccg

SEQ ID NO: 567033 - DNA, 25 bp, Rattus norvegicus
gacccgcttcgcaaagctgccggga

SEQ ID NO: 567034 - DNA, 25 bp, Rattus norvegicus
cgagggaagcaccttcacgacgttt

SEQ ID NO: 567035 - DNA, 25 bp, Rattus norvegicus
agcaccttcacgacgttttacgaca

SEQ ID NO: 567036 - DNA, 25 bp, Rattus norvegicus
cacgacgttttacgacacgactcgc

SEQ ID NO: 567037 - DNA, 25 bp, Rattus norvegicus
cacgttcaaaggaagtcgcagagac

SEQ ID NO: 567038 - DNA, 25 bp, Rattus norvegicus
ggttctcccagagcacagctggagg

SEQ ID NO: 567039 - DNA, 25 bp, Rattus norvegicus
gacttccgggttctcccagagcaca

SEQ ID NO: 567040 - DNA, 25 bp, Rattus norvegicus
cccgacacgttcaaaggaagtcgca

SEQ ID NO: 567041 - DNA, 25 bp, Rattus norvegicus
gacgtcaatgacaggcgcgcgcacc

SEQ ID NO: 567042 - DNA, 25 bp, Rattus norvegicus
ccgagggctccatttaaaacaggcg

SEQ ID NO: 567043 - DNA, 25 bp, Rattus norvegicus
ggccacgtatttctcagctcttttc

SEQ ID NO: 567044 - DNA, 25 bp, Rattus norvegicus
ctcgcaactttacgaagaacgcgtt

SEQ ID NO: 567045 - DNA, 25 bp, Rattus norvegicus
cggccatttcgagttccacggtagg

SEQ ID NO: 567046 - DNA, 25 bp, Rattus norvegicus
tggccgtcaatttctggctccgcgc

SEQ ID NO: 567047 - DNA, 25 bp, Rattus norvegicus
gggcgattgtttccagcatccgtaa

SEQ ID NO: 567048 - DNA, 25 bp, Rattus norvegicus
tccgcaaaggctactagggcgattg

SEQ ID NO: 567049 - DNA, 25 bp, Rattus norvegicus
gcaccggtgcgcaatggcgtaatcc

SEQ ID NO: 567050 - DNA, 25 bp, Rattus norvegicus
tcctggaaagcctcagacgtcaatg

SEQ ID NO: 567051 - DNA, 25 bp, Rattus norvegicus
gccagctatacacttcggccacgta

SEQ ID NO: 567052 - DNA, 25 bp, Rattus norvegicus
tgagggtgttttcctgccagctata

SEQ ID NO: 567053 - DNA, 25 bp, Rattus norvegicus
gaacgcgttccaactcttgagggtg

SEQ ID NO: 567054 - DNA, 25 bp, Rattus norvegicus
ccagggccagagcatcggccatttc

SEQ ID NO: 567055 - DNA, 25 bp, Rattus norvegicus
tctggcgacgcttagcaagaggata

SEQ ID NO: 567056 - DNA, 25 bp, Rattus norvegicus
ccgctgtctggcgacgcttagcaag

SEQ ID NO: 567057 - DNA, 25 bp, Rattus norvegicus
ggcacacagagactcgctcaagctc

SEQ ID NO: 567058 - DNA, 25 bp, Rattus norvegicus
agagactcgctcaagctcgggcggc

SEQ ID NO: 567059 - DNA, 25 bp, Rattus norvegicus
gctcagcaccgcgggaatccggaat

SEQ ID NO: 567060 - DNA, 25 bp, Rattus norvegicus
aatccggaatgagcgaagttgccgc

SEQ ID NO: 567061 - DNA, 25 bp, Rattus norvegicus
cgacgcttagcaagaggatacaccc

SEQ ID NO: 567062 - DNA, 25 bp, Rattus norvegicus
aggatacaccctctcatgtttattc

SEQ ID NO: 567063 - DNA, 25 bp, Rattus norvegicus
ctctcatgtttattcacgctcctta

SEQ ID NO: 567064 - DNA, 25 bp, Rattus norvegicus
ttcacgctccttaaacagccgcgtt

SEQ ID NO: 567065 - DNA, 25 bp, Rattus norvegicus
aacagccgcgttctcatacatattc

SEQ ID NO: 567066 - DNA, 25 bp, Rattus norvegicus
ctcatacatattcatcaaccgctcg

SEQ ID NO: 567067 - DNA, 25 bp, Rattus norvegicus
tgtgccaagtgcgaggcacacagag

SEQ ID NO: 567068 - DNA, 25 bp, Rattus norvegicus
atgagcgaagttgccgcgactctgt

SEQ ID NO: 567069 - DNA, 25 bp, Rattus norvegicus
cgagggacggaaagacaaacactgc

SEQ ID NO: 567070 - DNA, 25 bp, Rattus norvegicus
tccaccggcttggacatgctgtcgc

SEQ ID NO: 567071 - DNA, 25 bp, Rattus norvegicus
ctccgcccggaggaaatcaatgttg

SEQ ID NO: 567072 - DNA, 25 bp, Rattus norvegicus
tctggccgagctctaagaaaaaatc

SEQ ID NO: 567073 - DNA, 25 bp, Rattus norvegicus
gaccctggaacttctcctcggtgtc

SEQ ID NO: 567074 - DNA, 25 bp, Rattus norvegicus
ggcactttgccctctgctttttgtc

SEQ ID NO: 567075 - DNA, 25 bp, Rattus norvegicus
tgtcccgttgctttggctcgccaac

SEQ ID NO: 567076 - DNA, 25 bp, Rattus norvegicus
agccttaaacgccaagcagtccgga

SEQ ID NO: 567077 - DNA, 25 bp, Rattus norvegicus
cccggtgactttctcgtttgacaga

SEQ ID NO: 567078 - DNA, 25 bp, Rattus norvegicus
tccttcatgtgcatggctcgcaggc

SEQ ID NO: 567079 - DNA, 25 bp, Rattus norvegicus
aaacactgcagtggccggtcttctg

SEQ ID NO: 567080 - DNA, 25 bp, Rattus norvegicus
ttctccgactcggtgagcagcttcc

SEQ ID NO: 567081 - DNA, 25 bp, Rattus norvegicus
aggatccaccaagttgagcctcgga

SEQ ID NO: 567082 - DNA, 25 bp, Rattus norvegicus
ggcgaacttgtcctttttgagcagc

SEQ ID NO: 567083 - DNA, 25 bp, Rattus norvegicus
ttccttcatattttccgcgctgcca

SEQ ID NO: 567084 - DNA, 25 bp, Rattus norvegicus
tttgagccggagcagattgcagcta

SEQ ID NO: 567085 - DNA, 25 bp, Rattus norvegicus
ctaggagccggcgaccagtcgaatc

SEQ ID NO: 567086 - DNA, 25 bp, Rattus norvegicus
tcgaatccgacgcttccttccagag

SEQ ID NO: 567087 - DNA, 25 bp, Rattus norvegicus
acacactgggcggaaactccgggcg

SEQ ID NO: 567088 - DNA, 25 bp, Rattus norvegicus
caggagcattccactcggggagagc

SEQ ID NO: 567089 - DNA, 25 bp, Rattus norvegicus
tgtccttagcgcagcaccagggagc

SEQ ID NO: 567090 - DNA, 25 bp, Rattus norvegicus
tgtccctccagcttccttcatattt

SEQ ID NO: 567091 - DNA, 25 bp, Rattus norvegicus
gtggcaccggagctcagcacggtcc

SEQ ID NO: 567092 - DNA, 25 bp, Rattus norvegicus
atgctcccgtcagggcaaggtcctg

SEQ ID NO: 567093 - DNA, 25 bp, Rattus norvegicus
aggtcgagcccgtggatgctcccgt

SEQ ID NO: 567094 - DNA, 25 bp, Rattus norvegicus
ctgcagaccgttggcaaccggcttc

SEQ ID NO: 567095 - DNA, 25 bp, Rattus norvegicus
ggcggccggacgcaatcatccgcag

SEQ ID NO: 567096 - DNA, 25 bp, Rattus norvegicus
cgccagggattaggcaggagcattc

SEQ ID NO: 567097 - DNA, 25 bp, Rattus norvegicus
atccactgcggatgcgacacttgtg

SEQ ID NO: 567098 - DNA, 25 bp, Rattus norvegicus
ctccaaacgagaagacaagaacgcc

SEQ ID NO: 567099 - DNA, 25 bp, Rattus norvegicus
acaagaacgccaacagaatcgggtc

SEQ ID NO: 567100 - DNA, 25 bp, Rattus norvegicus
agaatcgggtctcagcgggttcaac

SEQ ID NO: 567101 - DNA, 25 bp, Rattus norvegicus
tggagaagcagtgcccagaacgccc

SEQ ID NO: 567102 - DNA, 25 bp, Rattus norvegicus
cagagtcacaggcatccactgcgga

SEQ ID NO: 567103 - DNA, 25 bp, Rattus norvegicus
tgcgacacttgtgcaatgaacggta

SEQ ID NO: 567104 - DNA, 25 bp, Rattus norvegicus
ttaattcctcgagtgctggagaagc

SEQ ID NO: 567105 - DNA, 25 bp, Rattus norvegicus
caatgaacggtacagaccgtgggcc

SEQ ID NO: 567106 - DNA, 25 bp, Rattus norvegicus
aacgctacgctacgctccaaacgag

SEQ ID NO: 567107 - DNA, 25 bp, Rattus norvegicus
cagggacgatgcgaatctttaattc

SEQ ID NO: 567108 - DNA, 25 bp, Rattus norvegicus
cgggttcaaccctgccgaggcagag

SEQ ID NO: 567109 - DNA, 25 bp, Rattus norvegicus
ggactgtgctacctcagggacgatg

SEQ ID NO: 567110 - DNA, 25 bp, Rattus norvegicus
cccatcataggacgggtggactgtg

SEQ ID NO: 567111 - DNA, 25 bp, Rattus norvegicus
cagggcactcaccagaagaacaagc

SEQ ID NO: 567112 - DNA, 25 bp, Rattus norvegicus
tgtgcaccggcagcatctcgcccgc

SEQ ID NO: 567113 - DNA, 25 bp, Rattus norvegicus
caccagaagaacaagcgcgagcaga

SEQ ID NO: 567114 - DNA, 25 bp, Rattus norvegicus
gcccaggcagggcactcaccagaag

SEQ ID NO: 567115 - DNA, 25 bp, Rattus norvegicus
gaaagcatcctctgaccgtccggga

SEQ ID NO: 567116 - DNA, 25 bp, Rattus norvegicus
gcggtgtagggaaagcatcctctga

SEQ ID NO: 567117 - DNA, 25 bp, Rattus norvegicus
gtggacgccacctgtgtctgccatc

SEQ ID NO: 567118 - DNA, 25 bp, Rattus norvegicus
cacgctttcgggtggacgccacctg

SEQ ID NO: 567119 - DNA, 25 bp, Rattus norvegicus
ggcaccctcgcacctcccacggatc

SEQ ID NO: 567120 - DNA, 25 bp, Rattus norvegicus
cgaaggtgagcatgccgggttcacc

SEQ ID NO: 567121 - DNA, 25 bp, Rattus norvegicus
agatggaaaactagcgaaggtgagc

SEQ ID NO: 567122 - DNA, 25 bp, Rattus norvegicus
ggaacccagcgccagcccgcccaga

SEQ ID NO: 567123 - DNA, 25 bp, Rattus norvegicus
tcctgcagcgggttgggtttcacct

SEQ ID NO: 567124 - DNA, 25 bp, Rattus norvegicus
ttgggtttcacctcggtgtgcaccg

SEQ ID NO: 567125 - DNA, 25 bp, Rattus norvegicus
gtcctgcacgagcacaagctggtgg

SEQ ID NO: 567126 - DNA, 25 bp, Rattus norvegicus
aatgcgtgtccctttactgcgcgcg

SEQ ID NO: 567127 - DNA, 25 bp, Rattus norvegicus
gagctcttccctaattgcataattg

SEQ ID NO: 567128 - DNA, 25 bp, Rattus norvegicus
ctgtcactttacttttgcgcgcgca

SEQ ID NO: 567129 - DNA, 25 bp, Rattus norvegicus
cccgcgtgtccctttaatgcgtgtc

SEQ ID NO: 567130 - DNA, 25 bp, Rattus norvegicus
taagtctccgcaaagtccaggatgg

SEQ ID NO: 567131 - DNA, 25 bp, Rattus norvegicus
ccgcccgggaataccggctgagtgt

SEQ ID NO: 567132 - DNA, 25 bp, Rattus norvegicus
tccaggatggatgtcgcggtgcaaa

SEQ ID NO: 567133 - DNA, 25 bp, Rattus norvegicus
ggctgtcccgagctcttccctaatt

SEQ ID NO: 567134 - DNA, 25 bp, Rattus norvegicus
ttcatccgggcccacgcgaagtttc

SEQ ID NO: 567135 - DNA, 25 bp, Rattus norvegicus
ttactgcgcgcgctcgtcaaggtcc

SEQ ID NO: 567136 - DNA, 25 bp, Rattus norvegicus
ggcccaggactcagctgtcacttta

SEQ ID NO: 567137 - DNA, 25 bp, Rattus norvegicus
cttttgcgcgcgcaccttactggtc

SEQ ID NO: 567138 - DNA, 25 bp, Rattus norvegicus
tgcataattgctacacgaggtgtcc

SEQ ID NO: 567139 - DNA, 25 bp, Rattus norvegicus
gcacggccttggaaatcatcgcctt

SEQ ID NO: 567140 - DNA, 25 bp, Rattus norvegicus
gaaatcatcgccttcgtcgtctcca

SEQ ID NO: 567141 - DNA, 25 bp, Rattus norvegicus
ggccttggaaatcatcgccttcgtc

SEQ ID NO: 567142 - DNA, 25 bp, Rattus norvegicus
ctagcacggccttggaaatcatcgc

SEQ ID NO: 567143 - DNA, 25 bp, Rattus norvegicus
ggctagcacggccttggaaatcatc

SEQ ID NO: 567144 - DNA, 25 bp, Rattus norvegicus
agcatggctagcacggccttggaaa

SEQ ID NO: 567145 - DNA, 25 bp, Rattus norvegicus
tgcagccggcagcatggctagcacg

SEQ ID NO: 567146 - DNA, 25 bp, Rattus norvegicus
cggaaccagcgcgaacgctgctgca

SEQ ID NO: 567147 - DNA, 25 bp, Rattus norvegicus
ggatccggaaccagcgcgaacgctg

SEQ ID NO: 567148 - DNA, 25 bp, Rattus norvegicus
cgagggatccggaaccagcgcgaac

SEQ ID NO: 567149 - DNA, 25 bp, Rattus norvegicus
cctcaagtgcccagtgggcgggacg

SEQ ID NO: 567150 - DNA, 25 bp, Rattus norvegicus
tccgccagcgccctcaagtgcccag

SEQ ID NO: 567151 - DNA, 25 bp, Rattus norvegicus
cgcgacctgagtgccctgacccgca

SEQ ID NO: 567152 - DNA, 25 bp, Rattus norvegicus
cttggaaatcatcgccttcgtcgtc

SEQ ID NO: 567153 - DNA, 25 bp, Rattus norvegicus
gcgcgttcagcatgcgcccagggac

SEQ ID NO: 567154 - DNA, 25 bp, Rattus norvegicus
cggcctaagattctgggcgtccagg

SEQ ID NO: 567155 - DNA, 25 bp, Rattus norvegicus
cccgacctggagtgcagggcgtatc

SEQ ID NO: 567156 - DNA, 25 bp, Rattus norvegicus
gccggcaaccttgtccacgtcgatg

SEQ ID NO: 567157 - DNA, 25 bp, Rattus norvegicus
gcgtccaggacgttgctatggcagc

SEQ ID NO: 567158 - DNA, 25 bp, Rattus norvegicus
ctctcgtgagcctgagatgtccctg

SEQ ID NO: 567159 - DNA, 25 bp, Rattus norvegicus
gccactcctctcgtgagcctgagat

SEQ ID NO: 567160 - DNA, 25 bp, Rattus norvegicus
aggagcagtgtcgtgtccctgaccc

SEQ ID NO: 567161 - DNA, 25 bp, Rattus norvegicus
gttcgcctcctaggcttgcggtgga

SEQ ID NO: 567162 - DNA, 25 bp, Rattus norvegicus
tgcttgcaagccagttcgcctccta

SEQ ID NO: 567163 - DNA, 25 bp, Rattus norvegicus
ggccacgtgcatcttaccatgcttg

SEQ ID NO: 567164 - DNA, 25 bp, Rattus norvegicus
gccagagggtagtagacgtgcttct

SEQ ID NO: 567165 - DNA, 25 bp, Rattus norvegicus
agtcgcggccgaaactgaaagaagg

SEQ ID NO: 567166 - DNA, 25 bp, Rattus norvegicus
agtgcagggcgtatccgcccacgcg

SEQ ID NO: 567167 - DNA, 25 bp, Rattus norvegicus
agagccgcctagagtcaggcgcagc

SEQ ID NO: 567168 - DNA, 25 bp, Rattus norvegicus
catccgttcagcgaagacctgggca

SEQ ID NO: 567169 - DNA, 25 bp, Rattus norvegicus
atcagagccgcctagagtcaggcgc

SEQ ID NO: 567170 - DNA, 25 bp, Rattus norvegicus
acagacgatgctgggccgcgtgccc

SEQ ID NO: 567171 - DNA, 25 bp, Rattus norvegicus
ccgtgttgggcgcagacagacgatg

SEQ ID NO: 567172 - DNA, 25 bp, Rattus norvegicus
gttcagcgaagacctgggcaccagc

SEQ ID NO: 567173 - DNA, 25 bp, Rattus norvegicus
cggccatccgttcagcgaagacctg

SEQ ID NO: 567174 - DNA, 25 bp, Rattus norvegicus
gttgccggccatccgttcagcgaag

SEQ ID NO: 567175 - DNA, 25 bp, Rattus norvegicus
caactctaggttgccggccatccgt

SEQ ID NO: 567176 - DNA, 25 bp, Rattus norvegicus
gccctcggccagtagcaactctagg

SEQ ID NO: 567177 - DNA, 25 bp, Rattus norvegicus
aggccttggccctcggccagtagca

SEQ ID NO: 567178 - DNA, 25 bp, Rattus norvegicus
cgtgcccggatcagagccgcctaga

SEQ ID NO: 567179 - DNA, 25 bp, Rattus norvegicus
cctgcaggaaaagggctcggcgctc

SEQ ID NO: 567180 - DNA, 25 bp, Rattus norvegicus
aagacctgggcaccagcgaagggcc

SEQ ID NO: 567181 - DNA, 25 bp, Rattus norvegicus
gcgctgcaagacacggggattcacg

SEQ ID NO: 567182 - DNA, 25 bp, Rattus norvegicus
tcgccaacagagatgcgagatgctc

SEQ ID NO: 567183 - DNA, 25 bp, Rattus norvegicus
cagctgctgcagacacgtgatgcta

SEQ ID NO: 567184 - DNA, 25 bp, Rattus norvegicus
atgcgagatgctctgtgtggctgaa

SEQ ID NO: 567185 - DNA, 25 bp, Rattus norvegicus
aagtccggcggacgcctggagcatc

SEQ ID NO: 567186 - DNA, 25 bp, Rattus norvegicus
ctggagcatcctagacctcagctca

SEQ ID NO: 567187 - DNA, 25 bp, Rattus norvegicus
tccagatcctgggattgctgctggc

SEQ ID NO: 567188 - DNA, 25 bp, Rattus norvegicus
cgggctccttcttccagggtgcaag

SEQ ID NO: 567189 - DNA, 25 bp, Rattus norvegicus
tccagggtgcaagataaagcgtgtc

SEQ ID NO: 567190 - DNA, 25 bp, Rattus norvegicus
gataaagcgtgtctggtccgggcaa

SEQ ID NO: 567191 - DNA, 25 bp, Rattus norvegicus
gcagcactaaaaagcgctcctccaa

SEQ ID NO: 567192 - DNA, 25 bp, Rattus norvegicus
caagttgtgacgaggccggtagccc

SEQ ID NO: 567193 - DNA, 25 bp, Rattus norvegicus
gcgcctagaccgcagcactaaaaag

SEQ ID NO: 567194 - DNA, 25 bp, Rattus norvegicus
ctctccggtcttctggtggcctctt

SEQ ID NO: 567195 - DNA, 25 bp, Rattus norvegicus
cagcctgcaacgctggcccagaaga

SEQ ID NO: 567196 - DNA, 25 bp, Rattus norvegicus
ccagaagagttctgaggcccgcgca

SEQ ID NO: 567197 - DNA, 25 bp, Rattus norvegicus
cggcggtttggagcccgctcacagc

SEQ ID NO: 567198 - DNA, 25 bp, Rattus norvegicus
agcctcgtcttgtgcttccacgtta

SEQ ID NO: 567199 - DNA, 25 bp, Rattus norvegicus
ttccacgttaccctatcagagatgg

SEQ ID NO: 567200 - DNA, 25 bp, Rattus norvegicus
cccgagcgctgaccgactgagcgga

SEQ ID NO: 567201 - DNA, 25 bp, Rattus norvegicus
accttcctgctcttcggctcaggtg

SEQ ID NO: 567202 - DNA, 25 bp, Rattus norvegicus
cttcggctcaggtgcccttggacat

SEQ ID NO: 567203 - DNA, 25 bp, Rattus norvegicus
tgttcccgttcctgcttgtcctggt

SEQ ID NO: 567204 - DNA, 25 bp, Rattus norvegicus
tgtcctggtggacctgcagtacgaa

SEQ ID NO: 567205 - DNA, 25 bp, Rattus norvegicus
gcgggcttcggatcctagtcccggc

SEQ ID NO: 567206 - DNA, 25 bp, Rattus norvegicus
gggacgggtcctattcctgaagcca

SEQ ID NO: 567207 - DNA, 25 bp, Rattus norvegicus
agggaacctgggctcgctccaggaa

SEQ ID NO: 567208 - DNA, 25 bp, Rattus norvegicus
cctgcagtacgaaggtgagtcccgc

SEQ ID NO: 567209 - DNA, 25 bp, Rattus norvegicus
ctcgctccagaagaccgcagatgta

SEQ ID NO: 567210 - DNA, 25 bp, Rattus norvegicus
cgctcagaaacaggaatgaacccgg

SEQ ID NO: 567211 - DNA, 25 bp, Rattus norvegicus
acagagttgtgctgtgacgaccgtc

SEQ ID NO: 567212 - DNA, 25 bp, Rattus norvegicus
acgaccgtcgggagcagtaatgctc

SEQ ID NO: 567213 - DNA, 25 bp, Rattus norvegicus
gccatgtccacaagacgctcagaaa

SEQ ID NO: 567214 - DNA, 25 bp, Rattus norvegicus
cactggatcaaagagccgctaggtt

SEQ ID NO: 567215 - DNA, 25 bp, Rattus norvegicus
cccggactggatggacatcggatct

SEQ ID NO: 567216 - DNA, 25 bp, Rattus norvegicus
catcggatctgaagggaccctggtc

SEQ ID NO: 567217 - DNA, 25 bp, Rattus norvegicus
tctcgggccacttcgcagccaagtg

SEQ ID NO: 567218 - DNA, 25 bp, Rattus norvegicus
aacgtaggagcagccgcagtccctt

SEQ ID NO: 567219 - DNA, 25 bp, Rattus norvegicus
gcgcgagaagccacgctaaggtctg

SEQ ID NO: 567220 - DNA, 25 bp, Rattus norvegicus
aaggtctgctcctcctggtaccctg

SEQ ID NO: 567221 - DNA, 25 bp, Rattus norvegicus
cgcgcagagggaagagaaaacactg

SEQ ID NO: 567222 - DNA, 25 bp, Rattus norvegicus
gctgcagtccgttactcggcctgtc

SEQ ID NO: 567223 - DNA, 25 bp, Rattus norvegicus
agcgggaccatggatgaaaggttca

SEQ ID NO: 567224 - DNA, 25 bp, Rattus norvegicus
tagcagggctcttgtcacaccggct

SEQ ID NO: 567225 - DNA, 25 bp, Rattus norvegicus
ctgcaccaacttcggggagcagctc

SEQ ID NO: 567226 - DNA, 25 bp, Rattus norvegicus
tcacctgccggcctgagagcgggac

SEQ ID NO: 567227 - DNA, 25 bp, Rattus norvegicus
gtgctcactctcctcttcgtggtca

SEQ ID NO: 567228 - DNA, 25 bp, Rattus norvegicus
gagtcctgcccgacgagcacaggca

SEQ ID NO: 567229 - DNA, 25 bp, Rattus norvegicus
tgaaaggttcaacaagtggctgctg

SEQ ID NO: 567230 - DNA, 25 bp, Rattus norvegicus
cgcgccctggcgagcctcatgaagt

SEQ ID NO: 567231 - DNA, 25 bp, Rattus norvegicus
agcctcatgaagtccctgtgctcgc

SEQ ID NO: 567232 - DNA, 25 bp, Rattus norvegicus
gatgcttcgtgtcgcctgagagcgc

SEQ ID NO: 567233 - DNA, 25 bp, Rattus norvegicus
gggcagccagacagtcacgctcttt

SEQ ID NO: 567234 - DNA, 25 bp, Rattus norvegicus
acagtcacgctctttggcggtaggg

SEQ ID NO: 567235 - DNA, 25 bp, Rattus norvegicus
ccgaaacttccgagcaggcgctcga

SEQ ID NO: 567236 - DNA, 25 bp, Rattus norvegicus
tggtcatcatgtaccagtacgtgtc

SEQ ID NO: 567237 - DNA, 25 bp, Rattus norvegicus
ggagctcggcttacgtcaaactcga

SEQ ID NO: 567238 - DNA, 25 bp, Rattus norvegicus
ttgtgtaacttatggcagcggccct

SEQ ID NO: 567239 - DNA, 25 bp, Rattus norvegicus
ttcgtgaccggcaccttcattgaga

SEQ ID NO: 567240 - DNA, 25 bp, Rattus norvegicus
agcggcccttaaggctcacgttgtt

SEQ ID NO: 567241 - DNA, 25 bp, Rattus norvegicus
caaagctctctgaaggctgacaagc

SEQ ID NO: 567242 - DNA, 25 bp, Rattus norvegicus
gacaagctgagtgatgtcggccaca

SEQ ID NO: 567243 - DNA, 25 bp, Rattus norvegicus
tgctccctcagttgtagctccgctg

SEQ ID NO: 567244 - DNA, 25 bp, Rattus norvegicus
ggcaaatccgccctgaccgtgcagt

SEQ ID NO: 567245 - DNA, 25 bp, Rattus norvegicus
ccagcaaaccctgagcgtgggagtc

SEQ ID NO: 567246 - DNA, 25 bp, Rattus norvegicus
cgcagacgcagtacggaggcctgta

SEQ ID NO: 567247 - DNA, 25 bp, Rattus norvegicus
tctgcggaagccgagtctcgctaga

SEQ ID NO: 567248 - DNA, 25 bp, Rattus norvegicus
aggagggccttcctctatgctccgc

SEQ ID NO: 567249 - DNA, 25 bp, Rattus norvegicus
aagcacggtgcgcatgtctccctgt

SEQ ID NO: 567250 - DNA, 25 bp, Rattus norvegicus
cgccgactagcggagcttcgatttg

SEQ ID NO: 567251 - DNA, 25 bp, Rattus norvegicus
cggcggagcagcaacagttctacct

SEQ ID NO: 567252 - DNA, 25 bp, Rattus norvegicus
tcacgcctagcgcaatggcggcggc

SEQ ID NO: 567253 - DNA, 25 bp, Rattus norvegicus
tctctcacgcctagcgcaatggcgg

SEQ ID NO: 567254 - DNA, 25 bp, Rattus norvegicus
cacgccgcgagccaatgggacacgg

SEQ ID NO: 567255 - DNA, 25 bp, Rattus norvegicus
gtgcgtggccaatccgcgtggccct

SEQ ID NO: 567256 - DNA, 25 bp, Rattus norvegicus
cgacaccgcagggtgcgtggccaat

SEQ ID NO: 567257 - DNA, 25 bp, Rattus norvegicus
cgcgcgctggagtgacgacaccgca

SEQ ID NO: 567258 - DNA, 25 bp, Rattus norvegicus
aacctcgttgtacagcggccctacg

SEQ ID NO: 567259 - DNA, 25 bp, Rattus norvegicus
gcaacagttctacctgctcctggga

SEQ ID NO: 567260 - DNA, 25 bp, Rattus norvegicus
cccgggcgccgaaatctcccgcgct

SEQ ID NO: 567261 - DNA, 25 bp, Rattus norvegicus
cccgacaatgtggtccggaaacagg

SEQ ID NO: 567262 - DNA, 25 bp, Rattus norvegicus
cggacagcggctccacagcccacgt

SEQ ID NO: 567263 - DNA, 25 bp, Rattus norvegicus
ggaaacctgctcagccccgacaatg

SEQ ID NO: 567264 - DNA, 25 bp, Rattus norvegicus
gttctacctgctcctgggaaacctg

SEQ ID NO: 567265 - DNA, 25 bp, Rattus norvegicus
cttagaaagctgtgcctgcgtttat

SEQ ID NO: 567266 - DNA, 25 bp, Rattus norvegicus
acttcgatttcctttgccgcggtga

SEQ ID NO: 567267 - DNA, 25 bp, Rattus norvegicus
tgccggcttagaaagctgtgcctgc

SEQ ID NO: 567268 - DNA, 25 bp, Rattus norvegicus
gccggcttagaaagctgtgcctgcg

SEQ ID NO: 567269 - DNA, 25 bp, Rattus norvegicus
ccggcttagaaagctgtgcctgcgt

SEQ ID NO: 567270 - DNA, 25 bp, Rattus norvegicus
gctgtgcctgcgtttattaagttgc

SEQ ID NO: 567271 - DNA, 25 bp, Rattus norvegicus
ctgtgcctgcgtttattaagttgcg

SEQ ID NO: 567272 - DNA, 25 bp, Rattus norvegicus
aaagctgtgcctgcgtttattaagt

SEQ ID NO: 567273 - DNA, 25 bp, Rattus norvegicus
agctgtgcctgcgtttattaagttg

SEQ ID NO: 567274 - DNA, 25 bp, Rattus norvegicus
gcttagaaagctgtgcctgcgttta

SEQ ID NO: 567275 - DNA, 25 bp, Rattus norvegicus
gaaagctgtgcctgcgtttattaag

SEQ ID NO: 567276 - DNA, 25 bp, Rattus norvegicus
ttagaaagctgtgcctgcgtttatt

SEQ ID NO: 567277 - DNA, 25 bp, Rattus norvegicus
agaaagctgtgcctgcgtttattaa

SEQ ID NO: 567278 - DNA, 25 bp, Rattus norvegicus
cggcttagaaagctgtgcctgcgtt

SEQ ID NO: 567279 - DNA, 25 bp, Rattus norvegicus
ggtgcatctcagacatcagctcttg

SEQ ID NO: 567280 - DNA, 25 bp, Rattus norvegicus
tcaacaatagcaggagccgcggttc

SEQ ID NO: 567281 - DNA, 25 bp, Rattus norvegicus
ccttgggaaccggtggagctcacct

SEQ ID NO: 567282 - DNA, 25 bp, Rattus norvegicus
ggccgcaggcccttcaacaatagca

SEQ ID NO: 567283 - DNA, 25 bp, Rattus norvegicus
gccacctttgatggctcggacctcg

SEQ ID NO: 567284 - DNA, 25 bp, Rattus norvegicus
gcattccgctcgtcaccagagacta

SEQ ID NO: 567285 - DNA, 25 bp, Rattus norvegicus
caccagagactagcgctggcgtctc

SEQ ID NO: 567286 - DNA, 25 bp, Rattus norvegicus
gtctccgcggtggagcttcttcccg

SEQ ID NO: 567287 - DNA, 25 bp, Rattus norvegicus
ttcttcccgcgctcggcttggtggt

SEQ ID NO: 567288 - DNA, 25 bp, Rattus norvegicus
gccgcccaagtaagggacagctcta

SEQ ID NO: 567289 - DNA, 25 bp, Rattus norvegicus
gcggtaacacctttctgcgcacctg

SEQ ID NO: 567290 - DNA, 25 bp, Rattus norvegicus
cgaggcggcaacttgtgcgagtccc

SEQ ID NO: 567291 - DNA, 25 bp, Rattus norvegicus
atacacccggccgaggcggcaactt

SEQ ID NO: 567292 - DNA, 25 bp, Rattus norvegicus
cgcaggtcacagctcggacgctgga

SEQ ID NO: 567293 - DNA, 25 bp, Rattus norvegicus
tccgcttgcctggaagaaccggttc

SEQ ID NO: 567294 - DNA, 25 bp, Rattus norvegicus
ctctatttggtgatgtggctcttta

SEQ ID NO: 567295 - DNA, 25 bp, Rattus norvegicus
tcacagaattgaggagggttatccc

SEQ ID NO: 567296 - DNA, 25 bp, Rattus norvegicus
tatgcacatggtcaggcctcttccc

SEQ ID NO: 567297 - DNA, 25 bp, Rattus norvegicus
tgagacctgtttgcctatgcacatg

SEQ ID NO: 567298 - DNA, 25 bp, Rattus norvegicus
tcccgtcgagctgcacgatatagtc

SEQ ID NO: 567299 - DNA, 25 bp, Rattus norvegicus
ccacaggcgagaggcagagttcctc

SEQ ID NO: 567300 - DNA, 25 bp, Rattus norvegicus
acctccagaactcgggctctatttg

SEQ ID NO: 567301 - DNA, 25 bp, Rattus norvegicus
ccgagtttggggtcagaatgctacc

SEQ ID NO: 567302 - DNA, 25 bp, Rattus norvegicus
aggtcaatcctgtctggacggtcca

SEQ ID NO: 567303 - DNA, 25 bp, Rattus norvegicus
aaacctccgtgtgagacgtcgcctc

SEQ ID NO: 567304 - DNA, 25 bp, Rattus norvegicus
gcgccgttcttaagtaccaagcaga

SEQ ID NO: 567305 - DNA, 25 bp, Rattus norvegicus
actctcgctatgaactcgggtcaca

SEQ ID NO: 567306 - DNA, 25 bp, Rattus norvegicus
tcggcagctggacatcctcaagtta

SEQ ID NO: 567307 - DNA, 25 bp, Rattus norvegicus
gtgcaggcggccgtgcacctgtgcg

SEQ ID NO: 567308 - DNA, 25 bp, Rattus norvegicus
cggccatattggctttgccggcagg

SEQ ID NO: 567309 - DNA, 25 bp, Rattus norvegicus
agcggccatattggctttgccggca

SEQ ID NO: 567310 - DNA, 25 bp, Rattus norvegicus
cgagcggccatattggctttgccgg

SEQ ID NO: 567311 - DNA, 25 bp, Rattus norvegicus
ccgagcggccatattggctttgccg

SEQ ID NO: 567312 - DNA, 25 bp, Rattus norvegicus
gagcaagcttgtcctcggcccgggc

SEQ ID NO: 567313 - DNA, 25 bp, Rattus norvegicus
ggccatattggctttgccggcaggc

SEQ ID NO: 567314 - DNA, 25 bp, Rattus norvegicus
ccagtgctcccggagggtgcaggcg

SEQ ID NO: 567315 - DNA, 25 bp, Rattus norvegicus
gggtcctgcggtcctcggctccacc

SEQ ID NO: 567316 - DNA, 25 bp, Rattus norvegicus
ctgggccgctcgacccttgacggtg

SEQ ID NO: 567317 - DNA, 25 bp, Rattus norvegicus
ctcgacccttgacggtggcggtcac

SEQ ID NO: 567318 - DNA, 25 bp, Rattus norvegicus
acgggccagtgctcccggagggtgc

SEQ ID NO: 567319 - DNA, 25 bp, Rattus norvegicus
ccgctcgacccttgacggtggcggt

SEQ ID NO: 567320 - DNA, 25 bp, Rattus norvegicus
cccgagcggccatattggctttgcc

SEQ ID NO: 567321 - DNA, 25 bp, Rattus norvegicus
gttccctgcaaagcggccttattta

SEQ ID NO: 567322 - DNA, 25 bp, Rattus norvegicus
gcggccaggctgtatctcggtacac

SEQ ID NO: 567323 - DNA, 25 bp, Rattus norvegicus
actgcctccgcgaaggctacaatga

SEQ ID NO: 567324 - DNA, 25 bp, Rattus norvegicus
agcgtggcatgagccagaaaccctg

SEQ ID NO: 567325 - DNA, 25 bp, Rattus norvegicus
gattgagcccggctcgctaccggca

SEQ ID NO: 567326 - DNA, 25 bp, Rattus norvegicus
cggccttatttatctgggcacagcc

SEQ ID NO: 567327 - DNA, 25 bp, Rattus norvegicus
cctgagcagggcttacgtaatcgca

SEQ ID NO: 567328 - DNA, 25 bp, Rattus norvegicus
gccactacttcgtgcagacgggcca

SEQ ID NO: 567329 - DNA, 25 bp, Rattus norvegicus
agacgggccactcgaattgctcttc

SEQ ID NO: 567330 - DNA, 25 bp, Rattus norvegicus
tcagcctggctctagaaccgggatt

SEQ ID NO: 567331 - DNA, 25 bp, Rattus norvegicus
tggagattctcgacacctcagcctg

SEQ ID NO: 567332 - DNA, 25 bp, Rattus norvegicus
ttattgtgcgaacaccggccgctga

SEQ ID NO: 567333 - DNA, 25 bp, Rattus norvegicus
gcctacggggtttgttattgtgcga

SEQ ID NO: 567334 - DNA, 25 bp, Rattus norvegicus
tcggtacacggaattgctgagagga

SEQ ID NO: 567335 - DNA, 25 bp, Rattus norvegicus
agatcccggctgctccggtcggcga

SEQ ID NO: 567336 - DNA, 25 bp, Rattus norvegicus
ttggggagcacaaagctcctgcacc

SEQ ID NO: 567337 - DNA, 25 bp, Rattus norvegicus
tccgagttggggagcacaaagctcc

SEQ ID NO: 567338 - DNA, 25 bp, Rattus norvegicus
cccgaatgagcgcttggcctgagcg

SEQ ID NO: 567339 - DNA, 25 bp, Rattus norvegicus
tccggtcggcgaagatcccggagaa

SEQ ID NO: 567340 - DNA, 25 bp, Rattus norvegicus
actcgcagaggtgtgggttccgcct

SEQ ID NO: 567341 - DNA, 25 bp, Rattus norvegicus
cgggtttgcaacctcgcactttcca

SEQ ID NO: 567342 - DNA, 25 bp, Rattus norvegicus
tttccacaccagaactacaggcttg

SEQ ID NO: 567343 - DNA, 25 bp, Rattus norvegicus
actacaggcttggacgcgaggttac

SEQ ID NO: 567344 - DNA, 25 bp, Rattus norvegicus
ggacgcgaggttacaccttcctgca

SEQ ID NO: 567345 - DNA, 25 bp, Rattus norvegicus
ggactcttggggactgaagaccctg

SEQ ID NO: 567346 - DNA, 25 bp, Rattus norvegicus
tgtccctgtgccaggcccaaacagg

SEQ ID NO: 567347 - DNA, 25 bp, Rattus norvegicus
cggggcctccaaggacactagttca

SEQ ID NO: 567348 - DNA, 25 bp, Rattus norvegicus
aggacactagttcagactcctgccc

SEQ ID NO: 567349 - DNA, 25 bp, Rattus norvegicus
acgtacccattgtggcggctccgag

SEQ ID NO: 567350 - DNA, 25 bp, Rattus norvegicus
cgccgtactcacgtacccattgtgg

SEQ ID NO: 567351 - DNA, 25 bp, Rattus norvegicus
acagaagtgtccttgctcccggcga

SEQ ID NO: 567352 - DNA, 25 bp, Rattus norvegicus
cgcaatctcccttacgacagaagtg

SEQ ID NO: 567353 - DNA, 25 bp, Rattus norvegicus
gccagtgcggatttggtccctgtcc

SEQ ID NO: 567354 - DNA, 25 bp, Rattus norvegicus
gtcctctgccgccagtgcggatttg

SEQ ID NO: 567355 - DNA, 25 bp, Rattus norvegicus
aaacagtcggtcctctgccgccagt

SEQ ID NO: 567356 - DNA, 25 bp, Rattus norvegicus
agtggctacctccaaacagtcggtc

SEQ ID NO: 567357 - DNA, 25 bp, Rattus norvegicus
agaaaactactggagtggctacctc

SEQ ID NO: 567358 - DNA, 25 bp, Rattus norvegicus
tgactacctaggagaaaactactgg

SEQ ID NO: 567359 - DNA, 25 bp, Rattus norvegicus
ccaaccttggcgtctgactacctag

SEQ ID NO: 567360 - DNA, 25 bp, Rattus norvegicus
gtctaagaggttgcgcgtttatgcc

SEQ ID NO: 567361 - DNA, 25 bp, Rattus norvegicus
agcccgcgagtctaagaggttgcgc

SEQ ID NO: 567362 - DNA, 25 bp, Rattus norvegicus
gggagaatgaaagcccgcgagtcta

SEQ ID NO: 567363 - DNA, 25 bp, Rattus norvegicus
ccacagagccttgagggtgcggact

SEQ ID NO: 567364 - DNA, 25 bp, Rattus norvegicus
gtgaacttccgagtctccgtcgaca

SEQ ID NO: 567365 - DNA, 25 bp, Rattus norvegicus
aaggagtggaatccggcgatacctc

SEQ ID NO: 567366 - DNA, 25 bp, Rattus norvegicus
cggatttactagagcgctggccagg

SEQ ID NO: 567367 - DNA, 25 bp, Rattus norvegicus
gtgcggactcgctggcaccctaaag

SEQ ID NO: 567368 - DNA, 25 bp, Rattus norvegicus
tgtgacactgagaagacataagccc

SEQ ID NO: 567369 - DNA, 25 bp, Rattus norvegicus
gcggatctgggtccactttactgtc

SEQ ID NO: 567370 - DNA, 25 bp, Rattus norvegicus
acatgtgactctcggtggaactgga

SEQ ID NO: 567371 - DNA, 25 bp, Rattus norvegicus
ctggacagcgtcgatccgaacgagc

SEQ ID NO: 567372 - DNA, 25 bp, Rattus norvegicus
gcctagggcccaacgcagacattgg

SEQ ID NO: 567373 - DNA, 25 bp, Rattus norvegicus
cagcgtgactccaggacctcgatta

SEQ ID NO: 567374 - DNA, 25 bp, Rattus norvegicus
cctcgattatctcggcagcagtctg

SEQ ID NO: 567375 - DNA, 25 bp, Rattus norvegicus
tgaggacagccgactgatgtgactc

SEQ ID NO: 567376 - DNA, 25 bp, Rattus norvegicus
tccgtcgacacagggagttgctgct

SEQ ID NO: 567377 - DNA, 25 bp, Rattus norvegicus
agtccgctcagaagtaccaagcatg

SEQ ID NO: 567378 - DNA, 25 bp, Rattus norvegicus
ggcgtccttcgctccattctgaaca

SEQ ID NO: 567379 - DNA, 25 bp, Rattus norvegicus
tgagtaccggttccctcatccttgg

SEQ ID NO: 567380 - DNA, 25 bp, Rattus norvegicus
ggctccagtgggctttgtgagtacc

SEQ ID NO: 567381 - DNA, 25 bp, Rattus norvegicus
gggaccatgttcaccagcaccggct

SEQ ID NO: 567382 - DNA, 25 bp, Rattus norvegicus
acttcgctcgctggttgacagtgcg

SEQ ID NO: 567383 - DNA, 25 bp, Rattus norvegicus
cgccttcttcctggaggctccggag

SEQ ID NO: 567384 - DNA, 25 bp, Rattus norvegicus
agagttctggcacctaccatcctcg

SEQ ID NO: 567385 - DNA, 25 bp, Rattus norvegicus
gcgctccaagccgtgaggttctgca

SEQ ID NO: 567386 - DNA, 25 bp, Rattus norvegicus
tgcggaagaactggctctcctcgcg

SEQ ID NO: 567387 - DNA, 25 bp, Rattus norvegicus
aggcctggtattccactgcggaaga

SEQ ID NO: 567388 - DNA, 25 bp, Rattus norvegicus
cgcccgagccttgtcagttcttgct

SEQ ID NO: 567389 - DNA, 25 bp, Rattus norvegicus
accaagcatgcgtggaaaccgcggc

SEQ ID NO: 567390 - DNA, 25 bp, Rattus norvegicus
cagaggtctcgagaaaggcctggta

SEQ ID NO: 567391 - DNA, 25 bp, Rattus norvegicus
ccaagaagcggccaagcacggtgac

SEQ ID NO: 567392 - DNA, 25 bp, Rattus norvegicus
ccggatccggaagtagatgtcgccc

SEQ ID NO: 567393 - DNA, 25 bp, Rattus norvegicus
ttcattctcacagactccggttgtc

SEQ ID NO: 567394 - DNA, 25 bp, Rattus norvegicus
gtctggaatcccgatgtcgttttca

SEQ ID NO: 567395 - DNA, 25 bp, Rattus norvegicus
tttactttacccagagtgttgaggc

SEQ ID NO: 567396 - DNA, 25 bp, Rattus norvegicus
tactgagtatcccaggccaccctgg

SEQ ID NO: 567397 - DNA, 25 bp, Rattus norvegicus
ccctgggaagtgattctcggtctta

SEQ ID NO: 567398 - DNA, 25 bp, Rattus norvegicus
tctcggtcttaagcttgtggtggtc

SEQ ID NO: 567399 - DNA, 25 bp, Rattus norvegicus
gaggacgggttaaatgcaactggta

SEQ ID NO: 567400 - DNA, 25 bp, Rattus norvegicus
actggtaactctcgggcgttagcgc

SEQ ID NO: 567401 - DNA, 25 bp, Rattus norvegicus
cgccggaagtctgcgatcctaaatt

SEQ ID NO: 567402 - DNA, 25 bp, Rattus norvegicus
gtctagaatctgtgtcctccggcga

SEQ ID NO: 567403 - DNA, 25 bp, Rattus norvegicus
gcgttacccagaagaggccggatcc

SEQ ID NO: 567404 - DNA, 25 bp, Rattus norvegicus
gccgagggctcgttactgagtatcc

SEQ ID NO: 567405 - DNA, 25 bp, Rattus norvegicus
tcctgggaactcacaggcggaagtc

SEQ ID NO: 567406 - DNA, 25 bp, Rattus norvegicus
ccttggactggcctgcaagcaggta

SEQ ID NO: 567407 - DNA, 25 bp, Rattus norvegicus
gaagctttcggagcgcccttggact

SEQ ID NO: 567408 - DNA, 25 bp, Rattus norvegicus
cttacagctcgatgtgccttgcccg

SEQ ID NO: 567409 - DNA, 25 bp, Rattus norvegicus
ccgcactcagaagcgccacggtgga

SEQ ID NO: 567410 - DNA, 25 bp, Rattus norvegicus
tgtccctgcgggctcgcacttacag

SEQ ID NO: 567411 - DNA, 25 bp, Rattus norvegicus
tctctgagcactctggctgtccctg

SEQ ID NO: 567412 - DNA, 25 bp, Rattus norvegicus
gcctggctccggtcaatttctgcac

SEQ ID NO: 567413 - DNA, 25 bp, Rattus norvegicus
tgctgtcgctgctcttgctagggac

SEQ ID NO: 567414 - DNA, 25 bp, Rattus norvegicus
tggtgtctcctagcgtaaccggaac

SEQ ID NO: 567415 - DNA, 25 bp, Rattus norvegicus
aggcccgcttcggtttctgtcgcgg

SEQ ID NO: 567416 - DNA, 25 bp, Rattus norvegicus
gctgaaaacccggaacgcggatctc

SEQ ID NO: 567417 - DNA, 25 bp, Rattus norvegicus
caggtacggtgtgacctgctgccca

SEQ ID NO: 567418 - DNA, 25 bp, Rattus norvegicus
gcggaagtcacccagccggagagct

SEQ ID NO: 567419 - DNA, 25 bp, Rattus norvegicus
caagacaagcatggaacccgcgttc

SEQ ID NO: 567420 - DNA, 25 bp, Rattus norvegicus
ttccgcttaggaaggagacgtgccc

SEQ ID NO: 567421 - DNA, 25 bp, Rattus norvegicus
acctcaagtaacagcgtgcgggcgt

SEQ ID NO: 567422 - DNA, 25 bp, Rattus norvegicus
catgtggatgttctgtcccgtgcca

SEQ ID NO: 567423 - DNA, 25 bp, Rattus norvegicus
agagaccaggccttgggcacgtttc

SEQ ID NO: 567424 - DNA, 25 bp, Rattus norvegicus
cgcgatgacttacaccggtcgagca

SEQ ID NO: 567425 - DNA, 25 bp, Rattus norvegicus
gccaggctgtaatggtgcgagatca

SEQ ID NO: 567426 - DNA, 25 bp, Rattus norvegicus
tgcgagatcaaaggctgcccgtgtc

SEQ ID NO: 567427 - DNA, 25 bp, Rattus norvegicus
agcccgggacaatccttcgcctttg

SEQ ID NO: 567428 - DNA, 25 bp, Rattus norvegicus
gcccggttgctaggagccgaagaaa

SEQ ID NO: 567429 - DNA, 25 bp, Rattus norvegicus
tgtcaggagcgtgttaatcagactc

SEQ ID NO: 567430 - DNA, 25 bp, Rattus norvegicus
aataacgtctttctcggggctcctg

SEQ ID NO: 567431 - DNA, 25 bp, Rattus norvegicus
tgcccaaacagtcaggaaacgcatg

SEQ ID NO: 567432 - DNA, 25 bp, Rattus norvegicus
tccttcggacgggaagagcaagaca

SEQ ID NO: 567433 - DNA, 25 bp, Rattus norvegicus
cttacaattcgtttgtggtcccgca

SEQ ID NO: 567434 - DNA, 25 bp, Rattus norvegicus
ccctctgtcttgctgtattgggaga

SEQ ID NO: 567435 - DNA, 25 bp, Rattus norvegicus
gcgctcctcgctgctaattacaaat

SEQ ID NO: 567436 - DNA, 25 bp, Rattus norvegicus
gcccattgtgggctgtttaactcca

SEQ ID NO: 567437 - DNA, 25 bp, Rattus norvegicus
catcggggctaataggtgaagtcac

SEQ ID NO: 567438 - DNA, 25 bp, Rattus norvegicus
tgcacacacgcatacgcacggattc

SEQ ID NO: 567439 - DNA, 25 bp, Rattus norvegicus
tctgctcaggtacattgcgctcaca

SEQ ID NO: 567440 - DNA, 25 bp, Rattus norvegicus
agatttccttccgtgctcgttttgc

SEQ ID NO: 567441 - DNA, 25 bp, Rattus norvegicus
gcgagccgcctctaagcatgccagg

SEQ ID NO: 567442 - DNA, 25 bp, Rattus norvegicus
tggtcccgcagctccaattcaaagc

SEQ ID NO: 567443 - DNA, 25 bp, Rattus norvegicus
cgcgggtcttcgctaaccttacaat

SEQ ID NO: 567444 - DNA, 25 bp, Rattus norvegicus
tggctttcaaacatcgcgggtcttc

SEQ ID NO: 567445 - DNA, 25 bp, Rattus norvegicus
agcacttttgctgcgacgacacaca

SEQ ID NO: 567446 - DNA, 25 bp, Rattus norvegicus
cgcacaggttctggtctggctttca

SEQ ID NO: 567447 - DNA, 25 bp, Rattus norvegicus
ccgggtcatacgtctgctgagaagc

SEQ ID NO: 567448 - DNA, 25 bp, Rattus norvegicus
ttgcagatgagctcccgcttgattg

SEQ ID NO: 567449 - DNA, 25 bp, Rattus norvegicus
ctgccgcatgtagcgcaggaaggcc

SEQ ID NO: 567450 - DNA, 25 bp, Rattus norvegicus
acgtgctccactgtgacgtggttca

SEQ ID NO: 567451 - DNA, 25 bp, Rattus norvegicus
ccaaaagcagacgtggctgctctgc

SEQ ID NO: 567452 - DNA, 25 bp, Rattus norvegicus
acttggccttgaaaggcttgccctc

SEQ ID NO: 567453 - DNA, 25 bp, Rattus norvegicus
cggatgtggttgatgagcttgtact

SEQ ID NO: 567454 - DNA, 25 bp, Rattus norvegicus
ctcggagcgcgcgaagactttgccg

SEQ ID NO: 567455 - DNA, 25 bp, Rattus norvegicus
cggggacagacacccacctgtatga

SEQ ID NO: 567456 - DNA, 25 bp, Rattus norvegicus
agggcccgttagtgctatcgaatta

SEQ ID NO: 567457 - DNA, 25 bp, Rattus norvegicus
atcctgtgtgctttgctgttgctgc

SEQ ID NO: 567458 - DNA, 25 bp, Rattus norvegicus
ggctgcggatcatcctgtgtgcttt

SEQ ID NO: 567459 - DNA, 25 bp, Rattus norvegicus
ctgtgacgtggttcaccagctcgtg

SEQ ID NO: 567460 - DNA, 25 bp, Rattus norvegicus
acctgtatgagtgcgcttgtggatc

SEQ ID NO: 567461 - DNA, 25 bp, Rattus norvegicus
gcgcaggattgactaggccatgatg

SEQ ID NO: 567462 - DNA, 25 bp, Rattus norvegicus
ctgcccactgcagccacaggagaga

SEQ ID NO: 567463 - DNA, 25 bp, Rattus norvegicus
cagcgcccaccgaaataaacagagg

SEQ ID NO: 567464 - DNA, 25 bp, Rattus norvegicus
attcgtggtcgctgcaagtttacta

SEQ ID NO: 567465 - DNA, 25 bp, Rattus norvegicus
tgtgagcactcactcccggattagc

SEQ ID NO: 567466 - DNA, 25 bp, Rattus norvegicus
gcgttgacttcattcggcggatgcc

SEQ ID NO: 567467 - DNA, 25 bp, Rattus norvegicus
tgcctgcctgagtgcgtacagccac

SEQ ID NO: 567468 - DNA, 25 bp, Rattus norvegicus
tgcgtacagccactgccctagggca

SEQ ID NO: 567469 - DNA, 25 bp, Rattus norvegicus
cttgtgccaaggacttcgctcggtc

SEQ ID NO: 567470 - DNA, 25 bp, Rattus norvegicus
attgtttttcagactagcctcaccc

SEQ ID NO: 567471 - DNA, 25 bp, Rattus norvegicus
ccatgatggccaatagcggtttctg

SEQ ID NO: 567472 - DNA, 25 bp, Rattus norvegicus
tcctccagcccaacttaaagaaaga

SEQ ID NO: 567473 - DNA, 25 bp, Rattus norvegicus
cgtctccaatgccaagctcgtaggg

SEQ ID NO: 567474 - DNA, 25 bp, Rattus norvegicus
aaggaactcgtgctggcctcctagc

SEQ ID NO: 567475 - DNA, 25 bp, Rattus norvegicus
agcctaaatcggcacagctcttgga

SEQ ID NO: 567476 - DNA, 25 bp, Rattus norvegicus
ctgggagcattttcagcctaaatcg

SEQ ID NO: 567477 - DNA, 25 bp, Rattus norvegicus
ctcctccagatcttagccaagcggg

SEQ ID NO: 567478 - DNA, 25 bp, Rattus norvegicus
gctcgatgggcagtctaggcataga

SEQ ID NO: 567479 - DNA, 25 bp, Rattus norvegicus
gcacacccgcggctgggagcatttt

SEQ ID NO: 567480 - DNA, 25 bp, Rattus norvegicus
agtctgcgcctagtggctgaggctc

SEQ ID NO: 567481 - DNA, 25 bp, Rattus norvegicus
cggcacagctcttggattatttctc

SEQ ID NO: 567482 - DNA, 25 bp, Rattus norvegicus
agatcttagccaagcgggcggcttc

SEQ ID NO: 567483 - DNA, 25 bp, Rattus norvegicus
acctcttcctgtggagctgggtttg

SEQ ID NO: 567484 - DNA, 25 bp, Rattus norvegicus
gtttgccggagccaccgatcattcc

SEQ ID NO: 567485 - DNA, 25 bp, Rattus norvegicus
tccgtggtgctgctcgcaggactcc

SEQ ID NO: 567486 - DNA, 25 bp, Rattus norvegicus
actccgagagcgctgagtctgcgcc

SEQ ID NO: 567487 - DNA, 25 bp, Rattus norvegicus
tctaggcatagatcgcgaattagga

SEQ ID NO: 567488 - DNA, 25 bp, Rattus norvegicus
atgcccggggcatccacgtgcatct

SEQ ID NO: 567489 - DNA, 25 bp, Rattus norvegicus
ctgctgagagctagcggagagcatc

SEQ ID NO: 567490 - DNA, 25 bp, Rattus norvegicus
ctcgcacgagcgtctagtcaggata

SEQ ID NO: 567491 - DNA, 25 bp, Rattus norvegicus
ggtcaaggtgctcccgaaccacaga

SEQ ID NO: 567492 - DNA, 25 bp, Rattus norvegicus
cacgccacagcggtcctgaggtcaa

SEQ ID NO: 567493 - DNA, 25 bp, Rattus norvegicus
cccatcaggttggatgtccggacta

SEQ ID NO: 567494 - DNA, 25 bp, Rattus norvegicus
ttcacgcgtgcagccacttcgcata

SEQ ID NO: 567495 - DNA, 25 bp, Rattus norvegicus
gagccaagatgggtgcatacaaata

SEQ ID NO: 567496 - DNA, 25 bp, Rattus norvegicus
ggcggagacaccaacctgacacagc

SEQ ID NO: 567497 - DNA, 25 bp, Rattus norvegicus
ggaccggccctagtcactgtcacga

SEQ ID NO: 567498 - DNA, 25 bp, Rattus norvegicus
gttacaatcctggtggcttcccgga

SEQ ID NO: 567499 - DNA, 25 bp, Rattus norvegicus
cttactcgcggtggcggttacaatc

SEQ ID NO: 567500 - DNA, 25 bp, Rattus norvegicus
ggacgaagctctcccggtcttactc

SEQ ID NO: 567501 - DNA, 25 bp, Rattus norvegicus
gcatttctatccgtcgcgaatcgcg

SEQ ID NO: 567502 - DNA, 25 bp, Rattus norvegicus
aggctgtgtggtgtttgcatttcta

SEQ ID NO: 567503 - DNA, 25 bp, Rattus norvegicus
ctcgccgatcaggaggggaaatcca

SEQ ID NO: 567504 - DNA, 25 bp, Rattus norvegicus
cacgttggctcttattcggggcctc

SEQ ID NO: 567505 - DNA, 25 bp, Rattus norvegicus
agtcgccagtgtttccaccgccggt

SEQ ID NO: 567506 - DNA, 25 bp, Rattus norvegicus
cgcgctggccatgcttctggacgcg

SEQ ID NO: 567507 - DNA, 25 bp, Rattus norvegicus
acagaacggcttcgtggactcggcc

SEQ ID NO: 567508 - DNA, 25 bp, Rattus norvegicus
ggggcacacgaactgtctcctggtc

SEQ ID NO: 567509 - DNA, 25 bp, Rattus norvegicus
tctcctggtcagagttcggcgttca

SEQ ID NO: 567510 - DNA, 25 bp, Rattus norvegicus
cacgccgctcacgttggctcttatt

SEQ ID NO: 567511 - DNA, 25 bp, Rattus norvegicus
atgcgcactcggacgcgcagggcca

SEQ ID NO: 567512 - DNA, 25 bp, Rattus norvegicus
acgcctcgcagaacgtgctcaatgg

SEQ ID NO: 567513 - DNA, 25 bp, Rattus norvegicus
tgctcaatgggcaaatgcgcctagg

SEQ ID NO: 567514 - DNA, 25 bp, Rattus norvegicus
gtgttcgggcgctcagagcaatacc

SEQ ID NO: 567515 - DNA, 25 bp, Rattus norvegicus
ctcagagcaataccgccaagtggcc

SEQ ID NO: 567516 - DNA, 25 bp, Rattus norvegicus
agttcggcgttcacgtcgcaaggtc

SEQ ID NO: 567517 - DNA, 25 bp, Rattus norvegicus
cacgtgcgccactgggcacaggaca

SEQ ID NO: 567518 - DNA, 25 bp, Rattus norvegicus
caggacagtgcgtgcgagaacaatt

SEQ ID NO: 567519 - DNA, 25 bp, Rattus norvegicus
gcgtgcgagaacaattattttcatc

SEQ ID NO: 567520 - DNA, 25 bp, Rattus norvegicus
tcatcagagactggtagctcgcgcc

SEQ ID NO: 567521 - DNA, 25 bp, Rattus norvegicus
ctggaagtgaagcaggacggaatcc

SEQ ID NO: 567522 - DNA, 25 bp, Rattus norvegicus
aaaggttctgggtcccgcgcacctg

SEQ ID NO: 567523 - DNA, 25 bp, Rattus norvegicus
aagcaggacggaatcctccaccaca

SEQ ID NO: 567524 - DNA, 25 bp, Rattus norvegicus
aacggtcccttgacagagggcattc

SEQ ID NO: 567525 - DNA, 25 bp, Rattus norvegicus
tcctctgtgcagaaccgacggcttt

SEQ ID NO: 567526 - DNA, 25 bp, Rattus norvegicus
ccggctcgctcgagggcttctaaac

SEQ ID NO: 567527 - DNA, 25 bp, Rattus norvegicus
tactgcgcgcttcgcagctgccgga

SEQ ID NO: 567528 - DNA, 25 bp, Rattus norvegicus
ggaaccttagatgctgccgcggaga

SEQ ID NO: 567529 - DNA, 25 bp, Rattus norvegicus
acggctttcgggctttcaattctgg

SEQ ID NO: 567530 - DNA, 25 bp, Rattus norvegicus
ggcattcgaggaccgaaaggttctg

SEQ ID NO: 567531 - DNA, 25 bp, Rattus norvegicus
gcttagaaccaaaagcttctgattg

SEQ ID NO: 567532 - DNA, 25 bp, Rattus norvegicus
ggcggagcttagaaccaaaagcttc

SEQ ID NO: 567533 - DNA, 25 bp, Rattus norvegicus
ctcccggaggcggagcttagaacca

SEQ ID NO: 567534 - DNA, 25 bp, Rattus norvegicus
aatctccagacgtccggctttgcgc

SEQ ID NO: 567535 - DNA, 25 bp, Rattus norvegicus
aacaatctccagacgtccggctttg

SEQ ID NO: 567536 - DNA, 25 bp, Rattus norvegicus
ttctgattggccgtaccacgggcgc

SEQ ID NO: 567537 - DNA, 25 bp, Rattus norvegicus
gctttgcgccacagcccaaccagtt

SEQ ID NO: 567538 - DNA, 25 bp, Rattus norvegicus
gagttcagcggccagcaagtcggct

SEQ ID NO: 567539 - DNA, 25 bp, Rattus norvegicus
cagcaagtcggctgggacgacaatg

SEQ ID NO: 567540 - DNA, 25 bp, Rattus norvegicus
acagtggcactattggcggccaggc

SEQ ID NO: 567541 - DNA, 25 bp, Rattus norvegicus
gcattggcggcggtcctcccagcaa

SEQ ID NO: 567542 - DNA, 25 bp, Rattus norvegicus
tcccagcaactgctgtggacgctga

SEQ ID NO: 567543 - DNA, 25 bp, Rattus norvegicus
caactgctgtggacgctgaaggtga

SEQ ID NO: 567544 - DNA, 25 bp, Rattus norvegicus
cccgccccctgacgaggtgagagtt

SEQ ID NO: 567545 - DNA, 25 bp, Rattus norvegicus
cccggcagctttccggggtcaaatg

SEQ ID NO: 567546 - DNA, 25 bp, Rattus norvegicus
gcgagagcaagcatctgctctgctc

SEQ ID NO: 567547 - DNA, 25 bp, Rattus norvegicus
agcatctgctctgctcgggacagcg

SEQ ID NO: 567548 - DNA, 25 bp, Rattus norvegicus
ctgtgtctgtctgccgctcgccttg

SEQ ID NO: 567549 - DNA, 25 bp, Rattus norvegicus
caaggcgttcacagcatgggccgtc

SEQ ID NO: 567550 - DNA, 25 bp, Rattus norvegicus
cacacctggaggcaagcacattttt

SEQ ID NO: 567551 - DNA, 25 bp, Rattus norvegicus
agagccactacgcacacctggaggc

SEQ ID NO: 567552 - DNA, 25 bp, Rattus norvegicus
aggtactgcaaccaaaccgcctcgg

SEQ ID NO: 567553 - DNA, 25 bp, Rattus norvegicus
tgcccgactgggcaggtactgcaac

SEQ ID NO: 567554 - DNA, 25 bp, Rattus norvegicus
taacggccaacactccgctggctgg

SEQ ID NO: 567555 - DNA, 25 bp, Rattus norvegicus
caacactccgctggctggtgaccga

SEQ ID NO: 567556 - DNA, 25 bp, Rattus norvegicus
ttccggggtcaaatgcacgctccgc

SEQ ID NO: 567557 - DNA, 25 bp, Rattus norvegicus
gcatcgcctgagacgctaacggcca

SEQ ID NO: 567558 - DNA, 25 bp, Rattus norvegicus
gctggtgaccgagtccctaagccgc

SEQ ID NO: 567559 - DNA, 25 bp, Rattus norvegicus
gtgcggcttccacctaggcgcatac

SEQ ID NO: 567560 - DNA, 25 bp, Rattus norvegicus
cccggtgcactctcgggctacgaag

SEQ ID NO: 567561 - DNA, 25 bp, Rattus norvegicus
ctgtgccttggccagctggcgacca

SEQ ID NO: 567562 - DNA, 25 bp, Rattus norvegicus
aagctacccggctgtgtccagccgt

SEQ ID NO: 567563 - DNA, 25 bp, Rattus norvegicus
cgggctacgaagctgttgcacggct

SEQ ID NO: 567564 - DNA, 25 bp, Rattus norvegicus
tggtgcggcgacctcagccgtagca

SEQ ID NO: 567565 - DNA, 25 bp, Rattus norvegicus
tctttgtcccgggtgcggcttccac

SEQ ID NO: 567566 - DNA, 25 bp, Rattus norvegicus
ggagcacgagctgcgatctcatctc

SEQ ID NO: 567567 - DNA, 25 bp, Rattus norvegicus
tgctgggtggctcgccgcgtaaccc

SEQ ID NO: 567568 - DNA, 25 bp, Rattus norvegicus
atccgcgggaggcagctccggtctc

SEQ ID NO: 567569 - DNA, 25 bp, Rattus norvegicus
tccggtctccgagctaactctagcg

SEQ ID NO: 567570 - DNA, 25 bp, Rattus norvegicus
ccgagctaactctagcggaggtgca

SEQ ID NO: 567571 - DNA, 25 bp, Rattus norvegicus
cgcgcgttacctgcaaggagcacga

SEQ ID NO: 567572 - DNA, 25 bp, Rattus norvegicus
acctcagccgtagcagggcagtgca

SEQ ID NO: 567573 - DNA, 25 bp, Rattus norvegicus
gggatccgcgtgtacttagcctatt

SEQ ID NO: 567574 - DNA, 25 bp, Rattus norvegicus
attcctggcgggtcttgcgcgctct

SEQ ID NO: 567575 - DNA, 25 bp, Rattus norvegicus
tagcctattcctggcgggtcttgcg

SEQ ID NO: 567576 - DNA, 25 bp, Rattus norvegicus
tccgcgtgtacttagcctattcctg

SEQ ID NO: 567577 - DNA, 25 bp, Rattus norvegicus
agaaagcgcagctgggacgcgaagc

SEQ ID NO: 567578 - DNA, 25 bp, Rattus norvegicus
gtacttagcctattcctggcgggtc

SEQ ID NO: 567579 - DNA, 25 bp, Rattus norvegicus
cttcctctcattggtacatgtcggg

SEQ ID NO: 567580 - DNA, 25 bp, Rattus norvegicus
ctctcattggtacatgtcggggtga

SEQ ID NO: 567581 - DNA, 25 bp, Rattus norvegicus
cattggtacatgtcggggtgacgtc

SEQ ID NO: 567582 - DNA, 25 bp, Rattus norvegicus
catcggttgccctttccatcactca

SEQ ID NO: 567583 - DNA, 25 bp, Rattus norvegicus
acgtcggaacaaggcgctcgcggcg

SEQ ID NO: 567584 - DNA, 25 bp, Rattus norvegicus
acatgtcggggtgacgtcggaacaa

SEQ ID NO: 567585 - DNA, 25 bp, Rattus norvegicus
ttccatcactcacgcgatcctcttc

SEQ ID NO: 567586 - DNA, 25 bp, Rattus norvegicus
tgggacgcgaagcagctgcggttcc

SEQ ID NO: 567587 - DNA, 25 bp, Rattus norvegicus
actgaagcgccatacgtgaggggcc

SEQ ID NO: 567588 - DNA, 25 bp, Rattus norvegicus
gcgctgccttgagcatcctctgtag

SEQ ID NO: 567589 - DNA, 25 bp, Rattus norvegicus
tcgcgccgcaaagccaactgcaaaa

SEQ ID NO: 567590 - DNA, 25 bp, Rattus norvegicus
ctgcggttacaggttggttatggcc

SEQ ID NO: 567591 - DNA, 25 bp, Rattus norvegicus
gccaactgcaaaaggcaagcgaata

SEQ ID NO: 567592 - DNA, 25 bp, Rattus norvegicus
gcgaataaacgcaaggccaggactc

SEQ ID NO: 567593 - DNA, 25 bp, Rattus norvegicus
taaacgcaaggccaggactcccgca

SEQ ID NO: 567594 - DNA, 25 bp, Rattus norvegicus
cctcgcccatgaggcagacgctagt

SEQ ID NO: 567595 - DNA, 25 bp, Rattus norvegicus
atcctctgtagctcgcgccgcaaag

SEQ ID NO: 567596 - DNA, 25 bp, Rattus norvegicus
agcggagctgactgaagcgccatac

SEQ ID NO: 567597 - DNA, 25 bp, Rattus norvegicus
actccgcgcgctgcggttacaggtt

SEQ ID NO: 567598 - DNA, 25 bp, Rattus norvegicus
gcaccgagtcttgcacaggaggccg

SEQ ID NO: 567599 - DNA, 25 bp, Rattus norvegicus
ttacaggttggttatggccgctggc

SEQ ID NO: 567600 - DNA, 25 bp, Rattus norvegicus
aggcagacgctagtgcagaagcaga

SEQ ID NO: 567601 - DNA, 25 bp, Rattus norvegicus
tcttgaggccgaagatgcgcacttt

SEQ ID NO: 567602 - DNA, 25 bp, Rattus norvegicus
gcgccgcaacctgcgcttcttgagg

SEQ ID NO: 567603 - DNA, 25 bp, Rattus norvegicus
cctgcgcttcttgaggccgaagatg

SEQ ID NO: 567604 - DNA, 25 bp, Rattus norvegicus
ccgaagatgcgcactttggagaaga

SEQ ID NO: 567605 - DNA, 25 bp, Rattus norvegicus
cgcactttggagaagatatccacta

SEQ ID NO: 567606 - DNA, 25 bp, Rattus norvegicus
ttggagaagatatccactaggttgc

SEQ ID NO: 567607 - DNA, 25 bp, Rattus norvegicus
agatatccactaggttgccattgca

SEQ ID NO: 567608 - DNA, 25 bp, Rattus norvegicus
atccactaggttgccattgcaaagc

SEQ ID NO: 567609 - DNA, 25 bp, Rattus norvegicus
taggttgccattgcaaagcccgcgg

SEQ ID NO: 567610 - DNA, 25 bp, Rattus norvegicus
aaagcccgcggttcttgctggggct

SEQ ID NO: 567611 - DNA, 25 bp, Rattus norvegicus
tgccgcttctgacggatcaagccgc

SEQ ID NO: 567612 - DNA, 25 bp, Rattus norvegicus
gtgacccacacagaccttggcgccg

SEQ ID NO: 567613 - DNA, 25 bp, Rattus norvegicus
ttctgacggatcaagccgctggcga

SEQ ID NO: 567614 - DNA, 25 bp, Rattus norvegicus
gcaacctgcgcttcttgaggccgaa

SEQ ID NO: 567615 - DNA, 25 bp, Rattus norvegicus
tggcgacctctctgctgagacctgc

SEQ ID NO: 567616 - DNA, 25 bp, Rattus norvegicus
tggtaacggcgccttgtgcgccacc

SEQ ID NO: 567617 - DNA, 25 bp, Rattus norvegicus
cctaggtgcgggtgtcctccgctac

SEQ ID NO: 567618 - DNA, 25 bp, Rattus norvegicus
agcaatccgccacttgggtgccctg

SEQ ID NO: 567619 - DNA, 25 bp, Rattus norvegicus
agtcgcagcgacgaaatggcctcgg

SEQ ID NO: 567620 - DNA, 25 bp, Rattus norvegicus
cctggctcctgcagagtcgcagcga

SEQ ID NO: 567621 - DNA, 25 bp, Rattus norvegicus
ccgctctggtgctcgcattagccaa

SEQ ID NO: 567622 - DNA, 25 bp, Rattus norvegicus
cgcgcgcagccttactcgggactgg

SEQ ID NO: 567623 - DNA, 25 bp, Rattus norvegicus
aggtcccaggacactggcgacctct

SEQ ID NO: 567624 - DNA, 25 bp, Rattus norvegicus
agcaaagttaatcccgccgcgtcac

SEQ ID NO: 567625 - DNA, 25 bp, Rattus norvegicus
acccaactgcaagcgcgcgaaggtt

SEQ ID NO: 567626 - DNA, 25 bp, Rattus norvegicus
cagcagctgtggcaagctcaggcca

SEQ ID NO: 567627 - DNA, 25 bp, Rattus norvegicus
gctcgcattagccaagcaaagttaa

SEQ ID NO: 567628 - DNA, 25 bp, Rattus norvegicus
agggacagcgcgagtctctggccac

SEQ ID NO: 567629 - DNA, 25 bp, Rattus norvegicus
ccgcgctgcctcgtcattgaatagc

SEQ ID NO: 567630 - DNA, 25 bp, Rattus norvegicus
gtgcctccctagctcctctgctcta

SEQ ID NO: 567631 - DNA, 25 bp, Rattus norvegicus
gccctccaccatgccacagccgccg

SEQ ID NO: 567632 - DNA, 25 bp, Rattus norvegicus
tgcacgcccgccctccaccatgcca

SEQ ID NO: 567633 - DNA, 25 bp, Rattus norvegicus
cactcggggactttgtgcatgcccc

SEQ ID NO: 567634 - DNA, 25 bp, Rattus norvegicus
cccgtccggggcaagaggcagaggg

SEQ ID NO: 567635 - DNA, 25 bp, Rattus norvegicus
gctcctctgctctactgctccatcc

SEQ ID NO: 567636 - DNA, 25 bp, Rattus norvegicus
gaggcggggcaagctgagggaaacc

SEQ ID NO: 567637 - DNA, 25 bp, Rattus norvegicus
agcatcatttctccgccctgcgctg

SEQ ID NO: 567638 - DNA, 25 bp, Rattus norvegicus
ccctgccggagcatcatttctccgc

SEQ ID NO: 567639 - DNA, 25 bp, Rattus norvegicus
cgtcattgaatagcgcaggcttccc

SEQ ID NO: 567640 - DNA, 25 bp, Rattus norvegicus
cgctgcctcgtcattgaatagcgca

SEQ ID NO: 567641 - DNA, 25 bp, Rattus norvegicus
tgccgcgctgcctcgtcattgaata

SEQ ID NO: 567642 - DNA, 25 bp, Rattus norvegicus
ctcgtcattgaatagcgcaggcttc

SEQ ID NO: 567643 - DNA, 25 bp, Rattus norvegicus
ccgcgaaaggtaaagacaggagcga

SEQ ID NO: 567644 - DNA, 25 bp, Rattus norvegicus
gctgaggtgccaacccggagcgtcc

SEQ ID NO: 567645 - DNA, 25 bp, Rattus norvegicus
ggtaaagagccagcgtggggaggcg

SEQ ID NO: 567646 - DNA, 25 bp, Rattus norvegicus
ccggtcgctgaggtgccaacccgga

SEQ ID NO: 567647 - DNA, 25 bp, Rattus norvegicus
gagcctcctgcccggtcgctgaggt

SEQ ID NO: 567648 - DNA, 25 bp, Rattus norvegicus
caggagcgagctcgcgagcctcctg

SEQ ID NO: 567649 - DNA, 25 bp, Rattus norvegicus
aaggtaaagacaggagcgagctcgc

SEQ ID NO: 567650 - DNA, 25 bp, Rattus norvegicus
cagcccgcgaaaggtaaagacagga

SEQ ID NO: 567651 - DNA, 25 bp, Rattus norvegicus
ccagcagcccgcgaaaggtaaagac

SEQ ID NO: 567652 - DNA, 25 bp, Rattus norvegicus
ggactcccagcagcccgcgaaaggt

SEQ ID NO: 567653 - DNA, 25 bp, Rattus norvegicus
gtggactcccagcagcccgcgaaag

SEQ ID NO: 567654 - DNA, 25 bp, Rattus norvegicus
tgagggcacagccagcgggcggcgc

SEQ ID NO: 567655 - DNA, 25 bp, Rattus norvegicus
tgccaacccggagcgtcccgggtca

SEQ ID NO: 567656 - DNA, 25 bp, Rattus norvegicus
agacaggagcgagctcgcgagcctc

SEQ ID NO: 567657 - DNA, 25 bp, Rattus norvegicus
atctgcccggccctggcgggaagac

SEQ ID NO: 567658 - DNA, 25 bp, Rattus norvegicus
tgcggtttgcgccttttcatctgcc

SEQ ID NO: 567659 - DNA, 25 bp, Rattus norvegicus
tcggtgaacccttcccgggctgcta

SEQ ID NO: 567660 - DNA, 25 bp, Rattus norvegicus
gcaaacaatgccaggagcgcaggga

SEQ ID NO: 567661 - DNA, 25 bp, Rattus norvegicus
cccatggctcagcttgcaaacaatg

SEQ ID NO: 567662 - DNA, 25 bp, Rattus norvegicus
acagcgcttaaaaactcccagcagc

SEQ ID NO: 567663 - DNA, 25 bp, Rattus norvegicus
actcccaggattctcacagcgctta

SEQ ID NO: 567664 - DNA, 25 bp, Rattus norvegicus
tatgcgagtgaactttcggtgaacc

SEQ ID NO: 567665 - DNA, 25 bp, Rattus norvegicus
ttgaattgcctaatatatgcgagtg

SEQ ID NO: 567666 - DNA, 25 bp, Rattus norvegicus
ttctgtcacacggaatgaaagattg

SEQ ID NO: 567667 - DNA, 25 bp, Rattus norvegicus
agaatagaccctcctgcctcggagc

SEQ ID NO: 567668 - DNA, 25 bp, Rattus norvegicus
ctttggcaaagaatagaccctcctg

SEQ ID NO: 567669 - DNA, 25 bp, Rattus norvegicus
cttcaaatgacccaaccagtctgac

SEQ ID NO: 567670 - DNA, 25 bp, Rattus norvegicus
tcccgggctgctaaccttcaaatga

SEQ ID NO: 567671 - DNA, 25 bp, Rattus norvegicus
ctcctaacactgagctcgggaaata

SEQ ID NO: 567672 - DNA, 25 bp, Rattus norvegicus
cgggtctgacctccgacgccagaag

SEQ ID NO: 567673 - DNA, 25 bp, Rattus norvegicus
gacgccagaagccagtctccgggcg

SEQ ID NO: 567674 - DNA, 25 bp, Rattus norvegicus
ctccgggcggaagaaacgctgcgca

SEQ ID NO: 567675 - DNA, 25 bp, Rattus norvegicus
tgcgcagcagaccagcgtgcgcatg

SEQ ID NO: 567676 - DNA, 25 bp, Rattus norvegicus
atgcgcactcggtgagcgcccgcaa

SEQ ID NO: 567677 - DNA, 25 bp, Rattus norvegicus
cgcccgcaaaggcttgtttcaggta

SEQ ID NO: 567678 - DNA, 25 bp, Rattus norvegicus
tcaggtagttgctgcgtttcgcacc

SEQ ID NO: 567679 - DNA, 25 bp, Rattus norvegicus
gccgtggagccctgagaactcctaa

SEQ ID NO: 567680 - DNA, 25 bp, Rattus norvegicus
cggaagtccttctccgcgggtctga

SEQ ID NO: 567681 - DNA, 25 bp, Rattus norvegicus
gctcgggaaataatgtccggctttc

SEQ ID NO: 567682 - DNA, 25 bp, Rattus norvegicus
cggctttcctaacaccgcggtgctg

SEQ ID NO: 567683 - DNA, 25 bp, Rattus norvegicus
cctaacaccgcggtgctgtgctgtg

SEQ ID NO: 567684 - DNA, 25 bp, Rattus norvegicus
tgctgcgtttcgcacccgggtttcg

SEQ ID NO: 567685 - DNA, 25 bp, Rattus norvegicus
ctcgagaaagctgtgcctctttcta

SEQ ID NO: 567686 - DNA, 25 bp, Rattus norvegicus
agttgaccttggatctgagggtgca

SEQ ID NO: 567687 - DNA, 25 bp, Rattus norvegicus
tctcgagaaagctgtgcctctttct

SEQ ID NO: 567688 - DNA, 25 bp, Rattus norvegicus
cgagaaagctgtgcctctttctaag

SEQ ID NO: 567689 - DNA, 25 bp, Rattus norvegicus
gcgggaactcaacataaccgtggta

SEQ ID NO: 567690 - DNA, 25 bp, Rattus norvegicus
agaaagctgtgcctctttctaagcc

SEQ ID NO: 567691 - DNA, 25 bp, Rattus norvegicus
agctggagttgaccttggatctgag

SEQ ID NO: 567692 - DNA, 25 bp, Rattus norvegicus
gagctggagttgaccttggatctga

SEQ ID NO: 567693 - DNA, 25 bp, Rattus norvegicus
tcgagctggagttgaccttggatct

SEQ ID NO: 567694 - DNA, 25 bp, Rattus norvegicus
ctcgagctggagttgaccttggatc

SEQ ID NO: 567695 - DNA, 25 bp, Rattus norvegicus
gctcgagctggagttgaccttggat

SEQ ID NO: 567696 - DNA, 25 bp, Rattus norvegicus
ctgctcgagctggagttgaccttgg

SEQ ID NO: 567697 - DNA, 25 bp, Rattus norvegicus
accaagatcgtgaagcccaatggtg

SEQ ID NO: 567698 - DNA, 25 bp, Rattus norvegicus
caccaagatcgtgaagcccaatggt

SEQ ID NO: 567699 - DNA, 25 bp, Rattus norvegicus
gtcagggtggatagcccagtttgca

SEQ ID NO: 567700 - DNA, 25 bp, Rattus norvegicus
ccgcgccacgcaccgcctgcgtcct

SEQ ID NO: 567701 - DNA, 25 bp, Rattus norvegicus
gcagcagtgaaagccaagtcgtgcc

SEQ ID NO: 567702 - DNA, 25 bp, Rattus norvegicus
gagcagccatcccaatccaggactg

SEQ ID NO: 567703 - DNA, 25 bp, Rattus norvegicus
caggactggcgcaaggtaaggtaca

SEQ ID NO: 567704 - DNA, 25 bp, Rattus norvegicus
gcaaggtaaggtacagccgcctgtt

SEQ ID NO: 567705 - DNA, 25 bp, Rattus norvegicus
acagccgcctgttgctttacgcaga

SEQ ID NO: 567706 - DNA, 25 bp, Rattus norvegicus
cccaatccaggactggcgcaaggta

SEQ ID NO: 567707 - DNA, 25 bp, Rattus norvegicus
ggatagcccagtttgcagtctgctg

SEQ ID NO: 567708 - DNA, 25 bp, Rattus norvegicus
cagtttgcagtctgctggagctggc

SEQ ID NO: 567709 - DNA, 25 bp, Rattus norvegicus
cctaggcatacgcaccaaacgcctc

SEQ ID NO: 567710 - DNA, 25 bp, Rattus norvegicus
ctccctgcgccacgaggatggagca

SEQ ID NO: 567711 - DNA, 25 bp, Rattus norvegicus
gcgccacgaggatggagcagccatc

SEQ ID NO: 567712 - DNA, 25 bp, Rattus norvegicus
cgcctgttgctttacgcagagcgcg

SEQ ID NO: 567713 - DNA, 25 bp, Rattus norvegicus
cgtttgagccaatcagcagttcggg

SEQ ID NO: 567714 - DNA, 25 bp, Rattus norvegicus
tctacagactttcgaagtggaatgg

SEQ ID NO: 567715 - DNA, 25 bp, Rattus norvegicus
tccactggctaagaggctcggaggt

SEQ ID NO: 567716 - DNA, 25 bp, Rattus norvegicus
aagcagacagacattcgtttgagcc

SEQ ID NO: 567717 - DNA, 25 bp, Rattus norvegicus
ttgtaaaggcttaattgaccgaggc

SEQ ID NO: 567718 - DNA, 25 bp, Rattus norvegicus
ttgaccgaggctgagagtggaactc

SEQ ID NO: 567719 - DNA, 25 bp, Rattus norvegicus
cgaatcggaagttctacagactttc

SEQ ID NO: 567720 - DNA, 25 bp, Rattus norvegicus
tcgaagtggaatggggtcatcaccc

SEQ ID NO: 567721 - DNA, 25 bp, Rattus norvegicus
tcggctccttaccacgtgttttaca

SEQ ID NO: 567722 - DNA, 25 bp, Rattus norvegicus
gttttacaagcagacaggacgacgc

SEQ ID NO: 567723 - DNA, 25 bp, Rattus norvegicus
gagcgaccgcctccactggctaaga

SEQ ID NO: 567724 - DNA, 25 bp, Rattus norvegicus
tcagcagttcgggaggttctgtccg

SEQ ID NO: 567725 - DNA, 25 bp, Rattus norvegicus
cctgtttggcaccagggccggcatc

SEQ ID NO: 567726 - DNA, 25 bp, Rattus norvegicus
gtggaactcagtttttcgaatcgga

SEQ ID NO: 567727 - DNA, 25 bp, Rattus norvegicus
cctcctggagccgagagggacttgt

SEQ ID NO: 567728 - DNA, 25 bp, Rattus norvegicus
acagagacgcgaccggaagtcaggc

SEQ ID NO: 567729 - DNA, 25 bp, Rattus norvegicus
ggtggcccaggactactctcagttt

SEQ ID NO: 567730 - DNA, 25 bp, Rattus norvegicus
tcagttttctcagcttgctcttgta

SEQ ID NO: 567731 - DNA, 25 bp, Rattus norvegicus
cttgctcttgtaccgtgaccatgcc

SEQ ID NO: 567732 - DNA, 25 bp, Rattus norvegicus
gtgaccatgccgctagaaaacctag

SEQ ID NO: 567733 - DNA, 25 bp, Rattus norvegicus
aacctagaggaagagggtctgccca

SEQ ID NO: 567734 - DNA, 25 bp, Rattus norvegicus
ggtctgcccaagaacccggatctgc

SEQ ID NO: 567735 - DNA, 25 bp, Rattus norvegicus
tgcgcatcgcgcagctgcgctttct

SEQ ID NO: 567736 - DNA, 25 bp, Rattus norvegicus
ctgatggccgccgtccgggaaaaca

SEQ ID NO: 567737 - DNA, 25 bp, Rattus norvegicus
gacttgtcttagtgggttcttcctc

SEQ ID NO: 567738 - DNA, 25 bp, Rattus norvegicus
gttccgggaagcctcggatgcttgt

SEQ ID NO: 567739 - DNA, 25 bp, Rattus norvegicus
gtgcttgcgacgactcctcctgctt

SEQ ID NO: 567740 - DNA, 25 bp, Rattus norvegicus
tgcgctttctgcttagcctgccgga

SEQ ID NO: 567741 - DNA, 25 bp, Rattus norvegicus
ggtcaggggactttggcatctttcc

SEQ ID NO: 567742 - DNA, 25 bp, Rattus norvegicus
cggcgtggaagacaagtcgagtttc

SEQ ID NO: 567743 - DNA, 25 bp, Rattus norvegicus
gcgcctcgaagttgaaatgcttttc

SEQ ID NO: 567744 - DNA, 25 bp, Rattus norvegicus
cggctctccgaagcgaatatattta

SEQ ID NO: 567745 - DNA, 25 bp, Rattus norvegicus
ggtaaggaccttctctcagggtgaa

SEQ ID NO: 567746 - DNA, 25 bp, Rattus norvegicus
ttcgcagatagggaagccggaccct

SEQ ID NO: 567747 - DNA, 25 bp, Rattus norvegicus
tgtggccgagggcaatagaacctta

SEQ ID NO: 567748 - DNA, 25 bp, Rattus norvegicus
gtgccgcttagaattgcgcctcgaa

SEQ ID NO: 567749 - DNA, 25 bp, Rattus norvegicus
atatatttacacagcctcggaggcg

SEQ ID NO: 567750 - DNA, 25 bp, Rattus norvegicus
ggggcctgtatactcttccaaagtc

SEQ ID NO: 567751 - DNA, 25 bp, Rattus norvegicus
aggggcaaagccacacaaacttgtc

SEQ ID NO: 567752 - DNA, 25 bp, Rattus norvegicus
gggcagtcggagtgattcagctcta

SEQ ID NO: 567753 - DNA, 25 bp, Rattus norvegicus
cagggctgccttcctgtagggtttc

SEQ ID NO: 567754 - DNA, 25 bp, Rattus norvegicus
ttgcgctgctggctcaaacatgttc

SEQ ID NO: 567755 - DNA, 25 bp, Rattus norvegicus
acagcgtgcgagtgtcacctctgcc

SEQ ID NO: 567756 - DNA, 25 bp, Rattus norvegicus
gcgagtgtcacctctgccgccagag

SEQ ID NO: 567757 - DNA, 25 bp, Rattus norvegicus
gtgcgagtgtcacctctgccgccag

SEQ ID NO: 567758 - DNA, 25 bp, Rattus norvegicus
agcacagcgtgcgagtgtcacctct

SEQ ID NO: 567759 - DNA, 25 bp, Rattus norvegicus
tctgccgccagagggagcacagcgt

SEQ ID NO: 567760 - DNA, 25 bp, Rattus norvegicus
agtgtcacctctgccgccagaggga

SEQ ID NO: 567761 - DNA, 25 bp, Rattus norvegicus
cctctgccgccagagggagcacagc

SEQ ID NO: 567762 - DNA, 25 bp, Rattus norvegicus
acctctgccgccagagggagcacag

SEQ ID NO: 567763 - DNA, 25 bp, Rattus norvegicus
ggagcacagcgtgcgagtgtcacct

SEQ ID NO: 567764 - DNA, 25 bp, Rattus norvegicus
ctctgccgccagagggagcacagcg

SEQ ID NO: 567765 - DNA, 25 bp, Rattus norvegicus
gagtgtcacctctgccgccagaggg

SEQ ID NO: 567766 - DNA, 25 bp, Rattus norvegicus
tgcgagtgtcacctctgccgccaga

SEQ ID NO: 567767 - DNA, 25 bp, Rattus norvegicus
cagcgtgcgagtgtcacctctgccg

SEQ ID NO: 567768 - DNA, 25 bp, Rattus norvegicus
cacagcgtgcgagtgtcacctctgc

SEQ ID NO: 567769 - DNA, 25 bp, Rattus norvegicus
cagcgtgcgagagtcacctcagcgt

SEQ ID NO: 567770 - DNA, 25 bp, Rattus norvegicus
ccacctggagtcaaacacgtaataa

SEQ ID NO: 567771 - DNA, 25 bp, Rattus norvegicus
gtaataacctcttccgatctgccgg

SEQ ID NO: 567772 - DNA, 25 bp, Rattus norvegicus
cgatctgccggctcccaaatgtgca

SEQ ID NO: 567773 - DNA, 25 bp, Rattus norvegicus
ccggctcccaaatgtgcaaaactga

SEQ ID NO: 567774 - DNA, 25 bp, Rattus norvegicus
cctggagtcaaacacgtaataacct

SEQ ID NO: 567775 - DNA, 25 bp, Rattus norvegicus
ctgaaagagagcacagcgtgcgaga

SEQ ID NO: 567776 - DNA, 25 bp, Rattus norvegicus
gcgagagtcacctcagcgtgcgagt

SEQ ID NO: 567777 - DNA, 25 bp, Rattus norvegicus
gtcacctcagcgtgcgagtgtcacc

SEQ ID NO: 567778 - DNA, 25 bp, Rattus norvegicus
ctcagcgtgcgagtgtcacctctgc

SEQ ID NO: 567779 - DNA, 25 bp, Rattus norvegicus
tgccgccagagagagcacagtgtac

SEQ ID NO: 567780 - DNA, 25 bp, Rattus norvegicus
gagagcacagtgtacgagtgtcacc

SEQ ID NO: 567781 - DNA, 25 bp, Rattus norvegicus
acgagtgtcacctctgccgccagag

SEQ ID NO: 567782 - DNA, 25 bp, Rattus norvegicus
cccaaatgtgcaaaactgaaagaga

SEQ ID NO: 567783 - DNA, 25 bp, Rattus norvegicus
gcgcggctggctttcgctttcgcct

SEQ ID NO: 567784 - DNA, 25 bp, Rattus norvegicus
tcccttaagcggaggcgcctcctgt

SEQ ID NO: 567785 - DNA, 25 bp, Rattus norvegicus
ttctttccgctcctacaatgtaaca

SEQ ID NO: 567786 - DNA, 25 bp, Rattus norvegicus
ctctctgctcgctccggcgaagttt

SEQ ID NO: 567787 - DNA, 25 bp, Rattus norvegicus
ccagggcgaagtcggaaacgcagcc

SEQ ID NO: 567788 - DNA, 25 bp, Rattus norvegicus
cggaaacgcagccacctatggaaga

SEQ ID NO: 567789 - DNA, 25 bp, Rattus norvegicus
ccacctatggaagagcctgccggtc

SEQ ID NO: 567790 - DNA, 25 bp, Rattus norvegicus
ggcgcagcgacgaaagcgtcgccca

SEQ ID NO: 567791 - DNA, 25 bp, Rattus norvegicus
cagcgcttcgctctgggctcgcagg

SEQ ID NO: 567792 - DNA, 25 bp, Rattus norvegicus
ctggagcatgaatgggaagccgcca

SEQ ID NO: 567793 - DNA, 25 bp, Rattus norvegicus
catgaatgggaagccgccactgtgc

SEQ ID NO: 567794 - DNA, 25 bp, Rattus norvegicus
tggagccgacctgctgtgacctcag

SEQ ID NO: 567795 - DNA, 25 bp, Rattus norvegicus
cgctcctacaatgtaacaaaaaggg

SEQ ID NO: 567796 - DNA, 25 bp, Rattus norvegicus
gccgcttttaaggaggctccgcgga

SEQ ID NO: 567797 - DNA, 25 bp, Rattus norvegicus
acgaggcagacacagcttcattagc

SEQ ID NO: 567798 - DNA, 25 bp, Rattus norvegicus
tgagagagtacgaaaggacatcgac

SEQ ID NO: 567799 - DNA, 25 bp, Rattus norvegicus
tctcatcgtgctgggtgagagagta

SEQ ID NO: 567800 - DNA, 25 bp, Rattus norvegicus
tgtctgttctcatcgtgctgggtga

SEQ ID NO: 567801 - DNA, 25 bp, Rattus norvegicus
cgacgtgcagatggctgtgtctgtt

SEQ ID NO: 567802 - DNA, 25 bp, Rattus norvegicus
tgttgcacttctacgctgagcaggg

SEQ ID NO: 567803 - DNA, 25 bp, Rattus norvegicus
gccaccggacttcttcagtgttttg

SEQ ID NO: 567804 - DNA, 25 bp, Rattus norvegicus
cggcaacgaggcagacacagcttca

SEQ ID NO: 567805 - DNA, 25 bp, Rattus norvegicus
tctccacatgtgagcggcaacgagg

SEQ ID NO: 567806 - DNA, 25 bp, Rattus norvegicus
ggacaaggccgactctccacatgtg

SEQ ID NO: 567807 - DNA, 25 bp, Rattus norvegicus
ccgagcacctgcaggacaaggccga

SEQ ID NO: 567808 - DNA, 25 bp, Rattus norvegicus
agattgtggacacaccttcgggccc

SEQ ID NO: 567809 - DNA, 25 bp, Rattus norvegicus
gtcacgagattgtggacacaccttc

SEQ ID NO: 567810 - DNA, 25 bp, Rattus norvegicus
tttggtccgggacatgttgcacttc

SEQ ID NO: 567811 - DNA, 25 bp, Rattus norvegicus
gcagaggtcacctggagcgtcaggc

SEQ ID NO: 567812 - DNA, 25 bp, Rattus norvegicus
tgaaggcaccccatctggattccag

SEQ ID NO: 567813 - DNA, 25 bp, Rattus norvegicus
tggattccagcaccgggggagaact

SEQ ID NO: 567814 - DNA, 25 bp, Rattus norvegicus
tgagggtgagaaccgccgggaccta

SEQ ID NO: 567815 - DNA, 25 bp, Rattus norvegicus
ccctaatcctgagtgaagtcctcaa

SEQ ID NO: 567816 - DNA, 25 bp, Rattus norvegicus
ctgagtgaagtcctcaagacaggta

SEQ ID NO: 567817 - DNA, 25 bp, Rattus norvegicus
gtcctcaagacaggtaaccaagttc

SEQ ID NO: 567818 - DNA, 25 bp, Rattus norvegicus
ctcaagacaggtaaccaagttcctt

SEQ ID NO: 567819 - DNA, 25 bp, Rattus norvegicus
tttccccgccagagctcaagaagct

SEQ ID NO: 567820 - DNA, 25 bp, Rattus norvegicus
gctcaagaagctcccgcctcaagaa

SEQ ID NO: 567821 - DNA, 25 bp, Rattus norvegicus
gggttcgagacccaccgtggcgcgc

SEQ ID NO: 567822 - DNA, 25 bp, Rattus norvegicus
cgccaccttggtggcagtcgccgcg

SEQ ID NO: 567823 - DNA, 25 bp, Rattus norvegicus
cgtcccaccggagcgcgcggtccct

SEQ ID NO: 567824 - DNA, 25 bp, Rattus norvegicus
agccgaagctcacctggcggctggc

SEQ ID NO: 567825 - DNA, 25 bp, Rattus norvegicus
ggaagtgtatctgggcggcttacaa

SEQ ID NO: 567826 - DNA, 25 bp, Rattus norvegicus
gtatctgggcggcttacaaggtaag

SEQ ID NO: 567827 - DNA, 25 bp, Rattus norvegicus
cctctaagagaaataggggtgtctg

SEQ ID NO: 567828 - DNA, 25 bp, Rattus norvegicus
caacatgggatcaggccggcggctt

SEQ ID NO: 567829 - DNA, 25 bp, Rattus norvegicus
aaggtaaggcgccaacatgggatca

SEQ ID NO: 567830 - DNA, 25 bp, Rattus norvegicus
cggcttacaaggtaaggcgccaaca

SEQ ID NO: 567831 - DNA, 25 bp, Rattus norvegicus
taaggcgccaacatgggatcaggcc

SEQ ID NO: 567832 - DNA, 25 bp, Rattus norvegicus
tctaagagaaataggggtgtctgga

SEQ ID NO: 567833 - DNA, 25 bp, Rattus norvegicus
agcctctaagagaaataggggtgtc

SEQ ID NO: 567834 - DNA, 25 bp, Rattus norvegicus
tggggacagcctctaagagaaatag

SEQ ID NO: 567835 - DNA, 25 bp, Rattus norvegicus
ggtggggacagcctctaagagaaat

SEQ ID NO: 567836 - DNA, 25 bp, Rattus norvegicus
ttgctgagtcgggcccaccggcagc

SEQ ID NO: 567837 - DNA, 25 bp, Rattus norvegicus
ggcttccccggccttgctgagtcgg

SEQ ID NO: 567838 - DNA, 25 bp, Rattus norvegicus
cttacaaggtaaggcgccaacatgg

SEQ ID NO: 567839 - DNA, 25 bp, Rattus norvegicus
tgctggacccttcgtccagcgaaga

SEQ ID NO: 567840 - DNA, 25 bp, Rattus norvegicus
gcctttggcacagggctgcgctcat

SEQ ID NO: 567841 - DNA, 25 bp, Rattus norvegicus
cagcgaagaggaatcggatgagatc

SEQ ID NO: 567842 - DNA, 25 bp, Rattus norvegicus
ttcgcattgcgctgcattgcctacc

SEQ ID NO: 567843 - DNA, 25 bp, Rattus norvegicus
ccgcaaaactgctccgcgagctgga

SEQ ID NO: 567844 - DNA, 25 bp, Rattus norvegicus
atgtccctgggatttgtcggggcct

SEQ ID NO: 567845 - DNA, 25 bp, Rattus norvegicus
gcagccaggcgggaaagtcccgctc

SEQ ID NO: 567846 - DNA, 25 bp, Rattus norvegicus
gggaaagtcccgctcgctccgtgac

SEQ ID NO: 567847 - DNA, 25 bp, Rattus norvegicus
ctcgctccgtgacctaggtggcgcg

SEQ ID NO: 567848 - DNA, 25 bp, Rattus norvegicus
acttgcagcgggcagcgcccacaga

SEQ ID NO: 567849 - DNA, 25 bp, Rattus norvegicus
tctgacctaggaagaagcgcctacc

SEQ ID NO: 567850 - DNA, 25 bp, Rattus norvegicus
tgggtctgcgctcagctcgcgctcg

SEQ ID NO: 567851 - DNA, 25 bp, Rattus norvegicus
aagaagcgcctaccgggacagccga

SEQ ID NO: 567852 - DNA, 25 bp, Rattus norvegicus
gtgctcgctctctctgacctaggaa

SEQ ID NO: 567853 - DNA, 25 bp, Rattus norvegicus
agctttctccatcgagcgcatcatg

SEQ ID NO: 567854 - DNA, 25 bp, Rattus norvegicus
ttgtgaatcacgcaaggaactctgc

SEQ ID NO: 567855 - DNA, 25 bp, Rattus norvegicus
ccgattcgcaaacggctcgcacttt

SEQ ID NO: 567856 - DNA, 25 bp, Rattus norvegicus
gcgggcgctagttgcctcctttaaa

SEQ ID NO: 567857 - DNA, 25 bp, Rattus norvegicus
cgcccatgtcattccacttcaagtg

SEQ ID NO: 567858 - DNA, 25 bp, Rattus norvegicus
tgcatggctcggaacgcatctcctt

SEQ ID NO: 567859 - DNA, 25 bp, Rattus norvegicus
taactttgctctttccgtgcccagc

SEQ ID NO: 567860 - DNA, 25 bp, Rattus norvegicus
gtacccttgggtgcactttgttctg

SEQ ID NO: 567861 - DNA, 25 bp, Rattus norvegicus
cgggccgactaggtgcttattaaat

SEQ ID NO: 567862 - DNA, 25 bp, Rattus norvegicus
gccttttccggaatgcagacttaga

SEQ ID NO: 567863 - DNA, 25 bp, Rattus norvegicus
atggccagctcagcttccctggaga

SEQ ID NO: 567864 - DNA, 25 bp, Rattus norvegicus
ttccaccggcaaaaccatcacgatt

SEQ ID NO: 567865 - DNA, 25 bp, Rattus norvegicus
gcgcatcatggccaagacgtccgag

SEQ ID NO: 567866 - DNA, 25 bp, Rattus norvegicus
cggccacttcgaaaacactagcttt

SEQ ID NO: 567867 - DNA, 25 bp, Rattus norvegicus
ccgccctagtctgagcgacggtgtt

SEQ ID NO: 567868 - DNA, 25 bp, Rattus norvegicus
acgcgggctacaagcccttcgtctg

SEQ ID NO: 567869 - DNA, 25 bp, Rattus norvegicus
cacatccgcatccacgcgggctaca

SEQ ID NO: 567870 - DNA, 25 bp, Rattus norvegicus
gctccacgctcaatacgcacatccg

SEQ ID NO: 567871 - DNA, 25 bp, Rattus norvegicus
taagtgtaaccagtgcggcaaagcc

SEQ ID NO: 567872 - DNA, 25 bp, Rattus norvegicus
accacataagtgtaaccagtgcggc

SEQ ID NO: 567873 - DNA, 25 bp, Rattus norvegicus
ctccgcaggaaaaaccacataagtg

SEQ ID NO: 567874 - DNA, 25 bp, Rattus norvegicus
gtctcggccttactgtacgcatgcc

SEQ ID NO: 567875 - DNA, 25 bp, Rattus norvegicus
ctaggtctcggccttactgtacgca

SEQ ID NO: 567876 - DNA, 25 bp, Rattus norvegicus
ccttgcctaggtctcggccttactg

SEQ ID NO: 567877 - DNA, 25 bp, Rattus norvegicus
ggggatctgctgtgtcccttgccta

SEQ ID NO: 567878 - DNA, 25 bp, Rattus norvegicus
tgttcgattctccttacccttggtg

SEQ ID NO: 567879 - DNA, 25 bp, Rattus norvegicus
gagcgacggtgttcgattctcctta

SEQ ID NO: 567880 - DNA, 25 bp, Rattus norvegicus
ctacaagcccttcgtctgcgagttt

SEQ ID NO: 567881 - DNA, 25 bp, Rattus norvegicus
atcatctaatcattcccaggagggg

SEQ ID NO: 567882 - DNA, 25 bp, Rattus norvegicus
ccgtttgatccgaatctagataatc

SEQ ID NO: 567883 - DNA, 25 bp, Rattus norvegicus
tcaagagctcggattactggcgcgt

SEQ ID NO: 567884 - DNA, 25 bp, Rattus norvegicus
cacacttttaatatcggcgcggtga

SEQ ID NO: 567885 - DNA, 25 bp, Rattus norvegicus
ggcccgggagtactcttccacacag

SEQ ID NO: 567886 - DNA, 25 bp, Rattus norvegicus
gaacactgttcttctacaccagagg

SEQ ID NO: 567887 - DNA, 25 bp, Rattus norvegicus
cagagacccttcaaacagcattaca

SEQ ID NO: 567888 - DNA, 25 bp, Rattus norvegicus
cgcttgctttctaagtaatgaccca

SEQ ID NO: 567889 - DNA, 25 bp, Rattus norvegicus
gatgaaatgatctcacgcttgcttt

SEQ ID NO: 567890 - DNA, 25 bp, Rattus norvegicus
tgccgccatgcacgctgatgaaatg

SEQ ID NO: 567891 - DNA, 25 bp, Rattus norvegicus
ctcaatagctatctctgccgccatg

SEQ ID NO: 567892 - DNA, 25 bp, Rattus norvegicus
acgcagttagcccacttcctcaata

SEQ ID NO: 567893 - DNA, 25 bp, Rattus norvegicus
ccgggtcctgattaccacgcagtta

SEQ ID NO: 567894 - DNA, 25 bp, Rattus norvegicus
ggtgattcagcccacgtcttctgga

SEQ ID NO: 567895 - DNA, 25 bp, Rattus norvegicus
atgcagacaggaagcctgagctctg

SEQ ID NO: 567896 - DNA, 25 bp, Rattus norvegicus
caggcagccatctttgcgtacttta

SEQ ID NO: 567897 - DNA, 25 bp, Rattus norvegicus
ttaaacgttcgtccctgaatcgctc

SEQ ID NO: 567898 - DNA, 25 bp, Rattus norvegicus
aatcgctcagggtcggatgcagaca

SEQ ID NO: 567899 - DNA, 25 bp, Rattus norvegicus
ctttgagctcttccgggaacgcgcc

SEQ ID NO: 567900 - DNA, 25 bp, Rattus norvegicus
gaagcgagcaagtgcccaacggcta

SEQ ID NO: 567901 - DNA, 25 bp, Rattus norvegicus
gagctctgggtcagcgcactgcaca

SEQ ID NO: 567902 - DNA, 25 bp, Rattus norvegicus
ctttgcgtactttacgctcctgacg

SEQ ID NO: 567903 - DNA, 25 bp, Rattus norvegicus
ctccgccttttgaagcgagcaagtg

SEQ ID NO: 567904 - DNA, 25 bp, Rattus norvegicus
tcctctccttgggagcacttcaaga

SEQ ID NO: 567905 - DNA, 25 bp, Rattus norvegicus
ctggaaagtcactcctgctgactct

SEQ ID NO: 567906 - DNA, 25 bp, Rattus norvegicus
gcagccgactagagcagcgtccacg

SEQ ID NO: 567907 - DNA, 25 bp, Rattus norvegicus
tcccagcgagttctgcagccgacta

SEQ ID NO: 567908 - DNA, 25 bp, Rattus norvegicus
tgcacaggagcctgtctggcccttc

SEQ ID NO: 567909 - DNA, 25 bp, Rattus norvegicus
atggagcacagaactggtgattttc

SEQ ID NO: 567910 - DNA, 25 bp, Rattus norvegicus
tggccatgcctccatacaggaagta

SEQ ID NO: 567911 - DNA, 25 bp, Rattus norvegicus
tccatgctcccgaaagttgtggctc

SEQ ID NO: 567912 - DNA, 25 bp, Rattus norvegicus
gcagggaaacacaaaggatctcaga

SEQ ID NO: 567913 - DNA, 25 bp, Rattus norvegicus
tcagagacgatccagccgatagggc

SEQ ID NO: 567914 - DNA, 25 bp, Rattus norvegicus
agaagggctcctcttcgctcagaga

SEQ ID NO: 567915 - DNA, 25 bp, Rattus norvegicus
agctacgctagggacgatcctctcg

SEQ ID NO: 567916 - DNA, 25 bp, Rattus norvegicus
agctgccagagctcccggaaaaacc

SEQ ID NO: 567917 - DNA, 25 bp, Rattus norvegicus
gttccagtaacctccgcatgtccga

SEQ ID NO: 567918 - DNA, 25 bp, Rattus norvegicus
tacccgggaagcacaccacataatg

SEQ ID NO: 567919 - DNA, 25 bp, Rattus norvegicus
tgaccgggaatgcaaagctacgcta

SEQ ID NO: 567920 - DNA, 25 bp, Rattus norvegicus
tcctggcagagactttaaagccggc

SEQ ID NO: 567921 - DNA, 25 bp, Rattus norvegicus
aataagttcttgcttccgagcgagg

SEQ ID NO: 567922 - DNA, 25 bp, Rattus norvegicus
tcccgcaggaatccgggaagctgcc

SEQ ID NO: 567923 - DNA, 25 bp, Rattus norvegicus
cggcgctgcggaacccaaaagagcc

SEQ ID NO: 567924 - DNA, 25 bp, Rattus norvegicus
ggtcccggcggagggacatgcgccc

SEQ ID NO: 567925 - DNA, 25 bp, Rattus norvegicus
cctccctgcgccatcctggaacagt

SEQ ID NO: 567926 - DNA, 25 bp, Rattus norvegicus
ccctgcgccatcctggaacagtccc

SEQ ID NO: 567927 - DNA, 25 bp, Rattus norvegicus
cgctgcagtcgtcggctggagcctc

SEQ ID NO: 567928 - DNA, 25 bp, Rattus norvegicus
tgcagtcgtcggctggagcctcaac

SEQ ID NO: 567929 - DNA, 25 bp, Rattus norvegicus
gcagtcgtcggctggagcctcaacc

SEQ ID NO: 567930 - DNA, 25 bp, Rattus norvegicus
ccgagcatgtccactaggcggcgct

SEQ ID NO: 567931 - DNA, 25 bp, Rattus norvegicus
gagcatgtccactaggcggcgctgc

SEQ ID NO: 567932 - DNA, 25 bp, Rattus norvegicus
agcatgtccactaggcggcgctgcg

SEQ ID NO: 567933 - DNA, 25 bp, Rattus norvegicus
ggcgctgcggaacccaaaagagccc

SEQ ID NO: 567934 - DNA, 25 bp, Rattus norvegicus
cgctgcggaacccaaaagagcccgg

SEQ ID NO: 567935 - DNA, 25 bp, Rattus norvegicus
gctgcggaacccaaaagagcccgga

SEQ ID NO: 567936 - DNA, 25 bp, Rattus norvegicus
tgccggtttctgttgcggtcccggc

SEQ ID NO: 567937 - DNA, 25 bp, Rattus norvegicus
ggcggtcacgtaggttacacacagt

SEQ ID NO: 567938 - DNA, 25 bp, Rattus norvegicus
aggccgctgtgccatccctgccgcg

SEQ ID NO: 567939 - DNA, 25 bp, Rattus norvegicus
gagccaatgggtgcagcagcaaagc

SEQ ID NO: 567940 - DNA, 25 bp, Rattus norvegicus
cggctggaggctcagctgactgcag

SEQ ID NO: 567941 - DNA, 25 bp, Rattus norvegicus
aggtaccgaggcgagcccgagccag

SEQ ID NO: 567942 - DNA, 25 bp, Rattus norvegicus
ctgtgccatccctgccgcggctccc

SEQ ID NO: 567943 - DNA, 25 bp, Rattus norvegicus
acagtcactctgtcggcggagcccg

SEQ ID NO: 567944 - DNA, 25 bp, Rattus norvegicus
acacagtcactctgtcggcggagcc

SEQ ID NO: 567945 - DNA, 25 bp, Rattus norvegicus
tacacacagtcactctgtcggcgga

SEQ ID NO: 567946 - DNA, 25 bp, Rattus norvegicus
gtcacgtaggttacacacagtcact

SEQ ID NO: 567947 - DNA, 25 bp, Rattus norvegicus
cggtcacgtaggttacacacagtca

SEQ ID NO: 567948 - DNA, 25 bp, Rattus norvegicus
gccaatgggtgcagcagcaaagccc

SEQ ID NO: 567949 - DNA, 25 bp, Rattus norvegicus
ctgggcggtcacgtaggttacacac

SEQ ID NO: 567950 - DNA, 25 bp, Rattus norvegicus
cgagccgggaccaccatggcgcggg

SEQ ID NO: 567951 - DNA, 25 bp, Rattus norvegicus
ttgctatagaggtagctgcgggtcc

SEQ ID NO: 567952 - DNA, 25 bp, Rattus norvegicus
tgcggcccacgaagagccggtttcc

SEQ ID NO: 567953 - DNA, 25 bp, Rattus norvegicus
tgctccttgagctcttgcgcactcg

SEQ ID NO: 567954 - DNA, 25 bp, Rattus norvegicus
cactcgggctcttatcagggctgcc

SEQ ID NO: 567955 - DNA, 25 bp, Rattus norvegicus
gacacgtgagcaaaggcggagcctc

SEQ ID NO: 567956 - DNA, 25 bp, Rattus norvegicus
ttagcccggagaagctaccgctgcg

SEQ ID NO: 567957 - DNA, 25 bp, Rattus norvegicus
tcaatattcagaccaaggctccgcc

SEQ ID NO: 567958 - DNA, 25 bp, Rattus norvegicus
aggctccgcccattggcagtcaagc

SEQ ID NO: 567959 - DNA, 25 bp, Rattus norvegicus
cgcaggtcagaccaccctcgagagg

SEQ ID NO: 567960 - DNA, 25 bp, Rattus norvegicus
ccctcgagaggcttcctcgggaatc

SEQ ID NO: 567961 - DNA, 25 bp, Rattus norvegicus
tgcggccattactggctgagaaaca

SEQ ID NO: 567962 - DNA, 25 bp, Rattus norvegicus
ctgagaaacaagcacgtgacgcgtt

SEQ ID NO: 567963 - DNA, 25 bp, Rattus norvegicus
gaaaggacctgctgcggttgctata

SEQ ID NO: 567964 - DNA, 25 bp, Rattus norvegicus
tgacgcgttgactcgaaaggacctg

SEQ ID NO: 567965 - DNA, 25 bp, Rattus norvegicus
caggtgcacattgttaggttttcga

SEQ ID NO: 567966 - DNA, 25 bp, Rattus norvegicus
taggttttcgaatctcggcccttgc

SEQ ID NO: 567967 - DNA, 25 bp, Rattus norvegicus
cattgttaggttttcgaatctcggc

SEQ ID NO: 567968 - DNA, 25 bp, Rattus norvegicus
cacattgttaggttttcgaatctcg

SEQ ID NO: 567969 - DNA, 25 bp, Rattus norvegicus
gcacattgttaggttttcgaatctc

SEQ ID NO: 567970 - DNA, 25 bp, Rattus norvegicus
aggtgcacattgttaggttttcgaa

SEQ ID NO: 567971 - DNA, 25 bp, Rattus norvegicus
agcaggtgcacattgttaggttttc

SEQ ID NO: 567972 - DNA, 25 bp, Rattus norvegicus
cagcaggtgcacattgttaggtttt

SEQ ID NO: 567973 - DNA, 25 bp, Rattus norvegicus
gcagcaggtgcacattgttaggttt

SEQ ID NO: 567974 - DNA, 25 bp, Rattus norvegicus
cgcagcaggtgcacattgttaggtt

SEQ ID NO: 567975 - DNA, 25 bp, Rattus norvegicus
gacgcagcaggtgcacattgttagg

SEQ ID NO: 567976 - DNA, 25 bp, Rattus norvegicus
tgacgcagcaggtgcacattgttag

SEQ ID NO: 567977 - DNA, 25 bp, Rattus norvegicus
gcaggtgcacattgttaggttttcg

SEQ ID NO: 567978 - DNA, 25 bp, Rattus norvegicus
gtgcacattgttaggttttcgaatc

SEQ ID NO: 567979 - DNA, 25 bp, Rattus norvegicus
ccctagtggccctcatgatggtcag

SEQ ID NO: 567980 - DNA, 25 bp, Rattus norvegicus
ggtctgcggcatctgccaccacaag

SEQ ID NO: 567981 - DNA, 25 bp, Rattus norvegicus
atcgaccgctacctgcaggatctgg

SEQ ID NO: 567982 - DNA, 25 bp, Rattus norvegicus
catatcgaccgctacctgcaggatc

SEQ ID NO: 567983 - DNA, 25 bp, Rattus norvegicus
aggggcatatcgaccgctacctgca

SEQ ID NO: 567984 - DNA, 25 bp, Rattus norvegicus
ccctcatgatggtcaggggcatatc

SEQ ID NO: 567985 - DNA, 25 bp, Rattus norvegicus
aagggccgccctagtggccctcatg

SEQ ID NO: 567986 - DNA, 25 bp, Rattus norvegicus
gctgcgttcccttcggaggccgcag

SEQ ID NO: 567987 - DNA, 25 bp, Rattus norvegicus
gctgcggcatctgccaccacaagga

SEQ ID NO: 567988 - DNA, 25 bp, Rattus norvegicus
cgcagcggctgcgttcccttcggag

SEQ ID NO: 567989 - DNA, 25 bp, Rattus norvegicus
tctgcggcatctgccaccacaagga

SEQ ID NO: 567990 - DNA, 25 bp, Rattus norvegicus
gtcatcctctccgcggtcgcagggt

SEQ ID NO: 567991 - DNA, 25 bp, Rattus norvegicus
gggctgcggcatctgccaccacaag

SEQ ID NO: 567992 - DNA, 25 bp, Rattus norvegicus
atggtcaggggcatatcgaccgcta

SEQ ID NO: 567993 - DNA, 25 bp, Rattus norvegicus
ccgcccaggactcccgtgcggagct

SEQ ID NO: 567994 - DNA, 25 bp, Rattus norvegicus
cgagagcgcggacgccccctattgg

SEQ ID NO: 567995 - DNA, 25 bp, Rattus norvegicus
cgggctctgcagcagtcccgaagcc

SEQ ID NO: 567996 - DNA, 25 bp, Rattus norvegicus
gcagagcccgctggtccccactccg

SEQ ID NO: 567997 - DNA, 25 bp, Rattus norvegicus
cgcggtcgcccgcaagccaagccgg

SEQ ID NO: 567998 - DNA, 25 bp, Rattus norvegicus
actcccgtgcggagctccgcccagg

SEQ ID NO: 567999 - DNA, 25 bp, Rattus norvegicus
cccgcaagccaagccgggccggcca

SEQ ID NO: 568000 - DNA, 25 bp, Rattus norvegicus
gaggggacgactgagccggcgccca

SEQ ID NO: 568001 - DNA, 25 bp, Rattus norvegicus
ggcgcccagagttgcggctccagct

SEQ ID NO: 568002 - DNA, 25 bp, Rattus norvegicus
gcgcccagagttgcggctccagctg

SEQ ID NO: 568003 - DNA, 25 bp, Rattus norvegicus
ggcggcgccttctcagcagagtcgc

SEQ ID NO: 568004 - DNA, 25 bp, Rattus norvegicus
ggcgccttctcagcagagtcgcggc

SEQ ID NO: 568005 - DNA, 25 bp, Rattus norvegicus
cttctcagcagagtcgcggcgccga

SEQ ID NO: 568006 - DNA, 25 bp, Rattus norvegicus
tctcagcagagtcgcggcgccgaga

SEQ ID NO: 568007 - DNA, 25 bp, Rattus norvegicus
ctttcactgccaggcttccgggctg

SEQ ID NO: 568008 - DNA, 25 bp, Rattus norvegicus
aggtgtcacgccctaccattggctg

SEQ ID NO: 568009 - DNA, 25 bp, Rattus norvegicus
cttctgtgttgtcattcggctgcga

SEQ ID NO: 568010 - DNA, 25 bp, Rattus norvegicus
cctttgcggcaggtaagtagcggcc

SEQ ID NO: 568011 - DNA, 25 bp, Rattus norvegicus
tgtgccctttctgaacctctttctc

SEQ ID NO: 568012 - DNA, 25 bp, Rattus norvegicus
cgcaggaccaggattcgctagatgg

SEQ ID NO: 568013 - DNA, 25 bp, Rattus norvegicus
ctcgcaggcgtcaaaactggccgtt

SEQ ID NO: 568014 - DNA, 25 bp, Rattus norvegicus
ctttgccgaacagaggcgggaccta

SEQ ID NO: 568015 - DNA, 25 bp, Rattus norvegicus
ataggtctcaccctgccaaagcctg

SEQ ID NO: 568016 - DNA, 25 bp, Rattus norvegicus
ggtaaccggtctggactctgggcaa

SEQ ID NO: 568017 - DNA, 25 bp, Rattus norvegicus
ggcctccagttgacattctctattg

SEQ ID NO: 568018 - DNA, 25 bp, Rattus norvegicus
tattggcttactcaggaaggcgggc

SEQ ID NO: 568019 - DNA, 25 bp, Rattus norvegicus
gaaatactgccctgctattggctta

SEQ ID NO: 568020 - DNA, 25 bp, Rattus norvegicus
actggccgttggctacgtatgcaga

SEQ ID NO: 568021 - DNA, 25 bp, Rattus norvegicus
tcctgcaggttcttgggccaatgca

SEQ ID NO: 568022 - DNA, 25 bp, Rattus norvegicus
gacacggttcctgaagtctgacgta

SEQ ID NO: 568023 - DNA, 25 bp, Rattus norvegicus
atgtttggctctcctgacacggttc

SEQ ID NO: 568024 - DNA, 25 bp, Rattus norvegicus
cgcgctcatttacggaaaatgtttg

SEQ ID NO: 568025 - DNA, 25 bp, Rattus norvegicus
cttgggccaatgcagaagaaaaagc

SEQ ID NO: 568026 - DNA, 25 bp, Rattus norvegicus
tatgctccttcctgcccataagtgc

SEQ ID NO: 568027 - DNA, 25 bp, Rattus norvegicus
tgacaacacggtgtcctgcaggttc

SEQ ID NO: 568028 - DNA, 25 bp, Rattus norvegicus
cagagccaatggcatgcggaaggcc

SEQ ID NO: 568029 - DNA, 25 bp, Rattus norvegicus
cggcagagccgatggcagagccaat

SEQ ID NO: 568030 - DNA, 25 bp, Rattus norvegicus
ggaaagggaagcactatgctccttc

SEQ ID NO: 568031 - DNA, 25 bp, Rattus norvegicus
gtctgacgtaaagcatggctgtctg

SEQ ID NO: 568032 - DNA, 25 bp, Rattus norvegicus
ccgggcactcagcagacgggatgac

SEQ ID NO: 568033 - DNA, 25 bp, Rattus norvegicus
ataagtgctggcctcggtgcacagc

SEQ ID NO: 568034 - DNA, 25 bp, Rattus norvegicus
aagcacaaaacacgcgctcatttac

SEQ ID NO: 568035 - DNA, 25 bp, Rattus norvegicus
cgtccttccgatcccgctgggtcct

SEQ ID NO: 568036 - DNA, 25 bp, Rattus norvegicus
agtaccatgagctcccggcctcggg

SEQ ID NO: 568037 - DNA, 25 bp, Rattus norvegicus
gtacactcagtaccatgagctcccg

SEQ ID NO: 568038 - DNA, 25 bp, Rattus norvegicus
tcgcctctgcatcgtacactcagta

SEQ ID NO: 568039 - DNA, 25 bp, Rattus norvegicus
tagcgccgtacttcaccgcagggta

SEQ ID NO: 568040 - DNA, 25 bp, Rattus norvegicus
gggctgtcaacacccgtccttccga

SEQ ID NO: 568041 - DNA, 25 bp, Rattus norvegicus
gtcgtcccagcctgcgggctgtcaa

SEQ ID NO: 568042 - DNA, 25 bp, Rattus norvegicus
catgaaggccatcccgggccgacgc

SEQ ID NO: 568043 - DNA, 25 bp, Rattus norvegicus
ggctggcggtttctccatgaaggcc

SEQ ID NO: 568044 - DNA, 25 bp, Rattus norvegicus
tcgtccagcagcaccttgcgggctg

SEQ ID NO: 568045 - DNA, 25 bp, Rattus norvegicus
gtcagcggcaccgtgtcgtccagca

SEQ ID NO: 568046 - DNA, 25 bp, Rattus norvegicus
tgcagactctggctcgcctcgacgg

SEQ ID NO: 568047 - DNA, 25 bp, Rattus norvegicus
tgtgcgactgcagactctggctcgc

SEQ ID NO: 568048 - DNA, 25 bp, Rattus norvegicus
caccgcagggtaggtgactgaaacc

SEQ ID NO: 568049 - DNA, 25 bp, Rattus norvegicus
cacgaccatagtgaagacccttcca

SEQ ID NO: 568050 - DNA, 25 bp, Rattus norvegicus
gctattgactaagcgcccacctcga

SEQ ID NO: 568051 - DNA, 25 bp, Rattus norvegicus
acctcgaaggcagtgcgcccagcaa

SEQ ID NO: 568052 - DNA, 25 bp, Rattus norvegicus
tgtatccggtacctcaaccgcgttg

SEQ ID NO: 568053 - DNA, 25 bp, Rattus norvegicus
cggctctctgactgacacgaccata

SEQ ID NO: 568054 - DNA, 25 bp, Rattus norvegicus
ttacattagagtccgttccgcaccg

SEQ ID NO: 568055 - DNA, 25 bp, Rattus norvegicus
ggatcagcctttccggtcaccgtct

SEQ ID NO: 568056 - DNA, 25 bp, Rattus norvegicus
ctctagcgcccacttccggaattgg

SEQ ID NO: 568057 - DNA, 25 bp, Rattus norvegicus
ggacgatcgggttatgcaccctcta

SEQ ID NO: 568058 - DNA, 25 bp, Rattus norvegicus
tccgtcactgacctattgcgtaatc

SEQ ID NO: 568059 - DNA, 25 bp, Rattus norvegicus
gcagcccaagtttggtcctggaaaa

SEQ ID NO: 568060 - DNA, 25 bp, Rattus norvegicus
ggcttactacaactcggcacgggtc

SEQ ID NO: 568061 - DNA, 25 bp, Rattus norvegicus
aacgaagccgctcactgggatagcc

SEQ ID NO: 568062 - DNA, 25 bp, Rattus norvegicus
gatagccgcgttcctgtcaattgca

SEQ ID NO: 568063 - DNA, 25 bp, Rattus norvegicus
cgctctccgcgataggcttagtttg

SEQ ID NO: 568064 - DNA, 25 bp, Rattus norvegicus
tgctagcatgcagccagacagtggg

SEQ ID NO: 568065 - DNA, 25 bp, Rattus norvegicus
ccctgggcttaaggatgctagcatg

SEQ ID NO: 568066 - DNA, 25 bp, Rattus norvegicus
aggctgccatccctctaagaacgta

SEQ ID NO: 568067 - DNA, 25 bp, Rattus norvegicus
gggaggtttgtatctcggactcatc

SEQ ID NO: 568068 - DNA, 25 bp, Rattus norvegicus
tcggactcatctgcattcacccttg

SEQ ID NO: 568069 - DNA, 25 bp, Rattus norvegicus
taagaacgtagccaccgtcgccttc

SEQ ID NO: 568070 - DNA, 25 bp, Rattus norvegicus
ttgcgccctccgacagaaaaaccag

SEQ ID NO: 568071 - DNA, 25 bp, Rattus norvegicus
gcttagtttgactccttaaaggcgc

SEQ ID NO: 568072 - DNA, 25 bp, Rattus norvegicus
acccttgcgatgctggggtgaagaa

SEQ ID NO: 568073 - DNA, 25 bp, Rattus norvegicus
caccttaagagagagcgggaaaacg

SEQ ID NO: 568074 - DNA, 25 bp, Rattus norvegicus
gctcaaaacatcaaacccggaagta

SEQ ID NO: 568075 - DNA, 25 bp, Rattus norvegicus
gcccggatttgtttggctcaaaaca

SEQ ID NO: 568076 - DNA, 25 bp, Rattus norvegicus
ttaaaggcgcaacgcactcgcttgc

SEQ ID NO: 568077 - DNA, 25 bp, Rattus norvegicus
gcctccgtatgtgatattaacgtcg

SEQ ID NO: 568078 - DNA, 25 bp, Rattus norvegicus
gataccactagtgcggcgatacctc

SEQ ID NO: 568079 - DNA, 25 bp, Rattus norvegicus
attaacgtgataccactagtgcggc

SEQ ID NO: 568080 - DNA, 25 bp, Rattus norvegicus
aagccattctattccattaacgtga

SEQ ID NO: 568081 - DNA, 25 bp, Rattus norvegicus
gacactctataagccattctattcc

SEQ ID NO: 568082 - DNA, 25 bp, Rattus norvegicus
agaactcgcttatggacactctata

SEQ ID NO: 568083 - DNA, 25 bp, Rattus norvegicus
cgcttaccgccagaactcgcttatg

SEQ ID NO: 568084 - DNA, 25 bp, Rattus norvegicus
aggtcagcccgtgccggtccgctta

SEQ ID NO: 568085 - DNA, 25 bp, Rattus norvegicus
aaagtggaatgtgaggtcagcccgt

SEQ ID NO: 568086 - DNA, 25 bp, Rattus norvegicus
tgcagtttatctttgactccgacgg

SEQ ID NO: 568087 - DNA, 25 bp, Rattus norvegicus
ccgtctttgttgtctctgcagttta

SEQ ID NO: 568088 - DNA, 25 bp, Rattus norvegicus
gctgcagctgccgtctttgttgtct

SEQ ID NO: 568089 - DNA, 25 bp, Rattus norvegicus
cgcaaacgggatgtactccgcgctg

SEQ ID NO: 568090 - DNA, 25 bp, Rattus norvegicus
cccaggcgcaaacgggatgtactcc

SEQ ID NO: 568091 - DNA, 25 bp, Rattus norvegicus
gcagttccgcatgcaaccaccgggt

SEQ ID NO: 568092 - DNA, 25 bp, Rattus norvegicus
gggatgacgccacggcccaacgcag

SEQ ID NO: 568093 - DNA, 25 bp, Rattus norvegicus
ttccgcatgcaaccaccgggtggcg

SEQ ID NO: 568094 - DNA, 25 bp, Rattus norvegicus
accgggtggcgagatgttcaaagcc

SEQ ID NO: 568095 - DNA, 25 bp, Rattus norvegicus
gcgagatgttcaaagcctgaccttg

SEQ ID NO: 568096 - DNA, 25 bp, Rattus norvegicus
ttcaaagcctgaccttgcaatacgg

SEQ ID NO: 568097 - DNA, 25 bp, Rattus norvegicus
ggctatctatccctgccgcgctggc

SEQ ID NO: 568098 - DNA, 25 bp, Rattus norvegicus
ccctgcccgtgcctcggctatctat

SEQ ID NO: 568099 - DNA, 25 bp, Rattus norvegicus
cacacgtgatctccgccgccgctaa

SEQ ID NO: 568100 - DNA, 25 bp, Rattus norvegicus
tcaccagatggtgcccgaggccgcg

SEQ ID NO: 568101 - DNA, 25 bp, Rattus norvegicus
ccatgtgtcaccagatggtgcccga

SEQ ID NO: 568102 - DNA, 25 bp, Rattus norvegicus
tacggccatgtgtcaccagatggtg

SEQ ID NO: 568103 - DNA, 25 bp, Rattus norvegicus
tgcaatacggccatgtgtcaccaga

SEQ ID NO: 568104 - DNA, 25 bp, Rattus norvegicus
cctgaccttgcaatacggccatgtg

SEQ ID NO: 568105 - DNA, 25 bp, Rattus norvegicus
cactgcatgccgttcacactgcata

SEQ ID NO: 568106 - DNA, 25 bp, Rattus norvegicus
cagcccgttcacactgcagcccgtt

SEQ ID NO: 568107 - DNA, 25 bp, Rattus norvegicus
ttcacactgcataccgttcacactg

SEQ ID NO: 568108 - DNA, 25 bp, Rattus norvegicus
tgcagcccgttcacactgcagcccg

SEQ ID NO: 568109 - DNA, 25 bp, Rattus norvegicus
tgccgttcacactgcatgccgttca

SEQ ID NO: 568110 - DNA, 25 bp, Rattus norvegicus
ccgttcacactgcagcccgttcaca

SEQ ID NO: 568111 - DNA, 25 bp, Rattus norvegicus
ccgttcacactgcatgccgttcaca

SEQ ID NO: 568112 - DNA, 25 bp, Rattus norvegicus
agcccgttcacactgcatgccgttc

SEQ ID NO: 568113 - DNA, 25 bp, Rattus norvegicus
catgccgttcacactgcataccgtt

SEQ ID NO: 568114 - DNA, 25 bp, Rattus norvegicus
tgccgttcacactgcataccgttca

SEQ ID NO: 568115 - DNA, 25 bp, Rattus norvegicus
ttcacactgcatgccgttcacactg

SEQ ID NO: 568116 - DNA, 25 bp, Rattus norvegicus
tgcatgccgttcacactgcataccg

SEQ ID NO: 568117 - DNA, 25 bp, Rattus norvegicus
gcatgccgttcacactgcataccgt

SEQ ID NO: 568118 - DNA, 25 bp, Rattus norvegicus
gttcacactgcataccgttcacact

SEQ ID NO: 568119 - DNA, 25 bp, Rattus norvegicus
cgtgaacgtgttctgctgaatcttc

SEQ ID NO: 568120 - DNA, 25 bp, Rattus norvegicus
gccaggtctttctcggtcaccggca

SEQ ID NO: 568121 - DNA, 25 bp, Rattus norvegicus
ctgcaggttcccgatgcgtttgttc

SEQ ID NO: 568122 - DNA, 25 bp, Rattus norvegicus
ggagcaccatgtcgagcaatcacgc

SEQ ID NO: 568123 - DNA, 25 bp, Rattus norvegicus
ggctcgaaagcgttgctacactagc

SEQ ID NO: 568124 - DNA, 25 bp, Rattus norvegicus
aggcaacgagcttcagggactgaga

SEQ ID NO: 568125 - DNA, 25 bp, Rattus norvegicus
caacaggagctggactgtcttcgtc

SEQ ID NO: 568126 - DNA, 25 bp, Rattus norvegicus
gcgtttgttcacacacttgaggtgc

SEQ ID NO: 568127 - DNA, 25 bp, Rattus norvegicus
gctttcgtggtctaggaactccaga

SEQ ID NO: 568128 - DNA, 25 bp, Rattus norvegicus
ccaatggacacgagcttaatgcttt

SEQ ID NO: 568129 - DNA, 25 bp, Rattus norvegicus
ttactgcaaatctagggcctggcca

SEQ ID NO: 568130 - DNA, 25 bp, Rattus norvegicus
cctatgttcctagggctatcccaga

SEQ ID NO: 568131 - DNA, 25 bp, Rattus norvegicus
gcgccgcggaaaaggcctatgttcc

SEQ ID NO: 568132 - DNA, 25 bp, Rattus norvegicus
actgagatgaaaagccctaagggcc

SEQ ID NO: 568133 - DNA, 25 bp, Rattus norvegicus
tcacgttccggctaaacggtgtcaa

SEQ ID NO: 568134 - DNA, 25 bp, Rattus norvegicus
tatcactggatactgcgcggtggga

SEQ ID NO: 568135 - DNA, 25 bp, Rattus norvegicus
ggagcgtttcctcacgttccggcta

SEQ ID NO: 568136 - DNA, 25 bp, Rattus norvegicus
cgctgtagctacagtggagcgtttc

SEQ ID NO: 568137 - DNA, 25 bp, Rattus norvegicus
acagctccaccgggctgcgagtgtg

SEQ ID NO: 568138 - DNA, 25 bp, Rattus norvegicus
atactgcgcggtgggacagctccac

SEQ ID NO: 568139 - DNA, 25 bp, Rattus norvegicus
gcgccctaggcccagtatcactgga

SEQ ID NO: 568140 - DNA, 25 bp, Rattus norvegicus
ccggatgaggaggatattttggtcc

SEQ ID NO: 568141 - DNA, 25 bp, Rattus norvegicus
ctgccacttggcgtccggatgagga

SEQ ID NO: 568142 - DNA, 25 bp, Rattus norvegicus
cgggactggcctgccacttggcgtc

SEQ ID NO: 568143 - DNA, 25 bp, Rattus norvegicus
actctgaacggtccactcctgtggc

SEQ ID NO: 568144 - DNA, 25 bp, Rattus norvegicus
ttgagctccgttgccaggcgacaga

SEQ ID NO: 568145 - DNA, 25 bp, Rattus norvegicus
cacccgagtgctggggttgagctcc

SEQ ID NO: 568146 - DNA, 25 bp, Rattus norvegicus
tcggttgacccgactctgaacggtc

SEQ ID NO: 568147 - DNA, 25 bp, Rattus norvegicus
gacctgcctcataagcccggtggtg

SEQ ID NO: 568148 - DNA, 25 bp, Rattus norvegicus
ccagccatcagctcggtgatgttca

SEQ ID NO: 568149 - DNA, 25 bp, Rattus norvegicus
ttctgggaaacctcatcgcgctggc

SEQ ID NO: 568150 - DNA, 25 bp, Rattus norvegicus
tgctggtaacggaactggtgctcac

SEQ ID NO: 568151 - DNA, 25 bp, Rattus norvegicus
agagtcgtcagtatctcctttcgga

SEQ ID NO: 568152 - DNA, 25 bp, Rattus norvegicus
ttattcgagaaaccagaccctagtg

SEQ ID NO: 568153 - DNA, 25 bp, Rattus norvegicus
cgcgcgtgtacctatttcgctttca

SEQ ID NO: 568154 - DNA, 25 bp, Rattus norvegicus
accttctttagtctggccacgatgc

SEQ ID NO: 568155 - DNA, 25 bp, Rattus norvegicus
gctgctcaactacggggagtacgtc

SEQ ID NO: 568156 - DNA, 25 bp, Rattus norvegicus
ctttatccagcacgggaggaccgca

SEQ ID NO: 568157 - DNA, 25 bp, Rattus norvegicus
ggaggaccgcataccttcagctgta

SEQ ID NO: 568158 - DNA, 25 bp, Rattus norvegicus
tcagcgtgatcctcaaccttattcg

SEQ ID NO: 568159 - DNA, 25 bp, Rattus norvegicus
ccttattcgcatgcagcttcggagc

SEQ ID NO: 568160 - DNA, 25 bp, Rattus norvegicus
gacctctatctccttgttccacgtg

SEQ ID NO: 568161 - DNA, 25 bp, Rattus norvegicus
aggcggaggccgttctcgtcctcca

SEQ ID NO: 568162 - DNA, 25 bp, Rattus norvegicus
ctgcgtgtgttcctttcgccgcagg

SEQ ID NO: 568163 - DNA, 25 bp, Rattus norvegicus
gcgtgtgttcctttcgccgcaggcc

SEQ ID NO: 568164 - DNA, 25 bp, Rattus norvegicus
ggttcgggattcagcgcccgcctgc

SEQ ID NO: 568165 - DNA, 25 bp, Rattus norvegicus
cgggttcgggattcagcgcccgcct

SEQ ID NO: 568166 - DNA, 25 bp, Rattus norvegicus
gcggagtttgaaggccacgtgtggc

SEQ ID NO: 568167 - DNA, 25 bp, Rattus norvegicus
atggaggagcggagtttgaaggcca

SEQ ID NO: 568168 - DNA, 25 bp, Rattus norvegicus
caccggcgtcccgatggcggcggat

SEQ ID NO: 568169 - DNA, 25 bp, Rattus norvegicus
tggtcgcaccattgccagggggctt

SEQ ID NO: 568170 - DNA, 25 bp, Rattus norvegicus
cagctggtcgcaccattgccagggg

SEQ ID NO: 568171 - DNA, 25 bp, Rattus norvegicus
tccagctggtcgcaccattgccagg

SEQ ID NO: 568172 - DNA, 25 bp, Rattus norvegicus
gcctgcgtgtgttcctttcgccgca

SEQ ID NO: 568173 - DNA, 25 bp, Rattus norvegicus
aggccgttctcgtcctccactccag

SEQ ID NO: 568174 - DNA, 25 bp, Rattus norvegicus
tctcgtcctccactccagctggtcg

SEQ ID NO: 568175 - DNA, 25 bp, Rattus norvegicus
cctacggcttccagcccatggtgtg

SEQ ID NO: 568176 - DNA, 25 bp, Rattus norvegicus
ggcaaagaggctcccaggagcagtc

SEQ ID NO: 568177 - DNA, 25 bp, Rattus norvegicus
ttcctgccaggcaaagaggctccca

SEQ ID NO: 568178 - DNA, 25 bp, Rattus norvegicus
tttgcagagcatgttcctgccaggc

SEQ ID NO: 568179 - DNA, 25 bp, Rattus norvegicus
agaaagcgaagccacgcggggcgac

SEQ ID NO: 568180 - DNA, 25 bp, Rattus norvegicus
cggagacccgctaccacaagtacgg

SEQ ID NO: 568181 - DNA, 25 bp, Rattus norvegicus
cggcttccagcccatggtgtgttgc

SEQ ID NO: 568182 - DNA, 25 bp, Rattus norvegicus
cccaccacccgccttgccgctcgcg

SEQ ID NO: 568183 - DNA, 25 bp, Rattus norvegicus
gcctggctaagaggcgctcccacca

SEQ ID NO: 568184 - DNA, 25 bp, Rattus norvegicus
ctcccaggagcagtcaggggagccc

SEQ ID NO: 568185 - DNA, 25 bp, Rattus norvegicus
agctatgggccctcagcgccactct

SEQ ID NO: 568186 - DNA, 25 bp, Rattus norvegicus
gtgctaagacaagcacagggctctg

SEQ ID NO: 568187 - DNA, 25 bp, Rattus norvegicus
atcctggaaaggtgctaagacaagc

SEQ ID NO: 568188 - DNA, 25 bp, Rattus norvegicus
aacctggcatcctggaaaggtgcta

SEQ ID NO: 568189 - DNA, 25 bp, Rattus norvegicus
ttgtctccagccgagagttgttttc

SEQ ID NO: 568190 - DNA, 25 bp, Rattus norvegicus
cgaacggcggctcagttaccagagc

SEQ ID NO: 568191 - DNA, 25 bp, Rattus norvegicus
gcggctgctcctgtaccgcgaacgg

SEQ ID NO: 568192 - DNA, 25 bp, Rattus norvegicus
agagttgttttctgccgctgcggag

SEQ ID NO: 568193 - DNA, 25 bp, Rattus norvegicus
cgggtttctcagctgattgtctcca

SEQ ID NO: 568194 - DNA, 25 bp, Rattus norvegicus
agcgcctcaaaagctcgggtttctc

SEQ ID NO: 568195 - DNA, 25 bp, Rattus norvegicus
gccaatcgcgggcagctcacagtgc

SEQ ID NO: 568196 - DNA, 25 bp, Rattus norvegicus
ttaacgaagtctggagtgacaggct

SEQ ID NO: 568197 - DNA, 25 bp, Rattus norvegicus
aagtcttgcagttgctgggccaatc

SEQ ID NO: 568198 - DNA, 25 bp, Rattus norvegicus
gagaacagctccaggtgtcagaatc

SEQ ID NO: 568199 - DNA, 25 bp, Rattus norvegicus
cgtaagcgacactccaaccaataga

SEQ ID NO: 568200 - DNA, 25 bp, Rattus norvegicus
cctcgtgctccttacgtaagcgaca

SEQ ID NO: 568201 - DNA, 25 bp, Rattus norvegicus
ctcttcctgtgtctcgcgtgggcag

SEQ ID NO: 568202 - DNA, 25 bp, Rattus norvegicus
tcgcctttgcctacctgcagctgtg

SEQ ID NO: 568203 - DNA, 25 bp, Rattus norvegicus
cgaagtcgggccaagacggcaccca

SEQ ID NO: 568204 - DNA, 25 bp, Rattus norvegicus
ctccgggatcttgtcccgaagtcgg

SEQ ID NO: 568205 - DNA, 25 bp, Rattus norvegicus
aatggagaagcccagtgcgggctcc

SEQ ID NO: 568206 - DNA, 25 bp, Rattus norvegicus
cctctgtaatggagaagcccagtgc

SEQ ID NO: 568207 - DNA, 25 bp, Rattus norvegicus
gcagggaagggtaatgccctctgta

SEQ ID NO: 568208 - DNA, 25 bp, Rattus norvegicus
aagctcctgcgctctccaaaggatc

SEQ ID NO: 568209 - DNA, 25 bp, Rattus norvegicus
aggcaagcgcggcaagctcctgcgc

SEQ ID NO: 568210 - DNA, 25 bp, Rattus norvegicus
caacggcggacagccgcactcggag

SEQ ID NO: 568211 - DNA, 25 bp, Rattus norvegicus
caagacggcacccaacggcggacag

SEQ ID NO: 568212 - DNA, 25 bp, Rattus norvegicus
ccgcactcggaggatgacagcagcg

SEQ ID NO: 568213 - DNA, 25 bp, Rattus norvegicus
acctcacggaccctagccacgctga

SEQ ID NO: 568214 - DNA, 25 bp, Rattus norvegicus
acgctgacctcctgcctctcatagc

SEQ ID NO: 568215 - DNA, 25 bp, Rattus norvegicus
cagcactccaggcaagcgcggcaag

SEQ ID NO: 568216 - DNA, 25 bp, Rattus norvegicus
atgccctctgtaatggagaagccca

SEQ ID NO: 568217 - DNA, 25 bp, Rattus norvegicus
tccaggtgccgggtccacccagaaa

SEQ ID NO: 568218 - DNA, 25 bp, Rattus norvegicus
gtccgccgtgctctggctgcctaaa

SEQ ID NO: 568219 - DNA, 25 bp, Rattus norvegicus
cctggtgcgaagacgcggtcatcgc

SEQ ID NO: 568220 - DNA, 25 bp, Rattus norvegicus
cgaggaagcagtgtgacaagctgcc

SEQ ID NO: 568221 - DNA, 25 bp, Rattus norvegicus
acgacgcccaagagtccgacgagca

SEQ ID NO: 568222 - DNA, 25 bp, Rattus norvegicus
agaaacaccgctgtgccgctgtctc

SEQ ID NO: 568223 - DNA, 25 bp, Rattus norvegicus
ctcacctgacagaaacaccgctgtg

SEQ ID NO: 568224 - DNA, 25 bp, Rattus norvegicus
tgttggagttcatttcggggagcac

SEQ ID NO: 568225 - DNA, 25 bp, Rattus norvegicus
cctgcggctcgcctggtgcgaagac

SEQ ID NO: 568226 - DNA, 25 bp, Rattus norvegicus
ggagttcacgctggcccatcccttt

SEQ ID NO: 568227 - DNA, 25 bp, Rattus norvegicus
ggcccatccctttctctctatgagg

SEQ ID NO: 568228 - DNA, 25 bp, Rattus norvegicus
tctctctatgaggaaatcgagcctg

SEQ ID NO: 568229 - DNA, 25 bp, Rattus norvegicus
gaaatcgagcctgggttacgtgtcc

SEQ ID NO: 568230 - DNA, 25 bp, Rattus norvegicus
gctgcctaaagccaaaaggatgttg

SEQ ID NO: 568231 - DNA, 25 bp, Rattus norvegicus
gacctgcaacaggtgggtcaccatt

SEQ ID NO: 568232 - DNA, 25 bp, Rattus norvegicus
atggttatctcctccgcgcgggcag

SEQ ID NO: 568233 - DNA, 25 bp, Rattus norvegicus
cattgaaggcaaagcccggctaccc

SEQ ID NO: 568234 - DNA, 25 bp, Rattus norvegicus
gaccgcgcacttcctgtcttcagta

SEQ ID NO: 568235 - DNA, 25 bp, Rattus norvegicus
cagaacggaccaagtagacccaatc

SEQ ID NO: 568236 - DNA, 25 bp, Rattus norvegicus
ctcctggcccagaacggaccaagta

SEQ ID NO: 568237 - DNA, 25 bp, Rattus norvegicus
ggatgcgcacgtcgcgcctcatgac

SEQ ID NO: 568238 - DNA, 25 bp, Rattus norvegicus
ccagcagcaggatgcgcacgtcgcg

SEQ ID NO: 568239 - DNA, 25 bp, Rattus norvegicus
gcgacaggatcagagaagtcttccc

SEQ ID NO: 568240 - DNA, 25 bp, Rattus norvegicus
cgccgaccagcgacaggatcagaga

SEQ ID NO: 568241 - DNA, 25 bp, Rattus norvegicus
ggcgcacctcctcgggaaactcctc

SEQ ID NO: 568242 - DNA, 25 bp, Rattus norvegicus
gcatccgcccctagtgtccagttaa

SEQ ID NO: 568243 - DNA, 25 bp, Rattus norvegicus
gtgggtcaccattgaaggcaaagcc

SEQ ID NO: 568244 - DNA, 25 bp, Rattus norvegicus
gtcggcggggatggttatctcctcc

SEQ ID NO: 568245 - DNA, 25 bp, Rattus norvegicus
gaacctaaacgagcgcatcctgcgg

SEQ ID NO: 568246 - DNA, 25 bp, Rattus norvegicus
tgttgaatgtgtgcggaacctaaac

SEQ ID NO: 568247 - DNA, 25 bp, Rattus norvegicus
ggccggaaccttcgacatagcggtg

SEQ ID NO: 568248 - DNA, 25 bp, Rattus norvegicus
cccgtaagatgagctcctggcggcg

SEQ ID NO: 568249 - DNA, 25 bp, Rattus norvegicus
cagacaaggagaactgtaccgccta

SEQ ID NO: 568250 - DNA, 25 bp, Rattus norvegicus
taccgcctactacgagcgctgtctg

SEQ ID NO: 568251 - DNA, 25 bp, Rattus norvegicus
gtgctcgccgtgctcagagtaagta

SEQ ID NO: 568252 - DNA, 25 bp, Rattus norvegicus
aacaaaactggcgaccctgagcggc

SEQ ID NO: 568253 - DNA, 25 bp, Rattus norvegicus
cgccctccatctgtaggtcctgtgg

SEQ ID NO: 568254 - DNA, 25 bp, Rattus norvegicus
ccctgcagactttgggtgagcaccg

SEQ ID NO: 568255 - DNA, 25 bp, Rattus norvegicus
gcctcagcccaagaacaaggctgtt

SEQ ID NO: 568256 - DNA, 25 bp, Rattus norvegicus
tgaccggcctccttccgtaggcaga

SEQ ID NO: 568257 - DNA, 25 bp, Rattus norvegicus
gtaaaactgctccttccggtggcta

SEQ ID NO: 568258 - DNA, 25 bp, Rattus norvegicus
tgggccgctgagaccgtagctcagc

SEQ ID NO: 568259 - DNA, 25 bp, Rattus norvegicus
tcaggactaccgcaagaagctgcta

SEQ ID NO: 568260 - DNA, 25 bp, Rattus norvegicus
agggacgaggcgctttgtcatcccg

SEQ ID NO: 568261 - DNA, 25 bp, Rattus norvegicus
gaggcttcggcagagcccgaaaaca

SEQ ID NO: 568262 - DNA, 25 bp, Rattus norvegicus
ccctatgagcgacggcttctcatca

SEQ ID NO: 568263 - DNA, 25 bp, Rattus norvegicus
gcttctcatcatggcggaccctaga

SEQ ID NO: 568264 - DNA, 25 bp, Rattus norvegicus
gcccgaaaacagagcgcccggcttg

SEQ ID NO: 568265 - DNA, 25 bp, Rattus norvegicus
ccctagagataaggcgcttcaggac

SEQ ID NO: 568266 - DNA, 25 bp, Rattus norvegicus
agctgctagaacacaaggagattga

SEQ ID NO: 568267 - DNA, 25 bp, Rattus norvegicus
cacaaggagattgacggccgtctta

SEQ ID NO: 568268 - DNA, 25 bp, Rattus norvegicus
ccgtcttaaggagcgtgagtgagcc

SEQ ID NO: 568269 - DNA, 25 bp, Rattus norvegicus
gtgagccttgacacactctctagtg

SEQ ID NO: 568270 - DNA, 25 bp, Rattus norvegicus
actctctagtgcctggaccggcttc

SEQ ID NO: 568271 - DNA, 25 bp, Rattus norvegicus
accggcttccgtctctgatagagtg

SEQ ID NO: 568272 - DNA, 25 bp, Rattus norvegicus
ctctgatagagtggaggcttcggca

SEQ ID NO: 568273 - DNA, 25 bp, Rattus norvegicus
agagcatcaagcttagccgcccggc

SEQ ID NO: 568274 - DNA, 25 bp, Rattus norvegicus
gaggcacggccacgcacaccactcc

SEQ ID NO: 568275 - DNA, 25 bp, Rattus norvegicus
agccggaaccgcctggccgaacgtg

SEQ ID NO: 568276 - DNA, 25 bp, Rattus norvegicus
acgctcccgtcccagcgcgtcagtc

SEQ ID NO: 568277 - DNA, 25 bp, Rattus norvegicus
ggctcccggacaggggcatcccagt

SEQ ID NO: 568278 - DNA, 25 bp, Rattus norvegicus
ccggccggacaacagagcatcaagc

SEQ ID NO: 568279 - DNA, 25 bp, Rattus norvegicus
actctcgtccctaggccctccaaga

SEQ ID NO: 568280 - DNA, 25 bp, Rattus norvegicus
cctttcatagcgacggcggcagaca

SEQ ID NO: 568281 - DNA, 25 bp, Rattus norvegicus
ggagttcgcgccctttcatagcgac

SEQ ID NO: 568282 - DNA, 25 bp, Rattus norvegicus
tgcaccggtaaaagggagttcgcgc

SEQ ID NO: 568283 - DNA, 25 bp, Rattus norvegicus
tcgctgcaccggtaaaagggagttc

SEQ ID NO: 568284 - DNA, 25 bp, Rattus norvegicus
ggctctgatcgctgcaccggtaaaa

SEQ ID NO: 568285 - DNA, 25 bp, Rattus norvegicus
gcgcgtgtcttcagcggctctgatc

SEQ ID NO: 568286 - DNA, 25 bp, Rattus norvegicus
cggacaggggcatcccagtctccgg

SEQ ID NO: 568287 - DNA, 25 bp, Rattus norvegicus
gccgggtgctaggatctcccaatcc

SEQ ID NO: 568288 - DNA, 25 bp, Rattus norvegicus
atccttatcccgtccagagccatgg

SEQ ID NO: 568289 - DNA, 25 bp, Rattus norvegicus
gtcggtgacatggacgctcagttcc

SEQ ID NO: 568290 - DNA, 25 bp, Rattus norvegicus
gacatcacggttcaggtcggtgaca

SEQ ID NO: 568291 - DNA, 25 bp, Rattus norvegicus
cccggtcactctgagggtgacatca

SEQ ID NO: 568292 - DNA, 25 bp, Rattus norvegicus
ccgagtttttccaccaacttcagca

SEQ ID NO: 568293 - DNA, 25 bp, Rattus norvegicus
caggggtgctactcaccgagttttt

SEQ ID NO: 568294 - DNA, 25 bp, Rattus norvegicus
gaaatggctctcgtcagcgtcactc

SEQ ID NO: 568295 - DNA, 25 bp, Rattus norvegicus
ctcctctcattctgggaagtcttca

SEQ ID NO: 568296 - DNA, 25 bp, Rattus norvegicus
ctccttcctgcgagcgcggaggaaa

SEQ ID NO: 568297 - DNA, 25 bp, Rattus norvegicus
cattttaagcgcagcacacgccggg

SEQ ID NO: 568298 - DNA, 25 bp, Rattus norvegicus
cccgatagcaacaaatttcgcattt

SEQ ID NO: 568299 - DNA, 25 bp, Rattus norvegicus
aagtcttcattggaggcatcagggg

SEQ ID NO: 568300 - DNA, 25 bp, Rattus norvegicus
gtccgcgtagcagccatctggcatc

SEQ ID NO: 568301 - DNA, 25 bp, Rattus norvegicus
cgtcactacctcgtagcggtgccga

SEQ ID NO: 568302 - DNA, 25 bp, Rattus norvegicus
agtctaatggttcgcgcctggaaga

SEQ ID NO: 568303 - DNA, 25 bp, Rattus norvegicus
aggcccgaagccactagtgttgctc

SEQ ID NO: 568304 - DNA, 25 bp, Rattus norvegicus
ctgaagtcgtagttctcgtcgctga

SEQ ID NO: 568305 - DNA, 25 bp, Rattus norvegicus
gacgaacccgactcggccgagctga

SEQ ID NO: 568306 - DNA, 25 bp, Rattus norvegicus
tgtagtagcgcagcgacgaacccga

SEQ ID NO: 568307 - DNA, 25 bp, Rattus norvegicus
tgagtgacatccacctcgtagaggc

SEQ ID NO: 568308 - DNA, 25 bp, Rattus norvegicus
agggcttccaggtcttcttgtcttc

SEQ ID NO: 568309 - DNA, 25 bp, Rattus norvegicus
acgcacacgggctcgatggtcacca

SEQ ID NO: 568310 - DNA, 25 bp, Rattus norvegicus
tcgtcctccctgaagctagaggttg

SEQ ID NO: 568311 - DNA, 25 bp, Rattus norvegicus
aggcgagctcaatgcgcagagagtc

SEQ ID NO: 568312 - DNA, 25 bp, Rattus norvegicus
ttgtcttccttgtagaaccagcgca

SEQ ID NO: 568313 - DNA, 25 bp, Rattus norvegicus
agtcgtagccgatgaagggcttcca

SEQ ID NO: 568314 - DNA, 25 bp, Rattus norvegicus
ggttccagtataccgggtagcactc

SEQ ID NO: 568315 - DNA, 25 bp, Rattus norvegicus
ccgtccaaagcctggggtgacgagt

SEQ ID NO: 568316 - DNA, 25 bp, Rattus norvegicus
cgcagggccctctcagtgtggcgct

SEQ ID NO: 568317 - DNA, 25 bp, Rattus norvegicus
tccgctcctctacgcggccgagtga

SEQ ID NO: 568318 - DNA, 25 bp, Rattus norvegicus
ccatttcacgttaaatacgccgagc

SEQ ID NO: 568319 - DNA, 25 bp, Rattus norvegicus
atacgccgagcaacagccctaagga

SEQ ID NO: 568320 - DNA, 25 bp, Rattus norvegicus
agcaacagccctaaggaccagcatg

SEQ ID NO: 568321 - DNA, 25 bp, Rattus norvegicus
ggaccagcatgctctaatcagaacc

SEQ ID NO: 568322 - DNA, 25 bp, Rattus norvegicus
tgctctaatcagaaccgcctgtctt

SEQ ID NO: 568323 - DNA, 25 bp, Rattus norvegicus
gaaccgcctgtcttcgcaagcttca

SEQ ID NO: 568324 - DNA, 25 bp, Rattus norvegicus
tcttcgcaagcttcacctaggctgc

SEQ ID NO: 568325 - DNA, 25 bp, Rattus norvegicus
ggacctgaaaccacagccgggggca

SEQ ID NO: 568326 - DNA, 25 bp, Rattus norvegicus
tggtgctaccaggtgctcgctcccg

SEQ ID NO: 568327 - DNA, 25 bp, Rattus norvegicus
tcttgaagtccgtccaaagcctggg

SEQ ID NO: 568328 - DNA, 25 bp, Rattus norvegicus
ggcgggatcttgaagtccgtccaaa

SEQ ID NO: 568329 - DNA, 25 bp, Rattus norvegicus
tcatctctttggtccttcgcgttcc

SEQ ID NO: 568330 - DNA, 25 bp, Rattus norvegicus
aagtccgacgggagggacagacagc

SEQ ID NO: 568331 - DNA, 25 bp, Rattus norvegicus
ctgcggacctttcatctctttggtc

SEQ ID NO: 568332 - DNA, 25 bp, Rattus norvegicus
aagagagcgacagcgctgcctgaga

SEQ ID NO: 568333 - DNA, 25 bp, Rattus norvegicus
cgtctggccttcaggggccaggaaa

SEQ ID NO: 568334 - DNA, 25 bp, Rattus norvegicus
tacgcttcgagcgtctggccttcag

SEQ ID NO: 568335 - DNA, 25 bp, Rattus norvegicus
cgtacgcttcgagcgtctggccttc

SEQ ID NO: 568336 - DNA, 25 bp, Rattus norvegicus
cagtgggagcgctttagaaggaccc

SEQ ID NO: 568337 - DNA, 25 bp, Rattus norvegicus
agaagacagtgggagcgctttagaa

SEQ ID NO: 568338 - DNA, 25 bp, Rattus norvegicus
acgcagcggatcagagaagacagtg

SEQ ID NO: 568339 - DNA, 25 bp, Rattus norvegicus
tgcaacgcagcggatcagagaagac

SEQ ID NO: 568340 - DNA, 25 bp, Rattus norvegicus
ttcttgcaacgcagcggatcagaga

SEQ ID NO: 568341 - DNA, 25 bp, Rattus norvegicus
ccactttcttgcaacgcagcggatc

SEQ ID NO: 568342 - DNA, 25 bp, Rattus norvegicus
ggacctgcggacctttcatctcttt

SEQ ID NO: 568343 - DNA, 25 bp, Rattus norvegicus
agagagagcgcgcatcacatttttt

SEQ ID NO: 568344 - DNA, 25 bp, Rattus norvegicus
tttgcaccagctacagaatcgcagc

SEQ ID NO: 568345 - DNA, 25 bp, Rattus norvegicus
cacacgtgggcctgttctaacctca

SEQ ID NO: 568346 - DNA, 25 bp, Rattus norvegicus
cagatctcagagtcgcaaaggcttt

SEQ ID NO: 568347 - DNA, 25 bp, Rattus norvegicus
ggggtgacctgactatcccaagatg

SEQ ID NO: 568348 - DNA, 25 bp, Rattus norvegicus
cagattccaaaacaggcgtcgccga

SEQ ID NO: 568349 - DNA, 25 bp, Rattus norvegicus
tgggttcctagctccagacagattc

SEQ ID NO: 568350 - DNA, 25 bp, Rattus norvegicus
gcggatctaactcccagccagaaga

SEQ ID NO: 568351 - DNA, 25 bp, Rattus norvegicus
tctccgagaggccaaataatgcttc

SEQ ID NO: 568352 - DNA, 25 bp, Rattus norvegicus
agcctcacgaccgagagttacgaga

SEQ ID NO: 568353 - DNA, 25 bp, Rattus norvegicus
ctcttctgttcaaggaggtcgttgc

SEQ ID NO: 568354 - DNA, 25 bp, Rattus norvegicus
ttgcctcacttaggaactcgacgtg

SEQ ID NO: 568355 - DNA, 25 bp, Rattus norvegicus
gcggcttctgaagcactgtctagta

SEQ ID NO: 568356 - DNA, 25 bp, Rattus norvegicus
cgagaacagctttcggcctgcactc

SEQ ID NO: 568357 - DNA, 25 bp, Rattus norvegicus
aagctgcggggcgatcccgctgaac

SEQ ID NO: 568358 - DNA, 25 bp, Rattus norvegicus
ggtgcagggtcacccggacgactcc

SEQ ID NO: 568359 - DNA, 25 bp, Rattus norvegicus
acgactccgcaccacccgctggggc

SEQ ID NO: 568360 - DNA, 25 bp, Rattus norvegicus
cagcgaccgcggcacgcccgcttct

SEQ ID NO: 568361 - DNA, 25 bp, Rattus norvegicus
gcccgcttctctgcccttgttattt

SEQ ID NO: 568362 - DNA, 25 bp, Rattus norvegicus
aggctgcaccctcctacctgcaaga

SEQ ID NO: 568363 - DNA, 25 bp, Rattus norvegicus
cccgctcgcagacttgttttgcagg

SEQ ID NO: 568364 - DNA, 25 bp, Rattus norvegicus
gacttgttttgcaggatttgtgccc

SEQ ID NO: 568365 - DNA, 25 bp, Rattus norvegicus
ggaggctaacttgacccacacttga

SEQ ID NO: 568366 - DNA, 25 bp, Rattus norvegicus
taaacagcaagctgcggggcgatcc

SEQ ID NO: 568367 - DNA, 25 bp, Rattus norvegicus
gcaccgatctgcatccacagcagga

SEQ ID NO: 568368 - DNA, 25 bp, Rattus norvegicus
tccacagcaggagagactaccgata

SEQ ID NO: 568369 - DNA, 25 bp, Rattus norvegicus
gagactaccgatacacggggcgttc

SEQ ID NO: 568370 - DNA, 25 bp, Rattus norvegicus
ttgacccacacttgaataaacagca

SEQ ID NO: 568371 - DNA, 25 bp, Rattus norvegicus
gctcaggacacttccaccactgttg

SEQ ID NO: 568372 - DNA, 25 bp, Rattus norvegicus
ccgaaccagccgagctaagtaggcg

SEQ ID NO: 568373 - DNA, 25 bp, Rattus norvegicus
tccgtacagtgcagaggccgaacca

SEQ ID NO: 568374 - DNA, 25 bp, Rattus norvegicus
catccggggcctccgtacagtgcag

SEQ ID NO: 568375 - DNA, 25 bp, Rattus norvegicus
ttccaccactgttgccttctgcttg

SEQ ID NO: 568376 - DNA, 25 bp, Rattus norvegicus
tatgggctcgctcaggacacttcca

SEQ ID NO: 568377 - DNA, 25 bp, Rattus norvegicus
cccacgtcttgtatgggctcgctca

SEQ ID NO: 568378 - DNA, 25 bp, Rattus norvegicus
gcgtagctccctatcgcctaaaaga

SEQ ID NO: 568379 - DNA, 25 bp, Rattus norvegicus
aaaacacgcagcacggcgcctagca

SEQ ID NO: 568380 - DNA, 25 bp, Rattus norvegicus
catacgctgtcttacgcaaaacacg

SEQ ID NO: 568381 - DNA, 25 bp, Rattus norvegicus
tctagtcactgacgcagcggggacc

SEQ ID NO: 568382 - DNA, 25 bp, Rattus norvegicus
cgggcttctacatgaggtctagtca

SEQ ID NO: 568383 - DNA, 25 bp, Rattus norvegicus
gccgcctgagcaccggtcttgggca

SEQ ID NO: 568384 - DNA, 25 bp, Rattus norvegicus
tgccttctgcttgggcctctgcagc

SEQ ID NO: 568385 - DNA, 25 bp, Rattus norvegicus
tgagccaggccacggactaagaaac

SEQ ID NO: 568386 - DNA, 25 bp, Rattus norvegicus
ggcggagccctccagtcaatccatt

SEQ ID NO: 568387 - DNA, 25 bp, Rattus norvegicus
gccttccgcgcgtctttcaaagact

SEQ ID NO: 568388 - DNA, 25 bp, Rattus norvegicus
ttcaaagacttcctccgaaccaatg

SEQ ID NO: 568389 - DNA, 25 bp, Rattus norvegicus
agcagtcaaaggctgagccaggcca

SEQ ID NO: 568390 - DNA, 25 bp, Rattus norvegicus
tagtaacctccctgcgcgtcgggga

SEQ ID NO: 568391 - DNA, 25 bp, Rattus norvegicus
cggactaagaaacagagcgaggata

SEQ ID NO: 568392 - DNA, 25 bp, Rattus norvegicus
ggatatgattggttgctagaacgcc

SEQ ID NO: 568393 - DNA, 25 bp, Rattus norvegicus
tttgactcgcctagtaacctccctg

SEQ ID NO: 568394 - DNA, 25 bp, Rattus norvegicus
cacgcgagcggaccaatgagctgac

SEQ ID NO: 568395 - DNA, 25 bp, Rattus norvegicus
gacccgaaggattctcgccgctggg

SEQ ID NO: 568396 - DNA, 25 bp, Rattus norvegicus
tccgctgcgttgctggacggccagc

SEQ ID NO: 568397 - DNA, 25 bp, Rattus norvegicus
gccagcggtttgactcgcctagtaa

SEQ ID NO: 568398 - DNA, 25 bp, Rattus norvegicus
tccgaaccaatgagcagtcaaaggc

SEQ ID NO: 568399 - DNA, 25 bp, Rattus norvegicus
acgccgttggcataccggtacacaa

SEQ ID NO: 568400 - DNA, 25 bp, Rattus norvegicus
gctgaggccactccgctatctggaa

SEQ ID NO: 568401 - DNA, 25 bp, Rattus norvegicus
agggtcacgtgcatcctctcggcct

SEQ ID NO: 568402 - DNA, 25 bp, Rattus norvegicus
ggtcaggcaatgttcagggcagccc

SEQ ID NO: 568403 - DNA, 25 bp, Rattus norvegicus
gtgaactgtctcgaaccgtccggca

SEQ ID NO: 568404 - DNA, 25 bp, Rattus norvegicus
tgtctccttgggtgaactgtctcga

SEQ ID NO: 568405 - DNA, 25 bp, Rattus norvegicus
ctatctggaagttgcgctgcagcca

SEQ ID NO: 568406 - DNA, 25 bp, Rattus norvegicus
gccatagtacctgcgggtgtcctga

SEQ ID NO: 568407 - DNA, 25 bp, Rattus norvegicus
cgccctagggcaccagattcggcaa

SEQ ID NO: 568408 - DNA, 25 bp, Rattus norvegicus
ctctgcggccatcttaggggaccag

SEQ ID NO: 568409 - DNA, 25 bp, Rattus norvegicus
acattagagcaagggccagggcctc

SEQ ID NO: 568410 - DNA, 25 bp, Rattus norvegicus
ggtacacaacattcagccatggcga

SEQ ID NO: 568411 - DNA, 25 bp, Rattus norvegicus
acctctgtgctacttacgccgttgg

SEQ ID NO: 568412 - DNA, 25 bp, Rattus norvegicus
ggtccactagggatctcggacatta

SEQ ID NO: 568413 - DNA, 25 bp, Rattus norvegicus
gtcaccgaaccacggtgttctacta

SEQ ID NO: 568414 - DNA, 25 bp, Rattus norvegicus
cgcgcatcgagtgctgcaaagcagc

SEQ ID NO: 568415 - DNA, 25 bp, Rattus norvegicus
cagcgttggaaatgcaacaactatc

SEQ ID NO: 568416 - DNA, 25 bp, Rattus norvegicus
actatccgatcttggccatgctctg

SEQ ID NO: 568417 - DNA, 25 bp, Rattus norvegicus
ccatgctctgaggaaggcttaaaag

SEQ ID NO: 568418 - DNA, 25 bp, Rattus norvegicus
ggcttaaaaggcaatcggtaattca

SEQ ID NO: 568419 - DNA, 25 bp, Rattus norvegicus
aaaacttcacgtcgttcggtgcgca

SEQ ID NO: 568420 - DNA, 25 bp, Rattus norvegicus
agccctgctcgcgaatagcggagcg

SEQ ID NO: 568421 - DNA, 25 bp, Rattus norvegicus
gctgcaaaatgctacgccgtcgctc

SEQ ID NO: 568422 - DNA, 25 bp, Rattus norvegicus
ggctactcacgtgccagatggcgaa

SEQ ID NO: 568423 - DNA, 25 bp, Rattus norvegicus
cagcagcgccagcatatagcagaag

SEQ ID NO: 568424 - DNA, 25 bp, Rattus norvegicus
aggccgcgaaagtgaacgccatggc

SEQ ID NO: 568425 - DNA, 25 bp, Rattus norvegicus
cgcacggccctctgggtaaaaccat

SEQ ID NO: 568426 - DNA, 25 bp, Rattus norvegicus
gttctactagaaaatcgcgcatcga

SEQ ID NO: 568427 - DNA, 25 bp, Rattus norvegicus
ggatcacaaggaccagacccgggtc

SEQ ID NO: 568428 - DNA, 25 bp, Rattus norvegicus
acgttccaaccgtctgcccgcagcg

SEQ ID NO: 568429 - DNA, 25 bp, Rattus norvegicus
ggccagaatgcaaccagaacccggg

SEQ ID NO: 568430 - DNA, 25 bp, Rattus norvegicus
acgccagggcgaggccagaatgcaa

SEQ ID NO: 568431 - DNA, 25 bp, Rattus norvegicus
agaacccgggcactcgccaccaaca

SEQ ID NO: 568432 - DNA, 25 bp, Rattus norvegicus
cggctggcacacagctcagtgttcc

SEQ ID NO: 568433 - DNA, 25 bp, Rattus norvegicus
ttcctgcttcggctggcacacagct

SEQ ID NO: 568434 - DNA, 25 bp, Rattus norvegicus
cgttgccgtatgatctcttgggccc

SEQ ID NO: 568435 - DNA, 25 bp, Rattus norvegicus
tcagccgtccgttgccgtatgatct

SEQ ID NO: 568436 - DNA, 25 bp, Rattus norvegicus
cccacctaactacgcggccgccgtg

SEQ ID NO: 568437 - DNA, 25 bp, Rattus norvegicus
taccattttccttccggtcgtcagc

SEQ ID NO: 568438 - DNA, 25 bp, Rattus norvegicus
gtgaacctgcacagtcccgcggtgc

SEQ ID NO: 568439 - DNA, 25 bp, Rattus norvegicus
aagtcgggacagacggtgaacctgc

SEQ ID NO: 568440 - DNA, 25 bp, Rattus norvegicus
ttccgccgcggggatcacaaggacc

SEQ ID NO: 568441 - DNA, 25 bp, Rattus norvegicus
gcggaattctcgcaggccaccaatc

SEQ ID NO: 568442 - DNA, 25 bp, Rattus norvegicus
gtggtcttcacctgcttcatcgtca

SEQ ID NO: 568443 - DNA, 25 bp, Rattus norvegicus
gctcttctacatcgcggtggtcttc

SEQ ID NO: 568444 - DNA, 25 bp, Rattus norvegicus
ccgcagtgttcctggttacgctcta

SEQ ID NO: 568445 - DNA, 25 bp, Rattus norvegicus
cgagtgaggacctacaaagtttgtc

SEQ ID NO: 568446 - DNA, 25 bp, Rattus norvegicus
gtggcatacctggatcaaccttttg

SEQ ID NO: 568447 - DNA, 25 bp, Rattus norvegicus
tcaccaccggcctggtattaggatg

SEQ ID NO: 568448 - DNA, 25 bp, Rattus norvegicus
ttgtaatttgcgaactgggccgggc

SEQ ID NO: 568449 - DNA, 25 bp, Rattus norvegicus
gatggccgcaaactgcagctttgta

SEQ ID NO: 568450 - DNA, 25 bp, Rattus norvegicus
ctaaaattttgtcaccgatggccgc

SEQ ID NO: 568451 - DNA, 25 bp, Rattus norvegicus
cggagactcggcatcaactaaaatt

SEQ ID NO: 568452 - DNA, 25 bp, Rattus norvegicus
ttgcagggtttcaggataccatgtg

SEQ ID NO: 568453 - DNA, 25 bp, Rattus norvegicus
gggtttccgcgactattggcaaatc

SEQ ID NO: 568454 - DNA, 25 bp, Rattus norvegicus
cgagaccattcattttgtagacaac

SEQ ID NO: 568455 - DNA, 25 bp, Rattus norvegicus
cagagacagtgactccgggtgttta

SEQ ID NO: 568456 - DNA, 25 bp, Rattus norvegicus
agagccgagcggttagtctctcctc

SEQ ID NO: 568457 - DNA, 25 bp, Rattus norvegicus
ggaggcttcgcttttctacccagaa

SEQ ID NO: 568458 - DNA, 25 bp, Rattus norvegicus
tggaggtgagtgtcccttttgcttc

SEQ ID NO: 568459 - DNA, 25 bp, Rattus norvegicus
cagtccttcgcgagccgacactgga

SEQ ID NO: 568460 - DNA, 25 bp, Rattus norvegicus
taatcagtagcatgtggggagctcc

SEQ ID NO: 568461 - DNA, 25 bp, Rattus norvegicus
gctccctgccaagcccatgatgtaa

SEQ ID NO: 568462 - DNA, 25 bp, Rattus norvegicus
tatggtccgggcttaggaatccgtc

SEQ ID NO: 568463 - DNA, 25 bp, Rattus norvegicus
gatcttccaatctgtgctcttccgc

SEQ ID NO: 568464 - DNA, 25 bp, Rattus norvegicus
tgtgtttcgctacgcagatcttcca

SEQ ID NO: 568465 - DNA, 25 bp, Rattus norvegicus
gtccagctcggttgggattcactcc

SEQ ID NO: 568466 - DNA, 25 bp, Rattus norvegicus
tggcgagccacattcccaagggcga

SEQ ID NO: 568467 - DNA, 25 bp, Rattus norvegicus
cgggtcccagaccaaagggtcactg

SEQ ID NO: 568468 - DNA, 25 bp, Rattus norvegicus
tgtttacggtctacaccagtcagcc

SEQ ID NO: 568469 - DNA, 25 bp, Rattus norvegicus
tgcagctctttctgtcctttcagta

SEQ ID NO: 568470 - DNA, 25 bp, Rattus norvegicus
tcagctctgcctggagcactcgctg

SEQ ID NO: 568471 - DNA, 25 bp, Rattus norvegicus
cgggctctcgagcatctgcctcgaa

SEQ ID NO: 568472 - DNA, 25 bp, Rattus norvegicus
ctcaagcgcgtaagccagacccagg

SEQ ID NO: 568473 - DNA, 25 bp, Rattus norvegicus
tgccgaggtctcactgcagctcttt

SEQ ID NO: 568474 - DNA, 25 bp, Rattus norvegicus
cctttcagtagtgatcgccgcttgg

SEQ ID NO: 568475 - DNA, 25 bp, Rattus norvegicus
ggacgccggaaatcaccatcctgaa

SEQ ID NO: 568476 - DNA, 25 bp, Rattus norvegicus
agagcgttcttcattcagttttgtg

SEQ ID NO: 568477 - DNA, 25 bp, Rattus norvegicus
gccttgtgagggatttacattttta

SEQ ID NO: 568478 - DNA, 25 bp, Rattus norvegicus
gctactgtctgtcatcgtctctgga

SEQ ID NO: 568479 - DNA, 25 bp, Rattus norvegicus
tggagaatcaaccagaaccaccgga

SEQ ID NO: 568480 - DNA, 25 bp, Rattus norvegicus
gcagagtcagtacctgcagcgcccg

SEQ ID NO: 568481 - DNA, 25 bp, Rattus norvegicus
ctaaccatgatgtttcgcgaccagg

SEQ ID NO: 568482 - DNA, 25 bp, Rattus norvegicus
gacgctctcgtctaggtctctcgtg

SEQ ID NO: 568483 - DNA, 25 bp, Rattus norvegicus
gtggttgctgtctcccgcagtaaaa

SEQ ID NO: 568484 - DNA, 25 bp, Rattus norvegicus
gtttactcagagaatgcggatccca

SEQ ID NO: 568485 - DNA, 25 bp, Rattus norvegicus
tgttcgatccctgtttactcagaga

SEQ ID NO: 568486 - DNA, 25 bp, Rattus norvegicus
tagagtgggtatgattgttcgatcc

SEQ ID NO: 568487 - DNA, 25 bp, Rattus norvegicus
gtggcacgcttgcaatcgtagagtg

SEQ ID NO: 568488 - DNA, 25 bp, Rattus norvegicus
tgcggatcccaaagataaagaggcc

SEQ ID NO: 568489 - DNA, 25 bp, Rattus norvegicus
tcccgcagtaaaagccatcggaatg

SEQ ID NO: 568490 - DNA, 25 bp, Rattus norvegicus
cctgcaggcaggatacgatctcaca

SEQ ID NO: 568491 - DNA, 25 bp, Rattus norvegicus
agaagaatttgagaacctgcaggca

SEQ ID NO: 568492 - DNA, 25 bp, Rattus norvegicus
ggaacccgtggacagaagaatttga

SEQ ID NO: 568493 - DNA, 25 bp, Rattus norvegicus
ctgcagacgcgggaacccgtggaca

SEQ ID NO: 568494 - DNA, 25 bp, Rattus norvegicus
gagatgtacggacgcctgcagacgc

SEQ ID NO: 568495 - DNA, 25 bp, Rattus norvegicus
ctcacagtgaggtggttgctgtctc

SEQ ID NO: 568496 - DNA, 25 bp, Rattus norvegicus
catcggaatgtacggtggcttctgc

SEQ ID NO: 568497 - DNA, 25 bp, Rattus norvegicus
attggcccgagcctcttgcgtcaag

SEQ ID NO: 568498 - DNA, 25 bp, Rattus norvegicus
ccacagaagaggctgggacgtgaca

SEQ ID NO: 568499 - DNA, 25 bp, Rattus norvegicus
ctcggtgcgccaaaagtgaagcaac

SEQ ID NO: 568500 - DNA, 25 bp, Rattus norvegicus
ggcgcacgtaccgacctgagatggt

SEQ ID NO: 568501 - DNA, 25 bp, Rattus norvegicus
tgagatggtctcctggtatcccttg

SEQ ID NO: 568502 - DNA, 25 bp, Rattus norvegicus
atcccttggtgaagaactgcatggc

SEQ ID NO: 568503 - DNA, 25 bp, Rattus norvegicus
agctcgttatcctcctcgctgcggg

SEQ ID NO: 568504 - DNA, 25 bp, Rattus norvegicus
tcggggaacccattggtgcacctta

SEQ ID NO: 568505 - DNA, 25 bp, Rattus norvegicus
attgctcccgagacaccctaaggtg

SEQ ID NO: 568506 - DNA, 25 bp, Rattus norvegicus
ccctaaggtgctaccaagcgctgcg

SEQ ID NO: 568507 - DNA, 25 bp, Rattus norvegicus
tgtcaccgggacaggagttcagcac

SEQ ID NO: 568508 - DNA, 25 bp, Rattus norvegicus
tcagcaccgaatgaggttcgaagtc

SEQ ID NO: 568509 - DNA, 25 bp, Rattus norvegicus
cgccgcgcctctctttttatggcgg

SEQ ID NO: 568510 - DNA, 25 bp, Rattus norvegicus
gttcgaagtctagggcaagccgcca

SEQ ID NO: 568511 - DNA, 25 bp, Rattus norvegicus
ctccgcatcggtcatcttcgactga

SEQ ID NO: 568512 - DNA, 25 bp, Rattus norvegicus
aagaggcgttcctggtctattcctc

SEQ ID NO: 568513 - DNA, 25 bp, Rattus norvegicus
gaatgaccgccaacaatcacgcctg

SEQ ID NO: 568514 - DNA, 25 bp, Rattus norvegicus
agcggcaagctgacactgggctgac

SEQ ID NO: 568515 - DNA, 25 bp, Rattus norvegicus
ctgcaggattgggaaacgcgaacta

SEQ ID NO: 568516 - DNA, 25 bp, Rattus norvegicus
ggaggtgacaagcttctcctctgca

SEQ ID NO: 568517 - DNA, 25 bp, Rattus norvegicus
gtatgtcacatacgcccggggaggt

SEQ ID NO: 568518 - DNA, 25 bp, Rattus norvegicus
ttccctcaccggaagagtgacagca

SEQ ID NO: 568519 - DNA, 25 bp, Rattus norvegicus
cggcatctttccctacctgagctgt

SEQ ID NO: 568520 - DNA, 25 bp, Rattus norvegicus
gggcttctgtatggccggcatcttt

SEQ ID NO: 568521 - DNA, 25 bp, Rattus norvegicus
tgtccgtacctcatgggcttctgta

SEQ ID NO: 568522 - DNA, 25 bp, Rattus norvegicus
gtgtgtccttctgtatgtccgtacc

SEQ ID NO: 568523 - DNA, 25 bp, Rattus norvegicus
caaagcagacttcggtgtgtccttc

SEQ ID NO: 568524 - DNA, 25 bp, Rattus norvegicus
actgactgtgcgtgccgcgaatgac

SEQ ID NO: 568525 - DNA, 25 bp, Rattus norvegicus
tggcggagctccaggcaaagcgaaa

SEQ ID NO: 568526 - DNA, 25 bp, Rattus norvegicus
attgcaggggttcttggctcaagta

SEQ ID NO: 568527 - DNA, 25 bp, Rattus norvegicus
agaggcactgacaacaggaagcggc

SEQ ID NO: 568528 - DNA, 25 bp, Rattus norvegicus
cgcctcagttcggagaaaaagccgc

SEQ ID NO: 568529 - DNA, 25 bp, Rattus norvegicus
ttcggagaaaaagccgcggctccag

SEQ ID NO: 568530 - DNA, 25 bp, Rattus norvegicus
ggcgtctgacgccatcacgtcggct

SEQ ID NO: 568531 - DNA, 25 bp, Rattus norvegicus
cgcggaaccaatcacgaggcctaga

SEQ ID NO: 568532 - DNA, 25 bp, Rattus norvegicus
gtccagaccctagactcaccaaagg

SEQ ID NO: 568533 - DNA, 25 bp, Rattus norvegicus
ccaggcaaagcgaaacgcctcagtt

SEQ ID NO: 568534 - DNA, 25 bp, Rattus norvegicus
aagtaagcgattctgcggctcgcga

SEQ ID NO: 568535 - DNA, 25 bp, Rattus norvegicus
ctgcggctcgcgatgccaggattct

SEQ ID NO: 568536 - DNA, 25 bp, Rattus norvegicus
ccaggattctgggtagcgcagagta

SEQ ID NO: 568537 - DNA, 25 bp, Rattus norvegicus
ccactggagagtcgggaccgcctgt

SEQ ID NO: 568538 - DNA, 25 bp, Rattus norvegicus
tcttggctcaagtaagcgattctgc

SEQ ID NO: 568539 - DNA, 25 bp, Rattus norvegicus
cgcaagccagctgggcccagaagta

SEQ ID NO: 568540 - DNA, 25 bp, Rattus norvegicus
tgggcccagaagtagcctcggagca

SEQ ID NO: 568541 - DNA, 25 bp, Rattus norvegicus
caggtccctcggtctccggtacttg

SEQ ID NO: 568542 - DNA, 25 bp, Rattus norvegicus
tacttgtagtccttgacaggcggga

SEQ ID NO: 568543 - DNA, 25 bp, Rattus norvegicus
ccagaagtagcctcggagcaggagt

SEQ ID NO: 568544 - DNA, 25 bp, Rattus norvegicus
tctccaaggtcaccctcgtgcccgg

SEQ ID NO: 568545 - DNA, 25 bp, Rattus norvegicus
ggagcgatcagaagcccgcaaggcc

SEQ ID NO: 568546 - DNA, 25 bp, Rattus norvegicus
actcaccttgcaaggggccagggtc

SEQ ID NO: 568547 - DNA, 25 bp, Rattus norvegicus
ggcggcaccggctgccggcatttca

SEQ ID NO: 568548 - DNA, 25 bp, Rattus norvegicus
tgccggcatttcaggagctcgccaa

SEQ ID NO: 568549 - DNA, 25 bp, Rattus norvegicus
tccacctgctgctgtgtggcacctg

SEQ ID NO: 568550 - DNA, 25 bp, Rattus norvegicus
ctgtgcggcgctgcgcgaccagctt

SEQ ID NO: 568551 - DNA, 25 bp, Rattus norvegicus
cccttggtgagagtgtacatggtgc

SEQ ID NO: 568552 - DNA, 25 bp, Rattus norvegicus
agtgtacatggtgcgccgtcccgcc

SEQ ID NO: 568553 - DNA, 25 bp, Rattus norvegicus
tctaatgtcgctcctgtcgggttcc

SEQ ID NO: 568554 - DNA, 25 bp, Rattus norvegicus
ggcgagcatcaccagcctagggctt

SEQ ID NO: 568555 - DNA, 25 bp, Rattus norvegicus
actgtgccgcgcctaggactcggat

SEQ ID NO: 568556 - DNA, 25 bp, Rattus norvegicus
ccaggcgacctagaggtctaatgtc

SEQ ID NO: 568557 - DNA, 25 bp, Rattus norvegicus
gatccaccggggaccaggcgaccta

SEQ ID NO: 568558 - DNA, 25 bp, Rattus norvegicus
agagctttcgatggggaggatccac

SEQ ID NO: 568559 - DNA, 25 bp, Rattus norvegicus
ggcctggaggctctagagctttcga

SEQ ID NO: 568560 - DNA, 25 bp, Rattus norvegicus
tctggattcaccgtcgccactgtgc

SEQ ID NO: 568561 - DNA, 25 bp, Rattus norvegicus
tgtcggtgccgcctcggtccatcag

SEQ ID NO: 568562 - DNA, 25 bp, Rattus norvegicus
ctgcttccttttccggtgccgggag

SEQ ID NO: 568563 - DNA, 25 bp, Rattus norvegicus
gggcgcccacatcatgccagacttg

SEQ ID NO: 568564 - DNA, 25 bp, Rattus norvegicus
attcccgcgctccacacggaggaaa

SEQ ID NO: 568565 - DNA, 25 bp, Rattus norvegicus
atcaggcctcctgcggttctccatt

SEQ ID NO: 568566 - DNA, 25 bp, Rattus norvegicus
tccacacggaggaaacagtccaggc

SEQ ID NO: 568567 - DNA, 25 bp, Rattus norvegicus
aaagtgtactagaagccgccgagcc

SEQ ID NO: 568568 - DNA, 25 bp, Rattus norvegicus
ctcctgcgggtaactctcggagaga

SEQ ID NO: 568569 - DNA, 25 bp, Rattus norvegicus
cgccctggttctcctgcgggtaact

SEQ ID NO: 568570 - DNA, 25 bp, Rattus norvegicus
ctcggagagagttagtcacgaccta

SEQ ID NO: 568571 - DNA, 25 bp, Rattus norvegicus
agtcacgacctaacacactaactct

SEQ ID NO: 568572 - DNA, 25 bp, Rattus norvegicus
aactctctttggcacggcaggatgc

SEQ ID NO: 568573 - DNA, 25 bp, Rattus norvegicus
tctttggcacggcaggatgccagcg

SEQ ID NO: 568574 - DNA, 25 bp, Rattus norvegicus
gggcacgccttcgaagccctgagct

SEQ ID NO: 568575 - DNA, 25 bp, Rattus norvegicus
tgacctcagggtcccaggtgccggt

SEQ ID NO: 568576 - DNA, 25 bp, Rattus norvegicus
ctgcacggtgcaccgagaaagggct

SEQ ID NO: 568577 - DNA, 25 bp, Rattus norvegicus
caggaggagcactaaccaggtgagc

SEQ ID NO: 568578 - DNA, 25 bp, Rattus norvegicus
cgccctgctctaacagctagcggag

SEQ ID NO: 568579 - DNA, 25 bp, Rattus norvegicus
gcccgggcaaaagtgtactagaagc

SEQ ID NO: 568580 - DNA, 25 bp, Rattus norvegicus
ctctaacagctagcggagcggcagg

SEQ ID NO: 568581 - DNA, 25 bp, Rattus norvegicus
ccaacagcaagagaggcaagacggc

SEQ ID NO: 568582 - DNA, 25 bp, Rattus norvegicus
tcacgcacggatgcctccgttaacg

SEQ ID NO: 568583 - DNA, 25 bp, Rattus norvegicus
tgggttagactcacgcacggatgcc

SEQ ID NO: 568584 - DNA, 25 bp, Rattus norvegicus
cggcagtgtgaaatgggttagactc

SEQ ID NO: 568585 - DNA, 25 bp, Rattus norvegicus
ctcgccaaagcatgacggcagtgtg

SEQ ID NO: 568586 - DNA, 25 bp, Rattus norvegicus
tgcaagttcattatcgcctcgccaa

SEQ ID NO: 568587 - DNA, 25 bp, Rattus norvegicus
gtgtgcatttcctcctgcaagttca

SEQ ID NO: 568588 - DNA, 25 bp, Rattus norvegicus
gcggcgctctgctccgagagaagca

SEQ ID NO: 568589 - DNA, 25 bp, Rattus norvegicus
gattcgatcgcccaacagcaagaga

SEQ ID NO: 568590 - DNA, 25 bp, Rattus norvegicus
ttcccagtttccaacgattcgatcg

SEQ ID NO: 568591 - DNA, 25 bp, Rattus norvegicus
cacggcaacaggcagagttgggttt

SEQ ID NO: 568592 - DNA, 25 bp, Rattus norvegicus
ttgaagcgccactttggtggccacg

SEQ ID NO: 568593 - DNA, 25 bp, Rattus norvegicus
ggtgccgagctctctgacttgaagc

SEQ ID NO: 568594 - DNA, 25 bp, Rattus norvegicus
ccgagagaagcagtgtgtgcatttc

SEQ ID NO: 568595 - DNA, 25 bp, Rattus norvegicus
ccgaagttctcgtgttacccgcgca

SEQ ID NO: 568596 - DNA, 25 bp, Rattus norvegicus
ggttgctgtagaaacggcgtccatg

SEQ ID NO: 568597 - DNA, 25 bp, Rattus norvegicus
cccggaagtcagcttcgaatttctg

SEQ ID NO: 568598 - DNA, 25 bp, Rattus norvegicus
ggactcgccggtcactacacgaatg

SEQ ID NO: 568599 - DNA, 25 bp, Rattus norvegicus
ccatggccgtgcctagacaagcatc

SEQ ID NO: 568600 - DNA, 25 bp, Rattus norvegicus
agaacctgtgggagcagatctgcga

SEQ ID NO: 568601 - DNA, 25 bp, Rattus norvegicus
aacgcgcgttcctagcctctgtgcg

SEQ ID NO: 568602 - DNA, 25 bp, Rattus norvegicus
gccggtgcactagccgagccttcga

SEQ ID NO: 568603 - DNA, 25 bp, Rattus norvegicus
agccttcgacccacacgtggagaaa

SEQ ID NO: 568604 - DNA, 25 bp, Rattus norvegicus
tgtcttggatttcggtgtgaccaca

SEQ ID NO: 568605 - DNA, 25 bp, Rattus norvegicus
tgtgaccacagacaacaggcctgca

SEQ ID NO: 568606 - DNA, 25 bp, Rattus norvegicus
caggcctgcagaaggaaaccgagtc

SEQ ID NO: 568607 - DNA, 25 bp, Rattus norvegicus
tagagaccgggactgcccgcagatc

SEQ ID NO: 568608 - DNA, 25 bp, Rattus norvegicus
catccagcctcagcgtgctgcgtga

SEQ ID NO: 568609 - DNA, 25 bp, Rattus norvegicus
ttttgagtgcgctggaggctgaacc

SEQ ID NO: 568610 - DNA, 25 bp, Rattus norvegicus
ccgacggactttgtaagcagctgaa

SEQ ID NO: 568611 - DNA, 25 bp, Rattus norvegicus
agcagctgaagccaaaacacccgtg

SEQ ID NO: 568612 - DNA, 25 bp, Rattus norvegicus
aacacccgtgggatgtagacggaca

SEQ ID NO: 568613 - DNA, 25 bp, Rattus norvegicus
cagggcgcacagttttgagtgcgct

SEQ ID NO: 568614 - DNA, 25 bp, Rattus norvegicus
ctggaggctgaacccaagattctgc

SEQ ID NO: 568615 - DNA, 25 bp, Rattus norvegicus
ccaagattctgcaccttccgggaaa

SEQ ID NO: 568616 - DNA, 25 bp, Rattus norvegicus
agtcgatgttccgacggactttgta

SEQ ID NO: 568617 - DNA, 25 bp, Rattus norvegicus
atgtagacggacaagctgctgtgcg

SEQ ID NO: 568618 - DNA, 25 bp, Rattus norvegicus
tgcaccttccgggaaaggtggagcc

SEQ ID NO: 568619 - DNA, 25 bp, Rattus norvegicus
ggctcgggatccaagtcgatgttcc

SEQ ID NO: 568620 - DNA, 25 bp, Rattus norvegicus
ctctacgtccctggcgccacgttct

SEQ ID NO: 568621 - DNA, 25 bp, Rattus norvegicus
aaaggtggagccctctacgtccctg

SEQ ID NO: 568622 - DNA, 25 bp, Rattus norvegicus
tctaacctgtggtgggctcgggatc

SEQ ID NO: 568623 - DNA, 25 bp, Rattus norvegicus
ttaatatgattggtcggcagtgagc

SEQ ID NO: 568624 - DNA, 25 bp, Rattus norvegicus
tcacagaggccggtagcccagggtc

SEQ ID NO: 568625 - DNA, 25 bp, Rattus norvegicus
gggtccttcagtgcgggttaatatg

SEQ ID NO: 568626 - DNA, 25 bp, Rattus norvegicus
tccagggcccacttactctgcttcg

SEQ ID NO: 568627 - DNA, 25 bp, Rattus norvegicus
tctgcttcggcctgcctcacagagg

SEQ ID NO: 568628 - DNA, 25 bp, Rattus norvegicus
ccttcagtgcgggttaatatgattg

SEQ ID NO: 568629 - DNA, 25 bp, Rattus norvegicus
tgagcggtcctcttttcctccttta

SEQ ID NO: 568630 - DNA, 25 bp, Rattus norvegicus
ctcctttacagctcgggcaccgtag

SEQ ID NO: 568631 - DNA, 25 bp, Rattus norvegicus
tcgggcaccgtagccatcatggtaa

SEQ ID NO: 568632 - DNA, 25 bp, Rattus norvegicus
gtagccatcatggtaagtctcctcg

SEQ ID NO: 568633 - DNA, 25 bp, Rattus norvegicus
tcatggtaagtctcctcgggctctc

SEQ ID NO: 568634 - DNA, 25 bp, Rattus norvegicus
agtctcctcgggctctcttcgctat

SEQ ID NO: 568635 - DNA, 25 bp, Rattus norvegicus
ggctctcttcgctatccgtcgcata

SEQ ID NO: 568636 - DNA, 25 bp, Rattus norvegicus
ccgtcgcatatccacgccatccctg

SEQ ID NO: 568637 - DNA, 25 bp, Rattus norvegicus
ggcggatcccaacctgtgatttggc

SEQ ID NO: 568638 - DNA, 25 bp, Rattus norvegicus
ctgcccgaggctctctgttccctat

SEQ ID NO: 568639 - DNA, 25 bp, Rattus norvegicus
tctctgttccctatcccgccgccac

SEQ ID NO: 568640 - DNA, 25 bp, Rattus norvegicus
cgggagcagccgtaattggatcttc

SEQ ID NO: 568641 - DNA, 25 bp, Rattus norvegicus
agcagccgtaattggatcttcgtcg

SEQ ID NO: 568642 - DNA, 25 bp, Rattus norvegicus
gccgtaattggatcttcgtcgcctc

SEQ ID NO: 568643 - DNA, 25 bp, Rattus norvegicus
taattggatcttcgtcgcctcctcc

SEQ ID NO: 568644 - DNA, 25 bp, Rattus norvegicus
ctcatcggggagccggttaaaggct

SEQ ID NO: 568645 - DNA, 25 bp, Rattus norvegicus
ttaaaggctgggtacctcggcacca

SEQ ID NO: 568646 - DNA, 25 bp, Rattus norvegicus
accggcggatcccaacctgtgattt

SEQ ID NO: 568647 - DNA, 25 bp, Rattus norvegicus
caacctgtgatttggctgccgggct

SEQ ID NO: 568648 - DNA, 25 bp, Rattus norvegicus
cctgtgatttggctgccgggcttcc

SEQ ID NO: 568649 - DNA, 25 bp, Rattus norvegicus
tcccaacctgtgatttggctgccgg

SEQ ID NO: 568650 - DNA, 25 bp, Rattus norvegicus
tgggtacctcggcaccaccggcgga

SEQ ID NO: 568651 - DNA, 25 bp, Rattus norvegicus
gagaataattcgttgctgtactgtc

SEQ ID NO: 568652 - DNA, 25 bp, Rattus norvegicus
cctggctacactgcgtgtgtgtggt

SEQ ID NO: 568653 - DNA, 25 bp, Rattus norvegicus
tcagcctggctacactgcgtgtgtg

SEQ ID NO: 568654 - DNA, 25 bp, Rattus norvegicus
ggacggcttctcagcctggctacac

SEQ ID NO: 568655 - DNA, 25 bp, Rattus norvegicus
gcctgctgcgctgggacggcttctc

SEQ ID NO: 568656 - DNA, 25 bp, Rattus norvegicus
ctcccagggtcacgtggctcgtggc

SEQ ID NO: 568657 - DNA, 25 bp, Rattus norvegicus
gcggcgtgcagggaaacacactgaa

SEQ ID NO: 568658 - DNA, 25 bp, Rattus norvegicus
agaccagtaggccagtcggcgccag

SEQ ID NO: 568659 - DNA, 25 bp, Rattus norvegicus
ttctaagaccagtaggccagtcggc

SEQ ID NO: 568660 - DNA, 25 bp, Rattus norvegicus
cgagatgaggattctaagaccagta

SEQ ID NO: 568661 - DNA, 25 bp, Rattus norvegicus
cgtcgggacgagatgaggattctaa

SEQ ID NO: 568662 - DNA, 25 bp, Rattus norvegicus
ttgctgtactgtcgtcgggacgaga

SEQ ID NO: 568663 - DNA, 25 bp, Rattus norvegicus
aggcggagccgcaccctgtctccac

SEQ ID NO: 568664 - DNA, 25 bp, Rattus norvegicus
tgtctccacccttgggcggccggga

SEQ ID NO: 568665 - DNA, 25 bp, Rattus norvegicus
tcaccatccctacagcctcgggagg

SEQ ID NO: 568666 - DNA, 25 bp, Rattus norvegicus
caaagaccgccgctaagcccttggg

SEQ ID NO: 568667 - DNA, 25 bp, Rattus norvegicus
ggcgcagcaactgcggacatccgca

SEQ ID NO: 568668 - DNA, 25 bp, Rattus norvegicus
ggacatccgcacacacgggccagag

SEQ ID NO: 568669 - DNA, 25 bp, Rattus norvegicus
ccagagctccgcagatggtgatgca

SEQ ID NO: 568670 - DNA, 25 bp, Rattus norvegicus
tccgcagatggtgatgcagggaaca

SEQ ID NO: 568671 - DNA, 25 bp, Rattus norvegicus
agatggtgatgcagggaacaaagac

SEQ ID NO: 568672 - DNA, 25 bp, Rattus norvegicus
gaccgccgctaagcccttgggtgag

SEQ ID NO: 568673 - DNA, 25 bp, Rattus norvegicus
gacaagcgcaggaccgtcgagtgcc

SEQ ID NO: 568674 - DNA, 25 bp, Rattus norvegicus
caggaccgtcgagtgccggtcttca

SEQ ID NO: 568675 - DNA, 25 bp, Rattus norvegicus
gagtgccggtcttcagcatagcctg

SEQ ID NO: 568676 - DNA, 25 bp, Rattus norvegicus
gccggtcttcagcatagcctgcttg

SEQ ID NO: 568677 - DNA, 25 bp, Rattus norvegicus
tgcttgccatctgcctgagccttca

SEQ ID NO: 568678 - DNA, 25 bp, Rattus norvegicus
catagcctgcttgccatctgcctga

SEQ ID NO: 568679 - DNA, 25 bp, Rattus norvegicus
ctgaggggtcgccagcaagaaagat

SEQ ID NO: 568680 - DNA, 25 bp, Rattus norvegicus
tgggaccaagggcgcctcgcacagc

SEQ ID NO: 568681 - DNA, 25 bp, Rattus norvegicus
actcgcctggctcaccatgtctgtg

SEQ ID NO: 568682 - DNA, 25 bp, Rattus norvegicus
tggctcaccatgtctgtgcctcggg

SEQ ID NO: 568683 - DNA, 25 bp, Rattus norvegicus
tcaccatgtctgtgcctcgggctgc

SEQ ID NO: 568684 - DNA, 25 bp, Rattus norvegicus
acagaggctccggaaccgacgctca

SEQ ID NO: 568685 - DNA, 25 bp, Rattus norvegicus
accgacgctcacacggccgcggaga

SEQ ID NO: 568686 - DNA, 25 bp, Rattus norvegicus
gcaacttggacttcctcagctgagg

SEQ ID NO: 568687 - DNA, 25 bp, Rattus norvegicus
ggcgctcttgattgggcagctcaca

SEQ ID NO: 568688 - DNA, 25 bp, Rattus norvegicus
atggcgggtgaggaacttccgcacc

SEQ ID NO: 568689 - DNA, 25 bp, Rattus norvegicus
cttgattgggcagctcacacaccgg

SEQ ID NO: 568690 - DNA, 25 bp, Rattus norvegicus
cggcagtttcctgcggacctcacga

SEQ ID NO: 568691 - DNA, 25 bp, Rattus norvegicus
cgcggagactctgcaacttggactt

SEQ ID NO: 568692 - DNA, 25 bp, Rattus norvegicus
gggcagctcacacaccggcagtttc

SEQ ID NO: 568693 - DNA, 25 bp, Rattus norvegicus
tccgcgcaagagctggactacagtt

SEQ ID NO: 568694 - DNA, 25 bp, Rattus norvegicus
cgaccgcggtctcaagcttccaaga

SEQ ID NO: 568695 - DNA, 25 bp, Rattus norvegicus
tccggacagcatgccgcacactttg

SEQ ID NO: 568696 - DNA, 25 bp, Rattus norvegicus
acccggtgggatatcacgtccagca

SEQ ID NO: 568697 - DNA, 25 bp, Rattus norvegicus
acgcatgcgcggtactgttacttga

SEQ ID NO: 568698 - DNA, 25 bp, Rattus norvegicus
cttgagcatgcttgcgacacaattc

SEQ ID NO: 568699 - DNA, 25 bp, Rattus norvegicus
gcactttactcaacagcgccgctgg

SEQ ID NO: 568700 - DNA, 25 bp, Rattus norvegicus
ctccaggagacgacagcctttactc

SEQ ID NO: 568701 - DNA, 25 bp, Rattus norvegicus
ttgttccctgtacgaagtcaccgcc

SEQ ID NO: 568702 - DNA, 25 bp, Rattus norvegicus
gttgagaggccacctgacagctata

SEQ ID NO: 568703 - DNA, 25 bp, Rattus norvegicus
tgctgagcgaaacaaggaacccatc

SEQ ID NO: 568704 - DNA, 25 bp, Rattus norvegicus
tccgccagtatgtggatcctgccca

SEQ ID NO: 568705 - DNA, 25 bp, Rattus norvegicus
aatcagtctcttgcgggtgccgatc

SEQ ID NO: 568706 - DNA, 25 bp, Rattus norvegicus
tcgcaactgctgtggtttccatagc

SEQ ID NO: 568707 - DNA, 25 bp, Rattus norvegicus
acggcgcagcggacactacgtctgc

SEQ ID NO: 568708 - DNA, 25 bp, Rattus norvegicus
gtggcagaggcacttccgttttgct

SEQ ID NO: 568709 - DNA, 25 bp, Rattus norvegicus
tcgcaggagctcctgatgggacagc

SEQ ID NO: 568710 - DNA, 25 bp, Rattus norvegicus
accgcgcactcaggagtcccgggtg

SEQ ID NO: 568711 - DNA, 25 bp, Rattus norvegicus
ccgttttgctcgcaggagctcctga

SEQ ID NO: 568712 - DNA, 25 bp, Rattus norvegicus
ctgatttgacagcaccgcgccggaa

SEQ ID NO: 568713 - DNA, 25 bp, Rattus norvegicus
gggcttcctccgctgatttgacagc

SEQ ID NO: 568714 - DNA, 25 bp, Rattus norvegicus
ctcacggccacggagggtcagtcac

SEQ ID NO: 568715 - DNA, 25 bp, Rattus norvegicus
agggctcaccatgtctgctcccagg

SEQ ID NO: 568716 - DNA, 25 bp, Rattus norvegicus
ggtcccgccactctgggagcagaag

SEQ ID NO: 568717 - DNA, 25 bp, Rattus norvegicus
gtgagacgatgtccgggtcccgcca

SEQ ID NO: 568718 - DNA, 25 bp, Rattus norvegicus
cagacctgcagaggcgatggtgaga

SEQ ID NO: 568719 - DNA, 25 bp, Rattus norvegicus
caggagtcccgggtgcagacctgca

SEQ ID NO: 568720 - DNA, 25 bp, Rattus norvegicus
tcctgatgggacagcgcacgcacac

SEQ ID NO: 568721 - DNA, 25 bp, Rattus norvegicus
ctcaaaggcaaacgtctcagagtcc

SEQ ID NO: 568722 - DNA, 25 bp, Rattus norvegicus
ccctctcagctggagaactctgggc

SEQ ID NO: 568723 - DNA, 25 bp, Rattus norvegicus
taccgcggctttgagcgacggctac

SEQ ID NO: 568724 - DNA, 25 bp, Rattus norvegicus
gcggtccaagtccaggtgagttctc

SEQ ID NO: 568725 - DNA, 25 bp, Rattus norvegicus
tcagcgcctccggaacccggaagtg

SEQ ID NO: 568726 - DNA, 25 bp, Rattus norvegicus
tccaaccatagtgggcgttcgctgc

SEQ ID NO: 568727 - DNA, 25 bp, Rattus norvegicus
gggcaaggggaaagctccaaccata

SEQ ID NO: 568728 - DNA, 25 bp, Rattus norvegicus
gcgccagtgtgagccgactaaatag

SEQ ID NO: 568729 - DNA, 25 bp, Rattus norvegicus
atgtccctcagatgcgtgggcttcc

SEQ ID NO: 568730 - DNA, 25 bp, Rattus norvegicus
gtggctttaagatgtccctcagatg

SEQ ID NO: 568731 - DNA, 25 bp, Rattus norvegicus
tggtttagcagagccaagagtactg

SEQ ID NO: 568732 - DNA, 25 bp, Rattus norvegicus
aaacgttgggtgctctccgaaagca

SEQ ID NO: 568733 - DNA, 25 bp, Rattus norvegicus
tcttcgtggagacccgatccgggat

SEQ ID NO: 568734 - DNA, 25 bp, Rattus norvegicus
gcgggctccaagctagctacagttg

SEQ ID NO: 568735 - DNA, 25 bp, Rattus norvegicus
ctgaacgaggccaacctgctgcaga

SEQ ID NO: 568736 - DNA, 25 bp, Rattus norvegicus
tgcctcacagcgctcagccagaagg

SEQ ID NO: 568737 - DNA, 25 bp, Rattus norvegicus
tccggcaagacgcaaagcaccaact

SEQ ID NO: 568738 - DNA, 25 bp, Rattus norvegicus
tgctgcgcaagcacgtgaaccagtg

SEQ ID NO: 568739 - DNA, 25 bp, Rattus norvegicus
tcgctctggccgatgtagcctacta

SEQ ID NO: 568740 - DNA, 25 bp, Rattus norvegicus
cagaagatctacacgtacgcgggca

SEQ ID NO: 568741 - DNA, 25 bp, Rattus norvegicus
ctgcgcttcgtgcagcagaagatct

SEQ ID NO: 568742 - DNA, 25 bp, Rattus norvegicus
agcggacttcgacgacctgtgcaac

SEQ ID NO: 568743 - DNA, 25 bp, Rattus norvegicus
tgctgccaaggcctcaagcggactt

SEQ ID NO: 568744 - DNA, 25 bp, Rattus norvegicus
cgctgacggcagcattcagtacctg

SEQ ID NO: 568745 - DNA, 25 bp, Rattus norvegicus
gacggctactacttcctgctgcagg

SEQ ID NO: 568746 - DNA, 25 bp, Rattus norvegicus
tcatccgagacgtggtggccagtct

SEQ ID NO: 568747 - DNA, 25 bp, Rattus norvegicus
gtctacacctggacggctcgaagca

SEQ ID NO: 568748 - DNA, 25 bp, Rattus norvegicus
cctgtgcaacctgccggagctgaac

SEQ ID NO: 568749 - DNA, 25 bp, Rattus norvegicus
cgccgcagagtcctggagccctaag

SEQ ID NO: 568750 - DNA, 25 bp, Rattus norvegicus
ctgtgagtcgatggcggccgaaaaa

SEQ ID NO: 568751 - DNA, 25 bp, Rattus norvegicus
tcgatggcggccgaaaaacgagaac

SEQ ID NO: 568752 - DNA, 25 bp, Rattus norvegicus
aacgagaaccggacgagtggcgtct

SEQ ID NO: 568753 - DNA, 25 bp, Rattus norvegicus
agttgaacctggtgcggctgctttg

SEQ ID NO: 568754 - DNA, 25 bp, Rattus norvegicus
atctttgaataaactgcggcttgaa

SEQ ID NO: 568755 - DNA, 25 bp, Rattus norvegicus
cgacgtcgcggctggagttgaacct

SEQ ID NO: 568756 - DNA, 25 bp, Rattus norvegicus
cggaaggggcctgtcaccgtccgct

SEQ ID NO: 568757 - DNA, 25 bp, Rattus norvegicus
gctgctttgtcgctgtgagtcgatg

SEQ ID NO: 568758 - DNA, 25 bp, Rattus norvegicus
tgcggcttgaaataaaactccgccc

SEQ ID NO: 568759 - DNA, 25 bp, Rattus norvegicus
ccctaagggcgggtgatctaatcca

SEQ ID NO: 568760 - DNA, 25 bp, Rattus norvegicus
gtgatctaatccacaggctactgtc

SEQ ID NO: 568761 - DNA, 25 bp, Rattus norvegicus
ggccacgccctctcgattctacgtc

SEQ ID NO: 568762 - DNA, 25 bp, Rattus norvegicus
cccatgcgtagcagggcggacctcg

SEQ ID NO: 568763 - DNA, 25 bp, Rattus norvegicus
tcaggccctgatgccacttgcaatt

SEQ ID NO: 568764 - DNA, 25 bp, Rattus norvegicus
cgtgtttgcggatgagctgcaaccc

SEQ ID NO: 568765 - DNA, 25 bp, Rattus norvegicus
ggcaccatgcatgcctgcccgggag

SEQ ID NO: 568766 - DNA, 25 bp, Rattus norvegicus
gatgccacttgcaattcgcgccctg

SEQ ID NO: 568767 - DNA, 25 bp, Rattus norvegicus
tgcggatcccagtccaggcgctcag

SEQ ID NO: 568768 - DNA, 25 bp, Rattus norvegicus
tcacgcggtcctctggcctgcggat

SEQ ID NO: 568769 - DNA, 25 bp, Rattus norvegicus
aaccgcgctcgcgtatgcaaatacc

SEQ ID NO: 568770 - DNA, 25 bp, Rattus norvegicus
acagaatctgggttgcgcggccagc

SEQ ID NO: 568771 - DNA, 25 bp, Rattus norvegicus
ggtccgcaccgtgggacagaatctg

SEQ ID NO: 568772 - DNA, 25 bp, Rattus norvegicus
cagccactctggtgcgtgacggcac

SEQ ID NO: 568773 - DNA, 25 bp, Rattus norvegicus
gcggctttgcgcttttccggtttca

SEQ ID NO: 568774 - DNA, 25 bp, Rattus norvegicus
catcggataaccacaggcgggcagg

SEQ ID NO: 568775 - DNA, 25 bp, Rattus norvegicus
cagctccgggacaggtgacaccgag

SEQ ID NO: 568776 - DNA, 25 bp, Rattus norvegicus
gtcgccagagcgctacggcaccatg

SEQ ID NO: 568777 - DNA, 25 bp, Rattus norvegicus
gcacacgttgtcgatgcccagcacg

SEQ ID NO: 568778 - DNA, 25 bp, Rattus norvegicus
cttgaggcagccgtactcggcagca

SEQ ID NO: 568779 - DNA, 25 bp, Rattus norvegicus
aaacgggcgcgtcagacgacagcgc

SEQ ID NO: 568780 - DNA, 25 bp, Rattus norvegicus
tgcgcgatcagctcggacaccggcg

SEQ ID NO: 568781 - DNA, 25 bp, Rattus norvegicus
agcagctgcgcgatcagctcggaca

SEQ ID NO: 568782 - DNA, 25 bp, Rattus norvegicus
ctcaccaggcgtgaagagcgcgatg

SEQ ID NO: 568783 - DNA, 25 bp, Rattus norvegicus
cgcgctgcaccgctgcagaaggaaa

SEQ ID NO: 568784 - DNA, 25 bp, Rattus norvegicus
cgccagctcgcacacgttgtcgatg

SEQ ID NO: 568785 - DNA, 25 bp, Rattus norvegicus
tgctgaacagtaggcgcgccgccag

SEQ ID NO: 568786 - DNA, 25 bp, Rattus norvegicus
gcccactcgaccgtgctgaacagta

SEQ ID NO: 568787 - DNA, 25 bp, Rattus norvegicus
aggcacgcacctggtccatgaaggc

SEQ ID NO: 568788 - DNA, 25 bp, Rattus norvegicus
tcctggaaggcacgcacctggtcca

SEQ ID NO: 568789 - DNA, 25 bp, Rattus norvegicus
agcttgtccacctgctcctggaagg

SEQ ID NO: 568790 - DNA, 25 bp, Rattus norvegicus
gtactcggcagcatccacctgcagg

SEQ ID NO: 568791 - DNA, 25 bp, Rattus norvegicus
gtgggtagctcccacctgccttgtc

SEQ ID NO: 568792 - DNA, 25 bp, Rattus norvegicus
cggcggatgctgcgcttgaagaaac

SEQ ID NO: 568793 - DNA, 25 bp, Rattus norvegicus
gccctcgcaggtgaacacgccgtag

SEQ ID NO: 568794 - DNA, 25 bp, Rattus norvegicus
tcgcaggtgaacacgccgtagtgct

SEQ ID NO: 568795 - DNA, 25 bp, Rattus norvegicus
tcggtcgcgcgtgggtagctcccac

SEQ ID NO: 568796 - DNA, 25 bp, Rattus norvegicus
ttccaggccaactttcccacgcgtg

SEQ ID NO: 568797 - DNA, 25 bp, Rattus norvegicus
ctgccttgtccacgccgttcgtgtc

SEQ ID NO: 568798 - DNA, 25 bp, Rattus norvegicus
ggaacccggctatcccgggcgcatg

SEQ ID NO: 568799 - DNA, 25 bp, Rattus norvegicus
tcaccggcaggtgtagctgagattg

SEQ ID NO: 568800 - DNA, 25 bp, Rattus norvegicus
aaagttttgcggcaacttcctgcgg

SEQ ID NO: 568801 - DNA, 25 bp, Rattus norvegicus
caatcgcagaggtccggccgataga

SEQ ID NO: 568802 - DNA, 25 bp, Rattus norvegicus
aaactttggccgcaagttgcgcggc

SEQ ID NO: 568803 - DNA, 25 bp, Rattus norvegicus
tagtgactcgccatccaagcgcgcg

SEQ ID NO: 568804 - DNA, 25 bp, Rattus norvegicus
caggccaacttagtgactcgccatc

SEQ ID NO: 568805 - DNA, 25 bp, Rattus norvegicus
gttcgttctgcttgagaacttgggg

SEQ ID NO: 568806 - DNA, 25 bp, Rattus norvegicus
tgaacgcgcgcgaactttgtgtcgc

SEQ ID NO: 568807 - DNA, 25 bp, Rattus norvegicus
tgtcgccgcggtctaacttcgactc

SEQ ID NO: 568808 - DNA, 25 bp, Rattus norvegicus
tctaacttcgactcggcttgctgca

SEQ ID NO: 568809 - DNA, 25 bp, Rattus norvegicus
ttcgactcggcttgctgcagcttca

SEQ ID NO: 568810 - DNA, 25 bp, Rattus norvegicus
gcagcttcaggttcgttctgcttga

SEQ ID NO: 568811 - DNA, 25 bp, Rattus norvegicus
gcttcaggttcgttctgcttgagaa

SEQ ID NO: 568812 - DNA, 25 bp, Rattus norvegicus
cgcggtctaacttcgactcggcttg

SEQ ID NO: 568813 - DNA, 25 bp, Rattus norvegicus
ggaagcttgaagtcccgagacgcta

SEQ ID NO: 568814 - DNA, 25 bp, Rattus norvegicus
cgaactttgtgtcgccgcggtctaa

SEQ ID NO: 568815 - DNA, 25 bp, Rattus norvegicus
ctttgcaaggttggtcggctatttg

SEQ ID NO: 568816 - DNA, 25 bp, Rattus norvegicus
aggcgcatcctttgcaaggttggtc

SEQ ID NO: 568817 - DNA, 25 bp, Rattus norvegicus
ccgagaaaggcgcatcctttgcaag

SEQ ID NO: 568818 - DNA, 25 bp, Rattus norvegicus
catcctttgcaaggttggtcggcta

SEQ ID NO: 568819 - DNA, 25 bp, Rattus norvegicus
cccattggacgagatgcagcaagga

SEQ ID NO: 568820 - DNA, 25 bp, Rattus norvegicus
gggcccagccttctctgactgcggt

SEQ ID NO: 568821 - DNA, 25 bp, Rattus norvegicus
accgggaaggccatgtgtctacgcc

SEQ ID NO: 568822 - DNA, 25 bp, Rattus norvegicus
cttcggcaagaagcagatgcgcatt

SEQ ID NO: 568823 - DNA, 25 bp, Rattus norvegicus
atcaagtgccaccaccgctatgggc

SEQ ID NO: 568824 - DNA, 25 bp, Rattus norvegicus
gcggaccagaccctctctttttgac

SEQ ID NO: 568825 - DNA, 25 bp, Rattus norvegicus
ttctcttccgcccactcagttgtga

SEQ ID NO: 568826 - DNA, 25 bp, Rattus norvegicus
tgagagacgggtcttcagccttttc

SEQ ID NO: 568827 - DNA, 25 bp, Rattus norvegicus
gtgacgtggcacagccgaacactta

SEQ ID NO: 568828 - DNA, 25 bp, Rattus norvegicus
ctgcgtagcaggtttaggccctttc

SEQ ID NO: 568829 - DNA, 25 bp, Rattus norvegicus
cagcaaggaatcatgggagcccgcc

SEQ ID NO: 568830 - DNA, 25 bp, Rattus norvegicus
ctactactattcatccgggcggaag

SEQ ID NO: 568831 - DNA, 25 bp, Rattus norvegicus
ctgtccttccgtacgcttgtgccaa

SEQ ID NO: 568832 - DNA, 25 bp, Rattus norvegicus
cgcctggaacctcgtactactacta

SEQ ID NO: 568833 - DNA, 25 bp, Rattus norvegicus
acttcacagtcctagcccgcgtggg

SEQ ID NO: 568834 - DNA, 25 bp, Rattus norvegicus
aggactggggtctaccatgcttgtc

SEQ ID NO: 568835 - DNA, 25 bp, Rattus norvegicus
accttctgctccctggttggccagg

SEQ ID NO: 568836 - DNA, 25 bp, Rattus norvegicus
atgcttgtcctccttcagggctgtg

SEQ ID NO: 568837 - DNA, 25 bp, Rattus norvegicus
tgctagcagcactacgcgaggagga

SEQ ID NO: 568838 - DNA, 25 bp, Rattus norvegicus
gtccctgcaactgctagcagcacta

SEQ ID NO: 568839 - DNA, 25 bp, Rattus norvegicus
ggttgccgcgcgaatttgaactgcg

SEQ ID NO: 568840 - DNA, 25 bp, Rattus norvegicus
ccttagaatgcttctgcgctggggc

SEQ ID NO: 568841 - DNA, 25 bp, Rattus norvegicus
ggtcagggcgcaacttcacagtcct

SEQ ID NO: 568842 - DNA, 25 bp, Rattus norvegicus
caacttagtgctggacgatggcgcg

SEQ ID NO: 568843 - DNA, 25 bp, Rattus norvegicus
acgcgccctgcattgccttagaatg

SEQ ID NO: 568844 - DNA, 25 bp, Rattus norvegicus
aaccagcagtgctcggcgtcaggct

SEQ ID NO: 568845 - DNA, 25 bp, Rattus norvegicus
gtgtgactcagggaaccagcagtgc

SEQ ID NO: 568846 - DNA, 25 bp, Rattus norvegicus
gacatggccgatgcttcctccctgt

SEQ ID NO: 568847 - DNA, 25 bp, Rattus norvegicus
ccggcctaccgttgctgtaggcgta

SEQ ID NO: 568848 - DNA, 25 bp, Rattus norvegicus
cgctcatgcggtatctgccgcgcgg

SEQ ID NO: 568849 - DNA, 25 bp, Rattus norvegicus
gcccattccgggctctaaaggactc

SEQ ID NO: 568850 - DNA, 25 bp, Rattus norvegicus
aaggactccaaagacctgctgctga

SEQ ID NO: 568851 - DNA, 25 bp, Rattus norvegicus
gacctgctgctgaaacctcctacta

SEQ ID NO: 568852 - DNA, 25 bp, Rattus norvegicus
ataccgcagcgacacgcgcagaggc

SEQ ID NO: 568853 - DNA, 25 bp, Rattus norvegicus
gtgcggtgagcacccggccgctcat

SEQ ID NO: 568854 - DNA, 25 bp, Rattus norvegicus
ccagcaggaacttgagcaggtaatc

SEQ ID NO: 568855 - DNA, 25 bp, Rattus norvegicus
agcaggtaatcgtagctcttcactg

SEQ ID NO: 568856 - DNA, 25 bp, Rattus norvegicus
tagctcttcactggactgccctggg

SEQ ID NO: 568857 - DNA, 25 bp, Rattus norvegicus
ccgtgcggtccaaacgctgatgctc

SEQ ID NO: 568858 - DNA, 25 bp, Rattus norvegicus
attggcttggcaccctggccgtcac

SEQ ID NO: 568859 - DNA, 25 bp, Rattus norvegicus
tgctccgtcctgaagactctccaga

SEQ ID NO: 568860 - DNA, 25 bp, Rattus norvegicus
agggccagaggataccgcagcgaca

SEQ ID NO: 568861 - DNA, 25 bp, Rattus norvegicus
ggctcagccaactctacctcaagtg

SEQ ID NO: 568862 - DNA, 25 bp, Rattus norvegicus
cgcagtcgatgtggatggtcctctt

SEQ ID NO: 568863 - DNA, 25 bp, Rattus norvegicus
tgaagaacagcaccacatcagcctg

SEQ ID NO: 568864 - DNA, 25 bp, Rattus norvegicus
gagccacccactccatggatgaaga

SEQ ID NO: 568865 - DNA, 25 bp, Rattus norvegicus
ttccagatggcgagtgagccaccca

SEQ ID NO: 568866 - DNA, 25 bp, Rattus norvegicus
cgagtcgcacaaagaagtccagctg

SEQ ID NO: 568867 - DNA, 25 bp, Rattus norvegicus
cgtaaaaggtgtaggcggctgcaac

SEQ ID NO: 568868 - DNA, 25 bp, Rattus norvegicus
atgtcctctgccaatgcgtaaaagg

SEQ ID NO: 568869 - DNA, 25 bp, Rattus norvegicus
agcgcgtgaaaatggcccgcatgtc

SEQ ID NO: 568870 - DNA, 25 bp, Rattus norvegicus
agcctcccatttcggtacactgtga

SEQ ID NO: 568871 - DNA, 25 bp, Rattus norvegicus
gggcacgcatgctttacccgcagca

SEQ ID NO: 568872 - DNA, 25 bp, Rattus norvegicus
ctggtttgacctccacgaacgtgta

SEQ ID NO: 568873 - DNA, 25 bp, Rattus norvegicus
aacgtgtagccgtcactggactcga

SEQ ID NO: 568874 - DNA, 25 bp, Rattus norvegicus
tacctcaagtgagccaggcgggtcc

SEQ ID NO: 568875 - DNA, 25 bp, Rattus norvegicus
cagaggctgctcttgcaggatcaga

SEQ ID NO: 568876 - DNA, 25 bp, Rattus norvegicus
tagataaccgtccaaccagaggctg

SEQ ID NO: 568877 - DNA, 25 bp, Rattus norvegicus
cggcgagccgactggcctagataac

SEQ ID NO: 568878 - DNA, 25 bp, Rattus norvegicus
cgatggacaggcatctcggcctatt

SEQ ID NO: 568879 - DNA, 25 bp, Rattus norvegicus
tccacctgcaggtgcggcttacatg

SEQ ID NO: 568880 - DNA, 25 bp, Rattus norvegicus
ggaaacagatccagctcacctgagg

SEQ ID NO: 568881 - DNA, 25 bp, Rattus norvegicus
gtgactcctctctcagggaaacaga

SEQ ID NO: 568882 - DNA, 25 bp, Rattus norvegicus
aatgcggagcttggccgttatccac

SEQ ID NO: 568883 - DNA, 25 bp, Rattus norvegicus
actgtggttccgcagcatcctagca

SEQ ID NO: 568884 - DNA, 25 bp, Rattus norvegicus
ctggagtctatcacctccgcggtgg

SEQ ID NO: 568885 - DNA, 25 bp, Rattus norvegicus
cccgactgtggaggcctctctaaag

SEQ ID NO: 568886 - DNA, 25 bp, Rattus norvegicus
aggccatgcacctcgtctctaagag

SEQ ID NO: 568887 - DNA, 25 bp, Rattus norvegicus
cccggatgcactcgagggaaaagca

SEQ ID NO: 568888 - DNA, 25 bp, Rattus norvegicus
cgccgctggagtgatggtcattaaa

SEQ ID NO: 568889 - DNA, 25 bp, Rattus norvegicus
gccgcacacgcggaaacgagtatca

SEQ ID NO: 568890 - DNA, 25 bp, Rattus norvegicus
ctgtaaatagactcagacgctggtc

SEQ ID NO: 568891 - DNA, 25 bp, Rattus norvegicus
cgccatgccgctgtaaatagactca

SEQ ID NO: 568892 - DNA, 25 bp, Rattus norvegicus
ggaaacgagtatcagccgagcaaca

SEQ ID NO: 568893 - DNA, 25 bp, Rattus norvegicus
agccgagcaacatcaagcgcaagca

SEQ ID NO: 568894 - DNA, 25 bp, Rattus norvegicus
caagcacaagcacggctgggtccgc

SEQ ID NO: 568895 - DNA, 25 bp, Rattus norvegicus
acgcctgctggcgtgcaggtcatcc

SEQ ID NO: 568896 - DNA, 25 bp, Rattus norvegicus
tccgccgcatgctgaagggccgcaa

SEQ ID NO: 568897 - DNA, 25 bp, Rattus norvegicus
agggccgcaagtccctgagccactg

SEQ ID NO: 568898 - DNA, 25 bp, Rattus norvegicus
tccctgagccactgaggagcgccat

SEQ ID NO: 568899 - DNA, 25 bp, Rattus norvegicus
gcaagttgaaagtggggacctgtcc

SEQ ID NO: 568900 - DNA, 25 bp, Rattus norvegicus
gaggagcgccatgccgctgtaaata

SEQ ID NO: 568901 - DNA, 25 bp, Rattus norvegicus
actcagacgctggtcgagttgcccg

SEQ ID NO: 568902 - DNA, 25 bp, Rattus norvegicus
gaccaccagcacctgcgatatctcg

SEQ ID NO: 568903 - DNA, 25 bp, Rattus norvegicus
gatctcaaggccttacttcccaaat

SEQ ID NO: 568904 - DNA, 25 bp, Rattus norvegicus
ggcggagatgcagagaccaattgta

SEQ ID NO: 568905 - DNA, 25 bp, Rattus norvegicus
actcgacgacgaaggcggagatgca

SEQ ID NO: 568906 - DNA, 25 bp, Rattus norvegicus
ttcaaccgaactcgacgacgaaggc

SEQ ID NO: 568907 - DNA, 25 bp, Rattus norvegicus
ggtttgatccttcaaccgaactcga

SEQ ID NO: 568908 - DNA, 25 bp, Rattus norvegicus
gcctcgcccacttccggatctcaag

SEQ ID NO: 568909 - DNA, 25 bp, Rattus norvegicus
cagagaccaattgtaacgcgagcga

SEQ ID NO: 568910 - DNA, 25 bp, Rattus norvegicus
cggcatggcggcacgggatcctcca

SEQ ID NO: 568911 - DNA, 25 bp, Rattus norvegicus
attgtaacgcgagcgagcaccggcc

SEQ ID NO: 568912 - DNA, 25 bp, Rattus norvegicus
caatgacgcgcggtgctgtcgccat

SEQ ID NO: 568913 - DNA, 25 bp, Rattus norvegicus
ctcgcgttgacctgtgacctccgac

SEQ ID NO: 568914 - DNA, 25 bp, Rattus norvegicus
tgcggcctcccttaccgcccggcat

SEQ ID NO: 568915 - DNA, 25 bp, Rattus norvegicus
gggatcctccactgtctcaaggctc

SEQ ID NO: 568916 - DNA, 25 bp, Rattus norvegicus
tgctgtcgccatcggcgtgagctgc

SEQ ID NO: 568917 - DNA, 25 bp, Rattus norvegicus
agtctccggatctcggtctccatca

SEQ ID NO: 568918 - DNA, 25 bp, Rattus norvegicus
tgttatgtctcttctgtctcccggc

SEQ ID NO: 568919 - DNA, 25 bp, Rattus norvegicus
atcgccagagccagtctccggatct

SEQ ID NO: 568920 - DNA, 25 bp, Rattus norvegicus
tctccatcagatccttggtcgcggc

SEQ ID NO: 568921 - DNA, 25 bp, Rattus norvegicus
gtcttcttcggccagcgtaaacaca

SEQ ID NO: 568922 - DNA, 25 bp, Rattus norvegicus
gcaaagctgaccttcttgaggcgca

SEQ ID NO: 568923 - DNA, 25 bp, Rattus norvegicus
gcgcagcccgcaatccaggaggctt

SEQ ID NO: 568924 - DNA, 25 bp, Rattus norvegicus
atcagcctgggcctccaagtgccgt

SEQ ID NO: 568925 - DNA, 25 bp, Rattus norvegicus
cgcaaggggttgagcaagcctagca

SEQ ID NO: 568926 - DNA, 25 bp, Rattus norvegicus
cgctgcccaacctgcggtacaggtg

SEQ ID NO: 568927 - DNA, 25 bp, Rattus norvegicus
gtacaggtgcggctgcagcacctca

SEQ ID NO: 568928 - DNA, 25 bp, Rattus norvegicus
tggccagcatctgtgggcggaaaaa

SEQ ID NO: 568929 - DNA, 25 bp, Rattus norvegicus
tcgatccacgaggacctgttatgtc

SEQ ID NO: 568930 - DNA, 25 bp, Rattus norvegicus
ccgcccgacgaagcaagacggtctg

SEQ ID NO: 568931 - DNA, 25 bp, Rattus norvegicus
tcatggggaccggagtggcaccacc

SEQ ID NO: 568932 - DNA, 25 bp, Rattus norvegicus
agcgcgtcactctcagtcactcagt

SEQ ID NO: 568933 - DNA, 25 bp, Rattus norvegicus
aggggcgtgtccacgtttctgcacc

SEQ ID NO: 568934 - DNA, 25 bp, Rattus norvegicus
cgcgctggagaagacaaaggcctct

SEQ ID NO: 568935 - DNA, 25 bp, Rattus norvegicus
tggcaccaccgagcgcgctggagaa

SEQ ID NO: 568936 - DNA, 25 bp, Rattus norvegicus
ggagaagacaaaggcctctctcgcc

SEQ ID NO: 568937 - DNA, 25 bp, Rattus norvegicus
atacccaggactccagacgcaggcg

SEQ ID NO: 568938 - DNA, 25 bp, Rattus norvegicus
gcagcaaacatacccaggactccag

SEQ ID NO: 568939 - DNA, 25 bp, Rattus norvegicus
tttttctgcgcttccttatcgcccg

SEQ ID NO: 568940 - DNA, 25 bp, Rattus norvegicus
gtcccggtgtcacccgcagcaaaca

SEQ ID NO: 568941 - DNA, 25 bp, Rattus norvegicus
cccggccacacgctagggtgtgtga

SEQ ID NO: 568942 - DNA, 25 bp, Rattus norvegicus
gacgcagcaccacgaggagcagcct

SEQ ID NO: 568943 - DNA, 25 bp, Rattus norvegicus
tgcagacgcagcaccacgaggagca

SEQ ID NO: 568944 - DNA, 25 bp, Rattus norvegicus
tgtccacgtttctgcaccagggacc

SEQ ID NO: 568945 - DNA, 25 bp, Rattus norvegicus
gagcacacatcagacccgcgggcaa

SEQ ID NO: 568946 - DNA, 25 bp, Rattus norvegicus
gctggagccggagctcgactggagc

SEQ ID NO: 568947 - DNA, 25 bp, Rattus norvegicus
ccgcgggcaactgagaccccggaga

SEQ ID NO: 568948 - DNA, 25 bp, Rattus norvegicus
atcagacccgcgggcaactgagacc

SEQ ID NO: 568949 - DNA, 25 bp, Rattus norvegicus
cccgcacaagtccagaaccagagaa

SEQ ID NO: 568950 - DNA, 25 bp, Rattus norvegicus
cagaaccagagaactggcagtgcga

SEQ ID NO: 568951 - DNA, 25 bp, Rattus norvegicus
cccgaacgtggaattcgagcctact

SEQ ID NO: 568952 - DNA, 25 bp, Rattus norvegicus
ggagcacacatcagacccgcgggca

SEQ ID NO: 568953 - DNA, 25 bp, Rattus norvegicus
tgcctatcccggagcacacatcaga

SEQ ID NO: 568954 - DNA, 25 bp, Rattus norvegicus
cgcaatttagggctgccccgagtta

SEQ ID NO: 568955 - DNA, 25 bp, Rattus norvegicus
cgtggaattcgagcctactccctca

SEQ ID NO: 568956 - DNA, 25 bp, Rattus norvegicus
gcccgcacaagtccagaaccagaga

SEQ ID NO: 568957 - DNA, 25 bp, Rattus norvegicus
gaacgtggaattcgagcctactccc

SEQ ID NO: 568958 - DNA, 25 bp, Rattus norvegicus
agaactggcagtgcgagggcgctcg

SEQ ID NO: 568959 - DNA, 25 bp, Rattus norvegicus
ctgcagcaccggtgcagagtccttg

SEQ ID NO: 568960 - DNA, 25 bp, Rattus norvegicus
acacagcttgggcatccacgggcga

SEQ ID NO: 568961 - DNA, 25 bp, Rattus norvegicus
cgggagcaccatctttgcgctcagc

SEQ ID NO: 568962 - DNA, 25 bp, Rattus norvegicus
gtcgacctaggtgcttgcaaatttg

SEQ ID NO: 568963 - DNA, 25 bp, Rattus norvegicus
ccgaagctcagcgttctggatgcgc

SEQ ID NO: 568964 - DNA, 25 bp, Rattus norvegicus
gcgcttacttgtttcctgtccgatc

SEQ ID NO: 568965 - DNA, 25 bp, Rattus norvegicus
tgtccgatctccaggctgtgcgcac

SEQ ID NO: 568966 - DNA, 25 bp, Rattus norvegicus
tcctggccgtagctcacacagcttg

SEQ ID NO: 568967 - DNA, 25 bp, Rattus norvegicus
gggacgctgcgccatcgcagtgatc

SEQ ID NO: 568968 - DNA, 25 bp, Rattus norvegicus
aatccatgtggcgtgggctaagcgc

SEQ ID NO: 568969 - DNA, 25 bp, Rattus norvegicus
gaaaccgtgcagaagtgtcgaccta

SEQ ID NO: 568970 - DNA, 25 bp, Rattus norvegicus
gggcaggactttcttccagaacttg

SEQ ID NO: 568971 - DNA, 25 bp, Rattus norvegicus
tcacgccgcaaaggggcaggacttt

SEQ ID NO: 568972 - DNA, 25 bp, Rattus norvegicus
ggttcctaaaaccagagctgccgtg

SEQ ID NO: 568973 - DNA, 25 bp, Rattus norvegicus
ggcgctccaggtcgtcccgctgtgt

SEQ ID NO: 568974 - DNA, 25 bp, Rattus norvegicus
attttcacgggtcacgcgctcaatg

SEQ ID NO: 568975 - DNA, 25 bp, Rattus norvegicus
ccagggaacggtagaccagcgaatc

SEQ ID NO: 568976 - DNA, 25 bp, Rattus norvegicus
ggtagcctatattatccagggaacg

SEQ ID NO: 568977 - DNA, 25 bp, Rattus norvegicus
ttctaccttggtggtcatgatcccg

SEQ ID NO: 568978 - DNA, 25 bp, Rattus norvegicus
catcagcgagtagtggtagcctata

SEQ ID NO: 568979 - DNA, 25 bp, Rattus norvegicus
gtcgcagctctccattttcacgggt

SEQ ID NO: 568980 - DNA, 25 bp, Rattus norvegicus
agctccagcttctggcgtcgcagct

SEQ ID NO: 568981 - DNA, 25 bp, Rattus norvegicus
gggacgagaactccggcatcagcga

SEQ ID NO: 568982 - DNA, 25 bp, Rattus norvegicus
gcactccgtccgtagctgggtctct

SEQ ID NO: 568983 - DNA, 25 bp, Rattus norvegicus
gcacatccacctcggtgcgcagttg

SEQ ID NO: 568984 - DNA, 25 bp, Rattus norvegicus
gctaatgcgcacatccacctcggtg

SEQ ID NO: 568985 - DNA, 25 bp, Rattus norvegicus
caggtgtccagagcgctaatgcgca

SEQ ID NO: 568986 - DNA, 25 bp, Rattus norvegicus
ccgtagctgggtctctcgagcctgc

SEQ ID NO: 568987 - DNA, 25 bp, Rattus norvegicus
tccagaccgagtttgggacacaccg

SEQ ID NO: 568988 - DNA, 25 bp, Rattus norvegicus
cacccgtctcgatccaagctgaaga

SEQ ID NO: 568989 - DNA, 25 bp, Rattus norvegicus
ggtttgacttccttgtaccagcgga

SEQ ID NO: 568990 - DNA, 25 bp, Rattus norvegicus
accgggaagccagccatgatgtagc

SEQ ID NO: 568991 - DNA, 25 bp, Rattus norvegicus
cggcaattgtagctccgtgaaggca

SEQ ID NO: 568992 - DNA, 25 bp, Rattus norvegicus
gggttgcgctccaccttgtacttga

SEQ ID NO: 568993 - DNA, 25 bp, Rattus norvegicus
cttgtacttgacatcgccgatctgc

SEQ ID NO: 568994 - DNA, 25 bp, Rattus norvegicus
gccaggcgtccacattgagcacatc

SEQ ID NO: 568995 - DNA, 25 bp, Rattus norvegicus
gctctttttggcagccgctacctta

SEQ ID NO: 568996 - DNA, 25 bp, Rattus norvegicus
tctggtcccgctgcatgtttttgtg

SEQ ID NO: 568997 - DNA, 25 bp, Rattus norvegicus
ctgccgtcggccaacgcaaaagaca

SEQ ID NO: 568998 - DNA, 25 bp, Rattus norvegicus
tgcagtgaagcttgagccgtagccc

SEQ ID NO: 568999 - DNA, 25 bp, Rattus norvegicus
gccgtagcccgatgtcagcattgca

SEQ ID NO: 569000 - DNA, 25 bp, Rattus norvegicus
agaccgctgtctccaggttctgccg

SEQ ID NO: 569001 - DNA, 25 bp, Rattus norvegicus
ctccgcgcgttgtcgcgcgacggtc

SEQ ID NO: 569002 - DNA, 25 bp, Rattus norvegicus
gtccactgcctgagcccgagagttc

SEQ ID NO: 569003 - DNA, 25 bp, Rattus norvegicus
tgcctgagcccgagagttccgcgcg

SEQ ID NO: 569004 - DNA, 25 bp, Rattus norvegicus
tgagcccgagagttccgcgcgcacg

SEQ ID NO: 569005 - DNA, 25 bp, Rattus norvegicus
gctgcctcgggatttcctcctcttc

SEQ ID NO: 569006 - DNA, 25 bp, Rattus norvegicus
cccgctagtgctcaccggctgatcc

SEQ ID NO: 569007 - DNA, 25 bp, Rattus norvegicus
aagggacttggttgagcaccgcgtt

SEQ ID NO: 569008 - DNA, 25 bp, Rattus norvegicus
acttggttgagcaccgcgttcggcg

SEQ ID NO: 569009 - DNA, 25 bp, Rattus norvegicus
aggacgactgtgttcgcggctccca

SEQ ID NO: 569010 - DNA, 25 bp, Rattus norvegicus
gggacatcagcaccatttccgccgg

SEQ ID NO: 569011 - DNA, 25 bp, Rattus norvegicus
tcagcaccatttccgccggctccgc

SEQ ID NO: 569012 - DNA, 25 bp, Rattus norvegicus
gctgtccactgcctgagcccgagag

SEQ ID NO: 569013 - DNA, 25 bp, Rattus norvegicus
gtgcccgggctgtccactgcctgag

SEQ ID NO: 569014 - DNA, 25 bp, Rattus norvegicus
gacgactgtgttcgcggctcccagg

SEQ ID NO: 569015 - DNA, 25 bp, Rattus norvegicus
aggtagtaccagcagccgcgatccc

SEQ ID NO: 569016 - DNA, 25 bp, Rattus norvegicus
ggtggcgtgcacattaccatagatc

SEQ ID NO: 569017 - DNA, 25 bp, Rattus norvegicus
ctcaggttagcctgtgcggccgaca

SEQ ID NO: 569018 - DNA, 25 bp, Rattus norvegicus
gttcagctgtttgctcaggttagcc

SEQ ID NO: 569019 - DNA, 25 bp, Rattus norvegicus
tgtccttgacgagggtgctgatgtt

SEQ ID NO: 569020 - DNA, 25 bp, Rattus norvegicus
agctgctgcatgacggtgtccttga

SEQ ID NO: 569021 - DNA, 25 bp, Rattus norvegicus
agctggcgttgatgcgctccacctc

SEQ ID NO: 569022 - DNA, 25 bp, Rattus norvegicus
gcgcactgtccggtcttgtctgcct

SEQ ID NO: 569023 - DNA, 25 bp, Rattus norvegicus
atagatcatgaagaggaccaggccc

SEQ ID NO: 569024 - DNA, 25 bp, Rattus norvegicus
tgatgaggaactggatgagcgacac

SEQ ID NO: 569025 - DNA, 25 bp, Rattus norvegicus
tgagcgacacgaagaggaagaaata

SEQ ID NO: 569026 - DNA, 25 bp, Rattus norvegicus
ccaccacctggctgtataggttgtc

SEQ ID NO: 569027 - DNA, 25 bp, Rattus norvegicus
aagaaatagcgcaggtagtaccagc

SEQ ID NO: 569028 - DNA, 25 bp, Rattus norvegicus
tcttgtctgcctggccagatctggg

SEQ ID NO: 569029 - DNA, 25 bp, Rattus norvegicus
ggactcagtggcagtcgcctcccag

SEQ ID NO: 569030 - DNA, 25 bp, Rattus norvegicus
tagaacgcggccagcgccactcaca

SEQ ID NO: 569031 - DNA, 25 bp, Rattus norvegicus
acacaagcctcgctgtctgcctctg

SEQ ID NO: 569032 - DNA, 25 bp, Rattus norvegicus
agcgcttcttccagctgttgcttgg

SEQ ID NO: 569033 - DNA, 25 bp, Rattus norvegicus
cagctgttgcttggactcagtggca

SEQ ID NO: 569034 - DNA, 25 bp, Rattus norvegicus
cgcaccaaggcttctgcaggggaca

SEQ ID NO: 569035 - DNA, 25 bp, Rattus norvegicus
actgagcctgcgtatcgtgtgcatg

SEQ ID NO: 569036 - DNA, 25 bp, Rattus norvegicus
gcgtatcgtgtgcatgcttaactta

SEQ ID NO: 569037 - DNA, 25 bp, Rattus norvegicus
tcgtgtgcatgcttaacttaaaata

SEQ ID NO: 569038 - DNA, 25 bp, Rattus norvegicus
tgactttctatcttcatcatcgtcg

SEQ ID NO: 569039 - DNA, 25 bp, Rattus norvegicus
atcatcgtcgtcgttggcgtcctct

SEQ ID NO: 569040 - DNA, 25 bp, Rattus norvegicus
gacagagccactgagcctgcgtatc

SEQ ID NO: 569041 - DNA, 25 bp, Rattus norvegicus
cctcagcgccacctcgcgaccaaca

SEQ ID NO: 569042 - DNA, 25 bp, Rattus norvegicus
gccactcacatgtgctccctcagcg

SEQ ID NO: 569043 - DNA, 25 bp, Rattus norvegicus
gtcgaggccgccagattccaggcca

SEQ ID NO: 569044 - DNA, 25 bp, Rattus norvegicus
gttcttcgacttcgggtgcccagtc

SEQ ID NO: 569045 - DNA, 25 bp, Rattus norvegicus
ttcgacttcgggtgcccagtctggg

SEQ ID NO: 569046 - DNA, 25 bp, Rattus norvegicus
cagcaccgtggcgttcatctgctca

SEQ ID NO: 569047 - DNA, 25 bp, Rattus norvegicus
ccgtggcgttcatctgctcagattt

SEQ ID NO: 569048 - DNA, 25 bp, Rattus norvegicus
tagcacttaattggcaccttggggt

SEQ ID NO: 569049 - DNA, 25 bp, Rattus norvegicus
tctgctcagattttgggcaacgggg

SEQ ID NO: 569050 - DNA, 25 bp, Rattus norvegicus
agggccagcagtcgccatgcgcgcc

SEQ ID NO: 569051 - DNA, 25 bp, Rattus norvegicus
ctccgggcctggctctgccatcccg

SEQ ID NO: 569052 - DNA, 25 bp, Rattus norvegicus
tgccatcccgccgtagctctgaccc

SEQ ID NO: 569053 - DNA, 25 bp, Rattus norvegicus
ccagaagggccactagcacttaatt

SEQ ID NO: 569054 - DNA, 25 bp, Rattus norvegicus
gccgcagttcttcgacttcgggtgc

SEQ ID NO: 569055 - DNA, 25 bp, Rattus norvegicus
cactagcacttaattggcaccttgg

SEQ ID NO: 569056 - DNA, 25 bp, Rattus norvegicus
cgttcatctgctcagattttgggca

SEQ ID NO: 569057 - DNA, 25 bp, Rattus norvegicus
atcctgcaaccgcaacccgttctta

SEQ ID NO: 569058 - DNA, 25 bp, Rattus norvegicus
tgagctggtgcttcaacaggtgcgt

SEQ ID NO: 569059 - DNA, 25 bp, Rattus norvegicus
cccgatcaggaccaccaagattgcg

SEQ ID NO: 569060 - DNA, 25 bp, Rattus norvegicus
gtggtgtttcggcactcatcctgca

SEQ ID NO: 569061 - DNA, 25 bp, Rattus norvegicus
caacaggtgcgtggtgtttcggcac

SEQ ID NO: 569062 - DNA, 25 bp, Rattus norvegicus
ggatgctccatccttttggctccca

SEQ ID NO: 569063 - DNA, 25 bp, Rattus norvegicus
ggaccaccaagattgcggccaccag

SEQ ID NO: 569064 - DNA, 25 bp, Rattus norvegicus
actatcaggcagactaagacaaccc

SEQ ID NO: 569065 - DNA, 25 bp, Rattus norvegicus
gcgaagtagactatcaggcagacta

SEQ ID NO: 569066 - DNA, 25 bp, Rattus norvegicus
cgctgcgttggcgaagtagactatc

SEQ ID NO: 569067 - DNA, 25 bp, Rattus norvegicus
tacaggcctcgctgtgcgctgcgtt

SEQ ID NO: 569068 - DNA, 25 bp, Rattus norvegicus
acccgttcttacaggcctcgctgtg

SEQ ID NO: 569069 - DNA, 25 bp, Rattus norvegicus
tgtttcggcactcatcctgcaaccg

SEQ ID NO: 569070 - DNA, 25 bp, Rattus norvegicus
caccggcggatgctccatccttttg

SEQ ID NO: 569071 - DNA, 25 bp, Rattus norvegicus
ccacggttactttggactggtcaga

SEQ ID NO: 569072 - DNA, 25 bp, Rattus norvegicus
ctgtgcgacccgcagatcacctgta

SEQ ID NO: 569073 - DNA, 25 bp, Rattus norvegicus
gacgaagcccgctgacctgtgcgac

SEQ ID NO: 569074 - DNA, 25 bp, Rattus norvegicus
tggatcccgggacggattcaacgcc

SEQ ID NO: 569075 - DNA, 25 bp, Rattus norvegicus
ctgccttttgaactcccagggagga

SEQ ID NO: 569076 - DNA, 25 bp, Rattus norvegicus
ccgagggcgttagctgccttttgaa

SEQ ID NO: 569077 - DNA, 25 bp, Rattus norvegicus
agctgcttgcgtcccactttcgaaa

SEQ ID NO: 569078 - DNA, 25 bp, Rattus norvegicus
agatcacctgtaccgtggagggcgc

SEQ ID NO: 569079 - DNA, 25 bp, Rattus norvegicus
actggtcagagtccatacgcatgcg

SEQ ID NO: 569080 - DNA, 25 bp, Rattus norvegicus
cgcaaacgtctctctagcgtccaga

SEQ ID NO: 569081 - DNA, 25 bp, Rattus norvegicus
cctctgcgtactgggtagtgattta

SEQ ID NO: 569082 - DNA, 25 bp, Rattus norvegicus
agtggagtcccatccggaagctgac

SEQ ID NO: 569083 - DNA, 25 bp, Rattus norvegicus
cattctggggagtggagtcccatcc

SEQ ID NO: 569084 - DNA, 25 bp, Rattus norvegicus
atacgcatgcgcactagctgcttgc

SEQ ID NO: 569085 - DNA, 25 bp, Rattus norvegicus
atgcccagaagggtcatcgcggcca

SEQ ID NO: 569086 - DNA, 25 bp, Rattus norvegicus
cagaaccttgagcaggcgaccgacc

SEQ ID NO: 569087 - DNA, 25 bp, Rattus norvegicus
ctgtggcttgctgaggatctacaac

SEQ ID NO: 569088 - DNA, 25 bp, Rattus norvegicus
actggcagtcctgcctttcctgaac

SEQ ID NO: 569089 - DNA, 25 bp, Rattus norvegicus
tgaaccctgcttcagagcggggagc

SEQ ID NO: 569090 - DNA, 25 bp, Rattus norvegicus
tgcagtccgatgactgacgtgctcc

SEQ ID NO: 569091 - DNA, 25 bp, Rattus norvegicus
gctgagacccagttagtatcactca

SEQ ID NO: 569092 - DNA, 25 bp, Rattus norvegicus
tatcactcagagaaaccggcgcgct

SEQ ID NO: 569093 - DNA, 25 bp, Rattus norvegicus
ggcgcgctctcagagtctttctcct

SEQ ID NO: 569094 - DNA, 25 bp, Rattus norvegicus
ttctcctctgcagatagaagcggtg

SEQ ID NO: 569095 - DNA, 25 bp, Rattus norvegicus
aagcggtggtatcctacctgcccgg

SEQ ID NO: 569096 - DNA, 25 bp, Rattus norvegicus
aagcccgaggacctgtgccaacgcg

SEQ ID NO: 569097 - DNA, 25 bp, Rattus norvegicus
tggaacagcagctgcgcagccagcg

SEQ ID NO: 569098 - DNA, 25 bp, Rattus norvegicus
cctgcgctaccgaggtcagaacctt

SEQ ID NO: 569099 - DNA, 25 bp, Rattus norvegicus
ttgagtaccacgaccgctggcagtt

SEQ ID NO: 569100 - DNA, 25 bp, Rattus norvegicus
ccctggggatttctagagtcgcact

SEQ ID NO: 569101 - DNA, 25 bp, Rattus norvegicus
tctagagtcgcactcgtttcggccc

SEQ ID NO: 569102 - DNA, 25 bp, Rattus norvegicus
agcatcccggtctacgcggtacttg

SEQ ID NO: 569103 - DNA, 25 bp, Rattus norvegicus
tacgcggtacttgcgacgacgcaga

SEQ ID NO: 569104 - DNA, 25 bp, Rattus norvegicus
acgacgcagaggttccgtgatgctg

SEQ ID NO: 569105 - DNA, 25 bp, Rattus norvegicus
ggctgcaggaagctgcggtccaaca

SEQ ID NO: 569106 - DNA, 25 bp, Rattus norvegicus
cctcctgccagttggcgaagcaggc

SEQ ID NO: 569107 - DNA, 25 bp, Rattus norvegicus
tccgtggcgtcgctcgtcagcacgt

SEQ ID NO: 569108 - DNA, 25 bp, Rattus norvegicus
gctggcagttgacgcacggagaact

SEQ ID NO: 569109 - DNA, 25 bp, Rattus norvegicus
tctctgcggagagagcgctgtcaac

SEQ ID NO: 569110 - DNA, 25 bp, Rattus norvegicus
atgctgcctccgacggccgacagga

SEQ ID NO: 569111 - DNA, 25 bp, Rattus norvegicus
gccgacaggagtcgcccgaggactc

SEQ ID NO: 569112 - DNA, 25 bp, Rattus norvegicus
tcccagacgctggatttcgtccgtg

SEQ ID NO: 569113 - DNA, 25 bp, Rattus norvegicus
gcctttccgtgagcagtgactgaca

SEQ ID NO: 569114 - DNA, 25 bp, Rattus norvegicus
ctcagtaccggcttgatttcgccgc

SEQ ID NO: 569115 - DNA, 25 bp, Rattus norvegicus
ccggcttgatttcgccgcttggttg

SEQ ID NO: 569116 - DNA, 25 bp, Rattus norvegicus
atttcgccgcttggttgccgtggag

SEQ ID NO: 569117 - DNA, 25 bp, Rattus norvegicus
tgccgtggagactcgtaggtaccct

SEQ ID NO: 569118 - DNA, 25 bp, Rattus norvegicus
tcgtaggtaccctgggctggcctct

SEQ ID NO: 569119 - DNA, 25 bp, Rattus norvegicus
ggctggcctctctagcttgagagtc

SEQ ID NO: 569120 - DNA, 25 bp, Rattus norvegicus
agcttgagagtctcgttgggttgca

SEQ ID NO: 569121 - DNA, 25 bp, Rattus norvegicus
ttgcaggctctctggcccgcggttc

SEQ ID NO: 569122 - DNA, 25 bp, Rattus norvegicus
ggttcctctctatggtctaaacctc

SEQ ID NO: 569123 - DNA, 25 bp, Rattus norvegicus
ctctatggtctaaacctccggaagg

SEQ ID NO: 569124 - DNA, 25 bp, Rattus norvegicus
ggtgagccgcactgacccggccttt

SEQ ID NO: 569125 - DNA, 25 bp, Rattus norvegicus
cgtgagcagtgactgacaagacctg

SEQ ID NO: 569126 - DNA, 25 bp, Rattus norvegicus
cccggcctttccgtgagcagtgact

SEQ ID NO: 569127 - DNA, 25 bp, Rattus norvegicus
gctacagaataaggaaaaggaactg

SEQ ID NO: 569128 - DNA, 25 bp, Rattus norvegicus
cgctttctgcgtatcgtctgcaaga

SEQ ID NO: 569129 - DNA, 25 bp, Rattus norvegicus
tttccgcaggatgcggactccggga

SEQ ID NO: 569130 - DNA, 25 bp, Rattus norvegicus
acagtctctgccgtgttttccgcag

SEQ ID NO: 569131 - DNA, 25 bp, Rattus norvegicus
cgcttttgggtttaggctacagaat

SEQ ID NO: 569132 - DNA, 25 bp, Rattus norvegicus
cgtatcgtctgcaagacggcgaggc

SEQ ID NO: 569133 - DNA, 25 bp, Rattus norvegicus
tctgccgtgttttccgcaggatgcg

SEQ ID NO: 569134 - DNA, 25 bp, Rattus norvegicus
agcaggaacagcctctgtggcctca

SEQ ID NO: 569135 - DNA, 25 bp, Rattus norvegicus
aacagcctctgtggcctcattgggg

SEQ ID NO: 569136 - DNA, 25 bp, Rattus norvegicus
cctcattggggctgctttggcttct

SEQ ID NO: 569137 - DNA, 25 bp, Rattus norvegicus
tttggcttctgggacttccgtggac

SEQ ID NO: 569138 - DNA, 25 bp, Rattus norvegicus
ggctggcgctttctgcgtatcgtct

SEQ ID NO: 569139 - DNA, 25 bp, Rattus norvegicus
ggcctgatgccaaggtacacgctgg

SEQ ID NO: 569140 - DNA, 25 bp, Rattus norvegicus
tctgggacttccgtggacctggagc

SEQ ID NO: 569141 - DNA, 25 bp, Rattus norvegicus
acagccgtatcctcacgcatgtgta

SEQ ID NO: 569142 - DNA, 25 bp, Rattus norvegicus
atcggtgaaatatgccgctacctgc

SEQ ID NO: 569143 - DNA, 25 bp, Rattus norvegicus
cggccagccatctgggaggagttca

SEQ ID NO: 569144 - DNA, 25 bp, Rattus norvegicus
cgagaacgtatccaccacggaggtg

SEQ ID NO: 569145 - DNA, 25 bp, Rattus norvegicus
tcacgcagcgtttcggtgtgcgaca

SEQ ID NO: 569146 - DNA, 25 bp, Rattus norvegicus
gccaccgcaggtagtgcagtacatc

SEQ ID NO: 569147 - DNA, 25 bp, Rattus norvegicus
cgccaccgagtgcaactgcagcatt

SEQ ID NO: 569148 - DNA, 25 bp, Rattus norvegicus
ttctcgtgggccagatcaaccagca

SEQ ID NO: 569149 - DNA, 25 bp, Rattus norvegicus
cgcttcgatggctatgttagtgaca

SEQ ID NO: 569150 - DNA, 25 bp, Rattus norvegicus
tgacagcgccaccaacaagaagatt

SEQ ID NO: 569151 - DNA, 25 bp, Rattus norvegicus
attgcccacagcgtgttccgaaagg

SEQ ID NO: 569152 - DNA, 25 bp, Rattus norvegicus
gtacatgtacttccgtgaccgcagc

SEQ ID NO: 569153 - DNA, 25 bp, Rattus norvegicus
tcaacgaggacacgatggagccact

SEQ ID NO: 569154 - DNA, 25 bp, Rattus norvegicus
ctgtcagaatgcaaagcccggtccc

SEQ ID NO: 569155 - DNA, 25 bp, Rattus norvegicus
ccggactgccacagtgctgcaaaga

SEQ ID NO: 569156 - DNA, 25 bp, Rattus norvegicus
cggcgtctgccaagtatgtgccagg

SEQ ID NO: 569157 - DNA, 25 bp, Rattus norvegicus
cggcgcgagcttccaaacgcagcga

SEQ ID NO: 569158 - DNA, 25 bp, Rattus norvegicus
tgctgggatcacaagcaaccctttc

SEQ ID NO: 569159 - DNA, 25 bp, Rattus norvegicus
cgaactgagcctacggcgtctgcca

SEQ ID NO: 569160 - DNA, 25 bp, Rattus norvegicus
acgaaccctcatggtgctgggatca

SEQ ID NO: 569161 - DNA, 25 bp, Rattus norvegicus
tgtgccaggcaaaggggcaaacttc

SEQ ID NO: 569162 - DNA, 25 bp, Rattus norvegicus
tcccacttgtgaacaccgcggggta

SEQ ID NO: 569163 - DNA, 25 bp, Rattus norvegicus
ccagagctagaagcggtggcaactc

SEQ ID NO: 569164 - DNA, 25 bp, Rattus norvegicus
tcgcaggcgcccaccaaagttggca

SEQ ID NO: 569165 - DNA, 25 bp, Rattus norvegicus
gcgcactcaccggacgcgctggtaa

SEQ ID NO: 569166 - DNA, 25 bp, Rattus norvegicus
tgcaaagatcttggagtggcgcgca

SEQ ID NO: 569167 - DNA, 25 bp, Rattus norvegicus
agaggcagccaagtctcccgggtcc

SEQ ID NO: 569168 - DNA, 25 bp, Rattus norvegicus
aacttcgcggaaagtgccgctcgcc

SEQ ID NO: 569169 - DNA, 25 bp, Rattus norvegicus
gtcaggatttggacgtccgttctcc

SEQ ID NO: 569170 - DNA, 25 bp, Rattus norvegicus
tttctccaccagctaatgagcgccg

SEQ ID NO: 569171 - DNA, 25 bp, Rattus norvegicus
tgggtagctaagtagctccgagctg

SEQ ID NO: 569172 - DNA, 25 bp, Rattus norvegicus
cggaacctgggtagctaagtagctc

SEQ ID NO: 569173 - DNA, 25 bp, Rattus norvegicus
actgtcgcggaacctgggtagctaa

SEQ ID NO: 569174 - DNA, 25 bp, Rattus norvegicus
aagctaggccctactgtcgcggaac

SEQ ID NO: 569175 - DNA, 25 bp, Rattus norvegicus
gcggattgagtaaagctaggcccta

SEQ ID NO: 569176 - DNA, 25 bp, Rattus norvegicus
ggacgtccgttctccgcagttgacg

SEQ ID NO: 569177 - DNA, 25 bp, Rattus norvegicus
ctgttgctccggtcaggatttggac

SEQ ID NO: 569178 - DNA, 25 bp, Rattus norvegicus
tctgtcattcctgttgctccggtca

SEQ ID NO: 569179 - DNA, 25 bp, Rattus norvegicus
aacgctaggctttctgtcattcctg

SEQ ID NO: 569180 - DNA, 25 bp, Rattus norvegicus
tgtctccgggaaacgctaggctttc

SEQ ID NO: 569181 - DNA, 25 bp, Rattus norvegicus
tgactggtcggtgtctccgggaaac

SEQ ID NO: 569182 - DNA, 25 bp, Rattus norvegicus
ccgcagttgacggacttgttccttg

SEQ ID NO: 569183 - DNA, 25 bp, Rattus norvegicus
tggacgctcggcttctgtgacgagc

SEQ ID NO: 569184 - DNA, 25 bp, Rattus norvegicus
gccgtacctcggctgtaaggcttcg

SEQ ID NO: 569185 - DNA, 25 bp, Rattus norvegicus
gtgatgtccatccaagtccagcctt

SEQ ID NO: 569186 - DNA, 25 bp, Rattus norvegicus
actccaggatctgcttctacgccta

SEQ ID NO: 569187 - DNA, 25 bp, Rattus norvegicus
tcggctcagcctgccgaggaaactc

SEQ ID NO: 569188 - DNA, 25 bp, Rattus norvegicus
gtcggctcagccttccgtggaaacg

SEQ ID NO: 569189 - DNA, 25 bp, Rattus norvegicus
ccctcgtatcttcctgagggccgta

SEQ ID NO: 569190 - DNA, 25 bp, Rattus norvegicus
ggtctccatgctggcccgagaccta

SEQ ID NO: 569191 - DNA, 25 bp, Rattus norvegicus
cgctagctgcttggaagggaaccgt

SEQ ID NO: 569192 - DNA, 25 bp, Rattus norvegicus
ccttggctcaaagtgctcggaccca

SEQ ID NO: 569193 - DNA, 25 bp, Rattus norvegicus
cacatgcgcctatggccttggctca

SEQ ID NO: 569194 - DNA, 25 bp, Rattus norvegicus
actgtggcttcgcttcatctgcgca

SEQ ID NO: 569195 - DNA, 25 bp, Rattus norvegicus
ttcgaccacgccgaaagcacgtacg

SEQ ID NO: 569196 - DNA, 25 bp, Rattus norvegicus
agcacgtacggcctctaccgggtga

SEQ ID NO: 569197 - DNA, 25 bp, Rattus norvegicus
cgccctctgctggttcctggacgag

SEQ ID NO: 569198 - DNA, 25 bp, Rattus norvegicus
gcttctgaggcggttcctggtctct

SEQ ID NO: 569199 - DNA, 25 bp, Rattus norvegicus
aggcggttcctggtctctcacacag

SEQ ID NO: 569200 - DNA, 25 bp, Rattus norvegicus
cagcgcatcctggaggaccaggaga

SEQ ID NO: 569201 - DNA, 25 bp, Rattus norvegicus
ctgctggttcctggacgaggcagct

SEQ ID NO: 569202 - DNA, 25 bp, Rattus norvegicus
cagctgcacggctgctgtctgtgcc

SEQ ID NO: 569203 - DNA, 25 bp, Rattus norvegicus
tgtctgtgcccttcgagaagcattc

SEQ ID NO: 569204 - DNA, 25 bp, Rattus norvegicus
agcattccacgttataggggccgca

SEQ ID NO: 569205 - DNA, 25 bp, Rattus norvegicus
ttccacgttataggggccgcaccac

SEQ ID NO: 569206 - DNA, 25 bp, Rattus norvegicus
ttataggggccgcaccacgcacgct

SEQ ID NO: 569207 - DNA, 25 bp, Rattus norvegicus
accacgcacgctgtgggcacttcgg

SEQ ID NO: 569208 - DNA, 25 bp, Rattus norvegicus
cacgctgtgggcacttcgggccgca

SEQ ID NO: 569209 - DNA, 25 bp, Rattus norvegicus
gcccttcgagaagcattccacgtta

SEQ ID NO: 569210 - DNA, 25 bp, Rattus norvegicus
ggttcctggtctctcacacagcgca

SEQ ID NO: 569211 - DNA, 25 bp, Rattus norvegicus
tgagcttcgcgctcttcctcgtgca

SEQ ID NO: 569212 - DNA, 25 bp, Rattus norvegicus
aactctgcagttcctcgacgccgtg

SEQ ID NO: 569213 - DNA, 25 bp, Rattus norvegicus
ccaagctgccttcgaactctgcagt

SEQ ID NO: 569214 - DNA, 25 bp, Rattus norvegicus
ccgagttgatgcgagagctattgcc

SEQ ID NO: 569215 - DNA, 25 bp, Rattus norvegicus
acgccgtgcagctctatcgacgacg

SEQ ID NO: 569216 - DNA, 25 bp, Rattus norvegicus
cattgatcgcgccttcagtcctgca

SEQ ID NO: 569217 - DNA, 25 bp, Rattus norvegicus
tccctgagagcagcgcgccattgat

SEQ ID NO: 569218 - DNA, 25 bp, Rattus norvegicus
tgccattcggttgagagccaccggt

SEQ ID NO: 569219 - DNA, 25 bp, Rattus norvegicus
acctctgcttctgcgctggctctag

SEQ ID NO: 569220 - DNA, 25 bp, Rattus norvegicus
ctgcgtgccttccagccagaaaagg

SEQ ID NO: 569221 - DNA, 25 bp, Rattus norvegicus
gagactaggcctgcagggtgccatt

SEQ ID NO: 569222 - DNA, 25 bp, Rattus norvegicus
gcagatcctgcagcagcgtgcactc

SEQ ID NO: 569223 - DNA, 25 bp, Rattus norvegicus
tgcgagcacagacgctccgaggcct

SEQ ID NO: 569224 - DNA, 25 bp, Rattus norvegicus
tgcgcgcagaccttgagcagatcct

SEQ ID NO: 569225 - DNA, 25 bp, Rattus norvegicus
aaaagcggcttaaaggcgacgcgtg

SEQ ID NO: 569226 - DNA, 25 bp, Rattus norvegicus
cggtcacagaacgaatctgtgcctt

SEQ ID NO: 569227 - DNA, 25 bp, Rattus norvegicus
gctaaactcaagctcgtacccgagg

SEQ ID NO: 569228 - DNA, 25 bp, Rattus norvegicus
tggccacgggaactaggctaaactc

SEQ ID NO: 569229 - DNA, 25 bp, Rattus norvegicus
ctcgcgtgctcatagcgctgctggc

SEQ ID NO: 569230 - DNA, 25 bp, Rattus norvegicus
gctacaggcgcctcgcgtgctcata

SEQ ID NO: 569231 - DNA, 25 bp, Rattus norvegicus
cggcgctgatggctacttcccagag

SEQ ID NO: 569232 - DNA, 25 bp, Rattus norvegicus
gcagccctcgtctgccggcagaaaa

SEQ ID NO: 569233 - DNA, 25 bp, Rattus norvegicus
tcctttaaggcgcagccctcgtctg

SEQ ID NO: 569234 - DNA, 25 bp, Rattus norvegicus
aaaggtatggccttgtcacgccctc

SEQ ID NO: 569235 - DNA, 25 bp, Rattus norvegicus
atgtaacgggatcattgcggtcggc

SEQ ID NO: 569236 - DNA, 25 bp, Rattus norvegicus
ccgcccagaagtgacgcgatgtaac

SEQ ID NO: 569237 - DNA, 25 bp, Rattus norvegicus
atctgtgcctttaaggtgtgagcca

SEQ ID NO: 569238 - DNA, 25 bp, Rattus norvegicus
ggctacttcccagaggagcgctgga

SEQ ID NO: 569239 - DNA, 25 bp, Rattus norvegicus
cctactcccgggaagttggcaagca

SEQ ID NO: 569240 - DNA, 25 bp, Rattus norvegicus
agcccgccctgtgtgacacgagcag

SEQ ID NO: 569241 - DNA, 25 bp, Rattus norvegicus
ttgctgcgctgcgacaggatacgca

SEQ ID NO: 569242 - DNA, 25 bp, Rattus norvegicus
gccacacgcgttcttagttcctact

SEQ ID NO: 569243 - DNA, 25 bp, Rattus norvegicus
accggctcagcgaaaggccaccatg

SEQ ID NO: 569244 - DNA, 25 bp, Rattus norvegicus
tgcaactcgtagcactcgggtcccg

SEQ ID NO: 569245 - DNA, 25 bp, Rattus norvegicus
tcgcgcgcgaagcagtagtccttca

SEQ ID NO: 569246 - DNA, 25 bp, Rattus norvegicus
ttggccacctcgtcattgctgcgct

SEQ ID NO: 569247 - DNA, 25 bp, Rattus norvegicus
gtcggacttgagcttgacgaactcc

SEQ ID NO: 569248 - DNA, 25 bp, Rattus norvegicus
tggcctacggaaggcgggacctcat

SEQ ID NO: 569249 - DNA, 25 bp, Rattus norvegicus
ggcaccggaccctctatggcttttc

SEQ ID NO: 569250 - DNA, 25 bp, Rattus norvegicus
cgcgtgtgcttttgagagtccatcc

SEQ ID NO: 569251 - DNA, 25 bp, Rattus norvegicus
acatccactagcagcgcatctcgta

SEQ ID NO: 569252 - DNA, 25 bp, Rattus norvegicus
catcccgccctgtattttgcagaca

SEQ ID NO: 569253 - DNA, 25 bp, Rattus norvegicus
gaaaggtcttcttgaggcccacgcc

SEQ ID NO: 569254 - DNA, 25 bp, Rattus norvegicus
tgaggtctgtccgtcactcaggggt

SEQ ID NO: 569255 - DNA, 25 bp, Rattus norvegicus
tcgagaaaggtcttcttgaggccca

SEQ ID NO: 569256 - DNA, 25 bp, Rattus norvegicus
gcttttctcgagaaaggtcttcttg

SEQ ID NO: 569257 - DNA, 25 bp, Rattus norvegicus
tgaaggtccgggcttttctcgagaa

SEQ ID NO: 569258 - DNA, 25 bp, Rattus norvegicus
cctgtgtgtagagcgacagggcgta

SEQ ID NO: 569259 - DNA, 25 bp, Rattus norvegicus
gcacgaaggttttgatgagcaggtc

SEQ ID NO: 569260 - DNA, 25 bp, Rattus norvegicus
gctgactgcgtctgcacgaaggttt

SEQ ID NO: 569261 - DNA, 25 bp, Rattus norvegicus
ttaccctgcgctgactgcgtctgca

SEQ ID NO: 569262 - DNA, 25 bp, Rattus norvegicus
gagcgaagcgccagattcccttacc

SEQ ID NO: 569263 - DNA, 25 bp, Rattus norvegicus
gcccgagagagcgaagcgccagatt

SEQ ID NO: 569264 - DNA, 25 bp, Rattus norvegicus
tgtccgtcactcaggggtggagctc

SEQ ID NO: 569265 - DNA, 25 bp, Rattus norvegicus
cccattgaggtctgtccgtcactca

SEQ ID NO: 569266 - DNA, 25 bp, Rattus norvegicus
tgcgtctgcacgaaggttttgatga

SEQ ID NO: 569267 - DNA, 25 bp, Rattus norvegicus
ctgctcttcgatcgctgcgggaccg

SEQ ID NO: 569268 - DNA, 25 bp, Rattus norvegicus
cgttgagcaggtcttggcacttctc

SEQ ID NO: 569269 - DNA, 25 bp, Rattus norvegicus
ccacacctcgaagttgtgcggcgtg

SEQ ID NO: 569270 - DNA, 25 bp, Rattus norvegicus
ttggcacttctcgtggcacttaacg

SEQ ID NO: 569271 - DNA, 25 bp, Rattus norvegicus
ctcgcactcgtagcagtaggtggga

SEQ ID NO: 569272 - DNA, 25 bp, Rattus norvegicus
ttaacgccgcactcggtgcagcgca

SEQ ID NO: 569273 - DNA, 25 bp, Rattus norvegicus
tcacgctgcaggcagtccgcgttga

SEQ ID NO: 569274 - DNA, 25 bp, Rattus norvegicus
gtggccgtccacacctcgaagttgt

SEQ ID NO: 569275 - DNA, 25 bp, Rattus norvegicus
gtagattaaggcttgcagggtcttc

SEQ ID NO: 569276 - DNA, 25 bp, Rattus norvegicus
ttaaggcttgcagggtcttcttgta

SEQ ID NO: 569277 - DNA, 25 bp, Rattus norvegicus
aagggccgttcaggcgtcccagaca

SEQ ID NO: 569278 - DNA, 25 bp, Rattus norvegicus
gtcttggcacttctcgtggcactta

SEQ ID NO: 569279 - DNA, 25 bp, Rattus norvegicus
aggcagtccgcgttgagcaggtctt

SEQ ID NO: 569280 - DNA, 25 bp, Rattus norvegicus
cagcgcatgccctgccgcgcgatgc

SEQ ID NO: 569281 - DNA, 25 bp, Rattus norvegicus
tgtcccggtcatccacggcactgtc

SEQ ID NO: 569282 - DNA, 25 bp, Rattus norvegicus
gtgggatgctgttgctcgtctcact

SEQ ID NO: 569283 - DNA, 25 bp, Rattus norvegicus
tcagagaactcttcatagctgtgca

SEQ ID NO: 569284 - DNA, 25 bp, Rattus norvegicus
catagctgtgcatggagtcgctgta

SEQ ID NO: 569285 - DNA, 25 bp, Rattus norvegicus
catggagtcgctgtaggactcccgg

SEQ ID NO: 569286 - DNA, 25 bp, Rattus norvegicus
gccgcacggagtactggtgcaccga

SEQ ID NO: 569287 - DNA, 25 bp, Rattus norvegicus
cggagtactggtgcaccgaagcatt

SEQ ID NO: 569288 - DNA, 25 bp, Rattus norvegicus
tcccacagccacctgagtgcccgcg

SEQ ID NO: 569289 - DNA, 25 bp, Rattus norvegicus
attgggctgcgaagtcgtgtagtaa

SEQ ID NO: 569290 - DNA, 25 bp, Rattus norvegicus
actcctataatcactgtcccggtca

SEQ ID NO: 569291 - DNA, 25 bp, Rattus norvegicus
gctcgtctcactcctataatcactg

SEQ ID NO: 569292 - DNA, 25 bp, Rattus norvegicus
tgctgttgctcgtctcactcctata

SEQ ID NO: 569293 - DNA, 25 bp, Rattus norvegicus
caccgaagcattgggctgcgaagtc

SEQ ID NO: 569294 - DNA, 25 bp, Rattus norvegicus
cccgcggctcagagaactcttcata

SEQ ID NO: 569295 - DNA, 25 bp, Rattus norvegicus
tacaggggctttgcgtgggcggggc

SEQ ID NO: 569296 - DNA, 25 bp, Rattus norvegicus
tggcccttagtgggcggaccttgta

SEQ ID NO: 569297 - DNA, 25 bp, Rattus norvegicus
gcttctggctgacgtggcccttagt

SEQ ID NO: 569298 - DNA, 25 bp, Rattus norvegicus
agtgggcggaccttgtagggtctgt

SEQ ID NO: 569299 - DNA, 25 bp, Rattus norvegicus
ttctggctgacgtggcccttagtgg

SEQ ID NO: 569300 - DNA, 25 bp, Rattus norvegicus
atgcttaccgggctgtgtttgtgtg

SEQ ID NO: 569301 - DNA, 25 bp, Rattus norvegicus
gggcttctggctgacgtggccctta

SEQ ID NO: 569302 - DNA, 25 bp, Rattus norvegicus
gggcagtagtggaccaaacttttca

SEQ ID NO: 569303 - DNA, 25 bp, Rattus norvegicus
ggcagtagtggaccaaacttttcag

SEQ ID NO: 569304 - DNA, 25 bp, Rattus norvegicus
gcagtagtggaccaaacttttcagt

SEQ ID NO: 569305 - DNA, 25 bp, Rattus norvegicus
cagtagtggaccaaacttttcagta

SEQ ID NO: 569306 - DNA, 25 bp, Rattus norvegicus
acttttcagtacggggagctttgtg

SEQ ID NO: 569307 - DNA, 25 bp, Rattus norvegicus
tttcagtacggggagctttgtgggc

SEQ ID NO: 569308 - DNA, 25 bp, Rattus norvegicus
accttgtagggtctgtggtgggcgt

SEQ ID NO: 569309 - DNA, 25 bp, Rattus norvegicus
tcagtcggttgacccacaacttcta

SEQ ID NO: 569310 - DNA, 25 bp, Rattus norvegicus
cgggactacggctcccacagggcag

SEQ ID NO: 569311 - DNA, 25 bp, Rattus norvegicus
cggtatgtcttacgccgcctccgta

SEQ ID NO: 569312 - DNA, 25 bp, Rattus norvegicus
tgtagatccgtttcggcccggcaac

SEQ ID NO: 569313 - DNA, 25 bp, Rattus norvegicus
ttagcgcgttttggctgtgtagatc

SEQ ID NO: 569314 - DNA, 25 bp, Rattus norvegicus
agccgagatgctccgccggcttagc

SEQ ID NO: 569315 - DNA, 25 bp, Rattus norvegicus
taccgtggaactcaccttagcgagc

SEQ ID NO: 569316 - DNA, 25 bp, Rattus norvegicus
tcaaggagtcctaggccgtatgccc

SEQ ID NO: 569317 - DNA, 25 bp, Rattus norvegicus
caaacatggagcatcccggctgatg

SEQ ID NO: 569318 - DNA, 25 bp, Rattus norvegicus
ggctactgctcccaaaacaaacatg

SEQ ID NO: 569319 - DNA, 25 bp, Rattus norvegicus
tcgcctgcgtctgaggttcctaggc

SEQ ID NO: 569320 - DNA, 25 bp, Rattus norvegicus
caacttctaccgtagggcaccaagg

SEQ ID NO: 569321 - DNA, 25 bp, Rattus norvegicus
taggctggcctcgagtgacccacac

SEQ ID NO: 569322 - DNA, 25 bp, Rattus norvegicus
ctcctcagcgctcgcggtaggtcta

SEQ ID NO: 569323 - DNA, 25 bp, Rattus norvegicus
gcagttacctcgcagccttgcctag

SEQ ID NO: 569324 - DNA, 25 bp, Rattus norvegicus
ctccctacagccctaagggtgaggc

SEQ ID NO: 569325 - DNA, 25 bp, Rattus norvegicus
tccgcggagcctgctgcactgttta

SEQ ID NO: 569326 - DNA, 25 bp, Rattus norvegicus
cactgtttagggcacactgggaatc

SEQ ID NO: 569327 - DNA, 25 bp, Rattus norvegicus
agcgctgacgcgctctgacgctgca

SEQ ID NO: 569328 - DNA, 25 bp, Rattus norvegicus
agagacatgactccaggcggccaga

SEQ ID NO: 569329 - DNA, 25 bp, Rattus norvegicus
tcccacgcacagcagagacatgact

SEQ ID NO: 569330 - DNA, 25 bp, Rattus norvegicus
cacactgggaatcggagaggttgtc

SEQ ID NO: 569331 - DNA, 25 bp, Rattus norvegicus
agcgcctacacagcgtctacacagg

SEQ ID NO: 569332 - DNA, 25 bp, Rattus norvegicus
ctagggctgatccacgcgcctctga

SEQ ID NO: 569333 - DNA, 25 bp, Rattus norvegicus
ccactcgagtgagcgacaggcaaga

SEQ ID NO: 569334 - DNA, 25 bp, Rattus norvegicus
ctcggtgcagatggcgttttggccc

SEQ ID NO: 569335 - DNA, 25 bp, Rattus norvegicus
aggttgtccctacgaccagtccagg

SEQ ID NO: 569336 - DNA, 25 bp, Rattus norvegicus
gctacctggtcagtcggtcgcccaa

SEQ ID NO: 569337 - DNA, 25 bp, Rattus norvegicus
acccgcggtgcacagctcaagtgac

SEQ ID NO: 569338 - DNA, 25 bp, Rattus norvegicus
acgtagtctgaatcacgccggcgca

SEQ ID NO: 569339 - DNA, 25 bp, Rattus norvegicus
cgcgcgtatttgagcacgtagtctg

SEQ ID NO: 569340 - DNA, 25 bp, Rattus norvegicus
gtgtgcgagcgtctacctccatcgt

SEQ ID NO: 569341 - DNA, 25 bp, Rattus norvegicus
cgcgggctctccactgaccagtggt

SEQ ID NO: 569342 - DNA, 25 bp, Rattus norvegicus
agcgcaccattggatcgctgcgacg

SEQ ID NO: 569343 - DNA, 25 bp, Rattus norvegicus
actcgggcaccgatacaagacggga

SEQ ID NO: 569344 - DNA, 25 bp, Rattus norvegicus
ctccagggtctcttcaatgggcagc

SEQ ID NO: 569345 - DNA, 25 bp, Rattus norvegicus
gcctctagcccgacccgggaatgta

SEQ ID NO: 569346 - DNA, 25 bp, Rattus norvegicus
gcgataaaaacagcacctcccgtga

SEQ ID NO: 569347 - DNA, 25 bp, Rattus norvegicus
aacgccacgaccaggacttatctca

SEQ ID NO: 569348 - DNA, 25 bp, Rattus norvegicus
tgccgggcctcctttgaaaacgcca

SEQ ID NO: 569349 - DNA, 25 bp, Rattus norvegicus
ggcgcaccgctaacctgagcctgga

SEQ ID NO: 569350 - DNA, 25 bp, Rattus norvegicus
ttcctaagaaaactagccactgcgg

SEQ ID NO: 569351 - DNA, 25 bp, Rattus norvegicus
agagcttcgtgacgcgcaggcgcat

SEQ ID NO: 569352 - DNA, 25 bp, Rattus norvegicus
gcgcatccgcaggaccgtggtccag

SEQ ID NO: 569353 - DNA, 25 bp, Rattus norvegicus
tagtagcctgccaagccgaccgcta

SEQ ID NO: 569354 - DNA, 25 bp, Rattus norvegicus
accgctacgcactcatggccaagta

SEQ ID NO: 569355 - DNA, 25 bp, Rattus norvegicus
atggccaagtacatcctagaccttg

SEQ ID NO: 569356 - DNA, 25 bp, Rattus norvegicus
ccaaaggttgggactagatagcggc

SEQ ID NO: 569357 - DNA, 25 bp, Rattus norvegicus
tcctagaccttgagcggctgcatcc

SEQ ID NO: 569358 - DNA, 25 bp, Rattus norvegicus
caccactgagtccttcctcgtggga

SEQ ID NO: 569359 - DNA, 25 bp, Rattus norvegicus
tgtgacaggggataatggcatcgcc

SEQ ID NO: 569360 - DNA, 25 bp, Rattus norvegicus
taatggcatcgcctggagctccaag

SEQ ID NO: 569361 - DNA, 25 bp, Rattus norvegicus
gaaggcaatcgggaggaaccaatca

SEQ ID NO: 569362 - DNA, 25 bp, Rattus norvegicus
gaaccaatcaggaaaggggccagtc

SEQ ID NO: 569363 - DNA, 25 bp, Rattus norvegicus
tggagctacccagggactggacctg

SEQ ID NO: 569364 - DNA, 25 bp, Rattus norvegicus
cgacctgatccagggccagagcttc

SEQ ID NO: 569365 - DNA, 25 bp, Rattus norvegicus
tttccctatccgcaggtcgccagag

SEQ ID NO: 569366 - DNA, 25 bp, Rattus norvegicus
cccggtaaaaggtgctcgagagcta

SEQ ID NO: 569367 - DNA, 25 bp, Rattus norvegicus
aagactactacgtggtccgcgagcc

SEQ ID NO: 569368 - DNA, 25 bp, Rattus norvegicus
tgctgcctctcggaaaagactacta

SEQ ID NO: 569369 - DNA, 25 bp, Rattus norvegicus
agattgctgacttcggcctcgctaa

SEQ ID NO: 569370 - DNA, 25 bp, Rattus norvegicus
tgaggcgcatgtgaagattgctgac

SEQ ID NO: 569371 - DNA, 25 bp, Rattus norvegicus
cgcgcaacatcctggtggagagtga

SEQ ID NO: 569372 - DNA, 25 bp, Rattus norvegicus
gcatcgtgacctggctgcgcgcaac

SEQ ID NO: 569373 - DNA, 25 bp, Rattus norvegicus
acgccgctgcgtgcatcgtgacctg

SEQ ID NO: 569374 - DNA, 25 bp, Rattus norvegicus
catggagtacctgggcgcacgccgc

SEQ ID NO: 569375 - DNA, 25 bp, Rattus norvegicus
ctggcagatctgcaaggtgcgagca

SEQ ID NO: 569376 - DNA, 25 bp, Rattus norvegicus
gtgctcgagagctactttccctatc

SEQ ID NO: 569377 - DNA, 25 bp, Rattus norvegicus
ttagtgatggagtacctgcccagcg

SEQ ID NO: 569378 - DNA, 25 bp, Rattus norvegicus
gtcgccagagcctgcggttagtgat

SEQ ID NO: 569379 - DNA, 25 bp, Rattus norvegicus
cgcaaggcggctataaggagcgtcc

SEQ ID NO: 569380 - DNA, 25 bp, Rattus norvegicus
gtgacctgagcctcgacctcctcgg

SEQ ID NO: 569381 - DNA, 25 bp, Rattus norvegicus
acctcctcggtgctgctcgtcgtgt

SEQ ID NO: 569382 - DNA, 25 bp, Rattus norvegicus
tgctgctcgtcgtgttccctccaag

SEQ ID NO: 569383 - DNA, 25 bp, Rattus norvegicus
ctccaaggcccatgggcggcgcaag

SEQ ID NO: 569384 - DNA, 25 bp, Rattus norvegicus
tggtcaccacctggtgcgtgcgctg

SEQ ID NO: 569385 - DNA, 25 bp, Rattus norvegicus
taaggagcgtccttacccgctgcct

SEQ ID NO: 569386 - DNA, 25 bp, Rattus norvegicus
tcctgccaccatgcacgcactgctg

SEQ ID NO: 569387 - DNA, 25 bp, Rattus norvegicus
tgctgctcctggctctagggtccgc

SEQ ID NO: 569388 - DNA, 25 bp, Rattus norvegicus
tggctctagggtccgcgctgcgctc

SEQ ID NO: 569389 - DNA, 25 bp, Rattus norvegicus
ggcgcgcgccaagctctgtggtcac

SEQ ID NO: 569390 - DNA, 25 bp, Rattus norvegicus
acacccgcgaccgtgagtggggaca

SEQ ID NO: 569391 - DNA, 25 bp, Rattus norvegicus
agcctgtggacacccgcgaccgtga

SEQ ID NO: 569392 - DNA, 25 bp, Rattus norvegicus
tgttccctccaaggcccatgggcgg

SEQ ID NO: 569393 - DNA, 25 bp, Rattus norvegicus
tgtgcggacaccgacagattggccc

SEQ ID NO: 569394 - DNA, 25 bp, Rattus norvegicus
ggctggcaacacatcggaagtcctc

SEQ ID NO: 569395 - DNA, 25 bp, Rattus norvegicus
ccgatttctctgagtgggtctctta

SEQ ID NO: 569396 - DNA, 25 bp, Rattus norvegicus
tcccactggagaatgtcgccgtatg

SEQ ID NO: 569397 - DNA, 25 bp, Rattus norvegicus
gtatgcctttgcctccagctctagc

SEQ ID NO: 569398 - DNA, 25 bp, Rattus norvegicus
cccgttgagcacgaaactggcgttg

SEQ ID NO: 569399 - DNA, 25 bp, Rattus norvegicus
cgcggccatggtaaagcgtgacagc

SEQ ID NO: 569400 - DNA, 25 bp, Rattus norvegicus
cttgtcctcagctgtcaccagagtg

SEQ ID NO: 569401 - DNA, 25 bp, Rattus norvegicus
tgttgtccgtatgggcgaacacgtc

SEQ ID NO: 569402 - DNA, 25 bp, Rattus norvegicus
cctgcaggtaggtgaccatgttgtc

SEQ ID NO: 569403 - DNA, 25 bp, Rattus norvegicus
cgaatgggacccacgttctggatca

SEQ ID NO: 569404 - DNA, 25 bp, Rattus norvegicus
gtacttgctccagggcactcgaatg

SEQ ID NO: 569405 - DNA, 25 bp, Rattus norvegicus
tgccactccaggaaaaggacctaca

SEQ ID NO: 569406 - DNA, 25 bp, Rattus norvegicus
ccagctctagcagccggttgaattt

SEQ ID NO: 569407 - DNA, 25 bp, Rattus norvegicus
aagattctcggttgtctgaaaacgc

SEQ ID NO: 569408 - DNA, 25 bp, Rattus norvegicus
cccggtgtcagcgtgaagataaaaa

SEQ ID NO: 569409 - DNA, 25 bp, Rattus norvegicus
gcgtgaagataaaaataagattctc

SEQ ID NO: 569410 - DNA, 25 bp, Rattus norvegicus
aaaagcgcgggctcctgatcctgga

SEQ ID NO: 569411 - DNA, 25 bp, Rattus norvegicus
aagactctggcactcaccgcgggcg

SEQ ID NO: 569412 - DNA, 25 bp, Rattus norvegicus
ctggctcttggcagctcgccttact

SEQ ID NO: 569413 - DNA, 25 bp, Rattus norvegicus
ccgcggggctgtgcagacacgaact

SEQ ID NO: 569414 - DNA, 25 bp, Rattus norvegicus
gccctggaggccacacgatttttac

SEQ ID NO: 569415 - DNA, 25 bp, Rattus norvegicus
tctgaaaacgcggtggtttcacaaa

SEQ ID NO: 569416 - DNA, 25 bp, Rattus norvegicus
aaaccgagtcagagtcgaggccgcg

SEQ ID NO: 569417 - DNA, 25 bp, Rattus norvegicus
ccggagctgtggagcatcttcagcg

SEQ ID NO: 569418 - DNA, 25 bp, Rattus norvegicus
tgcagacacgaactggggaaaagcg

SEQ ID NO: 569419 - DNA, 25 bp, Rattus norvegicus
ctgtggagcatcttcagcgcggtgc

SEQ ID NO: 569420 - DNA, 25 bp, Rattus norvegicus
cacacgatttttacctgggcgtccg

SEQ ID NO: 569421 - DNA, 25 bp, Rattus norvegicus
ccctcactggtgaattgcgcggtca

SEQ ID NO: 569422 - DNA, 25 bp, Rattus norvegicus
caccagggacatgcggtagccgcca

SEQ ID NO: 569423 - DNA, 25 bp, Rattus norvegicus
gcagctacctgtgaatctccgcttc

SEQ ID NO: 569424 - DNA, 25 bp, Rattus norvegicus
tggtgaggtacatccctgcgggaac

SEQ ID NO: 569425 - DNA, 25 bp, Rattus norvegicus
gaatctccgcttcaccagggacatg

SEQ ID NO: 569426 - DNA, 25 bp, Rattus norvegicus
ctcagcagctggtgaggtacatccc

SEQ ID NO: 569427 - DNA, 25 bp, Rattus norvegicus
cgcttcaccagggacatgcggtagc

SEQ ID NO: 569428 - DNA, 25 bp, Rattus norvegicus
cctgcgcagcagctacctgtgaatc

SEQ ID NO: 569429 - DNA, 25 bp, Rattus norvegicus
tcactggtgaattgcgcggtcacgg

SEQ ID NO: 569430 - DNA, 25 bp, Rattus norvegicus
tgaggtacatccctgcgggaacaga

SEQ ID NO: 569431 - DNA, 25 bp, Rattus norvegicus
agctccaggtccaggccggatagcg

SEQ ID NO: 569432 - DNA, 25 bp, Rattus norvegicus
aggccggatagcgtggcgccctcac

SEQ ID NO: 569433 - DNA, 25 bp, Rattus norvegicus
cgtggcgccctcactggtgaattgc

SEQ ID NO: 569434 - DNA, 25 bp, Rattus norvegicus
catccctgcgggaacagaacgtggg

SEQ ID NO: 569435 - DNA, 25 bp, Rattus norvegicus
gcggtgcttcataaaccctgcactg

SEQ ID NO: 569436 - DNA, 25 bp, Rattus norvegicus
cccagcttagaactagggatctgca

SEQ ID NO: 569437 - DNA, 25 bp, Rattus norvegicus
aactagggatctgcaggctggagac

SEQ ID NO: 569438 - DNA, 25 bp, Rattus norvegicus
accaggaagagagatttgggagtcc

SEQ ID NO: 569439 - DNA, 25 bp, Rattus norvegicus
ccagcccgggattgagggatgcaat

SEQ ID NO: 569440 - DNA, 25 bp, Rattus norvegicus
ttctgaaggcggcacctacgctcgg

SEQ ID NO: 569441 - DNA, 25 bp, Rattus norvegicus
aaaccctgcactggttggctgagcc

SEQ ID NO: 569442 - DNA, 25 bp, Rattus norvegicus
gcacctgtcattcttgcaggaggga

SEQ ID NO: 569443 - DNA, 25 bp, Rattus norvegicus
ttggctgagcctggacactcacccg

SEQ ID NO: 569444 - DNA, 25 bp, Rattus norvegicus
cactcacccgcaggctatttgcata

SEQ ID NO: 569445 - DNA, 25 bp, Rattus norvegicus
gcaggctatttgcatattttaaagc

SEQ ID NO: 569446 - DNA, 25 bp, Rattus norvegicus
attttaaagcgacaggagacgctcc

SEQ ID NO: 569447 - DNA, 25 bp, Rattus norvegicus
agacgctccttgctttctgcacctg

SEQ ID NO: 569448 - DNA, 25 bp, Rattus norvegicus
gccgggtcaggatagagctatgccc

SEQ ID NO: 569449 - DNA, 25 bp, Rattus norvegicus
gtgtcgcccacattcccaaacctga

SEQ ID NO: 569450 - DNA, 25 bp, Rattus norvegicus
agcgcgagtctcctgaaggctcctc

SEQ ID NO: 569451 - DNA, 25 bp, Rattus norvegicus
aacagcgcgagtctcctgaaggctc

SEQ ID NO: 569452 - DNA, 25 bp, Rattus norvegicus
gtcccgaaacaacagcgcgagtctc

SEQ ID NO: 569453 - DNA, 25 bp, Rattus norvegicus
aggcgcagtcccgaaacaacagcgc

SEQ ID NO: 569454 - DNA, 25 bp, Rattus norvegicus
agctcagaggctgcggctaagaccc

SEQ ID NO: 569455 - DNA, 25 bp, Rattus norvegicus
gccaaagctcagaggctgcggctaa

SEQ ID NO: 569456 - DNA, 25 bp, Rattus norvegicus
tgaccctctttgtaaacctgggcca

SEQ ID NO: 569457 - DNA, 25 bp, Rattus norvegicus
tgtcagacgaggtgtcgcccacatt

SEQ ID NO: 569458 - DNA, 25 bp, Rattus norvegicus
tactgttgtcagacgaggtgtcgcc

SEQ ID NO: 569459 - DNA, 25 bp, Rattus norvegicus
ggtacctcatactgttgtcagacga

SEQ ID NO: 569460 - DNA, 25 bp, Rattus norvegicus
ggggatgtggtacctcatactgttg

SEQ ID NO: 569461 - DNA, 25 bp, Rattus norvegicus
ttaccgggtgtgggctctgtccttc

SEQ ID NO: 569462 - DNA, 25 bp, Rattus norvegicus
tgaggaagccaaagctcagaggctg

SEQ ID NO: 569463 - DNA, 25 bp, Rattus norvegicus
tggctcctgggacaagcatcgagga

SEQ ID NO: 569464 - DNA, 25 bp, Rattus norvegicus
gggcgtcaggttctttcagttcctc

SEQ ID NO: 569465 - DNA, 25 bp, Rattus norvegicus
catctgaccagcctcgaggagcgtc

SEQ ID NO: 569466 - DNA, 25 bp, Rattus norvegicus
gtgttcctcgggctcatctgaccag

SEQ ID NO: 569467 - DNA, 25 bp, Rattus norvegicus
ggtccctctggccaccgttgaagct

SEQ ID NO: 569468 - DNA, 25 bp, Rattus norvegicus
ccaagtgacaggattcgtagggctc

SEQ ID NO: 569469 - DNA, 25 bp, Rattus norvegicus
ttcctccagctccttagccaagtga

SEQ ID NO: 569470 - DNA, 25 bp, Rattus norvegicus
ggggcgtcaggttcctctagatatt

SEQ ID NO: 569471 - DNA, 25 bp, Rattus norvegicus
ttcgtccagttccttagccaagtta

SEQ ID NO: 569472 - DNA, 25 bp, Rattus norvegicus
ggcgtcggattcctcccattccttg

SEQ ID NO: 569473 - DNA, 25 bp, Rattus norvegicus
ctctgccaacaagcacggtgcgtct

SEQ ID NO: 569474 - DNA, 25 bp, Rattus norvegicus
ggggcatcaggctcttccagctcct

SEQ ID NO: 569475 - DNA, 25 bp, Rattus norvegicus
acctcctttagcaagtagcagaatg

SEQ ID NO: 569476 - DNA, 25 bp, Rattus norvegicus
ttggccaagtgacaccctacgtcgg

SEQ ID NO: 569477 - DNA, 25 bp, Rattus norvegicus
tctcactgcctgcatcgtcatcaga

SEQ ID NO: 569478 - DNA, 25 bp, Rattus norvegicus
cgctcacagacgtgggtggagtctc

SEQ ID NO: 569479 - DNA, 25 bp, Rattus norvegicus
cgcctcagggtccaccatgcagatt

SEQ ID NO: 569480 - DNA, 25 bp, Rattus norvegicus
atgcagattcctggtgcgtccggca

SEQ ID NO: 569481 - DNA, 25 bp, Rattus norvegicus
gtggtagcgcctcagggtccaccat

SEQ ID NO: 569482 - DNA, 25 bp, Rattus norvegicus
tgcctgcatcgtcatcagaatccgc

SEQ ID NO: 569483 - DNA, 25 bp, Rattus norvegicus
tcgtcatcagaatccgccacaggca

SEQ ID NO: 569484 - DNA, 25 bp, Rattus norvegicus
tccgccacaggcacgggatcagagt

SEQ ID NO: 569485 - DNA, 25 bp, Rattus norvegicus
ggcacgggatcagagtcagacaatg

SEQ ID NO: 569486 - DNA, 25 bp, Rattus norvegicus
tcagagtcagacaatgtgggcagtg

SEQ ID NO: 569487 - DNA, 25 bp, Rattus norvegicus
agacaatgtgggcagtgactcgctc

SEQ ID NO: 569488 - DNA, 25 bp, Rattus norvegicus
tgggcagtgactcgctcacagacgt

SEQ ID NO: 569489 - DNA, 25 bp, Rattus norvegicus
tgactcgctcacagacgtgggtgga

SEQ ID NO: 569490 - DNA, 25 bp, Rattus norvegicus
agggtccaccatgcagattcctggt

SEQ ID NO: 569491 - DNA, 25 bp, Rattus norvegicus
cttccaggtcttgcgtggtgactac

SEQ ID NO: 569492 - DNA, 25 bp, Rattus norvegicus
accacgcccagtgcaggtgacagca

SEQ ID NO: 569493 - DNA, 25 bp, Rattus norvegicus
ctcgaggctttgtggtgacaacacc

SEQ ID NO: 569494 - DNA, 25 bp, Rattus norvegicus
cacggactggctccttgcgtgtact

SEQ ID NO: 569495 - DNA, 25 bp, Rattus norvegicus
gtggcgcaccagcttccagaagctc

SEQ ID NO: 569496 - DNA, 25 bp, Rattus norvegicus
gacccagcctcacgagcattcagga

SEQ ID NO: 569497 - DNA, 25 bp, Rattus norvegicus
ggcctacgcctagcttctcgaaaag

SEQ ID NO: 569498 - DNA, 25 bp, Rattus norvegicus
gcacaaagagctcaaggcggcctac

SEQ ID NO: 569499 - DNA, 25 bp, Rattus norvegicus
aggaaacagcactcggaccaccttg

SEQ ID NO: 569500 - DNA, 25 bp, Rattus norvegicus
cgtgtactgtccctcgaggccagac

SEQ ID NO: 569501 - DNA, 25 bp, Rattus norvegicus
cttcgcactgcactcctgctggtgg

SEQ ID NO: 569502 - DNA, 25 bp, Rattus norvegicus
tgtgtccttcttctggtcacgagtg

SEQ ID NO: 569503 - DNA, 25 bp, Rattus norvegicus
gcgcacgtctcggactgtagaccga

SEQ ID NO: 569504 - DNA, 25 bp, Rattus norvegicus
agccgccgttcaccagcactgtaaa

SEQ ID NO: 569505 - DNA, 25 bp, Rattus norvegicus
tgcaggctgcaacttagcggagacc

SEQ ID NO: 569506 - DNA, 25 bp, Rattus norvegicus
cgcccgatctgcgagcaacggggtc

SEQ ID NO: 569507 - DNA, 25 bp, Rattus norvegicus
gtcccactcctgaaggcgggtggct

SEQ ID NO: 569508 - DNA, 25 bp, Rattus norvegicus
ccggattgggatcttccgggctgtc

SEQ ID NO: 569509 - DNA, 25 bp, Rattus norvegicus
caggaccggtgcacttcggaacccg

SEQ ID NO: 569510 - DNA, 25 bp, Rattus norvegicus
tctagcccatcctgcgtctggatca

SEQ ID NO: 569511 - DNA, 25 bp, Rattus norvegicus
gcttctccgggttccaggctacctg

SEQ ID NO: 569512 - DNA, 25 bp, Rattus norvegicus
cgcccactcggagctagaggggcta

SEQ ID NO: 569513 - DNA, 25 bp, Rattus norvegicus
catgctcggtgagggctgccatcct

SEQ ID NO: 569514 - DNA, 25 bp, Rattus norvegicus
cgaaacacggcagcgcatgctcggt

SEQ ID NO: 569515 - DNA, 25 bp, Rattus norvegicus
gactagggcagaaaactgagattta

SEQ ID NO: 569516 - DNA, 25 bp, Rattus norvegicus
gaccgatcgctggacgcccgatctg

SEQ ID NO: 569517 - DNA, 25 bp, Rattus norvegicus
cctggctttgtgttgttaatgaggc

SEQ ID NO: 569518 - DNA, 25 bp, Rattus norvegicus
gcccggatgaaagaggccgccgacc

SEQ ID NO: 569519 - DNA, 25 bp, Rattus norvegicus
ccctaggcacgtgcgcacccgtacg

SEQ ID NO: 569520 - DNA, 25 bp, Rattus norvegicus
caccagcaacagcagggagctgggc

SEQ ID NO: 569521 - DNA, 25 bp, Rattus norvegicus
aactcctccaggacgtaggccagca

SEQ ID NO: 569522 - DNA, 25 bp, Rattus norvegicus
cagtgggcccgacctcgttccaact

SEQ ID NO: 569523 - DNA, 25 bp, Rattus norvegicus
ccacactcggaacgttgcgtccggg

SEQ ID NO: 569524 - DNA, 25 bp, Rattus norvegicus
gtacgcccgcctggatcgtaggcca

SEQ ID NO: 569525 - DNA, 25 bp, Rattus norvegicus
tggtagtattttatccaggcggccc

SEQ ID NO: 569526 - DNA, 25 bp, Rattus norvegicus
tccagtaacctatgtggtagtattt

SEQ ID NO: 569527 - DNA, 25 bp, Rattus norvegicus
ccacccggatccagtaacctatgtg

SEQ ID NO: 569528 - DNA, 25 bp, Rattus norvegicus
ccatctgccgtgtcccacgcggatc

SEQ ID NO: 569529 - DNA, 25 bp, Rattus norvegicus
gcaccgcccggacgctctgaacgcc

SEQ ID NO: 569530 - DNA, 25 bp, Rattus norvegicus
agcttaccggaagcactggagaccc

SEQ ID NO: 569531 - DNA, 25 bp, Rattus norvegicus
caacagcagggagctgggcgcctcc

SEQ ID NO: 569532 - DNA, 25 bp, Rattus norvegicus
tcgtaggccacactcggaacgttgc

SEQ ID NO: 569533 - DNA, 25 bp, Rattus norvegicus
aaagtgtgtaagttcgtcgcgctcc

SEQ ID NO: 569534 - DNA, 25 bp, Rattus norvegicus
tccttttgtgagtggcagtgaacga

SEQ ID NO: 569535 - DNA, 25 bp, Rattus norvegicus
agagcgggttagatcaaggattccc

SEQ ID NO: 569536 - DNA, 25 bp, Rattus norvegicus
tcctccgggatgatagtgcgttcgg

SEQ ID NO: 569537 - DNA, 25 bp, Rattus norvegicus
gccgctcaggttgactgtgtcctcc

SEQ ID NO: 569538 - DNA, 25 bp, Rattus norvegicus
cgcactgctatgaaggcgtcgggca

SEQ ID NO: 569539 - DNA, 25 bp, Rattus norvegicus
agtgaacgagcacgcactgctatga

SEQ ID NO: 569540 - DNA, 25 bp, Rattus norvegicus
aggcgggaattatacgtagctgatc

SEQ ID NO: 569541 - DNA, 25 bp, Rattus norvegicus
ggacttccgtcaaagaccatggtga

SEQ ID NO: 569542 - DNA, 25 bp, Rattus norvegicus
cacggcattaagagggcgggacttc

SEQ ID NO: 569543 - DNA, 25 bp, Rattus norvegicus
tgtacccaatagacgcacggcatta

SEQ ID NO: 569544 - DNA, 25 bp, Rattus norvegicus
cttagaacggtagtagctgtaccca

SEQ ID NO: 569545 - DNA, 25 bp, Rattus norvegicus
gtagctgatccgtaaccaataacga

SEQ ID NO: 569546 - DNA, 25 bp, Rattus norvegicus
tgcgcggaggatcacacttcctttt

SEQ ID NO: 569547 - DNA, 25 bp, Rattus norvegicus
ctacgggctcaagttcctgtggatg

SEQ ID NO: 569548 - DNA, 25 bp, Rattus norvegicus
cgctcgtcccaggaccgaaagggtg

SEQ ID NO: 569549 - DNA, 25 bp, Rattus norvegicus
ggagttcaataaatccgcagcgcga

SEQ ID NO: 569550 - DNA, 25 bp, Rattus norvegicus
ccgcagcgcgaaaagcgagtggatc

SEQ ID NO: 569551 - DNA, 25 bp, Rattus norvegicus
accgagtcacctgtctccatggagg

SEQ ID NO: 569552 - DNA, 25 bp, Rattus norvegicus
cagctcacagcagccttggggcagt

SEQ ID NO: 569553 - DNA, 25 bp, Rattus norvegicus
aggaagatcgagtccgggtcccaca

SEQ ID NO: 569554 - DNA, 25 bp, Rattus norvegicus
gttccgggaagatgtctcgggcacc

SEQ ID NO: 569555 - DNA, 25 bp, Rattus norvegicus
tcttgccgatcttctaccgcctggg

SEQ ID NO: 569556 - DNA, 25 bp, Rattus norvegicus
agttgctcaactcgctgctcacagc

SEQ ID NO: 569557 - DNA, 25 bp, Rattus norvegicus
ccgccagtttcatgtcggctgtgca

SEQ ID NO: 569558 - DNA, 25 bp, Rattus norvegicus
actacggcgtgttcgcgaccatgct

SEQ ID NO: 569559 - DNA, 25 bp, Rattus norvegicus
caacgcagtgccgacgacttcttta

SEQ ID NO: 569560 - DNA, 25 bp, Rattus norvegicus
cacagcgtttctcttcttgccgatc

SEQ ID NO: 569561 - DNA, 25 bp, Rattus norvegicus
ataagtgcgcagatgcggtgacgtc

SEQ ID NO: 569562 - DNA, 25 bp, Rattus norvegicus
ggcactcgaaacgtcatgagcggag

SEQ ID NO: 569563 - DNA, 25 bp, Rattus norvegicus
cgaaacgtcatgagcggagcgccac

SEQ ID NO: 569564 - DNA, 25 bp, Rattus norvegicus
tgagcggagcgccaccaatagataa

SEQ ID NO: 569565 - DNA, 25 bp, Rattus norvegicus
ccaccaatagataagtgcgcagatg

SEQ ID NO: 569566 - DNA, 25 bp, Rattus norvegicus
cgcagatgcggtgacgtcaccgaca

SEQ ID NO: 569567 - DNA, 25 bp, Rattus norvegicus
ccgacacgcgaccaagccggtgccg

SEQ ID NO: 569568 - DNA, 25 bp, Rattus norvegicus
aagctcgcggggagttcagccagtt

SEQ ID NO: 569569 - DNA, 25 bp, Rattus norvegicus
gggagttcagccagtttccggccca

SEQ ID NO: 569570 - DNA, 25 bp, Rattus norvegicus
ttcagccagtttccggcccaagtcg

SEQ ID NO: 569571 - DNA, 25 bp, Rattus norvegicus
cagtttccggcccaagtcgagccgg

SEQ ID NO: 569572 - DNA, 25 bp, Rattus norvegicus
ccaagtcgagccgggagggcttcct

SEQ ID NO: 569573 - DNA, 25 bp, Rattus norvegicus
tttccgccactttcctcctgccgtg

SEQ ID NO: 569574 - DNA, 25 bp, Rattus norvegicus
cggagcgccaccaatagataagtgc

SEQ ID NO: 569575 - DNA, 25 bp, Rattus norvegicus
cagctggagcgcaagaaggagacac

SEQ ID NO: 569576 - DNA, 25 bp, Rattus norvegicus
cacccaggacttcgcctactgccgc

SEQ ID NO: 569577 - DNA, 25 bp, Rattus norvegicus
cgcatgtggcctggggtagaccccc

SEQ ID NO: 569578 - DNA, 25 bp, Rattus norvegicus
gcagagccaggtgcgcatgtggcct

SEQ ID NO: 569579 - DNA, 25 bp, Rattus norvegicus
gactcactgcgcaaagagcagcgcg

SEQ ID NO: 569580 - DNA, 25 bp, Rattus norvegicus
tcgaggactcactgcgcaaagagca

SEQ ID NO: 569581 - DNA, 25 bp, Rattus norvegicus
cgcgcgcagatcgaggactcactgc

SEQ ID NO: 569582 - DNA, 25 bp, Rattus norvegicus
gtcacacgcgcgcagatcgaggact

SEQ ID NO: 569583 - DNA, 25 bp, Rattus norvegicus
acgtgtggcgcccgccaaggtcaca

SEQ ID NO: 569584 - DNA, 25 bp, Rattus norvegicus
tcacgactcaaaggcggcaaggccc

SEQ ID NO: 569585 - DNA, 25 bp, Rattus norvegicus
aggactcacgactcaaaggcggcaa

SEQ ID NO: 569586 - DNA, 25 bp, Rattus norvegicus
tggaggaggaggactcacgactcaa

SEQ ID NO: 569587 - DNA, 25 bp, Rattus norvegicus
agaaggagacacagcgcctgttgga

SEQ ID NO: 569588 - DNA, 25 bp, Rattus norvegicus
cgcaagaaggagacacagcgcctgt

SEQ ID NO: 569589 - DNA, 25 bp, Rattus norvegicus
cctgcgcactagcagtggggaaatc

SEQ ID NO: 569590 - DNA, 25 bp, Rattus norvegicus
caactaagacaaagggatccacgcg

SEQ ID NO: 569591 - DNA, 25 bp, Rattus norvegicus
tttgccgggcctggacaactaagac

SEQ ID NO: 569592 - DNA, 25 bp, Rattus norvegicus
cgcttgaaccagagaggagctcctg

SEQ ID NO: 569593 - DNA, 25 bp, Rattus norvegicus
cggggtaatccgcttgaaccagaga

SEQ ID NO: 569594 - DNA, 25 bp, Rattus norvegicus
tgcgcccacgcggtccggggtaatc

SEQ ID NO: 569595 - DNA, 25 bp, Rattus norvegicus
ggactaggggaatcctccaccgcca

SEQ ID NO: 569596 - DNA, 25 bp, Rattus norvegicus
cggagtactttgtttccctcacctg

SEQ ID NO: 569597 - DNA, 25 bp, Rattus norvegicus
cgcacgcgcggagtactttgtttcc

SEQ ID NO: 569598 - DNA, 25 bp, Rattus norvegicus
tcctaagagtcacgcgctgcgcacg

SEQ ID NO: 569599 - DNA, 25 bp, Rattus norvegicus
ttgccaaggagaccaggcggtccta

SEQ ID NO: 569600 - DNA, 25 bp, Rattus norvegicus
gagttccgcgcagttgccaaggaga

SEQ ID NO: 569601 - DNA, 25 bp, Rattus norvegicus
actcctgtacgggtttgctggaagg

SEQ ID NO: 569602 - DNA, 25 bp, Rattus norvegicus
tggggaaatccctgactcctgtacg

SEQ ID NO: 569603 - DNA, 25 bp, Rattus norvegicus
cgcacagatgtccatctcggggaca

SEQ ID NO: 569604 - DNA, 25 bp, Rattus norvegicus
tcagtggcatgagcacgcgctcgcc

SEQ ID NO: 569605 - DNA, 25 bp, Rattus norvegicus
tgcatgtggtactgtcagtggcatg

SEQ ID NO: 569606 - DNA, 25 bp, Rattus norvegicus
aagtccgtgcacaagggtgcatgtg

SEQ ID NO: 569607 - DNA, 25 bp, Rattus norvegicus
tccacgaagtccgtgcacaagggtg

SEQ ID NO: 569608 - DNA, 25 bp, Rattus norvegicus
gggagacgctgagtccacgaagtcc

SEQ ID NO: 569609 - DNA, 25 bp, Rattus norvegicus
acacaagagtgggtgcgcgtgtctc

SEQ ID NO: 569610 - DNA, 25 bp, Rattus norvegicus
cccgcaggtattggcgaaaggaagc

SEQ ID NO: 569611 - DNA, 25 bp, Rattus norvegicus
cgctgtcgcccgcaggtattggcga

SEQ ID NO: 569612 - DNA, 25 bp, Rattus norvegicus
gctgctcatccagggcggtgctgct

SEQ ID NO: 569613 - DNA, 25 bp, Rattus norvegicus
caaggcgctgctcatccagggcggt

SEQ ID NO: 569614 - DNA, 25 bp, Rattus norvegicus
gtgctcagccaatccaaggcgctgc

SEQ ID NO: 569615 - DNA, 25 bp, Rattus norvegicus
ggcctggcgtgctcagccaatccaa

SEQ ID NO: 569616 - DNA, 25 bp, Rattus norvegicus
ggggtgtacgctcctaatcttcaga

SEQ ID NO: 569617 - DNA, 25 bp, Rattus norvegicus
accggcacaggactcaccggaactg

SEQ ID NO: 569618 - DNA, 25 bp, Rattus norvegicus
gcgatcgaacaagcaacccatggtg

SEQ ID NO: 569619 - DNA, 25 bp, Rattus norvegicus
caagcctttggctgccacacgtgcg

SEQ ID NO: 569620 - DNA, 25 bp, Rattus norvegicus
cacgtgcgcaaacaaaggccgagca

SEQ ID NO: 569621 - DNA, 25 bp, Rattus norvegicus
agcaacccatggtgcgggctagccc

SEQ ID NO: 569622 - DNA, 25 bp, Rattus norvegicus
ggcgcgatcgaacaagcaacccatg

SEQ ID NO: 569623 - DNA, 25 bp, Rattus norvegicus
cagcgcggcgcgatcgaacaagcaa

SEQ ID NO: 569624 - DNA, 25 bp, Rattus norvegicus
tggcccgcacaacagcgcccgcagc

SEQ ID NO: 569625 - DNA, 25 bp, Rattus norvegicus
cactgaaagcgtggcccgcacaaca

SEQ ID NO: 569626 - DNA, 25 bp, Rattus norvegicus
cgcaccagcaggcactgaaagcgtg

SEQ ID NO: 569627 - DNA, 25 bp, Rattus norvegicus
actcaccggaactggggcgcaccag

SEQ ID NO: 569628 - DNA, 25 bp, Rattus norvegicus
aaacaaaggccgagcagccgccatc

SEQ ID NO: 569629 - DNA, 25 bp, Rattus norvegicus
tggctgccacacgtgcgcaaacaaa

SEQ ID NO: 569630 - DNA, 25 bp, Rattus norvegicus
tgggcggtgccacgcatcaatccgc

SEQ ID NO: 569631 - DNA, 25 bp, Rattus norvegicus
agacgttggcctagttctttgcaga

SEQ ID NO: 569632 - DNA, 25 bp, Rattus norvegicus
ccgcgctattggtgaagttcttttc

SEQ ID NO: 569633 - DNA, 25 bp, Rattus norvegicus
cccgcataagggttcgtgaggccac

SEQ ID NO: 569634 - DNA, 25 bp, Rattus norvegicus
taggcgaggctttctctaaggctcc

SEQ ID NO: 569635 - DNA, 25 bp, Rattus norvegicus
cttcgtgctattgactccggctccg

SEQ ID NO: 569636 - DNA, 25 bp, Rattus norvegicus
ttttcctgaaggtgtggctttctcc

SEQ ID NO: 569637 - DNA, 25 bp, Rattus norvegicus
cgccgcactattggcctagtctttt

SEQ ID NO: 569638 - DNA, 25 bp, Rattus norvegicus
ttacagagtctcttccggtaggcgc

SEQ ID NO: 569639 - DNA, 25 bp, Rattus norvegicus
gccctgttgtataagagcgacgctg

SEQ ID NO: 569640 - DNA, 25 bp, Rattus norvegicus
ctgctgcgctcgtagtctatctaga

SEQ ID NO: 569641 - DNA, 25 bp, Rattus norvegicus
tagctcttcctcatcgcgggttcga

SEQ ID NO: 569642 - DNA, 25 bp, Rattus norvegicus
tcgcgtccgtcacctcaatgctgtt

SEQ ID NO: 569643 - DNA, 25 bp, Rattus norvegicus
tactcagagttacagcgagcgcgtg

SEQ ID NO: 569644 - DNA, 25 bp, Rattus norvegicus
gctccgctctatctgcttcgtgcta

SEQ ID NO: 569645 - DNA, 25 bp, Rattus norvegicus
ggtcaccgtgtcttgtctcaggaca

SEQ ID NO: 569646 - DNA, 25 bp, Rattus norvegicus
ctcgcagcgcacgacgtattgcgtc

SEQ ID NO: 569647 - DNA, 25 bp, Rattus norvegicus
gtgtggttcctcaccgacacgtggc

SEQ ID NO: 569648 - DNA, 25 bp, Rattus norvegicus
acactgagtcctcggtgtggttcct

SEQ ID NO: 569649 - DNA, 25 bp, Rattus norvegicus
tccacggacactgagtcctcggtgt

SEQ ID NO: 569650 - DNA, 25 bp, Rattus norvegicus
tgtgacgctgtccactccacggaca

SEQ ID NO: 569651 - DNA, 25 bp, Rattus norvegicus
cgcacgacgtattgcgtcaggaccc

SEQ ID NO: 569652 - DNA, 25 bp, Rattus norvegicus
tcaccgacacgtggcgtggagttcc

SEQ ID NO: 569653 - DNA, 25 bp, Rattus norvegicus
ttcagcctcgcagcgcacgacgtat

SEQ ID NO: 569654 - DNA, 25 bp, Rattus norvegicus
ctcccacgtgccatcttcagcctcg

SEQ ID NO: 569655 - DNA, 25 bp, Rattus norvegicus
cctctccgcacctgactcccacgtg

SEQ ID NO: 569656 - DNA, 25 bp, Rattus norvegicus
aggacacagtaacagggctcgcacc

SEQ ID NO: 569657 - DNA, 25 bp, Rattus norvegicus
gtctcaggacacagtaacagggctc

SEQ ID NO: 569658 - DNA, 25 bp, Rattus norvegicus
caggtgctcagctgtgacgctgtcc

SEQ ID NO: 569659 - DNA, 25 bp, Rattus norvegicus
cagcgggcttagagctgaccgcgca

SEQ ID NO: 569660 - DNA, 25 bp, Rattus norvegicus
caccgactgcgggaggccggcactg

SEQ ID NO: 569661 - DNA, 25 bp, Rattus norvegicus
gaggccggcactgggcagaggaaat

SEQ ID NO: 569662 - DNA, 25 bp, Rattus norvegicus
tggggaagtaaagattgagtaaagc

SEQ ID NO: 569663 - DNA, 25 bp, Rattus norvegicus
ggggcgcggctgacgtcaacaagcg

SEQ ID NO: 569664 - DNA, 25 bp, Rattus norvegicus
tgagtaaagctgtttagacaggggc

SEQ ID NO: 569665 - DNA, 25 bp, Rattus norvegicus
taaagctgtttagacaggggcagtg

SEQ ID NO: 569666 - DNA, 25 bp, Rattus norvegicus
ctccccgaggaagccgcggatcgga

SEQ ID NO: 569667 - DNA, 25 bp, Rattus norvegicus
cgcggatcggagaccctggcgggaa

SEQ ID NO: 569668 - DNA, 25 bp, Rattus norvegicus
cccagttagattcgagcccgccctc

SEQ ID NO: 569669 - DNA, 25 bp, Rattus norvegicus
ccgccctcggcctcttaaaatagag

SEQ ID NO: 569670 - DNA, 25 bp, Rattus norvegicus
aacctcagcgggcttagagctgacc

SEQ ID NO: 569671 - DNA, 25 bp, Rattus norvegicus
gagacaccgcctccgggtgagtgaa

SEQ ID NO: 569672 - DNA, 25 bp, Rattus norvegicus
tagagacaccgcctccgggtgagtg

SEQ ID NO: 569673 - DNA, 25 bp, Rattus norvegicus
tcgcgtcgcctgatcgtccttttac

SEQ ID NO: 569674 - DNA, 25 bp, Rattus norvegicus
atccttactccggagaccgcgtctt

SEQ ID NO: 569675 - DNA, 25 bp, Rattus norvegicus
cccagagctgaaggtgatccggaac

SEQ ID NO: 569676 - DNA, 25 bp, Rattus norvegicus
cgtcttttaaactgcgcagcggaca

SEQ ID NO: 569677 - DNA, 25 bp, Rattus norvegicus
gcgccctgacgctggacttgtccag

SEQ ID NO: 569678 - DNA, 25 bp, Rattus norvegicus
cgtcagccaggatccttactccgga

SEQ ID NO: 569679 - DNA, 25 bp, Rattus norvegicus
aactgcgcagcggacagtcttgaga

SEQ ID NO: 569680 - DNA, 25 bp, Rattus norvegicus
aacttcggtcctccgatagctcctg

SEQ ID NO: 569681 - DNA, 25 bp, Rattus norvegicus
tggccactctgtggcgcgttggata

SEQ ID NO: 569682 - DNA, 25 bp, Rattus norvegicus
gtgtctttggtcacttggccgggac

SEQ ID NO: 569683 - DNA, 25 bp, Rattus norvegicus
cgcgttggatagacagtgccactgc

SEQ ID NO: 569684 - DNA, 25 bp, Rattus norvegicus
tcctgggagaaagttcctggagcca

SEQ ID NO: 569685 - DNA, 25 bp, Rattus norvegicus
cttgtccaggtcagtgtctttggtc

SEQ ID NO: 569686 - DNA, 25 bp, Rattus norvegicus
gtaagagccgcaggaacatcgcgtc

SEQ ID NO: 569687 - DNA, 25 bp, Rattus norvegicus
tcagtccatagtcccagcgcgtctg

SEQ ID NO: 569688 - DNA, 25 bp, Rattus norvegicus
gcctctgtcttgcagtctgtcgccg

SEQ ID NO: 569689 - DNA, 25 bp, Rattus norvegicus
agtccatagtcccagcgcgtctgct

SEQ ID NO: 569690 - DNA, 25 bp, Rattus norvegicus
ctgaggcccaagcaccgcggttcga

SEQ ID NO: 569691 - DNA, 25 bp, Rattus norvegicus
agtgagtactgaggcccaagcaccg

SEQ ID NO: 569692 - DNA, 25 bp, Rattus norvegicus
ctcgagtgagtactgaggcccaagc

SEQ ID NO: 569693 - DNA, 25 bp, Rattus norvegicus
gcgctgacactcgagtgagtactga

SEQ ID NO: 569694 - DNA, 25 bp, Rattus norvegicus
cccgcgctgacactcgagtgagtac

SEQ ID NO: 569695 - DNA, 25 bp, Rattus norvegicus
tggtcctgccccgtatcatatagtc

SEQ ID NO: 569696 - DNA, 25 bp, Rattus norvegicus
tcggttcccgcggtgccgccatgaa

SEQ ID NO: 569697 - DNA, 25 bp, Rattus norvegicus
atgaagtcccgcagggagaaattac

SEQ ID NO: 569698 - DNA, 25 bp, Rattus norvegicus
gtccaccttcttgtcccgctcctgg

SEQ ID NO: 569699 - DNA, 25 bp, Rattus norvegicus
tcccgcagggagaaattactgatcc

SEQ ID NO: 569700 - DNA, 25 bp, Rattus norvegicus
gagaaattactgatccccgcgctga

SEQ ID NO: 569701 - DNA, 25 bp, Rattus norvegicus
gcccggtattcgaactcgggactca

SEQ ID NO: 569702 - DNA, 25 bp, Rattus norvegicus
cgcttccggcagagcggtagcaaca

SEQ ID NO: 569703 - DNA, 25 bp, Rattus norvegicus
aactcgggactcaggccgcgcaaag

SEQ ID NO: 569704 - DNA, 25 bp, Rattus norvegicus
ggtctagctatagacgcccggtatt

SEQ ID NO: 569705 - DNA, 25 bp, Rattus norvegicus
ccgggcacagggtctagctatagac

SEQ ID NO: 569706 - DNA, 25 bp, Rattus norvegicus
ggtgcgctgctacaacgttccaaaa

SEQ ID NO: 569707 - DNA, 25 bp, Rattus norvegicus
cggagggccacagcatgtcggaccc

SEQ ID NO: 569708 - DNA, 25 bp, Rattus norvegicus
cggtagcaacaaaagctccttagtt

SEQ ID NO: 569709 - DNA, 25 bp, Rattus norvegicus
caggttctaactgcgctgcatccca

SEQ ID NO: 569710 - DNA, 25 bp, Rattus norvegicus
ctggtcacggacaggcaggttctaa

SEQ ID NO: 569711 - DNA, 25 bp, Rattus norvegicus
ctggcaacactggtcacggacaggc

SEQ ID NO: 569712 - DNA, 25 bp, Rattus norvegicus
attaagcctcgtcctgctgctccgg

SEQ ID NO: 569713 - DNA, 25 bp, Rattus norvegicus
cccagagccctagcaacgttcatta

SEQ ID NO: 569714 - DNA, 25 bp, Rattus norvegicus
gctcaggccgaatccggccgatctg

SEQ ID NO: 569715 - DNA, 25 bp, Rattus norvegicus
atcgtcatccacagctcgggcaaga

SEQ ID NO: 569716 - DNA, 25 bp, Rattus norvegicus
ctagccgggacccatcaccagtgtg

SEQ ID NO: 569717 - DNA, 25 bp, Rattus norvegicus
cgggacccatcaccagtgtgtggta

SEQ ID NO: 569718 - DNA, 25 bp, Rattus norvegicus
accagtgtgtggtagcctgcggccc

SEQ ID NO: 569719 - DNA, 25 bp, Rattus norvegicus
cccgagactcctcacctagccggga

SEQ ID NO: 569720 - DNA, 25 bp, Rattus norvegicus
agctcgggcaagaagtacggcttca

SEQ ID NO: 569721 - DNA, 25 bp, Rattus norvegicus
tcgggcaagaagtacggcttcagcc

SEQ ID NO: 569722 - DNA, 25 bp, Rattus norvegicus
agaagtacggcttcagccttcgcgc

SEQ ID NO: 569723 - DNA, 25 bp, Rattus norvegicus
agccttcgcgccattcgtgtctaca

SEQ ID NO: 569724 - DNA, 25 bp, Rattus norvegicus
tcgcgccattcgtgtctacatggga

SEQ ID NO: 569725 - DNA, 25 bp, Rattus norvegicus
cattcgtgtctacatgggagacagc

SEQ ID NO: 569726 - DNA, 25 bp, Rattus norvegicus
tctacatgggagacagcgacgtgta

SEQ ID NO: 569727 - DNA, 25 bp, Rattus norvegicus
acatgggagacagcgacgtgtacac

SEQ ID NO: 569728 - DNA, 25 bp, Rattus norvegicus
catcaccagtgtgtggtagcctgcg

SEQ ID NO: 569729 - DNA, 25 bp, Rattus norvegicus
gccgccgcaagtccacaagcagtat

SEQ ID NO: 569730 - DNA, 25 bp, Rattus norvegicus
ctgcatctgtcagagcgccgggact

SEQ ID NO: 569731 - DNA, 25 bp, Rattus norvegicus
aggaggctgcatctgtcagagcgcc

SEQ ID NO: 569732 - DNA, 25 bp, Rattus norvegicus
gccgagactgagctggtcgtcatga

SEQ ID NO: 569733 - DNA, 25 bp, Rattus norvegicus
cctaggcaccagtgagaggctggat

SEQ ID NO: 569734 - DNA, 25 bp, Rattus norvegicus
tgccgataagctgggcctaggcacc

SEQ ID NO: 569735 - DNA, 25 bp, Rattus norvegicus
gtaggggccagtctgccgataagct

SEQ ID NO: 569736 - DNA, 25 bp, Rattus norvegicus
ccctaggctgcgtaggggccagtct

SEQ ID NO: 569737 - DNA, 25 bp, Rattus norvegicus
aagtccacaagcagtatccctccgt

SEQ ID NO: 569738 - DNA, 25 bp, Rattus norvegicus
cctcgacacaagagcggccgccgca

SEQ ID NO: 569739 - DNA, 25 bp, Rattus norvegicus
cttcgatgaggagcctgggccgact

SEQ ID NO: 569740 - DNA, 25 bp, Rattus norvegicus
agcgccgggactccttcaagaagca

SEQ ID NO: 569741 - DNA, 25 bp, Rattus norvegicus
ccgtgcaggaagtgagcttcgatga

SEQ ID NO: 569742 - DNA, 25 bp, Rattus norvegicus
gggcacattcccataccagcacggt

SEQ ID NO: 569743 - DNA, 25 bp, Rattus norvegicus
caggctcggttacttccggttctca

SEQ ID NO: 569744 - DNA, 25 bp, Rattus norvegicus
ccgcgggagtacattcggcagtttc

SEQ ID NO: 569745 - DNA, 25 bp, Rattus norvegicus
ctccgcctcgtatggggtgaaagga

SEQ ID NO: 569746 - DNA, 25 bp, Rattus norvegicus
ttccggactcagatgagcagcattc

SEQ ID NO: 569747 - DNA, 25 bp, Rattus norvegicus
ccaaactggacgtgcttcggctatt

SEQ ID NO: 569748 - DNA, 25 bp, Rattus norvegicus
tccgagtcaactgccaagagctata

SEQ ID NO: 569749 - DNA, 25 bp, Rattus norvegicus
ttaggttccttccagacacgctccg

SEQ ID NO: 569750 - DNA, 25 bp, Rattus norvegicus
gtcttgcaggttcacgacttcgtta

SEQ ID NO: 569751 - DNA, 25 bp, Rattus norvegicus
ctatttccggaatggctcaggtatc

SEQ ID NO: 569752 - DNA, 25 bp, Rattus norvegicus
agagtcccgagtcctaccgagtcca

SEQ ID NO: 569753 - DNA, 25 bp, Rattus norvegicus
tccagcctcggaccgaatgcgtttc

SEQ ID NO: 569754 - DNA, 25 bp, Rattus norvegicus
gagcgctctctcgaatcggttatgc

SEQ ID NO: 569755 - DNA, 25 bp, Rattus norvegicus
ctccaattgccagcgtcggtcgata

SEQ ID NO: 569756 - DNA, 25 bp, Rattus norvegicus
ctcggctgtctcgtggcaaacaaca

SEQ ID NO: 569757 - DNA, 25 bp, Rattus norvegicus
cttgcccattggtttgctgagagca

SEQ ID NO: 569758 - DNA, 25 bp, Rattus norvegicus
aagacttccgtgttcggcttgagcg

SEQ ID NO: 569759 - DNA, 25 bp, Rattus norvegicus
cgtgctgcaacgcttgaggacaatt

SEQ ID NO: 569760 - DNA, 25 bp, Rattus norvegicus
ggacaattggtcatttccttcaaga

SEQ ID NO: 569761 - DNA, 25 bp, Rattus norvegicus
ccacgattggccagctcggctcagt

SEQ ID NO: 569762 - DNA, 25 bp, Rattus norvegicus
gcgagactgatgtgcacttgcccat

SEQ ID NO: 569763 - DNA, 25 bp, Rattus norvegicus
cttcaagaggcggagctttggaatt

SEQ ID NO: 569764 - DNA, 25 bp, Rattus norvegicus
ggaattttcgattgggccgttctga

SEQ ID NO: 569765 - DNA, 25 bp, Rattus norvegicus
gcttcctagtgtctgtcgcggcgat

SEQ ID NO: 569766 - DNA, 25 bp, Rattus norvegicus
tgctcgtcaccaacacactgggctg

SEQ ID NO: 569767 - DNA, 25 bp, Rattus norvegicus
cgcggcctgagcagagattcagcgc

SEQ ID NO: 569768 - DNA, 25 bp, Rattus norvegicus
aagcaacgacccacgattggccagc

SEQ ID NO: 569769 - DNA, 25 bp, Rattus norvegicus
agagacctatcggtcatcctggacc

SEQ ID NO: 569770 - DNA, 25 bp, Rattus norvegicus
gccgttctgaatagggcggtccttc

SEQ ID NO: 569771 - DNA, 25 bp, Rattus norvegicus
cttcgtaggttgcacatggcaccgc

SEQ ID NO: 569772 - DNA, 25 bp, Rattus norvegicus
caggaccctggacgcgttttcctca

SEQ ID NO: 569773 - DNA, 25 bp, Rattus norvegicus
ttccagaaactgttccaggcggggc

SEQ ID NO: 569774 - DNA, 25 bp, Rattus norvegicus
gtggtgtagagtcgcttcctcctcc

SEQ ID NO: 569775 - DNA, 25 bp, Rattus norvegicus
tcccacagaacgtgcccaggcaagg

SEQ ID NO: 569776 - DNA, 25 bp, Rattus norvegicus
aggcaaggccagtcgctcgccatgt

SEQ ID NO: 569777 - DNA, 25 bp, Rattus norvegicus
gatgttttccatagagcccggggca

SEQ ID NO: 569778 - DNA, 25 bp, Rattus norvegicus
cgttttcctcaggtactactgcttg

SEQ ID NO: 569779 - DNA, 25 bp, Rattus norvegicus
tactgcttggctcttcacccgggaa

SEQ ID NO: 569780 - DNA, 25 bp, Rattus norvegicus
ggggactccagagctgcagaacctt

SEQ ID NO: 569781 - DNA, 25 bp, Rattus norvegicus
gctgcagaaccttccgcgcgcggaa

SEQ ID NO: 569782 - DNA, 25 bp, Rattus norvegicus
ctcccagagccgagggcaggttcca

SEQ ID NO: 569783 - DNA, 25 bp, Rattus norvegicus
ccagccggacccttcgtaggttgca

SEQ ID NO: 569784 - DNA, 25 bp, Rattus norvegicus
ggaaccttccggtctcgggcgcaca

SEQ ID NO: 569785 - DNA, 25 bp, Rattus norvegicus
tttcacaagtgtgcacgctgcgcgt

SEQ ID NO: 569786 - DNA, 25 bp, Rattus norvegicus
gcggggctttctatgcaaacgaatc

SEQ ID NO: 569787 - DNA, 25 bp, Rattus norvegicus
gcagtcctcgctggcgtcctgcaaa

SEQ ID NO: 569788 - DNA, 25 bp, Rattus norvegicus
ctaaactgagacaacgctggcgaca

SEQ ID NO: 569789 - DNA, 25 bp, Rattus norvegicus
tcaccttgccctctctaaactgaga

SEQ ID NO: 569790 - DNA, 25 bp, Rattus norvegicus
tggtcctgggttgctctcaccttgc

SEQ ID NO: 569791 - DNA, 25 bp, Rattus norvegicus
actcccaggctgtcagtgcaacgcg

SEQ ID NO: 569792 - DNA, 25 bp, Rattus norvegicus
gaggtcacgcgagcttctccatgcc

SEQ ID NO: 569793 - DNA, 25 bp, Rattus norvegicus
gagcacgcacaagactcccgcaagg

SEQ ID NO: 569794 - DNA, 25 bp, Rattus norvegicus
ccatgcacgcacaaggtttcacaag

SEQ ID NO: 569795 - DNA, 25 bp, Rattus norvegicus
aactgggatccacgcacaccatgca

SEQ ID NO: 569796 - DNA, 25 bp, Rattus norvegicus
cgcgtgtgagcttatacttgaactg

SEQ ID NO: 569797 - DNA, 25 bp, Rattus norvegicus
gctcatggctccacacgcgtgtgag

SEQ ID NO: 569798 - DNA, 25 bp, Rattus norvegicus
ccaaatgcgagacccatagccacta

SEQ ID NO: 569799 - DNA, 25 bp, Rattus norvegicus
ggttcgaatgggttcgtgcaccctc

SEQ ID NO: 569800 - DNA, 25 bp, Rattus norvegicus
gcccgctggccagaaacgtggtcac

SEQ ID NO: 569801 - DNA, 25 bp, Rattus norvegicus
cgtggtcacgtgattttccgctgta

SEQ ID NO: 569802 - DNA, 25 bp, Rattus norvegicus
ttccgctgtaccctagaggtcattc

SEQ ID NO: 569803 - DNA, 25 bp, Rattus norvegicus
ttccatcctgatcctcgccagtaga

SEQ ID NO: 569804 - DNA, 25 bp, Rattus norvegicus
ctcgccagtagagccggataagctc

SEQ ID NO: 569805 - DNA, 25 bp, Rattus norvegicus
tgtttccggcaggattgggttcgaa

SEQ ID NO: 569806 - DNA, 25 bp, Rattus norvegicus
gtcccgcctaactcgggtgatctcg

SEQ ID NO: 569807 - DNA, 25 bp, Rattus norvegicus
ggctgtgctcatcctctgccagatt

SEQ ID NO: 569808 - DNA, 25 bp, Rattus norvegicus
cagattccctctttgttttggaggg

SEQ ID NO: 569809 - DNA, 25 bp, Rattus norvegicus
cgcggcgcagatacttcatgacgtc

SEQ ID NO: 569810 - DNA, 25 bp, Rattus norvegicus
catgacgtcacgtggaacggggctt

SEQ ID NO: 569811 - DNA, 25 bp, Rattus norvegicus
ctttactgtcaccatgcccaggggc

SEQ ID NO: 569812 - DNA, 25 bp, Rattus norvegicus
agctcggctcgattaggctgtttcc

SEQ ID NO: 569813 - DNA, 25 bp, Rattus norvegicus
gaagctggacctttttagatgctcc

SEQ ID NO: 569814 - DNA, 25 bp, Rattus norvegicus
cagggctcaggaagctggacctttt

SEQ ID NO: 569815 - DNA, 25 bp, Rattus norvegicus
atgggccaccgtgaagcggcgctgc

SEQ ID NO: 569816 - DNA, 25 bp, Rattus norvegicus
cctttttagatgctccggggcggag

SEQ ID NO: 569817 - DNA, 25 bp, Rattus norvegicus
ctggacctttttagatgctccgggg

SEQ ID NO: 569818 - DNA, 25 bp, Rattus norvegicus
caggaagctggacctttttagatgc

SEQ ID NO: 569819 - DNA, 25 bp, Rattus norvegicus
gggctcaggaagctggaccttttta

SEQ ID NO: 569820 - DNA, 25 bp, Rattus norvegicus
ctgtggagccctgcatggcccggcc

SEQ ID NO: 569821 - DNA, 25 bp, Rattus norvegicus
ccagcagcttcctgaagagcgcggg

SEQ ID NO: 569822 - DNA, 25 bp, Rattus norvegicus
gctctgattcaccagcagcttcctg

SEQ ID NO: 569823 - DNA, 25 bp, Rattus norvegicus
ggatgctctgattcaccagcagctt

SEQ ID NO: 569824 - DNA, 25 bp, Rattus norvegicus
aggcggatgctctgattcaccagca

SEQ ID NO: 569825 - DNA, 25 bp, Rattus norvegicus
tgcaggcggatgctctgattcacca

SEQ ID NO: 569826 - DNA, 25 bp, Rattus norvegicus
gctgcaggcggatgctctgattcac

SEQ ID NO: 569827 - DNA, 25 bp, Rattus norvegicus
agcagcagcaaagacagcgtcaggg

SEQ ID NO: 569828 - DNA, 25 bp, Rattus norvegicus
tccgattctcgcgagcagcagcaaa

SEQ ID NO: 569829 - DNA, 25 bp, Rattus norvegicus
cgattctcgcgagcagcagcaaaga

SEQ ID NO: 569830 - DNA, 25 bp, Rattus norvegicus
tctcgcgagcagcagcaaagacagc

SEQ ID NO: 569831 - DNA, 25 bp, Rattus norvegicus
gcgagcagcagcaaagacagcgtca

SEQ ID NO: 569832 - DNA, 25 bp, Rattus norvegicus
gagtctccgattctcgcgagcagca

SEQ ID NO: 569833 - DNA, 25 bp, Rattus norvegicus
gggatcccgccattcttgcggtccg

SEQ ID NO: 569834 - DNA, 25 bp, Rattus norvegicus
tgcggtccgcccaggctacaggtgc

SEQ ID NO: 569835 - DNA, 25 bp, Rattus norvegicus
cccaggttggcagcgcctcgcccac

SEQ ID NO: 569836 - DNA, 25 bp, Rattus norvegicus
cccctgctggcggaccgtaggaatg

SEQ ID NO: 569837 - DNA, 25 bp, Rattus norvegicus
gaggagtctccgattctcgcgagca

SEQ ID NO: 569838 - DNA, 25 bp, Rattus norvegicus
ttcctcagtggcaccctcctcggca

SEQ ID NO: 569839 - DNA, 25 bp, Rattus norvegicus
acggaggagtctccgattctcgcga

SEQ ID NO: 569840 - DNA, 25 bp, Rattus norvegicus
gaccgtaggaatggcgagctgcgcg

SEQ ID NO: 569841 - DNA, 25 bp, Rattus norvegicus
gaggcgtctacacgtccgcacctgg

SEQ ID NO: 569842 - DNA, 25 bp, Rattus norvegicus
cctcactgtcaagagggcaaactgc

SEQ ID NO: 569843 - DNA, 25 bp, Rattus norvegicus
ggcaaactgcagcttggaggcgccc

SEQ ID NO: 569844 - DNA, 25 bp, Rattus norvegicus
tcaccttgtataccgcacactttct

SEQ ID NO: 569845 - DNA, 25 bp, Rattus norvegicus
gacgaggtaggacgcgccctccaca

SEQ ID NO: 569846 - DNA, 25 bp, Rattus norvegicus
ctgggatcagcggtgacatcgcaaa

SEQ ID NO: 569847 - DNA, 25 bp, Rattus norvegicus
tgacatcgcaaagggcaggcccggc

SEQ ID NO: 569848 - DNA, 25 bp, Rattus norvegicus
acgtccgcacctggcgttcctagga

SEQ ID NO: 569849 - DNA, 25 bp, Rattus norvegicus
gcggggtggtcctctctagtcccgc

SEQ ID NO: 569850 - DNA, 25 bp, Rattus norvegicus
tggagccaggcatcaggtccagcct

SEQ ID NO: 569851 - DNA, 25 bp, Rattus norvegicus
gtccagcctgctagaagccgttgta

SEQ ID NO: 569852 - DNA, 25 bp, Rattus norvegicus
agaagccgttgtaggtgttcgcgtc

SEQ ID NO: 569853 - DNA, 25 bp, Rattus norvegicus
ggatttttgttgtcgcctgggatca

SEQ ID NO: 569854 - DNA, 25 bp, Rattus norvegicus
cagctgccatggtggccaaggatta

SEQ ID NO: 569855 - DNA, 25 bp, Rattus norvegicus
gccacccgcgaaactgctcaggttg

SEQ ID NO: 569856 - DNA, 25 bp, Rattus norvegicus
tgcgttcctgcgtgtccatgtcgat

SEQ ID NO: 569857 - DNA, 25 bp, Rattus norvegicus
ttgcgctccgccttgatgcgttcct

SEQ ID NO: 569858 - DNA, 25 bp, Rattus norvegicus
cagcttgcgcttgcggcatttggaa

SEQ ID NO: 569859 - DNA, 25 bp, Rattus norvegicus
ggcttttgagggtcttgactttctc

SEQ ID NO: 569860 - DNA, 25 bp, Rattus norvegicus
aggcgcgagatacgctccagcttgc

SEQ ID NO: 569861 - DNA, 25 bp, Rattus norvegicus
gctctgcttgtgcaggtcctccagc

SEQ ID NO: 569862 - DNA, 25 bp, Rattus norvegicus
cgccaccttagggtagaggaactgc

SEQ ID NO: 569863 - DNA, 25 bp, Rattus norvegicus
aggactttctgtttgagctgcgcca

SEQ ID NO: 569864 - DNA, 25 bp, Rattus norvegicus
accagcccgttggactggatgatca

SEQ ID NO: 569865 - DNA, 25 bp, Rattus norvegicus
tgatcagcctttccagctccggcga

SEQ ID NO: 569866 - DNA, 25 bp, Rattus norvegicus
acgcgagtttgagcagcccaagatc

SEQ ID NO: 569867 - DNA, 25 bp, Rattus norvegicus
cagtggccgaccctggtttcaatcc

SEQ ID NO: 569868 - DNA, 25 bp, Rattus norvegicus
tccagcgccttgacgaagccttcgg

SEQ ID NO: 569869 - DNA, 25 bp, Rattus norvegicus
ttcccggaaacgcagcaatcctatc

SEQ ID NO: 569870 - DNA, 25 bp, Rattus norvegicus
caagctccggaagcgatcatagtcc

SEQ ID NO: 569871 - DNA, 25 bp, Rattus norvegicus
gatcatagtccttccggccgcaaaa

SEQ ID NO: 569872 - DNA, 25 bp, Rattus norvegicus
gactgggaccctagagagacactgg

SEQ ID NO: 569873 - DNA, 25 bp, Rattus norvegicus
cagagataacttccgccgctgcaca

SEQ ID NO: 569874 - DNA, 25 bp, Rattus norvegicus
cagcgagtgactaaatggaccgatc

SEQ ID NO: 569875 - DNA, 25 bp, Rattus norvegicus
taaggcggtgcctacataacgcggc

SEQ ID NO: 569876 - DNA, 25 bp, Rattus norvegicus
atcgcgtcgtattcccaccgtggga

SEQ ID NO: 569877 - DNA, 25 bp, Rattus norvegicus
gcggtgctcttcatgcccactcatg

SEQ ID NO: 569878 - DNA, 25 bp, Rattus norvegicus
gatgtgcactcctgactggttcggc

SEQ ID NO: 569879 - DNA, 25 bp, Rattus norvegicus
actgtgggcgaaactggctaatgca

SEQ ID NO: 569880 - DNA, 25 bp, Rattus norvegicus
ctaatgcatgtgaatcgcgctgggc

SEQ ID NO: 569881 - DNA, 25 bp, Rattus norvegicus
cttgaacgcgaacgtcagggccagc

SEQ ID NO: 569882 - DNA, 25 bp, Rattus norvegicus
gtcctcgcccttatggagctctttc

SEQ ID NO: 569883 - DNA, 25 bp, Rattus norvegicus
ggcgtggctccaggtagatttgaga

SEQ ID NO: 569884 - DNA, 25 bp, Rattus norvegicus
gcgtggctccaggtagatttgagag

SEQ ID NO: 569885 - DNA, 25 bp, Rattus norvegicus
cgtggctccaggtagatttgagagc

SEQ ID NO: 569886 - DNA, 25 bp, Rattus norvegicus
gtggctccaggtagatttgagagcc

SEQ ID NO: 569887 - DNA, 25 bp, Rattus norvegicus
tggctccaggtagatttgagagccc

SEQ ID NO: 569888 - DNA, 25 bp, Rattus norvegicus
ggctccaggtagatttgagagcccg

SEQ ID NO: 569889 - DNA, 25 bp, Rattus norvegicus
gctccaggtagatttgagagcccgg

SEQ ID NO: 569890 - DNA, 25 bp, Rattus norvegicus
ctccaggtagatttgagagcccggt

SEQ ID NO: 569891 - DNA, 25 bp, Rattus norvegicus
tccaggtagatttgagagcccggtg

SEQ ID NO: 569892 - DNA, 25 bp, Rattus norvegicus
ccaggtagatttgagagcccggtgg

SEQ ID NO: 569893 - DNA, 25 bp, Rattus norvegicus
caggtagatttgagagcccggtggc

SEQ ID NO: 569894 - DNA, 25 bp, Rattus norvegicus
aggtagatttgagagcccggtggcc

SEQ ID NO: 569895 - DNA, 25 bp, Rattus norvegicus
gtagatttgagagcccggtggccac

SEQ ID NO: 569896 - DNA, 25 bp, Rattus norvegicus
tagatttgagagcccggtggccact

SEQ ID NO: 569897 - DNA, 25 bp, Rattus norvegicus
cagcccagcgtttcagcggcaaaca

SEQ ID NO: 569898 - DNA, 25 bp, Rattus norvegicus
tgtggcctaagccagggatatcttg

SEQ ID NO: 569899 - DNA, 25 bp, Rattus norvegicus
taagccagggatatcttgggtcgcg

SEQ ID NO: 569900 - DNA, 25 bp, Rattus norvegicus
aatttcggaggatgtggcctaagcc

SEQ ID NO: 569901 - DNA, 25 bp, Rattus norvegicus
tagaaggaagaaatttcggaggatg

SEQ ID NO: 569902 - DNA, 25 bp, Rattus norvegicus
gacggagtagattttagaaggaaga

SEQ ID NO: 569903 - DNA, 25 bp, Rattus norvegicus
gctcgggacggagtagattttagaa

SEQ ID NO: 569904 - DNA, 25 bp, Rattus norvegicus
tttcagcggcaaacagggaaaggga

SEQ ID NO: 569905 - DNA, 25 bp, Rattus norvegicus
tgtatgcacgcccagcccagcgttt

SEQ ID NO: 569906 - DNA, 25 bp, Rattus norvegicus
tggagattctgtatgcacgcccagc

SEQ ID NO: 569907 - DNA, 25 bp, Rattus norvegicus
agggcgaatctacacttgcgtcggg

SEQ ID NO: 569908 - DNA, 25 bp, Rattus norvegicus
atcagggcgaatctacacttgcgtc

SEQ ID NO: 569909 - DNA, 25 bp, Rattus norvegicus
ctttggaaggatcagggcgaatcta

SEQ ID NO: 569910 - DNA, 25 bp, Rattus norvegicus
tcgttgccctagatgggctcgggac

SEQ ID NO: 569911 - DNA, 25 bp, Rattus norvegicus
tcacgcggccgggagttcggagtgc

SEQ ID NO: 569912 - DNA, 25 bp, Rattus norvegicus
agttgtcgcctcctgcgatagcacc

SEQ ID NO: 569913 - DNA, 25 bp, Rattus norvegicus
caggtgctcgcggttgccacaagtt

SEQ ID NO: 569914 - DNA, 25 bp, Rattus norvegicus
gcctcctgcgatagcaccgttcggt

SEQ ID NO: 569915 - DNA, 25 bp, Rattus norvegicus
ttgtcgcctcctgcgatagcaccgt

SEQ ID NO: 569916 - DNA, 25 bp, Rattus norvegicus
gcgatagcaccgttcggtcccggta

SEQ ID NO: 569917 - DNA, 25 bp, Rattus norvegicus
tgcagttgtcgcctcctgcgatagc

SEQ ID NO: 569918 - DNA, 25 bp, Rattus norvegicus
agtttgcagttgtcgcctcctgcga

SEQ ID NO: 569919 - DNA, 25 bp, Rattus norvegicus
acaagtttgcagttgtcgcctcctg

SEQ ID NO: 569920 - DNA, 25 bp, Rattus norvegicus
gccacaagtttgcagttgtcgcctc

SEQ ID NO: 569921 - DNA, 25 bp, Rattus norvegicus
ttgccacaagtttgcagttgtcgcc

SEQ ID NO: 569922 - DNA, 25 bp, Rattus norvegicus
cggttgccacaagtttgcagttgtc

SEQ ID NO: 569923 - DNA, 25 bp, Rattus norvegicus
tcgcggttgccacaagtttgcagtt

SEQ ID NO: 569924 - DNA, 25 bp, Rattus norvegicus
gctcgcggttgccacaagtttgcag

SEQ ID NO: 569925 - DNA, 25 bp, Rattus norvegicus
acctaggttggagcgactgggtact

SEQ ID NO: 569926 - DNA, 25 bp, Rattus norvegicus
actgtgcaggcaactctcgaggacc

SEQ ID NO: 569927 - DNA, 25 bp, Rattus norvegicus
cccaagagactcgtgcccgctgggt

SEQ ID NO: 569928 - DNA, 25 bp, Rattus norvegicus
aactgcacttacgatcggccgccgg

SEQ ID NO: 569929 - DNA, 25 bp, Rattus norvegicus
gcgcgcctggaactgcacttacgat

SEQ ID NO: 569930 - DNA, 25 bp, Rattus norvegicus
cgtcaaccgggcgtcgctgactcag

SEQ ID NO: 569931 - DNA, 25 bp, Rattus norvegicus
cccgcgtcagctgcaactgagcatg

SEQ ID NO: 569932 - DNA, 25 bp, Rattus norvegicus
gggcgttctggtttcttctgcagtg

SEQ ID NO: 569933 - DNA, 25 bp, Rattus norvegicus
gctgctgtcacctggagactgtgca

SEQ ID NO: 569934 - DNA, 25 bp, Rattus norvegicus
ttcttctgcagtgcgattggggtcc

SEQ ID NO: 569935 - DNA, 25 bp, Rattus norvegicus
atcaaagcacgcctgcatggcctgc

SEQ ID NO: 569936 - DNA, 25 bp, Rattus norvegicus
tgcatggcctgcagcccgacagagt

SEQ ID NO: 569937 - DNA, 25 bp, Rattus norvegicus
gaagcgcgcatttgcacccaagaga

SEQ ID NO: 569938 - DNA, 25 bp, Rattus norvegicus
acgcatgcgcagatcaaagcacgcc

SEQ ID NO: 569939 - DNA, 25 bp, Rattus norvegicus
acgaggttctcatcctgggttgcgc

SEQ ID NO: 569940 - DNA, 25 bp, Rattus norvegicus
cccacgtgacgtctgtcgtctggta

SEQ ID NO: 569941 - DNA, 25 bp, Rattus norvegicus
aggacgcttcatcctttgctgcccg

SEQ ID NO: 569942 - DNA, 25 bp, Rattus norvegicus
caagctgagtgatccgctgtgaatc

SEQ ID NO: 569943 - DNA, 25 bp, Rattus norvegicus
ttcgcctccactctggccaaggtga

SEQ ID NO: 569944 - DNA, 25 bp, Rattus norvegicus
atcctcagggacctagaccgcaggc

SEQ ID NO: 569945 - DNA, 25 bp, Rattus norvegicus
gcgcggcgttgaaacgaggttctca

SEQ ID NO: 569946 - DNA, 25 bp, Rattus norvegicus
cgtggtgacccaaggaccgtcatcc

SEQ ID NO: 569947 - DNA, 25 bp, Rattus norvegicus
atgccgcttttctgttccgggcccg

SEQ ID NO: 569948 - DNA, 25 bp, Rattus norvegicus
gcccgccgagttcgctcaattggag

SEQ ID NO: 569949 - DNA, 25 bp, Rattus norvegicus
tcaattggagcgtaccctaccggtc

SEQ ID NO: 569950 - DNA, 25 bp, Rattus norvegicus
cggtccgtctctcctgtgctttaga

SEQ ID NO: 569951 - DNA, 25 bp, Rattus norvegicus
tccgaagaatagctgaaccgtggtg

SEQ ID NO: 569952 - DNA, 25 bp, Rattus norvegicus
caacatcaaggagagcggtgagccc

SEQ ID NO: 569953 - DNA, 25 bp, Rattus norvegicus
cccataattacagctgcggagagga

SEQ ID NO: 569954 - DNA, 25 bp, Rattus norvegicus
gaaacagtctccgagtacagccgtg

SEQ ID NO: 569955 - DNA, 25 bp, Rattus norvegicus
tgtgttgcacttagaaaattaccca

SEQ ID NO: 569956 - DNA, 25 bp, Rattus norvegicus
gagcctgaggcacaggtcgccctca

SEQ ID NO: 569957 - DNA, 25 bp, Rattus norvegicus
gtaactctattttgggaactctgca

SEQ ID NO: 569958 - DNA, 25 bp, Rattus norvegicus
cagcgtccaaactcgggcttctgtc

SEQ ID NO: 569959 - DNA, 25 bp, Rattus norvegicus
ttggtaccgcggcacagaacaatca

SEQ ID NO: 569960 - DNA, 25 bp, Rattus norvegicus
tgagggcgaacgtctctccttcctt

SEQ ID NO: 569961 - DNA, 25 bp, Rattus norvegicus
ttagaagttctcaagcggcgggagc

SEQ ID NO: 569962 - DNA, 25 bp, Rattus norvegicus
cctgtctcaggattgatgcggctta

SEQ ID NO: 569963 - DNA, 25 bp, Rattus norvegicus
accagtagtgtatcctgtctcagga

SEQ ID NO: 569964 - DNA, 25 bp, Rattus norvegicus
gggacctgcacataccagtagtgta

SEQ ID NO: 569965 - DNA, 25 bp, Rattus norvegicus
tactgctggacgaccgctctcggtc

SEQ ID NO: 569966 - DNA, 25 bp, Rattus norvegicus
tacagccgtgctccagctgtgccgg

SEQ ID NO: 569967 - DNA, 25 bp, Rattus norvegicus
ggaaacccgagaccatgaccatgcc

SEQ ID NO: 569968 - DNA, 25 bp, Rattus norvegicus
gggcgcaatctccagcttgtcttta

SEQ ID NO: 569969 - DNA, 25 bp, Rattus norvegicus
accactagtgctttcacggggcccg

SEQ ID NO: 569970 - DNA, 25 bp, Rattus norvegicus
gtaatagcctggctgcctcccgacg

SEQ ID NO: 569971 - DNA, 25 bp, Rattus norvegicus
cgtgcagcgaaagggagtaatagcc

SEQ ID NO: 569972 - DNA, 25 bp, Rattus norvegicus
ggctgcctttcctgagcgcctggaa

SEQ ID NO: 569973 - DNA, 25 bp, Rattus norvegicus
gtctttaaactgtcgtgcccaacca

SEQ ID NO: 569974 - DNA, 25 bp, Rattus norvegicus
ttgccatgacgacggtgcagttgct

SEQ ID NO: 569975 - DNA, 25 bp, Rattus norvegicus
tgacctgcaggctgtcacgctcaca

SEQ ID NO: 569976 - DNA, 25 bp, Rattus norvegicus
cagggcctgcaaaaaggtgctgtgc

SEQ ID NO: 569977 - DNA, 25 bp, Rattus norvegicus
aaccgtacatcctgggtgggacaca

SEQ ID NO: 569978 - DNA, 25 bp, Rattus norvegicus
tggcgaagtgtctccactgggtccc

SEQ ID NO: 569979 - DNA, 25 bp, Rattus norvegicus
agcggattcttttctccaggagtcg

SEQ ID NO: 569980 - DNA, 25 bp, Rattus norvegicus
cccaaccagggacacgtgcagcgaa

SEQ ID NO: 569981 - DNA, 25 bp, Rattus norvegicus
cgcctgacaggtgcggagcatgtac

SEQ ID NO: 569982 - DNA, 25 bp, Rattus norvegicus
caggcgcgcgagaagtgagtgcgcc

SEQ ID NO: 569983 - DNA, 25 bp, Rattus norvegicus
gcgcccgccgttgccgctttaagag

SEQ ID NO: 569984 - DNA, 25 bp, Rattus norvegicus
ccgttgccgctttaagagcggcggt

SEQ ID NO: 569985 - DNA, 25 bp, Rattus norvegicus
cagcgcggcgagaacccacccgcgg

SEQ ID NO: 569986 - DNA, 25 bp, Rattus norvegicus
gagcatgtacggcaaggcgagcaag

SEQ ID NO: 569987 - DNA, 25 bp, Rattus norvegicus
ggaggcgcgcttcccggaacagccc

SEQ ID NO: 569988 - DNA, 25 bp, Rattus norvegicus
gccgtggggtcacgcgagaccagaa

SEQ ID NO: 569989 - DNA, 25 bp, Rattus norvegicus
ctcatggggtcacgcgagaccagaa

SEQ ID NO: 569990 - DNA, 25 bp, Rattus norvegicus
cacacgagatcaaggggctcatggg

SEQ ID NO: 569991 - DNA, 25 bp, Rattus norvegicus
agttactggggatcaaaatggtgcg

SEQ ID NO: 569992 - DNA, 25 bp, Rattus norvegicus
gctcgtggagttactggggatcaaa

SEQ ID NO: 569993 - DNA, 25 bp, Rattus norvegicus
atttcagggggacacaggagatccg

SEQ ID NO: 569994 - DNA, 25 bp, Rattus norvegicus
gggacacacgagatcaaggggctca

SEQ ID NO: 569995 - DNA, 25 bp, Rattus norvegicus
aagcgtaagcgcctgcgtcgactcc

SEQ ID NO: 569996 - DNA, 25 bp, Rattus norvegicus
cacgtgaacggatccctgggtgagt

SEQ ID NO: 569997 - DNA, 25 bp, Rattus norvegicus
ccggcatgactatgagcgtgtgata

SEQ ID NO: 569998 - DNA, 25 bp, Rattus norvegicus
gcacccgttcccgagcgaaagcgta

SEQ ID NO: 569999 - DNA, 25 bp, Rattus norvegicus
gccgaaggtgaggtcgtgcacacta

SEQ ID NO: 570000 - DNA, 25 bp, Rattus norvegicus
tgagccaagtgtctctccctgcagg

SEQ ID NO: 570001 - DNA, 25 bp, Rattus norvegicus
acgaaagtctctggggtatccagcc

SEQ ID NO: 570002 - DNA, 25 bp, Rattus norvegicus
tggcgcctacaccagctagtgctac

SEQ ID NO: 570003 - DNA, 25 bp, Rattus norvegicus
caggcgccgggacaagggcctatta

SEQ ID NO: 570004 - DNA, 25 bp, Rattus norvegicus
gctgggcgccacctaccggtttcat

SEQ ID NO: 570005 - DNA, 25 bp, Rattus norvegicus
tggagccgcaccacgtgaacggatc

SEQ ID NO: 570006 - DNA, 25 bp, Rattus norvegicus
tggcctcaatgagcacgatggagcc

SEQ ID NO: 570007 - DNA, 25 bp, Rattus norvegicus
gcccggagggcccaatggcctcaat

SEQ ID NO: 570008 - DNA, 25 bp, Rattus norvegicus
ccggtttcatcggtcggcaccgtga

SEQ ID NO: 570009 - DNA, 25 bp, Rattus norvegicus
ccaccgtcaaacaccaggtcgttgg

SEQ ID NO: 570010 - DNA, 25 bp, Rattus norvegicus
gcgacgagatatcccagcctgggtt

SEQ ID NO: 570011 - DNA, 25 bp, Rattus norvegicus
ccaccatgggtagcagcgcactgaa

SEQ ID NO: 570012 - DNA, 25 bp, Rattus norvegicus
cagcgcactgaagggcacaaacacc

SEQ ID NO: 570013 - DNA, 25 bp, Rattus norvegicus
ccgcctgggtcaacgagccataata

SEQ ID NO: 570014 - DNA, 25 bp, Rattus norvegicus
gccataatagtttgcctcctgtgtg

SEQ ID NO: 570015 - DNA, 25 bp, Rattus norvegicus
ggaggtgtcccactcactgagactc

SEQ ID NO: 570016 - DNA, 25 bp, Rattus norvegicus
cgaagatcacgtccgggctgtccac

SEQ ID NO: 570017 - DNA, 25 bp, Rattus norvegicus
gctgtccaccaggatctcggcggca

SEQ ID NO: 570018 - DNA, 25 bp, Rattus norvegicus
ggagccaagcctacggcccaggaca

SEQ ID NO: 570019 - DNA, 25 bp, Rattus norvegicus
ggacaggctcgcacttaccgactaa

SEQ ID NO: 570020 - DNA, 25 bp, Rattus norvegicus
ccgactaagagttgggtcagactgc

SEQ ID NO: 570021 - DNA, 25 bp, Rattus norvegicus
gttggccagaacagccgcagtgagc

SEQ ID NO: 570022 - DNA, 25 bp, Rattus norvegicus
ctccgccaggttcagcgacgagata

SEQ ID NO: 570023 - DNA, 25 bp, Rattus norvegicus
cccgacgcgagcacgttgggtagcc

SEQ ID NO: 570024 - DNA, 25 bp, Rattus norvegicus
tctctgcccaaaggcgccgaagagc

SEQ ID NO: 570025 - DNA, 25 bp, Rattus norvegicus
cttcagaacaagtccgaggcggccg

SEQ ID NO: 570026 - DNA, 25 bp, Rattus norvegicus
aaatggcggcgtcttctccaccgcg

SEQ ID NO: 570027 - DNA, 25 bp, Rattus norvegicus
ctccctacaaaatggcggcgtcttc

SEQ ID NO: 570028 - DNA, 25 bp, Rattus norvegicus
ccggagcttgagtcctccctacaaa

SEQ ID NO: 570029 - DNA, 25 bp, Rattus norvegicus
ttcgacggacacgagctgggaaaac

SEQ ID NO: 570030 - DNA, 25 bp, Rattus norvegicus
agacggaggcctcttcgacggacac

SEQ ID NO: 570031 - DNA, 25 bp, Rattus norvegicus
ggcggaagctccctggagcgcctca

SEQ ID NO: 570032 - DNA, 25 bp, Rattus norvegicus
cggttaaaaggcgtctctgtggctg

SEQ ID NO: 570033 - DNA, 25 bp, Rattus norvegicus
ttcctattggtagagcgggcaagcc

SEQ ID NO: 570034 - DNA, 25 bp, Rattus norvegicus
ccctggaacggtctatctgcattcg

SEQ ID NO: 570035 - DNA, 25 bp, Rattus norvegicus
tggcagtctcctcttttggcgggct

SEQ ID NO: 570036 - DNA, 25 bp, Rattus norvegicus
cacgcccgtcgaccttgtgggcgga

SEQ ID NO: 570037 - DNA, 25 bp, Rattus norvegicus
ttcatgagaggttagccacgccttc

SEQ ID NO: 570038 - DNA, 25 bp, Rattus norvegicus
cccatcgcgtgtttagagattttcc

SEQ ID NO: 570039 - DNA, 25 bp, Rattus norvegicus
agccgacgtgctgcattattcatga

SEQ ID NO: 570040 - DNA, 25 bp, Rattus norvegicus
gcgagcgtgcctcctttgaaagaga

SEQ ID NO: 570041 - DNA, 25 bp, Rattus norvegicus
tcgaggcgagagacccagatttttg

SEQ ID NO: 570042 - DNA, 25 bp, Rattus norvegicus
cgcgaggccagtctaagtcttaata

SEQ ID NO: 570043 - DNA, 25 bp, Rattus norvegicus
ctggccacgcctccgggataagaaa

SEQ ID NO: 570044 - DNA, 25 bp, Rattus norvegicus
aaacaactcttgtgcgcgtgcgcgg

SEQ ID NO: 570045 - DNA, 25 bp, Rattus norvegicus
tccgcctacctgatgactcctaatg

SEQ ID NO: 570046 - DNA, 25 bp, Rattus norvegicus
ccgtggtctccaacgtgtttgtaga

SEQ ID NO: 570047 - DNA, 25 bp, Rattus norvegicus
cagcccgcgacgacaaacatgtttg

SEQ ID NO: 570048 - DNA, 25 bp, Rattus norvegicus
gcccttggaaccttgcgtcactgag

SEQ ID NO: 570049 - DNA, 25 bp, Rattus norvegicus
ttcatgaggtaggtttggccacgcc

SEQ ID NO: 570050 - DNA, 25 bp, Rattus norvegicus
gaacgttttgcctgcgaccctcaca

SEQ ID NO: 570051 - DNA, 25 bp, Rattus norvegicus
tccgtgatgacgtacgcgcgctggc

SEQ ID NO: 570052 - DNA, 25 bp, Rattus norvegicus
ggagggcccatcctacctctggtac

SEQ ID NO: 570053 - DNA, 25 bp, Rattus norvegicus
gcgcaggctcctaggcgcttggaca

SEQ ID NO: 570054 - DNA, 25 bp, Rattus norvegicus
cacatggacgctccgtgatgacgta

SEQ ID NO: 570055 - DNA, 25 bp, Rattus norvegicus
ggaagcgccatcctggccgccagat

SEQ ID NO: 570056 - DNA, 25 bp, Rattus norvegicus
atcctggccgccagatgtgcaggtg

SEQ ID NO: 570057 - DNA, 25 bp, Rattus norvegicus
cagttttcccggatgctcagcggca

SEQ ID NO: 570058 - DNA, 25 bp, Rattus norvegicus
cagcgcgggccaatctagatgagaa

SEQ ID NO: 570059 - DNA, 25 bp, Rattus norvegicus
tctagatgagaaccctagttgtgtg

SEQ ID NO: 570060 - DNA, 25 bp, Rattus norvegicus
aaccctagttgtgtgaccgtccgca

SEQ ID NO: 570061 - DNA, 25 bp, Rattus norvegicus
ggagtgcgcgcgtgcctcattttcc

SEQ ID NO: 570062 - DNA, 25 bp, Rattus norvegicus
cgggaactccatgtatgtttgaacc

SEQ ID NO: 570063 - DNA, 25 bp, Rattus norvegicus
tggtaccgacacagtctcagttttc

SEQ ID NO: 570064 - DNA, 25 bp, Rattus norvegicus
cgcttggacagaaggaacacatgga

SEQ ID NO: 570065 - DNA, 25 bp, Rattus norvegicus
cgtcgacacgcagcgtgctcagtgc

SEQ ID NO: 570066 - DNA, 25 bp, Rattus norvegicus
tgaaggtaaagctccgcccggaagc

SEQ ID NO: 570067 - DNA, 25 bp, Rattus norvegicus
tgtcacgtgctgaaggtaaagctcc

SEQ ID NO: 570068 - DNA, 25 bp, Rattus norvegicus
gcccggaagcggctccagacagttt

SEQ ID NO: 570069 - DNA, 25 bp, Rattus norvegicus
gcggctccagacagtttggcttctc

SEQ ID NO: 570070 - DNA, 25 bp, Rattus norvegicus
acagtttggcttctcctgccagggc

SEQ ID NO: 570071 - DNA, 25 bp, Rattus norvegicus
ctgccagggcccaacatggcgcccg

SEQ ID NO: 570072 - DNA, 25 bp, Rattus norvegicus
tgtgacgtcgacacgcagcgtgctc

SEQ ID NO: 570073 - DNA, 25 bp, Rattus norvegicus
ctgcgggcggaaagaccaagagctc

SEQ ID NO: 570074 - DNA, 25 bp, Rattus norvegicus
gtcctctttctcttcaacgaggcgg

SEQ ID NO: 570075 - DNA, 25 bp, Rattus norvegicus
tttctcttcaacgaggcggccgagc

SEQ ID NO: 570076 - DNA, 25 bp, Rattus norvegicus
cgcgcatgctcggtggaactcgaca

SEQ ID NO: 570077 - DNA, 25 bp, Rattus norvegicus
cggtggaactcgacagccgggacct

SEQ ID NO: 570078 - DNA, 25 bp, Rattus norvegicus
gcgcggattgtgacgtcgacacgca

SEQ ID NO: 570079 - DNA, 25 bp, Rattus norvegicus
ttggtcgtggacctcccggccagca

SEQ ID NO: 570080 - DNA, 25 bp, Rattus norvegicus
ttccgccgtctagaccagtgagccg

SEQ ID NO: 570081 - DNA, 25 bp, Rattus norvegicus
ggccttccgccgtctagaccagtga

SEQ ID NO: 570082 - DNA, 25 bp, Rattus norvegicus
gtgcacaggccttccgccgtctaga

SEQ ID NO: 570083 - DNA, 25 bp, Rattus norvegicus
aatgaacgtgcacaggccttccgcc

SEQ ID NO: 570084 - DNA, 25 bp, Rattus norvegicus
tccagcagctgcagaatgaacgtgc

SEQ ID NO: 570085 - DNA, 25 bp, Rattus norvegicus
cgctggtgcagaggatccagcagct

SEQ ID NO: 570086 - DNA, 25 bp, Rattus norvegicus
atcgctacgctggtgcagaggatcc

SEQ ID NO: 570087 - DNA, 25 bp, Rattus norvegicus
ccgtagagagatgccccgatcgcta

SEQ ID NO: 570088 - DNA, 25 bp, Rattus norvegicus
atggccccacacctccgtagagaga

SEQ ID NO: 570089 - DNA, 25 bp, Rattus norvegicus
gcgatgggctctggcttcatggccc

SEQ ID NO: 570090 - DNA, 25 bp, Rattus norvegicus
cacagaggtgctagctgctgcggat

SEQ ID NO: 570091 - DNA, 25 bp, Rattus norvegicus
agcggcggccgttcccaagcgacgc

SEQ ID NO: 570092 - DNA, 25 bp, Rattus norvegicus
accgccgccacagaggtgctagctg

SEQ ID NO: 570093 - DNA, 25 bp, Rattus norvegicus
tgagcatggcctcgtgcgtcgctgc

SEQ ID NO: 570094 - DNA, 25 bp, Rattus norvegicus
taggaggaccggtccctggctcacc

SEQ ID NO: 570095 - DNA, 25 bp, Rattus norvegicus
ttatgtaggcggcagtaggaggacc

SEQ ID NO: 570096 - DNA, 25 bp, Rattus norvegicus
taggtgagcgcgaagccttgagcat

SEQ ID NO: 570097 - DNA, 25 bp, Rattus norvegicus
cgaagccttgagcatggcctcgtgc

SEQ ID NO: 570098 - DNA, 25 bp, Rattus norvegicus
gcgtcgctgcggaaggtgagcagca

SEQ ID NO: 570099 - DNA, 25 bp, Rattus norvegicus
tgagcagcagtgcagcagtgcgcag

SEQ ID NO: 570100 - DNA, 25 bp, Rattus norvegicus
atgggcgccgtcgaaggcacggagc

SEQ ID NO: 570101 - DNA, 25 bp, Rattus norvegicus
ccagatgaggcgtcgcgtagctcca

SEQ ID NO: 570102 - DNA, 25 bp, Rattus norvegicus
gtcgcgtagctccagccggtctcga

SEQ ID NO: 570103 - DNA, 25 bp, Rattus norvegicus
cagccggtctcgagagtcagccaac

SEQ ID NO: 570104 - DNA, 25 bp, Rattus norvegicus
cggtctcgagagtcagccaactcga

SEQ ID NO: 570105 - DNA, 25 bp, Rattus norvegicus
cgagagtcagccaactcgaagaggc

SEQ ID NO: 570106 - DNA, 25 bp, Rattus norvegicus
agcgcgaagccttgagcatggcctc

SEQ ID NO: 570107 - DNA, 25 bp, Rattus norvegicus
ggtatcctgtgcacctgtggcagaa

SEQ ID NO: 570108 - DNA, 25 bp, Rattus norvegicus
ttgcgctcactggaagaagaacgga

SEQ ID NO: 570109 - DNA, 25 bp, Rattus norvegicus
aagtagagggtcacgcaatgccgct

SEQ ID NO: 570110 - DNA, 25 bp, Rattus norvegicus
cactggaagaagaacggacgccgac

SEQ ID NO: 570111 - DNA, 25 bp, Rattus norvegicus
gtacactacaaacctcacggggcca

SEQ ID NO: 570112 - DNA, 25 bp, Rattus norvegicus
ctcacggggccaagttcaagatcaa

SEQ ID NO: 570113 - DNA, 25 bp, Rattus norvegicus
ctcccatttcttgcgctcactggaa

SEQ ID NO: 570114 - DNA, 25 bp, Rattus norvegicus
caaggcatctgtgcgcgcttgccct

SEQ ID NO: 570115 - DNA, 25 bp, Rattus norvegicus
gctgcggctgcagcaaggcatctgt

SEQ ID NO: 570116 - DNA, 25 bp, Rattus norvegicus
tgcacctgtggcagaagctgcggct

SEQ ID NO: 570117 - DNA, 25 bp, Rattus norvegicus
cacgcaatgccgctgcacaggtatc

SEQ ID NO: 570118 - DNA, 25 bp, Rattus norvegicus
ttcttccagaagtagagggtcacgc

SEQ ID NO: 570119 - DNA, 25 bp, Rattus norvegicus
cgggcgcgcttcttccagaagtaga

SEQ ID NO: 570120 - DNA, 25 bp, Rattus norvegicus
aatgccgctgcacaggtatcctgtg

SEQ ID NO: 570121 - DNA, 25 bp, Rattus norvegicus
gtcgtacaggcggaagctaaggttc

SEQ ID NO: 570122 - DNA, 25 bp, Rattus norvegicus
tctaaagagagtggagcggcagtgt

SEQ ID NO: 570123 - DNA, 25 bp, Rattus norvegicus
gcccgggcgctctaaagagagtgga

SEQ ID NO: 570124 - DNA, 25 bp, Rattus norvegicus
gcaccgggcccgagctaggctcgcc

SEQ ID NO: 570125 - DNA, 25 bp, Rattus norvegicus
ccgaggaactgcttgagctcgcgcc

SEQ ID NO: 570126 - DNA, 25 bp, Rattus norvegicus
gccagccgaggaactgcttgagctc

SEQ ID NO: 570127 - DNA, 25 bp, Rattus norvegicus
ttgagccagccgaggaactgcttga

SEQ ID NO: 570128 - DNA, 25 bp, Rattus norvegicus
agcagtacgcgtgcttcttgagcca

SEQ ID NO: 570129 - DNA, 25 bp, Rattus norvegicus
gccactggtcgtacaggcggaagct

SEQ ID NO: 570130 - DNA, 25 bp, Rattus norvegicus
acaggcggaagctaaggttcgagca

SEQ ID NO: 570131 - DNA, 25 bp, Rattus norvegicus
ggcctcccaaaccagaccagcttcg

SEQ ID NO: 570132 - DNA, 25 bp, Rattus norvegicus
tgcttcttgagccagccgaggaact

SEQ ID NO: 570133 - DNA, 25 bp, Rattus norvegicus
agctaaggttcgagcagtacgcgtg

SEQ ID NO: 570134 - DNA, 25 bp, Rattus norvegicus
gttcgagcagtacgcgtgcttcttg

SEQ ID NO: 570135 - DNA, 25 bp, Rattus norvegicus
gggtggctccactcgctccagattc

SEQ ID NO: 570136 - DNA, 25 bp, Rattus norvegicus
aacgcggctcacgtgcacgtcgggt

SEQ ID NO: 570137 - DNA, 25 bp, Rattus norvegicus
tggtgagacccagcgcacactcagc

SEQ ID NO: 570138 - DNA, 25 bp, Rattus norvegicus
atccttgagagctggtggtgagacc

SEQ ID NO: 570139 - DNA, 25 bp, Rattus norvegicus
atttggcttggaagaggaaatcctt

SEQ ID NO: 570140 - DNA, 25 bp, Rattus norvegicus
cgaatctggtatttggcttggaaga

SEQ ID NO: 570141 - DNA, 25 bp, Rattus norvegicus
cctccacgcggtagcgaatctggta

SEQ ID NO: 570142 - DNA, 25 bp, Rattus norvegicus
ggcgggacgggcaccttccagtcca

SEQ ID NO: 570143 - DNA, 25 bp, Rattus norvegicus
ggttgctgacgtcatccaccacctg

SEQ ID NO: 570144 - DNA, 25 bp, Rattus norvegicus
gaggtctggttgctgacgtcatcca

SEQ ID NO: 570145 - DNA, 25 bp, Rattus norvegicus
cttcaagcccgcgagacggcaggag

SEQ ID NO: 570146 - DNA, 25 bp, Rattus norvegicus
acggtgccgggcttcaagcccgcga

SEQ ID NO: 570147 - DNA, 25 bp, Rattus norvegicus
tagatcccgaatgggttacaacgaa

SEQ ID NO: 570148 - DNA, 25 bp, Rattus norvegicus
ttttcgacccatagatcccgaatgg

SEQ ID NO: 570149 - DNA, 25 bp, Rattus norvegicus
tttgggtccgcacgcacgtcactgg

SEQ ID NO: 570150 - DNA, 25 bp, Rattus norvegicus
gggaacccagataagaggcctctga

SEQ ID NO: 570151 - DNA, 25 bp, Rattus norvegicus
gcctctgatgtataacggggtattc

SEQ ID NO: 570152 - DNA, 25 bp, Rattus norvegicus
acacagagcaacagaggcgaccaca

SEQ ID NO: 570153 - DNA, 25 bp, Rattus norvegicus
cgcaacgggcggtgactgcaacgcc

SEQ ID NO: 570154 - DNA, 25 bp, Rattus norvegicus
ccggagcaagtctgagcagccgaaa

SEQ ID NO: 570155 - DNA, 25 bp, Rattus norvegicus
gccgaaattgacaaggcgctaatgc

SEQ ID NO: 570156 - DNA, 25 bp, Rattus norvegicus
gatcctgtacccttaactccgaatg

SEQ ID NO: 570157 - DNA, 25 bp, Rattus norvegicus
actccgaatgggtccctagctcgca

SEQ ID NO: 570158 - DNA, 25 bp, Rattus norvegicus
tcgcagccctggtgcctttccagga

SEQ ID NO: 570159 - DNA, 25 bp, Rattus norvegicus
tcgagtagtacctgaaccctgttca

SEQ ID NO: 570160 - DNA, 25 bp, Rattus norvegicus
gagcctggtgggatagcttcgcaaa

SEQ ID NO: 570161 - DNA, 25 bp, Rattus norvegicus
tgctgtgcacacatcgagtagtacc

SEQ ID NO: 570162 - DNA, 25 bp, Rattus norvegicus
tacccacttgggtttgctgtgcaca

SEQ ID NO: 570163 - DNA, 25 bp, Rattus norvegicus
acaaagggcgcttgtctgcggcctt

SEQ ID NO: 570164 - DNA, 25 bp, Rattus norvegicus
gaatgtcggcggatttcctgaaatc

SEQ ID NO: 570165 - DNA, 25 bp, Rattus norvegicus
gcgagtcaactttccctcttaagcc

SEQ ID NO: 570166 - DNA, 25 bp, Rattus norvegicus
cccggtgtcgtcagcaatcagcggc

SEQ ID NO: 570167 - DNA, 25 bp, Rattus norvegicus
agccttgccgggctggactccgctt

SEQ ID NO: 570168 - DNA, 25 bp, Rattus norvegicus
tgtctgcggccttccctgaccgggt

SEQ ID NO: 570169 - DNA, 25 bp, Rattus norvegicus
ctgaccgggtggctgcttcccgaac

SEQ ID NO: 570170 - DNA, 25 bp, Rattus norvegicus
ccgaaggaatgtcggcggatttcct

SEQ ID NO: 570171 - DNA, 25 bp, Rattus norvegicus
tcggcggatttcctgaaatccgacc

SEQ ID NO: 570172 - DNA, 25 bp, Rattus norvegicus
gaacgccgggagtccgctgattcac

SEQ ID NO: 570173 - DNA, 25 bp, Rattus norvegicus
agtccgctgattcacgcggacagca

SEQ ID NO: 570174 - DNA, 25 bp, Rattus norvegicus
ggcggcgagtcaactttccctctta

SEQ ID NO: 570175 - DNA, 25 bp, Rattus norvegicus
tgtgggggagcaccgcatccctcct

SEQ ID NO: 570176 - DNA, 25 bp, Rattus norvegicus
tgtcgtcagcaatcagcggcgccac

SEQ ID NO: 570177 - DNA, 25 bp, Rattus norvegicus
ccgggccgctgagatgaaagcgagc

SEQ ID NO: 570178 - DNA, 25 bp, Rattus norvegicus
ctcctcgtctgctggggcggagcaa

SEQ ID NO: 570179 - DNA, 25 bp, Rattus norvegicus
tgcgagcggcctcctcgtctgctgg

SEQ ID NO: 570180 - DNA, 25 bp, Rattus norvegicus
tagtgacccgacgaccctgcgagcg

SEQ ID NO: 570181 - DNA, 25 bp, Rattus norvegicus
cggccggaacctgcggctcctagtg

SEQ ID NO: 570182 - DNA, 25 bp, Rattus norvegicus
ggcacctgtgccaagcaggccactg

SEQ ID NO: 570183 - DNA, 25 bp, Rattus norvegicus
ccgcgcctgattaagccacgtgggg

SEQ ID NO: 570184 - DNA, 25 bp, Rattus norvegicus
acagccgcgcctgattaagccacgt

SEQ ID NO: 570185 - DNA, 25 bp, Rattus norvegicus
agatgttcaggtccgccaggcacag

SEQ ID NO: 570186 - DNA, 25 bp, Rattus norvegicus
cgccgggatccagatgttcaggtcc

SEQ ID NO: 570187 - DNA, 25 bp, Rattus norvegicus
acctgtgccaagcaggccactgggg

SEQ ID NO: 570188 - DNA, 25 bp, Rattus norvegicus
gatccagatgttcaggtccgccagg

SEQ ID NO: 570189 - DNA, 25 bp, Rattus norvegicus
tgcgctggtggaagaggcccagccc

SEQ ID NO: 570190 - DNA, 25 bp, Rattus norvegicus
ggccgcgccgggatccagatgttca

SEQ ID NO: 570191 - DNA, 25 bp, Rattus norvegicus
ctgacacccgcacccggatcccgcg

SEQ ID NO: 570192 - DNA, 25 bp, Rattus norvegicus
agaggtgccagcagcggtgtcggca

SEQ ID NO: 570193 - DNA, 25 bp, Rattus norvegicus
cagctcggggacactcagaggtgcc

SEQ ID NO: 570194 - DNA, 25 bp, Rattus norvegicus
ccgcagctcggggacactcagaggt

SEQ ID NO: 570195 - DNA, 25 bp, Rattus norvegicus
cccttctctccgcagctcggggaca

SEQ ID NO: 570196 - DNA, 25 bp, Rattus norvegicus
ctgcggtagcgttgccgctgttgtt

SEQ ID NO: 570197 - DNA, 25 bp, Rattus norvegicus
ccatggctgcggtagcgttgccgct

SEQ ID NO: 570198 - DNA, 25 bp, Rattus norvegicus
ccggatcccgcgctgcgcacgctca

SEQ ID NO: 570199 - DNA, 25 bp, Rattus norvegicus
cgcagcctgacacccgcacccggat

SEQ ID NO: 570200 - DNA, 25 bp, Rattus norvegicus
gtgacgtcaacacccggtcccgcag

SEQ ID NO: 570201 - DNA, 25 bp, Rattus norvegicus
tcgctcagtgacgtcaacacccggt

SEQ ID NO: 570202 - DNA, 25 bp, Rattus norvegicus
gctgcctcgctcagtgacgtcaaca

SEQ ID NO: 570203 - DNA, 25 bp, Rattus norvegicus
aggctgcctcgctcagtgacgtcaa

SEQ ID NO: 570204 - DNA, 25 bp, Rattus norvegicus
tgcgcacgctcagccatggctgcgg

SEQ ID NO: 570205 - DNA, 25 bp, Rattus norvegicus
gctccaacacctcggtccgcgctgg

SEQ ID NO: 570206 - DNA, 25 bp, Rattus norvegicus
gctcaggccacttgtgtgacccagc

SEQ ID NO: 570207 - DNA, 25 bp, Rattus norvegicus
ccacgcgccggctgaaggccagccc

SEQ ID NO: 570208 - DNA, 25 bp, Rattus norvegicus
ggtttcttggtgaccgccgccagcc

SEQ ID NO: 570209 - DNA, 25 bp, Rattus norvegicus
tgtgtgacccagcttgccgtccctg

SEQ ID NO: 570210 - DNA, 25 bp, Rattus norvegicus
ctgctcaacaaacgctacgccgatt

SEQ ID NO: 570211 - DNA, 25 bp, Rattus norvegicus
aaacgctacgccgattggatgccgg

SEQ ID NO: 570212 - DNA, 25 bp, Rattus norvegicus
tacgccgattggatgccggggtcca

SEQ ID NO: 570213 - DNA, 25 bp, Rattus norvegicus
ggggtccagccgagccaatcagagt

SEQ ID NO: 570214 - DNA, 25 bp, Rattus norvegicus
caatcagagtggcacatgctggcgg

SEQ ID NO: 570215 - DNA, 25 bp, Rattus norvegicus
cccggtacctctcggtgggcgtctg

SEQ ID NO: 570216 - DNA, 25 bp, Rattus norvegicus
gctcgctcaggccacttgtgtgacc

SEQ ID NO: 570217 - DNA, 25 bp, Rattus norvegicus
atctcgccctctggggcgccgtctc

SEQ ID NO: 570218 - DNA, 25 bp, Rattus norvegicus
ccaggttcatggcaccgccgcccac

SEQ ID NO: 570219 - DNA, 25 bp, Rattus norvegicus
acgttcgagtccctagctgctaagg

SEQ ID NO: 570220 - DNA, 25 bp, Rattus norvegicus
gctctcagcaggttccgcccgctgc

SEQ ID NO: 570221 - DNA, 25 bp, Rattus norvegicus
catgcacctcttggcccgggcaagg

SEQ ID NO: 570222 - DNA, 25 bp, Rattus norvegicus
tctttgttggcatgcacctcttggc

SEQ ID NO: 570223 - DNA, 25 bp, Rattus norvegicus
cccgagcaggtgagtcctgtgtctt

SEQ ID NO: 570224 - DNA, 25 bp, Rattus norvegicus
tccctagctgctaaggtcctgagct

SEQ ID NO: 570225 - DNA, 25 bp, Rattus norvegicus
tgctaaggtcctgagctatggcgca

SEQ ID NO: 570226 - DNA, 25 bp, Rattus norvegicus
gtcctgagctatggcgcaggcctga

SEQ ID NO: 570227 - DNA, 25 bp, Rattus norvegicus
ggcgtggacgttcgagtccctagct

SEQ ID NO: 570228 - DNA, 25 bp, Rattus norvegicus
agggctgcctaaggccgggcttcct

SEQ ID NO: 570229 - DNA, 25 bp, Rattus norvegicus
cctaaggccgggcttcctaagagct

SEQ ID NO: 570230 - DNA, 25 bp, Rattus norvegicus
gtgacgtgggaagctgcacaagaac

SEQ ID NO: 570231 - DNA, 25 bp, Rattus norvegicus
gcttcctaagagctgcgagcccgga

SEQ ID NO: 570232 - DNA, 25 bp, Rattus norvegicus
agtcctgtgtctttgttggcatgca

SEQ ID NO: 570233 - DNA, 25 bp, Rattus norvegicus
gtcgcctctacatctcgggtggcta

SEQ ID NO: 570234 - DNA, 25 bp, Rattus norvegicus
tgtgcagacactcgacgtcatgctg

SEQ ID NO: 570235 - DNA, 25 bp, Rattus norvegicus
tcgccagtacctgctggaggccttc

SEQ ID NO: 570236 - DNA, 25 bp, Rattus norvegicus
tggaggccttcagctaccacgtgct

SEQ ID NO: 570237 - DNA, 25 bp, Rattus norvegicus
atgcagtctccacgcacagctgtgc

SEQ ID NO: 570238 - DNA, 25 bp, Rattus norvegicus
ggaggcacaccgtataccgacagtg

SEQ ID NO: 570239 - DNA, 25 bp, Rattus norvegicus
tgtcagcagcaaggtgttccagttg

SEQ ID NO: 570240 - DNA, 25 bp, Rattus norvegicus
tccgcgagctcacggagatggaact

SEQ ID NO: 570241 - DNA, 25 bp, Rattus norvegicus
tggctgtgctggataacttcgtgta

SEQ ID NO: 570242 - DNA, 25 bp, Rattus norvegicus
agccgcgtacagttccagctcactg

SEQ ID NO: 570243 - DNA, 25 bp, Rattus norvegicus
tctcagcggaggacaagaaggcact

SEQ ID NO: 570244 - DNA, 25 bp, Rattus norvegicus
gctatgatccagcagccgaccgatg

SEQ ID NO: 570245 - DNA, 25 bp, Rattus norvegicus
gctggccgcatctatgccctaggtg

SEQ ID NO: 570246 - DNA, 25 bp, Rattus norvegicus
tggacgcctgctaccgctatgatcc

SEQ ID NO: 570247 - DNA, 25 bp, Rattus norvegicus
tccgcggaaatttagcgagaagatc

SEQ ID NO: 570248 - DNA, 25 bp, Rattus norvegicus
cgcctcatgcctctccggtgcgcct

SEQ ID NO: 570249 - DNA, 25 bp, Rattus norvegicus
ggcagcgcaggcgtattcacctaca

SEQ ID NO: 570250 - DNA, 25 bp, Rattus norvegicus
ctgcgctacgctctgggccatgcat

SEQ ID NO: 570251 - DNA, 25 bp, Rattus norvegicus
tgggccatgcatgcgcctgcgcgtt

SEQ ID NO: 570252 - DNA, 25 bp, Rattus norvegicus
cgagaagatggcgacttcgaacaat

SEQ ID NO: 570253 - DNA, 25 bp, Rattus norvegicus
aggacctgagcctgacgcgagccgc

SEQ ID NO: 570254 - DNA, 25 bp, Rattus norvegicus
tttagcgagaagatcgcactgcaca

SEQ ID NO: 570255 - DNA, 25 bp, Rattus norvegicus
tcgcactgcacaaccagaagcaggc

SEQ ID NO: 570256 - DNA, 25 bp, Rattus norvegicus
ccttcgaggaggtcatgaaggacct

SEQ ID NO: 570257 - DNA, 25 bp, Rattus norvegicus
tcccgggctcccaacgcactgccca

SEQ ID NO: 570258 - DNA, 25 bp, Rattus norvegicus
cactgcccaggcagcgcaggcgtat

SEQ ID NO: 570259 - DNA, 25 bp, Rattus norvegicus
tcatgaaggacctgagcctgacgcg

SEQ ID NO: 570260 - DNA, 25 bp, Rattus norvegicus
ggcgacttcgaacaatccgcggaaa

SEQ ID NO: 570261 - DNA, 25 bp, Rattus norvegicus
aagacactgcttggctctggtttcc

SEQ ID NO: 570262 - DNA, 25 bp, Rattus norvegicus
ctccttccagagtgggctggtgaga

SEQ ID NO: 570263 - DNA, 25 bp, Rattus norvegicus
gcgctcagggctgtttcccatgcca

SEQ ID NO: 570264 - DNA, 25 bp, Rattus norvegicus
ttcccatgccacctttcgggacgag

SEQ ID NO: 570265 - DNA, 25 bp, Rattus norvegicus
cctttcgggacgagcagtagttgcg

SEQ ID NO: 570266 - DNA, 25 bp, Rattus norvegicus
attgggcatcctccgcgactacgtt

SEQ ID NO: 570267 - DNA, 25 bp, Rattus norvegicus
gactacgttccagcggcgctcctag

SEQ ID NO: 570268 - DNA, 25 bp, Rattus norvegicus
tcgggctggagcctccttccagagt

SEQ ID NO: 570269 - DNA, 25 bp, Rattus norvegicus
gttccagcggcgctcctagttcacg

SEQ ID NO: 570270 - DNA, 25 bp, Rattus norvegicus
ccgtggttctgctttcacacagaga

SEQ ID NO: 570271 - DNA, 25 bp, Rattus norvegicus
ggctgtttcccatgccacctttcgg

SEQ ID NO: 570272 - DNA, 25 bp, Rattus norvegicus
ttccaatcttgagtacgccgcagcc

SEQ ID NO: 570273 - DNA, 25 bp, Rattus norvegicus
tctggtttccttccaatcttgagta

SEQ ID NO: 570274 - DNA, 25 bp, Rattus norvegicus
ttctgctttcacacagagacccagc

SEQ ID NO: 570275 - DNA, 25 bp, Rattus norvegicus
ggtccagcgtcaccagcagcaacga

SEQ ID NO: 570276 - DNA, 25 bp, Rattus norvegicus
gcgcagcaccacgttgtcactatta

SEQ ID NO: 570277 - DNA, 25 bp, Rattus norvegicus
tcccagcgctaaggggtttcattta

SEQ ID NO: 570278 - DNA, 25 bp, Rattus norvegicus
ccctggcagaagttggctagaaagc

SEQ ID NO: 570279 - DNA, 25 bp, Rattus norvegicus
aagctcacgtgcaaccgtcgggtgc

SEQ ID NO: 570280 - DNA, 25 bp, Rattus norvegicus
gcgcagcacagcgtggttaagtgca

SEQ ID NO: 570281 - DNA, 25 bp, Rattus norvegicus
accatgtcctcgtagtggcgcagca

SEQ ID NO: 570282 - DNA, 25 bp, Rattus norvegicus
caaacggtccctgcttttcgcgtgg

SEQ ID NO: 570283 - DNA, 25 bp, Rattus norvegicus
gcgccaacgcaatggaacttaattt

SEQ ID NO: 570284 - DNA, 25 bp, Rattus norvegicus
ctacaggcgaactcgtgagcacggc

SEQ ID NO: 570285 - DNA, 25 bp, Rattus norvegicus
ttggagcttcagaggctacaggcga

SEQ ID NO: 570286 - DNA, 25 bp, Rattus norvegicus
ctctaagacccgactggtggacctg

SEQ ID NO: 570287 - DNA, 25 bp, Rattus norvegicus
cttggatgagtttgtctctaagacc

SEQ ID NO: 570288 - DNA, 25 bp, Rattus norvegicus
ccctcagtgtttcaggtagcgcaca

SEQ ID NO: 570289 - DNA, 25 bp, Rattus norvegicus
cgcacaatgtttccggcaaccccca

SEQ ID NO: 570290 - DNA, 25 bp, Rattus norvegicus
ggctgcggaataggcgccacatgac

SEQ ID NO: 570291 - DNA, 25 bp, Rattus norvegicus
cacatgacaggaggcacaggtcgga

SEQ ID NO: 570292 - DNA, 25 bp, Rattus norvegicus
taggcgccacatgacaggaggcaca

SEQ ID NO: 570293 - DNA, 25 bp, Rattus norvegicus
gaataggcgccacatgacaggaggc

SEQ ID NO: 570294 - DNA, 25 bp, Rattus norvegicus
cggaataggcgccacatgacaggag

SEQ ID NO: 570295 - DNA, 25 bp, Rattus norvegicus
catggtttcagagggcgccccactc

SEQ ID NO: 570296 - DNA, 25 bp, Rattus norvegicus
tccacgtggcatggtttcagagggc

SEQ ID NO: 570297 - DNA, 25 bp, Rattus norvegicus
tcctccacgtggcatggtttcagag

SEQ ID NO: 570298 - DNA, 25 bp, Rattus norvegicus
gttcctccacgtggcatggtttcag

SEQ ID NO: 570299 - DNA, 25 bp, Rattus norvegicus
cccagttcctccacgtggcatggtt

SEQ ID NO: 570300 - DNA, 25 bp, Rattus norvegicus
acaggtcggagtgtggggacgctcc

SEQ ID NO: 570301 - DNA, 25 bp, Rattus norvegicus
cagttcctccacgtggcatggtttc

SEQ ID NO: 570302 - DNA, 25 bp, Rattus norvegicus
cgccacatgacaggaggcacaggtc

SEQ ID NO: 570303 - DNA, 25 bp, Rattus norvegicus
gctgctatttgcacccgtccgagtc

SEQ ID NO: 570304 - DNA, 25 bp, Rattus norvegicus
agccatgctaccctctcgtccgcgg

SEQ ID NO: 570305 - DNA, 25 bp, Rattus norvegicus
gccctcgcgtcacgcgccgcagcca

SEQ ID NO: 570306 - DNA, 25 bp, Rattus norvegicus
ggtcgtcgctgcagcagccatgcta

SEQ ID NO: 570307 - DNA, 25 bp, Rattus norvegicus
ctcgagcccggtggtcgtcgctgca

SEQ ID NO: 570308 - DNA, 25 bp, Rattus norvegicus
ggtctccgctgctatttgcacccgt

SEQ ID NO: 570309 - DNA, 25 bp, Rattus norvegicus
tctctgcataactcggcatgggctc

SEQ ID NO: 570310 - DNA, 25 bp, Rattus norvegicus
gttgcaacatctctgcataactcgg

SEQ ID NO: 570311 - DNA, 25 bp, Rattus norvegicus
ggcccagcttcgttgcaacatctct

SEQ ID NO: 570312 - DNA, 25 bp, Rattus norvegicus
ggctgctgagcgcaacgctgtccac

SEQ ID NO: 570313 - DNA, 25 bp, Rattus norvegicus
tgcagccagatgagcgtgctccgcc

SEQ ID NO: 570314 - DNA, 25 bp, Rattus norvegicus
cagatgagcgtgctccgccaggccg

SEQ ID NO: 570315 - DNA, 25 bp, Rattus norvegicus
ccgaggcccagcttcgttgcaacat

SEQ ID NO: 570316 - DNA, 25 bp, Rattus norvegicus
ataactcggcatgggctctggcgcc

SEQ ID NO: 570317 - DNA, 25 bp, Rattus norvegicus
agaaaccatgcaaagcctcccgaga

SEQ ID NO: 570318 - DNA, 25 bp, Rattus norvegicus
gccggaagtgctcaccactaggttc

SEQ ID NO: 570319 - DNA, 25 bp, Rattus norvegicus
atgtaccattcacgcgccggaagtg

SEQ ID NO: 570320 - DNA, 25 bp, Rattus norvegicus
ccgggtggacgtgatgtaccattca

SEQ ID NO: 570321 - DNA, 25 bp, Rattus norvegicus
tcgttcacaactttcccaggcggga

SEQ ID NO: 570322 - DNA, 25 bp, Rattus norvegicus
cagtggctctccgtgacgtcacatt

SEQ ID NO: 570323 - DNA, 25 bp, Rattus norvegicus
tctctacactagtctgaagcatggc

SEQ ID NO: 570324 - DNA, 25 bp, Rattus norvegicus
gaaacgtagttctatgggaccaata

SEQ ID NO: 570325 - DNA, 25 bp, Rattus norvegicus
tctaaccggtcttcttcctgggaga

SEQ ID NO: 570326 - DNA, 25 bp, Rattus norvegicus
gaacagctcgtctacctctccagag

SEQ ID NO: 570327 - DNA, 25 bp, Rattus norvegicus
agcgttcttcacgtcgaacagctcg

SEQ ID NO: 570328 - DNA, 25 bp, Rattus norvegicus
gcgcctcgttaatgcactgctggta

SEQ ID NO: 570329 - DNA, 25 bp, Rattus norvegicus
gctgccgatgtagaaagcgttcttc

SEQ ID NO: 570330 - DNA, 25 bp, Rattus norvegicus
tcatctgccagggttcgttcacaac

SEQ ID NO: 570331 - DNA, 25 bp, Rattus norvegicus
cgcaactttctaagccgccgagctt

SEQ ID NO: 570332 - DNA, 25 bp, Rattus norvegicus
tcactgagtagtcacgcgcctcgga

SEQ ID NO: 570333 - DNA, 25 bp, Rattus norvegicus
gtcggaccactcctgccgggacttg

SEQ ID NO: 570334 - DNA, 25 bp, Rattus norvegicus
cctgctaggagtcccgcaccgaatt

SEQ ID NO: 570335 - DNA, 25 bp, Rattus norvegicus
gacattattgggactgacgggattg

SEQ ID NO: 570336 - DNA, 25 bp, Rattus norvegicus
ccagggcagctcgtgaggccaacta

SEQ ID NO: 570337 - DNA, 25 bp, Rattus norvegicus
tgaggccaactacgggagccactga

SEQ ID NO: 570338 - DNA, 25 bp, Rattus norvegicus
tgccacgatcgggaaaagttactca

SEQ ID NO: 570339 - DNA, 25 bp, Rattus norvegicus
ctaagccgccgagctttgcgatgcg

SEQ ID NO: 570340 - DNA, 25 bp, Rattus norvegicus
cgcctcgcagtccacaactttagaa

SEQ ID NO: 570341 - DNA, 25 bp, Rattus norvegicus
gaaaccatctgtgtctcctgcggcc

SEQ ID NO: 570342 - DNA, 25 bp, Rattus norvegicus
ctccaagcagtcacggggtccgaaa

SEQ ID NO: 570343 - DNA, 25 bp, Rattus norvegicus
cggaggtccagtcggggacattatt

SEQ ID NO: 570344 - DNA, 25 bp, Rattus norvegicus
ctccctgattgtgcctcggaagctg

SEQ ID NO: 570345 - DNA, 25 bp, Rattus norvegicus
caggcgcgttgctgaattctcaggg

SEQ ID NO: 570346 - DNA, 25 bp, Rattus norvegicus
ccaaagtaaagtcaagtctccggtg

SEQ ID NO: 570347 - DNA, 25 bp, Rattus norvegicus
acgtactctgtgtctccctttgctt

SEQ ID NO: 570348 - DNA, 25 bp, Rattus norvegicus
acgcctctgcgcttgcgcgtgtaca

SEQ ID NO: 570349 - DNA, 25 bp, Rattus norvegicus
tgcaagggtttcaggcccacacgta

SEQ ID NO: 570350 - DNA, 25 bp, Rattus norvegicus
ctatctcttttaaggggaagcgaca

SEQ ID NO: 570351 - DNA, 25 bp, Rattus norvegicus
tctcagggcagattatacctaggtg

SEQ ID NO: 570352 - DNA, 25 bp, Rattus norvegicus
cgcaagcgtcgaaagtagccatgtt

SEQ ID NO: 570353 - DNA, 25 bp, Rattus norvegicus
gcctaggtcctcatacgcaagcgtc

SEQ ID NO: 570354 - DNA, 25 bp, Rattus norvegicus
atgcaaatgagccaacggtttccgc

SEQ ID NO: 570355 - DNA, 25 bp, Rattus norvegicus
ctcgcctcagggatactcagagtcc

SEQ ID NO: 570356 - DNA, 25 bp, Rattus norvegicus
cgggctcaagcgtaatgaatggacc

SEQ ID NO: 570357 - DNA, 25 bp, Rattus norvegicus
cccgtatatgggactgacagccacg

SEQ ID NO: 570358 - DNA, 25 bp, Rattus norvegicus
agccatgttggctctttcacgcagg

SEQ ID NO: 570359 - DNA, 25 bp, Rattus norvegicus
aatcctcgcttctgtctccttgtgc

SEQ ID NO: 570360 - DNA, 25 bp, Rattus norvegicus
tcccttcagttattggccaaaagcg

SEQ ID NO: 570361 - DNA, 25 bp, Rattus norvegicus
caattcttgccgtctccagcgctga

SEQ ID NO: 570362 - DNA, 25 bp, Rattus norvegicus
cggatgtccgtctgcatcatgctta

SEQ ID NO: 570363 - DNA, 25 bp, Rattus norvegicus
tagcgattggtcaaaacggatgtcc

SEQ ID NO: 570364 - DNA, 25 bp, Rattus norvegicus
ccttgtggaacgctcggaagaacca

SEQ ID NO: 570365 - DNA, 25 bp, Rattus norvegicus
ccgcgggttccaattcctgtatgcc

SEQ ID NO: 570366 - DNA, 25 bp, Rattus norvegicus
agcgttgcttgttttctgcagaatc

SEQ ID NO: 570367 - DNA, 25 bp, Rattus norvegicus
agctctgtccattttccgcgggttc

SEQ ID NO: 570368 - DNA, 25 bp, Rattus norvegicus
tcccaggacctgtacatcttttgtg

SEQ ID NO: 570369 - DNA, 25 bp, Rattus norvegicus
cagtcaatcatcgtcgcccttcgga

SEQ ID NO: 570370 - DNA, 25 bp, Rattus norvegicus
cccgcgcgccagctaatttggagtt

SEQ ID NO: 570371 - DNA, 25 bp, Rattus norvegicus
ttccgaccttgctcttcagccattg

SEQ ID NO: 570372 - DNA, 25 bp, Rattus norvegicus
ccattggccaagagcgcttgtctcc

SEQ ID NO: 570373 - DNA, 25 bp, Rattus norvegicus
tgtggacattaaaaaagcgagcggc

SEQ ID NO: 570374 - DNA, 25 bp, Rattus norvegicus
ctgtactagggctttccgcttaaag

SEQ ID NO: 570375 - DNA, 25 bp, Rattus norvegicus
ggacagagccaagcgcccgttagct

SEQ ID NO: 570376 - DNA, 25 bp, Rattus norvegicus
taacgccgagttccttttcactgtc

SEQ ID NO: 570377 - DNA, 25 bp, Rattus norvegicus
cccaattcaggtggctaacagaacc

SEQ ID NO: 570378 - DNA, 25 bp, Rattus norvegicus
agcggggtatgccttctggcaataa

SEQ ID NO: 570379 - DNA, 25 bp, Rattus norvegicus
taccaatgtggtcctttcctaggca

SEQ ID NO: 570380 - DNA, 25 bp, Rattus norvegicus
tttcctaggcacatcagtctcccgg

SEQ ID NO: 570381 - DNA, 25 bp, Rattus norvegicus
cccggctccaaacttatggaatggc

SEQ ID NO: 570382 - DNA, 25 bp, Rattus norvegicus
tggagagcgaaccaaggccagcaga

SEQ ID NO: 570383 - DNA, 25 bp, Rattus norvegicus
cgccattactccgtgccggcttttg

SEQ ID NO: 570384 - DNA, 25 bp, Rattus norvegicus
gggccctttggaaatagaatagcca

SEQ ID NO: 570385 - DNA, 25 bp, Rattus norvegicus
gacacttcaacttgctcggctccgg

SEQ ID NO: 570386 - DNA, 25 bp, Rattus norvegicus
gctccgggcgagttgattcacttac

SEQ ID NO: 570387 - DNA, 25 bp, Rattus norvegicus
ctccacgggaatgctgggaatgtga

SEQ ID NO: 570388 - DNA, 25 bp, Rattus norvegicus
tccggtgctcgtgggcagctgcaat

SEQ ID NO: 570389 - DNA, 25 bp, Rattus norvegicus
agcgggtgcactcgactctctgctg

SEQ ID NO: 570390 - DNA, 25 bp, Rattus norvegicus
cctccaggctccacgggaatgctgg

SEQ ID NO: 570391 - DNA, 25 bp, Rattus norvegicus
accctcggattggaacaagtgcaca

SEQ ID NO: 570392 - DNA, 25 bp, Rattus norvegicus
catccctaaggtgagacgctgacgc

SEQ ID NO: 570393 - DNA, 25 bp, Rattus norvegicus
ggccacgcgaggttgtaaaaatcca

SEQ ID NO: 570394 - DNA, 25 bp, Rattus norvegicus
acaagtgcacagttcctcgggcgcc

SEQ ID NO: 570395 - DNA, 25 bp, Rattus norvegicus
tcgctgtctaaaccctcggattgga

SEQ ID NO: 570396 - DNA, 25 bp, Rattus norvegicus
ggcggatttgcctcgctgtctaaac

SEQ ID NO: 570397 - DNA, 25 bp, Rattus norvegicus
cctaagggcggatttgcctcgctgt

SEQ ID NO: 570398 - DNA, 25 bp, Rattus norvegicus
cctcgtgcgggtctccggtgctcgt

SEQ ID NO: 570399 - DNA, 25 bp, Rattus norvegicus
ccgcgctggggcgagcatccctaag

SEQ ID NO: 570400 - DNA, 25 bp, Rattus norvegicus
taaaaatccatgtgggaccgcgctg

SEQ ID NO: 570401 - DNA, 25 bp, Rattus norvegicus
tagggggcgcccaactcacgctggc

SEQ ID NO: 570402 - DNA, 25 bp, Rattus norvegicus
tgcgtctcccggactgcaatctgcg

SEQ ID NO: 570403 - DNA, 25 bp, Rattus norvegicus
atgagcggagatcctgtcagtactc

SEQ ID NO: 570404 - DNA, 25 bp, Rattus norvegicus
ctggatgagcggagatcctgtcagt

SEQ ID NO: 570405 - DNA, 25 bp, Rattus norvegicus
caatctgcgggcagaggctggatga

SEQ ID NO: 570406 - DNA, 25 bp, Rattus norvegicus
tcccggactgcaatctgcgggcaga

SEQ ID NO: 570407 - DNA, 25 bp, Rattus norvegicus
agcggagatcctgtcagtactccaa

SEQ ID NO: 570408 - DNA, 25 bp, Rattus norvegicus
cagggggacctgagctgcgtctccc

SEQ ID NO: 570409 - DNA, 25 bp, Rattus norvegicus
actctcaacccggtccaggcgagtc

SEQ ID NO: 570410 - DNA, 25 bp, Rattus norvegicus
cggtccaggcgagtctcgctcctgg

SEQ ID NO: 570411 - DNA, 25 bp, Rattus norvegicus
aggcgagtctcgctcctggccgcta

SEQ ID NO: 570412 - DNA, 25 bp, Rattus norvegicus
cgagtctcgctcctggccgctaggg

SEQ ID NO: 570413 - DNA, 25 bp, Rattus norvegicus
gagatcctgtcagtactccaaccct

SEQ ID NO: 570414 - DNA, 25 bp, Rattus norvegicus
accgcgtccctcgttggtggccagg

SEQ ID NO: 570415 - DNA, 25 bp, Rattus norvegicus
cgcgactgcggtgagctcatcccgg

SEQ ID NO: 570416 - DNA, 25 bp, Rattus norvegicus
gcacgtggccgccacccggctcctg

SEQ ID NO: 570417 - DNA, 25 bp, Rattus norvegicus
cccggcgcgactgcggtgagctcat

SEQ ID NO: 570418 - DNA, 25 bp, Rattus norvegicus
caggcccagcatggtagccgcggcc

SEQ ID NO: 570419 - DNA, 25 bp, Rattus norvegicus
cagctcgcacgcgtccaggcccagc

SEQ ID NO: 570420 - DNA, 25 bp, Rattus norvegicus
tcacctcgggcgcacagcgccagcc

SEQ ID NO: 570421 - DNA, 25 bp, Rattus norvegicus
gccgccacccggctcctgcgctcac

SEQ ID NO: 570422 - DNA, 25 bp, Rattus norvegicus
gtggactaaagtctcacgcccggcc

SEQ ID NO: 570423 - DNA, 25 bp, Rattus norvegicus
cgccccaaagttgccgcggggactg

SEQ ID NO: 570424 - DNA, 25 bp, Rattus norvegicus
agaatacatacacgccacgaggtcc

SEQ ID NO: 570425 - DNA, 25 bp, Rattus norvegicus
gccagaatacatacacgccacgagg

SEQ ID NO: 570426 - DNA, 25 bp, Rattus norvegicus
tggactaaagtctcacgcccggcca

SEQ ID NO: 570427 - DNA, 25 bp, Rattus norvegicus
ctcacgcccggccagaatacataca

SEQ ID NO: 570428 - DNA, 25 bp, Rattus norvegicus
cctgcgctcacctcgggcgcacagc

SEQ ID NO: 570429 - DNA, 25 bp, Rattus norvegicus
accaaaacccggtcaatctgcgccg

SEQ ID NO: 570430 - DNA, 25 bp, Rattus norvegicus
cgcagcaaccgcaacttaaccacca

SEQ ID NO: 570431 - DNA, 25 bp, Rattus norvegicus
agatgcatgtgacctactccctcgc

SEQ ID NO: 570432 - DNA, 25 bp, Rattus norvegicus
ctgagcagatgcatgtgacctactc

SEQ ID NO: 570433 - DNA, 25 bp, Rattus norvegicus
tgcctggctgagcagatgcatgtga

SEQ ID NO: 570434 - DNA, 25 bp, Rattus norvegicus
ctcgcccaccgcagctgcctggctg

SEQ ID NO: 570435 - DNA, 25 bp, Rattus norvegicus
ggacacgcggcctcacgcaacccag

SEQ ID NO: 570436 - DNA, 25 bp, Rattus norvegicus
cgcaacccaggctgcggtttcatca

SEQ ID NO: 570437 - DNA, 25 bp, Rattus norvegicus
acccaggctgcggtttcatcacctg

SEQ ID NO: 570438 - DNA, 25 bp, Rattus norvegicus
aggctgcggtttcatcacctgctcc

SEQ ID NO: 570439 - DNA, 25 bp, Rattus norvegicus
gcggtttcatcacctgctcccagga

SEQ ID NO: 570440 - DNA, 25 bp, Rattus norvegicus
ccaggactcctcattacgacgacag

SEQ ID NO: 570441 - DNA, 25 bp, Rattus norvegicus
ctcattacgacgacaggaagcgccc

SEQ ID NO: 570442 - DNA, 25 bp, Rattus norvegicus
atctcctggcctctatagccgacga

SEQ ID NO: 570443 - DNA, 25 bp, Rattus norvegicus
tcggaaggctggtacgtctaacaaa

SEQ ID NO: 570444 - DNA, 25 bp, Rattus norvegicus
gaagtcggaaggctggtacgtctaa

SEQ ID NO: 570445 - DNA, 25 bp, Rattus norvegicus
atagcgaaggtagccagtagagcca

SEQ ID NO: 570446 - DNA, 25 bp, Rattus norvegicus
ttccatagcgaaggtagccagtaga

SEQ ID NO: 570447 - DNA, 25 bp, Rattus norvegicus
tcttccatagcgaaggtagccagta

SEQ ID NO: 570448 - DNA, 25 bp, Rattus norvegicus
caggttcttccatagcgaaggtagc

SEQ ID NO: 570449 - DNA, 25 bp, Rattus norvegicus
ctcaggttcttccatagcgaaggta

SEQ ID NO: 570450 - DNA, 25 bp, Rattus norvegicus
tgcatctcaggttcttccatagcga

SEQ ID NO: 570451 - DNA, 25 bp, Rattus norvegicus
cagttgcatctcaggttcttccata

SEQ ID NO: 570452 - DNA, 25 bp, Rattus norvegicus
ctttcagttgcatctcaggttcttc

SEQ ID NO: 570453 - DNA, 25 bp, Rattus norvegicus
tctttcctttcagttgcatctcagg

SEQ ID NO: 570454 - DNA, 25 bp, Rattus norvegicus
gccatgaaccttcccgcgttgccct

SEQ ID NO: 570455 - DNA, 25 bp, Rattus norvegicus
gttctctctgccatgaaccttcccg

SEQ ID NO: 570456 - DNA, 25 bp, Rattus norvegicus
tggggttctaaagcggttctctctg

SEQ ID NO: 570457 - DNA, 25 bp, Rattus norvegicus
tacgtggatccgattggggaacaca

SEQ ID NO: 570458 - DNA, 25 bp, Rattus norvegicus
ggaacacacgcgcagtgaaatcctc

SEQ ID NO: 570459 - DNA, 25 bp, Rattus norvegicus
cctttacgaaggatagcgcgcatgc

SEQ ID NO: 570460 - DNA, 25 bp, Rattus norvegicus
ctcccatcatacgtggatccgattg

SEQ ID NO: 570461 - DNA, 25 bp, Rattus norvegicus
tctcagaatgctccgccctcccatc

SEQ ID NO: 570462 - DNA, 25 bp, Rattus norvegicus
gtctccgcctccgtctcagaatgct

SEQ ID NO: 570463 - DNA, 25 bp, Rattus norvegicus
cgcgcagtgaaatcctcagagggtc

SEQ ID NO: 570464 - DNA, 25 bp, Rattus norvegicus
tcctcagagggtctaaggctccttc

SEQ ID NO: 570465 - DNA, 25 bp, Rattus norvegicus
ctcagaggcctcagcggaagccacg

SEQ ID NO: 570466 - DNA, 25 bp, Rattus norvegicus
cttcagccctttacgaaggatagcg

SEQ ID NO: 570467 - DNA, 25 bp, Rattus norvegicus
cgcgcatgcgcctctgtactcagag

SEQ ID NO: 570468 - DNA, 25 bp, Rattus norvegicus
tctgtactcagaggcctcagcggaa

SEQ ID NO: 570469 - DNA, 25 bp, Rattus norvegicus
ttacgaaggatagcgcgcatgcgcc

SEQ ID NO: 570470 - DNA, 25 bp, Rattus norvegicus
ggtctaaggctccttcagcccttta

SEQ ID NO: 570471 - DNA, 25 bp, Rattus norvegicus
cgcgagttcgaagcccggagctgcc

SEQ ID NO: 570472 - DNA, 25 bp, Rattus norvegicus
tcttaaagggctcgcaccggatggt

SEQ ID NO: 570473 - DNA, 25 bp, Rattus norvegicus
gcaccggatggtttctggttcccta

SEQ ID NO: 570474 - DNA, 25 bp, Rattus norvegicus
gtttctggttccctagagctggagg

SEQ ID NO: 570475 - DNA, 25 bp, Rattus norvegicus
gctggagggaaaatgccgacccaca

SEQ ID NO: 570476 - DNA, 25 bp, Rattus norvegicus
cacctcgcggttacaaaatgttctc

SEQ ID NO: 570477 - DNA, 25 bp, Rattus norvegicus
aaaatgttctcacggccctcctgtg

SEQ ID NO: 570478 - DNA, 25 bp, Rattus norvegicus
gccctcctgtgatcatgtctacctg

SEQ ID NO: 570479 - DNA, 25 bp, Rattus norvegicus
gacgatgcctttcccagcgcggagc

SEQ ID NO: 570480 - DNA, 25 bp, Rattus norvegicus
cctctatgtgacaaggcgggcgatc

SEQ ID NO: 570481 - DNA, 25 bp, Rattus norvegicus
ttcctaaaccagtcgagtctcagcc

SEQ ID NO: 570482 - DNA, 25 bp, Rattus norvegicus
cagcagatctgcgaacccggaaccg

SEQ ID NO: 570483 - DNA, 25 bp, Rattus norvegicus
cagcaaagatgatgcctgttcgcca

SEQ ID NO: 570484 - DNA, 25 bp, Rattus norvegicus
tgtctacctgcagaaggcctcgctc

SEQ ID NO: 570485 - DNA, 25 bp, Rattus norvegicus
acgatgtctactgctttgcccgcga

SEQ ID NO: 570486 - DNA, 25 bp, Rattus norvegicus
taccattgcggctccaaggcacctg

SEQ ID NO: 570487 - DNA, 25 bp, Rattus norvegicus
ggtcaggtacccgatcactcagtcg

SEQ ID NO: 570488 - DNA, 25 bp, Rattus norvegicus
acccgcaggaactctacgatgtcta

SEQ ID NO: 570489 - DNA, 25 bp, Rattus norvegicus
accgctatgcgttgaccttcgctga

SEQ ID NO: 570490 - DNA, 25 bp, Rattus norvegicus
gcctgtcgccacctatccttgagtg

SEQ ID NO: 570491 - DNA, 25 bp, Rattus norvegicus
tccgaatgctcagtgtcctccaaag

SEQ ID NO: 570492 - DNA, 25 bp, Rattus norvegicus
cctccaaagctgcacgtgggacctg

SEQ ID NO: 570493 - DNA, 25 bp, Rattus norvegicus
cccacaggcgtcgtgttccattatc

SEQ ID NO: 570494 - DNA, 25 bp, Rattus norvegicus
atctccggagctccctatccaaagg

SEQ ID NO: 570495 - DNA, 25 bp, Rattus norvegicus
gctgcgttcgaagatggctttgaca

SEQ ID NO: 570496 - DNA, 25 bp, Rattus norvegicus
cctctcccaggtgaagtcttttacg

SEQ ID NO: 570497 - DNA, 25 bp, Rattus norvegicus
tgagtgtcaggtgttattccagccc

SEQ ID NO: 570498 - DNA, 25 bp, Rattus norvegicus
cgtcccggttgctatggtgatcgca

SEQ ID NO: 570499 - DNA, 25 bp, Rattus norvegicus
ttccacgcagcgaagagctgcccga

SEQ ID NO: 570500 - DNA, 25 bp, Rattus norvegicus
gcgcatcctccgagatctagacacg

SEQ ID NO: 570501 - DNA, 25 bp, Rattus norvegicus
aaacacgcggcctgcgggacccgag

SEQ ID NO: 570502 - DNA, 25 bp, Rattus norvegicus
agagctgcccgaccttggccactgt

SEQ ID NO: 570503 - DNA, 25 bp, Rattus norvegicus
agctgcagcttccacgcagcgaaga

SEQ ID NO: 570504 - DNA, 25 bp, Rattus norvegicus
cagcccgcagtgcagcggtccaaga

SEQ ID NO: 570505 - DNA, 25 bp, Rattus norvegicus
ccgcagcgagttcgcggattcacga

SEQ ID NO: 570506 - DNA, 25 bp, Rattus norvegicus
ggccgaggacctccgcagcgagttc

SEQ ID NO: 570507 - DNA, 25 bp, Rattus norvegicus
tcagggaaaccgaggctgcgcacgc

SEQ ID NO: 570508 - DNA, 25 bp, Rattus norvegicus
tagcagtagacaccgaagaggcgac

SEQ ID NO: 570509 - DNA, 25 bp, Rattus norvegicus
acccggagcgcggtagcagtagaca

SEQ ID NO: 570510 - DNA, 25 bp, Rattus norvegicus
ctagacacgcagtggggtccaggca

SEQ ID NO: 570511 - DNA, 25 bp, Rattus norvegicus
tccgagatctagacacgcagtgggg

SEQ ID NO: 570512 - DNA, 25 bp, Rattus norvegicus
aaggccacaggtcgcagcggcttca

SEQ ID NO: 570513 - DNA, 25 bp, Rattus norvegicus
actgcacggagccatcgcgtagcca

SEQ ID NO: 570514 - DNA, 25 bp, Rattus norvegicus
ctgggcttccgcgaaagtcatcttg

SEQ ID NO: 570515 - DNA, 25 bp, Rattus norvegicus
tgctccgcacaagcgcgctgggctt

SEQ ID NO: 570516 - DNA, 25 bp, Rattus norvegicus
gcttctttagaaaacgcttaactca

SEQ ID NO: 570517 - DNA, 25 bp, Rattus norvegicus
agaatgccgtcctgctccgcacaag

SEQ ID NO: 570518 - DNA, 25 bp, Rattus norvegicus
tccgcagatgccagaatgccgtcct

SEQ ID NO: 570519 - DNA, 25 bp, Rattus norvegicus
aggccatcgcgccaggccgtgtgca

SEQ ID NO: 570520 - DNA, 25 bp, Rattus norvegicus
ctcaccgggtactgcacggagccat

SEQ ID NO: 570521 - DNA, 25 bp, Rattus norvegicus
acgatatccatagttgcgcacgccc

SEQ ID NO: 570522 - DNA, 25 bp, Rattus norvegicus
cctcggcgttgtgacgatatccata

SEQ ID NO: 570523 - DNA, 25 bp, Rattus norvegicus
aggcatcgtagcgttcctcggcgtt

SEQ ID NO: 570524 - DNA, 25 bp, Rattus norvegicus
aaagtcatcttgtagcggcctccgc

SEQ ID NO: 570525 - DNA, 25 bp, Rattus norvegicus
agcagaaggcatcgtagcgttcctc

SEQ ID NO: 570526 - DNA, 25 bp, Rattus norvegicus
gtgtgcagctgctccgcagatgcca

SEQ ID NO: 570527 - DNA, 25 bp, Rattus norvegicus
acgcaactaccgtggagcagccaga

SEQ ID NO: 570528 - DNA, 25 bp, Rattus norvegicus
agagggtcaggtgattcctttcgcc

SEQ ID NO: 570529 - DNA, 25 bp, Rattus norvegicus
gggtctactactttcgtccacttga

SEQ ID NO: 570530 - DNA, 25 bp, Rattus norvegicus
aggggatgaccacagcttcgcacaa

SEQ ID NO: 570531 - DNA, 25 bp, Rattus norvegicus
cggccgcctcgtagtggtaacggca

SEQ ID NO: 570532 - DNA, 25 bp, Rattus norvegicus
tcattggtgacctcgcactcgtagc

SEQ ID NO: 570533 - DNA, 25 bp, Rattus norvegicus
cgcgccaggagactgcagcaagcct

SEQ ID NO: 570534 - DNA, 25 bp, Rattus norvegicus
ctgcagggtgacatttcggaggacc

SEQ ID NO: 570535 - DNA, 25 bp, Rattus norvegicus
gtccatcgttctgtagctcggcccg

SEQ ID NO: 570536 - DNA, 25 bp, Rattus norvegicus
tcggcgaaagccaaagggtctacta

SEQ ID NO: 570537 - DNA, 25 bp, Rattus norvegicus
cgtcgttcactctaggcctccgatg

SEQ ID NO: 570538 - DNA, 25 bp, Rattus norvegicus
cagcacgtgcacgactttcttcctg

SEQ ID NO: 570539 - DNA, 25 bp, Rattus norvegicus
caaaggggtttcagccacgcaacta

SEQ ID NO: 570540 - DNA, 25 bp, Rattus norvegicus
tcgtccacttgaggcgaacgccgtc

SEQ ID NO: 570541 - DNA, 25 bp, Rattus norvegicus
ccgagtcgtggtatctggctctcct

SEQ ID NO: 570542 - DNA, 25 bp, Rattus norvegicus
tcttcgcttcatcgggcttgggact

SEQ ID NO: 570543 - DNA, 25 bp, Rattus norvegicus
tggggactcgatcctcttcgcttca

SEQ ID NO: 570544 - DNA, 25 bp, Rattus norvegicus
agctcggctcggtgctttaccacca

SEQ ID NO: 570545 - DNA, 25 bp, Rattus norvegicus
ctgggtttcgccgagcacttccgaa

SEQ ID NO: 570546 - DNA, 25 bp, Rattus norvegicus
gaacaggcgcgcagtcacttagaga

SEQ ID NO: 570547 - DNA, 25 bp, Rattus norvegicus
cccagaagtccttgcgtagctgttc

SEQ ID NO: 570548 - DNA, 25 bp, Rattus norvegicus
gccggcgtcagttcatgaacctatg

SEQ ID NO: 570549 - DNA, 25 bp, Rattus norvegicus
atggagtcctcctccgtcgaacacg

SEQ ID NO: 570550 - DNA, 25 bp, Rattus norvegicus
aggctctgttatagtccgcttggtc

SEQ ID NO: 570551 - DNA, 25 bp, Rattus norvegicus
gcaacatcccggttgtccatcttga

SEQ ID NO: 570552 - DNA, 25 bp, Rattus norvegicus
ccgcgtgtcagttccgtgacagaaa

SEQ ID NO: 570553 - DNA, 25 bp, Rattus norvegicus
ccagagaggtgcacacgcaacgtta

SEQ ID NO: 570554 - DNA, 25 bp, Rattus norvegicus
tccgcttgtgcgttcattgcctgca

SEQ ID NO: 570555 - DNA, 25 bp, Rattus norvegicus
ttgtgcggctgttgcttcgctagct

SEQ ID NO: 570556 - DNA, 25 bp, Rattus norvegicus
cagttagtctgtggggcaccgcagc

SEQ ID NO: 570557 - DNA, 25 bp, Rattus norvegicus
cgtggaaagttgctgcaggctccga

SEQ ID NO: 570558 - DNA, 25 bp, Rattus norvegicus
caggctccgaggaacgcctccgccg

SEQ ID NO: 570559 - DNA, 25 bp, Rattus norvegicus
ctccgccgtccggagtccggattgt

SEQ ID NO: 570560 - DNA, 25 bp, Rattus norvegicus
gctgttgcttcgctagctccttccg

SEQ ID NO: 570561 - DNA, 25 bp, Rattus norvegicus
gttgcttcgctagctccttccgcgg

SEQ ID NO: 570562 - DNA, 25 bp, Rattus norvegicus
agcctcggccgccatggaactctgg

SEQ ID NO: 570563 - DNA, 25 bp, Rattus norvegicus
ggccgccatggaactctggagttga

SEQ ID NO: 570564 - DNA, 25 bp, Rattus norvegicus
aactctggagttgagtcgccaccgc

SEQ ID NO: 570565 - DNA, 25 bp, Rattus norvegicus
cccacgctggggcagttagtctgtg

SEQ ID NO: 570566 - DNA, 25 bp, Rattus norvegicus
gccctccgtcttctccctctgttcg

SEQ ID NO: 570567 - DNA, 25 bp, Rattus norvegicus
agttgagtcgccaccgcggagctcc

SEQ ID NO: 570568 - DNA, 25 bp, Rattus norvegicus
accgcagcgcgtggaaagttgctgc

SEQ ID NO: 570569 - DNA, 25 bp, Rattus norvegicus
ctctcgcgttcgctctcagatggaa

SEQ ID NO: 570570 - DNA, 25 bp, Rattus norvegicus
tctacccactgcgtgagtcccgaga

SEQ ID NO: 570571 - DNA, 25 bp, Rattus norvegicus
tgggcacactcctgacacagcacgg

SEQ ID NO: 570572 - DNA, 25 bp, Rattus norvegicus
agcgctcactttcgttctcctcaga

SEQ ID NO: 570573 - DNA, 25 bp, Rattus norvegicus
tccagaagttctgcatctcggagga

SEQ ID NO: 570574 - DNA, 25 bp, Rattus norvegicus
ctcctgtgcaggcagagacatcgtg

SEQ ID NO: 570575 - DNA, 25 bp, Rattus norvegicus
gtcgtgagtatgcaggaccctgacc

SEQ ID NO: 570576 - DNA, 25 bp, Rattus norvegicus
gtgtacgcgatctgagttgttcctc

SEQ ID NO: 570577 - DNA, 25 bp, Rattus norvegicus
ccactgggagttcatgacagcactg

SEQ ID NO: 570578 - DNA, 25 bp, Rattus norvegicus
cacatctcagcaaggttgggccctc

SEQ ID NO: 570579 - DNA, 25 bp, Rattus norvegicus
tgctcccgaatgcagagaccacatc

SEQ ID NO: 570580 - DNA, 25 bp, Rattus norvegicus
tggccacggttagaggctgcacacc

SEQ ID NO: 570581 - DNA, 25 bp, Rattus norvegicus
gaggctcacacggttaaccttagcg

SEQ ID NO: 570582 - DNA, 25 bp, Rattus norvegicus
agatgcggagccagcgccttctgat

SEQ ID NO: 570583 - DNA, 25 bp, Rattus norvegicus
gaactgtctgtcttaaggctggcca

SEQ ID NO: 570584 - DNA, 25 bp, Rattus norvegicus
gacgcgtcccaggattctcttcaga

SEQ ID NO: 570585 - DNA, 25 bp, Rattus norvegicus
ttccaacggaagagcctaagagccc

SEQ ID NO: 570586 - DNA, 25 bp, Rattus norvegicus
gctatgggaaccaagccaggtcacc

SEQ ID NO: 570587 - DNA, 25 bp, Rattus norvegicus
caggtcaccagccacttgaggtcta

SEQ ID NO: 570588 - DNA, 25 bp, Rattus norvegicus
cggggaaccctcagcttagccagtt

SEQ ID NO: 570589 - DNA, 25 bp, Rattus norvegicus
caagccggccacgaattgacgtgtc

SEQ ID NO: 570590 - DNA, 25 bp, Rattus norvegicus
ccatggcgagttgactggttctgta

SEQ ID NO: 570591 - DNA, 25 bp, Rattus norvegicus
ctcattggctgctgcgaactgtctg

SEQ ID NO: 570592 - DNA, 25 bp, Rattus norvegicus
agacttcattggcttgcgccgccgc

SEQ ID NO: 570593 - DNA, 25 bp, Rattus norvegicus
cgccactcggagagacgtgcctcaa

SEQ ID NO: 570594 - DNA, 25 bp, Rattus norvegicus
acccggaagtgtgagaggcaaaatc

SEQ ID NO: 570595 - DNA, 25 bp, Rattus norvegicus
aaatctgcctagcaaccggggaagc

SEQ ID NO: 570596 - DNA, 25 bp, Rattus norvegicus
tccattggatgcttgtctgtcagtc

SEQ ID NO: 570597 - DNA, 25 bp, Rattus norvegicus
gtggccaccttcaccttggagtagc

SEQ ID NO: 570598 - DNA, 25 bp, Rattus norvegicus
cccggtgaccatgacgtagagcaca

SEQ ID NO: 570599 - DNA, 25 bp, Rattus norvegicus
gccgaaaccgaaatccgtgagcttg

SEQ ID NO: 570600 - DNA, 25 bp, Rattus norvegicus
gcagcacgttttcgcacttgaggtc

SEQ ID NO: 570601 - DNA, 25 bp, Rattus norvegicus
acagcgcctgcgatctgcgagaaga

SEQ ID NO: 570602 - DNA, 25 bp, Rattus norvegicus
tggctgctgcctccatcacgatgta

SEQ ID NO: 570603 - DNA, 25 bp, Rattus norvegicus
agcttcccgttgcacacttcgatga

SEQ ID NO: 570604 - DNA, 25 bp, Rattus norvegicus
tccttccctgaagtgatggtgctca

SEQ ID NO: 570605 - DNA, 25 bp, Rattus norvegicus
cactttgatggccaccgtcccttta

SEQ ID NO: 570606 - DNA, 25 bp, Rattus norvegicus
tctcgggcctaacccatggtgcttg

SEQ ID NO: 570607 - DNA, 25 bp, Rattus norvegicus
cgcgatgacttttattgcccgggta

SEQ ID NO: 570608 - DNA, 25 bp, Rattus norvegicus
tgcccgggtaacaatttctgccttg

SEQ ID NO: 570609 - DNA, 25 bp, Rattus norvegicus
tttgtgactcaatcgccctgaatgg

SEQ ID NO: 570610 - DNA, 25 bp, Rattus norvegicus
agctctcgaggcaggaacttgttga

SEQ ID NO: 570611 - DNA, 25 bp, Rattus norvegicus
cgtgtgcccggcacctacgggtgtt

SEQ ID NO: 570612 - DNA, 25 bp, Rattus norvegicus
ttcctgcccgccgaggtcagatgcg

SEQ ID NO: 570613 - DNA, 25 bp, Rattus norvegicus
tggccacgctgaagcggctctccat

SEQ ID NO: 570614 - DNA, 25 bp, Rattus norvegicus
gctcatcgacgacgcgtacgggctg

SEQ ID NO: 570615 - DNA, 25 bp, Rattus norvegicus
ccaggtgcggctcatcgacgacgcg

SEQ ID NO: 570616 - DNA, 25 bp, Rattus norvegicus
tgacccgtccgagcgtagccactga

SEQ ID NO: 570617 - DNA, 25 bp, Rattus norvegicus
cgcagtgcgagaagatggacatccc

SEQ ID NO: 570618 - DNA, 25 bp, Rattus norvegicus
accgtgatctgaccacgcagtgcga

SEQ ID NO: 570619 - DNA, 25 bp, Rattus norvegicus
ttcagccgacgcgttgcaccgtgat

SEQ ID NO: 570620 - DNA, 25 bp, Rattus norvegicus
ggaataccagcccagcatcttctac

SEQ ID NO: 570621 - DNA, 25 bp, Rattus norvegicus
cacctacgggtgttcgtgagtaaca

SEQ ID NO: 570622 - DNA, 25 bp, Rattus norvegicus
aagcagagaacggtgcttgtcgtgt

SEQ ID NO: 570623 - DNA, 25 bp, Rattus norvegicus
tctccatcccgcttgtgagcctgga

SEQ ID NO: 570624 - DNA, 25 bp, Rattus norvegicus
ttcgtgagtaacagggccgtgatgt

SEQ ID NO: 570625 - DNA, 25 bp, Rattus norvegicus
tcggatcccagagtttcgcagagca

SEQ ID NO: 570626 - DNA, 25 bp, Rattus norvegicus
aggtctgaccgctacccacgtgcgt

SEQ ID NO: 570627 - DNA, 25 bp, Rattus norvegicus
gcagcccgatgtgctagtgtccttt

SEQ ID NO: 570628 - DNA, 25 bp, Rattus norvegicus
gcttctccggacgtcaccactttgt

SEQ ID NO: 570629 - DNA, 25 bp, Rattus norvegicus
tcaccactttgtagccggcaggttc

SEQ ID NO: 570630 - DNA, 25 bp, Rattus norvegicus
cgccgaaagtttggcctgcacctgc

SEQ ID NO: 570631 - DNA, 25 bp, Rattus norvegicus
aatatactggcaccgactgcgtggc

SEQ ID NO: 570632 - DNA, 25 bp, Rattus norvegicus
tgtgacccgcaccaataaacatctc

SEQ ID NO: 570633 - DNA, 25 bp, Rattus norvegicus
tgcctcttttgtgcaccaggccagg

SEQ ID NO: 570634 - DNA, 25 bp, Rattus norvegicus
ctgcgctgtggactttcctagactg

SEQ ID NO: 570635 - DNA, 25 bp, Rattus norvegicus
gcagaccctaagtgggacttccagg

SEQ ID NO: 570636 - DNA, 25 bp, Rattus norvegicus
cctgcagtatttaggaccgaagtta

SEQ ID NO: 570637 - DNA, 25 bp, Rattus norvegicus
tatagagaacgtccagcatcctagg

SEQ ID NO: 570638 - DNA, 25 bp, Rattus norvegicus
aggacgcccaacagcttcaagttta

SEQ ID NO: 570639 - DNA, 25 bp, Rattus norvegicus
ggactgggcactacccgctgcaata

SEQ ID NO: 570640 - DNA, 25 bp, Rattus norvegicus
ctcagcgtgcgatgcccgcagaggc

SEQ ID NO: 570641 - DNA, 25 bp, Rattus norvegicus
ccgcagaggccagcgagtggacctc

SEQ ID NO: 570642 - DNA, 25 bp, Rattus norvegicus
tggacctcgtggttcaacgtggacc

SEQ ID NO: 570643 - DNA, 25 bp, Rattus norvegicus
accacccgggaggagatggtgactt

SEQ ID NO: 570644 - DNA, 25 bp, Rattus norvegicus
gacttcgagagcctggcagccattc

SEQ ID NO: 570645 - DNA, 25 bp, Rattus norvegicus
gcctggcagccattcgcttctacta

SEQ ID NO: 570646 - DNA, 25 bp, Rattus norvegicus
aggcgcgcaccacggactgggcact

SEQ ID NO: 570647 - DNA, 25 bp, Rattus norvegicus
gcactacccgctgcaataggcgaga

SEQ ID NO: 570648 - DNA, 25 bp, Rattus norvegicus
ataggcgagagggtgcacgccaacc

SEQ ID NO: 570649 - DNA, 25 bp, Rattus norvegicus
tgcacgccaacccagagcgcggatt

SEQ ID NO: 570650 - DNA, 25 bp, Rattus norvegicus
gagcgcggattctggtgtcttaatc

SEQ ID NO: 570651 - DNA, 25 bp, Rattus norvegicus
tggtgtcttaatcgcgagcagccgc

SEQ ID NO: 570652 - DNA, 25 bp, Rattus norvegicus
gcttctactatggtcccgcgcgcgt

SEQ ID NO: 570653 - DNA, 25 bp, Rattus norvegicus
cagcgacctgcgctacctggatagc

SEQ ID NO: 570654 - DNA, 25 bp, Rattus norvegicus
tcgcgcctacggtacagatcgcttc

SEQ ID NO: 570655 - DNA, 25 bp, Rattus norvegicus
ccagcgctaggcgagctagtcttcc

SEQ ID NO: 570656 - DNA, 25 bp, Rattus norvegicus
ggtcaccgacagtcacttccgattc

SEQ ID NO: 570657 - DNA, 25 bp, Rattus norvegicus
gtgtcaccttcgtggaccctcgtga

SEQ ID NO: 570658 - DNA, 25 bp, Rattus norvegicus
tggtgacgctgctcaatctggaacc

SEQ ID NO: 570659 - DNA, 25 bp, Rattus norvegicus
gctgcttcgtgaaggttcgcgccta

SEQ ID NO: 570660 - DNA, 25 bp, Rattus norvegicus
ttcaacctagacgtgcccgagcggc

SEQ ID NO: 570661 - DNA, 25 bp, Rattus norvegicus
gcgagcgccgcttattcaacctaga

SEQ ID NO: 570662 - DNA, 25 bp, Rattus norvegicus
tggcactctggtcgttggacccaga

SEQ ID NO: 570663 - DNA, 25 bp, Rattus norvegicus
gacacgccgatgctctggcactctg

SEQ ID NO: 570664 - DNA, 25 bp, Rattus norvegicus
gtttgcagtggacctgcacgcgcca

SEQ ID NO: 570665 - DNA, 25 bp, Rattus norvegicus
gccgctgcgcacctatggcatgttt

SEQ ID NO: 570666 - DNA, 25 bp, Rattus norvegicus
ggcttccgcttgaaccttgcacgtc

SEQ ID NO: 570667 - DNA, 25 bp, Rattus norvegicus
cttactgcccgggatccgcacctgg

SEQ ID NO: 570668 - DNA, 25 bp, Rattus norvegicus
tggcctgagcctcgtccaggctctg

SEQ ID NO: 570669 - DNA, 25 bp, Rattus norvegicus
tcggtgatggccatgatttgctgca

SEQ ID NO: 570670 - DNA, 25 bp, Rattus norvegicus
atttgctgcaggacgtcgctcgtgt

SEQ ID NO: 570671 - DNA, 25 bp, Rattus norvegicus
cgctcgtgtcatggcccagtggagc

SEQ ID NO: 570672 - DNA, 25 bp, Rattus norvegicus
cggccatgaactacgggccgagcga

SEQ ID NO: 570673 - DNA, 25 bp, Rattus norvegicus
ttcatcaatcttctctgtgcaccgc

SEQ ID NO: 570674 - DNA, 25 bp, Rattus norvegicus
acccttttcatcaatcttctctgtg

SEQ ID NO: 570675 - DNA, 25 bp, Rattus norvegicus
gcactgctcacggaaacaccctttt

SEQ ID NO: 570676 - DNA, 25 bp, Rattus norvegicus
gacaggtccgatcccggagcttgcg

SEQ ID NO: 570677 - DNA, 25 bp, Rattus norvegicus
acccagggaccacgcctccttcaag

SEQ ID NO: 570678 - DNA, 25 bp, Rattus norvegicus
agcgcagagggacaggtccgatccc

SEQ ID NO: 570679 - DNA, 25 bp, Rattus norvegicus
cgccgctgtgcactgctcacggaaa

SEQ ID NO: 570680 - DNA, 25 bp, Rattus norvegicus
gagcttgcgcgcagcagctaaccgc

SEQ ID NO: 570681 - DNA, 25 bp, Rattus norvegicus
gtccatcgtacacctcacgtgcttg

SEQ ID NO: 570682 - DNA, 25 bp, Rattus norvegicus
ggtgttcgtcttacctgggcctcca

SEQ ID NO: 570683 - DNA, 25 bp, Rattus norvegicus
tgggcctccagtcaagcggcagatt

SEQ ID NO: 570684 - DNA, 25 bp, Rattus norvegicus
cccacgtcggaagtatagtctcctg

SEQ ID NO: 570685 - DNA, 25 bp, Rattus norvegicus
agtatagtctcctgaaactgtgacc

SEQ ID NO: 570686 - DNA, 25 bp, Rattus norvegicus
acgtggggcaccctttccactctgt

SEQ ID NO: 570687 - DNA, 25 bp, Rattus norvegicus
tcggccgcctgcaaccacccttaac

SEQ ID NO: 570688 - DNA, 25 bp, Rattus norvegicus
ccgcctttggggctgagccacctag

SEQ ID NO: 570689 - DNA, 25 bp, Rattus norvegicus
agccacctagcagtcggaaagatcc

SEQ ID NO: 570690 - DNA, 25 bp, Rattus norvegicus
agcagtcggaaagatccacagcggg

SEQ ID NO: 570691 - DNA, 25 bp, Rattus norvegicus
gtttctgtccaatcctataccgagc

SEQ ID NO: 570692 - DNA, 25 bp, Rattus norvegicus
gtccaatcctataccgagctgcaaa

SEQ ID NO: 570693 - DNA, 25 bp, Rattus norvegicus
tgccgagccacccttcttcccgtgg

SEQ ID NO: 570694 - DNA, 25 bp, Rattus norvegicus
tcctccctacaacccacgtggggca

SEQ ID NO: 570695 - DNA, 25 bp, Rattus norvegicus
agaggactccattcttccgtgcgcg

SEQ ID NO: 570696 - DNA, 25 bp, Rattus norvegicus
cttggtactgtgttccgaccttggc

SEQ ID NO: 570697 - DNA, 25 bp, Rattus norvegicus
tacgtgcgacactatccgccgcttg

SEQ ID NO: 570698 - DNA, 25 bp, Rattus norvegicus
ggtctccagatcctgctggcgcgta

SEQ ID NO: 570699 - DNA, 25 bp, Rattus norvegicus
ttcccggacacaggcctggtacaga

SEQ ID NO: 570700 - DNA, 25 bp, Rattus norvegicus
ctggtacagagcctccgcctcatgt

SEQ ID NO: 570701 - DNA, 25 bp, Rattus norvegicus
ctccgcctcatgtgcctggggaaac

SEQ ID NO: 570702 - DNA, 25 bp, Rattus norvegicus
tcaggtcctctctgcgttgaatgta

SEQ ID NO: 570703 - DNA, 25 bp, Rattus norvegicus
agtggccagacattagggaatcttg

SEQ ID NO: 570704 - DNA, 25 bp, Rattus norvegicus
cctgttgcttgttggatccaggaga

SEQ ID NO: 570705 - DNA, 25 bp, Rattus norvegicus
ttgaatgtactggagctgcgagcgc

SEQ ID NO: 570706 - DNA, 25 bp, Rattus norvegicus
ctccgcctcactcttggaaacaata

SEQ ID NO: 570707 - DNA, 25 bp, Rattus norvegicus
ataagaggatcatgagcccgtggcc

SEQ ID NO: 570708 - DNA, 25 bp, Rattus norvegicus
aaaccgagacagagaaggcttaagc

SEQ ID NO: 570709 - DNA, 25 bp, Rattus norvegicus
cagccaggctgggtacagcaacccg

SEQ ID NO: 570710 - DNA, 25 bp, Rattus norvegicus
ctgcgctggcttccggcagaggcac

SEQ ID NO: 570711 - DNA, 25 bp, Rattus norvegicus
gggctccgcaaggtaccgcgttgcc

SEQ ID NO: 570712 - DNA, 25 bp, Rattus norvegicus
gtcgccgctcgctatgagcgctggc

SEQ ID NO: 570713 - DNA, 25 bp, Rattus norvegicus
agttcgtcgccgctcgctatgagcg

SEQ ID NO: 570714 - DNA, 25 bp, Rattus norvegicus
tatggccatacagcggccaccagtt

SEQ ID NO: 570715 - DNA, 25 bp, Rattus norvegicus
gccagccgccggtatggccatacag

SEQ ID NO: 570716 - DNA, 25 bp, Rattus norvegicus
cgcagaagcgccagccgccggtatg

SEQ ID NO: 570717 - DNA, 25 bp, Rattus norvegicus
tgggtacagcaacccggcaaacggc

SEQ ID NO: 570718 - DNA, 25 bp, Rattus norvegicus
cggtatctgggtccagctgttgccc

SEQ ID NO: 570719 - DNA, 25 bp, Rattus norvegicus
gcctccggtatctgggtccagctgt

SEQ ID NO: 570720 - DNA, 25 bp, Rattus norvegicus
cgcgcagtgcgcgtgcacagaccaa

SEQ ID NO: 570721 - DNA, 25 bp, Rattus norvegicus
caacccggcaaacggcagcacggtg

SEQ ID NO: 570722 - DNA, 25 bp, Rattus norvegicus
agtgcgcgtgcacagaccaatgccc

SEQ ID NO: 570723 - DNA, 25 bp, Rattus norvegicus
gcccgaactagcacgcgcgttgaga

SEQ ID NO: 570724 - DNA, 25 bp, Rattus norvegicus
gcagaccgctttggcccgaactagc

SEQ ID NO: 570725 - DNA, 25 bp, Rattus norvegicus
atggcgataggacgcagaccgcttt

SEQ ID NO: 570726 - DNA, 25 bp, Rattus norvegicus
atcctgacctgctctcggatgcgtc

SEQ ID NO: 570727 - DNA, 25 bp, Rattus norvegicus
cacgcgcgttgagagttacctagtc

SEQ ID NO: 570728 - DNA, 25 bp, Rattus norvegicus
gcgccctccagggaacagtacacga

SEQ ID NO: 570729 - DNA, 25 bp, Rattus norvegicus
cccactagcgcatggcgataggacg

SEQ ID NO: 570730 - DNA, 25 bp, Rattus norvegicus
gaccttagctgtgcgcctcattccg

SEQ ID NO: 570731 - DNA, 25 bp, Rattus norvegicus
gcaacccgggccgaccttagctgtg

SEQ ID NO: 570732 - DNA, 25 bp, Rattus norvegicus
ctcttgctactctgggagcgcaacc

SEQ ID NO: 570733 - DNA, 25 bp, Rattus norvegicus
ccgagttcctcaggcttgaaggtgc

SEQ ID NO: 570734 - DNA, 25 bp, Rattus norvegicus
tcagatttgtttggccgagttcctc

SEQ ID NO: 570735 - DNA, 25 bp, Rattus norvegicus
cagtacacgacggagctcagatttg

SEQ ID NO: 570736 - DNA, 25 bp, Rattus norvegicus
gttacctagtccgatcctgacctgc

SEQ ID NO: 570737 - DNA, 25 bp, Rattus norvegicus
tgcgcttgctgctcgcccgcgcgcg

SEQ ID NO: 570738 - DNA, 25 bp, Rattus norvegicus
gatggacgttagagagggagcgcct

SEQ ID NO: 570739 - DNA, 25 bp, Rattus norvegicus
ccctgcgcttgctgctcgcccgcgc

SEQ ID NO: 570740 - DNA, 25 bp, Rattus norvegicus
tcctacactgtgtccccgctcggcc

SEQ ID NO: 570741 - DNA, 25 bp, Rattus norvegicus
ccgcggctcctacactgtgtccccg

SEQ ID NO: 570742 - DNA, 25 bp, Rattus norvegicus
gcctgcgcgccctcgtcggacccgc

SEQ ID NO: 570743 - DNA, 25 bp, Rattus norvegicus
gccgcggaacagtcgcctgcgcgcc

SEQ ID NO: 570744 - DNA, 25 bp, Rattus norvegicus
cctcgccgcggaacagtcgcctgcg

SEQ ID NO: 570745 - DNA, 25 bp, Rattus norvegicus
cgcctcgccgcggaacagtcgcctg

SEQ ID NO: 570746 - DNA, 25 bp, Rattus norvegicus
gccgtcgctgatggacgttagagag

SEQ ID NO: 570747 - DNA, 25 bp, Rattus norvegicus
cgctgatggacgttagagagggagc

SEQ ID NO: 570748 - DNA, 25 bp, Rattus norvegicus
ctgatggacgttagagagggagcgc

SEQ ID NO: 570749 - DNA, 25 bp, Rattus norvegicus
ccgtcgctgatggacgttagagagg

SEQ ID NO: 570750 - DNA, 25 bp, Rattus norvegicus
tcgccgcggaacagtcgcctgcgcg

SEQ ID NO: 570751 - DNA, 25 bp, Rattus norvegicus
tccgcagtcctgctttgaatcgtcc

SEQ ID NO: 570752 - DNA, 25 bp, Rattus norvegicus
ccctcgccatgaaggtaagtgttct

SEQ ID NO: 570753 - DNA, 25 bp, Rattus norvegicus
aggtaagtgttctgtgcgcacggac

SEQ ID NO: 570754 - DNA, 25 bp, Rattus norvegicus
ctggggtggcgacttcctctccgcg

SEQ ID NO: 570755 - DNA, 25 bp, Rattus norvegicus
cccttcgctggggtggcgacttcct

SEQ ID NO: 570756 - DNA, 25 bp, Rattus norvegicus
cgacgcttcgcttggattcctcggc

SEQ ID NO: 570757 - DNA, 25 bp, Rattus norvegicus
gctttgaatcgtccccccaggctta

SEQ ID NO: 570758 - DNA, 25 bp, Rattus norvegicus
gacgcgcccaggaggactccgcagt

SEQ ID NO: 570759 - DNA, 25 bp, Rattus norvegicus
ggtcgctgcgcccacccgacgcgcc

SEQ ID NO: 570760 - DNA, 25 bp, Rattus norvegicus
ccgggtgccagtgctcgcttccgct

SEQ ID NO: 570761 - DNA, 25 bp, Rattus norvegicus
gggcacatttccacgctataccagc

SEQ ID NO: 570762 - DNA, 25 bp, Rattus norvegicus
ggttcttgggcacatttccacgcta

SEQ ID NO: 570763 - DNA, 25 bp, Rattus norvegicus
ctctcggttcttgggcacatttcca

SEQ ID NO: 570764 - DNA, 25 bp, Rattus norvegicus
ggactccgcagtcctgctttgaatc

SEQ ID NO: 570765 - DNA, 25 bp, Rattus norvegicus
gcggggtcttctcggccgccatact

SEQ ID NO: 570766 - DNA, 25 bp, Rattus norvegicus
agcgccgaacctcgctgcggaggct

SEQ ID NO: 570767 - DNA, 25 bp, Rattus norvegicus
gccgtctaatctggagcaccggaga

SEQ ID NO: 570768 - DNA, 25 bp, Rattus norvegicus
gcagagcgccgaacctcgctgcgga

SEQ ID NO: 570769 - DNA, 25 bp, Rattus norvegicus
ctctccctttgctccgcgcctgcgc

SEQ ID NO: 570770 - DNA, 25 bp, Rattus norvegicus
ctgggccgtgtcctctccctttgct

SEQ ID NO: 570771 - DNA, 25 bp, Rattus norvegicus
gtccctgcccgctgtggtggatcct

SEQ ID NO: 570772 - DNA, 25 bp, Rattus norvegicus
aagggcggctgtccctgcccgctgt

SEQ ID NO: 570773 - DNA, 25 bp, Rattus norvegicus
cgggcgagtccggaagccgcgccat

SEQ ID NO: 570774 - DNA, 25 bp, Rattus norvegicus
ttctcggccgccatactgtaggctc

SEQ ID NO: 570775 - DNA, 25 bp, Rattus norvegicus
ctaatctggagcaccggagaacggc

SEQ ID NO: 570776 - DNA, 25 bp, Rattus norvegicus
tctggagcaccggagaacggcaaga

SEQ ID NO: 570777 - DNA, 25 bp, Rattus norvegicus
cggaggctccgccttgcgcaagaaa

SEQ ID NO: 570778 - DNA, 25 bp, Rattus norvegicus
ccatactgtaggctccgctccgcgg

SEQ ID NO: 570779 - DNA, 25 bp, Rattus norvegicus
ggtcgctacttatgtagctccgccc

SEQ ID NO: 570780 - DNA, 25 bp, Rattus norvegicus
tcggctgcgtctgtgcagagctcaa

SEQ ID NO: 570781 - DNA, 25 bp, Rattus norvegicus
gctgtggacttaactccgcggctga

SEQ ID NO: 570782 - DNA, 25 bp, Rattus norvegicus
ttctctggccgccaggctgtggact

SEQ ID NO: 570783 - DNA, 25 bp, Rattus norvegicus
gaccgcaggcgagctcggaagccaa

SEQ ID NO: 570784 - DNA, 25 bp, Rattus norvegicus
tcggaagccaagatatggtgagcgc

SEQ ID NO: 570785 - DNA, 25 bp, Rattus norvegicus
tgagcgcggggccattgacccagat

SEQ ID NO: 570786 - DNA, 25 bp, Rattus norvegicus
ccattgacccagatggagaggaatg

SEQ ID NO: 570787 - DNA, 25 bp, Rattus norvegicus
agaggaatggcagctattggctctc

SEQ ID NO: 570788 - DNA, 25 bp, Rattus norvegicus
agctattggctctccgcttctgcca

SEQ ID NO: 570789 - DNA, 25 bp, Rattus norvegicus
gcttctgccaagctaggcctgctgc

SEQ ID NO: 570790 - DNA, 25 bp, Rattus norvegicus
aggcctgctgcttcggcggccacta

SEQ ID NO: 570791 - DNA, 25 bp, Rattus norvegicus
cggccactaggtcgctacttatgta

SEQ ID NO: 570792 - DNA, 25 bp, Rattus norvegicus
ctgtgcagagctcaaggtgccgcag

SEQ ID NO: 570793 - DNA, 25 bp, Rattus norvegicus
gccgcagattctgtaacgagtctta

SEQ ID NO: 570794 - DNA, 25 bp, Rattus norvegicus
ctccgcccagtgctggggtagcttc

SEQ ID NO: 570795 - DNA, 25 bp, Rattus norvegicus
gtcttaagcaggcatcgcgtggtcc

SEQ ID NO: 570796 - DNA, 25 bp, Rattus norvegicus
tagcatgggcgagctccgcaaccgc

SEQ ID NO: 570797 - DNA, 25 bp, Rattus norvegicus
agcggccagctgagccgcgtgatcc

SEQ ID NO: 570798 - DNA, 25 bp, Rattus norvegicus
cggcctagcggacaccctgttcatt

SEQ ID NO: 570799 - DNA, 25 bp, Rattus norvegicus
tcattccatggggaaacatgggccc

SEQ ID NO: 570800 - DNA, 25 bp, Rattus norvegicus
tcaccgccagtccttgtctcggagg

SEQ ID NO: 570801 - DNA, 25 bp, Rattus norvegicus
ccttgtctcggaggacccttgtcac

SEQ ID NO: 570802 - DNA, 25 bp, Rattus norvegicus
cggaggacccttgtcacttccgctt

SEQ ID NO: 570803 - DNA, 25 bp, Rattus norvegicus
ttttccggccatgtctgcgcaaagc

SEQ ID NO: 570804 - DNA, 25 bp, Rattus norvegicus
ttggtgacgtcaccgcccagtgcta

SEQ ID NO: 570805 - DNA, 25 bp, Rattus norvegicus
ggacaccctgttcattccatgggga

SEQ ID NO: 570806 - DNA, 25 bp, Rattus norvegicus
gccgccatgccgcagattctgtaac

SEQ ID NO: 570807 - DNA, 25 bp, Rattus norvegicus
cagccacagcgaagggtagcacacc

SEQ ID NO: 570808 - DNA, 25 bp, Rattus norvegicus
cactcgggaaaacgtgcgcggccga

SEQ ID NO: 570809 - DNA, 25 bp, Rattus norvegicus
ctgtgggcagacgagctcagacaca

SEQ ID NO: 570810 - DNA, 25 bp, Rattus norvegicus
gacgagctcagacacagagcgaccc

SEQ ID NO: 570811 - DNA, 25 bp, Rattus norvegicus
gttacctgcctagggctcgcggctt

SEQ ID NO: 570812 - DNA, 25 bp, Rattus norvegicus
tcgcggcttcgccttttaaactcca

SEQ ID NO: 570813 - DNA, 25 bp, Rattus norvegicus
aactccaatcttctaacgaagccga

SEQ ID NO: 570814 - DNA, 25 bp, Rattus norvegicus
cgaagccgaactttccaggacgccg

SEQ ID NO: 570815 - DNA, 25 bp, Rattus norvegicus
ggctaaacctccctgtctggggaca

SEQ ID NO: 570816 - DNA, 25 bp, Rattus norvegicus
aacctccctgtctggggacagcggc

SEQ ID NO: 570817 - DNA, 25 bp, Rattus norvegicus
attccctcagttcagggctgcggca

SEQ ID NO: 570818 - DNA, 25 bp, Rattus norvegicus
ctccgcttcccagcggagagaacag

SEQ ID NO: 570819 - DNA, 25 bp, Rattus norvegicus
acgttatctgcaagctgtcacagcc

SEQ ID NO: 570820 - DNA, 25 bp, Rattus norvegicus
gacagcggctccgagctcaccatgg

SEQ ID NO: 570821 - DNA, 25 bp, Rattus norvegicus
ctgtcctctgacgggaggagcgatc

SEQ ID NO: 570822 - DNA, 25 bp, Rattus norvegicus
ggcgagttcggagccgcgccatggt

SEQ ID NO: 570823 - DNA, 25 bp, Rattus norvegicus
agggagccagtgcactgatgacgtc

SEQ ID NO: 570824 - DNA, 25 bp, Rattus norvegicus
tcttccgcgtcagagctgagccgga

SEQ ID NO: 570825 - DNA, 25 bp, Rattus norvegicus
atcctcttccgcgtcagagctgagc

SEQ ID NO: 570826 - DNA, 25 bp, Rattus norvegicus
ggtacttccgccctgatcctcttcc

SEQ ID NO: 570827 - DNA, 25 bp, Rattus norvegicus
agcccgtaggtacttccgccctgat

SEQ ID NO: 570828 - DNA, 25 bp, Rattus norvegicus
ctgcctgagcccgtaggtacttccg

SEQ ID NO: 570829 - DNA, 25 bp, Rattus norvegicus
actgatgacgtcacgactcgggctg

SEQ ID NO: 570830 - DNA, 25 bp, Rattus norvegicus
tgagcgagggccgctgtcctctgac

SEQ ID NO: 570831 - DNA, 25 bp, Rattus norvegicus
agcgatcggttgagccgcggaagcc

SEQ ID NO: 570832 - DNA, 25 bp, Rattus norvegicus
agccagtgcactgatgacgtcacga

SEQ ID NO: 570833 - DNA, 25 bp, Rattus norvegicus
agtgcactgatgacgtcacgactcg

SEQ ID NO: 570834 - DNA, 25 bp, Rattus norvegicus
agagggactgcgacccctaggcctc

SEQ ID NO: 570835 - DNA, 25 bp, Rattus norvegicus
ctctgctatccgagtgactggggcc

SEQ ID NO: 570836 - DNA, 25 bp, Rattus norvegicus
gacaggttccttgtgccttgcggct

SEQ ID NO: 570837 - DNA, 25 bp, Rattus norvegicus
ccaaggggcgcagaatcctctgggt

SEQ ID NO: 570838 - DNA, 25 bp, Rattus norvegicus
cagcaccttgttggcgggcaccaag

SEQ ID NO: 570839 - DNA, 25 bp, Rattus norvegicus
gggcaccaagtgactgggtcccgca

SEQ ID NO: 570840 - DNA, 25 bp, Rattus norvegicus
aagtgactgggtcccgcacctttgc

SEQ ID NO: 570841 - DNA, 25 bp, Rattus norvegicus
cagtggagccgcaccggtttgctgt

SEQ ID NO: 570842 - DNA, 25 bp, Rattus norvegicus
gcaccggtttgctgtcctgcttcgg

SEQ ID NO: 570843 - DNA, 25 bp, Rattus norvegicus
gctgtcctgcttcggggtcccaggt

SEQ ID NO: 570844 - DNA, 25 bp, Rattus norvegicus
tcccgggctgcttgtgggccactgt

SEQ ID NO: 570845 - DNA, 25 bp, Rattus norvegicus
ctgcttgtgggccactgtccgcggc

SEQ ID NO: 570846 - DNA, 25 bp, Rattus norvegicus
gggcctgaaggctctgctatccgag

SEQ ID NO: 570847 - DNA, 25 bp, Rattus norvegicus
ttgtgtgtgccgcacctgtgctctg

SEQ ID NO: 570848 - DNA, 25 bp, Rattus norvegicus
acgcgcttgtgcgagctgcgctgcc

SEQ ID NO: 570849 - DNA, 25 bp, Rattus norvegicus
tctgtgcttctgctaagcgctgaga

SEQ ID NO: 570850 - DNA, 25 bp, Rattus norvegicus
tctgagtgggagccagtggccaaat

SEQ ID NO: 570851 - DNA, 25 bp, Rattus norvegicus
aagcccgtgcggtggtccgtccctg

SEQ ID NO: 570852 - DNA, 25 bp, Rattus norvegicus
cctgactctgttctccgagttggtg

SEQ ID NO: 570853 - DNA, 25 bp, Rattus norvegicus
tctgttctccgagttggtgctggca

SEQ ID NO: 570854 - DNA, 25 bp, Rattus norvegicus
tggcagttctgtgcttctgctaagc

SEQ ID NO: 570855 - DNA, 25 bp, Rattus norvegicus
cgtgctcctgactctgttctccgag

SEQ ID NO: 570856 - DNA, 25 bp, Rattus norvegicus
ttctgctaagcgctgagagggctac

SEQ ID NO: 570857 - DNA, 25 bp, Rattus norvegicus
ctgagagggctacgcgcgcaaactt

SEQ ID NO: 570858 - DNA, 25 bp, Rattus norvegicus
gctacgcgcgcaaacttggaggcta

SEQ ID NO: 570859 - DNA, 25 bp, Rattus norvegicus
gcgcgcaaacttggaggctacgata

SEQ ID NO: 570860 - DNA, 25 bp, Rattus norvegicus
cttggaggctacgatatggtgagcc

SEQ ID NO: 570861 - DNA, 25 bp, Rattus norvegicus
ccagggacggctgtctgaagagaaa

SEQ ID NO: 570862 - DNA, 25 bp, Rattus norvegicus
tctccgagttggtgctggcagttct

SEQ ID NO: 570863 - DNA, 25 bp, Rattus norvegicus
caagccgaatgcctccgcctccggt

SEQ ID NO: 570864 - DNA, 25 bp, Rattus norvegicus
gcctgtgtgcccaagagaagtttaa

SEQ ID NO: 570865 - DNA, 25 bp, Rattus norvegicus
gacaagccgaatgcctccgcctccg

SEQ ID NO: 570866 - DNA, 25 bp, Rattus norvegicus
cgacaagccgaatgcctccgcctcc

SEQ ID NO: 570867 - DNA, 25 bp, Rattus norvegicus
cctcctgcctgtgtgcccaagagaa

SEQ ID NO: 570868 - DNA, 25 bp, Rattus norvegicus
tgcctgtgtgcccaagagaagttta

SEQ ID NO: 570869 - DNA, 25 bp, Rattus norvegicus
cctgtgtgcccaagagaagtttaat

SEQ ID NO: 570870 - DNA, 25 bp, Rattus norvegicus
cccgtggcaggcgggttagtgtgca

SEQ ID NO: 570871 - DNA, 25 bp, Rattus norvegicus
ctcctgggcgacaagccgaatgcct

SEQ ID NO: 570872 - DNA, 25 bp, Rattus norvegicus
tcctgggcgacaagccgaatgcctc

SEQ ID NO: 570873 - DNA, 25 bp, Rattus norvegicus
cctgggcgacaagccgaatgcctcc

SEQ ID NO: 570874 - DNA, 25 bp, Rattus norvegicus
gcgacaagccgaatgcctccgcctc

SEQ ID NO: 570875 - DNA, 25 bp, Rattus norvegicus
tgggcgacaagccgaatgcctccgc

SEQ ID NO: 570876 - DNA, 25 bp, Rattus norvegicus
ctgggcgacaagccgaatgcctccg

SEQ ID NO: 570877 - DNA, 25 bp, Rattus norvegicus
gaaactcacagtcgccctgggccga

SEQ ID NO: 570878 - DNA, 25 bp, Rattus norvegicus
ccttccggtgggtactctgagcacc

SEQ ID NO: 570879 - DNA, 25 bp, Rattus norvegicus
ctccaagttgggttcgaaaggtgcg

SEQ ID NO: 570880 - DNA, 25 bp, Rattus norvegicus
ccggtctgactcacctggatgttga

SEQ ID NO: 570881 - DNA, 25 bp, Rattus norvegicus
gggctcgctgcaccagaaactcaca

SEQ ID NO: 570882 - DNA, 25 bp, Rattus norvegicus
aagctgcagcggctctagagagtcc

SEQ ID NO: 570883 - DNA, 25 bp, Rattus norvegicus
tgcccagagaccagccaatcacaag

SEQ ID NO: 570884 - DNA, 25 bp, Rattus norvegicus
gtcctctggaaactccggaagactg

SEQ ID NO: 570885 - DNA, 25 bp, Rattus norvegicus
ctggatttccatctctcggattgtc

SEQ ID NO: 570886 - DNA, 25 bp, Rattus norvegicus
ttgtcatcacttggctagcagcgcg

SEQ ID NO: 570887 - DNA, 25 bp, Rattus norvegicus
aagcgccggatcctgcaatcttgtg

SEQ ID NO: 570888 - DNA, 25 bp, Rattus norvegicus
tcttgtgctccaggttcttgcgttc

SEQ ID NO: 570889 - DNA, 25 bp, Rattus norvegicus
tgcgttctccttggactccaagttg

SEQ ID NO: 570890 - DNA, 25 bp, Rattus norvegicus
gctgtgatcagccacgccttggctg

SEQ ID NO: 570891 - DNA, 25 bp, Rattus norvegicus
tttctctgatactcctcggaggaga

SEQ ID NO: 570892 - DNA, 25 bp, Rattus norvegicus
aaaacccgggcgagcttgctccata

SEQ ID NO: 570893 - DNA, 25 bp, Rattus norvegicus
ccgggtggcggaatttctctgatac

SEQ ID NO: 570894 - DNA, 25 bp, Rattus norvegicus
tcgttttctgtcatgcgaattcctc

SEQ ID NO: 570895 - DNA, 25 bp, Rattus norvegicus
tccttcctgagagtccgatccgacg

SEQ ID NO: 570896 - DNA, 25 bp, Rattus norvegicus
gttcaggcggataagatcgtctttc

SEQ ID NO: 570897 - DNA, 25 bp, Rattus norvegicus
gaattcctcttggtccgcaccgcgg

SEQ ID NO: 570898 - DNA, 25 bp, Rattus norvegicus
atcgtctttcgtcgtcggtgtttgc

SEQ ID NO: 570899 - DNA, 25 bp, Rattus norvegicus
gagttgtgaagagctagccggccct

SEQ ID NO: 570900 - DNA, 25 bp, Rattus norvegicus
tgccgcttctgctgttgagttgtga

SEQ ID NO: 570901 - DNA, 25 bp, Rattus norvegicus
ccgtcgtgttctactggtctgggct

SEQ ID NO: 570902 - DNA, 25 bp, Rattus norvegicus
tttgtctgatctgcttggcctgccg

SEQ ID NO: 570903 - DNA, 25 bp, Rattus norvegicus
ggggcctttgcctttgtctgatctg

SEQ ID NO: 570904 - DNA, 25 bp, Rattus norvegicus
cctgttggaccagctcatgggcacg

SEQ ID NO: 570905 - DNA, 25 bp, Rattus norvegicus
agctgaccagagtgctgggagcgcg

SEQ ID NO: 570906 - DNA, 25 bp, Rattus norvegicus
cacgttcccgtactcactgagacga

SEQ ID NO: 570907 - DNA, 25 bp, Rattus norvegicus
ctagcgtgcgatagggagctgacca

SEQ ID NO: 570908 - DNA, 25 bp, Rattus norvegicus
tcccgtactcactgagacgaggctg

SEQ ID NO: 570909 - DNA, 25 bp, Rattus norvegicus
tactcactgagacgaggctgggaga

SEQ ID NO: 570910 - DNA, 25 bp, Rattus norvegicus
ctgggagaggtagttccggctcacc

SEQ ID NO: 570911 - DNA, 25 bp, Rattus norvegicus
aggtagttccggctcaccgccagcg

SEQ ID NO: 570912 - DNA, 25 bp, Rattus norvegicus
ctgctcccgagctccggccatcggc

SEQ ID NO: 570913 - DNA, 25 bp, Rattus norvegicus
atcggcccaccggtgggcacgggca

SEQ ID NO: 570914 - DNA, 25 bp, Rattus norvegicus
gcatcgctcgcaacgccatcttgtc

SEQ ID NO: 570915 - DNA, 25 bp, Rattus norvegicus
atcttgtctcctccgtcccgactgg

SEQ ID NO: 570916 - DNA, 25 bp, Rattus norvegicus
caggcgcagatatagcagggaggcc

SEQ ID NO: 570917 - DNA, 25 bp, Rattus norvegicus
cccagactcgtgactggagttctgc

SEQ ID NO: 570918 - DNA, 25 bp, Rattus norvegicus
gctcacgttcccgtactcactgaga

SEQ ID NO: 570919 - DNA, 25 bp, Rattus norvegicus
gtcgagtaacccgagcgttccaggc

SEQ ID NO: 570920 - DNA, 25 bp, Rattus norvegicus
cagctctccaggtcgagtaacccga

SEQ ID NO: 570921 - DNA, 25 bp, Rattus norvegicus
agctctccaggtcgagtaacccgag

SEQ ID NO: 570922 - DNA, 25 bp, Rattus norvegicus
ctctccaggtcgagtaacccgagcg

SEQ ID NO: 570923 - DNA, 25 bp, Rattus norvegicus
tctccaggtcgagtaacccgagcgt

SEQ ID NO: 570924 - DNA, 25 bp, Rattus norvegicus
ctccaggtcgagtaacccgagcgtt

SEQ ID NO: 570925 - DNA, 25 bp, Rattus norvegicus
caggtcgagtaacccgagcgttcca

SEQ ID NO: 570926 - DNA, 25 bp, Rattus norvegicus
tcgagtaacccgagcgttccaggcc

SEQ ID NO: 570927 - DNA, 25 bp, Rattus norvegicus
aacccgagcgttccaggcccttgtg

SEQ ID NO: 570928 - DNA, 25 bp, Rattus norvegicus
gcgttccaggcccttgtgcctttaa

SEQ ID NO: 570929 - DNA, 25 bp, Rattus norvegicus
ccttgtgcctttaagagtgcctggc

SEQ ID NO: 570930 - DNA, 25 bp, Rattus norvegicus
cttgtgcctttaagagtgcctggcg

SEQ ID NO: 570931 - DNA, 25 bp, Rattus norvegicus
ttgtgcctttaagagtgcctggcgg

SEQ ID NO: 570932 - DNA, 25 bp, Rattus norvegicus
tccaggtcgagtaacccgagcgttc

SEQ ID NO: 570933 - DNA, 25 bp, Rattus norvegicus
gatccgcgttgcaaagggttgagcc

SEQ ID NO: 570934 - DNA, 25 bp, Rattus norvegicus
ctgacccgtagtcccagcaaagtta

SEQ ID NO: 570935 - DNA, 25 bp, Rattus norvegicus
cccttctgctttgctgctggaactg

SEQ ID NO: 570936 - DNA, 25 bp, Rattus norvegicus
ctggcgcgaaaaacataccgtctgc

SEQ ID NO: 570937 - DNA, 25 bp, Rattus norvegicus
gcgcctgcttagtgcacgtcctttc

SEQ ID NO: 570938 - DNA, 25 bp, Rattus norvegicus
tcccgggaatctctttggctattgc

SEQ ID NO: 570939 - DNA, 25 bp, Rattus norvegicus
ggttaccaccgatcactacagcttc

SEQ ID NO: 570940 - DNA, 25 bp, Rattus norvegicus
agttagggtcaccttggcccacatg

SEQ ID NO: 570941 - DNA, 25 bp, Rattus norvegicus
gtttcccaggactccgtgccatgcg

SEQ ID NO: 570942 - DNA, 25 bp, Rattus norvegicus
gttggaatgcacacaacgcgtcctc

SEQ ID NO: 570943 - DNA, 25 bp, Rattus norvegicus
cccactgcctatgaggaggttacca

SEQ ID NO: 570944 - DNA, 25 bp, Rattus norvegicus
gcgacagtgccctatgcagttggaa

SEQ ID NO: 570945 - DNA, 25 bp, Rattus norvegicus
tcttcccgcctacagaggggtctga

SEQ ID NO: 570946 - DNA, 25 bp, Rattus norvegicus
tagcccatagccgagagcgacagtg

SEQ ID NO: 570947 - DNA, 25 bp, Rattus norvegicus
accactcgggctcgtggttcctcgg

SEQ ID NO: 570948 - DNA, 25 bp, Rattus norvegicus
agtgcttggacgctgttcagcccgc

SEQ ID NO: 570949 - DNA, 25 bp, Rattus norvegicus
actgcccgctgtagccctggctagg

SEQ ID NO: 570950 - DNA, 25 bp, Rattus norvegicus
tagggctgaggactcccggatcact

SEQ ID NO: 570951 - DNA, 25 bp, Rattus norvegicus
gaccactgctgcctagggctgagga

SEQ ID NO: 570952 - DNA, 25 bp, Rattus norvegicus
agctggcttccatcgaccactgctg

SEQ ID NO: 570953 - DNA, 25 bp, Rattus norvegicus
tactgctccggatccctggaggctc

SEQ ID NO: 570954 - DNA, 25 bp, Rattus norvegicus
ctctctgtcagtcgggaggacgcac

SEQ ID NO: 570955 - DNA, 25 bp, Rattus norvegicus
tcgacctccgggtggctctctgtca

SEQ ID NO: 570956 - DNA, 25 bp, Rattus norvegicus
gtatgtcgctgccttttgcctgtcc

SEQ ID NO: 570957 - DNA, 25 bp, Rattus norvegicus
tggcccgctgttttgcgggtatgtc

SEQ ID NO: 570958 - DNA, 25 bp, Rattus norvegicus
ggctccgctgtctgcagggttgctt

SEQ ID NO: 570959 - DNA, 25 bp, Rattus norvegicus
gatccctggaggctcagcggctgtt

SEQ ID NO: 570960 - DNA, 25 bp, Rattus norvegicus
ggacgcactcacagctggcttccat

SEQ ID NO: 570961 - DNA, 25 bp, Rattus norvegicus
ccgctgctctctgtaccacgtgagg

SEQ ID NO: 570962 - DNA, 25 bp, Rattus norvegicus
tctgcttgtgctgaaaccggtttca

SEQ ID NO: 570963 - DNA, 25 bp, Rattus norvegicus
accggtttcaggactcttgtctgga

SEQ ID NO: 570964 - DNA, 25 bp, Rattus norvegicus
tgcccagtgattggacctccgctga

SEQ ID NO: 570965 - DNA, 25 bp, Rattus norvegicus
cctccgctgatttgtgggtactgta

SEQ ID NO: 570966 - DNA, 25 bp, Rattus norvegicus
agcactcgccgcgtgtgcatgcaca

SEQ ID NO: 570967 - DNA, 25 bp, Rattus norvegicus
tgcacagcccggacgggacaacttt

SEQ ID NO: 570968 - DNA, 25 bp, Rattus norvegicus
tggacaccctacacgagacatcgga

SEQ ID NO: 570969 - DNA, 25 bp, Rattus norvegicus
gctgtctggacaaacactcgggccc

SEQ ID NO: 570970 - DNA, 25 bp, Rattus norvegicus
tgcctacagcaactccaggaagaga

SEQ ID NO: 570971 - DNA, 25 bp, Rattus norvegicus
cctggctctatgctccagcgtttta

SEQ ID NO: 570972 - DNA, 25 bp, Rattus norvegicus
agagacgcatctcctggttcccact

SEQ ID NO: 570973 - DNA, 25 bp, Rattus norvegicus
tgtgcttcacccttcgctctagaga

SEQ ID NO: 570974 - DNA, 25 bp, Rattus norvegicus
acacccgcagccgttgtggtctgtt

SEQ ID NO: 570975 - DNA, 25 bp, Rattus norvegicus
agctgcgaccctgaggagacgcacg

SEQ ID NO: 570976 - DNA, 25 bp, Rattus norvegicus
cacggtctcggtcgctaacgccggg

SEQ ID NO: 570977 - DNA, 25 bp, Rattus norvegicus
tctccgagaggaaacgcccgcgagc

SEQ ID NO: 570978 - DNA, 25 bp, Rattus norvegicus
agaaacgccgcggtgagctcgccct

SEQ ID NO: 570979 - DNA, 25 bp, Rattus norvegicus
tcccggggcgcgcaacaaagagccg

SEQ ID NO: 570980 - DNA, 25 bp, Rattus norvegicus
tgctcgccacggtctcggtcgctaa

SEQ ID NO: 570981 - DNA, 25 bp, Rattus norvegicus
gccttcgccttgacgttgccggggc

SEQ ID NO: 570982 - DNA, 25 bp, Rattus norvegicus
gcaggacactactccgcggagccga

SEQ ID NO: 570983 - DNA, 25 bp, Rattus norvegicus
agcagagggctgcaggacactactc

SEQ ID NO: 570984 - DNA, 25 bp, Rattus norvegicus
aggagacaaagcaacaggcagcaga

SEQ ID NO: 570985 - DNA, 25 bp, Rattus norvegicus
cgcgcggcgctctccgagaggaaac

SEQ ID NO: 570986 - DNA, 25 bp, Rattus norvegicus
cccatagctgcgaccctgaggagac

SEQ ID NO: 570987 - DNA, 25 bp, Rattus norvegicus
tcctcttaggtggacgcactcgctc

SEQ ID NO: 570988 - DNA, 25 bp, Rattus norvegicus
atggaagatggaaggaagaaacgcc

SEQ ID NO: 570989 - DNA, 25 bp, Rattus norvegicus
tctcctaagaagacgcgcacgcctt

SEQ ID NO: 570990 - DNA, 25 bp, Rattus norvegicus
caccgggtaccagtccgagagcacg

SEQ ID NO: 570991 - DNA, 25 bp, Rattus norvegicus
agagcacgtgcgcagagcatcagct

SEQ ID NO: 570992 - DNA, 25 bp, Rattus norvegicus
acctgtccgaatccgagtccgatga

SEQ ID NO: 570993 - DNA, 25 bp, Rattus norvegicus
cgatgagtccgagtcctgcagctct

SEQ ID NO: 570994 - DNA, 25 bp, Rattus norvegicus
tgggttttcaccagcatccgagctc

SEQ ID NO: 570995 - DNA, 25 bp, Rattus norvegicus
ccgccgaacttgagcgtctgcagct

SEQ ID NO: 570996 - DNA, 25 bp, Rattus norvegicus
gaggaaacttggcttccgcgcggtc

SEQ ID NO: 570997 - DNA, 25 bp, Rattus norvegicus
gacgagctcgaggttctcctaagaa

SEQ ID NO: 570998 - DNA, 25 bp, Rattus norvegicus
gtctctcaggtaaccgcacggcgtc

SEQ ID NO: 570999 - DNA, 25 bp, Rattus norvegicus
gcacggcgtcattcacgggacttcc

SEQ ID NO: 571000 - DNA, 25 bp, Rattus norvegicus
tcacggacgagacgtaggctcccag

SEQ ID NO: 571001 - DNA, 25 bp, Rattus norvegicus
cagggactggaggatttgaagtaca

SEQ ID NO: 571002 - DNA, 25 bp, Rattus norvegicus
ccgcacgggcctaagacgagctcga

SEQ ID NO: 571003 - DNA, 25 bp, Rattus norvegicus
agggactgtcacgtgttcccgaggc

SEQ ID NO: 571004 - DNA, 25 bp, Rattus norvegicus
tgtccggggtctcagggactgtcac

SEQ ID NO: 571005 - DNA, 25 bp, Rattus norvegicus
ggtctcagggactgtcacgtgttcc

SEQ ID NO: 571006 - DNA, 25 bp, Rattus norvegicus
agcgaccgcgctcagccacgtaccc

SEQ ID NO: 571007 - DNA, 25 bp, Rattus norvegicus
ggggcatcccgaggtacccactcca

SEQ ID NO: 571008 - DNA, 25 bp, Rattus norvegicus
cacgtgttcccgaggcgcttctaaa

SEQ ID NO: 571009 - DNA, 25 bp, Rattus norvegicus
aggtacccactccaggcctcgcctg

SEQ ID NO: 571010 - DNA, 25 bp, Rattus norvegicus
gagcagaagcgaccgcgctcagcca

SEQ ID NO: 571011 - DNA, 25 bp, Rattus norvegicus
catctggagcagaagcgaccgcgct

SEQ ID NO: 571012 - DNA, 25 bp, Rattus norvegicus
gccaccgcttccatctggagcagaa

SEQ ID NO: 571013 - DNA, 25 bp, Rattus norvegicus
tccaggtcctgctcctgccgccacc

SEQ ID NO: 571014 - DNA, 25 bp, Rattus norvegicus
cccaccaccgcctccaggtcctgct

SEQ ID NO: 571015 - DNA, 25 bp, Rattus norvegicus
aggcgcttctaaaaccctggcggct

SEQ ID NO: 571016 - DNA, 25 bp, Rattus norvegicus
ccgaggcgcttctaaaaccctggcg

SEQ ID NO: 571017 - DNA, 25 bp, Rattus norvegicus
cggtgcagagctatgggtgcctgcc

SEQ ID NO: 571018 - DNA, 25 bp, Rattus norvegicus
ctcggtggccaggacatcgccatgg

SEQ ID NO: 571019 - DNA, 25 bp, Rattus norvegicus
catcgccatggtgggcggcccttta

SEQ ID NO: 571020 - DNA, 25 bp, Rattus norvegicus
cctttaggttctccgggaggctctg

SEQ ID NO: 571021 - DNA, 25 bp, Rattus norvegicus
gaagtacaagttcggaccccagaga

SEQ ID NO: 571022 - DNA, 25 bp, Rattus norvegicus
ccgggacttgtagtgactgcacggg

SEQ ID NO: 571023 - DNA, 25 bp, Rattus norvegicus
tgcctgcccggggatagaagtgctc

SEQ ID NO: 571024 - DNA, 25 bp, Rattus norvegicus
gggatagaagtgctctcgcgctttc

SEQ ID NO: 571025 - DNA, 25 bp, Rattus norvegicus
agtgctctcgcgctttctcaactcg

SEQ ID NO: 571026 - DNA, 25 bp, Rattus norvegicus
tcgcgctttctcaactcgctttagg

SEQ ID NO: 571027 - DNA, 25 bp, Rattus norvegicus
gctttctcaactcgctttagggtgg

SEQ ID NO: 571028 - DNA, 25 bp, Rattus norvegicus
ttagggtggcgttgtccgcttctcc

SEQ ID NO: 571029 - DNA, 25 bp, Rattus norvegicus
catctggatatcgcggggcctcggt

SEQ ID NO: 571030 - DNA, 25 bp, Rattus norvegicus
caactcgctttagggtggcgttgtc

SEQ ID NO: 571031 - DNA, 25 bp, Rattus norvegicus
gaccgctgtcaatcgcggggcacca

SEQ ID NO: 571032 - DNA, 25 bp, Rattus norvegicus
cctccagctgcgctgccgcgcgatc

SEQ ID NO: 571033 - DNA, 25 bp, Rattus norvegicus
ggccgcgcgggtctcacttatcctt

SEQ ID NO: 571034 - DNA, 25 bp, Rattus norvegicus
taaggagctctctagcccgagccgg

SEQ ID NO: 571035 - DNA, 25 bp, Rattus norvegicus
tcaatcgcggggcaccaggtaagga

SEQ ID NO: 571036 - DNA, 25 bp, Rattus norvegicus
tctttcgccgagaccgctgtcaatc

SEQ ID NO: 571037 - DNA, 25 bp, Rattus norvegicus
cccgccctgtcacgccgtcacgcgc

SEQ ID NO: 571038 - DNA, 25 bp, Rattus norvegicus
aggccgctgcacctgcccggtcttt

SEQ ID NO: 571039 - DNA, 25 bp, Rattus norvegicus
cccgagccgatggaggtagtgagaa

SEQ ID NO: 571040 - DNA, 25 bp, Rattus norvegicus
aggagcacccggtcacggcctccgg

SEQ ID NO: 571041 - DNA, 25 bp, Rattus norvegicus
ggaccaattacgacaggagcacccg

SEQ ID NO: 571042 - DNA, 25 bp, Rattus norvegicus
ggcggaccaattacgacaggagcac

SEQ ID NO: 571043 - DNA, 25 bp, Rattus norvegicus
agtcacacgctgtccggcctcggcg

SEQ ID NO: 571044 - DNA, 25 bp, Rattus norvegicus
ggcaccaggtaaggagctctctagc

SEQ ID NO: 571045 - DNA, 25 bp, Rattus norvegicus
ggcccggcgcttggcttcagcttct

SEQ ID NO: 571046 - DNA, 25 bp, Rattus norvegicus
gcttcttccctctgtatctacgctt

SEQ ID NO: 571047 - DNA, 25 bp, Rattus norvegicus
gtatctacgcttcccacgcgagttc

SEQ ID NO: 571048 - DNA, 25 bp, Rattus norvegicus
ctcccgcaggatgggggacaacact

SEQ ID NO: 571049 - DNA, 25 bp, Rattus norvegicus
tcccttccagaggagccaggagcac

SEQ ID NO: 571050 - DNA, 25 bp, Rattus norvegicus
cagcaggggcaataagctgctcttc

SEQ ID NO: 571051 - DNA, 25 bp, Rattus norvegicus
atcagcgtgatcctggtgagctcgg

SEQ ID NO: 571052 - DNA, 25 bp, Rattus norvegicus
cccatcagcgtgatcctggtgagct

SEQ ID NO: 571053 - DNA, 25 bp, Rattus norvegicus
agcgtcgctcggtgaagtctcgcga

SEQ ID NO: 571054 - DNA, 25 bp, Rattus norvegicus
ggtatcccttccagaggagccagga

SEQ ID NO: 571055 - DNA, 25 bp, Rattus norvegicus
cccgcgtcccagacaagtaagtggc

SEQ ID NO: 571056 - DNA, 25 bp, Rattus norvegicus
cccagacaagtaagtggcgcctggc

SEQ ID NO: 571057 - DNA, 25 bp, Rattus norvegicus
agctgctcttcaggtatcccttcca

SEQ ID NO: 571058 - DNA, 25 bp, Rattus norvegicus
cttcaggtatcccttccagaggagc

SEQ ID NO: 571059 - DNA, 25 bp, Rattus norvegicus
ctgttagcggctgaagcccaggagc

SEQ ID NO: 571060 - DNA, 25 bp, Rattus norvegicus
cgccatcagcaggatctacacggtg

SEQ ID NO: 571061 - DNA, 25 bp, Rattus norvegicus
gaaacgaacgtcagcctctccatcg

SEQ ID NO: 571062 - DNA, 25 bp, Rattus norvegicus
tgggaaggaaacgaacgtcagcctc

SEQ ID NO: 571063 - DNA, 25 bp, Rattus norvegicus
tccatgagcccggtaagtgcgctgc

SEQ ID NO: 571064 - DNA, 25 bp, Rattus norvegicus
tggtcatcgagctgtctgacaaccc

SEQ ID NO: 571065 - DNA, 25 bp, Rattus norvegicus
gccgggagctcctggtcatcgagct

SEQ ID NO: 571066 - DNA, 25 bp, Rattus norvegicus
agtgcaccgccatcagcaggatcta

SEQ ID NO: 571067 - DNA, 25 bp, Rattus norvegicus
gaggacggcatctccttcgagtacc

SEQ ID NO: 571068 - DNA, 25 bp, Rattus norvegicus
gcagacaaaagagaccggcggtaca

SEQ ID NO: 571069 - DNA, 25 bp, Rattus norvegicus
gctggtgctgagctcgccaactcca

SEQ ID NO: 571070 - DNA, 25 bp, Rattus norvegicus
ttcattgagccgtggaaggtgagac

SEQ ID NO: 571071 - DNA, 25 bp, Rattus norvegicus
cagcgcgcaccgttcattgagccgt

SEQ ID NO: 571072 - DNA, 25 bp, Rattus norvegicus
tgtcggtatggctgcagtgcaccgc

SEQ ID NO: 571073 - DNA, 25 bp, Rattus norvegicus
gcactgagacatgtttgtaatcgtt

SEQ ID NO: 571074 - DNA, 25 bp, Rattus norvegicus
ttgactcaacagcactgagacatgt

SEQ ID NO: 571075 - DNA, 25 bp, Rattus norvegicus
ggctttgactcaacagcactgagac

SEQ ID NO: 571076 - DNA, 25 bp, Rattus norvegicus
ccgggctttgactcaacagcactga

SEQ ID NO: 571077 - DNA, 25 bp, Rattus norvegicus
tacccgggctttgactcaacagcac

SEQ ID NO: 571078 - DNA, 25 bp, Rattus norvegicus
caggaagcctggtacccgggctttg

SEQ ID NO: 571079 - DNA, 25 bp, Rattus norvegicus
ctgagacatgtttgtaatcgttggc

SEQ ID NO: 571080 - DNA, 25 bp, Rattus norvegicus
cgcaggaagcctggtacccgggctt

SEQ ID NO: 571081 - DNA, 25 bp, Rattus norvegicus
cgggactggaagtcgcaggaagcct

SEQ ID NO: 571082 - DNA, 25 bp, Rattus norvegicus
ttttctaggagagaccgagcgcagc

SEQ ID NO: 571083 - DNA, 25 bp, Rattus norvegicus
tgaattttctaggagagaccgagcg

SEQ ID NO: 571084 - DNA, 25 bp, Rattus norvegicus
ccgagtgaattttctaggagagacc

SEQ ID NO: 571085 - DNA, 25 bp, Rattus norvegicus
catgtttgtaatcgttggcgtgccc

SEQ ID NO: 571086 - DNA, 25 bp, Rattus norvegicus
gttcccgagtgaattttctaggaga

SEQ ID NO: 571087 - DNA, 25 bp, Rattus norvegicus
ttaataagagatgggtgagtggtcc

SEQ ID NO: 571088 - DNA, 25 bp, Rattus norvegicus
cccatccttacactgtggtcatgtc

SEQ ID NO: 571089 - DNA, 25 bp, Rattus norvegicus
gtcccatccttacactgtggtcatg

SEQ ID NO: 571090 - DNA, 25 bp, Rattus norvegicus
gtggtcccatccttacactgtggtc

SEQ ID NO: 571091 - DNA, 25 bp, Rattus norvegicus
tgagtggtcccatccttacactgtg

SEQ ID NO: 571092 - DNA, 25 bp, Rattus norvegicus
atgggtgagtggtcccatccttaca

SEQ ID NO: 571093 - DNA, 25 bp, Rattus norvegicus
tccttacactgtggtcatgtctatc

SEQ ID NO: 571094 - DNA, 25 bp, Rattus norvegicus
cacggataactctgatttaataaga

SEQ ID NO: 571095 - DNA, 25 bp, Rattus norvegicus
agacacggataactctgatttaata

SEQ ID NO: 571096 - DNA, 25 bp, Rattus norvegicus
tttcaatagacacggataactctga

SEQ ID NO: 571097 - DNA, 25 bp, Rattus norvegicus
gcatttcaatagacacggataactc

SEQ ID NO: 571098 - DNA, 25 bp, Rattus norvegicus
ccctgcatttcaatagacacggata

SEQ ID NO: 571099 - DNA, 25 bp, Rattus norvegicus
tttaccctgcatttcaatagacacg

SEQ ID NO: 571100 - DNA, 25 bp, Rattus norvegicus
ggtgagtggtcccatccttacactg

SEQ ID NO: 571101 - DNA, 25 bp, Rattus norvegicus
gaagacacccgcatgtctccggaca

SEQ ID NO: 571102 - DNA, 25 bp, Rattus norvegicus
gagaagagcactgtccctagagccc

SEQ ID NO: 571103 - DNA, 25 bp, Rattus norvegicus
tcccagtggggagaagagcactgtc

SEQ ID NO: 571104 - DNA, 25 bp, Rattus norvegicus
tttccgaggatcctcccagtgggga

SEQ ID NO: 571105 - DNA, 25 bp, Rattus norvegicus
actcaggtctttccgaggatcctcc

SEQ ID NO: 571106 - DNA, 25 bp, Rattus norvegicus
tgtctccggacacctgaacactcag

SEQ ID NO: 571107 - DNA, 25 bp, Rattus norvegicus
agggtccggaagacacccgcatgtc

SEQ ID NO: 571108 - DNA, 25 bp, Rattus norvegicus
gccctctctagggtccggaagacac

SEQ ID NO: 571109 - DNA, 25 bp, Rattus norvegicus
gcagcgtttgccctctctagggtcc

SEQ ID NO: 571110 - DNA, 25 bp, Rattus norvegicus
ggccgagctcctcacctgccttccg

SEQ ID NO: 571111 - DNA, 25 bp, Rattus norvegicus
ctggaaggacgacctggaccgtgcc

SEQ ID NO: 571112 - DNA, 25 bp, Rattus norvegicus
agttcggccgctggaaggacgacct

SEQ ID NO: 571113 - DNA, 25 bp, Rattus norvegicus
agccaggcagcgtttgccctctcta

SEQ ID NO: 571114 - DNA, 25 bp, Rattus norvegicus
ctgaacactcaggtctttccgagga

SEQ ID NO: 571115 - DNA, 25 bp, Rattus norvegicus
tgagggtcctattccgccagacttc

SEQ ID NO: 571116 - DNA, 25 bp, Rattus norvegicus
cggtgctgtgcacggccctccggat

SEQ ID NO: 571117 - DNA, 25 bp, Rattus norvegicus
cgtgttctatggatgcagagcccgc

SEQ ID NO: 571118 - DNA, 25 bp, Rattus norvegicus
cagctggtaagtggccgtgttctat

SEQ ID NO: 571119 - DNA, 25 bp, Rattus norvegicus
tttggtgtccagctggtaagtggcc

SEQ ID NO: 571120 - DNA, 25 bp, Rattus norvegicus
tcccaaagagcccagaagagcttct

SEQ ID NO: 571121 - DNA, 25 bp, Rattus norvegicus
acaacaggcgggatcccaaagagcc

SEQ ID NO: 571122 - DNA, 25 bp, Rattus norvegicus
tgcagtccagctgcctggctcgggt

SEQ ID NO: 571123 - DNA, 25 bp, Rattus norvegicus
gggacccacgtcctctgtgtctcta

SEQ ID NO: 571124 - DNA, 25 bp, Rattus norvegicus
tcaagttgcgttcggacaacaggcg

SEQ ID NO: 571125 - DNA, 25 bp, Rattus norvegicus
cgatctcaagccctcaagttgcgtt

SEQ ID NO: 571126 - DNA, 25 bp, Rattus norvegicus
gtgtctctaccgcagtctgcctgga

SEQ ID NO: 571127 - DNA, 25 bp, Rattus norvegicus
ggcgacccggctgcctgcgcattat

SEQ ID NO: 571128 - DNA, 25 bp, Rattus norvegicus
ctattccgccagacttcgttgttcg

SEQ ID NO: 571129 - DNA, 25 bp, Rattus norvegicus
atccggtcacttgggatcctgctct

SEQ ID NO: 571130 - DNA, 25 bp, Rattus norvegicus
tgcagcccgacccactgtgccagct

SEQ ID NO: 571131 - DNA, 25 bp, Rattus norvegicus
ggaatggatgctgacgtgaccgtct

SEQ ID NO: 571132 - DNA, 25 bp, Rattus norvegicus
gggctcagacttcgcgacgctgcgc

SEQ ID NO: 571133 - DNA, 25 bp, Rattus norvegicus
tggcatctggccgacctcacgagat

SEQ ID NO: 571134 - DNA, 25 bp, Rattus norvegicus
cgacctcacgagatccggtcacttg

SEQ ID NO: 571135 - DNA, 25 bp, Rattus norvegicus
tgccagctcgccgtgggctcagact

SEQ ID NO: 571136 - DNA, 25 bp, Rattus norvegicus
ggatcctgctctggcattccctggg

SEQ ID NO: 571137 - DNA, 25 bp, Rattus norvegicus
tcgtccaggaaatgcagggtgctcg

SEQ ID NO: 571138 - DNA, 25 bp, Rattus norvegicus
gacaccggttttagggatcctctgc

SEQ ID NO: 571139 - DNA, 25 bp, Rattus norvegicus
gttttagggatcctctgcccaggcg

SEQ ID NO: 571140 - DNA, 25 bp, Rattus norvegicus
tgacgtgaccgtctctgcagcccga

SEQ ID NO: 571141 - DNA, 25 bp, Rattus norvegicus
actgaagcctgagtctgcgcagaag

SEQ ID NO: 571142 - DNA, 25 bp, Rattus norvegicus
cccaggccaccggaagcgcagtgag

SEQ ID NO: 571143 - DNA, 25 bp, Rattus norvegicus
gtcctccggctccttcaactacgcg

SEQ ID NO: 571144 - DNA, 25 bp, Rattus norvegicus
agcagcggcagtagcgcaccaccgt

SEQ ID NO: 571145 - DNA, 25 bp, Rattus norvegicus
tcggagcccatgagcgcgctagcct

SEQ ID NO: 571146 - DNA, 25 bp, Rattus norvegicus
ccaagcagttcatcgcggcgcagaa

SEQ ID NO: 571147 - DNA, 25 bp, Rattus norvegicus
ttcatcgcggcgcagaacttgggtc

SEQ ID NO: 571148 - DNA, 25 bp, Rattus norvegicus
cgcagaacttgggtcccgcgtccgg

SEQ ID NO: 571149 - DNA, 25 bp, Rattus norvegicus
cccttcgtggaacccgaggccatgt

SEQ ID NO: 571150 - DNA, 25 bp, Rattus norvegicus
gtgccggacgtgtttccgctgccac

SEQ ID NO: 571151 - DNA, 25 bp, Rattus norvegicus
ttcagccctggccagacacctgcag

SEQ ID NO: 571152 - DNA, 25 bp, Rattus norvegicus
tgcagccttcctcagtgctctgctg

SEQ ID NO: 571153 - DNA, 25 bp, Rattus norvegicus
cgcctgtcgctgtcaacgccttggg

SEQ ID NO: 571154 - DNA, 25 bp, Rattus norvegicus
ctgtcaacgccttggggctgcccaa

SEQ ID NO: 571155 - DNA, 25 bp, Rattus norvegicus
ccgggtgtcccttgcaacagcagca

SEQ ID NO: 571156 - DNA, 25 bp, Rattus norvegicus
cttggggctgcccaagggcgtcacc

SEQ ID NO: 571157 - DNA, 25 bp, Rattus norvegicus
agcaccgatgagcaagacgagagtc

SEQ ID NO: 571158 - DNA, 25 bp, Rattus norvegicus
ggtaagactgcacagtggtttcatc

SEQ ID NO: 571159 - DNA, 25 bp, Rattus norvegicus
ccgtgcggctggaatgccgcgtttc

SEQ ID NO: 571160 - DNA, 25 bp, Rattus norvegicus
gggtgccgccacctcagatattctg

SEQ ID NO: 571161 - DNA, 25 bp, Rattus norvegicus
cgccacctcagatattctggaagaa

SEQ ID NO: 571162 - DNA, 25 bp, Rattus norvegicus
aatcgctcactcacagcactgatcg

SEQ ID NO: 571163 - DNA, 25 bp, Rattus norvegicus
cactgatcgagtgaggtaagactgc

SEQ ID NO: 571164 - DNA, 25 bp, Rattus norvegicus
ccatagcttgcgcagacccggggct

SEQ ID NO: 571165 - DNA, 25 bp, Rattus norvegicus
acccggggctagacggtacatcaga

SEQ ID NO: 571166 - DNA, 25 bp, Rattus norvegicus
cggtacatcagagactgcttgcaga

SEQ ID NO: 571167 - DNA, 25 bp, Rattus norvegicus
agagactgcttgcagatcggtgagc

SEQ ID NO: 571168 - DNA, 25 bp, Rattus norvegicus
ggagaagccacgttagcaccgatga

SEQ ID NO: 571169 - DNA, 25 bp, Rattus norvegicus
gagagtcacatgtcgtccaaatgtc

SEQ ID NO: 571170 - DNA, 25 bp, Rattus norvegicus
atcggtgagcggagaagccacgtta

SEQ ID NO: 571171 - DNA, 25 bp, Rattus norvegicus
ggtgtgcattgacgttcctttgtac

SEQ ID NO: 571172 - DNA, 25 bp, Rattus norvegicus
cataccttgtgacgggtgccacata

SEQ ID NO: 571173 - DNA, 25 bp, Rattus norvegicus
gctgagacgcctgcaaaagaatgga

SEQ ID NO: 571174 - DNA, 25 bp, Rattus norvegicus
gcctgcaaaagaatggagcgcctcc

SEQ ID NO: 571175 - DNA, 25 bp, Rattus norvegicus
ggagcgcctccatctagaacgtaga

SEQ ID NO: 571176 - DNA, 25 bp, Rattus norvegicus
agccgtcctggcaacgctcgaagac

SEQ ID NO: 571177 - DNA, 25 bp, Rattus norvegicus
gcgctaatccagtgtcataccttgt

SEQ ID NO: 571178 - DNA, 25 bp, Rattus norvegicus
tgccacatagttgccggggaaaacg

SEQ ID NO: 571179 - DNA, 25 bp, Rattus norvegicus
ttgccggggaaaacgccgatcttgc

SEQ ID NO: 571180 - DNA, 25 bp, Rattus norvegicus
cgccgatcttgctggtgtgcattga

SEQ ID NO: 571181 - DNA, 25 bp, Rattus norvegicus
gaagaccaaaaacatctcgcctttc

SEQ ID NO: 571182 - DNA, 25 bp, Rattus norvegicus
cgttcctttgtaccagccgtcctgg

SEQ ID NO: 571183 - DNA, 25 bp, Rattus norvegicus
tggcaacgctcgaagaccaaaaaca

SEQ ID NO: 571184 - DNA, 25 bp, Rattus norvegicus
ctagaacgtagaagagcgctaatcc

SEQ ID NO: 571185 - DNA, 25 bp, Rattus norvegicus
cgcttcgccaaggaattcgtggacg

SEQ ID NO: 571186 - DNA, 25 bp, Rattus norvegicus
agccgagagacagccttcacgtacg

SEQ ID NO: 571187 - DNA, 25 bp, Rattus norvegicus
agccttcacgtacgcggtgagcgct

SEQ ID NO: 571188 - DNA, 25 bp, Rattus norvegicus
agcgctgctggagtggtaaatgcca

SEQ ID NO: 571189 - DNA, 25 bp, Rattus norvegicus
tggtaaatgccatgagccgagcatg

SEQ ID NO: 571190 - DNA, 25 bp, Rattus norvegicus
tgccatgagccgagcatgtcgggaa

SEQ ID NO: 571191 - DNA, 25 bp, Rattus norvegicus
tcgggaaggcgagctgtctacctgt

SEQ ID NO: 571192 - DNA, 25 bp, Rattus norvegicus
caaggacttacctcgggactggctg

SEQ ID NO: 571193 - DNA, 25 bp, Rattus norvegicus
tcgactatggctaccgcttcgccaa

SEQ ID NO: 571194 - DNA, 25 bp, Rattus norvegicus
cgccaaggaattcgtggacgcacga

SEQ ID NO: 571195 - DNA, 25 bp, Rattus norvegicus
ggacgcacgagaaagggaacgaatc

SEQ ID NO: 571196 - DNA, 25 bp, Rattus norvegicus
gggaacgaatccacgccaagggctc

SEQ ID NO: 571197 - DNA, 25 bp, Rattus norvegicus
ccaagggctcctatgagagcgcacg

SEQ ID NO: 571198 - DNA, 25 bp, Rattus norvegicus
ttgcggggacaacatcgactatggc

SEQ ID NO: 571199 - DNA, 25 bp, Rattus norvegicus
tccgctgctcgcctttgttcgcggc

SEQ ID NO: 571200 - DNA, 25 bp, Rattus norvegicus
cggggatgagctcagcgacagtccc

SEQ ID NO: 571201 - DNA, 25 bp, Rattus norvegicus
cccgagacccggcagcttcggaaga

SEQ ID NO: 571202 - DNA, 25 bp, Rattus norvegicus
ttcccagcaggtccgggagacccaa

SEQ ID NO: 571203 - DNA, 25 bp, Rattus norvegicus
gcgcacaaccaggatgcggcgacca

SEQ ID NO: 571204 - DNA, 25 bp, Rattus norvegicus
actggagggacgcaccacagcgccg

SEQ ID NO: 571205 - DNA, 25 bp, Rattus norvegicus
cgcgcccggagcgaatggagctccc

SEQ ID NO: 571206 - DNA, 25 bp, Rattus norvegicus
tccgcctggccggtgcctggagact

SEQ ID NO: 571207 - DNA, 25 bp, Rattus norvegicus
cggtgcctggagactgactcttcac

SEQ ID NO: 571208 - DNA, 25 bp, Rattus norvegicus
ctggagactgactcttcacggtggc

SEQ ID NO: 571209 - DNA, 25 bp, Rattus norvegicus
actgactcttcacggtggccaggga

SEQ ID NO: 571210 - DNA, 25 bp, Rattus norvegicus
ctgccgggaaccgatcgcgctttgc

SEQ ID NO: 571211 - DNA, 25 bp, Rattus norvegicus
ctcgttcccagcaggtccgggagac

SEQ ID NO: 571212 - DNA, 25 bp, Rattus norvegicus
ctcccacccgcccagcgaggagggc

SEQ ID NO: 571213 - DNA, 25 bp, Rattus norvegicus
tgcacagggtgagttcctgggtacc

SEQ ID NO: 571214 - DNA, 25 bp, Rattus norvegicus
tggaaggctaccttccgcccaagtc

SEQ ID NO: 571215 - DNA, 25 bp, Rattus norvegicus
cctacccgcggtagatgcaagggcc

SEQ ID NO: 571216 - DNA, 25 bp, Rattus norvegicus
ggccgggccaacagcaagcagctga

SEQ ID NO: 571217 - DNA, 25 bp, Rattus norvegicus
agtcaacttgtagctgtgctgcagg

SEQ ID NO: 571218 - DNA, 25 bp, Rattus norvegicus
ttccgcctcgccacagtgactatgg

SEQ ID NO: 571219 - DNA, 25 bp, Rattus norvegicus
acgtcagcgcgcaagagtcaacttg

SEQ ID NO: 571220 - DNA, 25 bp, Rattus norvegicus
gtcactgtcgctggcgtgtgacgtc

SEQ ID NO: 571221 - DNA, 25 bp, Rattus norvegicus
ttgccgccctgaaaccatagcggta

SEQ ID NO: 571222 - DNA, 25 bp, Rattus norvegicus
ctcaaggtaaggacaccgcacgttg

SEQ ID NO: 571223 - DNA, 25 bp, Rattus norvegicus
gcggacgaaacaaacacagcggttc

SEQ ID NO: 571224 - DNA, 25 bp, Rattus norvegicus
caacttcacaggtcgaggtggcttg

SEQ ID NO: 571225 - DNA, 25 bp, Rattus norvegicus
cggagaactgcacaggctcaaggta

SEQ ID NO: 571226 - DNA, 25 bp, Rattus norvegicus
cacagtgactatggtgcggagaact

SEQ ID NO: 571227 - DNA, 25 bp, Rattus norvegicus
cctttgaaagcgctgtgaacccgga

SEQ ID NO: 571228 - DNA, 25 bp, Rattus norvegicus
aggctcgcccaaggagtcttctctc

SEQ ID NO: 571229 - DNA, 25 bp, Rattus norvegicus
cggccgttcacgtcaacgcggtgac

SEQ ID NO: 571230 - DNA, 25 bp, Rattus norvegicus
gcggctgccctgtagtcctttgaaa

SEQ ID NO: 571231 - DNA, 25 bp, Rattus norvegicus
cgctagagccggaggattgaacttc

SEQ ID NO: 571232 - DNA, 25 bp, Rattus norvegicus
aaacaggtccatcacggcggcttcg

SEQ ID NO: 571233 - DNA, 25 bp, Rattus norvegicus
cccaaagccgggtagcagtgaagtc

SEQ ID NO: 571234 - DNA, 25 bp, Rattus norvegicus
atctcaagcagatgcggggtccaca

SEQ ID NO: 571235 - DNA, 25 bp, Rattus norvegicus
ccgccgagcttgctatgcctctgag

SEQ ID NO: 571236 - DNA, 25 bp, Rattus norvegicus
cctctgagctgcaaggtgagtcgcc

SEQ ID NO: 571237 - DNA, 25 bp, Rattus norvegicus
ttccgaccaataggcgcagatgtgc

SEQ ID NO: 571238 - DNA, 25 bp, Rattus norvegicus
gccagctgtcaggttcactccttga

SEQ ID NO: 571239 - DNA, 25 bp, Rattus norvegicus
ggatcgctctgctgccagctcagtg

SEQ ID NO: 571240 - DNA, 25 bp, Rattus norvegicus
ctggccgcatttacgtaacctcttc

SEQ ID NO: 571241 - DNA, 25 bp, Rattus norvegicus
gaactgcgcccagagaagctggctg

SEQ ID NO: 571242 - DNA, 25 bp, Rattus norvegicus
tgatacggggaaggacgcaaagtcc

SEQ ID NO: 571243 - DNA, 25 bp, Rattus norvegicus
taggctccgccttctgatacgggga

SEQ ID NO: 571244 - DNA, 25 bp, Rattus norvegicus
gccaatttagagactaggctccgcc

SEQ ID NO: 571245 - DNA, 25 bp, Rattus norvegicus
cactcagccgccaatttagagacta

SEQ ID NO: 571246 - DNA, 25 bp, Rattus norvegicus
ttcaaaagccgccaatccgagctgc

SEQ ID NO: 571247 - DNA, 25 bp, Rattus norvegicus
tgcttccgggttcaaaagccgccaa

SEQ ID NO: 571248 - DNA, 25 bp, Rattus norvegicus
acagcgtccgtacacccagctcatc

SEQ ID NO: 571249 - DNA, 25 bp, Rattus norvegicus
ttcctaggcagagcggccctcggct

SEQ ID NO: 571250 - DNA, 25 bp, Rattus norvegicus
ttcccgggccgttcctaggcagagc

SEQ ID NO: 571251 - DNA, 25 bp, Rattus norvegicus
ctggcgctggaaaggaacgactttc

SEQ ID NO: 571252 - DNA, 25 bp, Rattus norvegicus
cttcgcgggaactgcgcccagagaa

SEQ ID NO: 571253 - DNA, 25 bp, Rattus norvegicus
gtccaccggttgcatagcttcgcgg

SEQ ID NO: 571254 - DNA, 25 bp, Rattus norvegicus
ccggttgcatagcttcgcgggaact

SEQ ID NO: 571255 - DNA, 25 bp, Rattus norvegicus
cccttagaaggttgtggcacgagcc

SEQ ID NO: 571256 - DNA, 25 bp, Rattus norvegicus
ccagactctggtgctgggtcgatga

SEQ ID NO: 571257 - DNA, 25 bp, Rattus norvegicus
ggggagcatcacactcagccagctc

SEQ ID NO: 571258 - DNA, 25 bp, Rattus norvegicus
cgcgcctcttctcgttgcgggttaa

SEQ ID NO: 571259 - DNA, 25 bp, Rattus norvegicus
cgctgaacacaaaccctgcgctggg

SEQ ID NO: 571260 - DNA, 25 bp, Rattus norvegicus
tgcaggcgttgtcaccgcaactttc

SEQ ID NO: 571261 - DNA, 25 bp, Rattus norvegicus
gtatttccagcatcctgcgaccagc

SEQ ID NO: 571262 - DNA, 25 bp, Rattus norvegicus
gacagcgcactcctggcccttagaa

SEQ ID NO: 571263 - DNA, 25 bp, Rattus norvegicus
acagcccggtgaagagccctgtttg

SEQ ID NO: 571264 - DNA, 25 bp, Rattus norvegicus
ctgaggcaccgtgacaagaacgatc

SEQ ID NO: 571265 - DNA, 25 bp, Rattus norvegicus
cgccttccgggcaaaggccagtaca

SEQ ID NO: 571266 - DNA, 25 bp, Rattus norvegicus
caaaggcgtcttcgagtgtcatccc

SEQ ID NO: 571267 - DNA, 25 bp, Rattus norvegicus
cgcgtcccagtagcgttcaaggata

SEQ ID NO: 571268 - DNA, 25 bp, Rattus norvegicus
cccaggcgtccgaaagttctgcagc

SEQ ID NO: 571269 - DNA, 25 bp, Rattus norvegicus
ggcctctaggctcccgcacgtggta

SEQ ID NO: 571270 - DNA, 25 bp, Rattus norvegicus
agctccacgcgcgttctcgccatcc

SEQ ID NO: 571271 - DNA, 25 bp, Rattus norvegicus
gtcccttgacgcgaagtggagatcg

SEQ ID NO: 571272 - DNA, 25 bp, Rattus norvegicus
gcctgtaaagccctgtcacacttga

SEQ ID NO: 571273 - DNA, 25 bp, Rattus norvegicus
cacttgcctgtaaagccctgtcaca

SEQ ID NO: 571274 - DNA, 25 bp, Rattus norvegicus
tgccatccgtcccttgacgcgaagt

SEQ ID NO: 571275 - DNA, 25 bp, Rattus norvegicus
gcgcactctcccacttgcctgtaaa

SEQ ID NO: 571276 - DNA, 25 bp, Rattus norvegicus
tcactcatcctcagcgcgcactctc

SEQ ID NO: 571277 - DNA, 25 bp, Rattus norvegicus
cagtatcgtcgccagcaggcaggag

SEQ ID NO: 571278 - DNA, 25 bp, Rattus norvegicus
acaccagtatcgtcgccagcaggca

SEQ ID NO: 571279 - DNA, 25 bp, Rattus norvegicus
ctcccgcacgtggtagacaccagta

SEQ ID NO: 571280 - DNA, 25 bp, Rattus norvegicus
tgtcacacttgacattcgccgcctg

SEQ ID NO: 571281 - DNA, 25 bp, Rattus norvegicus
ccagcaggcaggagacagccagcgg

SEQ ID NO: 571282 - DNA, 25 bp, Rattus norvegicus
gtggtagacaccagtatcgtcgcca

SEQ ID NO: 571283 - DNA, 25 bp, Rattus norvegicus
aatcggtgcgcggagtttcccgagc

SEQ ID NO: 571284 - DNA, 25 bp, Rattus norvegicus
tcttaaagtagtctgggcgcgttgg

SEQ ID NO: 571285 - DNA, 25 bp, Rattus norvegicus
cgaggccactctcggggtcttaaag

SEQ ID NO: 571286 - DNA, 25 bp, Rattus norvegicus
gaagtgcttccaaagacctctcctg

SEQ ID NO: 571287 - DNA, 25 bp, Rattus norvegicus
cagcccggtttgcatcgggaaactc

SEQ ID NO: 571288 - DNA, 25 bp, Rattus norvegicus
acgactcgcttcagcccggtttgca

SEQ ID NO: 571289 - DNA, 25 bp, Rattus norvegicus
tcggctgggcctgcacgactcgctt

SEQ ID NO: 571290 - DNA, 25 bp, Rattus norvegicus
cactcacgggagtaacagcggcagc

SEQ ID NO: 571291 - DNA, 25 bp, Rattus norvegicus
aactctgcgcagagcgcgcgacttc

SEQ ID NO: 571292 - DNA, 25 bp, Rattus norvegicus
gcgtctgaaactctgcgcagagcgc

SEQ ID NO: 571293 - DNA, 25 bp, Rattus norvegicus
cccacagaaatagcccgtggtcgga

SEQ ID NO: 571294 - DNA, 25 bp, Rattus norvegicus
catcgggaaactcgggaagtgcttc

SEQ ID NO: 571295 - DNA, 25 bp, Rattus norvegicus
gtcctccgatcgctggcaatcggtg

SEQ ID NO: 571296 - DNA, 25 bp, Rattus norvegicus
aaatagcccgtggtcggatcggcgc

SEQ ID NO: 571297 - DNA, 25 bp, Rattus norvegicus
ggcagcggcgacctgcaacttgttt

SEQ ID NO: 571298 - DNA, 25 bp, Rattus norvegicus
ttcgattcccggacagggtgagaga

SEQ ID NO: 571299 - DNA, 25 bp, Rattus norvegicus
tgcgacgtgttgcagaggcctcgcc

SEQ ID NO: 571300 - DNA, 25 bp, Rattus norvegicus
tggagcaggccctgcggtccagcct

SEQ ID NO: 571301 - DNA, 25 bp, Rattus norvegicus
ttggtccgaactagcggcctgtggc

SEQ ID NO: 571302 - DNA, 25 bp, Rattus norvegicus
tcgatgtcccactcggagctgcgac

SEQ ID NO: 571303 - DNA, 25 bp, Rattus norvegicus
agccgaggctggtcgatgtcccact

SEQ ID NO: 571304 - DNA, 25 bp, Rattus norvegicus
tgcaacttgttttgtttgcgcgcgc

SEQ ID NO: 571305 - DNA, 25 bp, Rattus norvegicus
ctcgtggtcctctggtcttccctgt

SEQ ID NO: 571306 - DNA, 25 bp, Rattus norvegicus
atcgggttcatcttacgcagtttgc

SEQ ID NO: 571307 - DNA, 25 bp, Rattus norvegicus
aagatgaggctgaagatcgggttca

SEQ ID NO: 571308 - DNA, 25 bp, Rattus norvegicus
tacgctgcctcgtcctgcggatcga

SEQ ID NO: 571309 - DNA, 25 bp, Rattus norvegicus
tgcggatcgagagctgtccgccctc

SEQ ID NO: 571310 - DNA, 25 bp, Rattus norvegicus
caatgcgcgggacagagtcggactc

SEQ ID NO: 571311 - DNA, 25 bp, Rattus norvegicus
gccctctcacagagaaggcttctga

SEQ ID NO: 571312 - DNA, 25 bp, Rattus norvegicus
ggctctgaggcgacttaaagcgcta

SEQ ID NO: 571313 - DNA, 25 bp, Rattus norvegicus
cggctggcgctaaattcttcaggtg

SEQ ID NO: 571314 - DNA, 25 bp, Rattus norvegicus
ggaatgtactgctcgaccctgattg

SEQ ID NO: 571315 - DNA, 25 bp, Rattus norvegicus
gcctagcatgtttggtggtctccca

SEQ ID NO: 571316 - DNA, 25 bp, Rattus norvegicus
ggattattcaaacccgaggagtctc

SEQ ID NO: 571317 - DNA, 25 bp, Rattus norvegicus
ccgatctgattggtcgtgaggatta

SEQ ID NO: 571318 - DNA, 25 bp, Rattus norvegicus
cggcaacttgacgagaccagtcgca

SEQ ID NO: 571319 - DNA, 25 bp, Rattus norvegicus
cccagcctcttgttttgcagagttc

SEQ ID NO: 571320 - DNA, 25 bp, Rattus norvegicus
tccggcgagaactggcttatcacta

SEQ ID NO: 571321 - DNA, 25 bp, Rattus norvegicus
cgagtcttacctggcgcgagctctt

SEQ ID NO: 571322 - DNA, 25 bp, Rattus norvegicus
cgtcccagtctacgcggaaagagcc

SEQ ID NO: 571323 - DNA, 25 bp, Rattus norvegicus
ctcctgacagaaaagccgcgcggct

SEQ ID NO: 571324 - DNA, 25 bp, Rattus norvegicus
gtctcccaggtcgttaactcccaga

SEQ ID NO: 571325 - DNA, 25 bp, Rattus norvegicus
tcccagaagaaggtgaagatcgagc

SEQ ID NO: 571326 - DNA, 25 bp, Rattus norvegicus
tgctgaagtctccatgtgacagtga

SEQ ID NO: 571327 - DNA, 25 bp, Rattus norvegicus
gtcggtcccgcacgtaatcagaaca

SEQ ID NO: 571328 - DNA, 25 bp, Rattus norvegicus
tctctgattgaaacaaagtccctgc

SEQ ID NO: 571329 - DNA, 25 bp, Rattus norvegicus
ggagaagcttcggtccaactgctga

SEQ ID NO: 571330 - DNA, 25 bp, Rattus norvegicus
ctcctttgctgcgatctggaaacga

SEQ ID NO: 571331 - DNA, 25 bp, Rattus norvegicus
gtttctaggcgccactccagtcctg

SEQ ID NO: 571332 - DNA, 25 bp, Rattus norvegicus
tcacagtcacaggaacgggccgcta

SEQ ID NO: 571333 - DNA, 25 bp, Rattus norvegicus
gggccgctattccagcaccggcaga

SEQ ID NO: 571334 - DNA, 25 bp, Rattus norvegicus
cgaactggcagacatgaacggcttc

SEQ ID NO: 571335 - DNA, 25 bp, Rattus norvegicus
aacggcttcactccggaggagatga

SEQ ID NO: 571336 - DNA, 25 bp, Rattus norvegicus
gccagcttcagcaagaggatccaga

SEQ ID NO: 571337 - DNA, 25 bp, Rattus norvegicus
cctgcccgatctttggcggggttca

SEQ ID NO: 571338 - DNA, 25 bp, Rattus norvegicus
ggctccgcgaccaagaactaccatt

SEQ ID NO: 571339 - DNA, 25 bp, Rattus norvegicus
gggtgagctcacttcctccggcgtc

SEQ ID NO: 571340 - DNA, 25 bp, Rattus norvegicus
gaatggaacgcttgagtaggccaaa

SEQ ID NO: 571341 - DNA, 25 bp, Rattus norvegicus
cttgagtaggccaaaaaccggctgc

SEQ ID NO: 571342 - DNA, 25 bp, Rattus norvegicus
ccaaaaaccggctgcgtcctgctga

SEQ ID NO: 571343 - DNA, 25 bp, Rattus norvegicus
tccatcccgaagctccgaagtcaag

SEQ ID NO: 571344 - DNA, 25 bp, Rattus norvegicus
cgaagtcaagggatcggcagcaccc

SEQ ID NO: 571345 - DNA, 25 bp, Rattus norvegicus
aggtctggggctcgcagcttcttcc

SEQ ID NO: 571346 - DNA, 25 bp, Rattus norvegicus
ccagtgggtactgactcccggccgg

SEQ ID NO: 571347 - DNA, 25 bp, Rattus norvegicus
ctaggggcttgttggacccacgcct

SEQ ID NO: 571348 - DNA, 25 bp, Rattus norvegicus
ttgttggacccacgcctcggagccg

SEQ ID NO: 571349 - DNA, 25 bp, Rattus norvegicus
ctcggagccgggtggaattcctccg

SEQ ID NO: 571350 - DNA, 25 bp, Rattus norvegicus
gcggaaatagaaagtccagaaccca

SEQ ID NO: 571351 - DNA, 25 bp, Rattus norvegicus
ccagatgctgcccagtgggtactga

SEQ ID NO: 571352 - DNA, 25 bp, Rattus norvegicus
agcacccatggtcccgcgcaaaaga

SEQ ID NO: 571353 - DNA, 25 bp, Rattus norvegicus
ccaagtccggactactgtgtgcgca

SEQ ID NO: 571354 - DNA, 25 bp, Rattus norvegicus
aaccacgcaggacctggtctacatc

SEQ ID NO: 571355 - DNA, 25 bp, Rattus norvegicus
tggtctacatcgacccaagtccgga

SEQ ID NO: 571356 - DNA, 25 bp, Rattus norvegicus
tggtacaggtcaacagccgcttcaa

SEQ ID NO: 571357 - DNA, 25 bp, Rattus norvegicus
tgtgtgcgcaacgagagcactggct

SEQ ID NO: 571358 - DNA, 25 bp, Rattus norvegicus
agagcactggctcactgggcacgca

SEQ ID NO: 571359 - DNA, 25 bp, Rattus norvegicus
gggacgcctgtgcaacaagacctca

SEQ ID NO: 571360 - DNA, 25 bp, Rattus norvegicus
tgggcgtggctatgaccagtttaag

SEQ ID NO: 571361 - DNA, 25 bp, Rattus norvegicus
acttccgcaaggtgggcgatgccct

SEQ ID NO: 571362 - DNA, 25 bp, Rattus norvegicus
tgccctcaaggagaagtatgacagc

SEQ ID NO: 571363 - DNA, 25 bp, Rattus norvegicus
cagcgcagcggccatgaggttgaac

SEQ ID NO: 571364 - DNA, 25 bp, Rattus norvegicus
ccatgaggttgaacagccggggcaa

SEQ ID NO: 571365 - DNA, 25 bp, Rattus norvegicus
ccggggcaagctggtacaggtcaac

SEQ ID NO: 571366 - DNA, 25 bp, Rattus norvegicus
accagtttaagacggtgcagaccga

SEQ ID NO: 571367 - DNA, 25 bp, Rattus norvegicus
gaggtctcagcgcatccattttcta

SEQ ID NO: 571368 - DNA, 25 bp, Rattus norvegicus
gtcgtcagaggctcctcacgccaat

SEQ ID NO: 571369 - DNA, 25 bp, Rattus norvegicus
taatatatgtcgtcagaggctcctc

SEQ ID NO: 571370 - DNA, 25 bp, Rattus norvegicus
agggccgctcgggttaatatatgtc

SEQ ID NO: 571371 - DNA, 25 bp, Rattus norvegicus
tacagctacatctttagggccgctc

SEQ ID NO: 571372 - DNA, 25 bp, Rattus norvegicus
agccagatctccatgtacagctaca

SEQ ID NO: 571373 - DNA, 25 bp, Rattus norvegicus
gcaagcagattttcccagccagatc

SEQ ID NO: 571374 - DNA, 25 bp, Rattus norvegicus
gtgaggggagcaagcagattttccc

SEQ ID NO: 571375 - DNA, 25 bp, Rattus norvegicus
ctcaggctctctcggaggctttgca

SEQ ID NO: 571376 - DNA, 25 bp, Rattus norvegicus
agcgcatccattttctaagatcctc

SEQ ID NO: 571377 - DNA, 25 bp, Rattus norvegicus
gcagagaggtctcagcgcatccatt

SEQ ID NO: 571378 - DNA, 25 bp, Rattus norvegicus
taagatcctctcctttcgcgacaag

SEQ ID NO: 571379 - DNA, 25 bp, Rattus norvegicus
tcctttcgcgacaagaatcttgggc

SEQ ID NO: 571380 - DNA, 25 bp, Rattus norvegicus
acagtggcccggcaagctcccgagt

SEQ ID NO: 571381 - DNA, 25 bp, Rattus norvegicus
ttgacaccgatacaccattttaata

SEQ ID NO: 571382 - DNA, 25 bp, Rattus norvegicus
gtcgctaccgcgaatcccaaatcga

SEQ ID NO: 571383 - DNA, 25 bp, Rattus norvegicus
cgcgaatcccaaatcgacctctata

SEQ ID NO: 571384 - DNA, 25 bp, Rattus norvegicus
tcccaaatcgacctctataccaatg

SEQ ID NO: 571385 - DNA, 25 bp, Rattus norvegicus
atcgacctctataccaatggcctag

SEQ ID NO: 571386 - DNA, 25 bp, Rattus norvegicus
gacctctataccaatggcctagaaa

SEQ ID NO: 571387 - DNA, 25 bp, Rattus norvegicus
tataccaatggcctagaaacacaag

SEQ ID NO: 571388 - DNA, 25 bp, Rattus norvegicus
ccaatggcctagaaacacaagagac

SEQ ID NO: 571389 - DNA, 25 bp, Rattus norvegicus
tggcctagaaacacaagagactcgt

SEQ ID NO: 571390 - DNA, 25 bp, Rattus norvegicus
cctagaaacacaagagactcgtacc

SEQ ID NO: 571391 - DNA, 25 bp, Rattus norvegicus
gaaacacaagagactcgtacccgcc

SEQ ID NO: 571392 - DNA, 25 bp, Rattus norvegicus
cctcttgacaccgatacaccatttt

SEQ ID NO: 571393 - DNA, 25 bp, Rattus norvegicus
gacaccgatacaccattttaataag

SEQ ID NO: 571394 - DNA, 25 bp, Rattus norvegicus
aagagactcgtacccgcctcttgac

SEQ ID NO: 571395 - DNA, 25 bp, Rattus norvegicus
tctgtgctaacgctagtacctgaac

SEQ ID NO: 571396 - DNA, 25 bp, Rattus norvegicus
gaattcacagcacctctcctgcagg

SEQ ID NO: 571397 - DNA, 25 bp, Rattus norvegicus
aatgtctttcagtgcccattggtcc

SEQ ID NO: 571398 - DNA, 25 bp, Rattus norvegicus
tgactgcgagagtaccagaaactgc

SEQ ID NO: 571399 - DNA, 25 bp, Rattus norvegicus
ttcgcgctgaagaacacgatgactg

SEQ ID NO: 571400 - DNA, 25 bp, Rattus norvegicus
cccagagcgcacgtgttcgcgctga

SEQ ID NO: 571401 - DNA, 25 bp, Rattus norvegicus
cgtttcctattattgccggaagtga

SEQ ID NO: 571402 - DNA, 25 bp, Rattus norvegicus
gtacctgaacgacctgtgatctcca

SEQ ID NO: 571403 - DNA, 25 bp, Rattus norvegicus
aagaggtacggcactggaagttatc

SEQ ID NO: 571404 - DNA, 25 bp, Rattus norvegicus
tccctagtcctcatttcggagaaga

SEQ ID NO: 571405 - DNA, 25 bp, Rattus norvegicus
taccaagtggcaagcatccctagtc

SEQ ID NO: 571406 - DNA, 25 bp, Rattus norvegicus
actgtagcttactgggccggtgcta

SEQ ID NO: 571407 - DNA, 25 bp, Rattus norvegicus
cccattggtcctaaactgtagctta

SEQ ID NO: 571408 - DNA, 25 bp, Rattus norvegicus
actggtgcccaagccatggagaggc

SEQ ID NO: 571409 - DNA, 25 bp, Rattus norvegicus
tcccggctgagccattttcttttcg

SEQ ID NO: 571410 - DNA, 25 bp, Rattus norvegicus
tcctgcaggagaggtgctgtgaatt

SEQ ID NO: 571411 - DNA, 25 bp, Rattus norvegicus
ggcagtttctggtactctcgcagtc

SEQ ID NO: 571412 - DNA, 25 bp, Rattus norvegicus
tctcgcagtcatcgtgttcttcagc

SEQ ID NO: 571413 - DNA, 25 bp, Rattus norvegicus
ttcttcagcgcgaacacgtgcgctc

SEQ ID NO: 571414 - DNA, 25 bp, Rattus norvegicus
cctctccatggcttgggcaccagtt

SEQ ID NO: 571415 - DNA, 25 bp, Rattus norvegicus
cgtcacttccggcaataataggaaa

SEQ ID NO: 571416 - DNA, 25 bp, Rattus norvegicus
tttcttttcggctgacagctcctgc

SEQ ID NO: 571417 - DNA, 25 bp, Rattus norvegicus
agctcctgcccacaggctgagtcgt

SEQ ID NO: 571418 - DNA, 25 bp, Rattus norvegicus
gtggagatcacaggtcgttcaggta

SEQ ID NO: 571419 - DNA, 25 bp, Rattus norvegicus
ggtcgttcaggtactagcgttagca

SEQ ID NO: 571420 - DNA, 25 bp, Rattus norvegicus
agtgccgtacctctttctgcccgta

SEQ ID NO: 571421 - DNA, 25 bp, Rattus norvegicus
gataacttccagtgccgtacctctt

SEQ ID NO: 571422 - DNA, 25 bp, Rattus norvegicus
ctagcgttagcacagataacttcca

SEQ ID NO: 571423 - DNA, 25 bp, Rattus norvegicus
aggcacggctcccacaccgtggagc

SEQ ID NO: 571424 - DNA, 25 bp, Rattus norvegicus
actgaggagctctgcatgccctcag

SEQ ID NO: 571425 - DNA, 25 bp, Rattus norvegicus
gggcttccggcacctgctgaaggaa

SEQ ID NO: 571426 - DNA, 25 bp, Rattus norvegicus
ttccggcacctgctgaaggaaaaca

SEQ ID NO: 571427 - DNA, 25 bp, Rattus norvegicus
ctgcggtcgcggtaaataatgcgcg

SEQ ID NO: 571428 - DNA, 25 bp, Rattus norvegicus
tcgcggtaaataatgcgcgggccgc

SEQ ID NO: 571429 - DNA, 25 bp, Rattus norvegicus
cgcggtaaataatgcgcgggccgca

SEQ ID NO: 571430 - DNA, 25 bp, Rattus norvegicus
gcccagcgctcatcgacttgctccc

SEQ ID NO: 571431 - DNA, 25 bp, Rattus norvegicus
ccgcgctcactgaggagctctgcat

SEQ ID NO: 571432 - DNA, 25 bp, Rattus norvegicus
cgcgctcactgaggagctctgcatg

SEQ ID NO: 571433 - DNA, 25 bp, Rattus norvegicus
cgctcactgaggagctctgcatgcc

SEQ ID NO: 571434 - DNA, 25 bp, Rattus norvegicus
ctcactgaggagctctgcatgccct

SEQ ID NO: 571435 - DNA, 25 bp, Rattus norvegicus
ccgggcttccggcacctgctgaagg

SEQ ID NO: 571436 - DNA, 25 bp, Rattus norvegicus
tcactgaggagctctgcatgccctc

SEQ ID NO: 571437 - DNA, 25 bp, Rattus norvegicus
gggcttccggcacctgctgaaggaa

SEQ ID NO: 571438 - DNA, 25 bp, Rattus norvegicus
gcggccagactaggggtacgcgcga

SEQ ID NO: 571439 - DNA, 25 bp, Rattus norvegicus
cagaccggcggccagactaggggta

SEQ ID NO: 571440 - DNA, 25 bp, Rattus norvegicus
gcccagcgctcatcgacttgctccc

SEQ ID NO: 571441 - DNA, 25 bp, Rattus norvegicus
cgcggtaaataatgcgcgggccgca

SEQ ID NO: 571442 - DNA, 25 bp, Rattus norvegicus
tcgcggtaaataatgcgcgggccgc

SEQ ID NO: 571443 - DNA, 25 bp, Rattus norvegicus
ttccggcacctgctgaaggaaaaca

SEQ ID NO: 571444 - DNA, 25 bp, Rattus norvegicus
aggctctgtccctggacactctgag

SEQ ID NO: 571445 - DNA, 25 bp, Rattus norvegicus
ggcaggacatgccgcccggcttgct

SEQ ID NO: 571446 - DNA, 25 bp, Rattus norvegicus
ctggcaggacatgccgcccggcttg

SEQ ID NO: 571447 - DNA, 25 bp, Rattus norvegicus
tctggcaggacatgccgcccggctt

SEQ ID NO: 571448 - DNA, 25 bp, Rattus norvegicus
tgctctggcaggacatgccgcccgg

SEQ ID NO: 571449 - DNA, 25 bp, Rattus norvegicus
ttgatcgcggtgtggcgccagcgaa

SEQ ID NO: 571450 - DNA, 25 bp, Rattus norvegicus
ctgcggtcgcggtaaataatgcgcg

SEQ ID NO: 571451 - DNA, 25 bp, Rattus norvegicus
agcgtcgggccttccgtatataata

SEQ ID NO: 571452 - DNA, 25 bp, Rattus norvegicus
gcaccagcggccgttgaaaaatggc

SEQ ID NO: 571453 - DNA, 25 bp, Rattus norvegicus
cttgtctttttcccgggtcgtgctg

SEQ ID NO: 571454 - DNA, 25 bp, Rattus norvegicus
agctcacggagtcccgacttgtctt

SEQ ID NO: 571455 - DNA, 25 bp, Rattus norvegicus
acggaagaagagctcacggagtccc

SEQ ID NO: 571456 - DNA, 25 bp, Rattus norvegicus
tatataatagagatgggacggaaga

SEQ ID NO: 571457 - DNA, 25 bp, Rattus norvegicus
gggccttccgtatataatagagatg

SEQ ID NO: 571458 - DNA, 25 bp, Rattus norvegicus
tgagctgaaagctggtgagtgcatt

SEQ ID NO: 571459 - DNA, 25 bp, Rattus norvegicus
ctgttactgagctgaaagctggtga

SEQ ID NO: 571460 - DNA, 25 bp, Rattus norvegicus
agcggccgttgaaaaatggcgactg

SEQ ID NO: 571461 - DNA, 25 bp, Rattus norvegicus
cggcacgtacacactggagaggcgt

SEQ ID NO: 571462 - DNA, 25 bp, Rattus norvegicus
gccgcagagcggcacgtacacactg

SEQ ID NO: 571463 - DNA, 25 bp, Rattus norvegicus
tggcgactgttactgagctgaaagc

SEQ ID NO: 571464 - DNA, 25 bp, Rattus norvegicus
tgagtgcattgggatgctcgcctgt

SEQ ID NO: 571465 - DNA, 25 bp, Rattus norvegicus
gggtacctcaacctgtgactggagc

SEQ ID NO: 571466 - DNA, 25 bp, Rattus norvegicus
cccagggactgcgagcccacattcc

SEQ ID NO: 571467 - DNA, 25 bp, Rattus norvegicus
gagcgagagtctccccaagtctggg

SEQ ID NO: 571468 - DNA, 25 bp, Rattus norvegicus
actggagcgagagtctccccaagtc

SEQ ID NO: 571469 - DNA, 25 bp, Rattus norvegicus
caacctgtgactggagcgagagtct

SEQ ID NO: 571470 - DNA, 25 bp, Rattus norvegicus
tcaacctgtgactggagcgagagtc

SEQ ID NO: 571471 - DNA, 25 bp, Rattus norvegicus
cctcaacctgtgactggagcgagag

SEQ ID NO: 571472 - DNA, 25 bp, Rattus norvegicus
acctcaacctgtgactggagcgaga

SEQ ID NO: 571473 - DNA, 25 bp, Rattus norvegicus
tacctcaacctgtgactggagcgag

SEQ ID NO: 571474 - DNA, 25 bp, Rattus norvegicus
gtacctcaacctgtgactggagcga

SEQ ID NO: 571475 - DNA, 25 bp, Rattus norvegicus
ggtacctcaacctgtgactggagcg

SEQ ID NO: 571476 - DNA, 25 bp, Rattus norvegicus
ctcaacctgtgactggagcgagagt

SEQ ID NO: 571477 - DNA, 25 bp, Rattus norvegicus
agggactgcgagcccacattccgca

SEQ ID NO: 571478 - DNA, 25 bp, Rattus norvegicus
ggggtacctcaacctgtgactggag

SEQ ID NO: 571479 - DNA, 25 bp, Rattus norvegicus
gtgttagatacgtgtcagcccgaga

SEQ ID NO: 571480 - DNA, 25 bp, Rattus norvegicus
tgttgattacatcaagaccggcttc

SEQ ID NO: 571481 - DNA, 25 bp, Rattus norvegicus
aaaactgcctcttgttgattacatc

SEQ ID NO: 571482 - DNA, 25 bp, Rattus norvegicus
cgtaaataaaactgcctcttgttga

SEQ ID NO: 571483 - DNA, 25 bp, Rattus norvegicus
cccgagatctcgtaaataaaactgc

SEQ ID NO: 571484 - DNA, 25 bp, Rattus norvegicus
gtgtcagcccgagatctcgtaaata

SEQ ID NO: 571485 - DNA, 25 bp, Rattus norvegicus
acgtgtcagcccgagatctcgtaaa

SEQ ID NO: 571486 - DNA, 25 bp, Rattus norvegicus
gttagatacgtgtcagcccgagatc

SEQ ID NO: 571487 - DNA, 25 bp, Rattus norvegicus
cctgtgttagatacgtgtcagcccg

SEQ ID NO: 571488 - DNA, 25 bp, Rattus norvegicus
tgattacatcaagaccggcttctcg

SEQ ID NO: 571489 - DNA, 25 bp, Rattus norvegicus
atctcgtaaataaaactgcctcttg

SEQ ID NO: 571490 - DNA, 25 bp, Rattus norvegicus
agatacgtgtcagcccgagatctcg

SEQ ID NO: 571491 - DNA, 25 bp, Rattus norvegicus
attacatcaagaccggcttctcgtg

SEQ ID NO: 571492 - DNA, 25 bp, Rattus norvegicus
gtcagcccgagatctcgtaaataaa

SEQ ID NO: 571493 - DNA, 25 bp, Rattus norvegicus
tgagggagcaacacaacagcacacc

SEQ ID NO: 571494 - DNA, 25 bp, Rattus norvegicus
acccaacccggccaatgagggagca

SEQ ID NO: 571495 - DNA, 25 bp, Rattus norvegicus
aaccctgcgcggttagctcccgagt

SEQ ID NO: 571496 - DNA, 25 bp, Rattus norvegicus
gcacgtctcgcggatcatgctgtga

SEQ ID NO: 571497 - DNA, 25 bp, Rattus norvegicus
cggcgctcaccttcggctgtttcat

SEQ ID NO: 571498 - DNA, 25 bp, Rattus norvegicus
ccttctcgctgagtgtgatggcggc

SEQ ID NO: 571499 - DNA, 25 bp, Rattus norvegicus
gaattccctgttcgccttctcgctg

SEQ ID NO: 571500 - DNA, 25 bp, Rattus norvegicus
aaccggagcctgaagtacaggtgtc

SEQ ID NO: 571501 - DNA, 25 bp, Rattus norvegicus
tcgtcacgatgaacaccgtgctgtc

SEQ ID NO: 571502 - DNA, 25 bp, Rattus norvegicus
gctcccaagggaaggtcgtcacgat

SEQ ID NO: 571503 - DNA, 25 bp, Rattus norvegicus
cggattgactgaaagcaccgccttt

SEQ ID NO: 571504 - DNA, 25 bp, Rattus norvegicus
acccgttgttgattggcggattgac

SEQ ID NO: 571505 - DNA, 25 bp, Rattus norvegicus
acaccgtgctgtcgcgcgcgaattc

SEQ ID NO: 571506 - DNA, 25 bp, Rattus norvegicus
aaagcaccgcctttcggcgcgtgca

SEQ ID NO: 571507 - DNA, 25 bp, Rattus norvegicus
gcggcttccaacttttgccctcgga

SEQ ID NO: 571508 - DNA, 25 bp, Rattus norvegicus
tctgcctgcgcttatgtgagagaaa

SEQ ID NO: 571509 - DNA, 25 bp, Rattus norvegicus
gggcatgactgatgcgccctctgcc

SEQ ID NO: 571510 - DNA, 25 bp, Rattus norvegicus
cgcgatgttccactcgtcccgagaa

SEQ ID NO: 571511 - DNA, 25 bp, Rattus norvegicus
cggctccgccgatcgcggttttgtt

SEQ ID NO: 571512 - DNA, 25 bp, Rattus norvegicus
ggacatccgaactgccctcagtggc

SEQ ID NO: 571513 - DNA, 25 bp, Rattus norvegicus
gcctcacaggaaaccggacatccga

SEQ ID NO: 571514 - DNA, 25 bp, Rattus norvegicus
tttgccctcggatatggcagcccgc

SEQ ID NO: 571515 - DNA, 25 bp, Rattus norvegicus
acagcaagtgcatggtggatggacc

SEQ ID NO: 571516 - DNA, 25 bp, Rattus norvegicus
ccagagacaagaagcacagcaagtg

SEQ ID NO: 571517 - DNA, 25 bp, Rattus norvegicus
cgagcaaggaacacgccagagacaa

SEQ ID NO: 571518 - DNA, 25 bp, Rattus norvegicus
aagcccagtcccgactcgaaggcgg

SEQ ID NO: 571519 - DNA, 25 bp, Rattus norvegicus
ggctctgcttccgagaagcccagtc

SEQ ID NO: 571520 - DNA, 25 bp, Rattus norvegicus
ctctgagtgtcaggtacgagcctca

SEQ ID NO: 571521 - DNA, 25 bp, Rattus norvegicus
cgcgagaaaggtctcggccagctca

SEQ ID NO: 571522 - DNA, 25 bp, Rattus norvegicus
aaaaggccaagtgttgacgaccagg

SEQ ID NO: 571523 - DNA, 25 bp, Rattus norvegicus
ccaagtgttgacgaccaggggtaga

SEQ ID NO: 571524 - DNA, 25 bp, Rattus norvegicus
ccgcaccaggggtatacccagaacg

SEQ ID NO: 571525 - DNA, 25 bp, Rattus norvegicus
tatacccagaacgagcggcaggaga

SEQ ID NO: 571526 - DNA, 25 bp, Rattus norvegicus
agaaaagggagattccacttccgcg

SEQ ID NO: 571527 - DNA, 25 bp, Rattus norvegicus
gagattccacttccgcgccatagca

SEQ ID NO: 571528 - DNA, 25 bp, Rattus norvegicus
gccatagcagagagcccgccgagca

SEQ ID NO: 571529 - DNA, 25 bp, Rattus norvegicus
ccgccgagcagcgtgagaaaagtcc

SEQ ID NO: 571530 - DNA, 25 bp, Rattus norvegicus
gcacccagcagaccagcgcgagaaa

SEQ ID NO: 571531 - DNA, 25 bp, Rattus norvegicus
gctccgcacctgcttcggtggcatt

SEQ ID NO: 571532 - DNA, 25 bp, Rattus norvegicus
cttcggtggcattcttaaaaggcca

SEQ ID NO: 571533 - DNA, 25 bp, Rattus norvegicus
ggccagctcagactccggaaaactc

SEQ ID NO: 571534 - DNA, 25 bp, Rattus norvegicus
cagcgtgagaaaagtcccgcccgac

SEQ ID NO: 571535 - DNA, 25 bp, Rattus norvegicus
gactggagctggaaagttcaaacta

SEQ ID NO: 571536 - DNA, 25 bp, Rattus norvegicus
gccgctgctccggtcaacctgggaa

SEQ ID NO: 571537 - DNA, 25 bp, Rattus norvegicus
agcttctcccttttcgccagcagtg

SEQ ID NO: 571538 - DNA, 25 bp, Rattus norvegicus
cactcacagaggcagcggcggttca

SEQ ID NO: 571539 - DNA, 25 bp, Rattus norvegicus
ggaggctctgcccaacttctctggg

SEQ ID NO: 571540 - DNA, 25 bp, Rattus norvegicus
actaaacgtgttgctctcccgggtg

SEQ ID NO: 571541 - DNA, 25 bp, Rattus norvegicus
caccagggtggagagtctctgcaca

SEQ ID NO: 571542 - DNA, 25 bp, Rattus norvegicus
gagtctctgcacagcgatcaccagc

SEQ ID NO: 571543 - DNA, 25 bp, Rattus norvegicus
gagccggtgcatctgcactcacaga

SEQ ID NO: 571544 - DNA, 25 bp, Rattus norvegicus
cagacagcactgtcccggggaatcc

SEQ ID NO: 571545 - DNA, 25 bp, Rattus norvegicus
ccgctgggctcagagacacttagtg

SEQ ID NO: 571546 - DNA, 25 bp, Rattus norvegicus
taacctccgcgccaataagagcgag

SEQ ID NO: 571547 - DNA, 25 bp, Rattus norvegicus
agagagccaccggtgccagtccgct

SEQ ID NO: 571548 - DNA, 25 bp, Rattus norvegicus
gttcaggcgcatccaccaccagggt

SEQ ID NO: 571549 - DNA, 25 bp, Rattus norvegicus
ctccttggaaagaggcagaagtgta

SEQ ID NO: 571550 - DNA, 25 bp, Rattus norvegicus
gggagtccagcctgacccgcagaca

SEQ ID NO: 571551 - DNA, 25 bp, Rattus norvegicus
agactcgcaaactccagtgtccttg

SEQ ID NO: 571552 - DNA, 25 bp, Rattus norvegicus
aagcaaaggcatcggggagtccagc

SEQ ID NO: 571553 - DNA, 25 bp, Rattus norvegicus
gggtccgcactgcttacgcggtgca

SEQ ID NO: 571554 - DNA, 25 bp, Rattus norvegicus
cctactgaagctcggggtccgcact

SEQ ID NO: 571555 - DNA, 25 bp, Rattus norvegicus
cgctgcagttacagcgcggcaccgg

SEQ ID NO: 571556 - DNA, 25 bp, Rattus norvegicus
aggtggcagtggacctgctcctata

SEQ ID NO: 571557 - DNA, 25 bp, Rattus norvegicus
gagcctagagatggccggacaccct

SEQ ID NO: 571558 - DNA, 25 bp, Rattus norvegicus
ttgatctggtcaagagccctaggga

SEQ ID NO: 571559 - DNA, 25 bp, Rattus norvegicus
atgctccacactttgccagtggttg

SEQ ID NO: 571560 - DNA, 25 bp, Rattus norvegicus
ggccgctgagttctttacaactccg

SEQ ID NO: 571561 - DNA, 25 bp, Rattus norvegicus
cgcagacacccttcattctgcgggg

SEQ ID NO: 571562 - DNA, 25 bp, Rattus norvegicus
tgctcctatagcgatggaccgggct

SEQ ID NO: 571563 - DNA, 25 bp, Rattus norvegicus
tcctggatgctgctccctggcacag

SEQ ID NO: 571564 - DNA, 25 bp, Rattus norvegicus
cgcccggcgcctttgaatttggcca

SEQ ID NO: 571565 - DNA, 25 bp, Rattus norvegicus
caagaaaccgggattctggccggtg

SEQ ID NO: 571566 - DNA, 25 bp, Rattus norvegicus
aaagtgaactcattggcgcccgcgc

SEQ ID NO: 571567 - DNA, 25 bp, Rattus norvegicus
ggcagcggaggaagttgtaacactt

SEQ ID NO: 571568 - DNA, 25 bp, Rattus norvegicus
ggaagttgtaacacttgcatctccc

SEQ ID NO: 571569 - DNA, 25 bp, Rattus norvegicus
agagcgagctaggaaacgcggttcc

SEQ ID NO: 571570 - DNA, 25 bp, Rattus norvegicus
cggctgcgagttggccagctttaca

SEQ ID NO: 571571 - DNA, 25 bp, Rattus norvegicus
ccagctttacagtcggcggagcatc

SEQ ID NO: 571572 - DNA, 25 bp, Rattus norvegicus
tacagtcggcggagcatcccagctc

SEQ ID NO: 571573 - DNA, 25 bp, Rattus norvegicus
gctcccagactctcggagctctgga

SEQ ID NO: 571574 - DNA, 25 bp, Rattus norvegicus
gagctctggagtccctgttccggcc

SEQ ID NO: 571575 - DNA, 25 bp, Rattus norvegicus
tttgaatttggccaggcgagcgctg

SEQ ID NO: 571576 - DNA, 25 bp, Rattus norvegicus
ttgcccacaattacagtcctggatg

SEQ ID NO: 571577 - DNA, 25 bp, Rattus norvegicus
cgcagaagtcttacagttccagtga

SEQ ID NO: 571578 - DNA, 25 bp, Rattus norvegicus
gcgctgacgtcatgccaaccttttc

SEQ ID NO: 571579 - DNA, 25 bp, Rattus norvegicus
cgctgaagttctaagaggccggacc

SEQ ID NO: 571580 - DNA, 25 bp, Rattus norvegicus
gaccgatgcgcacagagaaggaatg

SEQ ID NO: 571581 - DNA, 25 bp, Rattus norvegicus
tggatgtgaaggaacgcaggcctta

SEQ ID NO: 571582 - DNA, 25 bp, Rattus norvegicus
aggccttactgctccttgaccaaga

SEQ ID NO: 571583 - DNA, 25 bp, Rattus norvegicus
tcgtccgcggacaatgaggagtgta

SEQ ID NO: 571584 - DNA, 25 bp, Rattus norvegicus
ttccagtgaaaccttgaaagctttc

SEQ ID NO: 571585 - DNA, 25 bp, Rattus norvegicus
ttcgatcatgattcttcacggctgc

SEQ ID NO: 571586 - DNA, 25 bp, Rattus norvegicus
ttcacggctgctttacggaaacaga

SEQ ID NO: 571587 - DNA, 25 bp, Rattus norvegicus
tggtccacagagaagccgacgagta

SEQ ID NO: 571588 - DNA, 25 bp, Rattus norvegicus
gccgacgagtatcctagacaaggta

SEQ ID NO: 571589 - DNA, 25 bp, Rattus norvegicus
ccggctcgagtagaacaaggtatcc

SEQ ID NO: 571590 - DNA, 25 bp, Rattus norvegicus
ggcgctatacaaactcgtccgcgga

SEQ ID NO: 571591 - DNA, 25 bp, Rattus norvegicus
cagagcagcttcagcctatcatgtc

SEQ ID NO: 571592 - DNA, 25 bp, Rattus norvegicus
gccgggtgtaaacagagcagcttca

SEQ ID NO: 571593 - DNA, 25 bp, Rattus norvegicus
ttccacgcgcggctccacgctctcg

SEQ ID NO: 571594 - DNA, 25 bp, Rattus norvegicus
ggcggttcctcgtgcggttccacgc

SEQ ID NO: 571595 - DNA, 25 bp, Rattus norvegicus
gtgtaaacagagcagcttcagccta

SEQ ID NO: 571596 - DNA, 25 bp, Rattus norvegicus
agcagcttcagcctatcatgtctgg

SEQ ID NO: 571597 - DNA, 25 bp, Rattus norvegicus
gcctatcatgtctggctgccgctcg

SEQ ID NO: 571598 - DNA, 25 bp, Rattus norvegicus
atcatgtctggctgccgctcgcagc

SEQ ID NO: 571599 - DNA, 25 bp, Rattus norvegicus
gagcccggcgctgtaacgcgatccg

SEQ ID NO: 571600 - DNA, 25 bp, Rattus norvegicus
gcgctgtaacgcgatccgctccaga

SEQ ID NO: 571601 - DNA, 25 bp, Rattus norvegicus
atccgctccagacccaggcaagttg

SEQ ID NO: 571602 - DNA, 25 bp, Rattus norvegicus
cgctccagacccaggcaagttggca

SEQ ID NO: 571603 - DNA, 25 bp, Rattus norvegicus
agacccaggcaagttggcagcgccg

SEQ ID NO: 571604 - DNA, 25 bp, Rattus norvegicus
ctccgctccgcacggccacggcgag

SEQ ID NO: 571605 - DNA, 25 bp, Rattus norvegicus
ctgcccgttgttgagcggcagccca

SEQ ID NO: 571606 - DNA, 25 bp, Rattus norvegicus
gctgcgtcatggtttgagaatcgga

SEQ ID NO: 571607 - DNA, 25 bp, Rattus norvegicus
catggtttgagaatcggaatcccta

SEQ ID NO: 571608 - DNA, 25 bp, Rattus norvegicus
tcggaatccctaactgacctggtgg

SEQ ID NO: 571609 - DNA, 25 bp, Rattus norvegicus
tggcaaacgcttttgcctctgccca

SEQ ID NO: 571610 - DNA, 25 bp, Rattus norvegicus
aactgacctggtggtcccttgcgta

SEQ ID NO: 571611 - DNA, 25 bp, Rattus norvegicus
cccttgcgtaggctgagatacatac

SEQ ID NO: 571612 - DNA, 25 bp, Rattus norvegicus
tccgtatcaatgtgcgtgcctggta

SEQ ID NO: 571613 - DNA, 25 bp, Rattus norvegicus
gagcggcagcccacgttcaacttcg

SEQ ID NO: 571614 - DNA, 25 bp, Rattus norvegicus
acttccctccgtatcaatgtgcgtg

SEQ ID NO: 571615 - DNA, 25 bp, Rattus norvegicus
agattcctgatctgcccgttgttga

SEQ ID NO: 571616 - DNA, 25 bp, Rattus norvegicus
tgcgtgcctggtaagattcctgatc

SEQ ID NO: 571617 - DNA, 25 bp, Rattus norvegicus
ttacctccgtggcaaacgcttttgc

SEQ ID NO: 571618 - DNA, 25 bp, Rattus norvegicus
tacatacggagaggcgtttacctcc

SEQ ID NO: 571619 - DNA, 25 bp, Rattus norvegicus
ctctcttgcaaagacacaggtctga

SEQ ID NO: 571620 - DNA, 25 bp, Rattus norvegicus
aggcgcgggaagcagcctcgtccat

SEQ ID NO: 571621 - DNA, 25 bp, Rattus norvegicus
ggctaagatcgtcccgctggctcac

SEQ ID NO: 571622 - DNA, 25 bp, Rattus norvegicus
agcaaaagcgcggatggctaagatc

SEQ ID NO: 571623 - DNA, 25 bp, Rattus norvegicus
atgagtgcgtgagaagcaaaagcgc

SEQ ID NO: 571624 - DNA, 25 bp, Rattus norvegicus
gctggtcctccagtcctgtgtccaa

SEQ ID NO: 571625 - DNA, 25 bp, Rattus norvegicus
gtcctgtgtccaaagttattacttg

SEQ ID NO: 571626 - DNA, 25 bp, Rattus norvegicus
agacacaggtctgagggcccacagc

SEQ ID NO: 571627 - DNA, 25 bp, Rattus norvegicus
tgagggcccacagcttaagtaccca

SEQ ID NO: 571628 - DNA, 25 bp, Rattus norvegicus
agtacccactcaacgctttcgcgtg

SEQ ID NO: 571629 - DNA, 25 bp, Rattus norvegicus
acgcacaggcgcacaaacaaggggc

SEQ ID NO: 571630 - DNA, 25 bp, Rattus norvegicus
cccgaacgaacgcaggcttcctgag

SEQ ID NO: 571631 - DNA, 25 bp, Rattus norvegicus
cttcctgagaaggagatgagtgcgt

SEQ ID NO: 571632 - DNA, 25 bp, Rattus norvegicus
gttattacttgcaggtgaaactcga

SEQ ID NO: 571633 - DNA, 25 bp, Rattus norvegicus
tgggaggagatcctttccgcacaca

SEQ ID NO: 571634 - DNA, 25 bp, Rattus norvegicus
tccggtgacgcttgatcgctgaact

SEQ ID NO: 571635 - DNA, 25 bp, Rattus norvegicus
aaaccgcaccaggtctacgggagtg

SEQ ID NO: 571636 - DNA, 25 bp, Rattus norvegicus
gtagtttagctataggctgcgcttc

SEQ ID NO: 571637 - DNA, 25 bp, Rattus norvegicus
cgcaggcagacgcagacgagaacta

SEQ ID NO: 571638 - DNA, 25 bp, Rattus norvegicus
ggtcaattctcgctagacgtggggt

SEQ ID NO: 571639 - DNA, 25 bp, Rattus norvegicus
tccgcacacacgaggaaggttgagc

SEQ ID NO: 571640 - DNA, 25 bp, Rattus norvegicus
cagtctggactgtagctgctgccca

SEQ ID NO: 571641 - DNA, 25 bp, Rattus norvegicus
gtcttgccaccttccctgggtcatt

SEQ ID NO: 571642 - DNA, 25 bp, Rattus norvegicus
cccgactgctgggaccagaccgata

SEQ ID NO: 571643 - DNA, 25 bp, Rattus norvegicus
cgtgagaacctcagcgcggctttca

SEQ ID NO: 571644 - DNA, 25 bp, Rattus norvegicus
gctttcagccggcaactcaacgtca

SEQ ID NO: 571645 - DNA, 25 bp, Rattus norvegicus
aattcgtgccgtctttcctgcgagg

SEQ ID NO: 571646 - DNA, 25 bp, Rattus norvegicus
cgggtggtagcaagaggtcaattct

SEQ ID NO: 571647 - DNA, 25 bp, Rattus norvegicus
tctccagacggcaccctgtacattg

SEQ ID NO: 571648 - DNA, 25 bp, Rattus norvegicus
tgcagatctggggaatatccggatc

SEQ ID NO: 571649 - DNA, 25 bp, Rattus norvegicus
cgaccgacggggagatctccttagt

SEQ ID NO: 571650 - DNA, 25 bp, Rattus norvegicus
tggctacgccaaagacgccaaactc

SEQ ID NO: 571651 - DNA, 25 bp, Rattus norvegicus
tgtgactgctaccaaaccggagatg

SEQ ID NO: 571652 - DNA, 25 bp, Rattus norvegicus
gactgcaagaacgacgccaactgtg

SEQ ID NO: 571653 - DNA, 25 bp, Rattus norvegicus
ataccctcggaatgtgactgcaaga

SEQ ID NO: 571654 - DNA, 25 bp, Rattus norvegicus
tctccttagtggctgggataccctc

SEQ ID NO: 571655 - DNA, 25 bp, Rattus norvegicus
tcctacagcggggtcctttacatca

SEQ ID NO: 571656 - DNA, 25 bp, Rattus norvegicus
atgcggttcagaccaccctggagtc

SEQ ID NO: 571657 - DNA, 25 bp, Rattus norvegicus
gcccatgcactgtcaggtccctgga

SEQ ID NO: 571658 - DNA, 25 bp, Rattus norvegicus
accgaataaggcaggtcacgaccga

SEQ ID NO: 571659 - DNA, 25 bp, Rattus norvegicus
gaaaaccggcaagttcgcatcgctg

SEQ ID NO: 571660 - DNA, 25 bp, Rattus norvegicus
caccgaaactgatgagaagaagatc

SEQ ID NO: 571661 - DNA, 25 bp, Rattus norvegicus
tccgctacggcatgaccctggacga

SEQ ID NO: 571662 - DNA, 25 bp, Rattus norvegicus
gcagggctacgatgggtactacgta

SEQ ID NO: 571663 - DNA, 25 bp, Rattus norvegicus
gttcgctgacgtggagatgcagttc

SEQ ID NO: 571664 - DNA, 25 bp, Rattus norvegicus
aacgtgaccgtgtcgcaatccacca

SEQ ID NO: 571665 - DNA, 25 bp, Rattus norvegicus
acggtcaagtcgctcatcggcaagg

SEQ ID NO: 571666 - DNA, 25 bp, Rattus norvegicus
cgtgcagaccaacgtgctcaacatc

SEQ ID NO: 571667 - DNA, 25 bp, Rattus norvegicus
ttcatcaagaccaccacgccagaga

SEQ ID NO: 571668 - DNA, 25 bp, Rattus norvegicus
ggcaaggacacgcactacttcatca

SEQ ID NO: 571669 - DNA, 25 bp, Rattus norvegicus
tcgccaacgaggactgcatcaaggt

SEQ ID NO: 571670 - DNA, 25 bp, Rattus norvegicus
cggcggtgctcaacaatgccttcta

SEQ ID NO: 571671 - DNA, 25 bp, Rattus norvegicus
caaggcgctggagaacggtatcaac

SEQ ID NO: 571672 - DNA, 25 bp, Rattus norvegicus
ttctacctggagaacctgcacttca

SEQ ID NO: 571673 - DNA, 25 bp, Rattus norvegicus
actacgtactgtccgtggagcagta

SEQ ID NO: 571674 - DNA, 25 bp, Rattus norvegicus
ctgcacttcaccatcgagggcaagg

SEQ ID NO: 571675 - DNA, 25 bp, Rattus norvegicus
tgctacagcatcgacaagatcggtg

SEQ ID NO: 571676 - DNA, 25 bp, Rattus norvegicus
ctagcgcaggtcaccagcaagccgg

SEQ ID NO: 571677 - DNA, 25 bp, Rattus norvegicus
cagcagctagcgcaggtcaccagca

SEQ ID NO: 571678 - DNA, 25 bp, Rattus norvegicus
agcagctagcgcaggtcaccagcaa

SEQ ID NO: 571679 - DNA, 25 bp, Rattus norvegicus
gcagctagcgcaggtcaccagcaag

SEQ ID NO: 571680 - DNA, 25 bp, Rattus norvegicus
cagctagcgcaggtcaccagcaagc

SEQ ID NO: 571681 - DNA, 25 bp, Rattus norvegicus
agctagcgcaggtcaccagcaagcc

SEQ ID NO: 571682 - DNA, 25 bp, Rattus norvegicus
agcgcaggtcaccagcaagccggca

SEQ ID NO: 571683 - DNA, 25 bp, Rattus norvegicus
ctgcagcctgctacagcatcgacaa

SEQ ID NO: 571684 - DNA, 25 bp, Rattus norvegicus
gcagcctgctacagcatcgacaaga

SEQ ID NO: 571685 - DNA, 25 bp, Rattus norvegicus
agcctgctacagcatcgacaagatc

SEQ ID NO: 571686 - DNA, 25 bp, Rattus norvegicus
gcctgctacagcatcgacaagatcg

SEQ ID NO: 571687 - DNA, 25 bp, Rattus norvegicus
cctgctacagcatcgacaagatcgg

SEQ ID NO: 571688 - DNA, 25 bp, Rattus norvegicus
ctgctacagcatcgacaagatcggt

SEQ ID NO: 571689 - DNA, 25 bp, Rattus norvegicus
gtccctgtgcggtttatcctgcttt

SEQ ID NO: 571690 - DNA, 25 bp, Rattus norvegicus
ccacgtgggcgtcagaagagactct

SEQ ID NO: 571691 - DNA, 25 bp, Rattus norvegicus
ttttttgtgcactcagggagggacc

SEQ ID NO: 571692 - DNA, 25 bp, Rattus norvegicus
cagtgacttttacggtccctgtgcg

SEQ ID NO: 571693 - DNA, 25 bp, Rattus norvegicus
agccgggtgttgcagtgacttttac

SEQ ID NO: 571694 - DNA, 25 bp, Rattus norvegicus
tgatctgcagtctgcccagcacgcg

SEQ ID NO: 571695 - DNA, 25 bp, Rattus norvegicus
cccgggtagagttgatctgcagtct

SEQ ID NO: 571696 - DNA, 25 bp, Rattus norvegicus
cagccgtcccgggtagagttgatct

SEQ ID NO: 571697 - DNA, 25 bp, Rattus norvegicus
cgtggcttgcagctccacgcgatca

SEQ ID NO: 571698 - DNA, 25 bp, Rattus norvegicus
gtgcaggccacgctcagacggtccg

SEQ ID NO: 571699 - DNA, 25 bp, Rattus norvegicus
agcaccggagcagggtcctccgcga

SEQ ID NO: 571700 - DNA, 25 bp, Rattus norvegicus
cacgtgcaggctgagcaccggagca

SEQ ID NO: 571701 - DNA, 25 bp, Rattus norvegicus
gtgcagcccacgtgcaggctgagca

SEQ ID NO: 571702 - DNA, 25 bp, Rattus norvegicus
gaagagactctgagtgcgccctccc

SEQ ID NO: 571703 - DNA, 25 bp, Rattus norvegicus
cgacgcagacatggtggactgatcc

SEQ ID NO: 571704 - DNA, 25 bp, Rattus norvegicus
ggattcctgaggctcctccgcgcgt

SEQ ID NO: 571705 - DNA, 25 bp, Rattus norvegicus
aggccgccgaccatgcctaggagag

SEQ ID NO: 571706 - DNA, 25 bp, Rattus norvegicus
ctacgacggcaaggttttctacatc

SEQ ID NO: 571707 - DNA, 25 bp, Rattus norvegicus
tcctctcgaaagtcttgtggtttcc

SEQ ID NO: 571708 - DNA, 25 bp, Rattus norvegicus
tcgcctgttccgacgcagacatggt

SEQ ID NO: 571709 - DNA, 25 bp, Rattus norvegicus
ggagcttcccggatccgagcccaga

SEQ ID NO: 571710 - DNA, 25 bp, Rattus norvegicus
tcgcacgcaaatgaggaggccagtc

SEQ ID NO: 571711 - DNA, 25 bp, Rattus norvegicus
cgggccgcatgctaatcgcacgcaa

SEQ ID NO: 571712 - DNA, 25 bp, Rattus norvegicus
tctttagacttctttctcgtccaga

SEQ ID NO: 571713 - DNA, 25 bp, Rattus norvegicus
tactgttgttgggacttcttccagg

SEQ ID NO: 571714 - DNA, 25 bp, Rattus norvegicus
gcgttctgtgcccttactgttgttg

SEQ ID NO: 571715 - DNA, 25 bp, Rattus norvegicus
caccgctaggaacagccaaggcacg

SEQ ID NO: 571716 - DNA, 25 bp, Rattus norvegicus
ctgcagggttaagctcaggaatgtg

SEQ ID NO: 571717 - DNA, 25 bp, Rattus norvegicus
ccaacatggcgcaggaggtatccga

SEQ ID NO: 571718 - DNA, 25 bp, Rattus norvegicus
cactgtcggtcctcggaaggcaaga

SEQ ID NO: 571719 - DNA, 25 bp, Rattus norvegicus
gagcgtcgctatccagccttccggg

SEQ ID NO: 571720 - DNA, 25 bp, Rattus norvegicus
gggcaaaccatgtcttcctagggtg

SEQ ID NO: 571721 - DNA, 25 bp, Rattus norvegicus
gccgggagtttctgcttcgcaatgc

SEQ ID NO: 571722 - DNA, 25 bp, Rattus norvegicus
gagacggacaaacactggcgccacc

SEQ ID NO: 571723 - DNA, 25 bp, Rattus norvegicus
ttctgttgtttggtgtttgggcttc

SEQ ID NO: 571724 - DNA, 25 bp, Rattus norvegicus
agacccttcgctgcgagggcgagac

SEQ ID NO: 571725 - DNA, 25 bp, Rattus norvegicus
gtatccgagtacctgagccagaacc

SEQ ID NO: 571726 - DNA, 25 bp, Rattus norvegicus
ttataaaagggagcgagccagcggc

SEQ ID NO: 571727 - DNA, 25 bp, Rattus norvegicus
aaagcatcctgggagaacgcgctcg

SEQ ID NO: 571728 - DNA, 25 bp, Rattus norvegicus
tcgtctcgcagggtcccaacatggc

SEQ ID NO: 571729 - DNA, 25 bp, Rattus norvegicus
tttgtttattttggccgcgcgcgac

SEQ ID NO: 571730 - DNA, 25 bp, Rattus norvegicus
ggccatggaagccagcttttgttta

SEQ ID NO: 571731 - DNA, 25 bp, Rattus norvegicus
cggtttattagaggcctgtgacgta

SEQ ID NO: 571732 - DNA, 25 bp, Rattus norvegicus
ccttacccggtaatgacagatgcca

SEQ ID NO: 571733 - DNA, 25 bp, Rattus norvegicus
tgacagatgccaagccggtgcacaa

SEQ ID NO: 571734 - DNA, 25 bp, Rattus norvegicus
tctcgaatggtgagtgagagcctta

SEQ ID NO: 571735 - DNA, 25 bp, Rattus norvegicus
ccggaggaaagatggtttacatctc

SEQ ID NO: 571736 - DNA, 25 bp, Rattus norvegicus
tacggcaacatcagggcgtccggtc

SEQ ID NO: 571737 - DNA, 25 bp, Rattus norvegicus
gtcaggagttgtctcccagcagcca

SEQ ID NO: 571738 - DNA, 25 bp, Rattus norvegicus
cctctagcctgtcttcggtttatta

SEQ ID NO: 571739 - DNA, 25 bp, Rattus norvegicus
cccggtacagcgaattcccgttgtg

SEQ ID NO: 571740 - DNA, 25 bp, Rattus norvegicus
atatccggtctcctgactcagcgtc

SEQ ID NO: 571741 - DNA, 25 bp, Rattus norvegicus
tccacgccagcggaagttaattgtg

SEQ ID NO: 571742 - DNA, 25 bp, Rattus norvegicus
gtccggtcttctctgtcgctaggaa

SEQ ID NO: 571743 - DNA, 25 bp, Rattus norvegicus
ggtggcaatcgcaggtccctgaagc

SEQ ID NO: 571744 - DNA, 25 bp, Rattus norvegicus
gagagccttaccctgggccgcttct

SEQ ID NO: 571745 - DNA, 25 bp, Rattus norvegicus
tacgtgcaggactacctggagtgtg

SEQ ID NO: 571746 - DNA, 25 bp, Rattus norvegicus
ccaggcgagagttgacagaccaatc

SEQ ID NO: 571747 - DNA, 25 bp, Rattus norvegicus
ttgacagaccaatcgcccgggtggc

SEQ ID NO: 571748 - DNA, 25 bp, Rattus norvegicus
gcgggagaatgcgaactcttcggta

SEQ ID NO: 571749 - DNA, 25 bp, Rattus norvegicus
cccagccttattaggagtgagtgct

SEQ ID NO: 571750 - DNA, 25 bp, Rattus norvegicus
caagtccactgagactccgacaggc

SEQ ID NO: 571751 - DNA, 25 bp, Rattus norvegicus
ggctgctcacctgctacgtgcagga

SEQ ID NO: 571752 - DNA, 25 bp, Rattus norvegicus
cccacgacatgcagaggaacgtgtc

SEQ ID NO: 571753 - DNA, 25 bp, Rattus norvegicus
ctgcgggagctggacaacaaatacc

SEQ ID NO: 571754 - DNA, 25 bp, Rattus norvegicus
ataccaaggtactttccctctctcg

SEQ ID NO: 571755 - DNA, 25 bp, Rattus norvegicus
tctctcgggtgtaagtgtgcgcgaa

SEQ ID NO: 571756 - DNA, 25 bp, Rattus norvegicus
agggtcctgcacaacacactcgcgg

SEQ ID NO: 571757 - DNA, 25 bp, Rattus norvegicus
tccgacaggcaaggaggctgatagc

SEQ ID NO: 571758 - DNA, 25 bp, Rattus norvegicus
gtgcgcgaagtgcaccgagcgatct

SEQ ID NO: 571759 - DNA, 25 bp, Rattus norvegicus
cacgatcgcttctcctattggcttc

SEQ ID NO: 571760 - DNA, 25 bp, Rattus norvegicus
aggaagtgcttcctgtgccaacgga

SEQ ID NO: 571761 - DNA, 25 bp, Rattus norvegicus
attccaggactggtgtgcggtactg

SEQ ID NO: 571762 - DNA, 25 bp, Rattus norvegicus
accagctactgatgggcggtaacga

SEQ ID NO: 571763 - DNA, 25 bp, Rattus norvegicus
ccaggatcacgttaagggacaccta

SEQ ID NO: 571764 - DNA, 25 bp, Rattus norvegicus
tcgcgttaagtgcaatcgggaacca

SEQ ID NO: 571765 - DNA, 25 bp, Rattus norvegicus
gaaaccttccttgcagccgtgggta

SEQ ID NO: 571766 - DNA, 25 bp, Rattus norvegicus
gctcggcgttcgctaccgcgaagaa

SEQ ID NO: 571767 - DNA, 25 bp, Rattus norvegicus
caccaacgtgggacatccggacagg

SEQ ID NO: 571768 - DNA, 25 bp, Rattus norvegicus
ggttctcacctcctgatcctcgttg

SEQ ID NO: 571769 - DNA, 25 bp, Rattus norvegicus
agaggtgaccagtcctgggttctca

SEQ ID NO: 571770 - DNA, 25 bp, Rattus norvegicus
tccggacaggcaatgaaggctctca

SEQ ID NO: 571771 - DNA, 25 bp, Rattus norvegicus
gcggtactgtcactcaagcccagga

SEQ ID NO: 571772 - DNA, 25 bp, Rattus norvegicus
ctctcagagcgaaggacatgtgcga

SEQ ID NO: 571773 - DNA, 25 bp, Rattus norvegicus
atcggggctacggtgtcagcttttc

SEQ ID NO: 571774 - DNA, 25 bp, Rattus norvegicus
ctcaggtgtgttggcgccgttctca

SEQ ID NO: 571775 - DNA, 25 bp, Rattus norvegicus
ctcgttgctcggctcaggtgtgttg

SEQ ID NO: 571776 - DNA, 25 bp, Rattus norvegicus
ccttttccagggtggcgacctggtg

SEQ ID NO: 571777 - DNA, 25 bp, Rattus norvegicus
gacatccttttccagggtggcgacc

SEQ ID NO: 571778 - DNA, 25 bp, Rattus norvegicus
cgtccttgcgacatccttttccagg

SEQ ID NO: 571779 - DNA, 25 bp, Rattus norvegicus
gtggccagcccttccgtccttgcga

SEQ ID NO: 571780 - DNA, 25 bp, Rattus norvegicus
cccggtagttccaggtctgcgtggc

SEQ ID NO: 571781 - DNA, 25 bp, Rattus norvegicus
gatcccggtagttccaggtctgcgt

SEQ ID NO: 571782 - DNA, 25 bp, Rattus norvegicus
gagagtcgggatcccggtagttcca

SEQ ID NO: 571783 - DNA, 25 bp, Rattus norvegicus
ttttccacgcctcgcgggcctggga

SEQ ID NO: 571784 - DNA, 25 bp, Rattus norvegicus
gtgtcagcttttccacgcctcgcgg

SEQ ID NO: 571785 - DNA, 25 bp, Rattus norvegicus
tgttggcgccgttctcactctctcg

SEQ ID NO: 571786 - DNA, 25 bp, Rattus norvegicus
tacggtgtcagcttttccacgcctc

SEQ ID NO: 571787 - DNA, 25 bp, Rattus norvegicus
tagcgagaccttcttggaacacgtc

SEQ ID NO: 571788 - DNA, 25 bp, Rattus norvegicus
tccacagcctcggaatggggcaatg

SEQ ID NO: 571789 - DNA, 25 bp, Rattus norvegicus
gggcaatgtctcctcgtcatcctcg

SEQ ID NO: 571790 - DNA, 25 bp, Rattus norvegicus
aggcacctctggtcgaacctcagtc

SEQ ID NO: 571791 - DNA, 25 bp, Rattus norvegicus
ggcggccttgccttctaggtaggaa

SEQ ID NO: 571792 - DNA, 25 bp, Rattus norvegicus
gcgcagtaactgtgctccgcccaga

SEQ ID NO: 571793 - DNA, 25 bp, Rattus norvegicus
gcccagacgagatagctcagccatt

SEQ ID NO: 571794 - DNA, 25 bp, Rattus norvegicus
cagacagcaggttattggccggata

SEQ ID NO: 571795 - DNA, 25 bp, Rattus norvegicus
ccggatagagtaggtcacgttgcac

SEQ ID NO: 571796 - DNA, 25 bp, Rattus norvegicus
ggccagactgctcttctctacggaa

SEQ ID NO: 571797 - DNA, 25 bp, Rattus norvegicus
gccagcactgctatcgtttcgcaca

SEQ ID NO: 571798 - DNA, 25 bp, Rattus norvegicus
cgtgcccgtgtacagcatcactcta

SEQ ID NO: 571799 - DNA, 25 bp, Rattus norvegicus
cgtggcttccgtaaccaatgaaatg

SEQ ID NO: 571800 - DNA, 25 bp, Rattus norvegicus
cgggtcttgcaccaccatagcgaga

SEQ ID NO: 571801 - DNA, 25 bp, Rattus norvegicus
cccgttcgagcctctggaatgaaga

SEQ ID NO: 571802 - DNA, 25 bp, Rattus norvegicus
ggacgagtgtaaaatccgagccttc

SEQ ID NO: 571803 - DNA, 25 bp, Rattus norvegicus
cccaggaatctggaagctgaaagcc

SEQ ID NO: 571804 - DNA, 25 bp, Rattus norvegicus
ttagcatgacactgggtagccatcc

SEQ ID NO: 571805 - DNA, 25 bp, Rattus norvegicus
cccgccagccttggaaggaggaagc

SEQ ID NO: 571806 - DNA, 25 bp, Rattus norvegicus
aagcccggcggattgcaaatgaagt

SEQ ID NO: 571807 - DNA, 25 bp, Rattus norvegicus
tgaagactgactcccgaggactgcg

SEQ ID NO: 571808 - DNA, 25 bp, Rattus norvegicus
cgcgctgaagcctcctagtgcggtt

SEQ ID NO: 571809 - DNA, 25 bp, Rattus norvegicus
aggcctcggcttcctcatttgtttg

SEQ ID NO: 571810 - DNA, 25 bp, Rattus norvegicus
tggcgcacagttggctaagcactcc

SEQ ID NO: 571811 - DNA, 25 bp, Rattus norvegicus
ctaagcactcctgcgctgaatcggg

SEQ ID NO: 571812 - DNA, 25 bp, Rattus norvegicus
gggccattgtctgcgctcccattgc

SEQ ID NO: 571813 - DNA, 25 bp, Rattus norvegicus
tgcttccacgctgcaagtctcggcg

SEQ ID NO: 571814 - DNA, 25 bp, Rattus norvegicus
ggtgccagagcgcaacgcgctagtc

SEQ ID NO: 571815 - DNA, 25 bp, Rattus norvegicus
atttcattttcacttccccacgtcg

SEQ ID NO: 571816 - DNA, 25 bp, Rattus norvegicus
gcctacgcggctttcatcatttctc

SEQ ID NO: 571817 - DNA, 25 bp, Rattus norvegicus
tcatttctcggaaaagtcaatttca

SEQ ID NO: 571818 - DNA, 25 bp, Rattus norvegicus
tctcggaaaagtcaatttcattttc

SEQ ID NO: 571819 - DNA, 25 bp, Rattus norvegicus
agcaacaagcggcagcacgtgagtg

SEQ ID NO: 571820 - DNA, 25 bp, Rattus norvegicus
caacaagcggcagcacgtgagtgtg

SEQ ID NO: 571821 - DNA, 25 bp, Rattus norvegicus
ttcaccgcggccacgctgggagtgt

SEQ ID NO: 571822 - DNA, 25 bp, Rattus norvegicus
ctggctagcgagctggccaccacaa

SEQ ID NO: 571823 - DNA, 25 bp, Rattus norvegicus
tagcgagctggccaccacaaggtgg

SEQ ID NO: 571824 - DNA, 25 bp, Rattus norvegicus
cattggtggcctacgcggctttcat

SEQ ID NO: 571825 - DNA, 25 bp, Rattus norvegicus
ccaccacaaggtggccgtagggaag

SEQ ID NO: 571826 - DNA, 25 bp, Rattus norvegicus
ccgccgctgttcattggtggcctac

SEQ ID NO: 571827 - DNA, 25 bp, Rattus norvegicus
aggtgcggaagttcgccgccgctgt

SEQ ID NO: 571828 - DNA, 25 bp, Rattus norvegicus
gcggctttcatcatttctcggaaaa

SEQ ID NO: 571829 - DNA, 25 bp, Rattus norvegicus
cgcacctcaggaacactaagctttg

SEQ ID NO: 571830 - DNA, 25 bp, Rattus norvegicus
acactaagctttgatcccaccaaca

SEQ ID NO: 571831 - DNA, 25 bp, Rattus norvegicus
ttcacccaggtttagggacaccagc

SEQ ID NO: 571832 - DNA, 25 bp, Rattus norvegicus
atattcgagggtctgagtcctgccc

SEQ ID NO: 571833 - DNA, 25 bp, Rattus norvegicus
ctggaaagcgcgaaagcagcagaca

SEQ ID NO: 571834 - DNA, 25 bp, Rattus norvegicus
accggcgctgtttccagcttctctg

SEQ ID NO: 571835 - DNA, 25 bp, Rattus norvegicus
tagggacaccagcttggcctcccgg

SEQ ID NO: 571836 - DNA, 25 bp, Rattus norvegicus
aacacaaaggatcctccgcccagat

SEQ ID NO: 571837 - DNA, 25 bp, Rattus norvegicus
ccggtggcaacgcaggtcctggaaa

SEQ ID NO: 571838 - DNA, 25 bp, Rattus norvegicus
gcctggaggcaacacaaaggatcct

SEQ ID NO: 571839 - DNA, 25 bp, Rattus norvegicus
gcctcttcctaggagctgcagactg

SEQ ID NO: 571840 - DNA, 25 bp, Rattus norvegicus
ttcagtgcttgcctgagcaagcctg

SEQ ID NO: 571841 - DNA, 25 bp, Rattus norvegicus
ccctgcgccatattcgagggtctga

SEQ ID NO: 571842 - DNA, 25 bp, Rattus norvegicus
aaccctaatttccagcgcgccagga

SEQ ID NO: 571843 - DNA, 25 bp, Rattus norvegicus
acagtccgtgtccacgcgcggtgag

SEQ ID NO: 571844 - DNA, 25 bp, Rattus norvegicus
acgtcctgtctctgcggtgcaccag

SEQ ID NO: 571845 - DNA, 25 bp, Rattus norvegicus
acctgtgcagcgaggaacgtcctgt

SEQ ID NO: 571846 - DNA, 25 bp, Rattus norvegicus
tcccggcacctgaaccgagcaggga

SEQ ID NO: 571847 - DNA, 25 bp, Rattus norvegicus
gtcacagagcagcaccgggacagtc

SEQ ID NO: 571848 - DNA, 25 bp, Rattus norvegicus
agggaaggtcccagccgtcacacca

SEQ ID NO: 571849 - DNA, 25 bp, Rattus norvegicus
ggcggctgtcactgcaatccacgaa

SEQ ID NO: 571850 - DNA, 25 bp, Rattus norvegicus
tacttatgacatcgggctctgagcg

SEQ ID NO: 571851 - DNA, 25 bp, Rattus norvegicus
cggctagggtcgctttggccgacac

SEQ ID NO: 571852 - DNA, 25 bp, Rattus norvegicus
ccgcgcagggttgcgatgctattta

SEQ ID NO: 571853 - DNA, 25 bp, Rattus norvegicus
gagcctcccgaagccgagggaaatg

SEQ ID NO: 571854 - DNA, 25 bp, Rattus norvegicus
tgctatttaaggagtcgcggccgca

SEQ ID NO: 571855 - DNA, 25 bp, Rattus norvegicus
gcagctgctctgttggctgcgccac

SEQ ID NO: 571856 - DNA, 25 bp, Rattus norvegicus
aaagcggaacgtcccgcagagcctc

SEQ ID NO: 571857 - DNA, 25 bp, Rattus norvegicus
tcaccaagtcgtgtgagaaaagcct

SEQ ID NO: 571858 - DNA, 25 bp, Rattus norvegicus
agactcagcggtgggactaaaggaa

SEQ ID NO: 571859 - DNA, 25 bp, Rattus norvegicus
tgggactaaaggaagcgacactgtt

SEQ ID NO: 571860 - DNA, 25 bp, Rattus norvegicus
acactgttttgtgagggtcctcgcc

SEQ ID NO: 571861 - DNA, 25 bp, Rattus norvegicus
tgctgggatttgtaaacagacgatc

SEQ ID NO: 571862 - DNA, 25 bp, Rattus norvegicus
ctctggacaggctttaaaacccact

SEQ ID NO: 571863 - DNA, 25 bp, Rattus norvegicus
attactttaatgactctggacaggc

SEQ ID NO: 571864 - DNA, 25 bp, Rattus norvegicus
ttgaacccggcggaacagcctatta

SEQ ID NO: 571865 - DNA, 25 bp, Rattus norvegicus
acagacgatcgtgtgagactcagcg

SEQ ID NO: 571866 - DNA, 25 bp, Rattus norvegicus
gagctctcccttgaacccggcggaa

SEQ ID NO: 571867 - DNA, 25 bp, Rattus norvegicus
agagggacgtgtcaccaagtcgtgt

SEQ ID NO: 571868 - DNA, 25 bp, Rattus norvegicus
cctgccgggatgtccggacaaataa

SEQ ID NO: 571869 - DNA, 25 bp, Rattus norvegicus
agtcgcgtgccaaagacccgcggga

SEQ ID NO: 571870 - DNA, 25 bp, Rattus norvegicus
ctctgcgccagcgaagagtgcaggc

SEQ ID NO: 571871 - DNA, 25 bp, Rattus norvegicus
cgaagccacagtgttcccgcagggg

SEQ ID NO: 571872 - DNA, 25 bp, Rattus norvegicus
ggagaccaaagacaccaagtacgcg

SEQ ID NO: 571873 - DNA, 25 bp, Rattus norvegicus
gcgcgcatccttgccttcttgcaat

SEQ ID NO: 571874 - DNA, 25 bp, Rattus norvegicus
ttcttgcaatccaaggctcgcctgg

SEQ ID NO: 571875 - DNA, 25 bp, Rattus norvegicus
caatccaaggctcgcctgggcgcgg

SEQ ID NO: 571876 - DNA, 25 bp, Rattus norvegicus
tcccggagccggatttctcctatca

SEQ ID NO: 571877 - DNA, 25 bp, Rattus norvegicus
agccggatttctcctatcaactgca

SEQ ID NO: 571878 - DNA, 25 bp, Rattus norvegicus
atttctcctatcaactgcatccagc

SEQ ID NO: 571879 - DNA, 25 bp, Rattus norvegicus
cacagcccgggcgaagccacagtgt

SEQ ID NO: 571880 - DNA, 25 bp, Rattus norvegicus
cccaggttcattcccttggcctcct

SEQ ID NO: 571881 - DNA, 25 bp, Rattus norvegicus
gcactgccttacttgtccagcgcga

SEQ ID NO: 571882 - DNA, 25 bp, Rattus norvegicus
agacaccaagtacgcgcgcatcctt

SEQ ID NO: 571883 - DNA, 25 bp, Rattus norvegicus
atccagccggcccagagttcccggg

SEQ ID NO: 571884 - DNA, 25 bp, Rattus norvegicus
tggagcggatggagaccaaagacac

SEQ ID NO: 571885 - DNA, 25 bp, Rattus norvegicus
taaggacttcctggcaggtggcatc

SEQ ID NO: 571886 - DNA, 25 bp, Rattus norvegicus
ttccttaaggacttcctggcaggtg

SEQ ID NO: 571887 - DNA, 25 bp, Rattus norvegicus
cccggctttcagcatgggggatcag

SEQ ID NO: 571888 - DNA, 25 bp, Rattus norvegicus
ggcccagccaatgcgcgctgcgcgc

SEQ ID NO: 571889 - DNA, 25 bp, Rattus norvegicus
gcgagacgcggagccggggatataa

SEQ ID NO: 571890 - DNA, 25 bp, Rattus norvegicus
atataaggagggctgcggtcaggcg

SEQ ID NO: 571891 - DNA, 25 bp, Rattus norvegicus
tcccttcgcgtcgtgcagggacgga

SEQ ID NO: 571892 - DNA, 25 bp, Rattus norvegicus
caagagcaaaagagcggctccttgc

SEQ ID NO: 571893 - DNA, 25 bp, Rattus norvegicus
ggctccttgcagactgtgcgcgccc

SEQ ID NO: 571894 - DNA, 25 bp, Rattus norvegicus
tgagcttccttaaggacttcctggc

SEQ ID NO: 571895 - DNA, 25 bp, Rattus norvegicus
tcaggctttgagcttccttaaggac

SEQ ID NO: 571896 - DNA, 25 bp, Rattus norvegicus
ccgccgccgtctccaagaccgcggt

SEQ ID NO: 571897 - DNA, 25 bp, Rattus norvegicus
ggggatcaggctttgagcttcctta

SEQ ID NO: 571898 - DNA, 25 bp, Rattus norvegicus
acttcctggcaggtggcatcgccgc

SEQ ID NO: 571899 - DNA, 25 bp, Rattus norvegicus
gcagagatgacccaagccgaaaagg

SEQ ID NO: 571900 - DNA, 25 bp, Rattus norvegicus
ccagaatcctctacgggtgacgccg

SEQ ID NO: 571901 - DNA, 25 bp, Rattus norvegicus
tctggccttggttagaccacggcta

SEQ ID NO: 571902 - DNA, 25 bp, Rattus norvegicus
tcagtcccagaatcctctacgggtg

SEQ ID NO: 571903 - DNA, 25 bp, Rattus norvegicus
aatcctctacgggtgacgccggtgg

SEQ ID NO: 571904 - DNA, 25 bp, Rattus norvegicus
cggccatcttgactgtgggcagcca

SEQ ID NO: 571905 - DNA, 25 bp, Rattus norvegicus
ccatcttgactgtgggcagccaggg

SEQ ID NO: 571906 - DNA, 25 bp, Rattus norvegicus
gcgcctgcgcgatggttctccactg

SEQ ID NO: 571907 - DNA, 25 bp, Rattus norvegicus
cgatggttctccactgcctactgtg

SEQ ID NO: 571908 - DNA, 25 bp, Rattus norvegicus
tggtggcagagatgacccaagccga

SEQ ID NO: 571909 - DNA, 25 bp, Rattus norvegicus
cttggttagaccacggctagcctgg

SEQ ID NO: 571910 - DNA, 25 bp, Rattus norvegicus
cactggtccccgagtcgctgcagga

SEQ ID NO: 571911 - DNA, 25 bp, Rattus norvegicus
tccactgcctactgtggcgtcggtg

SEQ ID NO: 571912 - DNA, 25 bp, Rattus norvegicus
gggtcgtgccctcagtcccagaatc

SEQ ID NO: 571913 - DNA, 25 bp, Rattus norvegicus
aaaggagaccgccagggcctccctg

SEQ ID NO: 571914 - DNA, 25 bp, Rattus norvegicus
acgcgttggaagctagcggagactc

SEQ ID NO: 571915 - DNA, 25 bp, Rattus norvegicus
ctgtccagggcatcacctgctcgta

SEQ ID NO: 571916 - DNA, 25 bp, Rattus norvegicus
acagcttctcggcagggcctcgaga

SEQ ID NO: 571917 - DNA, 25 bp, Rattus norvegicus
gctcctgtcgtccatagttccaaga

SEQ ID NO: 571918 - DNA, 25 bp, Rattus norvegicus
tgccgaagatggtcctggcagcgct

SEQ ID NO: 571919 - DNA, 25 bp, Rattus norvegicus
cggagactcgcgcacacgtgagcgc

SEQ ID NO: 571920 - DNA, 25 bp, Rattus norvegicus
atttctccctcccacgcgttggaag

SEQ ID NO: 571921 - DNA, 25 bp, Rattus norvegicus
agcgttcgggttctcgttcgctctg

SEQ ID NO: 571922 - DNA, 25 bp, Rattus norvegicus
gaactgtggccgctaccgactctcg

SEQ ID NO: 571923 - DNA, 25 bp, Rattus norvegicus
agccgctcacctgggaactgtggcc

SEQ ID NO: 571924 - DNA, 25 bp, Rattus norvegicus
atgcggaagcccgtgagccgctcac

SEQ ID NO: 571925 - DNA, 25 bp, Rattus norvegicus
gacagtctgtgtcctcccgtagagg

SEQ ID NO: 571926 - DNA, 25 bp, Rattus norvegicus
cggaacggagtctctgccgaagatg

SEQ ID NO: 571927 - DNA, 25 bp, Rattus norvegicus
gcatgagcacgggctgcccttgcct

SEQ ID NO: 571928 - DNA, 25 bp, Rattus norvegicus
tcgccagcggcccaggaagcagcat

SEQ ID NO: 571929 - DNA, 25 bp, Rattus norvegicus
ggaagcagcatgcaccgcgatgcca

SEQ ID NO: 571930 - DNA, 25 bp, Rattus norvegicus
gcaccgcgatgccaccgacagcagc

SEQ ID NO: 571931 - DNA, 25 bp, Rattus norvegicus
tgcgcctcagcctgtacctgagctg

SEQ ID NO: 571932 - DNA, 25 bp, Rattus norvegicus
ctggggacactggtcgcgctcgtct

SEQ ID NO: 571933 - DNA, 25 bp, Rattus norvegicus
tggtcgcgctcgtctgctggagccc

SEQ ID NO: 571934 - DNA, 25 bp, Rattus norvegicus
agccgccggacttcgcctcttcctg

SEQ ID NO: 571935 - DNA, 25 bp, Rattus norvegicus
ccgctgtccgctgcgggtgagtacc

SEQ ID NO: 571936 - DNA, 25 bp, Rattus norvegicus
tgagtaccggtctcggctgcctcgc

SEQ ID NO: 571937 - DNA, 25 bp, Rattus norvegicus
tcccgcatcctaagcccgctgagga

SEQ ID NO: 571938 - DNA, 25 bp, Rattus norvegicus
ccactgtcagtcagccgcaggtacc

SEQ ID NO: 571939 - DNA, 25 bp, Rattus norvegicus
gtcccgctacctgggcacgccaggt

SEQ ID NO: 571940 - DNA, 25 bp, Rattus norvegicus
gggtctactgcgattggtcgcgccc

SEQ ID NO: 571941 - DNA, 25 bp, Rattus norvegicus
gctcccggcacagcagtcacccaga

SEQ ID NO: 571942 - DNA, 25 bp, Rattus norvegicus
tgtcagcacccgtatgtcgctagtg

SEQ ID NO: 571943 - DNA, 25 bp, Rattus norvegicus
tgggcctgtgtcagcacccgtatgt

SEQ ID NO: 571944 - DNA, 25 bp, Rattus norvegicus
tgtgtgcacagagcggcctcgccac

SEQ ID NO: 571945 - DNA, 25 bp, Rattus norvegicus
gcggtagccgcagaacaaaggagcc

SEQ ID NO: 571946 - DNA, 25 bp, Rattus norvegicus
tgtgataagaagcagcggtagccgc

SEQ ID NO: 571947 - DNA, 25 bp, Rattus norvegicus
cgttgtgataagaagcagcggtagc

SEQ ID NO: 571948 - DNA, 25 bp, Rattus norvegicus
attggaactcgggttcacgggctct

SEQ ID NO: 571949 - DNA, 25 bp, Rattus norvegicus
taccgcagaaaacgttgtgataaga

SEQ ID NO: 571950 - DNA, 25 bp, Rattus norvegicus
ctgcctgcccagataccgcagaaaa

SEQ ID NO: 571951 - DNA, 25 bp, Rattus norvegicus
ggttcacgggctctagcacacgctc

SEQ ID NO: 571952 - DNA, 25 bp, Rattus norvegicus
acccgtatgtcgctagtgccttagc

SEQ ID NO: 571953 - DNA, 25 bp, Rattus norvegicus
tcttggagccaacgaggaacgagtg

SEQ ID NO: 571954 - DNA, 25 bp, Rattus norvegicus
gcccagataccgcagaaaacgttgt

SEQ ID NO: 571955 - DNA, 25 bp, Rattus norvegicus
ggatatcaaccctcttcacccatgg

SEQ ID NO: 571956 - DNA, 25 bp, Rattus norvegicus
ccgaagctcaaaggccaggatatca

SEQ ID NO: 571957 - DNA, 25 bp, Rattus norvegicus
tccacccagcggtacgtgcctagtt

SEQ ID NO: 571958 - DNA, 25 bp, Rattus norvegicus
ctccagagggataaaagggcttgac

SEQ ID NO: 571959 - DNA, 25 bp, Rattus norvegicus
aggcgacttccgcttctccagaggg

SEQ ID NO: 571960 - DNA, 25 bp, Rattus norvegicus
ttcccgctacgtgcgtgcttgcaga

SEQ ID NO: 571961 - DNA, 25 bp, Rattus norvegicus
cgcgcggtgctataggacttgaagc

SEQ ID NO: 571962 - DNA, 25 bp, Rattus norvegicus
cttcctaagcatcttgaggcgcgcg

SEQ ID NO: 571963 - DNA, 25 bp, Rattus norvegicus
ggtgggtcatcctggccaatcagct

SEQ ID NO: 571964 - DNA, 25 bp, Rattus norvegicus
caatcagctggcatgccgcgtagca

SEQ ID NO: 571965 - DNA, 25 bp, Rattus norvegicus
ttccgggctacacgtgtcactgttt

SEQ ID NO: 571966 - DNA, 25 bp, Rattus norvegicus
ccaagtcccagagagctttaaattc

SEQ ID NO: 571967 - DNA, 25 bp, Rattus norvegicus
gggcagtcccatgcactcttaccga

SEQ ID NO: 571968 - DNA, 25 bp, Rattus norvegicus
ccatggccttcactgcgcatgcgtg

SEQ ID NO: 571969 - DNA, 25 bp, Rattus norvegicus
caagctcttcaagctcggcggtggc

SEQ ID NO: 571970 - DNA, 25 bp, Rattus norvegicus
cctctgcagctgtgccaaaggctca

SEQ ID NO: 571971 - DNA, 25 bp, Rattus norvegicus
ccagctgcagcttgtggaactgtgc

SEQ ID NO: 571972 - DNA, 25 bp, Rattus norvegicus
acatggcctaacaagcgccagctgc

SEQ ID NO: 571973 - DNA, 25 bp, Rattus norvegicus
ttcttccgttcccacggcaacatgg

SEQ ID NO: 571974 - DNA, 25 bp, Rattus norvegicus
ccaggagtatgttgggaatggtttc

SEQ ID NO: 571975 - DNA, 25 bp, Rattus norvegicus
actcgaatgttttgagggcctccag

SEQ ID NO: 571976 - DNA, 25 bp, Rattus norvegicus
cgcgctgtgctgactcgaatgtttt

SEQ ID NO: 571977 - DNA, 25 bp, Rattus norvegicus
cttccatcttcgcaaacgcgctgtg

SEQ ID NO: 571978 - DNA, 25 bp, Rattus norvegicus
ggccgagacttttgtattctaagga

SEQ ID NO: 571979 - DNA, 25 bp, Rattus norvegicus
cgagagattttattggccgagactt

SEQ ID NO: 571980 - DNA, 25 bp, Rattus norvegicus
actattcgccgatgaaggggaaaca

SEQ ID NO: 571981 - DNA, 25 bp, Rattus norvegicus
gggcgtaccaccacagaaactattc

SEQ ID NO: 571982 - DNA, 25 bp, Rattus norvegicus
ggctccagcagacggactacaattc

SEQ ID NO: 571983 - DNA, 25 bp, Rattus norvegicus
cgccgcgcccatgggctccgccagc

SEQ ID NO: 571984 - DNA, 25 bp, Rattus norvegicus
cgcagggagtcaccgcaccgtgctg

SEQ ID NO: 571985 - DNA, 25 bp, Rattus norvegicus
gaacggcgcagggagtcaccgcacc

SEQ ID NO: 571986 - DNA, 25 bp, Rattus norvegicus
gctgcagcctttgcctcgcgtggga

SEQ ID NO: 571987 - DNA, 25 bp, Rattus norvegicus
gggcatgctgcagcctttgcctcgc

SEQ ID NO: 571988 - DNA, 25 bp, Rattus norvegicus
tggacacaccgcgggcgcagcgcta

SEQ ID NO: 571989 - DNA, 25 bp, Rattus norvegicus
cagcgcggctagctgcgtctctgcg

SEQ ID NO: 571990 - DNA, 25 bp, Rattus norvegicus
actggagcgggaagccttgcccgga

SEQ ID NO: 571991 - DNA, 25 bp, Rattus norvegicus
cctccgttggacctgagggactgga

SEQ ID NO: 571992 - DNA, 25 bp, Rattus norvegicus
atccaacctccgttggacctgaggg

SEQ ID NO: 571993 - DNA, 25 bp, Rattus norvegicus
tcgctgtggtatccaacctccgttg

SEQ ID NO: 571994 - DNA, 25 bp, Rattus norvegicus
gggacctcgctgtggtatccaacct

SEQ ID NO: 571995 - DNA, 25 bp, Rattus norvegicus
gagtgctggccacgattctgcccac

SEQ ID NO: 571996 - DNA, 25 bp, Rattus norvegicus
cgggctcgcgggtcctggacacacc

SEQ ID NO: 571997 - DNA, 25 bp, Rattus norvegicus
cgcgctcaccctcatgaccggggta

SEQ ID NO: 571998 - DNA, 25 bp, Rattus norvegicus
tcgatgacaaatggcacgtgattta

SEQ ID NO: 571999 - DNA, 25 bp, Rattus norvegicus
tacggtaagccccagtcggaagcac

SEQ ID NO: 572000 - DNA, 25 bp, Rattus norvegicus
ctgtaagtcacgtagccattctccc

SEQ ID NO: 572001 - DNA, 25 bp, Rattus norvegicus
tggcacgtgatttaagtttgcaata

SEQ ID NO: 572002 - DNA, 25 bp, Rattus norvegicus
cctcgtcagggtcaaccgcgctcac

SEQ ID NO: 572003 - DNA, 25 bp, Rattus norvegicus
cccgtaaagtggtcgatgacaaatg

SEQ ID NO: 572004 - DNA, 25 bp, Rattus norvegicus
aggtactcacagcacccgtaaagtg

SEQ ID NO: 572005 - DNA, 25 bp, Rattus norvegicus
gtccagattctcagaggtactcaca

SEQ ID NO: 572006 - DNA, 25 bp, Rattus norvegicus
tcagttcatagtccagattctcaga

SEQ ID NO: 572007 - DNA, 25 bp, Rattus norvegicus
gcgaggcatcagttcatagtccaga

SEQ ID NO: 572008 - DNA, 25 bp, Rattus norvegicus
ctcagcatgtagacgcgaggcatca

SEQ ID NO: 572009 - DNA, 25 bp, Rattus norvegicus
cggaagcacgaatcctcagcatgta

SEQ ID NO: 572010 - DNA, 25 bp, Rattus norvegicus
tttaagtttgcaatactgtaagtca

SEQ ID NO: 572011 - DNA, 25 bp, Rattus norvegicus
gcgactccatttcaaagatctcacg

SEQ ID NO: 572012 - DNA, 25 bp, Rattus norvegicus
agccgagatggacaggagtcgaacc

SEQ ID NO: 572013 - DNA, 25 bp, Rattus norvegicus
aaagttggctcccaagtagcggcgg

SEQ ID NO: 572014 - DNA, 25 bp, Rattus norvegicus
actcaactctgcgagtgggcaaggg

SEQ ID NO: 572015 - DNA, 25 bp, Rattus norvegicus
gctacccggagtagcatgctggcct

SEQ ID NO: 572016 - DNA, 25 bp, Rattus norvegicus
gtcagacagcctggcgctacccgga

SEQ ID NO: 572017 - DNA, 25 bp, Rattus norvegicus
cccgcagtcgtgttcccgggtcaga

SEQ ID NO: 572018 - DNA, 25 bp, Rattus norvegicus
tggagaccgctccaaagccgagatg

SEQ ID NO: 572019 - DNA, 25 bp, Rattus norvegicus
tcatctctgtacttggagaccgctc

SEQ ID NO: 572020 - DNA, 25 bp, Rattus norvegicus
tctcacgctcaagcgatcggctctg

SEQ ID NO: 572021 - DNA, 25 bp, Rattus norvegicus
tcctccgggcacagaacatctaaga

SEQ ID NO: 572022 - DNA, 25 bp, Rattus norvegicus
ccttgcaaaggagccgcagtaaacc

SEQ ID NO: 572023 - DNA, 25 bp, Rattus norvegicus
cccggaggcttagccttgcaaagga

SEQ ID NO: 572024 - DNA, 25 bp, Rattus norvegicus
gatcggctctgctttcatctctgta

SEQ ID NO: 572025 - DNA, 25 bp, Rattus norvegicus
aggactcgacctcggaaagtttgtg

SEQ ID NO: 572026 - DNA, 25 bp, Rattus norvegicus
cgcagcccagagaaaaagaaggact

SEQ ID NO: 572027 - DNA, 25 bp, Rattus norvegicus
gccacgctttggaacgcagcccaga

SEQ ID NO: 572028 - DNA, 25 bp, Rattus norvegicus
gagactaaaccgaagccagccacgc

SEQ ID NO: 572029 - DNA, 25 bp, Rattus norvegicus
cggctgatgagcaaacgagactaaa

SEQ ID NO: 572030 - DNA, 25 bp, Rattus norvegicus
cagagctccaggtaccggctgatga

SEQ ID NO: 572031 - DNA, 25 bp, Rattus norvegicus
cgcatcccagggttgcaagtctatc

SEQ ID NO: 572032 - DNA, 25 bp, Rattus norvegicus
agaactccttctggcggccgagcgc

SEQ ID NO: 572033 - DNA, 25 bp, Rattus norvegicus
ttctcgtgcgagatgggagattccc

SEQ ID NO: 572034 - DNA, 25 bp, Rattus norvegicus
ccctcagctacaagttctcgtgcga

SEQ ID NO: 572035 - DNA, 25 bp, Rattus norvegicus
ccaagggtcccgtaatctgtgagcc

SEQ ID NO: 572036 - DNA, 25 bp, Rattus norvegicus
tttgtaggacaaaggcagctgagcc

SEQ ID NO: 572037 - DNA, 25 bp, Rattus norvegicus
ttgtggggctcgaacattttaacgc

SEQ ID NO: 572038 - DNA, 25 bp, Rattus norvegicus
tccctaaacgcattctcggcgctta

SEQ ID NO: 572039 - DNA, 25 bp, Rattus norvegicus
ccctgggcaccatttctataacaag

SEQ ID NO: 572040 - DNA, 25 bp, Rattus norvegicus
cagtccagtttcttgagcgcagatc

SEQ ID NO: 572041 - DNA, 25 bp, Rattus norvegicus
gtcctcggtgttcttccttacagtc

SEQ ID NO: 572042 - DNA, 25 bp, Rattus norvegicus
tcccacgccgattggatatttgtta

SEQ ID NO: 572043 - DNA, 25 bp, Rattus norvegicus
tccgggctcgaagtaccaactttgc

SEQ ID NO: 572044 - DNA, 25 bp, Rattus norvegicus
aagcagagcgcgatcctcctccagt

SEQ ID NO: 572045 - DNA, 25 bp, Rattus norvegicus
gggcgcatttccagtggctctcgac

SEQ ID NO: 572046 - DNA, 25 bp, Rattus norvegicus
tctcgacccggggaaagtttgagca

SEQ ID NO: 572047 - DNA, 25 bp, Rattus norvegicus
tttgtcagaacatgtccaggcagcc

SEQ ID NO: 572048 - DNA, 25 bp, Rattus norvegicus
tgaccgggttctccagcttcagtcg

SEQ ID NO: 572049 - DNA, 25 bp, Rattus norvegicus
gcctcccagccagttgcagctaaga

SEQ ID NO: 572050 - DNA, 25 bp, Rattus norvegicus
ccaggtttcccgatgcagtgatctc

SEQ ID NO: 572051 - DNA, 25 bp, Rattus norvegicus
agctgcgcatgcctgcctttcattc

SEQ ID NO: 572052 - DNA, 25 bp, Rattus norvegicus
cagtgctctgtgtgtattttgcgaa

SEQ ID NO: 572053 - DNA, 25 bp, Rattus norvegicus
cgtctcaacgcgttttgcctatttg

SEQ ID NO: 572054 - DNA, 25 bp, Rattus norvegicus
taggagaattgtagccttgagttga

SEQ ID NO: 572055 - DNA, 25 bp, Rattus norvegicus
gaggcggagtattccaaagaggttc

SEQ ID NO: 572056 - DNA, 25 bp, Rattus norvegicus
caaagaggttccctctacttcgccg

SEQ ID NO: 572057 - DNA, 25 bp, Rattus norvegicus
tacttcgccgttagagccacttcct

SEQ ID NO: 572058 - DNA, 25 bp, Rattus norvegicus
acgggatctctaccggcggttgcta

SEQ ID NO: 572059 - DNA, 25 bp, Rattus norvegicus
gcggttgctatttcagggtgccgaa

SEQ ID NO: 572060 - DNA, 25 bp, Rattus norvegicus
ggtgccgaaccatggccgaatattc

SEQ ID NO: 572061 - DNA, 25 bp, Rattus norvegicus
tggccgaatattcttacgtaaagtc

SEQ ID NO: 572062 - DNA, 25 bp, Rattus norvegicus
cgtaaagtccaccaaactcgtgctc

SEQ ID NO: 572063 - DNA, 25 bp, Rattus norvegicus
actcgtgctcaagggcactaaagcc

SEQ ID NO: 572064 - DNA, 25 bp, Rattus norvegicus
cactaaagccaagaggtgaggcggc

SEQ ID NO: 572065 - DNA, 25 bp, Rattus norvegicus
gaacatccgggacttcgccgcagga

SEQ ID NO: 572066 - DNA, 25 bp, Rattus norvegicus
gccgtagcgcctcgatcactgtaaa

SEQ ID NO: 572067 - DNA, 25 bp, Rattus norvegicus
ccgctaaggaccctcattagcatga

SEQ ID NO: 572068 - DNA, 25 bp, Rattus norvegicus
tcgtcgggtcgtgcgttcgctctag

SEQ ID NO: 572069 - DNA, 25 bp, Rattus norvegicus
ggaccctcattagcatgaccacttg

SEQ ID NO: 572070 - DNA, 25 bp, Rattus norvegicus
ccagtcactagtccctcgcagtgaa

SEQ ID NO: 572071 - DNA, 25 bp, Rattus norvegicus
tgctcacagcctttgttcggcgccg

SEQ ID NO: 572072 - DNA, 25 bp, Rattus norvegicus
cccggaggctggagctgcactcgtc

SEQ ID NO: 572073 - DNA, 25 bp, Rattus norvegicus
tccctcgcagtgaagtggctgggct

SEQ ID NO: 572074 - DNA, 25 bp, Rattus norvegicus
agctgcactcgtcgggtcgtgcgtt

SEQ ID NO: 572075 - DNA, 25 bp, Rattus norvegicus
tgcttccaattaattgcccgggcgg

SEQ ID NO: 572076 - DNA, 25 bp, Rattus norvegicus
ctctcacaagtgttgcttccaatta

SEQ ID NO: 572077 - DNA, 25 bp, Rattus norvegicus
cggagtcaaccaccgccagcgcctt

SEQ ID NO: 572078 - DNA, 25 bp, Rattus norvegicus
ttagcatgaccacttgggaagattc

SEQ ID NO: 572079 - DNA, 25 bp, Rattus norvegicus
acagcctttgttcggcgccggctga

SEQ ID NO: 572080 - DNA, 25 bp, Rattus norvegicus
agggccgctcgcctttcatcgtcct

SEQ ID NO: 572081 - DNA, 25 bp, Rattus norvegicus
ggacagggcgctcctgcacatagca

SEQ ID NO: 572082 - DNA, 25 bp, Rattus norvegicus
agtagcgagcttcgggtcttaggct

SEQ ID NO: 572083 - DNA, 25 bp, Rattus norvegicus
tgattccaatccttctgcggcccag

SEQ ID NO: 572084 - DNA, 25 bp, Rattus norvegicus
cttgtcggtgctcctgattccaatc

SEQ ID NO: 572085 - DNA, 25 bp, Rattus norvegicus
tccgggtccgccagttaaagcgcag

SEQ ID NO: 572086 - DNA, 25 bp, Rattus norvegicus
aggagagcacgcgacactccgggtc

SEQ ID NO: 572087 - DNA, 25 bp, Rattus norvegicus
caggtcaggcgcctggagccagaca

SEQ ID NO: 572088 - DNA, 25 bp, Rattus norvegicus
atagaagctccaacaggcgcggtgc

SEQ ID NO: 572089 - DNA, 25 bp, Rattus norvegicus
taaagtggccgccttgtcgcccgcg

SEQ ID NO: 572090 - DNA, 25 bp, Rattus norvegicus
tggcctggtcccaagacagtaaagt

SEQ ID NO: 572091 - DNA, 25 bp, Rattus norvegicus
atccagggtcctcttatccaggagc

SEQ ID NO: 572092 - DNA, 25 bp, Rattus norvegicus
tcctgcacatagcagccaggctcag

SEQ ID NO: 572093 - DNA, 25 bp, Rattus norvegicus
gatgcttaccggctctcgggacagg

SEQ ID NO: 572094 - DNA, 25 bp, Rattus norvegicus
agcaacactagcaacatggcccggc

SEQ ID NO: 572095 - DNA, 25 bp, Rattus norvegicus
tcacgtagatcaagcgaggcccatc

SEQ ID NO: 572096 - DNA, 25 bp, Rattus norvegicus
ctgggaaccggtgggctgctctcct

SEQ ID NO: 572097 - DNA, 25 bp, Rattus norvegicus
ctccaccgctgcttgctttatggca

SEQ ID NO: 572098 - DNA, 25 bp, Rattus norvegicus
tgcttgctttatggcacagcgggcc

SEQ ID NO: 572099 - DNA, 25 bp, Rattus norvegicus
acagcgggcctcgaatcctgggcct

SEQ ID NO: 572100 - DNA, 25 bp, Rattus norvegicus
atcctgggcctcgatggccgaaacc

SEQ ID NO: 572101 - DNA, 25 bp, Rattus norvegicus
tcgatggccgaaacctcggaggccc

SEQ ID NO: 572102 - DNA, 25 bp, Rattus norvegicus
gcgaagcgggtcacgtagatcaagc

SEQ ID NO: 572103 - DNA, 25 bp, Rattus norvegicus
agcagcaggccgcagacaggaccat

SEQ ID NO: 572104 - DNA, 25 bp, Rattus norvegicus
agcgaggcccatctggcctttgccg

SEQ ID NO: 572105 - DNA, 25 bp, Rattus norvegicus
aagcatctcggcttcctgtcaggcg

SEQ ID NO: 572106 - DNA, 25 bp, Rattus norvegicus
gcgctgtcgacgtccactggaaaga

SEQ ID NO: 572107 - DNA, 25 bp, Rattus norvegicus
tcaactgccacacgccatggcggtg

SEQ ID NO: 572108 - DNA, 25 bp, Rattus norvegicus
gcagaatctgggctttcggtgaccc

SEQ ID NO: 572109 - DNA, 25 bp, Rattus norvegicus
aagtcgcttcggtgctgtatggacc

SEQ ID NO: 572110 - DNA, 25 bp, Rattus norvegicus
cccacgctcaaagacagagaaggcc

SEQ ID NO: 572111 - DNA, 25 bp, Rattus norvegicus
cggctaaggctggacgaaaccactg

SEQ ID NO: 572112 - DNA, 25 bp, Rattus norvegicus
gcctcgtacgtggactccgctctag

SEQ ID NO: 572113 - DNA, 25 bp, Rattus norvegicus
gagtccctcgtagcgccgcttgcag

SEQ ID NO: 572114 - DNA, 25 bp, Rattus norvegicus
agatgctgggccgtagtctcctcac

SEQ ID NO: 572115 - DNA, 25 bp, Rattus norvegicus
cacagcaagtgccaccggtgggtga

SEQ ID NO: 572116 - DNA, 25 bp, Rattus norvegicus
tgagctccagccgaggctcagattg

SEQ ID NO: 572117 - DNA, 25 bp, Rattus norvegicus
cactggttcggtcccgcggagttat

SEQ ID NO: 572118 - DNA, 25 bp, Rattus norvegicus
ttatgggtgcaaacgcgcctgtgaa

SEQ ID NO: 572119 - DNA, 25 bp, Rattus norvegicus
gggaaccctcagatacctgcgccta

SEQ ID NO: 572120 - DNA, 25 bp, Rattus norvegicus
atggaccgagtacacattttaggga

SEQ ID NO: 572121 - DNA, 25 bp, Rattus norvegicus
tctcccgagcaagtttgtgtccgcc

SEQ ID NO: 572122 - DNA, 25 bp, Rattus norvegicus
agggaagttctagccttcgcgaacg

SEQ ID NO: 572123 - DNA, 25 bp, Rattus norvegicus
gcctctccagtcaggaacggattta

SEQ ID NO: 572124 - DNA, 25 bp, Rattus norvegicus
accagcagcggttcttcctcgaaga

SEQ ID NO: 572125 - DNA, 25 bp, Rattus norvegicus
ccgcagtgcgaactcaaggcgtgca

SEQ ID NO: 572126 - DNA, 25 bp, Rattus norvegicus
ccgcgtgaacggtcctcaaatctac

SEQ ID NO: 572127 - DNA, 25 bp, Rattus norvegicus
caggactgaagtcacgtgatgctca

SEQ ID NO: 572128 - DNA, 25 bp, Rattus norvegicus
atggccgccttgtctacattagcta

SEQ ID NO: 572129 - DNA, 25 bp, Rattus norvegicus
gcattacctgtaaacgaagccgccc

SEQ ID NO: 572130 - DNA, 25 bp, Rattus norvegicus
cctcaaagttaaccgggcaggcgtg

SEQ ID NO: 572131 - DNA, 25 bp, Rattus norvegicus
gcgcagccaagggacctcaaagtta

SEQ ID NO: 572132 - DNA, 25 bp, Rattus norvegicus
tcagtgtcgagaggactcgctgtca

SEQ ID NO: 572133 - DNA, 25 bp, Rattus norvegicus
cagagatgtggtgtcagtcagtgtc

SEQ ID NO: 572134 - DNA, 25 bp, Rattus norvegicus
tgccctgacgctcaccagagatgtg

SEQ ID NO: 572135 - DNA, 25 bp, Rattus norvegicus
tcaaatctaccagagcggaggccgc

SEQ ID NO: 572136 - DNA, 25 bp, Rattus norvegicus
accgccatcttaggacctcattgtg

SEQ ID NO: 572137 - DNA, 25 bp, Rattus norvegicus
tggcatgttgacgtttcgcccggga

SEQ ID NO: 572138 - DNA, 25 bp, Rattus norvegicus
tgcgagccctaagtacagacgcctc

SEQ ID NO: 572139 - DNA, 25 bp, Rattus norvegicus
cacgtgtcaacaggtgcagcgcgct

SEQ ID NO: 572140 - DNA, 25 bp, Rattus norvegicus
cggcgactgcaacgcactcacggta

SEQ ID NO: 572141 - DNA, 25 bp, Rattus norvegicus
agtggatcccattctgctgcctatc

SEQ ID NO: 572142 - DNA, 25 bp, Rattus norvegicus
agcaagtgcggagtggatcccattc

SEQ ID NO: 572143 - DNA, 25 bp, Rattus norvegicus
gggcgaggccacctagccctggatt

SEQ ID NO: 572144 - DNA, 25 bp, Rattus norvegicus
acacctagcctttgtctgggctcta

SEQ ID NO: 572145 - DNA, 25 bp, Rattus norvegicus
ctcaggttagtttttaggggcgctg

SEQ ID NO: 572146 - DNA, 25 bp, Rattus norvegicus
ggaacccggcgcaactctcaggtta

SEQ ID NO: 572147 - DNA, 25 bp, Rattus norvegicus
cagccagccgagtgcgcagtcagca

SEQ ID NO: 572148 - DNA, 25 bp, Rattus norvegicus
tggcggacgatcatagtgggactcc

SEQ ID NO: 572149 - DNA, 25 bp, Rattus norvegicus
agtcatcgtgcctcagggaacccgg

SEQ ID NO: 572150 - DNA, 25 bp, Rattus norvegicus
ggtggcttcgcgacacacgtgtcaa

SEQ ID NO: 572151 - DNA, 25 bp, Rattus norvegicus
tttcataatctacgctgccataccg

SEQ ID NO: 572152 - DNA, 25 bp, Rattus norvegicus
ctggactccgtacgtggtcagaata

SEQ ID NO: 572153 - DNA, 25 bp, Rattus norvegicus
ttcgcccgtctaaggatctcgcaca

SEQ ID NO: 572154 - DNA, 25 bp, Rattus norvegicus
tcagaacagaaaacgagcgggttca

SEQ ID NO: 572155 - DNA, 25 bp, Rattus norvegicus
gagagtccacttcgcccgtctaagg

SEQ ID NO: 572156 - DNA, 25 bp, Rattus norvegicus
tccatcggaaaaagagagagtccac

SEQ ID NO: 572157 - DNA, 25 bp, Rattus norvegicus
tgctgctctctccatcggaaaaaga

SEQ ID NO: 572158 - DNA, 25 bp, Rattus norvegicus
tgccataccgatgtcctgctgctct

SEQ ID NO: 572159 - DNA, 25 bp, Rattus norvegicus
agtcctaatgggctgtcctggtgca

SEQ ID NO: 572160 - DNA, 25 bp, Rattus norvegicus
ttcccttgtgttctcagtcctaatg

SEQ ID NO: 572161 - DNA, 25 bp, Rattus norvegicus
gcggcagcccgtatttcataatcta

SEQ ID NO: 572162 - DNA, 25 bp, Rattus norvegicus
ggaaagctacggtgatcagaacaga

SEQ ID NO: 572163 - DNA, 25 bp, Rattus norvegicus
ggtcagaatactcaagccggcgatg

SEQ ID NO: 572164 - DNA, 25 bp, Rattus norvegicus
tcaagccggcgatgaggaaagctac

SEQ ID NO: 572165 - DNA, 25 bp, Rattus norvegicus
tgcacgcctcgagtgagagtcagcc

SEQ ID NO: 572166 - DNA, 25 bp, Rattus norvegicus
tagcagcccaaggtgcaggccgtag

SEQ ID NO: 572167 - DNA, 25 bp, Rattus norvegicus
agggtccgaagctgcagtccctgct

SEQ ID NO: 572168 - DNA, 25 bp, Rattus norvegicus
ccgcaccggggacctacaagaggag

SEQ ID NO: 572169 - DNA, 25 bp, Rattus norvegicus
cgtgggcaaccctctgagtagaagc

SEQ ID NO: 572170 - DNA, 25 bp, Rattus norvegicus
cgctcggctcagcagtcgctcaaag

SEQ ID NO: 572171 - DNA, 25 bp, Rattus norvegicus
agattccaggaaggcggtgtctagc

SEQ ID NO: 572172 - DNA, 25 bp, Rattus norvegicus
ccagggtgtaggcacacgtggttac

SEQ ID NO: 572173 - DNA, 25 bp, Rattus norvegicus
tctccgcaacttactggggcagtgc

SEQ ID NO: 572174 - DNA, 25 bp, Rattus norvegicus
tctcgaaggctagacgagctgccgc

SEQ ID NO: 572175 - DNA, 25 bp, Rattus norvegicus
acgtggttacaagcttgctcgctgg

SEQ ID NO: 572176 - DNA, 25 bp, Rattus norvegicus
cgtcttccaggtccgcgcagacaga

SEQ ID NO: 572177 - DNA, 25 bp, Rattus norvegicus
ctgcgggcagctgcacacagctgga

SEQ ID NO: 572178 - DNA, 25 bp, Rattus norvegicus
ctccaggcacgctgagattccagga

SEQ ID NO: 572179 - DNA, 25 bp, Rattus norvegicus
cgctcttcccattgcgccgcacgcg

SEQ ID NO: 572180 - DNA, 25 bp, Rattus norvegicus
agccgctatcccaggcccgcgcgca

SEQ ID NO: 572181 - DNA, 25 bp, Rattus norvegicus
caccgggatgccctgccgggagctg

SEQ ID NO: 572182 - DNA, 25 bp, Rattus norvegicus
caggacccgcccacaaccgctcccg

SEQ ID NO: 572183 - DNA, 25 bp, Rattus norvegicus
gcccacaaccgctcccgccgaagcc

SEQ ID NO: 572184 - DNA, 25 bp, Rattus norvegicus
acagcccggcgcacctggaggagga

SEQ ID NO: 572185 - DNA, 25 bp, Rattus norvegicus
gcccgccgggaaccctgcagacgcg

SEQ ID NO: 572186 - DNA, 25 bp, Rattus norvegicus
ggcgcagagccgctatcccaggccc

SEQ ID NO: 572187 - DNA, 25 bp, Rattus norvegicus
gacgcgggccgccatggaacacatc

SEQ ID NO: 572188 - DNA, 25 bp, Rattus norvegicus
gggccgccatggaacacatccgtac

SEQ ID NO: 572189 - DNA, 25 bp, Rattus norvegicus
agagaaggaagagggatgctgagcg

SEQ ID NO: 572190 - DNA, 25 bp, Rattus norvegicus
gatgctgagcgcaccgggatgccct

SEQ ID NO: 572191 - DNA, 25 bp, Rattus norvegicus
ggcggctccctagcatctcccagag

SEQ ID NO: 572192 - DNA, 25 bp, Rattus norvegicus
ctggaccgcgaacgagggaggagct

SEQ ID NO: 572193 - DNA, 25 bp, Rattus norvegicus
gagtgactcgatcagccgctgcttc

SEQ ID NO: 572194 - DNA, 25 bp, Rattus norvegicus
gattagttatctctgcggacggctg

SEQ ID NO: 572195 - DNA, 25 bp, Rattus norvegicus
ccctagaaggttccggcctgctctt

SEQ ID NO: 572196 - DNA, 25 bp, Rattus norvegicus
tgctcttcctcgcttagcccagtgg

SEQ ID NO: 572197 - DNA, 25 bp, Rattus norvegicus
ttagcccagtggttcctcagcgacc

SEQ ID NO: 572198 - DNA, 25 bp, Rattus norvegicus
tcccaggctccagccggattagtta

SEQ ID NO: 572199 - DNA, 25 bp, Rattus norvegicus
atgacgcgctcttggtcaggggaaa

SEQ ID NO: 572200 - DNA, 25 bp, Rattus norvegicus
acaccacccggtcagttagctaggc

SEQ ID NO: 572201 - DNA, 25 bp, Rattus norvegicus
gcccactcggggcttgcgtcatcat

SEQ ID NO: 572202 - DNA, 25 bp, Rattus norvegicus
cctttgcagggcgagagctgtctat

SEQ ID NO: 572203 - DNA, 25 bp, Rattus norvegicus
ttctgctgctgaagactggtgaggc

SEQ ID NO: 572204 - DNA, 25 bp, Rattus norvegicus
gagcgcgagctcagagacacaagta

SEQ ID NO: 572205 - DNA, 25 bp, Rattus norvegicus
agacacaagtagatccggcgggacc

SEQ ID NO: 572206 - DNA, 25 bp, Rattus norvegicus
ccgggtgctatctctatggcgagga

SEQ ID NO: 572207 - DNA, 25 bp, Rattus norvegicus
tcccagtgggacagtaatgagaatt

SEQ ID NO: 572208 - DNA, 25 bp, Rattus norvegicus
cactgagtggaagcaattgcggagc

SEQ ID NO: 572209 - DNA, 25 bp, Rattus norvegicus
ggttctggacgtgggcacccactta

SEQ ID NO: 572210 - DNA, 25 bp, Rattus norvegicus
gtgggcacccacttacctatgcaca

SEQ ID NO: 572211 - DNA, 25 bp, Rattus norvegicus
tgcacagctggatcgcgtaagcata

SEQ ID NO: 572212 - DNA, 25 bp, Rattus norvegicus
gcatagtacgcaccagcccagaagc

SEQ ID NO: 572213 - DNA, 25 bp, Rattus norvegicus
gctcccggatcggaggggacacact

SEQ ID NO: 572214 - DNA, 25 bp, Rattus norvegicus
caccacagggatccagtagagcacc

SEQ ID NO: 572215 - DNA, 25 bp, Rattus norvegicus
gacacactgcgcagagtcgcgcgtg

SEQ ID NO: 572216 - DNA, 25 bp, Rattus norvegicus
tggagactcgatacccaccttggcc

SEQ ID NO: 572217 - DNA, 25 bp, Rattus norvegicus
tgagaattgacactcgctctgggtc

SEQ ID NO: 572218 - DNA, 25 bp, Rattus norvegicus
aattgcggagcggagcagtagtccc

SEQ ID NO: 572219 - DNA, 25 bp, Rattus norvegicus
gcccagaagcaagctgatgaacacc

SEQ ID NO: 572220 - DNA, 25 bp, Rattus norvegicus
agggatccgggctcagactcccacg

SEQ ID NO: 572221 - DNA, 25 bp, Rattus norvegicus
caagtccaggctgttctccatcgtg

SEQ ID NO: 572222 - DNA, 25 bp, Rattus norvegicus
agaagcctccgcagcgcagccatag

SEQ ID NO: 572223 - DNA, 25 bp, Rattus norvegicus
cctttggatacaggcgcacgttgga

SEQ ID NO: 572224 - DNA, 25 bp, Rattus norvegicus
ggcacttaccgtctccttggcagca

SEQ ID NO: 572225 - DNA, 25 bp, Rattus norvegicus
ccgccacgcagtagtagaggacagt

SEQ ID NO: 572226 - DNA, 25 bp, Rattus norvegicus
cccatacagctggtagcacacaagg

SEQ ID NO: 572227 - DNA, 25 bp, Rattus norvegicus
agaggcggtctgaaatctcgcgaga

SEQ ID NO: 572228 - DNA, 25 bp, Rattus norvegicus
atctcgcgagaagtcggagcagcgc

SEQ ID NO: 572229 - DNA, 25 bp, Rattus norvegicus
cttacccgagagcagcctttggata

SEQ ID NO: 572230 - DNA, 25 bp, Rattus norvegicus
tgttctgctccgtgctggatcctta

SEQ ID NO: 572231 - DNA, 25 bp, Rattus norvegicus
ggctgctctctgtgttctgctccgt

SEQ ID NO: 572232 - DNA, 25 bp, Rattus norvegicus
cggcaactagcaagggagcccaaca

SEQ ID NO: 572233 - DNA, 25 bp, Rattus norvegicus
acagtgcccgtagccacggcaacta

SEQ ID NO: 572234 - DNA, 25 bp, Rattus norvegicus
ccactagctccgaggggtcggctct

SEQ ID NO: 572235 - DNA, 25 bp, Rattus norvegicus
cctcttcggtaggtacaagcatccc

SEQ ID NO: 572236 - DNA, 25 bp, Rattus norvegicus
ttccgtggagctggcgcacctgcac

SEQ ID NO: 572237 - DNA, 25 bp, Rattus norvegicus
ttcggtaggtacaagcatcccgccc

SEQ ID NO: 572238 - DNA, 25 bp, Rattus norvegicus
agcctcttcggtaggtacaagcatc

SEQ ID NO: 572239 - DNA, 25 bp, Rattus norvegicus
acagcctcttcggtaggtacaagca

SEQ ID NO: 572240 - DNA, 25 bp, Rattus norvegicus
tcacagcctcttcggtaggtacaag

SEQ ID NO: 572241 - DNA, 25 bp, Rattus norvegicus
gatcacagcctcttcggtaggtaca

SEQ ID NO: 572242 - DNA, 25 bp, Rattus norvegicus
tgcagggcacccggcaggatcacag

SEQ ID NO: 572243 - DNA, 25 bp, Rattus norvegicus
agatcctgcccgacggcagtgtgca

SEQ ID NO: 572244 - DNA, 25 bp, Rattus norvegicus
accggcttccacctgcagatcctgc

SEQ ID NO: 572245 - DNA, 25 bp, Rattus norvegicus
tgccgcaccggcttccacctgcaga

SEQ ID NO: 572246 - DNA, 25 bp, Rattus norvegicus
tgcacggcatcctgcgccgccggca

SEQ ID NO: 572247 - DNA, 25 bp, Rattus norvegicus
ggagctggcgcacctgcacggcatc

SEQ ID NO: 572248 - DNA, 25 bp, Rattus norvegicus
cccgacggcagtgtgcagggcaccc

SEQ ID NO: 572249 - DNA, 25 bp, Rattus norvegicus
ttcggtcatctcagagccgcctctt

SEQ ID NO: 572250 - DNA, 25 bp, Rattus norvegicus
gaggactccgcctggctgttctttt

SEQ ID NO: 572251 - DNA, 25 bp, Rattus norvegicus
tcgtcttcctctgttgtcgccgctg

SEQ ID NO: 572252 - DNA, 25 bp, Rattus norvegicus
gaccgagccgagtgaaatgacaacc

SEQ ID NO: 572253 - DNA, 25 bp, Rattus norvegicus
ccgagagacacttccggttcgatga

SEQ ID NO: 572254 - DNA, 25 bp, Rattus norvegicus
cagccggaagaccaatccgacacta

SEQ ID NO: 572255 - DNA, 25 bp, Rattus norvegicus
gcagtccagctgtcgtcgtctttga

SEQ ID NO: 572256 - DNA, 25 bp, Rattus norvegicus
cctcccaggaaggtcttcggtcatc

SEQ ID NO: 572257 - DNA, 25 bp, Rattus norvegicus
tgagtccttctcctcaggaccgagc

SEQ ID NO: 572258 - DNA, 25 bp, Rattus norvegicus
tccgcgcatccagtgcaagcggtgc

SEQ ID NO: 572259 - DNA, 25 bp, Rattus norvegicus
gcggtgcaccgccatcttttttgtg

SEQ ID NO: 572260 - DNA, 25 bp, Rattus norvegicus
tttttgtgggcaaagattcctcgcg

SEQ ID NO: 572261 - DNA, 25 bp, Rattus norvegicus
tccgacactacaattccgactaggc

SEQ ID NO: 572262 - DNA, 25 bp, Rattus norvegicus
tgacaaccagctggaaagaccgaga

SEQ ID NO: 572263 - DNA, 25 bp, Rattus norvegicus
gaccgcgcagacagcttaggattgg

SEQ ID NO: 572264 - DNA, 25 bp, Rattus norvegicus
gccaggtcgccttgtacactttctg

SEQ ID NO: 572265 - DNA, 25 bp, Rattus norvegicus
ccaaccagtgggtgagtgaggccca

SEQ ID NO: 572266 - DNA, 25 bp, Rattus norvegicus
ggtccttccagagccgaagagatga

SEQ ID NO: 572267 - DNA, 25 bp, Rattus norvegicus
cggcagccgcagacctaaaaagatc

SEQ ID NO: 572268 - DNA, 25 bp, Rattus norvegicus
atcggaaccaggctcccagggcata

SEQ ID NO: 572269 - DNA, 25 bp, Rattus norvegicus
aggagcggcggatcagattaactga

SEQ ID NO: 572270 - DNA, 25 bp, Rattus norvegicus
actgaagtaccaccctcggcaaggc

SEQ ID NO: 572271 - DNA, 25 bp, Rattus norvegicus
ggaactttgcctggatggcactttc

SEQ ID NO: 572272 - DNA, 25 bp, Rattus norvegicus
tggcactttcctgttctccagtccg

SEQ ID NO: 572273 - DNA, 25 bp, Rattus norvegicus
gctcggcctggagatccaagatgga

SEQ ID NO: 572274 - DNA, 25 bp, Rattus norvegicus
ccaagatggagttgttgagtcgagc

SEQ ID NO: 572275 - DNA, 25 bp, Rattus norvegicus
agtctggcggccttgaaacaacacg

SEQ ID NO: 572276 - DNA, 25 bp, Rattus norvegicus
gcatcgcagacctcacgggccaggt

SEQ ID NO: 572277 - DNA, 25 bp, Rattus norvegicus
aggagactgacagcgtatccggttc

SEQ ID NO: 572278 - DNA, 25 bp, Rattus norvegicus
acagcgtatccggttcaccaggaga

SEQ ID NO: 572279 - DNA, 25 bp, Rattus norvegicus
ctgcctagcaacacggcggggcttc

SEQ ID NO: 572280 - DNA, 25 bp, Rattus norvegicus
ggggcttcctagcaacgcggcaagc

SEQ ID NO: 572281 - DNA, 25 bp, Rattus norvegicus
cccgagctggatgcagagcagcagc

SEQ ID NO: 572282 - DNA, 25 bp, Rattus norvegicus
tggatgcagagcagcagcaacaaga

SEQ ID NO: 572283 - DNA, 25 bp, Rattus norvegicus
aggaagggaaagctaccagtagaca

SEQ ID NO: 572284 - DNA, 25 bp, Rattus norvegicus
ccagtagacaggtagcgcaacctgc

SEQ ID NO: 572285 - DNA, 25 bp, Rattus norvegicus
gcccgcctgtctccggcgtgaagga

SEQ ID NO: 572286 - DNA, 25 bp, Rattus norvegicus
cctggcactcatggccgcagggctg

SEQ ID NO: 572287 - DNA, 25 bp, Rattus norvegicus
ggctgtgtctcctccacgcgcggta

SEQ ID NO: 572288 - DNA, 25 bp, Rattus norvegicus
ctctcttggccaaggcctcggggta

SEQ ID NO: 572289 - DNA, 25 bp, Rattus norvegicus
gcctcggggtagcagcggcttctcc

SEQ ID NO: 572290 - DNA, 25 bp, Rattus norvegicus
ttcaccaggagagggaccaggaatg

SEQ ID NO: 572291 - DNA, 25 bp, Rattus norvegicus
gtgcgaaaccgggacagcctgtttc

SEQ ID NO: 572292 - DNA, 25 bp, Rattus norvegicus
gggacagcctgtttccgttcgcaaa

SEQ ID NO: 572293 - DNA, 25 bp, Rattus norvegicus
ttcccggcaaagttgtccgcggcca

SEQ ID NO: 572294 - DNA, 25 bp, Rattus norvegicus
cgctttcccggcaaagttgtccgcg

SEQ ID NO: 572295 - DNA, 25 bp, Rattus norvegicus
ggatacggaggtcgccccatctcta

SEQ ID NO: 572296 - DNA, 25 bp, Rattus norvegicus
gctgcaggacccaaggtcctccgtg

SEQ ID NO: 572297 - DNA, 25 bp, Rattus norvegicus
cagctgggctgcaggacccaaggtc

SEQ ID NO: 572298 - DNA, 25 bp, Rattus norvegicus
cctccgcgggtgacaacggcagctg

SEQ ID NO: 572299 - DNA, 25 bp, Rattus norvegicus
ctgttccggctggaggccacccggt

SEQ ID NO: 572300 - DNA, 25 bp, Rattus norvegicus
ctccgcgtcgctgttccggctggag

SEQ ID NO: 572301 - DNA, 25 bp, Rattus norvegicus
acacacaggcggctgtccctcaccc

SEQ ID NO: 572302 - DNA, 25 bp, Rattus norvegicus
gcttctccggagtagtcgcgggtcc

SEQ ID NO: 572303 - DNA, 25 bp, Rattus norvegicus
cgctacccggcttctccggagtagt

SEQ ID NO: 572304 - DNA, 25 bp, Rattus norvegicus
cagcctgtttccgttcgcaaattcg

SEQ ID NO: 572305 - DNA, 25 bp, Rattus norvegicus
ggtcctggggatccgcccgaagtca

SEQ ID NO: 572306 - DNA, 25 bp, Rattus norvegicus
agcgaccacatcagggattccaccg

SEQ ID NO: 572307 - DNA, 25 bp, Rattus norvegicus
cttcatctccgggaaggagcggctg

SEQ ID NO: 572308 - DNA, 25 bp, Rattus norvegicus
attccaccgccagggcgctggatgc

SEQ ID NO: 572309 - DNA, 25 bp, Rattus norvegicus
gcccgaagtcactccagggtggatg

SEQ ID NO: 572310 - DNA, 25 bp, Rattus norvegicus
cctgcgtcctgagcgccggagaaga

SEQ ID NO: 572311 - DNA, 25 bp, Rattus norvegicus
agccgcaatgcctgcgtcctgagcg

SEQ ID NO: 572312 - DNA, 25 bp, Rattus norvegicus
ctacgggccaagaggccgcctgcag

SEQ ID NO: 572313 - DNA, 25 bp, Rattus norvegicus
ctaagcctttccagatgtggccgcg

SEQ ID NO: 572314 - DNA, 25 bp, Rattus norvegicus
cgctggccctaagcctttccagatg

SEQ ID NO: 572315 - DNA, 25 bp, Rattus norvegicus
acaccgggcgcatcccgatagcggg

SEQ ID NO: 572316 - DNA, 25 bp, Rattus norvegicus
gtgattgggttacaccgggcgcatc

SEQ ID NO: 572317 - DNA, 25 bp, Rattus norvegicus
agcggctgggctcccatctccagga

SEQ ID NO: 572318 - DNA, 25 bp, Rattus norvegicus
ctgcggaggtccttcagcgaccaca

SEQ ID NO: 572319 - DNA, 25 bp, Rattus norvegicus
gcagcttcgacgttcccagtgcgct

SEQ ID NO: 572320 - DNA, 25 bp, Rattus norvegicus
ttacttcgggcagcttcgacgttcc

SEQ ID NO: 572321 - DNA, 25 bp, Rattus norvegicus
ccgacgtgggatcccgattacttcg

SEQ ID NO: 572322 - DNA, 25 bp, Rattus norvegicus
aaccaggatgtgctgacgaccgcga

SEQ ID NO: 572323 - DNA, 25 bp, Rattus norvegicus
taaggaagctgcgaaccaggatgtg

SEQ ID NO: 572324 - DNA, 25 bp, Rattus norvegicus
cgatttttgcccgagctgggtcgag

SEQ ID NO: 572325 - DNA, 25 bp, Rattus norvegicus
aaacccacgatttttgcccgagctg

SEQ ID NO: 572326 - DNA, 25 bp, Rattus norvegicus
ccctgcgaggtagcaatcaaaaacc

SEQ ID NO: 572327 - DNA, 25 bp, Rattus norvegicus
tccctaagagcgctccctgcgaggt

SEQ ID NO: 572328 - DNA, 25 bp, Rattus norvegicus
atggctgtgcgtcctcgctgttgga

SEQ ID NO: 572329 - DNA, 25 bp, Rattus norvegicus
ctcccagcctgggtcatggctgtgc

SEQ ID NO: 572330 - DNA, 25 bp, Rattus norvegicus
cagagcactgcagcgtttggttgga

SEQ ID NO: 572331 - DNA, 25 bp, Rattus norvegicus
ctgcgccgcccttaatgtgtagaga

SEQ ID NO: 572332 - DNA, 25 bp, Rattus norvegicus
cgcccttaatgtgtagagacgagcc

SEQ ID NO: 572333 - DNA, 25 bp, Rattus norvegicus
gcgaactggccgacctggagaacga

SEQ ID NO: 572334 - DNA, 25 bp, Rattus norvegicus
ccgtgagcagccgtatgagcatcta

SEQ ID NO: 572335 - DNA, 25 bp, Rattus norvegicus
atctatgacaacgtgccgggctcta

SEQ ID NO: 572336 - DNA, 25 bp, Rattus norvegicus
tttactccagctcgggcgaactggc

SEQ ID NO: 572337 - DNA, 25 bp, Rattus norvegicus
agcagccgtatgagcatctatgaca

SEQ ID NO: 572338 - DNA, 25 bp, Rattus norvegicus
tggagaacgaggacatcttccctga

SEQ ID NO: 572339 - DNA, 25 bp, Rattus norvegicus
tcttccctgagctcgatgacattct

SEQ ID NO: 572340 - DNA, 25 bp, Rattus norvegicus
atgacattctctaccacgtgaaggg

SEQ ID NO: 572341 - DNA, 25 bp, Rattus norvegicus
tgcagcggatagtcaaccagtggtc

SEQ ID NO: 572342 - DNA, 25 bp, Rattus norvegicus
accagtggtctgaaaagttctcgga

SEQ ID NO: 572343 - DNA, 25 bp, Rattus norvegicus
aaagttctcggacgagggcgactcg

SEQ ID NO: 572344 - DNA, 25 bp, Rattus norvegicus
gacgagggcgactcggactcagccc

SEQ ID NO: 572345 - DNA, 25 bp, Rattus norvegicus
agatacacctggacgtggaccacga

SEQ ID NO: 572346 - DNA, 25 bp, Rattus norvegicus
tgccgggctctatcctttactccag

SEQ ID NO: 572347 - DNA, 25 bp, Rattus norvegicus
ccctggcagttgagccggctcagct

SEQ ID NO: 572348 - DNA, 25 bp, Rattus norvegicus
gctaccaaggactgtggacttcgcg

SEQ ID NO: 572349 - DNA, 25 bp, Rattus norvegicus
tagctctgcgcgctaccaaggactg

SEQ ID NO: 572350 - DNA, 25 bp, Rattus norvegicus
tcacgtagcccggtagctctgcgcg

SEQ ID NO: 572351 - DNA, 25 bp, Rattus norvegicus
agccctcagtcacgtagcccggtag

SEQ ID NO: 572352 - DNA, 25 bp, Rattus norvegicus
cgtggcgagccctcagtcacgtagc

SEQ ID NO: 572353 - DNA, 25 bp, Rattus norvegicus
cggctcagctgggaactcaacctag

SEQ ID NO: 572354 - DNA, 25 bp, Rattus norvegicus
cgagcagcctgtccctggcagttga

SEQ ID NO: 572355 - DNA, 25 bp, Rattus norvegicus
tcggtctagcacagttggggcccag

SEQ ID NO: 572356 - DNA, 25 bp, Rattus norvegicus
gcgtcctggtcggtctagcacagtt

SEQ ID NO: 572357 - DNA, 25 bp, Rattus norvegicus
gactctgcacgtggatgggcgtcct

SEQ ID NO: 572358 - DNA, 25 bp, Rattus norvegicus
ttctgcacgcaggaaggactctgca

SEQ ID NO: 572359 - DNA, 25 bp, Rattus norvegicus
agctggcacgttctgcacgcaggaa

SEQ ID NO: 572360 - DNA, 25 bp, Rattus norvegicus
ctgggaactcaacctagggtggcca

SEQ ID NO: 572361 - DNA, 25 bp, Rattus norvegicus
tagagaagttggaacgcagccgcga

SEQ ID NO: 572362 - DNA, 25 bp, Rattus norvegicus
atcaggatgaccttcctgtctctca

SEQ ID NO: 572363 - DNA, 25 bp, Rattus norvegicus
tgcaacttccatgggtcggcctagg

SEQ ID NO: 572364 - DNA, 25 bp, Rattus norvegicus
ccgagcactggctcggtgctcttca

SEQ ID NO: 572365 - DNA, 25 bp, Rattus norvegicus
ctactccagtgtccggtggggtgaa

SEQ ID NO: 572366 - DNA, 25 bp, Rattus norvegicus
tgaggctggaatcaggatgaccttc

SEQ ID NO: 572367 - DNA, 25 bp, Rattus norvegicus
cccaagcggtgtggccgctctgtct

SEQ ID NO: 572368 - DNA, 25 bp, Rattus norvegicus
gtgacagcagctgcgacttcccgcg

SEQ ID NO: 572369 - DNA, 25 bp, Rattus norvegicus
gactgtccaggatgcaacttccatg

SEQ ID NO: 572370 - DNA, 25 bp, Rattus norvegicus
caagctgcgcggcttggaagccaga

SEQ ID NO: 572371 - DNA, 25 bp, Rattus norvegicus
cgcggctccgtagagaagttggaac

SEQ ID NO: 572372 - DNA, 25 bp, Rattus norvegicus
ttggaagccagagtgacagcagctg

SEQ ID NO: 572373 - DNA, 25 bp, Rattus norvegicus
cgtcgcagcccggactgtccaggat

SEQ ID NO: 572374 - DNA, 25 bp, Rattus norvegicus
tcctaagcgggagacgcctctgggc

SEQ ID NO: 572375 - DNA, 25 bp, Rattus norvegicus
aggcccgagcgcctcggttcgctag

SEQ ID NO: 572376 - DNA, 25 bp, Rattus norvegicus
gcttcctaagtgagccggtgaccgt

SEQ ID NO: 572377 - DNA, 25 bp, Rattus norvegicus
ggatcgcctgggagcctcaagtgac

SEQ ID NO: 572378 - DNA, 25 bp, Rattus norvegicus
gcctcggttcgctagtggactgcct

SEQ ID NO: 572379 - DNA, 25 bp, Rattus norvegicus
cctgcgacgctctgcgagcaggtga

SEQ ID NO: 572380 - DNA, 25 bp, Rattus norvegicus
atgcgaggttccctcgtgcgcgcgc

SEQ ID NO: 572381 - DNA, 25 bp, Rattus norvegicus
tactacacgaaggacgctaccggga

SEQ ID NO: 572382 - DNA, 25 bp, Rattus norvegicus
cgcctcggggagctactacacgaag

SEQ ID NO: 572383 - DNA, 25 bp, Rattus norvegicus
ctacggagggaactgcgcgcccgct

SEQ ID NO: 572384 - DNA, 25 bp, Rattus norvegicus
tgtcgccgttgcctacggagggaac

SEQ ID NO: 572385 - DNA, 25 bp, Rattus norvegicus
tgaccgtgccgtgcggccacagcta

SEQ ID NO: 572386 - DNA, 25 bp, Rattus norvegicus
ggtgttcagctaccggctccgtcac

SEQ ID NO: 572387 - DNA, 25 bp, Rattus norvegicus
tggactgcctggtgttcagctaccg

SEQ ID NO: 572388 - DNA, 25 bp, Rattus norvegicus
gcggccacagctactgtcgccgttg

SEQ ID NO: 572389 - DNA, 25 bp, Rattus norvegicus
agtgttgcacagtacctcctccgag

SEQ ID NO: 572390 - DNA, 25 bp, Rattus norvegicus
gccttctcggcaaacttcatcatca

SEQ ID NO: 572391 - DNA, 25 bp, Rattus norvegicus
gcaaacttcatcatcatcagggctc

SEQ ID NO: 572392 - DNA, 25 bp, Rattus norvegicus
tcgatccagttgtgcagagtgttgc

SEQ ID NO: 572393 - DNA, 25 bp, Rattus norvegicus
agtacctcctccgaggggcacggct

SEQ ID NO: 572394 - DNA, 25 bp, Rattus norvegicus
ggggcacggctgctctaccagctct

SEQ ID NO: 572395 - DNA, 25 bp, Rattus norvegicus
acagcaagcactgtagcacccgctt

SEQ ID NO: 572396 - DNA, 25 bp, Rattus norvegicus
aagcactgtagcacccgcttggcct

SEQ ID NO: 572397 - DNA, 25 bp, Rattus norvegicus
cgcttggcctcacctatgcggatgc

SEQ ID NO: 572398 - DNA, 25 bp, Rattus norvegicus
tcacctatgcggatgcgcttgatgg

SEQ ID NO: 572399 - DNA, 25 bp, Rattus norvegicus
cgcttgatgggatcggcctcaagga

SEQ ID NO: 572400 - DNA, 25 bp, Rattus norvegicus
ccggtagtcacgctcccgtagctgg

SEQ ID NO: 572401 - DNA, 25 bp, Rattus norvegicus
agtcacgctcccgtagctgggctcg

SEQ ID NO: 572402 - DNA, 25 bp, Rattus norvegicus
ggctcgcttcatgtcgatccagttg

SEQ ID NO: 572403 - DNA, 25 bp, Rattus norvegicus
ccgtcccacaatgcaaaggtcgttg

SEQ ID NO: 572404 - DNA, 25 bp, Rattus norvegicus
acaaaaggcacctccggagcctgga

SEQ ID NO: 572405 - DNA, 25 bp, Rattus norvegicus
ttgtagtttccaacggccagacaca

SEQ ID NO: 572406 - DNA, 25 bp, Rattus norvegicus
aacatgggcgatggctccaggaaac

SEQ ID NO: 572407 - DNA, 25 bp, Rattus norvegicus
gcaaactagcgcgagcgagccaata

SEQ ID NO: 572408 - DNA, 25 bp, Rattus norvegicus
tgacgctattagacgagcgccagca

SEQ ID NO: 572409 - DNA, 25 bp, Rattus norvegicus
ggagacccgcagctcatcgctctta

SEQ ID NO: 572410 - DNA, 25 bp, Rattus norvegicus
atcgctcttatagtggagcagctca

SEQ ID NO: 572411 - DNA, 25 bp, Rattus norvegicus
ctcaagagccgtggcctgtttgata

SEQ ID NO: 572412 - DNA, 25 bp, Rattus norvegicus
ctgtttgatagcttccgccgggact

SEQ ID NO: 572413 - DNA, 25 bp, Rattus norvegicus
ctggccgacgtggacactaaggtac

SEQ ID NO: 572414 - DNA, 25 bp, Rattus norvegicus
acctcgcctctttgacgtgccagag

SEQ ID NO: 572415 - DNA, 25 bp, Rattus norvegicus
tgccagagcccggagtaaaacaaaa

SEQ ID NO: 572416 - DNA, 25 bp, Rattus norvegicus
acacaggctataagaacatgggcga

SEQ ID NO: 572417 - DNA, 25 bp, Rattus norvegicus
tgtctgcgcgcagtgcttgcccagc

SEQ ID NO: 572418 - DNA, 25 bp, Rattus norvegicus
attgtctgtagcgtgtctgcgcgca

SEQ ID NO: 572419 - DNA, 25 bp, Rattus norvegicus
aggtccctaggaactccgcactgcg

SEQ ID NO: 572420 - DNA, 25 bp, Rattus norvegicus
cgtcccggagcattgtctgtagcgt

SEQ ID NO: 572421 - DNA, 25 bp, Rattus norvegicus
cggttccgcagcttcgccgtcggtg

SEQ ID NO: 572422 - DNA, 25 bp, Rattus norvegicus
tcacctggggagctgcggttccgca

SEQ ID NO: 572423 - DNA, 25 bp, Rattus norvegicus
gccagacaaaaagcggcgggatctg

SEQ ID NO: 572424 - DNA, 25 bp, Rattus norvegicus
gggccgccacgttcgccagacaaaa

SEQ ID NO: 572425 - DNA, 25 bp, Rattus norvegicus
cggagcacgaggtccggactctcca

SEQ ID NO: 572426 - DNA, 25 bp, Rattus norvegicus
ttcggcgcctgcaccgagggcacaa

SEQ ID NO: 572427 - DNA, 25 bp, Rattus norvegicus
tagctttcccgtttcggcgcctgca

SEQ ID NO: 572428 - DNA, 25 bp, Rattus norvegicus
gcgggcatttctcgaatgaattgaa

SEQ ID NO: 572429 - DNA, 25 bp, Rattus norvegicus
tttcaaagcgggcatttctcgaatg

SEQ ID NO: 572430 - DNA, 25 bp, Rattus norvegicus
cgccaccacagagactctgcgaaag

SEQ ID NO: 572431 - DNA, 25 bp, Rattus norvegicus
gaccgcgccatggagggttaccata

SEQ ID NO: 572432 - DNA, 25 bp, Rattus norvegicus
ctgcagccgggaggccaccatgact

SEQ ID NO: 572433 - DNA, 25 bp, Rattus norvegicus
ggtgcgcctcctcgctctgaggctg

SEQ ID NO: 572434 - DNA, 25 bp, Rattus norvegicus
cggtcagatggcagagccttccgct

SEQ ID NO: 572435 - DNA, 25 bp, Rattus norvegicus
cttagcacgatgtcgccacgagggc

SEQ ID NO: 572436 - DNA, 25 bp, Rattus norvegicus
cgggctccgtgtcgcttagcacgat

SEQ ID NO: 572437 - DNA, 25 bp, Rattus norvegicus
aaggacacagccaatcgcctgcgca

SEQ ID NO: 572438 - DNA, 25 bp, Rattus norvegicus
caggccctgaaggacacagccaatc

SEQ ID NO: 572439 - DNA, 25 bp, Rattus norvegicus
ccactcgtcggcctggggtgactct

SEQ ID NO: 572440 - DNA, 25 bp, Rattus norvegicus
agggttaccataagccagatcagca

SEQ ID NO: 572441 - DNA, 25 bp, Rattus norvegicus
gggcctcggtcactgccggtcgctt

SEQ ID NO: 572442 - DNA, 25 bp, Rattus norvegicus
accatgactgctggcgggagaacct

SEQ ID NO: 572443 - DNA, 25 bp, Rattus norvegicus
tcctaaggtgtcttaacgcgcccgc

SEQ ID NO: 572444 - DNA, 25 bp, Rattus norvegicus
cagatcagcagaagctccaggccct

SEQ ID NO: 572445 - DNA, 25 bp, Rattus norvegicus
gcccggggactcatgatcacttcac

SEQ ID NO: 572446 - DNA, 25 bp, Rattus norvegicus
actacttcgggactcagcctgtgca

SEQ ID NO: 572447 - DNA, 25 bp, Rattus norvegicus
ctagtttcgattagggacagcggct

SEQ ID NO: 572448 - DNA, 25 bp, Rattus norvegicus
agcccggcaacctcgcagacttgag

SEQ ID NO: 572449 - DNA, 25 bp, Rattus norvegicus
cacgccctgtgggttgctgctcaat

SEQ ID NO: 572450 - DNA, 25 bp, Rattus norvegicus
cctggtataaccacttcttggcaga

SEQ ID NO: 572451 - DNA, 25 bp, Rattus norvegicus
acatatgtcgcgagcagagcagccg

SEQ ID NO: 572452 - DNA, 25 bp, Rattus norvegicus
gtctgaccggactcgagctagtttc

SEQ ID NO: 572453 - DNA, 25 bp, Rattus norvegicus
tgctcaatctcgtcagtacactggc

SEQ ID NO: 572454 - DNA, 25 bp, Rattus norvegicus
tcttggcagatcctgacgtcctggc

SEQ ID NO: 572455 - DNA, 25 bp, Rattus norvegicus
ccggtcactgtgcaggtcagctaca

SEQ ID NO: 572456 - DNA, 25 bp, Rattus norvegicus
tgctgggctacctaggcagttgcct

SEQ ID NO: 572457 - DNA, 25 bp, Rattus norvegicus
agagtccgaggtcgcctcttgccaa

SEQ ID NO: 572458 - DNA, 25 bp, Rattus norvegicus
ccagccggaccagtggaactacttc

SEQ ID NO: 572459 - DNA, 25 bp, Rattus norvegicus
gggcgcccgctatcccgggcaagat

SEQ ID NO: 572460 - DNA, 25 bp, Rattus norvegicus
ttcgctggtgcaaatcttgggcgcc

SEQ ID NO: 572461 - DNA, 25 bp, Rattus norvegicus
ggtgcaaatcttgggcgcccgctat

SEQ ID NO: 572462 - DNA, 25 bp, Rattus norvegicus
cctggagttcgctggtgcaaatctt

SEQ ID NO: 572463 - DNA, 25 bp, Rattus norvegicus
cgcctgagtgaggacagcccagaag

SEQ ID NO: 572464 - DNA, 25 bp, Rattus norvegicus
tgcagactgctgaattggagcctgg

SEQ ID NO: 572465 - DNA, 25 bp, Rattus norvegicus
ctttgcagactgctgaattggagcc

SEQ ID NO: 572466 - DNA, 25 bp, Rattus norvegicus
cgcctctttgcagactgctgaattg

SEQ ID NO: 572467 - DNA, 25 bp, Rattus norvegicus
ccacgcctctttgcagactgctgaa

SEQ ID NO: 572468 - DNA, 25 bp, Rattus norvegicus
agttcccacgcctctttgcagactg

SEQ ID NO: 572469 - DNA, 25 bp, Rattus norvegicus
gagcctggagttcgctggtgcaaat

SEQ ID NO: 572470 - DNA, 25 bp, Rattus norvegicus
caccgcatgcctgggaggaacagac

SEQ ID NO: 572471 - DNA, 25 bp, Rattus norvegicus
aggaacagacggtgggatcttgctc

SEQ ID NO: 572472 - DNA, 25 bp, Rattus norvegicus
cagacggtgggatcttgctcccgct

SEQ ID NO: 572473 - DNA, 25 bp, Rattus norvegicus
ctgtgggtcctagcacagccagtgg

SEQ ID NO: 572474 - DNA, 25 bp, Rattus norvegicus
agctggcgcaggttgctccgcagct

SEQ ID NO: 572475 - DNA, 25 bp, Rattus norvegicus
gcggttcctgcgcaagaccaagacg

SEQ ID NO: 572476 - DNA, 25 bp, Rattus norvegicus
gaccaagacgcgaaggctgcccaga

SEQ ID NO: 572477 - DNA, 25 bp, Rattus norvegicus
cagaccttcaggcacatcctcgagg

SEQ ID NO: 572478 - DNA, 25 bp, Rattus norvegicus
aggcacatcctcgaggccgttgttc

SEQ ID NO: 572479 - DNA, 25 bp, Rattus norvegicus
gggactcgagtgagtcgcctcccgc

SEQ ID NO: 572480 - DNA, 25 bp, Rattus norvegicus
aggttgctccgcagcttcctggcgc

SEQ ID NO: 572481 - DNA, 25 bp, Rattus norvegicus
tcaccgtcttcaggttgccactgtc

SEQ ID NO: 572482 - DNA, 25 bp, Rattus norvegicus
cggcgactgtgggtcctagcacagc

SEQ ID NO: 572483 - DNA, 25 bp, Rattus norvegicus
cagccgggcaaagcggttcctgcgc

SEQ ID NO: 572484 - DNA, 25 bp, Rattus norvegicus
tggcggcgtctccttgtctccgttt

SEQ ID NO: 572485 - DNA, 25 bp, Rattus norvegicus
cgcgatcgggaagctacagcgccgc

SEQ ID NO: 572486 - DNA, 25 bp, Rattus norvegicus
actgtccttgccagccatggccgga

SEQ ID NO: 572487 - DNA, 25 bp, Rattus norvegicus
cgctgattggctgagttatctcccg

SEQ ID NO: 572488 - DNA, 25 bp, Rattus norvegicus
ggtcatctttgaactggccggctta

SEQ ID NO: 572489 - DNA, 25 bp, Rattus norvegicus
cacgctcccggaagtaggaggcgtc

SEQ ID NO: 572490 - DNA, 25 bp, Rattus norvegicus
cagtaggcgtagcacggtcatcttt

SEQ ID NO: 572491 - DNA, 25 bp, Rattus norvegicus
aacgtgagcgcggtagtttttcaag

SEQ ID NO: 572492 - DNA, 25 bp, Rattus norvegicus
tgacagcgagcgtcagcggccatct

SEQ ID NO: 572493 - DNA, 25 bp, Rattus norvegicus
tccgagtgagaattccgcgtaaaca

SEQ ID NO: 572494 - DNA, 25 bp, Rattus norvegicus
cccagccacgatcggcttactaagt

SEQ ID NO: 572495 - DNA, 25 bp, Rattus norvegicus
actaagtgatttggtaccctaatgg

SEQ ID NO: 572496 - DNA, 25 bp, Rattus norvegicus
aatggtacatcctcacgacagcagc

SEQ ID NO: 572497 - DNA, 25 bp, Rattus norvegicus
cagcagcacgattgtgaggcgatcc

SEQ ID NO: 572498 - DNA, 25 bp, Rattus norvegicus
ccgcgggttgcgaaccagatgctaa

SEQ ID NO: 572499 - DNA, 25 bp, Rattus norvegicus
ttccagccatttgggatgctccggc

SEQ ID NO: 572500 - DNA, 25 bp, Rattus norvegicus
atgaattagtgttggctagcgccgc

SEQ ID NO: 572501 - DNA, 25 bp, Rattus norvegicus
tggcgtccggacaacccagacggga

SEQ ID NO: 572502 - DNA, 25 bp, Rattus norvegicus
gcctcatgggagagcctgaagagaa

SEQ ID NO: 572503 - DNA, 25 bp, Rattus norvegicus
agggtgctgtgcctgcacccggtcc

SEQ ID NO: 572504 - DNA, 25 bp, Rattus norvegicus
cccacgagtctgcttcgacagggtc

SEQ ID NO: 572505 - DNA, 25 bp, Rattus norvegicus
ttcgacagggtctgcacctacctct

SEQ ID NO: 572506 - DNA, 25 bp, Rattus norvegicus
gtcgctgctcgctggcctcatggga

SEQ ID NO: 572507 - DNA, 25 bp, Rattus norvegicus
ccagacgggagcagcgcctcacgag

SEQ ID NO: 572508 - DNA, 25 bp, Rattus norvegicus
tgacagggttgactgctgccactga

SEQ ID NO: 572509 - DNA, 25 bp, Rattus norvegicus
ctgccactgaactacgtgagcgtcg

SEQ ID NO: 572510 - DNA, 25 bp, Rattus norvegicus
gcttagttcccggagacgaacaaga

SEQ ID NO: 572511 - DNA, 25 bp, Rattus norvegicus
agggaggagcccaagttatcacacc

SEQ ID NO: 572512 - DNA, 25 bp, Rattus norvegicus
gcccaagttatcacaccagggcggg

SEQ ID NO: 572513 - DNA, 25 bp, Rattus norvegicus
ggcaggtcagcgagtcccgatccca

SEQ ID NO: 572514 - DNA, 25 bp, Rattus norvegicus
caccagccgttctccgagggtgctg

SEQ ID NO: 572515 - DNA, 25 bp, Rattus norvegicus
tcttcgcctacttcttcttcgtctt

SEQ ID NO: 572516 - DNA, 25 bp, Rattus norvegicus
tgaatgcaaaggacatggccggccg

SEQ ID NO: 572517 - DNA, 25 bp, Rattus norvegicus
gcaggtctgagaccgtgttttacgg

SEQ ID NO: 572518 - DNA, 25 bp, Rattus norvegicus
tctgcacggtggctgctacggccgc

SEQ ID NO: 572519 - DNA, 25 bp, Rattus norvegicus
acatggccggccgaaagtcttctcc

SEQ ID NO: 572520 - DNA, 25 bp, Rattus norvegicus
cgccgttgccgcagtgacagtacgg

SEQ ID NO: 572521 - DNA, 25 bp, Rattus norvegicus
tggacgcagcgaacgtgaatgcaaa

SEQ ID NO: 572522 - DNA, 25 bp, Rattus norvegicus
gcttgtcgaaatggggacgtgtccc

SEQ ID NO: 572523 - DNA, 25 bp, Rattus norvegicus
cacagcaactttgggacccggggcg

SEQ ID NO: 572524 - DNA, 25 bp, Rattus norvegicus
gccggagttggctccacagcaactt

SEQ ID NO: 572525 - DNA, 25 bp, Rattus norvegicus
tcgagcatagcggagagtcccgaag

SEQ ID NO: 572526 - DNA, 25 bp, Rattus norvegicus
ggcggtaacaactccgcgtcgtcca

SEQ ID NO: 572527 - DNA, 25 bp, Rattus norvegicus
ggcgtcgcgtcgctctcagcatcat

SEQ ID NO: 572528 - DNA, 25 bp, Rattus norvegicus
tgcacttcgcagcaggtctgagacc

SEQ ID NO: 572529 - DNA, 25 bp, Rattus norvegicus
atgctacggcgctgcttgacgaact

SEQ ID NO: 572530 - DNA, 25 bp, Rattus norvegicus
cctgagactcgaactgcagcaactg

SEQ ID NO: 572531 - DNA, 25 bp, Rattus norvegicus
gctacggcgctgcttgacgaactcg

SEQ ID NO: 572532 - DNA, 25 bp, Rattus norvegicus
gcgagatgatgctacggcgctgctt

SEQ ID NO: 572533 - DNA, 25 bp, Rattus norvegicus
actgcagcaactggcccatgaagct

SEQ ID NO: 572534 - DNA, 25 bp, Rattus norvegicus
ctcgaactgcagcaactggcccatg

SEQ ID NO: 572535 - DNA, 25 bp, Rattus norvegicus
tgagactcgaactgcagcaactggc

SEQ ID NO: 572536 - DNA, 25 bp, Rattus norvegicus
tgagcacctgagactcgaactgcag

SEQ ID NO: 572537 - DNA, 25 bp, Rattus norvegicus
ctgcgcaggacgtggtgagcacctg

SEQ ID NO: 572538 - DNA, 25 bp, Rattus norvegicus
aagctgaagacgaactgcgaggtgg

SEQ ID NO: 572539 - DNA, 25 bp, Rattus norvegicus
cacggggaagctgaagacgaactgc

SEQ ID NO: 572540 - DNA, 25 bp, Rattus norvegicus
cacccacggacacggggaagctgaa

SEQ ID NO: 572541 - DNA, 25 bp, Rattus norvegicus
gcgtgcacacccacggacacgggga

SEQ ID NO: 572542 - DNA, 25 bp, Rattus norvegicus
tgcacacccacggacacggggaagc

SEQ ID NO: 572543 - DNA, 25 bp, Rattus norvegicus
ccttccctcatttgccggttgtgta

SEQ ID NO: 572544 - DNA, 25 bp, Rattus norvegicus
atcgtcaccatgtcgccggcaaagc

SEQ ID NO: 572545 - DNA, 25 bp, Rattus norvegicus
agccttttgagcacgctgcagtcca

SEQ ID NO: 572546 - DNA, 25 bp, Rattus norvegicus
ctcatctcggttcatcagccttttg

SEQ ID NO: 572547 - DNA, 25 bp, Rattus norvegicus
ctccgccgcacgatggtattgcagc

SEQ ID NO: 572548 - DNA, 25 bp, Rattus norvegicus
gcagaatctgctccaggctcacgga

SEQ ID NO: 572549 - DNA, 25 bp, Rattus norvegicus
cgacactgtgctgtcctcccggaga

SEQ ID NO: 572550 - DNA, 25 bp, Rattus norvegicus
ccaggtttacctttaagcaggcaga

SEQ ID NO: 572551 - DNA, 25 bp, Rattus norvegicus
ggctcaggtcaccaagtcccttaca

SEQ ID NO: 572552 - DNA, 25 bp, Rattus norvegicus
gggactccagcagcccgaaatcatt

SEQ ID NO: 572553 - DNA, 25 bp, Rattus norvegicus
gaaactcttcggacgcgtgcggact

SEQ ID NO: 572554 - DNA, 25 bp, Rattus norvegicus
tgtgtaggaactcccgagacagatc

SEQ ID NO: 572555 - DNA, 25 bp, Rattus norvegicus
tccaggccagaaccgctcatgtcaa

SEQ ID NO: 572556 - DNA, 25 bp, Rattus norvegicus
ggttataccgaaacaggcctctctg

SEQ ID NO: 572557 - DNA, 25 bp, Rattus norvegicus
gaacttcgtttccaagccggccagc

SEQ ID NO: 572558 - DNA, 25 bp, Rattus norvegicus
gggctcaacctgcaccagaacttcg

SEQ ID NO: 572559 - DNA, 25 bp, Rattus norvegicus
gcgaggtatcaagggtcccaggatc

SEQ ID NO: 572560 - DNA, 25 bp, Rattus norvegicus
ggccgcacaaactcttggtggcttg

SEQ ID NO: 572561 - DNA, 25 bp, Rattus norvegicus
ggctcccagcagaaaggccgcctgt

SEQ ID NO: 572562 - DNA, 25 bp, Rattus norvegicus
gatgccggacatctcagaactttgc

SEQ ID NO: 572563 - DNA, 25 bp, Rattus norvegicus
ctttgctggccagttagatggcatc

SEQ ID NO: 572564 - DNA, 25 bp, Rattus norvegicus
gcatcgagaacttttcctctgggga

SEQ ID NO: 572565 - DNA, 25 bp, Rattus norvegicus
caaagcgtacctctggtgctgcagc

SEQ ID NO: 572566 - DNA, 25 bp, Rattus norvegicus
aagaaacgtgtctgccgctcgactc

SEQ ID NO: 572567 - DNA, 25 bp, Rattus norvegicus
agcctggcatggactgtctcccttt

SEQ ID NO: 572568 - DNA, 25 bp, Rattus norvegicus
gaccctggctttggtgtttgccacc

SEQ ID NO: 572569 - DNA, 25 bp, Rattus norvegicus
tgatacccagaaccatgtgtgcgga

SEQ ID NO: 572570 - DNA, 25 bp, Rattus norvegicus
ggggcgcacaaagaatccaggtctc

SEQ ID NO: 572571 - DNA, 25 bp, Rattus norvegicus
gcactgcgcgactgctcctcgccct

SEQ ID NO: 572572 - DNA, 25 bp, Rattus norvegicus
cgacagcagccacagccatggtgct

SEQ ID NO: 572573 - DNA, 25 bp, Rattus norvegicus
gcgggaccagacagggcgctgtcgc

SEQ ID NO: 572574 - DNA, 25 bp, Rattus norvegicus
gtccgtgattggtcgctttcggccc

SEQ ID NO: 572575 - DNA, 25 bp, Rattus norvegicus
gtagccgtccgtgattggtcgcttt

SEQ ID NO: 572576 - DNA, 25 bp, Rattus norvegicus
cggcacgtagccgtccgtgattggt

SEQ ID NO: 572577 - DNA, 25 bp, Rattus norvegicus
gccctgcgccagtctgacgtcactg

SEQ ID NO: 572578 - DNA, 25 bp, Rattus norvegicus
acctaaggacggactgacagcggca

SEQ ID NO: 572579 - DNA, 25 bp, Rattus norvegicus
caccacctaaggacggactgacagc

SEQ ID NO: 572580 - DNA, 25 bp, Rattus norvegicus
tgtggccgctgctgcgcagcgaccc

SEQ ID NO: 572581 - DNA, 25 bp, Rattus norvegicus
agacccgcggcggaagtgtggccgc

SEQ ID NO: 572582 - DNA, 25 bp, Rattus norvegicus
agccacagccatggtgctgggtgaa

SEQ ID NO: 572583 - DNA, 25 bp, Rattus norvegicus
aaggacggactgacagcggcactgc

SEQ ID NO: 572584 - DNA, 25 bp, Rattus norvegicus
cacagccatggtgctgggtgaagac

SEQ ID NO: 572585 - DNA, 25 bp, Rattus norvegicus
aacgtgaagcgatcccgcaaaaatc

SEQ ID NO: 572586 - DNA, 25 bp, Rattus norvegicus
ccagagacattgagggctgcgaacc

SEQ ID NO: 572587 - DNA, 25 bp, Rattus norvegicus
gccaccgacgcgttctgcgcgagtt

SEQ ID NO: 572588 - DNA, 25 bp, Rattus norvegicus
cgtcaccgccatggcgggcatcaaa

SEQ ID NO: 572589 - DNA, 25 bp, Rattus norvegicus
tcgtgaagccaggagcgacgtcacc

SEQ ID NO: 572590 - DNA, 25 bp, Rattus norvegicus
caccgcccgggtcgtgaagccagga

SEQ ID NO: 572591 - DNA, 25 bp, Rattus norvegicus
cggcgtgcacttccgggtgttgtct

SEQ ID NO: 572592 - DNA, 25 bp, Rattus norvegicus
tgacaggaaccacagtcctatcccg

SEQ ID NO: 572593 - DNA, 25 bp, Rattus norvegicus
atcccgcaaaaatcacgaggtcttt

SEQ ID NO: 572594 - DNA, 25 bp, Rattus norvegicus
cgcagggcaaaccagtgtggtttcc

SEQ ID NO: 572595 - DNA, 25 bp, Rattus norvegicus
tctgcgcgagtttgcaaccagagac

SEQ ID NO: 572596 - DNA, 25 bp, Rattus norvegicus
tttcccaccggaggcacgaacgcag

SEQ ID NO: 572597 - DNA, 25 bp, Rattus norvegicus
cctccggggcttgacaggaaccaca

SEQ ID NO: 572598 - DNA, 25 bp, Rattus norvegicus
ccagtgtggtttcccaccggaggca

SEQ ID NO: 572599 - DNA, 25 bp, Rattus norvegicus
tggtgaaaaggaaccgagactggac

SEQ ID NO: 572600 - DNA, 25 bp, Rattus norvegicus
cccaagcactggaggctaaggagac

SEQ ID NO: 572601 - DNA, 25 bp, Rattus norvegicus
aaaggaaccgagactggactggcag

SEQ ID NO: 572602 - DNA, 25 bp, Rattus norvegicus
agtacacggacgacgaggagcaaac

SEQ ID NO: 572603 - DNA, 25 bp, Rattus norvegicus
acgaggagcaaacggacctggcctg

SEQ ID NO: 572604 - DNA, 25 bp, Rattus norvegicus
cccagggagattcgagaagatcgga

SEQ ID NO: 572605 - DNA, 25 bp, Rattus norvegicus
tcgagaagatcggacgaccctcggc

SEQ ID NO: 572606 - DNA, 25 bp, Rattus norvegicus
ctgaggacacacagcggggtaaaga

SEQ ID NO: 572607 - DNA, 25 bp, Rattus norvegicus
gcctgggctccagccgtcgaagaga

SEQ ID NO: 572608 - DNA, 25 bp, Rattus norvegicus
ccagccgtcgaagagagggtcagac

SEQ ID NO: 572609 - DNA, 25 bp, Rattus norvegicus
agggtcagacggaccagagtaccga

SEQ ID NO: 572610 - DNA, 25 bp, Rattus norvegicus
agtaccgaggcaaccgcgggtctct

SEQ ID NO: 572611 - DNA, 25 bp, Rattus norvegicus
ctgggacccaagcactggaggctaa

SEQ ID NO: 572612 - DNA, 25 bp, Rattus norvegicus
acacacagcggggtaaagatgctgg

SEQ ID NO: 572613 - DNA, 25 bp, Rattus norvegicus
tcagtcggtagcaaatgaaggcaca

SEQ ID NO: 572614 - DNA, 25 bp, Rattus norvegicus
cacataaaggttgtgggcgatgtac

SEQ ID NO: 572615 - DNA, 25 bp, Rattus norvegicus
ctctctttgtttcgatcagtcggta

SEQ ID NO: 572616 - DNA, 25 bp, Rattus norvegicus
gattatcgcctcctaactctctttg

SEQ ID NO: 572617 - DNA, 25 bp, Rattus norvegicus
cttctttccgaaggattatcgcctc

SEQ ID NO: 572618 - DNA, 25 bp, Rattus norvegicus
cgaagctaagcttctttccgaagga

SEQ ID NO: 572619 - DNA, 25 bp, Rattus norvegicus
ggcgatgtactgtgaaggttcctta

SEQ ID NO: 572620 - DNA, 25 bp, Rattus norvegicus
caccggaaacacagtcatcttcgcg

SEQ ID NO: 572621 - DNA, 25 bp, Rattus norvegicus
taaagcacagagcattgatttgccc

SEQ ID NO: 572622 - DNA, 25 bp, Rattus norvegicus
cgcggtgcctttgctgtacgcgcct

SEQ ID NO: 572623 - DNA, 25 bp, Rattus norvegicus
tgctgtacgcgcctgctcactgtct

SEQ ID NO: 572624 - DNA, 25 bp, Rattus norvegicus
tcttccctccgcagattgaatgggg

SEQ ID NO: 572625 - DNA, 25 bp, Rattus norvegicus
gcatgcgcacttgttctcaccggaa

SEQ ID NO: 572626 - DNA, 25 bp, Rattus norvegicus
aggccgaggtcgactaaagcacaga

SEQ ID NO: 572627 - DNA, 25 bp, Rattus norvegicus
tgtatagatggctggttccgtaacc

SEQ ID NO: 572628 - DNA, 25 bp, Rattus norvegicus
aacctgtctcaggtcgcattgtggg

SEQ ID NO: 572629 - DNA, 25 bp, Rattus norvegicus
tgagtgttaacacctccgcaggggc

SEQ ID NO: 572630 - DNA, 25 bp, Rattus norvegicus
agctcttcctgagactcgggactga

SEQ ID NO: 572631 - DNA, 25 bp, Rattus norvegicus
gcaaggtcgatctcagctcttcctg

SEQ ID NO: 572632 - DNA, 25 bp, Rattus norvegicus
cggatgtagacatcatcgctctagc

SEQ ID NO: 572633 - DNA, 25 bp, Rattus norvegicus
tacgcaagcgcgagcctgcaaagca

SEQ ID NO: 572634 - DNA, 25 bp, Rattus norvegicus
ctcagggagtctgcgaaaggttgca

SEQ ID NO: 572635 - DNA, 25 bp, Rattus norvegicus
cctgcgcagactccattggggctgc

SEQ ID NO: 572636 - DNA, 25 bp, Rattus norvegicus
cgaaaggttgcaagacgccgcccag

SEQ ID NO: 572637 - DNA, 25 bp, Rattus norvegicus
ccatacctggcgtccgccggatatg

SEQ ID NO: 572638 - DNA, 25 bp, Rattus norvegicus
ctctagccaggctgcaaggtcgatc

SEQ ID NO: 572639 - DNA, 25 bp, Rattus norvegicus
gcaaaccgtccgcagtacgcaagcg

SEQ ID NO: 572640 - DNA, 25 bp, Rattus norvegicus
gccaggccctgcaatcggatgtaga

SEQ ID NO: 572641 - DNA, 25 bp, Rattus norvegicus
agcccaatactggggtcgaccgctc

SEQ ID NO: 572642 - DNA, 25 bp, Rattus norvegicus
gtttgggtgcacatccgtcgtgaaa

SEQ ID NO: 572643 - DNA, 25 bp, Rattus norvegicus
ggaggcttcgctggactccggcacc

SEQ ID NO: 572644 - DNA, 25 bp, Rattus norvegicus
tccggcaccctcagtggggtggcaa

SEQ ID NO: 572645 - DNA, 25 bp, Rattus norvegicus
ggtggcaagcggtctcctgcaaaag

SEQ ID NO: 572646 - DNA, 25 bp, Rattus norvegicus
tctcctgcaaaagcgaggctcggtg

SEQ ID NO: 572647 - DNA, 25 bp, Rattus norvegicus
ggctgtcccacgtgtccgtcacttt

SEQ ID NO: 572648 - DNA, 25 bp, Rattus norvegicus
gagtcttgtcgggtactaccaagga

SEQ ID NO: 572649 - DNA, 25 bp, Rattus norvegicus
catccgtcgtgaaaagccagcaaac

SEQ ID NO: 572650 - DNA, 25 bp, Rattus norvegicus
gccagcaaacaaaagtagtgcgctc

SEQ ID NO: 572651 - DNA, 25 bp, Rattus norvegicus
agtagtgcgctccagtccatgcgcc

SEQ ID NO: 572652 - DNA, 25 bp, Rattus norvegicus
acgcctaggtcccaggggttgcaga

SEQ ID NO: 572653 - DNA, 25 bp, Rattus norvegicus
ctgcgtgcggcccagagacccagag

SEQ ID NO: 572654 - DNA, 25 bp, Rattus norvegicus
tgtcccacgtgtccgtcacttttcg

SEQ ID NO: 572655 - DNA, 25 bp, Rattus norvegicus
tcgccgtgactaagcaccggcggcg

SEQ ID NO: 572656 - DNA, 25 bp, Rattus norvegicus
agaccggagacgtgcacgttttgtt

SEQ ID NO: 572657 - DNA, 25 bp, Rattus norvegicus
ctgcacctgtgcacactggcggact

SEQ ID NO: 572658 - DNA, 25 bp, Rattus norvegicus
accgagaccggagacgtgcacgttt

SEQ ID NO: 572659 - DNA, 25 bp, Rattus norvegicus
gcagtagcgccatgcgcggaagtgc

SEQ ID NO: 572660 - DNA, 25 bp, Rattus norvegicus
agcttgtgactctccaccaccgcgg

SEQ ID NO: 572661 - DNA, 25 bp, Rattus norvegicus
gcaagtgccgcccagcttgtgactc

SEQ ID NO: 572662 - DNA, 25 bp, Rattus norvegicus
tgcagcgtcgccgtgactaagcacc

SEQ ID NO: 572663 - DNA, 25 bp, Rattus norvegicus
ctggcggactcggtcgcgttaccct

SEQ ID NO: 572664 - DNA, 25 bp, Rattus norvegicus
aagcttggctgaagtcttggcgtta

SEQ ID NO: 572665 - DNA, 25 bp, Rattus norvegicus
acgcccggcagctaagcttggctga

SEQ ID NO: 572666 - DNA, 25 bp, Rattus norvegicus
cgcaggcagagttgcacgcccggca

SEQ ID NO: 572667 - DNA, 25 bp, Rattus norvegicus
gagggccccggtactcacgcaagtg

SEQ ID NO: 572668 - DNA, 25 bp, Rattus norvegicus
tcttggcgttagcactgcacctgtg

SEQ ID NO: 572669 - DNA, 25 bp, Rattus norvegicus
tccaagctcgcggaaggcacggccg

SEQ ID NO: 572670 - DNA, 25 bp, Rattus norvegicus
cctccgtgcgcttttgactacaatc

SEQ ID NO: 572671 - DNA, 25 bp, Rattus norvegicus
gcgtacctccgtgcgcttttgacta

SEQ ID NO: 572672 - DNA, 25 bp, Rattus norvegicus
ctttcaccggagtggtgcgtacctc

SEQ ID NO: 572673 - DNA, 25 bp, Rattus norvegicus
cacaactgggatgctttcaccggag

SEQ ID NO: 572674 - DNA, 25 bp, Rattus norvegicus
cccgagtctcggtaagtgttgcctt

SEQ ID NO: 572675 - DNA, 25 bp, Rattus norvegicus
gcgtcgttggcattttcttgctctc

SEQ ID NO: 572676 - DNA, 25 bp, Rattus norvegicus
cttctcgtggcgtcgttggcatttt

SEQ ID NO: 572677 - DNA, 25 bp, Rattus norvegicus
gcccggtgaatccttctcgccatgg

SEQ ID NO: 572678 - DNA, 25 bp, Rattus norvegicus
cagggcctaaaatcctctctcggtc

SEQ ID NO: 572679 - DNA, 25 bp, Rattus norvegicus
ggtttatctcattcaggcccacgcc

SEQ ID NO: 572680 - DNA, 25 bp, Rattus norvegicus
tgagcacgggctatgggtttatctc

SEQ ID NO: 572681 - DNA, 25 bp, Rattus norvegicus
atgacccgcgccgtctgagcacggg

SEQ ID NO: 572682 - DNA, 25 bp, Rattus norvegicus
tccttctcgccatggcttctcgtgg

SEQ ID NO: 572683 - DNA, 25 bp, Rattus norvegicus
tgttaacgactttcagggcagttgc

SEQ ID NO: 572684 - DNA, 25 bp, Rattus norvegicus
gcgggccgcctaccttctcgcacag

SEQ ID NO: 572685 - DNA, 25 bp, Rattus norvegicus
tctcgcacagcgtccgcacttggtt

SEQ ID NO: 572686 - DNA, 25 bp, Rattus norvegicus
ctcggtgttaacgactttcagggca

SEQ ID NO: 572687 - DNA, 25 bp, Rattus norvegicus
tcgaagggcccggttcacctgcgaa

SEQ ID NO: 572688 - DNA, 25 bp, Rattus norvegicus
cccacgctaaccaagtctcggtgtt

SEQ ID NO: 572689 - DNA, 25 bp, Rattus norvegicus
gctaaccaagtctcggtgttaacga

SEQ ID NO: 572690 - DNA, 25 bp, Rattus norvegicus
ttcagggcagttgcccgtggaccca

SEQ ID NO: 572691 - DNA, 25 bp, Rattus norvegicus
caagtctcggtgttaacgactttca

SEQ ID NO: 572692 - DNA, 25 bp, Rattus norvegicus
ccgtcccacactccaggccgggcca

SEQ ID NO: 572693 - DNA, 25 bp, Rattus norvegicus
taacgactttcagggcagttgcccg

SEQ ID NO: 572694 - DNA, 25 bp, Rattus norvegicus
cccgtggacccaggggactgcagca

SEQ ID NO: 572695 - DNA, 25 bp, Rattus norvegicus
tggacccaggggactgcagcagcct

SEQ ID NO: 572696 - DNA, 25 bp, Rattus norvegicus
actgcagcagcctgactttcggggg

SEQ ID NO: 572697 - DNA, 25 bp, Rattus norvegicus
caaccttttacttccctagtacatg

SEQ ID NO: 572698 - DNA, 25 bp, Rattus norvegicus
atggttgggctttatcctcaacctt

SEQ ID NO: 572699 - DNA, 25 bp, Rattus norvegicus
cttggatctctctcggcacagggaa

SEQ ID NO: 572700 - DNA, 25 bp, Rattus norvegicus
tttacttccctagtacatgcactaa

SEQ ID NO: 572701 - DNA, 25 bp, Rattus norvegicus
gggatggttgggctttatcctcaac

SEQ ID NO: 572702 - DNA, 25 bp, Rattus norvegicus
gaattgggatggttgggctttatcc

SEQ ID NO: 572703 - DNA, 25 bp, Rattus norvegicus
ctctctcggcacagggaattgggat

SEQ ID NO: 572704 - DNA, 25 bp, Rattus norvegicus
gatctctctcggcacagggaattgg

SEQ ID NO: 572705 - DNA, 25 bp, Rattus norvegicus
ggttcttgccttggatctctctcgg

SEQ ID NO: 572706 - DNA, 25 bp, Rattus norvegicus
ctggggccagcatccttctctggtt

SEQ ID NO: 572707 - DNA, 25 bp, Rattus norvegicus
gggccagcatccttctctggttctt

SEQ ID NO: 572708 - DNA, 25 bp, Rattus norvegicus
tgggttcttgccttggatctctctc

SEQ ID NO: 572709 - DNA, 25 bp, Rattus norvegicus
ccctctgggaagtgggttcttgcct

SEQ ID NO: 572710 - DNA, 25 bp, Rattus norvegicus
ttcttcctgccctctgggaagtggg

SEQ ID NO: 572711 - DNA, 25 bp, Rattus norvegicus
agtccgcgcgtcttgttgacactca

SEQ ID NO: 572712 - DNA, 25 bp, Rattus norvegicus
ccgtgcactacggaattgtgagctc

SEQ ID NO: 572713 - DNA, 25 bp, Rattus norvegicus
tggcatgtgacactgcgttccttta

SEQ ID NO: 572714 - DNA, 25 bp, Rattus norvegicus
cgccaattcctgctctggccgaatg

SEQ ID NO: 572715 - DNA, 25 bp, Rattus norvegicus
ctccggtaacggagtatcatggttc

SEQ ID NO: 572716 - DNA, 25 bp, Rattus norvegicus
gggaggccagcttattttatgcaca

SEQ ID NO: 572717 - DNA, 25 bp, Rattus norvegicus
ggctgcgtttcagtcactcggatca

SEQ ID NO: 572718 - DNA, 25 bp, Rattus norvegicus
tcggatcaggcggtgactctttaac

SEQ ID NO: 572719 - DNA, 25 bp, Rattus norvegicus
acagcacccttggagacccggtttg

SEQ ID NO: 572720 - DNA, 25 bp, Rattus norvegicus
agcgaaaccctatgcgtggcccaca

SEQ ID NO: 572721 - DNA, 25 bp, Rattus norvegicus
gccgcgctgaagctctgaaagcatc

SEQ ID NO: 572722 - DNA, 25 bp, Rattus norvegicus
atcaccttctgagacgcgatccgta

SEQ ID NO: 572723 - DNA, 25 bp, Rattus norvegicus
gtgttccattcgtactcctcccaag

SEQ ID NO: 572724 - DNA, 25 bp, Rattus norvegicus
gcagccttcttgtgcaccttgaaag

SEQ ID NO: 572725 - DNA, 25 bp, Rattus norvegicus
ctacctgggagggtccaccgactct

SEQ ID NO: 572726 - DNA, 25 bp, Rattus norvegicus
ggttgcatacgaacgctgcctcaca

SEQ ID NO: 572727 - DNA, 25 bp, Rattus norvegicus
ccgagcgaggagctaggttgcatac

SEQ ID NO: 572728 - DNA, 25 bp, Rattus norvegicus
gcacctagcaggcaggcaccgagcg

SEQ ID NO: 572729 - DNA, 25 bp, Rattus norvegicus
aatctctcgtgctagggcgggcacc

SEQ ID NO: 572730 - DNA, 25 bp, Rattus norvegicus
ctcggagcccgaatctctcgtgcta

SEQ ID NO: 572731 - DNA, 25 bp, Rattus norvegicus
aggtgtggacctgccctggcaccgc

SEQ ID NO: 572732 - DNA, 25 bp, Rattus norvegicus
tccgcgcacgcgcaggtgtggacct

SEQ ID NO: 572733 - DNA, 25 bp, Rattus norvegicus
gagtccgacatggacgcgcgccgca

SEQ ID NO: 572734 - DNA, 25 bp, Rattus norvegicus
agccagagcacaaggacatcgtccg

SEQ ID NO: 572735 - DNA, 25 bp, Rattus norvegicus
acagcgccagggtggccggctcaat

SEQ ID NO: 572736 - DNA, 25 bp, Rattus norvegicus
gccggctcaattgctcgaggaaatc

SEQ ID NO: 572737 - DNA, 25 bp, Rattus norvegicus
acaccttcacacagcgccagggtgg

SEQ ID NO: 572738 - DNA, 25 bp, Rattus norvegicus
attgctcgaggaaatccgaagttcg

SEQ ID NO: 572739 - DNA, 25 bp, Rattus norvegicus
cccagcggccgtcagctttgagcat

SEQ ID NO: 572740 - DNA, 25 bp, Rattus norvegicus
tgcctggattcgggcaccggcccga

SEQ ID NO: 572741 - DNA, 25 bp, Rattus norvegicus
cgcacctgcgttgagactacatttc

SEQ ID NO: 572742 - DNA, 25 bp, Rattus norvegicus
cccgcacctgcgttgagactacatt

SEQ ID NO: 572743 - DNA, 25 bp, Rattus norvegicus
agcgttatgacttcccgcggctcac

SEQ ID NO: 572744 - DNA, 25 bp, Rattus norvegicus
tggcgggagcgttatgacttcccgc

SEQ ID NO: 572745 - DNA, 25 bp, Rattus norvegicus
atcatctccgtcaccgccaccgatg

SEQ ID NO: 572746 - DNA, 25 bp, Rattus norvegicus
agccagccgacactcacatcatctc

SEQ ID NO: 572747 - DNA, 25 bp, Rattus norvegicus
ctcccgttccgattcccgcatgctg

SEQ ID NO: 572748 - DNA, 25 bp, Rattus norvegicus
accgcgcacgcagcatccctcggct

SEQ ID NO: 572749 - DNA, 25 bp, Rattus norvegicus
cctcggccggtttcgcaccgcgcac

SEQ ID NO: 572750 - DNA, 25 bp, Rattus norvegicus
ccgtcagctttgagcatgcgcgccg

SEQ ID NO: 572751 - DNA, 25 bp, Rattus norvegicus
cccagccgcgctagtggaaagaggg

SEQ ID NO: 572752 - DNA, 25 bp, Rattus norvegicus
gccaccgatgcccttcacgaccacc

SEQ ID NO: 572753 - DNA, 25 bp, Rattus norvegicus
tgctgctactactggggaccgcggc

SEQ ID NO: 572754 - DNA, 25 bp, Rattus norvegicus
cggctcaaggaggacagcaggtaca

SEQ ID NO: 572755 - DNA, 25 bp, Rattus norvegicus
caccgtgcgcctggatacctggggc

SEQ ID NO: 572756 - DNA, 25 bp, Rattus norvegicus
gggtttgaagaaggactcgctactc

SEQ ID NO: 572757 - DNA, 25 bp, Rattus norvegicus
ccgcgccctatctggtcaaggtgca

SEQ ID NO: 572758 - DNA, 25 bp, Rattus norvegicus
aggaccctctgcctgctgtcaactg

SEQ ID NO: 572759 - DNA, 25 bp, Rattus norvegicus
tgatcgagggaaaggtgcacccgcc

SEQ ID NO: 572760 - DNA, 25 bp, Rattus norvegicus
tcacaccatgagatggcgacgcgcc

SEQ ID NO: 572761 - DNA, 25 bp, Rattus norvegicus
tggaaccagccaggcagagtccgca

SEQ ID NO: 572762 - DNA, 25 bp, Rattus norvegicus
tcgcctctttgcctttctgtgattc

SEQ ID NO: 572763 - DNA, 25 bp, Rattus norvegicus
caaccaaggcggtggcaaaggcttt

SEQ ID NO: 572764 - DNA, 25 bp, Rattus norvegicus
tgtcactcccgcaaccaaggcggtg

SEQ ID NO: 572765 - DNA, 25 bp, Rattus norvegicus
agcactccacacaaaggactgttcc

SEQ ID NO: 572766 - DNA, 25 bp, Rattus norvegicus
ttcaggactcgccaccttcacagga

SEQ ID NO: 572767 - DNA, 25 bp, Rattus norvegicus
cctttgagccgagcctctgaggcta

SEQ ID NO: 572768 - DNA, 25 bp, Rattus norvegicus
gtctgtccgtgacgccatttttccg

SEQ ID NO: 572769 - DNA, 25 bp, Rattus norvegicus
gcgagtctgtccgtgacgccatttt

SEQ ID NO: 572770 - DNA, 25 bp, Rattus norvegicus
tgtgctccgcctccgttgtcaaagt

SEQ ID NO: 572771 - DNA, 25 bp, Rattus norvegicus
ccaatcaggagcgagtctgtccgtg

SEQ ID NO: 572772 - DNA, 25 bp, Rattus norvegicus
tccgttgtcaaagtccccaatcagg

SEQ ID NO: 572773 - DNA, 25 bp, Rattus norvegicus
tgacgccatttttccgcgacgaagc

SEQ ID NO: 572774 - DNA, 25 bp, Rattus norvegicus
ttcctcctttgagccgagcctctga

SEQ ID NO: 572775 - DNA, 25 bp, Rattus norvegicus
cctctgaggctatgggcagccagga

SEQ ID NO: 572776 - DNA, 25 bp, Rattus norvegicus
tggcctcctcgggtctcctgctgca

SEQ ID NO: 572777 - DNA, 25 bp, Rattus norvegicus
ctgcaggtactctgctgcgcccgct

SEQ ID NO: 572778 - DNA, 25 bp, Rattus norvegicus
aggctactctgggttccccgcattg

SEQ ID NO: 572779 - DNA, 25 bp, Rattus norvegicus
gttgggagtctacggttccagtctc

SEQ ID NO: 572780 - DNA, 25 bp, Rattus norvegicus
catttttccgcgacgaagcaggcgc

SEQ ID NO: 572781 - DNA, 25 bp, Rattus norvegicus
ctgcgtccaacctgcgggcaattga

SEQ ID NO: 572782 - DNA, 25 bp, Rattus norvegicus
ccctcctgggacaaacttttctgca

SEQ ID NO: 572783 - DNA, 25 bp, Rattus norvegicus
gagcgcagaccggattgtgatcacc

SEQ ID NO: 572784 - DNA, 25 bp, Rattus norvegicus
tgtgatcacctttccctcttcgggc

SEQ ID NO: 572785 - DNA, 25 bp, Rattus norvegicus
cttcgggctgtaagagagcgagaca

SEQ ID NO: 572786 - DNA, 25 bp, Rattus norvegicus
agcgagacaagccaccgaagcgagg

SEQ ID NO: 572787 - DNA, 25 bp, Rattus norvegicus
tccgagccactccagactgagcgga

SEQ ID NO: 572788 - DNA, 25 bp, Rattus norvegicus
gtgatcgagtccacgctgcttcctg

SEQ ID NO: 572789 - DNA, 25 bp, Rattus norvegicus
acccgggacactagagcagctccga

SEQ ID NO: 572790 - DNA, 25 bp, Rattus norvegicus
gaccaaacttgtcgcgcgtcaccgt

SEQ ID NO: 572791 - DNA, 25 bp, Rattus norvegicus
cttcggcgagatgtctgagcgcaaa

SEQ ID NO: 572792 - DNA, 25 bp, Rattus norvegicus
gggtctgccctctagcgagagaagc

SEQ ID NO: 572793 - DNA, 25 bp, Rattus norvegicus
tctgcaagcccttggaccaaacttg

SEQ ID NO: 572794 - DNA, 25 bp, Rattus norvegicus
cgtagagcgctcatcttcggcgaga

SEQ ID NO: 572795 - DNA, 25 bp, Rattus norvegicus
ttctcgcgataggttagtggctttc

SEQ ID NO: 572796 - DNA, 25 bp, Rattus norvegicus
ctttgtagaagtctggagcgcgtcc

SEQ ID NO: 572797 - DNA, 25 bp, Rattus norvegicus
gagcgcgtccatataagtagccaga

SEQ ID NO: 572798 - DNA, 25 bp, Rattus norvegicus
cggcaagctgagcaaggcgctatct

SEQ ID NO: 572799 - DNA, 25 bp, Rattus norvegicus
cgcggaagcgcgcacattcaactcg

SEQ ID NO: 572800 - DNA, 25 bp, Rattus norvegicus
cgtcacgggcttcattgagactttc

SEQ ID NO: 572801 - DNA, 25 bp, Rattus norvegicus
aggctcagtccaccggatcggcttc

SEQ ID NO: 572802 - DNA, 25 bp, Rattus norvegicus
cccggaagaagcgtggctgctttcc

SEQ ID NO: 572803 - DNA, 25 bp, Rattus norvegicus
tgctttcctgctcctaacgcggcga

SEQ ID NO: 572804 - DNA, 25 bp, Rattus norvegicus
ccggcaccatgcagtcggacgatgt

SEQ ID NO: 572805 - DNA, 25 bp, Rattus norvegicus
tgtgagttccctcctcttgctctgg

SEQ ID NO: 572806 - DNA, 25 bp, Rattus norvegicus
gcggcttttcgctcatttaggactc

SEQ ID NO: 572807 - DNA, 25 bp, Rattus norvegicus
cctgcatattctgctggaccgtttg

SEQ ID NO: 572808 - DNA, 25 bp, Rattus norvegicus
ctcggattgcgagacttccagagcc

SEQ ID NO: 572809 - DNA, 25 bp, Rattus norvegicus
gtctttcggagcgaagccctgccga

SEQ ID NO: 572810 - DNA, 25 bp, Rattus norvegicus
ttgggtccctcctctccgagcagtg

SEQ ID NO: 572811 - DNA, 25 bp, Rattus norvegicus
tgcgcgctgggattccgaaaactga

SEQ ID NO: 572812 - DNA, 25 bp, Rattus norvegicus
gaaaactgacactgtgcggctcaca

SEQ ID NO: 572813 - DNA, 25 bp, Rattus norvegicus
tttgcaaagcaacaaagagggcaga

SEQ ID NO: 572814 - DNA, 25 bp, Rattus norvegicus
cagagaggtcggtttgcaaagcaac

SEQ ID NO: 572815 - DNA, 25 bp, Rattus norvegicus
agggactcaccgttacaccactgga

SEQ ID NO: 572816 - DNA, 25 bp, Rattus norvegicus
accgccgggatggagatgcaactcc

SEQ ID NO: 572817 - DNA, 25 bp, Rattus norvegicus
aatccgcgggactgtgcacggagac

SEQ ID NO: 572818 - DNA, 25 bp, Rattus norvegicus
cggagccaaggttttggaatccgcg

SEQ ID NO: 572819 - DNA, 25 bp, Rattus norvegicus
tcggcttctcggagcgaacggagcc

SEQ ID NO: 572820 - DNA, 25 bp, Rattus norvegicus
catcaatgaagtgaaggtcggcttc

SEQ ID NO: 572821 - DNA, 25 bp, Rattus norvegicus
caccactggaatgggtgcatcaatg

SEQ ID NO: 572822 - DNA, 25 bp, Rattus norvegicus
agaaggaagcaaagtctttcggagc

SEQ ID NO: 572823 - DNA, 25 bp, Rattus norvegicus
cctccgtctgctgtcgcggtagtaa

SEQ ID NO: 572824 - DNA, 25 bp, Rattus norvegicus
tggtcgcaagggtctcagatcccga

SEQ ID NO: 572825 - DNA, 25 bp, Rattus norvegicus
ctgctgtcgcggtagtaacaggttc

SEQ ID NO: 572826 - DNA, 25 bp, Rattus norvegicus
taacaggttcgtggctgtcgcctta

SEQ ID NO: 572827 - DNA, 25 bp, Rattus norvegicus
ggctgtcgccttagccctgtgccaa

SEQ ID NO: 572828 - DNA, 25 bp, Rattus norvegicus
tgtgccaaccagacagcctggcgca

SEQ ID NO: 572829 - DNA, 25 bp, Rattus norvegicus
acgtctctacctcctggtcgcaagg

SEQ ID NO: 572830 - DNA, 25 bp, Rattus norvegicus
gcgcaggtggatcccagctattttt

SEQ ID NO: 572831 - DNA, 25 bp, Rattus norvegicus
ccagctatttttaagccatgacacg

SEQ ID NO: 572832 - DNA, 25 bp, Rattus norvegicus
catgacacgtacatcgaagcaggtt

SEQ ID NO: 572833 - DNA, 25 bp, Rattus norvegicus
aagcaggttcctttcggtgtgcgcg

SEQ ID NO: 572834 - DNA, 25 bp, Rattus norvegicus
tgacatccagggacaccgtgtcacg

SEQ ID NO: 572835 - DNA, 25 bp, Rattus norvegicus
cagggacaccgtgtcacgcagcggt

SEQ ID NO: 572836 - DNA, 25 bp, Rattus norvegicus
tctcagatcccgagttggcctgcgg

SEQ ID NO: 572837 - DNA, 25 bp, Rattus norvegicus
cgaatcctgagaggagcttggagca

SEQ ID NO: 572838 - DNA, 25 bp, Rattus norvegicus
ttgcttctctctgcgcgcggagtcg

SEQ ID NO: 572839 - DNA, 25 bp, Rattus norvegicus
gcatgggcttcccaagttgtgcttg

SEQ ID NO: 572840 - DNA, 25 bp, Rattus norvegicus
tcccatggcttggactctgtttctg

SEQ ID NO: 572841 - DNA, 25 bp, Rattus norvegicus
cctcgcggacttccagggcgtggaa

SEQ ID NO: 572842 - DNA, 25 bp, Rattus norvegicus
aaacctactgctgttggctccctgc

SEQ ID NO: 572843 - DNA, 25 bp, Rattus norvegicus
cactcccggggaaacctactgctgt

SEQ ID NO: 572844 - DNA, 25 bp, Rattus norvegicus
tgatatccctgttccgctgctgtag

SEQ ID NO: 572845 - DNA, 25 bp, Rattus norvegicus
tcagctccgtagtccgggacccgga

SEQ ID NO: 572846 - DNA, 25 bp, Rattus norvegicus
ggctcattagcgatgcggtctccca

SEQ ID NO: 572847 - DNA, 25 bp, Rattus norvegicus
tgactcattggctgtcgctccgagg

SEQ ID NO: 572848 - DNA, 25 bp, Rattus norvegicus
tgcgcacagcttgcgatcgcgcgtc

SEQ ID NO: 572849 - DNA, 25 bp, Rattus norvegicus
gagaaaagagactcgccacagacca

SEQ ID NO: 572850 - DNA, 25 bp, Rattus norvegicus
ggagcgggactctcacctttggcat

SEQ ID NO: 572851 - DNA, 25 bp, Rattus norvegicus
gtgctctacactcctgaccgactta

SEQ ID NO: 572852 - DNA, 25 bp, Rattus norvegicus
tacagtggccctcgatagcgtagcg

SEQ ID NO: 572853 - DNA, 25 bp, Rattus norvegicus
tcgctccccgtgttaatggaaatac

SEQ ID NO: 572854 - DNA, 25 bp, Rattus norvegicus
tgaacttcggtacagcttcgctccc

SEQ ID NO: 572855 - DNA, 25 bp, Rattus norvegicus
gctgtgtttgctctgaacttcggta

SEQ ID NO: 572856 - DNA, 25 bp, Rattus norvegicus
tgcagtagctgtgtttgctctgaac

SEQ ID NO: 572857 - DNA, 25 bp, Rattus norvegicus
cctctgctggatggtgcagtagctg

SEQ ID NO: 572858 - DNA, 25 bp, Rattus norvegicus
tgcagcgtcgcctctgctggatggt

SEQ ID NO: 572859 - DNA, 25 bp, Rattus norvegicus
gccattctgaaacgcctgcgcagtg

SEQ ID NO: 572860 - DNA, 25 bp, Rattus norvegicus
agtcaccgccattctgaaacgcctg

SEQ ID NO: 572861 - DNA, 25 bp, Rattus norvegicus
tacttacaaagtacagtggccctcg

SEQ ID NO: 572862 - DNA, 25 bp, Rattus norvegicus
actcctgaccgacttagtgggctaa

SEQ ID NO: 572863 - DNA, 25 bp, Rattus norvegicus
ttagtgggctaagtcaccgccattc

SEQ ID NO: 572864 - DNA, 25 bp, Rattus norvegicus
atagcgtagcgcagggccgtccatc

SEQ ID NO: 572865 - DNA, 25 bp, Rattus norvegicus
cccgggactccctagagttgcgatt

SEQ ID NO: 572866 - DNA, 25 bp, Rattus norvegicus
gataacgccgcctgtctccaatgga

SEQ ID NO: 572867 - DNA, 25 bp, Rattus norvegicus
tcatatatacctttcgcggccggcg

SEQ ID NO: 572868 - DNA, 25 bp, Rattus norvegicus
ccctttgttgatacagtagtccgaa

SEQ ID NO: 572869 - DNA, 25 bp, Rattus norvegicus
tgctcatccatcagccggacgaaga

SEQ ID NO: 572870 - DNA, 25 bp, Rattus norvegicus
cggcgcattaatgacattccgggtg

SEQ ID NO: 572871 - DNA, 25 bp, Rattus norvegicus
cgaggcgttgttgaagataaagcta

SEQ ID NO: 572872 - DNA, 25 bp, Rattus norvegicus
catctgtttccctggcgcgggccaa

SEQ ID NO: 572873 - DNA, 25 bp, Rattus norvegicus
gggcaagcgtcccagacagaaaccc

SEQ ID NO: 572874 - DNA, 25 bp, Rattus norvegicus
gagttgcgattcttcccaaaatata

SEQ ID NO: 572875 - DNA, 25 bp, Rattus norvegicus
gtagtccgaaaaagtgctaatgttc

SEQ ID NO: 572876 - DNA, 25 bp, Rattus norvegicus
tgctttctcgccaattattgccgcg

SEQ ID NO: 572877 - DNA, 25 bp, Rattus norvegicus
tctcggccctctgtttgctttctcg

SEQ ID NO: 572878 - DNA, 25 bp, Rattus norvegicus
cattccgggtgatagttgcagctta

SEQ ID NO: 572879 - DNA, 25 bp, Rattus norvegicus
tcatcacgcaaacgggcgggtaggt

SEQ ID NO: 572880 - DNA, 25 bp, Rattus norvegicus
agtagggagccacgaggatttcatc

SEQ ID NO: 572881 - DNA, 25 bp, Rattus norvegicus
ggagccacgaggatttcatcacgca

SEQ ID NO: 572882 - DNA, 25 bp, Rattus norvegicus
gccacgaggatttcatcacgcaaac

SEQ ID NO: 572883 - DNA, 25 bp, Rattus norvegicus
cctatactggggctgggaatgcctg

SEQ ID NO: 572884 - DNA, 25 bp, Rattus norvegicus
gaatgcctggttcccggaggccagc

SEQ ID NO: 572885 - DNA, 25 bp, Rattus norvegicus
atttcatcacgcaaacgggcgggta

SEQ ID NO: 572886 - DNA, 25 bp, Rattus norvegicus
caaacgggcgggtaggtttcatcag

SEQ ID NO: 572887 - DNA, 25 bp, Rattus norvegicus
cgggtaggtttcatcagcgcctata

SEQ ID NO: 572888 - DNA, 25 bp, Rattus norvegicus
gtaggtttcatcagcgcctatactg

SEQ ID NO: 572889 - DNA, 25 bp, Rattus norvegicus
ttcatcagcgcctatactggggctg

SEQ ID NO: 572890 - DNA, 25 bp, Rattus norvegicus
tcagcgcctatactggggctgggaa

SEQ ID NO: 572891 - DNA, 25 bp, Rattus norvegicus
cccacccgcgccaactcagcttcct

SEQ ID NO: 572892 - DNA, 25 bp, Rattus norvegicus
cgaggatttcatcacgcaaacgggc

SEQ ID NO: 572893 - DNA, 25 bp, Rattus norvegicus
cgtcgccgagggctacgcggcgagt

SEQ ID NO: 572894 - DNA, 25 bp, Rattus norvegicus
ccgccgacatgtctcctgcacgccg

SEQ ID NO: 572895 - DNA, 25 bp, Rattus norvegicus
tcggcccagcccttctcgtgcccgt

SEQ ID NO: 572896 - DNA, 25 bp, Rattus norvegicus
ggctgcaactgctgcccgccgacat

SEQ ID NO: 572897 - DNA, 25 bp, Rattus norvegicus
gagtctggctgcaactgctgcccgc

SEQ ID NO: 572898 - DNA, 25 bp, Rattus norvegicus
gggagtctggctgcaactgctgccc

SEQ ID NO: 572899 - DNA, 25 bp, Rattus norvegicus
ctacgcggcgagtggggatagcccg

SEQ ID NO: 572900 - DNA, 25 bp, Rattus norvegicus
ctacctcccggggtggtgctgaaga

SEQ ID NO: 572901 - DNA, 25 bp, Rattus norvegicus
cggatcccggcgtagcctccagccc

SEQ ID NO: 572902 - DNA, 25 bp, Rattus norvegicus
gagactccggatcccggcgtagcct

SEQ ID NO: 572903 - DNA, 25 bp, Rattus norvegicus
agtgagactccggatcccggcgtag

SEQ ID NO: 572904 - DNA, 25 bp, Rattus norvegicus
tcgcaagtgagactccggatcccgg

SEQ ID NO: 572905 - DNA, 25 bp, Rattus norvegicus
tgtccagctaccgaacccccgtatg

SEQ ID NO: 572906 - DNA, 25 bp, Rattus norvegicus
cccgtcgcaagtgagactccggatc

SEQ ID NO: 572907 - DNA, 25 bp, Rattus norvegicus
cttccgtcgtcttctgtgcagctac

SEQ ID NO: 572908 - DNA, 25 bp, Rattus norvegicus
ccctccttgtgatgctcttcgtcta

SEQ ID NO: 572909 - DNA, 25 bp, Rattus norvegicus
cgcacgccgagactacagaccataa

SEQ ID NO: 572910 - DNA, 25 bp, Rattus norvegicus
tccctagttcccagcggagttttca

SEQ ID NO: 572911 - DNA, 25 bp, Rattus norvegicus
cgtctatgctcgagtgttcgtcgta

SEQ ID NO: 572912 - DNA, 25 bp, Rattus norvegicus
ccctgaactggttgggctatgccaa

SEQ ID NO: 572913 - DNA, 25 bp, Rattus norvegicus
gtgtcactccaatccgcgctgctgt

SEQ ID NO: 572914 - DNA, 25 bp, Rattus norvegicus
acgctgaggcgcaagagtgtcactc

SEQ ID NO: 572915 - DNA, 25 bp, Rattus norvegicus
ttgcgcccatcatgagccagtggtg

SEQ ID NO: 572916 - DNA, 25 bp, Rattus norvegicus
ggacgtgctctgtgtaactgccagc

SEQ ID NO: 572917 - DNA, 25 bp, Rattus norvegicus
tgggactcctcgtaatgccaccagg

SEQ ID NO: 572918 - DNA, 25 bp, Rattus norvegicus
acagctgacttggtagtgggactcc

SEQ ID NO: 572919 - DNA, 25 bp, Rattus norvegicus
aacgtgttcgtgacttcgctggcca

SEQ ID NO: 572920 - DNA, 25 bp, Rattus norvegicus
cctgcgcaccttgggtctcattatg

SEQ ID NO: 572921 - DNA, 25 bp, Rattus norvegicus
gtgtggccggaagccttaaagctgc

SEQ ID NO: 572922 - DNA, 25 bp, Rattus norvegicus
ccgtgtggcgcgaggaagccacctt

SEQ ID NO: 572923 - DNA, 25 bp, Rattus norvegicus
tgacggtgctacaggcacgaggcct

SEQ ID NO: 572924 - DNA, 25 bp, Rattus norvegicus
tgggcaaggagaagtacgccacgtc

SEQ ID NO: 572925 - DNA, 25 bp, Rattus norvegicus
ccagaccgagagcagcggctaccta

SEQ ID NO: 572926 - DNA, 25 bp, Rattus norvegicus
tacgccacgtcggtgtccgagcgca

SEQ ID NO: 572927 - DNA, 25 bp, Rattus norvegicus
cctctctgctcgaaaaacatcttca

SEQ ID NO: 572928 - DNA, 25 bp, Rattus norvegicus
gtgcgtccttacctctctgctcgaa

SEQ ID NO: 572929 - DNA, 25 bp, Rattus norvegicus
cagctgaggaccactgagtgcgtcc

SEQ ID NO: 572930 - DNA, 25 bp, Rattus norvegicus
gagggaggcctttgctcccacctcg

SEQ ID NO: 572931 - DNA, 25 bp, Rattus norvegicus
caccgggaccagagccgcaggaaga

SEQ ID NO: 572932 - DNA, 25 bp, Rattus norvegicus
cgataagttcctgggtcgcgccgaa

SEQ ID NO: 572933 - DNA, 25 bp, Rattus norvegicus
gcgctgctcggtctcgataagttcc

SEQ ID NO: 572934 - DNA, 25 bp, Rattus norvegicus
cgcacgtacaggtgacggtgctaca

SEQ ID NO: 572935 - DNA, 25 bp, Rattus norvegicus
tacagtggcgcgcttcgcccgggac

SEQ ID NO: 572936 - DNA, 25 bp, Rattus norvegicus
atcagggacttagccgggttccgag

SEQ ID NO: 572937 - DNA, 25 bp, Rattus norvegicus
gccgctctgtccagaagccgaggtg

SEQ ID NO: 572938 - DNA, 25 bp, Rattus norvegicus
agccgaggtgaggtctttctctcca

SEQ ID NO: 572939 - DNA, 25 bp, Rattus norvegicus
gaggtctttctctccagaatccaag

SEQ ID NO: 572940 - DNA, 25 bp, Rattus norvegicus
cgaggacgcgtctccaagccgtgct

SEQ ID NO: 572941 - DNA, 25 bp, Rattus norvegicus
cgcttcgcccgggacggatggatca

SEQ ID NO: 572942 - DNA, 25 bp, Rattus norvegicus
agcgccacggcctcgcgggtgtctt

SEQ ID NO: 572943 - DNA, 25 bp, Rattus norvegicus
ggacgcgtcgtctcccatgcagcac

SEQ ID NO: 572944 - DNA, 25 bp, Rattus norvegicus
cctgaagaggcccagcaactttgcc

SEQ ID NO: 572945 - DNA, 25 bp, Rattus norvegicus
agcaactttgccagcgggaagcgcc

SEQ ID NO: 572946 - DNA, 25 bp, Rattus norvegicus
gggcgcccaacttgcaggctccagt

SEQ ID NO: 572947 - DNA, 25 bp, Rattus norvegicus
cagaatccaagcagggccaggactc

SEQ ID NO: 572948 - DNA, 25 bp, Rattus norvegicus
ggttccgagccgctctgtccagaag

SEQ ID NO: 572949 - DNA, 25 bp, Rattus norvegicus
tcgcattattcgcagagccagctgg

SEQ ID NO: 572950 - DNA, 25 bp, Rattus norvegicus
gatgcatccggaataagcgtccctc

SEQ ID NO: 572951 - DNA, 25 bp, Rattus norvegicus
tctacccgagtccacagaacggatc

SEQ ID NO: 572952 - DNA, 25 bp, Rattus norvegicus
gggcggagcaaactgccagtcgatt

SEQ ID NO: 572953 - DNA, 25 bp, Rattus norvegicus
cagtcgattggccagctgaccggaa

SEQ ID NO: 572954 - DNA, 25 bp, Rattus norvegicus
ctgaccggaagaggaagatgcatcc

SEQ ID NO: 572955 - DNA, 25 bp, Rattus norvegicus
taagcgtccctccactgtactactg

SEQ ID NO: 572956 - DNA, 25 bp, Rattus norvegicus
actgctgaccagttataagttctta

SEQ ID NO: 572957 - DNA, 25 bp, Rattus norvegicus
tgtctggccgtactgcggcacttta

SEQ ID NO: 572958 - DNA, 25 bp, Rattus norvegicus
gcggcactttacaaacggcgagatg

SEQ ID NO: 572959 - DNA, 25 bp, Rattus norvegicus
agctggtggaagattcgcattattc

SEQ ID NO: 572960 - DNA, 25 bp, Rattus norvegicus
cagagccagctggtgtgctccgact

SEQ ID NO: 572961 - DNA, 25 bp, Rattus norvegicus
tgcgtggtcaccgaaggggtcctta

SEQ ID NO: 572962 - DNA, 25 bp, Rattus norvegicus
gctcctctgagctggtggaagattc

SEQ ID NO: 572963 - DNA, 25 bp, Rattus norvegicus
gcgccattaagactggtggtgttga

SEQ ID NO: 572964 - DNA, 25 bp, Rattus norvegicus
gcgcccatgatgcaggttgttatga

SEQ ID NO: 572965 - DNA, 25 bp, Rattus norvegicus
gcgcaatgccttgagcctgctctta

SEQ ID NO: 572966 - DNA, 25 bp, Rattus norvegicus
aagctgccgctctcactggacaaca

SEQ ID NO: 572967 - DNA, 25 bp, Rattus norvegicus
agcataggctcaccctcgagtggaa

SEQ ID NO: 572968 - DNA, 25 bp, Rattus norvegicus
cctccgacggcgtaagcataggctc

SEQ ID NO: 572969 - DNA, 25 bp, Rattus norvegicus
gctaccgctgcccttgaggttgtca

SEQ ID NO: 572970 - DNA, 25 bp, Rattus norvegicus
atggcctctgcaccagttacactgg

SEQ ID NO: 572971 - DNA, 25 bp, Rattus norvegicus
ggtcttcatgcaacctcccgctatg

SEQ ID NO: 572972 - DNA, 25 bp, Rattus norvegicus
ctgtggtctcgcttttccagaggcc

SEQ ID NO: 572973 - DNA, 25 bp, Rattus norvegicus
aaatctggccctagactgtggtctc

SEQ ID NO: 572974 - DNA, 25 bp, Rattus norvegicus
tacgtatcagtagacggctcggacc

SEQ ID NO: 572975 - DNA, 25 bp, Rattus norvegicus
gccgctttaaacctacatacgtatc

SEQ ID NO: 572976 - DNA, 25 bp, Rattus norvegicus
tctcaggaatctgtgcggcgcttgt

SEQ ID NO: 572977 - DNA, 25 bp, Rattus norvegicus
caccctccttcgagccgggttgtgg

SEQ ID NO: 572978 - DNA, 25 bp, Rattus norvegicus
tgtgggcgccgccacttagtccctt

SEQ ID NO: 572979 - DNA, 25 bp, Rattus norvegicus
cgagaggagtgctcagcgggagccc

SEQ ID NO: 572980 - DNA, 25 bp, Rattus norvegicus
gccacttagtcccttgggccgctcc

SEQ ID NO: 572981 - DNA, 25 bp, Rattus norvegicus
cccagagcacttgcaaccgcggata

SEQ ID NO: 572982 - DNA, 25 bp, Rattus norvegicus
cagagcacttgcaaccgcggatagg

SEQ ID NO: 572983 - DNA, 25 bp, Rattus norvegicus
gagcacttgcaaccgcggataggga

SEQ ID NO: 572984 - DNA, 25 bp, Rattus norvegicus
acttgcaaccgcggatagggaccgg

SEQ ID NO: 572985 - DNA, 25 bp, Rattus norvegicus
atagggaccgggcagccaggcgcac

SEQ ID NO: 572986 - DNA, 25 bp, Rattus norvegicus
agcagcagcaagcgcgcagaccgca

SEQ ID NO: 572987 - DNA, 25 bp, Rattus norvegicus
tcgccccgcggggacctacagcgta

SEQ ID NO: 572988 - DNA, 25 bp, Rattus norvegicus
acccgagcgtgcgagaggagtgctc

SEQ ID NO: 572989 - DNA, 25 bp, Rattus norvegicus
ccaccggccgcacaccaccctcctt

SEQ ID NO: 572990 - DNA, 25 bp, Rattus norvegicus
tgggcgccgccacttagtcccttgg

SEQ ID NO: 572991 - DNA, 25 bp, Rattus norvegicus
tggacatggccctccgaggtctcta

SEQ ID NO: 572992 - DNA, 25 bp, Rattus norvegicus
cgtgacacctggacccacgcaggtg

SEQ ID NO: 572993 - DNA, 25 bp, Rattus norvegicus
ttctgcgtcaccgtgacacctggac

SEQ ID NO: 572994 - DNA, 25 bp, Rattus norvegicus
gatcctcaaggccagatcgccgagc

SEQ ID NO: 572995 - DNA, 25 bp, Rattus norvegicus
agtcctgatcctcaaggccagatcg

SEQ ID NO: 572996 - DNA, 25 bp, Rattus norvegicus
caagctaccctccaggaagtcctga

SEQ ID NO: 572997 - DNA, 25 bp, Rattus norvegicus
agtgagcacctttctccaaccaagc

SEQ ID NO: 572998 - DNA, 25 bp, Rattus norvegicus
acatggacacgagtgagcacctttc

SEQ ID NO: 572999 - DNA, 25 bp, Rattus norvegicus
tggcgagacacatggacacgagtga

SEQ ID NO: 573000 - DNA, 25 bp, Rattus norvegicus
cgggcaatgacgcatggcgagacac

SEQ ID NO: 573001 - DNA, 25 bp, Rattus norvegicus
gccctccgaggtctctagtaccgtg

SEQ ID NO: 573002 - DNA, 25 bp, Rattus norvegicus
acgctctgctggacgcgctcgttca

SEQ ID NO: 573003 - DNA, 25 bp, Rattus norvegicus
aacgcacgtgatcgcgggtggacat

SEQ ID NO: 573004 - DNA, 25 bp, Rattus norvegicus
ctagtaccgtggtgacgggcaatga

SEQ ID NO: 573005 - DNA, 25 bp, Rattus norvegicus
taggcgctccgtacacgtctgatcc

SEQ ID NO: 573006 - DNA, 25 bp, Rattus norvegicus
gggtacggattccacttctcagatc

SEQ ID NO: 573007 - DNA, 25 bp, Rattus norvegicus
agcggccttcagctaccgagcagca

SEQ ID NO: 573008 - DNA, 25 bp, Rattus norvegicus
ctcgcgctacgagcggtagtgtttg

SEQ ID NO: 573009 - DNA, 25 bp, Rattus norvegicus
gatgacgccatcagtccgcgcaaga

SEQ ID NO: 573010 - DNA, 25 bp, Rattus norvegicus
ttccaggccagtcgctccgatgacg

SEQ ID NO: 573011 - DNA, 25 bp, Rattus norvegicus
agcttccgctcagacccgcttaagg

SEQ ID NO: 573012 - DNA, 25 bp, Rattus norvegicus
ctcagcgaggccgaacgtgcactga

SEQ ID NO: 573013 - DNA, 25 bp, Rattus norvegicus
ggactggacagacaggggttctttc

SEQ ID NO: 573014 - DNA, 25 bp, Rattus norvegicus
tcctccgcgaggcaacacgtctaag

SEQ ID NO: 573015 - DNA, 25 bp, Rattus norvegicus
gtcctctctgcaaatgtcctcacta

SEQ ID NO: 573016 - DNA, 25 bp, Rattus norvegicus
ccgagcagcagtagtgtcctctctg

SEQ ID NO: 573017 - DNA, 25 bp, Rattus norvegicus
gtaccaggctgtccctctaggcgct

SEQ ID NO: 573018 - DNA, 25 bp, Rattus norvegicus
gagctctggagctcagcacgtcagc

SEQ ID NO: 573019 - DNA, 25 bp, Rattus norvegicus
cacacacgcccttctcagtcaaaga

SEQ ID NO: 573020 - DNA, 25 bp, Rattus norvegicus
atccgcgagcctacggtgaccctga

SEQ ID NO: 573021 - DNA, 25 bp, Rattus norvegicus
aactgcccgtcgctcctgtcatcga

SEQ ID NO: 573022 - DNA, 25 bp, Rattus norvegicus
ctggcccaatggcaggctgaatccc

SEQ ID NO: 573023 - DNA, 25 bp, Rattus norvegicus
tgctgcgcgccacatccagggcaga

SEQ ID NO: 573024 - DNA, 25 bp, Rattus norvegicus
cgcgccacatccagggcagagaggc

SEQ ID NO: 573025 - DNA, 25 bp, Rattus norvegicus
ccacctggcgctgtgagaccggcgt

SEQ ID NO: 573026 - DNA, 25 bp, Rattus norvegicus
tgagaccggcgtcgccaccatgttc

SEQ ID NO: 573027 - DNA, 25 bp, Rattus norvegicus
gtcaaagacatcctgaacctggagc

SEQ ID NO: 573028 - DNA, 25 bp, Rattus norvegicus
catgctggccgccttcaagccggag

SEQ ID NO: 573029 - DNA, 25 bp, Rattus norvegicus
cttcaagccggaggcctactcaggc

SEQ ID NO: 573030 - DNA, 25 bp, Rattus norvegicus
cccaagtgctctcctgctttcccaa

SEQ ID NO: 573031 - DNA, 25 bp, Rattus norvegicus
ctggggacctgtctgcgcgcctcga

SEQ ID NO: 573032 - DNA, 25 bp, Rattus norvegicus
cctacattttatccgcgagcctacg

SEQ ID NO: 573033 - DNA, 25 bp, Rattus norvegicus
ataggagacccaccaagtgcgcagg

SEQ ID NO: 573034 - DNA, 25 bp, Rattus norvegicus
gatcgcgagtgcctggttttctgca

SEQ ID NO: 573035 - DNA, 25 bp, Rattus norvegicus
ccttctaaaggcagagccgcagttg

SEQ ID NO: 573036 - DNA, 25 bp, Rattus norvegicus
ctgtaatcggggtggtgattctccc

SEQ ID NO: 573037 - DNA, 25 bp, Rattus norvegicus
cggccctcccagataaagatgactt

SEQ ID NO: 573038 - DNA, 25 bp, Rattus norvegicus
ggcgcgcaggagaaacgactcaaca

SEQ ID NO: 573039 - DNA, 25 bp, Rattus norvegicus
agggcttgaagctggacttgtcctc

SEQ ID NO: 573040 - DNA, 25 bp, Rattus norvegicus
gtctttctcggatcccagcccgttg

SEQ ID NO: 573041 - DNA, 25 bp, Rattus norvegicus
tctttggacaggactctaaggggcc

SEQ ID NO: 573042 - DNA, 25 bp, Rattus norvegicus
ggcctagagaagagggtcacccaaa

SEQ ID NO: 573043 - DNA, 25 bp, Rattus norvegicus
cactagccttgtgggttagtccctg

SEQ ID NO: 573044 - DNA, 25 bp, Rattus norvegicus
tccagccctatagaaaacatgcagc

SEQ ID NO: 573045 - DNA, 25 bp, Rattus norvegicus
tctgggcaccacaagagcaaatcca

SEQ ID NO: 573046 - DNA, 25 bp, Rattus norvegicus
ctggcttccaagagaacagatcggg

SEQ ID NO: 573047 - DNA, 25 bp, Rattus norvegicus
tacgaatacgtaatgttcaaccaac

SEQ ID NO: 573048 - DNA, 25 bp, Rattus norvegicus
tgttcaaccaacaggccgtggcttc

SEQ ID NO: 573049 - DNA, 25 bp, Rattus norvegicus
tactcaattgtacgaatacgtaatg

SEQ ID NO: 573050 - DNA, 25 bp, Rattus norvegicus
gttcagagacccaattactcaattg

SEQ ID NO: 573051 - DNA, 25 bp, Rattus norvegicus
ctgtttacgttcagagacccaatta

SEQ ID NO: 573052 - DNA, 25 bp, Rattus norvegicus
atgacctgtttacgttcagagaccc

SEQ ID NO: 573053 - DNA, 25 bp, Rattus norvegicus
tggcgttcacaggatgacctgttta

SEQ ID NO: 573054 - DNA, 25 bp, Rattus norvegicus
ttacgccttggcgttcacaggatga

SEQ ID NO: 573055 - DNA, 25 bp, Rattus norvegicus
aaccaacaggccgtggcttcccgtg

SEQ ID NO: 573056 - DNA, 25 bp, Rattus norvegicus
tgagacttcatcaaaggtccggtgg

SEQ ID NO: 573057 - DNA, 25 bp, Rattus norvegicus
cgtgatctgattaagatgagacttc

SEQ ID NO: 573058 - DNA, 25 bp, Rattus norvegicus
ttggccaacaatccgtgatctgatt

SEQ ID NO: 573059 - DNA, 25 bp, Rattus norvegicus
gcgctctacggattggccaacaatc

SEQ ID NO: 573060 - DNA, 25 bp, Rattus norvegicus
ctgtgcgctctacggattggccaac

SEQ ID NO: 573061 - DNA, 25 bp, Rattus norvegicus
taggcggaacaggactgcaccatcc

SEQ ID NO: 573062 - DNA, 25 bp, Rattus norvegicus
tcccagggaagctgaccattggtta

SEQ ID NO: 573063 - DNA, 25 bp, Rattus norvegicus
tctgattagccgaaggtaacgttcc

SEQ ID NO: 573064 - DNA, 25 bp, Rattus norvegicus
agttcgctcgcaggctctgattagc

SEQ ID NO: 573065 - DNA, 25 bp, Rattus norvegicus
tcacctctcgcgaggagttcgctcg

SEQ ID NO: 573066 - DNA, 25 bp, Rattus norvegicus
tggcggaggcagcttcaacctcacc

SEQ ID NO: 573067 - DNA, 25 bp, Rattus norvegicus
tgtcgctcgtctcccatcttcaaga

SEQ ID NO: 573068 - DNA, 25 bp, Rattus norvegicus
gcgtccatcgcttgctcgccagaaa

SEQ ID NO: 573069 - DNA, 25 bp, Rattus norvegicus
ggctttgatacggtcgccgctttcg

SEQ ID NO: 573070 - DNA, 25 bp, Rattus norvegicus
tatcgtaccggttcttgcagccgta

SEQ ID NO: 573071 - DNA, 25 bp, Rattus norvegicus
gagacgggcttgtccttatcgtacc

SEQ ID NO: 573072 - DNA, 25 bp, Rattus norvegicus
tacctacttgtggaaggagacgggc

SEQ ID NO: 573073 - DNA, 25 bp, Rattus norvegicus
gcggagcacgccagttacctacttg

SEQ ID NO: 573074 - DNA, 25 bp, Rattus norvegicus
cagttatggggacgattacctcacc

SEQ ID NO: 573075 - DNA, 25 bp, Rattus norvegicus
gccgactggagagaaacacgggcca

SEQ ID NO: 573076 - DNA, 25 bp, Rattus norvegicus
gaatagagttcatttccggggacta

SEQ ID NO: 573077 - DNA, 25 bp, Rattus norvegicus
cggtgcaactacaggcggcttctaa

SEQ ID NO: 573078 - DNA, 25 bp, Rattus norvegicus
ctagctactactcccggtgcaacta

SEQ ID NO: 573079 - DNA, 25 bp, Rattus norvegicus
tacaggcggcttctaaagcgagagc

SEQ ID NO: 573080 - DNA, 25 bp, Rattus norvegicus
ccgtgccagtccgtgtgacagaata

SEQ ID NO: 573081 - DNA, 25 bp, Rattus norvegicus
cggcagaggaactaccgtgccagtc

SEQ ID NO: 573082 - DNA, 25 bp, Rattus norvegicus
cgcgtacctcgtcgcggcagaggaa

SEQ ID NO: 573083 - DNA, 25 bp, Rattus norvegicus
tgagcctaggcttccggaggcaagc

SEQ ID NO: 573084 - DNA, 25 bp, Rattus norvegicus
gttccaccttcgtccagagactctg

SEQ ID NO: 573085 - DNA, 25 bp, Rattus norvegicus
tccggggactacctagctactactc

SEQ ID NO: 573086 - DNA, 25 bp, Rattus norvegicus
agaaacacgggccaccaccgcagag

SEQ ID NO: 573087 - DNA, 25 bp, Rattus norvegicus
cgattcagggctgagcctaggcttc

SEQ ID NO: 573088 - DNA, 25 bp, Rattus norvegicus
tccgtgtgacagaatagagttcatt

SEQ ID NO: 573089 - DNA, 25 bp, Rattus norvegicus
ggaagcagcggcgtcccctatggac

SEQ ID NO: 573090 - DNA, 25 bp, Rattus norvegicus
cgaagctagggtgcggtgacacttc

SEQ ID NO: 573091 - DNA, 25 bp, Rattus norvegicus
gtgcggtgacacttccgtggtcccg

SEQ ID NO: 573092 - DNA, 25 bp, Rattus norvegicus
ctcttccgaagctagggtgcggtga

SEQ ID NO: 573093 - DNA, 25 bp, Rattus norvegicus
ccctatggacgacgggtttctgagc

SEQ ID NO: 573094 - DNA, 25 bp, Rattus norvegicus
ggtttctgagcctggactcgcccac

SEQ ID NO: 573095 - DNA, 25 bp, Rattus norvegicus
agctgtgctgccgaggctgagatgc

SEQ ID NO: 573096 - DNA, 25 bp, Rattus norvegicus
ctgtggcggcgctcttccgaagcta

SEQ ID NO: 573097 - DNA, 25 bp, Rattus norvegicus
ctgagatgcgagcgacgccgcagcc

SEQ ID NO: 573098 - DNA, 25 bp, Rattus norvegicus
tgagcctggactcgcccacctatgt

SEQ ID NO: 573099 - DNA, 25 bp, Rattus norvegicus
ttgtacaggtaacgccctcctgcgg

SEQ ID NO: 573100 - DNA, 25 bp, Rattus norvegicus
tatgtcttgtacaggtaacgccctc

SEQ ID NO: 573101 - DNA, 25 bp, Rattus norvegicus
cgcccacctatgtcttgtacaggta

SEQ ID NO: 573102 - DNA, 25 bp, Rattus norvegicus
tggactcgcccacctatgtcttgta

SEQ ID NO: 573103 - DNA, 25 bp, Rattus norvegicus
cggtgtcagcgtgtctaatccaacc

SEQ ID NO: 573104 - DNA, 25 bp, Rattus norvegicus
cggtgtcagcgctgtctaatccaac

SEQ ID NO: 573105 - DNA, 25 bp, Rattus norvegicus
tcggtgtcagcgtgtctaatccaac

SEQ ID NO: 573106 - DNA, 25 bp, Rattus norvegicus
gtcggtgtcagcgtgtctaatccaa

SEQ ID NO: 573107 - DNA, 25 bp, Rattus norvegicus
gtgtccgcgctgtctaatccaacca

SEQ ID NO: 573108 - DNA, 25 bp, Rattus norvegicus
gtgtccgcgtgtctaatccaaccag

SEQ ID NO: 573109 - DNA, 25 bp, Rattus norvegicus
aaccagcaggcttgtcagtgtccgc

SEQ ID NO: 573110 - DNA, 25 bp, Rattus norvegicus
agtgtccgcgctgtctaatccaacc

SEQ ID NO: 573111 - DNA, 25 bp, Rattus norvegicus
tgtcagcgtgtctaatccaaccagc

SEQ ID NO: 573112 - DNA, 25 bp, Rattus norvegicus
ctcgtcggtgtcagcgctgtctaat

SEQ ID NO: 573113 - DNA, 25 bp, Rattus norvegicus
tgtctaatccaaccagcaggcttgt

SEQ ID NO: 573114 - DNA, 25 bp, Rattus norvegicus
gtgtcagcgtgtctaatccaaccag

SEQ ID NO: 573115 - DNA, 25 bp, Rattus norvegicus
gtgtcagcgctgtctaatccaacca

SEQ ID NO: 573116 - DNA, 25 bp, Rattus norvegicus
gacttttcggtgtcagcgctgtcta

SEQ ID NO: 573117 - DNA, 25 bp, Rattus norvegicus
cttctccgggtgttcatcgtgcaac

SEQ ID NO: 573118 - DNA, 25 bp, Rattus norvegicus
agggcagcctaacgctcgcctccga

SEQ ID NO: 573119 - DNA, 25 bp, Rattus norvegicus
atgcgagccggatttggtggtctcc

SEQ ID NO: 573120 - DNA, 25 bp, Rattus norvegicus
atttggtggtctccaggtaggctcc

SEQ ID NO: 573121 - DNA, 25 bp, Rattus norvegicus
ccagagtgggctctcatggggctca

SEQ ID NO: 573122 - DNA, 25 bp, Rattus norvegicus
ctagacttggaaactggtgctggca

SEQ ID NO: 573123 - DNA, 25 bp, Rattus norvegicus
tccgggtgttcatcgtgcaactccc

SEQ ID NO: 573124 - DNA, 25 bp, Rattus norvegicus
ggtgcacacccgctcagggtgctta

SEQ ID NO: 573125 - DNA, 25 bp, Rattus norvegicus
tcagggtgcttaccgtgcaccgggc

SEQ ID NO: 573126 - DNA, 25 bp, Rattus norvegicus
gcaccgggcgctgctactgaactgt

SEQ ID NO: 573127 - DNA, 25 bp, Rattus norvegicus
ctactgaactgtgtgagcgagcgga

SEQ ID NO: 573128 - DNA, 25 bp, Rattus norvegicus
agcgagcggagactgcccgccatgc

SEQ ID NO: 573129 - DNA, 25 bp, Rattus norvegicus
ctctccgggtgcgtacggtgcacac

SEQ ID NO: 573130 - DNA, 25 bp, Rattus norvegicus
ggctcagctgggactagacttggaa

SEQ ID NO: 573131 - DNA, 25 bp, Rattus norvegicus
gtctgcctcgatcatctcttcatct

SEQ ID NO: 573132 - DNA, 25 bp, Rattus norvegicus
cggcctggcacctgttgctgtacct

SEQ ID NO: 573133 - DNA, 25 bp, Rattus norvegicus
gcgcactgcgttccacggtatcatc

SEQ ID NO: 573134 - DNA, 25 bp, Rattus norvegicus
agtgagtgtccctgcgcactgcgtt

SEQ ID NO: 573135 - DNA, 25 bp, Rattus norvegicus
agccgtgaagagagtgagtgtccct

SEQ ID NO: 573136 - DNA, 25 bp, Rattus norvegicus
gaagtcaggcagctgaagctcgttg

SEQ ID NO: 573137 - DNA, 25 bp, Rattus norvegicus
tgagaaactgctcgcgctggttgtc

SEQ ID NO: 573138 - DNA, 25 bp, Rattus norvegicus
ttacttcagaatggggcggatgaga

SEQ ID NO: 573139 - DNA, 25 bp, Rattus norvegicus
agctactgaggaccctcggcgctgc

SEQ ID NO: 573140 - DNA, 25 bp, Rattus norvegicus
tggtcctctacgtctgcctcgatca

SEQ ID NO: 573141 - DNA, 25 bp, Rattus norvegicus
cttctcaggcaacgcggtttgtggc

SEQ ID NO: 573142 - DNA, 25 bp, Rattus norvegicus
gttgctgtacctgggcttctcaggc

SEQ ID NO: 573143 - DNA, 25 bp, Rattus norvegicus
ctgccctccgggttacttcagaatg

SEQ ID NO: 573144 - DNA, 25 bp, Rattus norvegicus
catccctggaagagcggcctggcac

SEQ ID NO: 573145 - DNA, 25 bp, Rattus norvegicus
ggtcaggagctatgacgccacccga

SEQ ID NO: 573146 - DNA, 25 bp, Rattus norvegicus
tcaggagctatgacgccacccgagc

SEQ ID NO: 573147 - DNA, 25 bp, Rattus norvegicus
caggagctatgacgccacccgagcg

SEQ ID NO: 573148 - DNA, 25 bp, Rattus norvegicus
agctatgacgccacccgagcgggca

SEQ ID NO: 573149 - DNA, 25 bp, Rattus norvegicus
gacgccacccgagcgggcaatgacg

SEQ ID NO: 573150 - DNA, 25 bp, Rattus norvegicus
ccacgctggggtagaccgcagtgcc

SEQ ID NO: 573151 - DNA, 25 bp, Rattus norvegicus
aatgacgggcgggtcgaactcgcgc

SEQ ID NO: 573152 - DNA, 25 bp, Rattus norvegicus
gcgggtcgaactcgcgcaggcgccg

SEQ ID NO: 573153 - DNA, 25 bp, Rattus norvegicus
gtgctgagcgccacgctgctggccc

SEQ ID NO: 573154 - DNA, 25 bp, Rattus norvegicus
ctcggtcctcgggacgcaggacttg

SEQ ID NO: 573155 - DNA, 25 bp, Rattus norvegicus
tcctcgggacgcaggacttgagcgc

SEQ ID NO: 573156 - DNA, 25 bp, Rattus norvegicus
cggctccacgctggggtagaccgca

SEQ ID NO: 573157 - DNA, 25 bp, Rattus norvegicus
gtagaccgcagtgccggcgtcgcgg

SEQ ID NO: 573158 - DNA, 25 bp, Rattus norvegicus
atgacgccacccgagcgggcaatga

SEQ ID NO: 573159 - DNA, 25 bp, Rattus norvegicus
ctcgcttccagcagcgacagtatga

SEQ ID NO: 573160 - DNA, 25 bp, Rattus norvegicus
ttctgcagcccacgagagcgcgcga

SEQ ID NO: 573161 - DNA, 25 bp, Rattus norvegicus
gtgcgttgcggcaactcgccgcaca

SEQ ID NO: 573162 - DNA, 25 bp, Rattus norvegicus
cgcaacccagctggaagcttggagg

SEQ ID NO: 573163 - DNA, 25 bp, Rattus norvegicus
ggtcggctccgaacggcacctcaga

SEQ ID NO: 573164 - DNA, 25 bp, Rattus norvegicus
ggtaagacttctgcagcccacgaga

SEQ ID NO: 573165 - DNA, 25 bp, Rattus norvegicus
agaggctgaaagtgggtaagacttc

SEQ ID NO: 573166 - DNA, 25 bp, Rattus norvegicus
acagagaaacggagccggcgaccgc

SEQ ID NO: 573167 - DNA, 25 bp, Rattus norvegicus
gcaagtgccacaacgacagaagaca

SEQ ID NO: 573168 - DNA, 25 bp, Rattus norvegicus
ccaggagcagctgcaagtgccacaa

SEQ ID NO: 573169 - DNA, 25 bp, Rattus norvegicus
cgagagcttgggaagtagcagcaat

SEQ ID NO: 573170 - DNA, 25 bp, Rattus norvegicus
tctcgcgagagcttgggaagtagca

SEQ ID NO: 573171 - DNA, 25 bp, Rattus norvegicus
tcgccgcacagatgtgctctcgcga

SEQ ID NO: 573172 - DNA, 25 bp, Rattus norvegicus
cagaagacagagaaacggagccggc

SEQ ID NO: 573173 - DNA, 25 bp, Rattus norvegicus
aagggaccacggagcctctttctca

SEQ ID NO: 573174 - DNA, 25 bp, Rattus norvegicus
ctgcctgcgatcaacgaagtacctc

SEQ ID NO: 573175 - DNA, 25 bp, Rattus norvegicus
ggactctttcgtgtgcgctccagca

SEQ ID NO: 573176 - DNA, 25 bp, Rattus norvegicus
gcgaagggactgtcactctggactc

SEQ ID NO: 573177 - DNA, 25 bp, Rattus norvegicus
tctcaaggctttgtccgctgcctgc

SEQ ID NO: 573178 - DNA, 25 bp, Rattus norvegicus
ccatcctgggactgtactgagcgcc

SEQ ID NO: 573179 - DNA, 25 bp, Rattus norvegicus
tttctgatgcaggaacgcaggccct

SEQ ID NO: 573180 - DNA, 25 bp, Rattus norvegicus
gtccgagagcatgatcaactttctg

SEQ ID NO: 573181 - DNA, 25 bp, Rattus norvegicus
ttcggcgttttcttcctgggatgta

SEQ ID NO: 573182 - DNA, 25 bp, Rattus norvegicus
gctttctgaaccacagcggcctgga

SEQ ID NO: 573183 - DNA, 25 bp, Rattus norvegicus
gccgggatgaacgtgagctttctga

SEQ ID NO: 573184 - DNA, 25 bp, Rattus norvegicus
cttcctctcctgctggcgcaagggt

SEQ ID NO: 573185 - DNA, 25 bp, Rattus norvegicus
actgttggctctctccagatcgcgc

SEQ ID NO: 573186 - DNA, 25 bp, Rattus norvegicus
tgggcgatagccacgcactgttggc

SEQ ID NO: 573187 - DNA, 25 bp, Rattus norvegicus
tcccgcacaggacaagggtgacacc

SEQ ID NO: 573188 - DNA, 25 bp, Rattus norvegicus
tcccttcagagctgtgcgcgctgca

SEQ ID NO: 573189 - DNA, 25 bp, Rattus norvegicus
gaagccacgcgtgctcttctcgcag

SEQ ID NO: 573190 - DNA, 25 bp, Rattus norvegicus
cgaccaactggccagcgtgctgaag

SEQ ID NO: 573191 - DNA, 25 bp, Rattus norvegicus
gttgcgccaacctcgaaccgtgcga

SEQ ID NO: 573192 - DNA, 25 bp, Rattus norvegicus
ccagaaccgccgctacaagtgtaag

SEQ ID NO: 573193 - DNA, 25 bp, Rattus norvegicus
ggtctcaacgcctacggctacaacg

SEQ ID NO: 573194 - DNA, 25 bp, Rattus norvegicus
cagcggccaacagcaacttcgtgaa

SEQ ID NO: 573195 - DNA, 25 bp, Rattus norvegicus
caacttcgtgaacttcggcgtcggg

SEQ ID NO: 573196 - DNA, 25 bp, Rattus norvegicus
ttgaacacggtgcagagtcccggga

SEQ ID NO: 573197 - DNA, 25 bp, Rattus norvegicus
atgccacagggcaattcgggcgtct

SEQ ID NO: 573198 - DNA, 25 bp, Rattus norvegicus
acctttaggagaagggcgatgactc

SEQ ID NO: 573199 - DNA, 25 bp, Rattus norvegicus
cacggcatccgagcctggtagggaa

SEQ ID NO: 573200 - DNA, 25 bp, Rattus norvegicus
tctcgcaggcgcaggtctatgagct

SEQ ID NO: 573201 - DNA, 25 bp, Rattus norvegicus
cggtgccgggcatatagttcatttt

SEQ ID NO: 573202 - DNA, 25 bp, Rattus norvegicus
tttgagctctcgcaaggctgcactg

SEQ ID NO: 573203 - DNA, 25 bp, Rattus norvegicus
cggtatcgcctgtccatccactgaa

SEQ ID NO: 573204 - DNA, 25 bp, Rattus norvegicus
ttcggtcgcagacaacgttttcttc

SEQ ID NO: 573205 - DNA, 25 bp, Rattus norvegicus
cgttttcttcctttctagtcagtga

SEQ ID NO: 573206 - DNA, 25 bp, Rattus norvegicus
ctagtcgccggaagcgtttcaggta

SEQ ID NO: 573207 - DNA, 25 bp, Rattus norvegicus
ttcctcactcgtgacaagcgctgtc

SEQ ID NO: 573208 - DNA, 25 bp, Rattus norvegicus
gcccgggttgatccgtacagtccat

SEQ ID NO: 573209 - DNA, 25 bp, Rattus norvegicus
agggcggagaataggcgtttcctca

SEQ ID NO: 573210 - DNA, 25 bp, Rattus norvegicus
tagtcagtgaagtgaagtccaggtc

SEQ ID NO: 573211 - DNA, 25 bp, Rattus norvegicus
gtacagtccatgaccgctcggcact

SEQ ID NO: 573212 - DNA, 25 bp, Rattus norvegicus
tcgggattggctgtagccgtcctaa

SEQ ID NO: 573213 - DNA, 25 bp, Rattus norvegicus
gtgacggcccttcgtacggccgcta

SEQ ID NO: 573214 - DNA, 25 bp, Rattus norvegicus
atccactgaaaaaggcgtgccgggc

SEQ ID NO: 573215 - DNA, 25 bp, Rattus norvegicus
gtgcctcaggccctgaaccgggtga

SEQ ID NO: 573216 - DNA, 25 bp, Rattus norvegicus
aagcaccgatttctggtgggtcccg

SEQ ID NO: 573217 - DNA, 25 bp, Rattus norvegicus
tgggtcccgacacgtcgtcttctca

SEQ ID NO: 573218 - DNA, 25 bp, Rattus norvegicus
gcgacacttcggcaggtcctcctgt

SEQ ID NO: 573219 - DNA, 25 bp, Rattus norvegicus
agcagggatgtgtctcggctccctc

SEQ ID NO: 573220 - DNA, 25 bp, Rattus norvegicus
agtgtgcaccgtacctcagggcatc

SEQ ID NO: 573221 - DNA, 25 bp, Rattus norvegicus
ctagatcccaaactcggagccggtc

SEQ ID NO: 573222 - DNA, 25 bp, Rattus norvegicus
tttgggttctacttctgcgtgtgca

SEQ ID NO: 573223 - DNA, 25 bp, Rattus norvegicus
cgccgggtgccttaatgttggatag

SEQ ID NO: 573224 - DNA, 25 bp, Rattus norvegicus
ataggtgggaactcgcctgtcatcc

SEQ ID NO: 573225 - DNA, 25 bp, Rattus norvegicus
cgattgaggtcacttgctacttttc

SEQ ID NO: 573226 - DNA, 25 bp, Rattus norvegicus
ttcacccgaaactcaggctctctgt

SEQ ID NO: 573227 - DNA, 25 bp, Rattus norvegicus
agcgtttgttcctgagctgtgcggt

SEQ ID NO: 573228 - DNA, 25 bp, Rattus norvegicus
gaggagctacatctcgcgcgagtcc

SEQ ID NO: 573229 - DNA, 25 bp, Rattus norvegicus
cagcagcttgtgaagtgcgagcgcc

SEQ ID NO: 573230 - DNA, 25 bp, Rattus norvegicus
gagggcagctcacgcacaaacatgg

SEQ ID NO: 573231 - DNA, 25 bp, Rattus norvegicus
ctcacgcacaaacatggggccggtg

SEQ ID NO: 573232 - DNA, 25 bp, Rattus norvegicus
tggggaagtattccgcctccacgta

SEQ ID NO: 573233 - DNA, 25 bp, Rattus norvegicus
ggttccggtaaagccacagctcctc

SEQ ID NO: 573234 - DNA, 25 bp, Rattus norvegicus
cctcgggctgaatccgccgctggaa

SEQ ID NO: 573235 - DNA, 25 bp, Rattus norvegicus
agctcggtcgccctgaggaggaaac

SEQ ID NO: 573236 - DNA, 25 bp, Rattus norvegicus
gacaggctacttcggcgaaagaacc

SEQ ID NO: 573237 - DNA, 25 bp, Rattus norvegicus
cacctagcgacctccgaggggactg

SEQ ID NO: 573238 - DNA, 25 bp, Rattus norvegicus
cgcctgggaacgttgacagatcctt

SEQ ID NO: 573239 - DNA, 25 bp, Rattus norvegicus
gacagatccttacaggaaggccaca

SEQ ID NO: 573240 - DNA, 25 bp, Rattus norvegicus
acgcgcggccggcagatcagacgct

SEQ ID NO: 573241 - DNA, 25 bp, Rattus norvegicus
agatcagacgctgacgtggctccgg

SEQ ID NO: 573242 - DNA, 25 bp, Rattus norvegicus
aagattgacaggctacttcggcgaa

SEQ ID NO: 573243 - DNA, 25 bp, Rattus norvegicus
ggccgagagttagcaatcggttccc

SEQ ID NO: 573244 - DNA, 25 bp, Rattus norvegicus
tcacagtggccgagagttagcaatc

SEQ ID NO: 573245 - DNA, 25 bp, Rattus norvegicus
ccttaccgcctatcctatcaggagt

SEQ ID NO: 573246 - DNA, 25 bp, Rattus norvegicus
ctatcaggagtatgttctcgttccc

SEQ ID NO: 573247 - DNA, 25 bp, Rattus norvegicus
ccagcttcgcccaggagagcatgct

SEQ ID NO: 573248 - DNA, 25 bp, Rattus norvegicus
cccaggagagcatgctgctgtggct

SEQ ID NO: 573249 - DNA, 25 bp, Rattus norvegicus
catcactcggtcctctggaatcgga

SEQ ID NO: 573250 - DNA, 25 bp, Rattus norvegicus
ctggaatcggagtcagatgtgtctc

SEQ ID NO: 573251 - DNA, 25 bp, Rattus norvegicus
agatgtgtctctgtacgtgcaactg

SEQ ID NO: 573252 - DNA, 25 bp, Rattus norvegicus
ctctgtacgtgcaactggccgtttc

SEQ ID NO: 573253 - DNA, 25 bp, Rattus norvegicus
ctggccgtttccacatcagtcgagg

SEQ ID NO: 573254 - DNA, 25 bp, Rattus norvegicus
ccgtttccacatcagtcgaggcgcg

SEQ ID NO: 573255 - DNA, 25 bp, Rattus norvegicus
ctggcagacgagaggcgtctgccca

SEQ ID NO: 573256 - DNA, 25 bp, Rattus norvegicus
gtaagcggaactctcacagtggccg

SEQ ID NO: 573257 - DNA, 25 bp, Rattus norvegicus
ccgaccctgtggaatggtggaaaca

SEQ ID NO: 573258 - DNA, 25 bp, Rattus norvegicus
ctgaatcggacagagccctgcgctc

SEQ ID NO: 573259 - DNA, 25 bp, Rattus norvegicus
cacggagaccatcgctgcagacttc

SEQ ID NO: 573260 - DNA, 25 bp, Rattus norvegicus
aggcctcctaatctcgcagcgatcg

SEQ ID NO: 573261 - DNA, 25 bp, Rattus norvegicus
acacaacgcaatcaggcctcctaat

SEQ ID NO: 573262 - DNA, 25 bp, Rattus norvegicus
tggtggaaacacaacgcaatcaggc

SEQ ID NO: 573263 - DNA, 25 bp, Rattus norvegicus
tcgcgatgtcttttcttggagctcc

SEQ ID NO: 573264 - DNA, 25 bp, Rattus norvegicus
cgccaagcagtgttccctccgagag

SEQ ID NO: 573265 - DNA, 25 bp, Rattus norvegicus
cctccgagaggcgttcagttctgct

SEQ ID NO: 573266 - DNA, 25 bp, Rattus norvegicus
cgttcagttctgctgaggatctcca

SEQ ID NO: 573267 - DNA, 25 bp, Rattus norvegicus
ctcggtccgccgaccctgtggaatg

SEQ ID NO: 573268 - DNA, 25 bp, Rattus norvegicus
tctgctgaggatctccacggagacc

SEQ ID NO: 573269 - DNA, 25 bp, Rattus norvegicus
tctcgcagcgatcgatcgcgatgtc

SEQ ID NO: 573270 - DNA, 25 bp, Rattus norvegicus
gacggagaggtcactgaatcggaca

SEQ ID NO: 573271 - DNA, 25 bp, Rattus norvegicus
taaccaggaggacgtcagcgcgact

SEQ ID NO: 573272 - DNA, 25 bp, Rattus norvegicus
tgaccggtacgcaatgacgcagacc

SEQ ID NO: 573273 - DNA, 25 bp, Rattus norvegicus
gtggccctgctctacaattcctaga

SEQ ID NO: 573274 - DNA, 25 bp, Rattus norvegicus
ccatatggtattcgagtggccctgc

SEQ ID NO: 573275 - DNA, 25 bp, Rattus norvegicus
agcacgtactagacgccatatggta

SEQ ID NO: 573276 - DNA, 25 bp, Rattus norvegicus
gtcgggcctgcaaggctaatactta

SEQ ID NO: 573277 - DNA, 25 bp, Rattus norvegicus
acccggcactgagagcgaagaagga

SEQ ID NO: 573278 - DNA, 25 bp, Rattus norvegicus
tgccgggaaatgcagtccgggaccc

SEQ ID NO: 573279 - DNA, 25 bp, Rattus norvegicus
cggggctccgatagaaagctgcaca

SEQ ID NO: 573280 - DNA, 25 bp, Rattus norvegicus
cgcgtcccagacaccgggtagtacg

SEQ ID NO: 573281 - DNA, 25 bp, Rattus norvegicus
gtacgttaggacgagagcctgagcc

SEQ ID NO: 573282 - DNA, 25 bp, Rattus norvegicus
cgggtggctgccagtttacaagtac

SEQ ID NO: 573283 - DNA, 25 bp, Rattus norvegicus
cttgggagtcgatgacagcctgaca

SEQ ID NO: 573284 - DNA, 25 bp, Rattus norvegicus
tacagaggcttgtgggtaaccagga

SEQ ID NO: 573285 - DNA, 25 bp, Rattus norvegicus
tcaagctctacgatctcggacgtcg

SEQ ID NO: 573286 - DNA, 25 bp, Rattus norvegicus
gcctctaggggaatcgaagcccgcc

SEQ ID NO: 573287 - DNA, 25 bp, Rattus norvegicus
aggggaatcgaagcccgcctcacgc

SEQ ID NO: 573288 - DNA, 25 bp, Rattus norvegicus
gcctggctcgaccaatcaagctcta

SEQ ID NO: 573289 - DNA, 25 bp, Rattus norvegicus
ctgcccttaagagtcccggcctggg

SEQ ID NO: 573290 - DNA, 25 bp, Rattus norvegicus
tacgatctcggacgtcgggttacgc

SEQ ID NO: 573291 - DNA, 25 bp, Rattus norvegicus
cacattgatgcgtgagtccgggacc

SEQ ID NO: 573292 - DNA, 25 bp, Rattus norvegicus
aaccggctcccagcttcaggtcccg

SEQ ID NO: 573293 - DNA, 25 bp, Rattus norvegicus
tcaggccgccatgcaaggcccggga

SEQ ID NO: 573294 - DNA, 25 bp, Rattus norvegicus
gagagcggcgcgctcatgcacagtt

SEQ ID NO: 573295 - DNA, 25 bp, Rattus norvegicus
ggcgcgctcatgcacagtttcggca

SEQ ID NO: 573296 - DNA, 25 bp, Rattus norvegicus
acagtttcggcatcttcctgcaggg

SEQ ID NO: 573297 - DNA, 25 bp, Rattus norvegicus
cgtcgtggccttcagcacattgatg

SEQ ID NO: 573298 - DNA, 25 bp, Rattus norvegicus
ccacgtcgccagctgcagacctagc

SEQ ID NO: 573299 - DNA, 25 bp, Rattus norvegicus
tttggggccttagtcatctcgtagt

SEQ ID NO: 573300 - DNA, 25 bp, Rattus norvegicus
cggttgcgagatagcagaattatgc

SEQ ID NO: 573301 - DNA, 25 bp, Rattus norvegicus
tctcgtagtgatcacgggctccctc

SEQ ID NO: 573302 - DNA, 25 bp, Rattus norvegicus
gcttttgtagctgaggtttccgtgg

SEQ ID NO: 573303 - DNA, 25 bp, Rattus norvegicus
tcccaggatttgagagctcattgga

SEQ ID NO: 573304 - DNA, 25 bp, Rattus norvegicus
attatgccagtagccgaagagcggc

SEQ ID NO: 573305 - DNA, 25 bp, Rattus norvegicus
acctccttccggcacggttgcgaga

SEQ ID NO: 573306 - DNA, 25 bp, Rattus norvegicus
gctgagcccggtttgcgatgttagc

SEQ ID NO: 573307 - DNA, 25 bp, Rattus norvegicus
gagactgggcttccggcctctctaa

SEQ ID NO: 573308 - DNA, 25 bp, Rattus norvegicus
tcactcggagtgacgtcacagggcg

SEQ ID NO: 573309 - DNA, 25 bp, Rattus norvegicus
tcattggatggtagtggcgtcactc

SEQ ID NO: 573310 - DNA, 25 bp, Rattus norvegicus
cgcgccgctaccgtgaaggacacga

SEQ ID NO: 573311 - DNA, 25 bp, Rattus norvegicus
ggacacgagcccttcccaggatttg

SEQ ID NO: 573312 - DNA, 25 bp, Rattus norvegicus
agccgagggctccttttgcactggt

SEQ ID NO: 573313 - DNA, 25 bp, Rattus norvegicus
ctacggcgggcattgactgcagcac

SEQ ID NO: 573314 - DNA, 25 bp, Rattus norvegicus
tgtgtcttgcgctccagcagctcgt

SEQ ID NO: 573315 - DNA, 25 bp, Rattus norvegicus
gcagctcgtccctgggatccgttca

SEQ ID NO: 573316 - DNA, 25 bp, Rattus norvegicus
atccgttcaggtcctggtggggtct

SEQ ID NO: 573317 - DNA, 25 bp, Rattus norvegicus
aacaatggagccgaagctggtgccc

SEQ ID NO: 573318 - DNA, 25 bp, Rattus norvegicus
cgtcgtctcaggcttctggtagccc

SEQ ID NO: 573319 - DNA, 25 bp, Rattus norvegicus
ttctggtagcccgagttccatcgcc

SEQ ID NO: 573320 - DNA, 25 bp, Rattus norvegicus
tgcgcctctgggacctgagaaaagt

SEQ ID NO: 573321 - DNA, 25 bp, Rattus norvegicus
ggtctccgctgcttttccagctgcg

SEQ ID NO: 573322 - DNA, 25 bp, Rattus norvegicus
cgaggtcgccgcaatgcgctaagca

SEQ ID NO: 573323 - DNA, 25 bp, Rattus norvegicus
atgcgctaagcacagtctccgtcca

SEQ ID NO: 573324 - DNA, 25 bp, Rattus norvegicus
aaaggttcccgcaggagcgctccga

SEQ ID NO: 573325 - DNA, 25 bp, Rattus norvegicus
gactcttacctcacttggcgctgcg

SEQ ID NO: 573326 - DNA, 25 bp, Rattus norvegicus
tgagaaaagtcctcggtctccgctg

SEQ ID NO: 573327 - DNA, 25 bp, Rattus norvegicus
gatagtttcatgcaaacaatctata

SEQ ID NO: 573328 - DNA, 25 bp, Rattus norvegicus
tataagcactggaattaaaatatga

SEQ ID NO: 573329 - DNA, 25 bp, Rattus norvegicus
actggaattaaaatatgatagtttc

SEQ ID NO: 573330 - DNA, 25 bp, Rattus norvegicus
gcaaacaatctatataaagatcaga

SEQ ID NO: 573331 - DNA, 25 bp, Rattus norvegicus
agatcagataacaaactgaaaggta

SEQ ID NO: 573332 - DNA, 25 bp, Rattus norvegicus
gataacaaactgaaaggtaaagcta

SEQ ID NO: 573333 - DNA, 25 bp, Rattus norvegicus
taagaagatataaggcggcagtttg

SEQ ID NO: 573334 - DNA, 25 bp, Rattus norvegicus
gaaagactctggaaaggccaagaca

SEQ ID NO: 573335 - DNA, 25 bp, Rattus norvegicus
gctggaaagactctggaaaggccaa

SEQ ID NO: 573336 - DNA, 25 bp, Rattus norvegicus
gctaaaaatatcgagaattcgctgt

SEQ ID NO: 573337 - DNA, 25 bp, Rattus norvegicus
gatataaggcggcagtttgaatcgc

SEQ ID NO: 573338 - DNA, 25 bp, Rattus norvegicus
cgctgtgaaggattaagaagatata

SEQ ID NO: 573339 - DNA, 25 bp, Rattus norvegicus
atcgagaattcgctgtgaaggatta

SEQ ID NO: 573340 - DNA, 25 bp, Rattus norvegicus
ggtaaggctggaaagactctggaaa

SEQ ID NO: 573341 - DNA, 25 bp, Rattus norvegicus
atgaagtgcttagcgtccgagtctc

SEQ ID NO: 573342 - DNA, 25 bp, Rattus norvegicus
ctgaattccacacgaggcggcatga

SEQ ID NO: 573343 - DNA, 25 bp, Rattus norvegicus
gcgcaggcattctgactcctgaatt

SEQ ID NO: 573344 - DNA, 25 bp, Rattus norvegicus
tgccttaccggaaatgacaccactg

SEQ ID NO: 573345 - DNA, 25 bp, Rattus norvegicus
gttccgaggacagccacagcatcta

SEQ ID NO: 573346 - DNA, 25 bp, Rattus norvegicus
ctggaatactctaggcaccgcttca

SEQ ID NO: 573347 - DNA, 25 bp, Rattus norvegicus
gcgctctctcagtgttctccggaga

SEQ ID NO: 573348 - DNA, 25 bp, Rattus norvegicus
gctcttcggaagactgcacgggatc

SEQ ID NO: 573349 - DNA, 25 bp, Rattus norvegicus
ttggggaaaccgacgcctgaagtca

SEQ ID NO: 573350 - DNA, 25 bp, Rattus norvegicus
ttcatgggaacaccaccaatttggg

SEQ ID NO: 573351 - DNA, 25 bp, Rattus norvegicus
gactcattttttcgtttctcgcgca

SEQ ID NO: 573352 - DNA, 25 bp, Rattus norvegicus
gaccgctcttgaacagctggacaga

SEQ ID NO: 573353 - DNA, 25 bp, Rattus norvegicus
cggacgcaagggagacttttccact

SEQ ID NO: 573354 - DNA, 25 bp, Rattus norvegicus
ttggcggttcctctttatttcatgg

SEQ ID NO: 573355 - DNA, 25 bp, Rattus norvegicus
ggagacgcccccgacagccgtggat

SEQ ID NO: 573356 - DNA, 25 bp, Rattus norvegicus
tgcttggtgagacccgacggggcct

SEQ ID NO: 573357 - DNA, 25 bp, Rattus norvegicus
tgcctctggcccttcctccccgccg

SEQ ID NO: 573358 - DNA, 25 bp, Rattus norvegicus
cgcctcctgcgaggtcactcgtggg

SEQ ID NO: 573359 - DNA, 25 bp, Rattus norvegicus
cctcctgcgaggtcactcgtgggct

SEQ ID NO: 573360 - DNA, 25 bp, Rattus norvegicus
ctcctgcgaggtcactcgtgggctg

SEQ ID NO: 573361 - DNA, 25 bp, Rattus norvegicus
tgtgatgggcggctcgcactcccag

SEQ ID NO: 573362 - DNA, 25 bp, Rattus norvegicus
cccgacagccgtggatgccgcgtga

SEQ ID NO: 573363 - DNA, 25 bp, Rattus norvegicus
acagccgtggatgccgcgtgagtct

SEQ ID NO: 573364 - DNA, 25 bp, Rattus norvegicus
cgtggatgccgcgtgagtctgagca

SEQ ID NO: 573365 - DNA, 25 bp, Rattus norvegicus
tgccgcgtgagtctgagcagggcgt

SEQ ID NO: 573366 - DNA, 25 bp, Rattus norvegicus
ggcgtggggcttggggactcaggac

SEQ ID NO: 573367 - DNA, 25 bp, Rattus norvegicus
tcactcgtgggctggctgtgatggg

SEQ ID NO: 573368 - DNA, 25 bp, Rattus norvegicus
actcaggacagggacgggcgccgga

SEQ ID NO: 573369 - DNA, 25 bp, Rattus norvegicus
cttcgctgtgagctttctgtaccca

SEQ ID NO: 573370 - DNA, 25 bp, Rattus norvegicus
agtctccgcatcctggtttgcctgg

SEQ ID NO: 573371 - DNA, 25 bp, Rattus norvegicus
ttctgtctgcccgtgtgcttttcgt

SEQ ID NO: 573372 - DNA, 25 bp, Rattus norvegicus
cgaaagttcgggatgttctgtctgc

SEQ ID NO: 573373 - DNA, 25 bp, Rattus norvegicus
agtacaccgcatcccagccgagatg

SEQ ID NO: 573374 - DNA, 25 bp, Rattus norvegicus
ctgagtttcaggcaagtacaccgca

SEQ ID NO: 573375 - DNA, 25 bp, Rattus norvegicus
agccgagaccaaatccctgagtttc

SEQ ID NO: 573376 - DNA, 25 bp, Rattus norvegicus
ccattttgaaggaagaggccgccgt

SEQ ID NO: 573377 - DNA, 25 bp, Rattus norvegicus
cccagagcctgtcgtctcagagcag

SEQ ID NO: 573378 - DNA, 25 bp, Rattus norvegicus
cgcgcacacgctcggaaatggatgt

SEQ ID NO: 573379 - DNA, 25 bp, Rattus norvegicus
cctagcggcaggaagctcagataaa

SEQ ID NO: 573380 - DNA, 25 bp, Rattus norvegicus
gtcacgccattaagtcctagcggca

SEQ ID NO: 573381 - DNA, 25 bp, Rattus norvegicus
ttcagtccctggcagatcctgtcgc

SEQ ID NO: 573382 - DNA, 25 bp, Rattus norvegicus
gggtcgctttctctaagcgtcgaca

SEQ ID NO: 573383 - DNA, 25 bp, Rattus norvegicus
cctgtgcgcgctccgcaaggagaac

SEQ ID NO: 573384 - DNA, 25 bp, Rattus norvegicus
gctcccggctgtgccagtgcagaaa

SEQ ID NO: 573385 - DNA, 25 bp, Rattus norvegicus
ctgctgccaagtgtgcgccgcggtc

SEQ ID NO: 573386 - DNA, 25 bp, Rattus norvegicus
gccggctcggcgctagtgccagatc

SEQ ID NO: 573387 - DNA, 25 bp, Rattus norvegicus
cctctgcctagctgctcggccggct

SEQ ID NO: 573388 - DNA, 25 bp, Rattus norvegicus
gcctgcgatcccacgcgctgcccgc

SEQ ID NO: 573389 - DNA, 25 bp, Rattus norvegicus
ttgccctgcccggacgcctgcgatc

SEQ ID NO: 573390 - DNA, 25 bp, Rattus norvegicus
ctccgcaaggagaaccgagcggctc

SEQ ID NO: 573391 - DNA, 25 bp, Rattus norvegicus
aaggagaaccgagcggctcgccagc

SEQ ID NO: 573392 - DNA, 25 bp, Rattus norvegicus
aggccaggaggtctagagtctcctt

SEQ ID NO: 573393 - DNA, 25 bp, Rattus norvegicus
cagaaaggtgcctgcggcgactcag

SEQ ID NO: 573394 - DNA, 25 bp, Rattus norvegicus
ctgtgccagtgcagaaaggtgcctg

SEQ ID NO: 573395 - DNA, 25 bp, Rattus norvegicus
ctagtgccagatcgctgcggctgct

SEQ ID NO: 573396 - DNA, 25 bp, Rattus norvegicus
aggtctagagtctccttgccctgcc

SEQ ID NO: 573397 - DNA, 25 bp, Rattus norvegicus
taggtaactcacagggcaaccgccc

SEQ ID NO: 573398 - DNA, 25 bp, Rattus norvegicus
gtattttcccgacgtcagcctctgg

SEQ ID NO: 573399 - DNA, 25 bp, Rattus norvegicus
aggtccttcactctgcggcgcgaga

SEQ ID NO: 573400 - DNA, 25 bp, Rattus norvegicus
tgcgaccaatcagaagcggccagag

SEQ ID NO: 573401 - DNA, 25 bp, Rattus norvegicus
aggcctctctacgtcggcacgcaaa

SEQ ID NO: 573402 - DNA, 25 bp, Rattus norvegicus
cctctctgcgactaaggtggctgct

SEQ ID NO: 573403 - DNA, 25 bp, Rattus norvegicus
gccggtcctagagacctggcctaaa

SEQ ID NO: 573404 - DNA, 25 bp, Rattus norvegicus
gaacctgccgaagccctagccatgg

SEQ ID NO: 573405 - DNA, 25 bp, Rattus norvegicus
cgcctggccgcatagcaataggtaa

SEQ ID NO: 573406 - DNA, 25 bp, Rattus norvegicus
gtggctccgagagacacagtgcagc

SEQ ID NO: 573407 - DNA, 25 bp, Rattus norvegicus
gccgtagcattaaacgagtggctcc

SEQ ID NO: 573408 - DNA, 25 bp, Rattus norvegicus
tgagatccagttcggccgtagcatt

SEQ ID NO: 573409 - DNA, 25 bp, Rattus norvegicus
tggcctaaaaacagccaggccgcca

SEQ ID NO: 573410 - DNA, 25 bp, Rattus norvegicus
ggaggccactctctcaccgcgtatt

SEQ ID NO: 573411 - DNA, 25 bp, Rattus norvegicus
aaagcgttccgaagcaagcaccctg

SEQ ID NO: 573412 - DNA, 25 bp, Rattus norvegicus
ggcaccggaaccctgcagagttacg

SEQ ID NO: 573413 - DNA, 25 bp, Rattus norvegicus
cgaggcaccggaaccctgcagagtt

SEQ ID NO: 573414 - DNA, 25 bp, Rattus norvegicus
ccctgcagagttacgggtagcagtg

SEQ ID NO: 573415 - DNA, 25 bp, Rattus norvegicus
acggtctagcgtgcagcctcaggtt

SEQ ID NO: 573416 - DNA, 25 bp, Rattus norvegicus
tggactacggtctagcgtgcagcct

SEQ ID NO: 573417 - DNA, 25 bp, Rattus norvegicus
ctaatcctgtggcttggtgcctggg

SEQ ID NO: 573418 - DNA, 25 bp, Rattus norvegicus
gctcctatctaatcctgtggcttgg

SEQ ID NO: 573419 - DNA, 25 bp, Rattus norvegicus
tgcgcagctcctatctaatcctgtg

SEQ ID NO: 573420 - DNA, 25 bp, Rattus norvegicus
gagcatcctgcgcagctcctatcta

SEQ ID NO: 573421 - DNA, 25 bp, Rattus norvegicus
ttccgaagcaagcaccctgcggtgc

SEQ ID NO: 573422 - DNA, 25 bp, Rattus norvegicus
gtagcagtgagcctgtaccagctca

SEQ ID NO: 573423 - DNA, 25 bp, Rattus norvegicus
ttacgggtagcagtgagcctgtacc

SEQ ID NO: 573424 - DNA, 25 bp, Rattus norvegicus
ccctgcggtgctcggggagcatcct

SEQ ID NO: 573425 - DNA, 25 bp, Rattus norvegicus
tgcgaccagacctttcagcagctcg

SEQ ID NO: 573426 - DNA, 25 bp, Rattus norvegicus
gcaattatctgctggcgccgacgcc

SEQ ID NO: 573427 - DNA, 25 bp, Rattus norvegicus
tagcgatgcacttagcaattatctg

SEQ ID NO: 573428 - DNA, 25 bp, Rattus norvegicus
accaactgtgctagcgatgcactta

SEQ ID NO: 573429 - DNA, 25 bp, Rattus norvegicus
gctcggaccaactgtgctagcgatg

SEQ ID NO: 573430 - DNA, 25 bp, Rattus norvegicus
cagacctttcagcagctcggaccaa

SEQ ID NO: 573431 - DNA, 25 bp, Rattus norvegicus
ccctctcccgggacgcagataaagg

SEQ ID NO: 573432 - DNA, 25 bp, Rattus norvegicus
ctgcgttcctgtctctgcgaccaga

SEQ ID NO: 573433 - DNA, 25 bp, Rattus norvegicus
tgaggatgctgcgttcctgtctctg

SEQ ID NO: 573434 - DNA, 25 bp, Rattus norvegicus
gagcacgctgaggatgctgcgttcc

SEQ ID NO: 573435 - DNA, 25 bp, Rattus norvegicus
ttctccgagaagcagaggggctgtt

SEQ ID NO: 573436 - DNA, 25 bp, Rattus norvegicus
gataaaggtaccttctccgagaagc

SEQ ID NO: 573437 - DNA, 25 bp, Rattus norvegicus
gggacgcagataaaggtaccttctc

SEQ ID NO: 573438 - DNA, 25 bp, Rattus norvegicus
gaaaacagagcggaagcagccccct

SEQ ID NO: 573439 - DNA, 25 bp, Rattus norvegicus
tagcccacgttgtggcacagccgca

SEQ ID NO: 573440 - DNA, 25 bp, Rattus norvegicus
cacatttgagcatctcgggccagta

SEQ ID NO: 573441 - DNA, 25 bp, Rattus norvegicus
ccctcggggaacttgtcacatttga

SEQ ID NO: 573442 - DNA, 25 bp, Rattus norvegicus
gcatacccttaccttggggcttcga

SEQ ID NO: 573443 - DNA, 25 bp, Rattus norvegicus
tgctgcacctacttgcggcgctgca

SEQ ID NO: 573444 - DNA, 25 bp, Rattus norvegicus
cgagtctctgatcgatggggtcttc

SEQ ID NO: 573445 - DNA, 25 bp, Rattus norvegicus
cacgtagtcgtactcgctggccgaa

SEQ ID NO: 573446 - DNA, 25 bp, Rattus norvegicus
cgatatccgactggaagctcacgta

SEQ ID NO: 573447 - DNA, 25 bp, Rattus norvegicus
aggtccaccgggatgtccacgcact

SEQ ID NO: 573448 - DNA, 25 bp, Rattus norvegicus
ggttgggcagcaccatcttcttgta

SEQ ID NO: 573449 - DNA, 25 bp, Rattus norvegicus
tgctgcttcacctctgccatggtct

SEQ ID NO: 573450 - DNA, 25 bp, Rattus norvegicus
agttcttgttgagcagcggcaccca

SEQ ID NO: 573451 - DNA, 25 bp, Rattus norvegicus
cgaagaactgcatgaccggctcgca

SEQ ID NO: 573452 - DNA, 25 bp, Rattus norvegicus
gcgcccgctctgataggagccgata

SEQ ID NO: 573453 - DNA, 25 bp, Rattus norvegicus
tgacgcatcgatggttggtcatccc

SEQ ID NO: 573454 - DNA, 25 bp, Rattus norvegicus
cgctctggccgcttcagtgacgcat

SEQ ID NO: 573455 - DNA, 25 bp, Rattus norvegicus
agcgacgctctatggcaggtcctcc

SEQ ID NO: 573456 - DNA, 25 bp, Rattus norvegicus
gccgccgcgtctaggtcggctctat

SEQ ID NO: 573457 - DNA, 25 bp, Rattus norvegicus
tcgggagtcactctggcctcccagg

SEQ ID NO: 573458 - DNA, 25 bp, Rattus norvegicus
gccgcgattatggacgacttcactt

SEQ ID NO: 573459 - DNA, 25 bp, Rattus norvegicus
tggcctcccaggagcgacgctctat

SEQ ID NO: 573460 - DNA, 25 bp, Rattus norvegicus
gctctatggcgcgtcttccgactct

SEQ ID NO: 573461 - DNA, 25 bp, Rattus norvegicus
cctgtatcgctatggtagcggcgtc

SEQ ID NO: 573462 - DNA, 25 bp, Rattus norvegicus
tcctacaccgggtgggccgcgatta

SEQ ID NO: 573463 - DNA, 25 bp, Rattus norvegicus
tgtaggcctccttcgggaacatgcc

SEQ ID NO: 573464 - DNA, 25 bp, Rattus norvegicus
gctaccgcagcttcccgactgtagg

SEQ ID NO: 573465 - DNA, 25 bp, Rattus norvegicus
ttcacttccagtcgggcatgagcgg

SEQ ID NO: 573466 - DNA, 25 bp, Rattus norvegicus
atactgttacttgcgggtcgtgggc

SEQ ID NO: 573467 - DNA, 25 bp, Rattus norvegicus
cgcctacactaggaagacttctgtc

SEQ ID NO: 573468 - DNA, 25 bp, Rattus norvegicus
cgcgcagcctcggaggtatccttta

SEQ ID NO: 573469 - DNA, 25 bp, Rattus norvegicus
gcaaggctttttgcgacaggacgta

SEQ ID NO: 573470 - DNA, 25 bp, Rattus norvegicus
tgacgacgaacgtggtgcgacagct

SEQ ID NO: 573471 - DNA, 25 bp, Rattus norvegicus
gttaacagggccgaaccaggatgtc

SEQ ID NO: 573472 - DNA, 25 bp, Rattus norvegicus
ctggaggctctcagctacagccatg

SEQ ID NO: 573473 - DNA, 25 bp, Rattus norvegicus
ctacagccatgagtgaaggggatcg

SEQ ID NO: 573474 - DNA, 25 bp, Rattus norvegicus
ggaagggcttcacccgcctacacta

SEQ ID NO: 573475 - DNA, 25 bp, Rattus norvegicus
ctaggccggcaatctgacctgtgtc

SEQ ID NO: 573476 - DNA, 25 bp, Rattus norvegicus
gacctgtgtcttgcccgaactcgca

SEQ ID NO: 573477 - DNA, 25 bp, Rattus norvegicus
cggtgtccgggaaggtcttcattca

SEQ ID NO: 573478 - DNA, 25 bp, Rattus norvegicus
tcagcgagactacagcagtggcacc

SEQ ID NO: 573479 - DNA, 25 bp, Rattus norvegicus
agtggcacccgctgccagttccaga

SEQ ID NO: 573480 - DNA, 25 bp, Rattus norvegicus
gaagacttctgtcccagctaccgcg

SEQ ID NO: 573481 - DNA, 25 bp, Rattus norvegicus
gcgacccgggtcacttatagcagcc

SEQ ID NO: 573482 - DNA, 25 bp, Rattus norvegicus
ctctatagcgtggagagagcccgcc

SEQ ID NO: 573483 - DNA, 25 bp, Rattus norvegicus
gcgtgtccgctcttccctaagactg

SEQ ID NO: 573484 - DNA, 25 bp, Rattus norvegicus
agactgattggttagtgctctctca

SEQ ID NO: 573485 - DNA, 25 bp, Rattus norvegicus
ctctctcagcgcagggatgtttccg

SEQ ID NO: 573486 - DNA, 25 bp, Rattus norvegicus
atgtttccggttgacgctgtgtttc

SEQ ID NO: 573487 - DNA, 25 bp, Rattus norvegicus
gtgcggtctccggagttatttcaga

SEQ ID NO: 573488 - DNA, 25 bp, Rattus norvegicus
atttcagagagagctcccgcgccta

SEQ ID NO: 573489 - DNA, 25 bp, Rattus norvegicus
gctttaagtgcctattgcgaggtga

SEQ ID NO: 573490 - DNA, 25 bp, Rattus norvegicus
ctggatgggccaagcacttaacacg

SEQ ID NO: 573491 - DNA, 25 bp, Rattus norvegicus
cacgatgcacgtttcacatttgaac

SEQ ID NO: 573492 - DNA, 25 bp, Rattus norvegicus
tccttgctgtgtgaagtgagcgccc

SEQ ID NO: 573493 - DNA, 25 bp, Rattus norvegicus
cgccttccggaagtacgctctatag

SEQ ID NO: 573494 - DNA, 25 bp, Rattus norvegicus
ccacgccgtgtacccgctttaagtg

SEQ ID NO: 573495 - DNA, 25 bp, Rattus norvegicus
ccggacaggagcctactaatatgta

SEQ ID NO: 573496 - DNA, 25 bp, Rattus norvegicus
ttccgaatctctccgattgtggtgc

SEQ ID NO: 573497 - DNA, 25 bp, Rattus norvegicus
ggcagccaagctgaagcgcgttcgc

SEQ ID NO: 573498 - DNA, 25 bp, Rattus norvegicus
aacgcgctgaaggtcagtgttctcc

SEQ ID NO: 573499 - DNA, 25 bp, Rattus norvegicus
tgaaggtcagtgttctccgggaacc

SEQ ID NO: 573500 - DNA, 25 bp, Rattus norvegicus
gaccgggcgtgaatgtcctggaaaa

SEQ ID NO: 573501 - DNA, 25 bp, Rattus norvegicus
cgccatgttggaaacgcggctacgg

SEQ ID NO: 573502 - DNA, 25 bp, Rattus norvegicus
caaggcagcaatcgagagccggaca

SEQ ID NO: 573503 - DNA, 25 bp, Rattus norvegicus
atatgtacctggataagtgccttca

SEQ ID NO: 573504 - DNA, 25 bp, Rattus norvegicus
agtgccttcacctccaggtcgaatt

SEQ ID NO: 573505 - DNA, 25 bp, Rattus norvegicus
ctccaggtcgaatttgacaatctcc

SEQ ID NO: 573506 - DNA, 25 bp, Rattus norvegicus
gacaatctcctggttacagattcgg

SEQ ID NO: 573507 - DNA, 25 bp, Rattus norvegicus
tacagattcggacgtggacatcctg

SEQ ID NO: 573508 - DNA, 25 bp, Rattus norvegicus
tgaatgtcctggaaaatgccaaggc

SEQ ID NO: 573509 - DNA, 25 bp, Rattus norvegicus
tcaccgaggactggagtcgagcctc

SEQ ID NO: 573510 - DNA, 25 bp, Rattus norvegicus
tgcgcacgctcttacgtaggcctgg

SEQ ID NO: 573511 - DNA, 25 bp, Rattus norvegicus
ggtccacgttcagcggcgtagacaa

SEQ ID NO: 573512 - DNA, 25 bp, Rattus norvegicus
gcatcagtgcttaagggcgagcatc

SEQ ID NO: 573513 - DNA, 25 bp, Rattus norvegicus
tcagctcactccgagagcatcagtg

SEQ ID NO: 573514 - DNA, 25 bp, Rattus norvegicus
agctccgggatgcagctaacgtttc

SEQ ID NO: 573515 - DNA, 25 bp, Rattus norvegicus
agctaacgtttcgtggccagccaga

SEQ ID NO: 573516 - DNA, 25 bp, Rattus norvegicus
cgtggccagccagaaccgaatctca

SEQ ID NO: 573517 - DNA, 25 bp, Rattus norvegicus
gaaccgaatctcacgcaaagtccca

SEQ ID NO: 573518 - DNA, 25 bp, Rattus norvegicus
cgcaaagtcccacaaagactcggta

SEQ ID NO: 573519 - DNA, 25 bp, Rattus norvegicus
gactcggtaaacgaacctcgctatg

SEQ ID NO: 573520 - DNA, 25 bp, Rattus norvegicus
cgaacctcgctatgccaggctaatc

SEQ ID NO: 573521 - DNA, 25 bp, Rattus norvegicus
ccggactgatgcctgttctggagac

SEQ ID NO: 573522 - DNA, 25 bp, Rattus norvegicus
cgcgggtcttcagaaagcgacctca

SEQ ID NO: 573523 - DNA, 25 bp, Rattus norvegicus
cctgcaaaaagcaacccgggtgctg

SEQ ID NO: 573524 - DNA, 25 bp, Rattus norvegicus
aaagcgctcttcttcctccacttgg

SEQ ID NO: 573525 - DNA, 25 bp, Rattus norvegicus
cgagggctccaaagcgctcttcttc

SEQ ID NO: 573526 - DNA, 25 bp, Rattus norvegicus
aggacgagggctccaaagcgctctt

SEQ ID NO: 573527 - DNA, 25 bp, Rattus norvegicus
gtactcatcatcctcgttctccgag

SEQ ID NO: 573528 - DNA, 25 bp, Rattus norvegicus
gggcttgttgtactcatcatcctcg

SEQ ID NO: 573529 - DNA, 25 bp, Rattus norvegicus
caggggcttgttgtactcatcatcc

SEQ ID NO: 573530 - DNA, 25 bp, Rattus norvegicus
ttctcgtcgtccgagtctgggtcca

SEQ ID NO: 573531 - DNA, 25 bp, Rattus norvegicus
ggcgaatcttctcgtcgtccgagtc

SEQ ID NO: 573532 - DNA, 25 bp, Rattus norvegicus
gcagcaggcgaatcttctcgtcgtc

SEQ ID NO: 573533 - DNA, 25 bp, Rattus norvegicus
tgcgcagcagcaggcgaatcttctc

SEQ ID NO: 573534 - DNA, 25 bp, Rattus norvegicus
tgcttgcgcagcagcaggcgaatct

SEQ ID NO: 573535 - DNA, 25 bp, Rattus norvegicus
cgcccaggctgagcacggagaaggc

SEQ ID NO: 573536 - DNA, 25 bp, Rattus norvegicus
cggcgtcacacgctgtgcgcgccca

SEQ ID NO: 573537 - DNA, 25 bp, Rattus norvegicus
cgctgtccacccagtggctccggga

SEQ ID NO: 573538 - DNA, 25 bp, Rattus norvegicus
atggcggagccggattgtgctgatt

SEQ ID NO: 573539 - DNA, 25 bp, Rattus norvegicus
gcgagaagagcctgccagtctctct

SEQ ID NO: 573540 - DNA, 25 bp, Rattus norvegicus
agcgagaagagcctgccagtctctc

SEQ ID NO: 573541 - DNA, 25 bp, Rattus norvegicus
gagagcgagaagagcctgccagtct

SEQ ID NO: 573542 - DNA, 25 bp, Rattus norvegicus
cagtggctccgggagagcgagaaga

SEQ ID NO: 573543 - DNA, 25 bp, Rattus norvegicus
gacaccccgaaagagcggcaggcga

SEQ ID NO: 573544 - DNA, 25 bp, Rattus norvegicus
cccggggctagagcgcgcgcgggct

SEQ ID NO: 573545 - DNA, 25 bp, Rattus norvegicus
ggtacgggcatggaggggcgtctgt

SEQ ID NO: 573546 - DNA, 25 bp, Rattus norvegicus
ggcgtctgtgctacttggaaggttt

SEQ ID NO: 573547 - DNA, 25 bp, Rattus norvegicus
gcggcaggcgaggaaggtgaccgct

SEQ ID NO: 573548 - DNA, 25 bp, Rattus norvegicus
tgtgtcccgacgacaccccgaaaga

SEQ ID NO: 573549 - DNA, 25 bp, Rattus norvegicus
gcgtctgtgctacttggaaggtttt

SEQ ID NO: 573550 - DNA, 25 bp, Rattus norvegicus
ggcgaggaaggtgaccgctgtccac

SEQ ID NO: 573551 - DNA, 25 bp, Rattus norvegicus
tgtggaccaccagccaaagtatctt

SEQ ID NO: 573552 - DNA, 25 bp, Rattus norvegicus
aacggctcccaggtcgatggctcct

SEQ ID NO: 573553 - DNA, 25 bp, Rattus norvegicus
ggccaggccgtgagaacggctccca

SEQ ID NO: 573554 - DNA, 25 bp, Rattus norvegicus
aagtatcttagagcaggccaggccg

SEQ ID NO: 573555 - DNA, 25 bp, Rattus norvegicus
agcgcggtggccttgtggaccacca

SEQ ID NO: 573556 - DNA, 25 bp, Rattus norvegicus
ccgacagccagaatctaaggggaca

SEQ ID NO: 573557 - DNA, 25 bp, Rattus norvegicus
ggacagtccgacagccagaatctaa

SEQ ID NO: 573558 - DNA, 25 bp, Rattus norvegicus
cctcagcggtccgaggacagtccga

SEQ ID NO: 573559 - DNA, 25 bp, Rattus norvegicus
tggcaaagtgtacggcctcagcggt

SEQ ID NO: 573560 - DNA, 25 bp, Rattus norvegicus
ttgtacaagagagtggcaaagtgta

SEQ ID NO: 573561 - DNA, 25 bp, Rattus norvegicus
actgccgtgagctctttgtacaaga

SEQ ID NO: 573562 - DNA, 25 bp, Rattus norvegicus
catgtagggaactgccgtgagctct

SEQ ID NO: 573563 - DNA, 25 bp, Rattus norvegicus
caaacttggccatgtagggaactgc

SEQ ID NO: 573564 - DNA, 25 bp, Rattus norvegicus
tcttggcgaaaatgacaaacttggc

SEQ ID NO: 573565 - DNA, 25 bp, Rattus norvegicus
ccacgacccggaaagttggcacgtg

SEQ ID NO: 573566 - DNA, 25 bp, Rattus norvegicus
gacaccggagctccctcggcgttat

SEQ ID NO: 573567 - DNA, 25 bp, Rattus norvegicus
agctccctcggcgttatctgctggg

SEQ ID NO: 573568 - DNA, 25 bp, Rattus norvegicus
cgcgcgggcaacttacgaggcatct

SEQ ID NO: 573569 - DNA, 25 bp, Rattus norvegicus
cttacgaggcatctggctaaaaata

SEQ ID NO: 573570 - DNA, 25 bp, Rattus norvegicus
ccgggtcattttcagtccattatcg

SEQ ID NO: 573571 - DNA, 25 bp, Rattus norvegicus
acgccaccgggtcattttcagtcca

SEQ ID NO: 573572 - DNA, 25 bp, Rattus norvegicus
attatcgcgtcaggcgggaaagagc

SEQ ID NO: 573573 - DNA, 25 bp, Rattus norvegicus
ctgaagccgggcacatgtggccaat

SEQ ID NO: 573574 - DNA, 25 bp, Rattus norvegicus
cacatgtggccaatgcgaccgagga

SEQ ID NO: 573575 - DNA, 25 bp, Rattus norvegicus
aatgcgaccgaggagctccaagctg

SEQ ID NO: 573576 - DNA, 25 bp, Rattus norvegicus
ggagctccaagctgcacagcgctct

SEQ ID NO: 573577 - DNA, 25 bp, Rattus norvegicus
catctggctaaaaatacagccgccc

SEQ ID NO: 573578 - DNA, 25 bp, Rattus norvegicus
ttcagtccattatcgcgtcaggcgg

SEQ ID NO: 573579 - DNA, 25 bp, Rattus norvegicus
gattttcttcagctgtttggccgcc

SEQ ID NO: 573580 - DNA, 25 bp, Rattus norvegicus
cggcaaaagttcctagggagcgcgc

SEQ ID NO: 573581 - DNA, 25 bp, Rattus norvegicus
cgggcctctgttcaaggtgctgaaa

SEQ ID NO: 573582 - DNA, 25 bp, Rattus norvegicus
ttcaaggtgctgaaaggagtctcgg

SEQ ID NO: 573583 - DNA, 25 bp, Rattus norvegicus
ttaccttcttcttgcggtcacggga

SEQ ID NO: 573584 - DNA, 25 bp, Rattus norvegicus
gtcacgggagcggttccgccgcttc

SEQ ID NO: 573585 - DNA, 25 bp, Rattus norvegicus
gccgcttcctgttggattcctcctt

SEQ ID NO: 573586 - DNA, 25 bp, Rattus norvegicus
tcctgttggattcctccttctcctt

SEQ ID NO: 573587 - DNA, 25 bp, Rattus norvegicus
tctccttctgctcctggagggcctg

SEQ ID NO: 573588 - DNA, 25 bp, Rattus norvegicus
cccagaggcggcaaaagttcctagg

SEQ ID NO: 573589 - DNA, 25 bp, Rattus norvegicus
cgcctcgatgtctttgattttcttc

SEQ ID NO: 573590 - DNA, 25 bp, Rattus norvegicus
ctgtttggccgcctgagccatggcg

SEQ ID NO: 573591 - DNA, 25 bp, Rattus norvegicus
cctcagctgcgcagggcacgagctt

SEQ ID NO: 573592 - DNA, 25 bp, Rattus norvegicus
gcctgcgcctcgatgtctttgattt

SEQ ID NO: 573593 - DNA, 25 bp, Rattus norvegicus
cgccgaaacccgtagctagtcagct

SEQ ID NO: 573594 - DNA, 25 bp, Rattus norvegicus
acccgtagctagtcagctgggagcg

SEQ ID NO: 573595 - DNA, 25 bp, Rattus norvegicus
ccgaagcagactccggggcggccta

SEQ ID NO: 573596 - DNA, 25 bp, Rattus norvegicus
ggaccgcggagatgccccaaactga

SEQ ID NO: 573597 - DNA, 25 bp, Rattus norvegicus
cccaaactgacacggccgccatctt

SEQ ID NO: 573598 - DNA, 25 bp, Rattus norvegicus
cgccatcttggagacagtgagctcc

SEQ ID NO: 573599 - DNA, 25 bp, Rattus norvegicus
cttggagacagtgagctccgactgg

SEQ ID NO: 573600 - DNA, 25 bp, Rattus norvegicus
tagctggaagagcaggctagtcgcc

SEQ ID NO: 573601 - DNA, 25 bp, Rattus norvegicus
gggcgtcgctcctcctttctcacgc

SEQ ID NO: 573602 - DNA, 25 bp, Rattus norvegicus
ttctcacgcgctgagatctggcgga

SEQ ID NO: 573603 - DNA, 25 bp, Rattus norvegicus
agcggaaggtgcacccggattacac

SEQ ID NO: 573604 - DNA, 25 bp, Rattus norvegicus
gcacccggattacacagccggggaa

SEQ ID NO: 573605 - DNA, 25 bp, Rattus norvegicus
ggcctagcctcaggctcggcagctg

SEQ ID NO: 573606 - DNA, 25 bp, Rattus norvegicus
agcgcgacgccgaaacccgtagcta

SEQ ID NO: 573607 - DNA, 25 bp, Rattus norvegicus
cgcaagtttctttttagccaggatg

SEQ ID NO: 573608 - DNA, 25 bp, Rattus norvegicus
ggaacttcccacagtcgctgttcta

SEQ ID NO: 573609 - DNA, 25 bp, Rattus norvegicus
tgcggaaaaagctcggtggaacttc

SEQ ID NO: 573610 - DNA, 25 bp, Rattus norvegicus
tttagccaggatgcttgggtccgga

SEQ ID NO: 573611 - DNA, 25 bp, Rattus norvegicus
cgcccagtccttagcggagtcgata

SEQ ID NO: 573612 - DNA, 25 bp, Rattus norvegicus
cggagtcgatactagcagagaggac

SEQ ID NO: 573613 - DNA, 25 bp, Rattus norvegicus
cgcaacccgagtgactccggcgaga

SEQ ID NO: 573614 - DNA, 25 bp, Rattus norvegicus
ccgtcagctggcttcaaaacaaaga

SEQ ID NO: 573615 - DNA, 25 bp, Rattus norvegicus
aaagagtcctttcagcggcttcaga

SEQ ID NO: 573616 - DNA, 25 bp, Rattus norvegicus
ttcagatgctggctcgtcgccatgg

SEQ ID NO: 573617 - DNA, 25 bp, Rattus norvegicus
ccgcctttgcggtggactagaaagg

SEQ ID NO: 573618 - DNA, 25 bp, Rattus norvegicus
gtcacacccgggaattcacagtaga

SEQ ID NO: 573619 - DNA, 25 bp, Rattus norvegicus
attcacagtagaagccgcaagtttc

SEQ ID NO: 573620 - DNA, 25 bp, Rattus norvegicus
cgctgttctagtggcgttcacattt

SEQ ID NO: 573621 - DNA, 25 bp, Rattus norvegicus
ctagaaccctgtacactgctcacgg

SEQ ID NO: 573622 - DNA, 25 bp, Rattus norvegicus
ttccagcatggttgccgaagactga

SEQ ID NO: 573623 - DNA, 25 bp, Rattus norvegicus
tccctaggctccaaaaaggcgtgcg

SEQ ID NO: 573624 - DNA, 25 bp, Rattus norvegicus
tcctcccagcgcaggtaaaggcggc

SEQ ID NO: 573625 - DNA, 25 bp, Rattus norvegicus
ttagactagggtttgtggcactacg

SEQ ID NO: 573626 - DNA, 25 bp, Rattus norvegicus
agcgacgacctttactcagggagga

SEQ ID NO: 573627 - DNA, 25 bp, Rattus norvegicus
cgacctggccagagcatagtgcacc

SEQ ID NO: 573628 - DNA, 25 bp, Rattus norvegicus
gctgaacctctgaaggcgacgattc

SEQ ID NO: 573629 - DNA, 25 bp, Rattus norvegicus
cgcgccatcaccaaggaggtaggtc

SEQ ID NO: 573630 - DNA, 25 bp, Rattus norvegicus
cttgcgaagtgcgataccgaaagca

SEQ ID NO: 573631 - DNA, 25 bp, Rattus norvegicus
gccgccctaacctgtggtgtcagtg

SEQ ID NO: 573632 - DNA, 25 bp, Rattus norvegicus
gacgattcgtcggacgccgccctaa

SEQ ID NO: 573633 - DNA, 25 bp, Rattus norvegicus
cagcgagctcaggtgttccagcatg

SEQ ID NO: 573634 - DNA, 25 bp, Rattus norvegicus
tagtgcaccggtcagtgctcctggc

SEQ ID NO: 573635 - DNA, 25 bp, Rattus norvegicus
caatcaacgtgccagcggtgaggag

SEQ ID NO: 573636 - DNA, 25 bp, Rattus norvegicus
cggcgatcaatcagagcgcaggagc

SEQ ID NO: 573637 - DNA, 25 bp, Rattus norvegicus
tggccaatcaacgtgccagcggtga

SEQ ID NO: 573638 - DNA, 25 bp, Rattus norvegicus
gaacggcgatcaatcagagcgcagg

SEQ ID NO: 573639 - DNA, 25 bp, Rattus norvegicus
gagctgtacgcagcgcgattgcgct

SEQ ID NO: 573640 - DNA, 25 bp, Rattus norvegicus
tacgcagcgcgattgcgctgccgcg

SEQ ID NO: 573641 - DNA, 25 bp, Rattus norvegicus
ccggaacggagcctgagacctggtc

SEQ ID NO: 573642 - DNA, 25 bp, Rattus norvegicus
acggagcctgagacctggtcgaagc

SEQ ID NO: 573643 - DNA, 25 bp, Rattus norvegicus
gcctgagacctggtcgaagctggta

SEQ ID NO: 573644 - DNA, 25 bp, Rattus norvegicus
cctgagacctggtcgaagctggtag

SEQ ID NO: 573645 - DNA, 25 bp, Rattus norvegicus
agacctggtcgaagctggtagggct

SEQ ID NO: 573646 - DNA, 25 bp, Rattus norvegicus
ttgggcgtcacctgggagagagacg

SEQ ID NO: 573647 - DNA, 25 bp, Rattus norvegicus
gagcggctggccaatcaacgtgcca

SEQ ID NO: 573648 - DNA, 25 bp, Rattus norvegicus
cgatcaatcagagcgcaggagcggc

SEQ ID NO: 573649 - DNA, 25 bp, Rattus norvegicus
gagcgcaaagggcacggccctaacg

SEQ ID NO: 573650 - DNA, 25 bp, Rattus norvegicus
attggacagcatcggccgccactcg

SEQ ID NO: 573651 - DNA, 25 bp, Rattus norvegicus
gttcccggaaatcgcgtgactcgcc

SEQ ID NO: 573652 - DNA, 25 bp, Rattus norvegicus
tgtttatgtccttcctgacgggttc

SEQ ID NO: 573653 - DNA, 25 bp, Rattus norvegicus
ctccatgctgcctcggtttgttttg

SEQ ID NO: 573654 - DNA, 25 bp, Rattus norvegicus
tgaaagcggttcaggcactaggtcc

SEQ ID NO: 573655 - DNA, 25 bp, Rattus norvegicus
tcggcactcacctgaggctgaaagc

SEQ ID NO: 573656 - DNA, 25 bp, Rattus norvegicus
ccgcgcgtgcccgtcttttatataa

SEQ ID NO: 573657 - DNA, 25 bp, Rattus norvegicus
tctgacaggccggttgccggcagtc

SEQ ID NO: 573658 - DNA, 25 bp, Rattus norvegicus
gacatataaacaaatcccgagaggg

SEQ ID NO: 573659 - DNA, 25 bp, Rattus norvegicus
tcaagctgcttagagaggacatata

SEQ ID NO: 573660 - DNA, 25 bp, Rattus norvegicus
gcctccggacctttcaagctgctta

SEQ ID NO: 573661 - DNA, 25 bp, Rattus norvegicus
atcggccgccactcgtcagcgaggg

SEQ ID NO: 573662 - DNA, 25 bp, Rattus norvegicus
ggccaatcgcaaggcgccctgaagt

SEQ ID NO: 573663 - DNA, 25 bp, Rattus norvegicus
ttttcatgtcctcagcgggtgtcgc

SEQ ID NO: 573664 - DNA, 25 bp, Rattus norvegicus
tttaagagccgtcaagtgcccgtga

SEQ ID NO: 573665 - DNA, 25 bp, Rattus norvegicus
gagccgtcaagtgcccgtgacgtca

SEQ ID NO: 573666 - DNA, 25 bp, Rattus norvegicus
gtgacgtcagggcaggaagtgtttg

SEQ ID NO: 573667 - DNA, 25 bp, Rattus norvegicus
aagtgtttgaggaagtggcgctgag

SEQ ID NO: 573668 - DNA, 25 bp, Rattus norvegicus
cccgagttttcatgtcctcagcggg

SEQ ID NO: 573669 - DNA, 25 bp, Rattus norvegicus
agttttcatgtcctcagcgggtgtc

SEQ ID NO: 573670 - DNA, 25 bp, Rattus norvegicus
ttcatgtcctcagcgggtgtcgcta

SEQ ID NO: 573671 - DNA, 25 bp, Rattus norvegicus
tcctcagcgggtgtcgctagcggcc

SEQ ID NO: 573672 - DNA, 25 bp, Rattus norvegicus
tgagtcccacgcgagggtggctcgt

SEQ ID NO: 573673 - DNA, 25 bp, Rattus norvegicus
gctcgtggccggtggaccggctcgc

SEQ ID NO: 573674 - DNA, 25 bp, Rattus norvegicus
ctgcaccgcgctcggtgcggtgcgg

SEQ ID NO: 573675 - DNA, 25 bp, Rattus norvegicus
cgagttttcatgtcctcagcgggtg

SEQ ID NO: 573676 - DNA, 25 bp, Rattus norvegicus
cgtcaagtgcccgtgacgtcagggc

SEQ ID NO: 573677 - DNA, 25 bp, Rattus norvegicus
gccattgttccaccggtaagacaca

SEQ ID NO: 573678 - DNA, 25 bp, Rattus norvegicus
gccgccctccgatccctctcctcag

SEQ ID NO: 573679 - DNA, 25 bp, Rattus norvegicus
ggccgccattgttccaccggtaaga

SEQ ID NO: 573680 - DNA, 25 bp, Rattus norvegicus
gacgtcaccgcgctgcgccctgtca

SEQ ID NO: 573681 - DNA, 25 bp, Rattus norvegicus
ttgttccaccggtaagacacaggtg

SEQ ID NO: 573682 - DNA, 25 bp, Rattus norvegicus
caccggtaagacacaggtgtgggtc

SEQ ID NO: 573683 - DNA, 25 bp, Rattus norvegicus
cccggcaccatgagcaaacgcaagg

SEQ ID NO: 573684 - DNA, 25 bp, Rattus norvegicus
cggcaccatgagcaaacgcaaggcc

SEQ ID NO: 573685 - DNA, 25 bp, Rattus norvegicus
caggagaccctcaacggcggcatca

SEQ ID NO: 573686 - DNA, 25 bp, Rattus norvegicus
caacggcggcatcacggacatgctc

SEQ ID NO: 573687 - DNA, 25 bp, Rattus norvegicus
gcatcacggacatgctcgtgggtga

SEQ ID NO: 573688 - DNA, 25 bp, Rattus norvegicus
acggacatgctcgtgggtgagtccc

SEQ ID NO: 573689 - DNA, 25 bp, Rattus norvegicus
agcgtctgtcctggacgccggtgga

SEQ ID NO: 573690 - DNA, 25 bp, Rattus norvegicus
tgcgccctgtcaggggccgccattg

SEQ ID NO: 573691 - DNA, 25 bp, Rattus norvegicus
cgggcacagcgaaggtcctcaagcc

SEQ ID NO: 573692 - DNA, 25 bp, Rattus norvegicus
tgcccggacccttctggtcgcctga

SEQ ID NO: 573693 - DNA, 25 bp, Rattus norvegicus
ccaccctcgggttgtaggtgaggcg

SEQ ID NO: 573694 - DNA, 25 bp, Rattus norvegicus
accttcagcgttgccttggtggagc

SEQ ID NO: 573695 - DNA, 25 bp, Rattus norvegicus
tggttcgagaagaccttcagcgttg

SEQ ID NO: 573696 - DNA, 25 bp, Rattus norvegicus
cggcgttggttcgagaagaccttca

SEQ ID NO: 573697 - DNA, 25 bp, Rattus norvegicus
agtagccgccctgggccgcgacctt

SEQ ID NO: 573698 - DNA, 25 bp, Rattus norvegicus
ttctcgcgagaacggcgcctccggg

SEQ ID NO: 573699 - DNA, 25 bp, Rattus norvegicus
ggctccggcacgttctcgcgagaac

SEQ ID NO: 573700 - DNA, 25 bp, Rattus norvegicus
gcccgcgcaccttcagggaacagta

SEQ ID NO: 573701 - DNA, 25 bp, Rattus norvegicus
cttcagggaacagtagccatggctc

SEQ ID NO: 573702 - DNA, 25 bp, Rattus norvegicus
gggaacagtagccatggctccggca

SEQ ID NO: 573703 - DNA, 25 bp, Rattus norvegicus
gaaggtcctcaagccctttcggcca

SEQ ID NO: 573704 - DNA, 25 bp, Rattus norvegicus
gccatttccacaacccgcgccggtc

SEQ ID NO: 573705 - DNA, 25 bp, Rattus norvegicus
tatgccacctggagcagattgcaca

SEQ ID NO: 573706 - DNA, 25 bp, Rattus norvegicus
tgacgaaggagaggtcgtccggtcc

SEQ ID NO: 573707 - DNA, 25 bp, Rattus norvegicus
cgactcccggaacagtccgagcgga

SEQ ID NO: 573708 - DNA, 25 bp, Rattus norvegicus
ctcccggaacagtccgagcggagcg

SEQ ID NO: 573709 - DNA, 25 bp, Rattus norvegicus
gcctccgcacctcagcagccgctga

SEQ ID NO: 573710 - DNA, 25 bp, Rattus norvegicus
cgtaccctgggcctgggtgtcttct

SEQ ID NO: 573711 - DNA, 25 bp, Rattus norvegicus
tgggtgtcttctgcaaacggagcga

SEQ ID NO: 573712 - DNA, 25 bp, Rattus norvegicus
tgtcttctgcaaacggagcgagcgg

SEQ ID NO: 573713 - DNA, 25 bp, Rattus norvegicus
ccgtcgcgggaggactgtcctgtat

SEQ ID NO: 573714 - DNA, 25 bp, Rattus norvegicus
tgtcctgtatgccacctggagcaga

SEQ ID NO: 573715 - DNA, 25 bp, Rattus norvegicus
cctggagcagattgcacaggctcgg

SEQ ID NO: 573716 - DNA, 25 bp, Rattus norvegicus
ccaggtttgggcgtctgatctatgt

SEQ ID NO: 573717 - DNA, 25 bp, Rattus norvegicus
gtctgatctatgtgccgcctctgcc

SEQ ID NO: 573718 - DNA, 25 bp, Rattus norvegicus
aggactgtcctgtatgccacctgga

SEQ ID NO: 573719 - DNA, 25 bp, Rattus norvegicus
ctcggcccaaggggttcgaccgatg

SEQ ID NO: 573720 - DNA, 25 bp, Rattus norvegicus
agcctcacctggtttgaccaccggg

SEQ ID NO: 573721 - DNA, 25 bp, Rattus norvegicus
cgcagctgcagcagtggttggcacc

SEQ ID NO: 573722 - DNA, 25 bp, Rattus norvegicus
gcgctccgcagctgcagcagtggtt

SEQ ID NO: 573723 - DNA, 25 bp, Rattus norvegicus
gttcgaccgatggtggtggcggcaa

SEQ ID NO: 573724 - DNA, 25 bp, Rattus norvegicus
gtcaggctgggtgacgcgctccgca

SEQ ID NO: 573725 - DNA, 25 bp, Rattus norvegicus
gcaagcggccttctgcctcccagct

SEQ ID NO: 573726 - DNA, 25 bp, Rattus norvegicus
cattgttctgggactactgggtagt

SEQ ID NO: 573727 - DNA, 25 bp, Rattus norvegicus
aacgcagcctcacctggtttgacca

SEQ ID NO: 573728 - DNA, 25 bp, Rattus norvegicus
aacagtagttgtgttggcattgttc

SEQ ID NO: 573729 - DNA, 25 bp, Rattus norvegicus
tgttggcattgttctgggactactg

SEQ ID NO: 573730 - DNA, 25 bp, Rattus norvegicus
agttatttctccctaggaacagtag

SEQ ID NO: 573731 - DNA, 25 bp, Rattus norvegicus
ttgcgaaacgcagcctcacctggtt

SEQ ID NO: 573732 - DNA, 25 bp, Rattus norvegicus
tctgggactactgggtagtttgaag

SEQ ID NO: 573733 - DNA, 25 bp, Rattus norvegicus
ctcctccagagggtgatgagcacgg

SEQ ID NO: 573734 - DNA, 25 bp, Rattus norvegicus
tgttgtacttctccgggtccggcga

SEQ ID NO: 573735 - DNA, 25 bp, Rattus norvegicus
tcaccacgttgttgtacttctccgg

SEQ ID NO: 573736 - DNA, 25 bp, Rattus norvegicus
ctgtgacggtcaccacgttgttgta

SEQ ID NO: 573737 - DNA, 25 bp, Rattus norvegicus
tgatgaacaagcacagggatatccc

SEQ ID NO: 573738 - DNA, 25 bp, Rattus norvegicus
ggggctctgccgaatctcctccaga

SEQ ID NO: 573739 - DNA, 25 bp, Rattus norvegicus
tcctcatccgagttcttccggaagc

SEQ ID NO: 573740 - DNA, 25 bp, Rattus norvegicus
cgcagatgttctcctcatccgagtt

SEQ ID NO: 573741 - DNA, 25 bp, Rattus norvegicus
gctcgctcagctcgcagatgttctc

SEQ ID NO: 573742 - DNA, 25 bp, Rattus norvegicus
catccgagaagcttccgcgaggctc

SEQ ID NO: 573743 - DNA, 25 bp, Rattus norvegicus
caccggtaagtcaacgggatgcccg

SEQ ID NO: 573744 - DNA, 25 bp, Rattus norvegicus
cgctgacgcactgcaccggtaagtc

SEQ ID NO: 573745 - DNA, 25 bp, Rattus norvegicus
aggcctcgtcctcaggaggcgctga

SEQ ID NO: 573746 - DNA, 25 bp, Rattus norvegicus
agggatatccctgtgacggtcacca

SEQ ID NO: 573747 - DNA, 25 bp, Rattus norvegicus
aaatgagaggagagcctcagcgacc

SEQ ID NO: 573748 - DNA, 25 bp, Rattus norvegicus
aaggtatgtcgcaacgctgagtttc

SEQ ID NO: 573749 - DNA, 25 bp, Rattus norvegicus
tcgcaacgctgagtttccaaacgtc

SEQ ID NO: 573750 - DNA, 25 bp, Rattus norvegicus
tgagtttccaaacgtcccaatctga

SEQ ID NO: 573751 - DNA, 25 bp, Rattus norvegicus
gtcccaatctgaactcctgcctatg

SEQ ID NO: 573752 - DNA, 25 bp, Rattus norvegicus
cctgcctatgtgagtcccgtcactg

SEQ ID NO: 573753 - DNA, 25 bp, Rattus norvegicus
tgtgagtcccgtcactgggccacgc

SEQ ID NO: 573754 - DNA, 25 bp, Rattus norvegicus
tgggccacctgcgattcggatcctt

SEQ ID NO: 573755 - DNA, 25 bp, Rattus norvegicus
tcggatccttacctctggtcgggtc

SEQ ID NO: 573756 - DNA, 25 bp, Rattus norvegicus
acctctggtcgggtctgtctggcac

SEQ ID NO: 573757 - DNA, 25 bp, Rattus norvegicus
ggcgtcaagcgcaagaggtctgccc

SEQ ID NO: 573758 - DNA, 25 bp, Rattus norvegicus
tgcacgcccagatccagagctctgg

SEQ ID NO: 573759 - DNA, 25 bp, Rattus norvegicus
agcctcagcgaccacagggtgactg

SEQ ID NO: 573760 - DNA, 25 bp, Rattus norvegicus
gtgactggccgagcatctccggtcc

SEQ ID NO: 573761 - DNA, 25 bp, Rattus norvegicus
tcgttgatctccaggaggccgctgg

SEQ ID NO: 573762 - DNA, 25 bp, Rattus norvegicus
tagcgcgctcgccacagggcggaac

SEQ ID NO: 573763 - DNA, 25 bp, Rattus norvegicus
ccacagggcggaactgggctgtccc

SEQ ID NO: 573764 - DNA, 25 bp, Rattus norvegicus
ctgagaccggccgagacctccgctc

SEQ ID NO: 573765 - DNA, 25 bp, Rattus norvegicus
ctccgccgtctaccgtgcagtggga

SEQ ID NO: 573766 - DNA, 25 bp, Rattus norvegicus
aggatgaggccctgcccagcacgag

SEQ ID NO: 573767 - DNA, 25 bp, Rattus norvegicus
cttcgccctaccttctcctcgccgt

SEQ ID NO: 573768 - DNA, 25 bp, Rattus norvegicus
ttctcctcgccgtcgtagacgcgca

SEQ ID NO: 573769 - DNA, 25 bp, Rattus norvegicus
agacgcgcactcctcgctgctggat

SEQ ID NO: 573770 - DNA, 25 bp, Rattus norvegicus
tcctcgctgctggatcaccagggtc

SEQ ID NO: 573771 - DNA, 25 bp, Rattus norvegicus
ccagggtctcgttgatctccaggag

SEQ ID NO: 573772 - DNA, 25 bp, Rattus norvegicus
ccaggaggccgctggtccacacgaa

SEQ ID NO: 573773 - DNA, 25 bp, Rattus norvegicus
tggtccacacgaagcggtccatggc

SEQ ID NO: 573774 - DNA, 25 bp, Rattus norvegicus
tgctggatcaccagggtctcgttga

SEQ ID NO: 573775 - DNA, 25 bp, Rattus norvegicus
gcagagtccaggaaacgctcccttg

SEQ ID NO: 573776 - DNA, 25 bp, Rattus norvegicus
cgcgcattaagagatggcagagtcc

SEQ ID NO: 573777 - DNA, 25 bp, Rattus norvegicus
gcgaggagtaccttgcgggttcctc

SEQ ID NO: 573778 - DNA, 25 bp, Rattus norvegicus
cagcggtttatcttcggggtccgag

SEQ ID NO: 573779 - DNA, 25 bp, Rattus norvegicus
ctgccggggtacagcggtttatctt

SEQ ID NO: 573780 - DNA, 25 bp, Rattus norvegicus
gcccggcgcttcagtggaagctgcc

SEQ ID NO: 573781 - DNA, 25 bp, Rattus norvegicus
cccgttttgagagcctaggccgctg

SEQ ID NO: 573782 - DNA, 25 bp, Rattus norvegicus
ggccgaagccgctagcccgttttga

SEQ ID NO: 573783 - DNA, 25 bp, Rattus norvegicus
ccttcagaggtgagcgatggcatgc

SEQ ID NO: 573784 - DNA, 25 bp, Rattus norvegicus
agaccagccggccttcagaggtgag

SEQ ID NO: 573785 - DNA, 25 bp, Rattus norvegicus
aggaaacgctcccttggccggcctg

SEQ ID NO: 573786 - DNA, 25 bp, Rattus norvegicus
gtccgttcaatccacgcaggcctga

SEQ ID NO: 573787 - DNA, 25 bp, Rattus norvegicus
tccgcgctcattggtccgttcaatc

SEQ ID NO: 573788 - DNA, 25 bp, Rattus norvegicus
cgaccaagagagaccagccggcctt

SEQ ID NO: 573789 - DNA, 25 bp, Rattus norvegicus
aaacccgctcgtgtacttggacgtg

SEQ ID NO: 573790 - DNA, 25 bp, Rattus norvegicus
gcacgcggcctaggtatcgcttcct

SEQ ID NO: 573791 - DNA, 25 bp, Rattus norvegicus
gacccgtacctgcagcgacggcgga

SEQ ID NO: 573792 - DNA, 25 bp, Rattus norvegicus
agcgatgctagctctgcgctgcggt

SEQ ID NO: 573793 - DNA, 25 bp, Rattus norvegicus
ccgacccgtgacagcgatgctagct

SEQ ID NO: 573794 - DNA, 25 bp, Rattus norvegicus
ctctgttgtgtctgctctgagttct

SEQ ID NO: 573795 - DNA, 25 bp, Rattus norvegicus
cctaggtatcgcttcctgggtcgta

SEQ ID NO: 573796 - DNA, 25 bp, Rattus norvegicus
gtctcgaagccagaggaccaataaa

SEQ ID NO: 573797 - DNA, 25 bp, Rattus norvegicus
gcaggggacactagagaaccagttc

SEQ ID NO: 573798 - DNA, 25 bp, Rattus norvegicus
tgccagatgcaaccagcaggggaca

SEQ ID NO: 573799 - DNA, 25 bp, Rattus norvegicus
ggatggggcacaaagcacgaactga

SEQ ID NO: 573800 - DNA, 25 bp, Rattus norvegicus
cacgaactgattgcgctgccagatg

SEQ ID NO: 573801 - DNA, 25 bp, Rattus norvegicus
accaataaaggcgatggcacgcggc

SEQ ID NO: 573802 - DNA, 25 bp, Rattus norvegicus
tgggtcgtacgacctctgttgtgtc

SEQ ID NO: 573803 - DNA, 25 bp, Rattus norvegicus
tgtcaacagaggctcacgtgaccgg

SEQ ID NO: 573804 - DNA, 25 bp, Rattus norvegicus
ctcggcgtaactcgcccgtcggact

SEQ ID NO: 573805 - DNA, 25 bp, Rattus norvegicus
gtagtcctccacacacgatccttct

SEQ ID NO: 573806 - DNA, 25 bp, Rattus norvegicus
acccggaagtgtcaacagaggctca

SEQ ID NO: 573807 - DNA, 25 bp, Rattus norvegicus
tcgtcccacccggaagtgtcaacag

SEQ ID NO: 573808 - DNA, 25 bp, Rattus norvegicus
ggagccgaaccagtccaccgcctca

SEQ ID NO: 573809 - DNA, 25 bp, Rattus norvegicus
gccgtggtatgccatgcctgcgacc

SEQ ID NO: 573810 - DNA, 25 bp, Rattus norvegicus
tcaaaggcacagtgaggccgtggta

SEQ ID NO: 573811 - DNA, 25 bp, Rattus norvegicus
gctcatcacgatcaaaggcacagtg

SEQ ID NO: 573812 - DNA, 25 bp, Rattus norvegicus
ccagaacacgctcatcacgatcaaa

SEQ ID NO: 573813 - DNA, 25 bp, Rattus norvegicus
accagggcacgaggaggcccacgaa

SEQ ID NO: 573814 - DNA, 25 bp, Rattus norvegicus
ccgcctcatcctccgccgtagtcct

SEQ ID NO: 573815 - DNA, 25 bp, Rattus norvegicus
ccttggggataaaccagggcacgag

SEQ ID NO: 573816 - DNA, 25 bp, Rattus norvegicus
acagtgaggccgtggtatgccatgc

SEQ ID NO: 573817 - DNA, 25 bp, Rattus norvegicus
cgcggccagaggagcaatagcagcc

SEQ ID NO: 573818 - DNA, 25 bp, Rattus norvegicus
ctggaaagtttgcatccaccatagc

SEQ ID NO: 573819 - DNA, 25 bp, Rattus norvegicus
ctacgggttggatttacggcagcac

SEQ ID NO: 573820 - DNA, 25 bp, Rattus norvegicus
cacactgtcgcacagagtcgggatc

SEQ ID NO: 573821 - DNA, 25 bp, Rattus norvegicus
gctcaagaagctgccggaaagtgtg

SEQ ID NO: 573822 - DNA, 25 bp, Rattus norvegicus
gggccaacgtcacgcgctcaagaag

SEQ ID NO: 573823 - DNA, 25 bp, Rattus norvegicus
gcgaactggaactgcgggccaacgt

SEQ ID NO: 573824 - DNA, 25 bp, Rattus norvegicus
cgggcgccacgtgcgaactggaact

SEQ ID NO: 573825 - DNA, 25 bp, Rattus norvegicus
cagaagaggtctcaggtacaccttc

SEQ ID NO: 573826 - DNA, 25 bp, Rattus norvegicus
cgcgtctggagcagaagaggtctca

SEQ ID NO: 573827 - DNA, 25 bp, Rattus norvegicus
tggcctccggatagtcttctcccta

SEQ ID NO: 573828 - DNA, 25 bp, Rattus norvegicus
tgagcaatggcctccggatagtctt

SEQ ID NO: 573829 - DNA, 25 bp, Rattus norvegicus
atctacgcggaactgagcaatggcc

SEQ ID NO: 573830 - DNA, 25 bp, Rattus norvegicus
acctgccgccgggacaaaggctagc

SEQ ID NO: 573831 - DNA, 25 bp, Rattus norvegicus
ctgtgcgcctgggtcgcggagctcg

SEQ ID NO: 573832 - DNA, 25 bp, Rattus norvegicus
cgcccacgccacaggtcccgcccat

SEQ ID NO: 573833 - DNA, 25 bp, Rattus norvegicus
ctcagccgccgcaggctgtgcgcct

SEQ ID NO: 573834 - DNA, 25 bp, Rattus norvegicus
gtggtgtactcagccgccgcaggct

SEQ ID NO: 573835 - DNA, 25 bp, Rattus norvegicus
aaatgtgggtggtgtactcagccgc

SEQ ID NO: 573836 - DNA, 25 bp, Rattus norvegicus
cgaaatgtgggtggtgtactcagcc

SEQ ID NO: 573837 - DNA, 25 bp, Rattus norvegicus
accgcgaaatgtgggtggtgtactc

SEQ ID NO: 573838 - DNA, 25 bp, Rattus norvegicus
agagccctaagacgccggtcggccg

SEQ ID NO: 573839 - DNA, 25 bp, Rattus norvegicus
cacagagccctaagacgccggtcgg

SEQ ID NO: 573840 - DNA, 25 bp, Rattus norvegicus
gcgggtggagcctctccacagagcc

SEQ ID NO: 573841 - DNA, 25 bp, Rattus norvegicus
agcgggtggagcctctccacagagc

SEQ ID NO: 573842 - DNA, 25 bp, Rattus norvegicus
ttggccgccgtggagagaggagcgg

SEQ ID NO: 573843 - DNA, 25 bp, Rattus norvegicus
caggcggctggcgaagaagcgacgc

SEQ ID NO: 573844 - DNA, 25 bp, Rattus norvegicus
cacgccacaggtcccgcccatgccc

SEQ ID NO: 573845 - DNA, 25 bp, Rattus norvegicus
gcagcgtgtacgcacctgcccgaag

SEQ ID NO: 573846 - DNA, 25 bp, Rattus norvegicus
ggcggcgagctaatcttccagtaca

SEQ ID NO: 573847 - DNA, 25 bp, Rattus norvegicus
ctgttcctccagtactcgtgactga

SEQ ID NO: 573848 - DNA, 25 bp, Rattus norvegicus
gctcctgagagagcgtgcgctgtta

SEQ ID NO: 573849 - DNA, 25 bp, Rattus norvegicus
cacttgggccacaccactgcggtgg

SEQ ID NO: 573850 - DNA, 25 bp, Rattus norvegicus
agcgcttgcctgttctactattcta

SEQ ID NO: 573851 - DNA, 25 bp, Rattus norvegicus
ccagtacagattccgctctttcaga

SEQ ID NO: 573852 - DNA, 25 bp, Rattus norvegicus
tctttcagaagtgtcggcgagtccc

SEQ ID NO: 573853 - DNA, 25 bp, Rattus norvegicus
aggaaccacggatgcgcgtcttcgc

SEQ ID NO: 573854 - DNA, 25 bp, Rattus norvegicus
tccctggcttgtaaagtcgctcttc

SEQ ID NO: 573855 - DNA, 25 bp, Rattus norvegicus
cgtttgtggggacaatgcctgaaca

SEQ ID NO: 573856 - DNA, 25 bp, Rattus norvegicus
agccaaagaggccagtcggaaagta

SEQ ID NO: 573857 - DNA, 25 bp, Rattus norvegicus
ctgcccgaagcgcaattttcctctg

SEQ ID NO: 573858 - DNA, 25 bp, Rattus norvegicus
ttcctgcaggtagccaaatagccgc

SEQ ID NO: 573859 - DNA, 25 bp, Rattus norvegicus
agcagcagctcggaagatgcacgcg

SEQ ID NO: 573860 - DNA, 25 bp, Rattus norvegicus
tgtgcggggcacacctgctaccgct

SEQ ID NO: 573861 - DNA, 25 bp, Rattus norvegicus
ctgctaccgctacatccctctccgc

SEQ ID NO: 573862 - DNA, 25 bp, Rattus norvegicus
ggcacacctgctaccgctacatccc

SEQ ID NO: 573863 - DNA, 25 bp, Rattus norvegicus
ggggcacacctgctaccgctacatc

SEQ ID NO: 573864 - DNA, 25 bp, Rattus norvegicus
gcggggcacacctgctaccgctaca

SEQ ID NO: 573865 - DNA, 25 bp, Rattus norvegicus
gtgcggggcacacctgctaccgcta

SEQ ID NO: 573866 - DNA, 25 bp, Rattus norvegicus
cccactccaccccagtgtgcggggc

SEQ ID NO: 573867 - DNA, 25 bp, Rattus norvegicus
agcccgcgagtgctcacccctctaa

SEQ ID NO: 573868 - DNA, 25 bp, Rattus norvegicus
agcgcgcgtgagtgcggcgcagccc

SEQ ID NO: 573869 - DNA, 25 bp, Rattus norvegicus
agcaaagcgcgcgtgagtgcggcgc

SEQ ID NO: 573870 - DNA, 25 bp, Rattus norvegicus
ctgcaggcggccgagcaaagcgcgc

SEQ ID NO: 573871 - DNA, 25 bp, Rattus norvegicus
ctcggaagatgcacgcggggctcct

SEQ ID NO: 573872 - DNA, 25 bp, Rattus norvegicus
ccctgctgcaggcggccgagcaaag

SEQ ID NO: 573873 - DNA, 25 bp, Rattus norvegicus
acacgaggatgctccctgcaagaca

SEQ ID NO: 573874 - DNA, 25 bp, Rattus norvegicus
tgttctcgtcacgacgcatgctcga

SEQ ID NO: 573875 - DNA, 25 bp, Rattus norvegicus
ttaccgacagctgcagtgtcttcgc

SEQ ID NO: 573876 - DNA, 25 bp, Rattus norvegicus
acatgtgctctgattggtccggtcc

SEQ ID NO: 573877 - DNA, 25 bp, Rattus norvegicus
cgacttatgggcgtaacatgtgctc

SEQ ID NO: 573878 - DNA, 25 bp, Rattus norvegicus
gagcctcctgattggtcgacttatg

SEQ ID NO: 573879 - DNA, 25 bp, Rattus norvegicus
ctcccaggtaataaggagcctcctg

SEQ ID NO: 573880 - DNA, 25 bp, Rattus norvegicus
cgcatagagtacgtgtggagcacca

SEQ ID NO: 573881 - DNA, 25 bp, Rattus norvegicus
cagtaaagccggtcgtccacgcgct

SEQ ID NO: 573882 - DNA, 25 bp, Rattus norvegicus
gcaccatgttctggtagacgcagta

SEQ ID NO: 573883 - DNA, 25 bp, Rattus norvegicus
tctcgaagaagaagagcaccatgtt

SEQ ID NO: 573884 - DNA, 25 bp, Rattus norvegicus
acgtgctcgccctgctgcaagtagc

SEQ ID NO: 573885 - DNA, 25 bp, Rattus norvegicus
tcagcctcagcaggacgttccagaa

SEQ ID NO: 573886 - DNA, 25 bp, Rattus norvegicus
gccacagcgtccaggccagcatgta

SEQ ID NO: 573887 - DNA, 25 bp, Rattus norvegicus
ccgcgacgatcacttcccttgtgtg

SEQ ID NO: 573888 - DNA, 25 bp, Rattus norvegicus
ctccggcgctgtttgaaggtcttct

SEQ ID NO: 573889 - DNA, 25 bp, Rattus norvegicus
aagctccggcgctgtttgaaggtct

SEQ ID NO: 573890 - DNA, 25 bp, Rattus norvegicus
ccggcgctgtttgaaggtcttctcg

SEQ ID NO: 573891 - DNA, 25 bp, Rattus norvegicus
ggcgctgtttgaaggtcttctcgga

SEQ ID NO: 573892 - DNA, 25 bp, Rattus norvegicus
cgctgtttgaaggtcttctcggacg

SEQ ID NO: 573893 - DNA, 25 bp, Rattus norvegicus
ctgtttgaaggtcttctcggacggc

SEQ ID NO: 573894 - DNA, 25 bp, Rattus norvegicus
gcgacgatcacttcccttgtgtgtc

SEQ ID NO: 573895 - DNA, 25 bp, Rattus norvegicus
cgacgatcacttcccttgtgtgtct

SEQ ID NO: 573896 - DNA, 25 bp, Rattus norvegicus
acgatcacttcccttgtgtgtctcc

SEQ ID NO: 573897 - DNA, 25 bp, Rattus norvegicus
cgagtcaggtgactcacggcgcatc

SEQ ID NO: 573898 - DNA, 25 bp, Rattus norvegicus
agtcaggtgactcacggcgcatcag

SEQ ID NO: 573899 - DNA, 25 bp, Rattus norvegicus
gccatgacaggcgtggcggaagctc

SEQ ID NO: 573900 - DNA, 25 bp, Rattus norvegicus
cggcccggagagaggccatgacagg

SEQ ID NO: 573901 - DNA, 25 bp, Rattus norvegicus
agcaaagacgtgagtccctcgcggg

SEQ ID NO: 573902 - DNA, 25 bp, Rattus norvegicus
gcgtgcgctcgggtcttcaaacctc

SEQ ID NO: 573903 - DNA, 25 bp, Rattus norvegicus
gtgtctagaggctctgcgtgcgctc

SEQ ID NO: 573904 - DNA, 25 bp, Rattus norvegicus
actcagcgcccggtgacccgggagt

SEQ ID NO: 573905 - DNA, 25 bp, Rattus norvegicus
agggcccgcgtctttgtcactcagc

SEQ ID NO: 573906 - DNA, 25 bp, Rattus norvegicus
gcacggaagctatcccggctggagt

SEQ ID NO: 573907 - DNA, 25 bp, Rattus norvegicus
ctcccgccggcgagtctacaagggg

SEQ ID NO: 573908 - DNA, 25 bp, Rattus norvegicus
ggctccgtgacacacaacagcaaag

SEQ ID NO: 573909 - DNA, 25 bp, Rattus norvegicus
tctccgagagctccaggctccgtga

SEQ ID NO: 573910 - DNA, 25 bp, Rattus norvegicus
ggtgtcctttttcctctccgagagc

SEQ ID NO: 573911 - DNA, 25 bp, Rattus norvegicus
tgtgcaagggcttcggtgtcctttt

SEQ ID NO: 573912 - DNA, 25 bp, Rattus norvegicus
accagagcagatgccgcgggaacga

SEQ ID NO: 573913 - DNA, 25 bp, Rattus norvegicus
gaggcctccatgaccagagcagatg

SEQ ID NO: 573914 - DNA, 25 bp, Rattus norvegicus
gcttcaggtcgctggtcagcgtcgc

SEQ ID NO: 573915 - DNA, 25 bp, Rattus norvegicus
tagttgaagagcacgcagagtccgc

SEQ ID NO: 573916 - DNA, 25 bp, Rattus norvegicus
cgcccgccacgaagaggtagttgaa

SEQ ID NO: 573917 - DNA, 25 bp, Rattus norvegicus
caaaacacctggtccgacgggcgcg

SEQ ID NO: 573918 - DNA, 25 bp, Rattus norvegicus
ccagcagtcggtgaccgggttgtaa

SEQ ID NO: 573919 - DNA, 25 bp, Rattus norvegicus
agccagcagctgcacttgcgagcgc

SEQ ID NO: 573920 - DNA, 25 bp, Rattus norvegicus
cccaaggcatataggtggccgtcca

SEQ ID NO: 573921 - DNA, 25 bp, Rattus norvegicus
cagctcgagggtcatagcgctccac

SEQ ID NO: 573922 - DNA, 25 bp, Rattus norvegicus
ggcctccgcctggtagcaataaacc

SEQ ID NO: 573923 - DNA, 25 bp, Rattus norvegicus
cacctccagatagtggtcgcacatg

SEQ ID NO: 573924 - DNA, 25 bp, Rattus norvegicus
tcgtagcagttgtccaggctcagct

SEQ ID NO: 573925 - DNA, 25 bp, Rattus norvegicus
acctcgatgaccaagtcgggctctc

SEQ ID NO: 573926 - DNA, 25 bp, Rattus norvegicus
cgcagggcagtgaagctcacgcctt

SEQ ID NO: 573927 - DNA, 25 bp, Rattus norvegicus
ttatgagcccgcaaccggcgacctg

SEQ ID NO: 573928 - DNA, 25 bp, Rattus norvegicus
tcgtctaaagactcgagctccacgg

SEQ ID NO: 573929 - DNA, 25 bp, Rattus norvegicus
taacccattccaggccgagtgaaca

SEQ ID NO: 573930 - DNA, 25 bp, Rattus norvegicus
cgcccggcgcttgtcttagagcaac

SEQ ID NO: 573931 - DNA, 25 bp, Rattus norvegicus
aagctgggagctcgctcttggtagc

SEQ ID NO: 573932 - DNA, 25 bp, Rattus norvegicus
gggtcctccaaaccatgtccatatt

SEQ ID NO: 573933 - DNA, 25 bp, Rattus norvegicus
ggctctatgagccaaggctccctga

SEQ ID NO: 573934 - DNA, 25 bp, Rattus norvegicus
gctccctgaaccaatactgtgactg

SEQ ID NO: 573935 - DNA, 25 bp, Rattus norvegicus
ggtctgacacgcatgcgcacgcgac

SEQ ID NO: 573936 - DNA, 25 bp, Rattus norvegicus
tgtgactgtgtcacggcccacgcat

SEQ ID NO: 573937 - DNA, 25 bp, Rattus norvegicus
tgagccagtcctccgcggatctcgt

SEQ ID NO: 573938 - DNA, 25 bp, Rattus norvegicus
tgtccatattccgagctagctagcg

SEQ ID NO: 573939 - DNA, 25 bp, Rattus norvegicus
aggttcctccatcgttccggaatca

SEQ ID NO: 573940 - DNA, 25 bp, Rattus norvegicus
agatgctgcgcgctttcccaatgcc

SEQ ID NO: 573941 - DNA, 25 bp, Rattus norvegicus
caaccactgggttggcagcagccga

SEQ ID NO: 573942 - DNA, 25 bp, Rattus norvegicus
agccgattactcctgcgtgtgccct

SEQ ID NO: 573943 - DNA, 25 bp, Rattus norvegicus
caaatgtctaggaggcggaacaacc

SEQ ID NO: 573944 - DNA, 25 bp, Rattus norvegicus
actggcccgcaaagtgcagtctgca

SEQ ID NO: 573945 - DNA, 25 bp, Rattus norvegicus
gacggaaaatcaacgccacactggc

SEQ ID NO: 573946 - DNA, 25 bp, Rattus norvegicus
cctgaggttatctccgaacaaatgc

SEQ ID NO: 573947 - DNA, 25 bp, Rattus norvegicus
tgctgccagaaaccgccgttcctga

SEQ ID NO: 573948 - DNA, 25 bp, Rattus norvegicus
ctgaagagtgtgaaaagctgctgcc

SEQ ID NO: 573949 - DNA, 25 bp, Rattus norvegicus
cgtcccgtctgtatggcatgctgta

SEQ ID NO: 573950 - DNA, 25 bp, Rattus norvegicus
ggaacaaccgtctcgctgctgaaga

SEQ ID NO: 573951 - DNA, 25 bp, Rattus norvegicus
gaatggcaactcgagggagacgtta

SEQ ID NO: 573952 - DNA, 25 bp, Rattus norvegicus
cccaaccgcgagaagcagagcaaat

SEQ ID NO: 573953 - DNA, 25 bp, Rattus norvegicus
gtgccaagggcacgggtgcacccaa

SEQ ID NO: 573954 - DNA, 25 bp, Rattus norvegicus
agcgggcgtctaacccatcaagtta

SEQ ID NO: 573955 - DNA, 25 bp, Rattus norvegicus
ttagcgcctcaaagggccggcatcc

SEQ ID NO: 573956 - DNA, 25 bp, Rattus norvegicus
cttcacgatgagacgcgccgtgcca

SEQ ID NO: 573957 - DNA, 25 bp, Rattus norvegicus
ccgtgcaccggggtcgcgtttgcac

SEQ ID NO: 573958 - DNA, 25 bp, Rattus norvegicus
gccactcgccactcgcctcccgccg

SEQ ID NO: 573959 - DNA, 25 bp, Rattus norvegicus
agccggcccgacactcgccactcgc

SEQ ID NO: 573960 - DNA, 25 bp, Rattus norvegicus
ccgccgagccggtgggagcgttcca

SEQ ID NO: 573961 - DNA, 25 bp, Rattus norvegicus
tcaaagggcatcgtgccgccgagcc

SEQ ID NO: 573962 - DNA, 25 bp, Rattus norvegicus
gagtcaaagggcatcgtgccgccga

SEQ ID NO: 573963 - DNA, 25 bp, Rattus norvegicus
tcctggagtcaaagggcatcgtgcc

SEQ ID NO: 573964 - DNA, 25 bp, Rattus norvegicus
cctcctggagtcaaagggcatcgtg

SEQ ID NO: 573965 - DNA, 25 bp, Rattus norvegicus
cctctagggcctgccgaggcgtgca

SEQ ID NO: 573966 - DNA, 25 bp, Rattus norvegicus
aagtgacgctccgcgcagcccattg

SEQ ID NO: 573967 - DNA, 25 bp, Rattus norvegicus
gtcgtcgccggctgcaaagggcctc

SEQ ID NO: 573968 - DNA, 25 bp, Rattus norvegicus
tcacctcctggagtcaaagggcatc

SEQ ID NO: 573969 - DNA, 25 bp, Rattus norvegicus
ctgccgaggcgtgcaccgtgcaccg

SEQ ID NO: 573970 - DNA, 25 bp, Rattus norvegicus
acgctccgcgcagcccattgggcgc

SEQ ID NO: 573971 - DNA, 25 bp, Rattus norvegicus
tcatccaccctctgtgagacactgg

SEQ ID NO: 573972 - DNA, 25 bp, Rattus norvegicus
ccctctgtgagacactgggagttgc

SEQ ID NO: 573973 - DNA, 25 bp, Rattus norvegicus
aagacaggcactccacccagcgtga

SEQ ID NO: 573974 - DNA, 25 bp, Rattus norvegicus
tgcttgctccctgtagatcccggta

SEQ ID NO: 573975 - DNA, 25 bp, Rattus norvegicus
tgtagatcccggtataggctcctgc

SEQ ID NO: 573976 - DNA, 25 bp, Rattus norvegicus
tcccggtataggctcctgcgggaag

SEQ ID NO: 573977 - DNA, 25 bp, Rattus norvegicus
aggaaggacaccagcttgcagtgcc

SEQ ID NO: 573978 - DNA, 25 bp, Rattus norvegicus
tagggtctccgtgctcactcaccga

SEQ ID NO: 573979 - DNA, 25 bp, Rattus norvegicus
acctacctctccatgattggccgga

SEQ ID NO: 573980 - DNA, 25 bp, Rattus norvegicus
ctctccatgattggccggaacaggc

SEQ ID NO: 573981 - DNA, 25 bp, Rattus norvegicus
aacaggcggtgcctcgtgcccactg

SEQ ID NO: 573982 - DNA, 25 bp, Rattus norvegicus
ggagggatgctacctaccttgcgcc

SEQ ID NO: 573983 - DNA, 25 bp, Rattus norvegicus
acgggacgtagggtctccgtgctca

SEQ ID NO: 573984 - DNA, 25 bp, Rattus norvegicus
agactcctggtcactggggaatggc

SEQ ID NO: 573985 - DNA, 25 bp, Rattus norvegicus
cacacgagaaacttcgggaggcgga

SEQ ID NO: 573986 - DNA, 25 bp, Rattus norvegicus
gccctgaacatgaccgaggcctcaa

SEQ ID NO: 573987 - DNA, 25 bp, Rattus norvegicus
caggtagactggtgttcctagaggc

SEQ ID NO: 573988 - DNA, 25 bp, Rattus norvegicus
ttcctagaggcagtacaaacgtccc

SEQ ID NO: 573989 - DNA, 25 bp, Rattus norvegicus
aagtcccgtggaccgagtagcaaga

SEQ ID NO: 573990 - DNA, 25 bp, Rattus norvegicus
caagactggattgcagcgccacagt

SEQ ID NO: 573991 - DNA, 25 bp, Rattus norvegicus
tggcgaaagccgacagacccagagc

SEQ ID NO: 573992 - DNA, 25 bp, Rattus norvegicus
agcttggtcgactccgccaatcaga

SEQ ID NO: 573993 - DNA, 25 bp, Rattus norvegicus
ccaatcagaatgtggcgggactctc

SEQ ID NO: 573994 - DNA, 25 bp, Rattus norvegicus
gggactctcagactgtccaatcaga

SEQ ID NO: 573995 - DNA, 25 bp, Rattus norvegicus
caatcagagtgctgtttgagcgcgc

SEQ ID NO: 573996 - DNA, 25 bp, Rattus norvegicus
ctgaagaagcctgcgcacgcgccta

SEQ ID NO: 573997 - DNA, 25 bp, Rattus norvegicus
acgcgcctacattgagcacacgaga

SEQ ID NO: 573998 - DNA, 25 bp, Rattus norvegicus
ttcccaggcactcgctgaagagctc

SEQ ID NO: 573999 - DNA, 25 bp, Rattus norvegicus
cgcacgcgcactgctgaagacaaca

SEQ ID NO: 574000 - DNA, 25 bp, Rattus norvegicus
tgcgtggcacctgtgactaggaccc

SEQ ID NO: 574001 - DNA, 25 bp, Rattus norvegicus
tggcgcacagggtttgggccatccc

SEQ ID NO: 574002 - DNA, 25 bp, Rattus norvegicus
agagaaatcacccacgacactgtcg

SEQ ID NO: 574003 - DNA, 25 bp, Rattus norvegicus
cactgtcgcgcgctgagcaaacact

SEQ ID NO: 574004 - DNA, 25 bp, Rattus norvegicus
gcaaacactgtctactgcgcacgcg

SEQ ID NO: 574005 - DNA, 25 bp, Rattus norvegicus
aggggtgcggaccatcccatccagc

SEQ ID NO: 574006 - DNA, 25 bp, Rattus norvegicus
cgcactgctgaagacaacagaccta

SEQ ID NO: 574007 - DNA, 25 bp, Rattus norvegicus
tgaagacaacagacctaagcctcgc

SEQ ID NO: 574008 - DNA, 25 bp, Rattus norvegicus
tccctaggacactaccaaggcagtc

SEQ ID NO: 574009 - DNA, 25 bp, Rattus norvegicus
ggacactaccaaggcagtctcaggg

SEQ ID NO: 574010 - DNA, 25 bp, Rattus norvegicus
agtctcaggggtgcggaccatccca

SEQ ID NO: 574011 - DNA, 25 bp, Rattus norvegicus
tgagccgtagacacaccccgtgaca

SEQ ID NO: 574012 - DNA, 25 bp, Rattus norvegicus
gcgcgctgagcaaacactgtctact

SEQ ID NO: 574013 - DNA, 25 bp, Rattus norvegicus
agaatccttgggtctgtgcgtcgat

SEQ ID NO: 574014 - DNA, 25 bp, Rattus norvegicus
tgcgtcgatccgcagtctgtctgtc

SEQ ID NO: 574015 - DNA, 25 bp, Rattus norvegicus
ctcgcacttggagagcccagcagcg

SEQ ID NO: 574016 - DNA, 25 bp, Rattus norvegicus
agcgtgttcctaggagcctcctacc

SEQ ID NO: 574017 - DNA, 25 bp, Rattus norvegicus
accagccgccctggggttattctca

SEQ ID NO: 574018 - DNA, 25 bp, Rattus norvegicus
aatgcagccacctaggcagggccca

SEQ ID NO: 574019 - DNA, 25 bp, Rattus norvegicus
cagctcccaagcttgagaatccttg

SEQ ID NO: 574020 - DNA, 25 bp, Rattus norvegicus
ctgggtagcgcttcgcttagcaacc

SEQ ID NO: 574021 - DNA, 25 bp, Rattus norvegicus
gcgacggctgttgcaaagggcacaa

SEQ ID NO: 574022 - DNA, 25 bp, Rattus norvegicus
accttcctcagagcggacatccttg

SEQ ID NO: 574023 - DNA, 25 bp, Rattus norvegicus
ttacaaaaccctgcgctgggtagcg

SEQ ID NO: 574024 - DNA, 25 bp, Rattus norvegicus
tctgcgatcgttagggaaagagccc

SEQ ID NO: 574025 - DNA, 25 bp, Rattus norvegicus
cgccgcgcagggctgtaataattac

SEQ ID NO: 574026 - DNA, 25 bp, Rattus norvegicus
atccttgggctttcctagttcagtg

SEQ ID NO: 574027 - DNA, 25 bp, Rattus norvegicus
atcccggccgggatccagtatgtct

SEQ ID NO: 574028 - DNA, 25 bp, Rattus norvegicus
gcgaaacgcgaacggagactggatc

SEQ ID NO: 574029 - DNA, 25 bp, Rattus norvegicus
cttctcttcggaagcagggtaggca

SEQ ID NO: 574030 - DNA, 25 bp, Rattus norvegicus
cgggcctacacgagaggaatccgga

SEQ ID NO: 574031 - DNA, 25 bp, Rattus norvegicus
gtccggattaggcactccgaatgtt

SEQ ID NO: 574032 - DNA, 25 bp, Rattus norvegicus
ctcctagaggcagagtttaagccac

SEQ ID NO: 574033 - DNA, 25 bp, Rattus norvegicus
aagagcagagcttaggcggtcacca

SEQ ID NO: 574034 - DNA, 25 bp, Rattus norvegicus
ccagctgtatcttggcccatgtcca

SEQ ID NO: 574035 - DNA, 25 bp, Rattus norvegicus
ccaagttccgcaagggtgcagagcc

SEQ ID NO: 574036 - DNA, 25 bp, Rattus norvegicus
caggcatctgggagaccttgtcttg

SEQ ID NO: 574037 - DNA, 25 bp, Rattus norvegicus
cgcgcggaaccaacagcaggcatct

SEQ ID NO: 574038 - DNA, 25 bp, Rattus norvegicus
acaagggtttcagcgatgtaacatc

SEQ ID NO: 574039 - DNA, 25 bp, Rattus norvegicus
ttgtcttgcctcaagcttccaagtc

SEQ ID NO: 574040 - DNA, 25 bp, Rattus norvegicus
cgagggcgaagagtcattatcaaca

SEQ ID NO: 574041 - DNA, 25 bp, Rattus norvegicus
acctcggcgttgccgtggtgatcca

SEQ ID NO: 574042 - DNA, 25 bp, Rattus norvegicus
gccgccggtgtgaaatgtcacgtgg

SEQ ID NO: 574043 - DNA, 25 bp, Rattus norvegicus
cgcccatcgggctgggtgagcggtg

SEQ ID NO: 574044 - DNA, 25 bp, Rattus norvegicus
caggatggaccacgcccatcgggct

SEQ ID NO: 574045 - DNA, 25 bp, Rattus norvegicus
tccaggatggaccacgcccatcggg

SEQ ID NO: 574046 - DNA, 25 bp, Rattus norvegicus
tgatccaggatggaccacgcccatc

SEQ ID NO: 574047 - DNA, 25 bp, Rattus norvegicus
ggtgatccaggatggaccacgccca

SEQ ID NO: 574048 - DNA, 25 bp, Rattus norvegicus
tggtgatccaggatggaccacgccc

SEQ ID NO: 574049 - DNA, 25 bp, Rattus norvegicus
ttgccgtggtgatccaggatggacc

SEQ ID NO: 574050 - DNA, 25 bp, Rattus norvegicus
tgcgtattgcgtggccccacctcgg

SEQ ID NO: 574051 - DNA, 25 bp, Rattus norvegicus
cgagcatgcgtattgcgtggcccca

SEQ ID NO: 574052 - DNA, 25 bp, Rattus norvegicus
ccgtagcaccaacggggcgagcatg

SEQ ID NO: 574053 - DNA, 25 bp, Rattus norvegicus
atgtcacgtgggttttgtgcgcccg

SEQ ID NO: 574054 - DNA, 25 bp, Rattus norvegicus
gccgtggtgatccaggatggaccac

SEQ ID NO: 574055 - DNA, 25 bp, Rattus norvegicus
aagctgagccgaagtcgagtgcttc

SEQ ID NO: 574056 - DNA, 25 bp, Rattus norvegicus
tcgctctactgccacaagggctcta

SEQ ID NO: 574057 - DNA, 25 bp, Rattus norvegicus
cgagcggacaagcacccgagatgtg

SEQ ID NO: 574058 - DNA, 25 bp, Rattus norvegicus
acccgagatgtggaagctgagccga

SEQ ID NO: 574059 - DNA, 25 bp, Rattus norvegicus
aagtcgagtgcttctggacgagccc

SEQ ID NO: 574060 - DNA, 25 bp, Rattus norvegicus
cgcatctccgggctgcgaggagact

SEQ ID NO: 574061 - DNA, 25 bp, Rattus norvegicus
agttggcagggacccgacgcatctc

SEQ ID NO: 574062 - DNA, 25 bp, Rattus norvegicus
attaatgcccggatcctgcaggtcc

SEQ ID NO: 574063 - DNA, 25 bp, Rattus norvegicus
ggctctagggttcggcctgagacac

SEQ ID NO: 574064 - DNA, 25 bp, Rattus norvegicus
tgaccgcttccaggccaggtatttc

SEQ ID NO: 574065 - DNA, 25 bp, Rattus norvegicus
ggccaggtatttctattccggagtg

SEQ ID NO: 574066 - DNA, 25 bp, Rattus norvegicus
tctattccggagtgggagagacaga

SEQ ID NO: 574067 - DNA, 25 bp, Rattus norvegicus
agaagtcctgaatcatggtgcccgg

SEQ ID NO: 574068 - DNA, 25 bp, Rattus norvegicus
ccggaggacacctttgattaatgcc

SEQ ID NO: 574069 - DNA, 25 bp, Rattus norvegicus
cgcggagccacgtgatttgtgttgc

SEQ ID NO: 574070 - DNA, 25 bp, Rattus norvegicus
gtgcctatcggtgagcgcacacgca

SEQ ID NO: 574071 - DNA, 25 bp, Rattus norvegicus
agcgcacacgcaggcctgaaggatg

SEQ ID NO: 574072 - DNA, 25 bp, Rattus norvegicus
aggcctgaaggatggtgcacacaca

SEQ ID NO: 574073 - DNA, 25 bp, Rattus norvegicus
tgcacacacaggtgtgctccggagg

SEQ ID NO: 574074 - DNA, 25 bp, Rattus norvegicus
cacggacccgcaggggacacagaca

SEQ ID NO: 574075 - DNA, 25 bp, Rattus norvegicus
ctacgggtcccttccagacgagaca

SEQ ID NO: 574076 - DNA, 25 bp, Rattus norvegicus
tgcacccagctgcagcgtccaatta

SEQ ID NO: 574077 - DNA, 25 bp, Rattus norvegicus
tacccgaactcggagacctctgtgc

SEQ ID NO: 574078 - DNA, 25 bp, Rattus norvegicus
atttgtgttgctacccgaactcgga

SEQ ID NO: 574079 - DNA, 25 bp, Rattus norvegicus
ttccagacgagacagccaccaactg

SEQ ID NO: 574080 - DNA, 25 bp, Rattus norvegicus
cgtccaattattgccggaagccgtc

SEQ ID NO: 574081 - DNA, 25 bp, Rattus norvegicus
gaactcggagacctctgtgcgcgcg

SEQ ID NO: 574082 - DNA, 25 bp, Rattus norvegicus
attattgccggaagccgtccgcctc

SEQ ID NO: 574083 - DNA, 25 bp, Rattus norvegicus
agaacaccggggcttctcgggagct

SEQ ID NO: 574084 - DNA, 25 bp, Rattus norvegicus
tggacccgagccctaggctgtggct

SEQ ID NO: 574085 - DNA, 25 bp, Rattus norvegicus
gaaacgcgcgtggacccgagcccta

SEQ ID NO: 574086 - DNA, 25 bp, Rattus norvegicus
cgcgcagagcctgtccggtaacggc

SEQ ID NO: 574087 - DNA, 25 bp, Rattus norvegicus
tgaatgcaaagaacgcggagctggc

SEQ ID NO: 574088 - DNA, 25 bp, Rattus norvegicus
gagagaccgctcacccgggaaacgc

SEQ ID NO: 574089 - DNA, 25 bp, Rattus norvegicus
gagctcctgcgggagtgaatgcaaa

SEQ ID NO: 574090 - DNA, 25 bp, Rattus norvegicus
tcctgcgggagtgaatgcaaagaac

SEQ ID NO: 574091 - DNA, 25 bp, Rattus norvegicus
agtgcgcgcagagcctgtccggtaa

SEQ ID NO: 574092 - DNA, 25 bp, Rattus norvegicus
aacaacgcaggtgggcgtgtcgtcc

SEQ ID NO: 574093 - DNA, 25 bp, Rattus norvegicus
agcctgtcagccgtcacgtgtcgga

SEQ ID NO: 574094 - DNA, 25 bp, Rattus norvegicus
agccgtcacgtgtcggagcgtcccg

SEQ ID NO: 574095 - DNA, 25 bp, Rattus norvegicus
ccggcatggaccctcaggcagccac

SEQ ID NO: 574096 - DNA, 25 bp, Rattus norvegicus
cgcgaccacccgggctggaagtcga

SEQ ID NO: 574097 - DNA, 25 bp, Rattus norvegicus
gacgaccatcactcaggtgctgcca

SEQ ID NO: 574098 - DNA, 25 bp, Rattus norvegicus
gcagccaccacctcgaagtaatcgt

SEQ ID NO: 574099 - DNA, 25 bp, Rattus norvegicus
gccattcctaacgtgggcgtgcact

SEQ ID NO: 574100 - DNA, 25 bp, Rattus norvegicus
ggacgcagttgctcttccagctgct

SEQ ID NO: 574101 - DNA, 25 bp, Rattus norvegicus
cggaggacaacctgcgacgaccatc

SEQ ID NO: 574102 - DNA, 25 bp, Rattus norvegicus
atcccggggaatgcgactcccattg

SEQ ID NO: 574103 - DNA, 25 bp, Rattus norvegicus
ctcccattggggagcttcccagatc

SEQ ID NO: 574104 - DNA, 25 bp, Rattus norvegicus
tggggaccgccgctccttaatccta

SEQ ID NO: 574105 - DNA, 25 bp, Rattus norvegicus
ggcttaaagccgtcctctcgcgaga

SEQ ID NO: 574106 - DNA, 25 bp, Rattus norvegicus
aatgggtctctgctccggacagttt

SEQ ID NO: 574107 - DNA, 25 bp, Rattus norvegicus
cgagcacgaagcctcgcgaggacta

SEQ ID NO: 574108 - DNA, 25 bp, Rattus norvegicus
cagcgcccgtgaacttcctaggata

SEQ ID NO: 574109 - DNA, 25 bp, Rattus norvegicus
ggaaatcagtgctgccgctccgaga

SEQ ID NO: 574110 - DNA, 25 bp, Rattus norvegicus
ttccagctgctctttggtgaggccc

SEQ ID NO: 574111 - DNA, 25 bp, Rattus norvegicus
ggctcagtgaacgtgcgcttcagca

SEQ ID NO: 574112 - DNA, 25 bp, Rattus norvegicus
gagaagcgcgctccactcaagtctt

SEQ ID NO: 574113 - DNA, 25 bp, Rattus norvegicus
ggcctggagcatatcgtgccgaaca

SEQ ID NO: 574114 - DNA, 25 bp, Rattus norvegicus
ttcaacgccggccacatcgtgggct

SEQ ID NO: 574115 - DNA, 25 bp, Rattus norvegicus
gattgtcgctccttcttcgccttca

SEQ ID NO: 574116 - DNA, 25 bp, Rattus norvegicus
agtgcctgcttctggattgtcgctc

SEQ ID NO: 574117 - DNA, 25 bp, Rattus norvegicus
ccgcacaagatcgacagactatttc

SEQ ID NO: 574118 - DNA, 25 bp, Rattus norvegicus
gccagattaggatcagcgagcactt

SEQ ID NO: 574119 - DNA, 25 bp, Rattus norvegicus
cgaaccagcgcgcagcaaaggactg

SEQ ID NO: 574120 - DNA, 25 bp, Rattus norvegicus
cgatgacgtctttgcttttggcttt

SEQ ID NO: 574121 - DNA, 25 bp, Rattus norvegicus
agcgggcccaactgagaccgtgatc

SEQ ID NO: 574122 - DNA, 25 bp, Rattus norvegicus
aagtcttcttcctccaaggtacgcg

SEQ ID NO: 574123 - DNA, 25 bp, Rattus norvegicus
gcacttgaggatttagggccacaaa

SEQ ID NO: 574124 - DNA, 25 bp, Rattus norvegicus
tcacgccgtagtgctgctggacgaa

SEQ ID NO: 574125 - DNA, 25 bp, Rattus norvegicus
cagtcgtgcgcaggaacttctttcc

SEQ ID NO: 574126 - DNA, 25 bp, Rattus norvegicus
tgctcctagtatccggcccagctgg

SEQ ID NO: 574127 - DNA, 25 bp, Rattus norvegicus
cgaccaatggggtgcagtgtttgac

SEQ ID NO: 574128 - DNA, 25 bp, Rattus norvegicus
tgcagagccttagccaatgaagatc

SEQ ID NO: 574129 - DNA, 25 bp, Rattus norvegicus
ccgagctctgccaatggaagggcgc

SEQ ID NO: 574130 - DNA, 25 bp, Rattus norvegicus
cttccagagcgtgaggatcaagatt

SEQ ID NO: 574131 - DNA, 25 bp, Rattus norvegicus
cgtctgtttgtatgcgcgagcacgc

SEQ ID NO: 574132 - DNA, 25 bp, Rattus norvegicus
atctcgggcgcctgagtttacatgc

SEQ ID NO: 574133 - DNA, 25 bp, Rattus norvegicus
tgagtttacatgcacgagcacgcgc

SEQ ID NO: 574134 - DNA, 25 bp, Rattus norvegicus
aatccgtctgggtgctcccacttga

SEQ ID NO: 574135 - DNA, 25 bp, Rattus norvegicus
cccacttgagggatcgggtctactg

SEQ ID NO: 574136 - DNA, 25 bp, Rattus norvegicus
ggggcactccaagtcaagtcccttc

SEQ ID NO: 574137 - DNA, 25 bp, Rattus norvegicus
tactgatgtcagtctcccggtgtcc

SEQ ID NO: 574138 - DNA, 25 bp, Rattus norvegicus
accctgctgcaggttttgaggccgt

SEQ ID NO: 574139 - DNA, 25 bp, Rattus norvegicus
cagtttctcgggtgctttgaccgca

SEQ ID NO: 574140 - DNA, 25 bp, Rattus norvegicus
cggggactgtggaatcccaaacatc

SEQ ID NO: 574141 - DNA, 25 bp, Rattus norvegicus
caccctgtgcaggtccagagacacg

SEQ ID NO: 574142 - DNA, 25 bp, Rattus norvegicus
tttgggtgtcacaaattccgacttc

SEQ ID NO: 574143 - DNA, 25 bp, Rattus norvegicus
gggcctgtgcgtcccagaacacata

SEQ ID NO: 574144 - DNA, 25 bp, Rattus norvegicus
ctagagaggtgttcgagaacgaccc

SEQ ID NO: 574145 - DNA, 25 bp, Rattus norvegicus
taccaagtcttcgaggaggccaagc

SEQ ID NO: 574146 - DNA, 25 bp, Rattus norvegicus
ggttgactgcacacccttctttctg

SEQ ID NO: 574147 - DNA, 25 bp, Rattus norvegicus
acaggcatcatggtcctcggaatcc

SEQ ID NO: 574148 - DNA, 25 bp, Rattus norvegicus
tccgagtcttcgcacagtgagtacc

SEQ ID NO: 574149 - DNA, 25 bp, Rattus norvegicus
gtccgcggttcgcttcagtttctcg

SEQ ID NO: 574150 - DNA, 25 bp, Rattus norvegicus
tggccagaatgaccggagcccgtgt

SEQ ID NO: 574151 - DNA, 25 bp, Rattus norvegicus
ggagcatcccagacacacaggcatc

SEQ ID NO: 574152 - DNA, 25 bp, Rattus norvegicus
cttcaccgccgcttggccagaatga

SEQ ID NO: 574153 - DNA, 25 bp, Rattus norvegicus
gcttgccggggtcccaaaatctgag

SEQ ID NO: 574154 - DNA, 25 bp, Rattus norvegicus
ttaggaggtgcctccgcagagcagc

SEQ ID NO: 574155 - DNA, 25 bp, Rattus norvegicus
cagagcagcgctactcctggggcaa

SEQ ID NO: 574156 - DNA, 25 bp, Rattus norvegicus
gctccatcgggtttttaggaggtgc

SEQ ID NO: 574157 - DNA, 25 bp, Rattus norvegicus
aatctgagggccaaatggcgtttta

SEQ ID NO: 574158 - DNA, 25 bp, Rattus norvegicus
acagacggccgggacaccgtcctgg

SEQ ID NO: 574159 - DNA, 25 bp, Rattus norvegicus
tcgtctgccgatcggtgccaacaga

SEQ ID NO: 574160 - DNA, 25 bp, Rattus norvegicus
cacttgtgggctcgttaccaggaca

SEQ ID NO: 574161 - DNA, 25 bp, Rattus norvegicus
ggcgcggacctcagcgcgcacttgt

SEQ ID NO: 574162 - DNA, 25 bp, Rattus norvegicus
gccttgagaagcacgcggccacggt

SEQ ID NO: 574163 - DNA, 25 bp, Rattus norvegicus
atcgccaccgagatgaccaaagggg

SEQ ID NO: 574164 - DNA, 25 bp, Rattus norvegicus
ccaagggaggaaaggtgccgccatc

SEQ ID NO: 574165 - DNA, 25 bp, Rattus norvegicus
agacccggactcttaagctctgcga

SEQ ID NO: 574166 - DNA, 25 bp, Rattus norvegicus
tggcgttttagaaaaggctccatcg

SEQ ID NO: 574167 - DNA, 25 bp, Rattus norvegicus
tagctcagcggtggagcgctcacgt

SEQ ID NO: 574168 - DNA, 25 bp, Rattus norvegicus
tcagcggtggagcgctcacgtagct

SEQ ID NO: 574169 - DNA, 25 bp, Rattus norvegicus
agcgctcacgtagctcagcggtgga

SEQ ID NO: 574170 - DNA, 25 bp, Rattus norvegicus
gtagctcagcggtggagcgctcacg

SEQ ID NO: 574171 - DNA, 25 bp, Rattus norvegicus
cggtggagcgctcacgtagctcagc

SEQ ID NO: 574172 - DNA, 25 bp, Rattus norvegicus
agctcagcggtggagcgctcacgta

SEQ ID NO: 574173 - DNA, 25 bp, Rattus norvegicus
ggtggagcgctcacgtagctcagcg

SEQ ID NO: 574174 - DNA, 25 bp, Rattus norvegicus
cgtagctcagcggtggagcgctcac

SEQ ID NO: 574175 - DNA, 25 bp, Rattus norvegicus
ctcagcggtggagcgctcacgtagc

SEQ ID NO: 574176 - DNA, 25 bp, Rattus norvegicus
gctcacgtagctcagcggtggagcg

SEQ ID NO: 574177 - DNA, 25 bp, Rattus norvegicus
tggagcgctcacgtagctcagcggt

SEQ ID NO: 574178 - DNA, 25 bp, Rattus norvegicus
agcggtggagcgctcacgtagctca

SEQ ID NO: 574179 - DNA, 25 bp, Rattus norvegicus
ggagcgctcacgtagctcagcggtg

SEQ ID NO: 574180 - DNA, 25 bp, Rattus norvegicus
cgctcacgtagctcagcggtggagc

SEQ ID NO: 574181 - DNA, 25 bp, Rattus norvegicus
gccgctcatctcccgcgcctctcgc

SEQ ID NO: 574182 - DNA, 25 bp, Rattus norvegicus
gcgcctccatgtgcgctcggagaga

SEQ ID NO: 574183 - DNA, 25 bp, Rattus norvegicus
gcgtgcgcgtgtggcggccgccgac

SEQ ID NO: 574184 - DNA, 25 bp, Rattus norvegicus
gcgcgcctccatgtgcgctcggaga

SEQ ID NO: 574185 - DNA, 25 bp, Rattus norvegicus
tgctacccgccctgggataggggag

SEQ ID NO: 574186 - DNA, 25 bp, Rattus norvegicus
ccgacgctgaaaagcgctgcgcgcg

SEQ ID NO: 574187 - DNA, 25 bp, Rattus norvegicus
tcggagagaggccacgtgtgtgcgc

SEQ ID NO: 574188 - DNA, 25 bp, Rattus norvegicus
gcctctcgccggtgctacccgccct

SEQ ID NO: 574189 - DNA, 25 bp, Rattus norvegicus
cgccgacgctgaaaagcgctgcgcg

SEQ ID NO: 574190 - DNA, 25 bp, Rattus norvegicus
gccgccgacgctgaaaagcgctgcg

SEQ ID NO: 574191 - DNA, 25 bp, Rattus norvegicus
ggccgccgacgctgaaaagcgctgc

SEQ ID NO: 574192 - DNA, 25 bp, Rattus norvegicus
gcgcctgcgcgccttttcgcgcctt

SEQ ID NO: 574193 - DNA, 25 bp, Rattus norvegicus
tgcgcgccttttcgcgccttcggcg

SEQ ID NO: 574194 - DNA, 25 bp, Rattus norvegicus
cttttcgcgccttcggcgccctcct

SEQ ID NO: 574195 - DNA, 25 bp, Rattus norvegicus
gatgtgtcccaaacgccgtgcctca

SEQ ID NO: 574196 - DNA, 25 bp, Rattus norvegicus
ttgcgatccgcaaagctctcactga

SEQ ID NO: 574197 - DNA, 25 bp, Rattus norvegicus
agttgcccgctctcttctgagatca

SEQ ID NO: 574198 - DNA, 25 bp, Rattus norvegicus
cgcggcggcttcaagataactgaac

SEQ ID NO: 574199 - DNA, 25 bp, Rattus norvegicus
cgctgaaagagcatccggatactga

SEQ ID NO: 574200 - DNA, 25 bp, Rattus norvegicus
cctcagagctgaagggcgcctttca

SEQ ID NO: 574201 - DNA, 25 bp, Rattus norvegicus
tccgagagaggttacgatgtgtccc

SEQ ID NO: 574202 - DNA, 25 bp, Rattus norvegicus
ccagcctccttccagagggtgcata

SEQ ID NO: 574203 - DNA, 25 bp, Rattus norvegicus
tgcacgctgggaactggagttttga

SEQ ID NO: 574204 - DNA, 25 bp, Rattus norvegicus
agtagctccggctcctttaaggctg

SEQ ID NO: 574205 - DNA, 25 bp, Rattus norvegicus
tgcttctgacgtgccgctgaaaagt

SEQ ID NO: 574206 - DNA, 25 bp, Rattus norvegicus
atctctttcccggacgcaggaccag

SEQ ID NO: 574207 - DNA, 25 bp, Rattus norvegicus
ccgcacgcggagagtcgtaaactga

SEQ ID NO: 574208 - DNA, 25 bp, Rattus norvegicus
ctctcactgaggatagccctagttg

SEQ ID NO: 574209 - DNA, 25 bp, Rattus norvegicus
catggatcccgcagagcgcgcgcag

SEQ ID NO: 574210 - DNA, 25 bp, Rattus norvegicus
gcatcccggcaggcgcggaaacttg

SEQ ID NO: 574211 - DNA, 25 bp, Rattus norvegicus
tgtcggagcttctggaccccaaccg

SEQ ID NO: 574212 - DNA, 25 bp, Rattus norvegicus
agggaaggtgaaccgaagatggacg

SEQ ID NO: 574213 - DNA, 25 bp, Rattus norvegicus
acgctctctggtccacggagagcga

SEQ ID NO: 574214 - DNA, 25 bp, Rattus norvegicus
gggcacgctctctggtccacggaga

SEQ ID NO: 574215 - DNA, 25 bp, Rattus norvegicus
gcgccctcctcggactgggtctgag

SEQ ID NO: 574216 - DNA, 25 bp, Rattus norvegicus
ttctccgcatggatcccgcagagcg

SEQ ID NO: 574217 - DNA, 25 bp, Rattus norvegicus
cagcgcttggggctgcactggttca

SEQ ID NO: 574218 - DNA, 25 bp, Rattus norvegicus
tcctcggactgggtctgagccggtc

SEQ ID NO: 574219 - DNA, 25 bp, Rattus norvegicus
cagagtcccgcggtccctggcggtt

SEQ ID NO: 574220 - DNA, 25 bp, Rattus norvegicus
actggttcagagtcccgcggtccct

SEQ ID NO: 574221 - DNA, 25 bp, Rattus norvegicus
ctgcactggttcagagtcccgcggt

SEQ ID NO: 574222 - DNA, 25 bp, Rattus norvegicus
tccctggcggttctccgcatggatc

SEQ ID NO: 574223 - DNA, 25 bp, Rattus norvegicus
tgtcacgtgaacagtgccgcgcccg

SEQ ID NO: 574224 - DNA, 25 bp, Rattus norvegicus
accgactcgagaggcccggcagctg

SEQ ID NO: 574225 - DNA, 25 bp, Rattus norvegicus
accgagaagaccctgcggccggcag

SEQ ID NO: 574226 - DNA, 25 bp, Rattus norvegicus
cggcagcgcctgtcacgtgaacagt

SEQ ID NO: 574227 - DNA, 25 bp, Rattus norvegicus
tctccacttggctcgtgatggtgtc

SEQ ID NO: 574228 - DNA, 25 bp, Rattus norvegicus
tgccgcttactctcttctcctggag

SEQ ID NO: 574229 - DNA, 25 bp, Rattus norvegicus
ctgggctcacccagcagcaacagga

SEQ ID NO: 574230 - DNA, 25 bp, Rattus norvegicus
cctggagtctccacttggctcgtga

SEQ ID NO: 574231 - DNA, 25 bp, Rattus norvegicus
tgatgcttagccatccgtccttttc

SEQ ID NO: 574232 - DNA, 25 bp, Rattus norvegicus
ctcgtgatggtgtcacgtgccgatc

SEQ ID NO: 574233 - DNA, 25 bp, Rattus norvegicus
tgtcacgtgccgatcggcgtcacgt

SEQ ID NO: 574234 - DNA, 25 bp, Rattus norvegicus
ccgatcggcgtcacgtggtctccag

SEQ ID NO: 574235 - DNA, 25 bp, Rattus norvegicus
tggtctccaggccacgtgatgctta

SEQ ID NO: 574236 - DNA, 25 bp, Rattus norvegicus
ccaggccacgtgatgcttagccatc

SEQ ID NO: 574237 - DNA, 25 bp, Rattus norvegicus
cagttcctccaggttgtacctgatg

SEQ ID NO: 574238 - DNA, 25 bp, Rattus norvegicus
gcttccgctaaggaaggctcgggcc

SEQ ID NO: 574239 - DNA, 25 bp, Rattus norvegicus
tccgctaaggaaggctcgggccgca

SEQ ID NO: 574240 - DNA, 25 bp, Rattus norvegicus
gggcaggcctccctagcgtcggccc

SEQ ID NO: 574241 - DNA, 25 bp, Rattus norvegicus
cctggtacagttcctccaggttgta

SEQ ID NO: 574242 - DNA, 25 bp, Rattus norvegicus
tgtacctgatggatgtgctgctctg

SEQ ID NO: 574243 - DNA, 25 bp, Rattus norvegicus
atgtgctgctctggatggccttgac

SEQ ID NO: 574244 - DNA, 25 bp, Rattus norvegicus
tggccttgaccgcttcgtgaagctt

SEQ ID NO: 574245 - DNA, 25 bp, Rattus norvegicus
cttcgtgaagcttccgccacgtgtc

SEQ ID NO: 574246 - DNA, 25 bp, Rattus norvegicus
aagcttccgccacgtgtcctgagtg

SEQ ID NO: 574247 - DNA, 25 bp, Rattus norvegicus
ccgccacgtgtcctgagtgtagttg

SEQ ID NO: 574248 - DNA, 25 bp, Rattus norvegicus
ccacgtgtcctgagtgtagttgtca

SEQ ID NO: 574249 - DNA, 25 bp, Rattus norvegicus
ctgagtgtagttgtcaggcagccgc

SEQ ID NO: 574250 - DNA, 25 bp, Rattus norvegicus
ctgcgggaggaggaaaacagccagg

SEQ ID NO: 574251 - DNA, 25 bp, Rattus norvegicus
ggacgtcttcccagtgcgatctgga

SEQ ID NO: 574252 - DNA, 25 bp, Rattus norvegicus
cgttctacaacgaatgctcgcgaga

SEQ ID NO: 574253 - DNA, 25 bp, Rattus norvegicus
cgaggaatcgggtcactagcacaca

SEQ ID NO: 574254 - DNA, 25 bp, Rattus norvegicus
ggacgcagggacacgtttccaagtc

SEQ ID NO: 574255 - DNA, 25 bp, Rattus norvegicus
agccaggagcacctctgcacactga

SEQ ID NO: 574256 - DNA, 25 bp, Rattus norvegicus
gctctgtttgctccaggctgtgaga

SEQ ID NO: 574257 - DNA, 25 bp, Rattus norvegicus
ctgtggcgtcccagtgattgcactg

SEQ ID NO: 574258 - DNA, 25 bp, Rattus norvegicus
gggactcgcagcagacgttctacaa

SEQ ID NO: 574259 - DNA, 25 bp, Rattus norvegicus
cccggcgaagacttgagtggatgaa

SEQ ID NO: 574260 - DNA, 25 bp, Rattus norvegicus
tggggccacctcacatcctagggct

SEQ ID NO: 574261 - DNA, 25 bp, Rattus norvegicus
gaggcggaatgctctacacccattg

SEQ ID NO: 574262 - DNA, 25 bp, Rattus norvegicus
ttccaagtcggttgggattcctcca

SEQ ID NO: 574263 - DNA, 25 bp, Rattus norvegicus
tcaggaaaacatcccgcgagggcta

SEQ ID NO: 574264 - DNA, 25 bp, Rattus norvegicus
gcgatctggacttttgctctgtttg

SEQ ID NO: 574265 - DNA, 25 bp, Rattus norvegicus
aggccgcagctgtggcacaggcaca

SEQ ID NO: 574266 - DNA, 25 bp, Rattus norvegicus
acgtgtagatgaccgtgtccacctc

SEQ ID NO: 574267 - DNA, 25 bp, Rattus norvegicus
cagctgcacggctacggcctataga

SEQ ID NO: 574268 - DNA, 25 bp, Rattus norvegicus
cggctacggcctatagatcttgata

SEQ ID NO: 574269 - DNA, 25 bp, Rattus norvegicus
cggcctatagatcttgataacatcc

SEQ ID NO: 574270 - DNA, 25 bp, Rattus norvegicus
taacatccttgatgggccgacggca

SEQ ID NO: 574271 - DNA, 25 bp, Rattus norvegicus
ccgacggcagataggacagcaggcc

SEQ ID NO: 574272 - DNA, 25 bp, Rattus norvegicus
ctttggccgagccagctgcacggct

SEQ ID NO: 574273 - DNA, 25 bp, Rattus norvegicus
catgtgtccacacgtgtagatgacc

SEQ ID NO: 574274 - DNA, 25 bp, Rattus norvegicus
atgaccgtgtccacctcgctgtcga

SEQ ID NO: 574275 - DNA, 25 bp, Rattus norvegicus
tcgctgtcgaagcacaccgtgcact

SEQ ID NO: 574276 - DNA, 25 bp, Rattus norvegicus
gtgcactctccattcctgctgccgg

SEQ ID NO: 574277 - DNA, 25 bp, Rattus norvegicus
agctgtggcacaggcacatgtgtcc

SEQ ID NO: 574278 - DNA, 25 bp, Rattus norvegicus
acaggcacatgtgtccacacgtgta

SEQ ID NO: 574279 - DNA, 25 bp, Rattus norvegicus
gtccgtctgtgccagtgacacgtga

SEQ ID NO: 574280 - DNA, 25 bp, Rattus norvegicus
cgtctgtccgtctgcgccagtgaca

SEQ ID NO: 574281 - DNA, 25 bp, Rattus norvegicus
ctgtccgtctgtgccagtgacacgt

SEQ ID NO: 574282 - DNA, 25 bp, Rattus norvegicus
tgccagtgacacgtgagtgaggtct

SEQ ID NO: 574283 - DNA, 25 bp, Rattus norvegicus
gtctgcgggctctgtccgtctgtcc

SEQ ID NO: 574284 - DNA, 25 bp, Rattus norvegicus
gtctgtgccagtgacacgtgagtga

SEQ ID NO: 574285 - DNA, 25 bp, Rattus norvegicus
acacgtgagtgaggtctgcaggctc

SEQ ID NO: 574286 - DNA, 25 bp, Rattus norvegicus
tctgtccgtctgtgccagtgacacg

SEQ ID NO: 574287 - DNA, 25 bp, Rattus norvegicus
cgccagtgacacgtgagtgaggtct

SEQ ID NO: 574288 - DNA, 25 bp, Rattus norvegicus
cgtctgcgccagtgacacgtgagtg

SEQ ID NO: 574289 - DNA, 25 bp, Rattus norvegicus
gtctgcgggctctgtccgtctgtct

SEQ ID NO: 574290 - DNA, 25 bp, Rattus norvegicus
gtctgtccgtctgcgccagtgacac

SEQ ID NO: 574291 - DNA, 25 bp, Rattus norvegicus
tctgcgccagtgacacgtgagtgag

SEQ ID NO: 574292 - DNA, 25 bp, Rattus norvegicus
ccagtgacacgtgagtgaggtctgc

SEQ ID NO: 574293 - DNA, 25 bp, Rattus norvegicus
ggcccttctcgtgcgtgcgtccaaa

SEQ ID NO: 574294 - DNA, 25 bp, Rattus norvegicus
gatgatcatatccacctcgtgcacc

SEQ ID NO: 574295 - DNA, 25 bp, Rattus norvegicus
gcttgatgatcatatccacctcgtg

SEQ ID NO: 574296 - DNA, 25 bp, Rattus norvegicus
ctgaaacttgttgtgcttgatgatc

SEQ ID NO: 574297 - DNA, 25 bp, Rattus norvegicus
ggtgtccctctgaaacttgttgtgc

SEQ ID NO: 574298 - DNA, 25 bp, Rattus norvegicus
atgtcgaagtcgtaggtgtccctct

SEQ ID NO: 574299 - DNA, 25 bp, Rattus norvegicus
tcagcatggcaatgtcgaagtcgta

SEQ ID NO: 574300 - DNA, 25 bp, Rattus norvegicus
ggggtcttcagcctcagcatggcaa

SEQ ID NO: 574301 - DNA, 25 bp, Rattus norvegicus
ccagtctttctgaggcaagcaggca

SEQ ID NO: 574302 - DNA, 25 bp, Rattus norvegicus
tcggcccagtctttctgaggcaagc

SEQ ID NO: 574303 - DNA, 25 bp, Rattus norvegicus
catcagtgtggcctcggcccagtct

SEQ ID NO: 574304 - DNA, 25 bp, Rattus norvegicus
tcttttgcgtcatcagtgtggcctc

SEQ ID NO: 574305 - DNA, 25 bp, Rattus norvegicus
ctcacgatgcctgtcttttgcgtca

SEQ ID NO: 574306 - DNA, 25 bp, Rattus norvegicus
cgtgcgtccaaacccgctcacgatg

SEQ ID NO: 574307 - DNA, 25 bp, Rattus norvegicus
tctgctgacacagctcaggccggca

SEQ ID NO: 574308 - DNA, 25 bp, Rattus norvegicus
gaccgaatctctggggctttattta

SEQ ID NO: 574309 - DNA, 25 bp, Rattus norvegicus
tcacttggtgagagtttaccgcgca

SEQ ID NO: 574310 - DNA, 25 bp, Rattus norvegicus
agagtgtacttagcgccctctgctg

SEQ ID NO: 574311 - DNA, 25 bp, Rattus norvegicus
gcttccgaccgaccgaatctctggg

SEQ ID NO: 574312 - DNA, 25 bp, Rattus norvegicus
ggcactcaccggtactttcatctta

SEQ ID NO: 574313 - DNA, 25 bp, Rattus norvegicus
cttaaactcatctctgttgaacttg

SEQ ID NO: 574314 - DNA, 25 bp, Rattus norvegicus
ctctgttgaacttgaaggctatgtc

SEQ ID NO: 574315 - DNA, 25 bp, Rattus norvegicus
aggctatgtccgagagagtcctctg

SEQ ID NO: 574316 - DNA, 25 bp, Rattus norvegicus
agtcctctggaagaagcccgtgggt

SEQ ID NO: 574317 - DNA, 25 bp, Rattus norvegicus
ggctgggaatgatgcctgcaagaca

SEQ ID NO: 574318 - DNA, 25 bp, Rattus norvegicus
tggagcgttcgccaccaggccgtgc

SEQ ID NO: 574319 - DNA, 25 bp, Rattus norvegicus
cgcaggcgccaagagtgtacttagc

SEQ ID NO: 574320 - DNA, 25 bp, Rattus norvegicus
gctttatttactgccggcgtggagg

SEQ ID NO: 574321 - DNA, 25 bp, Rattus norvegicus
tgcgacagttgtgggtgccacgact

SEQ ID NO: 574322 - DNA, 25 bp, Rattus norvegicus
ggcggtaacaaagcggtagccaaca

SEQ ID NO: 574323 - DNA, 25 bp, Rattus norvegicus
gtggaatttctcgtggggcagcaca

SEQ ID NO: 574324 - DNA, 25 bp, Rattus norvegicus
gcgcggagctgattgtagactcgca

SEQ ID NO: 574325 - DNA, 25 bp, Rattus norvegicus
cagtcttcaggtccttcagtgaggc

SEQ ID NO: 574326 - DNA, 25 bp, Rattus norvegicus
ttcttggcgatgaccacagtcttca

SEQ ID NO: 574327 - DNA, 25 bp, Rattus norvegicus
gttctcggcctagcggaaggattct

SEQ ID NO: 574328 - DNA, 25 bp, Rattus norvegicus
agccaacaagcagctcgagcacatg

SEQ ID NO: 574329 - DNA, 25 bp, Rattus norvegicus
agcacatggccatcggcgaaggctc

SEQ ID NO: 574330 - DNA, 25 bp, Rattus norvegicus
agcttgaagctgttgcggttgcgac

SEQ ID NO: 574331 - DNA, 25 bp, Rattus norvegicus
tcggccttgatgacgttgagatgct

SEQ ID NO: 574332 - DNA, 25 bp, Rattus norvegicus
gggcagcacaaagatggcggtaaca

SEQ ID NO: 574333 - DNA, 25 bp, Rattus norvegicus
agccgtctgcaccatgcgcttgtcg

SEQ ID NO: 574334 - DNA, 25 bp, Rattus norvegicus
tggcccactcgatgttgcctgagta

SEQ ID NO: 574335 - DNA, 25 bp, Rattus norvegicus
ggttgtggcgctttccttggcttcc

SEQ ID NO: 574336 - DNA, 25 bp, Rattus norvegicus
caccagaggtgctgtcgggtggggc

SEQ ID NO: 574337 - DNA, 25 bp, Rattus norvegicus
ttgtggcgctttccttggcttccca

SEQ ID NO: 574338 - DNA, 25 bp, Rattus norvegicus
tggcttcccaggattggtctccgcg

SEQ ID NO: 574339 - DNA, 25 bp, Rattus norvegicus
ggcttcccaggattggtctccgcgc

SEQ ID NO: 574340 - DNA, 25 bp, Rattus norvegicus
tcccaggattggtctccgcgccaca

SEQ ID NO: 574341 - DNA, 25 bp, Rattus norvegicus
cggaagcggaagcactgagcctgcc

SEQ ID NO: 574342 - DNA, 25 bp, Rattus norvegicus
aagcactgagcctgccgggcgtgtc

SEQ ID NO: 574343 - DNA, 25 bp, Rattus norvegicus
agcactgagcctgccgggcgtgtca

SEQ ID NO: 574344 - DNA, 25 bp, Rattus norvegicus
ggcgtgtcaccaccccgcacctgga

SEQ ID NO: 574345 - DNA, 25 bp, Rattus norvegicus
gaagatcgtcctccgctgcaccaga

SEQ ID NO: 574346 - DNA, 25 bp, Rattus norvegicus
agaagatcgtcctccgctgcaccag

SEQ ID NO: 574347 - DNA, 25 bp, Rattus norvegicus
caacaaaaccgatccccagaagatc

SEQ ID NO: 574348 - DNA, 25 bp, Rattus norvegicus
atcgtcctccgctgcaccagaggtg

SEQ ID NO: 574349 - DNA, 25 bp, Rattus norvegicus
gagaatcccggtctagtagcaaagc

SEQ ID NO: 574350 - DNA, 25 bp, Rattus norvegicus
cccaatcccgcgcacacctgcctgt

SEQ ID NO: 574351 - DNA, 25 bp, Rattus norvegicus
agttcccgccaggaggaggtggaat

SEQ ID NO: 574352 - DNA, 25 bp, Rattus norvegicus
ctcctctctcctttgtccctcgtcg

SEQ ID NO: 574353 - DNA, 25 bp, Rattus norvegicus
tagcggagagaatcccggtctagta

SEQ ID NO: 574354 - DNA, 25 bp, Rattus norvegicus
gtgcggggcaccgtcttctcctcgt

SEQ ID NO: 574355 - DNA, 25 bp, Rattus norvegicus
tcccggtctagtagcaaagcgatcc

SEQ ID NO: 574356 - DNA, 25 bp, Rattus norvegicus
tctagtagcaaagcgatccggacgg

SEQ ID NO: 574357 - DNA, 25 bp, Rattus norvegicus
aagcgatccggacgggaatggttct

SEQ ID NO: 574358 - DNA, 25 bp, Rattus norvegicus
gcagcgagctcgttcccactccttt

SEQ ID NO: 574359 - DNA, 25 bp, Rattus norvegicus
tcgcaggtgccacgctcccaggctc

SEQ ID NO: 574360 - DNA, 25 bp, Rattus norvegicus
agcgagctcacttgctcgcaggtgc

SEQ ID NO: 574361 - DNA, 25 bp, Rattus norvegicus
gtcttctcctcgtccagcgagctca

SEQ ID NO: 574362 - DNA, 25 bp, Rattus norvegicus
gaatgtagcggagagaatcccggtc

SEQ ID NO: 574363 - DNA, 25 bp, Rattus norvegicus
gacggcaaacttcacttctgactcc

SEQ ID NO: 574364 - DNA, 25 bp, Rattus norvegicus
cgagcgtcctcaataggctgcagtc

SEQ ID NO: 574365 - DNA, 25 bp, Rattus norvegicus
actcacgtatctgcgcacgagcgtc

SEQ ID NO: 574366 - DNA, 25 bp, Rattus norvegicus
acctggctggctactttcagagacg

SEQ ID NO: 574367 - DNA, 25 bp, Rattus norvegicus
gtccgcaggacgttccaggcctgaa

SEQ ID NO: 574368 - DNA, 25 bp, Rattus norvegicus
gctacaactgccttccgggtgggcc

SEQ ID NO: 574369 - DNA, 25 bp, Rattus norvegicus
ggatcgacccggctacaactgcctt

SEQ ID NO: 574370 - DNA, 25 bp, Rattus norvegicus
tccgaggatgaatgtccctcgaccc

SEQ ID NO: 574371 - DNA, 25 bp, Rattus norvegicus
agctgagcgcaacctccgaggatga

SEQ ID NO: 574372 - DNA, 25 bp, Rattus norvegicus
actaaccgcgcagcggcatccaggg

SEQ ID NO: 574373 - DNA, 25 bp, Rattus norvegicus
gggaactgcgcactcggacctggct

SEQ ID NO: 574374 - DNA, 25 bp, Rattus norvegicus
gctactttcagagacggcaaacttc

SEQ ID NO: 574375 - DNA, 25 bp, Rattus norvegicus
gctgcagtccatggttgtcgctccc

SEQ ID NO: 574376 - DNA, 25 bp, Rattus norvegicus
tgcagcccggtacacatgtctcagc

SEQ ID NO: 574377 - DNA, 25 bp, Rattus norvegicus
ccagatgtaactccaaccagtgctg

SEQ ID NO: 574378 - DNA, 25 bp, Rattus norvegicus
atcctaggccggagcgaaggtacgt

SEQ ID NO: 574379 - DNA, 25 bp, Rattus norvegicus
gcagaacctgtgctgccggatccta

SEQ ID NO: 574380 - DNA, 25 bp, Rattus norvegicus
aagtcgcccaatgttctgctgcaga

SEQ ID NO: 574381 - DNA, 25 bp, Rattus norvegicus
ccggatcagaagtcgcccaatgttc

SEQ ID NO: 574382 - DNA, 25 bp, Rattus norvegicus
gcggtaatggcgacaccggatcaga

SEQ ID NO: 574383 - DNA, 25 bp, Rattus norvegicus
cttccgcgaatatggcggcgccgta

SEQ ID NO: 574384 - DNA, 25 bp, Rattus norvegicus
cctcgcgcgggaagcggtgcattat

SEQ ID NO: 574385 - DNA, 25 bp, Rattus norvegicus
tagttaccgcgagcgtcgcccagca

SEQ ID NO: 574386 - DNA, 25 bp, Rattus norvegicus
tgcagtcccgggaactagttaccgc

SEQ ID NO: 574387 - DNA, 25 bp, Rattus norvegicus
gtgctgttcacaagaggcgcccaga

SEQ ID NO: 574388 - DNA, 25 bp, Rattus norvegicus
gctcggactcggcatccagatgtaa

SEQ ID NO: 574389 - DNA, 25 bp, Rattus norvegicus
caagctgcggaagcgcactgcagtc

SEQ ID NO: 574390 - DNA, 25 bp, Rattus norvegicus
actgtggaggctgagcgccatgacc

SEQ ID NO: 574391 - DNA, 25 bp, Rattus norvegicus
ggcggccactggtgcttcctaactc

SEQ ID NO: 574392 - DNA, 25 bp, Rattus norvegicus
tggtccggttcccaccgacagacag

SEQ ID NO: 574393 - DNA, 25 bp, Rattus norvegicus
ctgcattcttctggtccggttccca

SEQ ID NO: 574394 - DNA, 25 bp, Rattus norvegicus
gcggctctgctcctggacccattgt

SEQ ID NO: 574395 - DNA, 25 bp, Rattus norvegicus
taactccgccctgcattcttctggt

SEQ ID NO: 574396 - DNA, 25 bp, Rattus norvegicus
gctcctggacccattgtcctcatta

SEQ ID NO: 574397 - DNA, 25 bp, Rattus norvegicus
aatgtcaactctcctgcgggttggg

SEQ ID NO: 574398 - DNA, 25 bp, Rattus norvegicus
ccacagctgaagaatgtcaactctc

SEQ ID NO: 574399 - DNA, 25 bp, Rattus norvegicus
gatgatgtcagaatatccacagctg

SEQ ID NO: 574400 - DNA, 25 bp, Rattus norvegicus
aggtgtgcgatgatgtcagaatatc

SEQ ID NO: 574401 - DNA, 25 bp, Rattus norvegicus
tagcaaagcgtgcagggctgaagcc

SEQ ID NO: 574402 - DNA, 25 bp, Rattus norvegicus
tgtcctcattagcaaagcgtgcagg

SEQ ID NO: 574403 - DNA, 25 bp, Rattus norvegicus
ggacccattgtcctcattagcaaag

SEQ ID NO: 574404 - DNA, 25 bp, Rattus norvegicus
cgccctgcattcttctggtccggtt

SEQ ID NO: 574405 - DNA, 25 bp, Rattus norvegicus
gcttggtggcaacaattgcgcactc

SEQ ID NO: 574406 - DNA, 25 bp, Rattus norvegicus
ttcctaactgtcctgggatttcgga

SEQ ID NO: 574407 - DNA, 25 bp, Rattus norvegicus
cgctggttccgcgagcttttcctaa

SEQ ID NO: 574408 - DNA, 25 bp, Rattus norvegicus
gggtgtctcctaaagtgcctgaaaa

SEQ ID NO: 574409 - DNA, 25 bp, Rattus norvegicus
ttaaacatggcaagcgaaagccacc

SEQ ID NO: 574410 - DNA, 25 bp, Rattus norvegicus
ggacctagccgtgtaattaaacatg

SEQ ID NO: 574411 - DNA, 25 bp, Rattus norvegicus
tgcgtccttcatttggacctagccg

SEQ ID NO: 574412 - DNA, 25 bp, Rattus norvegicus
cggagatctataaattgcgtccttc

SEQ ID NO: 574413 - DNA, 25 bp, Rattus norvegicus
tattttacagtctgcatccgagggg

SEQ ID NO: 574414 - DNA, 25 bp, Rattus norvegicus
cccagctgggtaacagttttcttat

SEQ ID NO: 574415 - DNA, 25 bp, Rattus norvegicus
tgggagcccattgttacccagctgg

SEQ ID NO: 574416 - DNA, 25 bp, Rattus norvegicus
cgcggctgagtttccactttcgccg

SEQ ID NO: 574417 - DNA, 25 bp, Rattus norvegicus
tcctcccggaggagcggagatctat

SEQ ID NO: 574418 - DNA, 25 bp, Rattus norvegicus
tctgctgcaaatagatcgcgttctc

SEQ ID NO: 574419 - DNA, 25 bp, Rattus norvegicus
ggttattctccagctcgttattatc

SEQ ID NO: 574420 - DNA, 25 bp, Rattus norvegicus
agaacacaagcgtgcggccgccgtc

SEQ ID NO: 574421 - DNA, 25 bp, Rattus norvegicus
cggccgctcggagaacacaagcgtg

SEQ ID NO: 574422 - DNA, 25 bp, Rattus norvegicus
cgccaggatcgcaggacgtgatgcc

SEQ ID NO: 574423 - DNA, 25 bp, Rattus norvegicus
gccaggtgacccagcttggctacca

SEQ ID NO: 574424 - DNA, 25 bp, Rattus norvegicus
cagcgtgaagctgagtgcgtcgcct

SEQ ID NO: 574425 - DNA, 25 bp, Rattus norvegicus
tgcgaggtgtccacgcacagcaagc

SEQ ID NO: 574426 - DNA, 25 bp, Rattus norvegicus
cagcttggctaccacctggttattc

SEQ ID NO: 574427 - DNA, 25 bp, Rattus norvegicus
cgttattatcgaagttggcagcatc

SEQ ID NO: 574428 - DNA, 25 bp, Rattus norvegicus
acgtgatgccgaaggccacagctgc

SEQ ID NO: 574429 - DNA, 25 bp, Rattus norvegicus
ctgcggtccgcagacaggctcacgt

SEQ ID NO: 574430 - DNA, 25 bp, Rattus norvegicus
acaccaccgcgcacagcgaagaagg

SEQ ID NO: 574431 - DNA, 25 bp, Rattus norvegicus
ccagtattccttgcggtccagcagc

SEQ ID NO: 574432 - DNA, 25 bp, Rattus norvegicus
gtggaagcgcagctcagcgtccagc

SEQ ID NO: 574433 - DNA, 25 bp, Rattus norvegicus
tcgcggaggagcagagcatcatggt

SEQ ID NO: 574434 - DNA, 25 bp, Rattus norvegicus
agcagagcatcatggtcgtggtggg

SEQ ID NO: 574435 - DNA, 25 bp, Rattus norvegicus
agtcgcggaggagcagagcatcatg

SEQ ID NO: 574436 - DNA, 25 bp, Rattus norvegicus
aggagcagagcatcatggtcgtagt

SEQ ID NO: 574437 - DNA, 25 bp, Rattus norvegicus
gattcgcggaggagcagagcatcat

SEQ ID NO: 574438 - DNA, 25 bp, Rattus norvegicus
atcatggtcgtagtggggattcgcg

SEQ ID NO: 574439 - DNA, 25 bp, Rattus norvegicus
cagagcatcatggtcgtggtgggga

SEQ ID NO: 574440 - DNA, 25 bp, Rattus norvegicus
gagtcgcggaggagcagagcatcat

SEQ ID NO: 574441 - DNA, 25 bp, Rattus norvegicus
attcgcggaggagcagagcatcatg

SEQ ID NO: 574442 - DNA, 25 bp, Rattus norvegicus
gcagagcatcatggtcgtagtgggg

SEQ ID NO: 574443 - DNA, 25 bp, Rattus norvegicus
cgcggaggagcagagcatcatggtc

SEQ ID NO: 574444 - DNA, 25 bp, Rattus norvegicus
catcatggtcgtagtggggattcgc

SEQ ID NO: 574445 - DNA, 25 bp, Rattus norvegicus
cggaggagcagagcatcatggtcgt

SEQ ID NO: 574446 - DNA, 25 bp, Rattus norvegicus
agcatcatggtcgtagtggggattc

SEQ ID NO: 574447 - DNA, 25 bp, Rattus norvegicus
tgcggggctacctaccactattctc

SEQ ID NO: 574448 - DNA, 25 bp, Rattus norvegicus
agtggtcccacctcagtctgtccta

SEQ ID NO: 574449 - DNA, 25 bp, Rattus norvegicus
ttctgcaagctctacactgggagcc

SEQ ID NO: 574450 - DNA, 25 bp, Rattus norvegicus
cggcctgtagtcctttcgtctctgg

SEQ ID NO: 574451 - DNA, 25 bp, Rattus norvegicus
tctctggcagtaaagtcgttaattc

SEQ ID NO: 574452 - DNA, 25 bp, Rattus norvegicus
gcccgtgcccacagcactttgttaa

SEQ ID NO: 574453 - DNA, 25 bp, Rattus norvegicus
tggcctgcggtaggatcatgtcagt

SEQ ID NO: 574454 - DNA, 25 bp, Rattus norvegicus
tcgattaccgaagttgcgcactgtc

SEQ ID NO: 574455 - DNA, 25 bp, Rattus norvegicus
actgtccgcgtactgcgcatcttcg

SEQ ID NO: 574456 - DNA, 25 bp, Rattus norvegicus
ctgatgttactcgtgctgtgctggc

SEQ ID NO: 574457 - DNA, 25 bp, Rattus norvegicus
accgctgtcggcaggaacaaacgca

SEQ ID NO: 574458 - DNA, 25 bp, Rattus norvegicus
agcctaggaggccagatcagccgtc

SEQ ID NO: 574459 - DNA, 25 bp, Rattus norvegicus
ccgactttcacgagcaggatggatt

SEQ ID NO: 574460 - DNA, 25 bp, Rattus norvegicus
gtcctacgctggtcccttctgcaag

SEQ ID NO: 574461 - DNA, 25 bp, Rattus norvegicus
ggcctccgggcaaatgtggatacga

SEQ ID NO: 574462 - DNA, 25 bp, Rattus norvegicus
ctgaacctgtgcctccgacggggcg

SEQ ID NO: 574463 - DNA, 25 bp, Rattus norvegicus
tcctgcagtctttaacacaaaccgc

SEQ ID NO: 574464 - DNA, 25 bp, Rattus norvegicus
acggcctccgggcaaatgtggatac

SEQ ID NO: 574465 - DNA, 25 bp, Rattus norvegicus
ccgggcaaatgtggatacgagtaag

SEQ ID NO: 574466 - DNA, 25 bp, Rattus norvegicus
tacgagtaaggtggacgctaagccc

SEQ ID NO: 574467 - DNA, 25 bp, Rattus norvegicus
gagtaaggtggacgctaagccctta

SEQ ID NO: 574468 - DNA, 25 bp, Rattus norvegicus
ggacgctaagcccttactttccatc

SEQ ID NO: 574469 - DNA, 25 bp, Rattus norvegicus
tccatccccgcgagggtggacgaga

SEQ ID NO: 574470 - DNA, 25 bp, Rattus norvegicus
gacgagatggaagagagcacgaatc

SEQ ID NO: 574471 - DNA, 25 bp, Rattus norvegicus
gccgtaatcctgcagtctttaacac

SEQ ID NO: 574472 - DNA, 25 bp, Rattus norvegicus
atggaagagagcacgaatcgccctg

SEQ ID NO: 574473 - DNA, 25 bp, Rattus norvegicus
gagagcacgaatcgccctgaacctg

SEQ ID NO: 574474 - DNA, 25 bp, Rattus norvegicus
cagtctttaacacaaaccgctcttt

SEQ ID NO: 574475 - DNA, 25 bp, Rattus norvegicus
taatagacctatcagtcacatcccg

SEQ ID NO: 574476 - DNA, 25 bp, Rattus norvegicus
aaccggggctggacagagcttgctt

SEQ ID NO: 574477 - DNA, 25 bp, Rattus norvegicus
tccgcagtgcccagtctttgtcggg

SEQ ID NO: 574478 - DNA, 25 bp, Rattus norvegicus
atgaaatgcgtgaatatgagtgtta

SEQ ID NO: 574479 - DNA, 25 bp, Rattus norvegicus
ctcccacacgcatgattttaataga

SEQ ID NO: 574480 - DNA, 25 bp, Rattus norvegicus
ttccggagacagagctccgcagtgc

SEQ ID NO: 574481 - DNA, 25 bp, Rattus norvegicus
agtcacatcccgacacatctgcaga

SEQ ID NO: 574482 - DNA, 25 bp, Rattus norvegicus
catctgcagatcaggcgcgctgcgc

SEQ ID NO: 574483 - DNA, 25 bp, Rattus norvegicus
gggcttctcgaatagactggaattt

SEQ ID NO: 574484 - DNA, 25 bp, Rattus norvegicus
gacagagcttgctttcctgcgtccc

SEQ ID NO: 574485 - DNA, 25 bp, Rattus norvegicus
cgtgaccgcaagagctcaggggccc

SEQ ID NO: 574486 - DNA, 25 bp, Rattus norvegicus
cccgagccagcagtgctgaaccggg

SEQ ID NO: 574487 - DNA, 25 bp, Rattus norvegicus
gactggaattttccggagacagagc

SEQ ID NO: 574488 - DNA, 25 bp, Rattus norvegicus
atgagtgttattcttctcccacacg

SEQ ID NO: 574489 - DNA, 25 bp, Rattus norvegicus
gaacctttcacccactcatcgaatg

SEQ ID NO: 574490 - DNA, 25 bp, Rattus norvegicus
agaacctcctccagaacctttgcga

SEQ ID NO: 574491 - DNA, 25 bp, Rattus norvegicus
atttctagggctccctcgtcgctta

SEQ ID NO: 574492 - DNA, 25 bp, Rattus norvegicus
actcatcgaatgtgcgacccagacc

SEQ ID NO: 574493 - DNA, 25 bp, Rattus norvegicus
ttgaactccggcttccaggcgctaa

SEQ ID NO: 574494 - DNA, 25 bp, Rattus norvegicus
ttccaggcgctaagcccgctttgga

SEQ ID NO: 574495 - DNA, 25 bp, Rattus norvegicus
cagcacaccgtgtacgtgtccacga

SEQ ID NO: 574496 - DNA, 25 bp, Rattus norvegicus
tccaaatcccgcatttctagggctc

SEQ ID NO: 574497 - DNA, 25 bp, Rattus norvegicus
acaccgtgtacgtgtccacgagctc

SEQ ID NO: 574498 - DNA, 25 bp, Rattus norvegicus
gcctctcgctcagggccgaagctga

SEQ ID NO: 574499 - DNA, 25 bp, Rattus norvegicus
tcgctcagggccgaagctgagtgtc

SEQ ID NO: 574500 - DNA, 25 bp, Rattus norvegicus
agctgagtgtcgcagccgccatgtt

SEQ ID NO: 574501 - DNA, 25 bp, Rattus norvegicus
ctaagcccgctttggatgcccgcgt

SEQ ID NO: 574502 - DNA, 25 bp, Rattus norvegicus
ctcgtcgcttatcgcagaacctttc

SEQ ID NO: 574503 - DNA, 25 bp, Rattus norvegicus
catctgtacaaactggggctctgga

SEQ ID NO: 574504 - DNA, 25 bp, Rattus norvegicus
gaaaaagttacagagccggcggtca

SEQ ID NO: 574505 - DNA, 25 bp, Rattus norvegicus
ccggcggtcatacaaaagttggcat

SEQ ID NO: 574506 - DNA, 25 bp, Rattus norvegicus
catcgcctcgctgggtttttgtctt

SEQ ID NO: 574507 - DNA, 25 bp, Rattus norvegicus
tttgtcttttgtcctcccgagccga

SEQ ID NO: 574508 - DNA, 25 bp, Rattus norvegicus
ccgagccgagaaaacgctgtgtgcc

SEQ ID NO: 574509 - DNA, 25 bp, Rattus norvegicus
gtgtgcctcctctgcggacgataaa

SEQ ID NO: 574510 - DNA, 25 bp, Rattus norvegicus
ctgtacaaaaggtctcgtgaaaaca

SEQ ID NO: 574511 - DNA, 25 bp, Rattus norvegicus
cacggaagttcagtctaagaggcca

SEQ ID NO: 574512 - DNA, 25 bp, Rattus norvegicus
aagaggccagtctggtgtcagcgcc

SEQ ID NO: 574513 - DNA, 25 bp, Rattus norvegicus
cagatgtcacctggcgctcggctct

SEQ ID NO: 574514 - DNA, 25 bp, Rattus norvegicus
ctctccagagcggtctttttcacta

SEQ ID NO: 574515 - DNA, 25 bp, Rattus norvegicus
tttttcactagagcgcggagacatc

SEQ ID NO: 574516 - DNA, 25 bp, Rattus norvegicus
tcagcctcaggcagaagagccggcg

SEQ ID NO: 574517 - DNA, 25 bp, Rattus norvegicus
actctggggccgcaacttctagcaa

SEQ ID NO: 574518 - DNA, 25 bp, Rattus norvegicus
ccaagaggaagaaagaatcgctgtc

SEQ ID NO: 574519 - DNA, 25 bp, Rattus norvegicus
caaacaggtgcagtcgtggccaagt

SEQ ID NO: 574520 - DNA, 25 bp, Rattus norvegicus
gtggccaagttaaggcttcactttc

SEQ ID NO: 574521 - DNA, 25 bp, Rattus norvegicus
tcactttctgggtctgaagcggtgc

SEQ ID NO: 574522 - DNA, 25 bp, Rattus norvegicus
ctcttggcgactggaagactccttc

SEQ ID NO: 574523 - DNA, 25 bp, Rattus norvegicus
aagactccttcctgtgctggcttcc

SEQ ID NO: 574524 - DNA, 25 bp, Rattus norvegicus
ttccttggcggcttccaactctggg

SEQ ID NO: 574525 - DNA, 25 bp, Rattus norvegicus
gtgccaacgcgagcagagagccaga

SEQ ID NO: 574526 - DNA, 25 bp, Rattus norvegicus
tgccattaaatgagcgcgccgcggc

SEQ ID NO: 574527 - DNA, 25 bp, Rattus norvegicus
gcggggtcacagctacattgcttcc

SEQ ID NO: 574528 - DNA, 25 bp, Rattus norvegicus
ctacattgcttcctgagcgcgcgcg

SEQ ID NO: 574529 - DNA, 25 bp, Rattus norvegicus
tgtgcccaggacaagctgtccgctg

SEQ ID NO: 574530 - DNA, 25 bp, Rattus norvegicus
gcgctccgaatgattaacgattggg

SEQ ID NO: 574531 - DNA, 25 bp, Rattus norvegicus
ccacggcgtcactttagggttggcg

SEQ ID NO: 574532 - DNA, 25 bp, Rattus norvegicus
ctggaggctgccgttcgttcgctgt

SEQ ID NO: 574533 - DNA, 25 bp, Rattus norvegicus
ctgccgttcgttcgctgtcccggga

SEQ ID NO: 574534 - DNA, 25 bp, Rattus norvegicus
ccctaggcctgtctgtgaggaccct

SEQ ID NO: 574535 - DNA, 25 bp, Rattus norvegicus
ctgtctgtgaggaccctgctgcggc

SEQ ID NO: 574536 - DNA, 25 bp, Rattus norvegicus
atcgccgtctgctggccgccaccac

SEQ ID NO: 574537 - DNA, 25 bp, Rattus norvegicus
tccgccctcacggagccacctcggg

SEQ ID NO: 574538 - DNA, 25 bp, Rattus norvegicus
gaatgaaggcagagcgcatccgaga

SEQ ID NO: 574539 - DNA, 25 bp, Rattus norvegicus
agccacctcgggctgtcacctgtgt

SEQ ID NO: 574540 - DNA, 25 bp, Rattus norvegicus
acctcgggctgtcacctgtgtggcg

SEQ ID NO: 574541 - DNA, 25 bp, Rattus norvegicus
acaccacggcgtcactttagggttg

SEQ ID NO: 574542 - DNA, 25 bp, Rattus norvegicus
ccggcagttcggtgtttgctgttct

SEQ ID NO: 574543 - DNA, 25 bp, Rattus norvegicus
gtttgctgttctgcgcgcgcctctg

SEQ ID NO: 574544 - DNA, 25 bp, Rattus norvegicus
ctactgacaccacggcgtcacttta

SEQ ID NO: 574545 - DNA, 25 bp, Rattus norvegicus
atcctgcacatcctcccggaaagta

SEQ ID NO: 574546 - DNA, 25 bp, Rattus norvegicus
ccggggaggagtgaacttacagata

SEQ ID NO: 574547 - DNA, 25 bp, Rattus norvegicus
taaatcttgcctccatagccactgg

SEQ ID NO: 574548 - DNA, 25 bp, Rattus norvegicus
ttcacccgtctctgtaagggcgacc

SEQ ID NO: 574549 - DNA, 25 bp, Rattus norvegicus
gggcgacccacctagacatggcgtt

SEQ ID NO: 574550 - DNA, 25 bp, Rattus norvegicus
gttcgcgaaggtctccctcttactg

SEQ ID NO: 574551 - DNA, 25 bp, Rattus norvegicus
tgggctgctctccatagagtccaga

SEQ ID NO: 574552 - DNA, 25 bp, Rattus norvegicus
taaatagccgcgtttttgttcctgc

SEQ ID NO: 574553 - DNA, 25 bp, Rattus norvegicus
cgcgcgagttcgagacacacttaca

SEQ ID NO: 574554 - DNA, 25 bp, Rattus norvegicus
tacagttagttcttcctgcagcccg

SEQ ID NO: 574555 - DNA, 25 bp, Rattus norvegicus
tgcaccttcgcagccctgtctggtt

SEQ ID NO: 574556 - DNA, 25 bp, Rattus norvegicus
cacactgcaggcgagagagacaaga

SEQ ID NO: 574557 - DNA, 25 bp, Rattus norvegicus
ggggatcccgccacataatgaagcg

SEQ ID NO: 574558 - DNA, 25 bp, Rattus norvegicus
gggatacagccacccactaaatctt

SEQ ID NO: 574559 - DNA, 25 bp, Rattus norvegicus
agtggcttcttgtcccgggatgaga

SEQ ID NO: 574560 - DNA, 25 bp, Rattus norvegicus
tgagcgggcctgacgcttcatccgc

SEQ ID NO: 574561 - DNA, 25 bp, Rattus norvegicus
cgcgcaggaactcgcggatgttgct

SEQ ID NO: 574562 - DNA, 25 bp, Rattus norvegicus
aactcgcggatgttgctcaggcact

SEQ ID NO: 574563 - DNA, 25 bp, Rattus norvegicus
tgttgctcaggcactcgctctcgtt

SEQ ID NO: 574564 - DNA, 25 bp, Rattus norvegicus
gctccgggtagacctgcaacacaca

SEQ ID NO: 574565 - DNA, 25 bp, Rattus norvegicus
ctgcaacacacagcggcgctgagcg

SEQ ID NO: 574566 - DNA, 25 bp, Rattus norvegicus
ggaagtgacgtcgtcaaaccgcgcc

SEQ ID NO: 574567 - DNA, 25 bp, Rattus norvegicus
tgcgtcttcagctgcgggtgcttct

SEQ ID NO: 574568 - DNA, 25 bp, Rattus norvegicus
tgctccaaccctgctagtgctcgtc

SEQ ID NO: 574569 - DNA, 25 bp, Rattus norvegicus
caccacgtactccatggctggggtc

SEQ ID NO: 574570 - DNA, 25 bp, Rattus norvegicus
tggctggggtccctctacacgcact

SEQ ID NO: 574571 - DNA, 25 bp, Rattus norvegicus
gagacgtcgagtggcttcttgtccc

SEQ ID NO: 574572 - DNA, 25 bp, Rattus norvegicus
tcttcccgcgggtgctgcgtcttca

SEQ ID NO: 574573 - DNA, 25 bp, Rattus norvegicus
tgcgtgaaggtgactccgttgcaga

SEQ ID NO: 574574 - DNA, 25 bp, Rattus norvegicus
gtccgtgatgccatagacgtcgatg

SEQ ID NO: 574575 - DNA, 25 bp, Rattus norvegicus
atagacgtcgatgagtgcccagagt

SEQ ID NO: 574576 - DNA, 25 bp, Rattus norvegicus
cgccgcagtggaacagcactggttc

SEQ ID NO: 574577 - DNA, 25 bp, Rattus norvegicus
ctggttcgccatcattgacactata

SEQ ID NO: 574578 - DNA, 25 bp, Rattus norvegicus
tgacactatagaagacgcgaccgtg

SEQ ID NO: 574579 - DNA, 25 bp, Rattus norvegicus
accgtgacgatcagcccagtaggcc

SEQ ID NO: 574580 - DNA, 25 bp, Rattus norvegicus
cttggcccagtatccaggtcgtgtg

SEQ ID NO: 574581 - DNA, 25 bp, Rattus norvegicus
gggatatcctgtgcgctcatgagcg

SEQ ID NO: 574582 - DNA, 25 bp, Rattus norvegicus
ccgcacctgctcgtacaggcgaatg

SEQ ID NO: 574583 - DNA, 25 bp, Rattus norvegicus
ccgttgcagaagctgttccgtcgcg

SEQ ID NO: 574584 - DNA, 25 bp, Rattus norvegicus
ctgcgcgagtgaccgtctagacgca

SEQ ID NO: 574585 - DNA, 25 bp, Rattus norvegicus
tagacgcacgttcttgcccttggcc

SEQ ID NO: 574586 - DNA, 25 bp, Rattus norvegicus
tcgtgcgcagtgaagccgaagcgca

SEQ ID NO: 574587 - DNA, 25 bp, Rattus norvegicus
gtcagggccagcttatccaggcgca

SEQ ID NO: 574588 - DNA, 25 bp, Rattus norvegicus
gcctactcacggctggctcttgagg

SEQ ID NO: 574589 - DNA, 25 bp, Rattus norvegicus
tcagcaccagccatgggaggcagcg

SEQ ID NO: 574590 - DNA, 25 bp, Rattus norvegicus
cgcccatcctttgtgttcgaatagc

SEQ ID NO: 574591 - DNA, 25 bp, Rattus norvegicus
ttcgaatagcgtcagactcgcaggc

SEQ ID NO: 574592 - DNA, 25 bp, Rattus norvegicus
tactgccgatcagtcgcgtgcttcc

SEQ ID NO: 574593 - DNA, 25 bp, Rattus norvegicus
gcttctccagcgaggagctgctgtc

SEQ ID NO: 574594 - DNA, 25 bp, Rattus norvegicus
cgcgggcactttaaggcgccatttt

SEQ ID NO: 574595 - DNA, 25 bp, Rattus norvegicus
ccattttccgcgtggtgttctgtta

SEQ ID NO: 574596 - DNA, 25 bp, Rattus norvegicus
tgcagcaaagcggtctgggagtcaa

SEQ ID NO: 574597 - DNA, 25 bp, Rattus norvegicus
acccagggcgcatgtgcacacttgt

SEQ ID NO: 574598 - DNA, 25 bp, Rattus norvegicus
gcacacttgtggctgttccgagcgg

SEQ ID NO: 574599 - DNA, 25 bp, Rattus norvegicus
tgaggactccttctacggctggacg

SEQ ID NO: 574600 - DNA, 25 bp, Rattus norvegicus
accgaatgcagttgaggcggtttgc

SEQ ID NO: 574601 - DNA, 25 bp, Rattus norvegicus
gttgtcacagccgatcatctctccg

SEQ ID NO: 574602 - DNA, 25 bp, Rattus norvegicus
cgaggcgttttctcggttctcgttg

SEQ ID NO: 574603 - DNA, 25 bp, Rattus norvegicus
tcgtgattgttcgaggcgttttctc

SEQ ID NO: 574604 - DNA, 25 bp, Rattus norvegicus
atgtcgtcatggtcgtgattgttcg

SEQ ID NO: 574605 - DNA, 25 bp, Rattus norvegicus
cgttcctgaggtgatgtcgtcatgg

SEQ ID NO: 574606 - DNA, 25 bp, Rattus norvegicus
ctttcttctccttgggcgttcctga

SEQ ID NO: 574607 - DNA, 25 bp, Rattus norvegicus
tgctttggccttagagcgtttcttc

SEQ ID NO: 574608 - DNA, 25 bp, Rattus norvegicus
cacagacagtacgtgggctcgttgg

SEQ ID NO: 574609 - DNA, 25 bp, Rattus norvegicus
cagccgatcatctctccgtaggaga

SEQ ID NO: 574610 - DNA, 25 bp, Rattus norvegicus
atgggacactcgtcgttgtcacagc

SEQ ID NO: 574611 - DNA, 25 bp, Rattus norvegicus
gttctcgttgtttcgctgcctccgg

SEQ ID NO: 574612 - DNA, 25 bp, Rattus norvegicus
ggggacgcctccctctctgctttgg

SEQ ID NO: 574613 - DNA, 25 bp, Rattus norvegicus
tctccgtaggagacctggttgcaca

SEQ ID NO: 574614 - DNA, 25 bp, Rattus norvegicus
gacctggttgcacagacagtacgtg

SEQ ID NO: 574615 - DNA, 25 bp, Rattus norvegicus
acccgccaccagcgtggagagcgga

SEQ ID NO: 574616 - DNA, 25 bp, Rattus norvegicus
ccgcggcgcccgcatagcactccac

SEQ ID NO: 574617 - DNA, 25 bp, Rattus norvegicus
atagcactccacctcgcgcggccgc

SEQ ID NO: 574618 - DNA, 25 bp, Rattus norvegicus
tcccggaggacacggcaaatcaccg

SEQ ID NO: 574619 - DNA, 25 bp, Rattus norvegicus
aggacacggcaaatcaccgagccca

SEQ ID NO: 574620 - DNA, 25 bp, Rattus norvegicus
gtcggcggctacatctggcgcctgc

SEQ ID NO: 574621 - DNA, 25 bp, Rattus norvegicus
ggcggccgaggctctagcgcacact

SEQ ID NO: 574622 - DNA, 25 bp, Rattus norvegicus
ctctagcgcacactccgccggccgt

SEQ ID NO: 574623 - DNA, 25 bp, Rattus norvegicus
gagcgcgcacacacccaaagagggc

SEQ ID NO: 574624 - DNA, 25 bp, Rattus norvegicus
tcgccgcacttgtccaacgtggaaa

SEQ ID NO: 574625 - DNA, 25 bp, Rattus norvegicus
gcacttgtccaacgtggaaaaccca

SEQ ID NO: 574626 - DNA, 25 bp, Rattus norvegicus
caaataccagtttcaaacacttggg

SEQ ID NO: 574627 - DNA, 25 bp, Rattus norvegicus
tcaaacacttgggaaacattcagcc

SEQ ID NO: 574628 - DNA, 25 bp, Rattus norvegicus
ggccgtgcgtacgagcgcgcacaca

SEQ ID NO: 574629 - DNA, 25 bp, Rattus norvegicus
cggcctgcaggattttgccttacgc

SEQ ID NO: 574630 - DNA, 25 bp, Rattus norvegicus
gccgctcggacgcagtctcctggtg

SEQ ID NO: 574631 - DNA, 25 bp, Rattus norvegicus
atcgtgggccgctcggacgcagtct

SEQ ID NO: 574632 - DNA, 25 bp, Rattus norvegicus
caggcaagaaggagccgctgatcgt

SEQ ID NO: 574633 - DNA, 25 bp, Rattus norvegicus
cctcacaggcaagaaggagccgctg

SEQ ID NO: 574634 - DNA, 25 bp, Rattus norvegicus
caggtgcataacagcctcacaggca

SEQ ID NO: 574635 - DNA, 25 bp, Rattus norvegicus
caccggtgtgcaggtgcataacagc

SEQ ID NO: 574636 - DNA, 25 bp, Rattus norvegicus
cacaaggccaggacaccggtgtgca

SEQ ID NO: 574637 - DNA, 25 bp, Rattus norvegicus
tggcaacggccacaaggccaggaca

SEQ ID NO: 574638 - DNA, 25 bp, Rattus norvegicus
cgggcatggcaacggccacaaggcc

SEQ ID NO: 574639 - DNA, 25 bp, Rattus norvegicus
tgtccccaatatgctgagggcgctc

SEQ ID NO: 574640 - DNA, 25 bp, Rattus norvegicus
ttgccttacgcctgttcgctggatc

SEQ ID NO: 574641 - DNA, 25 bp, Rattus norvegicus
gcccggcctgcaggattttgcctta

SEQ ID NO: 574642 - DNA, 25 bp, Rattus norvegicus
tacgcctgttcgctggatctgtccc

SEQ ID NO: 574643 - DNA, 25 bp, Rattus norvegicus
cggccactgccattggtctcagctc

SEQ ID NO: 574644 - DNA, 25 bp, Rattus norvegicus
gccggaagcgtgctccggactccga

SEQ ID NO: 574645 - DNA, 25 bp, Rattus norvegicus
catgaccgtccagcggacttccggg

SEQ ID NO: 574646 - DNA, 25 bp, Rattus norvegicus
tggagcaccaggcagagtccgccct

SEQ ID NO: 574647 - DNA, 25 bp, Rattus norvegicus
cggtccgggccggtacctgctagca

SEQ ID NO: 574648 - DNA, 25 bp, Rattus norvegicus
tacctgctagcagcggcgaacagtg

SEQ ID NO: 574649 - DNA, 25 bp, Rattus norvegicus
cagcggcgaacagtggaacgcgatc

SEQ ID NO: 574650 - DNA, 25 bp, Rattus norvegicus
atcgcggcggagagcagtgccatca

SEQ ID NO: 574651 - DNA, 25 bp, Rattus norvegicus
gagagcagtgccatcacgaccgccg

SEQ ID NO: 574652 - DNA, 25 bp, Rattus norvegicus
ggacaaacagccatccgcgggacgc

SEQ ID NO: 574653 - DNA, 25 bp, Rattus norvegicus
gggacgccggtatcgatcttacctc

SEQ ID NO: 574654 - DNA, 25 bp, Rattus norvegicus
gtatcgatcttacctcctccgcagg

SEQ ID NO: 574655 - DNA, 25 bp, Rattus norvegicus
cggatgcccatgaccgtccagcgga

SEQ ID NO: 574656 - DNA, 25 bp, Rattus norvegicus
ggcgcggatcgccacacaccggatg

SEQ ID NO: 574657 - DNA, 25 bp, Rattus norvegicus
cgcccgacccatcttccgcgcgtgc

SEQ ID NO: 574658 - DNA, 25 bp, Rattus norvegicus
taacccggcggatgctcgctcgaaa

SEQ ID NO: 574659 - DNA, 25 bp, Rattus norvegicus
gcgacttcctaacccggcggatgct

SEQ ID NO: 574660 - DNA, 25 bp, Rattus norvegicus
ccggcggatgctcgctcgaaacgct

SEQ ID NO: 574661 - DNA, 25 bp, Rattus norvegicus
taacggccgcgcgctaacagtcgcg

SEQ ID NO: 574662 - DNA, 25 bp, Rattus norvegicus
cgggaagatgaataagggctggctg

SEQ ID NO: 574663 - DNA, 25 bp, Rattus norvegicus
cgtgcgcatcctcgcctctgcgcgc

SEQ ID NO: 574664 - DNA, 25 bp, Rattus norvegicus
caggcggaaggccagccccggatta

SEQ ID NO: 574665 - DNA, 25 bp, Rattus norvegicus
ccggattaggctcgtcgtgtgtgat

SEQ ID NO: 574666 - DNA, 25 bp, Rattus norvegicus
cgtcgtgtgtgatgacgttgtactc

SEQ ID NO: 574667 - DNA, 25 bp, Rattus norvegicus
atgacgttgtactcccggcgcgggt

SEQ ID NO: 574668 - DNA, 25 bp, Rattus norvegicus
cccgttgtctgtgtggggctgagaa

SEQ ID NO: 574669 - DNA, 25 bp, Rattus norvegicus
ctgagagaccgctccgcgggaagat

SEQ ID NO: 574670 - DNA, 25 bp, Rattus norvegicus
ctcccagcccaggttgcccacccag

SEQ ID NO: 574671 - DNA, 25 bp, Rattus norvegicus
ttggaaaatacgtgtcagtgtggcc

SEQ ID NO: 574672 - DNA, 25 bp, Rattus norvegicus
cgccgccgcaagaataaacgattta

SEQ ID NO: 574673 - DNA, 25 bp, Rattus norvegicus
gcagacagttgtcaaaacggggacc

SEQ ID NO: 574674 - DNA, 25 bp, Rattus norvegicus
aggttgcttccgctgctagctctca

SEQ ID NO: 574675 - DNA, 25 bp, Rattus norvegicus
ccaggctggaggttgcttccgctgc

SEQ ID NO: 574676 - DNA, 25 bp, Rattus norvegicus
acgtgtcagtgtggccacaaccgtc

SEQ ID NO: 574677 - DNA, 25 bp, Rattus norvegicus
aatacgtgtcagtgtggccacaacc

SEQ ID NO: 574678 - DNA, 25 bp, Rattus norvegicus
ccgccgcaagaataaacgatttatt

SEQ ID NO: 574679 - DNA, 25 bp, Rattus norvegicus
gtcccgccgccgcaagaataaacga

SEQ ID NO: 574680 - DNA, 25 bp, Rattus norvegicus
ctggatagaagtgttgggtaaatta

SEQ ID NO: 574681 - DNA, 25 bp, Rattus norvegicus
atcactggatagaagtgttgggtaa

SEQ ID NO: 574682 - DNA, 25 bp, Rattus norvegicus
aaatgcaagctgctcagtccgcgac

SEQ ID NO: 574683 - DNA, 25 bp, Rattus norvegicus
tggcaaatgcaagctgctcagtccg

SEQ ID NO: 574684 - DNA, 25 bp, Rattus norvegicus
cgatttatttggaaaatacgtgtca

SEQ ID NO: 574685 - DNA, 25 bp, Rattus norvegicus
cctccgcggctatgcggaagccgga

SEQ ID NO: 574686 - DNA, 25 bp, Rattus norvegicus
cacctcacgtggtcgcagggctgag

SEQ ID NO: 574687 - DNA, 25 bp, Rattus norvegicus
agggctgagttcactgtcgagtaca

SEQ ID NO: 574688 - DNA, 25 bp, Rattus norvegicus
cagtggcgctccttcaacatctcta

SEQ ID NO: 574689 - DNA, 25 bp, Rattus norvegicus
tggagcgcttcctctccggaacttc

SEQ ID NO: 574690 - DNA, 25 bp, Rattus norvegicus
gaacttcagcgcgttcggacctcag

SEQ ID NO: 574691 - DNA, 25 bp, Rattus norvegicus
cggacctcaggccagtgccactaga

SEQ ID NO: 574692 - DNA, 25 bp, Rattus norvegicus
tctctatatgggacaccgcaggtga

SEQ ID NO: 574693 - DNA, 25 bp, Rattus norvegicus
catcctggactggtgaccgagaagc

SEQ ID NO: 574694 - DNA, 25 bp, Rattus norvegicus
gtgggtaaaacgtccttgctgcagc

SEQ ID NO: 574695 - DNA, 25 bp, Rattus norvegicus
ttgctgcagcgctacatggagcgtc

SEQ ID NO: 574696 - DNA, 25 bp, Rattus norvegicus
tacatggagcgtcgcttcccggaca

SEQ ID NO: 574697 - DNA, 25 bp, Rattus norvegicus
ggcggcgccttctacctgaagcagt

SEQ ID NO: 574698 - DNA, 25 bp, Rattus norvegicus
gtgccactagagttctggattccta

SEQ ID NO: 574699 - DNA, 25 bp, Rattus norvegicus
ctgaagcgttggctcgcgacacact

SEQ ID NO: 574700 - DNA, 25 bp, Rattus norvegicus
gtgggctgcgatcgcacatccatta

SEQ ID NO: 574701 - DNA, 25 bp, Rattus norvegicus
acggccaggtgcactcttccacagg

SEQ ID NO: 574702 - DNA, 25 bp, Rattus norvegicus
ttctgctccacgaggagcgcagccg

SEQ ID NO: 574703 - DNA, 25 bp, Rattus norvegicus
ggctcagcgtctggcttctgctgcc

SEQ ID NO: 574704 - DNA, 25 bp, Rattus norvegicus
tacaagtccgcgacttggggcctgg

SEQ ID NO: 574705 - DNA, 25 bp, Rattus norvegicus
gttcggactccctgcgacaccaagt

SEQ ID NO: 574706 - DNA, 25 bp, Rattus norvegicus
tctctctcacctcggggtcaggagc

SEQ ID NO: 574707 - DNA, 25 bp, Rattus norvegicus
gactgaagcttagcgcgtaccgtgg

SEQ ID NO: 574708 - DNA, 25 bp, Rattus norvegicus
gcgccaacaaattggggagctcctc

SEQ ID NO: 574709 - DNA, 25 bp, Rattus norvegicus
accagggagccagtgagatttgaac

SEQ ID NO: 574710 - DNA, 25 bp, Rattus norvegicus
agatttgaactctcatagccaaggc

SEQ ID NO: 574711 - DNA, 25 bp, Rattus norvegicus
cctcctttgttacgggctgggtgag

SEQ ID NO: 574712 - DNA, 25 bp, Rattus norvegicus
gcacatccattacggaacctccttt

SEQ ID NO: 574713 - DNA, 25 bp, Rattus norvegicus
ggctgcgtcgcagctgagtcacctc

SEQ ID NO: 574714 - DNA, 25 bp, Rattus norvegicus
tcggagattcggttcctgctgatca

SEQ ID NO: 574715 - DNA, 25 bp, Rattus norvegicus
acgccctgcagggaccagtcagctt

SEQ ID NO: 574716 - DNA, 25 bp, Rattus norvegicus
gcacaacgtgtacctggacgccctg

SEQ ID NO: 574717 - DNA, 25 bp, Rattus norvegicus
gcgggcaagtttggcacaacgtgta

SEQ ID NO: 574718 - DNA, 25 bp, Rattus norvegicus
cacgcgattcccttggcttgctgct

SEQ ID NO: 574719 - DNA, 25 bp, Rattus norvegicus
tgttttccattttcccacgcgattc

SEQ ID NO: 574720 - DNA, 25 bp, Rattus norvegicus
gctgatcatcaacttcccgcggagg

SEQ ID NO: 574721 - DNA, 25 bp, Rattus norvegicus
gcgtggtgagctcttcctctcgcac

SEQ ID NO: 574722 - DNA, 25 bp, Rattus norvegicus
accgcgcacttgtggcgctgagtca

SEQ ID NO: 574723 - DNA, 25 bp, Rattus norvegicus
tggcgctgagtcaccgggaaactga

SEQ ID NO: 574724 - DNA, 25 bp, Rattus norvegicus
cgccaccaggaaatgccttttttag

SEQ ID NO: 574725 - DNA, 25 bp, Rattus norvegicus
atgccttttttagactgccagtctg

SEQ ID NO: 574726 - DNA, 25 bp, Rattus norvegicus
ggcgtgcaggcctgttttccatttt

SEQ ID NO: 574727 - DNA, 25 bp, Rattus norvegicus
caagcgcttcttcgtgctgcgcggc

SEQ ID NO: 574728 - DNA, 25 bp, Rattus norvegicus
cctctacaccaaggacgagtacttc

SEQ ID NO: 574729 - DNA, 25 bp, Rattus norvegicus
agcacaagtacctgatcgccctcta

SEQ ID NO: 574730 - DNA, 25 bp, Rattus norvegicus
cgcggacgccaagcacaagtacctg

SEQ ID NO: 574731 - DNA, 25 bp, Rattus norvegicus
ctgaacatcaacaagcgcgcggacg

SEQ ID NO: 574732 - DNA, 25 bp, Rattus norvegicus
caaacccaggtcgtcgttggtggca

SEQ ID NO: 574733 - DNA, 25 bp, Rattus norvegicus
gccgaacatccttccgagcggcgga

SEQ ID NO: 574734 - DNA, 25 bp, Rattus norvegicus
gacggcccgaacctcaataacaaca

SEQ ID NO: 574735 - DNA, 25 bp, Rattus norvegicus
ctgcgcaagcagaagcacggccaca

SEQ ID NO: 574736 - DNA, 25 bp, Rattus norvegicus
ctccgcggctggagtactatgagag

SEQ ID NO: 574737 - DNA, 25 bp, Rattus norvegicus
ccgaagcgagtgatcgcgctcgact

SEQ ID NO: 574738 - DNA, 25 bp, Rattus norvegicus
gcgctcgactgctgtctgaacatca

SEQ ID NO: 574739 - DNA, 25 bp, Rattus norvegicus
ctcaccgacttggtcagcgaaggcc

SEQ ID NO: 574740 - DNA, 25 bp, Rattus norvegicus
ccacagcgtgcgcaagtgcggctac

SEQ ID NO: 574741 - DNA, 25 bp, Rattus norvegicus
ctctcctggtcggacggtgctctga

SEQ ID NO: 574742 - DNA, 25 bp, Rattus norvegicus
gtgtggcaccggtattgaatgagtc

SEQ ID NO: 574743 - DNA, 25 bp, Rattus norvegicus
acggtgctctgagaggctgcaatct

SEQ ID NO: 574744 - DNA, 25 bp, Rattus norvegicus
caaacacaagctggtgcgcttgctg

SEQ ID NO: 574745 - DNA, 25 bp, Rattus norvegicus
cgcatgccaaccaaacacaagctgg

SEQ ID NO: 574746 - DNA, 25 bp, Rattus norvegicus
tggagtcgcctgcaacgcatgccaa

SEQ ID NO: 574747 - DNA, 25 bp, Rattus norvegicus
cccggcctattggagtcgcctgcaa

SEQ ID NO: 574748 - DNA, 25 bp, Rattus norvegicus
agcatgggctacgagtccgctaggt

SEQ ID NO: 574749 - DNA, 25 bp, Rattus norvegicus
cgccgcagcctatgagcatgggcta

SEQ ID NO: 574750 - DNA, 25 bp, Rattus norvegicus
cgctgctactccaggacccagtgca

SEQ ID NO: 574751 - DNA, 25 bp, Rattus norvegicus
ccggctcaggcgagagtgcaaaaaa

SEQ ID NO: 574752 - DNA, 25 bp, Rattus norvegicus
gcaactcagctagagcgagcaccga

SEQ ID NO: 574753 - DNA, 25 bp, Rattus norvegicus
ccggtattgaatgagtcgccgctcc

SEQ ID NO: 574754 - DNA, 25 bp, Rattus norvegicus
gctgcaatctccaggccgtgtggca

SEQ ID NO: 574755 - DNA, 25 bp, Rattus norvegicus
tcaggacccgcccttctgagtaggg

SEQ ID NO: 574756 - DNA, 25 bp, Rattus norvegicus
aacactcggtctccacaacggcagt

SEQ ID NO: 574757 - DNA, 25 bp, Rattus norvegicus
gacgtagccctcacttgtgcgtttg

SEQ ID NO: 574758 - DNA, 25 bp, Rattus norvegicus
atagtggctccatgatgccggccta

SEQ ID NO: 574759 - DNA, 25 bp, Rattus norvegicus
gcccttctgagtagggcgcccgcga

SEQ ID NO: 574760 - DNA, 25 bp, Rattus norvegicus
tccaggtttggcctcgcggcgagct

SEQ ID NO: 574761 - DNA, 25 bp, Rattus norvegicus
ctgtggaggtttttgctgaagttca

SEQ ID NO: 574762 - DNA, 25 bp, Rattus norvegicus
agttcagcttcaggattgaatcagg

SEQ ID NO: 574763 - DNA, 25 bp, Rattus norvegicus
attgaatcaggtatcggagaggacg

SEQ ID NO: 574764 - DNA, 25 bp, Rattus norvegicus
acggtcgcaaggtactgacgtcaga

SEQ ID NO: 574765 - DNA, 25 bp, Rattus norvegicus
aggtactgacgtcagagcctcagca

SEQ ID NO: 574766 - DNA, 25 bp, Rattus norvegicus
agcctcagcaagaagtcgcctgcga

SEQ ID NO: 574767 - DNA, 25 bp, Rattus norvegicus
aagtcgcctgcgactctctacgtcg

SEQ ID NO: 574768 - DNA, 25 bp, Rattus norvegicus
gtgcgtttgttggtatagtggctcc

SEQ ID NO: 574769 - DNA, 25 bp, Rattus norvegicus
cgccgccgcgtcttttgaaagtttg

SEQ ID NO: 574770 - DNA, 25 bp, Rattus norvegicus
aagtttgcaccggtagcgcactgga

SEQ ID NO: 574771 - DNA, 25 bp, Rattus norvegicus
catcgctgctccgagagtcgcggcg

SEQ ID NO: 574772 - DNA, 25 bp, Rattus norvegicus
gtgcaccgtgttgcccatcgctgct

SEQ ID NO: 574773 - DNA, 25 bp, Rattus norvegicus
ctcgggcagccaggctctggcttgc

SEQ ID NO: 574774 - DNA, 25 bp, Rattus norvegicus
tccggctgtaacaaaggcacggggc

SEQ ID NO: 574775 - DNA, 25 bp, Rattus norvegicus
gctcatcagcgacctccggctgtaa

SEQ ID NO: 574776 - DNA, 25 bp, Rattus norvegicus
acgccgccaagaagtagcacgtgtg

SEQ ID NO: 574777 - DNA, 25 bp, Rattus norvegicus
tctgggaaattctagggcgcttata

SEQ ID NO: 574778 - DNA, 25 bp, Rattus norvegicus
caccgtggcctttctccggtctggg

SEQ ID NO: 574779 - DNA, 25 bp, Rattus norvegicus
tattttcaacgaggcgtggcgtccc

SEQ ID NO: 574780 - DNA, 25 bp, Rattus norvegicus
caatcactaggtattttcaacgagg

SEQ ID NO: 574781 - DNA, 25 bp, Rattus norvegicus
gcgctgacctgttccacaatcacta

SEQ ID NO: 574782 - DNA, 25 bp, Rattus norvegicus
gctgtacgaggagacccgggacacc

SEQ ID NO: 574783 - DNA, 25 bp, Rattus norvegicus
acgcgctctcacgcgttcgcggaga

SEQ ID NO: 574784 - DNA, 25 bp, Rattus norvegicus
ggtcctcttggtcactctggatccc

SEQ ID NO: 574785 - DNA, 25 bp, Rattus norvegicus
tcccacgacccagcaacggacagtc

SEQ ID NO: 574786 - DNA, 25 bp, Rattus norvegicus
ggctgtcgcttggtcctggcgccct

SEQ ID NO: 574787 - DNA, 25 bp, Rattus norvegicus
acgcaaccaccagggctgtcgcttg

SEQ ID NO: 574788 - DNA, 25 bp, Rattus norvegicus
ttctggtcctcttggtcactctgga

SEQ ID NO: 574789 - DNA, 25 bp, Rattus norvegicus
ggtcccttctggtcctcttggtcac

SEQ ID NO: 574790 - DNA, 25 bp, Rattus norvegicus
atagcccacagctgggttcccggtc

SEQ ID NO: 574791 - DNA, 25 bp, Rattus norvegicus
gcagctctgtccctgcccactcggt

SEQ ID NO: 574792 - DNA, 25 bp, Rattus norvegicus
tccacccgctggcagctcgcagccc

SEQ ID NO: 574793 - DNA, 25 bp, Rattus norvegicus
ctgcgctgagaagcgctggggaccc

SEQ ID NO: 574794 - DNA, 25 bp, Rattus norvegicus
ccggccaccgagcacagacaggagg

SEQ ID NO: 574795 - DNA, 25 bp, Rattus norvegicus
ggacagtccggctctcctctgctgc

SEQ ID NO: 574796 - DNA, 25 bp, Rattus norvegicus
accaccagggctgtcgcttggtcct

SEQ ID NO: 574797 - DNA, 25 bp, Rattus norvegicus
acataacctgttctccggcttcctt

SEQ ID NO: 574798 - DNA, 25 bp, Rattus norvegicus
tgcacttccggctcgcgtgcggtgt

SEQ ID NO: 574799 - DNA, 25 bp, Rattus norvegicus
cgccaccgtctagcccggagctctt

SEQ ID NO: 574800 - DNA, 25 bp, Rattus norvegicus
aggggtcgccgtcgccaccgtctag

SEQ ID NO: 574801 - DNA, 25 bp, Rattus norvegicus
cgcactcactcaggctcgcgggcgg

SEQ ID NO: 574802 - DNA, 25 bp, Rattus norvegicus
ctgaccgactgttccaggcagggga

SEQ ID NO: 574803 - DNA, 25 bp, Rattus norvegicus
ggtttgctgaccgactgttccaggc

SEQ ID NO: 574804 - DNA, 25 bp, Rattus norvegicus
caagcccggggtttgctgaccgact

SEQ ID NO: 574805 - DNA, 25 bp, Rattus norvegicus
ggtccgcacctgttacagacaaacg

SEQ ID NO: 574806 - DNA, 25 bp, Rattus norvegicus
gcggttagcaggtccgcacctgtta

SEQ ID NO: 574807 - DNA, 25 bp, Rattus norvegicus
tgcggtgtccctggcaaatgccacc

SEQ ID NO: 574808 - DNA, 25 bp, Rattus norvegicus
acctgttacagacaaacgcgcccgt

SEQ ID NO: 574809 - DNA, 25 bp, Rattus norvegicus
cagctgcgcggttagcaggtccgca

SEQ ID NO: 574810 - DNA, 25 bp, Rattus norvegicus
gcatgcgcagcacagtgggctccgc

SEQ ID NO: 574811 - DNA, 25 bp, Rattus norvegicus
caataaacagctggcggaaacgcgg

SEQ ID NO: 574812 - DNA, 25 bp, Rattus norvegicus
ttctcgtggggcgacgccttccgcg

SEQ ID NO: 574813 - DNA, 25 bp, Rattus norvegicus
ggctgtcaggtcctagcgtcaccac

SEQ ID NO: 574814 - DNA, 25 bp, Rattus norvegicus
cggaatgaaagtgggcgacttctcg

SEQ ID NO: 574815 - DNA, 25 bp, Rattus norvegicus
gcctgcgcaataaacagctggcgga

SEQ ID NO: 574816 - DNA, 25 bp, Rattus norvegicus
actgcgcctgcgcaataaacagctg

SEQ ID NO: 574817 - DNA, 25 bp, Rattus norvegicus
aggctctctggcctccactgcgcct

SEQ ID NO: 574818 - DNA, 25 bp, Rattus norvegicus
tttaaacgcctccaggctctctggc

SEQ ID NO: 574819 - DNA, 25 bp, Rattus norvegicus
gtctgcgcctttaaacgcctccagg

SEQ ID NO: 574820 - DNA, 25 bp, Rattus norvegicus
gaacctccttagctttcggcagaga

SEQ ID NO: 574821 - DNA, 25 bp, Rattus norvegicus
tttgcctcgtctgcgcctttaaacg

SEQ ID NO: 574822 - DNA, 25 bp, Rattus norvegicus
gcctttgcctcgtctgcgcctttaa

SEQ ID NO: 574823 - DNA, 25 bp, Rattus norvegicus
cttagctttcggcagagaccgtgga

SEQ ID NO: 574824 - DNA, 25 bp, Rattus norvegicus
aggctgcctaggcaagtcgtgtggc

SEQ ID NO: 574825 - DNA, 25 bp, Rattus norvegicus
gtgataggagcagcgccagccaccc

SEQ ID NO: 574826 - DNA, 25 bp, Rattus norvegicus
tccaggacgaagatggcggcaactt

SEQ ID NO: 574827 - DNA, 25 bp, Rattus norvegicus
ccaaaaaagtgtgcctccaggacga

SEQ ID NO: 574828 - DNA, 25 bp, Rattus norvegicus
agatgacgcaaaatccagcgctccc

SEQ ID NO: 574829 - DNA, 25 bp, Rattus norvegicus
tccggaggcccagagcaggcgactc

SEQ ID NO: 574830 - DNA, 25 bp, Rattus norvegicus
gcgggaggagatgacgcaaaatcca

SEQ ID NO: 574831 - DNA, 25 bp, Rattus norvegicus
tcactgcaccaggatggagagacct

SEQ ID NO: 574832 - DNA, 25 bp, Rattus norvegicus
tcccggggctgaaccgctgtcactg

SEQ ID NO: 574833 - DNA, 25 bp, Rattus norvegicus
cgaagatggcggcaacttagcccgg

SEQ ID NO: 574834 - DNA, 25 bp, Rattus norvegicus
ctccggtcgccgtcagtgggcagca

SEQ ID NO: 574835 - DNA, 25 bp, Rattus norvegicus
acccgcgcgctgacaatgccggggt

SEQ ID NO: 574836 - DNA, 25 bp, Rattus norvegicus
agcgggctgtcctcagctgggccat

SEQ ID NO: 574837 - DNA, 25 bp, Rattus norvegicus
ctgtcctcagctgggccatggggac

SEQ ID NO: 574838 - DNA, 25 bp, Rattus norvegicus
cgctgtcactgcaccaggatggaga

SEQ ID NO: 574839 - DNA, 25 bp, Rattus norvegicus
ggccaactccgttgtggaacttgtc

SEQ ID NO: 574840 - DNA, 25 bp, Rattus norvegicus
tttctaggaaactctgccaagccgg

SEQ ID NO: 574841 - DNA, 25 bp, Rattus norvegicus
gtcgtccaggggctcgcggccaact

SEQ ID NO: 574842 - DNA, 25 bp, Rattus norvegicus
gctcgcggccaactccgttgtggaa

SEQ ID NO: 574843 - DNA, 25 bp, Rattus norvegicus
cctccggccagtgcttcacggtgga

SEQ ID NO: 574844 - DNA, 25 bp, Rattus norvegicus
aaactctgccaagccggtgtggcgc

SEQ ID NO: 574845 - DNA, 25 bp, Rattus norvegicus
ctccgttgtggaacttgtcggattt

SEQ ID NO: 574846 - DNA, 25 bp, Rattus norvegicus
gggctctttttctaggaaactctgc

SEQ ID NO: 574847 - DNA, 25 bp, Rattus norvegicus
acaaccgaagcagggctctttttct

SEQ ID NO: 574848 - DNA, 25 bp, Rattus norvegicus
ccgaggcaagaacaaccgaagcagg

SEQ ID NO: 574849 - DNA, 25 bp, Rattus norvegicus
cggcagcaagggcaaccgaggcaag

SEQ ID NO: 574850 - DNA, 25 bp, Rattus norvegicus
cgccgcccaggcacacagactcctc

SEQ ID NO: 574851 - DNA, 25 bp, Rattus norvegicus
ctcctggccagcatgggggagtcct

SEQ ID NO: 574852 - DNA, 25 bp, Rattus norvegicus
tgtggcgcctagagacttgttaccc

SEQ ID NO: 574853 - DNA, 25 bp, Rattus norvegicus
ccgctggtggtgtctccagtggcat

SEQ ID NO: 574854 - DNA, 25 bp, Rattus norvegicus
gagaggcttcatctctgccgggccc

SEQ ID NO: 574855 - DNA, 25 bp, Rattus norvegicus
caggtcttgggagaggcttcatctc

SEQ ID NO: 574856 - DNA, 25 bp, Rattus norvegicus
gggactctcacgagatccgcccagt

SEQ ID NO: 574857 - DNA, 25 bp, Rattus norvegicus
tagcagagacttttctctctcgccc

SEQ ID NO: 574858 - DNA, 25 bp, Rattus norvegicus
ggcatcgatttagcagagacttttc

SEQ ID NO: 574859 - DNA, 25 bp, Rattus norvegicus
tgtctccagtggcatcgatttagca

SEQ ID NO: 574860 - DNA, 25 bp, Rattus norvegicus
gcaaacgaggctccgatccgccatt

SEQ ID NO: 574861 - DNA, 25 bp, Rattus norvegicus
gctccgatccgccattaaaataaca

SEQ ID NO: 574862 - DNA, 25 bp, Rattus norvegicus
ataacaaacaataattccgacgtag

SEQ ID NO: 574863 - DNA, 25 bp, Rattus norvegicus
taaacttcgctttcctaaacatcga

SEQ ID NO: 574864 - DNA, 25 bp, Rattus norvegicus
tttcctaaacatcgaaagctgttcc

SEQ ID NO: 574865 - DNA, 25 bp, Rattus norvegicus
tcgaaagctgttcctcctaaactca

SEQ ID NO: 574866 - DNA, 25 bp, Rattus norvegicus
cgagatccgcccagtcaaccgttcg

SEQ ID NO: 574867 - DNA, 25 bp, Rattus norvegicus
ccaggaccgctcacgccctagaggt

SEQ ID NO: 574868 - DNA, 25 bp, Rattus norvegicus
ggtccaaccggttcttctgggcaga

SEQ ID NO: 574869 - DNA, 25 bp, Rattus norvegicus
ttcctccgtgtccactacttttgcg

SEQ ID NO: 574870 - DNA, 25 bp, Rattus norvegicus
gtccactacttttgcgccttaataa

SEQ ID NO: 574871 - DNA, 25 bp, Rattus norvegicus
catcccgccgcctcatggacctacc

SEQ ID NO: 574872 - DNA, 25 bp, Rattus norvegicus
tggacctaccgactcctctaaacag

SEQ ID NO: 574873 - DNA, 25 bp, Rattus norvegicus
cgactcctctaaacagcaaagtttt

SEQ ID NO: 574874 - DNA, 25 bp, Rattus norvegicus
agcaaagttttcgatgcctcctgtc

SEQ ID NO: 574875 - DNA, 25 bp, Rattus norvegicus
tttcgatgcctcctgtctctaggga

SEQ ID NO: 574876 - DNA, 25 bp, Rattus norvegicus
cgatgcctcctgtctctagggaagg

SEQ ID NO: 574877 - DNA, 25 bp, Rattus norvegicus
ctcctgtctctagggaaggacgctg

SEQ ID NO: 574878 - DNA, 25 bp, Rattus norvegicus
gcgggccgaagcttccggctacgaa

SEQ ID NO: 574879 - DNA, 25 bp, Rattus norvegicus
cctagaggtccaaccggttcttctg

SEQ ID NO: 574880 - DNA, 25 bp, Rattus norvegicus
ccaaccggttcttctgggcagaggc

SEQ ID NO: 574881 - DNA, 25 bp, Rattus norvegicus
gttccatcagccgagctgttctctg

SEQ ID NO: 574882 - DNA, 25 bp, Rattus norvegicus
atcagcacccggctcttgtccagga

SEQ ID NO: 574883 - DNA, 25 bp, Rattus norvegicus
ttcgaagtcgtccagcatcagcacc

SEQ ID NO: 574884 - DNA, 25 bp, Rattus norvegicus
tccacggtcctttcgaagtcgtcca

SEQ ID NO: 574885 - DNA, 25 bp, Rattus norvegicus
tatgagcactgcagcttcccgtcca

SEQ ID NO: 574886 - DNA, 25 bp, Rattus norvegicus
cgagctgttctctggctggaatagc

SEQ ID NO: 574887 - DNA, 25 bp, Rattus norvegicus
tcgcccgtgtggattctcgtatgtt

SEQ ID NO: 574888 - DNA, 25 bp, Rattus norvegicus
aggtaccgctcgtacgccgaggcaa

SEQ ID NO: 574889 - DNA, 25 bp, Rattus norvegicus
cttttctccggtgtgggaacgcatg

SEQ ID NO: 574890 - DNA, 25 bp, Rattus norvegicus
ttcacacttgtatggcttttctccg

SEQ ID NO: 574891 - DNA, 25 bp, Rattus norvegicus
gcgataggcgcacaattcacacttg

SEQ ID NO: 574892 - DNA, 25 bp, Rattus norvegicus
cttccgtaattgcagcgataggcgc

SEQ ID NO: 574893 - DNA, 25 bp, Rattus norvegicus
tgggacaggttgcttccgtaattgc

SEQ ID NO: 574894 - DNA, 25 bp, Rattus norvegicus
ctggaatagccacagtatgagcact

SEQ ID NO: 574895 - DNA, 25 bp, Rattus norvegicus
gtgttcggtcacattcgccgacccg

SEQ ID NO: 574896 - DNA, 25 bp, Rattus norvegicus
cagcagcctggacgagaagcagaaa

SEQ ID NO: 574897 - DNA, 25 bp, Rattus norvegicus
gcacggtgagcaagcgcagcagcct

SEQ ID NO: 574898 - DNA, 25 bp, Rattus norvegicus
gcatcgacatcttcgggcgcacggt

SEQ ID NO: 574899 - DNA, 25 bp, Rattus norvegicus
tccaagtcccgggagagcaaacgga

SEQ ID NO: 574900 - DNA, 25 bp, Rattus norvegicus
cggaagcgctccaagtcccgggaga

SEQ ID NO: 574901 - DNA, 25 bp, Rattus norvegicus
gcacaacaagaagcgcagccgctcg

SEQ ID NO: 574902 - DNA, 25 bp, Rattus norvegicus
aaagagccgagcgtgttcggtcaca

SEQ ID NO: 574903 - DNA, 25 bp, Rattus norvegicus
accaagagctccaagcacaacaaga

SEQ ID NO: 574904 - DNA, 25 bp, Rattus norvegicus
gctctaagcacaccaagagctccaa

SEQ ID NO: 574905 - DNA, 25 bp, Rattus norvegicus
gagccggagctcgtcccgctctaag

SEQ ID NO: 574906 - DNA, 25 bp, Rattus norvegicus
cagctgccatcttagggactccggg

SEQ ID NO: 574907 - DNA, 25 bp, Rattus norvegicus
gttcgagcgacagcgaaaaatgtga

SEQ ID NO: 574908 - DNA, 25 bp, Rattus norvegicus
cggtgctgccacagctgccatctta

SEQ ID NO: 574909 - DNA, 25 bp, Rattus norvegicus
tccagatcgatagttttagagccta

SEQ ID NO: 574910 - DNA, 25 bp, Rattus norvegicus
ttcctcgaactccaagtaagtggcg

SEQ ID NO: 574911 - DNA, 25 bp, Rattus norvegicus
cggacgggagtgctgtcctatcatc

SEQ ID NO: 574912 - DNA, 25 bp, Rattus norvegicus
gctgtcctatcatcgcgtgctcgcg

SEQ ID NO: 574913 - DNA, 25 bp, Rattus norvegicus
tgagccagtggactgtatgcgactg

SEQ ID NO: 574914 - DNA, 25 bp, Rattus norvegicus
cccgcgtttatagtgctctgacagc

SEQ ID NO: 574915 - DNA, 25 bp, Rattus norvegicus
gctgcccgctgtcctggatctatag

SEQ ID NO: 574916 - DNA, 25 bp, Rattus norvegicus
tcctggatctatagtcaggcggccc

SEQ ID NO: 574917 - DNA, 25 bp, Rattus norvegicus
agggactctgtgtggaagtactgtt

SEQ ID NO: 574918 - DNA, 25 bp, Rattus norvegicus
gttttgtgcagaactgcgatctcca

SEQ ID NO: 574919 - DNA, 25 bp, Rattus norvegicus
gtaagtggcgtccatgatccttccc

SEQ ID NO: 574920 - DNA, 25 bp, Rattus norvegicus
gagcctatctactggaattcctcga

SEQ ID NO: 574921 - DNA, 25 bp, Rattus norvegicus
cctctgggcgcccagtgtctgatag

SEQ ID NO: 574922 - DNA, 25 bp, Rattus norvegicus
ctgttggggacttttgatggttttg

SEQ ID NO: 574923 - DNA, 25 bp, Rattus norvegicus
cccacgctctccctgcggtctgtct

SEQ ID NO: 574924 - DNA, 25 bp, Rattus norvegicus
aagcattatgtgagtcggcgtccgc

SEQ ID NO: 574925 - DNA, 25 bp, Rattus norvegicus
taagccatagccacggccgcaagtg

SEQ ID NO: 574926 - DNA, 25 bp, Rattus norvegicus
cacggccgcaagtgctcggcggcaa

SEQ ID NO: 574927 - DNA, 25 bp, Rattus norvegicus
tcggcggcaaggatcgctttggccc

SEQ ID NO: 574928 - DNA, 25 bp, Rattus norvegicus
aggcgggtgcccaacaagcattatg

SEQ ID NO: 574929 - DNA, 25 bp, Rattus norvegicus
atgtgagtcggcgtccgcgccacgc

SEQ ID NO: 574930 - DNA, 25 bp, Rattus norvegicus
cacgcgcccatgctccctgcgcctt

SEQ ID NO: 574931 - DNA, 25 bp, Rattus norvegicus
ccgccatctcctcgcgagctctcgc

SEQ ID NO: 574932 - DNA, 25 bp, Rattus norvegicus
ttgcccacccgtgcaaaagtctggc

SEQ ID NO: 574933 - DNA, 25 bp, Rattus norvegicus
agccgctgctggagacgaagacaga

SEQ ID NO: 574934 - DNA, 25 bp, Rattus norvegicus
ctgctggagacgaagacagaaacca

SEQ ID NO: 574935 - DNA, 25 bp, Rattus norvegicus
agacagaaaccaggagagaaaccca

SEQ ID NO: 574936 - DNA, 25 bp, Rattus norvegicus
ttaaacgcgataagccatagccacg

SEQ ID NO: 574937 - DNA, 25 bp, Rattus norvegicus
agaggagcctcgtcggctttcagca

SEQ ID NO: 574938 - DNA, 25 bp, Rattus norvegicus
ggctgtcacaaaccggaacgcgatg

SEQ ID NO: 574939 - DNA, 25 bp, Rattus norvegicus
cgggctgaggtgctcaccttccttc

SEQ ID NO: 574940 - DNA, 25 bp, Rattus norvegicus
tctgacagtgcgttagcgccaccta

SEQ ID NO: 574941 - DNA, 25 bp, Rattus norvegicus
gaccgcgtcctaaggctggccaggc

SEQ ID NO: 574942 - DNA, 25 bp, Rattus norvegicus
ctcggtggaaccatagcgtcaggtt

SEQ ID NO: 574943 - DNA, 25 bp, Rattus norvegicus
catttcgaatttacgcgggcggctg

SEQ ID NO: 574944 - DNA, 25 bp, Rattus norvegicus
gccgccaactcaggtctcggtggaa

SEQ ID NO: 574945 - DNA, 25 bp, Rattus norvegicus
accggaacgcgatgacgacatggcc

SEQ ID NO: 574946 - DNA, 25 bp, Rattus norvegicus
tgacgacatggccagcgtccgcact

SEQ ID NO: 574947 - DNA, 25 bp, Rattus norvegicus
gtccgcactcggatagaggagcctc

SEQ ID NO: 574948 - DNA, 25 bp, Rattus norvegicus
gctttcagcaactgctctgacagtg

SEQ ID NO: 574949 - DNA, 25 bp, Rattus norvegicus
gttagcgccacctacgggatcggcg

SEQ ID NO: 574950 - DNA, 25 bp, Rattus norvegicus
gcgtcaggttccagaactacacccg

SEQ ID NO: 574951 - DNA, 25 bp, Rattus norvegicus
tccagcttgtcaggccgcagatgcc

SEQ ID NO: 574952 - DNA, 25 bp, Rattus norvegicus
tccgagcccgggctgctcagagcaa

SEQ ID NO: 574953 - DNA, 25 bp, Rattus norvegicus
ctcagagcaagcagtcctccgggcg

SEQ ID NO: 574954 - DNA, 25 bp, Rattus norvegicus
gtctgaggtagtggaggctccatct

SEQ ID NO: 574955 - DNA, 25 bp, Rattus norvegicus
gggtcctcagttctcctcgcagtgc

SEQ ID NO: 574956 - DNA, 25 bp, Rattus norvegicus
gctggcagtgcagcgcgaccacgaa

SEQ ID NO: 574957 - DNA, 25 bp, Rattus norvegicus
tgcagcgcgaccacgaaggccgcta

SEQ ID NO: 574958 - DNA, 25 bp, Rattus norvegicus
acgaaggccgctactctgaggcggt

SEQ ID NO: 574959 - DNA, 25 bp, Rattus norvegicus
ctgaggcggtgttttactacaaggt

SEQ ID NO: 574960 - DNA, 25 bp, Rattus norvegicus
gtctcgggccgcgtcaccggatcaa

SEQ ID NO: 574961 - DNA, 25 bp, Rattus norvegicus
accggatcaagtgctggcggaaccc

SEQ ID NO: 574962 - DNA, 25 bp, Rattus norvegicus
gtcctgctcgggtcggccgagtcca

SEQ ID NO: 574963 - DNA, 25 bp, Rattus norvegicus
tcggccgagtccagcttgtcaggcc

SEQ ID NO: 574964 - DNA, 25 bp, Rattus norvegicus
gaaagccctcggcttcgacctggca

SEQ ID NO: 574965 - DNA, 25 bp, Rattus norvegicus
ggctccgtttcagcgccgtgtccat

SEQ ID NO: 574966 - DNA, 25 bp, Rattus norvegicus
aagctccgagtctgtgcagtgctcc

SEQ ID NO: 574967 - DNA, 25 bp, Rattus norvegicus
ccagggtaacgctgcgcagaagctc

SEQ ID NO: 574968 - DNA, 25 bp, Rattus norvegicus
cggtgcagtctacactacaggggca

SEQ ID NO: 574969 - DNA, 25 bp, Rattus norvegicus
cgctggtcttgttgtagggaccctc

SEQ ID NO: 574970 - DNA, 25 bp, Rattus norvegicus
acccttggtgcagctcctggattta

SEQ ID NO: 574971 - DNA, 25 bp, Rattus norvegicus
taaggcgagtatccgcgtaggcatc

SEQ ID NO: 574972 - DNA, 25 bp, Rattus norvegicus
tagggtcctgtcacacgcgtcctac

SEQ ID NO: 574973 - DNA, 25 bp, Rattus norvegicus
ttgcaatctgcttgaaccgctggtc

SEQ ID NO: 574974 - DNA, 25 bp, Rattus norvegicus
cagaccgccctgatagcctgtgtca

SEQ ID NO: 574975 - DNA, 25 bp, Rattus norvegicus
tcacccgacgctctgtcacaaaaag

SEQ ID NO: 574976 - DNA, 25 bp, Rattus norvegicus
aaaaagccctggagtcccggtcatg

SEQ ID NO: 574977 - DNA, 25 bp, Rattus norvegicus
cccggtcatggccactaggagagac

SEQ ID NO: 574978 - DNA, 25 bp, Rattus norvegicus
cgtaggcatcgacttccacatcagc

SEQ ID NO: 574979 - DNA, 25 bp, Rattus norvegicus
agcttcgagaaacggccgcgggcct

SEQ ID NO: 574980 - DNA, 25 bp, Rattus norvegicus
tgggttctctgaccgccacgtgcca

SEQ ID NO: 574981 - DNA, 25 bp, Rattus norvegicus
ctccaggttcactttgggttctctg

SEQ ID NO: 574982 - DNA, 25 bp, Rattus norvegicus
taccattcgctgtgagtgagcgccc

SEQ ID NO: 574983 - DNA, 25 bp, Rattus norvegicus
ccttccataccattcgctgtgagtg

SEQ ID NO: 574984 - DNA, 25 bp, Rattus norvegicus
agagtctctccagacgcagagtaga

SEQ ID NO: 574985 - DNA, 25 bp, Rattus norvegicus
cgcagagtagattggtttcctgccc

SEQ ID NO: 574986 - DNA, 25 bp, Rattus norvegicus
agcggccttacttcctcagagtctc

SEQ ID NO: 574987 - DNA, 25 bp, Rattus norvegicus
accgtgaggagcactgcctgcggct

SEQ ID NO: 574988 - DNA, 25 bp, Rattus norvegicus
cgcggacttggttcagtgcgcgctc

SEQ ID NO: 574989 - DNA, 25 bp, Rattus norvegicus
tgccaggcaagtgcaaggccatgaa

SEQ ID NO: 574990 - DNA, 25 bp, Rattus norvegicus
ggccatgaacggcacggcgaacccg

SEQ ID NO: 574991 - DNA, 25 bp, Rattus norvegicus
cgaacccgctgctggaccgtgagga

SEQ ID NO: 574992 - DNA, 25 bp, Rattus norvegicus
agagctccgatctgggtgccaggca

SEQ ID NO: 574993 - DNA, 25 bp, Rattus norvegicus
cagcaggctcattttgccgtggcgg

SEQ ID NO: 574994 - DNA, 25 bp, Rattus norvegicus
gtgtcgatggcagacagcaggctca

SEQ ID NO: 574995 - DNA, 25 bp, Rattus norvegicus
aactgcagcagtgggcgcgcacggg

SEQ ID NO: 574996 - DNA, 25 bp, Rattus norvegicus
gtcgatggcagacagcaggctcatt

SEQ ID NO: 574997 - DNA, 25 bp, Rattus norvegicus
cgatggcagacagcaggctcatttt

SEQ ID NO: 574998 - DNA, 25 bp, Rattus norvegicus
atggcagacagcaggctcattttgc

SEQ ID NO: 574999 - DNA, 25 bp, Rattus norvegicus
caggctcattttgccgtggcggtgt

SEQ ID NO: 575000 - DNA, 25 bp, Rattus norvegicus
gacagcaggctcattttgccgtggc

SEQ ID NO: 575001 - DNA, 25 bp, Rattus norvegicus
tcattttgccgtggcggtgtcggcc

SEQ ID NO: 575002 - DNA, 25 bp, Rattus norvegicus
gggcaccggggagcctgtgcccact

SEQ ID NO: 575003 - DNA, 25 bp, Rattus norvegicus
tgtgcccactgccagccgcccgggc

SEQ ID NO: 575004 - DNA, 25 bp, Rattus norvegicus
cagacagcaggctcattttgccgtg

SEQ ID NO: 575005 - DNA, 25 bp, Rattus norvegicus
tcgtgtcgatggcagacagcaggct

SEQ ID NO: 575006 - DNA, 25 bp, Rattus norvegicus
gcgctcgtgtcgatggcagacagca

SEQ ID NO: 575007 - DNA, 25 bp, Rattus norvegicus
ttcactagccgaagagttggtcgca

SEQ ID NO: 575008 - DNA, 25 bp, Rattus norvegicus
tcgcacgtttgctgttggtgacacc

SEQ ID NO: 575009 - DNA, 25 bp, Rattus norvegicus
tgacacccgcttctgacggacagga

SEQ ID NO: 575010 - DNA, 25 bp, Rattus norvegicus
gagggcagcccaacggatttaagca

SEQ ID NO: 575011 - DNA, 25 bp, Rattus norvegicus
aagtccgtccttggtgaggcgatca

SEQ ID NO: 575012 - DNA, 25 bp, Rattus norvegicus
cagtcttttccggactcggccatca

SEQ ID NO: 575013 - DNA, 25 bp, Rattus norvegicus
acgcccattctccagtcagtctttt

SEQ ID NO: 575014 - DNA, 25 bp, Rattus norvegicus
gtaagaaacccaacctctgaggctg

SEQ ID NO: 575015 - DNA, 25 bp, Rattus norvegicus
tctgaggctgtcctccactagggta

SEQ ID NO: 575016 - DNA, 25 bp, Rattus norvegicus
tagctacacagctcagtcccgcgga

SEQ ID NO: 575017 - DNA, 25 bp, Rattus norvegicus
gcacttgcgcgcctggaggatgaaa

SEQ ID NO: 575018 - DNA, 25 bp, Rattus norvegicus
cggagcttccagctgattgggagca

SEQ ID NO: 575019 - DNA, 25 bp, Rattus norvegicus
ggcgatcatgcgagcacgcccattc

SEQ ID NO: 575020 - DNA, 25 bp, Rattus norvegicus
accgcgtcctctaccgagcaggtaa

SEQ ID NO: 575021 - DNA, 25 bp, Rattus norvegicus
attgcgtaccctacggcctggatga

SEQ ID NO: 575022 - DNA, 25 bp, Rattus norvegicus
accacctttgatacgccgttcgcgg

SEQ ID NO: 575023 - DNA, 25 bp, Rattus norvegicus
ctggatgaaccagctgccgctcttg

SEQ ID NO: 575024 - DNA, 25 bp, Rattus norvegicus
ctttgaggtaaagcacattgcgtac

SEQ ID NO: 575025 - DNA, 25 bp, Rattus norvegicus
gctttgatatcctgttctttgaccc

SEQ ID NO: 575026 - DNA, 25 bp, Rattus norvegicus
cgcgggcaagttcggtatgttcact

SEQ ID NO: 575027 - DNA, 25 bp, Rattus norvegicus
cagtttaacacaaacgtcgcgttca

SEQ ID NO: 575028 - DNA, 25 bp, Rattus norvegicus
gttcagtgacaacggaaccctcgtc

SEQ ID NO: 575029 - DNA, 25 bp, Rattus norvegicus
gccgctaccgtaagcacaacctgta

SEQ ID NO: 575030 - DNA, 25 bp, Rattus norvegicus
gctgacgtggacctcaccacctttg

SEQ ID NO: 575031 - DNA, 25 bp, Rattus norvegicus
caacctgtactttgaggaagccttc

SEQ ID NO: 575032 - DNA, 25 bp, Rattus norvegicus
aggaagccttcgatagccctgctga

SEQ ID NO: 575033 - DNA, 25 bp, Rattus norvegicus
cccgcaggacgggagataccagttt

SEQ ID NO: 575034 - DNA, 25 bp, Rattus norvegicus
gccgctcttggcagccattgaaatc

SEQ ID NO: 575035 - DNA, 25 bp, Rattus norvegicus
ttgtcctcgtaggaaatgggctcca

SEQ ID NO: 575036 - DNA, 25 bp, Rattus norvegicus
ggtcattccagcctcgctcccacag

SEQ ID NO: 575037 - DNA, 25 bp, Rattus norvegicus
cttcttgtcctcgtaggaaatgggc

SEQ ID NO: 575038 - DNA, 25 bp, Rattus norvegicus
tggaggcagagcttcgcagagacat

SEQ ID NO: 575039 - DNA, 25 bp, Rattus norvegicus
ctcgtaggaaatgggctccagacca

SEQ ID NO: 575040 - DNA, 25 bp, Rattus norvegicus
taggaaatgggctccagaccaggga

SEQ ID NO: 575041 - DNA, 25 bp, Rattus norvegicus
aaatgggctccagaccagggacctc

SEQ ID NO: 575042 - DNA, 25 bp, Rattus norvegicus
agaccagggacctcttacaccctgt

SEQ ID NO: 575043 - DNA, 25 bp, Rattus norvegicus
gaggctcgggcttccactcatacgc

SEQ ID NO: 575044 - DNA, 25 bp, Rattus norvegicus
gcttccactcatacgcctcgcgttt

SEQ ID NO: 575045 - DNA, 25 bp, Rattus norvegicus
gcttcgcagagacatcgagtgcccg

SEQ ID NO: 575046 - DNA, 25 bp, Rattus norvegicus
ggctccagaccagggacctcttaca

SEQ ID NO: 575047 - DNA, 25 bp, Rattus norvegicus
ttccagcctcgctcccacagcggga

SEQ ID NO: 575048 - DNA, 25 bp, Rattus norvegicus
gcagagcttcgcagagacatcgagt

SEQ ID NO: 575049 - DNA, 25 bp, Rattus norvegicus
tcctccggttcctcggtggcgcgat

SEQ ID NO: 575050 - DNA, 25 bp, Rattus norvegicus
tacctggtcgcggagtttgaggaac

SEQ ID NO: 575051 - DNA, 25 bp, Rattus norvegicus
tttgaggaacgccatggcggtcgcc

SEQ ID NO: 575052 - DNA, 25 bp, Rattus norvegicus
atccaaactccactccacaatatta

SEQ ID NO: 575053 - DNA, 25 bp, Rattus norvegicus
aggccagagtaagcccggcgcccat

SEQ ID NO: 575054 - DNA, 25 bp, Rattus norvegicus
gtggcgtgcacaagctcagctcagt

SEQ ID NO: 575055 - DNA, 25 bp, Rattus norvegicus
caagctcagctcagtcaggtgcgga

SEQ ID NO: 575056 - DNA, 25 bp, Rattus norvegicus
ctcagctcagtcaggtgcggagaag

SEQ ID NO: 575057 - DNA, 25 bp, Rattus norvegicus
cggagctgatgcttcttccatcaga

SEQ ID NO: 575058 - DNA, 25 bp, Rattus norvegicus
tcttccatcagaatagcgagggcaa

SEQ ID NO: 575059 - DNA, 25 bp, Rattus norvegicus
cccgagcctcacctggcaggaaaga

SEQ ID NO: 575060 - DNA, 25 bp, Rattus norvegicus
gcaaagccacctgttaggcccgagc

SEQ ID NO: 575061 - DNA, 25 bp, Rattus norvegicus
ctcacctacctggtcgcggagtttg

SEQ ID NO: 575062 - DNA, 25 bp, Rattus norvegicus
gagacctcggagctgatgcttcttc

SEQ ID NO: 575063 - DNA, 25 bp, Rattus norvegicus
caatagggtgaagggctcccgcaca

SEQ ID NO: 575064 - DNA, 25 bp, Rattus norvegicus
acggctgccaacgaccaatagggtg

SEQ ID NO: 575065 - DNA, 25 bp, Rattus norvegicus
ttgcgcagttctacgtccacggctg

SEQ ID NO: 575066 - DNA, 25 bp, Rattus norvegicus
tggtcgcggtcaccatggagatagc

SEQ ID NO: 575067 - DNA, 25 bp, Rattus norvegicus
gatgacgtaacttccaccgccgcgg

SEQ ID NO: 575068 - DNA, 25 bp, Rattus norvegicus
gtcacttccggacgcacaggcgatg

SEQ ID NO: 575069 - DNA, 25 bp, Rattus norvegicus
tccctggagcaggaacagtcacttc

SEQ ID NO: 575070 - DNA, 25 bp, Rattus norvegicus
ggtccggaccgcatcagtttgccta

SEQ ID NO: 575071 - DNA, 25 bp, Rattus norvegicus
ctcgtcatgaaacaccgccatggtc

SEQ ID NO: 575072 - DNA, 25 bp, Rattus norvegicus
ttgaaagtcctcgatctccacctcg

SEQ ID NO: 575073 - DNA, 25 bp, Rattus norvegicus
cgtctctgtgtcctcgtcatattga

SEQ ID NO: 575074 - DNA, 25 bp, Rattus norvegicus
accttggtgatggagaagttatccc

SEQ ID NO: 575075 - DNA, 25 bp, Rattus norvegicus
ccagccctttagagtaccttggtga

SEQ ID NO: 575076 - DNA, 25 bp, Rattus norvegicus
cgaaaatgcgcaagctctaggagtc

SEQ ID NO: 575077 - DNA, 25 bp, Rattus norvegicus
ggtccgtgttaataagttgtctcga

SEQ ID NO: 575078 - DNA, 25 bp, Rattus norvegicus
ggtggcttagcatttcgttattctc

SEQ ID NO: 575079 - DNA, 25 bp, Rattus norvegicus
tccgcgcactcgcttttggtggctt

SEQ ID NO: 575080 - DNA, 25 bp, Rattus norvegicus
acgggatcctcaggggtctcaagcc

SEQ ID NO: 575081 - DNA, 25 bp, Rattus norvegicus
tccctcgtgagcacggacgaccgtt

SEQ ID NO: 575082 - DNA, 25 bp, Rattus norvegicus
ccgcaggtgagggaagagaacccac

SEQ ID NO: 575083 - DNA, 25 bp, Rattus norvegicus
agctagagcgggtgaacgcacatcc

SEQ ID NO: 575084 - DNA, 25 bp, Rattus norvegicus
tccattcctggcctgacgctggcag

SEQ ID NO: 575085 - DNA, 25 bp, Rattus norvegicus
gtgtgaccacctcgggttccgccta

SEQ ID NO: 575086 - DNA, 25 bp, Rattus norvegicus
acactgggctcacgagcttgcggtc

SEQ ID NO: 575087 - DNA, 25 bp, Rattus norvegicus
tccttctctagtccaagggccgtgg

SEQ ID NO: 575088 - DNA, 25 bp, Rattus norvegicus
acacctgtgcgcagatgaatctagg

SEQ ID NO: 575089 - DNA, 25 bp, Rattus norvegicus
aattccggagaaagtgacacctgtg

SEQ ID NO: 575090 - DNA, 25 bp, Rattus norvegicus
aggacgctcggcataagttgctgca

SEQ ID NO: 575091 - DNA, 25 bp, Rattus norvegicus
ccctggtcacgtctgcggtgaaccc

SEQ ID NO: 575092 - DNA, 25 bp, Rattus norvegicus
tccattcttccaacactcgggtccg

SEQ ID NO: 575093 - DNA, 25 bp, Rattus norvegicus
gtggcctgtcctgccctccattctt

SEQ ID NO: 575094 - DNA, 25 bp, Rattus norvegicus
cagctggtaaggacaagagtggcct

SEQ ID NO: 575095 - DNA, 25 bp, Rattus norvegicus
gccctgccagctggtaaggacaaga

SEQ ID NO: 575096 - DNA, 25 bp, Rattus norvegicus
cggaagaagccctgccagctggtaa

SEQ ID NO: 575097 - DNA, 25 bp, Rattus norvegicus
tccgctcggatcaccggaagaagcc

SEQ ID NO: 575098 - DNA, 25 bp, Rattus norvegicus
tcggtccaaggtccgctcggatcac

SEQ ID NO: 575099 - DNA, 25 bp, Rattus norvegicus
ggtccggctccttccgtggctgagt

SEQ ID NO: 575100 - DNA, 25 bp, Rattus norvegicus
aggccgtactatcgcgagaactctg

SEQ ID NO: 575101 - DNA, 25 bp, Rattus norvegicus
cgaaactgtcagaacactagctgga

SEQ ID NO: 575102 - DNA, 25 bp, Rattus norvegicus
cggaaggaaatctcgcgaaactgtc

SEQ ID NO: 575103 - DNA, 25 bp, Rattus norvegicus
gccctaaagaggctttgcgcaggcg

SEQ ID NO: 575104 - DNA, 25 bp, Rattus norvegicus
gtgcctccacgttgagccctaaaga

SEQ ID NO: 575105 - DNA, 25 bp, Rattus norvegicus
gaaggctccagccaaggcccacgga

SEQ ID NO: 575106 - DNA, 25 bp, Rattus norvegicus
accacccggtaagtgtgctgcctgg

SEQ ID NO: 575107 - DNA, 25 bp, Rattus norvegicus
ttctctgtagttagtgatttgcagc

SEQ ID NO: 575108 - DNA, 25 bp, Rattus norvegicus
cgggccctgcttattctctgtagtt

SEQ ID NO: 575109 - DNA, 25 bp, Rattus norvegicus
ttcaccagctgctcccggaaagggc

SEQ ID NO: 575110 - DNA, 25 bp, Rattus norvegicus
gggagaccgatttcaccagctgctc

SEQ ID NO: 575111 - DNA, 25 bp, Rattus norvegicus
gaagccctgggagaccgatttcacc

SEQ ID NO: 575112 - DNA, 25 bp, Rattus norvegicus
agcagttttcgtcgcggggtcgcac

SEQ ID NO: 575113 - DNA, 25 bp, Rattus norvegicus
caagcatgttcacgcagcagttttc

SEQ ID NO: 575114 - DNA, 25 bp, Rattus norvegicus
gcagaccggcaagcatgttcacgca

SEQ ID NO: 575115 - DNA, 25 bp, Rattus norvegicus
cgcctgactggtcggtaggatataa

SEQ ID NO: 575116 - DNA, 25 bp, Rattus norvegicus
agatgggcagctgaaggctccagcc

SEQ ID NO: 575117 - DNA, 25 bp, Rattus norvegicus
gatttgcagctgagacctcttgacc

SEQ ID NO: 575118 - DNA, 25 bp, Rattus norvegicus
gtaggatataaaagcagaccggcaa

SEQ ID NO: 575119 - DNA, 25 bp, Rattus norvegicus
cgttaagcaccgcacttccgttttg

SEQ ID NO: 575120 - DNA, 25 bp, Rattus norvegicus
cacttccgttttgcggctgtgtgcg

SEQ ID NO: 575121 - DNA, 25 bp, Rattus norvegicus
tcggaagcgcgagacggctgctttc

SEQ ID NO: 575122 - DNA, 25 bp, Rattus norvegicus
aggcccgaggagcagcagcctcaag

SEQ ID NO: 575123 - DNA, 25 bp, Rattus norvegicus
gcagcctcaagagcgggccgctgca

SEQ ID NO: 575124 - DNA, 25 bp, Rattus norvegicus
tgccgctggaacttctgcgccgact

SEQ ID NO: 575125 - DNA, 25 bp, Rattus norvegicus
agaaggaggcgcactccgtccctct

SEQ ID NO: 575126 - DNA, 25 bp, Rattus norvegicus
ggttggtgaatgaggctctccgccc

SEQ ID NO: 575127 - DNA, 25 bp, Rattus norvegicus
aggcagcgtcacctcgtttggtacg

SEQ ID NO: 575128 - DNA, 25 bp, Rattus norvegicus
cgggaccgcacagaggcagcgtcac

SEQ ID NO: 575129 - DNA, 25 bp, Rattus norvegicus
cctaaggacgctcccgtacagttca

SEQ ID NO: 575130 - DNA, 25 bp, Rattus norvegicus
aagcgcgttctcgaccctaaggacg

SEQ ID NO: 575131 - DNA, 25 bp, Rattus norvegicus
ttccctggcaggcagaagcgcgttc

SEQ ID NO: 575132 - DNA, 25 bp, Rattus norvegicus
ccgtccctctcagggttggtgaatg

SEQ ID NO: 575133 - DNA, 25 bp, Rattus norvegicus
tgaccttggtctctcccttgactga

SEQ ID NO: 575134 - DNA, 25 bp, Rattus norvegicus
gtttcagcaggcgaatgtagatttc

SEQ ID NO: 575135 - DNA, 25 bp, Rattus norvegicus
gccctttgcgcgtttcagcaggcga

SEQ ID NO: 575136 - DNA, 25 bp, Rattus norvegicus
ggcgtctgccgagacgtcacgacgc

SEQ ID NO: 575137 - DNA, 25 bp, Rattus norvegicus
tctcccttgactgagtgcggcgttc

SEQ ID NO: 575138 - DNA, 25 bp, Rattus norvegicus
gaacgtgaccttggtctctcccttg

SEQ ID NO: 575139 - DNA, 25 bp, Rattus norvegicus
gctaacctcagccaggcccttgggg

SEQ ID NO: 575140 - DNA, 25 bp, Rattus norvegicus
tggcccggaacctcggccagctggt

SEQ ID NO: 575141 - DNA, 25 bp, Rattus norvegicus
ctaggtagttgctaccgcgcgccgc

SEQ ID NO: 575142 - DNA, 25 bp, Rattus norvegicus
ccgtgtcacgtgacctaggtagttg

SEQ ID NO: 575143 - DNA, 25 bp, Rattus norvegicus
tcacggcggccgtgtcacgtgacct

SEQ ID NO: 575144 - DNA, 25 bp, Rattus norvegicus
tcacgacgcgcggaatcccgagggt

SEQ ID NO: 575145 - DNA, 25 bp, Rattus norvegicus
ccgagacgtcacgacgcgcggaatc

SEQ ID NO: 575146 - DNA, 25 bp, Rattus norvegicus
actgagtgcggcgttccttaggacc

SEQ ID NO: 575147 - DNA, 25 bp, Rattus norvegicus
ctgttcgctgcaggtgttcaccgag

SEQ ID NO: 575148 - DNA, 25 bp, Rattus norvegicus
gactcagacgcctaccctgtgagtg

SEQ ID NO: 575149 - DNA, 25 bp, Rattus norvegicus
gcctaccctgtgagtgctggctgct

SEQ ID NO: 575150 - DNA, 25 bp, Rattus norvegicus
acccaccggctgttcgctgcaggtg

SEQ ID NO: 575151 - DNA, 25 bp, Rattus norvegicus
caggtgttcaccgaggacttcgagg

SEQ ID NO: 575152 - DNA, 25 bp, Rattus norvegicus
aggacttcgaggtgagccagctcta

SEQ ID NO: 575153 - DNA, 25 bp, Rattus norvegicus
tgagccagctctatgactgcaactg

SEQ ID NO: 575154 - DNA, 25 bp, Rattus norvegicus
tgactgcaactggatcgtggtgaac

SEQ ID NO: 575155 - DNA, 25 bp, Rattus norvegicus
tgaactgctctacaccggctagcta

SEQ ID NO: 575156 - DNA, 25 bp, Rattus norvegicus
accggctagctacttccacgtgctg

SEQ ID NO: 575157 - DNA, 25 bp, Rattus norvegicus
tgctgcccttccgcaagcctgtgag

SEQ ID NO: 575158 - DNA, 25 bp, Rattus norvegicus
gccctagccttccagcaccgtgacg

SEQ ID NO: 575159 - DNA, 25 bp, Rattus norvegicus
ctggatcgtggtgaactgctctaca

SEQ ID NO: 575160 - DNA, 25 bp, Rattus norvegicus
ggtgccgctcctagccacccaccgg

SEQ ID NO: 575161 - DNA, 25 bp, Rattus norvegicus
aagaactcttgcttgggcttggctc

SEQ ID NO: 575162 - DNA, 25 bp, Rattus norvegicus
ggacctgccaccctgggtttatata

SEQ ID NO: 575163 - DNA, 25 bp, Rattus norvegicus
tggggaactttgctccggaactgca

SEQ ID NO: 575164 - DNA, 25 bp, Rattus norvegicus
ccgagaacgctgtcttggggaactt

SEQ ID NO: 575165 - DNA, 25 bp, Rattus norvegicus
gtcttatctcagtgcgtttccggga

SEQ ID NO: 575166 - DNA, 25 bp, Rattus norvegicus
ttggggttggtcaaggtcttatctc

SEQ ID NO: 575167 - DNA, 25 bp, Rattus norvegicus
atcctgtggtcccatgatgtgcgaa

SEQ ID NO: 575168 - DNA, 25 bp, Rattus norvegicus
ggtgtaatgttcctccggatgacca

SEQ ID NO: 575169 - DNA, 25 bp, Rattus norvegicus
tgttgcctgccttccttacggctta

SEQ ID NO: 575170 - DNA, 25 bp, Rattus norvegicus
tttatataaggcaggctcccaagcg

SEQ ID NO: 575171 - DNA, 25 bp, Rattus norvegicus
ggcttatccagctacgatctctctg

SEQ ID NO: 575172 - DNA, 25 bp, Rattus norvegicus
agaatgcgcgattgtgccagttgcc

SEQ ID NO: 575173 - DNA, 25 bp, Rattus norvegicus
ctcccaagcggtccagagaatgcgc

SEQ ID NO: 575174 - DNA, 25 bp, Rattus norvegicus
cgagacttggaggtagctgctatcc

SEQ ID NO: 575175 - DNA, 25 bp, Rattus norvegicus
gccttggaggcaaacagcacaccta

SEQ ID NO: 575176 - DNA, 25 bp, Rattus norvegicus
ttgcccgcgaactcgtagaggatgc

SEQ ID NO: 575177 - DNA, 25 bp, Rattus norvegicus
cggtggcgccactaggcttccaaag

SEQ ID NO: 575178 - DNA, 25 bp, Rattus norvegicus
tcctcgggatacttgtcggcgatca

SEQ ID NO: 575179 - DNA, 25 bp, Rattus norvegicus
tggcaatgccagacgtgtccgcgaa

SEQ ID NO: 575180 - DNA, 25 bp, Rattus norvegicus
cgtggcatagtcttctgcaaaggca

SEQ ID NO: 575181 - DNA, 25 bp, Rattus norvegicus
ccaggcctataagcagcggcacgtc

SEQ ID NO: 575182 - DNA, 25 bp, Rattus norvegicus
cggcacgtcgtagctcatgcgatca

SEQ ID NO: 575183 - DNA, 25 bp, Rattus norvegicus
tgcgatcaatgaaaggcccgcttaa

SEQ ID NO: 575184 - DNA, 25 bp, Rattus norvegicus
cttaaggggttcaccagaagctgca

SEQ ID NO: 575185 - DNA, 25 bp, Rattus norvegicus
ctaccggctgctttccctaagatgc

SEQ ID NO: 575186 - DNA, 25 bp, Rattus norvegicus
accgcttccgacagtttggtggccg

SEQ ID NO: 575187 - DNA, 25 bp, Rattus norvegicus
gggcacgatgaccatgtacaacatg

SEQ ID NO: 575188 - DNA, 25 bp, Rattus norvegicus
tcccgcagtgcagaggctaggataa

SEQ ID NO: 575189 - DNA, 25 bp, Rattus norvegicus
ttttgtccaggagcccatcagagcg

SEQ ID NO: 575190 - DNA, 25 bp, Rattus norvegicus
ctgctccctatggtcagcgcacgtg

SEQ ID NO: 575191 - DNA, 25 bp, Rattus norvegicus
gcatctgcttctgggtttgtgaatg

SEQ ID NO: 575192 - DNA, 25 bp, Rattus norvegicus
gcggaccagcctctggcatctgctt

SEQ ID NO: 575193 - DNA, 25 bp, Rattus norvegicus
gtatcttccggcagacgcacctgga

SEQ ID NO: 575194 - DNA, 25 bp, Rattus norvegicus
agcgcacgtggctaagccttgctta

SEQ ID NO: 575195 - DNA, 25 bp, Rattus norvegicus
cggccgtggcgacgaagatttcgtc

SEQ ID NO: 575196 - DNA, 25 bp, Rattus norvegicus
aggtctgtctctacgctttgtcgcg

SEQ ID NO: 575197 - DNA, 25 bp, Rattus norvegicus
gccttgcttacaaacaaacgtctca

SEQ ID NO: 575198 - DNA, 25 bp, Rattus norvegicus
gcgcatgcgctaaggtctgtctcta

SEQ ID NO: 575199 - DNA, 25 bp, Rattus norvegicus
tatcacagatctagggcgcatgcgc

SEQ ID NO: 575200 - DNA, 25 bp, Rattus norvegicus
tcagaggcggtccttatcacagatc

SEQ ID NO: 575201 - DNA, 25 bp, Rattus norvegicus
aaacgtctcagcaaggcgcaggcgc

SEQ ID NO: 575202 - DNA, 25 bp, Rattus norvegicus
acgttctcacctgcgcggcagacag

SEQ ID NO: 575203 - DNA, 25 bp, Rattus norvegicus
tcccggtatcgaagctgtgcactgg

SEQ ID NO: 575204 - DNA, 25 bp, Rattus norvegicus
ctcctggaaccggttgcagagagcg

SEQ ID NO: 575205 - DNA, 25 bp, Rattus norvegicus
tggccaaagcctcagcactcagttc

SEQ ID NO: 575206 - DNA, 25 bp, Rattus norvegicus
ggatactccctgagccggacctgga

SEQ ID NO: 575207 - DNA, 25 bp, Rattus norvegicus
gctcgctgtagcctgggaccaggaa

SEQ ID NO: 575208 - DNA, 25 bp, Rattus norvegicus
caggaaagagtctgctcccggtatc

SEQ ID NO: 575209 - DNA, 25 bp, Rattus norvegicus
aggctcccgcggataacgctagtgc

SEQ ID NO: 575210 - DNA, 25 bp, Rattus norvegicus
ttcgctccgagtccagcaagcattt

SEQ ID NO: 575211 - DNA, 25 bp, Rattus norvegicus
agcaagcatttccagcctctccttg

SEQ ID NO: 575212 - DNA, 25 bp, Rattus norvegicus
ccgctgagcccagaaagggcggctt

SEQ ID NO: 575213 - DNA, 25 bp, Rattus norvegicus
gcgtttcttcctggctgttttccca

SEQ ID NO: 575214 - DNA, 25 bp, Rattus norvegicus
ggtgtccaccggctggccaaagcct

SEQ ID NO: 575215 - DNA, 25 bp, Rattus norvegicus
gctcgactcccagagagcacaggga

SEQ ID NO: 575216 - DNA, 25 bp, Rattus norvegicus
cggataacgctagtgcgcgctgagc

SEQ ID NO: 575217 - DNA, 25 bp, Rattus norvegicus
gccttggggctccaccggcttcttg

SEQ ID NO: 575218 - DNA, 25 bp, Rattus norvegicus
accggcttcttggcccgagctgctg

SEQ ID NO: 575219 - DNA, 25 bp, Rattus norvegicus
ctgctgcgcgtgcagatggccttgc

SEQ ID NO: 575220 - DNA, 25 bp, Rattus norvegicus
tgcagatggccttgcgcgatcgccg

SEQ ID NO: 575221 - DNA, 25 bp, Rattus norvegicus
tctcgtccgcctcccgcagaggtag

SEQ ID NO: 575222 - DNA, 25 bp, Rattus norvegicus
gcgcactccggccttctcgtccgcc

SEQ ID NO: 575223 - DNA, 25 bp, Rattus norvegicus
cgtgcggactagaggcgagcgcact

SEQ ID NO: 575224 - DNA, 25 bp, Rattus norvegicus
acttctctggtcctgcgggcgccag

SEQ ID NO: 575225 - DNA, 25 bp, Rattus norvegicus
tgctctgggccttggggctccaccg

SEQ ID NO: 575226 - DNA, 25 bp, Rattus norvegicus
cgcgcgctgtagacagacagcaaga

SEQ ID NO: 575227 - DNA, 25 bp, Rattus norvegicus
cggcgcgcgctgtagacagacagca

SEQ ID NO: 575228 - DNA, 25 bp, Rattus norvegicus
attataaaggcgagtgctgagcggc

SEQ ID NO: 575229 - DNA, 25 bp, Rattus norvegicus
gtgagattataaaggcgagtgctga

SEQ ID NO: 575230 - DNA, 25 bp, Rattus norvegicus
gacagcaagacatctggccacttcc

SEQ ID NO: 575231 - DNA, 25 bp, Rattus norvegicus
aaaacgtggctctctgctgctgcca

SEQ ID NO: 575232 - DNA, 25 bp, Rattus norvegicus
tcccgagtttcggatgacagctgcc

SEQ ID NO: 575233 - DNA, 25 bp, Rattus norvegicus
gctccactcggttcaactcggcatt

SEQ ID NO: 575234 - DNA, 25 bp, Rattus norvegicus
tttgtcgtttctactctgcggcggc

SEQ ID NO: 575235 - DNA, 25 bp, Rattus norvegicus
actctggcccggaggacaactcggc

SEQ ID NO: 575236 - DNA, 25 bp, Rattus norvegicus
ggggcgcactcgtcaaattccgatg

SEQ ID NO: 575237 - DNA, 25 bp, Rattus norvegicus
gggctcagctttcccgagtttcgga

SEQ ID NO: 575238 - DNA, 25 bp, Rattus norvegicus
cgcgactcgcacttctcagttatcg

SEQ ID NO: 575239 - DNA, 25 bp, Rattus norvegicus
gctggggaagtctctaagtggcctt

SEQ ID NO: 575240 - DNA, 25 bp, Rattus norvegicus
cgatcggcccgaggaaaacgtggct

SEQ ID NO: 575241 - DNA, 25 bp, Rattus norvegicus
gctgccaggggcgttagcccaatgt

SEQ ID NO: 575242 - DNA, 25 bp, Rattus norvegicus
attccgatgtgtcttacgtaaaagg

SEQ ID NO: 575243 - DNA, 25 bp, Rattus norvegicus
taaaagttttccaacgcgactcgca

SEQ ID NO: 575244 - DNA, 25 bp, Rattus norvegicus
agcccttcccgcgtcggtagagttg

SEQ ID NO: 575245 - DNA, 25 bp, Rattus norvegicus
accctctcttgggacaactcctggt

SEQ ID NO: 575246 - DNA, 25 bp, Rattus norvegicus
tggggaccctctcttgggacaactc

SEQ ID NO: 575247 - DNA, 25 bp, Rattus norvegicus
ttctctagtgctgctggcttcccgc

SEQ ID NO: 575248 - DNA, 25 bp, Rattus norvegicus
ctcgagtctcctcggttctctagtg

SEQ ID NO: 575249 - DNA, 25 bp, Rattus norvegicus
gcgtaacgacgtccactcgagtctc

SEQ ID NO: 575250 - DNA, 25 bp, Rattus norvegicus
agccagtggatgaagaggccgctcc

SEQ ID NO: 575251 - DNA, 25 bp, Rattus norvegicus
agtctcctcggttctctagtgctgc

SEQ ID NO: 575252 - DNA, 25 bp, Rattus norvegicus
agggacccagcagcgctggcccgaa

SEQ ID NO: 575253 - DNA, 25 bp, Rattus norvegicus
ggacaactcctggtcccttctgagc

SEQ ID NO: 575254 - DNA, 25 bp, Rattus norvegicus
ggctgtactgctgggtctggtccca

SEQ ID NO: 575255 - DNA, 25 bp, Rattus norvegicus
cgcgatcctggctgcgtaacgacgt

SEQ ID NO: 575256 - DNA, 25 bp, Rattus norvegicus
tggctgcgtaacgacgtccactcga

SEQ ID NO: 575257 - DNA, 25 bp, Rattus norvegicus
tgaaagaggacaccgtgggctggcc

SEQ ID NO: 575258 - DNA, 25 bp, Rattus norvegicus
agctcggcgtagacccagggaccca

SEQ ID NO: 575259 - DNA, 25 bp, Rattus norvegicus
ggggcctgactcagagttttccaaa

SEQ ID NO: 575260 - DNA, 25 bp, Rattus norvegicus
gggcgggccattcattctcctcatc

SEQ ID NO: 575261 - DNA, 25 bp, Rattus norvegicus
gactgcaggtcatcaagtccaccgc

SEQ ID NO: 575262 - DNA, 25 bp, Rattus norvegicus
ggacacctgcgagcgcccaaaggta

SEQ ID NO: 575263 - DNA, 25 bp, Rattus norvegicus
tttccaaagtcgcagcggaacctgc

SEQ ID NO: 575264 - DNA, 25 bp, Rattus norvegicus
gggcgccgtccgagacgagcataaa

SEQ ID NO: 575265 - DNA, 25 bp, Rattus norvegicus
tcatccgcctctgtcacagacttgg

SEQ ID NO: 575266 - DNA, 25 bp, Rattus norvegicus
tgctgcaaggactggagaggacacc

SEQ ID NO: 575267 - DNA, 25 bp, Rattus norvegicus
acttctggaatgtagccggcttgga

SEQ ID NO: 575268 - DNA, 25 bp, Rattus norvegicus
ttggagagggcccaaagctgaacgc

SEQ ID NO: 575269 - DNA, 25 bp, Rattus norvegicus
agctgaacgcttgctcgggacagcg

SEQ ID NO: 575270 - DNA, 25 bp, Rattus norvegicus
cgaggtccagcctccctagtctgtg

SEQ ID NO: 575271 - DNA, 25 bp, Rattus norvegicus
ccgcctctctggaccgaggatcatg

SEQ ID NO: 575272 - DNA, 25 bp, Rattus norvegicus
aacctgcgagcggagctacttctgg

SEQ ID NO: 575273 - DNA, 25 bp, Rattus norvegicus
cgggcaagacgctacctgtgcgcgt

SEQ ID NO: 575274 - DNA, 25 bp, Rattus norvegicus
gagctgcctggcagtaggcatccca

SEQ ID NO: 575275 - DNA, 25 bp, Rattus norvegicus
ccaggtccagccctgggcggctcag

SEQ ID NO: 575276 - DNA, 25 bp, Rattus norvegicus
gtaggcatcccaggcactcaatcct

SEQ ID NO: 575277 - DNA, 25 bp, Rattus norvegicus
ggcagtaggcatcccaggcactcaa

SEQ ID NO: 575278 - DNA, 25 bp, Rattus norvegicus
acctgtgcgcgtgccgggcattcca

SEQ ID NO: 575279 - DNA, 25 bp, Rattus norvegicus
tgagaaccgggagctcccagcgcta

SEQ ID NO: 575280 - DNA, 25 bp, Rattus norvegicus
cagcgctaggagctgcctggcagta

SEQ ID NO: 575281 - DNA, 25 bp, Rattus norvegicus
accgggagctcccagcgctaggagc

SEQ ID NO: 575282 - DNA, 25 bp, Rattus norvegicus
gcgcagcctgagaaaggggtgagaa

SEQ ID NO: 575283 - DNA, 25 bp, Rattus norvegicus
ctgctgcgatttcggagctcctgat

SEQ ID NO: 575284 - DNA, 25 bp, Rattus norvegicus
ttgcgtggaaagctgctgcgatttc

SEQ ID NO: 575285 - DNA, 25 bp, Rattus norvegicus
aagtgattgcgtggaaagctgctgc

SEQ ID NO: 575286 - DNA, 25 bp, Rattus norvegicus
atttcggagctcctgatagcggggc

SEQ ID NO: 575287 - DNA, 25 bp, Rattus norvegicus
gacgtatgcacggtcgcgtcggccc

SEQ ID NO: 575288 - DNA, 25 bp, Rattus norvegicus
ggccgctacttaatcctgctcgcgg

SEQ ID NO: 575289 - DNA, 25 bp, Rattus norvegicus
tggccgcggccgctacttaatcctg

SEQ ID NO: 575290 - DNA, 25 bp, Rattus norvegicus
gccaacggagacctggaagcccgta

SEQ ID NO: 575291 - DNA, 25 bp, Rattus norvegicus
tcacccggcagtgcagccaacggag

SEQ ID NO: 575292 - DNA, 25 bp, Rattus norvegicus
caggtcgcctggagtggaccacgcc

SEQ ID NO: 575293 - DNA, 25 bp, Rattus norvegicus
tccgcgggaacacctcggaacttgc

SEQ ID NO: 575294 - DNA, 25 bp, Rattus norvegicus
ccgcgagcagggtctagaaagccgc

SEQ ID NO: 575295 - DNA, 25 bp, Rattus norvegicus
agaaaccgcccacagtcaaaacacg

SEQ ID NO: 575296 - DNA, 25 bp, Rattus norvegicus
gcggcactcacgtccgcacaaagaa

SEQ ID NO: 575297 - DNA, 25 bp, Rattus norvegicus
gctcttctgggcgtcgcggcactca

SEQ ID NO: 575298 - DNA, 25 bp, Rattus norvegicus
ccgcagcggtgaagccaggtcgcct

SEQ ID NO: 575299 - DNA, 25 bp, Rattus norvegicus
ctgactaacagagacgcggtccgtc

SEQ ID NO: 575300 - DNA, 25 bp, Rattus norvegicus
cggccgctccgctgactaacagaga

SEQ ID NO: 575301 - DNA, 25 bp, Rattus norvegicus
cggtgccactgctggactcgccgga

SEQ ID NO: 575302 - DNA, 25 bp, Rattus norvegicus
gtgctaacttttatcgacaaccacg

SEQ ID NO: 575303 - DNA, 25 bp, Rattus norvegicus
gtacccgtgctaacttttatcgaca

SEQ ID NO: 575304 - DNA, 25 bp, Rattus norvegicus
agagtttgccttcctcatgcagtcg

SEQ ID NO: 575305 - DNA, 25 bp, Rattus norvegicus
ctgacgctcacggtacccgtgctaa

SEQ ID NO: 575306 - DNA, 25 bp, Rattus norvegicus
agggtggcctgacgctcacggtacc

SEQ ID NO: 575307 - DNA, 25 bp, Rattus norvegicus
gtggggtgtacctgcttactagcca

SEQ ID NO: 575308 - DNA, 25 bp, Rattus norvegicus
tagccacaggactgccacggctgcg

SEQ ID NO: 575309 - DNA, 25 bp, Rattus norvegicus
acacctgcacggtgccactgctgga

SEQ ID NO: 575310 - DNA, 25 bp, Rattus norvegicus
taggggaaatcaccgcgggcagcct

SEQ ID NO: 575311 - DNA, 25 bp, Rattus norvegicus
ggccacgctggtaggggaaatcacc

SEQ ID NO: 575312 - DNA, 25 bp, Rattus norvegicus
tcatgcagtcgctgagctgggccac

SEQ ID NO: 575313 - DNA, 25 bp, Rattus norvegicus
ccacggctgcggaagagtttgcctt

SEQ ID NO: 575314 - DNA, 25 bp, Rattus norvegicus
tgcttactagccacaggactgccac

SEQ ID NO: 575315 - DNA, 25 bp, Rattus norvegicus
gctgctccagcggtcgccacaggtg

SEQ ID NO: 575316 - DNA, 25 bp, Rattus norvegicus
cagctcgtgttgagccagcctctca

SEQ ID NO: 575317 - DNA, 25 bp, Rattus norvegicus
ttgagccagcctctcaccctgtcgc

SEQ ID NO: 575318 - DNA, 25 bp, Rattus norvegicus
ccctgtcgcctccagggccgcactg

SEQ ID NO: 575319 - DNA, 25 bp, Rattus norvegicus
ggaagcgctgctccagcggtcgcca

SEQ ID NO: 575320 - DNA, 25 bp, Rattus norvegicus
tcttcacgcctcagcgtcccggccc

SEQ ID NO: 575321 - DNA, 25 bp, Rattus norvegicus
agcacccaccacagctcgtgttgag

SEQ ID NO: 575322 - DNA, 25 bp, Rattus norvegicus
tgcccggcgccaatatggagccgca

SEQ ID NO: 575323 - DNA, 25 bp, Rattus norvegicus
gcgccaatatggagccgcaccgagt

SEQ ID NO: 575324 - DNA, 25 bp, Rattus norvegicus
aatatggagccgcaccgagtctagc

SEQ ID NO: 575325 - DNA, 25 bp, Rattus norvegicus
agcccgcgctgccaaggggctgaag

SEQ ID NO: 575326 - DNA, 25 bp, Rattus norvegicus
ggggcgactcactcacctaggctcg

SEQ ID NO: 575327 - DNA, 25 bp, Rattus norvegicus
ctccgcccacgttcattcccttagg

SEQ ID NO: 575328 - DNA, 25 bp, Rattus norvegicus
actggccggcggaagcgctgctcca

SEQ ID NO: 575329 - DNA, 25 bp, Rattus norvegicus
agccgtttgtccgtagtcgcctcct

SEQ ID NO: 575330 - DNA, 25 bp, Rattus norvegicus
gagccaaaattcctgggcggctccg

SEQ ID NO: 575331 - DNA, 25 bp, Rattus norvegicus
tgggaccctggctccattcgcccgc

SEQ ID NO: 575332 - DNA, 25 bp, Rattus norvegicus
cagcggctgcatggtagggagccac

SEQ ID NO: 575333 - DNA, 25 bp, Rattus norvegicus
agggagccaccgagtgcagccgttt

SEQ ID NO: 575334 - DNA, 25 bp, Rattus norvegicus
agccaccgagtgcagccgtttgtcc

SEQ ID NO: 575335 - DNA, 25 bp, Rattus norvegicus
ccgagtgcagccgtttgtccgtagt

SEQ ID NO: 575336 - DNA, 25 bp, Rattus norvegicus
tgcagccgtttgtccgtagtcgcct

SEQ ID NO: 575337 - DNA, 25 bp, Rattus norvegicus
cccggcccgaggaaatgcagtccga

SEQ ID NO: 575338 - DNA, 25 bp, Rattus norvegicus
cccgaggaaatgcagtccgagccaa

SEQ ID NO: 575339 - DNA, 25 bp, Rattus norvegicus
aggaaatgcagtccgagccaaaatt

SEQ ID NO: 575340 - DNA, 25 bp, Rattus norvegicus
tgcagtccgagccaaaattcctggg

SEQ ID NO: 575341 - DNA, 25 bp, Rattus norvegicus
gtccgagccaaaattcctgggcggc

SEQ ID NO: 575342 - DNA, 25 bp, Rattus norvegicus
tttgtccgtagtcgcctcctgggga

SEQ ID NO: 575343 - DNA, 25 bp, Rattus norvegicus
gcatcctgcggatcatcaagccttg

SEQ ID NO: 575344 - DNA, 25 bp, Rattus norvegicus
ttctacctaataggccgccgcgcgt

SEQ ID NO: 575345 - DNA, 25 bp, Rattus norvegicus
ggacgcggacgcatcttagagctct

SEQ ID NO: 575346 - DNA, 25 bp, Rattus norvegicus
tagagctctcaggagcccgtgcctc

SEQ ID NO: 575347 - DNA, 25 bp, Rattus norvegicus
cagacaagcaggaagctgcggctta

SEQ ID NO: 575348 - DNA, 25 bp, Rattus norvegicus
tccaggcctgcaagctctgatcttc

SEQ ID NO: 575349 - DNA, 25 bp, Rattus norvegicus
gctgcagactcagccgcactgctgg

SEQ ID NO: 575350 - DNA, 25 bp, Rattus norvegicus
gtcgccaggcgccactacagcgaag

SEQ ID NO: 575351 - DNA, 25 bp, Rattus norvegicus
cttcttcaagatggtggagggcttc

SEQ ID NO: 575352 - DNA, 25 bp, Rattus norvegicus
acaagctggtggaagacctgaagac

SEQ ID NO: 575353 - DNA, 25 bp, Rattus norvegicus
ttgcaaccatgtgttgagcctctcc

SEQ ID NO: 575354 - DNA, 25 bp, Rattus norvegicus
ctcctgggaggtcatcgaaggctac

SEQ ID NO: 575355 - DNA, 25 bp, Rattus norvegicus
gaggcctccctgcagtcagcttcta

SEQ ID NO: 575356 - DNA, 25 bp, Rattus norvegicus
gcgccagcatcgtggaggacaagct

SEQ ID NO: 575357 - DNA, 25 bp, Rattus norvegicus
tctggaccagaagtttatatcgttg

SEQ ID NO: 575358 - DNA, 25 bp, Rattus norvegicus
tcttccttgagggactgcgttcctg

SEQ ID NO: 575359 - DNA, 25 bp, Rattus norvegicus
gaacgcacgcttcttccttgaggga

SEQ ID NO: 575360 - DNA, 25 bp, Rattus norvegicus
gcgctgcactccacgccaactggca

SEQ ID NO: 575361 - DNA, 25 bp, Rattus norvegicus
gaacaaacacactgcctcacgggcg

SEQ ID NO: 575362 - DNA, 25 bp, Rattus norvegicus
tatatcgttggcttaagaagagagg

SEQ ID NO: 575363 - DNA, 25 bp, Rattus norvegicus
tccagcttcgttctggaccagaagt

SEQ ID NO: 575364 - DNA, 25 bp, Rattus norvegicus
tgccggacgaaaatgtccagcttcg

SEQ ID NO: 575365 - DNA, 25 bp, Rattus norvegicus
ccatctgggacttgccggacgaaaa

SEQ ID NO: 575366 - DNA, 25 bp, Rattus norvegicus
tgcacgatccctactccatctggga

SEQ ID NO: 575367 - DNA, 25 bp, Rattus norvegicus
gggctggctttgcacgatccctact

SEQ ID NO: 575368 - DNA, 25 bp, Rattus norvegicus
tcccgtgcggggacacgtgctaagt

SEQ ID NO: 575369 - DNA, 25 bp, Rattus norvegicus
actgcgttcctggtgagtcacggca

SEQ ID NO: 575370 - DNA, 25 bp, Rattus norvegicus
taagggaggtcgaacaaacacactg

SEQ ID NO: 575371 - DNA, 25 bp, Rattus norvegicus
atggctccttcgcagccctactgga

SEQ ID NO: 575372 - DNA, 25 bp, Rattus norvegicus
agcagatccgcctggccctgcagga

SEQ ID NO: 575373 - DNA, 25 bp, Rattus norvegicus
cctgaattatgagcagatccgcctg

SEQ ID NO: 575374 - DNA, 25 bp, Rattus norvegicus
agatgtcggaggagcctcctcgccc

SEQ ID NO: 575375 - DNA, 25 bp, Rattus norvegicus
atcaggccgtgctggccgcactctt

SEQ ID NO: 575376 - DNA, 25 bp, Rattus norvegicus
tgcactgcgacatcaggccgtgctg

SEQ ID NO: 575377 - DNA, 25 bp, Rattus norvegicus
ggccctggaccacgctgtggaagca

SEQ ID NO: 575378 - DNA, 25 bp, Rattus norvegicus
cttcgcagccctactggaggatgca

SEQ ID NO: 575379 - DNA, 25 bp, Rattus norvegicus
agagatacgcctgctgcatggctcc

SEQ ID NO: 575380 - DNA, 25 bp, Rattus norvegicus
cccgcaaagagatacgcctgctgca

SEQ ID NO: 575381 - DNA, 25 bp, Rattus norvegicus
gaacgggacccgcaaagagatacgc

SEQ ID NO: 575382 - DNA, 25 bp, Rattus norvegicus
gaagcactgaagaccgcggcgaacg

SEQ ID NO: 575383 - DNA, 25 bp, Rattus norvegicus
ccacgctgtggaagcactgaagacc

SEQ ID NO: 575384 - DNA, 25 bp, Rattus norvegicus
ctactggaggatgcactgcgacatc

SEQ ID NO: 575385 - DNA, 25 bp, Rattus norvegicus
gccgttgcgagacaccagctgaacc

SEQ ID NO: 575386 - DNA, 25 bp, Rattus norvegicus
tgagcggactacagtctccagagtg

SEQ ID NO: 575387 - DNA, 25 bp, Rattus norvegicus
agcagctctacaccgacggccgttg

SEQ ID NO: 575388 - DNA, 25 bp, Rattus norvegicus
tttggggcaaagagcacggaagacc

SEQ ID NO: 575389 - DNA, 25 bp, Rattus norvegicus
ggccatctgggactgagtgaacttt

SEQ ID NO: 575390 - DNA, 25 bp, Rattus norvegicus
tcagagacatcacgagacccgcgta

SEQ ID NO: 575391 - DNA, 25 bp, Rattus norvegicus
ggggctctgctttctgcactgctca

SEQ ID NO: 575392 - DNA, 25 bp, Rattus norvegicus
ctcccgcagccaattgaggggtctc

SEQ ID NO: 575393 - DNA, 25 bp, Rattus norvegicus
tccaccatggctttcgccaattttc

SEQ ID NO: 575394 - DNA, 25 bp, Rattus norvegicus
caattttcgccgcatcttgcggtta

SEQ ID NO: 575395 - DNA, 25 bp, Rattus norvegicus
ttgcggttatccaccttcgagaaga

SEQ ID NO: 575396 - DNA, 25 bp, Rattus norvegicus
cccaacgacgtatgggagatcctgg

SEQ ID NO: 575397 - DNA, 25 bp, Rattus norvegicus
agtcccgtgaatacgagcatgtccg

SEQ ID NO: 575398 - DNA, 25 bp, Rattus norvegicus
ccttcgagaagagaaagtcccgtga

SEQ ID NO: 575399 - DNA, 25 bp, Rattus norvegicus
cttctagagccggagctcgcgctgc

SEQ ID NO: 575400 - DNA, 25 bp, Rattus norvegicus
tgtggtcgcaaagaaaaatgtagcc

SEQ ID NO: 575401 - DNA, 25 bp, Rattus norvegicus
gcccgtttcgtagttgtggtcgcaa

SEQ ID NO: 575402 - DNA, 25 bp, Rattus norvegicus
tgcgggatctgttgcccgtttcgta

SEQ ID NO: 575403 - DNA, 25 bp, Rattus norvegicus
accgagtctccacggtgcgggatct

SEQ ID NO: 575404 - DNA, 25 bp, Rattus norvegicus
ttgctccgaaggcaccgagtctcca

SEQ ID NO: 575405 - DNA, 25 bp, Rattus norvegicus
ctcgcgctgcacgtgagaagctgcc

SEQ ID NO: 575406 - DNA, 25 bp, Rattus norvegicus
tgaagtagacggtgcgggcacaccc

SEQ ID NO: 575407 - DNA, 25 bp, Rattus norvegicus
cggacacgaaccgagccgagagctc

SEQ ID NO: 575408 - DNA, 25 bp, Rattus norvegicus
ggcgggccagcagattccaatctct

SEQ ID NO: 575409 - DNA, 25 bp, Rattus norvegicus
gggtcccgagaaactcatcctccga

SEQ ID NO: 575410 - DNA, 25 bp, Rattus norvegicus
gagttctctctggttctggctcgcc

SEQ ID NO: 575411 - DNA, 25 bp, Rattus norvegicus
cccatttaaggattccagaagcgtc

SEQ ID NO: 575412 - DNA, 25 bp, Rattus norvegicus
cggagtggtgcgaatgcgaacaaaa

SEQ ID NO: 575413 - DNA, 25 bp, Rattus norvegicus
ctgctccaggcaggaatgagttaac

SEQ ID NO: 575414 - DNA, 25 bp, Rattus norvegicus
ttgaggcagtggctccggctcgtct

SEQ ID NO: 575415 - DNA, 25 bp, Rattus norvegicus
acagcctgggaaccgcgttgaggca

SEQ ID NO: 575416 - DNA, 25 bp, Rattus norvegicus
ggaatgagttaacgtctgcacagcc

SEQ ID NO: 575417 - DNA, 25 bp, Rattus norvegicus
ccgcaacccagcagaggagcgggac

SEQ ID NO: 575418 - DNA, 25 bp, Rattus norvegicus
ccagagataagaagccggcgcaaac

SEQ ID NO: 575419 - DNA, 25 bp, Rattus norvegicus
gtctgcacagcctgggaaccgcgtt

SEQ ID NO: 575420 - DNA, 25 bp, Rattus norvegicus
ggaccacggtgtcctccgcccactg

SEQ ID NO: 575421 - DNA, 25 bp, Rattus norvegicus
taagtcgtcagcgagcgctccggtc

SEQ ID NO: 575422 - DNA, 25 bp, Rattus norvegicus
agcccgggctaagtcgtcagcgagc

SEQ ID NO: 575423 - DNA, 25 bp, Rattus norvegicus
acaacaaggtgatctgagtcactta

SEQ ID NO: 575424 - DNA, 25 bp, Rattus norvegicus
tgtgtaattaaacaacaaggtgatc

SEQ ID NO: 575425 - DNA, 25 bp, Rattus norvegicus
ggcctcgggactgtgtaattaaaca

SEQ ID NO: 575426 - DNA, 25 bp, Rattus norvegicus
agcccaggcctctgcgggagaagct

SEQ ID NO: 575427 - DNA, 25 bp, Rattus norvegicus
gctcacctggcttctaaggaagttg

SEQ ID NO: 575428 - DNA, 25 bp, Rattus norvegicus
aagtgtccatcaggcccgcagccag

SEQ ID NO: 575429 - DNA, 25 bp, Rattus norvegicus
tacagttcgccagctccggaaccgg

SEQ ID NO: 575430 - DNA, 25 bp, Rattus norvegicus
ccgggctttagacaccaagaccttg

SEQ ID NO: 575431 - DNA, 25 bp, Rattus norvegicus
accttgcggaagagaactacaactc

SEQ ID NO: 575432 - DNA, 25 bp, Rattus norvegicus
agtaagcggccgtacgattggctgc

SEQ ID NO: 575433 - DNA, 25 bp, Rattus norvegicus
gcgcaaatggcgttgagatggttca

SEQ ID NO: 575434 - DNA, 25 bp, Rattus norvegicus
ggccctgttcaaactccagcgctga

SEQ ID NO: 575435 - DNA, 25 bp, Rattus norvegicus
tgggcactggaggatctgaagaact

SEQ ID NO: 575436 - DNA, 25 bp, Rattus norvegicus
tgcgagtctcgttgctcacctggct

SEQ ID NO: 575437 - DNA, 25 bp, Rattus norvegicus
ttcccgagttggtgaagtgtccatc

SEQ ID NO: 575438 - DNA, 25 bp, Rattus norvegicus
gggaaacgattgacacagctgcctg

SEQ ID NO: 575439 - DNA, 25 bp, Rattus norvegicus
ttcctatttaccgaagcggagcggc

SEQ ID NO: 575440 - DNA, 25 bp, Rattus norvegicus
cgggcggcttcttgattgactaatc

SEQ ID NO: 575441 - DNA, 25 bp, Rattus norvegicus
aagtgtcttggaacagaaggatgcg

SEQ ID NO: 575442 - DNA, 25 bp, Rattus norvegicus
cacgcaccgcgagcgctcagaggag

SEQ ID NO: 575443 - DNA, 25 bp, Rattus norvegicus
acagcgcctccttgcggcgctggga

SEQ ID NO: 575444 - DNA, 25 bp, Rattus norvegicus
accgaggtcccagggaagtgagaca

SEQ ID NO: 575445 - DNA, 25 bp, Rattus norvegicus
gcgagccgcggatttcctgaggctc

SEQ ID NO: 575446 - DNA, 25 bp, Rattus norvegicus
gctcggaggtcacccgaatgctgtg

SEQ ID NO: 575447 - DNA, 25 bp, Rattus norvegicus
tctgggccctgagcgtcttcaacag

SEQ ID NO: 575448 - DNA, 25 bp, Rattus norvegicus
tcgcgcgaccagttccgcgtcttta

SEQ ID NO: 575449 - DNA, 25 bp, Rattus norvegicus
gaccagttccgcgtctttatccctg

SEQ ID NO: 575450 - DNA, 25 bp, Rattus norvegicus
ccagatggatctggtgcctggatgc

SEQ ID NO: 575451 - DNA, 25 bp, Rattus norvegicus
attcggatgtgctccgtgaccctgg

SEQ ID NO: 575452 - DNA, 25 bp, Rattus norvegicus
cccaggatgactgccctcgtggcag

SEQ ID NO: 575453 - DNA, 25 bp, Rattus norvegicus
gccctcgtggcaggtcagcaaagag

SEQ ID NO: 575454 - DNA, 25 bp, Rattus norvegicus
agcgtcttcaacagcggctgggttg

SEQ ID NO: 575455 - DNA, 25 bp, Rattus norvegicus
aagtctgcccggacagccagggttc

SEQ ID NO: 575456 - DNA, 25 bp, Rattus norvegicus
tgccctttaagcatcccggtgcctg

SEQ ID NO: 575457 - DNA, 25 bp, Rattus norvegicus
tggtctttccgcaggctgctagagt

SEQ ID NO: 575458 - DNA, 25 bp, Rattus norvegicus
gagagcggctgtcctttctggccac

SEQ ID NO: 575459 - DNA, 25 bp, Rattus norvegicus
tggccacccgcaggactgcagaatc

SEQ ID NO: 575460 - DNA, 25 bp, Rattus norvegicus
actgcagaatctccgctgaagtccc

SEQ ID NO: 575461 - DNA, 25 bp, Rattus norvegicus
cgatggctgtgcctcctccgtttct

SEQ ID NO: 575462 - DNA, 25 bp, Rattus norvegicus
ttcgctcttcgcctgggctcagaca

SEQ ID NO: 575463 - DNA, 25 bp, Rattus norvegicus
cagagccgcttaagccgctggaagc

SEQ ID NO: 575464 - DNA, 25 bp, Rattus norvegicus
aagcgctgacgctgtggcttcttcc

SEQ ID NO: 575465 - DNA, 25 bp, Rattus norvegicus
cttccctggatatgccagtgcgtta

SEQ ID NO: 575466 - DNA, 25 bp, Rattus norvegicus
tcatccacatcggtgagctcggagg

SEQ ID NO: 575467 - DNA, 25 bp, Rattus norvegicus
cagtgatgcgcagagtccaaactta

SEQ ID NO: 575468 - DNA, 25 bp, Rattus norvegicus
gggccacctaatagagccagtgatg

SEQ ID NO: 575469 - DNA, 25 bp, Rattus norvegicus
aatgtagcctatgctgcgctggcgg

SEQ ID NO: 575470 - DNA, 25 bp, Rattus norvegicus
cgccagtgagaagcctcattatgtg

SEQ ID NO: 575471 - DNA, 25 bp, Rattus norvegicus
gcctcattatgtgcggctctgcctc

SEQ ID NO: 575472 - DNA, 25 bp, Rattus norvegicus
tgcggctctgcctcgaagaacaagc

SEQ ID NO: 575473 - DNA, 25 bp, Rattus norvegicus
gcctcgaagaacaagcctctcgctg

SEQ ID NO: 575474 - DNA, 25 bp, Rattus norvegicus
cgggcccgcgaacagagcatgaaat

SEQ ID NO: 575475 - DNA, 25 bp, Rattus norvegicus
cccgcgaacagagcatgaaattgtt

SEQ ID NO: 575476 - DNA, 25 bp, Rattus norvegicus
catgaaattgttggaaatggctccc

SEQ ID NO: 575477 - DNA, 25 bp, Rattus norvegicus
cttcaccctcagaacaaagatgttt

SEQ ID NO: 575478 - DNA, 25 bp, Rattus norvegicus
gatgttttctccagcataaatcggc

SEQ ID NO: 575479 - DNA, 25 bp, Rattus norvegicus
ttctccagcataaatcggctctctc

SEQ ID NO: 575480 - DNA, 25 bp, Rattus norvegicus
ataaatcggctctctctcggcgcgg

SEQ ID NO: 575481 - DNA, 25 bp, Rattus norvegicus
ggccggcgttcccacaaatgtagcc

SEQ ID NO: 575482 - DNA, 25 bp, Rattus norvegicus
gttcccacaaatgtagcctatgctg

SEQ ID NO: 575483 - DNA, 25 bp, Rattus norvegicus
gcgagtctcactgggctaggcccgc

SEQ ID NO: 575484 - DNA, 25 bp, Rattus norvegicus
agcaccgacgcccaaggacacccgg

SEQ ID NO: 575485 - DNA, 25 bp, Rattus norvegicus
gtctcagcaccaccgagcaggggca

SEQ ID NO: 575486 - DNA, 25 bp, Rattus norvegicus
agcaccaccgagcaggggcatccgg

SEQ ID NO: 575487 - DNA, 25 bp, Rattus norvegicus
ggctccgagggtcgtcccagagcac

SEQ ID NO: 575488 - DNA, 25 bp, Rattus norvegicus
gagggtcgtcccagagcaccgacgc

SEQ ID NO: 575489 - DNA, 25 bp, Rattus norvegicus
gccctgatttcccggtgcaggaagg

SEQ ID NO: 575490 - DNA, 25 bp, Rattus norvegicus
cgactctcaccgtgcggaggtcgcg

SEQ ID NO: 575491 - DNA, 25 bp, Rattus norvegicus
ggcgaaggacagtcccgtcacatcc

SEQ ID NO: 575492 - DNA, 25 bp, Rattus norvegicus
ccgcccagctgcctgctccgcagca

SEQ ID NO: 575493 - DNA, 25 bp, Rattus norvegicus
gcagcagccagcatcgcctccacgg

SEQ ID NO: 575494 - DNA, 25 bp, Rattus norvegicus
cgcaggcgcgagtctcactgggcta

SEQ ID NO: 575495 - DNA, 25 bp, Rattus norvegicus
ccggacagtccttgcgcaggcgcga

SEQ ID NO: 575496 - DNA, 25 bp, Rattus norvegicus
gggagccaggtagcctccagcgtcc

SEQ ID NO: 575497 - DNA, 25 bp, Rattus norvegicus
aggcttagccctgactggccagtgc

SEQ ID NO: 575498 - DNA, 25 bp, Rattus norvegicus
ccagggtctggctgcacggaagtat

SEQ ID NO: 575499 - DNA, 25 bp, Rattus norvegicus
acggaagtatgcagtggggtcccta

SEQ ID NO: 575500 - DNA, 25 bp, Rattus norvegicus
tctcgagagacctaaacactgaatc

SEQ ID NO: 575501 - DNA, 25 bp, Rattus norvegicus
cccggtccacgcaggaagagcctga

SEQ ID NO: 575502 - DNA, 25 bp, Rattus norvegicus
ttcgcgggcattaccgtgtagtagc

SEQ ID NO: 575503 - DNA, 25 bp, Rattus norvegicus
aaggagacggcgatgactgtgaacc

SEQ ID NO: 575504 - DNA, 25 bp, Rattus norvegicus
ccctctggaagtagctagcgcctgt

SEQ ID NO: 575505 - DNA, 25 bp, Rattus norvegicus
gaccgtctcttgcacccagtggaag

SEQ ID NO: 575506 - DNA, 25 bp, Rattus norvegicus
ggcttcctgtgcaccagacccggaa

SEQ ID NO: 575507 - DNA, 25 bp, Rattus norvegicus
ccagacccggaaggttttggctgca

SEQ ID NO: 575508 - DNA, 25 bp, Rattus norvegicus
ctgcagtgacctggggaccgagtct

SEQ ID NO: 575509 - DNA, 25 bp, Rattus norvegicus
tgactgtgaaccagaacaagctgcc

SEQ ID NO: 575510 - DNA, 25 bp, Rattus norvegicus
aacactgaatcgttgggccagaatc

SEQ ID NO: 575511 - DNA, 25 bp, Rattus norvegicus
tgacagtgctctcgaatccgcacag

SEQ ID NO: 575512 - DNA, 25 bp, Rattus norvegicus
ctcgccgctcacctaggtaaatgca

SEQ ID NO: 575513 - DNA, 25 bp, Rattus norvegicus
caggaccagggcaacctgtgggcca

SEQ ID NO: 575514 - DNA, 25 bp, Rattus norvegicus
aacctgtgggccacgcctcatgtct

SEQ ID NO: 575515 - DNA, 25 bp, Rattus norvegicus
acgcctcatgtctccgcggaagggt

SEQ ID NO: 575516 - DNA, 25 bp, Rattus norvegicus
ggtcgaaagcctggccactgccgag

SEQ ID NO: 575517 - DNA, 25 bp, Rattus norvegicus
agctggacctcggagcatgccctga

SEQ ID NO: 575518 - DNA, 25 bp, Rattus norvegicus
atgccctgagctcggtaggagagca

SEQ ID NO: 575519 - DNA, 25 bp, Rattus norvegicus
gcgctaagcggatgacagtgctctc

SEQ ID NO: 575520 - DNA, 25 bp, Rattus norvegicus
tcacctaggtaaatgcacagcagcc

SEQ ID NO: 575521 - DNA, 25 bp, Rattus norvegicus
aatccgcacagctggatggctccgg

SEQ ID NO: 575522 - DNA, 25 bp, Rattus norvegicus
atggctccggtcaggttactaatga

SEQ ID NO: 575523 - DNA, 25 bp, Rattus norvegicus
ctaatgagaccaattactgggacca

SEQ ID NO: 575524 - DNA, 25 bp, Rattus norvegicus
ttactgggaccagcttagagcggcg

SEQ ID NO: 575525 - DNA, 25 bp, Rattus norvegicus
accgagagtgttcgacctccctctg

SEQ ID NO: 575526 - DNA, 25 bp, Rattus norvegicus
gagtgttcgggtgtgcccttcctcc

SEQ ID NO: 575527 - DNA, 25 bp, Rattus norvegicus
tggagaccggaccaatggaagtttg

SEQ ID NO: 575528 - DNA, 25 bp, Rattus norvegicus
tcttggcttggagaccggaccaatg

SEQ ID NO: 575529 - DNA, 25 bp, Rattus norvegicus
gccaatcaagagcaggcttctaacg

SEQ ID NO: 575530 - DNA, 25 bp, Rattus norvegicus
ggtaaatagtacaagcagccaatca

SEQ ID NO: 575531 - DNA, 25 bp, Rattus norvegicus
ggggcagtacctcagctccggtcac

SEQ ID NO: 575532 - DNA, 25 bp, Rattus norvegicus
ctgcgtcacgcaatatccggacaaa

SEQ ID NO: 575533 - DNA, 25 bp, Rattus norvegicus
gattctcaggactctcggggcagta

SEQ ID NO: 575534 - DNA, 25 bp, Rattus norvegicus
acgtccatcacgagaactgggattc

SEQ ID NO: 575535 - DNA, 25 bp, Rattus norvegicus
tgactcagcatctccctgccgaggg

SEQ ID NO: 575536 - DNA, 25 bp, Rattus norvegicus
gctgtgccgacgtccatcacgagaa

SEQ ID NO: 575537 - DNA, 25 bp, Rattus norvegicus
cagctagggcgaccacgcgggtcct

SEQ ID NO: 575538 - DNA, 25 bp, Rattus norvegicus
gtcctcgagcggctgactcagcatc

SEQ ID NO: 575539 - DNA, 25 bp, Rattus norvegicus
gtcctagatactccagatctgcatg

SEQ ID NO: 575540 - DNA, 25 bp, Rattus norvegicus
tactgcgcatgtgcggaaatcggtc

SEQ ID NO: 575541 - DNA, 25 bp, Rattus norvegicus
tgaagacaagaccatcgagctcatg

SEQ ID NO: 575542 - DNA, 25 bp, Rattus norvegicus
cccgactcggtgattgaagacaaga

SEQ ID NO: 575543 - DNA, 25 bp, Rattus norvegicus
agttgtagtcttcgccgtgcgtcct

SEQ ID NO: 575544 - DNA, 25 bp, Rattus norvegicus
gcccgacggcttcttgttcccataa

SEQ ID NO: 575545 - DNA, 25 bp, Rattus norvegicus
ggccctatcccgagcaagtcctaga

SEQ ID NO: 575546 - DNA, 25 bp, Rattus norvegicus
ataaggcttagcgatccgccgcggt

SEQ ID NO: 575547 - DNA, 25 bp, Rattus norvegicus
cgcgaggatttctgggacaagtagt

SEQ ID NO: 575548 - DNA, 25 bp, Rattus norvegicus
ccaggaagtctggaacgaccaaccg

SEQ ID NO: 575549 - DNA, 25 bp, Rattus norvegicus
tcggtcgcaccgcaaagatctcaga

SEQ ID NO: 575550 - DNA, 25 bp, Rattus norvegicus
gtgggcactgcagacaactactgcg

SEQ ID NO: 575551 - DNA, 25 bp, Rattus norvegicus
cgcgcaagcacctagacgaccagtg

SEQ ID NO: 575552 - DNA, 25 bp, Rattus norvegicus
tctcagacaagtgaggagttgcctc

SEQ ID NO: 575553 - DNA, 25 bp, Rattus norvegicus
gcctggcgtgctgctactgaagaaa

SEQ ID NO: 575554 - DNA, 25 bp, Rattus norvegicus
cagcagtgttccgtgcggtcgtaga

SEQ ID NO: 575555 - DNA, 25 bp, Rattus norvegicus
ccggttccacacgatgcagtcgcta

SEQ ID NO: 575556 - DNA, 25 bp, Rattus norvegicus
cccaggccgatgaagccgatgaaca

SEQ ID NO: 575557 - DNA, 25 bp, Rattus norvegicus
tcctaggagccgatcttcaccttcg

SEQ ID NO: 575558 - DNA, 25 bp, Rattus norvegicus
gatccatttaagcagcatgaggctg

SEQ ID NO: 575559 - DNA, 25 bp, Rattus norvegicus
gacggagcctacaacgatccattta

SEQ ID NO: 575560 - DNA, 25 bp, Rattus norvegicus
ggcacgtactccttgacggagccta

SEQ ID NO: 575561 - DNA, 25 bp, Rattus norvegicus
agtccaccaagtccgtgggcacgta

SEQ ID NO: 575562 - DNA, 25 bp, Rattus norvegicus
ttccatagccttggggaacgagctg

SEQ ID NO: 575563 - DNA, 25 bp, Rattus norvegicus
atccggttaggcgtcctggaagaag

SEQ ID NO: 575564 - DNA, 25 bp, Rattus norvegicus
agtcgctacagcgtaactcccgggg

SEQ ID NO: 575565 - DNA, 25 bp, Rattus norvegicus
ggtcaagcgggtgctaatccggtta

SEQ ID NO: 575566 - DNA, 25 bp, Rattus norvegicus
ccgatgaacagaggcaccacgcaca

SEQ ID NO: 575567 - DNA, 25 bp, Rattus norvegicus
ggaacagtcgccgtcccgagaggac

SEQ ID NO: 575568 - DNA, 25 bp, Rattus norvegicus
caggccggacgcttcagcgaggcca

SEQ ID NO: 575569 - DNA, 25 bp, Rattus norvegicus
acaataagaacaggccggacgcttc

SEQ ID NO: 575570 - DNA, 25 bp, Rattus norvegicus
gggccagcccgagacaataagaaca

SEQ ID NO: 575571 - DNA, 25 bp, Rattus norvegicus
tcacgagggccagcccgagacaata

SEQ ID NO: 575572 - DNA, 25 bp, Rattus norvegicus
cccgagaggacgctcacgagggcca

SEQ ID NO: 575573 - DNA, 25 bp, Rattus norvegicus
ctcgcgggcggtctcagcagacaaa

SEQ ID NO: 575574 - DNA, 25 bp, Rattus norvegicus
atacagcgcccagttcggctcagcg

SEQ ID NO: 575575 - DNA, 25 bp, Rattus norvegicus
ccaatcaatacagcgcccagttcgg

SEQ ID NO: 575576 - DNA, 25 bp, Rattus norvegicus
aagcagcacaccttccggggagccg

SEQ ID NO: 575577 - DNA, 25 bp, Rattus norvegicus
gggcagagcccaagcagcacacctt

SEQ ID NO: 575578 - DNA, 25 bp, Rattus norvegicus
aagaaggcgccttctgttgggctcg

SEQ ID NO: 575579 - DNA, 25 bp, Rattus norvegicus
tcagcgaggccacgcgttctactta

SEQ ID NO: 575580 - DNA, 25 bp, Rattus norvegicus
cgcgactgctagcacacccagagtg

SEQ ID NO: 575581 - DNA, 25 bp, Rattus norvegicus
acttctggccgcagtgttgagcgct

SEQ ID NO: 575582 - DNA, 25 bp, Rattus norvegicus
ctgacccgcctcgttggttggctct

SEQ ID NO: 575583 - DNA, 25 bp, Rattus norvegicus
cccaagcgtgatttatcgggttccg

SEQ ID NO: 575584 - DNA, 25 bp, Rattus norvegicus
cctaggtaatgaggcggatcgctga

SEQ ID NO: 575585 - DNA, 25 bp, Rattus norvegicus
tgatttatcgggttccgccctctcg

SEQ ID NO: 575586 - DNA, 25 bp, Rattus norvegicus
ccagacgctggcgaagccaatcact

SEQ ID NO: 575587 - DNA, 25 bp, Rattus norvegicus
taatgaggcggatcgctgacccgcc

SEQ ID NO: 575588 - DNA, 25 bp, Rattus norvegicus
aagccaatcacttctggccgcagtg

SEQ ID NO: 575589 - DNA, 25 bp, Rattus norvegicus
aggcctgactccaaccgctcgctcc

SEQ ID NO: 575590 - DNA, 25 bp, Rattus norvegicus
ccgccttctctacggcccgcctatg

SEQ ID NO: 575591 - DNA, 25 bp, Rattus norvegicus
ccgccctacaagtggtttgccctag

SEQ ID NO: 575592 - DNA, 25 bp, Rattus norvegicus
tacaagtggtttgccctaggtaatg

SEQ ID NO: 575593 - DNA, 25 bp, Rattus norvegicus
tttgccctaggtaatgaggcggatc

SEQ ID NO: 575594 - DNA, 25 bp, Rattus norvegicus
cgctggcgaagccaatcacttctgg

SEQ ID NO: 575595 - DNA, 25 bp, Rattus norvegicus
ttcagacagctgagtgccaccagcg

SEQ ID NO: 575596 - DNA, 25 bp, Rattus norvegicus
acgccactttcacgtgacagacacg

SEQ ID NO: 575597 - DNA, 25 bp, Rattus norvegicus
ggaggctcgtgggactaagattccc

SEQ ID NO: 575598 - DNA, 25 bp, Rattus norvegicus
tcctccgttgtagcgcagctttgga

SEQ ID NO: 575599 - DNA, 25 bp, Rattus norvegicus
tggggaggacctggccgcatcctcc

SEQ ID NO: 575600 - DNA, 25 bp, Rattus norvegicus
ggacgcaggaggctcctccgttgta

SEQ ID NO: 575601 - DNA, 25 bp, Rattus norvegicus
ctgagctacgccagcggacgcagga

SEQ ID NO: 575602 - DNA, 25 bp, Rattus norvegicus
cccaagcgtgaagtttgaactgatc

SEQ ID NO: 575603 - DNA, 25 bp, Rattus norvegicus
tctgtcctctgtcccaacaattcag

SEQ ID NO: 575604 - DNA, 25 bp, Rattus norvegicus
tgcgagacggacaagagtttttctg

SEQ ID NO: 575605 - DNA, 25 bp, Rattus norvegicus
attcaaacatctgggtgcgagacgg

SEQ ID NO: 575606 - DNA, 25 bp, Rattus norvegicus
gacgagcgtttctttcagtcctctg

SEQ ID NO: 575607 - DNA, 25 bp, Rattus norvegicus
aagtttgaactgatcgctgcggtgg

SEQ ID NO: 575608 - DNA, 25 bp, Rattus norvegicus
cccactgcgaggtggacgagcgttt

SEQ ID NO: 575609 - DNA, 25 bp, Rattus norvegicus
aagacgccaggcaccgagcacactg

SEQ ID NO: 575610 - DNA, 25 bp, Rattus norvegicus
aggcaccgagcacactgctgtctgg

SEQ ID NO: 575611 - DNA, 25 bp, Rattus norvegicus
ctccaaaagtgggaagacgccaggc

SEQ ID NO: 575612 - DNA, 25 bp, Rattus norvegicus
ccgtgatttactctccaaaagtggg

SEQ ID NO: 575613 - DNA, 25 bp, Rattus norvegicus
aagtgtgtccgtgatttactctcca

SEQ ID NO: 575614 - DNA, 25 bp, Rattus norvegicus
tgaatcgcataagtaagtgtgtccg

SEQ ID NO: 575615 - DNA, 25 bp, Rattus norvegicus
gaagtcattgtggatgaatcgcata

SEQ ID NO: 575616 - DNA, 25 bp, Rattus norvegicus
acactgctgtctgggttcccgactc

SEQ ID NO: 575617 - DNA, 25 bp, Rattus norvegicus
gcttgcagtttatgccgccgctgcc

SEQ ID NO: 575618 - DNA, 25 bp, Rattus norvegicus
tcccgactctgaggcctgtgcgtgt

SEQ ID NO: 575619 - DNA, 25 bp, Rattus norvegicus
cgtgtgtgcgctgtcagaaagcaaa

SEQ ID NO: 575620 - DNA, 25 bp, Rattus norvegicus
gcgctgtcagaaagcaaagttcaca

SEQ ID NO: 575621 - DNA, 25 bp, Rattus norvegicus
ttcacaccagtgaatcggcggcacc

SEQ ID NO: 575622 - DNA, 25 bp, Rattus norvegicus
gctgccacggagaagtcattgtgga

SEQ ID NO: 575623 - DNA, 25 bp, Rattus norvegicus
gccaatgaacctagctcactgccag

SEQ ID NO: 575624 - DNA, 25 bp, Rattus norvegicus
ggcgactgctccctcgccaatgaac

SEQ ID NO: 575625 - DNA, 25 bp, Rattus norvegicus
aggtccatggcgatggagggcgcct

SEQ ID NO: 575626 - DNA, 25 bp, Rattus norvegicus
gcgatgatatcaggtccatggcgat

SEQ ID NO: 575627 - DNA, 25 bp, Rattus norvegicus
tcagcgatgatatcaggtccatggc

SEQ ID NO: 575628 - DNA, 25 bp, Rattus norvegicus
gctcagcgatgatatcaggtccatg

SEQ ID NO: 575629 - DNA, 25 bp, Rattus norvegicus
atgaacctagctcactgccaggcac

SEQ ID NO: 575630 - DNA, 25 bp, Rattus norvegicus
gaagacagggaagagcggcacccgc

SEQ ID NO: 575631 - DNA, 25 bp, Rattus norvegicus
ccgcgagaagctgagcgctagctcg

SEQ ID NO: 575632 - DNA, 25 bp, Rattus norvegicus
agaagctgagcgctagctcgcccag

SEQ ID NO: 575633 - DNA, 25 bp, Rattus norvegicus
tgagcgctagctcgcccaggctcag

SEQ ID NO: 575634 - DNA, 25 bp, Rattus norvegicus
ctagctcgcccaggctcagcgatga

SEQ ID NO: 575635 - DNA, 25 bp, Rattus norvegicus
ccaggctcagcgatgatatcaggtc

SEQ ID NO: 575636 - DNA, 25 bp, Rattus norvegicus
ctcgcccaggctcagcgatgatatc

SEQ ID NO: 575637 - DNA, 25 bp, Rattus norvegicus
gagacatactgctgttcgggtaata

SEQ ID NO: 575638 - DNA, 25 bp, Rattus norvegicus
ctctatgcacactgagccggggtcg

SEQ ID NO: 575639 - DNA, 25 bp, Rattus norvegicus
tggagttcagttatctgccgcgccc

SEQ ID NO: 575640 - DNA, 25 bp, Rattus norvegicus
gtcaagggcgcaatttctgtagatg

SEQ ID NO: 575641 - DNA, 25 bp, Rattus norvegicus
tctgtagatggcgaacctgaagccc

SEQ ID NO: 575642 - DNA, 25 bp, Rattus norvegicus
gaagcccagtcaacgccagatcaga

SEQ ID NO: 575643 - DNA, 25 bp, Rattus norvegicus
cagggatcagctgtgacacgcgaca

SEQ ID NO: 575644 - DNA, 25 bp, Rattus norvegicus
gctccgccctgtaggtgacatcacg

SEQ ID NO: 575645 - DNA, 25 bp, Rattus norvegicus
ttcagaattggtcagttcgcgttcc

SEQ ID NO: 575646 - DNA, 25 bp, Rattus norvegicus
tcatcacgacattacggcttcaccg

SEQ ID NO: 575647 - DNA, 25 bp, Rattus norvegicus
tccggtttgaccgatgccttggctg

SEQ ID NO: 575648 - DNA, 25 bp, Rattus norvegicus
tccctccacaggacgctactgatga

SEQ ID NO: 575649 - DNA, 25 bp, Rattus norvegicus
ccggggctgtgctcaactttaaact

SEQ ID NO: 575650 - DNA, 25 bp, Rattus norvegicus
ctttaaactgtgagtaggccgcggc

SEQ ID NO: 575651 - DNA, 25 bp, Rattus norvegicus
caacggctctctggatccggcctta

SEQ ID NO: 575652 - DNA, 25 bp, Rattus norvegicus
tgccatctcggtgtctcgttctcct

SEQ ID NO: 575653 - DNA, 25 bp, Rattus norvegicus
gccatcgactcccagagcaacgtaa

SEQ ID NO: 575654 - DNA, 25 bp, Rattus norvegicus
gaccggctgctacaggccatcgact

SEQ ID NO: 575655 - DNA, 25 bp, Rattus norvegicus
ctcactggagtttggttctcgaggc

SEQ ID NO: 575656 - DNA, 25 bp, Rattus norvegicus
caggacctgataagtgcgcatgcgt

SEQ ID NO: 575657 - DNA, 25 bp, Rattus norvegicus
tagtgtccctatggccgctccaatc

SEQ ID NO: 575658 - DNA, 25 bp, Rattus norvegicus
tgaccttcggatagcgtccgttgcc

SEQ ID NO: 575659 - DNA, 25 bp, Rattus norvegicus
tccaggacttggcatgtgagcttcc

SEQ ID NO: 575660 - DNA, 25 bp, Rattus norvegicus
cagttagcaggaagagccggtgttc

SEQ ID NO: 575661 - DNA, 25 bp, Rattus norvegicus
tggagggtcttaccattccgcaacc

SEQ ID NO: 575662 - DNA, 25 bp, Rattus norvegicus
ttcctcaaagctagaggtcctcatc

SEQ ID NO: 575663 - DNA, 25 bp, Rattus norvegicus
caacgtaagtgactgccgcgcgatc

SEQ ID NO: 575664 - DNA, 25 bp, Rattus norvegicus
cgcagaatcaatgggcggggctcac

SEQ ID NO: 575665 - DNA, 25 bp, Rattus norvegicus
gggtccaccgctacgggaacgcgca

SEQ ID NO: 575666 - DNA, 25 bp, Rattus norvegicus
agtgaaggacctccgggcagccacc

SEQ ID NO: 575667 - DNA, 25 bp, Rattus norvegicus
ctctgactgaaacctaccgggtcca

SEQ ID NO: 575668 - DNA, 25 bp, Rattus norvegicus
ttggccgccatagtgactctgactg

SEQ ID NO: 575669 - DNA, 25 bp, Rattus norvegicus
gcctcagcttaccttgccagcgttg

SEQ ID NO: 575670 - DNA, 25 bp, Rattus norvegicus
gtcaggctacgggattccggagcca

SEQ ID NO: 575671 - DNA, 25 bp, Rattus norvegicus
ggcgacctctcctgggtcaggctac

SEQ ID NO: 575672 - DNA, 25 bp, Rattus norvegicus
gcggacgaggcaggaaactttccga

SEQ ID NO: 575673 - DNA, 25 bp, Rattus norvegicus
tcgcatctcagggactggcagctcc

SEQ ID NO: 575674 - DNA, 25 bp, Rattus norvegicus
gcgtcctcgcgagggtcgcatctca

SEQ ID NO: 575675 - DNA, 25 bp, Rattus norvegicus
gcgggaagttggttccttgagctct

SEQ ID NO: 575676 - DNA, 25 bp, Rattus norvegicus
actgcagcatgaagagggttgactc

SEQ ID NO: 575677 - DNA, 25 bp, Rattus norvegicus
actcggctcagccaggaaggtcctc

SEQ ID NO: 575678 - DNA, 25 bp, Rattus norvegicus
acaaacggcagtcaggaaccggcgc

SEQ ID NO: 575679 - DNA, 25 bp, Rattus norvegicus
aggtgattctgagcgccttcccgtt

SEQ ID NO: 575680 - DNA, 25 bp, Rattus norvegicus
cgcgttgtctgggacttcgaagtat

SEQ ID NO: 575681 - DNA, 25 bp, Rattus norvegicus
catttggaaggtgccggtctcctac

SEQ ID NO: 575682 - DNA, 25 bp, Rattus norvegicus
ttgcctttggcaagtacttcgcgtc

SEQ ID NO: 575683 - DNA, 25 bp, Rattus norvegicus
atccgcgttacgttctgccgcttgc

SEQ ID NO: 575684 - DNA, 25 bp, Rattus norvegicus
ctctgtgccacatcctagcgctgtg

SEQ ID NO: 575685 - DNA, 25 bp, Rattus norvegicus
acgtcgcttccacagcctcaggtgg

SEQ ID NO: 575686 - DNA, 25 bp, Rattus norvegicus
ccggcgttgtccagaggatttacca

SEQ ID NO: 575687 - DNA, 25 bp, Rattus norvegicus
cggtaacgtggtcaacaaggtgatt

SEQ ID NO: 575688 - DNA, 25 bp, Rattus norvegicus
cccgcagtaaccagagcacgaaata

SEQ ID NO: 575689 - DNA, 25 bp, Rattus norvegicus
cacgaaatactctgggcgcatgcgc

SEQ ID NO: 575690 - DNA, 25 bp, Rattus norvegicus
ctgtgtctactatggtacgcgctga

SEQ ID NO: 575691 - DNA, 25 bp, Rattus norvegicus
ggtggagccctcaccgaagacgtga

SEQ ID NO: 575692 - DNA, 25 bp, Rattus norvegicus
cgaccaatggtaagcaggttttgcc

SEQ ID NO: 575693 - DNA, 25 bp, Rattus norvegicus
gatttttccttaaggcctccgcagc

SEQ ID NO: 575694 - DNA, 25 bp, Rattus norvegicus
tcccaacagtgtgaggtaggcctcg

SEQ ID NO: 575695 - DNA, 25 bp, Rattus norvegicus
gctacctcccgtggctcaacattgg

SEQ ID NO: 575696 - DNA, 25 bp, Rattus norvegicus
ctctcgcaccggagtagatggtccc

SEQ ID NO: 575697 - DNA, 25 bp, Rattus norvegicus
ccaagttcgcgccacaagcaaggtc

SEQ ID NO: 575698 - DNA, 25 bp, Rattus norvegicus
ctagccttcgggtcacagatttttc

SEQ ID NO: 575699 - DNA, 25 bp, Rattus norvegicus
tgtccatcgagtcttccatgaggtg

SEQ ID NO: 575700 - DNA, 25 bp, Rattus norvegicus
ccggacggaaaacaactgcctactg

SEQ ID NO: 575701 - DNA, 25 bp, Rattus norvegicus
cgggctcgccgcacgtatatatggc

SEQ ID NO: 575702 - DNA, 25 bp, Rattus norvegicus
tatatatggccgcaggagatctcgc

SEQ ID NO: 575703 - DNA, 25 bp, Rattus norvegicus
ttccaccatggtcgccaagcgcagg

SEQ ID NO: 575704 - DNA, 25 bp, Rattus norvegicus
acggcttccacgtctcttctactgg

SEQ ID NO: 575705 - DNA, 25 bp, Rattus norvegicus
tggacaacccaacgagctgcacatg

SEQ ID NO: 575706 - DNA, 25 bp, Rattus norvegicus
cctaagagggctcatgtccatgtcc

SEQ ID NO: 575707 - DNA, 25 bp, Rattus norvegicus
gatcgttgggttcttctcgtgtacc

SEQ ID NO: 575708 - DNA, 25 bp, Rattus norvegicus
agccagggtcttgtgattcgccaaa

SEQ ID NO: 575709 - DNA, 25 bp, Rattus norvegicus
acgtctttgctccacgtcggtctga

SEQ ID NO: 575710 - DNA, 25 bp, Rattus norvegicus
ttctgagtcctcacgcagtctcttc

SEQ ID NO: 575711 - DNA, 25 bp, Rattus norvegicus
ttccagtcctcacttccggtgtttc

SEQ ID NO: 575712 - DNA, 25 bp, Rattus norvegicus
taaggcccattcctgagcggagatc

SEQ ID NO: 575713 - DNA, 25 bp, Rattus norvegicus
ttcttacccaaaaggagcagatcgg

SEQ ID NO: 575714 - DNA, 25 bp, Rattus norvegicus
cttggccctagtcaggacccgtaca

SEQ ID NO: 575715 - DNA, 25 bp, Rattus norvegicus
tgcagatcaggagcttcgaaatgtc

SEQ ID NO: 575716 - DNA, 25 bp, Rattus norvegicus
ctcagtttgtggctcgtaacggacc

SEQ ID NO: 575717 - DNA, 25 bp, Rattus norvegicus
tcggaggcgagttctacagttacta

SEQ ID NO: 575718 - DNA, 25 bp, Rattus norvegicus
ttactacaagtgcaagctggcgctg

SEQ ID NO: 575719 - DNA, 25 bp, Rattus norvegicus
tgtttcccagcgacagccgtaaatg

SEQ ID NO: 575720 - DNA, 25 bp, Rattus norvegicus
cgctaggccctcacgattctgagtc

SEQ ID NO: 575721 - DNA, 25 bp, Rattus norvegicus
tgtaattccagtgcgcccattcagc

SEQ ID NO: 575722 - DNA, 25 bp, Rattus norvegicus
gagttgtagtttccgagttgcgccc

SEQ ID NO: 575723 - DNA, 25 bp, Rattus norvegicus
atcccaaggcatgcctggagttgta

SEQ ID NO: 575724 - DNA, 25 bp, Rattus norvegicus
cctcaggtcataatcccaaggcatg

SEQ ID NO: 575725 - DNA, 25 bp, Rattus norvegicus
ccctggtcgatccagtagatcactg

SEQ ID NO: 575726 - DNA, 25 bp, Rattus norvegicus
gcccattcagcagcctcaggtcata

SEQ ID NO: 575727 - DNA, 25 bp, Rattus norvegicus
cctgaaagcggagagtggaagtctc

SEQ ID NO: 575728 - DNA, 25 bp, Rattus norvegicus
gggcgtcacgggatctgtaattcca

SEQ ID NO: 575729 - DNA, 25 bp, Rattus norvegicus
tcaggtcacaatcgcggggcgtcac

SEQ ID NO: 575730 - DNA, 25 bp, Rattus norvegicus
gtcacctgagtagcggcgttgtcct

SEQ ID NO: 575731 - DNA, 25 bp, Rattus norvegicus
gcccgccaggtttcggcctcaatgt

SEQ ID NO: 575732 - DNA, 25 bp, Rattus norvegicus
ccagagccgcttgagactacatttc

SEQ ID NO: 575733 - DNA, 25 bp, Rattus norvegicus
agatcactgtgaggtcacctgagta

SEQ ID NO: 575734 - DNA, 25 bp, Rattus norvegicus
ccaataagtgcttcaggtcacaatc

SEQ ID NO: 575735 - DNA, 25 bp, Rattus norvegicus
tgcgcacgtgtactctgttcctgtg

SEQ ID NO: 575736 - DNA, 25 bp, Rattus norvegicus
cgccaggcgaaaagggcgaatacta

SEQ ID NO: 575737 - DNA, 25 bp, Rattus norvegicus
ggcacggcccacgtagtcttgagcc

SEQ ID NO: 575738 - DNA, 25 bp, Rattus norvegicus
aaggataagacgtcgcggaaccgcg

SEQ ID NO: 575739 - DNA, 25 bp, Rattus norvegicus
tccgcacgaagatggcggctccact

SEQ ID NO: 575740 - DNA, 25 bp, Rattus norvegicus
cctgtcattgcgctgactgtgctgc

SEQ ID NO: 575741 - DNA, 25 bp, Rattus norvegicus
ctggattcccatctgcgcacgtgta

SEQ ID NO: 575742 - DNA, 25 bp, Rattus norvegicus
ggactcactacatccacgaggctcg

SEQ ID NO: 575743 - DNA, 25 bp, Rattus norvegicus
atctactccggacaactgaggtcga

SEQ ID NO: 575744 - DNA, 25 bp, Rattus norvegicus
ggctgcgtctcttccagacactttg

SEQ ID NO: 575745 - DNA, 25 bp, Rattus norvegicus
cccgctcgggttaagctatgagcca

SEQ ID NO: 575746 - DNA, 25 bp, Rattus norvegicus
gaggctccgcctccttactgcaaaa

SEQ ID NO: 575747 - DNA, 25 bp, Rattus norvegicus
ctgcaaaactctcaggggaggccct

SEQ ID NO: 575748 - DNA, 25 bp, Rattus norvegicus
tcctccgtactagtgcgcaggcacg

SEQ ID NO: 575749 - DNA, 25 bp, Rattus norvegicus
agaaggcccggtcgcacaagtggca

SEQ ID NO: 575750 - DNA, 25 bp, Rattus norvegicus
aagggcctgtgacccgtgtgcttgc

SEQ ID NO: 575751 - DNA, 25 bp, Rattus norvegicus
catgtgtcgcttcatgtgcagagcc

SEQ ID NO: 575752 - DNA, 25 bp, Rattus norvegicus
agagcgcgcgaacttccagccgcag

SEQ ID NO: 575753 - DNA, 25 bp, Rattus norvegicus
ctgtgacccgtgtgcttgcggtagt

SEQ ID NO: 575754 - DNA, 25 bp, Rattus norvegicus
cacaagtggcactggaagggcctgt

SEQ ID NO: 575755 - DNA, 25 bp, Rattus norvegicus
cccggtcgcacaagtggcactggaa

SEQ ID NO: 575756 - DNA, 25 bp, Rattus norvegicus
gcttcatgtgcagagccaggtggtc

SEQ ID NO: 575757 - DNA, 25 bp, Rattus norvegicus
gacccaggctacatgtgtcgcttca

SEQ ID NO: 575758 - DNA, 25 bp, Rattus norvegicus
cgagtcgacccaggctacatgtgtc

SEQ ID NO: 575759 - DNA, 25 bp, Rattus norvegicus
cgctcatgggctggccgagtcgacc

SEQ ID NO: 575760 - DNA, 25 bp, Rattus norvegicus
ccacagtcgctcatgggctggccga

SEQ ID NO: 575761 - DNA, 25 bp, Rattus norvegicus
tggaacccgccacagtcgctcatgg

SEQ ID NO: 575762 - DNA, 25 bp, Rattus norvegicus
gggtaagctcgtcagagcgcgcgaa

SEQ ID NO: 575763 - DNA, 25 bp, Rattus norvegicus
gtctaagtcctcacggatgacaatc

SEQ ID NO: 575764 - DNA, 25 bp, Rattus norvegicus
caaaggacggcaagataggctcgct

SEQ ID NO: 575765 - DNA, 25 bp, Rattus norvegicus
caccctatggtctgataccctgata

SEQ ID NO: 575766 - DNA, 25 bp, Rattus norvegicus
agtactcgctcctgcaccctatggt

SEQ ID NO: 575767 - DNA, 25 bp, Rattus norvegicus
tgacaatctaactaccggcgccctg

SEQ ID NO: 575768 - DNA, 25 bp, Rattus norvegicus
ataggctcgctgagcgccatggcag

SEQ ID NO: 575769 - DNA, 25 bp, Rattus norvegicus
ccacagcctgaggtctaagtcctca

SEQ ID NO: 575770 - DNA, 25 bp, Rattus norvegicus
cattggggtctgcacccagtgcacg

SEQ ID NO: 575771 - DNA, 25 bp, Rattus norvegicus
gtctaactcctaggccattggggtc

SEQ ID NO: 575772 - DNA, 25 bp, Rattus norvegicus
tcatttcgcggccagcgctgcagga

SEQ ID NO: 575773 - DNA, 25 bp, Rattus norvegicus
tgtttaggtcctcatccgtgctgcc

SEQ ID NO: 575774 - DNA, 25 bp, Rattus norvegicus
caggatgaagtccagcacgctgttt

SEQ ID NO: 575775 - DNA, 25 bp, Rattus norvegicus
cccggctccgggtagtagaacgcag

SEQ ID NO: 575776 - DNA, 25 bp, Rattus norvegicus
ccgtccagtcccatggacaggatga

SEQ ID NO: 575777 - DNA, 25 bp, Rattus norvegicus
tgcgcaagcgcacaacggaataggt

SEQ ID NO: 575778 - DNA, 25 bp, Rattus norvegicus
gtgcaggcgcagtacgaaccttttg

SEQ ID NO: 575779 - DNA, 25 bp, Rattus norvegicus
gcagtatttttcacccacagcccaa

SEQ ID NO: 575780 - DNA, 25 bp, Rattus norvegicus
ccgttatgtccggtctgaaggaagc

SEQ ID NO: 575781 - DNA, 25 bp, Rattus norvegicus
tgaaggaagccgtaagtgcgcaagc

SEQ ID NO: 575782 - DNA, 25 bp, Rattus norvegicus
caccgcccgtttcttagcaacaggg

SEQ ID NO: 575783 - DNA, 25 bp, Rattus norvegicus
tgccagacgtcccagcagagctggt

SEQ ID NO: 575784 - DNA, 25 bp, Rattus norvegicus
agctggtcggccagttgcttagcaa

SEQ ID NO: 575785 - DNA, 25 bp, Rattus norvegicus
acaggccgcttgcttgacgccctag

SEQ ID NO: 575786 - DNA, 25 bp, Rattus norvegicus
ctggtcggctagttgcctagcaaca

SEQ ID NO: 575787 - DNA, 25 bp, Rattus norvegicus
ggtggagagcccttcagtaccttgc

SEQ ID NO: 575788 - DNA, 25 bp, Rattus norvegicus
ttgcccttcaggtccagtacgtaga

SEQ ID NO: 575789 - DNA, 25 bp, Rattus norvegicus
cttccggtccatgaagcagcgcgtg

SEQ ID NO: 575790 - DNA, 25 bp, Rattus norvegicus
gtgggactcgcaaaaagaccaccgc

SEQ ID NO: 575791 - DNA, 25 bp, Rattus norvegicus
agactcgctccttggccttggcgct

SEQ ID NO: 575792 - DNA, 25 bp, Rattus norvegicus
ttaaggtgtgctgcagactcgctcc

SEQ ID NO: 575793 - DNA, 25 bp, Rattus norvegicus
attttcggcggagcaaaagtggcgc

SEQ ID NO: 575794 - DNA, 25 bp, Rattus norvegicus
cccacggtaatgctactgaggggca

SEQ ID NO: 575795 - DNA, 25 bp, Rattus norvegicus
tgtggccacatactgacccagcctt

SEQ ID NO: 575796 - DNA, 25 bp, Rattus norvegicus
tacttaggtgccgtccaggcttccg

SEQ ID NO: 575797 - DNA, 25 bp, Rattus norvegicus
tggcgctcaccattggacctactta

SEQ ID NO: 575798 - DNA, 25 bp, Rattus norvegicus
atcctcggcccgagtggatccctag

SEQ ID NO: 575799 - DNA, 25 bp, Rattus norvegicus
acagcccattggttgacgctaagta

SEQ ID NO: 575800 - DNA, 25 bp, Rattus norvegicus
agagccggaagcagtcgaccacaca

SEQ ID NO: 575801 - DNA, 25 bp, Rattus norvegicus
caggtaatcgtaggtcttcgccata

SEQ ID NO: 575802 - DNA, 25 bp, Rattus norvegicus
tgaacgtggaattgaaggcgtcctc

SEQ ID NO: 575803 - DNA, 25 bp, Rattus norvegicus
acgctaagtatagggaggcttgtta

SEQ ID NO: 575804 - DNA, 25 bp, Rattus norvegicus
cgctggacccgtctatcatctcaga

SEQ ID NO: 575805 - DNA, 25 bp, Rattus norvegicus
gcgcttcaccgcctccagtgagttg

SEQ ID NO: 575806 - DNA, 25 bp, Rattus norvegicus
cctccagtgagttgaggccggccat

SEQ ID NO: 575807 - DNA, 25 bp, Rattus norvegicus
tgaggccggccatagctcactcgct

SEQ ID NO: 575808 - DNA, 25 bp, Rattus norvegicus
tcactcgctccactgggctcaggcg

SEQ ID NO: 575809 - DNA, 25 bp, Rattus norvegicus
gtcgcgggtcccagtctctcacttt

SEQ ID NO: 575810 - DNA, 25 bp, Rattus norvegicus
tgcaggctcctcgtcctccggagca

SEQ ID NO: 575811 - DNA, 25 bp, Rattus norvegicus
agtctctcactttctcgcgccgttc

SEQ ID NO: 575812 - DNA, 25 bp, Rattus norvegicus
tgctgtcgggccgatgaggtcaccc

SEQ ID NO: 575813 - DNA, 25 bp, Rattus norvegicus
ctgacgtaggcatggctggccgcct

SEQ ID NO: 575814 - DNA, 25 bp, Rattus norvegicus
atggctggccgcctttgccctgcag

SEQ ID NO: 575815 - DNA, 25 bp, Rattus norvegicus
caccttggtccagccgcagacaatg

SEQ ID NO: 575816 - DNA, 25 bp, Rattus norvegicus
cagacaatgggagcgcggcatctgc

SEQ ID NO: 575817 - DNA, 25 bp, Rattus norvegicus
cgcgcagaaccgtttcccgcaactc

SEQ ID NO: 575818 - DNA, 25 bp, Rattus norvegicus
gcaggccagcgtccgaattctccta

SEQ ID NO: 575819 - DNA, 25 bp, Rattus norvegicus
tctcggcactgcactcaccatagtg

SEQ ID NO: 575820 - DNA, 25 bp, Rattus norvegicus
ttccgagcttccgactgcgcagaac

SEQ ID NO: 575821 - DNA, 25 bp, Rattus norvegicus
caagttccgagcttccgactgcgca

SEQ ID NO: 575822 - DNA, 25 bp, Rattus norvegicus
tggtttacaaactctccgcaagttc

SEQ ID NO: 575823 - DNA, 25 bp, Rattus norvegicus
ggcaccagagttggtttacaaactc

SEQ ID NO: 575824 - DNA, 25 bp, Rattus norvegicus
gctgctgattggaaggctctgctat

SEQ ID NO: 575825 - DNA, 25 bp, Rattus norvegicus
gcagaacccgcgactcctcggccct

SEQ ID NO: 575826 - DNA, 25 bp, Rattus norvegicus
tccgtgcgcattgcgaagccgccag

SEQ ID NO: 575827 - DNA, 25 bp, Rattus norvegicus
tgcactcaccatagtgcgctcctgt

SEQ ID NO: 575828 - DNA, 25 bp, Rattus norvegicus
ggtgtcaacgcggtccgtgcgcatt

SEQ ID NO: 575829 - DNA, 25 bp, Rattus norvegicus
tcctgcctgcgctgctcagtgcggg

SEQ ID NO: 575830 - DNA, 25 bp, Rattus norvegicus
tgattggaaggctctgctatgcgcg

SEQ ID NO: 575831 - DNA, 25 bp, Rattus norvegicus
atagtgcgctcctgtcctgcctgcg

SEQ ID NO: 575832 - DNA, 25 bp, Rattus norvegicus
agcgccgaaaatggaggcaccaggc

SEQ ID NO: 575833 - DNA, 25 bp, Rattus norvegicus
gcgtacgtgtagatcttctgctgca

SEQ ID NO: 575834 - DNA, 25 bp, Rattus norvegicus
ccaggtgtagactggccaccacgtc

SEQ ID NO: 575835 - DNA, 25 bp, Rattus norvegicus
tgcttcgagccgtccaggtgtagac

SEQ ID NO: 575836 - DNA, 25 bp, Rattus norvegicus
aggcgagtcgctggcatccagcacc

SEQ ID NO: 575837 - DNA, 25 bp, Rattus norvegicus
gcagcactcggtgcacaggcgagtc

SEQ ID NO: 575838 - DNA, 25 bp, Rattus norvegicus
tagtagccgtcctcccgagggtgct

SEQ ID NO: 575839 - DNA, 25 bp, Rattus norvegicus
cctgcagcaggaagtagtagccgtc

SEQ ID NO: 575840 - DNA, 25 bp, Rattus norvegicus
accacgtctcggatgacatcgcttg

SEQ ID NO: 575841 - DNA, 25 bp, Rattus norvegicus
caggtactgaatgctgccgtcagcg

SEQ ID NO: 575842 - DNA, 25 bp, Rattus norvegicus
aagtccgcttgaggccttggcagca

SEQ ID NO: 575843 - DNA, 25 bp, Rattus norvegicus
ttgcacaggtcgtcgaagtccgctt

SEQ ID NO: 575844 - DNA, 25 bp, Rattus norvegicus
ttcagctccggcaggttgcacaggt

SEQ ID NO: 575845 - DNA, 25 bp, Rattus norvegicus
ctctgcagcaggttggcctcgttca

SEQ ID NO: 575846 - DNA, 25 bp, Rattus norvegicus
ttctgctgcacgaagcgcagcttca

SEQ ID NO: 575847 - DNA, 25 bp, Rattus norvegicus
gctggatctatcacaaagtggcttc

SEQ ID NO: 575848 - DNA, 25 bp, Rattus norvegicus
accggcctgcgcttgcacagaagct

SEQ ID NO: 575849 - DNA, 25 bp, Rattus norvegicus
tgcgcttgcacagaagctgttcagc

SEQ ID NO: 575850 - DNA, 25 bp, Rattus norvegicus
aagctgttcagcttggagtggtcgc

SEQ ID NO: 575851 - DNA, 25 bp, Rattus norvegicus
tggtcgctggatctatcacaaagtg

SEQ ID NO: 575852 - DNA, 25 bp, Rattus norvegicus
atcacaaagtggcttcctagcttgc

SEQ ID NO: 575853 - DNA, 25 bp, Rattus norvegicus
agtggcttcctagcttgctcacgca

SEQ ID NO: 575854 - DNA, 25 bp, Rattus norvegicus
tcacgcagagtgaaaatggcccggc

SEQ ID NO: 575855 - DNA, 25 bp, Rattus norvegicus
aaaatggcccggcaagcacggctgg

SEQ ID NO: 575856 - DNA, 25 bp, Rattus norvegicus
aggctggagacactggatgtgcttc

SEQ ID NO: 575857 - DNA, 25 bp, Rattus norvegicus
atgtgcttcgagaccgcccttcgtt

SEQ ID NO: 575858 - DNA, 25 bp, Rattus norvegicus
cgcgagcgggaaggcatttcagccg

SEQ ID NO: 575859 - DNA, 25 bp, Rattus norvegicus
ttcctagcttgctcacgcagagtga

SEQ ID NO: 575860 - DNA, 25 bp, Rattus norvegicus
cagcttggagtggtcgctggatcta

SEQ ID NO: 575861 - DNA, 25 bp, Rattus norvegicus
cttgaggtgagcaggagcattccct

SEQ ID NO: 575862 - DNA, 25 bp, Rattus norvegicus
actgcgcaagcgtatggtcttccgg

SEQ ID NO: 575863 - DNA, 25 bp, Rattus norvegicus
cctgtcagtgcgcacgcgtaatata

SEQ ID NO: 575864 - DNA, 25 bp, Rattus norvegicus
cgcgtaatataaagcaaggaagatc

SEQ ID NO: 575865 - DNA, 25 bp, Rattus norvegicus
aggaagatctacttcgcttgcgcga

SEQ ID NO: 575866 - DNA, 25 bp, Rattus norvegicus
cgcttgcgcgaagtgttggcagttt

SEQ ID NO: 575867 - DNA, 25 bp, Rattus norvegicus
cccaccgggtgtactgtcactgtag

SEQ ID NO: 575868 - DNA, 25 bp, Rattus norvegicus
tgcactcttgagcaatcgtggctga

SEQ ID NO: 575869 - DNA, 25 bp, Rattus norvegicus
cccaccctgcttacttagaggatga

SEQ ID NO: 575870 - DNA, 25 bp, Rattus norvegicus
gtcactgtagtctccactgcgcaag

SEQ ID NO: 575871 - DNA, 25 bp, Rattus norvegicus
atagcaactcggtcttttatagccc

SEQ ID NO: 575872 - DNA, 25 bp, Rattus norvegicus
acgcgactgccgtgattggttaagc

SEQ ID NO: 575873 - DNA, 25 bp, Rattus norvegicus
gtcctcagcgcgaagaggccggatt

SEQ ID NO: 575874 - DNA, 25 bp, Rattus norvegicus
cttttagggcgtggatgcactcttg

SEQ ID NO: 575875 - DNA, 25 bp, Rattus norvegicus
gcacagtccaccgtgtatgccttct

SEQ ID NO: 575876 - DNA, 25 bp, Rattus norvegicus
ggtggtgctcggtttcccgtgcaat

SEQ ID NO: 575877 - DNA, 25 bp, Rattus norvegicus
atctgcagaagcgtctggggcctcg

SEQ ID NO: 575878 - DNA, 25 bp, Rattus norvegicus
accgaaatgaatgatctgcagaagc

SEQ ID NO: 575879 - DNA, 25 bp, Rattus norvegicus
tgtatgccttctccgcgcgcccgct

SEQ ID NO: 575880 - DNA, 25 bp, Rattus norvegicus
cccgggactacaccgaaatgaatga

SEQ ID NO: 575881 - DNA, 25 bp, Rattus norvegicus
cacgacccgggactacaccgaaatg

SEQ ID NO: 575882 - DNA, 25 bp, Rattus norvegicus
aatgtcgcgtccctctgaggcacca

SEQ ID NO: 575883 - DNA, 25 bp, Rattus norvegicus
cattgagaatgtcgcgtccctctga

SEQ ID NO: 575884 - DNA, 25 bp, Rattus norvegicus
tgctgctcattgagaatgtcgcgtc

SEQ ID NO: 575885 - DNA, 25 bp, Rattus norvegicus
ggcaaggtgctgctcattgagaatg

SEQ ID NO: 575886 - DNA, 25 bp, Rattus norvegicus
ccctgcggggcaaggtgctgctcat

SEQ ID NO: 575887 - DNA, 25 bp, Rattus norvegicus
gagcccgtgagcctgggctccctgc

SEQ ID NO: 575888 - DNA, 25 bp, Rattus norvegicus
gcggtggcacagtccaccgtgtatg

SEQ ID NO: 575889 - DNA, 25 bp, Rattus norvegicus
cgcacgtgcgtggttacgtgcgtgc

SEQ ID NO: 575890 - DNA, 25 bp, Rattus norvegicus
gctcgctggccctcaggccggaccc

SEQ ID NO: 575891 - DNA, 25 bp, Rattus norvegicus
tcccaccgcgcagagcgtcaggccg

SEQ ID NO: 575892 - DNA, 25 bp, Rattus norvegicus
agtggtgagcgtccgctctgccctc

SEQ ID NO: 575893 - DNA, 25 bp, Rattus norvegicus
gctcagtggtgagcgtccgctctgc

SEQ ID NO: 575894 - DNA, 25 bp, Rattus norvegicus
cttagcacgccgtgcgctaggcgga

SEQ ID NO: 575895 - DNA, 25 bp, Rattus norvegicus
agctcggagccttgatggggaccac

SEQ ID NO: 575896 - DNA, 25 bp, Rattus norvegicus
cccagaagacggagctcggagcctt

SEQ ID NO: 575897 - DNA, 25 bp, Rattus norvegicus
tgtggagacccagaagacggagctc

SEQ ID NO: 575898 - DNA, 25 bp, Rattus norvegicus
gcggtccttagcacgccgtgcgcta

SEQ ID NO: 575899 - DNA, 25 bp, Rattus norvegicus
acccatgagcgaccggatgtggaga

SEQ ID NO: 575900 - DNA, 25 bp, Rattus norvegicus
cacgccgtgcgctaggcggatgtcc

SEQ ID NO: 575901 - DNA, 25 bp, Rattus norvegicus
aaggccggggcacccatgagcgacc

SEQ ID NO: 575902 - DNA, 25 bp, Rattus norvegicus
ccacgctccagcgtggggctcagtg

SEQ ID NO: 575903 - DNA, 25 bp, Rattus norvegicus
aggcatatggacgtccgcccgacca

SEQ ID NO: 575904 - DNA, 25 bp, Rattus norvegicus
gagtagggcgcaccgacccacggtc

SEQ ID NO: 575905 - DNA, 25 bp, Rattus norvegicus
ctctgcacatgccacggcaggagta

SEQ ID NO: 575906 - DNA, 25 bp, Rattus norvegicus
ggtcaccgaaaatgaaccgagaggc

SEQ ID NO: 575907 - DNA, 25 bp, Rattus norvegicus
tgaaccgagaggcatatggacgtcc

SEQ ID NO: 575908 - DNA, 25 bp, Rattus norvegicus
atttagggttctacctggggcgatg

SEQ ID NO: 575909 - DNA, 25 bp, Rattus norvegicus
ctacctggggcgatgatagaaatga

SEQ ID NO: 575910 - DNA, 25 bp, Rattus norvegicus
gaggcagcggcgagcaacacaacac

SEQ ID NO: 575911 - DNA, 25 bp, Rattus norvegicus
ggcgagcaacacaacaccggtatgg

SEQ ID NO: 575912 - DNA, 25 bp, Rattus norvegicus
acaacaccggtatggtgggatcgga

SEQ ID NO: 575913 - DNA, 25 bp, Rattus norvegicus
cgaccaggatttagggttctacctg

SEQ ID NO: 575914 - DNA, 25 bp, Rattus norvegicus
atgtcgccagggcaccgggtccgct

SEQ ID NO: 575915 - DNA, 25 bp, Rattus norvegicus
tggatctcagatgtcgccagggcac

SEQ ID NO: 575916 - DNA, 25 bp, Rattus norvegicus
ggactcacccgctggatctcagatg

SEQ ID NO: 575917 - DNA, 25 bp, Rattus norvegicus
gaagcggaagcgcagtgcacttccg

SEQ ID NO: 575918 - DNA, 25 bp, Rattus norvegicus
tgtcgggctaccactgcccacctta

SEQ ID NO: 575919 - DNA, 25 bp, Rattus norvegicus
gggcctaacggtgctgcggagtgac

SEQ ID NO: 575920 - DNA, 25 bp, Rattus norvegicus
cggagtgacggcccatgaggccaca

SEQ ID NO: 575921 - DNA, 25 bp, Rattus norvegicus
aagcgcagtgcacttccggcgcgca

SEQ ID NO: 575922 - DNA, 25 bp, Rattus norvegicus
gcccaccttacacattccgccgccg

SEQ ID NO: 575923 - DNA, 25 bp, Rattus norvegicus
tgaggatcctgtcgggctaccactg

SEQ ID NO: 575924 - DNA, 25 bp, Rattus norvegicus
ctgtgaggatcctgtcgggctacca

SEQ ID NO: 575925 - DNA, 25 bp, Rattus norvegicus
cgcaccctggggctgtgaggatcct

SEQ ID NO: 575926 - DNA, 25 bp, Rattus norvegicus
ttccaagggcttggccgagacaccc

SEQ ID NO: 575927 - DNA, 25 bp, Rattus norvegicus
attttccaagggcttggccgagaca

SEQ ID NO: 575928 - DNA, 25 bp, Rattus norvegicus
gtggccgacccttcccggatcctca

SEQ ID NO: 575929 - DNA, 25 bp, Rattus norvegicus
gcccatgaggccacagggcggcagg

SEQ ID NO: 575930 - DNA, 25 bp, Rattus norvegicus
cagcaggcggccatgttggagcggc

SEQ ID NO: 575931 - DNA, 25 bp, Rattus norvegicus
gaagtgcgtcatcagctcggcactc

SEQ ID NO: 575932 - DNA, 25 bp, Rattus norvegicus
ggcgttggtctgagttcagtaactc

SEQ ID NO: 575933 - DNA, 25 bp, Rattus norvegicus
taactctgcgcagcttttctggcca

SEQ ID NO: 575934 - DNA, 25 bp, Rattus norvegicus
tttctggccagctgggatctcttga

SEQ ID NO: 575935 - DNA, 25 bp, Rattus norvegicus
gatctcttgatcgttcctctgccgc

SEQ ID NO: 575936 - DNA, 25 bp, Rattus norvegicus
gtggccggcctctgtgattttaaga

SEQ ID NO: 575937 - DNA, 25 bp, Rattus norvegicus
ttatgctacacctgtggccggcctc

SEQ ID NO: 575938 - DNA, 25 bp, Rattus norvegicus
cgatgccgactgagccgttatgcta

SEQ ID NO: 575939 - DNA, 25 bp, Rattus norvegicus
ctgttcaaggtcacgggccgtgcca

SEQ ID NO: 575940 - DNA, 25 bp, Rattus norvegicus
ctcaagtcgccggtttggccgcagc

SEQ ID NO: 575941 - DNA, 25 bp, Rattus norvegicus
aaccggaatcgagagcgtgttgcca

SEQ ID NO: 575942 - DNA, 25 bp, Rattus norvegicus
ttttaagaggattagcggcgagcga

SEQ ID NO: 575943 - DNA, 25 bp, Rattus norvegicus
ccatagccgtatctagaagtcgaaa

SEQ ID NO: 575944 - DNA, 25 bp, Rattus norvegicus
gaagtcgaaacaaaacaagcggctg

SEQ ID NO: 575945 - DNA, 25 bp, Rattus norvegicus
ctcttttcactgaggaaggccacca

SEQ ID NO: 575946 - DNA, 25 bp, Rattus norvegicus
gcggaagctaactgcccggaaaagc

SEQ ID NO: 575947 - DNA, 25 bp, Rattus norvegicus
cggaaaagccagtccggtcgctctc

SEQ ID NO: 575948 - DNA, 25 bp, Rattus norvegicus
tccggctcataaatggcgttgacta

SEQ ID NO: 575949 - DNA, 25 bp, Rattus norvegicus
cattggttcgcttcaaagcttcgta

SEQ ID NO: 575950 - DNA, 25 bp, Rattus norvegicus
agcttcgtattcttattggtcaatg

SEQ ID NO: 575951 - DNA, 25 bp, Rattus norvegicus
caatgagcaaaggtcgctgtgcaga

SEQ ID NO: 575952 - DNA, 25 bp, Rattus norvegicus
gtgtccctgctatggctactccgga

SEQ ID NO: 575953 - DNA, 25 bp, Rattus norvegicus
ctactccggattcgctggcgctgtt

SEQ ID NO: 575954 - DNA, 25 bp, Rattus norvegicus
cggccttggccttagcgaaaacaag

SEQ ID NO: 575955 - DNA, 25 bp, Rattus norvegicus
aacaaggcccgcgagactctcaaga

SEQ ID NO: 575956 - DNA, 25 bp, Rattus norvegicus
cgagactctcaagaacgcggctttg

SEQ ID NO: 575957 - DNA, 25 bp, Rattus norvegicus
ctttgagcactcagctgcgcgaggc

SEQ ID NO: 575958 - DNA, 25 bp, Rattus norvegicus
gtccggtcgctctccggctcataaa

SEQ ID NO: 575959 - DNA, 25 bp, Rattus norvegicus
aggcgactcaggtccaccaccgaag

SEQ ID NO: 575960 - DNA, 25 bp, Rattus norvegicus
ggacgcgccgccagaaagaaagatg

SEQ ID NO: 575961 - DNA, 25 bp, Rattus norvegicus
ttacctaggcttccgcgtctgcgca

SEQ ID NO: 575962 - DNA, 25 bp, Rattus norvegicus
atcgacctcagacgcgggttaccta

SEQ ID NO: 575963 - DNA, 25 bp, Rattus norvegicus
gccaccggcggagaaatcggcaatc

SEQ ID NO: 575964 - DNA, 25 bp, Rattus norvegicus
ggaatcccggacctacacctggaga

SEQ ID NO: 575965 - DNA, 25 bp, Rattus norvegicus
agtacacttgccagaccctgggctc

SEQ ID NO: 575966 - DNA, 25 bp, Rattus norvegicus
ggcgtcagaggtcagagtacacttg

SEQ ID NO: 575967 - DNA, 25 bp, Rattus norvegicus
tcaaggctacttggcgtcagaggtc

SEQ ID NO: 575968 - DNA, 25 bp, Rattus norvegicus
cggtgctgcacgtctgactatccta

SEQ ID NO: 575969 - DNA, 25 bp, Rattus norvegicus
aagaagcttggtcatcggtgctgca

SEQ ID NO: 575970 - DNA, 25 bp, Rattus norvegicus
atggcgtagggtcacgtggaattac

SEQ ID NO: 575971 - DNA, 25 bp, Rattus norvegicus
tccgtacaaacagggcggccatgct

SEQ ID NO: 575972 - DNA, 25 bp, Rattus norvegicus
tccctagcaggatcgagaaggctcg

SEQ ID NO: 575973 - DNA, 25 bp, Rattus norvegicus
cgctctgtacgacgcgtggggttaa

SEQ ID NO: 575974 - DNA, 25 bp, Rattus norvegicus
aacccgagactgacggtagcaggga

SEQ ID NO: 575975 - DNA, 25 bp, Rattus norvegicus
cgcacagttaagctggagctcagta

SEQ ID NO: 575976 - DNA, 25 bp, Rattus norvegicus
cagttaagctggagctcagtatccc

SEQ ID NO: 575977 - DNA, 25 bp, Rattus norvegicus
cagccgctcagccacagtacgaaaa

SEQ ID NO: 575978 - DNA, 25 bp, Rattus norvegicus
tcagccacagtacgaaaaaagttcc

SEQ ID NO: 575979 - DNA, 25 bp, Rattus norvegicus
agcgtggcaaggtgtgcttctgcca

SEQ ID NO: 575980 - DNA, 25 bp, Rattus norvegicus
tacgaaaaaagttccacaagcactc

SEQ ID NO: 575981 - DNA, 25 bp, Rattus norvegicus
gccatgcctggaacccgagactgac

SEQ ID NO: 575982 - DNA, 25 bp, Rattus norvegicus
ccggctgttggctctccctagggct

SEQ ID NO: 575983 - DNA, 25 bp, Rattus norvegicus
gagcggggagaagatcacgcatacc

SEQ ID NO: 575984 - DNA, 25 bp, Rattus norvegicus
gaagatcacgcataccggccaggta

SEQ ID NO: 575985 - DNA, 25 bp, Rattus norvegicus
cataccggccaggtaacggccgtgc

SEQ ID NO: 575986 - DNA, 25 bp, Rattus norvegicus
tgtgcttctgccaggctagcgcgcg

SEQ ID NO: 575987 - DNA, 25 bp, Rattus norvegicus
gacccgcaggcagtgtctggaaaaa

SEQ ID NO: 575988 - DNA, 25 bp, Rattus norvegicus
ggacctcagcctcttctcacagatg

SEQ ID NO: 575989 - DNA, 25 bp, Rattus norvegicus
agagaaacccgagagcaggcctgag

SEQ ID NO: 575990 - DNA, 25 bp, Rattus norvegicus
gcctgtgctcaaggggatgccaatc

SEQ ID NO: 575991 - DNA, 25 bp, Rattus norvegicus
ccgatcctgaaagggttgtgcgcta

SEQ ID NO: 575992 - DNA, 25 bp, Rattus norvegicus
caaaaggggtcctgcacaggggatc

SEQ ID NO: 575993 - DNA, 25 bp, Rattus norvegicus
tcaaattgtgtctgagagcccggcc

SEQ ID NO: 575994 - DNA, 25 bp, Rattus norvegicus
aactacagcgcctttctgccctatg

SEQ ID NO: 575995 - DNA, 25 bp, Rattus norvegicus
tcacctcggtgctgggcatgtatgc

SEQ ID NO: 575996 - DNA, 25 bp, Rattus norvegicus
ctgggctacccgcaatacctaagcg

SEQ ID NO: 575997 - DNA, 25 bp, Rattus norvegicus
agccagtctctttgcccgcgcagtt

SEQ ID NO: 575998 - DNA, 25 bp, Rattus norvegicus
tcctcggatcgacagccagtctctt

SEQ ID NO: 575999 - DNA, 25 bp, Rattus norvegicus
gccgccaaccagcactgggctgagg

SEQ ID NO: 576000 - DNA, 25 bp, Rattus norvegicus
cccagaggcacaggcagtgaccact

SEQ ID NO: 576001 - DNA, 25 bp, Rattus norvegicus
gctcacagatctgcacccgggaaaa

SEQ ID NO: 576002 - DNA, 25 bp, Rattus norvegicus
ccagacgctggtttctttttatgtc

SEQ ID NO: 576003 - DNA, 25 bp, Rattus norvegicus
tgtcaaaccagacagggacgctccc

SEQ ID NO: 576004 - DNA, 25 bp, Rattus norvegicus
ctacgaccctcaactctgcgattta

SEQ ID NO: 576005 - DNA, 25 bp, Rattus norvegicus
ggacgcagtgcctcgctatttcgct

SEQ ID NO: 576006 - DNA, 25 bp, Rattus norvegicus
ccgccgctgcagagacacatgaggc

SEQ ID NO: 576007 - DNA, 25 bp, Rattus norvegicus
ccaggtacttttggcgatggaagcg

SEQ ID NO: 576008 - DNA, 25 bp, Rattus norvegicus
cctgcgcgtccgtcattttgaggga

SEQ ID NO: 576009 - DNA, 25 bp, Rattus norvegicus
accgccacttggtcctccgattttg

SEQ ID NO: 576010 - DNA, 25 bp, Rattus norvegicus
cctggccatcaatccgaaatccgag

SEQ ID NO: 576011 - DNA, 25 bp, Rattus norvegicus
cacatagcttcgtcgtttacgggtt

SEQ ID NO: 576012 - DNA, 25 bp, Rattus norvegicus
taccaggcacggtcttgaagccatc

SEQ ID NO: 576013 - DNA, 25 bp, Rattus norvegicus
tgaagccatctctagaacacatagc

SEQ ID NO: 576014 - DNA, 25 bp, Rattus norvegicus
gaggaccctaaaacagccctggcca

SEQ ID NO: 576015 - DNA, 25 bp, Rattus norvegicus
cacgatcacgagagacgagggagaa

SEQ ID NO: 576016 - DNA, 25 bp, Rattus norvegicus
cccagctcgccacgcattaattagg

SEQ ID NO: 576017 - DNA, 25 bp, Rattus norvegicus
acgcattaattaggccgcgcggggc

SEQ ID NO: 576018 - DNA, 25 bp, Rattus norvegicus
ccgcagcagctaattgcttcccgga

SEQ ID NO: 576019 - DNA, 25 bp, Rattus norvegicus
cagccaccttgacggtcgcgttgcg

SEQ ID NO: 576020 - DNA, 25 bp, Rattus norvegicus
ccggactccgggtcttactggctcg

SEQ ID NO: 576021 - DNA, 25 bp, Rattus norvegicus
gtcttactggctcgggcaactgcgg

SEQ ID NO: 576022 - DNA, 25 bp, Rattus norvegicus
acgtgtcccgcagtctctctggctg

SEQ ID NO: 576023 - DNA, 25 bp, Rattus norvegicus
ccgcagtctctctggctggaggaac

SEQ ID NO: 576024 - DNA, 25 bp, Rattus norvegicus
tcacacagcgggcacgatcacgaga

SEQ ID NO: 576025 - DNA, 25 bp, Rattus norvegicus
aggagcgggaaagaaacgcagacct

SEQ ID NO: 576026 - DNA, 25 bp, Rattus norvegicus
aaacgcagacctgggaaggatcttc

SEQ ID NO: 576027 - DNA, 25 bp, Rattus norvegicus
acctgggaaggatcttcaatgcctc

SEQ ID NO: 576028 - DNA, 25 bp, Rattus norvegicus
ttcaatgcctcctctacgtcgggct

SEQ ID NO: 576029 - DNA, 25 bp, Rattus norvegicus
gaactaagcgttcgcgcgcacggtc

SEQ ID NO: 576030 - DNA, 25 bp, Rattus norvegicus
gtggattgcttttccggatccggca

SEQ ID NO: 576031 - DNA, 25 bp, Rattus norvegicus
cagtacgccgcggtttgcagccggc

SEQ ID NO: 576032 - DNA, 25 bp, Rattus norvegicus
ctgcgctccgaggtcgtcagtacgc

SEQ ID NO: 576033 - DNA, 25 bp, Rattus norvegicus
ggttccgctgcagtccctgtttgca

SEQ ID NO: 576034 - DNA, 25 bp, Rattus norvegicus
agagcagctcgactctggagtgccc

SEQ ID NO: 576035 - DNA, 25 bp, Rattus norvegicus
cagcgccagcctgcggagagcagct

SEQ ID NO: 576036 - DNA, 25 bp, Rattus norvegicus
tctggaacccggagtggattgcttt

SEQ ID NO: 576037 - DNA, 25 bp, Rattus norvegicus
atcccttcgggcaacgcctgaggct

SEQ ID NO: 576038 - DNA, 25 bp, Rattus norvegicus
ggcgccgcaaaatccggactggagc

SEQ ID NO: 576039 - DNA, 25 bp, Rattus norvegicus
cccatgccagaggacggagctgcct

SEQ ID NO: 576040 - DNA, 25 bp, Rattus norvegicus
gacgagcggtgatgaactacttccc

SEQ ID NO: 576041 - DNA, 25 bp, Rattus norvegicus
accacgaagccaggcggcgaggact

SEQ ID NO: 576042 - DNA, 25 bp, Rattus norvegicus
ggcgaggactatgcccaggagcact

SEQ ID NO: 576043 - DNA, 25 bp, Rattus norvegicus
ctgcggcttcatggccagagccaca

SEQ ID NO: 576044 - DNA, 25 bp, Rattus norvegicus
ggactgctcggtcttcttggagctc

SEQ ID NO: 576045 - DNA, 25 bp, Rattus norvegicus
gcttcatggccagagccacacagct

SEQ ID NO: 576046 - DNA, 25 bp, Rattus norvegicus
caggactgctcggtcttcttggagc

SEQ ID NO: 576047 - DNA, 25 bp, Rattus norvegicus
cccgcccacagtgtcagtccacacc

SEQ ID NO: 576048 - DNA, 25 bp, Rattus norvegicus
cccgccctccaacagcgctccggcc

SEQ ID NO: 576049 - DNA, 25 bp, Rattus norvegicus
ccggagtgcggtgccctcatccgac

SEQ ID NO: 576050 - DNA, 25 bp, Rattus norvegicus
ctcggactaccacgcccggagtgcg

SEQ ID NO: 576051 - DNA, 25 bp, Rattus norvegicus
actggctgcccctcccgctgtagca

SEQ ID NO: 576052 - DNA, 25 bp, Rattus norvegicus
cagagccacacagctcactggctgc

SEQ ID NO: 576053 - DNA, 25 bp, Rattus norvegicus
cggcttcatggccagagccacacag

SEQ ID NO: 576054 - DNA, 25 bp, Rattus norvegicus
cggctgcggcttcatggccagagcc

SEQ ID NO: 576055 - DNA, 25 bp, Rattus norvegicus
atggtgagcggccacctgccgccct

SEQ ID NO: 576056 - DNA, 25 bp, Rattus norvegicus
ccctggcgctcggactaccacgccc

SEQ ID NO: 576057 - DNA, 25 bp, Rattus norvegicus
attgctacagtctgggtggacgtgc

SEQ ID NO: 576058 - DNA, 25 bp, Rattus norvegicus
tgtgtgtttgtatgcagaccgtgtg

SEQ ID NO: 576059 - DNA, 25 bp, Rattus norvegicus
ccctagggagaaacatgggcacaga

SEQ ID NO: 576060 - DNA, 25 bp, Rattus norvegicus
ttctgtgtgtgcacgtgagcatgtc

SEQ ID NO: 576061 - DNA, 25 bp, Rattus norvegicus
tccgagtgtccatgcgcttctgaac

SEQ ID NO: 576062 - DNA, 25 bp, Rattus norvegicus
gtccatgctcgtgtgtccgagtgtc

SEQ ID NO: 576063 - DNA, 25 bp, Rattus norvegicus
ccgagcctagcttccggttctgcgg

SEQ ID NO: 576064 - DNA, 25 bp, Rattus norvegicus
caggtgcactgcaggatgcgtgtct

SEQ ID NO: 576065 - DNA, 25 bp, Rattus norvegicus
gcgtctgctggcagtagccgccgct

SEQ ID NO: 576066 - DNA, 25 bp, Rattus norvegicus
gtttcaaggacgctaggactcaccg

SEQ ID NO: 576067 - DNA, 25 bp, Rattus norvegicus
atctccggataactgaggtgctggc

SEQ ID NO: 576068 - DNA, 25 bp, Rattus norvegicus
gacgtgcggacgtgcgtccatgctc

SEQ ID NO: 576069 - DNA, 25 bp, Rattus norvegicus
cctgcaggttgcagatctccggata

SEQ ID NO: 576070 - DNA, 25 bp, Rattus norvegicus
agaccgtgtgactgctgtgtgtaca

SEQ ID NO: 576071 - DNA, 25 bp, Rattus norvegicus
tctgcagaatactgggaagcgcgcc

SEQ ID NO: 576072 - DNA, 25 bp, Rattus norvegicus
cgggtttcagcaccaaggccagagc

SEQ ID NO: 576073 - DNA, 25 bp, Rattus norvegicus
caccagcatcgtgaatgcgcatgca

SEQ ID NO: 576074 - DNA, 25 bp, Rattus norvegicus
ggcggtactctccactcactgaaag

SEQ ID NO: 576075 - DNA, 25 bp, Rattus norvegicus
gcgcgtgaacgtgcgccagtctcta

SEQ ID NO: 576076 - DNA, 25 bp, Rattus norvegicus
ccgactcagagtaagaaggaaacct

SEQ ID NO: 576077 - DNA, 25 bp, Rattus norvegicus
taaaatctgcaacgcgtggaggctc

SEQ ID NO: 576078 - DNA, 25 bp, Rattus norvegicus
ggctccgcctctgcgagtaggaaaa

SEQ ID NO: 576079 - DNA, 25 bp, Rattus norvegicus
aacgcttttattcggacaggctccg

SEQ ID NO: 576080 - DNA, 25 bp, Rattus norvegicus
gccctagtctgtgcggcgtttccaa

SEQ ID NO: 576081 - DNA, 25 bp, Rattus norvegicus
tccaattgcagtagaaacccagtca

SEQ ID NO: 576082 - DNA, 25 bp, Rattus norvegicus
aacccagtcaggtctgcgttcgctg

SEQ ID NO: 576083 - DNA, 25 bp, Rattus norvegicus
agtcctgtccacacacatttaggca

SEQ ID NO: 576084 - DNA, 25 bp, Rattus norvegicus
aggccagagctcacatgcagacccg

SEQ ID NO: 576085 - DNA, 25 bp, Rattus norvegicus
gggccgctgtgcacggtcctgggcc

SEQ ID NO: 576086 - DNA, 25 bp, Rattus norvegicus
gacacagagcgcctcccagcccagg

SEQ ID NO: 576087 - DNA, 25 bp, Rattus norvegicus
cctcccagcccagggccgccactcg

SEQ ID NO: 576088 - DNA, 25 bp, Rattus norvegicus
ccactcgcaggagcgtgggcagcag

SEQ ID NO: 576089 - DNA, 25 bp, Rattus norvegicus
tgggcagcagcgagacaaagggctg

SEQ ID NO: 576090 - DNA, 25 bp, Rattus norvegicus
cgcgggaactttcctcgccgaggca

SEQ ID NO: 576091 - DNA, 25 bp, Rattus norvegicus
gggaactttcctcgccgaggcagcg

SEQ ID NO: 576092 - DNA, 25 bp, Rattus norvegicus
aggcagcgagcagatccggacgacc

SEQ ID NO: 576093 - DNA, 25 bp, Rattus norvegicus
cagcgagcagatccggacgacccgg

SEQ ID NO: 576094 - DNA, 25 bp, Rattus norvegicus
gagcagatccggacgacccgggttc

SEQ ID NO: 576095 - DNA, 25 bp, Rattus norvegicus
ttccggtgaggctgccgcccgtgag

SEQ ID NO: 576096 - DNA, 25 bp, Rattus norvegicus
ggcgtctgccgtccctcgcgcgccc

SEQ ID NO: 576097 - DNA, 25 bp, Rattus norvegicus
cgagccggagctacgaggagccggc

SEQ ID NO: 576098 - DNA, 25 bp, Rattus norvegicus
gaggctgctgcagggaggacacaga

SEQ ID NO: 576099 - DNA, 25 bp, Rattus norvegicus
tgggcatggccatccagaagcattt

SEQ ID NO: 576100 - DNA, 25 bp, Rattus norvegicus
tgatctgttcccgtttttgtaggcc

SEQ ID NO: 576101 - DNA, 25 bp, Rattus norvegicus
cagggccacggactcgcgacaactt

SEQ ID NO: 576102 - DNA, 25 bp, Rattus norvegicus
cggactcgcgacaacttcaccaagg

SEQ ID NO: 576103 - DNA, 25 bp, Rattus norvegicus
caacttcaccaaggcgccgtcgtgg

SEQ ID NO: 576104 - DNA, 25 bp, Rattus norvegicus
ccatgtctccgcaggacggcgcggt

SEQ ID NO: 576105 - DNA, 25 bp, Rattus norvegicus
ggccttcagcttccaggcggcgacg

SEQ ID NO: 576106 - DNA, 25 bp, Rattus norvegicus
cgtgggaagtgtacggtgcctccat

SEQ ID NO: 576107 - DNA, 25 bp, Rattus norvegicus
ccagaagcatttggagcgtcagatg

SEQ ID NO: 576108 - DNA, 25 bp, Rattus norvegicus
agaccgtgcaggctctgtgcgcacc

SEQ ID NO: 576109 - DNA, 25 bp, Rattus norvegicus
cgccaggcatcttccgcgcgctgct

SEQ ID NO: 576110 - DNA, 25 bp, Rattus norvegicus
ggacccacagccgagtgatctgttc

SEQ ID NO: 576111 - DNA, 25 bp, Rattus norvegicus
gccgagtgatctgttcccgtttttg

SEQ ID NO: 576112 - DNA, 25 bp, Rattus norvegicus
tgcgggcccagaccgtgcaggctct

SEQ ID NO: 576113 - DNA, 25 bp, Rattus norvegicus
cggcccgataggtccattgtgcgcc

SEQ ID NO: 576114 - DNA, 25 bp, Rattus norvegicus
tcgcgccaaggggaagtgtcccgac

SEQ ID NO: 576115 - DNA, 25 bp, Rattus norvegicus
agttgtagtcctcaccggcccgctt

SEQ ID NO: 576116 - DNA, 25 bp, Rattus norvegicus
tggggtctatgtcctctgaagtgtc

SEQ ID NO: 576117 - DNA, 25 bp, Rattus norvegicus
tgaagtgtccttgaaaggccacaga

SEQ ID NO: 576118 - DNA, 25 bp, Rattus norvegicus
aggccacagagtcgtatttaactta

SEQ ID NO: 576119 - DNA, 25 bp, Rattus norvegicus
actcatgccgggtcaccgaggcact

SEQ ID NO: 576120 - DNA, 25 bp, Rattus norvegicus
agacgacgttcagctcctgggtttc

SEQ ID NO: 576121 - DNA, 25 bp, Rattus norvegicus
tcgcccattgtgcacaccaagcggg

SEQ ID NO: 576122 - DNA, 25 bp, Rattus norvegicus
cgaccggcccattgctctcagtgag

SEQ ID NO: 576123 - DNA, 25 bp, Rattus norvegicus
gtagaacattcagctctggcgcgtc

SEQ ID NO: 576124 - DNA, 25 bp, Rattus norvegicus
tctctacgatggtgtggcccgacaa

SEQ ID NO: 576125 - DNA, 25 bp, Rattus norvegicus
cgacaagcccatcgcgcgcattggg

SEQ ID NO: 576126 - DNA, 25 bp, Rattus norvegicus
cactgatagcgcgacggttctacgc

SEQ ID NO: 576127 - DNA, 25 bp, Rattus norvegicus
tgagagcggtcttctcacctcggct

SEQ ID NO: 576128 - DNA, 25 bp, Rattus norvegicus
cagccgccacttcctttgttgttgc

SEQ ID NO: 576129 - DNA, 25 bp, Rattus norvegicus
gtcgggccaggcctctaacttctgt

SEQ ID NO: 576130 - DNA, 25 bp, Rattus norvegicus
aaagggccagccctcggagagcaca

SEQ ID NO: 576131 - DNA, 25 bp, Rattus norvegicus
gccgcggacagttcttaaagggcca

SEQ ID NO: 576132 - DNA, 25 bp, Rattus norvegicus
tgaatcaaaacgtggggctggttcc

SEQ ID NO: 576133 - DNA, 25 bp, Rattus norvegicus
ccgccgctccgaatgttgtgaatca

SEQ ID NO: 576134 - DNA, 25 bp, Rattus norvegicus
ggctccagccgctactgtttgcttg

SEQ ID NO: 576135 - DNA, 25 bp, Rattus norvegicus
agcctttcaagatggcgacccgcta

SEQ ID NO: 576136 - DNA, 25 bp, Rattus norvegicus
ccgcggccctaagaaggtaaccatg

SEQ ID NO: 576137 - DNA, 25 bp, Rattus norvegicus
ctcgtaggcgtcgattctgagctgc

SEQ ID NO: 576138 - DNA, 25 bp, Rattus norvegicus
ttgttgcttttgtctcacgccgagc

SEQ ID NO: 576139 - DNA, 25 bp, Rattus norvegicus
cgtcatctccgggaagtgtgcttgc

SEQ ID NO: 576140 - DNA, 25 bp, Rattus norvegicus
accatgacatgttagtgcgcgccgc

SEQ ID NO: 576141 - DNA, 25 bp, Rattus norvegicus
caggtgtaaccacttccggtctgaa

SEQ ID NO: 576142 - DNA, 25 bp, Rattus norvegicus
aaggggattttaggctcttagcaca

SEQ ID NO: 576143 - DNA, 25 bp, Rattus norvegicus
tctggcgggttaatcaggctggcaa

SEQ ID NO: 576144 - DNA, 25 bp, Rattus norvegicus
cgccgctaagggaaattaaggcagc

SEQ ID NO: 576145 - DNA, 25 bp, Rattus norvegicus
ttaaggcagctgacccactgtggtc

SEQ ID NO: 576146 - DNA, 25 bp, Rattus norvegicus
cagcgggtctgaaaatggtcccaac

SEQ ID NO: 576147 - DNA, 25 bp, Rattus norvegicus
gcggcctttgctgcaccgagaactc

SEQ ID NO: 576148 - DNA, 25 bp, Rattus norvegicus
tgccgaacaattccggaaactgccg

SEQ ID NO: 576149 - DNA, 25 bp, Rattus norvegicus
gccggaagtgatctcaggtgtaacc

SEQ ID NO: 576150 - DNA, 25 bp, Rattus norvegicus
gcgacgttctcgagtctatgccgaa

SEQ ID NO: 576151 - DNA, 25 bp, Rattus norvegicus
tgacgccaactctgcgaaggggatt

SEQ ID NO: 576152 - DNA, 25 bp, Rattus norvegicus
gatgattttgcgctcctctagggtc

SEQ ID NO: 576153 - DNA, 25 bp, Rattus norvegicus
agcttctcggtctgctcctgagtta

SEQ ID NO: 576154 - DNA, 25 bp, Rattus norvegicus
gagaactcgctgctacctgaaactg

SEQ ID NO: 576155 - DNA, 25 bp, Rattus norvegicus
gtgtccttcgggctcctccgcccaa

SEQ ID NO: 576156 - DNA, 25 bp, Rattus norvegicus
caccattcccgggtaaggggctgag

SEQ ID NO: 576157 - DNA, 25 bp, Rattus norvegicus
gtgcagcgccatcttcccagagctg

SEQ ID NO: 576158 - DNA, 25 bp, Rattus norvegicus
atgctcggcgcgctccgcttggagc

SEQ ID NO: 576159 - DNA, 25 bp, Rattus norvegicus
agcccggcgcactgacctgaaagtg

SEQ ID NO: 576160 - DNA, 25 bp, Rattus norvegicus
accgccagtgcgcttcttttgcaac

SEQ ID NO: 576161 - DNA, 25 bp, Rattus norvegicus
gtcgagcatagctcgctcctctgcg

SEQ ID NO: 576162 - DNA, 25 bp, Rattus norvegicus
actcggcggtcgagcatagctcgct

SEQ ID NO: 576163 - DNA, 25 bp, Rattus norvegicus
cgagctcaggctcccggggcgaaca

SEQ ID NO: 576164 - DNA, 25 bp, Rattus norvegicus
cgcctccggccaatgacagtcctct

SEQ ID NO: 576165 - DNA, 25 bp, Rattus norvegicus
ggctccaccaatgaggctgcgcgct

SEQ ID NO: 576166 - DNA, 25 bp, Rattus norvegicus
ccgaggctccaccaatgaggctgcg

SEQ ID NO: 576167 - DNA, 25 bp, Rattus norvegicus
ggcagacccgcatccctccagcgca

SEQ ID NO: 576168 - DNA, 25 bp, Rattus norvegicus
gacctgaaagtgcagcgccatcttc

SEQ ID NO: 576169 - DNA, 25 bp, Rattus norvegicus
aacatgcgatctttcctgggagtca

SEQ ID NO: 576170 - DNA, 25 bp, Rattus norvegicus
gccctctttggcagcgacaccgagg

SEQ ID NO: 576171 - DNA, 25 bp, Rattus norvegicus
gacctggagagcattgacatcgatc

SEQ ID NO: 576172 - DNA, 25 bp, Rattus norvegicus
agattgacgaacgtgatggcgacca

SEQ ID NO: 576173 - DNA, 25 bp, Rattus norvegicus
atggcgaccagagcaacgaagacga

SEQ ID NO: 576174 - DNA, 25 bp, Rattus norvegicus
gccgagacactcaagtcccaagatt

SEQ ID NO: 576175 - DNA, 25 bp, Rattus norvegicus
gcctcacagcaagcccaagatctgg

SEQ ID NO: 576176 - DNA, 25 bp, Rattus norvegicus
gtgcaccgcatgcagcacctcatgg

SEQ ID NO: 576177 - DNA, 25 bp, Rattus norvegicus
acgcgcgagagcacaagcacactga

SEQ ID NO: 576178 - DNA, 25 bp, Rattus norvegicus
tttctacccagccacggactgtaca

SEQ ID NO: 576179 - DNA, 25 bp, Rattus norvegicus
acggactgtacacctgccacatagg

SEQ ID NO: 576180 - DNA, 25 bp, Rattus norvegicus
gccacataggcaagttttccaactg

SEQ ID NO: 576181 - DNA, 25 bp, Rattus norvegicus
gcacagggctcgctgttgaacatgc

SEQ ID NO: 576182 - DNA, 25 bp, Rattus norvegicus
aaggaccaggaagacggcgccctct

SEQ ID NO: 576183 - DNA, 25 bp, Rattus norvegicus
cctggcccagcaggagagcgagatt

SEQ ID NO: 576184 - DNA, 25 bp, Rattus norvegicus
gccctcggccgctgacgtcaccaca

SEQ ID NO: 576185 - DNA, 25 bp, Rattus norvegicus
tgacgtcaccacattcccgccgcga

SEQ ID NO: 576186 - DNA, 25 bp, Rattus norvegicus
agccgcagtgacaggcaagcccggc

SEQ ID NO: 576187 - DNA, 25 bp, Rattus norvegicus
aggacttcggcttcttctcgtcgtc

SEQ ID NO: 576188 - DNA, 25 bp, Rattus norvegicus
ccttcctggcccagcaggagagcga

SEQ ID NO: 576189 - DNA, 25 bp, Rattus norvegicus
agagcgagattgctggcatcgagaa

SEQ ID NO: 576190 - DNA, 25 bp, Rattus norvegicus
agattgctggcatcgagaatgactc

SEQ ID NO: 576191 - DNA, 25 bp, Rattus norvegicus
tggcatcgagaatgactcgggtttc

SEQ ID NO: 576192 - DNA, 25 bp, Rattus norvegicus
catcgagaatgactcgggtttcggg

SEQ ID NO: 576193 - DNA, 25 bp, Rattus norvegicus
gtttcggggcacctgccgccagcca

SEQ ID NO: 576194 - DNA, 25 bp, Rattus norvegicus
ccgccagccaggtggcctctgcgca

SEQ ID NO: 576195 - DNA, 25 bp, Rattus norvegicus
gggaggcccagtctcgatcagaccc

SEQ ID NO: 576196 - DNA, 25 bp, Rattus norvegicus
cttcttctcgtcgtcggagagcggg

SEQ ID NO: 576197 - DNA, 25 bp, Rattus norvegicus
cgaaagcgtctgaaccggaatgctc

SEQ ID NO: 576198 - DNA, 25 bp, Rattus norvegicus
cggtcccttggcgatgtagcctatc

SEQ ID NO: 576199 - DNA, 25 bp, Rattus norvegicus
ttcaggggtccgctacatctagccc

SEQ ID NO: 576200 - DNA, 25 bp, Rattus norvegicus
aacgcgtttcgattcgtttcgctca

SEQ ID NO: 576201 - DNA, 25 bp, Rattus norvegicus
gtttcgctcatctcggcacggtcct

SEQ ID NO: 576202 - DNA, 25 bp, Rattus norvegicus
gtcctttcgtcacacctctggtctg

SEQ ID NO: 576203 - DNA, 25 bp, Rattus norvegicus
ctacgaaacagctgtcctctcggtc

SEQ ID NO: 576204 - DNA, 25 bp, Rattus norvegicus
ctctcggtcttcagttcctacagca

SEQ ID NO: 576205 - DNA, 25 bp, Rattus norvegicus
ccttctgatgaggtcaccacggggc

SEQ ID NO: 576206 - DNA, 25 bp, Rattus norvegicus
ttgctctctgggaactgtattaagt

SEQ ID NO: 576207 - DNA, 25 bp, Rattus norvegicus
tttcccaagaatccctgcgcgagct

SEQ ID NO: 576208 - DNA, 25 bp, Rattus norvegicus
ccgagactattaacacgcggctctg

SEQ ID NO: 576209 - DNA, 25 bp, Rattus norvegicus
actcggaggcagaagttcggttaca

SEQ ID NO: 576210 - DNA, 25 bp, Rattus norvegicus
ttgcgcgatgcccaaggctaaggga

SEQ ID NO: 576211 - DNA, 25 bp, Rattus norvegicus
tgccaccgaaggcagcgcgcctttt

SEQ ID NO: 576212 - DNA, 25 bp, Rattus norvegicus
tccgggcttcctagccggatgcctt

SEQ ID NO: 576213 - DNA, 25 bp, Rattus norvegicus
cagcgcgccttttgcagcgtgggaa

SEQ ID NO: 576214 - DNA, 25 bp, Rattus norvegicus
ttcctagccggatgccttgtcccgg

SEQ ID NO: 576215 - DNA, 25 bp, Rattus norvegicus
atgcatcgctcgctgccaccgaagg

SEQ ID NO: 576216 - DNA, 25 bp, Rattus norvegicus
acccagactgcagtggaagatggtg

SEQ ID NO: 576217 - DNA, 25 bp, Rattus norvegicus
ctgcactggtgcctggctggctcct

SEQ ID NO: 576218 - DNA, 25 bp, Rattus norvegicus
gagcaagaccgacccagactgcagt

SEQ ID NO: 576219 - DNA, 25 bp, Rattus norvegicus
cgccatttggccagggagcaagacc

SEQ ID NO: 576220 - DNA, 25 bp, Rattus norvegicus
ccactcgtcccactgaggtaggcgg

SEQ ID NO: 576221 - DNA, 25 bp, Rattus norvegicus
ttccagaggataaagagcaccgagc

SEQ ID NO: 576222 - DNA, 25 bp, Rattus norvegicus
actccgcgctcacagcatgcatagg

SEQ ID NO: 576223 - DNA, 25 bp, Rattus norvegicus
cccactgaggtaggcggtcagtgtc

SEQ ID NO: 576224 - DNA, 25 bp, Rattus norvegicus
ggcttggcccaaggcggatcttccg

SEQ ID NO: 576225 - DNA, 25 bp, Rattus norvegicus
cggagcctctttagtgcggaagttc

SEQ ID NO: 576226 - DNA, 25 bp, Rattus norvegicus
tggcgacagtcctccgtcggggaac

SEQ ID NO: 576227 - DNA, 25 bp, Rattus norvegicus
gcgctcagatctcggaatacaactc

SEQ ID NO: 576228 - DNA, 25 bp, Rattus norvegicus
agctctcacgatggctcggctctgc

SEQ ID NO: 576229 - DNA, 25 bp, Rattus norvegicus
ggctcggctctgctcagtccaacaa

SEQ ID NO: 576230 - DNA, 25 bp, Rattus norvegicus
tcgttccaccgtagcggggctccag

SEQ ID NO: 576231 - DNA, 25 bp, Rattus norvegicus
ctctcgagccatctggggcctcgga

SEQ ID NO: 576232 - DNA, 25 bp, Rattus norvegicus
tgagcaggtaacagaccgcggcctg

SEQ ID NO: 576233 - DNA, 25 bp, Rattus norvegicus
caaatctcgcgcgacttgcggcggc

SEQ ID NO: 576234 - DNA, 25 bp, Rattus norvegicus
ctggtttgctgtccggctgccggct

SEQ ID NO: 576235 - DNA, 25 bp, Rattus norvegicus
caacaacctctcgagccatctgggg

SEQ ID NO: 576236 - DNA, 25 bp, Rattus norvegicus
atctcggaatacaactcccagcacg

SEQ ID NO: 576237 - DNA, 25 bp, Rattus norvegicus
gaacgtccgtcgagctctcacgatg

SEQ ID NO: 576238 - DNA, 25 bp, Rattus norvegicus
ccgcggacctcttggtcaaatctcg

SEQ ID NO: 576239 - DNA, 25 bp, Rattus norvegicus
agcagtggcccgtctcgttatgtgc

SEQ ID NO: 576240 - DNA, 25 bp, Rattus norvegicus
ggatctttcgacaagactgccagcg

SEQ ID NO: 576241 - DNA, 25 bp, Rattus norvegicus
tcgtcgcttggcctcgggatctttc

SEQ ID NO: 576242 - DNA, 25 bp, Rattus norvegicus
cctggagctgcgacggtcgtcgctt

SEQ ID NO: 576243 - DNA, 25 bp, Rattus norvegicus
cagtgccaaggtgcactcggtggcc

SEQ ID NO: 576244 - DNA, 25 bp, Rattus norvegicus
agttcccggcgcacagtgccaaggt

SEQ ID NO: 576245 - DNA, 25 bp, Rattus norvegicus
acagcaagactcgtgagttcccggc

SEQ ID NO: 576246 - DNA, 25 bp, Rattus norvegicus
cgcggagcgacaaggcgcttttatc

SEQ ID NO: 576247 - DNA, 25 bp, Rattus norvegicus
aggagttgttccgaggccacagcaa

SEQ ID NO: 576248 - DNA, 25 bp, Rattus norvegicus
caaggcgcttttatcggcgcatgcg

SEQ ID NO: 576249 - DNA, 25 bp, Rattus norvegicus
ctcgttatgtgctcgggatgcagga

SEQ ID NO: 576250 - DNA, 25 bp, Rattus norvegicus
ttccggcgcgcgatccttgcggaga

SEQ ID NO: 576251 - DNA, 25 bp, Rattus norvegicus
cctcgggatctttcgacaagactgc

SEQ ID NO: 576252 - DNA, 25 bp, Rattus norvegicus
atgcaggagttgttccgaggccaca

SEQ ID NO: 576253 - DNA, 25 bp, Rattus norvegicus
cggagccagagcgtttcccctactg

SEQ ID NO: 576254 - DNA, 25 bp, Rattus norvegicus
gcggatgccgaaggcgccctccaat

SEQ ID NO: 576255 - DNA, 25 bp, Rattus norvegicus
actccgccaggcgagctgggaccga

SEQ ID NO: 576256 - DNA, 25 bp, Rattus norvegicus
cctggtgtaactccgccaggcgagc

SEQ ID NO: 576257 - DNA, 25 bp, Rattus norvegicus
agctcgcgccgctgcctggtgtaac

SEQ ID NO: 576258 - DNA, 25 bp, Rattus norvegicus
agtgcggtgtgctcagccagctcgc

SEQ ID NO: 576259 - DNA, 25 bp, Rattus norvegicus
acctggtggtcccagcaaccgtcta

SEQ ID NO: 576260 - DNA, 25 bp, Rattus norvegicus
gtggtcccagcaaccgtctaagcca

SEQ ID NO: 576261 - DNA, 25 bp, Rattus norvegicus
tggggagcccctctaaaccgcactg

SEQ ID NO: 576262 - DNA, 25 bp, Rattus norvegicus
ttcagcaccacaccgagcgggcagg

SEQ ID NO: 576263 - DNA, 25 bp, Rattus norvegicus
tgctccgagtctgcagtaccagccg

SEQ ID NO: 576264 - DNA, 25 bp, Rattus norvegicus
tgcgcatctgcccacatctgcctgc

SEQ ID NO: 576265 - DNA, 25 bp, Rattus norvegicus
aaccgtctaagccactgcagggctc

SEQ ID NO: 576266 - DNA, 25 bp, Rattus norvegicus
ccacggtcagcaccgacctggtggt

SEQ ID NO: 576267 - DNA, 25 bp, Rattus norvegicus
gtctacgaacctgttggaggctgca

SEQ ID NO: 576268 - DNA, 25 bp, Rattus norvegicus
agcgcggtctacgaacctgttggag

SEQ ID NO: 576269 - DNA, 25 bp, Rattus norvegicus
tgccgggcttagcgcgagccacacg

SEQ ID NO: 576270 - DNA, 25 bp, Rattus norvegicus
cgagacgctccctcctgccgggctt

SEQ ID NO: 576271 - DNA, 25 bp, Rattus norvegicus
cctcctcactcctccgccgagacgc

SEQ ID NO: 576272 - DNA, 25 bp, Rattus norvegicus
ttggaggctgcagttcctccgcggc

SEQ ID NO: 576273 - DNA, 25 bp, Rattus norvegicus
agcgcggaccctcggccagggtctc

SEQ ID NO: 576274 - DNA, 25 bp, Rattus norvegicus
atgccgcgtcccagtcagtccgggt

SEQ ID NO: 576275 - DNA, 25 bp, Rattus norvegicus
gggagtccccgacagggcagccttc

SEQ ID NO: 576276 - DNA, 25 bp, Rattus norvegicus
tgactaggcctgggtccagcgcgcc

SEQ ID NO: 576277 - DNA, 25 bp, Rattus norvegicus
actgcagacccaggctggggccgcg

SEQ ID NO: 576278 - DNA, 25 bp, Rattus norvegicus
taccctctctccgagtcccagctga

SEQ ID NO: 576279 - DNA, 25 bp, Rattus norvegicus
tcctccgcggccgaccagggcgccc

SEQ ID NO: 576280 - DNA, 25 bp, Rattus norvegicus
agcgagcgcggtctacgaacctgtt

SEQ ID NO: 576281 - DNA, 25 bp, Rattus norvegicus
tggctgcaccgggtcgcttaggacc

SEQ ID NO: 576282 - DNA, 25 bp, Rattus norvegicus
tcctcgttctgaaagccgctccttt

SEQ ID NO: 576283 - DNA, 25 bp, Rattus norvegicus
aactcgctcctcctcgttctgaaag

SEQ ID NO: 576284 - DNA, 25 bp, Rattus norvegicus
gttggcgagcgcctagcacccactt

SEQ ID NO: 576285 - DNA, 25 bp, Rattus norvegicus
agctgttggcgagcgcctagcaccc

SEQ ID NO: 576286 - DNA, 25 bp, Rattus norvegicus
taggaccgcgcgctcgcactggctg

SEQ ID NO: 576287 - DNA, 25 bp, Rattus norvegicus
tgcaccgggtcgcttaggaccgcgc

SEQ ID NO: 576288 - DNA, 25 bp, Rattus norvegicus
gccactggctgcaccgggtcgctta

SEQ ID NO: 576289 - DNA, 25 bp, Rattus norvegicus
tgctgtgcgccactggctgcaccgg

SEQ ID NO: 576290 - DNA, 25 bp, Rattus norvegicus
caccttaccttacctggtgctgctg

SEQ ID NO: 576291 - DNA, 25 bp, Rattus norvegicus
ggtcaccttaccttacctggtgctg

SEQ ID NO: 576292 - DNA, 25 bp, Rattus norvegicus
tcggtcaccttaccttacctggtgc

SEQ ID NO: 576293 - DNA, 25 bp, Rattus norvegicus
catcccgaggcgacgtctgccggga

SEQ ID NO: 576294 - DNA, 25 bp, Rattus norvegicus
ggtcgcttaggaccgcgcgctcgca

SEQ ID NO: 576295 - DNA, 25 bp, Rattus norvegicus
tggcagaatccaggagcgtggcctc

SEQ ID NO: 576296 - DNA, 25 bp, Rattus norvegicus
ggtgagcactctccagccggggctc

SEQ ID NO: 576297 - DNA, 25 bp, Rattus norvegicus
cgggtcacgggcttcactcgtgagt

SEQ ID NO: 576298 - DNA, 25 bp, Rattus norvegicus
cacgggcttcactcgtgagttgacc

SEQ ID NO: 576299 - DNA, 25 bp, Rattus norvegicus
tcactcgtgagttgaccgcagaagc

SEQ ID NO: 576300 - DNA, 25 bp, Rattus norvegicus
tgagttgaccgcagaagcgccctgg

SEQ ID NO: 576301 - DNA, 25 bp, Rattus norvegicus
agctggcgcagggttggcagaatcc

SEQ ID NO: 576302 - DNA, 25 bp, Rattus norvegicus
gtggcctcccagatcggtgagcact

SEQ ID NO: 576303 - DNA, 25 bp, Rattus norvegicus
agatcggtgagcactctccagccgg

SEQ ID NO: 576304 - DNA, 25 bp, Rattus norvegicus
ccctgttgcggggcactcagagaga

SEQ ID NO: 576305 - DNA, 25 bp, Rattus norvegicus
cactcagagagagcgcagcgatgcg

SEQ ID NO: 576306 - DNA, 25 bp, Rattus norvegicus
atgcgggcagtgtcttgggttagca

SEQ ID NO: 576307 - DNA, 25 bp, Rattus norvegicus
gaatccaggagcgtggcctcccaga

SEQ ID NO: 576308 - DNA, 25 bp, Rattus norvegicus
tcccagatcggtgagcactctccag

SEQ ID NO: 576309 - DNA, 25 bp, Rattus norvegicus
tcccgcctgagcaaagggacccgag

SEQ ID NO: 576310 - DNA, 25 bp, Rattus norvegicus
catgttgccggcagcgggtgcactc

SEQ ID NO: 576311 - DNA, 25 bp, Rattus norvegicus
accgacgcttgaactggcacagaca

SEQ ID NO: 576312 - DNA, 25 bp, Rattus norvegicus
ttaagtctgagctcagagaacgagg

SEQ ID NO: 576313 - DNA, 25 bp, Rattus norvegicus
actcccgcacagagggcgaaacgtg

SEQ ID NO: 576314 - DNA, 25 bp, Rattus norvegicus
gggtgcactcttgcatctcctcgcg

SEQ ID NO: 576315 - DNA, 25 bp, Rattus norvegicus
acgcgacgggcactgacccgaagta

SEQ ID NO: 576316 - DNA, 25 bp, Rattus norvegicus
attggggagcgaaatgcgcccgcaa

SEQ ID NO: 576317 - DNA, 25 bp, Rattus norvegicus
actcgagaaagggagattaagtctg

SEQ ID NO: 576318 - DNA, 25 bp, Rattus norvegicus
gacctagacttggtagactcgagaa

SEQ ID NO: 576319 - DNA, 25 bp, Rattus norvegicus
cagccgcccggcagaagaaccggga

SEQ ID NO: 576320 - DNA, 25 bp, Rattus norvegicus
ccgggctttggctgtagtctgacag

SEQ ID NO: 576321 - DNA, 25 bp, Rattus norvegicus
gaactggcacagacaagggcgtacc

SEQ ID NO: 576322 - DNA, 25 bp, Rattus norvegicus
cccataggcttcgtggagctctgcc

SEQ ID NO: 576323 - DNA, 25 bp, Rattus norvegicus
gggcacccaacctggccactggcct

SEQ ID NO: 576324 - DNA, 25 bp, Rattus norvegicus
gccactggcctctccgagggccgag

SEQ ID NO: 576325 - DNA, 25 bp, Rattus norvegicus
cctgcccgatgttggacacggggcc

SEQ ID NO: 576326 - DNA, 25 bp, Rattus norvegicus
cccgcccggccgaggctgccgagcc

SEQ ID NO: 576327 - DNA, 25 bp, Rattus norvegicus
cccgcgctcagactggatctcaggg

SEQ ID NO: 576328 - DNA, 25 bp, Rattus norvegicus
ctcagactggatctcaggggaccga

SEQ ID NO: 576329 - DNA, 25 bp, Rattus norvegicus
agactggatctcaggggaccgagta

SEQ ID NO: 576330 - DNA, 25 bp, Rattus norvegicus
gatctcaggggaccgagtaccaatc

SEQ ID NO: 576331 - DNA, 25 bp, Rattus norvegicus
ctcaggggaccgagtaccaatcatg

SEQ ID NO: 576332 - DNA, 25 bp, Rattus norvegicus
ggggaccgagtaccaatcatgaatg

SEQ ID NO: 576333 - DNA, 25 bp, Rattus norvegicus
accgagtaccaatcatgaatgaaca

SEQ ID NO: 576334 - DNA, 25 bp, Rattus norvegicus
tcatgaatgaacagcgccagggact

SEQ ID NO: 576335 - DNA, 25 bp, Rattus norvegicus
aatgaacagcgccagggactggtgc

SEQ ID NO: 576336 - DNA, 25 bp, Rattus norvegicus
caaagcctgcccgatgttggacacg

SEQ ID NO: 576337 - DNA, 25 bp, Rattus norvegicus
gaatccgaggcacagcacttcatcc

SEQ ID NO: 576338 - DNA, 25 bp, Rattus norvegicus
tcgtacacttctcggaaagcgatgc

SEQ ID NO: 576339 - DNA, 25 bp, Rattus norvegicus
gaaagcgatgctttggcgcacacgg

SEQ ID NO: 576340 - DNA, 25 bp, Rattus norvegicus
atgctttggcgcacacggttctccc

SEQ ID NO: 576341 - DNA, 25 bp, Rattus norvegicus
tgatgaatccgaggcacagcacttc

SEQ ID NO: 576342 - DNA, 25 bp, Rattus norvegicus
tgggcggtgatccacaatcggtccc

SEQ ID NO: 576343 - DNA, 25 bp, Rattus norvegicus
cctgcctgctgtgggactcgtcctt

SEQ ID NO: 576344 - DNA, 25 bp, Rattus norvegicus
gtcataaaatcgtacacttctcgga

SEQ ID NO: 576345 - DNA, 25 bp, Rattus norvegicus
gtgggactcgtccttcgatctgatc

SEQ ID NO: 576346 - DNA, 25 bp, Rattus norvegicus
ttcgatctgatctcccagctcgggt

SEQ ID NO: 576347 - DNA, 25 bp, Rattus norvegicus
gatctcccagctcgggtttctagtg

SEQ ID NO: 576348 - DNA, 25 bp, Rattus norvegicus
tttctagtgacgctctgggcggtga

SEQ ID NO: 576349 - DNA, 25 bp, Rattus norvegicus
agtgcagacgcctggggctcctccg

SEQ ID NO: 576350 - DNA, 25 bp, Rattus norvegicus
cccagttgatgaatccgaggcacag

SEQ ID NO: 576351 - DNA, 25 bp, Rattus norvegicus
gtccgagccttaggccggctcgacg

SEQ ID NO: 576352 - DNA, 25 bp, Rattus norvegicus
acctcgcgcggtgtcaaggctgcgc

SEQ ID NO: 576353 - DNA, 25 bp, Rattus norvegicus
cccgctgcgtgttggctttttaatc

SEQ ID NO: 576354 - DNA, 25 bp, Rattus norvegicus
tggctttttaatcaggcggggctgc

SEQ ID NO: 576355 - DNA, 25 bp, Rattus norvegicus
gacctcgtgtgctgtcgtcgcttta

SEQ ID NO: 576356 - DNA, 25 bp, Rattus norvegicus
tgtcgtcgctttaggccctccgggc

SEQ ID NO: 576357 - DNA, 25 bp, Rattus norvegicus
gctcctcagtgctctgagctgcttc

SEQ ID NO: 576358 - DNA, 25 bp, Rattus norvegicus
agctgcttcgctggtccgagcctta

SEQ ID NO: 576359 - DNA, 25 bp, Rattus norvegicus
gacctcagtgcacgcatggacctgc

SEQ ID NO: 576360 - DNA, 25 bp, Rattus norvegicus
atgatgcccggcgaaacgcacccgg

SEQ ID NO: 576361 - DNA, 25 bp, Rattus norvegicus
cctgcagcaggtgcgaggatccatg

SEQ ID NO: 576362 - DNA, 25 bp, Rattus norvegicus
gcgaggatccatggccgaccggttt

SEQ ID NO: 576363 - DNA, 25 bp, Rattus norvegicus
cgcagcaccatgatgcccggcgaaa

SEQ ID NO: 576364 - DNA, 25 bp, Rattus norvegicus
cggctcgacggggacctcagtgcac

SEQ ID NO: 576365 - DNA, 25 bp, Rattus norvegicus
ggcctctaacaagcggcccattaga

SEQ ID NO: 576366 - DNA, 25 bp, Rattus norvegicus
gctccacgaagggtccggctcctgt

SEQ ID NO: 576367 - DNA, 25 bp, Rattus norvegicus
ttcacgctttactaggactgccttc

SEQ ID NO: 576368 - DNA, 25 bp, Rattus norvegicus
ctgtgctaggcgcttcacgctttac

SEQ ID NO: 576369 - DNA, 25 bp, Rattus norvegicus
tgcaaacgcccaggtctgtgctagg

SEQ ID NO: 576370 - DNA, 25 bp, Rattus norvegicus
cgagagcaattaacgcggctccggc

SEQ ID NO: 576371 - DNA, 25 bp, Rattus norvegicus
tcattcctcctggagcgaggttgtc

SEQ ID NO: 576372 - DNA, 25 bp, Rattus norvegicus
tcccattagggcgaattgtcattcc

SEQ ID NO: 576373 - DNA, 25 bp, Rattus norvegicus
ggcccattagaaggaattgtcactc

SEQ ID NO: 576374 - DNA, 25 bp, Rattus norvegicus
gggttcggagaatgggcctctaaca

SEQ ID NO: 576375 - DNA, 25 bp, Rattus norvegicus
ctgcccgcttctgataccggggttc

SEQ ID NO: 576376 - DNA, 25 bp, Rattus norvegicus
gactgccttcaccttggagctcgtg

SEQ ID NO: 576377 - DNA, 25 bp, Rattus norvegicus
ttggcgcccatttgtctgcccgctt

SEQ ID NO: 576378 - DNA, 25 bp, Rattus norvegicus
gctcctgtgacttgcaggggaaacc

SEQ ID NO: 576379 - DNA, 25 bp, Rattus norvegicus
atctacagtacctgcgcgctggctg

SEQ ID NO: 576380 - DNA, 25 bp, Rattus norvegicus
cgggtgttaacaggatgatgctctt

SEQ ID NO: 576381 - DNA, 25 bp, Rattus norvegicus
cgccaattggttgagtcgagtctcc

SEQ ID NO: 576382 - DNA, 25 bp, Rattus norvegicus
ggtccgcgtcccagaatctacagta

SEQ ID NO: 576383 - DNA, 25 bp, Rattus norvegicus
gatgatgctcttgaccgccttggta

SEQ ID NO: 576384 - DNA, 25 bp, Rattus norvegicus
aagaagccgcccaaggaatcgcccg

SEQ ID NO: 576385 - DNA, 25 bp, Rattus norvegicus
tggaggcgctcatgtccgacaagaa

SEQ ID NO: 576386 - DNA, 25 bp, Rattus norvegicus
agcgcagggtcaaggtctccagcct

SEQ ID NO: 576387 - DNA, 25 bp, Rattus norvegicus
gcggtgacttgttttcgtctgatga

SEQ ID NO: 576388 - DNA, 25 bp, Rattus norvegicus
tggcttctccgtccaaaggcggtga

SEQ ID NO: 576389 - DNA, 25 bp, Rattus norvegicus
tacgcggcgcagaaagtcatggctt

SEQ ID NO: 576390 - DNA, 25 bp, Rattus norvegicus
cccaaaagttagagtcttcgcttgc

SEQ ID NO: 576391 - DNA, 25 bp, Rattus norvegicus
gagtctcccacttcccttcggagga

SEQ ID NO: 576392 - DNA, 25 bp, Rattus norvegicus
ccgccttggtatcccagtgcattga

SEQ ID NO: 576393 - DNA, 25 bp, Rattus norvegicus
gggttatcaatcacccagctggatc

SEQ ID NO: 576394 - DNA, 25 bp, Rattus norvegicus
aaatgtgcactgacaccgggcctgg

SEQ ID NO: 576395 - DNA, 25 bp, Rattus norvegicus
cctgccatcaataaatgtgcactga

SEQ ID NO: 576396 - DNA, 25 bp, Rattus norvegicus
ggcccgctccagtagcccaagagat

SEQ ID NO: 576397 - DNA, 25 bp, Rattus norvegicus
taattgctcgtggaggcccattctc

SEQ ID NO: 576398 - DNA, 25 bp, Rattus norvegicus
gtctcagcctaatcacatttaattg

SEQ ID NO: 576399 - DNA, 25 bp, Rattus norvegicus
ctggatcccgaaggtctcagcctaa

SEQ ID NO: 576400 - DNA, 25 bp, Rattus norvegicus
ggcaggaatgcagccgggttatcaa

SEQ ID NO: 576401 - DNA, 25 bp, Rattus norvegicus
agccgcccgtttgaagtcgcgagcc

SEQ ID NO: 576402 - DNA, 25 bp, Rattus norvegicus
actccgggcagaaggacagagtccg

SEQ ID NO: 576403 - DNA, 25 bp, Rattus norvegicus
tagctggcctcggaccgaccagggt

SEQ ID NO: 576404 - DNA, 25 bp, Rattus norvegicus
gcgcactcctgagtggctcagcgca

SEQ ID NO: 576405 - DNA, 25 bp, Rattus norvegicus
ccaagagatcccagccgaccaggta

SEQ ID NO: 576406 - DNA, 25 bp, Rattus norvegicus
ctgcacctggctagctggcctcgga

SEQ ID NO: 576407 - DNA, 25 bp, Rattus norvegicus
gtccgcgccgcgcaatatttgacgc

SEQ ID NO: 576408 - DNA, 25 bp, Rattus norvegicus
cgcaatatttgacgcgctgtgaccc

SEQ ID NO: 576409 - DNA, 25 bp, Rattus norvegicus
ggtgtcgctacacaaacctcaaggg

SEQ ID NO: 576410 - DNA, 25 bp, Rattus norvegicus
agggatccgcggtgctttctcctcc

SEQ ID NO: 576411 - DNA, 25 bp, Rattus norvegicus
cgctgtacgaggtgcgttcgcctcc

SEQ ID NO: 576412 - DNA, 25 bp, Rattus norvegicus
tagagacctgctccagggatccgcg

SEQ ID NO: 576413 - DNA, 25 bp, Rattus norvegicus
aggcgtcattagtccgcgccgcgca

SEQ ID NO: 576414 - DNA, 25 bp, Rattus norvegicus
cccgagtctcaaggcgtcattagtc

SEQ ID NO: 576415 - DNA, 25 bp, Rattus norvegicus
caagcgcgaggaggcccggccctat

SEQ ID NO: 576416 - DNA, 25 bp, Rattus norvegicus
cgcaacgaacaagcgcgaggaggcc

SEQ ID NO: 576417 - DNA, 25 bp, Rattus norvegicus
ggtccacgcgcaacgaacaagcgcg

SEQ ID NO: 576418 - DNA, 25 bp, Rattus norvegicus
gaacttccgtcttcacgagccggtc

SEQ ID NO: 576419 - DNA, 25 bp, Rattus norvegicus
ctgtgacccgcctgccggaagtcgg

SEQ ID NO: 576420 - DNA, 25 bp, Rattus norvegicus
cctgcgggccgaggtctagagacct

SEQ ID NO: 576421 - DNA, 25 bp, Rattus norvegicus
cgtggatgtccttaaagcggggcct

SEQ ID NO: 576422 - DNA, 25 bp, Rattus norvegicus
agatcctcacgttcagcttgtcata

SEQ ID NO: 576423 - DNA, 25 bp, Rattus norvegicus
ttgtcatacaccagcacattacggg

SEQ ID NO: 576424 - DNA, 25 bp, Rattus norvegicus
tctgcgccaccacgtgaacgaagtc

SEQ ID NO: 576425 - DNA, 25 bp, Rattus norvegicus
tcaccgtgcggtcatcgtcagtgct

SEQ ID NO: 576426 - DNA, 25 bp, Rattus norvegicus
gcgagttgcccatgagtttgtagta

SEQ ID NO: 576427 - DNA, 25 bp, Rattus norvegicus
aactttccgtacatgacggcctcgg

SEQ ID NO: 576428 - DNA, 25 bp, Rattus norvegicus
tgtcggagtcaatggagaactttcc

SEQ ID NO: 576429 - DNA, 25 bp, Rattus norvegicus
gaggaccacaccataggaccagatg

SEQ ID NO: 576430 - DNA, 25 bp, Rattus norvegicus
aggccgtagctgaagacctcccaga

SEQ ID NO: 576431 - DNA, 25 bp, Rattus norvegicus
ccacgtcctggttggagtagccaca

SEQ ID NO: 576432 - DNA, 25 bp, Rattus norvegicus
cattcgatcatgagggcgtagaccc

SEQ ID NO: 576433 - DNA, 25 bp, Rattus norvegicus
tagtaatcggcggagtacacctctc

SEQ ID NO: 576434 - DNA, 25 bp, Rattus norvegicus
ggaaactcgttccagcattcgatca

SEQ ID NO: 576435 - DNA, 25 bp, Rattus norvegicus
agcgcgcgtcgcatagaggaaagac

SEQ ID NO: 576436 - DNA, 25 bp, Rattus norvegicus
aggtcattctccaacacctcacatt

SEQ ID NO: 576437 - DNA, 25 bp, Rattus norvegicus
ggcggcacaggtcattctccaacac

SEQ ID NO: 576438 - DNA, 25 bp, Rattus norvegicus
tcctggcggcacaggtcattctcca

SEQ ID NO: 576439 - DNA, 25 bp, Rattus norvegicus
gcgatggtgtactcctggcggcaca

SEQ ID NO: 576440 - DNA, 25 bp, Rattus norvegicus
gcttcgcacttgggcagctggagcc

SEQ ID NO: 576441 - DNA, 25 bp, Rattus norvegicus
tcgggcatgggcagcgcttcgcact

SEQ ID NO: 576442 - DNA, 25 bp, Rattus norvegicus
ttcgcagcatcagggctctcgggca

SEQ ID NO: 576443 - DNA, 25 bp, Rattus norvegicus
tgcagttcgcagcatcagggctctc

SEQ ID NO: 576444 - DNA, 25 bp, Rattus norvegicus
tgcgcatgcagttcgcagcatcagg

SEQ ID NO: 576445 - DNA, 25 bp, Rattus norvegicus
gatcccgatgcgcatgcagttcgca

SEQ ID NO: 576446 - DNA, 25 bp, Rattus norvegicus
cagcctctcggcggggatcccgatg

SEQ ID NO: 576447 - DNA, 25 bp, Rattus norvegicus
gggaaactcacagcgacccagcctc

SEQ ID NO: 576448 - DNA, 25 bp, Rattus norvegicus
attcatcccggcacagctcccgcgg

SEQ ID NO: 576449 - DNA, 25 bp, Rattus norvegicus
gtgtccctcgctctgcaccgtgaat

SEQ ID NO: 576450 - DNA, 25 bp, Rattus norvegicus
gagccgcacatacagaacaccagtg

SEQ ID NO: 576451 - DNA, 25 bp, Rattus norvegicus
accagtggcggtaatggtcttcagc

SEQ ID NO: 576452 - DNA, 25 bp, Rattus norvegicus
tcttcagcccgttggtagccacgca

SEQ ID NO: 576453 - DNA, 25 bp, Rattus norvegicus
ccacgcactggtagtagcccgtgtc

SEQ ID NO: 576454 - DNA, 25 bp, Rattus norvegicus
agcccgtgtctgtcgtgtccagatc

SEQ ID NO: 576455 - DNA, 25 bp, Rattus norvegicus
tgtccagatcctggatccgcagccg

SEQ ID NO: 576456 - DNA, 25 bp, Rattus norvegicus
cagccgggagccatattctgtcttc

SEQ ID NO: 576457 - DNA, 25 bp, Rattus norvegicus
ttctgtcttccggatgatgaccctc

SEQ ID NO: 576458 - DNA, 25 bp, Rattus norvegicus
atgaccctccgtggctcctgtacga

SEQ ID NO: 576459 - DNA, 25 bp, Rattus norvegicus
ctcctgtacgacaggggcatcattc

SEQ ID NO: 576460 - DNA, 25 bp, Rattus norvegicus
ggggcatcattcttcagccaccgca

SEQ ID NO: 576461 - DNA, 25 bp, Rattus norvegicus
tctgcaccgtgaatgctatctgcta

SEQ ID NO: 576462 - DNA, 25 bp, Rattus norvegicus
tgctatctgctagcacggggcctct

SEQ ID NO: 576463 - DNA, 25 bp, Rattus norvegicus
ctgggatgcacttacaaaaagctcc

SEQ ID NO: 576464 - DNA, 25 bp, Rattus norvegicus
agactaactcagaaccgcatctgcc

SEQ ID NO: 576465 - DNA, 25 bp, Rattus norvegicus
taagagggatgcatgtgaactggaa

SEQ ID NO: 576466 - DNA, 25 bp, Rattus norvegicus
tgcatgtgaactggaaaggcggtga

SEQ ID NO: 576467 - DNA, 25 bp, Rattus norvegicus
ctgggaaagaaacgatggagtccga

SEQ ID NO: 576468 - DNA, 25 bp, Rattus norvegicus
acgatggagtccgagtcttgggaca

SEQ ID NO: 576469 - DNA, 25 bp, Rattus norvegicus
ctcgactgggatgcacttacaaaaa

SEQ ID NO: 576470 - DNA, 25 bp, Rattus norvegicus
tccgagtcttgggacacacagagca

SEQ ID NO: 576471 - DNA, 25 bp, Rattus norvegicus
tcttgggacacacagagcacgtcta

SEQ ID NO: 576472 - DNA, 25 bp, Rattus norvegicus
tgggacacacagagcacgtctacgg

SEQ ID NO: 576473 - DNA, 25 bp, Rattus norvegicus
cagagcacgtctacgggtgcacttc

SEQ ID NO: 576474 - DNA, 25 bp, Rattus norvegicus
cgtctacgggtgcacttctcgactg

SEQ ID NO: 576475 - DNA, 25 bp, Rattus norvegicus
gaaaaaagactaactcagaaccgca

SEQ ID NO: 576476 - DNA, 25 bp, Rattus norvegicus
gcacttctcgactgggatgcactta

SEQ ID NO: 576477 - DNA, 25 bp, Rattus norvegicus
cttcgttttccacaggcagcgggga

SEQ ID NO: 576478 - DNA, 25 bp, Rattus norvegicus
gcggaggtgcggaaataatctttaa

SEQ ID NO: 576479 - DNA, 25 bp, Rattus norvegicus
agcgtattgcccttcgttttccaca

SEQ ID NO: 576480 - DNA, 25 bp, Rattus norvegicus
tgaggcgccaattgctcagcccgcg

SEQ ID NO: 576481 - DNA, 25 bp, Rattus norvegicus
ttcctgggcgctctacgcgagacct

SEQ ID NO: 576482 - DNA, 25 bp, Rattus norvegicus
cgcgagaccttaggaccacattatt

SEQ ID NO: 576483 - DNA, 25 bp, Rattus norvegicus
ggaccacattattcaccgaccgtct

SEQ ID NO: 576484 - DNA, 25 bp, Rattus norvegicus
cgaccgtctcataaatctgaactta

SEQ ID NO: 576485 - DNA, 25 bp, Rattus norvegicus
gtcaccaatgacttcggttagccgc

SEQ ID NO: 576486 - DNA, 25 bp, Rattus norvegicus
ggttagccgccaccaaatgtcgtta

SEQ ID NO: 576487 - DNA, 25 bp, Rattus norvegicus
tgtcgttaaaaagggctgctgggcc

SEQ ID NO: 576488 - DNA, 25 bp, Rattus norvegicus
tccagccatataaaacacgcgctct

SEQ ID NO: 576489 - DNA, 25 bp, Rattus norvegicus
cacgcgctctaatacaacgtaaccg

SEQ ID NO: 576490 - DNA, 25 bp, Rattus norvegicus
taattagatctggagcgtattgccc

SEQ ID NO: 576491 - DNA, 25 bp, Rattus norvegicus
gcttgtccagcatccgaaactgttg

SEQ ID NO: 576492 - DNA, 25 bp, Rattus norvegicus
gaggtgtggtcttcgaacatcgatg

SEQ ID NO: 576493 - DNA, 25 bp, Rattus norvegicus
tccgagaatggagcgaaaagccagc

SEQ ID NO: 576494 - DNA, 25 bp, Rattus norvegicus
ttctaagtacaaaggtggagccttc

SEQ ID NO: 576495 - DNA, 25 bp, Rattus norvegicus
gctccagaatgtaaccggccgcgtc

SEQ ID NO: 576496 - DNA, 25 bp, Rattus norvegicus
gaaactgttgccacccaccgtcaga

SEQ ID NO: 576497 - DNA, 25 bp, Rattus norvegicus
accgtcagaggcctggaaacctggg

SEQ ID NO: 576498 - DNA, 25 bp, Rattus norvegicus
acctggggacctggatcagaaatca

SEQ ID NO: 576499 - DNA, 25 bp, Rattus norvegicus
ccctgaggggttctctgttatccgt

SEQ ID NO: 576500 - DNA, 25 bp, Rattus norvegicus
tcctgggcgccaaaaagagaggtga

SEQ ID NO: 576501 - DNA, 25 bp, Rattus norvegicus
cagcgcctcgggacttctaagtaca

SEQ ID NO: 576502 - DNA, 25 bp, Rattus norvegicus
tgttatccgttcttcgaaatcctgg

SEQ ID NO: 576503 - DNA, 25 bp, Rattus norvegicus
tcagaaactaggcacttgatgaagc

SEQ ID NO: 576504 - DNA, 25 bp, Rattus norvegicus
ggagccttcggttcatctgcttgtc

SEQ ID NO: 576505 - DNA, 25 bp, Rattus norvegicus
cggctgtgactctccgggaaacaaa

SEQ ID NO: 576506 - DNA, 25 bp, Rattus norvegicus
aaaggtgctgcacaaccgagcgagc

SEQ ID NO: 576507 - DNA, 25 bp, Rattus norvegicus
gctcctcccagttgtgccctggttg

SEQ ID NO: 576508 - DNA, 25 bp, Rattus norvegicus
tgtctccggatttcaggaaaattga

SEQ ID NO: 576509 - DNA, 25 bp, Rattus norvegicus
cccggagttctattggcaacaggta

SEQ ID NO: 576510 - DNA, 25 bp, Rattus norvegicus
cccgctattgcataatgtctccgga

SEQ ID NO: 576511 - DNA, 25 bp, Rattus norvegicus
gggactcgccaccttaaggtagctg

SEQ ID NO: 576512 - DNA, 25 bp, Rattus norvegicus
cataaacttttgctgccttggcagg

SEQ ID NO: 576513 - DNA, 25 bp, Rattus norvegicus
cgcggggcatgcattacataaactt

SEQ ID NO: 576514 - DNA, 25 bp, Rattus norvegicus
tcacggactagggagcagaaccacg

SEQ ID NO: 576515 - DNA, 25 bp, Rattus norvegicus
tactaacacacatctctcggcgcgg

SEQ ID NO: 576516 - DNA, 25 bp, Rattus norvegicus
ggcgctcggaactgacctactaaca

SEQ ID NO: 576517 - DNA, 25 bp, Rattus norvegicus
gtgcgtcccgttgcgcaacagagct

SEQ ID NO: 576518 - DNA, 25 bp, Rattus norvegicus
caacagagctctcggagtgggtccc

SEQ ID NO: 576519 - DNA, 25 bp, Rattus norvegicus
cccagctatggggtccgctcgttgt

SEQ ID NO: 576520 - DNA, 25 bp, Rattus norvegicus
gcggagggtgcagagtgctgttccc

SEQ ID NO: 576521 - DNA, 25 bp, Rattus norvegicus
agtgctgttcccagggccgggttca

SEQ ID NO: 576522 - DNA, 25 bp, Rattus norvegicus
gttcagggctcggtgggcaactttg

SEQ ID NO: 576523 - DNA, 25 bp, Rattus norvegicus
cagtgggatacccagctatggggtc

SEQ ID NO: 576524 - DNA, 25 bp, Rattus norvegicus
atacccagctatggggtccgctcgt

SEQ ID NO: 576525 - DNA, 25 bp, Rattus norvegicus
tgcaacaactcctggggtcgcccag

SEQ ID NO: 576526 - DNA, 25 bp, Rattus norvegicus
tccgctcgttgtgcggctggagcta

SEQ ID NO: 576527 - DNA, 25 bp, Rattus norvegicus
tgccaccgtcccacgtaaccgcata

SEQ ID NO: 576528 - DNA, 25 bp, Rattus norvegicus
acgtaaccgcatactgcaacaactc

SEQ ID NO: 576529 - DNA, 25 bp, Rattus norvegicus
accgcatactgcaacaactcctggg

SEQ ID NO: 576530 - DNA, 25 bp, Rattus norvegicus
gcatactgcaacaactcctggggtc

SEQ ID NO: 576531 - DNA, 25 bp, Rattus norvegicus
tactgcaacaactcctggggtcgcc

SEQ ID NO: 576532 - DNA, 25 bp, Rattus norvegicus
ggatacccagctatggggtccgctc

SEQ ID NO: 576533 - DNA, 25 bp, Rattus norvegicus
agggacctcgatccaagacgttctc

SEQ ID NO: 576534 - DNA, 25 bp, Rattus norvegicus
tagctgactccactccggagcatcg

SEQ ID NO: 576535 - DNA, 25 bp, Rattus norvegicus
gacggacacatccagtagctgactc

SEQ ID NO: 576536 - DNA, 25 bp, Rattus norvegicus
gacagcgcagcctcagacggacaca

SEQ ID NO: 576537 - DNA, 25 bp, Rattus norvegicus
cttcctgggcgcaggctccggcagt

SEQ ID NO: 576538 - DNA, 25 bp, Rattus norvegicus
cgagtttgctgcgttgcgctcgccc

SEQ ID NO: 576539 - DNA, 25 bp, Rattus norvegicus
cttgcagagccgagtttgctgcgtt

SEQ ID NO: 576540 - DNA, 25 bp, Rattus norvegicus
tcccgcattcctttgttctggcgcg

SEQ ID NO: 576541 - DNA, 25 bp, Rattus norvegicus
aagacgttctccttgggcagcgact

SEQ ID NO: 576542 - DNA, 25 bp, Rattus norvegicus
cagtggcaggcagggacctcgatcc

SEQ ID NO: 576543 - DNA, 25 bp, Rattus norvegicus
cgtaccggagatagggcaagcgcct

SEQ ID NO: 576544 - DNA, 25 bp, Rattus norvegicus
ccctcgctcacgtaccggagatagg

SEQ ID NO: 576545 - DNA, 25 bp, Rattus norvegicus
ggggctttgcggcaccaccttcctg

SEQ ID NO: 576546 - DNA, 25 bp, Rattus norvegicus
cttgggcagcgactggacgtgcctc

SEQ ID NO: 576547 - DNA, 25 bp, Rattus norvegicus
cgcccgctgtaaacatacaatatgg

SEQ ID NO: 576548 - DNA, 25 bp, Rattus norvegicus
ggccaaggcgacagacgcctgtcgt

SEQ ID NO: 576549 - DNA, 25 bp, Rattus norvegicus
acgcctgtcgtgtgcgtgcgcgtct

SEQ ID NO: 576550 - DNA, 25 bp, Rattus norvegicus
gggcgcccgctgtaaacatacaata

SEQ ID NO: 576551 - DNA, 25 bp, Rattus norvegicus
acagacgcctgtcgtgtgcgtgcgc

SEQ ID NO: 576552 - DNA, 25 bp, Rattus norvegicus
ctgtaaacatacaatatggcggcgg

SEQ ID NO: 576553 - DNA, 25 bp, Rattus norvegicus
cgtgctgcgcgcgactaggctctgc

SEQ ID NO: 576554 - DNA, 25 bp, Rattus norvegicus
tgcgcgcgactaggctctgcggcat

SEQ ID NO: 576555 - DNA, 25 bp, Rattus norvegicus
cgactaggctctgcggcatgggcta

SEQ ID NO: 576556 - DNA, 25 bp, Rattus norvegicus
gctacagctctgaggtgaaaaccga

SEQ ID NO: 576557 - DNA, 25 bp, Rattus norvegicus
tctgaggtgaaaaccgaggatgagc

SEQ ID NO: 576558 - DNA, 25 bp, Rattus norvegicus
aaaaccgaggatgagctgcgcgtgc

SEQ ID NO: 576559 - DNA, 25 bp, Rattus norvegicus
agaaccgaggtgagctgcgggcagc

SEQ ID NO: 576560 - DNA, 25 bp, Rattus norvegicus
cgcgggcgcccgctgtaaacataca

SEQ ID NO: 576561 - DNA, 25 bp, Rattus norvegicus
gaactcgaactacaacgggaccaca

SEQ ID NO: 576562 - DNA, 25 bp, Rattus norvegicus
gcggtccagcctagattagccaagg

SEQ ID NO: 576563 - DNA, 25 bp, Rattus norvegicus
aggcggattggctcctacctggcca

SEQ ID NO: 576564 - DNA, 25 bp, Rattus norvegicus
agccttgcacacacgggttcccggt

SEQ ID NO: 576565 - DNA, 25 bp, Rattus norvegicus
ccagaacccagcagggctaggcagc

SEQ ID NO: 576566 - DNA, 25 bp, Rattus norvegicus
taggcagcgcccagaacagagctgg

SEQ ID NO: 576567 - DNA, 25 bp, Rattus norvegicus
gtatggtaacacctcccagcccgaa

SEQ ID NO: 576568 - DNA, 25 bp, Rattus norvegicus
aacgggaccacacgctgaaccgagc

SEQ ID NO: 576569 - DNA, 25 bp, Rattus norvegicus
cgcagtcccggatctcaaatgcttg

SEQ ID NO: 576570 - DNA, 25 bp, Rattus norvegicus
tctcaaatgcttggggacgctgctt

SEQ ID NO: 576571 - DNA, 25 bp, Rattus norvegicus
gacccggaacttggacgggacagca

SEQ ID NO: 576572 - DNA, 25 bp, Rattus norvegicus
cccgagatccagtatggtaacacct

SEQ ID NO: 576573 - DNA, 25 bp, Rattus norvegicus
gattagccaaggtctgtcgcctgtg

SEQ ID NO: 576574 - DNA, 25 bp, Rattus norvegicus
atttcagaggcgctgggactctgca

SEQ ID NO: 576575 - DNA, 25 bp, Rattus norvegicus
agcgccctcggagggccactccaga

SEQ ID NO: 576576 - DNA, 25 bp, Rattus norvegicus
tgccagtctccatgcgcactcgagc

SEQ ID NO: 576577 - DNA, 25 bp, Rattus norvegicus
atgcgcactcgagcgccctcggagg

SEQ ID NO: 576578 - DNA, 25 bp, Rattus norvegicus
tggggccaacgtccttgccaggcct

SEQ ID NO: 576579 - DNA, 25 bp, Rattus norvegicus
aacgtccttgccaggccttcgtgtg

SEQ ID NO: 576580 - DNA, 25 bp, Rattus norvegicus
ttgccaggccttcgtgtgctagcag

SEQ ID NO: 576581 - DNA, 25 bp, Rattus norvegicus
ttcgtgtgctagcagcctctccgga

SEQ ID NO: 576582 - DNA, 25 bp, Rattus norvegicus
tgctagcagcctctccggacactgg

SEQ ID NO: 576583 - DNA, 25 bp, Rattus norvegicus
ctctccggacactggcagagtcctg

SEQ ID NO: 576584 - DNA, 25 bp, Rattus norvegicus
ccggacactggcagagtcctgggct

SEQ ID NO: 576585 - DNA, 25 bp, Rattus norvegicus
ggctcggaacaagatgtccccgctg

SEQ ID NO: 576586 - DNA, 25 bp, Rattus norvegicus
ctcctcgctctccaggcaacatcgc

SEQ ID NO: 576587 - DNA, 25 bp, Rattus norvegicus
aggcaacatcgcctgccagtctcca

SEQ ID NO: 576588 - DNA, 25 bp, Rattus norvegicus
caggccttcgtgtgctagcagcctc

SEQ ID NO: 576589 - DNA, 25 bp, Rattus norvegicus
tgcgatccacgaacagcaagttatc

SEQ ID NO: 576590 - DNA, 25 bp, Rattus norvegicus
gactggagcctgcagatttcacctc

SEQ ID NO: 576591 - DNA, 25 bp, Rattus norvegicus
tgccgcttttgtcagggtgttacca

SEQ ID NO: 576592 - DNA, 25 bp, Rattus norvegicus
agcgcccgctttctgatgcaaatga

SEQ ID NO: 576593 - DNA, 25 bp, Rattus norvegicus
cccgagcgcaagtaaagattcccaa

SEQ ID NO: 576594 - DNA, 25 bp, Rattus norvegicus
ttccagagtcattgtgcgatccacg

SEQ ID NO: 576595 - DNA, 25 bp, Rattus norvegicus
tggccacggacttcttccagagtca

SEQ ID NO: 576596 - DNA, 25 bp, Rattus norvegicus
tggctgtgctttccggaactgtatc

SEQ ID NO: 576597 - DNA, 25 bp, Rattus norvegicus
gatcgctacccgacaactctctgta

SEQ ID NO: 576598 - DNA, 25 bp, Rattus norvegicus
ctgcaaacttctatcctggaggacc

SEQ ID NO: 576599 - DNA, 25 bp, Rattus norvegicus
aatgtaataatcctggtcccgcgcc

SEQ ID NO: 576600 - DNA, 25 bp, Rattus norvegicus
ccggttccctacttctgatctggta

SEQ ID NO: 576601 - DNA, 25 bp, Rattus norvegicus
tctggcaccctagtcatgatctggc

SEQ ID NO: 576602 - DNA, 25 bp, Rattus norvegicus
tccttttatagaccggctccgcgcg

SEQ ID NO: 576603 - DNA, 25 bp, Rattus norvegicus
gggagcctctcctgtgaccctatcg

SEQ ID NO: 576604 - DNA, 25 bp, Rattus norvegicus
ctgtgaccctatcggggctcccagg

SEQ ID NO: 576605 - DNA, 25 bp, Rattus norvegicus
acaccgctaggacccggtctgcatt

SEQ ID NO: 576606 - DNA, 25 bp, Rattus norvegicus
ctctgcatttgcaccgggatccttc

SEQ ID NO: 576607 - DNA, 25 bp, Rattus norvegicus
ggctgcgttattctagaaccgcccg

SEQ ID NO: 576608 - DNA, 25 bp, Rattus norvegicus
cggatcctttctgagtccaactcgg

SEQ ID NO: 576609 - DNA, 25 bp, Rattus norvegicus
tgcaccgggatccttcggatccttt

SEQ ID NO: 576610 - DNA, 25 bp, Rattus norvegicus
acccgtagcggatcgcgactttgct

SEQ ID NO: 576611 - DNA, 25 bp, Rattus norvegicus
atcgcgactttgctggccaggccct

SEQ ID NO: 576612 - DNA, 25 bp, Rattus norvegicus
cggcttctatttcggtctcccaggc

SEQ ID NO: 576613 - DNA, 25 bp, Rattus norvegicus
ctatttcggtctcccaggccttggc

SEQ ID NO: 576614 - DNA, 25 bp, Rattus norvegicus
gtgcacttagacaggtgcggctcga

SEQ ID NO: 576615 - DNA, 25 bp, Rattus norvegicus
gcttcaaggccgtggcttcctggaa

SEQ ID NO: 576616 - DNA, 25 bp, Rattus norvegicus
ttcctggaagattcgggctgcgtta

SEQ ID NO: 576617 - DNA, 25 bp, Rattus norvegicus
gcagaacggcgaccagcccaagcca

SEQ ID NO: 576618 - DNA, 25 bp, Rattus norvegicus
ctctccgccagggacaaaccgtttg

SEQ ID NO: 576619 - DNA, 25 bp, Rattus norvegicus
acgtatcgacgagctctccgccagg

SEQ ID NO: 576620 - DNA, 25 bp, Rattus norvegicus
gagaggactcgcaacgtatcgacga

SEQ ID NO: 576621 - DNA, 25 bp, Rattus norvegicus
ccaccgatcgagaggactcgcaacg

SEQ ID NO: 576622 - DNA, 25 bp, Rattus norvegicus
gcaggacactatcaccagcaaggtc

SEQ ID NO: 576623 - DNA, 25 bp, Rattus norvegicus
ctatgaaaccgagcaggacactatc

SEQ ID NO: 576624 - DNA, 25 bp, Rattus norvegicus
ttggataccggctatgaaaccgagc

SEQ ID NO: 576625 - DNA, 25 bp, Rattus norvegicus
agccagccttggataccggctatga

SEQ ID NO: 576626 - DNA, 25 bp, Rattus norvegicus
accgtttgatgtcaagtgtgaactc

SEQ ID NO: 576627 - DNA, 25 bp, Rattus norvegicus
gatgtcaagtgtgaactcaagtttg

SEQ ID NO: 576628 - DNA, 25 bp, Rattus norvegicus
gaactcaagtttgcagactcggatg

SEQ ID NO: 576629 - DNA, 25 bp, Rattus norvegicus
aagtttgcagactcggatgccgacg

SEQ ID NO: 576630 - DNA, 25 bp, Rattus norvegicus
tccgccagggacaaaccgtttgatg

SEQ ID NO: 576631 - DNA, 25 bp, Rattus norvegicus
gtacgcagtcaaacccgcagcgcag

SEQ ID NO: 576632 - DNA, 25 bp, Rattus norvegicus
tccgggacaacaggcgttccgcctg

SEQ ID NO: 576633 - DNA, 25 bp, Rattus norvegicus
aactggaggcctgtccggagagcac

SEQ ID NO: 576634 - DNA, 25 bp, Rattus norvegicus
gcgcccagacgcgtgacactaaatc

SEQ ID NO: 576635 - DNA, 25 bp, Rattus norvegicus
agaaataccaccctcttcattcggc

SEQ ID NO: 576636 - DNA, 25 bp, Rattus norvegicus
cttcattcggccgagggtctgttca

SEQ ID NO: 576637 - DNA, 25 bp, Rattus norvegicus
ttgaatattgttcccgcgagaactc

SEQ ID NO: 576638 - DNA, 25 bp, Rattus norvegicus
ctcgggtttctcacgagatgtgttg

SEQ ID NO: 576639 - DNA, 25 bp, Rattus norvegicus
agatgtgttgtccaatccgcgcctc

SEQ ID NO: 576640 - DNA, 25 bp, Rattus norvegicus
caaacgagaggcgtgtcttgcagcg

SEQ ID NO: 576641 - DNA, 25 bp, Rattus norvegicus
gtcttgcagcgactgcgcatgtgca

SEQ ID NO: 576642 - DNA, 25 bp, Rattus norvegicus
gcatgctgcgcgacttgtgctttta

SEQ ID NO: 576643 - DNA, 25 bp, Rattus norvegicus
ccgacccggaaggaggctcctgaga

SEQ ID NO: 576644 - DNA, 25 bp, Rattus norvegicus
tgagaactcaggttccgggacaaca

SEQ ID NO: 576645 - DNA, 25 bp, Rattus norvegicus
aagtgctcggcgttgcaggcctacg

SEQ ID NO: 576646 - DNA, 25 bp, Rattus norvegicus
gcctctgccggaagtgctcggcgtt

SEQ ID NO: 576647 - DNA, 25 bp, Rattus norvegicus
tacgtcaccgaaaggcgacggaggc

SEQ ID NO: 576648 - DNA, 25 bp, Rattus norvegicus
cggcgccaggacgtacgtcaccgaa

SEQ ID NO: 576649 - DNA, 25 bp, Rattus norvegicus
acgactcggcgtttccgccttcctg

SEQ ID NO: 576650 - DNA, 25 bp, Rattus norvegicus
cggcgcgcctaaccaacgactcggc

SEQ ID NO: 576651 - DNA, 25 bp, Rattus norvegicus
agagcccgcgccgtaaaacctgcgg

SEQ ID NO: 576652 - DNA, 25 bp, Rattus norvegicus
ggccacggaagagcccgcgccgtaa

SEQ ID NO: 576653 - DNA, 25 bp, Rattus norvegicus
gaacctcaggcctggaggtcccgcg

SEQ ID NO: 576654 - DNA, 25 bp, Rattus norvegicus
gcatcacttcgctggccgaaccgtg

SEQ ID NO: 576655 - DNA, 25 bp, Rattus norvegicus
tggcctctgtggcatcacttcgctg

SEQ ID NO: 576656 - DNA, 25 bp, Rattus norvegicus
taggtggcctctgtggcatcacttc

SEQ ID NO: 576657 - DNA, 25 bp, Rattus norvegicus
atctagtggtcacgcaaggcgcgga

SEQ ID NO: 576658 - DNA, 25 bp, Rattus norvegicus
ggcgcgccatctagtggtcacgcaa

SEQ ID NO: 576659 - DNA, 25 bp, Rattus norvegicus
ctcacagcgcgtgcgcagtggttta

SEQ ID NO: 576660 - DNA, 25 bp, Rattus norvegicus
gagccaagtcgttgtgtgcctcaca

SEQ ID NO: 576661 - DNA, 25 bp, Rattus norvegicus
cgccggactatgtgagccgcttcga

SEQ ID NO: 576662 - DNA, 25 bp, Rattus norvegicus
ctaaggccggggcaacgactcgaat

SEQ ID NO: 576663 - DNA, 25 bp, Rattus norvegicus
gcccggcgatccctagctatatcga

SEQ ID NO: 576664 - DNA, 25 bp, Rattus norvegicus
attggctagccctacagcgaggagc

SEQ ID NO: 576665 - DNA, 25 bp, Rattus norvegicus
tgctcaccggtactcgtagtgctcg

SEQ ID NO: 576666 - DNA, 25 bp, Rattus norvegicus
gccgccgattggacgaaaccactga

SEQ ID NO: 576667 - DNA, 25 bp, Rattus norvegicus
agtgctcgtcgaagtacttgtctga

SEQ ID NO: 576668 - DNA, 25 bp, Rattus norvegicus
aggcccaacgctctggatttgaatc

SEQ ID NO: 576669 - DNA, 25 bp, Rattus norvegicus
tagtagatctgcttgtgggccatcc

SEQ ID NO: 576670 - DNA, 25 bp, Rattus norvegicus
ctgctggcgtgcgaaggaaaaaacc

SEQ ID NO: 576671 - DNA, 25 bp, Rattus norvegicus
tccgctcagacctcgaggacaggta

SEQ ID NO: 576672 - DNA, 25 bp, Rattus norvegicus
atttgaatccgacagccggccgccg

SEQ ID NO: 576673 - DNA, 25 bp, Rattus norvegicus
ccatcagcggcaactatgacttttg

SEQ ID NO: 576674 - DNA, 25 bp, Rattus norvegicus
gggtaacccgagcacacagctaggc

SEQ ID NO: 576675 - DNA, 25 bp, Rattus norvegicus
ctatgtggtcaaggtgggtaacccg

SEQ ID NO: 576676 - DNA, 25 bp, Rattus norvegicus
ggtcgggagtcacctatgtggtcaa

SEQ ID NO: 576677 - DNA, 25 bp, Rattus norvegicus
cagcatgagcgccaccaggaagagc

SEQ ID NO: 576678 - DNA, 25 bp, Rattus norvegicus
gctccacaaggtgtcccacttgaaa

SEQ ID NO: 576679 - DNA, 25 bp, Rattus norvegicus
ctgggccacctgctccacaaggtgt

SEQ ID NO: 576680 - DNA, 25 bp, Rattus norvegicus
tcggtgacatcggtcgatgaccttc

SEQ ID NO: 576681 - DNA, 25 bp, Rattus norvegicus
ccgcttcaggaatgactcggtgaca

SEQ ID NO: 576682 - DNA, 25 bp, Rattus norvegicus
acgcaccaagtacaaccgcttcagg

SEQ ID NO: 576683 - DNA, 25 bp, Rattus norvegicus
cgagcccacggaggggcatgcttcc

SEQ ID NO: 576684 - DNA, 25 bp, Rattus norvegicus
tccctctccgaaaaggctgtcctgg

SEQ ID NO: 576685 - DNA, 25 bp, Rattus norvegicus
gctctgctgccttgtaacggtgaaa

SEQ ID NO: 576686 - DNA, 25 bp, Rattus norvegicus
cttgtaacggtgaaagggctcgatc

SEQ ID NO: 576687 - DNA, 25 bp, Rattus norvegicus
accggaccgtcactcacagcttctg

SEQ ID NO: 576688 - DNA, 25 bp, Rattus norvegicus
ccgtttcttcgaaggctgggcctcg

SEQ ID NO: 576689 - DNA, 25 bp, Rattus norvegicus
tcgggttccagtgttcgcccgcttc

SEQ ID NO: 576690 - DNA, 25 bp, Rattus norvegicus
agcgactcgggttccagtgttcgcc

SEQ ID NO: 576691 - DNA, 25 bp, Rattus norvegicus
ttagccacagctcccagcgactcgg

SEQ ID NO: 576692 - DNA, 25 bp, Rattus norvegicus
gatggtcaaacttctccgccatcgc

SEQ ID NO: 576693 - DNA, 25 bp, Rattus norvegicus
gctcctctagatggtcaaacttctc

SEQ ID NO: 576694 - DNA, 25 bp, Rattus norvegicus
ccaggtgctcctctagatggtcaaa

SEQ ID NO: 576695 - DNA, 25 bp, Rattus norvegicus
gaacttctccaggtgctcctctaga

SEQ ID NO: 576696 - DNA, 25 bp, Rattus norvegicus
tgttctccacgaacttctccaggtg

SEQ ID NO: 576697 - DNA, 25 bp, Rattus norvegicus
gccgagctgccgaatgttctccacg

SEQ ID NO: 576698 - DNA, 25 bp, Rattus norvegicus
cgatgatgccgagctgccgaatgtt

SEQ ID NO: 576699 - DNA, 25 bp, Rattus norvegicus
gttggaagtcgctgacgatgatgcc

SEQ ID NO: 576700 - DNA, 25 bp, Rattus norvegicus
cccacttccgtttcttcgaaggctg

SEQ ID NO: 576701 - DNA, 25 bp, Rattus norvegicus
acccgcgactctggattgtgtagcc

SEQ ID NO: 576702 - DNA, 25 bp, Rattus norvegicus
cactgtggtgcctggatttggttaa

SEQ ID NO: 576703 - DNA, 25 bp, Rattus norvegicus
acctcgttctgcaaggctcatctgg

SEQ ID NO: 576704 - DNA, 25 bp, Rattus norvegicus
tggttgcatgctgccaccgctaagt

SEQ ID NO: 576705 - DNA, 25 bp, Rattus norvegicus
ccgctaagtctcagctaaggctcca

SEQ ID NO: 576706 - DNA, 25 bp, Rattus norvegicus
taaggctccagtttaggggctcctc

SEQ ID NO: 576707 - DNA, 25 bp, Rattus norvegicus
ggcctcaggtttctctctggctaag

SEQ ID NO: 576708 - DNA, 25 bp, Rattus norvegicus
tggctaagcttgtccagccgcctcg

SEQ ID NO: 576709 - DNA, 25 bp, Rattus norvegicus
cctgaacttgctcgcccagattctg

SEQ ID NO: 576710 - DNA, 25 bp, Rattus norvegicus
cccagaggatccgaaggcaaacttt

SEQ ID NO: 576711 - DNA, 25 bp, Rattus norvegicus
aagcttcagagcttctgcgggctgg

SEQ ID NO: 576712 - DNA, 25 bp, Rattus norvegicus
tgcgggctggttcccatttacgtac

SEQ ID NO: 576713 - DNA, 25 bp, Rattus norvegicus
agtctttctgccagtccgctgcatc

SEQ ID NO: 576714 - DNA, 25 bp, Rattus norvegicus
ctcgcgagctcaaatcactgtggtg

SEQ ID NO: 576715 - DNA, 25 bp, Rattus norvegicus
accagctccgtgtagaagtcgcaga

SEQ ID NO: 576716 - DNA, 25 bp, Rattus norvegicus
gcgcatgaaacagcagctcggtgca

SEQ ID NO: 576717 - DNA, 25 bp, Rattus norvegicus
tgaaacagcagctcggtgcaggaga

SEQ ID NO: 576718 - DNA, 25 bp, Rattus norvegicus
aatgccagccaggagccgtgcagct

SEQ ID NO: 576719 - DNA, 25 bp, Rattus norvegicus
tgcagctcgcgcatgaagtccagca

SEQ ID NO: 576720 - DNA, 25 bp, Rattus norvegicus
aagtccagcatctcttcggcgctgc

SEQ ID NO: 576721 - DNA, 25 bp, Rattus norvegicus
tcgctcaccagctccgtgtagaagt

SEQ ID NO: 576722 - DNA, 25 bp, Rattus norvegicus
gcgcaccggcctgcggcaaagtaca

SEQ ID NO: 576723 - DNA, 25 bp, Rattus norvegicus
tgcggcaaagtacagagctaccacc

SEQ ID NO: 576724 - DNA, 25 bp, Rattus norvegicus
agagctaccaccttgttctgcagcg

SEQ ID NO: 576725 - DNA, 25 bp, Rattus norvegicus
cgcacggccacctgtcagcaggaag

SEQ ID NO: 576726 - DNA, 25 bp, Rattus norvegicus
cttcctctagagcagcgcgccgtga

SEQ ID NO: 576727 - DNA, 25 bp, Rattus norvegicus
agggagcgcagtggccactccagcc

SEQ ID NO: 576728 - DNA, 25 bp, Rattus norvegicus
cacgaaaaccacctcgaagggtgcg

SEQ ID NO: 576729 - DNA, 25 bp, Rattus norvegicus
cgtggatgactgaagccatttctca

SEQ ID NO: 576730 - DNA, 25 bp, Rattus norvegicus
ccacataatgtgatgccccaggacg

SEQ ID NO: 576731 - DNA, 25 bp, Rattus norvegicus
atcgtcccacgagccaccatcaggg

SEQ ID NO: 576732 - DNA, 25 bp, Rattus norvegicus
aggcagggcgtcaccgcggtgaccc

SEQ ID NO: 576733 - DNA, 25 bp, Rattus norvegicus
atctatccggcgcattcagggaggc

SEQ ID NO: 576734 - DNA, 25 bp, Rattus norvegicus
gtatccgcaccgcacatctatccgg

SEQ ID NO: 576735 - DNA, 25 bp, Rattus norvegicus
ggcgctacgcagtatccgcaccgca

SEQ ID NO: 576736 - DNA, 25 bp, Rattus norvegicus
aacgcaccatccgtgcaggaagccg

SEQ ID NO: 576737 - DNA, 25 bp, Rattus norvegicus
aaaggcccagaacgcaccatccgtg

SEQ ID NO: 576738 - DNA, 25 bp, Rattus norvegicus
actgaagccatttctcaacccgaca

SEQ ID NO: 576739 - DNA, 25 bp, Rattus norvegicus
cgacgtggatgactgaagccatttc

SEQ ID NO: 576740 - DNA, 25 bp, Rattus norvegicus
atgcaacgacgtggatgactgaagc

SEQ ID NO: 576741 - DNA, 25 bp, Rattus norvegicus
tcagggaggcaaacccaaggtcaca

SEQ ID NO: 576742 - DNA, 25 bp, Rattus norvegicus
ccggcgcattcagggaggcaaaccc

SEQ ID NO: 576743 - DNA, 25 bp, Rattus norvegicus
tcgcgaggctgcaagccaggacttc

SEQ ID NO: 576744 - DNA, 25 bp, Rattus norvegicus
cttgaagacacaccgccttactgca

SEQ ID NO: 576745 - DNA, 25 bp, Rattus norvegicus
gccgaggaactaggctcagcttgca

SEQ ID NO: 576746 - DNA, 25 bp, Rattus norvegicus
ttccaggaaccgtcctgcctctttg

SEQ ID NO: 576747 - DNA, 25 bp, Rattus norvegicus
tgtcctgggaccttacgtctgtctc

SEQ ID NO: 576748 - DNA, 25 bp, Rattus norvegicus
aggacttcccacgatcgcacgtcaa

SEQ ID NO: 576749 - DNA, 25 bp, Rattus norvegicus
tcagcttgcaaagctcagggcctcc

SEQ ID NO: 576750 - DNA, 25 bp, Rattus norvegicus
gctgcagccgctattctagatctca

SEQ ID NO: 576751 - DNA, 25 bp, Rattus norvegicus
atgcatgaggctcggtcacatgacc

SEQ ID NO: 576752 - DNA, 25 bp, Rattus norvegicus
ggtcacatgaccttgcgcagcgcag

SEQ ID NO: 576753 - DNA, 25 bp, Rattus norvegicus
tcgtcactgcggagcagcagctttg

SEQ ID NO: 576754 - DNA, 25 bp, Rattus norvegicus
gctgcaggacgcgagccctttaaaa

SEQ ID NO: 576755 - DNA, 25 bp, Rattus norvegicus
aacgggcgttggcatttactcttca

SEQ ID NO: 576756 - DNA, 25 bp, Rattus norvegicus
cgggccctcttagaagcggaacagg

SEQ ID NO: 576757 - DNA, 25 bp, Rattus norvegicus
ccgtccttctcgacaggtgccggga

SEQ ID NO: 576758 - DNA, 25 bp, Rattus norvegicus
ggtctgcttaggtttagctgccgca

SEQ ID NO: 576759 - DNA, 25 bp, Rattus norvegicus
tgccgcaaccgccaccgtcactccg

SEQ ID NO: 576760 - DNA, 25 bp, Rattus norvegicus
ttaggtttagctgccgcaaccgcca

SEQ ID NO: 576761 - DNA, 25 bp, Rattus norvegicus
tgcttaggtttagctgccgcaaccg

SEQ ID NO: 576762 - DNA, 25 bp, Rattus norvegicus
cggttgggtctgcttaggtttagct

SEQ ID NO: 576763 - DNA, 25 bp, Rattus norvegicus
gtccttctcgacaggtgccgggacc

SEQ ID NO: 576764 - DNA, 25 bp, Rattus norvegicus
tggctctgtccacaaagggtcctcg

SEQ ID NO: 576765 - DNA, 25 bp, Rattus norvegicus
gctctgtccacaaagggtcctcgat

SEQ ID NO: 576766 - DNA, 25 bp, Rattus norvegicus
atcttcggaggtgccgaagggcctg

SEQ ID NO: 576767 - DNA, 25 bp, Rattus norvegicus
tctgtccacaaagggtcctcgatct

SEQ ID NO: 576768 - DNA, 25 bp, Rattus norvegicus
ggggtagatcttcggaggtgccgaa

SEQ ID NO: 576769 - DNA, 25 bp, Rattus norvegicus
tctgcttaggtttagctgccgcaac

SEQ ID NO: 576770 - DNA, 25 bp, Rattus norvegicus
gcctgccgacggttgggtctgctta

SEQ ID NO: 576771 - DNA, 25 bp, Rattus norvegicus
agcttggcccgcacgaactgcagca

SEQ ID NO: 576772 - DNA, 25 bp, Rattus norvegicus
gcgggcttctctaacggtggaggaa

SEQ ID NO: 576773 - DNA, 25 bp, Rattus norvegicus
catgtgggcgggcttctctaacggt

SEQ ID NO: 576774 - DNA, 25 bp, Rattus norvegicus
gatggcgctgcagcttggcccgcac

SEQ ID NO: 576775 - DNA, 25 bp, Rattus norvegicus
ttggcccgcacgaactgcagcacgt

SEQ ID NO: 576776 - DNA, 25 bp, Rattus norvegicus
acgaactgcagcacgtcttctcctt

SEQ ID NO: 576777 - DNA, 25 bp, Rattus norvegicus
ttctcctccaggaattggcttggcg

SEQ ID NO: 576778 - DNA, 25 bp, Rattus norvegicus
ctgcagcacgtcttctccttcctgg

SEQ ID NO: 576779 - DNA, 25 bp, Rattus norvegicus
ctgctgcgcgctgcgcaggtgaaca

SEQ ID NO: 576780 - DNA, 25 bp, Rattus norvegicus
gcgcaggtgaacaaggtgaggtccc

SEQ ID NO: 576781 - DNA, 25 bp, Rattus norvegicus
cgaagggcttctcctccaggaattg

SEQ ID NO: 576782 - DNA, 25 bp, Rattus norvegicus
ggcttctcctccaggaattggcttg

SEQ ID NO: 576783 - DNA, 25 bp, Rattus norvegicus
ctcctccaggaattggcttggcggg

SEQ ID NO: 576784 - DNA, 25 bp, Rattus norvegicus
gcgtggcaagcaggatggcgctgca

SEQ ID NO: 576785 - DNA, 25 bp, Rattus norvegicus
gagccctaacagtatagggaggttc

SEQ ID NO: 576786 - DNA, 25 bp, Rattus norvegicus
atgtcgagcctgaccttgcctgcga

SEQ ID NO: 576787 - DNA, 25 bp, Rattus norvegicus
tgcctgcgaccacaggcttgacctt

SEQ ID NO: 576788 - DNA, 25 bp, Rattus norvegicus
tagcgacaatcaccgctccgaagtc

SEQ ID NO: 576789 - DNA, 25 bp, Rattus norvegicus
cgagcaaagaacgactagagcccta

SEQ ID NO: 576790 - DNA, 25 bp, Rattus norvegicus
ccacggggagcatgtaatgtcggaa

SEQ ID NO: 576791 - DNA, 25 bp, Rattus norvegicus
ttgcgcggcgcctcgcttatggcgc

SEQ ID NO: 576792 - DNA, 25 bp, Rattus norvegicus
caagttcacctgcaggtgaggctac

SEQ ID NO: 576793 - DNA, 25 bp, Rattus norvegicus
ctgcaggtgaggctaccgggactca

SEQ ID NO: 576794 - DNA, 25 bp, Rattus norvegicus
ggttgtacaccttcggggatgtcga

SEQ ID NO: 576795 - DNA, 25 bp, Rattus norvegicus
aggcttgaccttgccgacagccgcg

SEQ ID NO: 576796 - DNA, 25 bp, Rattus norvegicus
ccactgtcctagttccgcgtagaga

SEQ ID NO: 576797 - DNA, 25 bp, Rattus norvegicus
gaccagagcactagcgacaatcacc

SEQ ID NO: 576798 - DNA, 25 bp, Rattus norvegicus
tcaccgctccgaagtcgagcaaaga

SEQ ID NO: 576799 - DNA, 25 bp, Rattus norvegicus
ttctggttcgactcgaagttggaga

SEQ ID NO: 576800 - DNA, 25 bp, Rattus norvegicus
tgtaatcggtcaacaatcgacacgg

SEQ ID NO: 576801 - DNA, 25 bp, Rattus norvegicus
cggcacgtcacgcaccttgtaattc

SEQ ID NO: 576802 - DNA, 25 bp, Rattus norvegicus
accttgtaattctggttcgactcga

SEQ ID NO: 576803 - DNA, 25 bp, Rattus norvegicus
gtcaacaatcgacacggactacgcc

SEQ ID NO: 576804 - DNA, 25 bp, Rattus norvegicus
ctcgaagttggagagtggagttcca

SEQ ID NO: 576805 - DNA, 25 bp, Rattus norvegicus
ggaacagtcaccttaattgtaatcg

SEQ ID NO: 576806 - DNA, 25 bp, Rattus norvegicus
atgatggcaacaacggggaacagtc

SEQ ID NO: 576807 - DNA, 25 bp, Rattus norvegicus
ggcaccaccagccatgatggcaaca

SEQ ID NO: 576808 - DNA, 25 bp, Rattus norvegicus
agcactccttcaggacaggcaccgg

SEQ ID NO: 576809 - DNA, 25 bp, Rattus norvegicus
ctgtaccgtcagcactccttcagga

SEQ ID NO: 576810 - DNA, 25 bp, Rattus norvegicus
ggcgagtggctgtaccgtcagcact

SEQ ID NO: 576811 - DNA, 25 bp, Rattus norvegicus
agcacagcctccacgcggcgagtgg

SEQ ID NO: 576812 - DNA, 25 bp, Rattus norvegicus
cggactacgccagggctcggcacgt

SEQ ID NO: 576813 - DNA, 25 bp, Rattus norvegicus
gggaaccctgaggtgagcaagctca

SEQ ID NO: 576814 - DNA, 25 bp, Rattus norvegicus
caatactgacagtgccaggctcaac

SEQ ID NO: 576815 - DNA, 25 bp, Rattus norvegicus
attggtccgtacataactgcagagc

SEQ ID NO: 576816 - DNA, 25 bp, Rattus norvegicus
caaacaacacgtgcggcgattggtc

SEQ ID NO: 576817 - DNA, 25 bp, Rattus norvegicus
gcagctcactcacggaaggaatcag

SEQ ID NO: 576818 - DNA, 25 bp, Rattus norvegicus
cgtctggaggtgatgcaatactgac

SEQ ID NO: 576819 - DNA, 25 bp, Rattus norvegicus
cgtgctcctttttcaccgcctggtg

SEQ ID NO: 576820 - DNA, 25 bp, Rattus norvegicus
gcgtacaatgtccaacacccacaaa

SEQ ID NO: 576821 - DNA, 25 bp, Rattus norvegicus
acagatagttacaccggcaggcctc

SEQ ID NO: 576822 - DNA, 25 bp, Rattus norvegicus
caagctcaggttgcagactgcgacc

SEQ ID NO: 576823 - DNA, 25 bp, Rattus norvegicus
actgcgaccacgttccgcgtctgga

SEQ ID NO: 576824 - DNA, 25 bp, Rattus norvegicus
cgcgccgtccaatcagcgtacaatg

SEQ ID NO: 576825 - DNA, 25 bp, Rattus norvegicus
cctggtgctatccacagatagttac

SEQ ID NO: 576826 - DNA, 25 bp, Rattus norvegicus
cggaaggaatcagcgtgctcctttt

SEQ ID NO: 576827 - DNA, 25 bp, Rattus norvegicus
gctctagaggttcccagactgctga

SEQ ID NO: 576828 - DNA, 25 bp, Rattus norvegicus
gtcgttggagcttggaacgaaccaa

SEQ ID NO: 576829 - DNA, 25 bp, Rattus norvegicus
gaaccaactctcagaagcgtcggga

SEQ ID NO: 576830 - DNA, 25 bp, Rattus norvegicus
cgtcgggagcgtctagacactttct

SEQ ID NO: 576831 - DNA, 25 bp, Rattus norvegicus
actttctgagggacgtaaggctctg

SEQ ID NO: 576832 - DNA, 25 bp, Rattus norvegicus
ctctggaacgttgtttgaggcagta

SEQ ID NO: 576833 - DNA, 25 bp, Rattus norvegicus
gccgcttgaagcgtccagctctaga

SEQ ID NO: 576834 - DNA, 25 bp, Rattus norvegicus
gctccttgctggtagccatggatcc

SEQ ID NO: 576835 - DNA, 25 bp, Rattus norvegicus
ccatggatccggagacccgcgaact

SEQ ID NO: 576836 - DNA, 25 bp, Rattus norvegicus
agacccgcgaactgcgcgccttgga

SEQ ID NO: 576837 - DNA, 25 bp, Rattus norvegicus
gtcgcagcgctgcagcgagaatgca

SEQ ID NO: 576838 - DNA, 25 bp, Rattus norvegicus
tcgaggagaagacctccggagcctg

SEQ ID NO: 576839 - DNA, 25 bp, Rattus norvegicus
agcctggtacgtggctcgggttcat

SEQ ID NO: 576840 - DNA, 25 bp, Rattus norvegicus
gcgagttctcgaatggtccgcgccc

SEQ ID NO: 576841 - DNA, 25 bp, Rattus norvegicus
gcgaggtcacctcacctgggagttt

SEQ ID NO: 576842 - DNA, 25 bp, Rattus norvegicus
gcgtgggccaccacaaggctcttgt

SEQ ID NO: 576843 - DNA, 25 bp, Rattus norvegicus
ccactgctgaatcgttgtaggactg

SEQ ID NO: 576844 - DNA, 25 bp, Rattus norvegicus
agagcctatgggtggtgttcacacc

SEQ ID NO: 576845 - DNA, 25 bp, Rattus norvegicus
tcactggcctcgctccggcaaagag

SEQ ID NO: 576846 - DNA, 25 bp, Rattus norvegicus
tagaatgggatgcaccgtcactggc

SEQ ID NO: 576847 - DNA, 25 bp, Rattus norvegicus
tgagccttcgcttacatctgtagaa

SEQ ID NO: 576848 - DNA, 25 bp, Rattus norvegicus
cgcgcggtcttaggaccactgctga

SEQ ID NO: 576849 - DNA, 25 bp, Rattus norvegicus
tcacttccgaaacgagcacttggga

SEQ ID NO: 576850 - DNA, 25 bp, Rattus norvegicus
tgtgctggcagagtgactcacttcc

SEQ ID NO: 576851 - DNA, 25 bp, Rattus norvegicus
caacttgcagtctaggagcgccgga

SEQ ID NO: 576852 - DNA, 25 bp, Rattus norvegicus
tgttgccttcgccatggtaactcca

SEQ ID NO: 576853 - DNA, 25 bp, Rattus norvegicus
tcacgacccggactggaaggtacta

SEQ ID NO: 576854 - DNA, 25 bp, Rattus norvegicus
gcagtctgaagaaaagcgcctgtca

SEQ ID NO: 576855 - DNA, 25 bp, Rattus norvegicus
ggctcattcgcctgcacaaccggga

SEQ ID NO: 576856 - DNA, 25 bp, Rattus norvegicus
aaatgagaacctcttcgactggaac

SEQ ID NO: 576857 - DNA, 25 bp, Rattus norvegicus
tcggtggagctggtaaatgagaacc

SEQ ID NO: 576858 - DNA, 25 bp, Rattus norvegicus
agcgaccgcttcatctcggtggagc

SEQ ID NO: 576859 - DNA, 25 bp, Rattus norvegicus
ctcatgaaggagctccaggacatcg

SEQ ID NO: 576860 - DNA, 25 bp, Rattus norvegicus
cagagcgcatcgctgcgcggcaaag

SEQ ID NO: 576861 - DNA, 25 bp, Rattus norvegicus
ggccacgctgctccgtaaaatcggg

SEQ ID NO: 576862 - DNA, 25 bp, Rattus norvegicus
agccgagcctaagatggccacgctg

SEQ ID NO: 576863 - DNA, 25 bp, Rattus norvegicus
cgtcccagctatccggctcggggat

SEQ ID NO: 576864 - DNA, 25 bp, Rattus norvegicus
acccgtcatatgacagcggcgacgc

SEQ ID NO: 576865 - DNA, 25 bp, Rattus norvegicus
cccttgccggagaagacccgtcata

SEQ ID NO: 576866 - DNA, 25 bp, Rattus norvegicus
ggccgcgcacaaaggaccacggaca

SEQ ID NO: 576867 - DNA, 25 bp, Rattus norvegicus
ggtgcagcttttagactccgggcca

SEQ ID NO: 576868 - DNA, 25 bp, Rattus norvegicus
aagagcggtggccacaagcagcagc

SEQ ID NO: 576869 - DNA, 25 bp, Rattus norvegicus
cagaatgccgccctctgtgcgttag

SEQ ID NO: 576870 - DNA, 25 bp, Rattus norvegicus
ttctcgctgcagaacacctggttgg

SEQ ID NO: 576871 - DNA, 25 bp, Rattus norvegicus
acaggcgcaggtgtgacttacgctc

SEQ ID NO: 576872 - DNA, 25 bp, Rattus norvegicus
cctctgtgcgttagtcacgttaaga

SEQ ID NO: 576873 - DNA, 25 bp, Rattus norvegicus
tcacgttaagactggcctagcactg

SEQ ID NO: 576874 - DNA, 25 bp, Rattus norvegicus
taagactggcctagcactgctgtcc

SEQ ID NO: 576875 - DNA, 25 bp, Rattus norvegicus
tagcactgctgtcccgctgctgcag

SEQ ID NO: 576876 - DNA, 25 bp, Rattus norvegicus
ctgcagctgggttagttgaggtgaa

SEQ ID NO: 576877 - DNA, 25 bp, Rattus norvegicus
cccacggccctaatcacagtaaatg

SEQ ID NO: 576878 - DNA, 25 bp, Rattus norvegicus
acggccctaatcacagtaaatgctg

SEQ ID NO: 576879 - DNA, 25 bp, Rattus norvegicus
cagtaaatgctgtgcttctcgctgc

SEQ ID NO: 576880 - DNA, 25 bp, Rattus norvegicus
cctctcgctggcacaggcgcaggtg

SEQ ID NO: 576881 - DNA, 25 bp, Rattus norvegicus
cgccctctgtgcgttagtcacgtta

SEQ ID NO: 576882 - DNA, 25 bp, Rattus norvegicus
cgctgcagaacacctggttggccag

SEQ ID NO: 576883 - DNA, 25 bp, Rattus norvegicus
cagccttgtgctcctatcctttcta

SEQ ID NO: 576884 - DNA, 25 bp, Rattus norvegicus
atactcggccgcctggatcttctca

SEQ ID NO: 576885 - DNA, 25 bp, Rattus norvegicus
atcttctcacgcgtggtttcggcca

SEQ ID NO: 576886 - DNA, 25 bp, Rattus norvegicus
agctcgtgggacagtcgcttcacct

SEQ ID NO: 576887 - DNA, 25 bp, Rattus norvegicus
gggctgcagtcccactgagcatgga

SEQ ID NO: 576888 - DNA, 25 bp, Rattus norvegicus
gcccacctggtctgaggctgtgatt

SEQ ID NO: 576889 - DNA, 25 bp, Rattus norvegicus
agctacgtctcccttagcattgtgg

SEQ ID NO: 576890 - DNA, 25 bp, Rattus norvegicus
tgtagtcctactgtgcgctcactgc

SEQ ID NO: 576891 - DNA, 25 bp, Rattus norvegicus
tcactgcttggcctgttgtgtgccg

SEQ ID NO: 576892 - DNA, 25 bp, Rattus norvegicus
gcgcgcgctctatgcgggatttgaa

SEQ ID NO: 576893 - DNA, 25 bp, Rattus norvegicus
ggcgccgctgacgtgacagcagtaa

SEQ ID NO: 576894 - DNA, 25 bp, Rattus norvegicus
gctgtggagactacgaataagattc

SEQ ID NO: 576895 - DNA, 25 bp, Rattus norvegicus
cgtcctacaacgtcagagcctggtt

SEQ ID NO: 576896 - DNA, 25 bp, Rattus norvegicus
gcctgcctggcttcaatcggtgatt

SEQ ID NO: 576897 - DNA, 25 bp, Rattus norvegicus
ggcgtgcatcgcaccgccaggatct

SEQ ID NO: 576898 - DNA, 25 bp, Rattus norvegicus
accgcaagtcgtaggcaggacccga

SEQ ID NO: 576899 - DNA, 25 bp, Rattus norvegicus
agtcccagacgcctgcggaagttgg

SEQ ID NO: 576900 - DNA, 25 bp, Rattus norvegicus
cgtttgcagggtatcagcgacggtc

SEQ ID NO: 576901 - DNA, 25 bp, Rattus norvegicus
ctaagccgaaaccaggcggcaggta

SEQ ID NO: 576902 - DNA, 25 bp, Rattus norvegicus
tgatttcccgccgatccagcggacg

SEQ ID NO: 576903 - DNA, 25 bp, Rattus norvegicus
ccaggaaaccagacaggtgagggct

SEQ ID NO: 576904 - DNA, 25 bp, Rattus norvegicus
cggcgcccttttcacggacagagaa

SEQ ID NO: 576905 - DNA, 25 bp, Rattus norvegicus
gtgcagggaacacaacgccgccagt

SEQ ID NO: 576906 - DNA, 25 bp, Rattus norvegicus
tgaccactgcagagcactcaggatg

SEQ ID NO: 576907 - DNA, 25 bp, Rattus norvegicus
tgtggctagagacagccacgccttc

SEQ ID NO: 576908 - DNA, 25 bp, Rattus norvegicus
gttcatcactagtgtctcggaaggc

SEQ ID NO: 576909 - DNA, 25 bp, Rattus norvegicus
ggacccgactaaagttcatcactag

SEQ ID NO: 576910 - DNA, 25 bp, Rattus norvegicus
caggatcttcccgagaacgaacttt

SEQ ID NO: 576911 - DNA, 25 bp, Rattus norvegicus
ggactgccggcatcgctaccggcga

SEQ ID NO: 576912 - DNA, 25 bp, Rattus norvegicus
tgccggcatcgctaccggcgaagct

SEQ ID NO: 576913 - DNA, 25 bp, Rattus norvegicus
aagttgtttagagctgggaccgcgc

SEQ ID NO: 576914 - DNA, 25 bp, Rattus norvegicus
gtttagagctgggaccgcgccactg

SEQ ID NO: 576915 - DNA, 25 bp, Rattus norvegicus
cccggagctccgtacagaaagaggc

SEQ ID NO: 576916 - DNA, 25 bp, Rattus norvegicus
ctccgtacagaaagaggcgtgacta

SEQ ID NO: 576917 - DNA, 25 bp, Rattus norvegicus
acagaaagaggcgtgactaattgga

SEQ ID NO: 576918 - DNA, 25 bp, Rattus norvegicus
cgtgtcctccgccatgacaggtggg

SEQ ID NO: 576919 - DNA, 25 bp, Rattus norvegicus
tcctccgccatgacaggtgggcgca

SEQ ID NO: 576920 - DNA, 25 bp, Rattus norvegicus
ccgagtgaccttggcgtcagctggc

SEQ ID NO: 576921 - DNA, 25 bp, Rattus norvegicus
ttggcgtcagctggcgccggcataa

SEQ ID NO: 576922 - DNA, 25 bp, Rattus norvegicus
cagagcagcaggtgagcgcctaccc

SEQ ID NO: 576923 - DNA, 25 bp, Rattus norvegicus
actgcacgggctgcagctgccgagc

SEQ ID NO: 576924 - DNA, 25 bp, Rattus norvegicus
ccgtgcactgcacgggctgcagctg

SEQ ID NO: 576925 - DNA, 25 bp, Rattus norvegicus
tctgcagcacgagagagatggagat

SEQ ID NO: 576926 - DNA, 25 bp, Rattus norvegicus
ccactccgatctgcagcacgagaga

SEQ ID NO: 576927 - DNA, 25 bp, Rattus norvegicus
tgcaagcagccgtgggtcctaccca

SEQ ID NO: 576928 - DNA, 25 bp, Rattus norvegicus
ccgtgggtcctacccaggaagatga

SEQ ID NO: 576929 - DNA, 25 bp, Rattus norvegicus
tacccaggaagatgagcagcacgcc

SEQ ID NO: 576930 - DNA, 25 bp, Rattus norvegicus
ggaagatgagcagcacgcccactcc

SEQ ID NO: 576931 - DNA, 25 bp, Rattus norvegicus
agatgagcaccacgaggggcacgaa

SEQ ID NO: 576932 - DNA, 25 bp, Rattus norvegicus
ctccgcggcgctcttcttgttggcg

SEQ ID NO: 576933 - DNA, 25 bp, Rattus norvegicus
gatgtccagcatgctctccgcggcg

SEQ ID NO: 576934 - DNA, 25 bp, Rattus norvegicus
gccatgagcagtgcgatgtccagca

SEQ ID NO: 576935 - DNA, 25 bp, Rattus norvegicus
ctgcgacgcgttggccatgagcagt

SEQ ID NO: 576936 - DNA, 25 bp, Rattus norvegicus
accacggccttgagctgcgacgcgt

SEQ ID NO: 576937 - DNA, 25 bp, Rattus norvegicus
aaggcgaactcattgccctgctcca

SEQ ID NO: 576938 - DNA, 25 bp, Rattus norvegicus
ggggcacgaagaaggcgaactcatt

SEQ ID NO: 576939 - DNA, 25 bp, Rattus norvegicus
acctctgccggccacccacagggac

SEQ ID NO: 576940 - DNA, 25 bp, Rattus norvegicus
tgagccggacttcccagggcactgt

SEQ ID NO: 576941 - DNA, 25 bp, Rattus norvegicus
ccggctagctctcccggccactccg

SEQ ID NO: 576942 - DNA, 25 bp, Rattus norvegicus
gagagcgagcgccggctagctctcc

SEQ ID NO: 576943 - DNA, 25 bp, Rattus norvegicus
gccggacttcccagggcactgtgct

SEQ ID NO: 576944 - DNA, 25 bp, Rattus norvegicus
agggcactgtgctcctcggcgctca

SEQ ID NO: 576945 - DNA, 25 bp, Rattus norvegicus
gacccagaccgaatcctcacctctg

SEQ ID NO: 576946 - DNA, 25 bp, Rattus norvegicus
cgcagcccagccctgagccggactt

SEQ ID NO: 576947 - DNA, 25 bp, Rattus norvegicus
ccctgctcagtgaatggagagagcg

SEQ ID NO: 576948 - DNA, 25 bp, Rattus norvegicus
ctgccctgctcagtgaatggagaga

SEQ ID NO: 576949 - DNA, 25 bp, Rattus norvegicus
gtgtctgccctgctcagtgaatgga

SEQ ID NO: 576950 - DNA, 25 bp, Rattus norvegicus
gtctccggtgtctgccctgctcagt

SEQ ID NO: 576951 - DNA, 25 bp, Rattus norvegicus
tgacgctcagcgcagccaatgggag

SEQ ID NO: 576952 - DNA, 25 bp, Rattus norvegicus
agcccaggacccagaccgaatcctc

SEQ ID NO: 576953 - DNA, 25 bp, Rattus norvegicus
cgtactcctcggtgccgggatccat

SEQ ID NO: 576954 - DNA, 25 bp, Rattus norvegicus
aggtcgccgttgagctcgtactcct

SEQ ID NO: 576955 - DNA, 25 bp, Rattus norvegicus
agcccaggcaggcagtgcttaccga

SEQ ID NO: 576956 - DNA, 25 bp, Rattus norvegicus
ttaccgggcccgatgcccacaggtg

SEQ ID NO: 576957 - DNA, 25 bp, Rattus norvegicus
tcaccaccaccaagcagggaagacg

SEQ ID NO: 576958 - DNA, 25 bp, Rattus norvegicus
ctcgggacaggtcaagcacgacttt

SEQ ID NO: 576959 - DNA, 25 bp, Rattus norvegicus
tcaagcacgactttgcctggaagca

SEQ ID NO: 576960 - DNA, 25 bp, Rattus norvegicus
ctccaaccaggaggcggtgactcct

SEQ ID NO: 576961 - DNA, 25 bp, Rattus norvegicus
agagcgggatgccagccttctccac

SEQ ID NO: 576962 - DNA, 25 bp, Rattus norvegicus
tagctgtctgcctgatgctggcctc

SEQ ID NO: 576963 - DNA, 25 bp, Rattus norvegicus
tcaccgtgtggtgacgtagctgtct

SEQ ID NO: 576964 - DNA, 25 bp, Rattus norvegicus
ctacagctggcgaccgtgtggtcac

SEQ ID NO: 576965 - DNA, 25 bp, Rattus norvegicus
tggtgccagccagacacaggctctg

SEQ ID NO: 576966 - DNA, 25 bp, Rattus norvegicus
ggaccaccacttgcgctcgggacag

SEQ ID NO: 576967 - DNA, 25 bp, Rattus norvegicus
ttgacccttttttccagcctctgga

SEQ ID NO: 576968 - DNA, 25 bp, Rattus norvegicus
tgcttctactctgcaagacgcgccg

SEQ ID NO: 576969 - DNA, 25 bp, Rattus norvegicus
gagcaggctcctgtccggtgcttcc

SEQ ID NO: 576970 - DNA, 25 bp, Rattus norvegicus
ttccagcctctggagccctctgtag

SEQ ID NO: 576971 - DNA, 25 bp, Rattus norvegicus
ggagccctctgtagctcctctgggc

SEQ ID NO: 576972 - DNA, 25 bp, Rattus norvegicus
cctcagggacacctagcaggtcgtc

SEQ ID NO: 576973 - DNA, 25 bp, Rattus norvegicus
acagcttgagacaggccatgttccc

SEQ ID NO: 576974 - DNA, 25 bp, Rattus norvegicus
tgtgagtatcgagccctcccgctcg

SEQ ID NO: 576975 - DNA, 25 bp, Rattus norvegicus
gcaatccacgcctcgggagcagatc

SEQ ID NO: 576976 - DNA, 25 bp, Rattus norvegicus
agaggcggcgctgtctcatcccgcg

SEQ ID NO: 576977 - DNA, 25 bp, Rattus norvegicus
ccgtgtgtccttggcccgcagagat

SEQ ID NO: 576978 - DNA, 25 bp, Rattus norvegicus
ccctgcagcgcagggtgcttctact

SEQ ID NO: 576979 - DNA, 25 bp, Rattus norvegicus
gcccgctcgccctgtgagtatcgag

SEQ ID NO: 576980 - DNA, 25 bp, Rattus norvegicus
agcctaacggggtcgcctctgtgct

SEQ ID NO: 576981 - DNA, 25 bp, Rattus norvegicus
gtggaaccacatgctcggctacctg

SEQ ID NO: 576982 - DNA, 25 bp, Rattus norvegicus
cggactctcctcagcggggttccga

SEQ ID NO: 576983 - DNA, 25 bp, Rattus norvegicus
ttcgtcttcttcaacggcgcgctcg

SEQ ID NO: 576984 - DNA, 25 bp, Rattus norvegicus
gccaaggcctgcttcggaggcaaca

SEQ ID NO: 576985 - DNA, 25 bp, Rattus norvegicus
tcaagcggcagggtaacgagcgcca

SEQ ID NO: 576986 - DNA, 25 bp, Rattus norvegicus
ggtggcttctacaccgactgggtga

SEQ ID NO: 576987 - DNA, 25 bp, Rattus norvegicus
tgcatcgcctgtacggtggcttcta

SEQ ID NO: 576988 - DNA, 25 bp, Rattus norvegicus
gtggatgccgacaactgcctgcatc

SEQ ID NO: 576989 - DNA, 25 bp, Rattus norvegicus
tcgagaagcactgtccgagcgccgt

SEQ ID NO: 576990 - DNA, 25 bp, Rattus norvegicus
tgcagggcttccaggactacatcga

SEQ ID NO: 576991 - DNA, 25 bp, Rattus norvegicus
ctaagggcccgacgagccaagcagc

SEQ ID NO: 576992 - DNA, 25 bp, Rattus norvegicus
gacgcgaggccctgaaagtcctgcc

SEQ ID NO: 576993 - DNA, 25 bp, Rattus norvegicus
aggcttgcggctctctcggactctc

SEQ ID NO: 576994 - DNA, 25 bp, Rattus norvegicus
cttcggaggcaacatcgagctcttc

SEQ ID NO: 576995 - DNA, 25 bp, Rattus norvegicus
cggagccgagccatgcccaaagccg

SEQ ID NO: 576996 - DNA, 25 bp, Rattus norvegicus
aataatcggaggttcagccacgggg

SEQ ID NO: 576997 - DNA, 25 bp, Rattus norvegicus
cccacgaataatcggaggttcagcc

SEQ ID NO: 576998 - DNA, 25 bp, Rattus norvegicus
gtggctcttgcggcctccgtaggcc

SEQ ID NO: 576999 - DNA, 25 bp, Rattus norvegicus
aagagccgcgtttggaaccttgcgc

SEQ ID NO: 577000 - DNA, 25 bp, Rattus norvegicus
gctgctaaaagagccgcgtttggaa

SEQ ID NO: 577001 - DNA, 25 bp, Rattus norvegicus
ggtcaggctggctgctaaaagagcc

SEQ ID NO: 577002 - DNA, 25 bp, Rattus norvegicus
gacaaggtctaagactgcgcctgct

SEQ ID NO: 577003 - DNA, 25 bp, Rattus norvegicus
agctgaggacgctcgctttacggac

SEQ ID NO: 577004 - DNA, 25 bp, Rattus norvegicus
ggcggaaacgcgtgacaaggtctaa

SEQ ID NO: 577005 - DNA, 25 bp, Rattus norvegicus
attgtgcagcagatgcgcgcgcatc

SEQ ID NO: 577006 - DNA, 25 bp, Rattus norvegicus
gccacggggcgcctgacccaccagc

SEQ ID NO: 577007 - DNA, 25 bp, Rattus norvegicus
aacgcgtgacaaggtctaagactgc

SEQ ID NO: 577008 - DNA, 25 bp, Rattus norvegicus
tgctccgagctgaggacgctcgctt

SEQ ID NO: 577009 - DNA, 25 bp, Rattus norvegicus
cccgagaggcgcgactggcgggctc

SEQ ID NO: 577010 - DNA, 25 bp, Rattus norvegicus
tgcctactggctcgggccggcctgc

SEQ ID NO: 577011 - DNA, 25 bp, Rattus norvegicus
cccgcgtgcctactggctcgggccg

SEQ ID NO: 577012 - DNA, 25 bp, Rattus norvegicus
gaccttgtcctggcgggcaggaccc

SEQ ID NO: 577013 - DNA, 25 bp, Rattus norvegicus
aatgcccccagtgtctgccagagcc

SEQ ID NO: 577014 - DNA, 25 bp, Rattus norvegicus
ctaggtagcggccaatgcccccagt

SEQ ID NO: 577015 - DNA, 25 bp, Rattus norvegicus
acggtagctaggtagcggccaatgc

SEQ ID NO: 577016 - DNA, 25 bp, Rattus norvegicus
tgcaggaactttccccgcgcgggct

SEQ ID NO: 577017 - DNA, 25 bp, Rattus norvegicus
cctgcgaagttgcaggaactttccc

SEQ ID NO: 577018 - DNA, 25 bp, Rattus norvegicus
ccctgcgaagttgcaggaactttcc

SEQ ID NO: 577019 - DNA, 25 bp, Rattus norvegicus
ccggtcgtctgacagcggggccgca

SEQ ID NO: 577020 - DNA, 25 bp, Rattus norvegicus
ttggggctgggacccggtcgtctga

SEQ ID NO: 577021 - DNA, 25 bp, Rattus norvegicus
gctccggccgcgttggggctgggac

SEQ ID NO: 577022 - DNA, 25 bp, Rattus norvegicus
ggtagctaggtagcggccaatgccc

SEQ ID NO: 577023 - DNA, 25 bp, Rattus norvegicus
cgccactaagcgtgaatctctccgt

SEQ ID NO: 577024 - DNA, 25 bp, Rattus norvegicus
tgcctgctcgacatgctggtctact

SEQ ID NO: 577025 - DNA, 25 bp, Rattus norvegicus
tgcctgaaagatacaacatgctctc

SEQ ID NO: 577026 - DNA, 25 bp, Rattus norvegicus
ctgctcgacctcagctatggagttg

SEQ ID NO: 577027 - DNA, 25 bp, Rattus norvegicus
gacacccgggcatggagtacactgc

SEQ ID NO: 577028 - DNA, 25 bp, Rattus norvegicus
ccttatatgaggctccactcggaca

SEQ ID NO: 577029 - DNA, 25 bp, Rattus norvegicus
ccctgggcaggtacacactgctgga

SEQ ID NO: 577030 - DNA, 25 bp, Rattus norvegicus
cccaatccggctcgcgtttggattc

SEQ ID NO: 577031 - DNA, 25 bp, Rattus norvegicus
gcggggctcaactaaggcgccattc

SEQ ID NO: 577032 - DNA, 25 bp, Rattus norvegicus
gctctgggccaatgtgtaattctca

SEQ ID NO: 577033 - DNA, 25 bp, Rattus norvegicus
agcgagattcggtttcgagcaaaga

SEQ ID NO: 577034 - DNA, 25 bp, Rattus norvegicus
tcatggagtgttgaccgacctgtcg

SEQ ID NO: 577035 - DNA, 25 bp, Rattus norvegicus
ggcacctgtatggacgacctgatca

SEQ ID NO: 577036 - DNA, 25 bp, Rattus norvegicus
tcttacacgtagactcaggcacctg

SEQ ID NO: 577037 - DNA, 25 bp, Rattus norvegicus
gtgacctggtcactagcacctgcgg

SEQ ID NO: 577038 - DNA, 25 bp, Rattus norvegicus
atcatccacccgcagcagacggaga

SEQ ID NO: 577039 - DNA, 25 bp, Rattus norvegicus
gcgacacgtggtgcacaatccacag

SEQ ID NO: 577040 - DNA, 25 bp, Rattus norvegicus
ggtgcggcgatgcaggcacccggcc

SEQ ID NO: 577041 - DNA, 25 bp, Rattus norvegicus
agccgggccagctccatcatccacc

SEQ ID NO: 577042 - DNA, 25 bp, Rattus norvegicus
tcggggcccgctggggctttcagca

SEQ ID NO: 577043 - DNA, 25 bp, Rattus norvegicus
atccacccgcagcagacggagagtg

SEQ ID NO: 577044 - DNA, 25 bp, Rattus norvegicus
acccgcagcagacggagagtgcttc

SEQ ID NO: 577045 - DNA, 25 bp, Rattus norvegicus
ccgcagcagacggagagtgcttcgc

SEQ ID NO: 577046 - DNA, 25 bp, Rattus norvegicus
agagtgcttcgcgtggccgccaggc

SEQ ID NO: 577047 - DNA, 25 bp, Rattus norvegicus
gccaggcggcgctacagaaacccgg

SEQ ID NO: 577048 - DNA, 25 bp, Rattus norvegicus
cgaggctggtgacctggtcactagc

SEQ ID NO: 577049 - DNA, 25 bp, Rattus norvegicus
gacctggtcactagcacctgcgggg

SEQ ID NO: 577050 - DNA, 25 bp, Rattus norvegicus
cgtggtgcacaatccacagcggctg

SEQ ID NO: 577051 - DNA, 25 bp, Rattus norvegicus
caggaaaccgtctggcaggccggcc

SEQ ID NO: 577052 - DNA, 25 bp, Rattus norvegicus
ctaggcggccgcattccagagccgg

SEQ ID NO: 577053 - DNA, 25 bp, Rattus norvegicus
tgtaaatacggaaccgctggcggcc

SEQ ID NO: 577054 - DNA, 25 bp, Rattus norvegicus
taatgtagtgtaaatacggaaccgc

SEQ ID NO: 577055 - DNA, 25 bp, Rattus norvegicus
gagcgtttaaaccattattaatgta

SEQ ID NO: 577056 - DNA, 25 bp, Rattus norvegicus
cacaggggccatctgctaggcggcc

SEQ ID NO: 577057 - DNA, 25 bp, Rattus norvegicus
cagcatgtatttatgagagcgttta

SEQ ID NO: 577058 - DNA, 25 bp, Rattus norvegicus
tggattgccaattaatcagcatgta

SEQ ID NO: 577059 - DNA, 25 bp, Rattus norvegicus
caggccggccctcggcaaatggatt

SEQ ID NO: 577060 - DNA, 25 bp, Rattus norvegicus
ggggcctccaggaaaccgtctggca

SEQ ID NO: 577061 - DNA, 25 bp, Rattus norvegicus
cccggcgtgtttatcgggatgtgga

SEQ ID NO: 577062 - DNA, 25 bp, Rattus norvegicus
ctccaggacgatccgcaagggggct

SEQ ID NO: 577063 - DNA, 25 bp, Rattus norvegicus
cagctgagcagctcgaccggcggac

SEQ ID NO: 577064 - DNA, 25 bp, Rattus norvegicus
ccctcggcaaatggattgccaatta

SEQ ID NO: 577065 - DNA, 25 bp, Rattus norvegicus
ctcaaaacgcgggtcaccggcgtgg

SEQ ID NO: 577066 - DNA, 25 bp, Rattus norvegicus
agcgcagccgacctgagggttccca

SEQ ID NO: 577067 - DNA, 25 bp, Rattus norvegicus
ggcgacttttattatttgttctcaa

SEQ ID NO: 577068 - DNA, 25 bp, Rattus norvegicus
tatttgttctcaaaacgcgggtcac

SEQ ID NO: 577069 - DNA, 25 bp, Rattus norvegicus
cagggccactgctaaccggggacac

SEQ ID NO: 577070 - DNA, 25 bp, Rattus norvegicus
acctagagtgttggcgagcgcagcc

SEQ ID NO: 577071 - DNA, 25 bp, Rattus norvegicus
agctcctagaatggagcccggctcc

SEQ ID NO: 577072 - DNA, 25 bp, Rattus norvegicus
ccagaagcagctcctagaatggagc

SEQ ID NO: 577073 - DNA, 25 bp, Rattus norvegicus
cggggtcttccagcgatcagccctt

SEQ ID NO: 577074 - DNA, 25 bp, Rattus norvegicus
ccagtgtagaaagcggggtcttcca

SEQ ID NO: 577075 - DNA, 25 bp, Rattus norvegicus
gtggggctcccagcccagtgtagaa

SEQ ID NO: 577076 - DNA, 25 bp, Rattus norvegicus
ctgagaccctgctagtggtgcgtgt

SEQ ID NO: 577077 - DNA, 25 bp, Rattus norvegicus
attgggctcgtgctgagaccctgct

SEQ ID NO: 577078 - DNA, 25 bp, Rattus norvegicus
taaccggggacaccagagcctgctc

SEQ ID NO: 577079 - DNA, 25 bp, Rattus norvegicus
caggagctcgctgagacctgggatt

SEQ ID NO: 577080 - DNA, 25 bp, Rattus norvegicus
cccaaggcgcagaaacgagtgtgtg

SEQ ID NO: 577081 - DNA, 25 bp, Rattus norvegicus
tcgcagcttcgatcgctgggctcgc

SEQ ID NO: 577082 - DNA, 25 bp, Rattus norvegicus
tgaacacaactctcccagactgggg

SEQ ID NO: 577083 - DNA, 25 bp, Rattus norvegicus
agacctgggattggcttccgggcct

SEQ ID NO: 577084 - DNA, 25 bp, Rattus norvegicus
ggtgtctccgctggcttctctgcct

SEQ ID NO: 577085 - DNA, 25 bp, Rattus norvegicus
tgtccttccttgtctggcccgtaac

SEQ ID NO: 577086 - DNA, 25 bp, Rattus norvegicus
gacgctcagtcctcgcagcttcgat

SEQ ID NO: 577087 - DNA, 25 bp, Rattus norvegicus
ttgagcacgaaagggccagctcctg

SEQ ID NO: 577088 - DNA, 25 bp, Rattus norvegicus
ttagaaagcaaacggcttgagcacg

SEQ ID NO: 577089 - DNA, 25 bp, Rattus norvegicus
ctgtccgcattcaaagtagtaatga

SEQ ID NO: 577090 - DNA, 25 bp, Rattus norvegicus
ggcccgtaactgtccgcattcaaag

SEQ ID NO: 577091 - DNA, 25 bp, Rattus norvegicus
aggtccgagaaagaccagaagcttc

SEQ ID NO: 577092 - DNA, 25 bp, Rattus norvegicus
agaagcttcggccacgctgaacaca

SEQ ID NO: 577093 - DNA, 25 bp, Rattus norvegicus
gctgctgcataccccaccaagtgta

SEQ ID NO: 577094 - DNA, 25 bp, Rattus norvegicus
ccgcaacgctgagcgcctgtgagta

SEQ ID NO: 577095 - DNA, 25 bp, Rattus norvegicus
cttctttgctctcccgtgtatgagg

SEQ ID NO: 577096 - DNA, 25 bp, Rattus norvegicus
gtccttctttgctctcccgtgtatg

SEQ ID NO: 577097 - DNA, 25 bp, Rattus norvegicus
tttgctctcccgtgtatgagggacg

SEQ ID NO: 577098 - DNA, 25 bp, Rattus norvegicus
aggtccttctttgctctcccgtgta

SEQ ID NO: 577099 - DNA, 25 bp, Rattus norvegicus
gcaggtccttctttgctctcccgtg

SEQ ID NO: 577100 - DNA, 25 bp, Rattus norvegicus
agggcgcaggtccttctttgctctc

SEQ ID NO: 577101 - DNA, 25 bp, Rattus norvegicus
tacagggcgcaggtccttctttgct

SEQ ID NO: 577102 - DNA, 25 bp, Rattus norvegicus
actgccacggactgggcctgcgcgc

SEQ ID NO: 577103 - DNA, 25 bp, Rattus norvegicus
ccgctagcgtggactgccacggact

SEQ ID NO: 577104 - DNA, 25 bp, Rattus norvegicus
accaagtgtacctgctccgccgcta

SEQ ID NO: 577105 - DNA, 25 bp, Rattus norvegicus
tcctacagggcgcaggtccttcttt

SEQ ID NO: 577106 - DNA, 25 bp, Rattus norvegicus
gctgagcgcctgtgagtacccaccc

SEQ ID NO: 577107 - DNA, 25 bp, Rattus norvegicus
gctcccggggatgcgaccacggcta

SEQ ID NO: 577108 - DNA, 25 bp, Rattus norvegicus
atgatccgcacagccctcgggcgga

SEQ ID NO: 577109 - DNA, 25 bp, Rattus norvegicus
gtcgatgatccgcacagccctcggg

SEQ ID NO: 577110 - DNA, 25 bp, Rattus norvegicus
agcgatgcggtcgatgatccgcaca

SEQ ID NO: 577111 - DNA, 25 bp, Rattus norvegicus
gatcatgaagctgcggtagcgatgc

SEQ ID NO: 577112 - DNA, 25 bp, Rattus norvegicus
tcttcgatcatgaagctgcggtagc

SEQ ID NO: 577113 - DNA, 25 bp, Rattus norvegicus
aggatctcttcgatcatgaagctgc

SEQ ID NO: 577114 - DNA, 25 bp, Rattus norvegicus
cggtgaggatctcttcgatcatgaa

SEQ ID NO: 577115 - DNA, 25 bp, Rattus norvegicus
tgcacgccgaacttgagcagctcgc

SEQ ID NO: 577116 - DNA, 25 bp, Rattus norvegicus
tgcacgtacccaggtggctgtggaa

SEQ ID NO: 577117 - DNA, 25 bp, Rattus norvegicus
gcagcgcctgcacgccgaacttgag

SEQ ID NO: 577118 - DNA, 25 bp, Rattus norvegicus
atgcgaccacggctaggcagcgacg

SEQ ID NO: 577119 - DNA, 25 bp, Rattus norvegicus
aggctcggtgaggatctcttcgatc

SEQ ID NO: 577120 - DNA, 25 bp, Rattus norvegicus
ggccgctgcacgtacccaggtggct

SEQ ID NO: 577121 - DNA, 25 bp, Rattus norvegicus
gactccaggccgcaggagatcctta

SEQ ID NO: 577122 - DNA, 25 bp, Rattus norvegicus
tcttccgccttcgacccgccagggc

SEQ ID NO: 577123 - DNA, 25 bp, Rattus norvegicus
tccgtcccttttcccacttgcgagc

SEQ ID NO: 577124 - DNA, 25 bp, Rattus norvegicus
gcgcagtctcctcgccaagagggga

SEQ ID NO: 577125 - DNA, 25 bp, Rattus norvegicus
cgcaggagatccttagcgcagtctc

SEQ ID NO: 577126 - DNA, 25 bp, Rattus norvegicus
caccctcccgggtggcccagcaacg

SEQ ID NO: 577127 - DNA, 25 bp, Rattus norvegicus
cgtcccaggctagccaccctcccgg

SEQ ID NO: 577128 - DNA, 25 bp, Rattus norvegicus
ggtgacctcagcgtcccaggctagc

SEQ ID NO: 577129 - DNA, 25 bp, Rattus norvegicus
tggaaaaggtgacctcagcgtccca

SEQ ID NO: 577130 - DNA, 25 bp, Rattus norvegicus
caggcacggtggaaaaggtgacctc

SEQ ID NO: 577131 - DNA, 25 bp, Rattus norvegicus
atcccggaaactggccgctcaggga

SEQ ID NO: 577132 - DNA, 25 bp, Rattus norvegicus
taaaatcccggaaactggccgctca

SEQ ID NO: 577133 - DNA, 25 bp, Rattus norvegicus
agccgctgagtcttccgccttcgac

SEQ ID NO: 577134 - DNA, 25 bp, Rattus norvegicus
ttagcgcagtctcctcgccaagagg

SEQ ID NO: 577135 - DNA, 25 bp, Rattus norvegicus
gaggttcggagtccgcagccaatta

SEQ ID NO: 577136 - DNA, 25 bp, Rattus norvegicus
tcgactctccattggctgacgcgta

SEQ ID NO: 577137 - DNA, 25 bp, Rattus norvegicus
agggtcctcgcgctttctacgcaca

SEQ ID NO: 577138 - DNA, 25 bp, Rattus norvegicus
gtaggctcagcgctcgaccacacag

SEQ ID NO: 577139 - DNA, 25 bp, Rattus norvegicus
acacagccctgatcagccttttagc

SEQ ID NO: 577140 - DNA, 25 bp, Rattus norvegicus
gttcgaaaaccctaggagctgtcca

SEQ ID NO: 577141 - DNA, 25 bp, Rattus norvegicus
taggagctgtccattgcgtcacgga

SEQ ID NO: 577142 - DNA, 25 bp, Rattus norvegicus
ctgacgcgtatcacgtgcaccgagc

SEQ ID NO: 577143 - DNA, 25 bp, Rattus norvegicus
tgcaccgagcgactctggctattgg

SEQ ID NO: 577144 - DNA, 25 bp, Rattus norvegicus
ctagaagtcccaagaccgatctgcg

SEQ ID NO: 577145 - DNA, 25 bp, Rattus norvegicus
cacgtggttctgtgagccaagctcc

SEQ ID NO: 577146 - DNA, 25 bp, Rattus norvegicus
ttgtccttaggtggcgggttatcca

SEQ ID NO: 577147 - DNA, 25 bp, Rattus norvegicus
ggcgttttttggaggcgcatcccta

SEQ ID NO: 577148 - DNA, 25 bp, Rattus norvegicus
aggaatccgagcagcgccttggact

SEQ ID NO: 577149 - DNA, 25 bp, Rattus norvegicus
ggggtcattcttcacattcctcacc

SEQ ID NO: 577150 - DNA, 25 bp, Rattus norvegicus
cgtcacttccgccatcaggtttgtg

SEQ ID NO: 577151 - DNA, 25 bp, Rattus norvegicus
atagcggccacgtgacacggcttgc

SEQ ID NO: 577152 - DNA, 25 bp, Rattus norvegicus
cgaggcacacgtcagtcaagaagtt

SEQ ID NO: 577153 - DNA, 25 bp, Rattus norvegicus
ccatcaccgcggaaggcgggactca

SEQ ID NO: 577154 - DNA, 25 bp, Rattus norvegicus
gaggacggtcctcgctattctcccg

SEQ ID NO: 577155 - DNA, 25 bp, Rattus norvegicus
gcgtgactggctgcgtacgtagcca

SEQ ID NO: 577156 - DNA, 25 bp, Rattus norvegicus
ccgactagctaaggcgaaagggcga

SEQ ID NO: 577157 - DNA, 25 bp, Rattus norvegicus
tcaagaagttctgccaatgggcgcg

SEQ ID NO: 577158 - DNA, 25 bp, Rattus norvegicus
gtagccttccctcaggccgctgagg

SEQ ID NO: 577159 - DNA, 25 bp, Rattus norvegicus
gggaaaccttttctgcgagcttgag

SEQ ID NO: 577160 - DNA, 25 bp, Rattus norvegicus
ttcctcctttagactcggggcggca

SEQ ID NO: 577161 - DNA, 25 bp, Rattus norvegicus
cttcaatcaaacttgcgggcgggcg

SEQ ID NO: 577162 - DNA, 25 bp, Rattus norvegicus
tcagccatcaccttccagtggggtc

SEQ ID NO: 577163 - DNA, 25 bp, Rattus norvegicus
aaagtgcaaagacccgggctcctgc

SEQ ID NO: 577164 - DNA, 25 bp, Rattus norvegicus
gtcagccgctactccatcctcgatg

SEQ ID NO: 577165 - DNA, 25 bp, Rattus norvegicus
tggcgtgggccacccacagggttca

SEQ ID NO: 577166 - DNA, 25 bp, Rattus norvegicus
ccacccacagggttcaggtgtcagc

SEQ ID NO: 577167 - DNA, 25 bp, Rattus norvegicus
ccctccaggcggaagagtccggaga

SEQ ID NO: 577168 - DNA, 25 bp, Rattus norvegicus
tgcctatccctccaggcggaagagt

SEQ ID NO: 577169 - DNA, 25 bp, Rattus norvegicus
ctcccgcggttctggtgagcaaaag

SEQ ID NO: 577170 - DNA, 25 bp, Rattus norvegicus
tgcctgtggacgatcctcccgcggt

SEQ ID NO: 577171 - DNA, 25 bp, Rattus norvegicus
gtacttccgcatcctgcagtcgtca

SEQ ID NO: 577172 - DNA, 25 bp, Rattus norvegicus
ggtcggtgtacttccgcatcctgca

SEQ ID NO: 577173 - DNA, 25 bp, Rattus norvegicus
atcccggtcggtgtacttccgcatc

SEQ ID NO: 577174 - DNA, 25 bp, Rattus norvegicus
aagtgcgcgcgcgtcatcccggtcg

SEQ ID NO: 577175 - DNA, 25 bp, Rattus norvegicus
ctggtgagcaaaagtgcaaagaccc

SEQ ID NO: 577176 - DNA, 25 bp, Rattus norvegicus
gttcaggtgtcagccgctactccat

SEQ ID NO: 577177 - DNA, 25 bp, Rattus norvegicus
tctggtcaatgggacgctgtatatt

SEQ ID NO: 577178 - DNA, 25 bp, Rattus norvegicus
tgaccaaactttggcccaggattca

SEQ ID NO: 577179 - DNA, 25 bp, Rattus norvegicus
tatagatggccgctttgattcgggc

SEQ ID NO: 577180 - DNA, 25 bp, Rattus norvegicus
caggtggagttaattatagatggcc

SEQ ID NO: 577181 - DNA, 25 bp, Rattus norvegicus
tcctgctgtagcacaggtggagtta

SEQ ID NO: 577182 - DNA, 25 bp, Rattus norvegicus
agcccacgagcatcgtcctgctgta

SEQ ID NO: 577183 - DNA, 25 bp, Rattus norvegicus
gccatccatatcaaccggccgggga

SEQ ID NO: 577184 - DNA, 25 bp, Rattus norvegicus
tcacggaacacattgcagcgccatc

SEQ ID NO: 577185 - DNA, 25 bp, Rattus norvegicus
gcagctatcactcacggaacacatt

SEQ ID NO: 577186 - DNA, 25 bp, Rattus norvegicus
cgcggagacccggatgaataaaaca

SEQ ID NO: 577187 - DNA, 25 bp, Rattus norvegicus
acgctgtatattgattctggttcgc

SEQ ID NO: 577188 - DNA, 25 bp, Rattus norvegicus
acataaacccgggtctggtcaatgg

SEQ ID NO: 577189 - DNA, 25 bp, Rattus norvegicus
aggattcaaccaacgtgctctcggc

SEQ ID NO: 577190 - DNA, 25 bp, Rattus norvegicus
ttctggttcgcgtgcagctatcact

SEQ ID NO: 577191 - DNA, 25 bp, Rattus norvegicus
ggccaatgccctgtggatgcaggta

SEQ ID NO: 577192 - DNA, 25 bp, Rattus norvegicus
gtctgtctggtctgcaagcgcccgc

SEQ ID NO: 577193 - DNA, 25 bp, Rattus norvegicus
tccaacgcggagtcgggcaccgaga

SEQ ID NO: 577194 - DNA, 25 bp, Rattus norvegicus
cgtattcgtcttcgtccaacgcgga

SEQ ID NO: 577195 - DNA, 25 bp, Rattus norvegicus
tgcctcagctcgtcggcgctggaca

SEQ ID NO: 577196 - DNA, 25 bp, Rattus norvegicus
agccatccggatcgtagctgcgccg

SEQ ID NO: 577197 - DNA, 25 bp, Rattus norvegicus
gccgcctgagccatccggatcgtag

SEQ ID NO: 577198 - DNA, 25 bp, Rattus norvegicus
tcgctgtcgtcgtcgtattcgtctt

SEQ ID NO: 577199 - DNA, 25 bp, Rattus norvegicus
agcaccgtgactgactgacggcccg

SEQ ID NO: 577200 - DNA, 25 bp, Rattus norvegicus
tttccgccgccgtgcggcaggagca

SEQ ID NO: 577201 - DNA, 25 bp, Rattus norvegicus
cgctgtctagtgaggatttgaaatc

SEQ ID NO: 577202 - DNA, 25 bp, Rattus norvegicus
cgcggtaaccaaggcggcgctgtct

SEQ ID NO: 577203 - DNA, 25 bp, Rattus norvegicus
ctagaacgtgtagtgcgcaagcgcg

SEQ ID NO: 577204 - DNA, 25 bp, Rattus norvegicus
tctccgctgccgactagaacgtgta

SEQ ID NO: 577205 - DNA, 25 bp, Rattus norvegicus
gtctgtcctggcgagtagcacagaa

SEQ ID NO: 577206 - DNA, 25 bp, Rattus norvegicus
cgcctcaaaatggaattcgaatctg

SEQ ID NO: 577207 - DNA, 25 bp, Rattus norvegicus
cctggcgagtagcacagaaataaca

SEQ ID NO: 577208 - DNA, 25 bp, Rattus norvegicus
gtagcacagaaataacatgggattc

SEQ ID NO: 577209 - DNA, 25 bp, Rattus norvegicus
taacatgggattcaaaggcaagcgc

SEQ ID NO: 577210 - DNA, 25 bp, Rattus norvegicus
attcaaaggcaagcgctggctcctc

SEQ ID NO: 577211 - DNA, 25 bp, Rattus norvegicus
aaggcaagcgctggctcctcacggt

SEQ ID NO: 577212 - DNA, 25 bp, Rattus norvegicus
tcctcacggtctgtggtctgagaca

SEQ ID NO: 577213 - DNA, 25 bp, Rattus norvegicus
ctgtggtctgagacacggttccagc

SEQ ID NO: 577214 - DNA, 25 bp, Rattus norvegicus
ccttcacgcctcaaaatggaattcg

SEQ ID NO: 577215 - DNA, 25 bp, Rattus norvegicus
attcgaatctgaccttccggggtca

SEQ ID NO: 577216 - DNA, 25 bp, Rattus norvegicus
tgaccttccggggtcatcgccaagg

SEQ ID NO: 577217 - DNA, 25 bp, Rattus norvegicus
catcgccaaggttaagggaattgtt

SEQ ID NO: 577218 - DNA, 25 bp, Rattus norvegicus
tgagacacggttccagcacctcctt

SEQ ID NO: 577219 - DNA, 25 bp, Rattus norvegicus
cctgtgatgcaagggacattccgga

SEQ ID NO: 577220 - DNA, 25 bp, Rattus norvegicus
gtccactacccagttcgggacctga

SEQ ID NO: 577221 - DNA, 25 bp, Rattus norvegicus
cccgggagacatccaggggaactag

SEQ ID NO: 577222 - DNA, 25 bp, Rattus norvegicus
gagacgcaaggctccgagtcccaac

SEQ ID NO: 577223 - DNA, 25 bp, Rattus norvegicus
gagtcccaaccgctttccgcattgg

SEQ ID NO: 577224 - DNA, 25 bp, Rattus norvegicus
tccgcattgggaccagcgatcacca

SEQ ID NO: 577225 - DNA, 25 bp, Rattus norvegicus
aagccgctgtcattccctgagagga

SEQ ID NO: 577226 - DNA, 25 bp, Rattus norvegicus
tgagaggaggaagaccacccatatc

SEQ ID NO: 577227 - DNA, 25 bp, Rattus norvegicus
tctcaccgggtcagtgttgagcgcc

SEQ ID NO: 577228 - DNA, 25 bp, Rattus norvegicus
tgcaggatctccactttgctgactt

SEQ ID NO: 577229 - DNA, 25 bp, Rattus norvegicus
ttgctgactttcttgttgggcggga

SEQ ID NO: 577230 - DNA, 25 bp, Rattus norvegicus
agtcgttcatatcgcactgcaggca

SEQ ID NO: 577231 - DNA, 25 bp, Rattus norvegicus
taggctatggccatgctccgccagg

SEQ ID NO: 577232 - DNA, 25 bp, Rattus norvegicus
aatgctgtcgccctgcttgttcacg

SEQ ID NO: 577233 - DNA, 25 bp, Rattus norvegicus
gcggtgctcaacagcagcgggccaa

SEQ ID NO: 577234 - DNA, 25 bp, Rattus norvegicus
agccagcagagttctggcccgggcg

SEQ ID NO: 577235 - DNA, 25 bp, Rattus norvegicus
gggctgcattcctgcatcctcctcg

SEQ ID NO: 577236 - DNA, 25 bp, Rattus norvegicus
gcattcctgcatcctcctcgctcgg

SEQ ID NO: 577237 - DNA, 25 bp, Rattus norvegicus
ctcctcgctcggctcgcagcctccc

SEQ ID NO: 577238 - DNA, 25 bp, Rattus norvegicus
gattcattggctcggcggcctagac

SEQ ID NO: 577239 - DNA, 25 bp, Rattus norvegicus
ggcctagactgcctggcgccgtccc

SEQ ID NO: 577240 - DNA, 25 bp, Rattus norvegicus
gacgtcacccattcacccggcccgc

SEQ ID NO: 577241 - DNA, 25 bp, Rattus norvegicus
gccagccgggcggtcgctctgacaa

SEQ ID NO: 577242 - DNA, 25 bp, Rattus norvegicus
ctgattcattggctcggcggcctag

SEQ ID NO: 577243 - DNA, 25 bp, Rattus norvegicus
ggcggtcgctctgacaacgcggacg

SEQ ID NO: 577244 - DNA, 25 bp, Rattus norvegicus
cggtgctcaacagcagcgggccaag

SEQ ID NO: 577245 - DNA, 25 bp, Rattus norvegicus
cagcgggccaaggagcgggcggcac

SEQ ID NO: 577246 - DNA, 25 bp, Rattus norvegicus
cagccgggcggtcgctctgacaacg

SEQ ID NO: 577247 - DNA, 25 bp, Rattus norvegicus
gctatttctcagtgcggcggcggct

SEQ ID NO: 577248 - DNA, 25 bp, Rattus norvegicus
cgacgccatgaagatcaaggatgcc

SEQ ID NO: 577249 - DNA, 25 bp, Rattus norvegicus
tcgcgccttagaccgacgccatgaa

SEQ ID NO: 577250 - DNA, 25 bp, Rattus norvegicus
ctagaaataggggtcgcgaggcatc

SEQ ID NO: 577251 - DNA, 25 bp, Rattus norvegicus
tgggctttgtagtccgcccgcgcgt

SEQ ID NO: 577252 - DNA, 25 bp, Rattus norvegicus
tctgccgcaggagagtggagcctca

SEQ ID NO: 577253 - DNA, 25 bp, Rattus norvegicus
tggagcctcacgctgcggagaacta

SEQ ID NO: 577254 - DNA, 25 bp, Rattus norvegicus
caaggatgccaaaaaaccctgtaag

SEQ ID NO: 577255 - DNA, 25 bp, Rattus norvegicus
ctcacgctgcggagaactacaactc

SEQ ID NO: 577256 - DNA, 25 bp, Rattus norvegicus
ttgggaagaccgctctgggagccac

SEQ ID NO: 577257 - DNA, 25 bp, Rattus norvegicus
gccggctttaggcttgcgactgctc

SEQ ID NO: 577258 - DNA, 25 bp, Rattus norvegicus
ggagtcttcacctctcttcgctgag

SEQ ID NO: 577259 - DNA, 25 bp, Rattus norvegicus
ggcccagtctgctagggagtcttca

SEQ ID NO: 577260 - DNA, 25 bp, Rattus norvegicus
tctcttcgctgagctctgcaccgga

SEQ ID NO: 577261 - DNA, 25 bp, Rattus norvegicus
ggcaggctaagctttcccgtctagg

SEQ ID NO: 577262 - DNA, 25 bp, Rattus norvegicus
tctccggaaacacggactgcgttac

SEQ ID NO: 577263 - DNA, 25 bp, Rattus norvegicus
ctaagctttcccgtctagggcgccg

SEQ ID NO: 577264 - DNA, 25 bp, Rattus norvegicus
tttcgttgacgaggaagaaggcttg

SEQ ID NO: 577265 - DNA, 25 bp, Rattus norvegicus
actgtgctgacaatctccggaaaca

SEQ ID NO: 577266 - DNA, 25 bp, Rattus norvegicus
ctgcgttacaggaatggccattttg

SEQ ID NO: 577267 - DNA, 25 bp, Rattus norvegicus
ggccattttgtgaactccagagtcg

SEQ ID NO: 577268 - DNA, 25 bp, Rattus norvegicus
ctccagagtcgaaattaaacagcgg

SEQ ID NO: 577269 - DNA, 25 bp, Rattus norvegicus
ttaaacagcggaagacggaagccga

SEQ ID NO: 577270 - DNA, 25 bp, Rattus norvegicus
gccgacaaggctcgtgcagcatttc

SEQ ID NO: 577271 - DNA, 25 bp, Rattus norvegicus
agcatttcgccgcatacaacagttg

SEQ ID NO: 577272 - DNA, 25 bp, Rattus norvegicus
tacaacagttgtccgggcaggctaa

SEQ ID NO: 577273 - DNA, 25 bp, Rattus norvegicus
caaacgacatgtttcgttgacgagg

SEQ ID NO: 577274 - DNA, 25 bp, Rattus norvegicus
cttggatggatatttactgtgctga

SEQ ID NO: 577275 - DNA, 25 bp, Rattus norvegicus
cgacgtagacgttagctcagttggc

SEQ ID NO: 577276 - DNA, 25 bp, Rattus norvegicus
ggggctgcttctcgatacacaggca

SEQ ID NO: 577277 - DNA, 25 bp, Rattus norvegicus
tccttcggacggtaagatggtgatg

SEQ ID NO: 577278 - DNA, 25 bp, Rattus norvegicus
atgaagatacatccgggctccttgg

SEQ ID NO: 577279 - DNA, 25 bp, Rattus norvegicus
ggcacggcgtgaccattaattacca

SEQ ID NO: 577280 - DNA, 25 bp, Rattus norvegicus
tctcctggcagtggaaccgacgtag

SEQ ID NO: 577281 - DNA, 25 bp, Rattus norvegicus
gggaacgctgaagaagtgcacactc

SEQ ID NO: 577282 - DNA, 25 bp, Rattus norvegicus
gtgcacactcggtagccgtcatagg

SEQ ID NO: 577283 - DNA, 25 bp, Rattus norvegicus
gccgtcataggtacgccagccagta

SEQ ID NO: 577284 - DNA, 25 bp, Rattus norvegicus
agccagtacggcgactcctgagata

SEQ ID NO: 577285 - DNA, 25 bp, Rattus norvegicus
ctcctgagataagcggctggctcca

SEQ ID NO: 577286 - DNA, 25 bp, Rattus norvegicus
ctggctccattgctcagagaacttc

SEQ ID NO: 577287 - DNA, 25 bp, Rattus norvegicus
actctgggcttctgccatgtgtctc

SEQ ID NO: 577288 - DNA, 25 bp, Rattus norvegicus
cgaagttcccgacctgctctacaga

SEQ ID NO: 577289 - DNA, 25 bp, Rattus norvegicus
atcgagctactccttaccttgagga

SEQ ID NO: 577290 - DNA, 25 bp, Rattus norvegicus
ttgccctcagcgacccagagtcggg

SEQ ID NO: 577291 - DNA, 25 bp, Rattus norvegicus
gcggagcagaaacccagaacgcgca

SEQ ID NO: 577292 - DNA, 25 bp, Rattus norvegicus
atgggagcccttgccagtcgctcag

SEQ ID NO: 577293 - DNA, 25 bp, Rattus norvegicus
tcgctcagcacagagcgtcagcttg

SEQ ID NO: 577294 - DNA, 25 bp, Rattus norvegicus
acgtactgggcacgatgagtcctgc

SEQ ID NO: 577295 - DNA, 25 bp, Rattus norvegicus
ccttgaggattgagccacagcctga

SEQ ID NO: 577296 - DNA, 25 bp, Rattus norvegicus
gttccagggcagcatcgagctactc

SEQ ID NO: 577297 - DNA, 25 bp, Rattus norvegicus
acagcctgagactctcggaggggca

SEQ ID NO: 577298 - DNA, 25 bp, Rattus norvegicus
aggcttctggcatcaaaggctttcc

SEQ ID NO: 577299 - DNA, 25 bp, Rattus norvegicus
aatctcctagctaccatcctggggc

SEQ ID NO: 577300 - DNA, 25 bp, Rattus norvegicus
cccgctgtttattcccggagccagg

SEQ ID NO: 577301 - DNA, 25 bp, Rattus norvegicus
actccttagtaagcaggcagcgcga

SEQ ID NO: 577302 - DNA, 25 bp, Rattus norvegicus
cggacgcgggcaacttgagaaaatc

SEQ ID NO: 577303 - DNA, 25 bp, Rattus norvegicus
gcgaaccgaagcgtgcggcttcttc

SEQ ID NO: 577304 - DNA, 25 bp, Rattus norvegicus
aggacagccggtcattttctccaga

SEQ ID NO: 577305 - DNA, 25 bp, Rattus norvegicus
cctcacaagtaggtcacacttggga

SEQ ID NO: 577306 - DNA, 25 bp, Rattus norvegicus
ttgggagccttcatctcgaacgagc

SEQ ID NO: 577307 - DNA, 25 bp, Rattus norvegicus
ctctaggagacgaacgtggaggctc

SEQ ID NO: 577308 - DNA, 25 bp, Rattus norvegicus
gtcaacccggtctgtagggtgatta

SEQ ID NO: 577309 - DNA, 25 bp, Rattus norvegicus
tgcggggaaaagacttctgcgaatc

SEQ ID NO: 577310 - DNA, 25 bp, Rattus norvegicus
tccagatcgggaggttagaagctcg

SEQ ID NO: 577311 - DNA, 25 bp, Rattus norvegicus
tagcgtccgaccgttcagcgcggag

SEQ ID NO: 577312 - DNA, 25 bp, Rattus norvegicus
gactcctcccgagcagcaagaggga

SEQ ID NO: 577313 - DNA, 25 bp, Rattus norvegicus
ctgcttcccgaaccgccattttgaa

SEQ ID NO: 577314 - DNA, 25 bp, Rattus norvegicus
tgattctgaggaaccgagagcgagc

SEQ ID NO: 577315 - DNA, 25 bp, Rattus norvegicus
aggcgacttggaggagagctaacac

SEQ ID NO: 577316 - DNA, 25 bp, Rattus norvegicus
acgcggccataagcacggaggcctg

SEQ ID NO: 577317 - DNA, 25 bp, Rattus norvegicus
tggagccgcgagtctttacctcaga

SEQ ID NO: 577318 - DNA, 25 bp, Rattus norvegicus
ccgaaaagcacggatgacccagcta

SEQ ID NO: 577319 - DNA, 25 bp, Rattus norvegicus
cccagctacttgagtcccgaaaagg

SEQ ID NO: 577320 - DNA, 25 bp, Rattus norvegicus
gcactaactgtatgagcctgttaca

SEQ ID NO: 577321 - DNA, 25 bp, Rattus norvegicus
taaaggcggtgatttgcactaactg

SEQ ID NO: 577322 - DNA, 25 bp, Rattus norvegicus
ctgaggtaagttcccagccggtggt

SEQ ID NO: 577323 - DNA, 25 bp, Rattus norvegicus
tgcacgttaccggtctctcaaaggc

SEQ ID NO: 577324 - DNA, 25 bp, Rattus norvegicus
aatcttttccggagcgggatctgcc

SEQ ID NO: 577325 - DNA, 25 bp, Rattus norvegicus
gatgggagcctggataatcttttcc

SEQ ID NO: 577326 - DNA, 25 bp, Rattus norvegicus
aatgtccgccactgcgcaaactcgg

SEQ ID NO: 577327 - DNA, 25 bp, Rattus norvegicus
tacctcagagcgctagccaggaggc

SEQ ID NO: 577328 - DNA, 25 bp, Rattus norvegicus
gcgcaagcagcaacccgcagggttc

SEQ ID NO: 577329 - DNA, 25 bp, Rattus norvegicus
gggtctgtccgtccttgcacgttac

SEQ ID NO: 577330 - DNA, 25 bp, Rattus norvegicus
cgacgagtgagaaagcccacggccc

SEQ ID NO: 577331 - DNA, 25 bp, Rattus norvegicus
actgccatgtggttgtcaccgacgc

SEQ ID NO: 577332 - DNA, 25 bp, Rattus norvegicus
gcgaacacggagagaacaatcgttc

SEQ ID NO: 577333 - DNA, 25 bp, Rattus norvegicus
ctgcaccttctggagctcctgggct

SEQ ID NO: 577334 - DNA, 25 bp, Rattus norvegicus
tcacctgctaccatgcctttggcgg

SEQ ID NO: 577335 - DNA, 25 bp, Rattus norvegicus
cacgacggtaagagacgggtcaaga

SEQ ID NO: 577336 - DNA, 25 bp, Rattus norvegicus
ggtcaagatcttcgattccggagga

SEQ ID NO: 577337 - DNA, 25 bp, Rattus norvegicus
gaggtgcacaccagtttggagagaa

SEQ ID NO: 577338 - DNA, 25 bp, Rattus norvegicus
cgcagcgcatgacgtgaagtaccca

SEQ ID NO: 577339 - DNA, 25 bp, Rattus norvegicus
tcgcggtcaccaacgactgccatgt

SEQ ID NO: 577340 - DNA, 25 bp, Rattus norvegicus
atgcggaccattgcgtcgtgcgtcc

SEQ ID NO: 577341 - DNA, 25 bp, Rattus norvegicus
attgggatctcccacccgtgacgcg

SEQ ID NO: 577342 - DNA, 25 bp, Rattus norvegicus
aagtacccactggatgtcgcggtca

SEQ ID NO: 577343 - DNA, 25 bp, Rattus norvegicus
gcgagacgtgtctcaagctctaata

SEQ ID NO: 577344 - DNA, 25 bp, Rattus norvegicus
gccgagcttgtgacaccagcgattg

SEQ ID NO: 577345 - DNA, 25 bp, Rattus norvegicus
tcaaattcatttctagcctcggctc

SEQ ID NO: 577346 - DNA, 25 bp, Rattus norvegicus
acttcagctcaaaggaggggtctcc

SEQ ID NO: 577347 - DNA, 25 bp, Rattus norvegicus
tggtggtccatttcaaattcatttc

SEQ ID NO: 577348 - DNA, 25 bp, Rattus norvegicus
gaggggtctccttctccaggcccag

SEQ ID NO: 577349 - DNA, 25 bp, Rattus norvegicus
gagcccgatcgcctttgcagggcac

SEQ ID NO: 577350 - DNA, 25 bp, Rattus norvegicus
ggaaccgctcgcctttgtaaagcgc

SEQ ID NO: 577351 - DNA, 25 bp, Rattus norvegicus
ttctcggtctgcagcggccttacat

SEQ ID NO: 577352 - DNA, 25 bp, Rattus norvegicus
agcgcgccgccaacatgtcggatac

SEQ ID NO: 577353 - DNA, 25 bp, Rattus norvegicus
tgtcggatacgaaggtaaaagttgc

SEQ ID NO: 577354 - DNA, 25 bp, Rattus norvegicus
tgaaccgaagaggtgagccactttc

SEQ ID NO: 577355 - DNA, 25 bp, Rattus norvegicus
ttttgcatttctgctccggccgagg

SEQ ID NO: 577356 - DNA, 25 bp, Rattus norvegicus
caactttgcaaactgcaggggcagc

SEQ ID NO: 577357 - DNA, 25 bp, Rattus norvegicus
atggtgtggactaggcctgcgcacc

SEQ ID NO: 577358 - DNA, 25 bp, Rattus norvegicus
ttaaaataccgctgcaaagctcagt

SEQ ID NO: 577359 - DNA, 25 bp, Rattus norvegicus
tgctagccgtcttcttcgcgctcgg

SEQ ID NO: 577360 - DNA, 25 bp, Rattus norvegicus
ctgctgctcatcgtcatgggcgcct

SEQ ID NO: 577361 - DNA, 25 bp, Rattus norvegicus
agctgcggacacaggaaaagtttcc

SEQ ID NO: 577362 - DNA, 25 bp, Rattus norvegicus
ccgctcatcgtcttcctgctgctca

SEQ ID NO: 577363 - DNA, 25 bp, Rattus norvegicus
tactactgcatgagccagcagcacc

SEQ ID NO: 577364 - DNA, 25 bp, Rattus norvegicus
tacgagtcctactactgcatgagcc

SEQ ID NO: 577365 - DNA, 25 bp, Rattus norvegicus
cccgggactggctctacgagtccta

SEQ ID NO: 577366 - DNA, 25 bp, Rattus norvegicus
ggctttgcccaaaataaagttgcca

SEQ ID NO: 577367 - DNA, 25 bp, Rattus norvegicus
tgcccaaaataaagttgccagggtg

SEQ ID NO: 577368 - DNA, 25 bp, Rattus norvegicus
gtgtgggttcagcatctctgcgccc

SEQ ID NO: 577369 - DNA, 25 bp, Rattus norvegicus
agctgcgttttctccgggcgccgct

SEQ ID NO: 577370 - DNA, 25 bp, Rattus norvegicus
cacagcagtggcagtcctccggctt

SEQ ID NO: 577371 - DNA, 25 bp, Rattus norvegicus
tgctcatcgtcatgggcgcctgcct

SEQ ID NO: 577372 - DNA, 25 bp, Rattus norvegicus
ctcccatccctgtccgcggaacgcc

SEQ ID NO: 577373 - DNA, 25 bp, Rattus norvegicus
gtcgcttctcagtgctttgacagca

SEQ ID NO: 577374 - DNA, 25 bp, Rattus norvegicus
ttgacagcacgtcgcaacccttagg

SEQ ID NO: 577375 - DNA, 25 bp, Rattus norvegicus
cgcaacccttaggaagacgccattc

SEQ ID NO: 577376 - DNA, 25 bp, Rattus norvegicus
gtcgcctcctttctgtgcctttagg

SEQ ID NO: 577377 - DNA, 25 bp, Rattus norvegicus
tcacagaacaacagtcgcctccttt

SEQ ID NO: 577378 - DNA, 25 bp, Rattus norvegicus
taggctaccgaggagattgaggacc

SEQ ID NO: 577379 - DNA, 25 bp, Rattus norvegicus
aggaccgggagacgctggccctcct

SEQ ID NO: 577380 - DNA, 25 bp, Rattus norvegicus
ccctcctggcagctcggagtgagaa

SEQ ID NO: 577381 - DNA, 25 bp, Rattus norvegicus
ctttggatggggagacgtacatcga

SEQ ID NO: 577382 - DNA, 25 bp, Rattus norvegicus
cgtacatcgagaagtacactcgggg

SEQ ID NO: 577383 - DNA, 25 bp, Rattus norvegicus
tgtgctgcaggtcgagaacatcctg

SEQ ID NO: 577384 - DNA, 25 bp, Rattus norvegicus
aacatcctgagtctggagcggctcc

SEQ ID NO: 577385 - DNA, 25 bp, Rattus norvegicus
ggaagacgccattcacagaacaaca

SEQ ID NO: 577386 - DNA, 25 bp, Rattus norvegicus
tgcctttaggctaccgaggagattg

SEQ ID NO: 577387 - DNA, 25 bp, Rattus norvegicus
ctcaacagcggtaataggcgcaaga

SEQ ID NO: 577388 - DNA, 25 bp, Rattus norvegicus
ctatatttcccagaggcaccagcga

SEQ ID NO: 577389 - DNA, 25 bp, Rattus norvegicus
caccagcgacagagagcgcgggctc

SEQ ID NO: 577390 - DNA, 25 bp, Rattus norvegicus
catcgtcgcagcgtgatgacgcaga

SEQ ID NO: 577391 - DNA, 25 bp, Rattus norvegicus
tgaagccttaccagcaggggcgacc

SEQ ID NO: 577392 - DNA, 25 bp, Rattus norvegicus
agatccggacgcgtcgttgccacca

SEQ ID NO: 577393 - DNA, 25 bp, Rattus norvegicus
catggcctcaggagccggaggcata

SEQ ID NO: 577394 - DNA, 25 bp, Rattus norvegicus
tctcgctgtgtctgtgtgtcgccta

SEQ ID NO: 577395 - DNA, 25 bp, Rattus norvegicus
tctccatagagacggtgacaaacac

SEQ ID NO: 577396 - DNA, 25 bp, Rattus norvegicus
cctcggcgggagatctccatagaga

SEQ ID NO: 577397 - DNA, 25 bp, Rattus norvegicus
cagggccgctgaagaggagcctcca

SEQ ID NO: 577398 - DNA, 25 bp, Rattus norvegicus
cgacgacgactgcagggacgacgac

SEQ ID NO: 577399 - DNA, 25 bp, Rattus norvegicus
gagaatccgcgctcttgccagaaaa

SEQ ID NO: 577400 - DNA, 25 bp, Rattus norvegicus
caacaccaggtacgggaccagcacg

SEQ ID NO: 577401 - DNA, 25 bp, Rattus norvegicus
cggcgcccaggtacaacactttgga

SEQ ID NO: 577402 - DNA, 25 bp, Rattus norvegicus
tccgatgagcatgcgatacttgagc

SEQ ID NO: 577403 - DNA, 25 bp, Rattus norvegicus
cgggcatcttccaataccgggatga

SEQ ID NO: 577404 - DNA, 25 bp, Rattus norvegicus
gcgcttcttggccacgttgaccaga

SEQ ID NO: 577405 - DNA, 25 bp, Rattus norvegicus
attcaaccgcgtagaccaggccgtc

SEQ ID NO: 577406 - DNA, 25 bp, Rattus norvegicus
accgagacgccaggcaccatgttca

SEQ ID NO: 577407 - DNA, 25 bp, Rattus norvegicus
ccatgttcagcgtgaccagagcgtc

SEQ ID NO: 577408 - DNA, 25 bp, Rattus norvegicus
cgcggtagatgaacacaccctcgtg

SEQ ID NO: 577409 - DNA, 25 bp, Rattus norvegicus
tccacggacacggtgatgcccttct

SEQ ID NO: 577410 - DNA, 25 bp, Rattus norvegicus
gatgcccttcttgcgccgattcttg

SEQ ID NO: 577411 - DNA, 25 bp, Rattus norvegicus
tcggcgaagatcacgtccaccattc

SEQ ID NO: 577412 - DNA, 25 bp, Rattus norvegicus
acgcggtgacttgcgtgattgcatc

SEQ ID NO: 577413 - DNA, 25 bp, Rattus norvegicus
ccggatccacgctttgacgcggtga

SEQ ID NO: 577414 - DNA, 25 bp, Rattus norvegicus
gtgattgcatcacagccgttctgta

SEQ ID NO: 577415 - DNA, 25 bp, Rattus norvegicus
aacaacgtgtgcgatgctgagtacg

SEQ ID NO: 577416 - DNA, 25 bp, Rattus norvegicus
taacgtaacgtatcgcagcatagta

SEQ ID NO: 577417 - DNA, 25 bp, Rattus norvegicus
tcgcagcatagtataacaacgtgtg

SEQ ID NO: 577418 - DNA, 25 bp, Rattus norvegicus
tggttcctagttacgcgccgtctct

SEQ ID NO: 577419 - DNA, 25 bp, Rattus norvegicus
ggtgtttctttgtgagtggttccta

SEQ ID NO: 577420 - DNA, 25 bp, Rattus norvegicus
tcaacaatccgtcgccggaagcgga

SEQ ID NO: 577421 - DNA, 25 bp, Rattus norvegicus
agcagcgggcgtcaacaatccgtcg

SEQ ID NO: 577422 - DNA, 25 bp, Rattus norvegicus
cattcgtgcacctgccgcgagtact

SEQ ID NO: 577423 - DNA, 25 bp, Rattus norvegicus
taggattgccacagccattcgtgca

SEQ ID NO: 577424 - DNA, 25 bp, Rattus norvegicus
tgaggtagccgcagtaggattgcca

SEQ ID NO: 577425 - DNA, 25 bp, Rattus norvegicus
gtggcatattcggtaacgtaacgta

SEQ ID NO: 577426 - DNA, 25 bp, Rattus norvegicus
cgccgcagcgcttaggaagtagaag

SEQ ID NO: 577427 - DNA, 25 bp, Rattus norvegicus
gcagagcccaccctggtcacaggga

SEQ ID NO: 577428 - DNA, 25 bp, Rattus norvegicus
cgccgtctctctggttcttctgttg

SEQ ID NO: 577429 - DNA, 25 bp, Rattus norvegicus
cgtaggcggctccagtgtaatctat

SEQ ID NO: 577430 - DNA, 25 bp, Rattus norvegicus
agcagcagccgttccgggcgcagca

SEQ ID NO: 577431 - DNA, 25 bp, Rattus norvegicus
gtaatctatgtacggtgtggtggaa

SEQ ID NO: 577432 - DNA, 25 bp, Rattus norvegicus
gctccagtgtaatctatgtacggtg

SEQ ID NO: 577433 - DNA, 25 bp, Rattus norvegicus
aggcggctccagtgtaatctatgta

SEQ ID NO: 577434 - DNA, 25 bp, Rattus norvegicus
cgagtactgtgcgtaggcggctcca

SEQ ID NO: 577435 - DNA, 25 bp, Rattus norvegicus
gtactggtcataggcagcagccgcc

SEQ ID NO: 577436 - DNA, 25 bp, Rattus norvegicus
cgatgctgcatatgggtactggtca

SEQ ID NO: 577437 - DNA, 25 bp, Rattus norvegicus
cagctggcgatgctgcatatgggta

SEQ ID NO: 577438 - DNA, 25 bp, Rattus norvegicus
gtcacatagcctgtggcagctggcg

SEQ ID NO: 577439 - DNA, 25 bp, Rattus norvegicus
cccagtggtcacatagcctgtggca

SEQ ID NO: 577440 - DNA, 25 bp, Rattus norvegicus
ggcatagctgtagcccccagtggtc

SEQ ID NO: 577441 - DNA, 25 bp, Rattus norvegicus
tgggtactggtcataggcagcagcc

SEQ ID NO: 577442 - DNA, 25 bp, Rattus norvegicus
ctgctggacggcatagctgtagccc

SEQ ID NO: 577443 - DNA, 25 bp, Rattus norvegicus
tgtccttctgggtggtgtgcatctt

SEQ ID NO: 577444 - DNA, 25 bp, Rattus norvegicus
gagctgccacaccagtgcggactga

SEQ ID NO: 577445 - DNA, 25 bp, Rattus norvegicus
gaccgtccctcctgcttaggagctg

SEQ ID NO: 577446 - DNA, 25 bp, Rattus norvegicus
aaaggggttggctcagaggctacct

SEQ ID NO: 577447 - DNA, 25 bp, Rattus norvegicus
ttctcagaaaatcgagtggctgggg

SEQ ID NO: 577448 - DNA, 25 bp, Rattus norvegicus
gaggtagatgttcctttctcagaaa

SEQ ID NO: 577449 - DNA, 25 bp, Rattus norvegicus
ccaagtccaaaagaggtagatgttc

SEQ ID NO: 577450 - DNA, 25 bp, Rattus norvegicus
tgcggactgaggaccgctctccaac

SEQ ID NO: 577451 - DNA, 25 bp, Rattus norvegicus
gatcgtccgggtaaccagctccgta

SEQ ID NO: 577452 - DNA, 25 bp, Rattus norvegicus
cctcgaagtacttgcgcaggctggc

SEQ ID NO: 577453 - DNA, 25 bp, Rattus norvegicus
gtctccgaagacctcgaagtacttg

SEQ ID NO: 577454 - DNA, 25 bp, Rattus norvegicus
gagagtcctccttccgcataactta

SEQ ID NO: 577455 - DNA, 25 bp, Rattus norvegicus
tagccgcggattgtgcaagcctttt

SEQ ID NO: 577456 - DNA, 25 bp, Rattus norvegicus
cttggtgtacgtcgtgtccttctgg

SEQ ID NO: 577457 - DNA, 25 bp, Rattus norvegicus
tgcgctcgccgtgctctgtgcggct

SEQ ID NO: 577458 - DNA, 25 bp, Rattus norvegicus
gcaccgatcggtcaccactccaatg

SEQ ID NO: 577459 - DNA, 25 bp, Rattus norvegicus
ccctttctcaaacctggaaggcaca

SEQ ID NO: 577460 - DNA, 25 bp, Rattus norvegicus
tggaaggcacagttccctccggtcg

SEQ ID NO: 577461 - DNA, 25 bp, Rattus norvegicus
ggcacagttccctccggtcggtgtc

SEQ ID NO: 577462 - DNA, 25 bp, Rattus norvegicus
cagcccgggtgcatagaagggttaa

SEQ ID NO: 577463 - DNA, 25 bp, Rattus norvegicus
cccatgaagtcggatccttgagctg

SEQ ID NO: 577464 - DNA, 25 bp, Rattus norvegicus
tgaagtcggatccttgagctgcggc

SEQ ID NO: 577465 - DNA, 25 bp, Rattus norvegicus
cggcggcagccaactgctccatatt

SEQ ID NO: 577466 - DNA, 25 bp, Rattus norvegicus
tgctccatatttggcttctattaca

SEQ ID NO: 577467 - DNA, 25 bp, Rattus norvegicus
ttggcttctattacacatttacata

SEQ ID NO: 577468 - DNA, 25 bp, Rattus norvegicus
tacacatttacatactggagcgagc

SEQ ID NO: 577469 - DNA, 25 bp, Rattus norvegicus
tttacatactggagcgagcgagcga

SEQ ID NO: 577470 - DNA, 25 bp, Rattus norvegicus
ctggagtcgcagttgcggagagaca

SEQ ID NO: 577471 - DNA, 25 bp, Rattus norvegicus
tgcggccgcttcctgatccaaagca

SEQ ID NO: 577472 - DNA, 25 bp, Rattus norvegicus
gcgctgccctcttcactcctcaaca

SEQ ID NO: 577473 - DNA, 25 bp, Rattus norvegicus
tcgcctagcttgagagaggcaaccc

SEQ ID NO: 577474 - DNA, 25 bp, Rattus norvegicus
cttgagagaggcaaccccgagcttg

SEQ ID NO: 577475 - DNA, 25 bp, Rattus norvegicus
ccaggccagcgtctcggggccagga

SEQ ID NO: 577476 - DNA, 25 bp, Rattus norvegicus
gccatcgcagcgcagtgggagaggc

SEQ ID NO: 577477 - DNA, 25 bp, Rattus norvegicus
ggagggtcgcgctgccctcttcact

SEQ ID NO: 577478 - DNA, 25 bp, Rattus norvegicus
ccaccgccgccctgttggtgcggcc

SEQ ID NO: 577479 - DNA, 25 bp, Rattus norvegicus
cctcctccttccgtgtggcgtaggg

SEQ ID NO: 577480 - DNA, 25 bp, Rattus norvegicus
ggccgcttcctgatccaaagcagca

SEQ ID NO: 577481 - DNA, 25 bp, Rattus norvegicus
gcttcctgatccaaagcagcagcag

SEQ ID NO: 577482 - DNA, 25 bp, Rattus norvegicus
cgcccgcggcagtagcggaggagct

SEQ ID NO: 577483 - DNA, 25 bp, Rattus norvegicus
ctgcgccgggactgctctcctgcgc

SEQ ID NO: 577484 - DNA, 25 bp, Rattus norvegicus
ggaccggccctagctgcagccgcca

SEQ ID NO: 577485 - DNA, 25 bp, Rattus norvegicus
aagagcggagcaatgaatgcctgcc

SEQ ID NO: 577486 - DNA, 25 bp, Rattus norvegicus
gacggcgaaaaatgaaatctaacca

SEQ ID NO: 577487 - DNA, 25 bp, Rattus norvegicus
cctccgaggagaaggccactgctct

SEQ ID NO: 577488 - DNA, 25 bp, Rattus norvegicus
caccagtcggccctccgaggagaag

SEQ ID NO: 577489 - DNA, 25 bp, Rattus norvegicus
atgaatgcctgcctcccaagaaacg

SEQ ID NO: 577490 - DNA, 25 bp, Rattus norvegicus
gccctccgaggagaaggccactgct

SEQ ID NO: 577491 - DNA, 25 bp, Rattus norvegicus
tgcctcccaagaaacgtgagatccc

SEQ ID NO: 577492 - DNA, 25 bp, Rattus norvegicus
aatgaaatctaaccaagagcggagc

SEQ ID NO: 577493 - DNA, 25 bp, Rattus norvegicus
taaccaagagcggagcaatgaatgc

SEQ ID NO: 577494 - DNA, 25 bp, Rattus norvegicus
cagcgacaaccactgcgtggagggt

SEQ ID NO: 577495 - DNA, 25 bp, Rattus norvegicus
tgcccagcgacaaccactgcgtgga

SEQ ID NO: 577496 - DNA, 25 bp, Rattus norvegicus
ggccactgctctgcccagcgacaac

SEQ ID NO: 577497 - DNA, 25 bp, Rattus norvegicus
tgcctgcctcccaagaaacgtgaga

SEQ ID NO: 577498 - DNA, 25 bp, Rattus norvegicus
gaatgcctgcctcccaagaaacgtg

SEQ ID NO: 577499 - DNA, 25 bp, Rattus norvegicus
acaccgtgttcttatgcccgtgcgc

SEQ ID NO: 577500 - DNA, 25 bp, Rattus norvegicus
cgcacaccgtgttcttatgcccgtg

SEQ ID NO: 577501 - DNA, 25 bp, Rattus norvegicus
actgatgctccgtgagcccggtgcg

SEQ ID NO: 577502 - DNA, 25 bp, Rattus norvegicus
tgcgcagactgatgctccgtgagcc

SEQ ID NO: 577503 - DNA, 25 bp, Rattus norvegicus
atggctgtgcgcagactgatgctcc

SEQ ID NO: 577504 - DNA, 25 bp, Rattus norvegicus
tcaggtccgcgtctatgcggggcat

SEQ ID NO: 577505 - DNA, 25 bp, Rattus norvegicus
aagtcgagtttcaggtccgcgtcta

SEQ ID NO: 577506 - DNA, 25 bp, Rattus norvegicus
cagaacatccttgaagtcgagtttc

SEQ ID NO: 577507 - DNA, 25 bp, Rattus norvegicus
gtcgcagcagaacatccttgaagtc

SEQ ID NO: 577508 - DNA, 25 bp, Rattus norvegicus
tttaggtcgcagcagaacatccttg

SEQ ID NO: 577509 - DNA, 25 bp, Rattus norvegicus
gctccgtttaggtcgcagcagaaca

SEQ ID NO: 577510 - DNA, 25 bp, Rattus norvegicus
tcttgaggctgctccgtttaggtcg

SEQ ID NO: 577511 - DNA, 25 bp, Rattus norvegicus
acctcggatcggctcttgaggctgc

SEQ ID NO: 577512 - DNA, 25 bp, Rattus norvegicus
gcccggtgcgcacaccgtgttctta

SEQ ID NO: 577513 - DNA, 25 bp, Rattus norvegicus
tcacctggttgagacagtcctcgcc

SEQ ID NO: 577514 - DNA, 25 bp, Rattus norvegicus
gccggtcttcaccaatcactgcgtg

SEQ ID NO: 577515 - DNA, 25 bp, Rattus norvegicus
cttcccggtaatgagcagggatccc

SEQ ID NO: 577516 - DNA, 25 bp, Rattus norvegicus
gtactgtgatcaaacgctcctgcga

SEQ ID NO: 577517 - DNA, 25 bp, Rattus norvegicus
cggctccggaggagcatccctgagc

SEQ ID NO: 577518 - DNA, 25 bp, Rattus norvegicus
gctccggcagccaataatcagtctc

SEQ ID NO: 577519 - DNA, 25 bp, Rattus norvegicus
ccgctacaggcactcgtcttttata

SEQ ID NO: 577520 - DNA, 25 bp, Rattus norvegicus
acgacagccagttcccgggagctac

SEQ ID NO: 577521 - DNA, 25 bp, Rattus norvegicus
tgcaattgctccaagtcggctccgg

SEQ ID NO: 577522 - DNA, 25 bp, Rattus norvegicus
gggctgtcgcctcactgcaattgct

SEQ ID NO: 577523 - DNA, 25 bp, Rattus norvegicus
cggcctcgtcacatagcacagcatg

SEQ ID NO: 577524 - DNA, 25 bp, Rattus norvegicus
agtcctcgccgttggcttttgcctc

SEQ ID NO: 577525 - DNA, 25 bp, Rattus norvegicus
tcctatcactgccatcacctggttg

SEQ ID NO: 577526 - DNA, 25 bp, Rattus norvegicus
ctgtcccggtttgagagtactgtga

SEQ ID NO: 577527 - DNA, 25 bp, Rattus norvegicus
atgagcagtgttcccagacggtatc

SEQ ID NO: 577528 - DNA, 25 bp, Rattus norvegicus
tgagcctacacttgtcgcgttgcga

SEQ ID NO: 577529 - DNA, 25 bp, Rattus norvegicus
cagtgggaatgacgtctctgagtcc

SEQ ID NO: 577530 - DNA, 25 bp, Rattus norvegicus
tcccagacggtatctgagaaaaacg

SEQ ID NO: 577531 - DNA, 25 bp, Rattus norvegicus
gctccgagccacgtccgggacagga

SEQ ID NO: 577532 - DNA, 25 bp, Rattus norvegicus
cctattggtgatcgtgcagagcatg

SEQ ID NO: 577533 - DNA, 25 bp, Rattus norvegicus
aggtcctccagcattcctattggtg

SEQ ID NO: 577534 - DNA, 25 bp, Rattus norvegicus
gcactcagcgattggcccaggtcct

SEQ ID NO: 577535 - DNA, 25 bp, Rattus norvegicus
gccctcattcggcactcagcgattg

SEQ ID NO: 577536 - DNA, 25 bp, Rattus norvegicus
cttacctgtaggacattttggcgcg

SEQ ID NO: 577537 - DNA, 25 bp, Rattus norvegicus
cgggacaggaccaacgcagaacttc

SEQ ID NO: 577538 - DNA, 25 bp, Rattus norvegicus
cggaacttaccgagcggctccgagc

SEQ ID NO: 577539 - DNA, 25 bp, Rattus norvegicus
cggaacccacggagtacgctggagc

SEQ ID NO: 577540 - DNA, 25 bp, Rattus norvegicus
cgcggaattcgcaccaggaggtact

SEQ ID NO: 577541 - DNA, 25 bp, Rattus norvegicus
cctgcttaacctgttgctctcgaga

SEQ ID NO: 577542 - DNA, 25 bp, Rattus norvegicus
tctgggccggctgcgtccggaacac

SEQ ID NO: 577543 - DNA, 25 bp, Rattus norvegicus
cggccagagcacaacccagagtctg

SEQ ID NO: 577544 - DNA, 25 bp, Rattus norvegicus
gccaagctcagccttgtgctctgcg

SEQ ID NO: 577545 - DNA, 25 bp, Rattus norvegicus
cagagccgccaagctcagccttgtg

SEQ ID NO: 577546 - DNA, 25 bp, Rattus norvegicus
gttgctctcgagaccgcgccggagc

SEQ ID NO: 577547 - DNA, 25 bp, Rattus norvegicus
tgggttcccacagcagcaactcacg

SEQ ID NO: 577548 - DNA, 25 bp, Rattus norvegicus
gcgcgctgacttacctcctgcttaa

SEQ ID NO: 577549 - DNA, 25 bp, Rattus norvegicus
aggctcaaggcaaaagaaggccgcg

SEQ ID NO: 577550 - DNA, 25 bp, Rattus norvegicus
ggaggaccgaggaactaaagccaca

SEQ ID NO: 577551 - DNA, 25 bp, Rattus norvegicus
cacaatgacaacagagcggcagctc

SEQ ID NO: 577552 - DNA, 25 bp, Rattus norvegicus
tgtgacgtcacaatgacaacagagc

SEQ ID NO: 577553 - DNA, 25 bp, Rattus norvegicus
gcccgacttttgacatcacggagga

SEQ ID NO: 577554 - DNA, 25 bp, Rattus norvegicus
cggcttagagatgccagagccgcca

SEQ ID NO: 577555 - DNA, 25 bp, Rattus norvegicus
gaagtgtctagttttggccggaagc

SEQ ID NO: 577556 - DNA, 25 bp, Rattus norvegicus
tcgccaccgcatgtggaagccactg

SEQ ID NO: 577557 - DNA, 25 bp, Rattus norvegicus
tccaggagacactgcgagagaagcc

SEQ ID NO: 577558 - DNA, 25 bp, Rattus norvegicus
ccctagcgggatccaggagacactg

SEQ ID NO: 577559 - DNA, 25 bp, Rattus norvegicus
agcggaaattcctaccctggtcatt

SEQ ID NO: 577560 - DNA, 25 bp, Rattus norvegicus
cggggcagcatggtttcgcaagccc

SEQ ID NO: 577561 - DNA, 25 bp, Rattus norvegicus
cacatgccaagtagccggaagcgga

SEQ ID NO: 577562 - DNA, 25 bp, Rattus norvegicus
tcgtcagcgactcacatgccaagta

SEQ ID NO: 577563 - DNA, 25 bp, Rattus norvegicus
agaccgtccatcctttcgtcagcga

SEQ ID NO: 577564 - DNA, 25 bp, Rattus norvegicus
gcggagcactgagccaccagaccgt

SEQ ID NO: 577565 - DNA, 25 bp, Rattus norvegicus
aaacctgctgcagcaaccgcgcgga

SEQ ID NO: 577566 - DNA, 25 bp, Rattus norvegicus
ccagggacaaacctgctgcagcaac

SEQ ID NO: 577567 - DNA, 25 bp, Rattus norvegicus
gaagccactgagtgccttgacccgc

SEQ ID NO: 577568 - DNA, 25 bp, Rattus norvegicus
cattgttttcggtcgttcagggcgc

SEQ ID NO: 577569 - DNA, 25 bp, Rattus norvegicus
ccatgccgagcccagtcctggaatt

SEQ ID NO: 577570 - DNA, 25 bp, Rattus norvegicus
ggaatcctcggtgcgaactcgctga

SEQ ID NO: 577571 - DNA, 25 bp, Rattus norvegicus
ggccacgcaccaagaggaatcctcg

SEQ ID NO: 577572 - DNA, 25 bp, Rattus norvegicus
gcttggagcgggtcctaagcaaaaa

SEQ ID NO: 577573 - DNA, 25 bp, Rattus norvegicus
gaaccgcctgtggaatcgaggaatc

SEQ ID NO: 577574 - DNA, 25 bp, Rattus norvegicus
acgtgtcccgcgtgcgacactgcta

SEQ ID NO: 577575 - DNA, 25 bp, Rattus norvegicus
tgccaacaaacgcttggacgtgtcc

SEQ ID NO: 577576 - DNA, 25 bp, Rattus norvegicus
ctatggccacggaagctaagaacta

SEQ ID NO: 577577 - DNA, 25 bp, Rattus norvegicus
gtcccttgactacaaaatggctatg

SEQ ID NO: 577578 - DNA, 25 bp, Rattus norvegicus
aacagtcgccgcatgcaagccttcg

SEQ ID NO: 577579 - DNA, 25 bp, Rattus norvegicus
tcaatgcatggcacgctcggtcgct

SEQ ID NO: 577580 - DNA, 25 bp, Rattus norvegicus
aggctccctagctcaatgcatggca

SEQ ID NO: 577581 - DNA, 25 bp, Rattus norvegicus
tcctggaattgagagaggctcccta

SEQ ID NO: 577582 - DNA, 25 bp, Rattus norvegicus
tgtcacctcaggacagcgcccgtgt

SEQ ID NO: 577583 - DNA, 25 bp, Rattus norvegicus
tgtagacacgcagcacggcactgcc

SEQ ID NO: 577584 - DNA, 25 bp, Rattus norvegicus
ccaatgacagcgctagtcaagtggc

SEQ ID NO: 577585 - DNA, 25 bp, Rattus norvegicus
ctgctggaagactggaaaacttttg

SEQ ID NO: 577586 - DNA, 25 bp, Rattus norvegicus
gaaactgtttctccgagctcgtgac

SEQ ID NO: 577587 - DNA, 25 bp, Rattus norvegicus
gctcgtgacaacaaatgcatgcctt

SEQ ID NO: 577588 - DNA, 25 bp, Rattus norvegicus
tgcatgccttgcaaatcatcccggg

SEQ ID NO: 577589 - DNA, 25 bp, Rattus norvegicus
gacagttagcagcatccagcagagg

SEQ ID NO: 577590 - DNA, 25 bp, Rattus norvegicus
gactcaaggcctgggcgcatctgct

SEQ ID NO: 577591 - DNA, 25 bp, Rattus norvegicus
tcacgtgggttagcaacaggcagca

SEQ ID NO: 577592 - DNA, 25 bp, Rattus norvegicus
acttttgccaggctggtcttgcgca

SEQ ID NO: 577593 - DNA, 25 bp, Rattus norvegicus
gctgcatcgcggacgacagttagca

SEQ ID NO: 577594 - DNA, 25 bp, Rattus norvegicus
ggctaggcagcagcgcacgtccgca

SEQ ID NO: 577595 - DNA, 25 bp, Rattus norvegicus
acgtccgcaggaacgcactaggcta

SEQ ID NO: 577596 - DNA, 25 bp, Rattus norvegicus
atcatcccgggacatcggcgtttcc

SEQ ID NO: 577597 - DNA, 25 bp, Rattus norvegicus
ctgtgcacggcaagtcggccgtttc

SEQ ID NO: 577598 - DNA, 25 bp, Rattus norvegicus
atgactggagcgctgcgccactgtc

SEQ ID NO: 577599 - DNA, 25 bp, Rattus norvegicus
gccctgaggcttcggaagccgcgaa

SEQ ID NO: 577600 - DNA, 25 bp, Rattus norvegicus
ggcacgcgcgacaccagctgcatga

SEQ ID NO: 577601 - DNA, 25 bp, Rattus norvegicus
cagcagcgacaagcagctccgcgga

SEQ ID NO: 577602 - DNA, 25 bp, Rattus norvegicus
tgcggctggccagcagcgacaagca

SEQ ID NO: 577603 - DNA, 25 bp, Rattus norvegicus
cctgctcttgtacccgcgcttggga

SEQ ID NO: 577604 - DNA, 25 bp, Rattus norvegicus
gagctggaggccttgcgacatgact

SEQ ID NO: 577605 - DNA, 25 bp, Rattus norvegicus
ggccgtaccgcagcctagaagcagg

SEQ ID NO: 577606 - DNA, 25 bp, Rattus norvegicus
tgcgtaagccaaggccaccgaggcg

SEQ ID NO: 577607 - DNA, 25 bp, Rattus norvegicus
gccgtttcggagcaagccaccgtca

SEQ ID NO: 577608 - DNA, 25 bp, Rattus norvegicus
tcccagggcgctgtgcacggcaagt

SEQ ID NO: 577609 - DNA, 25 bp, Rattus norvegicus
agatagagctgcgtaagccaaggcc

SEQ ID NO: 577610 - DNA, 25 bp, Rattus norvegicus
ccttgcgacatgactggagcgctgc

SEQ ID NO: 577611 - DNA, 25 bp, Rattus norvegicus
acggtgggttggcatcagggtagcc

SEQ ID NO: 577612 - DNA, 25 bp, Rattus norvegicus
ccctcaacttggtccggacagatca

SEQ ID NO: 577613 - DNA, 25 bp, Rattus norvegicus
ggccgctttgtctctacggcacaca

SEQ ID NO: 577614 - DNA, 25 bp, Rattus norvegicus
cgggccgctttgtctctacggcaca

SEQ ID NO: 577615 - DNA, 25 bp, Rattus norvegicus
tggaaggaccgagagccactccggc

SEQ ID NO: 577616 - DNA, 25 bp, Rattus norvegicus
atcgatggaaggaccgagagccact

SEQ ID NO: 577617 - DNA, 25 bp, Rattus norvegicus
aggacggaccggaggatcgatggaa

SEQ ID NO: 577618 - DNA, 25 bp, Rattus norvegicus
gcgcgccttacctgaccagcggcgg

SEQ ID NO: 577619 - DNA, 25 bp, Rattus norvegicus
acagatcaggcggtgtagagggctc

SEQ ID NO: 577620 - DNA, 25 bp, Rattus norvegicus
cagggcgttcggtgcatccccacag

SEQ ID NO: 577621 - DNA, 25 bp, Rattus norvegicus
agccgaccctacgtcaccatggcaa

SEQ ID NO: 577622 - DNA, 25 bp, Rattus norvegicus
gccgggagcttgaacccctaaggca

SEQ ID NO: 577623 - DNA, 25 bp, Rattus norvegicus
gtcgcgcgtactggcgcgcgcctta

SEQ ID NO: 577624 - DNA, 25 bp, Rattus norvegicus
gctttgtctctacggcacacagccg

SEQ ID NO: 577625 - DNA, 25 bp, Rattus norvegicus
ggagggaggaaccacaggtcaccca

SEQ ID NO: 577626 - DNA, 25 bp, Rattus norvegicus
tgacaccggatgacacgcatactcg

SEQ ID NO: 577627 - DNA, 25 bp, Rattus norvegicus
actcggggatggacagcggctcctt

SEQ ID NO: 577628 - DNA, 25 bp, Rattus norvegicus
ggctcctgtcctccggctgcggagt

SEQ ID NO: 577629 - DNA, 25 bp, Rattus norvegicus
tgtcctccggctgcggagttccggt

SEQ ID NO: 577630 - DNA, 25 bp, Rattus norvegicus
ctgcccggcggacgaagctggctaa

SEQ ID NO: 577631 - DNA, 25 bp, Rattus norvegicus
ctcccgaggcgactcggaatcggga

SEQ ID NO: 577632 - DNA, 25 bp, Rattus norvegicus
gctaaggcctcgaggacggaccgcc

SEQ ID NO: 577633 - DNA, 25 bp, Rattus norvegicus
cctgtgacccactcggggatggaca

SEQ ID NO: 577634 - DNA, 25 bp, Rattus norvegicus
ggaggaaccacaggtcacccaagtg

SEQ ID NO: 577635 - DNA, 25 bp, Rattus norvegicus
tcacccaagtgactgggctgtggtc

SEQ ID NO: 577636 - DNA, 25 bp, Rattus norvegicus
cccgggtggcctgacaccggatgac

SEQ ID NO: 577637 - DNA, 25 bp, Rattus norvegicus
ggcctgacaccggatgacacgcata

SEQ ID NO: 577638 - DNA, 25 bp, Rattus norvegicus
acgaagctggctaaggcctcgagga

SEQ ID NO: 577639 - DNA, 25 bp, Rattus norvegicus
tctatccggccgtggatgagcagga

SEQ ID NO: 577640 - DNA, 25 bp, Rattus norvegicus
ggcgactcggccctcaacgagcaag

SEQ ID NO: 577641 - DNA, 25 bp, Rattus norvegicus
tcggccctcaacgagcaagagaagg

SEQ ID NO: 577642 - DNA, 25 bp, Rattus norvegicus
tcaacgagcaagagaaggagctgca

SEQ ID NO: 577643 - DNA, 25 bp, Rattus norvegicus
taaagcgcctctatccggccgtgga

SEQ ID NO: 577644 - DNA, 25 bp, Rattus norvegicus
gctacatcggcctctcgcagaacaa

SEQ ID NO: 577645 - DNA, 25 bp, Rattus norvegicus
agttcagctacatcggcctctcgca

SEQ ID NO: 577646 - DNA, 25 bp, Rattus norvegicus
ggacaagttcagctacatcggcctc

SEQ ID NO: 577647 - DNA, 25 bp, Rattus norvegicus
cccgaaggacaagttcagctacatc

SEQ ID NO: 577648 - DNA, 25 bp, Rattus norvegicus
gtcccgcggagagatccgacggtgc

SEQ ID NO: 577649 - DNA, 25 bp, Rattus norvegicus
cctgcgggtgcactacaaaggtacg

SEQ ID NO: 577650 - DNA, 25 bp, Rattus norvegicus
cgcagaacaacctgcgggtgcacta

SEQ ID NO: 577651 - DNA, 25 bp, Rattus norvegicus
tcctggagcccgaaggacaagttca

SEQ ID NO: 577652 - DNA, 25 bp, Rattus norvegicus
cagcggcggctaaagcgcctctatc

SEQ ID NO: 577653 - DNA, 25 bp, Rattus norvegicus
cgcctccaaccttctgttcgatgaa

SEQ ID NO: 577654 - DNA, 25 bp, Rattus norvegicus
gttgcgcgagcagcaagccgtgctc

SEQ ID NO: 577655 - DNA, 25 bp, Rattus norvegicus
ccgcgaaacatgtcgaggcgcatgc

SEQ ID NO: 577656 - DNA, 25 bp, Rattus norvegicus
tgacccggaagcagacgccctcagt

SEQ ID NO: 577657 - DNA, 25 bp, Rattus norvegicus
aaggctatctgacccgtgacccgga

SEQ ID NO: 577658 - DNA, 25 bp, Rattus norvegicus
catggccaacggaaagaaggctatc

SEQ ID NO: 577659 - DNA, 25 bp, Rattus norvegicus
cggtctgagctgcaccatggccaac

SEQ ID NO: 577660 - DNA, 25 bp, Rattus norvegicus
aatacgcgacgagcgcggtctgagc

SEQ ID NO: 577661 - DNA, 25 bp, Rattus norvegicus
gtcctcctcttcgtctagtggctcg

SEQ ID NO: 577662 - DNA, 25 bp, Rattus norvegicus
ctgggcgctagcgaaagtgagttcc

SEQ ID NO: 577663 - DNA, 25 bp, Rattus norvegicus
tagcagcgttttatccctggaagaa

SEQ ID NO: 577664 - DNA, 25 bp, Rattus norvegicus
gttcgatgaacagctcctcacgccg

SEQ ID NO: 577665 - DNA, 25 bp, Rattus norvegicus
tgtttacaaagcgacacgtcccgcc

SEQ ID NO: 577666 - DNA, 25 bp, Rattus norvegicus
cctcttctcctttagcagcgtttta

SEQ ID NO: 577667 - DNA, 25 bp, Rattus norvegicus
aaggtcgctgcggtacccacccgca

SEQ ID NO: 577668 - DNA, 25 bp, Rattus norvegicus
accgactcctggtgtcgcaccccgg

SEQ ID NO: 577669 - DNA, 25 bp, Rattus norvegicus
gctgcggtacccacccgcacccagg

SEQ ID NO: 577670 - DNA, 25 bp, Rattus norvegicus
atgcggcgcgcggagccttgacaaa

SEQ ID NO: 577671 - DNA, 25 bp, Rattus norvegicus
cggagccttgacaaagctgggagcc

SEQ ID NO: 577672 - DNA, 25 bp, Rattus norvegicus
agctgggagcccgaacagggcccga

SEQ ID NO: 577673 - DNA, 25 bp, Rattus norvegicus
cgaacagggcccgagacgaacctgc

SEQ ID NO: 577674 - DNA, 25 bp, Rattus norvegicus
acagggcccgagacgaacctgcaaa

SEQ ID NO: 577675 - DNA, 25 bp, Rattus norvegicus
agggcccgagacgaacctgcaaaag

SEQ ID NO: 577676 - DNA, 25 bp, Rattus norvegicus
ggcccgagacgaacctgcaaaaggc

SEQ ID NO: 577677 - DNA, 25 bp, Rattus norvegicus
cgagacgaacctgcaaaaggcggtg

SEQ ID NO: 577678 - DNA, 25 bp, Rattus norvegicus
tgcaaaaggcggtggggacggtgca

SEQ ID NO: 577679 - DNA, 25 bp, Rattus norvegicus
ggggacggtgcaggcacgagaggtc

SEQ ID NO: 577680 - DNA, 25 bp, Rattus norvegicus
agccgcccacaaggtcgctgcggta

SEQ ID NO: 577681 - DNA, 25 bp, Rattus norvegicus
gccgcactcaggaagaagccgagga

SEQ ID NO: 577682 - DNA, 25 bp, Rattus norvegicus
cgcgctgcgagcaagcgaatatggc

SEQ ID NO: 577683 - DNA, 25 bp, Rattus norvegicus
ccgctgctgaaagatgagggcttcg

SEQ ID NO: 577684 - DNA, 25 bp, Rattus norvegicus
ccgagtcatcatcccgctgctgaaa

SEQ ID NO: 577685 - DNA, 25 bp, Rattus norvegicus
tgttcgactggagatcccggcagag

SEQ ID NO: 577686 - DNA, 25 bp, Rattus norvegicus
ggcactgcagcagtcacggcgctga

SEQ ID NO: 577687 - DNA, 25 bp, Rattus norvegicus
cctgccgctgtctccggaaaggaca

SEQ ID NO: 577688 - DNA, 25 bp, Rattus norvegicus
ggcctctgggttccattaggtacca

SEQ ID NO: 577689 - DNA, 25 bp, Rattus norvegicus
agcttcatccttagccggcctctgg

SEQ ID NO: 577690 - DNA, 25 bp, Rattus norvegicus
gcgcctggtacccttcgagcttcat

SEQ ID NO: 577691 - DNA, 25 bp, Rattus norvegicus
atggcagcagaatgagaaacctggc

SEQ ID NO: 577692 - DNA, 25 bp, Rattus norvegicus
tgacagtcaaagtcgccaactccgc

SEQ ID NO: 577693 - DNA, 25 bp, Rattus norvegicus
gaacccgggccgctgacagtcaaag

SEQ ID NO: 577694 - DNA, 25 bp, Rattus norvegicus
agcgtcacccgggagagagattctg

SEQ ID NO: 577695 - DNA, 25 bp, Rattus norvegicus
tttcggagccagtttcctgcggcta

SEQ ID NO: 577696 - DNA, 25 bp, Rattus norvegicus
cctgcggctacgtgttgttaatgga

SEQ ID NO: 577697 - DNA, 25 bp, Rattus norvegicus
aattatcttagactgggccggccgg

SEQ ID NO: 577698 - DNA, 25 bp, Rattus norvegicus
gagccgtatatttcccgcgcctgtt

SEQ ID NO: 577699 - DNA, 25 bp, Rattus norvegicus
cgcctgttcccttgtcgagtctgaa

SEQ ID NO: 577700 - DNA, 25 bp, Rattus norvegicus
tgtcgagtctgaatatgctgctgtc

SEQ ID NO: 577701 - DNA, 25 bp, Rattus norvegicus
tgctgctgtcagactcgcttaatga

SEQ ID NO: 577702 - DNA, 25 bp, Rattus norvegicus
cgcgccgctgattacagttttattt

SEQ ID NO: 577703 - DNA, 25 bp, Rattus norvegicus
tggctctatgtaaagagcgccgtta

SEQ ID NO: 577704 - DNA, 25 bp, Rattus norvegicus
agcgccgttaatttagcctctcctc

SEQ ID NO: 577705 - DNA, 25 bp, Rattus norvegicus
agcctctcctctcggtgtgtttgcg

SEQ ID NO: 577706 - DNA, 25 bp, Rattus norvegicus
tttgcgatcgccacgcctgagtgac

SEQ ID NO: 577707 - DNA, 25 bp, Rattus norvegicus
gacagcctcccgcaggggaagtcgc

SEQ ID NO: 577708 - DNA, 25 bp, Rattus norvegicus
cctgagtgactgagcgcgtccctgc

SEQ ID NO: 577709 - DNA, 25 bp, Rattus norvegicus
tcgatccagctggtggtgcggttcc

SEQ ID NO: 577710 - DNA, 25 bp, Rattus norvegicus
ctcgtgggacagtcccaatcgccga

SEQ ID NO: 577711 - DNA, 25 bp, Rattus norvegicus
gcgggtcctagagcccgagacgcgc

SEQ ID NO: 577712 - DNA, 25 bp, Rattus norvegicus
gtgcaggtaactgcgctgccccgga

SEQ ID NO: 577713 - DNA, 25 bp, Rattus norvegicus
cctctcgcagccactgccggcgccc

SEQ ID NO: 577714 - DNA, 25 bp, Rattus norvegicus
ccggcccgagtacgcggccagccag

SEQ ID NO: 577715 - DNA, 25 bp, Rattus norvegicus
cgcctctcacgctgccatgtgcgcc

SEQ ID NO: 577716 - DNA, 25 bp, Rattus norvegicus
gagtggcgcctctgtccatgcggcc

SEQ ID NO: 577717 - DNA, 25 bp, Rattus norvegicus
agaccttgccgtcgaagtcgcgcgc

SEQ ID NO: 577718 - DNA, 25 bp, Rattus norvegicus
tctatgtagtagaccttgccgtcga

SEQ ID NO: 577719 - DNA, 25 bp, Rattus norvegicus
gatcggagcactccgggtcctacct

SEQ ID NO: 577720 - DNA, 25 bp, Rattus norvegicus
tggtgcggttcctgtgatctatgta

SEQ ID NO: 577721 - DNA, 25 bp, Rattus norvegicus
tgccgggtccggatcggagcactcc

SEQ ID NO: 577722 - DNA, 25 bp, Rattus norvegicus
cggttcctgtgatctatgtagtaga

SEQ ID NO: 577723 - DNA, 25 bp, Rattus norvegicus
gagaggggcagacgttgttacacaa

SEQ ID NO: 577724 - DNA, 25 bp, Rattus norvegicus
ccgctttaacgtccgcgtgtgggtg

SEQ ID NO: 577725 - DNA, 25 bp, Rattus norvegicus
cgttgttacacaaggactgacagtc

SEQ ID NO: 577726 - DNA, 25 bp, Rattus norvegicus
aggactgacagtctctcggcggcct

SEQ ID NO: 577727 - DNA, 25 bp, Rattus norvegicus
tcggcggcctgctactaccatacag

SEQ ID NO: 577728 - DNA, 25 bp, Rattus norvegicus
agcgcctccagctttaccgctttaa

SEQ ID NO: 577729 - DNA, 25 bp, Rattus norvegicus
gcttcccgtagatgtcctctgcgca

SEQ ID NO: 577730 - DNA, 25 bp, Rattus norvegicus
gccctgacgcttatggttccgcctg

SEQ ID NO: 577731 - DNA, 25 bp, Rattus norvegicus
gtagcacagcgttcctggcctgctc

SEQ ID NO: 577732 - DNA, 25 bp, Rattus norvegicus
ctgcctcccggaactcttagtctga

SEQ ID NO: 577733 - DNA, 25 bp, Rattus norvegicus
aaccgggtgtgtttgctctactaga

SEQ ID NO: 577734 - DNA, 25 bp, Rattus norvegicus
ctctactagaggtgaagcgtgcata

SEQ ID NO: 577735 - DNA, 25 bp, Rattus norvegicus
tccgaacggagagggagacgatcac

SEQ ID NO: 577736 - DNA, 25 bp, Rattus norvegicus
tcacgtccggcgacgggagttagca

SEQ ID NO: 577737 - DNA, 25 bp, Rattus norvegicus
caaacgacacgttgttattgttgtt

SEQ ID NO: 577738 - DNA, 25 bp, Rattus norvegicus
cccggctgcagttgctgcaaatgtg

SEQ ID NO: 577739 - DNA, 25 bp, Rattus norvegicus
ttgctgcaaatgtgcttgatctcct

SEQ ID NO: 577740 - DNA, 25 bp, Rattus norvegicus
tcgagcccgggcaaattccgagacc

SEQ ID NO: 577741 - DNA, 25 bp, Rattus norvegicus
acagtggatcacaaacgacacgttg

SEQ ID NO: 577742 - DNA, 25 bp, Rattus norvegicus
tcgggggcttcatgctcagcaaata

SEQ ID NO: 577743 - DNA, 25 bp, Rattus norvegicus
tgacctcttcgagcccgggcaaatt

SEQ ID NO: 577744 - DNA, 25 bp, Rattus norvegicus
catgctcagcaaataaaaagctttc

SEQ ID NO: 577745 - DNA, 25 bp, Rattus norvegicus
agctttctttttgggcttcacggcg

SEQ ID NO: 577746 - DNA, 25 bp, Rattus norvegicus
tctttttgggcttcacggcggcgcc

SEQ ID NO: 577747 - DNA, 25 bp, Rattus norvegicus
tggcaaggcgccctgtctgcagcgc

SEQ ID NO: 577748 - DNA, 25 bp, Rattus norvegicus
tggcgcgctcgaggtcttgacctct

SEQ ID NO: 577749 - DNA, 25 bp, Rattus norvegicus
aggtcttgacctcttcgagcccggg

SEQ ID NO: 577750 - DNA, 25 bp, Rattus norvegicus
ctccttgcccagttgacagtggatc

SEQ ID NO: 577751 - DNA, 25 bp, Rattus norvegicus
ctccgtacctgctgggctcgcagga

SEQ ID NO: 577752 - DNA, 25 bp, Rattus norvegicus
gaacgaaagggaaagcgagccacaa

SEQ ID NO: 577753 - DNA, 25 bp, Rattus norvegicus
agtaaaacaggcactcccggcaaag

SEQ ID NO: 577754 - DNA, 25 bp, Rattus norvegicus
tggcccggagtaaaacaggcactcc

SEQ ID NO: 577755 - DNA, 25 bp, Rattus norvegicus
caggtggcccggagtaaaacaggca

SEQ ID NO: 577756 - DNA, 25 bp, Rattus norvegicus
ggcgcgcgccctacccggagagaaa

SEQ ID NO: 577757 - DNA, 25 bp, Rattus norvegicus
tgctgggctcgcaggaccgcagctc

SEQ ID NO: 577758 - DNA, 25 bp, Rattus norvegicus
tctctagccgcaactcctgctggag

SEQ ID NO: 577759 - DNA, 25 bp, Rattus norvegicus
gagcggcagccttgagactcctcct

SEQ ID NO: 577760 - DNA, 25 bp, Rattus norvegicus
gagagcggcagccttgagactcctc

SEQ ID NO: 577761 - DNA, 25 bp, Rattus norvegicus
aagggaaagcgagccacaaagccgg

SEQ ID NO: 577762 - DNA, 25 bp, Rattus norvegicus
agtggcaagcggctcccgcacgcag

SEQ ID NO: 577763 - DNA, 25 bp, Rattus norvegicus
gtcggcgccggcacacgcgcacaca

SEQ ID NO: 577764 - DNA, 25 bp, Rattus norvegicus
ccaggacccgccgaagtggcaagcg

SEQ ID NO: 577765 - DNA, 25 bp, Rattus norvegicus
ttcgggtcgccgacactcgaggagc

SEQ ID NO: 577766 - DNA, 25 bp, Rattus norvegicus
agaggctcaggacctgctgcaccga

SEQ ID NO: 577767 - DNA, 25 bp, Rattus norvegicus
caggccgtgaaacgaggctcatcgc

SEQ ID NO: 577768 - DNA, 25 bp, Rattus norvegicus
ccacgaggcccaggtcacgcggtga

SEQ ID NO: 577769 - DNA, 25 bp, Rattus norvegicus
tgctgcaccgacaggttgatcatcg

SEQ ID NO: 577770 - DNA, 25 bp, Rattus norvegicus
tcagcaccgtgccatgggcccagag

SEQ ID NO: 577771 - DNA, 25 bp, Rattus norvegicus
cgcgcattacccgtgaggttcctca

SEQ ID NO: 577772 - DNA, 25 bp, Rattus norvegicus
tgtgatccactcagggcactggcgc

SEQ ID NO: 577773 - DNA, 25 bp, Rattus norvegicus
cagaaacatgaactgtgatccactc

SEQ ID NO: 577774 - DNA, 25 bp, Rattus norvegicus
gggcgcttcgctcctccaggtcatt

SEQ ID NO: 577775 - DNA, 25 bp, Rattus norvegicus
tggatcctgggagctgccaattttt

SEQ ID NO: 577776 - DNA, 25 bp, Rattus norvegicus
agagcgaccgctgcgtgtggatcct

SEQ ID NO: 577777 - DNA, 25 bp, Rattus norvegicus
ttggctgctccgagggaacaacctc

SEQ ID NO: 577778 - DNA, 25 bp, Rattus norvegicus
ttgatcatcgagtggtcggcgccct

SEQ ID NO: 577779 - DNA, 25 bp, Rattus norvegicus
acgatcagcagcgtggccacgaaca

SEQ ID NO: 577780 - DNA, 25 bp, Rattus norvegicus
cggagacgccagaagtcaaccactc

SEQ ID NO: 577781 - DNA, 25 bp, Rattus norvegicus
gcgaggtccctacggccctcggaga

SEQ ID NO: 577782 - DNA, 25 bp, Rattus norvegicus
gcgtggccacgaacaccagcagagt

SEQ ID NO: 577783 - DNA, 25 bp, Rattus norvegicus
ctgagctttcctcggtgatgccggg

SEQ ID NO: 577784 - DNA, 25 bp, Rattus norvegicus
gcacaccatcagcaacaggacgatc

SEQ ID NO: 577785 - DNA, 25 bp, Rattus norvegicus
tggacacttgtccacgcaagctttc

SEQ ID NO: 577786 - DNA, 25 bp, Rattus norvegicus
ccgaggtaaccaccgtggacacttg

SEQ ID NO: 577787 - DNA, 25 bp, Rattus norvegicus
gaggccaccgagaccaccgaggtaa

SEQ ID NO: 577788 - DNA, 25 bp, Rattus norvegicus
gaactcgatcttgggaggccaccga

SEQ ID NO: 577789 - DNA, 25 bp, Rattus norvegicus
ggcatgactcctttgaactcgatct

SEQ ID NO: 577790 - DNA, 25 bp, Rattus norvegicus
tgccctgagcaggaggcatgactcc

SEQ ID NO: 577791 - DNA, 25 bp, Rattus norvegicus
atgccggggcgacctgccctgagca

SEQ ID NO: 577792 - DNA, 25 bp, Rattus norvegicus
cgttgtgccacattttgagtgcttg

SEQ ID NO: 577793 - DNA, 25 bp, Rattus norvegicus
cttcacaagggagcgatcgaggtaa

SEQ ID NO: 577794 - DNA, 25 bp, Rattus norvegicus
cctcggtgcccagaccagccagggc

SEQ ID NO: 577795 - DNA, 25 bp, Rattus norvegicus
acctggacgccggtatgggccggcg

SEQ ID NO: 577796 - DNA, 25 bp, Rattus norvegicus
ccgagtaggctgtgggacccagccc

SEQ ID NO: 577797 - DNA, 25 bp, Rattus norvegicus
taatcccgagtaggctgtgggaccc

SEQ ID NO: 577798 - DNA, 25 bp, Rattus norvegicus
cacaagggagcgatcgaggtaagct

SEQ ID NO: 577799 - DNA, 25 bp, Rattus norvegicus
gctggagcttcacaagggagcgatc

SEQ ID NO: 577800 - DNA, 25 bp, Rattus norvegicus
cacaaggcgctggagcttcacaagg

SEQ ID NO: 577801 - DNA, 25 bp, Rattus norvegicus
acacacaaggcgctggagcttcaca

SEQ ID NO: 577802 - DNA, 25 bp, Rattus norvegicus
tacgaaacacacaaggcgctggagc

SEQ ID NO: 577803 - DNA, 25 bp, Rattus norvegicus
ggatacgaaacacacaaggcgctgg

SEQ ID NO: 577804 - DNA, 25 bp, Rattus norvegicus
agcccgacctaagcttcgaagccgc

SEQ ID NO: 577805 - DNA, 25 bp, Rattus norvegicus
tggccgtttcctaggatacgaaaca

SEQ ID NO: 577806 - DNA, 25 bp, Rattus norvegicus
ttcctaggatacgaaacacacaagg

SEQ ID NO: 577807 - DNA, 25 bp, Rattus norvegicus
cgcctgcgcgtacggaacaattcca

SEQ ID NO: 577808 - DNA, 25 bp, Rattus norvegicus
gggaacccgagttgcaactgcattg

SEQ ID NO: 577809 - DNA, 25 bp, Rattus norvegicus
ttgcaactgcattggacgcgctacg

SEQ ID NO: 577810 - DNA, 25 bp, Rattus norvegicus
gacgcgctacgtccctacaaagtga

SEQ ID NO: 577811 - DNA, 25 bp, Rattus norvegicus
ccctgctctcttacggtttccgtgg

SEQ ID NO: 577812 - DNA, 25 bp, Rattus norvegicus
tctcttacggtttccgtggcgtgga

SEQ ID NO: 577813 - DNA, 25 bp, Rattus norvegicus
gcacgcgcgtttaggtttccactcc

SEQ ID NO: 577814 - DNA, 25 bp, Rattus norvegicus
ccgcagttacaggacgttttagaga

SEQ ID NO: 577815 - DNA, 25 bp, Rattus norvegicus
ctagctcagcagagagtgcacggga

SEQ ID NO: 577816 - DNA, 25 bp, Rattus norvegicus
caattccagggtggtaaaatccgca

SEQ ID NO: 577817 - DNA, 25 bp, Rattus norvegicus
tccgcaaagtaagaacacacccaac

SEQ ID NO: 577818 - DNA, 25 bp, Rattus norvegicus
gtgtgtagacgtcacggcgcacgct

SEQ ID NO: 577819 - DNA, 25 bp, Rattus norvegicus
acggcgcacgctgcgtcctagcagg

SEQ ID NO: 577820 - DNA, 25 bp, Rattus norvegicus
gggcagtccgctagctcagcagaga

SEQ ID NO: 577821 - DNA, 25 bp, Rattus norvegicus
agcacacgtgccttgccggagaagc

SEQ ID NO: 577822 - DNA, 25 bp, Rattus norvegicus
gcctgctggcttctccgatctaatc

SEQ ID NO: 577823 - DNA, 25 bp, Rattus norvegicus
gatctaatcaaactggcccgcgtta

SEQ ID NO: 577824 - DNA, 25 bp, Rattus norvegicus
ccttcgtagttcctggagtgtggca

SEQ ID NO: 577825 - DNA, 25 bp, Rattus norvegicus
tgcggttgttgaaactcccttcgta

SEQ ID NO: 577826 - DNA, 25 bp, Rattus norvegicus
caccaatttccggtgcgcctaagga

SEQ ID NO: 577827 - DNA, 25 bp, Rattus norvegicus
caaatccatggaagccgtgagctcc

SEQ ID NO: 577828 - DNA, 25 bp, Rattus norvegicus
cgctctcgaatgtcacgtggccctt

SEQ ID NO: 577829 - DNA, 25 bp, Rattus norvegicus
tggcaataacggagtacgctctcga

SEQ ID NO: 577830 - DNA, 25 bp, Rattus norvegicus
gggcaccttttaggcgcctgcagat

SEQ ID NO: 577831 - DNA, 25 bp, Rattus norvegicus
gaagtcggcgcgcaaattatacgtc

SEQ ID NO: 577832 - DNA, 25 bp, Rattus norvegicus
gcccgcggtgcactgtaaacccaaa

SEQ ID NO: 577833 - DNA, 25 bp, Rattus norvegicus
cgtggcccttctacgacaagctgga

SEQ ID NO: 577834 - DNA, 25 bp, Rattus norvegicus
aaagaggacctgctcgtagctgcca

SEQ ID NO: 577835 - DNA, 25 bp, Rattus norvegicus
aagcggctcttttctctcgcgtaca

SEQ ID NO: 577836 - DNA, 25 bp, Rattus norvegicus
ctggctgctccagattcgacggctt

SEQ ID NO: 577837 - DNA, 25 bp, Rattus norvegicus
cggctggaatccgacagctttccca

SEQ ID NO: 577838 - DNA, 25 bp, Rattus norvegicus
ccgcacgttcgcaactgaagctgga

SEQ ID NO: 577839 - DNA, 25 bp, Rattus norvegicus
cctaggaaccgaatccctgcgggca

SEQ ID NO: 577840 - DNA, 25 bp, Rattus norvegicus
agggaaacctcttcgtttgcatacg

SEQ ID NO: 577841 - DNA, 25 bp, Rattus norvegicus
catacgaaaagctagaggtgccgcc

SEQ ID NO: 577842 - DNA, 25 bp, Rattus norvegicus
gccgccagcaggctgcgttccgaag

SEQ ID NO: 577843 - DNA, 25 bp, Rattus norvegicus
cctcggtccagctaagcggctcttt

SEQ ID NO: 577844 - DNA, 25 bp, Rattus norvegicus
gtgctgccgagtctggtccatcctc

SEQ ID NO: 577845 - DNA, 25 bp, Rattus norvegicus
tcccgaacagatgcgggctcgcgct

SEQ ID NO: 577846 - DNA, 25 bp, Rattus norvegicus
acgggacctggaactgactgtctca

SEQ ID NO: 577847 - DNA, 25 bp, Rattus norvegicus
ttcgacggcttctcccgaacagatg

SEQ ID NO: 577848 - DNA, 25 bp, Rattus norvegicus
ccatcctccgggaacggctggaatc

SEQ ID NO: 577849 - DNA, 25 bp, Rattus norvegicus
agtgaccgaatcctcccgcaggaaa

SEQ ID NO: 577850 - DNA, 25 bp, Rattus norvegicus
ggtcgcgataccaatctgactcttg

SEQ ID NO: 577851 - DNA, 25 bp, Rattus norvegicus
ttctagtctcgatcccttacgggcc

SEQ ID NO: 577852 - DNA, 25 bp, Rattus norvegicus
ccaatttggtggtaagacttgcctc

SEQ ID NO: 577853 - DNA, 25 bp, Rattus norvegicus
tcctcgccggctacccaatttggtg

SEQ ID NO: 577854 - DNA, 25 bp, Rattus norvegicus
tcctcggcgctgcttctaatggagc

SEQ ID NO: 577855 - DNA, 25 bp, Rattus norvegicus
cctcttcatgatcgccggcaaactt

SEQ ID NO: 577856 - DNA, 25 bp, Rattus norvegicus
gtgcgcctctgacaagcccgaaagt

SEQ ID NO: 577857 - DNA, 25 bp, Rattus norvegicus
tggctgctcgctgacatcctcaaac

SEQ ID NO: 577858 - DNA, 25 bp, Rattus norvegicus
ggcccgtgattgacaggctgaacta

SEQ ID NO: 577859 - DNA, 25 bp, Rattus norvegicus
ttgcccaagtttgccgggagatgcc

SEQ ID NO: 577860 - DNA, 25 bp, Rattus norvegicus
cctaaacctggcttgcgtggactgg

SEQ ID NO: 577861 - DNA, 25 bp, Rattus norvegicus
ccacgtgaatgccaggtcaaagctc

SEQ ID NO: 577862 - DNA, 25 bp, Rattus norvegicus
cccgagtgtcaagggatcactgttc

SEQ ID NO: 577863 - DNA, 25 bp, Rattus norvegicus
gcgatgctagacacgcctgtggtca

SEQ ID NO: 577864 - DNA, 25 bp, Rattus norvegicus
aggccgtagcgtatgctgagcagca

SEQ ID NO: 577865 - DNA, 25 bp, Rattus norvegicus
cccttctttgatggcgaacatgatg

SEQ ID NO: 577866 - DNA, 25 bp, Rattus norvegicus
ggatgctaccttgcggctgtcctca

SEQ ID NO: 577867 - DNA, 25 bp, Rattus norvegicus
tgctgtagtgcatcttgtccaagta

SEQ ID NO: 577868 - DNA, 25 bp, Rattus norvegicus
cttgtccaagtagtaggcgttgttc

SEQ ID NO: 577869 - DNA, 25 bp, Rattus norvegicus
cttctcttcatccagcgtgtcgggg

SEQ ID NO: 577870 - DNA, 25 bp, Rattus norvegicus
tcacgaagtagtgtgtgtccttgcc

SEQ ID NO: 577871 - DNA, 25 bp, Rattus norvegicus
cgctgcgccgatcttcacgaagtag

SEQ ID NO: 577872 - DNA, 25 bp, Rattus norvegicus
cgtgggctgtgacacggtcacattc

SEQ ID NO: 577873 - DNA, 25 bp, Rattus norvegicus
tcctgccgttcaccagcagcgtggg

SEQ ID NO: 577874 - DNA, 25 bp, Rattus norvegicus
tggtgaaccttcgagtcctgccgtt

SEQ ID NO: 577875 - DNA, 25 bp, Rattus norvegicus
gaacatgatgcctttgccgatgatg

SEQ ID NO: 577876 - DNA, 25 bp, Rattus norvegicus
cagcagcgtggagtactggaattca

SEQ ID NO: 577877 - DNA, 25 bp, Rattus norvegicus
tgctacactgagactcccgtcaatg

SEQ ID NO: 577878 - DNA, 25 bp, Rattus norvegicus
atcccgaggtctgccctagcctttt

SEQ ID NO: 577879 - DNA, 25 bp, Rattus norvegicus
tagccttttaggtccgattgtcctc

SEQ ID NO: 577880 - DNA, 25 bp, Rattus norvegicus
ttctggtcgcccacactttctttcg

SEQ ID NO: 577881 - DNA, 25 bp, Rattus norvegicus
tctctttcacttttgcaggccctgc

SEQ ID NO: 577882 - DNA, 25 bp, Rattus norvegicus
gcaggccctgcaaccttttaaaatg

SEQ ID NO: 577883 - DNA, 25 bp, Rattus norvegicus
tccgtcgctcgctttttgtctctcg

SEQ ID NO: 577884 - DNA, 25 bp, Rattus norvegicus
caatgactgcattgagagccggctc

SEQ ID NO: 577885 - DNA, 25 bp, Rattus norvegicus
cttcacgctcgatttccaggcattc

SEQ ID NO: 577886 - DNA, 25 bp, Rattus norvegicus
tatctgctattaggaggctccagga

SEQ ID NO: 577887 - DNA, 25 bp, Rattus norvegicus
ctgcccagcgcggttattagaagct

SEQ ID NO: 577888 - DNA, 25 bp, Rattus norvegicus
gaagctgaagtgaagccgccgctaa

SEQ ID NO: 577889 - DNA, 25 bp, Rattus norvegicus
cacggattaaggaacacgcgcgcgc

SEQ ID NO: 577890 - DNA, 25 bp, Rattus norvegicus
ccctttgctgtgattcgccagtcgc

SEQ ID NO: 577891 - DNA, 25 bp, Rattus norvegicus
ccacaggcctggagtcactcgaaga

SEQ ID NO: 577892 - DNA, 25 bp, Rattus norvegicus
gggtcctgcgttcacgacaaccatc

SEQ ID NO: 577893 - DNA, 25 bp, Rattus norvegicus
cccaaggcgtcagccatgcctgaga

SEQ ID NO: 577894 - DNA, 25 bp, Rattus norvegicus
tgtcttggagcgatccgaatctgcc

SEQ ID NO: 577895 - DNA, 25 bp, Rattus norvegicus
tgcacggattcagcctcggcgtcct

SEQ ID NO: 577896 - DNA, 25 bp, Rattus norvegicus
ggccctgttcacttcctgcacggat

SEQ ID NO: 577897 - DNA, 25 bp, Rattus norvegicus
catcgtatagttgagggccctgttc

SEQ ID NO: 577898 - DNA, 25 bp, Rattus norvegicus
gtctcggtaaaaagccacaggcctg

SEQ ID NO: 577899 - DNA, 25 bp, Rattus norvegicus
gcgggacgcagtctcccgactgttc

SEQ ID NO: 577900 - DNA, 25 bp, Rattus norvegicus
ctttgcttagttctctgggcgggac

SEQ ID NO: 577901 - DNA, 25 bp, Rattus norvegicus
gcgggagctccctttgcttagttct

SEQ ID NO: 577902 - DNA, 25 bp, Rattus norvegicus
cttgctggagctacttgagaccggt

SEQ ID NO: 577903 - DNA, 25 bp, Rattus norvegicus
acgcatttttgctgcgccacgcaga

SEQ ID NO: 577904 - DNA, 25 bp, Rattus norvegicus
ggtaactactcactgccggtgtcgg

SEQ ID NO: 577905 - DNA, 25 bp, Rattus norvegicus
gggaacgcagacctaggctcacctg

SEQ ID NO: 577906 - DNA, 25 bp, Rattus norvegicus
agtcgcaagatccttactcccacgt

SEQ ID NO: 577907 - DNA, 25 bp, Rattus norvegicus
tcacgacggcaccagcaacgggacg

SEQ ID NO: 577908 - DNA, 25 bp, Rattus norvegicus
ccagcaacgggacggcacggttgcc

SEQ ID NO: 577909 - DNA, 25 bp, Rattus norvegicus
cccagctgggcactgtaggtcaatc

SEQ ID NO: 577910 - DNA, 25 bp, Rattus norvegicus
tgggcactgtaggtcaatctcccta

SEQ ID NO: 577911 - DNA, 25 bp, Rattus norvegicus
gtaggtcaatctccctacaccagcg

SEQ ID NO: 577912 - DNA, 25 bp, Rattus norvegicus
ctgggctcttacacacacaccgggg

SEQ ID NO: 577913 - DNA, 25 bp, Rattus norvegicus
actgtcaggcctggaccctcgcagg

SEQ ID NO: 577914 - DNA, 25 bp, Rattus norvegicus
accctcgcagggactatcggcggca

SEQ ID NO: 577915 - DNA, 25 bp, Rattus norvegicus
atcggcggcacgaggacctcttaca

SEQ ID NO: 577916 - DNA, 25 bp, Rattus norvegicus
cacgccatcgaggacgtcccggtaa

SEQ ID NO: 577917 - DNA, 25 bp, Rattus norvegicus
ctaggctcacctgcccgctgggaag

SEQ ID NO: 577918 - DNA, 25 bp, Rattus norvegicus
catcgaggacgtcccggtaagaggc

SEQ ID NO: 577919 - DNA, 25 bp, Rattus norvegicus
agtcttctgttcagttccgggtcgc

SEQ ID NO: 577920 - DNA, 25 bp, Rattus norvegicus
ctcgggattcccgagctgagcagcg

SEQ ID NO: 577921 - DNA, 25 bp, Rattus norvegicus
ttgtctccatctggggctcagtccc

SEQ ID NO: 577922 - DNA, 25 bp, Rattus norvegicus
acgcaggcgcagttgtctccatctg

SEQ ID NO: 577923 - DNA, 25 bp, Rattus norvegicus
gcagtcggggaactccgctttctgc

SEQ ID NO: 577924 - DNA, 25 bp, Rattus norvegicus
atggtagcggtactgcacgcaggca

SEQ ID NO: 577925 - DNA, 25 bp, Rattus norvegicus
agtgtctcaacgcttcgctcctggg

SEQ ID NO: 577926 - DNA, 25 bp, Rattus norvegicus
tacaaggtcacggtggcggaagtac

SEQ ID NO: 577927 - DNA, 25 bp, Rattus norvegicus
ggcggaagtacagcggcgcctctca

SEQ ID NO: 577928 - DNA, 25 bp, Rattus norvegicus
ctcagctccacctcgaagtacaagg

SEQ ID NO: 577929 - DNA, 25 bp, Rattus norvegicus
caacctcttcggtggcgtggtgaac

SEQ ID NO: 577930 - DNA, 25 bp, Rattus norvegicus
gtccaagtccaacagcaatgccgtc

SEQ ID NO: 577931 - DNA, 25 bp, Rattus norvegicus
atctgtcttcgcaggccctgtgtcc

SEQ ID NO: 577932 - DNA, 25 bp, Rattus norvegicus
acgcgctcgcatctgtcttcgcagg

SEQ ID NO: 577933 - DNA, 25 bp, Rattus norvegicus
tatgcttctttccagcgcgctaatc

SEQ ID NO: 577934 - DNA, 25 bp, Rattus norvegicus
tccttttatcaagtcgcagcccgtg

SEQ ID NO: 577935 - DNA, 25 bp, Rattus norvegicus
acaaaacaccctgcgtgttctgccg

SEQ ID NO: 577936 - DNA, 25 bp, Rattus norvegicus
ggcatttaacaaaacaccctgcgtg

SEQ ID NO: 577937 - DNA, 25 bp, Rattus norvegicus
aagtcgcagcccgtgcgaacgacgg

SEQ ID NO: 577938 - DNA, 25 bp, Rattus norvegicus
tttcagaaaactgtctccttttatc

SEQ ID NO: 577939 - DNA, 25 bp, Rattus norvegicus
tggcacacgccatttcaatcaaatc

SEQ ID NO: 577940 - DNA, 25 bp, Rattus norvegicus
attctctgcgctttgtccctcgctg

SEQ ID NO: 577941 - DNA, 25 bp, Rattus norvegicus
gtgtccatggattctctgcgctttg

SEQ ID NO: 577942 - DNA, 25 bp, Rattus norvegicus
cgcgctaatccaccttcagcgtgga

SEQ ID NO: 577943 - DNA, 25 bp, Rattus norvegicus
cccaggccaaacatatgcttctttc

SEQ ID NO: 577944 - DNA, 25 bp, Rattus norvegicus
cattctctaagctcagccgggggga

SEQ ID NO: 577945 - DNA, 25 bp, Rattus norvegicus
agatagttgatattccgggtccagc

SEQ ID NO: 577946 - DNA, 25 bp, Rattus norvegicus
aggcgtaattgctcgagtgtccatg

SEQ ID NO: 577947 - DNA, 25 bp, Rattus norvegicus
gtaatcagctcgcagacgtagtgtg

SEQ ID NO: 577948 - DNA, 25 bp, Rattus norvegicus
cgctatcggcgccatcacaaagggt

SEQ ID NO: 577949 - DNA, 25 bp, Rattus norvegicus
agctcgcagacgtagtgtgggtcac

SEQ ID NO: 577950 - DNA, 25 bp, Rattus norvegicus
ctatcggcgccatcacaaagggtca

SEQ ID NO: 577951 - DNA, 25 bp, Rattus norvegicus
gcaccagtaatcagctcgcagacgt

SEQ ID NO: 577952 - DNA, 25 bp, Rattus norvegicus
ggcgtggctttcagagcaccagtaa

SEQ ID NO: 577953 - DNA, 25 bp, Rattus norvegicus
cttacccaccgtgcggggaatggcg

SEQ ID NO: 577954 - DNA, 25 bp, Rattus norvegicus
cgataaaggacttacccaccgtgcg

SEQ ID NO: 577955 - DNA, 25 bp, Rattus norvegicus
cccgggtcattacagagtcgccgtg

SEQ ID NO: 577956 - DNA, 25 bp, Rattus norvegicus
ggcgaacccgggtcattacagagtc

SEQ ID NO: 577957 - DNA, 25 bp, Rattus norvegicus
cagctgcggcgaacccgggtcatta

SEQ ID NO: 577958 - DNA, 25 bp, Rattus norvegicus
tcacaaagggtcagggcgcagctgc

SEQ ID NO: 577959 - DNA, 25 bp, Rattus norvegicus
ccatcacaaagggtcagggcgcagc

SEQ ID NO: 577960 - DNA, 25 bp, Rattus norvegicus
tcattacagagtcgccgtgcggctc

SEQ ID NO: 577961 - DNA, 25 bp, Rattus norvegicus
gcacgctggcgcacgcgcaaaaaga

SEQ ID NO: 577962 - DNA, 25 bp, Rattus norvegicus
tcggacgccgccgtcggagttgtca

SEQ ID NO: 577963 - DNA, 25 bp, Rattus norvegicus
ctatagagaaggtgtcggacgccgc

SEQ ID NO: 577964 - DNA, 25 bp, Rattus norvegicus
cacggtgtctatagagaaggtgtcg

SEQ ID NO: 577965 - DNA, 25 bp, Rattus norvegicus
gcccacacggtgtctatagagaagg

SEQ ID NO: 577966 - DNA, 25 bp, Rattus norvegicus
tgggtgcccacacggtgtctataga

SEQ ID NO: 577967 - DNA, 25 bp, Rattus norvegicus
gcagcactcgggtgggtgcccacac

SEQ ID NO: 577968 - DNA, 25 bp, Rattus norvegicus
tcaggcgtcgttaggcagcactcgg

SEQ ID NO: 577969 - DNA, 25 bp, Rattus norvegicus
cggtcaggcgtcgttaggcagcact

SEQ ID NO: 577970 - DNA, 25 bp, Rattus norvegicus
ggtcgagagagcaggaccggagaca

SEQ ID NO: 577971 - DNA, 25 bp, Rattus norvegicus
tccggcctgtggagaccttccggga

SEQ ID NO: 577972 - DNA, 25 bp, Rattus norvegicus
ggtgtccggcctgtggagaccttcc

SEQ ID NO: 577973 - DNA, 25 bp, Rattus norvegicus
caaaaagacgcataggcggaagtgg

SEQ ID NO: 577974 - DNA, 25 bp, Rattus norvegicus
gcacgcgcaaaaagacgcataggcg

SEQ ID NO: 577975 - DNA, 25 bp, Rattus norvegicus
agccgtgcctgatccttttcattca

SEQ ID NO: 577976 - DNA, 25 bp, Rattus norvegicus
ctttccgttcgtccagccaatcgtg

SEQ ID NO: 577977 - DNA, 25 bp, Rattus norvegicus
ccagccaatcgtggaagagatctgc

SEQ ID NO: 577978 - DNA, 25 bp, Rattus norvegicus
acttcctgctcaatcaatgtcctag

SEQ ID NO: 577979 - DNA, 25 bp, Rattus norvegicus
aatgtcctagcagttcaggctccgc

SEQ ID NO: 577980 - DNA, 25 bp, Rattus norvegicus
agccggggaataagtacagcgctca

SEQ ID NO: 577981 - DNA, 25 bp, Rattus norvegicus
aggtgacttggagcctacgcgaccc

SEQ ID NO: 577982 - DNA, 25 bp, Rattus norvegicus
cccggccgagatacaagagtggact

SEQ ID NO: 577983 - DNA, 25 bp, Rattus norvegicus
actctactctccacgtgcgtgtggg

SEQ ID NO: 577984 - DNA, 25 bp, Rattus norvegicus
gaacttccaggcaaatgtcaccatc

SEQ ID NO: 577985 - DNA, 25 bp, Rattus norvegicus
ccctctgggagcagaaagccagttt

SEQ ID NO: 577986 - DNA, 25 bp, Rattus norvegicus
agatccctgtaagcggctgtaagcc

SEQ ID NO: 577987 - DNA, 25 bp, Rattus norvegicus
ttcagcgacaaccttgcgagccgtc

SEQ ID NO: 577988 - DNA, 25 bp, Rattus norvegicus
agagacgtgggttcagatccctgta

SEQ ID NO: 577989 - DNA, 25 bp, Rattus norvegicus
gtaacagcccgcgagcgtcggtctc

SEQ ID NO: 577990 - DNA, 25 bp, Rattus norvegicus
cttaagagtctctgggttcgcgcct

SEQ ID NO: 577991 - DNA, 25 bp, Rattus norvegicus
caagaagcgagactcgctggggact

SEQ ID NO: 577992 - DNA, 25 bp, Rattus norvegicus
agagaccccggtagcatgcgaggcc

SEQ ID NO: 577993 - DNA, 25 bp, Rattus norvegicus
agtctctgggttcgcgcctgcgtcg

SEQ ID NO: 577994 - DNA, 25 bp, Rattus norvegicus
cctcattatcaagggtacggagtgg

SEQ ID NO: 577995 - DNA, 25 bp, Rattus norvegicus
cgggtgcggcgcacctcattatcaa

SEQ ID NO: 577996 - DNA, 25 bp, Rattus norvegicus
gtcggtctcccttaagagtctctgg

SEQ ID NO: 577997 - DNA, 25 bp, Rattus norvegicus
gcggcgcacctcattatcaagggta

SEQ ID NO: 577998 - DNA, 25 bp, Rattus norvegicus
agcgcctttccggaagccaacgtct

SEQ ID NO: 577999 - DNA, 25 bp, Rattus norvegicus
caacgtctccgacgccctgtgatga

SEQ ID NO: 578000 - DNA, 25 bp, Rattus norvegicus
tccgacgccctgtgatgacgtaaca

SEQ ID NO: 578001 - DNA, 25 bp, Rattus norvegicus
tgtgatgacgtaacagcccgcgagc

SEQ ID NO: 578002 - DNA, 25 bp, Rattus norvegicus
gagcgtcggtctcccttaagagtct

SEQ ID NO: 578003 - DNA, 25 bp, Rattus norvegicus
cgcttatgtcctctgctcagctctc

SEQ ID NO: 578004 - DNA, 25 bp, Rattus norvegicus
acgggatccagagcgccgcgcactt

SEQ ID NO: 578005 - DNA, 25 bp, Rattus norvegicus
cgccacgctgctggagtccaggcgt

SEQ ID NO: 578006 - DNA, 25 bp, Rattus norvegicus
cctggtaactgcagctcccgcaggc

SEQ ID NO: 578007 - DNA, 25 bp, Rattus norvegicus
ttcttcgcgccctggtaactgcagc

SEQ ID NO: 578008 - DNA, 25 bp, Rattus norvegicus
gccgcgcacttcgtcatgttcttcg

SEQ ID NO: 578009 - DNA, 25 bp, Rattus norvegicus
gagtccaggcgtcccccgcttatgt

SEQ ID NO: 578010 - DNA, 25 bp, Rattus norvegicus
gacatgttcacgcacgggatccaga

SEQ ID NO: 578011 - DNA, 25 bp, Rattus norvegicus
tatacggccgacatgttcacgcacg

SEQ ID NO: 578012 - DNA, 25 bp, Rattus norvegicus
agcacctgtatacggccgacatgtt

SEQ ID NO: 578013 - DNA, 25 bp, Rattus norvegicus
acgccaagcacctgtatacggccga

SEQ ID NO: 578014 - DNA, 25 bp, Rattus norvegicus
ggctaccggctctggccacgctcct

SEQ ID NO: 578015 - DNA, 25 bp, Rattus norvegicus
acttcgtcatgttcttcgcgccctg

SEQ ID NO: 578016 - DNA, 25 bp, Rattus norvegicus
gttcacgcacgggatccagagcgcc

SEQ ID NO: 578017 - DNA, 25 bp, Rattus norvegicus
cggtgcccaggaaagacgtcttcag

SEQ ID NO: 578018 - DNA, 25 bp, Rattus norvegicus
acgtcttcaggatgcggccgtcatc

SEQ ID NO: 578019 - DNA, 25 bp, Rattus norvegicus
gtacttatagaacacctggcgcccg

SEQ ID NO: 578020 - DNA, 25 bp, Rattus norvegicus
cggccgtcatcactgtagtcaaaga

SEQ ID NO: 578021 - DNA, 25 bp, Rattus norvegicus
gtgctgtcgtagacgatctccgata

SEQ ID NO: 578022 - DNA, 25 bp, Rattus norvegicus
gtaaatgttccggatgtagccaatg

SEQ ID NO: 578023 - DNA, 25 bp, Rattus norvegicus
ggtgtaatcgaacctggcgttgatc

SEQ ID NO: 578024 - DNA, 25 bp, Rattus norvegicus
caaagatgaccgaggcgttgctttc

SEQ ID NO: 578025 - DNA, 25 bp, Rattus norvegicus
gtggtctcgtcatagccgaaggtga

SEQ ID NO: 578026 - DNA, 25 bp, Rattus norvegicus
ccatcttcaggacgccagtggtctc

SEQ ID NO: 578027 - DNA, 25 bp, Rattus norvegicus
cccgctttggagattcaccatcttc

SEQ ID NO: 578028 - DNA, 25 bp, Rattus norvegicus
tggcgttgatcatgccttcctcaga

SEQ ID NO: 578029 - DNA, 25 bp, Rattus norvegicus
agtctcactgatgacgggcttgatg

SEQ ID NO: 578030 - DNA, 25 bp, Rattus norvegicus
taaatctgcttgtccacgaggggcc

SEQ ID NO: 578031 - DNA, 25 bp, Rattus norvegicus
agccgccgatagaggaagcccgaag

SEQ ID NO: 578032 - DNA, 25 bp, Rattus norvegicus
tgtctgcacacgtgcgctgccctga

SEQ ID NO: 578033 - DNA, 25 bp, Rattus norvegicus
atcggagaccacagatcaagagatg

SEQ ID NO: 578034 - DNA, 25 bp, Rattus norvegicus
tctcctggcttgtaggacaatcgtg

SEQ ID NO: 578035 - DNA, 25 bp, Rattus norvegicus
tgtgtccgagacaggactgcgctgc

SEQ ID NO: 578036 - DNA, 25 bp, Rattus norvegicus
actctcccgcaggtctctggaggcg

SEQ ID NO: 578037 - DNA, 25 bp, Rattus norvegicus
tatctctcatggtcatccgcggcgc

SEQ ID NO: 578038 - DNA, 25 bp, Rattus norvegicus
atcgtggagtttactcctctccggg

SEQ ID NO: 578039 - DNA, 25 bp, Rattus norvegicus
ggcactcagtccttatctctcatgg

SEQ ID NO: 578040 - DNA, 25 bp, Rattus norvegicus
ccgtctgttgcgattgttgctgctg

SEQ ID NO: 578041 - DNA, 25 bp, Rattus norvegicus
cgtcgtccttggacagggagttgta

SEQ ID NO: 578042 - DNA, 25 bp, Rattus norvegicus
acggcacggtcacttgctgtctgca

SEQ ID NO: 578043 - DNA, 25 bp, Rattus norvegicus
catctcccgcttctcgtgggtcttg

SEQ ID NO: 578044 - DNA, 25 bp, Rattus norvegicus
ttgtagagatccagcatgaagagcg

SEQ ID NO: 578045 - DNA, 25 bp, Rattus norvegicus
accagcgcctttcctacggcgagaa

SEQ ID NO: 578046 - DNA, 25 bp, Rattus norvegicus
gggacctagggattgcgccaaccta

SEQ ID NO: 578047 - DNA, 25 bp, Rattus norvegicus
tcccagaatccataccgtccgagtg

SEQ ID NO: 578048 - DNA, 25 bp, Rattus norvegicus
tccgggttcaagattgagaaaagtc

SEQ ID NO: 578049 - DNA, 25 bp, Rattus norvegicus
gtgacgaagcaaatagccaaaccta

SEQ ID NO: 578050 - DNA, 25 bp, Rattus norvegicus
ccaacctatagggaagagccgacgg

SEQ ID NO: 578051 - DNA, 25 bp, Rattus norvegicus
tggagcgctcgcaaaaacctgggtt

SEQ ID NO: 578052 - DNA, 25 bp, Rattus norvegicus
ggtccaggtgatccaggctccatcc

SEQ ID NO: 578053 - DNA, 25 bp, Rattus norvegicus
cgagaagccagtcgcccggaaaagg

SEQ ID NO: 578054 - DNA, 25 bp, Rattus norvegicus
cctcagacaggaagtggtagaactg

SEQ ID NO: 578055 - DNA, 25 bp, Rattus norvegicus
aggctcggcctccatgatcgcagct

SEQ ID NO: 578056 - DNA, 25 bp, Rattus norvegicus
cggaacatgcactcaacgagccttg

SEQ ID NO: 578057 - DNA, 25 bp, Rattus norvegicus
cgacgccgctcttccaagggaggag

SEQ ID NO: 578058 - DNA, 25 bp, Rattus norvegicus
ttgaaaggcgtcttcctcacttttc

SEQ ID NO: 578059 - DNA, 25 bp, Rattus norvegicus
tgcgaccgaggatgcaatactgatc

SEQ ID NO: 578060 - DNA, 25 bp, Rattus norvegicus
ctgctccataaagcacgtgaccgga

SEQ ID NO: 578061 - DNA, 25 bp, Rattus norvegicus
gcaataacgcgtctagcagctgctc

SEQ ID NO: 578062 - DNA, 25 bp, Rattus norvegicus
gcctgcaagcgttgcctagcaataa

SEQ ID NO: 578063 - DNA, 25 bp, Rattus norvegicus
ctaacctagcaaggagcctgcaagc

SEQ ID NO: 578064 - DNA, 25 bp, Rattus norvegicus
aatactgatccatgtcggcccgcgg

SEQ ID NO: 578065 - DNA, 25 bp, Rattus norvegicus
ctttaaagacgatgccgtgggcgcc

SEQ ID NO: 578066 - DNA, 25 bp, Rattus norvegicus
acctctacgtgcttggctttaaaga

SEQ ID NO: 578067 - DNA, 25 bp, Rattus norvegicus
cgcggcgtgatcttacctctacgtg

SEQ ID NO: 578068 - DNA, 25 bp, Rattus norvegicus
ctcagaaggagtgcaagtgagcacc

SEQ ID NO: 578069 - DNA, 25 bp, Rattus norvegicus
ctcaacaccgaaagacctcagaagg

SEQ ID NO: 578070 - DNA, 25 bp, Rattus norvegicus
gcgctggcggatctcaacaccgaaa

SEQ ID NO: 578071 - DNA, 25 bp, Rattus norvegicus
gtatcgtacagattcccgaggcctg

SEQ ID NO: 578072 - DNA, 25 bp, Rattus norvegicus
ccacactgcggggatctaacctagc

SEQ ID NO: 578073 - DNA, 25 bp, Rattus norvegicus
tagtacatcctgctggtgccaccgc

SEQ ID NO: 578074 - DNA, 25 bp, Rattus norvegicus
agccgccgttgcagctcatgtctgc

SEQ ID NO: 578075 - DNA, 25 bp, Rattus norvegicus
tacccaccagtagccgtcggagttc

SEQ ID NO: 578076 - DNA, 25 bp, Rattus norvegicus
ctcatgtctgcggtcactcaagaga

SEQ ID NO: 578077 - DNA, 25 bp, Rattus norvegicus
gtcatgcgacccagcgtgttgatcc

SEQ ID NO: 578078 - DNA, 25 bp, Rattus norvegicus
tgtaggtcatctcgtagcgcaggtc

SEQ ID NO: 578079 - DNA, 25 bp, Rattus norvegicus
cggagttctggtcgttgacagtgca

SEQ ID NO: 578080 - DNA, 25 bp, Rattus norvegicus
ggccaaaggtcccagcctgagctag

SEQ ID NO: 578081 - DNA, 25 bp, Rattus norvegicus
atgcactttcctcggcctagacctg

SEQ ID NO: 578082 - DNA, 25 bp, Rattus norvegicus
gtgacccggggcaatgcactttcct

SEQ ID NO: 578083 - DNA, 25 bp, Rattus norvegicus
gataccgggtcctgccttccgtgac

SEQ ID NO: 578084 - DNA, 25 bp, Rattus norvegicus
tccctgttcacaggggtgagcgctg

SEQ ID NO: 578085 - DNA, 25 bp, Rattus norvegicus
tcacggtaagactgtcgcccgggtc

SEQ ID NO: 578086 - DNA, 25 bp, Rattus norvegicus
aggagacgggcaactccctggccaa

SEQ ID NO: 578087 - DNA, 25 bp, Rattus norvegicus
cacgcgttgctatggttcttgctcc

SEQ ID NO: 578088 - DNA, 25 bp, Rattus norvegicus
gtgcactccagaggacgtcacactg

SEQ ID NO: 578089 - DNA, 25 bp, Rattus norvegicus
gacctccttcatctggactcctgtg

SEQ ID NO: 578090 - DNA, 25 bp, Rattus norvegicus
tgctccgaaagacttgcgtcctctg

SEQ ID NO: 578091 - DNA, 25 bp, Rattus norvegicus
gcctgttattccctgactgctccga

SEQ ID NO: 578092 - DNA, 25 bp, Rattus norvegicus
tcccgtcgtagaaagccagcctgtt

SEQ ID NO: 578093 - DNA, 25 bp, Rattus norvegicus
tgccctcagggaacatgcgcgttac

SEQ ID NO: 578094 - DNA, 25 bp, Rattus norvegicus
agaagtacctctccatgccctagtg

SEQ ID NO: 578095 - DNA, 25 bp, Rattus norvegicus
ccgacaggccggaagtttgcaacca

SEQ ID NO: 578096 - DNA, 25 bp, Rattus norvegicus
ccaggatgccgggtttcagcaaagg

SEQ ID NO: 578097 - DNA, 25 bp, Rattus norvegicus
gaagagacgactttccacctagaga

SEQ ID NO: 578098 - DNA, 25 bp, Rattus norvegicus
tggccatcctatccagactgcagtc

SEQ ID NO: 578099 - DNA, 25 bp, Rattus norvegicus
tccatgactagtggggtaagccctc

SEQ ID NO: 578100 - DNA, 25 bp, Rattus norvegicus
tgaggaatccgcgtcgtcaaattgc

SEQ ID NO: 578101 - DNA, 25 bp, Rattus norvegicus
cctgggctcctagaggccacgtcga

SEQ ID NO: 578102 - DNA, 25 bp, Rattus norvegicus
gagtaacgccattaccgccaagagc

SEQ ID NO: 578103 - DNA, 25 bp, Rattus norvegicus
attaccgccaagagccgccgagagc

SEQ ID NO: 578104 - DNA, 25 bp, Rattus norvegicus
gcccggatgaagagtaacgccatta

SEQ ID NO: 578105 - DNA, 25 bp, Rattus norvegicus
gcgccgtgtaacaccttcgctcggt

SEQ ID NO: 578106 - DNA, 25 bp, Rattus norvegicus
ttgcctatcacggtctgtgtggacc

SEQ ID NO: 578107 - DNA, 25 bp, Rattus norvegicus
ccgattctctatcgcggcgccgtgt

SEQ ID NO: 578108 - DNA, 25 bp, Rattus norvegicus
cagcttctgcgctgacgtgtcgcta

SEQ ID NO: 578109 - DNA, 25 bp, Rattus norvegicus
cccggttctcgagggccgtgctgac

SEQ ID NO: 578110 - DNA, 25 bp, Rattus norvegicus
cgcctgctgctgcttttcctgctgg

SEQ ID NO: 578111 - DNA, 25 bp, Rattus norvegicus
tcctagaggccacgtcgacggtagc

SEQ ID NO: 578112 - DNA, 25 bp, Rattus norvegicus
tagcggacgcgcactggacgctgac

SEQ ID NO: 578113 - DNA, 25 bp, Rattus norvegicus
aagagccgccgagagccctagcgga

SEQ ID NO: 578114 - DNA, 25 bp, Rattus norvegicus
cctcgcttgcctatcacggtctgtg

SEQ ID NO: 578115 - DNA, 25 bp, Rattus norvegicus
ctcaatgtctttctcgggcacgtgc

SEQ ID NO: 578116 - DNA, 25 bp, Rattus norvegicus
aggcggcgttgcattccttgcactc

SEQ ID NO: 578117 - DNA, 25 bp, Rattus norvegicus
cttgcactcgaagggtttccggcct

SEQ ID NO: 578118 - DNA, 25 bp, Rattus norvegicus
cgcggtagtgcttcagatcctcacc

SEQ ID NO: 578119 - DNA, 25 bp, Rattus norvegicus
gagggcatccaccagctcagccgtg

SEQ ID NO: 578120 - DNA, 25 bp, Rattus norvegicus
gccgtgctgctgctcacgtactgta

SEQ ID NO: 578121 - DNA, 25 bp, Rattus norvegicus
cacgtactgtatgttcttctcaatg

SEQ ID NO: 578122 - DNA, 25 bp, Rattus norvegicus
ctcaatgtccttcctggtggccttg

SEQ ID NO: 578123 - DNA, 25 bp, Rattus norvegicus
aggtgccgctcacagttggctttga

SEQ ID NO: 578124 - DNA, 25 bp, Rattus norvegicus
tgaacgggtagtggcagatcttgca

SEQ ID NO: 578125 - DNA, 25 bp, Rattus norvegicus
cggcgatgtagtcacagatgttgca

SEQ ID NO: 578126 - DNA, 25 bp, Rattus norvegicus
gatcttgcagatgtacggccgctcc

SEQ ID NO: 578127 - DNA, 25 bp, Rattus norvegicus
gagcagctttgtctgcggcgatgta

SEQ ID NO: 578128 - DNA, 25 bp, Rattus norvegicus
ggccagcacgtagctctcaatgtct

SEQ ID NO: 578129 - DNA, 25 bp, Rattus norvegicus
taacctcatggttgctgccacggtc

SEQ ID NO: 578130 - DNA, 25 bp, Rattus norvegicus
cagatcttcaaggtcccatcaggga

SEQ ID NO: 578131 - DNA, 25 bp, Rattus norvegicus
cggtaccgccgacatgactgacagc

SEQ ID NO: 578132 - DNA, 25 bp, Rattus norvegicus
gtgcccagcactcgagttgaggtga

SEQ ID NO: 578133 - DNA, 25 bp, Rattus norvegicus
ccctggacagaggaggtcacagact

SEQ ID NO: 578134 - DNA, 25 bp, Rattus norvegicus
gcccttctctaggaagcctaaccga

SEQ ID NO: 578135 - DNA, 25 bp, Rattus norvegicus
caagcaccgcaagtccctggacaga

SEQ ID NO: 578136 - DNA, 25 bp, Rattus norvegicus
tcctgacaaggacagacctgggccg

SEQ ID NO: 578137 - DNA, 25 bp, Rattus norvegicus
gacgcccatgcacgtttaaagctta

SEQ ID NO: 578138 - DNA, 25 bp, Rattus norvegicus
cacggtcgtcggagcaaacccagaa

SEQ ID NO: 578139 - DNA, 25 bp, Rattus norvegicus
cccggatcgcagtcgccgcttaaaa

SEQ ID NO: 578140 - DNA, 25 bp, Rattus norvegicus
ggcagcttagccatccgcgtttgaa

SEQ ID NO: 578141 - DNA, 25 bp, Rattus norvegicus
ataatggctgctcacctcaagtctc

SEQ ID NO: 578142 - DNA, 25 bp, Rattus norvegicus
ccgcgccgacgcatgcctgtataat

SEQ ID NO: 578143 - DNA, 25 bp, Rattus norvegicus
cccgagagggactagaaagtatgta

SEQ ID NO: 578144 - DNA, 25 bp, Rattus norvegicus
gcgctcggacggctaatatggatgc

SEQ ID NO: 578145 - DNA, 25 bp, Rattus norvegicus
gccagcctcagagtcaccaacaata

SEQ ID NO: 578146 - DNA, 25 bp, Rattus norvegicus
tcaccaacaatacgcgtcggcgcgg

SEQ ID NO: 578147 - DNA, 25 bp, Rattus norvegicus
cgggaggatcaaagtccgcagagca

SEQ ID NO: 578148 - DNA, 25 bp, Rattus norvegicus
gactggctcggtcatctccgtgctt

SEQ ID NO: 578149 - DNA, 25 bp, Rattus norvegicus
tccgtgcttcccgacccgagaggga

SEQ ID NO: 578150 - DNA, 25 bp, Rattus norvegicus
tatggatgcgcatcaggtcctgctg

SEQ ID NO: 578151 - DNA, 25 bp, Rattus norvegicus
caaccgagcgcatgctgccaggcgt

SEQ ID NO: 578152 - DNA, 25 bp, Rattus norvegicus
tcctttctgccaaacgccgagtttc

SEQ ID NO: 578153 - DNA, 25 bp, Rattus norvegicus
cgagtttcagaagtacaccgcgctc

SEQ ID NO: 578154 - DNA, 25 bp, Rattus norvegicus
ttaaaaggtcgctccggcaatgctc

SEQ ID NO: 578155 - DNA, 25 bp, Rattus norvegicus
gtaccatccgagtcccggcagggct

SEQ ID NO: 578156 - DNA, 25 bp, Rattus norvegicus
cagcgctgggaagatgtttctggcc

SEQ ID NO: 578157 - DNA, 25 bp, Rattus norvegicus
agcagccagcatctttgcagtccgc

SEQ ID NO: 578158 - DNA, 25 bp, Rattus norvegicus
acgaccactgggtgtgcgatccaag

SEQ ID NO: 578159 - DNA, 25 bp, Rattus norvegicus
atccaagccgcggagtccaggaagg

SEQ ID NO: 578160 - DNA, 25 bp, Rattus norvegicus
tgcaacttctgagcctgcaccgcaa

SEQ ID NO: 578161 - DNA, 25 bp, Rattus norvegicus
ctcaccgaggccttgaggagaccgc

SEQ ID NO: 578162 - DNA, 25 bp, Rattus norvegicus
aggatggcggcaaagtctgtgaaac

SEQ ID NO: 578163 - DNA, 25 bp, Rattus norvegicus
ccggacagctctggaaacctgggct

SEQ ID NO: 578164 - DNA, 25 bp, Rattus norvegicus
tgaataacaagagagaggaccgcgc

SEQ ID NO: 578165 - DNA, 25 bp, Rattus norvegicus
ggaagcagccttcgcagctgcaact

SEQ ID NO: 578166 - DNA, 25 bp, Rattus norvegicus
gcagtccgctgcaatgcttcgggta

SEQ ID NO: 578167 - DNA, 25 bp, Rattus norvegicus
ctcgcacaagttgctctccactgga

SEQ ID NO: 578168 - DNA, 25 bp, Rattus norvegicus
ctcttctagagacagaccagggcga

SEQ ID NO: 578169 - DNA, 25 bp, Rattus norvegicus
tctgtgaaactgtacggggtgaata

SEQ ID NO: 578170 - DNA, 25 bp, Rattus norvegicus
acgttacagggagcacctaggctca

SEQ ID NO: 578171 - DNA, 25 bp, Rattus norvegicus
tagggaattcccgttgttgtcaatc

SEQ ID NO: 578172 - DNA, 25 bp, Rattus norvegicus
tgaccgcaaggtctgtcggccattc

SEQ ID NO: 578173 - DNA, 25 bp, Rattus norvegicus
tctccaggacgtacagggaattgtc

SEQ ID NO: 578174 - DNA, 25 bp, Rattus norvegicus
tgatccgcaggatgacgttgttctc

SEQ ID NO: 578175 - DNA, 25 bp, Rattus norvegicus
ctgacctggtgattctcggtgatcc

SEQ ID NO: 578176 - DNA, 25 bp, Rattus norvegicus
gatcttcttctcgtccgtctcggtg

SEQ ID NO: 578177 - DNA, 25 bp, Rattus norvegicus
gcagatctctccgttggtggtgacc

SEQ ID NO: 578178 - DNA, 25 bp, Rattus norvegicus
tggcgtatgcgtcatctcccgaata

SEQ ID NO: 578179 - DNA, 25 bp, Rattus norvegicus
ggatattcccgaggtctgcgatgta

SEQ ID NO: 578180 - DNA, 25 bp, Rattus norvegicus
ggtttgtttttgctgaccgccctga

SEQ ID NO: 578181 - DNA, 25 bp, Rattus norvegicus
cgtacagttcctgttctcccggaga

SEQ ID NO: 578182 - DNA, 25 bp, Rattus norvegicus
ccatcggcgttgaacacgtacagtt

SEQ ID NO: 578183 - DNA, 25 bp, Rattus norvegicus
tcacggtgtactgatggataccatc

SEQ ID NO: 578184 - DNA, 25 bp, Rattus norvegicus
cggccattctagacggacctgtaca

SEQ ID NO: 578185 - DNA, 25 bp, Rattus norvegicus
gggagccgcatctcctcagggcagg

SEQ ID NO: 578186 - DNA, 25 bp, Rattus norvegicus
gagctgcccgcacgggctccgcacc

SEQ ID NO: 578187 - DNA, 25 bp, Rattus norvegicus
gcacactgagctgcccgcacgggct

SEQ ID NO: 578188 - DNA, 25 bp, Rattus norvegicus
gggcatctcggagcgcgcacactga

SEQ ID NO: 578189 - DNA, 25 bp, Rattus norvegicus
cgctgggcatctcggagcgcgcaca

SEQ ID NO: 578190 - DNA, 25 bp, Rattus norvegicus
ccagagctcccggctggaggccaag

SEQ ID NO: 578191 - DNA, 25 bp, Rattus norvegicus
ctcagtcaccactggtgagcgcgga

SEQ ID NO: 578192 - DNA, 25 bp, Rattus norvegicus
gtcaccactggtgagcgcggacttc

SEQ ID NO: 578193 - DNA, 25 bp, Rattus norvegicus
caccactggtgagcgcggacttcgc

SEQ ID NO: 578194 - DNA, 25 bp, Rattus norvegicus
tgagcgcggacttcgctgccatcct

SEQ ID NO: 578195 - DNA, 25 bp, Rattus norvegicus
ggacttcgctgccatcctgcggctg

SEQ ID NO: 578196 - DNA, 25 bp, Rattus norvegicus
cctgcggctgcctaaggctcgctgg

SEQ ID NO: 578197 - DNA, 25 bp, Rattus norvegicus
gcaaatacccagagctcccggctgg

SEQ ID NO: 578198 - DNA, 25 bp, Rattus norvegicus
atacccagagctcccggctggaggc

SEQ ID NO: 578199 - DNA, 25 bp, Rattus norvegicus
tcctgccttccagcgtgctttttgc

SEQ ID NO: 578200 - DNA, 25 bp, Rattus norvegicus
tccggagacaaaagggtccaggcca

SEQ ID NO: 578201 - DNA, 25 bp, Rattus norvegicus
gcagtgacaaagacagccgaatcgg

SEQ ID NO: 578202 - DNA, 25 bp, Rattus norvegicus
gcgcacagcaggtcaggcagtgaca

SEQ ID NO: 578203 - DNA, 25 bp, Rattus norvegicus
ggccgagtcaaatcaaagtcaccct

SEQ ID NO: 578204 - DNA, 25 bp, Rattus norvegicus
tcaggcttccaaccaggccgagtca

SEQ ID NO: 578205 - DNA, 25 bp, Rattus norvegicus
taactagtcacctctgcacctctgg

SEQ ID NO: 578206 - DNA, 25 bp, Rattus norvegicus
cggtgctccaggaagtcaataacta

SEQ ID NO: 578207 - DNA, 25 bp, Rattus norvegicus
ctcgcccagagaaaagccggtgctc

SEQ ID NO: 578208 - DNA, 25 bp, Rattus norvegicus
ccgccatcttgacggaaagaggccc

SEQ ID NO: 578209 - DNA, 25 bp, Rattus norvegicus
tcaagctacccagacactgtgcgcg

SEQ ID NO: 578210 - DNA, 25 bp, Rattus norvegicus
atcggtagtcgctgagcttaacctc

SEQ ID NO: 578211 - DNA, 25 bp, Rattus norvegicus
cgcggccacacgttcaatcggtagt

SEQ ID NO: 578212 - DNA, 25 bp, Rattus norvegicus
cgcgggtgtttcgaagtccgcaacg

SEQ ID NO: 578213 - DNA, 25 bp, Rattus norvegicus
cgcgagcggcgatattcctgtagct

SEQ ID NO: 578214 - DNA, 25 bp, Rattus norvegicus
tgacagtatctgatccgacctggga

SEQ ID NO: 578215 - DNA, 25 bp, Rattus norvegicus
ctcccgaggcttccatgacagtatc

SEQ ID NO: 578216 - DNA, 25 bp, Rattus norvegicus
ctgatcgtcagggatcgggacctca

SEQ ID NO: 578217 - DNA, 25 bp, Rattus norvegicus
gagcctgtcctggagctgatcgtca

SEQ ID NO: 578218 - DNA, 25 bp, Rattus norvegicus
tcctgtagctcctcctgttccggga

SEQ ID NO: 578219 - DNA, 25 bp, Rattus norvegicus
actgcacgcgcttcttacacttgga

SEQ ID NO: 578220 - DNA, 25 bp, Rattus norvegicus
tgaagtgcttcacgctggccaggct

SEQ ID NO: 578221 - DNA, 25 bp, Rattus norvegicus
ggctgggagcattgcacacgctcta

SEQ ID NO: 578222 - DNA, 25 bp, Rattus norvegicus
atgtgcgccactcggtgaaagtgta

SEQ ID NO: 578223 - DNA, 25 bp, Rattus norvegicus
tcggccggcacgtccagaaatgtgc

SEQ ID NO: 578224 - DNA, 25 bp, Rattus norvegicus
tgtcagcatcctctccttctttggg

SEQ ID NO: 578225 - DNA, 25 bp, Rattus norvegicus
gtcctgagggaaacacagaaactcc

SEQ ID NO: 578226 - DNA, 25 bp, Rattus norvegicus
gctgccactttctgagccgacagga

SEQ ID NO: 578227 - DNA, 25 bp, Rattus norvegicus
ctcctccaaaaggaagctcagcctg

SEQ ID NO: 578228 - DNA, 25 bp, Rattus norvegicus
cctgtgccgccataacactcgtggg

SEQ ID NO: 578229 - DNA, 25 bp, Rattus norvegicus
gccggatcgtcctcaggtcatgtga

SEQ ID NO: 578230 - DNA, 25 bp, Rattus norvegicus
ataggcccttgttgccgagccggat

SEQ ID NO: 578231 - DNA, 25 bp, Rattus norvegicus
gtcccttggctttcccgaagtgata

SEQ ID NO: 578232 - DNA, 25 bp, Rattus norvegicus
ccaggatctccaggaggtgtccctt

SEQ ID NO: 578233 - DNA, 25 bp, Rattus norvegicus
cgtgggaaccacagcatttgcaacc

SEQ ID NO: 578234 - DNA, 25 bp, Rattus norvegicus
cgagggtttaaacgcttcgcaagca

SEQ ID NO: 578235 - DNA, 25 bp, Rattus norvegicus
tgcgcagctagccacctcaggtgag

SEQ ID NO: 578236 - DNA, 25 bp, Rattus norvegicus
tgcagactacgtgtgtgcgcagcta

SEQ ID NO: 578237 - DNA, 25 bp, Rattus norvegicus
ctccggggatccgagtttgcagact

SEQ ID NO: 578238 - DNA, 25 bp, Rattus norvegicus
cgcagcctgagagcctttaaagccg

SEQ ID NO: 578239 - DNA, 25 bp, Rattus norvegicus
gcggctcgaaccacaggacaggtta

SEQ ID NO: 578240 - DNA, 25 bp, Rattus norvegicus
cccgaggcaggcacagccaatgacg

SEQ ID NO: 578241 - DNA, 25 bp, Rattus norvegicus
cggcaagacctcctcggcttcagag

SEQ ID NO: 578242 - DNA, 25 bp, Rattus norvegicus
cgtagtcagaaagcggcgaatggta

SEQ ID NO: 578243 - DNA, 25 bp, Rattus norvegicus
ttaacatggcgacgctgcgcaggct

SEQ ID NO: 578244 - DNA, 25 bp, Rattus norvegicus
cgcctcggcacttactggtctgtga

SEQ ID NO: 578245 - DNA, 25 bp, Rattus norvegicus
ggtctgtgagaaatccaactttggc

SEQ ID NO: 578246 - DNA, 25 bp, Rattus norvegicus
aactttggccacgataagtctcgcc

SEQ ID NO: 578247 - DNA, 25 bp, Rattus norvegicus
cctggacacttccttaacatggcga

SEQ ID NO: 578248 - DNA, 25 bp, Rattus norvegicus
agtctcgccataagcatctcgtgga

SEQ ID NO: 578249 - DNA, 25 bp, Rattus norvegicus
catctcgtggagacgcactatcata

SEQ ID NO: 578250 - DNA, 25 bp, Rattus norvegicus
ggagacgcactatcataattacagg

SEQ ID NO: 578251 - DNA, 25 bp, Rattus norvegicus
cataattacagggtgagtcaggtcc

SEQ ID NO: 578252 - DNA, 25 bp, Rattus norvegicus
ggtgagtcaggtccacccggtctcc

SEQ ID NO: 578253 - DNA, 25 bp, Rattus norvegicus
ttaaggtagaatcacgccgtgcatc

SEQ ID NO: 578254 - DNA, 25 bp, Rattus norvegicus
ggctggagagatttaaggtagaatc

SEQ ID NO: 578255 - DNA, 25 bp, Rattus norvegicus
cacagtctctggtacacgggtgctc

SEQ ID NO: 578256 - DNA, 25 bp, Rattus norvegicus
tcacagtcacgggtacacgggtgct

SEQ ID NO: 578257 - DNA, 25 bp, Rattus norvegicus
acgggtgctcacagtctctggtaca

SEQ ID NO: 578258 - DNA, 25 bp, Rattus norvegicus
acagtcacgggtacacatgtgctca

SEQ ID NO: 578259 - DNA, 25 bp, Rattus norvegicus
gtacacgggtgctcacagtcacagg

SEQ ID NO: 578260 - DNA, 25 bp, Rattus norvegicus
atgtgctcacagtcacgggtacacg

SEQ ID NO: 578261 - DNA, 25 bp, Rattus norvegicus
agtcacgggtacacatgtgctcaca

SEQ ID NO: 578262 - DNA, 25 bp, Rattus norvegicus
tgctcacagtcacgggtacacgggt

SEQ ID NO: 578263 - DNA, 25 bp, Rattus norvegicus
gggtgctcacagtcacgggtacaca

SEQ ID NO: 578264 - DNA, 25 bp, Rattus norvegicus
tgctcacagtcacgggtacacatgt

SEQ ID NO: 578265 - DNA, 25 bp, Rattus norvegicus
agtctctggtacacgggtgctcaca

SEQ ID NO: 578266 - DNA, 25 bp, Rattus norvegicus
acgggtgctcacagtcacaggtaca

SEQ ID NO: 578267 - DNA, 25 bp, Rattus norvegicus
tgctcacagtcacaggtacacgggt

SEQ ID NO: 578268 - DNA, 25 bp, Rattus norvegicus
tctggtacacgggtgctcacagtca

SEQ ID NO: 578269 - DNA, 25 bp, Rattus norvegicus
cggcggtagacactttgttccagtt

SEQ ID NO: 578270 - DNA, 25 bp, Rattus norvegicus
ctggcgcacgcttcccgtccagcaa

SEQ ID NO: 578271 - DNA, 25 bp, Rattus norvegicus
ccgtccagcaaaccgggcacggagg

SEQ ID NO: 578272 - DNA, 25 bp, Rattus norvegicus
ggaggggagtacctcgtacagctcc

SEQ ID NO: 578273 - DNA, 25 bp, Rattus norvegicus
cggcacccggcggtagacactttgt

SEQ ID NO: 578274 - DNA, 25 bp, Rattus norvegicus
actttgttccagttgggtccctgcg

SEQ ID NO: 578275 - DNA, 25 bp, Rattus norvegicus
ttgggtccctgcgtggcctgcgctt

SEQ ID NO: 578276 - DNA, 25 bp, Rattus norvegicus
cacggaccagcctctcgctccgggc

SEQ ID NO: 578277 - DNA, 25 bp, Rattus norvegicus
tcccggtctccggtgtagtgcaaaa

SEQ ID NO: 578278 - DNA, 25 bp, Rattus norvegicus
tctccggtgtagtgcaaaaagcttc

SEQ ID NO: 578279 - DNA, 25 bp, Rattus norvegicus
tgctcgctggggcaggtaacccgac

SEQ ID NO: 578280 - DNA, 25 bp, Rattus norvegicus
ggcaggtaacccgactcgaagttga

SEQ ID NO: 578281 - DNA, 25 bp, Rattus norvegicus
agtacctcgtacagctcctcggagg

SEQ ID NO: 578282 - DNA, 25 bp, Rattus norvegicus
ttcctacttgcgaccgacaaacctg

SEQ ID NO: 578283 - DNA, 25 bp, Rattus norvegicus
ccaaagggtaaggatggacgcgctc

SEQ ID NO: 578284 - DNA, 25 bp, Rattus norvegicus
tcagcatccagctatggcggcagtg

SEQ ID NO: 578285 - DNA, 25 bp, Rattus norvegicus
cccaaagtcgccagcgaggtttgtc

SEQ ID NO: 578286 - DNA, 25 bp, Rattus norvegicus
aggtaagcttgcagcctcgactgtc

SEQ ID NO: 578287 - DNA, 25 bp, Rattus norvegicus
ctgagggacagcaggatattccttt

SEQ ID NO: 578288 - DNA, 25 bp, Rattus norvegicus
ttcctttggagatttcccagcgaga

SEQ ID NO: 578289 - DNA, 25 bp, Rattus norvegicus
tcccagcgagagagctctaaagagt

SEQ ID NO: 578290 - DNA, 25 bp, Rattus norvegicus
agtgacctcgaaggttcttcttctg

SEQ ID NO: 578291 - DNA, 25 bp, Rattus norvegicus
ttcttctgctgagtcccaaagggta

SEQ ID NO: 578292 - DNA, 25 bp, Rattus norvegicus
gagctcagtttgacctcagcatcca

SEQ ID NO: 578293 - DNA, 25 bp, Rattus norvegicus
tgggcctaagcctccgagctcagtt

SEQ ID NO: 578294 - DNA, 25 bp, Rattus norvegicus
cctcacagtttcagctgggcctaag

SEQ ID NO: 578295 - DNA, 25 bp, Rattus norvegicus
gcctatttgtcccagggtcggctca

SEQ ID NO: 578296 - DNA, 25 bp, Rattus norvegicus
gcccgctttgtcgtctgtctggcct

SEQ ID NO: 578297 - DNA, 25 bp, Rattus norvegicus
ccaggaagactatgatgatgatgat

SEQ ID NO: 578298 - DNA, 25 bp, Rattus norvegicus
cttccaggaggacgagtaagagccc

SEQ ID NO: 578299 - DNA, 25 bp, Rattus norvegicus
cggccaccctcgagactccctgacg

SEQ ID NO: 578300 - DNA, 25 bp, Rattus norvegicus
acacgtgggccttccaggaggacga

SEQ ID NO: 578301 - DNA, 25 bp, Rattus norvegicus
tgacgacaacgacgacggccaggac

SEQ ID NO: 578302 - DNA, 25 bp, Rattus norvegicus
tggagaccaggaagactatgatgat

SEQ ID NO: 578303 - DNA, 25 bp, Rattus norvegicus
cccgccgagctgttcgcccagcaag

SEQ ID NO: 578304 - DNA, 25 bp, Rattus norvegicus
ggcccagccagagcccgccgagctg

SEQ ID NO: 578305 - DNA, 25 bp, Rattus norvegicus
cccatcgcaggaaggctggggccca

SEQ ID NO: 578306 - DNA, 25 bp, Rattus norvegicus
ttgtcctcccatcgcaggaaggctg

SEQ ID NO: 578307 - DNA, 25 bp, Rattus norvegicus
tccttgtcctcccatcgcaggaagg

SEQ ID NO: 578308 - DNA, 25 bp, Rattus norvegicus
agccgcagttctccctccttgtcct

SEQ ID NO: 578309 - DNA, 25 bp, Rattus norvegicus
tcctgcagccggacttggtcccggg

SEQ ID NO: 578310 - DNA, 25 bp, Rattus norvegicus
acggccaggacacgtgggccttcca

SEQ ID NO: 578311 - DNA, 25 bp, Rattus norvegicus
gcagggtgccgtgatgtaatttccg

SEQ ID NO: 578312 - DNA, 25 bp, Rattus norvegicus
ccgcacgatgcacttactcaggttg

SEQ ID NO: 578313 - DNA, 25 bp, Rattus norvegicus
ctaactggacctgtagaggccgctc

SEQ ID NO: 578314 - DNA, 25 bp, Rattus norvegicus
ggcaaactttggctatcgcccgtta

SEQ ID NO: 578315 - DNA, 25 bp, Rattus norvegicus
tatcgcccgttaggcctgaactttc

SEQ ID NO: 578316 - DNA, 25 bp, Rattus norvegicus
tggcggccatcttgaacttcccgac

SEQ ID NO: 578317 - DNA, 25 bp, Rattus norvegicus
tgaacttcccgacttctccgcggtg

SEQ ID NO: 578318 - DNA, 25 bp, Rattus norvegicus
gctccgcgaaccgtagacgccagtg

SEQ ID NO: 578319 - DNA, 25 bp, Rattus norvegicus
gtcgcgcatgtgcaaagcacgtaga

SEQ ID NO: 578320 - DNA, 25 bp, Rattus norvegicus
agcacgtagagaaaagcggcactcc

SEQ ID NO: 578321 - DNA, 25 bp, Rattus norvegicus
ccgcgctaagaatccggatagaaaa

SEQ ID NO: 578322 - DNA, 25 bp, Rattus norvegicus
ccgagggttgagaccagagctccac

SEQ ID NO: 578323 - DNA, 25 bp, Rattus norvegicus
cggcactccgagtccgcgctaagaa

SEQ ID NO: 578324 - DNA, 25 bp, Rattus norvegicus
aaggcgcgcggaaaggcaaactttg

SEQ ID NO: 578325 - DNA, 25 bp, Rattus norvegicus
gcctaccaatggtgcagtgttcacc

SEQ ID NO: 578326 - DNA, 25 bp, Rattus norvegicus
cctgccgtttgcctaccaatggtgc

SEQ ID NO: 578327 - DNA, 25 bp, Rattus norvegicus
cggtgcctgccgtttgcctaccaat

SEQ ID NO: 578328 - DNA, 25 bp, Rattus norvegicus
aatatgtgcctgtttcggtgcctgc

SEQ ID NO: 578329 - DNA, 25 bp, Rattus norvegicus
aaagcaatatgtgcctgtttcggtg

SEQ ID NO: 578330 - DNA, 25 bp, Rattus norvegicus
cgtcactatcgatctacgatttatg

SEQ ID NO: 578331 - DNA, 25 bp, Rattus norvegicus
atgcgcgaccgtcactatcgatcta

SEQ ID NO: 578332 - DNA, 25 bp, Rattus norvegicus
gttgcaatgcgcgaccgtcactatc

SEQ ID NO: 578333 - DNA, 25 bp, Rattus norvegicus
ctctcggcattcacatttgccatct

SEQ ID NO: 578334 - DNA, 25 bp, Rattus norvegicus
atttgccatctttacaggtcccgtg

SEQ ID NO: 578335 - DNA, 25 bp, Rattus norvegicus
tacaggtcccgtgctcaatgcagcg

SEQ ID NO: 578336 - DNA, 25 bp, Rattus norvegicus
tggcacacgcgctggtcacaagccg

SEQ ID NO: 578337 - DNA, 25 bp, Rattus norvegicus
gccctcttcacagcggcaggctccc

SEQ ID NO: 578338 - DNA, 25 bp, Rattus norvegicus
gtgcagtgttcaccattccagccct

SEQ ID NO: 578339 - DNA, 25 bp, Rattus norvegicus
tgtaaagaggccttgccagttccca

SEQ ID NO: 578340 - DNA, 25 bp, Rattus norvegicus
cggcttgccaagattgcgtctgtgc

SEQ ID NO: 578341 - DNA, 25 bp, Rattus norvegicus
accgtggagaccacagcgcttggca

SEQ ID NO: 578342 - DNA, 25 bp, Rattus norvegicus
ccgccctgttcggtgacaccgtgga

SEQ ID NO: 578343 - DNA, 25 bp, Rattus norvegicus
cctcaagtagaggaccgccctgttc

SEQ ID NO: 578344 - DNA, 25 bp, Rattus norvegicus
caggctagagagacgcgtgcgtact

SEQ ID NO: 578345 - DNA, 25 bp, Rattus norvegicus
cgtgcgtactgaggtccaggagaaa

SEQ ID NO: 578346 - DNA, 25 bp, Rattus norvegicus
caacgtcagcagagcggcttgccaa

SEQ ID NO: 578347 - DNA, 25 bp, Rattus norvegicus
ggcggaaccagcttcccggaagtca

SEQ ID NO: 578348 - DNA, 25 bp, Rattus norvegicus
acggcccgatccagagctgtggttt

SEQ ID NO: 578349 - DNA, 25 bp, Rattus norvegicus
tcgaagccctggtatcggaacggcc

SEQ ID NO: 578350 - DNA, 25 bp, Rattus norvegicus
ttgttgctttagtactgcggcgggc

SEQ ID NO: 578351 - DNA, 25 bp, Rattus norvegicus
tcccggaagtcattggcaggctaga

SEQ ID NO: 578352 - DNA, 25 bp, Rattus norvegicus
agttcccagctcctgctcaacttgt

SEQ ID NO: 578353 - DNA, 25 bp, Rattus norvegicus
cacatcggggttcttgcccaagttc

SEQ ID NO: 578354 - DNA, 25 bp, Rattus norvegicus
ctcatccagcgtgaaagacaggttg

SEQ ID NO: 578355 - DNA, 25 bp, Rattus norvegicus
ggcaggaagctcgtgtccacatcgg

SEQ ID NO: 578356 - DNA, 25 bp, Rattus norvegicus
tcccagtagctgaaggtgatctcca

SEQ ID NO: 578357 - DNA, 25 bp, Rattus norvegicus
tggccagagccatcccagtagctga

SEQ ID NO: 578358 - DNA, 25 bp, Rattus norvegicus
agcgcccgcttcaggaactgctgca

SEQ ID NO: 578359 - DNA, 25 bp, Rattus norvegicus
tccttgacgtacatgagctgctcca

SEQ ID NO: 578360 - DNA, 25 bp, Rattus norvegicus
cgctttggccacgatgaagtcgtaa

SEQ ID NO: 578361 - DNA, 25 bp, Rattus norvegicus
cgtcgaagctgaagagcggcccact

SEQ ID NO: 578362 - DNA, 25 bp, Rattus norvegicus
agccgcacatcatcgtgcacgtcga

SEQ ID NO: 578363 - DNA, 25 bp, Rattus norvegicus
tgactcgtctttctccatcgtggca

SEQ ID NO: 578364 - DNA, 25 bp, Rattus norvegicus
acctttcccgcgtgtgactcgtctt

SEQ ID NO: 578365 - DNA, 25 bp, Rattus norvegicus
gttcttctcataccagctgcgcagc

SEQ ID NO: 578366 - DNA, 25 bp, Rattus norvegicus
acgcaggatctctagctgtagccga

SEQ ID NO: 578367 - DNA, 25 bp, Rattus norvegicus
actctggacttcagcgacgtgtcaa

SEQ ID NO: 578368 - DNA, 25 bp, Rattus norvegicus
tcccgaggattcagagtaggaacga

SEQ ID NO: 578369 - DNA, 25 bp, Rattus norvegicus
cccgcgatgggaagtgccttataaa

SEQ ID NO: 578370 - DNA, 25 bp, Rattus norvegicus
tcagacagactcttggcgacgccgc

SEQ ID NO: 578371 - DNA, 25 bp, Rattus norvegicus
tgcgcgaagagctagagcacatccg

SEQ ID NO: 578372 - DNA, 25 bp, Rattus norvegicus
acatccgcggggcatcaacttctac

SEQ ID NO: 578373 - DNA, 25 bp, Rattus norvegicus
tcttaacggccgttgcgaggatcga

SEQ ID NO: 578374 - DNA, 25 bp, Rattus norvegicus
gatcgaccgcgtcccacagagaatt

SEQ ID NO: 578375 - DNA, 25 bp, Rattus norvegicus
gtgtgctctacctgcaccgcagctt

SEQ ID NO: 578376 - DNA, 25 bp, Rattus norvegicus
aggagttcttcgagatccgcaccga

SEQ ID NO: 578377 - DNA, 25 bp, Rattus norvegicus
cgggcagagtgctcaactccaggca

SEQ ID NO: 578378 - DNA, 25 bp, Rattus norvegicus
gagaattcctgatcgcccttgccca

SEQ ID NO: 578379 - DNA, 25 bp, Rattus norvegicus
acgccggtaaccgatgggacactgg

SEQ ID NO: 578380 - DNA, 25 bp, Rattus norvegicus
gggcacgtcgctcgtgaacatgttc

SEQ ID NO: 578381 - DNA, 25 bp, Rattus norvegicus
cggcggctaccagaagaccctggtg

SEQ ID NO: 578382 - DNA, 25 bp, Rattus norvegicus
tgttcatcggcttcagccagttctc

SEQ ID NO: 578383 - DNA, 25 bp, Rattus norvegicus
agccagttctcggactcctttcttc

SEQ ID NO: 578384 - DNA, 25 bp, Rattus norvegicus
tcggactcctttcttctggaccagc

SEQ ID NO: 578385 - DNA, 25 bp, Rattus norvegicus
aggctaagggctcgaacgtcttctg

SEQ ID NO: 578386 - DNA, 25 bp, Rattus norvegicus
tgctcacctggatcccggcgctgtt

SEQ ID NO: 578387 - DNA, 25 bp, Rattus norvegicus
tcttctggaccagcccaacttctgg

SEQ ID NO: 578388 - DNA, 25 bp, Rattus norvegicus
ctggactacgatggctctgtgctgc

SEQ ID NO: 578389 - DNA, 25 bp, Rattus norvegicus
cgagcctcctgttgctggactacga

SEQ ID NO: 578390 - DNA, 25 bp, Rattus norvegicus
cgcactcgagctgctgtgcggcagc

SEQ ID NO: 578391 - DNA, 25 bp, Rattus norvegicus
cagcccaacttctggtgccacgggg

SEQ ID NO: 578392 - DNA, 25 bp, Rattus norvegicus
agcgcccgaagtccgtggaggacct

SEQ ID NO: 578393 - DNA, 25 bp, Rattus norvegicus
cgggtgccactgtcaccggccgatg

SEQ ID NO: 578394 - DNA, 25 bp, Rattus norvegicus
aagaccctggtggtgctcacctgga

SEQ ID NO: 578395 - DNA, 25 bp, Rattus norvegicus
cgctgttccgagagaggcgagcggt

SEQ ID NO: 578396 - DNA, 25 bp, Rattus norvegicus
acgttcggagcgctgttccgagaga

SEQ ID NO: 578397 - DNA, 25 bp, Rattus norvegicus
tgttcgtaagggtgagcacgggtag

SEQ ID NO: 578398 - DNA, 25 bp, Rattus norvegicus
ggtgcagctcctcgcctggaaccga

SEQ ID NO: 578399 - DNA, 25 bp, Rattus norvegicus
ccgccgtagcggagctgccggtgct

SEQ ID NO: 578400 - DNA, 25 bp, Rattus norvegicus
ccgactggctcggacacagagcgcg

SEQ ID NO: 578401 - DNA, 25 bp, Rattus norvegicus
agcccgactggctcggacacagagc

SEQ ID NO: 578402 - DNA, 25 bp, Rattus norvegicus
cgcaggccgggtcccgagcccgact

SEQ ID NO: 578403 - DNA, 25 bp, Rattus norvegicus
gccgcgccggtgacgcggcaggtca

SEQ ID NO: 578404 - DNA, 25 bp, Rattus norvegicus
ggtcgccctcctccgcgatggccgc

SEQ ID NO: 578405 - DNA, 25 bp, Rattus norvegicus
ttcagctccctcttcgccctcgtga

SEQ ID NO: 578406 - DNA, 25 bp, Rattus norvegicus
tcccaaggatcatcccgcgtggccc

SEQ ID NO: 578407 - DNA, 25 bp, Rattus norvegicus
acgcgtctgggagacgggtgacgtt

SEQ ID NO: 578408 - DNA, 25 bp, Rattus norvegicus
ttgtgtccacgcctcccaaggatca

SEQ ID NO: 578409 - DNA, 25 bp, Rattus norvegicus
caagcgcgggagaccagaccagaaa

SEQ ID NO: 578410 - DNA, 25 bp, Rattus norvegicus
tttcactttcagctgcgcgcgccga

SEQ ID NO: 578411 - DNA, 25 bp, Rattus norvegicus
tgagcgctctttcactttcagctgc

SEQ ID NO: 578412 - DNA, 25 bp, Rattus norvegicus
ccagaccagaaagagcgagcgccga

SEQ ID NO: 578413 - DNA, 25 bp, Rattus norvegicus
gggccacagcctagaccaggcaagc

SEQ ID NO: 578414 - DNA, 25 bp, Rattus norvegicus
tgaagcgacacgtccgcggcggctt

SEQ ID NO: 578415 - DNA, 25 bp, Rattus norvegicus
cccacagcctcgcactgaagttgtg

SEQ ID NO: 578416 - DNA, 25 bp, Rattus norvegicus
ccgcatgacatgaaagtggacgagc

SEQ ID NO: 578417 - DNA, 25 bp, Rattus norvegicus
gcgagtccgttagccgcatgacatg

SEQ ID NO: 578418 - DNA, 25 bp, Rattus norvegicus
aggaagagcgagtccgttagccgca

SEQ ID NO: 578419 - DNA, 25 bp, Rattus norvegicus
cacactcacgaagcggctacacatg

SEQ ID NO: 578420 - DNA, 25 bp, Rattus norvegicus
cactgaagttgtgaagcgacacgtc

SEQ ID NO: 578421 - DNA, 25 bp, Rattus norvegicus
cgagcgccgaaaagctgagcgctct

SEQ ID NO: 578422 - DNA, 25 bp, Rattus norvegicus
agcggctacacatggccacagcgag

SEQ ID NO: 578423 - DNA, 25 bp, Rattus norvegicus
gctgattggccacaagcccatagtc

SEQ ID NO: 578424 - DNA, 25 bp, Rattus norvegicus
aaccgggcctggagagcgcttgcta

SEQ ID NO: 578425 - DNA, 25 bp, Rattus norvegicus
gagcattacgtcaaccgggcctgga

SEQ ID NO: 578426 - DNA, 25 bp, Rattus norvegicus
ggctcagagcattacgtcaaccggg

SEQ ID NO: 578427 - DNA, 25 bp, Rattus norvegicus
tggggctcagagcattacgtcaacc

SEQ ID NO: 578428 - DNA, 25 bp, Rattus norvegicus
tccctggggctcagagcattacgtc

SEQ ID NO: 578429 - DNA, 25 bp, Rattus norvegicus
ccgtccctggggctcagagcattac

SEQ ID NO: 578430 - DNA, 25 bp, Rattus norvegicus
gattggccacaagcccatagtccag

SEQ ID NO: 578431 - DNA, 25 bp, Rattus norvegicus
gcgctgattggccacaagcccatag

SEQ ID NO: 578432 - DNA, 25 bp, Rattus norvegicus
ctaggtcttcatgcccgcgctgatt

SEQ ID NO: 578433 - DNA, 25 bp, Rattus norvegicus
gagagcgcttgctagaacgggactg

SEQ ID NO: 578434 - DNA, 25 bp, Rattus norvegicus
gcattacgtcaaccgggcctggaga

SEQ ID NO: 578435 - DNA, 25 bp, Rattus norvegicus
cggaccgtccctggggctcagagca

SEQ ID NO: 578436 - DNA, 25 bp, Rattus norvegicus
tcagagcattacgtcaaccgggcct

SEQ ID NO: 578437 - DNA, 25 bp, Rattus norvegicus
cgtagtaaccctgggacgctgcata

SEQ ID NO: 578438 - DNA, 25 bp, Rattus norvegicus
gtaaccctgggacgctgcatacagc

SEQ ID NO: 578439 - DNA, 25 bp, Rattus norvegicus
acgctgcatacagccgggtgccctg

SEQ ID NO: 578440 - DNA, 25 bp, Rattus norvegicus
ggtgccctgcacctcgcaccgcgcc

SEQ ID NO: 578441 - DNA, 25 bp, Rattus norvegicus
ctccctctcgcggtgccgcagtccc

SEQ ID NO: 578442 - DNA, 25 bp, Rattus norvegicus
ggaaggcgactggtcttttgctctc

SEQ ID NO: 578443 - DNA, 25 bp, Rattus norvegicus
ggcgactggtcttttgctctcctta

SEQ ID NO: 578444 - DNA, 25 bp, Rattus norvegicus
gtcttttgctctccttagccctcgg

SEQ ID NO: 578445 - DNA, 25 bp, Rattus norvegicus
ggtccacgcactgctcctagggcaa

SEQ ID NO: 578446 - DNA, 25 bp, Rattus norvegicus
tgctcctagggcaagagccttcacc

SEQ ID NO: 578447 - DNA, 25 bp, Rattus norvegicus
agggcaagagccttcacctcttcta

SEQ ID NO: 578448 - DNA, 25 bp, Rattus norvegicus
gcaagagccttcacctcttctacag

SEQ ID NO: 578449 - DNA, 25 bp, Rattus norvegicus
agccaacaccatgcgcgagatcgtg

SEQ ID NO: 578450 - DNA, 25 bp, Rattus norvegicus
tacagccaacaccatgcgcgagatc

SEQ ID NO: 578451 - DNA, 25 bp, Rattus norvegicus
ctttcgcgccattacccgaaggtgg

SEQ ID NO: 578452 - DNA, 25 bp, Rattus norvegicus
ccttgaagtgctaagctggaagccc

SEQ ID NO: 578453 - DNA, 25 bp, Rattus norvegicus
ccagctggatgccacccttgaagtg

SEQ ID NO: 578454 - DNA, 25 bp, Rattus norvegicus
acagccttagcagaacgcgcgtgcg

SEQ ID NO: 578455 - DNA, 25 bp, Rattus norvegicus
tattctcccagtcgcacagccttag

SEQ ID NO: 578456 - DNA, 25 bp, Rattus norvegicus
tggactgctgcggtcgccatattct

SEQ ID NO: 578457 - DNA, 25 bp, Rattus norvegicus
cgcaccagttctgcgggatctggac

SEQ ID NO: 578458 - DNA, 25 bp, Rattus norvegicus
taaccgcagggctactgggtggact

SEQ ID NO: 578459 - DNA, 25 bp, Rattus norvegicus
tgagaggagcaaccgtaaccgcagg

SEQ ID NO: 578460 - DNA, 25 bp, Rattus norvegicus
tggggtacgcagatccgggatttca

SEQ ID NO: 578461 - DNA, 25 bp, Rattus norvegicus
cattacccgaaggtggctgcgtgct

SEQ ID NO: 578462 - DNA, 25 bp, Rattus norvegicus
atctggacttgggtctgagcaagga

SEQ ID NO: 578463 - DNA, 25 bp, Rattus norvegicus
gcggacaacgccaggcgtccgtatc

SEQ ID NO: 578464 - DNA, 25 bp, Rattus norvegicus
agtggaccgcgctggccctttcgcg

SEQ ID NO: 578465 - DNA, 25 bp, Rattus norvegicus
ttagaggcttttccgcggccaagta

SEQ ID NO: 578466 - DNA, 25 bp, Rattus norvegicus
ccctgactaggaccggacggagcta

SEQ ID NO: 578467 - DNA, 25 bp, Rattus norvegicus
gcggcgcagatgtccaccttctctg

SEQ ID NO: 578468 - DNA, 25 bp, Rattus norvegicus
ccgggaatccagctgttgaggaaac

SEQ ID NO: 578469 - DNA, 25 bp, Rattus norvegicus
aaagccaggtttgcagcgcgatgat

SEQ ID NO: 578470 - DNA, 25 bp, Rattus norvegicus
gctcctacgcgtctaaggtctactg

SEQ ID NO: 578471 - DNA, 25 bp, Rattus norvegicus
cggccaagtactccggcccaggtga

SEQ ID NO: 578472 - DNA, 25 bp, Rattus norvegicus
cccggctctgacttaccttagaggc

SEQ ID NO: 578473 - DNA, 25 bp, Rattus norvegicus
cggtccacgcgcagaaatcgctcgg

SEQ ID NO: 578474 - DNA, 25 bp, Rattus norvegicus
gggtacgcttgaagtcccgcccatc

SEQ ID NO: 578475 - DNA, 25 bp, Rattus norvegicus
gctagatgacagcaagtcccgcgct

SEQ ID NO: 578476 - DNA, 25 bp, Rattus norvegicus
aagtgtccaccctcccgctagatga

SEQ ID NO: 578477 - DNA, 25 bp, Rattus norvegicus
tctgtcgcgacttgagctaaaacta

SEQ ID NO: 578478 - DNA, 25 bp, Rattus norvegicus
gctgggcattgagctctaccgagaa

SEQ ID NO: 578479 - DNA, 25 bp, Rattus norvegicus
tcctctttcttcgaggggtgtccca

SEQ ID NO: 578480 - DNA, 25 bp, Rattus norvegicus
ttccttgagcgcttattgggtgccc

SEQ ID NO: 578481 - DNA, 25 bp, Rattus norvegicus
gtgcaatcagccagcagcagctctg

SEQ ID NO: 578482 - DNA, 25 bp, Rattus norvegicus
tcctttgtcccaatcgcgcggcgga

SEQ ID NO: 578483 - DNA, 25 bp, Rattus norvegicus
agaggagcagatgcccagccaagca

SEQ ID NO: 578484 - DNA, 25 bp, Rattus norvegicus
attcgcgcaggacgtagaaccggtc

SEQ ID NO: 578485 - DNA, 25 bp, Rattus norvegicus
cccgtcaatgcggagtgagtgttcc

SEQ ID NO: 578486 - DNA, 25 bp, Rattus norvegicus
tcgatcctattttgaccacgctggg

SEQ ID NO: 578487 - DNA, 25 bp, Rattus norvegicus
atgagcgccagatttcccttaggcc

SEQ ID NO: 578488 - DNA, 25 bp, Rattus norvegicus
ttctccaccgatgaaatgagcgcca

SEQ ID NO: 578489 - DNA, 25 bp, Rattus norvegicus
ggacctgagaccaaacgctgcggct

SEQ ID NO: 578490 - DNA, 25 bp, Rattus norvegicus
caattactgccgaccggacctgaga

SEQ ID NO: 578491 - DNA, 25 bp, Rattus norvegicus
ccagtcaagtttacgccacgcaatt

SEQ ID NO: 578492 - DNA, 25 bp, Rattus norvegicus
aggggctcccgaagacccagtcaag

SEQ ID NO: 578493 - DNA, 25 bp, Rattus norvegicus
atcccgagtgatccaggagaccctg

SEQ ID NO: 578494 - DNA, 25 bp, Rattus norvegicus
agccgactgagtcgccttgtggtcc

SEQ ID NO: 578495 - DNA, 25 bp, Rattus norvegicus
tggtcccggccatctggtggcatct

SEQ ID NO: 578496 - DNA, 25 bp, Rattus norvegicus
cacaggtatttaaggcctcgggcgc

SEQ ID NO: 578497 - DNA, 25 bp, Rattus norvegicus
ggggctacaggtgaccacgtatgtc

SEQ ID NO: 578498 - DNA, 25 bp, Rattus norvegicus
cttgtggagagagctctgtggtccc

SEQ ID NO: 578499 - DNA, 25 bp, Rattus norvegicus
acgcaggctggtgacgcactacgac

SEQ ID NO: 578500 - DNA, 25 bp, Rattus norvegicus
ctctgctgcacagggcctcagcgga

SEQ ID NO: 578501 - DNA, 25 bp, Rattus norvegicus
ttctgctgtaggctaactgcggccg

SEQ ID NO: 578502 - DNA, 25 bp, Rattus norvegicus
tctctgcctgccactggtccggaaa

SEQ ID NO: 578503 - DNA, 25 bp, Rattus norvegicus
gtccggaaatccagagtctagggta

SEQ ID NO: 578504 - DNA, 25 bp, Rattus norvegicus
agagtctagggtacgttctgctgta

SEQ ID NO: 578505 - DNA, 25 bp, Rattus norvegicus
tcagcggaccgtgacgcagccgact

SEQ ID NO: 578506 - DNA, 25 bp, Rattus norvegicus
acccagatctgccagcgttcttgga

SEQ ID NO: 578507 - DNA, 25 bp, Rattus norvegicus
cgcgctgactccgaacgaagcatcg

SEQ ID NO: 578508 - DNA, 25 bp, Rattus norvegicus
gggcagaatagtccgcaaccggttg

SEQ ID NO: 578509 - DNA, 25 bp, Rattus norvegicus
agtgtagtccaaagcgggcagaata

SEQ ID NO: 578510 - DNA, 25 bp, Rattus norvegicus
cgtcgtgtcgggaagtgtagtccaa

SEQ ID NO: 578511 - DNA, 25 bp, Rattus norvegicus
cacactgggcattgcacctggtgca

SEQ ID NO: 578512 - DNA, 25 bp, Rattus norvegicus
ggcgggcatcatctgctggcacact

SEQ ID NO: 578513 - DNA, 25 bp, Rattus norvegicus
gcaggctgtttcagcgccgagctct

SEQ ID NO: 578514 - DNA, 25 bp, Rattus norvegicus
caaaccctttctagctgggctgctg

SEQ ID NO: 578515 - DNA, 25 bp, Rattus norvegicus
tcggatttcttcagccggcagtgcc

SEQ ID NO: 578516 - DNA, 25 bp, Rattus norvegicus
tgccctccagcatctgtcggatttc

SEQ ID NO: 578517 - DNA, 25 bp, Rattus norvegicus
gggacgcatcttatcagccagtggc

SEQ ID NO: 578518 - DNA, 25 bp, Rattus norvegicus
gtcctgcagcgtatcgggacgcatc

SEQ ID NO: 578519 - DNA, 25 bp, Rattus norvegicus
ctactctgcccgatgtagtcctgca

SEQ ID NO: 578520 - DNA, 25 bp, Rattus norvegicus
gtcgtagctctcacggctctcagtc

SEQ ID NO: 578521 - DNA, 25 bp, Rattus norvegicus
ggcaagctcaggaaggtagctctca

SEQ ID NO: 578522 - DNA, 25 bp, Rattus norvegicus
ctccttgaagcgactggcgcacgca

SEQ ID NO: 578523 - DNA, 25 bp, Rattus norvegicus
gccttcctatcggtcgcacgctcac

SEQ ID NO: 578524 - DNA, 25 bp, Rattus norvegicus
acgctcccgctagctgccggagata

SEQ ID NO: 578525 - DNA, 25 bp, Rattus norvegicus
ctagctgccggagatacccgggctc

SEQ ID NO: 578526 - DNA, 25 bp, Rattus norvegicus
agcagcgtggctctctgagcgtgct

SEQ ID NO: 578527 - DNA, 25 bp, Rattus norvegicus
ggtagctctcatcaccggcatcact

SEQ ID NO: 578528 - DNA, 25 bp, Rattus norvegicus
accggcatcactggccaggtgagtg

SEQ ID NO: 578529 - DNA, 25 bp, Rattus norvegicus
cacggggaactacactccacgagtc

SEQ ID NO: 578530 - DNA, 25 bp, Rattus norvegicus
cactccacgagtcccggaaggtgtg

SEQ ID NO: 578531 - DNA, 25 bp, Rattus norvegicus
ccgcgggatgggacagcttcaaccc

SEQ ID NO: 578532 - DNA, 25 bp, Rattus norvegicus
tggccactgcagctccttgaagcga

SEQ ID NO: 578533 - DNA, 25 bp, Rattus norvegicus
cgccttgtcagaccgtggtggccac

SEQ ID NO: 578534 - DNA, 25 bp, Rattus norvegicus
ggacagcttcaacccgagcagcgtg

SEQ ID NO: 578535 - DNA, 25 bp, Rattus norvegicus
tcacccgtgagcaatgaagtgcctg

SEQ ID NO: 578536 - DNA, 25 bp, Rattus norvegicus
ggctggacgccactccgaaatgcaa

SEQ ID NO: 578537 - DNA, 25 bp, Rattus norvegicus
tgacgccatttgctccacagacaag

SEQ ID NO: 578538 - DNA, 25 bp, Rattus norvegicus
gaggggtcgtctccttttgacgcca

SEQ ID NO: 578539 - DNA, 25 bp, Rattus norvegicus
atggactcaaacaactcaagcgggg

SEQ ID NO: 578540 - DNA, 25 bp, Rattus norvegicus
ccggaccctacactgatggactcaa

SEQ ID NO: 578541 - DNA, 25 bp, Rattus norvegicus
ctgtgacctttccacctgggctgtg

SEQ ID NO: 578542 - DNA, 25 bp, Rattus norvegicus
cgcagcgggtaattacagctcatta

SEQ ID NO: 578543 - DNA, 25 bp, Rattus norvegicus
tcgcagctttcggaccaggcagcct

SEQ ID NO: 578544 - DNA, 25 bp, Rattus norvegicus
gcccaagtaattcgtgtccctgtca

SEQ ID NO: 578545 - DNA, 25 bp, Rattus norvegicus
cgcgggcacttagaacggaacctgc

SEQ ID NO: 578546 - DNA, 25 bp, Rattus norvegicus
cctcaaggcctaggtggagtagata

SEQ ID NO: 578547 - DNA, 25 bp, Rattus norvegicus
ggcctaggcgttctcagggcctcaa

SEQ ID NO: 578548 - DNA, 25 bp, Rattus norvegicus
tgggctgtgctcctaaacacacgtg

SEQ ID NO: 578549 - DNA, 25 bp, Rattus norvegicus
ctgtcgggactctcgattttaggca

SEQ ID NO: 578550 - DNA, 25 bp, Rattus norvegicus
gcccttgcctggcttcttgtcgtcg

SEQ ID NO: 578551 - DNA, 25 bp, Rattus norvegicus
tgccattcagggtgatcttcttgtc

SEQ ID NO: 578552 - DNA, 25 bp, Rattus norvegicus
tccgtcttgatgtcctggatgcgca

SEQ ID NO: 578553 - DNA, 25 bp, Rattus norvegicus
cgaacatgttgtaggagtccgggtc

SEQ ID NO: 578554 - DNA, 25 bp, Rattus norvegicus
attttaggcactgtggccgcactgc

SEQ ID NO: 578555 - DNA, 25 bp, Rattus norvegicus
tcaccgcgtccttcttcttgaagcg

SEQ ID NO: 578556 - DNA, 25 bp, Rattus norvegicus
tgatgttgtccacgctgaagccctg

SEQ ID NO: 578557 - DNA, 25 bp, Rattus norvegicus
cccgcagcgacgtcatgatgttgtc

SEQ ID NO: 578558 - DNA, 25 bp, Rattus norvegicus
gccgcgtacaggctcatggcctgca

SEQ ID NO: 578559 - DNA, 25 bp, Rattus norvegicus
gccgtatgctgttctgccagccctg

SEQ ID NO: 578560 - DNA, 25 bp, Rattus norvegicus
gccagccctgcttattgtcccgata

SEQ ID NO: 578561 - DNA, 25 bp, Rattus norvegicus
gtccatgatgaactggtagatgcca

SEQ ID NO: 578562 - DNA, 25 bp, Rattus norvegicus
ggacacgtaccgttctccgtcttga

SEQ ID NO: 578563 - DNA, 25 bp, Rattus norvegicus
gcggccgcctccatgaagcgtaaga

SEQ ID NO: 578564 - DNA, 25 bp, Rattus norvegicus
tccatgaagcgtaagagcgagcggc

SEQ ID NO: 578565 - DNA, 25 bp, Rattus norvegicus
tgtgaatgaagctccacggaacatc

SEQ ID NO: 578566 - DNA, 25 bp, Rattus norvegicus
tgtgggcccttctttttgtgaatga

SEQ ID NO: 578567 - DNA, 25 bp, Rattus norvegicus
cagtgaccaatgaacggcccgagcc

SEQ ID NO: 578568 - DNA, 25 bp, Rattus norvegicus
aaggctccagttgcgtgacgtcacg

SEQ ID NO: 578569 - DNA, 25 bp, Rattus norvegicus
cctgcctgtaggaaggctccagttg

SEQ ID NO: 578570 - DNA, 25 bp, Rattus norvegicus
tggcgtcaccgagtacctgcctgta

SEQ ID NO: 578571 - DNA, 25 bp, Rattus norvegicus
agacttttctttatggcgtcaccga

SEQ ID NO: 578572 - DNA, 25 bp, Rattus norvegicus
tttctgcccgattggcggaagcgtt

SEQ ID NO: 578573 - DNA, 25 bp, Rattus norvegicus
ccggtgtgaagaagagccgcagctc

SEQ ID NO: 578574 - DNA, 25 bp, Rattus norvegicus
aatgaacggcccgagccggcaggcc

SEQ ID NO: 578575 - DNA, 25 bp, Rattus norvegicus
gcggaagcgttcagacttttcttta

SEQ ID NO: 578576 - DNA, 25 bp, Rattus norvegicus
gacgtcacgccgcagtgaccaatga

SEQ ID NO: 578577 - DNA, 25 bp, Rattus norvegicus
ttttgagcatccgtcacccaggcta

SEQ ID NO: 578578 - DNA, 25 bp, Rattus norvegicus
tgcgccggccgcttaaggaagcatt

SEQ ID NO: 578579 - DNA, 25 bp, Rattus norvegicus
ccggccgcttaaggaagcattggga

SEQ ID NO: 578580 - DNA, 25 bp, Rattus norvegicus
cgcttaaggaagcattgggaaaact

SEQ ID NO: 578581 - DNA, 25 bp, Rattus norvegicus
gggaaaacttctgaacttttgagca

SEQ ID NO: 578582 - DNA, 25 bp, Rattus norvegicus
cccaggctaggacttttttacgcag

SEQ ID NO: 578583 - DNA, 25 bp, Rattus norvegicus
tgaacttttgagcatccgtcaccca

SEQ ID NO: 578584 - DNA, 25 bp, Rattus norvegicus
tgagcatccgtcacccaggctagga

SEQ ID NO: 578585 - DNA, 25 bp, Rattus norvegicus
atccgtcacccaggctaggactttt

SEQ ID NO: 578586 - DNA, 25 bp, Rattus norvegicus
cagttacatttttttccgggcagcg

SEQ ID NO: 578587 - DNA, 25 bp, Rattus norvegicus
gcgagagacgcctgtgaatgagcca

SEQ ID NO: 578588 - DNA, 25 bp, Rattus norvegicus
gacgcctgtgaatgagccagcggcc

SEQ ID NO: 578589 - DNA, 25 bp, Rattus norvegicus
gctaggacttttttacgcagttaca

SEQ ID NO: 578590 - DNA, 25 bp, Rattus norvegicus
cttctgaacttttgagcatccgtca

SEQ ID NO: 578591 - DNA, 25 bp, Rattus norvegicus
tgcggtcgccctggctccagaggca

SEQ ID NO: 578592 - DNA, 25 bp, Rattus norvegicus
agaggcaggcgaaggacggtccctt

SEQ ID NO: 578593 - DNA, 25 bp, Rattus norvegicus
gtgagcttcgctcgaggtctggttt

SEQ ID NO: 578594 - DNA, 25 bp, Rattus norvegicus
ttcgctcgaggtctggtttggagat

SEQ ID NO: 578595 - DNA, 25 bp, Rattus norvegicus
gtgtcacggggattcactgcctctt

SEQ ID NO: 578596 - DNA, 25 bp, Rattus norvegicus
gcctctgcatctttctacgatccag

SEQ ID NO: 578597 - DNA, 25 bp, Rattus norvegicus
tgcatctttctacgatccaggaggc

SEQ ID NO: 578598 - DNA, 25 bp, Rattus norvegicus
tttctacgatccaggaggcaaaggc

SEQ ID NO: 578599 - DNA, 25 bp, Rattus norvegicus
tacgatccaggaggcaaaggcgaga

SEQ ID NO: 578600 - DNA, 25 bp, Rattus norvegicus
atggaggggacgcacggaaacccag

SEQ ID NO: 578601 - DNA, 25 bp, Rattus norvegicus
cccaggttaggcgagtggatctctg

SEQ ID NO: 578602 - DNA, 25 bp, Rattus norvegicus
agctgcaagcgcgtgcgtgctccga

SEQ ID NO: 578603 - DNA, 25 bp, Rattus norvegicus
ttcaccttcgtgtcgcctctgcggt

SEQ ID NO: 578604 - DNA, 25 bp, Rattus norvegicus
ctgctgcccgctgcttcaccttcgt

SEQ ID NO: 578605 - DNA, 25 bp, Rattus norvegicus
tgcgtcgccgttgcctccctgaagt

SEQ ID NO: 578606 - DNA, 25 bp, Rattus norvegicus
tgccaccagcgaataccagagctcg

SEQ ID NO: 578607 - DNA, 25 bp, Rattus norvegicus
ggcttcgtgatgagcgcccatgact

SEQ ID NO: 578608 - DNA, 25 bp, Rattus norvegicus
ggtgcagagacagccgaccagagta

SEQ ID NO: 578609 - DNA, 25 bp, Rattus norvegicus
ccggagaagcgacccaggtgaacgc

SEQ ID NO: 578610 - DNA, 25 bp, Rattus norvegicus
gtcgccaccttcgttatcctgttag

SEQ ID NO: 578611 - DNA, 25 bp, Rattus norvegicus
cagcagcctgcttctgcgtgagccg

SEQ ID NO: 578612 - DNA, 25 bp, Rattus norvegicus
ctcggcctctgtggcattgtggaac

SEQ ID NO: 578613 - DNA, 25 bp, Rattus norvegicus
acggggacacccatcgagctaccag

SEQ ID NO: 578614 - DNA, 25 bp, Rattus norvegicus
ctgaagaaaagcttacggccggcga

SEQ ID NO: 578615 - DNA, 25 bp, Rattus norvegicus
cgccctatgaggttgactgtaaact

SEQ ID NO: 578616 - DNA, 25 bp, Rattus norvegicus
acttcctctacgcaccgggttagca

SEQ ID NO: 578617 - DNA, 25 bp, Rattus norvegicus
cgtggacaggctttgctagaacttc

SEQ ID NO: 578618 - DNA, 25 bp, Rattus norvegicus
gcccatgactcctgcctgtagcggg

SEQ ID NO: 578619 - DNA, 25 bp, Rattus norvegicus
acaaaccgagtgagtgccctactgc

SEQ ID NO: 578620 - DNA, 25 bp, Rattus norvegicus
cacgcgatggtacatgggtttgaga

SEQ ID NO: 578621 - DNA, 25 bp, Rattus norvegicus
aagccgctcaccacgcgatggtaca

SEQ ID NO: 578622 - DNA, 25 bp, Rattus norvegicus
gcgcacagagttcttccagccctgg

SEQ ID NO: 578623 - DNA, 25 bp, Rattus norvegicus
gcggaacgaaccctcctcgaacatg

SEQ ID NO: 578624 - DNA, 25 bp, Rattus norvegicus
tcgatggtccagtagtggcccttgc

SEQ ID NO: 578625 - DNA, 25 bp, Rattus norvegicus
tgagagcctggcacttccgcctgaa

SEQ ID NO: 578626 - DNA, 25 bp, Rattus norvegicus
cttgatgaagcattcgttaagcgag

SEQ ID NO: 578627 - DNA, 25 bp, Rattus norvegicus
tacgagtaaggaggcttctctggcc

SEQ ID NO: 578628 - DNA, 25 bp, Rattus norvegicus
ggcgagctctgtatggccatgacga

SEQ ID NO: 578629 - DNA, 25 bp, Rattus norvegicus
cgcctgcaggaactggtagatctcg

SEQ ID NO: 578630 - DNA, 25 bp, Rattus norvegicus
cggaaaaaagggaagcgcgcctgca

SEQ ID NO: 578631 - DNA, 25 bp, Rattus norvegicus
ccagccctggtaggcgccacggaaa

SEQ ID NO: 578632 - DNA, 25 bp, Rattus norvegicus
cgaacatgaactcgctggccgggtc

SEQ ID NO: 578633 - DNA, 25 bp, Rattus norvegicus
gccggtcaggcagcccattgtccat

SEQ ID NO: 578634 - DNA, 25 bp, Rattus norvegicus
atgcgctccctgttgcaggtgctcg

SEQ ID NO: 578635 - DNA, 25 bp, Rattus norvegicus
tcggcaggtggcctcagctgatagc

SEQ ID NO: 578636 - DNA, 25 bp, Rattus norvegicus
gtggtgtgctgagctgacctctaaa

SEQ ID NO: 578637 - DNA, 25 bp, Rattus norvegicus
tgagctgacctctaaaaacaccctc

SEQ ID NO: 578638 - DNA, 25 bp, Rattus norvegicus
cccgacatcaccaagaaaatcaata

SEQ ID NO: 578639 - DNA, 25 bp, Rattus norvegicus
tcaatactcaagacagacacgtgct

SEQ ID NO: 578640 - DNA, 25 bp, Rattus norvegicus
tctcttatgcgctccctgttgcagg

SEQ ID NO: 578641 - DNA, 25 bp, Rattus norvegicus
acagacacgtgctcgcggccactgt

SEQ ID NO: 578642 - DNA, 25 bp, Rattus norvegicus
tgcctggaatatatggttgcccacg

SEQ ID NO: 578643 - DNA, 25 bp, Rattus norvegicus
gcccattgtccatggggtctgtgca

SEQ ID NO: 578644 - DNA, 25 bp, Rattus norvegicus
ggtctgtgcatcctcgtgcagataa

SEQ ID NO: 578645 - DNA, 25 bp, Rattus norvegicus
ggccactgtttttctccggtgcaga

SEQ ID NO: 578646 - DNA, 25 bp, Rattus norvegicus
tgcagataaacacacgcccagagcc

SEQ ID NO: 578647 - DNA, 25 bp, Rattus norvegicus
gtccaaatatttcttttgtcctcca

SEQ ID NO: 578648 - DNA, 25 bp, Rattus norvegicus
cctctgtagggataaataaaacgtg

SEQ ID NO: 578649 - DNA, 25 bp, Rattus norvegicus
gcgcgctcgcctctcttcagaaaag

SEQ ID NO: 578650 - DNA, 25 bp, Rattus norvegicus
tggcgcatcaaaactcgctgcagtc

SEQ ID NO: 578651 - DNA, 25 bp, Rattus norvegicus
cgcagaagaacttcctggcgcatca

SEQ ID NO: 578652 - DNA, 25 bp, Rattus norvegicus
ccagcatcctctgtagggataaata

SEQ ID NO: 578653 - DNA, 25 bp, Rattus norvegicus
aaataaaacgtgctcggcgcccaga

SEQ ID NO: 578654 - DNA, 25 bp, Rattus norvegicus
cgcccagaggctgacgaaggacctc

SEQ ID NO: 578655 - DNA, 25 bp, Rattus norvegicus
gcctctcttcagaaaaggaaacgta

SEQ ID NO: 578656 - DNA, 25 bp, Rattus norvegicus
ctgacgaaggacctcggggcgccca

SEQ ID NO: 578657 - DNA, 25 bp, Rattus norvegicus
ttcagaaaaggaaacgtagctcttc

SEQ ID NO: 578658 - DNA, 25 bp, Rattus norvegicus
cgtagctcttccaaaaatataaatc

SEQ ID NO: 578659 - DNA, 25 bp, Rattus norvegicus
atcagttctgacgtccaaatatttc

SEQ ID NO: 578660 - DNA, 25 bp, Rattus norvegicus
ttgtcctccagcatcctctgtaggg

SEQ ID NO: 578661 - DNA, 25 bp, Rattus norvegicus
ctccaatttcatgccggctctggtg

SEQ ID NO: 578662 - DNA, 25 bp, Rattus norvegicus
ggggttgagcatccagtaattgtcc

SEQ ID NO: 578663 - DNA, 25 bp, Rattus norvegicus
cttgcccatgaggtactcgttgatc

SEQ ID NO: 578664 - DNA, 25 bp, Rattus norvegicus
tactcgttgatctcggccagcgtca

SEQ ID NO: 578665 - DNA, 25 bp, Rattus norvegicus
gccatcggtcacctcgggatcgtct

SEQ ID NO: 578666 - DNA, 25 bp, Rattus norvegicus
cccgtcagagcctaaggagtcgtcg

SEQ ID NO: 578667 - DNA, 25 bp, Rattus norvegicus
cgcgtggggcaaatacctccaattt

SEQ ID NO: 578668 - DNA, 25 bp, Rattus norvegicus
aaggaccgctcctgcgtctttcgga

SEQ ID NO: 578669 - DNA, 25 bp, Rattus norvegicus
gtctttcggagagagacgcttttcc

SEQ ID NO: 578670 - DNA, 25 bp, Rattus norvegicus
ttccgtaaggttgtcctccgctgga

SEQ ID NO: 578671 - DNA, 25 bp, Rattus norvegicus
tcctccgctggaatgtttctttgga

SEQ ID NO: 578672 - DNA, 25 bp, Rattus norvegicus
gccaggacacgcaagccttagaatt

SEQ ID NO: 578673 - DNA, 25 bp, Rattus norvegicus
cgctcaggctatcttctcccaggaa

SEQ ID NO: 578674 - DNA, 25 bp, Rattus norvegicus
tggtgcaatgctgtccttactccga

SEQ ID NO: 578675 - DNA, 25 bp, Rattus norvegicus
ttggcccggacctgacgccgcctgc

SEQ ID NO: 578676 - DNA, 25 bp, Rattus norvegicus
acccgggcgcgtttgggagctgcgg

SEQ ID NO: 578677 - DNA, 25 bp, Rattus norvegicus
gctgagcgacctgggacggcgccgt

SEQ ID NO: 578678 - DNA, 25 bp, Rattus norvegicus
cagggcaccgaaccgtcggggctga

SEQ ID NO: 578679 - DNA, 25 bp, Rattus norvegicus
gagtggaaccgcagggcaccgaacc

SEQ ID NO: 578680 - DNA, 25 bp, Rattus norvegicus
aagctgcaggtaagtgtagcgtccg

SEQ ID NO: 578681 - DNA, 25 bp, Rattus norvegicus
caagctgcaggtaagtgtagcgtcc

SEQ ID NO: 578682 - DNA, 25 bp, Rattus norvegicus
cctgcaagctgcaggtaagtgtagc

SEQ ID NO: 578683 - DNA, 25 bp, Rattus norvegicus
cgccgcctgcaagctgcaggtaagt

SEQ ID NO: 578684 - DNA, 25 bp, Rattus norvegicus
ctacggcagactgctgcggcccgga

SEQ ID NO: 578685 - DNA, 25 bp, Rattus norvegicus
aagtgcggccctacggcagactgct

SEQ ID NO: 578686 - DNA, 25 bp, Rattus norvegicus
gcggatcgacgtgctcggcgctcgc

SEQ ID NO: 578687 - DNA, 25 bp, Rattus norvegicus
cagatatggagggttggtttttaat

SEQ ID NO: 578688 - DNA, 25 bp, Rattus norvegicus
cgcctgcaagctgcaggtaagtgta

SEQ ID NO: 578689 - DNA, 25 bp, Rattus norvegicus
ctgagtttcccgttgccgcagctca

SEQ ID NO: 578690 - DNA, 25 bp, Rattus norvegicus
cagggatccctgaatgccgctgacc

SEQ ID NO: 578691 - DNA, 25 bp, Rattus norvegicus
ctgaccttgaagagggctgcgtcct

SEQ ID NO: 578692 - DNA, 25 bp, Rattus norvegicus
tcctcccggttgtagtcctgtttgc

SEQ ID NO: 578693 - DNA, 25 bp, Rattus norvegicus
tttgcccgcgtgtttccacgggatg

SEQ ID NO: 578694 - DNA, 25 bp, Rattus norvegicus
cacgggatgcggaagacgctcttct

SEQ ID NO: 578695 - DNA, 25 bp, Rattus norvegicus
ggaagacgctcttctcctcgttctc

SEQ ID NO: 578696 - DNA, 25 bp, Rattus norvegicus
accagcccggggtacttgccgctgt

SEQ ID NO: 578697 - DNA, 25 bp, Rattus norvegicus
cttgccgctgtcgatctggtcgatc

SEQ ID NO: 578698 - DNA, 25 bp, Rattus norvegicus
cagccactgtctgagtttcccgttg

SEQ ID NO: 578699 - DNA, 25 bp, Rattus norvegicus
ggctgcccgtctccaagttcatgac

SEQ ID NO: 578700 - DNA, 25 bp, Rattus norvegicus
agttcatgacgcgtgctgacctcct

SEQ ID NO: 578701 - DNA, 25 bp, Rattus norvegicus
gcgctgcggggagacaaactttccc

SEQ ID NO: 578702 - DNA, 25 bp, Rattus norvegicus
atctggtcgatcagccactgtctga

SEQ ID NO: 578703 - DNA, 25 bp, Rattus norvegicus
agccgccaaacctgcggtttgcgca

SEQ ID NO: 578704 - DNA, 25 bp, Rattus norvegicus
acccgggacgcgacattactgtccg

SEQ ID NO: 578705 - DNA, 25 bp, Rattus norvegicus
ggaccggacgttacctggctcatcc

SEQ ID NO: 578706 - DNA, 25 bp, Rattus norvegicus
ctcgcagcgcgctccacccgggacg

SEQ ID NO: 578707 - DNA, 25 bp, Rattus norvegicus
aaacctgcggtttgcgcacgcgcgc

SEQ ID NO: 578708 - DNA, 25 bp, Rattus norvegicus
cgacattactgtccggcgctgcgca

SEQ ID NO: 578709 - DNA, 25 bp, Rattus norvegicus
cgctgcgcacctcggggagagcggc

SEQ ID NO: 578710 - DNA, 25 bp, Rattus norvegicus
cccgcggcccgacgcctagcgcgca

SEQ ID NO: 578711 - DNA, 25 bp, Rattus norvegicus
acgcgcttgggctcgcgcacgagca

SEQ ID NO: 578712 - DNA, 25 bp, Rattus norvegicus
cttgggctcgcgcacgagcagaagc

SEQ ID NO: 578713 - DNA, 25 bp, Rattus norvegicus
tcgcgcacgagcagaagccgccaaa

SEQ ID NO: 578714 - DNA, 25 bp, Rattus norvegicus
gcacgagcagaagccgccaaacctg

SEQ ID NO: 578715 - DNA, 25 bp, Rattus norvegicus
gcagaagccgccaaacctgcggttt

SEQ ID NO: 578716 - DNA, 25 bp, Rattus norvegicus
gccgctccgcgctcgcgggaggaga

SEQ ID NO: 578717 - DNA, 25 bp, Rattus norvegicus
gtccctgtgaccgactaggtagttg

SEQ ID NO: 578718 - DNA, 25 bp, Rattus norvegicus
aatcctccggattcgcttagcctta

SEQ ID NO: 578719 - DNA, 25 bp, Rattus norvegicus
cagcgtcagcgttaggtacttccct

SEQ ID NO: 578720 - DNA, 25 bp, Rattus norvegicus
tggggcaaagcgaccaagtcagacc

SEQ ID NO: 578721 - DNA, 25 bp, Rattus norvegicus
ctgacttctgttttcctggggcaaa

SEQ ID NO: 578722 - DNA, 25 bp, Rattus norvegicus
tcacgaccacaagaagttgctactg

SEQ ID NO: 578723 - DNA, 25 bp, Rattus norvegicus
gccgtaaacgaaggatctcaatcac

SEQ ID NO: 578724 - DNA, 25 bp, Rattus norvegicus
cgtcgcgcttacgtcacaagtcctg

SEQ ID NO: 578725 - DNA, 25 bp, Rattus norvegicus
gatctcgtttccctgcggctccagg

SEQ ID NO: 578726 - DNA, 25 bp, Rattus norvegicus
tagttggagcagctgtcgccatgtt

SEQ ID NO: 578727 - DNA, 25 bp, Rattus norvegicus
accaccggttctggacgtgaagcga

SEQ ID NO: 578728 - DNA, 25 bp, Rattus norvegicus
tgaagcgacccttcctgtgccgtga

SEQ ID NO: 578729 - DNA, 25 bp, Rattus norvegicus
ccacagtgggcctgaatggtgagcc

SEQ ID NO: 578730 - DNA, 25 bp, Rattus norvegicus
ttcgaacggaaggtcgtccctgtga

SEQ ID NO: 578731 - DNA, 25 bp, Rattus norvegicus
gggtgtggtcacacattctttcttc

SEQ ID NO: 578732 - DNA, 25 bp, Rattus norvegicus
accggctagccggttttgagctggc

SEQ ID NO: 578733 - DNA, 25 bp, Rattus norvegicus
tgtacccggagcagctggctgaatc

SEQ ID NO: 578734 - DNA, 25 bp, Rattus norvegicus
taaatccctcgtcacgcgtgcctgg

SEQ ID NO: 578735 - DNA, 25 bp, Rattus norvegicus
tgaatcgctcgctccctttgcaaga

SEQ ID NO: 578736 - DNA, 25 bp, Rattus norvegicus
aagatatttggtctctggccgcgcg

SEQ ID NO: 578737 - DNA, 25 bp, Rattus norvegicus
cgcgcgtgcctatatgtctggtttc

SEQ ID NO: 578738 - DNA, 25 bp, Rattus norvegicus
gtctggtttcttcctttgcaggata

SEQ ID NO: 578739 - DNA, 25 bp, Rattus norvegicus
gatagttggtcctagctgcgtgtgc

SEQ ID NO: 578740 - DNA, 25 bp, Rattus norvegicus
tgctcgtgggccaggtttctttccc

SEQ ID NO: 578741 - DNA, 25 bp, Rattus norvegicus
cagctgatctctggtcgcgagtacc

SEQ ID NO: 578742 - DNA, 25 bp, Rattus norvegicus
ctggcttcttttgcaggacgctggc

SEQ ID NO: 578743 - DNA, 25 bp, Rattus norvegicus
agtctgctgcttgtcacccgccagg

SEQ ID NO: 578744 - DNA, 25 bp, Rattus norvegicus
cagggcgtttccgtgcccatgcatg

SEQ ID NO: 578745 - DNA, 25 bp, Rattus norvegicus
ttccctgcggacgttgggaggacat

SEQ ID NO: 578746 - DNA, 25 bp, Rattus norvegicus
ctcccggcaacaaaggggatctggg

SEQ ID NO: 578747 - DNA, 25 bp, Rattus norvegicus
ttgctgtccctccagcgtgtgctta

SEQ ID NO: 578748 - DNA, 25 bp, Rattus norvegicus
ctcagtgtccttagcccaggtggga

SEQ ID NO: 578749 - DNA, 25 bp, Rattus norvegicus
ggtaataccctcctcagtgtcctta

SEQ ID NO: 578750 - DNA, 25 bp, Rattus norvegicus
ccagcgtgtgcttattgttagactc

SEQ ID NO: 578751 - DNA, 25 bp, Rattus norvegicus
tattgttagactcggggtgcttccc

SEQ ID NO: 578752 - DNA, 25 bp, Rattus norvegicus
ggagtccctctttgcgagccacatc

SEQ ID NO: 578753 - DNA, 25 bp, Rattus norvegicus
cgaagcttcctctttctcgggcgta

SEQ ID NO: 578754 - DNA, 25 bp, Rattus norvegicus
gacccgaggcgtgcaagcctgtctc

SEQ ID NO: 578755 - DNA, 25 bp, Rattus norvegicus
ccagtgcctggcacctttggggacc

SEQ ID NO: 578756 - DNA, 25 bp, Rattus norvegicus
tttggggacctagctcccggcaaca

SEQ ID NO: 578757 - DNA, 25 bp, Rattus norvegicus
agcatcgtgggcctcgttgctgtcc

SEQ ID NO: 578758 - DNA, 25 bp, Rattus norvegicus
ccagagctcgcgctgtctgcgacaa

SEQ ID NO: 578759 - DNA, 25 bp, Rattus norvegicus
tttagatagagatccactcgattcc

SEQ ID NO: 578760 - DNA, 25 bp, Rattus norvegicus
cagagagaatcggacggggacggaa

SEQ ID NO: 578761 - DNA, 25 bp, Rattus norvegicus
cacaggtcaaagtgagtgccggagc

SEQ ID NO: 578762 - DNA, 25 bp, Rattus norvegicus
ttctgtaaggcacaggtcaaagtga

SEQ ID NO: 578763 - DNA, 25 bp, Rattus norvegicus
tcacagtttctgtaaggcacaggtc

SEQ ID NO: 578764 - DNA, 25 bp, Rattus norvegicus
agtagttcacagtttctgtaaggca

SEQ ID NO: 578765 - DNA, 25 bp, Rattus norvegicus
gtcaaagtgagtgccggagctgtcc

SEQ ID NO: 578766 - DNA, 25 bp, Rattus norvegicus
tagagatccactcgattccttccct

SEQ ID NO: 578767 - DNA, 25 bp, Rattus norvegicus
tcaagtttagatagagatccactcg

SEQ ID NO: 578768 - DNA, 25 bp, Rattus norvegicus
cccgatcaagtttagatagagatcc

SEQ ID NO: 578769 - DNA, 25 bp, Rattus norvegicus
cacacacagtcaaacccgatcaagt

SEQ ID NO: 578770 - DNA, 25 bp, Rattus norvegicus
ggagctgtccatgattccaaacaca

SEQ ID NO: 578771 - DNA, 25 bp, Rattus norvegicus
gtccatgattccaaacacacacagt

SEQ ID NO: 578772 - DNA, 25 bp, Rattus norvegicus
aggcctgcgcgcctttcagtcctgg

SEQ ID NO: 578773 - DNA, 25 bp, Rattus norvegicus
gattttagaacagctcacgcgactc

SEQ ID NO: 578774 - DNA, 25 bp, Rattus norvegicus
ccccggaccgggtagtggcagcaca

SEQ ID NO: 578775 - DNA, 25 bp, Rattus norvegicus
agtggcagcacagggccccgagtct

SEQ ID NO: 578776 - DNA, 25 bp, Rattus norvegicus
cctggggccgcaggcgaaggcccgg

SEQ ID NO: 578777 - DNA, 25 bp, Rattus norvegicus
ccgcaaggagctgcggaagcgcctc

SEQ ID NO: 578778 - DNA, 25 bp, Rattus norvegicus
caaggagctgcggaagcgcctcaac

SEQ ID NO: 578779 - DNA, 25 bp, Rattus norvegicus
aggagctgcggaagcgcctcaacct

SEQ ID NO: 578780 - DNA, 25 bp, Rattus norvegicus
tgcggaagcgcctcaacctggagga

SEQ ID NO: 578781 - DNA, 25 bp, Rattus norvegicus
cggaagcgcctcaacctggaggagt

SEQ ID NO: 578782 - DNA, 25 bp, Rattus norvegicus
acctggaggagtggattttagaaca

SEQ ID NO: 578783 - DNA, 25 bp, Rattus norvegicus
ctggaggagtggattttagaacagc

SEQ ID NO: 578784 - DNA, 25 bp, Rattus norvegicus
tggattttagaacagctcacgcgac

SEQ ID NO: 578785 - DNA, 25 bp, Rattus norvegicus
ttagaacagctcacgcgactctacg

SEQ ID NO: 578786 - DNA, 25 bp, Rattus norvegicus
gagtggattttagaacagctcacgc

SEQ ID NO: 578787 - DNA, 25 bp, Rattus norvegicus
tatccgtttggggttcgagcttatg

SEQ ID NO: 578788 - DNA, 25 bp, Rattus norvegicus
ggcaagttaaaaaccgtgcggctga

SEQ ID NO: 578789 - DNA, 25 bp, Rattus norvegicus
atgacgtcatccagacgcgactctc

SEQ ID NO: 578790 - DNA, 25 bp, Rattus norvegicus
cagacgcgactctcgggctatttca

SEQ ID NO: 578791 - DNA, 25 bp, Rattus norvegicus
caaaatactaatcgaagggcaagtt

SEQ ID NO: 578792 - DNA, 25 bp, Rattus norvegicus
ggggttcgagcttatgcagcattca

SEQ ID NO: 578793 - DNA, 25 bp, Rattus norvegicus
agaatttcacatgagggaaggggta

SEQ ID NO: 578794 - DNA, 25 bp, Rattus norvegicus
agacgtctcggagaatttcacatga

SEQ ID NO: 578795 - DNA, 25 bp, Rattus norvegicus
acctctttctaagacgtctcggaga

SEQ ID NO: 578796 - DNA, 25 bp, Rattus norvegicus
ggagactatgctcaacctctttcta

SEQ ID NO: 578797 - DNA, 25 bp, Rattus norvegicus
gctgtcggagactatgctcaacctc

SEQ ID NO: 578798 - DNA, 25 bp, Rattus norvegicus
tcgggctatttcaggctgtcggaga

SEQ ID NO: 578799 - DNA, 25 bp, Rattus norvegicus
actctcgggctatttcaggctgtcg

SEQ ID NO: 578800 - DNA, 25 bp, Rattus norvegicus
gcagcattcaaaatactaatcgaag

SEQ ID NO: 578801 - DNA, 25 bp, Rattus norvegicus
tcctttgactcccatcgcttggcag

SEQ ID NO: 578802 - DNA, 25 bp, Rattus norvegicus
tggcagccaacggatcgcctactcg

SEQ ID NO: 578803 - DNA, 25 bp, Rattus norvegicus
ctgggaaagaagaaccctagtgcca

SEQ ID NO: 578804 - DNA, 25 bp, Rattus norvegicus
cgcttggcagccaacggatcgccta

SEQ ID NO: 578805 - DNA, 25 bp, Rattus norvegicus
actgtgtgcctccaagcagtccgca

SEQ ID NO: 578806 - DNA, 25 bp, Rattus norvegicus
cctccaagcagtccgcacgcgcggg

SEQ ID NO: 578807 - DNA, 25 bp, Rattus norvegicus
cagcgcactgtgtgcctccaagcag

SEQ ID NO: 578808 - DNA, 25 bp, Rattus norvegicus
aagaagaaccctagtgccaggcaga

SEQ ID NO: 578809 - DNA, 25 bp, Rattus norvegicus
gaaccctagtgccaggcagagcccg

SEQ ID NO: 578810 - DNA, 25 bp, Rattus norvegicus
cagagcccgccaccggccagatgct

SEQ ID NO: 578811 - DNA, 25 bp, Rattus norvegicus
ccagatgctcgtggggcgcacgttc

SEQ ID NO: 578812 - DNA, 25 bp, Rattus norvegicus
cacgttcctcctctcctttgactcc

SEQ ID NO: 578813 - DNA, 25 bp, Rattus norvegicus
tttgactcccatcgcttggcagcca

SEQ ID NO: 578814 - DNA, 25 bp, Rattus norvegicus
tgtgtgcctccaagcagtccgcacg

SEQ ID NO: 578815 - DNA, 25 bp, Rattus norvegicus
gggcgtctctcctttctcggccatt

SEQ ID NO: 578816 - DNA, 25 bp, Rattus norvegicus
ttctcggccattggagggtttccga

SEQ ID NO: 578817 - DNA, 25 bp, Rattus norvegicus
cggaaaccatttcttttcaggagca

SEQ ID NO: 578818 - DNA, 25 bp, Rattus norvegicus
cagcagttggttaccctaaactttg

SEQ ID NO: 578819 - DNA, 25 bp, Rattus norvegicus
caggggtggcctctgggactccttt

SEQ ID NO: 578820 - DNA, 25 bp, Rattus norvegicus
gggactcctttggtcatgcgctgtg

SEQ ID NO: 578821 - DNA, 25 bp, Rattus norvegicus
ttggtcatgcgctgtgtgtctctgc

SEQ ID NO: 578822 - DNA, 25 bp, Rattus norvegicus
ccgcagctggcggagaaactgcatt

SEQ ID NO: 578823 - DNA, 25 bp, Rattus norvegicus
taccagatccgcaatcgggcgtctc

SEQ ID NO: 578824 - DNA, 25 bp, Rattus norvegicus
tcctactcgcccgagggagatgacc

SEQ ID NO: 578825 - DNA, 25 bp, Rattus norvegicus
cattggagggtttccgacgagcaaa

SEQ ID NO: 578826 - DNA, 25 bp, Rattus norvegicus
ggagatgacccgtgacctccgaagt

SEQ ID NO: 578827 - DNA, 25 bp, Rattus norvegicus
cctccgaagtgaggttaccagatcc

SEQ ID NO: 578828 - DNA, 25 bp, Rattus norvegicus
gaaactgcattctcgctcctactcg

SEQ ID NO: 578829 - DNA, 25 bp, Rattus norvegicus
ctgctcaaggacagcgacaagatcc

SEQ ID NO: 578830 - DNA, 25 bp, Rattus norvegicus
tgcccgcagggagaacttcagcggt

SEQ ID NO: 578831 - DNA, 25 bp, Rattus norvegicus
gccggggccatggtacaacagacca

SEQ ID NO: 578832 - DNA, 25 bp, Rattus norvegicus
gaccctagctggtgcaagacgccca

SEQ ID NO: 578833 - DNA, 25 bp, Rattus norvegicus
agtggccacatcaagcggcccatga

SEQ ID NO: 578834 - DNA, 25 bp, Rattus norvegicus
cctttatggtgtggtcgcagatcga

SEQ ID NO: 578835 - DNA, 25 bp, Rattus norvegicus
tcgagcggcgcaagatcatggagca

SEQ ID NO: 578836 - DNA, 25 bp, Rattus norvegicus
gcaaacgctggaagctgctcaagga

SEQ ID NO: 578837 - DNA, 25 bp, Rattus norvegicus
gccaaacaccctgccgacaagaagg

SEQ ID NO: 578838 - DNA, 25 bp, Rattus norvegicus
tggctgactaccctgactacaagta

SEQ ID NO: 578839 - DNA, 25 bp, Rattus norvegicus
gccgtctacaaggtgcggactccca

SEQ ID NO: 578840 - DNA, 25 bp, Rattus norvegicus
taaggcggctgcatcgttctctccg

SEQ ID NO: 578841 - DNA, 25 bp, Rattus norvegicus
tctccaagcggctgggcaaacgctg

SEQ ID NO: 578842 - DNA, 25 bp, Rattus norvegicus
gcggccacagccaaacctggggaga

SEQ ID NO: 578843 - DNA, 25 bp, Rattus norvegicus
cctagcatctcgtctgcgtcgtttc

SEQ ID NO: 578844 - DNA, 25 bp, Rattus norvegicus
ggggccagcaaggttgtgaacccta

SEQ ID NO: 578845 - DNA, 25 bp, Rattus norvegicus
ttcgcggtggtacctaccgacactc

SEQ ID NO: 578846 - DNA, 25 bp, Rattus norvegicus
gcaggcagaagcagagagacgactc

SEQ ID NO: 578847 - DNA, 25 bp, Rattus norvegicus
gtcatcctagaattaaagcagctgg

SEQ ID NO: 578848 - DNA, 25 bp, Rattus norvegicus
cattgagaagttcgggcgctgtgac

SEQ ID NO: 578849 - DNA, 25 bp, Rattus norvegicus
tacgatcccgactaaggttgccgga

SEQ ID NO: 578850 - DNA, 25 bp, Rattus norvegicus
ttgcggtacaccagcacactcttca

SEQ ID NO: 578851 - DNA, 25 bp, Rattus norvegicus
tcctgcagggacaaggaaagctacc

SEQ ID NO: 578852 - DNA, 25 bp, Rattus norvegicus
catcaaggtgtgctgtctgggaacc

SEQ ID NO: 578853 - DNA, 25 bp, Rattus norvegicus
acgccgctcgggctttaaacctctg

SEQ ID NO: 578854 - DNA, 25 bp, Rattus norvegicus
cgtcgtttctcccaacggcttcatt

SEQ ID NO: 578855 - DNA, 25 bp, Rattus norvegicus
tggcgagattcagtgcctagcatct

SEQ ID NO: 578856 - DNA, 25 bp, Rattus norvegicus
tgcacccggactcaagtacacagta

SEQ ID NO: 578857 - DNA, 25 bp, Rattus norvegicus
ggccggcgtcttattgcggcttccc

SEQ ID NO: 578858 - DNA, 25 bp, Rattus norvegicus
cccgcactgcaggtacgcgcgtccc

SEQ ID NO: 578859 - DNA, 25 bp, Rattus norvegicus
ggtcgtgggtcaccggacaccacag

SEQ ID NO: 578860 - DNA, 25 bp, Rattus norvegicus
gcctgagcctcgctgcctgctgtgg

SEQ ID NO: 578861 - DNA, 25 bp, Rattus norvegicus
ggagtgcctgcgctacctgcccagg

SEQ ID NO: 578862 - DNA, 25 bp, Rattus norvegicus
cttattgcggcttcccgattgcccg

SEQ ID NO: 578863 - DNA, 25 bp, Rattus norvegicus
ggagccagaaggcgccgagcacacc

SEQ ID NO: 578864 - DNA, 25 bp, Rattus norvegicus
tgatctacccgagttcccggcatgc

SEQ ID NO: 578865 - DNA, 25 bp, Rattus norvegicus
cggtgtactgatctacccgagttcc

SEQ ID NO: 578866 - DNA, 25 bp, Rattus norvegicus
gttgtcgcggtgtactgatctaccc

SEQ ID NO: 578867 - DNA, 25 bp, Rattus norvegicus
catgcgtggaaaacagcgcgcaggc

SEQ ID NO: 578868 - DNA, 25 bp, Rattus norvegicus
cacagcggagcatgcgtggaaaaca

SEQ ID NO: 578869 - DNA, 25 bp, Rattus norvegicus
gacaccacagcggagcatgcgtgga

SEQ ID NO: 578870 - DNA, 25 bp, Rattus norvegicus
gcgccatggagtgcctgcgctacct

SEQ ID NO: 578871 - DNA, 25 bp, Rattus norvegicus
tgtgatcccgcagctcgcttgcctg

SEQ ID NO: 578872 - DNA, 25 bp, Rattus norvegicus
aagagatctcggtcaaggtgagcgc

SEQ ID NO: 578873 - DNA, 25 bp, Rattus norvegicus
agagagggcgctctcagtgtctccg

SEQ ID NO: 578874 - DNA, 25 bp, Rattus norvegicus
tcgcttgcctgtcccttgccagtgt

SEQ ID NO: 578875 - DNA, 25 bp, Rattus norvegicus
tggcgacctgctttctgctgcggaa

SEQ ID NO: 578876 - DNA, 25 bp, Rattus norvegicus
ggctgacctccacgccgacctgctc

SEQ ID NO: 578877 - DNA, 25 bp, Rattus norvegicus
acctgctccgcggggacagctttgt

SEQ ID NO: 578878 - DNA, 25 bp, Rattus norvegicus
tgtgggcggccgctggcttccaacc

SEQ ID NO: 578879 - DNA, 25 bp, Rattus norvegicus
ttccctgtgtatgacccggccagcg

SEQ ID NO: 578880 - DNA, 25 bp, Rattus norvegicus
cgcctacgatgccttcagcagctgg

SEQ ID NO: 578881 - DNA, 25 bp, Rattus norvegicus
ctacgatgccttcagcagctggaaa

SEQ ID NO: 578882 - DNA, 25 bp, Rattus norvegicus
ccgggccatggcgacctgctttctg

SEQ ID NO: 578883 - DNA, 25 bp, Rattus norvegicus
cagcagctggaaagagatctcggtc

SEQ ID NO: 578884 - DNA, 25 bp, Rattus norvegicus
cttcagcagctggaaagagatctcg

SEQ ID NO: 578885 - DNA, 25 bp, Rattus norvegicus
ccgtagtgtcgcagctcgtcaccaa

SEQ ID NO: 578886 - DNA, 25 bp, Rattus norvegicus
ccaggcttgcagacttgacggtcca

SEQ ID NO: 578887 - DNA, 25 bp, Rattus norvegicus
gagcacgcgacctttctccggagcg

SEQ ID NO: 578888 - DNA, 25 bp, Rattus norvegicus
ctcttcaaggtcttaggcaaccgga

SEQ ID NO: 578889 - DNA, 25 bp, Rattus norvegicus
aaggcctaaatgctgcgcgtgcgca

SEQ ID NO: 578890 - DNA, 25 bp, Rattus norvegicus
cgagcgagtgtttccgcgtcaacct

SEQ ID NO: 578891 - DNA, 25 bp, Rattus norvegicus
gcgaccgatcgcaaaggcctagacc

SEQ ID NO: 578892 - DNA, 25 bp, Rattus norvegicus
cggtcgcttactagtcctcggactt

SEQ ID NO: 578893 - DNA, 25 bp, Rattus norvegicus
tcgtcaccaacgcaaatcccaggga

SEQ ID NO: 578894 - DNA, 25 bp, Rattus norvegicus
ctgccagttgttctccgacaggaaa

SEQ ID NO: 578895 - DNA, 25 bp, Rattus norvegicus
gcgaacttactttcgtctgccagtt

SEQ ID NO: 578896 - DNA, 25 bp, Rattus norvegicus
ggcgctcaacgctttctgaaaagta

SEQ ID NO: 578897 - DNA, 25 bp, Rattus norvegicus
ttctctggctgctcgaagaaggcgc

SEQ ID NO: 578898 - DNA, 25 bp, Rattus norvegicus
gccatcgctgcagggtctcctcaaa

SEQ ID NO: 578899 - DNA, 25 bp, Rattus norvegicus
acccagggaagctgcctgtgttctc

SEQ ID NO: 578900 - DNA, 25 bp, Rattus norvegicus
tcagcgctgatagacacgcccttcg

SEQ ID NO: 578901 - DNA, 25 bp, Rattus norvegicus
caggccagtgaggttcagcgaagcc

SEQ ID NO: 578902 - DNA, 25 bp, Rattus norvegicus
ttggccacgacgcagccgaacgtct

SEQ ID NO: 578903 - DNA, 25 bp, Rattus norvegicus
gactcgtcgtccagcagctgatgga

SEQ ID NO: 578904 - DNA, 25 bp, Rattus norvegicus
tcgaacgggtccgactcgtcgtcca

SEQ ID NO: 578905 - DNA, 25 bp, Rattus norvegicus
cctcccgcaggatgtcgaacgggtc

SEQ ID NO: 578906 - DNA, 25 bp, Rattus norvegicus
tcatcgcgacgcttgcgctgcagct

SEQ ID NO: 578907 - DNA, 25 bp, Rattus norvegicus
gaggctcttgcgctccttctgcgac

SEQ ID NO: 578908 - DNA, 25 bp, Rattus norvegicus
tcgtcacgagcctttcagcggcttg

SEQ ID NO: 578909 - DNA, 25 bp, Rattus norvegicus
acttcacctaagtgacctcgtcacg

SEQ ID NO: 578910 - DNA, 25 bp, Rattus norvegicus
cagaggggaagcctagttgtgcacc

SEQ ID NO: 578911 - DNA, 25 bp, Rattus norvegicus
gggcggagctatcacgagataccca

SEQ ID NO: 578912 - DNA, 25 bp, Rattus norvegicus
gttgtgcaccgccatacttcaccta

SEQ ID NO: 578913 - DNA, 25 bp, Rattus norvegicus
ggattcgcttttcccgttcaacagc

SEQ ID NO: 578914 - DNA, 25 bp, Rattus norvegicus
ggcgggagccatgtcaagagaacac

SEQ ID NO: 578915 - DNA, 25 bp, Rattus norvegicus
caagagaacacgacgggccgacgga

SEQ ID NO: 578916 - DNA, 25 bp, Rattus norvegicus
acagcgaaaaagaggaaagcgcgcg

SEQ ID NO: 578917 - DNA, 25 bp, Rattus norvegicus
ctgtccgcggagtgagcccggcaaa

SEQ ID NO: 578918 - DNA, 25 bp, Rattus norvegicus
cggcaaagttgtctcagttcgagcg

SEQ ID NO: 578919 - DNA, 25 bp, Rattus norvegicus
ttgtctcagttcgagcgtcggctcc

SEQ ID NO: 578920 - DNA, 25 bp, Rattus norvegicus
cgcccaacagtctcgttcaggaaaa

SEQ ID NO: 578921 - DNA, 25 bp, Rattus norvegicus
tcaggaaaatagtccaagagagccc

SEQ ID NO: 578922 - DNA, 25 bp, Rattus norvegicus
agtccgcggagccacagcctcgttt

SEQ ID NO: 578923 - DNA, 25 bp, Rattus norvegicus
ccggcaccggagtggcttcagaagc

SEQ ID NO: 578924 - DNA, 25 bp, Rattus norvegicus
ctgagtcgctatgaggaaaagaaac

SEQ ID NO: 578925 - DNA, 25 bp, Rattus norvegicus
acaacttaaaatggcagcgaccgct

SEQ ID NO: 578926 - DNA, 25 bp, Rattus norvegicus
tcaacagcccatgtttcccgagtgg

SEQ ID NO: 578927 - DNA, 25 bp, Rattus norvegicus
tctcagccacggagaaccggccggt

SEQ ID NO: 578928 - DNA, 25 bp, Rattus norvegicus
tgcaactccggtatcggcatagccg

SEQ ID NO: 578929 - DNA, 25 bp, Rattus norvegicus
agtctcggccctacagccaggcaaa

SEQ ID NO: 578930 - DNA, 25 bp, Rattus norvegicus
gacttgaagggacccgagtctcggc

SEQ ID NO: 578931 - DNA, 25 bp, Rattus norvegicus
gcgaggatatgaagggacccaagtc

SEQ ID NO: 578932 - DNA, 25 bp, Rattus norvegicus
gtgttcgctctttctattggctggc

SEQ ID NO: 578933 - DNA, 25 bp, Rattus norvegicus
acggagcactgctgtctgtgagtcc

SEQ ID NO: 578934 - DNA, 25 bp, Rattus norvegicus
gcgattggctgaatgccgaggctcc

SEQ ID NO: 578935 - DNA, 25 bp, Rattus norvegicus
ctctcagtgcgtcagcgaccggggc

SEQ ID NO: 578936 - DNA, 25 bp, Rattus norvegicus
tagtctgcaggttcgggtcgttttg

SEQ ID NO: 578937 - DNA, 25 bp, Rattus norvegicus
ctctcacgctcgctgggaacggagc

SEQ ID NO: 578938 - DNA, 25 bp, Rattus norvegicus
tgccaggggcttgtacggctctcac

SEQ ID NO: 578939 - DNA, 25 bp, Rattus norvegicus
ggcgcgctctagtgttcgctctttc

SEQ ID NO: 578940 - DNA, 25 bp, Rattus norvegicus
gcatagccgggttggcccgaagcca

SEQ ID NO: 578941 - DNA, 25 bp, Rattus norvegicus
agccgggcgtttccaagagcagaaa

SEQ ID NO: 578942 - DNA, 25 bp, Rattus norvegicus
cgaactagggagcatcgccagccta

SEQ ID NO: 578943 - DNA, 25 bp, Rattus norvegicus
cagaggcgcggagctccgctctaca

SEQ ID NO: 578944 - DNA, 25 bp, Rattus norvegicus
ctagcgcgcatacaggcccgggctg

SEQ ID NO: 578945 - DNA, 25 bp, Rattus norvegicus
acacacatatgcactcgcgcgagcg

SEQ ID NO: 578946 - DNA, 25 bp, Rattus norvegicus
tccaagagcagaaactgcgcgctaa

SEQ ID NO: 578947 - DNA, 25 bp, Rattus norvegicus
ctaagcccgggcctcatagagttca

SEQ ID NO: 578948 - DNA, 25 bp, Rattus norvegicus
agttcagttcggttctgggcttgtc

SEQ ID NO: 578949 - DNA, 25 bp, Rattus norvegicus
gttccctagctgcacgcaccgagga

SEQ ID NO: 578950 - DNA, 25 bp, Rattus norvegicus
tgcacgcaccgaggactgctctgct

SEQ ID NO: 578951 - DNA, 25 bp, Rattus norvegicus
ggactgctctgctaaacccgatgca

SEQ ID NO: 578952 - DNA, 25 bp, Rattus norvegicus
tgctaaacccgatgcaccactgctg

SEQ ID NO: 578953 - DNA, 25 bp, Rattus norvegicus
ctgcacccggggctctgcgaactag

SEQ ID NO: 578954 - DNA, 25 bp, Rattus norvegicus
tccctccgtgggaagtgagagccaa

SEQ ID NO: 578955 - DNA, 25 bp, Rattus norvegicus
cacgggtgacagtcgtggccccagc

SEQ ID NO: 578956 - DNA, 25 bp, Rattus norvegicus
gggtggcatgtaccacctcgacacc

SEQ ID NO: 578957 - DNA, 25 bp, Rattus norvegicus
gtaccacctcgacacccacgcaccg

SEQ ID NO: 578958 - DNA, 25 bp, Rattus norvegicus
ccctggctgcggtgcacctccggct

SEQ ID NO: 578959 - DNA, 25 bp, Rattus norvegicus
gctccgcggacagccggtgctcgtt

SEQ ID NO: 578960 - DNA, 25 bp, Rattus norvegicus
cagcgctcgggcgtcgcaccagctg

SEQ ID NO: 578961 - DNA, 25 bp, Rattus norvegicus
cagggaaagggccacgggtgacagt

SEQ ID NO: 578962 - DNA, 25 bp, Rattus norvegicus
tagtgcccggagacgcttagtaccg

SEQ ID NO: 578963 - DNA, 25 bp, Rattus norvegicus
gccggtgctcgttcctcccaaccaa

SEQ ID NO: 578964 - DNA, 25 bp, Rattus norvegicus
agacgcttagtaccgggtggcatgt

SEQ ID NO: 578965 - DNA, 25 bp, Rattus norvegicus
cgagaacgctcctagtgcccggaga

SEQ ID NO: 578966 - DNA, 25 bp, Rattus norvegicus
ctacctgccgagaacgctcctagtg

SEQ ID NO: 578967 - DNA, 25 bp, Rattus norvegicus
agtaccgggtggcatgtaccacctc

SEQ ID NO: 578968 - DNA, 25 bp, Rattus norvegicus
gcttagtaccgggtggcatgtacca

SEQ ID NO: 578969 - DNA, 25 bp, Rattus norvegicus
gcggtggccgactggccatcttcct

SEQ ID NO: 578970 - DNA, 25 bp, Rattus norvegicus
ccgagaatcagagagtgggacccga

SEQ ID NO: 578971 - DNA, 25 bp, Rattus norvegicus
tgaccgacgagagctccgatgtccc

SEQ ID NO: 578972 - DNA, 25 bp, Rattus norvegicus
ctcctgcgccaagtggcgtgggaca

SEQ ID NO: 578973 - DNA, 25 bp, Rattus norvegicus
cccagtgggcaaccatgaccgacga

SEQ ID NO: 578974 - DNA, 25 bp, Rattus norvegicus
tcagagagtgggacccgagatctcc

SEQ ID NO: 578975 - DNA, 25 bp, Rattus norvegicus
cctcgcggaaacattaacgggtctg

SEQ ID NO: 578976 - DNA, 25 bp, Rattus norvegicus
gcgcgcggcaaccttggatcaacgc

SEQ ID NO: 578977 - DNA, 25 bp, Rattus norvegicus
ttttcttttggtactgagggcgcgc

SEQ ID NO: 578978 - DNA, 25 bp, Rattus norvegicus
ctcggatttgcaactcttagggttt

SEQ ID NO: 578979 - DNA, 25 bp, Rattus norvegicus
gccgcagagccagctcggatttgca

SEQ ID NO: 578980 - DNA, 25 bp, Rattus norvegicus
gagaagccagtgctgcagccgcctt

SEQ ID NO: 578981 - DNA, 25 bp, Rattus norvegicus
agacgcaagcgtctgctgcacccga

SEQ ID NO: 578982 - DNA, 25 bp, Rattus norvegicus
acctacgcccaaggtgcggcgcaga

SEQ ID NO: 578983 - DNA, 25 bp, Rattus norvegicus
cggccgccaagtacactggtgtgcc

SEQ ID NO: 578984 - DNA, 25 bp, Rattus norvegicus
gccgccaagtacactggtgtgccag

SEQ ID NO: 578985 - DNA, 25 bp, Rattus norvegicus
acggccgccaagtacactggtgtgc

SEQ ID NO: 578986 - DNA, 25 bp, Rattus norvegicus
actggtgtgccagccccaattcgct

SEQ ID NO: 578987 - DNA, 25 bp, Rattus norvegicus
aattcgctctgcgtagttcccttgg

SEQ ID NO: 578988 - DNA, 25 bp, Rattus norvegicus
attcgctctgcgtagttcccttggc

SEQ ID NO: 578989 - DNA, 25 bp, Rattus norvegicus
cgctctgcgtagttcccttggcgaa

SEQ ID NO: 578990 - DNA, 25 bp, Rattus norvegicus
gctctgcgtagttcccttggcgaag

SEQ ID NO: 578991 - DNA, 25 bp, Rattus norvegicus
tgcgtagttcccttggcgaaggagc

SEQ ID NO: 578992 - DNA, 25 bp, Rattus norvegicus
gtacactggtgtgccagccccaatt

SEQ ID NO: 578993 - DNA, 25 bp, Rattus norvegicus
cttggcgaaggagccggtgcacacg

SEQ ID NO: 578994 - DNA, 25 bp, Rattus norvegicus
cacggccgccaagtacactggtgtg

SEQ ID NO: 578995 - DNA, 25 bp, Rattus norvegicus
ctctgcgtagttcccttggcgaagg

SEQ ID NO: 578996 - DNA, 25 bp, Rattus norvegicus
ccaattcgctctgcgtagttccctt

SEQ ID NO: 578997 - DNA, 25 bp, Rattus norvegicus
cttttttgaaacagtgggggctctg

SEQ ID NO: 578998 - DNA, 25 bp, Rattus norvegicus
cgacttgattggttacaagaaagca

SEQ ID NO: 578999 - DNA, 25 bp, Rattus norvegicus
cgctacgacttgattggttacaaga

SEQ ID NO: 579000 - DNA, 25 bp, Rattus norvegicus
cctgggtagtaaacgctacgacttg

SEQ ID NO: 579001 - DNA, 25 bp, Rattus norvegicus
aagaactaagactgtgcaaatgtgg

SEQ ID NO: 579002 - DNA, 25 bp, Rattus norvegicus
gcagaaataaagaactaagactgtg

SEQ ID NO: 579003 - DNA, 25 bp, Rattus norvegicus
gtactgtgatgtaagactaaatagc

SEQ ID NO: 579004 - DNA, 25 bp, Rattus norvegicus
tccagacatgatagtagtactgtga

SEQ ID NO: 579005 - DNA, 25 bp, Rattus norvegicus
cgcgtccagacatgatagtagtact

SEQ ID NO: 579006 - DNA, 25 bp, Rattus norvegicus
ccacgcgctcggacgcccacgcgct

SEQ ID NO: 579007 - DNA, 25 bp, Rattus norvegicus
tccgcaaattcttaagtcttaatta

SEQ ID NO: 579008 - DNA, 25 bp, Rattus norvegicus
tgaagtttccgcaaattcttaagtc

SEQ ID NO: 579009 - DNA, 25 bp, Rattus norvegicus
ttgtgtttgaagtttccgcaaattc

SEQ ID NO: 579010 - DNA, 25 bp, Rattus norvegicus
agagcctttgtgtttgaagtttccg

SEQ ID NO: 579011 - DNA, 25 bp, Rattus norvegicus
tttaaatagaccttctgcggacctg

SEQ ID NO: 579012 - DNA, 25 bp, Rattus norvegicus
tctgcggacctgattgaagaccaca

SEQ ID NO: 579013 - DNA, 25 bp, Rattus norvegicus
agaaagcaagcttccctttaaatag

SEQ ID NO: 579014 - DNA, 25 bp, Rattus norvegicus
ccacgtccagacatggttgtgagta

SEQ ID NO: 579015 - DNA, 25 bp, Rattus norvegicus
aagcgcattagcagtttaaccaccg

SEQ ID NO: 579016 - DNA, 25 bp, Rattus norvegicus
tgcaacagctaaggaaagcgcatta

SEQ ID NO: 579017 - DNA, 25 bp, Rattus norvegicus
gaaaagggccttttgcaacagctaa

SEQ ID NO: 579018 - DNA, 25 bp, Rattus norvegicus
cgaaaagtgaacaaccctttgaatg

SEQ ID NO: 579019 - DNA, 25 bp, Rattus norvegicus
ccagagcaaagaagcttcgaaaagt

SEQ ID NO: 579020 - DNA, 25 bp, Rattus norvegicus
gctacctcgcatgctccagagcaaa

SEQ ID NO: 579021 - DNA, 25 bp, Rattus norvegicus
gacaccgcttatatgctacctcgca

SEQ ID NO: 579022 - DNA, 25 bp, Rattus norvegicus
tatagcataggacaccgcttatatg

SEQ ID NO: 579023 - DNA, 25 bp, Rattus norvegicus
ctttgaatgagttcgtgggtggccc

SEQ ID NO: 579024 - DNA, 25 bp, Rattus norvegicus
tgattgaagaccacaggcgttagga

SEQ ID NO: 579025 - DNA, 25 bp, Rattus norvegicus
agctcatcactaaggccgtggctgc

SEQ ID NO: 579026 - DNA, 25 bp, Rattus norvegicus
aaggctgccggagcaccaatcagcg

SEQ ID NO: 579027 - DNA, 25 bp, Rattus norvegicus
gccgtggctgcctccaaggagcgca

SEQ ID NO: 579028 - DNA, 25 bp, Rattus norvegicus
tctatatatacagcggccgggcccg

SEQ ID NO: 579029 - DNA, 25 bp, Rattus norvegicus
tactccaccggcgtattgccattag

SEQ ID NO: 579030 - DNA, 25 bp, Rattus norvegicus
gcgtattgccattagttcctgactt

SEQ ID NO: 579031 - DNA, 25 bp, Rattus norvegicus
gttcctgacttccagaggctcatca

SEQ ID NO: 579032 - DNA, 25 bp, Rattus norvegicus
aggctcatcatgtcggaaactgctc

SEQ ID NO: 579033 - DNA, 25 bp, Rattus norvegicus
atgtcggaaactgctcctgctgccc

SEQ ID NO: 579034 - DNA, 25 bp, Rattus norvegicus
ctgctcggagcttgccagccaggaa

SEQ ID NO: 579035 - DNA, 25 bp, Rattus norvegicus
cccggtgtccgagctcatcactaag

SEQ ID NO: 579036 - DNA, 25 bp, Rattus norvegicus
gagcttgccagccaggaaggctgcc

SEQ ID NO: 579037 - DNA, 25 bp, Rattus norvegicus
tgccaagaagcctgcagggatgcgc

SEQ ID NO: 579038 - DNA, 25 bp, Rattus norvegicus
cgcgcctgcgctctatatatacagc

SEQ ID NO: 579039 - DNA, 25 bp, Rattus norvegicus
ctggtctactatagaaatacatgtg

SEQ ID NO: 579040 - DNA, 25 bp, Rattus norvegicus
aaggagcccgcgctttgttgggatt

SEQ ID NO: 579041 - DNA, 25 bp, Rattus norvegicus
tggaccggagaacattcaaaggagc

SEQ ID NO: 579042 - DNA, 25 bp, Rattus norvegicus
tcagactgttcgctattggaccgga

SEQ ID NO: 579043 - DNA, 25 bp, Rattus norvegicus
gaggagctgtccatcttttatacaa

SEQ ID NO: 579044 - DNA, 25 bp, Rattus norvegicus
agagttgacactacaaggttttgtg

SEQ ID NO: 579045 - DNA, 25 bp, Rattus norvegicus
ctttagcaataggaagagagttgac

SEQ ID NO: 579046 - DNA, 25 bp, Rattus norvegicus
gtacgagccatttctttagcaatag

SEQ ID NO: 579047 - DNA, 25 bp, Rattus norvegicus
tacatgtgtacactatggcagagca

SEQ ID NO: 579048 - DNA, 25 bp, Rattus norvegicus
tagtagcttagatatgtaactggtc

SEQ ID NO: 579049 - DNA, 25 bp, Rattus norvegicus
ttgttgggattggtccgcctttgct

SEQ ID NO: 579050 - DNA, 25 bp, Rattus norvegicus
atttaagccctctcgccacgaatgc

SEQ ID NO: 579051 - DNA, 25 bp, Rattus norvegicus
acatgaaattttaggtggctcttaa

SEQ ID NO: 579052 - DNA, 25 bp, Rattus norvegicus
tggcagagcaaacagcaactttaca

SEQ ID NO: 579053 - DNA, 25 bp, Rattus norvegicus
gacgcgcgctcctacagactttcga

SEQ ID NO: 579054 - DNA, 25 bp, Rattus norvegicus
tcagcgacttcatggtgtacccgtg

SEQ ID NO: 579055 - DNA, 25 bp, Rattus norvegicus
cacctttgcaggaatcattgggcca

SEQ ID NO: 579056 - DNA, 25 bp, Rattus norvegicus
tgagaacgcgcataacgtgacgctc

SEQ ID NO: 579057 - DNA, 25 bp, Rattus norvegicus
taaggacccgcgctcgaattggttc

SEQ ID NO: 579058 - DNA, 25 bp, Rattus norvegicus
gaacacagcctggacccggctattg

SEQ ID NO: 579059 - DNA, 25 bp, Rattus norvegicus
ccaatgacgtggcagtaaggacccg

SEQ ID NO: 579060 - DNA, 25 bp, Rattus norvegicus
tggttccgcccaggcgcgaaatgta

SEQ ID NO: 579061 - DNA, 25 bp, Rattus norvegicus
cggcaggttgttattctcggggact

SEQ ID NO: 579062 - DNA, 25 bp, Rattus norvegicus
tcgcatcccgttttcctgtcagcaa

SEQ ID NO: 579063 - DNA, 25 bp, Rattus norvegicus
gggctgcagacgagccagcatgatc

SEQ ID NO: 579064 - DNA, 25 bp, Rattus norvegicus
cacgactctccgaagcgcgtactgg

SEQ ID NO: 579065 - DNA, 25 bp, Rattus norvegicus
cgcgtactggtatcggtcatcagga

SEQ ID NO: 579066 - DNA, 25 bp, Rattus norvegicus
tcgaacgcagttggccctcaagaca

SEQ ID NO: 579067 - DNA, 25 bp, Rattus norvegicus
tttgcgaagcaaacggtgcacacgg

SEQ ID NO: 579068 - DNA, 25 bp, Rattus norvegicus
gcgtagttgcctttgcgaagcaaac

SEQ ID NO: 579069 - DNA, 25 bp, Rattus norvegicus
cgtagttgcctttgcgaagcaaacg

SEQ ID NO: 579070 - DNA, 25 bp, Rattus norvegicus
gtagttgcctttgcgaagcaaacgg

SEQ ID NO: 579071 - DNA, 25 bp, Rattus norvegicus
agttgcctttgcgaagcaaacggtg

SEQ ID NO: 579072 - DNA, 25 bp, Rattus norvegicus
gttgcctttgcgaagcaaacggtgc

SEQ ID NO: 579073 - DNA, 25 bp, Rattus norvegicus
ttgcctttgcgaagcaaacggtgca

SEQ ID NO: 579074 - DNA, 25 bp, Rattus norvegicus
ctttgcgaagcaaacggtgcacacg

SEQ ID NO: 579075 - DNA, 25 bp, Rattus norvegicus
ttgcgaagcaaacggtgcacacggc

SEQ ID NO: 579076 - DNA, 25 bp, Rattus norvegicus
gcgaagcaaacggtgcacacggccc

SEQ ID NO: 579077 - DNA, 25 bp, Rattus norvegicus
gagccttaccgccttgtttgccgcg

SEQ ID NO: 579078 - DNA, 25 bp, Rattus norvegicus
ggcgcgagccttaccgccttgtttg

SEQ ID NO: 579079 - DNA, 25 bp, Rattus norvegicus
gcgcgagccttaccgccttgtttgc

SEQ ID NO: 579080 - DNA, 25 bp, Rattus norvegicus
gcctttgcgaagcaaacggtgcaca

SEQ ID NO: 579081 - DNA, 25 bp, Rattus norvegicus
gttcgccgctgcaaacaggtccatc

SEQ ID NO: 579082 - DNA, 25 bp, Rattus norvegicus
gctggctaatcctgcaccgatgaaa

SEQ ID NO: 579083 - DNA, 25 bp, Rattus norvegicus
gagcatgcgcacgagatttctactg

SEQ ID NO: 579084 - DNA, 25 bp, Rattus norvegicus
tgcccaatcgggaggtctgtaagtt

SEQ ID NO: 579085 - DNA, 25 bp, Rattus norvegicus
agctggtacccaataagagactgtc

SEQ ID NO: 579086 - DNA, 25 bp, Rattus norvegicus
caggtccatccaatcacgtctggtg

SEQ ID NO: 579087 - DNA, 25 bp, Rattus norvegicus
ggtgttactcaaattccctggatcg

SEQ ID NO: 579088 - DNA, 25 bp, Rattus norvegicus
agcgcacttcacaggtctttagacg

SEQ ID NO: 579089 - DNA, 25 bp, Rattus norvegicus
cgtccgaattttggcgtcacacaga

SEQ ID NO: 579090 - DNA, 25 bp, Rattus norvegicus
gtcagcgttcttgggatgtcaacaa

SEQ ID NO: 579091 - DNA, 25 bp, Rattus norvegicus
agtgtccctgcgtggcatcttcaga

SEQ ID NO: 579092 - DNA, 25 bp, Rattus norvegicus
attgaatcttttcaggggcgcctta

SEQ ID NO: 579093 - DNA, 25 bp, Rattus norvegicus
aaatttgaacactcggacacgccgg

SEQ ID NO: 579094 - DNA, 25 bp, Rattus norvegicus
gggcgccttagggaaggacattcta

SEQ ID NO: 579095 - DNA, 25 bp, Rattus norvegicus
aggctcaggcattcttctcaaaaac

SEQ ID NO: 579096 - DNA, 25 bp, Rattus norvegicus
atctttagtaatgtctggacgcggc

SEQ ID NO: 579097 - DNA, 25 bp, Rattus norvegicus
agtggcttccatcttttctaatttg

SEQ ID NO: 579098 - DNA, 25 bp, Rattus norvegicus
ttgggactcggactaacgtataaga

SEQ ID NO: 579099 - DNA, 25 bp, Rattus norvegicus
ataggaatgcgatattttgggactc

SEQ ID NO: 579100 - DNA, 25 bp, Rattus norvegicus
ataagggacccaaaatcgcatcttt

SEQ ID NO: 579101 - DNA, 25 bp, Rattus norvegicus
gtgcctttacttttgattggataga

SEQ ID NO: 579102 - DNA, 25 bp, Rattus norvegicus
cgtgcaccgtctgctctacaagggc

SEQ ID NO: 579103 - DNA, 25 bp, Rattus norvegicus
gaaagcacgacactgacttatttta

SEQ ID NO: 579104 - DNA, 25 bp, Rattus norvegicus
tggtgcagatttcgaaggctcaggc

SEQ ID NO: 579105 - DNA, 25 bp, Rattus norvegicus
cccttcttaggagctggtgcagatt

SEQ ID NO: 579106 - DNA, 25 bp, Rattus norvegicus
agagatagctttcttagagcccttc

SEQ ID NO: 579107 - DNA, 25 bp, Rattus norvegicus
ccatcctttttctgagctttagaga

SEQ ID NO: 579108 - DNA, 25 bp, Rattus norvegicus
gaattcaaatgaaggcgcaagtgcc

SEQ ID NO: 579109 - DNA, 25 bp, Rattus norvegicus
ggcaagattctttcttccttctaca

SEQ ID NO: 579110 - DNA, 25 bp, Rattus norvegicus
acagcttagccatgttgaatttaaa

SEQ ID NO: 579111 - DNA, 25 bp, Rattus norvegicus
agctgtcactctcatttctactgtg

SEQ ID NO: 579112 - DNA, 25 bp, Rattus norvegicus
cacactttctgtagatgcagctgtc

SEQ ID NO: 579113 - DNA, 25 bp, Rattus norvegicus
ctggctattacccagccaatgaatt

SEQ ID NO: 579114 - DNA, 25 bp, Rattus norvegicus
cgggatggcacgtactaagcagacc

SEQ ID NO: 579115 - DNA, 25 bp, Rattus norvegicus
gcttaaacggtcctacgagcagtta

SEQ ID NO: 579116 - DNA, 25 bp, Rattus norvegicus
ctacgtctatttaagggcaagattc

SEQ ID NO: 579117 - DNA, 25 bp, Rattus norvegicus
aggccaatcaaaatgtttctacgtc

SEQ ID NO: 579118 - DNA, 25 bp, Rattus norvegicus
ctttcgaaatgttgcaaggccaatc

SEQ ID NO: 579119 - DNA, 25 bp, Rattus norvegicus
tgtggcgcgcgactttcgaaatgtt

SEQ ID NO: 579120 - DNA, 25 bp, Rattus norvegicus
ccaatgaatttgtggcgcgcgactt

SEQ ID NO: 579121 - DNA, 25 bp, Rattus norvegicus
tcttaaagctaccaatcacactggc

SEQ ID NO: 579122 - DNA, 25 bp, Rattus norvegicus
gcattcgtggagagagagcttaaac

SEQ ID NO: 579123 - DNA, 25 bp, Rattus norvegicus
tgcgtagccaggtagcgaagttcta

SEQ ID NO: 579124 - DNA, 25 bp, Rattus norvegicus
cctttggttcatgccaggaactgta

SEQ ID NO: 579125 - DNA, 25 bp, Rattus norvegicus
cccatcactggggatactaggttta

SEQ ID NO: 579126 - DNA, 25 bp, Rattus norvegicus
agtagttgcttacactgcgtagcca

SEQ ID NO: 579127 - DNA, 25 bp, Rattus norvegicus
tcttatcccacggtaacgtattgtg

SEQ ID NO: 579128 - DNA, 25 bp, Rattus norvegicus
gacgcagacacgacccttaagcctg

SEQ ID NO: 579129 - DNA, 25 bp, Rattus norvegicus
accgaaggcctgcaagacgcagaca

SEQ ID NO: 579130 - DNA, 25 bp, Rattus norvegicus
gctccgcccttaagacttgcgtgga

SEQ ID NO: 579131 - DNA, 25 bp, Rattus norvegicus
agtgacgtcacaagctccgccctta

SEQ ID NO: 579132 - DNA, 25 bp, Rattus norvegicus
tccctcaagacttgcgcggaaagga

SEQ ID NO: 579133 - DNA, 25 bp, Rattus norvegicus
atcgcagaacagaaagcccgccggc

SEQ ID NO: 579134 - DNA, 25 bp, Rattus norvegicus
ctgagcttagagtcgctcctttata

SEQ ID NO: 579135 - DNA, 25 bp, Rattus norvegicus
tgccgcgaccggacatatcttaaag

SEQ ID NO: 579136 - DNA, 25 bp, Rattus norvegicus
tacttgaaaccgtgtgtggctctga

SEQ ID NO: 579137 - DNA, 25 bp, Rattus norvegicus
cctgagaaacctgccgctacaaaga

SEQ ID NO: 579138 - DNA, 25 bp, Rattus norvegicus
cgaggaggtcttgtcttcctacttc

SEQ ID NO: 579139 - DNA, 25 bp, Rattus norvegicus
tcctacttcttttcttcgtcttggc

SEQ ID NO: 579140 - DNA, 25 bp, Rattus norvegicus
tcgtcttggcatttgctggtcactc

SEQ ID NO: 579141 - DNA, 25 bp, Rattus norvegicus
gcgggcgttagcatgcaccaatcac

SEQ ID NO: 579142 - DNA, 25 bp, Rattus norvegicus
aaccatgtcggagacagcgccagtc

SEQ ID NO: 579143 - DNA, 25 bp, Rattus norvegicus
gctctataaatacgccgcgaggagg

SEQ ID NO: 579144 - DNA, 25 bp, Rattus norvegicus
caggaagcctgcgaaagctgctgtc

SEQ ID NO: 579145 - DNA, 25 bp, Rattus norvegicus
tgctgtccctcgaaagaagcccgcg

SEQ ID NO: 579146 - DNA, 25 bp, Rattus norvegicus
gcgggaccttcagtgtctgagctca

SEQ ID NO: 579147 - DNA, 25 bp, Rattus norvegicus
tctgagctcatcgtgcaggcagtct

SEQ ID NO: 579148 - DNA, 25 bp, Rattus norvegicus
caggcagtctcatcctccaaggagc

SEQ ID NO: 579149 - DNA, 25 bp, Rattus norvegicus
ggcccggccctgctctataaatacg

SEQ ID NO: 579150 - DNA, 25 bp, Rattus norvegicus
gctggtcactcctcagcaaccatgt

SEQ ID NO: 579151 - DNA, 25 bp, Rattus norvegicus
tgcttgccgcgaccagacatttcac

SEQ ID NO: 579152 - DNA, 25 bp, Rattus norvegicus
aacttatactcaactcctggcgcga

SEQ ID NO: 579153 - DNA, 25 bp, Rattus norvegicus
ttgacgatgcctgagcccgccaagt

SEQ ID NO: 579154 - DNA, 25 bp, Rattus norvegicus
cctggcgcgaaaaacggagtgattt

SEQ ID NO: 579155 - DNA, 25 bp, Rattus norvegicus
acggagtgattttattggctactca

SEQ ID NO: 579156 - DNA, 25 bp, Rattus norvegicus
tggctactcatacagcttttttaac

SEQ ID NO: 579157 - DNA, 25 bp, Rattus norvegicus
ttaacctaagccaatagtatcgtgg

SEQ ID NO: 579158 - DNA, 25 bp, Rattus norvegicus
ttgattggacagttcgtgcatgacg

SEQ ID NO: 579159 - DNA, 25 bp, Rattus norvegicus
gtgcatgacgtctcagaatctccga

SEQ ID NO: 579160 - DNA, 25 bp, Rattus norvegicus
tccgaacaagaacagctacagcttt

SEQ ID NO: 579161 - DNA, 25 bp, Rattus norvegicus
atagcaggaagaacccgagaactcc

SEQ ID NO: 579162 - DNA, 25 bp, Rattus norvegicus
cgagaactcccaacaactctttctg

SEQ ID NO: 579163 - DNA, 25 bp, Rattus norvegicus
tggtgttcacactctgttgacgatg

SEQ ID NO: 579164 - DNA, 25 bp, Rattus norvegicus
gtgaagcagccacagcactaaactt

SEQ ID NO: 579165 - DNA, 25 bp, Rattus norvegicus
agagcagacctcaacagaatggaag

SEQ ID NO: 579166 - DNA, 25 bp, Rattus norvegicus
cacattccttatatgcagggtgttc

SEQ ID NO: 579167 - DNA, 25 bp, Rattus norvegicus
taattgaagactgaaccctctcgcc

SEQ ID NO: 579168 - DNA, 25 bp, Rattus norvegicus
cgtccagacatctctacaaagctgg

SEQ ID NO: 579169 - DNA, 25 bp, Rattus norvegicus
ggttcatgcctaatgacgtcaccaa

SEQ ID NO: 579170 - DNA, 25 bp, Rattus norvegicus
atggaaggtacaggcacattcctta

SEQ ID NO: 579171 - DNA, 25 bp, Rattus norvegicus
ccctagcacggttcatgcctaatga

SEQ ID NO: 579172 - DNA, 25 bp, Rattus norvegicus
ttgtgagatcagacgacagacgaga

SEQ ID NO: 579173 - DNA, 25 bp, Rattus norvegicus
aagggcctttggttttgtgagatca

SEQ ID NO: 579174 - DNA, 25 bp, Rattus norvegicus
acgaatcatgctcgcccttttaata

SEQ ID NO: 579175 - DNA, 25 bp, Rattus norvegicus
gacgtcctgaataacaccgctaatc

SEQ ID NO: 579176 - DNA, 25 bp, Rattus norvegicus
aaatattctagttgagacgtcctga

SEQ ID NO: 579177 - DNA, 25 bp, Rattus norvegicus
cagggtgttcggacctaattgaaga

SEQ ID NO: 579178 - DNA, 25 bp, Rattus norvegicus
acagacgagagtcccttaaccgcca

SEQ ID NO: 579179 - DNA, 25 bp, Rattus norvegicus
ggatgcgtcgcctcgtcactcagcg

SEQ ID NO: 579180 - DNA, 25 bp, Rattus norvegicus
tgacagccagactcctagacggcct

SEQ ID NO: 579181 - DNA, 25 bp, Rattus norvegicus
gaggccgctgtgcatctcaaagtgg

SEQ ID NO: 579182 - DNA, 25 bp, Rattus norvegicus
aacgacgactccgaggaggccgctg

SEQ ID NO: 579183 - DNA, 25 bp, Rattus norvegicus
tttctcaaagacaacgacgactccg

SEQ ID NO: 579184 - DNA, 25 bp, Rattus norvegicus
ggggcaataccggtgctttctcaaa

SEQ ID NO: 579185 - DNA, 25 bp, Rattus norvegicus
tctcaaagtggctggtgggtacaga

SEQ ID NO: 579186 - DNA, 25 bp, Rattus norvegicus
cagggtctccgaccaggggcaatac

SEQ ID NO: 579187 - DNA, 25 bp, Rattus norvegicus
tagacggcctcgctactctgcggat

SEQ ID NO: 579188 - DNA, 25 bp, Rattus norvegicus
gacgctggtgacagccagactccta

SEQ ID NO: 579189 - DNA, 25 bp, Rattus norvegicus
gggcgagcagatgaccgagtaccac

SEQ ID NO: 579190 - DNA, 25 bp, Rattus norvegicus
ggtacttctgtaccgggctggccag

SEQ ID NO: 579191 - DNA, 25 bp, Rattus norvegicus
agacgaggtcgccagcggtacttct

SEQ ID NO: 579192 - DNA, 25 bp, Rattus norvegicus
atccgaggtgtcagggtctccgacc

SEQ ID NO: 579193 - DNA, 25 bp, Rattus norvegicus
ttcgcaatggccgagtttgtaactg

SEQ ID NO: 579194 - DNA, 25 bp, Rattus norvegicus
tagtccgcctcagagacgagtcatc

SEQ ID NO: 579195 - DNA, 25 bp, Rattus norvegicus
gtatccacgcttgtcctgggcagca

SEQ ID NO: 579196 - DNA, 25 bp, Rattus norvegicus
gcgatgccaagatccgctcagcttg

SEQ ID NO: 579197 - DNA, 25 bp, Rattus norvegicus
cgctcagcttgaactaggatttacc

SEQ ID NO: 579198 - DNA, 25 bp, Rattus norvegicus
cgtcactggacctgtggctgttcca

SEQ ID NO: 579199 - DNA, 25 bp, Rattus norvegicus
ggcgttttatatctgcctcaaagga

SEQ ID NO: 579200 - DNA, 25 bp, Rattus norvegicus
agggatgctctcctgtatcattcgg

SEQ ID NO: 579201 - DNA, 25 bp, Rattus norvegicus
gaaatgagtcttttcgagtcgccca

SEQ ID NO: 579202 - DNA, 25 bp, Rattus norvegicus
ttgtaactgaggaggccaacgcagc

SEQ ID NO: 579203 - DNA, 25 bp, Rattus norvegicus
tgtgactccgaagtcgttcgcaatg

SEQ ID NO: 579204 - DNA, 25 bp, Rattus norvegicus
tctcgctggacactatccgggtccg

SEQ ID NO: 579205 - DNA, 25 bp, Rattus norvegicus
agacggtctgccttgttccgcgaag

SEQ ID NO: 579206 - DNA, 25 bp, Rattus norvegicus
cgagtcgcccagaaaatacttagtg

SEQ ID NO: 579207 - DNA, 25 bp, Rattus norvegicus
aggctctgcggtggttacgtacttt

SEQ ID NO: 579208 - DNA, 25 bp, Rattus norvegicus
agcagcggtcctcgcggttcttggc

SEQ ID NO: 579209 - DNA, 25 bp, Rattus norvegicus
agggtccagtcaccggaagtgccgc

SEQ ID NO: 579210 - DNA, 25 bp, Rattus norvegicus
aaggtccggcttgagggtccagtca

SEQ ID NO: 579211 - DNA, 25 bp, Rattus norvegicus
agaccgaacgggctcccggagtgca

SEQ ID NO: 579212 - DNA, 25 bp, Rattus norvegicus
ccctaagaagaggtgagaccgaacg

SEQ ID NO: 579213 - DNA, 25 bp, Rattus norvegicus
cactttcgttccctaagaagaggtg

SEQ ID NO: 579214 - DNA, 25 bp, Rattus norvegicus
tggcttgctgacctctcggcctctt

SEQ ID NO: 579215 - DNA, 25 bp, Rattus norvegicus
tatcctgcggttggcttgctgacct

SEQ ID NO: 579216 - DNA, 25 bp, Rattus norvegicus
tctccaggttggtatcctgcggttg

SEQ ID NO: 579217 - DNA, 25 bp, Rattus norvegicus
agggcgatttgcgttggccttgtaa

SEQ ID NO: 579218 - DNA, 25 bp, Rattus norvegicus
tacgtactttgaggcgtggctacgc

SEQ ID NO: 579219 - DNA, 25 bp, Rattus norvegicus
cagacccagctggtgagggcgattt

SEQ ID NO: 579220 - DNA, 25 bp, Rattus norvegicus
gcggctcccttgttgtcacggtcaa

SEQ ID NO: 579221 - DNA, 25 bp, Rattus norvegicus
cccgactcttcctgttcctgccgca

SEQ ID NO: 579222 - DNA, 25 bp, Rattus norvegicus
cgcgcccggtaggatgtaaattaca

SEQ ID NO: 579223 - DNA, 25 bp, Rattus norvegicus
taaggcagtttttccggcattccca

SEQ ID NO: 579224 - DNA, 25 bp, Rattus norvegicus
cagtttttccggcattcccaggcgg

SEQ ID NO: 579225 - DNA, 25 bp, Rattus norvegicus
ttcccaggcggtggacacctccaag

SEQ ID NO: 579226 - DNA, 25 bp, Rattus norvegicus
agctcactagaggaaccggcaccgg

SEQ ID NO: 579227 - DNA, 25 bp, Rattus norvegicus
ctggccaggctgctatcggcgctct

SEQ ID NO: 579228 - DNA, 25 bp, Rattus norvegicus
ctatcggcgctcttctacgggacat

SEQ ID NO: 579229 - DNA, 25 bp, Rattus norvegicus
tacgggacatgctccttcctcatcg

SEQ ID NO: 579230 - DNA, 25 bp, Rattus norvegicus
tcctcatcgtgctggtcaacaaggc

SEQ ID NO: 579231 - DNA, 25 bp, Rattus norvegicus
tcaacaaggcgctgctgaccacata

SEQ ID NO: 579232 - DNA, 25 bp, Rattus norvegicus
ggcgctgctgaccacatatgggtga

SEQ ID NO: 579233 - DNA, 25 bp, Rattus norvegicus
ccacatatgggtgaggctggttata

SEQ ID NO: 579234 - DNA, 25 bp, Rattus norvegicus
cacctccaaggagagagctcactag

SEQ ID NO: 579235 - DNA, 25 bp, Rattus norvegicus
tcttttgatggatggcctctgagga

SEQ ID NO: 579236 - DNA, 25 bp, Rattus norvegicus
ggccaatcagcgcatacttcccgtt

SEQ ID NO: 579237 - DNA, 25 bp, Rattus norvegicus
gcctctgaggaagctcggccaatca

SEQ ID NO: 579238 - DNA, 25 bp, Rattus norvegicus
gctagctgggactcatcttcgcctc

SEQ ID NO: 579239 - DNA, 25 bp, Rattus norvegicus
tcttcgcctctgattggtgtgattc

SEQ ID NO: 579240 - DNA, 25 bp, Rattus norvegicus
tgtgattcttttgatggatggcctc

SEQ ID NO: 579241 - DNA, 25 bp, Rattus norvegicus
atcagcgcatacttcccgttgtcgg

SEQ ID NO: 579242 - DNA, 25 bp, Rattus norvegicus
ttcccgttgtcggacttcaattctc

SEQ ID NO: 579243 - DNA, 25 bp, Rattus norvegicus
gttgtcggacttcaattctccgccc

SEQ ID NO: 579244 - DNA, 25 bp, Rattus norvegicus
agccttcctccggttcagcgtgcgg

SEQ ID NO: 579245 - DNA, 25 bp, Rattus norvegicus
tccccgatccgagaggccgactagg

SEQ ID NO: 579246 - DNA, 25 bp, Rattus norvegicus
gataggctgggcaccaggattgcta

SEQ ID NO: 579247 - DNA, 25 bp, Rattus norvegicus
caccaggattgctagctgggactca

SEQ ID NO: 579248 - DNA, 25 bp, Rattus norvegicus
tcctccggttcagcgtgcggtgaag

SEQ ID NO: 579249 - DNA, 25 bp, Rattus norvegicus
cgccaccactgcgttatctaaatgt

SEQ ID NO: 579250 - DNA, 25 bp, Rattus norvegicus
acgaacattgggtctctccggagca

SEQ ID NO: 579251 - DNA, 25 bp, Rattus norvegicus
gaatcctggggtaccgccaccactg

SEQ ID NO: 579252 - DNA, 25 bp, Rattus norvegicus
tggaatcctggggtaccgccaccac

SEQ ID NO: 579253 - DNA, 25 bp, Rattus norvegicus
ctctccggagcagcgggtctggaat

SEQ ID NO: 579254 - DNA, 25 bp, Rattus norvegicus
accactgcgttatctaaatgttttt

SEQ ID NO: 579255 - DNA, 25 bp, Rattus norvegicus
acattgggtctctccggagcagcgg

SEQ ID NO: 579256 - DNA, 25 bp, Rattus norvegicus
gggtaccgccaccactgcgttatct

SEQ ID NO: 579257 - DNA, 25 bp, Rattus norvegicus
gaacattgggtctctccggagcagc

SEQ ID NO: 579258 - DNA, 25 bp, Rattus norvegicus
tggggtaccgccaccactgcgttat

SEQ ID NO: 579259 - DNA, 25 bp, Rattus norvegicus
ccaccactgcgttatctaaatgttt

SEQ ID NO: 579260 - DNA, 25 bp, Rattus norvegicus
taccgccaccactgcgttatctaaa

SEQ ID NO: 579261 - DNA, 25 bp, Rattus norvegicus
ggtaccgccaccactgcgttatcta

SEQ ID NO: 579262 - DNA, 25 bp, Rattus norvegicus
aacattgggtctctccggagcagcg

SEQ ID NO: 579263 - DNA, 25 bp, Rattus norvegicus
acaggtccagtgacgatggtaaatc

SEQ ID NO: 579264 - DNA, 25 bp, Rattus norvegicus
ccttcgcggaacaaggcagaccgtc

SEQ ID NO: 579265 - DNA, 25 bp, Rattus norvegicus
ggtcctgcacttttctcacgcagcg

SEQ ID NO: 579266 - DNA, 25 bp, Rattus norvegicus
gatgactcgtctctgaggcggacta

SEQ ID NO: 579267 - DNA, 25 bp, Rattus norvegicus
cgtggatacgccgagatgactcgtc

SEQ ID NO: 579268 - DNA, 25 bp, Rattus norvegicus
tgctgcccaggacaagcgtggatac

SEQ ID NO: 579269 - DNA, 25 bp, Rattus norvegicus
ccagttcctttgaggcagatataaa

SEQ ID NO: 579270 - DNA, 25 bp, Rattus norvegicus
aggagagcatccctgtcgcctcttc

SEQ ID NO: 579271 - DNA, 25 bp, Rattus norvegicus
ctgggcgactcgaaaagactcattt

SEQ ID NO: 579272 - DNA, 25 bp, Rattus norvegicus
acttcggagtcacagatattcgttg

SEQ ID NO: 579273 - DNA, 25 bp, Rattus norvegicus
ctcggccattgcgaacgacttcgga

SEQ ID NO: 579274 - DNA, 25 bp, Rattus norvegicus
gctgcgttggcctcctcagttacaa

SEQ ID NO: 579275 - DNA, 25 bp, Rattus norvegicus
tcctagttcaagctgagcggatctt

SEQ ID NO: 579276 - DNA, 25 bp, Rattus norvegicus
cggatcttggcatcgctgctgccca

SEQ ID NO: 579277 - DNA, 25 bp, Rattus norvegicus
gcgacgccgccgaatagtactctta

SEQ ID NO: 579278 - DNA, 25 bp, Rattus norvegicus
gccttctgagtccacatactgcagg

SEQ ID NO: 579279 - DNA, 25 bp, Rattus norvegicus
ttgatatcttgaaaagcacactcat

SEQ ID NO: 579280 - DNA, 25 bp, Rattus norvegicus
ccgttcttaaaatgttgatatcttg

SEQ ID NO: 579281 - DNA, 25 bp, Rattus norvegicus
ggaacatattgaattcacaatgata

SEQ ID NO: 579282 - DNA, 25 bp, Rattus norvegicus
tgcgaatcctattaggaacatattg

SEQ ID NO: 579283 - DNA, 25 bp, Rattus norvegicus
gaatagtactcttattacatgcgaa

SEQ ID NO: 579284 - DNA, 25 bp, Rattus norvegicus
acgccgccgaatagtactcttatta

SEQ ID NO: 579285 - DNA, 25 bp, Rattus norvegicus
cgtggacacgcgacgccgccgaata

SEQ ID NO: 579286 - DNA, 25 bp, Rattus norvegicus
agctaggccgtggacacgcgacgcc

SEQ ID NO: 579287 - DNA, 25 bp, Rattus norvegicus
catactgcaggcgtttgaggtagca

SEQ ID NO: 579288 - DNA, 25 bp, Rattus norvegicus
ccacatactgcaggcgtttgaggta

SEQ ID NO: 579289 - DNA, 25 bp, Rattus norvegicus
tgagtccacatactgcaggcgtttg

SEQ ID NO: 579290 - DNA, 25 bp, Rattus norvegicus
cgccgaatagtactcttattacatg

SEQ ID NO: 579291 - DNA, 25 bp, Rattus norvegicus
gcttcccattggtctacataaaaaa

SEQ ID NO: 579292 - DNA, 25 bp, Rattus norvegicus
tttatttttgattatgtctggacgc

SEQ ID NO: 579293 - DNA, 25 bp, Rattus norvegicus
aacccttctctgatcactttctata

SEQ ID NO: 579294 - DNA, 25 bp, Rattus norvegicus
cagccaatcccataggtgttttttc

SEQ ID NO: 579295 - DNA, 25 bp, Rattus norvegicus
ttgttggtataaacgcttcccattg

SEQ ID NO: 579296 - DNA, 25 bp, Rattus norvegicus
cgtcatataagttcttgcccaacca

SEQ ID NO: 579297 - DNA, 25 bp, Rattus norvegicus
tgattggatatttctcaaatacgtc

SEQ ID NO: 579298 - DNA, 25 bp, Rattus norvegicus
gctaagaaaacacaattctgattgg

SEQ ID NO: 579299 - DNA, 25 bp, Rattus norvegicus
ggccttattcaaatgagggctaaga

SEQ ID NO: 579300 - DNA, 25 bp, Rattus norvegicus
ctctagggcggaaactacccgctct

SEQ ID NO: 579301 - DNA, 25 bp, Rattus norvegicus
actgtagctcaggaactctagggcg

SEQ ID NO: 579302 - DNA, 25 bp, Rattus norvegicus
ctccggcatgttgagactgtagctc

SEQ ID NO: 579303 - DNA, 25 bp, Rattus norvegicus
gaacagacttggcaggctccggcat

SEQ ID NO: 579304 - DNA, 25 bp, Rattus norvegicus
actataagagacagagaacccttct

SEQ ID NO: 579305 - DNA, 25 bp, Rattus norvegicus
gggaagccagctgtttctctgtaga

SEQ ID NO: 579306 - DNA, 25 bp, Rattus norvegicus
gtagagcagcctacataataatatg

SEQ ID NO: 579307 - DNA, 25 bp, Rattus norvegicus
gcagcctacataataatatgtctgg

SEQ ID NO: 579308 - DNA, 25 bp, Rattus norvegicus
ctgtagagcagcctacataataata

SEQ ID NO: 579309 - DNA, 25 bp, Rattus norvegicus
aggcacttccgcctgacgctccctg

SEQ ID NO: 579310 - DNA, 25 bp, Rattus norvegicus
aagccagctgtttctctgtagagca

SEQ ID NO: 579311 - DNA, 25 bp, Rattus norvegicus
ccgggaagccagctgtttctctgta

SEQ ID NO: 579312 - DNA, 25 bp, Rattus norvegicus
ttcccgggaagccagctgtttctct

SEQ ID NO: 579313 - DNA, 25 bp, Rattus norvegicus
tgcttttcccgggaagccagctgtt

SEQ ID NO: 579314 - DNA, 25 bp, Rattus norvegicus
atataagacggaactgcttttcccg

SEQ ID NO: 579315 - DNA, 25 bp, Rattus norvegicus
acataataatatgtctggccgaggc

SEQ ID NO: 579316 - DNA, 25 bp, Rattus norvegicus
gttccatataagacggaactgcttt

SEQ ID NO: 579317 - DNA, 25 bp, Rattus norvegicus
cctgacgctccctgttttcactccg

SEQ ID NO: 579318 - DNA, 25 bp, Rattus norvegicus
gccagctgtttctctgtagagcagc

SEQ ID NO: 579319 - DNA, 25 bp, Rattus norvegicus
tcagaatgctaaccaatgacgggtc

SEQ ID NO: 579320 - DNA, 25 bp, Rattus norvegicus
caagttctttattatgtctggacgc

SEQ ID NO: 579321 - DNA, 25 bp, Rattus norvegicus
cttcatgtttttgtagcgagcgtta

SEQ ID NO: 579322 - DNA, 25 bp, Rattus norvegicus
agcgtgttccttcttcatgtttttg

SEQ ID NO: 579323 - DNA, 25 bp, Rattus norvegicus
actataaaaatcaagagcgtgttcc

SEQ ID NO: 579324 - DNA, 25 bp, Rattus norvegicus
atgacgggtctcctttttcgcgcct

SEQ ID NO: 579325 - DNA, 25 bp, Rattus norvegicus
aggctgagtctgcttttacccaata

SEQ ID NO: 579326 - DNA, 25 bp, Rattus norvegicus
ggtcattcagagaaaaggctgagtc

SEQ ID NO: 579327 - DNA, 25 bp, Rattus norvegicus
ctctgtatctttttagtggtcattc

SEQ ID NO: 579328 - DNA, 25 bp, Rattus norvegicus
tagagcttcgcatgcaaataagatg

SEQ ID NO: 579329 - DNA, 25 bp, Rattus norvegicus
aagccgcgggtactctttatctaga

SEQ ID NO: 579330 - DNA, 25 bp, Rattus norvegicus
caccgaacaagaaaaccaggtagtg

SEQ ID NO: 579331 - DNA, 25 bp, Rattus norvegicus
cggacttggcaggttcaggcatact

SEQ ID NO: 579332 - DNA, 25 bp, Rattus norvegicus
tcgcgccttggcttaactataaaaa

SEQ ID NO: 579333 - DNA, 25 bp, Rattus norvegicus
tctccggcctcctcaatgtgtcttc

SEQ ID NO: 579334 - DNA, 25 bp, Rattus norvegicus
cccttctagtatttggctgacgccc

SEQ ID NO: 579335 - DNA, 25 bp, Rattus norvegicus
tcactcaggccagagagggacaccg

SEQ ID NO: 579336 - DNA, 25 bp, Rattus norvegicus
tgtccacgcgtgtcactcaggccag

SEQ ID NO: 579337 - DNA, 25 bp, Rattus norvegicus
ctaccaggcgtagcccgagcgtact

SEQ ID NO: 579338 - DNA, 25 bp, Rattus norvegicus
gtggcctctgctcgtcaggcgctct

SEQ ID NO: 579339 - DNA, 25 bp, Rattus norvegicus
cctgcagggtccctaccaggcgtag

SEQ ID NO: 579340 - DNA, 25 bp, Rattus norvegicus
tcctcagaactcctcgagtgggcgg

SEQ ID NO: 579341 - DNA, 25 bp, Rattus norvegicus
gaaggtcctcagaactcctcgagtg

SEQ ID NO: 579342 - DNA, 25 bp, Rattus norvegicus
ctggacccggttgaaggtcctcaga

SEQ ID NO: 579343 - DNA, 25 bp, Rattus norvegicus
ggctcctatgctggctcgctggcga

SEQ ID NO: 579344 - DNA, 25 bp, Rattus norvegicus
tgcttcggaggctcctatgctggct

SEQ ID NO: 579345 - DNA, 25 bp, Rattus norvegicus
caatgtgtcttcctccagcccttgg

SEQ ID NO: 579346 - DNA, 25 bp, Rattus norvegicus
ccttggatctgcttcggaggctcct

SEQ ID NO: 579347 - DNA, 25 bp, Rattus norvegicus
aacggaccaaggctgcgcgtccacg

SEQ ID NO: 579348 - DNA, 25 bp, Rattus norvegicus
gcgaaccttgcttctcggtttccga

SEQ ID NO: 579349 - DNA, 25 bp, Rattus norvegicus
ttctcggtttccgaagtgcctggcg

SEQ ID NO: 579350 - DNA, 25 bp, Rattus norvegicus
tccacagcctttgcggaggtagagc

SEQ ID NO: 579351 - DNA, 25 bp, Rattus norvegicus
gcgggtccctggaccttattgaaga

SEQ ID NO: 579352 - DNA, 25 bp, Rattus norvegicus
cttattgaagaccaagcggagctgc

SEQ ID NO: 579353 - DNA, 25 bp, Rattus norvegicus
cgggatcgccgctaagcgtgcgcca

SEQ ID NO: 579354 - DNA, 25 bp, Rattus norvegicus
aagcgtgcgccagctctgcggactc

SEQ ID NO: 579355 - DNA, 25 bp, Rattus norvegicus
tgcggactcctgctccggacctggg

SEQ ID NO: 579356 - DNA, 25 bp, Rattus norvegicus
tgctccggacctggggaaaccgcaa

SEQ ID NO: 579357 - DNA, 25 bp, Rattus norvegicus
cttcgccgggctgtacaggtaagcc

SEQ ID NO: 579358 - DNA, 25 bp, Rattus norvegicus
aagccacctggacgcgcgtttaagc

SEQ ID NO: 579359 - DNA, 25 bp, Rattus norvegicus
gccagaggctaacggaccaaggctg

SEQ ID NO: 579360 - DNA, 25 bp, Rattus norvegicus
gacgcgcgtttaagccagaggctaa

SEQ ID NO: 579361 - DNA, 25 bp, Rattus norvegicus
gaatccaagcatccgctgctcgagc

SEQ ID NO: 579362 - DNA, 25 bp, Rattus norvegicus
acgttagcccgctctgggatatgcg

SEQ ID NO: 579363 - DNA, 25 bp, Rattus norvegicus
gcgggatcccagtttggtggcctcc

SEQ ID NO: 579364 - DNA, 25 bp, Rattus norvegicus
ggtgacacgcggacctcagcaacca

SEQ ID NO: 579365 - DNA, 25 bp, Rattus norvegicus
gagagttggtgacacgcggacctca

SEQ ID NO: 579366 - DNA, 25 bp, Rattus norvegicus
acggttgggccacgagcgccagaaa

SEQ ID NO: 579367 - DNA, 25 bp, Rattus norvegicus
agcaaccacgttagcccgctctggg

SEQ ID NO: 579368 - DNA, 25 bp, Rattus norvegicus
acttctgatgtttcggacctcggcg

SEQ ID NO: 579369 - DNA, 25 bp, Rattus norvegicus
cccttttcaacttctgatgtttcgg

SEQ ID NO: 579370 - DNA, 25 bp, Rattus norvegicus
cgaggaccctgctttgcccaggtag

SEQ ID NO: 579371 - DNA, 25 bp, Rattus norvegicus
tcgcaggcttctcccgtgggtctgc

SEQ ID NO: 579372 - DNA, 25 bp, Rattus norvegicus
tgctgcacacggtgaacctggtaga

SEQ ID NO: 579373 - DNA, 25 bp, Rattus norvegicus
cggtggacatgctgcacacggtgaa

SEQ ID NO: 579374 - DNA, 25 bp, Rattus norvegicus
agcgccagaaaagcgcgagggaaca

SEQ ID NO: 579375 - DNA, 25 bp, Rattus norvegicus
gcaggccgcattacgagatcccgca

SEQ ID NO: 579376 - DNA, 25 bp, Rattus norvegicus
gcaaggtgacgtcacactcccaagg

SEQ ID NO: 579377 - DNA, 25 bp, Rattus norvegicus
ccagacgcaccagttgcggggcaca

SEQ ID NO: 579378 - DNA, 25 bp, Rattus norvegicus
gacgcaccagttgcggggcacacca

SEQ ID NO: 579379 - DNA, 25 bp, Rattus norvegicus
cagttgcggggcacaccagaaaggc

SEQ ID NO: 579380 - DNA, 25 bp, Rattus norvegicus
ggcacaccagaaaggcgggctaccc

SEQ ID NO: 579381 - DNA, 25 bp, Rattus norvegicus
ccgcattcagctagcccggcccaga

SEQ ID NO: 579382 - DNA, 25 bp, Rattus norvegicus
ttcagctagcccggcccagaacaaa

SEQ ID NO: 579383 - DNA, 25 bp, Rattus norvegicus
cccttctccgactccctggcttcct

SEQ ID NO: 579384 - DNA, 25 bp, Rattus norvegicus
cttcctcccgcgcaggccgcattac

SEQ ID NO: 579385 - DNA, 25 bp, Rattus norvegicus
ggccgcattacgagatcccgcaagg

SEQ ID NO: 579386 - DNA, 25 bp, Rattus norvegicus
cgagatcccgcaaggtgacgtcaca

SEQ ID NO: 579387 - DNA, 25 bp, Rattus norvegicus
cgcattacgagatcccgcaaggtga

SEQ ID NO: 579388 - DNA, 25 bp, Rattus norvegicus
gatcccgcaaggtgacgtcacactc

SEQ ID NO: 579389 - DNA, 25 bp, Rattus norvegicus
ttgaaaggcaaggagcgggaacgta

SEQ ID NO: 579390 - DNA, 25 bp, Rattus norvegicus
gcagtggaaatacccaccttgaaag

SEQ ID NO: 579391 - DNA, 25 bp, Rattus norvegicus
tgggaatgcagtggaaatacccacc

SEQ ID NO: 579392 - DNA, 25 bp, Rattus norvegicus
ctcctgggaatgcagtggaaatacc

SEQ ID NO: 579393 - DNA, 25 bp, Rattus norvegicus
agacctcctgggaatgcagtggaaa

SEQ ID NO: 579394 - DNA, 25 bp, Rattus norvegicus
aggaagacctcctgggaatgcagtg

SEQ ID NO: 579395 - DNA, 25 bp, Rattus norvegicus
gcgcaaggaagacctcctgggaatg

SEQ ID NO: 579396 - DNA, 25 bp, Rattus norvegicus
gacgaggcgcaaggaagacctcctg

SEQ ID NO: 579397 - DNA, 25 bp, Rattus norvegicus
ttcacctgcggatccttggcgctgt

SEQ ID NO: 579398 - DNA, 25 bp, Rattus norvegicus
ggccgggctgccttcacctgcggat

SEQ ID NO: 579399 - DNA, 25 bp, Rattus norvegicus
gcagcgctttgaacttgcgcgcagc

SEQ ID NO: 579400 - DNA, 25 bp, Rattus norvegicus
gagcaggcagcgctttgaacttgcg

SEQ ID NO: 579401 - DNA, 25 bp, Rattus norvegicus
caggaaggtgttgaggctcgctccc

SEQ ID NO: 579402 - DNA, 25 bp, Rattus norvegicus
aaggagcgggaacgtagccctgagc

SEQ ID NO: 579403 - DNA, 25 bp, Rattus norvegicus
ttgggtcaagcacgccaagagcgcc

SEQ ID NO: 579404 - DNA, 25 bp, Rattus norvegicus
tcaattggtccatccgatgggaggc

SEQ ID NO: 579405 - DNA, 25 bp, Rattus norvegicus
ttccaactcgcgcttcaattggtcc

SEQ ID NO: 579406 - DNA, 25 bp, Rattus norvegicus
cagtttgaattccaactcgcgcttc

SEQ ID NO: 579407 - DNA, 25 bp, Rattus norvegicus
cggcgcaccgcagtttgaattccaa

SEQ ID NO: 579408 - DNA, 25 bp, Rattus norvegicus
gacatctttggcaacgacacactcg

SEQ ID NO: 579409 - DNA, 25 bp, Rattus norvegicus
cccgagttcgcccaagacatctttg

SEQ ID NO: 579410 - DNA, 25 bp, Rattus norvegicus
acgccgggcccagtgaagcacaagt

SEQ ID NO: 579411 - DNA, 25 bp, Rattus norvegicus
gtcgctttgggtcaagcacgccaag

SEQ ID NO: 579412 - DNA, 25 bp, Rattus norvegicus
caagactacgccaccaacgacccgg

SEQ ID NO: 579413 - DNA, 25 bp, Rattus norvegicus
cgcagctaaaactcacccaagacta

SEQ ID NO: 579414 - DNA, 25 bp, Rattus norvegicus
acgacacactcgcagctaaaactca

SEQ ID NO: 579415 - DNA, 25 bp, Rattus norvegicus
tttggcaacgacacactcgcagcta

SEQ ID NO: 579416 - DNA, 25 bp, Rattus norvegicus
agtgaagcacaagtcccgaccctgc

SEQ ID NO: 579417 - DNA, 25 bp, Rattus norvegicus
tgcacccgttgaaccttggcgtttc

SEQ ID NO: 579418 - DNA, 25 bp, Rattus norvegicus
caaaagtcagtttagcttcgcaggc

SEQ ID NO: 579419 - DNA, 25 bp, Rattus norvegicus
cttggtctccagatttggcggcgct

SEQ ID NO: 579420 - DNA, 25 bp, Rattus norvegicus
ctgtgtgcgccaaggaccagatgcg

SEQ ID NO: 579421 - DNA, 25 bp, Rattus norvegicus
agcagtagctgtgtgcgccaaggac

SEQ ID NO: 579422 - DNA, 25 bp, Rattus norvegicus
ctcagtctggctcagagcggtggct

SEQ ID NO: 579423 - DNA, 25 bp, Rattus norvegicus
caggagggaaactcagtctggctca

SEQ ID NO: 579424 - DNA, 25 bp, Rattus norvegicus
tttagcttcgcaggcttgtgggccg

SEQ ID NO: 579425 - DNA, 25 bp, Rattus norvegicus
aaccttggcgtttcagcatgcagga

SEQ ID NO: 579426 - DNA, 25 bp, Rattus norvegicus
ctccggccggagcaaaagtcagttt

SEQ ID NO: 579427 - DNA, 25 bp, Rattus norvegicus
accgcggatgcacccgttgaacctt

SEQ ID NO: 579428 - DNA, 25 bp, Rattus norvegicus
gacgcaggcgtcaccgcggatgcac

SEQ ID NO: 579429 - DNA, 25 bp, Rattus norvegicus
cagcatgcaggagggaaactcagtc

SEQ ID NO: 579430 - DNA, 25 bp, Rattus norvegicus
ccagatgcggggcttggtctccaga

SEQ ID NO: 579431 - DNA, 25 bp, Rattus norvegicus
ggttcgaaatcgtccgctgtcaatc

SEQ ID NO: 579432 - DNA, 25 bp, Rattus norvegicus
ccctgaggacgtgtttctgcgcaga

SEQ ID NO: 579433 - DNA, 25 bp, Rattus norvegicus
gctcggagctcatacctttgtggga

SEQ ID NO: 579434 - DNA, 25 bp, Rattus norvegicus
gagcctataaatcccgcgagaatga

SEQ ID NO: 579435 - DNA, 25 bp, Rattus norvegicus
cctccctccagatatcgcgagaaga

SEQ ID NO: 579436 - DNA, 25 bp, Rattus norvegicus
agacggtctatcctttcaacgagcg

SEQ ID NO: 579437 - DNA, 25 bp, Rattus norvegicus
agcgacttcctctccgggcgagatt

SEQ ID NO: 579438 - DNA, 25 bp, Rattus norvegicus
tggcctggcgcagtcctctaaaatc

SEQ ID NO: 579439 - DNA, 25 bp, Rattus norvegicus
agtcgctgacatcgaacctcttctg

SEQ ID NO: 579440 - DNA, 25 bp, Rattus norvegicus
acgacctcaggcgtgtgacatcctc

SEQ ID NO: 579441 - DNA, 25 bp, Rattus norvegicus
ctcccaggaccgtaaaggacagtgt

SEQ ID NO: 579442 - DNA, 25 bp, Rattus norvegicus
acagtgtgagtcctggctttgtcgc

SEQ ID NO: 579443 - DNA, 25 bp, Rattus norvegicus
gctttgtcgccaaggagcgtcagga

SEQ ID NO: 579444 - DNA, 25 bp, Rattus norvegicus
tcgtgggtttgcctagtttatcgta

SEQ ID NO: 579445 - DNA, 25 bp, Rattus norvegicus
ctcaggcatgttgtcactgggactc

SEQ ID NO: 579446 - DNA, 25 bp, Rattus norvegicus
cacgtccagcactccaaattggcta

SEQ ID NO: 579447 - DNA, 25 bp, Rattus norvegicus
agcactccaaattggctacatggga

SEQ ID NO: 579448 - DNA, 25 bp, Rattus norvegicus
ggaggatgcatatgcaacagccttt

SEQ ID NO: 579449 - DNA, 25 bp, Rattus norvegicus
gcagttccgaactctagatctctag

SEQ ID NO: 579450 - DNA, 25 bp, Rattus norvegicus
ttccactgaaagtataggtggctct

SEQ ID NO: 579451 - DNA, 25 bp, Rattus norvegicus
tgggactcttgacctgcagttccga

SEQ ID NO: 579452 - DNA, 25 bp, Rattus norvegicus
gcaacagccttttccactgaaagta

SEQ ID NO: 579453 - DNA, 25 bp, Rattus norvegicus
tagcactgaagccacaggtcctgtc

SEQ ID NO: 579454 - DNA, 25 bp, Rattus norvegicus
gaagccacaggtcctgtctatttta

SEQ ID NO: 579455 - DNA, 25 bp, Rattus norvegicus
aacgcacacttatgattggtttatg

SEQ ID NO: 579456 - DNA, 25 bp, Rattus norvegicus
ttatgagtactcattcaaatgaggc

SEQ ID NO: 579457 - DNA, 25 bp, Rattus norvegicus
gaggcatagaaacgcacacttatga

SEQ ID NO: 579458 - DNA, 25 bp, Rattus norvegicus
ctagatctctagcactgaagccaca

SEQ ID NO: 579459 - DNA, 25 bp, Rattus norvegicus
cacaagtatataaaggcccttttca

SEQ ID NO: 579460 - DNA, 25 bp, Rattus norvegicus
ggttgatggcatccacaccttcaca

SEQ ID NO: 579461 - DNA, 25 bp, Rattus norvegicus
gccatggatgttgtctatgcgctta

SEQ ID NO: 579462 - DNA, 25 bp, Rattus norvegicus
gcagaacgtgttttgtgtcatcatg

SEQ ID NO: 579463 - DNA, 25 bp, Rattus norvegicus
agttggaatttgcacatttgtcatg

SEQ ID NO: 579464 - DNA, 25 bp, Rattus norvegicus
ctgtttctctttagagcagaacgtg

SEQ ID NO: 579465 - DNA, 25 bp, Rattus norvegicus
gcttcttggagacgctatctgtttc

SEQ ID NO: 579466 - DNA, 25 bp, Rattus norvegicus
ccctataagagggaactgcttcttg

SEQ ID NO: 579467 - DNA, 25 bp, Rattus norvegicus
catttgtcatgttagcagtctggga

SEQ ID NO: 579468 - DNA, 25 bp, Rattus norvegicus
ctgtaccgttattgctatagttgga

SEQ ID NO: 579469 - DNA, 25 bp, Rattus norvegicus
tttcactgcgctcctgttttcactc

SEQ ID NO: 579470 - DNA, 25 bp, Rattus norvegicus
gttttgtgtcatcatgtctggccga

SEQ ID NO: 579471 - DNA, 25 bp, Rattus norvegicus
gtctgggaattactgattgtgtata

SEQ ID NO: 579472 - DNA, 25 bp, Rattus norvegicus
ttctaaagggctgtaccgttattgc

SEQ ID NO: 579473 - DNA, 25 bp, Rattus norvegicus
cacaaaacatgtagtggccctgaaa

SEQ ID NO: 579474 - DNA, 25 bp, Rattus norvegicus
tggaaaagcagttcccacttatagg

SEQ ID NO: 579475 - DNA, 25 bp, Rattus norvegicus
agcagatgacctctctggaaaagca

SEQ ID NO: 579476 - DNA, 25 bp, Rattus norvegicus
gtcctacaaaggagcagatgacctc

SEQ ID NO: 579477 - DNA, 25 bp, Rattus norvegicus
ccacgtccagacatgatgtcctaca

SEQ ID NO: 579478 - DNA, 25 bp, Rattus norvegicus
aattgagcagcttagccgccgaagc

SEQ ID NO: 579479 - DNA, 25 bp, Rattus norvegicus
ccggatgtttatgtaattgagcagc

SEQ ID NO: 579480 - DNA, 25 bp, Rattus norvegicus
agcgttacctccttcacaaaacatg

SEQ ID NO: 579481 - DNA, 25 bp, Rattus norvegicus
gtaaaatctgaacaagcgttacctc

SEQ ID NO: 579482 - DNA, 25 bp, Rattus norvegicus
tgtacattctgatgagtaaaatctg

SEQ ID NO: 579483 - DNA, 25 bp, Rattus norvegicus
tgactagttctgttaaagttaaatg

SEQ ID NO: 579484 - DNA, 25 bp, Rattus norvegicus
atcagtactgtgactagttctgtta

SEQ ID NO: 579485 - DNA, 25 bp, Rattus norvegicus
tgaaaaggacctttaaggatgatcc

SEQ ID NO: 579486 - DNA, 25 bp, Rattus norvegicus
cctttaaggatgatccggatgttta

SEQ ID NO: 579487 - DNA, 25 bp, Rattus norvegicus
gctgctccgcattgagcggcgaaga

SEQ ID NO: 579488 - DNA, 25 bp, Rattus norvegicus
tggtccatccaagccggggacgcac

SEQ ID NO: 579489 - DNA, 25 bp, Rattus norvegicus
atctatggtccatccaagccgggga

SEQ ID NO: 579490 - DNA, 25 bp, Rattus norvegicus
ggccggaagacatctatggtccatc

SEQ ID NO: 579491 - DNA, 25 bp, Rattus norvegicus
aggcctaggccggaagacatctatg

SEQ ID NO: 579492 - DNA, 25 bp, Rattus norvegicus
gagccaacctaaggcctaggccgga

SEQ ID NO: 579493 - DNA, 25 bp, Rattus norvegicus
aggctccgagccaacctaaggccta

SEQ ID NO: 579494 - DNA, 25 bp, Rattus norvegicus
gagtccgcgtgctcaggctccgagc

SEQ ID NO: 579495 - DNA, 25 bp, Rattus norvegicus
gcgagcctgagcaacacttcggcct

SEQ ID NO: 579496 - DNA, 25 bp, Rattus norvegicus
cgtggcctgctcattctgctccacc

SEQ ID NO: 579497 - DNA, 25 bp, Rattus norvegicus
acttcggcctttttcttctggctgc

SEQ ID NO: 579498 - DNA, 25 bp, Rattus norvegicus
cctgagcaacacttcggcctttttc

SEQ ID NO: 579499 - DNA, 25 bp, Rattus norvegicus
ggcctgccaggagtccgcgtgctca

SEQ ID NO: 579500 - DNA, 25 bp, Rattus norvegicus
ttttcttctggctgctccgcattga

SEQ ID NO: 579501 - DNA, 25 bp, Rattus norvegicus
ggtgcgagtttttatgccctatttg

SEQ ID NO: 579502 - DNA, 25 bp, Rattus norvegicus
tgccctatttgaatgagaactcata

SEQ ID NO: 579503 - DNA, 25 bp, Rattus norvegicus
ttccagagcgcgtttcgattgggca

SEQ ID NO: 579504 - DNA, 25 bp, Rattus norvegicus
ttaacatgcctgaaactgcgaagtc

SEQ ID NO: 579505 - DNA, 25 bp, Rattus norvegicus
tgcaattggctgatatcttcttttc

SEQ ID NO: 579506 - DNA, 25 bp, Rattus norvegicus
gtctatgggcgcgaaaacgagccta

SEQ ID NO: 579507 - DNA, 25 bp, Rattus norvegicus
caagagcttggttcttatagttgtc

SEQ ID NO: 579508 - DNA, 25 bp, Rattus norvegicus
tgtcacaactacaacgcgaaaaaga

SEQ ID NO: 579509 - DNA, 25 bp, Rattus norvegicus
tccagacatgacaaacagcaagttg

SEQ ID NO: 579510 - DNA, 25 bp, Rattus norvegicus
ccagctcgggaagagcgcgtcttcg

SEQ ID NO: 579511 - DNA, 25 bp, Rattus norvegicus
cagggtcctggttgctagaatcata

SEQ ID NO: 579512 - DNA, 25 bp, Rattus norvegicus
tcatagtgttccagtcttaacatgc

SEQ ID NO: 579513 - DNA, 25 bp, Rattus norvegicus
ctcataaaaaatagacgggcccagg

SEQ ID NO: 579514 - DNA, 25 bp, Rattus norvegicus
cttcttttcttctaggccaatagga

SEQ ID NO: 579515 - DNA, 25 bp, Rattus norvegicus
aagcaagcccatttctaattggtta

SEQ ID NO: 579516 - DNA, 25 bp, Rattus norvegicus
agctcctcacacttcagcataagtg

SEQ ID NO: 579517 - DNA, 25 bp, Rattus norvegicus
tcgcgaccagagaatcctataaaaa

SEQ ID NO: 579518 - DNA, 25 bp, Rattus norvegicus
gtgtcataacttgagtatctttcgg

SEQ ID NO: 579519 - DNA, 25 bp, Rattus norvegicus
tatctttcggaatgtctggacgtgg

SEQ ID NO: 579520 - DNA, 25 bp, Rattus norvegicus
ttgcccaccgcaaaaacggttctca

SEQ ID NO: 579521 - DNA, 25 bp, Rattus norvegicus
gaagaaaccagccaatcgcataggc

SEQ ID NO: 579522 - DNA, 25 bp, Rattus norvegicus
ggcgttattcaaatgaggcttaagc

SEQ ID NO: 579523 - DNA, 25 bp, Rattus norvegicus
caacaacttaggcagtgactctttg

SEQ ID NO: 579524 - DNA, 25 bp, Rattus norvegicus
ggaagtctaacgctcaacaacttag

SEQ ID NO: 579525 - DNA, 25 bp, Rattus norvegicus
caggcatttttagataggaagtcta

SEQ ID NO: 579526 - DNA, 25 bp, Rattus norvegicus
cggacttaaccggatcaggcatttt

SEQ ID NO: 579527 - DNA, 25 bp, Rattus norvegicus
gcataggctctttttcgcgaccaga

SEQ ID NO: 579528 - DNA, 25 bp, Rattus norvegicus
acggttctcattggtctagaataaa

SEQ ID NO: 579529 - DNA, 25 bp, Rattus norvegicus
ccagcgtttggtgcgtgagattgct

SEQ ID NO: 579530 - DNA, 25 bp, Rattus norvegicus
caggaagcgagtgaggcctaccttg

SEQ ID NO: 579531 - DNA, 25 bp, Rattus norvegicus
cattgccctgcaggaagcgagtgag

SEQ ID NO: 579532 - DNA, 25 bp, Rattus norvegicus
tcattgccctgcaggaagcgagtga

SEQ ID NO: 579533 - DNA, 25 bp, Rattus norvegicus
cgtcattgccctgcaggaagcgagt

SEQ ID NO: 579534 - DNA, 25 bp, Rattus norvegicus
gccgtcattgccctgcaggaagcga

SEQ ID NO: 579535 - DNA, 25 bp, Rattus norvegicus
tcggccgtcattgccctgcaggaag

SEQ ID NO: 579536 - DNA, 25 bp, Rattus norvegicus
cctgcaggaagcgagtgaggcctac

SEQ ID NO: 579537 - DNA, 25 bp, Rattus norvegicus
agcgtttggtgcgtgagattgctca

SEQ ID NO: 579538 - DNA, 25 bp, Rattus norvegicus
gcctttccagcgtttggtgcgtgag

SEQ ID NO: 579539 - DNA, 25 bp, Rattus norvegicus
tgcctttccagcgtttggtgcgtga

SEQ ID NO: 579540 - DNA, 25 bp, Rattus norvegicus
gttgcctttccagcgtttggtgcgt

SEQ ID NO: 579541 - DNA, 25 bp, Rattus norvegicus
tccggcaaccggtggcgtgaagaaa

SEQ ID NO: 579542 - DNA, 25 bp, Rattus norvegicus
ttggtgcgtgagattgctcaggact

SEQ ID NO: 579543 - DNA, 25 bp, Rattus norvegicus
ccttgatttaaacgcgcaccaatcc

SEQ ID NO: 579544 - DNA, 25 bp, Rattus norvegicus
tctcaacgttctcaaatggcccgta

SEQ ID NO: 579545 - DNA, 25 bp, Rattus norvegicus
ctacattcctctcaacgttctcaaa

SEQ ID NO: 579546 - DNA, 25 bp, Rattus norvegicus
ttttctctgcacacacctcattcta

SEQ ID NO: 579547 - DNA, 25 bp, Rattus norvegicus
tacttgaattttctctgcacacacc

SEQ ID NO: 579548 - DNA, 25 bp, Rattus norvegicus
atccaagaaggtggcttgttatata

SEQ ID NO: 579549 - DNA, 25 bp, Rattus norvegicus
ccgtccaatccaagaaggtggcttg

SEQ ID NO: 579550 - DNA, 25 bp, Rattus norvegicus
ttaccgtccaatccaagaaggtggc

SEQ ID NO: 579551 - DNA, 25 bp, Rattus norvegicus
gacatcatcaacttaccgtccaatc

SEQ ID NO: 579552 - DNA, 25 bp, Rattus norvegicus
ccctgtttggaacatgacatcatca

SEQ ID NO: 579553 - DNA, 25 bp, Rattus norvegicus
tcattccttgatttaaacgcgcacc

SEQ ID NO: 579554 - DNA, 25 bp, Rattus norvegicus
acgttctcaaatggcccgtactaag

SEQ ID NO: 579555 - DNA, 25 bp, Rattus norvegicus
tcaaatggcccgtactaagcagacc

SEQ ID NO: 579556 - DNA, 25 bp, Rattus norvegicus
ggaacatgacatcatcaacttaccg

SEQ ID NO: 579557 - DNA, 25 bp, Rattus norvegicus
ttccttgcgcggagctcaaaactgc

SEQ ID NO: 579558 - DNA, 25 bp, Rattus norvegicus
ttctgcgtttgagcagatgaactgg

SEQ ID NO: 579559 - DNA, 25 bp, Rattus norvegicus
taagttggggttctgcgtttgagca

SEQ ID NO: 579560 - DNA, 25 bp, Rattus norvegicus
tcgcttcgtttctggcggatggttt

SEQ ID NO: 579561 - DNA, 25 bp, Rattus norvegicus
aagtaaacattgtcgggtcgcttcg

SEQ ID NO: 579562 - DNA, 25 bp, Rattus norvegicus
tatcgctgcactgccagaaagaggc

SEQ ID NO: 579563 - DNA, 25 bp, Rattus norvegicus
tcccggaagttatcgctgcactgcc

SEQ ID NO: 579564 - DNA, 25 bp, Rattus norvegicus
aggcgtcgatctcccggaagttatc

SEQ ID NO: 579565 - DNA, 25 bp, Rattus norvegicus
aaaaaagccaagcaagtgcgcaggc

SEQ ID NO: 579566 - DNA, 25 bp, Rattus norvegicus
gcggaccgcctctctgggtcaaaaa

SEQ ID NO: 579567 - DNA, 25 bp, Rattus norvegicus
aggtgtacaacttgcgcggaccgcc

SEQ ID NO: 579568 - DNA, 25 bp, Rattus norvegicus
tgccatcacttctccgcaaggtgta

SEQ ID NO: 579569 - DNA, 25 bp, Rattus norvegicus
ccctacagtgggtcctcgtggtgat

SEQ ID NO: 579570 - DNA, 25 bp, Rattus norvegicus
ggagctcaaaactgcactgccatca

SEQ ID NO: 579571 - DNA, 25 bp, Rattus norvegicus
cggtttctgcacaggctgactttta

SEQ ID NO: 579572 - DNA, 25 bp, Rattus norvegicus
tttcgtttctttgctatgtctggac

SEQ ID NO: 579573 - DNA, 25 bp, Rattus norvegicus
tttctttgctatgtctggacgtggg

SEQ ID NO: 579574 - DNA, 25 bp, Rattus norvegicus
gcggtatcttctctcagtgagtaga

SEQ ID NO: 579575 - DNA, 25 bp, Rattus norvegicus
gcatagcggtatcttctctcagtga

SEQ ID NO: 579576 - DNA, 25 bp, Rattus norvegicus
agtgccacagcatagcggtatcttc

SEQ ID NO: 579577 - DNA, 25 bp, Rattus norvegicus
cgttgcgtataagtgccacagcata

SEQ ID NO: 579578 - DNA, 25 bp, Rattus norvegicus
cacgccctgcgttgcgtataagtgc

SEQ ID NO: 579579 - DNA, 25 bp, Rattus norvegicus
gaccgaacaactgtacggtttctgc

SEQ ID NO: 579580 - DNA, 25 bp, Rattus norvegicus
tcaggcatagcgaaaatgaaacacc

SEQ ID NO: 579581 - DNA, 25 bp, Rattus norvegicus
gcgggctcaggcatagcgaaaatga

SEQ ID NO: 579582 - DNA, 25 bp, Rattus norvegicus
acttcgcgggctcaggcatagcgaa

SEQ ID NO: 579583 - DNA, 25 bp, Rattus norvegicus
ccctgcgttgcgtataagtgccaca

SEQ ID NO: 579584 - DNA, 25 bp, Rattus norvegicus
tctcagtgagtagattctagttttc

SEQ ID NO: 579585 - DNA, 25 bp, Rattus norvegicus
cggtgttagcatagctgctctgggc

SEQ ID NO: 579586 - DNA, 25 bp, Rattus norvegicus
cagagtgcagtcatgtctggccgag

SEQ ID NO: 579587 - DNA, 25 bp, Rattus norvegicus
ccttgcaggttctcatttcggtccg

SEQ ID NO: 579588 - DNA, 25 bp, Rattus norvegicus
tgcaggttctcatttcggtccgccc

SEQ ID NO: 579589 - DNA, 25 bp, Rattus norvegicus
cctgccgtataaaagcgggcgccca

SEQ ID NO: 579590 - DNA, 25 bp, Rattus norvegicus
tgccgtataaaagcgggcgcccagg

SEQ ID NO: 579591 - DNA, 25 bp, Rattus norvegicus
ggcgcccaggctcggtgttagcata

SEQ ID NO: 579592 - DNA, 25 bp, Rattus norvegicus
gcccaggctcggtgttagcatagct

SEQ ID NO: 579593 - DNA, 25 bp, Rattus norvegicus
tcagagtgcagtcatgtctggccga

SEQ ID NO: 579594 - DNA, 25 bp, Rattus norvegicus
gctcggtgttagcatagctgctctg

SEQ ID NO: 579595 - DNA, 25 bp, Rattus norvegicus
gtgttagcatagctgctctgggctc

SEQ ID NO: 579596 - DNA, 25 bp, Rattus norvegicus
cctccttgcaggttctcatttcggt

SEQ ID NO: 579597 - DNA, 25 bp, Rattus norvegicus
gcctcctccttgcaggttctcattt

SEQ ID NO: 579598 - DNA, 25 bp, Rattus norvegicus
ccaggctcggtgttagcatagctgc

SEQ ID NO: 579599 - DNA, 25 bp, Rattus norvegicus
ggccagagctcgctagggctcgcca

SEQ ID NO: 579600 - DNA, 25 bp, Rattus norvegicus
ccggggaccccccgcactgcagccg

SEQ ID NO: 579601 - DNA, 25 bp, Rattus norvegicus
cggggaccccccgcactgcagccgc

SEQ ID NO: 579602 - DNA, 25 bp, Rattus norvegicus
ggggaccccccgcactgcagccgcg

SEQ ID NO: 579603 - DNA, 25 bp, Rattus norvegicus
gccagagctcgctagggctcgccag

SEQ ID NO: 579604 - DNA, 25 bp, Rattus norvegicus
ccagagctcgctagggctcgccagg

SEQ ID NO: 579605 - DNA, 25 bp, Rattus norvegicus
gggaccccccgcactgcagccgcgg

SEQ ID NO: 579606 - DNA, 25 bp, Rattus norvegicus
ggaccccccgcactgcagccgcggg

SEQ ID NO: 579607 - DNA, 25 bp, Rattus norvegicus
gaccccccgcactgcagccgcgggg

SEQ ID NO: 579608 - DNA, 25 bp, Rattus norvegicus
accccccgcactgcagccgcggggg

SEQ ID NO: 579609 - DNA, 25 bp, Rattus norvegicus
cccccgcactgcagccgcggggggc

SEQ ID NO: 579610 - DNA, 25 bp, Rattus norvegicus
ggcgctcagggggcggccagagctc

SEQ ID NO: 579611 - DNA, 25 bp, Rattus norvegicus
gcgctcagggggcggccagagctcg

SEQ ID NO: 579612 - DNA, 25 bp, Rattus norvegicus
cgctcagggggcggccagagctcgc

SEQ ID NO: 579613 - DNA, 25 bp, Rattus norvegicus
gtgaccctgacaggtcctgcctatg

SEQ ID NO: 579614 - DNA, 25 bp, Rattus norvegicus
gatagcacgttcctccagtttactt

SEQ ID NO: 579615 - DNA, 25 bp, Rattus norvegicus
cgtcacgtgaccctgacaggtcctg

SEQ ID NO: 579616 - DNA, 25 bp, Rattus norvegicus
caggtcctgcctatggcgcggcaga

SEQ ID NO: 579617 - DNA, 25 bp, Rattus norvegicus
ggcagaccacccacgccgagggcca

SEQ ID NO: 579618 - DNA, 25 bp, Rattus norvegicus
ccgagggccatggacctgcttaata

SEQ ID NO: 579619 - DNA, 25 bp, Rattus norvegicus
gccatggacctgcttaatagaaaca

SEQ ID NO: 579620 - DNA, 25 bp, Rattus norvegicus
gtaattgtgagtccgcgccgcactc

SEQ ID NO: 579621 - DNA, 25 bp, Rattus norvegicus
cctgcttaatagaaacaggcttgta

SEQ ID NO: 579622 - DNA, 25 bp, Rattus norvegicus
gcgctgatagcacgttcctccagtt

SEQ ID NO: 579623 - DNA, 25 bp, Rattus norvegicus
taaagttttcggatccgtcacgtga

SEQ ID NO: 579624 - DNA, 25 bp, Rattus norvegicus
caggcttgtaattgtgagtccgcgc

SEQ ID NO: 579625 - DNA, 25 bp, Rattus norvegicus
ctccagtttactttgccttccttgg

SEQ ID NO: 579626 - DNA, 25 bp, Rattus norvegicus
agggctgcgctgatagcacgttcct

SEQ ID NO: 579627 - DNA, 25 bp, Rattus norvegicus
gagcccagagcagctatgctaacac

SEQ ID NO: 579628 - DNA, 25 bp, Rattus norvegicus
tgggcgcccgcttttatacggcagg

SEQ ID NO: 579629 - DNA, 25 bp, Rattus norvegicus
cctgggcgcccgcttttatacggca

SEQ ID NO: 579630 - DNA, 25 bp, Rattus norvegicus
tatgctaacaccgagcctgggcgcc

SEQ ID NO: 579631 - DNA, 25 bp, Rattus norvegicus
agctatgctaacaccgagcctgggc

SEQ ID NO: 579632 - DNA, 25 bp, Rattus norvegicus
agcagctatgctaacaccgagcctg

SEQ ID NO: 579633 - DNA, 25 bp, Rattus norvegicus
cggaccgaaatgagaacctgcaagg

SEQ ID NO: 579634 - DNA, 25 bp, Rattus norvegicus
gcccagagcagctatgctaacaccg

SEQ ID NO: 579635 - DNA, 25 bp, Rattus norvegicus
gggcggaccgaaatgagaacctgca

SEQ ID NO: 579636 - DNA, 25 bp, Rattus norvegicus
tcggccagacatgactgcactctga

SEQ ID NO: 579637 - DNA, 25 bp, Rattus norvegicus
ccgaaatgagaacctgcaaggagga

SEQ ID NO: 579638 - DNA, 25 bp, Rattus norvegicus
aaatgagaacctgcaaggaggaggc

SEQ ID NO: 579639 - DNA, 25 bp, Rattus norvegicus
ctcggccagacatgactgcactctg

SEQ ID NO: 579640 - DNA, 25 bp, Rattus norvegicus
cagagcagctatgctaacaccgagc

SEQ ID NO: 579641 - DNA, 25 bp, Rattus norvegicus
ggcatgttatattccggtacctagt

SEQ ID NO: 579642 - DNA, 25 bp, Rattus norvegicus
ggacgcctgcttattggtaagttta

SEQ ID NO: 579643 - DNA, 25 bp, Rattus norvegicus
atccagtggaaaggaggacgcctgc

SEQ ID NO: 579644 - DNA, 25 bp, Rattus norvegicus
cacgctcttatgcaaatccagtgga

SEQ ID NO: 579645 - DNA, 25 bp, Rattus norvegicus
tgaaggccttatagacacgctctta

SEQ ID NO: 579646 - DNA, 25 bp, Rattus norvegicus
tccggtacctagtgataacaaaata

SEQ ID NO: 579647 - DNA, 25 bp, Rattus norvegicus
acttcgtaggctcaggcatgttata

SEQ ID NO: 579648 - DNA, 25 bp, Rattus norvegicus
ggagagaaatctgcgcgctcacttg

SEQ ID NO: 579649 - DNA, 25 bp, Rattus norvegicus
agcctttgggttgggagagaaatct

SEQ ID NO: 579650 - DNA, 25 bp, Rattus norvegicus
ggaacatacagtacgagccctttta

SEQ ID NO: 579651 - DNA, 25 bp, Rattus norvegicus
tggaagtttctcttttacttgtgga

SEQ ID NO: 579652 - DNA, 25 bp, Rattus norvegicus
aggccggagatgttctggaagtttc

SEQ ID NO: 579653 - DNA, 25 bp, Rattus norvegicus
cttaaaatgctaatgaggccggaga

SEQ ID NO: 579654 - DNA, 25 bp, Rattus norvegicus
tctgactgtaggacgggaagtaagt

SEQ ID NO: 579655 - DNA, 25 bp, Rattus norvegicus
tctgattggtcaaaatagctgcagg

SEQ ID NO: 579656 - DNA, 25 bp, Rattus norvegicus
cataattggctggtgagttcttttg

SEQ ID NO: 579657 - DNA, 25 bp, Rattus norvegicus
ggccacatttatacaggcggctgga

SEQ ID NO: 579658 - DNA, 25 bp, Rattus norvegicus
tggctggtgagttcttttgttttct

SEQ ID NO: 579659 - DNA, 25 bp, Rattus norvegicus
aacttatgctctctcccctcgaatg

SEQ ID NO: 579660 - DNA, 25 bp, Rattus norvegicus
gctgcaggaacaacataattggctg

SEQ ID NO: 579661 - DNA, 25 bp, Rattus norvegicus
tggtcaaaatagctgcaggaacaac

SEQ ID NO: 579662 - DNA, 25 bp, Rattus norvegicus
ggcggctggattctgattggtcaaa

SEQ ID NO: 579663 - DNA, 25 bp, Rattus norvegicus
agcttcacggccacatttatacagg

SEQ ID NO: 579664 - DNA, 25 bp, Rattus norvegicus
agaaaaagcttcacggccacattta

SEQ ID NO: 579665 - DNA, 25 bp, Rattus norvegicus
gtcttgacctcccaaaggaaagtga

SEQ ID NO: 579666 - DNA, 25 bp, Rattus norvegicus
tagtatgtcttgacctcccaaagga

SEQ ID NO: 579667 - DNA, 25 bp, Rattus norvegicus
cgagccatagtatgtcttgacctcc

SEQ ID NO: 579668 - DNA, 25 bp, Rattus norvegicus
cttagtacgagccatagtatgtctt

SEQ ID NO: 579669 - DNA, 25 bp, Rattus norvegicus
ctgaaggatactcagtgagagatga

SEQ ID NO: 579670 - DNA, 25 bp, Rattus norvegicus
ttcgccattcctgaacccgcgaagt

SEQ ID NO: 579671 - DNA, 25 bp, Rattus norvegicus
cagtacagttgttcggttctatttc

SEQ ID NO: 579672 - DNA, 25 bp, Rattus norvegicus
tttaaaatcagcctgtgcagagaca

SEQ ID NO: 579673 - DNA, 25 bp, Rattus norvegicus
ccatttatactcaacgcagggcgtg

SEQ ID NO: 579674 - DNA, 25 bp, Rattus norvegicus
cacagctatgctttgccatttatac

SEQ ID NO: 579675 - DNA, 25 bp, Rattus norvegicus
cctgctactactcggggagctggcc

SEQ ID NO: 579676 - DNA, 25 bp, Rattus norvegicus
tgagagatgacacagctatgctttg

SEQ ID NO: 579677 - DNA, 25 bp, Rattus norvegicus
ccggcccgaagagaagggctccaag

SEQ ID NO: 579678 - DNA, 25 bp, Rattus norvegicus
ctggaaggtagaatccactgaagga

SEQ ID NO: 579679 - DNA, 25 bp, Rattus norvegicus
agtcattgtagagagctggaaggta

SEQ ID NO: 579680 - DNA, 25 bp, Rattus norvegicus
accacgtccagtcattgtagagagc

SEQ ID NO: 579681 - DNA, 25 bp, Rattus norvegicus
ccttgtttaccacgtccagtcattg

SEQ ID NO: 579682 - DNA, 25 bp, Rattus norvegicus
ggcacgagccttaccaccttgttta

SEQ ID NO: 579683 - DNA, 25 bp, Rattus norvegicus
ccagatctggagaacgaccgctatc

SEQ ID NO: 579684 - DNA, 25 bp, Rattus norvegicus
ttctctcggggtttttgctctcacc

SEQ ID NO: 579685 - DNA, 25 bp, Rattus norvegicus
tgcagactagtcgattctctcgggg

SEQ ID NO: 579686 - DNA, 25 bp, Rattus norvegicus
ccaccgtcggtgttgcagactagtc

SEQ ID NO: 579687 - DNA, 25 bp, Rattus norvegicus
gaccgctatcgctgggaatccgtac

SEQ ID NO: 579688 - DNA, 25 bp, Rattus norvegicus
gggaatccgtactcttgcctcatcg

SEQ ID NO: 579689 - DNA, 25 bp, Rattus norvegicus
gcctgcgcaatatgccgggtgtacg

SEQ ID NO: 579690 - DNA, 25 bp, Rattus norvegicus
tgctctccgtgttgtgacttctgga

SEQ ID NO: 579691 - DNA, 25 bp, Rattus norvegicus
gacttctggaataaccgccgtgttg

SEQ ID NO: 579692 - DNA, 25 bp, Rattus norvegicus
ccgtgttggttgattgaaggcagtc

SEQ ID NO: 579693 - DNA, 25 bp, Rattus norvegicus
ggcagtccatgtcgcctgtaccagg

SEQ ID NO: 579694 - DNA, 25 bp, Rattus norvegicus
ctgtaccaggatcccgccctaatga

SEQ ID NO: 579695 - DNA, 25 bp, Rattus norvegicus
cctaatgaggacactctgggctctc

SEQ ID NO: 579696 - DNA, 25 bp, Rattus norvegicus
tctgggctctcagaaacgacgacga

SEQ ID NO: 579697 - DNA, 25 bp, Rattus norvegicus
tctggtcagtctcagggcgtttggc

SEQ ID NO: 579698 - DNA, 25 bp, Rattus norvegicus
gttccgggtgtctggtcagtctcag

SEQ ID NO: 579699 - DNA, 25 bp, Rattus norvegicus
cgcctcaggccggttccgggtgtct

SEQ ID NO: 579700 - DNA, 25 bp, Rattus norvegicus
aaatcggtggctacttgggccgagc

SEQ ID NO: 579701 - DNA, 25 bp, Rattus norvegicus
taaaatcggtggctacttgggccga

SEQ ID NO: 579702 - DNA, 25 bp, Rattus norvegicus
gcggcctaatggctccgggaaaata

SEQ ID NO: 579703 - DNA, 25 bp, Rattus norvegicus
ctccgcggcctaatggctccgggaa

SEQ ID NO: 579704 - DNA, 25 bp, Rattus norvegicus
atgggacaaaacctcttcctccgcg

SEQ ID NO: 579705 - DNA, 25 bp, Rattus norvegicus
cacttttgtgactgcggggtgctac

SEQ ID NO: 579706 - DNA, 25 bp, Rattus norvegicus
tcgacacttttgtgactgcggggtg

SEQ ID NO: 579707 - DNA, 25 bp, Rattus norvegicus
ggactttcgacacttttgtgactgc

SEQ ID NO: 579708 - DNA, 25 bp, Rattus norvegicus
gaagccggaagtgctctgtgccccg

SEQ ID NO: 579709 - DNA, 25 bp, Rattus norvegicus
agtgtcgctggtgcctagagaagcc

SEQ ID NO: 579710 - DNA, 25 bp, Rattus norvegicus
aatcatagagtgtcgctggtgccta

SEQ ID NO: 579711 - DNA, 25 bp, Rattus norvegicus
ctagcctggagcacgagctcgctca

SEQ ID NO: 579712 - DNA, 25 bp, Rattus norvegicus
ggagcacgagctcgctcaccgcgta

SEQ ID NO: 579713 - DNA, 25 bp, Rattus norvegicus
tgcggccctggtggcctttccctgg

SEQ ID NO: 579714 - DNA, 25 bp, Rattus norvegicus
tggcttccaacctctttctacgaac

SEQ ID NO: 579715 - DNA, 25 bp, Rattus norvegicus
acctctttctacgaacgagtctaag

SEQ ID NO: 579716 - DNA, 25 bp, Rattus norvegicus
cgagtctaagtagcagcgagcattc

SEQ ID NO: 579717 - DNA, 25 bp, Rattus norvegicus
accgcgtagctcctgcgccgagaag

SEQ ID NO: 579718 - DNA, 25 bp, Rattus norvegicus
tcctgcgccgagaagagaacccagc

SEQ ID NO: 579719 - DNA, 25 bp, Rattus norvegicus
gagaagagaacccagctcgcccagg

SEQ ID NO: 579720 - DNA, 25 bp, Rattus norvegicus
gctcgcccaggaaccggaagctatc

SEQ ID NO: 579721 - DNA, 25 bp, Rattus norvegicus
aaccggaagctatcgcggacagcca

SEQ ID NO: 579722 - DNA, 25 bp, Rattus norvegicus
agctatcgcggacagccacaaaggc

SEQ ID NO: 579723 - DNA, 25 bp, Rattus norvegicus
aggcgtacccgtaggcgaccgcact

SEQ ID NO: 579724 - DNA, 25 bp, Rattus norvegicus
gtctaagtagcagcgagcattctcc

SEQ ID NO: 579725 - DNA, 25 bp, Rattus norvegicus
gaagcctagctttccgccagggcga

SEQ ID NO: 579726 - DNA, 25 bp, Rattus norvegicus
ggagagctaccgcagccagcaactt

SEQ ID NO: 579727 - DNA, 25 bp, Rattus norvegicus
gccagcaactttgcaacttttgcag

SEQ ID NO: 579728 - DNA, 25 bp, Rattus norvegicus
gcaagttgttgcacacagttccaga

SEQ ID NO: 579729 - DNA, 25 bp, Rattus norvegicus
ggacactactggctcttcaggacag

SEQ ID NO: 579730 - DNA, 25 bp, Rattus norvegicus
gtgaaggaagtgtctcagatcgctg

SEQ ID NO: 579731 - DNA, 25 bp, Rattus norvegicus
tcagatcgctgaagctccgggtatc

SEQ ID NO: 579732 - DNA, 25 bp, Rattus norvegicus
tccgggtatcctcacagggtgcgcc

SEQ ID NO: 579733 - DNA, 25 bp, Rattus norvegicus
cccaagatcccgatagccttatatc

SEQ ID NO: 579734 - DNA, 25 bp, Rattus norvegicus
tagccttatatctgcggcggtgatg

SEQ ID NO: 579735 - DNA, 25 bp, Rattus norvegicus
ccactgcactctgcgcgagaaggtc

SEQ ID NO: 579736 - DNA, 25 bp, Rattus norvegicus
gtcactcgcaaggactgggtattta

SEQ ID NO: 579737 - DNA, 25 bp, Rattus norvegicus
ggacagcgatgcgtgagtctctccc

SEQ ID NO: 579738 - DNA, 25 bp, Rattus norvegicus
actcagagccagtgacccagtcagc

SEQ ID NO: 579739 - DNA, 25 bp, Rattus norvegicus
gacgcacagaagcaaacaagatttc

SEQ ID NO: 579740 - DNA, 25 bp, Rattus norvegicus
ctctgttttggagcctcgaccgata

SEQ ID NO: 579741 - DNA, 25 bp, Rattus norvegicus
ccggcatcttcattactctgttttg

SEQ ID NO: 579742 - DNA, 25 bp, Rattus norvegicus
cctgtatcccggcatcttcattact

SEQ ID NO: 579743 - DNA, 25 bp, Rattus norvegicus
ctgtggttagggaacgatcttggtt

SEQ ID NO: 579744 - DNA, 25 bp, Rattus norvegicus
aacgatcttggttgcggcttctgca

SEQ ID NO: 579745 - DNA, 25 bp, Rattus norvegicus
ttgcggcttctgcagtttccgcctc

SEQ ID NO: 579746 - DNA, 25 bp, Rattus norvegicus
tgtcctcttaaaaagttcactctcg

SEQ ID NO: 579747 - DNA, 25 bp, Rattus norvegicus
ctcgaccgatagagggcgctcaggt

SEQ ID NO: 579748 - DNA, 25 bp, Rattus norvegicus
gcgaactgcctttgacgcacagaag

SEQ ID NO: 579749 - DNA, 25 bp, Rattus norvegicus
tttacggtttggatcggctgcattg

SEQ ID NO: 579750 - DNA, 25 bp, Rattus norvegicus
gctgcattgcagctgtcggtggtct

SEQ ID NO: 579751 - DNA, 25 bp, Rattus norvegicus
agctgtcggtggtctcctgcagttc

SEQ ID NO: 579752 - DNA, 25 bp, Rattus norvegicus
gttcactctcgcgaactgcctttga

SEQ ID NO: 579753 - DNA, 25 bp, Rattus norvegicus
aggcgatatccggtgaccagacctc

SEQ ID NO: 579754 - DNA, 25 bp, Rattus norvegicus
acagcacggcagagcgaaatcgcac

SEQ ID NO: 579755 - DNA, 25 bp, Rattus norvegicus
agcttcagggttgcggcactcgttg

SEQ ID NO: 579756 - DNA, 25 bp, Rattus norvegicus
caaccgtgcggggtaggcgatatcc

SEQ ID NO: 579757 - DNA, 25 bp, Rattus norvegicus
cacagagcttcagggttgcggcact

SEQ ID NO: 579758 - DNA, 25 bp, Rattus norvegicus
gcgaaatcgcacgtcctcaaaacca

SEQ ID NO: 579759 - DNA, 25 bp, Rattus norvegicus
atccggtgaccagacctccaggact

SEQ ID NO: 579760 - DNA, 25 bp, Rattus norvegicus
caggactcgccgctcagttttcttc

SEQ ID NO: 579761 - DNA, 25 bp, Rattus norvegicus
gactcgccgctcagttttcttcagg

SEQ ID NO: 579762 - DNA, 25 bp, Rattus norvegicus
cagttttcttcagggtccgcggtcg

SEQ ID NO: 579763 - DNA, 25 bp, Rattus norvegicus
tccgcggtcgtttccgcaggcagac

SEQ ID NO: 579764 - DNA, 25 bp, Rattus norvegicus
gtttccgcaggcagaccgacagcac

SEQ ID NO: 579765 - DNA, 25 bp, Rattus norvegicus
gcaggcagaccgacagcacggcaga

SEQ ID NO: 579766 - DNA, 25 bp, Rattus norvegicus
gtcctcaaaaccacagccgtgcttc

SEQ ID NO: 579767 - DNA, 25 bp, Rattus norvegicus
caacagatgttgtggccgcagtcga

SEQ ID NO: 579768 - DNA, 25 bp, Rattus norvegicus
gcagactcctaagggccgagcggaa

SEQ ID NO: 579769 - DNA, 25 bp, Rattus norvegicus
ctgcacctcacggacagcgcgggaa

SEQ ID NO: 579770 - DNA, 25 bp, Rattus norvegicus
tctcggcttctcagatccggagcgg

SEQ ID NO: 579771 - DNA, 25 bp, Rattus norvegicus
caaagtattgaagacacacggggca

SEQ ID NO: 579772 - DNA, 25 bp, Rattus norvegicus
ccgcagtcgagcatcatgggttcca

SEQ ID NO: 579773 - DNA, 25 bp, Rattus norvegicus
gccaggcacgcgcaacagatgttgt

SEQ ID NO: 579774 - DNA, 25 bp, Rattus norvegicus
cactgcgggcacgacacgttagtct

SEQ ID NO: 579775 - DNA, 25 bp, Rattus norvegicus
cgcagttgcttcaccagctgggtca

SEQ ID NO: 579776 - DNA, 25 bp, Rattus norvegicus
tcgcagtacagcttcagaggctcgc

SEQ ID NO: 579777 - DNA, 25 bp, Rattus norvegicus
ggcatctggtcctgctcgcagtaca

SEQ ID NO: 579778 - DNA, 25 bp, Rattus norvegicus
tcgcacaccacgcagatgggcatct

SEQ ID NO: 579779 - DNA, 25 bp, Rattus norvegicus
acaggttctccttccgagtctgagc

SEQ ID NO: 579780 - DNA, 25 bp, Rattus norvegicus
tttctcggcggcaaaccaggaagcc

SEQ ID NO: 579781 - DNA, 25 bp, Rattus norvegicus
cttccgctctttgagccgggtggtg

SEQ ID NO: 579782 - DNA, 25 bp, Rattus norvegicus
ggggacccacagaccgacaggtaga

SEQ ID NO: 579783 - DNA, 25 bp, Rattus norvegicus
cctggcttccgctctttgagccggg

SEQ ID NO: 579784 - DNA, 25 bp, Rattus norvegicus
ccggcacaggcagcgcggctatcga

SEQ ID NO: 579785 - DNA, 25 bp, Rattus norvegicus
cagcgcggctatcgaagggctagta

SEQ ID NO: 579786 - DNA, 25 bp, Rattus norvegicus
cgaagggctagtagcgagactgaca

SEQ ID NO: 579787 - DNA, 25 bp, Rattus norvegicus
gccgcagacccttttctgggcacag

SEQ ID NO: 579788 - DNA, 25 bp, Rattus norvegicus
cagctggaggggacccacagaccga

SEQ ID NO: 579789 - DNA, 25 bp, Rattus norvegicus
tgaaagggtcgccaccctggcttcc

SEQ ID NO: 579790 - DNA, 25 bp, Rattus norvegicus
ccacagaccgacaggtagagcgggc

SEQ ID NO: 579791 - DNA, 25 bp, Rattus norvegicus
ttgcacgcttgaaagggtcgccacc

SEQ ID NO: 579792 - DNA, 25 bp, Rattus norvegicus
ctgggattccatttgcacgcttgaa

SEQ ID NO: 579793 - DNA, 25 bp, Rattus norvegicus
tgcggcacactaggagaacggctcc

SEQ ID NO: 579794 - DNA, 25 bp, Rattus norvegicus
cagacccttttctgggcacagggga

SEQ ID NO: 579795 - DNA, 25 bp, Rattus norvegicus
gtcttccctagcgaacgccttcaga

SEQ ID NO: 579796 - DNA, 25 bp, Rattus norvegicus
ccgcaaggtcccaggagcactgtgc

SEQ ID NO: 579797 - DNA, 25 bp, Rattus norvegicus
gagcactgtgccaggtcccagcaac

SEQ ID NO: 579798 - DNA, 25 bp, Rattus norvegicus
ccgtttccctgggtctcagcactga

SEQ ID NO: 579799 - DNA, 25 bp, Rattus norvegicus
agcactgagtcccatctcggcgctg

SEQ ID NO: 579800 - DNA, 25 bp, Rattus norvegicus
atccggtgcctctagtcactcggga

SEQ ID NO: 579801 - DNA, 25 bp, Rattus norvegicus
aggaaacaaaagtgtctccgcggcg

SEQ ID NO: 579802 - DNA, 25 bp, Rattus norvegicus
gcgccaacccagcaaactttacaaa

SEQ ID NO: 579803 - DNA, 25 bp, Rattus norvegicus
ctttacaaacctgcctggggtctca

SEQ ID NO: 579804 - DNA, 25 bp, Rattus norvegicus
tctcaggacgcagcgactagggctc

SEQ ID NO: 579805 - DNA, 25 bp, Rattus norvegicus
ggtggctctgcctctatctcgtgcc

SEQ ID NO: 579806 - DNA, 25 bp, Rattus norvegicus
tcctgctggccagagacacatcttg

SEQ ID NO: 579807 - DNA, 25 bp, Rattus norvegicus
ccgccggtaaactcggagcagcttc

SEQ ID NO: 579808 - DNA, 25 bp, Rattus norvegicus
ttgcatctaggagcatcccgcgagc

SEQ ID NO: 579809 - DNA, 25 bp, Rattus norvegicus
tgcgcgctggcacacagatttgcag

SEQ ID NO: 579810 - DNA, 25 bp, Rattus norvegicus
agttcacgtctaccagctcctcgta

SEQ ID NO: 579811 - DNA, 25 bp, Rattus norvegicus
ctcgtactgctcgatggccaggatg

SEQ ID NO: 579812 - DNA, 25 bp, Rattus norvegicus
ggtgatgttccagggcatgtgccta

SEQ ID NO: 579813 - DNA, 25 bp, Rattus norvegicus
cctacacatggggatgcgcacagcc

SEQ ID NO: 579814 - DNA, 25 bp, Rattus norvegicus
ccacaggcataacgctaccaggatg

SEQ ID NO: 579815 - DNA, 25 bp, Rattus norvegicus
gagcatcgcactgtcctcctgggct

SEQ ID NO: 579816 - DNA, 25 bp, Rattus norvegicus
ttcaagtccctctgatctccttatg

SEQ ID NO: 579817 - DNA, 25 bp, Rattus norvegicus
ccttatgtctttacctaggggcagc

SEQ ID NO: 579818 - DNA, 25 bp, Rattus norvegicus
tggagctccagtccgcactgaacgg

SEQ ID NO: 579819 - DNA, 25 bp, Rattus norvegicus
gacactggcagggacagcactcacc

SEQ ID NO: 579820 - DNA, 25 bp, Rattus norvegicus
cacggccattgtgggaccctattta

SEQ ID NO: 579821 - DNA, 25 bp, Rattus norvegicus
ttgatgggatcgtgcaggaactcca

SEQ ID NO: 579822 - DNA, 25 bp, Rattus norvegicus
actccagggtacagatgggtgcgta

SEQ ID NO: 579823 - DNA, 25 bp, Rattus norvegicus
agagcagcgggcacaacagccgcgc

SEQ ID NO: 579824 - DNA, 25 bp, Rattus norvegicus
tcggctccctcccaggtttggctga

SEQ ID NO: 579825 - DNA, 25 bp, Rattus norvegicus
agacaacgcgcgtgactctcccacg

SEQ ID NO: 579826 - DNA, 25 bp, Rattus norvegicus
cctcccaggtttggctgacccggag

SEQ ID NO: 579827 - DNA, 25 bp, Rattus norvegicus
agggccgcgaatcacgatgctcaca

SEQ ID NO: 579828 - DNA, 25 bp, Rattus norvegicus
gcgaatcacgatgctcacacgcgct

SEQ ID NO: 579829 - DNA, 25 bp, Rattus norvegicus
cttggcggcctctgggtctggatat

SEQ ID NO: 579830 - DNA, 25 bp, Rattus norvegicus
tctgggtctggatattgtgcggcct

SEQ ID NO: 579831 - DNA, 25 bp, Rattus norvegicus
taccagcagagcagcgggcacaaca

SEQ ID NO: 579832 - DNA, 25 bp, Rattus norvegicus
agccgcgccctggtgtcctacgatg

SEQ ID NO: 579833 - DNA, 25 bp, Rattus norvegicus
ccctggtgtcctacgatggtctcaa

SEQ ID NO: 579834 - DNA, 25 bp, Rattus norvegicus
tgtcctacgatggtctcaaccagcg

SEQ ID NO: 579835 - DNA, 25 bp, Rattus norvegicus
atggtctcaaccagcgcgtgcgggt

SEQ ID NO: 579836 - DNA, 25 bp, Rattus norvegicus
aggttctgtaccagcagagcagcgg

SEQ ID NO: 579837 - DNA, 25 bp, Rattus norvegicus
gtctttgcgtgaccagcgtgtttgc

SEQ ID NO: 579838 - DNA, 25 bp, Rattus norvegicus
ccactgccagctttttgagccgcta

SEQ ID NO: 579839 - DNA, 25 bp, Rattus norvegicus
ctttttgagccgctactggtcgtcc

SEQ ID NO: 579840 - DNA, 25 bp, Rattus norvegicus
ccgctactggtcgtccgaagactga

SEQ ID NO: 579841 - DNA, 25 bp, Rattus norvegicus
ccgaagactgacagttctgcaaacc

SEQ ID NO: 579842 - DNA, 25 bp, Rattus norvegicus
gactgacagttctgcaaaccaaccc

SEQ ID NO: 579843 - DNA, 25 bp, Rattus norvegicus
tgcgaagcctgaggttccagggttc

SEQ ID NO: 579844 - DNA, 25 bp, Rattus norvegicus
acccagcggcaatgtctttgcgtga

SEQ ID NO: 579845 - DNA, 25 bp, Rattus norvegicus
accagcgtgtttgcgtcacggaagg

SEQ ID NO: 579846 - DNA, 25 bp, Rattus norvegicus
tgcgtcacggaagggtcccgccctg

SEQ ID NO: 579847 - DNA, 25 bp, Rattus norvegicus
accgcggagccgtgtctacaggcca

SEQ ID NO: 579848 - DNA, 25 bp, Rattus norvegicus
cctttctgcgccctgctgggcaggt

SEQ ID NO: 579849 - DNA, 25 bp, Rattus norvegicus
ccctgctgggcaggttgcgaagcct

SEQ ID NO: 579850 - DNA, 25 bp, Rattus norvegicus
tgccactattaacccagcggcaatg

SEQ ID NO: 579851 - DNA, 25 bp, Rattus norvegicus
agtcgccgtgcctttggaaagcatg

SEQ ID NO: 579852 - DNA, 25 bp, Rattus norvegicus
ccgctttcgagaagcagcatctctg

SEQ ID NO: 579853 - DNA, 25 bp, Rattus norvegicus
cccgggactccgctttcgagaagca

SEQ ID NO: 579854 - DNA, 25 bp, Rattus norvegicus
tttggaaagcatgagctccgcccgg

SEQ ID NO: 579855 - DNA, 25 bp, Rattus norvegicus
cggtgccttcgttttcctccgtcag

SEQ ID NO: 579856 - DNA, 25 bp, Rattus norvegicus
cgtgcctttggaaagcatgagctcc

SEQ ID NO: 579857 - DNA, 25 bp, Rattus norvegicus
cgagaagcagcatctctggatgtac

SEQ ID NO: 579858 - DNA, 25 bp, Rattus norvegicus
aaagcatgagctccgcccgggactc

SEQ ID NO: 579859 - DNA, 25 bp, Rattus norvegicus
atctctggatgtacctgcaggcgct

SEQ ID NO: 579860 - DNA, 25 bp, Rattus norvegicus
ctccgtcagagtcgccgtgcctttg

SEQ ID NO: 579861 - DNA, 25 bp, Rattus norvegicus
gaggcaaaactcagaggccgccagc

SEQ ID NO: 579862 - DNA, 25 bp, Rattus norvegicus
cccggtggaggcaaaactcagaggc

SEQ ID NO: 579863 - DNA, 25 bp, Rattus norvegicus
tttggatccgagttccggcgtcagg

SEQ ID NO: 579864 - DNA, 25 bp, Rattus norvegicus
gggaagatggtatcctacgcgcacc

SEQ ID NO: 579865 - DNA, 25 bp, Rattus norvegicus
tttttggcgaagatgcccggtcttg

SEQ ID NO: 579866 - DNA, 25 bp, Rattus norvegicus
cgacaggaccggcttaaagagatag

SEQ ID NO: 579867 - DNA, 25 bp, Rattus norvegicus
cccggtcttgatgtcggccatggct

SEQ ID NO: 579868 - DNA, 25 bp, Rattus norvegicus
ctgaccttttcctgtgcccggttga

SEQ ID NO: 579869 - DNA, 25 bp, Rattus norvegicus
gttgagccgcttttgcacgtttttg

SEQ ID NO: 579870 - DNA, 25 bp, Rattus norvegicus
cgtttcgaccgacctcactcaaata

SEQ ID NO: 579871 - DNA, 25 bp, Rattus norvegicus
ccacccatgaaaagatgcgacaatc

SEQ ID NO: 579872 - DNA, 25 bp, Rattus norvegicus
gcgtgcccaagagagtggccaccct

SEQ ID NO: 579873 - DNA, 25 bp, Rattus norvegicus
ctgggagtctggagcatttagtgcc

SEQ ID NO: 579874 - DNA, 25 bp, Rattus norvegicus
tgcctaaatggatcctgcacagctg

SEQ ID NO: 579875 - DNA, 25 bp, Rattus norvegicus
tgcacagctgcaatcactgggagca

SEQ ID NO: 579876 - DNA, 25 bp, Rattus norvegicus
ggcgcttgctccacttcgcagtgcg

SEQ ID NO: 579877 - DNA, 25 bp, Rattus norvegicus
ctgcttgcgggagagctaatactca

SEQ ID NO: 579878 - DNA, 25 bp, Rattus norvegicus
agcgcaaggccagcactgccatcgg

SEQ ID NO: 579879 - DNA, 25 bp, Rattus norvegicus
cctgaccaatgggttgacagaagtg

SEQ ID NO: 579880 - DNA, 25 bp, Rattus norvegicus
ggaccacatcatcgaggacgcgctc

SEQ ID NO: 579881 - DNA, 25 bp, Rattus norvegicus
cgacagacgtctgctcctgaccaat

SEQ ID NO: 579882 - DNA, 25 bp, Rattus norvegicus
gccaatggcgcggtgccaatcacga

SEQ ID NO: 579883 - DNA, 25 bp, Rattus norvegicus
cgagccggagctagagcccattccg

SEQ ID NO: 579884 - DNA, 25 bp, Rattus norvegicus
cccattccgggcagtgaggccggca

SEQ ID NO: 579885 - DNA, 25 bp, Rattus norvegicus
ggactcagcggtatcgcacctcatc

SEQ ID NO: 579886 - DNA, 25 bp, Rattus norvegicus
acgcgctcgtggtgtcgttccgcct

SEQ ID NO: 579887 - DNA, 25 bp, Rattus norvegicus
tgcgggtcacgctggaccacatcat

SEQ ID NO: 579888 - DNA, 25 bp, Rattus norvegicus
ttccgcctcggggagaagctcttct

SEQ ID NO: 579889 - DNA, 25 bp, Rattus norvegicus
gagaagctcttctccggggtcctca

SEQ ID NO: 579890 - DNA, 25 bp, Rattus norvegicus
ggggtcctcatggacctgtctaaaa

SEQ ID NO: 579891 - DNA, 25 bp, Rattus norvegicus
tccgccgcgagggagagcgcaaacc

SEQ ID NO: 579892 - DNA, 25 bp, Rattus norvegicus
tgccaatcacgagcatcagggaaag

SEQ ID NO: 579893 - DNA, 25 bp, Rattus norvegicus
tttgatgaggaagcagacgaatctc

SEQ ID NO: 579894 - DNA, 25 bp, Rattus norvegicus
agtgcggctctctgaccgagcgctc

SEQ ID NO: 579895 - DNA, 25 bp, Rattus norvegicus
ggactcccacgagggacacaggctc

SEQ ID NO: 579896 - DNA, 25 bp, Rattus norvegicus
gatcacatgaggaaacgagtccaag

SEQ ID NO: 579897 - DNA, 25 bp, Rattus norvegicus
acgaatctctgttagtgcagcggga

SEQ ID NO: 579898 - DNA, 25 bp, Rattus norvegicus
ccaggacgtgtttgatgaggaagca

SEQ ID NO: 579899 - DNA, 25 bp, Rattus norvegicus
ccagccctggagaccaggacgtgtt

SEQ ID NO: 579900 - DNA, 25 bp, Rattus norvegicus
ttggtttcgagcgactcccgagatc

SEQ ID NO: 579901 - DNA, 25 bp, Rattus norvegicus
tcctggcaatgtcttggtttcgagc

SEQ ID NO: 579902 - DNA, 25 bp, Rattus norvegicus
ccggactcgtggtgttcctggcaat

SEQ ID NO: 579903 - DNA, 25 bp, Rattus norvegicus
aagcacttgcctgcgtttccggtgg

SEQ ID NO: 579904 - DNA, 25 bp, Rattus norvegicus
ccgaaccggaagcacttgcctgcgt

SEQ ID NO: 579905 - DNA, 25 bp, Rattus norvegicus
acccagacgcataggaggagaccca

SEQ ID NO: 579906 - DNA, 25 bp, Rattus norvegicus
tgcagcgggaatggcaggatcacat

SEQ ID NO: 579907 - DNA, 25 bp, Rattus norvegicus
ttcgcggccgccagagtattcggcc

SEQ ID NO: 579908 - DNA, 25 bp, Rattus norvegicus
cctggaggttataccactgcgcctc

SEQ ID NO: 579909 - DNA, 25 bp, Rattus norvegicus
taggaggtgattgcgccttgagaac

SEQ ID NO: 579910 - DNA, 25 bp, Rattus norvegicus
attgcgccttgagaacccggtagct

SEQ ID NO: 579911 - DNA, 25 bp, Rattus norvegicus
cttgagaacccggtagctcgtcgtg

SEQ ID NO: 579912 - DNA, 25 bp, Rattus norvegicus
ccggtagctcgtcgtgggtccgcct

SEQ ID NO: 579913 - DNA, 25 bp, Rattus norvegicus
ctccctagagcggagcgccggagtc

SEQ ID NO: 579914 - DNA, 25 bp, Rattus norvegicus
tccgagcgcggtccgatcggcacag

SEQ ID NO: 579915 - DNA, 25 bp, Rattus norvegicus
atcggcacagccgaggctcaagagc

SEQ ID NO: 579916 - DNA, 25 bp, Rattus norvegicus
tgtggccgccgagattgcacgtccc

SEQ ID NO: 579917 - DNA, 25 bp, Rattus norvegicus
tgccgcctgtactgggacccgactg

SEQ ID NO: 579918 - DNA, 25 bp, Rattus norvegicus
gcgtctccggaaggtcacctgcatc

SEQ ID NO: 579919 - DNA, 25 bp, Rattus norvegicus
ggtccgcctggaggttataccactg

SEQ ID NO: 579920 - DNA, 25 bp, Rattus norvegicus
ggaaggtcacctgcatcgctccggt

SEQ ID NO: 579921 - DNA, 25 bp, Rattus norvegicus
accactctccgtctgcgttcccgaa

SEQ ID NO: 579922 - DNA, 25 bp, Rattus norvegicus
tcctgccgtgacctttaactggagg

SEQ ID NO: 579923 - DNA, 25 bp, Rattus norvegicus
agggagtgcctccagcaacagcaca

SEQ ID NO: 579924 - DNA, 25 bp, Rattus norvegicus
taactggaggtaagcaacaagcgcc

SEQ ID NO: 579925 - DNA, 25 bp, Rattus norvegicus
ggtaagcaacaagcgccataactgg

SEQ ID NO: 579926 - DNA, 25 bp, Rattus norvegicus
aagcgccataactggcgccacaggg

SEQ ID NO: 579927 - DNA, 25 bp, Rattus norvegicus
gccacagggagtgcctccagcaaca

SEQ ID NO: 579928 - DNA, 25 bp, Rattus norvegicus
gcccacgcctcctctcctttcttta

SEQ ID NO: 579929 - DNA, 25 bp, Rattus norvegicus
cacttccggtgacagccagggttct

SEQ ID NO: 579930 - DNA, 25 bp, Rattus norvegicus
agattcgtcccggtcctgccgtgac

SEQ ID NO: 579931 - DNA, 25 bp, Rattus norvegicus
cgttcccgaacgtgacgagcgtgcg

SEQ ID NO: 579932 - DNA, 25 bp, Rattus norvegicus
gccgccggcatagcgtttggtttag

SEQ ID NO: 579933 - DNA, 25 bp, Rattus norvegicus
tggaatgacttctctccgtcacttc

SEQ ID NO: 579934 - DNA, 25 bp, Rattus norvegicus
cacctctgccggaagtggaatgact

SEQ ID NO: 579935 - DNA, 25 bp, Rattus norvegicus
gcaaggatcgggacctcaaggccca

SEQ ID NO: 579936 - DNA, 25 bp, Rattus norvegicus
ggcagcgaggcctcaaaggcccgca

SEQ ID NO: 579937 - DNA, 25 bp, Rattus norvegicus
agcagtccctattcccggcggttgc

SEQ ID NO: 579938 - DNA, 25 bp, Rattus norvegicus
agtaaggagcgccatcgcgagcacc

SEQ ID NO: 579939 - DNA, 25 bp, Rattus norvegicus
agcagtagtagcagccgcaaggatc

SEQ ID NO: 579940 - DNA, 25 bp, Rattus norvegicus
ggccgccgcaaaagtgcatcggcta

SEQ ID NO: 579941 - DNA, 25 bp, Rattus norvegicus
aggcccatcgcagccggactaagtc

SEQ ID NO: 579942 - DNA, 25 bp, Rattus norvegicus
gactaagtcgtccaaggagccgccc

SEQ ID NO: 579943 - DNA, 25 bp, Rattus norvegicus
aggagccgccctcggcctacaagga

SEQ ID NO: 579944 - DNA, 25 bp, Rattus norvegicus
tcggcctacaaggagccgcccaagg

SEQ ID NO: 579945 - DNA, 25 bp, Rattus norvegicus
gcctaccgggaggacaagagcgaac

SEQ ID NO: 579946 - DNA, 25 bp, Rattus norvegicus
aagagcgaaccgaaggcctacaggc

SEQ ID NO: 579947 - DNA, 25 bp, Rattus norvegicus
cggtgtcccacagggcctcgcagag

SEQ ID NO: 579948 - DNA, 25 bp, Rattus norvegicus
gcatcggctacgtccagcagtagta

SEQ ID NO: 579949 - DNA, 25 bp, Rattus norvegicus
gccctcatcaagagcaggccgaaga

SEQ ID NO: 579950 - DNA, 25 bp, Rattus norvegicus
tcagcgcgcggaccctgttacctgt

SEQ ID NO: 579951 - DNA, 25 bp, Rattus norvegicus
tggagcgcgcggacgcacactcacg

SEQ ID NO: 579952 - DNA, 25 bp, Rattus norvegicus
ccgggaaggttgtgcgtactgtaat

SEQ ID NO: 579953 - DNA, 25 bp, Rattus norvegicus
ccagcacgtctgtccgcggcggtag

SEQ ID NO: 579954 - DNA, 25 bp, Rattus norvegicus
tgtactacggcgtgcccagcacgtc

SEQ ID NO: 579955 - DNA, 25 bp, Rattus norvegicus
gggccgccttcaggaatgtactacg

SEQ ID NO: 579956 - DNA, 25 bp, Rattus norvegicus
cattggccagcagcggagaagccgc

SEQ ID NO: 579957 - DNA, 25 bp, Rattus norvegicus
aacgcagccattggccagcagcgga

SEQ ID NO: 579958 - DNA, 25 bp, Rattus norvegicus
tctaaccgcagtcggcgccgctgaa

SEQ ID NO: 579959 - DNA, 25 bp, Rattus norvegicus
atgggcctcttgctccgggtcacgt

SEQ ID NO: 579960 - DNA, 25 bp, Rattus norvegicus
tcaggaatgtactacggcgtgccca

SEQ ID NO: 579961 - DNA, 25 bp, Rattus norvegicus
atggaagggccggaacgcagccatt

SEQ ID NO: 579962 - DNA, 25 bp, Rattus norvegicus
agaagccgcgcgttcattgggcaac

SEQ ID NO: 579963 - DNA, 25 bp, Rattus norvegicus
gacctcaccacgcttctgcaagaga

SEQ ID NO: 579964 - DNA, 25 bp, Rattus norvegicus
cggctgcacaaaggttccgacctca

SEQ ID NO: 579965 - DNA, 25 bp, Rattus norvegicus
aggctagggacttggttgaaccatt

SEQ ID NO: 579966 - DNA, 25 bp, Rattus norvegicus
aggcggaagccaacatcgacgcgcg

SEQ ID NO: 579967 - DNA, 25 bp, Rattus norvegicus
ccagagtcctggactttagcgagtc

SEQ ID NO: 579968 - DNA, 25 bp, Rattus norvegicus
acaaaaccggtcatcaggctgtgcc

SEQ ID NO: 579969 - DNA, 25 bp, Rattus norvegicus
gccagcggagtagcgcaccttagtt

SEQ ID NO: 579970 - DNA, 25 bp, Rattus norvegicus
attcctgtttatgcagtcctccggc

SEQ ID NO: 579971 - DNA, 25 bp, Rattus norvegicus
tgatcaactgctagaagaaaactgg

SEQ ID NO: 579972 - DNA, 25 bp, Rattus norvegicus
ccaccggaacctcagtgatcaactg

SEQ ID NO: 579973 - DNA, 25 bp, Rattus norvegicus
aagctgaagagctcactcgccaatg

SEQ ID NO: 579974 - DNA, 25 bp, Rattus norvegicus
ttcggtcggtgcataacaggaaacg

SEQ ID NO: 579975 - DNA, 25 bp, Rattus norvegicus
cgcaccttagttccggctgcacaaa

SEQ ID NO: 579976 - DNA, 25 bp, Rattus norvegicus
agggcgattaagctttgaggcttcc

SEQ ID NO: 579977 - DNA, 25 bp, Rattus norvegicus
tctgtagtccggaccgccgagacca

SEQ ID NO: 579978 - DNA, 25 bp, Rattus norvegicus
atgtggtctgactctcctctccttc

SEQ ID NO: 579979 - DNA, 25 bp, Rattus norvegicus
aacttcaggcgggacgtacctgcgg

SEQ ID NO: 579980 - DNA, 25 bp, Rattus norvegicus
cccgactgagcgcaatgtgcggtcg

SEQ ID NO: 579981 - DNA, 25 bp, Rattus norvegicus
gcgcatcagtttcagggatcctgta

SEQ ID NO: 579982 - DNA, 25 bp, Rattus norvegicus
ctaatttccgccactccggggagca

SEQ ID NO: 579983 - DNA, 25 bp, Rattus norvegicus
tcctgtaatctgatccctctgagtc

SEQ ID NO: 579984 - DNA, 25 bp, Rattus norvegicus
ttgcaaaagttgagctccgccgcgc

SEQ ID NO: 579985 - DNA, 25 bp, Rattus norvegicus
cgaccgtctagtcgactttcaacga

SEQ ID NO: 579986 - DNA, 25 bp, Rattus norvegicus
cccaggagcaggagttctgtagtcc

SEQ ID NO: 579987 - DNA, 25 bp, Rattus norvegicus
acagttctgatttggttcaacctcg

SEQ ID NO: 579988 - DNA, 25 bp, Rattus norvegicus
caccggccctgagtgacagttctga

SEQ ID NO: 579989 - DNA, 25 bp, Rattus norvegicus
tgggagtactgctcgccttactttg

SEQ ID NO: 579990 - DNA, 25 bp, Rattus norvegicus
cccaagttttcacagatgtggtctg

SEQ ID NO: 579991 - DNA, 25 bp, Rattus norvegicus
gcccgcctcttgcaagtttctattg

SEQ ID NO: 579992 - DNA, 25 bp, Rattus norvegicus
taggattctttggagcccgcctctt

SEQ ID NO: 579993 - DNA, 25 bp, Rattus norvegicus
cccttgcctgcgttcgacgagagca

SEQ ID NO: 579994 - DNA, 25 bp, Rattus norvegicus
ttagaactaccaagaccgcaatgcc

SEQ ID NO: 579995 - DNA, 25 bp, Rattus norvegicus
gtagtccattcttccaggtcaatcg

SEQ ID NO: 579996 - DNA, 25 bp, Rattus norvegicus
agttatgcctcaatgctttctggga

SEQ ID NO: 579997 - DNA, 25 bp, Rattus norvegicus
acgccatttactcaccagttctatg

SEQ ID NO: 579998 - DNA, 25 bp, Rattus norvegicus
ctcttagacgacctaggattgggta

SEQ ID NO: 579999 - DNA, 25 bp, Rattus norvegicus
acctctttcccggatgcctcttaga

SEQ ID NO: 580000 - DNA, 25 bp, Rattus norvegicus
tcgactgacgggcaaacatcgcttt

SEQ ID NO: 580001 - DNA, 25 bp, Rattus norvegicus
cggcgactggtacctttgtttggcg

SEQ ID NO: 580002 - DNA, 25 bp, Rattus norvegicus
agaatgctcctacctcgggcgcaga

SEQ ID NO: 580003 - DNA, 25 bp, Rattus norvegicus
gcttacccggtagaaaagaatgctc

SEQ ID NO: 580004 - DNA, 25 bp, Rattus norvegicus
gcgatgcaaacaacgacgccattta

SEQ ID NO: 580005 - DNA, 25 bp, Rattus norvegicus
tcacttcctctacggaggcgggatt

SEQ ID NO: 580006 - DNA, 25 bp, Rattus norvegicus
tccggtctacggatacttccgccta

SEQ ID NO: 580007 - DNA, 25 bp, Rattus norvegicus
ggatacttccgcctagagccgaacg

SEQ ID NO: 580008 - DNA, 25 bp, Rattus norvegicus
cctagagccgaacgctcagggtgcg

SEQ ID NO: 580009 - DNA, 25 bp, Rattus norvegicus
ctgggtgctgacagaccggctgaaa

SEQ ID NO: 580010 - DNA, 25 bp, Rattus norvegicus
gaccggctgaaagaaggtgagcttc

SEQ ID NO: 580011 - DNA, 25 bp, Rattus norvegicus
aaggtgagcttcgtaagatcgtgga

SEQ ID NO: 580012 - DNA, 25 bp, Rattus norvegicus
cttcgtaagatcgtggagctgaggt

SEQ ID NO: 580013 - DNA, 25 bp, Rattus norvegicus
cgagctgcccaatgaggctgggtta

SEQ ID NO: 580014 - DNA, 25 bp, Rattus norvegicus
ggctgggttacctcagtattccttc

SEQ ID NO: 580015 - DNA, 25 bp, Rattus norvegicus
ctcagtattccttctccgagacttc

SEQ ID NO: 580016 - DNA, 25 bp, Rattus norvegicus
gacttctctcggatcggctgggaga

SEQ ID NO: 580017 - DNA, 25 bp, Rattus norvegicus
accctgcggaagactagtgcgcctg

SEQ ID NO: 580018 - DNA, 25 bp, Rattus norvegicus
tgggcagaccctgcggaagactagt

SEQ ID NO: 580019 - DNA, 25 bp, Rattus norvegicus
gtacccggccagctctgtctgttca

SEQ ID NO: 580020 - DNA, 25 bp, Rattus norvegicus
ctgttcacagctgtaccgtgtacct

SEQ ID NO: 580021 - DNA, 25 bp, Rattus norvegicus
gtctgttcacagctgtaccgtgtac

SEQ ID NO: 580022 - DNA, 25 bp, Rattus norvegicus
tctgtctgttcacagctgtacagtg

SEQ ID NO: 580023 - DNA, 25 bp, Rattus norvegicus
tctgttcacagctgtaccgtgtacc

SEQ ID NO: 580024 - DNA, 25 bp, Rattus norvegicus
tgtctgttcacagctgtacagtgta

SEQ ID NO: 580025 - DNA, 25 bp, Rattus norvegicus
tctgtctgttcacagctgtaccgtg

SEQ ID NO: 580026 - DNA, 25 bp, Rattus norvegicus
gttcacagctgtaccgtgtacccgg

SEQ ID NO: 580027 - DNA, 25 bp, Rattus norvegicus
cacagctgtaccgtgtacctggccg

SEQ ID NO: 580028 - DNA, 25 bp, Rattus norvegicus
tgttcacagctgtaccgtgtacctg

SEQ ID NO: 580029 - DNA, 25 bp, Rattus norvegicus
ctgttcacagctgtaccgtgtaccc

SEQ ID NO: 580030 - DNA, 25 bp, Rattus norvegicus
ttcacagctgtacagtgtacccggc

SEQ ID NO: 580031 - DNA, 25 bp, Rattus norvegicus
tgtacccggccagctctgtctgttc

SEQ ID NO: 580032 - DNA, 25 bp, Rattus norvegicus
tgtctgttcacagctgtaccgtgta

SEQ ID NO: 580033 - DNA, 25 bp, Rattus norvegicus
tctacttcccgctgcgtcagttaca

SEQ ID NO: 580034 - DNA, 25 bp, Rattus norvegicus
cgccaatgacccagtgtcgcgttga

SEQ ID NO: 580035 - DNA, 25 bp, Rattus norvegicus
acccagtgtcgcgttgaagtccgaa

SEQ ID NO: 580036 - DNA, 25 bp, Rattus norvegicus
tgaagtccgaattcgtcctaggctg

SEQ ID NO: 580037 - DNA, 25 bp, Rattus norvegicus
tccgaattcgtcctaggctgttcca

SEQ ID NO: 580038 - DNA, 25 bp, Rattus norvegicus
caggaacgcgcaggtttcgcctcta

SEQ ID NO: 580039 - DNA, 25 bp, Rattus norvegicus
gtttcgcctctacgcgggtgtcgct

SEQ ID NO: 580040 - DNA, 25 bp, Rattus norvegicus
ccctccaggctatgagttaaggtta

SEQ ID NO: 580041 - DNA, 25 bp, Rattus norvegicus
tgagttaaggttagaaaagcacctc

SEQ ID NO: 580042 - DNA, 25 bp, Rattus norvegicus
acagtcctcaccttgcgccgcgaga

SEQ ID NO: 580043 - DNA, 25 bp, Rattus norvegicus
gcaaaaccacgccaatgacccagtg

SEQ ID NO: 580044 - DNA, 25 bp, Rattus norvegicus
ctcgggcctgcgagtccttctactt

SEQ ID NO: 580045 - DNA, 25 bp, Rattus norvegicus
cacttccggccgctccgaccaatgg

SEQ ID NO: 580046 - DNA, 25 bp, Rattus norvegicus
gcgagacccacgacggtctccgaga

SEQ ID NO: 580047 - DNA, 25 bp, Rattus norvegicus
tctagcacgctcctgtctgccggaa

SEQ ID NO: 580048 - DNA, 25 bp, Rattus norvegicus
agcagcaccagccagtttcgcattg

SEQ ID NO: 580049 - DNA, 25 bp, Rattus norvegicus
cgtgcctgagattctaagccgtaca

SEQ ID NO: 580050 - DNA, 25 bp, Rattus norvegicus
tcccatggagctatgcacgctgtta

SEQ ID NO: 580051 - DNA, 25 bp, Rattus norvegicus
agcatgcgcgtctcttatcagcctg

SEQ ID NO: 580052 - DNA, 25 bp, Rattus norvegicus
tatcagcctgagaagcatgcgcgtc

SEQ ID NO: 580053 - DNA, 25 bp, Rattus norvegicus
cgcgtctctcaccaggctgcagttt

SEQ ID NO: 580054 - DNA, 25 bp, Rattus norvegicus
gctgcagtttcttagcggcacatta

SEQ ID NO: 580055 - DNA, 25 bp, Rattus norvegicus
atgcgcgttcgtcctcacgttaatg

SEQ ID NO: 580056 - DNA, 25 bp, Rattus norvegicus
cacgttaatgcttccctgtagttga

SEQ ID NO: 580057 - DNA, 25 bp, Rattus norvegicus
catgtcctcgaggagcggttgctta

SEQ ID NO: 580058 - DNA, 25 bp, Rattus norvegicus
gagcgcggagtagcatggaatttcc

SEQ ID NO: 580059 - DNA, 25 bp, Rattus norvegicus
ccctctagttagcaacgcctggtga

SEQ ID NO: 580060 - DNA, 25 bp, Rattus norvegicus
agccacgggcctcgctatgaaaagc

SEQ ID NO: 580061 - DNA, 25 bp, Rattus norvegicus
ccgcggttcacttcagactcgttga

SEQ ID NO: 580062 - DNA, 25 bp, Rattus norvegicus
acccggctcgggagaatgagcactc

SEQ ID NO: 580063 - DNA, 25 bp, Rattus norvegicus
ccgcaaacccggctcgggagaatga

SEQ ID NO: 580064 - DNA, 25 bp, Rattus norvegicus
ggagaatgagcactccctgctccct

SEQ ID NO: 580065 - DNA, 25 bp, Rattus norvegicus
tgctccctctggtccttgcgaccgg

SEQ ID NO: 580066 - DNA, 25 bp, Rattus norvegicus
gcgaccggccacgtcccagaactca

SEQ ID NO: 580067 - DNA, 25 bp, Rattus norvegicus
ctccctggccgtgtgaacccgcaaa

SEQ ID NO: 580068 - DNA, 25 bp, Rattus norvegicus
cgacatacttgtcgccgcggttcac

SEQ ID NO: 580069 - DNA, 25 bp, Rattus norvegicus
cagactcgttgagaggtctgaagcg

SEQ ID NO: 580070 - DNA, 25 bp, Rattus norvegicus
tccctggaacttggcgacatacttg

SEQ ID NO: 580071 - DNA, 25 bp, Rattus norvegicus
accgtgtcttctccctggaacttgg

SEQ ID NO: 580072 - DNA, 25 bp, Rattus norvegicus
atcatcaccgtgtcttctccctgga

SEQ ID NO: 580073 - DNA, 25 bp, Rattus norvegicus
ggacagggccactcaccgcaatcat

SEQ ID NO: 580074 - DNA, 25 bp, Rattus norvegicus
tgacgtggggacagggccactcacc

SEQ ID NO: 580075 - DNA, 25 bp, Rattus norvegicus
tttggtctagctgcctggggctcgc

SEQ ID NO: 580076 - DNA, 25 bp, Rattus norvegicus
cttatcccactgagcggcggggagt

SEQ ID NO: 580077 - DNA, 25 bp, Rattus norvegicus
ctgcttcttggctcccgtcgcttat

SEQ ID NO: 580078 - DNA, 25 bp, Rattus norvegicus
atagcgctttggtctagctgcctgg

SEQ ID NO: 580079 - DNA, 25 bp, Rattus norvegicus
ctgccggtgatagcgctttggtcta

SEQ ID NO: 580080 - DNA, 25 bp, Rattus norvegicus
cgccatgatggagcggaagtgaact

SEQ ID NO: 580081 - DNA, 25 bp, Rattus norvegicus
acgctgaggagcactgaggcgctgt

SEQ ID NO: 580082 - DNA, 25 bp, Rattus norvegicus
ggacaggatagtgggccgagccata

SEQ ID NO: 580083 - DNA, 25 bp, Rattus norvegicus
gcctttgagggtgtgagtgtcagct

SEQ ID NO: 580084 - DNA, 25 bp, Rattus norvegicus
cgccagcctgggcactaaggccttt

SEQ ID NO: 580085 - DNA, 25 bp, Rattus norvegicus
agcttgccgccagcctgggcactaa

SEQ ID NO: 580086 - DNA, 25 bp, Rattus norvegicus
ctgccgccatgaccgccatgatgga

SEQ ID NO: 580087 - DNA, 25 bp, Rattus norvegicus
cgtcgcttatcccactgagcggcgg

SEQ ID NO: 580088 - DNA, 25 bp, Rattus norvegicus
cggtcgcaggcttggattggctgct

SEQ ID NO: 580089 - DNA, 25 bp, Rattus norvegicus
catcaaagtgatgtgtcgcttcaga

SEQ ID NO: 580090 - DNA, 25 bp, Rattus norvegicus
ctgccagaaagatggcggacccggc

SEQ ID NO: 580091 - DNA, 25 bp, Rattus norvegicus
cggctgccagaaagatggcggaccc

SEQ ID NO: 580092 - DNA, 25 bp, Rattus norvegicus
tcccggctgccagaaagatggcgga

SEQ ID NO: 580093 - DNA, 25 bp, Rattus norvegicus
aaagtgatgtgtcgcttcagacctc

SEQ ID NO: 580094 - DNA, 25 bp, Rattus norvegicus
tgcagtcccggctgccagaaagatg

SEQ ID NO: 580095 - DNA, 25 bp, Rattus norvegicus
acccggcggagtgcaacatcaaagt

SEQ ID NO: 580096 - DNA, 25 bp, Rattus norvegicus
ccggcggagtgcaacatcaaagtga

SEQ ID NO: 580097 - DNA, 25 bp, Rattus norvegicus
cggagtgcaacatcaaagtgatgtg

SEQ ID NO: 580098 - DNA, 25 bp, Rattus norvegicus
tcaaagtgatgtgtcgcttcagacc

SEQ ID NO: 580099 - DNA, 25 bp, Rattus norvegicus
cggacccggcggagtgcaacatcaa

SEQ ID NO: 580100 - DNA, 25 bp, Rattus norvegicus
agtcccggctgccagaaagatggcg

SEQ ID NO: 580101 - DNA, 25 bp, Rattus norvegicus
cggcggagtgcaacatcaaagtgat

SEQ ID NO: 580102 - DNA, 25 bp, Rattus norvegicus
ctgcagtcccggctgccagaaagat

SEQ ID NO: 580103 - DNA, 25 bp, Rattus norvegicus
gacactaagcgcagttgccagtctg

SEQ ID NO: 580104 - DNA, 25 bp, Rattus norvegicus
attcttggctaccttgcccggtgcg

SEQ ID NO: 580105 - DNA, 25 bp, Rattus norvegicus
tagggcgccattaagcctcagacgg

SEQ ID NO: 580106 - DNA, 25 bp, Rattus norvegicus
agtgttgacgcccactcgtccgtga

SEQ ID NO: 580107 - DNA, 25 bp, Rattus norvegicus
tgccagtctgtggaccctagagcta

SEQ ID NO: 580108 - DNA, 25 bp, Rattus norvegicus
ctcatgccaatagaagtgcgacacg

SEQ ID NO: 580109 - DNA, 25 bp, Rattus norvegicus
taattcctttacacagcccagcctg

SEQ ID NO: 580110 - DNA, 25 bp, Rattus norvegicus
acttgactctggtctcagcctgggc

SEQ ID NO: 580111 - DNA, 25 bp, Rattus norvegicus
gtcgcaaggtctccaaccctaggta

SEQ ID NO: 580112 - DNA, 25 bp, Rattus norvegicus
tcttcaggcggtttctcagtcgctc

SEQ ID NO: 580113 - DNA, 25 bp, Rattus norvegicus
gaagcgtctcgcactccctcttagg

SEQ ID NO: 580114 - DNA, 25 bp, Rattus norvegicus
ctccgctcatcacgtgggtactctg

SEQ ID NO: 580115 - DNA, 25 bp, Rattus norvegicus
tgcgccctttgctgcttaggacttg

SEQ ID NO: 580116 - DNA, 25 bp, Rattus norvegicus
tgcgacacgtttaccgacactaagc

SEQ ID NO: 580117 - DNA, 25 bp, Rattus norvegicus
ggaaagatccttgtggccgcccact

SEQ ID NO: 580118 - DNA, 25 bp, Rattus norvegicus
acgtcccttctcttctaggtcttgg

SEQ ID NO: 580119 - DNA, 25 bp, Rattus norvegicus
cttccctgtgcactcggcattttta

SEQ ID NO: 580120 - DNA, 25 bp, Rattus norvegicus
aggctggctgaaatgtgtggaatcc

SEQ ID NO: 580121 - DNA, 25 bp, Rattus norvegicus
ccgccgggttcattgtgtttacgag

SEQ ID NO: 580122 - DNA, 25 bp, Rattus norvegicus
ttcggcgttgccacatttcttaacc

SEQ ID NO: 580123 - DNA, 25 bp, Rattus norvegicus
tattctcgggagaggacgtcccttc

SEQ ID NO: 580124 - DNA, 25 bp, Rattus norvegicus
tgcccacggttgcaacctaaagttc

SEQ ID NO: 580125 - DNA, 25 bp, Rattus norvegicus
gccggttctgctttcgttgagcttg

SEQ ID NO: 580126 - DNA, 25 bp, Rattus norvegicus
ttaccacgtggacctcgcttacagc

SEQ ID NO: 580127 - DNA, 25 bp, Rattus norvegicus
atggctgccgcacttcctaactgag

SEQ ID NO: 580128 - DNA, 25 bp, Rattus norvegicus
cggtgtctcccaaggctgtggaaaa

SEQ ID NO: 580129 - DNA, 25 bp, Rattus norvegicus
ggccacggtcgctgtatattgtccc

SEQ ID NO: 580130 - DNA, 25 bp, Rattus norvegicus
tattgtccctaagtgcgcttgcgcc

SEQ ID NO: 580131 - DNA, 25 bp, Rattus norvegicus
caccacccacctggacggccacgca

SEQ ID NO: 580132 - DNA, 25 bp, Rattus norvegicus
ggcgcacctgctacaccagggtcta

SEQ ID NO: 580133 - DNA, 25 bp, Rattus norvegicus
taccctggacgaggaccagtcacca

SEQ ID NO: 580134 - DNA, 25 bp, Rattus norvegicus
actctaccctggacgaggaccagtc

SEQ ID NO: 580135 - DNA, 25 bp, Rattus norvegicus
tggctgagcaaagccactctaccct

SEQ ID NO: 580136 - DNA, 25 bp, Rattus norvegicus
aaccctgcgtcctgtctgcctgtgt

SEQ ID NO: 580137 - DNA, 25 bp, Rattus norvegicus
agggacgaaccctgcgtcctgtctg

SEQ ID NO: 580138 - DNA, 25 bp, Rattus norvegicus
ctctaccgcgggctaccctggaaga

SEQ ID NO: 580139 - DNA, 25 bp, Rattus norvegicus
gtggttacaaccagaccaagctcta

SEQ ID NO: 580140 - DNA, 25 bp, Rattus norvegicus
accgctgtgtgcagtgtggttacaa

SEQ ID NO: 580141 - DNA, 25 bp, Rattus norvegicus
tgcgaaccgcagctaccgctgtgtg

SEQ ID NO: 580142 - DNA, 25 bp, Rattus norvegicus
cgaatcaatgaacggccggatggcc

SEQ ID NO: 580143 - DNA, 25 bp, Rattus norvegicus
aggagtcagagctcgcgaatcaatg

SEQ ID NO: 580144 - DNA, 25 bp, Rattus norvegicus
caccagggtctagcgctcagtatgg

SEQ ID NO: 580145 - DNA, 25 bp, Rattus norvegicus
ttctctggacgacacattgatgcca

SEQ ID NO: 580146 - DNA, 25 bp, Rattus norvegicus
cacggttgccacttaaacaggattt

SEQ ID NO: 580147 - DNA, 25 bp, Rattus norvegicus
ctctggacgacacattgatgccatc

SEQ ID NO: 580148 - DNA, 25 bp, Rattus norvegicus
aattctctggacgacacattgatgc

SEQ ID NO: 580149 - DNA, 25 bp, Rattus norvegicus
tcctaattctctggacgacacattg

SEQ ID NO: 580150 - DNA, 25 bp, Rattus norvegicus
ggatttcctaattctctggacgaca

SEQ ID NO: 580151 - DNA, 25 bp, Rattus norvegicus
acaggatttcctaattctctggacg

SEQ ID NO: 580152 - DNA, 25 bp, Rattus norvegicus
gttgccacttaaacaggatttccta

SEQ ID NO: 580153 - DNA, 25 bp, Rattus norvegicus
ccacggttgccacttaaacaggatt

SEQ ID NO: 580154 - DNA, 25 bp, Rattus norvegicus
cgccacggttgccacttaaacagga

SEQ ID NO: 580155 - DNA, 25 bp, Rattus norvegicus
cgcgccacggttgccacttaaacag

SEQ ID NO: 580156 - DNA, 25 bp, Rattus norvegicus
gcgcgccacggttgccacttaaaca

SEQ ID NO: 580157 - DNA, 25 bp, Rattus norvegicus
ggcgcgccacggttgccacttaaac

SEQ ID NO: 580158 - DNA, 25 bp, Rattus norvegicus
tgccacttaaacaggatttcctaat

SEQ ID NO: 580159 - DNA, 25 bp, Rattus norvegicus
aagtgcggaaagaagcaacagccgc

SEQ ID NO: 580160 - DNA, 25 bp, Rattus norvegicus
cacgccctgtggcagcagccaggag

SEQ ID NO: 580161 - DNA, 25 bp, Rattus norvegicus
gctgtccgggtgtcccgacctgtct

SEQ ID NO: 580162 - DNA, 25 bp, Rattus norvegicus
ggtgtcccgacctgtctgtgctgtt

SEQ ID NO: 580163 - DNA, 25 bp, Rattus norvegicus
tgtctgtgctgtttcccggcccgca

SEQ ID NO: 580164 - DNA, 25 bp, Rattus norvegicus
cgctccacccgcgggcggaaaagtg

SEQ ID NO: 580165 - DNA, 25 bp, Rattus norvegicus
cgagtccacgcacacacacgccctg

SEQ ID NO: 580166 - DNA, 25 bp, Rattus norvegicus
cacgcgcgcacggtcgacacgcagc

SEQ ID NO: 580167 - DNA, 25 bp, Rattus norvegicus
cgacacgcagccgacacgcaactgg

SEQ ID NO: 580168 - DNA, 25 bp, Rattus norvegicus
ccgacacgcaactggcccgcgaccg

SEQ ID NO: 580169 - DNA, 25 bp, Rattus norvegicus
ccgaggggcagcaagagtggagaaa

SEQ ID NO: 580170 - DNA, 25 bp, Rattus norvegicus
ggagaaagtgcggaaagaagcaaca

SEQ ID NO: 580171 - DNA, 25 bp, Rattus norvegicus
ggcagcagccaggagccgccagagc

SEQ ID NO: 580172 - DNA, 25 bp, Rattus norvegicus
aggcggcgagtccacgcacacacac

SEQ ID NO: 580173 - DNA, 25 bp, Rattus norvegicus
ggggctttacgacatcaccttccta

SEQ ID NO: 580174 - DNA, 25 bp, Rattus norvegicus
acaaccaggacttgtcgcgcgcgag

SEQ ID NO: 580175 - DNA, 25 bp, Rattus norvegicus
ctctacggccggaaccttgttgcta

SEQ ID NO: 580176 - DNA, 25 bp, Rattus norvegicus
tggtttgcggcagccttagacgctg

SEQ ID NO: 580177 - DNA, 25 bp, Rattus norvegicus
tagacgctgcggagtttgaatcgtg

SEQ ID NO: 580178 - DNA, 25 bp, Rattus norvegicus
agcggagaacggttcagggactcta

SEQ ID NO: 580179 - DNA, 25 bp, Rattus norvegicus
gcgagctacctgacccgttgtgcct

SEQ ID NO: 580180 - DNA, 25 bp, Rattus norvegicus
ttcagggactctagggacaggaacg

SEQ ID NO: 580181 - DNA, 25 bp, Rattus norvegicus
aggctgcagcatggcttcctaggcc

SEQ ID NO: 580182 - DNA, 25 bp, Rattus norvegicus
cttcctaggccaggtggagctgtag

SEQ ID NO: 580183 - DNA, 25 bp, Rattus norvegicus
agctgtaggcatgggccacacccgc

SEQ ID NO: 580184 - DNA, 25 bp, Rattus norvegicus
tggagtgcgcactctgcggacccgc

SEQ ID NO: 580185 - DNA, 25 bp, Rattus norvegicus
gggacgtggacaaccaggacttgtc

SEQ ID NO: 580186 - DNA, 25 bp, Rattus norvegicus
cgcacctggtttacgacactcgggg

SEQ ID NO: 580187 - DNA, 25 bp, Rattus norvegicus
ggtcgcgctttgacacctgcctaga

SEQ ID NO: 580188 - DNA, 25 bp, Rattus norvegicus
tgctctaagccctgtgggtttcaca

SEQ ID NO: 580189 - DNA, 25 bp, Rattus norvegicus
agcccacgcgtcttttgctctaagc

SEQ ID NO: 580190 - DNA, 25 bp, Rattus norvegicus
ccagatgctctttactgttcccagc

SEQ ID NO: 580191 - DNA, 25 bp, Rattus norvegicus
aggatccggtgcgtactctgaaagc

SEQ ID NO: 580192 - DNA, 25 bp, Rattus norvegicus
ctaagttgcgatttggagaaggatc

SEQ ID NO: 580193 - DNA, 25 bp, Rattus norvegicus
tatccctcgggcttataggaaaaga

SEQ ID NO: 580194 - DNA, 25 bp, Rattus norvegicus
gagcccactcaggtcgcagcttcat

SEQ ID NO: 580195 - DNA, 25 bp, Rattus norvegicus
ttgacacctgcctagagtcccgggg

SEQ ID NO: 580196 - DNA, 25 bp, Rattus norvegicus
tgctccctggggagcaccagattcg

SEQ ID NO: 580197 - DNA, 25 bp, Rattus norvegicus
ttcacacgggttcccagacgggtgc

SEQ ID NO: 580198 - DNA, 25 bp, Rattus norvegicus
agacgcagttttctctaagtaacct

SEQ ID NO: 580199 - DNA, 25 bp, Rattus norvegicus
gggttccagcagtgctccgattgtg

SEQ ID NO: 580200 - DNA, 25 bp, Rattus norvegicus
tccgattgtgtctggttctcaggcc

SEQ ID NO: 580201 - DNA, 25 bp, Rattus norvegicus
gtggtctctccctttctgtcaatcg

SEQ ID NO: 580202 - DNA, 25 bp, Rattus norvegicus
tccactcttagtgggcgtgtctctc

SEQ ID NO: 580203 - DNA, 25 bp, Rattus norvegicus
tgagacagcgcaaaggaccatggga

SEQ ID NO: 580204 - DNA, 25 bp, Rattus norvegicus
cccggcggagaacagtgtctgttac

SEQ ID NO: 580205 - DNA, 25 bp, Rattus norvegicus
tgtctgttaccaaacgtgtagcagt

SEQ ID NO: 580206 - DNA, 25 bp, Rattus norvegicus
cggaaggcagtatctgaggaaaaac

SEQ ID NO: 580207 - DNA, 25 bp, Rattus norvegicus
acttgatttgatcccgtggtctctc

SEQ ID NO: 580208 - DNA, 25 bp, Rattus norvegicus
tgaagagtggcagactaagtacgcc

SEQ ID NO: 580209 - DNA, 25 bp, Rattus norvegicus
agtacgccagcctgcgaagctcaca

SEQ ID NO: 580210 - DNA, 25 bp, Rattus norvegicus
tgacgcgtacgcagtaggaaaactg

SEQ ID NO: 580211 - DNA, 25 bp, Rattus norvegicus
aactgtaagtttggcgaggatcctg

SEQ ID NO: 580212 - DNA, 25 bp, Rattus norvegicus
ccagcttatggaggcgaggctgttc

SEQ ID NO: 580213 - DNA, 25 bp, Rattus norvegicus
tgttccagagcctggccggctcttt

SEQ ID NO: 580214 - DNA, 25 bp, Rattus norvegicus
gcccgggcgagaacttgatttgatc

SEQ ID NO: 580215 - DNA, 25 bp, Rattus norvegicus
tggcgacaaataacgcggctaattc

SEQ ID NO: 580216 - DNA, 25 bp, Rattus norvegicus
gctaattcttctcgccctgctggtc

SEQ ID NO: 580217 - DNA, 25 bp, Rattus norvegicus
ctgctggtccctgcgcacagggaca

SEQ ID NO: 580218 - DNA, 25 bp, Rattus norvegicus
ccgccgcgcctttcagagttaatta

SEQ ID NO: 580219 - DNA, 25 bp, Rattus norvegicus
gccctcatgaatatggatgcctctg

SEQ ID NO: 580220 - DNA, 25 bp, Rattus norvegicus
gcctctgccaatttaatacggttga

SEQ ID NO: 580221 - DNA, 25 bp, Rattus norvegicus
gtcataacctgacctcggcgaggcg

SEQ ID NO: 580222 - DNA, 25 bp, Rattus norvegicus
cgtgcagaaagaaaagacgactttt

SEQ ID NO: 580223 - DNA, 25 bp, Rattus norvegicus
tgaaaggctgttgtagactgtgcgc

SEQ ID NO: 580224 - DNA, 25 bp, Rattus norvegicus
ctctgcacgcccagggaacagtggc

SEQ ID NO: 580225 - DNA, 25 bp, Rattus norvegicus
caggagcagggcctaattacctaca

SEQ ID NO: 580226 - DNA, 25 bp, Rattus norvegicus
ttacctacaggtacgtgcggggcag

SEQ ID NO: 580227 - DNA, 25 bp, Rattus norvegicus
gcgcggcgatcaggctaaataagca

SEQ ID NO: 580228 - DNA, 25 bp, Rattus norvegicus
cacgtgttgctaggctggcgacaaa

SEQ ID NO: 580229 - DNA, 25 bp, Rattus norvegicus
ctgtgtctcagtgtctctttgctta

SEQ ID NO: 580230 - DNA, 25 bp, Rattus norvegicus
tatctcagagcaagggcctgttcca

SEQ ID NO: 580231 - DNA, 25 bp, Rattus norvegicus
ttaggggtccagtcgagagaatatc

SEQ ID NO: 580232 - DNA, 25 bp, Rattus norvegicus
ttccgggtctcctcgtaggaagagc

SEQ ID NO: 580233 - DNA, 25 bp, Rattus norvegicus
tgtggcgtttacagtgtccaaacta

SEQ ID NO: 580234 - DNA, 25 bp, Rattus norvegicus
catcgctctccggtcctatagtgtc

SEQ ID NO: 580235 - DNA, 25 bp, Rattus norvegicus
ctgggccagatcctaaaagctgtgc

SEQ ID NO: 580236 - DNA, 25 bp, Rattus norvegicus
tgtagggcgcaactcagcaaggaca

SEQ ID NO: 580237 - DNA, 25 bp, Rattus norvegicus
tccttacctggaggctagcaaatcc

SEQ ID NO: 580238 - DNA, 25 bp, Rattus norvegicus
tgggtggttcacttcgctccttacc

SEQ ID NO: 580239 - DNA, 25 bp, Rattus norvegicus
caagatcacgacttcccgcgggaca

SEQ ID NO: 580240 - DNA, 25 bp, Rattus norvegicus
gctctcccgagtctcctagacaaga

SEQ ID NO: 580241 - DNA, 25 bp, Rattus norvegicus
ggcacgcaaaggcatcccgaggact

SEQ ID NO: 580242 - DNA, 25 bp, Rattus norvegicus
gactgcttcactctcccggcaagga

SEQ ID NO: 580243 - DNA, 25 bp, Rattus norvegicus
agaggttcccgcatactgtcccgcg

SEQ ID NO: 580244 - DNA, 25 bp, Rattus norvegicus
gagcgacccaaacggacggctgcca

SEQ ID NO: 580245 - DNA, 25 bp, Rattus norvegicus
caatatccgggctagagaagttggg

SEQ ID NO: 580246 - DNA, 25 bp, Rattus norvegicus
gggacccaacaatatccgggctaga

SEQ ID NO: 580247 - DNA, 25 bp, Rattus norvegicus
tcacgccaaggcagggacccaacaa

SEQ ID NO: 580248 - DNA, 25 bp, Rattus norvegicus
cctgctactactcggcggagcatgc

SEQ ID NO: 580249 - DNA, 25 bp, Rattus norvegicus
gggcgtcccttcacgccaaggcagg

SEQ ID NO: 580250 - DNA, 25 bp, Rattus norvegicus
tcgggagctaacaccagccgggcct

SEQ ID NO: 580251 - DNA, 25 bp, Rattus norvegicus
ccgggactgtcagtcctggaatgga

SEQ ID NO: 580252 - DNA, 25 bp, Rattus norvegicus
cgtgggaaccgggactgtcagtcct

SEQ ID NO: 580253 - DNA, 25 bp, Rattus norvegicus
ttgagccgcttagcggtctgccagc

SEQ ID NO: 580254 - DNA, 25 bp, Rattus norvegicus
ggctccgtcccgttgagccgcttag

SEQ ID NO: 580255 - DNA, 25 bp, Rattus norvegicus
taccgagaggttcccgcatactgtc

SEQ ID NO: 580256 - DNA, 25 bp, Rattus norvegicus
gctgccaggacttaccgagaggttc

SEQ ID NO: 580257 - DNA, 25 bp, Rattus norvegicus
gaaggctgttcttcgctcccgacgc

SEQ ID NO: 580258 - DNA, 25 bp, Rattus norvegicus
tgtcacggcagcaggaagtaaacgc

SEQ ID NO: 580259 - DNA, 25 bp, Rattus norvegicus
taaacgccagaggtcagccggcttc

SEQ ID NO: 580260 - DNA, 25 bp, Rattus norvegicus
atgcgcgccgagagactgcgacaac

SEQ ID NO: 580261 - DNA, 25 bp, Rattus norvegicus
ctccttctctgggaacacaggggca

SEQ ID NO: 580262 - DNA, 25 bp, Rattus norvegicus
tgcctggaaatagagtgcgggactc

SEQ ID NO: 580263 - DNA, 25 bp, Rattus norvegicus
acgccgcgagcagccattgtcacgg

SEQ ID NO: 580264 - DNA, 25 bp, Rattus norvegicus
ctcgcgactctggttcctggacaac

SEQ ID NO: 580265 - DNA, 25 bp, Rattus norvegicus
tgtccctgtctaaacaatttcacgg

SEQ ID NO: 580266 - DNA, 25 bp, Rattus norvegicus
tccacagtaacaggcgggagaccag

SEQ ID NO: 580267 - DNA, 25 bp, Rattus norvegicus
ggctgtcgtcctccacagtaacagg

SEQ ID NO: 580268 - DNA, 25 bp, Rattus norvegicus
ttcacggttttatacggctgtcgtc

SEQ ID NO: 580269 - DNA, 25 bp, Rattus norvegicus
tgtgttgaacaactgtgtccctgtc

SEQ ID NO: 580270 - DNA, 25 bp, Rattus norvegicus
cctggacaactgaggtgcctggaaa

SEQ ID NO: 580271 - DNA, 25 bp, Rattus norvegicus
ggggaggatctggaaccgcaaactc

SEQ ID NO: 580272 - DNA, 25 bp, Rattus norvegicus
aacactcaggtaacagggcttgggg

SEQ ID NO: 580273 - DNA, 25 bp, Rattus norvegicus
cagagactgggagagcgcgtcttcc

SEQ ID NO: 580274 - DNA, 25 bp, Rattus norvegicus
tacacagattgggaacacaagctca

SEQ ID NO: 580275 - DNA, 25 bp, Rattus norvegicus
cgaggtcgcgctccatacacagatt

SEQ ID NO: 580276 - DNA, 25 bp, Rattus norvegicus
tccgggcgggcacacggaacactca

SEQ ID NO: 580277 - DNA, 25 bp, Rattus norvegicus
ggccagttcagacgccgagagtccg

SEQ ID NO: 580278 - DNA, 25 bp, Rattus norvegicus
tgggaggacggaatttcccatcgcg

SEQ ID NO: 580279 - DNA, 25 bp, Rattus norvegicus
tggacgggagcacacgcactcaccg

SEQ ID NO: 580280 - DNA, 25 bp, Rattus norvegicus
accagtcagtgtcggtctgggctga

SEQ ID NO: 580281 - DNA, 25 bp, Rattus norvegicus
tggaaagcaccttgctccgggccgc

SEQ ID NO: 580282 - DNA, 25 bp, Rattus norvegicus
cgctgcacgcaggtacagctggaaa

SEQ ID NO: 580283 - DNA, 25 bp, Rattus norvegicus
gtgcctcccaccaggggacactggg

SEQ ID NO: 580284 - DNA, 25 bp, Rattus norvegicus
ggttcccactctgaaacggagcgtg

SEQ ID NO: 580285 - DNA, 25 bp, Rattus norvegicus
ctccaccagagtgaggagccgagag

SEQ ID NO: 580286 - DNA, 25 bp, Rattus norvegicus
gaccgacccggtggaaactgatctc

SEQ ID NO: 580287 - DNA, 25 bp, Rattus norvegicus
ctcggcgctctgtctgaagctggaa

SEQ ID NO: 580288 - DNA, 25 bp, Rattus norvegicus
cgccgagtctcaacgtgggcaagca

SEQ ID NO: 580289 - DNA, 25 bp, Rattus norvegicus
gaagactcgcgagaacgtgcgccga

SEQ ID NO: 580290 - DNA, 25 bp, Rattus norvegicus
aaggctgccgctttccgccagggca

SEQ ID NO: 580291 - DNA, 25 bp, Rattus norvegicus
tttcaagccgcagaagccgggaggt

SEQ ID NO: 580292 - DNA, 25 bp, Rattus norvegicus
ggtcgtgccaagttttcaagccgca

SEQ ID NO: 580293 - DNA, 25 bp, Rattus norvegicus
aacaagttccgtgaggtcgtgccaa

SEQ ID NO: 580294 - DNA, 25 bp, Rattus norvegicus
ctcgtcaaagcataacaagttccgt

SEQ ID NO: 580295 - DNA, 25 bp, Rattus norvegicus
cactcccttgcgaccgcgggaaaat

SEQ ID NO: 580296 - DNA, 25 bp, Rattus norvegicus
aggaccttcccatcatgccgcggga

SEQ ID NO: 580297 - DNA, 25 bp, Rattus norvegicus
ctccaggagactcaaaggaccttcc

SEQ ID NO: 580298 - DNA, 25 bp, Rattus norvegicus
atccggaattgaaccgagctcggca

SEQ ID NO: 580299 - DNA, 25 bp, Rattus norvegicus
gcagccagcgtctctgccgtaaata

SEQ ID NO: 580300 - DNA, 25 bp, Rattus norvegicus
gagcccaacggagtctggtcatctc

SEQ ID NO: 580301 - DNA, 25 bp, Rattus norvegicus
tggtcatctcccgaccctgagttta

SEQ ID NO: 580302 - DNA, 25 bp, Rattus norvegicus
ccctgagtttaggagttcgccattg

SEQ ID NO: 580303 - DNA, 25 bp, Rattus norvegicus
gggccgtggaatcgaccaccgcaaa

SEQ ID NO: 580304 - DNA, 25 bp, Rattus norvegicus
caagtccgggcactcagttccacgg

SEQ ID NO: 580305 - DNA, 25 bp, Rattus norvegicus
agttccacggcactcacctttggtg

SEQ ID NO: 580306 - DNA, 25 bp, Rattus norvegicus
acctttggtgagcagcacagccatg

SEQ ID NO: 580307 - DNA, 25 bp, Rattus norvegicus
ccaactgcagccagatgaagatgta

SEQ ID NO: 580308 - DNA, 25 bp, Rattus norvegicus
cccgagcatggagcaggactaaaac

SEQ ID NO: 580309 - DNA, 25 bp, Rattus norvegicus
ctctccgattggctgacgcctcttg

SEQ ID NO: 580310 - DNA, 25 bp, Rattus norvegicus
agctggagtggcgatccattgacgc

SEQ ID NO: 580311 - DNA, 25 bp, Rattus norvegicus
gagttagacgtatccgcggcgagaa

SEQ ID NO: 580312 - DNA, 25 bp, Rattus norvegicus
ctactgaggacacgtttgtggctcc

SEQ ID NO: 580313 - DNA, 25 bp, Rattus norvegicus
tttgcccgacacacgccctccgctc

SEQ ID NO: 580314 - DNA, 25 bp, Rattus norvegicus
ggggctccgggctttgcccgacaca

SEQ ID NO: 580315 - DNA, 25 bp, Rattus norvegicus
gctccaggaggcagtcgtcctccgg

SEQ ID NO: 580316 - DNA, 25 bp, Rattus norvegicus
ccttgcagacaaggccgctgcggcg

SEQ ID NO: 580317 - DNA, 25 bp, Rattus norvegicus
gctcccgagggagccttgcagacaa

SEQ ID NO: 580318 - DNA, 25 bp, Rattus norvegicus
tgccattactgtgcgccgaggccgc

SEQ ID NO: 580319 - DNA, 25 bp, Rattus norvegicus
cgctgccattactgtgcgccgaggc

SEQ ID NO: 580320 - DNA, 25 bp, Rattus norvegicus
cccgcaggcgtgaaggacgaagccc

SEQ ID NO: 580321 - DNA, 25 bp, Rattus norvegicus
caacccgcaggcgtgaaggacgaag

SEQ ID NO: 580322 - DNA, 25 bp, Rattus norvegicus
cttctgcaaaagcagggcgagggca

SEQ ID NO: 580323 - DNA, 25 bp, Rattus norvegicus
gctttcaaccggtttaccttctgca

SEQ ID NO: 580324 - DNA, 25 bp, Rattus norvegicus
gaagggaagtttccctgcatccgca

SEQ ID NO: 580325 - DNA, 25 bp, Rattus norvegicus
ggcctccggctctcagcccgctccc

SEQ ID NO: 580326 - DNA, 25 bp, Rattus norvegicus
cggctcacagcgctgccattactgt

SEQ ID NO: 580327 - DNA, 25 bp, Rattus norvegicus
taacgtgccctgtttcttcagaaag

SEQ ID NO: 580328 - DNA, 25 bp, Rattus norvegicus
tgcacgccaccgttctagagtaagg

SEQ ID NO: 580329 - DNA, 25 bp, Rattus norvegicus
cgcagaggatgtaccttccggtttc

SEQ ID NO: 580330 - DNA, 25 bp, Rattus norvegicus
tagtcatccgcctcaacaaggcttc

SEQ ID NO: 580331 - DNA, 25 bp, Rattus norvegicus
cagagttcgggcctgcaactttttt

SEQ ID NO: 580332 - DNA, 25 bp, Rattus norvegicus
gaggccgcgacaaccgcatcagagc

SEQ ID NO: 580333 - DNA, 25 bp, Rattus norvegicus
ccgtaatcagtgacgaggtccgcta

SEQ ID NO: 580334 - DNA, 25 bp, Rattus norvegicus
ccgttcttcgtcttggtgtcggcga

SEQ ID NO: 580335 - DNA, 25 bp, Rattus norvegicus
gtcggcgaaaaagcctgccttcaga

SEQ ID NO: 580336 - DNA, 25 bp, Rattus norvegicus
gccgctcctgcttcttagtctgaca

SEQ ID NO: 580337 - DNA, 25 bp, Rattus norvegicus
gggactccacgatccagccattttg

SEQ ID NO: 580338 - DNA, 25 bp, Rattus norvegicus
gctccagcgttgtgtacgcgatgta

SEQ ID NO: 580339 - DNA, 25 bp, Rattus norvegicus
tcttcagaaagggtggctcagggac

SEQ ID NO: 580340 - DNA, 25 bp, Rattus norvegicus
tctgacaggaaaagggcgtcggtcc

SEQ ID NO: 580341 - DNA, 25 bp, Rattus norvegicus
tggtccaaggaacagctttccaatc

SEQ ID NO: 580342 - DNA, 25 bp, Rattus norvegicus
ccttcctagcgttgagctgtagatg

SEQ ID NO: 580343 - DNA, 25 bp, Rattus norvegicus
catattccttcctagcgttgagctg

SEQ ID NO: 580344 - DNA, 25 bp, Rattus norvegicus
ctcttcttggacagcaggtggcgct

SEQ ID NO: 580345 - DNA, 25 bp, Rattus norvegicus
agctgtagatgtggcgtagcctgct

SEQ ID NO: 580346 - DNA, 25 bp, Rattus norvegicus
tccaatcctgcacgcagggaggaag

SEQ ID NO: 580347 - DNA, 25 bp, Rattus norvegicus
gaggggccctccatattccttccta

SEQ ID NO: 580348 - DNA, 25 bp, Rattus norvegicus
cagctttccaatcctgcacgcaggg

SEQ ID NO: 580349 - DNA, 25 bp, Rattus norvegicus
aaggacgccagattgcaggtggcta

SEQ ID NO: 580350 - DNA, 25 bp, Rattus norvegicus
gtgcgggtcaccaactggtccaagg

SEQ ID NO: 580351 - DNA, 25 bp, Rattus norvegicus
actctatgaacaggctggtgcgcga

SEQ ID NO: 580352 - DNA, 25 bp, Rattus norvegicus
cccggctgtctgcactctatgaaca

SEQ ID NO: 580353 - DNA, 25 bp, Rattus norvegicus
taacgcccggctgtctgcactctat

SEQ ID NO: 580354 - DNA, 25 bp, Rattus norvegicus
aggcgttgcttcctcttcttggaca

SEQ ID NO: 580355 - DNA, 25 bp, Rattus norvegicus
acctcgccatctcggttgctgactg

SEQ ID NO: 580356 - DNA, 25 bp, Rattus norvegicus
atctcggttgctgactgacctcgcc

SEQ ID NO: 580357 - DNA, 25 bp, Rattus norvegicus
ccatctcggttgctgactgacctca

SEQ ID NO: 580358 - DNA, 25 bp, Rattus norvegicus
ctgacctcgccagctcggttgctga

SEQ ID NO: 580359 - DNA, 25 bp, Rattus norvegicus
acctcgccagctcggttgctgactg

SEQ ID NO: 580360 - DNA, 25 bp, Rattus norvegicus
tcggttgctgactgacctcaccatc

SEQ ID NO: 580361 - DNA, 25 bp, Rattus norvegicus
accatctcggttgctgactgacctc

SEQ ID NO: 580362 - DNA, 25 bp, Rattus norvegicus
ctcgccatctcggttgctgactgac

SEQ ID NO: 580363 - DNA, 25 bp, Rattus norvegicus
ctgacctcaccagctcggttgctga

SEQ ID NO: 580364 - DNA, 25 bp, Rattus norvegicus
tcggttgctgactgacctcgccagc

SEQ ID NO: 580365 - DNA, 25 bp, Rattus norvegicus
tcgccatctcggttgctgactgacc

SEQ ID NO: 580366 - DNA, 25 bp, Rattus norvegicus
cggttgctgactgacctcgccatct

SEQ ID NO: 580367 - DNA, 25 bp, Rattus norvegicus
gctcggttgctgactgacctcacca

SEQ ID NO: 580368 - DNA, 25 bp, Rattus norvegicus
tcggttgctgactgacctcaccagc

SEQ ID NO: 580369 - DNA, 25 bp, Rattus norvegicus
ccggtctgcaccagttctaggtccg

SEQ ID NO: 580370 - DNA, 25 bp, Rattus norvegicus
agggaggagaatacctgccaggctc

SEQ ID NO: 580371 - DNA, 25 bp, Rattus norvegicus
gtgaggaaacaccaacctggagaac

SEQ ID NO: 580372 - DNA, 25 bp, Rattus norvegicus
cccgtgaggaaacaccaacctggag

SEQ ID NO: 580373 - DNA, 25 bp, Rattus norvegicus
tgcaccagttctaggtccgcgcctt

SEQ ID NO: 580374 - DNA, 25 bp, Rattus norvegicus
gggaagggcccagttaatgtccaga

SEQ ID NO: 580375 - DNA, 25 bp, Rattus norvegicus
aaacagttggattccccggtctgca

SEQ ID NO: 580376 - DNA, 25 bp, Rattus norvegicus
gcattgtgttttcgcgatctttgtt

SEQ ID NO: 580377 - DNA, 25 bp, Rattus norvegicus
ggaggagaatacctgccaggctccc

SEQ ID NO: 580378 - DNA, 25 bp, Rattus norvegicus
ccagagtagcatccgatggtcgccc

SEQ ID NO: 580379 - DNA, 25 bp, Rattus norvegicus
atgtccagagtagcatccgatggtc

SEQ ID NO: 580380 - DNA, 25 bp, Rattus norvegicus
gggcccagttaatgtccagagtagc

SEQ ID NO: 580381 - DNA, 25 bp, Rattus norvegicus
accagttctaggtccgcgccttggc

SEQ ID NO: 580382 - DNA, 25 bp, Rattus norvegicus
tgcggccgcgatgcccaccgcagct

SEQ ID NO: 580383 - DNA, 25 bp, Rattus norvegicus
tcgggcagatcctcacagcggaaga

SEQ ID NO: 580384 - DNA, 25 bp, Rattus norvegicus
tgcacaaggcccaacccaagaactg

SEQ ID NO: 580385 - DNA, 25 bp, Rattus norvegicus
agaactgagaccacaaaatggctgc

SEQ ID NO: 580386 - DNA, 25 bp, Rattus norvegicus
cccggtttatcgaggcgtattcgtg

SEQ ID NO: 580387 - DNA, 25 bp, Rattus norvegicus
ttccctctccggatatgcacaaggc

SEQ ID NO: 580388 - DNA, 25 bp, Rattus norvegicus
cgcgcccgaaacgacagtttactca

SEQ ID NO: 580389 - DNA, 25 bp, Rattus norvegicus
gtttactcatctcaggcgcagcaga

SEQ ID NO: 580390 - DNA, 25 bp, Rattus norvegicus
agcagatacctctccgctctgggga

SEQ ID NO: 580391 - DNA, 25 bp, Rattus norvegicus
cgggatcatggagaaccggagtttc

SEQ ID NO: 580392 - DNA, 25 bp, Rattus norvegicus
ggagtttcggtctccactcgcctgc

SEQ ID NO: 580393 - DNA, 25 bp, Rattus norvegicus
actcgctctcttcaatacgccatgg

SEQ ID NO: 580394 - DNA, 25 bp, Rattus norvegicus
catggccgtacatggcggacattaa

SEQ ID NO: 580395 - DNA, 25 bp, Rattus norvegicus
tggcggacattaaaactccactgtg

SEQ ID NO: 580396 - DNA, 25 bp, Rattus norvegicus
gccattttgtgtgggtctgctgctc

SEQ ID NO: 580397 - DNA, 25 bp, Rattus norvegicus
cctatccgtgggttctcggtgtgac

SEQ ID NO: 580398 - DNA, 25 bp, Rattus norvegicus
gcgcgactgtgccattttaaaccgg

SEQ ID NO: 580399 - DNA, 25 bp, Rattus norvegicus
tttaaaccggctcgggagagcgctg

SEQ ID NO: 580400 - DNA, 25 bp, Rattus norvegicus
cccagactttgctcggggatcggga

SEQ ID NO: 580401 - DNA, 25 bp, Rattus norvegicus
tcgggagtaagtgactagcacaaca

SEQ ID NO: 580402 - DNA, 25 bp, Rattus norvegicus
caacaatggcagcagccgtgtcctc

SEQ ID NO: 580403 - DNA, 25 bp, Rattus norvegicus
cgtgtcctccgagcatctgggcacg

SEQ ID NO: 580404 - DNA, 25 bp, Rattus norvegicus
ctcgttggggctccactcgagacgt

SEQ ID NO: 580405 - DNA, 25 bp, Rattus norvegicus
cggccgctgggaaagatgcctatcc

SEQ ID NO: 580406 - DNA, 25 bp, Rattus norvegicus
gcctcccgctgctcggaaagaatgc

SEQ ID NO: 580407 - DNA, 25 bp, Rattus norvegicus
ctccactcgagacgtccgtgtggga

SEQ ID NO: 580408 - DNA, 25 bp, Rattus norvegicus
ggttaacaactctgcgctggcgggc

SEQ ID NO: 580409 - DNA, 25 bp, Rattus norvegicus
tgtgacgttcccgagggcctcctga

SEQ ID NO: 580410 - DNA, 25 bp, Rattus norvegicus
tgctcggaaagaatgcgcgactgtg

SEQ ID NO: 580411 - DNA, 25 bp, Rattus norvegicus
tgacgggcaacactgactggcaaca

SEQ ID NO: 580412 - DNA, 25 bp, Rattus norvegicus
cgcaggccttgcaacagggtttctc

SEQ ID NO: 580413 - DNA, 25 bp, Rattus norvegicus
cgcctggaaggtggtaggatttaca

SEQ ID NO: 580414 - DNA, 25 bp, Rattus norvegicus
ttacacgcagctgggtctatttgcc

SEQ ID NO: 580415 - DNA, 25 bp, Rattus norvegicus
ctatttgcccatgcgcacaccagga

SEQ ID NO: 580416 - DNA, 25 bp, Rattus norvegicus
aaaacgcccgtgctccagggagtgc

SEQ ID NO: 580417 - DNA, 25 bp, Rattus norvegicus
gtgcgcagacgcaaagccacttctg

SEQ ID NO: 580418 - DNA, 25 bp, Rattus norvegicus
tctgggcggaaccagacgctctgca

SEQ ID NO: 580419 - DNA, 25 bp, Rattus norvegicus
cgacacagggcaacactgacgggca

SEQ ID NO: 580420 - DNA, 25 bp, Rattus norvegicus
aagatcctcatcattggcgagagtg

SEQ ID NO: 580421 - DNA, 25 bp, Rattus norvegicus
ggacgtgctgaccactctgaagatc

SEQ ID NO: 580422 - DNA, 25 bp, Rattus norvegicus
gactggcaacactgactggcaccga

SEQ ID NO: 580423 - DNA, 25 bp, Rattus norvegicus
agggtttctcactactgggcgtcta

SEQ ID NO: 580424 - DNA, 25 bp, Rattus norvegicus
tcagcttcccaaacattctgtcgga

SEQ ID NO: 580425 - DNA, 25 bp, Rattus norvegicus
gggcctgtcgcttgtgcctcacctt

SEQ ID NO: 580426 - DNA, 25 bp, Rattus norvegicus
ctgcgagcctagagccaagagtatc

SEQ ID NO: 580427 - DNA, 25 bp, Rattus norvegicus
ccatgtcttgcagggcctgtcgctt

SEQ ID NO: 580428 - DNA, 25 bp, Rattus norvegicus
aagcggccgcgccatgtcttgcagg

SEQ ID NO: 580429 - DNA, 25 bp, Rattus norvegicus
taaagccactgcttaagcggccgcg

SEQ ID NO: 580430 - DNA, 25 bp, Rattus norvegicus
acggtgcttgtaaagccactgctta

SEQ ID NO: 580431 - DNA, 25 bp, Rattus norvegicus
tacgggttgtcacggtgcttgtaaa

SEQ ID NO: 580432 - DNA, 25 bp, Rattus norvegicus
ctcagtcttcgtagggtacgggttg

SEQ ID NO: 580433 - DNA, 25 bp, Rattus norvegicus
cgagcctagagccaagagtatcttc

SEQ ID NO: 580434 - DNA, 25 bp, Rattus norvegicus
agcgtcatctgcgagcctagagcca

SEQ ID NO: 580435 - DNA, 25 bp, Rattus norvegicus
tgcactagcgtcatctgcgagccta

SEQ ID NO: 580436 - DNA, 25 bp, Rattus norvegicus
gtctggattacctgcactagcgtca

SEQ ID NO: 580437 - DNA, 25 bp, Rattus norvegicus
gccaagagtatcttctcagtcttcg

SEQ ID NO: 580438 - DNA, 25 bp, Rattus norvegicus
acccacgttagaggagtctggatta

SEQ ID NO: 580439 - DNA, 25 bp, Rattus norvegicus
gcatcggaccgagcatgagcatacc

SEQ ID NO: 580440 - DNA, 25 bp, Rattus norvegicus
ggtgcctcggtcgtcaaaaatcaca

SEQ ID NO: 580441 - DNA, 25 bp, Rattus norvegicus
agggcgtgagcttcatcaaactttg

SEQ ID NO: 580442 - DNA, 25 bp, Rattus norvegicus
ccttttgaattagtgggtcagcatc

SEQ ID NO: 580443 - DNA, 25 bp, Rattus norvegicus
ggactcctgatcttgttacacttca

SEQ ID NO: 580444 - DNA, 25 bp, Rattus norvegicus
ccaggagacgtagatctgccctctt

SEQ ID NO: 580445 - DNA, 25 bp, Rattus norvegicus
taaatccttaagaacctggcgtgcg

SEQ ID NO: 580446 - DNA, 25 bp, Rattus norvegicus
ctcggcgccaactcaatttttatta

SEQ ID NO: 580447 - DNA, 25 bp, Rattus norvegicus
cagcgctcaatctgctcctgctata

SEQ ID NO: 580448 - DNA, 25 bp, Rattus norvegicus
gtctcacctgggaaccatctgcttg

SEQ ID NO: 580449 - DNA, 25 bp, Rattus norvegicus
actgcgctgcaaatcccggtactgg

SEQ ID NO: 580450 - DNA, 25 bp, Rattus norvegicus
taatctcttttagcaaccagcggtg

SEQ ID NO: 580451 - DNA, 25 bp, Rattus norvegicus
ccacccgcgctgactgataataaca

SEQ ID NO: 580452 - DNA, 25 bp, Rattus norvegicus
aaactgagcctggtcgctgagtacc

SEQ ID NO: 580453 - DNA, 25 bp, Rattus norvegicus
tgcgtcatcaacacgcgccagggtc

SEQ ID NO: 580454 - DNA, 25 bp, Rattus norvegicus
ttcacgccagggcatgtcagatcgg

SEQ ID NO: 580455 - DNA, 25 bp, Rattus norvegicus
tgtcagatcggatcctacctgctca

SEQ ID NO: 580456 - DNA, 25 bp, Rattus norvegicus
tgctcacctcatcagaggtcgccga

SEQ ID NO: 580457 - DNA, 25 bp, Rattus norvegicus
cccataacccggagtggctggttga

SEQ ID NO: 580458 - DNA, 25 bp, Rattus norvegicus
ttgacagccgagctgcgggttacct

SEQ ID NO: 580459 - DNA, 25 bp, Rattus norvegicus
ttacctgtcggccaccgtgctgcag

SEQ ID NO: 580460 - DNA, 25 bp, Rattus norvegicus
cgtgctgcagctacacttccgcaga

SEQ ID NO: 580461 - DNA, 25 bp, Rattus norvegicus
gcagactccgggttaccacgggcta

SEQ ID NO: 580462 - DNA, 25 bp, Rattus norvegicus
gcgggttcacgccacaagaggtgaa

SEQ ID NO: 580463 - DNA, 25 bp, Rattus norvegicus
caggcaaacaccaattgcgtcatca

SEQ ID NO: 580464 - DNA, 25 bp, Rattus norvegicus
aggcctggttcctcggccatactgc

SEQ ID NO: 580465 - DNA, 25 bp, Rattus norvegicus
ccacaagaggtgaaaaggatcccgc

SEQ ID NO: 580466 - DNA, 25 bp, Rattus norvegicus
gttaccacgggctaccaggcaaaca

SEQ ID NO: 580467 - DNA, 25 bp, Rattus norvegicus
cacagtggctgccacacgcgacatt

SEQ ID NO: 580468 - DNA, 25 bp, Rattus norvegicus
ggtactcggcgcctacactcgccaa

SEQ ID NO: 580469 - DNA, 25 bp, Rattus norvegicus
tactcggcgcctacactcgccaacg

SEQ ID NO: 580470 - DNA, 25 bp, Rattus norvegicus
tcggcgcctacactcgccaacgccg

SEQ ID NO: 580471 - DNA, 25 bp, Rattus norvegicus
gcctacactcgccaacgccgccctc

SEQ ID NO: 580472 - DNA, 25 bp, Rattus norvegicus
cctacactcgccaacgccgccctcc

SEQ ID NO: 580473 - DNA, 25 bp, Rattus norvegicus
tcttgtcaccacagtggctgccaca

SEQ ID NO: 580474 - DNA, 25 bp, Rattus norvegicus
acagtggctgccacacgcgacattt

SEQ ID NO: 580475 - DNA, 25 bp, Rattus norvegicus
cagtggctgccacacgcgacattta

SEQ ID NO: 580476 - DNA, 25 bp, Rattus norvegicus
agtggctgccacacgcgacatttag

SEQ ID NO: 580477 - DNA, 25 bp, Rattus norvegicus
gtggctgccacacgcgacatttagg

SEQ ID NO: 580478 - DNA, 25 bp, Rattus norvegicus
gctgccacacgcgacatttaggaca

SEQ ID NO: 580479 - DNA, 25 bp, Rattus norvegicus
ctgccacacgcgacatttaggacaa

SEQ ID NO: 580480 - DNA, 25 bp, Rattus norvegicus
ttcctcttgtcaccacagtggctgc

SEQ ID NO: 580481 - DNA, 25 bp, Rattus norvegicus
cagccacggtcagtgttggtgtaga

SEQ ID NO: 580482 - DNA, 25 bp, Rattus norvegicus
ctgcgcaggcaggtacaggcctgta

SEQ ID NO: 580483 - DNA, 25 bp, Rattus norvegicus
ctagggctgaatcctgcgcaggcag

SEQ ID NO: 580484 - DNA, 25 bp, Rattus norvegicus
tgccctagggctgaatcctgcgcag

SEQ ID NO: 580485 - DNA, 25 bp, Rattus norvegicus
agccacagcaactaggcgacagcca

SEQ ID NO: 580486 - DNA, 25 bp, Rattus norvegicus
gcgtcgtgccctagggctgaatcct

SEQ ID NO: 580487 - DNA, 25 bp, Rattus norvegicus
tggccactgcgtcgtgccctagggc

SEQ ID NO: 580488 - DNA, 25 bp, Rattus norvegicus
tgaagtcagacctccggtggccact

SEQ ID NO: 580489 - DNA, 25 bp, Rattus norvegicus
gtacaggcctgtagtgcgcacccag

SEQ ID NO: 580490 - DNA, 25 bp, Rattus norvegicus
cagtgttggtgtagaaagtgaagtc

SEQ ID NO: 580491 - DNA, 25 bp, Rattus norvegicus
aactaggcgacagccacggtcagtg

SEQ ID NO: 580492 - DNA, 25 bp, Rattus norvegicus
cgacatttaggacaagccacagcaa

SEQ ID NO: 580493 - DNA, 25 bp, Rattus norvegicus
tttaggacaagccacagcaactagg

SEQ ID NO: 580494 - DNA, 25 bp, Rattus norvegicus
agaaagtgaagtcagacctccggtg

SEQ ID NO: 580495 - DNA, 25 bp, Rattus norvegicus
ttaaagcttcttgcacctgggaacc

SEQ ID NO: 580496 - DNA, 25 bp, Rattus norvegicus
atggccgcgaagacctcagccagtg

SEQ ID NO: 580497 - DNA, 25 bp, Rattus norvegicus
tccggtctcaggactaggcacactc

SEQ ID NO: 580498 - DNA, 25 bp, Rattus norvegicus
caccggcgtcgtctcggctttattt

SEQ ID NO: 580499 - DNA, 25 bp, Rattus norvegicus
ctttatttacccagacaggcgcgcg

SEQ ID NO: 580500 - DNA, 25 bp, Rattus norvegicus
gaagccttctcatgtttcccgactg

SEQ ID NO: 580501 - DNA, 25 bp, Rattus norvegicus
tgctgttaactcctcgcgtagacgc

SEQ ID NO: 580502 - DNA, 25 bp, Rattus norvegicus
ggatgctttcgcctagcagcgccca

SEQ ID NO: 580503 - DNA, 25 bp, Rattus norvegicus
cagcgcccagcaagaccggttcttt

SEQ ID NO: 580504 - DNA, 25 bp, Rattus norvegicus
gctcgcgtcaccagtacagaggttg

SEQ ID NO: 580505 - DNA, 25 bp, Rattus norvegicus
aaatcctgtgtcttaactgctcctg

SEQ ID NO: 580506 - DNA, 25 bp, Rattus norvegicus
actgctcctggtgccggaaatgtca

SEQ ID NO: 580507 - DNA, 25 bp, Rattus norvegicus
ggaaatgtcaccaagctaggccggg

SEQ ID NO: 580508 - DNA, 25 bp, Rattus norvegicus
ctgattaccaggaggttaaagcttc

SEQ ID NO: 580509 - DNA, 25 bp, Rattus norvegicus
agagagacttaagtcccggccggcg

SEQ ID NO: 580510 - DNA, 25 bp, Rattus norvegicus
gcacgtgtacccacagataaatacg

SEQ ID NO: 580511 - DNA, 25 bp, Rattus norvegicus
accctgtgtctacctagggctgaca

SEQ ID NO: 580512 - DNA, 25 bp, Rattus norvegicus
ccaggggcatgttgctcttgaagcc

SEQ ID NO: 580513 - DNA, 25 bp, Rattus norvegicus
ggctctcaggatcgcccaggagctt

SEQ ID NO: 580514 - DNA, 25 bp, Rattus norvegicus
tcgcccaggagcttgaaggtgaaga

SEQ ID NO: 580515 - DNA, 25 bp, Rattus norvegicus
aggctctggcaagctgagcagcgcc

SEQ ID NO: 580516 - DNA, 25 bp, Rattus norvegicus
tttccactcggggaaggcgcacagc

SEQ ID NO: 580517 - DNA, 25 bp, Rattus norvegicus
agctgccgctgtcatccagagagtc

SEQ ID NO: 580518 - DNA, 25 bp, Rattus norvegicus
ccagagagtccttccgcgactgtga

SEQ ID NO: 580519 - DNA, 25 bp, Rattus norvegicus
taggtgtaagcgcagccgcctagac

SEQ ID NO: 580520 - DNA, 25 bp, Rattus norvegicus
tggcacccaaggatacgcatgaagg

SEQ ID NO: 580521 - DNA, 25 bp, Rattus norvegicus
gtacaccgaacagacacacgcacgt

SEQ ID NO: 580522 - DNA, 25 bp, Rattus norvegicus
gcgactgtgatctctccagcgagcc

SEQ ID NO: 580523 - DNA, 25 bp, Rattus norvegicus
ataaactagccggttgcacccgcca

SEQ ID NO: 580524 - DNA, 25 bp, Rattus norvegicus
tgcaaggtgctacagcgaagcgcct

SEQ ID NO: 580525 - DNA, 25 bp, Rattus norvegicus
cccgcgtcagtgcaaggtgctacag

SEQ ID NO: 580526 - DNA, 25 bp, Rattus norvegicus
ttctctgcccgcgtcagtgcaaggt

SEQ ID NO: 580527 - DNA, 25 bp, Rattus norvegicus
tgctacagcgaagcgcctggaggcc

SEQ ID NO: 580528 - DNA, 25 bp, Rattus norvegicus
ccgggcctcctacctgctccacagc

SEQ ID NO: 580529 - DNA, 25 bp, Rattus norvegicus
acagccgcagtccacgcgccgctta

SEQ ID NO: 580530 - DNA, 25 bp, Rattus norvegicus
cgccgcttagctccgcagcttggga

SEQ ID NO: 580531 - DNA, 25 bp, Rattus norvegicus
ccgcagcttgggatcacaactaagg

SEQ ID NO: 580532 - DNA, 25 bp, Rattus norvegicus
tcacaactaaggacaatcgggaggc

SEQ ID NO: 580533 - DNA, 25 bp, Rattus norvegicus
actaaggacaatcgggaggcagacg

SEQ ID NO: 580534 - DNA, 25 bp, Rattus norvegicus
agacgggatcagctgccgcagagct

SEQ ID NO: 580535 - DNA, 25 bp, Rattus norvegicus
gagctcgataaactagccggttgca

SEQ ID NO: 580536 - DNA, 25 bp, Rattus norvegicus
tgccgcagagctcgataaactagcc

SEQ ID NO: 580537 - DNA, 25 bp, Rattus norvegicus
ggccgcgactctgggttctcacggc

SEQ ID NO: 580538 - DNA, 25 bp, Rattus norvegicus
ggccgggcacttacgtctgcagtgc

SEQ ID NO: 580539 - DNA, 25 bp, Rattus norvegicus
agtgcccaggcctgagccacaggcg

SEQ ID NO: 580540 - DNA, 25 bp, Rattus norvegicus
gctccgcgctagtcggtgacagcac

SEQ ID NO: 580541 - DNA, 25 bp, Rattus norvegicus
ttctcacggccgactgagggcgact

SEQ ID NO: 580542 - DNA, 25 bp, Rattus norvegicus
gcggcccgtcgaggctccgcgaaaa

SEQ ID NO: 580543 - DNA, 25 bp, Rattus norvegicus
gccgctccgcatttagtccgagatg

SEQ ID NO: 580544 - DNA, 25 bp, Rattus norvegicus
catttagtccgagatggcgtccctc

SEQ ID NO: 580545 - DNA, 25 bp, Rattus norvegicus
ccggattcgagagcgaggaaaagca

SEQ ID NO: 580546 - DNA, 25 bp, Rattus norvegicus
aagcagcaaccggaagggcttgacg

SEQ ID NO: 580547 - DNA, 25 bp, Rattus norvegicus
agcaagccgaggtttgcctgaaggc

SEQ ID NO: 580548 - DNA, 25 bp, Rattus norvegicus
gcggaaactgccgagctgtcccgaa

SEQ ID NO: 580549 - DNA, 25 bp, Rattus norvegicus
tcccgaaggcggctgcgtccgagtt

SEQ ID NO: 580550 - DNA, 25 bp, Rattus norvegicus
agccacaggcgtgtgctccgcgcta

SEQ ID NO: 580551 - DNA, 25 bp, Rattus norvegicus
cgggatgtctctcacactacggtcc

SEQ ID NO: 580552 - DNA, 25 bp, Rattus norvegicus
tcccgggatgtctctcacactacgg

SEQ ID NO: 580553 - DNA, 25 bp, Rattus norvegicus
tactgtttttcagctgtcacgaccg

SEQ ID NO: 580554 - DNA, 25 bp, Rattus norvegicus
ctttactgtttttcagctgtcacga

SEQ ID NO: 580555 - DNA, 25 bp, Rattus norvegicus
cacactacggtccttctttactgtt

SEQ ID NO: 580556 - DNA, 25 bp, Rattus norvegicus
ctcacactacggtccttctttactg

SEQ ID NO: 580557 - DNA, 25 bp, Rattus norvegicus
gtctctcacactacggtccttcttt

SEQ ID NO: 580558 - DNA, 25 bp, Rattus norvegicus
ctttcccgggatgtctctcacacta

SEQ ID NO: 580559 - DNA, 25 bp, Rattus norvegicus
gatgtctctcacactacggtccttc

SEQ ID NO: 580560 - DNA, 25 bp, Rattus norvegicus
ttcctttcccgggatgtctctcaca

SEQ ID NO: 580561 - DNA, 25 bp, Rattus norvegicus
atccgcgccggtacgtttgtcgccg

SEQ ID NO: 580562 - DNA, 25 bp, Rattus norvegicus
agatccgcgccggtacgtttgtcgc

SEQ ID NO: 580563 - DNA, 25 bp, Rattus norvegicus
ggagcgtccgcagcgcacagatccg

SEQ ID NO: 580564 - DNA, 25 bp, Rattus norvegicus
cctggggacctgtcgggcttggcga

SEQ ID NO: 580565 - DNA, 25 bp, Rattus norvegicus
cgggcctagaggtacaccagttctg

SEQ ID NO: 580566 - DNA, 25 bp, Rattus norvegicus
cgacacgcaagatgaggcgggccta

SEQ ID NO: 580567 - DNA, 25 bp, Rattus norvegicus
tgcctgctacctcttcgtgtctgtc

SEQ ID NO: 580568 - DNA, 25 bp, Rattus norvegicus
ccggacctcaagttctttctgtgta

SEQ ID NO: 580569 - DNA, 25 bp, Rattus norvegicus
acgcccatctgcctggaggactaca

SEQ ID NO: 580570 - DNA, 25 bp, Rattus norvegicus
gccgctctgtgtgtgaacgcgccaa

SEQ ID NO: 580571 - DNA, 25 bp, Rattus norvegicus
tacggctttgcctggcctgaccgaa

SEQ ID NO: 580572 - DNA, 25 bp, Rattus norvegicus
cccgacactctgtgcatggactaca

SEQ ID NO: 580573 - DNA, 25 bp, Rattus norvegicus
aagaccggccagatcgccaactgtg

SEQ ID NO: 580574 - DNA, 25 bp, Rattus norvegicus
cttctttagccaggatgagcgcgcc

SEQ ID NO: 580575 - DNA, 25 bp, Rattus norvegicus
gcgcgccttcactgtcttctggatc

SEQ ID NO: 580576 - DNA, 25 bp, Rattus norvegicus
ttcctcatcgatatggagcgcttta

SEQ ID NO: 580577 - DNA, 25 bp, Rattus norvegicus
gaacggcccattatattcctctctg

SEQ ID NO: 580578 - DNA, 25 bp, Rattus norvegicus
gtgcaagggcatcggttacaactac

SEQ ID NO: 580579 - DNA, 25 bp, Rattus norvegicus
ctggacgacacgcagcacgaagttg

SEQ ID NO: 580580 - DNA, 25 bp, Rattus norvegicus
accgtcgatgttttcccggtcgctg

SEQ ID NO: 580581 - DNA, 25 bp, Rattus norvegicus
ctcaccgtcgatgttttcccggtcg

SEQ ID NO: 580582 - DNA, 25 bp, Rattus norvegicus
ctgcagattgcagccagtgtcctcg

SEQ ID NO: 580583 - DNA, 25 bp, Rattus norvegicus
agattgcagccagtgtcctcgcggc

SEQ ID NO: 580584 - DNA, 25 bp, Rattus norvegicus
cagccagtgtcctcgcggctgaggt

SEQ ID NO: 580585 - DNA, 25 bp, Rattus norvegicus
tcctcgcggctgaggtccgtgtccg

SEQ ID NO: 580586 - DNA, 25 bp, Rattus norvegicus
gcggtaggactccagccgcgagtgc

SEQ ID NO: 580587 - DNA, 25 bp, Rattus norvegicus
cgcgagtgcgcattcctccggagct

SEQ ID NO: 580588 - DNA, 25 bp, Rattus norvegicus
cgaagttgtgttccccatcgctgac

SEQ ID NO: 580589 - DNA, 25 bp, Rattus norvegicus
ctccggagcttagggctggacgaca

SEQ ID NO: 580590 - DNA, 25 bp, Rattus norvegicus
acacgcagcacgaagttgtgttccc

SEQ ID NO: 580591 - DNA, 25 bp, Rattus norvegicus
gatgttttcccggtcgctgatgtgc

SEQ ID NO: 580592 - DNA, 25 bp, Rattus norvegicus
attcctccggagcttagggctggac

SEQ ID NO: 580593 - DNA, 25 bp, Rattus norvegicus
cagccgcgatttccgcaagctgttc

SEQ ID NO: 580594 - DNA, 25 bp, Rattus norvegicus
caagctgttccggttcacgccgggg

SEQ ID NO: 580595 - DNA, 25 bp, Rattus norvegicus
cggacacaatgacgggaccgcagga

SEQ ID NO: 580596 - DNA, 25 bp, Rattus norvegicus
cggcgctgcacggtgaatcttagct

SEQ ID NO: 580597 - DNA, 25 bp, Rattus norvegicus
tgaatcttagcttgccggccgggtt

SEQ ID NO: 580598 - DNA, 25 bp, Rattus norvegicus
cgcttgcttcgcttccacctttgtg

SEQ ID NO: 580599 - DNA, 25 bp, Rattus norvegicus
tttggaagcagattctccaggcgtg

SEQ ID NO: 580600 - DNA, 25 bp, Rattus norvegicus
tctccaggcgtgaaagtgcgcagtg

SEQ ID NO: 580601 - DNA, 25 bp, Rattus norvegicus
tggccggcaccctgtctaaaagtct

SEQ ID NO: 580602 - DNA, 25 bp, Rattus norvegicus
aaaagtcttcgccttctagacgcca

SEQ ID NO: 580603 - DNA, 25 bp, Rattus norvegicus
ttctagacgccaatgcggctctccg

SEQ ID NO: 580604 - DNA, 25 bp, Rattus norvegicus
gctcttccgctcttgagtctcaacg

SEQ ID NO: 580605 - DNA, 25 bp, Rattus norvegicus
cggcaggaagtagatagtggcccta

SEQ ID NO: 580606 - DNA, 25 bp, Rattus norvegicus
tcttgagtctcaacggcaggaagta

SEQ ID NO: 580607 - DNA, 25 bp, Rattus norvegicus
ttgatttcggccagggactcacgga

SEQ ID NO: 580608 - DNA, 25 bp, Rattus norvegicus
tggtgcgtcactggggctcccactc

SEQ ID NO: 580609 - DNA, 25 bp, Rattus norvegicus
cgccgacgtcactggtgcgtcactg

SEQ ID NO: 580610 - DNA, 25 bp, Rattus norvegicus
tgcaaggcggtgactcccaaccctt

SEQ ID NO: 580611 - DNA, 25 bp, Rattus norvegicus
acagcaaagccacccgcaagcgggg

SEQ ID NO: 580612 - DNA, 25 bp, Rattus norvegicus
cgggccacagaggacctgcgcgtct

SEQ ID NO: 580613 - DNA, 25 bp, Rattus norvegicus
gagacttttgatttcggccagggac

SEQ ID NO: 580614 - DNA, 25 bp, Rattus norvegicus
tgtctctctagttccgagacttttg

SEQ ID NO: 580615 - DNA, 25 bp, Rattus norvegicus
agaagggagccagaatgtctctcta

SEQ ID NO: 580616 - DNA, 25 bp, Rattus norvegicus
tgccgcggcacctccagagaaggga

SEQ ID NO: 580617 - DNA, 25 bp, Rattus norvegicus
acaggtctttgtgacccgtgccgcg

SEQ ID NO: 580618 - DNA, 25 bp, Rattus norvegicus
caccacaacgaaccacaggtctttg

SEQ ID NO: 580619 - DNA, 25 bp, Rattus norvegicus
ccgtgcaccaagaggccgccaccac

SEQ ID NO: 580620 - DNA, 25 bp, Rattus norvegicus
cgcggagcccaagccacagcaaagc

SEQ ID NO: 580621 - DNA, 25 bp, Rattus norvegicus
agtcccgcagcaggtgtcacgggca

SEQ ID NO: 580622 - DNA, 25 bp, Rattus norvegicus
ctcaggagcaccagggtaggaatga

SEQ ID NO: 580623 - DNA, 25 bp, Rattus norvegicus
taggaatgacagatgggcccgcagc

SEQ ID NO: 580624 - DNA, 25 bp, Rattus norvegicus
gtgaggcgccctgaacctgtcagct

SEQ ID NO: 580625 - DNA, 25 bp, Rattus norvegicus
tgtcagctcccgctgtcacctgtag

SEQ ID NO: 580626 - DNA, 25 bp, Rattus norvegicus
gtcacctgtagggaaggacccggca

SEQ ID NO: 580627 - DNA, 25 bp, Rattus norvegicus
gccggggaccgccttaatcagcaaa

SEQ ID NO: 580628 - DNA, 25 bp, Rattus norvegicus
tgcgcgcgaaccacgaagggttgtt

SEQ ID NO: 580629 - DNA, 25 bp, Rattus norvegicus
gtcgagaccctgaccctcgaaagga

SEQ ID NO: 580630 - DNA, 25 bp, Rattus norvegicus
gaaaggagcccgctgccgtctttac

SEQ ID NO: 580631 - DNA, 25 bp, Rattus norvegicus
tgccgtctttacctccgttctctgg

SEQ ID NO: 580632 - DNA, 25 bp, Rattus norvegicus
agagaatcccgactcgccacagctg

SEQ ID NO: 580633 - DNA, 25 bp, Rattus norvegicus
gcagagctccgagtgcaagcgaacc

SEQ ID NO: 580634 - DNA, 25 bp, Rattus norvegicus
gcgaggctcgcacccttgcaagaga

SEQ ID NO: 580635 - DNA, 25 bp, Rattus norvegicus
cgccggtgtcgtagtagtcgtccac

SEQ ID NO: 580636 - DNA, 25 bp, Rattus norvegicus
agtcgtccacgttttcctgcctgaa

SEQ ID NO: 580637 - DNA, 25 bp, Rattus norvegicus
cctgcctgaacacagtcatgataga

SEQ ID NO: 580638 - DNA, 25 bp, Rattus norvegicus
gatagactgtcacgcctcaccaaag

SEQ ID NO: 580639 - DNA, 25 bp, Rattus norvegicus
cccagagtgtgaacccaaggatccg

SEQ ID NO: 580640 - DNA, 25 bp, Rattus norvegicus
cgcttcgaagaagccggaggctttc

SEQ ID NO: 580641 - DNA, 25 bp, Rattus norvegicus
cgcagacctctgaaagacatggaga

SEQ ID NO: 580642 - DNA, 25 bp, Rattus norvegicus
tggagagaagaatgaaacggtaaac

SEQ ID NO: 580643 - DNA, 25 bp, Rattus norvegicus
tcggtcctgatctcgaggcctccag

SEQ ID NO: 580644 - DNA, 25 bp, Rattus norvegicus
gaccacgcgccctttgttaagtctg

SEQ ID NO: 580645 - DNA, 25 bp, Rattus norvegicus
ctcagggaagggacacaaagcgcct

SEQ ID NO: 580646 - DNA, 25 bp, Rattus norvegicus
tccgagtggcctccgctccgtgagt

SEQ ID NO: 580647 - DNA, 25 bp, Rattus norvegicus
cccaaggatccgtgtgggccagacg

SEQ ID NO: 580648 - DNA, 25 bp, Rattus norvegicus
tgcaccaagccgcagacctctgaaa

SEQ ID NO: 580649 - DNA, 25 bp, Rattus norvegicus
acatctgtctttctggactggcgcc

SEQ ID NO: 580650 - DNA, 25 bp, Rattus norvegicus
tagatgcgcagacccaacggagagc

SEQ ID NO: 580651 - DNA, 25 bp, Rattus norvegicus
catagaccgacgtgatgtccgaacg

SEQ ID NO: 580652 - DNA, 25 bp, Rattus norvegicus
gtccgaacgatcatagaagctcagt

SEQ ID NO: 580653 - DNA, 25 bp, Rattus norvegicus
gctcagttctccgatcagttccagg

SEQ ID NO: 580654 - DNA, 25 bp, Rattus norvegicus
ggaaaagctcctggcggctcagaca

SEQ ID NO: 580655 - DNA, 25 bp, Rattus norvegicus
tcgcgtccagcatgtttcccaacta

SEQ ID NO: 580656 - DNA, 25 bp, Rattus norvegicus
atggtcccgcaatcctggcggttta

SEQ ID NO: 580657 - DNA, 25 bp, Rattus norvegicus
tcctggcggtttagcagctcaggcg

SEQ ID NO: 580658 - DNA, 25 bp, Rattus norvegicus
aggaggcggagatgtaaccctacgc

SEQ ID NO: 580659 - DNA, 25 bp, Rattus norvegicus
ccctgtctaccaatggcagcaagta

SEQ ID NO: 580660 - DNA, 25 bp, Rattus norvegicus
ggcgttggctccttgcattccggat

SEQ ID NO: 580661 - DNA, 25 bp, Rattus norvegicus
cagatgccatcctagacttcgagtg

SEQ ID NO: 580662 - DNA, 25 bp, Rattus norvegicus
aggcggcaatgcgatcctctagatg

SEQ ID NO: 580663 - DNA, 25 bp, Rattus norvegicus
ctgactgcacggcggtgacatcagg

SEQ ID NO: 580664 - DNA, 25 bp, Rattus norvegicus
gtcctcctggcgagaagtcatctcc

SEQ ID NO: 580665 - DNA, 25 bp, Rattus norvegicus
gcagcacgtcgcctgcctgcaccca

SEQ ID NO: 580666 - DNA, 25 bp, Rattus norvegicus
tgcacccagcggctcgctcgcctgt

SEQ ID NO: 580667 - DNA, 25 bp, Rattus norvegicus
cgctcgcctgtcagaaggaggagga

SEQ ID NO: 580668 - DNA, 25 bp, Rattus norvegicus
ggcggcagctccaagtttaatggtc

SEQ ID NO: 580669 - DNA, 25 bp, Rattus norvegicus
tccaagtttaatggtccacgtcagg

SEQ ID NO: 580670 - DNA, 25 bp, Rattus norvegicus
ttaatggtccacgtcaggcgcgcct

SEQ ID NO: 580671 - DNA, 25 bp, Rattus norvegicus
tctccgcccagcgatcgcgaagagg

SEQ ID NO: 580672 - DNA, 25 bp, Rattus norvegicus
tctgctttcaatgagccgcctctgg

SEQ ID NO: 580673 - DNA, 25 bp, Rattus norvegicus
ccctgactctgtgcggcactagggg

SEQ ID NO: 580674 - DNA, 25 bp, Rattus norvegicus
aatgcgggtccagccaaggcgcgca

SEQ ID NO: 580675 - DNA, 25 bp, Rattus norvegicus
gcgccctgactctgtgcggcactag

SEQ ID NO: 580676 - DNA, 25 bp, Rattus norvegicus
tcgcgaagagggtctgctttcaatg

SEQ ID NO: 580677 - DNA, 25 bp, Rattus norvegicus
cggatactccacagcaccatcgata

SEQ ID NO: 580678 - DNA, 25 bp, Rattus norvegicus
tggcggccaactcgttcagcccttt

SEQ ID NO: 580679 - DNA, 25 bp, Rattus norvegicus
tacttccgagacttcgtggcggcca

SEQ ID NO: 580680 - DNA, 25 bp, Rattus norvegicus
tgcgtactgtgctcttctcctttta

SEQ ID NO: 580681 - DNA, 25 bp, Rattus norvegicus
gcggctcagctaccagagcgtcttc

SEQ ID NO: 580682 - DNA, 25 bp, Rattus norvegicus
gttcatctatgcacagctctggctg

SEQ ID NO: 580683 - DNA, 25 bp, Rattus norvegicus
gaagtgcggcttgttttcccggcta

SEQ ID NO: 580684 - DNA, 25 bp, Rattus norvegicus
aggccgcccaacagatcatgtggta

SEQ ID NO: 580685 - DNA, 25 bp, Rattus norvegicus
cagggttcttggcactggagtacca

SEQ ID NO: 580686 - DNA, 25 bp, Rattus norvegicus
tgggtttgcacagtcacagggttct

SEQ ID NO: 580687 - DNA, 25 bp, Rattus norvegicus
ccggatcaccctcttcttggctgtg

SEQ ID NO: 580688 - DNA, 25 bp, Rattus norvegicus
tgatgttttcctagccgcagcggtg

SEQ ID NO: 580689 - DNA, 25 bp, Rattus norvegicus
tccgggacacggatactcctcagtc

SEQ ID NO: 580690 - DNA, 25 bp, Rattus norvegicus
cactgatctggggtttgtgctctga

SEQ ID NO: 580691 - DNA, 25 bp, Rattus norvegicus
tagggaacactctacctttccaagc

SEQ ID NO: 580692 - DNA, 25 bp, Rattus norvegicus
gtgcccgccgtgctttacagacgtt

SEQ ID NO: 580693 - DNA, 25 bp, Rattus norvegicus
tctgcctctctgaggcggggctcca

SEQ ID NO: 580694 - DNA, 25 bp, Rattus norvegicus
ccacagcgggaaggtctcgaaaatg

SEQ ID NO: 580695 - DNA, 25 bp, Rattus norvegicus
cctttccaagcagtagcgactgatg

SEQ ID NO: 580696 - DNA, 25 bp, Rattus norvegicus
actgatgtaccagtgctgcgcgccc

SEQ ID NO: 580697 - DNA, 25 bp, Rattus norvegicus
gccaagggtgacaagcagttgcacc

SEQ ID NO: 580698 - DNA, 25 bp, Rattus norvegicus
acctgggtcttgacgagacttgaga

SEQ ID NO: 580699 - DNA, 25 bp, Rattus norvegicus
ggttctcagtcccttgctggccact

SEQ ID NO: 580700 - DNA, 25 bp, Rattus norvegicus
gcactacccggtgcggttctcagtc

SEQ ID NO: 580701 - DNA, 25 bp, Rattus norvegicus
gctttacagacgtttcccgcactac

SEQ ID NO: 580702 - DNA, 25 bp, Rattus norvegicus
gaactacaggctcggaggtcgctct

SEQ ID NO: 580703 - DNA, 25 bp, Rattus norvegicus
cccggagtcctcagttatggccacg

SEQ ID NO: 580704 - DNA, 25 bp, Rattus norvegicus
ctcgaaaatggagaactacaggctc

SEQ ID NO: 580705 - DNA, 25 bp, Rattus norvegicus
cgcatgcagcaaccagtggaaggtc

SEQ ID NO: 580706 - DNA, 25 bp, Rattus norvegicus
cagtggaaggtcagctgaaaggccc

SEQ ID NO: 580707 - DNA, 25 bp, Rattus norvegicus
gcgttctacaccctaggtactgttc

SEQ ID NO: 580708 - DNA, 25 bp, Rattus norvegicus
gcggggtcctctcgtgtccaaccga

SEQ ID NO: 580709 - DNA, 25 bp, Rattus norvegicus
gaaacccacgggatcctctccagag

SEQ ID NO: 580710 - DNA, 25 bp, Rattus norvegicus
acgggatcctctccagagttctgga

SEQ ID NO: 580711 - DNA, 25 bp, Rattus norvegicus
tccagagttctggagagacgctcgc

SEQ ID NO: 580712 - DNA, 25 bp, Rattus norvegicus
ccgggaaagctacccgcgcatgcag

SEQ ID NO: 580713 - DNA, 25 bp, Rattus norvegicus
cctcccagctgggatcgcgtgggaa

SEQ ID NO: 580714 - DNA, 25 bp, Rattus norvegicus
cccagctgagggtgagattaggaac

SEQ ID NO: 580715 - DNA, 25 bp, Rattus norvegicus
acgctgggagcgctttggtgtccca

SEQ ID NO: 580716 - DNA, 25 bp, Rattus norvegicus
cccgggcctgtgcaaggagcacgct

SEQ ID NO: 580717 - DNA, 25 bp, Rattus norvegicus
gtgggaccagcgttctacaccctag

SEQ ID NO: 580718 - DNA, 25 bp, Rattus norvegicus
tgagattaggaaccgggaaagctac

SEQ ID NO: 580719 - DNA, 25 bp, Rattus norvegicus
agcacctactaccacctggctgggg

SEQ ID NO: 580720 - DNA, 25 bp, Rattus norvegicus
gctgagtcattcgatgccaacgtta

SEQ ID NO: 580721 - DNA, 25 bp, Rattus norvegicus
cgcactttaggctgctgagtcattc

SEQ ID NO: 580722 - DNA, 25 bp, Rattus norvegicus
cgcgattctagacacgcactttagg

SEQ ID NO: 580723 - DNA, 25 bp, Rattus norvegicus
agctctgtcacactgcgcgattcta

SEQ ID NO: 580724 - DNA, 25 bp, Rattus norvegicus
cctgccgtggaaaggcgagcatcac

SEQ ID NO: 580725 - DNA, 25 bp, Rattus norvegicus
ggacaacgctacctgccacgggtga

SEQ ID NO: 580726 - DNA, 25 bp, Rattus norvegicus
tcggaccgtattgttgggacaacgc

SEQ ID NO: 580727 - DNA, 25 bp, Rattus norvegicus
ggttgaggcttgtaatcggaccgta

SEQ ID NO: 580728 - DNA, 25 bp, Rattus norvegicus
caggggcatcgggatatcactgttc

SEQ ID NO: 580729 - DNA, 25 bp, Rattus norvegicus
gacacacgtcggagcgcagcaccta

SEQ ID NO: 580730 - DNA, 25 bp, Rattus norvegicus
cggcgtccgacagaggacacacgtc

SEQ ID NO: 580731 - DNA, 25 bp, Rattus norvegicus
ccctgcagtcgttcgcacggaaacg

SEQ ID NO: 580732 - DNA, 25 bp, Rattus norvegicus
tcactgttcccggattggaatccga

SEQ ID NO: 580733 - DNA, 25 bp, Rattus norvegicus
acctgagccggactatgtagccagc

SEQ ID NO: 580734 - DNA, 25 bp, Rattus norvegicus
tgtagccagccaaccgcacgtgttg

SEQ ID NO: 580735 - DNA, 25 bp, Rattus norvegicus
ggaaggtcagcagggtccctcacgc

SEQ ID NO: 580736 - DNA, 25 bp, Rattus norvegicus
ctacgacgaagatgagtacatgatc

SEQ ID NO: 580737 - DNA, 25 bp, Rattus norvegicus
ccggcgtgcagtacaactatgtcta

SEQ ID NO: 580738 - DNA, 25 bp, Rattus norvegicus
tgaatcagatagagcccggcgtgca

SEQ ID NO: 580739 - DNA, 25 bp, Rattus norvegicus
gccacccagcgccatgaatcagata

SEQ ID NO: 580740 - DNA, 25 bp, Rattus norvegicus
ccatttttctatccgtctgtccatc

SEQ ID NO: 580741 - DNA, 25 bp, Rattus norvegicus
cccaggaaccgcgagaaggtcacca

SEQ ID NO: 580742 - DNA, 25 bp, Rattus norvegicus
gtgttggtgcttcgcccgagactct

SEQ ID NO: 580743 - DNA, 25 bp, Rattus norvegicus
ccggctattaatccgcgcggcgctg

SEQ ID NO: 580744 - DNA, 25 bp, Rattus norvegicus
ggcggcacgtgactctcagccggct

SEQ ID NO: 580745 - DNA, 25 bp, Rattus norvegicus
caaccgcacgtgttggagaccggga

SEQ ID NO: 580746 - DNA, 25 bp, Rattus norvegicus
ccctcacgcgtgtctgtgtctgggt

SEQ ID NO: 580747 - DNA, 25 bp, Rattus norvegicus
cagcctatacatagcggcgaggaac

SEQ ID NO: 580748 - DNA, 25 bp, Rattus norvegicus
ccttggcagtaacgcggacctctgc

SEQ ID NO: 580749 - DNA, 25 bp, Rattus norvegicus
ctagtgaggaccaatcgcatgccga

SEQ ID NO: 580750 - DNA, 25 bp, Rattus norvegicus
ttagtcttacgttgaggccttggca

SEQ ID NO: 580751 - DNA, 25 bp, Rattus norvegicus
tccacccaggtctagcggttctgtg

SEQ ID NO: 580752 - DNA, 25 bp, Rattus norvegicus
gtggccgtgtctacgtagtctactc

SEQ ID NO: 580753 - DNA, 25 bp, Rattus norvegicus
tctttggagatcaagctttctttgc

SEQ ID NO: 580754 - DNA, 25 bp, Rattus norvegicus
gcctccggcgattggttactcccaa

SEQ ID NO: 580755 - DNA, 25 bp, Rattus norvegicus
agtcgcctgcggtaggattctttgg

SEQ ID NO: 580756 - DNA, 25 bp, Rattus norvegicus
actaaacgctggctggagtcgcctg

SEQ ID NO: 580757 - DNA, 25 bp, Rattus norvegicus
tgagccagttcgtcaggccactaaa

SEQ ID NO: 580758 - DNA, 25 bp, Rattus norvegicus
cttcagggatctcgtgagccagttc

SEQ ID NO: 580759 - DNA, 25 bp, Rattus norvegicus
ctctgcgcttgggagttaggtaaga

SEQ ID NO: 580760 - DNA, 25 bp, Rattus norvegicus
cttgctgggtctctttcgtccctca

SEQ ID NO: 580761 - DNA, 25 bp, Rattus norvegicus
gagccagaattgaccagggacctct

SEQ ID NO: 580762 - DNA, 25 bp, Rattus norvegicus
tatcgcaatccgagtagttggcatc

SEQ ID NO: 580763 - DNA, 25 bp, Rattus norvegicus
tgcgcgccatcacggaccgaagata

SEQ ID NO: 580764 - DNA, 25 bp, Rattus norvegicus
gtaacgtggcgactctggctttcgc

SEQ ID NO: 580765 - DNA, 25 bp, Rattus norvegicus
cggctgattcctcgagttgccagta

SEQ ID NO: 580766 - DNA, 25 bp, Rattus norvegicus
accaagaggacccagtgcggtgaca

SEQ ID NO: 580767 - DNA, 25 bp, Rattus norvegicus
tctgtgcgcgcaagtggaaaaccaa

SEQ ID NO: 580768 - DNA, 25 bp, Rattus norvegicus
ccaggaaatgccgaaggggtctgca

SEQ ID NO: 580769 - DNA, 25 bp, Rattus norvegicus
ctgcggattacctgcagcagccggg

SEQ ID NO: 580770 - DNA, 25 bp, Rattus norvegicus
ataagtggctacagtctccgggctc

SEQ ID NO: 580771 - DNA, 25 bp, Rattus norvegicus
cgaggacgagatccagttcctgaga

SEQ ID NO: 580772 - DNA, 25 bp, Rattus norvegicus
ccggcagggtccctgtagagtgaca

SEQ ID NO: 580773 - DNA, 25 bp, Rattus norvegicus
tcctgagaactgtaagtgccatgtc

SEQ ID NO: 580774 - DNA, 25 bp, Rattus norvegicus
catcgccacatgtgtgcaggtgtgc

SEQ ID NO: 580775 - DNA, 25 bp, Rattus norvegicus
taaggacacgcactgctcgctaccg

SEQ ID NO: 580776 - DNA, 25 bp, Rattus norvegicus
tgccaggtaaggacacgcactgctc

SEQ ID NO: 580777 - DNA, 25 bp, Rattus norvegicus
cacggctgccaggtaaggacacgca

SEQ ID NO: 580778 - DNA, 25 bp, Rattus norvegicus
cagaagccgagtgatgaagacaagg

SEQ ID NO: 580779 - DNA, 25 bp, Rattus norvegicus
gaggactcgagtgggacagctacct

SEQ ID NO: 580780 - DNA, 25 bp, Rattus norvegicus
tccctgctgcgagagatcggggttc

SEQ ID NO: 580781 - DNA, 25 bp, Rattus norvegicus
tcgaaactccctgctgcgagagatc

SEQ ID NO: 580782 - DNA, 25 bp, Rattus norvegicus
agagtcgctgcctcgaaactccctg

SEQ ID NO: 580783 - DNA, 25 bp, Rattus norvegicus
cgaacctgaggagagtcgctgcctc

SEQ ID NO: 580784 - DNA, 25 bp, Rattus norvegicus
gctccggggcacaagcgaacctgag

SEQ ID NO: 580785 - DNA, 25 bp, Rattus norvegicus
ccggtagctgcgcttgcatccagca

SEQ ID NO: 580786 - DNA, 25 bp, Rattus norvegicus
caaccgcgggccaagtcggctgcag

SEQ ID NO: 580787 - DNA, 25 bp, Rattus norvegicus
gacagctacctggagcacggctgcc

SEQ ID NO: 580788 - DNA, 25 bp, Rattus norvegicus
cttgcatccagcagaagccgagtga

SEQ ID NO: 580789 - DNA, 25 bp, Rattus norvegicus
gggaaacactcaagcgcacacaatg

SEQ ID NO: 580790 - DNA, 25 bp, Rattus norvegicus
cttagtggggatgccaactttgccc

SEQ ID NO: 580791 - DNA, 25 bp, Rattus norvegicus
aaccgcctcttagtggggatgccaa

SEQ ID NO: 580792 - DNA, 25 bp, Rattus norvegicus
gcaccgtgtgaaccgcctcttagtg

SEQ ID NO: 580793 - DNA, 25 bp, Rattus norvegicus
ttttctgtagtggaagtcgccgcca

SEQ ID NO: 580794 - DNA, 25 bp, Rattus norvegicus
tgtagtggaagtcgccgccaacatg

SEQ ID NO: 580795 - DNA, 25 bp, Rattus norvegicus
cccttagaatatgctgaaaccgatt

SEQ ID NO: 580796 - DNA, 25 bp, Rattus norvegicus
tctgtccagcaccttttacctcagg

SEQ ID NO: 580797 - DNA, 25 bp, Rattus norvegicus
tttacctcaggctgccgtgaggagc

SEQ ID NO: 580798 - DNA, 25 bp, Rattus norvegicus
ccgcgcggggaaacactcaagcgca

SEQ ID NO: 580799 - DNA, 25 bp, Rattus norvegicus
cgcacacaatgaactctgaggaggc

SEQ ID NO: 580800 - DNA, 25 bp, Rattus norvegicus
atgaactctgaggaggccgcgagct

SEQ ID NO: 580801 - DNA, 25 bp, Rattus norvegicus
cgctgaggcgttttctgtagtggaa

SEQ ID NO: 580802 - DNA, 25 bp, Rattus norvegicus
gaaaccgatttctcagaggggcgcc

SEQ ID NO: 580803 - DNA, 25 bp, Rattus norvegicus
tctcaagagcggcaccgaggaaagg

SEQ ID NO: 580804 - DNA, 25 bp, Rattus norvegicus
cggctcttcggagctggactccatt

SEQ ID NO: 580805 - DNA, 25 bp, Rattus norvegicus
tggactccattttgcagattgcggc

SEQ ID NO: 580806 - DNA, 25 bp, Rattus norvegicus
cattttgcagattgcggcttggtga

SEQ ID NO: 580807 - DNA, 25 bp, Rattus norvegicus
aggagtcgtgaactgcaccgcagcc

SEQ ID NO: 580808 - DNA, 25 bp, Rattus norvegicus
caccgcagccgtgtgctctcaagag

SEQ ID NO: 580809 - DNA, 25 bp, Rattus norvegicus
cgagtatggctaaaacgcctgtgca

SEQ ID NO: 580810 - DNA, 25 bp, Rattus norvegicus
tggtccaaactgagccaggaaggta

SEQ ID NO: 580811 - DNA, 25 bp, Rattus norvegicus
cccgagtcttgccaagaagtggcaa

SEQ ID NO: 580812 - DNA, 25 bp, Rattus norvegicus
tcgactagttcgagtatggctaaaa

SEQ ID NO: 580813 - DNA, 25 bp, Rattus norvegicus
aaaacgcctgtgcacgcatgcgcca

SEQ ID NO: 580814 - DNA, 25 bp, Rattus norvegicus
ctgagccaggaaggtacgggttatt

SEQ ID NO: 580815 - DNA, 25 bp, Rattus norvegicus
ccgaggaaaggtgtggtccaaactg

SEQ ID NO: 580816 - DNA, 25 bp, Rattus norvegicus
caagaagtggcaaagctcgactagt

SEQ ID NO: 580817 - DNA, 25 bp, Rattus norvegicus
ctggtctgctcgcacaagctggtct

SEQ ID NO: 580818 - DNA, 25 bp, Rattus norvegicus
ttgcacacgctggtctgctcgcaca

SEQ ID NO: 580819 - DNA, 25 bp, Rattus norvegicus
acacgctggtctgcttgcacacgct

SEQ ID NO: 580820 - DNA, 25 bp, Rattus norvegicus
agacactggtctgctcgcacacact

SEQ ID NO: 580821 - DNA, 25 bp, Rattus norvegicus
gctggcacacgctggtctgctcaca

SEQ ID NO: 580822 - DNA, 25 bp, Rattus norvegicus
ggcacacgctggtctgcttgcacac

SEQ ID NO: 580823 - DNA, 25 bp, Rattus norvegicus
tggcacacgctggtctgctcgcaca

SEQ ID NO: 580824 - DNA, 25 bp, Rattus norvegicus
tcgcacacgctggtctgctggcaca

SEQ ID NO: 580825 - DNA, 25 bp, Rattus norvegicus
gtctgctcgcacaagctggtctgct

SEQ ID NO: 580826 - DNA, 25 bp, Rattus norvegicus
gacactggtctgctcgcacacactg

SEQ ID NO: 580827 - DNA, 25 bp, Rattus norvegicus
acacgctggtctgctggcacacgct

SEQ ID NO: 580828 - DNA, 25 bp, Rattus norvegicus
acactggtctgctcgcacacgctgg

SEQ ID NO: 580829 - DNA, 25 bp, Rattus norvegicus
gcacacgctggtctgcttgcacacg

SEQ ID NO: 580830 - DNA, 25 bp, Rattus norvegicus
tggcacacgctggtctgctcacaga

SEQ ID NO: 580831 - DNA, 25 bp, Rattus norvegicus
ggcctcctctttgttcgccgacgga

SEQ ID NO: 580832 - DNA, 25 bp, Rattus norvegicus
ttcgccgacggagggctcctcagcg

SEQ ID NO: 580833 - DNA, 25 bp, Rattus norvegicus
ggccgccgctcgaatccggaggaac

SEQ ID NO: 580834 - DNA, 25 bp, Rattus norvegicus
gaatccggaggaaccgcaccgagga

SEQ ID NO: 580835 - DNA, 25 bp, Rattus norvegicus
gcgcggggattttctccttagcctc

SEQ ID NO: 580836 - DNA, 25 bp, Rattus norvegicus
ggattttctccttagcctcctcagc

SEQ ID NO: 580837 - DNA, 25 bp, Rattus norvegicus
ctcagcctcgtcagtctcctcagcg

SEQ ID NO: 580838 - DNA, 25 bp, Rattus norvegicus
agcctcctcagcgtctcctcagtgc

SEQ ID NO: 580839 - DNA, 25 bp, Rattus norvegicus
agtgcctcgtcagtcgtctcctcag

SEQ ID NO: 580840 - DNA, 25 bp, Rattus norvegicus
acagggctctctagctgctccgcgg

SEQ ID NO: 580841 - DNA, 25 bp, Rattus norvegicus
tgctgttaccttccgacagctccag

SEQ ID NO: 580842 - DNA, 25 bp, Rattus norvegicus
ctaagagggaattgctgttaccttc

SEQ ID NO: 580843 - DNA, 25 bp, Rattus norvegicus
gcgcgcacacaagcacatgtacaca

SEQ ID NO: 580844 - DNA, 25 bp, Rattus norvegicus
gtcacggccacagggctctctagct

SEQ ID NO: 580845 - DNA, 25 bp, Rattus norvegicus
cagcccattctcctcgggttgcaga

SEQ ID NO: 580846 - DNA, 25 bp, Rattus norvegicus
ctggcccagtccctccgggaagatg

SEQ ID NO: 580847 - DNA, 25 bp, Rattus norvegicus
acgctccttcccgttcgcatgagaa

SEQ ID NO: 580848 - DNA, 25 bp, Rattus norvegicus
cgcatgagaacacacagatcccact

SEQ ID NO: 580849 - DNA, 25 bp, Rattus norvegicus
ggacgactctgcacacgtctcactt

SEQ ID NO: 580850 - DNA, 25 bp, Rattus norvegicus
gggacacggcctcagggacgactct

SEQ ID NO: 580851 - DNA, 25 bp, Rattus norvegicus
ttgcagaggcaaacccgcaagggcc

SEQ ID NO: 580852 - DNA, 25 bp, Rattus norvegicus
cgacagcagctgatccttccttttt

SEQ ID NO: 580853 - DNA, 25 bp, Rattus norvegicus
tcgggcccgaaaatgtctcaacctc

SEQ ID NO: 580854 - DNA, 25 bp, Rattus norvegicus
cccatctcgcggcatctgtgattgg

SEQ ID NO: 580855 - DNA, 25 bp, Rattus norvegicus
tgtctcaacctcgagactccagatc

SEQ ID NO: 580856 - DNA, 25 bp, Rattus norvegicus
agagcctagcgtcatggcagcgctg

SEQ ID NO: 580857 - DNA, 25 bp, Rattus norvegicus
gcagcgctgcgtagtgattggctaa

SEQ ID NO: 580858 - DNA, 25 bp, Rattus norvegicus
gctaagtggaaaacgcgagtcctcc

SEQ ID NO: 580859 - DNA, 25 bp, Rattus norvegicus
tacggtggtgccgtcagccaaggta

SEQ ID NO: 580860 - DNA, 25 bp, Rattus norvegicus
cctcgcagacattcaggaaatgatg

SEQ ID NO: 580861 - DNA, 25 bp, Rattus norvegicus
ggtctccttatctctcggccgcgga

SEQ ID NO: 580862 - DNA, 25 bp, Rattus norvegicus
ggccacgcctcgcagacattcagga

SEQ ID NO: 580863 - DNA, 25 bp, Rattus norvegicus
acttcaagaagattacggtggtgcc

SEQ ID NO: 580864 - DNA, 25 bp, Rattus norvegicus
aaatgatgcaatgcttgagccctgc

SEQ ID NO: 580865 - DNA, 25 bp, Rattus norvegicus
tgagccctgcagctaaagttcagtc

SEQ ID NO: 580866 - DNA, 25 bp, Rattus norvegicus
gtcaagccgaatggcggaagtcccg

SEQ ID NO: 580867 - DNA, 25 bp, Rattus norvegicus
gcccgctcttgacggcggaagtccg

SEQ ID NO: 580868 - DNA, 25 bp, Rattus norvegicus
ggcgcattacaacttcaagaagatt

SEQ ID NO: 580869 - DNA, 25 bp, Rattus norvegicus
gccggcatggcgcattacaacttca

SEQ ID NO: 580870 - DNA, 25 bp, Rattus norvegicus
tctccaggtttcctcgtgcgttcca

SEQ ID NO: 580871 - DNA, 25 bp, Rattus norvegicus
tgacggcggaagtccggtcctccgc

SEQ ID NO: 580872 - DNA, 25 bp, Rattus norvegicus
ctaaagttcagtcaagccgaatggc

SEQ ID NO: 580873 - DNA, 25 bp, Rattus norvegicus
gtgcatgcaggaacaggtagatatc

SEQ ID NO: 580874 - DNA, 25 bp, Rattus norvegicus
caggtagatatcagaagattcatca

SEQ ID NO: 580875 - DNA, 25 bp, Rattus norvegicus
gagctatcatgtaggtgcatgttga

SEQ ID NO: 580876 - DNA, 25 bp, Rattus norvegicus
gtgtaagtgcgaaaaagccgagctc

SEQ ID NO: 580877 - DNA, 25 bp, Rattus norvegicus
ggaacaggtagatatcagaagattc

SEQ ID NO: 580878 - DNA, 25 bp, Rattus norvegicus
catgtgcatgcaggaacaggtagat

SEQ ID NO: 580879 - DNA, 25 bp, Rattus norvegicus
ctatcatgtaggtgcatgttgagaa

SEQ ID NO: 580880 - DNA, 25 bp, Rattus norvegicus
catgcaggaacaggtagatatcaga

SEQ ID NO: 580881 - DNA, 25 bp, Rattus norvegicus
gatatcagaagattcatcagatccc

SEQ ID NO: 580882 - DNA, 25 bp, Rattus norvegicus
tggtgttgcaaaaggttttgagcta

SEQ ID NO: 580883 - DNA, 25 bp, Rattus norvegicus
gcaaaaggttttgagctatcatgta

SEQ ID NO: 580884 - DNA, 25 bp, Rattus norvegicus
aggttttgagctatcatgtaggtgc

SEQ ID NO: 580885 - DNA, 25 bp, Rattus norvegicus
ttttgagctatcatgtaggtgcatg

SEQ ID NO: 580886 - DNA, 25 bp, Rattus norvegicus
cgcacacacacaccatgtgcatgca

SEQ ID NO: 580887 - DNA, 25 bp, Rattus norvegicus
ccctggagcccaagagatggtgttg

SEQ ID NO: 580888 - DNA, 25 bp, Rattus norvegicus
tagtgattgcgaccctggagcccaa

SEQ ID NO: 580889 - DNA, 25 bp, Rattus norvegicus
gtccggaagacttgctggagatccc

SEQ ID NO: 580890 - DNA, 25 bp, Rattus norvegicus
gactgcccgcacgtctagctgcttt

SEQ ID NO: 580891 - DNA, 25 bp, Rattus norvegicus
cgactcccagtggacagctgagact

SEQ ID NO: 580892 - DNA, 25 bp, Rattus norvegicus
ccaatctagcgtagtcctgacgtca

SEQ ID NO: 580893 - DNA, 25 bp, Rattus norvegicus
tgcctccagccaattgccaatctag

SEQ ID NO: 580894 - DNA, 25 bp, Rattus norvegicus
gctgatccaatcactcctgccagtg

SEQ ID NO: 580895 - DNA, 25 bp, Rattus norvegicus
agcttcctcactggggagacttctt

SEQ ID NO: 580896 - DNA, 25 bp, Rattus norvegicus
gtacttcaacgctctcggcagcatg

SEQ ID NO: 580897 - DNA, 25 bp, Rattus norvegicus
cctgactcagcttgtgtgcgcgtgt

SEQ ID NO: 580898 - DNA, 25 bp, Rattus norvegicus
cgggctcaccaatcagctggaggca

SEQ ID NO: 580899 - DNA, 25 bp, Rattus norvegicus
tggcatcttcgaccatgcccgggct

SEQ ID NO: 580900 - DNA, 25 bp, Rattus norvegicus
tcggtcgccagccaatggcatcttc

SEQ ID NO: 580901 - DNA, 25 bp, Rattus norvegicus
tcatgcaacaatcgcgtgtaccgtt

SEQ ID NO: 580902 - DNA, 25 bp, Rattus norvegicus
tacgaattgagtacgacctaggctg

SEQ ID NO: 580903 - DNA, 25 bp, Rattus norvegicus
gagcttccggtctgttttttaatga

SEQ ID NO: 580904 - DNA, 25 bp, Rattus norvegicus
agaacttccgcagccgttgagcctg

SEQ ID NO: 580905 - DNA, 25 bp, Rattus norvegicus
gtctcggggagcaattcatgcaaca

SEQ ID NO: 580906 - DNA, 25 bp, Rattus norvegicus
agctaggccatagtccaggtctcca

SEQ ID NO: 580907 - DNA, 25 bp, Rattus norvegicus
gcgtgtgcttttcccatgttaccaa

SEQ ID NO: 580908 - DNA, 25 bp, Rattus norvegicus
taggggacgccatactcgttctgca

SEQ ID NO: 580909 - DNA, 25 bp, Rattus norvegicus
atgttaccaacgctacggggtctcg

SEQ ID NO: 580910 - DNA, 25 bp, Rattus norvegicus
gtgactggcatcttggagaagcttc

SEQ ID NO: 580911 - DNA, 25 bp, Rattus norvegicus
gctgtgacaggtgacgccatcttct

SEQ ID NO: 580912 - DNA, 25 bp, Rattus norvegicus
ctatccgcatggaacaatcctgtgg

SEQ ID NO: 580913 - DNA, 25 bp, Rattus norvegicus
cagggaaagcgctgaacctacttgc

SEQ ID NO: 580914 - DNA, 25 bp, Rattus norvegicus
tcgttctgcagtcattcgctgggtc

SEQ ID NO: 580915 - DNA, 25 bp, Rattus norvegicus
gggacggaactcatggaaacggatc

SEQ ID NO: 580916 - DNA, 25 bp, Rattus norvegicus
tccatgatggaaaaactctgagcga

SEQ ID NO: 580917 - DNA, 25 bp, Rattus norvegicus
ggacgaccagctcctccatgatgga

SEQ ID NO: 580918 - DNA, 25 bp, Rattus norvegicus
aaacgcatcttggagggcatcctca

SEQ ID NO: 580919 - DNA, 25 bp, Rattus norvegicus
caccgtgcttgaactgaaacgcatc

SEQ ID NO: 580920 - DNA, 25 bp, Rattus norvegicus
aggaggaatcgagcaccgtgcttga

SEQ ID NO: 580921 - DNA, 25 bp, Rattus norvegicus
atcatctttaaggactcggaggagg

SEQ ID NO: 580922 - DNA, 25 bp, Rattus norvegicus
cgatccggggccacaagaccatcat

SEQ ID NO: 580923 - DNA, 25 bp, Rattus norvegicus
tgttcctcacgatccggggccacaa

SEQ ID NO: 580924 - DNA, 25 bp, Rattus norvegicus
ccgctgggatggaagtgttcctcac

SEQ ID NO: 580925 - DNA, 25 bp, Rattus norvegicus
cggagcaaggcgtaaagccagaagc

SEQ ID NO: 580926 - DNA, 25 bp, Rattus norvegicus
cagtcaggttagaaatgccggagca

SEQ ID NO: 580927 - DNA, 25 bp, Rattus norvegicus
aactctgagcgagtgcggcttcacc

SEQ ID NO: 580928 - DNA, 25 bp, Rattus norvegicus
tggaaacggatctacagtcaggtta

SEQ ID NO: 580929 - DNA, 25 bp, Rattus norvegicus
aagcgtcgagcgacgcggaccctct

SEQ ID NO: 580930 - DNA, 25 bp, Rattus norvegicus
agcggagttcttcgggaccctagtg

SEQ ID NO: 580931 - DNA, 25 bp, Rattus norvegicus
tggtccgcatgaaggagttggtagc

SEQ ID NO: 580932 - DNA, 25 bp, Rattus norvegicus
acaagtgtcctgtgaagcgtcgagc

SEQ ID NO: 580933 - DNA, 25 bp, Rattus norvegicus
cgcagcggctacaagtgtcctgtga

SEQ ID NO: 580934 - DNA, 25 bp, Rattus norvegicus
gagccgcagcggctacaagtgtcct

SEQ ID NO: 580935 - DNA, 25 bp, Rattus norvegicus
agcggtcgccatggagctttctggc

SEQ ID NO: 580936 - DNA, 25 bp, Rattus norvegicus
aagctgagcggtcgccatggagctt

SEQ ID NO: 580937 - DNA, 25 bp, Rattus norvegicus
ctctgtggcgcgctgttgaagctga

SEQ ID NO: 580938 - DNA, 25 bp, Rattus norvegicus
cttcgggaccctagtggagcaggac

SEQ ID NO: 580939 - DNA, 25 bp, Rattus norvegicus
cttccgggtgacgattctctgtggc

SEQ ID NO: 580940 - DNA, 25 bp, Rattus norvegicus
agttcttcgggaccctagtggagca

SEQ ID NO: 580941 - DNA, 25 bp, Rattus norvegicus
tcgccatggagctttctggcgagta

SEQ ID NO: 580942 - DNA, 25 bp, Rattus norvegicus
acgattctctgtggcgcgctgttga

SEQ ID NO: 580943 - DNA, 25 bp, Rattus norvegicus
gtagcgttcggcatctcacgacctc

SEQ ID NO: 580944 - DNA, 25 bp, Rattus norvegicus
gaccaggactcttcgacgtccagca

SEQ ID NO: 580945 - DNA, 25 bp, Rattus norvegicus
tacggtagcgttcggcatctcacga

SEQ ID NO: 580946 - DNA, 25 bp, Rattus norvegicus
tcggcatctcacgacctccttaaga

SEQ ID NO: 580947 - DNA, 25 bp, Rattus norvegicus
tctcacgacctccttaagatgagtg

SEQ ID NO: 580948 - DNA, 25 bp, Rattus norvegicus
acgacctccttaagatgagtgacca

SEQ ID NO: 580949 - DNA, 25 bp, Rattus norvegicus
aggcttcagtgcttgctgagtacgg

SEQ ID NO: 580950 - DNA, 25 bp, Rattus norvegicus
acaaggcttcagtgcttgctgagta

SEQ ID NO: 580951 - DNA, 25 bp, Rattus norvegicus
cgtgggacaaggcttcagtgcttgc

SEQ ID NO: 580952 - DNA, 25 bp, Rattus norvegicus
ccacagcccattggcgctcgggcga

SEQ ID NO: 580953 - DNA, 25 bp, Rattus norvegicus
gagtcccgcctatcgccacagccca

SEQ ID NO: 580954 - DNA, 25 bp, Rattus norvegicus
ctgagtacggtagcgttcggcatct

SEQ ID NO: 580955 - DNA, 25 bp, Rattus norvegicus
tgagtgaccaggactcttcgacgtc

SEQ ID NO: 580956 - DNA, 25 bp, Rattus norvegicus
ccgcccttgcatgagtcccgcctat

SEQ ID NO: 580957 - DNA, 25 bp, Rattus norvegicus
agcattctctgctgctgcattgcgg

SEQ ID NO: 580958 - DNA, 25 bp, Rattus norvegicus
tggcattggctaccaggcagcgtct

SEQ ID NO: 580959 - DNA, 25 bp, Rattus norvegicus
tgtggcattggctaccaggcagcgt

SEQ ID NO: 580960 - DNA, 25 bp, Rattus norvegicus
ctccgggtgtggcattggctaccag

SEQ ID NO: 580961 - DNA, 25 bp, Rattus norvegicus
tcctccgggtgtggcattggctacc

SEQ ID NO: 580962 - DNA, 25 bp, Rattus norvegicus
atcctccgggtgtggcattggctac

SEQ ID NO: 580963 - DNA, 25 bp, Rattus norvegicus
ctgcattgcgggatgcgcagctgtg

SEQ ID NO: 580964 - DNA, 25 bp, Rattus norvegicus
ctgctgctgcattgcgggatgcgca

SEQ ID NO: 580965 - DNA, 25 bp, Rattus norvegicus
gcattggctaccaggcagcgtctcg

SEQ ID NO: 580966 - DNA, 25 bp, Rattus norvegicus
ctctgctgctgcattgcgggatgcg

SEQ ID NO: 580967 - DNA, 25 bp, Rattus norvegicus
tctctgctgctgcattgcgggatgc

SEQ ID NO: 580968 - DNA, 25 bp, Rattus norvegicus
ttctctgctgctgcattgcgggatg

SEQ ID NO: 580969 - DNA, 25 bp, Rattus norvegicus
cattctctgctgctgcattgcggga

SEQ ID NO: 580970 - DNA, 25 bp, Rattus norvegicus
gcagcattctctgctgctgcattgc

SEQ ID NO: 580971 - DNA, 25 bp, Rattus norvegicus
ttcaaaactgatctcgcccgcctgt

SEQ ID NO: 580972 - DNA, 25 bp, Rattus norvegicus
cggcggctggcttttcaaaactgat

SEQ ID NO: 580973 - DNA, 25 bp, Rattus norvegicus
tgatctcgcccgcctgttggtctca

SEQ ID NO: 580974 - DNA, 25 bp, Rattus norvegicus
aaactgatctcgcccgcctgttggt

SEQ ID NO: 580975 - DNA, 25 bp, Rattus norvegicus
tcaaaactgatctcgcccgcctgtt

SEQ ID NO: 580976 - DNA, 25 bp, Rattus norvegicus
tttcaaaactgatctcgcccgcctg

SEQ ID NO: 580977 - DNA, 25 bp, Rattus norvegicus
ttttcaaaactgatctcgcccgcct

SEQ ID NO: 580978 - DNA, 25 bp, Rattus norvegicus
ctggcttttcaaaactgatctcgcc

SEQ ID NO: 580979 - DNA, 25 bp, Rattus norvegicus
gctggcttttcaaaactgatctcgc

SEQ ID NO: 580980 - DNA, 25 bp, Rattus norvegicus
ggctggcttttcaaaactgatctcg

SEQ ID NO: 580981 - DNA, 25 bp, Rattus norvegicus
cggctggcttttcaaaactgatctc

SEQ ID NO: 580982 - DNA, 25 bp, Rattus norvegicus
gcggctggcttttcaaaactgatct

SEQ ID NO: 580983 - DNA, 25 bp, Rattus norvegicus
ggcggctggcttttcaaaactgatc

SEQ ID NO: 580984 - DNA, 25 bp, Rattus norvegicus
caaaactgatctcgcccgcctgttg

SEQ ID NO: 580985 - DNA, 25 bp, Rattus norvegicus
gtagcgcttaatcaaactgcccggc

SEQ ID NO: 580986 - DNA, 25 bp, Rattus norvegicus
gtgggtctgctgtttagattcgccg

SEQ ID NO: 580987 - DNA, 25 bp, Rattus norvegicus
cgcagtgggtctgctgtttagattc

SEQ ID NO: 580988 - DNA, 25 bp, Rattus norvegicus
gcattataccggctcgcagtgggtc

SEQ ID NO: 580989 - DNA, 25 bp, Rattus norvegicus
caccgagaccttttagcattatacc

SEQ ID NO: 580990 - DNA, 25 bp, Rattus norvegicus
ctcgcaccgagaccttttagcatta

SEQ ID NO: 580991 - DNA, 25 bp, Rattus norvegicus
agcatagcgtctcgcaccgagacct

SEQ ID NO: 580992 - DNA, 25 bp, Rattus norvegicus
tcactcctcccacccagcatagcgt

SEQ ID NO: 580993 - DNA, 25 bp, Rattus norvegicus
agcaactctggccttctgatcactc

SEQ ID NO: 580994 - DNA, 25 bp, Rattus norvegicus
gcgcttaatcaaactgcccggcgtc

SEQ ID NO: 580995 - DNA, 25 bp, Rattus norvegicus
tcagtccaggtagcgcttaatcaaa

SEQ ID NO: 580996 - DNA, 25 bp, Rattus norvegicus
ccacctcagtccaggtagcgcttaa

SEQ ID NO: 580997 - DNA, 25 bp, Rattus norvegicus
cgcctgttggtctcaccgccttccg

SEQ ID NO: 580998 - DNA, 25 bp, Rattus norvegicus
cccaaaagcaactctggccttctga

SEQ ID NO: 580999 - DNA, 25 bp, Rattus norvegicus
cgctttggccctgtggcgtattttt

SEQ ID NO: 581000 - DNA, 25 bp, Rattus norvegicus
cgacagcttgtttggtttctcctca

SEQ ID NO: 581001 - DNA, 25 bp, Rattus norvegicus
gctccgaactcggatagccgctttg

SEQ ID NO: 581002 - DNA, 25 bp, Rattus norvegicus
actgtggcctctgtgaaagagaccc

SEQ ID NO: 581003 - DNA, 25 bp, Rattus norvegicus
cctggccgagtgttttcctgactgt

SEQ ID NO: 581004 - DNA, 25 bp, Rattus norvegicus
tctcctcagatgttgtgcctgcggg

SEQ ID NO: 581005 - DNA, 25 bp, Rattus norvegicus
ggagaatctcgcgtcctcacctgga

SEQ ID NO: 581006 - DNA, 25 bp, Rattus norvegicus
aaccacgggacgcatgcagttcagt

SEQ ID NO: 581007 - DNA, 25 bp, Rattus norvegicus
ctaggatgtggaaagccttaggatc

SEQ ID NO: 581008 - DNA, 25 bp, Rattus norvegicus
catccgaagacaggcagagagaccc

SEQ ID NO: 581009 - DNA, 25 bp, Rattus norvegicus
cctgcggacgcagaacattctagga

SEQ ID NO: 581010 - DNA, 25 bp, Rattus norvegicus
gagacccagaaacaagctgccttgg

SEQ ID NO: 581011 - DNA, 25 bp, Rattus norvegicus
ttggacgacttcgacaacccgcgtg

SEQ ID NO: 581012 - DNA, 25 bp, Rattus norvegicus
accggaaatgtgctgtaggggacta

SEQ ID NO: 581013 - DNA, 25 bp, Rattus norvegicus
gaaccttcgtgttcgctgttgtaga

SEQ ID NO: 581014 - DNA, 25 bp, Rattus norvegicus
tcgtcgctggagaagactaactgtg

SEQ ID NO: 581015 - DNA, 25 bp, Rattus norvegicus
agaagactaactgtggctacctttc

SEQ ID NO: 581016 - DNA, 25 bp, Rattus norvegicus
ggctacctttcgctctgatcgcata

SEQ ID NO: 581017 - DNA, 25 bp, Rattus norvegicus
ctgatcgcatagagtgcgccgcgtc

SEQ ID NO: 581018 - DNA, 25 bp, Rattus norvegicus
cgccgcgtcgtgtccgcctgaaaat

SEQ ID NO: 581019 - DNA, 25 bp, Rattus norvegicus
tgtccgcctgaaaatgagatccgca

SEQ ID NO: 581020 - DNA, 25 bp, Rattus norvegicus
acccggctcatcgtcgctggagaag

SEQ ID NO: 581021 - DNA, 25 bp, Rattus norvegicus
ttcttagatccgagcgtttccctcc

SEQ ID NO: 581022 - DNA, 25 bp, Rattus norvegicus
tcgctgttgtagaaatccggacacc

SEQ ID NO: 581023 - DNA, 25 bp, Rattus norvegicus
tccggacaccgtgaatcacaattaa

SEQ ID NO: 581024 - DNA, 25 bp, Rattus norvegicus
caattaagttgacctttgctgagga

SEQ ID NO: 581025 - DNA, 25 bp, Rattus norvegicus
aggtgcggtgcgattcttagatccg

SEQ ID NO: 581026 - DNA, 25 bp, Rattus norvegicus
atgagatccgcagaaccttcgtgtt

SEQ ID NO: 581027 - DNA, 25 bp, Rattus norvegicus
gctgctcagtcgctgtacagcgcac

SEQ ID NO: 581028 - DNA, 25 bp, Rattus norvegicus
taataggctggagggagggtcctcc

SEQ ID NO: 581029 - DNA, 25 bp, Rattus norvegicus
aagcgacgagtctaataggctggag

SEQ ID NO: 581030 - DNA, 25 bp, Rattus norvegicus
tggaagcgacgagtctaataggctg

SEQ ID NO: 581031 - DNA, 25 bp, Rattus norvegicus
acaagtggaatggaagcgacgagtc

SEQ ID NO: 581032 - DNA, 25 bp, Rattus norvegicus
actctcattggacaagtggaatgga

SEQ ID NO: 581033 - DNA, 25 bp, Rattus norvegicus
cgagactctcattggacaagtggaa

SEQ ID NO: 581034 - DNA, 25 bp, Rattus norvegicus
ggagcggtctcgagactctcattgg

SEQ ID NO: 581035 - DNA, 25 bp, Rattus norvegicus
tgcctttaacccgacgcacggcgcg

SEQ ID NO: 581036 - DNA, 25 bp, Rattus norvegicus
gtcggactgcctttaacccgacgca

SEQ ID NO: 581037 - DNA, 25 bp, Rattus norvegicus
ccacatggcatgtgaccagcgtggg

SEQ ID NO: 581038 - DNA, 25 bp, Rattus norvegicus
tcagtcgctgtacagcgcacagtcc

SEQ ID NO: 581039 - DNA, 25 bp, Rattus norvegicus
ccgctgaagcgccacatggcatgtg

SEQ ID NO: 581040 - DNA, 25 bp, Rattus norvegicus
tctcgagactctcattggacaagtg

SEQ ID NO: 581041 - DNA, 25 bp, Rattus norvegicus
cagcggactgactgcaagcgtaacc

SEQ ID NO: 581042 - DNA, 25 bp, Rattus norvegicus
tcggttgcaccttctgatccggtca

SEQ ID NO: 581043 - DNA, 25 bp, Rattus norvegicus
gggaggtgcacagcctaacgttgta

SEQ ID NO: 581044 - DNA, 25 bp, Rattus norvegicus
agacgtctcgcaggctatttttagc

SEQ ID NO: 581045 - DNA, 25 bp, Rattus norvegicus
cctgcgctgattggaaagacgtctc

SEQ ID NO: 581046 - DNA, 25 bp, Rattus norvegicus
gcaattcgaactcggcctgcgctga

SEQ ID NO: 581047 - DNA, 25 bp, Rattus norvegicus
tggcgtgaccgagcctctccattaa

SEQ ID NO: 581048 - DNA, 25 bp, Rattus norvegicus
gcgccgagcccacgcaatatttgca

SEQ ID NO: 581049 - DNA, 25 bp, Rattus norvegicus
tttcatgcaaactggatggcgctgc

SEQ ID NO: 581050 - DNA, 25 bp, Rattus norvegicus
tcaggagtcggagcagaaactgttc

SEQ ID NO: 581051 - DNA, 25 bp, Rattus norvegicus
gctacacattgggagcacatccatg

SEQ ID NO: 581052 - DNA, 25 bp, Rattus norvegicus
tgttgccaatattcctccagggacg

SEQ ID NO: 581053 - DNA, 25 bp, Rattus norvegicus
aggccttcctattggtgcaattcga

SEQ ID NO: 581054 - DNA, 25 bp, Rattus norvegicus
tagcccgtttcgtgcacaatctgta

SEQ ID NO: 581055 - DNA, 25 bp, Rattus norvegicus
ctctccggacatggagccagagccg

SEQ ID NO: 581056 - DNA, 25 bp, Rattus norvegicus
tcagtgctcagcgaggaccaagccg

SEQ ID NO: 581057 - DNA, 25 bp, Rattus norvegicus
atgcctggacagaaatgccgcggga

SEQ ID NO: 581058 - DNA, 25 bp, Rattus norvegicus
atgcaccgagggctagccttgagcc

SEQ ID NO: 581059 - DNA, 25 bp, Rattus norvegicus
gcggaactccacgtagcctagcaac

SEQ ID NO: 581060 - DNA, 25 bp, Rattus norvegicus
caaccgcttcccgttctctgattgg

SEQ ID NO: 581061 - DNA, 25 bp, Rattus norvegicus
aagccgcagggcctcagtgctcagc

SEQ ID NO: 581062 - DNA, 25 bp, Rattus norvegicus
cgccacgatcggtctgctgggcact

SEQ ID NO: 581063 - DNA, 25 bp, Rattus norvegicus
ggcaacttgctgcttcgcagaagct

SEQ ID NO: 581064 - DNA, 25 bp, Rattus norvegicus
tctctgctagaaggcaacttgctgc

SEQ ID NO: 581065 - DNA, 25 bp, Rattus norvegicus
cgcagccgctctctgctagaaggca

SEQ ID NO: 581066 - DNA, 25 bp, Rattus norvegicus
ctgggcagccgccattttcaaatcc

SEQ ID NO: 581067 - DNA, 25 bp, Rattus norvegicus
ctgattggtcgatctctgggcagcc

SEQ ID NO: 581068 - DNA, 25 bp, Rattus norvegicus
tcccgttctctgattggtcgatctc

SEQ ID NO: 581069 - DNA, 25 bp, Rattus norvegicus
tgttatcgggagtcacgtgggtcct

SEQ ID NO: 581070 - DNA, 25 bp, Rattus norvegicus
cctcggctgttatcgggagtcacgt

SEQ ID NO: 581071 - DNA, 25 bp, Rattus norvegicus
tcacagctacggagcagcctaggtg

SEQ ID NO: 581072 - DNA, 25 bp, Rattus norvegicus
gccaggccaggctgagcactcagaa

SEQ ID NO: 581073 - DNA, 25 bp, Rattus norvegicus
ctgctcacagctacggagcagccta

SEQ ID NO: 581074 - DNA, 25 bp, Rattus norvegicus
agctacggagcagcctaggtgcgcc

SEQ ID NO: 581075 - DNA, 25 bp, Rattus norvegicus
gctcctgaggtctgcgtgcgtgctc

SEQ ID NO: 581076 - DNA, 25 bp, Rattus norvegicus
gtgcgtgctcgctgcctttgcagaa

SEQ ID NO: 581077 - DNA, 25 bp, Rattus norvegicus
gccaggctgagcactcagaagaaaa

SEQ ID NO: 581078 - DNA, 25 bp, Rattus norvegicus
cgctccaccgcgagcgggaggcatg

SEQ ID NO: 581079 - DNA, 25 bp, Rattus norvegicus
tttgcagaagcacagcgctccaccg

SEQ ID NO: 581080 - DNA, 25 bp, Rattus norvegicus
tgctcgctgcctttgcagaagcaca

SEQ ID NO: 581081 - DNA, 25 bp, Rattus norvegicus
ctgcctttgcagaagcacagcgctc

SEQ ID NO: 581082 - DNA, 25 bp, Rattus norvegicus
ctcagaagaaaagcccggcgtcttg

SEQ ID NO: 581083 - DNA, 25 bp, Rattus norvegicus
cccgagttcctgaccatgatgtcca

SEQ ID NO: 581084 - DNA, 25 bp, Rattus norvegicus
gatggaaacggcaccgtggacttcc

SEQ ID NO: 581085 - DNA, 25 bp, Rattus norvegicus
aatcgacaaggatggaaacggcacc

SEQ ID NO: 581086 - DNA, 25 bp, Rattus norvegicus
tccaggaagatgaaagacaccgaca

SEQ ID NO: 581087 - DNA, 25 bp, Rattus norvegicus
gacaccgacagcgaggaggagatcc

SEQ ID NO: 581088 - DNA, 25 bp, Rattus norvegicus
ttccgggtgtttgacaaggacggca

SEQ ID NO: 581089 - DNA, 25 bp, Rattus norvegicus
gtttgacaaggacggcaacggcttc

SEQ ID NO: 581090 - DNA, 25 bp, Rattus norvegicus
ggacggcaacggcttcgtcagcgca

SEQ ID NO: 581091 - DNA, 25 bp, Rattus norvegicus
aacggcttcgtcagcgcagctgagc

SEQ ID NO: 581092 - DNA, 25 bp, Rattus norvegicus
cttcgtcagcgcagctgagctgagg

SEQ ID NO: 581093 - DNA, 25 bp, Rattus norvegicus
ctgagctgaggcacgtgatgaccag

SEQ ID NO: 581094 - DNA, 25 bp, Rattus norvegicus
cgacgaggaggtagatgaaatgata

SEQ ID NO: 581095 - DNA, 25 bp, Rattus norvegicus
atgaaatgatacaggcggcggatac

SEQ ID NO: 581096 - DNA, 25 bp, Rattus norvegicus
ctgaccatgatgtccaggaagatga

SEQ ID NO: 581097 - DNA, 25 bp, Rattus norvegicus
aaaggccacccatgagtttgctctg

SEQ ID NO: 581098 - DNA, 25 bp, Rattus norvegicus
gtctcagggaaaaggccacccatga

SEQ ID NO: 581099 - DNA, 25 bp, Rattus norvegicus
aagagctggtctcgcggtcctgact

SEQ ID NO: 581100 - DNA, 25 bp, Rattus norvegicus
tgcggcgcgaagcacgtacccacat

SEQ ID NO: 581101 - DNA, 25 bp, Rattus norvegicus
acagaagagtgcaacacgtgcgtcc

SEQ ID NO: 581102 - DNA, 25 bp, Rattus norvegicus
cccgaagggtgacatgcaaaacaga

SEQ ID NO: 581103 - DNA, 25 bp, Rattus norvegicus
actcagctgtcaccgcccgaagggt

SEQ ID NO: 581104 - DNA, 25 bp, Rattus norvegicus
tatctgccgcgtgcggtctgagcgt

SEQ ID NO: 581105 - DNA, 25 bp, Rattus norvegicus
ttgtagtttctgtatctgccgcgtg

SEQ ID NO: 581106 - DNA, 25 bp, Rattus norvegicus
tgactgctaccttggccaccgctgg

SEQ ID NO: 581107 - DNA, 25 bp, Rattus norvegicus
cttgtcactctgagcgctgggacct

SEQ ID NO: 581108 - DNA, 25 bp, Rattus norvegicus
tgagcccggacctaagccgggacca

SEQ ID NO: 581109 - DNA, 25 bp, Rattus norvegicus
cggagcctgactgctaccttggcca

SEQ ID NO: 581110 - DNA, 25 bp, Rattus norvegicus
tccgcgatgcccgtctcagggaaaa

SEQ ID NO: 581111 - DNA, 25 bp, Rattus norvegicus
tgtgagctcagctcctcagggaagg

SEQ ID NO: 581112 - DNA, 25 bp, Rattus norvegicus
gacaggtaacgctccctcaggggtc

SEQ ID NO: 581113 - DNA, 25 bp, Rattus norvegicus
cagcgcctggctggtttctgaagcc

SEQ ID NO: 581114 - DNA, 25 bp, Rattus norvegicus
ttaaagcatgggaaggacactgagc

SEQ ID NO: 581115 - DNA, 25 bp, Rattus norvegicus
gcgacccacggagctttagttttca

SEQ ID NO: 581116 - DNA, 25 bp, Rattus norvegicus
aaagcaagagcaacgtggacgccgg

SEQ ID NO: 581117 - DNA, 25 bp, Rattus norvegicus
agttttcactttctgtcttctgagc

SEQ ID NO: 581118 - DNA, 25 bp, Rattus norvegicus
cacgaggtttcacttccggttactg

SEQ ID NO: 581119 - DNA, 25 bp, Rattus norvegicus
gcttctcgcccgtgagactgagtga

SEQ ID NO: 581120 - DNA, 25 bp, Rattus norvegicus
gcgcgcctgcgcataaaagaaaaag

SEQ ID NO: 581121 - DNA, 25 bp, Rattus norvegicus
tcgtccaatccagagcgagctttgc

SEQ ID NO: 581122 - DNA, 25 bp, Rattus norvegicus
agggaaagctcggtcgtccaatcca

SEQ ID NO: 581123 - DNA, 25 bp, Rattus norvegicus
tccggctgcctacatctcgcgagaa

SEQ ID NO: 581124 - DNA, 25 bp, Rattus norvegicus
ctctctcacggtccacgaggtttca

SEQ ID NO: 581125 - DNA, 25 bp, Rattus norvegicus
actccgccctttgggactttgagtg

SEQ ID NO: 581126 - DNA, 25 bp, Rattus norvegicus
ccaacacgggcgacttgggacagtc

SEQ ID NO: 581127 - DNA, 25 bp, Rattus norvegicus
gacagtcgccaatggggtgcagaca

SEQ ID NO: 581128 - DNA, 25 bp, Rattus norvegicus
ggagctagtgtacaccgaccggacc

SEQ ID NO: 581129 - DNA, 25 bp, Rattus norvegicus
cggtgcccagcacgatcacgtcgta

SEQ ID NO: 581130 - DNA, 25 bp, Rattus norvegicus
cacgtcgtattcctcattcatggcg

SEQ ID NO: 581131 - DNA, 25 bp, Rattus norvegicus
cggccgccacctcaacgggaagaga

SEQ ID NO: 581132 - DNA, 25 bp, Rattus norvegicus
gtgctgtcagtcatgggagacctgc

SEQ ID NO: 581133 - DNA, 25 bp, Rattus norvegicus
ggagacctgctatctcattggtgca

SEQ ID NO: 581134 - DNA, 25 bp, Rattus norvegicus
cctcgtttcccgtctcgcgagagaa

SEQ ID NO: 581135 - DNA, 25 bp, Rattus norvegicus
ttcctacccgtcttgcgctacggtg

SEQ ID NO: 581136 - DNA, 25 bp, Rattus norvegicus
tgggctaccacgtgcctgattccgg

SEQ ID NO: 581137 - DNA, 25 bp, Rattus norvegicus
tggagttcggttaagtcttcaggcc

SEQ ID NO: 581138 - DNA, 25 bp, Rattus norvegicus
gattccggcacctagacatgagatg

SEQ ID NO: 581139 - DNA, 25 bp, Rattus norvegicus
cagccctgactgtcggaggaacctg

SEQ ID NO: 581140 - DNA, 25 bp, Rattus norvegicus
gacgctgagaacgtgctctgcactc

SEQ ID NO: 581141 - DNA, 25 bp, Rattus norvegicus
gtctccaagcatccttatgacttca

SEQ ID NO: 581142 - DNA, 25 bp, Rattus norvegicus
tgaatgaccacgcactccgcagcct

SEQ ID NO: 581143 - DNA, 25 bp, Rattus norvegicus
aaagtcctgaaggatagccacgccc

SEQ ID NO: 581144 - DNA, 25 bp, Rattus norvegicus
ctgcagaatccttcagccctgactg

SEQ ID NO: 581145 - DNA, 25 bp, Rattus norvegicus
acttcacgccggggtcaaagtcctg

SEQ ID NO: 581146 - DNA, 25 bp, Rattus norvegicus
aggaacctggcgcaagccgcgtgct

SEQ ID NO: 581147 - DNA, 25 bp, Rattus norvegicus
gcaagccgcgtgctgacctgcacag

SEQ ID NO: 581148 - DNA, 25 bp, Rattus norvegicus
tgctgacctgcacaggccagatgca

SEQ ID NO: 581149 - DNA, 25 bp, Rattus norvegicus
ccagatgcagggctaaagggagaca

SEQ ID NO: 581150 - DNA, 25 bp, Rattus norvegicus
ctaaagggagacacgggtgatcgac

SEQ ID NO: 581151 - DNA, 25 bp, Rattus norvegicus
cacgggtgatcgacgctgagaacgt

SEQ ID NO: 581152 - DNA, 25 bp, Rattus norvegicus
aggcgcctgttaggtctgcagaatc

SEQ ID NO: 581153 - DNA, 25 bp, Rattus norvegicus
tggtgcaaaaaatcggcccgggagc

SEQ ID NO: 581154 - DNA, 25 bp, Rattus norvegicus
gtgagcgcgaacacgtgtcagaatg

SEQ ID NO: 581155 - DNA, 25 bp, Rattus norvegicus
tcacagtgcatgtccgggtgtcacc

SEQ ID NO: 581156 - DNA, 25 bp, Rattus norvegicus
gggtgtcacctcatcctttctcgga

SEQ ID NO: 581157 - DNA, 25 bp, Rattus norvegicus
tctcggaatagtctcccggaccagc

SEQ ID NO: 581158 - DNA, 25 bp, Rattus norvegicus
cccagagagaaaccggcgtctcggg

SEQ ID NO: 581159 - DNA, 25 bp, Rattus norvegicus
ccgccgggcgctggtgcaaaaaatc

SEQ ID NO: 581160 - DNA, 25 bp, Rattus norvegicus
tcgccgcggaggatggtgacctcac

SEQ ID NO: 581161 - DNA, 25 bp, Rattus norvegicus
atggtgacctcacggctcgggccgc

SEQ ID NO: 581162 - DNA, 25 bp, Rattus norvegicus
gccgtcggaaccgaagatctcaccg

SEQ ID NO: 581163 - DNA, 25 bp, Rattus norvegicus
aaccgaagatctcaccggaggggcg

SEQ ID NO: 581164 - DNA, 25 bp, Rattus norvegicus
atcggaaccgggcagcagggaacaa

SEQ ID NO: 581165 - DNA, 25 bp, Rattus norvegicus
cgggcagcagggaacaacgccatcc

SEQ ID NO: 581166 - DNA, 25 bp, Rattus norvegicus
aagatcccgccgtgcgcgattgtga

SEQ ID NO: 581167 - DNA, 25 bp, Rattus norvegicus
tgagaccgtggatttggcgtgggtt

SEQ ID NO: 581168 - DNA, 25 bp, Rattus norvegicus
cgagccgggcaaacttcatattgtg

SEQ ID NO: 581169 - DNA, 25 bp, Rattus norvegicus
ccgggccgccatagtgcgtgagacc

SEQ ID NO: 581170 - DNA, 25 bp, Rattus norvegicus
gccgggcaaacttcatattgtgggg

SEQ ID NO: 581171 - DNA, 25 bp, Rattus norvegicus
ggcaaacttcatattgtgggggccc

SEQ ID NO: 581172 - DNA, 25 bp, Rattus norvegicus
cccgcgcaggggtcttggcctcggg

SEQ ID NO: 581173 - DNA, 25 bp, Rattus norvegicus
gtgggtgtaggagctggccgcgccc

SEQ ID NO: 581174 - DNA, 25 bp, Rattus norvegicus
cgcggtggtcaggagtgggcctgca

SEQ ID NO: 581175 - DNA, 25 bp, Rattus norvegicus
aggaggccggaagctctctgcagac

SEQ ID NO: 581176 - DNA, 25 bp, Rattus norvegicus
ggaggccggaagctctctgcagacc

SEQ ID NO: 581177 - DNA, 25 bp, Rattus norvegicus
gctctctgcagaccggcatcccttc

SEQ ID NO: 581178 - DNA, 25 bp, Rattus norvegicus
tctgcagaccggcatcccttcgccg

SEQ ID NO: 581179 - DNA, 25 bp, Rattus norvegicus
atcccttcgccgctccctgaggctc

SEQ ID NO: 581180 - DNA, 25 bp, Rattus norvegicus
tgcgagccgggcaaacttcatattg

SEQ ID NO: 581181 - DNA, 25 bp, Rattus norvegicus
ccagcgagtagaaagcagatgcctc

SEQ ID NO: 581182 - DNA, 25 bp, Rattus norvegicus
cagcagccggctctcgtagacaggg

SEQ ID NO: 581183 - DNA, 25 bp, Rattus norvegicus
gggctcccatagacaccgagcgcgg

SEQ ID NO: 581184 - DNA, 25 bp, Rattus norvegicus
cccttaccagcgagtagaaagcaga

SEQ ID NO: 581185 - DNA, 25 bp, Rattus norvegicus
cagaattgagttcgtggcgtgcagt

SEQ ID NO: 581186 - DNA, 25 bp, Rattus norvegicus
agcagatgcctcagaaccataggtc

SEQ ID NO: 581187 - DNA, 25 bp, Rattus norvegicus
tgcctcagaaccataggtcacgtaa

SEQ ID NO: 581188 - DNA, 25 bp, Rattus norvegicus
ccataggtcacgtaattgccatagc

SEQ ID NO: 581189 - DNA, 25 bp, Rattus norvegicus
ggtcacgtaattgccatagccttgc

SEQ ID NO: 581190 - DNA, 25 bp, Rattus norvegicus
tgccatagccttgcgagctgctgta

SEQ ID NO: 581191 - DNA, 25 bp, Rattus norvegicus
agtcagccagtgtgcggccgcccga

SEQ ID NO: 581192 - DNA, 25 bp, Rattus norvegicus
ctctcgtagacagggcagtagacgg

SEQ ID NO: 581193 - DNA, 25 bp, Rattus norvegicus
ttgcgagctgctgtaggggctccca

SEQ ID NO: 581194 - DNA, 25 bp, Rattus norvegicus
tgtaggggctcccatagacaccgag

SEQ ID NO: 581195 - DNA, 25 bp, Rattus norvegicus
gtctcgtcgcgtccctccgggactc

SEQ ID NO: 581196 - DNA, 25 bp, Rattus norvegicus
aacctgggcggtgcgcacttccggt

SEQ ID NO: 581197 - DNA, 25 bp, Rattus norvegicus
gggcatcgtcgtcttccaatcgcgc

SEQ ID NO: 581198 - DNA, 25 bp, Rattus norvegicus
cgtcgtcttccaatcgcgcacaatg

SEQ ID NO: 581199 - DNA, 25 bp, Rattus norvegicus
cccacggcggcttcgtggccagtag

SEQ ID NO: 581200 - DNA, 25 bp, Rattus norvegicus
cgcacaatgagacggcgctgagcgc

SEQ ID NO: 581201 - DNA, 25 bp, Rattus norvegicus
aaccctgtcaatggccgggcgcttc

SEQ ID NO: 581202 - DNA, 25 bp, Rattus norvegicus
cccgaggagcgtatctgcccggccc

SEQ ID NO: 581203 - DNA, 25 bp, Rattus norvegicus
tacgttggcgccgtccttctccggc

SEQ ID NO: 581204 - DNA, 25 bp, Rattus norvegicus
agctctcgggttcgagtccgtgtct

SEQ ID NO: 581205 - DNA, 25 bp, Rattus norvegicus
tcgggttcgagtccgtgtcttcact

SEQ ID NO: 581206 - DNA, 25 bp, Rattus norvegicus
cgagtccgtgtcttcactttgtgtc

SEQ ID NO: 581207 - DNA, 25 bp, Rattus norvegicus
gtcttcactttgtgtcggggctccg

SEQ ID NO: 581208 - DNA, 25 bp, Rattus norvegicus
ttccaatcgcgcacaatgagacggc

SEQ ID NO: 581209 - DNA, 25 bp, Rattus norvegicus
agtcccttaagtcttgccgagcttg

SEQ ID NO: 581210 - DNA, 25 bp, Rattus norvegicus
gcgcacatttctcttaagtccctta

SEQ ID NO: 581211 - DNA, 25 bp, Rattus norvegicus
gtcttgccgagcttgtcagacctgc

SEQ ID NO: 581212 - DNA, 25 bp, Rattus norvegicus
ctggcagaggtacaggcgcacattt

SEQ ID NO: 581213 - DNA, 25 bp, Rattus norvegicus
cggtggggtcgctcgactcccttgc

SEQ ID NO: 581214 - DNA, 25 bp, Rattus norvegicus
cacgaatcaagttcagctgggcgtt

SEQ ID NO: 581215 - DNA, 25 bp, Rattus norvegicus
catagccgatcgtccctcacagtga

SEQ ID NO: 581216 - DNA, 25 bp, Rattus norvegicus
ctgcggcgaggccatagccgatcgt

SEQ ID NO: 581217 - DNA, 25 bp, Rattus norvegicus
tgtcagacctgctctccctaagtca

SEQ ID NO: 581218 - DNA, 25 bp, Rattus norvegicus
cacccgcagcgggagcaacagcagt

SEQ ID NO: 581219 - DNA, 25 bp, Rattus norvegicus
gactcctggctcaactccgggaaga

SEQ ID NO: 581220 - DNA, 25 bp, Rattus norvegicus
agggccaggggccactctcttattt

SEQ ID NO: 581221 - DNA, 25 bp, Rattus norvegicus
ctcttatttgcgctctcccaggttc

SEQ ID NO: 581222 - DNA, 25 bp, Rattus norvegicus
gctcaactccgggaagatatgaccc

SEQ ID NO: 581223 - DNA, 25 bp, Rattus norvegicus
cccgcgcggtgcatcactttgcgga

SEQ ID NO: 581224 - DNA, 25 bp, Rattus norvegicus
acggcgccatctcttggccggcaga

SEQ ID NO: 581225 - DNA, 25 bp, Rattus norvegicus
agagacgggatgcagtgtagtcctc

SEQ ID NO: 581226 - DNA, 25 bp, Rattus norvegicus
gaaaccttgtgccaacggcgccatc

SEQ ID NO: 581227 - DNA, 25 bp, Rattus norvegicus
atgcagtgtagtcctccggtcagca

SEQ ID NO: 581228 - DNA, 25 bp, Rattus norvegicus
cagtgcagctttgcttccgcgagtc

SEQ ID NO: 581229 - DNA, 25 bp, Rattus norvegicus
ttgcttccgcgagtcgcacgcaggc

SEQ ID NO: 581230 - DNA, 25 bp, Rattus norvegicus
cgcgccttcacggatgcgctggacg

SEQ ID NO: 581231 - DNA, 25 bp, Rattus norvegicus
acgcaggcgcagacgtgtactcccg

SEQ ID NO: 581232 - DNA, 25 bp, Rattus norvegicus
atcactttgcggactcggtggaggc

SEQ ID NO: 581233 - DNA, 25 bp, Rattus norvegicus
atgggcacagtcgtctcggaaggcc

SEQ ID NO: 581234 - DNA, 25 bp, Rattus norvegicus
ctggcaggcggttccgatctggaac

SEQ ID NO: 581235 - DNA, 25 bp, Rattus norvegicus
ttccgatctggaacggagactcggg

SEQ ID NO: 581236 - DNA, 25 bp, Rattus norvegicus
gagactcgggtgagcgcgccttcac

SEQ ID NO: 581237 - DNA, 25 bp, Rattus norvegicus
gagcgcagcgccagtcgccgtactt

SEQ ID NO: 581238 - DNA, 25 bp, Rattus norvegicus
acgcctggatcctatagcgtcccag

SEQ ID NO: 581239 - DNA, 25 bp, Rattus norvegicus
cgccgtacttctagcgaacgcctgg

SEQ ID NO: 581240 - DNA, 25 bp, Rattus norvegicus
gctacaccacgtgggtgcgggaacc

SEQ ID NO: 581241 - DNA, 25 bp, Rattus norvegicus
gcctagtatcgtccgtggctacacc

SEQ ID NO: 581242 - DNA, 25 bp, Rattus norvegicus
gcacggtacccggtagcctagtatc

SEQ ID NO: 581243 - DNA, 25 bp, Rattus norvegicus
tccagcctttgcacggtacccggta

SEQ ID NO: 581244 - DNA, 25 bp, Rattus norvegicus
gggtgtcccggcgtctctccctgtg

SEQ ID NO: 581245 - DNA, 25 bp, Rattus norvegicus
tgcccttcaggaaaggtagggtgtc

SEQ ID NO: 581246 - DNA, 25 bp, Rattus norvegicus
gggctgccacttggacgtccgcctg

SEQ ID NO: 581247 - DNA, 25 bp, Rattus norvegicus
ggctgtgaccaaatatgtccctttc

SEQ ID NO: 581248 - DNA, 25 bp, Rattus norvegicus
cgtgacgtgccaggctgtgaccaaa

SEQ ID NO: 581249 - DNA, 25 bp, Rattus norvegicus
cagagctcacgggtgacgcgactcc

SEQ ID NO: 581250 - DNA, 25 bp, Rattus norvegicus
ctagcgaacgcctggatcctatagc

SEQ ID NO: 581251 - DNA, 25 bp, Rattus norvegicus
cgcacgtgtctgtgcactgcaggca

SEQ ID NO: 581252 - DNA, 25 bp, Rattus norvegicus
agggtgccgcgacgctttgtaaata

SEQ ID NO: 581253 - DNA, 25 bp, Rattus norvegicus
cgggtctgtcctaccagttgtcgca

SEQ ID NO: 581254 - DNA, 25 bp, Rattus norvegicus
cagtctcagcgtcctgaagaggtca

SEQ ID NO: 581255 - DNA, 25 bp, Rattus norvegicus
cgcgacgctttgtaaatactgtaga

SEQ ID NO: 581256 - DNA, 25 bp, Rattus norvegicus
attttccaagaaggccagggtgccg

SEQ ID NO: 581257 - DNA, 25 bp, Rattus norvegicus
tcctggcaaagggaattttccaaga

SEQ ID NO: 581258 - DNA, 25 bp, Rattus norvegicus
ccgctaggtcgccttcctggcaaag

SEQ ID NO: 581259 - DNA, 25 bp, Rattus norvegicus
taccagttgtcgcacgcacgtgtct

SEQ ID NO: 581260 - DNA, 25 bp, Rattus norvegicus
acgctgagttcacgtgcgggtctgt

SEQ ID NO: 581261 - DNA, 25 bp, Rattus norvegicus
gcctgccgcacgctgagttcacgtg

SEQ ID NO: 581262 - DNA, 25 bp, Rattus norvegicus
gcctcgaggcaggtctgcgtagatt

SEQ ID NO: 581263 - DNA, 25 bp, Rattus norvegicus
gactctccgcggctggcaacaaagg

SEQ ID NO: 581264 - DNA, 25 bp, Rattus norvegicus
tactgtagaggaacctgccagccgg

SEQ ID NO: 581265 - DNA, 25 bp, Rattus norvegicus
cgaaagatccctagatcgccgctga

SEQ ID NO: 581266 - DNA, 25 bp, Rattus norvegicus
acagcccagcttcatcgcgacgtgt

SEQ ID NO: 581267 - DNA, 25 bp, Rattus norvegicus
cctcccagcagagcatgcaggacgt

SEQ ID NO: 581268 - DNA, 25 bp, Rattus norvegicus
acgtgcgcgacgtgtggcagcctct

SEQ ID NO: 581269 - DNA, 25 bp, Rattus norvegicus
agcctctgcgcagacttttccactg

SEQ ID NO: 581270 - DNA, 25 bp, Rattus norvegicus
gcagacttttccactgcagtgtggg

SEQ ID NO: 581271 - DNA, 25 bp, Rattus norvegicus
ggggttccgcgagcgcctccaatca

SEQ ID NO: 581272 - DNA, 25 bp, Rattus norvegicus
ttcatcgcgacgtgtgcagctcgcc

SEQ ID NO: 581273 - DNA, 25 bp, Rattus norvegicus
acgtgtgcagctcgccgctaggcag

SEQ ID NO: 581274 - DNA, 25 bp, Rattus norvegicus
gcagcgcttctgagcggaggcttct

SEQ ID NO: 581275 - DNA, 25 bp, Rattus norvegicus
gcggaggcttctgtcgctaaagcca

SEQ ID NO: 581276 - DNA, 25 bp, Rattus norvegicus
tcgctaaagccacattgaaagtgtc

SEQ ID NO: 581277 - DNA, 25 bp, Rattus norvegicus
gaaagtgtcatgtctccacggcctc

SEQ ID NO: 581278 - DNA, 25 bp, Rattus norvegicus
agatccctagatcgccgctgaatta

SEQ ID NO: 581279 - DNA, 25 bp, Rattus norvegicus
gcacattttccaaagcagcgcaagg

SEQ ID NO: 581280 - DNA, 25 bp, Rattus norvegicus
ccgagactccgcacaaagcacattt

SEQ ID NO: 581281 - DNA, 25 bp, Rattus norvegicus
agctcaatctgtctcgtgtctccgc

SEQ ID NO: 581282 - DNA, 25 bp, Rattus norvegicus
tagtcagcagtgcagcagccgcaac

SEQ ID NO: 581283 - DNA, 25 bp, Rattus norvegicus
gcttctgaacagagccgggtagtca

SEQ ID NO: 581284 - DNA, 25 bp, Rattus norvegicus
gctggagcatccctgagcttctgaa

SEQ ID NO: 581285 - DNA, 25 bp, Rattus norvegicus
tgtggcatcccgacagaacaggaga

SEQ ID NO: 581286 - DNA, 25 bp, Rattus norvegicus
ccgcgctaccggtcagatcttaaaa

SEQ ID NO: 581287 - DNA, 25 bp, Rattus norvegicus
tggcaggtcgccgaatacagcaacg

SEQ ID NO: 581288 - DNA, 25 bp, Rattus norvegicus
tgcctttggaactgacccagagccg

SEQ ID NO: 581289 - DNA, 25 bp, Rattus norvegicus
cagaagatctgggtgcctgtcgatc

SEQ ID NO: 581290 - DNA, 25 bp, Rattus norvegicus
ccctcgttgcccagatgtgagtgca

SEQ ID NO: 581291 - DNA, 25 bp, Rattus norvegicus
tggctccggaaacctcctgtgtgcc

SEQ ID NO: 581292 - DNA, 25 bp, Rattus norvegicus
actcggagtcttccctccaggggtg

SEQ ID NO: 581293 - DNA, 25 bp, Rattus norvegicus
aaccgtaaatgagccgccagtggga

SEQ ID NO: 581294 - DNA, 25 bp, Rattus norvegicus
ctcggctgaaaaaccgtaaatgagc

SEQ ID NO: 581295 - DNA, 25 bp, Rattus norvegicus
cttctggctcggctgaaaaaccgta

SEQ ID NO: 581296 - DNA, 25 bp, Rattus norvegicus
gcagtctcttctggctcggctgaaa

SEQ ID NO: 581297 - DNA, 25 bp, Rattus norvegicus
ttagccgccagagtgccagaaaggg

SEQ ID NO: 581298 - DNA, 25 bp, Rattus norvegicus
gccttagccgccagagtgccagaaa

SEQ ID NO: 581299 - DNA, 25 bp, Rattus norvegicus
ggacgccagagccttagccgccaga

SEQ ID NO: 581300 - DNA, 25 bp, Rattus norvegicus
aagcgggacggacgccagagcctta

SEQ ID NO: 581301 - DNA, 25 bp, Rattus norvegicus
ctggccacttgtcgctctgccggga

SEQ ID NO: 581302 - DNA, 25 bp, Rattus norvegicus
atcctcacgcctcactggccacttg

SEQ ID NO: 581303 - DNA, 25 bp, Rattus norvegicus
agcgctctcggccttcctcccgctg

SEQ ID NO: 581304 - DNA, 25 bp, Rattus norvegicus
tagttgcgttccacgagcgctctcg

SEQ ID NO: 581305 - DNA, 25 bp, Rattus norvegicus
agggacgcgcgcctagttgcgttcc

SEQ ID NO: 581306 - DNA, 25 bp, Rattus norvegicus
tcccagcgcagtgccgctgctgctc

SEQ ID NO: 581307 - DNA, 25 bp, Rattus norvegicus
cgctgattgagaacccgtgtgtaca

SEQ ID NO: 581308 - DNA, 25 bp, Rattus norvegicus
cacgcaactgcatacacgaaacacg

SEQ ID NO: 581309 - DNA, 25 bp, Rattus norvegicus
cgaaacacgcgtgagtgcgggctca

SEQ ID NO: 581310 - DNA, 25 bp, Rattus norvegicus
cgggctcacgtgtacgatcttgcta

SEQ ID NO: 581311 - DNA, 25 bp, Rattus norvegicus
tcttgctacacacgcacacaaagtt

SEQ ID NO: 581312 - DNA, 25 bp, Rattus norvegicus
tctgcgtttgcagtatagagataca

SEQ ID NO: 581313 - DNA, 25 bp, Rattus norvegicus
atatgtcttagcgtgactctcgtgc

SEQ ID NO: 581314 - DNA, 25 bp, Rattus norvegicus
gactctcgtgcacacgcttgataga

SEQ ID NO: 581315 - DNA, 25 bp, Rattus norvegicus
cttgatagaggtgcacctgtgctca

SEQ ID NO: 581316 - DNA, 25 bp, Rattus norvegicus
agccgccgctcgctgattgagaacc

SEQ ID NO: 581317 - DNA, 25 bp, Rattus norvegicus
cgtgtgtacatttacgggcatttta

SEQ ID NO: 581318 - DNA, 25 bp, Rattus norvegicus
taaacaaaggtagcaacgaggacca

SEQ ID NO: 581319 - DNA, 25 bp, Rattus norvegicus
caaatacccagaaagccaccgaaga

SEQ ID NO: 581320 - DNA, 25 bp, Rattus norvegicus
cacggagccaagagtgcactgaata

SEQ ID NO: 581321 - DNA, 25 bp, Rattus norvegicus
ttccttctctcgatcacaggagacg

SEQ ID NO: 581322 - DNA, 25 bp, Rattus norvegicus
aaggaacacgtccaccgcagtgctg

SEQ ID NO: 581323 - DNA, 25 bp, Rattus norvegicus
ctcacgaaagggctagaacgtgtaa

SEQ ID NO: 581324 - DNA, 25 bp, Rattus norvegicus
ccacagcgcgtcaggaaatacgaca

SEQ ID NO: 581325 - DNA, 25 bp, Rattus norvegicus
cgcagtgctgctgccacgcagtgat

SEQ ID NO: 581326 - DNA, 25 bp, Rattus norvegicus
acgcagtgatgtcgagcgctgacta

SEQ ID NO: 581327 - DNA, 25 bp, Rattus norvegicus
tcgagcgctgactataaatcctgcc

SEQ ID NO: 581328 - DNA, 25 bp, Rattus norvegicus
aatcctgcctgcttaatcacatcgg

SEQ ID NO: 581329 - DNA, 25 bp, Rattus norvegicus
tcggcagagctcatgtgcactaaca

SEQ ID NO: 581330 - DNA, 25 bp, Rattus norvegicus
tgcactaacacatgtggcccgctgg

SEQ ID NO: 581331 - DNA, 25 bp, Rattus norvegicus
acatgtggcccgctggaaacggcca

SEQ ID NO: 581332 - DNA, 25 bp, Rattus norvegicus
gaaacggccagctgcaatcggagcg

SEQ ID NO: 581333 - DNA, 25 bp, Rattus norvegicus
tgcaatcggagcgtgcacaatctcc

SEQ ID NO: 581334 - DNA, 25 bp, Rattus norvegicus
tacgacagggtaaggctcacgaaag

SEQ ID NO: 581335 - DNA, 25 bp, Rattus norvegicus
ctactcctttgctgcgtcgtggaca

SEQ ID NO: 581336 - DNA, 25 bp, Rattus norvegicus
tcctcctgggaagacgaaatgcgtc

SEQ ID NO: 581337 - DNA, 25 bp, Rattus norvegicus
ccaatcgctcaggtgggaggagata

SEQ ID NO: 581338 - DNA, 25 bp, Rattus norvegicus
cctcactagagaccacaagcgactg

SEQ ID NO: 581339 - DNA, 25 bp, Rattus norvegicus
gcccactctcctagggtcttttctg

SEQ ID NO: 581340 - DNA, 25 bp, Rattus norvegicus
ggcggaataacgtcctcccagagga

SEQ ID NO: 581341 - DNA, 25 bp, Rattus norvegicus
cgctttcccattcgctggcggaata

SEQ ID NO: 581342 - DNA, 25 bp, Rattus norvegicus
tggccagtgctgttttaacccaatc

SEQ ID NO: 581343 - DNA, 25 bp, Rattus norvegicus
gcagtaactacagacctggccagtg

SEQ ID NO: 581344 - DNA, 25 bp, Rattus norvegicus
ggtgaccacgctgttgcagtaacta

SEQ ID NO: 581345 - DNA, 25 bp, Rattus norvegicus
tctggcttcctaaaactgcagggtg

SEQ ID NO: 581346 - DNA, 25 bp, Rattus norvegicus
gctggggtctgtaattcccatctcc

SEQ ID NO: 581347 - DNA, 25 bp, Rattus norvegicus
acccgactccgtgagcggactgaac

SEQ ID NO: 581348 - DNA, 25 bp, Rattus norvegicus
ggagtctgagccacccaatagaatc

SEQ ID NO: 581349 - DNA, 25 bp, Rattus norvegicus
tccgtagaaagttcacaccgcgtgg

SEQ ID NO: 581350 - DNA, 25 bp, Rattus norvegicus
tctggggcggtgtcctacctgttta

SEQ ID NO: 581351 - DNA, 25 bp, Rattus norvegicus
tacctgtttaagtttgtcctgccag

SEQ ID NO: 581352 - DNA, 25 bp, Rattus norvegicus
gtcctgccaggaattgtggaacctg

SEQ ID NO: 581353 - DNA, 25 bp, Rattus norvegicus
ccactacagcctcattccaatatgg

SEQ ID NO: 581354 - DNA, 25 bp, Rattus norvegicus
tatggcatcctctctatgcgcatgc

SEQ ID NO: 581355 - DNA, 25 bp, Rattus norvegicus
gccgctcgtggtaggctccttttcc

SEQ ID NO: 581356 - DNA, 25 bp, Rattus norvegicus
ttcacaccgcgtgggtaacccgagc

SEQ ID NO: 581357 - DNA, 25 bp, Rattus norvegicus
tctgtacagcgaactccttcaacga

SEQ ID NO: 581358 - DNA, 25 bp, Rattus norvegicus
ttcaacgaccttttcccaatgctcg

SEQ ID NO: 581359 - DNA, 25 bp, Rattus norvegicus
tcccaatgctcgcaaaatgtctcga

SEQ ID NO: 581360 - DNA, 25 bp, Rattus norvegicus
atgtctcgagccaattagcccgccg

SEQ ID NO: 581361 - DNA, 25 bp, Rattus norvegicus
tccctccataagtgatccgtagaaa

SEQ ID NO: 581362 - DNA, 25 bp, Rattus norvegicus
gcacactcaacctgcgggccagaga

SEQ ID NO: 581363 - DNA, 25 bp, Rattus norvegicus
tagaggagctccagtgtcacaacgg

SEQ ID NO: 581364 - DNA, 25 bp, Rattus norvegicus
gacagcgtgagaccgggaaaacatt

SEQ ID NO: 581365 - DNA, 25 bp, Rattus norvegicus
gagaaaactgcaacccacgcgggcg

SEQ ID NO: 581366 - DNA, 25 bp, Rattus norvegicus
tgcgggccgtgagcaagagaaaact

SEQ ID NO: 581367 - DNA, 25 bp, Rattus norvegicus
agagaagctgaggtcccacgctcca

SEQ ID NO: 581368 - DNA, 25 bp, Rattus norvegicus
cccgccgtgtccatggagagaagct

SEQ ID NO: 581369 - DNA, 25 bp, Rattus norvegicus
agcttgtggcgtcaaagtgcccgcc

SEQ ID NO: 581370 - DNA, 25 bp, Rattus norvegicus
acccggactgtccaatgatgaagcg

SEQ ID NO: 581371 - DNA, 25 bp, Rattus norvegicus
agtccgcaaggtcacaggtcgcctc

SEQ ID NO: 581372 - DNA, 25 bp, Rattus norvegicus
aggagccattccacttccggtagaa

SEQ ID NO: 581373 - DNA, 25 bp, Rattus norvegicus
cctgtcgttaaacgtgcgccgtgcg

SEQ ID NO: 581374 - DNA, 25 bp, Rattus norvegicus
tatccgcttgctttactgttagagg

SEQ ID NO: 581375 - DNA, 25 bp, Rattus norvegicus
cgttccgggagaaaggtcactcagg

SEQ ID NO: 581376 - DNA, 25 bp, Rattus norvegicus
ccctggtcgcagaacaagcctggaa

SEQ ID NO: 581377 - DNA, 25 bp, Rattus norvegicus
cctacgcctccgtttagcacaagag

SEQ ID NO: 581378 - DNA, 25 bp, Rattus norvegicus
ctccgtttagcacaagaggcatcta

SEQ ID NO: 581379 - DNA, 25 bp, Rattus norvegicus
agcacaagaggcatctaagaccctg

SEQ ID NO: 581380 - DNA, 25 bp, Rattus norvegicus
gaggcatctaagaccctgaaggccc

SEQ ID NO: 581381 - DNA, 25 bp, Rattus norvegicus
ccagtcactcgcttatcagttctct

SEQ ID NO: 581382 - DNA, 25 bp, Rattus norvegicus
tcgcttatcagttctctccgagatt

SEQ ID NO: 581383 - DNA, 25 bp, Rattus norvegicus
gttctctccgagatttacactttta

SEQ ID NO: 581384 - DNA, 25 bp, Rattus norvegicus
atttacacttttatcgcccgctcgg

SEQ ID NO: 581385 - DNA, 25 bp, Rattus norvegicus
tcgggtttgccactcccgaagcttc

SEQ ID NO: 581386 - DNA, 25 bp, Rattus norvegicus
tgtccaactcttaggaacaccaacg

SEQ ID NO: 581387 - DNA, 25 bp, Rattus norvegicus
cgtaattttaagctcatgctcctta

SEQ ID NO: 581388 - DNA, 25 bp, Rattus norvegicus
taagctcatgctccttaaagtcgga

SEQ ID NO: 581389 - DNA, 25 bp, Rattus norvegicus
cttaaagtcggagacgcccttgacg

SEQ ID NO: 581390 - DNA, 25 bp, Rattus norvegicus
tgctccttaaagtcggagacgccct

SEQ ID NO: 581391 - DNA, 25 bp, Rattus norvegicus
gagtgggctctcactccgccgggtc

SEQ ID NO: 581392 - DNA, 25 bp, Rattus norvegicus
ttggacgttgcaaatcatagctcga

SEQ ID NO: 581393 - DNA, 25 bp, Rattus norvegicus
gcttgcgcagcacggtcccaaagaa

SEQ ID NO: 581394 - DNA, 25 bp, Rattus norvegicus
catagctcgaatgttctcttgaaag

SEQ ID NO: 581395 - DNA, 25 bp, Rattus norvegicus
aaatgccttgcggagtgggctctca

SEQ ID NO: 581396 - DNA, 25 bp, Rattus norvegicus
acctaaggatctgatcggatgtttg

SEQ ID NO: 581397 - DNA, 25 bp, Rattus norvegicus
ttgcggcgaacctaaggatctgatc

SEQ ID NO: 581398 - DNA, 25 bp, Rattus norvegicus
aaacgcttgcattgcggcgaaccta

SEQ ID NO: 581399 - DNA, 25 bp, Rattus norvegicus
gcccaggccgtgaaacgcttgcatt

SEQ ID NO: 581400 - DNA, 25 bp, Rattus norvegicus
cactcagtaaaggagcgtgggctga

SEQ ID NO: 581401 - DNA, 25 bp, Rattus norvegicus
tcaaccttccactcagtaaaggagc

SEQ ID NO: 581402 - DNA, 25 bp, Rattus norvegicus
aacaacagagcagctctcaaccttc

SEQ ID NO: 581403 - DNA, 25 bp, Rattus norvegicus
cagcacggtcccaaagaacaacaga

SEQ ID NO: 581404 - DNA, 25 bp, Rattus norvegicus
ctcttgaaagtaaatgccttgcgga

SEQ ID NO: 581405 - DNA, 25 bp, Rattus norvegicus
ttaggaggcatccttggttccgccc

SEQ ID NO: 581406 - DNA, 25 bp, Rattus norvegicus
gaggcatccttggttccgcccacaa

SEQ ID NO: 581407 - DNA, 25 bp, Rattus norvegicus
accgggaaggattttcagagagttg

SEQ ID NO: 581408 - DNA, 25 bp, Rattus norvegicus
agagttggaatagctgcggctgcaa

SEQ ID NO: 581409 - DNA, 25 bp, Rattus norvegicus
aatagctgcggctgcaaagagaagc

SEQ ID NO: 581410 - DNA, 25 bp, Rattus norvegicus
caaagagaagcgctccattcagccc

SEQ ID NO: 581411 - DNA, 25 bp, Rattus norvegicus
tttatgccctccaggccagccggag

SEQ ID NO: 581412 - DNA, 25 bp, Rattus norvegicus
caggccagccggagtccggtctctg

SEQ ID NO: 581413 - DNA, 25 bp, Rattus norvegicus
gtccggtctctgcaccaccaggacc

SEQ ID NO: 581414 - DNA, 25 bp, Rattus norvegicus
ctgggtttaggaggcatccttggtt

SEQ ID NO: 581415 - DNA, 25 bp, Rattus norvegicus
gcctctctgtcgcttgctgggttta

SEQ ID NO: 581416 - DNA, 25 bp, Rattus norvegicus
tctctgtcgcttgctgggtttagga

SEQ ID NO: 581417 - DNA, 25 bp, Rattus norvegicus
cgcgcgacctctctgggaccgggaa

SEQ ID NO: 581418 - DNA, 25 bp, Rattus norvegicus
cgacctctctgggaccgggaaggat

SEQ ID NO: 581419 - DNA, 25 bp, Rattus norvegicus
catctggcagtaccagcgaagcttc

SEQ ID NO: 581420 - DNA, 25 bp, Rattus norvegicus
gcgtgcttgtctgggatcacttctc

SEQ ID NO: 581421 - DNA, 25 bp, Rattus norvegicus
agcgaagcttctgcagccctttaga

SEQ ID NO: 581422 - DNA, 25 bp, Rattus norvegicus
attctattcgcgatggccttggggc

SEQ ID NO: 581423 - DNA, 25 bp, Rattus norvegicus
tggcgaccctgagagtacaacagcg

SEQ ID NO: 581424 - DNA, 25 bp, Rattus norvegicus
cggataggcgggaccaaaactgaca

SEQ ID NO: 581425 - DNA, 25 bp, Rattus norvegicus
cggcttccgcgctcacgagatttag

SEQ ID NO: 581426 - DNA, 25 bp, Rattus norvegicus
tcgtctgcccgaccttcaaggttct

SEQ ID NO: 581427 - DNA, 25 bp, Rattus norvegicus
ggttctaccatgttctcgcgggcga

SEQ ID NO: 581428 - DNA, 25 bp, Rattus norvegicus
ttgcagccgcaatggtatgactacg

SEQ ID NO: 581429 - DNA, 25 bp, Rattus norvegicus
tcaggacccgtacgagagtcggatt

SEQ ID NO: 581430 - DNA, 25 bp, Rattus norvegicus
gagccatctgggtttcgatcaactc

SEQ ID NO: 581431 - DNA, 25 bp, Rattus norvegicus
agccacttacctcgtcgcggcattg

SEQ ID NO: 581432 - DNA, 25 bp, Rattus norvegicus
cgcggcattgtttttggcacatctg

SEQ ID NO: 581433 - DNA, 25 bp, Rattus norvegicus
caccgacgtcctgcagcgttatctg

SEQ ID NO: 581434 - DNA, 25 bp, Rattus norvegicus
gagactatcgctcccttcctaatgg

SEQ ID NO: 581435 - DNA, 25 bp, Rattus norvegicus
ttcaggccctagagtcgatccggag

SEQ ID NO: 581436 - DNA, 25 bp, Rattus norvegicus
gctgccatcggtactctgaactctg

SEQ ID NO: 581437 - DNA, 25 bp, Rattus norvegicus
agccggtcacgagtgacacctttgc

SEQ ID NO: 581438 - DNA, 25 bp, Rattus norvegicus
cgaacccggcttcgagatggggatc

SEQ ID NO: 581439 - DNA, 25 bp, Rattus norvegicus
atggggatcctctcagactccgatg

SEQ ID NO: 581440 - DNA, 25 bp, Rattus norvegicus
agactccgatggtctggggcttcca

SEQ ID NO: 581441 - DNA, 25 bp, Rattus norvegicus
gcgaactccagtcatcctttaggtg

SEQ ID NO: 581442 - DNA, 25 bp, Rattus norvegicus
actcggtgcagctcagtgcctgcca

SEQ ID NO: 581443 - DNA, 25 bp, Rattus norvegicus
ctaatgggcggagcctgtacctcct

SEQ ID NO: 581444 - DNA, 25 bp, Rattus norvegicus
ctcggtattctgcttgtgctgccta

SEQ ID NO: 581445 - DNA, 25 bp, Rattus norvegicus
ccaaaatggcggctctcaggctggc

SEQ ID NO: 581446 - DNA, 25 bp, Rattus norvegicus
actccaggtcgttgttgagggtctc

SEQ ID NO: 581447 - DNA, 25 bp, Rattus norvegicus
tttctctagtccgaggcgatgcaga

SEQ ID NO: 581448 - DNA, 25 bp, Rattus norvegicus
taggcattccgaggcacgctttcta

SEQ ID NO: 581449 - DNA, 25 bp, Rattus norvegicus
tctctggagggcaacgctcaacacc

SEQ ID NO: 581450 - DNA, 25 bp, Rattus norvegicus
gcaaatatttgctgcctctaggaga

SEQ ID NO: 581451 - DNA, 25 bp, Rattus norvegicus
cgcttcggtctccagcctgcaaata

SEQ ID NO: 581452 - DNA, 25 bp, Rattus norvegicus
cagtcggtaacagcgccatcagatc

SEQ ID NO: 581453 - DNA, 25 bp, Rattus norvegicus
tttccagacccacagcgaccatggt

SEQ ID NO: 581454 - DNA, 25 bp, Rattus norvegicus
tcggctttgctgatcactctctgga

SEQ ID NO: 581455 - DNA, 25 bp, Rattus norvegicus
tggccactgttaaaacggatacacc

SEQ ID NO: 581456 - DNA, 25 bp, Rattus norvegicus
aacgcagctcggtggttattgtctc

SEQ ID NO: 581457 - DNA, 25 bp, Rattus norvegicus
ttgcagcgtgcacaaaatcgaatta

SEQ ID NO: 581458 - DNA, 25 bp, Rattus norvegicus
tcctgggctgtgtatttagtttctg

SEQ ID NO: 581459 - DNA, 25 bp, Rattus norvegicus
cccaaggtagcatcgtttcacatct

SEQ ID NO: 581460 - DNA, 25 bp, Rattus norvegicus
gcgctccgcatgcaaagtccttaag

SEQ ID NO: 581461 - DNA, 25 bp, Rattus norvegicus
acgcgagtgcgtctgccgctgcgct

SEQ ID NO: 581462 - DNA, 25 bp, Rattus norvegicus
gcagccccatctgcgagtgttttcg

SEQ ID NO: 581463 - DNA, 25 bp, Rattus norvegicus
agctttgtcggcactttccgcagcc

SEQ ID NO: 581464 - DNA, 25 bp, Rattus norvegicus
gcccaagctttgtcggcactttccg

SEQ ID NO: 581465 - DNA, 25 bp, Rattus norvegicus
cgagcccaagctttgtcggcacttt

SEQ ID NO: 581466 - DNA, 25 bp, Rattus norvegicus
ccggagggagccgagcccaagcttt

SEQ ID NO: 581467 - DNA, 25 bp, Rattus norvegicus
ccggccagagaacagcgagctgccg

SEQ ID NO: 581468 - DNA, 25 bp, Rattus norvegicus
cccggctgcgcagcactcgtcgccg

SEQ ID NO: 581469 - DNA, 25 bp, Rattus norvegicus
aggccgccggctagcgggagagccc

SEQ ID NO: 581470 - DNA, 25 bp, Rattus norvegicus
gacgccaacacagcggcgcagaggt

SEQ ID NO: 581471 - DNA, 25 bp, Rattus norvegicus
tgctggacgccaacacagcggcgca

SEQ ID NO: 581472 - DNA, 25 bp, Rattus norvegicus
cgccggggtgctggacgccaacaca

SEQ ID NO: 581473 - DNA, 25 bp, Rattus norvegicus
gcatgaacgcggtgcggacgtggat

SEQ ID NO: 581474 - DNA, 25 bp, Rattus norvegicus
cgcagcactcgtcgccgccggccag

SEQ ID NO: 581475 - DNA, 25 bp, Rattus norvegicus
aaagagcaacgtcctctttcccaat

SEQ ID NO: 581476 - DNA, 25 bp, Rattus norvegicus
tctttcccaattacccactgtcagt

SEQ ID NO: 581477 - DNA, 25 bp, Rattus norvegicus
tacccactgtcagtccgggaacagg

SEQ ID NO: 581478 - DNA, 25 bp, Rattus norvegicus
cccttcttctcggtgggtctcggag

SEQ ID NO: 581479 - DNA, 25 bp, Rattus norvegicus
cgggccatcaaaagagcaacgtcct

SEQ ID NO: 581480 - DNA, 25 bp, Rattus norvegicus
ccggcgcgggccatcaaaagagcaa

SEQ ID NO: 581481 - DNA, 25 bp, Rattus norvegicus
gtcaaacccagtgtggcgtcggcga

SEQ ID NO: 581482 - DNA, 25 bp, Rattus norvegicus
tgtgtttctgactccggggccggcc

SEQ ID NO: 581483 - DNA, 25 bp, Rattus norvegicus
ccctgctctgtgtttctgactccgg

SEQ ID NO: 581484 - DNA, 25 bp, Rattus norvegicus
cctaccctgctctgtgtttctgact

SEQ ID NO: 581485 - DNA, 25 bp, Rattus norvegicus
ctcggtgggtctcggagccgacctc

SEQ ID NO: 581486 - DNA, 25 bp, Rattus norvegicus
ggagtccggttctccgcctcaggcc

SEQ ID NO: 581487 - DNA, 25 bp, Rattus norvegicus
cagcctctcccggactggatccctt

SEQ ID NO: 581488 - DNA, 25 bp, Rattus norvegicus
cggcccgtgacgtcaaacccagtgt

SEQ ID NO: 581489 - DNA, 25 bp, Rattus norvegicus
tgactacggaccagccgcgctgggt

SEQ ID NO: 581490 - DNA, 25 bp, Rattus norvegicus
acatggaggtgactacggaccagcc

SEQ ID NO: 581491 - DNA, 25 bp, Rattus norvegicus
agccgcgctgggtgagccaccatca

SEQ ID NO: 581492 - DNA, 25 bp, Rattus norvegicus
gggtgagccaccatcacccggcggt

SEQ ID NO: 581493 - DNA, 25 bp, Rattus norvegicus
gggcctcggccattcgtacatggac

SEQ ID NO: 581494 - DNA, 25 bp, Rattus norvegicus
tttaacatcgatggtcaaggcaacc

SEQ ID NO: 581495 - DNA, 25 bp, Rattus norvegicus
atggtcaaggcaaccacgtcccgtc

SEQ ID NO: 581496 - DNA, 25 bp, Rattus norvegicus
attcgtacatggacccggcacagta

SEQ ID NO: 581497 - DNA, 25 bp, Rattus norvegicus
cgtcctactacggaaactcggtcag

SEQ ID NO: 581498 - DNA, 25 bp, Rattus norvegicus
gaaactcggtcagggctacggtgca

SEQ ID NO: 581499 - DNA, 25 bp, Rattus norvegicus
ctacggtgcagaggtatcctccgac

SEQ ID NO: 581500 - DNA, 25 bp, Rattus norvegicus
gtggacgtactttttaacatcgatg

SEQ ID NO: 581501 - DNA, 25 bp, Rattus norvegicus
ccctgacggaagaggtggacgtact

SEQ ID NO: 581502 - DNA, 25 bp, Rattus norvegicus
cacagcccgggacatggaggtgact

SEQ ID NO: 581503 - DNA, 25 bp, Rattus norvegicus
agcagccaccacaccgcctcgccct

SEQ ID NO: 581504 - DNA, 25 bp, Rattus norvegicus
ccattgctggcatcgcagggagcca

SEQ ID NO: 581505 - DNA, 25 bp, Rattus norvegicus
tctgctgcacggatctctgccctgg

SEQ ID NO: 581506 - DNA, 25 bp, Rattus norvegicus
gcacggatctctgccctggctggat

SEQ ID NO: 581507 - DNA, 25 bp, Rattus norvegicus
tctgccctggctggatggcggcaaa

SEQ ID NO: 581508 - DNA, 25 bp, Rattus norvegicus
ccctggctggatggcggcaaagccc

SEQ ID NO: 581509 - DNA, 25 bp, Rattus norvegicus
gccctgagcagccaccacaccgcct

SEQ ID NO: 581510 - DNA, 25 bp, Rattus norvegicus
tctccaagacgtccatccaccacgg

SEQ ID NO: 581511 - DNA, 25 bp, Rattus norvegicus
tctgtccgtctaccctccggcttca

SEQ ID NO: 581512 - DNA, 25 bp, Rattus norvegicus
ggcttcatcctcttctctggctgcg

SEQ ID NO: 581513 - DNA, 25 bp, Rattus norvegicus
ttcatcctcttctctggctgcgggc

SEQ ID NO: 581514 - DNA, 25 bp, Rattus norvegicus
tggctgcgggccactccagtccgca

SEQ ID NO: 581515 - DNA, 25 bp, Rattus norvegicus
agtccgcatctcttcaccttcccgc

SEQ ID NO: 581516 - DNA, 25 bp, Rattus norvegicus
ctggatggcggcaaagccctgagca

SEQ ID NO: 581517 - DNA, 25 bp, Rattus norvegicus
cgagctcggtgagcggccagccttc

SEQ ID NO: 581518 - DNA, 25 bp, Rattus norvegicus
gtagacaccgaaggcagcaccgttg

SEQ ID NO: 581519 - DNA, 25 bp, Rattus norvegicus
agcaccgttgtcctcccgtgtgtca

SEQ ID NO: 581520 - DNA, 25 bp, Rattus norvegicus
cactgcgcccaaagacagttacttc

SEQ ID NO: 581521 - DNA, 25 bp, Rattus norvegicus
ctctagcagatagagagcagcaccc

SEQ ID NO: 581522 - DNA, 25 bp, Rattus norvegicus
ggaggccgcgcgcacctgaacaaac

SEQ ID NO: 581523 - DNA, 25 bp, Rattus norvegicus
tgcgtgcgccgagaacatgacttct

SEQ ID NO: 581524 - DNA, 25 bp, Rattus norvegicus
gacttctgccttcaagctggatttc

SEQ ID NO: 581525 - DNA, 25 bp, Rattus norvegicus
gctggatttcctcccggacatgatg

SEQ ID NO: 581526 - DNA, 25 bp, Rattus norvegicus
acatgatggtcgagggccgcctgct

SEQ ID NO: 581527 - DNA, 25 bp, Rattus norvegicus
ccgcctgctcgttgctgacagaatg

SEQ ID NO: 581528 - DNA, 25 bp, Rattus norvegicus
ttgctgacagaatgtgagtggccga

SEQ ID NO: 581529 - DNA, 25 bp, Rattus norvegicus
tcttctcttcagaggacgcggctgg

SEQ ID NO: 581530 - DNA, 25 bp, Rattus norvegicus
cttcttcggtgttgaagtagacacc

SEQ ID NO: 581531 - DNA, 25 bp, Rattus norvegicus
catgaccagcttgtcgtccgtggtg

SEQ ID NO: 581532 - DNA, 25 bp, Rattus norvegicus
tgaccagcttgtcgtccgtggtgga

SEQ ID NO: 581533 - DNA, 25 bp, Rattus norvegicus
ggagtcgcagcatgaccagcttgtc

SEQ ID NO: 581534 - DNA, 25 bp, Rattus norvegicus
ggagtcgcagcgtgaccagcttgtc

SEQ ID NO: 581535 - DNA, 25 bp, Rattus norvegicus
gtgaccagcttgtcttccgtggtgg

SEQ ID NO: 581536 - DNA, 25 bp, Rattus norvegicus
gtggacaggagtcgcagcatgacca

SEQ ID NO: 581537 - DNA, 25 bp, Rattus norvegicus
tcgcagcatgaccagcttgtcgtcc

SEQ ID NO: 581538 - DNA, 25 bp, Rattus norvegicus
gacaggagtcgcagcgtgaccagct

SEQ ID NO: 581539 - DNA, 25 bp, Rattus norvegicus
cgtgaccagcttgtcttccgtggtg

SEQ ID NO: 581540 - DNA, 25 bp, Rattus norvegicus
gacaggagtcgcagcatgaccagct

SEQ ID NO: 581541 - DNA, 25 bp, Rattus norvegicus
accagcttgtcgtccgtggtggaca

SEQ ID NO: 581542 - DNA, 25 bp, Rattus norvegicus
ggacaggagtcgcagcatgaccagc

SEQ ID NO: 581543 - DNA, 25 bp, Rattus norvegicus
acaggagtcgcagcgtgaccagctt

SEQ ID NO: 581544 - DNA, 25 bp, Rattus norvegicus
cagcatgaccagcttgtcgtccgtg

SEQ ID NO: 581545 - DNA, 25 bp, Rattus norvegicus
ccattgtttcccttccaggaggctc

SEQ ID NO: 581546 - DNA, 25 bp, Rattus norvegicus
tgccgcggccgctatggaaacggcc

SEQ ID NO: 581547 - DNA, 25 bp, Rattus norvegicus
ctagcaacggctgaagagaaaaaga

SEQ ID NO: 581548 - DNA, 25 bp, Rattus norvegicus
tgcccagagccaattcagtcctagc

SEQ ID NO: 581549 - DNA, 25 bp, Rattus norvegicus
gaaggcggccaaagcgttctgcctc

SEQ ID NO: 581550 - DNA, 25 bp, Rattus norvegicus
agttacctccaaacggtcccagcag

SEQ ID NO: 581551 - DNA, 25 bp, Rattus norvegicus
tccggcaggacgcaactgaaacttg

SEQ ID NO: 581552 - DNA, 25 bp, Rattus norvegicus
cgaagtttgcctgggtcctgcccac

SEQ ID NO: 581553 - DNA, 25 bp, Rattus norvegicus
ggcaatctttttcagccggcgaagt

SEQ ID NO: 581554 - DNA, 25 bp, Rattus norvegicus
ttgtgacatccaggcaatctttttc

SEQ ID NO: 581555 - DNA, 25 bp, Rattus norvegicus
gcaaaactttgcaagggcgcaccga

SEQ ID NO: 581556 - DNA, 25 bp, Rattus norvegicus
cggggctgctccaaagttcttgtga

SEQ ID NO: 581557 - DNA, 25 bp, Rattus norvegicus
ggcgcaccgattgctaggctttcca

SEQ ID NO: 581558 - DNA, 25 bp, Rattus norvegicus
caactgaaacttgcgagggagacac

SEQ ID NO: 581559 - DNA, 25 bp, Rattus norvegicus
cggagtcgcctctcgggtccctcgg

SEQ ID NO: 581560 - DNA, 25 bp, Rattus norvegicus
acccgctcgtccctccactgctcgc

SEQ ID NO: 581561 - DNA, 25 bp, Rattus norvegicus
tccctcggggagtaggagtccaggc

SEQ ID NO: 581562 - DNA, 25 bp, Rattus norvegicus
cgcgccagctcttgcctatcgtcgg

SEQ ID NO: 581563 - DNA, 25 bp, Rattus norvegicus
gagagatccctcacattgaccagac

SEQ ID NO: 581564 - DNA, 25 bp, Rattus norvegicus
gccgagagatccctcacattgacca

SEQ ID NO: 581565 - DNA, 25 bp, Rattus norvegicus
ccggccgagagatccctcacattga

SEQ ID NO: 581566 - DNA, 25 bp, Rattus norvegicus
tggggcagacacctcttctgtcgcc

SEQ ID NO: 581567 - DNA, 25 bp, Rattus norvegicus
atgtggggcagacacctcttctgtc

SEQ ID NO: 581568 - DNA, 25 bp, Rattus norvegicus
gcccaggcatgtggggcagacacct

SEQ ID NO: 581569 - DNA, 25 bp, Rattus norvegicus
acattgaccagaccctccgggagag

SEQ ID NO: 581570 - DNA, 25 bp, Rattus norvegicus
gtctgaggagaacgacgtccgaccc

SEQ ID NO: 581571 - DNA, 25 bp, Rattus norvegicus
aggagaacgacgtccgacccgctcg

SEQ ID NO: 581572 - DNA, 25 bp, Rattus norvegicus
cacattgaccagaccctccgggaga

SEQ ID NO: 581573 - DNA, 25 bp, Rattus norvegicus
cggaactctaaagaggcgtagaaga

SEQ ID NO: 581574 - DNA, 25 bp, Rattus norvegicus
gggaagtggattggccgtcaggaaa

SEQ ID NO: 581575 - DNA, 25 bp, Rattus norvegicus
cgtcaggaaagggaaagcgcctgaa

SEQ ID NO: 581576 - DNA, 25 bp, Rattus norvegicus
caggaaagggaaagcgcctgaattg

SEQ ID NO: 581577 - DNA, 25 bp, Rattus norvegicus
aaagcgcctgaattggaggtgcgca

SEQ ID NO: 581578 - DNA, 25 bp, Rattus norvegicus
ggcggaactctaaagaggcgtagaa

SEQ ID NO: 581579 - DNA, 25 bp, Rattus norvegicus
ctctaaagaggcgtagaagagtggt

SEQ ID NO: 581580 - DNA, 25 bp, Rattus norvegicus
aagagtggtgggatagtagaattac

SEQ ID NO: 581581 - DNA, 25 bp, Rattus norvegicus
atagtagaattacggggcgctgtcg

SEQ ID NO: 581582 - DNA, 25 bp, Rattus norvegicus
ggtcaagtttggtcacccagttctc

SEQ ID NO: 581583 - DNA, 25 bp, Rattus norvegicus
caagtttggtcacccagttctcaag

SEQ ID NO: 581584 - DNA, 25 bp, Rattus norvegicus
cccagttctcaagggggttgcctga

SEQ ID NO: 581585 - DNA, 25 bp, Rattus norvegicus
gttgcctgatgcgaacgcggggaag

SEQ ID NO: 581586 - DNA, 25 bp, Rattus norvegicus
cgcaggcgcaggcaattcacgggtt

SEQ ID NO: 581587 - DNA, 25 bp, Rattus norvegicus
cccaggctcacgtggtgcgttcagg

SEQ ID NO: 581588 - DNA, 25 bp, Rattus norvegicus
agctctccgccgagcggtcccgctt

SEQ ID NO: 581589 - DNA, 25 bp, Rattus norvegicus
atggataccggcctaggaaagccgg

SEQ ID NO: 581590 - DNA, 25 bp, Rattus norvegicus
cgtctatggataccggcctaggaaa

SEQ ID NO: 581591 - DNA, 25 bp, Rattus norvegicus
aggggcgtctatggataccggccta

SEQ ID NO: 581592 - DNA, 25 bp, Rattus norvegicus
tcaggcgcagttaccagacggagag

SEQ ID NO: 581593 - DNA, 25 bp, Rattus norvegicus
cttctcaggcgcagttaccagacgg

SEQ ID NO: 581594 - DNA, 25 bp, Rattus norvegicus
ggtcccgcttctcaggcgcagttac

SEQ ID NO: 581595 - DNA, 25 bp, Rattus norvegicus
acatggcatcggctactgtggcagc

SEQ ID NO: 581596 - DNA, 25 bp, Rattus norvegicus
cccagactgcacatggcatcggcta

SEQ ID NO: 581597 - DNA, 25 bp, Rattus norvegicus
ctctgcttggttgcagctttttccc

SEQ ID NO: 581598 - DNA, 25 bp, Rattus norvegicus
tcgccctctgcttggttgcagcttt

SEQ ID NO: 581599 - DNA, 25 bp, Rattus norvegicus
cgttcagggtctccggcacaggacc

SEQ ID NO: 581600 - DNA, 25 bp, Rattus norvegicus
gcatcggctactgtggcagctgcag

SEQ ID NO: 581601 - DNA, 25 bp, Rattus norvegicus
ggaacccagaggtcccgatttgctc

SEQ ID NO: 581602 - DNA, 25 bp, Rattus norvegicus
cccttaggaggccaggagcgaggat

SEQ ID NO: 581603 - DNA, 25 bp, Rattus norvegicus
tcccgatttgctccccttaggaggc

SEQ ID NO: 581604 - DNA, 25 bp, Rattus norvegicus
tccggtcagccaggccttgtccggc

SEQ ID NO: 581605 - DNA, 25 bp, Rattus norvegicus
tccaaggctcctccggtcagccagg

SEQ ID NO: 581606 - DNA, 25 bp, Rattus norvegicus
gacggctcgagctggggacctcctc

SEQ ID NO: 581607 - DNA, 25 bp, Rattus norvegicus
cctgtcacatgactccgtgggcgga

SEQ ID NO: 581608 - DNA, 25 bp, Rattus norvegicus
agagcgcctgtcacatgactccgtg

SEQ ID NO: 581609 - DNA, 25 bp, Rattus norvegicus
gaggagctgagagcgcctgtcacat

SEQ ID NO: 581610 - DNA, 25 bp, Rattus norvegicus
agcaacgcggtggacgtccgccaac

SEQ ID NO: 581611 - DNA, 25 bp, Rattus norvegicus
tgaccatagcaacgcggtggacgtc

SEQ ID NO: 581612 - DNA, 25 bp, Rattus norvegicus
gcccacggtgaccatagcaacgcgg

SEQ ID NO: 581613 - DNA, 25 bp, Rattus norvegicus
gctgagagcgcctgtcacatgactc

SEQ ID NO: 581614 - DNA, 25 bp, Rattus norvegicus
cgcctcctggcgtccagtcccgccc

SEQ ID NO: 581615 - DNA, 25 bp, Rattus norvegicus
cacagtctgggttagccatctaact

SEQ ID NO: 581616 - DNA, 25 bp, Rattus norvegicus
cgccttctaacctgcggaaatccaa

SEQ ID NO: 581617 - DNA, 25 bp, Rattus norvegicus
gcagccgccttctaacctgcggaaa

SEQ ID NO: 581618 - DNA, 25 bp, Rattus norvegicus
ctcactttgagaagcagccgccttc

SEQ ID NO: 581619 - DNA, 25 bp, Rattus norvegicus
gcccgggctcactttgagaagcagc

SEQ ID NO: 581620 - DNA, 25 bp, Rattus norvegicus
gtctggcccgggctcactttgagaa

SEQ ID NO: 581621 - DNA, 25 bp, Rattus norvegicus
cagacagggccagcccgtggagatt

SEQ ID NO: 581622 - DNA, 25 bp, Rattus norvegicus
actctgcgtctttggtcgcagcggg

SEQ ID NO: 581623 - DNA, 25 bp, Rattus norvegicus
atctaactctgcgtctttggtcgca

SEQ ID NO: 581624 - DNA, 25 bp, Rattus norvegicus
ttagccatctaactctgcgtctttg

SEQ ID NO: 581625 - DNA, 25 bp, Rattus norvegicus
gtcctggccctctacgacagacagg

SEQ ID NO: 581626 - DNA, 25 bp, Rattus norvegicus
taacctgcggaaatccaacttcttc

SEQ ID NO: 581627 - DNA, 25 bp, Rattus norvegicus
caacttcttccacttcgtcctggcc

SEQ ID NO: 581628 - DNA, 25 bp, Rattus norvegicus
ccgtggagattgagaggacggcctt

SEQ ID NO: 581629 - DNA, 25 bp, Rattus norvegicus
tccgtagaatcaggcgccaccgata

SEQ ID NO: 581630 - DNA, 25 bp, Rattus norvegicus
atcaaaacggctcggtaggcacttc

SEQ ID NO: 581631 - DNA, 25 bp, Rattus norvegicus
tacggaccggaagagtcctttcatc

SEQ ID NO: 581632 - DNA, 25 bp, Rattus norvegicus
tgctttagcttctagctcccgtgga

SEQ ID NO: 581633 - DNA, 25 bp, Rattus norvegicus
gcgggcaggctaagcatgcattcta

SEQ ID NO: 581634 - DNA, 25 bp, Rattus norvegicus
ttctccgcggactcaaatctttttg

SEQ ID NO: 581635 - DNA, 25 bp, Rattus norvegicus
taccttccgggtcgaggtgcataca

SEQ ID NO: 581636 - DNA, 25 bp, Rattus norvegicus
ggatgtgcacacgtcctcctccagg

SEQ ID NO: 581637 - DNA, 25 bp, Rattus norvegicus
cagaagctgcagtctccgtagaatc

SEQ ID NO: 581638 - DNA, 25 bp, Rattus norvegicus
accaagattggctcgcgcccactta

SEQ ID NO: 581639 - DNA, 25 bp, Rattus norvegicus
tgcactctgtgcaccatcagttgtg

SEQ ID NO: 581640 - DNA, 25 bp, Rattus norvegicus
tgatacgcctggatcctgggttctc

SEQ ID NO: 581641 - DNA, 25 bp, Rattus norvegicus
gggttcctctcgtagtccaggctga

SEQ ID NO: 581642 - DNA, 25 bp, Rattus norvegicus
ccaggcacccgtagaagctctgcta

SEQ ID NO: 581643 - DNA, 25 bp, Rattus norvegicus
ccaggcaagaaagtagcagaaagtg

SEQ ID NO: 581644 - DNA, 25 bp, Rattus norvegicus
attggcccgccttgggcgtgcctat

SEQ ID NO: 581645 - DNA, 25 bp, Rattus norvegicus
agtctgtgccggagagcagtagaaa

SEQ ID NO: 581646 - DNA, 25 bp, Rattus norvegicus
cccagccttgacttcataataaagc

SEQ ID NO: 581647 - DNA, 25 bp, Rattus norvegicus
taaagctccctaaaggctaggactc

SEQ ID NO: 581648 - DNA, 25 bp, Rattus norvegicus
ctcctgctcgaagagggaaagcccg

SEQ ID NO: 581649 - DNA, 25 bp, Rattus norvegicus
gagagcttccgagcgccaagcagag

SEQ ID NO: 581650 - DNA, 25 bp, Rattus norvegicus
ccaccagctcttgggtatgcgaagg

SEQ ID NO: 581651 - DNA, 25 bp, Rattus norvegicus
agcaagcaggcttgggccaccagct

SEQ ID NO: 581652 - DNA, 25 bp, Rattus norvegicus
gcgaattagctccagcagccgagtc

SEQ ID NO: 581653 - DNA, 25 bp, Rattus norvegicus
gccgattttggtgcaatgcgaatta

SEQ ID NO: 581654 - DNA, 25 bp, Rattus norvegicus
ctccaaaattgatgtgaagccgatt

SEQ ID NO: 581655 - DNA, 25 bp, Rattus norvegicus
cctctagccgctccaaaattgatgt

SEQ ID NO: 581656 - DNA, 25 bp, Rattus norvegicus
gcccaaggcactgtgctcctgggga

SEQ ID NO: 581657 - DNA, 25 bp, Rattus norvegicus
tggctgtgtgctcttactcatcgtg

SEQ ID NO: 581658 - DNA, 25 bp, Rattus norvegicus
gcgagagcagctcctcctggaaaaa

SEQ ID NO: 581659 - DNA, 25 bp, Rattus norvegicus
ctggaaaaagcaagcggaagacatc

SEQ ID NO: 581660 - DNA, 25 bp, Rattus norvegicus
gatcttcgagttcaaggagaccctc

SEQ ID NO: 581661 - DNA, 25 bp, Rattus norvegicus
accctcggaacgtaagtgggtgctg

SEQ ID NO: 581662 - DNA, 25 bp, Rattus norvegicus
ccgccaccgcggcagaaattggctg

SEQ ID NO: 581663 - DNA, 25 bp, Rattus norvegicus
aaattggctgctcgatgcgtcctca

SEQ ID NO: 581664 - DNA, 25 bp, Rattus norvegicus
tactcatcgtgtgtaggggcgcact

SEQ ID NO: 581665 - DNA, 25 bp, Rattus norvegicus
ttgtcccacagtccgctcttatgga

SEQ ID NO: 581666 - DNA, 25 bp, Rattus norvegicus
ctcttatggagaccctccgcgagtc

SEQ ID NO: 581667 - DNA, 25 bp, Rattus norvegicus
gcgggcgactttccatttcctttgc

SEQ ID NO: 581668 - DNA, 25 bp, Rattus norvegicus
cccacgcgtgactgtgggctgagca

SEQ ID NO: 581669 - DNA, 25 bp, Rattus norvegicus
tggatcttgctgatcgctggctgtg

SEQ ID NO: 581670 - DNA, 25 bp, Rattus norvegicus
gatgcgtcctcattgtcccacagtc

SEQ ID NO: 581671 - DNA, 25 bp, Rattus norvegicus
cgccagcaccttggcatacacgatg

SEQ ID NO: 581672 - DNA, 25 bp, Rattus norvegicus
ctctccagcttggtaatgccacggc

SEQ ID NO: 581673 - DNA, 25 bp, Rattus norvegicus
taatgccacggcaggtagttgtaga

SEQ ID NO: 581674 - DNA, 25 bp, Rattus norvegicus
atacacgatggtctcggccagctcg

SEQ ID NO: 581675 - DNA, 25 bp, Rattus norvegicus
ccgccacgcttaaaagggtcgagag

SEQ ID NO: 581676 - DNA, 25 bp, Rattus norvegicus
cacctccgcggagtaaaagagccct

SEQ ID NO: 581677 - DNA, 25 bp, Rattus norvegicus
acgagacgtgcgaactagctcttga

SEQ ID NO: 581678 - DNA, 25 bp, Rattus norvegicus
tcaggggtctccactccgacggcag

SEQ ID NO: 581679 - DNA, 25 bp, Rattus norvegicus
gctcttgaccgccagacccagttgg

SEQ ID NO: 581680 - DNA, 25 bp, Rattus norvegicus
gacccagttggtttgtagcgcgcct

SEQ ID NO: 581681 - DNA, 25 bp, Rattus norvegicus
gcgcgcctctatgggttaggtcaga

SEQ ID NO: 581682 - DNA, 25 bp, Rattus norvegicus
gcttgccaggagtaaagagttgttc

SEQ ID NO: 581683 - DNA, 25 bp, Rattus norvegicus
agttgttccctacgcaggtactccg

SEQ ID NO: 581684 - DNA, 25 bp, Rattus norvegicus
gcccttgcacagctcggggaaggaa

SEQ ID NO: 581685 - DNA, 25 bp, Rattus norvegicus
agatgccaacgaagcagtgacctga

SEQ ID NO: 581686 - DNA, 25 bp, Rattus norvegicus
agaaccgcggggctcaggaaaagct

SEQ ID NO: 581687 - DNA, 25 bp, Rattus norvegicus
accgcggggctcaggaaaagctgcc

SEQ ID NO: 581688 - DNA, 25 bp, Rattus norvegicus
cgcgtcaccgtccagctgcccggtc

SEQ ID NO: 581689 - DNA, 25 bp, Rattus norvegicus
tccctggcgggcgtcggcatccaga

SEQ ID NO: 581690 - DNA, 25 bp, Rattus norvegicus
cgtcggcatccagagctttgggaca

SEQ ID NO: 581691 - DNA, 25 bp, Rattus norvegicus
ccaacgaagcagtgacctgagagga

SEQ ID NO: 581692 - DNA, 25 bp, Rattus norvegicus
ctttgggacaagatgccaacgaagc

SEQ ID NO: 581693 - DNA, 25 bp, Rattus norvegicus
ccctcctgtaggacggctgtccggg

SEQ ID NO: 581694 - DNA, 25 bp, Rattus norvegicus
gcggccctcctgtaggacggctgtc

SEQ ID NO: 581695 - DNA, 25 bp, Rattus norvegicus
gacgttctcgctgtcgccggctctg

SEQ ID NO: 581696 - DNA, 25 bp, Rattus norvegicus
atccagagctttgggacaagatgcc

SEQ ID NO: 581697 - DNA, 25 bp, Rattus norvegicus
cagtgacctgagaggagcggatctc

SEQ ID NO: 581698 - DNA, 25 bp, Rattus norvegicus
tgacctgagaggagcggatctctgt

SEQ ID NO: 581699 - DNA, 25 bp, Rattus norvegicus
agaccggaagccgtgctccattttc

SEQ ID NO: 581700 - DNA, 25 bp, Rattus norvegicus
ggaatataacacatcgcgagaccgg

SEQ ID NO: 581701 - DNA, 25 bp, Rattus norvegicus
cttctcgcgggaatataacacatcg

SEQ ID NO: 581702 - DNA, 25 bp, Rattus norvegicus
agcgtcctctcttctcgcgggaata

SEQ ID NO: 581703 - DNA, 25 bp, Rattus norvegicus
cctctctcacctaggccgccgtttc

SEQ ID NO: 581704 - DNA, 25 bp, Rattus norvegicus
tctcgggagtctgctcatcggccac

SEQ ID NO: 581705 - DNA, 25 bp, Rattus norvegicus
gtgcacgcatgcgtacgccctgggc

SEQ ID NO: 581706 - DNA, 25 bp, Rattus norvegicus
tttccgggaggaggagcgtcctctc

SEQ ID NO: 581707 - DNA, 25 bp, Rattus norvegicus
agcacgcaccgttcgcgccgtgaag

SEQ ID NO: 581708 - DNA, 25 bp, Rattus norvegicus
cgttcgcgccgtgaagataaggaca

SEQ ID NO: 581709 - DNA, 25 bp, Rattus norvegicus
cgccgtgaagataaggacaccgaca

SEQ ID NO: 581710 - DNA, 25 bp, Rattus norvegicus
gataaggacaccgacaccactacct

SEQ ID NO: 581711 - DNA, 25 bp, Rattus norvegicus
cgtctacgccgtgcctcgcggggaa

SEQ ID NO: 581712 - DNA, 25 bp, Rattus norvegicus
ctgatatccgccacagcgggcggcg

SEQ ID NO: 581713 - DNA, 25 bp, Rattus norvegicus
ccgagagttccggtgggccaatcag

SEQ ID NO: 581714 - DNA, 25 bp, Rattus norvegicus
tcaggttgctctactgagaagcggc

SEQ ID NO: 581715 - DNA, 25 bp, Rattus norvegicus
ccgatagcctacaccaatcaggttg

SEQ ID NO: 581716 - DNA, 25 bp, Rattus norvegicus
cccttagcaaagatggcgtccgata

SEQ ID NO: 581717 - DNA, 25 bp, Rattus norvegicus
cggaagttctttgcccttagcaaag

SEQ ID NO: 581718 - DNA, 25 bp, Rattus norvegicus
gctgaggcttcaccaaccggaagtt

SEQ ID NO: 581719 - DNA, 25 bp, Rattus norvegicus
cctctattttagttgcgcgaagctg

SEQ ID NO: 581720 - DNA, 25 bp, Rattus norvegicus
ccaaggatctgtgcggtccgagagt

SEQ ID NO: 581721 - DNA, 25 bp, Rattus norvegicus
tgggccaatcagagcgtcctccaca

SEQ ID NO: 581722 - DNA, 25 bp, Rattus norvegicus
tggaccggcaagagaaccaaccgtg

SEQ ID NO: 581723 - DNA, 25 bp, Rattus norvegicus
ccaaccgtgtcttaggtgagctttg

SEQ ID NO: 581724 - DNA, 25 bp, Rattus norvegicus
gaagaggcgccggaatcttgatcga

SEQ ID NO: 581725 - DNA, 25 bp, Rattus norvegicus
tgatcgagcgaagcaggcgaccttc

SEQ ID NO: 581726 - DNA, 25 bp, Rattus norvegicus
agagggcgccagaacctctatttta

SEQ ID NO: 581727 - DNA, 25 bp, Rattus norvegicus
ccagcgcgcgtatagtccatggtgg

SEQ ID NO: 581728 - DNA, 25 bp, Rattus norvegicus
gcaccagcgcgcgtatagtccatgg

SEQ ID NO: 581729 - DNA, 25 bp, Rattus norvegicus
tgcctaggagtccatgctgcggatc

SEQ ID NO: 581730 - DNA, 25 bp, Rattus norvegicus
gaggctgcctaggagtccatgctgc

SEQ ID NO: 581731 - DNA, 25 bp, Rattus norvegicus
cccaacctctcacgccggactgggg

SEQ ID NO: 581732 - DNA, 25 bp, Rattus norvegicus
tggagtatggtccaagggcaggaca

SEQ ID NO: 581733 - DNA, 25 bp, Rattus norvegicus
cgcctcctggtagagggtggagtat

SEQ ID NO: 581734 - DNA, 25 bp, Rattus norvegicus
ctaggagtccatgctgcggatcgcg

SEQ ID NO: 581735 - DNA, 25 bp, Rattus norvegicus
gcttcacttaactcatcgaaagccc

SEQ ID NO: 581736 - DNA, 25 bp, Rattus norvegicus
tgggcttcacttaactcatcgaaag

SEQ ID NO: 581737 - DNA, 25 bp, Rattus norvegicus
gcctgggcttcacttaactcatcga

SEQ ID NO: 581738 - DNA, 25 bp, Rattus norvegicus
gcgcctgggcttcacttaactcatc

SEQ ID NO: 581739 - DNA, 25 bp, Rattus norvegicus
gctgcgcctgggcttcacttaactc

SEQ ID NO: 581740 - DNA, 25 bp, Rattus norvegicus
gctgctgcgcctgggcttcacttaa

SEQ ID NO: 581741 - DNA, 25 bp, Rattus norvegicus
aagtctcaggctgccgcctttaaag

SEQ ID NO: 581742 - DNA, 25 bp, Rattus norvegicus
ccgcagggctatgccgcactacagg

SEQ ID NO: 581743 - DNA, 25 bp, Rattus norvegicus
accttaagtctcaggctgccgcctt

SEQ ID NO: 581744 - DNA, 25 bp, Rattus norvegicus
tcaggggacaccttaagtctcaggc

SEQ ID NO: 581745 - DNA, 25 bp, Rattus norvegicus
tgccactcaggggacaccttaagtc

SEQ ID NO: 581746 - DNA, 25 bp, Rattus norvegicus
cgcctttaaaggcactgcgggcgcg

SEQ ID NO: 581747 - DNA, 25 bp, Rattus norvegicus
aggatgccactcaggggacacctta

SEQ ID NO: 581748 - DNA, 25 bp, Rattus norvegicus
gacatgaatatttaaagaccgcgtt

SEQ ID NO: 581749 - DNA, 25 bp, Rattus norvegicus
ttacacctttaaaacaatgacatga

SEQ ID NO: 581750 - DNA, 25 bp, Rattus norvegicus
tggaagtcacacgtttacaccttta

SEQ ID NO: 581751 - DNA, 25 bp, Rattus norvegicus
gtccgacctggaagtcacacgttta

SEQ ID NO: 581752 - DNA, 25 bp, Rattus norvegicus
agagcgcgtccgacctggaagtcac

SEQ ID NO: 581753 - DNA, 25 bp, Rattus norvegicus
cactacaggcctcggcgtcgccgct

SEQ ID NO: 581754 - DNA, 25 bp, Rattus norvegicus
aggctgccgcctttaaaggcactgc

SEQ ID NO: 581755 - DNA, 25 bp, Rattus norvegicus
aaaaatgctgctcccggtggcggcg

SEQ ID NO: 581756 - DNA, 25 bp, Rattus norvegicus
attcccctttaagcctgctgtctcg

SEQ ID NO: 581757 - DNA, 25 bp, Rattus norvegicus
gggccgcggcgctcccacaatgcac

SEQ ID NO: 581758 - DNA, 25 bp, Rattus norvegicus
gctcccttaagcgtcgcctgaataa

SEQ ID NO: 581759 - DNA, 25 bp, Rattus norvegicus
ttaagcgtcgcctgaataaaaatgc

SEQ ID NO: 581760 - DNA, 25 bp, Rattus norvegicus
gtcgcctgaataaaaatgctgctcc

SEQ ID NO: 581761 - DNA, 25 bp, Rattus norvegicus
ctgcggcccgatattcccctttaag

SEQ ID NO: 581762 - DNA, 25 bp, Rattus norvegicus
ataaaaatgctgctcccggtggcgg

SEQ ID NO: 581763 - DNA, 25 bp, Rattus norvegicus
gcccgccgcttaccggctcgctttg

SEQ ID NO: 581764 - DNA, 25 bp, Rattus norvegicus
acgccgcgtggagctcggcctaggc

SEQ ID NO: 581765 - DNA, 25 bp, Rattus norvegicus
agagcggccacctccctttaaggcg

SEQ ID NO: 581766 - DNA, 25 bp, Rattus norvegicus
cccgagcgcggcaatgattggtctc

SEQ ID NO: 581767 - DNA, 25 bp, Rattus norvegicus
ctgaataaaaatgctgctcccggtg

SEQ ID NO: 581768 - DNA, 25 bp, Rattus norvegicus
cgggctcccttaagcgtcgcctgaa

SEQ ID NO: 581769 - DNA, 25 bp, Rattus norvegicus
cctcggtccctgagcttcccgcggc

SEQ ID NO: 581770 - DNA, 25 bp, Rattus norvegicus
gtccctgagcttcccgcggcgcaaa

SEQ ID NO: 581771 - DNA, 25 bp, Rattus norvegicus
cccgcctgcggctggtgaaggcggc

SEQ ID NO: 581772 - DNA, 25 bp, Rattus norvegicus
gcctgcggctggtgaaggcggcggc

SEQ ID NO: 581773 - DNA, 25 bp, Rattus norvegicus
ctgggcctcggtccctgagcttccc

SEQ ID NO: 581774 - DNA, 25 bp, Rattus norvegicus
gggcctcggtccctgagcttcccgc

SEQ ID NO: 581775 - DNA, 25 bp, Rattus norvegicus
ggcctcggtccctgagcttcccgcg

SEQ ID NO: 581776 - DNA, 25 bp, Rattus norvegicus
gcctcggtccctgagcttcccgcgg

SEQ ID NO: 581777 - DNA, 25 bp, Rattus norvegicus
ctcggtccctgagcttcccgcggcg

SEQ ID NO: 581778 - DNA, 25 bp, Rattus norvegicus
cggtccctgagcttcccgcggcgca

SEQ ID NO: 581779 - DNA, 25 bp, Rattus norvegicus
ggtccctgagcttcccgcggcgcaa

SEQ ID NO: 581780 - DNA, 25 bp, Rattus norvegicus
tcccgcggcgcaaaacccctctctc

SEQ ID NO: 581781 - DNA, 25 bp, Rattus norvegicus
aacccctctctctgctcgggtccct

SEQ ID NO: 581782 - DNA, 25 bp, Rattus norvegicus
ctgagcttcccgcggcgcaaaaccc

SEQ ID NO: 581783 - DNA, 25 bp, Rattus norvegicus
cgaggcttggcgacctcagacagat

SEQ ID NO: 581784 - DNA, 25 bp, Rattus norvegicus
cgcggggcgcgatgctgaacatgtg

SEQ ID NO: 581785 - DNA, 25 bp, Rattus norvegicus
ttggcgacctcagacagatcctcca

SEQ ID NO: 581786 - DNA, 25 bp, Rattus norvegicus
ggcttggcgacctcagacagatcct

SEQ ID NO: 581787 - DNA, 25 bp, Rattus norvegicus
gggcgtgttgaggtcgccgaggctt

SEQ ID NO: 581788 - DNA, 25 bp, Rattus norvegicus
ggaattgtagtccgcgtcctgcgcc

SEQ ID NO: 581789 - DNA, 25 bp, Rattus norvegicus
cgcgcgccgcacgccgggaattgta

SEQ ID NO: 581790 - DNA, 25 bp, Rattus norvegicus
gacacgtcgagacgcggccgcaccg

SEQ ID NO: 581791 - DNA, 25 bp, Rattus norvegicus
gctggtccaggtcggggtcgccgcc

SEQ ID NO: 581792 - DNA, 25 bp, Rattus norvegicus
cacatgttcagcatcgcgccccgcg

SEQ ID NO: 581793 - DNA, 25 bp, Rattus norvegicus
gctggaccaccgtgcgcacgctccc

SEQ ID NO: 581794 - DNA, 25 bp, Rattus norvegicus
cccgcgcgctggaccaccgtgcgca

SEQ ID NO: 581795 - DNA, 25 bp, Rattus norvegicus
ctggtggacaaagcgtgagtatcgg

SEQ ID NO: 581796 - DNA, 25 bp, Rattus norvegicus
agcgtgcgcacggtggtccagcgcg

SEQ ID NO: 581797 - DNA, 25 bp, Rattus norvegicus
gaagaacttacccatccgcgctctg

SEQ ID NO: 581798 - DNA, 25 bp, Rattus norvegicus
cccatccgcgctctgcgagcaaacg

SEQ ID NO: 581799 - DNA, 25 bp, Rattus norvegicus
tgcctttagaaataagccgaggatc

SEQ ID NO: 581800 - DNA, 25 bp, Rattus norvegicus
gtgaagaacttacccatccgcgctc

SEQ ID NO: 581801 - DNA, 25 bp, Rattus norvegicus
gcaacttttagcagggggtgaagaa

SEQ ID NO: 581802 - DNA, 25 bp, Rattus norvegicus
cggattttaggcaacttttagcagg

SEQ ID NO: 581803 - DNA, 25 bp, Rattus norvegicus
gcgcggattttaggcaacttttagc

SEQ ID NO: 581804 - DNA, 25 bp, Rattus norvegicus
ccaggcgcggattttaggcaacttt

SEQ ID NO: 581805 - DNA, 25 bp, Rattus norvegicus
ggccagccctcgctcagtctgagag

SEQ ID NO: 581806 - DNA, 25 bp, Rattus norvegicus
aataagccgaggatcgcggctcctc

SEQ ID NO: 581807 - DNA, 25 bp, Rattus norvegicus
ctttagaaataagccgaggatcgcg

SEQ ID NO: 581808 - DNA, 25 bp, Rattus norvegicus
gccgcggctcaagcgtcggtggccg

SEQ ID NO: 581809 - DNA, 25 bp, Rattus norvegicus
gagcctgcctttagaaataagccga

SEQ ID NO: 581810 - DNA, 25 bp, Rattus norvegicus
ggcgagcctgcctttagaaataagc

SEQ ID NO: 581811 - DNA, 25 bp, Rattus norvegicus
gagcctttgtcatgggcgccgtcac

SEQ ID NO: 581812 - DNA, 25 bp, Rattus norvegicus
ctttgaacagaccaccagccgtgta

SEQ ID NO: 581813 - DNA, 25 bp, Rattus norvegicus
taccacaggcgcagctcatcggaca

SEQ ID NO: 581814 - DNA, 25 bp, Rattus norvegicus
gccgcgccagctctctttgaacaga

SEQ ID NO: 581815 - DNA, 25 bp, Rattus norvegicus
tgccgccagattgggcatgctgcca

SEQ ID NO: 581816 - DNA, 25 bp, Rattus norvegicus
atgctgccagagctagctgagccca

SEQ ID NO: 581817 - DNA, 25 bp, Rattus norvegicus
ttggaggtcttaaactgcgccttga

SEQ ID NO: 581818 - DNA, 25 bp, Rattus norvegicus
cccaaggaaggagtccgcaggatct

SEQ ID NO: 581819 - DNA, 25 bp, Rattus norvegicus
tcctggtcgctctccaggctgcgta

SEQ ID NO: 581820 - DNA, 25 bp, Rattus norvegicus
tgccctcgatatatagtgggtactc

SEQ ID NO: 581821 - DNA, 25 bp, Rattus norvegicus
ctccttgatgcggtactgcgagctc

SEQ ID NO: 581822 - DNA, 25 bp, Rattus norvegicus
tggctgtgcaggtacacgccacctc

SEQ ID NO: 581823 - DNA, 25 bp, Rattus norvegicus
gccttggatggcgagtcctcagcca

SEQ ID NO: 581824 - DNA, 25 bp, Rattus norvegicus
gccttgacgctgtagtggccctcct

SEQ ID NO: 581825 - DNA, 25 bp, Rattus norvegicus
cgctcaggagggagcggtagccatc

SEQ ID NO: 581826 - DNA, 25 bp, Rattus norvegicus
ctcggaggctcggagcccggaacgc

SEQ ID NO: 581827 - DNA, 25 bp, Rattus norvegicus
agcggtagccatctgtgtacgcgga

SEQ ID NO: 581828 - DNA, 25 bp, Rattus norvegicus
tagccatctgtgtacgcggagggct

SEQ ID NO: 581829 - DNA, 25 bp, Rattus norvegicus
acgcggagggctgagcagcgcttcc

SEQ ID NO: 581830 - DNA, 25 bp, Rattus norvegicus
ttcctcccctcgagtgctgaaatgg

SEQ ID NO: 581831 - DNA, 25 bp, Rattus norvegicus
ccagcctcccttcgggactccactt

SEQ ID NO: 581832 - DNA, 25 bp, Rattus norvegicus
ttcctgccgctaaagtgtaagagcc

SEQ ID NO: 581833 - DNA, 25 bp, Rattus norvegicus
ctgccgctaaagtgtaagagcctca

SEQ ID NO: 581834 - DNA, 25 bp, Rattus norvegicus
taaagtgtaagagcctcagacatcc

SEQ ID NO: 581835 - DNA, 25 bp, Rattus norvegicus
gtgtaagagcctcagacatcctcgc

SEQ ID NO: 581836 - DNA, 25 bp, Rattus norvegicus
ctcagacatcctcgctcgctggagg

SEQ ID NO: 581837 - DNA, 25 bp, Rattus norvegicus
cagacatcctcgctcgctggagggc

SEQ ID NO: 581838 - DNA, 25 bp, Rattus norvegicus
gggactccacttcctgccgctaaag

SEQ ID NO: 581839 - DNA, 25 bp, Rattus norvegicus
agtacgaagcccgtccggctcaggg

SEQ ID NO: 581840 - DNA, 25 bp, Rattus norvegicus
cctgggtccaaggtctgggtctgct

SEQ ID NO: 581841 - DNA, 25 bp, Rattus norvegicus
cgaaccaaccgagcagcagcctgga

SEQ ID NO: 581842 - DNA, 25 bp, Rattus norvegicus
ccctcgtctttgtgtgagaagtaag

SEQ ID NO: 581843 - DNA, 25 bp, Rattus norvegicus
agaagtaagtgtggggccagcctac

SEQ ID NO: 581844 - DNA, 25 bp, Rattus norvegicus
ggggccagcctacctcgcacaaagg

SEQ ID NO: 581845 - DNA, 25 bp, Rattus norvegicus
tgctggcgttggtacccggcacctt

SEQ ID NO: 581846 - DNA, 25 bp, Rattus norvegicus
gcagggccgctgagtcatcaacggc

SEQ ID NO: 581847 - DNA, 25 bp, Rattus norvegicus
gttgcaacgcccgagtacgaagccc

SEQ ID NO: 581848 - DNA, 25 bp, Rattus norvegicus
gcctcgcgcgtcagaattaagtggc

SEQ ID NO: 581849 - DNA, 25 bp, Rattus norvegicus
ccgcctttgtctgccgggtaggagc

SEQ ID NO: 581850 - DNA, 25 bp, Rattus norvegicus
ctgggccgaggatgcaacaacgaac

SEQ ID NO: 581851 - DNA, 25 bp, Rattus norvegicus
gcggttccgacagcggttgcaacgc

SEQ ID NO: 581852 - DNA, 25 bp, Rattus norvegicus
cgctctgcaggccaacgacagggtc

SEQ ID NO: 581853 - DNA, 25 bp, Rattus norvegicus
taaaactattggctagccgttctga

SEQ ID NO: 581854 - DNA, 25 bp, Rattus norvegicus
cgcggagtgatgagctaaaactatt

SEQ ID NO: 581855 - DNA, 25 bp, Rattus norvegicus
catgtacgccgagctccaaaggagc

SEQ ID NO: 581856 - DNA, 25 bp, Rattus norvegicus
cctttccggtttgcgcgtgcgcgga

SEQ ID NO: 581857 - DNA, 25 bp, Rattus norvegicus
gccgttctgatgaaaggcggaatcc

SEQ ID NO: 581858 - DNA, 25 bp, Rattus norvegicus
gtgcgcggaacgtcatgtacgccga

SEQ ID NO: 581859 - DNA, 25 bp, Rattus norvegicus
aggcggaatccttgtgttaattggc

SEQ ID NO: 581860 - DNA, 25 bp, Rattus norvegicus
tgtgttaattggctgcgactcggga

SEQ ID NO: 581861 - DNA, 25 bp, Rattus norvegicus
aacgtgaagtctccgcagtgcctga

SEQ ID NO: 581862 - DNA, 25 bp, Rattus norvegicus
gcagtgcctgatgggcttgttccag

SEQ ID NO: 581863 - DNA, 25 bp, Rattus norvegicus
accgccgccttatggcggcgatcgg

SEQ ID NO: 581864 - DNA, 25 bp, Rattus norvegicus
cccgtcgttgagctgccttggtcac

SEQ ID NO: 581865 - DNA, 25 bp, Rattus norvegicus
ttccaggccggctagctacggctgc

SEQ ID NO: 581866 - DNA, 25 bp, Rattus norvegicus
tagctacggctgctgaagggcccgt

SEQ ID NO: 581867 - DNA, 25 bp, Rattus norvegicus
ggatatcgatatcggtgcgcacctc

SEQ ID NO: 581868 - DNA, 25 bp, Rattus norvegicus
tcacagtggctggaacatcacgggc

SEQ ID NO: 581869 - DNA, 25 bp, Rattus norvegicus
tgccagtgccagtcagtcagagtgc

SEQ ID NO: 581870 - DNA, 25 bp, Rattus norvegicus
gtagaccctacacaccaccaaatgg

SEQ ID NO: 581871 - DNA, 25 bp, Rattus norvegicus
aggttggcgctgaccaaatggttca

SEQ ID NO: 581872 - DNA, 25 bp, Rattus norvegicus
acaaggcggctgcatggtcctatac

SEQ ID NO: 581873 - DNA, 25 bp, Rattus norvegicus
cctggactctttgggtcgcagaacc

SEQ ID NO: 581874 - DNA, 25 bp, Rattus norvegicus
cagaaccgctaaaccggcacggata

SEQ ID NO: 581875 - DNA, 25 bp, Rattus norvegicus
tggatgagactaagcgtagacccta

SEQ ID NO: 581876 - DNA, 25 bp, Rattus norvegicus
tgaaggtctgaatacccagctcccg

SEQ ID NO: 581877 - DNA, 25 bp, Rattus norvegicus
tgagagcagattccatggcacaggc

SEQ ID NO: 581878 - DNA, 25 bp, Rattus norvegicus
ggccaagccgaggaccctctaaaga

SEQ ID NO: 581879 - DNA, 25 bp, Rattus norvegicus
ctgaagcagcgactgggctctaacc

SEQ ID NO: 581880 - DNA, 25 bp, Rattus norvegicus
agtgcgtgtccctacgctgagccag

SEQ ID NO: 581881 - DNA, 25 bp, Rattus norvegicus
ctgcctggaacttgcaggttattta

SEQ ID NO: 581882 - DNA, 25 bp, Rattus norvegicus
cagaggcccaaacccaggcgaacga

SEQ ID NO: 581883 - DNA, 25 bp, Rattus norvegicus
ttatttatgtggatgctgaagccgg

SEQ ID NO: 581884 - DNA, 25 bp, Rattus norvegicus
acgcactgcgcgtgcgtacgctcga

SEQ ID NO: 581885 - DNA, 25 bp, Rattus norvegicus
ggtcggcctccactgacgtcagaac

SEQ ID NO: 581886 - DNA, 25 bp, Rattus norvegicus
gtcagaacgcctcgctacttacagc

SEQ ID NO: 581887 - DNA, 25 bp, Rattus norvegicus
cagctgagttattcgggctgaccgc

SEQ ID NO: 581888 - DNA, 25 bp, Rattus norvegicus
ttgaatgaaagctccgcaagatggc

SEQ ID NO: 581889 - DNA, 25 bp, Rattus norvegicus
tccaaccgagcgaggtccagagctc

SEQ ID NO: 581890 - DNA, 25 bp, Rattus norvegicus
cacgaggtgcctcattcaagggtga

SEQ ID NO: 581891 - DNA, 25 bp, Rattus norvegicus
ttcaagggtgagcaggaaagcacac

SEQ ID NO: 581892 - DNA, 25 bp, Rattus norvegicus
cgctgtgaggcgtctgcagacacaa

SEQ ID NO: 581893 - DNA, 25 bp, Rattus norvegicus
gcagacacaaccctgagctcctgga

SEQ ID NO: 581894 - DNA, 25 bp, Rattus norvegicus
gctgaccgcgccagtttgaatgaaa

SEQ ID NO: 581895 - DNA, 25 bp, Rattus norvegicus
agaacccgggccttgatcgccgtgc

SEQ ID NO: 581896 - DNA, 25 bp, Rattus norvegicus
ctgctaaattcttctccgcgagtcg

SEQ ID NO: 581897 - DNA, 25 bp, Rattus norvegicus
agccagacctgagcggatgcgcagc

SEQ ID NO: 581898 - DNA, 25 bp, Rattus norvegicus
ggcagaactagggtaaccgcggata

SEQ ID NO: 581899 - DNA, 25 bp, Rattus norvegicus
tagggaacacgagcaccgctgcgcc

SEQ ID NO: 581900 - DNA, 25 bp, Rattus norvegicus
tcccgagtagggaacacgagcaccg

SEQ ID NO: 581901 - DNA, 25 bp, Rattus norvegicus
tgtctcagcccaagatcccgagtag

SEQ ID NO: 581902 - DNA, 25 bp, Rattus norvegicus
taggatccgctaccctgctaaattc

SEQ ID NO: 581903 - DNA, 25 bp, Rattus norvegicus
cagttagtccttggctgtctcagcc

SEQ ID NO: 581904 - DNA, 25 bp, Rattus norvegicus
ttggtccctcccacatcgtaggatc

SEQ ID NO: 581905 - DNA, 25 bp, Rattus norvegicus
acgggccgctacagttagtccttgg

SEQ ID NO: 581906 - DNA, 25 bp, Rattus norvegicus
cagcgtcgctgcgttgctaggagac

SEQ ID NO: 581907 - DNA, 25 bp, Rattus norvegicus
aactgggctcggctcgctcacgtgg

SEQ ID NO: 581908 - DNA, 25 bp, Rattus norvegicus
gatgcgcagcgagaacccgggcctt

SEQ ID NO: 581909 - DNA, 25 bp, Rattus norvegicus
ttctttccggctggcctcaggcgat

SEQ ID NO: 581910 - DNA, 25 bp, Rattus norvegicus
gtctccctgaggttctttccggctg

SEQ ID NO: 581911 - DNA, 25 bp, Rattus norvegicus
ggaccactctcggtagccaaactac

SEQ ID NO: 581912 - DNA, 25 bp, Rattus norvegicus
agacagaccgtacgcctgcgcagtg

SEQ ID NO: 581913 - DNA, 25 bp, Rattus norvegicus
ctgcgcagtgctgctccagagctcg

SEQ ID NO: 581914 - DNA, 25 bp, Rattus norvegicus
gtcccaggctgagggattttacgca

SEQ ID NO: 581915 - DNA, 25 bp, Rattus norvegicus
cgtggtgtgacgtgagacatcattc

SEQ ID NO: 581916 - DNA, 25 bp, Rattus norvegicus
gggattttacgcagggaccactctc

SEQ ID NO: 581917 - DNA, 25 bp, Rattus norvegicus
gccaaactacggctgacgttcctta

SEQ ID NO: 581918 - DNA, 25 bp, Rattus norvegicus
ttccttactaggagtgacgtaatgc

SEQ ID NO: 581919 - DNA, 25 bp, Rattus norvegicus
ttgccgccgcagtgaatcgatctgt

SEQ ID NO: 581920 - DNA, 25 bp, Rattus norvegicus
aatcgatctgtcacgtggtctccgc

SEQ ID NO: 581921 - DNA, 25 bp, Rattus norvegicus
tggggttcatccagtgcccggtctc

SEQ ID NO: 581922 - DNA, 25 bp, Rattus norvegicus
cgcttctgcacaggtgggtgcatgc

SEQ ID NO: 581923 - DNA, 25 bp, Rattus norvegicus
accttctgcgtgctgccgcagctgt

SEQ ID NO: 581924 - DNA, 25 bp, Rattus norvegicus
tacctgggaacaggcaaggccggcc

SEQ ID NO: 581925 - DNA, 25 bp, Rattus norvegicus
agccaatcaagagcgtgcctgccgg

SEQ ID NO: 581926 - DNA, 25 bp, Rattus norvegicus
cactttcccgccaactctgatcggc

SEQ ID NO: 581927 - DNA, 25 bp, Rattus norvegicus
atgctgagctactgccactttcccg

SEQ ID NO: 581928 - DNA, 25 bp, Rattus norvegicus
ctgcagctgccatgctgagctactg

SEQ ID NO: 581929 - DNA, 25 bp, Rattus norvegicus
cgactcagacgctgcagctgccatg

SEQ ID NO: 581930 - DNA, 25 bp, Rattus norvegicus
ctgttctgccagcaccttgaggggc

SEQ ID NO: 581931 - DNA, 25 bp, Rattus norvegicus
ggccacccgaagacagcgactcaga

SEQ ID NO: 581932 - DNA, 25 bp, Rattus norvegicus
gcgtgctgccgcagctgttctgcca

SEQ ID NO: 581933 - DNA, 25 bp, Rattus norvegicus
agcacagtaccctgcatccacacgg

SEQ ID NO: 581934 - DNA, 25 bp, Rattus norvegicus
agaaggtaccgctcgggtcccgcag

SEQ ID NO: 581935 - DNA, 25 bp, Rattus norvegicus
gccacgcacggagaaggtaccgctc

SEQ ID NO: 581936 - DNA, 25 bp, Rattus norvegicus
ctccaggccacgcacggagaaggta

SEQ ID NO: 581937 - DNA, 25 bp, Rattus norvegicus
cggtgcgaaagtactagaaggatgc

SEQ ID NO: 581938 - DNA, 25 bp, Rattus norvegicus
tgccaaggcgcaagtggaacgactt

SEQ ID NO: 581939 - DNA, 25 bp, Rattus norvegicus
gtggaacgacttgcatctccctcgc

SEQ ID NO: 581940 - DNA, 25 bp, Rattus norvegicus
caccacaaagggaagggccttgcgc

SEQ ID NO: 581941 - DNA, 25 bp, Rattus norvegicus
gaagaagacccgctcctctcgtggt

SEQ ID NO: 581942 - DNA, 25 bp, Rattus norvegicus
tgcacctcacaatggtctcaggacg

SEQ ID NO: 581943 - DNA, 25 bp, Rattus norvegicus
ggccaccgccaaacggagtggtcga

SEQ ID NO: 581944 - DNA, 25 bp, Rattus norvegicus
tccgcctgttttagcgggtgaagaa

SEQ ID NO: 581945 - DNA, 25 bp, Rattus norvegicus
gcgccttcctattgtctccgatcta

SEQ ID NO: 581946 - DNA, 25 bp, Rattus norvegicus
gatctattccgcacgtgtcctggtc

SEQ ID NO: 581947 - DNA, 25 bp, Rattus norvegicus
cagctctaggctctgctggctggcc

SEQ ID NO: 581948 - DNA, 25 bp, Rattus norvegicus
ctccgagcagcaagcaaggcgcgac

SEQ ID NO: 581949 - DNA, 25 bp, Rattus norvegicus
gcggctcccgcctgtctattctgtt

SEQ ID NO: 581950 - DNA, 25 bp, Rattus norvegicus
agttctcccacttcggcagccgagg

SEQ ID NO: 581951 - DNA, 25 bp, Rattus norvegicus
tcgatgagcgcatctgcgatgggct

SEQ ID NO: 581952 - DNA, 25 bp, Rattus norvegicus
gtaatcggatgggtttccacggcga

SEQ ID NO: 581953 - DNA, 25 bp, Rattus norvegicus
gtttccacggcgaggagtttggcac

SEQ ID NO: 581954 - DNA, 25 bp, Rattus norvegicus
agtttggcacgtaggcgtgttttgt

SEQ ID NO: 581955 - DNA, 25 bp, Rattus norvegicus
tgttttgtggcggtgacaatcagct

SEQ ID NO: 581956 - DNA, 25 bp, Rattus norvegicus
gtggcggtgacaatcagctgatttc

SEQ ID NO: 581957 - DNA, 25 bp, Rattus norvegicus
cagctgatttcccagtttgtacggg

SEQ ID NO: 581958 - DNA, 25 bp, Rattus norvegicus
tcccagtttgtacgggaacttgatg

SEQ ID NO: 581959 - DNA, 25 bp, Rattus norvegicus
tacgggaacttgatgaaggcgaccc

SEQ ID NO: 581960 - DNA, 25 bp, Rattus norvegicus
ccatctgtgccggatgtgccagagg

SEQ ID NO: 581961 - DNA, 25 bp, Rattus norvegicus
ccggatgtgccagaggcaacagaca

SEQ ID NO: 581962 - DNA, 25 bp, Rattus norvegicus
ccagaggcaacagacacctggctgg

SEQ ID NO: 581963 - DNA, 25 bp, Rattus norvegicus
agacacctggctggcgaagacctcg

SEQ ID NO: 581964 - DNA, 25 bp, Rattus norvegicus
tggcgaagacctcgatgagcgcatc

SEQ ID NO: 581965 - DNA, 25 bp, Rattus norvegicus
ctccacaacaaaagggccgggcgca

SEQ ID NO: 581966 - DNA, 25 bp, Rattus norvegicus
agcgtcttggtgaccgccttccaaa

SEQ ID NO: 581967 - DNA, 25 bp, Rattus norvegicus
gccttccaaacgtggcagccgagca

SEQ ID NO: 581968 - DNA, 25 bp, Rattus norvegicus
gtggctgctgttccctgcagctgtt

SEQ ID NO: 581969 - DNA, 25 bp, Rattus norvegicus
gttcctccagactcgaggccttcga

SEQ ID NO: 581970 - DNA, 25 bp, Rattus norvegicus
aggccttcgaagtcacgctgggtta

SEQ ID NO: 581971 - DNA, 25 bp, Rattus norvegicus
cagatcccggggaagcatctgcgcc

SEQ ID NO: 581972 - DNA, 25 bp, Rattus norvegicus
cagagcagctggtgccacccagatc

SEQ ID NO: 581973 - DNA, 25 bp, Rattus norvegicus
cctcggatgtaagccgaagagtcgc

SEQ ID NO: 581974 - DNA, 25 bp, Rattus norvegicus
tgcataaaggaaagcacctcggatg

SEQ ID NO: 581975 - DNA, 25 bp, Rattus norvegicus
agccgcgtgtccgagtcatgcataa

SEQ ID NO: 581976 - DNA, 25 bp, Rattus norvegicus
ggacagccagtcaggtcgctctctc

SEQ ID NO: 581977 - DNA, 25 bp, Rattus norvegicus
aggcccgggcgcgacacaaaagcgt

SEQ ID NO: 581978 - DNA, 25 bp, Rattus norvegicus
gccttcgcgctggactccaggactg

SEQ ID NO: 581979 - DNA, 25 bp, Rattus norvegicus
gtccaagttgaacgccagagacacg

SEQ ID NO: 581980 - DNA, 25 bp, Rattus norvegicus
agtccacagtgacagtcctctcctg

SEQ ID NO: 581981 - DNA, 25 bp, Rattus norvegicus
tcagtgagctcggtgagtccacagt

SEQ ID NO: 581982 - DNA, 25 bp, Rattus norvegicus
caaccacttacgtgcgcgcatcagg

SEQ ID NO: 581983 - DNA, 25 bp, Rattus norvegicus
ccaccgctctggacttggaacagtg

SEQ ID NO: 581984 - DNA, 25 bp, Rattus norvegicus
cggccgagacgcaacagagacaagc

SEQ ID NO: 581985 - DNA, 25 bp, Rattus norvegicus
aaacgctgctcacccaggatcggga

SEQ ID NO: 581986 - DNA, 25 bp, Rattus norvegicus
cgtgagcttgtctacgtccaagttg

SEQ ID NO: 581987 - DNA, 25 bp, Rattus norvegicus
tgggttctcgcagacatcgtcctct

SEQ ID NO: 581988 - DNA, 25 bp, Rattus norvegicus
gggccactgtacaccgtgagcttgt

SEQ ID NO: 581989 - DNA, 25 bp, Rattus norvegicus
agaagtccagcgagtagccgaagta

SEQ ID NO: 581990 - DNA, 25 bp, Rattus norvegicus
cgcgcatcaggtatgtagaagtcca

SEQ ID NO: 581991 - DNA, 25 bp, Rattus norvegicus
acttggaacagtggatcccgcgctc

SEQ ID NO: 581992 - DNA, 25 bp, Rattus norvegicus
acaagcgaacggaggtgcccagttc

SEQ ID NO: 581993 - DNA, 25 bp, Rattus norvegicus
gtgccaagcccaaacggggatactg

SEQ ID NO: 581994 - DNA, 25 bp, Rattus norvegicus
tgcggatactacagggactgaagcc

SEQ ID NO: 581995 - DNA, 25 bp, Rattus norvegicus
gatactgggacagaacgcggtgcct

SEQ ID NO: 581996 - DNA, 25 bp, Rattus norvegicus
cgcggtgcctaaagcgtggttactg

SEQ ID NO: 581997 - DNA, 25 bp, Rattus norvegicus
tggttactggaacccagcactggtg

SEQ ID NO: 581998 - DNA, 25 bp, Rattus norvegicus
gtaccttgcgtccagcggcagaaga

SEQ ID NO: 581999 - DNA, 25 bp, Rattus norvegicus
cggcagaagatggtgtccgacagtc

SEQ ID NO: 582000 - DNA, 25 bp, Rattus norvegicus
agcagctctttggtcacttcggaca

SEQ ID NO: 582001 - DNA, 25 bp, Rattus norvegicus
cttcggacatgatggggactggaca

SEQ ID NO: 582002 - DNA, 25 bp, Rattus norvegicus
gacaagagggtctttgcttcccgta

SEQ ID NO: 582003 - DNA, 25 bp, Rattus norvegicus
tgcccgcagagacagcgcctgtcaa

SEQ ID NO: 582004 - DNA, 25 bp, Rattus norvegicus
cgggcgaagccgcaactaggagttt

SEQ ID NO: 582005 - DNA, 25 bp, Rattus norvegicus
gcggcttgacttccggcttccttta

SEQ ID NO: 582006 - DNA, 25 bp, Rattus norvegicus
gaagccgtgatactaagcgcgagca

SEQ ID NO: 582007 - DNA, 25 bp, Rattus norvegicus
gaggccagcatagaaggcgatcttg

SEQ ID NO: 582008 - DNA, 25 bp, Rattus norvegicus
gtccgcgctcacctggttgtttttg

SEQ ID NO: 582009 - DNA, 25 bp, Rattus norvegicus
acccgggatggaacaggtgaacttg

SEQ ID NO: 582010 - DNA, 25 bp, Rattus norvegicus
gacctcctcagagccgaaaacaatc

SEQ ID NO: 582011 - DNA, 25 bp, Rattus norvegicus
gggccgatcctcttgtctgcttttg

SEQ ID NO: 582012 - DNA, 25 bp, Rattus norvegicus
ttcgtgctgccgtttgaggccagca

SEQ ID NO: 582013 - DNA, 25 bp, Rattus norvegicus
gatgaggatgaccagcagaagcacc

SEQ ID NO: 582014 - DNA, 25 bp, Rattus norvegicus
cagcatctcgtagtgcgccgacgtg

SEQ ID NO: 582015 - DNA, 25 bp, Rattus norvegicus
ccctggatgaaagtgggcagagact

SEQ ID NO: 582016 - DNA, 25 bp, Rattus norvegicus
cttcgcctttgggaccctggatgaa

SEQ ID NO: 582017 - DNA, 25 bp, Rattus norvegicus
acctcgtagccttcgtgctgccgtt

SEQ ID NO: 582018 - DNA, 25 bp, Rattus norvegicus
ggcgatcttgggcaccgtgctatag

SEQ ID NO: 582019 - DNA, 25 bp, Rattus norvegicus
aacttgcccgtggtgggatcgtagt

SEQ ID NO: 582020 - DNA, 25 bp, Rattus norvegicus
ttgtttttgcagagatcagcccaca

SEQ ID NO: 582021 - DNA, 25 bp, Rattus norvegicus
ctcgttttcagcttccgtggtcacc

SEQ ID NO: 582022 - DNA, 25 bp, Rattus norvegicus
gtgacatggcctccggctccgtaca

SEQ ID NO: 582023 - DNA, 25 bp, Rattus norvegicus
attctcaataatcaacagctcggtg

SEQ ID NO: 582024 - DNA, 25 bp, Rattus norvegicus
tcactgccactcttaattctcaata

SEQ ID NO: 582025 - DNA, 25 bp, Rattus norvegicus
tgtggcacacgaggggctctccctc

SEQ ID NO: 582026 - DNA, 25 bp, Rattus norvegicus
tcaacagctcggtgacatggcctcc

SEQ ID NO: 582027 - DNA, 25 bp, Rattus norvegicus
gcgtgacgtgtaggtctcgttttca

SEQ ID NO: 582028 - DNA, 25 bp, Rattus norvegicus
cgtggtcaccgccacttaagcagga

SEQ ID NO: 582029 - DNA, 25 bp, Rattus norvegicus
gccacttaagcaggacagcgatgtc

SEQ ID NO: 582030 - DNA, 25 bp, Rattus norvegicus
ggacagcgatgtctccctgcctttc

SEQ ID NO: 582031 - DNA, 25 bp, Rattus norvegicus
caatgtgcgccttgcctaaaaacga

SEQ ID NO: 582032 - DNA, 25 bp, Rattus norvegicus
gtgcgccttgcctaaaaacgagcta

SEQ ID NO: 582033 - DNA, 25 bp, Rattus norvegicus
aaacgagctaatcggcctgtttgtg

SEQ ID NO: 582034 - DNA, 25 bp, Rattus norvegicus
taatcggcctgtttgtggcacacga

SEQ ID NO: 582035 - DNA, 25 bp, Rattus norvegicus
cgtgctccagtacatggggccacta

SEQ ID NO: 582036 - DNA, 25 bp, Rattus norvegicus
acacgtgagatgattcccgagcgtc

SEQ ID NO: 582037 - DNA, 25 bp, Rattus norvegicus
agatgcgcaaccaccgcgctgtttg

SEQ ID NO: 582038 - DNA, 25 bp, Rattus norvegicus
tcgcgtctggaactgcgctaccagc

SEQ ID NO: 582039 - DNA, 25 bp, Rattus norvegicus
ggggccactaccatcgcgtctggaa

SEQ ID NO: 582040 - DNA, 25 bp, Rattus norvegicus
catgtgcgccaacgtgtaccctgca

SEQ ID NO: 582041 - DNA, 25 bp, Rattus norvegicus
gaatctggtagatgcgccgcagtgc

SEQ ID NO: 582042 - DNA, 25 bp, Rattus norvegicus
cccgcatatccgcagtcatttaaaa

SEQ ID NO: 582043 - DNA, 25 bp, Rattus norvegicus
acagttaaatgatcgctgcaggcca

SEQ ID NO: 582044 - DNA, 25 bp, Rattus norvegicus
cccgagcgtcgagtgacaaacctta

SEQ ID NO: 582045 - DNA, 25 bp, Rattus norvegicus
ccctagagtctcagtggggacacgt

SEQ ID NO: 582046 - DNA, 25 bp, Rattus norvegicus
caggacgtgcttccagctacggaga

SEQ ID NO: 582047 - DNA, 25 bp, Rattus norvegicus
gcagtgcctgactcttccgagggct

SEQ ID NO: 582048 - DNA, 25 bp, Rattus norvegicus
aaaccttaactgctgtgcgggtaca

SEQ ID NO: 582049 - DNA, 25 bp, Rattus norvegicus
gggcccaagtgaatctaagaaaagc

SEQ ID NO: 582050 - DNA, 25 bp, Rattus norvegicus
gcactaaggtggtttccagggcaac

SEQ ID NO: 582051 - DNA, 25 bp, Rattus norvegicus
caaccgaggtcggccgcagcaggtc

SEQ ID NO: 582052 - DNA, 25 bp, Rattus norvegicus
cgcgaccgcggcctggaaactaggc

SEQ ID NO: 582053 - DNA, 25 bp, Rattus norvegicus
ttgtgggcccaagtgaatctaagaa

SEQ ID NO: 582054 - DNA, 25 bp, Rattus norvegicus
tctaagaaaagctgtctgtccgctc

SEQ ID NO: 582055 - DNA, 25 bp, Rattus norvegicus
gaaaagctgtctgtccgctcacctc

SEQ ID NO: 582056 - DNA, 25 bp, Rattus norvegicus
gggaagcgcactaaggtggtttcca

SEQ ID NO: 582057 - DNA, 25 bp, Rattus norvegicus
agcgcgtggtgcatgcccccaatgc

SEQ ID NO: 582058 - DNA, 25 bp, Rattus norvegicus
ccaatgccactgtacagctccagga

SEQ ID NO: 582059 - DNA, 25 bp, Rattus norvegicus
tccaggacacgcagaggttccatcc

SEQ ID NO: 582060 - DNA, 25 bp, Rattus norvegicus
ctaggcctaccggtccaacgcttct

SEQ ID NO: 582061 - DNA, 25 bp, Rattus norvegicus
acgcagaggttccatcctctcgcaa

SEQ ID NO: 582062 - DNA, 25 bp, Rattus norvegicus
cgagagccggaacttgtgggcccaa

SEQ ID NO: 582063 - DNA, 25 bp, Rattus norvegicus
ttccgatctgcaacaccgctcttgc

SEQ ID NO: 582064 - DNA, 25 bp, Rattus norvegicus
ctgcaacaccgctcttgcaggctct

SEQ ID NO: 582065 - DNA, 25 bp, Rattus norvegicus
caacaccgctcttgcaggctcttcc

SEQ ID NO: 582066 - DNA, 25 bp, Rattus norvegicus
ccttccgatctgcaacaccgctctt

SEQ ID NO: 582067 - DNA, 25 bp, Rattus norvegicus
gccttccgatctgcaacaccgctct

SEQ ID NO: 582068 - DNA, 25 bp, Rattus norvegicus
tgcaacaccgctcttgcaggctctt

SEQ ID NO: 582069 - DNA, 25 bp, Rattus norvegicus
tctgcaacaccgctcttgcaggctc

SEQ ID NO: 582070 - DNA, 25 bp, Rattus norvegicus
atctgcaacaccgctcttgcaggct

SEQ ID NO: 582071 - DNA, 25 bp, Rattus norvegicus
gatctgcaacaccgctcttgcaggc

SEQ ID NO: 582072 - DNA, 25 bp, Rattus norvegicus
cgatctgcaacaccgctcttgcagg

SEQ ID NO: 582073 - DNA, 25 bp, Rattus norvegicus
ccgatctgcaacaccgctcttgcag

SEQ ID NO: 582074 - DNA, 25 bp, Rattus norvegicus
tccgatctgcaacaccgctcttgca

SEQ ID NO: 582075 - DNA, 25 bp, Rattus norvegicus
cttccgatctgcaacaccgctcttg

SEQ ID NO: 582076 - DNA, 25 bp, Rattus norvegicus
gcaacaccgctcttgcaggctcttc

SEQ ID NO: 582077 - DNA, 25 bp, Rattus norvegicus
tcagtgccagggaccgatttacaca

SEQ ID NO: 582078 - DNA, 25 bp, Rattus norvegicus
cagtgccagggaccgatttacacaa

SEQ ID NO: 582079 - DNA, 25 bp, Rattus norvegicus
tgccagggaccgatttacacaactt

SEQ ID NO: 582080 - DNA, 25 bp, Rattus norvegicus
ctcagtgccagggaccgatttacac

SEQ ID NO: 582081 - DNA, 25 bp, Rattus norvegicus
ggctcagtgccagggaccgatttac

SEQ ID NO: 582082 - DNA, 25 bp, Rattus norvegicus
tggctcagtgccagggaccgattta

SEQ ID NO: 582083 - DNA, 25 bp, Rattus norvegicus
cgcctaggcccacgcccctttggct

SEQ ID NO: 582084 - DNA, 25 bp, Rattus norvegicus
cctcctaccggcgcgcctaggccca

SEQ ID NO: 582085 - DNA, 25 bp, Rattus norvegicus
agaccgcagctttgcgaccgcgccc

SEQ ID NO: 582086 - DNA, 25 bp, Rattus norvegicus
gaagaccgcagctttgcgaccgcgc

SEQ ID NO: 582087 - DNA, 25 bp, Rattus norvegicus
agaagaccgcagctttgcgaccgcg

SEQ ID NO: 582088 - DNA, 25 bp, Rattus norvegicus
cagaagaccgcagctttgcgaccgc

SEQ ID NO: 582089 - DNA, 25 bp, Rattus norvegicus
cttgcaggctcttcccgctccccgg

SEQ ID NO: 582090 - DNA, 25 bp, Rattus norvegicus
gtgccagggaccgatttacacaact

SEQ ID NO: 582091 - DNA, 25 bp, Rattus norvegicus
ttgaaaggcccgcaagccgaagccg

SEQ ID NO: 582092 - DNA, 25 bp, Rattus norvegicus
ggactcccgcagacgccctttgcaa

SEQ ID NO: 582093 - DNA, 25 bp, Rattus norvegicus
acgccctttgcaagccctccctaga

SEQ ID NO: 582094 - DNA, 25 bp, Rattus norvegicus
acagcactcacagggcatccgcgtg

SEQ ID NO: 582095 - DNA, 25 bp, Rattus norvegicus
cagggcatccgcgtgagcacgttgc

SEQ ID NO: 582096 - DNA, 25 bp, Rattus norvegicus
ttcaggaagctctcgtactccgcca

SEQ ID NO: 582097 - DNA, 25 bp, Rattus norvegicus
tccatgtttgaaaggcccgcaagcc

SEQ ID NO: 582098 - DNA, 25 bp, Rattus norvegicus
ctcctccatgtttgaaaggcccgca

SEQ ID NO: 582099 - DNA, 25 bp, Rattus norvegicus
ctgtaggagctgacgtccagccgcg

SEQ ID NO: 582100 - DNA, 25 bp, Rattus norvegicus
tcgaagctgtaggagctgacgtcca

SEQ ID NO: 582101 - DNA, 25 bp, Rattus norvegicus
ctccgccacgttgttgaagcaggga

SEQ ID NO: 582102 - DNA, 25 bp, Rattus norvegicus
gaagctctcgtactccgccacgttg

SEQ ID NO: 582103 - DNA, 25 bp, Rattus norvegicus
tcgtactccgccacgttgttgaagc

SEQ ID NO: 582104 - DNA, 25 bp, Rattus norvegicus
gtccgtgtcctccttgaccaccatg

SEQ ID NO: 582105 - DNA, 25 bp, Rattus norvegicus
acaaaatcctgctggccgagctcga

SEQ ID NO: 582106 - DNA, 25 bp, Rattus norvegicus
tcgagcagcttaagggccagggcaa

SEQ ID NO: 582107 - DNA, 25 bp, Rattus norvegicus
gccggcaggtggatcagctcaccaa

SEQ ID NO: 582108 - DNA, 25 bp, Rattus norvegicus
gctcaccaatgacaaggcccgtgtg

SEQ ID NO: 582109 - DNA, 25 bp, Rattus norvegicus
cgaggacatcatgcggctgcgagaa

SEQ ID NO: 582110 - DNA, 25 bp, Rattus norvegicus
attgcaggagctgaatgaccgcttc

SEQ ID NO: 582111 - DNA, 25 bp, Rattus norvegicus
ctgcgagaaaagtaaggcctgaccc

SEQ ID NO: 582112 - DNA, 25 bp, Rattus norvegicus
ctgctgcaggactccgtggacttct

SEQ ID NO: 582113 - DNA, 25 bp, Rattus norvegicus
tcctcgagcagcagaacaaaatcct

SEQ ID NO: 582114 - DNA, 25 bp, Rattus norvegicus
gagggacaacctggccgaggacatc

SEQ ID NO: 582115 - DNA, 25 bp, Rattus norvegicus
gagttcaagaacacccgcaccaacg

SEQ ID NO: 582116 - DNA, 25 bp, Rattus norvegicus
ctacatcgacaaggtgcgcttcctc

SEQ ID NO: 582117 - DNA, 25 bp, Rattus norvegicus
tggccgacgccatcaacaccgagtt

SEQ ID NO: 582118 - DNA, 25 bp, Rattus norvegicus
accggagctatgtgaccacatccac

SEQ ID NO: 582119 - DNA, 25 bp, Rattus norvegicus
agctcgcctcttgtcctgccggagg

SEQ ID NO: 582120 - DNA, 25 bp, Rattus norvegicus
ccaaagcacagcgtgggcgcaccgg

SEQ ID NO: 582121 - DNA, 25 bp, Rattus norvegicus
gcgtcggctgggcaccagaacagac

SEQ ID NO: 582122 - DNA, 25 bp, Rattus norvegicus
ccagaacagacgcagaaggagcagc

SEQ ID NO: 582123 - DNA, 25 bp, Rattus norvegicus
gcagcagcatcaggctgcctaccag

SEQ ID NO: 582124 - DNA, 25 bp, Rattus norvegicus
tcaggctgcctaccagggcgaacag

SEQ ID NO: 582125 - DNA, 25 bp, Rattus norvegicus
ctgcaacagtgttgccgggtacgga

SEQ ID NO: 582126 - DNA, 25 bp, Rattus norvegicus
cggagccaaggaagcaagcagcctc

SEQ ID NO: 582127 - DNA, 25 bp, Rattus norvegicus
caaggaagcaagcagcctccgggct

SEQ ID NO: 582128 - DNA, 25 bp, Rattus norvegicus
gggctcgcccgcttctttcaagcca

SEQ ID NO: 582129 - DNA, 25 bp, Rattus norvegicus
ccctggctgccgaagctggtggaca

SEQ ID NO: 582130 - DNA, 25 bp, Rattus norvegicus
ctggtggacagctagcagatgacga

SEQ ID NO: 582131 - DNA, 25 bp, Rattus norvegicus
agcagatgacgatcctccgagctcg

SEQ ID NO: 582132 - DNA, 25 bp, Rattus norvegicus
tcccgggaaagcaacgcccaaagca

SEQ ID NO: 582133 - DNA, 25 bp, Rattus norvegicus
cagagcgaatgtaccagaggcgacg

SEQ ID NO: 582134 - DNA, 25 bp, Rattus norvegicus
tggaagagctgtccgcccgctctgg

SEQ ID NO: 582135 - DNA, 25 bp, Rattus norvegicus
cttcctagagagacgcgggcgacgc

SEQ ID NO: 582136 - DNA, 25 bp, Rattus norvegicus
cctcttcctagagagacgcgggcga

SEQ ID NO: 582137 - DNA, 25 bp, Rattus norvegicus
gctgcgacctcttcctagagagacg

SEQ ID NO: 582138 - DNA, 25 bp, Rattus norvegicus
tccagacagagcgaatgtaccagag

SEQ ID NO: 582139 - DNA, 25 bp, Rattus norvegicus
ccctggcaatgggtgtctcgctggt

SEQ ID NO: 582140 - DNA, 25 bp, Rattus norvegicus
cgctggtgcgccttgtccagacaga

SEQ ID NO: 582141 - DNA, 25 bp, Rattus norvegicus
tgtctcgctggtgcgccttgtccag

SEQ ID NO: 582142 - DNA, 25 bp, Rattus norvegicus
cttgtccagacagagcgaatgtacc

SEQ ID NO: 582143 - DNA, 25 bp, Rattus norvegicus
cgcgtgccctggcaatgggtgtctc

SEQ ID NO: 582144 - DNA, 25 bp, Rattus norvegicus
cgtggaagagctgtccgcccgctct

SEQ ID NO: 582145 - DNA, 25 bp, Rattus norvegicus
cgcgctcccgtggaagagctgtccg

SEQ ID NO: 582146 - DNA, 25 bp, Rattus norvegicus
ccagccggggtcacggcttccaggc

SEQ ID NO: 582147 - DNA, 25 bp, Rattus norvegicus
tcctttctccgtcacttctcgagtg

SEQ ID NO: 582148 - DNA, 25 bp, Rattus norvegicus
ggcagcgctcaagtcgcctagattc

SEQ ID NO: 582149 - DNA, 25 bp, Rattus norvegicus
cgagcacggttcaggcagcgctcaa

SEQ ID NO: 582150 - DNA, 25 bp, Rattus norvegicus
catcctccagagacgcccggggaat

SEQ ID NO: 582151 - DNA, 25 bp, Rattus norvegicus
gggcctgtccagcttctccgctgtt

SEQ ID NO: 582152 - DNA, 25 bp, Rattus norvegicus
tgagaaggaccctgcactggcaatc

SEQ ID NO: 582153 - DNA, 25 bp, Rattus norvegicus
gcactggcaatctcccttagtgttt

SEQ ID NO: 582154 - DNA, 25 bp, Rattus norvegicus
aagctgaggacacagccgttaaccc

SEQ ID NO: 582155 - DNA, 25 bp, Rattus norvegicus
gcacgcagcggacatgcctctcttt

SEQ ID NO: 582156 - DNA, 25 bp, Rattus norvegicus
ccaggatgttggtaagtgttttcac

SEQ ID NO: 582157 - DNA, 25 bp, Rattus norvegicus
ccctgcgttcgttcattctaaattc

SEQ ID NO: 582158 - DNA, 25 bp, Rattus norvegicus
ttctaaattcccaaggccgagccca

SEQ ID NO: 582159 - DNA, 25 bp, Rattus norvegicus
tctggtcagatttggagcgagcacg

SEQ ID NO: 582160 - DNA, 25 bp, Rattus norvegicus
cacttctcgagtgccgcggtgtcga

SEQ ID NO: 582161 - DNA, 25 bp, Rattus norvegicus
gcgggaaagggatctgtatcctgca

SEQ ID NO: 582162 - DNA, 25 bp, Rattus norvegicus
tgtatcctgcatcgctctttccgcg

SEQ ID NO: 582163 - DNA, 25 bp, Rattus norvegicus
tggagtcgacttttcgccgatggtc

SEQ ID NO: 582164 - DNA, 25 bp, Rattus norvegicus
tggtccaaagcgacacgtccaagtc

SEQ ID NO: 582165 - DNA, 25 bp, Rattus norvegicus
aagtcgcctcccatagcggcggtgg

SEQ ID NO: 582166 - DNA, 25 bp, Rattus norvegicus
cgctcggagcacaggtagccacagc

SEQ ID NO: 582167 - DNA, 25 bp, Rattus norvegicus
ccgcgccttctgctggctttgtgag

SEQ ID NO: 582168 - DNA, 25 bp, Rattus norvegicus
gctttgtgagcctcaagcccgacct

SEQ ID NO: 582169 - DNA, 25 bp, Rattus norvegicus
ccctctgctttctgaaaagccagtg

SEQ ID NO: 582170 - DNA, 25 bp, Rattus norvegicus
taaggggcaaggacgacctgccgct

SEQ ID NO: 582171 - DNA, 25 bp, Rattus norvegicus
cccgggagaagcacatggagagcca

SEQ ID NO: 582172 - DNA, 25 bp, Rattus norvegicus
acatggagagccatggaccaggcga

SEQ ID NO: 582173 - DNA, 25 bp, Rattus norvegicus
gagggacccgcaaccttggagtcga

SEQ ID NO: 582174 - DNA, 25 bp, Rattus norvegicus
tggaccggctcaagatcgtgagttc

SEQ ID NO: 582175 - DNA, 25 bp, Rattus norvegicus
tagaactcggatctggagactcgga

SEQ ID NO: 582176 - DNA, 25 bp, Rattus norvegicus
tggatcgggctcaagagtagaactc

SEQ ID NO: 582177 - DNA, 25 bp, Rattus norvegicus
tttctgtaaccaaggtgaggccggc

SEQ ID NO: 582178 - DNA, 25 bp, Rattus norvegicus
gctaaactgtggagccttttctgta

SEQ ID NO: 582179 - DNA, 25 bp, Rattus norvegicus
tggggctgatcttcgctaaactgtg

SEQ ID NO: 582180 - DNA, 25 bp, Rattus norvegicus
caggaagcctgtcccgtccggggct

SEQ ID NO: 582181 - DNA, 25 bp, Rattus norvegicus
aagcttcgctggactcttgaggctc

SEQ ID NO: 582182 - DNA, 25 bp, Rattus norvegicus
gttccgccgaggaccaaagcttcgc

SEQ ID NO: 582183 - DNA, 25 bp, Rattus norvegicus
tgctgcgaacaaaggagtctgcggc

SEQ ID NO: 582184 - DNA, 25 bp, Rattus norvegicus
ctgggctcatcgtgctgcgaacaaa

SEQ ID NO: 582185 - DNA, 25 bp, Rattus norvegicus
tcacgtgccgaccttccggcgatgg

SEQ ID NO: 582186 - DNA, 25 bp, Rattus norvegicus
ccacgatccgcacaccggaagtgta

SEQ ID NO: 582187 - DNA, 25 bp, Rattus norvegicus
aagtgtatagggaggacccgccacg

SEQ ID NO: 582188 - DNA, 25 bp, Rattus norvegicus
gaggcacctgatggccgggaatccc

SEQ ID NO: 582189 - DNA, 25 bp, Rattus norvegicus
agtgacctttcctctccgcatttgg

SEQ ID NO: 582190 - DNA, 25 bp, Rattus norvegicus
gccagccctaagtctgggaaagttc

SEQ ID NO: 582191 - DNA, 25 bp, Rattus norvegicus
ggctgcagcctcactttcctttggt

SEQ ID NO: 582192 - DNA, 25 bp, Rattus norvegicus
ctctggtacccggagtgaaatccta

SEQ ID NO: 582193 - DNA, 25 bp, Rattus norvegicus
gaggggtttctccagcctccacgaa

SEQ ID NO: 582194 - DNA, 25 bp, Rattus norvegicus
cccagggcctcaaggaaagatcgct

SEQ ID NO: 582195 - DNA, 25 bp, Rattus norvegicus
tgggaaagttccaccggtgctcagc

SEQ ID NO: 582196 - DNA, 25 bp, Rattus norvegicus
ctcagcgccctcttggatctggagc

SEQ ID NO: 582197 - DNA, 25 bp, Rattus norvegicus
cgcagccagtggaattagatctgtt

SEQ ID NO: 582198 - DNA, 25 bp, Rattus norvegicus
ttttgaacccagtggagcgcgtcgc

SEQ ID NO: 582199 - DNA, 25 bp, Rattus norvegicus
ttgcgggaccgactgcaagtgacct

SEQ ID NO: 582200 - DNA, 25 bp, Rattus norvegicus
ctccgcatttggttggttctgtctc

SEQ ID NO: 582201 - DNA, 25 bp, Rattus norvegicus
cgaaactgtcagaggcctccggatc

SEQ ID NO: 582202 - DNA, 25 bp, Rattus norvegicus
aggacgcacgctcagccttaggcga

SEQ ID NO: 582203 - DNA, 25 bp, Rattus norvegicus
gttctcggcgccgtaattgacgcgg

SEQ ID NO: 582204 - DNA, 25 bp, Rattus norvegicus
ccgcggctgctttgtctcgggcagt

SEQ ID NO: 582205 - DNA, 25 bp, Rattus norvegicus
agtctcgcgagaggattgtcacttc

SEQ ID NO: 582206 - DNA, 25 bp, Rattus norvegicus
ctcactacagagtgcgcgaacgaga

SEQ ID NO: 582207 - DNA, 25 bp, Rattus norvegicus
ggcgacagcgctgcagacgccatta

SEQ ID NO: 582208 - DNA, 25 bp, Rattus norvegicus
tgcagacgccattatcctctgcttc

SEQ ID NO: 582209 - DNA, 25 bp, Rattus norvegicus
gctgcacagacgtcgccgtcgtgct

SEQ ID NO: 582210 - DNA, 25 bp, Rattus norvegicus
tcccactcgattgcggcctgtaggt

SEQ ID NO: 582211 - DNA, 25 bp, Rattus norvegicus
ttacagcccaaagggagtcgccggc

SEQ ID NO: 582212 - DNA, 25 bp, Rattus norvegicus
attgacgcggccttgggccaatcgc

SEQ ID NO: 582213 - DNA, 25 bp, Rattus norvegicus
ggtttgtcctcgttctctgtctagc

SEQ ID NO: 582214 - DNA, 25 bp, Rattus norvegicus
accgccgaagcctgggcagccaatg

SEQ ID NO: 582215 - DNA, 25 bp, Rattus norvegicus
agcgtgcctctgcagttggcgtgct

SEQ ID NO: 582216 - DNA, 25 bp, Rattus norvegicus
tctgtctagcagtgaccgaccgtcg

SEQ ID NO: 582217 - DNA, 25 bp, Rattus norvegicus
atacaccacttttccgcagcgggcg

SEQ ID NO: 582218 - DNA, 25 bp, Rattus norvegicus
ggcagttgactttctccgtgggata

SEQ ID NO: 582219 - DNA, 25 bp, Rattus norvegicus
tctgcgtcgcttgcgctccaggtac

SEQ ID NO: 582220 - DNA, 25 bp, Rattus norvegicus
actggggattcattgtcgcggttcc

SEQ ID NO: 582221 - DNA, 25 bp, Rattus norvegicus
cagaagggcttcaggctctggcgaa

SEQ ID NO: 582222 - DNA, 25 bp, Rattus norvegicus
ctccaggtaccggtgactcacaagc

SEQ ID NO: 582223 - DNA, 25 bp, Rattus norvegicus
ccaaagggcagggaaccagccagtc

SEQ ID NO: 582224 - DNA, 25 bp, Rattus norvegicus
accagccagtctggcaccaagggac

SEQ ID NO: 582225 - DNA, 25 bp, Rattus norvegicus
gaatagggacccagagaactctact

SEQ ID NO: 582226 - DNA, 25 bp, Rattus norvegicus
gaactctactagtagccgcccagtg

SEQ ID NO: 582227 - DNA, 25 bp, Rattus norvegicus
aactggtacccacggccgcagcagt

SEQ ID NO: 582228 - DNA, 25 bp, Rattus norvegicus
cgcagcagtcctaggcgcccaggtg

SEQ ID NO: 582229 - DNA, 25 bp, Rattus norvegicus
tcgctcaccttatccaggcagttga

SEQ ID NO: 582230 - DNA, 25 bp, Rattus norvegicus
agcgcgcaccgacccaaagggcagg

SEQ ID NO: 582231 - DNA, 25 bp, Rattus norvegicus
gtcgctgtcggaaccgctctagcca

SEQ ID NO: 582232 - DNA, 25 bp, Rattus norvegicus
ggcatgtgtcgtcaacctcaaaatc

SEQ ID NO: 582233 - DNA, 25 bp, Rattus norvegicus
agacgcaccacaacccagcagtggg

SEQ ID NO: 582234 - DNA, 25 bp, Rattus norvegicus
ataccgagtgctcattggctgccgc

SEQ ID NO: 582235 - DNA, 25 bp, Rattus norvegicus
atcagtggcacacttcccggaagtg

SEQ ID NO: 582236 - DNA, 25 bp, Rattus norvegicus
aagtgcaagcgcaccacgcggtctc

SEQ ID NO: 582237 - DNA, 25 bp, Rattus norvegicus
agctgtgctgaaagcccacattagc

SEQ ID NO: 582238 - DNA, 25 bp, Rattus norvegicus
gccagctcaccggtgaaaattccgg

SEQ ID NO: 582239 - DNA, 25 bp, Rattus norvegicus
aaaatcccgcacgtactcaaacttg

SEQ ID NO: 582240 - DNA, 25 bp, Rattus norvegicus
ccggaagttcctgtcgctgtcggaa

SEQ ID NO: 582241 - DNA, 25 bp, Rattus norvegicus
gactgccgatcctagctgtgctgaa

SEQ ID NO: 582242 - DNA, 25 bp, Rattus norvegicus
agtagcggccaaaggactgccgatc

SEQ ID NO: 582243 - DNA, 25 bp, Rattus norvegicus
cctcaagcaccgtcttaaagtaacg

SEQ ID NO: 582244 - DNA, 25 bp, Rattus norvegicus
tcaaacttgctcttggccatagcca

SEQ ID NO: 582245 - DNA, 25 bp, Rattus norvegicus
gggaagctttgagacgtatgtgttt

SEQ ID NO: 582246 - DNA, 25 bp, Rattus norvegicus
atgtgtttcttctggttcgcttgtg

SEQ ID NO: 582247 - DNA, 25 bp, Rattus norvegicus
gtatgtgtttcttctggttcgcttg

SEQ ID NO: 582248 - DNA, 25 bp, Rattus norvegicus
tctggttcgcttgtgtgtatatgct

SEQ ID NO: 582249 - DNA, 25 bp, Rattus norvegicus
ttctggttcgcttgtgtgtatatgc

SEQ ID NO: 582250 - DNA, 25 bp, Rattus norvegicus
cttctggttcgcttgtgtgtatatg

SEQ ID NO: 582251 - DNA, 25 bp, Rattus norvegicus
gacgtatgtgtttcttctggttcgc

SEQ ID NO: 582252 - DNA, 25 bp, Rattus norvegicus
tcttctggttcgcttgtgtgtatat

SEQ ID NO: 582253 - DNA, 25 bp, Rattus norvegicus
gtttcttctggttcgcttgtgtgta

SEQ ID NO: 582254 - DNA, 25 bp, Rattus norvegicus
gagacgtatgtgtttcttctggttc

SEQ ID NO: 582255 - DNA, 25 bp, Rattus norvegicus
ctttgagacgtatgtgtttcttctg

SEQ ID NO: 582256 - DNA, 25 bp, Rattus norvegicus
agctttgagacgtatgtgtttcttc

SEQ ID NO: 582257 - DNA, 25 bp, Rattus norvegicus
ggaagctttgagacgtatgtgtttc

SEQ ID NO: 582258 - DNA, 25 bp, Rattus norvegicus
gtgtttcttctggttcgcttgtgtg

SEQ ID NO: 582259 - DNA, 25 bp, Rattus norvegicus
tcggtcgaggcaacccagtcgccta

SEQ ID NO: 582260 - DNA, 25 bp, Rattus norvegicus
cagtcgcctacccttggggtagatc

SEQ ID NO: 582261 - DNA, 25 bp, Rattus norvegicus
ccttggggtagatccaccgacggag

SEQ ID NO: 582262 - DNA, 25 bp, Rattus norvegicus
tagatccaccgacggagcaggcgct

SEQ ID NO: 582263 - DNA, 25 bp, Rattus norvegicus
ggcgctctctcaaggaatgccgaca

SEQ ID NO: 582264 - DNA, 25 bp, Rattus norvegicus
aggaatgccgacacccacatgctgc

SEQ ID NO: 582265 - DNA, 25 bp, Rattus norvegicus
accggatggggcttgcctgaagcac

SEQ ID NO: 582266 - DNA, 25 bp, Rattus norvegicus
gaagcacgtggcctctggtgactaa

SEQ ID NO: 582267 - DNA, 25 bp, Rattus norvegicus
acgtggcctctggtgactaagagca

SEQ ID NO: 582268 - DNA, 25 bp, Rattus norvegicus
tctggtgactaagagcaggcacgcg

SEQ ID NO: 582269 - DNA, 25 bp, Rattus norvegicus
tgagaagccggagaagaacctggca

SEQ ID NO: 582270 - DNA, 25 bp, Rattus norvegicus
acctggcaggcagggcatgtgtatc

SEQ ID NO: 582271 - DNA, 25 bp, Rattus norvegicus
ttgtgtgtatatgctcggtcgaggc

SEQ ID NO: 582272 - DNA, 25 bp, Rattus norvegicus
tatgctcggtcgaggcaacccagtc

SEQ ID NO: 582273 - DNA, 25 bp, Rattus norvegicus
gaccacgtctacttccaggcgcgga

SEQ ID NO: 582274 - DNA, 25 bp, Rattus norvegicus
gacccgcagttctcgcccttagagt

SEQ ID NO: 582275 - DNA, 25 bp, Rattus norvegicus
cagaccctttgttctccaggttggg

SEQ ID NO: 582276 - DNA, 25 bp, Rattus norvegicus
agccttccgtctttcggcccagaga

SEQ ID NO: 582277 - DNA, 25 bp, Rattus norvegicus
ctccacaaggcgctagctgcgtgca

SEQ ID NO: 582278 - DNA, 25 bp, Rattus norvegicus
ccgagcccttctggatagagaaaca

SEQ ID NO: 582279 - DNA, 25 bp, Rattus norvegicus
cgctaggtaaggatcccgagccctt

SEQ ID NO: 582280 - DNA, 25 bp, Rattus norvegicus
agcatcaggcgggttccaccttaaa

SEQ ID NO: 582281 - DNA, 25 bp, Rattus norvegicus
ccacagccacgagcgtcatggagca

SEQ ID NO: 582282 - DNA, 25 bp, Rattus norvegicus
tagcgtcagcgagggacaaattccg

SEQ ID NO: 582283 - DNA, 25 bp, Rattus norvegicus
caagggtccagaaaatagcgtcagc

SEQ ID NO: 582284 - DNA, 25 bp, Rattus norvegicus
tggggcatccacagaagaggtccta

SEQ ID NO: 582285 - DNA, 25 bp, Rattus norvegicus
gacattgtatgtcgcgcccaggagt

SEQ ID NO: 582286 - DNA, 25 bp, Rattus norvegicus
ccaggagtctgattgcaaacgaacg

SEQ ID NO: 582287 - DNA, 25 bp, Rattus norvegicus
ctggcccagggttactgagcatctc

SEQ ID NO: 582288 - DNA, 25 bp, Rattus norvegicus
cagcgaagcgcgtgctgctcaccga

SEQ ID NO: 582289 - DNA, 25 bp, Rattus norvegicus
tggcgcttgcagcacccttttgcca

SEQ ID NO: 582290 - DNA, 25 bp, Rattus norvegicus
ctcagcaagcgggaaaggcctgttc

SEQ ID NO: 582291 - DNA, 25 bp, Rattus norvegicus
ggcctgttctctcaggaagctgaaa

SEQ ID NO: 582292 - DNA, 25 bp, Rattus norvegicus
gcttgcaggaaacccgagctccctg

SEQ ID NO: 582293 - DNA, 25 bp, Rattus norvegicus
gcatctccgggaggattcggtttcc

SEQ ID NO: 582294 - DNA, 25 bp, Rattus norvegicus
aagagctttaggtagctggcccagg

SEQ ID NO: 582295 - DNA, 25 bp, Rattus norvegicus
agccggctccgcaggaagagcttta

SEQ ID NO: 582296 - DNA, 25 bp, Rattus norvegicus
gaaagcgtccctcggcctgcttatc

SEQ ID NO: 582297 - DNA, 25 bp, Rattus norvegicus
ggtcgtgatcgaccactttaaagta

SEQ ID NO: 582298 - DNA, 25 bp, Rattus norvegicus
gtcttccgcgcacacttagagctga

SEQ ID NO: 582299 - DNA, 25 bp, Rattus norvegicus
tccctgcgaccgactctgcgagaag

SEQ ID NO: 582300 - DNA, 25 bp, Rattus norvegicus
attcggtttcccaggcagcgaagcg

SEQ ID NO: 582301 - DNA, 25 bp, Rattus norvegicus
tgagtttccgcaactcctccagatc

SEQ ID NO: 582302 - DNA, 25 bp, Rattus norvegicus
atgatccatgcgcttgtgcacggtc

SEQ ID NO: 582303 - DNA, 25 bp, Rattus norvegicus
cctccagatcgcagtggtgcttttt

SEQ ID NO: 582304 - DNA, 25 bp, Rattus norvegicus
gcttggtcttgagcacacgctcggt

SEQ ID NO: 582305 - DNA, 25 bp, Rattus norvegicus
tttcactttcagatgatccatgcgc

SEQ ID NO: 582306 - DNA, 25 bp, Rattus norvegicus
ctgttgattgctttgagtttccgca

SEQ ID NO: 582307 - DNA, 25 bp, Rattus norvegicus
atgcgcttgtgcacggtcgtcctcg

SEQ ID NO: 582308 - DNA, 25 bp, Rattus norvegicus
tgagcacacgctcggttttgcagga

SEQ ID NO: 582309 - DNA, 25 bp, Rattus norvegicus
ttttgcaggaggtgtagagcgcttc

SEQ ID NO: 582310 - DNA, 25 bp, Rattus norvegicus
agagcgcttctacgtcttcccggga

SEQ ID NO: 582311 - DNA, 25 bp, Rattus norvegicus
cgcttctacgtcttcccgggagatg

SEQ ID NO: 582312 - DNA, 25 bp, Rattus norvegicus
cttcccgggagatgagcgtgcattt

SEQ ID NO: 582313 - DNA, 25 bp, Rattus norvegicus
catttggccgcgtggaaggcgatac

SEQ ID NO: 582314 - DNA, 25 bp, Rattus norvegicus
cgtggaaggcgatactgttgattgc

SEQ ID NO: 582315 - DNA, 25 bp, Rattus norvegicus
tcctccgaaagtatcgtcacgcgcg

SEQ ID NO: 582316 - DNA, 25 bp, Rattus norvegicus
cgctgacaatgagacgggaagacca

SEQ ID NO: 582317 - DNA, 25 bp, Rattus norvegicus
agccctcgctatttaagtccttcgc

SEQ ID NO: 582318 - DNA, 25 bp, Rattus norvegicus
ctttgtgccctagaagctccctgtc

SEQ ID NO: 582319 - DNA, 25 bp, Rattus norvegicus
ctgtcttgctactttctcccgggtc

SEQ ID NO: 582320 - DNA, 25 bp, Rattus norvegicus
aaccctgacttgctgcgttggcctg

SEQ ID NO: 582321 - DNA, 25 bp, Rattus norvegicus
tggcctgggcacatcttcaccgaag

SEQ ID NO: 582322 - DNA, 25 bp, Rattus norvegicus
cgaaggctttcgctggagagtttaa

SEQ ID NO: 582323 - DNA, 25 bp, Rattus norvegicus
gcgacacgcgcttcagattgtattt

SEQ ID NO: 582324 - DNA, 25 bp, Rattus norvegicus
cacggcagagtgtagttatagttaa

SEQ ID NO: 582325 - DNA, 25 bp, Rattus norvegicus
tggctgcatttcctcctagatttgg

SEQ ID NO: 582326 - DNA, 25 bp, Rattus norvegicus
ttccggaaggagatcgcaactcagc

SEQ ID NO: 582327 - DNA, 25 bp, Rattus norvegicus
ggaagaccacttctggcaaccaagg

SEQ ID NO: 582328 - DNA, 25 bp, Rattus norvegicus
ggcctggacctgttgactgtcattg

SEQ ID NO: 582329 - DNA, 25 bp, Rattus norvegicus
cggaggcctgcttgattatgtgtgc

SEQ ID NO: 582330 - DNA, 25 bp, Rattus norvegicus
gccagttctcgaggcacaggccttc

SEQ ID NO: 582331 - DNA, 25 bp, Rattus norvegicus
ttctcgaggcacaggccttcaggta

SEQ ID NO: 582332 - DNA, 25 bp, Rattus norvegicus
gaggcacaggccttcaggtaggttc

SEQ ID NO: 582333 - DNA, 25 bp, Rattus norvegicus
ggcacaggccttcaggtaggttccc

SEQ ID NO: 582334 - DNA, 25 bp, Rattus norvegicus
tgagccctccggtagactcactccg

SEQ ID NO: 582335 - DNA, 25 bp, Rattus norvegicus
ggtagactcactccggccgcgctgg

SEQ ID NO: 582336 - DNA, 25 bp, Rattus norvegicus
ctgggcagccggctccgatcgtccc

SEQ ID NO: 582337 - DNA, 25 bp, Rattus norvegicus
ggccgacgcgtacgccgggtgacgc

SEQ ID NO: 582338 - DNA, 25 bp, Rattus norvegicus
tgcggaggcctgcttgattatgtgt

SEQ ID NO: 582339 - DNA, 25 bp, Rattus norvegicus
gcctgcttgattatgtgtgccctcc

SEQ ID NO: 582340 - DNA, 25 bp, Rattus norvegicus
ttgattatgtgtgccctcctcgggc

SEQ ID NO: 582341 - DNA, 25 bp, Rattus norvegicus
tgcttgattatgtgtgccctcctcg

SEQ ID NO: 582342 - DNA, 25 bp, Rattus norvegicus
cgcctgtgcggaggcctgcttgatt

SEQ ID NO: 582343 - DNA, 25 bp, Rattus norvegicus
tgtcatgtgattcggcgctcactca

SEQ ID NO: 582344 - DNA, 25 bp, Rattus norvegicus
tgcctcggcctgtgggagaaagtgc

SEQ ID NO: 582345 - DNA, 25 bp, Rattus norvegicus
ctgtgggagaaagtgcgtgtggccc

SEQ ID NO: 582346 - DNA, 25 bp, Rattus norvegicus
ggctgtcatgtgattcggcgctcac

SEQ ID NO: 582347 - DNA, 25 bp, Rattus norvegicus
tgtgattcggcgctcactcaagtgt

SEQ ID NO: 582348 - DNA, 25 bp, Rattus norvegicus
tgattcggcgctcactcaagtgtca

SEQ ID NO: 582349 - DNA, 25 bp, Rattus norvegicus
tcggcgctcactcaagtgtcatttg

SEQ ID NO: 582350 - DNA, 25 bp, Rattus norvegicus
ggcgctcactcaagtgtcatttggt

SEQ ID NO: 582351 - DNA, 25 bp, Rattus norvegicus
gtgtcatttggtggccgcctgcgtc

SEQ ID NO: 582352 - DNA, 25 bp, Rattus norvegicus
ggccgggtccgcagagcctgcggcg

SEQ ID NO: 582353 - DNA, 25 bp, Rattus norvegicus
cggccgcgtcctgcgccagggtagg

SEQ ID NO: 582354 - DNA, 25 bp, Rattus norvegicus
gggagcgtgcgacccgcgctggagc

SEQ ID NO: 582355 - DNA, 25 bp, Rattus norvegicus
aagtgtcatttggtggccgcctgcg

SEQ ID NO: 582356 - DNA, 25 bp, Rattus norvegicus
ccgggctgtcatgtgattcggcgct

SEQ ID NO: 582357 - DNA, 25 bp, Rattus norvegicus
tgaacacacggagcgtgaacacacg

SEQ ID NO: 582358 - DNA, 25 bp, Rattus norvegicus
gtgaacacatgagcgtgaacacatg

SEQ ID NO: 582359 - DNA, 25 bp, Rattus norvegicus
cacactgagcgtgaacacatgagcg

SEQ ID NO: 582360 - DNA, 25 bp, Rattus norvegicus
gagcgtgaacacatgagcgtgaaca

SEQ ID NO: 582361 - DNA, 25 bp, Rattus norvegicus
gtgaacacacggagcgtgaacacac

SEQ ID NO: 582362 - DNA, 25 bp, Rattus norvegicus
tgagcgtgaacacactgagcgtgaa

SEQ ID NO: 582363 - DNA, 25 bp, Rattus norvegicus
acacggagcgtgaacacacggagcg

SEQ ID NO: 582364 - DNA, 25 bp, Rattus norvegicus
cgtgaacacactgagcgtgaacaca

SEQ ID NO: 582365 - DNA, 25 bp, Rattus norvegicus
tgaacacactgagcgtgaacacact

SEQ ID NO: 582366 - DNA, 25 bp, Rattus norvegicus
agcgtgaacacacggagcgtgaaca

SEQ ID NO: 582367 - DNA, 25 bp, Rattus norvegicus
gtgaacacatgagcgtgaacacacg

SEQ ID NO: 582368 - DNA, 25 bp, Rattus norvegicus
tgaacacactgagcgtgaacacatg

SEQ ID NO: 582369 - DNA, 25 bp, Rattus norvegicus
ctgagcgtgaacacactgagcgtga

SEQ ID NO: 582370 - DNA, 25 bp, Rattus norvegicus
agcgtgaacacatgagcgtgaacac

SEQ ID NO: 582371 - DNA, 25 bp, Rattus norvegicus
accaagtcgaacaactccaggtctc

SEQ ID NO: 582372 - DNA, 25 bp, Rattus norvegicus
gcttccggtgacatcacgtctccta

SEQ ID NO: 582373 - DNA, 25 bp, Rattus norvegicus
tagaagttcaactgcacctcctcca

SEQ ID NO: 582374 - DNA, 25 bp, Rattus norvegicus
cacagcggccgcatcgaggacgaca

SEQ ID NO: 582375 - DNA, 25 bp, Rattus norvegicus
catcgaggacgacaccagcccagga

SEQ ID NO: 582376 - DNA, 25 bp, Rattus norvegicus
caccagcccaggacgccggggaagt

SEQ ID NO: 582377 - DNA, 25 bp, Rattus norvegicus
tccgaagccgggaacccacatattg

SEQ ID NO: 582378 - DNA, 25 bp, Rattus norvegicus
cccacatattgctggactccgagag

SEQ ID NO: 582379 - DNA, 25 bp, Rattus norvegicus
gccggctccacggaagcaccaatag

SEQ ID NO: 582380 - DNA, 25 bp, Rattus norvegicus
cggaagcaccaatagacgcggagaa

SEQ ID NO: 582381 - DNA, 25 bp, Rattus norvegicus
gagcggagaccagtcgcagcccgct

SEQ ID NO: 582382 - DNA, 25 bp, Rattus norvegicus
cccggcctaagaacagctggagagc

SEQ ID NO: 582383 - DNA, 25 bp, Rattus norvegicus
tccgagagagcggtccgcagccacg

SEQ ID NO: 582384 - DNA, 25 bp, Rattus norvegicus
cccgaggaactcatagaagttcaac

SEQ ID NO: 582385 - DNA, 25 bp, Rattus norvegicus
cctggagcaatggaaggccctgcac

SEQ ID NO: 582386 - DNA, 25 bp, Rattus norvegicus
ttcgtggccgagaatagtcgcgacg

SEQ ID NO: 582387 - DNA, 25 bp, Rattus norvegicus
tgacgcgggagagaaacttgagtcc

SEQ ID NO: 582388 - DNA, 25 bp, Rattus norvegicus
ctcgactgggtgtttatggtggact

SEQ ID NO: 582389 - DNA, 25 bp, Rattus norvegicus
tcaacttctccttctgggccgagcg

SEQ ID NO: 582390 - DNA, 25 bp, Rattus norvegicus
gtcaaccgcgcgctcgaccaaggtg

SEQ ID NO: 582391 - DNA, 25 bp, Rattus norvegicus
tgcccaaagcccgactgaagcaatg

SEQ ID NO: 582392 - DNA, 25 bp, Rattus norvegicus
ggcccagtatcctgcgcgctggctg

SEQ ID NO: 582393 - DNA, 25 bp, Rattus norvegicus
gcggtctgaggcctgtctacacctc

SEQ ID NO: 582394 - DNA, 25 bp, Rattus norvegicus
tgaagcaatggatggccgtcagccg

SEQ ID NO: 582395 - DNA, 25 bp, Rattus norvegicus
gggacgcgacaagaaacaagtcagc

SEQ ID NO: 582396 - DNA, 25 bp, Rattus norvegicus
cttcctcaaagacccgaatgcgacg

SEQ ID NO: 582397 - DNA, 25 bp, Rattus norvegicus
gcgcgatcctaagccttcctcaaag

SEQ ID NO: 582398 - DNA, 25 bp, Rattus norvegicus
gtccaagtgcttggcccacagggcg

SEQ ID NO: 582399 - DNA, 25 bp, Rattus norvegicus
aaacggctgagctcacaatcccggc

SEQ ID NO: 582400 - DNA, 25 bp, Rattus norvegicus
gcccagtccgcaagaaaggtccacg

SEQ ID NO: 582401 - DNA, 25 bp, Rattus norvegicus
aggtccacgccttcatcctcggaga

SEQ ID NO: 582402 - DNA, 25 bp, Rattus norvegicus
cctcggagatccttggtaaaggcga

SEQ ID NO: 582403 - DNA, 25 bp, Rattus norvegicus
gcataagggtttcctgggcaacgcc

SEQ ID NO: 582404 - DNA, 25 bp, Rattus norvegicus
ggattaatgaggacacgaagccgtg

SEQ ID NO: 582405 - DNA, 25 bp, Rattus norvegicus
caaggcctagagaatacggaagaga

SEQ ID NO: 582406 - DNA, 25 bp, Rattus norvegicus
ggaggccgccaacaaacggctgagc

SEQ ID NO: 582407 - DNA, 25 bp, Rattus norvegicus
gttctgggtagccaaggccttggaa

SEQ ID NO: 582408 - DNA, 25 bp, Rattus norvegicus
cctctcatgattgggcgaggcgagc

SEQ ID NO: 582409 - DNA, 25 bp, Rattus norvegicus
ccaggattctcgcacgtggctagag

SEQ ID NO: 582410 - DNA, 25 bp, Rattus norvegicus
gtggaaaatgggacacaagagcttc

SEQ ID NO: 582411 - DNA, 25 bp, Rattus norvegicus
tatggcggatgattccaggattctc

SEQ ID NO: 582412 - DNA, 25 bp, Rattus norvegicus
caacgccattgtcgcactccgggag

SEQ ID NO: 582413 - DNA, 25 bp, Rattus norvegicus
atgcgagaaggagaaccaaggaatc

SEQ ID NO: 582414 - DNA, 25 bp, Rattus norvegicus
aggagaaccaaggaatcgcaagctc

SEQ ID NO: 582415 - DNA, 25 bp, Rattus norvegicus
tccagggtcggcgagttaaaggatg

SEQ ID NO: 582416 - DNA, 25 bp, Rattus norvegicus
gaacctgtgccagcgggtttctgcg

SEQ ID NO: 582417 - DNA, 25 bp, Rattus norvegicus
aggctccatttccagcagcgccata

SEQ ID NO: 582418 - DNA, 25 bp, Rattus norvegicus
ctactccgggggtccaggctccatt

SEQ ID NO: 582419 - DNA, 25 bp, Rattus norvegicus
aggaatcgcaagctccttgaaagga

SEQ ID NO: 582420 - DNA, 25 bp, Rattus norvegicus
ttccagcagcgccatattctcgcag

SEQ ID NO: 582421 - DNA, 25 bp, Rattus norvegicus
ttaaaggatgcgagaaggagaacca

SEQ ID NO: 582422 - DNA, 25 bp, Rattus norvegicus
ctgggaacctgtgccagcgggtttc

SEQ ID NO: 582423 - DNA, 25 bp, Rattus norvegicus
cagcccttcatcgtggttggttttt

SEQ ID NO: 582424 - DNA, 25 bp, Rattus norvegicus
ttctcgcagcccttcatcgtggttg

SEQ ID NO: 582425 - DNA, 25 bp, Rattus norvegicus
catattctcgcagcccttcatcgtg

SEQ ID NO: 582426 - DNA, 25 bp, Rattus norvegicus
cgcaagctccttgaaaggaagatga

SEQ ID NO: 582427 - DNA, 25 bp, Rattus norvegicus
gaaggtgaccgctccctcaggacca

SEQ ID NO: 582428 - DNA, 25 bp, Rattus norvegicus
tcaaagccggagaaccctgaggcca

SEQ ID NO: 582429 - DNA, 25 bp, Rattus norvegicus
tcctccctctttcggggagccagcg

SEQ ID NO: 582430 - DNA, 25 bp, Rattus norvegicus
agcgggccgcgacactcaaagccgg

SEQ ID NO: 582431 - DNA, 25 bp, Rattus norvegicus
gccggagaaccctgaggccagagcc

SEQ ID NO: 582432 - DNA, 25 bp, Rattus norvegicus
cggccgcgatccacgttgtggacca

SEQ ID NO: 582433 - DNA, 25 bp, Rattus norvegicus
cgatccacgttgtggaccaggccgg

SEQ ID NO: 582434 - DNA, 25 bp, Rattus norvegicus
aggggagaaggtgaccgctccctca

SEQ ID NO: 582435 - DNA, 25 bp, Rattus norvegicus
cggtgggctccgtcctgactttgcg

SEQ ID NO: 582436 - DNA, 25 bp, Rattus norvegicus
tcaggaccacagcaagagccactca

SEQ ID NO: 582437 - DNA, 25 bp, Rattus norvegicus
ggaccacagcaagagccactcacga

SEQ ID NO: 582438 - DNA, 25 bp, Rattus norvegicus
cacgatcaccgcatcgcccggggca

SEQ ID NO: 582439 - DNA, 25 bp, Rattus norvegicus
cagttcggtgggctccgtcctgact

SEQ ID NO: 582440 - DNA, 25 bp, Rattus norvegicus
gaaggactcatgctggaggggagaa

SEQ ID NO: 582441 - DNA, 25 bp, Rattus norvegicus
ggatcccggttccttgactccagcg

SEQ ID NO: 582442 - DNA, 25 bp, Rattus norvegicus
tcacggcgcgctcacaatggagctc

SEQ ID NO: 582443 - DNA, 25 bp, Rattus norvegicus
ggcggctttccagagcctgctggac

SEQ ID NO: 582444 - DNA, 25 bp, Rattus norvegicus
gcatccagacgctggcggatcccgg

SEQ ID NO: 582445 - DNA, 25 bp, Rattus norvegicus
tatgtacagagaggcatccagacgc

SEQ ID NO: 582446 - DNA, 25 bp, Rattus norvegicus
atggagctctccgagtatgtacaga

SEQ ID NO: 582447 - DNA, 25 bp, Rattus norvegicus
tcccgagtcacgtggtgcgcatgtc

SEQ ID NO: 582448 - DNA, 25 bp, Rattus norvegicus
cagagaccgaaggaaaggccgcagc

SEQ ID NO: 582449 - DNA, 25 bp, Rattus norvegicus
ccgaggccagctactcagagaccga

SEQ ID NO: 582450 - DNA, 25 bp, Rattus norvegicus
cggtccaatgggcatctgcggccgc

SEQ ID NO: 582451 - DNA, 25 bp, Rattus norvegicus
caggtgagcgccaagccggtccaat

SEQ ID NO: 582452 - DNA, 25 bp, Rattus norvegicus
gaagcccagcttttagccacactcg

SEQ ID NO: 582453 - DNA, 25 bp, Rattus norvegicus
ttaatacacgcactgagtctcccgc

SEQ ID NO: 582454 - DNA, 25 bp, Rattus norvegicus
ttgggcatagctccggcccgggcaa

SEQ ID NO: 582455 - DNA, 25 bp, Rattus norvegicus
tctcccacgtggcttgtccttaaca

SEQ ID NO: 582456 - DNA, 25 bp, Rattus norvegicus
gtgtaggacgtcacaactggctctc

SEQ ID NO: 582457 - DNA, 25 bp, Rattus norvegicus
acggatttcggcgtgtctgtagcac

SEQ ID NO: 582458 - DNA, 25 bp, Rattus norvegicus
agccggctgcagaaaccgccatttg

SEQ ID NO: 582459 - DNA, 25 bp, Rattus norvegicus
caagcgcttctctgatcccggggaa

SEQ ID NO: 582460 - DNA, 25 bp, Rattus norvegicus
acacttgtcctctacgtgggtcgta

SEQ ID NO: 582461 - DNA, 25 bp, Rattus norvegicus
ctgcgaaggatcgtccaaggagaca

SEQ ID NO: 582462 - DNA, 25 bp, Rattus norvegicus
ctgccgagggtcttatttctctgtt

SEQ ID NO: 582463 - DNA, 25 bp, Rattus norvegicus
cttgctcgctttgagcgcgtccatc

SEQ ID NO: 582464 - DNA, 25 bp, Rattus norvegicus
tctctgttgctgaggagcgtgtcta

SEQ ID NO: 582465 - DNA, 25 bp, Rattus norvegicus
agccatcctttctcactgccgaggg

SEQ ID NO: 582466 - DNA, 25 bp, Rattus norvegicus
cccgtgtgacagagaatggagccca

SEQ ID NO: 582467 - DNA, 25 bp, Rattus norvegicus
gcacgccgtcgttgcaaagccattg

SEQ ID NO: 582468 - DNA, 25 bp, Rattus norvegicus
ggcatctcgtgctctctgcgaagga

SEQ ID NO: 582469 - DNA, 25 bp, Rattus norvegicus
cgacacttggtgatccgtctgcacc

SEQ ID NO: 582470 - DNA, 25 bp, Rattus norvegicus
aacccaagcggaaggagaggcctcg

SEQ ID NO: 582471 - DNA, 25 bp, Rattus norvegicus
ggtctagaccgcaccgcctggtctt

SEQ ID NO: 582472 - DNA, 25 bp, Rattus norvegicus
tccgtgtcagagaccagcccggcag

SEQ ID NO: 582473 - DNA, 25 bp, Rattus norvegicus
cgtttcttggttgcacccaggctgc

SEQ ID NO: 582474 - DNA, 25 bp, Rattus norvegicus
gaggcctggccgcagaacccaagcg

SEQ ID NO: 582475 - DNA, 25 bp, Rattus norvegicus
agaggcctcgcttcggtcagcccag

SEQ ID NO: 582476 - DNA, 25 bp, Rattus norvegicus
ctccttggtagttcttcccactctg

SEQ ID NO: 582477 - DNA, 25 bp, Rattus norvegicus
cgctgctcttttctgggcctgaggt

SEQ ID NO: 582478 - DNA, 25 bp, Rattus norvegicus
ggcctgaggttctgaggatgctcct

SEQ ID NO: 582479 - DNA, 25 bp, Rattus norvegicus
gaaactttgggcgagtgagaacgta

SEQ ID NO: 582480 - DNA, 25 bp, Rattus norvegicus
gagcgcgcccacgacacttggtgat

SEQ ID NO: 582481 - DNA, 25 bp, Rattus norvegicus
agctgcacctgagcggtgcgtgctc

SEQ ID NO: 582482 - DNA, 25 bp, Rattus norvegicus
ttaggggtgattcctgccgagaccc

SEQ ID NO: 582483 - DNA, 25 bp, Rattus norvegicus
gacgtcacgacagggacctactgtt

SEQ ID NO: 582484 - DNA, 25 bp, Rattus norvegicus
tccagctaccactgtgacgtcacga

SEQ ID NO: 582485 - DNA, 25 bp, Rattus norvegicus
tcgcctctgtccacagtgttcgagc

SEQ ID NO: 582486 - DNA, 25 bp, Rattus norvegicus
ggcgggctactccatttcgcctctg

SEQ ID NO: 582487 - DNA, 25 bp, Rattus norvegicus
ggtacacagagcagtcccaagggac

SEQ ID NO: 582488 - DNA, 25 bp, Rattus norvegicus
ggacggcttcgttccagttctggtc

SEQ ID NO: 582489 - DNA, 25 bp, Rattus norvegicus
cccggacccggttcgtgcagatggt

SEQ ID NO: 582490 - DNA, 25 bp, Rattus norvegicus
gacaaccgacgaatgcgtgccacga

SEQ ID NO: 582491 - DNA, 25 bp, Rattus norvegicus
actggagtctcaggtcctccctcgg

SEQ ID NO: 582492 - DNA, 25 bp, Rattus norvegicus
gtgccacgagcaacactggagtctc

SEQ ID NO: 582493 - DNA, 25 bp, Rattus norvegicus
agcagtcgggaaaccctgcctcaca

SEQ ID NO: 582494 - DNA, 25 bp, Rattus norvegicus
ccgccagcaaggaagtgacaaccga

SEQ ID NO: 582495 - DNA, 25 bp, Rattus norvegicus
ggcacagaccaagtcctcccaggag

SEQ ID NO: 582496 - DNA, 25 bp, Rattus norvegicus
gcctcacaggatgggtcggcacaga

SEQ ID NO: 582497 - DNA, 25 bp, Rattus norvegicus
gacactggaagtgggcgcagtcacc

SEQ ID NO: 582498 - DNA, 25 bp, Rattus norvegicus
tgggtttggattgtgcgtcaccttc

SEQ ID NO: 582499 - DNA, 25 bp, Rattus norvegicus
ccggggctgcaagacggaaaaagct

SEQ ID NO: 582500 - DNA, 25 bp, Rattus norvegicus
ttgtgcctgttcacggactcagcgg

SEQ ID NO: 582501 - DNA, 25 bp, Rattus norvegicus
gccgactttcgttttgtgcctgttc

SEQ ID NO: 582502 - DNA, 25 bp, Rattus norvegicus
agccctcggccgttgtccgctttag

SEQ ID NO: 582503 - DNA, 25 bp, Rattus norvegicus
gcttataagtgcagggctggccgca

SEQ ID NO: 582504 - DNA, 25 bp, Rattus norvegicus
ggcaggaggctgaccaataagcacc

SEQ ID NO: 582505 - DNA, 25 bp, Rattus norvegicus
tcggacgcaatccaggcccagggct

SEQ ID NO: 582506 - DNA, 25 bp, Rattus norvegicus
gctggagtcatcacacggggacacc

SEQ ID NO: 582507 - DNA, 25 bp, Rattus norvegicus
gagtgcaaatgtctgatcccgaggc

SEQ ID NO: 582508 - DNA, 25 bp, Rattus norvegicus
gcgtcaccttctcctttagattcga

SEQ ID NO: 582509 - DNA, 25 bp, Rattus norvegicus
atcccgaggctcacagaaggcagga

SEQ ID NO: 582510 - DNA, 25 bp, Rattus norvegicus
ggctggccgcactacaccggcgttt

SEQ ID NO: 582511 - DNA, 25 bp, Rattus norvegicus
ctgacttttctgctccggtaattaa

SEQ ID NO: 582512 - DNA, 25 bp, Rattus norvegicus
cacccatccgggttcaggaactgca

SEQ ID NO: 582513 - DNA, 25 bp, Rattus norvegicus
ctgcagaaatccgagaattgcgttt

SEQ ID NO: 582514 - DNA, 25 bp, Rattus norvegicus
ctccctactgggttctcagcggtgg

SEQ ID NO: 582515 - DNA, 25 bp, Rattus norvegicus
cgggcttgtaggtccacctctcagc

SEQ ID NO: 582516 - DNA, 25 bp, Rattus norvegicus
gcccagactgaacttgatcactgtg

SEQ ID NO: 582517 - DNA, 25 bp, Rattus norvegicus
agacgcaacgacagtccctcacttg

SEQ ID NO: 582518 - DNA, 25 bp, Rattus norvegicus
gagaatcgatctgcaccagccagcg

SEQ ID NO: 582519 - DNA, 25 bp, Rattus norvegicus
tgcaaattgctgaagctccctactg

SEQ ID NO: 582520 - DNA, 25 bp, Rattus norvegicus
ctgggtatagccatctcggttcgca

SEQ ID NO: 582521 - DNA, 25 bp, Rattus norvegicus
ctcccggactgcagcgaagcaaagg

SEQ ID NO: 582522 - DNA, 25 bp, Rattus norvegicus
gcggtgactgcgaacagctccatcc

SEQ ID NO: 582523 - DNA, 25 bp, Rattus norvegicus
ctcccacaaaccgtaggcaggcgtg

SEQ ID NO: 582524 - DNA, 25 bp, Rattus norvegicus
ccgcgtttattacggagaatcgatc

SEQ ID NO: 582525 - DNA, 25 bp, Rattus norvegicus
atcagcgggcggctatttcagcccc

SEQ ID NO: 582526 - DNA, 25 bp, Rattus norvegicus
agcctcgcgcctcctagcatcccag

SEQ ID NO: 582527 - DNA, 25 bp, Rattus norvegicus
gcctcgcgcctcctagcatcccagg

SEQ ID NO: 582528 - DNA, 25 bp, Rattus norvegicus
tcgcgcctcctagcatcccaggcgg

SEQ ID NO: 582529 - DNA, 25 bp, Rattus norvegicus
gctgtcagatcagcgggcggctatt

SEQ ID NO: 582530 - DNA, 25 bp, Rattus norvegicus
ctgtcagatcagcgggcggctattt

SEQ ID NO: 582531 - DNA, 25 bp, Rattus norvegicus
gtcagatcagcgggcggctatttca

SEQ ID NO: 582532 - DNA, 25 bp, Rattus norvegicus
cagcctcgcgcctcctagcatccca

SEQ ID NO: 582533 - DNA, 25 bp, Rattus norvegicus
tcagatcagcgggcggctatttcag

SEQ ID NO: 582534 - DNA, 25 bp, Rattus norvegicus
gatcagcgggcggctatttcagccc

SEQ ID NO: 582535 - DNA, 25 bp, Rattus norvegicus
atttcagccccccacaccgcagtcc

SEQ ID NO: 582536 - DNA, 25 bp, Rattus norvegicus
caccgcagtccgcagagtccgcagc

SEQ ID NO: 582537 - DNA, 25 bp, Rattus norvegicus
cgggcggctatttcagccccccaca

SEQ ID NO: 582538 - DNA, 25 bp, Rattus norvegicus
agatcagcgggcggctatttcagcc

SEQ ID NO: 582539 - DNA, 25 bp, Rattus norvegicus
gaatgtaattaactctagaccacct

SEQ ID NO: 582540 - DNA, 25 bp, Rattus norvegicus
gcatcccaggcggtgcgctagctaa

SEQ ID NO: 582541 - DNA, 25 bp, Rattus norvegicus
catcccaggcggtgcgctagctaac

SEQ ID NO: 582542 - DNA, 25 bp, Rattus norvegicus
atcccaggcggtgcgctagctaacc

SEQ ID NO: 582543 - DNA, 25 bp, Rattus norvegicus
caggcggtgcgctagctaacctccc

SEQ ID NO: 582544 - DNA, 25 bp, Rattus norvegicus
ccacctcgaactcgcgcctgccggg

SEQ ID NO: 582545 - DNA, 25 bp, Rattus norvegicus
ctagaccacctcgaactcgcgcctg

SEQ ID NO: 582546 - DNA, 25 bp, Rattus norvegicus
ttaaacaaccttccaaatgaatgta

SEQ ID NO: 582547 - DNA, 25 bp, Rattus norvegicus
tgaatgtaattaactctagaccacc

SEQ ID NO: 582548 - DNA, 25 bp, Rattus norvegicus
tccaaatgaatgtaattaactctag

SEQ ID NO: 582549 - DNA, 25 bp, Rattus norvegicus
ccttccaaatgaatgtaattaactc

SEQ ID NO: 582550 - DNA, 25 bp, Rattus norvegicus
acaaccttccaaatgaatgtaatta

SEQ ID NO: 582551 - DNA, 25 bp, Rattus norvegicus
tgtcaccaccaaggccgcccttccg

SEQ ID NO: 582552 - DNA, 25 bp, Rattus norvegicus
gctagctaacctccccagcctttta

SEQ ID NO: 582553 - DNA, 25 bp, Rattus norvegicus
cgcagaggagccttaccgagtggtt

SEQ ID NO: 582554 - DNA, 25 bp, Rattus norvegicus
gtgactcgcgcgagcatgcctttca

SEQ ID NO: 582555 - DNA, 25 bp, Rattus norvegicus
ttaagctgttctctgcgctccgcca

SEQ ID NO: 582556 - DNA, 25 bp, Rattus norvegicus
atgccggaccgttaagctgttctct

SEQ ID NO: 582557 - DNA, 25 bp, Rattus norvegicus
ttcgtcttggtcttgctcgccagga

SEQ ID NO: 582558 - DNA, 25 bp, Rattus norvegicus
gtgcttcttcttcgtcttggtcttg

SEQ ID NO: 582559 - DNA, 25 bp, Rattus norvegicus
cggaacagcttcactttctgagcca

SEQ ID NO: 582560 - DNA, 25 bp, Rattus norvegicus
cccggaggctaagcccgaggagcaa

SEQ ID NO: 582561 - DNA, 25 bp, Rattus norvegicus
cggccgagccaaacggctagagatc

SEQ ID NO: 582562 - DNA, 25 bp, Rattus norvegicus
acccaagaggcagacgcatgtcgtg

SEQ ID NO: 582563 - DNA, 25 bp, Rattus norvegicus
caagcgctgccggagaaacccaaga

SEQ ID NO: 582564 - DNA, 25 bp, Rattus norvegicus
ctccctgggttccaaaggaagcgca

SEQ ID NO: 582565 - DNA, 25 bp, Rattus norvegicus
gctcagaagcacagcacagcaaatg

SEQ ID NO: 582566 - DNA, 25 bp, Rattus norvegicus
tttctgagccacgaagtgcttcttc

SEQ ID NO: 582567 - DNA, 25 bp, Rattus norvegicus
tctgcaaaggcttctgtggctctga

SEQ ID NO: 582568 - DNA, 25 bp, Rattus norvegicus
ctataataagagatggccgggcctc

SEQ ID NO: 582569 - DNA, 25 bp, Rattus norvegicus
caccgcgcgaacaaaggcggattga

SEQ ID NO: 582570 - DNA, 25 bp, Rattus norvegicus
cacgagggcttcgtgtctgcaaagg

SEQ ID NO: 582571 - DNA, 25 bp, Rattus norvegicus
ggtccaaccacctgtgcagtatagc

SEQ ID NO: 582572 - DNA, 25 bp, Rattus norvegicus
tctgtggctctgagtatctcgttcc

SEQ ID NO: 582573 - DNA, 25 bp, Rattus norvegicus
tgcagtatagcacgacccgctctgg

SEQ ID NO: 582574 - DNA, 25 bp, Rattus norvegicus
tatacgggtaatgcggtgtgacacc

SEQ ID NO: 582575 - DNA, 25 bp, Rattus norvegicus
aaggagatccgggtccaaccacctg

SEQ ID NO: 582576 - DNA, 25 bp, Rattus norvegicus
ccggcggccgcattatacgggtaat

SEQ ID NO: 582577 - DNA, 25 bp, Rattus norvegicus
ggtcacgacctaggaaaggagatcc

SEQ ID NO: 582578 - DNA, 25 bp, Rattus norvegicus
tgcatattcaggacgggtcacgacc

SEQ ID NO: 582579 - DNA, 25 bp, Rattus norvegicus
gagtatctcgttccctgcatattca

SEQ ID NO: 582580 - DNA, 25 bp, Rattus norvegicus
cccgctctggggacctataataaga

SEQ ID NO: 582581 - DNA, 25 bp, Rattus norvegicus
cgcgacttgtcccagcgtgactcgg

SEQ ID NO: 582582 - DNA, 25 bp, Rattus norvegicus
cgacttgtcccagcgtgactcgggc

SEQ ID NO: 582583 - DNA, 25 bp, Rattus norvegicus
cctggacaggttgccgcgacttgtc

SEQ ID NO: 582584 - DNA, 25 bp, Rattus norvegicus
ggctcctggacaggttgccgcgact

SEQ ID NO: 582585 - DNA, 25 bp, Rattus norvegicus
ttggcgacccgcagctccatgggga

SEQ ID NO: 582586 - DNA, 25 bp, Rattus norvegicus
gtccgcggctcctggacaggttgcc

SEQ ID NO: 582587 - DNA, 25 bp, Rattus norvegicus
agctccatggggacctgggctgaag

SEQ ID NO: 582588 - DNA, 25 bp, Rattus norvegicus
tggagttggcgacccgcagctccat

SEQ ID NO: 582589 - DNA, 25 bp, Rattus norvegicus
ctgccattggagttggcgacccgca

SEQ ID NO: 582590 - DNA, 25 bp, Rattus norvegicus
cagctgccattggagttggcgaccc

SEQ ID NO: 582591 - DNA, 25 bp, Rattus norvegicus
gcaccgttctcgcagctgccattgg

SEQ ID NO: 582592 - DNA, 25 bp, Rattus norvegicus
cccacagccgcacgcaccgttctcg

SEQ ID NO: 582593 - DNA, 25 bp, Rattus norvegicus
acctgggctgaaggcgcccgaggtc

SEQ ID NO: 582594 - DNA, 25 bp, Rattus norvegicus
tgactcgggcacgagaaaccgctgg

SEQ ID NO: 582595 - DNA, 25 bp, Rattus norvegicus
tgccgggagaactggtgacaacaaa

SEQ ID NO: 582596 - DNA, 25 bp, Rattus norvegicus
ttatctgccgcgacgcttctcgaga

SEQ ID NO: 582597 - DNA, 25 bp, Rattus norvegicus
atgctgcgagcatcgttatctgccg

SEQ ID NO: 582598 - DNA, 25 bp, Rattus norvegicus
ctccgtaatgcagccgtgagatgct

SEQ ID NO: 582599 - DNA, 25 bp, Rattus norvegicus
aggctcacactcaggctccgtaatg

SEQ ID NO: 582600 - DNA, 25 bp, Rattus norvegicus
ctctgagggacggtgtccgctgccc

SEQ ID NO: 582601 - DNA, 25 bp, Rattus norvegicus
ctgccttcgcgagggaagcctcggt

SEQ ID NO: 582602 - DNA, 25 bp, Rattus norvegicus
actgcaggcaggttttgcgtgaacc

SEQ ID NO: 582603 - DNA, 25 bp, Rattus norvegicus
actggtgacaacaaaaggcgtgggc

SEQ ID NO: 582604 - DNA, 25 bp, Rattus norvegicus
ctgacaactcgcagaccacaagttt

SEQ ID NO: 582605 - DNA, 25 bp, Rattus norvegicus
cttctcgagagagaactgacaactc

SEQ ID NO: 582606 - DNA, 25 bp, Rattus norvegicus
tttgcgtgaacctgggcctacgtag

SEQ ID NO: 582607 - DNA, 25 bp, Rattus norvegicus
tagcctgcgaagacctgggctgtcc

SEQ ID NO: 582608 - DNA, 25 bp, Rattus norvegicus
gcagaccacaagttttacacgcccg

SEQ ID NO: 582609 - DNA, 25 bp, Rattus norvegicus
gaaagacgcaaactcagcacctagg

SEQ ID NO: 582610 - DNA, 25 bp, Rattus norvegicus
tcaggaaccgcgtcttcatactgcc

SEQ ID NO: 582611 - DNA, 25 bp, Rattus norvegicus
cagcgtcaggaaccgcgtcttcata

SEQ ID NO: 582612 - DNA, 25 bp, Rattus norvegicus
gatttcccttcacccacagcgtcag

SEQ ID NO: 582613 - DNA, 25 bp, Rattus norvegicus
tttctgagcgatttcccttcaccca

SEQ ID NO: 582614 - DNA, 25 bp, Rattus norvegicus
taggttttctgagcgatttcccttc

SEQ ID NO: 582615 - DNA, 25 bp, Rattus norvegicus
gcagttattgtctttgtcgcgtagg

SEQ ID NO: 582616 - DNA, 25 bp, Rattus norvegicus
agccgcgcagttattgtctttgtcg

SEQ ID NO: 582617 - DNA, 25 bp, Rattus norvegicus
gcctaagccgcgcagttattgtctt

SEQ ID NO: 582618 - DNA, 25 bp, Rattus norvegicus
acctaaagcctaagccgcgcagtta

SEQ ID NO: 582619 - DNA, 25 bp, Rattus norvegicus
atgcgtgggtcggacctaaagccta

SEQ ID NO: 582620 - DNA, 25 bp, Rattus norvegicus
agcacctaggcttgatgcgtgggtc

SEQ ID NO: 582621 - DNA, 25 bp, Rattus norvegicus
gacgcaaactcagcacctaggcttg

SEQ ID NO: 582622 - DNA, 25 bp, Rattus norvegicus
gaggggcaaaaacgaacagagcgcc

SEQ ID NO: 582623 - DNA, 25 bp, Rattus norvegicus
tgaggccctgagagcctagtacccg

SEQ ID NO: 582624 - DNA, 25 bp, Rattus norvegicus
gtaggtcctcagtagtcgtcgcatc

SEQ ID NO: 582625 - DNA, 25 bp, Rattus norvegicus
aactgtcgagccgagcaccgcggtc

SEQ ID NO: 582626 - DNA, 25 bp, Rattus norvegicus
gctgccgcaactgtcgagccgagca

SEQ ID NO: 582627 - DNA, 25 bp, Rattus norvegicus
ctttgctgccgcaactgtcgagccg

SEQ ID NO: 582628 - DNA, 25 bp, Rattus norvegicus
ggccctgagagcctagtacccgcgg

SEQ ID NO: 582629 - DNA, 25 bp, Rattus norvegicus
ggacacaggtaggtcctcagtagtc

SEQ ID NO: 582630 - DNA, 25 bp, Rattus norvegicus
tcgtggcttttgatttcacagccct

SEQ ID NO: 582631 - DNA, 25 bp, Rattus norvegicus
cgcatcgtggcttttgatttcacag

SEQ ID NO: 582632 - DNA, 25 bp, Rattus norvegicus
tcgtcgcatcgtggcttttgatttc

SEQ ID NO: 582633 - DNA, 25 bp, Rattus norvegicus
tcctcagtagtcgtcgcatcgtggc

SEQ ID NO: 582634 - DNA, 25 bp, Rattus norvegicus
cacaggtaggtcctcagtagtcgtc

SEQ ID NO: 582635 - DNA, 25 bp, Rattus norvegicus
ctgacccggtgaggccctgagagcc

SEQ ID NO: 582636 - DNA, 25 bp, Rattus norvegicus
gtagtcgtcgcatcgtggcttttga

SEQ ID NO: 582637 - DNA, 25 bp, Rattus norvegicus
ttttgaaactgcctttcaggcggcc

SEQ ID NO: 582638 - DNA, 25 bp, Rattus norvegicus
agcttgcaggtgtcgccttttgaaa

SEQ ID NO: 582639 - DNA, 25 bp, Rattus norvegicus
ttcaattcacaaccggccgagcttg

SEQ ID NO: 582640 - DNA, 25 bp, Rattus norvegicus
gtgcgggcgctgcattcaattcaca

SEQ ID NO: 582641 - DNA, 25 bp, Rattus norvegicus
aatagctcccggctcaggtacgtgc

SEQ ID NO: 582642 - DNA, 25 bp, Rattus norvegicus
tgacactaatagctcccggctcagg

SEQ ID NO: 582643 - DNA, 25 bp, Rattus norvegicus
cgaccgggagcctgacactaatagc

SEQ ID NO: 582644 - DNA, 25 bp, Rattus norvegicus
ctgtattcagcacgggctgctcgga

SEQ ID NO: 582645 - DNA, 25 bp, Rattus norvegicus
tcccgaccacgagcggcacaagtgg

SEQ ID NO: 582646 - DNA, 25 bp, Rattus norvegicus
gcacaagtggcgacattcccatgga

SEQ ID NO: 582647 - DNA, 25 bp, Rattus norvegicus
cgtgcggcagcttgctgtattcagc

SEQ ID NO: 582648 - DNA, 25 bp, Rattus norvegicus
ctgctcggacgtgtgctgctggccc

SEQ ID NO: 582649 - DNA, 25 bp, Rattus norvegicus
cgacattcccatggaggggccgtgc

SEQ ID NO: 582650 - DNA, 25 bp, Rattus norvegicus
ggccgctgttcacttctggctgcgc

SEQ ID NO: 582651 - DNA, 25 bp, Rattus norvegicus
tttgtacacacggtgacctccgggc

SEQ ID NO: 582652 - DNA, 25 bp, Rattus norvegicus
aaggagctctttatggtacattacc

SEQ ID NO: 582653 - DNA, 25 bp, Rattus norvegicus
cgattcccacggactggcgtgctct

SEQ ID NO: 582654 - DNA, 25 bp, Rattus norvegicus
tttgggtccaacacgcctaggagcg

SEQ ID NO: 582655 - DNA, 25 bp, Rattus norvegicus
gccgcccgatctttgactatgtttg

SEQ ID NO: 582656 - DNA, 25 bp, Rattus norvegicus
taccagcgccttgtgtcggcgagcc

SEQ ID NO: 582657 - DNA, 25 bp, Rattus norvegicus
gctctgactctgaaagggcctgaaa

SEQ ID NO: 582658 - DNA, 25 bp, Rattus norvegicus
tgcaggacatagaggggtttgtaca

SEQ ID NO: 582659 - DNA, 25 bp, Rattus norvegicus
cagtcaagggctcaggtaccagcgc

SEQ ID NO: 582660 - DNA, 25 bp, Rattus norvegicus
cccagcacatgtgttacgattccca

SEQ ID NO: 582661 - DNA, 25 bp, Rattus norvegicus
acagtactctgtgaaccgacggcgg

SEQ ID NO: 582662 - DNA, 25 bp, Rattus norvegicus
ttcgttccactcacagtactctgtg

SEQ ID NO: 582663 - DNA, 25 bp, Rattus norvegicus
cctgatttccgcgagcgtctgaaca

SEQ ID NO: 582664 - DNA, 25 bp, Rattus norvegicus
gcaggtgtctgctgtacagtacgcc

SEQ ID NO: 582665 - DNA, 25 bp, Rattus norvegicus
ggagcagcccatcagtcccttgagg

SEQ ID NO: 582666 - DNA, 25 bp, Rattus norvegicus
gggacctacccgaactgccacagat

SEQ ID NO: 582667 - DNA, 25 bp, Rattus norvegicus
ggcgccgcatgcagtctatcaacga

SEQ ID NO: 582668 - DNA, 25 bp, Rattus norvegicus
tacgcggctccgtggtttgaacgga

SEQ ID NO: 582669 - DNA, 25 bp, Rattus norvegicus
acgaatactgctaccgcgacggggc

SEQ ID NO: 582670 - DNA, 25 bp, Rattus norvegicus
ggtagagttcctcagtcaccagctg

SEQ ID NO: 582671 - DNA, 25 bp, Rattus norvegicus
cttcccgtcctcttacttcgatgag

SEQ ID NO: 582672 - DNA, 25 bp, Rattus norvegicus
tgccacagatcacgcacaaagcgtc

SEQ ID NO: 582673 - DNA, 25 bp, Rattus norvegicus
acgaaaagcgcctctccaaggtaga

SEQ ID NO: 582674 - DNA, 25 bp, Rattus norvegicus
tatcaacgacgccttcgaggggctg

SEQ ID NO: 582675 - DNA, 25 bp, Rattus norvegicus
aggacagtgtctgtgccgctgcctt

SEQ ID NO: 582676 - DNA, 25 bp, Rattus norvegicus
cacgcgcctgtggatgtagttataa

SEQ ID NO: 582677 - DNA, 25 bp, Rattus norvegicus
ttataagaatcctcgcgtgccggcc

SEQ ID NO: 582678 - DNA, 25 bp, Rattus norvegicus
ggaagatttcttcaccgatcagtcc

SEQ ID NO: 582679 - DNA, 25 bp, Rattus norvegicus
ctgcctgttcccagggttccggaga

SEQ ID NO: 582680 - DNA, 25 bp, Rattus norvegicus
cagggcaacttagccttcgggactt

SEQ ID NO: 582681 - DNA, 25 bp, Rattus norvegicus
tgccaaggcaaacctcgccaaactt

SEQ ID NO: 582682 - DNA, 25 bp, Rattus norvegicus
gaacggctcggctgtaatgaagcgc

SEQ ID NO: 582683 - DNA, 25 bp, Rattus norvegicus
ttcgggacttccctcgctgccaagg

SEQ ID NO: 582684 - DNA, 25 bp, Rattus norvegicus
cctatccagggcaacttagccttcg

SEQ ID NO: 582685 - DNA, 25 bp, Rattus norvegicus
tgccaaaccggttcataggccgccc

SEQ ID NO: 582686 - DNA, 25 bp, Rattus norvegicus
ttctgctgcttttcagccctcgggc

SEQ ID NO: 582687 - DNA, 25 bp, Rattus norvegicus
acactcctgtgccacacacaaaagg

SEQ ID NO: 582688 - DNA, 25 bp, Rattus norvegicus
gcaagtgacactcctgtgccacaca

SEQ ID NO: 582689 - DNA, 25 bp, Rattus norvegicus
cgtttgtgcgcaagtgacactcctg

SEQ ID NO: 582690 - DNA, 25 bp, Rattus norvegicus
cgcgctgctgcgtttgtgcgcaagt

SEQ ID NO: 582691 - DNA, 25 bp, Rattus norvegicus
ctcggctgtaatgaagcgcttcgga

SEQ ID NO: 582692 - DNA, 25 bp, Rattus norvegicus
tctgcggctgcctgttcccagggtt

SEQ ID NO: 582693 - DNA, 25 bp, Rattus norvegicus
gctattcgcggctcctgacgcggcg

SEQ ID NO: 582694 - DNA, 25 bp, Rattus norvegicus
tctacagcagcgtgtgcacccacta

SEQ ID NO: 582695 - DNA, 25 bp, Rattus norvegicus
agctcagcgctattctcgggctccg

SEQ ID NO: 582696 - DNA, 25 bp, Rattus norvegicus
tggaagagctgctccggcccgacga

SEQ ID NO: 582697 - DNA, 25 bp, Rattus norvegicus
cggctcgtccgcctggctgctggaa

SEQ ID NO: 582698 - DNA, 25 bp, Rattus norvegicus
tctacggcgcacatcgccgtgcggg

SEQ ID NO: 582699 - DNA, 25 bp, Rattus norvegicus
gccgccttcaaggtctccttgcagt

SEQ ID NO: 582700 - DNA, 25 bp, Rattus norvegicus
catgcagctctacagcagcgtgtgc

SEQ ID NO: 582701 - DNA, 25 bp, Rattus norvegicus
tccaagccgggctcgcagctataag

SEQ ID NO: 582702 - DNA, 25 bp, Rattus norvegicus
cactgcgcccgagggtgtgtctcca

SEQ ID NO: 582703 - DNA, 25 bp, Rattus norvegicus
ctgagcgggcagcttctccaaccgt

SEQ ID NO: 582704 - DNA, 25 bp, Rattus norvegicus
cgcagtacgaattgggtcgcggccc

SEQ ID NO: 582705 - DNA, 25 bp, Rattus norvegicus
ttccgactgagcgagcatcgccagg

SEQ ID NO: 582706 - DNA, 25 bp, Rattus norvegicus
gcgcccgacaggaacttccgactga

SEQ ID NO: 582707 - DNA, 25 bp, Rattus norvegicus
gcaagtcggacagaaacagcccagt

SEQ ID NO: 582708 - DNA, 25 bp, Rattus norvegicus
ttccttcgggtcgaccagaagcagc

SEQ ID NO: 582709 - DNA, 25 bp, Rattus norvegicus
gcatttcgcagtcgtagctggcctg

SEQ ID NO: 582710 - DNA, 25 bp, Rattus norvegicus
gacccattttctcttcttgcgcatt

SEQ ID NO: 582711 - DNA, 25 bp, Rattus norvegicus
tgaggctcaagcttgcaatcagatc

SEQ ID NO: 582712 - DNA, 25 bp, Rattus norvegicus
gccgctgaaggtagctgaggctcaa

SEQ ID NO: 582713 - DNA, 25 bp, Rattus norvegicus
ctgcagtcctggcatgcactaaaac

SEQ ID NO: 582714 - DNA, 25 bp, Rattus norvegicus
ctccaggtgaattgaaagtcgtctc

SEQ ID NO: 582715 - DNA, 25 bp, Rattus norvegicus
gggagactcgccaacctccaggtga

SEQ ID NO: 582716 - DNA, 25 bp, Rattus norvegicus
tacatccgtcgtcacgatgcgagcc

SEQ ID NO: 582717 - DNA, 25 bp, Rattus norvegicus
ctgtgcgctccttgctgaggatgct

SEQ ID NO: 582718 - DNA, 25 bp, Rattus norvegicus
ctcggcccgaagtaagtgcagcaga

SEQ ID NO: 582719 - DNA, 25 bp, Rattus norvegicus
ttgccggagcttggatttcggatcc

SEQ ID NO: 582720 - DNA, 25 bp, Rattus norvegicus
gatccagctgcggttcctaccaatt

SEQ ID NO: 582721 - DNA, 25 bp, Rattus norvegicus
ctaagcttggtgtgaggcttccctc

SEQ ID NO: 582722 - DNA, 25 bp, Rattus norvegicus
ggggctcccactgtccgacttgaag

SEQ ID NO: 582723 - DNA, 25 bp, Rattus norvegicus
gaacaccgggaactcgctctcactg

SEQ ID NO: 582724 - DNA, 25 bp, Rattus norvegicus
tttcctctgaactgccctgaagtca

SEQ ID NO: 582725 - DNA, 25 bp, Rattus norvegicus
gcgacctcctgtagctttcctctga

SEQ ID NO: 582726 - DNA, 25 bp, Rattus norvegicus
gctggcttcactgccttccgagttt

SEQ ID NO: 582727 - DNA, 25 bp, Rattus norvegicus
gaactgctgtctgcggctgtctaag

SEQ ID NO: 582728 - DNA, 25 bp, Rattus norvegicus
cagcctgtgggagctgaactgctgt

SEQ ID NO: 582729 - DNA, 25 bp, Rattus norvegicus
tgtcgcattcgatcagcctgtggga

SEQ ID NO: 582730 - DNA, 25 bp, Rattus norvegicus
cctggacagcgtgtcgcattcgatc

SEQ ID NO: 582731 - DNA, 25 bp, Rattus norvegicus
gtccgacttgaagcgagcagacttc

SEQ ID NO: 582732 - DNA, 25 bp, Rattus norvegicus
ttctttctccgtcctggtgtctccg

SEQ ID NO: 582733 - DNA, 25 bp, Rattus norvegicus
agcagacttcttcctggacagcgtg

SEQ ID NO: 582734 - DNA, 25 bp, Rattus norvegicus
ttccgagtttctgcggctcgacctg

SEQ ID NO: 582735 - DNA, 25 bp, Rattus norvegicus
tgactgaacgatggtggccgcgacc

SEQ ID NO: 582736 - DNA, 25 bp, Rattus norvegicus
tgggcctccagggacccagagccgt

SEQ ID NO: 582737 - DNA, 25 bp, Rattus norvegicus
tctctctggccttgactgaacgatg

SEQ ID NO: 582738 - DNA, 25 bp, Rattus norvegicus
gcacggcgatctgcagtacctgggc

SEQ ID NO: 582739 - DNA, 25 bp, Rattus norvegicus
ctgcaggtgtcccttgtccctgaga

SEQ ID NO: 582740 - DNA, 25 bp, Rattus norvegicus
cttgtccctgagactatccctgtct

SEQ ID NO: 582741 - DNA, 25 bp, Rattus norvegicus
ctatccctgtctccttttcgggagg

SEQ ID NO: 582742 - DNA, 25 bp, Rattus norvegicus
cggagcctcagcgttgtacccacga

SEQ ID NO: 582743 - DNA, 25 bp, Rattus norvegicus
gctcccggcacagccctggggaaag

SEQ ID NO: 582744 - DNA, 25 bp, Rattus norvegicus
gatgtctctaaggttcccttacctg

SEQ ID NO: 582745 - DNA, 25 bp, Rattus norvegicus
cccttacctggttcagcgacaggtc

SEQ ID NO: 582746 - DNA, 25 bp, Rattus norvegicus
gccgctgctgctgtcacacaaagag

SEQ ID NO: 582747 - DNA, 25 bp, Rattus norvegicus
gctgtcacacaaagagccggaaatg

SEQ ID NO: 582748 - DNA, 25 bp, Rattus norvegicus
ttgtacccacgactcctgggagacg

SEQ ID NO: 582749 - DNA, 25 bp, Rattus norvegicus
cggatctgaatggactggggcaccc

SEQ ID NO: 582750 - DNA, 25 bp, Rattus norvegicus
tctttcctgagatacactgcgctgc

SEQ ID NO: 582751 - DNA, 25 bp, Rattus norvegicus
aggtgcttcgacgtcgtacctgcag

SEQ ID NO: 582752 - DNA, 25 bp, Rattus norvegicus
gatacactgcgctgccggatctgaa

SEQ ID NO: 582753 - DNA, 25 bp, Rattus norvegicus
tcggtcatcctgctcggtgaagcca

SEQ ID NO: 582754 - DNA, 25 bp, Rattus norvegicus
tgaagccactccacttgtaagtctg

SEQ ID NO: 582755 - DNA, 25 bp, Rattus norvegicus
tgagtcgggcgtctgactttcagaa

SEQ ID NO: 582756 - DNA, 25 bp, Rattus norvegicus
ctttcagaattgacagtggcagtgg

SEQ ID NO: 582757 - DNA, 25 bp, Rattus norvegicus
tcgatgtaatcccacgagcgagttc

SEQ ID NO: 582758 - DNA, 25 bp, Rattus norvegicus
gcgagttctatggttgctgaagcta

SEQ ID NO: 582759 - DNA, 25 bp, Rattus norvegicus
ttgagatgcgctcctcgggcaatac

SEQ ID NO: 582760 - DNA, 25 bp, Rattus norvegicus
tcgggcaatacttcatcagcacgga

SEQ ID NO: 582761 - DNA, 25 bp, Rattus norvegicus
tcagcacggaatcttccagtctttc

SEQ ID NO: 582762 - DNA, 25 bp, Rattus norvegicus
acccggtcatgagaggtgcttcgac

SEQ ID NO: 582763 - DNA, 25 bp, Rattus norvegicus
cacccgacgccagtgtcgatagcag

SEQ ID NO: 582764 - DNA, 25 bp, Rattus norvegicus
cggctgtttgcatctcgtgcggccc

SEQ ID NO: 582765 - DNA, 25 bp, Rattus norvegicus
ctacgcgagccgtttggaccctgcg

SEQ ID NO: 582766 - DNA, 25 bp, Rattus norvegicus
actcctccagcaggtggttctggcc

SEQ ID NO: 582767 - DNA, 25 bp, Rattus norvegicus
cgctgcgaccctctggaaaggagtc

SEQ ID NO: 582768 - DNA, 25 bp, Rattus norvegicus
gaccctctggaaaggagtcccgcgc

SEQ ID NO: 582769 - DNA, 25 bp, Rattus norvegicus
cagtgtcgatagcaggcttggtcgc

SEQ ID NO: 582770 - DNA, 25 bp, Rattus norvegicus
gcttggtcgcctcttctcggcagaa

SEQ ID NO: 582771 - DNA, 25 bp, Rattus norvegicus
ctcttctcggcagaagctggggctc

SEQ ID NO: 582772 - DNA, 25 bp, Rattus norvegicus
ttcgcgaacaagttttggagcaccc

SEQ ID NO: 582773 - DNA, 25 bp, Rattus norvegicus
gagcacccggaaccgctcgtgcgtg

SEQ ID NO: 582774 - DNA, 25 bp, Rattus norvegicus
aatccgaggccgtccggctgtttgc

SEQ ID NO: 582775 - DNA, 25 bp, Rattus norvegicus
gtgagatttggcttcggttcccgaa

SEQ ID NO: 582776 - DNA, 25 bp, Rattus norvegicus
accgctcgtgcgtgagatttggctt

SEQ ID NO: 582777 - DNA, 25 bp, Rattus norvegicus
ggcgactacgtgtcgttcagatttt

SEQ ID NO: 582778 - DNA, 25 bp, Rattus norvegicus
ggagccaccggcttaagccttctgc

SEQ ID NO: 582779 - DNA, 25 bp, Rattus norvegicus
ccaatccggtgacgctgcgagagta

SEQ ID NO: 582780 - DNA, 25 bp, Rattus norvegicus
gggcttctagataagggagtgtccc

SEQ ID NO: 582781 - DNA, 25 bp, Rattus norvegicus
gctgcgagagtatgcgaaccaatca

SEQ ID NO: 582782 - DNA, 25 bp, Rattus norvegicus
aggagttttcggtctgcagtcaccc

SEQ ID NO: 582783 - DNA, 25 bp, Rattus norvegicus
ctgcaaatcgcccaatccggtgacg

SEQ ID NO: 582784 - DNA, 25 bp, Rattus norvegicus
gtggctcactttggctcagcctcca

SEQ ID NO: 582785 - DNA, 25 bp, Rattus norvegicus
cggaaccgagcgaccgtggctcact

SEQ ID NO: 582786 - DNA, 25 bp, Rattus norvegicus
tttttaacctgtagggcgactgagc

SEQ ID NO: 582787 - DNA, 25 bp, Rattus norvegicus
tgcaaggtagcttcctggggtaagc

SEQ ID NO: 582788 - DNA, 25 bp, Rattus norvegicus
agccttgcagctgtctgcggggaca

SEQ ID NO: 582789 - DNA, 25 bp, Rattus norvegicus
cccgaaccggggagccaagctagag

SEQ ID NO: 582790 - DNA, 25 bp, Rattus norvegicus
tgcgaaccaatcaggagccaccggc

SEQ ID NO: 582791 - DNA, 25 bp, Rattus norvegicus
atggcggtcatgtgcaccaaagagc

SEQ ID NO: 582792 - DNA, 25 bp, Rattus norvegicus
ggcatggcggtcatgtgcaccaaag

SEQ ID NO: 582793 - DNA, 25 bp, Rattus norvegicus
atgtgcaccaaagagctccccggag

SEQ ID NO: 582794 - DNA, 25 bp, Rattus norvegicus
gcatggcggtcatgtgcaccaaaga

SEQ ID NO: 582795 - DNA, 25 bp, Rattus norvegicus
cggtcatgtgcaccaaagagctccc

SEQ ID NO: 582796 - DNA, 25 bp, Rattus norvegicus
catgtgcaccaaagagctccccgga

SEQ ID NO: 582797 - DNA, 25 bp, Rattus norvegicus
caggcatggcggtcatgtgcaccaa

SEQ ID NO: 582798 - DNA, 25 bp, Rattus norvegicus
gcggtcatgtgcaccaaagagctcc

SEQ ID NO: 582799 - DNA, 25 bp, Rattus norvegicus
tccccggaggttccgaggcaggcat

SEQ ID NO: 582800 - DNA, 25 bp, Rattus norvegicus
gcaggcatggcggtcatgtgcacca

SEQ ID NO: 582801 - DNA, 25 bp, Rattus norvegicus
tggcggtcatgtgcaccaaagagct

SEQ ID NO: 582802 - DNA, 25 bp, Rattus norvegicus
tcatgtgcaccaaagagctccccgg

SEQ ID NO: 582803 - DNA, 25 bp, Rattus norvegicus
ctccccggaggttccgaggcaggca

SEQ ID NO: 582804 - DNA, 25 bp, Rattus norvegicus
ttccgaggcaggcatggcggtcatg

SEQ ID NO: 582805 - DNA, 25 bp, Rattus norvegicus
gggaatccggagttcgcatttacca

SEQ ID NO: 582806 - DNA, 25 bp, Rattus norvegicus
ggctacagtcgaggcccattcccgg

SEQ ID NO: 582807 - DNA, 25 bp, Rattus norvegicus
tccggagttcgcatttaccacgacg

SEQ ID NO: 582808 - DNA, 25 bp, Rattus norvegicus
ggagtctggcgccttctcactgctc

SEQ ID NO: 582809 - DNA, 25 bp, Rattus norvegicus
tcccggccatgtctctcgctgggaa

SEQ ID NO: 582810 - DNA, 25 bp, Rattus norvegicus
atgtctctcgctgggaacgccggac

SEQ ID NO: 582811 - DNA, 25 bp, Rattus norvegicus
agttcgcatttaccacgacgcctcg

SEQ ID NO: 582812 - DNA, 25 bp, Rattus norvegicus
aaagctggggctacagtcgaggccc

SEQ ID NO: 582813 - DNA, 25 bp, Rattus norvegicus
tggagcagcgcctgatgcacctgag

SEQ ID NO: 582814 - DNA, 25 bp, Rattus norvegicus
ctgatgcacctgagcgcgctccggg

SEQ ID NO: 582815 - DNA, 25 bp, Rattus norvegicus
tatgggtcaggcctgcgattcgttc

SEQ ID NO: 582816 - DNA, 25 bp, Rattus norvegicus
tcaggcctgcgattcgttctggaga

SEQ ID NO: 582817 - DNA, 25 bp, Rattus norvegicus
tgcgattcgttctggagagaaagcc

SEQ ID NO: 582818 - DNA, 25 bp, Rattus norvegicus
tctcgctgggaacgccggacggaca

SEQ ID NO: 582819 - DNA, 25 bp, Rattus norvegicus
cgcgcaggcgtcacacaatagtctc

SEQ ID NO: 582820 - DNA, 25 bp, Rattus norvegicus
aggcgtcacacaatagtctccaaca

SEQ ID NO: 582821 - DNA, 25 bp, Rattus norvegicus
aatagtctccaacacacaggccgcg

SEQ ID NO: 582822 - DNA, 25 bp, Rattus norvegicus
gtttgccggctgaggctaccaaggc

SEQ ID NO: 582823 - DNA, 25 bp, Rattus norvegicus
ctgaggctaccaaggcggtgtcgaa

SEQ ID NO: 582824 - DNA, 25 bp, Rattus norvegicus
taccaaggcggtgtcgaagtcgctt

SEQ ID NO: 582825 - DNA, 25 bp, Rattus norvegicus
gcggtgtcgaagtcgcttccctttc

SEQ ID NO: 582826 - DNA, 25 bp, Rattus norvegicus
gttttcttggtgagttaatggagga

SEQ ID NO: 582827 - DNA, 25 bp, Rattus norvegicus
gaaggccagcgagcgttgttgccct

SEQ ID NO: 582828 - DNA, 25 bp, Rattus norvegicus
gcgagcgttgttgccctagcatccc

SEQ ID NO: 582829 - DNA, 25 bp, Rattus norvegicus
ctagcatccctccttccgtcgcgcc

SEQ ID NO: 582830 - DNA, 25 bp, Rattus norvegicus
ttcgccatccacctgtcgcaccgga

SEQ ID NO: 582831 - DNA, 25 bp, Rattus norvegicus
ctgcgctccgctgtctccacggcgc

SEQ ID NO: 582832 - DNA, 25 bp, Rattus norvegicus
attcttctctgggtggttttcttgg

SEQ ID NO: 582833 - DNA, 25 bp, Rattus norvegicus
tgcgtaatcccgagccgacccattg

SEQ ID NO: 582834 - DNA, 25 bp, Rattus norvegicus
ctcaaggctgcgaggtgcgtaatcc

SEQ ID NO: 582835 - DNA, 25 bp, Rattus norvegicus
taacctgtttggctcaaggctgcga

SEQ ID NO: 582836 - DNA, 25 bp, Rattus norvegicus
ccggggatgtaacctgtttggctca

SEQ ID NO: 582837 - DNA, 25 bp, Rattus norvegicus
gctaactatagctgccggggatgta

SEQ ID NO: 582838 - DNA, 25 bp, Rattus norvegicus
gacgtaagccggctaactatagctg

SEQ ID NO: 582839 - DNA, 25 bp, Rattus norvegicus
tctgtgtgcgcgctttcatctcggg

SEQ ID NO: 582840 - DNA, 25 bp, Rattus norvegicus
cgcgctttcatctcggggcgaaagg

SEQ ID NO: 582841 - DNA, 25 bp, Rattus norvegicus
acgacctgccaagggtgagatgatg

SEQ ID NO: 582842 - DNA, 25 bp, Rattus norvegicus
gtgagatgatggagcagcgtcttca

SEQ ID NO: 582843 - DNA, 25 bp, Rattus norvegicus
atggagcagcgtcttcagtggccgc

SEQ ID NO: 582844 - DNA, 25 bp, Rattus norvegicus
accagctcttgaacacacctcaatg

SEQ ID NO: 582845 - DNA, 25 bp, Rattus norvegicus
cacctcaatgagagcggcggtggaa

SEQ ID NO: 582846 - DNA, 25 bp, Rattus norvegicus
ctgagcagaaagacgtaagccggct

SEQ ID NO: 582847 - DNA, 25 bp, Rattus norvegicus
ctccaatcaggggccacggggcctg

SEQ ID NO: 582848 - DNA, 25 bp, Rattus norvegicus
gcaccgccgcggctccaatcagggg

SEQ ID NO: 582849 - DNA, 25 bp, Rattus norvegicus
ttccacgggcttcggcgaaagtgga

SEQ ID NO: 582850 - DNA, 25 bp, Rattus norvegicus
gagaccgagtggttccacgggcttc

SEQ ID NO: 582851 - DNA, 25 bp, Rattus norvegicus
cgccactctggagaccgagtggttc

SEQ ID NO: 582852 - DNA, 25 bp, Rattus norvegicus
tcaccacctggctaacgccactctg

SEQ ID NO: 582853 - DNA, 25 bp, Rattus norvegicus
aggacctgtcctcctccgctcacca

SEQ ID NO: 582854 - DNA, 25 bp, Rattus norvegicus
gtcgcatcctgctgcaggacctgtc

SEQ ID NO: 582855 - DNA, 25 bp, Rattus norvegicus
aggagagtcgcatcctgctgcagga

SEQ ID NO: 582856 - DNA, 25 bp, Rattus norvegicus
cacccgtgaggagagtcgcatcctg

SEQ ID NO: 582857 - DNA, 25 bp, Rattus norvegicus
tccaggccacccgtgaggagagtcg

SEQ ID NO: 582858 - DNA, 25 bp, Rattus norvegicus
cccgcaagtcttcctccaggccacc

SEQ ID NO: 582859 - DNA, 25 bp, Rattus norvegicus
agcaccgagtcgctgtccacgcccg

SEQ ID NO: 582860 - DNA, 25 bp, Rattus norvegicus
atcaccttcagcaccgagtcgctgt

SEQ ID NO: 582861 - DNA, 25 bp, Rattus norvegicus
gtttgcccggctacgcagatgatca

SEQ ID NO: 582862 - DNA, 25 bp, Rattus norvegicus
aacccatggcatctccgggctctgg

SEQ ID NO: 582863 - DNA, 25 bp, Rattus norvegicus
gctctggcttttggtccttcggatc

SEQ ID NO: 582864 - DNA, 25 bp, Rattus norvegicus
caggaaacttattcaggcgcttcgc

SEQ ID NO: 582865 - DNA, 25 bp, Rattus norvegicus
taagtccttaactgtgcgagaaccc

SEQ ID NO: 582866 - DNA, 25 bp, Rattus norvegicus
cggactcggagacctggttcactta

SEQ ID NO: 582867 - DNA, 25 bp, Rattus norvegicus
tgccaggtggcccaaaagttcacgg

SEQ ID NO: 582868 - DNA, 25 bp, Rattus norvegicus
agcgccagactagcagaacccatgg

SEQ ID NO: 582869 - DNA, 25 bp, Rattus norvegicus
ttccgattcgcttttccctgcctgg

SEQ ID NO: 582870 - DNA, 25 bp, Rattus norvegicus
cgtaggttcctaaaagactgctgca

SEQ ID NO: 582871 - DNA, 25 bp, Rattus norvegicus
ggactgctttctttctgggacacga

SEQ ID NO: 582872 - DNA, 25 bp, Rattus norvegicus
caagcgcggcgagaaacaaacatcc

SEQ ID NO: 582873 - DNA, 25 bp, Rattus norvegicus
cctgagctttgcttagggacgtcta

SEQ ID NO: 582874 - DNA, 25 bp, Rattus norvegicus
tgcatctgctgtcatcggaaacctg

SEQ ID NO: 582875 - DNA, 25 bp, Rattus norvegicus
tgttttcacagtagtccgccacccg

SEQ ID NO: 582876 - DNA, 25 bp, Rattus norvegicus
ggggtctaggcgcaaacctcagcca

SEQ ID NO: 582877 - DNA, 25 bp, Rattus norvegicus
gcatcgcttcctctcgcgttaaaga

SEQ ID NO: 582878 - DNA, 25 bp, Rattus norvegicus
tcctctagtaacatctgcagctctg

SEQ ID NO: 582879 - DNA, 25 bp, Rattus norvegicus
ccagacgggatctcctcctctagta

SEQ ID NO: 582880 - DNA, 25 bp, Rattus norvegicus
tatcagcgccctcttgccagacggg

SEQ ID NO: 582881 - DNA, 25 bp, Rattus norvegicus
aggttctggtaactctctatcagcg

SEQ ID NO: 582882 - DNA, 25 bp, Rattus norvegicus
gaagcgccgcagagatcagacacta

SEQ ID NO: 582883 - DNA, 25 bp, Rattus norvegicus
ggagtacagcccgaccaagagaaga

SEQ ID NO: 582884 - DNA, 25 bp, Rattus norvegicus
gcagagctcggccaggataggcttt

SEQ ID NO: 582885 - DNA, 25 bp, Rattus norvegicus
aaagactgccgggagcacgacccgg

SEQ ID NO: 582886 - DNA, 25 bp, Rattus norvegicus
cccgaccaagagaagactgcagcga

SEQ ID NO: 582887 - DNA, 25 bp, Rattus norvegicus
cctcacctgtatgtagttgttttca

SEQ ID NO: 582888 - DNA, 25 bp, Rattus norvegicus
gcccaagcgcctcacctgtatgtag

SEQ ID NO: 582889 - DNA, 25 bp, Rattus norvegicus
tttggcgaccgcagccagagtctgt

SEQ ID NO: 582890 - DNA, 25 bp, Rattus norvegicus
agaggcttcttcctgagaaggcaac

SEQ ID NO: 582891 - DNA, 25 bp, Rattus norvegicus
catgcgcagtatctttagggcggga

SEQ ID NO: 582892 - DNA, 25 bp, Rattus norvegicus
cgggagtaggacctgctataggaca

SEQ ID NO: 582893 - DNA, 25 bp, Rattus norvegicus
gacctgctataggacaggcttcgta

SEQ ID NO: 582894 - DNA, 25 bp, Rattus norvegicus
aggacaggcttcgtagccaattaaa

SEQ ID NO: 582895 - DNA, 25 bp, Rattus norvegicus
gcccgcgtcagaggcttcttcctga

SEQ ID NO: 582896 - DNA, 25 bp, Rattus norvegicus
tcctgagaaggcaaccggaacttgt

SEQ ID NO: 582897 - DNA, 25 bp, Rattus norvegicus
ggaacttgtgcttccgctgcgctga

SEQ ID NO: 582898 - DNA, 25 bp, Rattus norvegicus
cttccgctgcgctgaggaaaaagtc

SEQ ID NO: 582899 - DNA, 25 bp, Rattus norvegicus
cgctgaggaaaaagtcgctacggga

SEQ ID NO: 582900 - DNA, 25 bp, Rattus norvegicus
tcgctacgggaaaagctagagctga

SEQ ID NO: 582901 - DNA, 25 bp, Rattus norvegicus
cacgccacgggcttttaaagtgtcg

SEQ ID NO: 582902 - DNA, 25 bp, Rattus norvegicus
cgtagccaattaaaggcccgcgtca

SEQ ID NO: 582903 - DNA, 25 bp, Rattus norvegicus
aggccttgcccgtcatttggctata

SEQ ID NO: 582904 - DNA, 25 bp, Rattus norvegicus
tggctataacaaggtaaatgccgac

SEQ ID NO: 582905 - DNA, 25 bp, Rattus norvegicus
cccgtcatttggctataacaaggta

SEQ ID NO: 582906 - DNA, 25 bp, Rattus norvegicus
aaccggacaggccttgcccgtcatt

SEQ ID NO: 582907 - DNA, 25 bp, Rattus norvegicus
cgtcgagacaaaaccggacaggcct

SEQ ID NO: 582908 - DNA, 25 bp, Rattus norvegicus
gcaagcgtcgagacaaaaccggaca

SEQ ID NO: 582909 - DNA, 25 bp, Rattus norvegicus
tgaggggcaagcgtcgagacaaaac

SEQ ID NO: 582910 - DNA, 25 bp, Rattus norvegicus
tacagttcccataagcccgcggggc

SEQ ID NO: 582911 - DNA, 25 bp, Rattus norvegicus
cttacagaggaaggtgtccggaagc

SEQ ID NO: 582912 - DNA, 25 bp, Rattus norvegicus
cgctagcttacagaggaaggtgtcc

SEQ ID NO: 582913 - DNA, 25 bp, Rattus norvegicus
gggaatgacgctagcttacagagga

SEQ ID NO: 582914 - DNA, 25 bp, Rattus norvegicus
caggagggaatgacgctagcttaca

SEQ ID NO: 582915 - DNA, 25 bp, Rattus norvegicus
accggaacaggagggaatgacgcta

SEQ ID NO: 582916 - DNA, 25 bp, Rattus norvegicus
cagttcccataagcccgcggggcaa

SEQ ID NO: 582917 - DNA, 25 bp, Rattus norvegicus
cggctccgagggaagagtgacttat

SEQ ID NO: 582918 - DNA, 25 bp, Rattus norvegicus
gttcgcaactagacatgtacgagta

SEQ ID NO: 582919 - DNA, 25 bp, Rattus norvegicus
cgcaactagacatgtacgagtaatc

SEQ ID NO: 582920 - DNA, 25 bp, Rattus norvegicus
ctagacatgtacgagtaatcttccc

SEQ ID NO: 582921 - DNA, 25 bp, Rattus norvegicus
tgtacgagtaatcttcccaacccat

SEQ ID NO: 582922 - DNA, 25 bp, Rattus norvegicus
tcctaaaccgacaaaaatgacactc

SEQ ID NO: 582923 - DNA, 25 bp, Rattus norvegicus
gacaaaaatgacactcccaacgagg

SEQ ID NO: 582924 - DNA, 25 bp, Rattus norvegicus
tgacactcccaacgaggcgtccttg

SEQ ID NO: 582925 - DNA, 25 bp, Rattus norvegicus
cccaacgaggcgtccttgagatttc

SEQ ID NO: 582926 - DNA, 25 bp, Rattus norvegicus
aacgaggcgtccttgagatttccgg

SEQ ID NO: 582927 - DNA, 25 bp, Rattus norvegicus
gagtgacttatagttcgcaactaga

SEQ ID NO: 582928 - DNA, 25 bp, Rattus norvegicus
ccggggcaccgcactccaagcctgt

SEQ ID NO: 582929 - DNA, 25 bp, Rattus norvegicus
ggcgaattttctcaatgcctagtac

SEQ ID NO: 582930 - DNA, 25 bp, Rattus norvegicus
tccttgagatttccggggcaccgca

SEQ ID NO: 582931 - DNA, 25 bp, Rattus norvegicus
gcggagggccatcgagctttaacaa

SEQ ID NO: 582932 - DNA, 25 bp, Rattus norvegicus
caacagttaaattagccgggcgctc

SEQ ID NO: 582933 - DNA, 25 bp, Rattus norvegicus
gacctatgaagggacacacgagtga

SEQ ID NO: 582934 - DNA, 25 bp, Rattus norvegicus
gaaattaattaacgagcagctgctc

SEQ ID NO: 582935 - DNA, 25 bp, Rattus norvegicus
ttagtcacggaggacggaaggcact

SEQ ID NO: 582936 - DNA, 25 bp, Rattus norvegicus
gagtctcgcggactgtcaagttaga

SEQ ID NO: 582937 - DNA, 25 bp, Rattus norvegicus
tccgtccaaggagtcaatatcgccc

SEQ ID NO: 582938 - DNA, 25 bp, Rattus norvegicus
gggcctggccacagacctacaggtc

SEQ ID NO: 582939 - DNA, 25 bp, Rattus norvegicus
gaagcgctgacgtcagcccatgctg

SEQ ID NO: 582940 - DNA, 25 bp, Rattus norvegicus
cggctctaagccacagaagcgctga

SEQ ID NO: 582941 - DNA, 25 bp, Rattus norvegicus
gtcaagttagatgtgcgcggctcta

SEQ ID NO: 582942 - DNA, 25 bp, Rattus norvegicus
cctacaggtcactgggatgctggcc

SEQ ID NO: 582943 - DNA, 25 bp, Rattus norvegicus
cgaacggtgtttctccttagtcacg

SEQ ID NO: 582944 - DNA, 25 bp, Rattus norvegicus
ttaacaaatgaactccgtccaagga

SEQ ID NO: 582945 - DNA, 25 bp, Rattus norvegicus
atgagtcggctccttcgccaacgcg

SEQ ID NO: 582946 - DNA, 25 bp, Rattus norvegicus
cgcagagcccaagatcatgaaggtc

SEQ ID NO: 582947 - DNA, 25 bp, Rattus norvegicus
tcacggtgaagacgcctaaagagaa

SEQ ID NO: 582948 - DNA, 25 bp, Rattus norvegicus
cgctgtgcccgagaacagctcggtc

SEQ ID NO: 582949 - DNA, 25 bp, Rattus norvegicus
cggtgcctgtactagtgagccgcgc

SEQ ID NO: 582950 - DNA, 25 bp, Rattus norvegicus
tcctcacaaaggagccgggagctgc

SEQ ID NO: 582951 - DNA, 25 bp, Rattus norvegicus
tccgccggctaagaaaggaacgagc

SEQ ID NO: 582952 - DNA, 25 bp, Rattus norvegicus
gtgcaccatcatggcgtcttccatg

SEQ ID NO: 582953 - DNA, 25 bp, Rattus norvegicus
cgtgacgtcatcttagtgcaccatc

SEQ ID NO: 582954 - DNA, 25 bp, Rattus norvegicus
agcaatttcgctgcccgtgacgtca

SEQ ID NO: 582955 - DNA, 25 bp, Rattus norvegicus
gggccagacgtttctagcaatttcg

SEQ ID NO: 582956 - DNA, 25 bp, Rattus norvegicus
tcgccgctattttataagccaacgc

SEQ ID NO: 582957 - DNA, 25 bp, Rattus norvegicus
accgagagcaaagggccagacgttt

SEQ ID NO: 582958 - DNA, 25 bp, Rattus norvegicus
ctttcaaagaagaacgggagacgcg

SEQ ID NO: 582959 - DNA, 25 bp, Rattus norvegicus
tcgaccagcatcttccgggtgggag

SEQ ID NO: 582960 - DNA, 25 bp, Rattus norvegicus
tgcaggacttctcaggaatgggggg

SEQ ID NO: 582961 - DNA, 25 bp, Rattus norvegicus
ggtgtggctggtcgaccagcatctt

SEQ ID NO: 582962 - DNA, 25 bp, Rattus norvegicus
tgtggctggtcgaccagcatcttcc

SEQ ID NO: 582963 - DNA, 25 bp, Rattus norvegicus
tggctggtcgaccagcatcttccgg

SEQ ID NO: 582964 - DNA, 25 bp, Rattus norvegicus
gctggtcgaccagcatcttccgggt

SEQ ID NO: 582965 - DNA, 25 bp, Rattus norvegicus
ctggtcgaccagcatcttccgggtg

SEQ ID NO: 582966 - DNA, 25 bp, Rattus norvegicus
ccagcatcttccgggtgggagaaag

SEQ ID NO: 582967 - DNA, 25 bp, Rattus norvegicus
gtcgaccagcatcttccgggtggga

SEQ ID NO: 582968 - DNA, 25 bp, Rattus norvegicus
gaccagcatcttccgggtgggagaa

SEQ ID NO: 582969 - DNA, 25 bp, Rattus norvegicus
ggtgcccaccgactgcaggacttct

SEQ ID NO: 582970 - DNA, 25 bp, Rattus norvegicus
agggtgcccaccgactgcaggactt

SEQ ID NO: 582971 - DNA, 25 bp, Rattus norvegicus
tggtcgaccagcatcttccgggtgg

SEQ ID NO: 582972 - DNA, 25 bp, Rattus norvegicus
gtgcccaccgactgcaggacttctc

SEQ ID NO: 582973 - DNA, 25 bp, Rattus norvegicus
tcccgccaagtagattcaaatgctt

SEQ ID NO: 582974 - DNA, 25 bp, Rattus norvegicus
tgtcgccgcaccttcttcattctcc

SEQ ID NO: 582975 - DNA, 25 bp, Rattus norvegicus
tcccgaggcggactccatagctgaa

SEQ ID NO: 582976 - DNA, 25 bp, Rattus norvegicus
ggcggactccatagctgaacagttc

SEQ ID NO: 582977 - DNA, 25 bp, Rattus norvegicus
ctacagtactaactcccgccaagta

SEQ ID NO: 582978 - DNA, 25 bp, Rattus norvegicus
ctgtttttgtgacggggcagtgcat

SEQ ID NO: 582979 - DNA, 25 bp, Rattus norvegicus
ggatgcctcccgtgacgtcaccatg

SEQ ID NO: 582980 - DNA, 25 bp, Rattus norvegicus
tgacgtcaccatgcgcctgcgctct

SEQ ID NO: 582981 - DNA, 25 bp, Rattus norvegicus
gcgctctgctggctcactgtaagcc

SEQ ID NO: 582982 - DNA, 25 bp, Rattus norvegicus
cactgtaagcctgcatagatgggtg

SEQ ID NO: 582983 - DNA, 25 bp, Rattus norvegicus
taggttgggcctcagccgcggatac

SEQ ID NO: 582984 - DNA, 25 bp, Rattus norvegicus
gccgcggatacataggctgtttttg

SEQ ID NO: 582985 - DNA, 25 bp, Rattus norvegicus
cataggctgtttttgtgacggggca

SEQ ID NO: 582986 - DNA, 25 bp, Rattus norvegicus
ctgaacagttcgcactacagtacta

SEQ ID NO: 582987 - DNA, 25 bp, Rattus norvegicus
gctttggagttgttaatttctcacg

SEQ ID NO: 582988 - DNA, 25 bp, Rattus norvegicus
cacccggcctgaagggctttggagt

SEQ ID NO: 582989 - DNA, 25 bp, Rattus norvegicus
atttctcacggactcgcttgggcga

SEQ ID NO: 582990 - DNA, 25 bp, Rattus norvegicus
cgaacgccactgaggagttgggcct

SEQ ID NO: 582991 - DNA, 25 bp, Rattus norvegicus
ggagcatcgctagccgctaccacgg

SEQ ID NO: 582992 - DNA, 25 bp, Rattus norvegicus
cacggggcaagagtcacattagctt

SEQ ID NO: 582993 - DNA, 25 bp, Rattus norvegicus
ggctgacaggaaacgctccgcggac

SEQ ID NO: 582994 - DNA, 25 bp, Rattus norvegicus
ggctatccggacacgtccctcaagg

SEQ ID NO: 582995 - DNA, 25 bp, Rattus norvegicus
gtgatccaggttctgtcgctgattg

SEQ ID NO: 582996 - DNA, 25 bp, Rattus norvegicus
cggcggaaaacggaagtgtgatcca

SEQ ID NO: 582997 - DNA, 25 bp, Rattus norvegicus
gcgacagccagctccgcacaggagg

SEQ ID NO: 582998 - DNA, 25 bp, Rattus norvegicus
gaacggccagaattcccgcgagggc

SEQ ID NO: 582999 - DNA, 25 bp, Rattus norvegicus
caccatctttgtgccgcccgagggg

SEQ ID NO: 583000 - DNA, 25 bp, Rattus norvegicus
acattagcttaaccgggccaccagc

SEQ ID NO: 583001 - DNA, 25 bp, Rattus norvegicus
caacacggtggagctgaagcgcgcc

SEQ ID NO: 583002 - DNA, 25 bp, Rattus norvegicus
tcgccgcacgcggtggacggcaaca

SEQ ID NO: 583003 - DNA, 25 bp, Rattus norvegicus
tgacctactcgaacgtggaggaggc

SEQ ID NO: 583004 - DNA, 25 bp, Rattus norvegicus
tgcttcggcttcgtgacctactcga

SEQ ID NO: 583005 - DNA, 25 bp, Rattus norvegicus
agacgaagcgctcccgctgcttcgg

SEQ ID NO: 583006 - DNA, 25 bp, Rattus norvegicus
agcagtccggcaagaagcgcggctt

SEQ ID NO: 583007 - DNA, 25 bp, Rattus norvegicus
ccttcgggacgctgacggactgcgt

SEQ ID NO: 583008 - DNA, 25 bp, Rattus norvegicus
ccacgccaaggtgaagaagctgttc

SEQ ID NO: 583009 - DNA, 25 bp, Rattus norvegicus
acaaggcggcggtggtcaagttcca

SEQ ID NO: 583010 - DNA, 25 bp, Rattus norvegicus
agggcgacctgatcgagcacttctc

SEQ ID NO: 583011 - DNA, 25 bp, Rattus norvegicus
ggtcaagttccacccgatccagggc

SEQ ID NO: 583012 - DNA, 25 bp, Rattus norvegicus
agatcatcgccgacaagcagtccgg

SEQ ID NO: 583013 - DNA, 25 bp, Rattus norvegicus
agcacttctcgcagttcggcgccgt

SEQ ID NO: 583014 - DNA, 25 bp, Rattus norvegicus
ggcttcggcttcgtctacttccaga

SEQ ID NO: 583015 - DNA, 25 bp, Rattus norvegicus
ccgcgccaggcctctgtattgatag

SEQ ID NO: 583016 - DNA, 25 bp, Rattus norvegicus
agcccttacttctgtgcgatgttca

SEQ ID NO: 583017 - DNA, 25 bp, Rattus norvegicus
agcctgcagcccttacttctgtgcg

SEQ ID NO: 583018 - DNA, 25 bp, Rattus norvegicus
accgcgtggtcctggcagcctgcag

SEQ ID NO: 583019 - DNA, 25 bp, Rattus norvegicus
acgtggaggtagaagcccaccgcgt

SEQ ID NO: 583020 - DNA, 25 bp, Rattus norvegicus
ctggtgtcttacagtaagcggctgc

SEQ ID NO: 583021 - DNA, 25 bp, Rattus norvegicus
tacagtaagcggctgctgtgtgacg

SEQ ID NO: 583022 - DNA, 25 bp, Rattus norvegicus
gtcacctcactggtgtcttacagta

SEQ ID NO: 583023 - DNA, 25 bp, Rattus norvegicus
gactctttctgtcacctcactggtg

SEQ ID NO: 583024 - DNA, 25 bp, Rattus norvegicus
gtccatgctgtgactctttctgtca

SEQ ID NO: 583025 - DNA, 25 bp, Rattus norvegicus
tgtgtgtgtccatgctgtgactctt

SEQ ID NO: 583026 - DNA, 25 bp, Rattus norvegicus
cctctgtattgatagcgtgtgatcc

SEQ ID NO: 583027 - DNA, 25 bp, Rattus norvegicus
tgtgcgatgttcacaggtaaggcga

SEQ ID NO: 583028 - DNA, 25 bp, Rattus norvegicus
gaagcccaccgcgtggtcctggcag

SEQ ID NO: 583029 - DNA, 25 bp, Rattus norvegicus
ggcggaagaatcgtacccttgtctg

SEQ ID NO: 583030 - DNA, 25 bp, Rattus norvegicus
tggacggacagaccctcagcaagct

SEQ ID NO: 583031 - DNA, 25 bp, Rattus norvegicus
ataagctgttccttccgccctcagg

SEQ ID NO: 583032 - DNA, 25 bp, Rattus norvegicus
ttgtctgttcaacgcatgcccggta

SEQ ID NO: 583033 - DNA, 25 bp, Rattus norvegicus
tccgccctcaggttacgtagtagta

SEQ ID NO: 583034 - DNA, 25 bp, Rattus norvegicus
tgacatcactttacctgggcacgtg

SEQ ID NO: 583035 - DNA, 25 bp, Rattus norvegicus
acaaagctgcatgggatgacatcac

SEQ ID NO: 583036 - DNA, 25 bp, Rattus norvegicus
ctcatggtcactaaacggggaaaca

SEQ ID NO: 583037 - DNA, 25 bp, Rattus norvegicus
taactctcacggctcctcatggtca

SEQ ID NO: 583038 - DNA, 25 bp, Rattus norvegicus
tgcaggtaatcccaccggtggccca

SEQ ID NO: 583039 - DNA, 25 bp, Rattus norvegicus
acggaggagaacgtgcaggtaatcc

SEQ ID NO: 583040 - DNA, 25 bp, Rattus norvegicus
tctacaccgcggagatagaggtgac

SEQ ID NO: 583041 - DNA, 25 bp, Rattus norvegicus
agcaagctcatcgactacatctaca

SEQ ID NO: 583042 - DNA, 25 bp, Rattus norvegicus
gcatgcccggtataagctgttcctt

SEQ ID NO: 583043 - DNA, 25 bp, Rattus norvegicus
ggctcacagtgctcagctggagcga

SEQ ID NO: 583044 - DNA, 25 bp, Rattus norvegicus
gtggtgctgggaacagacttcagac

SEQ ID NO: 583045 - DNA, 25 bp, Rattus norvegicus
cagccgaaggcaagctgctgagatt

SEQ ID NO: 583046 - DNA, 25 bp, Rattus norvegicus
aacagacttcagacttggcgcccgc

SEQ ID NO: 583047 - DNA, 25 bp, Rattus norvegicus
ctcccgcagcatggagggcgatcta

SEQ ID NO: 583048 - DNA, 25 bp, Rattus norvegicus
tgcttcgccggctcacagtgctcag

SEQ ID NO: 583049 - DNA, 25 bp, Rattus norvegicus
gcgccctttgctcagagcctggctc

SEQ ID NO: 583050 - DNA, 25 bp, Rattus norvegicus
ccctcagcgctgtcaggagccgagg

SEQ ID NO: 583051 - DNA, 25 bp, Rattus norvegicus
cgacctcgcactgcccgaatccctc

SEQ ID NO: 583052 - DNA, 25 bp, Rattus norvegicus
ctagaagcagcacagcgacctcgca

SEQ ID NO: 583053 - DNA, 25 bp, Rattus norvegicus
cgtccctggccaccgcctagaagca

SEQ ID NO: 583054 - DNA, 25 bp, Rattus norvegicus
tcctccgggagcgatcggaggactt

SEQ ID NO: 583055 - DNA, 25 bp, Rattus norvegicus
ttggcgcccgcttctcccagtgtgg

SEQ ID NO: 583056 - DNA, 25 bp, Rattus norvegicus
catggagggcgatctacccggctcg

SEQ ID NO: 583057 - DNA, 25 bp, Rattus norvegicus
tcatggcaggccacgtgtatgccgt

SEQ ID NO: 583058 - DNA, 25 bp, Rattus norvegicus
tctctacgcggttggaggcttcgac

SEQ ID NO: 583059 - DNA, 25 bp, Rattus norvegicus
caatgaccttctctacgcggttgga

SEQ ID NO: 583060 - DNA, 25 bp, Rattus norvegicus
cggccgtgctcaatgaccttctcta

SEQ ID NO: 583061 - DNA, 25 bp, Rattus norvegicus
tccattgccagcatgcaggagcgcc

SEQ ID NO: 583062 - DNA, 25 bp, Rattus norvegicus
agtggacatccattgccagcatgca

SEQ ID NO: 583063 - DNA, 25 bp, Rattus norvegicus
tgtgaaggaccagtggacatccatt

SEQ ID NO: 583064 - DNA, 25 bp, Rattus norvegicus
taacggctcccttcgggtgcggaca

SEQ ID NO: 583065 - DNA, 25 bp, Rattus norvegicus
tggtgttcatggcaggccacgtgta

SEQ ID NO: 583066 - DNA, 25 bp, Rattus norvegicus
tcctgtgtctcaggtgtggtgttca

SEQ ID NO: 583067 - DNA, 25 bp, Rattus norvegicus
gactctcacgccctatgttcctgtg

SEQ ID NO: 583068 - DNA, 25 bp, Rattus norvegicus
acccatcaggttgggcggtcatccc

SEQ ID NO: 583069 - DNA, 25 bp, Rattus norvegicus
caccttgtcacccatcaggttgggc

SEQ ID NO: 583070 - DNA, 25 bp, Rattus norvegicus
atgtgtacgacggtgtgaaggacca

SEQ ID NO: 583071 - DNA, 25 bp, Rattus norvegicus
ggctgagcaccgtctcccagtatga

SEQ ID NO: 583072 - DNA, 25 bp, Rattus norvegicus
ctgccagagcctgggatgatgctca

SEQ ID NO: 583073 - DNA, 25 bp, Rattus norvegicus
ggagacctttgccttagctgggatg

SEQ ID NO: 583074 - DNA, 25 bp, Rattus norvegicus
ctctgcgtgtccctgttgcaaagaa

SEQ ID NO: 583075 - DNA, 25 bp, Rattus norvegicus
catatttgcggtagttgggatcttc

SEQ ID NO: 583076 - DNA, 25 bp, Rattus norvegicus
ctcccaaggtatgtgcccgcagaac

SEQ ID NO: 583077 - DNA, 25 bp, Rattus norvegicus
cgcggtacaggaacaccagcaactc

SEQ ID NO: 583078 - DNA, 25 bp, Rattus norvegicus
ctggcacattgagcatccgggtttt

SEQ ID NO: 583079 - DNA, 25 bp, Rattus norvegicus
tttcctagacaatgaccagtggctg

SEQ ID NO: 583080 - DNA, 25 bp, Rattus norvegicus
tggtgcttcctccaagtggacagcc

SEQ ID NO: 583081 - DNA, 25 bp, Rattus norvegicus
cattcgtaagggctctccaggtgca

SEQ ID NO: 583082 - DNA, 25 bp, Rattus norvegicus
gcgttagtagctgtttccattcgta

SEQ ID NO: 583083 - DNA, 25 bp, Rattus norvegicus
ctgtgacccaggctctgcgttagta

SEQ ID NO: 583084 - DNA, 25 bp, Rattus norvegicus
ttcctctatagtttgacggcagccc

SEQ ID NO: 583085 - DNA, 25 bp, Rattus norvegicus
ccgtggttctgctggatgacctaga

SEQ ID NO: 583086 - DNA, 25 bp, Rattus norvegicus
caaagaagacgaggtcgggtacata

SEQ ID NO: 583087 - DNA, 25 bp, Rattus norvegicus
ttgtatctaagactccgaggcaccg

SEQ ID NO: 583088 - DNA, 25 bp, Rattus norvegicus
agaggacacgcttttgacacagatc

SEQ ID NO: 583089 - DNA, 25 bp, Rattus norvegicus
ctgcgttgtatctaagactccgagg

SEQ ID NO: 583090 - DNA, 25 bp, Rattus norvegicus
ctgctggatgacctagacgacgaga

SEQ ID NO: 583091 - DNA, 25 bp, Rattus norvegicus
gtacatatggtagcgcccacgagga

SEQ ID NO: 583092 - DNA, 25 bp, Rattus norvegicus
atgacctagacgacgagagggagct

SEQ ID NO: 583093 - DNA, 25 bp, Rattus norvegicus
cgcttttgacacagatctgcaagtc

SEQ ID NO: 583094 - DNA, 25 bp, Rattus norvegicus
acagatctgcaagtcgtttcctttg

SEQ ID NO: 583095 - DNA, 25 bp, Rattus norvegicus
tgaggatgacgacaaagaagacgag

SEQ ID NO: 583096 - DNA, 25 bp, Rattus norvegicus
gggagctgggaccaaaggacaaaga

SEQ ID NO: 583097 - DNA, 25 bp, Rattus norvegicus
tctgcaagtcgtttcctttgcctgc

SEQ ID NO: 583098 - DNA, 25 bp, Rattus norvegicus
tcgggtacatatggtagcgcccacg

SEQ ID NO: 583099 - DNA, 25 bp, Rattus norvegicus
ggcccactgccaggagtacgagatt

SEQ ID NO: 583100 - DNA, 25 bp, Rattus norvegicus
cttctgcaagtgcaatgagtgcacc

SEQ ID NO: 583101 - DNA, 25 bp, Rattus norvegicus
gctggccatcagcaagggctacgtg

SEQ ID NO: 583102 - DNA, 25 bp, Rattus norvegicus
ggctgacgctcagcccgctggagca

SEQ ID NO: 583103 - DNA, 25 bp, Rattus norvegicus
aaggactccttcagccattcgcgct

SEQ ID NO: 583104 - DNA, 25 bp, Rattus norvegicus
tgcaatgagtgcaccgagaagcagc

SEQ ID NO: 583105 - DNA, 25 bp, Rattus norvegicus
cccatgactacttctgcaagtgcaa

SEQ ID NO: 583106 - DNA, 25 bp, Rattus norvegicus
attgtacacatcctgctgctcaagg

SEQ ID NO: 583107 - DNA, 25 bp, Rattus norvegicus
ccaggagtacgagattgtacacatc

SEQ ID NO: 583108 - DNA, 25 bp, Rattus norvegicus
atggcacgcgcttctcccacgacat

SEQ ID NO: 583109 - DNA, 25 bp, Rattus norvegicus
cagccatccggccttcgcacagggc

SEQ ID NO: 583110 - DNA, 25 bp, Rattus norvegicus
tgcgcattgtggaggccatcctcag

SEQ ID NO: 583111 - DNA, 25 bp, Rattus norvegicus
tcagcaagggctacgtgcgcattgt

SEQ ID NO: 583112 - DNA, 25 bp, Rattus norvegicus
cgagaagcagcgcaaggactccttc

SEQ ID NO: 583113 - DNA, 25 bp, Rattus norvegicus
gcgacgtgttcaacgccaccagcgg

SEQ ID NO: 583114 - DNA, 25 bp, Rattus norvegicus
ccagggcagtgctgcaaatcctgtc

SEQ ID NO: 583115 - DNA, 25 bp, Rattus norvegicus
agacgcgaccggtatagggctaaag

SEQ ID NO: 583116 - DNA, 25 bp, Rattus norvegicus
tgtcctctttatcggctgccagctg

SEQ ID NO: 583117 - DNA, 25 bp, Rattus norvegicus
tggcgctcgttgtcctctttatcgg

SEQ ID NO: 583118 - DNA, 25 bp, Rattus norvegicus
ctcagtcattggttcgcagcctctc

SEQ ID NO: 583119 - DNA, 25 bp, Rattus norvegicus
gctgaagagcggctggaaaaccgta

SEQ ID NO: 583120 - DNA, 25 bp, Rattus norvegicus
atctgcggcggcttacatatagagc

SEQ ID NO: 583121 - DNA, 25 bp, Rattus norvegicus
cgggcactgattcctccgcaggtgc

SEQ ID NO: 583122 - DNA, 25 bp, Rattus norvegicus
aggctcttagcagcgccggtttgca

SEQ ID NO: 583123 - DNA, 25 bp, Rattus norvegicus
ctctggagcttgctcgagctgaaga

SEQ ID NO: 583124 - DNA, 25 bp, Rattus norvegicus
cgcggatcatgtacggcgacgtgtt

SEQ ID NO: 583125 - DNA, 25 bp, Rattus norvegicus
cggtttgcatcatcagaagtgagga

SEQ ID NO: 583126 - DNA, 25 bp, Rattus norvegicus
tcgggacagccagaagtgggaactc

SEQ ID NO: 583127 - DNA, 25 bp, Rattus norvegicus
ggctgcctcccagaaacgaaatctg

SEQ ID NO: 583128 - DNA, 25 bp, Rattus norvegicus
tctgctgcgtaattgctttaattta

SEQ ID NO: 583129 - DNA, 25 bp, Rattus norvegicus
cacatcatataatatctgctgcgta

SEQ ID NO: 583130 - DNA, 25 bp, Rattus norvegicus
tggagaccgcagtacacatcatata

SEQ ID NO: 583131 - DNA, 25 bp, Rattus norvegicus
tgatggatgactatctggagaccgc

SEQ ID NO: 583132 - DNA, 25 bp, Rattus norvegicus
gaaatctgccggtcctgacagcttg

SEQ ID NO: 583133 - DNA, 25 bp, Rattus norvegicus
cagctgcaaggctgcctcccagaaa

SEQ ID NO: 583134 - DNA, 25 bp, Rattus norvegicus
taatgatgacgttcgcgccctctcc

SEQ ID NO: 583135 - DNA, 25 bp, Rattus norvegicus
accctctaattaatgatgacgttcg

SEQ ID NO: 583136 - DNA, 25 bp, Rattus norvegicus
agacttgctcctaaagattcctggg

SEQ ID NO: 583137 - DNA, 25 bp, Rattus norvegicus
ctcttcgaggagctgtgcagacttg

SEQ ID NO: 583138 - DNA, 25 bp, Rattus norvegicus
cctgacagcttggttgaaggtgatg

SEQ ID NO: 583139 - DNA, 25 bp, Rattus norvegicus
tacgagttctccgatcgcgctggac

SEQ ID NO: 583140 - DNA, 25 bp, Rattus norvegicus
ttacagatgaaaatacgagttctcc

SEQ ID NO: 583141 - DNA, 25 bp, Rattus norvegicus
tgagcatgctctgaccgaagacggc

SEQ ID NO: 583142 - DNA, 25 bp, Rattus norvegicus
taagcgccgatccttatctcgcaga

SEQ ID NO: 583143 - DNA, 25 bp, Rattus norvegicus
cgtcacaggggagttctcaaagctc

SEQ ID NO: 583144 - DNA, 25 bp, Rattus norvegicus
ttctgcaaaactcaaagtccgggcc

SEQ ID NO: 583145 - DNA, 25 bp, Rattus norvegicus
agatctagcctagagcgctcggcca

SEQ ID NO: 583146 - DNA, 25 bp, Rattus norvegicus
cggatagctggcacacctccaaata

SEQ ID NO: 583147 - DNA, 25 bp, Rattus norvegicus
cccggcgagagacaaaagctgcttc

SEQ ID NO: 583148 - DNA, 25 bp, Rattus norvegicus
gcttcggctcctcacactaagttta

SEQ ID NO: 583149 - DNA, 25 bp, Rattus norvegicus
tcctcggccagctctttctgcaaaa

SEQ ID NO: 583150 - DNA, 25 bp, Rattus norvegicus
ggccggagtgtaattcccaccgata

SEQ ID NO: 583151 - DNA, 25 bp, Rattus norvegicus
tctcgcagacacaaagcggcggggc

SEQ ID NO: 583152 - DNA, 25 bp, Rattus norvegicus
gtgcacgcgccgcaactttattagc

SEQ ID NO: 583153 - DNA, 25 bp, Rattus norvegicus
tgcggtccacggcaagccttttagc

SEQ ID NO: 583154 - DNA, 25 bp, Rattus norvegicus
ggcacgcatgcccaagtgaaccaca

SEQ ID NO: 583155 - DNA, 25 bp, Rattus norvegicus
gcgcggacccacgatgaaagcaggc

SEQ ID NO: 583156 - DNA, 25 bp, Rattus norvegicus
ccagggtcccggtgaagcccagaga

SEQ ID NO: 583157 - DNA, 25 bp, Rattus norvegicus
cagcgcgcgctgggtttagtagccc

SEQ ID NO: 583158 - DNA, 25 bp, Rattus norvegicus
ttcgcacaaagtgcgggtccaaagg

SEQ ID NO: 583159 - DNA, 25 bp, Rattus norvegicus
tgctgcagcaccagctgatagggtg

SEQ ID NO: 583160 - DNA, 25 bp, Rattus norvegicus
ccggtgaagcccagagacagagcca

SEQ ID NO: 583161 - DNA, 25 bp, Rattus norvegicus
agcgccatggagctgaagcacgcgc

SEQ ID NO: 583162 - DNA, 25 bp, Rattus norvegicus
aagcacgcgcggacccacgatgaaa

SEQ ID NO: 583163 - DNA, 25 bp, Rattus norvegicus
acccacgatgaaagcaggcgcgggc

SEQ ID NO: 583164 - DNA, 25 bp, Rattus norvegicus
tttagtagcccgagggagggagcag

SEQ ID NO: 583165 - DNA, 25 bp, Rattus norvegicus
tcccaggccacaccacaactaaaca

SEQ ID NO: 583166 - DNA, 25 bp, Rattus norvegicus
aacacccgcaccctcctgcaccgcc

SEQ ID NO: 583167 - DNA, 25 bp, Rattus norvegicus
tcccacttcgcacaaagtgcgggtc

SEQ ID NO: 583168 - DNA, 25 bp, Rattus norvegicus
caaagtgcgggtccaaaggaaagcg

SEQ ID NO: 583169 - DNA, 25 bp, Rattus norvegicus
actgaatgggtccagcaggccaggc

SEQ ID NO: 583170 - DNA, 25 bp, Rattus norvegicus
agcgtgttcgactccattcctgcct

SEQ ID NO: 583171 - DNA, 25 bp, Rattus norvegicus
ttgctgcgccacaaacgttacctca

SEQ ID NO: 583172 - DNA, 25 bp, Rattus norvegicus
aaacgttacctcagaacgcgcgcct

SEQ ID NO: 583173 - DNA, 25 bp, Rattus norvegicus
aggccctccggtcaagcgcaggact

SEQ ID NO: 583174 - DNA, 25 bp, Rattus norvegicus
agcgcaggactctgcgtgacaaacg

SEQ ID NO: 583175 - DNA, 25 bp, Rattus norvegicus
tctgcgtgacaaacgccagcagcca

SEQ ID NO: 583176 - DNA, 25 bp, Rattus norvegicus
ggttccgagcgtgttcgactccatt

SEQ ID NO: 583177 - DNA, 25 bp, Rattus norvegicus
tcagggttcaccgagaggtagaccc

SEQ ID NO: 583178 - DNA, 25 bp, Rattus norvegicus
cagcagctgcttttatccctggtcc

SEQ ID NO: 583179 - DNA, 25 bp, Rattus norvegicus
tggctgcttctcagagatgccacgc

SEQ ID NO: 583180 - DNA, 25 bp, Rattus norvegicus
cccagccgctatgtttgaattcagg

SEQ ID NO: 583181 - DNA, 25 bp, Rattus norvegicus
ccgctatgtttgaattcagggttca

SEQ ID NO: 583182 - DNA, 25 bp, Rattus norvegicus
ccgcctaaagccgaggacgctgagg

SEQ ID NO: 583183 - DNA, 25 bp, Rattus norvegicus
ctgcaggcgttgctcactctgggat

SEQ ID NO: 583184 - DNA, 25 bp, Rattus norvegicus
accgcacttcgatgaggtgtgatcc

SEQ ID NO: 583185 - DNA, 25 bp, Rattus norvegicus
gaggatcttaaaggcaccgcacttc

SEQ ID NO: 583186 - DNA, 25 bp, Rattus norvegicus
ctgcaggttcttctctaaactctga

SEQ ID NO: 583187 - DNA, 25 bp, Rattus norvegicus
cgacacggtcactctgcaggttctt

SEQ ID NO: 583188 - DNA, 25 bp, Rattus norvegicus
accaagtgcacagcaggggagcgac

SEQ ID NO: 583189 - DNA, 25 bp, Rattus norvegicus
gctacgctcagtgtgtgtcaggcat

SEQ ID NO: 583190 - DNA, 25 bp, Rattus norvegicus
agcctgccgcgaagtcttccagctg

SEQ ID NO: 583191 - DNA, 25 bp, Rattus norvegicus
ggggctttcgcaagcacactcacct

SEQ ID NO: 583192 - DNA, 25 bp, Rattus norvegicus
gcaccgccaggcagtttgccctgtg

SEQ ID NO: 583193 - DNA, 25 bp, Rattus norvegicus
gcaaacagctgacagggcaccgcca

SEQ ID NO: 583194 - DNA, 25 bp, Rattus norvegicus
cccgcaatgcaaagcgtgctaactg

SEQ ID NO: 583195 - DNA, 25 bp, Rattus norvegicus
tgctaactgagcacaccgggcgcaa

SEQ ID NO: 583196 - DNA, 25 bp, Rattus norvegicus
tcttccagctggaagctgcccatgg

SEQ ID NO: 583197 - DNA, 25 bp, Rattus norvegicus
atgcatctctcgcttgctttctgga

SEQ ID NO: 583198 - DNA, 25 bp, Rattus norvegicus
gcaagtgcacagcatggcgatttta

SEQ ID NO: 583199 - DNA, 25 bp, Rattus norvegicus
ctggtgactgcatgtctcgtggcta

SEQ ID NO: 583200 - DNA, 25 bp, Rattus norvegicus
cttcgtgggaccctcaagggccata

SEQ ID NO: 583201 - DNA, 25 bp, Rattus norvegicus
tgaccgagcaaatgacccttcgtgg

SEQ ID NO: 583202 - DNA, 25 bp, Rattus norvegicus
gctgcggcgacactcgcaacatctg

SEQ ID NO: 583203 - DNA, 25 bp, Rattus norvegicus
taagctatccggtgccatccttgtc

SEQ ID NO: 583204 - DNA, 25 bp, Rattus norvegicus
gcggtgcttggctccctaagctatc

SEQ ID NO: 583205 - DNA, 25 bp, Rattus norvegicus
gccatctttgggcagcagtgaatca

SEQ ID NO: 583206 - DNA, 25 bp, Rattus norvegicus
gaatgcatttgtacagcgctgcctg

SEQ ID NO: 583207 - DNA, 25 bp, Rattus norvegicus
acctggtgcacctggcttcagaatg

SEQ ID NO: 583208 - DNA, 25 bp, Rattus norvegicus
cggggcgaccctttacatatgaacg

SEQ ID NO: 583209 - DNA, 25 bp, Rattus norvegicus
gttcggtaatgtgccgtttagcctc

SEQ ID NO: 583210 - DNA, 25 bp, Rattus norvegicus
acttctgcttccacggcatgtttta

SEQ ID NO: 583211 - DNA, 25 bp, Rattus norvegicus
tcgcggagacccgtgcagcgactca

SEQ ID NO: 583212 - DNA, 25 bp, Rattus norvegicus
caccgagtggttctgcatattaatg

SEQ ID NO: 583213 - DNA, 25 bp, Rattus norvegicus
gcgcagctggagagagcccagcata

SEQ ID NO: 583214 - DNA, 25 bp, Rattus norvegicus
ggagatcgcagcacccagcgccaag

SEQ ID NO: 583215 - DNA, 25 bp, Rattus norvegicus
aagcgcagcgcagcaccgcgacaga

SEQ ID NO: 583216 - DNA, 25 bp, Rattus norvegicus
gcatattaatgagctcgctctccga

SEQ ID NO: 583217 - DNA, 25 bp, Rattus norvegicus
acagacggcaggagcacccatcgac

SEQ ID NO: 583218 - DNA, 25 bp, Rattus norvegicus
tctccgagagggcaggagcgaattt

SEQ ID NO: 583219 - DNA, 25 bp, Rattus norvegicus
cccagcatagagaggcgggctcaaa

SEQ ID NO: 583220 - DNA, 25 bp, Rattus norvegicus
gcgggctcaaaaccgagaaccctgc

SEQ ID NO: 583221 - DNA, 25 bp, Rattus norvegicus
cacctaggcatcctggaacccgggg

SEQ ID NO: 583222 - DNA, 25 bp, Rattus norvegicus
tctcccgcagggtccaagtgtaagt

SEQ ID NO: 583223 - DNA, 25 bp, Rattus norvegicus
ggggcccaagatccgctacagcgac

SEQ ID NO: 583224 - DNA, 25 bp, Rattus norvegicus
agggagcccaagcaccacctaggca

SEQ ID NO: 583225 - DNA, 25 bp, Rattus norvegicus
gtgggacaaggtcgcctctcagtcc

SEQ ID NO: 583226 - DNA, 25 bp, Rattus norvegicus
tagcgtgttggggaccattgaagcc

SEQ ID NO: 583227 - DNA, 25 bp, Rattus norvegicus
acagagtgggacaaggtcgcctctc

SEQ ID NO: 583228 - DNA, 25 bp, Rattus norvegicus
tggctacaggctcagtcacctctcg

SEQ ID NO: 583229 - DNA, 25 bp, Rattus norvegicus
acgagaggagcctgatcgcccgcac

SEQ ID NO: 583230 - DNA, 25 bp, Rattus norvegicus
tctgctcacgagaggagcctgatcg

SEQ ID NO: 583231 - DNA, 25 bp, Rattus norvegicus
acaaggattagcgtgttggggacca

SEQ ID NO: 583232 - DNA, 25 bp, Rattus norvegicus
agtcacctctcgtgcggctctaatc

SEQ ID NO: 583233 - DNA, 25 bp, Rattus norvegicus
cgcgccagcgtctccgcagcacgct

SEQ ID NO: 583234 - DNA, 25 bp, Rattus norvegicus
tgttggggaccattgaagcctgccc

SEQ ID NO: 583235 - DNA, 25 bp, Rattus norvegicus
tcagtttgcgcgttccggctcgcgc

SEQ ID NO: 583236 - DNA, 25 bp, Rattus norvegicus
tcctcacgtggctacaggctcagtc

SEQ ID NO: 583237 - DNA, 25 bp, Rattus norvegicus
gtgcggctctaatctgctcacgaga

SEQ ID NO: 583238 - DNA, 25 bp, Rattus norvegicus
ccgtgctgtgggataacaaggatta

SEQ ID NO: 583239 - DNA, 25 bp, Rattus norvegicus
agacctgtctctctgacctcgactg

SEQ ID NO: 583240 - DNA, 25 bp, Rattus norvegicus
gatcgcgagcgcaaccgtatgcata

SEQ ID NO: 583241 - DNA, 25 bp, Rattus norvegicus
cggcggtaattacgggcacgctcca

SEQ ID NO: 583242 - DNA, 25 bp, Rattus norvegicus
tgcataacctcaacgctgcgctgga

SEQ ID NO: 583243 - DNA, 25 bp, Rattus norvegicus
ggcagcgacctgtccagtttcctca

SEQ ID NO: 583244 - DNA, 25 bp, Rattus norvegicus
cggacagtaagtgcgcttcgaaggc

SEQ ID NO: 583245 - DNA, 25 bp, Rattus norvegicus
tagccgcgggtcatacggacagtaa

SEQ ID NO: 583246 - DNA, 25 bp, Rattus norvegicus
cggcgacatcactcgggagaccagc

SEQ ID NO: 583247 - DNA, 25 bp, Rattus norvegicus
ggtgctcacacgagctgatctgatc

SEQ ID NO: 583248 - DNA, 25 bp, Rattus norvegicus
tcgtgtgccacactcggtgctcaca

SEQ ID NO: 583249 - DNA, 25 bp, Rattus norvegicus
gcgcccattgttgcgcgccgtactt

SEQ ID NO: 583250 - DNA, 25 bp, Rattus norvegicus
ttatgcaaatagcaggcgccgcacg

SEQ ID NO: 583251 - DNA, 25 bp, Rattus norvegicus
agccgcccgcgagcataaattatgc

SEQ ID NO: 583252 - DNA, 25 bp, Rattus norvegicus
gagccgtcgcgtcaaggccaacgat

SEQ ID NO: 583253 - DNA, 25 bp, Rattus norvegicus
ctaatagctccgctggccgcagaaa

SEQ ID NO: 583254 - DNA, 25 bp, Rattus norvegicus
aaatgcgtgcggacctttccctcta

SEQ ID NO: 583255 - DNA, 25 bp, Rattus norvegicus
tcgcgctagcgtgatcattacccta

SEQ ID NO: 583256 - DNA, 25 bp, Rattus norvegicus
cctagctaggccttcgtggacctga

SEQ ID NO: 583257 - DNA, 25 bp, Rattus norvegicus
tggacctgaaaagatccgaggcctc

SEQ ID NO: 583258 - DNA, 25 bp, Rattus norvegicus
tgaggtccacagcacaagccgttga

SEQ ID NO: 583259 - DNA, 25 bp, Rattus norvegicus
ccagccgatgtgaaaaaatgcgtgc

SEQ ID NO: 583260 - DNA, 25 bp, Rattus norvegicus
ctctactctgaggacgttggactgg

SEQ ID NO: 583261 - DNA, 25 bp, Rattus norvegicus
aggccgcctctgtctgcaatgcttt

SEQ ID NO: 583262 - DNA, 25 bp, Rattus norvegicus
cggtgtttgcgaagacatttgcatc

SEQ ID NO: 583263 - DNA, 25 bp, Rattus norvegicus
tgcgcttgggtaaacggcgctaata

SEQ ID NO: 583264 - DNA, 25 bp, Rattus norvegicus
cagaagattgttcggtgcctccctc

SEQ ID NO: 583265 - DNA, 25 bp, Rattus norvegicus
tcgctctcggcccacttttaaacaa

SEQ ID NO: 583266 - DNA, 25 bp, Rattus norvegicus
tccggttcaaagattgggcgccctc

SEQ ID NO: 583267 - DNA, 25 bp, Rattus norvegicus
gggagcaccgcactcgtggagtttc

SEQ ID NO: 583268 - DNA, 25 bp, Rattus norvegicus
ggcgacgccgcccacacaatctggc

SEQ ID NO: 583269 - DNA, 25 bp, Rattus norvegicus
cgctcggacgggttaatcactgcaa

SEQ ID NO: 583270 - DNA, 25 bp, Rattus norvegicus
gccctcagtccagtgggagtcccat

SEQ ID NO: 583271 - DNA, 25 bp, Rattus norvegicus
cccacccagcccgagaaagcgctgc

SEQ ID NO: 583272 - DNA, 25 bp, Rattus norvegicus
gagcaccgcactcgtggagtttccc

SEQ ID NO: 583273 - DNA, 25 bp, Rattus norvegicus
tcagtccagtgggagtcccatccca

SEQ ID NO: 583274 - DNA, 25 bp, Rattus norvegicus
tggagagccctccactgcctccgcc

SEQ ID NO: 583275 - DNA, 25 bp, Rattus norvegicus
agacatgaaaggctctccaattgga

SEQ ID NO: 583276 - DNA, 25 bp, Rattus norvegicus
aaaacaaagacatgaaaggctctcc

SEQ ID NO: 583277 - DNA, 25 bp, Rattus norvegicus
cgggttaatcactgcaaaaacaaag

SEQ ID NO: 583278 - DNA, 25 bp, Rattus norvegicus
ggacgggttaatcactgcaaaaaca

SEQ ID NO: 583279 - DNA, 25 bp, Rattus norvegicus
gatcgcgctcggacgggttaatcac

SEQ ID NO: 583280 - DNA, 25 bp, Rattus norvegicus
ctcggacgggttaatcactgcaaaa

SEQ ID NO: 583281 - DNA, 25 bp, Rattus norvegicus
tgccctcccgggcacaataaagtgg

SEQ ID NO: 583282 - DNA, 25 bp, Rattus norvegicus
gtgactccggaaggccgtaggctcc

SEQ ID NO: 583283 - DNA, 25 bp, Rattus norvegicus
tcgccttttgtttgctttgtgctgg

SEQ ID NO: 583284 - DNA, 25 bp, Rattus norvegicus
cgctgctctcgctcgccttttgttt

SEQ ID NO: 583285 - DNA, 25 bp, Rattus norvegicus
actcgcggacggaatcgcaggcccg

SEQ ID NO: 583286 - DNA, 25 bp, Rattus norvegicus
gcacaataaagtggggcgcgagcca

SEQ ID NO: 583287 - DNA, 25 bp, Rattus norvegicus
cagagtttacttgctcgtgcgccgc

SEQ ID NO: 583288 - DNA, 25 bp, Rattus norvegicus
gctgtgctcagagtttacttgctcg

SEQ ID NO: 583289 - DNA, 25 bp, Rattus norvegicus
aaaccaacttctctcggagacgcac

SEQ ID NO: 583290 - DNA, 25 bp, Rattus norvegicus
gctctgcctagagccggggaagctc

SEQ ID NO: 583291 - DNA, 25 bp, Rattus norvegicus
cgagtggttccagttcactggttcc

SEQ ID NO: 583292 - DNA, 25 bp, Rattus norvegicus
ccgccgcgagtggttccagttcact

SEQ ID NO: 583293 - DNA, 25 bp, Rattus norvegicus
gcgcgctgtgcattgtgggaatccc

SEQ ID NO: 583294 - DNA, 25 bp, Rattus norvegicus
cctggggaccactcgcggacggaat

SEQ ID NO: 583295 - DNA, 25 bp, Rattus norvegicus
catccgcttaccaaaaacttgcagc

SEQ ID NO: 583296 - DNA, 25 bp, Rattus norvegicus
tggagacatttccaggcggagcacc

SEQ ID NO: 583297 - DNA, 25 bp, Rattus norvegicus
agaacgtactcagggcgtccaagtg

SEQ ID NO: 583298 - DNA, 25 bp, Rattus norvegicus
atcccgtatccggatgccgggtcct

SEQ ID NO: 583299 - DNA, 25 bp, Rattus norvegicus
cggcgctgcccaaggaaggaaagaa

SEQ ID NO: 583300 - DNA, 25 bp, Rattus norvegicus
cttgcagcaaatacagcgacctcca

SEQ ID NO: 583301 - DNA, 25 bp, Rattus norvegicus
cggggagcaagcgacaactaatgga

SEQ ID NO: 583302 - DNA, 25 bp, Rattus norvegicus
ccctgtctgctagaagcaaactttg

SEQ ID NO: 583303 - DNA, 25 bp, Rattus norvegicus
tccggctcaagagcgatcctcgcaa

SEQ ID NO: 583304 - DNA, 25 bp, Rattus norvegicus
ctcgcaaagtttgagcggcagagcc

SEQ ID NO: 583305 - DNA, 25 bp, Rattus norvegicus
agcggcagagccaattccttacctg

SEQ ID NO: 583306 - DNA, 25 bp, Rattus norvegicus
tacctgcgctaggaaagagccggcc

SEQ ID NO: 583307 - DNA, 25 bp, Rattus norvegicus
gcgtccaagtgcacaagctgttcta

SEQ ID NO: 583308 - DNA, 25 bp, Rattus norvegicus
aagctgttctatccctcgcaagcca

SEQ ID NO: 583309 - DNA, 25 bp, Rattus norvegicus
cgccatcgaggcagcacgagcaact

SEQ ID NO: 583310 - DNA, 25 bp, Rattus norvegicus
tcgttagttcgttaggcagcaatgc

SEQ ID NO: 583311 - DNA, 25 bp, Rattus norvegicus
agcttcgcgtcacaagggtattttc

SEQ ID NO: 583312 - DNA, 25 bp, Rattus norvegicus
acatgagggcctacggaacacagtg

SEQ ID NO: 583313 - DNA, 25 bp, Rattus norvegicus
aaccctggaagcctctggcagtgca

SEQ ID NO: 583314 - DNA, 25 bp, Rattus norvegicus
acggtctcaggcacagcaaaggcgc

SEQ ID NO: 583315 - DNA, 25 bp, Rattus norvegicus
caattgtgtccggtgcacggtctca

SEQ ID NO: 583316 - DNA, 25 bp, Rattus norvegicus
cgaatgctaactcacctacgggtgg

SEQ ID NO: 583317 - DNA, 25 bp, Rattus norvegicus
cttgcgcgttgggatgtaacgaacc

SEQ ID NO: 583318 - DNA, 25 bp, Rattus norvegicus
acgagcaactggttcctgcagcccg

SEQ ID NO: 583319 - DNA, 25 bp, Rattus norvegicus
agtccagtgcttgttggcttcagcg

SEQ ID NO: 583320 - DNA, 25 bp, Rattus norvegicus
acagagctgccctggtacggtaaga

SEQ ID NO: 583321 - DNA, 25 bp, Rattus norvegicus
aacgaaccggcggagacccacactg

SEQ ID NO: 583322 - DNA, 25 bp, Rattus norvegicus
tggatcacgccatcaccgaatgcta

SEQ ID NO: 583323 - DNA, 25 bp, Rattus norvegicus
gacactgctgggagctgcggcaaca

SEQ ID NO: 583324 - DNA, 25 bp, Rattus norvegicus
cccggctctgccactgccctgacgc

SEQ ID NO: 583325 - DNA, 25 bp, Rattus norvegicus
ttaagctgttctcgccagcggccgg

SEQ ID NO: 583326 - DNA, 25 bp, Rattus norvegicus
actgccctgacgctggctctgaggc

SEQ ID NO: 583327 - DNA, 25 bp, Rattus norvegicus
tgacgctggctctgaggcgccgtca

SEQ ID NO: 583328 - DNA, 25 bp, Rattus norvegicus
ggcgccgtcacagagtgatcctgct

SEQ ID NO: 583329 - DNA, 25 bp, Rattus norvegicus
agtgatcctgctcggcgaaccttca

SEQ ID NO: 583330 - DNA, 25 bp, Rattus norvegicus
gctcggcgaaccttcactcatctta

SEQ ID NO: 583331 - DNA, 25 bp, Rattus norvegicus
agctgcggcaacagggaactggccc

SEQ ID NO: 583332 - DNA, 25 bp, Rattus norvegicus
gcgaaccttcactcatcttaagctg

SEQ ID NO: 583333 - DNA, 25 bp, Rattus norvegicus
ttcactcatcttaagctgttctcgc

SEQ ID NO: 583334 - DNA, 25 bp, Rattus norvegicus
aggctgcccctcgaggacactgctg

SEQ ID NO: 583335 - DNA, 25 bp, Rattus norvegicus
atcttaagctgttctcgccagcggc

SEQ ID NO: 583336 - DNA, 25 bp, Rattus norvegicus
gttcctgggagaagcgactggggaa

SEQ ID NO: 583337 - DNA, 25 bp, Rattus norvegicus
gccgatctgccaggtaagagcgccc

SEQ ID NO: 583338 - DNA, 25 bp, Rattus norvegicus
gcggaaatttacacacgcgtttgca

SEQ ID NO: 583339 - DNA, 25 bp, Rattus norvegicus
cgacctgacggtgaacgcggaaatt

SEQ ID NO: 583340 - DNA, 25 bp, Rattus norvegicus
ttcccttggtctcgacctgacggtg

SEQ ID NO: 583341 - DNA, 25 bp, Rattus norvegicus
ctcggcagcgaggagctttcttttt

SEQ ID NO: 583342 - DNA, 25 bp, Rattus norvegicus
tacacacgcgtttgcaacgcacacg

SEQ ID NO: 583343 - DNA, 25 bp, Rattus norvegicus
catccgacgccgatctgccaggtaa

SEQ ID NO: 583344 - DNA, 25 bp, Rattus norvegicus
aactcagccagcgagtcatccgacg

SEQ ID NO: 583345 - DNA, 25 bp, Rattus norvegicus
cgggagccgctggagaactcagcca

SEQ ID NO: 583346 - DNA, 25 bp, Rattus norvegicus
agaaaccggcctcgaatcgggactg

SEQ ID NO: 583347 - DNA, 25 bp, Rattus norvegicus
gagccttagaaaccggcctcgaatc

SEQ ID NO: 583348 - DNA, 25 bp, Rattus norvegicus
ttcagacagactctgcgggctccga

SEQ ID NO: 583349 - DNA, 25 bp, Rattus norvegicus
gcgcgcactgtcgttttcagacaga

SEQ ID NO: 583350 - DNA, 25 bp, Rattus norvegicus
gcagcgaggagctttcttttttccc

SEQ ID NO: 583351 - DNA, 25 bp, Rattus norvegicus
acgctctagctgacacgcgggaaca

SEQ ID NO: 583352 - DNA, 25 bp, Rattus norvegicus
cggacgactgcagaagggactccca

SEQ ID NO: 583353 - DNA, 25 bp, Rattus norvegicus
taccgaccaggcacggacgactgca

SEQ ID NO: 583354 - DNA, 25 bp, Rattus norvegicus
tgctacaatcgcagcggcctagcgc

SEQ ID NO: 583355 - DNA, 25 bp, Rattus norvegicus
ctgttctccgtgctacaatcgcagc

SEQ ID NO: 583356 - DNA, 25 bp, Rattus norvegicus
aggacgttgagcagcgccctgttct

SEQ ID NO: 583357 - DNA, 25 bp, Rattus norvegicus
catgccctgccagcggggacagacg

SEQ ID NO: 583358 - DNA, 25 bp, Rattus norvegicus
aacgcgtacagagcggaagaagccc

SEQ ID NO: 583359 - DNA, 25 bp, Rattus norvegicus
tgactggccgcgaagaacgcgtaca

SEQ ID NO: 583360 - DNA, 25 bp, Rattus norvegicus
tccacacgacctgaactcacgagtt

SEQ ID NO: 583361 - DNA, 25 bp, Rattus norvegicus
ctaggacggcggaggcccacatctc

SEQ ID NO: 583362 - DNA, 25 bp, Rattus norvegicus
tgcagaagggactcccaggaccaga

SEQ ID NO: 583363 - DNA, 25 bp, Rattus norvegicus
ctcacgagttcccttcgagggtgtg

SEQ ID NO: 583364 - DNA, 25 bp, Rattus norvegicus
cacatctcggtgatgactggccgcg

SEQ ID NO: 583365 - DNA, 25 bp, Rattus norvegicus
gcttagacttaactctgacctcgcg

SEQ ID NO: 583366 - DNA, 25 bp, Rattus norvegicus
gctggcactcggtagcttagactta

SEQ ID NO: 583367 - DNA, 25 bp, Rattus norvegicus
caacctcactgagccgcgagtgcgg

SEQ ID NO: 583368 - DNA, 25 bp, Rattus norvegicus
acatgagcatgagagaggagatcgc

SEQ ID NO: 583369 - DNA, 25 bp, Rattus norvegicus
ccgctacccggacatgagcatgaga

SEQ ID NO: 583370 - DNA, 25 bp, Rattus norvegicus
ccaaaggaaccgctacccggacatg

SEQ ID NO: 583371 - DNA, 25 bp, Rattus norvegicus
ttcacaagccagcagttgcaagagc

SEQ ID NO: 583372 - DNA, 25 bp, Rattus norvegicus
ggcgtcaacgcactcacttcacaag

SEQ ID NO: 583373 - DNA, 25 bp, Rattus norvegicus
gcggaagacccagccaagaagaaga

SEQ ID NO: 583374 - DNA, 25 bp, Rattus norvegicus
tacctgctgcagacaaggagcgcgg

SEQ ID NO: 583375 - DNA, 25 bp, Rattus norvegicus
gcctgttcctacctgctgcagacaa

SEQ ID NO: 583376 - DNA, 25 bp, Rattus norvegicus
ttagcttgaggtgactcgcgcctgt

SEQ ID NO: 583377 - DNA, 25 bp, Rattus norvegicus
accgggtgcaatagtgttagcttga

SEQ ID NO: 583378 - DNA, 25 bp, Rattus norvegicus
agaagaagaaacagcggcgtcaacg

SEQ ID NO: 583379 - DNA, 25 bp, Rattus norvegicus
agttcagcggcttggtgcagcccta

SEQ ID NO: 583380 - DNA, 25 bp, Rattus norvegicus
aacaacatcaacaacctcacgggct

SEQ ID NO: 583381 - DNA, 25 bp, Rattus norvegicus
gtggccctgacgtttctcccgctgg

SEQ ID NO: 583382 - DNA, 25 bp, Rattus norvegicus
aaccggcgagccaagtggcgcaaga

SEQ ID NO: 583383 - DNA, 25 bp, Rattus norvegicus
ctacgtgccgcagttcagcggcttg

SEQ ID NO: 583384 - DNA, 25 bp, Rattus norvegicus
tgcagccctacgaggacgtgtacgc

SEQ ID NO: 583385 - DNA, 25 bp, Rattus norvegicus
gccggctactcctacaacaactggg

SEQ ID NO: 583386 - DNA, 25 bp, Rattus norvegicus
caactgggccgccaagagcttggca

SEQ ID NO: 583387 - DNA, 25 bp, Rattus norvegicus
cttcttcaactccatgagtccgcta

SEQ ID NO: 583388 - DNA, 25 bp, Rattus norvegicus
gagtccgctatcctctcagtccatg

SEQ ID NO: 583389 - DNA, 25 bp, Rattus norvegicus
tatcctctcagtccatgttctcggc

SEQ ID NO: 583390 - DNA, 25 bp, Rattus norvegicus
atgccatccagcatgggcccgggct

SEQ ID NO: 583391 - DNA, 25 bp, Rattus norvegicus
aactcgggcctcaacaacatcaaca

SEQ ID NO: 583392 - DNA, 25 bp, Rattus norvegicus
cggaaccagcagttggacctgtgca

SEQ ID NO: 583393 - DNA, 25 bp, Rattus norvegicus
ccactacaccaaggggatgtggcgt

SEQ ID NO: 583394 - DNA, 25 bp, Rattus norvegicus
cgaggcaccctctcctagcctgggc

SEQ ID NO: 583395 - DNA, 25 bp, Rattus norvegicus
ttcacccgatcaaaaacccgaggca

SEQ ID NO: 583396 - DNA, 25 bp, Rattus norvegicus
ggccctgggatcgttcacccgatca

SEQ ID NO: 583397 - DNA, 25 bp, Rattus norvegicus
agcctggaggccctgggatcgttca

SEQ ID NO: 583398 - DNA, 25 bp, Rattus norvegicus
ccgtgaactgaatgtagggagcctg

SEQ ID NO: 583399 - DNA, 25 bp, Rattus norvegicus
agcctgggccgtccgagtgcatgca

SEQ ID NO: 583400 - DNA, 25 bp, Rattus norvegicus
cgcctcaacccgtgaactgaatgta

SEQ ID NO: 583401 - DNA, 25 bp, Rattus norvegicus
cggagcgcctcaacccgtgaactga

SEQ ID NO: 583402 - DNA, 25 bp, Rattus norvegicus
aagacgccgttcgtccctgccggag

SEQ ID NO: 583403 - DNA, 25 bp, Rattus norvegicus
agccagcgccaaagtggctcggaga

SEQ ID NO: 583404 - DNA, 25 bp, Rattus norvegicus
aactgtccactacaccaaggggatg

SEQ ID NO: 583405 - DNA, 25 bp, Rattus norvegicus
caggtggtgcgttcgaaccctcgac

SEQ ID NO: 583406 - DNA, 25 bp, Rattus norvegicus
caaagtggctcggagaagacgccgt

SEQ ID NO: 583407 - DNA, 25 bp, Rattus norvegicus
ccctgaagcccgaagaggttctctc

SEQ ID NO: 583408 - DNA, 25 bp, Rattus norvegicus
gccactccaggctcggcatagtact

SEQ ID NO: 583409 - DNA, 25 bp, Rattus norvegicus
tcggcatagtactcctcttcccgat

SEQ ID NO: 583410 - DNA, 25 bp, Rattus norvegicus
tggaagccgcctgcaccctgaagcc

SEQ ID NO: 583411 - DNA, 25 bp, Rattus norvegicus
gggaatcaccgacagcaccaccatg

SEQ ID NO: 583412 - DNA, 25 bp, Rattus norvegicus
aagaggttctctcggccaccgcagc

SEQ ID NO: 583413 - DNA, 25 bp, Rattus norvegicus
ggcctcggtgctccgttggtcctca

SEQ ID NO: 583414 - DNA, 25 bp, Rattus norvegicus
cctgcgcactgcaggtgccatcgtg

SEQ ID NO: 583415 - DNA, 25 bp, Rattus norvegicus
cactgcaggtgccatcgtgggcctc

SEQ ID NO: 583416 - DNA, 25 bp, Rattus norvegicus
atcaccgacagcaccaccatgggat

SEQ ID NO: 583417 - DNA, 25 bp, Rattus norvegicus
caggctcggcatagtactcctcttc

SEQ ID NO: 583418 - DNA, 25 bp, Rattus norvegicus
gcgggtcttcgtctccctgcgcact

SEQ ID NO: 583419 - DNA, 25 bp, Rattus norvegicus
tcttcccgatcctggaagccgcctg

SEQ ID NO: 583420 - DNA, 25 bp, Rattus norvegicus
cggtgctccgttggtcctcagctgc

SEQ ID NO: 583421 - DNA, 25 bp, Rattus norvegicus
aagtgccttcgctcggccaggtccg

SEQ ID NO: 583422 - DNA, 25 bp, Rattus norvegicus
caaagggtagccggtcaggcctgct

SEQ ID NO: 583423 - DNA, 25 bp, Rattus norvegicus
acgcaagtgccttcgctcggccagg

SEQ ID NO: 583424 - DNA, 25 bp, Rattus norvegicus
ttgccaccagcataggagttgcatg

SEQ ID NO: 583425 - DNA, 25 bp, Rattus norvegicus
cgcgggccggaaggcccagcaccca

SEQ ID NO: 583426 - DNA, 25 bp, Rattus norvegicus
cacagcagtatttgccaccagcata

SEQ ID NO: 583427 - DNA, 25 bp, Rattus norvegicus
caccagcataggagttgcatggcgc

SEQ ID NO: 583428 - DNA, 25 bp, Rattus norvegicus
acagccaccgcggtggaagacaacc

SEQ ID NO: 583429 - DNA, 25 bp, Rattus norvegicus
ggtggaagacaaccggcgcacagca

SEQ ID NO: 583430 - DNA, 25 bp, Rattus norvegicus
cggcgcacagcaaccggagtcgcgc

SEQ ID NO: 583431 - DNA, 25 bp, Rattus norvegicus
cgggccgccatgttgactcctggca

SEQ ID NO: 583432 - DNA, 25 bp, Rattus norvegicus
ccatgttgactcctggcagccgcgg

SEQ ID NO: 583433 - DNA, 25 bp, Rattus norvegicus
agactcggcctccactgcccaccgc

SEQ ID NO: 583434 - DNA, 25 bp, Rattus norvegicus
cataggagttgcatggcgcgcgaca

SEQ ID NO: 583435 - DNA, 25 bp, Rattus norvegicus
ccctgcctcgcgagaagtttagata

SEQ ID NO: 583436 - DNA, 25 bp, Rattus norvegicus
tcccgctgttgttttccagaagccg

SEQ ID NO: 583437 - DNA, 25 bp, Rattus norvegicus
caggcaacgtttgaatcccgctgtt

SEQ ID NO: 583438 - DNA, 25 bp, Rattus norvegicus
actcggtgacgcaggcaacgtttga

SEQ ID NO: 583439 - DNA, 25 bp, Rattus norvegicus
tctcagatcacaggattactcggtg

SEQ ID NO: 583440 - DNA, 25 bp, Rattus norvegicus
accactcggtagatttctcagatca

SEQ ID NO: 583441 - DNA, 25 bp, Rattus norvegicus
gaaattccgatggtcctaccactcg

SEQ ID NO: 583442 - DNA, 25 bp, Rattus norvegicus
gagcggttagcctaggtgaaattcc

SEQ ID NO: 583443 - DNA, 25 bp, Rattus norvegicus
ccgcctaaatatcgcgagaccggtc

SEQ ID NO: 583444 - DNA, 25 bp, Rattus norvegicus
tgcggcccagtccagtcacggcaga

SEQ ID NO: 583445 - DNA, 25 bp, Rattus norvegicus
tctaccgcagctcgagggcgagcct

SEQ ID NO: 583446 - DNA, 25 bp, Rattus norvegicus
catcctaactggaacccgaagcgtt

SEQ ID NO: 583447 - DNA, 25 bp, Rattus norvegicus
cagaagccgttttcacggctgtttc

SEQ ID NO: 583448 - DNA, 25 bp, Rattus norvegicus
cctttgtcttctctgcgctccttaa

SEQ ID NO: 583449 - DNA, 25 bp, Rattus norvegicus
tgcgcagaccggtgaagaggacaaa

SEQ ID NO: 583450 - DNA, 25 bp, Rattus norvegicus
tgcccatgctgccagccagcggaag

SEQ ID NO: 583451 - DNA, 25 bp, Rattus norvegicus
cagtccaggcgaccagatgctcagc

SEQ ID NO: 583452 - DNA, 25 bp, Rattus norvegicus
ctcgaaccggtggttgcaagtcgac

SEQ ID NO: 583453 - DNA, 25 bp, Rattus norvegicus
gtctgttcccgctcagggctcgaac

SEQ ID NO: 583454 - DNA, 25 bp, Rattus norvegicus
aggcaccaagtcctcacagtaccga

SEQ ID NO: 583455 - DNA, 25 bp, Rattus norvegicus
cccgcacgtgcttttaaatgactta

SEQ ID NO: 583456 - DNA, 25 bp, Rattus norvegicus
cgcagaaacagagtgaaccgggtca

SEQ ID NO: 583457 - DNA, 25 bp, Rattus norvegicus
ctcgcgcgcaccaaagtaaactagg

SEQ ID NO: 583458 - DNA, 25 bp, Rattus norvegicus
agctccagcagtgaccgccatcaga

SEQ ID NO: 583459 - DNA, 25 bp, Rattus norvegicus
gcgtggccaacgaaaacaggatgtg

SEQ ID NO: 583460 - DNA, 25 bp, Rattus norvegicus
gcggcagcctggtttcccagcgcaa

SEQ ID NO: 583461 - DNA, 25 bp, Rattus norvegicus
tgacttagggagagaagacctcgcg

SEQ ID NO: 583462 - DNA, 25 bp, Rattus norvegicus
gccctacgaaatggccaaagctcca

SEQ ID NO: 583463 - DNA, 25 bp, Rattus norvegicus
cctgagattaaagcgagaattctga

SEQ ID NO: 583464 - DNA, 25 bp, Rattus norvegicus
agtgcggggcccaatagtcagcagc

SEQ ID NO: 583465 - DNA, 25 bp, Rattus norvegicus
tgccgcggccagactgtgagagtgc

SEQ ID NO: 583466 - DNA, 25 bp, Rattus norvegicus
gggccttctgccctgttggctgccg

SEQ ID NO: 583467 - DNA, 25 bp, Rattus norvegicus
tggagggccttctgccctgttggct

SEQ ID NO: 583468 - DNA, 25 bp, Rattus norvegicus
gctctaatgaaacccggcctgtgga

SEQ ID NO: 583469 - DNA, 25 bp, Rattus norvegicus
atcggctctaatgaaacccggcctg

SEQ ID NO: 583470 - DNA, 25 bp, Rattus norvegicus
ctgataaatcggctctaatgaaacc

SEQ ID NO: 583471 - DNA, 25 bp, Rattus norvegicus
gaattctgataaatcggctctaatg

SEQ ID NO: 583472 - DNA, 25 bp, Rattus norvegicus
cgagaattctgataaatcggctcta

SEQ ID NO: 583473 - DNA, 25 bp, Rattus norvegicus
gggcccacctgagattaaagcgaga

SEQ ID NO: 583474 - DNA, 25 bp, Rattus norvegicus
cccgggcccacctgagattaaagcg

SEQ ID NO: 583475 - DNA, 25 bp, Rattus norvegicus
gcaggaggcagcacccgagcgggcc

SEQ ID NO: 583476 - DNA, 25 bp, Rattus norvegicus
ccacctgagattaaagcgagaattc

SEQ ID NO: 583477 - DNA, 25 bp, Rattus norvegicus
aggccgggaaaaggaatggcactca

SEQ ID NO: 583478 - DNA, 25 bp, Rattus norvegicus
gttgcctggaaaaatcaaaacgatg

SEQ ID NO: 583479 - DNA, 25 bp, Rattus norvegicus
ctgcccagcctacgcggcgtctccg

SEQ ID NO: 583480 - DNA, 25 bp, Rattus norvegicus
ctcagagccgcagcctataaggttc

SEQ ID NO: 583481 - DNA, 25 bp, Rattus norvegicus
agccgcagcctataaggttccgttg

SEQ ID NO: 583482 - DNA, 25 bp, Rattus norvegicus
agcctataaggttccgttgcctgga

SEQ ID NO: 583483 - DNA, 25 bp, Rattus norvegicus
tttcctccgggagggcaacattgtg

SEQ ID NO: 583484 - DNA, 25 bp, Rattus norvegicus
agctgcgccgctttcctccgggagg

SEQ ID NO: 583485 - DNA, 25 bp, Rattus norvegicus
gacgcggctcctgccggcttccacc

SEQ ID NO: 583486 - DNA, 25 bp, Rattus norvegicus
ctagattctgcaggaggccgggaaa

SEQ ID NO: 583487 - DNA, 25 bp, Rattus norvegicus
cgtcgggctgctagattctgcagga

SEQ ID NO: 583488 - DNA, 25 bp, Rattus norvegicus
acacagcaggacatggggctccggc

SEQ ID NO: 583489 - DNA, 25 bp, Rattus norvegicus
cttccaccgctcacctgccatcctc

SEQ ID NO: 583490 - DNA, 25 bp, Rattus norvegicus
ggcaacattgtggcgggacacagca

SEQ ID NO: 583491 - DNA, 25 bp, Rattus norvegicus
tgaggttccgacaactcgcacgcct

SEQ ID NO: 583492 - DNA, 25 bp, Rattus norvegicus
ccagcaagagtccaggtgaggttcc

SEQ ID NO: 583493 - DNA, 25 bp, Rattus norvegicus
taaggggcagctcaccttgtcctcg

SEQ ID NO: 583494 - DNA, 25 bp, Rattus norvegicus
ggtctcgtccggaatctcctcaatg

SEQ ID NO: 583495 - DNA, 25 bp, Rattus norvegicus
gcctatgcgcggcagtatctgattg

SEQ ID NO: 583496 - DNA, 25 bp, Rattus norvegicus
ctagctacctggaacgggttgcatc

SEQ ID NO: 583497 - DNA, 25 bp, Rattus norvegicus
gtttgcggccgaaaggacagtgcca

SEQ ID NO: 583498 - DNA, 25 bp, Rattus norvegicus
agtccctagatacaccacgcctatg

SEQ ID NO: 583499 - DNA, 25 bp, Rattus norvegicus
cagctgcgtccggtaatttcctgga

SEQ ID NO: 583500 - DNA, 25 bp, Rattus norvegicus
gcagactgccgagccacgtagacct

SEQ ID NO: 583501 - DNA, 25 bp, Rattus norvegicus
cggcccaagttcgtggagaagatcc

SEQ ID NO: 583502 - DNA, 25 bp, Rattus norvegicus
ctatgtggaaatagagcgcgcctcc

SEQ ID NO: 583503 - DNA, 25 bp, Rattus norvegicus
ctcgatcgaacggatacggaaacta

SEQ ID NO: 583504 - DNA, 25 bp, Rattus norvegicus
taccggagcttgcttgacgcagagc

SEQ ID NO: 583505 - DNA, 25 bp, Rattus norvegicus
tccgcagcacggagagcaacttaag

SEQ ID NO: 583506 - DNA, 25 bp, Rattus norvegicus
gcgcctgcatcatgcgctgctggga

SEQ ID NO: 583507 - DNA, 25 bp, Rattus norvegicus
tactgccaagacgacgggcgcgcca

SEQ ID NO: 583508 - DNA, 25 bp, Rattus norvegicus
cgcgccatttgtgtggtgtgcgacc

SEQ ID NO: 583509 - DNA, 25 bp, Rattus norvegicus
tgcgacccaataggcagctggccgc

SEQ ID NO: 583510 - DNA, 25 bp, Rattus norvegicus
tgtcggtcgagtgtggccacagctt

SEQ ID NO: 583511 - DNA, 25 bp, Rattus norvegicus
catctgcctagagtttttccgggaa

SEQ ID NO: 583512 - DNA, 25 bp, Rattus norvegicus
cacctgctccatctgcctagagttt

SEQ ID NO: 583513 - DNA, 25 bp, Rattus norvegicus
gcagagctccaaggcgaggccacct

SEQ ID NO: 583514 - DNA, 25 bp, Rattus norvegicus
ctcggaagtaccaaggacacggatg

SEQ ID NO: 583515 - DNA, 25 bp, Rattus norvegicus
cccagcaccacaaggctcggaagta

SEQ ID NO: 583516 - DNA, 25 bp, Rattus norvegicus
gcttggaccgtagcatccagggatc

SEQ ID NO: 583517 - DNA, 25 bp, Rattus norvegicus
tcgcccattgggtactcggagccca

SEQ ID NO: 583518 - DNA, 25 bp, Rattus norvegicus
agcaacttaagctctactgccaaga

SEQ ID NO: 583519 - DNA, 25 bp, Rattus norvegicus
cctcaggtaggaccgagcaagacga

SEQ ID NO: 583520 - DNA, 25 bp, Rattus norvegicus
caggccctcaggtaggaccgagcaa

SEQ ID NO: 583521 - DNA, 25 bp, Rattus norvegicus
ggcgcggactcagcgtgccctctga

SEQ ID NO: 583522 - DNA, 25 bp, Rattus norvegicus
aggtgcctgcggagcaggatcgcga

SEQ ID NO: 583523 - DNA, 25 bp, Rattus norvegicus
cgagaggcagcatgactcggaggcg

SEQ ID NO: 583524 - DNA, 25 bp, Rattus norvegicus
cgccatattggctgttgtcctgtga

SEQ ID NO: 583525 - DNA, 25 bp, Rattus norvegicus
cctctgacctgttggcagcaggcgg

SEQ ID NO: 583526 - DNA, 25 bp, Rattus norvegicus
cgtgccctctgacctgttggcagca

SEQ ID NO: 583527 - DNA, 25 bp, Rattus norvegicus
cgccaccaagcctggaagcgggagc

SEQ ID NO: 583528 - DNA, 25 bp, Rattus norvegicus
tggcttcaggccctcaggtaggacc

SEQ ID NO: 583529 - DNA, 25 bp, Rattus norvegicus
gagcaagacgactccgactgcccgt

SEQ ID NO: 583530 - DNA, 25 bp, Rattus norvegicus
cgactgcccgtctgcttacacctcc

SEQ ID NO: 583531 - DNA, 25 bp, Rattus norvegicus
gtaggaccgagcaagacgactccga

SEQ ID NO: 583532 - DNA, 25 bp, Rattus norvegicus
catattggctgttgtcctgtgaggg

SEQ ID NO: 583533 - DNA, 25 bp, Rattus norvegicus
tgttacttcacgcagacgaggcatc

SEQ ID NO: 583534 - DNA, 25 bp, Rattus norvegicus
cggcggagggtattccaacagattc

SEQ ID NO: 583535 - DNA, 25 bp, Rattus norvegicus
ccaggacttgaatcttctgcgcatg

SEQ ID NO: 583536 - DNA, 25 bp, Rattus norvegicus
tctgcgcatgtctcaaacgttcccg

SEQ ID NO: 583537 - DNA, 25 bp, Rattus norvegicus
cacaaggcttcgctagactctttca

SEQ ID NO: 583538 - DNA, 25 bp, Rattus norvegicus
cctacgcgctagaagaagattgtcc

SEQ ID NO: 583539 - DNA, 25 bp, Rattus norvegicus
agattgtcccagttcgcgatccggc

SEQ ID NO: 583540 - DNA, 25 bp, Rattus norvegicus
ttgctaggcgacgacagccgttttt

SEQ ID NO: 583541 - DNA, 25 bp, Rattus norvegicus
agccgttttttccatgccgattgga

SEQ ID NO: 583542 - DNA, 25 bp, Rattus norvegicus
tcagatgaggcgtggttttttcagc

SEQ ID NO: 583543 - DNA, 25 bp, Rattus norvegicus
gcctacgatggaggagtcggaaccc

SEQ ID NO: 583544 - DNA, 25 bp, Rattus norvegicus
cagtacccttgggacgtggttctga

SEQ ID NO: 583545 - DNA, 25 bp, Rattus norvegicus
tgaacctgagttccggacagacgtg

SEQ ID NO: 583546 - DNA, 25 bp, Rattus norvegicus
gacgaggcatcattctgcgagcacc

SEQ ID NO: 583547 - DNA, 25 bp, Rattus norvegicus
tctgtccactcgcttggcctgggga

SEQ ID NO: 583548 - DNA, 25 bp, Rattus norvegicus
gcgggagacgaagggaaacagagtc

SEQ ID NO: 583549 - DNA, 25 bp, Rattus norvegicus
agattcactcggctggctcgggccg

SEQ ID NO: 583550 - DNA, 25 bp, Rattus norvegicus
tgtgccagattcactcggctggctc

SEQ ID NO: 583551 - DNA, 25 bp, Rattus norvegicus
gtcgtggagtgtgccagattcactc

SEQ ID NO: 583552 - DNA, 25 bp, Rattus norvegicus
ctacggggtcccatggactgctgag

SEQ ID NO: 583553 - DNA, 25 bp, Rattus norvegicus
tgggctgcatcctacggggtcccat

SEQ ID NO: 583554 - DNA, 25 bp, Rattus norvegicus
agccgggcattcaggtaccggcgtc

SEQ ID NO: 583555 - DNA, 25 bp, Rattus norvegicus
gcccagccgggcattcaggtaccgg

SEQ ID NO: 583556 - DNA, 25 bp, Rattus norvegicus
tcagagcgcagcggcggatcccagc

SEQ ID NO: 583557 - DNA, 25 bp, Rattus norvegicus
tcacgttggcaagggaacatcgtgc

SEQ ID NO: 583558 - DNA, 25 bp, Rattus norvegicus
cgggctcaaaatgcgcggcgtccgc

SEQ ID NO: 583559 - DNA, 25 bp, Rattus norvegicus
aaacagagtcacgttggcaagggaa

SEQ ID NO: 583560 - DNA, 25 bp, Rattus norvegicus
ccttccgcgggctcaaaatgcgcgg

SEQ ID NO: 583561 - DNA, 25 bp, Rattus norvegicus
tcgctctcagcgctgcagaggctct

SEQ ID NO: 583562 - DNA, 25 bp, Rattus norvegicus
ttcgccaccttcgagcgggcgagga

SEQ ID NO: 583563 - DNA, 25 bp, Rattus norvegicus
gtgcacgggccagccaagggcacct

SEQ ID NO: 583564 - DNA, 25 bp, Rattus norvegicus
cacagcacaaaggaaagctagggcg

SEQ ID NO: 583565 - DNA, 25 bp, Rattus norvegicus
tcccaccctgcctcccttcacgggc

SEQ ID NO: 583566 - DNA, 25 bp, Rattus norvegicus
ccacgcggatgtggagcccagacct

SEQ ID NO: 583567 - DNA, 25 bp, Rattus norvegicus
gccagccacgcggatgtggagccca

SEQ ID NO: 583568 - DNA, 25 bp, Rattus norvegicus
ccgaaatggtgcaacggcccgggag

SEQ ID NO: 583569 - DNA, 25 bp, Rattus norvegicus
atggccggcgtcagcttcagcggcc

SEQ ID NO: 583570 - DNA, 25 bp, Rattus norvegicus
gtgcgtctgtccgttcggcctccgt

SEQ ID NO: 583571 - DNA, 25 bp, Rattus norvegicus
ggcggcgactccctcattccctccc

SEQ ID NO: 583572 - DNA, 25 bp, Rattus norvegicus
cggccgggccacagcacaaaggaaa

SEQ ID NO: 583573 - DNA, 25 bp, Rattus norvegicus
cgggccacagcacaaaggaaagcta

SEQ ID NO: 583574 - DNA, 25 bp, Rattus norvegicus
tcggtccgcccgtgcgtgcgtctgt

SEQ ID NO: 583575 - DNA, 25 bp, Rattus norvegicus
gcttgcctgccagagcgcagcctta

SEQ ID NO: 583576 - DNA, 25 bp, Rattus norvegicus
ggcaactgtggttccctctcctttc

SEQ ID NO: 583577 - DNA, 25 bp, Rattus norvegicus
agtgtccgtgagcacctcgctgtag

SEQ ID NO: 583578 - DNA, 25 bp, Rattus norvegicus
gtagcacggcggcttagacatgtcc

SEQ ID NO: 583579 - DNA, 25 bp, Rattus norvegicus
agacatgtccgattccgctgcggaa

SEQ ID NO: 583580 - DNA, 25 bp, Rattus norvegicus
gcagccttaccttggcgcggatagc

SEQ ID NO: 583581 - DNA, 25 bp, Rattus norvegicus
ggcgcgcaggttctgctccctcagt

SEQ ID NO: 583582 - DNA, 25 bp, Rattus norvegicus
agtcgctcctcctggcgccgtttga

SEQ ID NO: 583583 - DNA, 25 bp, Rattus norvegicus
gcagcagagcaggacgatgagaccc

SEQ ID NO: 583584 - DNA, 25 bp, Rattus norvegicus
gaacgtgtaggtgccctgggacatc

SEQ ID NO: 583585 - DNA, 25 bp, Rattus norvegicus
cggcaggtcctcgtcagctttactg

SEQ ID NO: 583586 - DNA, 25 bp, Rattus norvegicus
tcagctttactggacgctgggctcc

SEQ ID NO: 583587 - DNA, 25 bp, Rattus norvegicus
tgccgccagtgtcactcggggacct

SEQ ID NO: 583588 - DNA, 25 bp, Rattus norvegicus
agccaggctgccctcaagctcgagg

SEQ ID NO: 583589 - DNA, 25 bp, Rattus norvegicus
agccaccctgggagccctgttgcga

SEQ ID NO: 583590 - DNA, 25 bp, Rattus norvegicus
ggctgcccgctgtcccaatcggggt

SEQ ID NO: 583591 - DNA, 25 bp, Rattus norvegicus
tcgcggtactcacgggcccaggcat

SEQ ID NO: 583592 - DNA, 25 bp, Rattus norvegicus
ggagcagacagtggcaacgaaagcc

SEQ ID NO: 583593 - DNA, 25 bp, Rattus norvegicus
ggtcatcggcccgaagaccatcttc

SEQ ID NO: 583594 - DNA, 25 bp, Rattus norvegicus
aagccacccgcagggagggtcatcg

SEQ ID NO: 583595 - DNA, 25 bp, Rattus norvegicus
taccaggctagggttccaagccacc

SEQ ID NO: 583596 - DNA, 25 bp, Rattus norvegicus
tttccaagcgaactggtggcggctc

SEQ ID NO: 583597 - DNA, 25 bp, Rattus norvegicus
ttgctgtggcaacggtttccaagcg

SEQ ID NO: 583598 - DNA, 25 bp, Rattus norvegicus
agagcgatgctctctccacagtgca

SEQ ID NO: 583599 - DNA, 25 bp, Rattus norvegicus
aggcacacccagaccggccagaaga

SEQ ID NO: 583600 - DNA, 25 bp, Rattus norvegicus
agccctgttgcgacgactgcagcca

SEQ ID NO: 583601 - DNA, 25 bp, Rattus norvegicus
ggcaagcggcccagcggacagaacc

SEQ ID NO: 583602 - DNA, 25 bp, Rattus norvegicus
cctcgacgtgctgaggcaggcacac

SEQ ID NO: 583603 - DNA, 25 bp, Rattus norvegicus
agctgccaattagggccgagccttt

SEQ ID NO: 583604 - DNA, 25 bp, Rattus norvegicus
ccggccacctcattggagctcggag

SEQ ID NO: 583605 - DNA, 25 bp, Rattus norvegicus
cggaagggctcatgtatgcgcttaa

SEQ ID NO: 583606 - DNA, 25 bp, Rattus norvegicus
aagcgtcaaccgtgcatctttgcga

SEQ ID NO: 583607 - DNA, 25 bp, Rattus norvegicus
ccaggaggccaaacatacgattgga

SEQ ID NO: 583608 - DNA, 25 bp, Rattus norvegicus
ccaggttcgaatttctaggccttcg

SEQ ID NO: 583609 - DNA, 25 bp, Rattus norvegicus
cgtcgcctctttctggttggactgc

SEQ ID NO: 583610 - DNA, 25 bp, Rattus norvegicus
cccgcgccggactactattggtcag

SEQ ID NO: 583611 - DNA, 25 bp, Rattus norvegicus
tcaatcaatagacgagcggacgctc

SEQ ID NO: 583612 - DNA, 25 bp, Rattus norvegicus
gccctctgtttacttggctcaatca

SEQ ID NO: 583613 - DNA, 25 bp, Rattus norvegicus
tacgatgttctcgagctccatgggc

SEQ ID NO: 583614 - DNA, 25 bp, Rattus norvegicus
tagcaccgtgttcgctacgatgttc

SEQ ID NO: 583615 - DNA, 25 bp, Rattus norvegicus
cttcccgggccttgagtagcaccgt

SEQ ID NO: 583616 - DNA, 25 bp, Rattus norvegicus
cgattggattaagcaagcgtcaacc

SEQ ID NO: 583617 - DNA, 25 bp, Rattus norvegicus
acaatcgctgtgtgtgggcatcacg

SEQ ID NO: 583618 - DNA, 25 bp, Rattus norvegicus
gcgccgccagtgttcttaactctga

SEQ ID NO: 583619 - DNA, 25 bp, Rattus norvegicus
ttaactctgaatgcagccggccacc

SEQ ID NO: 583620 - DNA, 25 bp, Rattus norvegicus
cccaagcccaagttactgggactga

SEQ ID NO: 583621 - DNA, 25 bp, Rattus norvegicus
aagggctacatcagtgcggtgctgc

SEQ ID NO: 583622 - DNA, 25 bp, Rattus norvegicus
gctatcgtgggccactcggacaatc

SEQ ID NO: 583623 - DNA, 25 bp, Rattus norvegicus
ggaccgacacacctttctgcagacg

SEQ ID NO: 583624 - DNA, 25 bp, Rattus norvegicus
ctgctgcgttatccgtgactacctg

SEQ ID NO: 583625 - DNA, 25 bp, Rattus norvegicus
atggcgtactggatgcgcgcaccaa

SEQ ID NO: 583626 - DNA, 25 bp, Rattus norvegicus
ggcgtgcaatctgtgtgggtcacac

SEQ ID NO: 583627 - DNA, 25 bp, Rattus norvegicus
ggcgtgcatggaggcatcctcaata

SEQ ID NO: 583628 - DNA, 25 bp, Rattus norvegicus
cctcaataagacagtgcacgatctg

SEQ ID NO: 583629 - DNA, 25 bp, Rattus norvegicus
tgcacgatctgattggcggattgcg

SEQ ID NO: 583630 - DNA, 25 bp, Rattus norvegicus
tcagcgtatcgatgacgtggctatc

SEQ ID NO: 583631 - DNA, 25 bp, Rattus norvegicus
cagggcccattctcaggactcaaga

SEQ ID NO: 583632 - DNA, 25 bp, Rattus norvegicus
ctggcagcatttagcgggtcccaaa

SEQ ID NO: 583633 - DNA, 25 bp, Rattus norvegicus
agactacagagcttcggcctgggtc

SEQ ID NO: 583634 - DNA, 25 bp, Rattus norvegicus
catatgggtgataactgatggcgcc

SEQ ID NO: 583635 - DNA, 25 bp, Rattus norvegicus
tggcgagccctggaacccacaacag

SEQ ID NO: 583636 - DNA, 25 bp, Rattus norvegicus
tgctgcctctcctgctaggtttctc

SEQ ID NO: 583637 - DNA, 25 bp, Rattus norvegicus
ttctctgggttggaaacctttcatc

SEQ ID NO: 583638 - DNA, 25 bp, Rattus norvegicus
cccgagtagcgcgaaaaatgtctaa

SEQ ID NO: 583639 - DNA, 25 bp, Rattus norvegicus
cgcagttctgcaagtagctttttta

SEQ ID NO: 583640 - DNA, 25 bp, Rattus norvegicus
agccagtcagcgtttccaattcttc

SEQ ID NO: 583641 - DNA, 25 bp, Rattus norvegicus
ccagtaccagtcaggccaagaaacc

SEQ ID NO: 583642 - DNA, 25 bp, Rattus norvegicus
cagatcccggatctctggagctgga

SEQ ID NO: 583643 - DNA, 25 bp, Rattus norvegicus
gcccataggccaagtacgaactctg

SEQ ID NO: 583644 - DNA, 25 bp, Rattus norvegicus
gctattcaccctctgaagcagtgta

SEQ ID NO: 583645 - DNA, 25 bp, Rattus norvegicus
cagcggggatttgacgaagcgcgcg

SEQ ID NO: 583646 - DNA, 25 bp, Rattus norvegicus
gcaccttcctcgcagtgtccgggct

SEQ ID NO: 583647 - DNA, 25 bp, Rattus norvegicus
cgggctcccgaggtgtgaggatcca

SEQ ID NO: 583648 - DNA, 25 bp, Rattus norvegicus
gcctcggccagcaggcactcttggt

SEQ ID NO: 583649 - DNA, 25 bp, Rattus norvegicus
tcggccagcaggcactcttggtaca

SEQ ID NO: 583650 - DNA, 25 bp, Rattus norvegicus
caggcactcttggtacagcggggat

SEQ ID NO: 583651 - DNA, 25 bp, Rattus norvegicus
acgaagcgcgcgtagctgtcgaact

SEQ ID NO: 583652 - DNA, 25 bp, Rattus norvegicus
aagcgcgcgtagctgtcgaacttca

SEQ ID NO: 583653 - DNA, 25 bp, Rattus norvegicus
gcgcgtagctgtcgaacttcatcaa

SEQ ID NO: 583654 - DNA, 25 bp, Rattus norvegicus
gtagctgtcgaacttcatcaaattg

SEQ ID NO: 583655 - DNA, 25 bp, Rattus norvegicus
tcatcaaattgaagatctgctcggc

SEQ ID NO: 583656 - DNA, 25 bp, Rattus norvegicus
tcaaattgaagatctgctcggccag

SEQ ID NO: 583657 - DNA, 25 bp, Rattus norvegicus
aaattgaagatctgctcggccagcg

SEQ ID NO: 583658 - DNA, 25 bp, Rattus norvegicus
gccagcaggcactcttggtacagcg

SEQ ID NO: 583659 - DNA, 25 bp, Rattus norvegicus
agagcctggcaggactatcctcgca

SEQ ID NO: 583660 - DNA, 25 bp, Rattus norvegicus
gcggattctgcgtgtcaccctcgct

SEQ ID NO: 583661 - DNA, 25 bp, Rattus norvegicus
cctcgagtaggatggtagcacgtaa

SEQ ID NO: 583662 - DNA, 25 bp, Rattus norvegicus
tagcacgtaaccaggtggcagccga

SEQ ID NO: 583663 - DNA, 25 bp, Rattus norvegicus
ggtggcagccgacaatgcgatctcc

SEQ ID NO: 583664 - DNA, 25 bp, Rattus norvegicus
gattaccggcgcatcacgcggacca

SEQ ID NO: 583665 - DNA, 25 bp, Rattus norvegicus
cagcagcagagagaactgcggccgt

SEQ ID NO: 583666 - DNA, 25 bp, Rattus norvegicus
acttcgcagatgagcccaccgaggc

SEQ ID NO: 583667 - DNA, 25 bp, Rattus norvegicus
ctatcctcgcagactgcatggcggg

SEQ ID NO: 583668 - DNA, 25 bp, Rattus norvegicus
tcgtggatggctatgcctctggcgc

SEQ ID NO: 583669 - DNA, 25 bp, Rattus norvegicus
accgccagtctggaagggttccaca

SEQ ID NO: 583670 - DNA, 25 bp, Rattus norvegicus
gggttccacatacaggaacggccta

SEQ ID NO: 583671 - DNA, 25 bp, Rattus norvegicus
ggaacggcctacttcgcagatgagc

SEQ ID NO: 583672 - DNA, 25 bp, Rattus norvegicus
gggcctccctggtttaagagcttga

SEQ ID NO: 583673 - DNA, 25 bp, Rattus norvegicus
tgcttcacttcgaagacgataatcg

SEQ ID NO: 583674 - DNA, 25 bp, Rattus norvegicus
tccgtgattggttggatcccttgtc

SEQ ID NO: 583675 - DNA, 25 bp, Rattus norvegicus
caagcggcccgcaaaaactacaagt

SEQ ID NO: 583676 - DNA, 25 bp, Rattus norvegicus
gttccaggatgcttcacttcgaaga

SEQ ID NO: 583677 - DNA, 25 bp, Rattus norvegicus
agacgataatcgctttcctccagcc

SEQ ID NO: 583678 - DNA, 25 bp, Rattus norvegicus
agagacctctgcttttcgttggcca

SEQ ID NO: 583679 - DNA, 25 bp, Rattus norvegicus
ttcgttggccagctagcctaacgtg

SEQ ID NO: 583680 - DNA, 25 bp, Rattus norvegicus
agcctaacgtgctgctccgtgattg

SEQ ID NO: 583681 - DNA, 25 bp, Rattus norvegicus
tggatcccttgtcgctcgtgagaac

SEQ ID NO: 583682 - DNA, 25 bp, Rattus norvegicus
ctcgtgagaacccttggtagtggcc

SEQ ID NO: 583683 - DNA, 25 bp, Rattus norvegicus
aacccttggtagtggccggctgaca

SEQ ID NO: 583684 - DNA, 25 bp, Rattus norvegicus
gcgaccaggaacctccaaagttatg

SEQ ID NO: 583685 - DNA, 25 bp, Rattus norvegicus
cgcaaaaactacaagttccaggatg

SEQ ID NO: 583686 - DNA, 25 bp, Rattus norvegicus
ttgtcgctcgtgagaacccttggta

SEQ ID NO: 583687 - DNA, 25 bp, Rattus norvegicus
cgtggctagcaacatccaggtcctg

SEQ ID NO: 583688 - DNA, 25 bp, Rattus norvegicus
atggtgtgtttcatgccctggcttc

SEQ ID NO: 583689 - DNA, 25 bp, Rattus norvegicus
caacagacgttttcccgacgacact

SEQ ID NO: 583690 - DNA, 25 bp, Rattus norvegicus
gacgacactaacctccctgcaaatg

SEQ ID NO: 583691 - DNA, 25 bp, Rattus norvegicus
ggagggattcccattcgaggaccaa

SEQ ID NO: 583692 - DNA, 25 bp, Rattus norvegicus
tcaaatttgaaacctgcggcttttc

SEQ ID NO: 583693 - DNA, 25 bp, Rattus norvegicus
ggccctctactagtggcaccgtgtc

SEQ ID NO: 583694 - DNA, 25 bp, Rattus norvegicus
gcaccgtgtcagttacattgaaaca

SEQ ID NO: 583695 - DNA, 25 bp, Rattus norvegicus
gtcgccgacatggaacccgtggcta

SEQ ID NO: 583696 - DNA, 25 bp, Rattus norvegicus
gcccgcacatccataggagttcgta

SEQ ID NO: 583697 - DNA, 25 bp, Rattus norvegicus
agatcctggcgccaaaagcctttcc

SEQ ID NO: 583698 - DNA, 25 bp, Rattus norvegicus
aagcctttccttgactacgccgtgc

SEQ ID NO: 583699 - DNA, 25 bp, Rattus norvegicus
cgggctgcatttggctcccaacttg

SEQ ID NO: 583700 - DNA, 25 bp, Rattus norvegicus
aacaaaagtggtaacgcggctgcca

SEQ ID NO: 583701 - DNA, 25 bp, Rattus norvegicus
tcccaggaacttcggagcacgctct

SEQ ID NO: 583702 - DNA, 25 bp, Rattus norvegicus
tggggccctatcagaacgtgagtgc

SEQ ID NO: 583703 - DNA, 25 bp, Rattus norvegicus
atacgtgcacgaccgcttcttggtg

SEQ ID NO: 583704 - DNA, 25 bp, Rattus norvegicus
acgagcctggtggaacgatacgtgc

SEQ ID NO: 583705 - DNA, 25 bp, Rattus norvegicus
acgtcaaggtggttatgctgggcaa

SEQ ID NO: 583706 - DNA, 25 bp, Rattus norvegicus
caccagaagcctgcgaagtgcgagg

SEQ ID NO: 583707 - DNA, 25 bp, Rattus norvegicus
cccagaggtgctgtttggagttagc

SEQ ID NO: 583708 - DNA, 25 bp, Rattus norvegicus
ctcttgtggtccagtcccagaggtg

SEQ ID NO: 583709 - DNA, 25 bp, Rattus norvegicus
ggcagcgaacacttggtcccaggaa

SEQ ID NO: 583710 - DNA, 25 bp, Rattus norvegicus
tggcccaggaaatacttcaccatcg

SEQ ID NO: 583711 - DNA, 25 bp, Rattus norvegicus
ccgtgcagcatcagggtgaagagcc

SEQ ID NO: 583712 - DNA, 25 bp, Rattus norvegicus
cctaccgccgccatgagaggctata

SEQ ID NO: 583713 - DNA, 25 bp, Rattus norvegicus
ggctataggactgcgcgacgcttcc

SEQ ID NO: 583714 - DNA, 25 bp, Rattus norvegicus
tcgggtaccgttgccagaaggcagc

SEQ ID NO: 583715 - DNA, 25 bp, Rattus norvegicus
tcggcatagccgagtcagggtagca

SEQ ID NO: 583716 - DNA, 25 bp, Rattus norvegicus
gagcctttgcagctaccgtgcgcag

SEQ ID NO: 583717 - DNA, 25 bp, Rattus norvegicus
tgcgcaggcctcaagcgagttggcc

SEQ ID NO: 583718 - DNA, 25 bp, Rattus norvegicus
gccttcctggctgcaaacctactga

SEQ ID NO: 583719 - DNA, 25 bp, Rattus norvegicus
tactgagttcgcagctacaaggacc

SEQ ID NO: 583720 - DNA, 25 bp, Rattus norvegicus
gcagcggtcacaatagcgctgcacc

SEQ ID NO: 583721 - DNA, 25 bp, Rattus norvegicus
aaaccgaggcggtcggcatagccga

SEQ ID NO: 583722 - DNA, 25 bp, Rattus norvegicus
caaacatggctgctgccgtcgccga

SEQ ID NO: 583723 - DNA, 25 bp, Rattus norvegicus
ggcagcgctgttggcactcgtcaac

SEQ ID NO: 583724 - DNA, 25 bp, Rattus norvegicus
tggcactcgtcaacactcagcagca

SEQ ID NO: 583725 - DNA, 25 bp, Rattus norvegicus
cactcagcagcaaagcaaagtttgc

SEQ ID NO: 583726 - DNA, 25 bp, Rattus norvegicus
cagctaggcctaaggcccgctggta

SEQ ID NO: 583727 - DNA, 25 bp, Rattus norvegicus
ctacaaggaccaagacaccgggaca

SEQ ID NO: 583728 - DNA, 25 bp, Rattus norvegicus
tagcagcagctgctacagcttgaca

SEQ ID NO: 583729 - DNA, 25 bp, Rattus norvegicus
agccctggggctcccttcaactgga

SEQ ID NO: 583730 - DNA, 25 bp, Rattus norvegicus
gcctcccgcgcctagtgtgggtctg

SEQ ID NO: 583731 - DNA, 25 bp, Rattus norvegicus
gaggggtccactaatccctgcaccg

SEQ ID NO: 583732 - DNA, 25 bp, Rattus norvegicus
ccgcggggacgaagctccttcgtca

SEQ ID NO: 583733 - DNA, 25 bp, Rattus norvegicus
ctggtccagacaccgcggggacgaa

SEQ ID NO: 583734 - DNA, 25 bp, Rattus norvegicus
ttcaactggaggctcgacgcccgcg

SEQ ID NO: 583735 - DNA, 25 bp, Rattus norvegicus
agcagctcgggtctgcctcccagag

SEQ ID NO: 583736 - DNA, 25 bp, Rattus norvegicus
caaaatggaggcagcagctcgggtc

SEQ ID NO: 583737 - DNA, 25 bp, Rattus norvegicus
ccacgacagaccaagctgaacagga

SEQ ID NO: 583738 - DNA, 25 bp, Rattus norvegicus
ccttctcgctgtagggctcacctgg

SEQ ID NO: 583739 - DNA, 25 bp, Rattus norvegicus
tggtttcgacccgaggccaaggcaa

SEQ ID NO: 583740 - DNA, 25 bp, Rattus norvegicus
catcttaggttacagcccgggctcc

SEQ ID NO: 583741 - DNA, 25 bp, Rattus norvegicus
gagacacctggtctggctgaggcct

SEQ ID NO: 583742 - DNA, 25 bp, Rattus norvegicus
gggatgcagcctaacagcgcgcccg

SEQ ID NO: 583743 - DNA, 25 bp, Rattus norvegicus
gactgaaggggcagctcccgagctc

SEQ ID NO: 583744 - DNA, 25 bp, Rattus norvegicus
tgggcaataagtaaccagagcggtg

SEQ ID NO: 583745 - DNA, 25 bp, Rattus norvegicus
ggaaggtgcacgtcaacggtctcca

SEQ ID NO: 583746 - DNA, 25 bp, Rattus norvegicus
aacggtctccatgcggagttgcata

SEQ ID NO: 583747 - DNA, 25 bp, Rattus norvegicus
cggagttgcatagacagctggccca

SEQ ID NO: 583748 - DNA, 25 bp, Rattus norvegicus
ttgcatagacagctggcccatcgcc

SEQ ID NO: 583749 - DNA, 25 bp, Rattus norvegicus
cgcctcggtgggcaataagtaacca

SEQ ID NO: 583750 - DNA, 25 bp, Rattus norvegicus
gtgcgctgcgggttactgatttacc

SEQ ID NO: 583751 - DNA, 25 bp, Rattus norvegicus
ccggcttgcccagagttagagggtc

SEQ ID NO: 583752 - DNA, 25 bp, Rattus norvegicus
cccagagttagagggtcggctccct

SEQ ID NO: 583753 - DNA, 25 bp, Rattus norvegicus
ccgaagagccaggaatgtccctgca

SEQ ID NO: 583754 - DNA, 25 bp, Rattus norvegicus
tgtccctgcaactacagcgtggcgg

SEQ ID NO: 583755 - DNA, 25 bp, Rattus norvegicus
accagagcggtgaccagggtgctct

SEQ ID NO: 583756 - DNA, 25 bp, Rattus norvegicus
ggacaaaaggccctgtgtgcgctgc

SEQ ID NO: 583757 - DNA, 25 bp, Rattus norvegicus
agggtccgcagcctccgtaaaatcg

SEQ ID NO: 583758 - DNA, 25 bp, Rattus norvegicus
ttcacgagagcgagctcggagctcc

SEQ ID NO: 583759 - DNA, 25 bp, Rattus norvegicus
agaaggcaggccatcccgcctcagt

SEQ ID NO: 583760 - DNA, 25 bp, Rattus norvegicus
gccggctgtgcaccggacacagctt

SEQ ID NO: 583761 - DNA, 25 bp, Rattus norvegicus
cggtcgaagcgcactccgtccggtt

SEQ ID NO: 583762 - DNA, 25 bp, Rattus norvegicus
tccggctcctcggagctcttgtaag

SEQ ID NO: 583763 - DNA, 25 bp, Rattus norvegicus
gctcttgtaaggtccggctccacca

SEQ ID NO: 583764 - DNA, 25 bp, Rattus norvegicus
gcgaagtttgggctctgcagatccc

SEQ ID NO: 583765 - DNA, 25 bp, Rattus norvegicus
cgggcacaggacactccatcttttc

SEQ ID NO: 583766 - DNA, 25 bp, Rattus norvegicus
aattccgcagggcagcgagttacga

SEQ ID NO: 583767 - DNA, 25 bp, Rattus norvegicus
atcttttctgcaagccgcgccgttg

SEQ ID NO: 583768 - DNA, 25 bp, Rattus norvegicus
cgcgccgttgaagagctgcgcatgc

SEQ ID NO: 583769 - DNA, 25 bp, Rattus norvegicus
cggccagcaactctcgcgaagtttg

SEQ ID NO: 583770 - DNA, 25 bp, Rattus norvegicus
agcgagttacgaggccctgcaccct

SEQ ID NO: 583771 - DNA, 25 bp, Rattus norvegicus
ttccgaagagttgcggccgctcgcg

SEQ ID NO: 583772 - DNA, 25 bp, Rattus norvegicus
cggccatcgggtgccgcctgtttct

SEQ ID NO: 583773 - DNA, 25 bp, Rattus norvegicus
gcgcgcgttctccactttccgaaga

SEQ ID NO: 583774 - DNA, 25 bp, Rattus norvegicus
gcgttctccactttccgaagagttg

SEQ ID NO: 583775 - DNA, 25 bp, Rattus norvegicus
gtgagtacgcgtcgcctcggcactc

SEQ ID NO: 583776 - DNA, 25 bp, Rattus norvegicus
cttggcggtgagtacgcgtcgcctc

SEQ ID NO: 583777 - DNA, 25 bp, Rattus norvegicus
tggtttcactagttcatcgcccgcc

SEQ ID NO: 583778 - DNA, 25 bp, Rattus norvegicus
ctgtttctcgcggtctgccaggcgg

SEQ ID NO: 583779 - DNA, 25 bp, Rattus norvegicus
gcctcgcagcgagtaggcctctcgg

SEQ ID NO: 583780 - DNA, 25 bp, Rattus norvegicus
cccggctaacggactcccgaggatg

SEQ ID NO: 583781 - DNA, 25 bp, Rattus norvegicus
actcccgaggatggcagctaggcct

SEQ ID NO: 583782 - DNA, 25 bp, Rattus norvegicus
ggatggcagctaggcctgccgcctc

SEQ ID NO: 583783 - DNA, 25 bp, Rattus norvegicus
cgttacttggcgtgttttgtagttg

SEQ ID NO: 583784 - DNA, 25 bp, Rattus norvegicus
gcgtgttttgtagttggtttcacta

SEQ ID NO: 583785 - DNA, 25 bp, Rattus norvegicus
cacagagtggcgcaggctgttttct

SEQ ID NO: 583786 - DNA, 25 bp, Rattus norvegicus
tgccgggttggtgcagctccggctc

SEQ ID NO: 583787 - DNA, 25 bp, Rattus norvegicus
tggcgcaggctgttttctggacatt

SEQ ID NO: 583788 - DNA, 25 bp, Rattus norvegicus
ttttctggacattctgcccctcaca

SEQ ID NO: 583789 - DNA, 25 bp, Rattus norvegicus
cccgttgagaggtgccgggttggtg

SEQ ID NO: 583790 - DNA, 25 bp, Rattus norvegicus
gctccggctccgtttctgccagcca

SEQ ID NO: 583791 - DNA, 25 bp, Rattus norvegicus
cagctggcgctgcagacggaccact

SEQ ID NO: 583792 - DNA, 25 bp, Rattus norvegicus
tggcgctgcagacggaccactcagt

SEQ ID NO: 583793 - DNA, 25 bp, Rattus norvegicus
tgcagacggaccactcagtccacgt

SEQ ID NO: 583794 - DNA, 25 bp, Rattus norvegicus
agacggaccactcagtccacgtcga

SEQ ID NO: 583795 - DNA, 25 bp, Rattus norvegicus
gtccacgtcgaccacccaccgttca

SEQ ID NO: 583796 - DNA, 25 bp, Rattus norvegicus
gtcgaccacccaccgttcactgggc

SEQ ID NO: 583797 - DNA, 25 bp, Rattus norvegicus
ggccgcgggtacctgggcacagagt

SEQ ID NO: 583798 - DNA, 25 bp, Rattus norvegicus
ttctgccagccacgcccacagctgg

SEQ ID NO: 583799 - DNA, 25 bp, Rattus norvegicus
acccggaagttttagccgcgctgcg

SEQ ID NO: 583800 - DNA, 25 bp, Rattus norvegicus
gcggagtattgcgtcacggacagca

SEQ ID NO: 583801 - DNA, 25 bp, Rattus norvegicus
tatccgttcgcgtgggaagacttta

SEQ ID NO: 583802 - DNA, 25 bp, Rattus norvegicus
cggaaacgtcgtcttcctgtgagta

SEQ ID NO: 583803 - DNA, 25 bp, Rattus norvegicus
ctgacctcgtgttaaagataacgta

SEQ ID NO: 583804 - DNA, 25 bp, Rattus norvegicus
cctgcgcactcgttgcttgagtgtc

SEQ ID NO: 583805 - DNA, 25 bp, Rattus norvegicus
ttctacgtcacggacctcggggcac

SEQ ID NO: 583806 - DNA, 25 bp, Rattus norvegicus
cgtgatcggtttcctttctacgtca

SEQ ID NO: 583807 - DNA, 25 bp, Rattus norvegicus
tcagcccggaaacggttcgtgatcg

SEQ ID NO: 583808 - DNA, 25 bp, Rattus norvegicus
gcgtgtcgtcaccagggagactccg

SEQ ID NO: 583809 - DNA, 25 bp, Rattus norvegicus
tccgagtcagggcagataccttccc

SEQ ID NO: 583810 - DNA, 25 bp, Rattus norvegicus
gcgtatgtgcatcacgccgtcggag

SEQ ID NO: 583811 - DNA, 25 bp, Rattus norvegicus
ggccctctcgctcgtgagaactcgg

SEQ ID NO: 583812 - DNA, 25 bp, Rattus norvegicus
gaaggctttggacatctatccgttc

SEQ ID NO: 583813 - DNA, 25 bp, Rattus norvegicus
gtcgcaagggtctcacaccctttac

SEQ ID NO: 583814 - DNA, 25 bp, Rattus norvegicus
cttcgataccaacacccgcgttttg

SEQ ID NO: 583815 - DNA, 25 bp, Rattus norvegicus
ccgcctcatcttgtccttggatcta

SEQ ID NO: 583816 - DNA, 25 bp, Rattus norvegicus
cttgtccttggatctaaagagcgta

SEQ ID NO: 583817 - DNA, 25 bp, Rattus norvegicus
tccttggatctaaagagcgtacgtc

SEQ ID NO: 583818 - DNA, 25 bp, Rattus norvegicus
ctaaagagcgtacgtctaggacagc

SEQ ID NO: 583819 - DNA, 25 bp, Rattus norvegicus
gcgtacgtctaggacagcgcgccca

SEQ ID NO: 583820 - DNA, 25 bp, Rattus norvegicus
tgcctaaccatcctcgccgcttcga

SEQ ID NO: 583821 - DNA, 25 bp, Rattus norvegicus
aacacccgcgttttggcgtcctgtg

SEQ ID NO: 583822 - DNA, 25 bp, Rattus norvegicus
ttggcgtcctgtggtttctcctcag

SEQ ID NO: 583823 - DNA, 25 bp, Rattus norvegicus
tgtggtttctcctcagggcgacatc

SEQ ID NO: 583824 - DNA, 25 bp, Rattus norvegicus
ggtttctcctcagggcgacatcact

SEQ ID NO: 583825 - DNA, 25 bp, Rattus norvegicus
tgcgtcgcaagggtctcacaccctt

SEQ ID NO: 583826 - DNA, 25 bp, Rattus norvegicus
gcgcgcccaggacttgcctaaccat

SEQ ID NO: 583827 - DNA, 25 bp, Rattus norvegicus
gcttcctggaacacgcgcgattgta

SEQ ID NO: 583828 - DNA, 25 bp, Rattus norvegicus
gtgtcacgtgaccatcgctttctgc

SEQ ID NO: 583829 - DNA, 25 bp, Rattus norvegicus
ggaggagggcactacttccatcttc

SEQ ID NO: 583830 - DNA, 25 bp, Rattus norvegicus
agagcgcaggcctcatcatcaccga

SEQ ID NO: 583831 - DNA, 25 bp, Rattus norvegicus
tcatcaccgagacagggttagcgcc

SEQ ID NO: 583832 - DNA, 25 bp, Rattus norvegicus
gggagcagccaccaaaccctcaatg

SEQ ID NO: 583833 - DNA, 25 bp, Rattus norvegicus
tcaatggacgccgatggcccaactc

SEQ ID NO: 583834 - DNA, 25 bp, Rattus norvegicus
acccggtcgtgattgacatggaaga

SEQ ID NO: 583835 - DNA, 25 bp, Rattus norvegicus
agacgagtcgcacctctgattggca

SEQ ID NO: 583836 - DNA, 25 bp, Rattus norvegicus
gattggcacctctctttgattgaca

SEQ ID NO: 583837 - DNA, 25 bp, Rattus norvegicus
aggccgtagccaccaacgttgctga

SEQ ID NO: 583838 - DNA, 25 bp, Rattus norvegicus
acgttgctgatcactgggcaccgtc

SEQ ID NO: 583839 - DNA, 25 bp, Rattus norvegicus
tgcacagcggttcattcacatcgaa

SEQ ID NO: 583840 - DNA, 25 bp, Rattus norvegicus
gcgcgattgtacttccgcttcaagg

SEQ ID NO: 583841 - DNA, 25 bp, Rattus norvegicus
cccgctttatgtgttctaatctcca

SEQ ID NO: 583842 - DNA, 25 bp, Rattus norvegicus
tctcggagaacatgcgacgcttcct

SEQ ID NO: 583843 - DNA, 25 bp, Rattus norvegicus
cggagctggtacatctcggagaaca

SEQ ID NO: 583844 - DNA, 25 bp, Rattus norvegicus
ccgtgtttgatgagaaccggagctg

SEQ ID NO: 583845 - DNA, 25 bp, Rattus norvegicus
acgtcatcctgttctccgtgtttga

SEQ ID NO: 583846 - DNA, 25 bp, Rattus norvegicus
tgtcagacgagaggaacgtcatcct

SEQ ID NO: 583847 - DNA, 25 bp, Rattus norvegicus
cattcacagatgatgtcagacgaga

SEQ ID NO: 583848 - DNA, 25 bp, Rattus norvegicus
tcattagtgacgtctccttcataca

SEQ ID NO: 583849 - DNA, 25 bp, Rattus norvegicus
actctactgtacacgtcattagtga

SEQ ID NO: 583850 - DNA, 25 bp, Rattus norvegicus
gtgacggctcctgcactctactgta

SEQ ID NO: 583851 - DNA, 25 bp, Rattus norvegicus
ctgcctacggcatgagtgacggctc

SEQ ID NO: 583852 - DNA, 25 bp, Rattus norvegicus
aggccttacgtagtgacgtgtgtgc

SEQ ID NO: 583853 - DNA, 25 bp, Rattus norvegicus
ccgacgaggcacatgtgcagctgca

SEQ ID NO: 583854 - DNA, 25 bp, Rattus norvegicus
gttctaatctccagtaggccttacg

SEQ ID NO: 583855 - DNA, 25 bp, Rattus norvegicus
aggagccctatcaacgcgtagagta

SEQ ID NO: 583856 - DNA, 25 bp, Rattus norvegicus
gctgcccgcgagtcacgtttgggat

SEQ ID NO: 583857 - DNA, 25 bp, Rattus norvegicus
catctcggaccgagtggcgttaaaa

SEQ ID NO: 583858 - DNA, 25 bp, Rattus norvegicus
tttaccctgcatcaggtagtcctgc

SEQ ID NO: 583859 - DNA, 25 bp, Rattus norvegicus
ggccatcgcaaagccgtgctgccta

SEQ ID NO: 583860 - DNA, 25 bp, Rattus norvegicus
cacgtttgggatgcaccgagagccc

SEQ ID NO: 583861 - DNA, 25 bp, Rattus norvegicus
ccggaagtagctagatcctcgggtg

SEQ ID NO: 583862 - DNA, 25 bp, Rattus norvegicus
acagagcgcggccaacagcagacac

SEQ ID NO: 583863 - DNA, 25 bp, Rattus norvegicus
tagagcgcggccagaccgaaacaga

SEQ ID NO: 583864 - DNA, 25 bp, Rattus norvegicus
agcgaccaaaggagcgcgaacttgc

SEQ ID NO: 583865 - DNA, 25 bp, Rattus norvegicus
gttagcaccgtactgcgcaggacca

SEQ ID NO: 583866 - DNA, 25 bp, Rattus norvegicus
agtagcgcggctacctgtgcgcaag

SEQ ID NO: 583867 - DNA, 25 bp, Rattus norvegicus
cgtcccgcgatttaggcgaccgagc

SEQ ID NO: 583868 - DNA, 25 bp, Rattus norvegicus
caagcgccgagtgccgttagcaccg

SEQ ID NO: 583869 - DNA, 25 bp, Rattus norvegicus
cccagaggtgcttctgggaagttga

SEQ ID NO: 583870 - DNA, 25 bp, Rattus norvegicus
gagatcggtatttaactaaagtcca

SEQ ID NO: 583871 - DNA, 25 bp, Rattus norvegicus
ccgacgctgccatggcgtcatatta

SEQ ID NO: 583872 - DNA, 25 bp, Rattus norvegicus
catagcatattctgattggccgaca

SEQ ID NO: 583873 - DNA, 25 bp, Rattus norvegicus
ctgcgcactgcatttctctgagggc

SEQ ID NO: 583874 - DNA, 25 bp, Rattus norvegicus
ggcgtcatattaccatagcatattc

SEQ ID NO: 583875 - DNA, 25 bp, Rattus norvegicus
agttgagcgcggttcttcactttgc

SEQ ID NO: 583876 - DNA, 25 bp, Rattus norvegicus
ttcactttgccggtcggtgaggtac

SEQ ID NO: 583877 - DNA, 25 bp, Rattus norvegicus
gctgccgacttctccagagtctcgg

SEQ ID NO: 583878 - DNA, 25 bp, Rattus norvegicus
cgctgctgtcgagagaggtcactcc

SEQ ID NO: 583879 - DNA, 25 bp, Rattus norvegicus
aggtcactccgccaggaaggacgtg

SEQ ID NO: 583880 - DNA, 25 bp, Rattus norvegicus
ccgcctgccatggactcggagtact

SEQ ID NO: 583881 - DNA, 25 bp, Rattus norvegicus
cggagtactacagcggtgaccagtc

SEQ ID NO: 583882 - DNA, 25 bp, Rattus norvegicus
ctgattggccgacagaagggtaacg

SEQ ID NO: 583883 - DNA, 25 bp, Rattus norvegicus
cagagaacgatctggtcgcagagtc

SEQ ID NO: 583884 - DNA, 25 bp, Rattus norvegicus
tgcacatgcgcaaaactcagtagtc

SEQ ID NO: 583885 - DNA, 25 bp, Rattus norvegicus
aaactcagtagtcccgctgcgcgcg

SEQ ID NO: 583886 - DNA, 25 bp, Rattus norvegicus
ccgtctgaagccctggaaacgtcga

SEQ ID NO: 583887 - DNA, 25 bp, Rattus norvegicus
cgcttcttgccttccgtacgagtgg

SEQ ID NO: 583888 - DNA, 25 bp, Rattus norvegicus
gtgtttctggttcagcgtgcgactg

SEQ ID NO: 583889 - DNA, 25 bp, Rattus norvegicus
ccgctgtcccatgtgaagcaggttg

SEQ ID NO: 583890 - DNA, 25 bp, Rattus norvegicus
ttccgcttagctgcttctccggtca

SEQ ID NO: 583891 - DNA, 25 bp, Rattus norvegicus
cgtgctacgccagacatcacgggtc

SEQ ID NO: 583892 - DNA, 25 bp, Rattus norvegicus
gtgtgctgcgcagagtagacactgc

SEQ ID NO: 583893 - DNA, 25 bp, Rattus norvegicus
cgcgtaactctgacggccaacatta

SEQ ID NO: 583894 - DNA, 25 bp, Rattus norvegicus
aaacgtcgagccgtcggtgagacct

SEQ ID NO: 583895 - DNA, 25 bp, Rattus norvegicus
gcccagaggccggtaagtgtttctg

SEQ ID NO: 583896 - DNA, 25 bp, Rattus norvegicus
tgcatctacccagaagcagcgaaga

SEQ ID NO: 583897 - DNA, 25 bp, Rattus norvegicus
tcctccagggcggtgagatccagat

SEQ ID NO: 583898 - DNA, 25 bp, Rattus norvegicus
tttaaaaggcagtgtcgtgtccgga

SEQ ID NO: 583899 - DNA, 25 bp, Rattus norvegicus
gcgcacgctccgtctccgtcagtcc

SEQ ID NO: 583900 - DNA, 25 bp, Rattus norvegicus
cctgagctgttctagtgcgcggcgt

SEQ ID NO: 583901 - DNA, 25 bp, Rattus norvegicus
attatccgcgctcgctacgggcgag

SEQ ID NO: 583902 - DNA, 25 bp, Rattus norvegicus
gcggtgagatccagatcccagaatg

SEQ ID NO: 583903 - DNA, 25 bp, Rattus norvegicus
atccagatcccagaatggcccttta

SEQ ID NO: 583904 - DNA, 25 bp, Rattus norvegicus
gtggcgctgaattgaggacacctta

SEQ ID NO: 583905 - DNA, 25 bp, Rattus norvegicus
tgaggacaccttaggtagttcccaa

SEQ ID NO: 583906 - DNA, 25 bp, Rattus norvegicus
cccaggcgaagtcgcaagctcgtct

SEQ ID NO: 583907 - DNA, 25 bp, Rattus norvegicus
aagtcgcaagctcgtctggggagtc

SEQ ID NO: 583908 - DNA, 25 bp, Rattus norvegicus
agctcgtctggggagtccctgaccc

SEQ ID NO: 583909 - DNA, 25 bp, Rattus norvegicus
cccagaatggccctttaaaaggcag

SEQ ID NO: 583910 - DNA, 25 bp, Rattus norvegicus
caggatccctcctccagggcggtga

SEQ ID NO: 583911 - DNA, 25 bp, Rattus norvegicus
actaatgtaccaggcctgtggtccc

SEQ ID NO: 583912 - DNA, 25 bp, Rattus norvegicus
cggtactcacccaggcgctcaggag

SEQ ID NO: 583913 - DNA, 25 bp, Rattus norvegicus
cgaagttgaccctgaccgtgcgact

SEQ ID NO: 583914 - DNA, 25 bp, Rattus norvegicus
gctggcccgggctccctagtgcgaa

SEQ ID NO: 583915 - DNA, 25 bp, Rattus norvegicus
cctgaccgtgcgacttgcctggcga

SEQ ID NO: 583916 - DNA, 25 bp, Rattus norvegicus
cctggttgctgaaggctcggcctct

SEQ ID NO: 583917 - DNA, 25 bp, Rattus norvegicus
acacaaagaaacagcgcgccatcgc

SEQ ID NO: 583918 - DNA, 25 bp, Rattus norvegicus
cgccacagcgagacccgcgtctggc

SEQ ID NO: 583919 - DNA, 25 bp, Rattus norvegicus
ggacatctaccggactaatgtacca

SEQ ID NO: 583920 - DNA, 25 bp, Rattus norvegicus
accggactaatgtaccaggcctgtg

SEQ ID NO: 583921 - DNA, 25 bp, Rattus norvegicus
acgctcagacccagcatgctcggtg

SEQ ID NO: 583922 - DNA, 25 bp, Rattus norvegicus
gctccctagtgcgaagttgaccctg

SEQ ID NO: 583923 - DNA, 25 bp, Rattus norvegicus
cagcatgctcggtgcgccacagcga

SEQ ID NO: 583924 - DNA, 25 bp, Rattus norvegicus
ttctgacggggctgctcatggccac

SEQ ID NO: 583925 - DNA, 25 bp, Rattus norvegicus
aggccgcacggccagcgtgcttttc

SEQ ID NO: 583926 - DNA, 25 bp, Rattus norvegicus
ccagaactgcctcggtgtagtccca

SEQ ID NO: 583927 - DNA, 25 bp, Rattus norvegicus
ccacacatatgacgtgagtgatttc

SEQ ID NO: 583928 - DNA, 25 bp, Rattus norvegicus
gcgtaggcaagagcttccacacata

SEQ ID NO: 583929 - DNA, 25 bp, Rattus norvegicus
ccgcttctacgtgacgacttgcgta

SEQ ID NO: 583930 - DNA, 25 bp, Rattus norvegicus
gccttggggttgttcagcaacgaca

SEQ ID NO: 583931 - DNA, 25 bp, Rattus norvegicus
tatgttacactgcaccggatcccgg

SEQ ID NO: 583932 - DNA, 25 bp, Rattus norvegicus
ggagcgcctggtgagcactttccac

SEQ ID NO: 583933 - DNA, 25 bp, Rattus norvegicus
tctcacgaggcttgctggagcgcct

SEQ ID NO: 583934 - DNA, 25 bp, Rattus norvegicus
ccggcataggcttctcacgaggctt

SEQ ID NO: 583935 - DNA, 25 bp, Rattus norvegicus
actcctcaatttactccggcatagg

SEQ ID NO: 583936 - DNA, 25 bp, Rattus norvegicus
cggatcccggaagcactcctcaatt

SEQ ID NO: 583937 - DNA, 25 bp, Rattus norvegicus
ctccgaggggagctaattttatgtt

SEQ ID NO: 583938 - DNA, 25 bp, Rattus norvegicus
ttccacacgtggtgcggtacaacgc

SEQ ID NO: 583939 - DNA, 25 bp, Rattus norvegicus
atcgacggctctaaacgggatcctc

SEQ ID NO: 583940 - DNA, 25 bp, Rattus norvegicus
gctagttgtccctctctctctgcga

SEQ ID NO: 583941 - DNA, 25 bp, Rattus norvegicus
gtgcgcgctgaaggacgcctcctct

SEQ ID NO: 583942 - DNA, 25 bp, Rattus norvegicus
acgcctgcagcgtgcacgctagttg

SEQ ID NO: 583943 - DNA, 25 bp, Rattus norvegicus
acgggatcctctgagcgatttcttc

SEQ ID NO: 583944 - DNA, 25 bp, Rattus norvegicus
tcccggattactggatcgacggctc

SEQ ID NO: 583945 - DNA, 25 bp, Rattus norvegicus
gtactgagaacctcgtcccggatta

SEQ ID NO: 583946 - DNA, 25 bp, Rattus norvegicus
cctcggtcacctccagtactgagaa

SEQ ID NO: 583947 - DNA, 25 bp, Rattus norvegicus
tgctcaaagtcacggtgccctcctg

SEQ ID NO: 583948 - DNA, 25 bp, Rattus norvegicus
cccgcggcgaagatgctcaaagtca

SEQ ID NO: 583949 - DNA, 25 bp, Rattus norvegicus
agcggcggcatcttccggagtcccg

SEQ ID NO: 583950 - DNA, 25 bp, Rattus norvegicus
tcctctcgctcctgtgttgcaggcg

SEQ ID NO: 583951 - DNA, 25 bp, Rattus norvegicus
ctggtgctcacggtctcagcatctc

SEQ ID NO: 583952 - DNA, 25 bp, Rattus norvegicus
gcgatttcttcgaggtggagtcaga

SEQ ID NO: 583953 - DNA, 25 bp, Rattus norvegicus
ccaatcagaaggcagcaggctgttc

SEQ ID NO: 583954 - DNA, 25 bp, Rattus norvegicus
ttcagcaagctgttttccagcccgc

SEQ ID NO: 583955 - DNA, 25 bp, Rattus norvegicus
cccgcgcgtttcagcaagctgtttt

SEQ ID NO: 583956 - DNA, 25 bp, Rattus norvegicus
tccaggaaaaggtagctcacagctc

SEQ ID NO: 583957 - DNA, 25 bp, Rattus norvegicus
agcagtcgccaagtccaggaaaagg

SEQ ID NO: 583958 - DNA, 25 bp, Rattus norvegicus
ccagcacggctggaagcagccaatg

SEQ ID NO: 583959 - DNA, 25 bp, Rattus norvegicus
tggcctccgaggatggagcgattcc

SEQ ID NO: 583960 - DNA, 25 bp, Rattus norvegicus
gctgttccggtcaaggcgagcaaca

SEQ ID NO: 583961 - DNA, 25 bp, Rattus norvegicus
gcggaggatgccaagcagtcgccaa

SEQ ID NO: 583962 - DNA, 25 bp, Rattus norvegicus
ggtcaaggcgagcaacaccctcagc

SEQ ID NO: 583963 - DNA, 25 bp, Rattus norvegicus
acctctggagtgttagcggagcaac

SEQ ID NO: 583964 - DNA, 25 bp, Rattus norvegicus
ttagcggagcaacgtgtgttcgctg

SEQ ID NO: 583965 - DNA, 25 bp, Rattus norvegicus
ggattggctggcgtctcagcctgaa

SEQ ID NO: 583966 - DNA, 25 bp, Rattus norvegicus
cagcctgaagggagccgattggcct

SEQ ID NO: 583967 - DNA, 25 bp, Rattus norvegicus
gcacgtttacagctcgaacccactt

SEQ ID NO: 583968 - DNA, 25 bp, Rattus norvegicus
cggctaggctgtcttgcacgtttac

SEQ ID NO: 583969 - DNA, 25 bp, Rattus norvegicus
acgttcctgcgtccagcgccatttt

SEQ ID NO: 583970 - DNA, 25 bp, Rattus norvegicus
gctgtgcctcggttatacgctctta

SEQ ID NO: 583971 - DNA, 25 bp, Rattus norvegicus
cggttatacgctcttactgaggtca

SEQ ID NO: 583972 - DNA, 25 bp, Rattus norvegicus
ttactgaggtcactcgccctaactc

SEQ ID NO: 583973 - DNA, 25 bp, Rattus norvegicus
ggcgtttcgcgagactgtaggtctc

SEQ ID NO: 583974 - DNA, 25 bp, Rattus norvegicus
aagttgccagccagggcggcgtttc

SEQ ID NO: 583975 - DNA, 25 bp, Rattus norvegicus
tgcggctctcgcaagttgccagcca

SEQ ID NO: 583976 - DNA, 25 bp, Rattus norvegicus
gtcactgtgtctgcggctctcgcaa

SEQ ID NO: 583977 - DNA, 25 bp, Rattus norvegicus
tcccgcagcgcaggtcactgtgtct

SEQ ID NO: 583978 - DNA, 25 bp, Rattus norvegicus
cgtccagcgccattttcctgctgtg

SEQ ID NO: 583979 - DNA, 25 bp, Rattus norvegicus
ccctttcccgacgtagagctttgca

SEQ ID NO: 583980 - DNA, 25 bp, Rattus norvegicus
acgtagagctttgcacccgtgctcc

SEQ ID NO: 583981 - DNA, 25 bp, Rattus norvegicus
tcccttttatgtgcctgtcctgagc

SEQ ID NO: 583982 - DNA, 25 bp, Rattus norvegicus
gtcctgagcacagcagaaaatggtg

SEQ ID NO: 583983 - DNA, 25 bp, Rattus norvegicus
gaaagcccgaggttggaatccagga

SEQ ID NO: 583984 - DNA, 25 bp, Rattus norvegicus
ggaaccgggacagccacggccttgc

SEQ ID NO: 583985 - DNA, 25 bp, Rattus norvegicus
caagaggacgcacacgcgcacggtc

SEQ ID NO: 583986 - DNA, 25 bp, Rattus norvegicus
ctgtaataataaacctgcggccggg

SEQ ID NO: 583987 - DNA, 25 bp, Rattus norvegicus
gcggcgcagccctactgtaataata

SEQ ID NO: 583988 - DNA, 25 bp, Rattus norvegicus
gcgcggcggctttgcagacaaataa

SEQ ID NO: 583989 - DNA, 25 bp, Rattus norvegicus
ccagactgcttactcggcaggaatc

SEQ ID NO: 583990 - DNA, 25 bp, Rattus norvegicus
tgccaccgcggagccagactgctta

SEQ ID NO: 583991 - DNA, 25 bp, Rattus norvegicus
gccttgccgccttcccttttatgtg
